United States Patent 7,901,882 (ANALYSIS OF METHYLATION USING NUCLEIC ACID ARRAYS) - sequence listing, part 11

SEQ ID NO: 394583 - DNA, 25 bp, Mus musculus
tggcgaatcacagagtggtggaatc

SEQ ID NO: 394584 - DNA, 25 bp, Mus musculus
ggtggaatctattgcctttgtctga

SEQ ID NO: 394585 - DNA, 25 bp, Mus musculus
gtctgacaagtcatccatctcccgg

SEQ ID NO: 394586 - DNA, 25 bp, Mus musculus
gcccggtgaggctgaattattcatc

SEQ ID NO: 394587 - DNA, 25 bp, Mus musculus
ttgaggattgcttcctggacccatc

SEQ ID NO: 394588 - DNA, 25 bp, Mus musculus
cagctgccgccttttcataccggta

SEQ ID NO: 394589 - DNA, 25 bp, Mus musculus
ttcatctttaatctgcccgcagctg

SEQ ID NO: 394590 - DNA, 25 bp, Mus musculus
tcataccggtaacgcgagttctccc

SEQ ID NO: 394591 - DNA, 25 bp, Mus musculus
aactccagcggtgcccggttgcaat

SEQ ID NO: 394592 - DNA, 25 bp, Mus musculus
agacgagcagctacagcccgggttt

SEQ ID NO: 394593 - DNA, 25 bp, Mus musculus
ttctaggcccggttccgcacagatc

SEQ ID NO: 394594 - DNA, 25 bp, Mus musculus
gcgccagcggcagttgcgcattcta

SEQ ID NO: 394595 - DNA, 25 bp, Mus musculus
tggacccatcaatcggggccagtga

SEQ ID NO: 394596 - DNA, 25 bp, Mus musculus
atgaagcaggttcatccaggcggcc

SEQ ID NO: 394597 - DNA, 25 bp, Mus musculus
gaagccttgctctttttcggaggga

SEQ ID NO: 394598 - DNA, 25 bp, Mus musculus
acttcgggtcgctgcgaatctctca

SEQ ID NO: 394599 - DNA, 25 bp, Mus musculus
gccagtgacggggaacctcttcgaa

SEQ ID NO: 394600 - DNA, 25 bp, Mus musculus
gcgacagcgttttccaaggctggta

SEQ ID NO: 394601 - DNA, 25 bp, Mus musculus
tgagctcatccacctgaactgccta

SEQ ID NO: 394602 - DNA, 25 bp, Mus musculus
gcgcgccgtttctgtgacacacaat

SEQ ID NO: 394603 - DNA, 25 bp, Mus musculus
tcatcaccctgtcgatggccagaca

SEQ ID NO: 394604 - DNA, 25 bp, Mus musculus
gaactgcctagttcccttgggcctg

SEQ ID NO: 394605 - DNA, 25 bp, Mus musculus
ttcaggcagacagcttcggcctcca

SEQ ID NO: 394606 - DNA, 25 bp, Mus musculus
gggaccacatcaagcttcaggcaga

SEQ ID NO: 394607 - DNA, 25 bp, Mus musculus
cctggaaggaactgacgaccgagcc

SEQ ID NO: 394608 - DNA, 25 bp, Mus musculus
acctgcgggcgcaaaaagcctggaa

SEQ ID NO: 394609 - DNA, 25 bp, Mus musculus
tgcggctgcgagcattgatcttttc

SEQ ID NO: 394610 - DNA, 25 bp, Mus musculus
tttggtcccaagcacgcagccacgt

SEQ ID NO: 394611 - DNA, 25 bp, Mus musculus
ggctcatcccacgacaccttgtgtt

SEQ ID NO: 394612 - DNA, 25 bp, Mus musculus
gcgatctccttctgcagtgactctc

SEQ ID NO: 394613 - DNA, 25 bp, Mus musculus
cgctgcctatgaccgccactagtta

SEQ ID NO: 394614 - DNA, 25 bp, Mus musculus
atggggaagcgcacgaggatccctc

SEQ ID NO: 394615 - DNA, 25 bp, Mus musculus
acgaggatccctcgacgtgtccgtg

SEQ ID NO: 394616 - DNA, 25 bp, Mus musculus
atccctcgacgtgtccgtggcagga

SEQ ID NO: 394617 - DNA, 25 bp, Mus musculus
gtcgcttactgcacggcgcagctca

SEQ ID NO: 394618 - DNA, 25 bp, Mus musculus
cgggctggatggtcgcttactgcac

SEQ ID NO: 394619 - DNA, 25 bp, Mus musculus
atcaaggctctctcggtccgggtcg

SEQ ID NO: 394620 - DNA, 25 bp, Mus musculus
tcagtgcaggatcaaggctctctcg

SEQ ID NO: 394621 - DNA, 25 bp, Mus musculus
gctggtcagtgcaggatcaaggctc

SEQ ID NO: 394622 - DNA, 25 bp, Mus musculus
actgcacggcgcagctcagcggcat

SEQ ID NO: 394623 - DNA, 25 bp, Mus musculus
gcgctgctgccgctatttatgccca

SEQ ID NO: 394624 - DNA, 25 bp, Mus musculus
tgccgctatttatgcccagtgggag

SEQ ID NO: 394625 - DNA, 25 bp, Mus musculus
atttatgcccagtgggagctgccgc

SEQ ID NO: 394626 - DNA, 25 bp, Mus musculus
tcctgcgagtcccaagggccgctgt

SEQ ID NO: 394627 - DNA, 25 bp, Mus musculus
gggccgctgtgaccggaaccgctct

SEQ ID NO: 394628 - DNA, 25 bp, Mus musculus
tcgatagtctcggaagtcctccagc

SEQ ID NO: 394629 - DNA, 25 bp, Mus musculus
gaagtcctccagcttgcgctgcatg

SEQ ID NO: 394630 - DNA, 25 bp, Mus musculus
ccagcttgcgctgcatggcactcat

SEQ ID NO: 394631 - DNA, 25 bp, Mus musculus
atggcactcatgctgggttcgccca

SEQ ID NO: 394632 - DNA, 25 bp, Mus musculus
ctgggttcgcccacgcggttctcta

SEQ ID NO: 394633 - DNA, 25 bp, Mus musculus
tgtgcaggcgtcgatagtctcggaa

SEQ ID NO: 394634 - DNA, 25 bp, Mus musculus
cggttctctagccatgggacagtgc

SEQ ID NO: 394635 - DNA, 25 bp, Mus musculus
ttctcctgcacacggggaggcttgt

SEQ ID NO: 394636 - DNA, 25 bp, Mus musculus
agctggcacttctcctgcacacggg

SEQ ID NO: 394637 - DNA, 25 bp, Mus musculus
tggctcaggcgcaacttggtctgca

SEQ ID NO: 394638 - DNA, 25 bp, Mus musculus
cgcaacttggtctgcagcgtgttga

SEQ ID NO: 394639 - DNA, 25 bp, Mus musculus
ctgcagcgtgttgaagttgatctcc

SEQ ID NO: 394640 - DNA, 25 bp, Mus musculus
tgttgaagttgatctccagctggca

SEQ ID NO: 394641 - DNA, 25 bp, Mus musculus
cgaaaccagcttgccctcggagggc

SEQ ID NO: 394642 - DNA, 25 bp, Mus musculus
tgaccctcaggtcagccaatcgcga

SEQ ID NO: 394643 - DNA, 25 bp, Mus musculus
ctgctgcagcgggaaaaagaacaga

SEQ ID NO: 394644 - DNA, 25 bp, Mus musculus
cggctgtcgccagctgtcgtaacac

SEQ ID NO: 394645 - DNA, 25 bp, Mus musculus
ctattgcgctaccaccagagtgacc

SEQ ID NO: 394646 - DNA, 25 bp, Mus musculus
atcgcgacgcggcacctcaagaaag

SEQ ID NO: 394647 - DNA, 25 bp, Mus musculus
tgatggtcctcaggttccttcccgc

SEQ ID NO: 394648 - DNA, 25 bp, Mus musculus
ctcacaccggagtcacttccgaaga

SEQ ID NO: 394649 - DNA, 25 bp, Mus musculus
acttccgaagagagaaccgccatga

SEQ ID NO: 394650 - DNA, 25 bp, Mus musculus
ccgagtcccagcagcaagacggcaa

SEQ ID NO: 394651 - DNA, 25 bp, Mus musculus
ctgccatctgagacccggtagtacc

SEQ ID NO: 394652 - DNA, 25 bp, Mus musculus
actacggacggctgctcttcagttc

SEQ ID NO: 394653 - DNA, 25 bp, Mus musculus
ctcagcgagctcaggccttgatgtt

SEQ ID NO: 394654 - DNA, 25 bp, Mus musculus
ccttgatgttctggggcctgcaagc

SEQ ID NO: 394655 - DNA, 25 bp, Mus musculus
atgacaaggcgctgcatgcccgcta

SEQ ID NO: 394656 - DNA, 25 bp, Mus musculus
cgcgtccctgcagtaggtaaatggg

SEQ ID NO: 394657 - DNA, 25 bp, Mus musculus
taggaccagcctgttttagggcgca

SEQ ID NO: 394658 - DNA, 25 bp, Mus musculus
aggggtcttaggaccaaagcagatc

SEQ ID NO: 394659 - DNA, 25 bp, Mus musculus
agatccgtaggaccagcctgtttta

SEQ ID NO: 394660 - DNA, 25 bp, Mus musculus
ggttacgcgtccctgcagtaggtaa

SEQ ID NO: 394661 - DNA, 25 bp, Mus musculus
cagcctgttttagggcgcacgcggt

SEQ ID NO: 394662 - DNA, 25 bp, Mus musculus
ggcgggcgatactcagactgactga

SEQ ID NO: 394663 - DNA, 25 bp, Mus musculus
tcagactgactgagcctggaagaaa

SEQ ID NO: 394664 - DNA, 25 bp, Mus musculus
ggagccgtgggcctcgagcatctcc

SEQ ID NO: 394665 - DNA, 25 bp, Mus musculus
tcgagcatctcccacaaatcgggtc

SEQ ID NO: 394666 - DNA, 25 bp, Mus musculus
tctcccacaaatcgggtctattgtg

SEQ ID NO: 394667 - DNA, 25 bp, Mus musculus
caaatcgggtctattgtgcgtggtg

SEQ ID NO: 394668 - DNA, 25 bp, Mus musculus
gtcttaggaccaaagcagatccgta

SEQ ID NO: 394669 - DNA, 25 bp, Mus musculus
accaaagcagatccgtaggaccagc

SEQ ID NO: 394670 - DNA, 25 bp, Mus musculus
ttcgcggatctggagccggcgccgc

SEQ ID NO: 394671 - DNA, 25 bp, Mus musculus
agggtcctccgctgcctcggtcgcc

SEQ ID NO: 394672 - DNA, 25 bp, Mus musculus
ctggcggtcgcggagacacgcgcac

SEQ ID NO: 394673 - DNA, 25 bp, Mus musculus
gtcgcgcaccattgttgagacccgc

SEQ ID NO: 394674 - DNA, 25 bp, Mus musculus
ccggcaccatgctccgggctgagcc

SEQ ID NO: 394675 - DNA, 25 bp, Mus musculus
ccgagcgtcgcgcaccattgttgag

SEQ ID NO: 394676 - DNA, 25 bp, Mus musculus
gagacacgcgcacccggagccgcgc

SEQ ID NO: 394677 - DNA, 25 bp, Mus musculus
agcgtcgcgcaccattgttgagacc

SEQ ID NO: 394678 - DNA, 25 bp, Mus musculus
gtcagccccgcggagttcgcggatc

SEQ ID NO: 394679 - DNA, 25 bp, Mus musculus
cgcaccattgttgagacccgcgcgg

SEQ ID NO: 394680 - DNA, 25 bp, Mus musculus
caccattgttgagacccgcgcgggg

SEQ ID NO: 394681 - DNA, 25 bp, Mus musculus
ccgaagggatggcagttcccacgcg

SEQ ID NO: 394682 - DNA, 25 bp, Mus musculus
atggcagttcccacgcgggtgcgat

SEQ ID NO: 394683 - DNA, 25 bp, Mus musculus
caggccgaagggatggcagttccca

SEQ ID NO: 394684 - DNA, 25 bp, Mus musculus
tcgctgtctctatggacccggatcc

SEQ ID NO: 394685 - DNA, 25 bp, Mus musculus
cctccaagctaagccaggccttttt

SEQ ID NO: 394686 - DNA, 25 bp, Mus musculus
agccgcacgtcgctgtctctatgga

SEQ ID NO: 394687 - DNA, 25 bp, Mus musculus
cgggatcgaaggagagcttgtcctc

SEQ ID NO: 394688 - DNA, 25 bp, Mus musculus
atcccagcgcaaaggtgagggaggc

SEQ ID NO: 394689 - DNA, 25 bp, Mus musculus
cggccgggcaaagccttgtccgcat

SEQ ID NO: 394690 - DNA, 25 bp, Mus musculus
ggcaaagccttgtccgcatccattc

SEQ ID NO: 394691 - DNA, 25 bp, Mus musculus
tcgaaggagagcttgtcctcgagcc

SEQ ID NO: 394692 - DNA, 25 bp, Mus musculus
caatcccgcataaaagggtttagag

SEQ ID NO: 394693 - DNA, 25 bp, Mus musculus
gcgcagaccggccttctcggagtcg

SEQ ID NO: 394694 - DNA, 25 bp, Mus musculus
gacccgcgtggagaacagtgttccc

SEQ ID NO: 394695 - DNA, 25 bp, Mus musculus
cccaggatctgggtcatgtctcctg

SEQ ID NO: 394696 - DNA, 25 bp, Mus musculus
atctgggtcatgtctcctggcgtcc

SEQ ID NO: 394697 - DNA, 25 bp, Mus musculus
agccaggcctttttcaccgccgaga

SEQ ID NO: 394698 - DNA, 25 bp, Mus musculus
cgccaggtcggaaatcagacaaaca

SEQ ID NO: 394699 - DNA, 25 bp, Mus musculus
tgcggatcacatccaagccggactg

SEQ ID NO: 394700 - DNA, 25 bp, Mus musculus
gccagcttctgcaccaacgacttga

SEQ ID NO: 394701 - DNA, 25 bp, Mus musculus
cccacgttgcggacagaacactaga

SEQ ID NO: 394702 - DNA, 25 bp, Mus musculus
tgttgacgttttcctcgcgcacagc

SEQ ID NO: 394703 - DNA, 25 bp, Mus musculus
actcacggtattcggccactattcg

SEQ ID NO: 394704 - DNA, 25 bp, Mus musculus
ggcgcgggttcacgtatactacgac

SEQ ID NO: 394705 - DNA, 25 bp, Mus musculus
agtcggtcacctcgcgttccacgaa

SEQ ID NO: 394706 - DNA, 25 bp, Mus musculus
gcacgtaacgccctagcccattatg

SEQ ID NO: 394707 - DNA, 25 bp, Mus musculus
cccattatggaggacgctggtcaga

SEQ ID NO: 394708 - DNA, 25 bp, Mus musculus
cgccctggagagttttgcttccgga

SEQ ID NO: 394709 - DNA, 25 bp, Mus musculus
tttgcttccggagtcaccgcgagta

SEQ ID NO: 394710 - DNA, 25 bp, Mus musculus
tatactacgactcctgggttccgtc

SEQ ID NO: 394711 - DNA, 25 bp, Mus musculus
atctcctccaccgacttgctgttga

SEQ ID NO: 394712 - DNA, 25 bp, Mus musculus
tttgtcgcaccaggcggttcctgct

SEQ ID NO: 394713 - DNA, 25 bp, Mus musculus
gaaaacttacacacacgcgccgaca

SEQ ID NO: 394714 - DNA, 25 bp, Mus musculus
aagtagagttctatcacggcgaaga

SEQ ID NO: 394715 - DNA, 25 bp, Mus musculus
caggcgttgagcacgtgattgcttc

SEQ ID NO: 394716 - DNA, 25 bp, Mus musculus
ccgcaggtcctcactttggagagaa

SEQ ID NO: 394717 - DNA, 25 bp, Mus musculus
aactttacgcgtcttgggatgagga

SEQ ID NO: 394718 - DNA, 25 bp, Mus musculus
tctgtggaccgcaggcgaaacaaca

SEQ ID NO: 394719 - DNA, 25 bp, Mus musculus
tgcattcacttaggacgcgaacaca

SEQ ID NO: 394720 - DNA, 25 bp, Mus musculus
acacacgtgtgctcaggaaaggaca

SEQ ID NO: 394721 - DNA, 25 bp, Mus musculus
aggtaccctagctgtcccaatggca

SEQ ID NO: 394722 - DNA, 25 bp, Mus musculus
ggcagtaccactagctcgcgcgact

SEQ ID NO: 394723 - DNA, 25 bp, Mus musculus
gctgagtttttctgcccaaggctga

SEQ ID NO: 394724 - DNA, 25 bp, Mus musculus
gcctgcaggtgaagaccaagacgta

SEQ ID NO: 394725 - DNA, 25 bp, Mus musculus
ccctgcgacctggacgctgagtttt

SEQ ID NO: 394726 - DNA, 25 bp, Mus musculus
catttggatgccgaagcatcgggac

SEQ ID NO: 394727 - DNA, 25 bp, Mus musculus
cgttcctcctggcagagagtgatga

SEQ ID NO: 394728 - DNA, 25 bp, Mus musculus
gcttcagcggtaccgccaggaggct

SEQ ID NO: 394729 - DNA, 25 bp, Mus musculus
acggctgcgccaagaactgcagcgg

SEQ ID NO: 394730 - DNA, 25 bp, Mus musculus
tggccctccgtgaggcccgggccac

SEQ ID NO: 394731 - DNA, 25 bp, Mus musculus
tcctggcagagagtgatgaggccaa

SEQ ID NO: 394732 - DNA, 25 bp, Mus musculus
cgacccgttcctcctggcagagagt

SEQ ID NO: 394733 - DNA, 25 bp, Mus musculus
cgaagcatcgggactccgggatccc

SEQ ID NO: 394734 - DNA, 25 bp, Mus musculus
ccgggcatttggatgccgaagcatc

SEQ ID NO: 394735 - DNA, 25 bp, Mus musculus
ctgctcgcaggagcttcagcggtac

SEQ ID NO: 394736 - DNA, 25 bp, Mus musculus
ctggaggcctgctcgcaggagcttc

SEQ ID NO: 394737 - DNA, 25 bp, Mus musculus
aggaggcagcccgagctcgggagca

SEQ ID NO: 394738 - DNA, 25 bp, Mus musculus
cccgggccaccttgcgggtcagtga

SEQ ID NO: 394739 - DNA, 25 bp, Mus musculus
caggtggaacggctgcgccaagaac

SEQ ID NO: 394740 - DNA, 25 bp, Mus musculus
cttctacctttagggcggactgagc

SEQ ID NO: 394741 - DNA, 25 bp, Mus musculus
gcttgatctgttcccggccaagcca

SEQ ID NO: 394742 - DNA, 25 bp, Mus musculus
cgctgcttgatctgttcccggccaa

SEQ ID NO: 394743 - DNA, 25 bp, Mus musculus
tcctggcggtgatgaagaggcccat

SEQ ID NO: 394744 - DNA, 25 bp, Mus musculus
cgtctcacctgctgcagcgccctcg

SEQ ID NO: 394745 - DNA, 25 bp, Mus musculus
aagaggcccattagctgcttctacc

SEQ ID NO: 394746 - DNA, 25 bp, Mus musculus
tagctgcttctacctttagggcgga

SEQ ID NO: 394747 - DNA, 25 bp, Mus musculus
ccagggacccgttcctggcggtgat

SEQ ID NO: 394748 - DNA, 25 bp, Mus musculus
tccacctcccaattaggacgtgaga

SEQ ID NO: 394749 - DNA, 25 bp, Mus musculus
ctcccaattaggacgtgagaaaccg

SEQ ID NO: 394750 - DNA, 25 bp, Mus musculus
cgtgagaaaccgtcaaccaagatta

SEQ ID NO: 394751 - DNA, 25 bp, Mus musculus
caaccaagattaatagttgcccggc

SEQ ID NO: 394752 - DNA, 25 bp, Mus musculus
agatgagcccagaatccgggccgcc

SEQ ID NO: 394753 - DNA, 25 bp, Mus musculus
ttagggcggactgagccgctccctc

SEQ ID NO: 394754 - DNA, 25 bp, Mus musculus
ggtgactgcagtgcttcttcctcgc

SEQ ID NO: 394755 - DNA, 25 bp, Mus musculus
gcgcagtcagaacctctgacgcctt

SEQ ID NO: 394756 - DNA, 25 bp, Mus musculus
agggctcggccaaagtcagaactgc

SEQ ID NO: 394757 - DNA, 25 bp, Mus musculus
cttttctagcttgccgttgggattc

SEQ ID NO: 394758 - DNA, 25 bp, Mus musculus
tgccgttgggattctcgcgacaatc

SEQ ID NO: 394759 - DNA, 25 bp, Mus musculus
aaagtcagaactgcgcggtgactgc

SEQ ID NO: 394760 - DNA, 25 bp, Mus musculus
cctctgatcagaggcagcgtctctg

SEQ ID NO: 394761 - DNA, 25 bp, Mus musculus
cttcttcctcgcagggtagagcgga

SEQ ID NO: 394762 - DNA, 25 bp, Mus musculus
tacagctctcttctaccttgtcgga

SEQ ID NO: 394763 - DNA, 25 bp, Mus musculus
gtttgggattgcctgtgtacagctc

SEQ ID NO: 394764 - DNA, 25 bp, Mus musculus
cccgtctcctcggagtttgggattg

SEQ ID NO: 394765 - DNA, 25 bp, Mus musculus
tcgcgtgaaattcgcttcccgtctc

SEQ ID NO: 394766 - DNA, 25 bp, Mus musculus
cgacaatcccgaaacctcgcgtgaa

SEQ ID NO: 394767 - DNA, 25 bp, Mus musculus
ctctgctgactgaacgctcctttga

SEQ ID NO: 394768 - DNA, 25 bp, Mus musculus
tccctgccggccagaagagtgcgct

SEQ ID NO: 394769 - DNA, 25 bp, Mus musculus
catccggggccctgcgaatcgggta

SEQ ID NO: 394770 - DNA, 25 bp, Mus musculus
cgagggttgtgctccctgccggcca

SEQ ID NO: 394771 - DNA, 25 bp, Mus musculus
gctgctgctgggaatgcgcaaacct

SEQ ID NO: 394772 - DNA, 25 bp, Mus musculus
agggccagctctgcgatctggaccc

SEQ ID NO: 394773 - DNA, 25 bp, Mus musculus
cgctaacttctacgggcgctgcggc

SEQ ID NO: 394774 - DNA, 25 bp, Mus musculus
cgctgtgtgtctgccgctcgcagcg

SEQ ID NO: 394775 - DNA, 25 bp, Mus musculus
tcgcagcgcccgctctgtggttcgg

SEQ ID NO: 394776 - DNA, 25 bp, Mus musculus
tctgtggttcggacggccgaaccta

SEQ ID NO: 394777 - DNA, 25 bp, Mus musculus
cggccgaacctacgcgcagatctgt

SEQ ID NO: 394778 - DNA, 25 bp, Mus musculus
acgcgcagatctgtcgcctgcagga

SEQ ID NO: 394779 - DNA, 25 bp, Mus musculus
ctcggctggacgctaacctcactgt

SEQ ID NO: 394780 - DNA, 25 bp, Mus musculus
aatgcgcaaacctggagggccagct

SEQ ID NO: 394781 - DNA, 25 bp, Mus musculus
acgctaacctcactgtggtgcatcc

SEQ ID NO: 394782 - DNA, 25 bp, Mus musculus
ggcctaggattattcaccgcaaata

SEQ ID NO: 394783 - DNA, 25 bp, Mus musculus
gaccgctcttggctcagcgtctgtg

SEQ ID NO: 394784 - DNA, 25 bp, Mus musculus
ctcctgcctgtatgaactgcatctc

SEQ ID NO: 394785 - DNA, 25 bp, Mus musculus
ttctgactgtgattcccggtagccg

SEQ ID NO: 394786 - DNA, 25 bp, Mus musculus
tggggatcgtcctactacacgcttt

SEQ ID NO: 394787 - DNA, 25 bp, Mus musculus
agaaggtcctctccacccagtgaga

SEQ ID NO: 394788 - DNA, 25 bp, Mus musculus
gggtccctgtgtccatcatagcttg

SEQ ID NO: 394789 - DNA, 25 bp, Mus musculus
tcatagcttgttctccgtggcgtca

SEQ ID NO: 394790 - DNA, 25 bp, Mus musculus
gtacctacctgcagagcacaggctg

SEQ ID NO: 394791 - DNA, 25 bp, Mus musculus
catctgcggggagtaacctcagttc

SEQ ID NO: 394792 - DNA, 25 bp, Mus musculus
gcagcggacggggtttaataatgtc

SEQ ID NO: 394793 - DNA, 25 bp, Mus musculus
ccggaaagtgacacgcgatttatta

SEQ ID NO: 394794 - DNA, 25 bp, Mus musculus
taataaacgcgctgagaggcctagg

SEQ ID NO: 394795 - DNA, 25 bp, Mus musculus
ctgtgtgtggaaagcgacaacctcc

SEQ ID NO: 394796 - DNA, 25 bp, Mus musculus
tggtcctggagctggcctacgtgat

SEQ ID NO: 394797 - DNA, 25 bp, Mus musculus
gtggtgctcttcctccgctcggatc

SEQ ID NO: 394798 - DNA, 25 bp, Mus musculus
aatctgctgggcaacgtggtgctct

SEQ ID NO: 394799 - DNA, 25 bp, Mus musculus
gcttatcagctgctcaatctgctgg

SEQ ID NO: 394800 - DNA, 25 bp, Mus musculus
ggccttgcaactggcgctagctgct

SEQ ID NO: 394801 - DNA, 25 bp, Mus musculus
cactggtactcaccgcgctgtgggc

SEQ ID NO: 394802 - DNA, 25 bp, Mus musculus
gatgccactggtactcaccgcgctg

SEQ ID NO: 394803 - DNA, 25 bp, Mus musculus
agcgcccgcgcggatgccactggta

SEQ ID NO: 394804 - DNA, 25 bp, Mus musculus
gatcccagcgatcggaaagccggtg

SEQ ID NO: 394805 - DNA, 25 bp, Mus musculus
aatgcggaagcagtgggatcccagc

SEQ ID NO: 394806 - DNA, 25 bp, Mus musculus
gagacgtcagttcgctgctaggccc

SEQ ID NO: 394807 - DNA, 25 bp, Mus musculus
tattggttgcaggagacgtcagttc

SEQ ID NO: 394808 - DNA, 25 bp, Mus musculus
ccctgcggagctcctattggttgca

SEQ ID NO: 394809 - DNA, 25 bp, Mus musculus
caactggcgctagctgcttatcagc

SEQ ID NO: 394810 - DNA, 25 bp, Mus musculus
cacctgcggcttgctccgcctcagt

SEQ ID NO: 394811 - DNA, 25 bp, Mus musculus
gcacacagcctactggacaatagga

SEQ ID NO: 394812 - DNA, 25 bp, Mus musculus
ctggacaataggattatttccgggg

SEQ ID NO: 394813 - DNA, 25 bp, Mus musculus
tcaatcggtccctcggtaccctatg

SEQ ID NO: 394814 - DNA, 25 bp, Mus musculus
ctcggtaccctatgagcgcctgcgg

SEQ ID NO: 394815 - DNA, 25 bp, Mus musculus
gggccaggccgacctaattcaatta

SEQ ID NO: 394816 - DNA, 25 bp, Mus musculus
aattcaattagctaggcggccgccg

SEQ ID NO: 394817 - DNA, 25 bp, Mus musculus
gccgccgcttccttgtaactctggg

SEQ ID NO: 394818 - DNA, 25 bp, Mus musculus
ttccttgtaactctgggcccgcagg

SEQ ID NO: 394819 - DNA, 25 bp, Mus musculus
cccgcagctgctctttgtgttcaga

SEQ ID NO: 394820 - DNA, 25 bp, Mus musculus
tctttgtgttcagagcccatgcata

SEQ ID NO: 394821 - DNA, 25 bp, Mus musculus
cccatgcatatggattcggtccctc

SEQ ID NO: 394822 - DNA, 25 bp, Mus musculus
ccaacccggcttctggcacctgcgg

SEQ ID NO: 394823 - DNA, 25 bp, Mus musculus
tatggattcggtccctccctctcgt

SEQ ID NO: 394824 - DNA, 25 bp, Mus musculus
cacgcacacgacagcgccgctaggc

SEQ ID NO: 394825 - DNA, 25 bp, Mus musculus
agacagggtcctcagcgctctgtcc

SEQ ID NO: 394826 - DNA, 25 bp, Mus musculus
tgccgcccggcgtccacgcacacga

SEQ ID NO: 394827 - DNA, 25 bp, Mus musculus
cgccgccttcctggagttccgagag

SEQ ID NO: 394828 - DNA, 25 bp, Mus musculus
ttccgagaggtcgtgcccagcggcc

SEQ ID NO: 394829 - DNA, 25 bp, Mus musculus
ggcgcccgaagaagacgtggtaggc

SEQ ID NO: 394830 - DNA, 25 bp, Mus musculus
cggcgtagatggagaagaggcagta

SEQ ID NO: 394831 - DNA, 25 bp, Mus musculus
ggagcacagccgtgtccgcgtcagc

SEQ ID NO: 394832 - DNA, 25 bp, Mus musculus
gtgtccgcgtcagccgcatcccacc

SEQ ID NO: 394833 - DNA, 25 bp, Mus musculus
tccgccctgggcgtgaggaaaagct

SEQ ID NO: 394834 - DNA, 25 bp, Mus musculus
aagctccggcccaggttgccgccct

SEQ ID NO: 394835 - DNA, 25 bp, Mus musculus
tccctgcgggctaagcccagacagg

SEQ ID NO: 394836 - DNA, 25 bp, Mus musculus
ccttcctggagttccgagaggtcgt

SEQ ID NO: 394837 - DNA, 25 bp, Mus musculus
taagcccagacagggtcctcagcgc

SEQ ID NO: 394838 - DNA, 25 bp, Mus musculus
ccgcagatacacaaaggacaggttc

SEQ ID NO: 394839 - DNA, 25 bp, Mus musculus
tgaagctctttctgagcgccaggtc

SEQ ID NO: 394840 - DNA, 25 bp, Mus musculus
cctgcttgatggctccttgaagctc

SEQ ID NO: 394841 - DNA, 25 bp, Mus musculus
gtgctacccactaccctgcttgatg

SEQ ID NO: 394842 - DNA, 25 bp, Mus musculus
aaacagctaggctcgctcgctcagg

SEQ ID NO: 394843 - DNA, 25 bp, Mus musculus
cgctcagggctttttcgcccggtga

SEQ ID NO: 394844 - DNA, 25 bp, Mus musculus
cccggtgattgatgtcccagagtca

SEQ ID NO: 394845 - DNA, 25 bp, Mus musculus
tactttggcccttctgcgcacttcg

SEQ ID NO: 394846 - DNA, 25 bp, Mus musculus
gccttcaagtctcagcgcagcctgg

SEQ ID NO: 394847 - DNA, 25 bp, Mus musculus
ctccaggatggagactacggccttg

SEQ ID NO: 394848 - DNA, 25 bp, Mus musculus
gcccggctcctacaacgtgaacatg

SEQ ID NO: 394849 - DNA, 25 bp, Mus musculus
tacagtaccctctgtgcctgcggtg

SEQ ID NO: 394850 - DNA, 25 bp, Mus musculus
tttccctggatggagagtaaccgca

SEQ ID NO: 394851 - DNA, 25 bp, Mus musculus
tcccagagtcaacagcgagcgagca

SEQ ID NO: 394852 - DNA, 25 bp, Mus musculus
cgcttccaccgccagaagtacttgg

SEQ ID NO: 394853 - DNA, 25 bp, Mus musculus
ggcctataaaccagtctatgcgatc

SEQ ID NO: 394854 - DNA, 25 bp, Mus musculus
agacgctgctcatttctgccgctga

SEQ ID NO: 394855 - DNA, 25 bp, Mus musculus
acgcttcagggctttcaggacagca

SEQ ID NO: 394856 - DNA, 25 bp, Mus musculus
tttcctgtgttttaagagacgcttc

SEQ ID NO: 394857 - DNA, 25 bp, Mus musculus
tttagacgagtgagcgcctacagtc

SEQ ID NO: 394858 - DNA, 25 bp, Mus musculus
tgcttgctggtttccgatcggttta

SEQ ID NO: 394859 - DNA, 25 bp, Mus musculus
ttcactgtaacacgccgtataggtc

SEQ ID NO: 394860 - DNA, 25 bp, Mus musculus
tgctctggccaaggcgctcaaaatg

SEQ ID NO: 394861 - DNA, 25 bp, Mus musculus
ccctaagaagaagaagccgcgcaca

SEQ ID NO: 394862 - DNA, 25 bp, Mus musculus
tgattgcccagcctgcctttaccgg

SEQ ID NO: 394863 - DNA, 25 bp, Mus musculus
tgccgctgaggcaaatgggcctata

SEQ ID NO: 394864 - DNA, 25 bp, Mus musculus
tgaccgatgcgcaagtaaaaacctg

SEQ ID NO: 394865 - DNA, 25 bp, Mus musculus
ggacagcactgtctaccctgggtag

SEQ ID NO: 394866 - DNA, 25 bp, Mus musculus
tcctggctagtaattgcttgttccc

SEQ ID NO: 394867 - DNA, 25 bp, Mus musculus
tggtctgacgactccaccaaaatca

SEQ ID NO: 394868 - DNA, 25 bp, Mus musculus
actttccggagaaccagaactctcg

SEQ ID NO: 394869 - DNA, 25 bp, Mus musculus
cgttgaggactttccggagaaccag

SEQ ID NO: 394870 - DNA, 25 bp, Mus musculus
aaatcaccagcgtcacgtccgtggc

SEQ ID NO: 394871 - DNA, 25 bp, Mus musculus
cgcaggcgacagacagcagaggaac

SEQ ID NO: 394872 - DNA, 25 bp, Mus musculus
acagacagcagaggaacgtgaggcc

SEQ ID NO: 394873 - DNA, 25 bp, Mus musculus
gaggcagcaggcgaaccgcatcctc

SEQ ID NO: 394874 - DNA, 25 bp, Mus musculus
ctgcagcaggaagccttccagaaga

SEQ ID NO: 394875 - DNA, 25 bp, Mus musculus
tgcctgcagacccactgtgcgtgca

SEQ ID NO: 394876 - DNA, 25 bp, Mus musculus
tgtgcgtgcacaactcctcgctctt

SEQ ID NO: 394877 - DNA, 25 bp, Mus musculus
aacctgcagccgtggtctgacgact

SEQ ID NO: 394878 - DNA, 25 bp, Mus musculus
cttcggcctgcgagtgaggacccaa

SEQ ID NO: 394879 - DNA, 25 bp, Mus musculus
aagagggttagagtcctggctagta

SEQ ID NO: 394880 - DNA, 25 bp, Mus musculus
gccgagaagcaacgcggtacttttc

SEQ ID NO: 394881 - DNA, 25 bp, Mus musculus
cggcggatgcacgaagtccaaacga

SEQ ID NO: 394882 - DNA, 25 bp, Mus musculus
tgctccgggcctctggatttcgctc

SEQ ID NO: 394883 - DNA, 25 bp, Mus musculus
tggatttcgctctctcctgggactg

SEQ ID NO: 394884 - DNA, 25 bp, Mus musculus
tcctgggactgcttggggattccca

SEQ ID NO: 394885 - DNA, 25 bp, Mus musculus
ggcctcccaagggtatcagacttca

SEQ ID NO: 394886 - DNA, 25 bp, Mus musculus
agtccaaacgaactatccacagcgc

SEQ ID NO: 394887 - DNA, 25 bp, Mus musculus
atccttgaggccgagaagcaacgcg

SEQ ID NO: 394888 - DNA, 25 bp, Mus musculus
cctctccgcagggaattcgttgggc

SEQ ID NO: 394889 - DNA, 25 bp, Mus musculus
ttcgttgggcccgaatctcagcgaa

SEQ ID NO: 394890 - DNA, 25 bp, Mus musculus
cgaatctcagcgaatcccgcgtgca

SEQ ID NO: 394891 - DNA, 25 bp, Mus musculus
gctcccaagcgctgcaaccttagga

SEQ ID NO: 394892 - DNA, 25 bp, Mus musculus
cgggttcattccttgcgccgcggcg

SEQ ID NO: 394893 - DNA, 25 bp, Mus musculus
acttcaggaagtttggggatccttg

SEQ ID NO: 394894 - DNA, 25 bp, Mus musculus
tcagtctctctgagccatttgggtc

SEQ ID NO: 394895 - DNA, 25 bp, Mus musculus
tggaaaaccacttgaccctcacggc

SEQ ID NO: 394896 - DNA, 25 bp, Mus musculus
atgctgttgctagtgcgtgttcttc

SEQ ID NO: 394897 - DNA, 25 bp, Mus musculus
cgtgagcgccgatttacatgtatgc

SEQ ID NO: 394898 - DNA, 25 bp, Mus musculus
cttctctatgtgcacgcaagcgtga

SEQ ID NO: 394899 - DNA, 25 bp, Mus musculus
cgcacgatgtgcgtggaaaaccact

SEQ ID NO: 394900 - DNA, 25 bp, Mus musculus
gtatgcatgaacgattgggcttctc

SEQ ID NO: 394901 - DNA, 25 bp, Mus musculus
agtcccaagctaggttgtcccggtg

SEQ ID NO: 394902 - DNA, 25 bp, Mus musculus
ctctggaaatcagggacgttaaagc

SEQ ID NO: 394903 - DNA, 25 bp, Mus musculus
actcatccctaaaagccggcgcagg

SEQ ID NO: 394904 - DNA, 25 bp, Mus musculus
gcatcttttgcgcatgcagatttac

SEQ ID NO: 394905 - DNA, 25 bp, Mus musculus
tttatcgggagcagatttacgtttc

SEQ ID NO: 394906 - DNA, 25 bp, Mus musculus
gagggcctccctccaaagccgaatg

SEQ ID NO: 394907 - DNA, 25 bp, Mus musculus
cgctcgccttgcactgtacagactt

SEQ ID NO: 394908 - DNA, 25 bp, Mus musculus
ggccttcatggtccgcgctccgaat

SEQ ID NO: 394909 - DNA, 25 bp, Mus musculus
gccagggctgcttcattgggattca

SEQ ID NO: 394910 - DNA, 25 bp, Mus musculus
ttcattgggattcatgggcgtgttg

SEQ ID NO: 394911 - DNA, 25 bp, Mus musculus
cgcgcgcggggacctaatccatcaa

SEQ ID NO: 394912 - DNA, 25 bp, Mus musculus
tccatcaaattgtctacaaattgtg

SEQ ID NO: 394913 - DNA, 25 bp, Mus musculus
gtctacaaattgtgaagaaaattca

SEQ ID NO: 394914 - DNA, 25 bp, Mus musculus
ttaactagacgggcggataaatggc

SEQ ID NO: 394915 - DNA, 25 bp, Mus musculus
gggcccattcgtcccggccttcatg

SEQ ID NO: 394916 - DNA, 25 bp, Mus musculus
aaaaccatatggtcgccagcgctgg

SEQ ID NO: 394917 - DNA, 25 bp, Mus musculus
atggtccgcgctccgaattacagac

SEQ ID NO: 394918 - DNA, 25 bp, Mus musculus
tacagacccatccatcctaagagag

SEQ ID NO: 394919 - DNA, 25 bp, Mus musculus
ccatcctaagagagggcgatttatg

SEQ ID NO: 394920 - DNA, 25 bp, Mus musculus
tgggcccggctattgtcgcctgtca

SEQ ID NO: 394921 - DNA, 25 bp, Mus musculus
gctattgtcgcctgtcagcggccgc

SEQ ID NO: 394922 - DNA, 25 bp, Mus musculus
cagagactccctaaatgtgttgtga

SEQ ID NO: 394923 - DNA, 25 bp, Mus musculus
tcccatcgcggcctggaaagaaatg

SEQ ID NO: 394924 - DNA, 25 bp, Mus musculus
tgctcgcgacgagagagtcaagacc

SEQ ID NO: 394925 - DNA, 25 bp, Mus musculus
ggtcccgctcttgtttcttctccaa

SEQ ID NO: 394926 - DNA, 25 bp, Mus musculus
ctaaacctgagcaaactgggccatg

SEQ ID NO: 394927 - DNA, 25 bp, Mus musculus
ggccatgggacacctcctgtctctg

SEQ ID NO: 394928 - DNA, 25 bp, Mus musculus
agaaagcgtttctccaactcgtaga

SEQ ID NO: 394929 - DNA, 25 bp, Mus musculus
ccttaaaggtcttgctggcgagctc

SEQ ID NO: 394930 - DNA, 25 bp, Mus musculus
cctcttcccagtccaggagtaagtc

SEQ ID NO: 394931 - DNA, 25 bp, Mus musculus
ctccgggaagagcttgggttctcac

SEQ ID NO: 394932 - DNA, 25 bp, Mus musculus
gggttctcacacctctctcagatca

SEQ ID NO: 394933 - DNA, 25 bp, Mus musculus
gcaggggaatctagacttgtgccta

SEQ ID NO: 394934 - DNA, 25 bp, Mus musculus
ttgtgcctaccttcggctgcctgca

SEQ ID NO: 394935 - DNA, 25 bp, Mus musculus
tgtctctggtctcctgaaagtccta

SEQ ID NO: 394936 - DNA, 25 bp, Mus musculus
cagccgcggagtgacgcggtcgccg

SEQ ID NO: 394937 - DNA, 25 bp, Mus musculus
tggccgagatggcagcaccagcccg

SEQ ID NO: 394938 - DNA, 25 bp, Mus musculus
gagatggcagcaccagcccggagat

SEQ ID NO: 394939 - DNA, 25 bp, Mus musculus
atggcagcaccagcccggagatctc

SEQ ID NO: 394940 - DNA, 25 bp, Mus musculus
agcaccagcccggagatctcaggct

SEQ ID NO: 394941 - DNA, 25 bp, Mus musculus
accagcccggagatctcaggctctg

SEQ ID NO: 394942 - DNA, 25 bp, Mus musculus
cagcccggagatctcaggctctgca

SEQ ID NO: 394943 - DNA, 25 bp, Mus musculus
gcccggagatctcaggctctgcaag

SEQ ID NO: 394944 - DNA, 25 bp, Mus musculus
ccggagatctcaggctctgcaagcc

SEQ ID NO: 394945 - DNA, 25 bp, Mus musculus
tctgcaagccgcagttgggaagctt

SEQ ID NO: 394946 - DNA, 25 bp, Mus musculus
gcctggccgagatggcagcaccagc

SEQ ID NO: 394947 - DNA, 25 bp, Mus musculus
caagccgcagttgggaagcttgaga

SEQ ID NO: 394948 - DNA, 25 bp, Mus musculus
gaagcttgagaagggtaccaggatc

SEQ ID NO: 394949 - DNA, 25 bp, Mus musculus
agcttgagaagggtaccaggatccc

SEQ ID NO: 394950 - DNA, 25 bp, Mus musculus
ctcggcccgagatgtttgtaaatta

SEQ ID NO: 394951 - DNA, 25 bp, Mus musculus
cccaaactgagagcagtgctctggg

SEQ ID NO: 394952 - DNA, 25 bp, Mus musculus
tgctcccgaacctggggtgactaaa

SEQ ID NO: 394953 - DNA, 25 bp, Mus musculus
tgcctttattgctcccgaacctggg

SEQ ID NO: 394954 - DNA, 25 bp, Mus musculus
gaggtgcctttattgctcccgaacc

SEQ ID NO: 394955 - DNA, 25 bp, Mus musculus
cggcccgagatgtttgtaaattaca

SEQ ID NO: 394956 - DNA, 25 bp, Mus musculus
ccggctggaattagcctgcctaatg

SEQ ID NO: 394957 - DNA, 25 bp, Mus musculus
ctacgccgtgctcggcccgagatgt

SEQ ID NO: 394958 - DNA, 25 bp, Mus musculus
aatgcgcctgtcagtcccggctcta

SEQ ID NO: 394959 - DNA, 25 bp, Mus musculus
aggagccggctggaattagcctgcc

SEQ ID NO: 394960 - DNA, 25 bp, Mus musculus
agcctgcctaatgcgcctgtcagtc

SEQ ID NO: 394961 - DNA, 25 bp, Mus musculus
gagcagtgctctgggcacacccgtc

SEQ ID NO: 394962 - DNA, 25 bp, Mus musculus
tgcctaatgcgcctgtcagtcccgg

SEQ ID NO: 394963 - DNA, 25 bp, Mus musculus
tgtaaattacattagaggtgccttt

SEQ ID NO: 394964 - DNA, 25 bp, Mus musculus
tcttattgagtcgaggctggaaatc

SEQ ID NO: 394965 - DNA, 25 bp, Mus musculus
gctcggggaccgctctaaattctcc

SEQ ID NO: 394966 - DNA, 25 bp, Mus musculus
tttctgggagcccagctcggggacc

SEQ ID NO: 394967 - DNA, 25 bp, Mus musculus
aacgtgtaaggctgtttctgggagc

SEQ ID NO: 394968 - DNA, 25 bp, Mus musculus
tgttcagctaaggaaaataaacgtg

SEQ ID NO: 394969 - DNA, 25 bp, Mus musculus
aattctcgcctttcctgttcagcta

SEQ ID NO: 394970 - DNA, 25 bp, Mus musculus
ccctcagcgggctgtgcggaagtct

SEQ ID NO: 394971 - DNA, 25 bp, Mus musculus
tgtgcggaagtctcgccctcacgaa

SEQ ID NO: 394972 - DNA, 25 bp, Mus musculus
ccctcacgaaggacaggaacaaatg

SEQ ID NO: 394973 - DNA, 25 bp, Mus musculus
tggaaatcattcagctcggcggcgc

SEQ ID NO: 394974 - DNA, 25 bp, Mus musculus
tgtaattaaagcgatctgcaagggg

SEQ ID NO: 394975 - DNA, 25 bp, Mus musculus
tcctagcaagcaagcgcaagcgggg

SEQ ID NO: 394976 - DNA, 25 bp, Mus musculus
ggcgcctgtcctataaatccacata

SEQ ID NO: 394977 - DNA, 25 bp, Mus musculus
gggtacgtcctagcaagcaagcgca

SEQ ID NO: 394978 - DNA, 25 bp, Mus musculus
cgaggccttggccttttgtctgctg

SEQ ID NO: 394979 - DNA, 25 bp, Mus musculus
gggatcagacggacagcagctacag

SEQ ID NO: 394980 - DNA, 25 bp, Mus musculus
ggcgatgtttggtgaaaaagtttga

SEQ ID NO: 394981 - DNA, 25 bp, Mus musculus
ttgagtttctcagtaccccgcgtgg

SEQ ID NO: 394982 - DNA, 25 bp, Mus musculus
tagaagaaccgaagacagttcctcc

SEQ ID NO: 394983 - DNA, 25 bp, Mus musculus
caagcgctacgggtggtgcctgcct

SEQ ID NO: 394984 - DNA, 25 bp, Mus musculus
gtgcctgccttgcaaggaccgcgag

SEQ ID NO: 394985 - DNA, 25 bp, Mus musculus
caaggaccgcgaggccttggccttt

SEQ ID NO: 394986 - DNA, 25 bp, Mus musculus
gccttttgtctgctggccctcactg

SEQ ID NO: 394987 - DNA, 25 bp, Mus musculus
gtctgctggccctcactgcacagag

SEQ ID NO: 394988 - DNA, 25 bp, Mus musculus
cctcactgcacagaggcgtggcgta

SEQ ID NO: 394989 - DNA, 25 bp, Mus musculus
cggacagcagctacagccagtagaa

SEQ ID NO: 394990 - DNA, 25 bp, Mus musculus
tacagccagtagaagaaccgaagac

SEQ ID NO: 394991 - DNA, 25 bp, Mus musculus
tgccttgcaaggaccgcgaggcctt

SEQ ID NO: 394992 - DNA, 25 bp, Mus musculus
gccggcctactacaaacgtcagatt

SEQ ID NO: 394993 - DNA, 25 bp, Mus musculus
ggtttctgagccgagtttttctgga

SEQ ID NO: 394994 - DNA, 25 bp, Mus musculus
cggcatcggaacgtccggggatata

SEQ ID NO: 394995 - DNA, 25 bp, Mus musculus
ttagctcttccagctgtctccatgg

SEQ ID NO: 394996 - DNA, 25 bp, Mus musculus
ggccgctttacatctccctggaatc

SEQ ID NO: 394997 - DNA, 25 bp, Mus musculus
agccacgctcgcaatgggatcttcg

SEQ ID NO: 394998 - DNA, 25 bp, Mus musculus
tgttgtctgcctcctagctgagcta

SEQ ID NO: 394999 - DNA, 25 bp, Mus musculus
tagctgagctagttcaccgaccggg

SEQ ID NO: 395000 - DNA, 25 bp, Mus musculus
gggtgtagcatctccagggcccata

SEQ ID NO: 395001 - DNA, 25 bp, Mus musculus
ccgatgctgttcgtatccaagcgtc

SEQ ID NO: 395002 - DNA, 25 bp, Mus musculus
tcccgcaatgagttcctgacgtctg

SEQ ID NO: 395003 - DNA, 25 bp, Mus musculus
gacgtctgtctcataagccctcctt

SEQ ID NO: 395004 - DNA, 25 bp, Mus musculus
aagaggctggcttagcgcttacctg

SEQ ID NO: 395005 - DNA, 25 bp, Mus musculus
ccgtcgccaagtgcgcaggtatgac

SEQ ID NO: 395006 - DNA, 25 bp, Mus musculus
cgtagccttgccttttgccgctgga

SEQ ID NO: 395007 - DNA, 25 bp, Mus musculus
tcgctgagcttaggccagggtcacc

SEQ ID NO: 395008 - DNA, 25 bp, Mus musculus
agcgcttaagtttatggtgaggaga

SEQ ID NO: 395009 - DNA, 25 bp, Mus musculus
cggtgctgcaggagaaagcgcttaa

SEQ ID NO: 395010 - DNA, 25 bp, Mus musculus
tccgggcgattatggacccggcaga

SEQ ID NO: 395011 - DNA, 25 bp, Mus musculus
gcagacccagtagtccgggcgatta

SEQ ID NO: 395012 - DNA, 25 bp, Mus musculus
ctggagcctccagaactacaagtcc

SEQ ID NO: 395013 - DNA, 25 bp, Mus musculus
ctctacgcagtgacccgtgggagtt

SEQ ID NO: 395014 - DNA, 25 bp, Mus musculus
tggcttgcacacagccgcgactcta

SEQ ID NO: 395015 - DNA, 25 bp, Mus musculus
tccgggctctcgagtgctctacatt

SEQ ID NO: 395016 - DNA, 25 bp, Mus musculus
tcgtttggtaaccacggtgacactc

SEQ ID NO: 395017 - DNA, 25 bp, Mus musculus
tccggctttgccttcttagagactg

SEQ ID NO: 395018 - DNA, 25 bp, Mus musculus
tgccagtgccaggaggtaaaaagag

SEQ ID NO: 395019 - DNA, 25 bp, Mus musculus
gagtgctctacatttggcttgcaca

SEQ ID NO: 395020 - DNA, 25 bp, Mus musculus
tgtgtccttgcacggtgcacctgcg

SEQ ID NO: 395021 - DNA, 25 bp, Mus musculus
gcggaggaacaaagcagcgcgctca

SEQ ID NO: 395022 - DNA, 25 bp, Mus musculus
cgaacgaggccgatgacaaatgggc

SEQ ID NO: 395023 - DNA, 25 bp, Mus musculus
cccattacgctgtaataacagaaga

SEQ ID NO: 395024 - DNA, 25 bp, Mus musculus
acagaagatggatggcctggcgccc

SEQ ID NO: 395025 - DNA, 25 bp, Mus musculus
gtaacgggagccgatccgactccgc

SEQ ID NO: 395026 - DNA, 25 bp, Mus musculus
caatcccggccgacggagacgcccg

SEQ ID NO: 395027 - DNA, 25 bp, Mus musculus
caaagcagcgcgctcagcgggcgca

SEQ ID NO: 395028 - DNA, 25 bp, Mus musculus
gcctgccaggacacgcagctgtgca

SEQ ID NO: 395029 - DNA, 25 bp, Mus musculus
ggacacgcagctgtgcacacacatg

SEQ ID NO: 395030 - DNA, 25 bp, Mus musculus
cgcagctgtgcacacacatggcctg

SEQ ID NO: 395031 - DNA, 25 bp, Mus musculus
catggcctgcacacgcgccagccgc

SEQ ID NO: 395032 - DNA, 25 bp, Mus musculus
cagccgcctgtgtccttgcacggtg

SEQ ID NO: 395033 - DNA, 25 bp, Mus musculus
cggttatcagcgaacgaggccgatg

SEQ ID NO: 395034 - DNA, 25 bp, Mus musculus
ctgcactcgaggagccggacccttt

SEQ ID NO: 395035 - DNA, 25 bp, Mus musculus
gcctctcaggaaacgcgctcgctgt

SEQ ID NO: 395036 - DNA, 25 bp, Mus musculus
tgcactcgaggagccggaccctttc

SEQ ID NO: 395037 - DNA, 25 bp, Mus musculus
tccctagcgcccgggtcctagagga

SEQ ID NO: 395038 - DNA, 25 bp, Mus musculus
cccgtaggacagacggagggcagcc

SEQ ID NO: 395039 - DNA, 25 bp, Mus musculus
ctggatattcccgtcccgtaggaca

SEQ ID NO: 395040 - DNA, 25 bp, Mus musculus
tcgcgcaccctctgccggcgcctct

SEQ ID NO: 395041 - DNA, 25 bp, Mus musculus
acctcttcgccggtcctcgcgcacc

SEQ ID NO: 395042 - DNA, 25 bp, Mus musculus
ttagcagcggacctcttcgccggtc

SEQ ID NO: 395043 - DNA, 25 bp, Mus musculus
ggcttagcagcggacctcttcgccg

SEQ ID NO: 395044 - DNA, 25 bp, Mus musculus
tcctctcaagagctcgcccggctta

SEQ ID NO: 395045 - DNA, 25 bp, Mus musculus
tggcttggccctcctctcaagagct

SEQ ID NO: 395046 - DNA, 25 bp, Mus musculus
tcctagaggagcgtggcttggccct

SEQ ID NO: 395047 - DNA, 25 bp, Mus musculus
ggatattcccgtcccgtaggacaga

SEQ ID NO: 395048 - DNA, 25 bp, Mus musculus
cctgaggtccctgctcctgtcctct

SEQ ID NO: 395049 - DNA, 25 bp, Mus musculus
ctctctccaggctgtcgtcctcccg

SEQ ID NO: 395050 - DNA, 25 bp, Mus musculus
gcttcccggagcttctcggcctttc

SEQ ID NO: 395051 - DNA, 25 bp, Mus musculus
ccgctgccttcctctccggctgcag

SEQ ID NO: 395052 - DNA, 25 bp, Mus musculus
cagctcctccggcaggcgccagagc

SEQ ID NO: 395053 - DNA, 25 bp, Mus musculus
acaccacgtcggaccgggtcacatg

SEQ ID NO: 395054 - DNA, 25 bp, Mus musculus
ggccggctcgacgcacagccgaaga

SEQ ID NO: 395055 - DNA, 25 bp, Mus musculus
aggtaggagcagatgagcagcagca

SEQ ID NO: 395056 - DNA, 25 bp, Mus musculus
cgcagccagcggcagacttgggcca

SEQ ID NO: 395057 - DNA, 25 bp, Mus musculus
cgcagctggtgaagcgccgcagcca

SEQ ID NO: 395058 - DNA, 25 bp, Mus musculus
ctatcgggcgccagagcaggtcgca

SEQ ID NO: 395059 - DNA, 25 bp, Mus musculus
gtgccacacggtcccgagccgacca

SEQ ID NO: 395060 - DNA, 25 bp, Mus musculus
ccctcacgcctgtatttcggggtgc

SEQ ID NO: 395061 - DNA, 25 bp, Mus musculus
cttacaggtcggtgccgagccgcgt

SEQ ID NO: 395062 - DNA, 25 bp, Mus musculus
gaactcgaagcgcaggctctgctcg

SEQ ID NO: 395063 - DNA, 25 bp, Mus musculus
cggcaggcgcttcatgaagtgcacc

SEQ ID NO: 395064 - DNA, 25 bp, Mus musculus
ggcccttgcgggtaaaggccatgta

SEQ ID NO: 395065 - DNA, 25 bp, Mus musculus
tcatgaagtgcacctcgcgctgatg

SEQ ID NO: 395066 - DNA, 25 bp, Mus musculus
cctcgcgctgatgctggcgcgtctt

SEQ ID NO: 395067 - DNA, 25 bp, Mus musculus
atgctggcgcgtcttggagcccttg

SEQ ID NO: 395068 - DNA, 25 bp, Mus musculus
gggtaaaggccatgtaccagccctc

SEQ ID NO: 395069 - DNA, 25 bp, Mus musculus
ggccatgtaccagccctcgtacttg

SEQ ID NO: 395070 - DNA, 25 bp, Mus musculus
tggcgttctgcagcgccgtgtagtt

SEQ ID NO: 395071 - DNA, 25 bp, Mus musculus
ctccagcacgatctctgtgaatacg

SEQ ID NO: 395072 - DNA, 25 bp, Mus musculus
cgagctcccgctggattcctcggcc

SEQ ID NO: 395073 - DNA, 25 bp, Mus musculus
gctccggggcccaagtcctctggct

SEQ ID NO: 395074 - DNA, 25 bp, Mus musculus
tagttgaggaactcgaagcgcaggc

SEQ ID NO: 395075 - DNA, 25 bp, Mus musculus
cagccctcgtacttggcgttctgca

SEQ ID NO: 395076 - DNA, 25 bp, Mus musculus
cttacctgggcttggaggcagagaa

SEQ ID NO: 395077 - DNA, 25 bp, Mus musculus
tcgtggaatgtcgtgctcgccgcgc

SEQ ID NO: 395078 - DNA, 25 bp, Mus musculus
cgaagggtcggtcctcgtgtccctg

SEQ ID NO: 395079 - DNA, 25 bp, Mus musculus
tcctcgtgtccctgcccgagagtgt

SEQ ID NO: 395080 - DNA, 25 bp, Mus musculus
cccgagagtgtcagctgggttcccc

SEQ ID NO: 395081 - DNA, 25 bp, Mus musculus
acgcggctcgtggaatgtcgtgctc

SEQ ID NO: 395082 - DNA, 25 bp, Mus musculus
cagcgctccttacctgggcttggag

SEQ ID NO: 395083 - DNA, 25 bp, Mus musculus
gtcacgccgtcccactggaggccgc

SEQ ID NO: 395084 - DNA, 25 bp, Mus musculus
gcagagaaccagcaagtgcaacagc

SEQ ID NO: 395085 - DNA, 25 bp, Mus musculus
atcccgacgcggctcgtggaatgtc

SEQ ID NO: 395086 - DNA, 25 bp, Mus musculus
gcaacagcctgtgggagacaaaagc

SEQ ID NO: 395087 - DNA, 25 bp, Mus musculus
agcggctatcccgacgcggctcgtg

SEQ ID NO: 395088 - DNA, 25 bp, Mus musculus
gacaagccgaaggtgcggaggctga

SEQ ID NO: 395089 - DNA, 25 bp, Mus musculus
ttctgcgcagcgctccttacctggg

SEQ ID NO: 395090 - DNA, 25 bp, Mus musculus
aggagcagtcgtcgcctcttccacg

SEQ ID NO: 395091 - DNA, 25 bp, Mus musculus
ctcccgcgttcaataccgaagaaga

SEQ ID NO: 395092 - DNA, 25 bp, Mus musculus
agcgcgcgaggacgctccacaaact

SEQ ID NO: 395093 - DNA, 25 bp, Mus musculus
cgctcgccacacgaagcagggagga

SEQ ID NO: 395094 - DNA, 25 bp, Mus musculus
gtcccgcccattaaaggagccgcgc

SEQ ID NO: 395095 - DNA, 25 bp, Mus musculus
ccgcctcagccagttccggtcccgc

SEQ ID NO: 395096 - DNA, 25 bp, Mus musculus
ccgccatgctgaaacggccgtgagc

SEQ ID NO: 395097 - DNA, 25 bp, Mus musculus
ggccgccttcctcggccacgcctca

SEQ ID NO: 395098 - DNA, 25 bp, Mus musculus
gacgggcatcccactcgggaagaac

SEQ ID NO: 395099 - DNA, 25 bp, Mus musculus
cgcttgctcgcccagaacacgtgga

SEQ ID NO: 395100 - DNA, 25 bp, Mus musculus
ctgcaagagccagcgagtgtcgcct

SEQ ID NO: 395101 - DNA, 25 bp, Mus musculus
ggagagctcacaacctgcaagagcc

SEQ ID NO: 395102 - DNA, 25 bp, Mus musculus
gtaccactctgccactcccgcgttc

SEQ ID NO: 395103 - DNA, 25 bp, Mus musculus
ccagaacacgtggacgggcatccca

SEQ ID NO: 395104 - DNA, 25 bp, Mus musculus
acaaagggcgccgtgaacaccgcgg

SEQ ID NO: 395105 - DNA, 25 bp, Mus musculus
tgtgagcaatgacggacgcctcccg

SEQ ID NO: 395106 - DNA, 25 bp, Mus musculus
tgcgggaaaagtcaccagcacgccc

SEQ ID NO: 395107 - DNA, 25 bp, Mus musculus
gaggctgaacacctacgcgggactg

SEQ ID NO: 395108 - DNA, 25 bp, Mus musculus
acgcgggactggaaggccaactcac

SEQ ID NO: 395109 - DNA, 25 bp, Mus musculus
acgacaccgcacaggaacctgcggg

SEQ ID NO: 395110 - DNA, 25 bp, Mus musculus
ccggctcccgatgggttatcttctc

SEQ ID NO: 395111 - DNA, 25 bp, Mus musculus
gagctaccgactgctccaacgaagc

SEQ ID NO: 395112 - DNA, 25 bp, Mus musculus
ccaaaggcccggagccctgcaaagg

SEQ ID NO: 395113 - DNA, 25 bp, Mus musculus
ggctcgagccctttgtcagccgctg

SEQ ID NO: 395114 - DNA, 25 bp, Mus musculus
gccgcgtctccacggaaggaggacc

SEQ ID NO: 395115 - DNA, 25 bp, Mus musculus
gcctttccttgggataagcccattg

SEQ ID NO: 395116 - DNA, 25 bp, Mus musculus
ggacgtaccattttggctcgccacc

SEQ ID NO: 395117 - DNA, 25 bp, Mus musculus
ccattgcgctttatttgctagggga

SEQ ID NO: 395118 - DNA, 25 bp, Mus musculus
caggagcaggatccttgggcagcaa

SEQ ID NO: 395119 - DNA, 25 bp, Mus musculus
gattcggacaaactctcctttcggc

SEQ ID NO: 395120 - DNA, 25 bp, Mus musculus
cagaaggcagcgtggagctgagagc

SEQ ID NO: 395121 - DNA, 25 bp, Mus musculus
cctggcggcgcagcgacctgctggg

SEQ ID NO: 395122 - DNA, 25 bp, Mus musculus
agagccgagcctgagcccagccgcc

SEQ ID NO: 395123 - DNA, 25 bp, Mus musculus
cggacaaactctcctttcggccttg

SEQ ID NO: 395124 - DNA, 25 bp, Mus musculus
caagtgagagcggagcagaaggcag

SEQ ID NO: 395125 - DNA, 25 bp, Mus musculus
tccttgggcagcaagtgagagcgga

SEQ ID NO: 395126 - DNA, 25 bp, Mus musculus
agcaggatccttgggcagcaagtga

SEQ ID NO: 395127 - DNA, 25 bp, Mus musculus
gattttagggcccacctcagagtcc

SEQ ID NO: 395128 - DNA, 25 bp, Mus musculus
aggatagggcgctcacacagtgccc

SEQ ID NO: 395129 - DNA, 25 bp, Mus musculus
gtggccaggatagggcgctcacaca

SEQ ID NO: 395130 - DNA, 25 bp, Mus musculus
gacaaactctcctttcggccttggc

SEQ ID NO: 395131 - DNA, 25 bp, Mus musculus
cccgcggctgtcactgccgcctccc

SEQ ID NO: 395132 - DNA, 25 bp, Mus musculus
cgcctctgcgtccaggcctagtagg

SEQ ID NO: 395133 - DNA, 25 bp, Mus musculus
gcaggacccggcatctgaacacttc

SEQ ID NO: 395134 - DNA, 25 bp, Mus musculus
cccagcaagcatcgcaaaaactaca

SEQ ID NO: 395135 - DNA, 25 bp, Mus musculus
tctgaacacttcacggggaccggcc

SEQ ID NO: 395136 - DNA, 25 bp, Mus musculus
gaggcgcagctttccaccaggagcc

SEQ ID NO: 395137 - DNA, 25 bp, Mus musculus
cgctggggtcaaaggtcagcgcctc

SEQ ID NO: 395138 - DNA, 25 bp, Mus musculus
acccagccggtagcgggcgatcgaa

SEQ ID NO: 395139 - DNA, 25 bp, Mus musculus
tgaagcgggttcagaccacgattcc

SEQ ID NO: 395140 - DNA, 25 bp, Mus musculus
acccgcagaggtcggccaggttcga

SEQ ID NO: 395141 - DNA, 25 bp, Mus musculus
actgctccggaatcacgggcgcgtt

SEQ ID NO: 395142 - DNA, 25 bp, Mus musculus
tcttcaggttctttcacgccctctt

SEQ ID NO: 395143 - DNA, 25 bp, Mus musculus
acgccctcttcctgaagcgggttca

SEQ ID NO: 395144 - DNA, 25 bp, Mus musculus
ttcagaccacgattcccagcaagca

SEQ ID NO: 395145 - DNA, 25 bp, Mus musculus
ccaggcctagtagggcggacccgca

SEQ ID NO: 395146 - DNA, 25 bp, Mus musculus
cagctgtgctgggacatcacctacc

SEQ ID NO: 395147 - DNA, 25 bp, Mus musculus
cttgcaggtgtttgccatgttcgca

SEQ ID NO: 395148 - DNA, 25 bp, Mus musculus
caaaaccactctgagcgcgcgtggg

SEQ ID NO: 395149 - DNA, 25 bp, Mus musculus
ccgtgctgggtaatagcagtgtgct

SEQ ID NO: 395150 - DNA, 25 bp, Mus musculus
cggctgaccgctacatcgccgtgtg

SEQ ID NO: 395151 - DNA, 25 bp, Mus musculus
atgttcgcatcttcctacatgctgg

SEQ ID NO: 395152 - DNA, 25 bp, Mus musculus
cttccaagtgttaccacagctgtgc

SEQ ID NO: 395153 - DNA, 25 bp, Mus musculus
aactccagcccgtggtggcctctga

SEQ ID NO: 395154 - DNA, 25 bp, Mus musculus
acagcatgagtttcccgcgaggctc

SEQ ID NO: 395155 - DNA, 25 bp, Mus musculus
cggctctgtgccgacagcatgagtt

SEQ ID NO: 395156 - DNA, 25 bp, Mus musculus
agcagcccacgaggaacagggttcc

SEQ ID NO: 395157 - DNA, 25 bp, Mus musculus
gtcttcgggtcctccgtggagaaga

SEQ ID NO: 395158 - DNA, 25 bp, Mus musculus
cgcagaacttaggacgcgggtcttc

SEQ ID NO: 395159 - DNA, 25 bp, Mus musculus
cctacatgctggtggtgatgacggc

SEQ ID NO: 395160 - DNA, 25 bp, Mus musculus
cagtcgcccgcaggctgttaacagc

SEQ ID NO: 395161 - DNA, 25 bp, Mus musculus
ctgcagcagagtcagtcgcccgcag

SEQ ID NO: 395162 - DNA, 25 bp, Mus musculus
gaactcctacggcagagacgcgcct

SEQ ID NO: 395163 - DNA, 25 bp, Mus musculus
gcagtgcctagactggcacagcata

SEQ ID NO: 395164 - DNA, 25 bp, Mus musculus
cacgctgtcagtcccgcgggcagtg

SEQ ID NO: 395165 - DNA, 25 bp, Mus musculus
aatacgcgcgcgcacgctgtcagtc

SEQ ID NO: 395166 - DNA, 25 bp, Mus musculus
atacgcagatacacaccaggcggcc

SEQ ID NO: 395167 - DNA, 25 bp, Mus musculus
ggcacaatgacagcatacgcagata

SEQ ID NO: 395168 - DNA, 25 bp, Mus musculus
tcgggaagggcacaatgacagcata

SEQ ID NO: 395169 - DNA, 25 bp, Mus musculus
tcacctggcggcgttctggggctct

SEQ ID NO: 395170 - DNA, 25 bp, Mus musculus
agcatacccaagaactcctacggca

SEQ ID NO: 395171 - DNA, 25 bp, Mus musculus
ttctggggctctctgtgtgctgctg

SEQ ID NO: 395172 - DNA, 25 bp, Mus musculus
ctagactggcacagcatacccaaga

SEQ ID NO: 395173 - DNA, 25 bp, Mus musculus
cccaacgttggaaggtctgcgcaga

SEQ ID NO: 395174 - DNA, 25 bp, Mus musculus
agtccagggcttggctcacctcatt

SEQ ID NO: 395175 - DNA, 25 bp, Mus musculus
tcacctcattcaccagggacggaag

SEQ ID NO: 395176 - DNA, 25 bp, Mus musculus
ggacggaagtgtcagccctgcactc

SEQ ID NO: 395177 - DNA, 25 bp, Mus musculus
cccgggtaccaggactagcagtccg

SEQ ID NO: 395178 - DNA, 25 bp, Mus musculus
atcaggccttggctagctcctgcgg

SEQ ID NO: 395179 - DNA, 25 bp, Mus musculus
cgtcatgaagcgtgcaggaactctg

SEQ ID NO: 395180 - DNA, 25 bp, Mus musculus
aactctgcgcctgctttcggatctg

SEQ ID NO: 395181 - DNA, 25 bp, Mus musculus
atctgagcaacttcaccggcgcggc

SEQ ID NO: 395182 - DNA, 25 bp, Mus musculus
cggccgccacttgctgctattaaga

SEQ ID NO: 395183 - DNA, 25 bp, Mus musculus
ggagtcgacgttcagtccagggctt

SEQ ID NO: 395184 - DNA, 25 bp, Mus musculus
gacccgcgctgatcttggtatggga

SEQ ID NO: 395185 - DNA, 25 bp, Mus musculus
atggagcctggatggaagctacttc

SEQ ID NO: 395186 - DNA, 25 bp, Mus musculus
ctacttcagagcactgagctgtgtc

SEQ ID NO: 395187 - DNA, 25 bp, Mus musculus
ctggacgtctttttcgtgccgtggc

SEQ ID NO: 395188 - DNA, 25 bp, Mus musculus
gctgggccgggctttattaatatgc

SEQ ID NO: 395189 - DNA, 25 bp, Mus musculus
cgcggagcagacaggaaggaagcca

SEQ ID NO: 395190 - DNA, 25 bp, Mus musculus
cggcatgcgtgtgacgcagctctta

SEQ ID NO: 395191 - DNA, 25 bp, Mus musculus
gtgtgacgcagctcttaaaaaacga

SEQ ID NO: 395192 - DNA, 25 bp, Mus musculus
gaggcgaagcctcacgctcggcgtc

SEQ ID NO: 395193 - DNA, 25 bp, Mus musculus
tcttaaaaaacgagacggaggcaga

SEQ ID NO: 395194 - DNA, 25 bp, Mus musculus
gccgggctttattaatatgctaatt

SEQ ID NO: 395195 - DNA, 25 bp, Mus musculus
ggcccagccgagtcacgatgcccgc

SEQ ID NO: 395196 - DNA, 25 bp, Mus musculus
tcgcgcgtcctctccctctcgcaag

SEQ ID NO: 395197 - DNA, 25 bp, Mus musculus
aaggcgagctgcctctgcgtgtgta

SEQ ID NO: 395198 - DNA, 25 bp, Mus musculus
gtgtgcgtgtctgtgcgctcccgcc

SEQ ID NO: 395199 - DNA, 25 bp, Mus musculus
agctgcctctgcgtgtgtacgcgcg

SEQ ID NO: 395200 - DNA, 25 bp, Mus musculus
ccgtgtcaaagtgacccgggcgagc

SEQ ID NO: 395201 - DNA, 25 bp, Mus musculus
atatgctaattgtcctggtagtggg

SEQ ID NO: 395202 - DNA, 25 bp, Mus musculus
gatgccggaggagcttcaccagctt

SEQ ID NO: 395203 - DNA, 25 bp, Mus musculus
gatttcccgggagaacttgtctgcc

SEQ ID NO: 395204 - DNA, 25 bp, Mus musculus
gcgagtcgaagccaagcgccgtatg

SEQ ID NO: 395205 - DNA, 25 bp, Mus musculus
cggtgacacgtggacgccacaggaa

SEQ ID NO: 395206 - DNA, 25 bp, Mus musculus
cacaggaaagggaggaagcacttgc

SEQ ID NO: 395207 - DNA, 25 bp, Mus musculus
aagcacttgcgtgccgatgctgcgg

SEQ ID NO: 395208 - DNA, 25 bp, Mus musculus
tagggctgaaaagaccgaagttgtc

SEQ ID NO: 395209 - DNA, 25 bp, Mus musculus
cgattcctgggcacgccagagggac

SEQ ID NO: 395210 - DNA, 25 bp, Mus musculus
aagacttcttcctaaggatgccgga

SEQ ID NO: 395211 - DNA, 25 bp, Mus musculus
cgtagttcctttttcggagcacgtg

SEQ ID NO: 395212 - DNA, 25 bp, Mus musculus
cttcaccagcttggcgccgtagttc

SEQ ID NO: 395213 - DNA, 25 bp, Mus musculus
gtcccaggctgtcgggcatctagta

SEQ ID NO: 395214 - DNA, 25 bp, Mus musculus
aactgggtgtgtctcagccgctccc

SEQ ID NO: 395215 - DNA, 25 bp, Mus musculus
ggcatctagtatccgcgccggagtt

SEQ ID NO: 395216 - DNA, 25 bp, Mus musculus
caggagcgtggcatctgacgtagaa

SEQ ID NO: 395217 - DNA, 25 bp, Mus musculus
tttgcaaaagcgaccggcgctgtga

SEQ ID NO: 395218 - DNA, 25 bp, Mus musculus
tttctgcgggatagccaactctcgg

SEQ ID NO: 395219 - DNA, 25 bp, Mus musculus
cccttgtgctcagatttctgcggga

SEQ ID NO: 395220 - DNA, 25 bp, Mus musculus
agtgacgcgttttacccggagcatg

SEQ ID NO: 395221 - DNA, 25 bp, Mus musculus
ctagatttagtctgggtctctcctc

SEQ ID NO: 395222 - DNA, 25 bp, Mus musculus
ggtacgcgacctcgtgtgcgccact

SEQ ID NO: 395223 - DNA, 25 bp, Mus musculus
gtgtgcgccactcttttccgctgcg

SEQ ID NO: 395224 - DNA, 25 bp, Mus musculus
cgcgcgacttgatgacgacactgga

SEQ ID NO: 395225 - DNA, 25 bp, Mus musculus
ttgatgacgacactggacccgccct

SEQ ID NO: 395226 - DNA, 25 bp, Mus musculus
gcgctgtgagtccttggtttggtct

SEQ ID NO: 395227 - DNA, 25 bp, Mus musculus
ctttggtgttcttaagtcgtgccgc

SEQ ID NO: 395228 - DNA, 25 bp, Mus musculus
ctcgacccgggctgtgctttggtgt

SEQ ID NO: 395229 - DNA, 25 bp, Mus musculus
ggaccggaagcaacttctagattta

SEQ ID NO: 395230 - DNA, 25 bp, Mus musculus
ccgagggcaccatagaagcggcgat

SEQ ID NO: 395231 - DNA, 25 bp, Mus musculus
ccgcagagtcaccagctacttggga

SEQ ID NO: 395232 - DNA, 25 bp, Mus musculus
aaagaggcgtgctgcttggctttga

SEQ ID NO: 395233 - DNA, 25 bp, Mus musculus
ccctgcaaggctccgggacctggta

SEQ ID NO: 395234 - DNA, 25 bp, Mus musculus
atacaggctgtgaagccagaggccc

SEQ ID NO: 395235 - DNA, 25 bp, Mus musculus
cccacgttgaccgagttgaaggcga

SEQ ID NO: 395236 - DNA, 25 bp, Mus musculus
ttgccgtacgagtagcccgggtaca

SEQ ID NO: 395237 - DNA, 25 bp, Mus musculus
gtcccagccgaggaatcgagtgatg

SEQ ID NO: 395238 - DNA, 25 bp, Mus musculus
gggctgcgaagccacctttgcacag

SEQ ID NO: 395239 - DNA, 25 bp, Mus musculus
ctgcgggtatccgagaaaggctgtc

SEQ ID NO: 395240 - DNA, 25 bp, Mus musculus
tgggccacccacagtaggatcgagc

SEQ ID NO: 395241 - DNA, 25 bp, Mus musculus
acagctcgggatcaaagagagatga

SEQ ID NO: 395242 - DNA, 25 bp, Mus musculus
cacctcctcgtagggtggcaccagg

SEQ ID NO: 395243 - DNA, 25 bp, Mus musculus
ccgcaggctagccaggctcgagtta

SEQ ID NO: 395244 - DNA, 25 bp, Mus musculus
atctgacccagtagcgactctcgca

SEQ ID NO: 395245 - DNA, 25 bp, Mus musculus
cagcggccatctgacccagtagcga

SEQ ID NO: 395246 - DNA, 25 bp, Mus musculus
gggccctgtagctcgcagcggccat

SEQ ID NO: 395247 - DNA, 25 bp, Mus musculus
ttgtgctggcagcttgggccctgta

SEQ ID NO: 395248 - DNA, 25 bp, Mus musculus
tccgaggaggctccagatctggacc

SEQ ID NO: 395249 - DNA, 25 bp, Mus musculus
cacgtgccgctgacattctgtccga

SEQ ID NO: 395250 - DNA, 25 bp, Mus musculus
tcaccactgctggacacatcgtctg

SEQ ID NO: 395251 - DNA, 25 bp, Mus musculus
ggacatgccagtcggccagggacat

SEQ ID NO: 395252 - DNA, 25 bp, Mus musculus
tagcgactctcgcaacagggctcca

SEQ ID NO: 395253 - DNA, 25 bp, Mus musculus
acagacctgccagtcgtgtcgcgtt

SEQ ID NO: 395254 - DNA, 25 bp, Mus musculus
ccatggcacataacgcagctgggca

SEQ ID NO: 395255 - DNA, 25 bp, Mus musculus
ctgccggataggtggacatgccagt

SEQ ID NO: 395256 - DNA, 25 bp, Mus musculus
agggacattccgttcaccactgctg

SEQ ID NO: 395257 - DNA, 25 bp, Mus musculus
attctgtccgattccgaggaggctc

SEQ ID NO: 395258 - DNA, 25 bp, Mus musculus
tctcgggttcggcaaagctagcaaa

SEQ ID NO: 395259 - DNA, 25 bp, Mus musculus
ttgctcctccctttccagctgtgaa

SEQ ID NO: 395260 - DNA, 25 bp, Mus musculus
tttccagctgtgaacctttaggccc

SEQ ID NO: 395261 - DNA, 25 bp, Mus musculus
tcactttatggcaacccagggcgcc

SEQ ID NO: 395262 - DNA, 25 bp, Mus musculus
gtcgggtctcagctcccacactttg

SEQ ID NO: 395263 - DNA, 25 bp, Mus musculus
gccggcgcccattcactttatggca

SEQ ID NO: 395264 - DNA, 25 bp, Mus musculus
tgccgctcgtttcgccgattttctc

SEQ ID NO: 395265 - DNA, 25 bp, Mus musculus
tgagtctcacagtgcagtgccaccc

SEQ ID NO: 395266 - DNA, 25 bp, Mus musculus
accgtcaggcgggacagagaacccg

SEQ ID NO: 395267 - DNA, 25 bp, Mus musculus
cccggagtcacgagaagcagtgccg

SEQ ID NO: 395268 - DNA, 25 bp, Mus musculus
agctagcaaaagtacggtggtccgt

SEQ ID NO: 395269 - DNA, 25 bp, Mus musculus
gtccagcccgaactgtggctaattg

SEQ ID NO: 395270 - DNA, 25 bp, Mus musculus
agaagcgtttgccatccactgagca

SEQ ID NO: 395271 - DNA, 25 bp, Mus musculus
gctaattgaggccttgggctctccc

SEQ ID NO: 395272 - DNA, 25 bp, Mus musculus
gggcctcctgacgttgccatcaaga

SEQ ID NO: 395273 - DNA, 25 bp, Mus musculus
tcagcgaagtctcttcttagagttc

SEQ ID NO: 395274 - DNA, 25 bp, Mus musculus
gccaggctggacatgagctgcggct

SEQ ID NO: 395275 - DNA, 25 bp, Mus musculus
caggtcagcgaagtctcttcttaga

SEQ ID NO: 395276 - DNA, 25 bp, Mus musculus
gctgacaggtcagcgaagtctcttc

SEQ ID NO: 395277 - DNA, 25 bp, Mus musculus
attttggatccgctgacaggtcagc

SEQ ID NO: 395278 - DNA, 25 bp, Mus musculus
ctgacgttgccatcaagaataagga

SEQ ID NO: 395279 - DNA, 25 bp, Mus musculus
tgccgccggttctgggactaggccc

SEQ ID NO: 395280 - DNA, 25 bp, Mus musculus
ccatcaagaataaggaggaagggtc

SEQ ID NO: 395281 - DNA, 25 bp, Mus musculus
ctcttcttagagttccagcgtcgtg

SEQ ID NO: 395282 - DNA, 25 bp, Mus musculus
tcttagagttccagcgtcgtgaggg

SEQ ID NO: 395283 - DNA, 25 bp, Mus musculus
tccagcgtcgtgagggcctcctgac

SEQ ID NO: 395284 - DNA, 25 bp, Mus musculus
cctcctgacgttgccatcaagaata

SEQ ID NO: 395285 - DNA, 25 bp, Mus musculus
gccattttggatccgctgacaggtc

SEQ ID NO: 395286 - DNA, 25 bp, Mus musculus
ccgggttcagatccctgagtgtcta

SEQ ID NO: 395287 - DNA, 25 bp, Mus musculus
gtgtcctccacgctggctgaaaatc

SEQ ID NO: 395288 - DNA, 25 bp, Mus musculus
gagcgcgcacaggaacaggacactt

SEQ ID NO: 395289 - DNA, 25 bp, Mus musculus
tgcctgcccttagcttgcctgtgca

SEQ ID NO: 395290 - DNA, 25 bp, Mus musculus
tgggcagtacaaggactcacctgtg

SEQ ID NO: 395291 - DNA, 25 bp, Mus musculus
acctgtgtggatgaacgttcacttg

SEQ ID NO: 395292 - DNA, 25 bp, Mus musculus
cgttcacttgcacgtgccatgatgc

SEQ ID NO: 395293 - DNA, 25 bp, Mus musculus
ctcacccggcacacaagacattagg

SEQ ID NO: 395294 - DNA, 25 bp, Mus musculus
ttagggctgaaacgcatattcctgc

SEQ ID NO: 395295 - DNA, 25 bp, Mus musculus
catgcgcgttacactggctttggga

SEQ ID NO: 395296 - DNA, 25 bp, Mus musculus
ccgggaagctaagacggaatcgcta

SEQ ID NO: 395297 - DNA, 25 bp, Mus musculus
accctgaggcccgaatcatattctc

SEQ ID NO: 395298 - DNA, 25 bp, Mus musculus
ttgctacacatcagcgacacgtctg

SEQ ID NO: 395299 - DNA, 25 bp, Mus musculus
ctgggtgaatcagccgtgtcctcca

SEQ ID NO: 395300 - DNA, 25 bp, Mus musculus
cggagctcgtgcagcctgatcatca

SEQ ID NO: 395301 - DNA, 25 bp, Mus musculus
ggccaatttcatgggcggcatcatg

SEQ ID NO: 395302 - DNA, 25 bp, Mus musculus
gcgtcttcctcctgaggtcacgatc

SEQ ID NO: 395303 - DNA, 25 bp, Mus musculus
acgcagagtgagtgcaccggcaccc

SEQ ID NO: 395304 - DNA, 25 bp, Mus musculus
ggagtgcagcgcagaccacatcgcc

SEQ ID NO: 395305 - DNA, 25 bp, Mus musculus
agttcctcgggctgtctcaggatga

SEQ ID NO: 395306 - DNA, 25 bp, Mus musculus
atctgccgtggccaatttcatgggc

SEQ ID NO: 395307 - DNA, 25 bp, Mus musculus
gctcactcgagtgaaatctgccgtg

SEQ ID NO: 395308 - DNA, 25 bp, Mus musculus
cggcgccggagtaatatgctcactc

SEQ ID NO: 395309 - DNA, 25 bp, Mus musculus
ccatgtcgcccggttgcggaagtgt

SEQ ID NO: 395310 - DNA, 25 bp, Mus musculus
atcatcacatgactccacggccgta

SEQ ID NO: 395311 - DNA, 25 bp, Mus musculus
tcctgaggtcacgatctcggagcta

SEQ ID NO: 395312 - DNA, 25 bp, Mus musculus
tccgctcggcgcaagcaggaaccag

SEQ ID NO: 395313 - DNA, 25 bp, Mus musculus
atctcggagctagctgtgctcggcc

SEQ ID NO: 395314 - DNA, 25 bp, Mus musculus
ctggactacggcgtcaccgcagacg

SEQ ID NO: 395315 - DNA, 25 bp, Mus musculus
cggagacacgtaagcaaccagagga

SEQ ID NO: 395316 - DNA, 25 bp, Mus musculus
agcgccacctgctgatggcacagga

SEQ ID NO: 395317 - DNA, 25 bp, Mus musculus
taagcaaccagaggacgggcttccg

SEQ ID NO: 395318 - DNA, 25 bp, Mus musculus
cagatggccggttctagacgggaca

SEQ ID NO: 395319 - DNA, 25 bp, Mus musculus
ttctagacgggacaccgatgctggc

SEQ ID NO: 395320 - DNA, 25 bp, Mus musculus
acaggcccttgacacactgcagcga

SEQ ID NO: 395321 - DNA, 25 bp, Mus musculus
ttgacacactgcagcgaggtacatc

SEQ ID NO: 395322 - DNA, 25 bp, Mus musculus
cgaggtacatctcaggaacgctggg

SEQ ID NO: 395323 - DNA, 25 bp, Mus musculus
aagctggggatctggcccgcaccca

SEQ ID NO: 395324 - DNA, 25 bp, Mus musculus
tcgcgagtacaacgcgcgcctgttc

SEQ ID NO: 395325 - DNA, 25 bp, Mus musculus
cgcctgttcggtctggcgcagcgca

SEQ ID NO: 395326 - DNA, 25 bp, Mus musculus
cgagcgttgctggactacggcgtca

SEQ ID NO: 395327 - DNA, 25 bp, Mus musculus
tggcacaggacgagaacggagacac

SEQ ID NO: 395328 - DNA, 25 bp, Mus musculus
tccgaggcgagctaagattaaaatc

SEQ ID NO: 395329 - DNA, 25 bp, Mus musculus
catcgtgcgagcaggccaagctatt

SEQ ID NO: 395330 - DNA, 25 bp, Mus musculus
ctaggtcccatcttgggtcaggtgc

SEQ ID NO: 395331 - DNA, 25 bp, Mus musculus
actcggaccctcaagaagcccgagg

SEQ ID NO: 395332 - DNA, 25 bp, Mus musculus
tgtccaagctaagccgggccactcg

SEQ ID NO: 395333 - DNA, 25 bp, Mus musculus
cgtgatccggtccatcgtgcgagca

SEQ ID NO: 395334 - DNA, 25 bp, Mus musculus
ggcgagctaagattaaaatcctaca

SEQ ID NO: 395335 - DNA, 25 bp, Mus musculus
cgcgcccagagcgtagttctttgct

SEQ ID NO: 395336 - DNA, 25 bp, Mus musculus
gtagttctttgcttctccgaggcga

SEQ ID NO: 395337 - DNA, 25 bp, Mus musculus
gggcctccactaggtcccatcttgg

SEQ ID NO: 395338 - DNA, 25 bp, Mus musculus
caagctattcctgggcctccactag

SEQ ID NO: 395339 - DNA, 25 bp, Mus musculus
tgcgagcaggccaagctattcctgg

SEQ ID NO: 395340 - DNA, 25 bp, Mus musculus
tcccatcttgggtcaggtgcggtgt

SEQ ID NO: 395341 - DNA, 25 bp, Mus musculus
tacatcatgtccaagctaagccggg

SEQ ID NO: 395342 - DNA, 25 bp, Mus musculus
cgtagcatagggtctccgcgccgcg

SEQ ID NO: 395343 - DNA, 25 bp, Mus musculus
tcccaccgacgcaccgagcgctcgg

SEQ ID NO: 395344 - DNA, 25 bp, Mus musculus
gccagccgtagcatagggtctccgc

SEQ ID NO: 395345 - DNA, 25 bp, Mus musculus
gacagccagcgcgagcgcttggccc

SEQ ID NO: 395346 - DNA, 25 bp, Mus musculus
tgttgacgccgatcatgctggcccg

SEQ ID NO: 395347 - DNA, 25 bp, Mus musculus
tgtggatgctgttgacgccgatcat

SEQ ID NO: 395348 - DNA, 25 bp, Mus musculus
gcccgtagcgcacggagcagagcga

SEQ ID NO: 395349 - DNA, 25 bp, Mus musculus
gagcgctgcggccagccgtagcata

SEQ ID NO: 395350 - DNA, 25 bp, Mus musculus
agagcacgggcttgagactgcgcga

SEQ ID NO: 395351 - DNA, 25 bp, Mus musculus
accaccaggtcggtgtagagcacgg

SEQ ID NO: 395352 - DNA, 25 bp, Mus musculus
ctctgcaggcggctgaccaccaggt

SEQ ID NO: 395353 - DNA, 25 bp, Mus musculus
ttcttcttgcggctctgcaggcggc

SEQ ID NO: 395354 - DNA, 25 bp, Mus musculus
gcctttttcttcttgcggctctgca

SEQ ID NO: 395355 - DNA, 25 bp, Mus musculus
agagcgagcgcgaacgcagccgccc

SEQ ID NO: 395356 - DNA, 25 bp, Mus musculus
ccctcgctcactgtgactgggtgga

SEQ ID NO: 395357 - DNA, 25 bp, Mus musculus
cttcaaggccaaagcgagtggagct

SEQ ID NO: 395358 - DNA, 25 bp, Mus musculus
gtagacagcgatggagccaccaatg

SEQ ID NO: 395359 - DNA, 25 bp, Mus musculus
accaggagctgtcaggtaccgagca

SEQ ID NO: 395360 - DNA, 25 bp, Mus musculus
agccgggactctcgggtataacaga

SEQ ID NO: 395361 - DNA, 25 bp, Mus musculus
ggtataacagaaggactcgcacgta

SEQ ID NO: 395362 - DNA, 25 bp, Mus musculus
ctgggaagacgtgctgctcccgcac

SEQ ID NO: 395363 - DNA, 25 bp, Mus musculus
gcgctcgttcagctgcacttggcga

SEQ ID NO: 395364 - DNA, 25 bp, Mus musculus
aagtcccgaagttaggcggctgcca

SEQ ID NO: 395365 - DNA, 25 bp, Mus musculus
agacttgagtctccgtgtctcccgc

SEQ ID NO: 395366 - DNA, 25 bp, Mus musculus
cccgtaggtgggtccacagattcca

SEQ ID NO: 395367 - DNA, 25 bp, Mus musculus
ccacagattccacgggcggcactag

SEQ ID NO: 395368 - DNA, 25 bp, Mus musculus
tggctccgtgtcacgaatggctgtc

SEQ ID NO: 395369 - DNA, 25 bp, Mus musculus
acggaatccacagctccggagcgta

SEQ ID NO: 395370 - DNA, 25 bp, Mus musculus
ttgagaagggcgctttgcccataca

SEQ ID NO: 395371 - DNA, 25 bp, Mus musculus
cgccgtggtggccatttttgagaag

SEQ ID NO: 395372 - DNA, 25 bp, Mus musculus
cgagctagacgttcctccatagagg

SEQ ID NO: 395373 - DNA, 25 bp, Mus musculus
cagagcagttcccttctggaggacg

SEQ ID NO: 395374 - DNA, 25 bp, Mus musculus
tttgcccatacaagggcggggcttc

SEQ ID NO: 395375 - DNA, 25 bp, Mus musculus
gcggggcttctttcctcattttcaa

SEQ ID NO: 395376 - DNA, 25 bp, Mus musculus
tcccgcgcggtgcagttcttatcac

SEQ ID NO: 395377 - DNA, 25 bp, Mus musculus
tccttgcgttttggatcggctcctc

SEQ ID NO: 395378 - DNA, 25 bp, Mus musculus
tctgcgactctcctaaggccggagg

SEQ ID NO: 395379 - DNA, 25 bp, Mus musculus
gggtaccctatgtcaatgctctctg

SEQ ID NO: 395380 - DNA, 25 bp, Mus musculus
tagagaaaggggtccagccgacacc

SEQ ID NO: 395381 - DNA, 25 bp, Mus musculus
tcacatgacgagacaggcctgaacg

SEQ ID NO: 395382 - DNA, 25 bp, Mus musculus
aggggaaatcacctgctccgtcagg

SEQ ID NO: 395383 - DNA, 25 bp, Mus musculus
ccaacgagatcaaaggcggggccca

SEQ ID NO: 395384 - DNA, 25 bp, Mus musculus
catcttggtccttgctttttcttga

SEQ ID NO: 395385 - DNA, 25 bp, Mus musculus
cgcgcctgcaccatggaagcagtgg

SEQ ID NO: 395386 - DNA, 25 bp, Mus musculus
aggtgccgtagacgcgccgcaagtc

SEQ ID NO: 395387 - DNA, 25 bp, Mus musculus
cggcacagcccgcaccaagaactgg

SEQ ID NO: 395388 - DNA, 25 bp, Mus musculus
ttgtattcgggctcgcccacacgcg

SEQ ID NO: 395389 - DNA, 25 bp, Mus musculus
ccgggccaccttgtattcgggctcg

SEQ ID NO: 395390 - DNA, 25 bp, Mus musculus
ttgcgcattacgtgccgggccacct

SEQ ID NO: 395391 - DNA, 25 bp, Mus musculus
ccactggctggcttgcgcattacgt

SEQ ID NO: 395392 - DNA, 25 bp, Mus musculus
gctttttcttgaggcggccacgctg

SEQ ID NO: 395393 - DNA, 25 bp, Mus musculus
accatggaagcagtggagttctcgc

SEQ ID NO: 395394 - DNA, 25 bp, Mus musculus
ggatcgacagactcgcaggcgcgct

SEQ ID NO: 395395 - DNA, 25 bp, Mus musculus
gcaggcgcgctgagatgctcatctt

SEQ ID NO: 395396 - DNA, 25 bp, Mus musculus
gagatgctcatcttggtccttgctt

SEQ ID NO: 395397 - DNA, 25 bp, Mus musculus
catcgtcgccactggctggcttgcg

SEQ ID NO: 395398 - DNA, 25 bp, Mus musculus
tctgccaggattgcggtgagctgct

SEQ ID NO: 395399 - DNA, 25 bp, Mus musculus
atacaaaggaccagcccgagggtgg

SEQ ID NO: 395400 - DNA, 25 bp, Mus musculus
atgcgttgcgctgtttgagtcattg

SEQ ID NO: 395401 - DNA, 25 bp, Mus musculus
ttgcgctgtttgagtcattgggaca

SEQ ID NO: 395402 - DNA, 25 bp, Mus musculus
ttgagtcattgggacactttgcgcg

SEQ ID NO: 395403 - DNA, 25 bp, Mus musculus
cccggggctgatctgatacaaagga

SEQ ID NO: 395404 - DNA, 25 bp, Mus musculus
tgagctgctggcccacggcccagga

SEQ ID NO: 395405 - DNA, 25 bp, Mus musculus
ggtcacctgcccgagctgctatcgg

SEQ ID NO: 395406 - DNA, 25 bp, Mus musculus
cggaattaggcatcgtctgccagga

SEQ ID NO: 395407 - DNA, 25 bp, Mus musculus
tgccgcggaattaggcatcgtctgc

SEQ ID NO: 395408 - DNA, 25 bp, Mus musculus
caggcgcactggctggcacctggct

SEQ ID NO: 395409 - DNA, 25 bp, Mus musculus
ggaagcccaaggctgctagcgcgca

SEQ ID NO: 395410 - DNA, 25 bp, Mus musculus
cccgagctgctatcgggagagccgt

SEQ ID NO: 395411 - DNA, 25 bp, Mus musculus
gcatcgtctgccaggattgcggtga

SEQ ID NO: 395412 - DNA, 25 bp, Mus musculus
acaggccgagccagtgacaaagagc

SEQ ID NO: 395413 - DNA, 25 bp, Mus musculus
ccttacagaagggaaacactatggc

SEQ ID NO: 395414 - DNA, 25 bp, Mus musculus
gagttgccgagccaatccctacagc

SEQ ID NO: 395415 - DNA, 25 bp, Mus musculus
ggccgccctgccttcaaactatgga

SEQ ID NO: 395416 - DNA, 25 bp, Mus musculus
ggcctaggctgaaaccgcggaaaca

SEQ ID NO: 395417 - DNA, 25 bp, Mus musculus
gatgctactcacgttgtcgatcaca

SEQ ID NO: 395418 - DNA, 25 bp, Mus musculus
cacaacaggctggttggcgatcaca

SEQ ID NO: 395419 - DNA, 25 bp, Mus musculus
atgcgcagtctagtcgccggtactg

SEQ ID NO: 395420 - DNA, 25 bp, Mus musculus
ggactccatggcagaggaatctttc

SEQ ID NO: 395421 - DNA, 25 bp, Mus musculus
gggctacagctctttcctttgtcta

SEQ ID NO: 395422 - DNA, 25 bp, Mus musculus
tgctgttctaatccggcaaggccca

SEQ ID NO: 395423 - DNA, 25 bp, Mus musculus
ccaatgactgcggagtgctgttcta

SEQ ID NO: 395424 - DNA, 25 bp, Mus musculus
ggcgatcacatcgtaggactccatg

SEQ ID NO: 395425 - DNA, 25 bp, Mus musculus
attacacggatgttggctggccgcc

SEQ ID NO: 395426 - DNA, 25 bp, Mus musculus
ccgacgtcttgaaggctccggcttg

SEQ ID NO: 395427 - DNA, 25 bp, Mus musculus
cccaatggcggagctgcggcctagc

SEQ ID NO: 395428 - DNA, 25 bp, Mus musculus
tccgctggcccataggggcgctttc

SEQ ID NO: 395429 - DNA, 25 bp, Mus musculus
tctcatccacagtgggtccgctggc

SEQ ID NO: 395430 - DNA, 25 bp, Mus musculus
atcgcctcggggagtctcatccaca

SEQ ID NO: 395431 - DNA, 25 bp, Mus musculus
cgcaggcgcggagttagacctcgcc

SEQ ID NO: 395432 - DNA, 25 bp, Mus musculus
acagcatcctctggccgacgtcttg

SEQ ID NO: 395433 - DNA, 25 bp, Mus musculus
cgctccaggttaccgctatcgtcaa

SEQ ID NO: 395434 - DNA, 25 bp, Mus musculus
gcggagttagacctcgccgtagccc

SEQ ID NO: 395435 - DNA, 25 bp, Mus musculus
ctgaccagccgaacccgctccaggt

SEQ ID NO: 395436 - DNA, 25 bp, Mus musculus
ccgctatcgtcaagtactggtatgc

SEQ ID NO: 395437 - DNA, 25 bp, Mus musculus
caagtactggtatgctctgggcctc

SEQ ID NO: 395438 - DNA, 25 bp, Mus musculus
gggactgcacgccatctacggagag

SEQ ID NO: 395439 - DNA, 25 bp, Mus musculus
cgccatctacggagagtgtcgccgc

SEQ ID NO: 395440 - DNA, 25 bp, Mus musculus
tcttctatcgcccttatccgggagc

SEQ ID NO: 395441 - DNA, 25 bp, Mus musculus
aacccattgtatgcggggcagctgc

SEQ ID NO: 395442 - DNA, 25 bp, Mus musculus
agaggcccttcctcgctgcgctggt

SEQ ID NO: 395443 - DNA, 25 bp, Mus musculus
tgtcccttcttagagggaagaaagc

SEQ ID NO: 395444 - DNA, 25 bp, Mus musculus
cccggcccgctgatcatttttatta

SEQ ID NO: 395445 - DNA, 25 bp, Mus musculus
gccagagacgcagctatttctatta

SEQ ID NO: 395446 - DNA, 25 bp, Mus musculus
tacacgcaagatggctgaaggtggc

SEQ ID NO: 395447 - DNA, 25 bp, Mus musculus
gaccagccttgatgtagggacaccc

SEQ ID NO: 395448 - DNA, 25 bp, Mus musculus
ataaagctctgaagcgacagccgca

SEQ ID NO: 395449 - DNA, 25 bp, Mus musculus
ccagcgggtgctgattaaaggcgcc

SEQ ID NO: 395450 - DNA, 25 bp, Mus musculus
taaaggcgccgcctgccgatttctc

SEQ ID NO: 395451 - DNA, 25 bp, Mus musculus
cctttccgagtagcgggaccagcct

SEQ ID NO: 395452 - DNA, 25 bp, Mus musculus
gaggacaaacggacccacggacaga

SEQ ID NO: 395453 - DNA, 25 bp, Mus musculus
tcttcactctgcttcgaacccattg

SEQ ID NO: 395454 - DNA, 25 bp, Mus musculus
catggcagccttctccgcgggtttt

SEQ ID NO: 395455 - DNA, 25 bp, Mus musculus
actatcactgggtacggcacgagca

SEQ ID NO: 395456 - DNA, 25 bp, Mus musculus
cttggaatcgttcacatggggaatg

SEQ ID NO: 395457 - DNA, 25 bp, Mus musculus
cggagcgctcggaacgaagctctcc

SEQ ID NO: 395458 - DNA, 25 bp, Mus musculus
cgagtcggctgacttggaagagccc

SEQ ID NO: 395459 - DNA, 25 bp, Mus musculus
cccacggtcaggtcgatgacgccgt

SEQ ID NO: 395460 - DNA, 25 bp, Mus musculus
tgcagcgcacggtgtatcacgttgt

SEQ ID NO: 395461 - DNA, 25 bp, Mus musculus
ctccgccttgacgtgagcgtgcagc

SEQ ID NO: 395462 - DNA, 25 bp, Mus musculus
gggtgccgttcacgatgacgttgca

SEQ ID NO: 395463 - DNA, 25 bp, Mus musculus
ctcctcggacgacagtagctttttg

SEQ ID NO: 395464 - DNA, 25 bp, Mus musculus
gttgttctccttgaccgactccagc

SEQ ID NO: 395465 - DNA, 25 bp, Mus musculus
tggcagttggaagcgcagttgttct

SEQ ID NO: 395466 - DNA, 25 bp, Mus musculus
tcacgcagccggtcttgggcagcat

SEQ ID NO: 395467 - DNA, 25 bp, Mus musculus
catccgcagagcataggcgtggtcc

SEQ ID NO: 395468 - DNA, 25 bp, Mus musculus
tcgcggggccattgatgtagctcgc

SEQ ID NO: 395469 - DNA, 25 bp, Mus musculus
cctggagagcgctttcaaggaaatg

SEQ ID NO: 395470 - DNA, 25 bp, Mus musculus
atcccgcacgagtgtctggtcatcg

SEQ ID NO: 395471 - DNA, 25 bp, Mus musculus
tgagaagaagatcccgcacgagtgt

SEQ ID NO: 395472 - DNA, 25 bp, Mus musculus
ttcactgagaagaagatcccgcacg

SEQ ID NO: 395473 - DNA, 25 bp, Mus musculus
cccacgcgcttcttcactgagaaga

SEQ ID NO: 395474 - DNA, 25 bp, Mus musculus
accacatcacgcaacagctgcagga

SEQ ID NO: 395475 - DNA, 25 bp, Mus musculus
acgagtgtctggtcatcggggccct

SEQ ID NO: 395476 - DNA, 25 bp, Mus musculus
ccgtggtggcatcgcgcctgctgca

SEQ ID NO: 395477 - DNA, 25 bp, Mus musculus
cacggcaggaccctaacccgcgcgg

SEQ ID NO: 395478 - DNA, 25 bp, Mus musculus
cagctgcaggacatcgtggagatcc

SEQ ID NO: 395479 - DNA, 25 bp, Mus musculus
caggacatcgtggagatcctgaaga

SEQ ID NO: 395480 - DNA, 25 bp, Mus musculus
tcctgaagaactcggccatccttcc

SEQ ID NO: 395481 - DNA, 25 bp, Mus musculus
gagagcacgccagcccacggcagga

SEQ ID NO: 395482 - DNA, 25 bp, Mus musculus
actgcactgcgtgttctgtcgccgc

SEQ ID NO: 395483 - DNA, 25 bp, Mus musculus
tgctgctactacagcggcgcgcatc

SEQ ID NO: 395484 - DNA, 25 bp, Mus musculus
acctgaagctcaccaacatcgtgga

SEQ ID NO: 395485 - DNA, 25 bp, Mus musculus
cggaggcggcctgttatatggaatt

SEQ ID NO: 395486 - DNA, 25 bp, Mus musculus
acactcggtgtgtgacgtggagata

SEQ ID NO: 395487 - DNA, 25 bp, Mus musculus
ctgtgtgccagtactgctgctacta

SEQ ID NO: 395488 - DNA, 25 bp, Mus musculus
ttcaacgccctgcacgtggagaagc

SEQ ID NO: 395489 - DNA, 25 bp, Mus musculus
ccggagtgcaaccaggcctacaatc

SEQ ID NO: 395490 - DNA, 25 bp, Mus musculus
caaacataacttctgccggggctgc

SEQ ID NO: 395491 - DNA, 25 bp, Mus musculus
cggtgcagctgccatgcaaacataa

SEQ ID NO: 395492 - DNA, 25 bp, Mus musculus
cacgttttcgtggaaccggtgcagc

SEQ ID NO: 395493 - DNA, 25 bp, Mus musculus
actgctttgaggaggagctcatctg

SEQ ID NO: 395494 - DNA, 25 bp, Mus musculus
atggaatttggaccacagcgctctc

SEQ ID NO: 395495 - DNA, 25 bp, Mus musculus
tacgggcaagtacactgaacgcgtg

SEQ ID NO: 395496 - DNA, 25 bp, Mus musculus
ggggttctgctcctctctacccaaa

SEQ ID NO: 395497 - DNA, 25 bp, Mus musculus
tgcgtgctggacttgcatctgcaga

SEQ ID NO: 395498 - DNA, 25 bp, Mus musculus
tggttctgctctgttgcggctgcca

SEQ ID NO: 395499 - DNA, 25 bp, Mus musculus
cctccgaagggagcgtggttctgct

SEQ ID NO: 395500 - DNA, 25 bp, Mus musculus
gcagccaaatgcacagctactccta

SEQ ID NO: 395501 - DNA, 25 bp, Mus musculus
ccaggtaagagttcgcaagtgcagc

SEQ ID NO: 395502 - DNA, 25 bp, Mus musculus
ggtgcatccctctgggaccaggtaa

SEQ ID NO: 395503 - DNA, 25 bp, Mus musculus
gctttcctggtcagcttcgcctggt

SEQ ID NO: 395504 - DNA, 25 bp, Mus musculus
cttcagttctgctttcctggtcagc

SEQ ID NO: 395505 - DNA, 25 bp, Mus musculus
ggcctagccgcgacacttcagttct

SEQ ID NO: 395506 - DNA, 25 bp, Mus musculus
tctctacccaaagtgcgcaagcgcg

SEQ ID NO: 395507 - DNA, 25 bp, Mus musculus
gtccctcgcacgcacagcggaggaa

SEQ ID NO: 395508 - DNA, 25 bp, Mus musculus
acttgcatctgcagaagccgcgtgg

SEQ ID NO: 395509 - DNA, 25 bp, Mus musculus
ccagcgggaggtgcaaagccgccca

SEQ ID NO: 395510 - DNA, 25 bp, Mus musculus
actgccggctgtggagctccagctc

SEQ ID NO: 395511 - DNA, 25 bp, Mus musculus
gagcacctgcgatcctttcccgatg

SEQ ID NO: 395512 - DNA, 25 bp, Mus musculus
ggaccttgtccgcttcagccaacgg

SEQ ID NO: 395513 - DNA, 25 bp, Mus musculus
gcctgcctcgatccgccttatatag

SEQ ID NO: 395514 - DNA, 25 bp, Mus musculus
tttcgctcaggctcttgctcgctct

SEQ ID NO: 395515 - DNA, 25 bp, Mus musculus
tttcccgatgcaccggaggcttcct

SEQ ID NO: 395516 - DNA, 25 bp, Mus musculus
cttgcttcccggtcttttcgctcag

SEQ ID NO: 395517 - DNA, 25 bp, Mus musculus
gatcggtacatgactgccggctgtg

SEQ ID NO: 395518 - DNA, 25 bp, Mus musculus
gcccttggtggatcggtacatgact

SEQ ID NO: 395519 - DNA, 25 bp, Mus musculus
cgttgatctggtcgcggcgcgcctt

SEQ ID NO: 395520 - DNA, 25 bp, Mus musculus
ggttccgaatctcggcgttgatctg

SEQ ID NO: 395521 - DNA, 25 bp, Mus musculus
agctccttgaggttccgaatctcgg

SEQ ID NO: 395522 - DNA, 25 bp, Mus musculus
ttgtccgcttcagccaacggcagca

SEQ ID NO: 395523 - DNA, 25 bp, Mus musculus
ccttatatagctcctgacaggcgtg

SEQ ID NO: 395524 - DNA, 25 bp, Mus musculus
agcagtcctttgtccggaccgagcc

SEQ ID NO: 395525 - DNA, 25 bp, Mus musculus
ccctgaagtgcccactgaccgggaa

SEQ ID NO: 395526 - DNA, 25 bp, Mus musculus
tccaagtgtcgcagatcctcagtcc

SEQ ID NO: 395527 - DNA, 25 bp, Mus musculus
gcacaagacctccaagtgtcgcaga

SEQ ID NO: 395528 - DNA, 25 bp, Mus musculus
gccgaagcagcacaagacctccaag

SEQ ID NO: 395529 - DNA, 25 bp, Mus musculus
cggaccgagccgaagcagcacaaga

SEQ ID NO: 395530 - DNA, 25 bp, Mus musculus
accaaagcctctgggacggagtctg

SEQ ID NO: 395531 - DNA, 25 bp, Mus musculus
cctctgggacggagtctggtagccc

SEQ ID NO: 395532 - DNA, 25 bp, Mus musculus
cgggcgccttcctggaccaggattc

SEQ ID NO: 395533 - DNA, 25 bp, Mus musculus
tcctggaccaggattccgagtgcaa

SEQ ID NO: 395534 - DNA, 25 bp, Mus musculus
attccgagtgcaaggaggagctact

SEQ ID NO: 395535 - DNA, 25 bp, Mus musculus
aggagctactgaaagattcgcgttc

SEQ ID NO: 395536 - DNA, 25 bp, Mus musculus
aaagattcgcgttctgagcgtggcg

SEQ ID NO: 395537 - DNA, 25 bp, Mus musculus
tgaccgggaagccaccaaagcctct

SEQ ID NO: 395538 - DNA, 25 bp, Mus musculus
actgggacgccggattcgcaagccc

SEQ ID NO: 395539 - DNA, 25 bp, Mus musculus
gcggtccttcctcttcgcacgattg

SEQ ID NO: 395540 - DNA, 25 bp, Mus musculus
cctcttcgcacgattggacggttgc

SEQ ID NO: 395541 - DNA, 25 bp, Mus musculus
gtcagtccgtgaaggggcttctcac

SEQ ID NO: 395542 - DNA, 25 bp, Mus musculus
atcgctagttgaggtgatggcgact

SEQ ID NO: 395543 - DNA, 25 bp, Mus musculus
ccggattcgcaagcccgatttggtc

SEQ ID NO: 395544 - DNA, 25 bp, Mus musculus
aagcccgatttggtcagtccgtgaa

SEQ ID NO: 395545 - DNA, 25 bp, Mus musculus
cgcgctcaccaagcaggtgctgaaa

SEQ ID NO: 395546 - DNA, 25 bp, Mus musculus
tgtaatcgcgctcaccaagcaggtg

SEQ ID NO: 395547 - DNA, 25 bp, Mus musculus
tgtggcaccgatgtaatcgcgctca

SEQ ID NO: 395548 - DNA, 25 bp, Mus musculus
gtgaacacctgtggcaccgatgtaa

SEQ ID NO: 395549 - DNA, 25 bp, Mus musculus
acggagaaggtgaacacctgtggca

SEQ ID NO: 395550 - DNA, 25 bp, Mus musculus
ccgtgaaggggcttctcacggagaa

SEQ ID NO: 395551 - DNA, 25 bp, Mus musculus
tggacggttgcgtctcttttggccc

SEQ ID NO: 395552 - DNA, 25 bp, Mus musculus
ccgcacatcgggcatcatcgagatc

SEQ ID NO: 395553 - DNA, 25 bp, Mus musculus
gagtcacgcgcctttcagttggaaa

SEQ ID NO: 395554 - DNA, 25 bp, Mus musculus
ctcttgattggctggcagacctgcc

SEQ ID NO: 395555 - DNA, 25 bp, Mus musculus
agctggctcagtccgaatcagtgtc

SEQ ID NO: 395556 - DNA, 25 bp, Mus musculus
agctggagcagccaccctatgattg

SEQ ID NO: 395557 - DNA, 25 bp, Mus musculus
gtggcgcttgtgaacccgaagtaaa

SEQ ID NO: 395558 - DNA, 25 bp, Mus musculus
cgccgcactgcccacttggaagatg

SEQ ID NO: 395559 - DNA, 25 bp, Mus musculus
cgagaacgaggagaccgtgatcatc

SEQ ID NO: 395560 - DNA, 25 bp, Mus musculus
cgggtgtacgggcagaacatcaaca

SEQ ID NO: 395561 - DNA, 25 bp, Mus musculus
gcaagtcttattacctgtgcacgtc

SEQ ID NO: 395562 - DNA, 25 bp, Mus musculus
atcgccttcactgagcacgagcggc

SEQ ID NO: 395563 - DNA, 25 bp, Mus musculus
gagatcgagattaaaccgctgcgca

SEQ ID NO: 395564 - DNA, 25 bp, Mus musculus
ccgctgcgcaagatggagaagagca

SEQ ID NO: 395565 - DNA, 25 bp, Mus musculus
caacaacgagacgtggtcccgcatc

SEQ ID NO: 395566 - DNA, 25 bp, Mus musculus
aaactggctcgtgggccattccgcg

SEQ ID NO: 395567 - DNA, 25 bp, Mus musculus
aaggcggggtcccagctagcgcacc

SEQ ID NO: 395568 - DNA, 25 bp, Mus musculus
tgcccgcccactccgcgagaaaggc

SEQ ID NO: 395569 - DNA, 25 bp, Mus musculus
agcccagagagaccaggggaaccga

SEQ ID NO: 395570 - DNA, 25 bp, Mus musculus
ctcacgagaactgaggccaggctgc

SEQ ID NO: 395571 - DNA, 25 bp, Mus musculus
ctgccaggctcgcagcccatgaggg

SEQ ID NO: 395572 - DNA, 25 bp, Mus musculus
attccgcgggcagatccaaaccctg

SEQ ID NO: 395573 - DNA, 25 bp, Mus musculus
ctgcgcaccacaaaactggctcgtg

SEQ ID NO: 395574 - DNA, 25 bp, Mus musculus
ggaagtactgcgcaccacaaaactg

SEQ ID NO: 395575 - DNA, 25 bp, Mus musculus
agctttccaggaagtactgcgcacc

SEQ ID NO: 395576 - DNA, 25 bp, Mus musculus
tgcaattgatgtgagctttccagga

SEQ ID NO: 395577 - DNA, 25 bp, Mus musculus
gggcagatccaaaccctgccaggct

SEQ ID NO: 395578 - DNA, 25 bp, Mus musculus
tccaaacgtctttaggcgagacttg

SEQ ID NO: 395579 - DNA, 25 bp, Mus musculus
ttaggcgagacttgcaattgatgtg

SEQ ID NO: 395580 - DNA, 25 bp, Mus musculus
cttcgccgtgttcatcgagaaggtg

SEQ ID NO: 395581 - DNA, 25 bp, Mus musculus
ccgaggagtggtacaagtccaagtt

SEQ ID NO: 395582 - DNA, 25 bp, Mus musculus
gtatgagtccctggccgctaagaac

SEQ ID NO: 395583 - DNA, 25 bp, Mus musculus
agatccgcgcgcagtatgagtccct

SEQ ID NO: 395584 - DNA, 25 bp, Mus musculus
accagacctgacttcggcgctgagg

SEQ ID NO: 395585 - DNA, 25 bp, Mus musculus
gtggccgtggctaaaccagacctga

SEQ ID NO: 395586 - DNA, 25 bp, Mus musculus
ccatgagcttcggatcggagcacta

SEQ ID NO: 395587 - DNA, 25 bp, Mus musculus
ggccacgttgcaggcgtcttcgcaa

SEQ ID NO: 395588 - DNA, 25 bp, Mus musculus
agctggctttcgtgcgccaggtcca

SEQ ID NO: 395589 - DNA, 25 bp, Mus musculus
tgcaccagctggagacgcagaaccg

SEQ ID NO: 395590 - DNA, 25 bp, Mus musculus
tccgcactaacgagaaggagcagct

SEQ ID NO: 395591 - DNA, 25 bp, Mus musculus
ggcgcgcaccaacgagtacaagatc

SEQ ID NO: 395592 - DNA, 25 bp, Mus musculus
cgcagtcgctgtcccgcagcaatgt

SEQ ID NO: 395593 - DNA, 25 bp, Mus musculus
cagaaccgtgcgctcgaggccgagc

SEQ ID NO: 395594 - DNA, 25 bp, Mus musculus
agaagtggctcatctcttcctcctc

SEQ ID NO: 395595 - DNA, 25 bp, Mus musculus
cagaaatctggcgagttgagagcga

SEQ ID NO: 395596 - DNA, 25 bp, Mus musculus
agcgacaacggcaaccacaggtctg

SEQ ID NO: 395597 - DNA, 25 bp, Mus musculus
agggtcgtcgatacctcctcctcgt

SEQ ID NO: 395598 - DNA, 25 bp, Mus musculus
ggagtctgcccgtccggactccaga

SEQ ID NO: 395599 - DNA, 25 bp, Mus musculus
ctccagacgcagagagaagtggctc

SEQ ID NO: 395600 - DNA, 25 bp, Mus musculus
ttccaactcttcatcgtagtcctcg

SEQ ID NO: 395601 - DNA, 25 bp, Mus musculus
cttggcctcagaggcgcgcttgttt

SEQ ID NO: 395602 - DNA, 25 bp, Mus musculus
cgcttgttttccgtggcgtccgtct

SEQ ID NO: 395603 - DNA, 25 bp, Mus musculus
gtagtcctcgaagcggcctctcaag

SEQ ID NO: 395604 - DNA, 25 bp, Mus musculus
gtccatggcggggatcagaaatctg

SEQ ID NO: 395605 - DNA, 25 bp, Mus musculus
tgaaggaagctcaccggttttcgcg

SEQ ID NO: 395606 - DNA, 25 bp, Mus musculus
tgtgggccacgccttgaaggaagct

SEQ ID NO: 395607 - DNA, 25 bp, Mus musculus
aagtgtggttcacctaggctaccta

SEQ ID NO: 395608 - DNA, 25 bp, Mus musculus
gccgtgctgcaattcctccggcaga

SEQ ID NO: 395609 - DNA, 25 bp, Mus musculus
cgctcggttttgaaagtagctcttt

SEQ ID NO: 395610 - DNA, 25 bp, Mus musculus
gtagctctttctcgtgccttttctc

SEQ ID NO: 395611 - DNA, 25 bp, Mus musculus
tagctcctcccactgccgtaaatgg

SEQ ID NO: 395612 - DNA, 25 bp, Mus musculus
cctccatgtggcgaaaacgcagtca

SEQ ID NO: 395613 - DNA, 25 bp, Mus musculus
aacgcagtcacgcttgacggcgcga

SEQ ID NO: 395614 - DNA, 25 bp, Mus musculus
tgctacctccgcaggctggcgacgg

SEQ ID NO: 395615 - DNA, 25 bp, Mus musculus
gcagagcaacctccgcgaggccgaa

SEQ ID NO: 395616 - DNA, 25 bp, Mus musculus
ttctcagccgggtcaccgcttcagt

SEQ ID NO: 395617 - DNA, 25 bp, Mus musculus
acctcggtgttctcgggttcagcct

SEQ ID NO: 395618 - DNA, 25 bp, Mus musculus
ggttcagcctcaggtcctgcggctc

SEQ ID NO: 395619 - DNA, 25 bp, Mus musculus
cctctgcgggcttgttttgaatttc

SEQ ID NO: 395620 - DNA, 25 bp, Mus musculus
tttgaatttcctgggcccgcctcta

SEQ ID NO: 395621 - DNA, 25 bp, Mus musculus
tcaagctagagcctgagggaccgcc

SEQ ID NO: 395622 - DNA, 25 bp, Mus musculus
aaccatagagatcccttaaagaggc

SEQ ID NO: 395623 - DNA, 25 bp, Mus musculus
gttatctccacagcgggcaatgtca

SEQ ID NO: 395624 - DNA, 25 bp, Mus musculus
agcaatcgcgaaggcttcgctctcc

SEQ ID NO: 395625 - DNA, 25 bp, Mus musculus
ggccattgtcctccgcggcgctgag

SEQ ID NO: 395626 - DNA, 25 bp, Mus musculus
gcggcgctgagcatcaccagcacta

SEQ ID NO: 395627 - DNA, 25 bp, Mus musculus
tcaccagcactagcaaggcagtagc

SEQ ID NO: 395628 - DNA, 25 bp, Mus musculus
caaggcagtagcttgcgcagttatc

SEQ ID NO: 395629 - DNA, 25 bp, Mus musculus
agtagcttgcgcagttatctccaca

SEQ ID NO: 395630 - DNA, 25 bp, Mus musculus
tcctctcggggagcaatcgcgaagg

SEQ ID NO: 395631 - DNA, 25 bp, Mus musculus
gcacaaactactacctcagccaggg

SEQ ID NO: 395632 - DNA, 25 bp, Mus musculus
tcttgctccactgcggccgggcgaa

SEQ ID NO: 395633 - DNA, 25 bp, Mus musculus
gatcccttaaagaggctggcgcgct

SEQ ID NO: 395634 - DNA, 25 bp, Mus musculus
ggcaatgtcacaacccgaccaacag

SEQ ID NO: 395635 - DNA, 25 bp, Mus musculus
ctacctcagccagggccatggtgtg

SEQ ID NO: 395636 - DNA, 25 bp, Mus musculus
cgagaggcgaacaaatcgaaggtac

SEQ ID NO: 395637 - DNA, 25 bp, Mus musculus
tcttcgacgggatgcctcgcagtaa

SEQ ID NO: 395638 - DNA, 25 bp, Mus musculus
cgagtaaattcgttctccgcatttc

SEQ ID NO: 395639 - DNA, 25 bp, Mus musculus
aggcgaaacgagaggcgaacaaatc

SEQ ID NO: 395640 - DNA, 25 bp, Mus musculus
tgcctcgcagtaagcaacagatcga

SEQ ID NO: 395641 - DNA, 25 bp, Mus musculus
tacatcgacatcttcgacgggatgc

SEQ ID NO: 395642 - DNA, 25 bp, Mus musculus
gtgcaggagcacctctacatcgaca

SEQ ID NO: 395643 - DNA, 25 bp, Mus musculus
atcagatctggaacatcgtgcagga

SEQ ID NO: 395644 - DNA, 25 bp, Mus musculus
ccaggagaagcagaacaatcagatc

SEQ ID NO: 395645 - DNA, 25 bp, Mus musculus
ttgaagcggcatctccaggagaagc

SEQ ID NO: 395646 - DNA, 25 bp, Mus musculus
gtaccagctcttgaagcggcatctc

SEQ ID NO: 395647 - DNA, 25 bp, Mus musculus
cgggactcgtaccagctcttgaagc

SEQ ID NO: 395648 - DNA, 25 bp, Mus musculus
gcatttcccgggactcgtaccagct

SEQ ID NO: 395649 - DNA, 25 bp, Mus musculus
acagatcgacgccatggtgggcagc

SEQ ID NO: 395650 - DNA, 25 bp, Mus musculus
aggcttcctagatccgccatggggc

SEQ ID NO: 395651 - DNA, 25 bp, Mus musculus
atggggccctgaccctcattttctc

SEQ ID NO: 395652 - DNA, 25 bp, Mus musculus
gcaaaaagaaaacctcgcgctgttc

SEQ ID NO: 395653 - DNA, 25 bp, Mus musculus
tggaaaaacggccagactctagtcg

SEQ ID NO: 395654 - DNA, 25 bp, Mus musculus
ctagtcggccctacaaagctcaatc

SEQ ID NO: 395655 - DNA, 25 bp, Mus musculus
ccgagcagccaagagcgctttctca

SEQ ID NO: 395656 - DNA, 25 bp, Mus musculus
ggcggccgatgtccttcaacaaacc

SEQ ID NO: 395657 - DNA, 25 bp, Mus musculus
aaacctagcgacgagctcggcccga

SEQ ID NO: 395658 - DNA, 25 bp, Mus musculus
ccctcggcgtggattggctataaac

SEQ ID NO: 395659 - DNA, 25 bp, Mus musculus
acttcccgtttcagccggcgtcaga

SEQ ID NO: 395660 - DNA, 25 bp, Mus musculus
gcgtcagacccgacgtcagaacgga

SEQ ID NO: 395661 - DNA, 25 bp, Mus musculus
cagaacggaagtagccctggtctta

SEQ ID NO: 395662 - DNA, 25 bp, Mus musculus
tggtcttacctacgctcgtggacga

SEQ ID NO: 395663 - DNA, 25 bp, Mus musculus
tgcgttgagacgctccgtgaggtat

SEQ ID NO: 395664 - DNA, 25 bp, Mus musculus
gcggcttgctggagtaccaggtact

SEQ ID NO: 395665 - DNA, 25 bp, Mus musculus
aagtcccgcgcatgctcacagcacg

SEQ ID NO: 395666 - DNA, 25 bp, Mus musculus
caacggtgtgcgaagtcccgcgcat

SEQ ID NO: 395667 - DNA, 25 bp, Mus musculus
tgcagcacgcaacggtgtgcgaagt

SEQ ID NO: 395668 - DNA, 25 bp, Mus musculus
atgtttgcgaagaagtgcagcacgc

SEQ ID NO: 395669 - DNA, 25 bp, Mus musculus
agctcgctctgcatgtttgcgaaga

SEQ ID NO: 395670 - DNA, 25 bp, Mus musculus
ccagggcacgtagctcgctctgcat

SEQ ID NO: 395671 - DNA, 25 bp, Mus musculus
atgccaccagctgggtcccgacgta

SEQ ID NO: 395672 - DNA, 25 bp, Mus musculus
gactcctgtgattctgggatgccac

SEQ ID NO: 395673 - DNA, 25 bp, Mus musculus
gggctccgaggactcctgtgattct

SEQ ID NO: 395674 - DNA, 25 bp, Mus musculus
cagatgggccttcccgtttccacta

SEQ ID NO: 395675 - DNA, 25 bp, Mus musculus
agatcgcgcgcagatgggccttccc

SEQ ID NO: 395676 - DNA, 25 bp, Mus musculus
taccaggtactgaggagttgatcca

SEQ ID NO: 395677 - DNA, 25 bp, Mus musculus
aggagttgatccacctgctcccggc

SEQ ID NO: 395678 - DNA, 25 bp, Mus musculus
gagcactggcgaagccgccactctg

SEQ ID NO: 395679 - DNA, 25 bp, Mus musculus
gcagatgaatgagctgcaacaagca

SEQ ID NO: 395680 - DNA, 25 bp, Mus musculus
ccatggcaacggagtgtcgcggtta

SEQ ID NO: 395681 - DNA, 25 bp, Mus musculus
ggaagctcctgagcactggcgaagc

SEQ ID NO: 395682 - DNA, 25 bp, Mus musculus
cgccactctgccagttgccttaaaa

SEQ ID NO: 395683 - DNA, 25 bp, Mus musculus
ttgccttaaaaaggcgccagcgcgc

SEQ ID NO: 395684 - DNA, 25 bp, Mus musculus
ccagcgcgcgcgcatcagcagaagg

SEQ ID NO: 395685 - DNA, 25 bp, Mus musculus
gctgcggctctcttccaaaataggc

SEQ ID NO: 395686 - DNA, 25 bp, Mus musculus
tctcttccaaaataggcaagaactg

SEQ ID NO: 395687 - DNA, 25 bp, Mus musculus
aagagctgcgaggagcacagacgtc

SEQ ID NO: 395688 - DNA, 25 bp, Mus musculus
tctgtctgcatcacattgccatggc

SEQ ID NO: 395689 - DNA, 25 bp, Mus musculus
tgtcgcggttagcagatgaatgagc

SEQ ID NO: 395690 - DNA, 25 bp, Mus musculus
gctgcaacaagcagaggagcccgca

SEQ ID NO: 395691 - DNA, 25 bp, Mus musculus
gagcacagacgtcacgcagggcctc

SEQ ID NO: 395692 - DNA, 25 bp, Mus musculus
cccgcgcgccttcgagaacttatag

SEQ ID NO: 395693 - DNA, 25 bp, Mus musculus
ttttcaggttctatgtcccaggaca

SEQ ID NO: 395694 - DNA, 25 bp, Mus musculus
gctcccatctattcctgacgtcagg

SEQ ID NO: 395695 - DNA, 25 bp, Mus musculus
agcgaagaccgccaagcccagggag

SEQ ID NO: 395696 - DNA, 25 bp, Mus musculus
agaacttatagccagcgggaacgcg

SEQ ID NO: 395697 - DNA, 25 bp, Mus musculus
ccgagacccacatctggcagagcgg

SEQ ID NO: 395698 - DNA, 25 bp, Mus musculus
gaacctcaaaggtaggcttcgctga

SEQ ID NO: 395699 - DNA, 25 bp, Mus musculus
ggcggtcctcttcctcttgttttca

SEQ ID NO: 395700 - DNA, 25 bp, Mus musculus
cgctcattaacctgcgcagctgtcg

SEQ ID NO: 395701 - DNA, 25 bp, Mus musculus
gcagctgtcgccataacaaccggag

SEQ ID NO: 395702 - DNA, 25 bp, Mus musculus
tccagtgtctcctctctgcagcgag

SEQ ID NO: 395703 - DNA, 25 bp, Mus musculus
ggccgatgccatgggtaacaacttc

SEQ ID NO: 395704 - DNA, 25 bp, Mus musculus
gcgcgtgtcactaagacgctcatta

SEQ ID NO: 395705 - DNA, 25 bp, Mus musculus
tcccaggacagggagacgctcaacc

SEQ ID NO: 395706 - DNA, 25 bp, Mus musculus
tccgcatcctggacgagcagacggt

SEQ ID NO: 395707 - DNA, 25 bp, Mus musculus
caggtccgcatcctcggtgagttcc

SEQ ID NO: 395708 - DNA, 25 bp, Mus musculus
tgcatggcgccatcacgcaggtccg

SEQ ID NO: 395709 - DNA, 25 bp, Mus musculus
ctctggatgctcttcagcctgcatg

SEQ ID NO: 395710 - DNA, 25 bp, Mus musculus
gcatgcagctgtgcgtggatgcctc

SEQ ID NO: 395711 - DNA, 25 bp, Mus musculus
acggagagctgcacctgagtcacaa

SEQ ID NO: 395712 - DNA, 25 bp, Mus musculus
tgcacagcggcgacatcctgggcct

SEQ ID NO: 395713 - DNA, 25 bp, Mus musculus
tccttcggggtcaccacgtgtgacc

SEQ ID NO: 395714 - DNA, 25 bp, Mus musculus
gcgtggccgagaccatcttcatcaa

SEQ ID NO: 395715 - DNA, 25 bp, Mus musculus
gaactcgctcaattctcagcacagc

SEQ ID NO: 395716 - DNA, 25 bp, Mus musculus
gtgagcctgtgcgacctcaacgtgc

SEQ ID NO: 395717 - DNA, 25 bp, Mus musculus
cccgtcgcagacagcgagctggtgc

SEQ ID NO: 395718 - DNA, 25 bp, Mus musculus
gacggtgacagtcgccctgtctctc

SEQ ID NO: 395719 - DNA, 25 bp, Mus musculus
tcttcatcaaggtcacgcgctcggg

SEQ ID NO: 395720 - DNA, 25 bp, Mus musculus
gcgactcgttcctccgaagggcaca

SEQ ID NO: 395721 - DNA, 25 bp, Mus musculus
gccgttagcgactcgttcctccgaa

SEQ ID NO: 395722 - DNA, 25 bp, Mus musculus
cggctgctgaccgtgcggtgctaaa

SEQ ID NO: 395723 - DNA, 25 bp, Mus musculus
tccgaagggcacaggacaggttgtt

SEQ ID NO: 395724 - DNA, 25 bp, Mus musculus
ttgtccttgggtggcggagacacaa

SEQ ID NO: 395725 - DNA, 25 bp, Mus musculus
ttgggtggcggagacacaaacacag

SEQ ID NO: 395726 - DNA, 25 bp, Mus musculus
cacaaacacagattggggcctgacg

SEQ ID NO: 395727 - DNA, 25 bp, Mus musculus
attggggcctgacggccacttgccg

SEQ ID NO: 395728 - DNA, 25 bp, Mus musculus
atcttcaccgctacggtgcccgagg

SEQ ID NO: 395729 - DNA, 25 bp, Mus musculus
tcaccgctacggtgcccgaggtctt

SEQ ID NO: 395730 - DNA, 25 bp, Mus musculus
tcctgcggacacctctgaggctgtc

SEQ ID NO: 395731 - DNA, 25 bp, Mus musculus
tggcctcagcggctgctgaccgtgc

SEQ ID NO: 395732 - DNA, 25 bp, Mus musculus
taaaggaggagttcctgcggacacc

SEQ ID NO: 395733 - DNA, 25 bp, Mus musculus
cacctctgaggctgtcggtggccgt

SEQ ID NO: 395734 - DNA, 25 bp, Mus musculus
cgtagccagggctcgcagcttgccg

SEQ ID NO: 395735 - DNA, 25 bp, Mus musculus
gttggacaccaccacgtactgttcc

SEQ ID NO: 395736 - DNA, 25 bp, Mus musculus
tcaccgctttcgttcttctcgatga

SEQ ID NO: 395737 - DNA, 25 bp, Mus musculus
gttcttctcgatgacatctaccacc

SEQ ID NO: 395738 - DNA, 25 bp, Mus musculus
tggaggctcagctccgagttctctt

SEQ ID NO: 395739 - DNA, 25 bp, Mus musculus
ccgagttctcttgtttcttatagtt

SEQ ID NO: 395740 - DNA, 25 bp, Mus musculus
ttgtttcttatagttggacaccacc

SEQ ID NO: 395741 - DNA, 25 bp, Mus musculus
caccacgtactgttccaggatcatg

SEQ ID NO: 395742 - DNA, 25 bp, Mus musculus
gtactgttccaggatcatgggctcg

SEQ ID NO: 395743 - DNA, 25 bp, Mus musculus
ctgtccatcgccctcgagggaggct

SEQ ID NO: 395744 - DNA, 25 bp, Mus musculus
catcgccctcgagggaggctgctcg

SEQ ID NO: 395745 - DNA, 25 bp, Mus musculus
gagcagcccgtagccagggctcgca

SEQ ID NO: 395746 - DNA, 25 bp, Mus musculus
caaggacaggccatatagcaaggcc

SEQ ID NO: 395747 - DNA, 25 bp, Mus musculus
aggctgctcggtcgccagctctgca

SEQ ID NO: 395748 - DNA, 25 bp, Mus musculus
cccggtgcctctgctcatgtgatgc

SEQ ID NO: 395749 - DNA, 25 bp, Mus musculus
gtgcctctgctcatgtgatgccgcg

SEQ ID NO: 395750 - DNA, 25 bp, Mus musculus
ctctctgcagctcgaacccgcaccc

SEQ ID NO: 395751 - DNA, 25 bp, Mus musculus
cgccggcgtgatcagcctcttcgcc

SEQ ID NO: 395752 - DNA, 25 bp, Mus musculus
cgcgcagcgatacccgtccgcccgc

SEQ ID NO: 395753 - DNA, 25 bp, Mus musculus
gttgcacgcactgcgcgcagcgata

SEQ ID NO: 395754 - DNA, 25 bp, Mus musculus
cagttgcacgcactgcgcgcagcga

SEQ ID NO: 395755 - DNA, 25 bp, Mus musculus
cgcgctccgcagttgcacgcactgc

SEQ ID NO: 395756 - DNA, 25 bp, Mus musculus
tgctcatgtgatgccgcggccgaga

SEQ ID NO: 395757 - DNA, 25 bp, Mus musculus
tctgctcatgtgatgccgcggccga

SEQ ID NO: 395758 - DNA, 25 bp, Mus musculus
gcctctgctcatgtgatgccgcggc

SEQ ID NO: 395759 - DNA, 25 bp, Mus musculus
cggtgcctctgctcatgtgatgccg

SEQ ID NO: 395760 - DNA, 25 bp, Mus musculus
tctgcagctcgaacccgcacccgca

SEQ ID NO: 395761 - DNA, 25 bp, Mus musculus
ctcccggtgcctctgctcatgtgat

SEQ ID NO: 395762 - DNA, 25 bp, Mus musculus
gtgaatctccgggactggccagccc

SEQ ID NO: 395763 - DNA, 25 bp, Mus musculus
ctccgggcgcctacagctgaggctc

SEQ ID NO: 395764 - DNA, 25 bp, Mus musculus
cccggttcctgcagttacacgccac

SEQ ID NO: 395765 - DNA, 25 bp, Mus musculus
gagcatcgtccccacaaagcgagtg

SEQ ID NO: 395766 - DNA, 25 bp, Mus musculus
ttgcacgcagtaggcgagcatcgtc

SEQ ID NO: 395767 - DNA, 25 bp, Mus musculus
accacggtggcatcttgcacgcagt

SEQ ID NO: 395768 - DNA, 25 bp, Mus musculus
acgtccaccacggtggcatcttgca

SEQ ID NO: 395769 - DNA, 25 bp, Mus musculus
ttagaggggctcctccgcttctcca

SEQ ID NO: 395770 - DNA, 25 bp, Mus musculus
cacatagtgtttagaggggctcctc

SEQ ID NO: 395771 - DNA, 25 bp, Mus musculus
ggtcggtggaagcagtactcacata

SEQ ID NO: 395772 - DNA, 25 bp, Mus musculus
gtcccaggctgctcccgtgggcctg

SEQ ID NO: 395773 - DNA, 25 bp, Mus musculus
ctcgcctgcccgctctctctgccgc

SEQ ID NO: 395774 - DNA, 25 bp, Mus musculus
ggaagcagtactcacatagtgttta

SEQ ID NO: 395775 - DNA, 25 bp, Mus musculus
agggctccgtgcgtcccaggctgct

SEQ ID NO: 395776 - DNA, 25 bp, Mus musculus
tcagccgcacttccggactccgggc

SEQ ID NO: 395777 - DNA, 25 bp, Mus musculus
tcagtcttccttagccggggcccag

SEQ ID NO: 395778 - DNA, 25 bp, Mus musculus
tgcgtctcccgaggcgtgcccgagt

SEQ ID NO: 395779 - DNA, 25 bp, Mus musculus
tcgccgaaacctgcccgcagcggtg

SEQ ID NO: 395780 - DNA, 25 bp, Mus musculus
tcaggagcccaccagacgggcaggt

SEQ ID NO: 395781 - DNA, 25 bp, Mus musculus
agaacgagctccagctgggcagtgc

SEQ ID NO: 395782 - DNA, 25 bp, Mus musculus
tggccacaagcttcagcgatgcccg

SEQ ID NO: 395783 - DNA, 25 bp, Mus musculus
cccagacccgccgacgccattagcc

SEQ ID NO: 395784 - DNA, 25 bp, Mus musculus
gccattagcccagtcgcccacaatt

SEQ ID NO: 395785 - DNA, 25 bp, Mus musculus
cggcccggacacgtcagccgcactt

SEQ ID NO: 395786 - DNA, 25 bp, Mus musculus
ggccgagctggccacaagcttcagc

SEQ ID NO: 395787 - DNA, 25 bp, Mus musculus
cgggccaatccggaggcgagtctct

SEQ ID NO: 395788 - DNA, 25 bp, Mus musculus
agcgagaagcccagaacgagctcca

SEQ ID NO: 395789 - DNA, 25 bp, Mus musculus
cccacaattccgagcgcggcccgga

SEQ ID NO: 395790 - DNA, 25 bp, Mus musculus
ggggctctcctaatctcggagattc

SEQ ID NO: 395791 - DNA, 25 bp, Mus musculus
tcctaatctcggagattcccgagcc

SEQ ID NO: 395792 - DNA, 25 bp, Mus musculus
atacaccctgcgcaggctcttgggg

SEQ ID NO: 395793 - DNA, 25 bp, Mus musculus
ggtctacatacaccctgcgcaggct

SEQ ID NO: 395794 - DNA, 25 bp, Mus musculus
ccacgccgccttcccggtctacata

SEQ ID NO: 395795 - DNA, 25 bp, Mus musculus
ccacgtatcggttccgcccacgccg

SEQ ID NO: 395796 - DNA, 25 bp, Mus musculus
ctagctaccgccagccactcccgct

SEQ ID NO: 395797 - DNA, 25 bp, Mus musculus
ccacccgcgcctagctaccgccagc

SEQ ID NO: 395798 - DNA, 25 bp, Mus musculus
aaggaagcgagcacactcccgccgg

SEQ ID NO: 395799 - DNA, 25 bp, Mus musculus
ttgcgagaaggaagcgagcacactc

SEQ ID NO: 395800 - DNA, 25 bp, Mus musculus
ccagttccggttgcgagaaggaagc

SEQ ID NO: 395801 - DNA, 25 bp, Mus musculus
gaaccagttccggttgcgagaagga

SEQ ID NO: 395802 - DNA, 25 bp, Mus musculus
agccactcccgctgaggccacgccc

SEQ ID NO: 395803 - DNA, 25 bp, Mus musculus
aatctcggagattcccgagccagcc

SEQ ID NO: 395804 - DNA, 25 bp, Mus musculus
gcagaatgaggcaacatccgccagc

SEQ ID NO: 395805 - DNA, 25 bp, Mus musculus
gcctccaccacacctcccgccgcag

SEQ ID NO: 395806 - DNA, 25 bp, Mus musculus
gatggaagcgctcaagcctccacca

SEQ ID NO: 395807 - DNA, 25 bp, Mus musculus
cctcgaggaggatggaagcgctcaa

SEQ ID NO: 395808 - DNA, 25 bp, Mus musculus
gtcaacgcaaaaccctcgaggagga

SEQ ID NO: 395809 - DNA, 25 bp, Mus musculus
cgggctcgcagaggtcaacgcaaaa

SEQ ID NO: 395810 - DNA, 25 bp, Mus musculus
aacgacgtcgtggagccacccggct

SEQ ID NO: 395811 - DNA, 25 bp, Mus musculus
acctggccaacgacgtcgtggagcc

SEQ ID NO: 395812 - DNA, 25 bp, Mus musculus
aacagggtcgcgccgaaggagacct

SEQ ID NO: 395813 - DNA, 25 bp, Mus musculus
atccgccagcgcaatcaacagggtc

SEQ ID NO: 395814 - DNA, 25 bp, Mus musculus
cccttgtgcagaatgaggcaacatc

SEQ ID NO: 395815 - DNA, 25 bp, Mus musculus
ggccagagggtacgccctcgcgagc

SEQ ID NO: 395816 - DNA, 25 bp, Mus musculus
agagcttggcttcgccgctacgcgc

SEQ ID NO: 395817 - DNA, 25 bp, Mus musculus
cgccagcgcaatcaacagggtcgcg

SEQ ID NO: 395818 - DNA, 25 bp, Mus musculus
gagtgatgggtctgcagtctaaacc

SEQ ID NO: 395819 - DNA, 25 bp, Mus musculus
tgcggcccggccctcgagtctttta

SEQ ID NO: 395820 - DNA, 25 bp, Mus musculus
acttccgaatttaatgggaggagcg

SEQ ID NO: 395821 - DNA, 25 bp, Mus musculus
ggtctgcagtctaaaccctgtcaaa

SEQ ID NO: 395822 - DNA, 25 bp, Mus musculus
ggccggatgcagtttcaggagtgat

SEQ ID NO: 395823 - DNA, 25 bp, Mus musculus
atccaagccgttacggaataccgtg

SEQ ID NO: 395824 - DNA, 25 bp, Mus musculus
cttcagctcagcatccaagccgtta

SEQ ID NO: 395825 - DNA, 25 bp, Mus musculus
taggttgaaacttcagctcagcatc

SEQ ID NO: 395826 - DNA, 25 bp, Mus musculus
cgctccttggctttgtaggttgaaa

SEQ ID NO: 395827 - DNA, 25 bp, Mus musculus
gacttgcccgctccttggctttgta

SEQ ID NO: 395828 - DNA, 25 bp, Mus musculus
cttaggaggagatgaaacggccgcc

SEQ ID NO: 395829 - DNA, 25 bp, Mus musculus
aaacggccgcctgtccggagtggca

SEQ ID NO: 395830 - DNA, 25 bp, Mus musculus
ccggagtggcacgaggacttcaccc

SEQ ID NO: 395831 - DNA, 25 bp, Mus musculus
ccctgtcaaacttccgaatttaatg

SEQ ID NO: 395832 - DNA, 25 bp, Mus musculus
ccggccctgccacgtctgaggaaaa

SEQ ID NO: 395833 - DNA, 25 bp, Mus musculus
tacgtctcttctccggtgaggctcc

SEQ ID NO: 395834 - DNA, 25 bp, Mus musculus
gctagccaatcgtacgtctcttctc

SEQ ID NO: 395835 - DNA, 25 bp, Mus musculus
gctccggccaagctagccaatcgta

SEQ ID NO: 395836 - DNA, 25 bp, Mus musculus
gctgtacggagcacatccgcctgct

SEQ ID NO: 395837 - DNA, 25 bp, Mus musculus
agtcggagctgtacggagcacatcc

SEQ ID NO: 395838 - DNA, 25 bp, Mus musculus
catcgttttttccatggacgccacc

SEQ ID NO: 395839 - DNA, 25 bp, Mus musculus
agggcctaacatcgttttttccatg

SEQ ID NO: 395840 - DNA, 25 bp, Mus musculus
ggcaccgcaactcccaaaggcagtg

SEQ ID NO: 395841 - DNA, 25 bp, Mus musculus
tcgggaaggcagctggcaccgcaac

SEQ ID NO: 395842 - DNA, 25 bp, Mus musculus
cccaccagggaagctgctcgggaag

SEQ ID NO: 395843 - DNA, 25 bp, Mus musculus
ccacgtctgaggaaaagcctttgcg

SEQ ID NO: 395844 - DNA, 25 bp, Mus musculus
ctgggtatctgacggagaagctctc

SEQ ID NO: 395845 - DNA, 25 bp, Mus musculus
tgagctttctccctggggttggcct

SEQ ID NO: 395846 - DNA, 25 bp, Mus musculus
cggacccgtgcctaaggagaagacg

SEQ ID NO: 395847 - DNA, 25 bp, Mus musculus
caggtggccacgagcctttgaattc

SEQ ID NO: 395848 - DNA, 25 bp, Mus musculus
gtgagacacagcttcaggcgcggaa

SEQ ID NO: 395849 - DNA, 25 bp, Mus musculus
taaaggcacagccaccagcgaggcg

SEQ ID NO: 395850 - DNA, 25 bp, Mus musculus
aggtccgagcctgcaaaacgtggtc

SEQ ID NO: 395851 - DNA, 25 bp, Mus musculus
gcaaaacgtggtccgcagtgtaacc

SEQ ID NO: 395852 - DNA, 25 bp, Mus musculus
gaagcaagctagaaggcggaaccta

SEQ ID NO: 395853 - DNA, 25 bp, Mus musculus
ctggtgcaataggactgcggcaacc

SEQ ID NO: 395854 - DNA, 25 bp, Mus musculus
tttgaattcccgctcgtcttgatgc

SEQ ID NO: 395855 - DNA, 25 bp, Mus musculus
ctcgtcttgatgctcctgggctcaa

SEQ ID NO: 395856 - DNA, 25 bp, Mus musculus
ctgggctcaaagacgaacgggacta

SEQ ID NO: 395857 - DNA, 25 bp, Mus musculus
agccgattcccttagctgcttgagc

SEQ ID NO: 395858 - DNA, 25 bp, Mus musculus
agtccgttctactgaggggcggcta

SEQ ID NO: 395859 - DNA, 25 bp, Mus musculus
ctccgaccttgggattcctggacac

SEQ ID NO: 395860 - DNA, 25 bp, Mus musculus
gggctgcggccgttactccttggcc

SEQ ID NO: 395861 - DNA, 25 bp, Mus musculus
cacctgtatcctggagaccgggaac

SEQ ID NO: 395862 - DNA, 25 bp, Mus musculus
gtttacacctgtatcctggagaccg

SEQ ID NO: 395863 - DNA, 25 bp, Mus musculus
tgccactgtttacacctgtatcctg

SEQ ID NO: 395864 - DNA, 25 bp, Mus musculus
gcgaagatgccactgtttacacctg

SEQ ID NO: 395865 - DNA, 25 bp, Mus musculus
tcaggctaagaagcccgcgaagatg

SEQ ID NO: 395866 - DNA, 25 bp, Mus musculus
cgggtcaggctaagaagcccgcgaa

SEQ ID NO: 395867 - DNA, 25 bp, Mus musculus
gatgccgcacctcaccgacagggag

SEQ ID NO: 395868 - DNA, 25 bp, Mus musculus
ctcaccgacagggaggatccggagt

SEQ ID NO: 395869 - DNA, 25 bp, Mus musculus
atccggagtagtgggcagaggcaga

SEQ ID NO: 395870 - DNA, 25 bp, Mus musculus
agaggcagtgacgtcgtcgcgctcc

SEQ ID NO: 395871 - DNA, 25 bp, Mus musculus
tcgcgctccgggtcttgcgacatgc

SEQ ID NO: 395872 - DNA, 25 bp, Mus musculus
ggtcttgcgacatgccgactcccag

SEQ ID NO: 395873 - DNA, 25 bp, Mus musculus
gagcgaagccgagcggtgggaccct

SEQ ID NO: 395874 - DNA, 25 bp, Mus musculus
ttaacgtcacacagcatcaggatcc

SEQ ID NO: 395875 - DNA, 25 bp, Mus musculus
tcctgaaggccaagggaatccggtg

SEQ ID NO: 395876 - DNA, 25 bp, Mus musculus
ggagcccaccggttaacgtcacaca

SEQ ID NO: 395877 - DNA, 25 bp, Mus musculus
atcgcagcggccgatgctttccctt

SEQ ID NO: 395878 - DNA, 25 bp, Mus musculus
tcgtgcttccagagtcgcccgcaaa

SEQ ID NO: 395879 - DNA, 25 bp, Mus musculus
gctcagcgatgtcgggagaatcctc

SEQ ID NO: 395880 - DNA, 25 bp, Mus musculus
tcgggagaatcctccaggagcctgg

SEQ ID NO: 395881 - DNA, 25 bp, Mus musculus
gatgcccgggatccctgtgcgatcc

SEQ ID NO: 395882 - DNA, 25 bp, Mus musculus
gatccgggccgtgactgtctcctct

SEQ ID NO: 395883 - DNA, 25 bp, Mus musculus
tgtctcctctctcctgcaggaagcg

SEQ ID NO: 395884 - DNA, 25 bp, Mus musculus
ggccagatccgcgtctacagcatga

SEQ ID NO: 395885 - DNA, 25 bp, Mus musculus
cgcgtctacagcatgaggttctgcc

SEQ ID NO: 395886 - DNA, 25 bp, Mus musculus
gacagtgtacaagacctcgtgcttc

SEQ ID NO: 395887 - DNA, 25 bp, Mus musculus
cttcgctcagaggacgctgatggtc

SEQ ID NO: 395888 - DNA, 25 bp, Mus musculus
tcgcctattggctcgctcttccaga

SEQ ID NO: 395889 - DNA, 25 bp, Mus musculus
ctcgcggattcccagtaggatgtga

SEQ ID NO: 395890 - DNA, 25 bp, Mus musculus
gcgccgcatttagggtttagcttca

SEQ ID NO: 395891 - DNA, 25 bp, Mus musculus
gctgacttcacaaacgggacaacta

SEQ ID NO: 395892 - DNA, 25 bp, Mus musculus
gacaactagcgtcctactccgagcg

SEQ ID NO: 395893 - DNA, 25 bp, Mus musculus
tactccgagcggagccatctgtgcc

SEQ ID NO: 395894 - DNA, 25 bp, Mus musculus
gagaggaaccgcctgctaccgactt

SEQ ID NO: 395895 - DNA, 25 bp, Mus musculus
gacttcctctttaggtagccataga

SEQ ID NO: 395896 - DNA, 25 bp, Mus musculus
agccatagatttccggcctgaccct

SEQ ID NO: 395897 - DNA, 25 bp, Mus musculus
caagctgctataacgcggtcgccta

SEQ ID NO: 395898 - DNA, 25 bp, Mus musculus
ctcttccagacgagccaggtattgg

SEQ ID NO: 395899 - DNA, 25 bp, Mus musculus
cgcccgaaggttgctctgagatgct

SEQ ID NO: 395900 - DNA, 25 bp, Mus musculus
tgagatgctttttctgccaccgcca

SEQ ID NO: 395901 - DNA, 25 bp, Mus musculus
tgaccctcgtttctcgagcaagctg

SEQ ID NO: 395902 - DNA, 25 bp, Mus musculus
tgccggtaagggactctggacccgc

SEQ ID NO: 395903 - DNA, 25 bp, Mus musculus
ggcgactagaccaaggcggctcccg

SEQ ID NO: 395904 - DNA, 25 bp, Mus musculus
ccgcccagctttactgggcaacaga

SEQ ID NO: 395905 - DNA, 25 bp, Mus musculus
gctttactgggcaacagagttactc

SEQ ID NO: 395906 - DNA, 25 bp, Mus musculus
agagttactcatttccgcgttgtca

SEQ ID NO: 395907 - DNA, 25 bp, Mus musculus
cgcgttgtcacggaaactttttgct

SEQ ID NO: 395908 - DNA, 25 bp, Mus musculus
tcacggaaactttttgctccttata

SEQ ID NO: 395909 - DNA, 25 bp, Mus musculus
gatctcccacgcacatctacgggga

SEQ ID NO: 395910 - DNA, 25 bp, Mus musculus
ttcatcccacacactcagcttgtgg

SEQ ID NO: 395911 - DNA, 25 bp, Mus musculus
gtccctcagagctcctggtcacgat

SEQ ID NO: 395912 - DNA, 25 bp, Mus musculus
agggttcccgcagacgtccctcaga

SEQ ID NO: 395913 - DNA, 25 bp, Mus musculus
ggcagcaaagcctcatagtcgaacc

SEQ ID NO: 395914 - DNA, 25 bp, Mus musculus
taccgagtgggcctcgctccaagcg

SEQ ID NO: 395915 - DNA, 25 bp, Mus musculus
ttgctccttataagaacaaaacacc

SEQ ID NO: 395916 - DNA, 25 bp, Mus musculus
gtgtaagggacaggcgaaccacctc

SEQ ID NO: 395917 - DNA, 25 bp, Mus musculus
gctcccaagaacagaccgaagagtg

SEQ ID NO: 395918 - DNA, 25 bp, Mus musculus
ggccctggtctccagatcgagaaca

SEQ ID NO: 395919 - DNA, 25 bp, Mus musculus
cgcttggcttcagagcggtagctcc

SEQ ID NO: 395920 - DNA, 25 bp, Mus musculus
cccagagcagagtcgtgggtccatc

SEQ ID NO: 395921 - DNA, 25 bp, Mus musculus
gatccagctagcgttgcccatttta

SEQ ID NO: 395922 - DNA, 25 bp, Mus musculus
tgcccattttaagaggatttcccta

SEQ ID NO: 395923 - DNA, 25 bp, Mus musculus
ccggccagagcatcgagagagcatt

SEQ ID NO: 395924 - DNA, 25 bp, Mus musculus
gttttggaatcaccctctggacctg

SEQ ID NO: 395925 - DNA, 25 bp, Mus musculus
aggctagagccactatcccaggcga

SEQ ID NO: 395926 - DNA, 25 bp, Mus musculus
tctggacctgggagcaagcgatcca

SEQ ID NO: 395927 - DNA, 25 bp, Mus musculus
ctgacacactcgctagcttgcttgc

SEQ ID NO: 395928 - DNA, 25 bp, Mus musculus
tgctcttgtcaacatgggtcctggc

SEQ ID NO: 395929 - DNA, 25 bp, Mus musculus
ctccggataagggtctgctgtgagc

SEQ ID NO: 395930 - DNA, 25 bp, Mus musculus
agccgcctccaaacccatgtttttg

SEQ ID NO: 395931 - DNA, 25 bp, Mus musculus
atgctggcccttttcttgccgcagc

SEQ ID NO: 395932 - DNA, 25 bp, Mus musculus
gctcggactctccttgccatgctgg

SEQ ID NO: 395933 - DNA, 25 bp, Mus musculus
ttgcacggttctcaccgggtgccgc

SEQ ID NO: 395934 - DNA, 25 bp, Mus musculus
ccagacctctgagtttgcacggttc

SEQ ID NO: 395935 - DNA, 25 bp, Mus musculus
cccgccggcaggtctgtaccaaatg

SEQ ID NO: 395936 - DNA, 25 bp, Mus musculus
atcttcttccactagccgtagcgga

SEQ ID NO: 395937 - DNA, 25 bp, Mus musculus
tcgcgatgtcagaacgctgggtgtc

SEQ ID NO: 395938 - DNA, 25 bp, Mus musculus
aggttttgagcagcgtcgcgatgtc

SEQ ID NO: 395939 - DNA, 25 bp, Mus musculus
cctttccggagcgaggttttgagca

SEQ ID NO: 395940 - DNA, 25 bp, Mus musculus
aaaaccagcggcaggcaggctcacg

SEQ ID NO: 395941 - DNA, 25 bp, Mus musculus
ggcgcgaccgggatctgtcaaaaaa

SEQ ID NO: 395942 - DNA, 25 bp, Mus musculus
cggctcccggaagactacaaggatc

SEQ ID NO: 395943 - DNA, 25 bp, Mus musculus
tttttgcgggttcactcctactgga

SEQ ID NO: 395944 - DNA, 25 bp, Mus musculus
agcgccaacttttcccatctctgga

SEQ ID NO: 395945 - DNA, 25 bp, Mus musculus
ctttgtccgggtcccgtgcgccagt

SEQ ID NO: 395946 - DNA, 25 bp, Mus musculus
tccatcctttagcatgtcccggcgg

SEQ ID NO: 395947 - DNA, 25 bp, Mus musculus
cctctccgggttcaatcttctcggg

SEQ ID NO: 395948 - DNA, 25 bp, Mus musculus
caatcttctcgggttccgttccact

SEQ ID NO: 395949 - DNA, 25 bp, Mus musculus
tcaggaccacaactccatccaagtt

SEQ ID NO: 395950 - DNA, 25 bp, Mus musculus
agcacccttcctcttggggcgagca

SEQ ID NO: 395951 - DNA, 25 bp, Mus musculus
tccgagctgcgctgtgtccagggct

SEQ ID NO: 395952 - DNA, 25 bp, Mus musculus
ctccatccaagttgggctgggcggc

SEQ ID NO: 395953 - DNA, 25 bp, Mus musculus
tcccatctctggagcgtagagaagc

SEQ ID NO: 395954 - DNA, 25 bp, Mus musculus
gaggagccgtctccagcgccaactt

SEQ ID NO: 395955 - DNA, 25 bp, Mus musculus
gccactgcgaacaggggtctcatga

SEQ ID NO: 395956 - DNA, 25 bp, Mus musculus
gctcgctccagaaacagcgcacggt

SEQ ID NO: 395957 - DNA, 25 bp, Mus musculus
gtctcctacggccagagcgtgcagc

SEQ ID NO: 395958 - DNA, 25 bp, Mus musculus
ggcggctttctggaggctgccattc

SEQ ID NO: 395959 - DNA, 25 bp, Mus musculus
ggtcacactggtccctggaccggct

SEQ ID NO: 395960 - DNA, 25 bp, Mus musculus
cccgccggaagcgagctgagtcctg

SEQ ID NO: 395961 - DNA, 25 bp, Mus musculus
ggctgcacagatcgttccccggttc

SEQ ID NO: 395962 - DNA, 25 bp, Mus musculus
tcgctgctcgccctctcgtccctac

SEQ ID NO: 395963 - DNA, 25 bp, Mus musculus
cctcaccttactcgcggcggctttc

SEQ ID NO: 395964 - DNA, 25 bp, Mus musculus
tgtggcgtgctcacgcagaggctcc

SEQ ID NO: 395965 - DNA, 25 bp, Mus musculus
tttctggaggctgccattcggcggt

SEQ ID NO: 395966 - DNA, 25 bp, Mus musculus
cccacgtcaggggagcgcagaccag

SEQ ID NO: 395967 - DNA, 25 bp, Mus musculus
ggagcgcagaccagctgatcaccca

SEQ ID NO: 395968 - DNA, 25 bp, Mus musculus
accagctgatcacccacggccaggc

SEQ ID NO: 395969 - DNA, 25 bp, Mus musculus
agttcctcggtcacactggtccctg

SEQ ID NO: 395970 - DNA, 25 bp, Mus musculus
ccctctgtggcgtgctcacgcagag

SEQ ID NO: 395971 - DNA, 25 bp, Mus musculus
cgccggatgccggtcagccggcaca

SEQ ID NO: 395972 - DNA, 25 bp, Mus musculus
ttttgaagcagcgagagctagacgc

SEQ ID NO: 395973 - DNA, 25 bp, Mus musculus
cacgcttttgagctacgagggccca

SEQ ID NO: 395974 - DNA, 25 bp, Mus musculus
gtcggcgaccaggtgtcgccacttc

SEQ ID NO: 395975 - DNA, 25 bp, Mus musculus
cccagcccgtactgggcggagtgaa

SEQ ID NO: 395976 - DNA, 25 bp, Mus musculus
gtactagaagggtcaagcctgtaga

SEQ ID NO: 395977 - DNA, 25 bp, Mus musculus
tcaagcctgtagagggcggaatcaa

SEQ ID NO: 395978 - DNA, 25 bp, Mus musculus
gaaccaggggcacgcttttgagcta

SEQ ID NO: 395979 - DNA, 25 bp, Mus musculus
ggtgctaagcgagactaagcctgta

SEQ ID NO: 395980 - DNA, 25 bp, Mus musculus
aaccgagcgagcgacgttaagaggc

SEQ ID NO: 395981 - DNA, 25 bp, Mus musculus
aaatcctgttctgcggggagccttg

SEQ ID NO: 395982 - DNA, 25 bp, Mus musculus
cgcggcctcaggtgaaccgtgctcg

SEQ ID NO: 395983 - DNA, 25 bp, Mus musculus
ggcgtgggattgcaaaatcctgttc

SEQ ID NO: 395984 - DNA, 25 bp, Mus musculus
tggcctattaggagcggagcaaaaa

SEQ ID NO: 395985 - DNA, 25 bp, Mus musculus
aatcaagagccctgaggcgtggcct

SEQ ID NO: 395986 - DNA, 25 bp, Mus musculus
acacacgtaccctcggcagtaaagc

SEQ ID NO: 395987 - DNA, 25 bp, Mus musculus
atcgggctcgcactaggacccaggc

SEQ ID NO: 395988 - DNA, 25 bp, Mus musculus
ctccgtccgtcctgtaggttcattc

SEQ ID NO: 395989 - DNA, 25 bp, Mus musculus
acacagacccacacagcgagagcga

SEQ ID NO: 395990 - DNA, 25 bp, Mus musculus
ttgtttgctgacaactgggctgaga

SEQ ID NO: 395991 - DNA, 25 bp, Mus musculus
ttctcggacattttcaacaccagcg

SEQ ID NO: 395992 - DNA, 25 bp, Mus musculus
cacgcacaaagctgctaaagatgta

SEQ ID NO: 395993 - DNA, 25 bp, Mus musculus
cgagaactcgatggagaagcacatc

SEQ ID NO: 395994 - DNA, 25 bp, Mus musculus
tttgaccggtcagatggcatcgggc

SEQ ID NO: 395995 - DNA, 25 bp, Mus musculus
catcaacacttttctgcagaacgtg

SEQ ID NO: 395996 - DNA, 25 bp, Mus musculus
cgtgcagattctgctcgaggcagcc

SEQ ID NO: 395997 - DNA, 25 bp, Mus musculus
gccagctacctggagcagatcgaga

SEQ ID NO: 395998 - DNA, 25 bp, Mus musculus
ccctagccgccaccatttattttga

SEQ ID NO: 395999 - DNA, 25 bp, Mus musculus
tgacaccggagaaaggacacgcacg

SEQ ID NO: 396000 - DNA, 25 bp, Mus musculus
aactccaggagaccactcgtcggac

SEQ ID NO: 396001 - DNA, 25 bp, Mus musculus
agggcaccttggcaatattcagcga

SEQ ID NO: 396002 - DNA, 25 bp, Mus musculus
cggtccgcgtgtgcacagcaataac

SEQ ID NO: 396003 - DNA, 25 bp, Mus musculus
gccgttgttttctgctcgctgcaca

SEQ ID NO: 396004 - DNA, 25 bp, Mus musculus
cgggccctacatctgtcttgcttta

SEQ ID NO: 396005 - DNA, 25 bp, Mus musculus
gccatagattccctagcctctcgtg

SEQ ID NO: 396006 - DNA, 25 bp, Mus musculus
ccttgctaacagaagcggctcactc

SEQ ID NO: 396007 - DNA, 25 bp, Mus musculus
tcgaaatgacgtgatgccaacagcc

SEQ ID NO: 396008 - DNA, 25 bp, Mus musculus
gccgctgctgtttggctcgaaatga

SEQ ID NO: 396009 - DNA, 25 bp, Mus musculus
cccgcgggagtatttttagcactct

SEQ ID NO: 396010 - DNA, 25 bp, Mus musculus
gtcaacttcatgtgcgtaatcagcc

SEQ ID NO: 396011 - DNA, 25 bp, Mus musculus
gcagttaaggggcttcctctcggac

SEQ ID NO: 396012 - DNA, 25 bp, Mus musculus
tggccactagtcacgtaagcagaga

SEQ ID NO: 396013 - DNA, 25 bp, Mus musculus
gcggctcactctggccactttattc

SEQ ID NO: 396014 - DNA, 25 bp, Mus musculus
tctccgcgatccgtagaccaggtaa

SEQ ID NO: 396015 - DNA, 25 bp, Mus musculus
ggcaatgctgcagctgctctaccta

SEQ ID NO: 396016 - DNA, 25 bp, Mus musculus
gcctccggaggcgttctagatgcca

SEQ ID NO: 396017 - DNA, 25 bp, Mus musculus
ccgcgctcatgttggtggcaatgct

SEQ ID NO: 396018 - DNA, 25 bp, Mus musculus
cgcggctaggttcagcgtttgcaaa

SEQ ID NO: 396019 - DNA, 25 bp, Mus musculus
cgattatcgcgtctacaggggtcta

SEQ ID NO: 396020 - DNA, 25 bp, Mus musculus
tccgtttcagtgttcgcggccacca

SEQ ID NO: 396021 - DNA, 25 bp, Mus musculus
tgcaaatgtcctacgccatccgatg

SEQ ID NO: 396022 - DNA, 25 bp, Mus musculus
gtcatcttagctacgcatgccagtg

SEQ ID NO: 396023 - DNA, 25 bp, Mus musculus
gcatgccagtgtggacaacctacta

SEQ ID NO: 396024 - DNA, 25 bp, Mus musculus
tacacctgtccggacttctggagcg

SEQ ID NO: 396025 - DNA, 25 bp, Mus musculus
tcacgccagtgatgcagccaagctc

SEQ ID NO: 396026 - DNA, 25 bp, Mus musculus
gccaagctctatcggggatcctgtt

SEQ ID NO: 396027 - DNA, 25 bp, Mus musculus
cccagcgagcgcattgaagtttcag

SEQ ID NO: 396028 - DNA, 25 bp, Mus musculus
cgtcggtagcgtctggtcacgcgtt

SEQ ID NO: 396029 - DNA, 25 bp, Mus musculus
agctgtgttttgaggtgcgtcggta

SEQ ID NO: 396030 - DNA, 25 bp, Mus musculus
actccatttcgggttcgctgagctg

SEQ ID NO: 396031 - DNA, 25 bp, Mus musculus
ttcgactccatttcgggttcgctga

SEQ ID NO: 396032 - DNA, 25 bp, Mus musculus
agtgcctgccctttcgactccattt

SEQ ID NO: 396033 - DNA, 25 bp, Mus musculus
tctcttagacaagtgcctgcccttt

SEQ ID NO: 396034 - DNA, 25 bp, Mus musculus
ggggctctcttctcttagacaagtg

SEQ ID NO: 396035 - DNA, 25 bp, Mus musculus
tagcgtctggtcacgcgttcacacg

SEQ ID NO: 396036 - DNA, 25 bp, Mus musculus
agctggtccagtcttttcttaaagg

SEQ ID NO: 396037 - DNA, 25 bp, Mus musculus
tgtagtgcagccagctggtccagtc

SEQ ID NO: 396038 - DNA, 25 bp, Mus musculus
aatcactaggcgctgtagtgcagcc

SEQ ID NO: 396039 - DNA, 25 bp, Mus musculus
agccaggacgtgagccaggaaatca

SEQ ID NO: 396040 - DNA, 25 bp, Mus musculus
cttaaaggggctctcttctcttaga

SEQ ID NO: 396041 - DNA, 25 bp, Mus musculus
agccaggaaatcactaggcgctgta

SEQ ID NO: 396042 - DNA, 25 bp, Mus musculus
ccaccatgcgcaggcgtactgaggc

SEQ ID NO: 396043 - DNA, 25 bp, Mus musculus
aggccgcggagtttttggagcgcag

SEQ ID NO: 396044 - DNA, 25 bp, Mus musculus
tgcggatgatcaacgtgcagcgcct

SEQ ID NO: 396045 - DNA, 25 bp, Mus musculus
gactgtagccgtctgtggcgcctcc

SEQ ID NO: 396046 - DNA, 25 bp, Mus musculus
cacatgtccggagtcgtcgtgggac

SEQ ID NO: 396047 - DNA, 25 bp, Mus musculus
cgtgctcgcgcggagaagtaaacaa

SEQ ID NO: 396048 - DNA, 25 bp, Mus musculus
aggtaacggctggacgccgtcgctt

SEQ ID NO: 396049 - DNA, 25 bp, Mus musculus
gaggcggcccatgtccctcggcacc

SEQ ID NO: 396050 - DNA, 25 bp, Mus musculus
agtcgtcgtgggactgtagccgtct

SEQ ID NO: 396051 - DNA, 25 bp, Mus musculus
catcgcggagtccaccatgcgcagg

SEQ ID NO: 396052 - DNA, 25 bp, Mus musculus
ccctcggcacccgacgtgcactggc

SEQ ID NO: 396053 - DNA, 25 bp, Mus musculus
ttcttgctcaggagtgcaggtgagt

SEQ ID NO: 396054 - DNA, 25 bp, Mus musculus
tgctcgcgcggagaagtaaacaaac

SEQ ID NO: 396055 - DNA, 25 bp, Mus musculus
acgccgtcgcttcgaccgccgcctc

SEQ ID NO: 396056 - DNA, 25 bp, Mus musculus
aaaaggagaaagtccgccagcgagg

SEQ ID NO: 396057 - DNA, 25 bp, Mus musculus
ggaaccgctcggagcgctcactctt

SEQ ID NO: 396058 - DNA, 25 bp, Mus musculus
tttacgtcagttccgcctcgtgctg

SEQ ID NO: 396059 - DNA, 25 bp, Mus musculus
cagagggcatgttcgttttacgtca

SEQ ID NO: 396060 - DNA, 25 bp, Mus musculus
cagcctgcgattgcagcctcggaag

SEQ ID NO: 396061 - DNA, 25 bp, Mus musculus
gatggcgcccgggtcacatgaccct

SEQ ID NO: 396062 - DNA, 25 bp, Mus musculus
tcacacggaggtcatcctagaaacc

SEQ ID NO: 396063 - DNA, 25 bp, Mus musculus
gatctcgcgagacctacggactctc

SEQ ID NO: 396064 - DNA, 25 bp, Mus musculus
attttccgccgcgacgagcctcggt

SEQ ID NO: 396065 - DNA, 25 bp, Mus musculus
ggctgcagccgggaaagattttccg

SEQ ID NO: 396066 - DNA, 25 bp, Mus musculus
tttcctcgcctttctctccggtgga

SEQ ID NO: 396067 - DNA, 25 bp, Mus musculus
cctcaggggctcgttaccttgggtg

SEQ ID NO: 396068 - DNA, 25 bp, Mus musculus
cgcggggcaaacatacgggtcctcg

SEQ ID NO: 396069 - DNA, 25 bp, Mus musculus
actctcgtggaaaagatggcgcccg

SEQ ID NO: 396070 - DNA, 25 bp, Mus musculus
gcagcggcatgaaggtcacgtcgct

SEQ ID NO: 396071 - DNA, 25 bp, Mus musculus
ctcggctcatctcagaggctaaatc

SEQ ID NO: 396072 - DNA, 25 bp, Mus musculus
ggctaaatctccttgcaaacgcaga

SEQ ID NO: 396073 - DNA, 25 bp, Mus musculus
ttgcaaacgcagacacaaccgggag

SEQ ID NO: 396074 - DNA, 25 bp, Mus musculus
gagcgaccggaatccgggattcacc

SEQ ID NO: 396075 - DNA, 25 bp, Mus musculus
gcgttcctgacactccaccggtagt

SEQ ID NO: 396076 - DNA, 25 bp, Mus musculus
agagggagcgatcgcccgccacttc

SEQ ID NO: 396077 - DNA, 25 bp, Mus musculus
acttcctctttctcgctctaagacg

SEQ ID NO: 396078 - DNA, 25 bp, Mus musculus
ctctccagcctgctccttgggtgga

SEQ ID NO: 396079 - DNA, 25 bp, Mus musculus
caagctccacccatgggcgtggtca

SEQ ID NO: 396080 - DNA, 25 bp, Mus musculus
ggaaatacccatatttggccttata

SEQ ID NO: 396081 - DNA, 25 bp, Mus musculus
tcacgtcacaggacgcgcactcatt

SEQ ID NO: 396082 - DNA, 25 bp, Mus musculus
ttggccttatatgggcactcacgtc

SEQ ID NO: 396083 - DNA, 25 bp, Mus musculus
ctcattcacataaaacgctgcgctg

SEQ ID NO: 396084 - DNA, 25 bp, Mus musculus
accggcggacttgaggtccctatgc

SEQ ID NO: 396085 - DNA, 25 bp, Mus musculus
tagccttcggaggaggcagcactca

SEQ ID NO: 396086 - DNA, 25 bp, Mus musculus
tcgacgacccttccgattactttga

SEQ ID NO: 396087 - DNA, 25 bp, Mus musculus
ctgcgaacacacaccggcggacttg

SEQ ID NO: 396088 - DNA, 25 bp, Mus musculus
agcttgtaggtgaagacgctgccga

SEQ ID NO: 396089 - DNA, 25 bp, Mus musculus
agcggaccggcatctcggaagcgat

SEQ ID NO: 396090 - DNA, 25 bp, Mus musculus
agctctaccggctgcacttggaggc

SEQ ID NO: 396091 - DNA, 25 bp, Mus musculus
ctaccggaccatcgctaggtgctgc

SEQ ID NO: 396092 - DNA, 25 bp, Mus musculus
ttgctgctaagtggacgcgactcga

SEQ ID NO: 396093 - DNA, 25 bp, Mus musculus
aggctgctctgctgaaggtgaatca

SEQ ID NO: 396094 - DNA, 25 bp, Mus musculus
gaaggtgaatcaccgcgtccaattg

SEQ ID NO: 396095 - DNA, 25 bp, Mus musculus
gcgtccaattgcctttccctagaga

SEQ ID NO: 396096 - DNA, 25 bp, Mus musculus
aaaagtcctcgctcgccgctcaaag

SEQ ID NO: 396097 - DNA, 25 bp, Mus musculus
ccgattactttgacactgtgggata

SEQ ID NO: 396098 - DNA, 25 bp, Mus musculus
agagctcatgctggtcattggcgcc

SEQ ID NO: 396099 - DNA, 25 bp, Mus musculus
tttgacgtgcgcttgggaggtcctt

SEQ ID NO: 396100 - DNA, 25 bp, Mus musculus
cctttcctcgaaagcgtctggcatc

SEQ ID NO: 396101 - DNA, 25 bp, Mus musculus
ttcctcgaaagcgtctggcatcctg

SEQ ID NO: 396102 - DNA, 25 bp, Mus musculus
tcgaaagcgtctggcatcctgtctg

SEQ ID NO: 396103 - DNA, 25 bp, Mus musculus
ttgcaacacgtcagcgcccagggct

SEQ ID NO: 396104 - DNA, 25 bp, Mus musculus
gggcccagagctcatgctggtcatt

SEQ ID NO: 396105 - DNA, 25 bp, Mus musculus
atgctggtcattggcgccgttggca

SEQ ID NO: 396106 - DNA, 25 bp, Mus musculus
gggtcggaacctttctgtacagatc

SEQ ID NO: 396107 - DNA, 25 bp, Mus musculus
ctttctgtacagatcagcgcgatca

SEQ ID NO: 396108 - DNA, 25 bp, Mus musculus
cagatcagcgcgatcaaacaagttg

SEQ ID NO: 396109 - DNA, 25 bp, Mus musculus
cgcgatcaaacaagttgagaccctc

SEQ ID NO: 396110 - DNA, 25 bp, Mus musculus
agttgagaccctcccccaggagagt

SEQ ID NO: 396111 - DNA, 25 bp, Mus musculus
gcgggcggtgctccctaatagttcc

SEQ ID NO: 396112 - DNA, 25 bp, Mus musculus
gctcactcggttgtgtgttgtgtca

SEQ ID NO: 396113 - DNA, 25 bp, Mus musculus
tgtgtcaaaatgctcttttcgcgcg

SEQ ID NO: 396114 - DNA, 25 bp, Mus musculus
ctcactcggttgtgtgttgtgtcaa

SEQ ID NO: 396115 - DNA, 25 bp, Mus musculus
tcactcggttgtgtgttgtgtcaaa

SEQ ID NO: 396116 - DNA, 25 bp, Mus musculus
cactcggttgtgtgttgtgtcaaaa

SEQ ID NO: 396117 - DNA, 25 bp, Mus musculus
ctcggttgtgtgttgtgtcaaaatg

SEQ ID NO: 396118 - DNA, 25 bp, Mus musculus
gtgtcaaaatgctcttttcgcgcgc

SEQ ID NO: 396119 - DNA, 25 bp, Mus musculus
tcggttgtgtgttgtgtcaaaatgc

SEQ ID NO: 396120 - DNA, 25 bp, Mus musculus
ggttgtgtgttgtgtcaaaatgctc

SEQ ID NO: 396121 - DNA, 25 bp, Mus musculus
tgtgtgttgtgtcaaaatgctcttt

SEQ ID NO: 396122 - DNA, 25 bp, Mus musculus
tgtgttgtgtcaaaatgctcttttc

SEQ ID NO: 396123 - DNA, 25 bp, Mus musculus
gtgttgtgtcaaaatgctcttttcg

SEQ ID NO: 396124 - DNA, 25 bp, Mus musculus
gttgtgtcaaaatgctcttttcgcg

SEQ ID NO: 396125 - DNA, 25 bp, Mus musculus
tgctcactcggttgtgtgttgtgtc

SEQ ID NO: 396126 - DNA, 25 bp, Mus musculus
cagagcctcacaagtgcgtcgcaca

SEQ ID NO: 396127 - DNA, 25 bp, Mus musculus
gacaggcacagttgtcccggtcacc

SEQ ID NO: 396128 - DNA, 25 bp, Mus musculus
tgctactcactgtgcctcgggtgga

SEQ ID NO: 396129 - DNA, 25 bp, Mus musculus
agcctgtgagctccggaagaaacta

SEQ ID NO: 396130 - DNA, 25 bp, Mus musculus
tccagccgcaggaggatgccaagcc

SEQ ID NO: 396131 - DNA, 25 bp, Mus musculus
gatgtgacagtgtcgggtccttcca

SEQ ID NO: 396132 - DNA, 25 bp, Mus musculus
tgggctccgggcaattaacagagtc

SEQ ID NO: 396133 - DNA, 25 bp, Mus musculus
cgccaccgagaaggacaaggggact

SEQ ID NO: 396134 - DNA, 25 bp, Mus musculus
tccagagacgctgccaataaatatg

SEQ ID NO: 396135 - DNA, 25 bp, Mus musculus
cagagtcggtgaactctcttcctta

SEQ ID NO: 396136 - DNA, 25 bp, Mus musculus
cccacccacctagggaaggatgtga

SEQ ID NO: 396137 - DNA, 25 bp, Mus musculus
cccgaagcgacagctggaactacca

SEQ ID NO: 396138 - DNA, 25 bp, Mus musculus
aatgaatccactgctaccctgtccg

SEQ ID NO: 396139 - DNA, 25 bp, Mus musculus
ttcttttgctctcgtgggaaaattc

SEQ ID NO: 396140 - DNA, 25 bp, Mus musculus
agcgggtcccaagcccagcgcgcat

SEQ ID NO: 396141 - DNA, 25 bp, Mus musculus
agctcggccgccacgattggctgcg

SEQ ID NO: 396142 - DNA, 25 bp, Mus musculus
cacaacccggccctctgcacttaac

SEQ ID NO: 396143 - DNA, 25 bp, Mus musculus
tcggccaatagacgccacgccgtcg

SEQ ID NO: 396144 - DNA, 25 bp, Mus musculus
ggacgtcctcctctcggccaataga

SEQ ID NO: 396145 - DNA, 25 bp, Mus musculus
cccgctttcacaacccggccctctg

SEQ ID NO: 396146 - DNA, 25 bp, Mus musculus
aacaaacagagcgagcggggccaga

SEQ ID NO: 396147 - DNA, 25 bp, Mus musculus
ggtcgggacgctcggtccctgtcca

SEQ ID NO: 396148 - DNA, 25 bp, Mus musculus
ggtccctgtccacgctggccctgga

SEQ ID NO: 396149 - DNA, 25 bp, Mus musculus
gagctgccggtgctcgctctccgag

SEQ ID NO: 396150 - DNA, 25 bp, Mus musculus
tgcgctcgcggtgagaggagcctcc

SEQ ID NO: 396151 - DNA, 25 bp, Mus musculus
cgcccggtccgacgcagttggacgc

SEQ ID NO: 396152 - DNA, 25 bp, Mus musculus
tcgtccggacggagatccggtgagg

SEQ ID NO: 396153 - DNA, 25 bp, Mus musculus
gccacgattggctgcgggacgtcct

SEQ ID NO: 396154 - DNA, 25 bp, Mus musculus
catcatcaattatggctgcctgggc

SEQ ID NO: 396155 - DNA, 25 bp, Mus musculus
ccggcagttcccgatcgcgaattaa

SEQ ID NO: 396156 - DNA, 25 bp, Mus musculus
ttctaggtaagcgatcaggggctcc

SEQ ID NO: 396157 - DNA, 25 bp, Mus musculus
ggtctggcaagcaaaccggcagttc

SEQ ID NO: 396158 - DNA, 25 bp, Mus musculus
gaggcttttctctgtggcggagcta

SEQ ID NO: 396159 - DNA, 25 bp, Mus musculus
tcaaacgggtgacaggaaacgcctc

SEQ ID NO: 396160 - DNA, 25 bp, Mus musculus
tggcgccaaggtttccctctgattg

SEQ ID NO: 396161 - DNA, 25 bp, Mus musculus
cgcgaattaactcgcccagtgtgga

SEQ ID NO: 396162 - DNA, 25 bp, Mus musculus
gagtcgtttctctacccggctggag

SEQ ID NO: 396163 - DNA, 25 bp, Mus musculus
ctgcctgggcttcaaccgtaacttc

SEQ ID NO: 396164 - DNA, 25 bp, Mus musculus
ggaaacgcctcctgccatcatcaat

SEQ ID NO: 396165 - DNA, 25 bp, Mus musculus
acttacaggtgcatccctttccaga

SEQ ID NO: 396166 - DNA, 25 bp, Mus musculus
tgtgtgcacatcctccgtaagtata

SEQ ID NO: 396167 - DNA, 25 bp, Mus musculus
cctctgattgggtgactgcttttgc

SEQ ID NO: 396168 - DNA, 25 bp, Mus musculus
tgtgcgccatcagccttgaccgcta

SEQ ID NO: 396169 - DNA, 25 bp, Mus musculus
gtgttcaccagtcgcgcgctcaaag

SEQ ID NO: 396170 - DNA, 25 bp, Mus musculus
ggtatgtcatctcctcgtccatcgg

SEQ ID NO: 396171 - DNA, 25 bp, Mus musculus
cggccgagccaagctgcaagatcaa

SEQ ID NO: 396172 - DNA, 25 bp, Mus musculus
ccgcgtcgcatcaaggccatcattg

SEQ ID NO: 396173 - DNA, 25 bp, Mus musculus
ggtccatcacgcaggccatcgagta

SEQ ID NO: 396174 - DNA, 25 bp, Mus musculus
ttggctctcgacgtgctcttttgca

SEQ ID NO: 396175 - DNA, 25 bp, Mus musculus
tcctgccgcttagaaataaaacttg

SEQ ID NO: 396176 - DNA, 25 bp, Mus musculus
ctgcggccctcttccttatgtgagg

SEQ ID NO: 396177 - DNA, 25 bp, Mus musculus
ccgcgttcatgttccgccaggagca

SEQ ID NO: 396178 - DNA, 25 bp, Mus musculus
ccttactccctgcaggtgacactga

SEQ ID NO: 396179 - DNA, 25 bp, Mus musculus
tgacactgacgctggtttgcctggc

SEQ ID NO: 396180 - DNA, 25 bp, Mus musculus
tggcctgctcatgctgttcacagta

SEQ ID NO: 396181 - DNA, 25 bp, Mus musculus
cgtgctggttattatcgcggtgttc

SEQ ID NO: 396182 - DNA, 25 bp, Mus musculus
ttcacaccctgggtcggacagctct

SEQ ID NO: 396183 - DNA, 25 bp, Mus musculus
ggttccattgtaagcgccacaaatg

SEQ ID NO: 396184 - DNA, 25 bp, Mus musculus
acaaatgggcgcctcctgatgacgc

SEQ ID NO: 396185 - DNA, 25 bp, Mus musculus
tcctgatgacgcacacggaagcgtc

SEQ ID NO: 396186 - DNA, 25 bp, Mus musculus
gaagcgtcgacacctcctggagaaa

SEQ ID NO: 396187 - DNA, 25 bp, Mus musculus
tcctggagaaagagaatcctgcgca

SEQ ID NO: 396188 - DNA, 25 bp, Mus musculus
tgcgcagcactgttccggagatcaa

SEQ ID NO: 396189 - DNA, 25 bp, Mus musculus
cagtgtctgcggtgcgtatggccac

SEQ ID NO: 396190 - DNA, 25 bp, Mus musculus
ttgggctttccggatcggagctaaa

SEQ ID NO: 396191 - DNA, 25 bp, Mus musculus
cggatcggagctaaagcagagactt

SEQ ID NO: 396192 - DNA, 25 bp, Mus musculus
gcagagacttaaccggcccgactcg

SEQ ID NO: 396193 - DNA, 25 bp, Mus musculus
atcgaggtgggatagttccttgcgc

SEQ ID NO: 396194 - DNA, 25 bp, Mus musculus
cggcatgcctggacaccagtggttc

SEQ ID NO: 396195 - DNA, 25 bp, Mus musculus
acagctctccgggagtcctggacgt

SEQ ID NO: 396196 - DNA, 25 bp, Mus musculus
ataccgtgcccacccatccgggagc

SEQ ID NO: 396197 - DNA, 25 bp, Mus musculus
agcgtgctgggatgtcagccctgct

SEQ ID NO: 396198 - DNA, 25 bp, Mus musculus
cagccctgctggtgctgtcactgca

SEQ ID NO: 396199 - DNA, 25 bp, Mus musculus
tggtgctgtcactgcagcccggtcc

SEQ ID NO: 396200 - DNA, 25 bp, Mus musculus
ggtccctggagcgataccgtgccca

SEQ ID NO: 396201 - DNA, 25 bp, Mus musculus
ccggactcttgcaaagcctcgggcg

SEQ ID NO: 396202 - DNA, 25 bp, Mus musculus
tcttgcaaagcctcgggcgggccca

SEQ ID NO: 396203 - DNA, 25 bp, Mus musculus
gcaccgcgcacagcgcaccgcgctc

SEQ ID NO: 396204 - DNA, 25 bp, Mus musculus
cagctcgcgcctgggcgcacgcagc

SEQ ID NO: 396205 - DNA, 25 bp, Mus musculus
agctgccagcgcttcggctctgcgc

SEQ ID NO: 396206 - DNA, 25 bp, Mus musculus
ctgccggccgccaggcttagcgtaa

SEQ ID NO: 396207 - DNA, 25 bp, Mus musculus
ccaggcttagcgtaaggcgcttgga

SEQ ID NO: 396208 - DNA, 25 bp, Mus musculus
gagcggcgcccacccacgcacctga

SEQ ID NO: 396209 - DNA, 25 bp, Mus musculus
agcccggtccctggagcgataccgt

SEQ ID NO: 396210 - DNA, 25 bp, Mus musculus
ggatgctctgggatcttcactcaca

SEQ ID NO: 396211 - DNA, 25 bp, Mus musculus
gagctgccatgtcttccgacttcga

SEQ ID NO: 396212 - DNA, 25 bp, Mus musculus
acccgagagcatgtgggctttcgta

SEQ ID NO: 396213 - DNA, 25 bp, Mus musculus
gcccgcgcctgcaacttagagtttg

SEQ ID NO: 396214 - DNA, 25 bp, Mus musculus
tgagcaagccgaatgcgaaccctga

SEQ ID NO: 396215 - DNA, 25 bp, Mus musculus
tagctctgtcatgagcgcttcagtc

SEQ ID NO: 396216 - DNA, 25 bp, Mus musculus
cgggctcagcggaacagattttctc

SEQ ID NO: 396217 - DNA, 25 bp, Mus musculus
tgcggtgactcccacctcagtctgg

SEQ ID NO: 396218 - DNA, 25 bp, Mus musculus
cagtttcccgcccatgtagtggtgc

SEQ ID NO: 396219 - DNA, 25 bp, Mus musculus
attcccacggagcagatgcgccagc

SEQ ID NO: 396220 - DNA, 25 bp, Mus musculus
gccgggaaaagacctatgacacatg

SEQ ID NO: 396221 - DNA, 25 bp, Mus musculus
cttcgaagggtacgagcaggacttc

SEQ ID NO: 396222 - DNA, 25 bp, Mus musculus
cacagccatcgcatttccgggacgg

SEQ ID NO: 396223 - DNA, 25 bp, Mus musculus
cgcggcgtcaatcttccctcggaaa

SEQ ID NO: 396224 - DNA, 25 bp, Mus musculus
tctcattaaggcgagtgtgttcctc

SEQ ID NO: 396225 - DNA, 25 bp, Mus musculus
cagactactccgttcctccggattt

SEQ ID NO: 396226 - DNA, 25 bp, Mus musculus
gtccgcattgtctttcggaacccgc

SEQ ID NO: 396227 - DNA, 25 bp, Mus musculus
cctccaggagcgaggcccgcaccgt

SEQ ID NO: 396228 - DNA, 25 bp, Mus musculus
ctcgcacgctgagcacaggccgcac

SEQ ID NO: 396229 - DNA, 25 bp, Mus musculus
tcccggcgcccaaaggatcattgtt

SEQ ID NO: 396230 - DNA, 25 bp, Mus musculus
cccaaaggatcattgttggccgccc

SEQ ID NO: 396231 - DNA, 25 bp, Mus musculus
ccggctgtttatttatgcacacgtc

SEQ ID NO: 396232 - DNA, 25 bp, Mus musculus
tttatttatgcacacgtcaccgggg

SEQ ID NO: 396233 - DNA, 25 bp, Mus musculus
ctggcatctcattaaggcgagtgtg

SEQ ID NO: 396234 - DNA, 25 bp, Mus musculus
gagtgtgttcctctcgccctgtcaa

SEQ ID NO: 396235 - DNA, 25 bp, Mus musculus
gtgtgttcctctcgccctgtcaata

SEQ ID NO: 396236 - DNA, 25 bp, Mus musculus
tgtcaataatctccgctcccagact

SEQ ID NO: 396237 - DNA, 25 bp, Mus musculus
tatgcacacgtcaccggggaggccc

SEQ ID NO: 396238 - DNA, 25 bp, Mus musculus
ttacctgactctgacacccggtgcg

SEQ ID NO: 396239 - DNA, 25 bp, Mus musculus
ctggcagtgcccgcctgatgttccg

SEQ ID NO: 396240 - DNA, 25 bp, Mus musculus
ggaggcgccacagcatagttgagca

SEQ ID NO: 396241 - DNA, 25 bp, Mus musculus
acagcatagttgagcagcgccagca

SEQ ID NO: 396242 - DNA, 25 bp, Mus musculus
ctggtggcctcgaccctgagacttc

SEQ ID NO: 396243 - DNA, 25 bp, Mus musculus
gagacttctgaatccccgaaccttg

SEQ ID NO: 396244 - DNA, 25 bp, Mus musculus
gggaccctgaagctcccgccgcagc

SEQ ID NO: 396245 - DNA, 25 bp, Mus musculus
tcggcttcgggattttttgtctata

SEQ ID NO: 396246 - DNA, 25 bp, Mus musculus
ttttgtctatataagggctcgaggc

SEQ ID NO: 396247 - DNA, 25 bp, Mus musculus
tataagggctcgaggcacttggagc

SEQ ID NO: 396248 - DNA, 25 bp, Mus musculus
ggcaccggctgccatttctccgcac

SEQ ID NO: 396249 - DNA, 25 bp, Mus musculus
tgatgttccgccgtgcccagaggag

SEQ ID NO: 396250 - DNA, 25 bp, Mus musculus
ggagcaccgcctttacctgactctg

SEQ ID NO: 396251 - DNA, 25 bp, Mus musculus
tgcggtccctgggtaacctcactcg

SEQ ID NO: 396252 - DNA, 25 bp, Mus musculus
tggctgcgaaaacttgtaaccgtgt

SEQ ID NO: 396253 - DNA, 25 bp, Mus musculus
gatgtcaagtcctcgctggtcaatg

SEQ ID NO: 396254 - DNA, 25 bp, Mus musculus
tctccgccgaccctcccttcccgca

SEQ ID NO: 396255 - DNA, 25 bp, Mus musculus
tggtcaatgaatcagagacgaatca

SEQ ID NO: 396256 - DNA, 25 bp, Mus musculus
agacgaatcaaaacagctcctccga

SEQ ID NO: 396257 - DNA, 25 bp, Mus musculus
atcaaaacagctcctccgattccga

SEQ ID NO: 396258 - DNA, 25 bp, Mus musculus
tcctccgattccgaggtaggaagag

SEQ ID NO: 396259 - DNA, 25 bp, Mus musculus
tccgattccgaggtaggaagagccc

SEQ ID NO: 396260 - DNA, 25 bp, Mus musculus
tccagccggttccagggccgggaga

SEQ ID NO: 396261 - DNA, 25 bp, Mus musculus
gggatttagccgatgtcaagtcctc

SEQ ID NO: 396262 - DNA, 25 bp, Mus musculus
tgctggctgcgaaaacttgtaaccg

SEQ ID NO: 396263 - DNA, 25 bp, Mus musculus
gccgatgtcaagtcctcgctggtca

SEQ ID NO: 396264 - DNA, 25 bp, Mus musculus
gctgctggctgcgaaaacttgtaac

SEQ ID NO: 396265 - DNA, 25 bp, Mus musculus
caagtcctcgctggtcaatgaatca

SEQ ID NO: 396266 - DNA, 25 bp, Mus musculus
atccgcgcggcagcatgcctgcgag

SEQ ID NO: 396267 - DNA, 25 bp, Mus musculus
tgaatggaactgtgcctgagtatcc

SEQ ID NO: 396268 - DNA, 25 bp, Mus musculus
tgtgcctgagtatccggcgcggcac

SEQ ID NO: 396269 - DNA, 25 bp, Mus musculus
ctgtgaatggaactgtgcctgagta

SEQ ID NO: 396270 - DNA, 25 bp, Mus musculus
tcgctgtgaatggaactgtgcctga

SEQ ID NO: 396271 - DNA, 25 bp, Mus musculus
cgcttcgctgtgaatggaactgtgc

SEQ ID NO: 396272 - DNA, 25 bp, Mus musculus
tgtgcgcttcgctgtgaatggaact

SEQ ID NO: 396273 - DNA, 25 bp, Mus musculus
tattgtgcgcttcgctgtgaatgga

SEQ ID NO: 396274 - DNA, 25 bp, Mus musculus
cgttattgtgcgcttcgctgtgaat

SEQ ID NO: 396275 - DNA, 25 bp, Mus musculus
ggggagatccccgttattgtgcgct

SEQ ID NO: 396276 - DNA, 25 bp, Mus musculus
agcatgcctgcgagccagcagcggc

SEQ ID NO: 396277 - DNA, 25 bp, Mus musculus
aactgtgcctgagtatccggcgcgg

SEQ ID NO: 396278 - DNA, 25 bp, Mus musculus
cggcagcatgcctgcgagccagcag

SEQ ID NO: 396279 - DNA, 25 bp, Mus musculus
atggaactgtgcctgagtatccggc

SEQ ID NO: 396280 - DNA, 25 bp, Mus musculus
ggtctcacgacatccggtgccattc

SEQ ID NO: 396281 - DNA, 25 bp, Mus musculus
cgcggaaggctctccaacatgcctg

SEQ ID NO: 396282 - DNA, 25 bp, Mus musculus
ggcggtcccttggtcttctggacca

SEQ ID NO: 396283 - DNA, 25 bp, Mus musculus
ttcagttttcccaaagctgccctcg

SEQ ID NO: 396284 - DNA, 25 bp, Mus musculus
cgcaggctcgcagaacttgcttgca

SEQ ID NO: 396285 - DNA, 25 bp, Mus musculus
gaacggtaacttgggccgccatcgc

SEQ ID NO: 396286 - DNA, 25 bp, Mus musculus
ccaagcgcgcagtcatattttcaga

SEQ ID NO: 396287 - DNA, 25 bp, Mus musculus
ggtgacgcttgccaacttcgcagag

SEQ ID NO: 396288 - DNA, 25 bp, Mus musculus
cttcgcagaggtctggaccaagcgc

SEQ ID NO: 396289 - DNA, 25 bp, Mus musculus
tccgcctctgggacttttgctttca

SEQ ID NO: 396290 - DNA, 25 bp, Mus musculus
taacagatttgcagcaggtagcccg

SEQ ID NO: 396291 - DNA, 25 bp, Mus musculus
ggcagttttgcagagcccgccagtt

SEQ ID NO: 396292 - DNA, 25 bp, Mus musculus
aaagctgccctcgacccttgcggag

SEQ ID NO: 396293 - DNA, 25 bp, Mus musculus
gtagggagcgctctatctgcccagt

SEQ ID NO: 396294 - DNA, 25 bp, Mus musculus
gcgctctgaacgtccaggcttcgcg

SEQ ID NO: 396295 - DNA, 25 bp, Mus musculus
cagcagatcggtgccctgcggtcct

SEQ ID NO: 396296 - DNA, 25 bp, Mus musculus
cccgtgtcgaatctggcgctctgaa

SEQ ID NO: 396297 - DNA, 25 bp, Mus musculus
ctctggagtttaattacgcgccagg

SEQ ID NO: 396298 - DNA, 25 bp, Mus musculus
gcacggccctttggactttggcgtc

SEQ ID NO: 396299 - DNA, 25 bp, Mus musculus
gagccctcgggagctcgcgcaacat

SEQ ID NO: 396300 - DNA, 25 bp, Mus musculus
ggagctcgcgcaacatggcggctcc

SEQ ID NO: 396301 - DNA, 25 bp, Mus musculus
tcgagtacgccctgctggacgccgt

SEQ ID NO: 396302 - DNA, 25 bp, Mus musculus
tggacgccgtcacccagcaagagaa

SEQ ID NO: 396303 - DNA, 25 bp, Mus musculus
ccagcaagagaaggatgagttggtc

SEQ ID NO: 396304 - DNA, 25 bp, Mus musculus
agttggtctaccagtatctgcagaa

SEQ ID NO: 396305 - DNA, 25 bp, Mus musculus
cagtatctgcagaaggtggacggct

SEQ ID NO: 396306 - DNA, 25 bp, Mus musculus
ttacgcgccagggaagcacggccct

SEQ ID NO: 396307 - DNA, 25 bp, Mus musculus
caggacctagcggtgcccgagtttc

SEQ ID NO: 396308 - DNA, 25 bp, Mus musculus
gcaaggctttccagcgcctgctctg

SEQ ID NO: 396309 - DNA, 25 bp, Mus musculus
tcatcatgtccctggccagcgctga

SEQ ID NO: 396310 - DNA, 25 bp, Mus musculus
agcgctgatctggtcatgggattgc

SEQ ID NO: 396311 - DNA, 25 bp, Mus musculus
ccttcttctgcgagctctggacttc

SEQ ID NO: 396312 - DNA, 25 bp, Mus musculus
attgagaccctgtgtgtcatcgccc

SEQ ID NO: 396313 - DNA, 25 bp, Mus musculus
gtcgccctttcgctaccagagtttg

SEQ ID NO: 396314 - DNA, 25 bp, Mus musculus
gcgatttcgtcaccaacagggccta

SEQ ID NO: 396315 - DNA, 25 bp, Mus musculus
ccctgtgcatcatggccttcgtgta

SEQ ID NO: 396316 - DNA, 25 bp, Mus musculus
gaaggcgctcaagacactgggcatc

SEQ ID NO: 396317 - DNA, 25 bp, Mus musculus
catcatcatgggtgtgttcacgctc

SEQ ID NO: 396318 - DNA, 25 bp, Mus musculus
cctggccaacgtggtgaaggctttc

SEQ ID NO: 396319 - DNA, 25 bp, Mus musculus
tgaaggctttccaccgcgacctggt

SEQ ID NO: 396320 - DNA, 25 bp, Mus musculus
cttcgtcttcttcaactggctgggc

SEQ ID NO: 396321 - DNA, 25 bp, Mus musculus
atcgttctgctcatcgtggtgggta

SEQ ID NO: 396322 - DNA, 25 bp, Mus musculus
aagtcacgcgcggagaccactgcag

SEQ ID NO: 396323 - DNA, 25 bp, Mus musculus
gcggaccgcgtgacgttaagcacct

SEQ ID NO: 396324 - DNA, 25 bp, Mus musculus
ggctccctgaacgagccaatcagcg

SEQ ID NO: 396325 - DNA, 25 bp, Mus musculus
aaagatggcggcgacgcctaagccg

SEQ ID NO: 396326 - DNA, 25 bp, Mus musculus
ccctgcggagctgacacatcaacaa

SEQ ID NO: 396327 - DNA, 25 bp, Mus musculus
gagaccactgcagatcccgggctct

SEQ ID NO: 396328 - DNA, 25 bp, Mus musculus
gccgacgaacccatggcggcgtgta

SEQ ID NO: 396329 - DNA, 25 bp, Mus musculus
gcaccctagcgaggccgatggagct

SEQ ID NO: 396330 - DNA, 25 bp, Mus musculus
gagttgcgtacagcccggggctacc

SEQ ID NO: 396331 - DNA, 25 bp, Mus musculus
cgcgtgacgttaagcacctggaggc

SEQ ID NO: 396332 - DNA, 25 bp, Mus musculus
cgtggttttcgaggcgccgcctcca

SEQ ID NO: 396333 - DNA, 25 bp, Mus musculus
ccagtcctcgcggtttctagaggcc

SEQ ID NO: 396334 - DNA, 25 bp, Mus musculus
cgtccacgcgcggagttgcgtacag

SEQ ID NO: 396335 - DNA, 25 bp, Mus musculus
atcccgggctctcagcggaggtttt

SEQ ID NO: 396336 - DNA, 25 bp, Mus musculus
agctcggtttccaagacggtctcgg

SEQ ID NO: 396337 - DNA, 25 bp, Mus musculus
accacgcggcggctttgagcgtccg

SEQ ID NO: 396338 - DNA, 25 bp, Mus musculus
ctgcgcgcacgtgggagtaaactgc

SEQ ID NO: 396339 - DNA, 25 bp, Mus musculus
cgcgcacgtgggagtaaactgcgca

SEQ ID NO: 396340 - DNA, 25 bp, Mus musculus
agccggaagtccagagctggacgtt

SEQ ID NO: 396341 - DNA, 25 bp, Mus musculus
ctccggagctcggtttccaagacgg

SEQ ID NO: 396342 - DNA, 25 bp, Mus musculus
ccagtccgggccagcgccctttctt

SEQ ID NO: 396343 - DNA, 25 bp, Mus musculus
ttcagaaaccagtccgggccagcgc

SEQ ID NO: 396344 - DNA, 25 bp, Mus musculus
agcttcagaaaccagtccgggccag

SEQ ID NO: 396345 - DNA, 25 bp, Mus musculus
gcatgagtggtcagcttcagaaacc

SEQ ID NO: 396346 - DNA, 25 bp, Mus musculus
agggcaaacgccagcatgagtggtc

SEQ ID NO: 396347 - DNA, 25 bp, Mus musculus
agctcctggacctcggagctgcggg

SEQ ID NO: 396348 - DNA, 25 bp, Mus musculus
tgagcacgggtggagctcctggacc

SEQ ID NO: 396349 - DNA, 25 bp, Mus musculus
aagtccagagctggacgttgaggtc

SEQ ID NO: 396350 - DNA, 25 bp, Mus musculus
cgagttgacaagctccaggagatcc

SEQ ID NO: 396351 - DNA, 25 bp, Mus musculus
ctcgcgtgacagacgcttgggacca

SEQ ID NO: 396352 - DNA, 25 bp, Mus musculus
ttgggaccaccaatccgcatagtca

SEQ ID NO: 396353 - DNA, 25 bp, Mus musculus
tcagtcaaacgcgagaggcgcattc

SEQ ID NO: 396354 - DNA, 25 bp, Mus musculus
ctcgactccacttcgattggctttg

SEQ ID NO: 396355 - DNA, 25 bp, Mus musculus
tgtgtagctccggatgcgaagaagc

SEQ ID NO: 396356 - DNA, 25 bp, Mus musculus
cccaaaatggcggacgtatcaagca

SEQ ID NO: 396357 - DNA, 25 bp, Mus musculus
aggcgcccaagacccgcagttagtc

SEQ ID NO: 396358 - DNA, 25 bp, Mus musculus
atcccgagaagtcgctgtgaaggcc

SEQ ID NO: 396359 - DNA, 25 bp, Mus musculus
gtcacctcggcgtccaaagttcgca

SEQ ID NO: 396360 - DNA, 25 bp, Mus musculus
gaggcgcattctttttcccatggtc

SEQ ID NO: 396361 - DNA, 25 bp, Mus musculus
ggtcttgacggatccggaacctcta

SEQ ID NO: 396362 - DNA, 25 bp, Mus musculus
ggttcaccgacaccatcagcgaagc

SEQ ID NO: 396363 - DNA, 25 bp, Mus musculus
ccttcacacggatcattggcttgtc

SEQ ID NO: 396364 - DNA, 25 bp, Mus musculus
tgcagcggcaggctaggcaatgcca

SEQ ID NO: 396365 - DNA, 25 bp, Mus musculus
gctcgaaggctcgtgcacactggct

SEQ ID NO: 396366 - DNA, 25 bp, Mus musculus
gagagcatcgctggctcgaaggctc

SEQ ID NO: 396367 - DNA, 25 bp, Mus musculus
agcccagcgctgtgcagcccttgag

SEQ ID NO: 396368 - DNA, 25 bp, Mus musculus
caactgggcccagccggctacggaa

SEQ ID NO: 396369 - DNA, 25 bp, Mus musculus
acgggagaccaggacaccgccttca

SEQ ID NO: 396370 - DNA, 25 bp, Mus musculus
gcttcatatggaccacgggagacca

SEQ ID NO: 396371 - DNA, 25 bp, Mus musculus
cactgcggggcttcatatggaccac

SEQ ID NO: 396372 - DNA, 25 bp, Mus musculus
aggctaggcaatgccagccgcagcg

SEQ ID NO: 396373 - DNA, 25 bp, Mus musculus
ccaacgggctgctatggattgggtt

SEQ ID NO: 396374 - DNA, 25 bp, Mus musculus
acattcctggaagcttggcgggcgt

SEQ ID NO: 396375 - DNA, 25 bp, Mus musculus
ggcgccgcacattcctggaagcttg

SEQ ID NO: 396376 - DNA, 25 bp, Mus musculus
cccagcagctgctacgcgctctttc

SEQ ID NO: 396377 - DNA, 25 bp, Mus musculus
gcgtcgcgatgctgctgcgcctgct

SEQ ID NO: 396378 - DNA, 25 bp, Mus musculus
cacgccttccaacaactggggcggg

SEQ ID NO: 396379 - DNA, 25 bp, Mus musculus
ccgccggctttgttcgctttgtcct

SEQ ID NO: 396380 - DNA, 25 bp, Mus musculus
tgctgggagagaccaacaggtgccc

SEQ ID NO: 396381 - DNA, 25 bp, Mus musculus
cttgcagcggccaggtcgctcggaa

SEQ ID NO: 396382 - DNA, 25 bp, Mus musculus
ttcgctttgtcctcgcgcacctaag

SEQ ID NO: 396383 - DNA, 25 bp, Mus musculus
cgcacccttgccagtgagcgagcga

SEQ ID NO: 396384 - DNA, 25 bp, Mus musculus
ggtgggagcccacgccttccaacaa

SEQ ID NO: 396385 - DNA, 25 bp, Mus musculus
tcccgcctctgctgggagagaccaa

SEQ ID NO: 396386 - DNA, 25 bp, Mus musculus
atcctcacaggctgcatccgagcgg

SEQ ID NO: 396387 - DNA, 25 bp, Mus musculus
aacgtccggatcctcacaggctgca

SEQ ID NO: 396388 - DNA, 25 bp, Mus musculus
tggagcaatagttgcgccgccctca

SEQ ID NO: 396389 - DNA, 25 bp, Mus musculus
cgcggttccctggagcaatagttgc

SEQ ID NO: 396390 - DNA, 25 bp, Mus musculus
tcgctcggaagtgttgatgatgctg

SEQ ID NO: 396391 - DNA, 25 bp, Mus musculus
ctggaagaacgccatcccggagagc

SEQ ID NO: 396392 - DNA, 25 bp, Mus musculus
gccttgttattgtcacgtggccgcg

SEQ ID NO: 396393 - DNA, 25 bp, Mus musculus
caggtgggttcttgagtcgccactc

SEQ ID NO: 396394 - DNA, 25 bp, Mus musculus
cgccgcaggcggaaaagtttctcgg

SEQ ID NO: 396395 - DNA, 25 bp, Mus musculus
agtttctcggcgtgccatcccgttc

SEQ ID NO: 396396 - DNA, 25 bp, Mus musculus
tggctctcccgctgtgcaggggcat

SEQ ID NO: 396397 - DNA, 25 bp, Mus musculus
tcttgagtcgccactcctaggccag

SEQ ID NO: 396398 - DNA, 25 bp, Mus musculus
cttcagtgcggggactgagccacca

SEQ ID NO: 396399 - DNA, 25 bp, Mus musculus
actgagccaccaggagcacgaggcg

SEQ ID NO: 396400 - DNA, 25 bp, Mus musculus
cagctcttggacgacgatgcgcagc

SEQ ID NO: 396401 - DNA, 25 bp, Mus musculus
cacacggctgtgagtatcagtatca

SEQ ID NO: 396402 - DNA, 25 bp, Mus musculus
atcagtatcattccggtggggtgaa

SEQ ID NO: 396403 - DNA, 25 bp, Mus musculus
gtgcgagaccagaagagtccgccta

SEQ ID NO: 396404 - DNA, 25 bp, Mus musculus
agagcgcactatacagcgcccaggc

SEQ ID NO: 396405 - DNA, 25 bp, Mus musculus
gggctggagccttgttattgtcacg

SEQ ID NO: 396406 - DNA, 25 bp, Mus musculus
cggacggcattctacgcccagaagc

SEQ ID NO: 396407 - DNA, 25 bp, Mus musculus
ggtcaggacaatcagcgctctggtc

SEQ ID NO: 396408 - DNA, 25 bp, Mus musculus
gaagactccgggaacagcgagctcc

SEQ ID NO: 396409 - DNA, 25 bp, Mus musculus
agcctgggacgtcctcaaagcccgg

SEQ ID NO: 396410 - DNA, 25 bp, Mus musculus
cgcgaaagaaagagcctgggacgtc

SEQ ID NO: 396411 - DNA, 25 bp, Mus musculus
cttcctccaagttggcccgagggcg

SEQ ID NO: 396412 - DNA, 25 bp, Mus musculus
cgaacgcagatcacttcctccaagt

SEQ ID NO: 396413 - DNA, 25 bp, Mus musculus
gggatctccacagccggtcaggaca

SEQ ID NO: 396414 - DNA, 25 bp, Mus musculus
cgcgctgagttctccgcgctggact

SEQ ID NO: 396415 - DNA, 25 bp, Mus musculus
cgctgctatcggctccgcgctgagt

SEQ ID NO: 396416 - DNA, 25 bp, Mus musculus
atacccggagcaagtaggtgcgccc

SEQ ID NO: 396417 - DNA, 25 bp, Mus musculus
gttctggacacctgagtccgggata

SEQ ID NO: 396418 - DNA, 25 bp, Mus musculus
ggtcgccctctctagggctgcggtc

SEQ ID NO: 396419 - DNA, 25 bp, Mus musculus
gggcgtagactgtccgttctggaca

SEQ ID NO: 396420 - DNA, 25 bp, Mus musculus
aggagaggatcccaagacgtgcaca

SEQ ID NO: 396421 - DNA, 25 bp, Mus musculus
gaccaaggtcaagggcgaccgcttc

SEQ ID NO: 396422 - DNA, 25 bp, Mus musculus
gcgaccgcttcctttcccagcctta

SEQ ID NO: 396423 - DNA, 25 bp, Mus musculus
ccgggaaccgctgccaaagtttcag

SEQ ID NO: 396424 - DNA, 25 bp, Mus musculus
ctgccaaagtttcaggccgggctgg

SEQ ID NO: 396425 - DNA, 25 bp, Mus musculus
actcacctcgggtggacatggctca

SEQ ID NO: 396426 - DNA, 25 bp, Mus musculus
aagacgtgcacacgggctcgcgcgt

SEQ ID NO: 396427 - DNA, 25 bp, Mus musculus
aggacacctgctcggctcgctggct

SEQ ID NO: 396428 - DNA, 25 bp, Mus musculus
cgctgctgacagctaaggccggctg

SEQ ID NO: 396429 - DNA, 25 bp, Mus musculus
ggcccactcgggtccagaggctgct

SEQ ID NO: 396430 - DNA, 25 bp, Mus musculus
actcactgcccgcttggccacggcg

SEQ ID NO: 396431 - DNA, 25 bp, Mus musculus
ttggccctcaggcttcgcccacatc

SEQ ID NO: 396432 - DNA, 25 bp, Mus musculus
ccacatccggcgaccaaggtcaagg

SEQ ID NO: 396433 - DNA, 25 bp, Mus musculus
ggctccgcacgccatcccacctggt

SEQ ID NO: 396434 - DNA, 25 bp, Mus musculus
cgtatggtacgcaagcgcagcgtca

SEQ ID NO: 396435 - DNA, 25 bp, Mus musculus
gttctccaagcttacgtccatcctg

SEQ ID NO: 396436 - DNA, 25 bp, Mus musculus
cttgcttttgctttggtacgggtga

SEQ ID NO: 396437 - DNA, 25 bp, Mus musculus
acactgctctctggtcaccgagaga

SEQ ID NO: 396438 - DNA, 25 bp, Mus musculus
tggtattttcccagcggccttccag

SEQ ID NO: 396439 - DNA, 25 bp, Mus musculus
gccttccagtcttgccctacgtatg

SEQ ID NO: 396440 - DNA, 25 bp, Mus musculus
tccatcctgcagcatgccgtggagg

SEQ ID NO: 396441 - DNA, 25 bp, Mus musculus
agcgtcaacacgtcgctgccaaatc

SEQ ID NO: 396442 - DNA, 25 bp, Mus musculus
tcaccgagagacgagtgccagcacc

SEQ ID NO: 396443 - DNA, 25 bp, Mus musculus
attgcagccgaacgacctcggagcc

SEQ ID NO: 396444 - DNA, 25 bp, Mus musculus
atcgaggagctctccaggtcgtccc

SEQ ID NO: 396445 - DNA, 25 bp, Mus musculus
agaagctgctgcagtcccgggacag

SEQ ID NO: 396446 - DNA, 25 bp, Mus musculus
ccagcgccgcgcaagacaaaagaac

SEQ ID NO: 396447 - DNA, 25 bp, Mus musculus
tcccgggacaggatgttctccaagc

SEQ ID NO: 396448 - DNA, 25 bp, Mus musculus
tacaaggttgccttcctgccgaggc

SEQ ID NO: 396449 - DNA, 25 bp, Mus musculus
gcactcccagcggtgcccgccggcc

SEQ ID NO: 396450 - DNA, 25 bp, Mus musculus
ggacgcactcccagcggtgcccgcc

SEQ ID NO: 396451 - DNA, 25 bp, Mus musculus
acctggggacgcactcccagcggtg

SEQ ID NO: 396452 - DNA, 25 bp, Mus musculus
cgcgggccacacctggggacgcact

SEQ ID NO: 396453 - DNA, 25 bp, Mus musculus
tgggtttctcctccgtgggctccgc

SEQ ID NO: 396454 - DNA, 25 bp, Mus musculus
acaaggttgccttcctgccgaggcc

SEQ ID NO: 396455 - DNA, 25 bp, Mus musculus
gtacaaggttgccttcctgccgagg

SEQ ID NO: 396456 - DNA, 25 bp, Mus musculus
gagtacaaggttgccttcctgccga

SEQ ID NO: 396457 - DNA, 25 bp, Mus musculus
cggagtacaaggttgccttcctgcc

SEQ ID NO: 396458 - DNA, 25 bp, Mus musculus
cgcggagtacaaggttgccttcctg

SEQ ID NO: 396459 - DNA, 25 bp, Mus musculus
ccgcggagtacaaggttgccttcct

SEQ ID NO: 396460 - DNA, 25 bp, Mus musculus
gcccgcggagtacaaggttgccttc

SEQ ID NO: 396461 - DNA, 25 bp, Mus musculus
gagtgggtttctcctccgtgggctc

SEQ ID NO: 396462 - DNA, 25 bp, Mus musculus
gctatggcttcctctacctggcgct

SEQ ID NO: 396463 - DNA, 25 bp, Mus musculus
gctgctgtgctatggcttcctctac

SEQ ID NO: 396464 - DNA, 25 bp, Mus musculus
tggcgctctatgctcaggtgtccca

SEQ ID NO: 396465 - DNA, 25 bp, Mus musculus
aacagctggctgctgtgctatggct

SEQ ID NO: 396466 - DNA, 25 bp, Mus musculus
cgctcccggagctaccgtggctgca

SEQ ID NO: 396467 - DNA, 25 bp, Mus musculus
gtgctcctgttggacgcgcccatct

SEQ ID NO: 396468 - DNA, 25 bp, Mus musculus
atctcaggctagcaggagtaccgcc

SEQ ID NO: 396469 - DNA, 25 bp, Mus musculus
gctgctgcggtatctcaggctagca

SEQ ID NO: 396470 - DNA, 25 bp, Mus musculus
cgcggccacagcaactgtgtctgga

SEQ ID NO: 396471 - DNA, 25 bp, Mus musculus
agtttgggctgcgaccgcggccaca

SEQ ID NO: 396472 - DNA, 25 bp, Mus musculus
gacgtctctccgcagtttgggctgc

SEQ ID NO: 396473 - DNA, 25 bp, Mus musculus
tacgcacaaggctgcggggacgtct

SEQ ID NO: 396474 - DNA, 25 bp, Mus musculus
tggccacgagagtgcgtacgcacaa

SEQ ID NO: 396475 - DNA, 25 bp, Mus musculus
ggaagcaggctgctgcggtatctca

SEQ ID NO: 396476 - DNA, 25 bp, Mus musculus
tgcaagaagccgtgctccctgagga

SEQ ID NO: 396477 - DNA, 25 bp, Mus musculus
actgccacctgctcgcgtaagtacg

SEQ ID NO: 396478 - DNA, 25 bp, Mus musculus
acagtgcctggagtggcagactgcc

SEQ ID NO: 396479 - DNA, 25 bp, Mus musculus
cctttccctacggacagtgcctgga

SEQ ID NO: 396480 - DNA, 25 bp, Mus musculus
tggactccaacgcttacatcatctc

SEQ ID NO: 396481 - DNA, 25 bp, Mus musculus
agcgctgcgtggactccaacgctta

SEQ ID NO: 396482 - DNA, 25 bp, Mus musculus
agcacgaagcgctgcgtggactcca

SEQ ID NO: 396483 - DNA, 25 bp, Mus musculus
tgcatgtggtgcagcagcacgaagc

SEQ ID NO: 396484 - DNA, 25 bp, Mus musculus
agaagccgtgctccctgaggacctc

SEQ ID NO: 396485 - DNA, 25 bp, Mus musculus
cgttctcggtccattccagtaagcc

SEQ ID NO: 396486 - DNA, 25 bp, Mus musculus
atcagaacgcgaggccgtgcaagaa

SEQ ID NO: 396487 - DNA, 25 bp, Mus musculus
ggtccattccagtaagcccaaatca

SEQ ID NO: 396488 - DNA, 25 bp, Mus musculus
gcccaaatcagaacgcgaggccgtg

SEQ ID NO: 396489 - DNA, 25 bp, Mus musculus
tgcgccaactgcacgagcagcggca

SEQ ID NO: 396490 - DNA, 25 bp, Mus musculus
ttggcacccttagcgctctgaacga

SEQ ID NO: 396491 - DNA, 25 bp, Mus musculus
gaagcaagcactcctgacccgctgg

SEQ ID NO: 396492 - DNA, 25 bp, Mus musculus
ccaggcacccgaggctgcagtgtct

SEQ ID NO: 396493 - DNA, 25 bp, Mus musculus
ctgcagtgtctcctggccagcagcg

SEQ ID NO: 396494 - DNA, 25 bp, Mus musculus
tctcctggccagcagcgggcaaaag

SEQ ID NO: 396495 - DNA, 25 bp, Mus musculus
ccagcagcgggcaaaagggcactga

SEQ ID NO: 396496 - DNA, 25 bp, Mus musculus
cccagcgtcccaaagcagaagcaag

SEQ ID NO: 396497 - DNA, 25 bp, Mus musculus
gcacccttagcgctctgaacgaaag

SEQ ID NO: 396498 - DNA, 25 bp, Mus musculus
tgcttggcacccttagcgctctgaa

SEQ ID NO: 396499 - DNA, 25 bp, Mus musculus
aggctgggtgcttggcacccttagc

SEQ ID NO: 396500 - DNA, 25 bp, Mus musculus
ctgagctgaacagcgaggctgggtg

SEQ ID NO: 396501 - DNA, 25 bp, Mus musculus
cagcgtcccaaagcagaagcaagca

SEQ ID NO: 396502 - DNA, 25 bp, Mus musculus
cgggcaaaagggcactgagctgaac

SEQ ID NO: 396503 - DNA, 25 bp, Mus musculus
cttagcgctctgaacgaaaggcaga

SEQ ID NO: 396504 - DNA, 25 bp, Mus musculus
gtccggcaagaggaaactgacatcc

SEQ ID NO: 396505 - DNA, 25 bp, Mus musculus
gcaggaggtgcgaattcatctatta

SEQ ID NO: 396506 - DNA, 25 bp, Mus musculus
tctattacgggcacgaggaagctcc

SEQ ID NO: 396507 - DNA, 25 bp, Mus musculus
tagggctcccaacgttcaaagctgg

SEQ ID NO: 396508 - DNA, 25 bp, Mus musculus
tcaaagctggaggatatcgcgcaca

SEQ ID NO: 396509 - DNA, 25 bp, Mus musculus
tatcgcgcacaacccaagaggctga

SEQ ID NO: 396510 - DNA, 25 bp, Mus musculus
cactcacttgctggctcgatcacta

SEQ ID NO: 396511 - DNA, 25 bp, Mus musculus
ccgcctggtactgaaacctggcttc

SEQ ID NO: 396512 - DNA, 25 bp, Mus musculus
tgggctccttcctagacttcagtgc

SEQ ID NO: 396513 - DNA, 25 bp, Mus musculus
tgagagcgagctagtccacagcatc

SEQ ID NO: 396514 - DNA, 25 bp, Mus musculus
atgccacgaacctgaacccaattga

SEQ ID NO: 396515 - DNA, 25 bp, Mus musculus
cccaattgaccggtgtccagctgca

SEQ ID NO: 396516 - DNA, 25 bp, Mus musculus
acaatctgctacagctcggaggaca

SEQ ID NO: 396517 - DNA, 25 bp, Mus musculus
cattactttcagagcaagcgccgga

SEQ ID NO: 396518 - DNA, 25 bp, Mus musculus
tagcttctcgggagggtgcttccct

SEQ ID NO: 396519 - DNA, 25 bp, Mus musculus
ttgtcgaagacgtcggtgcaccagc

SEQ ID NO: 396520 - DNA, 25 bp, Mus musculus
cggttcagcacacctactccgtagg

SEQ ID NO: 396521 - DNA, 25 bp, Mus musculus
ttcccttccacgtagcggttcagca

SEQ ID NO: 396522 - DNA, 25 bp, Mus musculus
gccgtccttgaccaatagcttctcg

SEQ ID NO: 396523 - DNA, 25 bp, Mus musculus
cgcaccttgataacggcagggtcca

SEQ ID NO: 396524 - DNA, 25 bp, Mus musculus
cggcggagatgaacttgtcgaagac

SEQ ID NO: 396525 - DNA, 25 bp, Mus musculus
ggtgtagctacgcttgaccagctcc

SEQ ID NO: 396526 - DNA, 25 bp, Mus musculus
tgttgatgatgatgaccagctggga

SEQ ID NO: 396527 - DNA, 25 bp, Mus musculus
ctcagagctgtagatgttgatgatg

SEQ ID NO: 396528 - DNA, 25 bp, Mus musculus
gctgacgttatcatgctcagagctg

SEQ ID NO: 396529 - DNA, 25 bp, Mus musculus
cccgaactgcatgatggtctggatc

SEQ ID NO: 396530 - DNA, 25 bp, Mus musculus
ccaagcggagcgtgccacacttttt

SEQ ID NO: 396531 - DNA, 25 bp, Mus musculus
tgcaccagcgtgtgccgtccttgac

SEQ ID NO: 396532 - DNA, 25 bp, Mus musculus
gtctccaccgccagcttccttgtcc

SEQ ID NO: 396533 - DNA, 25 bp, Mus musculus
aggccacaccccgtgctgtcattag

SEQ ID NO: 396534 - DNA, 25 bp, Mus musculus
caagctctgaaaccgctggtcgccg

SEQ ID NO: 396535 - DNA, 25 bp, Mus musculus
ccacaagctctgaaaccgctggtcg

SEQ ID NO: 396536 - DNA, 25 bp, Mus musculus
accactctgacgctgccgccgcagc

SEQ ID NO: 396537 - DNA, 25 bp, Mus musculus
agcgggagcaccactctgacgctgc

SEQ ID NO: 396538 - DNA, 25 bp, Mus musculus
agcctctggacagcgggagcaccac

SEQ ID NO: 396539 - DNA, 25 bp, Mus musculus
cgagctaggtctgagcctctggaca

SEQ ID NO: 396540 - DNA, 25 bp, Mus musculus
ttaggctcccgagctaggtctgagc

SEQ ID NO: 396541 - DNA, 25 bp, Mus musculus
tgctaaatcttaggctcccgagcta

SEQ ID NO: 396542 - DNA, 25 bp, Mus musculus
gcctccggtgctaaatcttaggctc

SEQ ID NO: 396543 - DNA, 25 bp, Mus musculus
aaggagcctccggtgctaaatctta

SEQ ID NO: 396544 - DNA, 25 bp, Mus musculus
cagcctcagcccgggaaaggagcct

SEQ ID NO: 396545 - DNA, 25 bp, Mus musculus
tccgccatggtcctgcagcctcagc

SEQ ID NO: 396546 - DNA, 25 bp, Mus musculus
tgtctccgtggacaatgagcaccgg

SEQ ID NO: 396547 - DNA, 25 bp, Mus musculus
caagggacctccacttaagcttcgg

SEQ ID NO: 396548 - DNA, 25 bp, Mus musculus
tgcgtcccaagggacctccacttaa

SEQ ID NO: 396549 - DNA, 25 bp, Mus musculus
cacggagggctttccagaggctccg

SEQ ID NO: 396550 - DNA, 25 bp, Mus musculus
ctcatagcacggagggctttccaga

SEQ ID NO: 396551 - DNA, 25 bp, Mus musculus
cgtcctcatagcacggagggctttc

SEQ ID NO: 396552 - DNA, 25 bp, Mus musculus
taaagggcgtcctcatagcacggag

SEQ ID NO: 396553 - DNA, 25 bp, Mus musculus
aagtaaagggcgtcctcatagcacg

SEQ ID NO: 396554 - DNA, 25 bp, Mus musculus
cagccgctgtctccgtggacaatga

SEQ ID NO: 396555 - DNA, 25 bp, Mus musculus
ctccgtggacaatgagcaccgggaa

SEQ ID NO: 396556 - DNA, 25 bp, Mus musculus
ggacctccacttaagcttcggaaga

SEQ ID NO: 396557 - DNA, 25 bp, Mus musculus
ccgctgtctccgtggacaatgagca

SEQ ID NO: 396558 - DNA, 25 bp, Mus musculus
cgtggacaatgagcaccgggaagta

SEQ ID NO: 396559 - DNA, 25 bp, Mus musculus
cggcagccgctgtctccgtggacaa

SEQ ID NO: 396560 - DNA, 25 bp, Mus musculus
gctcttactggtatccagcgtcttc

SEQ ID NO: 396561 - DNA, 25 bp, Mus musculus
agggctgcagtgcagtccgggatca

SEQ ID NO: 396562 - DNA, 25 bp, Mus musculus
gcccggagctcctgccatgaggccc

SEQ ID NO: 396563 - DNA, 25 bp, Mus musculus
tgcagcagtggctcgccagccgcag

SEQ ID NO: 396564 - DNA, 25 bp, Mus musculus
gtcgctgcagcagtggctcgccagc

SEQ ID NO: 396565 - DNA, 25 bp, Mus musculus
ccctggccagagtcgggtcgctgca

SEQ ID NO: 396566 - DNA, 25 bp, Mus musculus
ctcaggcgagccctggccagagtcg

SEQ ID NO: 396567 - DNA, 25 bp, Mus musculus
atgagcggacaactctggtcccggg

SEQ ID NO: 396568 - DNA, 25 bp, Mus musculus
ccaggtcgcggctcttactggtatc

SEQ ID NO: 396569 - DNA, 25 bp, Mus musculus
ggtatccagcgtcttctggagcatg

SEQ ID NO: 396570 - DNA, 25 bp, Mus musculus
gtcgcggctcttactggtatccagc

SEQ ID NO: 396571 - DNA, 25 bp, Mus musculus
atgaggcccgcaagcctcctcctgc

SEQ ID NO: 396572 - DNA, 25 bp, Mus musculus
cccgctcgacctaggacagccgctt

SEQ ID NO: 396573 - DNA, 25 bp, Mus musculus
cttctggagcatgagcggacaactc

SEQ ID NO: 396574 - DNA, 25 bp, Mus musculus
tacctccagcctgcggatgtctacg

SEQ ID NO: 396575 - DNA, 25 bp, Mus musculus
tcccgcgcaagctggaagatctgct

SEQ ID NO: 396576 - DNA, 25 bp, Mus musculus
cccgtctgcaaaactgtccgaggaa

SEQ ID NO: 396577 - DNA, 25 bp, Mus musculus
tgacaaacggggacgagagagcact

SEQ ID NO: 396578 - DNA, 25 bp, Mus musculus
gtcccgaacggaaagcttgagtctc

SEQ ID NO: 396579 - DNA, 25 bp, Mus musculus
tctcggtccaccaagggaaggaagc

SEQ ID NO: 396580 - DNA, 25 bp, Mus musculus
ctcgcgagatctaggggtcgtgatc

SEQ ID NO: 396581 - DNA, 25 bp, Mus musculus
tcgtgatctcgttgcgttgcctagc

SEQ ID NO: 396582 - DNA, 25 bp, Mus musculus
gttgcctagcgacaaaaggacgctg

SEQ ID NO: 396583 - DNA, 25 bp, Mus musculus
tgtagccctaagtctcctaccatgg

SEQ ID NO: 396584 - DNA, 25 bp, Mus musculus
ctagggacctgcagaagctgaagca

SEQ ID NO: 396585 - DNA, 25 bp, Mus musculus
agcagcaggcgatggcgtactacca

SEQ ID NO: 396586 - DNA, 25 bp, Mus musculus
tactaccaggagaacgacgtcccgc

SEQ ID NO: 396587 - DNA, 25 bp, Mus musculus
tcctaccatgggagatgaagacggc

SEQ ID NO: 396588 - DNA, 25 bp, Mus musculus
actgaggtgcgtgccctgaccctgt

SEQ ID NO: 396589 - DNA, 25 bp, Mus musculus
acagcggatctgagcaggaccggac

SEQ ID NO: 396590 - DNA, 25 bp, Mus musculus
cgctactcccgcgtggactgaggtg

SEQ ID NO: 396591 - DNA, 25 bp, Mus musculus
gcacgcggtgagatcatcccacgca

SEQ ID NO: 396592 - DNA, 25 bp, Mus musculus
accttgctccttcaagctggtgatg

SEQ ID NO: 396593 - DNA, 25 bp, Mus musculus
tccgagctgttcattttggcgggtg

SEQ ID NO: 396594 - DNA, 25 bp, Mus musculus
agctgcttctcctcgtccgagctgt

SEQ ID NO: 396595 - DNA, 25 bp, Mus musculus
atcctcccaggtggctgtatgcggt

SEQ ID NO: 396596 - DNA, 25 bp, Mus musculus
tatgcggttctgctaaggccgccgc

SEQ ID NO: 396597 - DNA, 25 bp, Mus musculus
gcaccatggagactcgacccgggtt

SEQ ID NO: 396598 - DNA, 25 bp, Mus musculus
cgccaccctagagctggacagcgga

SEQ ID NO: 396599 - DNA, 25 bp, Mus musculus
cactacccggaagttgggatcgctc

SEQ ID NO: 396600 - DNA, 25 bp, Mus musculus
atcccactgcgggaagacgctgcag

SEQ ID NO: 396601 - DNA, 25 bp, Mus musculus
gctggtgatgagctgcagctgcttc

SEQ ID NO: 396602 - DNA, 25 bp, Mus musculus
ctcgaaggccgaggagctcaggtaa

SEQ ID NO: 396603 - DNA, 25 bp, Mus musculus
ctggtccttcttctgcttagtccgc

SEQ ID NO: 396604 - DNA, 25 bp, Mus musculus
caagagccgcagcacgctgcacgtg

SEQ ID NO: 396605 - DNA, 25 bp, Mus musculus
aacaggcggccttgctccaagagcc

SEQ ID NO: 396606 - DNA, 25 bp, Mus musculus
gaggcgacaacaggcggccttgctc

SEQ ID NO: 396607 - DNA, 25 bp, Mus musculus
gcaacgccgagcctagagcgccagt

SEQ ID NO: 396608 - DNA, 25 bp, Mus musculus
accgtggctggcagtcggtgctccc

SEQ ID NO: 396609 - DNA, 25 bp, Mus musculus
acggcaccggcaggctgaagagacc

SEQ ID NO: 396610 - DNA, 25 bp, Mus musculus
gagcctagcagcgacggcaccggca

SEQ ID NO: 396611 - DNA, 25 bp, Mus musculus
aaccagccatcgtcaacggggcgga

SEQ ID NO: 396612 - DNA, 25 bp, Mus musculus
cggctagcgaaccagccatcgtcaa

SEQ ID NO: 396613 - DNA, 25 bp, Mus musculus
gttcttgcaaattcccggctagcga

SEQ ID NO: 396614 - DNA, 25 bp, Mus musculus
acgggctgagagttcttgcaaattc

SEQ ID NO: 396615 - DNA, 25 bp, Mus musculus
cttctgcttagtccgccgattctgg

SEQ ID NO: 396616 - DNA, 25 bp, Mus musculus
tacaacgcagcacctaagctcggtc

SEQ ID NO: 396617 - DNA, 25 bp, Mus musculus
tcggcgatctctctaggccactgca

SEQ ID NO: 396618 - DNA, 25 bp, Mus musculus
taccagctaactggctggctctggc

SEQ ID NO: 396619 - DNA, 25 bp, Mus musculus
ccggtccacagtcacggtctggatt

SEQ ID NO: 396620 - DNA, 25 bp, Mus musculus
gtctggattccttcccgcaaccgtg

SEQ ID NO: 396621 - DNA, 25 bp, Mus musculus
tgctagggcccagaaagagcgcttt

SEQ ID NO: 396622 - DNA, 25 bp, Mus musculus
cgaagctgcggcaggggaattaccc

SEQ ID NO: 396623 - DNA, 25 bp, Mus musculus
ctcggactaggatccggcgacagta

SEQ ID NO: 396624 - DNA, 25 bp, Mus musculus
ggcgacagtaatctgggtccgctga

SEQ ID NO: 396625 - DNA, 25 bp, Mus musculus
ccgctgaggaattggatttactttt

SEQ ID NO: 396626 - DNA, 25 bp, Mus musculus
tgttacaatcttccgaagcgccaga

SEQ ID NO: 396627 - DNA, 25 bp, Mus musculus
ctccttgtgcgcgttcttcgagacc

SEQ ID NO: 396628 - DNA, 25 bp, Mus musculus
tggcaccggacgtccattttgtctg

SEQ ID NO: 396629 - DNA, 25 bp, Mus musculus
tctggtttcccgaacataggcaaaa

SEQ ID NO: 396630 - DNA, 25 bp, Mus musculus
tgggccgagccgggtaacaacgctc

SEQ ID NO: 396631 - DNA, 25 bp, Mus musculus
tgggaggcacaaagtgagtggggag

SEQ ID NO: 396632 - DNA, 25 bp, Mus musculus
agtggggaggacagcgagtgtgtgt

SEQ ID NO: 396633 - DNA, 25 bp, Mus musculus
cccacagtccggctgtcacctcccg

SEQ ID NO: 396634 - DNA, 25 bp, Mus musculus
cacagtccggctgtcacctcccggc

SEQ ID NO: 396635 - DNA, 25 bp, Mus musculus
ggtccctcgagactgctgaacgtgg

SEQ ID NO: 396636 - DNA, 25 bp, Mus musculus
gtccctcgagactgctgaacgtgga

SEQ ID NO: 396637 - DNA, 25 bp, Mus musculus
cgagagggtgggaggcacaaagtga

SEQ ID NO: 396638 - DNA, 25 bp, Mus musculus
ccctcgagactgctgaacgtggagg

SEQ ID NO: 396639 - DNA, 25 bp, Mus musculus
ggccggtctcttaggagcaatcgcg

SEQ ID NO: 396640 - DNA, 25 bp, Mus musculus
ctccaagccacctccggccggtctc

SEQ ID NO: 396641 - DNA, 25 bp, Mus musculus
ggtaacaacgctcctctccaagcca

SEQ ID NO: 396642 - DNA, 25 bp, Mus musculus
gccgggtaacaacgctcctctccaa

SEQ ID NO: 396643 - DNA, 25 bp, Mus musculus
tccctcgagactgctgaacgtggag

SEQ ID NO: 396644 - DNA, 25 bp, Mus musculus
ggcgacgaccttcgggagatagtca

SEQ ID NO: 396645 - DNA, 25 bp, Mus musculus
tcagggtgggcacatttctcccgta

SEQ ID NO: 396646 - DNA, 25 bp, Mus musculus
aaggtattgcttcgggaggcacccg

SEQ ID NO: 396647 - DNA, 25 bp, Mus musculus
tatagagggactgggcctgaaactc

SEQ ID NO: 396648 - DNA, 25 bp, Mus musculus
tgggcctgaaactcggccacgtcct

SEQ ID NO: 396649 - DNA, 25 bp, Mus musculus
aggtaagagccgacccagactcatc

SEQ ID NO: 396650 - DNA, 25 bp, Mus musculus
ggtgacccgcgcactgacaagatct

SEQ ID NO: 396651 - DNA, 25 bp, Mus musculus
actcatctagagacggagcagagga

SEQ ID NO: 396652 - DNA, 25 bp, Mus musculus
tcgggagatagtcaaaaagctggtg

SEQ ID NO: 396653 - DNA, 25 bp, Mus musculus
atttctcccgtagtagcatttgcgg

SEQ ID NO: 396654 - DNA, 25 bp, Mus musculus
ggaagctcctgtcccaagtactgct

SEQ ID NO: 396655 - DNA, 25 bp, Mus musculus
tctgcattaggcagcggccgagttg

SEQ ID NO: 396656 - DNA, 25 bp, Mus musculus
ccgcgaggtttttccttgtctcttg

SEQ ID NO: 396657 - DNA, 25 bp, Mus musculus
tccttgtctcttgggcgacgacctt

SEQ ID NO: 396658 - DNA, 25 bp, Mus musculus
cgtgctcgctcgttgtgactctgag

SEQ ID NO: 396659 - DNA, 25 bp, Mus musculus
acccgggcagtgtggagatataacc

SEQ ID NO: 396660 - DNA, 25 bp, Mus musculus
agatataaccctgcaggcagtcgca

SEQ ID NO: 396661 - DNA, 25 bp, Mus musculus
cgacggcaatagaggcgtgctcgct

SEQ ID NO: 396662 - DNA, 25 bp, Mus musculus
tgctgctcaccgtcgtaggtacgta

SEQ ID NO: 396663 - DNA, 25 bp, Mus musculus
gatcctgttcatcgtgttcctcgcg

SEQ ID NO: 396664 - DNA, 25 bp, Mus musculus
gccactcgcgcaagctgatcctgtt

SEQ ID NO: 396665 - DNA, 25 bp, Mus musculus
aaagctatggccctgagcgatctgg

SEQ ID NO: 396666 - DNA, 25 bp, Mus musculus
gctcccacagcgaagcaaagctatg

SEQ ID NO: 396667 - DNA, 25 bp, Mus musculus
taccgctggtggacgaaactccttg

SEQ ID NO: 396668 - DNA, 25 bp, Mus musculus
gggagcgagacactccctgtcgttc

SEQ ID NO: 396669 - DNA, 25 bp, Mus musculus
actgggtaaactgagcagggctctg

SEQ ID NO: 396670 - DNA, 25 bp, Mus musculus
gtgactctgagacgctatcccagtg

SEQ ID NO: 396671 - DNA, 25 bp, Mus musculus
cctcgcgctgctgctagacaacatg

SEQ ID NO: 396672 - DNA, 25 bp, Mus musculus
tgatcttcttggtgacccagcggcg

SEQ ID NO: 396673 - DNA, 25 bp, Mus musculus
taacggaaggagacctggataagtc

SEQ ID NO: 396674 - DNA, 25 bp, Mus musculus
ctcgaactccaccttgatcttcttg

SEQ ID NO: 396675 - DNA, 25 bp, Mus musculus
tagagtagcaggaactgtgcgagca

SEQ ID NO: 396676 - DNA, 25 bp, Mus musculus
agcagcgtgaggaacgagcccagca

SEQ ID NO: 396677 - DNA, 25 bp, Mus musculus
acgccaggatcaggagcagcagccc

SEQ ID NO: 396678 - DNA, 25 bp, Mus musculus
gccgtcttggtctgcagcagctcct

SEQ ID NO: 396679 - DNA, 25 bp, Mus musculus
agggcaccgtgtcgcccaggaacac

SEQ ID NO: 396680 - DNA, 25 bp, Mus musculus
cgccgccataaaggtactccctgag

SEQ ID NO: 396681 - DNA, 25 bp, Mus musculus
tggtcttgatgaagggcaccgtgtc

SEQ ID NO: 396682 - DNA, 25 bp, Mus musculus
ccatcttgaggacatcggtcgcgga

SEQ ID NO: 396683 - DNA, 25 bp, Mus musculus
gcaggcccggcaccggcttaaggta

SEQ ID NO: 396684 - DNA, 25 bp, Mus musculus
atccgtgcgtccgtcgtctccggag

SEQ ID NO: 396685 - DNA, 25 bp, Mus musculus
cgcaccagccggatggtcttgatga

SEQ ID NO: 396686 - DNA, 25 bp, Mus musculus
agatgggcacaatagactggaatga

SEQ ID NO: 396687 - DNA, 25 bp, Mus musculus
cgtagtctgtagctctcacctcaga

SEQ ID NO: 396688 - DNA, 25 bp, Mus musculus
agcgaggagcgtttatttgcaatca

SEQ ID NO: 396689 - DNA, 25 bp, Mus musculus
ggagcgtttatttgcaatcacttta

SEQ ID NO: 396690 - DNA, 25 bp, Mus musculus
cactttaactcttggtggctggttc

SEQ ID NO: 396691 - DNA, 25 bp, Mus musculus
tgaaccaatgtggtccctgctcgcg

SEQ ID NO: 396692 - DNA, 25 bp, Mus musculus
agctctcacctcagagtcaatatta

SEQ ID NO: 396693 - DNA, 25 bp, Mus musculus
aggctcaacgcgctgcggacagcga

SEQ ID NO: 396694 - DNA, 25 bp, Mus musculus
agactggaatgaaaagctaatattg

SEQ ID NO: 396695 - DNA, 25 bp, Mus musculus
agctaatattgaaccaatgtggtcc

SEQ ID NO: 396696 - DNA, 25 bp, Mus musculus
tgctgtcggcccagctaagctgagg

SEQ ID NO: 396697 - DNA, 25 bp, Mus musculus
gcgatgccaccctttgttgcgcagc

SEQ ID NO: 396698 - DNA, 25 bp, Mus musculus
ctggttctcttccagcgccctgtgg

SEQ ID NO: 396699 - DNA, 25 bp, Mus musculus
agtcaatattatctcagatgggcac

SEQ ID NO: 396700 - DNA, 25 bp, Mus musculus
gactccgttccattctgggcccgga

SEQ ID NO: 396701 - DNA, 25 bp, Mus musculus
caacccggacttggtgttcgccgag

SEQ ID NO: 396702 - DNA, 25 bp, Mus musculus
ggcactcagctacgccaattccagt

SEQ ID NO: 396703 - DNA, 25 bp, Mus musculus
caagcgctgcttcaccatcgagtcg

SEQ ID NO: 396704 - DNA, 25 bp, Mus musculus
gcagcatgtttcagccggcgcccaa

SEQ ID NO: 396705 - DNA, 25 bp, Mus musculus
attctcgggatcttcggctttgcct

SEQ ID NO: 396706 - DNA, 25 bp, Mus musculus
cgcgtttggtgcaagattctcggga

SEQ ID NO: 396707 - DNA, 25 bp, Mus musculus
ccctgcccgccttttgcaaaggaga

SEQ ID NO: 396708 - DNA, 25 bp, Mus musculus
attgtccttggacttagggcgccct

SEQ ID NO: 396709 - DNA, 25 bp, Mus musculus
cgaacacttccatggattgtccttg

SEQ ID NO: 396710 - DNA, 25 bp, Mus musculus
ccgcactaattaggctcatgaacta

SEQ ID NO: 396711 - DNA, 25 bp, Mus musculus
ttcggaggaagctgtttatgtgatc

SEQ ID NO: 396712 - DNA, 25 bp, Mus musculus
gcctccctctgacgcactttaaaga

SEQ ID NO: 396713 - DNA, 25 bp, Mus musculus
tcagggcgagtaatagcgaccaatc

SEQ ID NO: 396714 - DNA, 25 bp, Mus musculus
tgcagcggctcctacagctgctgtc

SEQ ID NO: 396715 - DNA, 25 bp, Mus musculus
gcaccggcgacaggtaagcgcgcac

SEQ ID NO: 396716 - DNA, 25 bp, Mus musculus
ggagctcgcaaacggttccggcagc

SEQ ID NO: 396717 - DNA, 25 bp, Mus musculus
cagcggccgtggcaacaaaggcgac

SEQ ID NO: 396718 - DNA, 25 bp, Mus musculus
caaaggcgacgaatgactcccggtc

SEQ ID NO: 396719 - DNA, 25 bp, Mus musculus
tagccgcctgacaaaaccatccagg

SEQ ID NO: 396720 - DNA, 25 bp, Mus musculus
tgctgtcgctactgctacggctccg

SEQ ID NO: 396721 - DNA, 25 bp, Mus musculus
tgacaaaaccatccaggcagccggg

SEQ ID NO: 396722 - DNA, 25 bp, Mus musculus
tctcgcgctgtctgaggctctcgcg

SEQ ID NO: 396723 - DNA, 25 bp, Mus musculus
ttccggtcctagtcgccggtgtctg

SEQ ID NO: 396724 - DNA, 25 bp, Mus musculus
ccaggtgggcccatcaggtgcgtac

SEQ ID NO: 396725 - DNA, 25 bp, Mus musculus
atcaggtgcgtactcggccgtcgcc

SEQ ID NO: 396726 - DNA, 25 bp, Mus musculus
gacagttaggccaggccgcccggct

SEQ ID NO: 396727 - DNA, 25 bp, Mus musculus
ggttgttgtcttcgccgcctcggcg

SEQ ID NO: 396728 - DNA, 25 bp, Mus musculus
acctgtgtggtggtataggcgtccc

SEQ ID NO: 396729 - DNA, 25 bp, Mus musculus
ggcccacgagctccttagagacgtc

SEQ ID NO: 396730 - DNA, 25 bp, Mus musculus
cagccggtggatcagggcaagcact

SEQ ID NO: 396731 - DNA, 25 bp, Mus musculus
ggccttccaccagacacagggcgga

SEQ ID NO: 396732 - DNA, 25 bp, Mus musculus
tataggcgtccccattgcggtagcg

SEQ ID NO: 396733 - DNA, 25 bp, Mus musculus
aagcactgtgttggcatcggtgcga

SEQ ID NO: 396734 - DNA, 25 bp, Mus musculus
cgccctctcatggtagacctgtgtg

SEQ ID NO: 396735 - DNA, 25 bp, Mus musculus
gactgtccgccctctcatggtagac

SEQ ID NO: 396736 - DNA, 25 bp, Mus musculus
atgtgcactgtagtcaaactcaccc

SEQ ID NO: 396737 - DNA, 25 bp, Mus musculus
ctcatggtagacctgtgtggtggta

SEQ ID NO: 396738 - DNA, 25 bp, Mus musculus
cggacaccatgtgcactgtagtcaa

SEQ ID NO: 396739 - DNA, 25 bp, Mus musculus
cgtcacggacaccatgtgcactgta

SEQ ID NO: 396740 - DNA, 25 bp, Mus musculus
ttagagacgtcacggacaccatgtg

SEQ ID NO: 396741 - DNA, 25 bp, Mus musculus
gtagtggtagctggtggccttccac

SEQ ID NO: 396742 - DNA, 25 bp, Mus musculus
tcccggcccaaagaaggatttgata

SEQ ID NO: 396743 - DNA, 25 bp, Mus musculus
gcgagatgccatcccacgatgccta

SEQ ID NO: 396744 - DNA, 25 bp, Mus musculus
gtggcgctgaagaatataaatattt

SEQ ID NO: 396745 - DNA, 25 bp, Mus musculus
tttaaagtggcaggattagagcgtc

SEQ ID NO: 396746 - DNA, 25 bp, Mus musculus
gccgctcgtttgctttattaattca

SEQ ID NO: 396747 - DNA, 25 bp, Mus musculus
agtcagcttattagccgctcgtttg

SEQ ID NO: 396748 - DNA, 25 bp, Mus musculus
cctcaaaaaggcaggacagtcagct

SEQ ID NO: 396749 - DNA, 25 bp, Mus musculus
atttggcgcactttcgagtccttcc

SEQ ID NO: 396750 - DNA, 25 bp, Mus musculus
ggctcgccttgatccactgcaaaca

SEQ ID NO: 396751 - DNA, 25 bp, Mus musculus
aaagtgaagcagaggcggctcgcct

SEQ ID NO: 396752 - DNA, 25 bp, Mus musculus
gccgctctgttcaaactagataatt

SEQ ID NO: 396753 - DNA, 25 bp, Mus musculus
cacgatgcctatctgggcgtagggc

SEQ ID NO: 396754 - DNA, 25 bp, Mus musculus
aaggatttgatagccgctctgttca

SEQ ID NO: 396755 - DNA, 25 bp, Mus musculus
ccggctgcaccgagcggctcagaga

SEQ ID NO: 396756 - DNA, 25 bp, Mus musculus
tcgaggattgccttatagtactagg

SEQ ID NO: 396757 - DNA, 25 bp, Mus musculus
cgaggtcgaggattgccttatagta

SEQ ID NO: 396758 - DNA, 25 bp, Mus musculus
cttatagtactaggccaccacgccg

SEQ ID NO: 396759 - DNA, 25 bp, Mus musculus
cggagcccggaaacagtctgtgcct

SEQ ID NO: 396760 - DNA, 25 bp, Mus musculus
cagtctgtgccttagcctcctgatt

SEQ ID NO: 396761 - DNA, 25 bp, Mus musculus
aagttggagttttgagaaccctctg

SEQ ID NO: 396762 - DNA, 25 bp, Mus musculus
acgcttgaaagcgaaaggtccattc

SEQ ID NO: 396763 - DNA, 25 bp, Mus musculus
gcgaaaggtccattcatcagccgcg

SEQ ID NO: 396764 - DNA, 25 bp, Mus musculus
gggaggcaacttctccaggcgcgat

SEQ ID NO: 396765 - DNA, 25 bp, Mus musculus
aggcgcgatcctgtgcgccaggaaa

SEQ ID NO: 396766 - DNA, 25 bp, Mus musculus
tgtgcgccaggaaacccgaagcagt

SEQ ID NO: 396767 - DNA, 25 bp, Mus musculus
ccaggaaacccgaagcagtgccacg

SEQ ID NO: 396768 - DNA, 25 bp, Mus musculus
acccgaagcagtgccacgcttgaaa

SEQ ID NO: 396769 - DNA, 25 bp, Mus musculus
ggctccgggaggcaacttctccagg

SEQ ID NO: 396770 - DNA, 25 bp, Mus musculus
tgatacgaaccgtcgacggccgtgg

SEQ ID NO: 396771 - DNA, 25 bp, Mus musculus
caccgcccgctattgggagagaacc

SEQ ID NO: 396772 - DNA, 25 bp, Mus musculus
ggaggcggcactgggccctatacac

SEQ ID NO: 396773 - DNA, 25 bp, Mus musculus
cccgcagaggccgacaaggggttct

SEQ ID NO: 396774 - DNA, 25 bp, Mus musculus
actgtgagcccgcagaggccgacaa

SEQ ID NO: 396775 - DNA, 25 bp, Mus musculus
ccaacctgtcggttgcagcgggctg

SEQ ID NO: 396776 - DNA, 25 bp, Mus musculus
cacttccgggttggccgtctccatg

SEQ ID NO: 396777 - DNA, 25 bp, Mus musculus
cgacccggctgatacgaaccgtcga

SEQ ID NO: 396778 - DNA, 25 bp, Mus musculus
cgtagaagcacaggggcccacatca

SEQ ID NO: 396779 - DNA, 25 bp, Mus musculus
tttcttccgtagaagcacaggggcc

SEQ ID NO: 396780 - DNA, 25 bp, Mus musculus
cgctgctggggtccctttcttccgt

SEQ ID NO: 396781 - DNA, 25 bp, Mus musculus
cctaagggctgctgtcaggaggacc

SEQ ID NO: 396782 - DNA, 25 bp, Mus musculus
gcgaggtccctaagggctgctgtca

SEQ ID NO: 396783 - DNA, 25 bp, Mus musculus
tgggtgctgaggttccaacctgtcg

SEQ ID NO: 396784 - DNA, 25 bp, Mus musculus
tcttctgattggctcgggcggatca

SEQ ID NO: 396785 - DNA, 25 bp, Mus musculus
tcgggcggatcagccaatcggctgc

SEQ ID NO: 396786 - DNA, 25 bp, Mus musculus
ctgcggccgttctggctctatggtc

SEQ ID NO: 396787 - DNA, 25 bp, Mus musculus
ccgccaacatcgtgtcttctgattg

SEQ ID NO: 396788 - DNA, 25 bp, Mus musculus
cttaccagggaggaaacagcggctc

SEQ ID NO: 396789 - DNA, 25 bp, Mus musculus
ctcgcgaagccgaacttaccaggga

SEQ ID NO: 396790 - DNA, 25 bp, Mus musculus
gtcgcgcctcgcgaagccgaactta

SEQ ID NO: 396791 - DNA, 25 bp, Mus musculus
ttccaagcccgcttcggcagatctg

SEQ ID NO: 396792 - DNA, 25 bp, Mus musculus
tgtgtgggctttcgcgctcctcgct

SEQ ID NO: 396793 - DNA, 25 bp, Mus musculus
cagccgcagttgctgtgtgggcttt

SEQ ID NO: 396794 - DNA, 25 bp, Mus musculus
ggcgagccgcgaacctcgctctggt

SEQ ID NO: 396795 - DNA, 25 bp, Mus musculus
acaacctggaactcggcggcactca

SEQ ID NO: 396796 - DNA, 25 bp, Mus musculus
agccgcgtcagaactcgcatcggga

SEQ ID NO: 396797 - DNA, 25 bp, Mus musculus
ttcggcagatctgcgaggacgagcc

SEQ ID NO: 396798 - DNA, 25 bp, Mus musculus
gcgctcggtcccagtcagcttgact

SEQ ID NO: 396799 - DNA, 25 bp, Mus musculus
agcctcagtgaaatgcgccgacgta

SEQ ID NO: 396800 - DNA, 25 bp, Mus musculus
gtagcgggtgcaccagaaccacata

SEQ ID NO: 396801 - DNA, 25 bp, Mus musculus
accacatagcggtccaaggcgattg

SEQ ID NO: 396802 - DNA, 25 bp, Mus musculus
ccgatacatagacggtgaccggctg

SEQ ID NO: 396803 - DNA, 25 bp, Mus musculus
cataagctagcgtgagaggcacaca

SEQ ID NO: 396804 - DNA, 25 bp, Mus musculus
acgcggttcctcagcttcactgaca

SEQ ID NO: 396805 - DNA, 25 bp, Mus musculus
cagcactgcagatagagcccagatg

SEQ ID NO: 396806 - DNA, 25 bp, Mus musculus
ggcagccagcagaccgcgaacacta

SEQ ID NO: 396807 - DNA, 25 bp, Mus musculus
gtccaggtctcgcaataggttgaaa

SEQ ID NO: 396808 - DNA, 25 bp, Mus musculus
cacgtcggacaaggccaggttgcca

SEQ ID NO: 396809 - DNA, 25 bp, Mus musculus
actcctcgcagaggctcacgtcgtg

SEQ ID NO: 396810 - DNA, 25 bp, Mus musculus
cccgtacgtaagacaggaggatggc

SEQ ID NO: 396811 - DNA, 25 bp, Mus musculus
ctccacatggtaggtgtgcaccgcg

SEQ ID NO: 396812 - DNA, 25 bp, Mus musculus
tgcgtcgcagctcttcaacatcatg

SEQ ID NO: 396813 - DNA, 25 bp, Mus musculus
gtgtgcccgagagtggacccaaaaa

SEQ ID NO: 396814 - DNA, 25 bp, Mus musculus
gcggcctcccagttgttgtgattct

SEQ ID NO: 396815 - DNA, 25 bp, Mus musculus
ttgcctcgtaggtgagcatttcctc

SEQ ID NO: 396816 - DNA, 25 bp, Mus musculus
gcagaagccgcctcgagttcacatc

SEQ ID NO: 396817 - DNA, 25 bp, Mus musculus
tctggttctgagaggcagccgcaaa

SEQ ID NO: 396818 - DNA, 25 bp, Mus musculus
ggctgacgtccctcacgacatttta

SEQ ID NO: 396819 - DNA, 25 bp, Mus musculus
acagcagtttcttctggcctttgga

SEQ ID NO: 396820 - DNA, 25 bp, Mus musculus
tgagtcacctcaaggcgaatgcacc

SEQ ID NO: 396821 - DNA, 25 bp, Mus musculus
cccatcagtttagaccaggtgtcca

SEQ ID NO: 396822 - DNA, 25 bp, Mus musculus
cccggccgacattacgtgataaagg

SEQ ID NO: 396823 - DNA, 25 bp, Mus musculus
ataaaggactttggtctgcgcacgc

SEQ ID NO: 396824 - DNA, 25 bp, Mus musculus
tctggtcgtccatcattgcctcgta

SEQ ID NO: 396825 - DNA, 25 bp, Mus musculus
cgcacgcgcattctctaacttgttg

SEQ ID NO: 396826 - DNA, 25 bp, Mus musculus
gcaggagcgcagcactttcttgtgg

SEQ ID NO: 396827 - DNA, 25 bp, Mus musculus
cgcgcgaagagccaagccctgcgtg

SEQ ID NO: 396828 - DNA, 25 bp, Mus musculus
ggcgaccgccgcacgtctgctgaaa

SEQ ID NO: 396829 - DNA, 25 bp, Mus musculus
tgctgaaaccggagcttcaggtgtg

SEQ ID NO: 396830 - DNA, 25 bp, Mus musculus
aggcggtggcgctctacaccacaca

SEQ ID NO: 396831 - DNA, 25 bp, Mus musculus
ggcgacaacgcacataccatcaagt

SEQ ID NO: 396832 - DNA, 25 bp, Mus musculus
gtattgcccgctctccaaagtgcca

SEQ ID NO: 396833 - DNA, 25 bp, Mus musculus
gccgcgcagcaacagggacagcctg

SEQ ID NO: 396834 - DNA, 25 bp, Mus musculus
gcctgcccagcaagaagctgcgcta

SEQ ID NO: 396835 - DNA, 25 bp, Mus musculus
agcgggctgcatcaagctgtgtaca

SEQ ID NO: 396836 - DNA, 25 bp, Mus musculus
tgtgtacacctgaaacctgcgctcc

SEQ ID NO: 396837 - DNA, 25 bp, Mus musculus
cccttgcctcaatttgggaagtcgt

SEQ ID NO: 396838 - DNA, 25 bp, Mus musculus
tcgtcttgattttacggaagccgca

SEQ ID NO: 396839 - DNA, 25 bp, Mus musculus
taaaaggaagcaaggctgccctacc

SEQ ID NO: 396840 - DNA, 25 bp, Mus musculus
cctctggaaataggccggcatcttg

SEQ ID NO: 396841 - DNA, 25 bp, Mus musculus
tgaaggtagactagccggctcccga

SEQ ID NO: 396842 - DNA, 25 bp, Mus musculus
agaaggccgatcgtagcgaagaatc

SEQ ID NO: 396843 - DNA, 25 bp, Mus musculus
cgaagaatcgcaagacccgagagtc

SEQ ID NO: 396844 - DNA, 25 bp, Mus musculus
cacaccagagcgacggttcctgatc

SEQ ID NO: 396845 - DNA, 25 bp, Mus musculus
tgagggcattttccggcctctggaa

SEQ ID NO: 396846 - DNA, 25 bp, Mus musculus
tagccaaaatgacgtgcgcggaagc

SEQ ID NO: 396847 - DNA, 25 bp, Mus musculus
ggcatcttgacggtacgctcagttc

SEQ ID NO: 396848 - DNA, 25 bp, Mus musculus
tcagcgaactccctagtggcctgga

SEQ ID NO: 396849 - DNA, 25 bp, Mus musculus
aggaaccacgtgattccctcgcggc

SEQ ID NO: 396850 - DNA, 25 bp, Mus musculus
ggcctttgcgcatgttccgcctttc

SEQ ID NO: 396851 - DNA, 25 bp, Mus musculus
tgcggtctgatctgcgacgagaaaa

SEQ ID NO: 396852 - DNA, 25 bp, Mus musculus
gcagtgtctacacagtcatagccaa

SEQ ID NO: 396853 - DNA, 25 bp, Mus musculus
gccttactcaccgttggcgcgcttg

SEQ ID NO: 396854 - DNA, 25 bp, Mus musculus
ccggctgcgtttgtttgcggctccc

SEQ ID NO: 396855 - DNA, 25 bp, Mus musculus
caatggacacccagctgatgctcgg

SEQ ID NO: 396856 - DNA, 25 bp, Mus musculus
acccagctgatgctcggagtcgggc

SEQ ID NO: 396857 - DNA, 25 bp, Mus musculus
ctgatcggtgaggacgcaggctctc

SEQ ID NO: 396858 - DNA, 25 bp, Mus musculus
gacgcaggctctctgtctgccaggc

SEQ ID NO: 396859 - DNA, 25 bp, Mus musculus
gcttcgccagggagaggctagactt

SEQ ID NO: 396860 - DNA, 25 bp, Mus musculus
ctagggcccggctgcgtttgtttgc

SEQ ID NO: 396861 - DNA, 25 bp, Mus musculus
accgcctgctttgggactatgggtt

SEQ ID NO: 396862 - DNA, 25 bp, Mus musculus
cgttgaccgcctgctttgggactat

SEQ ID NO: 396863 - DNA, 25 bp, Mus musculus
gatactcccgttgaccgcctgcttt

SEQ ID NO: 396864 - DNA, 25 bp, Mus musculus
gcggggctcgatactcccgttgacc

SEQ ID NO: 396865 - DNA, 25 bp, Mus musculus
ttgggccgaggacttcggcctcctc

SEQ ID NO: 396866 - DNA, 25 bp, Mus musculus
tagacttgggccgaggacttcggcc

SEQ ID NO: 396867 - DNA, 25 bp, Mus musculus
tctgccaggccatgccgcagctccg

SEQ ID NO: 396868 - DNA, 25 bp, Mus musculus
gcgcccgccagagcatctctggata

SEQ ID NO: 396869 - DNA, 25 bp, Mus musculus
catctctggatagatttgctgtatc

SEQ ID NO: 396870 - DNA, 25 bp, Mus musculus
gatttgctgtatcccgccatccggc

SEQ ID NO: 396871 - DNA, 25 bp, Mus musculus
cctgttgtggtgatgcttacgtttc

SEQ ID NO: 396872 - DNA, 25 bp, Mus musculus
gcttacgtttcaaagcaatgatgga

SEQ ID NO: 396873 - DNA, 25 bp, Mus musculus
tgatggaaagagaaaagccattgcc

SEQ ID NO: 396874 - DNA, 25 bp, Mus musculus
agccattgccagtggcctctgaaag

SEQ ID NO: 396875 - DNA, 25 bp, Mus musculus
gcctctgaaagtggggcgagttact

SEQ ID NO: 396876 - DNA, 25 bp, Mus musculus
gcagcaggatgagcgagtgaaaaac

SEQ ID NO: 396877 - DNA, 25 bp, Mus musculus
gatgagcgagtgaaaaactgagccc

SEQ ID NO: 396878 - DNA, 25 bp, Mus musculus
atcccgttcggtcttcattcaccgt

SEQ ID NO: 396879 - DNA, 25 bp, Mus musculus
ggacggtaccctgctctcgcctgag

SEQ ID NO: 396880 - DNA, 25 bp, Mus musculus
ttcaccgtctccaggaaggcggatc

SEQ ID NO: 396881 - DNA, 25 bp, Mus musculus
ggtcttcattcaccgtctccaggaa

SEQ ID NO: 396882 - DNA, 25 bp, Mus musculus
cgccatcttcagagcacgcaagagg

SEQ ID NO: 396883 - DNA, 25 bp, Mus musculus
ctgctccgggcttccctatgagggc

SEQ ID NO: 396884 - DNA, 25 bp, Mus musculus
caagaggcacgataggcggagatac

SEQ ID NO: 396885 - DNA, 25 bp, Mus musculus
gcttccctatgagggcggggcctca

SEQ ID NO: 396886 - DNA, 25 bp, Mus musculus
tgccgccatcttcagagcacgcaag

SEQ ID NO: 396887 - DNA, 25 bp, Mus musculus
gaggaccagagcaaccttcccgcag

SEQ ID NO: 396888 - DNA, 25 bp, Mus musculus
agccactcaccgaggaccagagcaa

SEQ ID NO: 396889 - DNA, 25 bp, Mus musculus
ctgttgtgtcatgcgcctgcccagc

SEQ ID NO: 396890 - DNA, 25 bp, Mus musculus
agtcgctgttgtgtcatgcgcctgc

SEQ ID NO: 396891 - DNA, 25 bp, Mus musculus
ggccagagtcgctgttgtgtcatgc

SEQ ID NO: 396892 - DNA, 25 bp, Mus musculus
ctggaaacaagtgcgggccagagtc

SEQ ID NO: 396893 - DNA, 25 bp, Mus musculus
cggtcctggaaacaagtgcgggcca

SEQ ID NO: 396894 - DNA, 25 bp, Mus musculus
cgcgatccggtcctggaaacaagtg

SEQ ID NO: 396895 - DNA, 25 bp, Mus musculus
ataccgaggagtagccggagcacgc

SEQ ID NO: 396896 - DNA, 25 bp, Mus musculus
ctcggggcatgataagcaggggtgc

SEQ ID NO: 396897 - DNA, 25 bp, Mus musculus
cccggtacctcctctcgcagcggct

SEQ ID NO: 396898 - DNA, 25 bp, Mus musculus
ctcgcagcggctcgccgtccggaac

SEQ ID NO: 396899 - DNA, 25 bp, Mus musculus
cgtccggaacgagcgcgggcacctc

SEQ ID NO: 396900 - DNA, 25 bp, Mus musculus
ttcgccctccggcatggtgtcctgg

SEQ ID NO: 396901 - DNA, 25 bp, Mus musculus
tccggcatggtgtcctggctgcttc

SEQ ID NO: 396902 - DNA, 25 bp, Mus musculus
gccctggctcggggcatgataagca

SEQ ID NO: 396903 - DNA, 25 bp, Mus musculus
gccgctgaagagtgcgcggagccca

SEQ ID NO: 396904 - DNA, 25 bp, Mus musculus
cctcgcctgtgggaagcccagtctg

SEQ ID NO: 396905 - DNA, 25 bp, Mus musculus
tgtgggaagcccagtctggaccgcc

SEQ ID NO: 396906 - DNA, 25 bp, Mus musculus
tctggaccgccggacgcctggtttc

SEQ ID NO: 396907 - DNA, 25 bp, Mus musculus
accgccggacgcctggtttctctag

SEQ ID NO: 396908 - DNA, 25 bp, Mus musculus
gacgcctggtttctctagccgcgct

SEQ ID NO: 396909 - DNA, 25 bp, Mus musculus
gccggacgcctggtttctctagccg

SEQ ID NO: 396910 - DNA, 25 bp, Mus musculus
gagctggaaaacatcgtggccaaca

SEQ ID NO: 396911 - DNA, 25 bp, Mus musculus
ctgccgactgtcaatggagctggaa

SEQ ID NO: 396912 - DNA, 25 bp, Mus musculus
ggaggctgaagcatccgaagcatta

SEQ ID NO: 396913 - DNA, 25 bp, Mus musculus
ccgcgggctccgagaaagaataatg

SEQ ID NO: 396914 - DNA, 25 bp, Mus musculus
ggctcagcgccataccggcagcagt

SEQ ID NO: 396915 - DNA, 25 bp, Mus musculus
agtcgtttttgactcctgccggcga

SEQ ID NO: 396916 - DNA, 25 bp, Mus musculus
cgctttctcggatcttggcgggaca

SEQ ID NO: 396917 - DNA, 25 bp, Mus musculus
cttctggttcccatagacgcgccgt

SEQ ID NO: 396918 - DNA, 25 bp, Mus musculus
agtgcacctttgtcagagacctggc

SEQ ID NO: 396919 - DNA, 25 bp, Mus musculus
tggccaacacggtcttgctgaaagc

SEQ ID NO: 396920 - DNA, 25 bp, Mus musculus
ggcgcgcatacttcgtgcctagaga

SEQ ID NO: 396921 - DNA, 25 bp, Mus musculus
ctgcccggaaacaaagtgcaccttt

SEQ ID NO: 396922 - DNA, 25 bp, Mus musculus
ccttggcttgtgctttccgctttct

SEQ ID NO: 396923 - DNA, 25 bp, Mus musculus
acagtcccggtgcaatagagccctc

SEQ ID NO: 396924 - DNA, 25 bp, Mus musculus
ccctatctgtcggaagttgaatatg

SEQ ID NO: 396925 - DNA, 25 bp, Mus musculus
gccgcattcctcttggactgcattg

SEQ ID NO: 396926 - DNA, 25 bp, Mus musculus
tgggtcggtcaggactttaatcttc

SEQ ID NO: 396927 - DNA, 25 bp, Mus musculus
cttcctattggcgtagtcgtggcaa

SEQ ID NO: 396928 - DNA, 25 bp, Mus musculus
tggcaaggagcgtcaagcgcctctt

SEQ ID NO: 396929 - DNA, 25 bp, Mus musculus
cggccatggcttaccattcggcata

SEQ ID NO: 396930 - DNA, 25 bp, Mus musculus
agccagcctactagtcaatccgaga

SEQ ID NO: 396931 - DNA, 25 bp, Mus musculus
ccgattggaagagagctcaccagta

SEQ ID NO: 396932 - DNA, 25 bp, Mus musculus
ttccgacgagccaatggtagacagc

SEQ ID NO: 396933 - DNA, 25 bp, Mus musculus
accaggcaagagaagtagctgtttc

SEQ ID NO: 396934 - DNA, 25 bp, Mus musculus
gctgtttcagtagtgttcgtaccca

SEQ ID NO: 396935 - DNA, 25 bp, Mus musculus
ttcgtacccacgactcagcgaagta

SEQ ID NO: 396936 - DNA, 25 bp, Mus musculus
cgacccttgggtagagcgaacgtca

SEQ ID NO: 396937 - DNA, 25 bp, Mus musculus
cacctattggctggtagcgccgcaa

SEQ ID NO: 396938 - DNA, 25 bp, Mus musculus
tccaagcccagtcttacgtgccaga

SEQ ID NO: 396939 - DNA, 25 bp, Mus musculus
tatagccacattctgtactcccgtc

SEQ ID NO: 396940 - DNA, 25 bp, Mus musculus
cttacgtgccagatgacaaagaaga

SEQ ID NO: 396941 - DNA, 25 bp, Mus musculus
caccagggtgagcatgtagcagaat

SEQ ID NO: 396942 - DNA, 25 bp, Mus musculus
cagaatgctgcgaaggtgaacgcca

SEQ ID NO: 396943 - DNA, 25 bp, Mus musculus
catggcccaccggactctagggaca

SEQ ID NO: 396944 - DNA, 25 bp, Mus musculus
cccaatgagcccagtgtttgtgcac

SEQ ID NO: 396945 - DNA, 25 bp, Mus musculus
gcccagtgtttgtgcacctccagaa

SEQ ID NO: 396946 - DNA, 25 bp, Mus musculus
tgcacctccagaacatgcagacctg

SEQ ID NO: 396947 - DNA, 25 bp, Mus musculus
ctggaagcccgttcctggtacaact

SEQ ID NO: 396948 - DNA, 25 bp, Mus musculus
tcctggtacaactttcggacaacta

SEQ ID NO: 396949 - DNA, 25 bp, Mus musculus
ttcggacaactaagcccactatagc

SEQ ID NO: 396950 - DNA, 25 bp, Mus musculus
acaaagaagatgagggaggcgcaca

SEQ ID NO: 396951 - DNA, 25 bp, Mus musculus
aagcccactatagccacattctgta

SEQ ID NO: 396952 - DNA, 25 bp, Mus musculus
tcactcactattcggggttcatggc

SEQ ID NO: 396953 - DNA, 25 bp, Mus musculus
cagagcggccgtgcactctccagaa

SEQ ID NO: 396954 - DNA, 25 bp, Mus musculus
gcaggcgcaactcagggaacagagc

SEQ ID NO: 396955 - DNA, 25 bp, Mus musculus
ggatattcgacttgccactgctgcg

SEQ ID NO: 396956 - DNA, 25 bp, Mus musculus
acctgtagtttccatggatattcga

SEQ ID NO: 396957 - DNA, 25 bp, Mus musculus
gctgccttgcggaacctgtagtttc

SEQ ID NO: 396958 - DNA, 25 bp, Mus musculus
aatccttccgactcgggttgcgccg

SEQ ID NO: 396959 - DNA, 25 bp, Mus musculus
gcaggcgcaaatccttccgactcgg

SEQ ID NO: 396960 - DNA, 25 bp, Mus musculus
tccgcctcccgttccaagatggttg

SEQ ID NO: 396961 - DNA, 25 bp, Mus musculus
cggggctcactcactattcggggtt

SEQ ID NO: 396962 - DNA, 25 bp, Mus musculus
ccatagacaggatcgaggctgcgcc

SEQ ID NO: 396963 - DNA, 25 bp, Mus musculus
gccagacaacttcggcaagcatata

SEQ ID NO: 396964 - DNA, 25 bp, Mus musculus
ccgcgcagttctgaccaaggccaga

SEQ ID NO: 396965 - DNA, 25 bp, Mus musculus
aagatggttgccactccgccctaga

SEQ ID NO: 396966 - DNA, 25 bp, Mus musculus
gactgcggtctttagtttcgggaca

SEQ ID NO: 396967 - DNA, 25 bp, Mus musculus
acgcaatgcggtgtgactgaagtga

SEQ ID NO: 396968 - DNA, 25 bp, Mus musculus
gatcctcgaccgtgagctcgtctcg

SEQ ID NO: 396969 - DNA, 25 bp, Mus musculus
gtttcgggacaggtctcttcaggcc

SEQ ID NO: 396970 - DNA, 25 bp, Mus musculus
agccggccagctcgctgccttaaag

SEQ ID NO: 396971 - DNA, 25 bp, Mus musculus
tttcccagggcaagcggaaccacga

SEQ ID NO: 396972 - DNA, 25 bp, Mus musculus
gttcccaagtcagacgccacaggct

SEQ ID NO: 396973 - DNA, 25 bp, Mus musculus
ctagggcattgcaaggcgttcccaa

SEQ ID NO: 396974 - DNA, 25 bp, Mus musculus
tcggtacacagagcactagggcatt

SEQ ID NO: 396975 - DNA, 25 bp, Mus musculus
tcggaactgtcctaatcggtacaca

SEQ ID NO: 396976 - DNA, 25 bp, Mus musculus
agcccatcttcgagagttattcgga

SEQ ID NO: 396977 - DNA, 25 bp, Mus musculus
accggctcaggccagttgatctaaa

SEQ ID NO: 396978 - DNA, 25 bp, Mus musculus
gcctaggtccctatggatgtccaga

SEQ ID NO: 396979 - DNA, 25 bp, Mus musculus
ctcactgtccggcttgactgggtct

SEQ ID NO: 396980 - DNA, 25 bp, Mus musculus
ccctgggatctgcagtacacgtagt

SEQ ID NO: 396981 - DNA, 25 bp, Mus musculus
tggaaatcggatagcccgctgtggc

SEQ ID NO: 396982 - DNA, 25 bp, Mus musculus
cgcgttgcatggaaatcggatagcc

SEQ ID NO: 396983 - DNA, 25 bp, Mus musculus
tctggtcacgcgttgcatggaaatc

SEQ ID NO: 396984 - DNA, 25 bp, Mus musculus
cacgtagttctggtcacgcgttgca

SEQ ID NO: 396985 - DNA, 25 bp, Mus musculus
tctgcagtacacgtagttctggtca

SEQ ID NO: 396986 - DNA, 25 bp, Mus musculus
tggagtccctagcaggcctcggcgt

SEQ ID NO: 396987 - DNA, 25 bp, Mus musculus
gaaggggctacagcccgcgcgctct

SEQ ID NO: 396988 - DNA, 25 bp, Mus musculus
aatctgcacgcacgcgcgggctttc

SEQ ID NO: 396989 - DNA, 25 bp, Mus musculus
agcgcgagccaccagcgaatctgca

SEQ ID NO: 396990 - DNA, 25 bp, Mus musculus
gcgtctcctcagaacgcccggcgga

SEQ ID NO: 396991 - DNA, 25 bp, Mus musculus
ggcacgcgagcgactctcaggcttc

SEQ ID NO: 396992 - DNA, 25 bp, Mus musculus
gcttacgcagactgagggcacgcga

SEQ ID NO: 396993 - DNA, 25 bp, Mus musculus
agcggctcagcgcgtctcctcagaa

SEQ ID NO: 396994 - DNA, 25 bp, Mus musculus
tcctgggtaaccaagctccacttcg

SEQ ID NO: 396995 - DNA, 25 bp, Mus musculus
ccgccaacggaggttgcagagcctt

SEQ ID NO: 396996 - DNA, 25 bp, Mus musculus
aggacgaacgctcgctatgacatcc

SEQ ID NO: 396997 - DNA, 25 bp, Mus musculus
ggatcggcgctcctatctctgccaa

SEQ ID NO: 396998 - DNA, 25 bp, Mus musculus
ttgtagtttgcggatgcgccatcta

SEQ ID NO: 396999 - DNA, 25 bp, Mus musculus
taccggggaataggaatcgccgcca

SEQ ID NO: 397000 - DNA, 25 bp, Mus musculus
gtcccgcggtgattggagagaactt

SEQ ID NO: 397001 - DNA, 25 bp, Mus musculus
ttgcgtaatccacgtcccgcggtga

SEQ ID NO: 397002 - DNA, 25 bp, Mus musculus
cagaaacttccggttgcgtaatcca

SEQ ID NO: 397003 - DNA, 25 bp, Mus musculus
aggcgcgagaccaacacggaagctc

SEQ ID NO: 397004 - DNA, 25 bp, Mus musculus
gccgccatcttagccacaagaaggc

SEQ ID NO: 397005 - DNA, 25 bp, Mus musculus
actgcaactctcctttgggaggttc

SEQ ID NO: 397006 - DNA, 25 bp, Mus musculus
tgccaatctggcctgaagctcctgc

SEQ ID NO: 397007 - DNA, 25 bp, Mus musculus
tgcgccatctagaggacgaacgctc

SEQ ID NO: 397008 - DNA, 25 bp, Mus musculus
cttgcaaagtggctgcttgcggccc

SEQ ID NO: 397009 - DNA, 25 bp, Mus musculus
agggctctccgaacttcctagctag

SEQ ID NO: 397010 - DNA, 25 bp, Mus musculus
cgcaaccgatctcggggctgggcac

SEQ ID NO: 397011 - DNA, 25 bp, Mus musculus
acacctggcaggtgtcagtcggttt

SEQ ID NO: 397012 - DNA, 25 bp, Mus musculus
cagtcggtttggaaggctgacagcc

SEQ ID NO: 397013 - DNA, 25 bp, Mus musculus
tgacagcccacgcaggtcaaagcga

SEQ ID NO: 397014 - DNA, 25 bp, Mus musculus
tcaaagcgacagcagcccagggcca

SEQ ID NO: 397015 - DNA, 25 bp, Mus musculus
tctggcacttcccagggctcggtag

SEQ ID NO: 397016 - DNA, 25 bp, Mus musculus
cgcaagcaggctcgcgaaaagtttt

SEQ ID NO: 397017 - DNA, 25 bp, Mus musculus
aagttttcccagtagttcgcgatag

SEQ ID NO: 397018 - DNA, 25 bp, Mus musculus
gtcggcgccgtttccatgtcgtccg

SEQ ID NO: 397019 - DNA, 25 bp, Mus musculus
tagttcgcgataggccaggcctgtc

SEQ ID NO: 397020 - DNA, 25 bp, Mus musculus
gcggggaccaagctgcagtacagca

SEQ ID NO: 397021 - DNA, 25 bp, Mus musculus
actcgtccgcaacttgcaaagtggc

SEQ ID NO: 397022 - DNA, 25 bp, Mus musculus
tcttcctgagctctgtctgtccgca

SEQ ID NO: 397023 - DNA, 25 bp, Mus musculus
accatgctcactcgccactggggtt

SEQ ID NO: 397024 - DNA, 25 bp, Mus musculus
gcccggcaacatctgtaccagtcta

SEQ ID NO: 397025 - DNA, 25 bp, Mus musculus
atcaaatctgaggttggcagacttc

SEQ ID NO: 397026 - DNA, 25 bp, Mus musculus
cagacttcggagatgcagcccatga

SEQ ID NO: 397027 - DNA, 25 bp, Mus musculus
catgagttggcctcggttttgcacc

SEQ ID NO: 397028 - DNA, 25 bp, Mus musculus
cccagggacccagcagaaactgaca

SEQ ID NO: 397029 - DNA, 25 bp, Mus musculus
gcagcctacacaacagcccgaaggg

SEQ ID NO: 397030 - DNA, 25 bp, Mus musculus
cggacggaataaagagctcggtctc

SEQ ID NO: 397031 - DNA, 25 bp, Mus musculus
gcctccgagtccgaaaataccttca

SEQ ID NO: 397032 - DNA, 25 bp, Mus musculus
ctcttcacagggtgagcgggtttcc

SEQ ID NO: 397033 - DNA, 25 bp, Mus musculus
ctgccatgtttttgtgtctggtttc

SEQ ID NO: 397034 - DNA, 25 bp, Mus musculus
gcccgaaggagtcgtcagccatctt

SEQ ID NO: 397035 - DNA, 25 bp, Mus musculus
tcaggaaagccactgcaccatgctc

SEQ ID NO: 397036 - DNA, 25 bp, Mus musculus
gcgccctgcggtagttttgcaacca

SEQ ID NO: 397037 - DNA, 25 bp, Mus musculus
ggcctgccaatactcgcttccggaa

SEQ ID NO: 397038 - DNA, 25 bp, Mus musculus
ggagccctagtaccggaagtaggca

SEQ ID NO: 397039 - DNA, 25 bp, Mus musculus
attttgggaagagttgacctggcgc

SEQ ID NO: 397040 - DNA, 25 bp, Mus musculus
tgacctggcgctttagctgttacca

SEQ ID NO: 397041 - DNA, 25 bp, Mus musculus
tagctgttaccaaggcaaccggagg

SEQ ID NO: 397042 - DNA, 25 bp, Mus musculus
ccgaagctgcgcaggaaaagtgcca

SEQ ID NO: 397043 - DNA, 25 bp, Mus musculus
gagcgaatccaatcgcccgaagctg

SEQ ID NO: 397044 - DNA, 25 bp, Mus musculus
taactgcgaaggttcggagcgaatc

SEQ ID NO: 397045 - DNA, 25 bp, Mus musculus
caattcggggaaaacatagcatttc

SEQ ID NO: 397046 - DNA, 25 bp, Mus musculus
atccagcgtcaacaacaattcgggg

SEQ ID NO: 397047 - DNA, 25 bp, Mus musculus
gcatctgatccacttatccagcgtc

SEQ ID NO: 397048 - DNA, 25 bp, Mus musculus
tagttttgcaaccagcatctgatcc

SEQ ID NO: 397049 - DNA, 25 bp, Mus musculus
ggaaaagtgccacacgctgtccacc

SEQ ID NO: 397050 - DNA, 25 bp, Mus musculus
cgtgcagaactcgagcgcctcatgc

SEQ ID NO: 397051 - DNA, 25 bp, Mus musculus
tgcccgaggtgcagtactcaaacta

SEQ ID NO: 397052 - DNA, 25 bp, Mus musculus
gcggccatgttcgagtcgcttttca

SEQ ID NO: 397053 - DNA, 25 bp, Mus musculus
ctagctgcgagcaccagttctgtta

SEQ ID NO: 397054 - DNA, 25 bp, Mus musculus
tttgctcacaacacgctggcctacg

SEQ ID NO: 397055 - DNA, 25 bp, Mus musculus
cctacgaccttggaggcgacaatga

SEQ ID NO: 397056 - DNA, 25 bp, Mus musculus
tgcccaatgcgtcgctcgagacttt

SEQ ID NO: 397057 - DNA, 25 bp, Mus musculus
gctcgtcatgatcgcggagtacttc

SEQ ID NO: 397058 - DNA, 25 bp, Mus musculus
tggacgacgtgctctacgccaagct

SEQ ID NO: 397059 - DNA, 25 bp, Mus musculus
tgcgggcctctacgaccatttcaac

SEQ ID NO: 397060 - DNA, 25 bp, Mus musculus
tgcccagattcgtacaaagcagctg

SEQ ID NO: 397061 - DNA, 25 bp, Mus musculus
gcctagccgcaaagtggacatcatg

SEQ ID NO: 397062 - DNA, 25 bp, Mus musculus
ggccctactacggaggcttgcctca

SEQ ID NO: 397063 - DNA, 25 bp, Mus musculus
tactaccgtccaggcgagcacttcg

SEQ ID NO: 397064 - DNA, 25 bp, Mus musculus
atcctgcgcggcttttacagccttc

SEQ ID NO: 397065 - DNA, 25 bp, Mus musculus
aaggcccatcgccagcgggaagtga

SEQ ID NO: 397066 - DNA, 25 bp, Mus musculus
tgggtgacaagttctggcgttctcc

SEQ ID NO: 397067 - DNA, 25 bp, Mus musculus
acaagttctggcgttctccggtcct

SEQ ID NO: 397068 - DNA, 25 bp, Mus musculus
ttctggcgttctccggtcctgcggc

SEQ ID NO: 397069 - DNA, 25 bp, Mus musculus
caggtgacagggtcaggaggcagaa

SEQ ID NO: 397070 - DNA, 25 bp, Mus musculus
aggccaaggcccatcgccagcggga

SEQ ID NO: 397071 - DNA, 25 bp, Mus musculus
ccagcgggaagtgaggacgctccat

SEQ ID NO: 397072 - DNA, 25 bp, Mus musculus
aggacgctccatagccgcggattca

SEQ ID NO: 397073 - DNA, 25 bp, Mus musculus
tccatagccgcggattcagtgtctg

SEQ ID NO: 397074 - DNA, 25 bp, Mus musculus
gccgcggattcagtgtctggacttc

SEQ ID NO: 397075 - DNA, 25 bp, Mus musculus
cggattcagtgtctggacttccatc

SEQ ID NO: 397076 - DNA, 25 bp, Mus musculus
gcggcttttacagccttcgcgggcc

SEQ ID NO: 397077 - DNA, 25 bp, Mus musculus
ttcagtgtctggacttccatcctgc

SEQ ID NO: 397078 - DNA, 25 bp, Mus musculus
ccggagccatagagttgacgcgcaa

SEQ ID NO: 397079 - DNA, 25 bp, Mus musculus
gacctccgaggagaatgcgttttcc

SEQ ID NO: 397080 - DNA, 25 bp, Mus musculus
cccttccggtctgtgggatcgagac

SEQ ID NO: 397081 - DNA, 25 bp, Mus musculus
cgctgttttccggttcctctcaaga

SEQ ID NO: 397082 - DNA, 25 bp, Mus musculus
atccggctttcgatggcttttgttt

SEQ ID NO: 397083 - DNA, 25 bp, Mus musculus
gcaggtctagctacccggagccata

SEQ ID NO: 397084 - DNA, 25 bp, Mus musculus
gcactcggaacttaggcttgcctca

SEQ ID NO: 397085 - DNA, 25 bp, Mus musculus
ggcggaacgcagctcaccttagatt

SEQ ID NO: 397086 - DNA, 25 bp, Mus musculus
acctcaagctacgagacggttcctc

SEQ ID NO: 397087 - DNA, 25 bp, Mus musculus
ctctcctgccttgggtgttgaagcc

SEQ ID NO: 397088 - DNA, 25 bp, Mus musculus
tactgtcgccgtcaacctggaaagc

SEQ ID NO: 397089 - DNA, 25 bp, Mus musculus
ttgtttgctctttggtccctcgctg

SEQ ID NO: 397090 - DNA, 25 bp, Mus musculus
acctgcaggtcacagttgtttgctc

SEQ ID NO: 397091 - DNA, 25 bp, Mus musculus
cgcggtttcctcaggtctgtcacct

SEQ ID NO: 397092 - DNA, 25 bp, Mus musculus
tgccagctactggtctctgcgcacg

SEQ ID NO: 397093 - DNA, 25 bp, Mus musculus
tgggaacctccaaaggctcacggga

SEQ ID NO: 397094 - DNA, 25 bp, Mus musculus
ctgttgccggaaactaagaggggct

SEQ ID NO: 397095 - DNA, 25 bp, Mus musculus
accctagcccagacgacgcgaaatg

SEQ ID NO: 397096 - DNA, 25 bp, Mus musculus
catgattattgcgtccgcctggagc

SEQ ID NO: 397097 - DNA, 25 bp, Mus musculus
tcgccacggtgcttctttgacgacc

SEQ ID NO: 397098 - DNA, 25 bp, Mus musculus
tgtttcttatgctcgcgatgccgtg

SEQ ID NO: 397099 - DNA, 25 bp, Mus musculus
cgctgctccggtgcttgtgtttctt

SEQ ID NO: 397100 - DNA, 25 bp, Mus musculus
tccgcttggcttcgttcgcgaccgt

SEQ ID NO: 397101 - DNA, 25 bp, Mus musculus
gcctcgtagccgtcatcgcgtttct

SEQ ID NO: 397102 - DNA, 25 bp, Mus musculus
gcacctgtagagactgcgccgtcca

SEQ ID NO: 397103 - DNA, 25 bp, Mus musculus
ggacgtctttaacccgagaggcaga

SEQ ID NO: 397104 - DNA, 25 bp, Mus musculus
ccctctcgcgccatctaagatggta

SEQ ID NO: 397105 - DNA, 25 bp, Mus musculus
aggcagatggccctcgaggtcctcc

SEQ ID NO: 397106 - DNA, 25 bp, Mus musculus
cgtgactgtgtttgtctataaagtt

SEQ ID NO: 397107 - DNA, 25 bp, Mus musculus
ggcgtcaggccgtgaacacctaaag

SEQ ID NO: 397108 - DNA, 25 bp, Mus musculus
tcaccggcggaaaccgcgcgttata

SEQ ID NO: 397109 - DNA, 25 bp, Mus musculus
ccgcgcgttatacttcttcttcttg

SEQ ID NO: 397110 - DNA, 25 bp, Mus musculus
gtcctggtgccgtttactccgccta

SEQ ID NO: 397111 - DNA, 25 bp, Mus musculus
agtgccgcccgtagacaagcagctc

SEQ ID NO: 397112 - DNA, 25 bp, Mus musculus
tcgagcgctgggcttcggatcctct

SEQ ID NO: 397113 - DNA, 25 bp, Mus musculus
gctaaagtacgaacgttagctccgc

SEQ ID NO: 397114 - DNA, 25 bp, Mus musculus
gaagacctgcacctcccgggattct

SEQ ID NO: 397115 - DNA, 25 bp, Mus musculus
gagggacggcaacccttaagctgtg

SEQ ID NO: 397116 - DNA, 25 bp, Mus musculus
ctcagagcctcggtgtttcacggtg

SEQ ID NO: 397117 - DNA, 25 bp, Mus musculus
gttcgagtctggatggtacccattg

SEQ ID NO: 397118 - DNA, 25 bp, Mus musculus
ttaagctgtgggcactaatggcggc

SEQ ID NO: 397119 - DNA, 25 bp, Mus musculus
cctggtcctatctggttcgagtctg

SEQ ID NO: 397120 - DNA, 25 bp, Mus musculus
tgggcacatagagacggggtccatc

SEQ ID NO: 397121 - DNA, 25 bp, Mus musculus
cccagggcatgtaccgagactacgg

SEQ ID NO: 397122 - DNA, 25 bp, Mus musculus
ggggacctgagtttggacagcatca

SEQ ID NO: 397123 - DNA, 25 bp, Mus musculus
ttagtctagtttgctccgggatttg

SEQ ID NO: 397124 - DNA, 25 bp, Mus musculus
gaccgaggatcctgcacgttctgtg

SEQ ID NO: 397125 - DNA, 25 bp, Mus musculus
gtatctccctagctgactgtctttc

SEQ ID NO: 397126 - DNA, 25 bp, Mus musculus
ccgtggtgcaagtggttcagcccaa

SEQ ID NO: 397127 - DNA, 25 bp, Mus musculus
aggtgttctccatctccagttaata

SEQ ID NO: 397128 - DNA, 25 bp, Mus musculus
agagaattcttagcagcctgtccga

SEQ ID NO: 397129 - DNA, 25 bp, Mus musculus
tgcgcagtatagagcccatgggccc

SEQ ID NO: 397130 - DNA, 25 bp, Mus musculus
agtcctcatctctttgtgcgcagta

SEQ ID NO: 397131 - DNA, 25 bp, Mus musculus
cggaccggtccacagaggttcatct

SEQ ID NO: 397132 - DNA, 25 bp, Mus musculus
ccaagtcggtcgctttctgtctgta

SEQ ID NO: 397133 - DNA, 25 bp, Mus musculus
cctggacaggatcagaggtgttctc

SEQ ID NO: 397134 - DNA, 25 bp, Mus musculus
cacgccgtcctcgttggcgctccga

SEQ ID NO: 397135 - DNA, 25 bp, Mus musculus
cgcccgggatgcttgggtcccaaag

SEQ ID NO: 397136 - DNA, 25 bp, Mus musculus
aaagagctgccactggcgcgccgca

SEQ ID NO: 397137 - DNA, 25 bp, Mus musculus
agaggtcgcgcagctcccggttctc

SEQ ID NO: 397138 - DNA, 25 bp, Mus musculus
gcgccggttgagctgtttgagctca

SEQ ID NO: 397139 - DNA, 25 bp, Mus musculus
agctgtttgagctcacggatctcgc

SEQ ID NO: 397140 - DNA, 25 bp, Mus musculus
gagctcacggatctcgcccaggtga

SEQ ID NO: 397141 - DNA, 25 bp, Mus musculus
gaccctgcagctgccgattcacctc

SEQ ID NO: 397142 - DNA, 25 bp, Mus musculus
attcacctcctgcatcaggcggccg

SEQ ID NO: 397143 - DNA, 25 bp, Mus musculus
gccgccatctcctcgtccgtcagct

SEQ ID NO: 397144 - DNA, 25 bp, Mus musculus
ctgcttcggcctccatagttgatca

SEQ ID NO: 397145 - DNA, 25 bp, Mus musculus
ctccatagttgatcaggcagctgca

SEQ ID NO: 397146 - DNA, 25 bp, Mus musculus
gggccggttgcctctcaggctccga

SEQ ID NO: 397147 - DNA, 25 bp, Mus musculus
ttgggtcccaaagagctgccactgg

SEQ ID NO: 397148 - DNA, 25 bp, Mus musculus
cccttatagatgaagacgtgtatcg

SEQ ID NO: 397149 - DNA, 25 bp, Mus musculus
tcacagagctgagcggtgtctcact

SEQ ID NO: 397150 - DNA, 25 bp, Mus musculus
ttccgaaaaaccgttcacagagctg

SEQ ID NO: 397151 - DNA, 25 bp, Mus musculus
gtgtctcactagctccgtcccggaa

SEQ ID NO: 397152 - DNA, 25 bp, Mus musculus
ccgtcccggaagtggtccttcatca

SEQ ID NO: 397153 - DNA, 25 bp, Mus musculus
tggtccttcatcagctccgggtgcc

SEQ ID NO: 397154 - DNA, 25 bp, Mus musculus
tggggaacacgacccttatagatga

SEQ ID NO: 397155 - DNA, 25 bp, Mus musculus
tccgggtgcccggagcaaaatctcc

SEQ ID NO: 397156 - DNA, 25 bp, Mus musculus
catgaccagcgaactagacattttc

SEQ ID NO: 397157 - DNA, 25 bp, Mus musculus
agcaaaatctccgaactcccggaag

SEQ ID NO: 397158 - DNA, 25 bp, Mus musculus
actcccggaagtcgctctgcggcta

SEQ ID NO: 397159 - DNA, 25 bp, Mus musculus
ggggcccgtacaagctccagcttcg

SEQ ID NO: 397160 - DNA, 25 bp, Mus musculus
cccgggcatcgtcatgaccagcgaa

SEQ ID NO: 397161 - DNA, 25 bp, Mus musculus
actagacattttcgtggggaacacg

SEQ ID NO: 397162 - DNA, 25 bp, Mus musculus
catcaaggtcagtggcctaaggatc

SEQ ID NO: 397163 - DNA, 25 bp, Mus musculus
atagggtctaggtgggcagaataac

SEQ ID NO: 397164 - DNA, 25 bp, Mus musculus
tctaggtgggcagaataacattttg

SEQ ID NO: 397165 - DNA, 25 bp, Mus musculus
ataacattttgagtgaaggcccggg

SEQ ID NO: 397166 - DNA, 25 bp, Mus musculus
tggcctaaggatccaaactttggga

SEQ ID NO: 397167 - DNA, 25 bp, Mus musculus
ccaaactttgggaaactctggctgg

SEQ ID NO: 397168 - DNA, 25 bp, Mus musculus
gtccagtgagctgcgcggtccgtcc

SEQ ID NO: 397169 - DNA, 25 bp, Mus musculus
aggcctgcgcttcacgactcgcggg

SEQ ID NO: 397170 - DNA, 25 bp, Mus musculus
gggccataggcctgcgaaaggattc

SEQ ID NO: 397171 - DNA, 25 bp, Mus musculus
taggcctgcgaaaggattctgtccc

SEQ ID NO: 397172 - DNA, 25 bp, Mus musculus
tggaaggttccagcctcagcacagt

SEQ ID NO: 397173 - DNA, 25 bp, Mus musculus
gcacagtcctgagacgagacagctg

SEQ ID NO: 397174 - DNA, 25 bp, Mus musculus
gccaagcatcaaggtcagtggccta

SEQ ID NO: 397175 - DNA, 25 bp, Mus musculus
catgggattccggaggcacaggtta

SEQ ID NO: 397176 - DNA, 25 bp, Mus musculus
cccacttctagaaagagcgattaca

SEQ ID NO: 397177 - DNA, 25 bp, Mus musculus
agagaagcggtcttggtatcccatc

SEQ ID NO: 397178 - DNA, 25 bp, Mus musculus
tgcggaacccggtagcagctagttc

SEQ ID NO: 397179 - DNA, 25 bp, Mus musculus
tttcggtgcaaaatcctcggacttc

SEQ ID NO: 397180 - DNA, 25 bp, Mus musculus
tcattgtgcggctcctactaaacgg

SEQ ID NO: 397181 - DNA, 25 bp, Mus musculus
cgtttccggaaacatggtgagcatt

SEQ ID NO: 397182 - DNA, 25 bp, Mus musculus
tgagcattaggccactgcgcccgag

SEQ ID NO: 397183 - DNA, 25 bp, Mus musculus
cccgagcgagattaagggtctcatt

SEQ ID NO: 397184 - DNA, 25 bp, Mus musculus
aacgctcgctggttctcgatggcgc

SEQ ID NO: 397185 - DNA, 25 bp, Mus musculus
agagcacgcggcatccaaaccctgg

SEQ ID NO: 397186 - DNA, 25 bp, Mus musculus
catcggggaacctgattgagacgct

SEQ ID NO: 397187 - DNA, 25 bp, Mus musculus
tgtagtcactgtacctcgggctaga

SEQ ID NO: 397188 - DNA, 25 bp, Mus musculus
ttcttgcaacacgagtcacggagtg

SEQ ID NO: 397189 - DNA, 25 bp, Mus musculus
cgctggttctggagccttcttgcaa

SEQ ID NO: 397190 - DNA, 25 bp, Mus musculus
acctctgggtggctctgccctgttt

SEQ ID NO: 397191 - DNA, 25 bp, Mus musculus
cgacactgaggtcgcacagaacaac

SEQ ID NO: 397192 - DNA, 25 bp, Mus musculus
ctttgagcccgtcccaaagggctgg

SEQ ID NO: 397193 - DNA, 25 bp, Mus musculus
aggtcgcacagaacaacctcggtcc

SEQ ID NO: 397194 - DNA, 25 bp, Mus musculus
ctgggcataaagctgccccgggacc

SEQ ID NO: 397195 - DNA, 25 bp, Mus musculus
tgccctgtttccgacgctggacctg

SEQ ID NO: 397196 - DNA, 25 bp, Mus musculus
ctgtttccgacgctggacctgggcg

SEQ ID NO: 397197 - DNA, 25 bp, Mus musculus
gcgccgtggagtttggtccccagat

SEQ ID NO: 397198 - DNA, 25 bp, Mus musculus
cccagatagcctcagggagcgcaga

SEQ ID NO: 397199 - DNA, 25 bp, Mus musculus
cagatagcctcagggagcgcagacc

SEQ ID NO: 397200 - DNA, 25 bp, Mus musculus
ctgccgctccttctgcgacccgaca

SEQ ID NO: 397201 - DNA, 25 bp, Mus musculus
cttctgcgacccgacactgaggtcg

SEQ ID NO: 397202 - DNA, 25 bp, Mus musculus
gacccgacactgaggtcgcacagaa

SEQ ID NO: 397203 - DNA, 25 bp, Mus musculus
cggggcgctgggcataaagctgccc

SEQ ID NO: 397204 - DNA, 25 bp, Mus musculus
ccgggtaagtgacccgcactgctgt

SEQ ID NO: 397205 - DNA, 25 bp, Mus musculus
gctcacttccgttagatcggctcca

SEQ ID NO: 397206 - DNA, 25 bp, Mus musculus
tcgccagtcgatgctgggcagtttg

SEQ ID NO: 397207 - DNA, 25 bp, Mus musculus
ctctacggacattcgagagtaggcg

SEQ ID NO: 397208 - DNA, 25 bp, Mus musculus
gcagtttgcgagcactctacggaca

SEQ ID NO: 397209 - DNA, 25 bp, Mus musculus
cgagcccttagagaagcatggatgc

SEQ ID NO: 397210 - DNA, 25 bp, Mus musculus
tgaatcgctgaagtggctgcgctgc

SEQ ID NO: 397211 - DNA, 25 bp, Mus musculus
agctaactgggtttcgctgcggtcc

SEQ ID NO: 397212 - DNA, 25 bp, Mus musculus
gcgcaccagtgagctgagctaactg

SEQ ID NO: 397213 - DNA, 25 bp, Mus musculus
tggtcccgctttcgtgacgtctttc

SEQ ID NO: 397214 - DNA, 25 bp, Mus musculus
cgtgccagcgacagcctattggtcc

SEQ ID NO: 397215 - DNA, 25 bp, Mus musculus
agcaggcgtggcctaaacaaaccac

SEQ ID NO: 397216 - DNA, 25 bp, Mus musculus
gaccaagttggaaggcagctcctga

SEQ ID NO: 397217 - DNA, 25 bp, Mus musculus
tcggctccaaatagctctgcgtggc

SEQ ID NO: 397218 - DNA, 25 bp, Mus musculus
gtcctgcgaggcatcagggtgtcca

SEQ ID NO: 397219 - DNA, 25 bp, Mus musculus
aggcatcagggtgtccagacgctct

SEQ ID NO: 397220 - DNA, 25 bp, Mus musculus
ggtgtccagacgctctcgcgatctc

SEQ ID NO: 397221 - DNA, 25 bp, Mus musculus
gacgctctcgcgatctctctagaga

SEQ ID NO: 397222 - DNA, 25 bp, Mus musculus
tctctagagacacccgggcagcagt

SEQ ID NO: 397223 - DNA, 25 bp, Mus musculus
gcagcagtcgctggggctccatagc

SEQ ID NO: 397224 - DNA, 25 bp, Mus musculus
tccatagctgggcaccagggtggct

SEQ ID NO: 397225 - DNA, 25 bp, Mus musculus
gggcaccagggtggctcctgctcct

SEQ ID NO: 397226 - DNA, 25 bp, Mus musculus
cctgctcctcgttttttgcaacatg

SEQ ID NO: 397227 - DNA, 25 bp, Mus musculus
tttttgcaacatgtgaccaggcgga

SEQ ID NO: 397228 - DNA, 25 bp, Mus musculus
tgaccaggcggagagacgctcataa

SEQ ID NO: 397229 - DNA, 25 bp, Mus musculus
ggagagacgctcataaccggccaca

SEQ ID NO: 397230 - DNA, 25 bp, Mus musculus
cggccacaccggacaactagggatc

SEQ ID NO: 397231 - DNA, 25 bp, Mus musculus
caactagggatcttctgcacggggc

SEQ ID NO: 397232 - DNA, 25 bp, Mus musculus
tgtcagtcccgcaggtggaccccta

SEQ ID NO: 397233 - DNA, 25 bp, Mus musculus
gcgcccatattcttcggggggacca

SEQ ID NO: 397234 - DNA, 25 bp, Mus musculus
gcggggacgcaataaggcccggata

SEQ ID NO: 397235 - DNA, 25 bp, Mus musculus
cggagtaagcagcttaaggagccgc

SEQ ID NO: 397236 - DNA, 25 bp, Mus musculus
ccagaaagtacggagtaagcagctt

SEQ ID NO: 397237 - DNA, 25 bp, Mus musculus
tcacacccgggccagaaagtacgga

SEQ ID NO: 397238 - DNA, 25 bp, Mus musculus
ttccagttttcacacccgggccaga

SEQ ID NO: 397239 - DNA, 25 bp, Mus musculus
aagcgcttccgttccagttttcaca

SEQ ID NO: 397240 - DNA, 25 bp, Mus musculus
tctgtggagaaagcgcttccgttcc

SEQ ID NO: 397241 - DNA, 25 bp, Mus musculus
caatgtctgtggagaaagcgcttcc

SEQ ID NO: 397242 - DNA, 25 bp, Mus musculus
gcaggctgcaatgtctgtggagaaa

SEQ ID NO: 397243 - DNA, 25 bp, Mus musculus
gcactagggcagcttggcgccacca

SEQ ID NO: 397244 - DNA, 25 bp, Mus musculus
cgccttcttctaacgggcacgagca

SEQ ID NO: 397245 - DNA, 25 bp, Mus musculus
cgagcagaggcgcacatgcgcacta

SEQ ID NO: 397246 - DNA, 25 bp, Mus musculus
ccagcgtgctcacgtttgcaaacta

SEQ ID NO: 397247 - DNA, 25 bp, Mus musculus
taagtcgagttcgtgtggtcgtccc

SEQ ID NO: 397248 - DNA, 25 bp, Mus musculus
ccacgttcttaggacagagtgtacc

SEQ ID NO: 397249 - DNA, 25 bp, Mus musculus
accacgcgtggcgtttccaactacg

SEQ ID NO: 397250 - DNA, 25 bp, Mus musculus
caccgggatcgcagaagcgctaagc

SEQ ID NO: 397251 - DNA, 25 bp, Mus musculus
aagccagcgtcctttagctcgactg

SEQ ID NO: 397252 - DNA, 25 bp, Mus musculus
cggctgctcgcgaagtcttcaagtg

SEQ ID NO: 397253 - DNA, 25 bp, Mus musculus
tgtcgaaccggtttccattccgctg

SEQ ID NO: 397254 - DNA, 25 bp, Mus musculus
cggttcgctctggtaagtcgagttc

SEQ ID NO: 397255 - DNA, 25 bp, Mus musculus
cgctctgtgggcgatgacataaaac

SEQ ID NO: 397256 - DNA, 25 bp, Mus musculus
cggacgggttcacgctttattggct

SEQ ID NO: 397257 - DNA, 25 bp, Mus musculus
aggcgcctcacctggcacgtagatc

SEQ ID NO: 397258 - DNA, 25 bp, Mus musculus
aacgttatttgcaccggcgctcgca

SEQ ID NO: 397259 - DNA, 25 bp, Mus musculus
ggagctcgctccagttcctcttgca

SEQ ID NO: 397260 - DNA, 25 bp, Mus musculus
ccctgtaggcaatccgtgcgacttc

SEQ ID NO: 397261 - DNA, 25 bp, Mus musculus
tgcaagacggccctagggtaacagc

SEQ ID NO: 397262 - DNA, 25 bp, Mus musculus
ggcattatctccgaagcctccagag

SEQ ID NO: 397263 - DNA, 25 bp, Mus musculus
ccgggctgttgcttccggcattatc

SEQ ID NO: 397264 - DNA, 25 bp, Mus musculus
cgatcctgcgggtcctatcctgcag

SEQ ID NO: 397265 - DNA, 25 bp, Mus musculus
aggcttaatgagctctccgcacgca

SEQ ID NO: 397266 - DNA, 25 bp, Mus musculus
ctgtggtttcgatgcccttcgtagg

SEQ ID NO: 397267 - DNA, 25 bp, Mus musculus
actcaagcggtgagagaggccgacc

SEQ ID NO: 397268 - DNA, 25 bp, Mus musculus
ttactcagacctggcgaaaccggcg

SEQ ID NO: 397269 - DNA, 25 bp, Mus musculus
gcctgcacggcgagacagttactca

SEQ ID NO: 397270 - DNA, 25 bp, Mus musculus
cagggcctgggaacgcagttccatc

SEQ ID NO: 397271 - DNA, 25 bp, Mus musculus
cgttgaggacgccaagccaagccct

SEQ ID NO: 397272 - DNA, 25 bp, Mus musculus
agttcatctcgggacctaggcattg

SEQ ID NO: 397273 - DNA, 25 bp, Mus musculus
cttcgggcaaaggtcagcagctacc

SEQ ID NO: 397274 - DNA, 25 bp, Mus musculus
aacagcgtattcacctgcgccctgg

SEQ ID NO: 397275 - DNA, 25 bp, Mus musculus
ctacaggcgtcgtttcgcggtcgcg

SEQ ID NO: 397276 - DNA, 25 bp, Mus musculus
cctcctgcagggctacaggcgtcgt

SEQ ID NO: 397277 - DNA, 25 bp, Mus musculus
tggctttgcatgtccctcctgcagg

SEQ ID NO: 397278 - DNA, 25 bp, Mus musculus
ctggcctgatggctttgcatgtccc

SEQ ID NO: 397279 - DNA, 25 bp, Mus musculus
ctcccgtggccaggctggcctgatg

SEQ ID NO: 397280 - DNA, 25 bp, Mus musculus
acgatgcagacggtgagtccgagca

SEQ ID NO: 397281 - DNA, 25 bp, Mus musculus
ggtagatcgcttcttcacgcccgcc

SEQ ID NO: 397282 - DNA, 25 bp, Mus musculus
tgcgtggtgccgcaccggctaagct

SEQ ID NO: 397283 - DNA, 25 bp, Mus musculus
ggttgatagggaaactgaacttctc

SEQ ID NO: 397284 - DNA, 25 bp, Mus musculus
cggcagacgggaaacagcgtattca

SEQ ID NO: 397285 - DNA, 25 bp, Mus musculus
gtccgccacgatgcagacggtgagt

SEQ ID NO: 397286 - DNA, 25 bp, Mus musculus
tcctgccctgcgacgttctagtcag

SEQ ID NO: 397287 - DNA, 25 bp, Mus musculus
ctgcgacgttctagtcagccggccg

SEQ ID NO: 397288 - DNA, 25 bp, Mus musculus
ctgaggccaagtactagatggaatc

SEQ ID NO: 397289 - DNA, 25 bp, Mus musculus
gggaaacacttgagaatcactgcta

SEQ ID NO: 397290 - DNA, 25 bp, Mus musculus
gagaatcactgctagctggttggta

SEQ ID NO: 397291 - DNA, 25 bp, Mus musculus
caggacgttgtaaacctgaggccaa

SEQ ID NO: 397292 - DNA, 25 bp, Mus musculus
ctcgcacagcgattggaggaacgcc

SEQ ID NO: 397293 - DNA, 25 bp, Mus musculus
gaggaacgccgagtctgtcacgtga

SEQ ID NO: 397294 - DNA, 25 bp, Mus musculus
gtctgtcacgtgacgcccaccgggt

SEQ ID NO: 397295 - DNA, 25 bp, Mus musculus
ggatcatctccgtacgtccaaaagc

SEQ ID NO: 397296 - DNA, 25 bp, Mus musculus
acgccactcatcttcgttgtcctgg

SEQ ID NO: 397297 - DNA, 25 bp, Mus musculus
tcatcttcgttgtcctggttgcgcc

SEQ ID NO: 397298 - DNA, 25 bp, Mus musculus
cttgaagctgtttgaaagggaaaca

SEQ ID NO: 397299 - DNA, 25 bp, Mus musculus
ctgagtgcgctataggcccgagccc

SEQ ID NO: 397300 - DNA, 25 bp, Mus musculus
cacttccggagctgagtgcgctata

SEQ ID NO: 397301 - DNA, 25 bp, Mus musculus
gctggttggtagcaaaaagccggcc

SEQ ID NO: 397302 - DNA, 25 bp, Mus musculus
aattcagtcactggcctccgcggga

SEQ ID NO: 397303 - DNA, 25 bp, Mus musculus
tctccctgcgcagggcgaatggccg

SEQ ID NO: 397304 - DNA, 25 bp, Mus musculus
tccagtcccggccagggtgacatca

SEQ ID NO: 397305 - DNA, 25 bp, Mus musculus
gggtgacatcaccaaactcctgaga

SEQ ID NO: 397306 - DNA, 25 bp, Mus musculus
caaactcctgagatcagagcggggc

SEQ ID NO: 397307 - DNA, 25 bp, Mus musculus
aaacagagtgagtaatcgcgggccc

SEQ ID NO: 397308 - DNA, 25 bp, Mus musculus
tcgggacaaacagcctcggcgtcct

SEQ ID NO: 397309 - DNA, 25 bp, Mus musculus
ccgcctctggcgaatggctttactt

SEQ ID NO: 397310 - DNA, 25 bp, Mus musculus
tggctttactttagcgcgccgtggg

SEQ ID NO: 397311 - DNA, 25 bp, Mus musculus
ccgggaccctgaccatggacggtga

SEQ ID NO: 397312 - DNA, 25 bp, Mus musculus
gccttgactcagtgtccctcctggg

SEQ ID NO: 397313 - DNA, 25 bp, Mus musculus
gggtgaatcttgactccgtttcctc

SEQ ID NO: 397314 - DNA, 25 bp, Mus musculus
ggatgcagcacgctcgctccgcgaa

SEQ ID NO: 397315 - DNA, 25 bp, Mus musculus
cgcttaggaaaacgtgtggaattca

SEQ ID NO: 397316 - DNA, 25 bp, Mus musculus
tacgtcgcgacaggcacaattgaag

SEQ ID NO: 397317 - DNA, 25 bp, Mus musculus
cccggaaatcggcattggctgcaaa

SEQ ID NO: 397318 - DNA, 25 bp, Mus musculus
tccacgtgcgtgatgaagccttctg

SEQ ID NO: 397319 - DNA, 25 bp, Mus musculus
gccgagtccagcgaagtagtggtca

SEQ ID NO: 397320 - DNA, 25 bp, Mus musculus
tgaccagccgcttgctcaccattga

SEQ ID NO: 397321 - DNA, 25 bp, Mus musculus
gaaggtccaggccaatacgtcgcga

SEQ ID NO: 397322 - DNA, 25 bp, Mus musculus
cgcccgtggtacagatcgagttggt

SEQ ID NO: 397323 - DNA, 25 bp, Mus musculus
ccacagcagcctaacggagtttcca

SEQ ID NO: 397324 - DNA, 25 bp, Mus musculus
gagtcacctgtgcaagtaccttttc

SEQ ID NO: 397325 - DNA, 25 bp, Mus musculus
ggagccctagcgacctacctgatag

SEQ ID NO: 397326 - DNA, 25 bp, Mus musculus
cctcgatcgatttaacccggcatgc

SEQ ID NO: 397327 - DNA, 25 bp, Mus musculus
gcagcgctagttctctggtctcaca

SEQ ID NO: 397328 - DNA, 25 bp, Mus musculus
tggtctccgcaaacgtgaagcgctc

SEQ ID NO: 397329 - DNA, 25 bp, Mus musculus
acttcattagtagccaggtcctgca

SEQ ID NO: 397330 - DNA, 25 bp, Mus musculus
ggtccgacttagatttcacgccatg

SEQ ID NO: 397331 - DNA, 25 bp, Mus musculus
ccgtaaatcatggttgtcgcttggc

SEQ ID NO: 397332 - DNA, 25 bp, Mus musculus
ctccttagtgcgagaccgtaaatca

SEQ ID NO: 397333 - DNA, 25 bp, Mus musculus
ttccagtttgcgttaccgggtcaca

SEQ ID NO: 397334 - DNA, 25 bp, Mus musculus
gaatgggactcctcacggctacttc

SEQ ID NO: 397335 - DNA, 25 bp, Mus musculus
ttttccaatgcgttacaggaggcgg

SEQ ID NO: 397336 - DNA, 25 bp, Mus musculus
tgactggcgcaaagcttttccaatg

SEQ ID NO: 397337 - DNA, 25 bp, Mus musculus
cgcgcgcgcagtcaaattctagagc

SEQ ID NO: 397338 - DNA, 25 bp, Mus musculus
gcatgcgcccgttagaacctgttgg

SEQ ID NO: 397339 - DNA, 25 bp, Mus musculus
cagaactgttgtaaagcgccgagcc

SEQ ID NO: 397340 - DNA, 25 bp, Mus musculus
ggcttacgcctctacttccgggtca

SEQ ID NO: 397341 - DNA, 25 bp, Mus musculus
tcgccattgggtaacgacttgatga

SEQ ID NO: 397342 - DNA, 25 bp, Mus musculus
ctctcggagtgccagtgataggtcc

SEQ ID NO: 397343 - DNA, 25 bp, Mus musculus
atgcagaggtatcttaggcgcgcgc

SEQ ID NO: 397344 - DNA, 25 bp, Mus musculus
cagccgcgggttgtttatctggagt

SEQ ID NO: 397345 - DNA, 25 bp, Mus musculus
caccgggaccggagttttcacgcag

SEQ ID NO: 397346 - DNA, 25 bp, Mus musculus
gtcccgagctggaacgccaccggga

SEQ ID NO: 397347 - DNA, 25 bp, Mus musculus
ccgcggagatggagtggtcactcct

SEQ ID NO: 397348 - DNA, 25 bp, Mus musculus
gcaacttcccaaaactttgtgtcgc

SEQ ID NO: 397349 - DNA, 25 bp, Mus musculus
accaagcaaggtaggggcgcaactt

SEQ ID NO: 397350 - DNA, 25 bp, Mus musculus
aagacgccctggtgctcaccaagca

SEQ ID NO: 397351 - DNA, 25 bp, Mus musculus
catcatcacccaggcgcggagggaa

SEQ ID NO: 397352 - DNA, 25 bp, Mus musculus
gatggaacacggctccatcatcacc

SEQ ID NO: 397353 - DNA, 25 bp, Mus musculus
cccgcgggattgttagatggaacac

SEQ ID NO: 397354 - DNA, 25 bp, Mus musculus
ttggacccaaactgaggagcccgga

SEQ ID NO: 397355 - DNA, 25 bp, Mus musculus
cgctccggattctccatgttggacc

SEQ ID NO: 397356 - DNA, 25 bp, Mus musculus
agttttcacgcaggaccgggatgcc

SEQ ID NO: 397357 - DNA, 25 bp, Mus musculus
ttcctcctcttgttttcgctccgga

SEQ ID NO: 397358 - DNA, 25 bp, Mus musculus
gacggcggagaacgcatcagcatgc

SEQ ID NO: 397359 - DNA, 25 bp, Mus musculus
ctgcacgtgagcagcggtcccaggc

SEQ ID NO: 397360 - DNA, 25 bp, Mus musculus
agcagctgcgacggcgcgagcacct

SEQ ID NO: 397361 - DNA, 25 bp, Mus musculus
agctggaggtgttcgagcgcgagct

SEQ ID NO: 397362 - DNA, 25 bp, Mus musculus
gcgcgagctgacgctgctactgcag

SEQ ID NO: 397363 - DNA, 25 bp, Mus musculus
gaacgcatcagcatgcccctgggta

SEQ ID NO: 397364 - DNA, 25 bp, Mus musculus
cggcggagaacgcatcagcatgccc

SEQ ID NO: 397365 - DNA, 25 bp, Mus musculus
agcaaactccgagcaagggacggcg

SEQ ID NO: 397366 - DNA, 25 bp, Mus musculus
caccttcaagcggagcaaactccga

SEQ ID NO: 397367 - DNA, 25 bp, Mus musculus
gtggaccgagaacggccgcacgtgc

SEQ ID NO: 397368 - DNA, 25 bp, Mus musculus
ctactgcagcaggtggaccgagaac

SEQ ID NO: 397369 - DNA, 25 bp, Mus musculus
gcgctgcacgtgagcagcggtccca

SEQ ID NO: 397370 - DNA, 25 bp, Mus musculus
gctgctactgcagcaggtggaccga

SEQ ID NO: 397371 - DNA, 25 bp, Mus musculus
ggaggaggaactgacgcgcgctgca

SEQ ID NO: 397372 - DNA, 25 bp, Mus musculus
cattctctctggtgtctctcagcct

SEQ ID NO: 397373 - DNA, 25 bp, Mus musculus
ggatgcctctcagatcccgcgactg

SEQ ID NO: 397374 - DNA, 25 bp, Mus musculus
tccaccgagatttaaagggcagccg

SEQ ID NO: 397375 - DNA, 25 bp, Mus musculus
gcggagggatcttcgaacgactctc

SEQ ID NO: 397376 - DNA, 25 bp, Mus musculus
ccaaaaagtgtagccgggcgcttcg

SEQ ID NO: 397377 - DNA, 25 bp, Mus musculus
gtgattaatttttctggagggacca

SEQ ID NO: 397378 - DNA, 25 bp, Mus musculus
ccgccatattggattttactctcca

SEQ ID NO: 397379 - DNA, 25 bp, Mus musculus
ggtgctacgtccgtgccgccatatt

SEQ ID NO: 397380 - DNA, 25 bp, Mus musculus
ttcccgcagaattccgtcgaagcca

SEQ ID NO: 397381 - DNA, 25 bp, Mus musculus
cgcggcagggaacttcattctctct

SEQ ID NO: 397382 - DNA, 25 bp, Mus musculus
gggatttactcttgtgcctccgctg

SEQ ID NO: 397383 - DNA, 25 bp, Mus musculus
cgacggcaacgacgtggtttctttg

SEQ ID NO: 397384 - DNA, 25 bp, Mus musculus
gtggactccttttcgtgtccttcca

SEQ ID NO: 397385 - DNA, 25 bp, Mus musculus
atcgcggccactagcgcggagcaaa

SEQ ID NO: 397386 - DNA, 25 bp, Mus musculus
agaagtaccatgtccgccggctcga

SEQ ID NO: 397387 - DNA, 25 bp, Mus musculus
taatcgctgcgccaggtctcctgcg

SEQ ID NO: 397388 - DNA, 25 bp, Mus musculus
acgataagtgccagagccaccgccg

SEQ ID NO: 397389 - DNA, 25 bp, Mus musculus
ccgccctccagttgcaccagctgca

SEQ ID NO: 397390 - DNA, 25 bp, Mus musculus
cagctcctgcccagtgcagaaggca

SEQ ID NO: 397391 - DNA, 25 bp, Mus musculus
tgcccagtgcagaaggcacggatct

SEQ ID NO: 397392 - DNA, 25 bp, Mus musculus
gcacggatctggcacaggtacgtca

SEQ ID NO: 397393 - DNA, 25 bp, Mus musculus
ctggcacaggtacgtcatgacgatg

SEQ ID NO: 397394 - DNA, 25 bp, Mus musculus
ttgtcaggtacggacagaagtacca

SEQ ID NO: 397395 - DNA, 25 bp, Mus musculus
aggtctcctgcgtccagacagtcgg

SEQ ID NO: 397396 - DNA, 25 bp, Mus musculus
cggctgggcgttgcccacacgataa

SEQ ID NO: 397397 - DNA, 25 bp, Mus musculus
cgttgcccacacgataagtgccaga

SEQ ID NO: 397398 - DNA, 25 bp, Mus musculus
catgacgatgagcttgtcaggtacg

SEQ ID NO: 397399 - DNA, 25 bp, Mus musculus
tgcgtccagacagtcgggcaggctc

SEQ ID NO: 397400 - DNA, 25 bp, Mus musculus
gtggaaggaatgagtaccgatcgca

SEQ ID NO: 397401 - DNA, 25 bp, Mus musculus
agtaccgatcgcaaagccggtttga

SEQ ID NO: 397402 - DNA, 25 bp, Mus musculus
tcgcaaagccggtttgatgggcgcc

SEQ ID NO: 397403 - DNA, 25 bp, Mus musculus
gggcgaccctgcttccgggatctag

SEQ ID NO: 397404 - DNA, 25 bp, Mus musculus
tccgtgtagatatgtctgaggttta

SEQ ID NO: 397405 - DNA, 25 bp, Mus musculus
cccgtccgtgtagatatgtctgagg

SEQ ID NO: 397406 - DNA, 25 bp, Mus musculus
ttccgggatctagcgtccggacttg

SEQ ID NO: 397407 - DNA, 25 bp, Mus musculus
gagcgcgccgtttcctggagccgca

SEQ ID NO: 397408 - DNA, 25 bp, Mus musculus
ctcaagagtagcgagcgcgccgttt

SEQ ID NO: 397409 - DNA, 25 bp, Mus musculus
gctggtctcagctcaagagtagcga

SEQ ID NO: 397410 - DNA, 25 bp, Mus musculus
ggcgcgtcgagctggtctcagctca

SEQ ID NO: 397411 - DNA, 25 bp, Mus musculus
tagacctaggctgagtttgcccggg

SEQ ID NO: 397412 - DNA, 25 bp, Mus musculus
ctgaggtttagacctaggctgagtt

SEQ ID NO: 397413 - DNA, 25 bp, Mus musculus
gggatctagcgtccggacttggaca

SEQ ID NO: 397414 - DNA, 25 bp, Mus musculus
ttgcccagagaaccagctctccgtg

SEQ ID NO: 397415 - DNA, 25 bp, Mus musculus
gcgtggaccacgatgccgcctggac

SEQ ID NO: 397416 - DNA, 25 bp, Mus musculus
atctccttgcgcagcgcggctagtg

SEQ ID NO: 397417 - DNA, 25 bp, Mus musculus
cggctagtgcagagtcgaggttaac

SEQ ID NO: 397418 - DNA, 25 bp, Mus musculus
ccggtctccggagagatctcagcca

SEQ ID NO: 397419 - DNA, 25 bp, Mus musculus
cctcttacgttttcagcgggctgtt

SEQ ID NO: 397420 - DNA, 25 bp, Mus musculus
gactcagttcgtcgtggatgcggct

SEQ ID NO: 397421 - DNA, 25 bp, Mus musculus
ctcagtcgcgggcagcccgttcata

SEQ ID NO: 397422 - DNA, 25 bp, Mus musculus
ccactagcgttaagaaggccgctga

SEQ ID NO: 397423 - DNA, 25 bp, Mus musculus
atccagcggcatggcgaggaccatc

SEQ ID NO: 397424 - DNA, 25 bp, Mus musculus
acctgagttagcagatccagcggca

SEQ ID NO: 397425 - DNA, 25 bp, Mus musculus
ctccgttggctgtagacacgctcca

SEQ ID NO: 397426 - DNA, 25 bp, Mus musculus
ttcatagccaggcaggcgtggacca

SEQ ID NO: 397427 - DNA, 25 bp, Mus musculus
gggcctctcttaacgcggcgatgac

SEQ ID NO: 397428 - DNA, 25 bp, Mus musculus
gtgacgcttacacggtcttcctggc

SEQ ID NO: 397429 - DNA, 25 bp, Mus musculus
aggctcccaggtgaaatcgtcgaca

SEQ ID NO: 397430 - DNA, 25 bp, Mus musculus
tctcagcttcagtcggaggctccca

SEQ ID NO: 397431 - DNA, 25 bp, Mus musculus
ggagatgcgatcctgccgctcccgt

SEQ ID NO: 397432 - DNA, 25 bp, Mus musculus
cccatcagacgggagatgcgatcct

SEQ ID NO: 397433 - DNA, 25 bp, Mus musculus
gcggtaaccacggagcaggtagtcc

SEQ ID NO: 397434 - DNA, 25 bp, Mus musculus
acgtgtcgcccagcatgcggtaacc

SEQ ID NO: 397435 - DNA, 25 bp, Mus musculus
aagcgcatacctgcaccgttcaagg

SEQ ID NO: 397436 - DNA, 25 bp, Mus musculus
tcaaggccatgttgccgtggtcact

SEQ ID NO: 397437 - DNA, 25 bp, Mus musculus
actgctgggctcaccggaagtgatc

SEQ ID NO: 397438 - DNA, 25 bp, Mus musculus
cacaggagatagagagagctgcctc

SEQ ID NO: 397439 - DNA, 25 bp, Mus musculus
cggaagtgatccaaataagatgcgc

SEQ ID NO: 397440 - DNA, 25 bp, Mus musculus
cgcctcccacatgtggtagctgagg

SEQ ID NO: 397441 - DNA, 25 bp, Mus musculus
ctagagaaaacaggcacaggagata

SEQ ID NO: 397442 - DNA, 25 bp, Mus musculus
ggcagcagcgaaagacgcttgaacc

SEQ ID NO: 397443 - DNA, 25 bp, Mus musculus
ctccaatctccgagggtcgtgcggc

SEQ ID NO: 397444 - DNA, 25 bp, Mus musculus
acatcgtcgcttctccgggcagcag

SEQ ID NO: 397445 - DNA, 25 bp, Mus musculus
gacgcttgaaccagaaggaaaaaga

SEQ ID NO: 397446 - DNA, 25 bp, Mus musculus
gccagggaaaacaactgctcacttc

SEQ ID NO: 397447 - DNA, 25 bp, Mus musculus
gaaaacaactgctcacttctccctg

SEQ ID NO: 397448 - DNA, 25 bp, Mus musculus
tcgctgcggcctcagttcggggcct

SEQ ID NO: 397449 - DNA, 25 bp, Mus musculus
cctggctgggtttctcccggccagg

SEQ ID NO: 397450 - DNA, 25 bp, Mus musculus
cggccagggaagtttcttcgctcta

SEQ ID NO: 397451 - DNA, 25 bp, Mus musculus
gtttcttcgctctaccctcagtgca

SEQ ID NO: 397452 - DNA, 25 bp, Mus musculus
atcgctctccctcgcaacggggatc

SEQ ID NO: 397453 - DNA, 25 bp, Mus musculus
tgccctctgctaccaacactcgatc

SEQ ID NO: 397454 - DNA, 25 bp, Mus musculus
gcgcgctccagccagggaaaacaac

SEQ ID NO: 397455 - DNA, 25 bp, Mus musculus
gggctcgacctccaatctccgaggg

SEQ ID NO: 397456 - DNA, 25 bp, Mus musculus
ccctggggccaggacaaatctcggc

SEQ ID NO: 397457 - DNA, 25 bp, Mus musculus
tgcaggtgatcgcagatcctcccgg

SEQ ID NO: 397458 - DNA, 25 bp, Mus musculus
ctgccaggtgcctgctgcaggaacc

SEQ ID NO: 397459 - DNA, 25 bp, Mus musculus
gtctgtggctagcaaacacgccatt

SEQ ID NO: 397460 - DNA, 25 bp, Mus musculus
acacgccatttacgcggtgcaggtg

SEQ ID NO: 397461 - DNA, 25 bp, Mus musculus
ttccgttcaggtgcaccgcatcgag

SEQ ID NO: 397462 - DNA, 25 bp, Mus musculus
gaagcttccgttcaggtgcaccgca

SEQ ID NO: 397463 - DNA, 25 bp, Mus musculus
gtgcgtgtccatcaccctcctgaag

SEQ ID NO: 397464 - DNA, 25 bp, Mus musculus
ccgtggtgaacgtgcgtgtccatca

SEQ ID NO: 397465 - DNA, 25 bp, Mus musculus
cagaaggtactaggagacgggcaac

SEQ ID NO: 397466 - DNA, 25 bp, Mus musculus
ccaggacaaatctcggcagaaggta

SEQ ID NO: 397467 - DNA, 25 bp, Mus musculus
acaacatgcagccttcttggtgccc

SEQ ID NO: 397468 - DNA, 25 bp, Mus musculus
tttcacggggcgcttctgccaggtg

SEQ ID NO: 397469 - DNA, 25 bp, Mus musculus
agggtcctcctgcacaacatgcagc

SEQ ID NO: 397470 - DNA, 25 bp, Mus musculus
tggcggctaccgctgtgcctgcacg

SEQ ID NO: 397471 - DNA, 25 bp, Mus musculus
gccggcagagtacagtcccgcacag

SEQ ID NO: 397472 - DNA, 25 bp, Mus musculus
agtacagtcccgcacagcgccagtg

SEQ ID NO: 397473 - DNA, 25 bp, Mus musculus
gctgaattgtgattaccacctccac

SEQ ID NO: 397474 - DNA, 25 bp, Mus musculus
cctcgatgtcccatagacgtggatg

SEQ ID NO: 397475 - DNA, 25 bp, Mus musculus
tgtcccatagacgtggatgagtgcc

SEQ ID NO: 397476 - DNA, 25 bp, Mus musculus
tagacgtggatgagtgccaggatcc

SEQ ID NO: 397477 - DNA, 25 bp, Mus musculus
aggatccggctgcttgccgccctgg

SEQ ID NO: 397478 - DNA, 25 bp, Mus musculus
gccgctgcgtcaacctcccgggctc

SEQ ID NO: 397479 - DNA, 25 bp, Mus musculus
gggctcctaccgctgcgagtgtcac

SEQ ID NO: 397480 - DNA, 25 bp, Mus musculus
ccctccggccgcgactgccagctcc

SEQ ID NO: 397481 - DNA, 25 bp, Mus musculus
agcccatgctgaattgtgattacca

SEQ ID NO: 397482 - DNA, 25 bp, Mus musculus
gggaccagagcccatgctgaattgt

SEQ ID NO: 397483 - DNA, 25 bp, Mus musculus
tgagggcgacattcgtcctgggccg

SEQ ID NO: 397484 - DNA, 25 bp, Mus musculus
cccgcggggtgcagattgcaccaca

SEQ ID NO: 397485 - DNA, 25 bp, Mus musculus
cagattgcaccacagtgggacttca

SEQ ID NO: 397486 - DNA, 25 bp, Mus musculus
taagagcgagcggtgcgtgaacacc

SEQ ID NO: 397487 - DNA, 25 bp, Mus musculus
gtctgcaaagctggcttcacgcgca

SEQ ID NO: 397488 - DNA, 25 bp, Mus musculus
gtgggacttcacaagcctgcatcta

SEQ ID NO: 397489 - DNA, 25 bp, Mus musculus
gtgcgtgaacaccagtggatccttc

SEQ ID NO: 397490 - DNA, 25 bp, Mus musculus
aggctttcagctggacgcctcccgt

SEQ ID NO: 397491 - DNA, 25 bp, Mus musculus
ccagcggggactactgtgtaagagc

SEQ ID NO: 397492 - DNA, 25 bp, Mus musculus
agcctgcatctattatgccaccttg

SEQ ID NO: 397493 - DNA, 25 bp, Mus musculus
ccgagaactgaaccagcggggacta

SEQ ID NO: 397494 - DNA, 25 bp, Mus musculus
ttgatgagtgccgagaactgaacca

SEQ ID NO: 397495 - DNA, 25 bp, Mus musculus
tgccaccttgcagacattgatgagt

SEQ ID NO: 397496 - DNA, 25 bp, Mus musculus
atgcgagtgtcctggaggctttcag

SEQ ID NO: 397497 - DNA, 25 bp, Mus musculus
tggatccttccgctgtgtctgcaaa

SEQ ID NO: 397498 - DNA, 25 bp, Mus musculus
cgcgctcaccgagcggccggtgcac

SEQ ID NO: 397499 - DNA, 25 bp, Mus musculus
gctggagcaggacagccctcgcctg

SEQ ID NO: 397500 - DNA, 25 bp, Mus musculus
acagccctcgcctggggagagtaag

SEQ ID NO: 397501 - DNA, 25 bp, Mus musculus
agtaaggagaaagggatgagctccc

SEQ ID NO: 397502 - DNA, 25 bp, Mus musculus
ccggtgcacgcgaccgggaagaagc

SEQ ID NO: 397503 - DNA, 25 bp, Mus musculus
gcgcagcgaccgcagaagcgacatc

SEQ ID NO: 397504 - DNA, 25 bp, Mus musculus
gaccgcagaagcgacatccctctgg

SEQ ID NO: 397505 - DNA, 25 bp, Mus musculus
cccatcggcgcacagacgggacgcc

SEQ ID NO: 397506 - DNA, 25 bp, Mus musculus
gacgccggcctacggcgtggcgcga

SEQ ID NO: 397507 - DNA, 25 bp, Mus musculus
cgtggcgcgagagccaaaacgcctc

SEQ ID NO: 397508 - DNA, 25 bp, Mus musculus
aaaacgcctcccagaacgcgtggcg

SEQ ID NO: 397509 - DNA, 25 bp, Mus musculus
ccggcgtgaaacgtgagccatggct

SEQ ID NO: 397510 - DNA, 25 bp, Mus musculus
agccatggctgggacggctggagca

SEQ ID NO: 397511 - DNA, 25 bp, Mus musculus
aagaagcgcagcgaccgcagaagcg

SEQ ID NO: 397512 - DNA, 25 bp, Mus musculus
tacatagtaggaaaggccgaggtcg

SEQ ID NO: 397513 - DNA, 25 bp, Mus musculus
ttgcttgtccgtccctcggtccttc

SEQ ID NO: 397514 - DNA, 25 bp, Mus musculus
ttccgcccgccacgtcgtcactgct

SEQ ID NO: 397515 - DNA, 25 bp, Mus musculus
gggcaaagaaccacatcgtcgccgc

SEQ ID NO: 397516 - DNA, 25 bp, Mus musculus
gcccgttgccgggattctcggtcgc

SEQ ID NO: 397517 - DNA, 25 bp, Mus musculus
gggattctcggtcgccgccacgtca

SEQ ID NO: 397518 - DNA, 25 bp, Mus musculus
cgacacagcgaagccggcatacata

SEQ ID NO: 397519 - DNA, 25 bp, Mus musculus
cgaagccggcatacatagtaggaaa

SEQ ID NO: 397520 - DNA, 25 bp, Mus musculus
agcagcgcagtatctcacctttttg

SEQ ID NO: 397521 - DNA, 25 bp, Mus musculus
agtatctcacctttttgcggcctcg

SEQ ID NO: 397522 - DNA, 25 bp, Mus musculus
tctcacctttttgcggcctcggtgc

SEQ ID NO: 397523 - DNA, 25 bp, Mus musculus
ctcagggctcagctcgaacgggaag

SEQ ID NO: 397524 - DNA, 25 bp, Mus musculus
gtcccgggcaaagaaccacatcgtc

SEQ ID NO: 397525 - DNA, 25 bp, Mus musculus
gccttcggagcagcgcagtatctca

SEQ ID NO: 397526 - DNA, 25 bp, Mus musculus
tgcttgcctacgtccgccatgttag

SEQ ID NO: 397527 - DNA, 25 bp, Mus musculus
aataaccgtcagagcccggcccgtg

SEQ ID NO: 397528 - DNA, 25 bp, Mus musculus
ggtctatctcatcgcttcctaaaac

SEQ ID NO: 397529 - DNA, 25 bp, Mus musculus
acacgagcgctttggtgcttgccta

SEQ ID NO: 397530 - DNA, 25 bp, Mus musculus
ttccagccggtctaggcaaagtttc

SEQ ID NO: 397531 - DNA, 25 bp, Mus musculus
ccgcctccctttgtgagctgctgaa

SEQ ID NO: 397532 - DNA, 25 bp, Mus musculus
ctgggcccacggacatggctttttt

SEQ ID NO: 397533 - DNA, 25 bp, Mus musculus
gacacatactttgctcgtacgttta

SEQ ID NO: 397534 - DNA, 25 bp, Mus musculus
ttgatcccgtaaactggaggctgcc

SEQ ID NO: 397535 - DNA, 25 bp, Mus musculus
ggaggctgcctggatttttagaaaa

SEQ ID NO: 397536 - DNA, 25 bp, Mus musculus
aaaagctgctggagtcgtgggaaac

SEQ ID NO: 397537 - DNA, 25 bp, Mus musculus
tcccaggaccatggagaaagcgtca

SEQ ID NO: 397538 - DNA, 25 bp, Mus musculus
gcattgagatccagagctcgcgatc

SEQ ID NO: 397539 - DNA, 25 bp, Mus musculus
cttcaccacggtgctggaatgactg

SEQ ID NO: 397540 - DNA, 25 bp, Mus musculus
gctcgtctctcgttactgctgcctg

SEQ ID NO: 397541 - DNA, 25 bp, Mus musculus
catcagtgtcatcaggtcagtggct

SEQ ID NO: 397542 - DNA, 25 bp, Mus musculus
cgaggaccagttccacatcagtgtc

SEQ ID NO: 397543 - DNA, 25 bp, Mus musculus
gtaaggaattcctgcccggagcctg

SEQ ID NO: 397544 - DNA, 25 bp, Mus musculus
ggcctacctgtggtgtaaggaattc

SEQ ID NO: 397545 - DNA, 25 bp, Mus musculus
tctccgcgtgcagcgctgtaaagga

SEQ ID NO: 397546 - DNA, 25 bp, Mus musculus
agcttggtggccgaacccaacctct

SEQ ID NO: 397547 - DNA, 25 bp, Mus musculus
atgaaaaccaagttctgcaccgggg

SEQ ID NO: 397548 - DNA, 25 bp, Mus musculus
ctcggccgcttgtccagcatgaaaa

SEQ ID NO: 397549 - DNA, 25 bp, Mus musculus
tactgctgcctgacgtccattgctg

SEQ ID NO: 397550 - DNA, 25 bp, Mus musculus
tatagcagtcgcctgccgtcagcct

SEQ ID NO: 397551 - DNA, 25 bp, Mus musculus
ttgtgatgcgccaaagcgtccaatc

SEQ ID NO: 397552 - DNA, 25 bp, Mus musculus
atcgtggactcaccgcctgagccta

SEQ ID NO: 397553 - DNA, 25 bp, Mus musculus
ccggtcagtgaagccggcgagccat

SEQ ID NO: 397554 - DNA, 25 bp, Mus musculus
gaggtccgaaagtagggccggcaga

SEQ ID NO: 397555 - DNA, 25 bp, Mus musculus
cctgctcgcagggtgacgtcagtgc

SEQ ID NO: 397556 - DNA, 25 bp, Mus musculus
ttgccgccgcctgctcgcagggtga

SEQ ID NO: 397557 - DNA, 25 bp, Mus musculus
cgcgtgacttctcgggcgttgccgc

SEQ ID NO: 397558 - DNA, 25 bp, Mus musculus
ggatctctgcggtggcgcgtcaggc

SEQ ID NO: 397559 - DNA, 25 bp, Mus musculus
attccactcggtggcggagggatct

SEQ ID NO: 397560 - DNA, 25 bp, Mus musculus
tggaaaattccactcggtggcggag

SEQ ID NO: 397561 - DNA, 25 bp, Mus musculus
ggccggcagaaagcctggaaaattc

SEQ ID NO: 397562 - DNA, 25 bp, Mus musculus
cgggtcgcctcaggtcaccacgccc

SEQ ID NO: 397563 - DNA, 25 bp, Mus musculus
aaagtacacgggtcgcctcaggtca

SEQ ID NO: 397564 - DNA, 25 bp, Mus musculus
gcgctgaaggaaaagtacacgggtc

SEQ ID NO: 397565 - DNA, 25 bp, Mus musculus
gtcagcgctgaaggaaaagtacacg

SEQ ID NO: 397566 - DNA, 25 bp, Mus musculus
cgaatgtcagcgctgaaggaaaagt

SEQ ID NO: 397567 - DNA, 25 bp, Mus musculus
ccggcagaaagcctggaaaattcca

SEQ ID NO: 397568 - DNA, 25 bp, Mus musculus
cgcaagtctcaaagacccggtctag

SEQ ID NO: 397569 - DNA, 25 bp, Mus musculus
cgctctcaccttgcagggtcgcaga

SEQ ID NO: 397570 - DNA, 25 bp, Mus musculus
gcttacttagatcacgcaagtctca

SEQ ID NO: 397571 - DNA, 25 bp, Mus musculus
cctggttcccagcttacttagatca

SEQ ID NO: 397572 - DNA, 25 bp, Mus musculus
gcatttcgatctttggtccttccta

SEQ ID NO: 397573 - DNA, 25 bp, Mus musculus
gcgtactcccgcatttcgatctttg

SEQ ID NO: 397574 - DNA, 25 bp, Mus musculus
ggagccaatcggagccagaagcctc

SEQ ID NO: 397575 - DNA, 25 bp, Mus musculus
gcctctccgactgaaggagccaatc

SEQ ID NO: 397576 - DNA, 25 bp, Mus musculus
ttacgccgcagaagctgccgcggga

SEQ ID NO: 397577 - DNA, 25 bp, Mus musculus
cgattcgcaggcgttacgccgcaga

SEQ ID NO: 397578 - DNA, 25 bp, Mus musculus
gtcctgcccagggtcgattcgcagg

SEQ ID NO: 397579 - DNA, 25 bp, Mus musculus
gagcccactgcctcactccagaatg

SEQ ID NO: 397580 - DNA, 25 bp, Mus musculus
cagggtgtggctacgctctcacctt

SEQ ID NO: 397581 - DNA, 25 bp, Mus musculus
gagtcctgtattgtccctctcccgt

SEQ ID NO: 397582 - DNA, 25 bp, Mus musculus
tcacccgggtctctcaaggctggga

SEQ ID NO: 397583 - DNA, 25 bp, Mus musculus
acagagcgcgccgagaggctgctct

SEQ ID NO: 397584 - DNA, 25 bp, Mus musculus
cggccaggaagcaggcggctcgagc

SEQ ID NO: 397585 - DNA, 25 bp, Mus musculus
ccgcgacccgaggacagagcgcgcc

SEQ ID NO: 397586 - DNA, 25 bp, Mus musculus
gctggacggacacaggcgtcgaccc

SEQ ID NO: 397587 - DNA, 25 bp, Mus musculus
gcctcagcagaaccagagagtgacg

SEQ ID NO: 397588 - DNA, 25 bp, Mus musculus
gctctgcgccctggttcgctgagtt

SEQ ID NO: 397589 - DNA, 25 bp, Mus musculus
tgggcctcagcagaaccagagagtg

SEQ ID NO: 397590 - DNA, 25 bp, Mus musculus
gttcctgggcctcagcagaaccaga

SEQ ID NO: 397591 - DNA, 25 bp, Mus musculus
tgcgccctggttcgctgagttgacc

SEQ ID NO: 397592 - DNA, 25 bp, Mus musculus
ggttcgctgagttgacccctcgtca

SEQ ID NO: 397593 - DNA, 25 bp, Mus musculus
ccgtcccgcgcctccagtccctgcc

SEQ ID NO: 397594 - DNA, 25 bp, Mus musculus
ctcgtcagtcggctggacggacaca

SEQ ID NO: 397595 - DNA, 25 bp, Mus musculus
tcagcagaaccagagagtgacgggc

SEQ ID NO: 397596 - DNA, 25 bp, Mus musculus
ttcccggttaacgtcaccaggctgc

SEQ ID NO: 397597 - DNA, 25 bp, Mus musculus
aaggagcctaggatcccagtgcgca

SEQ ID NO: 397598 - DNA, 25 bp, Mus musculus
gcgcaggcgctaagccttctcagga

SEQ ID NO: 397599 - DNA, 25 bp, Mus musculus
agcgctcgagaacgacctgtcctga

SEQ ID NO: 397600 - DNA, 25 bp, Mus musculus
tgttcctctccctcaggccgggagg

SEQ ID NO: 397601 - DNA, 25 bp, Mus musculus
agaccactcacagcttcactacatt

SEQ ID NO: 397602 - DNA, 25 bp, Mus musculus
tcccaggtcctttacaagatttctg

SEQ ID NO: 397603 - DNA, 25 bp, Mus musculus
acagcaaggacttcccgggcatgtc

SEQ ID NO: 397604 - DNA, 25 bp, Mus musculus
cccagcagtcgcacagcaaggactt

SEQ ID NO: 397605 - DNA, 25 bp, Mus musculus
tttccaaaagaagcccagcgccgtc

SEQ ID NO: 397606 - DNA, 25 bp, Mus musculus
ccagtcctccacaagtttccaaaag

SEQ ID NO: 397607 - DNA, 25 bp, Mus musculus
gggaccgtgagcctctccttcgcag

SEQ ID NO: 397608 - DNA, 25 bp, Mus musculus
agtcttaggactccgcagggacggc

SEQ ID NO: 397609 - DNA, 25 bp, Mus musculus
caccaggctgcttaagtcttaggac

SEQ ID NO: 397610 - DNA, 25 bp, Mus musculus
tcactccgcgcggaaattgagaatc

SEQ ID NO: 397611 - DNA, 25 bp, Mus musculus
aaacgctttgcctagcgcgcgcttg

SEQ ID NO: 397612 - DNA, 25 bp, Mus musculus
ctacaccttagcttctccgtgagga

SEQ ID NO: 397613 - DNA, 25 bp, Mus musculus
gtccaggccgaagatctgtagttcc

SEQ ID NO: 397614 - DNA, 25 bp, Mus musculus
tctccgtgaggagcacagcacagga

SEQ ID NO: 397615 - DNA, 25 bp, Mus musculus
agccctcgagaggtctcgatccaga

SEQ ID NO: 397616 - DNA, 25 bp, Mus musculus
gggactcacgtttctccaacaggga

SEQ ID NO: 397617 - DNA, 25 bp, Mus musculus
tcgatccagagagaaaacttgcttc

SEQ ID NO: 397618 - DNA, 25 bp, Mus musculus
cgatcctctcggttcgggactcacg

SEQ ID NO: 397619 - DNA, 25 bp, Mus musculus
gccaccaggtcacagagaaatactt

SEQ ID NO: 397620 - DNA, 25 bp, Mus musculus
gacgtgtcacgagaccacctggcct

SEQ ID NO: 397621 - DNA, 25 bp, Mus musculus
agacgcttatcctttcgctttaccg

SEQ ID NO: 397622 - DNA, 25 bp, Mus musculus
aacagggagtcctcgtagtccaggc

SEQ ID NO: 397623 - DNA, 25 bp, Mus musculus
acttgcttccgaggactacacctta

SEQ ID NO: 397624 - DNA, 25 bp, Mus musculus
agctcgagttgcagagccgccggcc

SEQ ID NO: 397625 - DNA, 25 bp, Mus musculus
gtgacgccgccaacacagtcctcca

SEQ ID NO: 397626 - DNA, 25 bp, Mus musculus
gccgcagctcgagttgcagagccgc

SEQ ID NO: 397627 - DNA, 25 bp, Mus musculus
ctatgtcgccctccgggaaggtact

SEQ ID NO: 397628 - DNA, 25 bp, Mus musculus
gtatttttaactagggccgcagctc

SEQ ID NO: 397629 - DNA, 25 bp, Mus musculus
aaggtactggggacgatccggctca

SEQ ID NO: 397630 - DNA, 25 bp, Mus musculus
ggacgatccggctcagtgacgccgc

SEQ ID NO: 397631 - DNA, 25 bp, Mus musculus
aacacagtcctccacccgcctcctg

SEQ ID NO: 397632 - DNA, 25 bp, Mus musculus
gtgcctctgggttgcagctgtcttc

SEQ ID NO: 397633 - DNA, 25 bp, Mus musculus
ccggccagagagagggtagggcaag

SEQ ID NO: 397634 - DNA, 25 bp, Mus musculus
ggttgcagctgtcttccagcccagc

SEQ ID NO: 397635 - DNA, 25 bp, Mus musculus
actgggacagaagggcaccgccggc

SEQ ID NO: 397636 - DNA, 25 bp, Mus musculus
tgagaagggttggactgggacagaa

SEQ ID NO: 397637 - DNA, 25 bp, Mus musculus
ctctgggttgcagctgtcttccagc

SEQ ID NO: 397638 - DNA, 25 bp, Mus musculus
cgtccaaatggctcggcccgcggaa

SEQ ID NO: 397639 - DNA, 25 bp, Mus musculus
ggcagggttccagactgacgtaccc

SEQ ID NO: 397640 - DNA, 25 bp, Mus musculus
tctccggttctcagagtggacactg

SEQ ID NO: 397641 - DNA, 25 bp, Mus musculus
tgtgaggcgacctgactggttctca

SEQ ID NO: 397642 - DNA, 25 bp, Mus musculus
cctagcgttcacaggtgcgcgactg

SEQ ID NO: 397643 - DNA, 25 bp, Mus musculus
tgcgaggttcgcaactcctagcgtt

SEQ ID NO: 397644 - DNA, 25 bp, Mus musculus
cctgtcagatggctggagaccttag

SEQ ID NO: 397645 - DNA, 25 bp, Mus musculus
ggccgccagttttcggcctgtcaga

SEQ ID NO: 397646 - DNA, 25 bp, Mus musculus
accttgtcctttggggtcactgcga

SEQ ID NO: 397647 - DNA, 25 bp, Mus musculus
gagaacttggtacggtccactccgc

SEQ ID NO: 397648 - DNA, 25 bp, Mus musculus
atcggagcgcgcaaagagaacttgg

SEQ ID NO: 397649 - DNA, 25 bp, Mus musculus
tcacagctctcgctcgttccggttg

SEQ ID NO: 397650 - DNA, 25 bp, Mus musculus
tctacaacggcgactagcaagtggc

SEQ ID NO: 397651 - DNA, 25 bp, Mus musculus
tccaggcacattgagagccggagtc

SEQ ID NO: 397652 - DNA, 25 bp, Mus musculus
ggaacacggattcgggctcagtttc

SEQ ID NO: 397653 - DNA, 25 bp, Mus musculus
tacggtgctacagaatttgctcttc

SEQ ID NO: 397654 - DNA, 25 bp, Mus musculus
tcagggtcctttccctacggtgcta

SEQ ID NO: 397655 - DNA, 25 bp, Mus musculus
ttagcaatagcagggcgcaggtttc

SEQ ID NO: 397656 - DNA, 25 bp, Mus musculus
acaggtacctgtgggcatttgagaa

SEQ ID NO: 397657 - DNA, 25 bp, Mus musculus
tttactgtcagaggcgggtccctca

SEQ ID NO: 397658 - DNA, 25 bp, Mus musculus
cagacttggtttgagaccacccgga

SEQ ID NO: 397659 - DNA, 25 bp, Mus musculus
ctggccatccggcagatagagtccc

SEQ ID NO: 397660 - DNA, 25 bp, Mus musculus
aagagccggatctcccgtgggaaca

SEQ ID NO: 397661 - DNA, 25 bp, Mus musculus
agaaccggctgctctctgagtaaga

SEQ ID NO: 397662 - DNA, 25 bp, Mus musculus
tgatgctcagctcgtgcccacagaa

SEQ ID NO: 397663 - DNA, 25 bp, Mus musculus
gacccaaagttctgcgtgatgctca

SEQ ID NO: 397664 - DNA, 25 bp, Mus musculus
actgtcagaacggtgtctccatatg

SEQ ID NO: 397665 - DNA, 25 bp, Mus musculus
tcctagagatggatggggatgaccc

SEQ ID NO: 397666 - DNA, 25 bp, Mus musculus
ccttccgcatgggagaccgcgcaat

SEQ ID NO: 397667 - DNA, 25 bp, Mus musculus
actgagtgtcatatgcgcgcgcagc

SEQ ID NO: 397668 - DNA, 25 bp, Mus musculus
gcgcgcgcaggccacaaggaccgaa

SEQ ID NO: 397669 - DNA, 25 bp, Mus musculus
gccacaaggaccgaacgcctgcgta

SEQ ID NO: 397670 - DNA, 25 bp, Mus musculus
aacgcctgcgtacagcgtaaggggc

SEQ ID NO: 397671 - DNA, 25 bp, Mus musculus
tgggcggtacaaaccaccagcgatc

SEQ ID NO: 397672 - DNA, 25 bp, Mus musculus
tgctgccatcttggcgcctcaactg

SEQ ID NO: 397673 - DNA, 25 bp, Mus musculus
cggtcgcgctgcagtgacgtcacac

SEQ ID NO: 397674 - DNA, 25 bp, Mus musculus
tgacgtcacacgcagcaggcggtga

SEQ ID NO: 397675 - DNA, 25 bp, Mus musculus
ttgactccatcttcgcggtagcagc

SEQ ID NO: 397676 - DNA, 25 bp, Mus musculus
gagcgctcggtagccagcggtctac

SEQ ID NO: 397677 - DNA, 25 bp, Mus musculus
tagccagcggtctacgggctcagag

SEQ ID NO: 397678 - DNA, 25 bp, Mus musculus
agtacaagggcggttctgcggcctt

SEQ ID NO: 397679 - DNA, 25 bp, Mus musculus
tggcgcctcaactgagtgtcatatg

SEQ ID NO: 397680 - DNA, 25 bp, Mus musculus
agagtttggacgacttctgcgcttg

SEQ ID NO: 397681 - DNA, 25 bp, Mus musculus
gtgctgttcgcctacgctcatactc

SEQ ID NO: 397682 - DNA, 25 bp, Mus musculus
ttccagctgcccaacgtgctgttcg

SEQ ID NO: 397683 - DNA, 25 bp, Mus musculus
agaccgctagcattgcctgctcgca

SEQ ID NO: 397684 - DNA, 25 bp, Mus musculus
tttgctgaagactcctgtgccgcca

SEQ ID NO: 397685 - DNA, 25 bp, Mus musculus
cgctgccgcagagccatttgctgaa

SEQ ID NO: 397686 - DNA, 25 bp, Mus musculus
gaccgcgctgcaatctggggatgat

SEQ ID NO: 397687 - DNA, 25 bp, Mus musculus
atcatgccgcgaacagagatcttgc

SEQ ID NO: 397688 - DNA, 25 bp, Mus musculus
ccgcgaccaagtgctgcgagagctc

SEQ ID NO: 397689 - DNA, 25 bp, Mus musculus
gcgcctgcgccgaagacttttaccg

SEQ ID NO: 397690 - DNA, 25 bp, Mus musculus
gcaccagtttccatggagcccgctg

SEQ ID NO: 397691 - DNA, 25 bp, Mus musculus
tctgcgcttgctcaaagaagtactg

SEQ ID NO: 397692 - DNA, 25 bp, Mus musculus
cggcgagcaaacctgttcctttgga

SEQ ID NO: 397693 - DNA, 25 bp, Mus musculus
atactctcgccctgtatcatggagg

SEQ ID NO: 397694 - DNA, 25 bp, Mus musculus
tgatgacgccacagcgccgcaggat

SEQ ID NO: 397695 - DNA, 25 bp, Mus musculus
tttccgaactcgtcaagcatcttgt

SEQ ID NO: 397696 - DNA, 25 bp, Mus musculus
gagactgagcccgaccgtacacatg

SEQ ID NO: 397697 - DNA, 25 bp, Mus musculus
ttgaagcagcaaagttcccggttgg

SEQ ID NO: 397698 - DNA, 25 bp, Mus musculus
gggcaatttgaacgtttgaagcagc

SEQ ID NO: 397699 - DNA, 25 bp, Mus musculus
tctcgctagcaaggcgggcaatttg

SEQ ID NO: 397700 - DNA, 25 bp, Mus musculus
ctctgccttttgctagctagacgta

SEQ ID NO: 397701 - DNA, 25 bp, Mus musculus
gctcccttcaggtccggcctgatta

SEQ ID NO: 397702 - DNA, 25 bp, Mus musculus
gggactgagctcaccaactccggta

SEQ ID NO: 397703 - DNA, 25 bp, Mus musculus
cgatcgtgaccggtgcgtacggtaa

SEQ ID NO: 397704 - DNA, 25 bp, Mus musculus
cgaacctccgcgatgccgatcgtga

SEQ ID NO: 397705 - DNA, 25 bp, Mus musculus
acattctggatgtccgcgaacctcc

SEQ ID NO: 397706 - DNA, 25 bp, Mus musculus
cagctggccgaccacattctggatg

SEQ ID NO: 397707 - DNA, 25 bp, Mus musculus
cctgtgacaacaaaagcggatggtc

SEQ ID NO: 397708 - DNA, 25 bp, Mus musculus
gaatccggacgcgaagttcgagatg

SEQ ID NO: 397709 - DNA, 25 bp, Mus musculus
aaatgcaccttgtccgagtccctct

SEQ ID NO: 397710 - DNA, 25 bp, Mus musculus
cgatggggctcttggaaacttctcc

SEQ ID NO: 397711 - DNA, 25 bp, Mus musculus
ataggaaccaagtagcgctctgagc

SEQ ID NO: 397712 - DNA, 25 bp, Mus musculus
tcagggaccaccagatcaggaacgc

SEQ ID NO: 397713 - DNA, 25 bp, Mus musculus
tcaggaacgccctgcactgcagttg

SEQ ID NO: 397714 - DNA, 25 bp, Mus musculus
ttggaacgacaatacatccgcggga

SEQ ID NO: 397715 - DNA, 25 bp, Mus musculus
taaaagcgcagcaaagcacacttcg

SEQ ID NO: 397716 - DNA, 25 bp, Mus musculus
gcacacttcgaagcgattttctaac

SEQ ID NO: 397717 - DNA, 25 bp, Mus musculus
ccaactccggagaaagagctttact

SEQ ID NO: 397718 - DNA, 25 bp, Mus musculus
ctttactcccgaagcgtgacgcgtc

SEQ ID NO: 397719 - DNA, 25 bp, Mus musculus
ggaaacttctccagtaaacatggta

SEQ ID NO: 397720 - DNA, 25 bp, Mus musculus
gtgacactaccgcaaatgcaccttg

SEQ ID NO: 397721 - DNA, 25 bp, Mus musculus
agtcggaaccctcgtagtgacacta

SEQ ID NO: 397722 - DNA, 25 bp, Mus musculus
ctacgaaggactggccgctgggcct

SEQ ID NO: 397723 - DNA, 25 bp, Mus musculus
gttccttccgcgctcctggaggagc

SEQ ID NO: 397724 - DNA, 25 bp, Mus musculus
cggatacgtttctgtgaggcagccc

SEQ ID NO: 397725 - DNA, 25 bp, Mus musculus
cagggaggacttggttccaacacct

SEQ ID NO: 397726 - DNA, 25 bp, Mus musculus
aggacttggttccaacacctgctgg

SEQ ID NO: 397727 - DNA, 25 bp, Mus musculus
ttggttccaacacctgctgggccgc

SEQ ID NO: 397728 - DNA, 25 bp, Mus musculus
cctgcctggggacctaccgctttgt

SEQ ID NO: 397729 - DNA, 25 bp, Mus musculus
tcatctcgccgaggccaggcaaccc

SEQ ID NO: 397730 - DNA, 25 bp, Mus musculus
aaccctcggcctcaacggtgcgcca

SEQ ID NO: 397731 - DNA, 25 bp, Mus musculus
gcgtccttgcttccgtagtccacgt

SEQ ID NO: 397732 - DNA, 25 bp, Mus musculus
ccctgctggcctacgaaggactggc

SEQ ID NO: 397733 - DNA, 25 bp, Mus musculus
ttgcttccgtagtccacgttccttc

SEQ ID NO: 397734 - DNA, 25 bp, Mus musculus
tcaacggtgcgccaccctggagccc

SEQ ID NO: 397735 - DNA, 25 bp, Mus musculus
ccgcccgcagcggatacgtttctgt

SEQ ID NO: 397736 - DNA, 25 bp, Mus musculus
tcccggcagccgcaagttactcttg

SEQ ID NO: 397737 - DNA, 25 bp, Mus musculus
tgccttgcggacttctcggttagag

SEQ ID NO: 397738 - DNA, 25 bp, Mus musculus
agctgcagccggtttgtgtccctgc

SEQ ID NO: 397739 - DNA, 25 bp, Mus musculus
cctcacactcttggcgcgtgctgga

SEQ ID NO: 397740 - DNA, 25 bp, Mus musculus
ttgcacggccactgcaggattctgc

SEQ ID NO: 397741 - DNA, 25 bp, Mus musculus
caccaggtccctttgcaactttcaa

SEQ ID NO: 397742 - DNA, 25 bp, Mus musculus
ctgcttgagttcctgaggacctgca

SEQ ID NO: 397743 - DNA, 25 bp, Mus musculus
agcggcgattagtgctcctttatcc

SEQ ID NO: 397744 - DNA, 25 bp, Mus musculus
atactaagccgtcctttcggagccg

SEQ ID NO: 397745 - DNA, 25 bp, Mus musculus
ggcgcgctggtcctttgatactaag

SEQ ID NO: 397746 - DNA, 25 bp, Mus musculus
ttggctagcagtcgcctgggatcac

SEQ ID NO: 397747 - DNA, 25 bp, Mus musculus
tctgctccgcgatctagtgtaactg

SEQ ID NO: 397748 - DNA, 25 bp, Mus musculus
tgagccaacagggtgcccagcctca

SEQ ID NO: 397749 - DNA, 25 bp, Mus musculus
attggtgtaccctctggcagtagga

SEQ ID NO: 397750 - DNA, 25 bp, Mus musculus
agccagtcctctcgcagggcttgga

SEQ ID NO: 397751 - DNA, 25 bp, Mus musculus
cacttacttgaacctgccctggcag

SEQ ID NO: 397752 - DNA, 25 bp, Mus musculus
tgccctggcagtgctggcactggtc

SEQ ID NO: 397753 - DNA, 25 bp, Mus musculus
ttgacacagcgaccggagaagcagg

SEQ ID NO: 397754 - DNA, 25 bp, Mus musculus
agccatagcacagcagccagctgtt

SEQ ID NO: 397755 - DNA, 25 bp, Mus musculus
actgggacacctgagcatagagcgc

SEQ ID NO: 397756 - DNA, 25 bp, Mus musculus
gcagcccaaactgcggagagacgtc

SEQ ID NO: 397757 - DNA, 25 bp, Mus musculus
gggtcccacggtagcacttacttga

SEQ ID NO: 397758 - DNA, 25 bp, Mus musculus
atgggcgcgtccaacaggagcacgc

SEQ ID NO: 397759 - DNA, 25 bp, Mus musculus
ccgtcctccagacacagttgctgtg

SEQ ID NO: 397760 - DNA, 25 bp, Mus musculus
cctgagataccgcagcagcctgctt

SEQ ID NO: 397761 - DNA, 25 bp, Mus musculus
gcggtactcctgctagcctgagata

SEQ ID NO: 397762 - DNA, 25 bp, Mus musculus
gcgccaggtagaggaagccatagca

SEQ ID NO: 397763 - DNA, 25 bp, Mus musculus
cacaggcaggtggagttgacacagc

SEQ ID NO: 397764 - DNA, 25 bp, Mus musculus
cgctgaccgattcgctagccacgta

SEQ ID NO: 397765 - DNA, 25 bp, Mus musculus
gttgacaagtttccgcaacgctcct

SEQ ID NO: 397766 - DNA, 25 bp, Mus musculus
aacgctcctgccttctccggttggt

SEQ ID NO: 397767 - DNA, 25 bp, Mus musculus
cacaggacagggaagtgcctgcgat

SEQ ID NO: 397768 - DNA, 25 bp, Mus musculus
ttagagagtgatttcgcctgttttc

SEQ ID NO: 397769 - DNA, 25 bp, Mus musculus
accgattcgctagccacgtactttg

SEQ ID NO: 397770 - DNA, 25 bp, Mus musculus
gtttagttgatccagaccgttgttg

SEQ ID NO: 397771 - DNA, 25 bp, Mus musculus
cagaccgttgttgacgggcgacacc

SEQ ID NO: 397772 - DNA, 25 bp, Mus musculus
actttgacttagagagtgatttcgc

SEQ ID NO: 397773 - DNA, 25 bp, Mus musculus
ccgtcgggagagacggaataagtga

SEQ ID NO: 397774 - DNA, 25 bp, Mus musculus
tgtctgagtccagcccgcgttcgct

SEQ ID NO: 397775 - DNA, 25 bp, Mus musculus
cgtttttgggtgtctgagtccagcc

SEQ ID NO: 397776 - DNA, 25 bp, Mus musculus
catacattcgtttttgggtgtctga

SEQ ID NO: 397777 - DNA, 25 bp, Mus musculus
tagtgttgacaagtttccgcaacgc

SEQ ID NO: 397778 - DNA, 25 bp, Mus musculus
cgtggcagtgtgacgcgcccgaaca

SEQ ID NO: 397779 - DNA, 25 bp, Mus musculus
tagccaggctgtgtgcgtggcagtg

SEQ ID NO: 397780 - DNA, 25 bp, Mus musculus
cgaacagccacacagtaggctcacg

SEQ ID NO: 397781 - DNA, 25 bp, Mus musculus
cacacagtaggctcacgtcccggtg

SEQ ID NO: 397782 - DNA, 25 bp, Mus musculus
gtaggctcacgtcccggtgtgctgc

SEQ ID NO: 397783 - DNA, 25 bp, Mus musculus
ccactgcacgaggttgcatggcgtc

SEQ ID NO: 397784 - DNA, 25 bp, Mus musculus
ttgcatggcgtcacacagcgggcca

SEQ ID NO: 397785 - DNA, 25 bp, Mus musculus
gggccaaccgcctggcgcgtatact

SEQ ID NO: 397786 - DNA, 25 bp, Mus musculus
cgcctggcgcgtatacttactgtgc

SEQ ID NO: 397787 - DNA, 25 bp, Mus musculus
cgcgtatacttactgtgcgcatttg

SEQ ID NO: 397788 - DNA, 25 bp, Mus musculus
cttactgtgcgcatttgacatcatg

SEQ ID NO: 397789 - DNA, 25 bp, Mus musculus
ttgacatcatgctgcctgcacggga

SEQ ID NO: 397790 - DNA, 25 bp, Mus musculus
atggcgtcacacagcgggccaaccg

SEQ ID NO: 397791 - DNA, 25 bp, Mus musculus
atcatgctgcctgcacgggacactc

SEQ ID NO: 397792 - DNA, 25 bp, Mus musculus
tggggcgaatggagtcccgcccatc

SEQ ID NO: 397793 - DNA, 25 bp, Mus musculus
cgtgcgagtgaaccctgaggtcaaa

SEQ ID NO: 397794 - DNA, 25 bp, Mus musculus
acaaggtgtccgacgacgtgcgagt

SEQ ID NO: 397795 - DNA, 25 bp, Mus musculus
gccctctccctcaggttcgaggtga

SEQ ID NO: 397796 - DNA, 25 bp, Mus musculus
tgacagcctgcgcagtcctactgtg

SEQ ID NO: 397797 - DNA, 25 bp, Mus musculus
tgcgctcctgtatgcagtgacagcc

SEQ ID NO: 397798 - DNA, 25 bp, Mus musculus
cccacagaggctgaggacacgcgag

SEQ ID NO: 397799 - DNA, 25 bp, Mus musculus
tcgtggaggagacccgcctcgcctt

SEQ ID NO: 397800 - DNA, 25 bp, Mus musculus
ccgcccatcctctcggtgatgtgtg

SEQ ID NO: 397801 - DNA, 25 bp, Mus musculus
cccacggaggtcacaaggtcaaggt

SEQ ID NO: 397802 - DNA, 25 bp, Mus musculus
aggtcaaaagtcacaagcgctcgtg

SEQ ID NO: 397803 - DNA, 25 bp, Mus musculus
ccatcccagggatcagggacaaggt

SEQ ID NO: 397804 - DNA, 25 bp, Mus musculus
tcctctcggtgatgtgtggaggccc

SEQ ID NO: 397805 - DNA, 25 bp, Mus musculus
ggggatggccactgtgaactctgcc

SEQ ID NO: 397806 - DNA, 25 bp, Mus musculus
cgggccaatatggtctggcagcttt

SEQ ID NO: 397807 - DNA, 25 bp, Mus musculus
tcacccgcccaggtattcaaatgcg

SEQ ID NO: 397808 - DNA, 25 bp, Mus musculus
attctctcaggtgcatggcgctgcg

SEQ ID NO: 397809 - DNA, 25 bp, Mus musculus
gcagctttgggacacttcgcacagt

SEQ ID NO: 397810 - DNA, 25 bp, Mus musculus
gggacacttcgcacagtttacgttg

SEQ ID NO: 397811 - DNA, 25 bp, Mus musculus
cacagtttacgttgccgaccctaca

SEQ ID NO: 397812 - DNA, 25 bp, Mus musculus
cgaccctacacttgtggagcagctc

SEQ ID NO: 397813 - DNA, 25 bp, Mus musculus
gctcctgcgacaagaaagtcactgt

SEQ ID NO: 397814 - DNA, 25 bp, Mus musculus
gcgctgtagtttctcatcatgggca

SEQ ID NO: 397815 - DNA, 25 bp, Mus musculus
gtttctcatcatgggcagagcaccg

SEQ ID NO: 397816 - DNA, 25 bp, Mus musculus
caccagcgtgcttgcggattgctaa

SEQ ID NO: 397817 - DNA, 25 bp, Mus musculus
cttgcggattgctaacggcgtgagt

SEQ ID NO: 397818 - DNA, 25 bp, Mus musculus
tcactgtccagagcgctgtagtttc

SEQ ID NO: 397819 - DNA, 25 bp, Mus musculus
tcaaatgcgccgattctctcaggtg

SEQ ID NO: 397820 - DNA, 25 bp, Mus musculus
ttgtaatctacatgattgcagaagc

SEQ ID NO: 397821 - DNA, 25 bp, Mus musculus
actggtgcacgtcatggtcacctgg

SEQ ID NO: 397822 - DNA, 25 bp, Mus musculus
cctgacactggtgcacgtcatggtc

SEQ ID NO: 397823 - DNA, 25 bp, Mus musculus
aagatgagcctgacactggtgcacg

SEQ ID NO: 397824 - DNA, 25 bp, Mus musculus
tgtacaccacgcttccccaagatga

SEQ ID NO: 397825 - DNA, 25 bp, Mus musculus
atggcatcgttggcagaccgggtct

SEQ ID NO: 397826 - DNA, 25 bp, Mus musculus
attacctcgcggcaccgcagcctgg

SEQ ID NO: 397827 - DNA, 25 bp, Mus musculus
ctacatgattgcagaagcatgaata

SEQ ID NO: 397828 - DNA, 25 bp, Mus musculus
tccataggaattgactataaaattg

SEQ ID NO: 397829 - DNA, 25 bp, Mus musculus
aaggattaaatctccataggaattg

SEQ ID NO: 397830 - DNA, 25 bp, Mus musculus
tgatagcttgaaaggattaaatctc

SEQ ID NO: 397831 - DNA, 25 bp, Mus musculus
cacctaggattgcatgatagcttga

SEQ ID NO: 397832 - DNA, 25 bp, Mus musculus
caggtggacacctaggattgcatga

SEQ ID NO: 397833 - DNA, 25 bp, Mus musculus
gcatgaataaaattctaaaactggg

SEQ ID NO: 397834 - DNA, 25 bp, Mus musculus
ccagcggaagctgaacacttgcaca

SEQ ID NO: 397835 - DNA, 25 bp, Mus musculus
cagaggcagtcccacagcgagtaac

SEQ ID NO: 397836 - DNA, 25 bp, Mus musculus
tgtccgttcccacatccgcgaagta

SEQ ID NO: 397837 - DNA, 25 bp, Mus musculus
gtagtccaccgcgagccagatgtcc

SEQ ID NO: 397838 - DNA, 25 bp, Mus musculus
ctggccacgcaggtagtagtccacc

SEQ ID NO: 397839 - DNA, 25 bp, Mus musculus
ggtgagcccaaaccaccagcgctgg

SEQ ID NO: 397840 - DNA, 25 bp, Mus musculus
cacttgcacagaaagggagcccagc

SEQ ID NO: 397841 - DNA, 25 bp, Mus musculus
ctgtcctcggtgctgaaatcatgca

SEQ ID NO: 397842 - DNA, 25 bp, Mus musculus
cgtcttgcaatctgctccaggctgc

SEQ ID NO: 397843 - DNA, 25 bp, Mus musculus
ctgctgaccaccgtcttgcaatctg

SEQ ID NO: 397844 - DNA, 25 bp, Mus musculus
gcgtggaaggacgaacctcgccttc

SEQ ID NO: 397845 - DNA, 25 bp, Mus musculus
tcttgctggcgttggatgcttgcct

SEQ ID NO: 397846 - DNA, 25 bp, Mus musculus
cgcagacctgtgtttgccgctggtc

SEQ ID NO: 397847 - DNA, 25 bp, Mus musculus
gggagcccagcaccacgaagaagag

SEQ ID NO: 397848 - DNA, 25 bp, Mus musculus
cacctgcttggtgggtctgataata

SEQ ID NO: 397849 - DNA, 25 bp, Mus musculus
gctcccaggcccgataaggacaatc

SEQ ID NO: 397850 - DNA, 25 bp, Mus musculus
cgatgaccagccagggattgcacca

SEQ ID NO: 397851 - DNA, 25 bp, Mus musculus
tcctgcgtttctgggtctaagctcc

SEQ ID NO: 397852 - DNA, 25 bp, Mus musculus
cttacactagtcagagcggttccta

SEQ ID NO: 397853 - DNA, 25 bp, Mus musculus
gcgtccagagtgtgccttagttttc

SEQ ID NO: 397854 - DNA, 25 bp, Mus musculus
agctccttctactgccaggtccagg

SEQ ID NO: 397855 - DNA, 25 bp, Mus musculus
gttcggagccttccctcagacaatg

SEQ ID NO: 397856 - DNA, 25 bp, Mus musculus
tgagtctcagagtccggaccacctg

SEQ ID NO: 397857 - DNA, 25 bp, Mus musculus
ggcatttttcgtccctcgctgagtc

SEQ ID NO: 397858 - DNA, 25 bp, Mus musculus
tgggctctcccaaatgcttggcatg

SEQ ID NO: 397859 - DNA, 25 bp, Mus musculus
cccaactgagagagagccgagactc

SEQ ID NO: 397860 - DNA, 25 bp, Mus musculus
ctgtgatgcgcttctctgaaaggga

SEQ ID NO: 397861 - DNA, 25 bp, Mus musculus
ctctcccttaagtgactgttcggtc

SEQ ID NO: 397862 - DNA, 25 bp, Mus musculus
tgtcttggcggcctgaacattcgca

SEQ ID NO: 397863 - DNA, 25 bp, Mus musculus
attcgcaggtgactgtgcccgcgga

SEQ ID NO: 397864 - DNA, 25 bp, Mus musculus
aacattcgcaggtgactgtgcccgc

SEQ ID NO: 397865 - DNA, 25 bp, Mus musculus
tggcggcctgaacattcgcaggtga

SEQ ID NO: 397866 - DNA, 25 bp, Mus musculus
gctctcagcctgatccctgtcttgg

SEQ ID NO: 397867 - DNA, 25 bp, Mus musculus
ggcgaccttgcgctctcagcctgat

SEQ ID NO: 397868 - DNA, 25 bp, Mus musculus
agaagccggcgaccttgcgctctca

SEQ ID NO: 397869 - DNA, 25 bp, Mus musculus
tccagcggagaagcaggagaagccg

SEQ ID NO: 397870 - DNA, 25 bp, Mus musculus
actcgcgcgtccagcggagaagcag

SEQ ID NO: 397871 - DNA, 25 bp, Mus musculus
tgacgcaggaccaggactcgcgcgt

SEQ ID NO: 397872 - DNA, 25 bp, Mus musculus
ccttgcgcgcatgcgcatggctcga

SEQ ID NO: 397873 - DNA, 25 bp, Mus musculus
gtggcacctgccttgcgcgcatgcg

SEQ ID NO: 397874 - DNA, 25 bp, Mus musculus
ttggcttcggccctgcacccgggtg

SEQ ID NO: 397875 - DNA, 25 bp, Mus musculus
ctgaacattcgcaggtgactgtgcc

SEQ ID NO: 397876 - DNA, 25 bp, Mus musculus
ttctgctgccagttcaccaacggaa

SEQ ID NO: 397877 - DNA, 25 bp, Mus musculus
tatctggacctcatccgtatgcgcg

SEQ ID NO: 397878 - DNA, 25 bp, Mus musculus
cagcacatgggctgcccgtggactc

SEQ ID NO: 397879 - DNA, 25 bp, Mus musculus
ctgaggacatcttctggcgcgcgag

SEQ ID NO: 397880 - DNA, 25 bp, Mus musculus
tatggagcaggacaaggtgcagttc

SEQ ID NO: 397881 - DNA, 25 bp, Mus musculus
ggcagcgcctacctgccgacaagta

SEQ ID NO: 397882 - DNA, 25 bp, Mus musculus
atacaaccagacgactcggacaacc

SEQ ID NO: 397883 - DNA, 25 bp, Mus musculus
cgtatgcgcgccaggagtacttcct

SEQ ID NO: 397884 - DNA, 25 bp, Mus musculus
gctggcccaccctatgaggacatcg

SEQ ID NO: 397885 - DNA, 25 bp, Mus musculus
gggactactcacaccgccataactt

SEQ ID NO: 397886 - DNA, 25 bp, Mus musculus
ccggctgctcacagcacatgggctg

SEQ ID NO: 397887 - DNA, 25 bp, Mus musculus
cggaatccagcgctttcacttcaag

SEQ ID NO: 397888 - DNA, 25 bp, Mus musculus
tcacttcaagcgctatggctaccgc

SEQ ID NO: 397889 - DNA, 25 bp, Mus musculus
aggcacgagtgggactactcacacc

SEQ ID NO: 397890 - DNA, 25 bp, Mus musculus
gcgcctctaggtgccctgcgactgt

SEQ ID NO: 397891 - DNA, 25 bp, Mus musculus
cgcccgggccataagaagtgcacct

SEQ ID NO: 397892 - DNA, 25 bp, Mus musculus
aagtgcacctgctatcggcccaatc

SEQ ID NO: 397893 - DNA, 25 bp, Mus musculus
tgctatcggcccaatcgccgcgaga

SEQ ID NO: 397894 - DNA, 25 bp, Mus musculus
gacgacgtgatcgtcttcctgcaca

SEQ ID NO: 397895 - DNA, 25 bp, Mus musculus
aaagtactacttcccggtgcgcgag

SEQ ID NO: 397896 - DNA, 25 bp, Mus musculus
cgctcgctgcgcttcgacatgaagg

SEQ ID NO: 397897 - DNA, 25 bp, Mus musculus
cacgccggacccacattacgagaaa

SEQ ID NO: 397898 - DNA, 25 bp, Mus musculus
ctgcgcacagcctgggcgccgagta

SEQ ID NO: 397899 - DNA, 25 bp, Mus musculus
ttgagcgcgccagcaagttcgtgct

SEQ ID NO: 397900 - DNA, 25 bp, Mus musculus
cggcgtgcttcatgctcatccttta

SEQ ID NO: 397901 - DNA, 25 bp, Mus musculus
acctagtgcagaacgtgcgcctcta

SEQ ID NO: 397902 - DNA, 25 bp, Mus musculus
tgctcatcctttaccagtacgcggg

SEQ ID NO: 397903 - DNA, 25 bp, Mus musculus
cttcgacatgaagggcgacgacgtg

SEQ ID NO: 397904 - DNA, 25 bp, Mus musculus
ttcatgcaatacaacagcacgcggg

SEQ ID NO: 397905 - DNA, 25 bp, Mus musculus
tgaggacactatccgccacatcgag

SEQ ID NO: 397906 - DNA, 25 bp, Mus musculus
cgaggagctcaacgacctggacatg

SEQ ID NO: 397907 - DNA, 25 bp, Mus musculus
caaggacctctttcagcagcgttac

SEQ ID NO: 397908 - DNA, 25 bp, Mus musculus
ggaagacctccttgcacatgtgtga

SEQ ID NO: 397909 - DNA, 25 bp, Mus musculus
tgcacgttgcaggagttcatggatt

SEQ ID NO: 397910 - DNA, 25 bp, Mus musculus
gtgggctgctacaacctatctttca

SEQ ID NO: 397911 - DNA, 25 bp, Mus musculus
ctggagagcgccaagaagaacctgc

SEQ ID NO: 397912 - DNA, 25 bp, Mus musculus
aacctgcgaggcatggccttcttcg

SEQ ID NO: 397913 - DNA, 25 bp, Mus musculus
ggcctcactgagttccagcgcaaga

SEQ ID NO: 397914 - DNA, 25 bp, Mus musculus
gctgtatgactatgccaaggacctc

SEQ ID NO: 397915 - DNA, 25 bp, Mus musculus
agcgcaagacgcagtacctatttga

SEQ ID NO: 397916 - DNA, 25 bp, Mus musculus
ccgtatcccgctacctgagtgaatg

SEQ ID NO: 397917 - DNA, 25 bp, Mus musculus
gcggacgttcaacctcaagttcatc

SEQ ID NO: 397918 - DNA, 25 bp, Mus musculus
acactggagggaaaaccgagtcaga

SEQ ID NO: 397919 - DNA, 25 bp, Mus musculus
cgcagcggccatgaaaccggcataa

SEQ ID NO: 397920 - DNA, 25 bp, Mus musculus
acttgaggcgctcgtggagagaaca

SEQ ID NO: 397921 - DNA, 25 bp, Mus musculus
ccgagtcagagtacaagaggaagcc

SEQ ID NO: 397922 - DNA, 25 bp, Mus musculus
gcagccgcggcatccgcagtgttcg

SEQ ID NO: 397923 - DNA, 25 bp, Mus musculus
tcgtccactccggtgtctgcaacga

SEQ ID NO: 397924 - DNA, 25 bp, Mus musculus
cagtgagaagccgacacgcgccttt

SEQ ID NO: 397925 - DNA, 25 bp, Mus musculus
cacaagccggtttctcaaagcaata

SEQ ID NO: 397926 - DNA, 25 bp, Mus musculus
agcaataacccagttgccagctgcc

SEQ ID NO: 397927 - DNA, 25 bp, Mus musculus
tgcacttccgcttcctagaggcgaa

SEQ ID NO: 397928 - DNA, 25 bp, Mus musculus
tcctagaggcgaaggcaggacgact

SEQ ID NO: 397929 - DNA, 25 bp, Mus musculus
gcaggacgacttccggctatcgagt

SEQ ID NO: 397930 - DNA, 25 bp, Mus musculus
ggaagcccaaggtgactcggactca

SEQ ID NO: 397931 - DNA, 25 bp, Mus musculus
tttgccagagagtcccgcagcggcc

SEQ ID NO: 397932 - DNA, 25 bp, Mus musculus
gtccagatgcacctgtgcgcccgtg

SEQ ID NO: 397933 - DNA, 25 bp, Mus musculus
ccagcgttgaccttggcgaagagcc

SEQ ID NO: 397934 - DNA, 25 bp, Mus musculus
tggcgaagagccaccctctacggtt

SEQ ID NO: 397935 - DNA, 25 bp, Mus musculus
ggttcacccagaagcagaccacatt

SEQ ID NO: 397936 - DNA, 25 bp, Mus musculus
cgcacgaacgaagccctctggaagc

SEQ ID NO: 397937 - DNA, 25 bp, Mus musculus
ctctggaagcaacgctgcccacgtg

SEQ ID NO: 397938 - DNA, 25 bp, Mus musculus
cacgtgggactctgctcctccaggt

SEQ ID NO: 397939 - DNA, 25 bp, Mus musculus
ccagccttcttcatgtcgcaggacg

SEQ ID NO: 397940 - DNA, 25 bp, Mus musculus
cgcaggacgcgcagagcaacacgct

SEQ ID NO: 397941 - DNA, 25 bp, Mus musculus
cagaccggcctctggctgaacacga

SEQ ID NO: 397942 - DNA, 25 bp, Mus musculus
ctctggctgaacacgataccatcgt

SEQ ID NO: 397943 - DNA, 25 bp, Mus musculus
ataccatcgtggaacgtcgagcgcc

SEQ ID NO: 397944 - DNA, 25 bp, Mus musculus
gtgctccgctgatcgtccagatgca

SEQ ID NO: 397945 - DNA, 25 bp, Mus musculus
ctggaccagcacgtctttgcgcagc

SEQ ID NO: 397946 - DNA, 25 bp, Mus musculus
cgaaactctcctctccgagtctgga

SEQ ID NO: 397947 - DNA, 25 bp, Mus musculus
cagcgcttcgcttctcagaaaccga

SEQ ID NO: 397948 - DNA, 25 bp, Mus musculus
ggcccatttgttgtgacagctgtca

SEQ ID NO: 397949 - DNA, 25 bp, Mus musculus
cggtttcaatctcgagctgctctgg

SEQ ID NO: 397950 - DNA, 25 bp, Mus musculus
cacacttcctgctgcggtttcaatc

SEQ ID NO: 397951 - DNA, 25 bp, Mus musculus
ccgagtctggactgaaattcactga

SEQ ID NO: 397952 - DNA, 25 bp, Mus musculus
ggcttcccaggcgtttatctcgaaa

SEQ ID NO: 397953 - DNA, 25 bp, Mus musculus
gcgtgctctcttctcgtggaaagtc

SEQ ID NO: 397954 - DNA, 25 bp, Mus musculus
gtaacccgaatgtctgcgtgctctc

SEQ ID NO: 397955 - DNA, 25 bp, Mus musculus
atcgtggctctcagggtaacccgaa

SEQ ID NO: 397956 - DNA, 25 bp, Mus musculus
cggccgcgattcctgaaagtgactg

SEQ ID NO: 397957 - DNA, 25 bp, Mus musculus
agtctgctccgctctagaaaatagg

SEQ ID NO: 397958 - DNA, 25 bp, Mus musculus
gtagagggtctctgcatagcgacgc

SEQ ID NO: 397959 - DNA, 25 bp, Mus musculus
taggattcaccaatgggcgcccaga

SEQ ID NO: 397960 - DNA, 25 bp, Mus musculus
gcggtagcaaatggcggctccttcc

SEQ ID NO: 397961 - DNA, 25 bp, Mus musculus
catgcggagccgagacttgagcatc

SEQ ID NO: 397962 - DNA, 25 bp, Mus musculus
agacttgagcatcgtccgggcgccg

SEQ ID NO: 397963 - DNA, 25 bp, Mus musculus
accagcagcttcagctcgttcagga

SEQ ID NO: 397964 - DNA, 25 bp, Mus musculus
ctcgttcaggaacatgcggagccga

SEQ ID NO: 397965 - DNA, 25 bp, Mus musculus
tgctccgggccttggaagcagatcc

SEQ ID NO: 397966 - DNA, 25 bp, Mus musculus
gcctgacctgctccgggccttggaa

SEQ ID NO: 397967 - DNA, 25 bp, Mus musculus
gtctccgcggcctgcaagcgctgtt

SEQ ID NO: 397968 - DNA, 25 bp, Mus musculus
atccggctcggttcggcccgtgcgt

SEQ ID NO: 397969 - DNA, 25 bp, Mus musculus
ctgctgctgagcgacagagcgtcca

SEQ ID NO: 397970 - DNA, 25 bp, Mus musculus
agcgacagagcgtccagcgcgcctg

SEQ ID NO: 397971 - DNA, 25 bp, Mus musculus
tgcaagcgctgttcactgctgccgc

SEQ ID NO: 397972 - DNA, 25 bp, Mus musculus
cagccaggtgctcgggcctgacctg

SEQ ID NO: 397973 - DNA, 25 bp, Mus musculus
ttcggagcccactgtccaggctgct

SEQ ID NO: 397974 - DNA, 25 bp, Mus musculus
cttgggctctgaggaaaacgcggaa

SEQ ID NO: 397975 - DNA, 25 bp, Mus musculus
cctctgagaggttcccgccacggaa

SEQ ID NO: 397976 - DNA, 25 bp, Mus musculus
ctccctcggcgaggcgcccagcaaa

SEQ ID NO: 397977 - DNA, 25 bp, Mus musculus
ccgggccctcagaaggcctctcctc

SEQ ID NO: 397978 - DNA, 25 bp, Mus musculus
gccacggaaccgcagaacctcaaaa

SEQ ID NO: 397979 - DNA, 25 bp, Mus musculus
aaacggcccgctcctctgagaggtt

SEQ ID NO: 397980 - DNA, 25 bp, Mus musculus
aaaaccgcgtctcacccgcagttgt

SEQ ID NO: 397981 - DNA, 25 bp, Mus musculus
aaaacgcggaagcagatcgctctcc

SEQ ID NO: 397982 - DNA, 25 bp, Mus musculus
gaagcagatcgctctcccggaaccg

SEQ ID NO: 397983 - DNA, 25 bp, Mus musculus
gcgcccgggacctggctaacctgtg

SEQ ID NO: 397984 - DNA, 25 bp, Mus musculus
acctggctaacctgtggggaacgcg

SEQ ID NO: 397985 - DNA, 25 bp, Mus musculus
cgactcccggggcagagacgttctc

SEQ ID NO: 397986 - DNA, 25 bp, Mus musculus
ggggcagagacgttctccctctgcg

SEQ ID NO: 397987 - DNA, 25 bp, Mus musculus
caaggtcatcccgagttcccggcga

SEQ ID NO: 397988 - DNA, 25 bp, Mus musculus
aggagggtctcgaagccgccgccat

SEQ ID NO: 397989 - DNA, 25 bp, Mus musculus
ccgtttcaagtactccaccgcttga

SEQ ID NO: 397990 - DNA, 25 bp, Mus musculus
gcgagtgctcccgtttcaagtactc

SEQ ID NO: 397991 - DNA, 25 bp, Mus musculus
cggacccttgtccttcggacctgtg

SEQ ID NO: 397992 - DNA, 25 bp, Mus musculus
attggcctgcggaaccatcggcccg

SEQ ID NO: 397993 - DNA, 25 bp, Mus musculus
tcttcaaaggagcggagatcctcgg

SEQ ID NO: 397994 - DNA, 25 bp, Mus musculus
ttcgacagcgagtgctcccgtttca

SEQ ID NO: 397995 - DNA, 25 bp, Mus musculus
ctcaccctggtagggcttcgacagc

SEQ ID NO: 397996 - DNA, 25 bp, Mus musculus
caccgccggcccttcatcaaaaagc

SEQ ID NO: 397997 - DNA, 25 bp, Mus musculus
accgctgccaccaggagggtctcga

SEQ ID NO: 397998 - DNA, 25 bp, Mus musculus
gtggcccaacccattggcctgcgga

SEQ ID NO: 397999 - DNA, 25 bp, Mus musculus
gcgcctcaccctggtagggcttcga

SEQ ID NO: 398000 - DNA, 25 bp, Mus musculus
tgcgtcctcgagctcagtcccgact

SEQ ID NO: 398001 - DNA, 25 bp, Mus musculus
cttcggacctgtggctcttcaaagg

SEQ ID NO: 398002 - DNA, 25 bp, Mus musculus
ctgcctggagctcaccaaggactta

SEQ ID NO: 398003 - DNA, 25 bp, Mus musculus
ccagcagagcgtgatcctaggcatg

SEQ ID NO: 398004 - DNA, 25 bp, Mus musculus
gcgggacatcgcatgcaaataaggg

SEQ ID NO: 398005 - DNA, 25 bp, Mus musculus
agacctccttaagccgggcgcgcga

SEQ ID NO: 398006 - DNA, 25 bp, Mus musculus
gttctaccttaagggcgcagacctc

SEQ ID NO: 398007 - DNA, 25 bp, Mus musculus
gtgattaccaagttcctgcggagga

SEQ ID NO: 398008 - DNA, 25 bp, Mus musculus
cggggatgctagtggtgattaccaa

SEQ ID NO: 398009 - DNA, 25 bp, Mus musculus
acctgatctccttcaccgaggtgga

SEQ ID NO: 398010 - DNA, 25 bp, Mus musculus
ctgggcgatatctccagcaacctga

SEQ ID NO: 398011 - DNA, 25 bp, Mus musculus
tgaggctagcgagctgcaacaagtc

SEQ ID NO: 398012 - DNA, 25 bp, Mus musculus
catgaagctgtacgcgctgtgcacc

SEQ ID NO: 398013 - DNA, 25 bp, Mus musculus
gcagcacggtgaacttgaggctcta

SEQ ID NO: 398014 - DNA, 25 bp, Mus musculus
gatggcatcatcttcgtgtccgagg

SEQ ID NO: 398015 - DNA, 25 bp, Mus musculus
tgcaacaagtcgtgcgggatgaacc

SEQ ID NO: 398016 - DNA, 25 bp, Mus musculus
tgcggctgctcacgtgccagacgct

SEQ ID NO: 398017 - DNA, 25 bp, Mus musculus
cctcagctgcggtcacgtgcggctg

SEQ ID NO: 398018 - DNA, 25 bp, Mus musculus
tgccagacgctgctgtcacttcgta

SEQ ID NO: 398019 - DNA, 25 bp, Mus musculus
gtcacttcgtagctgttccggcttc

SEQ ID NO: 398020 - DNA, 25 bp, Mus musculus
ttccggcttcctctgagtgaggctc

SEQ ID NO: 398021 - DNA, 25 bp, Mus musculus
aggctcgcaacgtctcccacggagt

SEQ ID NO: 398022 - DNA, 25 bp, Mus musculus
cacggagtcgccttcgttctgctct

SEQ ID NO: 398023 - DNA, 25 bp, Mus musculus
tgggtctcccgtggccactgagacc

SEQ ID NO: 398024 - DNA, 25 bp, Mus musculus
actgagacctcggagctcgaccggc

SEQ ID NO: 398025 - DNA, 25 bp, Mus musculus
cggctccggagagccgactggtttc

SEQ ID NO: 398026 - DNA, 25 bp, Mus musculus
agagccgactggtttccctgccggc

SEQ ID NO: 398027 - DNA, 25 bp, Mus musculus
tgcgctgtgcctttggtgccagcct

SEQ ID NO: 398028 - DNA, 25 bp, Mus musculus
gttttacctgggacccgcagtctgc

SEQ ID NO: 398029 - DNA, 25 bp, Mus musculus
cggtccagcagttttgggcgctctc

SEQ ID NO: 398030 - DNA, 25 bp, Mus musculus
ttgtgcttgcgactcttctgctccg

SEQ ID NO: 398031 - DNA, 25 bp, Mus musculus
ttgccgcgttctgtctgggcagcac

SEQ ID NO: 398032 - DNA, 25 bp, Mus musculus
ctcccggaccgtggaggacgtgctc

SEQ ID NO: 398033 - DNA, 25 bp, Mus musculus
ctcagcaagggagtgctgcgctccc

SEQ ID NO: 398034 - DNA, 25 bp, Mus musculus
cctacagcgacctcagcaagggagt

SEQ ID NO: 398035 - DNA, 25 bp, Mus musculus
tggcggtgctgctcaccttgcccgt

SEQ ID NO: 398036 - DNA, 25 bp, Mus musculus
gctgctgcttctggccagcctggcg

SEQ ID NO: 398037 - DNA, 25 bp, Mus musculus
gctcctggacctgggtagccgccga

SEQ ID NO: 398038 - DNA, 25 bp, Mus musculus
ttctgctccggcttggccaacagct

SEQ ID NO: 398039 - DNA, 25 bp, Mus musculus
ggccactttgtgcttgcgactcttc

SEQ ID NO: 398040 - DNA, 25 bp, Mus musculus
agcgccagaggccactttgtgcttg

SEQ ID NO: 398041 - DNA, 25 bp, Mus musculus
ggccaacagctcctggacctgggta

SEQ ID NO: 398042 - DNA, 25 bp, Mus musculus
acttctgcacggaagaggacagcgc

SEQ ID NO: 398043 - DNA, 25 bp, Mus musculus
gcgcgggactgctgaacttctgcac

SEQ ID NO: 398044 - DNA, 25 bp, Mus musculus
actcgacgtccgtagttgaccttcg

SEQ ID NO: 398045 - DNA, 25 bp, Mus musculus
ccaggttgaccactcgacgtccgta

SEQ ID NO: 398046 - DNA, 25 bp, Mus musculus
tgcagccaagcgctcctacgaaatg

SEQ ID NO: 398047 - DNA, 25 bp, Mus musculus
cagcaggagccatccgcgcaaaggt

SEQ ID NO: 398048 - DNA, 25 bp, Mus musculus
caccgcactagggtgagagcagcag

SEQ ID NO: 398049 - DNA, 25 bp, Mus musculus
tgtcgaagtccatctcctccagcgt

SEQ ID NO: 398050 - DNA, 25 bp, Mus musculus
ttcagtccacgttcccggagatggg

SEQ ID NO: 398051 - DNA, 25 bp, Mus musculus
ttcgaggcctccttcagtccacgtt

SEQ ID NO: 398052 - DNA, 25 bp, Mus musculus
caaacacggttcgaggcctccttca

SEQ ID NO: 398053 - DNA, 25 bp, Mus musculus
caggcccggaagctccaaacacggt

SEQ ID NO: 398054 - DNA, 25 bp, Mus musculus
cgtccgcactcgagacggagtagtc

SEQ ID NO: 398055 - DNA, 25 bp, Mus musculus
tttgaagccagccttcctgcaccag

SEQ ID NO: 398056 - DNA, 25 bp, Mus musculus
ggcttcctgccacgctttgaagcca

SEQ ID NO: 398057 - DNA, 25 bp, Mus musculus
gtagttgaccttcgagtcccgcctc

SEQ ID NO: 398058 - DNA, 25 bp, Mus musculus
gtcaaaacccggtggtgcgctccga

SEQ ID NO: 398059 - DNA, 25 bp, Mus musculus
gacccggatcggacagctgtctttg

SEQ ID NO: 398060 - DNA, 25 bp, Mus musculus
gtctcggtctccctactgtggactc

SEQ ID NO: 398061 - DNA, 25 bp, Mus musculus
cccagctccggggatttgaatgcaa

SEQ ID NO: 398062 - DNA, 25 bp, Mus musculus
ttgaatgcaaacaaagcggcagcgc

SEQ ID NO: 398063 - DNA, 25 bp, Mus musculus
tctctgccaattaccctaggctggg

SEQ ID NO: 398064 - DNA, 25 bp, Mus musculus
gccagcacgctaaggctgtcccgtg

SEQ ID NO: 398065 - DNA, 25 bp, Mus musculus
tgcgctccgagaatctgcaggcgta

SEQ ID NO: 398066 - DNA, 25 bp, Mus musculus
caagctcttcccgaagcaagggaca

SEQ ID NO: 398067 - DNA, 25 bp, Mus musculus
gccgcgctagggaaatccgatccca

SEQ ID NO: 398068 - DNA, 25 bp, Mus musculus
ggaacccgagcagttcgcgagcctg

SEQ ID NO: 398069 - DNA, 25 bp, Mus musculus
cgcgagcctggcaaagattcggacc

SEQ ID NO: 398070 - DNA, 25 bp, Mus musculus
tcggccaagaacctccgcgcgggaa

SEQ ID NO: 398071 - DNA, 25 bp, Mus musculus
actgcttgccttgatgccgatcgcc

SEQ ID NO: 398072 - DNA, 25 bp, Mus musculus
gtggtgcatagctctacgcctttcg

SEQ ID NO: 398073 - DNA, 25 bp, Mus musculus
caggcctagcgcactcaccgttagg

SEQ ID NO: 398074 - DNA, 25 bp, Mus musculus
cactcaccgttagggcaggctgtga

SEQ ID NO: 398075 - DNA, 25 bp, Mus musculus
gcaggctgtgacctctcacgtgctc

SEQ ID NO: 398076 - DNA, 25 bp, Mus musculus
cgcgccactcagcttctgaatttca

SEQ ID NO: 398077 - DNA, 25 bp, Mus musculus
tcagccagccttgggttttccagat

SEQ ID NO: 398078 - DNA, 25 bp, Mus musculus
ccttgggttttccagatgcggatgc

SEQ ID NO: 398079 - DNA, 25 bp, Mus musculus
agggcttgcttgtggcccaagatca

SEQ ID NO: 398080 - DNA, 25 bp, Mus musculus
cccaagatcaaagggaaggcaagga

SEQ ID NO: 398081 - DNA, 25 bp, Mus musculus
gcaaggagatttgaactcgggatgc

SEQ ID NO: 398082 - DNA, 25 bp, Mus musculus
ctcgggatgcgcagtttaacgttca

SEQ ID NO: 398083 - DNA, 25 bp, Mus musculus
cgttcagcggtctaacgacgggact

SEQ ID NO: 398084 - DNA, 25 bp, Mus musculus
ttttccaaagtcgaggcgccgcagt

SEQ ID NO: 398085 - DNA, 25 bp, Mus musculus
cgccgcagttagtggtgcatagctc

SEQ ID NO: 398086 - DNA, 25 bp, Mus musculus
acttttagcgctgcttcggctggtc

SEQ ID NO: 398087 - DNA, 25 bp, Mus musculus
ccatggcttctggaggtacgtgacc

SEQ ID NO: 398088 - DNA, 25 bp, Mus musculus
tgttagactcccaccaacggaagtc

SEQ ID NO: 398089 - DNA, 25 bp, Mus musculus
gtcttgctgtaatttcggccgccca

SEQ ID NO: 398090 - DNA, 25 bp, Mus musculus
gggtcggccattagcgttctctcga

SEQ ID NO: 398091 - DNA, 25 bp, Mus musculus
ttcaaggttacttcgcggagtgggc

SEQ ID NO: 398092 - DNA, 25 bp, Mus musculus
ctgttcccggaagtgcatctgcttg

SEQ ID NO: 398093 - DNA, 25 bp, Mus musculus
ctgaccgggcgttgttagactccca

SEQ ID NO: 398094 - DNA, 25 bp, Mus musculus
cgcatgtgcggcgtctacttttagc

SEQ ID NO: 398095 - DNA, 25 bp, Mus musculus
cgcggcccacgaagaggcagaactg

SEQ ID NO: 398096 - DNA, 25 bp, Mus musculus
agccgctagctgtcagggtgactga

SEQ ID NO: 398097 - DNA, 25 bp, Mus musculus
ggtcatgaacccgaaagccgctagc

SEQ ID NO: 398098 - DNA, 25 bp, Mus musculus
cgcgaacactcaagcggacaggtca

SEQ ID NO: 398099 - DNA, 25 bp, Mus musculus
cgctctgtccggtcttgctgtaatt

SEQ ID NO: 398100 - DNA, 25 bp, Mus musculus
ttagcgatgatgtcgtaggactcca

SEQ ID NO: 398101 - DNA, 25 bp, Mus musculus
acagccaggcgttgccaaggtaggc

SEQ ID NO: 398102 - DNA, 25 bp, Mus musculus
ttccggaagaacagccaggcgttgc

SEQ ID NO: 398103 - DNA, 25 bp, Mus musculus
ccaattgaagctttccggaagaaca

SEQ ID NO: 398104 - DNA, 25 bp, Mus musculus
ttggagccggctaaccaattgaagc

SEQ ID NO: 398105 - DNA, 25 bp, Mus musculus
aaatgacctgattgacggccggcgc

SEQ ID NO: 398106 - DNA, 25 bp, Mus musculus
cagtgcgctgcctacgcgaacgcgg

SEQ ID NO: 398107 - DNA, 25 bp, Mus musculus
attgtcgatgaccacgggctggtta

SEQ ID NO: 398108 - DNA, 25 bp, Mus musculus
ctgcccggcctcacattgtcgatga

SEQ ID NO: 398109 - DNA, 25 bp, Mus musculus
gtaccgcacatcctggactccgagg

SEQ ID NO: 398110 - DNA, 25 bp, Mus musculus
tgactgtgatcagctgtaccgcaca

SEQ ID NO: 398111 - DNA, 25 bp, Mus musculus
attaaggaccgcctgactgtgatca

SEQ ID NO: 398112 - DNA, 25 bp, Mus musculus
ccaatcacagatgccaaatgacctg

SEQ ID NO: 398113 - DNA, 25 bp, Mus musculus
gttcaccggcctagagcattaagga

SEQ ID NO: 398114 - DNA, 25 bp, Mus musculus
cgtaaggtgagtgcagtctcatcca

SEQ ID NO: 398115 - DNA, 25 bp, Mus musculus
gctcccgggcccagataaagggcca

SEQ ID NO: 398116 - DNA, 25 bp, Mus musculus
gcctgtgtctatggtctggcccgaa

SEQ ID NO: 398117 - DNA, 25 bp, Mus musculus
tgtctatggtctggcccgaagcgtc

SEQ ID NO: 398118 - DNA, 25 bp, Mus musculus
ggtctggcccgaagcgtccagctgc

SEQ ID NO: 398119 - DNA, 25 bp, Mus musculus
tctcatccaggatcgggggaccagt

SEQ ID NO: 398120 - DNA, 25 bp, Mus musculus
tgtatggcgccgcaggaaccggctc

SEQ ID NO: 398121 - DNA, 25 bp, Mus musculus
gagtgcagtctcatccaggatcggg

SEQ ID NO: 398122 - DNA, 25 bp, Mus musculus
gggcccagataaagggccacctcca

SEQ ID NO: 398123 - DNA, 25 bp, Mus musculus
agataaagggccacctccagagctc

SEQ ID NO: 398124 - DNA, 25 bp, Mus musculus
cctccagagctcttagccgagcgta

SEQ ID NO: 398125 - DNA, 25 bp, Mus musculus
gagctcttagccgagcgtaaggtga

SEQ ID NO: 398126 - DNA, 25 bp, Mus musculus
ccgagcgtaaggtgagtgcagtctc

SEQ ID NO: 398127 - DNA, 25 bp, Mus musculus
cttagccgagcgtaaggtgagtgca

SEQ ID NO: 398128 - DNA, 25 bp, Mus musculus
tcaacggcacgtacgccatcgcggg

SEQ ID NO: 398129 - DNA, 25 bp, Mus musculus
gcgtgatgctatggtgcgcgactac

SEQ ID NO: 398130 - DNA, 25 bp, Mus musculus
tcgactgcctgcgtgatgctatggt

SEQ ID NO: 398131 - DNA, 25 bp, Mus musculus
actggagccacagcccggggtcttc

SEQ ID NO: 398132 - DNA, 25 bp, Mus musculus
cggcgcacctgccattcttctatgg

SEQ ID NO: 398133 - DNA, 25 bp, Mus musculus
agctctgccagttctactctcagga

SEQ ID NO: 398134 - DNA, 25 bp, Mus musculus
tcgagcgccaactcaacggcacgta

SEQ ID NO: 398135 - DNA, 25 bp, Mus musculus
ttggtgcacgacgtgcgcttccacc

SEQ ID NO: 398136 - DNA, 25 bp, Mus musculus
cggctacgtgctgtcgttggtgcac

SEQ ID NO: 398137 - DNA, 25 bp, Mus musculus
ggctgttcctcctgcgccagtgttt

SEQ ID NO: 398138 - DNA, 25 bp, Mus musculus
acctgaagctggcaggcatggccga

SEQ ID NO: 398139 - DNA, 25 bp, Mus musculus
ctgaggccgaggagcacctgaagct

SEQ ID NO: 398140 - DNA, 25 bp, Mus musculus
tcttctatggcagcatctcgcgggc

SEQ ID NO: 398141 - DNA, 25 bp, Mus musculus
tgcaacctgcgtaagccgtgtaacc

SEQ ID NO: 398142 - DNA, 25 bp, Mus musculus
agtctatcgcatgcgcaagtatggc

SEQ ID NO: 398143 - DNA, 25 bp, Mus musculus
acaagaagctcttcctgaagcgaga

SEQ ID NO: 398144 - DNA, 25 bp, Mus musculus
cctgaggaactcaaagacaagaagc

SEQ ID NO: 398145 - DNA, 25 bp, Mus musculus
agagtccctacagcgaccctgagga

SEQ ID NO: 398146 - DNA, 25 bp, Mus musculus
acacaagtgtgtacgagagtcccta

SEQ ID NO: 398147 - DNA, 25 bp, Mus musculus
gccgatgcccatggacacaagtgtg

SEQ ID NO: 398148 - DNA, 25 bp, Mus musculus
gcacgcttagcgtcatcgacagaca

SEQ ID NO: 398149 - DNA, 25 bp, Mus musculus
cccgtatgtatacccagcacgctta

SEQ ID NO: 398150 - DNA, 25 bp, Mus musculus
agaatctcctcgtggcggacatcga

SEQ ID NO: 398151 - DNA, 25 bp, Mus musculus
catcgagcttggctgtggcaacttt

SEQ ID NO: 398152 - DNA, 25 bp, Mus musculus
tcttcctgaagcgagagaatctcct

SEQ ID NO: 398153 - DNA, 25 bp, Mus musculus
ccgtgcgccagggagtctatcgcat

SEQ ID NO: 398154 - DNA, 25 bp, Mus musculus
cgggagtgcatgacacccgtatgta

SEQ ID NO: 398155 - DNA, 25 bp, Mus musculus
tggcaactttggctccgtgcgccag

SEQ ID NO: 398156 - DNA, 25 bp, Mus musculus
ctcagaatcacacgggcttcaccga

SEQ ID NO: 398157 - DNA, 25 bp, Mus musculus
atcgcctacgaagagccggaacgga

SEQ ID NO: 398158 - DNA, 25 bp, Mus musculus
aatcacacgggcttcaccgaccgga

SEQ ID NO: 398159 - DNA, 25 bp, Mus musculus
gccggagcttcacggaggcaatgac

SEQ ID NO: 398160 - DNA, 25 bp, Mus musculus
tcacggaggcaatgacggcagtcac

SEQ ID NO: 398161 - DNA, 25 bp, Mus musculus
gtggactccgtgagctccggctcct

SEQ ID NO: 398162 - DNA, 25 bp, Mus musculus
cagtcacagtctcggcatcggcatc

SEQ ID NO: 398163 - DNA, 25 bp, Mus musculus
agatagggtagccacgctgcgcagc

SEQ ID NO: 398164 - DNA, 25 bp, Mus musculus
gacggggctcgacccagcaacttcg

SEQ ID NO: 398165 - DNA, 25 bp, Mus musculus
gccaccacgagggtcatcaccaggt

SEQ ID NO: 398166 - DNA, 25 bp, Mus musculus
ggagcgagagtgtcagtcacagtct

SEQ ID NO: 398167 - DNA, 25 bp, Mus musculus
ccatactggaaacgggcaagggccg

SEQ ID NO: 398168 - DNA, 25 bp, Mus musculus
tcggcatcggcatcgcctacgaaga

SEQ ID NO: 398169 - DNA, 25 bp, Mus musculus
agggtcatcaccaggtgcagcgctc

SEQ ID NO: 398170 - DNA, 25 bp, Mus musculus
gccggatcccgagccacgctgtgat

SEQ ID NO: 398171 - DNA, 25 bp, Mus musculus
acctcctgctctggttagtgaggcc

SEQ ID NO: 398172 - DNA, 25 bp, Mus musculus
gcccacctcctgctctggttagtga

SEQ ID NO: 398173 - DNA, 25 bp, Mus musculus
acagccttgtccagcagtgggatgc

SEQ ID NO: 398174 - DNA, 25 bp, Mus musculus
ggagtcacagccttgtccagcagtg

SEQ ID NO: 398175 - DNA, 25 bp, Mus musculus
cttcgccagcatcagggggagtcac

SEQ ID NO: 398176 - DNA, 25 bp, Mus musculus
aggcggggacccttcgccagcatca

SEQ ID NO: 398177 - DNA, 25 bp, Mus musculus
agaaactggactcccgcaactctgt

SEQ ID NO: 398178 - DNA, 25 bp, Mus musculus
gtggttgtcaacagaaactggactc

SEQ ID NO: 398179 - DNA, 25 bp, Mus musculus
aactgcagcgatgtggttgtcaaca

SEQ ID NO: 398180 - DNA, 25 bp, Mus musculus
cggtgtcttagcaactgcagcgatg

SEQ ID NO: 398181 - DNA, 25 bp, Mus musculus
ctgtgattggcggtgtcttagcaac

SEQ ID NO: 398182 - DNA, 25 bp, Mus musculus
agggtcgctgacgcacgcaagccgc

SEQ ID NO: 398183 - DNA, 25 bp, Mus musculus
gatcccgagccacgctgtgattggc

SEQ ID NO: 398184 - DNA, 25 bp, Mus musculus
tgctcctcgtccagccgagcgaata

SEQ ID NO: 398185 - DNA, 25 bp, Mus musculus
ctcaggtgataaggcgtccagcaga

SEQ ID NO: 398186 - DNA, 25 bp, Mus musculus
cttcttggcacgatccagggccttg

SEQ ID NO: 398187 - DNA, 25 bp, Mus musculus
tctagctggatagcacgcagtcggc

SEQ ID NO: 398188 - DNA, 25 bp, Mus musculus
tggcaaagcccaatactagtgtgta

SEQ ID NO: 398189 - DNA, 25 bp, Mus musculus
ctgtggccagaaccaccaggtatcg

SEQ ID NO: 398190 - DNA, 25 bp, Mus musculus
gcagtacgtacagcaccgcagagtt

SEQ ID NO: 398191 - DNA, 25 bp, Mus musculus
agcccaaagatgagccgccgcaaga

SEQ ID NO: 398192 - DNA, 25 bp, Mus musculus
actcgaggtttatgcgcccacgttt

SEQ ID NO: 398193 - DNA, 25 bp, Mus musculus
tacagggatctgcacccaggcactg

SEQ ID NO: 398194 - DNA, 25 bp, Mus musculus
cactgcctgagtgtcacagcttttc

SEQ ID NO: 398195 - DNA, 25 bp, Mus musculus
cagcttttctctggatgcgcaccgg

SEQ ID NO: 398196 - DNA, 25 bp, Mus musculus
gggccactatggtactcaggtgata

SEQ ID NO: 398197 - DNA, 25 bp, Mus musculus
ctggtcgacggctacaatgagcttg

SEQ ID NO: 398198 - DNA, 25 bp, Mus musculus
ctttggagcgcgatcctagacttgc

SEQ ID NO: 398199 - DNA, 25 bp, Mus musculus
ttgagcattttctgttcgcgcatcg

SEQ ID NO: 398200 - DNA, 25 bp, Mus musculus
cgtcctcgcaactctttgagcattt

SEQ ID NO: 398201 - DNA, 25 bp, Mus musculus
gggagacacggactctacgtcctcg

SEQ ID NO: 398202 - DNA, 25 bp, Mus musculus
gcggtatctcgggtgtcaacacacc

SEQ ID NO: 398203 - DNA, 25 bp, Mus musculus
gacgctgaaggcctcgcggtatctc

SEQ ID NO: 398204 - DNA, 25 bp, Mus musculus
gtgaggcggccaggaaacaaatccc

SEQ ID NO: 398205 - DNA, 25 bp, Mus musculus
gtatcccataggcatccgacgctga

SEQ ID NO: 398206 - DNA, 25 bp, Mus musculus
ggggagccgtgcgatgctatacaac

SEQ ID NO: 398207 - DNA, 25 bp, Mus musculus
cagtggtacagcctagcggttcgct

SEQ ID NO: 398208 - DNA, 25 bp, Mus musculus
tcttcaggaccggacagcaaccagc

SEQ ID NO: 398209 - DNA, 25 bp, Mus musculus
cagaggccaaggctgagcaagtgtc

SEQ ID NO: 398210 - DNA, 25 bp, Mus musculus
agctggagacactgggaacccggcc

SEQ ID NO: 398211 - DNA, 25 bp, Mus musculus
ctgcatctctgctgtatcccatagg

SEQ ID NO: 398212 - DNA, 25 bp, Mus musculus
gactcttcagggtatgcgcacgcgt

SEQ ID NO: 398213 - DNA, 25 bp, Mus musculus
ggcttgtcctcataataccggggca

SEQ ID NO: 398214 - DNA, 25 bp, Mus musculus
agtgcgtgtccgtaacgtaaataca

SEQ ID NO: 398215 - DNA, 25 bp, Mus musculus
tacctggagcacacaggcagactgc

SEQ ID NO: 398216 - DNA, 25 bp, Mus musculus
gtcttgactgagctctgccacccag

SEQ ID NO: 398217 - DNA, 25 bp, Mus musculus
caggccatcatggagccagtcttga

SEQ ID NO: 398218 - DNA, 25 bp, Mus musculus
agactgcagcagacatgcacccaga

SEQ ID NO: 398219 - DNA, 25 bp, Mus musculus
gacagccgcttacgtgggaatcgca

SEQ ID NO: 398220 - DNA, 25 bp, Mus musculus
ccgtggagctgctgggtaaaaccaa

SEQ ID NO: 398221 - DNA, 25 bp, Mus musculus
gtttccacggttagctcgcgacctg

SEQ ID NO: 398222 - DNA, 25 bp, Mus musculus
gtgggagaaagtctcaacaacttcc

SEQ ID NO: 398223 - DNA, 25 bp, Mus musculus
cgtaaatacagagcgccgcaagtgc

SEQ ID NO: 398224 - DNA, 25 bp, Mus musculus
tgggacacgcccactggcaagctac

SEQ ID NO: 398225 - DNA, 25 bp, Mus musculus
acttccgccaggagtgcgactcttc

SEQ ID NO: 398226 - DNA, 25 bp, Mus musculus
ttccatgggatggaggaaacccagg

SEQ ID NO: 398227 - DNA, 25 bp, Mus musculus
cctgggaggaatccgggctcgctcc

SEQ ID NO: 398228 - DNA, 25 bp, Mus musculus
aaccaccgggaaggagcgcagcacc

SEQ ID NO: 398229 - DNA, 25 bp, Mus musculus
gaggctccaggccaaccaccgggaa

SEQ ID NO: 398230 - DNA, 25 bp, Mus musculus
tcttggtctcggtgcacgcgcacac

SEQ ID NO: 398231 - DNA, 25 bp, Mus musculus
ccgcaactcttggtctcggtgcacg

SEQ ID NO: 398232 - DNA, 25 bp, Mus musculus
ccactcgccgcttccatgggatgga

SEQ ID NO: 398233 - DNA, 25 bp, Mus musculus
gtcacacctggaggggtccgagacc

SEQ ID NO: 398234 - DNA, 25 bp, Mus musculus
gacatcacctgtcacacctggaggg

SEQ ID NO: 398235 - DNA, 25 bp, Mus musculus
ttaacgccaagccttccagacatca

SEQ ID NO: 398236 - DNA, 25 bp, Mus musculus
ggaagcgtaccactgccaccactta

SEQ ID NO: 398237 - DNA, 25 bp, Mus musculus
cctgagatcacaacgcttagagaaa

SEQ ID NO: 398238 - DNA, 25 bp, Mus musculus
tgaacccgctcctgagatcacaacg

SEQ ID NO: 398239 - DNA, 25 bp, Mus musculus
ggatcctgcccgcaactcttggtct

SEQ ID NO: 398240 - DNA, 25 bp, Mus musculus
acgacaggacgcgacttcgggaacg

SEQ ID NO: 398241 - DNA, 25 bp, Mus musculus
gaccatagtgtcgtggacgtggccc

SEQ ID NO: 398242 - DNA, 25 bp, Mus musculus
ggctgttccgctctgctcagctctg

SEQ ID NO: 398243 - DNA, 25 bp, Mus musculus
ttcagactgtcccaggtacctggca

SEQ ID NO: 398244 - DNA, 25 bp, Mus musculus
ggaccaccgccaggacgaggacgct

SEQ ID NO: 398245 - DNA, 25 bp, Mus musculus
aggacgctcacgatcgcggctcctg

SEQ ID NO: 398246 - DNA, 25 bp, Mus musculus
cctgtcacccgagcctcggagagtg

SEQ ID NO: 398247 - DNA, 25 bp, Mus musculus
gtggcgtgggtacccttcacgtcca

SEQ ID NO: 398248 - DNA, 25 bp, Mus musculus
ttcacgtccaaagggccctgggcta

SEQ ID NO: 398249 - DNA, 25 bp, Mus musculus
tcccaggtacctggcactggagcgt

SEQ ID NO: 398250 - DNA, 25 bp, Mus musculus
agctccacgacaggacgcgacttcg

SEQ ID NO: 398251 - DNA, 25 bp, Mus musculus
ttcgggaacgcgtcagactctcacc

SEQ ID NO: 398252 - DNA, 25 bp, Mus musculus
cgtggccacgccatttcagactgtc

SEQ ID NO: 398253 - DNA, 25 bp, Mus musculus
tgggctacctgagctcttctcgcca

SEQ ID NO: 398254 - DNA, 25 bp, Mus musculus
agactacggatcgtgcgcgcgcacc

SEQ ID NO: 398255 - DNA, 25 bp, Mus musculus
caacccgggccacagtcaggctctc

SEQ ID NO: 398256 - DNA, 25 bp, Mus musculus
ccgggatggctcttctctagcccag

SEQ ID NO: 398257 - DNA, 25 bp, Mus musculus
gatggctcttctctagcccagcgca

SEQ ID NO: 398258 - DNA, 25 bp, Mus musculus
ctcacgctctgtacctgagcggggc

SEQ ID NO: 398259 - DNA, 25 bp, Mus musculus
ctctgtacctgagcggggctcttct

SEQ ID NO: 398260 - DNA, 25 bp, Mus musculus
ccctctcgcggagactacggatcgt

SEQ ID NO: 398261 - DNA, 25 bp, Mus musculus
gacgcagccgcctaagcagcgatgc

SEQ ID NO: 398262 - DNA, 25 bp, Mus musculus
gcgcacccgagcgagcacgtagcga

SEQ ID NO: 398263 - DNA, 25 bp, Mus musculus
agcacgtagcgacgtggaccgccgc

SEQ ID NO: 398264 - DNA, 25 bp, Mus musculus
ctggaagccttttccgggcccatcg

SEQ ID NO: 398265 - DNA, 25 bp, Mus musculus
tgcgtccggtctcctagtaaccatc

SEQ ID NO: 398266 - DNA, 25 bp, Mus musculus
ggtctcctagtaaccatcctctagc

SEQ ID NO: 398267 - DNA, 25 bp, Mus musculus
gtgcgcacgcgtacctgtctcgaca

SEQ ID NO: 398268 - DNA, 25 bp, Mus musculus
caggatgcgctgtggatcagtacca

SEQ ID NO: 398269 - DNA, 25 bp, Mus musculus
tcaagaccgtgaccactagtggagc

SEQ ID NO: 398270 - DNA, 25 bp, Mus musculus
tgctcccaagcctttcaagaccgtg

SEQ ID NO: 398271 - DNA, 25 bp, Mus musculus
ggcagccgcctgtcatggcccgaaa

SEQ ID NO: 398272 - DNA, 25 bp, Mus musculus
tggcccgaaagcgagggcaaaccca

SEQ ID NO: 398273 - DNA, 25 bp, Mus musculus
caagaagcggcacgagcgtctcttc

SEQ ID NO: 398274 - DNA, 25 bp, Mus musculus
gagcgctgcagtcacgacctctggt

SEQ ID NO: 398275 - DNA, 25 bp, Mus musculus
atctcgctgaccctggtcaagctcg

SEQ ID NO: 398276 - DNA, 25 bp, Mus musculus
aaggctcaaggtggcgcctcctcca

SEQ ID NO: 398277 - DNA, 25 bp, Mus musculus
ctctactcagcagcccgagctgggg

SEQ ID NO: 398278 - DNA, 25 bp, Mus musculus
atcagtaccagcagcgcaggcaccg

SEQ ID NO: 398279 - DNA, 25 bp, Mus musculus
agcgtctcttccaccggcaggatgc

SEQ ID NO: 398280 - DNA, 25 bp, Mus musculus
gtcaagctcgagtcggtacctccgc

SEQ ID NO: 398281 - DNA, 25 bp, Mus musculus
cagggtcaaggggtcaaagagcacc

SEQ ID NO: 398282 - DNA, 25 bp, Mus musculus
gcgctattaaggcacccgatcactg

SEQ ID NO: 398283 - DNA, 25 bp, Mus musculus
ggacgaatcgaaacctgcgctatta

SEQ ID NO: 398284 - DNA, 25 bp, Mus musculus
gacaccacgtttcatgtgccgtatg

SEQ ID NO: 398285 - DNA, 25 bp, Mus musculus
cggcaggactcccaagtttaccgtg

SEQ ID NO: 398286 - DNA, 25 bp, Mus musculus
ttccctggaataaaccgcaaagtca

SEQ ID NO: 398287 - DNA, 25 bp, Mus musculus
ccctgcagatgagacgatgttccct

SEQ ID NO: 398288 - DNA, 25 bp, Mus musculus
tatgagcaggcgcatttggaaatcc

SEQ ID NO: 398289 - DNA, 25 bp, Mus musculus
ttcttcgctgaagagcccgtactgc

SEQ ID NO: 398290 - DNA, 25 bp, Mus musculus
ccttccgctgtcaaaaaccttctgg

SEQ ID NO: 398291 - DNA, 25 bp, Mus musculus
ttccacgctgacctgtgaagttctg

SEQ ID NO: 398292 - DNA, 25 bp, Mus musculus
tgcgggataaagagcaacgccactc

SEQ ID NO: 398293 - DNA, 25 bp, Mus musculus
tgctatgcagcaccaaccggacagc

SEQ ID NO: 398294 - DNA, 25 bp, Mus musculus
cgacgggcagtttaaaatctcagga

SEQ ID NO: 398295 - DNA, 25 bp, Mus musculus
agtacgcggcgcatcatcaagttga

SEQ ID NO: 398296 - DNA, 25 bp, Mus musculus
tcttgatcttctgaaagcagccagg

SEQ ID NO: 398297 - DNA, 25 bp, Mus musculus
ctgcgcctgcgctgtcttctatggc

SEQ ID NO: 398298 - DNA, 25 bp, Mus musculus
ttctgtttcgagttggaggtcccgc

SEQ ID NO: 398299 - DNA, 25 bp, Mus musculus
aggctctctctgcagttacgaaatg

SEQ ID NO: 398300 - DNA, 25 bp, Mus musculus
ttgaatgttgcactgggtccacctg

SEQ ID NO: 398301 - DNA, 25 bp, Mus musculus
gatctaggtccgagccatccaagcg

SEQ ID NO: 398302 - DNA, 25 bp, Mus musculus
gtctcactcgtgtagatctaggtcc

SEQ ID NO: 398303 - DNA, 25 bp, Mus musculus
cgcgcgtgtctctgagagtctcact

SEQ ID NO: 398304 - DNA, 25 bp, Mus musculus
gcagccaggttgtcactttattcga

SEQ ID NO: 398305 - DNA, 25 bp, Mus musculus
acggcaacggcgtggtttgaatgtt

SEQ ID NO: 398306 - DNA, 25 bp, Mus musculus
aaccgtacggtctgtgacggcaacg

SEQ ID NO: 398307 - DNA, 25 bp, Mus musculus
cttctatggcgcgttgtgaatgggc

SEQ ID NO: 398308 - DNA, 25 bp, Mus musculus
ggtcccgcagacctatttcttgatc

SEQ ID NO: 398309 - DNA, 25 bp, Mus musculus
tttattcgagtcgtgctgcgacgcg

SEQ ID NO: 398310 - DNA, 25 bp, Mus musculus
aaagcctcggagaagccctatcctc

SEQ ID NO: 398311 - DNA, 25 bp, Mus musculus
cgatacaatgtgagacactcgcgga

SEQ ID NO: 398312 - DNA, 25 bp, Mus musculus
ctggactattgatgaggcctacgga

SEQ ID NO: 398313 - DNA, 25 bp, Mus musculus
gggctgttaactccgccacttcatt

SEQ ID NO: 398314 - DNA, 25 bp, Mus musculus
gcagatcaagaatacccaccgggtt

SEQ ID NO: 398315 - DNA, 25 bp, Mus musculus
ggttcacacaggtttcaacctcgca

SEQ ID NO: 398316 - DNA, 25 bp, Mus musculus
cgctgtggcactatcggccacatca

SEQ ID NO: 398317 - DNA, 25 bp, Mus musculus
cctcgcagcaattgttaagggcaga

SEQ ID NO: 398318 - DNA, 25 bp, Mus musculus
accctcagccgtacctggactattg

SEQ ID NO: 398319 - DNA, 25 bp, Mus musculus
ttcatcaacactgggacgctgtggc

SEQ ID NO: 398320 - DNA, 25 bp, Mus musculus
gccgaggatgtgtccttcatcaaca

SEQ ID NO: 398321 - DNA, 25 bp, Mus musculus
tccctcgatcccagccgaggatgtg

SEQ ID NO: 398322 - DNA, 25 bp, Mus musculus
ccgatttcgcactaactggggcgca

SEQ ID NO: 398323 - DNA, 25 bp, Mus musculus
gctacagtcctctcgcgatacaatg

SEQ ID NO: 398324 - DNA, 25 bp, Mus musculus
aaaacaagagcgaagacaggtaggc

SEQ ID NO: 398325 - DNA, 25 bp, Mus musculus
ccgttgacaagcgatggggaagaaa

SEQ ID NO: 398326 - DNA, 25 bp, Mus musculus
gccgcgagcgccgttgacaagcgat

SEQ ID NO: 398327 - DNA, 25 bp, Mus musculus
gaacgcctcccagagcggctcagga

SEQ ID NO: 398328 - DNA, 25 bp, Mus musculus
ccctgtcccagtgcgcgggtctgtg

SEQ ID NO: 398329 - DNA, 25 bp, Mus musculus
taagccaggcctacggcccaggtga

SEQ ID NO: 398330 - DNA, 25 bp, Mus musculus
accatatgtgccctgtcccagtgcg

SEQ ID NO: 398331 - DNA, 25 bp, Mus musculus
cgcttgcgtactgagggctcacacc

SEQ ID NO: 398332 - DNA, 25 bp, Mus musculus
tggagacgctctagccgaagcgccg

SEQ ID NO: 398333 - DNA, 25 bp, Mus musculus
gcggctctactggagacgctctagc

SEQ ID NO: 398334 - DNA, 25 bp, Mus musculus
tcgggcgctgctaagccaggcctac

SEQ ID NO: 398335 - DNA, 25 bp, Mus musculus
agacagtgggtctgtgagacaccga

SEQ ID NO: 398336 - DNA, 25 bp, Mus musculus
ctgtgagacaccgaaccgaggggcc

SEQ ID NO: 398337 - DNA, 25 bp, Mus musculus
tactgagggctcacaccatatgtgc

SEQ ID NO: 398338 - DNA, 25 bp, Mus musculus
actcgaacgcgcgagggaatgaatg

SEQ ID NO: 398339 - DNA, 25 bp, Mus musculus
gcgctccgattgatgtgcggcgcca

SEQ ID NO: 398340 - DNA, 25 bp, Mus musculus
acttgcgacgccagcggcgggactc

SEQ ID NO: 398341 - DNA, 25 bp, Mus musculus
gtcacgcgttacataacccggcggc

SEQ ID NO: 398342 - DNA, 25 bp, Mus musculus
gggcgccgccgtcgttcagtgtcct

SEQ ID NO: 398343 - DNA, 25 bp, Mus musculus
ctcccatccacaccgcggcccgctg

SEQ ID NO: 398344 - DNA, 25 bp, Mus musculus
agagcagcgcctcggctgcacgtga

SEQ ID NO: 398345 - DNA, 25 bp, Mus musculus
ctcggctgcacgtgaccgtgcggct

SEQ ID NO: 398346 - DNA, 25 bp, Mus musculus
gacccgccgcatcaccacgctgcct

SEQ ID NO: 398347 - DNA, 25 bp, Mus musculus
ctagctaatggtgctgcagcgacgc

SEQ ID NO: 398348 - DNA, 25 bp, Mus musculus
taatggtgctgcagcgacgcgcagc

SEQ ID NO: 398349 - DNA, 25 bp, Mus musculus
gactaaccgggtagacgaccgcgca

SEQ ID NO: 398350 - DNA, 25 bp, Mus musculus
ggaacgggaggtcacgcgttacata

SEQ ID NO: 398351 - DNA, 25 bp, Mus musculus
gccgcaccgcgctccgattgatgtg

SEQ ID NO: 398352 - DNA, 25 bp, Mus musculus
tccagggtcagggaaggacagacaa

SEQ ID NO: 398353 - DNA, 25 bp, Mus musculus
gccgtccaaggcaagcaccgaaata

SEQ ID NO: 398354 - DNA, 25 bp, Mus musculus
caccgaaataccttccagggtcagg

SEQ ID NO: 398355 - DNA, 25 bp, Mus musculus
tgcaagcatcggtgtaaagttactc

SEQ ID NO: 398356 - DNA, 25 bp, Mus musculus
gcggccagaaggtcacgctcacctt

SEQ ID NO: 398357 - DNA, 25 bp, Mus musculus
ggacagacaagttgccagccaggga

SEQ ID NO: 398358 - DNA, 25 bp, Mus musculus
tccttggaatgactcagcctcgctc

SEQ ID NO: 398359 - DNA, 25 bp, Mus musculus
ggaggaacctagaggtgatgccttt

SEQ ID NO: 398360 - DNA, 25 bp, Mus musculus
cgtctccagggctcggtgcactgga

SEQ ID NO: 398361 - DNA, 25 bp, Mus musculus
cgcggcagtcctacggggaccctga

SEQ ID NO: 398362 - DNA, 25 bp, Mus musculus
ctcagcacctgacgggttcgccgga

SEQ ID NO: 398363 - DNA, 25 bp, Mus musculus
cggaaaggccgagtcgacaataaca

SEQ ID NO: 398364 - DNA, 25 bp, Mus musculus
gatctgcgcagacacctgagtcacc

SEQ ID NO: 398365 - DNA, 25 bp, Mus musculus
agcgacttccggatctgcgcagaca

SEQ ID NO: 398366 - DNA, 25 bp, Mus musculus
ttctcacaggtcacggaggagcgca

SEQ ID NO: 398367 - DNA, 25 bp, Mus musculus
aggccggtggcagttggcaccgtcc

SEQ ID NO: 398368 - DNA, 25 bp, Mus musculus
ctgttgttaccgcagggtctggttt

SEQ ID NO: 398369 - DNA, 25 bp, Mus musculus
ctctaggggtcccaccacgctcgcc

SEQ ID NO: 398370 - DNA, 25 bp, Mus musculus
cccagcgtgtctggggccactggct

SEQ ID NO: 398371 - DNA, 25 bp, Mus musculus
gtctggggccactggctcctcaggc

SEQ ID NO: 398372 - DNA, 25 bp, Mus musculus
cctgtcctgttgttaccgcagggtc

SEQ ID NO: 398373 - DNA, 25 bp, Mus musculus
gtccccggctgaggtcctctcggtg

SEQ ID NO: 398374 - DNA, 25 bp, Mus musculus
gcttcttgcctgctgacctgcgggt

SEQ ID NO: 398375 - DNA, 25 bp, Mus musculus
gctctccgtgggtgcgctgggcacc

SEQ ID NO: 398376 - DNA, 25 bp, Mus musculus
agcgcagctccttgcggtggcctgt

SEQ ID NO: 398377 - DNA, 25 bp, Mus musculus
tcacaggtcacggaggagcgcagct

SEQ ID NO: 398378 - DNA, 25 bp, Mus musculus
tgcgccgcttctcacaggtcacgga

SEQ ID NO: 398379 - DNA, 25 bp, Mus musculus
cggtggcctgtcctgttgttaccgc

SEQ ID NO: 398380 - DNA, 25 bp, Mus musculus
ggacgtcctctgagccaaagggagc

SEQ ID NO: 398381 - DNA, 25 bp, Mus musculus
tctggtcctccgcaaattaagggga

SEQ ID NO: 398382 - DNA, 25 bp, Mus musculus
cccagcggccagcaccgggactcac

SEQ ID NO: 398383 - DNA, 25 bp, Mus musculus
taagtcgaagctgtccatggtggga

SEQ ID NO: 398384 - DNA, 25 bp, Mus musculus
ctggaggtgtgcactcttgaagatc

SEQ ID NO: 398385 - DNA, 25 bp, Mus musculus
tgtccagctgggactttctggtcct

SEQ ID NO: 398386 - DNA, 25 bp, Mus musculus
cccgtgtccagctgggactttctgg

SEQ ID NO: 398387 - DNA, 25 bp, Mus musculus
tcctctgagccaaagggagcggcgc

SEQ ID NO: 398388 - DNA, 25 bp, Mus musculus
tttctcgggccggactgccggctcg

SEQ ID NO: 398389 - DNA, 25 bp, Mus musculus
agcagggctaagtcgaagctgtcca

SEQ ID NO: 398390 - DNA, 25 bp, Mus musculus
ggtcccattcctggagcagggctaa

SEQ ID NO: 398391 - DNA, 25 bp, Mus musculus
agcgactcgaggtcccattcctgga

SEQ ID NO: 398392 - DNA, 25 bp, Mus musculus
cgggactcaccacagcgactcgagg

SEQ ID NO: 398393 - DNA, 25 bp, Mus musculus
aggtgtgcactcttgaagatctggg

SEQ ID NO: 398394 - DNA, 25 bp, Mus musculus
ggcttgtagagcagccgcccgcagc

SEQ ID NO: 398395 - DNA, 25 bp, Mus musculus
ttcgtagtcgccagcgaggaaggcc

SEQ ID NO: 398396 - DNA, 25 bp, Mus musculus
tgggagcgtggcgaccacctcacag

SEQ ID NO: 398397 - DNA, 25 bp, Mus musculus
acgtcagccaagtgaccgtgggagc

SEQ ID NO: 398398 - DNA, 25 bp, Mus musculus
cccagtggctcacgtcagccaagtg

SEQ ID NO: 398399 - DNA, 25 bp, Mus musculus
cggcttctgccctcttcaccgtcag

SEQ ID NO: 398400 - DNA, 25 bp, Mus musculus
actcatggtgcagagacggggattc

SEQ ID NO: 398401 - DNA, 25 bp, Mus musculus
cgccggcgtcctgattgaacctttt

SEQ ID NO: 398402 - DNA, 25 bp, Mus musculus
gccacttcgtagtcgccagcgagga

SEQ ID NO: 398403 - DNA, 25 bp, Mus musculus
acaggcggccgtttctcgcgcaggc

SEQ ID NO: 398404 - DNA, 25 bp, Mus musculus
cgctggacaacgtcaccggcttgta

SEQ ID NO: 398405 - DNA, 25 bp, Mus musculus
tgcacaccgtgagcccgctggacaa

SEQ ID NO: 398406 - DNA, 25 bp, Mus musculus
cagcccgctcagcatcacgttcacg

SEQ ID NO: 398407 - DNA, 25 bp, Mus musculus
agcggaagagctcggccgccacttc

SEQ ID NO: 398408 - DNA, 25 bp, Mus musculus
ttgcaggaagccaggaggacgcacc

SEQ ID NO: 398409 - DNA, 25 bp, Mus musculus
ctcccagccgctggcgctctgctcg

SEQ ID NO: 398410 - DNA, 25 bp, Mus musculus
gcgggctctgcccagacctccgcac

SEQ ID NO: 398411 - DNA, 25 bp, Mus musculus
cagacctccgcaccgctacccgcct

SEQ ID NO: 398412 - DNA, 25 bp, Mus musculus
gctacccgcctaccctcctgcaggg

SEQ ID NO: 398413 - DNA, 25 bp, Mus musculus
ctaccctcctgcagggtgcaggggt

SEQ ID NO: 398414 - DNA, 25 bp, Mus musculus
cgagttcccagctcaccctcgtaca

SEQ ID NO: 398415 - DNA, 25 bp, Mus musculus
agcttcggggtgcaagaccgccgcc

SEQ ID NO: 398416 - DNA, 25 bp, Mus musculus
cgcccgggagtgtgggcctggtcct

SEQ ID NO: 398417 - DNA, 25 bp, Mus musculus
cgcgcgtccacgttgcaggaagcca

SEQ ID NO: 398418 - DNA, 25 bp, Mus musculus
accctcgtacatcggcgctcgcgct

SEQ ID NO: 398419 - DNA, 25 bp, Mus musculus
ccacgttgcaggaagccaggaggac

SEQ ID NO: 398420 - DNA, 25 bp, Mus musculus
cagccacgccggaaggaggaagccg

SEQ ID NO: 398421 - DNA, 25 bp, Mus musculus
gcgtccacgttgcaggaagccagga

SEQ ID NO: 398422 - DNA, 25 bp, Mus musculus
agaatcttttctccccaggcctgtg

SEQ ID NO: 398423 - DNA, 25 bp, Mus musculus
ggcgggtgcaaggagaatcttttct

SEQ ID NO: 398424 - DNA, 25 bp, Mus musculus
tctaactggtagagacaggcgcgtt

SEQ ID NO: 398425 - DNA, 25 bp, Mus musculus
acttgggaggccatacaaagaggtc

SEQ ID NO: 398426 - DNA, 25 bp, Mus musculus
ttatcccgggagacttgggaggcca

SEQ ID NO: 398427 - DNA, 25 bp, Mus musculus
gggcagaactgctgctaagacaatt

SEQ ID NO: 398428 - DNA, 25 bp, Mus musculus
tctgcttgagaatggcgctttaccc

SEQ ID NO: 398429 - DNA, 25 bp, Mus musculus
gtgcgaccgacgactcggttccgct

SEQ ID NO: 398430 - DNA, 25 bp, Mus musculus
taagacaattcttatcccgggagac

SEQ ID NO: 398431 - DNA, 25 bp, Mus musculus
tctttcggaggccatggaggtctag

SEQ ID NO: 398432 - DNA, 25 bp, Mus musculus
ctaagttttgtctcccttgggcaat

SEQ ID NO: 398433 - DNA, 25 bp, Mus musculus
tcccttgggcaatggacaggggtta

SEQ ID NO: 398434 - DNA, 25 bp, Mus musculus
ggccatacaaagaggtcgccttatt

SEQ ID NO: 398435 - DNA, 25 bp, Mus musculus
cccatcgttctttcggaggccatgg

SEQ ID NO: 398436 - DNA, 25 bp, Mus musculus
tttgagtgactgaaggcaagatgca

SEQ ID NO: 398437 - DNA, 25 bp, Mus musculus
gctgggcactcctgctccggtgcgt

SEQ ID NO: 398438 - DNA, 25 bp, Mus musculus
aggcacggcctgtcattccaacgct

SEQ ID NO: 398439 - DNA, 25 bp, Mus musculus
ttagttacagaactcggcggactgc

SEQ ID NO: 398440 - DNA, 25 bp, Mus musculus
ttcctgaggaccaggcgcagactcc

SEQ ID NO: 398441 - DNA, 25 bp, Mus musculus
cccaagtctgcggtcgtttggcttg

SEQ ID NO: 398442 - DNA, 25 bp, Mus musculus
aggcgcagactccagtcttcacttc

SEQ ID NO: 398443 - DNA, 25 bp, Mus musculus
ccgggaagtcgcagaacctatgctt

SEQ ID NO: 398444 - DNA, 25 bp, Mus musculus
gtcgcagaacctatgcttacctcgg

SEQ ID NO: 398445 - DNA, 25 bp, Mus musculus
cagccactttccctaacaaggtagc

SEQ ID NO: 398446 - DNA, 25 bp, Mus musculus
cctaacaaggtagcgcctggacatg

SEQ ID NO: 398447 - DNA, 25 bp, Mus musculus
tggacatggcccgaatgacgtcacc

SEQ ID NO: 398448 - DNA, 25 bp, Mus musculus
ggcccgaatgacgtcaccctatagt

SEQ ID NO: 398449 - DNA, 25 bp, Mus musculus
gagccgggtctacatggattagtta

SEQ ID NO: 398450 - DNA, 25 bp, Mus musculus
gtgagtcctgcgcactccgggtcct

SEQ ID NO: 398451 - DNA, 25 bp, Mus musculus
aatacgtgcgcgtggctcgcggctc

SEQ ID NO: 398452 - DNA, 25 bp, Mus musculus
caccgcaggcatcccgaagcgtagg

SEQ ID NO: 398453 - DNA, 25 bp, Mus musculus
gctttcaagattgcccgctgccctt

SEQ ID NO: 398454 - DNA, 25 bp, Mus musculus
cgtgcccggacagaagctttcaaga

SEQ ID NO: 398455 - DNA, 25 bp, Mus musculus
agctgctcgccaagagagaggacta

SEQ ID NO: 398456 - DNA, 25 bp, Mus musculus
tgggcttcgggtcctgccaaccgct

SEQ ID NO: 398457 - DNA, 25 bp, Mus musculus
tctggtcacctgctcgctagcgctg

SEQ ID NO: 398458 - DNA, 25 bp, Mus musculus
gcacgcgctgagtgcgcggctcaca

SEQ ID NO: 398459 - DNA, 25 bp, Mus musculus
gctcacactgggtttggaccgtagg

SEQ ID NO: 398460 - DNA, 25 bp, Mus musculus
cccgctcggaggtaagaggccaccg

SEQ ID NO: 398461 - DNA, 25 bp, Mus musculus
gccaccgcgcttggggacgcacgat

SEQ ID NO: 398462 - DNA, 25 bp, Mus musculus
gacgcacgatctcgggtgggaatac

SEQ ID NO: 398463 - DNA, 25 bp, Mus musculus
ctgcagccagacagacggtgggctc

SEQ ID NO: 398464 - DNA, 25 bp, Mus musculus
gggaccttccgccaagcacagtatc

SEQ ID NO: 398465 - DNA, 25 bp, Mus musculus
ttggtggtgctaaaacgtgagttct

SEQ ID NO: 398466 - DNA, 25 bp, Mus musculus
cgagtgcacccgaaaaactggagta

SEQ ID NO: 398467 - DNA, 25 bp, Mus musculus
tgcaagaagactgacaagatcgacc

SEQ ID NO: 398468 - DNA, 25 bp, Mus musculus
ccggaagttgtacggctacgcgact

SEQ ID NO: 398469 - DNA, 25 bp, Mus musculus
tgcaccttagctcgggcttgggctt

SEQ ID NO: 398470 - DNA, 25 bp, Mus musculus
tgggctttcccactacctgcttaga

SEQ ID NO: 398471 - DNA, 25 bp, Mus musculus
cctgcgtctagatggctcccgcaaa

SEQ ID NO: 398472 - DNA, 25 bp, Mus musculus
catccatggagtgtgagtaccgggc

SEQ ID NO: 398473 - DNA, 25 bp, Mus musculus
acccgcgagccttgcttacagactg

SEQ ID NO: 398474 - DNA, 25 bp, Mus musculus
tacagactgggtgctctagagggca

SEQ ID NO: 398475 - DNA, 25 bp, Mus musculus
tctagagggcaagcgggtttattcc

SEQ ID NO: 398476 - DNA, 25 bp, Mus musculus
gcacctccactgctcaaggcagatt

SEQ ID NO: 398477 - DNA, 25 bp, Mus musculus
gcttgcacggcaaccggctaggaaa

SEQ ID NO: 398478 - DNA, 25 bp, Mus musculus
acaagccataggcagggccgtcctg

SEQ ID NO: 398479 - DNA, 25 bp, Mus musculus
ccttcccggtaggaagcgagcaact

SEQ ID NO: 398480 - DNA, 25 bp, Mus musculus
tctagtcccggacgagtctcgaatt

SEQ ID NO: 398481 - DNA, 25 bp, Mus musculus
ggaaatcggagccactgccaggtct

SEQ ID NO: 398482 - DNA, 25 bp, Mus musculus
agtggcgcctccctggtttcctagt

SEQ ID NO: 398483 - DNA, 25 bp, Mus musculus
cttgagccacatcgcggcgaacctg

SEQ ID NO: 398484 - DNA, 25 bp, Mus musculus
gcgttcttgagcagcacctcctcgg

SEQ ID NO: 398485 - DNA, 25 bp, Mus musculus
acccagagcttcagcgcgttcttga

SEQ ID NO: 398486 - DNA, 25 bp, Mus musculus
ctgcaagacgaagtagcagctgctc

SEQ ID NO: 398487 - DNA, 25 bp, Mus musculus
atctcgctgccttggggcaagctct

SEQ ID NO: 398488 - DNA, 25 bp, Mus musculus
gcaagctctagaagctgcgtctcca

SEQ ID NO: 398489 - DNA, 25 bp, Mus musculus
cgcgagccaggtcacaccagatgca

SEQ ID NO: 398490 - DNA, 25 bp, Mus musculus
cccgaccggagctcgcgtgagaaac

SEQ ID NO: 398491 - DNA, 25 bp, Mus musculus
agcaactgcgcaagttgtctccacg

SEQ ID NO: 398492 - DNA, 25 bp, Mus musculus
tggccggcttctctcctcagcggat

SEQ ID NO: 398493 - DNA, 25 bp, Mus musculus
gtctgtcggccctgtgtctccgttc

SEQ ID NO: 398494 - DNA, 25 bp, Mus musculus
ccgaaggagctctcgagcctgctga

SEQ ID NO: 398495 - DNA, 25 bp, Mus musculus
ggagatgtaccgcaccgagccgctc

SEQ ID NO: 398496 - DNA, 25 bp, Mus musculus
acggcgctctacctgctctgggaga

SEQ ID NO: 398497 - DNA, 25 bp, Mus musculus
tgcagcagccggacctgctgcctag

SEQ ID NO: 398498 - DNA, 25 bp, Mus musculus
actacttcagcaaggccgaccactt

SEQ ID NO: 398499 - DNA, 25 bp, Mus musculus
tgctgagcatcatctcggaggaggc

SEQ ID NO: 398500 - DNA, 25 bp, Mus musculus
tctcctcagcggatcccagaggggc

SEQ ID NO: 398501 - DNA, 25 bp, Mus musculus
agcacggcgtctggccggcttctct

SEQ ID NO: 398502 - DNA, 25 bp, Mus musculus
cactgtttttgtttgcgacgctgtc

SEQ ID NO: 398503 - DNA, 25 bp, Mus musculus
gtctccgttccgctcgtctgactta

SEQ ID NO: 398504 - DNA, 25 bp, Mus musculus
cgctcggccagcgtcgtcggtctgt

SEQ ID NO: 398505 - DNA, 25 bp, Mus musculus
gctcgtctgacttaggcactgtttt

SEQ ID NO: 398506 - DNA, 25 bp, Mus musculus
ccaggttgtagaccaccacggccga

SEQ ID NO: 398507 - DNA, 25 bp, Mus musculus
agcgagctttctccgaagcggccgc

SEQ ID NO: 398508 - DNA, 25 bp, Mus musculus
gccgccagcaccttgtccttgaagg

SEQ ID NO: 398509 - DNA, 25 bp, Mus musculus
tccacaccgtcaggttcgactgcgg

SEQ ID NO: 398510 - DNA, 25 bp, Mus musculus
tgcgggtccacgtattcgatgctca

SEQ ID NO: 398511 - DNA, 25 bp, Mus musculus
tcgatgctcaccatggccgagtacc

SEQ ID NO: 398512 - DNA, 25 bp, Mus musculus
ccaggctggcccacagctttgagga

SEQ ID NO: 398513 - DNA, 25 bp, Mus musculus
ctcaaccaactttgggagtccgtga

SEQ ID NO: 398514 - DNA, 25 bp, Mus musculus
ttcccgttgctctccaggttgtaga

SEQ ID NO: 398515 - DNA, 25 bp, Mus musculus
aagctccgatcctgcagcgtgtgca

SEQ ID NO: 398516 - DNA, 25 bp, Mus musculus
tgccaccggtgtgtttgctactccc

SEQ ID NO: 398517 - DNA, 25 bp, Mus musculus
tgaactccgtaggacctgccaccgg

SEQ ID NO: 398518 - DNA, 25 bp, Mus musculus
cgtgagccgaccttaggaagcgacc

SEQ ID NO: 398519 - DNA, 25 bp, Mus musculus
tcagaacgaggcgactcactccagg

SEQ ID NO: 398520 - DNA, 25 bp, Mus musculus
ccagcctgccgctcccagctacgga

SEQ ID NO: 398521 - DNA, 25 bp, Mus musculus
ataccctcgtcctgggttctcttgg

SEQ ID NO: 398522 - DNA, 25 bp, Mus musculus
cccacatcctgaagccgaggaaaag

SEQ ID NO: 398523 - DNA, 25 bp, Mus musculus
atcctgaagccgaggaaaagatccc

SEQ ID NO: 398524 - DNA, 25 bp, Mus musculus
cagctacggacacggaggccatgtg

SEQ ID NO: 398525 - DNA, 25 bp, Mus musculus
gagggtcctgtgtcccgacataccc

SEQ ID NO: 398526 - DNA, 25 bp, Mus musculus
cccagagaagcttggcagcgcgtgt

SEQ ID NO: 398527 - DNA, 25 bp, Mus musculus
cgcccagcgccctagagcgtttaga

SEQ ID NO: 398528 - DNA, 25 bp, Mus musculus
cagcgccctagagcgtttagaccta

SEQ ID NO: 398529 - DNA, 25 bp, Mus musculus
tagagcgtttagacctagtcacccg

SEQ ID NO: 398530 - DNA, 25 bp, Mus musculus
acccgcgcctccaagttccattgcc

SEQ ID NO: 398531 - DNA, 25 bp, Mus musculus
tcccagctacggacacggaggccat

SEQ ID NO: 398532 - DNA, 25 bp, Mus musculus
gaggccatgtggctcactaagccca

SEQ ID NO: 398533 - DNA, 25 bp, Mus musculus
agctccggagggtcctgtgtcccga

SEQ ID NO: 398534 - DNA, 25 bp, Mus musculus
agctcacgatcacgtagccggcggc

SEQ ID NO: 398535 - DNA, 25 bp, Mus musculus
tgccggacagcgacatcttcttgga

SEQ ID NO: 398536 - DNA, 25 bp, Mus musculus
cttggttttccgcaggatggcaagc

SEQ ID NO: 398537 - DNA, 25 bp, Mus musculus
agagtccacgcgtgtcttggttttc

SEQ ID NO: 398538 - DNA, 25 bp, Mus musculus
ctcccgtaagaagcgaagtctgctg

SEQ ID NO: 398539 - DNA, 25 bp, Mus musculus
cctcgtgataggattcccgggttga

SEQ ID NO: 398540 - DNA, 25 bp, Mus musculus
cgtcggaacccttctcctcgtgata

SEQ ID NO: 398541 - DNA, 25 bp, Mus musculus
caacagggcgctgcagcatagcaac

SEQ ID NO: 398542 - DNA, 25 bp, Mus musculus
catctacctcgttggtgacagccca

SEQ ID NO: 398543 - DNA, 25 bp, Mus musculus
agtggatgcactgtccagctcctca

SEQ ID NO: 398544 - DNA, 25 bp, Mus musculus
tctgctgccagatgctactcgagtc

SEQ ID NO: 398545 - DNA, 25 bp, Mus musculus
ctcccgccggtaggagaacatgcca

SEQ ID NO: 398546 - DNA, 25 bp, Mus musculus
gcttaccttttcgtgggtggacaca

SEQ ID NO: 398547 - DNA, 25 bp, Mus musculus
gcatagcaaccaggacaggcgactc

SEQ ID NO: 398548 - DNA, 25 bp, Mus musculus
gcggcatctttgtctcgcggcctcg

SEQ ID NO: 398549 - DNA, 25 bp, Mus musculus
tggacattgacctgtcgtccctgcg

SEQ ID NO: 398550 - DNA, 25 bp, Mus musculus
ctcccgcgaagagcctggtggacat

SEQ ID NO: 398551 - DNA, 25 bp, Mus musculus
ggggcgagcctttgtcaccgccctg

SEQ ID NO: 398552 - DNA, 25 bp, Mus musculus
acctgtcgtccctgcgggtgagtgc

SEQ ID NO: 398553 - DNA, 25 bp, Mus musculus
cgactctcccgcgaagagcctggtg

SEQ ID NO: 398554 - DNA, 25 bp, Mus musculus
cccggggaagatggcgaacgactct

SEQ ID NO: 398555 - DNA, 25 bp, Mus musculus
cgctccgaccggacgacaagccgcc

SEQ ID NO: 398556 - DNA, 25 bp, Mus musculus
accgccaagccatggtgtgagctcc

SEQ ID NO: 398557 - DNA, 25 bp, Mus musculus
ccatggtgtgagctccgcggccagc

SEQ ID NO: 398558 - DNA, 25 bp, Mus musculus
gggcgctccgagtctttcattcatt

SEQ ID NO: 398559 - DNA, 25 bp, Mus musculus
gctccgagtctttcattcattgtta

SEQ ID NO: 398560 - DNA, 25 bp, Mus musculus
ctgctgaatattcacgcgggcgggc

SEQ ID NO: 398561 - DNA, 25 bp, Mus musculus
ttcattcattgttagcggaggctgg

SEQ ID NO: 398562 - DNA, 25 bp, Mus musculus
tgctgctcagaaggtcttagctggt

SEQ ID NO: 398563 - DNA, 25 bp, Mus musculus
gctcagagtgggagcagcgtgctgc

SEQ ID NO: 398564 - DNA, 25 bp, Mus musculus
ctgaacgggtttagttcggagctgc

SEQ ID NO: 398565 - DNA, 25 bp, Mus musculus
gcccacctagaagggcgggagccca

SEQ ID NO: 398566 - DNA, 25 bp, Mus musculus
cgcctgccccagagcggaaggaatg

SEQ ID NO: 398567 - DNA, 25 bp, Mus musculus
gaaggaatgtgacccccgagcgagc

SEQ ID NO: 398568 - DNA, 25 bp, Mus musculus
cgcggagcagcccttgagcggctcc

SEQ ID NO: 398569 - DNA, 25 bp, Mus musculus
ttgagcggctcccagggctccggtt

SEQ ID NO: 398570 - DNA, 25 bp, Mus musculus
tgaacatcgccactggggcacccgg

SEQ ID NO: 398571 - DNA, 25 bp, Mus musculus
attgttgaacatcgccactggggca

SEQ ID NO: 398572 - DNA, 25 bp, Mus musculus
gctgctggattgttgaacatcgcca

SEQ ID NO: 398573 - DNA, 25 bp, Mus musculus
cggagctgctggattgttgaacatc

SEQ ID NO: 398574 - DNA, 25 bp, Mus musculus
agcccgaggctgaggacgctggcct

SEQ ID NO: 398575 - DNA, 25 bp, Mus musculus
tgctcagaaggtcttagctggtgcg

SEQ ID NO: 398576 - DNA, 25 bp, Mus musculus
cccatgtaggcactggctgtggtta

SEQ ID NO: 398577 - DNA, 25 bp, Mus musculus
ggccgcatttcatgcctccaacatg

SEQ ID NO: 398578 - DNA, 25 bp, Mus musculus
cgatccacttgcgttccagctctgg

SEQ ID NO: 398579 - DNA, 25 bp, Mus musculus
aggcgcccaggagcaaaaggcttcc

SEQ ID NO: 398580 - DNA, 25 bp, Mus musculus
cgcggacccacgatacagacattta

SEQ ID NO: 398581 - DNA, 25 bp, Mus musculus
cataagcttcactctgcgttgggcc

SEQ ID NO: 398582 - DNA, 25 bp, Mus musculus
tctcgccttccggtcatcactgagg

SEQ ID NO: 398583 - DNA, 25 bp, Mus musculus
ccagcgcaggtatccagtgcagttc

SEQ ID NO: 398584 - DNA, 25 bp, Mus musculus
ctgcagaagcagcaaacgttattcc

SEQ ID NO: 398585 - DNA, 25 bp, Mus musculus
cgccgtctcctgttagattctgaaa

SEQ ID NO: 398586 - DNA, 25 bp, Mus musculus
cagcccttgtttgcttcccgtgtca

SEQ ID NO: 398587 - DNA, 25 bp, Mus musculus
tggtggtacttcagatccctcgaca

SEQ ID NO: 398588 - DNA, 25 bp, Mus musculus
gctcagcaatatcgccatgcaggtg

SEQ ID NO: 398589 - DNA, 25 bp, Mus musculus
cccagctgtgccgtaaagtaaagag

SEQ ID NO: 398590 - DNA, 25 bp, Mus musculus
ctcggccgtgcacaagggccatttg

SEQ ID NO: 398591 - DNA, 25 bp, Mus musculus
gcaggaaatcttgccggcctgagtc

SEQ ID NO: 398592 - DNA, 25 bp, Mus musculus
tccttcaaggaaacgtcagtgctcg

SEQ ID NO: 398593 - DNA, 25 bp, Mus musculus
cgcactgttgtcttagccggtttca

SEQ ID NO: 398594 - DNA, 25 bp, Mus musculus
gaaatggaaaatcaccgaggctctc

SEQ ID NO: 398595 - DNA, 25 bp, Mus musculus
ctcactcaggacacggtggccagtc

SEQ ID NO: 398596 - DNA, 25 bp, Mus musculus
gcaactcagtctacagcctgctagg

SEQ ID NO: 398597 - DNA, 25 bp, Mus musculus
cctttcgcggcgcagggcttataaa

SEQ ID NO: 398598 - DNA, 25 bp, Mus musculus
tctcatcggtgagtgctggaaaagc

SEQ ID NO: 398599 - DNA, 25 bp, Mus musculus
acgatgaccgtcaaagccgaggctg

SEQ ID NO: 398600 - DNA, 25 bp, Mus musculus
aggctgctcgaagcacccttaccta

SEQ ID NO: 398601 - DNA, 25 bp, Mus musculus
agccggcatcggttttgaaggttca

SEQ ID NO: 398602 - DNA, 25 bp, Mus musculus
tgaccgtgcactgcggtgtccactc

SEQ ID NO: 398603 - DNA, 25 bp, Mus musculus
ctttccgggcatcgggacgatgacc

SEQ ID NO: 398604 - DNA, 25 bp, Mus musculus
cggagggagttagcgatcaatagtc

SEQ ID NO: 398605 - DNA, 25 bp, Mus musculus
cccgcggcggagaagcgatgcccaa

SEQ ID NO: 398606 - DNA, 25 bp, Mus musculus
cgatcaatagtcactggggcggcta

SEQ ID NO: 398607 - DNA, 25 bp, Mus musculus
tcaatagtcactggggcggctagaa

SEQ ID NO: 398608 - DNA, 25 bp, Mus musculus
gttagcgatcaatagtcactggggc

SEQ ID NO: 398609 - DNA, 25 bp, Mus musculus
agactccgacctggaaagtgggccg

SEQ ID NO: 398610 - DNA, 25 bp, Mus musculus
cccataggcaggtggagcaagcccg

SEQ ID NO: 398611 - DNA, 25 bp, Mus musculus
tctgctccacgagacccagcgctct

SEQ ID NO: 398612 - DNA, 25 bp, Mus musculus
agtggttcccgctctgctccacgag

SEQ ID NO: 398613 - DNA, 25 bp, Mus musculus
tgcggtgaccaaccaggattcggtc

SEQ ID NO: 398614 - DNA, 25 bp, Mus musculus
cagagtgcggtgaccaaccaggatt

SEQ ID NO: 398615 - DNA, 25 bp, Mus musculus
aagcgatgcccaaggtgcagagtgc

SEQ ID NO: 398616 - DNA, 25 bp, Mus musculus
ctagaagactccgacctggaaagtg

SEQ ID NO: 398617 - DNA, 25 bp, Mus musculus
ggcggctagaagactccgacctgga

SEQ ID NO: 398618 - DNA, 25 bp, Mus musculus
gggaacccagatcctacaccagcgt

SEQ ID NO: 398619 - DNA, 25 bp, Mus musculus
cgggctcccaagaacagcggctctt

SEQ ID NO: 398620 - DNA, 25 bp, Mus musculus
ggtgctttgctcttccttctcatct

SEQ ID NO: 398621 - DNA, 25 bp, Mus musculus
tcggtgagtcggtctctgcagaccc

SEQ ID NO: 398622 - DNA, 25 bp, Mus musculus
tgcagacccagcagtggcgaaggct

SEQ ID NO: 398623 - DNA, 25 bp, Mus musculus
ggtcccagccctgatggacggccga

SEQ ID NO: 398624 - DNA, 25 bp, Mus musculus
acaggctgtgttcaaggtgctttgc

SEQ ID NO: 398625 - DNA, 25 bp, Mus musculus
tgcgaggttcacacccaccgaactg

SEQ ID NO: 398626 - DNA, 25 bp, Mus musculus
cccaccgaactggttggcgacaggg

SEQ ID NO: 398627 - DNA, 25 bp, Mus musculus
tcgcagtcccgttgagttagtagtg

SEQ ID NO: 398628 - DNA, 25 bp, Mus musculus
aacccgccaagtcctgccagtgtgg

SEQ ID NO: 398629 - DNA, 25 bp, Mus musculus
tcccgcgatgctctgagggaaccca

SEQ ID NO: 398630 - DNA, 25 bp, Mus musculus
gcgtcctctgctgcgctcatagctg

SEQ ID NO: 398631 - DNA, 25 bp, Mus musculus
ttagtagtgctgtccctcccgcgat

SEQ ID NO: 398632 - DNA, 25 bp, Mus musculus
tactgttgtggtggtacctaccgcg

SEQ ID NO: 398633 - DNA, 25 bp, Mus musculus
caggattgaccacgcccatggcgga

SEQ ID NO: 398634 - DNA, 25 bp, Mus musculus
ctaccgcgggcgtcttaattcaaga

SEQ ID NO: 398635 - DNA, 25 bp, Mus musculus
gtgactactgttgtggtggtaccta

SEQ ID NO: 398636 - DNA, 25 bp, Mus musculus
ccgcgggcgtcttaattcaagatcg

SEQ ID NO: 398637 - DNA, 25 bp, Mus musculus
gaagcgatctgcgtgcgcctgcgca

SEQ ID NO: 398638 - DNA, 25 bp, Mus musculus
actagacggtgctgtggctgtcacc

SEQ ID NO: 398639 - DNA, 25 bp, Mus musculus
acgcccatggcggaagcgatctgcg

SEQ ID NO: 398640 - DNA, 25 bp, Mus musculus
gctgtcaccggggtctccgaggcta

SEQ ID NO: 398641 - DNA, 25 bp, Mus musculus
ggtctccgaggctagatcctgcctc

SEQ ID NO: 398642 - DNA, 25 bp, Mus musculus
gaggctagatcctgcctcgaagccc

SEQ ID NO: 398643 - DNA, 25 bp, Mus musculus
tgcggacagcttagccgactgcaga

SEQ ID NO: 398644 - DNA, 25 bp, Mus musculus
acagcttagccgactgcagaccacg

SEQ ID NO: 398645 - DNA, 25 bp, Mus musculus
ggagctcacagcactagacggtgct

SEQ ID NO: 398646 - DNA, 25 bp, Mus musculus
ccctaatgagggaacaatcgtcccg

SEQ ID NO: 398647 - DNA, 25 bp, Mus musculus
agccaggcacatcgtctccatttct

SEQ ID NO: 398648 - DNA, 25 bp, Mus musculus
ttccgcagctccaggccgccctaat

SEQ ID NO: 398649 - DNA, 25 bp, Mus musculus
ggaaagggccgccagcctttccgca

SEQ ID NO: 398650 - DNA, 25 bp, Mus musculus
gggaacaatcgtcccggcagagagc

SEQ ID NO: 398651 - DNA, 25 bp, Mus musculus
gtccccgcagaaaaggcgagtcgcg

SEQ ID NO: 398652 - DNA, 25 bp, Mus musculus
gcacaaagcacggacgcctgcgccc

SEQ ID NO: 398653 - DNA, 25 bp, Mus musculus
ggtcagcgcgcccagcacaaagcac

SEQ ID NO: 398654 - DNA, 25 bp, Mus musculus
atcgtcccggcagagagcaggcgac

SEQ ID NO: 398655 - DNA, 25 bp, Mus musculus
acattgtcagtgattgtgggaaagg

SEQ ID NO: 398656 - DNA, 25 bp, Mus musculus
ctgccacacattgtcagtgattgtg

SEQ ID NO: 398657 - DNA, 25 bp, Mus musculus
cgtctgctgccacacattgtcagtg

SEQ ID NO: 398658 - DNA, 25 bp, Mus musculus
tgcgacacgtctgctgccacacatt

SEQ ID NO: 398659 - DNA, 25 bp, Mus musculus
ctcctcgcccgcctctgcgacacgt

SEQ ID NO: 398660 - DNA, 25 bp, Mus musculus
cgcgaccgaagaagcacgaagggca

SEQ ID NO: 398661 - DNA, 25 bp, Mus musculus
tcatgcacactactcccagcagtgt

SEQ ID NO: 398662 - DNA, 25 bp, Mus musculus
ctctggggcgacgtccgcctttaag

SEQ ID NO: 398663 - DNA, 25 bp, Mus musculus
tgggccgcgaccgaagaagcacgaa

SEQ ID NO: 398664 - DNA, 25 bp, Mus musculus
ccgcagctgcagagaacttgccttg

SEQ ID NO: 398665 - DNA, 25 bp, Mus musculus
ggggtgcattcttggttgctctttc

SEQ ID NO: 398666 - DNA, 25 bp, Mus musculus
tggttgctctttcccgcagctgcag

SEQ ID NO: 398667 - DNA, 25 bp, Mus musculus
agccctctccgagtccgcctgcaga

SEQ ID NO: 398668 - DNA, 25 bp, Mus musculus
aacacgctggacacaagcgcgagcc

SEQ ID NO: 398669 - DNA, 25 bp, Mus musculus
ttgaggtacccaacacgctggacac

SEQ ID NO: 398670 - DNA, 25 bp, Mus musculus
acgcgggcagttgaggtacccaaca

SEQ ID NO: 398671 - DNA, 25 bp, Mus musculus
agtgcctagtcgcacagcctgggtt

SEQ ID NO: 398672 - DNA, 25 bp, Mus musculus
gcggcactaagtgcctagtcgcaca

SEQ ID NO: 398673 - DNA, 25 bp, Mus musculus
ctttaaggggcgacagccctgtcct

SEQ ID NO: 398674 - DNA, 25 bp, Mus musculus
tgcagctctcttgcctcctgttcaa

SEQ ID NO: 398675 - DNA, 25 bp, Mus musculus
cggtggacataagcgcggatagttc

SEQ ID NO: 398676 - DNA, 25 bp, Mus musculus
ataagcgcggatagttctttgccca

SEQ ID NO: 398677 - DNA, 25 bp, Mus musculus
cgcggatagttctttgcccagctac

SEQ ID NO: 398678 - DNA, 25 bp, Mus musculus
tagttctttgcccagctacgggcga

SEQ ID NO: 398679 - DNA, 25 bp, Mus musculus
tggtccccctttctgtagcgagttc

SEQ ID NO: 398680 - DNA, 25 bp, Mus musculus
tttgcagctctcttgcctcctgttc

SEQ ID NO: 398681 - DNA, 25 bp, Mus musculus
cgagaagagaacagctcaattacgg

SEQ ID NO: 398682 - DNA, 25 bp, Mus musculus
gagaacagctcaattacggaaagga

SEQ ID NO: 398683 - DNA, 25 bp, Mus musculus
tcaattacggaaaggagcaaagaaa

SEQ ID NO: 398684 - DNA, 25 bp, Mus musculus
gcaaagaaactaattcccgggctca

SEQ ID NO: 398685 - DNA, 25 bp, Mus musculus
ttcccgggctcaaacgccctgccca

SEQ ID NO: 398686 - DNA, 25 bp, Mus musculus
ccctgcccaccggagcttctctggt

SEQ ID NO: 398687 - DNA, 25 bp, Mus musculus
tttgcccagctacgggcgagaacgg

SEQ ID NO: 398688 - DNA, 25 bp, Mus musculus
ttgcggtccggtgccctgcagctga

SEQ ID NO: 398689 - DNA, 25 bp, Mus musculus
tgcggggtgcaagcacacgcacact

SEQ ID NO: 398690 - DNA, 25 bp, Mus musculus
gcacacgcacactcattaagagtcg

SEQ ID NO: 398691 - DNA, 25 bp, Mus musculus
ccgccgggttacgttctcggctgct

SEQ ID NO: 398692 - DNA, 25 bp, Mus musculus
ttacgttctcggctgctgcttggac

SEQ ID NO: 398693 - DNA, 25 bp, Mus musculus
ctcggctgctgcttggactagaaac

SEQ ID NO: 398694 - DNA, 25 bp, Mus musculus
gctgctgcttggactagaaactgca

SEQ ID NO: 398695 - DNA, 25 bp, Mus musculus
actagaaactgcagattgcggtccg

SEQ ID NO: 398696 - DNA, 25 bp, Mus musculus
aaactgcagattgcggtccggtgcc

SEQ ID NO: 398697 - DNA, 25 bp, Mus musculus
gcacactcattaagagtcgtgtatt

SEQ ID NO: 398698 - DNA, 25 bp, Mus musculus
agagtcgtgtatttattgaatgtcc

SEQ ID NO: 398699 - DNA, 25 bp, Mus musculus
ttgaatgtccgaattgggttagttc

SEQ ID NO: 398700 - DNA, 25 bp, Mus musculus
tgtccgaattgggttagttcattgg

SEQ ID NO: 398701 - DNA, 25 bp, Mus musculus
gaattgggttagttcattggaaatc

SEQ ID NO: 398702 - DNA, 25 bp, Mus musculus
gccgagccatcctagacggcgagac

SEQ ID NO: 398703 - DNA, 25 bp, Mus musculus
cggccctccagagagcggacgggac

SEQ ID NO: 398704 - DNA, 25 bp, Mus musculus
cgccgcgtcgcttgctccgccatgg

SEQ ID NO: 398705 - DNA, 25 bp, Mus musculus
gcgtcgcttgctccgccatggtccc

SEQ ID NO: 398706 - DNA, 25 bp, Mus musculus
ggccgagccatcctagacggcgaga

SEQ ID NO: 398707 - DNA, 25 bp, Mus musculus
gagccatcctagacggcgagaccca

SEQ ID NO: 398708 - DNA, 25 bp, Mus musculus
atcctagacggcgagacccagagca

SEQ ID NO: 398709 - DNA, 25 bp, Mus musculus
cctagacggcgagacccagagcagc

SEQ ID NO: 398710 - DNA, 25 bp, Mus musculus
ctagacggcgagacccagagcagcg

SEQ ID NO: 398711 - DNA, 25 bp, Mus musculus
tcggggatgtcgctgagcaggaacg

SEQ ID NO: 398712 - DNA, 25 bp, Mus musculus
aagggcagcgcggagctcggccctc

SEQ ID NO: 398713 - DNA, 25 bp, Mus musculus
agccatcctagacggcgagacccag

SEQ ID NO: 398714 - DNA, 25 bp, Mus musculus
agctcggccctccagagagcggacg

SEQ ID NO: 398715 - DNA, 25 bp, Mus musculus
gagctcggccctccagagagcggac

SEQ ID NO: 398716 - DNA, 25 bp, Mus musculus
gggacacatctgtctataggtatta

SEQ ID NO: 398717 - DNA, 25 bp, Mus musculus
tggcatccgagaacttaaacaaaga

SEQ ID NO: 398718 - DNA, 25 bp, Mus musculus
gtttcccagatgatggcatccgaga

SEQ ID NO: 398719 - DNA, 25 bp, Mus musculus
cgccgcggctgcacaaagttgcagt

SEQ ID NO: 398720 - DNA, 25 bp, Mus musculus
ttgcagtggcggatttccaagaagc

SEQ ID NO: 398721 - DNA, 25 bp, Mus musculus
tggcggatttccaagaagcttggcc

SEQ ID NO: 398722 - DNA, 25 bp, Mus musculus
ccacaggagctctgcgcgaggcaag

SEQ ID NO: 398723 - DNA, 25 bp, Mus musculus
ccagtggggacacatctgtctatag

SEQ ID NO: 398724 - DNA, 25 bp, Mus musculus
tttacaaatctctcgcgtggggtgg

SEQ ID NO: 398725 - DNA, 25 bp, Mus musculus
ctataggtattagcttgaacgtaca

SEQ ID NO: 398726 - DNA, 25 bp, Mus musculus
tagcttgaacgtacatccgcggcgc

SEQ ID NO: 398727 - DNA, 25 bp, Mus musculus
ttgaacgtacatccgcggcgcgcgc

SEQ ID NO: 398728 - DNA, 25 bp, Mus musculus
cggcgcgcgctttacaaatctctcg

SEQ ID NO: 398729 - DNA, 25 bp, Mus musculus
actttgaaaccagtggggacacatc

SEQ ID NO: 398730 - DNA, 25 bp, Mus musculus
gcggcatggccacggcggcttctaa

SEQ ID NO: 398731 - DNA, 25 bp, Mus musculus
tacctgccggggaacagcctgctca

SEQ ID NO: 398732 - DNA, 25 bp, Mus musculus
gccggctccattgtgcactcggacg

SEQ ID NO: 398733 - DNA, 25 bp, Mus musculus
ccgtcctcggtcaagatggtccaga

SEQ ID NO: 398734 - DNA, 25 bp, Mus musculus
atggtccagagcgacttcatgcagg

SEQ ID NO: 398735 - DNA, 25 bp, Mus musculus
gcaacggcggccatatgctgagcca

SEQ ID NO: 398736 - DNA, 25 bp, Mus musculus
tatgctgagccacgcgcaccagtgg

SEQ ID NO: 398737 - DNA, 25 bp, Mus musculus
gctgccgtggaagccagctcaccgt

SEQ ID NO: 398738 - DNA, 25 bp, Mus musculus
ccagctcaccgtggtcgggcagtgc

SEQ ID NO: 398739 - DNA, 25 bp, Mus musculus
gctggacgcgaagacctgcacgccg

SEQ ID NO: 398740 - DNA, 25 bp, Mus musculus
gagtctgctgtactcgcagcccgga

SEQ ID NO: 398741 - DNA, 25 bp, Mus musculus
gcagcccggaggcttcacggtgaac

SEQ ID NO: 398742 - DNA, 25 bp, Mus musculus
cgagttggcggagcatcatcaccac

SEQ ID NO: 398743 - DNA, 25 bp, Mus musculus
ggggccagggctcaacagccacgac

SEQ ID NO: 398744 - DNA, 25 bp, Mus musculus
tcgcgccaagtatgagcagctgctg

SEQ ID NO: 398745 - DNA, 25 bp, Mus musculus
tcactggatttggatgactggccgc

SEQ ID NO: 398746 - DNA, 25 bp, Mus musculus
tggcaacgacacagccaaccgcgtg

SEQ ID NO: 398747 - DNA, 25 bp, Mus musculus
gtgccaagcctacacgggactcttc

SEQ ID NO: 398748 - DNA, 25 bp, Mus musculus
ctcttcgcggtaaggatcgaggatc

SEQ ID NO: 398749 - DNA, 25 bp, Mus musculus
tacgattcctgggaggtccggataa

SEQ ID NO: 398750 - DNA, 25 bp, Mus musculus
agctcgcccacgttgtcattacaca

SEQ ID NO: 398751 - DNA, 25 bp, Mus musculus
cacagctgctgttgtgggtacgtga

SEQ ID NO: 398752 - DNA, 25 bp, Mus musculus
ttcctcctgcagtatggcgcagacg

SEQ ID NO: 398753 - DNA, 25 bp, Mus musculus
aaggccgcacggcactgttctatgc

SEQ ID NO: 398754 - DNA, 25 bp, Mus musculus
acgatcgcgctggtatagttgccca

SEQ ID NO: 398755 - DNA, 25 bp, Mus musculus
ggaccgttggacagatgcacccact

SEQ ID NO: 398756 - DNA, 25 bp, Mus musculus
atcagcgtgagggtgtacgattcct

SEQ ID NO: 398757 - DNA, 25 bp, Mus musculus
tgtgtggtcacacgaccttttcctc

SEQ ID NO: 398758 - DNA, 25 bp, Mus musculus
cgcacccaatcagcggcgaggggct

SEQ ID NO: 398759 - DNA, 25 bp, Mus musculus
aaggggagccgaactctgcgcgacc

SEQ ID NO: 398760 - DNA, 25 bp, Mus musculus
ctgcctgggtcttgtgattcgtccc

SEQ ID NO: 398761 - DNA, 25 bp, Mus musculus
gcagcctctccctgggctttgagga

SEQ ID NO: 398762 - DNA, 25 bp, Mus musculus
ccctcaaggtagaggtcggaggtca

SEQ ID NO: 398763 - DNA, 25 bp, Mus musculus
cagggctgccagagccctcaaggta

SEQ ID NO: 398764 - DNA, 25 bp, Mus musculus
cagaggcccgggtactggacagcct

SEQ ID NO: 398765 - DNA, 25 bp, Mus musculus
ctcccgctgttagagctagcctctg

SEQ ID NO: 398766 - DNA, 25 bp, Mus musculus
cctttggttcactcccgctgttaga

SEQ ID NO: 398767 - DNA, 25 bp, Mus musculus
ggccgagtgctttccctttggttca

SEQ ID NO: 398768 - DNA, 25 bp, Mus musculus
gccaggatgtttcttacggccaaca

SEQ ID NO: 398769 - DNA, 25 bp, Mus musculus
gctaaggaagcgcttccgcctggga

SEQ ID NO: 398770 - DNA, 25 bp, Mus musculus
aggggctggactacagaactccgcc

SEQ ID NO: 398771 - DNA, 25 bp, Mus musculus
ccctagttgcaattgctaaggaagc

SEQ ID NO: 398772 - DNA, 25 bp, Mus musculus
agtctagcaggttcctagggttgcc

SEQ ID NO: 398773 - DNA, 25 bp, Mus musculus
tggagacgatcacgattgagtagga

SEQ ID NO: 398774 - DNA, 25 bp, Mus musculus
gatcacgattgagtaggagcacaca

SEQ ID NO: 398775 - DNA, 25 bp, Mus musculus
taggagcacacaggcgcactcactg

SEQ ID NO: 398776 - DNA, 25 bp, Mus musculus
gcactcactgccttcctccttccct

SEQ ID NO: 398777 - DNA, 25 bp, Mus musculus
ccctggtccctaggggaggtctgca

SEQ ID NO: 398778 - DNA, 25 bp, Mus musculus
cggggccgctcagcctttgtctcgg

SEQ ID NO: 398779 - DNA, 25 bp, Mus musculus
cgcatccgggcccagtgcagcgtaa

SEQ ID NO: 398780 - DNA, 25 bp, Mus musculus
cgggcccagtgcagcgtaagtgacc

SEQ ID NO: 398781 - DNA, 25 bp, Mus musculus
gacgtgcggcttgggtgcaaatcct

SEQ ID NO: 398782 - DNA, 25 bp, Mus musculus
ggcttgggtgcaaatcctgtttctc

SEQ ID NO: 398783 - DNA, 25 bp, Mus musculus
aatcctgtttctccgggcagaggcc

SEQ ID NO: 398784 - DNA, 25 bp, Mus musculus
tgcgaggacctgcagtcatggaaaa

SEQ ID NO: 398785 - DNA, 25 bp, Mus musculus
caggttcctagggttgcccgcagac

SEQ ID NO: 398786 - DNA, 25 bp, Mus musculus
gaagctcggagaaacgcctcccgga

SEQ ID NO: 398787 - DNA, 25 bp, Mus musculus
agtagacggactcacagccgggccc

SEQ ID NO: 398788 - DNA, 25 bp, Mus musculus
cccagcggcacacctggcccagtca

SEQ ID NO: 398789 - DNA, 25 bp, Mus musculus
ccggaccgaccagtagacggactca

SEQ ID NO: 398790 - DNA, 25 bp, Mus musculus
ggtggaagctcggagaaacgcctcc

SEQ ID NO: 398791 - DNA, 25 bp, Mus musculus
cacagctgcgttggtcaggtggaag

SEQ ID NO: 398792 - DNA, 25 bp, Mus musculus
catgttggctactgcacagctgcgt

SEQ ID NO: 398793 - DNA, 25 bp, Mus musculus
ttctcgaccgtccactccatgttgg

SEQ ID NO: 398794 - DNA, 25 bp, Mus musculus
aggaagcgccgccttgtcttctcga

SEQ ID NO: 398795 - DNA, 25 bp, Mus musculus
cttctcacccgcgtagcgcagccgt

SEQ ID NO: 398796 - DNA, 25 bp, Mus musculus
gcacccgccgctccaacaagccgcc

SEQ ID NO: 398797 - DNA, 25 bp, Mus musculus
cccgtcaaagccgatcgcgcacccg

SEQ ID NO: 398798 - DNA, 25 bp, Mus musculus
tggcccagtcatgcaggcacccgcc

SEQ ID NO: 398799 - DNA, 25 bp, Mus musculus
tccactccatgttggctactgcaca

SEQ ID NO: 398800 - DNA, 25 bp, Mus musculus
gtcggccagccataaactctactct

SEQ ID NO: 398801 - DNA, 25 bp, Mus musculus
cctgagctgctatcccaggagttcc

SEQ ID NO: 398802 - DNA, 25 bp, Mus musculus
gtctcctggcgacaaccatggcggg

SEQ ID NO: 398803 - DNA, 25 bp, Mus musculus
acgcttccgccgcagtgccttgtgg

SEQ ID NO: 398804 - DNA, 25 bp, Mus musculus
gcgctgagtgacaccagagtcccgc

SEQ ID NO: 398805 - DNA, 25 bp, Mus musculus
ataaactctactctctgggaaaagc

SEQ ID NO: 398806 - DNA, 25 bp, Mus musculus
cgtcagccgagtcggccagccataa

SEQ ID NO: 398807 - DNA, 25 bp, Mus musculus
tcgtcctcttggctgaggtgcgtca

SEQ ID NO: 398808 - DNA, 25 bp, Mus musculus
ggcaggactctgctccgctctcagt

SEQ ID NO: 398809 - DNA, 25 bp, Mus musculus
ttagcctccggtgctttcggcgcag

SEQ ID NO: 398810 - DNA, 25 bp, Mus musculus
cagctcgcgttgcttagcctccggt

SEQ ID NO: 398811 - DNA, 25 bp, Mus musculus
accaatggcggccagctcgcgttgc

SEQ ID NO: 398812 - DNA, 25 bp, Mus musculus
tctcagtcccagttcgtcctcttgg

SEQ ID NO: 398813 - DNA, 25 bp, Mus musculus
tctctgggaaaagcatcgcgtctcg

SEQ ID NO: 398814 - DNA, 25 bp, Mus musculus
ggctctcgacgcgtcctagggcagc

SEQ ID NO: 398815 - DNA, 25 bp, Mus musculus
cgcagtagtactcgcgcggtggggc

SEQ ID NO: 398816 - DNA, 25 bp, Mus musculus
cctgggcggccgcagtagtactcgc

SEQ ID NO: 398817 - DNA, 25 bp, Mus musculus
tggcgatccttgtgtcccaagcagg

SEQ ID NO: 398818 - DNA, 25 bp, Mus musculus
tcgacgcgtcctagggcagcggtct

SEQ ID NO: 398819 - DNA, 25 bp, Mus musculus
gagccaggcgcggtagcgagcgccc

SEQ ID NO: 398820 - DNA, 25 bp, Mus musculus
cccgccgagtcatttgaccatataa

SEQ ID NO: 398821 - DNA, 25 bp, Mus musculus
atataaggacacacgcgcccgggcg

SEQ ID NO: 398822 - DNA, 25 bp, Mus musculus
tctaagggaacccagcggactgtgg

SEQ ID NO: 398823 - DNA, 25 bp, Mus musculus
cacaggctctcgacgcgtcctaggg

SEQ ID NO: 398824 - DNA, 25 bp, Mus musculus
cgagtcatttgaccatataaggaca

SEQ ID NO: 398825 - DNA, 25 bp, Mus musculus
cgccgagtcatttgaccatataagg

SEQ ID NO: 398826 - DNA, 25 bp, Mus musculus
taagggaacccagcggactgtggac

SEQ ID NO: 398827 - DNA, 25 bp, Mus musculus
tctggtggcgatccttgtgtcccaa

SEQ ID NO: 398828 - DNA, 25 bp, Mus musculus
atggccggggagaacttccagtatt

SEQ ID NO: 398829 - DNA, 25 bp, Mus musculus
tcggatacacacaccttcctgcgag

SEQ ID NO: 398830 - DNA, 25 bp, Mus musculus
aaagccctcgggaacactagcagcc

SEQ ID NO: 398831 - DNA, 25 bp, Mus musculus
gcctgggaagaatagcctgggatct

SEQ ID NO: 398832 - DNA, 25 bp, Mus musculus
aatagcctgggatctgagggccaca

SEQ ID NO: 398833 - DNA, 25 bp, Mus musculus
atctgagggccacagcgctaggaag

SEQ ID NO: 398834 - DNA, 25 bp, Mus musculus
ggagaacttccagtatttagaacta

SEQ ID NO: 398835 - DNA, 25 bp, Mus musculus
tttagaactattcgtgatccggcac

SEQ ID NO: 398836 - DNA, 25 bp, Mus musculus
ttcgtgatccggcacaaagctgctg

SEQ ID NO: 398837 - DNA, 25 bp, Mus musculus
ccggcacaaagctgctgtcacgttc

SEQ ID NO: 398838 - DNA, 25 bp, Mus musculus
ttgcctcggcgcagggcgcttttgt

SEQ ID NO: 398839 - DNA, 25 bp, Mus musculus
ccgggtccaattgcgtccgcttggt

SEQ ID NO: 398840 - DNA, 25 bp, Mus musculus
agggcgcttttgtgcctggttcctt

SEQ ID NO: 398841 - DNA, 25 bp, Mus musculus
tcacgttccataaaggaggtccttg

SEQ ID NO: 398842 - DNA, 25 bp, Mus musculus
caacgccaagcactgatgcggagta

SEQ ID NO: 398843 - DNA, 25 bp, Mus musculus
tcaacgggcagatcggctggttccc

SEQ ID NO: 398844 - DNA, 25 bp, Mus musculus
gcgtggcagcttcaacgggcagatc

SEQ ID NO: 398845 - DNA, 25 bp, Mus musculus
ctccaactacgttttggaggaagcg

SEQ ID NO: 398846 - DNA, 25 bp, Mus musculus
aagccaagcgctcgggatgcttccc

SEQ ID NO: 398847 - DNA, 25 bp, Mus musculus
tgcggagtacccagccaatggcagc

SEQ ID NO: 398848 - DNA, 25 bp, Mus musculus
ggtgctgaccgcatctatgacctca

SEQ ID NO: 398849 - DNA, 25 bp, Mus musculus
tatgacctcaacatcccagcctttg

SEQ ID NO: 398850 - DNA, 25 bp, Mus musculus
agcctttgtcaagttcgcctacgta

SEQ ID NO: 398851 - DNA, 25 bp, Mus musculus
ttcgcctacgtagcagaacgagagg

SEQ ID NO: 398852 - DNA, 25 bp, Mus musculus
cagaacgagaggatgagctgtccct

SEQ ID NO: 398853 - DNA, 25 bp, Mus musculus
gaagggctcccgtgtcacagttatg

SEQ ID NO: 398854 - DNA, 25 bp, Mus musculus
ccgtgtcacagttatggagaaatgc

SEQ ID NO: 398855 - DNA, 25 bp, Mus musculus
cggaaagacgcgcaggaagccaagc

SEQ ID NO: 398856 - DNA, 25 bp, Mus musculus
agaagcttcatcctcctgcggttga

SEQ ID NO: 398857 - DNA, 25 bp, Mus musculus
gcgcgatgccgagcagaagcttcat

SEQ ID NO: 398858 - DNA, 25 bp, Mus musculus
gttcttagtcctacacggccggctg

SEQ ID NO: 398859 - DNA, 25 bp, Mus musculus
cggatctcggaagttcgcctgcaac

SEQ ID NO: 398860 - DNA, 25 bp, Mus musculus
cccttttcgctgctggggtagcgtt

SEQ ID NO: 398861 - DNA, 25 bp, Mus musculus
aatcaaccagggatgggtgggcaca

SEQ ID NO: 398862 - DNA, 25 bp, Mus musculus
ctgagttttcaggatggtgtcaatc

SEQ ID NO: 398863 - DNA, 25 bp, Mus musculus
cctcctgcggttgactgaagagaca

SEQ ID NO: 398864 - DNA, 25 bp, Mus musculus
gccgagtccgcagtgtctacagctc

SEQ ID NO: 398865 - DNA, 25 bp, Mus musculus
ttcagcctcgtggaagctgtgaacc

SEQ ID NO: 398866 - DNA, 25 bp, Mus musculus
agcggctccacagcacaagttcagc

SEQ ID NO: 398867 - DNA, 25 bp, Mus musculus
cccgcaagcgcagtgtaatccctga

SEQ ID NO: 398868 - DNA, 25 bp, Mus musculus
ctacagctcggggaacgtgtccacc

SEQ ID NO: 398869 - DNA, 25 bp, Mus musculus
aagcaaagcggccagcggctccaca

SEQ ID NO: 398870 - DNA, 25 bp, Mus musculus
cctgttgacaactctgtatgctatc

SEQ ID NO: 398871 - DNA, 25 bp, Mus musculus
ggccagcgccatgtcaccaggtcga

SEQ ID NO: 398872 - DNA, 25 bp, Mus musculus
gctaacgcctctatgtgtcttaata

SEQ ID NO: 398873 - DNA, 25 bp, Mus musculus
tatgttgctcaacaagtacttgtca

SEQ ID NO: 398874 - DNA, 25 bp, Mus musculus
caagtacttgtcagtatcacctgca

SEQ ID NO: 398875 - DNA, 25 bp, Mus musculus
tgtcagtatcacctgcaaatggttc

SEQ ID NO: 398876 - DNA, 25 bp, Mus musculus
tggcagcgatcttggccagcgccat

SEQ ID NO: 398877 - DNA, 25 bp, Mus musculus
tcaagtcagcctgttgacaactctg

SEQ ID NO: 398878 - DNA, 25 bp, Mus musculus
ggtgggagctaacgcctctatgtgt

SEQ ID NO: 398879 - DNA, 25 bp, Mus musculus
gtatgctatcacaggaaatcctaga

SEQ ID NO: 398880 - DNA, 25 bp, Mus musculus
ggaaatcctagaaacaacacctcag

SEQ ID NO: 398881 - DNA, 25 bp, Mus musculus
gaaacaacacctcaggtagcagggg

SEQ ID NO: 398882 - DNA, 25 bp, Mus musculus
tgcaaatggttctcaagtcagcctg

SEQ ID NO: 398883 - DNA, 25 bp, Mus musculus
tctatgtgtcttaatatgttgctca

SEQ ID NO: 398884 - DNA, 25 bp, Mus musculus
cattccctcgtcgtgactcgtagcg

SEQ ID NO: 398885 - DNA, 25 bp, Mus musculus
agacttccgcgctcgactttacagg

SEQ ID NO: 398886 - DNA, 25 bp, Mus musculus
gtccgcagcgggttaagccaacctc

SEQ ID NO: 398887 - DNA, 25 bp, Mus musculus
tctcgctgcttctcacggagagtga

SEQ ID NO: 398888 - DNA, 25 bp, Mus musculus
gctctgcagcctgggtaacattccc

SEQ ID NO: 398889 - DNA, 25 bp, Mus musculus
agcggcgccgttagcttacgttgaa

SEQ ID NO: 398890 - DNA, 25 bp, Mus musculus
gggccgctaaatctgagacttccgc

SEQ ID NO: 398891 - DNA, 25 bp, Mus musculus
gattggctagacacctctgaccgca

SEQ ID NO: 398892 - DNA, 25 bp, Mus musculus
tctgaccgcacacgattgggtactg

SEQ ID NO: 398893 - DNA, 25 bp, Mus musculus
tggcagtttgcctcttcctcgtctg

SEQ ID NO: 398894 - DNA, 25 bp, Mus musculus
gtctgtcctccagcttgcgtccatg

SEQ ID NO: 398895 - DNA, 25 bp, Mus musculus
cctgtgccgctacccggagtatgac

SEQ ID NO: 398896 - DNA, 25 bp, Mus musculus
gttccctgtccacacaaaagcggtg

SEQ ID NO: 398897 - DNA, 25 bp, Mus musculus
tgacagctcggaaggcaagaacctc

SEQ ID NO: 398898 - DNA, 25 bp, Mus musculus
cgggagctctctcttacgtaacgca

SEQ ID NO: 398899 - DNA, 25 bp, Mus musculus
atcccaacagactggacagcagcac

SEQ ID NO: 398900 - DNA, 25 bp, Mus musculus
ccgtcagacgcgcaggtaacaggag

SEQ ID NO: 398901 - DNA, 25 bp, Mus musculus
cgcgcaggtaacaggagccctagaa

SEQ ID NO: 398902 - DNA, 25 bp, Mus musculus
caggagccctagaaatagcaatccc

SEQ ID NO: 398903 - DNA, 25 bp, Mus musculus
tagaaatagcaatcccaacagactg

SEQ ID NO: 398904 - DNA, 25 bp, Mus musculus
tcttccgctccgtctctgctagaga

SEQ ID NO: 398905 - DNA, 25 bp, Mus musculus
tctctgctagagatgtcccttccgc

SEQ ID NO: 398906 - DNA, 25 bp, Mus musculus
ctttcattggctgtccgggagctct

SEQ ID NO: 398907 - DNA, 25 bp, Mus musculus
cttacgtaacgcatcctcatttgta

SEQ ID NO: 398908 - DNA, 25 bp, Mus musculus
catcctcatttgtaaacgtggcgtc

SEQ ID NO: 398909 - DNA, 25 bp, Mus musculus
tgtaaacgtggcgtcaaagcctcca

SEQ ID NO: 398910 - DNA, 25 bp, Mus musculus
acgtggcgtcaaagcctccagggag

SEQ ID NO: 398911 - DNA, 25 bp, Mus musculus
ccaagctttcattggctgtccggga

SEQ ID NO: 398912 - DNA, 25 bp, Mus musculus
attttcttgtcgctgccttggcttc

SEQ ID NO: 398913 - DNA, 25 bp, Mus musculus
ccttggcttcttccggtctgatcag

SEQ ID NO: 398914 - DNA, 25 bp, Mus musculus
ctttgcatttcaggcgggtacgatt

SEQ ID NO: 398915 - DNA, 25 bp, Mus musculus
gccgtgaattctttatccctttgca

SEQ ID NO: 398916 - DNA, 25 bp, Mus musculus
tcagcccatcggaagacacggagtc

SEQ ID NO: 398917 - DNA, 25 bp, Mus musculus
atcgccggggtcgaccaaccatacg

SEQ ID NO: 398918 - DNA, 25 bp, Mus musculus
cgcgcgaacaaaactgtgagttcta

SEQ ID NO: 398919 - DNA, 25 bp, Mus musculus
ccgagcgcgggaaaggattttcttg

SEQ ID NO: 398920 - DNA, 25 bp, Mus musculus
ccaacagctcgtgagagtcgccgcg

SEQ ID NO: 398921 - DNA, 25 bp, Mus musculus
tcctcggcaaaacagaccgtcggcg

SEQ ID NO: 398922 - DNA, 25 bp, Mus musculus
gccctcactctcttcagggagcgaa

SEQ ID NO: 398923 - DNA, 25 bp, Mus musculus
agagagttttctgccggcttttagc

SEQ ID NO: 398924 - DNA, 25 bp, Mus musculus
tcctgaagccggagtctgtatgctg

SEQ ID NO: 398925 - DNA, 25 bp, Mus musculus
cgcttaccagcgaacgcacgagtga

SEQ ID NO: 398926 - DNA, 25 bp, Mus musculus
gcgtgggatttacgtgtcaagtgtc

SEQ ID NO: 398927 - DNA, 25 bp, Mus musculus
gtcaagtgtcaacgcgggaatccca

SEQ ID NO: 398928 - DNA, 25 bp, Mus musculus
accctcgcgttcacttggaagccaa

SEQ ID NO: 398929 - DNA, 25 bp, Mus musculus
ggaagccaagaggtttcatcgtttg

SEQ ID NO: 398930 - DNA, 25 bp, Mus musculus
tcatcgtttggtcagcgggagaaat

SEQ ID NO: 398931 - DNA, 25 bp, Mus musculus
ggagaaatcactcgcgaccggagga

SEQ ID NO: 398932 - DNA, 25 bp, Mus musculus
ggtgctgcttctcagtacttttagg

SEQ ID NO: 398933 - DNA, 25 bp, Mus musculus
agtactggggctgaaacctttctgc

SEQ ID NO: 398934 - DNA, 25 bp, Mus musculus
attccgctgttctttcgggagaccg

SEQ ID NO: 398935 - DNA, 25 bp, Mus musculus
gtgttcctccttcaagccctggtga

SEQ ID NO: 398936 - DNA, 25 bp, Mus musculus
tgcggggcgcgtcctttatcctaac

SEQ ID NO: 398937 - DNA, 25 bp, Mus musculus
ccgtgggtatccttcaaggcggctc

SEQ ID NO: 398938 - DNA, 25 bp, Mus musculus
cacacactgacttcgggagtgctcg

SEQ ID NO: 398939 - DNA, 25 bp, Mus musculus
tacttttaggcgtgccagtactggg

SEQ ID NO: 398940 - DNA, 25 bp, Mus musculus
ccctctacaagccagggtaggaagc

SEQ ID NO: 398941 - DNA, 25 bp, Mus musculus
gactgggccgcagatactttaaagc

SEQ ID NO: 398942 - DNA, 25 bp, Mus musculus
ctcgctttgtttgggtcgctgtaaa

SEQ ID NO: 398943 - DNA, 25 bp, Mus musculus
cttcctccagcttggtctcgctttg

SEQ ID NO: 398944 - DNA, 25 bp, Mus musculus
actaggcgacccgagagccaacttc

SEQ ID NO: 398945 - DNA, 25 bp, Mus musculus
aggcatcgctgggtcaactaggcga

SEQ ID NO: 398946 - DNA, 25 bp, Mus musculus
aggctgctcagcaaaaggaggcatc

SEQ ID NO: 398947 - DNA, 25 bp, Mus musculus
ccctcgacccaaggaggaacttctg

SEQ ID NO: 398948 - DNA, 25 bp, Mus musculus
ttataggttgcgcagattccgaccc

SEQ ID NO: 398949 - DNA, 25 bp, Mus musculus
tcctgtgggatacgaacacgcgatc

SEQ ID NO: 398950 - DNA, 25 bp, Mus musculus
gagcccagtgcctttcgaacctgca

SEQ ID NO: 398951 - DNA, 25 bp, Mus musculus
caccagtttgggcttcagcggatta

SEQ ID NO: 398952 - DNA, 25 bp, Mus musculus
cacacagagccggagttttcttctg

SEQ ID NO: 398953 - DNA, 25 bp, Mus musculus
tctgtgggcactgaaagagggacct

SEQ ID NO: 398954 - DNA, 25 bp, Mus musculus
taatccggccggtgctcggtgcttc

SEQ ID NO: 398955 - DNA, 25 bp, Mus musculus
tggattccaagtatgcagtaggctg

SEQ ID NO: 398956 - DNA, 25 bp, Mus musculus
ccgtgttctccgtggattccaagta

SEQ ID NO: 398957 - DNA, 25 bp, Mus musculus
gcagcgcatggaccgacccggagct

SEQ ID NO: 398958 - DNA, 25 bp, Mus musculus
tgaacttcaggagggccgtgttctc

SEQ ID NO: 398959 - DNA, 25 bp, Mus musculus
cagccggctgaacttcaggagggcc

SEQ ID NO: 398960 - DNA, 25 bp, Mus musculus
cggtgctcggtgcttcctgcgcctg

SEQ ID NO: 398961 - DNA, 25 bp, Mus musculus
gcgtggagccgaccatagagtctcc

SEQ ID NO: 398962 - DNA, 25 bp, Mus musculus
ccgaccatagagtctccaggctaga

SEQ ID NO: 398963 - DNA, 25 bp, Mus musculus
ccatagagtctccaggctagagagg

SEQ ID NO: 398964 - DNA, 25 bp, Mus musculus
gccagtcggcctatgaaggaagttc

SEQ ID NO: 398965 - DNA, 25 bp, Mus musculus
cggcctatgaaggaagttcgtaatc

SEQ ID NO: 398966 - DNA, 25 bp, Mus musculus
gaagttcgtaatccggccggtgctc

SEQ ID NO: 398967 - DNA, 25 bp, Mus musculus
tatgcagtaggctgcgggtcaacag

SEQ ID NO: 398968 - DNA, 25 bp, Mus musculus
ctctgagagagtcccgactgaccca

SEQ ID NO: 398969 - DNA, 25 bp, Mus musculus
cggactgcgctctcagggaacctcg

SEQ ID NO: 398970 - DNA, 25 bp, Mus musculus
tctcagctctgagagagtcccgact

SEQ ID NO: 398971 - DNA, 25 bp, Mus musculus
agagagtcccgactgacccaccgag

SEQ ID NO: 398972 - DNA, 25 bp, Mus musculus
ccaccgagctgtcaagcggcgaaca

SEQ ID NO: 398973 - DNA, 25 bp, Mus musculus
cggcgaacaactctggtctctgggt

SEQ ID NO: 398974 - DNA, 25 bp, Mus musculus
aacaactctggtctctgggtcctga

SEQ ID NO: 398975 - DNA, 25 bp, Mus musculus
aactctggtctctgggtcctgagtc

SEQ ID NO: 398976 - DNA, 25 bp, Mus musculus
gtctctgggtcctgagtccctcagt

SEQ ID NO: 398977 - DNA, 25 bp, Mus musculus
gtcctgagtccctcagtcgcgattc

SEQ ID NO: 398978 - DNA, 25 bp, Mus musculus
ctcagtcgcgattcccgccggccct

SEQ ID NO: 398979 - DNA, 25 bp, Mus musculus
caagtccttgccgccatgagcagca

SEQ ID NO: 398980 - DNA, 25 bp, Mus musculus
actgacccaccgagctgtcaagcgg

SEQ ID NO: 398981 - DNA, 25 bp, Mus musculus
aggagcagtgcggactgcgctctca

SEQ ID NO: 398982 - DNA, 25 bp, Mus musculus
tcacttcgcggacgcgcctggcgta

SEQ ID NO: 398983 - DNA, 25 bp, Mus musculus
gagtgccgtgtgcatctcctctccg

SEQ ID NO: 398984 - DNA, 25 bp, Mus musculus
ccggctgcacccagtcgtgtattct

SEQ ID NO: 398985 - DNA, 25 bp, Mus musculus
cgtgtattctccaaagccgcctgcg

SEQ ID NO: 398986 - DNA, 25 bp, Mus musculus
cgctatctgcgtcgcggagcctagc

SEQ ID NO: 398987 - DNA, 25 bp, Mus musculus
agcctagcgcgagagccggcgctct

SEQ ID NO: 398988 - DNA, 25 bp, Mus musculus
agttacctcacactcgagtgccgtg

SEQ ID NO: 398989 - DNA, 25 bp, Mus musculus
ttcagccattcacttcgcggacgcg

SEQ ID NO: 398990 - DNA, 25 bp, Mus musculus
tgcagcagctgcgaacacacgcgtc

SEQ ID NO: 398991 - DNA, 25 bp, Mus musculus
gagctacaccgactggcggcaactg

SEQ ID NO: 398992 - DNA, 25 bp, Mus musculus
ggcggcaactggaagaaattagatc

SEQ ID NO: 398993 - DNA, 25 bp, Mus musculus
aaattagatctacgcaaattgcgga

SEQ ID NO: 398994 - DNA, 25 bp, Mus musculus
cgcaaattgcggagctctgtagctc

SEQ ID NO: 398995 - DNA, 25 bp, Mus musculus
accggcagcgttcagccattcactt

SEQ ID NO: 398996 - DNA, 25 bp, Mus musculus
gctctcctttggtcgcagtatcacc

SEQ ID NO: 398997 - DNA, 25 bp, Mus musculus
tccagctggaagacaaggccaccca

SEQ ID NO: 398998 - DNA, 25 bp, Mus musculus
gagcctggacctcgcacacagtagg

SEQ ID NO: 398999 - DNA, 25 bp, Mus musculus
gacccactcgggttagagcctagag

SEQ ID NO: 399000 - DNA, 25 bp, Mus musculus
agcctagagaactagcccatctgtg

SEQ ID NO: 399001 - DNA, 25 bp, Mus musculus
taaggacctgctgcttcccaaacgc

SEQ ID NO: 399002 - DNA, 25 bp, Mus musculus
ttatggcagcagctccttgcatcgg

SEQ ID NO: 399003 - DNA, 25 bp, Mus musculus
tgttgctgaaactccggagatcatg

SEQ ID NO: 399004 - DNA, 25 bp, Mus musculus
tgcgatcccgtgttcttcagaagcc

SEQ ID NO: 399005 - DNA, 25 bp, Mus musculus
tgctgcagagttgcgcgaagtagtc

SEQ ID NO: 399006 - DNA, 25 bp, Mus musculus
cggcagtgcagcagctggacacttt

SEQ ID NO: 399007 - DNA, 25 bp, Mus musculus
tggacactttgcgagggcttctgct

SEQ ID NO: 399008 - DNA, 25 bp, Mus musculus
tgcccgtgacgctgcttatcatagc

SEQ ID NO: 399009 - DNA, 25 bp, Mus musculus
gcccggtcactggatgttgctgaaa

SEQ ID NO: 399010 - DNA, 25 bp, Mus musculus
ggaacacagcgccactgagctcgca

SEQ ID NO: 399011 - DNA, 25 bp, Mus musculus
ctccgtcccaggctcagggaaggta

SEQ ID NO: 399012 - DNA, 25 bp, Mus musculus
aaagggatcaggagacggccctgcc

SEQ ID NO: 399013 - DNA, 25 bp, Mus musculus
ctgccgcctccgctaagggaaaagg

SEQ ID NO: 399014 - DNA, 25 bp, Mus musculus
cggcgagcaaaccagcgtgcgcact

SEQ ID NO: 399015 - DNA, 25 bp, Mus musculus
agcaaaacggcaaggctgttcacca

SEQ ID NO: 399016 - DNA, 25 bp, Mus musculus
ggcaaggctgttcaccaaccgcgca

SEQ ID NO: 399017 - DNA, 25 bp, Mus musculus
cgcgtcccaagcagcaactggcgaa

SEQ ID NO: 399018 - DNA, 25 bp, Mus musculus
agcaactggcgaacgctccctcagg

SEQ ID NO: 399019 - DNA, 25 bp, Mus musculus
tagcacgcctctggggcggaacaca

SEQ ID NO: 399020 - DNA, 25 bp, Mus musculus
gaacgctccctcaggccggctttat

SEQ ID NO: 399021 - DNA, 25 bp, Mus musculus
tcaggccggctttattaagccgcgc

SEQ ID NO: 399022 - DNA, 25 bp, Mus musculus
cttgtggcgtcacgcgacgtcacca

SEQ ID NO: 399023 - DNA, 25 bp, Mus musculus
cagggaaggtacgtgacagcaaaac

SEQ ID NO: 399024 - DNA, 25 bp, Mus musculus
ctcagccgaccgtgcgttcagtgca

SEQ ID NO: 399025 - DNA, 25 bp, Mus musculus
agctgcactcgcagggcgatccatc

SEQ ID NO: 399026 - DNA, 25 bp, Mus musculus
cttcccacaggaagccataagcttg

SEQ ID NO: 399027 - DNA, 25 bp, Mus musculus
taagcttgtccttccatagaacctg

SEQ ID NO: 399028 - DNA, 25 bp, Mus musculus
ccagtgcccgtaggtaggaagccaa

SEQ ID NO: 399029 - DNA, 25 bp, Mus musculus
ggaaagcgcactggcccttcacctt

SEQ ID NO: 399030 - DNA, 25 bp, Mus musculus
gatgcagagccgaacagctgcaaga

SEQ ID NO: 399031 - DNA, 25 bp, Mus musculus
tccgcgaactgcagaccagagatgc

SEQ ID NO: 399032 - DNA, 25 bp, Mus musculus
tggccactgcatgatccgcgaactg

SEQ ID NO: 399033 - DNA, 25 bp, Mus musculus
gcggggacacccaggaaagcgcact

SEQ ID NO: 399034 - DNA, 25 bp, Mus musculus
tgccacagttgctgccggggatccc

SEQ ID NO: 399035 - DNA, 25 bp, Mus musculus
gagtgcagcgtacctcgcccggcaa

SEQ ID NO: 399036 - DNA, 25 bp, Mus musculus
ctgatgacccgggattgcaggctgc

SEQ ID NO: 399037 - DNA, 25 bp, Mus musculus
ggtaggaagccaataacacaaagtg

SEQ ID NO: 399038 - DNA, 25 bp, Mus musculus
cgtggaccaagaaggcgtcagctgc

SEQ ID NO: 399039 - DNA, 25 bp, Mus musculus
cacccgatacagagacccgcggaga

SEQ ID NO: 399040 - DNA, 25 bp, Mus musculus
tcgtagatccagtcggcaaaacgcc

SEQ ID NO: 399041 - DNA, 25 bp, Mus musculus
tccgcgtccgctgctttggcatttt

SEQ ID NO: 399042 - DNA, 25 bp, Mus musculus
ggacggactgagtcaccagaccctg

SEQ ID NO: 399043 - DNA, 25 bp, Mus musculus
agctgccagccgcttgggcaagcct

SEQ ID NO: 399044 - DNA, 25 bp, Mus musculus
agagggcggagtccaacccagctga

SEQ ID NO: 399045 - DNA, 25 bp, Mus musculus
attggcatctttcttcggagggcgc

SEQ ID NO: 399046 - DNA, 25 bp, Mus musculus
ctgccgctgtgtgagcgtcttctgc

SEQ ID NO: 399047 - DNA, 25 bp, Mus musculus
atgcaccgccgccagtcattgggtg

SEQ ID NO: 399048 - DNA, 25 bp, Mus musculus
cgacaccgacacaggcaggggcttc

SEQ ID NO: 399049 - DNA, 25 bp, Mus musculus
ttggcattttagacaccagccggga

SEQ ID NO: 399050 - DNA, 25 bp, Mus musculus
ggcaagcctcgcgttgtttggttaa

SEQ ID NO: 399051 - DNA, 25 bp, Mus musculus
tggagatgaagtggcctcgtagatc

SEQ ID NO: 399052 - DNA, 25 bp, Mus musculus
agccttgggtgtatgcggaagccca

SEQ ID NO: 399053 - DNA, 25 bp, Mus musculus
ggccctcacgttctctgagagcctg

SEQ ID NO: 399054 - DNA, 25 bp, Mus musculus
gctcaacgaggccacccgagggtca

SEQ ID NO: 399055 - DNA, 25 bp, Mus musculus
tgcatgtcaccacggcaagccttgg

SEQ ID NO: 399056 - DNA, 25 bp, Mus musculus
cccaagatactgcatgtcaccacgg

SEQ ID NO: 399057 - DNA, 25 bp, Mus musculus
gagggctgcgcacccaagatactgc

SEQ ID NO: 399058 - DNA, 25 bp, Mus musculus
cccatatcaggatgcggctagaccg

SEQ ID NO: 399059 - DNA, 25 bp, Mus musculus
cgcatcgtgcccgtggctcaacgag

SEQ ID NO: 399060 - DNA, 25 bp, Mus musculus
ctgccgcggccttagaacgttagac

SEQ ID NO: 399061 - DNA, 25 bp, Mus musculus
cgcggcggatttacgatccagttca

SEQ ID NO: 399062 - DNA, 25 bp, Mus musculus
cgttctctgagagcctggtcacctc

SEQ ID NO: 399063 - DNA, 25 bp, Mus musculus
gccgggccctctatgcgctagtctt

SEQ ID NO: 399064 - DNA, 25 bp, Mus musculus
atgcgctagtcttgctgctcgcctg

SEQ ID NO: 399065 - DNA, 25 bp, Mus musculus
gaacgttagacaggtcagtgcgctg

SEQ ID NO: 399066 - DNA, 25 bp, Mus musculus
ctttccatcgtcctgagtctgcgca

SEQ ID NO: 399067 - DNA, 25 bp, Mus musculus
ttcgatttcctctcaaagcagcagc

SEQ ID NO: 399068 - DNA, 25 bp, Mus musculus
aaagcacgtggtgcggctcttccca

SEQ ID NO: 399069 - DNA, 25 bp, Mus musculus
gctttcgcttttcgatttcctctca

SEQ ID NO: 399070 - DNA, 25 bp, Mus musculus
gccggcattgctttcgcttttcgat

SEQ ID NO: 399071 - DNA, 25 bp, Mus musculus
gcctgccggcattgctttcgctttt

SEQ ID NO: 399072 - DNA, 25 bp, Mus musculus
catcgtcctgagtctgcgcagtccg

SEQ ID NO: 399073 - DNA, 25 bp, Mus musculus
ctgagtctgcgcagtccgcggcgca

SEQ ID NO: 399074 - DNA, 25 bp, Mus musculus
tcccagaaagcacgtggtgcggctc

SEQ ID NO: 399075 - DNA, 25 bp, Mus musculus
acgtggtgcggctcttcccagcagc

SEQ ID NO: 399076 - DNA, 25 bp, Mus musculus
cgcagcgtccctagtggcgagcgca

SEQ ID NO: 399077 - DNA, 25 bp, Mus musculus
agtggcgagcgcagcccttgcagcc

SEQ ID NO: 399078 - DNA, 25 bp, Mus musculus
agcagcttctcggtgccggctgagt

SEQ ID NO: 399079 - DNA, 25 bp, Mus musculus
cggctgagttcccagaaagcacgtg

SEQ ID NO: 399080 - DNA, 25 bp, Mus musculus
atcccgcagagagaacgccaggagc

SEQ ID NO: 399081 - DNA, 25 bp, Mus musculus
cgcggaccaggaaggccaagcagcc

SEQ ID NO: 399082 - DNA, 25 bp, Mus musculus
gcgctgatggaacagccggccaatc

SEQ ID NO: 399083 - DNA, 25 bp, Mus musculus
gccggccaatctctgccgctgattg

SEQ ID NO: 399084 - DNA, 25 bp, Mus musculus
tactttcggttttcagcgccgagtc

SEQ ID NO: 399085 - DNA, 25 bp, Mus musculus
ttcagcgccgagtctgtcaaagctc

SEQ ID NO: 399086 - DNA, 25 bp, Mus musculus
cgagtctgtcaaagctccctggaga

SEQ ID NO: 399087 - DNA, 25 bp, Mus musculus
ctcagacccacttgggacactgctg

SEQ ID NO: 399088 - DNA, 25 bp, Mus musculus
acttgggacactgctgagcggcgca

SEQ ID NO: 399089 - DNA, 25 bp, Mus musculus
agcggcgcagagagatttgcccaga

SEQ ID NO: 399090 - DNA, 25 bp, Mus musculus
gagagatttgcccagactcgagctc

SEQ ID NO: 399091 - DNA, 25 bp, Mus musculus
ctctcctcggacctggggtctgctg

SEQ ID NO: 399092 - DNA, 25 bp, Mus musculus
gtgacctgtcatcccgcagagagaa

SEQ ID NO: 399093 - DNA, 25 bp, Mus musculus
cacaggtgacctgtcatcccgcaga

SEQ ID NO: 399094 - DNA, 25 bp, Mus musculus
ccagctcctgtaggatctccgaggg

SEQ ID NO: 399095 - DNA, 25 bp, Mus musculus
atcacatggcacagccgtcgcaggc

SEQ ID NO: 399096 - DNA, 25 bp, Mus musculus
gacctctcttctgattggctagaga

SEQ ID NO: 399097 - DNA, 25 bp, Mus musculus
gggcggccttaagagcagctcccgt

SEQ ID NO: 399098 - DNA, 25 bp, Mus musculus
gggccgggcctaatcacatggcaca

SEQ ID NO: 399099 - DNA, 25 bp, Mus musculus
gtcgcaggccgcctggcatcgcttt

SEQ ID NO: 399100 - DNA, 25 bp, Mus musculus
ttgccctcgctgttgccgaacgcgt

SEQ ID NO: 399101 - DNA, 25 bp, Mus musculus
atctccgagggcgaactggacaggc

SEQ ID NO: 399102 - DNA, 25 bp, Mus musculus
tcaagggagggctggagacatacca

SEQ ID NO: 399103 - DNA, 25 bp, Mus musculus
cccgctcgtcagatgaggatgcttg

SEQ ID NO: 399104 - DNA, 25 bp, Mus musculus
ctgcagccagccgaagttgctctgg

SEQ ID NO: 399105 - DNA, 25 bp, Mus musculus
gctccgcactgagactgacgctcaa

SEQ ID NO: 399106 - DNA, 25 bp, Mus musculus
gagcagctcccgtagcatcgccgag

SEQ ID NO: 399107 - DNA, 25 bp, Mus musculus
gacataccaggctcaccaaccgggg

SEQ ID NO: 399108 - DNA, 25 bp, Mus musculus
gcttccctgcacctgggtgccaagt

SEQ ID NO: 399109 - DNA, 25 bp, Mus musculus
gcacctgggtgccaagtttctgaaa

SEQ ID NO: 399110 - DNA, 25 bp, Mus musculus
acctgggtgccaagtttctgaaagc

SEQ ID NO: 399111 - DNA, 25 bp, Mus musculus
ttccctgcacctgggtgccaagttt

SEQ ID NO: 399112 - DNA, 25 bp, Mus musculus
tgaaagccacttccaagcaaaactc

SEQ ID NO: 399113 - DNA, 25 bp, Mus musculus
aaagccacttccaagcaaaactctc

SEQ ID NO: 399114 - DNA, 25 bp, Mus musculus
ttccaagcaaaactctccttccgct

SEQ ID NO: 399115 - DNA, 25 bp, Mus musculus
tccttccgctctgaaaacacaacta

SEQ ID NO: 399116 - DNA, 25 bp, Mus musculus
ttccgctctgaaaacacaactacag

SEQ ID NO: 399117 - DNA, 25 bp, Mus musculus
ccgctctgaaaacacaactacagta

SEQ ID NO: 399118 - DNA, 25 bp, Mus musculus
tgccaagtttctgaaagccacttcc

SEQ ID NO: 399119 - DNA, 25 bp, Mus musculus
ctctgaaaacacaactacagtagga

SEQ ID NO: 399120 - DNA, 25 bp, Mus musculus
ctgcacctgggtgccaagtttctga

SEQ ID NO: 399121 - DNA, 25 bp, Mus musculus
gtttctgaaagccacttccaagcaa

SEQ ID NO: 399122 - DNA, 25 bp, Mus musculus
gctcttgctccattcgccgctccgg

SEQ ID NO: 399123 - DNA, 25 bp, Mus musculus
aggcttccgtggatccgcggacagc

SEQ ID NO: 399124 - DNA, 25 bp, Mus musculus
gcttccgtggatccgcggacagcgc

SEQ ID NO: 399125 - DNA, 25 bp, Mus musculus
ccattcccacggcagctgggagaaa

SEQ ID NO: 399126 - DNA, 25 bp, Mus musculus
tggcccattcccacggcagctggga

SEQ ID NO: 399127 - DNA, 25 bp, Mus musculus
ggggtggcccattcccacggcagct

SEQ ID NO: 399128 - DNA, 25 bp, Mus musculus
ccacgcgcggccgagtgacgcagat

SEQ ID NO: 399129 - DNA, 25 bp, Mus musculus
gagattccgctcttgctccattcgc

SEQ ID NO: 399130 - DNA, 25 bp, Mus musculus
cgggagattccgctcttgctccatt

SEQ ID NO: 399131 - DNA, 25 bp, Mus musculus
acatcgggagattccgctcttgctc

SEQ ID NO: 399132 - DNA, 25 bp, Mus musculus
ctgtcacatcgggagattccgctct

SEQ ID NO: 399133 - DNA, 25 bp, Mus musculus
cgcgcgctgtcacatcgggagattc

SEQ ID NO: 399134 - DNA, 25 bp, Mus musculus
ccgagtgacgcagatcccggcgtgg

SEQ ID NO: 399135 - DNA, 25 bp, Mus musculus
ttcccacggcagctgggagaaagcg

SEQ ID NO: 399136 - DNA, 25 bp, Mus musculus
ctctggccgcgatgctgcctaggtt

SEQ ID NO: 399137 - DNA, 25 bp, Mus musculus
ctggaggccactgggagagccgctc

SEQ ID NO: 399138 - DNA, 25 bp, Mus musculus
cagcgatgtcaggtaaccccggctc

SEQ ID NO: 399139 - DNA, 25 bp, Mus musculus
tggctacactgccagcgagcgcggt

SEQ ID NO: 399140 - DNA, 25 bp, Mus musculus
cactgccagcgagcgcggtgcacga

SEQ ID NO: 399141 - DNA, 25 bp, Mus musculus
tcccgctcttggtccgctgcgccac

SEQ ID NO: 399142 - DNA, 25 bp, Mus musculus
gtgcacgacgaggaggcagcgatgt

SEQ ID NO: 399143 - DNA, 25 bp, Mus musculus
gctgcgccacttccgccgctctggc

SEQ ID NO: 399144 - DNA, 25 bp, Mus musculus
tgttttaaactgcccgccaactctg

SEQ ID NO: 399145 - DNA, 25 bp, Mus musculus
gccaactctgcaagctggcccagga

SEQ ID NO: 399146 - DNA, 25 bp, Mus musculus
ctggcccaggagcaagaatcgggaa

SEQ ID NO: 399147 - DNA, 25 bp, Mus musculus
cccaggagcaagaatcgggaaggca

SEQ ID NO: 399148 - DNA, 25 bp, Mus musculus
tcgggaaggcaggtgatcgccccct

SEQ ID NO: 399149 - DNA, 25 bp, Mus musculus
ctccctccgctttcccgctcttggt

SEQ ID NO: 399150 - DNA, 25 bp, Mus musculus
aagaggtgggcgatgccccatcccc

SEQ ID NO: 399151 - DNA, 25 bp, Mus musculus
tcccgactccaattacgtttgcgga

SEQ ID NO: 399152 - DNA, 25 bp, Mus musculus
ccaattacgtttgcggaagtgctgc

SEQ ID NO: 399153 - DNA, 25 bp, Mus musculus
caggccagagcgccgcatgtcggtt

SEQ ID NO: 399154 - DNA, 25 bp, Mus musculus
cccgagatgacaggcggcacccggg

SEQ ID NO: 399155 - DNA, 25 bp, Mus musculus
cggcgccgacccactcacctggagg

SEQ ID NO: 399156 - DNA, 25 bp, Mus musculus
cacctggaggcgctcagctgcgcga

SEQ ID NO: 399157 - DNA, 25 bp, Mus musculus
ggcagcgcctttgttttcccgactc

SEQ ID NO: 399158 - DNA, 25 bp, Mus musculus
ccggctggacccgtttcagggctga

SEQ ID NO: 399159 - DNA, 25 bp, Mus musculus
ctggacccgtttcagggctgagctg

SEQ ID NO: 399160 - DNA, 25 bp, Mus musculus
cccggctgccgtgacatattctaaa

SEQ ID NO: 399161 - DNA, 25 bp, Mus musculus
tattctaaagagtgaagaggtgggc

SEQ ID NO: 399162 - DNA, 25 bp, Mus musculus
ctgccgtgacatattctaaagagtg

SEQ ID NO: 399163 - DNA, 25 bp, Mus musculus
gtccgctcctcctcgccgctttggt

SEQ ID NO: 399164 - DNA, 25 bp, Mus musculus
aggccagtagccttcggccggagac

SEQ ID NO: 399165 - DNA, 25 bp, Mus musculus
ctccagcagtgcagcccagtttctg

SEQ ID NO: 399166 - DNA, 25 bp, Mus musculus
aaacaccggaggtcaccgcagcgaa

SEQ ID NO: 399167 - DNA, 25 bp, Mus musculus
ggcaagccgccaggaaaacaccgga

SEQ ID NO: 399168 - DNA, 25 bp, Mus musculus
gcaatcctcctgtggcgggcacagc

SEQ ID NO: 399169 - DNA, 25 bp, Mus musculus
agcctttcccagagaaacggaagag

SEQ ID NO: 399170 - DNA, 25 bp, Mus musculus
ttacctaagcgaggatgcagagccc

SEQ ID NO: 399171 - DNA, 25 bp, Mus musculus
tcacctgccctctgcagaggcgatg

SEQ ID NO: 399172 - DNA, 25 bp, Mus musculus
aggcctcgatgcagcgacccggtac

SEQ ID NO: 399173 - DNA, 25 bp, Mus musculus
cgagcttagcctctcggttcggggt

SEQ ID NO: 399174 - DNA, 25 bp, Mus musculus
gcgtgatccgcgagcttagcctctc

SEQ ID NO: 399175 - DNA, 25 bp, Mus musculus
ctttcggtggcttctgcagagctaa

SEQ ID NO: 399176 - DNA, 25 bp, Mus musculus
cgattggatttctttcggtggcttc

SEQ ID NO: 399177 - DNA, 25 bp, Mus musculus
cgaaagcaggaaagcggattaccta

SEQ ID NO: 399178 - DNA, 25 bp, Mus musculus
tcgctccctgaaagtggagccaagg

SEQ ID NO: 399179 - DNA, 25 bp, Mus musculus
gcggacgtccttcggcagtggtccc

SEQ ID NO: 399180 - DNA, 25 bp, Mus musculus
aactgctcacgagttcgcggctcgc

SEQ ID NO: 399181 - DNA, 25 bp, Mus musculus
cgggccagctgcaccgccatcgcaa

SEQ ID NO: 399182 - DNA, 25 bp, Mus musculus
acgtccttcggcagtggtcccggct

SEQ ID NO: 399183 - DNA, 25 bp, Mus musculus
cgagttcgcggctcgctccctgaaa

SEQ ID NO: 399184 - DNA, 25 bp, Mus musculus
tctcccctggagtagggcggacgtc

SEQ ID NO: 399185 - DNA, 25 bp, Mus musculus
ccgggcagcagagacaacgtctccc

SEQ ID NO: 399186 - DNA, 25 bp, Mus musculus
aagcctgaaaaggtgcggcatggcc

SEQ ID NO: 399187 - DNA, 25 bp, Mus musculus
ccgaagcctgaaaaggtgcggcatg

SEQ ID NO: 399188 - DNA, 25 bp, Mus musculus
cctcaggaagggagccgaagcctga

SEQ ID NO: 399189 - DNA, 25 bp, Mus musculus
cgggcgcttggctgttctcatgccc

SEQ ID NO: 399190 - DNA, 25 bp, Mus musculus
gccatcgcaagtctgcgcggcctcg

SEQ ID NO: 399191 - DNA, 25 bp, Mus musculus
tcccagaactgctcacgagttcgcg

SEQ ID NO: 399192 - DNA, 25 bp, Mus musculus
gtgacactaccttctagcgcgcatt

SEQ ID NO: 399193 - DNA, 25 bp, Mus musculus
cgcgggaattgtcctgtgaccagcc

SEQ ID NO: 399194 - DNA, 25 bp, Mus musculus
acctactgtggctgccgcgggaatt

SEQ ID NO: 399195 - DNA, 25 bp, Mus musculus
agctctagccagaggacctactgtg

SEQ ID NO: 399196 - DNA, 25 bp, Mus musculus
gggcgcaccagtagctctagccaga

SEQ ID NO: 399197 - DNA, 25 bp, Mus musculus
agccaatcggctgctcgctagagca

SEQ ID NO: 399198 - DNA, 25 bp, Mus musculus
tccttcggaccgaagcacggctgcg

SEQ ID NO: 399199 - DNA, 25 bp, Mus musculus
cctacttcgctggacgtccttcgga

SEQ ID NO: 399200 - DNA, 25 bp, Mus musculus
aaccctgagttgcacggcctacttc

SEQ ID NO: 399201 - DNA, 25 bp, Mus musculus
ctagagctgcggcacggcccagaag

SEQ ID NO: 399202 - DNA, 25 bp, Mus musculus
ggcacgctcgttcgcggtgacacta

SEQ ID NO: 399203 - DNA, 25 bp, Mus musculus
tgtgcaccctaggtgtccgcaggtg

SEQ ID NO: 399204 - DNA, 25 bp, Mus musculus
agcggcaagcactcagcaaaccctg

SEQ ID NO: 399205 - DNA, 25 bp, Mus musculus
ggccggtaagctcgaaggcttccta

SEQ ID NO: 399206 - DNA, 25 bp, Mus musculus
gtcacagacggcgtggtcaacttct

SEQ ID NO: 399207 - DNA, 25 bp, Mus musculus
ggccttgggaactgcttccggcaaa

SEQ ID NO: 399208 - DNA, 25 bp, Mus musculus
accacgagctcgttggcttcccaag

SEQ ID NO: 399209 - DNA, 25 bp, Mus musculus
atcctctcgcctcctgcaggtaggg

SEQ ID NO: 399210 - DNA, 25 bp, Mus musculus
ttccggcaaaagcagggcttccacc

SEQ ID NO: 399211 - DNA, 25 bp, Mus musculus
gacctggtcttagctggagcatcct

SEQ ID NO: 399212 - DNA, 25 bp, Mus musculus
gaggaagcgttctactctcggggac

SEQ ID NO: 399213 - DNA, 25 bp, Mus musculus
acgtccaaaggtgaagcgagtctgg

SEQ ID NO: 399214 - DNA, 25 bp, Mus musculus
aagcttgtggacgtgctcgagaaga

SEQ ID NO: 399215 - DNA, 25 bp, Mus musculus
gacgactttgtcttcacggcgcgca

SEQ ID NO: 399216 - DNA, 25 bp, Mus musculus
ccaaatacgtgctgtgggtggacga

SEQ ID NO: 399217 - DNA, 25 bp, Mus musculus
ctggcggtgtcccaagtaaccacca

SEQ ID NO: 399218 - DNA, 25 bp, Mus musculus
ggtcaacttcttcctggcgcgcaca

SEQ ID NO: 399219 - DNA, 25 bp, Mus musculus
aagtgcgccaagtgggctttgaccc

SEQ ID NO: 399220 - DNA, 25 bp, Mus musculus
tgacggcagcggctttcaatcagga

SEQ ID NO: 399221 - DNA, 25 bp, Mus musculus
cgggaaaacggaaggctcagttctg

SEQ ID NO: 399222 - DNA, 25 bp, Mus musculus
aaggctcagttctgtgcacccgcgc

SEQ ID NO: 399223 - DNA, 25 bp, Mus musculus
gtgcacccgcgccacgtgagagttc

SEQ ID NO: 399224 - DNA, 25 bp, Mus musculus
gtcccgcccgctcggtcgtgattga

SEQ ID NO: 399225 - DNA, 25 bp, Mus musculus
cccagggaaggatgacgtccactcg

SEQ ID NO: 399226 - DNA, 25 bp, Mus musculus
gcggctttcaatcaggaagcttccc

SEQ ID NO: 399227 - DNA, 25 bp, Mus musculus
tgacagccgcgccttccaatggaag

SEQ ID NO: 399228 - DNA, 25 bp, Mus musculus
acccaccgtccatgtctgacaagag

SEQ ID NO: 399229 - DNA, 25 bp, Mus musculus
ggagaaatccgcgtctgcagagaca

SEQ ID NO: 399230 - DNA, 25 bp, Mus musculus
agatggcggtgagctgcccacccgc

SEQ ID NO: 399231 - DNA, 25 bp, Mus musculus
cggagagacccttgccgggcagttt

SEQ ID NO: 399232 - DNA, 25 bp, Mus musculus
catgtctgacaagaggcagtgtctg

SEQ ID NO: 399233 - DNA, 25 bp, Mus musculus
cgccacgtgagagttccagtctgtg

SEQ ID NO: 399234 - DNA, 25 bp, Mus musculus
aaccgcgactgaggaaggaacggca

SEQ ID NO: 399235 - DNA, 25 bp, Mus musculus
actgaggaaggaacggcagccagca

SEQ ID NO: 399236 - DNA, 25 bp, Mus musculus
aggaaggaacggcagccagcagccc

SEQ ID NO: 399237 - DNA, 25 bp, Mus musculus
caggaagcctgggttccactcagga

SEQ ID NO: 399238 - DNA, 25 bp, Mus musculus
gcctgggttccactcaggaatccgc

SEQ ID NO: 399239 - DNA, 25 bp, Mus musculus
ccgaccaatggagtgcgcacactca

SEQ ID NO: 399240 - DNA, 25 bp, Mus musculus
gccaagaaccgcgactgaggaagga

SEQ ID NO: 399241 - DNA, 25 bp, Mus musculus
cgcacgccaagaaccgcgactgagg

SEQ ID NO: 399242 - DNA, 25 bp, Mus musculus
cccactgctgggcatcgcctagccg

SEQ ID NO: 399243 - DNA, 25 bp, Mus musculus
actcggcgtgcgcagtcgatgtgtg

SEQ ID NO: 399244 - DNA, 25 bp, Mus musculus
accttgctgctaagggactcggcgt

SEQ ID NO: 399245 - DNA, 25 bp, Mus musculus
ccacggcaccttgctgctaagggac

SEQ ID NO: 399246 - DNA, 25 bp, Mus musculus
gaggctacagggcacagcggggccc

SEQ ID NO: 399247 - DNA, 25 bp, Mus musculus
caatggagtgcgcacactcacgcct

SEQ ID NO: 399248 - DNA, 25 bp, Mus musculus
tccagtttgtgtcccgttgttacga

SEQ ID NO: 399249 - DNA, 25 bp, Mus musculus
aactggcggattctacttccggtcg

SEQ ID NO: 399250 - DNA, 25 bp, Mus musculus
ctggacagctctaggctctttctga

SEQ ID NO: 399251 - DNA, 25 bp, Mus musculus
aactcaggacctggagaggagagtt

SEQ ID NO: 399252 - DNA, 25 bp, Mus musculus
ctgctgcggaactcaggacctggag

SEQ ID NO: 399253 - DNA, 25 bp, Mus musculus
gccgggatcgctgctgcggaactca

SEQ ID NO: 399254 - DNA, 25 bp, Mus musculus
cgtcgacttgcgggccaggcaacgc

SEQ ID NO: 399255 - DNA, 25 bp, Mus musculus
cgatggcgcatccagtttgtgtccc

SEQ ID NO: 399256 - DNA, 25 bp, Mus musculus
tgtgtcccgttgttacgacaacgag

SEQ ID NO: 399257 - DNA, 25 bp, Mus musculus
gcatccagtttgtgtcccgttgtta

SEQ ID NO: 399258 - DNA, 25 bp, Mus musculus
ggctctttctgagctgagagcttta

SEQ ID NO: 399259 - DNA, 25 bp, Mus musculus
cggattctacttccggtcgtctgca

SEQ ID NO: 399260 - DNA, 25 bp, Mus musculus
agggaaaacactcaacgccagggtg

SEQ ID NO: 399261 - DNA, 25 bp, Mus musculus
gttcgccgctggacagctctaggct

SEQ ID NO: 399262 - DNA, 25 bp, Mus musculus
cgcttcttacagttgaggtttgaaa

SEQ ID NO: 399263 - DNA, 25 bp, Mus musculus
agccacccggaggaccacgtcgaga

SEQ ID NO: 399264 - DNA, 25 bp, Mus musculus
ctacacgggctcacctcgcactctt

SEQ ID NO: 399265 - DNA, 25 bp, Mus musculus
gcccaagagccaatcggagcgatta

SEQ ID NO: 399266 - DNA, 25 bp, Mus musculus
ctctgctgcccaagagccaatcgga

SEQ ID NO: 399267 - DNA, 25 bp, Mus musculus
tgaccgacgcttcttacagttgagg

SEQ ID NO: 399268 - DNA, 25 bp, Mus musculus
acaacggctggtcgccgtcagccag

SEQ ID NO: 399269 - DNA, 25 bp, Mus musculus
cacagacgctgaccgacgcttctta

SEQ ID NO: 399270 - DNA, 25 bp, Mus musculus
tctgggacactgtacttcgacacag

SEQ ID NO: 399271 - DNA, 25 bp, Mus musculus
cggcccacgcgatgaccgcaaagtt

SEQ ID NO: 399272 - DNA, 25 bp, Mus musculus
ccgcgtctgggacactgtacttcga

SEQ ID NO: 399273 - DNA, 25 bp, Mus musculus
caaagtttctcccaggctgctggcc

SEQ ID NO: 399274 - DNA, 25 bp, Mus musculus
ggtttgaaaagtgcagccgcgtctg

SEQ ID NO: 399275 - DNA, 25 bp, Mus musculus
tgaccgcaaagtttctcccaggctg

SEQ ID NO: 399276 - DNA, 25 bp, Mus musculus
ccgcctgcacgtcgggtactcggga

SEQ ID NO: 399277 - DNA, 25 bp, Mus musculus
gcgcttcaggggcagaatgtcaaat

SEQ ID NO: 399278 - DNA, 25 bp, Mus musculus
tcaggggcagaatgtcaaatgcatg

SEQ ID NO: 399279 - DNA, 25 bp, Mus musculus
tcaaatgcatgaccgcaccagggcg

SEQ ID NO: 399280 - DNA, 25 bp, Mus musculus
cgcaagggagcgagacaaagccacc

SEQ ID NO: 399281 - DNA, 25 bp, Mus musculus
ttcggctcgcctctgagccggcatg

SEQ ID NO: 399282 - DNA, 25 bp, Mus musculus
agccgccgattgtgtcgagtcagcg

SEQ ID NO: 399283 - DNA, 25 bp, Mus musculus
atcaccgaatcagcaggcgcgtccg

SEQ ID NO: 399284 - DNA, 25 bp, Mus musculus
tagacgccggggcagcatctgcccg

SEQ ID NO: 399285 - DNA, 25 bp, Mus musculus
tcccggggatcaccgaatcagcagg

SEQ ID NO: 399286 - DNA, 25 bp, Mus musculus
gtactcgggagcttgaccgagcaga

SEQ ID NO: 399287 - DNA, 25 bp, Mus musculus
agcgaaggacaggagcattcctata

SEQ ID NO: 399288 - DNA, 25 bp, Mus musculus
caggagcattcctataggcgtcgcg

SEQ ID NO: 399289 - DNA, 25 bp, Mus musculus
ttctgctcgctctctaggcgtcgtc

SEQ ID NO: 399290 - DNA, 25 bp, Mus musculus
gcgtgctctgctggaaacacaatgg

SEQ ID NO: 399291 - DNA, 25 bp, Mus musculus
cgacccaatcgaggagagggcagca

SEQ ID NO: 399292 - DNA, 25 bp, Mus musculus
gagagggcagcaactacgtttccca

SEQ ID NO: 399293 - DNA, 25 bp, Mus musculus
ggcagcaactacgtttcccagcgtg

SEQ ID NO: 399294 - DNA, 25 bp, Mus musculus
cccagcgtgctctgctggaaacaca

SEQ ID NO: 399295 - DNA, 25 bp, Mus musculus
aacacaatggagtttggcgtcatcc

SEQ ID NO: 399296 - DNA, 25 bp, Mus musculus
cgtcatccgggtcacgtggtctcgc

SEQ ID NO: 399297 - DNA, 25 bp, Mus musculus
gtcacgtggtctcgcgtttcccgga

SEQ ID NO: 399298 - DNA, 25 bp, Mus musculus
cgtttcccggagcactgagggattc

SEQ ID NO: 399299 - DNA, 25 bp, Mus musculus
cactgagggattccggccagggtcc

SEQ ID NO: 399300 - DNA, 25 bp, Mus musculus
tgctgggccgggaaaactacacttc

SEQ ID NO: 399301 - DNA, 25 bp, Mus musculus
catgcctcacctcgggtgcgcctgc

SEQ ID NO: 399302 - DNA, 25 bp, Mus musculus
cgtgccggagcaaccctgctggcga

SEQ ID NO: 399303 - DNA, 25 bp, Mus musculus
aactacgtttcccagcgtgctctgc

SEQ ID NO: 399304 - DNA, 25 bp, Mus musculus
ggccagggaagctgcagcactccca

SEQ ID NO: 399305 - DNA, 25 bp, Mus musculus
gccgcgcactctggttccgcctgcg

SEQ ID NO: 399306 - DNA, 25 bp, Mus musculus
gaccggaccagcgtccgccctagaa

SEQ ID NO: 399307 - DNA, 25 bp, Mus musculus
aggacgcctaggagagaccggacca

SEQ ID NO: 399308 - DNA, 25 bp, Mus musculus
agcactcccaggctctgtaggacgc

SEQ ID NO: 399309 - DNA, 25 bp, Mus musculus
ccgacatgtctgcagggccgacgct

SEQ ID NO: 399310 - DNA, 25 bp, Mus musculus
tagtcgataagttccgggctgaacc

SEQ ID NO: 399311 - DNA, 25 bp, Mus musculus
tccaggtagtcgataagttccgggc

SEQ ID NO: 399312 - DNA, 25 bp, Mus musculus
tcccttccaggtagtcgataagttc

SEQ ID NO: 399313 - DNA, 25 bp, Mus musculus
gagattttcccttccaggtagtcga

SEQ ID NO: 399314 - DNA, 25 bp, Mus musculus
tcgaactcttcaaaggagattttcc

SEQ ID NO: 399315 - DNA, 25 bp, Mus musculus
tctccgcctttcgaactcttcaaag

SEQ ID NO: 399316 - DNA, 25 bp, Mus musculus
tcggggaaaacaagaccgaggagca

SEQ ID NO: 399317 - DNA, 25 bp, Mus musculus
cccaggctctgtaggacgcctagga

SEQ ID NO: 399318 - DNA, 25 bp, Mus musculus
tactcggggtactcgaacatgtagc

SEQ ID NO: 399319 - DNA, 25 bp, Mus musculus
ccatgaagacatagaacgccagatt

SEQ ID NO: 399320 - DNA, 25 bp, Mus musculus
tgcccagcacgaagcaggagacttc

SEQ ID NO: 399321 - DNA, 25 bp, Mus musculus
gagcgttccatctgagcccgagaga

SEQ ID NO: 399322 - DNA, 25 bp, Mus musculus
gaacatgtagctcatgctgcacttg

SEQ ID NO: 399323 - DNA, 25 bp, Mus musculus
ctgcacttgttttcctcgaagccga

SEQ ID NO: 399324 - DNA, 25 bp, Mus musculus
tcgaagccgaagaagacatcccaca

SEQ ID NO: 399325 - DNA, 25 bp, Mus musculus
cccagggtcgccagaaacaccatga

SEQ ID NO: 399326 - DNA, 25 bp, Mus musculus
ttgactgagtggagaaacatggtgc

SEQ ID NO: 399327 - DNA, 25 bp, Mus musculus
gcagacgagcgcctctacaccagga

SEQ ID NO: 399328 - DNA, 25 bp, Mus musculus
tctacaccaggagaagctcggcagc

SEQ ID NO: 399329 - DNA, 25 bp, Mus musculus
ggaaagactccggtgccaagccgtg

SEQ ID NO: 399330 - DNA, 25 bp, Mus musculus
acttcgagtgccaggagagctccga

SEQ ID NO: 399331 - DNA, 25 bp, Mus musculus
acgccagattccagaggttgactga

SEQ ID NO: 399332 - DNA, 25 bp, Mus musculus
ttgagcactgccattcttcctttcc

SEQ ID NO: 399333 - DNA, 25 bp, Mus musculus
gaacgcgcacttgcgacggcccagg

SEQ ID NO: 399334 - DNA, 25 bp, Mus musculus
tttatacaggaagtgccggccgctg

SEQ ID NO: 399335 - DNA, 25 bp, Mus musculus
cccgcccgcctttatacaggaagtg

SEQ ID NO: 399336 - DNA, 25 bp, Mus musculus
acggcccgggaaagctccaggagct

SEQ ID NO: 399337 - DNA, 25 bp, Mus musculus
ggatcccggccagtctcttgcctga

SEQ ID NO: 399338 - DNA, 25 bp, Mus musculus
gctccgccaggagccagccgaaagg

SEQ ID NO: 399339 - DNA, 25 bp, Mus musculus
cctacctgctcgcagagtttgagca

SEQ ID NO: 399340 - DNA, 25 bp, Mus musculus
cgtgcacgctcaaaggctgcgcgta

SEQ ID NO: 399341 - DNA, 25 bp, Mus musculus
ccagtctcttgcctgacgcgggaga

SEQ ID NO: 399342 - DNA, 25 bp, Mus musculus
gctgcgaggctgagatcctctctcc

SEQ ID NO: 399343 - DNA, 25 bp, Mus musculus
ggctgactgctcctgagtgcacgac

SEQ ID NO: 399344 - DNA, 25 bp, Mus musculus
agtgcacgacgcagtccgaggctcc

SEQ ID NO: 399345 - DNA, 25 bp, Mus musculus
cgctccgcagatgtcaacgccggga

SEQ ID NO: 399346 - DNA, 25 bp, Mus musculus
ctggacggcacgtgtctaccactta

SEQ ID NO: 399347 - DNA, 25 bp, Mus musculus
cgccatggagagcaactgtgaaact

SEQ ID NO: 399348 - DNA, 25 bp, Mus musculus
acttacccacgccatggagagcaac

SEQ ID NO: 399349 - DNA, 25 bp, Mus musculus
ctgtgaaactggacggcacgtgtct

SEQ ID NO: 399350 - DNA, 25 bp, Mus musculus
ggacggcacgtgtctaccacttacc

SEQ ID NO: 399351 - DNA, 25 bp, Mus musculus
taccacttacccacgccatggagag

SEQ ID NO: 399352 - DNA, 25 bp, Mus musculus
ttacccacgccatggagagcaactg

SEQ ID NO: 399353 - DNA, 25 bp, Mus musculus
actgtgaaactggacggcacgtgtc

SEQ ID NO: 399354 - DNA, 25 bp, Mus musculus
agcaactgtgaaactggacggcacg

SEQ ID NO: 399355 - DNA, 25 bp, Mus musculus
cccacgccatggagagcaactgtga

SEQ ID NO: 399356 - DNA, 25 bp, Mus musculus
gagagcaactgtgaaactggacggc

SEQ ID NO: 399357 - DNA, 25 bp, Mus musculus
aactggacggcacgtgtctaccact

SEQ ID NO: 399358 - DNA, 25 bp, Mus musculus
tacccacgccatggagagcaactgt

SEQ ID NO: 399359 - DNA, 25 bp, Mus musculus
acgccatggagagcaactgtgaaac

SEQ ID NO: 399360 - DNA, 25 bp, Mus musculus
gtgcacaacgcccacggttactcca

SEQ ID NO: 399361 - DNA, 25 bp, Mus musculus
cgccagcggtattggggcagccaac

SEQ ID NO: 399362 - DNA, 25 bp, Mus musculus
acgcccacggttactccagccacag

SEQ ID NO: 399363 - DNA, 25 bp, Mus musculus
gcagccaggctcgccagcggtattg

SEQ ID NO: 399364 - DNA, 25 bp, Mus musculus
ctcgccagcggtattggggcagcca

SEQ ID NO: 399365 - DNA, 25 bp, Mus musculus
cagcggtattggggcagccaacgca

SEQ ID NO: 399366 - DNA, 25 bp, Mus musculus
tattggggcagccaacgcagcgggg

SEQ ID NO: 399367 - DNA, 25 bp, Mus musculus
gggggcagccgtgccagcagcacgc

SEQ ID NO: 399368 - DNA, 25 bp, Mus musculus
cccggcccagaacaggcgctggctc

SEQ ID NO: 399369 - DNA, 25 bp, Mus musculus
ctccgcagcctgcacaagcagggta

SEQ ID NO: 399370 - DNA, 25 bp, Mus musculus
tccgcagcctgcacaagcagggtag

SEQ ID NO: 399371 - DNA, 25 bp, Mus musculus
cgcagcctgcacaagcagggtaggc

SEQ ID NO: 399372 - DNA, 25 bp, Mus musculus
cagcctgcacaagcagggtaggcag

SEQ ID NO: 399373 - DNA, 25 bp, Mus musculus
ccagaacaggcgctggctcgcctcc

SEQ ID NO: 399374 - DNA, 25 bp, Mus musculus
gcccgaaagcggctgccgtcattca

SEQ ID NO: 399375 - DNA, 25 bp, Mus musculus
acgtacttcaactgccacctatatg

SEQ ID NO: 399376 - DNA, 25 bp, Mus musculus
gcgccgcactgtagcacgtacttca

SEQ ID NO: 399377 - DNA, 25 bp, Mus musculus
acagacggaactggcgctcccaagg

SEQ ID NO: 399378 - DNA, 25 bp, Mus musculus
ttgtccactcgaacacacagacgga

SEQ ID NO: 399379 - DNA, 25 bp, Mus musculus
gcgatcttcgccattttgtccactc

SEQ ID NO: 399380 - DNA, 25 bp, Mus musculus
aggccgcttaccttcgtgagtcttg

SEQ ID NO: 399381 - DNA, 25 bp, Mus musculus
cgagaccagagatgccacgcgaaga

SEQ ID NO: 399382 - DNA, 25 bp, Mus musculus
cggcctttgccgagaccatagatgc

SEQ ID NO: 399383 - DNA, 25 bp, Mus musculus
aactcggaagcaccaacagccagcg

SEQ ID NO: 399384 - DNA, 25 bp, Mus musculus
cgaggctctccggtcagaacaagag

SEQ ID NO: 399385 - DNA, 25 bp, Mus musculus
tacgaactgccgacgatagcgcccg

SEQ ID NO: 399386 - DNA, 25 bp, Mus musculus
gtcattcagggctttccaggtacga

SEQ ID NO: 399387 - DNA, 25 bp, Mus musculus
cctatatgagactgcgaggggcatt

SEQ ID NO: 399388 - DNA, 25 bp, Mus musculus
ggggcaatctgcttaacacggcgtc

SEQ ID NO: 399389 - DNA, 25 bp, Mus musculus
tgtatcgccgcgaagagcttagccg

SEQ ID NO: 399390 - DNA, 25 bp, Mus musculus
gtgtcgccgcacaaaagactggatg

SEQ ID NO: 399391 - DNA, 25 bp, Mus musculus
gggctgttatccctaaaaggctcca

SEQ ID NO: 399392 - DNA, 25 bp, Mus musculus
ggttacttagctccgcggtcaggct

SEQ ID NO: 399393 - DNA, 25 bp, Mus musculus
gtcaggcttctggtggcttccagta

SEQ ID NO: 399394 - DNA, 25 bp, Mus musculus
tacacagagtgagaatggggcaatc

SEQ ID NO: 399395 - DNA, 25 bp, Mus musculus
ctctgagtgactgtggtaaggctga

SEQ ID NO: 399396 - DNA, 25 bp, Mus musculus
cagctccagctgaagaacttgtgca

SEQ ID NO: 399397 - DNA, 25 bp, Mus musculus
tgcagcgcagacttgtgcacccgga

SEQ ID NO: 399398 - DNA, 25 bp, Mus musculus
tgcacccggagtttgttccgaccga

SEQ ID NO: 399399 - DNA, 25 bp, Mus musculus
gcccgcattttacgcagttcactgg

SEQ ID NO: 399400 - DNA, 25 bp, Mus musculus
ttaacacggcgtctttgcggagctc

SEQ ID NO: 399401 - DNA, 25 bp, Mus musculus
tccacctccggctgcactgggaaag

SEQ ID NO: 399402 - DNA, 25 bp, Mus musculus
cgcccttccggtctccaagaggtgg

SEQ ID NO: 399403 - DNA, 25 bp, Mus musculus
cataagtggcagactcctggcagga

SEQ ID NO: 399404 - DNA, 25 bp, Mus musculus
cactggacacgtgcgtcagcctagc

SEQ ID NO: 399405 - DNA, 25 bp, Mus musculus
gtgtccagctgctcagagggctccc

SEQ ID NO: 399406 - DNA, 25 bp, Mus musculus
ttggctaccggcttcacaaagatga

SEQ ID NO: 399407 - DNA, 25 bp, Mus musculus
atgatcatggcagctcggaccagtc

SEQ ID NO: 399408 - DNA, 25 bp, Mus musculus
catcggggtgccatccgaagtcgac

SEQ ID NO: 399409 - DNA, 25 bp, Mus musculus
cgaagtcgaccaccgtgacggaagc

SEQ ID NO: 399410 - DNA, 25 bp, Mus musculus
tggtctgcgtgcacctcatattatc

SEQ ID NO: 399411 - DNA, 25 bp, Mus musculus
aggacggacaagcagccgggtctcc

SEQ ID NO: 399412 - DNA, 25 bp, Mus musculus
ggaaagtttaactgcgcccgagagc

SEQ ID NO: 399413 - DNA, 25 bp, Mus musculus
tgtcctggcggtgaaccgcttgtca

SEQ ID NO: 399414 - DNA, 25 bp, Mus musculus
acccaggagttcgtcacgaagatta

SEQ ID NO: 399415 - DNA, 25 bp, Mus musculus
catattatcggggtgagtcagcgac

SEQ ID NO: 399416 - DNA, 25 bp, Mus musculus
caggcctgcgggtccagttcggcct

SEQ ID NO: 399417 - DNA, 25 bp, Mus musculus
cttgtgcgctttgggactaatagga

SEQ ID NO: 399418 - DNA, 25 bp, Mus musculus
tcctgggccacggtccgttctagaa

SEQ ID NO: 399419 - DNA, 25 bp, Mus musculus
aggtcaagtggcgtcatttccggga

SEQ ID NO: 399420 - DNA, 25 bp, Mus musculus
ccggcctggaaaagcctagaaagtg

SEQ ID NO: 399421 - DNA, 25 bp, Mus musculus
cagcagcggcccgagttcagagtcc

SEQ ID NO: 399422 - DNA, 25 bp, Mus musculus
cctacgctggttcctgggccacggt

SEQ ID NO: 399423 - DNA, 25 bp, Mus musculus
cacggcgaacccttgtgcgctttgg

SEQ ID NO: 399424 - DNA, 25 bp, Mus musculus
ggcgcgcaccgcaatgagcccgagt

SEQ ID NO: 399425 - DNA, 25 bp, Mus musculus
cctggacaagtgagccgagcctgcg

SEQ ID NO: 399426 - DNA, 25 bp, Mus musculus
cgccacacgtgatgaaaccagcgtg

SEQ ID NO: 399427 - DNA, 25 bp, Mus musculus
gagggcccaagttgcttccacccta

SEQ ID NO: 399428 - DNA, 25 bp, Mus musculus
caggtggcaccagagggcccaagtt

SEQ ID NO: 399429 - DNA, 25 bp, Mus musculus
tgcgcggccttttcacgtgtcccag

SEQ ID NO: 399430 - DNA, 25 bp, Mus musculus
cgtcgagggctgtaaacactgccca

SEQ ID NO: 399431 - DNA, 25 bp, Mus musculus
acctcaccgggagcaagcttggccg

SEQ ID NO: 399432 - DNA, 25 bp, Mus musculus
agccgcccagactctggcactatgg

SEQ ID NO: 399433 - DNA, 25 bp, Mus musculus
tgacgcttgtcaccagcggctgctg

SEQ ID NO: 399434 - DNA, 25 bp, Mus musculus
aagcttggccggtgacgtacctgcc

SEQ ID NO: 399435 - DNA, 25 bp, Mus musculus
ggctcggcactcttcccatggtgct

SEQ ID NO: 399436 - DNA, 25 bp, Mus musculus
ttccttttcggcctcggcggagctc

SEQ ID NO: 399437 - DNA, 25 bp, Mus musculus
actctggcactatggtcatggcgga

SEQ ID NO: 399438 - DNA, 25 bp, Mus musculus
tgaggcggaacaggccaggcaccaa

SEQ ID NO: 399439 - DNA, 25 bp, Mus musculus
caccaaggcgcaggtatcgtcccta

SEQ ID NO: 399440 - DNA, 25 bp, Mus musculus
gtccctacggctttcctgtcacaga

SEQ ID NO: 399441 - DNA, 25 bp, Mus musculus
ttcctgtcacagagttggcggggcc

SEQ ID NO: 399442 - DNA, 25 bp, Mus musculus
ccctggaggcctgctagacgcagga

SEQ ID NO: 399443 - DNA, 25 bp, Mus musculus
gccggctgttcattctgtgctcctc

SEQ ID NO: 399444 - DNA, 25 bp, Mus musculus
cgcaggagtcaacgcttgccgttca

SEQ ID NO: 399445 - DNA, 25 bp, Mus musculus
atccctgtcccgtgtctctcgagag

SEQ ID NO: 399446 - DNA, 25 bp, Mus musculus
tgacacggaacccactagccgacta

SEQ ID NO: 399447 - DNA, 25 bp, Mus musculus
ccgttcattggcttccgcgccggaa

SEQ ID NO: 399448 - DNA, 25 bp, Mus musculus
acgcggttttccaccggcacggatg

SEQ ID NO: 399449 - DNA, 25 bp, Mus musculus
atgagcacggcctgaagatccagca

SEQ ID NO: 399450 - DNA, 25 bp, Mus musculus
gcgatcgagtgtctgcccagttttt

SEQ ID NO: 399451 - DNA, 25 bp, Mus musculus
cagtttttgcagcttttccgggagg

SEQ ID NO: 399452 - DNA, 25 bp, Mus musculus
ggctgacatctcttccacggacttc

SEQ ID NO: 399453 - DNA, 25 bp, Mus musculus
accgagtagcggtgcagcatttctg

SEQ ID NO: 399454 - DNA, 25 bp, Mus musculus
ggggtctgctttacaaagggatcta

SEQ ID NO: 399455 - DNA, 25 bp, Mus musculus
tgtgcctcggatgagtgcttcttgc

SEQ ID NO: 399456 - DNA, 25 bp, Mus musculus
cttcttgccggaggccaaggttact

SEQ ID NO: 399457 - DNA, 25 bp, Mus musculus
tatcttctacgtgaacgccgcgccg

SEQ ID NO: 399458 - DNA, 25 bp, Mus musculus
gttctctcgggtcatcgtggaccgg

SEQ ID NO: 399459 - DNA, 25 bp, Mus musculus
agctcaagttggaaggcgcgttcgc

SEQ ID NO: 399460 - DNA, 25 bp, Mus musculus
atcgtggaccgggacaccgacacga

SEQ ID NO: 399461 - DNA, 25 bp, Mus musculus
aggccagccagcgagaaattttgtc

SEQ ID NO: 399462 - DNA, 25 bp, Mus musculus
tttgtcaggcaaacccgccagcagc

SEQ ID NO: 399463 - DNA, 25 bp, Mus musculus
tggcgggaaccctcaacggcaccta

SEQ ID NO: 399464 - DNA, 25 bp, Mus musculus
gcggcacgttaccaggctgcactgg

SEQ ID NO: 399465 - DNA, 25 bp, Mus musculus
gtagctcaggccttcccgggctcag

SEQ ID NO: 399466 - DNA, 25 bp, Mus musculus
gcccgcgagaacgtgtcctgaaaag

SEQ ID NO: 399467 - DNA, 25 bp, Mus musculus
ccgctcgctaggcatgtttggccga

SEQ ID NO: 399468 - DNA, 25 bp, Mus musculus
catgtttggccgatggccgtttccc

SEQ ID NO: 399469 - DNA, 25 bp, Mus musculus
cagcaaggctttcgactccaaagtc

SEQ ID NO: 399470 - DNA, 25 bp, Mus musculus
ccgggactcggtctccatctttcta

SEQ ID NO: 399471 - DNA, 25 bp, Mus musculus
ccatctttctaatctccggagttcg

SEQ ID NO: 399472 - DNA, 25 bp, Mus musculus
cttgaaccttcaggccgctttcgtc

SEQ ID NO: 399473 - DNA, 25 bp, Mus musculus
ctgtctcgccgggagcctaaaacgt

SEQ ID NO: 399474 - DNA, 25 bp, Mus musculus
ctaaaacgtgcttggctatggctga

SEQ ID NO: 399475 - DNA, 25 bp, Mus musculus
gcccactgccttttgtctgcacaga

SEQ ID NO: 399476 - DNA, 25 bp, Mus musculus
cttcctaaaatgtactctgagtgcc

SEQ ID NO: 399477 - DNA, 25 bp, Mus musculus
tctgagtgcctgtgggtgcgcacac

SEQ ID NO: 399478 - DNA, 25 bp, Mus musculus
aggctccgagcaacagaacacattc

SEQ ID NO: 399479 - DNA, 25 bp, Mus musculus
acacattccattcttcgcgctcggg

SEQ ID NO: 399480 - DNA, 25 bp, Mus musculus
ccacgggctgtcaaaacaagtcttc

SEQ ID NO: 399481 - DNA, 25 bp, Mus musculus
gccggagcgatgtctcctttctaca

SEQ ID NO: 399482 - DNA, 25 bp, Mus musculus
tctacaaagttgtggctgccactgc

SEQ ID NO: 399483 - DNA, 25 bp, Mus musculus
ccgtggcgcgctaaaacaaagtcta

SEQ ID NO: 399484 - DNA, 25 bp, Mus musculus
tttccttctggtgcctgagcgcacc

SEQ ID NO: 399485 - DNA, 25 bp, Mus musculus
cctcggtgagcctcggctcctgaga

SEQ ID NO: 399486 - DNA, 25 bp, Mus musculus
cgctgcgcgcacctcccagctccgg

SEQ ID NO: 399487 - DNA, 25 bp, Mus musculus
atggggctgccgttctgctccagcc

SEQ ID NO: 399488 - DNA, 25 bp, Mus musculus
tgttacctcccacggccttggccac

SEQ ID NO: 399489 - DNA, 25 bp, Mus musculus
ctccagccgggccaccttcaccggg

SEQ ID NO: 399490 - DNA, 25 bp, Mus musculus
cgcttcttcggtcggggctgtcccg

SEQ ID NO: 399491 - DNA, 25 bp, Mus musculus
ggctgtcccgaagacacgggctctc

SEQ ID NO: 399492 - DNA, 25 bp, Mus musculus
tgtcccgaagacacgggctctcgct

SEQ ID NO: 399493 - DNA, 25 bp, Mus musculus
gccgctccatgctgctccgatttgg

SEQ ID NO: 399494 - DNA, 25 bp, Mus musculus
tgctccgatttggagacaaagttcc

SEQ ID NO: 399495 - DNA, 25 bp, Mus musculus
tttggagacaaagttcccaccggca

SEQ ID NO: 399496 - DNA, 25 bp, Mus musculus
acaaagttcccaccggcaggtcgca

SEQ ID NO: 399497 - DNA, 25 bp, Mus musculus
gttcccaccggcaggtcgcaataaa

SEQ ID NO: 399498 - DNA, 25 bp, Mus musculus
ccaccggcaggtcgcaataaaacgc

SEQ ID NO: 399499 - DNA, 25 bp, Mus musculus
cccagctccgggctgttacctccca

SEQ ID NO: 399500 - DNA, 25 bp, Mus musculus
tagtcgccacgagtccagacgaggt

SEQ ID NO: 399501 - DNA, 25 bp, Mus musculus
gacagagaggagttaagaagaatgc

SEQ ID NO: 399502 - DNA, 25 bp, Mus musculus
cagagaggagttaagaagaatgcga

SEQ ID NO: 399503 - DNA, 25 bp, Mus musculus
ggagttaagaagaatgcgaaagatg

SEQ ID NO: 399504 - DNA, 25 bp, Mus musculus
aatgcgaaagatgtagggagtgctc

SEQ ID NO: 399505 - DNA, 25 bp, Mus musculus
ggaggggttgccagtgaaggctcca

SEQ ID NO: 399506 - DNA, 25 bp, Mus musculus
cggcttcgcctaagcgcgcgtgaga

SEQ ID NO: 399507 - DNA, 25 bp, Mus musculus
ttcgcctaagcgcgcgtgagagcca

SEQ ID NO: 399508 - DNA, 25 bp, Mus musculus
tcgccacgagtccagacgaggtggt

SEQ ID NO: 399509 - DNA, 25 bp, Mus musculus
gacgcgggagaagcctagtcgccac

SEQ ID NO: 399510 - DNA, 25 bp, Mus musculus
cgggagaagcctagtcgccacgagt

SEQ ID NO: 399511 - DNA, 25 bp, Mus musculus
gagaagcctagtcgccacgagtcca

SEQ ID NO: 399512 - DNA, 25 bp, Mus musculus
gcctagtcgccacgagtccagacga

SEQ ID NO: 399513 - DNA, 25 bp, Mus musculus
aagcctagtcgccacgagtccagac

SEQ ID NO: 399514 - DNA, 25 bp, Mus musculus
agggtccagatgtccagccagagga

SEQ ID NO: 399515 - DNA, 25 bp, Mus musculus
gccgcattttgccagcacttttcga

SEQ ID NO: 399516 - DNA, 25 bp, Mus musculus
cctcagacctcgcactcaccacgtc

SEQ ID NO: 399517 - DNA, 25 bp, Mus musculus
aagcagcagccgcattttgccagca

SEQ ID NO: 399518 - DNA, 25 bp, Mus musculus
gcagccgcattttgccagcactttt

SEQ ID NO: 399519 - DNA, 25 bp, Mus musculus
ttgccagcacttttcgaatcacacg

SEQ ID NO: 399520 - DNA, 25 bp, Mus musculus
gcacttttcgaatcacacggggaca

SEQ ID NO: 399521 - DNA, 25 bp, Mus musculus
tttcgaatcacacggggacaggcac

SEQ ID NO: 399522 - DNA, 25 bp, Mus musculus
atcacacggggacaggcacagcgac

SEQ ID NO: 399523 - DNA, 25 bp, Mus musculus
tccaggagtagacggaagtcgaggc

SEQ ID NO: 399524 - DNA, 25 bp, Mus musculus
tccagatgtccagccagaggaaggg

SEQ ID NO: 399525 - DNA, 25 bp, Mus musculus
cggccgggatgcgacagccgctcca

SEQ ID NO: 399526 - DNA, 25 bp, Mus musculus
cggcctcggcttaggggtggctcta

SEQ ID NO: 399527 - DNA, 25 bp, Mus musculus
acaggcacagcgaccccctttgtga

SEQ ID NO: 399528 - DNA, 25 bp, Mus musculus
acggccgacgaatgggtgcgtctaa

SEQ ID NO: 399529 - DNA, 25 bp, Mus musculus
cccgcctggcaggaaattaaacatc

SEQ ID NO: 399530 - DNA, 25 bp, Mus musculus
ccggcactggagaaagggttgctcc

SEQ ID NO: 399531 - DNA, 25 bp, Mus musculus
tgcgccgccgagtactttcgacttt

SEQ ID NO: 399532 - DNA, 25 bp, Mus musculus
tgggcacaaggcaggctgcatccct

SEQ ID NO: 399533 - DNA, 25 bp, Mus musculus
aggacctcatgcaccgggcgacgaa

SEQ ID NO: 399534 - DNA, 25 bp, Mus musculus
ccctcagcggctgaggaccgagttc

SEQ ID NO: 399535 - DNA, 25 bp, Mus musculus
gggaaggccacttctccctcaaatc

SEQ ID NO: 399536 - DNA, 25 bp, Mus musculus
cggagcaacttttctcggtgcgagc

SEQ ID NO: 399537 - DNA, 25 bp, Mus musculus
tctaagcgctgacgaacgccagggc

SEQ ID NO: 399538 - DNA, 25 bp, Mus musculus
ggtctggtcctcctccttgtagcaa

SEQ ID NO: 399539 - DNA, 25 bp, Mus musculus
ccttgtagcaagtccagggcgcagc

SEQ ID NO: 399540 - DNA, 25 bp, Mus musculus
ctcgtctccgggctctgttaattgc

SEQ ID NO: 399541 - DNA, 25 bp, Mus musculus
atcaatcgctgtgagcacggcgacc

SEQ ID NO: 399542 - DNA, 25 bp, Mus musculus
agcgaagatctagaggccaagaata

SEQ ID NO: 399543 - DNA, 25 bp, Mus musculus
ttcaggcctaaagcgaagatctaga

SEQ ID NO: 399544 - DNA, 25 bp, Mus musculus
gccgagaaattcaggcctaaagcga

SEQ ID NO: 399545 - DNA, 25 bp, Mus musculus
aacacctagcgaggccgagaaattc

SEQ ID NO: 399546 - DNA, 25 bp, Mus musculus
ctgcgctgtttttctccgggaaaca

SEQ ID NO: 399547 - DNA, 25 bp, Mus musculus
ctccaagaccaggtcactgccaggg

SEQ ID NO: 399548 - DNA, 25 bp, Mus musculus
cctttcgtcccgatcttggggctgc

SEQ ID NO: 399549 - DNA, 25 bp, Mus musculus
agaccaggtcactgccaggggtccc

SEQ ID NO: 399550 - DNA, 25 bp, Mus musculus
gatcttggggctgcgctgtttttct

SEQ ID NO: 399551 - DNA, 25 bp, Mus musculus
agagtcgaggcgatgcctccctaca

SEQ ID NO: 399552 - DNA, 25 bp, Mus musculus
ctggagcgaacccttccgcagcgcc

SEQ ID NO: 399553 - DNA, 25 bp, Mus musculus
gcagcgccggaatcctcaggttaaa

SEQ ID NO: 399554 - DNA, 25 bp, Mus musculus
tcctcaggttaaagaggagtggagc

SEQ ID NO: 399555 - DNA, 25 bp, Mus musculus
ggccaagaatagtgaccaaggtccc

SEQ ID NO: 399556 - DNA, 25 bp, Mus musculus
tctctttgtattgtaccgggcgcgc

SEQ ID NO: 399557 - DNA, 25 bp, Mus musculus
cgaaggctgcggaagaaatggtctc

SEQ ID NO: 399558 - DNA, 25 bp, Mus musculus
ttagagccttggtgttgggtcactg

SEQ ID NO: 399559 - DNA, 25 bp, Mus musculus
agagcgcgccgcgtgttagagcctt

SEQ ID NO: 399560 - DNA, 25 bp, Mus musculus
tagcgaagagcgttgagtggatttc

SEQ ID NO: 399561 - DNA, 25 bp, Mus musculus
cagtccaggctcgtgggatagcgaa

SEQ ID NO: 399562 - DNA, 25 bp, Mus musculus
aatcggaggcccagtccaggctcgt

SEQ ID NO: 399563 - DNA, 25 bp, Mus musculus
caacagcacggcaatcggaggccca

SEQ ID NO: 399564 - DNA, 25 bp, Mus musculus
acgcggagggcaacagcacggcaat

SEQ ID NO: 399565 - DNA, 25 bp, Mus musculus
agaggatgacctcatcccttccctt

SEQ ID NO: 399566 - DNA, 25 bp, Mus musculus
ccgagggagaggatgacctcatccc

SEQ ID NO: 399567 - DNA, 25 bp, Mus musculus
tcctccaccagctgactccgaggga

SEQ ID NO: 399568 - DNA, 25 bp, Mus musculus
ggagctcctcggacctgcacattcc

SEQ ID NO: 399569 - DNA, 25 bp, Mus musculus
ctgcggaagaaatggtctctttgta

SEQ ID NO: 399570 - DNA, 25 bp, Mus musculus
tgtagtggcgatacgtcccgccgct

SEQ ID NO: 399571 - DNA, 25 bp, Mus musculus
tgctgctgtagtggcgatacgtccc

SEQ ID NO: 399572 - DNA, 25 bp, Mus musculus
gccaacatccggtgacgaatccaag

SEQ ID NO: 399573 - DNA, 25 bp, Mus musculus
tcgggccaacatccggtgacgaatc

SEQ ID NO: 399574 - DNA, 25 bp, Mus musculus
tgatctttcctcttccggattacgg

SEQ ID NO: 399575 - DNA, 25 bp, Mus musculus
cgccagtcgggccaacatccggtga

SEQ ID NO: 399576 - DNA, 25 bp, Mus musculus
acatccggtgacgaatccaagtccc

SEQ ID NO: 399577 - DNA, 25 bp, Mus musculus
ggtgacgaatccaagtcccgcctct

SEQ ID NO: 399578 - DNA, 25 bp, Mus musculus
cgcctctaagcccatctgctgtcca

SEQ ID NO: 399579 - DNA, 25 bp, Mus musculus
aatgccgccctctgccggtctttac

SEQ ID NO: 399580 - DNA, 25 bp, Mus musculus
gtgagccgcttccagacaacccgga

SEQ ID NO: 399581 - DNA, 25 bp, Mus musculus
ccagacaacccggaagtgatctttc

SEQ ID NO: 399582 - DNA, 25 bp, Mus musculus
gacaacccggaagtgatctttcctc

SEQ ID NO: 399583 - DNA, 25 bp, Mus musculus
aagtgatctttcctcttccggatta

SEQ ID NO: 399584 - DNA, 25 bp, Mus musculus
ctgacatcccgggaaggagattccc

SEQ ID NO: 399585 - DNA, 25 bp, Mus musculus
ggctgagtccgccaaccacaaacgt

SEQ ID NO: 399586 - DNA, 25 bp, Mus musculus
acgtccttcctccagccgcgccctc

SEQ ID NO: 399587 - DNA, 25 bp, Mus musculus
cctccggacgcacgcggcgtgctga

SEQ ID NO: 399588 - DNA, 25 bp, Mus musculus
tgacgtcacggcgaccgaagccgtt

SEQ ID NO: 399589 - DNA, 25 bp, Mus musculus
tcacggcgaccgaagccgttgggca

SEQ ID NO: 399590 - DNA, 25 bp, Mus musculus
cccgcctgcagacccgagccatgaa

SEQ ID NO: 399591 - DNA, 25 bp, Mus musculus
ccgtctgcagcgctccacggtgccg

SEQ ID NO: 399592 - DNA, 25 bp, Mus musculus
cgcagcaacgaactgctcctgctga

SEQ ID NO: 399593 - DNA, 25 bp, Mus musculus
gctcttccacgtccgttcgaacttc

SEQ ID NO: 399594 - DNA, 25 bp, Mus musculus
ttccctggggacgtgcaggtaacgc

SEQ ID NO: 399595 - DNA, 25 bp, Mus musculus
cgcccacacgggttctcatacgatg

SEQ ID NO: 399596 - DNA, 25 bp, Mus musculus
ccacacgggttctcatacgatgggg

SEQ ID NO: 399597 - DNA, 25 bp, Mus musculus
gcagcgcagcaacgaactgctcctg

SEQ ID NO: 399598 - DNA, 25 bp, Mus musculus
taccggaagacgctgctcagccatg

SEQ ID NO: 399599 - DNA, 25 bp, Mus musculus
cccgaacaatctctgggttgcagga

SEQ ID NO: 399600 - DNA, 25 bp, Mus musculus
gacgagttcttccacgcgtgatttc

SEQ ID NO: 399601 - DNA, 25 bp, Mus musculus
gaagatcccttctcggccgggtaga

SEQ ID NO: 399602 - DNA, 25 bp, Mus musculus
ttgcgttcctggagctcccgaagat

SEQ ID NO: 399603 - DNA, 25 bp, Mus musculus
cgctgactgaaatttgctgcctgtg

SEQ ID NO: 399604 - DNA, 25 bp, Mus musculus
gactccggactctcggtagcaccga

SEQ ID NO: 399605 - DNA, 25 bp, Mus musculus
aaaggtcacaaacatggcgctggcc

SEQ ID NO: 399606 - DNA, 25 bp, Mus musculus
tccggcctgctttcagtactgcaca

SEQ ID NO: 399607 - DNA, 25 bp, Mus musculus
caggcctgggaatttggacgagttc

SEQ ID NO: 399608 - DNA, 25 bp, Mus musculus
gcgggcctcctcacctgtggataaa

SEQ ID NO: 399609 - DNA, 25 bp, Mus musculus
ctttgaattcccgagcagggctaca

SEQ ID NO: 399610 - DNA, 25 bp, Mus musculus
tctcagtgagcttcgtgccacccag

SEQ ID NO: 399611 - DNA, 25 bp, Mus musculus
agatgctccatgaactgctcccggg

SEQ ID NO: 399612 - DNA, 25 bp, Mus musculus
ccgagcgatgtcattgcagggtctg

SEQ ID NO: 399613 - DNA, 25 bp, Mus musculus
agccttcacctggacgggaatgcga

SEQ ID NO: 399614 - DNA, 25 bp, Mus musculus
caccggggtgaaggatccagccttc

SEQ ID NO: 399615 - DNA, 25 bp, Mus musculus
agttccgtgtttactgcggacaccg

SEQ ID NO: 399616 - DNA, 25 bp, Mus musculus
catctggggagatagcagagcttct

SEQ ID NO: 399617 - DNA, 25 bp, Mus musculus
aacttgagttttgcgcatctgggga

SEQ ID NO: 399618 - DNA, 25 bp, Mus musculus
acagcggcggaaccgatcgcggact

SEQ ID NO: 399619 - DNA, 25 bp, Mus musculus
gatcgaccagccgagcgcccgaagg

SEQ ID NO: 399620 - DNA, 25 bp, Mus musculus
cagccgcgctcgcaacgaggtaagc

SEQ ID NO: 399621 - DNA, 25 bp, Mus musculus
tgaaggaatccagcctgcccagcgg

SEQ ID NO: 399622 - DNA, 25 bp, Mus musculus
agttgaggcagtgaaggaatccagc

SEQ ID NO: 399623 - DNA, 25 bp, Mus musculus
caaaacccagggaggcgtgatcggc

SEQ ID NO: 399624 - DNA, 25 bp, Mus musculus
tgcgtgtgagcggatacaaaaccca

SEQ ID NO: 399625 - DNA, 25 bp, Mus musculus
tcgtttctgagtcgcggagacaact

SEQ ID NO: 399626 - DNA, 25 bp, Mus musculus
aaacacagctcatggggctcacgcc

SEQ ID NO: 399627 - DNA, 25 bp, Mus musculus
cagtgcgccaaaagggaggcctcgc

SEQ ID NO: 399628 - DNA, 25 bp, Mus musculus
cggtcccaacgtgcagtgcgccaaa

SEQ ID NO: 399629 - DNA, 25 bp, Mus musculus
ccacgattggtagagcggagcaacc

SEQ ID NO: 399630 - DNA, 25 bp, Mus musculus
cgcctactcggatgctccacgattg

SEQ ID NO: 399631 - DNA, 25 bp, Mus musculus
acgcggaagtaagccgtcgcctact

SEQ ID NO: 399632 - DNA, 25 bp, Mus musculus
tgcttactgacctgcggccgccagt

SEQ ID NO: 399633 - DNA, 25 bp, Mus musculus
caaagcgcccgtttcatcagagagg

SEQ ID NO: 399634 - DNA, 25 bp, Mus musculus
tcggtctacaacgaagcctggtacc

SEQ ID NO: 399635 - DNA, 25 bp, Mus musculus
cgggcgccgactacacttttgagaa

SEQ ID NO: 399636 - DNA, 25 bp, Mus musculus
tcgccacggctggacaaaaccggga

SEQ ID NO: 399637 - DNA, 25 bp, Mus musculus
caacgaagcctggtacccaaagcgc

SEQ ID NO: 399638 - DNA, 25 bp, Mus musculus
ggaaagatggggaatcaccaggccc

SEQ ID NO: 399639 - DNA, 25 bp, Mus musculus
agcggcgactgcttactgacctgcg

SEQ ID NO: 399640 - DNA, 25 bp, Mus musculus
attgtcgcgcttccctggcaagtgt

SEQ ID NO: 399641 - DNA, 25 bp, Mus musculus
aaacctgaatcctggtcttcgcgga

SEQ ID NO: 399642 - DNA, 25 bp, Mus musculus
cccacagctgaaggggtcgctggta

SEQ ID NO: 399643 - DNA, 25 bp, Mus musculus
tccctggcaagtgtgggcacccaca

SEQ ID NO: 399644 - DNA, 25 bp, Mus musculus
ccagcaaggcctgcgaagccggaac

SEQ ID NO: 399645 - DNA, 25 bp, Mus musculus
tggtcttcgcggattgtcgcgcttc

SEQ ID NO: 399646 - DNA, 25 bp, Mus musculus
ttccgtcttccacttccgggtggca

SEQ ID NO: 399647 - DNA, 25 bp, Mus musculus
tggcagcgcatctttgcgccgcctt

SEQ ID NO: 399648 - DNA, 25 bp, Mus musculus
tttgcgccgccttctcggaatctga

SEQ ID NO: 399649 - DNA, 25 bp, Mus musculus
tcggaatctgattggctggagcata

SEQ ID NO: 399650 - DNA, 25 bp, Mus musculus
ttggctggagcataaacgctaactg

SEQ ID NO: 399651 - DNA, 25 bp, Mus musculus
gcataaacgctaactgccgcgcagt

SEQ ID NO: 399652 - DNA, 25 bp, Mus musculus
ctgccgcgcagtttaaacctgaatc

SEQ ID NO: 399653 - DNA, 25 bp, Mus musculus
tgcgaagccggaacccttctcggta

SEQ ID NO: 399654 - DNA, 25 bp, Mus musculus
tgcgaactggcgcagggtagaaatc

SEQ ID NO: 399655 - DNA, 25 bp, Mus musculus
ccgggacggactggtccaactcgcg

SEQ ID NO: 399656 - DNA, 25 bp, Mus musculus
cggactggtccaactcgcggccgtt

SEQ ID NO: 399657 - DNA, 25 bp, Mus musculus
acgggctaccctggtacaagagtca

SEQ ID NO: 399658 - DNA, 25 bp, Mus musculus
ctttagggtgggacagagacgccta

SEQ ID NO: 399659 - DNA, 25 bp, Mus musculus
agagacgcctaccaccgcggtgtta

SEQ ID NO: 399660 - DNA, 25 bp, Mus musculus
ttgaggggccgcttcccactcccat

SEQ ID NO: 399661 - DNA, 25 bp, Mus musculus
ggcgcagggtagaaatctcgcgata

SEQ ID NO: 399662 - DNA, 25 bp, Mus musculus
tagaaatctcgcgatagcaggcctc

SEQ ID NO: 399663 - DNA, 25 bp, Mus musculus
aatctcgcgatagcaggcctccggg

SEQ ID NO: 399664 - DNA, 25 bp, Mus musculus
tcctgctcgcgttagttccggtcgc

SEQ ID NO: 399665 - DNA, 25 bp, Mus musculus
gagacagcgccgcagttgccgccag

SEQ ID NO: 399666 - DNA, 25 bp, Mus musculus
gttagttccggtcgcagaggagaca

SEQ ID NO: 399667 - DNA, 25 bp, Mus musculus
ctggtacaagagtcagggcagcctg

SEQ ID NO: 399668 - DNA, 25 bp, Mus musculus
ccctaccctgcttcaagtttcaggg

SEQ ID NO: 399669 - DNA, 25 bp, Mus musculus
gtccggggagttgctactgccgaat

SEQ ID NO: 399670 - DNA, 25 bp, Mus musculus
ccagtatccggtcagtgcggccagg

SEQ ID NO: 399671 - DNA, 25 bp, Mus musculus
ggagttgctactgccgaatccgccc

SEQ ID NO: 399672 - DNA, 25 bp, Mus musculus
cctcctgcccgggtacggcgcatgc

SEQ ID NO: 399673 - DNA, 25 bp, Mus musculus
ccggggagttgctactgccgaatcc

SEQ ID NO: 399674 - DNA, 25 bp, Mus musculus
gggctctgaggcctgcgtgcgtccg

SEQ ID NO: 399675 - DNA, 25 bp, Mus musculus
tcaagtttcagggccgaggggccac

SEQ ID NO: 399676 - DNA, 25 bp, Mus musculus
ctgcttcaagtttcagggccgaggg

SEQ ID NO: 399677 - DNA, 25 bp, Mus musculus
accctgcttcaagtttcagggccga

SEQ ID NO: 399678 - DNA, 25 bp, Mus musculus
ggcttcatgctggacccctaccctg

SEQ ID NO: 399679 - DNA, 25 bp, Mus musculus
cccagtatccggtcagtgcggccag

SEQ ID NO: 399680 - DNA, 25 bp, Mus musculus
tgcgcgcagcatgccacccatgacc

SEQ ID NO: 399681 - DNA, 25 bp, Mus musculus
gggagttgctactgccgaatccgcc

SEQ ID NO: 399682 - DNA, 25 bp, Mus musculus
cgagccaggggctactacgaccgcc

SEQ ID NO: 399683 - DNA, 25 bp, Mus musculus
cagatagctcgtgaccgcgacagtc

SEQ ID NO: 399684 - DNA, 25 bp, Mus musculus
cctttgacagatagctcgtgaccgc

SEQ ID NO: 399685 - DNA, 25 bp, Mus musculus
ttcagggcctttgacagatagctcg

SEQ ID NO: 399686 - DNA, 25 bp, Mus musculus
ctgatgcggttcagggcctttgaca

SEQ ID NO: 399687 - DNA, 25 bp, Mus musculus
cgccactttggaatgagggcagcgc

SEQ ID NO: 399688 - DNA, 25 bp, Mus musculus
ggctctcggcgccactttggaatga

SEQ ID NO: 399689 - DNA, 25 bp, Mus musculus
tttgcatcttggaagggtgcaagcg

SEQ ID NO: 399690 - DNA, 25 bp, Mus musculus
ctcagttttgcatcttggaagggtg

SEQ ID NO: 399691 - DNA, 25 bp, Mus musculus
ggccagctctcagttttgcatcttg

SEQ ID NO: 399692 - DNA, 25 bp, Mus musculus
ggctgtagcgtttgcggccagctct

SEQ ID NO: 399693 - DNA, 25 bp, Mus musculus
aggcgaaatgccgacgcgccacggc

SEQ ID NO: 399694 - DNA, 25 bp, Mus musculus
tgaccgcgacagtcctctaagttcg

SEQ ID NO: 399695 - DNA, 25 bp, Mus musculus
cgcagaaaaggaagaggcgaaatgc

SEQ ID NO: 399696 - DNA, 25 bp, Mus musculus
tgccaccgccgagagcaaaaccagg

SEQ ID NO: 399697 - DNA, 25 bp, Mus musculus
cccggtgtgcctcgttttcattatg

SEQ ID NO: 399698 - DNA, 25 bp, Mus musculus
atcgaccgcctctgaaattcttttc

SEQ ID NO: 399699 - DNA, 25 bp, Mus musculus
ttcttcgtcgaaggcggaaactaca

SEQ ID NO: 399700 - DNA, 25 bp, Mus musculus
tctaacaagatcagcgaccgcagcg

SEQ ID NO: 399701 - DNA, 25 bp, Mus musculus
gcctacgcagaagccagcggccaga

SEQ ID NO: 399702 - DNA, 25 bp, Mus musculus
cttgcaaggcgaagacaaagcttac

SEQ ID NO: 399703 - DNA, 25 bp, Mus musculus
cggcgagaagtctgcaaacgattac

SEQ ID NO: 399704 - DNA, 25 bp, Mus musculus
gacgatctcccaacacaaaatggtg

SEQ ID NO: 399705 - DNA, 25 bp, Mus musculus
acgcagtgcgagcttcttctcggaa

SEQ ID NO: 399706 - DNA, 25 bp, Mus musculus
tcttctcggaaaaactggtgacgta

SEQ ID NO: 399707 - DNA, 25 bp, Mus musculus
gcctataccggtcctgagtgcgcag

SEQ ID NO: 399708 - DNA, 25 bp, Mus musculus
ctctcacaagcgctgtcccggtgtg

SEQ ID NO: 399709 - DNA, 25 bp, Mus musculus
tttccaaccctgaagacaaagcttg

SEQ ID NO: 399710 - DNA, 25 bp, Mus musculus
ctcatcacaccgactaggactcgga

SEQ ID NO: 399711 - DNA, 25 bp, Mus musculus
gggacgccctactctcccgtcagtc

SEQ ID NO: 399712 - DNA, 25 bp, Mus musculus
gtgcgccacagaagtgaagcccgga

SEQ ID NO: 399713 - DNA, 25 bp, Mus musculus
taagaagcagaacccgctgtcgccc

SEQ ID NO: 399714 - DNA, 25 bp, Mus musculus
tccaaaggcgtgtctgtgcgccaca

SEQ ID NO: 399715 - DNA, 25 bp, Mus musculus
cagcaacttcatacagcggcctgga

SEQ ID NO: 399716 - DNA, 25 bp, Mus musculus
aggactcggaggaccacgcacctca

SEQ ID NO: 399717 - DNA, 25 bp, Mus musculus
gccggcatgcctgcgggttccaaag

SEQ ID NO: 399718 - DNA, 25 bp, Mus musculus
gcctcaactacaagggccggcatgc

SEQ ID NO: 399719 - DNA, 25 bp, Mus musculus
tgcgggaacggaaaagcctcaacta

SEQ ID NO: 399720 - DNA, 25 bp, Mus musculus
agcaccactgctgcgggaacggaaa

SEQ ID NO: 399721 - DNA, 25 bp, Mus musculus
gtgcacggagaaaaggataaaagcc

SEQ ID NO: 399722 - DNA, 25 bp, Mus musculus
caggcgtttgagtgcacggagaaaa

SEQ ID NO: 399723 - DNA, 25 bp, Mus musculus
tacccacaacctcactaagaagcag

SEQ ID NO: 399724 - DNA, 25 bp, Mus musculus
ccgggctttcctcatctcttcagtt

SEQ ID NO: 399725 - DNA, 25 bp, Mus musculus
gagctgcgcgcagcacactgaatcc

SEQ ID NO: 399726 - DNA, 25 bp, Mus musculus
gttagccggaaagcaggcacggtcc

SEQ ID NO: 399727 - DNA, 25 bp, Mus musculus
aggcacggtccgtgcaggagacttc

SEQ ID NO: 399728 - DNA, 25 bp, Mus musculus
caggagacttctcgccacaggacag

SEQ ID NO: 399729 - DNA, 25 bp, Mus musculus
tcgccacaggacagccttggctttc

SEQ ID NO: 399730 - DNA, 25 bp, Mus musculus
gcgcactgggactcacctctcgagt

SEQ ID NO: 399731 - DNA, 25 bp, Mus musculus
aggctcacttgagccgccagccagg

SEQ ID NO: 399732 - DNA, 25 bp, Mus musculus
tgggcggtgccctaagaaaccaatg

SEQ ID NO: 399733 - DNA, 25 bp, Mus musculus
taagaaaccaatggggagccgagcc

SEQ ID NO: 399734 - DNA, 25 bp, Mus musculus
cgcaagcccgttgactcgggccata

SEQ ID NO: 399735 - DNA, 25 bp, Mus musculus
ggccctcgctcagtcggaaaacaga

SEQ ID NO: 399736 - DNA, 25 bp, Mus musculus
catctcttcagtttccgtttccggg

SEQ ID NO: 399737 - DNA, 25 bp, Mus musculus
gagaacggccgcgaggctcacttga

SEQ ID NO: 399738 - DNA, 25 bp, Mus musculus
agcaagagtcgagacagggccgcta

SEQ ID NO: 399739 - DNA, 25 bp, Mus musculus
ggttttgtccgcaccgccgaatctc

SEQ ID NO: 399740 - DNA, 25 bp, Mus musculus
tcgcgctgtgagtctcgccacttaa

SEQ ID NO: 399741 - DNA, 25 bp, Mus musculus
ccagcaggaaaggacagagagcaag

SEQ ID NO: 399742 - DNA, 25 bp, Mus musculus
atccttcaagtaccgcataggcgcg

SEQ ID NO: 399743 - DNA, 25 bp, Mus musculus
tccttccctcaggtgaccgagagcg

SEQ ID NO: 399744 - DNA, 25 bp, Mus musculus
aagagccgccgtttgaatctgcgca

SEQ ID NO: 399745 - DNA, 25 bp, Mus musculus
atccgcatcagagatgccggccctg

SEQ ID NO: 399746 - DNA, 25 bp, Mus musculus
agcactcgcagcctcctgcagggtt

SEQ ID NO: 399747 - DNA, 25 bp, Mus musculus
aggggcggaccaagacccactgctc

SEQ ID NO: 399748 - DNA, 25 bp, Mus musculus
ccaggattggaactcgcgggagtcc

SEQ ID NO: 399749 - DNA, 25 bp, Mus musculus
gggctagaagccaggattggaactc

SEQ ID NO: 399750 - DNA, 25 bp, Mus musculus
cctggacatgtcaggaggcgtgctc

SEQ ID NO: 399751 - DNA, 25 bp, Mus musculus
agcgagcagcactgcagcactcgca

SEQ ID NO: 399752 - DNA, 25 bp, Mus musculus
tcggatccaacagtcctgctgcctt

SEQ ID NO: 399753 - DNA, 25 bp, Mus musculus
ctggagcaagacaaacacggcttta

SEQ ID NO: 399754 - DNA, 25 bp, Mus musculus
ctaaagattccgtcctggagcaaga

SEQ ID NO: 399755 - DNA, 25 bp, Mus musculus
ggtgctccgcctaaagattccgtcc

SEQ ID NO: 399756 - DNA, 25 bp, Mus musculus
tgcgctatgactttggcccgcctct

SEQ ID NO: 399757 - DNA, 25 bp, Mus musculus
ttggctgcgctatgactttggcccg

SEQ ID NO: 399758 - DNA, 25 bp, Mus musculus
gcttaataacaaccgctctcattgg

SEQ ID NO: 399759 - DNA, 25 bp, Mus musculus
tgggcccacgcgcttaataacaacc

SEQ ID NO: 399760 - DNA, 25 bp, Mus musculus
agccttctcattgagtgggcccacg

SEQ ID NO: 399761 - DNA, 25 bp, Mus musculus
tgcagcataacaaccagccttctca

SEQ ID NO: 399762 - DNA, 25 bp, Mus musculus
gcagcagcctgccaactgcagcata

SEQ ID NO: 399763 - DNA, 25 bp, Mus musculus
tctgcagggcttcggatccaacagt

SEQ ID NO: 399764 - DNA, 25 bp, Mus musculus
cgaagccggaggagaaattcctctt

SEQ ID NO: 399765 - DNA, 25 bp, Mus musculus
aggagaaattcctcttcacccggca

SEQ ID NO: 399766 - DNA, 25 bp, Mus musculus
tagcccggcaaggaggtcgctacga

SEQ ID NO: 399767 - DNA, 25 bp, Mus musculus
cacttagggccggacaggtacgtga

SEQ ID NO: 399768 - DNA, 25 bp, Mus musculus
caggtacgtgacctgcgcggtgtaa

SEQ ID NO: 399769 - DNA, 25 bp, Mus musculus
cccaggatgcgagccagggctcaga

SEQ ID NO: 399770 - DNA, 25 bp, Mus musculus
gcgcggtgtaactggcgcgctactc

SEQ ID NO: 399771 - DNA, 25 bp, Mus musculus
ctgcgcgagcctgggaccctaagtc

SEQ ID NO: 399772 - DNA, 25 bp, Mus musculus
agggctcagagacgctgcgcctgct

SEQ ID NO: 399773 - DNA, 25 bp, Mus musculus
tgccgtgcgcgttctagcccggcaa

SEQ ID NO: 399774 - DNA, 25 bp, Mus musculus
tgagcctctcaagcggccacttagg

SEQ ID NO: 399775 - DNA, 25 bp, Mus musculus
ctttcggtttctgggcgtctccatt

SEQ ID NO: 399776 - DNA, 25 bp, Mus musculus
gcgtctccattttgcggaccctaaa

SEQ ID NO: 399777 - DNA, 25 bp, Mus musculus
cggaccctaaagcacgcagcgaagt

SEQ ID NO: 399778 - DNA, 25 bp, Mus musculus
gcgaagtctctgagacctgagcctc

SEQ ID NO: 399779 - DNA, 25 bp, Mus musculus
ctgctgccacgtctgctttcggttt

SEQ ID NO: 399780 - DNA, 25 bp, Mus musculus
tgtctcgttcgatccagttttctgg

SEQ ID NO: 399781 - DNA, 25 bp, Mus musculus
cttgggccagctccgcaggctaact

SEQ ID NO: 399782 - DNA, 25 bp, Mus musculus
cgtcacctggctagcagcttgggcc

SEQ ID NO: 399783 - DNA, 25 bp, Mus musculus
attcctgaacctgttgggctcgctg

SEQ ID NO: 399784 - DNA, 25 bp, Mus musculus
agagcggtcgcatctcattcctgaa

SEQ ID NO: 399785 - DNA, 25 bp, Mus musculus
gcaggctaactttcctggacgccta

SEQ ID NO: 399786 - DNA, 25 bp, Mus musculus
tggacgcctactgaagagtctgctc

SEQ ID NO: 399787 - DNA, 25 bp, Mus musculus
caagagtactctggggacgtcctta

SEQ ID NO: 399788 - DNA, 25 bp, Mus musculus
ttctttccagtgtctcgttcgatcc

SEQ ID NO: 399789 - DNA, 25 bp, Mus musculus
ccagttttctggtggtctccagcga

SEQ ID NO: 399790 - DNA, 25 bp, Mus musculus
tccagcgaagacaggcgacaaagcc

SEQ ID NO: 399791 - DNA, 25 bp, Mus musculus
cgacaaagccgttgttgagtgggat

SEQ ID NO: 399792 - DNA, 25 bp, Mus musculus
acgtccttatcgctgggagagagcg

SEQ ID NO: 399793 - DNA, 25 bp, Mus musculus
agtctgctcctctctgtgttctttc

SEQ ID NO: 399794 - DNA, 25 bp, Mus musculus
gcggcaggtactcggccacaggtga

SEQ ID NO: 399795 - DNA, 25 bp, Mus musculus
gagcagtcgggttcctttcccacca

SEQ ID NO: 399796 - DNA, 25 bp, Mus musculus
aaagcccaagccagcggaggcctcg

SEQ ID NO: 399797 - DNA, 25 bp, Mus musculus
cgaaatgcagccatcggggtgccgt

SEQ ID NO: 399798 - DNA, 25 bp, Mus musculus
cctttcccaccagcgggccgagatc

SEQ ID NO: 399799 - DNA, 25 bp, Mus musculus
gtgctgcagagcagtcgggttcctt

SEQ ID NO: 399800 - DNA, 25 bp, Mus musculus
cacaggtgagtgctgcagagcagtc

SEQ ID NO: 399801 - DNA, 25 bp, Mus musculus
cctcgcccgagctggagttgtgacc

SEQ ID NO: 399802 - DNA, 25 bp, Mus musculus
ctggaggctcggaaagcccaagcca

SEQ ID NO: 399803 - DNA, 25 bp, Mus musculus
agtgagtacagttctggggagcgcc

SEQ ID NO: 399804 - DNA, 25 bp, Mus musculus
aaacctctgtgagccggcgtggaac

SEQ ID NO: 399805 - DNA, 25 bp, Mus musculus
tagcaaacctctgtgagccggcgtg

SEQ ID NO: 399806 - DNA, 25 bp, Mus musculus
cggaatcggtagcaaacctctgtga

SEQ ID NO: 399807 - DNA, 25 bp, Mus musculus
gatcccaccggtgggtgtcgatctc

SEQ ID NO: 399808 - DNA, 25 bp, Mus musculus
tggccttggtcaccgcctaggtaat

SEQ ID NO: 399809 - DNA, 25 bp, Mus musculus
cctgagagcagcatctgaagcagcc

SEQ ID NO: 399810 - DNA, 25 bp, Mus musculus
caggaactggcaggcgctctcacat

SEQ ID NO: 399811 - DNA, 25 bp, Mus musculus
agtgacgccggttcaatggcagccc

SEQ ID NO: 399812 - DNA, 25 bp, Mus musculus
agtttgctttccgtcccgcctacag

SEQ ID NO: 399813 - DNA, 25 bp, Mus musculus
ctcctcactccagagctagaagctg

SEQ ID NO: 399814 - DNA, 25 bp, Mus musculus
gccgtgctgcacttctgtgccttga

SEQ ID NO: 399815 - DNA, 25 bp, Mus musculus
aatcgcacgcgggagcttactcacg

SEQ ID NO: 399816 - DNA, 25 bp, Mus musculus
aagccggcctagtgttttcgcctcg

SEQ ID NO: 399817 - DNA, 25 bp, Mus musculus
tctctgtctctgtgccagcgcacgg

SEQ ID NO: 399818 - DNA, 25 bp, Mus musculus
gcggaaggctacaaggccagtcctc

SEQ ID NO: 399819 - DNA, 25 bp, Mus musculus
ctccttaccggagttgacacggccg

SEQ ID NO: 399820 - DNA, 25 bp, Mus musculus
tgccaggtgcaggaacccagctacc

SEQ ID NO: 399821 - DNA, 25 bp, Mus musculus
gtgccttgaggctcaccctggaagc

SEQ ID NO: 399822 - DNA, 25 bp, Mus musculus
ttgcactcacaaggatgcggggttg

SEQ ID NO: 399823 - DNA, 25 bp, Mus musculus
acccggatgatcctcgggccaaggg

SEQ ID NO: 399824 - DNA, 25 bp, Mus musculus
cggttcttaccgagtgagcgacgcc

SEQ ID NO: 399825 - DNA, 25 bp, Mus musculus
caccttcactttctgctgtacgaaa

SEQ ID NO: 399826 - DNA, 25 bp, Mus musculus
tttctgctgtacgaaatgcttcttc

SEQ ID NO: 399827 - DNA, 25 bp, Mus musculus
gcttcttcttggttttggaggcgaa

SEQ ID NO: 399828 - DNA, 25 bp, Mus musculus
ggaggacgccatagtctcccgcgca

SEQ ID NO: 399829 - DNA, 25 bp, Mus musculus
aagcgggagctagccgcgactccga

SEQ ID NO: 399830 - DNA, 25 bp, Mus musculus
gctcacctgcgcagccgtcatgtga

SEQ ID NO: 399831 - DNA, 25 bp, Mus musculus
cacctggctcgggttgcactcacaa

SEQ ID NO: 399832 - DNA, 25 bp, Mus musculus
gcgcttctgtcgcttccggttctgt

SEQ ID NO: 399833 - DNA, 25 bp, Mus musculus
ccggttctgtccagtttctagtgga

SEQ ID NO: 399834 - DNA, 25 bp, Mus musculus
ttctagtggatgagctctgtccgta

SEQ ID NO: 399835 - DNA, 25 bp, Mus musculus
agccgtcatgtgaccggaggcccgc

SEQ ID NO: 399836 - DNA, 25 bp, Mus musculus
tcgccatggcaacgctgactagggc

SEQ ID NO: 399837 - DNA, 25 bp, Mus musculus
cgtcatcgggctgcgcctcatggct

SEQ ID NO: 399838 - DNA, 25 bp, Mus musculus
gctaccggagccgaacccaatctga

SEQ ID NO: 399839 - DNA, 25 bp, Mus musculus
ccttcgaactaggaaaacctcagcg

SEQ ID NO: 399840 - DNA, 25 bp, Mus musculus
taggaaaacctcagcgtcggccggc

SEQ ID NO: 399841 - DNA, 25 bp, Mus musculus
cagtttcccgggaggtcatcgtggt

SEQ ID NO: 399842 - DNA, 25 bp, Mus musculus
ggaacatcctcctctctgaccgaga

SEQ ID NO: 399843 - DNA, 25 bp, Mus musculus
gacctgatcgccttttgcggggccc

SEQ ID NO: 399844 - DNA, 25 bp, Mus musculus
agattcccggctcggcggtggtcac

SEQ ID NO: 399845 - DNA, 25 bp, Mus musculus
tggtcactgctggttaggacacctc

SEQ ID NO: 399846 - DNA, 25 bp, Mus musculus
tggttaggacacctccacttcgcca

SEQ ID NO: 399847 - DNA, 25 bp, Mus musculus
aggccctgagtcgtccctcatgatg

SEQ ID NO: 399848 - DNA, 25 bp, Mus musculus
gtccctcatgatgctttcccgcggg

SEQ ID NO: 399849 - DNA, 25 bp, Mus musculus
ggcgggaccagactcgtattcaaac

SEQ ID NO: 399850 - DNA, 25 bp, Mus musculus
ccgaagactcagtgaaaggacctaa

SEQ ID NO: 399851 - DNA, 25 bp, Mus musculus
aaccaatcgtcctagggcgggcgca

SEQ ID NO: 399852 - DNA, 25 bp, Mus musculus
agtcagggcagaaccaatcgtccta

SEQ ID NO: 399853 - DNA, 25 bp, Mus musculus
tgcaggcaaaccattcagtcagggc

SEQ ID NO: 399854 - DNA, 25 bp, Mus musculus
ccgaacgcatcagtgactgcaggca

SEQ ID NO: 399855 - DNA, 25 bp, Mus musculus
ggatcaagattgctccgaacgcatc

SEQ ID NO: 399856 - DNA, 25 bp, Mus musculus
acggcgtccgacagggatcaagatt

SEQ ID NO: 399857 - DNA, 25 bp, Mus musculus
gggacccgaaggaatgccacacagc

SEQ ID NO: 399858 - DNA, 25 bp, Mus musculus
cacgtccggagctcttcacaggcag

SEQ ID NO: 399859 - DNA, 25 bp, Mus musculus
acacagctccgaccacggcagtggg

SEQ ID NO: 399860 - DNA, 25 bp, Mus musculus
ggacctaactcaataagcgtttcca

SEQ ID NO: 399861 - DNA, 25 bp, Mus musculus
gtttccatggtaacgataggccgcg

SEQ ID NO: 399862 - DNA, 25 bp, Mus musculus
ggcgcactttagaagcaaccgaaga

SEQ ID NO: 399863 - DNA, 25 bp, Mus musculus
cgggtacgcgagatcagctgattca

SEQ ID NO: 399864 - DNA, 25 bp, Mus musculus
gctcgagaaacttgggcaaactttg

SEQ ID NO: 399865 - DNA, 25 bp, Mus musculus
agaacttcccagtgcacggtgccgg

SEQ ID NO: 399866 - DNA, 25 bp, Mus musculus
gagaagcttgttgctcgtcgccgca

SEQ ID NO: 399867 - DNA, 25 bp, Mus musculus
ctccaggcccaggagtttgaacctc

SEQ ID NO: 399868 - DNA, 25 bp, Mus musculus
tttcctccagctgagaacgccgctg

SEQ ID NO: 399869 - DNA, 25 bp, Mus musculus
cgggctcagccatatcacggcgaga

SEQ ID NO: 399870 - DNA, 25 bp, Mus musculus
aaaggcatctcggtaccggaccacg

SEQ ID NO: 399871 - DNA, 25 bp, Mus musculus
ccctctggtaaaggtgcagtgttct

SEQ ID NO: 399872 - DNA, 25 bp, Mus musculus
gcagtgttctcctgagctacgcttc

SEQ ID NO: 399873 - DNA, 25 bp, Mus musculus
gctacgcttcttcttatgctctatg

SEQ ID NO: 399874 - DNA, 25 bp, Mus musculus
atgctctatgtacgcacccgtgtgc

SEQ ID NO: 399875 - DNA, 25 bp, Mus musculus
gtgcaccgtgctcgaccaagccatt

SEQ ID NO: 399876 - DNA, 25 bp, Mus musculus
gccgcagagaaagccgcaccgttac

SEQ ID NO: 399877 - DNA, 25 bp, Mus musculus
ttcctccgtgccgttccttgtgcga

SEQ ID NO: 399878 - DNA, 25 bp, Mus musculus
gcaggcagaacctcactctgaggtt

SEQ ID NO: 399879 - DNA, 25 bp, Mus musculus
tgcagggacttcctctacgtcttgc

SEQ ID NO: 399880 - DNA, 25 bp, Mus musculus
ggctgcagggacttcctctacgtct

SEQ ID NO: 399881 - DNA, 25 bp, Mus musculus
aacaccgcggctgcagggacttcct

SEQ ID NO: 399882 - DNA, 25 bp, Mus musculus
acaacaccgcggctgcagggacttc

SEQ ID NO: 399883 - DNA, 25 bp, Mus musculus
tacagcacaacaccgcggctgcagg

SEQ ID NO: 399884 - DNA, 25 bp, Mus musculus
aatccgtcccttctctacagcacaa

SEQ ID NO: 399885 - DNA, 25 bp, Mus musculus
acttcctctacgtcttgcgtcactt

SEQ ID NO: 399886 - DNA, 25 bp, Mus musculus
ttccgctgcgcgcagaggcgagtta

SEQ ID NO: 399887 - DNA, 25 bp, Mus musculus
agaggcgagttagcgaagacgggaa

SEQ ID NO: 399888 - DNA, 25 bp, Mus musculus
gggacttcctctacgtcttgcgtca

SEQ ID NO: 399889 - DNA, 25 bp, Mus musculus
gcagaacctcactctgaggtttaca

SEQ ID NO: 399890 - DNA, 25 bp, Mus musculus
ggggtctccgcaccactgcggcctc

SEQ ID NO: 399891 - DNA, 25 bp, Mus musculus
ttacaaatccgtcccttctctacag

SEQ ID NO: 399892 - DNA, 25 bp, Mus musculus
cacgctctgcggcattgagcgacca

SEQ ID NO: 399893 - DNA, 25 bp, Mus musculus
tcctgtttgaaacgtccgttggcta

SEQ ID NO: 399894 - DNA, 25 bp, Mus musculus
ttgagcgaccagaagtgacgttact

SEQ ID NO: 399895 - DNA, 25 bp, Mus musculus
aaggagactcgcatatttgctgctc

SEQ ID NO: 399896 - DNA, 25 bp, Mus musculus
tgagcaacgtggtctgttcgtccgc

SEQ ID NO: 399897 - DNA, 25 bp, Mus musculus
cctagcgggtcttcagcgactgaaa

SEQ ID NO: 399898 - DNA, 25 bp, Mus musculus
cagcgactgaaaggtagtcatttgc

SEQ ID NO: 399899 - DNA, 25 bp, Mus musculus
gtcatttgcagtggcgtaagggctc

SEQ ID NO: 399900 - DNA, 25 bp, Mus musculus
ggtctcatcatgttggtcctgtttg

SEQ ID NO: 399901 - DNA, 25 bp, Mus musculus
tccggattctactgtgggcgggaaa

SEQ ID NO: 399902 - DNA, 25 bp, Mus musculus
taaggccgtctctttccggattcta

SEQ ID NO: 399903 - DNA, 25 bp, Mus musculus
cgcgatattttaaggccgtctcttt

SEQ ID NO: 399904 - DNA, 25 bp, Mus musculus
gacgttacttcccagaattcttaga

SEQ ID NO: 399905 - DNA, 25 bp, Mus musculus
cgccctgacctggtctcatcatgtt

SEQ ID NO: 399906 - DNA, 25 bp, Mus musculus
ccagttccgtgttcttcttgggagc

SEQ ID NO: 399907 - DNA, 25 bp, Mus musculus
ggcgcttccgtccagaaagaacttc

SEQ ID NO: 399908 - DNA, 25 bp, Mus musculus
cctctctcgcgaaggagtgctaggc

SEQ ID NO: 399909 - DNA, 25 bp, Mus musculus
tctgggaaccagagtcttccggctc

SEQ ID NO: 399910 - DNA, 25 bp, Mus musculus
ccctcactgagactgcgcaggcgta

SEQ ID NO: 399911 - DNA, 25 bp, Mus musculus
aagcgccggacgttgtttctcttct

SEQ ID NO: 399912 - DNA, 25 bp, Mus musculus
ttccgcagcagattgtgcagcacta

SEQ ID NO: 399913 - DNA, 25 bp, Mus musculus
gagaggcccatcacctttaccagtt

SEQ ID NO: 399914 - DNA, 25 bp, Mus musculus
cattccatagcgtgccaatattggc

SEQ ID NO: 399915 - DNA, 25 bp, Mus musculus
ggcccgtttgtttgtccattccata

SEQ ID NO: 399916 - DNA, 25 bp, Mus musculus
agttcgccttggttcatgtcccgga

SEQ ID NO: 399917 - DNA, 25 bp, Mus musculus
cggtcaccaagtaacgcgcaatcga

SEQ ID NO: 399918 - DNA, 25 bp, Mus musculus
ccactgtgttgacgtgctctggttc

SEQ ID NO: 399919 - DNA, 25 bp, Mus musculus
tgtccgcactcggtacactcgatgc

SEQ ID NO: 399920 - DNA, 25 bp, Mus musculus
gctgtgattcgctcccgcaagccat

SEQ ID NO: 399921 - DNA, 25 bp, Mus musculus
aacaacgacggcgtgccttcgaggc

SEQ ID NO: 399922 - DNA, 25 bp, Mus musculus
gctcggtcgggattctcagggaaac

SEQ ID NO: 399923 - DNA, 25 bp, Mus musculus
ttacttcaggcaagagcgaggggct

SEQ ID NO: 399924 - DNA, 25 bp, Mus musculus
gcaagccatcgacgggaggagaccc

SEQ ID NO: 399925 - DNA, 25 bp, Mus musculus
gctttctccagaggggctgtgattc

SEQ ID NO: 399926 - DNA, 25 bp, Mus musculus
gggtgtttcgcaagctcagctgccc

SEQ ID NO: 399927 - DNA, 25 bp, Mus musculus
taaacaaaagattgtggccgccctc

SEQ ID NO: 399928 - DNA, 25 bp, Mus musculus
agcgcctcagactggcagctgcggc

SEQ ID NO: 399929 - DNA, 25 bp, Mus musculus
cacaggcccgagacagacaggggtc

SEQ ID NO: 399930 - DNA, 25 bp, Mus musculus
tcgcctgtgtgaggaaagggaccta

SEQ ID NO: 399931 - DNA, 25 bp, Mus musculus
ttgaacagatcgcacggcgtccacg

SEQ ID NO: 399932 - DNA, 25 bp, Mus musculus
ccctttgtgtctggtctgcttggaa

SEQ ID NO: 399933 - DNA, 25 bp, Mus musculus
tttcatggtggaatttacttcaggc

SEQ ID NO: 399934 - DNA, 25 bp, Mus musculus
gcgggcctctttctctttaaagagc

SEQ ID NO: 399935 - DNA, 25 bp, Mus musculus
cagaagcagcctcgggagccgagat

SEQ ID NO: 399936 - DNA, 25 bp, Mus musculus
cgagcgcgctgacgctacaccaatg

SEQ ID NO: 399937 - DNA, 25 bp, Mus musculus
cgctacaccaatgagcggcggcagg

SEQ ID NO: 399938 - DNA, 25 bp, Mus musculus
cagacgggagcgtccgtgacgtcca

SEQ ID NO: 399939 - DNA, 25 bp, Mus musculus
cactattgttgatgaggagccgcgg

SEQ ID NO: 399940 - DNA, 25 bp, Mus musculus
gcgtccgtgacgtccacgcgcggta

SEQ ID NO: 399941 - DNA, 25 bp, Mus musculus
tgccgttccagctgaagcagcagca

SEQ ID NO: 399942 - DNA, 25 bp, Mus musculus
gtgaggcgcaatgggtctcccacgc

SEQ ID NO: 399943 - DNA, 25 bp, Mus musculus
aagtcaggctacgtcacccgctggc

SEQ ID NO: 399944 - DNA, 25 bp, Mus musculus
cctggtcctgaagtcaggctacgtc

SEQ ID NO: 399945 - DNA, 25 bp, Mus musculus
ccatgagggcgacggtgccgttcca

SEQ ID NO: 399946 - DNA, 25 bp, Mus musculus
ggcggctgcatcacctcgtcggtgc

SEQ ID NO: 399947 - DNA, 25 bp, Mus musculus
ggacaacggaggagacactattgtt

SEQ ID NO: 399948 - DNA, 25 bp, Mus musculus
aggttctgttctcaccacgtccatc

SEQ ID NO: 399949 - DNA, 25 bp, Mus musculus
gacatcccacaacaggacaataata

SEQ ID NO: 399950 - DNA, 25 bp, Mus musculus
cgtccatctcgcaattggtctgttc

SEQ ID NO: 399951 - DNA, 25 bp, Mus musculus
cctgggtgtcgcttgctcgtgagaa

SEQ ID NO: 399952 - DNA, 25 bp, Mus musculus
gacccgcagctttgcttaggttctg

SEQ ID NO: 399953 - DNA, 25 bp, Mus musculus
cccgcgaggtgatgcattccgacat

SEQ ID NO: 399954 - DNA, 25 bp, Mus musculus
ccagcaggaaagcacgcagggctgt

SEQ ID NO: 399955 - DNA, 25 bp, Mus musculus
ttaagcgcgacgtacataggcagcc

SEQ ID NO: 399956 - DNA, 25 bp, Mus musculus
cgccgtcgtcatgggaaccaggttt

SEQ ID NO: 399957 - DNA, 25 bp, Mus musculus
ctcggcgcgaggcaagtgttcacgc

SEQ ID NO: 399958 - DNA, 25 bp, Mus musculus
tgccacttagtactcgggctcggcg

SEQ ID NO: 399959 - DNA, 25 bp, Mus musculus
tctgcgcctcagttgccacttagta

SEQ ID NO: 399960 - DNA, 25 bp, Mus musculus
gaagaccggcttggccttgtctccc

SEQ ID NO: 399961 - DNA, 25 bp, Mus musculus
tggtctgttctgaagacatcccaca

SEQ ID NO: 399962 - DNA, 25 bp, Mus musculus
aggcctggcagagctgtctgtgccc

SEQ ID NO: 399963 - DNA, 25 bp, Mus musculus
acggtggctgagaagggtctaatct

SEQ ID NO: 399964 - DNA, 25 bp, Mus musculus
tctaatctgatggacctgcgctgcg

SEQ ID NO: 399965 - DNA, 25 bp, Mus musculus
atggacctgcgctgcgcctccagga

SEQ ID NO: 399966 - DNA, 25 bp, Mus musculus
gcctgcgcattgtgctggtctccac

SEQ ID NO: 399967 - DNA, 25 bp, Mus musculus
gccaagacgaggttgagtagtctcg

SEQ ID NO: 399968 - DNA, 25 bp, Mus musculus
ttgagtagtctcgttttgaattttc

SEQ ID NO: 399969 - DNA, 25 bp, Mus musculus
tgaattttctcccttctgcttacgg

SEQ ID NO: 399970 - DNA, 25 bp, Mus musculus
ttctcccttctgcttacggcggact

SEQ ID NO: 399971 - DNA, 25 bp, Mus musculus
ccctctcgcgttgtggggctcgctg

SEQ ID NO: 399972 - DNA, 25 bp, Mus musculus
ggtgcggagcccgagaacgcaccac

SEQ ID NO: 399973 - DNA, 25 bp, Mus musculus
tgtctgtgcccagcgaccggacgct

SEQ ID NO: 399974 - DNA, 25 bp, Mus musculus
cacggagcatccgagtcctgggccg

SEQ ID NO: 399975 - DNA, 25 bp, Mus musculus
gagaacgcaccaccgccacggagca

SEQ ID NO: 399976 - DNA, 25 bp, Mus musculus
caacccggcacacgcttggagtaca

SEQ ID NO: 399977 - DNA, 25 bp, Mus musculus
ctccaggcttcgttaaccggaatgg

SEQ ID NO: 399978 - DNA, 25 bp, Mus musculus
ggcagagagctccaggcttcgttaa

SEQ ID NO: 399979 - DNA, 25 bp, Mus musculus
cttggagtacacgtcaaggggcaga

SEQ ID NO: 399980 - DNA, 25 bp, Mus musculus
tctgtgtgcgcgaagttccaacacc

SEQ ID NO: 399981 - DNA, 25 bp, Mus musculus
agctcccgctggaccttctcgttgt

SEQ ID NO: 399982 - DNA, 25 bp, Mus musculus
tcgagaccgcgcactgtctgtgtgc

SEQ ID NO: 399983 - DNA, 25 bp, Mus musculus
aggcagggtattcgagaccgcgcac

SEQ ID NO: 399984 - DNA, 25 bp, Mus musculus
cacgagcagcttcggagaagaggca

SEQ ID NO: 399985 - DNA, 25 bp, Mus musculus
cccgagtggacacgagcagcttcgg

SEQ ID NO: 399986 - DNA, 25 bp, Mus musculus
cgtccttcgcagcatcgttctcgga

SEQ ID NO: 399987 - DNA, 25 bp, Mus musculus
cagcatcgttctcggactgcaggtg

SEQ ID NO: 399988 - DNA, 25 bp, Mus musculus
gactgcaggtggctaagctcccgct

SEQ ID NO: 399989 - DNA, 25 bp, Mus musculus
cggcacacgcttggagtacacgtca

SEQ ID NO: 399990 - DNA, 25 bp, Mus musculus
cgagatcccttcgagacgccctagg

SEQ ID NO: 399991 - DNA, 25 bp, Mus musculus
accgctttcagagcctgagcgaggg

SEQ ID NO: 399992 - DNA, 25 bp, Mus musculus
atcccttcgagacgccctagggtcg

SEQ ID NO: 399993 - DNA, 25 bp, Mus musculus
gccggtcctcagctgattcgcagag

SEQ ID NO: 399994 - DNA, 25 bp, Mus musculus
cagctgattcgcagaggcgccgcca

SEQ ID NO: 399995 - DNA, 25 bp, Mus musculus
cgccaggcgaggaaagttccgtccg

SEQ ID NO: 399996 - DNA, 25 bp, Mus musculus
ggagcgacgtcagcacgtcggccct

SEQ ID NO: 399997 - DNA, 25 bp, Mus musculus
gccctcacgtccagctgggtgacta

SEQ ID NO: 399998 - DNA, 25 bp, Mus musculus
acgtccagctgggtgactactgacc

SEQ ID NO: 399999 - DNA, 25 bp, Mus musculus
ctgggtgactactgaccggaatgcc

SEQ ID NO: 400000 - DNA, 25 bp, Mus musculus
ctactgaccggaatgcccaggctgg

SEQ ID NO: 400001 - DNA, 25 bp, Mus musculus
ctagggtcgccggtcctcagctgat

SEQ ID NO: 400002 - DNA, 25 bp, Mus musculus
aggctggctccgaccgctttcagag

SEQ ID NO: 400003 - DNA, 25 bp, Mus musculus
accggaatgcccaggctggctccga

SEQ ID NO: 400004 - DNA, 25 bp, Mus musculus
acttcgccatcttcgccgtgacgtt

SEQ ID NO: 400005 - DNA, 25 bp, Mus musculus
ggtcctgggcgggtccctcattctc

SEQ ID NO: 400006 - DNA, 25 bp, Mus musculus
cctattcgccgaccgcctgaggcca

SEQ ID NO: 400007 - DNA, 25 bp, Mus musculus
cgccaccacggagctcacggccgag

SEQ ID NO: 400008 - DNA, 25 bp, Mus musculus
cgagaggaagcatgctggacttcgc

SEQ ID NO: 400009 - DNA, 25 bp, Mus musculus
ctggacttcgccatcttcgccgtga

SEQ ID NO: 400010 - DNA, 25 bp, Mus musculus
gttccccgtgcgcatgagtgctgtg

SEQ ID NO: 400011 - DNA, 25 bp, Mus musculus
catcttcgccgtgacgttcctgctg

SEQ ID NO: 400012 - DNA, 25 bp, Mus musculus
ccgtgacgttcctgctggcgctggt

SEQ ID NO: 400013 - DNA, 25 bp, Mus musculus
agcggtgctgtacctctacccggta

SEQ ID NO: 400014 - DNA, 25 bp, Mus musculus
ctcattctccctgtcccggacgggt

SEQ ID NO: 400015 - DNA, 25 bp, Mus musculus
gtgctgtacctctacccggtaactc

SEQ ID NO: 400016 - DNA, 25 bp, Mus musculus
ggcgaccgcggctcctattcgccga

SEQ ID NO: 400017 - DNA, 25 bp, Mus musculus
agcatgctggacttcgccatcttcg

SEQ ID NO: 400018 - DNA, 25 bp, Mus musculus
taacaaaggctgctgaggactccca

SEQ ID NO: 400019 - DNA, 25 bp, Mus musculus
agcagaggtgcattcccgcccggct

SEQ ID NO: 400020 - DNA, 25 bp, Mus musculus
ctacacgaatctggagcgggtggcc

SEQ ID NO: 400021 - DNA, 25 bp, Mus musculus
attcccgcccggctaacaaaggctg

SEQ ID NO: 400022 - DNA, 25 bp, Mus musculus
tggcgagtggcgttttctgtctaac

SEQ ID NO: 400023 - DNA, 25 bp, Mus musculus
gccgctgcctctgcgggctgtatga

SEQ ID NO: 400024 - DNA, 25 bp, Mus musculus
tgaggactcccagacccaggaaggc

SEQ ID NO: 400025 - DNA, 25 bp, Mus musculus
ttttctgtctaacgggatcttgctc

SEQ ID NO: 400026 - DNA, 25 bp, Mus musculus
agtcctctcctgtcagtgttccgga

SEQ ID NO: 400027 - DNA, 25 bp, Mus musculus
ctacatccaggtgcgatgcgacgcg

SEQ ID NO: 400028 - DNA, 25 bp, Mus musculus
tgcgagaataactacatccaggtgc

SEQ ID NO: 400029 - DNA, 25 bp, Mus musculus
tggccgactactgcgagaataacta

SEQ ID NO: 400030 - DNA, 25 bp, Mus musculus
cgggctctcttcgacagctacacga

SEQ ID NO: 400031 - DNA, 25 bp, Mus musculus
ctcccgtcgctaggagacgccggaa

SEQ ID NO: 400032 - DNA, 25 bp, Mus musculus
atgaatgagcggagaggaaaatccc

SEQ ID NO: 400033 - DNA, 25 bp, Mus musculus
tggcggagcactcaccgtggcagcc

SEQ ID NO: 400034 - DNA, 25 bp, Mus musculus
tagtgcggagtatcagccctgccgc

SEQ ID NO: 400035 - DNA, 25 bp, Mus musculus
caggtctcattgtctgcacggtgca

SEQ ID NO: 400036 - DNA, 25 bp, Mus musculus
cggggctcagcccaacgctgagagc

SEQ ID NO: 400037 - DNA, 25 bp, Mus musculus
cgctgagagcctgaccggcaaggac

SEQ ID NO: 400038 - DNA, 25 bp, Mus musculus
ccaccggcgccctagtgcggagtat

SEQ ID NO: 400039 - DNA, 25 bp, Mus musculus
agccctgcgctaggcagcagctgct

SEQ ID NO: 400040 - DNA, 25 bp, Mus musculus
ggcgactgactgaccgacccacaga

SEQ ID NO: 400041 - DNA, 25 bp, Mus musculus
aagggcggaccgacttgcgcctgac

SEQ ID NO: 400042 - DNA, 25 bp, Mus musculus
tttccagcgcgcgtccgtgtgagtc

SEQ ID NO: 400043 - DNA, 25 bp, Mus musculus
gtgagtcgcctccaggaaccaatga

SEQ ID NO: 400044 - DNA, 25 bp, Mus musculus
gtgaagcctgcccaatcactcgggt

SEQ ID NO: 400045 - DNA, 25 bp, Mus musculus
ccaatcactcgggtcccagggtctt

SEQ ID NO: 400046 - DNA, 25 bp, Mus musculus
gcgctgcagcggtacctgaagaccc

SEQ ID NO: 400047 - DNA, 25 bp, Mus musculus
gcgagctcacccagcaggcgctgca

SEQ ID NO: 400048 - DNA, 25 bp, Mus musculus
tgcaaggacggccagctccgggtcc

SEQ ID NO: 400049 - DNA, 25 bp, Mus musculus
catcgtggtgccctgcaaggacggc

SEQ ID NO: 400050 - DNA, 25 bp, Mus musculus
caggatgaaagtgacagtgtgcttc

SEQ ID NO: 400051 - DNA, 25 bp, Mus musculus
ggccaggcacctgttcggcccagcc

SEQ ID NO: 400052 - DNA, 25 bp, Mus musculus
ccgcgtctccgagcccgcgttcccg

SEQ ID NO: 400053 - DNA, 25 bp, Mus musculus
cagtttcactttggcgcgtggagcc

SEQ ID NO: 400054 - DNA, 25 bp, Mus musculus
gcacccgcagtttcactttggcgcg

SEQ ID NO: 400055 - DNA, 25 bp, Mus musculus
gtcgctagggccaccgccagaggca

SEQ ID NO: 400056 - DNA, 25 bp, Mus musculus
tgggagccggcgcaaaagtttcctc

SEQ ID NO: 400057 - DNA, 25 bp, Mus musculus
cctcggtgcgctctgtggtccgcga

SEQ ID NO: 400058 - DNA, 25 bp, Mus musculus
tcggtgcaacgcctcggtgcgctct

SEQ ID NO: 400059 - DNA, 25 bp, Mus musculus
ctgcagcggtacctgaagacccggg

SEQ ID NO: 400060 - DNA, 25 bp, Mus musculus
ccagaaaggacaagagccggacgtc

SEQ ID NO: 400061 - DNA, 25 bp, Mus musculus
actccttctgtaacgccattgcagg

SEQ ID NO: 400062 - DNA, 25 bp, Mus musculus
tgcaggtggcattgtgttggattct

SEQ ID NO: 400063 - DNA, 25 bp, Mus musculus
tctgagtgtgtagcatctgagtctc

SEQ ID NO: 400064 - DNA, 25 bp, Mus musculus
tctgagtctcggaatttaggggaaa

SEQ ID NO: 400065 - DNA, 25 bp, Mus musculus
gcggagtttccctccggcagaggca

SEQ ID NO: 400066 - DNA, 25 bp, Mus musculus
gggttgcgtggcaccttaactttga

SEQ ID NO: 400067 - DNA, 25 bp, Mus musculus
accttaactttgatcgcgcggccgc

SEQ ID NO: 400068 - DNA, 25 bp, Mus musculus
ccgcggctgcctctttaatcaggaa

SEQ ID NO: 400069 - DNA, 25 bp, Mus musculus
gcggctctgacatccacatgctgct

SEQ ID NO: 400070 - DNA, 25 bp, Mus musculus
ccacatgctgctcggcctgaaaagg

SEQ ID NO: 400071 - DNA, 25 bp, Mus musculus
tctgaagcacagacactcggccggg

SEQ ID NO: 400072 - DNA, 25 bp, Mus musculus
aggctccagcttaggggaacccaga

SEQ ID NO: 400073 - DNA, 25 bp, Mus musculus
gccggacgtctgactgcttaccact

SEQ ID NO: 400074 - DNA, 25 bp, Mus musculus
tctttgtgtgctccgggagagctca

SEQ ID NO: 400075 - DNA, 25 bp, Mus musculus
tgccgccttaaagcgcgctgaggtt

SEQ ID NO: 400076 - DNA, 25 bp, Mus musculus
tcaagcaccgacgaatgccgcctta

SEQ ID NO: 400077 - DNA, 25 bp, Mus musculus
tcggtcgattctcacggttcaagca

SEQ ID NO: 400078 - DNA, 25 bp, Mus musculus
cttcggtctgttttcgctcggtcga

SEQ ID NO: 400079 - DNA, 25 bp, Mus musculus
gttctcagactcgaacccttcggtc

SEQ ID NO: 400080 - DNA, 25 bp, Mus musculus
gggctagatcgcgtcgccactcttt

SEQ ID NO: 400081 - DNA, 25 bp, Mus musculus
aagcgcgctgaggttttcggttcta

SEQ ID NO: 400082 - DNA, 25 bp, Mus musculus
gcggcgtctcctcctgaactttgca

SEQ ID NO: 400083 - DNA, 25 bp, Mus musculus
catcccgtcagctgagcgcaggagt

SEQ ID NO: 400084 - DNA, 25 bp, Mus musculus
gagtgggccaaggtcaccctcgccg

SEQ ID NO: 400085 - DNA, 25 bp, Mus musculus
tgcagcgtccagcttgcaggaagcc

SEQ ID NO: 400086 - DNA, 25 bp, Mus musculus
atacttatttggcttctgcagcgtc

SEQ ID NO: 400087 - DNA, 25 bp, Mus musculus
cgcgtcgccactctttttcaagttc

SEQ ID NO: 400088 - DNA, 25 bp, Mus musculus
caactgagcaaatacccggccggtc

SEQ ID NO: 400089 - DNA, 25 bp, Mus musculus
cccgcctaagcgcacaaacaggtga

SEQ ID NO: 400090 - DNA, 25 bp, Mus musculus
taactgattggtaccgggagaccta

SEQ ID NO: 400091 - DNA, 25 bp, Mus musculus
ccggtcatggtttcagtcgagtaac

SEQ ID NO: 400092 - DNA, 25 bp, Mus musculus
ggacccgcccagagtagatattatc

SEQ ID NO: 400093 - DNA, 25 bp, Mus musculus
cgctgcgtcacttccagagaagctc

SEQ ID NO: 400094 - DNA, 25 bp, Mus musculus
ctcaatctttggtcacgctgcgtca

SEQ ID NO: 400095 - DNA, 25 bp, Mus musculus
ttcgcacatctgtccctgagcactg

SEQ ID NO: 400096 - DNA, 25 bp, Mus musculus
ctgacgccggaagattcccgtgtta

SEQ ID NO: 400097 - DNA, 25 bp, Mus musculus
tggggaccatctcctatcccagatg

SEQ ID NO: 400098 - DNA, 25 bp, Mus musculus
caggcagcctaagccgcaggaattc

SEQ ID NO: 400099 - DNA, 25 bp, Mus musculus
gaattcgcgcaactctcacagcctg

SEQ ID NO: 400100 - DNA, 25 bp, Mus musculus
acttcaggttcccagtgatgtgcga

SEQ ID NO: 400101 - DNA, 25 bp, Mus musculus
ccctggagaactagcttgtagaagc

SEQ ID NO: 400102 - DNA, 25 bp, Mus musculus
cgcggctgcacctgactcctcgccg

SEQ ID NO: 400103 - DNA, 25 bp, Mus musculus
gcggagtaccttgaacggacaggaa

SEQ ID NO: 400104 - DNA, 25 bp, Mus musculus
taccttgaacggacaggaactggca

SEQ ID NO: 400105 - DNA, 25 bp, Mus musculus
cggacaggaactggcaaagagtttc

SEQ ID NO: 400106 - DNA, 25 bp, Mus musculus
caggaactggcaaagagtttcgagc

SEQ ID NO: 400107 - DNA, 25 bp, Mus musculus
gcaaagagtttcgagccagccgagt

SEQ ID NO: 400108 - DNA, 25 bp, Mus musculus
aaagagtttcgagccagccgagtgc

SEQ ID NO: 400109 - DNA, 25 bp, Mus musculus
cgccctacgggagcccggggatgtg

SEQ ID NO: 400110 - DNA, 25 bp, Mus musculus
cccttccgcagcactcctggggccc

SEQ ID NO: 400111 - DNA, 25 bp, Mus musculus
cccgccgacgctgcccgcgggcgtc

SEQ ID NO: 400112 - DNA, 25 bp, Mus musculus
tcaccctttcattctccgcccgcgg

SEQ ID NO: 400113 - DNA, 25 bp, Mus musculus
ccggcctcacgtaagcgcgctcgcc

SEQ ID NO: 400114 - DNA, 25 bp, Mus musculus
gaaggcggcctccaattcgggccta

SEQ ID NO: 400115 - DNA, 25 bp, Mus musculus
agagaaggcggcctccaattcgggc

SEQ ID NO: 400116 - DNA, 25 bp, Mus musculus
ccaggagggactagaaacacagatt

SEQ ID NO: 400117 - DNA, 25 bp, Mus musculus
aaccctggccgctaagtcaatatgg

SEQ ID NO: 400118 - DNA, 25 bp, Mus musculus
cgtcttcggacctgttcggcaattt

SEQ ID NO: 400119 - DNA, 25 bp, Mus musculus
acttggacctgcagttccgccggaa

SEQ ID NO: 400120 - DNA, 25 bp, Mus musculus
tgcgtccgagcgctttcgttcaact

SEQ ID NO: 400121 - DNA, 25 bp, Mus musculus
tgggccctttagttaccaagtcgca

SEQ ID NO: 400122 - DNA, 25 bp, Mus musculus
gaccgagactaggaacggaccttga

SEQ ID NO: 400123 - DNA, 25 bp, Mus musculus
agggaaacgcctccgtctctatata

SEQ ID NO: 400124 - DNA, 25 bp, Mus musculus
tataaggagttttccggacgctctg

SEQ ID NO: 400125 - DNA, 25 bp, Mus musculus
ccgttccagccttcgccatgggatt

SEQ ID NO: 400126 - DNA, 25 bp, Mus musculus
catgggattcggagacctgaaaacc

SEQ ID NO: 400127 - DNA, 25 bp, Mus musculus
cggcctccaggtgctcaacgattac

SEQ ID NO: 400128 - DNA, 25 bp, Mus musculus
tacctggcggacaagagctacattg

SEQ ID NO: 400129 - DNA, 25 bp, Mus musculus
caccgagtagttccgcggacctgtc

SEQ ID NO: 400130 - DNA, 25 bp, Mus musculus
ctcgctagtgggaccgcagactcca

SEQ ID NO: 400131 - DNA, 25 bp, Mus musculus
gcaatcgccactccgtcagctgttg

SEQ ID NO: 400132 - DNA, 25 bp, Mus musculus
gtgccgccttcttgggctccgcaat

SEQ ID NO: 400133 - DNA, 25 bp, Mus musculus
ttctgcgtgatgaggctccttccta

SEQ ID NO: 400134 - DNA, 25 bp, Mus musculus
aggtcgcacaaacgaacgctgctca

SEQ ID NO: 400135 - DNA, 25 bp, Mus musculus
cgataaccagtgctcggtggccgca

SEQ ID NO: 400136 - DNA, 25 bp, Mus musculus
agagtgagaccacctcccacacggt

SEQ ID NO: 400137 - DNA, 25 bp, Mus musculus
gaaccaccttcagcgcggcgacggt

SEQ ID NO: 400138 - DNA, 25 bp, Mus musculus
ccggagcaggtacagaaccaccttc

SEQ ID NO: 400139 - DNA, 25 bp, Mus musculus
gatttccaggccatcgcgaagcaca

SEQ ID NO: 400140 - DNA, 25 bp, Mus musculus
tactgcggaggttgtggattagctc

SEQ ID NO: 400141 - DNA, 25 bp, Mus musculus
atccacatcgccgagtgacaggtcc

SEQ ID NO: 400142 - DNA, 25 bp, Mus musculus
cgaggaggcaactgcccgtgtccca

SEQ ID NO: 400143 - DNA, 25 bp, Mus musculus
ggagactgcaaaaacgcacggcgtt

SEQ ID NO: 400144 - DNA, 25 bp, Mus musculus
aatcggcaaagcaccttgatgctgc

SEQ ID NO: 400145 - DNA, 25 bp, Mus musculus
gcgacctgggcgtctggtcctctcg

SEQ ID NO: 400146 - DNA, 25 bp, Mus musculus
cttgatgctgcattcgttgttagtc

SEQ ID NO: 400147 - DNA, 25 bp, Mus musculus
ttcaggggccgaaatcggcaaagca

SEQ ID NO: 400148 - DNA, 25 bp, Mus musculus
gttagtctccgccatggtggtcgac

SEQ ID NO: 400149 - DNA, 25 bp, Mus musculus
ccgccatggtggtcgacgacgacga

SEQ ID NO: 400150 - DNA, 25 bp, Mus musculus
gagcgtctccgactgcaagggtagc

SEQ ID NO: 400151 - DNA, 25 bp, Mus musculus
gactgcaagggtagcgtgtactccg

SEQ ID NO: 400152 - DNA, 25 bp, Mus musculus
acaggtgatctgtcgctgaggccaa

SEQ ID NO: 400153 - DNA, 25 bp, Mus musculus
gccaagggagcagctggaacgcctc

SEQ ID NO: 400154 - DNA, 25 bp, Mus musculus
aacgcctcggggaagatgagctttc

SEQ ID NO: 400155 - DNA, 25 bp, Mus musculus
ttcgttgttagtctccgccatggtg

SEQ ID NO: 400156 - DNA, 25 bp, Mus musculus
ctttcggtgtcctgcggcactggat

SEQ ID NO: 400157 - DNA, 25 bp, Mus musculus
atgagctttcggtgtcctgcggcac

SEQ ID NO: 400158 - DNA, 25 bp, Mus musculus
aagacgaggttgtgcctcaaggcac

SEQ ID NO: 400159 - DNA, 25 bp, Mus musculus
gagtcgtggactcacccaccgcgtg

SEQ ID NO: 400160 - DNA, 25 bp, Mus musculus
aagagcgaagacgaggttgtgcctc

SEQ ID NO: 400161 - DNA, 25 bp, Mus musculus
ctcaaggcacgagagcggctcggtt

SEQ ID NO: 400162 - DNA, 25 bp, Mus musculus
gtgcctcaaggcacgagagcggctc

SEQ ID NO: 400163 - DNA, 25 bp, Mus musculus
aagcgagtccgctggagacccgatc

SEQ ID NO: 400164 - DNA, 25 bp, Mus musculus
gtccgctggagacccgatcgggctt

SEQ ID NO: 400165 - DNA, 25 bp, Mus musculus
gtgcccagcaacctcgtgtccgtcg

SEQ ID NO: 400166 - DNA, 25 bp, Mus musculus
atcgggcttggagccggtgtcccga

SEQ ID NO: 400167 - DNA, 25 bp, Mus musculus
gccacgcgcggggttcaaaccagct

SEQ ID NO: 400168 - DNA, 25 bp, Mus musculus
cgcgcggggttcaaaccagctggtt

SEQ ID NO: 400169 - DNA, 25 bp, Mus musculus
cagctggttttcgttagcccgccga

SEQ ID NO: 400170 - DNA, 25 bp, Mus musculus
gctggttttcgttagcccgccgagc

SEQ ID NO: 400171 - DNA, 25 bp, Mus musculus
agccgggagtcgtggactcacccac

SEQ ID NO: 400172 - DNA, 25 bp, Mus musculus
ttgctgccgtcgtgcaacagttgtg

SEQ ID NO: 400173 - DNA, 25 bp, Mus musculus
caacagttgtgtagagctggtcaga

SEQ ID NO: 400174 - DNA, 25 bp, Mus musculus
agagctggtcagagacgccatcgtc

SEQ ID NO: 400175 - DNA, 25 bp, Mus musculus
cgatcgctttgctgccgtcgtgcaa

SEQ ID NO: 400176 - DNA, 25 bp, Mus musculus
tgttaccgatcgctttgctgccgtc

SEQ ID NO: 400177 - DNA, 25 bp, Mus musculus
gtgtgcgtgttaccgatcgctttgc

SEQ ID NO: 400178 - DNA, 25 bp, Mus musculus
agttttgctggggaccgtcgatgct

SEQ ID NO: 400179 - DNA, 25 bp, Mus musculus
cgtcgagcgacacgcgctccgctcc

SEQ ID NO: 400180 - DNA, 25 bp, Mus musculus
agtcgcgactcggagcccgcgtcga

SEQ ID NO: 400181 - DNA, 25 bp, Mus musculus
cttcgctgacgtcagagctgcagtg

SEQ ID NO: 400182 - DNA, 25 bp, Mus musculus
tgttcgcaccttcgctgacgtcaga

SEQ ID NO: 400183 - DNA, 25 bp, Mus musculus
agaaggggcccagtgttcgcacctt

SEQ ID NO: 400184 - DNA, 25 bp, Mus musculus
tgcaggaagtgtgcgctttaagagc

SEQ ID NO: 400185 - DNA, 25 bp, Mus musculus
gcgcgaggcattcggcgccacctgt

SEQ ID NO: 400186 - DNA, 25 bp, Mus musculus
ctgttggtcttggtcaggagtctcc

SEQ ID NO: 400187 - DNA, 25 bp, Mus musculus
gaggtcctgattctctgccattcgg

SEQ ID NO: 400188 - DNA, 25 bp, Mus musculus
ccatcaggggttataagaggtcctg

SEQ ID NO: 400189 - DNA, 25 bp, Mus musculus
tcgcagctcaatcaccgaggcgctg

SEQ ID NO: 400190 - DNA, 25 bp, Mus musculus
gacatgtttgctatagggattcggg

SEQ ID NO: 400191 - DNA, 25 bp, Mus musculus
cttctgttaagacatgtttgctata

SEQ ID NO: 400192 - DNA, 25 bp, Mus musculus
cccggtgcactatgtcttctgttaa

SEQ ID NO: 400193 - DNA, 25 bp, Mus musculus
caggggtcacctcccggtgcactat

SEQ ID NO: 400194 - DNA, 25 bp, Mus musculus
aggagtctccgggacagtagcttct

SEQ ID NO: 400195 - DNA, 25 bp, Mus musculus
ccaacgtggcatcctgttggtcttg

SEQ ID NO: 400196 - DNA, 25 bp, Mus musculus
aaacagtcactctgcccaacgtggc

SEQ ID NO: 400197 - DNA, 25 bp, Mus musculus
gagtgagcaacattggcaggaaaca

SEQ ID NO: 400198 - DNA, 25 bp, Mus musculus
cagtagcttctggtcaggggtcacc

SEQ ID NO: 400199 - DNA, 25 bp, Mus musculus
caacattggcaggaaacagtcactc

SEQ ID NO: 400200 - DNA, 25 bp, Mus musculus
cgctcccggaaaggcggaaagagca

SEQ ID NO: 400201 - DNA, 25 bp, Mus musculus
gtccttctcctgctacctgcgctcg

SEQ ID NO: 400202 - DNA, 25 bp, Mus musculus
tgacgggttgcagccttcccggcgc

SEQ ID NO: 400203 - DNA, 25 bp, Mus musculus
ggccgaccctgacgggttgcagcct

SEQ ID NO: 400204 - DNA, 25 bp, Mus musculus
atgagccatgaagccgcccggcagc

SEQ ID NO: 400205 - DNA, 25 bp, Mus musculus
cccgggagcgatgagccatgaagcc

SEQ ID NO: 400206 - DNA, 25 bp, Mus musculus
cagccactggaggaggctccaagtt

SEQ ID NO: 400207 - DNA, 25 bp, Mus musculus
ccgccactgggagggtgcagccact

SEQ ID NO: 400208 - DNA, 25 bp, Mus musculus
tcagcatccttaggcccggcagcaa

SEQ ID NO: 400209 - DNA, 25 bp, Mus musculus
gcatctgcaagagcatcagcatccg

SEQ ID NO: 400210 - DNA, 25 bp, Mus musculus
ggctacagcatcagcatctgcaaga

SEQ ID NO: 400211 - DNA, 25 bp, Mus musculus
atggccggtgccctttgcgttgcct

SEQ ID NO: 400212 - DNA, 25 bp, Mus musculus
gcggcccatgcaggctacagcatca

SEQ ID NO: 400213 - DNA, 25 bp, Mus musculus
cacgcaggtgcgtgtaacccggacg

SEQ ID NO: 400214 - DNA, 25 bp, Mus musculus
ggcaagctatttttagagggctata

SEQ ID NO: 400215 - DNA, 25 bp, Mus musculus
gggcaaggagctctttgcactcggc

SEQ ID NO: 400216 - DNA, 25 bp, Mus musculus
ccagggagtgttgctgcgacacttg

SEQ ID NO: 400217 - DNA, 25 bp, Mus musculus
cgacacttgcgctggctcctgggac

SEQ ID NO: 400218 - DNA, 25 bp, Mus musculus
gcccgtacccagtgcagatccgagg

SEQ ID NO: 400219 - DNA, 25 bp, Mus musculus
tcccggtcctgggttaagatgcctc

SEQ ID NO: 400220 - DNA, 25 bp, Mus musculus
caaggcggtacgaggcaagctattt

SEQ ID NO: 400221 - DNA, 25 bp, Mus musculus
cctgctgccttacaaggcggtacga

SEQ ID NO: 400222 - DNA, 25 bp, Mus musculus
tgcggatctccctgctgccttacaa

SEQ ID NO: 400223 - DNA, 25 bp, Mus musculus
accaatgcggcactcggagaggacc

SEQ ID NO: 400224 - DNA, 25 bp, Mus musculus
tgaagtcactgaggaccaatgcggc

SEQ ID NO: 400225 - DNA, 25 bp, Mus musculus
cgcgtgtgaccatgtaaggtaaaca

SEQ ID NO: 400226 - DNA, 25 bp, Mus musculus
ccattaggccgcgtgtgaccatgta

SEQ ID NO: 400227 - DNA, 25 bp, Mus musculus
tataaaggggtagaggagtccgcca

SEQ ID NO: 400228 - DNA, 25 bp, Mus musculus
atcgtgcctccagagcgggtctcaa

SEQ ID NO: 400229 - DNA, 25 bp, Mus musculus
cccgccacagtgaggctcggatcgt

SEQ ID NO: 400230 - DNA, 25 bp, Mus musculus
caaatctcctcagctggcgtccgaa

SEQ ID NO: 400231 - DNA, 25 bp, Mus musculus
aacaaagaataatggcggcggactg

SEQ ID NO: 400232 - DNA, 25 bp, Mus musculus
cagagcgggtctcaaaccgcctaca

SEQ ID NO: 400233 - DNA, 25 bp, Mus musculus
ccgggtcgagctcggctgtttccgt

SEQ ID NO: 400234 - DNA, 25 bp, Mus musculus
tcggctgtttccgtgagtggccgct

SEQ ID NO: 400235 - DNA, 25 bp, Mus musculus
taaaactccagcgagatccgggccg

SEQ ID NO: 400236 - DNA, 25 bp, Mus musculus
ccgggccgcgaacgaaagcagtgac

SEQ ID NO: 400237 - DNA, 25 bp, Mus musculus
cagtgacggaggagcttgtaccacc

SEQ ID NO: 400238 - DNA, 25 bp, Mus musculus
tgtaccaccggtaagaggagcagga

SEQ ID NO: 400239 - DNA, 25 bp, Mus musculus
gccgcggtaaagatggagcctccgc

SEQ ID NO: 400240 - DNA, 25 bp, Mus musculus
taaagatggagcctccgcccgagcc

SEQ ID NO: 400241 - DNA, 25 bp, Mus musculus
cgctcgcagcgaacaaagaataatg

SEQ ID NO: 400242 - DNA, 25 bp, Mus musculus
gctgtgtagttcctgtgaggcccta

SEQ ID NO: 400243 - DNA, 25 bp, Mus musculus
tggacgcctttctaaatcctggccg

SEQ ID NO: 400244 - DNA, 25 bp, Mus musculus
ctctgctggccgaaatggacgcctt

SEQ ID NO: 400245 - DNA, 25 bp, Mus musculus
gttttgagcccgaccacatgcgctc

SEQ ID NO: 400246 - DNA, 25 bp, Mus musculus
tgggagagaacactaccgagcatcc

SEQ ID NO: 400247 - DNA, 25 bp, Mus musculus
tcaccgcgtttggtggcagtgaagt

SEQ ID NO: 400248 - DNA, 25 bp, Mus musculus
tgcagagactcctttcggaccctcg

SEQ ID NO: 400249 - DNA, 25 bp, Mus musculus
ccttgcatgggagaaaggccgacct

SEQ ID NO: 400250 - DNA, 25 bp, Mus musculus
tgcggagctcctccttaaaaggctg

SEQ ID NO: 400251 - DNA, 25 bp, Mus musculus
cacgtagatactcacggttccggga

SEQ ID NO: 400252 - DNA, 25 bp, Mus musculus
accctgcagtgcctccacgtagata

SEQ ID NO: 400253 - DNA, 25 bp, Mus musculus
tcgcgcccacgaaagagtcccggga

SEQ ID NO: 400254 - DNA, 25 bp, Mus musculus
atactggcggacaacccgcgggaca

SEQ ID NO: 400255 - DNA, 25 bp, Mus musculus
gcccaaggatgcgtagcgaagtaga

SEQ ID NO: 400256 - DNA, 25 bp, Mus musculus
ctgcggaaacctttgtcaggcgcca

SEQ ID NO: 400257 - DNA, 25 bp, Mus musculus
ggagagtggcgcttccagcttgcca

SEQ ID NO: 400258 - DNA, 25 bp, Mus musculus
agtggcgcttccagcttgccacgcg

SEQ ID NO: 400259 - DNA, 25 bp, Mus musculus
ttccagcttgccacgcgcaagggca

SEQ ID NO: 400260 - DNA, 25 bp, Mus musculus
ttccggaaggtaagcgcgcacgcct

SEQ ID NO: 400261 - DNA, 25 bp, Mus musculus
aaggtaagcgcgcacgcctcgaagc

SEQ ID NO: 400262 - DNA, 25 bp, Mus musculus
ccaccgcactagctccggagggagg

SEQ ID NO: 400263 - DNA, 25 bp, Mus musculus
aagcgcgcacgcctcgaagcgcggt

SEQ ID NO: 400264 - DNA, 25 bp, Mus musculus
ttctcgcgggtctggacgcagacca

SEQ ID NO: 400265 - DNA, 25 bp, Mus musculus
gtctggacgcagaccactcaccggt

SEQ ID NO: 400266 - DNA, 25 bp, Mus musculus
gcagaccactcaccggtcccgctgg

SEQ ID NO: 400267 - DNA, 25 bp, Mus musculus
aaacctttgtcaggcgccaggtgac

SEQ ID NO: 400268 - DNA, 25 bp, Mus musculus
tggagctgcggctctgcccaccgca

SEQ ID NO: 400269 - DNA, 25 bp, Mus musculus
cggtctgcggaaacctttgtcaggc

SEQ ID NO: 400270 - DNA, 25 bp, Mus musculus
tcgagtaacaaactgccgcagctcc

SEQ ID NO: 400271 - DNA, 25 bp, Mus musculus
ttattcctggcgcaggcctggacac

SEQ ID NO: 400272 - DNA, 25 bp, Mus musculus
ccttcctgccgggattattcctggc

SEQ ID NO: 400273 - DNA, 25 bp, Mus musculus
gccctcgcagactagtccgctgtgg

SEQ ID NO: 400274 - DNA, 25 bp, Mus musculus
agtggctgcgtctcccagcgcttgt

SEQ ID NO: 400275 - DNA, 25 bp, Mus musculus
aggagccggctagcggccttcagtt

SEQ ID NO: 400276 - DNA, 25 bp, Mus musculus
attggctacccgtcaccaggtgacc

SEQ ID NO: 400277 - DNA, 25 bp, Mus musculus
gaagtccgggtctgattggctaccc

SEQ ID NO: 400278 - DNA, 25 bp, Mus musculus
gctttgtgagtcacgtgcctgggcc

SEQ ID NO: 400279 - DNA, 25 bp, Mus musculus
attcgcgcggctcagcttaagggac

SEQ ID NO: 400280 - DNA, 25 bp, Mus musculus
tggaaaccagaattcgcgcggctca

SEQ ID NO: 400281 - DNA, 25 bp, Mus musculus
cgcagctcgagatgaatggaaacca

SEQ ID NO: 400282 - DNA, 25 bp, Mus musculus
cggactcggcgcagctcgagatgaa

SEQ ID NO: 400283 - DNA, 25 bp, Mus musculus
ggcggcctcgagtaacaaactgccg

SEQ ID NO: 400284 - DNA, 25 bp, Mus musculus
gccggtgcgcaccttgttgtagagt

SEQ ID NO: 400285 - DNA, 25 bp, Mus musculus
ttagggctccgactccaaggacaga

SEQ ID NO: 400286 - DNA, 25 bp, Mus musculus
gcagcactcagttccacaccagata

SEQ ID NO: 400287 - DNA, 25 bp, Mus musculus
aactgtttctggaaggcgctgcctc

SEQ ID NO: 400288 - DNA, 25 bp, Mus musculus
ccgggctggcaacctgttggtttct

SEQ ID NO: 400289 - DNA, 25 bp, Mus musculus
ttccctctccggagtcttgagtgtg

SEQ ID NO: 400290 - DNA, 25 bp, Mus musculus
gggtcgagccatcgtctccttcttc

SEQ ID NO: 400291 - DNA, 25 bp, Mus musculus
tcggcacatgggcaccgtgatttcc

SEQ ID NO: 400292 - DNA, 25 bp, Mus musculus
tcgtcctgcgtgtcatggttgaact

SEQ ID NO: 400293 - DNA, 25 bp, Mus musculus
cagaattggtgcacctccaggcctg

SEQ ID NO: 400294 - DNA, 25 bp, Mus musculus
tggatctccacaagcggccagaatt

SEQ ID NO: 400295 - DNA, 25 bp, Mus musculus
agcggcttgtggtagtcaggcaaac

SEQ ID NO: 400296 - DNA, 25 bp, Mus musculus
atccatacacagaacctcggcgtcg

SEQ ID NO: 400297 - DNA, 25 bp, Mus musculus
ggcttcgcttcggttataatccata

SEQ ID NO: 400298 - DNA, 25 bp, Mus musculus
ccatgtgcgagaagccaggttacgg

SEQ ID NO: 400299 - DNA, 25 bp, Mus musculus
gcccgggtctgtagtaacgggctga

SEQ ID NO: 400300 - DNA, 25 bp, Mus musculus
ccttctctctcctggactatgggct

SEQ ID NO: 400301 - DNA, 25 bp, Mus musculus
agcccagatgggagcaacagagatg

SEQ ID NO: 400302 - DNA, 25 bp, Mus musculus
agcccggatgtggagtctgagggcg

SEQ ID NO: 400303 - DNA, 25 bp, Mus musculus
cctcggggtgaagtcagaggctgag

SEQ ID NO: 400304 - DNA, 25 bp, Mus musculus
gtccactgctggtcgcgtgcaacct

SEQ ID NO: 400305 - DNA, 25 bp, Mus musculus
gccaggttacgggtggacgctccga

SEQ ID NO: 400306 - DNA, 25 bp, Mus musculus
cccagatgggagcaacagagatgag

SEQ ID NO: 400307 - DNA, 25 bp, Mus musculus
ttctctctcctggactatgggctcc

SEQ ID NO: 400308 - DNA, 25 bp, Mus musculus
gctccatgtgcgagaagccaggtta

SEQ ID NO: 400309 - DNA, 25 bp, Mus musculus
tatgggctccatgtgcgagaagcca

SEQ ID NO: 400310 - DNA, 25 bp, Mus musculus
ctcctggactatgggctccatgtgc

SEQ ID NO: 400311 - DNA, 25 bp, Mus musculus
tctctcctggactatgggctccatg

SEQ ID NO: 400312 - DNA, 25 bp, Mus musculus
cgcgaaatacaacagaaagcggtgc

SEQ ID NO: 400313 - DNA, 25 bp, Mus musculus
atacaacagaaagcggtgcgtggga

SEQ ID NO: 400314 - DNA, 25 bp, Mus musculus
agctccggggatgcgtcatcccgtc

SEQ ID NO: 400315 - DNA, 25 bp, Mus musculus
tgaggaggatgctcaccgcggctct

SEQ ID NO: 400316 - DNA, 25 bp, Mus musculus
tcaccgccagcgactgcgctccagc

SEQ ID NO: 400317 - DNA, 25 bp, Mus musculus
ctccagctgccgaccatcccggccc

SEQ ID NO: 400318 - DNA, 25 bp, Mus musculus
ctcgcggtcccacgcccaaaagctt

SEQ ID NO: 400319 - DNA, 25 bp, Mus musculus
ggcagcccggcaacaggatccgatt

SEQ ID NO: 400320 - DNA, 25 bp, Mus musculus
agcccggcaacaggatccgattaca

SEQ ID NO: 400321 - DNA, 25 bp, Mus musculus
acaggatccgattacacagagttcc

SEQ ID NO: 400322 - DNA, 25 bp, Mus musculus
atccgattacacagagttccagccg

SEQ ID NO: 400323 - DNA, 25 bp, Mus musculus
tacacagagttccagccggtgagga

SEQ ID NO: 400324 - DNA, 25 bp, Mus musculus
cagccggtgaggaccggtccctcct

SEQ ID NO: 400325 - DNA, 25 bp, Mus musculus
ccctcctacgggaggagcaggcggt

SEQ ID NO: 400326 - DNA, 25 bp, Mus musculus
tgacggtgcccgagaaacgtttgtc

SEQ ID NO: 400327 - DNA, 25 bp, Mus musculus
acagggtgtcgcgtgagactttgct

SEQ ID NO: 400328 - DNA, 25 bp, Mus musculus
gcccgagaaacgtttgtccttctga

SEQ ID NO: 400329 - DNA, 25 bp, Mus musculus
tccttctgagggtcgtagttcttca

SEQ ID NO: 400330 - DNA, 25 bp, Mus musculus
ttctgagggtcgtagttcttcaggc

SEQ ID NO: 400331 - DNA, 25 bp, Mus musculus
agggtcgtagttcttcaggctgatc

SEQ ID NO: 400332 - DNA, 25 bp, Mus musculus
ggtcgtagttcttcaggctgatctg

SEQ ID NO: 400333 - DNA, 25 bp, Mus musculus
tcgtagttcttcaggctgatctgca

SEQ ID NO: 400334 - DNA, 25 bp, Mus musculus
ttcttcaggctgatctgcagctcca

SEQ ID NO: 400335 - DNA, 25 bp, Mus musculus
tctgcagctccaccgtctccagaaa

SEQ ID NO: 400336 - DNA, 25 bp, Mus musculus
ttgcgctggttcccgtgcaggactt

SEQ ID NO: 400337 - DNA, 25 bp, Mus musculus
caccgcctcgtacagggtgtcgcgt

SEQ ID NO: 400338 - DNA, 25 bp, Mus musculus
cgagaaacgtttgtccttctgaggg

SEQ ID NO: 400339 - DNA, 25 bp, Mus musculus
cctcgtacagggtgtcgcgtgagac

SEQ ID NO: 400340 - DNA, 25 bp, Mus musculus
agcgaggacgccacctactgacagg

SEQ ID NO: 400341 - DNA, 25 bp, Mus musculus
cccagttagatcagcatctgccaca

SEQ ID NO: 400342 - DNA, 25 bp, Mus musculus
cttcgctcggaagcccagcggcagg

SEQ ID NO: 400343 - DNA, 25 bp, Mus musculus
agcggcagggtcaaggctgtttaac

SEQ ID NO: 400344 - DNA, 25 bp, Mus musculus
tcaaggctgtttaactcttcccggc

SEQ ID NO: 400345 - DNA, 25 bp, Mus musculus
cattcgccgcctccgactttgtggg

SEQ ID NO: 400346 - DNA, 25 bp, Mus musculus
tgggccgaggcatagattgagatta

SEQ ID NO: 400347 - DNA, 25 bp, Mus musculus
attaagtctgggatgcagcggtccg

SEQ ID NO: 400348 - DNA, 25 bp, Mus musculus
ctactgacaggctatcggaagcgcc

SEQ ID NO: 400349 - DNA, 25 bp, Mus musculus
ctcgggaacaccctgcagttgagga

SEQ ID NO: 400350 - DNA, 25 bp, Mus musculus
cgctctaagccttggggcacctgta

SEQ ID NO: 400351 - DNA, 25 bp, Mus musculus
atcggaagcgccgagaccgagtgtt

SEQ ID NO: 400352 - DNA, 25 bp, Mus musculus
acgccgcggagattcctcgggaaca

SEQ ID NO: 400353 - DNA, 25 bp, Mus musculus
ccgcgcgtacacacaagctgtaata

SEQ ID NO: 400354 - DNA, 25 bp, Mus musculus
gcgtctaatgcctggcgcgcgtgat

SEQ ID NO: 400355 - DNA, 25 bp, Mus musculus
ccggcccttggagccggttgatgat

SEQ ID NO: 400356 - DNA, 25 bp, Mus musculus
cgagaagccgcagttaccgcgtaag

SEQ ID NO: 400357 - DNA, 25 bp, Mus musculus
ctgcctgagaaagccggcgctgtgc

SEQ ID NO: 400358 - DNA, 25 bp, Mus musculus
cagcgactggctggcgtctaatgcc

SEQ ID NO: 400359 - DNA, 25 bp, Mus musculus
cgcgcgtgatgctcacatgcaccgt

SEQ ID NO: 400360 - DNA, 25 bp, Mus musculus
cgcttccttcaggatggctgaggca

SEQ ID NO: 400361 - DNA, 25 bp, Mus musculus
gctgaggcagcgttaagtcctctgg

SEQ ID NO: 400362 - DNA, 25 bp, Mus musculus
ggggtctagaacgatactctctggg

SEQ ID NO: 400363 - DNA, 25 bp, Mus musculus
atactctctgggttggattctttca

SEQ ID NO: 400364 - DNA, 25 bp, Mus musculus
gggttggattctttcagcctgaaca

SEQ ID NO: 400365 - DNA, 25 bp, Mus musculus
cctgaacatctgatcggaaggtcta

SEQ ID NO: 400366 - DNA, 25 bp, Mus musculus
taccgcgtaagcctctgggcttctc

SEQ ID NO: 400367 - DNA, 25 bp, Mus musculus
tgaacacatacggtaacagcgactg

SEQ ID NO: 400368 - DNA, 25 bp, Mus musculus
cggagaagctctagctctgcgagta

SEQ ID NO: 400369 - DNA, 25 bp, Mus musculus
gtgaccgcgggtgcgtcctctttcc

SEQ ID NO: 400370 - DNA, 25 bp, Mus musculus
tttccgcgcccaggtaagacatcgt

SEQ ID NO: 400371 - DNA, 25 bp, Mus musculus
ccaggtaagacatcgtcccgcctag

SEQ ID NO: 400372 - DNA, 25 bp, Mus musculus
gtaagacatcgtcccgcctagctca

SEQ ID NO: 400373 - DNA, 25 bp, Mus musculus
tccttcctcccgtgcctctgccaga

SEQ ID NO: 400374 - DNA, 25 bp, Mus musculus
ccagccaggagagcaggaaccggac

SEQ ID NO: 400375 - DNA, 25 bp, Mus musculus
aggaaccggactggctggtctctgc

SEQ ID NO: 400376 - DNA, 25 bp, Mus musculus
ggtctctgctggaccggtcccctgt

SEQ ID NO: 400377 - DNA, 25 bp, Mus musculus
tccgcttccctacggcctctttctc

SEQ ID NO: 400378 - DNA, 25 bp, Mus musculus
catcctctctacctccgcttcccta

SEQ ID NO: 400379 - DNA, 25 bp, Mus musculus
ctcccacggagaagctctagctctg

SEQ ID NO: 400380 - DNA, 25 bp, Mus musculus
ctctgcgagtaagctgtgaccgcgg

SEQ ID NO: 400381 - DNA, 25 bp, Mus musculus
ctagctctgcgagtaagctgtgacc

SEQ ID NO: 400382 - DNA, 25 bp, Mus musculus
cgtgccatgcggagcgtggactccc

SEQ ID NO: 400383 - DNA, 25 bp, Mus musculus
actcccgggagccaccatcatggtg

SEQ ID NO: 400384 - DNA, 25 bp, Mus musculus
ccatcatggtgaagaggaagagctc

SEQ ID NO: 400385 - DNA, 25 bp, Mus musculus
tcatggtgaagaggaagagctccga

SEQ ID NO: 400386 - DNA, 25 bp, Mus musculus
ggaacccgcgctgggttctgcggta

SEQ ID NO: 400387 - DNA, 25 bp, Mus musculus
ggaagagctccgagggccaggagca

SEQ ID NO: 400388 - DNA, 25 bp, Mus musculus
cgcggcatccctctgcccatccaga

SEQ ID NO: 400389 - DNA, 25 bp, Mus musculus
cagaccttcctgtggcggcaaacca

SEQ ID NO: 400390 - DNA, 25 bp, Mus musculus
agaccttcctgtggcggcaaaccag

SEQ ID NO: 400391 - DNA, 25 bp, Mus musculus
ttcctgtggcggcaaaccaggtgag

SEQ ID NO: 400392 - DNA, 25 bp, Mus musculus
tccacagtgggaggtgctgaaagca

SEQ ID NO: 400393 - DNA, 25 bp, Mus musculus
ttctgcggtaggactcccgggagcc

SEQ ID NO: 400394 - DNA, 25 bp, Mus musculus
aggactcccgggagccaccatcatg

SEQ ID NO: 400395 - DNA, 25 bp, Mus musculus
catcagccatgttccgcgcgcgggg

SEQ ID NO: 400396 - DNA, 25 bp, Mus musculus
ccggatacccatcttcgttctcttg

SEQ ID NO: 400397 - DNA, 25 bp, Mus musculus
cggttttgcactaaggcaggcgtgc

SEQ ID NO: 400398 - DNA, 25 bp, Mus musculus
atcttcgttctcttgcgccctttca

SEQ ID NO: 400399 - DNA, 25 bp, Mus musculus
ttgcgccctttcatccaatgcaagg

SEQ ID NO: 400400 - DNA, 25 bp, Mus musculus
tccaatgcaaggtgtggagcgctgc

SEQ ID NO: 400401 - DNA, 25 bp, Mus musculus
ggagcgctgcttgtgcaagaacttg

SEQ ID NO: 400402 - DNA, 25 bp, Mus musculus
caagaacttgcggttttgcactaag

SEQ ID NO: 400403 - DNA, 25 bp, Mus musculus
tgggtgcgtggaatacacaggacac

SEQ ID NO: 400404 - DNA, 25 bp, Mus musculus
tacacaggacacatacgtgctgctg

SEQ ID NO: 400405 - DNA, 25 bp, Mus musculus
acatacgtgctgctgcggtcagtca

SEQ ID NO: 400406 - DNA, 25 bp, Mus musculus
cggtcagtcagcaggggctgttaat

SEQ ID NO: 400407 - DNA, 25 bp, Mus musculus
agcaggggctgttaataccgtgttc

SEQ ID NO: 400408 - DNA, 25 bp, Mus musculus
cgacttcatcgtgcgcacccggata

SEQ ID NO: 400409 - DNA, 25 bp, Mus musculus
cctgtgggacttcctcgacttcatc

SEQ ID NO: 400410 - DNA, 25 bp, Mus musculus
cgggagccacctccagtgttcagga

SEQ ID NO: 400411 - DNA, 25 bp, Mus musculus
cagggcagctgcttccggcagagtc

SEQ ID NO: 400412 - DNA, 25 bp, Mus musculus
aactaactagttctcgacaaagccg

SEQ ID NO: 400413 - DNA, 25 bp, Mus musculus
cgcgacttgctcgatcgaactcaga

SEQ ID NO: 400414 - DNA, 25 bp, Mus musculus
aggcccaacgggacaggcgcgactt

SEQ ID NO: 400415 - DNA, 25 bp, Mus musculus
agtgttcaggatcttcctctggtga

SEQ ID NO: 400416 - DNA, 25 bp, Mus musculus
ccgtaacctgtggtgataggacccg

SEQ ID NO: 400417 - DNA, 25 bp, Mus musculus
tgaactcgtagagaaactgaggccc

SEQ ID NO: 400418 - DNA, 25 bp, Mus musculus
cctggatgtaatggacgggtaactc

SEQ ID NO: 400419 - DNA, 25 bp, Mus musculus
gccgactacctgcacctggatgtaa

SEQ ID NO: 400420 - DNA, 25 bp, Mus musculus
tcaacagcgacctggccaacctggg

SEQ ID NO: 400421 - DNA, 25 bp, Mus musculus
gggctgcaagatcggcccgtccatc

SEQ ID NO: 400422 - DNA, 25 bp, Mus musculus
gctcactcgctctagggaaccggca

SEQ ID NO: 400423 - DNA, 25 bp, Mus musculus
gcccaatcgggacggagtcttggct

SEQ ID NO: 400424 - DNA, 25 bp, Mus musculus
aagtggcccagcgtgcgcgacccta

SEQ ID NO: 400425 - DNA, 25 bp, Mus musculus
gcaggccttataactaatctcggtt

SEQ ID NO: 400426 - DNA, 25 bp, Mus musculus
gcgtccagaggagcaggccttataa

SEQ ID NO: 400427 - DNA, 25 bp, Mus musculus
acagcgggccaagggccacaccgaa

SEQ ID NO: 400428 - DNA, 25 bp, Mus musculus
tgtgcgccatgctgcaccgtctgct

SEQ ID NO: 400429 - DNA, 25 bp, Mus musculus
agaagcggccgcttgtgcccgcact

SEQ ID NO: 400430 - DNA, 25 bp, Mus musculus
gtacccggctagagacggacgccgc

SEQ ID NO: 400431 - DNA, 25 bp, Mus musculus
tgcgcgaccctaaggcgctcctgta

SEQ ID NO: 400432 - DNA, 25 bp, Mus musculus
ttaagcagaccgcaggattcgcacc

SEQ ID NO: 400433 - DNA, 25 bp, Mus musculus
ctcggttaagatttggagaccattg

SEQ ID NO: 400434 - DNA, 25 bp, Mus musculus
ctctccgcacacacggggttaagca

SEQ ID NO: 400435 - DNA, 25 bp, Mus musculus
gtgcccgcacttcgaagcgtccaga

SEQ ID NO: 400436 - DNA, 25 bp, Mus musculus
gacggacgccgccaacaaggaagcc

SEQ ID NO: 400437 - DNA, 25 bp, Mus musculus
cgctgccgagaaaggaagtggccca

SEQ ID NO: 400438 - DNA, 25 bp, Mus musculus
gcacgcgccagccaaaacaaaaggg

SEQ ID NO: 400439 - DNA, 25 bp, Mus musculus
cagcaacaccaactcggaccggtta

SEQ ID NO: 400440 - DNA, 25 bp, Mus musculus
tttgggaccacacaacaccgtcctg

SEQ ID NO: 400441 - DNA, 25 bp, Mus musculus
ttctaaaggccaaatccataacggc

SEQ ID NO: 400442 - DNA, 25 bp, Mus musculus
gccgaggcgatctctagctgtccgc

SEQ ID NO: 400443 - DNA, 25 bp, Mus musculus
gcagtccaacggcaagcagggttcg

SEQ ID NO: 400444 - DNA, 25 bp, Mus musculus
caaagcacggtcttgtgccggggcc

SEQ ID NO: 400445 - DNA, 25 bp, Mus musculus
aagaaattaatgtcgccgctggcca

SEQ ID NO: 400446 - DNA, 25 bp, Mus musculus
ccgtgtctgccaaggctgttaggtt

SEQ ID NO: 400447 - DNA, 25 bp, Mus musculus
aaaaccacgtgttccgccttctgcg

SEQ ID NO: 400448 - DNA, 25 bp, Mus musculus
gccaagctcagcgttacggaaagct

SEQ ID NO: 400449 - DNA, 25 bp, Mus musculus
tacggaaagcttcccacagagcgcc

SEQ ID NO: 400450 - DNA, 25 bp, Mus musculus
accgtcctgcatttatttctcctta

SEQ ID NO: 400451 - DNA, 25 bp, Mus musculus
tagccgtttaaatttggctgcggtc

SEQ ID NO: 400452 - DNA, 25 bp, Mus musculus
agcccgaatgtctgtaccgtccatg

SEQ ID NO: 400453 - DNA, 25 bp, Mus musculus
cttatcgtcgcctttgctggggacc

SEQ ID NO: 400454 - DNA, 25 bp, Mus musculus
tgtaccgtccatgtcaacagtgccc

SEQ ID NO: 400455 - DNA, 25 bp, Mus musculus
gcgtctcctcgccattacctcattc

SEQ ID NO: 400456 - DNA, 25 bp, Mus musculus
accaatcccagcctgtccaggggtg

SEQ ID NO: 400457 - DNA, 25 bp, Mus musculus
gtagccggctgtcctcgcgactttt

SEQ ID NO: 400458 - DNA, 25 bp, Mus musculus
tgctcctgtcgcgagacttcctgct

SEQ ID NO: 400459 - DNA, 25 bp, Mus musculus
tggcggaccctaaatacgccgatct

SEQ ID NO: 400460 - DNA, 25 bp, Mus musculus
ttctggactccagacccgactgggc

SEQ ID NO: 400461 - DNA, 25 bp, Mus musculus
gtcgggccctttttctggcagtagc

SEQ ID NO: 400462 - DNA, 25 bp, Mus musculus
tttttctggcagtagccggtttctc

SEQ ID NO: 400463 - DNA, 25 bp, Mus musculus
tagccggtttctccgcccagaaatc

SEQ ID NO: 400464 - DNA, 25 bp, Mus musculus
ggcgcttaccacttgagcccgaatg

SEQ ID NO: 400465 - DNA, 25 bp, Mus musculus
gctgtcctcgcgacttttgctgtcc

SEQ ID NO: 400466 - DNA, 25 bp, Mus musculus
ccggcttgaccgtagcgcgtcacac

SEQ ID NO: 400467 - DNA, 25 bp, Mus musculus
cgctcccgctaaagctgggacaaca

SEQ ID NO: 400468 - DNA, 25 bp, Mus musculus
cccgctaaagctgggacaacacttt

SEQ ID NO: 400469 - DNA, 25 bp, Mus musculus
aagctgggacaacactttcaaagtc

SEQ ID NO: 400470 - DNA, 25 bp, Mus musculus
acactttcaaagtcagttcacggga

SEQ ID NO: 400471 - DNA, 25 bp, Mus musculus
ctttcaaagtcagttcacgggacac

SEQ ID NO: 400472 - DNA, 25 bp, Mus musculus
ttcacgggacactgtaggacgtggg

SEQ ID NO: 400473 - DNA, 25 bp, Mus musculus
gcccaggcctggagcgagcattagg

SEQ ID NO: 400474 - DNA, 25 bp, Mus musculus
agttctccacgccacagcgggcagc

SEQ ID NO: 400475 - DNA, 25 bp, Mus musculus
gcattaggggttgccttgccttttg

SEQ ID NO: 400476 - DNA, 25 bp, Mus musculus
gcactactcggtggcagagcgccca

SEQ ID NO: 400477 - DNA, 25 bp, Mus musculus
ggggtgatcgctcccgctaaagctg

SEQ ID NO: 400478 - DNA, 25 bp, Mus musculus
actactcggtggcagagcgcccagg

SEQ ID NO: 400479 - DNA, 25 bp, Mus musculus
cgagcattaggggttgccttgcctt

SEQ ID NO: 400480 - DNA, 25 bp, Mus musculus
ggccagcgacttgttataatcggca

SEQ ID NO: 400481 - DNA, 25 bp, Mus musculus
gagatgatggaacccgcacgcctct

SEQ ID NO: 400482 - DNA, 25 bp, Mus musculus
caatcaacgggcacgagaaggcaga

SEQ ID NO: 400483 - DNA, 25 bp, Mus musculus
cttcctgtaggcctggccaatcaac

SEQ ID NO: 400484 - DNA, 25 bp, Mus musculus
gatgcggcgcgtttaccgcccactt

SEQ ID NO: 400485 - DNA, 25 bp, Mus musculus
cgcaaaccgcgcagcggcgacaata

SEQ ID NO: 400486 - DNA, 25 bp, Mus musculus
gtcccacgcccacgagtggggagca

SEQ ID NO: 400487 - DNA, 25 bp, Mus musculus
ggacgcgactgaaggccctttgaca

SEQ ID NO: 400488 - DNA, 25 bp, Mus musculus
cagaacaggggaaagagagatctca

SEQ ID NO: 400489 - DNA, 25 bp, Mus musculus
gccgcaagcgaacctgcagaacagg

SEQ ID NO: 400490 - DNA, 25 bp, Mus musculus
tctgagccatgacgccgcaagcgaa

SEQ ID NO: 400491 - DNA, 25 bp, Mus musculus
ttcggaaaggccctctgagccatga

SEQ ID NO: 400492 - DNA, 25 bp, Mus musculus
cgacaataacagatgcggcgcgttt

SEQ ID NO: 400493 - DNA, 25 bp, Mus musculus
atcggcataaggattcggaaaggcc

SEQ ID NO: 400494 - DNA, 25 bp, Mus musculus
cccagctcgagaaggagggaacctc

SEQ ID NO: 400495 - DNA, 25 bp, Mus musculus
tgcgccagcatgctcaggtgccaag

SEQ ID NO: 400496 - DNA, 25 bp, Mus musculus
agtcccgtcgccagcttcatttttg

SEQ ID NO: 400497 - DNA, 25 bp, Mus musculus
gcgattctccggtttggtttgattc

SEQ ID NO: 400498 - DNA, 25 bp, Mus musculus
agggaacctccactgacgggctcag

SEQ ID NO: 400499 - DNA, 25 bp, Mus musculus
acaacgggcgccaccagaagcgatc

SEQ ID NO: 400500 - DNA, 25 bp, Mus musculus
gcgatcccgcttaggctcccagaaa

SEQ ID NO: 400501 - DNA, 25 bp, Mus musculus
gcgaagtcatttgtagcatcaatta

SEQ ID NO: 400502 - DNA, 25 bp, Mus musculus
cagcccgaagaggtgcagcgattct

SEQ ID NO: 400503 - DNA, 25 bp, Mus musculus
gagaccgcgacccacctgactgaga

SEQ ID NO: 400504 - DNA, 25 bp, Mus musculus
tttttggcaagtctcagatcccgcg

SEQ ID NO: 400505 - DNA, 25 bp, Mus musculus
taccatagccacttgcgagcacgcg

SEQ ID NO: 400506 - DNA, 25 bp, Mus musculus
tggtgctccgagcacaacgtacagc

SEQ ID NO: 400507 - DNA, 25 bp, Mus musculus
agatcccgcgctgacaattacatgt

SEQ ID NO: 400508 - DNA, 25 bp, Mus musculus
aggcaggcggcttttggccacagaa

SEQ ID NO: 400509 - DNA, 25 bp, Mus musculus
cagaagcttgctgtccgtccgtccg

SEQ ID NO: 400510 - DNA, 25 bp, Mus musculus
gccgccgaggagagcatctgcttcc

SEQ ID NO: 400511 - DNA, 25 bp, Mus musculus
agagcatctgcttcccccaggctgg

SEQ ID NO: 400512 - DNA, 25 bp, Mus musculus
ggccaccacgggcttcctgcgagtt

SEQ ID NO: 400513 - DNA, 25 bp, Mus musculus
gggcttcctgcgagttgctccacct

SEQ ID NO: 400514 - DNA, 25 bp, Mus musculus
aggtggagcctgaactcacgcaatc

SEQ ID NO: 400515 - DNA, 25 bp, Mus musculus
ctccgccaggtggagcctgaactca

SEQ ID NO: 400516 - DNA, 25 bp, Mus musculus
cattttgcaaggttcagaggtcacg

SEQ ID NO: 400517 - DNA, 25 bp, Mus musculus
tgaactcacgcaatcattttgcaag

SEQ ID NO: 400518 - DNA, 25 bp, Mus musculus
agcctgaactcacgcaatcattttg

SEQ ID NO: 400519 - DNA, 25 bp, Mus musculus
tgcaaggttcagaggtcacgctgtg

SEQ ID NO: 400520 - DNA, 25 bp, Mus musculus
tggccacagaagcttgctgtccgtc

SEQ ID NO: 400521 - DNA, 25 bp, Mus musculus
gcggcttttggccacagaagcttgc

SEQ ID NO: 400522 - DNA, 25 bp, Mus musculus
tcgcagctgctgctcgcccatgtgg

SEQ ID NO: 400523 - DNA, 25 bp, Mus musculus
tggcttcgatgtgctggatctccac

SEQ ID NO: 400524 - DNA, 25 bp, Mus musculus
gtgatggaggccaacttttacagct

SEQ ID NO: 400525 - DNA, 25 bp, Mus musculus
tgtgatggaggccaacttttacagc

SEQ ID NO: 400526 - DNA, 25 bp, Mus musculus
cctgcgtgaagatgtgatggaggcc

SEQ ID NO: 400527 - DNA, 25 bp, Mus musculus
agggtgcccctcacgcctgcgtgaa

SEQ ID NO: 400528 - DNA, 25 bp, Mus musculus
gggcttcatcctgcgggatgcccca

SEQ ID NO: 400529 - DNA, 25 bp, Mus musculus
tgtgctggatctccacttccacttc

SEQ ID NO: 400530 - DNA, 25 bp, Mus musculus
acttccgccatgcagggcagcatcg

SEQ ID NO: 400531 - DNA, 25 bp, Mus musculus
ccatgcagggcagcatcggctgagc

SEQ ID NO: 400532 - DNA, 25 bp, Mus musculus
tcgatgtgctggatctccacttcca

SEQ ID NO: 400533 - DNA, 25 bp, Mus musculus
cgtgcactgggatgagcgagcgcac

SEQ ID NO: 400534 - DNA, 25 bp, Mus musculus
gagcgcaccgctacctctcgcagct

SEQ ID NO: 400535 - DNA, 25 bp, Mus musculus
gcttcgatgtgctggatctccactt

SEQ ID NO: 400536 - DNA, 25 bp, Mus musculus
gccgtagtaactgcggacgcgcaga

SEQ ID NO: 400537 - DNA, 25 bp, Mus musculus
gtatccttctggtggcctcccgggc

SEQ ID NO: 400538 - DNA, 25 bp, Mus musculus
cgcgttgccgtagtaactgcggacg

SEQ ID NO: 400539 - DNA, 25 bp, Mus musculus
tctcgcgagagtcgcgacgccagtc

SEQ ID NO: 400540 - DNA, 25 bp, Mus musculus
caagcatggctgctccgtctggggt

SEQ ID NO: 400541 - DNA, 25 bp, Mus musculus
gagctgggcattggcttgtcaccca

SEQ ID NO: 400542 - DNA, 25 bp, Mus musculus
tgggcattggcttgtcacccaccgg

SEQ ID NO: 400543 - DNA, 25 bp, Mus musculus
ggcttgtcacccaccggcgaggtga

SEQ ID NO: 400544 - DNA, 25 bp, Mus musculus
cggtgacctccgagggcgcctacta

SEQ ID NO: 400545 - DNA, 25 bp, Mus musculus
gggcgcctactacctggagcgtatc

SEQ ID NO: 400546 - DNA, 25 bp, Mus musculus
gcctactacctggagcgtatccttc

SEQ ID NO: 400547 - DNA, 25 bp, Mus musculus
acctggagcgtatccttctggtggc

SEQ ID NO: 400548 - DNA, 25 bp, Mus musculus
gcgcagttgcaagcatggctgctcc

SEQ ID NO: 400549 - DNA, 25 bp, Mus musculus
gagcgtatccttctggtggcctccc

SEQ ID NO: 400550 - DNA, 25 bp, Mus musculus
gctcccagaggaccgaactccagga

SEQ ID NO: 400551 - DNA, 25 bp, Mus musculus
ggtatagcgcgctcaaacttcctga

SEQ ID NO: 400552 - DNA, 25 bp, Mus musculus
ggagaagtcacctaggcctgtggcc

SEQ ID NO: 400553 - DNA, 25 bp, Mus musculus
gcggaccgcggaaaccaaagtgcca

SEQ ID NO: 400554 - DNA, 25 bp, Mus musculus
gcggggctttagtaatgcggtccaa

SEQ ID NO: 400555 - DNA, 25 bp, Mus musculus
ctcagagatggaaggacccggcttt

SEQ ID NO: 400556 - DNA, 25 bp, Mus musculus
gtctctgaattggtcggacgcctcc

SEQ ID NO: 400557 - DNA, 25 bp, Mus musculus
ggtcaggtttgctctagcgccgcac

SEQ ID NO: 400558 - DNA, 25 bp, Mus musculus
agcaggctggttcccagagcagacc

SEQ ID NO: 400559 - DNA, 25 bp, Mus musculus
cagcagcttctccaggcgggcaagc

SEQ ID NO: 400560 - DNA, 25 bp, Mus musculus
gctgggaagccactcagaaaactca

SEQ ID NO: 400561 - DNA, 25 bp, Mus musculus
ttgagtcatcttcgttgcaggtggc

SEQ ID NO: 400562 - DNA, 25 bp, Mus musculus
gagtgaccaacgagctgcgctttga

SEQ ID NO: 400563 - DNA, 25 bp, Mus musculus
cgaaggcagttctcccgcgaaaatt

SEQ ID NO: 400564 - DNA, 25 bp, Mus musculus
ttcggaaagaggaagcccgcggcta

SEQ ID NO: 400565 - DNA, 25 bp, Mus musculus
cactcatgccgctggccgagctggg

SEQ ID NO: 400566 - DNA, 25 bp, Mus musculus
tgcatcataggggtcctgcctgcac

SEQ ID NO: 400567 - DNA, 25 bp, Mus musculus
ctcgcgatgcatcataggggtcctg

SEQ ID NO: 400568 - DNA, 25 bp, Mus musculus
tgaggccctcgcgatgcatcatagg

SEQ ID NO: 400569 - DNA, 25 bp, Mus musculus
tcccaggctccggagttagcagccg

SEQ ID NO: 400570 - DNA, 25 bp, Mus musculus
acgcccagatctgggttcggaaaga

SEQ ID NO: 400571 - DNA, 25 bp, Mus musculus
acgcagcatggctccgtctcagctt

SEQ ID NO: 400572 - DNA, 25 bp, Mus musculus
gactccgcgacccaacgcagcatgg

SEQ ID NO: 400573 - DNA, 25 bp, Mus musculus
gtcacgtggggtcgacacgccctgc

SEQ ID NO: 400574 - DNA, 25 bp, Mus musculus
accctaggctgcagctcactggagg

SEQ ID NO: 400575 - DNA, 25 bp, Mus musculus
ctacagatcccaggctccggagtta

SEQ ID NO: 400576 - DNA, 25 bp, Mus musculus
gaagcccgcggctacagatcccagg

SEQ ID NO: 400577 - DNA, 25 bp, Mus musculus
ctccgtctcagcttggtgaggccct

SEQ ID NO: 400578 - DNA, 25 bp, Mus musculus
gcgggcgcttgaggaccaacccatc

SEQ ID NO: 400579 - DNA, 25 bp, Mus musculus
gccggccggtttgaaccagactgtc

SEQ ID NO: 400580 - DNA, 25 bp, Mus musculus
cccaggaggcaagtggccacgaact

SEQ ID NO: 400581 - DNA, 25 bp, Mus musculus
gcagaggcttatatgggacagtacc

SEQ ID NO: 400582 - DNA, 25 bp, Mus musculus
accagactgtcggtactcacgcttg

SEQ ID NO: 400583 - DNA, 25 bp, Mus musculus
cgcagcctgcgggaaaagtcctgag

SEQ ID NO: 400584 - DNA, 25 bp, Mus musculus
tagccacaacttgagcgggcgcttg

SEQ ID NO: 400585 - DNA, 25 bp, Mus musculus
ccaggcacaggactgccagcagcag

SEQ ID NO: 400586 - DNA, 25 bp, Mus musculus
cggtactcacgcttgctctgactga

SEQ ID NO: 400587 - DNA, 25 bp, Mus musculus
tgctcttcccggcttcggtgcagcg

SEQ ID NO: 400588 - DNA, 25 bp, Mus musculus
ctgcacgatttgctgagcctgcctc

SEQ ID NO: 400589 - DNA, 25 bp, Mus musculus
ctctgactgacagccaccggggatt

SEQ ID NO: 400590 - DNA, 25 bp, Mus musculus
cgcacgcgcgcaaaaactttagcca

SEQ ID NO: 400591 - DNA, 25 bp, Mus musculus
gaccagaagttgtccggctcacacc

SEQ ID NO: 400592 - DNA, 25 bp, Mus musculus
ccctcggcggatagactcatcaatc

SEQ ID NO: 400593 - DNA, 25 bp, Mus musculus
cagcttggacagcttggtgtctggc

SEQ ID NO: 400594 - DNA, 25 bp, Mus musculus
aggactcggcctcacctcggacttg

SEQ ID NO: 400595 - DNA, 25 bp, Mus musculus
agtacaccgtgacctagagacccgc

SEQ ID NO: 400596 - DNA, 25 bp, Mus musculus
tcggacttggcgtcacctcaccttt

SEQ ID NO: 400597 - DNA, 25 bp, Mus musculus
ggtgggtcactccatccttgtccag

SEQ ID NO: 400598 - DNA, 25 bp, Mus musculus
gccgccttttatgtgggcgtccgaa

SEQ ID NO: 400599 - DNA, 25 bp, Mus musculus
gtccgaagccagcaaagccacgtcg

SEQ ID NO: 400600 - DNA, 25 bp, Mus musculus
ccctctggccggaaggttgagagta

SEQ ID NO: 400601 - DNA, 25 bp, Mus musculus
tgagagtagtttacggtggtccagc

SEQ ID NO: 400602 - DNA, 25 bp, Mus musculus
gacttcaggagcagagccgtcgcgt

SEQ ID NO: 400603 - DNA, 25 bp, Mus musculus
cgtccgcctttaattctacaaggtg

SEQ ID NO: 400604 - DNA, 25 bp, Mus musculus
agaagcctttcctcagtacaccgtg

SEQ ID NO: 400605 - DNA, 25 bp, Mus musculus
gactcatcaatcaaaccgctcgggg

SEQ ID NO: 400606 - DNA, 25 bp, Mus musculus
tcaccgcggcccatggttcggctgg

SEQ ID NO: 400607 - DNA, 25 bp, Mus musculus
tgcgcatgcgggagcgcgcctaccc

SEQ ID NO: 400608 - DNA, 25 bp, Mus musculus
ccgccctgcgcagtcgcggcccaga

SEQ ID NO: 400609 - DNA, 25 bp, Mus musculus
cccggccggtcttagcaggaagcgc

SEQ ID NO: 400610 - DNA, 25 bp, Mus musculus
ggtcttagcaggaagcgccgccgcc

SEQ ID NO: 400611 - DNA, 25 bp, Mus musculus
ccgcggatcaccgagcggcctcccg

SEQ ID NO: 400612 - DNA, 25 bp, Mus musculus
tcaccgagcggcctcccgcgcatgc

SEQ ID NO: 400613 - DNA, 25 bp, Mus musculus
gcatgcgccataggggccaggggca

SEQ ID NO: 400614 - DNA, 25 bp, Mus musculus
cagccctggggattccgttcccaga

SEQ ID NO: 400615 - DNA, 25 bp, Mus musculus
tggggattccgttcccagaaggcac

SEQ ID NO: 400616 - DNA, 25 bp, Mus musculus
gaaggcaccgcgcaggctgctaccg

SEQ ID NO: 400617 - DNA, 25 bp, Mus musculus
tcggtggagcccgagcctccggtac

SEQ ID NO: 400618 - DNA, 25 bp, Mus musculus
cagcgagccaacaggaggggacgca

SEQ ID NO: 400619 - DNA, 25 bp, Mus musculus
ccagcggacagcagcgagccaacag

SEQ ID NO: 400620 - DNA, 25 bp, Mus musculus
gaggagccacacaaaatctgaacca

SEQ ID NO: 400621 - DNA, 25 bp, Mus musculus
ccacggctgccctctagggagcgag

SEQ ID NO: 400622 - DNA, 25 bp, Mus musculus
cgctcgtccgtctcatccgatgaga

SEQ ID NO: 400623 - DNA, 25 bp, Mus musculus
ttgccgcgggagcttttccctctct

SEQ ID NO: 400624 - DNA, 25 bp, Mus musculus
gcgaggcggcccgatacgcacctga

SEQ ID NO: 400625 - DNA, 25 bp, Mus musculus
ggcaccgcggtgtgacctcacagca

SEQ ID NO: 400626 - DNA, 25 bp, Mus musculus
aaatcgtcttgtgcgagaccggggc

SEQ ID NO: 400627 - DNA, 25 bp, Mus musculus
tgccctctagggagcgagcgcgctc

SEQ ID NO: 400628 - DNA, 25 bp, Mus musculus
atctgaaccaaggatccggagctta

SEQ ID NO: 400629 - DNA, 25 bp, Mus musculus
tgcctccgaggagccacacaaaatc

SEQ ID NO: 400630 - DNA, 25 bp, Mus musculus
caggggcatccgctgcctccgagga

SEQ ID NO: 400631 - DNA, 25 bp, Mus musculus
tcagtggcgtttcccaggggcatcc

SEQ ID NO: 400632 - DNA, 25 bp, Mus musculus
ctgcagcagtcagtggcgtttccca

SEQ ID NO: 400633 - DNA, 25 bp, Mus musculus
aggatccggagcttaaatcgtcttg

SEQ ID NO: 400634 - DNA, 25 bp, Mus musculus
taggtgggccgctttgagactgcca

SEQ ID NO: 400635 - DNA, 25 bp, Mus musculus
cacggacgaagagcagactgcctga

SEQ ID NO: 400636 - DNA, 25 bp, Mus musculus
agcctcaggactggaggaaacagca

SEQ ID NO: 400637 - DNA, 25 bp, Mus musculus
gtcacatacagcctcaggactggag

SEQ ID NO: 400638 - DNA, 25 bp, Mus musculus
tgtcaagtcacatacagcctcagga

SEQ ID NO: 400639 - DNA, 25 bp, Mus musculus
cggtgtcaagtcacatacagcctca

SEQ ID NO: 400640 - DNA, 25 bp, Mus musculus
ggaggatacggtgtcaagtcacata

SEQ ID NO: 400641 - DNA, 25 bp, Mus musculus
gcagactgcctgaatcgaaaccaac

SEQ ID NO: 400642 - DNA, 25 bp, Mus musculus
tgcctgaatcgaaaccaaccctcag

SEQ ID NO: 400643 - DNA, 25 bp, Mus musculus
aaccctcagctcctcaggctacctg

SEQ ID NO: 400644 - DNA, 25 bp, Mus musculus
aggctacctgttcccacctcgcttt

SEQ ID NO: 400645 - DNA, 25 bp, Mus musculus
acagcacggacgaagagcagactgc

SEQ ID NO: 400646 - DNA, 25 bp, Mus musculus
ttcctctgtggaggaagaagcgtag

SEQ ID NO: 400647 - DNA, 25 bp, Mus musculus
ctgttcccacctcgctttcctctgt

SEQ ID NO: 400648 - DNA, 25 bp, Mus musculus
ccggagaagctcgtctgtcagctca

SEQ ID NO: 400649 - DNA, 25 bp, Mus musculus
aggagcgttctcagcggttctaaaa

SEQ ID NO: 400650 - DNA, 25 bp, Mus musculus
cgtaagcgcaaactaggaacagtgg

SEQ ID NO: 400651 - DNA, 25 bp, Mus musculus
aacagtgggtgtgctcttttctgcc

SEQ ID NO: 400652 - DNA, 25 bp, Mus musculus
tgtgctcttttctgccaccatgcgc

SEQ ID NO: 400653 - DNA, 25 bp, Mus musculus
aggccgtagcaggagcgttctcagc

SEQ ID NO: 400654 - DNA, 25 bp, Mus musculus
atgccgtatcctttttccttggagg

SEQ ID NO: 400655 - DNA, 25 bp, Mus musculus
accgccctctcgacttggaagctgt

SEQ ID NO: 400656 - DNA, 25 bp, Mus musculus
tcgacttggaagctgtctctccgcg

SEQ ID NO: 400657 - DNA, 25 bp, Mus musculus
gcggttctaaaacccgcgcgcaggc

SEQ ID NO: 400658 - DNA, 25 bp, Mus musculus
tggagcatctcccaccacaatgccg

SEQ ID NO: 400659 - DNA, 25 bp, Mus musculus
ggtgggacagaatcgctccgcctcc

SEQ ID NO: 400660 - DNA, 25 bp, Mus musculus
ccgcagtgcccggtgggacagaatc

SEQ ID NO: 400661 - DNA, 25 bp, Mus musculus
tgtcagctcacgtaagcgcaaacta

SEQ ID NO: 400662 - DNA, 25 bp, Mus musculus
ctcacggacgcagagcatggctgcg

SEQ ID NO: 400663 - DNA, 25 bp, Mus musculus
aatagtctgtgagtcggcctgtgaa

SEQ ID NO: 400664 - DNA, 25 bp, Mus musculus
tccaaaccgcaatagtctgtgagtc

SEQ ID NO: 400665 - DNA, 25 bp, Mus musculus
cggtggattccaaaccgcaatagtc

SEQ ID NO: 400666 - DNA, 25 bp, Mus musculus
agctgatttgcacgtcctgcctcca

SEQ ID NO: 400667 - DNA, 25 bp, Mus musculus
gtggcgacgtgcacaggcctaattt

SEQ ID NO: 400668 - DNA, 25 bp, Mus musculus
acgtgcacaggcctaatttgggctt

SEQ ID NO: 400669 - DNA, 25 bp, Mus musculus
cctaatttgggcttgtgttgtcacg

SEQ ID NO: 400670 - DNA, 25 bp, Mus musculus
cttgtgttgtcacgcccttcgcgag

SEQ ID NO: 400671 - DNA, 25 bp, Mus musculus
agcccgggtcgtggacgttgaatct

SEQ ID NO: 400672 - DNA, 25 bp, Mus musculus
cgtggacgttgaatctgaagccgtg

SEQ ID NO: 400673 - DNA, 25 bp, Mus musculus
gtcaccacaaaggtaatgtgtctca

SEQ ID NO: 400674 - DNA, 25 bp, Mus musculus
aaaggtaatgtgtctcacggacgca

SEQ ID NO: 400675 - DNA, 25 bp, Mus musculus
cggggaagagctgatttgcacgtcc

SEQ ID NO: 400676 - DNA, 25 bp, Mus musculus
ccatccctgtactgtacttctcagg

SEQ ID NO: 400677 - DNA, 25 bp, Mus musculus
tctcagtggagtgggagaataaacc

SEQ ID NO: 400678 - DNA, 25 bp, Mus musculus
caccagggaagaggctccagtctcg

SEQ ID NO: 400679 - DNA, 25 bp, Mus musculus
tagcgctcttgttctcagtggagtg

SEQ ID NO: 400680 - DNA, 25 bp, Mus musculus
tcctctagcgctcttgttctcagtg

SEQ ID NO: 400681 - DNA, 25 bp, Mus musculus
agccggctgcaaaccctcctctagc

SEQ ID NO: 400682 - DNA, 25 bp, Mus musculus
ttctcaggtacagccggctgcaaac

SEQ ID NO: 400683 - DNA, 25 bp, Mus musculus
tacttctcaggtacagccggctgca

SEQ ID NO: 400684 - DNA, 25 bp, Mus musculus
cgcatgcaggatgcaagacgcggac

SEQ ID NO: 400685 - DNA, 25 bp, Mus musculus
tgcagaagcaccagggaagaggctc

SEQ ID NO: 400686 - DNA, 25 bp, Mus musculus
gagtgacgcatgcaggatgcaagac

SEQ ID NO: 400687 - DNA, 25 bp, Mus musculus
tgtgctccttgcagaagcaccaggg

SEQ ID NO: 400688 - DNA, 25 bp, Mus musculus
tccgggagcccatgtgtgctccttg

SEQ ID NO: 400689 - DNA, 25 bp, Mus musculus
aaccggaagtgtccgggagcccatg

SEQ ID NO: 400690 - DNA, 25 bp, Mus musculus
gtctgcgtcctggtgtctcccaggc

SEQ ID NO: 400691 - DNA, 25 bp, Mus musculus
ctgcgtcctggtgtctcccaggcgg

SEQ ID NO: 400692 - DNA, 25 bp, Mus musculus
ctggtctgcgtcctggtgtctccca

SEQ ID NO: 400693 - DNA, 25 bp, Mus musculus
cgactgctggtctgcgtcctggtgt

SEQ ID NO: 400694 - DNA, 25 bp, Mus musculus
aagcgactgctggtctgcgtcctgg

SEQ ID NO: 400695 - DNA, 25 bp, Mus musculus
agaagcgactgctggtctgcgtcct

SEQ ID NO: 400696 - DNA, 25 bp, Mus musculus
ctgctctgggtctgcacgcgcccgg

SEQ ID NO: 400697 - DNA, 25 bp, Mus musculus
tcctcgtcctcttctgggtcgctgt

SEQ ID NO: 400698 - DNA, 25 bp, Mus musculus
ggctggagagtggcttcgctttctc

SEQ ID NO: 400699 - DNA, 25 bp, Mus musculus
aaaatgggcaggtccgggctggaga

SEQ ID NO: 400700 - DNA, 25 bp, Mus musculus
tcgagagctggaaaatgggcaggtc

SEQ ID NO: 400701 - DNA, 25 bp, Mus musculus
gggcgaggttcgagagctggaaaat

SEQ ID NO: 400702 - DNA, 25 bp, Mus musculus
cagaagcgactgctggtctgcgtcc

SEQ ID NO: 400703 - DNA, 25 bp, Mus musculus
ctgctgcccgcggtccagcgcggtc

SEQ ID NO: 400704 - DNA, 25 bp, Mus musculus
cgaggactggaaacaaccttcttag

SEQ ID NO: 400705 - DNA, 25 bp, Mus musculus
agaccccgcgcgtcatgccagtggg

SEQ ID NO: 400706 - DNA, 25 bp, Mus musculus
ccctggctcagttcccaaaggggtg

SEQ ID NO: 400707 - DNA, 25 bp, Mus musculus
ctggcggtccgaggactggaaacaa

SEQ ID NO: 400708 - DNA, 25 bp, Mus musculus
cgcggttgctcagcacccgccgccg

SEQ ID NO: 400709 - DNA, 25 bp, Mus musculus
ctggaaacaaccttcttagagcgga

SEQ ID NO: 400710 - DNA, 25 bp, Mus musculus
cttcttagagcggagaaggcaccca

SEQ ID NO: 400711 - DNA, 25 bp, Mus musculus
agcggagaaggcacccagctactcc

SEQ ID NO: 400712 - DNA, 25 bp, Mus musculus
tactcccacccgagcggccgtgaag

SEQ ID NO: 400713 - DNA, 25 bp, Mus musculus
tgaagccgctgctgcgttcagcacc

SEQ ID NO: 400714 - DNA, 25 bp, Mus musculus
tgctgcgttcagcacctgggtgagt

SEQ ID NO: 400715 - DNA, 25 bp, Mus musculus
cctgggtgagtggacagctcccacc

SEQ ID NO: 400716 - DNA, 25 bp, Mus musculus
ggtgagtggacagctcccacccaga

SEQ ID NO: 400717 - DNA, 25 bp, Mus musculus
ctcagttcccaaaggggtggtgctg

SEQ ID NO: 400718 - DNA, 25 bp, Mus musculus
cgcttccagctggtgaaacacttct

SEQ ID NO: 400719 - DNA, 25 bp, Mus musculus
acacggggattgtctgcgtaaactc

SEQ ID NO: 400720 - DNA, 25 bp, Mus musculus
gtgacacggggattgtctgcgtaaa

SEQ ID NO: 400721 - DNA, 25 bp, Mus musculus
gcattgcgtcccttcttctttgggc

SEQ ID NO: 400722 - DNA, 25 bp, Mus musculus
attttccagcggagacagcgaataa

SEQ ID NO: 400723 - DNA, 25 bp, Mus musculus
cgcatctatgcattttccagcggag

SEQ ID NO: 400724 - DNA, 25 bp, Mus musculus
gcgcttccagctggtgaaacacttc

SEQ ID NO: 400725 - DNA, 25 bp, Mus musculus
cgtaacgctgtgacgaatatgacgt

SEQ ID NO: 400726 - DNA, 25 bp, Mus musculus
ggcgagccacctaaaacctgtctcc

SEQ ID NO: 400727 - DNA, 25 bp, Mus musculus
atgacgtctcccagcggatcctagg

SEQ ID NO: 400728 - DNA, 25 bp, Mus musculus
cgctgtgacgaatatgacgtctccc

SEQ ID NO: 400729 - DNA, 25 bp, Mus musculus
tgcgtaaactctttggaagtcgcta

SEQ ID NO: 400730 - DNA, 25 bp, Mus musculus
gtctgcgtaaactctttggaagtcg

SEQ ID NO: 400731 - DNA, 25 bp, Mus musculus
cgaatatgacgtctcccagcggatc

SEQ ID NO: 400732 - DNA, 25 bp, Mus musculus
cgagagaggaggtcgcgtcacttcc

SEQ ID NO: 400733 - DNA, 25 bp, Mus musculus
tcgtcatctgccttagtctccggcg

SEQ ID NO: 400734 - DNA, 25 bp, Mus musculus
cgaataaaccgccagaacaccgagt

SEQ ID NO: 400735 - DNA, 25 bp, Mus musculus
ggcctggcgattttccgaagtataa

SEQ ID NO: 400736 - DNA, 25 bp, Mus musculus
taatatagtgggaaggcaatgcgcc

SEQ ID NO: 400737 - DNA, 25 bp, Mus musculus
gcaatgcgcctcagtcacaaacgtc

SEQ ID NO: 400738 - DNA, 25 bp, Mus musculus
tcgcgagcagaacgcaagaaatcgc

SEQ ID NO: 400739 - DNA, 25 bp, Mus musculus
ctcagcccacctcgggtagtctgtg

SEQ ID NO: 400740 - DNA, 25 bp, Mus musculus
cgcaagaaatcgcatctgctctgca

SEQ ID NO: 400741 - DNA, 25 bp, Mus musculus
tctgctctgcagaactttggttatg

SEQ ID NO: 400742 - DNA, 25 bp, Mus musculus
caccgagttcacttccgagagagga

SEQ ID NO: 400743 - DNA, 25 bp, Mus musculus
gtgctgtccctgtcctgtctgctgt

SEQ ID NO: 400744 - DNA, 25 bp, Mus musculus
ggaagtcgctatccatcgtcatctg

SEQ ID NO: 400745 - DNA, 25 bp, Mus musculus
ctaggcgtttactatggccagcatc

SEQ ID NO: 400746 - DNA, 25 bp, Mus musculus
atgactgtctcccagccgaactgta

SEQ ID NO: 400747 - DNA, 25 bp, Mus musculus
tgtcaacaggctaaacgcaccaaga

SEQ ID NO: 400748 - DNA, 25 bp, Mus musculus
tcaatgtctctgctccgttcctttc

SEQ ID NO: 400749 - DNA, 25 bp, Mus musculus
cgtgcaccgactggctcaatgtctc

SEQ ID NO: 400750 - DNA, 25 bp, Mus musculus
caggattcagccgagtttgtgctca

SEQ ID NO: 400751 - DNA, 25 bp, Mus musculus
cgccttccttgatggttgagcttga

SEQ ID NO: 400752 - DNA, 25 bp, Mus musculus
tgcacaatctggagccttttggcgc

SEQ ID NO: 400753 - DNA, 25 bp, Mus musculus
ccagcgcggtagttaatgcacaatc

SEQ ID NO: 400754 - DNA, 25 bp, Mus musculus
ttcgtaaccgctttggaagtcgcta

SEQ ID NO: 400755 - DNA, 25 bp, Mus musculus
ttccggcgacatggtgagtgtcttc

SEQ ID NO: 400756 - DNA, 25 bp, Mus musculus
tgcgtcccttcctcttcggacttgg

SEQ ID NO: 400757 - DNA, 25 bp, Mus musculus
tgtgcttccagctcgtgaaccactt

SEQ ID NO: 400758 - DNA, 25 bp, Mus musculus
ccgaactgtaactcggcctgggagc

SEQ ID NO: 400759 - DNA, 25 bp, Mus musculus
caccaagaaggtcggcatcgtcggc

SEQ ID NO: 400760 - DNA, 25 bp, Mus musculus
agggcgaagcatgcggcgtctacat

SEQ ID NO: 400761 - DNA, 25 bp, Mus musculus
cgctgcccaccctgcacgcccgagc

SEQ ID NO: 400762 - DNA, 25 bp, Mus musculus
gcccaccctgcacgcccgagcgtct

SEQ ID NO: 400763 - DNA, 25 bp, Mus musculus
cacgcccgagcgtctggccgcttgc

SEQ ID NO: 400764 - DNA, 25 bp, Mus musculus
acccgacgcgccctgcgccgagctg

SEQ ID NO: 400765 - DNA, 25 bp, Mus musculus
acgctacgctgctatcccaacccgg

SEQ ID NO: 400766 - DNA, 25 bp, Mus musculus
ctgctccgtgtgcgcacggcaggag

SEQ ID NO: 400767 - DNA, 25 bp, Mus musculus
aagcatgcggcgtctacatcccgcg

SEQ ID NO: 400768 - DNA, 25 bp, Mus musculus
atgcggcgtctacatcccgcgctgc

SEQ ID NO: 400769 - DNA, 25 bp, Mus musculus
cggcgtctacatcccgcgctgcgcc

SEQ ID NO: 400770 - DNA, 25 bp, Mus musculus
cgcgctgcgcccagacgctacgctg

SEQ ID NO: 400771 - DNA, 25 bp, Mus musculus
tgcgcccagacgctacgctgctatc

SEQ ID NO: 400772 - DNA, 25 bp, Mus musculus
gcccagacgctacgctgctatccca

SEQ ID NO: 400773 - DNA, 25 bp, Mus musculus
cgccctgcgccgagctggtgcgaga

SEQ ID NO: 400774 - DNA, 25 bp, Mus musculus
cgcgcgcatgactcactcacctcct

SEQ ID NO: 400775 - DNA, 25 bp, Mus musculus
atgtaagggatgaggcggagccagt

SEQ ID NO: 400776 - DNA, 25 bp, Mus musculus
gcgcgcgcggacaccggttgccaaa

SEQ ID NO: 400777 - DNA, 25 bp, Mus musculus
gcgcggacaccggttgccaaacatt

SEQ ID NO: 400778 - DNA, 25 bp, Mus musculus
cggacaccggttgccaaacattgca

SEQ ID NO: 400779 - DNA, 25 bp, Mus musculus
cggttgccaaacattgcatcatccc

SEQ ID NO: 400780 - DNA, 25 bp, Mus musculus
tgagactcctgagtggcggatgtaa

SEQ ID NO: 400781 - DNA, 25 bp, Mus musculus
gaagccgcgtgacccaaagccactt

SEQ ID NO: 400782 - DNA, 25 bp, Mus musculus
tccgggtccgagacaacgtagactc

SEQ ID NO: 400783 - DNA, 25 bp, Mus musculus
ggtccgagacaacgtagactctcaa

SEQ ID NO: 400784 - DNA, 25 bp, Mus musculus
agacaacgtagactctcaagccaga

SEQ ID NO: 400785 - DNA, 25 bp, Mus musculus
aacgtagactctcaagccagagggc

SEQ ID NO: 400786 - DNA, 25 bp, Mus musculus
gacactgggagctggcgctccgccc

SEQ ID NO: 400787 - DNA, 25 bp, Mus musculus
accggttgccaaacattgcatcatc

SEQ ID NO: 400788 - DNA, 25 bp, Mus musculus
gttggtccagaccattcgcgcgctg

SEQ ID NO: 400789 - DNA, 25 bp, Mus musculus
agtcggccggctcggctcgtactgc

SEQ ID NO: 400790 - DNA, 25 bp, Mus musculus
ctttcgcgccggaaggcgggactat

SEQ ID NO: 400791 - DNA, 25 bp, Mus musculus
gaatggtacagcctttcgcgccgga

SEQ ID NO: 400792 - DNA, 25 bp, Mus musculus
aaagcctcggtgtgggaatggtaca

SEQ ID NO: 400793 - DNA, 25 bp, Mus musculus
tgaactgcgagggacgcaaagcctc

SEQ ID NO: 400794 - DNA, 25 bp, Mus musculus
tcggaaatccgttcgtgtgaactgc

SEQ ID NO: 400795 - DNA, 25 bp, Mus musculus
agaacatgctggctcggaaatccgt

SEQ ID NO: 400796 - DNA, 25 bp, Mus musculus
ttgccggtgaaacgagaacatgctg

SEQ ID NO: 400797 - DNA, 25 bp, Mus musculus
ctaagatcagtcttgccggtgaaac

SEQ ID NO: 400798 - DNA, 25 bp, Mus musculus
cacttccttagggttggctcggctc

SEQ ID NO: 400799 - DNA, 25 bp, Mus musculus
gcggcgcagcgacatagaaaacact

SEQ ID NO: 400800 - DNA, 25 bp, Mus musculus
cggaggtgacgttggtccagaccat

SEQ ID NO: 400801 - DNA, 25 bp, Mus musculus
gcgacatagaaaacacttccttagg

SEQ ID NO: 400802 - DNA, 25 bp, Mus musculus
atcgaatggagaagctccttccttc

SEQ ID NO: 400803 - DNA, 25 bp, Mus musculus
gcctccggtcagaatgctggagccg

SEQ ID NO: 400804 - DNA, 25 bp, Mus musculus
cagaatgctggagccgcttgaaagc

SEQ ID NO: 400805 - DNA, 25 bp, Mus musculus
ccgcttgaaagccaggggagctaca

SEQ ID NO: 400806 - DNA, 25 bp, Mus musculus
tgaaagccaggggagctacagctct

SEQ ID NO: 400807 - DNA, 25 bp, Mus musculus
agctacagctcttaacgcgggtgtg

SEQ ID NO: 400808 - DNA, 25 bp, Mus musculus
gctgcgttccggcaccctggctgtg

SEQ ID NO: 400809 - DNA, 25 bp, Mus musculus
ccggttggccagctgcgttccggca

SEQ ID NO: 400810 - DNA, 25 bp, Mus musculus
ctcgggtgagaaaagatcgaatgga

SEQ ID NO: 400811 - DNA, 25 bp, Mus musculus
ctcttaacgcgggtgtgtgtcacac

SEQ ID NO: 400812 - DNA, 25 bp, Mus musculus
tctgtgtaacttaagccggttggcc

SEQ ID NO: 400813 - DNA, 25 bp, Mus musculus
gcaccctggctgtgcgtctgggcct

SEQ ID NO: 400814 - DNA, 25 bp, Mus musculus
aatggagaagctccttccttctggc

SEQ ID NO: 400815 - DNA, 25 bp, Mus musculus
agcgggctccatctgtgtaacttaa

SEQ ID NO: 400816 - DNA, 25 bp, Mus musculus
cgccgtagctcttttcgttgaggca

SEQ ID NO: 400817 - DNA, 25 bp, Mus musculus
aggcagcgcaaaccctgggcgcagc

SEQ ID NO: 400818 - DNA, 25 bp, Mus musculus
agcggcttctcctcatcctgccggg

SEQ ID NO: 400819 - DNA, 25 bp, Mus musculus
tagctcttttcgttgaggcaaaccc

SEQ ID NO: 400820 - DNA, 25 bp, Mus musculus
tgctcgccgtagctcttttcgttga

SEQ ID NO: 400821 - DNA, 25 bp, Mus musculus
tatcttggtttgctcgccgtagctc

SEQ ID NO: 400822 - DNA, 25 bp, Mus musculus
cacctatcttggtttgctcgccgta

SEQ ID NO: 400823 - DNA, 25 bp, Mus musculus
gtagcgctcacctatcttggtttgc

SEQ ID NO: 400824 - DNA, 25 bp, Mus musculus
cccagtagcgctcacctatcttggt

SEQ ID NO: 400825 - DNA, 25 bp, Mus musculus
gtgccgtgcaactgaaaccccagta

SEQ ID NO: 400826 - DNA, 25 bp, Mus musculus
gtgtagacgccacacgactgtccct

SEQ ID NO: 400827 - DNA, 25 bp, Mus musculus
agctcctgtgccgtgcaactgaaac

SEQ ID NO: 400828 - DNA, 25 bp, Mus musculus
gccacacgactgtccctccgccagg

SEQ ID NO: 400829 - DNA, 25 bp, Mus musculus
caaagcgcgcgggttcccaatcggt

SEQ ID NO: 400830 - DNA, 25 bp, Mus musculus
taaccacaacgtcagcccgttcgta

SEQ ID NO: 400831 - DNA, 25 bp, Mus musculus
gtagccacgatgtcagcctgtctgt

SEQ ID NO: 400832 - DNA, 25 bp, Mus musculus
tgacgtcagctcagctcatccgtaa

SEQ ID NO: 400833 - DNA, 25 bp, Mus musculus
gtagtcatgacgtcagcccgtccgt

SEQ ID NO: 400834 - DNA, 25 bp, Mus musculus
gtcagtagccacgacgtcagccggt

SEQ ID NO: 400835 - DNA, 25 bp, Mus musculus
cgtccgtagccacgatgtcagcctg

SEQ ID NO: 400836 - DNA, 25 bp, Mus musculus
tgtctgtagccatgacgtcagctca

SEQ ID NO: 400837 - DNA, 25 bp, Mus musculus
aacgtcagcccgttcgtagtcatga

SEQ ID NO: 400838 - DNA, 25 bp, Mus musculus
taaccacgacgtcagcccgtctata

SEQ ID NO: 400839 - DNA, 25 bp, Mus musculus
gacgtcagcccgtctatagccatga

SEQ ID NO: 400840 - DNA, 25 bp, Mus musculus
gtctatagccatgacgtcagcccgt

SEQ ID NO: 400841 - DNA, 25 bp, Mus musculus
gtcagcccgtctgtagccacgtcag

SEQ ID NO: 400842 - DNA, 25 bp, Mus musculus
tgtagccacgtcagctcgtccgtag

SEQ ID NO: 400843 - DNA, 25 bp, Mus musculus
gatgtcagcctgtctgtagccatga

SEQ ID NO: 400844 - DNA, 25 bp, Mus musculus
accagcgtctgagctggcaggaagc

SEQ ID NO: 400845 - DNA, 25 bp, Mus musculus
cagaggtagccgagccaggacccaa

SEQ ID NO: 400846 - DNA, 25 bp, Mus musculus
gctggcccgacagggcagaggtagc

SEQ ID NO: 400847 - DNA, 25 bp, Mus musculus
aagcggtgagtgagctggcccgaca

SEQ ID NO: 400848 - DNA, 25 bp, Mus musculus
cgctcacctttgcaaacgaggagcc

SEQ ID NO: 400849 - DNA, 25 bp, Mus musculus
ccagcgtctgagctggcaggaagct

SEQ ID NO: 400850 - DNA, 25 bp, Mus musculus
gtagccgagccaggacccaaggccg

SEQ ID NO: 400851 - DNA, 25 bp, Mus musculus
gcctccttcccggagtcagcgcgtc

SEQ ID NO: 400852 - DNA, 25 bp, Mus musculus
tagcggcaggaccagcgtctgagct

SEQ ID NO: 400853 - DNA, 25 bp, Mus musculus
gagccactgggtggcaggccagggc

SEQ ID NO: 400854 - DNA, 25 bp, Mus musculus
acccgctcacctttgcaaacgagga

SEQ ID NO: 400855 - DNA, 25 bp, Mus musculus
tttgcaaacgaggagccactgggtg

SEQ ID NO: 400856 - DNA, 25 bp, Mus musculus
cacctttgcaaacgaggagccactg

SEQ ID NO: 400857 - DNA, 25 bp, Mus musculus
caggaagctggtggagaagcggtga

SEQ ID NO: 400858 - DNA, 25 bp, Mus musculus
aggcgggcctgtcacacgtgcactc

SEQ ID NO: 400859 - DNA, 25 bp, Mus musculus
gccgcgaggtatgaaatggaaactc

SEQ ID NO: 400860 - DNA, 25 bp, Mus musculus
cggccttggccttcaccttgacact

SEQ ID NO: 400861 - DNA, 25 bp, Mus musculus
caggcctagtgccagcggcacagag

SEQ ID NO: 400862 - DNA, 25 bp, Mus musculus
gaaatggaaactcaggcgcaatctc

SEQ ID NO: 400863 - DNA, 25 bp, Mus musculus
agaaagtttttagccgcgaggtatg

SEQ ID NO: 400864 - DNA, 25 bp, Mus musculus
gcgagacagaaagaaagtttttagc

SEQ ID NO: 400865 - DNA, 25 bp, Mus musculus
cctggcatttccgatgacaggagaa

SEQ ID NO: 400866 - DNA, 25 bp, Mus musculus
ccttggcctggcatttccgatgaca

SEQ ID NO: 400867 - DNA, 25 bp, Mus musculus
ccttaccttggcctggcatttccga

SEQ ID NO: 400868 - DNA, 25 bp, Mus musculus
aagagcagttatgccgcccgcccta

SEQ ID NO: 400869 - DNA, 25 bp, Mus musculus
cgctttgcataaacaaagagcagtt

SEQ ID NO: 400870 - DNA, 25 bp, Mus musculus
ttgacactcgctccgcgctttgcat

SEQ ID NO: 400871 - DNA, 25 bp, Mus musculus
ggacccaggcctagtgccagcggca

SEQ ID NO: 400872 - DNA, 25 bp, Mus musculus
ggacctaggggcagaaaatcagttc

SEQ ID NO: 400873 - DNA, 25 bp, Mus musculus
cgcgttacctggctgcgaaggcaga

SEQ ID NO: 400874 - DNA, 25 bp, Mus musculus
agcggatcacgcaggagaagcacca

SEQ ID NO: 400875 - DNA, 25 bp, Mus musculus
gaagcaccagctcagtcgagtcatg

SEQ ID NO: 400876 - DNA, 25 bp, Mus musculus
tcgagtcatgttgcccgggaaagta

SEQ ID NO: 400877 - DNA, 25 bp, Mus musculus
accgagacgcctgttggggacctag

SEQ ID NO: 400878 - DNA, 25 bp, Mus musculus
aaaatcagttccctgttcccggcat

SEQ ID NO: 400879 - DNA, 25 bp, Mus musculus
cccttcgggcagatgcagggcgctt

SEQ ID NO: 400880 - DNA, 25 bp, Mus musculus
tgccggcttcctgggcgctagagcc

SEQ ID NO: 400881 - DNA, 25 bp, Mus musculus
cgctagagcccggtaacttctgaag

SEQ ID NO: 400882 - DNA, 25 bp, Mus musculus
taacttctgaagcagtggggacccg

SEQ ID NO: 400883 - DNA, 25 bp, Mus musculus
aaggagcgacagcagcattgtgctc

SEQ ID NO: 400884 - DNA, 25 bp, Mus musculus
cagcattgtgctcgcgctgcagtga

SEQ ID NO: 400885 - DNA, 25 bp, Mus musculus
tgacgagagaaggaccgagacgcct

SEQ ID NO: 400886 - DNA, 25 bp, Mus musculus
gagcgactgagagactgacaccaga

SEQ ID NO: 400887 - DNA, 25 bp, Mus musculus
gcagagaacagcacgtttggggatc

SEQ ID NO: 400888 - DNA, 25 bp, Mus musculus
gcatccggcccacagctccctacct

SEQ ID NO: 400889 - DNA, 25 bp, Mus musculus
tccctacctgaagcagcagccgcct

SEQ ID NO: 400890 - DNA, 25 bp, Mus musculus
ctcgcagcacaccaggctcacggtg

SEQ ID NO: 400891 - DNA, 25 bp, Mus musculus
gacaggctgaactgggaacgcaaga

SEQ ID NO: 400892 - DNA, 25 bp, Mus musculus
ctgaactgggaacgcaagagagcga

SEQ ID NO: 400893 - DNA, 25 bp, Mus musculus
gcaagagagcgacgccgtgactagt

SEQ ID NO: 400894 - DNA, 25 bp, Mus musculus
gacgccgtgactagtgagcgactga

SEQ ID NO: 400895 - DNA, 25 bp, Mus musculus
gactgacaccagagaagggatctga

SEQ ID NO: 400896 - DNA, 25 bp, Mus musculus
cgccggggttagatctggctctgca

SEQ ID NO: 400897 - DNA, 25 bp, Mus musculus
ttagatctggctctgcaccgggcag

SEQ ID NO: 400898 - DNA, 25 bp, Mus musculus
accagagaagggatctgaagggaca

SEQ ID NO: 400899 - DNA, 25 bp, Mus musculus
atctggctctgcaccgggcagaagg

SEQ ID NO: 400900 - DNA, 25 bp, Mus musculus
ggcagccgaggccagaagtcacgcc

SEQ ID NO: 400901 - DNA, 25 bp, Mus musculus
ctaaatcccgggtggcgtccagctc

SEQ ID NO: 400902 - DNA, 25 bp, Mus musculus
agaacaggagacctgtaggacgtga

SEQ ID NO: 400903 - DNA, 25 bp, Mus musculus
tcagggtttccctggcaggatggac

SEQ ID NO: 400904 - DNA, 25 bp, Mus musculus
cctggcgcggcttcagggtttccct

SEQ ID NO: 400905 - DNA, 25 bp, Mus musculus
acaaatcgggaacctggcgcggctt

SEQ ID NO: 400906 - DNA, 25 bp, Mus musculus
aggccgagttgaccccagctaaatc

SEQ ID NO: 400907 - DNA, 25 bp, Mus musculus
cgctcgcgctcaagttcgagaacgc

SEQ ID NO: 400908 - DNA, 25 bp, Mus musculus
tcgaggagacgctcgcgctcaagtt

SEQ ID NO: 400909 - DNA, 25 bp, Mus musculus
caaccgcatcatcgaggagacgctc

SEQ ID NO: 400910 - DNA, 25 bp, Mus musculus
agccgccgccatgatcctgctggag

SEQ ID NO: 400911 - DNA, 25 bp, Mus musculus
ggccagaagtcacgcccgagagcct

SEQ ID NO: 400912 - DNA, 25 bp, Mus musculus
cctgctggaggtgaacaaccgcatc

SEQ ID NO: 400913 - DNA, 25 bp, Mus musculus
gctccctccgtcctaccctcgattg

SEQ ID NO: 400914 - DNA, 25 bp, Mus musculus
cagagtcagctctgcgcgacgacgc

SEQ ID NO: 400915 - DNA, 25 bp, Mus musculus
gcgggagagcccaagctccacctta

SEQ ID NO: 400916 - DNA, 25 bp, Mus musculus
cccagctgaagggaaacaagcgagc

SEQ ID NO: 400917 - DNA, 25 bp, Mus musculus
tctcctgggaggagtagttctccgg

SEQ ID NO: 400918 - DNA, 25 bp, Mus musculus
gcccgctacgcggacttctgggaaa

SEQ ID NO: 400919 - DNA, 25 bp, Mus musculus
gtttttgctctgtaggcaggacgga

SEQ ID NO: 400920 - DNA, 25 bp, Mus musculus
ccaatggcgacagtggtggactaac

SEQ ID NO: 400921 - DNA, 25 bp, Mus musculus
gcggcgaaagctaccgatccacttc

SEQ ID NO: 400922 - DNA, 25 bp, Mus musculus
ttcggactccatgcggcgaaagcta

SEQ ID NO: 400923 - DNA, 25 bp, Mus musculus
ttcatctccgtgaaagctcagagtc

SEQ ID NO: 400924 - DNA, 25 bp, Mus musculus
ggatccagctctaccacctcaatga

SEQ ID NO: 400925 - DNA, 25 bp, Mus musculus
ggcctcaggagcgtcagttctcacc

SEQ ID NO: 400926 - DNA, 25 bp, Mus musculus
ccgccaatcataaggcagaactagg

SEQ ID NO: 400927 - DNA, 25 bp, Mus musculus
ggtggactaacagagccgccaatca

SEQ ID NO: 400928 - DNA, 25 bp, Mus musculus
acgtcgggaaatggagttctgtgtc

SEQ ID NO: 400929 - DNA, 25 bp, Mus musculus
ccgctgtaaagcgatccgatggaga

SEQ ID NO: 400930 - DNA, 25 bp, Mus musculus
ctccgagagggtcctttgaactgtt

SEQ ID NO: 400931 - DNA, 25 bp, Mus musculus
cgcacgcgccgattcaagttgttaa

SEQ ID NO: 400932 - DNA, 25 bp, Mus musculus
ggcattttctgattccttactggtc

SEQ ID NO: 400933 - DNA, 25 bp, Mus musculus
tgaactgttgaagtcggccgctgta

SEQ ID NO: 400934 - DNA, 25 bp, Mus musculus
taggctccaggaaagccgactactc

SEQ ID NO: 400935 - DNA, 25 bp, Mus musculus
cctgggttaagctgcaaggcacgtc

SEQ ID NO: 400936 - DNA, 25 bp, Mus musculus
gcctacggtgctgatgagcagctcc

SEQ ID NO: 400937 - DNA, 25 bp, Mus musculus
ggcagccactccagtaccttcgggg

SEQ ID NO: 400938 - DNA, 25 bp, Mus musculus
ggagcccacgctgatgcaatcggaa

SEQ ID NO: 400939 - DNA, 25 bp, Mus musculus
gaacagtctcatcgtgcctcggagc

SEQ ID NO: 400940 - DNA, 25 bp, Mus musculus
tcgttgaagtggtatcgcacgcgcc

SEQ ID NO: 400941 - DNA, 25 bp, Mus musculus
ggggaaccctcgctcacgaacagtc

SEQ ID NO: 400942 - DNA, 25 bp, Mus musculus
tcggcccgcgcgtgccagaaaagtt

SEQ ID NO: 400943 - DNA, 25 bp, Mus musculus
acttgcctgcgctgttccggaccgt

SEQ ID NO: 400944 - DNA, 25 bp, Mus musculus
caccgaatgcggttgcgccacaagc

SEQ ID NO: 400945 - DNA, 25 bp, Mus musculus
ggcagaacgaaaggaccctagcctg

SEQ ID NO: 400946 - DNA, 25 bp, Mus musculus
tgagtggttcacatttactggaagc

SEQ ID NO: 400947 - DNA, 25 bp, Mus musculus
tgttccggaccgtgagatccgcctg

SEQ ID NO: 400948 - DNA, 25 bp, Mus musculus
tttactggaagcaacgccggttcgc

SEQ ID NO: 400949 - DNA, 25 bp, Mus musculus
cgtgccagaaaagttcgggcgcctg

SEQ ID NO: 400950 - DNA, 25 bp, Mus musculus
aggaccctagcctggctccggagca

SEQ ID NO: 400951 - DNA, 25 bp, Mus musculus
gtgaagaccggaacaggcagaacga

SEQ ID NO: 400952 - DNA, 25 bp, Mus musculus
cccgggcgcacatggaaagtgaaga

SEQ ID NO: 400953 - DNA, 25 bp, Mus musculus
gggccatatgtcctgcccgggcgca

SEQ ID NO: 400954 - DNA, 25 bp, Mus musculus
gttgcgccacaagcccgggccatat

SEQ ID NO: 400955 - DNA, 25 bp, Mus musculus
cacgacccaggtgtgagtggttcac

SEQ ID NO: 400956 - DNA, 25 bp, Mus musculus
ctgctggcgcatcgctgctaagcct

SEQ ID NO: 400957 - DNA, 25 bp, Mus musculus
tttcagaggcatctgccacccgctg

SEQ ID NO: 400958 - DNA, 25 bp, Mus musculus
gaccttagtggctctcctgcgcctt

SEQ ID NO: 400959 - DNA, 25 bp, Mus musculus
cgtctctggagaccttagtggctct

SEQ ID NO: 400960 - DNA, 25 bp, Mus musculus
acccgctgcgtctctggagacctta

SEQ ID NO: 400961 - DNA, 25 bp, Mus musculus
ttgacgctttcagaggcatctgcca

SEQ ID NO: 400962 - DNA, 25 bp, Mus musculus
gttgcctgacaacgcgttgacgctt

SEQ ID NO: 400963 - DNA, 25 bp, Mus musculus
tgggcccgccggttgcctgacaacg

SEQ ID NO: 400964 - DNA, 25 bp, Mus musculus
cccaggtgctggtctcgaggctgcc

SEQ ID NO: 400965 - DNA, 25 bp, Mus musculus
aagcctcgcagagtgcttgcacccg

SEQ ID NO: 400966 - DNA, 25 bp, Mus musculus
tcgctgctaagcctcgcagagtgct

SEQ ID NO: 400967 - DNA, 25 bp, Mus musculus
agtcgccggaaccacggactgtgga

SEQ ID NO: 400968 - DNA, 25 bp, Mus musculus
cgtggcttctcgctgggagtaagtc

SEQ ID NO: 400969 - DNA, 25 bp, Mus musculus
tgcgccttctcttctgctggcgcat

SEQ ID NO: 400970 - DNA, 25 bp, Mus musculus
gctattcttcgccttcgtgctgctc

SEQ ID NO: 400971 - DNA, 25 bp, Mus musculus
ggctgctcttccgaatcgggttagt

SEQ ID NO: 400972 - DNA, 25 bp, Mus musculus
tggctgctattcttcgccttcgtgc

SEQ ID NO: 400973 - DNA, 25 bp, Mus musculus
cagcgcgtgccaggccgtagctggc

SEQ ID NO: 400974 - DNA, 25 bp, Mus musculus
gtctccggctgttggctgctattct

SEQ ID NO: 400975 - DNA, 25 bp, Mus musculus
ggcctcctcatgacgcgcagccagc

SEQ ID NO: 400976 - DNA, 25 bp, Mus musculus
atcgcaccctagcgcgcaggtgctg

SEQ ID NO: 400977 - DNA, 25 bp, Mus musculus
ggagccaagtgccatcgcaccctag

SEQ ID NO: 400978 - DNA, 25 bp, Mus musculus
tgggcggagccaagtgccatcgcac

SEQ ID NO: 400979 - DNA, 25 bp, Mus musculus
gagccgggtctgaacgcgatgtagt

SEQ ID NO: 400980 - DNA, 25 bp, Mus musculus
gcccaggctccgatctgtgcaggct

SEQ ID NO: 400981 - DNA, 25 bp, Mus musculus
ggttagtgcccaggctccgatctgt

SEQ ID NO: 400982 - DNA, 25 bp, Mus musculus
ttccgaatcgggttagtgcccaggc

SEQ ID NO: 400983 - DNA, 25 bp, Mus musculus
ctgccaagaacagcggggtttccgc

SEQ ID NO: 400984 - DNA, 25 bp, Mus musculus
ttccatgtttgcatccgcctcgcgg

SEQ ID NO: 400985 - DNA, 25 bp, Mus musculus
accagtgcgctcgaggcttctcgta

SEQ ID NO: 400986 - DNA, 25 bp, Mus musculus
gtccggccagcacaccgcaggaaga

SEQ ID NO: 400987 - DNA, 25 bp, Mus musculus
gggttacggctgtccgctctgccac

SEQ ID NO: 400988 - DNA, 25 bp, Mus musculus
gcttgcagggatctcccgccaacta

SEQ ID NO: 400989 - DNA, 25 bp, Mus musculus
aggcttctcgtagtggggaaactga

SEQ ID NO: 400990 - DNA, 25 bp, Mus musculus
tttgaactccgcgagagtctgaggc

SEQ ID NO: 400991 - DNA, 25 bp, Mus musculus
gtgcggccgagagagtttgaactcc

SEQ ID NO: 400992 - DNA, 25 bp, Mus musculus
ttactcagatcagcaaggaggaggc

SEQ ID NO: 400993 - DNA, 25 bp, Mus musculus
gacagctcggccgtcattactcaga

SEQ ID NO: 400994 - DNA, 25 bp, Mus musculus
tgttgtaacaaagtttcctccgcgc

SEQ ID NO: 400995 - DNA, 25 bp, Mus musculus
cctcgcggggaggaaactccatgtt

SEQ ID NO: 400996 - DNA, 25 bp, Mus musculus
cgcccgggttccatgtttgcatccg

SEQ ID NO: 400997 - DNA, 25 bp, Mus musculus
ccagtttggcgccaatgggacgaga

SEQ ID NO: 400998 - DNA, 25 bp, Mus musculus
ggccagtagtttgcagacgtcattt

SEQ ID NO: 400999 - DNA, 25 bp, Mus musculus
tcggatgtccgtctcagcctgtttt

SEQ ID NO: 401000 - DNA, 25 bp, Mus musculus
ctgttttctagctcccagatccggg

SEQ ID NO: 401001 - DNA, 25 bp, Mus musculus
gtcttacctgcgctagagggtccca

SEQ ID NO: 401002 - DNA, 25 bp, Mus musculus
gcggcacttcatcttgggcatcaga

SEQ ID NO: 401003 - DNA, 25 bp, Mus musculus
tgagattatttgctaggccgaggtc

SEQ ID NO: 401004 - DNA, 25 bp, Mus musculus
gacgtcattttgatcccgaatctga

SEQ ID NO: 401005 - DNA, 25 bp, Mus musculus
tttacctgcgatgctgtggggatac

SEQ ID NO: 401006 - DNA, 25 bp, Mus musculus
ccttcgggagaaagtcagagttcac

SEQ ID NO: 401007 - DNA, 25 bp, Mus musculus
accgcttgagcatgcgcaattcgtg

SEQ ID NO: 401008 - DNA, 25 bp, Mus musculus
agggtcccagctccggacaagcttg

SEQ ID NO: 401009 - DNA, 25 bp, Mus musculus
cgggaactatgactacacgcaaaca

SEQ ID NO: 401010 - DNA, 25 bp, Mus musculus
cccgccgtgacgacactgtaataca

SEQ ID NO: 401011 - DNA, 25 bp, Mus musculus
ctgtaatacacatgcgcaccgtcca

SEQ ID NO: 401012 - DNA, 25 bp, Mus musculus
tgcatcgtcacggttctggtcctga

SEQ ID NO: 401013 - DNA, 25 bp, Mus musculus
agacgcccgagtccagcagagatgc

SEQ ID NO: 401014 - DNA, 25 bp, Mus musculus
cctgcaaggcttgggatgatgcatc

SEQ ID NO: 401015 - DNA, 25 bp, Mus musculus
gagctgcatctctatggtccgactg

SEQ ID NO: 401016 - DNA, 25 bp, Mus musculus
ggcggcgacgacagcttttacactg

SEQ ID NO: 401017 - DNA, 25 bp, Mus musculus
cccaggcgcctctaggaatctgacg

SEQ ID NO: 401018 - DNA, 25 bp, Mus musculus
ctgtctctcttcaaggcccgtgcta

SEQ ID NO: 401019 - DNA, 25 bp, Mus musculus
cccaaagcggaaccatcgagaattg

SEQ ID NO: 401020 - DNA, 25 bp, Mus musculus
tggccggaagtagatgcagcagtcc

SEQ ID NO: 401021 - DNA, 25 bp, Mus musculus
ctgcctcttcgtaggcccggcgaaa

SEQ ID NO: 401022 - DNA, 25 bp, Mus musculus
gcccggcgaaaccatcgagtgtgag

SEQ ID NO: 401023 - DNA, 25 bp, Mus musculus
tcccacgttcctggaagcgcgagca

SEQ ID NO: 401024 - DNA, 25 bp, Mus musculus
agggcccactcaagctggagctaga

SEQ ID NO: 401025 - DNA, 25 bp, Mus musculus
cttttacactgtggggcgacagcca

SEQ ID NO: 401026 - DNA, 25 bp, Mus musculus
gccagccaaaacctatgacccaaag

SEQ ID NO: 401027 - DNA, 25 bp, Mus musculus
gcccagctggcaaggccgccgtaga

SEQ ID NO: 401028 - DNA, 25 bp, Mus musculus
gccgtagacccagtcccttctcaga

SEQ ID NO: 401029 - DNA, 25 bp, Mus musculus
ccggtccagtagctcgcctacgaaa

SEQ ID NO: 401030 - DNA, 25 bp, Mus musculus
ctcgcctacgaaaggatgtctcttc

SEQ ID NO: 401031 - DNA, 25 bp, Mus musculus
cgaaaggatgtctcttctatccctc

SEQ ID NO: 401032 - DNA, 25 bp, Mus musculus
cttgatccaccctttatgcccgtgg

SEQ ID NO: 401033 - DNA, 25 bp, Mus musculus
tatgcccgtggttcggacggtccga

SEQ ID NO: 401034 - DNA, 25 bp, Mus musculus
ttcggacggtccgaagctgttgcta

SEQ ID NO: 401035 - DNA, 25 bp, Mus musculus
aagctgttgctagttcccggcacca

SEQ ID NO: 401036 - DNA, 25 bp, Mus musculus
accagatccaggcagccagccaaaa

SEQ ID NO: 401037 - DNA, 25 bp, Mus musculus
tgacccaaagttaccagtcctcttc

SEQ ID NO: 401038 - DNA, 25 bp, Mus musculus
gcggagtaaaagaaagctgacgccg

SEQ ID NO: 401039 - DNA, 25 bp, Mus musculus
gctagttcccggcaccagatccagg

SEQ ID NO: 401040 - DNA, 25 bp, Mus musculus
ctcggcagcctccacgcggggagaa

SEQ ID NO: 401041 - DNA, 25 bp, Mus musculus
gagcttggttgctagggacacctga

SEQ ID NO: 401042 - DNA, 25 bp, Mus musculus
ttctggccttagatctgtccgctgg

SEQ ID NO: 401043 - DNA, 25 bp, Mus musculus
ccattcctttctggccttagatctg

SEQ ID NO: 401044 - DNA, 25 bp, Mus musculus
cctttctctggtgagtcggagaccg

SEQ ID NO: 401045 - DNA, 25 bp, Mus musculus
gccacctcgcctttctctggtgagt

SEQ ID NO: 401046 - DNA, 25 bp, Mus musculus
acacccttctcggtcctggtttcag

SEQ ID NO: 401047 - DNA, 25 bp, Mus musculus
cctccacgcggggagaacttcgttg

SEQ ID NO: 401048 - DNA, 25 bp, Mus musculus
tggtcgcagagctggtgtccgaccc

SEQ ID NO: 401049 - DNA, 25 bp, Mus musculus
tccagtcgcggcgaagtagggtacc

SEQ ID NO: 401050 - DNA, 25 bp, Mus musculus
tagggacacctgaggtcgcccgctc

SEQ ID NO: 401051 - DNA, 25 bp, Mus musculus
ggtttcagcgtgtcctctttcccgc

SEQ ID NO: 401052 - DNA, 25 bp, Mus musculus
ggtcctggtttcagcgtgtcctctt

SEQ ID NO: 401053 - DNA, 25 bp, Mus musculus
gaacttcgttggcttctcctcgggc

SEQ ID NO: 401054 - DNA, 25 bp, Mus musculus
aacaggtcaagaccggccgcgcctg

SEQ ID NO: 401055 - DNA, 25 bp, Mus musculus
ccaaggccacgatccctgcagccct

SEQ ID NO: 401056 - DNA, 25 bp, Mus musculus
tccatggctgcgtggagccgcacga

SEQ ID NO: 401057 - DNA, 25 bp, Mus musculus
aggctgagatggacgctcctggacc

SEQ ID NO: 401058 - DNA, 25 bp, Mus musculus
tcctggacccgcgtgtggtgggccg

SEQ ID NO: 401059 - DNA, 25 bp, Mus musculus
ccacaaggggccagagccaaggcca

SEQ ID NO: 401060 - DNA, 25 bp, Mus musculus
cagagccaaggccacgatccctgca

SEQ ID NO: 401061 - DNA, 25 bp, Mus musculus
cacgatccatggctgcgtggagccg

SEQ ID NO: 401062 - DNA, 25 bp, Mus musculus
ccctccaggcacaggagagtacgga

SEQ ID NO: 401063 - DNA, 25 bp, Mus musculus
gcacaggagagtacggagggtccag

SEQ ID NO: 401064 - DNA, 25 bp, Mus musculus
gagggtccaggaacaggtcaagacc

SEQ ID NO: 401065 - DNA, 25 bp, Mus musculus
aggaacaggtcaagaccggccgcgc

SEQ ID NO: 401066 - DNA, 25 bp, Mus musculus
tcaagaccggccgcgcctgcggagt

SEQ ID NO: 401067 - DNA, 25 bp, Mus musculus
gtccaggaacaggtcaagaccggcc

SEQ ID NO: 401068 - DNA, 25 bp, Mus musculus
agggagcgcttaacccgcagctgtt

SEQ ID NO: 401069 - DNA, 25 bp, Mus musculus
ccatgcggccagctctagtccgtta

SEQ ID NO: 401070 - DNA, 25 bp, Mus musculus
gcgggctacacacgggcgcccacac

SEQ ID NO: 401071 - DNA, 25 bp, Mus musculus
agccacgcgcttgctgtccttctct

SEQ ID NO: 401072 - DNA, 25 bp, Mus musculus
cccaggcaatgtgtgctccagctcg

SEQ ID NO: 401073 - DNA, 25 bp, Mus musculus
cccgcagctgttcccgcactgcagc

SEQ ID NO: 401074 - DNA, 25 bp, Mus musculus
tccgttagcaagtgcgcgacaggcg

SEQ ID NO: 401075 - DNA, 25 bp, Mus musculus
tggcactattctgggctggtccctg

SEQ ID NO: 401076 - DNA, 25 bp, Mus musculus
tccctggcggcaggcccttgagaga

SEQ ID NO: 401077 - DNA, 25 bp, Mus musculus
caggcccttgagagatcgggttctc

SEQ ID NO: 401078 - DNA, 25 bp, Mus musculus
gttctctctgattgtcaggtcttgg

SEQ ID NO: 401079 - DNA, 25 bp, Mus musculus
tctctgattgtcaggtcttgggagg

SEQ ID NO: 401080 - DNA, 25 bp, Mus musculus
ctgcggaggcggaactctcatcttc

SEQ ID NO: 401081 - DNA, 25 bp, Mus musculus
ctctagtccgttagcaagtgcgcga

SEQ ID NO: 401082 - DNA, 25 bp, Mus musculus
gactgtcatcgagcggctggttaga

SEQ ID NO: 401083 - DNA, 25 bp, Mus musculus
cgggacatgagttcctgctgcagtc

SEQ ID NO: 401084 - DNA, 25 bp, Mus musculus
agatccgcacggtcccgggacatga

SEQ ID NO: 401085 - DNA, 25 bp, Mus musculus
cctcgcagcgttttaggcactccta

SEQ ID NO: 401086 - DNA, 25 bp, Mus musculus
ccggaacgtcctgcacgtgagtgtc

SEQ ID NO: 401087 - DNA, 25 bp, Mus musculus
agtctccgatagagccctgcctttg

SEQ ID NO: 401088 - DNA, 25 bp, Mus musculus
agagaccaaccttgcagagcctaca

SEQ ID NO: 401089 - DNA, 25 bp, Mus musculus
tatgggtatcggacaaggaagtctc

SEQ ID NO: 401090 - DNA, 25 bp, Mus musculus
gagcctacaagagcggggtctgttc

SEQ ID NO: 401091 - DNA, 25 bp, Mus musculus
cctgcctttgactcctgctggaatg

SEQ ID NO: 401092 - DNA, 25 bp, Mus musculus
ggggtgcagatgttctcctgtccaa

SEQ ID NO: 401093 - DNA, 25 bp, Mus musculus
ggaaccggtgtccaagtccctgatg

SEQ ID NO: 401094 - DNA, 25 bp, Mus musculus
ttccagtacgaagcggaccggagct

SEQ ID NO: 401095 - DNA, 25 bp, Mus musculus
gcggaacaagttaaagcggctaatc

SEQ ID NO: 401096 - DNA, 25 bp, Mus musculus
tggctgctgggtccgctctccgcct

SEQ ID NO: 401097 - DNA, 25 bp, Mus musculus
ccgcctgactgtcgcaactgccacc

SEQ ID NO: 401098 - DNA, 25 bp, Mus musculus
gagtcccgccgcctgactgtcgcaa

SEQ ID NO: 401099 - DNA, 25 bp, Mus musculus
cagcgagctccgcaggagacacagg

SEQ ID NO: 401100 - DNA, 25 bp, Mus musculus
tccgcaggagacacaggcgctggct

SEQ ID NO: 401101 - DNA, 25 bp, Mus musculus
ggtagagctctcaggatgctgccgc

SEQ ID NO: 401102 - DNA, 25 bp, Mus musculus
gagccctagtctccgggccgccgcc

SEQ ID NO: 401103 - DNA, 25 bp, Mus musculus
ctcggtcgccgcgtttgccctgaag

SEQ ID NO: 401104 - DNA, 25 bp, Mus musculus
gccgcgtttgccctgaagcccggtg

SEQ ID NO: 401105 - DNA, 25 bp, Mus musculus
cccggccagactgcggtagagctct

SEQ ID NO: 401106 - DNA, 25 bp, Mus musculus
ccagactgcggtagagctctcagga

SEQ ID NO: 401107 - DNA, 25 bp, Mus musculus
actgcggtagagctctcaggatgct

SEQ ID NO: 401108 - DNA, 25 bp, Mus musculus
gtgccctcccgcctcggactgctgc

SEQ ID NO: 401109 - DNA, 25 bp, Mus musculus
agctccgcaggagacacaggcgctg

SEQ ID NO: 401110 - DNA, 25 bp, Mus musculus
gccgtggagatatccgtgcattggt

SEQ ID NO: 401111 - DNA, 25 bp, Mus musculus
atgtcagagtgtgtcagcgtgtgtc

SEQ ID NO: 401112 - DNA, 25 bp, Mus musculus
ccttctgggcactcctggacctcca

SEQ ID NO: 401113 - DNA, 25 bp, Mus musculus
ccaggaccaactggctctccagatg

SEQ ID NO: 401114 - DNA, 25 bp, Mus musculus
ctggctctccagatgctagcgcagc

SEQ ID NO: 401115 - DNA, 25 bp, Mus musculus
cttcggggatgagaagtcaagactc

SEQ ID NO: 401116 - DNA, 25 bp, Mus musculus
tcaagactctttatggatgcgcagc

SEQ ID NO: 401117 - DNA, 25 bp, Mus musculus
tttatggatgcgcagcacaagcggg

SEQ ID NO: 401118 - DNA, 25 bp, Mus musculus
tgcaactgcacaacaacgaggcggg

SEQ ID NO: 401119 - DNA, 25 bp, Mus musculus
tgcacaacaacgaggcgggcaggct

SEQ ID NO: 401120 - DNA, 25 bp, Mus musculus
tatgggcagaagaagcaggcgttat

SEQ ID NO: 401121 - DNA, 25 bp, Mus musculus
aagaagcaggcgttatgcatgcgtg

SEQ ID NO: 401122 - DNA, 25 bp, Mus musculus
cacaagtaaaggtgtgaatgtcaga

SEQ ID NO: 401123 - DNA, 25 bp, Mus musculus
atatccgtgcattggtgcaactgca

SEQ ID NO: 401124 - DNA, 25 bp, Mus musculus
ctactgggatgcgtgatcggagcac

SEQ ID NO: 401125 - DNA, 25 bp, Mus musculus
ccatgttgagaggaaacgacgcgtc

SEQ ID NO: 401126 - DNA, 25 bp, Mus musculus
aacgacgcgtcacgcagcggccgaa

SEQ ID NO: 401127 - DNA, 25 bp, Mus musculus
gccggagctgcaactctacggcggc

SEQ ID NO: 401128 - DNA, 25 bp, Mus musculus
ccctagctaccgtggggaccagcat

SEQ ID NO: 401129 - DNA, 25 bp, Mus musculus
tcacactgccagcaggcgcgaggct

SEQ ID NO: 401130 - DNA, 25 bp, Mus musculus
gccaagggcgtcgaaagcctcgcca

SEQ ID NO: 401131 - DNA, 25 bp, Mus musculus
tcttgccctcatacatggacgcgga

SEQ ID NO: 401132 - DNA, 25 bp, Mus musculus
ggaacatgttcttcgtcttcttgcc

SEQ ID NO: 401133 - DNA, 25 bp, Mus musculus
gcccgggtcaggaacatgttcttcg

SEQ ID NO: 401134 - DNA, 25 bp, Mus musculus
tgtcggccagaatcttctccagggc

SEQ ID NO: 401135 - DNA, 25 bp, Mus musculus
cttcttcacttccttgtcggccaga

SEQ ID NO: 401136 - DNA, 25 bp, Mus musculus
cacgctttgcgcagctgggagtgat

SEQ ID NO: 401137 - DNA, 25 bp, Mus musculus
cccggacgccatgttgagaggaaac

SEQ ID NO: 401138 - DNA, 25 bp, Mus musculus
accgccaggagagcgtacagctcga

SEQ ID NO: 401139 - DNA, 25 bp, Mus musculus
ccgagtgtaagtgccatgggctttc

SEQ ID NO: 401140 - DNA, 25 bp, Mus musculus
gcgctctgcgcacctgctggcagaa

SEQ ID NO: 401141 - DNA, 25 bp, Mus musculus
cagaagctgcctccgttccgcgagg

SEQ ID NO: 401142 - DNA, 25 bp, Mus musculus
tcatgggcaccaacgacggcaaagc

SEQ ID NO: 401143 - DNA, 25 bp, Mus musculus
aacgacggcaaagctctgctgcctg

SEQ ID NO: 401144 - DNA, 25 bp, Mus musculus
cccggcttcctttgcgttttgtctg

SEQ ID NO: 401145 - DNA, 25 bp, Mus musculus
gacctcagcggctgcgacctgttgt

SEQ ID NO: 401146 - DNA, 25 bp, Mus musculus
gtcacacgcgcaccgagtgtaagtg

SEQ ID NO: 401147 - DNA, 25 bp, Mus musculus
cagctcgaggagaactgtctgtgcc

SEQ ID NO: 401148 - DNA, 25 bp, Mus musculus
tgtctgtgccgcttccactggtgct

SEQ ID NO: 401149 - DNA, 25 bp, Mus musculus
tgctgcgtggtgcaatgccaccgct

SEQ ID NO: 401150 - DNA, 25 bp, Mus musculus
gcaaggaactcagcctgtgcctctg

SEQ ID NO: 401151 - DNA, 25 bp, Mus musculus
cggacgagcggatctcctctacgca

SEQ ID NO: 401152 - DNA, 25 bp, Mus musculus
taggagctgtgtgtcgcagccgccc

SEQ ID NO: 401153 - DNA, 25 bp, Mus musculus
ccctgccgatcatgcgccggcgacc

SEQ ID NO: 401154 - DNA, 25 bp, Mus musculus
tggttcgccagtcccactgggctgt

SEQ ID NO: 401155 - DNA, 25 bp, Mus musculus
tcgccagtcccactgggctgtgagc

SEQ ID NO: 401156 - DNA, 25 bp, Mus musculus
ctggctgcggctcccacaagggccc

SEQ ID NO: 401157 - DNA, 25 bp, Mus musculus
gcgcccgcctcgcacaccctcggaa

SEQ ID NO: 401158 - DNA, 25 bp, Mus musculus
acctgagtaggagctgtgtgtcgca

SEQ ID NO: 401159 - DNA, 25 bp, Mus musculus
tgggaaattccctggacccctgtgc

SEQ ID NO: 401160 - DNA, 25 bp, Mus musculus
accaggagttgtcgcaaggggccct

SEQ ID NO: 401161 - DNA, 25 bp, Mus musculus
ctagaggcaccaggagttgtcgcaa

SEQ ID NO: 401162 - DNA, 25 bp, Mus musculus
ttaccctctagaggcaccaggagtt

SEQ ID NO: 401163 - DNA, 25 bp, Mus musculus
ccagcccgctgcacctccttaccct

SEQ ID NO: 401164 - DNA, 25 bp, Mus musculus
gcacaccctcggaagcgcaggctcg

SEQ ID NO: 401165 - DNA, 25 bp, Mus musculus
cactcctggcctgtcacggcccgcg

SEQ ID NO: 401166 - DNA, 25 bp, Mus musculus
gtggtgcacgcagtgtccaacgcgt

SEQ ID NO: 401167 - DNA, 25 bp, Mus musculus
gagtgctttcgcctacgccatagca

SEQ ID NO: 401168 - DNA, 25 bp, Mus musculus
cctacgccatagcagctgccggggt

SEQ ID NO: 401169 - DNA, 25 bp, Mus musculus
cagacgtggggacgaagaagctttc

SEQ ID NO: 401170 - DNA, 25 bp, Mus musculus
cgagagagtgctttcgcctacgcca

SEQ ID NO: 401171 - DNA, 25 bp, Mus musculus
acgcagtgtccaacgcgtgcgctct

SEQ ID NO: 401172 - DNA, 25 bp, Mus musculus
tgcaccgcttgcagctggacgcgct

SEQ ID NO: 401173 - DNA, 25 bp, Mus musculus
gacgaagaagctttccgtcggaagc

SEQ ID NO: 401174 - DNA, 25 bp, Mus musculus
cgcctccagacgtggggacgaagaa

SEQ ID NO: 401175 - DNA, 25 bp, Mus musculus
ttgcggttgcgacgcctccagacgt

SEQ ID NO: 401176 - DNA, 25 bp, Mus musculus
aactgaaggcttgcggttgcgacgc

SEQ ID NO: 401177 - DNA, 25 bp, Mus musculus
cgctctgggtaaactgaaggcttgc

SEQ ID NO: 401178 - DNA, 25 bp, Mus musculus
ccaacgcgtgcgctctgggtaaact

SEQ ID NO: 401179 - DNA, 25 bp, Mus musculus
ctttccgtcggaagctgcaccgctt

SEQ ID NO: 401180 - DNA, 25 bp, Mus musculus
ctggtgctgcttcgtggtctgcgaa

SEQ ID NO: 401181 - DNA, 25 bp, Mus musculus
ctgagttccgcacagtaggggcgct

SEQ ID NO: 401182 - DNA, 25 bp, Mus musculus
taggggcgctgctgcgcaaccgctt

SEQ ID NO: 401183 - DNA, 25 bp, Mus musculus
acaaccgcaacggtggccagctgga

SEQ ID NO: 401184 - DNA, 25 bp, Mus musculus
gccactccgacctggtctactttga

SEQ ID NO: 401185 - DNA, 25 bp, Mus musculus
tccgacctggtctactttgagaaat

SEQ ID NO: 401186 - DNA, 25 bp, Mus musculus
tttgagaaatctcccgacttctgtg

SEQ ID NO: 401187 - DNA, 25 bp, Mus musculus
tctcccgacttctgtgagcgcgagc

SEQ ID NO: 401188 - DNA, 25 bp, Mus musculus
cgcgcctggactcggcaggcactgt

SEQ ID NO: 401189 - DNA, 25 bp, Mus musculus
gggccgcctgtgcaataagagcagc

SEQ ID NO: 401190 - DNA, 25 bp, Mus musculus
gtggccgcggccacaacattctgcg

SEQ ID NO: 401191 - DNA, 25 bp, Mus musculus
gaatgccgcatcaccgagtgggtca

SEQ ID NO: 401192 - DNA, 25 bp, Mus musculus
cgtggtctgcgaagaatgccgcatc

SEQ ID NO: 401193 - DNA, 25 bp, Mus musculus
aataagagcagcacgggtcccgatg

SEQ ID NO: 401194 - DNA, 25 bp, Mus musculus
gccttttaagctggctagccgtgtt

SEQ ID NO: 401195 - DNA, 25 bp, Mus musculus
ccggggctagaacgctagctgtagc

SEQ ID NO: 401196 - DNA, 25 bp, Mus musculus
gctagaacgctagctgtagcgagat

SEQ ID NO: 401197 - DNA, 25 bp, Mus musculus
ttgggcgtctgcctacggagctccc

SEQ ID NO: 401198 - DNA, 25 bp, Mus musculus
tccgcggaagtctggctcggctgct

SEQ ID NO: 401199 - DNA, 25 bp, Mus musculus
gttcttcgctggtccgcggaagtct

SEQ ID NO: 401200 - DNA, 25 bp, Mus musculus
ttaagctggctagccgtgttcttcg

SEQ ID NO: 401201 - DNA, 25 bp, Mus musculus
cggagtcggtgccttttaagctggc

SEQ ID NO: 401202 - DNA, 25 bp, Mus musculus
atctccggttcccagtgcggaagtg

SEQ ID NO: 401203 - DNA, 25 bp, Mus musculus
cgagatctccggttcccagtgcgga

SEQ ID NO: 401204 - DNA, 25 bp, Mus musculus
cccgccggggctagaacgctagctg

SEQ ID NO: 401205 - DNA, 25 bp, Mus musculus
tccggttcccagtgcggaagtgaga

SEQ ID NO: 401206 - DNA, 25 bp, Mus musculus
ctagccgtgttcttcgctggtccgc

SEQ ID NO: 401207 - DNA, 25 bp, Mus musculus
tcggtgccttttaagctggctagcc

SEQ ID NO: 401208 - DNA, 25 bp, Mus musculus
ccgacggtggcggaacagccaagcc

SEQ ID NO: 401209 - DNA, 25 bp, Mus musculus
gcgagaaccttctccgcaagggccg

SEQ ID NO: 401210 - DNA, 25 bp, Mus musculus
cacttcttcacgcaagtctttcaag

SEQ ID NO: 401211 - DNA, 25 bp, Mus musculus
cgcagatgctgcgactcaacgccga

SEQ ID NO: 401212 - DNA, 25 bp, Mus musculus
tcaagccgttcctcgtggagcccga

SEQ ID NO: 401213 - DNA, 25 bp, Mus musculus
gcctactcctacatgggcaacgaga

SEQ ID NO: 401214 - DNA, 25 bp, Mus musculus
gccaacctggtgttcgtgtacctgc

SEQ ID NO: 401215 - DNA, 25 bp, Mus musculus
tgcagggctggcaagaccaggcctt

SEQ ID NO: 401216 - DNA, 25 bp, Mus musculus
acttcgtgtgccgacgctgctaccg

SEQ ID NO: 401217 - DNA, 25 bp, Mus musculus
aaacggccgtccgtgctcatctcgg

SEQ ID NO: 401218 - DNA, 25 bp, Mus musculus
cagcaaaaaggtgacgcccaagcca

SEQ ID NO: 401219 - DNA, 25 bp, Mus musculus
ctagtggcagcctcggccaagaaga

SEQ ID NO: 401220 - DNA, 25 bp, Mus musculus
tctttcaagacctcaagaacgaggg

SEQ ID NO: 401221 - DNA, 25 bp, Mus musculus
tctggtccagcaacgcaaccgcgag

SEQ ID NO: 401222 - DNA, 25 bp, Mus musculus
aagatcacttgggtcactccgcggc

SEQ ID NO: 401223 - DNA, 25 bp, Mus musculus
gcagtcaacgcggtgccgtcatctc

SEQ ID NO: 401224 - DNA, 25 bp, Mus musculus
cggtgccgtcatctctctggatttg

SEQ ID NO: 401225 - DNA, 25 bp, Mus musculus
cggctgtcgctatggtaaccagact

SEQ ID NO: 401226 - DNA, 25 bp, Mus musculus
ggaaggaagatcacttgggtcactc

SEQ ID NO: 401227 - DNA, 25 bp, Mus musculus
cgtcatctctctggatttgggagga

SEQ ID NO: 401228 - DNA, 25 bp, Mus musculus
cactccgcggctgtcgctatggtaa

SEQ ID NO: 401229 - DNA, 25 bp, Mus musculus
tggctggaatttggcgcagtcaacg

SEQ ID NO: 401230 - DNA, 25 bp, Mus musculus
aatttggcgcagtcaacgcggtgcc

SEQ ID NO: 401231 - DNA, 25 bp, Mus musculus
aaatcctcggcccagatttgtgaat

SEQ ID NO: 401232 - DNA, 25 bp, Mus musculus
agatttgtgaatcgagttcccgggg

SEQ ID NO: 401233 - DNA, 25 bp, Mus musculus
gccgcccattggctggaatttggcg

SEQ ID NO: 401234 - DNA, 25 bp, Mus musculus
ccattggctggaatttggcgcagtc

SEQ ID NO: 401235 - DNA, 25 bp, Mus musculus
ctatggtaaccagactgagcgggcg

SEQ ID NO: 401236 - DNA, 25 bp, Mus musculus
ggctttgagagcgacctcgggacaa

SEQ ID NO: 401237 - DNA, 25 bp, Mus musculus
cgccctaattaaagtccttggagtg

SEQ ID NO: 401238 - DNA, 25 bp, Mus musculus
taaagtccttggagtgctgtgcaca

SEQ ID NO: 401239 - DNA, 25 bp, Mus musculus
gtccttggagtgctgtgcacatgaa

SEQ ID NO: 401240 - DNA, 25 bp, Mus musculus
gtgctgtgcacatgaaggctgcaga

SEQ ID NO: 401241 - DNA, 25 bp, Mus musculus
ggctgcagagtacacagctggcctc

SEQ ID NO: 401242 - DNA, 25 bp, Mus musculus
cagagtacacagctggcctcggcca

SEQ ID NO: 401243 - DNA, 25 bp, Mus musculus
gggctacccagtaagccctcctcgc

SEQ ID NO: 401244 - DNA, 25 bp, Mus musculus
accacgccggacgtggtgacgtagc

SEQ ID NO: 401245 - DNA, 25 bp, Mus musculus
tttgagagcgacctcgggacaagcg

SEQ ID NO: 401246 - DNA, 25 bp, Mus musculus
ccccgggaggcgcacacaggaagca

SEQ ID NO: 401247 - DNA, 25 bp, Mus musculus
cacacaggaagcagggacgcgagcg

SEQ ID NO: 401248 - DNA, 25 bp, Mus musculus
aggacgcgctgacgaccacgccgga

SEQ ID NO: 401249 - DNA, 25 bp, Mus musculus
gcctcggccaggagctaagtctaga

SEQ ID NO: 401250 - DNA, 25 bp, Mus musculus
tagcttgtcgtagttcatgttaggc

SEQ ID NO: 401251 - DNA, 25 bp, Mus musculus
cgccgaagctgccatcaagttgagt

SEQ ID NO: 401252 - DNA, 25 bp, Mus musculus
taggagaaaccagcgggcgcaacgc

SEQ ID NO: 401253 - DNA, 25 bp, Mus musculus
tcaagttgagtttggataggcccgg

SEQ ID NO: 401254 - DNA, 25 bp, Mus musculus
cctggaagtcaaagcggtaggcgta

SEQ ID NO: 401255 - DNA, 25 bp, Mus musculus
agcgcttgccgtgcaccttgctcat

SEQ ID NO: 401256 - DNA, 25 bp, Mus musculus
ccttgctcatgatgtttttgtcgta

SEQ ID NO: 401257 - DNA, 25 bp, Mus musculus
gcagcgcgcgacttagcttgtcgta

SEQ ID NO: 401258 - DNA, 25 bp, Mus musculus
atgttaggcttgctcttgcgctcgc

SEQ ID NO: 401259 - DNA, 25 bp, Mus musculus
tcggtgagcttgaactcgccgtggc

SEQ ID NO: 401260 - DNA, 25 bp, Mus musculus
ttcgggccaggccagtaggagaaac

SEQ ID NO: 401261 - DNA, 25 bp, Mus musculus
ctcctccgaggatgaggatgggatt

SEQ ID NO: 401262 - DNA, 25 bp, Mus musculus
cgcggctgctgcaatgaaatctgtg

SEQ ID NO: 401263 - DNA, 25 bp, Mus musculus
ttttgtcgtagtagtagcgcagcgc

SEQ ID NO: 401264 - DNA, 25 bp, Mus musculus
tccgtagcgcccaagtcaggaaacg

SEQ ID NO: 401265 - DNA, 25 bp, Mus musculus
atgctcccagctacaaggccgcttg

SEQ ID NO: 401266 - DNA, 25 bp, Mus musculus
cctggcaggtacatgttgatcagca

SEQ ID NO: 401267 - DNA, 25 bp, Mus musculus
caaagcaactcactggaagcgtccc

SEQ ID NO: 401268 - DNA, 25 bp, Mus musculus
agctggctgtctaccttgcaggttc

SEQ ID NO: 401269 - DNA, 25 bp, Mus musculus
gtgtcttctagacccacatcgaaac

SEQ ID NO: 401270 - DNA, 25 bp, Mus musculus
cgatcctgaatctgcgtgtcttcta

SEQ ID NO: 401271 - DNA, 25 bp, Mus musculus
tgctttcaacctcctacgatcctga

SEQ ID NO: 401272 - DNA, 25 bp, Mus musculus
ccagcggatcacaaccttcgggcaa

SEQ ID NO: 401273 - DNA, 25 bp, Mus musculus
aaacccagaggggatcgcgctagcc

SEQ ID NO: 401274 - DNA, 25 bp, Mus musculus
atccgctttccaaaggggccggctg

SEQ ID NO: 401275 - DNA, 25 bp, Mus musculus
tgcggcgcagaagaaaacagtcaag

SEQ ID NO: 401276 - DNA, 25 bp, Mus musculus
aagaccatctccgacgggatctgcg

SEQ ID NO: 401277 - DNA, 25 bp, Mus musculus
gccggctgaagccttataaaaccca

SEQ ID NO: 401278 - DNA, 25 bp, Mus musculus
cggcagcgacgaccctggaagtcct

SEQ ID NO: 401279 - DNA, 25 bp, Mus musculus
cgggaacactctacttagcctaagc

SEQ ID NO: 401280 - DNA, 25 bp, Mus musculus
cgcgccgttttccaccttgactgag

SEQ ID NO: 401281 - DNA, 25 bp, Mus musculus
gttttccaccttgactgagcgcacc

SEQ ID NO: 401282 - DNA, 25 bp, Mus musculus
gcacagtcgctcagtagccggcagc

SEQ ID NO: 401283 - DNA, 25 bp, Mus musculus
tcctcctcatcccagagtgtgaggc

SEQ ID NO: 401284 - DNA, 25 bp, Mus musculus
tcatgtcgctgcagataagaagggc

SEQ ID NO: 401285 - DNA, 25 bp, Mus musculus
aagggcaagatcatgggctaacttc

SEQ ID NO: 401286 - DNA, 25 bp, Mus musculus
gggctaacttctcgggaacactcta

SEQ ID NO: 401287 - DNA, 25 bp, Mus musculus
gcaccgcaccgacggaaaatggaga

SEQ ID NO: 401288 - DNA, 25 bp, Mus musculus
tcaccgagtgagtgagcaccgcacc

SEQ ID NO: 401289 - DNA, 25 bp, Mus musculus
gatccggacacaggctgccgctgtg

SEQ ID NO: 401290 - DNA, 25 bp, Mus musculus
aatctagggtctggatccggacaca

SEQ ID NO: 401291 - DNA, 25 bp, Mus musculus
cgctcacagacgttggcacagtcgc

SEQ ID NO: 401292 - DNA, 25 bp, Mus musculus
aaagaaagccgggtcctgctccacg

SEQ ID NO: 401293 - DNA, 25 bp, Mus musculus
ttacaggacgcctagaaggggcttc

SEQ ID NO: 401294 - DNA, 25 bp, Mus musculus
gaaagtgttagatcgcgtccttaca

SEQ ID NO: 401295 - DNA, 25 bp, Mus musculus
gaagcccggtcctattcggatgaaa

SEQ ID NO: 401296 - DNA, 25 bp, Mus musculus
tggtgcaacctctcactgagcgagc

SEQ ID NO: 401297 - DNA, 25 bp, Mus musculus
tggtcctgcatatgctgcacgcgca

SEQ ID NO: 401298 - DNA, 25 bp, Mus musculus
tgcgggttacctctctgaaatactg

SEQ ID NO: 401299 - DNA, 25 bp, Mus musculus
tcgtctttggcccacaccataaagg

SEQ ID NO: 401300 - DNA, 25 bp, Mus musculus
tgccaaccgcttgcgttcgtctttg

SEQ ID NO: 401301 - DNA, 25 bp, Mus musculus
agatctgggttctgctgtgccaacc

SEQ ID NO: 401302 - DNA, 25 bp, Mus musculus
tggtccgactcacctagcatcttgc

SEQ ID NO: 401303 - DNA, 25 bp, Mus musculus
ttgagtctacagcacacctcttggc

SEQ ID NO: 401304 - DNA, 25 bp, Mus musculus
ctcttggctcaaggaagtggctcaa

SEQ ID NO: 401305 - DNA, 25 bp, Mus musculus
tacattcgctcctatggcccaaaga

SEQ ID NO: 401306 - DNA, 25 bp, Mus musculus
tggctctgcgagaccaccgtctctg

SEQ ID NO: 401307 - DNA, 25 bp, Mus musculus
cttcgtcaaaaaagatgggcactgc

SEQ ID NO: 401308 - DNA, 25 bp, Mus musculus
gtgacctgttcaccacatgtgtgga

SEQ ID NO: 401309 - DNA, 25 bp, Mus musculus
cgctggatgtgcctgctcttctcct

SEQ ID NO: 401310 - DNA, 25 bp, Mus musculus
ttcggcctgaccttctggctcatcg

SEQ ID NO: 401311 - DNA, 25 bp, Mus musculus
gctccctgtttctcgcaagtggcca

SEQ ID NO: 401312 - DNA, 25 bp, Mus musculus
tggagacacagacgtccataggcta

SEQ ID NO: 401313 - DNA, 25 bp, Mus musculus
ccataggctatggtgtgcgcagcgt

SEQ ID NO: 401314 - DNA, 25 bp, Mus musculus
tgctgcagtgcatcgcaggctgtgt

SEQ ID NO: 401315 - DNA, 25 bp, Mus musculus
acgccttcgtcgtgggtgcagttat

SEQ ID NO: 401316 - DNA, 25 bp, Mus musculus
tggccaagcccaagaaacgcaacga

SEQ ID NO: 401317 - DNA, 25 bp, Mus musculus
ctgcaatgtgcgcttcgtgaatctg

SEQ ID NO: 401318 - DNA, 25 bp, Mus musculus
tcttcagtgagaacgcagtggtggc

SEQ ID NO: 401319 - DNA, 25 bp, Mus musculus
cgcaacgagacactagtcttcagtg

SEQ ID NO: 401320 - DNA, 25 bp, Mus musculus
aaacgctcaggtccggtttgtgcga

SEQ ID NO: 401321 - DNA, 25 bp, Mus musculus
aaaccagccaggcttggcttcgtcc

SEQ ID NO: 401322 - DNA, 25 bp, Mus musculus
gcggacgccacaggtgcacacctgg

SEQ ID NO: 401323 - DNA, 25 bp, Mus musculus
tgagcaccgcggtggctgacacgtc

SEQ ID NO: 401324 - DNA, 25 bp, Mus musculus
tctcacctgagcaccgcggtggctg

SEQ ID NO: 401325 - DNA, 25 bp, Mus musculus
cggtgtctggtggatgagcttcctc

SEQ ID NO: 401326 - DNA, 25 bp, Mus musculus
gccgaacgaacaaaacgctcaggtc

SEQ ID NO: 401327 - DNA, 25 bp, Mus musculus
tgcctcacgcgagccgaacgaacaa

SEQ ID NO: 401328 - DNA, 25 bp, Mus musculus
ccaaggctgatgctgagaagccgcc

SEQ ID NO: 401329 - DNA, 25 bp, Mus musculus
gtttgcatggcgatctggccggccc

SEQ ID NO: 401330 - DNA, 25 bp, Mus musculus
ctggtgtttgcatggcgatctggcc

SEQ ID NO: 401331 - DNA, 25 bp, Mus musculus
tctctgcgacccatatggtggcggt

SEQ ID NO: 401332 - DNA, 25 bp, Mus musculus
gtgctcagtctctgcgacccatatg

SEQ ID NO: 401333 - DNA, 25 bp, Mus musculus
tgagcttcctcgagtgcacagcgct

SEQ ID NO: 401334 - DNA, 25 bp, Mus musculus
cgtccttgaagatgatgtcgggatt

SEQ ID NO: 401335 - DNA, 25 bp, Mus musculus
cccgtgttctcctcgtccttgaaga

SEQ ID NO: 401336 - DNA, 25 bp, Mus musculus
atcgcgctcacctgggtcatgaggc

SEQ ID NO: 401337 - DNA, 25 bp, Mus musculus
ctgggaggaccgatcgcgctcacct

SEQ ID NO: 401338 - DNA, 25 bp, Mus musculus
ctctttgaagcgctcagagctgcgc

SEQ ID NO: 401339 - DNA, 25 bp, Mus musculus
gatcttgccttcgtagcgcccgctg

SEQ ID NO: 401340 - DNA, 25 bp, Mus musculus
ttggggctgaactgcttgtaggcaa

SEQ ID NO: 401341 - DNA, 25 bp, Mus musculus
cttgtaggcaagaggcacgagcttg

SEQ ID NO: 401342 - DNA, 25 bp, Mus musculus
agcaggaacagacagaaccgcagtc

SEQ ID NO: 401343 - DNA, 25 bp, Mus musculus
gacagcttcggggactcaggcgtct

SEQ ID NO: 401344 - DNA, 25 bp, Mus musculus
cgtttgttttggcaacgcggcgacg

SEQ ID NO: 401345 - DNA, 25 bp, Mus musculus
gcgctcgacagcgaacctgcagcaa

SEQ ID NO: 401346 - DNA, 25 bp, Mus musculus
gcccagggtcttctccggcacgttg

SEQ ID NO: 401347 - DNA, 25 bp, Mus musculus
tcatgaggcggtcggcacccgtgtt

SEQ ID NO: 401348 - DNA, 25 bp, Mus musculus
tgcacacagttacggctcagggccc

SEQ ID NO: 401349 - DNA, 25 bp, Mus musculus
tatctttgcttttcggcgtccggac

SEQ ID NO: 401350 - DNA, 25 bp, Mus musculus
gggccactgcacgagtttatctttg

SEQ ID NO: 401351 - DNA, 25 bp, Mus musculus
tgcgcgcggtcccttctgggaaaaa

SEQ ID NO: 401352 - DNA, 25 bp, Mus musculus
gccgaaaacggactgcgcgtgcgca

SEQ ID NO: 401353 - DNA, 25 bp, Mus musculus
cgacacactaaaaggcagaggccga

SEQ ID NO: 401354 - DNA, 25 bp, Mus musculus
ggaggggcttcacacgacacactaa

SEQ ID NO: 401355 - DNA, 25 bp, Mus musculus
agcctgctaaggaggggcttcacac

SEQ ID NO: 401356 - DNA, 25 bp, Mus musculus
gcgggccaaacacgaagcctgctaa

SEQ ID NO: 401357 - DNA, 25 bp, Mus musculus
gatctcggcgccgacacgaaaccaa

SEQ ID NO: 401358 - DNA, 25 bp, Mus musculus
gcgtccggacagacccagatctcgg

SEQ ID NO: 401359 - DNA, 25 bp, Mus musculus
tgtcgcccgcctctcatttttacag

SEQ ID NO: 401360 - DNA, 25 bp, Mus musculus
ttacagcatccgctgcacacagtta

SEQ ID NO: 401361 - DNA, 25 bp, Mus musculus
aaaactaattcatcccagcgggcca

SEQ ID NO: 401362 - DNA, 25 bp, Mus musculus
tggcatcgcgcttcatcacgtgacg

SEQ ID NO: 401363 - DNA, 25 bp, Mus musculus
ccaggctttgtagtcgtggtacaga

SEQ ID NO: 401364 - DNA, 25 bp, Mus musculus
ctgggttttagggaagacgcactca

SEQ ID NO: 401365 - DNA, 25 bp, Mus musculus
acagcgcctggatgttttatttcca

SEQ ID NO: 401366 - DNA, 25 bp, Mus musculus
ccttccacacaatttgcggctgaga

SEQ ID NO: 401367 - DNA, 25 bp, Mus musculus
agggccgacgctccaagaaggaaga

SEQ ID NO: 401368 - DNA, 25 bp, Mus musculus
tgaagtcattaaagtcacgcgctgg

SEQ ID NO: 401369 - DNA, 25 bp, Mus musculus
cacgcgctggtgtttgtttatccgc

SEQ ID NO: 401370 - DNA, 25 bp, Mus musculus
ccttcccgatcccaagcagattgta

SEQ ID NO: 401371 - DNA, 25 bp, Mus musculus
gtgcctcacgcgacaaagaggtctc

SEQ ID NO: 401372 - DNA, 25 bp, Mus musculus
aagaggtctccagccgccctgtaaa

SEQ ID NO: 401373 - DNA, 25 bp, Mus musculus
gcacaccttcgtgggtgcaggatca

SEQ ID NO: 401374 - DNA, 25 bp, Mus musculus
cgtgacgcttgaccgcaggtttttt

SEQ ID NO: 401375 - DNA, 25 bp, Mus musculus
acaccaagggtgaacgcgctgacca

SEQ ID NO: 401376 - DNA, 25 bp, Mus musculus
cgtggctcaactcttctgggactct

SEQ ID NO: 401377 - DNA, 25 bp, Mus musculus
ttccgagccgagctgtcagcgcttg

SEQ ID NO: 401378 - DNA, 25 bp, Mus musculus
gggactctccgcctgcaatctactg

SEQ ID NO: 401379 - DNA, 25 bp, Mus musculus
tgttgcccgggatggacccgcccaa

SEQ ID NO: 401380 - DNA, 25 bp, Mus musculus
tggacccgcccaacgtgatgacgtc

SEQ ID NO: 401381 - DNA, 25 bp, Mus musculus
cggacgctcaggcttcggtaacctg

SEQ ID NO: 401382 - DNA, 25 bp, Mus musculus
caggcttcggtaacctgtgctgggc

SEQ ID NO: 401383 - DNA, 25 bp, Mus musculus
agcgggagtccttggcacgctcagc

SEQ ID NO: 401384 - DNA, 25 bp, Mus musculus
tggcacgctcagctctcgtttcttc

SEQ ID NO: 401385 - DNA, 25 bp, Mus musculus
cccgcacggccaggcgatggagttt

SEQ ID NO: 401386 - DNA, 25 bp, Mus musculus
ccaggcgatggagtttccggacctc

SEQ ID NO: 401387 - DNA, 25 bp, Mus musculus
cggacctcggggctcactgttccga

SEQ ID NO: 401388 - DNA, 25 bp, Mus musculus
caatctactgttgcccgggatggac

SEQ ID NO: 401389 - DNA, 25 bp, Mus musculus
ctcactgttccgagccgagctgtca

SEQ ID NO: 401390 - DNA, 25 bp, Mus musculus
cgctttgcataaacagatggcgcgg

SEQ ID NO: 401391 - DNA, 25 bp, Mus musculus
tccgcatcatctccatccattattg

SEQ ID NO: 401392 - DNA, 25 bp, Mus musculus
agctgcgcggcagcaagtacccgaa

SEQ ID NO: 401393 - DNA, 25 bp, Mus musculus
cgcggcagcaagtacccgaatgaca

SEQ ID NO: 401394 - DNA, 25 bp, Mus musculus
tacccgaatgacagtgacgcccgcg

SEQ ID NO: 401395 - DNA, 25 bp, Mus musculus
gttcccgtgcgcgagagcctctgat

SEQ ID NO: 401396 - DNA, 25 bp, Mus musculus
cctctctcctttcccggccggctcg

SEQ ID NO: 401397 - DNA, 25 bp, Mus musculus
ccattattgaagaaacagccgcgtc

SEQ ID NO: 401398 - DNA, 25 bp, Mus musculus
attgaagaaacagccgcgtcctctc

SEQ ID NO: 401399 - DNA, 25 bp, Mus musculus
gccgcgtcctctccaatcacatcaa

SEQ ID NO: 401400 - DNA, 25 bp, Mus musculus
ccctgggcagaagtgggttcatgac

SEQ ID NO: 401401 - DNA, 25 bp, Mus musculus
agaagtgggttcatgaccctgtgcc

SEQ ID NO: 401402 - DNA, 25 bp, Mus musculus
gcataaacagatggcgcggcgtctt

SEQ ID NO: 401403 - DNA, 25 bp, Mus musculus
agagcctctgattgagtctcccgcc

SEQ ID NO: 401404 - DNA, 25 bp, Mus musculus
cccatgcctgacgggtgcgagagct

SEQ ID NO: 401405 - DNA, 25 bp, Mus musculus
gcgagagctggacctggccgaaggt

SEQ ID NO: 401406 - DNA, 25 bp, Mus musculus
actcggccagaggtgggctcgagcc

SEQ ID NO: 401407 - DNA, 25 bp, Mus musculus
cctgtgctcgttcccgagcgacgga

SEQ ID NO: 401408 - DNA, 25 bp, Mus musculus
agaccctgtgctcgttcccgagcga

SEQ ID NO: 401409 - DNA, 25 bp, Mus musculus
tagtggcagaccctgtgctcgttcc

SEQ ID NO: 401410 - DNA, 25 bp, Mus musculus
gtttgtagtggcagaccctgtgctc

SEQ ID NO: 401411 - DNA, 25 bp, Mus musculus
tggcccttcgcacaggccggagacc

SEQ ID NO: 401412 - DNA, 25 bp, Mus musculus
tgatgatgtcatccgggcttccggt

SEQ ID NO: 401413 - DNA, 25 bp, Mus musculus
tcgacgcggactgatgatgtcatcc

SEQ ID NO: 401414 - DNA, 25 bp, Mus musculus
tacttcgacgcggactgatgatgtc

SEQ ID NO: 401415 - DNA, 25 bp, Mus musculus
ggccgttacttcgacgcggactgat

SEQ ID NO: 401416 - DNA, 25 bp, Mus musculus
tgtggagtttgtagtggcagaccct

SEQ ID NO: 401417 - DNA, 25 bp, Mus musculus
aagaagcggcctggtaagacgcagc

SEQ ID NO: 401418 - DNA, 25 bp, Mus musculus
gtgccgatccggtagactatccctc

SEQ ID NO: 401419 - DNA, 25 bp, Mus musculus
cgcaccgctcttataggcaggaggc

SEQ ID NO: 401420 - DNA, 25 bp, Mus musculus
caggggagtgaaacctaggcgtatc

SEQ ID NO: 401421 - DNA, 25 bp, Mus musculus
ctcacctgtcgggtttggcttagaa

SEQ ID NO: 401422 - DNA, 25 bp, Mus musculus
aagcagcggcccatattcgttccta

SEQ ID NO: 401423 - DNA, 25 bp, Mus musculus
ttcctagttttgagccgatgtcccg

SEQ ID NO: 401424 - DNA, 25 bp, Mus musculus
tccgaaggtccgaagcagagacgca

SEQ ID NO: 401425 - DNA, 25 bp, Mus musculus
gtgtctcgaatgcacccgcgtcatg

SEQ ID NO: 401426 - DNA, 25 bp, Mus musculus
tagacgctcatggtgcaggtattcc

SEQ ID NO: 401427 - DNA, 25 bp, Mus musculus
tagggcggatgaagctcaagcaatc

SEQ ID NO: 401428 - DNA, 25 bp, Mus musculus
acacctgtaggaggccgaggaccta

SEQ ID NO: 401429 - DNA, 25 bp, Mus musculus
gccgacgcgagaatctgccaccttt

SEQ ID NO: 401430 - DNA, 25 bp, Mus musculus
ggctccgtcattagcgccgtcacta

SEQ ID NO: 401431 - DNA, 25 bp, Mus musculus
ttggtaggctttcgcccacacctgt

SEQ ID NO: 401432 - DNA, 25 bp, Mus musculus
ctagtagtttccagggcgctgacgc

SEQ ID NO: 401433 - DNA, 25 bp, Mus musculus
gccctctgagtctctagtagtttcc

SEQ ID NO: 401434 - DNA, 25 bp, Mus musculus
cgctgacgcatgcttgcgcacacaa

SEQ ID NO: 401435 - DNA, 25 bp, Mus musculus
ctgacgctgagttgccatggcatcc

SEQ ID NO: 401436 - DNA, 25 bp, Mus musculus
ctgcgaaggagcctagtcactggcc

SEQ ID NO: 401437 - DNA, 25 bp, Mus musculus
acccagcctggcgtgtcgtacgcag

SEQ ID NO: 401438 - DNA, 25 bp, Mus musculus
catggcatcctactacgagattcta

SEQ ID NO: 401439 - DNA, 25 bp, Mus musculus
ccgcacggagctgcggtgcctctgt

SEQ ID NO: 401440 - DNA, 25 bp, Mus musculus
atgacatcaagaaggcgtaagtgcc

SEQ ID NO: 401441 - DNA, 25 bp, Mus musculus
ggcccgattccacctcgaagtgtcg

SEQ ID NO: 401442 - DNA, 25 bp, Mus musculus
ggttcagatcgggttactagactta

SEQ ID NO: 401443 - DNA, 25 bp, Mus musculus
cactcctgccgtgagatagccctgg

SEQ ID NO: 401444 - DNA, 25 bp, Mus musculus
cctgcgggaccagataaaggctgcg

SEQ ID NO: 401445 - DNA, 25 bp, Mus musculus
cgagattctagacgtaccgcggagt

SEQ ID NO: 401446 - DNA, 25 bp, Mus musculus
cgacaccaggttcacctgtcagata

SEQ ID NO: 401447 - DNA, 25 bp, Mus musculus
gaagctccgcaccaggaagtcctcg

SEQ ID NO: 401448 - DNA, 25 bp, Mus musculus
cctgtcagatatcgggcacggtctg

SEQ ID NO: 401449 - DNA, 25 bp, Mus musculus
tgcaggttcttaaggtagaagctcc

SEQ ID NO: 401450 - DNA, 25 bp, Mus musculus
tctgagcacaggtgcgcacgcgctc

SEQ ID NO: 401451 - DNA, 25 bp, Mus musculus
gtagaagctccgcaccaggaagtcc

SEQ ID NO: 401452 - DNA, 25 bp, Mus musculus
ccctctgccggccagctgaggaagt

SEQ ID NO: 401453 - DNA, 25 bp, Mus musculus
ggaagtcctcgcaccagatgtgctc

SEQ ID NO: 401454 - DNA, 25 bp, Mus musculus
cagatgtgctccgacaccaggttca

SEQ ID NO: 401455 - DNA, 25 bp, Mus musculus
tgtgctccgacaccaggttcacctg

SEQ ID NO: 401456 - DNA, 25 bp, Mus musculus
ttcacctgtcagatatcgggcacgg

SEQ ID NO: 401457 - DNA, 25 bp, Mus musculus
agatatcgggcacggtctgagcaca

SEQ ID NO: 401458 - DNA, 25 bp, Mus musculus
cacggtctgagcacaggtgcgcacg

SEQ ID NO: 401459 - DNA, 25 bp, Mus musculus
cctgggtctgcaggttcttaaggta

SEQ ID NO: 401460 - DNA, 25 bp, Mus musculus
gcgcgccaccgtgtccggaatcaaa

SEQ ID NO: 401461 - DNA, 25 bp, Mus musculus
cgtggactagtcagctccagtcaca

SEQ ID NO: 401462 - DNA, 25 bp, Mus musculus
cccgttaggagccacgtctcatgac

SEQ ID NO: 401463 - DNA, 25 bp, Mus musculus
cttcctccaatcaggctgcgttcta

SEQ ID NO: 401464 - DNA, 25 bp, Mus musculus
ggaatcaaagcaccactacacctgt

SEQ ID NO: 401465 - DNA, 25 bp, Mus musculus
atcaagtcgagtcctccaggcgttg

SEQ ID NO: 401466 - DNA, 25 bp, Mus musculus
ggctgcgttctaaccacgtggacta

SEQ ID NO: 401467 - DNA, 25 bp, Mus musculus
ctggttccaaacacgctgactgctc

SEQ ID NO: 401468 - DNA, 25 bp, Mus musculus
gggaccggcaacagcaacacacctg

SEQ ID NO: 401469 - DNA, 25 bp, Mus musculus
agcgccgccttaagcttagctccga

SEQ ID NO: 401470 - DNA, 25 bp, Mus musculus
ttgaaaccggagtacgcccgtgtca

SEQ ID NO: 401471 - DNA, 25 bp, Mus musculus
caggccacctcggagggtttcagtt

SEQ ID NO: 401472 - DNA, 25 bp, Mus musculus
gtcagtcactagacagcccttccgg

SEQ ID NO: 401473 - DNA, 25 bp, Mus musculus
tttcctttgtcagcggcctcgaagc

SEQ ID NO: 401474 - DNA, 25 bp, Mus musculus
gccagcacccggcatccgtaaaggt

SEQ ID NO: 401475 - DNA, 25 bp, Mus musculus
cgccagggaagtagacaagcagctt

SEQ ID NO: 401476 - DNA, 25 bp, Mus musculus
actgtcccgttctgagtccagcgcg

SEQ ID NO: 401477 - DNA, 25 bp, Mus musculus
gcctccggccagcatgtgaagctac

SEQ ID NO: 401478 - DNA, 25 bp, Mus musculus
ccagcatgtgaagctacgcgttccg

SEQ ID NO: 401479 - DNA, 25 bp, Mus musculus
aagctacgcgttccggctgggactc

SEQ ID NO: 401480 - DNA, 25 bp, Mus musculus
caccatgagcgacgaaagcgccagg

SEQ ID NO: 401481 - DNA, 25 bp, Mus musculus
agacaagcagcttcgcctgcgcgtg

SEQ ID NO: 401482 - DNA, 25 bp, Mus musculus
tgtgcgtgctcagcgagctgcagaa

SEQ ID NO: 401483 - DNA, 25 bp, Mus musculus
agctgcagaagaccgagcgcgacta

SEQ ID NO: 401484 - DNA, 25 bp, Mus musculus
actacgtgggcacgctggagttcct

SEQ ID NO: 401485 - DNA, 25 bp, Mus musculus
tctggagcattgtctgcgccagcac

SEQ ID NO: 401486 - DNA, 25 bp, Mus musculus
acccggcatccgtaaaggtgacgcg

SEQ ID NO: 401487 - DNA, 25 bp, Mus musculus
cgcacggcaccaagtctggagcatt

SEQ ID NO: 401488 - DNA, 25 bp, Mus musculus
gccgccgaggtcaaccggctcaagg

SEQ ID NO: 401489 - DNA, 25 bp, Mus musculus
ccctcgagcaggcttcggtaccaag

SEQ ID NO: 401490 - DNA, 25 bp, Mus musculus
cgacgtggagcgtgacaacctgata

SEQ ID NO: 401491 - DNA, 25 bp, Mus musculus
tggaggtgctcaccaaccagcgcgc

SEQ ID NO: 401492 - DNA, 25 bp, Mus musculus
ctcaagggccgcgaaccgactcggg

SEQ ID NO: 401493 - DNA, 25 bp, Mus musculus
gctgcaagagctcaatgaccgcttc

SEQ ID NO: 401494 - DNA, 25 bp, Mus musculus
ccaacgagaaggtggagctgcaaga

SEQ ID NO: 401495 - DNA, 25 bp, Mus musculus
tgaaccaggagttcctggccacgcg

SEQ ID NO: 401496 - DNA, 25 bp, Mus musculus
gccgacgctgtgaaccaggagttcc

SEQ ID NO: 401497 - DNA, 25 bp, Mus musculus
agctgctggacttctccctggccga

SEQ ID NO: 401498 - DNA, 25 bp, Mus musculus
atcccgcgtgtaccaggtgtcgcgc

SEQ ID NO: 401499 - DNA, 25 bp, Mus musculus
cgagttcaatgacatcccgcgtgta

SEQ ID NO: 401500 - DNA, 25 bp, Mus musculus
cggtaccaagggctcctcgagttca

SEQ ID NO: 401501 - DNA, 25 bp, Mus musculus
cgccaggtggaggtgctcaccaacc

SEQ ID NO: 401502 - DNA, 25 bp, Mus musculus
tcccacacgctctaagagtcagcat

SEQ ID NO: 401503 - DNA, 25 bp, Mus musculus
tgcctttacacggtcagtgccttta

SEQ ID NO: 401504 - DNA, 25 bp, Mus musculus
acgaactctcgcagaacgcgaatta

SEQ ID NO: 401505 - DNA, 25 bp, Mus musculus
agtcagcattatagacgaactctcg

SEQ ID NO: 401506 - DNA, 25 bp, Mus musculus
gccggccagtgcctttacacggtca

SEQ ID NO: 401507 - DNA, 25 bp, Mus musculus
cggtcagtgcctttacacgggacta

SEQ ID NO: 401508 - DNA, 25 bp, Mus musculus
ttacacgggactagaacaggcagta

SEQ ID NO: 401509 - DNA, 25 bp, Mus musculus
ctagaacaggcagtacgagcgagca

SEQ ID NO: 401510 - DNA, 25 bp, Mus musculus
gtacgagcgagcaaggtgctaccta

SEQ ID NO: 401511 - DNA, 25 bp, Mus musculus
aggtgctacctacctttgaaactgc

SEQ ID NO: 401512 - DNA, 25 bp, Mus musculus
ctacctttgaaactgcctacctttg

SEQ ID NO: 401513 - DNA, 25 bp, Mus musculus
gcctacctttgaactcgtgcgctga

SEQ ID NO: 401514 - DNA, 25 bp, Mus musculus
tgaactcgtgcgctgactgctccga

SEQ ID NO: 401515 - DNA, 25 bp, Mus musculus
cgcgaattagaatgccggccagtgc

SEQ ID NO: 401516 - DNA, 25 bp, Mus musculus
ccagctcgcagaggccatgcagaaa

SEQ ID NO: 401517 - DNA, 25 bp, Mus musculus
caggacgccggcgtgtacagctgca

SEQ ID NO: 401518 - DNA, 25 bp, Mus musculus
gccatgcagaaagcccggggcacgc

SEQ ID NO: 401519 - DNA, 25 bp, Mus musculus
acgccggcacgagggcacctcctag

SEQ ID NO: 401520 - DNA, 25 bp, Mus musculus
gcctagcctcagctggttccgggat

SEQ ID NO: 401521 - DNA, 25 bp, Mus musculus
cagagcccagctgcctgtggctgcg

SEQ ID NO: 401522 - DNA, 25 bp, Mus musculus
cccagctgcctgtggctgcggagct

SEQ ID NO: 401523 - DNA, 25 bp, Mus musculus
tctagtccagctcgcagaggccatg

SEQ ID NO: 401524 - DNA, 25 bp, Mus musculus
ggactcatctcttaaggcaccatac

SEQ ID NO: 401525 - DNA, 25 bp, Mus musculus
cccataggactcatctcttaaggca

SEQ ID NO: 401526 - DNA, 25 bp, Mus musculus
accttctgcacaggccgaaagcggg

SEQ ID NO: 401527 - DNA, 25 bp, Mus musculus
ctggtgaccttctgcacaggccgaa

SEQ ID NO: 401528 - DNA, 25 bp, Mus musculus
ccctaaaaatagtccctgaggcgca

SEQ ID NO: 401529 - DNA, 25 bp, Mus musculus
aatagtccctgaggcgcaatcgccg

SEQ ID NO: 401530 - DNA, 25 bp, Mus musculus
gggtgaagaagcgtttccaggtgag

SEQ ID NO: 401531 - DNA, 25 bp, Mus musculus
cccacctcggctcctgaggcccggc

SEQ ID NO: 401532 - DNA, 25 bp, Mus musculus
cggcggctccttccgccacccgcgc

SEQ ID NO: 401533 - DNA, 25 bp, Mus musculus
cccgccatgaagaagctgtgggtga

SEQ ID NO: 401534 - DNA, 25 bp, Mus musculus
ccgccatgaagaagctgtgggtgaa

SEQ ID NO: 401535 - DNA, 25 bp, Mus musculus
ccatgaagaagctgtgggtgaagaa

SEQ ID NO: 401536 - DNA, 25 bp, Mus musculus
gccgccgccttcatcttacccccac

SEQ ID NO: 401537 - DNA, 25 bp, Mus musculus
cccagccctgcttagtgggggcgac

SEQ ID NO: 401538 - DNA, 25 bp, Mus musculus
acgggcccagcacgttcctggggag

SEQ ID NO: 401539 - DNA, 25 bp, Mus musculus
ccctggccggcaactggaaagcgca

SEQ ID NO: 401540 - DNA, 25 bp, Mus musculus
ccggcaactggaaagcgcaggcgcc

SEQ ID NO: 401541 - DNA, 25 bp, Mus musculus
actggaaagcgcaggcgcctcccgg

SEQ ID NO: 401542 - DNA, 25 bp, Mus musculus
gcgatggagtaacgctggccccacc

SEQ ID NO: 401543 - DNA, 25 bp, Mus musculus
ggcaactggaaagcgcaggcgcctc

SEQ ID NO: 401544 - DNA, 25 bp, Mus musculus
ccttgggaccatgggtcgctcctaa

SEQ ID NO: 401545 - DNA, 25 bp, Mus musculus
cgcctggcgagatagagtcttcctc

SEQ ID NO: 401546 - DNA, 25 bp, Mus musculus
tcctggagcggtttagagttgaaga

SEQ ID NO: 401547 - DNA, 25 bp, Mus musculus
gccagccacgcggattagtatcctg

SEQ ID NO: 401548 - DNA, 25 bp, Mus musculus
agctgcatttgacttgctgcgccgc

SEQ ID NO: 401549 - DNA, 25 bp, Mus musculus
caccgtaatcagctcgctccggaga

SEQ ID NO: 401550 - DNA, 25 bp, Mus musculus
acactggaaatgcagagcaggcgct

SEQ ID NO: 401551 - DNA, 25 bp, Mus musculus
gacctgtatgtacactccagacttg

SEQ ID NO: 401552 - DNA, 25 bp, Mus musculus
cgagtaagctaccaggcacagacct

SEQ ID NO: 401553 - DNA, 25 bp, Mus musculus
ctcgatggcacgagcgagtaagcta

SEQ ID NO: 401554 - DNA, 25 bp, Mus musculus
tgagagtctccaatacctcgatggc

SEQ ID NO: 401555 - DNA, 25 bp, Mus musculus
tggccacgccagaagagaggtattg

SEQ ID NO: 401556 - DNA, 25 bp, Mus musculus
gtcccatctatgtcgtctggccacg

SEQ ID NO: 401557 - DNA, 25 bp, Mus musculus
ggtcgctcctaatcctcggctaacg

SEQ ID NO: 401558 - DNA, 25 bp, Mus musculus
ctgtacagaggacgggcgctctcga

SEQ ID NO: 401559 - DNA, 25 bp, Mus musculus
cgagctaatctggtgggcgcaagct

SEQ ID NO: 401560 - DNA, 25 bp, Mus musculus
atcgcgagctaatctggtgggcgca

SEQ ID NO: 401561 - DNA, 25 bp, Mus musculus
tggtgcgggcatcgcgagctaatct

SEQ ID NO: 401562 - DNA, 25 bp, Mus musculus
caaggcaagcacagacaaccggggc

SEQ ID NO: 401563 - DNA, 25 bp, Mus musculus
caggcagcccaaggcaagcacagac

SEQ ID NO: 401564 - DNA, 25 bp, Mus musculus
cctttcggtggccagtgacctctat

SEQ ID NO: 401565 - DNA, 25 bp, Mus musculus
agtgacctctatggcagcgcgttca

SEQ ID NO: 401566 - DNA, 25 bp, Mus musculus
ttcagtctgtacagaggacgggcgc

SEQ ID NO: 401567 - DNA, 25 bp, Mus musculus
ggcgctctcgatccacgtgtaagta

SEQ ID NO: 401568 - DNA, 25 bp, Mus musculus
ctcgatccacgtgtaagtagttacc

SEQ ID NO: 401569 - DNA, 25 bp, Mus musculus
gatccacgtgtaagtagttacctcg

SEQ ID NO: 401570 - DNA, 25 bp, Mus musculus
tcagaggatagcctttcggtggcca

SEQ ID NO: 401571 - DNA, 25 bp, Mus musculus
tggcagcgcgttcagtctgtacaga

SEQ ID NO: 401572 - DNA, 25 bp, Mus musculus
ggggtcccgcatcctggacaagcta

SEQ ID NO: 401573 - DNA, 25 bp, Mus musculus
ccttggagaagaatagagcgggacc

SEQ ID NO: 401574 - DNA, 25 bp, Mus musculus
cactccgggagtggaggactctgtt

SEQ ID NO: 401575 - DNA, 25 bp, Mus musculus
cctgctcaagcggtgcgctttctgc

SEQ ID NO: 401576 - DNA, 25 bp, Mus musculus
cgctaaccaggagcagagccatcca

SEQ ID NO: 401577 - DNA, 25 bp, Mus musculus
ggagatcaagcgtcgggaccaattc

SEQ ID NO: 401578 - DNA, 25 bp, Mus musculus
gcctcctagtggtgcgggcaaatct

SEQ ID NO: 401579 - DNA, 25 bp, Mus musculus
acacccaagacctcacgggctgtga

SEQ ID NO: 401580 - DNA, 25 bp, Mus musculus
tccgccgatctacgtcgcgggagga

SEQ ID NO: 401581 - DNA, 25 bp, Mus musculus
cttcgcccaggagctgggtcgcatc

SEQ ID NO: 401582 - DNA, 25 bp, Mus musculus
acgcagtgcaacctcggacctcgaa

SEQ ID NO: 401583 - DNA, 25 bp, Mus musculus
cctcgttggatgaacgcacgcgaca

SEQ ID NO: 401584 - DNA, 25 bp, Mus musculus
ggcgtcgcctgttccagcaaaaggc

SEQ ID NO: 401585 - DNA, 25 bp, Mus musculus
cagttcttcgaagagcggcgacgca

SEQ ID NO: 401586 - DNA, 25 bp, Mus musculus
agtctctgagaagcgcgtgccttcg

SEQ ID NO: 401587 - DNA, 25 bp, Mus musculus
tgctagccgagaaagcccgagtccc

SEQ ID NO: 401588 - DNA, 25 bp, Mus musculus
tgagcccaaaccagaaccagtccga

SEQ ID NO: 401589 - DNA, 25 bp, Mus musculus
agcctgtcccagaaaaggtccctga

SEQ ID NO: 401590 - DNA, 25 bp, Mus musculus
ggaaccttccgctgtcacatccaga

SEQ ID NO: 401591 - DNA, 25 bp, Mus musculus
ttatctgcccttagcgagacccagc

SEQ ID NO: 401592 - DNA, 25 bp, Mus musculus
tcccggggtctgcaaaagagcagca

SEQ ID NO: 401593 - DNA, 25 bp, Mus musculus
atcatgcagtcgctccagctgtcca

SEQ ID NO: 401594 - DNA, 25 bp, Mus musculus
atcccaggatggcaagggctgcctc

SEQ ID NO: 401595 - DNA, 25 bp, Mus musculus
ggctgtgttcgaggctaagttcaaa

SEQ ID NO: 401596 - DNA, 25 bp, Mus musculus
agagcagcagcttctctcagggcga

SEQ ID NO: 401597 - DNA, 25 bp, Mus musculus
gcggcagcatcgaaaaccttgaatc

SEQ ID NO: 401598 - DNA, 25 bp, Mus musculus
gacgacggcatataccggcccagtc

SEQ ID NO: 401599 - DNA, 25 bp, Mus musculus
gcctttcgctgtccctgtcgcagaa

SEQ ID NO: 401600 - DNA, 25 bp, Mus musculus
tccagagcacatgctgagcggagcg

SEQ ID NO: 401601 - DNA, 25 bp, Mus musculus
ctgacagctgtgcgggtgctgataa

SEQ ID NO: 401602 - DNA, 25 bp, Mus musculus
gaattattaagcacggggtgggctc

SEQ ID NO: 401603 - DNA, 25 bp, Mus musculus
tgccagtgcccgacggtgaaacgct

SEQ ID NO: 401604 - DNA, 25 bp, Mus musculus
tcgaggagagagacaagcggcagca

SEQ ID NO: 401605 - DNA, 25 bp, Mus musculus
gaagccacaaggagacgatcgagga

SEQ ID NO: 401606 - DNA, 25 bp, Mus musculus
cacacgcaggggctgacagctgtgc

SEQ ID NO: 401607 - DNA, 25 bp, Mus musculus
cgtggcggagcagcgcttgctccct

SEQ ID NO: 401608 - DNA, 25 bp, Mus musculus
gtgggctccagagcacatgctgagc

SEQ ID NO: 401609 - DNA, 25 bp, Mus musculus
gtcctgaattattaagcacggggtg

SEQ ID NO: 401610 - DNA, 25 bp, Mus musculus
cgctgttgacatgtcctgaattatt

SEQ ID NO: 401611 - DNA, 25 bp, Mus musculus
gtgaaacgctgttgacatgtcctga

SEQ ID NO: 401612 - DNA, 25 bp, Mus musculus
gcccgacggtgaaacgctgttgaca

SEQ ID NO: 401613 - DNA, 25 bp, Mus musculus
ccacaaggagacgatcgaggagaga

SEQ ID NO: 401614 - DNA, 25 bp, Mus musculus
aggcgaggcagccagcgggaagcgt

SEQ ID NO: 401615 - DNA, 25 bp, Mus musculus
gtggaagcctctggcgctgctgtgt

SEQ ID NO: 401616 - DNA, 25 bp, Mus musculus
agggaatgcaaatgaggcgaaccca

SEQ ID NO: 401617 - DNA, 25 bp, Mus musculus
tgatggatgcctgccccgcaggcga

SEQ ID NO: 401618 - DNA, 25 bp, Mus musculus
cgctgctcggtgatggatgcctgcc

SEQ ID NO: 401619 - DNA, 25 bp, Mus musculus
cgaacccagggaggagagccgagga

SEQ ID NO: 401620 - DNA, 25 bp, Mus musculus
gaatgcaaatgaggcgaacccaggg

SEQ ID NO: 401621 - DNA, 25 bp, Mus musculus
ccgagggaatgcaaatgaggcgaac

SEQ ID NO: 401622 - DNA, 25 bp, Mus musculus
acggaggtcactttgccgaggagcc

SEQ ID NO: 401623 - DNA, 25 bp, Mus musculus
tgcacggaggtcactttgccgagga

SEQ ID NO: 401624 - DNA, 25 bp, Mus musculus
gtgtgcacggaggtcactttgccga

SEQ ID NO: 401625 - DNA, 25 bp, Mus musculus
ctgctgtgtgcacggaggtcacttt

SEQ ID NO: 401626 - DNA, 25 bp, Mus musculus
aagcgttgcccgtgggtgcggcctt

SEQ ID NO: 401627 - DNA, 25 bp, Mus musculus
ctgtgtgcacggaggtcactttgcc

SEQ ID NO: 401628 - DNA, 25 bp, Mus musculus
tagcgctgcagcaaggctggctcta

SEQ ID NO: 401629 - DNA, 25 bp, Mus musculus
gcaaggctggctctactgctctcag

SEQ ID NO: 401630 - DNA, 25 bp, Mus musculus
ctgcagcaaggctggctctactgct

SEQ ID NO: 401631 - DNA, 25 bp, Mus musculus
ttcactgagccgtgcactgcacggc

SEQ ID NO: 401632 - DNA, 25 bp, Mus musculus
tggtaaaggtcttcactgagccgtg

SEQ ID NO: 401633 - DNA, 25 bp, Mus musculus
gcgacagcggtggtaaaggtcttca

SEQ ID NO: 401634 - DNA, 25 bp, Mus musculus
gaaacaactcgtacacatccaggct

SEQ ID NO: 401635 - DNA, 25 bp, Mus musculus
agcgcagaaacaactcgtacacatc

SEQ ID NO: 401636 - DNA, 25 bp, Mus musculus
tggagaagcgcagaaacaactcgta

SEQ ID NO: 401637 - DNA, 25 bp, Mus musculus
tgcaagttggagaagcgcagaaaca

SEQ ID NO: 401638 - DNA, 25 bp, Mus musculus
cacgtgcaagttggagaagcgcaga

SEQ ID NO: 401639 - DNA, 25 bp, Mus musculus
ctcagcacgtgcaagttggagaagc

SEQ ID NO: 401640 - DNA, 25 bp, Mus musculus
ctgctctcagcacgtgcaagttgga

SEQ ID NO: 401641 - DNA, 25 bp, Mus musculus
ggtcttcactgagccgtgcactgca

SEQ ID NO: 401642 - DNA, 25 bp, Mus musculus
ctgctaacggagttgctagccatcg

SEQ ID NO: 401643 - DNA, 25 bp, Mus musculus
ggctcgctgctaacggagttgctag

SEQ ID NO: 401644 - DNA, 25 bp, Mus musculus
gttccctgagccctgctcccttcgg

SEQ ID NO: 401645 - DNA, 25 bp, Mus musculus
ttgtctgagttggtagagcctcgcc

SEQ ID NO: 401646 - DNA, 25 bp, Mus musculus
cctcggagttgtctgagttggtaga

SEQ ID NO: 401647 - DNA, 25 bp, Mus musculus
gatgtagttctctccttgcctcgga

SEQ ID NO: 401648 - DNA, 25 bp, Mus musculus
gctctgtcgctagggagcgagcacc

SEQ ID NO: 401649 - DNA, 25 bp, Mus musculus
tcggctcgcgaaggcactgcacaga

SEQ ID NO: 401650 - DNA, 25 bp, Mus musculus
actgcacagacactcgccttcggcc

SEQ ID NO: 401651 - DNA, 25 bp, Mus musculus
tgctgccgcccagaggacagaccag

SEQ ID NO: 401652 - DNA, 25 bp, Mus musculus
acagaccagcctctgcccgcgattt

SEQ ID NO: 401653 - DNA, 25 bp, Mus musculus
cgagctgcaggatgcgatgtagttc

SEQ ID NO: 401654 - DNA, 25 bp, Mus musculus
ctgcaggatgcgatgtagttctctc

SEQ ID NO: 401655 - DNA, 25 bp, Mus musculus
ctctccttgcctcggagttgtctga

SEQ ID NO: 401656 - DNA, 25 bp, Mus musculus
acgtcagccacatcagcctggtcgg

SEQ ID NO: 401657 - DNA, 25 bp, Mus musculus
cgggctggatcaaaacgccggtagc

SEQ ID NO: 401658 - DNA, 25 bp, Mus musculus
gctggatcaaaacgccggtagccgt

SEQ ID NO: 401659 - DNA, 25 bp, Mus musculus
cggtagccgttcaccagctgttgct

SEQ ID NO: 401660 - DNA, 25 bp, Mus musculus
tcaccagctgttgcttctggagctg

SEQ ID NO: 401661 - DNA, 25 bp, Mus musculus
taacggcggttgagctcctctaagg

SEQ ID NO: 401662 - DNA, 25 bp, Mus musculus
aggacgtcagccacatcagcctggt

SEQ ID NO: 401663 - DNA, 25 bp, Mus musculus
ccatcggcgcaggagaacgcgtatt

SEQ ID NO: 401664 - DNA, 25 bp, Mus musculus
cggcgcaggagaacgcgtattgttc

SEQ ID NO: 401665 - DNA, 25 bp, Mus musculus
cgtattgttctgtgaagtagtccca

SEQ ID NO: 401666 - DNA, 25 bp, Mus musculus
tgaagtagtcccagcgcagaacctc

SEQ ID NO: 401667 - DNA, 25 bp, Mus musculus
tcccagcgcagaacctcaaagcgtg

SEQ ID NO: 401668 - DNA, 25 bp, Mus musculus
aacctcaaagcgtgaggcagggcga

SEQ ID NO: 401669 - DNA, 25 bp, Mus musculus
ggttgagctcctctaaggctgtccc

SEQ ID NO: 401670 - DNA, 25 bp, Mus musculus
gtcggccgcccttagagcagcactg

SEQ ID NO: 401671 - DNA, 25 bp, Mus musculus
atcagcaccaaaggccgccagcggg

SEQ ID NO: 401672 - DNA, 25 bp, Mus musculus
ggcaagacacgaggctcccagctct

SEQ ID NO: 401673 - DNA, 25 bp, Mus musculus
ctcggatccgggctgcaccgagttg

SEQ ID NO: 401674 - DNA, 25 bp, Mus musculus
tgaagcccagagagatgcccacggc

SEQ ID NO: 401675 - DNA, 25 bp, Mus musculus
ggtaggagctcaagcccggaatccc

SEQ ID NO: 401676 - DNA, 25 bp, Mus musculus
ccgccgagcagaggtaggagctcaa

SEQ ID NO: 401677 - DNA, 25 bp, Mus musculus
tcccggatgacgtcagaagcagccc

SEQ ID NO: 401678 - DNA, 25 bp, Mus musculus
gatcagtacctgacggccttcttgg

SEQ ID NO: 401679 - DNA, 25 bp, Mus musculus
ccctgccaggatggtgcaccctgag

SEQ ID NO: 401680 - DNA, 25 bp, Mus musculus
tcctcagcgccggagaggcagacgc

SEQ ID NO: 401681 - DNA, 25 bp, Mus musculus
agaggccggagctgtccatcagcac

SEQ ID NO: 401682 - DNA, 25 bp, Mus musculus
tgcaccctgagtgacgtcaggagca

SEQ ID NO: 401683 - DNA, 25 bp, Mus musculus
tgtccgacgtgtcaccgacagggcc

SEQ ID NO: 401684 - DNA, 25 bp, Mus musculus
tggtacgcagtgtgggcctcttcct

SEQ ID NO: 401685 - DNA, 25 bp, Mus musculus
gactattttgctgaactgctactgc

SEQ ID NO: 401686 - DNA, 25 bp, Mus musculus
gccactgccgcagactattttgctg

SEQ ID NO: 401687 - DNA, 25 bp, Mus musculus
acgggcgctgccctcatcgccactg

SEQ ID NO: 401688 - DNA, 25 bp, Mus musculus
cctattaccagccgggctccgtgtg

SEQ ID NO: 401689 - DNA, 25 bp, Mus musculus
actaggctctgcaccctattaccag

SEQ ID NO: 401690 - DNA, 25 bp, Mus musculus
gctgctcggtctgctgctcgctgct

SEQ ID NO: 401691 - DNA, 25 bp, Mus musculus
aactgctactgctggggcgctacgt

SEQ ID NO: 401692 - DNA, 25 bp, Mus musculus
tggtagccatgctggtacgcagtgt

SEQ ID NO: 401693 - DNA, 25 bp, Mus musculus
ctgctctgcgggctggtagccatgc

SEQ ID NO: 401694 - DNA, 25 bp, Mus musculus
atcgcactaggcatcgggctgctct

SEQ ID NO: 401695 - DNA, 25 bp, Mus musculus
caagcgcgggcatcgcactaggcat

SEQ ID NO: 401696 - DNA, 25 bp, Mus musculus
ttctggagacgcagctgagtgctgg

SEQ ID NO: 401697 - DNA, 25 bp, Mus musculus
tgctgctgccctactaggctctgca

SEQ ID NO: 401698 - DNA, 25 bp, Mus musculus
cacgcggcagaacacgcagttgctg

SEQ ID NO: 401699 - DNA, 25 bp, Mus musculus
aagcccggcgctccgtgatgacgaa

SEQ ID NO: 401700 - DNA, 25 bp, Mus musculus
tcggcctctaaaagggcgacgatca

SEQ ID NO: 401701 - DNA, 25 bp, Mus musculus
gacacaccagatagctcggcctcta

SEQ ID NO: 401702 - DNA, 25 bp, Mus musculus
ccagactctgggtatgggacacacc

SEQ ID NO: 401703 - DNA, 25 bp, Mus musculus
gcccgcctagtgacacggagtctgc

SEQ ID NO: 401704 - DNA, 25 bp, Mus musculus
gatgcacctggaatcgccgccctag

SEQ ID NO: 401705 - DNA, 25 bp, Mus musculus
atcagctgaggtgcgcaaggcccgc

SEQ ID NO: 401706 - DNA, 25 bp, Mus musculus
ccgaaaggcgacgtcaggatcagct

SEQ ID NO: 401707 - DNA, 25 bp, Mus musculus
aagcccgcttgcttctcagccatgg

SEQ ID NO: 401708 - DNA, 25 bp, Mus musculus
tcatagttccaggactccgaggtcc

SEQ ID NO: 401709 - DNA, 25 bp, Mus musculus
tgatgacgaaagcagcgcagccgca

SEQ ID NO: 401710 - DNA, 25 bp, Mus musculus
cgcagttgctgtcatagttccagga

SEQ ID NO: 401711 - DNA, 25 bp, Mus musculus
cccactgctcaaaggcgttttctga

SEQ ID NO: 401712 - DNA, 25 bp, Mus musculus
cgtgggtgcaccggcaggcttactt

SEQ ID NO: 401713 - DNA, 25 bp, Mus musculus
tgcgcttcagcctgcgcattctctt

SEQ ID NO: 401714 - DNA, 25 bp, Mus musculus
tggcgcaggagtctcaaggaagatg

SEQ ID NO: 401715 - DNA, 25 bp, Mus musculus
tgcaggcgtcgtgggtgcaccggca

SEQ ID NO: 401716 - DNA, 25 bp, Mus musculus
gcaggagtctcaaggaagatggcgc

SEQ ID NO: 401717 - DNA, 25 bp, Mus musculus
cgcaggagtctcaaggaagatggcg

SEQ ID NO: 401718 - DNA, 25 bp, Mus musculus
gcgcaggagtctcaaggaagatggc

SEQ ID NO: 401719 - DNA, 25 bp, Mus musculus
gggtgcaccggcaggcttacttgga

SEQ ID NO: 401720 - DNA, 25 bp, Mus musculus
ggcgcaggagtctcaaggaagatgg

SEQ ID NO: 401721 - DNA, 25 bp, Mus musculus
tgggtgcaccggcaggcttacttgg

SEQ ID NO: 401722 - DNA, 25 bp, Mus musculus
tcttccgccacttcgctctcatggc

SEQ ID NO: 401723 - DNA, 25 bp, Mus musculus
ttcttccgccacttcgctctcatgg

SEQ ID NO: 401724 - DNA, 25 bp, Mus musculus
cttcttccgccacttcgctctcatg

SEQ ID NO: 401725 - DNA, 25 bp, Mus musculus
ttgcgcttcagcctgcgcattctct

SEQ ID NO: 401726 - DNA, 25 bp, Mus musculus
ctcattaccgatggcagcacacagt

SEQ ID NO: 401727 - DNA, 25 bp, Mus musculus
cgaggtgacgttccaggtctactga

SEQ ID NO: 401728 - DNA, 25 bp, Mus musculus
gatagcttgtcccggccctcagcat

SEQ ID NO: 401729 - DNA, 25 bp, Mus musculus
gactcattaccgatggcagcacaca

SEQ ID NO: 401730 - DNA, 25 bp, Mus musculus
tggcagcacacagtccgatagcttg

SEQ ID NO: 401731 - DNA, 25 bp, Mus musculus
gcagcacacagtccgatagcttgtc

SEQ ID NO: 401732 - DNA, 25 bp, Mus musculus
acacagtccgatagcttgtcccggc

SEQ ID NO: 401733 - DNA, 25 bp, Mus musculus
tcacttctgctcctgcaggcgtcgt

SEQ ID NO: 401734 - DNA, 25 bp, Mus musculus
ctactgagactcattaccgatggca

SEQ ID NO: 401735 - DNA, 25 bp, Mus musculus
ggtctactgagactcattaccgatg

SEQ ID NO: 401736 - DNA, 25 bp, Mus musculus
gttccaggtctactgagactcatta

SEQ ID NO: 401737 - DNA, 25 bp, Mus musculus
aggtgacgttccaggtctactgaga

SEQ ID NO: 401738 - DNA, 25 bp, Mus musculus
ctgagactcattaccgatggcagca

SEQ ID NO: 401739 - DNA, 25 bp, Mus musculus
tgacgttccaggtctactgagactc

SEQ ID NO: 401740 - DNA, 25 bp, Mus musculus
tgaagcacacctgcgacgggtcgta

SEQ ID NO: 401741 - DNA, 25 bp, Mus musculus
gcgcggtttgtcttctcatattcca

SEQ ID NO: 401742 - DNA, 25 bp, Mus musculus
cgtggcaattaaaagcgcgcgactc

SEQ ID NO: 401743 - DNA, 25 bp, Mus musculus
ccttcaagtgccagcgtggactgta

SEQ ID NO: 401744 - DNA, 25 bp, Mus musculus
cggcacgatactgacgcttaggtta

SEQ ID NO: 401745 - DNA, 25 bp, Mus musculus
tacccaggctggacgaattgtgacg

SEQ ID NO: 401746 - DNA, 25 bp, Mus musculus
ctgaaggtaccgttcacatggtcca

SEQ ID NO: 401747 - DNA, 25 bp, Mus musculus
acatggtccacgatcttgccggtca

SEQ ID NO: 401748 - DNA, 25 bp, Mus musculus
tgccggtcaccaacagcgagaactt

SEQ ID NO: 401749 - DNA, 25 bp, Mus musculus
cagcgagaacttgagggtatgcaca

SEQ ID NO: 401750 - DNA, 25 bp, Mus musculus
gggtatgcacacgaaagtaaaagtc

SEQ ID NO: 401751 - DNA, 25 bp, Mus musculus
cgaaaatcttcttggctcgggccgc

SEQ ID NO: 401752 - DNA, 25 bp, Mus musculus
gcaagtctaggtactggggcctccc

SEQ ID NO: 401753 - DNA, 25 bp, Mus musculus
ggccgctttaatggatggcttcctc

SEQ ID NO: 401754 - DNA, 25 bp, Mus musculus
gccctgcggttgaccagaaccgtct

SEQ ID NO: 401755 - DNA, 25 bp, Mus musculus
gggcgggacacagtcacctccaaca

SEQ ID NO: 401756 - DNA, 25 bp, Mus musculus
aaccgtcttctcacgaggtgggcgg

SEQ ID NO: 401757 - DNA, 25 bp, Mus musculus
gacaggggcttaataaggacacgca

SEQ ID NO: 401758 - DNA, 25 bp, Mus musculus
catctggagaggcaacgctgcggtt

SEQ ID NO: 401759 - DNA, 25 bp, Mus musculus
ggcacatctggagaggcaacgctgc

SEQ ID NO: 401760 - DNA, 25 bp, Mus musculus
agtcacctccaacaccgccctgcgg

SEQ ID NO: 401761 - DNA, 25 bp, Mus musculus
ctcccgcatccaacacacgtggccc

SEQ ID NO: 401762 - DNA, 25 bp, Mus musculus
tcatacttgtttcccgggcagagtt

SEQ ID NO: 401763 - DNA, 25 bp, Mus musculus
acgcgtctcatacttgtttcccggg

SEQ ID NO: 401764 - DNA, 25 bp, Mus musculus
cgtgtctacgcgtctcatacttgtt

SEQ ID NO: 401765 - DNA, 25 bp, Mus musculus
ggtgccgtgtctacgcgtctcatac

SEQ ID NO: 401766 - DNA, 25 bp, Mus musculus
cggacgtcatggatgactaggctgt

SEQ ID NO: 401767 - DNA, 25 bp, Mus musculus
tgaccagaaccgtcttctcacgagg

SEQ ID NO: 401768 - DNA, 25 bp, Mus musculus
cttcgcgggcactaacggaccggag

SEQ ID NO: 401769 - DNA, 25 bp, Mus musculus
agagagagcgcctgcccatcctaaa

SEQ ID NO: 401770 - DNA, 25 bp, Mus musculus
caacgccgcagaagcagaaggcggc

SEQ ID NO: 401771 - DNA, 25 bp, Mus musculus
gcgtctgaggagcagcaacgccgca

SEQ ID NO: 401772 - DNA, 25 bp, Mus musculus
aacgcagctgtaggtcccggcgtct

SEQ ID NO: 401773 - DNA, 25 bp, Mus musculus
accgcgtacggtcaagcgcgcaggc

SEQ ID NO: 401774 - DNA, 25 bp, Mus musculus
ggcatctctgggtacccaccgcgta

SEQ ID NO: 401775 - DNA, 25 bp, Mus musculus
ggagacgggacacacatccgccacg

SEQ ID NO: 401776 - DNA, 25 bp, Mus musculus
cggtctccgacacagtgcactcaaa

SEQ ID NO: 401777 - DNA, 25 bp, Mus musculus
cggagttcacggagtacagacacct

SEQ ID NO: 401778 - DNA, 25 bp, Mus musculus
gtgcactcaaacgtggcgccgtctc

SEQ ID NO: 401779 - DNA, 25 bp, Mus musculus
cctgcccatcctaaaggcgggattc

SEQ ID NO: 401780 - DNA, 25 bp, Mus musculus
cagacacctctcgttctggggcgga

SEQ ID NO: 401781 - DNA, 25 bp, Mus musculus
agcgcccggtgatctcggtctccga

SEQ ID NO: 401782 - DNA, 25 bp, Mus musculus
atgacgaggcgtctcacagcgccct

SEQ ID NO: 401783 - DNA, 25 bp, Mus musculus
agcttgtggatgacgaggcgtctca

SEQ ID NO: 401784 - DNA, 25 bp, Mus musculus
tcggccttcagcttgtggatgacga

SEQ ID NO: 401785 - DNA, 25 bp, Mus musculus
tcatcatcggccttcagcttgtgga

SEQ ID NO: 401786 - DNA, 25 bp, Mus musculus
agacgccatcatcatcggccttcag

SEQ ID NO: 401787 - DNA, 25 bp, Mus musculus
tctcgcacagatagacgccatcatc

SEQ ID NO: 401788 - DNA, 25 bp, Mus musculus
cctcgatctgctcgtacttgcggca

SEQ ID NO: 401789 - DNA, 25 bp, Mus musculus
tcgtacttgcggcagggtaacagcc

SEQ ID NO: 401790 - DNA, 25 bp, Mus musculus
ccacatcctgcaggggccgggtgaa

SEQ ID NO: 401791 - DNA, 25 bp, Mus musculus
ggcagggtaacagccgttggtcctc

SEQ ID NO: 401792 - DNA, 25 bp, Mus musculus
gaattcgagagttaggtactttaca

SEQ ID NO: 401793 - DNA, 25 bp, Mus musculus
cagcaccacaatcccgtgttcccga

SEQ ID NO: 401794 - DNA, 25 bp, Mus musculus
gtgttcccgaccctccacatcctgc

SEQ ID NO: 401795 - DNA, 25 bp, Mus musculus
aggtactttacactccagcaccaca

SEQ ID NO: 401796 - DNA, 25 bp, Mus musculus
tcccagtacagcttgggctccggaa

SEQ ID NO: 401797 - DNA, 25 bp, Mus musculus
gcccatcacgtagcagcggaatttg

SEQ ID NO: 401798 - DNA, 25 bp, Mus musculus
ggcggccctccaagtgccattcgat

SEQ ID NO: 401799 - DNA, 25 bp, Mus musculus
cgggctcaggtttgcccatcacgta

SEQ ID NO: 401800 - DNA, 25 bp, Mus musculus
aatttggcgtgcttgccctcgttca

SEQ ID NO: 401801 - DNA, 25 bp, Mus musculus
ccctcgttcacccagaaggtcttgg

SEQ ID NO: 401802 - DNA, 25 bp, Mus musculus
caacacgggtttggggttctcatcg

SEQ ID NO: 401803 - DNA, 25 bp, Mus musculus
ttgcgggcgtgacacacgtacaccc

SEQ ID NO: 401804 - DNA, 25 bp, Mus musculus
ggctgctgtcccatacttcgtccaa

SEQ ID NO: 401805 - DNA, 25 bp, Mus musculus
cttaagtacaaagccgccgtcgcgg

SEQ ID NO: 401806 - DNA, 25 bp, Mus musculus
gtcctccggaaagcttaggcgctcg

SEQ ID NO: 401807 - DNA, 25 bp, Mus musculus
ggaccacgcatttgagctcggcctc

SEQ ID NO: 401808 - DNA, 25 bp, Mus musculus
ctccagcttgaagtggctgctgtcc

SEQ ID NO: 401809 - DNA, 25 bp, Mus musculus
gcctggcagtagagcaccttaagta

SEQ ID NO: 401810 - DNA, 25 bp, Mus musculus
ctggcttatttggttgggagttcta

SEQ ID NO: 401811 - DNA, 25 bp, Mus musculus
cttactttttacattgcgcgacgcc

SEQ ID NO: 401812 - DNA, 25 bp, Mus musculus
cgccgggaatcaccgagtcattgcc

SEQ ID NO: 401813 - DNA, 25 bp, Mus musculus
ctaggtgtgttcgatactgtccaga

SEQ ID NO: 401814 - DNA, 25 bp, Mus musculus
gcgcgacgcctccatttgcacgaaa

SEQ ID NO: 401815 - DNA, 25 bp, Mus musculus
accgctccgcgggattcagtagtgt

SEQ ID NO: 401816 - DNA, 25 bp, Mus musculus
ttgttgcccacctgaggctcttccg

SEQ ID NO: 401817 - DNA, 25 bp, Mus musculus
ggggtcagagagatcgttcttttta

SEQ ID NO: 401818 - DNA, 25 bp, Mus musculus
gctcccgaggcccaatgctttttgg

SEQ ID NO: 401819 - DNA, 25 bp, Mus musculus
gagcccggctgccaaagtgattgga

SEQ ID NO: 401820 - DNA, 25 bp, Mus musculus
catgctttccggtaggtcctttgcc

SEQ ID NO: 401821 - DNA, 25 bp, Mus musculus
cttccggtagcgaaggcatgctttc

SEQ ID NO: 401822 - DNA, 25 bp, Mus musculus
atcccggctagttccgtcctactga

SEQ ID NO: 401823 - DNA, 25 bp, Mus musculus
atactgtccagaaacgccgggaatc

SEQ ID NO: 401824 - DNA, 25 bp, Mus musculus
cccacgctggcctggtcggggtaag

SEQ ID NO: 401825 - DNA, 25 bp, Mus musculus
ccgggtagggacagcggactaacat

SEQ ID NO: 401826 - DNA, 25 bp, Mus musculus
tacttaagggcaaggcgtgggcgcc

SEQ ID NO: 401827 - DNA, 25 bp, Mus musculus
aggtggagccgtggactgcaggctc

SEQ ID NO: 401828 - DNA, 25 bp, Mus musculus
ctggcacagccgagcgctaggaggt

SEQ ID NO: 401829 - DNA, 25 bp, Mus musculus
ggatcgtccactcccattgtgcggc

SEQ ID NO: 401830 - DNA, 25 bp, Mus musculus
tcagggatcgtccactcccattgtg

SEQ ID NO: 401831 - DNA, 25 bp, Mus musculus
cagcggactaacatggaccgggttg

SEQ ID NO: 401832 - DNA, 25 bp, Mus musculus
gtaagtcagggatcgtccactccca

SEQ ID NO: 401833 - DNA, 25 bp, Mus musculus
tcggggtaagtcagggatcgtccac

SEQ ID NO: 401834 - DNA, 25 bp, Mus musculus
ctaacatggaccgggttgggcctcg

SEQ ID NO: 401835 - DNA, 25 bp, Mus musculus
caggtgggatcctgcggggacccga

SEQ ID NO: 401836 - DNA, 25 bp, Mus musculus
tagggacagcggactaacatggacc

SEQ ID NO: 401837 - DNA, 25 bp, Mus musculus
ggggcccaccagcgcaatttctgac

SEQ ID NO: 401838 - DNA, 25 bp, Mus musculus
caaaaacccgggctcgcaaggcttg

SEQ ID NO: 401839 - DNA, 25 bp, Mus musculus
cgctgcgctgggaaaactttgcaaa

SEQ ID NO: 401840 - DNA, 25 bp, Mus musculus
ttctcgcctgtgctgctgatgtaga

SEQ ID NO: 401841 - DNA, 25 bp, Mus musculus
ccctgcaggcggatgctgataaact

SEQ ID NO: 401842 - DNA, 25 bp, Mus musculus
gcctttcgctacaaacttgggcaga

SEQ ID NO: 401843 - DNA, 25 bp, Mus musculus
ggcagcttgcatcggtcacccttct

SEQ ID NO: 401844 - DNA, 25 bp, Mus musculus
tctgagctccagaagaccattcatc

SEQ ID NO: 401845 - DNA, 25 bp, Mus musculus
tgccgggctcttaccttcattcgcg

SEQ ID NO: 401846 - DNA, 25 bp, Mus musculus
accggtgacagcgtcgcaaattcca

SEQ ID NO: 401847 - DNA, 25 bp, Mus musculus
aaatcccagccatggttcgccggtg

SEQ ID NO: 401848 - DNA, 25 bp, Mus musculus
ctgccgcttctatcccagtggaata

SEQ ID NO: 401849 - DNA, 25 bp, Mus musculus
gccagtccagagctcgtgaccaata

SEQ ID NO: 401850 - DNA, 25 bp, Mus musculus
cagaccttgtctcgatccttgggga

SEQ ID NO: 401851 - DNA, 25 bp, Mus musculus
tctgcgctctacgtttgggtttccc

SEQ ID NO: 401852 - DNA, 25 bp, Mus musculus
cgtgaagctgccgacctgtaaagca

SEQ ID NO: 401853 - DNA, 25 bp, Mus musculus
tgacacacagggtcgtgaagctgcc

SEQ ID NO: 401854 - DNA, 25 bp, Mus musculus
ccaccgcaaggcttgtgacacacag

SEQ ID NO: 401855 - DNA, 25 bp, Mus musculus
caggggtgttcggtgcccaccgcaa

SEQ ID NO: 401856 - DNA, 25 bp, Mus musculus
atcccactttgtggctccaggggtg

SEQ ID NO: 401857 - DNA, 25 bp, Mus musculus
actgtccgaacaacatcccactttg

SEQ ID NO: 401858 - DNA, 25 bp, Mus musculus
tggggtctcttagcgcaactgtccg

SEQ ID NO: 401859 - DNA, 25 bp, Mus musculus
acctgggcccagtgtggggtctctt

SEQ ID NO: 401860 - DNA, 25 bp, Mus musculus
ccagaagctagagcgacctgggccc

SEQ ID NO: 401861 - DNA, 25 bp, Mus musculus
gcctctcagacggtggccagaagct

SEQ ID NO: 401862 - DNA, 25 bp, Mus musculus
cactctcagggatagctcgcggtag

SEQ ID NO: 401863 - DNA, 25 bp, Mus musculus
agtcctgcttggtgtccactctcag

SEQ ID NO: 401864 - DNA, 25 bp, Mus musculus
cgcggtccttcgaggagtcctgctt

SEQ ID NO: 401865 - DNA, 25 bp, Mus musculus
cctgtaaagcagagaattgatggtc

SEQ ID NO: 401866 - DNA, 25 bp, Mus musculus
cgcccattgagttgccacagcctgg

SEQ ID NO: 401867 - DNA, 25 bp, Mus musculus
cccgagctattgtggcggcgcccgc

SEQ ID NO: 401868 - DNA, 25 bp, Mus musculus
gcgctttggcgcagggcgcagcagc

SEQ ID NO: 401869 - DNA, 25 bp, Mus musculus
tccgcgcttctgctccaggggcagg

SEQ ID NO: 401870 - DNA, 25 bp, Mus musculus
aacagaggcgcccattgagttgcca

SEQ ID NO: 401871 - DNA, 25 bp, Mus musculus
ggcgcccattgagttgccacagcct

SEQ ID NO: 401872 - DNA, 25 bp, Mus musculus
tacgtccgcgcttctgctccagggg

SEQ ID NO: 401873 - DNA, 25 bp, Mus musculus
ccacagcctggggtgcctaagctcg

SEQ ID NO: 401874 - DNA, 25 bp, Mus musculus
acagcctggggtgcctaagctcgaa

SEQ ID NO: 401875 - DNA, 25 bp, Mus musculus
cctggggtgcctaagctcgaacttc

SEQ ID NO: 401876 - DNA, 25 bp, Mus musculus
tggggtgcctaagctcgaacttcgc

SEQ ID NO: 401877 - DNA, 25 bp, Mus musculus
ctcgaacttcgctggtccggctgcg

SEQ ID NO: 401878 - DNA, 25 bp, Mus musculus
tccggctgcgcctgctacgtccgcg

SEQ ID NO: 401879 - DNA, 25 bp, Mus musculus
agaggcgcccattgagttgccacag

SEQ ID NO: 401880 - DNA, 25 bp, Mus musculus
agacacgcgctgattgggcgacaga

SEQ ID NO: 401881 - DNA, 25 bp, Mus musculus
ggctactggcaaaggtgctcactgc

SEQ ID NO: 401882 - DNA, 25 bp, Mus musculus
cccaaagcttgatcaggagccctga

SEQ ID NO: 401883 - DNA, 25 bp, Mus musculus
ggatccggactagggagcatttatt

SEQ ID NO: 401884 - DNA, 25 bp, Mus musculus
gggcgacagaagctactttctcttc

SEQ ID NO: 401885 - DNA, 25 bp, Mus musculus
gtgctcactgcaccgcgaagatcgg

SEQ ID NO: 401886 - DNA, 25 bp, Mus musculus
gagtcccttgagtgcaggatcccaa

SEQ ID NO: 401887 - DNA, 25 bp, Mus musculus
caagtccacaggctccagaggagtc

SEQ ID NO: 401888 - DNA, 25 bp, Mus musculus
gggcgctaatagatccaagtccaca

SEQ ID NO: 401889 - DNA, 25 bp, Mus musculus
cctcgggaactctccggatctcgga

SEQ ID NO: 401890 - DNA, 25 bp, Mus musculus
aagccgctgcgtgggtaattctgcc

SEQ ID NO: 401891 - DNA, 25 bp, Mus musculus
ggccctaacataccttccagcggga

SEQ ID NO: 401892 - DNA, 25 bp, Mus musculus
atccggacgagctgaggccctaaca

SEQ ID NO: 401893 - DNA, 25 bp, Mus musculus
ggggcagcttcgctcgcaaattata

SEQ ID NO: 401894 - DNA, 25 bp, Mus musculus
acgcacaaagttgggacgcttagtc

SEQ ID NO: 401895 - DNA, 25 bp, Mus musculus
ccgtcgcgcctgaatccgactggag

SEQ ID NO: 401896 - DNA, 25 bp, Mus musculus
ttctaaccctcagccaacttgctgg

SEQ ID NO: 401897 - DNA, 25 bp, Mus musculus
ccaacttgctgggtgcatgccagtc

SEQ ID NO: 401898 - DNA, 25 bp, Mus musculus
tgggtgcatgccagtcctaaagcgg

SEQ ID NO: 401899 - DNA, 25 bp, Mus musculus
gcgggcagtctgtctgtccacgtcc

SEQ ID NO: 401900 - DNA, 25 bp, Mus musculus
acaaagttgggacgcttagtcctgg

SEQ ID NO: 401901 - DNA, 25 bp, Mus musculus
ccctggcatgcagtgttcttcgtgt

SEQ ID NO: 401902 - DNA, 25 bp, Mus musculus
atgcagtgttcttcgtgtcccggac

SEQ ID NO: 401903 - DNA, 25 bp, Mus musculus
taccttcctaaggagccaaggacca

SEQ ID NO: 401904 - DNA, 25 bp, Mus musculus
gaccaaagagcaagaggagccattc

SEQ ID NO: 401905 - DNA, 25 bp, Mus musculus
agccattccgggagcagccgcatct

SEQ ID NO: 401906 - DNA, 25 bp, Mus musculus
cgcatcttcccgagcggtcgagcgg

SEQ ID NO: 401907 - DNA, 25 bp, Mus musculus
tcctaaagcgggcagtctgtctgtc

SEQ ID NO: 401908 - DNA, 25 bp, Mus musculus
tccgacaaaacgagtgtaatcttta

SEQ ID NO: 401909 - DNA, 25 bp, Mus musculus
tgcgcttgttagcacgcacaactag

SEQ ID NO: 401910 - DNA, 25 bp, Mus musculus
cgtgccttacttggctgtgcgcttg

SEQ ID NO: 401911 - DNA, 25 bp, Mus musculus
tccgctcaagaacgtgccttacttg

SEQ ID NO: 401912 - DNA, 25 bp, Mus musculus
ggaaaaagcctcctccgctcaagaa

SEQ ID NO: 401913 - DNA, 25 bp, Mus musculus
cgaccgtgctcgaaggtctttccta

SEQ ID NO: 401914 - DNA, 25 bp, Mus musculus
tccgccaaagagatgcagctccagc

SEQ ID NO: 401915 - DNA, 25 bp, Mus musculus
ggaggcgaccagtcaccactgcttt

SEQ ID NO: 401916 - DNA, 25 bp, Mus musculus
cagatcctttcccagagcacgtttg

SEQ ID NO: 401917 - DNA, 25 bp, Mus musculus
aagtaccgctcacgccagatccttt

SEQ ID NO: 401918 - DNA, 25 bp, Mus musculus
atcacgcccaaagcgaaagtaccgc

SEQ ID NO: 401919 - DNA, 25 bp, Mus musculus
ctcagagcgcggctcgcatcaatca

SEQ ID NO: 401920 - DNA, 25 bp, Mus musculus
tattaattactcagccctcagagcg

SEQ ID NO: 401921 - DNA, 25 bp, Mus musculus
tagtcgcacaactagttccggaacg

SEQ ID NO: 401922 - DNA, 25 bp, Mus musculus
ttgagggagatctgagactgccctg

SEQ ID NO: 401923 - DNA, 25 bp, Mus musculus
cggaaagcagcggatcaccagcgag

SEQ ID NO: 401924 - DNA, 25 bp, Mus musculus
ctggacgcgcatgcccgctgagcac

SEQ ID NO: 401925 - DNA, 25 bp, Mus musculus
tgagactgccctggacgcgcatgcc

SEQ ID NO: 401926 - DNA, 25 bp, Mus musculus
tctgagactgccctggacgcgcatg

SEQ ID NO: 401927 - DNA, 25 bp, Mus musculus
ggagatctgagactgccctggacgc

SEQ ID NO: 401928 - DNA, 25 bp, Mus musculus
agatctgagactgccctggacgcgc

SEQ ID NO: 401929 - DNA, 25 bp, Mus musculus
cgcttgagggagatctgagactgcc

SEQ ID NO: 401930 - DNA, 25 bp, Mus musculus
atcaccagcgagtgcgcgcttgagg

SEQ ID NO: 401931 - DNA, 25 bp, Mus musculus
ggatcaccagcgagtgcgcgcttga

SEQ ID NO: 401932 - DNA, 25 bp, Mus musculus
cagcggatcaccagcgagtgcgcgc

SEQ ID NO: 401933 - DNA, 25 bp, Mus musculus
agcagcggatcaccagcgagtgcgc

SEQ ID NO: 401934 - DNA, 25 bp, Mus musculus
cgctgagcacctgcccagctccgca

SEQ ID NO: 401935 - DNA, 25 bp, Mus musculus
gaaagcagcggatcaccagcgagtg

SEQ ID NO: 401936 - DNA, 25 bp, Mus musculus
ctgagatttgagtttacatcttatt

SEQ ID NO: 401937 - DNA, 25 bp, Mus musculus
aagcgcgcgcgcggtactcctaaat

SEQ ID NO: 401938 - DNA, 25 bp, Mus musculus
ttcacaactgttgcggagaagcgcg

SEQ ID NO: 401939 - DNA, 25 bp, Mus musculus
tcaagtccattcacaactgttgcgg

SEQ ID NO: 401940 - DNA, 25 bp, Mus musculus
tccttcagaggactcaagtccattc

SEQ ID NO: 401941 - DNA, 25 bp, Mus musculus
atcttattcatttttccttcagagg

SEQ ID NO: 401942 - DNA, 25 bp, Mus musculus
ctctgtcctcccgggatctctgaga

SEQ ID NO: 401943 - DNA, 25 bp, Mus musculus
cgcgtggatacggactgttcatcag

SEQ ID NO: 401944 - DNA, 25 bp, Mus musculus
aactctaggcgcgtggatacggact

SEQ ID NO: 401945 - DNA, 25 bp, Mus musculus
acgctcaactctaggcgcgtggata

SEQ ID NO: 401946 - DNA, 25 bp, Mus musculus
aggtctagcctgacgctcaactcta

SEQ ID NO: 401947 - DNA, 25 bp, Mus musculus
cacagacgccggctagggcaaggtc

SEQ ID NO: 401948 - DNA, 25 bp, Mus musculus
agggcaaggtctagcctgacgctca

SEQ ID NO: 401949 - DNA, 25 bp, Mus musculus
ggactgttcatcagtctctgtcctc

SEQ ID NO: 401950 - DNA, 25 bp, Mus musculus
aggcctcagcgagcttggtgttgtt

SEQ ID NO: 401951 - DNA, 25 bp, Mus musculus
gcccgcttgcagttctgacagctct

SEQ ID NO: 401952 - DNA, 25 bp, Mus musculus
atgagaagaccacgcacacgcagcc

SEQ ID NO: 401953 - DNA, 25 bp, Mus musculus
ccggtccgcgtcgaagtagttatag

SEQ ID NO: 401954 - DNA, 25 bp, Mus musculus
aggtgtgcaggcatgccagcagctt

SEQ ID NO: 401955 - DNA, 25 bp, Mus musculus
agcagattttgcactcgtagtcctc

SEQ ID NO: 401956 - DNA, 25 bp, Mus musculus
cgctatcgttcgcaggcgctgccat

SEQ ID NO: 401957 - DNA, 25 bp, Mus musculus
agcgctaagatgctagccacggaca

SEQ ID NO: 401958 - DNA, 25 bp, Mus musculus
caggcgctgccatggcatgatacgc

SEQ ID NO: 401959 - DNA, 25 bp, Mus musculus
acgaagatgagaccggtgaacagca

SEQ ID NO: 401960 - DNA, 25 bp, Mus musculus
ccaccgccgtagtggttgacgaaga

SEQ ID NO: 401961 - DNA, 25 bp, Mus musculus
ggacgaaccgctgctcggggatccc

SEQ ID NO: 401962 - DNA, 25 bp, Mus musculus
ccacggacaggcagatgggtcccac

SEQ ID NO: 401963 - DNA, 25 bp, Mus musculus
tggctcaagcactcctggcagaagg

SEQ ID NO: 401964 - DNA, 25 bp, Mus musculus
gggtcccggaggtctctcatctctc

SEQ ID NO: 401965 - DNA, 25 bp, Mus musculus
tccggcagcacttggaaggatgcgc

SEQ ID NO: 401966 - DNA, 25 bp, Mus musculus
cataggtcatgcacgtggacccgtc

SEQ ID NO: 401967 - DNA, 25 bp, Mus musculus
acggcggggaacagtcacccgatgc

SEQ ID NO: 401968 - DNA, 25 bp, Mus musculus
ttccatcctaggaagggcacggcgg

SEQ ID NO: 401969 - DNA, 25 bp, Mus musculus
tccgggtgactcctagatggggatt

SEQ ID NO: 401970 - DNA, 25 bp, Mus musculus
tcatctctccgacaaccgggattcg

SEQ ID NO: 401971 - DNA, 25 bp, Mus musculus
ttcccagcgcgggaggtcagtccta

SEQ ID NO: 401972 - DNA, 25 bp, Mus musculus
attcacagctcgtggcgcgcttcca

SEQ ID NO: 401973 - DNA, 25 bp, Mus musculus
acggctcaccatggccgaactgctg

SEQ ID NO: 401974 - DNA, 25 bp, Mus musculus
tggacccgtccacgcagttgcaagc

SEQ ID NO: 401975 - DNA, 25 bp, Mus musculus
ctctccagcaggcaggtaaggggct

SEQ ID NO: 401976 - DNA, 25 bp, Mus musculus
gttgcaagcacactctccagcaggc

SEQ ID NO: 401977 - DNA, 25 bp, Mus musculus
aaccgggattcggtgtctgccgttg

SEQ ID NO: 401978 - DNA, 25 bp, Mus musculus
acggagttggagctcggtctctaaa

SEQ ID NO: 401979 - DNA, 25 bp, Mus musculus
tgtgtcccgacaccaaagtccgtgc

SEQ ID NO: 401980 - DNA, 25 bp, Mus musculus
gggcctcagcgaccctagagtgaag

SEQ ID NO: 401981 - DNA, 25 bp, Mus musculus
ctaaatgaatgacacggagagcccg

SEQ ID NO: 401982 - DNA, 25 bp, Mus musculus
gagagcccgacacgcgctgatgatg

SEQ ID NO: 401983 - DNA, 25 bp, Mus musculus
gatgatgcaacggagccaccgcgga

SEQ ID NO: 401984 - DNA, 25 bp, Mus musculus
gagctggttccgagaagctacttca

SEQ ID NO: 401985 - DNA, 25 bp, Mus musculus
gaagctacttcagcgcagccgagtc

SEQ ID NO: 401986 - DNA, 25 bp, Mus musculus
cgtagcggcatgaacgccgccagca

SEQ ID NO: 401987 - DNA, 25 bp, Mus musculus
cttctgcagggcgagcagacttccc

SEQ ID NO: 401988 - DNA, 25 bp, Mus musculus
gcttggaagagcaggtctcgcttta

SEQ ID NO: 401989 - DNA, 25 bp, Mus musculus
tctcgctttacgctgacagtcggca

SEQ ID NO: 401990 - DNA, 25 bp, Mus musculus
catggcgagtcgtggacactgcgcc

SEQ ID NO: 401991 - DNA, 25 bp, Mus musculus
cctagagtgaaggacccgacgctcc

SEQ ID NO: 401992 - DNA, 25 bp, Mus musculus
aggaaggatgcaccgcggcctcctc

SEQ ID NO: 401993 - DNA, 25 bp, Mus musculus
cccaggccggcatttgataggccga

SEQ ID NO: 401994 - DNA, 25 bp, Mus musculus
aatgggcggcggtctctttgcatat

SEQ ID NO: 401995 - DNA, 25 bp, Mus musculus
tttgcatatgcaacgagcgccagcc

SEQ ID NO: 401996 - DNA, 25 bp, Mus musculus
gcgtccaggactgcggctcaacaga

SEQ ID NO: 401997 - DNA, 25 bp, Mus musculus
cctaagtgcgttttagtctcggacg

SEQ ID NO: 401998 - DNA, 25 bp, Mus musculus
caggagccgctctgaggagcagcca

SEQ ID NO: 401999 - DNA, 25 bp, Mus musculus
accagcgcccagagggtccctgaaa

SEQ ID NO: 402000 - DNA, 25 bp, Mus musculus
tccctgaaaactgcgggtgtgggac

SEQ ID NO: 402001 - DNA, 25 bp, Mus musculus
gcgtggggaacctctggtgtctcct

SEQ ID NO: 402002 - DNA, 25 bp, Mus musculus
gcggctccgcagaatgacccatagt

SEQ ID NO: 402003 - DNA, 25 bp, Mus musculus
ggtgtctcctcctaagtgcgtttta

SEQ ID NO: 402004 - DNA, 25 bp, Mus musculus
agaatgacccatagtaacctcgccc

SEQ ID NO: 402005 - DNA, 25 bp, Mus musculus
tgcggctcaacagacgctgctcagc

SEQ ID NO: 402006 - DNA, 25 bp, Mus musculus
cagaagagactgtagcagcccgggc

SEQ ID NO: 402007 - DNA, 25 bp, Mus musculus
cagcgcctggctcggaccaagcgat

SEQ ID NO: 402008 - DNA, 25 bp, Mus musculus
accaagcgatcagagaaagagactg

SEQ ID NO: 402009 - DNA, 25 bp, Mus musculus
tgaaatgaatgaagagcggtgcccg

SEQ ID NO: 402010 - DNA, 25 bp, Mus musculus
ggagacctgcactgtccggagcagc

SEQ ID NO: 402011 - DNA, 25 bp, Mus musculus
tgcactgtccggagcagccgggcca

SEQ ID NO: 402012 - DNA, 25 bp, Mus musculus
tacccagagccaggttaggcgcgta

SEQ ID NO: 402013 - DNA, 25 bp, Mus musculus
cctggagccgcaggtgtcacctgga

SEQ ID NO: 402014 - DNA, 25 bp, Mus musculus
gcaggtgtcacctggagcgcgcacc

SEQ ID NO: 402015 - DNA, 25 bp, Mus musculus
cgcctcgaccagctccatcacgatg

SEQ ID NO: 402016 - DNA, 25 bp, Mus musculus
gatgctcagccctactcaccatggt

SEQ ID NO: 402017 - DNA, 25 bp, Mus musculus
tcgcctgtgactcggcggtacccag

SEQ ID NO: 402018 - DNA, 25 bp, Mus musculus
ggtcccgggtccctacagcagcgat

SEQ ID NO: 402019 - DNA, 25 bp, Mus musculus
ctacagcagcgattgcccgggatgc

SEQ ID NO: 402020 - DNA, 25 bp, Mus musculus
agctcgcgagcactgccgcagattc

SEQ ID NO: 402021 - DNA, 25 bp, Mus musculus
cctgattccggactgaaagggcgca

SEQ ID NO: 402022 - DNA, 25 bp, Mus musculus
gttcccaagactaaaggcgcgcgga

SEQ ID NO: 402023 - DNA, 25 bp, Mus musculus
ccagactaggggagtaagacagatc

SEQ ID NO: 402024 - DNA, 25 bp, Mus musculus
agacagatccgcctgacggcaccag

SEQ ID NO: 402025 - DNA, 25 bp, Mus musculus
acggcaccaggatctcggtggacta

SEQ ID NO: 402026 - DNA, 25 bp, Mus musculus
ctccgtccggggtgacaacaagaag

SEQ ID NO: 402027 - DNA, 25 bp, Mus musculus
acaacaagaagggaggcagaatcgc

SEQ ID NO: 402028 - DNA, 25 bp, Mus musculus
agactctacctgtcctcgctagcgg

SEQ ID NO: 402029 - DNA, 25 bp, Mus musculus
tcctcgctagcggtgatcacgccgt

SEQ ID NO: 402030 - DNA, 25 bp, Mus musculus
tgatcacgccgtcctccttggggat

SEQ ID NO: 402031 - DNA, 25 bp, Mus musculus
ggtggccctctatcttgctcagcag

SEQ ID NO: 402032 - DNA, 25 bp, Mus musculus
tgcttagggcaacccagccgcgtgt

SEQ ID NO: 402033 - DNA, 25 bp, Mus musculus
cgctggagaacctgattccggactg

SEQ ID NO: 402034 - DNA, 25 bp, Mus musculus
tgctttgcaaatggttgagtgaagc

SEQ ID NO: 402035 - DNA, 25 bp, Mus musculus
gcaaatggttgagtgaagccacacc

SEQ ID NO: 402036 - DNA, 25 bp, Mus musculus
tgcaaatggttgagtgaagccacac

SEQ ID NO: 402037 - DNA, 25 bp, Mus musculus
ttgagcgaaaccgaaaatcaatttg

SEQ ID NO: 402038 - DNA, 25 bp, Mus musculus
ttgcaaatggttgagtgaagccaca

SEQ ID NO: 402039 - DNA, 25 bp, Mus musculus
ctttgcaaatggttgagtgaagcca

SEQ ID NO: 402040 - DNA, 25 bp, Mus musculus
aggttgagcgaaaccgaaaatcaat

SEQ ID NO: 402041 - DNA, 25 bp, Mus musculus
tttgctttgcaaatggttgagtgaa

SEQ ID NO: 402042 - DNA, 25 bp, Mus musculus
atttgctttgcaaatggttgagtga

SEQ ID NO: 402043 - DNA, 25 bp, Mus musculus
aaccgaaaatcaatttgctttgcaa

SEQ ID NO: 402044 - DNA, 25 bp, Mus musculus
cgaaaccgaaaatcaatttgctttg

SEQ ID NO: 402045 - DNA, 25 bp, Mus musculus
tgagcgaaaccgaaaatcaatttgc

SEQ ID NO: 402046 - DNA, 25 bp, Mus musculus
tttgcaaatggttgagtgaagccac

SEQ ID NO: 402047 - DNA, 25 bp, Mus musculus
gagcgaaaccgaaaatcaatttgct

SEQ ID NO: 402048 - DNA, 25 bp, Mus musculus
tgaatgcgtccgctccatcaaacac

SEQ ID NO: 402049 - DNA, 25 bp, Mus musculus
acgagatgtgaatgcgtccgctcca

SEQ ID NO: 402050 - DNA, 25 bp, Mus musculus
gctccatcaaacacctacttaaagt

SEQ ID NO: 402051 - DNA, 25 bp, Mus musculus
tacttaaagtcaaagacagcgcgtg

SEQ ID NO: 402052 - DNA, 25 bp, Mus musculus
ggggatcaacatgcttgcgtggtta

SEQ ID NO: 402053 - DNA, 25 bp, Mus musculus
catgcttgcgtggttattctctaca

SEQ ID NO: 402054 - DNA, 25 bp, Mus musculus
gcgtggttattctctacactaaaaa

SEQ ID NO: 402055 - DNA, 25 bp, Mus musculus
gccggaaagaactatattcaattac

SEQ ID NO: 402056 - DNA, 25 bp, Mus musculus
tcaattacaagtaacgagggcattc

SEQ ID NO: 402057 - DNA, 25 bp, Mus musculus
tacaagtaacgagggcattcgaggc

SEQ ID NO: 402058 - DNA, 25 bp, Mus musculus
cattcgaggctgtggcccacgttaa

SEQ ID NO: 402059 - DNA, 25 bp, Mus musculus
tgtggcccacgttaagtcccagagc

SEQ ID NO: 402060 - DNA, 25 bp, Mus musculus
cccttgccggaaagaactatattca

SEQ ID NO: 402061 - DNA, 25 bp, Mus musculus
tgcgcgacgagatgtgaatgcgtcc

SEQ ID NO: 402062 - DNA, 25 bp, Mus musculus
tccgcctcctattgccttgttcttg

SEQ ID NO: 402063 - DNA, 25 bp, Mus musculus
tcttcggtgtcctccagcgttcagg

SEQ ID NO: 402064 - DNA, 25 bp, Mus musculus
actagccatgctccctcttcggtgt

SEQ ID NO: 402065 - DNA, 25 bp, Mus musculus
gcacgcgcagtacactagccatgct

SEQ ID NO: 402066 - DNA, 25 bp, Mus musculus
gttcgggctacaccgctccggctgt

SEQ ID NO: 402067 - DNA, 25 bp, Mus musculus
tgttcttgccatggcttctgctgta

SEQ ID NO: 402068 - DNA, 25 bp, Mus musculus
cttctgctgtattccggttgctgca

SEQ ID NO: 402069 - DNA, 25 bp, Mus musculus
cacgctggctcctccggttcgggga

SEQ ID NO: 402070 - DNA, 25 bp, Mus musculus
tgaagaagggattccgtgccgcctt

SEQ ID NO: 402071 - DNA, 25 bp, Mus musculus
cgccttccgcttccagaaagagctg

SEQ ID NO: 402072 - DNA, 25 bp, Mus musculus
ttccagaaagagctggagcgatggc

SEQ ID NO: 402073 - DNA, 25 bp, Mus musculus
ccgccagtgcgacggtaggcgtctc

SEQ ID NO: 402074 - DNA, 25 bp, Mus musculus
aggacaccaggctgcaggcaactgc

SEQ ID NO: 402075 - DNA, 25 bp, Mus musculus
tgctgctgcaccagtttccggggaa

SEQ ID NO: 402076 - DNA, 25 bp, Mus musculus
ccgtcacacttttgcttgtcctgtc

SEQ ID NO: 402077 - DNA, 25 bp, Mus musculus
tttgcttgtcctgtcctgaaaagta

SEQ ID NO: 402078 - DNA, 25 bp, Mus musculus
gtccgtcacacttttgcttgtcctg

SEQ ID NO: 402079 - DNA, 25 bp, Mus musculus
cacttttgcttgtcctgtcctgaaa

SEQ ID NO: 402080 - DNA, 25 bp, Mus musculus
tcacacttttgcttgtcctgtcctg

SEQ ID NO: 402081 - DNA, 25 bp, Mus musculus
tcccttgtatcgcgacttcagaacc

SEQ ID NO: 402082 - DNA, 25 bp, Mus musculus
tcccaggcgcggtcgggcgtcccat

SEQ ID NO: 402083 - DNA, 25 bp, Mus musculus
gagaagtgtcctgctccctttcccg

SEQ ID NO: 402084 - DNA, 25 bp, Mus musculus
aggggagaagtgtcctgctcccttt

SEQ ID NO: 402085 - DNA, 25 bp, Mus musculus
cactacagccgcgtatccggaaagg

SEQ ID NO: 402086 - DNA, 25 bp, Mus musculus
aagtgtcctgctccctttcccgcgc

SEQ ID NO: 402087 - DNA, 25 bp, Mus musculus
tacagccgcgtatccggaaaggtcc

SEQ ID NO: 402088 - DNA, 25 bp, Mus musculus
cgtatccggaaaggtccccatgcgt

SEQ ID NO: 402089 - DNA, 25 bp, Mus musculus
gcagcacacgcacacccagaccgga

SEQ ID NO: 402090 - DNA, 25 bp, Mus musculus
tggatccccaggtggcggccgaaac

SEQ ID NO: 402091 - DNA, 25 bp, Mus musculus
gcaccgcaggggactttaggacgcc

SEQ ID NO: 402092 - DNA, 25 bp, Mus musculus
gacggtgacgcgtgcagcccgcact

SEQ ID NO: 402093 - DNA, 25 bp, Mus musculus
tgctactcacccgtcctcgcttgga

SEQ ID NO: 402094 - DNA, 25 bp, Mus musculus
cctttgtgtggcagccggccgcaac

SEQ ID NO: 402095 - DNA, 25 bp, Mus musculus
agccggccgcaacgtctctgcaccg

SEQ ID NO: 402096 - DNA, 25 bp, Mus musculus
ctctgcaccgcaggggactttagga

SEQ ID NO: 402097 - DNA, 25 bp, Mus musculus
agaaagctccggccagacgcgccgg

SEQ ID NO: 402098 - DNA, 25 bp, Mus musculus
cccggtcgagctgcacgtggatcgt

SEQ ID NO: 402099 - DNA, 25 bp, Mus musculus
acccgcggtcgccagatgccgccct

SEQ ID NO: 402100 - DNA, 25 bp, Mus musculus
tgcaaccactgcactagccggccgg

SEQ ID NO: 402101 - DNA, 25 bp, Mus musculus
gcacgtggatcgtccggatgagcct

SEQ ID NO: 402102 - DNA, 25 bp, Mus musculus
gtggtgtgcccctgagacgcaagac

SEQ ID NO: 402103 - DNA, 25 bp, Mus musculus
cgacacagaagccagtggtgtgccc

SEQ ID NO: 402104 - DNA, 25 bp, Mus musculus
cccggtctcagcaggctccgggtga

SEQ ID NO: 402105 - DNA, 25 bp, Mus musculus
cggcgactttgcaaactctgcgcct

SEQ ID NO: 402106 - DNA, 25 bp, Mus musculus
aagctccgcggcgactttgcaaact

SEQ ID NO: 402107 - DNA, 25 bp, Mus musculus
tcaactcacaagaggcgggtttttc

SEQ ID NO: 402108 - DNA, 25 bp, Mus musculus
caggaagcggaactcagagcctttc

SEQ ID NO: 402109 - DNA, 25 bp, Mus musculus
cccgccgttcaggaagcggaactca

SEQ ID NO: 402110 - DNA, 25 bp, Mus musculus
ctccgggtgaacctgcgggtccgct

SEQ ID NO: 402111 - DNA, 25 bp, Mus musculus
gctgctcatctaagcgtcccgcgtt

SEQ ID NO: 402112 - DNA, 25 bp, Mus musculus
tcatctaagcgtcccgcgttcctaa

SEQ ID NO: 402113 - DNA, 25 bp, Mus musculus
ccaatgcgcctctggtccttaattc

SEQ ID NO: 402114 - DNA, 25 bp, Mus musculus
tccttaattctttggtgacactgct

SEQ ID NO: 402115 - DNA, 25 bp, Mus musculus
tgacactgcttggaggaggtgactc

SEQ ID NO: 402116 - DNA, 25 bp, Mus musculus
tgctgctgacggctgctgacggcca

SEQ ID NO: 402117 - DNA, 25 bp, Mus musculus
cccacccgcgactcggtactgatgc

SEQ ID NO: 402118 - DNA, 25 bp, Mus musculus
cgctgcggagtgtttttcattctta

SEQ ID NO: 402119 - DNA, 25 bp, Mus musculus
taccgccaacctcgaggcctgggaa

SEQ ID NO: 402120 - DNA, 25 bp, Mus musculus
cgtcagcccgctgcggagtgttttt

SEQ ID NO: 402121 - DNA, 25 bp, Mus musculus
ttcattcttatgagtctggcagaga

SEQ ID NO: 402122 - DNA, 25 bp, Mus musculus
ctatagagacggagcgcatcgcatc

SEQ ID NO: 402123 - DNA, 25 bp, Mus musculus
ggagcgcatcgcatcttagacttgg

SEQ ID NO: 402124 - DNA, 25 bp, Mus musculus
cggaaggacctggatgagctctgca

SEQ ID NO: 402125 - DNA, 25 bp, Mus musculus
tgagctctgcagcacccacaagggt

SEQ ID NO: 402126 - DNA, 25 bp, Mus musculus
ccacaagggtgagcgagctttccca

SEQ ID NO: 402127 - DNA, 25 bp, Mus musculus
cccggccatcactcatgctgattgg

SEQ ID NO: 402128 - DNA, 25 bp, Mus musculus
catgctgattggctcttacaggagc

SEQ ID NO: 402129 - DNA, 25 bp, Mus musculus
ttacaggagccaatcggcacccggc

SEQ ID NO: 402130 - DNA, 25 bp, Mus musculus
ctggcagagatgctatagagacgga

SEQ ID NO: 402131 - DNA, 25 bp, Mus musculus
gcggaggctcggctgctaccgccaa

SEQ ID NO: 402132 - DNA, 25 bp, Mus musculus
ctgcgccaaggaagatagcctgatc

SEQ ID NO: 402133 - DNA, 25 bp, Mus musculus
ctggaggaagctcgcagaaattctg

SEQ ID NO: 402134 - DNA, 25 bp, Mus musculus
ccgaaggacgaggtaactgcgccaa

SEQ ID NO: 402135 - DNA, 25 bp, Mus musculus
atccgagtttaagggcgtttcatgc

SEQ ID NO: 402136 - DNA, 25 bp, Mus musculus
tgcagccgcaatcttccgaggacta

SEQ ID NO: 402137 - DNA, 25 bp, Mus musculus
aggagctatggtgcatcccttgccg

SEQ ID NO: 402138 - DNA, 25 bp, Mus musculus
agcgattcccgaggcaaattaaata

SEQ ID NO: 402139 - DNA, 25 bp, Mus musculus
cgggctgccaagtcccaacgttgca

SEQ ID NO: 402140 - DNA, 25 bp, Mus musculus
taccagctcaatcgcagagaccgcg

SEQ ID NO: 402141 - DNA, 25 bp, Mus musculus
agtggcttttccacgcgcaacgcta

SEQ ID NO: 402142 - DNA, 25 bp, Mus musculus
acggtccagagggacaggctcatcc

SEQ ID NO: 402143 - DNA, 25 bp, Mus musculus
cctagctccagtccgcaagggagga

SEQ ID NO: 402144 - DNA, 25 bp, Mus musculus
ggcgcagccgctgcagttacttctc

SEQ ID NO: 402145 - DNA, 25 bp, Mus musculus
gactccaaaattcacgctgttcctg

SEQ ID NO: 402146 - DNA, 25 bp, Mus musculus
cgctacgcattagctagaggaagcc

SEQ ID NO: 402147 - DNA, 25 bp, Mus musculus
cgtgtgttgcggcttcccgggacca

SEQ ID NO: 402148 - DNA, 25 bp, Mus musculus
catcgcttttgtgcggcgtgtgttg

SEQ ID NO: 402149 - DNA, 25 bp, Mus musculus
ctgagtgtatggcatcgcttttgtg

SEQ ID NO: 402150 - DNA, 25 bp, Mus musculus
ttccgcgtctcttcagctgagtgta

SEQ ID NO: 402151 - DNA, 25 bp, Mus musculus
cttagagagagtgagtttccgcgtc

SEQ ID NO: 402152 - DNA, 25 bp, Mus musculus
tacgtgaggacgcaagcgggtctta

SEQ ID NO: 402153 - DNA, 25 bp, Mus musculus
agcctgcggaatcggcgtccgtgcc

SEQ ID NO: 402154 - DNA, 25 bp, Mus musculus
tccagacgtagtgacgcacgagcgc

SEQ ID NO: 402155 - DNA, 25 bp, Mus musculus
agcatgcgcagactgccgctccttt

SEQ ID NO: 402156 - DNA, 25 bp, Mus musculus
aaggcagtacgaagcacggagcatg

SEQ ID NO: 402157 - DNA, 25 bp, Mus musculus
ctagaggaagccgaaaaggcagtac

SEQ ID NO: 402158 - DNA, 25 bp, Mus musculus
agtctccggattcggcgtccagacg

SEQ ID NO: 402159 - DNA, 25 bp, Mus musculus
gtccgtgccggaagttgagtctccg

SEQ ID NO: 402160 - DNA, 25 bp, Mus musculus
ggtcaacggcctctgcgagcgctca

SEQ ID NO: 402161 - DNA, 25 bp, Mus musculus
tcaggagcctgcatgcaacatccgc

SEQ ID NO: 402162 - DNA, 25 bp, Mus musculus
cgtcgacgtctcaggagcctgcatg

SEQ ID NO: 402163 - DNA, 25 bp, Mus musculus
acaaaaatggctccgcgtcgacgtc

SEQ ID NO: 402164 - DNA, 25 bp, Mus musculus
agtactttgcccacgacaaaaatgg

SEQ ID NO: 402165 - DNA, 25 bp, Mus musculus
tgaccagaaacctacttccgctacg

SEQ ID NO: 402166 - DNA, 25 bp, Mus musculus
ctacttccgctacggctcctggaag

SEQ ID NO: 402167 - DNA, 25 bp, Mus musculus
ctcctggaaggggtcagtcctggcc

SEQ ID NO: 402168 - DNA, 25 bp, Mus musculus
cagtcctggccgttctcgcgtctgt

SEQ ID NO: 402169 - DNA, 25 bp, Mus musculus
cccagggtgagtgctctagtctccc

SEQ ID NO: 402170 - DNA, 25 bp, Mus musculus
tcggtgcgctcggtcaacggcctct

SEQ ID NO: 402171 - DNA, 25 bp, Mus musculus
ggcgaccctctctccggggactctc

SEQ ID NO: 402172 - DNA, 25 bp, Mus musculus
gactctccagcaggcccagggtgag

SEQ ID NO: 402173 - DNA, 25 bp, Mus musculus
ccttctctcgtcacatgaccagaaa

SEQ ID NO: 402174 - DNA, 25 bp, Mus musculus
ggctcgttcgtgtgcacctcctgct

SEQ ID NO: 402175 - DNA, 25 bp, Mus musculus
agcagagggcgccagcctgcacttg

SEQ ID NO: 402176 - DNA, 25 bp, Mus musculus
aggaggagaagcacctgaagatgct

SEQ ID NO: 402177 - DNA, 25 bp, Mus musculus
acctgaagatgctgcgggacatgac

SEQ ID NO: 402178 - DNA, 25 bp, Mus musculus
gacatgacggggctgccgcacaacc

SEQ ID NO: 402179 - DNA, 25 bp, Mus musculus
cggggcctttgtgcgacccgcagct

SEQ ID NO: 402180 - DNA, 25 bp, Mus musculus
tccacagcactcaggtagctggggc

SEQ ID NO: 402181 - DNA, 25 bp, Mus musculus
ggggatcttcctccggtccacagca

SEQ ID NO: 402182 - DNA, 25 bp, Mus musculus
ggacgcagaaagctggggatcttcc

SEQ ID NO: 402183 - DNA, 25 bp, Mus musculus
agatgctcttgctctttggccgggc

SEQ ID NO: 402184 - DNA, 25 bp, Mus musculus
gaacatgacggtcggctcgttcgtg

SEQ ID NO: 402185 - DNA, 25 bp, Mus musculus
cccacctacgtgaacatgacggtcg

SEQ ID NO: 402186 - DNA, 25 bp, Mus musculus
aagtgtttcgactgcgaccagcgcg

SEQ ID NO: 402187 - DNA, 25 bp, Mus musculus
gctgccgcacaaccgcaagtgtttc

SEQ ID NO: 402188 - DNA, 25 bp, Mus musculus
tacctgcaggcgctcagtagccggc

SEQ ID NO: 402189 - DNA, 25 bp, Mus musculus
ggctgccacatcttccagccgtggg

SEQ ID NO: 402190 - DNA, 25 bp, Mus musculus
atcttccagccgtggggttttggca

SEQ ID NO: 402191 - DNA, 25 bp, Mus musculus
cagaggagacgctggcgagactctg

SEQ ID NO: 402192 - DNA, 25 bp, Mus musculus
agagatctgcggtcccgctgtcaca

SEQ ID NO: 402193 - DNA, 25 bp, Mus musculus
tctgcggtcccgctgtcacatctgg

SEQ ID NO: 402194 - DNA, 25 bp, Mus musculus
tcacatctggggtcagcgtctgcag

SEQ ID NO: 402195 - DNA, 25 bp, Mus musculus
tctgcaggctgagcgtcctggcgcc

SEQ ID NO: 402196 - DNA, 25 bp, Mus musculus
ctccgctgccggcaacttgtgggct

SEQ ID NO: 402197 - DNA, 25 bp, Mus musculus
tgccggcaacttgtgggctccgctc

SEQ ID NO: 402198 - DNA, 25 bp, Mus musculus
gccgccagtcggtgcgcagctcaga

SEQ ID NO: 402199 - DNA, 25 bp, Mus musculus
tcggtgcgcagctcagacgattgcg

SEQ ID NO: 402200 - DNA, 25 bp, Mus musculus
aggcgctcagtagccggctgccaca

SEQ ID NO: 402201 - DNA, 25 bp, Mus musculus
aaggagagagatctgcggtcccgct

SEQ ID NO: 402202 - DNA, 25 bp, Mus musculus
ctcagcatcggccgcagggtgctct

SEQ ID NO: 402203 - DNA, 25 bp, Mus musculus
agcagggccagcacgggcagcagcg

SEQ ID NO: 402204 - DNA, 25 bp, Mus musculus
ctttggggcccagcacccagcagca

SEQ ID NO: 402205 - DNA, 25 bp, Mus musculus
aagcagccgctttggggcccagcac

SEQ ID NO: 402206 - DNA, 25 bp, Mus musculus
gccaagcagccgctttggggcccag

SEQ ID NO: 402207 - DNA, 25 bp, Mus musculus
gctagccaagcagccgctttggggc

SEQ ID NO: 402208 - DNA, 25 bp, Mus musculus
accgggctagccaagcagccgcttt

SEQ ID NO: 402209 - DNA, 25 bp, Mus musculus
gcggacaccgggctagccaagcagc

SEQ ID NO: 402210 - DNA, 25 bp, Mus musculus
caccgaacgcggagtgcacacgccc

SEQ ID NO: 402211 - DNA, 25 bp, Mus musculus
tcggtcaccgaacgcggagtgcaca

SEQ ID NO: 402212 - DNA, 25 bp, Mus musculus
ctcttggtcggtcaccgaacgcgga

SEQ ID NO: 402213 - DNA, 25 bp, Mus musculus
tgctcttggtcggtcaccgaacgcg

SEQ ID NO: 402214 - DNA, 25 bp, Mus musculus
ggaggcatagcgagcggagagaacg

SEQ ID NO: 402215 - DNA, 25 bp, Mus musculus
agggtgctcttggtcggtcaccgaa

SEQ ID NO: 402216 - DNA, 25 bp, Mus musculus
ccaacgcggaatcctagggacatcc

SEQ ID NO: 402217 - DNA, 25 bp, Mus musculus
aaatcagggagtgagactgcgagtc

SEQ ID NO: 402218 - DNA, 25 bp, Mus musculus
cccgccgccgagaaatcagggagtg

SEQ ID NO: 402219 - DNA, 25 bp, Mus musculus
tgacgaccaatctgccgggctggga

SEQ ID NO: 402220 - DNA, 25 bp, Mus musculus
tcactagcgagggtgacgaccaatc

SEQ ID NO: 402221 - DNA, 25 bp, Mus musculus
cgcacaagctttcgcaactcactag

SEQ ID NO: 402222 - DNA, 25 bp, Mus musculus
ggacagaaccgccaggcacagctcg

SEQ ID NO: 402223 - DNA, 25 bp, Mus musculus
acacacgcacagagacgcgccagga

SEQ ID NO: 402224 - DNA, 25 bp, Mus musculus
cgagctctcggaaccaacgcggaat

SEQ ID NO: 402225 - DNA, 25 bp, Mus musculus
cgcatgggatggacacgcggatccc

SEQ ID NO: 402226 - DNA, 25 bp, Mus musculus
tcacgacgcagactcgcatgggatg

SEQ ID NO: 402227 - DNA, 25 bp, Mus musculus
ggagcagccgcatcacgacgcagac

SEQ ID NO: 402228 - DNA, 25 bp, Mus musculus
gccgctctgctaggcgcacaagctt

SEQ ID NO: 402229 - DNA, 25 bp, Mus musculus
tgcgagtcgagctggctaactcttc

SEQ ID NO: 402230 - DNA, 25 bp, Mus musculus
tcacgtctgtcaatagggctgacaa

SEQ ID NO: 402231 - DNA, 25 bp, Mus musculus
ttcggcctggagatgagaatcattg

SEQ ID NO: 402232 - DNA, 25 bp, Mus musculus
gcctggagatgagaatcattgatca

SEQ ID NO: 402233 - DNA, 25 bp, Mus musculus
tggagatgagaatcattgatcacgg

SEQ ID NO: 402234 - DNA, 25 bp, Mus musculus
attgatcacggacggaaaccccatc

SEQ ID NO: 402235 - DNA, 25 bp, Mus musculus
ccatcacgtctgtcaatagggctga

SEQ ID NO: 402236 - DNA, 25 bp, Mus musculus
cgtctgtcaatagggctgacaaacg

SEQ ID NO: 402237 - DNA, 25 bp, Mus musculus
gtcaatagggctgacaaacggcgcc

SEQ ID NO: 402238 - DNA, 25 bp, Mus musculus
aatagggctgacaaacggcgcccgc

SEQ ID NO: 402239 - DNA, 25 bp, Mus musculus
tagggctgacaaacggcgcccgccg

SEQ ID NO: 402240 - DNA, 25 bp, Mus musculus
ggcgactagcactgagcgcggcgct

SEQ ID NO: 402241 - DNA, 25 bp, Mus musculus
ctcattcggcctggagatgagaatc

SEQ ID NO: 402242 - DNA, 25 bp, Mus musculus
gcctcgggcgactagcactgagcgc

SEQ ID NO: 402243 - DNA, 25 bp, Mus musculus
cccgcggctcattcggcctggagat

SEQ ID NO: 402244 - DNA, 25 bp, Mus musculus
ccggagctcagtcgctacgatgaca

SEQ ID NO: 402245 - DNA, 25 bp, Mus musculus
cgcgctgcctgagactttttggctc

SEQ ID NO: 402246 - DNA, 25 bp, Mus musculus
gcggcttgtcgtcccttcaattatc

SEQ ID NO: 402247 - DNA, 25 bp, Mus musculus
ccagccgcggactactttgtcctga

SEQ ID NO: 402248 - DNA, 25 bp, Mus musculus
gctccctattgacagcgcatcctgt

SEQ ID NO: 402249 - DNA, 25 bp, Mus musculus
tccgcaacgttcaactcgagatttc

SEQ ID NO: 402250 - DNA, 25 bp, Mus musculus
tcgagatttcgagtagcctccagtc

SEQ ID NO: 402251 - DNA, 25 bp, Mus musculus
actgagagcgctccacttggtatcc

SEQ ID NO: 402252 - DNA, 25 bp, Mus musculus
acttggtatccctccgctggggtca

SEQ ID NO: 402253 - DNA, 25 bp, Mus musculus
ctccgcgctagcaggaactaaattc

SEQ ID NO: 402254 - DNA, 25 bp, Mus musculus
cccaggacctgactggagaaatttc

SEQ ID NO: 402255 - DNA, 25 bp, Mus musculus
tcacaaagcagggttccttgtaagc

SEQ ID NO: 402256 - DNA, 25 bp, Mus musculus
tcgtttttaaagtgaggctgcggcc

SEQ ID NO: 402257 - DNA, 25 bp, Mus musculus
aggttccgcctagggccttgctcat

SEQ ID NO: 402258 - DNA, 25 bp, Mus musculus
ccaattgctagaaaggtgctccggg

SEQ ID NO: 402259 - DNA, 25 bp, Mus musculus
tctggctaggaattgtgcgttcggc

SEQ ID NO: 402260 - DNA, 25 bp, Mus musculus
tccgtttaggaactaccaattgcta

SEQ ID NO: 402261 - DNA, 25 bp, Mus musculus
caaatagctaagataccaggcagga

SEQ ID NO: 402262 - DNA, 25 bp, Mus musculus
ctttaacgcggtgatgtgagagata

SEQ ID NO: 402263 - DNA, 25 bp, Mus musculus
agtgcgcacgtcaaagccgggctca

SEQ ID NO: 402264 - DNA, 25 bp, Mus musculus
ttggagcaatccaaaacgccgactg

SEQ ID NO: 402265 - DNA, 25 bp, Mus musculus
gacctttcaggaaaatgcctaactg

SEQ ID NO: 402266 - DNA, 25 bp, Mus musculus
cactatctttgtaggggacctttca

SEQ ID NO: 402267 - DNA, 25 bp, Mus musculus
tagcgggacgctgacactatctttg

SEQ ID NO: 402268 - DNA, 25 bp, Mus musculus
gggctccgcgtagcctcactgttag

SEQ ID NO: 402269 - DNA, 25 bp, Mus musculus
gggactccgagcacctagccctggg

SEQ ID NO: 402270 - DNA, 25 bp, Mus musculus
ccgcgcgaaggctgagacaacctca

SEQ ID NO: 402271 - DNA, 25 bp, Mus musculus
tgccggagcgactccgaggtgaacc

SEQ ID NO: 402272 - DNA, 25 bp, Mus musculus
agcaggcgcaggtcaacgcagccat

SEQ ID NO: 402273 - DNA, 25 bp, Mus musculus
tacctcagagtcacgagcggaagcg

SEQ ID NO: 402274 - DNA, 25 bp, Mus musculus
ataaagcggacaaagcagcggcgtc

SEQ ID NO: 402275 - DNA, 25 bp, Mus musculus
cacgaccagcggtacctcagagtca

SEQ ID NO: 402276 - DNA, 25 bp, Mus musculus
aaagcagcggcgtctggtccggcct

SEQ ID NO: 402277 - DNA, 25 bp, Mus musculus
caggcgtcaggtccttccttggaag

SEQ ID NO: 402278 - DNA, 25 bp, Mus musculus
cgaggactccggagccatccaaact

SEQ ID NO: 402279 - DNA, 25 bp, Mus musculus
gagccatccaaacttccggtgcctg

SEQ ID NO: 402280 - DNA, 25 bp, Mus musculus
acttccggtgcctgcggcgcagcaa

SEQ ID NO: 402281 - DNA, 25 bp, Mus musculus
cattgcgatcgaggttgcactggca

SEQ ID NO: 402282 - DNA, 25 bp, Mus musculus
caacgcagccatggtgaagatcagt

SEQ ID NO: 402283 - DNA, 25 bp, Mus musculus
gaagatcagtttccagcccgcggta

SEQ ID NO: 402284 - DNA, 25 bp, Mus musculus
cggtagcgggcatcaaggctgataa

SEQ ID NO: 402285 - DNA, 25 bp, Mus musculus
caagaagcaggcattgcgatcgagg

SEQ ID NO: 402286 - DNA, 25 bp, Mus musculus
tcgaggtgcacacagcagtgttctg

SEQ ID NO: 402287 - DNA, 25 bp, Mus musculus
tagtggatcgccagacccaaacgga

SEQ ID NO: 402288 - DNA, 25 bp, Mus musculus
tcctggacgtccagcgcgctgataa

SEQ ID NO: 402289 - DNA, 25 bp, Mus musculus
ggggacctgctatacagcgtcttct

SEQ ID NO: 402290 - DNA, 25 bp, Mus musculus
tcctgcagcaggtacgggtccagga

SEQ ID NO: 402291 - DNA, 25 bp, Mus musculus
ggacacgcagctgccgcgacttcag

SEQ ID NO: 402292 - DNA, 25 bp, Mus musculus
agagcccggcaagcagctgctcctg

SEQ ID NO: 402293 - DNA, 25 bp, Mus musculus
gctctgaagccgctgagatcgccga

SEQ ID NO: 402294 - DNA, 25 bp, Mus musculus
cgcagctctcgcgtctcaagaagga

SEQ ID NO: 402295 - DNA, 25 bp, Mus musculus
cggcgagcaaagatgccgcagctct

SEQ ID NO: 402296 - DNA, 25 bp, Mus musculus
accagcgacagcttggcggacaacc

SEQ ID NO: 402297 - DNA, 25 bp, Mus musculus
cgcagtgccagacggcgactcaagc

SEQ ID NO: 402298 - DNA, 25 bp, Mus musculus
tgcgagaagccttgggctccacaag

SEQ ID NO: 402299 - DNA, 25 bp, Mus musculus
aagcgcacatggtccacctagtgga

SEQ ID NO: 402300 - DNA, 25 bp, Mus musculus
gcagcctttcgtcccggctgtcccg

SEQ ID NO: 402301 - DNA, 25 bp, Mus musculus
gtcccgcctccagcctggcggtcca

SEQ ID NO: 402302 - DNA, 25 bp, Mus musculus
cccggtgcaagcagcagcctttcgt

SEQ ID NO: 402303 - DNA, 25 bp, Mus musculus
tgctgcgcacggtgttcggccgcca

SEQ ID NO: 402304 - DNA, 25 bp, Mus musculus
tgcagctgctcgagacgctgctgcg

SEQ ID NO: 402305 - DNA, 25 bp, Mus musculus
ccgaactgcagctgctcgagacgct

SEQ ID NO: 402306 - DNA, 25 bp, Mus musculus
gcgcccgaactgcagctgctcgaga

SEQ ID NO: 402307 - DNA, 25 bp, Mus musculus
tgtgccgcgtcggatcgctgacctc

SEQ ID NO: 402308 - DNA, 25 bp, Mus musculus
cgctcgttttcgtgctgtgccgcgt

SEQ ID NO: 402309 - DNA, 25 bp, Mus musculus
attcgctcgccgctcgttttcgtgc

SEQ ID NO: 402310 - DNA, 25 bp, Mus musculus
gagccattcgctcgccgctcgtttt

SEQ ID NO: 402311 - DNA, 25 bp, Mus musculus
aaggcggagcgagccattcgctcgc

SEQ ID NO: 402312 - DNA, 25 bp, Mus musculus
gatcgctgacctcccgggagtcgcg

SEQ ID NO: 402313 - DNA, 25 bp, Mus musculus
tgcagagccctgcaagctgcggggc

SEQ ID NO: 402314 - DNA, 25 bp, Mus musculus
tttaccttgttgcatgatctcgaga

SEQ ID NO: 402315 - DNA, 25 bp, Mus musculus
tgggaaactggccaggtcactgcag

SEQ ID NO: 402316 - DNA, 25 bp, Mus musculus
tcacttcagccggtgagtgctgccg

SEQ ID NO: 402317 - DNA, 25 bp, Mus musculus
agggcgcagccatgatcacttcagc

SEQ ID NO: 402318 - DNA, 25 bp, Mus musculus
acagatccagggcttggccaggact

SEQ ID NO: 402319 - DNA, 25 bp, Mus musculus
agcgggccctgagctgacagatcca

SEQ ID NO: 402320 - DNA, 25 bp, Mus musculus
actgactgagcagcgcacccgggac

SEQ ID NO: 402321 - DNA, 25 bp, Mus musculus
gaatttgagccaagcctcaggcgga

SEQ ID NO: 402322 - DNA, 25 bp, Mus musculus
tctcgagaggcggaagctgcataaa

SEQ ID NO: 402323 - DNA, 25 bp, Mus musculus
gcagccggccagatctctgacttca

SEQ ID NO: 402324 - DNA, 25 bp, Mus musculus
ctaggcggtcgctggacctttattc

SEQ ID NO: 402325 - DNA, 25 bp, Mus musculus
tgtccgcttcttggtcgagtgaccc

SEQ ID NO: 402326 - DNA, 25 bp, Mus musculus
cacagcgtggcggtgaatttgagcc

SEQ ID NO: 402327 - DNA, 25 bp, Mus musculus
ttcgtaggaataggaccaggtagcc

SEQ ID NO: 402328 - DNA, 25 bp, Mus musculus
tccttgcgactgcacccttgacaca

SEQ ID NO: 402329 - DNA, 25 bp, Mus musculus
gtctagactaaagtcacccgcacgc

SEQ ID NO: 402330 - DNA, 25 bp, Mus musculus
gtcgtcttcgcccagcaagattggc

SEQ ID NO: 402331 - DNA, 25 bp, Mus musculus
gcaagattggccgagtcgcctcacg

SEQ ID NO: 402332 - DNA, 25 bp, Mus musculus
gagtcgcctcacgtgacttcggcta

SEQ ID NO: 402333 - DNA, 25 bp, Mus musculus
ctcacgtgacttcggctagcggtag

SEQ ID NO: 402334 - DNA, 25 bp, Mus musculus
gtaagcgcggccctccttgcgactg

SEQ ID NO: 402335 - DNA, 25 bp, Mus musculus
cgttcgtctgcagtctagactaaag

SEQ ID NO: 402336 - DNA, 25 bp, Mus musculus
cttgacacagccctgggatcattgc

SEQ ID NO: 402337 - DNA, 25 bp, Mus musculus
cacagccctgggatcattgcatgga

SEQ ID NO: 402338 - DNA, 25 bp, Mus musculus
atcattgcatggagggctcgccttg

SEQ ID NO: 402339 - DNA, 25 bp, Mus musculus
ggccgcttgagcatcccattgcttc

SEQ ID NO: 402340 - DNA, 25 bp, Mus musculus
cttcggctagcggtagcggttgccc

SEQ ID NO: 402341 - DNA, 25 bp, Mus musculus
cttccggtactcaccacgtatggta

SEQ ID NO: 402342 - DNA, 25 bp, Mus musculus
ccgcctcaggatgttggcgatcttc

SEQ ID NO: 402343 - DNA, 25 bp, Mus musculus
ccgccatgtctctgtggtgagtcgg

SEQ ID NO: 402344 - DNA, 25 bp, Mus musculus
cgctcagagctgtgatccgtgcgcc

SEQ ID NO: 402345 - DNA, 25 bp, Mus musculus
cagggctgaacggagttgctgtccc

SEQ ID NO: 402346 - DNA, 25 bp, Mus musculus
tgttggcgatcttcaaggtctctga

SEQ ID NO: 402347 - DNA, 25 bp, Mus musculus
ggcgcagagtacctccgagcttcac

SEQ ID NO: 402348 - DNA, 25 bp, Mus musculus
cgcagactgcaagggatgcacgcta

SEQ ID NO: 402349 - DNA, 25 bp, Mus musculus
cacgctaggtgtcctgaggccgacc

SEQ ID NO: 402350 - DNA, 25 bp, Mus musculus
cacgactccggcagcctgtatgcaa

SEQ ID NO: 402351 - DNA, 25 bp, Mus musculus
tgtatgcaacgtctctctagccttg

SEQ ID NO: 402352 - DNA, 25 bp, Mus musculus
agccttggggtttcactagcagaca

SEQ ID NO: 402353 - DNA, 25 bp, Mus musculus
cccggctttgctcttactaatggag

SEQ ID NO: 402354 - DNA, 25 bp, Mus musculus
cctgaggctggttcttacccggact

SEQ ID NO: 402355 - DNA, 25 bp, Mus musculus
ggtctctgagattctggctcttccc

SEQ ID NO: 402356 - DNA, 25 bp, Mus musculus
gtgacttcggctccaccaaccagag

SEQ ID NO: 402357 - DNA, 25 bp, Mus musculus
cgggtcctttgaatgctcctgagcg

SEQ ID NO: 402358 - DNA, 25 bp, Mus musculus
cccaggcggacgttgactggtcagt

SEQ ID NO: 402359 - DNA, 25 bp, Mus musculus
cctttgcgagcttcaccatggtggc

SEQ ID NO: 402360 - DNA, 25 bp, Mus musculus
ccctcaggtgttccgaggcagcatg

SEQ ID NO: 402361 - DNA, 25 bp, Mus musculus
tgagcctgcccagtaatcgcctctg

SEQ ID NO: 402362 - DNA, 25 bp, Mus musculus
gcgccaaggcctcttacctttgcga

SEQ ID NO: 402363 - DNA, 25 bp, Mus musculus
tcggaagagctcagcggaagccaca

SEQ ID NO: 402364 - DNA, 25 bp, Mus musculus
aagccacacgaaagcgactgcagta

SEQ ID NO: 402365 - DNA, 25 bp, Mus musculus
tgcagtagcgggtaccgacgactct

SEQ ID NO: 402366 - DNA, 25 bp, Mus musculus
actctggagcacgtacaaccgcctg

SEQ ID NO: 402367 - DNA, 25 bp, Mus musculus
cctgccagctacagctagcgtctga

SEQ ID NO: 402368 - DNA, 25 bp, Mus musculus
tctgaggcaaaagactgagcctgcc

SEQ ID NO: 402369 - DNA, 25 bp, Mus musculus
tccctccgaaagcaggggcctagtc

SEQ ID NO: 402370 - DNA, 25 bp, Mus musculus
tctgttccagttgctacgcgacggc

SEQ ID NO: 402371 - DNA, 25 bp, Mus musculus
ccgggtgacgtcagtccattgagtt

SEQ ID NO: 402372 - DNA, 25 bp, Mus musculus
gctgcgctgggaactatttgtgtct

SEQ ID NO: 402373 - DNA, 25 bp, Mus musculus
tatttgtgtctgtccctagaggggc

SEQ ID NO: 402374 - DNA, 25 bp, Mus musculus
tggcgcagctgaggaagcgctctct

SEQ ID NO: 402375 - DNA, 25 bp, Mus musculus
tggccgcgacacagaggccctttca

SEQ ID NO: 402376 - DNA, 25 bp, Mus musculus
tgggccgcctggctttgtcctgttt

SEQ ID NO: 402377 - DNA, 25 bp, Mus musculus
gtcctgtttttaaacgctctcctgc

SEQ ID NO: 402378 - DNA, 25 bp, Mus musculus
ggggcgttccagagtctgttccagt

SEQ ID NO: 402379 - DNA, 25 bp, Mus musculus
ttgacgaccgtgacctcaacgccgg

SEQ ID NO: 402380 - DNA, 25 bp, Mus musculus
gcaaaactcggaggctcccaacttg

SEQ ID NO: 402381 - DNA, 25 bp, Mus musculus
tacaaagagctttctccggccgggc

SEQ ID NO: 402382 - DNA, 25 bp, Mus musculus
cgcatcgggctacaaagagctttct

SEQ ID NO: 402383 - DNA, 25 bp, Mus musculus
acagaggccctttcaggctgcgagg

SEQ ID NO: 402384 - DNA, 25 bp, Mus musculus
tcctgtaggagattgtgcccgtgtg

SEQ ID NO: 402385 - DNA, 25 bp, Mus musculus
agattgtgcccgtgtgccagttagt

SEQ ID NO: 402386 - DNA, 25 bp, Mus musculus
ccgggaacaagctgcggatctcgtt

SEQ ID NO: 402387 - DNA, 25 bp, Mus musculus
cccgtgtgccagttagtccagtaga

SEQ ID NO: 402388 - DNA, 25 bp, Mus musculus
atagcacctggtactcggagcctgc

SEQ ID NO: 402389 - DNA, 25 bp, Mus musculus
ggatctcgttgtcatccgcgatgta

SEQ ID NO: 402390 - DNA, 25 bp, Mus musculus
cctggaatgtctgctcgtaggctga

SEQ ID NO: 402391 - DNA, 25 bp, Mus musculus
cggacactctcatcgccctggaatg

SEQ ID NO: 402392 - DNA, 25 bp, Mus musculus
ggcatctatgcggacactctcatcg

SEQ ID NO: 402393 - DNA, 25 bp, Mus musculus
atggacatccatggcatctatgcgg

SEQ ID NO: 402394 - DNA, 25 bp, Mus musculus
gccggccttgacatggacatccatg

SEQ ID NO: 402395 - DNA, 25 bp, Mus musculus
acacggccggccttgacatggacat

SEQ ID NO: 402396 - DNA, 25 bp, Mus musculus
cagttagtccagtagacacggccgg

SEQ ID NO: 402397 - DNA, 25 bp, Mus musculus
ccgcgatgtatagcacctggtactc

SEQ ID NO: 402398 - DNA, 25 bp, Mus musculus
ctgatgcggacctccgaggccatag

SEQ ID NO: 402399 - DNA, 25 bp, Mus musculus
ctccgaggccataggaaactgatgc

SEQ ID NO: 402400 - DNA, 25 bp, Mus musculus
gaaactgatgcggacctccgaggcc

SEQ ID NO: 402401 - DNA, 25 bp, Mus musculus
ccataggaaactgatgcggacctcc

SEQ ID NO: 402402 - DNA, 25 bp, Mus musculus
aaactgatgcggacctccgaggcca

SEQ ID NO: 402403 - DNA, 25 bp, Mus musculus
ataggaaactgatgcggacctccga

SEQ ID NO: 402404 - DNA, 25 bp, Mus musculus
gccataggaaactgatgcggacctc

SEQ ID NO: 402405 - DNA, 25 bp, Mus musculus
cgaggccataggaaactgatgcgga

SEQ ID NO: 402406 - DNA, 25 bp, Mus musculus
aactgatgcggacctccgaggccat

SEQ ID NO: 402407 - DNA, 25 bp, Mus musculus
taggaaactgatgcggacctccgag

SEQ ID NO: 402408 - DNA, 25 bp, Mus musculus
tccgaggccataggaaactgatgcg

SEQ ID NO: 402409 - DNA, 25 bp, Mus musculus
gacctccgaggccataggaaactga

SEQ ID NO: 402410 - DNA, 25 bp, Mus musculus
tgcggacctccgaggccataggaaa

SEQ ID NO: 402411 - DNA, 25 bp, Mus musculus
aggccataggaaactgatgcggacc

SEQ ID NO: 402412 - DNA, 25 bp, Mus musculus
aggctgcaaggactcacaaaggttg

SEQ ID NO: 402413 - DNA, 25 bp, Mus musculus
gtggcgccctaacgagcctctttca

SEQ ID NO: 402414 - DNA, 25 bp, Mus musculus
gtgcacgtgcgtgtaagtgatcata

SEQ ID NO: 402415 - DNA, 25 bp, Mus musculus
ttcgtccacccatcaagaggccatg

SEQ ID NO: 402416 - DNA, 25 bp, Mus musculus
accagccgggtacacatcgtgagcc

SEQ ID NO: 402417 - DNA, 25 bp, Mus musculus
cgagtgacccgtcccgcatttttcg

SEQ ID NO: 402418 - DNA, 25 bp, Mus musculus
ttttccatgactgcatccggcccgg

SEQ ID NO: 402419 - DNA, 25 bp, Mus musculus
agttggcgatcatcctgacccgtgc

SEQ ID NO: 402420 - DNA, 25 bp, Mus musculus
ggccattaagcccagcgaccgcttg

SEQ ID NO: 402421 - DNA, 25 bp, Mus musculus
accgcttgaggaatccgggtgctca

SEQ ID NO: 402422 - DNA, 25 bp, Mus musculus
atctctgaggttcctgtgtctagcc

SEQ ID NO: 402423 - DNA, 25 bp, Mus musculus
ctcattgcacaacagggagaccatg

SEQ ID NO: 402424 - DNA, 25 bp, Mus musculus
ggggtgcactaaaaatcgcttcttc

SEQ ID NO: 402425 - DNA, 25 bp, Mus musculus
gagccgagctctctgagtacacaca

SEQ ID NO: 402426 - DNA, 25 bp, Mus musculus
tagtcagcccgtgcgtgcagaacct

SEQ ID NO: 402427 - DNA, 25 bp, Mus musculus
acactctgacatgggtttgctagtc

SEQ ID NO: 402428 - DNA, 25 bp, Mus musculus
caggtcgcacgcctgcgcagaaaca

SEQ ID NO: 402429 - DNA, 25 bp, Mus musculus
agtgggcgactgtgcacactctgac

SEQ ID NO: 402430 - DNA, 25 bp, Mus musculus
aaaagccgtcgttgctcgagctgcg

SEQ ID NO: 402431 - DNA, 25 bp, Mus musculus
tggacgcctcgaagctggtacaaca

SEQ ID NO: 402432 - DNA, 25 bp, Mus musculus
gcagccgccttctcgttgtgtccat

SEQ ID NO: 402433 - DNA, 25 bp, Mus musculus
tcccgtacttgaggatgggcgccct

SEQ ID NO: 402434 - DNA, 25 bp, Mus musculus
aggtcgtcaagacctgaagccgctc

SEQ ID NO: 402435 - DNA, 25 bp, Mus musculus
tcctgcgccgaaaatccgttccagg

SEQ ID NO: 402436 - DNA, 25 bp, Mus musculus
cctgtgtacccgatgcgtcccgtaa

SEQ ID NO: 402437 - DNA, 25 bp, Mus musculus
tgccagccgcgccatttaggtcgca

SEQ ID NO: 402438 - DNA, 25 bp, Mus musculus
tctcctgagccgacgttcgcggcgt

SEQ ID NO: 402439 - DNA, 25 bp, Mus musculus
gtgcagaaccttggcgcagccgcct

SEQ ID NO: 402440 - DNA, 25 bp, Mus musculus
tggaactcgctacacggtcctgaca

SEQ ID NO: 402441 - DNA, 25 bp, Mus musculus
tcatctgccctgagtggttccggag

SEQ ID NO: 402442 - DNA, 25 bp, Mus musculus
gggatgcaagcccaacgcctgtgta

SEQ ID NO: 402443 - DNA, 25 bp, Mus musculus
cgcctacggagcaggtccgcacagg

SEQ ID NO: 402444 - DNA, 25 bp, Mus musculus
atagctctccgggtaccgcagggat

SEQ ID NO: 402445 - DNA, 25 bp, Mus musculus
gcgggtagtttggtacatagctctc

SEQ ID NO: 402446 - DNA, 25 bp, Mus musculus
cgagcttctccaggaggcggtgtct

SEQ ID NO: 402447 - DNA, 25 bp, Mus musculus
actacagtggccgtcgagcttctcc

SEQ ID NO: 402448 - DNA, 25 bp, Mus musculus
cgcgtgcaccctgtcactacagtgg

SEQ ID NO: 402449 - DNA, 25 bp, Mus musculus
cgggatccggtctcttcacgcgtgc

SEQ ID NO: 402450 - DNA, 25 bp, Mus musculus
tgctaggagctcagatttcggcttc

SEQ ID NO: 402451 - DNA, 25 bp, Mus musculus
ggaccaggccatgtgccgcgtagct

SEQ ID NO: 402452 - DNA, 25 bp, Mus musculus
ttgcacacagtctcatctgccctga

SEQ ID NO: 402453 - DNA, 25 bp, Mus musculus
tggcctgttcgtgtccttgcacaca

SEQ ID NO: 402454 - DNA, 25 bp, Mus musculus
attaaagcttctggcgccgcgtgag

SEQ ID NO: 402455 - DNA, 25 bp, Mus musculus
tgggacaacttgctcttcggtgcgg

SEQ ID NO: 402456 - DNA, 25 bp, Mus musculus
ccgcgctttagctttctgcgtcaga

SEQ ID NO: 402457 - DNA, 25 bp, Mus musculus
tcagaggccttagcaaaacagctgc

SEQ ID NO: 402458 - DNA, 25 bp, Mus musculus
cggcgtggcgagacccaacaaaatt

SEQ ID NO: 402459 - DNA, 25 bp, Mus musculus
ggcactgccgctttaagctcacttg

SEQ ID NO: 402460 - DNA, 25 bp, Mus musculus
acttgcccattgttcggaatcgagc

SEQ ID NO: 402461 - DNA, 25 bp, Mus musculus
atcgagccaatgagaggacgcccgc

SEQ ID NO: 402462 - DNA, 25 bp, Mus musculus
gagcaccgcccactaatctatatta

SEQ ID NO: 402463 - DNA, 25 bp, Mus musculus
tggctgctccgaaaagccatctttg

SEQ ID NO: 402464 - DNA, 25 bp, Mus musculus
ccagagtcctcgaactcgactttta

SEQ ID NO: 402465 - DNA, 25 bp, Mus musculus
ttaattccctcactcgcggcatcgg

SEQ ID NO: 402466 - DNA, 25 bp, Mus musculus
gcagtggataccagctccgagatca

SEQ ID NO: 402467 - DNA, 25 bp, Mus musculus
cgctcagccaatagcgccgggacta

SEQ ID NO: 402468 - DNA, 25 bp, Mus musculus
caagccagccttggcgattggcatc

SEQ ID NO: 402469 - DNA, 25 bp, Mus musculus
gcatcttgagtagccaatagcaacg

SEQ ID NO: 402470 - DNA, 25 bp, Mus musculus
tgaaaccaatgacaagccagccttg

SEQ ID NO: 402471 - DNA, 25 bp, Mus musculus
ggagctcccgccttgaaaccaatga

SEQ ID NO: 402472 - DNA, 25 bp, Mus musculus
ttctccttccctctagtcgtggagc

SEQ ID NO: 402473 - DNA, 25 bp, Mus musculus
agcccggccggacacctcaggtgaa

SEQ ID NO: 402474 - DNA, 25 bp, Mus musculus
aggaaccgaggacagccgcagcccg

SEQ ID NO: 402475 - DNA, 25 bp, Mus musculus
ctcgcagacggtacccaggaaccga

SEQ ID NO: 402476 - DNA, 25 bp, Mus musculus
ccttggctgacatgatgcggcgcct

SEQ ID NO: 402477 - DNA, 25 bp, Mus musculus
ccgctcgtccttggctgacatgatg

SEQ ID NO: 402478 - DNA, 25 bp, Mus musculus
tttgaagcctctcaggatatccctg

SEQ ID NO: 402479 - DNA, 25 bp, Mus musculus
tcccgggcggatacagtttgaagcc

SEQ ID NO: 402480 - DNA, 25 bp, Mus musculus
aaagcctggctccttagagccacgg

SEQ ID NO: 402481 - DNA, 25 bp, Mus musculus
aatagcaacgctcagcggcttcgct

SEQ ID NO: 402482 - DNA, 25 bp, Mus musculus
cgtccactctagttggcgatcctca

SEQ ID NO: 402483 - DNA, 25 bp, Mus musculus
gctgtgctagtctaggctggacttc

SEQ ID NO: 402484 - DNA, 25 bp, Mus musculus
cgggaacattgtgtaggcggaactc

SEQ ID NO: 402485 - DNA, 25 bp, Mus musculus
acagaaaagtgctggacgccgggcc

SEQ ID NO: 402486 - DNA, 25 bp, Mus musculus
cgggccgatcatggaagcttgacaa

SEQ ID NO: 402487 - DNA, 25 bp, Mus musculus
gaagcttgacaacctgcaggcaggc

SEQ ID NO: 402488 - DNA, 25 bp, Mus musculus
acatcggcgaagagaacagagagtc

SEQ ID NO: 402489 - DNA, 25 bp, Mus musculus
gctcaggcaggcgttcccaagaaag

SEQ ID NO: 402490 - DNA, 25 bp, Mus musculus
gttcccaagaaagccgatggccaca

SEQ ID NO: 402491 - DNA, 25 bp, Mus musculus
cctggaggctccttactctgtgctg

SEQ ID NO: 402492 - DNA, 25 bp, Mus musculus
ccttactctgtgctggtggctacga

SEQ ID NO: 402493 - DNA, 25 bp, Mus musculus
ggcgatcctcacattccacgcggtg

SEQ ID NO: 402494 - DNA, 25 bp, Mus musculus
gccagtcctgacgtccactctagtt

SEQ ID NO: 402495 - DNA, 25 bp, Mus musculus
gctacgagcaagaccgccagtcctg

SEQ ID NO: 402496 - DNA, 25 bp, Mus musculus
cccgggacttggtgtccacacgcag

SEQ ID NO: 402497 - DNA, 25 bp, Mus musculus
tcgcgatcggtctcccttgagattg

SEQ ID NO: 402498 - DNA, 25 bp, Mus musculus
tccaacctgccgctgatgtcatctt

SEQ ID NO: 402499 - DNA, 25 bp, Mus musculus
ggctccgctggagcctttataatcc

SEQ ID NO: 402500 - DNA, 25 bp, Mus musculus
tgccaagcgagcacaggtcctactg

SEQ ID NO: 402501 - DNA, 25 bp, Mus musculus
cccgctttgagggagcaagtccgag

SEQ ID NO: 402502 - DNA, 25 bp, Mus musculus
tgtgtcgacattctcccgaggctgg

SEQ ID NO: 402503 - DNA, 25 bp, Mus musculus
ctgcctggagtcttgtcaccctttt

SEQ ID NO: 402504 - DNA, 25 bp, Mus musculus
attgctcttcccgtgccgcaggtca

SEQ ID NO: 402505 - DNA, 25 bp, Mus musculus
caccgatgcgggacagctgagtcca

SEQ ID NO: 402506 - DNA, 25 bp, Mus musculus
gtggcccttctcagccatgagcgtg

SEQ ID NO: 402507 - DNA, 25 bp, Mus musculus
atagatgacttttacggggcccaga

SEQ ID NO: 402508 - DNA, 25 bp, Mus musculus
ctcgggacctgtcggagaaaagagt

SEQ ID NO: 402509 - DNA, 25 bp, Mus musculus
ttctgattgccaccagctgcctggg

SEQ ID NO: 402510 - DNA, 25 bp, Mus musculus
cccagtcagaaaggctgctgtcgct

SEQ ID NO: 402511 - DNA, 25 bp, Mus musculus
tgggaagccgcgactttccgaggct

SEQ ID NO: 402512 - DNA, 25 bp, Mus musculus
tatttcagttcagtgcgagaggagg

SEQ ID NO: 402513 - DNA, 25 bp, Mus musculus
ctttttatatttcagttcagtgcga

SEQ ID NO: 402514 - DNA, 25 bp, Mus musculus
ggaccgtgcgtcctagcctcacggg

SEQ ID NO: 402515 - DNA, 25 bp, Mus musculus
tctccctagcaactgcgggtctgcg

SEQ ID NO: 402516 - DNA, 25 bp, Mus musculus
ggaagcgcattctccctagcaactg

SEQ ID NO: 402517 - DNA, 25 bp, Mus musculus
cggaacgctcgctcgtgacccggaa

SEQ ID NO: 402518 - DNA, 25 bp, Mus musculus
tcgctctcggaacgctcgctcgtga

SEQ ID NO: 402519 - DNA, 25 bp, Mus musculus
cgcttcgctcttggctcaacccggc

SEQ ID NO: 402520 - DNA, 25 bp, Mus musculus
attcaatcccgtggtcctgcagcga

SEQ ID NO: 402521 - DNA, 25 bp, Mus musculus
ccacgcgggatgagcctcgtaccgc

SEQ ID NO: 402522 - DNA, 25 bp, Mus musculus
tcagaaaggctgctgtcgctaaggc

SEQ ID NO: 402523 - DNA, 25 bp, Mus musculus
ccgcgactttccgaggcttggggca

SEQ ID NO: 402524 - DNA, 25 bp, Mus musculus
tgcgcgatgtagttctgctcctgaa

SEQ ID NO: 402525 - DNA, 25 bp, Mus musculus
cccgccgtgggtctctgacgacagg

SEQ ID NO: 402526 - DNA, 25 bp, Mus musculus
ccgcagtcggtgtagggctctaagc

SEQ ID NO: 402527 - DNA, 25 bp, Mus musculus
tcggtgtagggctctaagcagcctg

SEQ ID NO: 402528 - DNA, 25 bp, Mus musculus
tagggctctaagcagcctgcgaatg

SEQ ID NO: 402529 - DNA, 25 bp, Mus musculus
taagcagcctgcgaatgccatgacg

SEQ ID NO: 402530 - DNA, 25 bp, Mus musculus
cagcctgcgaatgccatgacgtgcg

SEQ ID NO: 402531 - DNA, 25 bp, Mus musculus
cgaatgccatgacgtgcgcgatgta

SEQ ID NO: 402532 - DNA, 25 bp, Mus musculus
catgacgtgcgcgatgtagttctgc

SEQ ID NO: 402533 - DNA, 25 bp, Mus musculus
tgctcctgaactccgtgcaccaggt

SEQ ID NO: 402534 - DNA, 25 bp, Mus musculus
gaactccgtgcaccaggtgtgcctg

SEQ ID NO: 402535 - DNA, 25 bp, Mus musculus
ctccgtgcaccaggtgtgcctgagg

SEQ ID NO: 402536 - DNA, 25 bp, Mus musculus
tcctgaactccgtgcaccaggtgtg

SEQ ID NO: 402537 - DNA, 25 bp, Mus musculus
cgcgcgcaaatatggccacgtcctc

SEQ ID NO: 402538 - DNA, 25 bp, Mus musculus
caggccgtacaggtgctcgatctga

SEQ ID NO: 402539 - DNA, 25 bp, Mus musculus
tcacgctcgtcttctgctgcgtgtt

SEQ ID NO: 402540 - DNA, 25 bp, Mus musculus
ctcaaacacggtcaggccgtacagg

SEQ ID NO: 402541 - DNA, 25 bp, Mus musculus
gatagttctcaaacacggtcaggcc

SEQ ID NO: 402542 - DNA, 25 bp, Mus musculus
agttggtggcgtagagatagttctc

SEQ ID NO: 402543 - DNA, 25 bp, Mus musculus
gctgcgtgttggcattgtccgagtt

SEQ ID NO: 402544 - DNA, 25 bp, Mus musculus
ctcggatcacgctcgtcttctgctg

SEQ ID NO: 402545 - DNA, 25 bp, Mus musculus
actcagtactgttgaaccggttcac

SEQ ID NO: 402546 - DNA, 25 bp, Mus musculus
ggtgacgacctggtactcagtactg

SEQ ID NO: 402547 - DNA, 25 bp, Mus musculus
ttgtccacacgggtgacgacctggt

SEQ ID NO: 402548 - DNA, 25 bp, Mus musculus
atatgcagggcaccacccttgtcca

SEQ ID NO: 402549 - DNA, 25 bp, Mus musculus
ctggtggtagatatgcagggcacca

SEQ ID NO: 402550 - DNA, 25 bp, Mus musculus
ctcgatctgagacggcaggcagcgt

SEQ ID NO: 402551 - DNA, 25 bp, Mus musculus
aaccggttcactcggatcacgctcg

SEQ ID NO: 402552 - DNA, 25 bp, Mus musculus
tagctgtccgaacccgtatccttcg

SEQ ID NO: 402553 - DNA, 25 bp, Mus musculus
gttcctgtcgtccaggctgactgta

SEQ ID NO: 402554 - DNA, 25 bp, Mus musculus
cttgtacagcagtcggttgaggtcc

SEQ ID NO: 402555 - DNA, 25 bp, Mus musculus
agcctctcgatctcgcgcatgtcga

SEQ ID NO: 402556 - DNA, 25 bp, Mus musculus
tccgcacgcgaacgagtagaagtcc

SEQ ID NO: 402557 - DNA, 25 bp, Mus musculus
tggcgtccaggttggcagacagaaa

SEQ ID NO: 402558 - DNA, 25 bp, Mus musculus
gcagaggccggcagcaaacaccaac

SEQ ID NO: 402559 - DNA, 25 bp, Mus musculus
acagcaggcacacctcgcgtcgatt

SEQ ID NO: 402560 - DNA, 25 bp, Mus musculus
gtgccacaccggctcacatacttga

SEQ ID NO: 402561 - DNA, 25 bp, Mus musculus
cacatacttgacttcctggaactcg

SEQ ID NO: 402562 - DNA, 25 bp, Mus musculus
gaactcgtcgtagtgcgctgtcatg

SEQ ID NO: 402563 - DNA, 25 bp, Mus musculus
cgctgtcatggaatacggggcctcc

SEQ ID NO: 402564 - DNA, 25 bp, Mus musculus
gcccaggtatttgagcgccagcatg

SEQ ID NO: 402565 - DNA, 25 bp, Mus musculus
cagggaaattacttgcgccctcctc

SEQ ID NO: 402566 - DNA, 25 bp, Mus musculus
agccaggcagcagagagatgtctcg

SEQ ID NO: 402567 - DNA, 25 bp, Mus musculus
aggcagtggcttcaggcgctcttga

SEQ ID NO: 402568 - DNA, 25 bp, Mus musculus
cgctcttgagtatgcagccgagata

SEQ ID NO: 402569 - DNA, 25 bp, Mus musculus
ccgagataggagaagtgtgcgctct

SEQ ID NO: 402570 - DNA, 25 bp, Mus musculus
tgcagaaggggttctgagtcgactc

SEQ ID NO: 402571 - DNA, 25 bp, Mus musculus
ggggttctgagtcgactcggcaccc

SEQ ID NO: 402572 - DNA, 25 bp, Mus musculus
cccaaggagtttagcgaaacgtcag

SEQ ID NO: 402573 - DNA, 25 bp, Mus musculus
gagtttagcgaaacgtcagcgaccc

SEQ ID NO: 402574 - DNA, 25 bp, Mus musculus
aatctcttggcaaccctagccatct

SEQ ID NO: 402575 - DNA, 25 bp, Mus musculus
gagactccgggatgacaagtcccaa

SEQ ID NO: 402576 - DNA, 25 bp, Mus musculus
agagatgtctcggttgtcgccgacc

SEQ ID NO: 402577 - DNA, 25 bp, Mus musculus
ctgcaccggtttcggagcaggcagt

SEQ ID NO: 402578 - DNA, 25 bp, Mus musculus
gcggtattcgtcctccctctagaga

SEQ ID NO: 402579 - DNA, 25 bp, Mus musculus
cctaggtcgcctctggagactccgg

SEQ ID NO: 402580 - DNA, 25 bp, Mus musculus
agctggagccagagccgggaggaca

SEQ ID NO: 402581 - DNA, 25 bp, Mus musculus
gggtcgggagcaaatcccggcctca

SEQ ID NO: 402582 - DNA, 25 bp, Mus musculus
gcagtcagcggagcttgagagccga

SEQ ID NO: 402583 - DNA, 25 bp, Mus musculus
gagtcctggagtcgcagccgcagcc

SEQ ID NO: 402584 - DNA, 25 bp, Mus musculus
aaatcccggcctcagccggagagga

SEQ ID NO: 402585 - DNA, 25 bp, Mus musculus
ggacagagacaaagccgagaagctc

SEQ ID NO: 402586 - DNA, 25 bp, Mus musculus
tggcctcggaggtggctgtgatgat

SEQ ID NO: 402587 - DNA, 25 bp, Mus musculus
ctgtgatgatgtcctcggaggcggc

SEQ ID NO: 402588 - DNA, 25 bp, Mus musculus
ggcggcgggcccgaatgacacttac

SEQ ID NO: 402589 - DNA, 25 bp, Mus musculus
gggcccgaatgacacttacccggca

SEQ ID NO: 402590 - DNA, 25 bp, Mus musculus
cgaatgacacttacccggcaggtgc

SEQ ID NO: 402591 - DNA, 25 bp, Mus musculus
acacttacccggcaggtgcgcgtct

SEQ ID NO: 402592 - DNA, 25 bp, Mus musculus
acttacccggcaggtgcgcgtctgg

SEQ ID NO: 402593 - DNA, 25 bp, Mus musculus
agagccgagtcctggagtcgcagcc

SEQ ID NO: 402594 - DNA, 25 bp, Mus musculus
agagctacggtcactggcgcacacc

SEQ ID NO: 402595 - DNA, 25 bp, Mus musculus
cgcgagcctagctgcagagaacttc

SEQ ID NO: 402596 - DNA, 25 bp, Mus musculus
ttctaaattggaacgctcgggaaga

SEQ ID NO: 402597 - DNA, 25 bp, Mus musculus
ctccaacagtgtctgcagcgcaggc

SEQ ID NO: 402598 - DNA, 25 bp, Mus musculus
gacggtgcggtcagtcctgtttacc

SEQ ID NO: 402599 - DNA, 25 bp, Mus musculus
ctaaaccgctcgcagagctacggtc

SEQ ID NO: 402600 - DNA, 25 bp, Mus musculus
tggcgcacaccctgcttggtctgct

SEQ ID NO: 402601 - DNA, 25 bp, Mus musculus
gctccaggagcttcccggtcacaat

SEQ ID NO: 402602 - DNA, 25 bp, Mus musculus
agaacagcggttatactcaggtatc

SEQ ID NO: 402603 - DNA, 25 bp, Mus musculus
cccagagtctcggaatcatgtaacc

SEQ ID NO: 402604 - DNA, 25 bp, Mus musculus
atcatgtaacctctccgaggcgtgc

SEQ ID NO: 402605 - DNA, 25 bp, Mus musculus
gaggcgtgcccactaacttcctgtg

SEQ ID NO: 402606 - DNA, 25 bp, Mus musculus
cgcgaattgcgggaacctggctcca

SEQ ID NO: 402607 - DNA, 25 bp, Mus musculus
tggtctcctccaggatcgcgaattg

SEQ ID NO: 402608 - DNA, 25 bp, Mus musculus
agccgcgctgagtactgtggcctct

SEQ ID NO: 402609 - DNA, 25 bp, Mus musculus
gcggcggcaagaggatgaacaacaa

SEQ ID NO: 402610 - DNA, 25 bp, Mus musculus
caaggcctgagcactgacgttccgc

SEQ ID NO: 402611 - DNA, 25 bp, Mus musculus
agcactgacgttccgctgagcgcct

SEQ ID NO: 402612 - DNA, 25 bp, Mus musculus
gcccttagcgatgggacccggtaga

SEQ ID NO: 402613 - DNA, 25 bp, Mus musculus
cccggtagagcggaagtcactccgt

SEQ ID NO: 402614 - DNA, 25 bp, Mus musculus
gtcactccgtgaggcagtggcgaca

SEQ ID NO: 402615 - DNA, 25 bp, Mus musculus
gaacaacaagttcgacgcgtgagtg

SEQ ID NO: 402616 - DNA, 25 bp, Mus musculus
acctcagcgcttcgggtgtttccgc

SEQ ID NO: 402617 - DNA, 25 bp, Mus musculus
ggcgtcctgggaaggtcacctctcc

SEQ ID NO: 402618 - DNA, 25 bp, Mus musculus
ccgagcctcgattttgtcttctgca

SEQ ID NO: 402619 - DNA, 25 bp, Mus musculus
tgtcttctgcaagcggggacggtaa

SEQ ID NO: 402620 - DNA, 25 bp, Mus musculus
taacagagcccgtgtcgtagagttg

SEQ ID NO: 402621 - DNA, 25 bp, Mus musculus
cggtcggaacaagcgctgtcgtccc

SEQ ID NO: 402622 - DNA, 25 bp, Mus musculus
tcagaaagccacgagcccgcaaaga

SEQ ID NO: 402623 - DNA, 25 bp, Mus musculus
taggacgcgcagacactcccttgtc

SEQ ID NO: 402624 - DNA, 25 bp, Mus musculus
cgagcgattccaccgagcgtcagaa

SEQ ID NO: 402625 - DNA, 25 bp, Mus musculus
gtaccggatcgcgaacctcagttcc

SEQ ID NO: 402626 - DNA, 25 bp, Mus musculus
ccgccatcatgtccagcgaggagct

SEQ ID NO: 402627 - DNA, 25 bp, Mus musculus
gcgcggactccgaactgaacctcaa

SEQ ID NO: 402628 - DNA, 25 bp, Mus musculus
caggctggacatccaccagggtaca

SEQ ID NO: 402629 - DNA, 25 bp, Mus musculus
ctacaccgagttcccggagttcagc

SEQ ID NO: 402630 - DNA, 25 bp, Mus musculus
ttcaaaacgtgagcgctcgtcctgc

SEQ ID NO: 402631 - DNA, 25 bp, Mus musculus
gagtgcactgagcatctggccaagt

SEQ ID NO: 402632 - DNA, 25 bp, Mus musculus
cagccagatcgtgcgcatcaagttc

SEQ ID NO: 402633 - DNA, 25 bp, Mus musculus
atcaagttcattgcgcgccatgggg

SEQ ID NO: 402634 - DNA, 25 bp, Mus musculus
acctcgtcaggctggggatctgacc

SEQ ID NO: 402635 - DNA, 25 bp, Mus musculus
gtagatagtcctactgcacccgcgc

SEQ ID NO: 402636 - DNA, 25 bp, Mus musculus
tgttgttgaggctgaggattgactt

SEQ ID NO: 402637 - DNA, 25 bp, Mus musculus
tgtcaggccggagggttcgccttcc

SEQ ID NO: 402638 - DNA, 25 bp, Mus musculus
tgctgcgagccgacagctgctcctg

SEQ ID NO: 402639 - DNA, 25 bp, Mus musculus
tgtcccggaccgcaggtaaccagtg

SEQ ID NO: 402640 - DNA, 25 bp, Mus musculus
cgtgtcggccatcttgtgttgttga

SEQ ID NO: 402641 - DNA, 25 bp, Mus musculus
gtaaccagtggctcggtgtgtgtct

SEQ ID NO: 402642 - DNA, 25 bp, Mus musculus
ggccgcatggacacactcaggctgc

SEQ ID NO: 402643 - DNA, 25 bp, Mus musculus
gagccggccgcatggacacactcag

SEQ ID NO: 402644 - DNA, 25 bp, Mus musculus
catcttgtgttgttgaggctgagga

SEQ ID NO: 402645 - DNA, 25 bp, Mus musculus
ttctgagagactcctgtcccggacc

SEQ ID NO: 402646 - DNA, 25 bp, Mus musculus
tgcgtggcgacgtgtcggccatctt

SEQ ID NO: 402647 - DNA, 25 bp, Mus musculus
aggtcagcaggagcctcctcccgtg

SEQ ID NO: 402648 - DNA, 25 bp, Mus musculus
ctgcgctactcaggctccgtcctcg

SEQ ID NO: 402649 - DNA, 25 bp, Mus musculus
gattgacttgggttctgagagactc

SEQ ID NO: 402650 - DNA, 25 bp, Mus musculus
tattgctgggccacgccgcgtgcct

SEQ ID NO: 402651 - DNA, 25 bp, Mus musculus
tggcaggcagagaacatgtgcatgc

SEQ ID NO: 402652 - DNA, 25 bp, Mus musculus
atgtgcatgcttggtcacgtgcatg

SEQ ID NO: 402653 - DNA, 25 bp, Mus musculus
ttggtcacgtgcatgtgttgcgccc

SEQ ID NO: 402654 - DNA, 25 bp, Mus musculus
ttcttgaagccaataaaggagccgc

SEQ ID NO: 402655 - DNA, 25 bp, Mus musculus
tcgtcgcgctaaggaagttttccgc

SEQ ID NO: 402656 - DNA, 25 bp, Mus musculus
gctaaggaagttttccgcttcttga

SEQ ID NO: 402657 - DNA, 25 bp, Mus musculus
cggcgactctgcatcttgtgctctc

SEQ ID NO: 402658 - DNA, 25 bp, Mus musculus
actctgcatcttgtgctctcctttg

SEQ ID NO: 402659 - DNA, 25 bp, Mus musculus
tggaccaggcgccattgcagccatc

SEQ ID NO: 402660 - DNA, 25 bp, Mus musculus
tgcagccatcgtgatcgctgccctg

SEQ ID NO: 402661 - DNA, 25 bp, Mus musculus
ctacctgcgtggtgctggcactcgt

SEQ ID NO: 402662 - DNA, 25 bp, Mus musculus
gctggcactcgtggtcgtcgcgcta

SEQ ID NO: 402663 - DNA, 25 bp, Mus musculus
taaaggagccgcacaggccggcccg

SEQ ID NO: 402664 - DNA, 25 bp, Mus musculus
ccctttttgtcaccataccagggcg

SEQ ID NO: 402665 - DNA, 25 bp, Mus musculus
cgagatcatcgcctagggagcgagt

SEQ ID NO: 402666 - DNA, 25 bp, Mus musculus
tagccgctgcacagcgcggaaggcc

SEQ ID NO: 402667 - DNA, 25 bp, Mus musculus
cgcgacggggtgattcactcctaca

SEQ ID NO: 402668 - DNA, 25 bp, Mus musculus
cagtccgcccaaaccttcatgtttt

SEQ ID NO: 402669 - DNA, 25 bp, Mus musculus
atgtttttcgagctcgcggacaggc

SEQ ID NO: 402670 - DNA, 25 bp, Mus musculus
aaagttggcgtaccctagccgctgc

SEQ ID NO: 402671 - DNA, 25 bp, Mus musculus
cgaggctctgtcctccagttccaga

SEQ ID NO: 402672 - DNA, 25 bp, Mus musculus
cagttccagagactgggagcgcaga

SEQ ID NO: 402673 - DNA, 25 bp, Mus musculus
gacgcgcacactctgggcgtccagg

SEQ ID NO: 402674 - DNA, 25 bp, Mus musculus
atcccacgctgggactgggtgctag

SEQ ID NO: 402675 - DNA, 25 bp, Mus musculus
aaggtccgtcggattagagttagtg

SEQ ID NO: 402676 - DNA, 25 bp, Mus musculus
tcgctctccgaggtggagctgtcgt

SEQ ID NO: 402677 - DNA, 25 bp, Mus musculus
gactgggtgctagtgacctggaaca

SEQ ID NO: 402678 - DNA, 25 bp, Mus musculus
tcgttgcttaccttccttctttggc

SEQ ID NO: 402679 - DNA, 25 bp, Mus musculus
tccggcttcaaggttgcgtcatttg

SEQ ID NO: 402680 - DNA, 25 bp, Mus musculus
gcgtcatttgagagcgtcccgcgaa

SEQ ID NO: 402681 - DNA, 25 bp, Mus musculus
ccagaataatttccggcagagaccg

SEQ ID NO: 402682 - DNA, 25 bp, Mus musculus
tggaagcgtcacatcgcggaggaac

SEQ ID NO: 402683 - DNA, 25 bp, Mus musculus
aggcgttcgaggagatcattctgca

SEQ ID NO: 402684 - DNA, 25 bp, Mus musculus
aggttctttccacagacatcgtttg

SEQ ID NO: 402685 - DNA, 25 bp, Mus musculus
acgtctcgagccctttcgttgctta

SEQ ID NO: 402686 - DNA, 25 bp, Mus musculus
taaatctcgataacccaggcggcgc

SEQ ID NO: 402687 - DNA, 25 bp, Mus musculus
ggcttaaaccttaggcgcgatcatg

SEQ ID NO: 402688 - DNA, 25 bp, Mus musculus
tcattctgcagtgtgagcggcacgc

SEQ ID NO: 402689 - DNA, 25 bp, Mus musculus
ccgatgcacttaggtagtcaggctc

SEQ ID NO: 402690 - DNA, 25 bp, Mus musculus
agtcaggctccaaaaacgtcgtgtt

SEQ ID NO: 402691 - DNA, 25 bp, Mus musculus
cgtcgtgtttaaggaatcgagttca

SEQ ID NO: 402692 - DNA, 25 bp, Mus musculus
tcagagtaaacagggacacccgcgg

SEQ ID NO: 402693 - DNA, 25 bp, Mus musculus
tgcgggaaaggctgagctttgattt

SEQ ID NO: 402694 - DNA, 25 bp, Mus musculus
ggatggagcccaccttagtacccgc

SEQ ID NO: 402695 - DNA, 25 bp, Mus musculus
ctcagggatggagcccaccttagta

SEQ ID NO: 402696 - DNA, 25 bp, Mus musculus
cttgggctcagggatggagcccacc

SEQ ID NO: 402697 - DNA, 25 bp, Mus musculus
gggacacgctgcagcttgtcggccc

SEQ ID NO: 402698 - DNA, 25 bp, Mus musculus
ggctcagagtaaacagggacacccg

SEQ ID NO: 402699 - DNA, 25 bp, Mus musculus
cccacctcgctccagggctcagagt

SEQ ID NO: 402700 - DNA, 25 bp, Mus musculus
aaggagtggccacatggacccgccc

SEQ ID NO: 402701 - DNA, 25 bp, Mus musculus
ctttgtaagaaccggtctgggattg

SEQ ID NO: 402702 - DNA, 25 bp, Mus musculus
tggagactttgtaagaaccggtctg

SEQ ID NO: 402703 - DNA, 25 bp, Mus musculus
ttgatttggagactttgtaagaacc

SEQ ID NO: 402704 - DNA, 25 bp, Mus musculus
gctgagctttgatttggagactttg

SEQ ID NO: 402705 - DNA, 25 bp, Mus musculus
gctgcagcttgtcggcccgccttgg

SEQ ID NO: 402706 - DNA, 25 bp, Mus musculus
ccacgtcgggccagatccggcagaa

SEQ ID NO: 402707 - DNA, 25 bp, Mus musculus
cttatccgtaaggtgtccacgtcgg

SEQ ID NO: 402708 - DNA, 25 bp, Mus musculus
cccgcagaagcttatccgtaaggtg

SEQ ID NO: 402709 - DNA, 25 bp, Mus musculus
tccgacagtgaacccgaggctgagc

SEQ ID NO: 402710 - DNA, 25 bp, Mus musculus
gcccgaggtcctgcggtcgctgcta

SEQ ID NO: 402711 - DNA, 25 bp, Mus musculus
cgccgcctgaggagtcgtccgacag

SEQ ID NO: 402712 - DNA, 25 bp, Mus musculus
tgcgtcaggctctccctccactgct

SEQ ID NO: 402713 - DNA, 25 bp, Mus musculus
ctgaggagtcgtccgacagtgaacc

SEQ ID NO: 402714 - DNA, 25 bp, Mus musculus
agcgcgccgcggcttaacggaccgc

SEQ ID NO: 402715 - DNA, 25 bp, Mus musculus
tctgtaggtctgagcaccgggtgca

SEQ ID NO: 402716 - DNA, 25 bp, Mus musculus
agcaccgggtgcagcttcccgtact

SEQ ID NO: 402717 - DNA, 25 bp, Mus musculus
cttcccgtactcacctgcgtcaggc

SEQ ID NO: 402718 - DNA, 25 bp, Mus musculus
gctgcggggtcctcacccctatgtt

SEQ ID NO: 402719 - DNA, 25 bp, Mus musculus
cctatgttccgaaagggaagggatg

SEQ ID NO: 402720 - DNA, 25 bp, Mus musculus
ggccgtgtctctggaaagtgatttc

SEQ ID NO: 402721 - DNA, 25 bp, Mus musculus
caccgccatgccgaggaggccgtgt

SEQ ID NO: 402722 - DNA, 25 bp, Mus musculus
ccggccacagcacagagtaaacgaa

SEQ ID NO: 402723 - DNA, 25 bp, Mus musculus
tagctcgcgggctggcttcccgtca

SEQ ID NO: 402724 - DNA, 25 bp, Mus musculus
taaacgaactcgctccgaacgggca

SEQ ID NO: 402725 - DNA, 25 bp, Mus musculus
gcacagagtaaacgaactcgctccg

SEQ ID NO: 402726 - DNA, 25 bp, Mus musculus
ccacttactgcctatagcccagacc

SEQ ID NO: 402727 - DNA, 25 bp, Mus musculus
gcgtcgtccctacgctgccctcgtc

SEQ ID NO: 402728 - DNA, 25 bp, Mus musculus
ccctgacgcgctgccagcagaggcc

SEQ ID NO: 402729 - DNA, 25 bp, Mus musculus
ctacacttcccagggtgcgtcgcgc

SEQ ID NO: 402730 - DNA, 25 bp, Mus musculus
ggcttcccgtcacgccgctccagag

SEQ ID NO: 402731 - DNA, 25 bp, Mus musculus
cgtgtctctggaaagtgatttccaa

SEQ ID NO: 402732 - DNA, 25 bp, Mus musculus
cctcgagctagctcgcgggctggct

SEQ ID NO: 402733 - DNA, 25 bp, Mus musculus
tccagaggccttgccgcccaccaag

SEQ ID NO: 402734 - DNA, 25 bp, Mus musculus
agagagacacagaccgcgcgagctc

SEQ ID NO: 402735 - DNA, 25 bp, Mus musculus
acacatgcccgcacccagaaagtta

SEQ ID NO: 402736 - DNA, 25 bp, Mus musculus
cagaaagttaagtcaggggcgagcc

SEQ ID NO: 402737 - DNA, 25 bp, Mus musculus
aggcgcgcttaccaatgtggccgtc

SEQ ID NO: 402738 - DNA, 25 bp, Mus musculus
accaatgtggccgtcacgccgtcag

SEQ ID NO: 402739 - DNA, 25 bp, Mus musculus
cgccatgttcccgtgttaataactg

SEQ ID NO: 402740 - DNA, 25 bp, Mus musculus
cgtgttaataactgctgcctggttg

SEQ ID NO: 402741 - DNA, 25 bp, Mus musculus
actgctgcctggttgtttatttcaa

SEQ ID NO: 402742 - DNA, 25 bp, Mus musculus
tgtggtctagggaccgtgacctatg

SEQ ID NO: 402743 - DNA, 25 bp, Mus musculus
ggctctgcacttgcggagagagaca

SEQ ID NO: 402744 - DNA, 25 bp, Mus musculus
cgagcgaacgctgtcaccgctcagg

SEQ ID NO: 402745 - DNA, 25 bp, Mus musculus
gggtcctcagcatctccctggctgg

SEQ ID NO: 402746 - DNA, 25 bp, Mus musculus
ctggctggcgagacttcagagctcg

SEQ ID NO: 402747 - DNA, 25 bp, Mus musculus
tgtttatttcaatggagatcctccc

SEQ ID NO: 402748 - DNA, 25 bp, Mus musculus
gtaggcctgcgccacctgcttgaac

SEQ ID NO: 402749 - DNA, 25 bp, Mus musculus
gcagcggtcgtacacctcgcgcttg

SEQ ID NO: 402750 - DNA, 25 bp, Mus musculus
gggtgccacttgagcgcaagcttgc

SEQ ID NO: 402751 - DNA, 25 bp, Mus musculus
gacgcaaacgtctctcattggcgga

SEQ ID NO: 402752 - DNA, 25 bp, Mus musculus
acactcccttgtgacgcaaacgtct

SEQ ID NO: 402753 - DNA, 25 bp, Mus musculus
tagtagtccaccatggcggctggcc

SEQ ID NO: 402754 - DNA, 25 bp, Mus musculus
cagcacctcgtagtagtccaccatg

SEQ ID NO: 402755 - DNA, 25 bp, Mus musculus
acgccttgcggatggcctcggctga

SEQ ID NO: 402756 - DNA, 25 bp, Mus musculus
caagcttgcggtacgccttgcggat

SEQ ID NO: 402757 - DNA, 25 bp, Mus musculus
tcctccttgtgctcggggttcttgt

SEQ ID NO: 402758 - DNA, 25 bp, Mus musculus
tcgcgcttgcggacgtccgataaga

SEQ ID NO: 402759 - DNA, 25 bp, Mus musculus
gacgtactggaaggcatcgtggaac

SEQ ID NO: 402760 - DNA, 25 bp, Mus musculus
tctcggaaggagaagacgtactgga

SEQ ID NO: 402761 - DNA, 25 bp, Mus musculus
gtccgataagacctcgtaggcctgc

SEQ ID NO: 402762 - DNA, 25 bp, Mus musculus
acgtcccagaagtggcagctgatgc

SEQ ID NO: 402763 - DNA, 25 bp, Mus musculus
gttctccgcaaacttggtcaccttg

SEQ ID NO: 402764 - DNA, 25 bp, Mus musculus
tggtcaccttgtgcagctccgtctt

SEQ ID NO: 402765 - DNA, 25 bp, Mus musculus
tgcagcggctgtaggacttccacag

SEQ ID NO: 402766 - DNA, 25 bp, Mus musculus
ccggcagcgacttaggcagatcctg

SEQ ID NO: 402767 - DNA, 25 bp, Mus musculus
gctcagtttgatcttctcggtgttg

SEQ ID NO: 402768 - DNA, 25 bp, Mus musculus
tgggcacagtgttcacgaattcgtt

SEQ ID NO: 402769 - DNA, 25 bp, Mus musculus
ttcgttgaacttgagccggtagagc

SEQ ID NO: 402770 - DNA, 25 bp, Mus musculus
agagcaccgtagtcttgccggccga

SEQ ID NO: 402771 - DNA, 25 bp, Mus musculus
agtccaagcccagcataacgatgtg

SEQ ID NO: 402772 - DNA, 25 bp, Mus musculus
gttgcttctcaatctcggccaccgg

SEQ ID NO: 402773 - DNA, 25 bp, Mus musculus
tccgagttagcgtagctgccttgct

SEQ ID NO: 402774 - DNA, 25 bp, Mus musculus
gtccaccgaatccaccacgtagatg

SEQ ID NO: 402775 - DNA, 25 bp, Mus musculus
gctgtccctgcagtactaggcgctg

SEQ ID NO: 402776 - DNA, 25 bp, Mus musculus
tgctgtttaccgtgaagccgccctg

SEQ ID NO: 402777 - DNA, 25 bp, Mus musculus
acctctgctgcctcgatcgctgagg

SEQ ID NO: 402778 - DNA, 25 bp, Mus musculus
cccacaggacaagagaaccgcagga

SEQ ID NO: 402779 - DNA, 25 bp, Mus musculus
ccatgcgagccaggtaggagcctag

SEQ ID NO: 402780 - DNA, 25 bp, Mus musculus
gccacccgcgcggttctgagaagga

SEQ ID NO: 402781 - DNA, 25 bp, Mus musculus
cctcctggaggatgaaattgaaaac

SEQ ID NO: 402782 - DNA, 25 bp, Mus musculus
gaaaactccagtttctgtcttggtg

SEQ ID NO: 402783 - DNA, 25 bp, Mus musculus
agcgttgttctgcaagtgctgttta

SEQ ID NO: 402784 - DNA, 25 bp, Mus musculus
ctctgtggtcacagcccgacctggg

SEQ ID NO: 402785 - DNA, 25 bp, Mus musculus
cgccgcccagtgtgtcttgttagag

SEQ ID NO: 402786 - DNA, 25 bp, Mus musculus
ctcccagctgggatctggcgttgta

SEQ ID NO: 402787 - DNA, 25 bp, Mus musculus
tctggcgttgtagtatgcaggtttg

SEQ ID NO: 402788 - DNA, 25 bp, Mus musculus
tctgtcttggtgatcgagtgaccgc

SEQ ID NO: 402789 - DNA, 25 bp, Mus musculus
gggttaaacttggtgacaatgcaca

SEQ ID NO: 402790 - DNA, 25 bp, Mus musculus
taagcgctcaactggcaaacaaaca

SEQ ID NO: 402791 - DNA, 25 bp, Mus musculus
agaggttccttaagcgctcaactgg

SEQ ID NO: 402792 - DNA, 25 bp, Mus musculus
cagtagggataaccgagagggacca

SEQ ID NO: 402793 - DNA, 25 bp, Mus musculus
cgagagggaccagggctctcagctc

SEQ ID NO: 402794 - DNA, 25 bp, Mus musculus
tcagctcgcagatccgcgggctgta

SEQ ID NO: 402795 - DNA, 25 bp, Mus musculus
ggctgtagcggcatccggacgtccc

SEQ ID NO: 402796 - DNA, 25 bp, Mus musculus
cagtgcgctgcgacgcgatcgcaca

SEQ ID NO: 402797 - DNA, 25 bp, Mus musculus
ggccggcgtgatggactacaagtcc

SEQ ID NO: 402798 - DNA, 25 bp, Mus musculus
acgtgggccagagccctgcgtgcca

SEQ ID NO: 402799 - DNA, 25 bp, Mus musculus
tggcaaggcgcctacagctcggtcc

SEQ ID NO: 402800 - DNA, 25 bp, Mus musculus
cggtagcgcggcactcacaagcgcg

SEQ ID NO: 402801 - DNA, 25 bp, Mus musculus
gcgccgtgctgcctgcgctttaatg

SEQ ID NO: 402802 - DNA, 25 bp, Mus musculus
cctgcgctttaatggctgctcggcc

SEQ ID NO: 402803 - DNA, 25 bp, Mus musculus
cccgcgcgtcgcagaggttccttaa

SEQ ID NO: 402804 - DNA, 25 bp, Mus musculus
cgtaggcgaggtgctcagcaagaac

SEQ ID NO: 402805 - DNA, 25 bp, Mus musculus
tggacaacagcgacctgcagcggct

SEQ ID NO: 402806 - DNA, 25 bp, Mus musculus
agcaagagcaagaaccgcacgctgg

SEQ ID NO: 402807 - DNA, 25 bp, Mus musculus
ggggacatgtacctgctggacagca

SEQ ID NO: 402808 - DNA, 25 bp, Mus musculus
gtcttcgcccgcagacgcgatgtcg

SEQ ID NO: 402809 - DNA, 25 bp, Mus musculus
aagaacgatgcactctcagacctgg

SEQ ID NO: 402810 - DNA, 25 bp, Mus musculus
aggaagaccgtctaccgcatctcgg

SEQ ID NO: 402811 - DNA, 25 bp, Mus musculus
accgcatctcggtgaccatggtcag

SEQ ID NO: 402812 - DNA, 25 bp, Mus musculus
tgaccatggtcaggaaggagcagct

SEQ ID NO: 402813 - DNA, 25 bp, Mus musculus
cgcccagcagtcctgacggtgagga

SEQ ID NO: 402814 - DNA, 25 bp, Mus musculus
cggagcctcagctttaggcactgga

SEQ ID NO: 402815 - DNA, 25 bp, Mus musculus
aggcgccacagcagctctggaagtc

SEQ ID NO: 402816 - DNA, 25 bp, Mus musculus
gctgcgtttcttcagtggcatcttc

SEQ ID NO: 402817 - DNA, 25 bp, Mus musculus
ggagaagcgcaacaccttggacgta

SEQ ID NO: 402818 - DNA, 25 bp, Mus musculus
cggacttaataggatcagatcagtg

SEQ ID NO: 402819 - DNA, 25 bp, Mus musculus
tggcgttcagagctccgctgggtcc

SEQ ID NO: 402820 - DNA, 25 bp, Mus musculus
gtgcaaccaggtgcgcccccggaag

SEQ ID NO: 402821 - DNA, 25 bp, Mus musculus
atcaggagttggctgggcaagaccg

SEQ ID NO: 402822 - DNA, 25 bp, Mus musculus
ccggggcggacttaataggatcaga

SEQ ID NO: 402823 - DNA, 25 bp, Mus musculus
cagatcagtgtaatcgcatttcagc

SEQ ID NO: 402824 - DNA, 25 bp, Mus musculus
cgcatttcagccattgtcattcgaa

SEQ ID NO: 402825 - DNA, 25 bp, Mus musculus
gccattgtcattcgaactgccggga

SEQ ID NO: 402826 - DNA, 25 bp, Mus musculus
gtcattcgaactgccgggagcccga

SEQ ID NO: 402827 - DNA, 25 bp, Mus musculus
ggtccggctctttaaggcgacgcac

SEQ ID NO: 402828 - DNA, 25 bp, Mus musculus
tctttaaggcgacgcacggccacta

SEQ ID NO: 402829 - DNA, 25 bp, Mus musculus
taaggcgacgcacggccactagaga

SEQ ID NO: 402830 - DNA, 25 bp, Mus musculus
cccatggcgttcagagctccgctgg

SEQ ID NO: 402831 - DNA, 25 bp, Mus musculus
gtgtaatcgcatttcagccattgtc

SEQ ID NO: 402832 - DNA, 25 bp, Mus musculus
acgtgcacacgcgtccaaacaacga

SEQ ID NO: 402833 - DNA, 25 bp, Mus musculus
ggtccaccgctgtccaggctccgtc

SEQ ID NO: 402834 - DNA, 25 bp, Mus musculus
tccacgtcttctctctcggagcctc

SEQ ID NO: 402835 - DNA, 25 bp, Mus musculus
ctccttgccgcccacgccggatgca

SEQ ID NO: 402836 - DNA, 25 bp, Mus musculus
cgccggatgcacagccggccctctc

SEQ ID NO: 402837 - DNA, 25 bp, Mus musculus
gccggctacattcctactccctgca

SEQ ID NO: 402838 - DNA, 25 bp, Mus musculus
cactcctactcctgtgagccgagag

SEQ ID NO: 402839 - DNA, 25 bp, Mus musculus
cctactcctgtgagccgagagcgca

SEQ ID NO: 402840 - DNA, 25 bp, Mus musculus
gccgagagcgcagtttcacaaccac

SEQ ID NO: 402841 - DNA, 25 bp, Mus musculus
gcagtttcacaaccacgcacaagta

SEQ ID NO: 402842 - DNA, 25 bp, Mus musculus
ccacgcacaagtatacaaagacacg

SEQ ID NO: 402843 - DNA, 25 bp, Mus musculus
gtatacaaagacacgcgcacgtacg

SEQ ID NO: 402844 - DNA, 25 bp, Mus musculus
gcacgtacgtgcacacgcgtccaaa

SEQ ID NO: 402845 - DNA, 25 bp, Mus musculus
acgcgtccaaacaacgacgcggacg

SEQ ID NO: 402846 - DNA, 25 bp, Mus musculus
cgaatagcgaacctgctaacgtgaa

SEQ ID NO: 402847 - DNA, 25 bp, Mus musculus
acctgctaacgtgaacagggatggg

SEQ ID NO: 402848 - DNA, 25 bp, Mus musculus
ggacgacaatcttggggttccgaga

SEQ ID NO: 402849 - DNA, 25 bp, Mus musculus
cgtcttggaattggcgttgcctgcc

SEQ ID NO: 402850 - DNA, 25 bp, Mus musculus
cgttgcctgccttgacacgtttcca

SEQ ID NO: 402851 - DNA, 25 bp, Mus musculus
tgacacgtttccacttggcccggcg

SEQ ID NO: 402852 - DNA, 25 bp, Mus musculus
ggaaccagatttttacttgcacctc

SEQ ID NO: 402853 - DNA, 25 bp, Mus musculus
cttgcacctcgctgagtttgagggc

SEQ ID NO: 402854 - DNA, 25 bp, Mus musculus
ctcggtcagggagaggtactttttg

SEQ ID NO: 402855 - DNA, 25 bp, Mus musculus
agaggtactttttgcagtggaattc

SEQ ID NO: 402856 - DNA, 25 bp, Mus musculus
cagtggaattctttctccagctcca

SEQ ID NO: 402857 - DNA, 25 bp, Mus musculus
ccagcagctgttcgctggtgaaggc

SEQ ID NO: 402858 - DNA, 25 bp, Mus musculus
ttcgctggtgaaggcagtccgccgc

SEQ ID NO: 402859 - DNA, 25 bp, Mus musculus
ttcttgcctgtggacgtggtgctgc

SEQ ID NO: 402860 - DNA, 25 bp, Mus musculus
tgccgtcttccgcatccgcttggag

SEQ ID NO: 402861 - DNA, 25 bp, Mus musculus
cttggccaagaaggctttgccgtct

SEQ ID NO: 402862 - DNA, 25 bp, Mus musculus
gcagcgagccctccttggccaagaa

SEQ ID NO: 402863 - DNA, 25 bp, Mus musculus
cagcgggcgctgcatcatcatcagc

SEQ ID NO: 402864 - DNA, 25 bp, Mus musculus
gtctatgctgaaggcggtactactc

SEQ ID NO: 402865 - DNA, 25 bp, Mus musculus
atcatcatcagcgacggcgggaacg

SEQ ID NO: 402866 - DNA, 25 bp, Mus musculus
tgcgctcatagacgcgttcgggaga

SEQ ID NO: 402867 - DNA, 25 bp, Mus musculus
gaagccctccggacgctgggagtac

SEQ ID NO: 402868 - DNA, 25 bp, Mus musculus
aggtctcggcccagctaccagcagt

SEQ ID NO: 402869 - DNA, 25 bp, Mus musculus
gtctgtccgtcctgcagtccgtcgt

SEQ ID NO: 402870 - DNA, 25 bp, Mus musculus
gggcgccgccagcacctttaaatcg

SEQ ID NO: 402871 - DNA, 25 bp, Mus musculus
gcgctcctctttctcattcacattt

SEQ ID NO: 402872 - DNA, 25 bp, Mus musculus
tcacattttgccagctgcccagcgg

SEQ ID NO: 402873 - DNA, 25 bp, Mus musculus
agcgcctcggctttgtcgaagttgc

SEQ ID NO: 402874 - DNA, 25 bp, Mus musculus
tcgacatcaataccggggccgcatc

SEQ ID NO: 402875 - DNA, 25 bp, Mus musculus
cgtgagtgcgtacaagctccgcttc

SEQ ID NO: 402876 - DNA, 25 bp, Mus musculus
tcatcacagtgttgcccagtgaagc

SEQ ID NO: 402877 - DNA, 25 bp, Mus musculus
cgcgttatccatcattttcgacatc

SEQ ID NO: 402878 - DNA, 25 bp, Mus musculus
ggcgtcggctgtaaacactcccttc

SEQ ID NO: 402879 - DNA, 25 bp, Mus musculus
tctgatttcatttagggccatgggg

SEQ ID NO: 402880 - DNA, 25 bp, Mus musculus
tgttcacgcaatcaagttcattagg

SEQ ID NO: 402881 - DNA, 25 bp, Mus musculus
tcgcatttcggtttagggtggctcc

SEQ ID NO: 402882 - DNA, 25 bp, Mus musculus
tggctccgccactgtgctctgagct

SEQ ID NO: 402883 - DNA, 25 bp, Mus musculus
caggcgcaagcgtcgcctccttttg

SEQ ID NO: 402884 - DNA, 25 bp, Mus musculus
gtctttctgacaccctgttcccaag

SEQ ID NO: 402885 - DNA, 25 bp, Mus musculus
cgcagatcgagaccaccggagggtc

SEQ ID NO: 402886 - DNA, 25 bp, Mus musculus
tttgggagagcacctcagccactct

SEQ ID NO: 402887 - DNA, 25 bp, Mus musculus
gcgaagctcgctgtcatcctctgca

SEQ ID NO: 402888 - DNA, 25 bp, Mus musculus
ggggcttcacttcccatcccacagc

SEQ ID NO: 402889 - DNA, 25 bp, Mus musculus
gctgctgcagcatgcacggctgctg

SEQ ID NO: 402890 - DNA, 25 bp, Mus musculus
gcctcgcatcgggatcagacccgat

SEQ ID NO: 402891 - DNA, 25 bp, Mus musculus
agacccgatgctccgggaacccaga

SEQ ID NO: 402892 - DNA, 25 bp, Mus musculus
gtcgagcaggggtccctgttagtca

SEQ ID NO: 402893 - DNA, 25 bp, Mus musculus
agcaggggtccctgttagtcatccg

SEQ ID NO: 402894 - DNA, 25 bp, Mus musculus
cctgttagtcatccggacccgctga

SEQ ID NO: 402895 - DNA, 25 bp, Mus musculus
gctccgagttctcggctgctcaccg

SEQ ID NO: 402896 - DNA, 25 bp, Mus musculus
tggttcataccttcgcgtgctgctg

SEQ ID NO: 402897 - DNA, 25 bp, Mus musculus
tcccacagccagtacgcagccgccg

SEQ ID NO: 402898 - DNA, 25 bp, Mus musculus
ctcccgctggctgctccgcacagcc

SEQ ID NO: 402899 - DNA, 25 bp, Mus musculus
gcttcctgggaatggttcatacctt

SEQ ID NO: 402900 - DNA, 25 bp, Mus musculus
accaggaagaaaccgcgcgctcgcg

SEQ ID NO: 402901 - DNA, 25 bp, Mus musculus
cgagcatgcgcaccaggaagaaacc

SEQ ID NO: 402902 - DNA, 25 bp, Mus musculus
tccagctggactgtcgcgccgtgct

SEQ ID NO: 402903 - DNA, 25 bp, Mus musculus
ccgtgatttagtagcacctggaccg

SEQ ID NO: 402904 - DNA, 25 bp, Mus musculus
tttagtagcacctggaccgtgcgct

SEQ ID NO: 402905 - DNA, 25 bp, Mus musculus
ggccaaatcgatcaccagggcactg

SEQ ID NO: 402906 - DNA, 25 bp, Mus musculus
gatcaccagggcactggaccagccg

SEQ ID NO: 402907 - DNA, 25 bp, Mus musculus
agggcactggaccagccgcgacctg

SEQ ID NO: 402908 - DNA, 25 bp, Mus musculus
gagcgggatccgtgatttagtagca

SEQ ID NO: 402909 - DNA, 25 bp, Mus musculus
ccgcatgctgcgctaagggccgttt

SEQ ID NO: 402910 - DNA, 25 bp, Mus musculus
actcgcgcgccgaagcccaggtaga

SEQ ID NO: 402911 - DNA, 25 bp, Mus musculus
ccgaagcccaggtagagttgcgcgt

SEQ ID NO: 402912 - DNA, 25 bp, Mus musculus
agagttgcgcgtgctcgtccaggcc

SEQ ID NO: 402913 - DNA, 25 bp, Mus musculus
ccgccacgtgcagcggtgtgtctcg

SEQ ID NO: 402914 - DNA, 25 bp, Mus musculus
gcacctgcggggaggccaaatcgat

SEQ ID NO: 402915 - DNA, 25 bp, Mus musculus
gggacgcgccaccatagtcgagcgc

SEQ ID NO: 402916 - DNA, 25 bp, Mus musculus
atcaagcgctaattaacccgcccgg

SEQ ID NO: 402917 - DNA, 25 bp, Mus musculus
ggaagctcccgcccggagaagctaa

SEQ ID NO: 402918 - DNA, 25 bp, Mus musculus
ttcttcagcgccacgtctgcgggcc

SEQ ID NO: 402919 - DNA, 25 bp, Mus musculus
gagaagctaaccatttatgtcacac

SEQ ID NO: 402920 - DNA, 25 bp, Mus musculus
gctaaccatttatgtcacactgtga

SEQ ID NO: 402921 - DNA, 25 bp, Mus musculus
ccgccagtggccttttagcattctt

SEQ ID NO: 402922 - DNA, 25 bp, Mus musculus
cccgccagtggccttttagcattct

SEQ ID NO: 402923 - DNA, 25 bp, Mus musculus
gtcacactgtgacaattattctgca

SEQ ID NO: 402924 - DNA, 25 bp, Mus musculus
gtgacaattattctgcataaaatta

SEQ ID NO: 402925 - DNA, 25 bp, Mus musculus
gggccgtgatcagaggctcattacc

SEQ ID NO: 402926 - DNA, 25 bp, Mus musculus
gctcgcaatcaagcgctaattaacc

SEQ ID NO: 402927 - DNA, 25 bp, Mus musculus
gcgcgctcgcaatcaagcgctaatt

SEQ ID NO: 402928 - DNA, 25 bp, Mus musculus
cagaggctcattaccgcggcgtggc

SEQ ID NO: 402929 - DNA, 25 bp, Mus musculus
gatcagaggctcattaccgcggcgt

SEQ ID NO: 402930 - DNA, 25 bp, Mus musculus
acaggcctcatgtagggcaccacga

SEQ ID NO: 402931 - DNA, 25 bp, Mus musculus
atgcacagcggtgtggtgagctccc

SEQ ID NO: 402932 - DNA, 25 bp, Mus musculus
agatctggatctgctccgtgctgca

SEQ ID NO: 402933 - DNA, 25 bp, Mus musculus
ggatctgctccgtgctgcagcagca

SEQ ID NO: 402934 - DNA, 25 bp, Mus musculus
cgcaggcggtatggttcccgagaca

SEQ ID NO: 402935 - DNA, 25 bp, Mus musculus
tatggttcccgagacaggcctcatg

SEQ ID NO: 402936 - DNA, 25 bp, Mus musculus
gttcccgagacaggcctcatgtagg

SEQ ID NO: 402937 - DNA, 25 bp, Mus musculus
tcatgtagggcaccacgacctccgg

SEQ ID NO: 402938 - DNA, 25 bp, Mus musculus
cgggactggcattgggatcagcttt

SEQ ID NO: 402939 - DNA, 25 bp, Mus musculus
gcattgggatcagctttgcgactga

SEQ ID NO: 402940 - DNA, 25 bp, Mus musculus
gctttgcgactgagcaggtgtcgca

SEQ ID NO: 402941 - DNA, 25 bp, Mus musculus
actgagcaggtgtcgcacgcaggac

SEQ ID NO: 402942 - DNA, 25 bp, Mus musculus
agggcaccacgacctccgggactgg

SEQ ID NO: 402943 - DNA, 25 bp, Mus musculus
tgtcgcacgcaggactcgtggccgt

SEQ ID NO: 402944 - DNA, 25 bp, Mus musculus
ttctcccacggcaactttggttgtg

SEQ ID NO: 402945 - DNA, 25 bp, Mus musculus
cgctctcgaaacacgtggaggtcca

SEQ ID NO: 402946 - DNA, 25 bp, Mus musculus
cggataatccgagccgcagccgaac

SEQ ID NO: 402947 - DNA, 25 bp, Mus musculus
agccgaacccttccggatcgcaggg

SEQ ID NO: 402948 - DNA, 25 bp, Mus musculus
ggatcgcagggctctgactcagaaa

SEQ ID NO: 402949 - DNA, 25 bp, Mus musculus
cagaaagccggttcgtcctagcctg

SEQ ID NO: 402950 - DNA, 25 bp, Mus musculus
ggtcctccagagcaccgagacgttg

SEQ ID NO: 402951 - DNA, 25 bp, Mus musculus
cttgtattccgctacggcgtcgctc

SEQ ID NO: 402952 - DNA, 25 bp, Mus musculus
gtgacgacacgctcgcccatgcgta

SEQ ID NO: 402953 - DNA, 25 bp, Mus musculus
cccatgcgtactgagaggcagctcc

SEQ ID NO: 402954 - DNA, 25 bp, Mus musculus
ggcagctcctttacctcatcgcggg

SEQ ID NO: 402955 - DNA, 25 bp, Mus musculus
ccagcttgtgctttggtctggcaga

SEQ ID NO: 402956 - DNA, 25 bp, Mus musculus
ggcggacaacgccttcagtttcaga

SEQ ID NO: 402957 - DNA, 25 bp, Mus musculus
tggatcagtgcgagaaccaggaact

SEQ ID NO: 402958 - DNA, 25 bp, Mus musculus
gaggacgacgcgctgaaccagatcg

SEQ ID NO: 402959 - DNA, 25 bp, Mus musculus
tcggtcttgctacccggggctcaag

SEQ ID NO: 402960 - DNA, 25 bp, Mus musculus
cccggggctgactcggtcttgctac

SEQ ID NO: 402961 - DNA, 25 bp, Mus musculus
cctggtccttgtgggccgctagtcc

SEQ ID NO: 402962 - DNA, 25 bp, Mus musculus
gtggcgctactaccctcagctccag

SEQ ID NO: 402963 - DNA, 25 bp, Mus musculus
cctgcggactactcggcacccgcca

SEQ ID NO: 402964 - DNA, 25 bp, Mus musculus
ggctttcatccacggcctgcggact

SEQ ID NO: 402965 - DNA, 25 bp, Mus musculus
cctcagcttccctgccaccagccgc

SEQ ID NO: 402966 - DNA, 25 bp, Mus musculus
gctgaaccagatcgcgcgcgaggta

SEQ ID NO: 402967 - DNA, 25 bp, Mus musculus
tccaagaccggtcccgcagcagctg

SEQ ID NO: 402968 - DNA, 25 bp, Mus musculus
gacgagcgcggctccaagaccggtc

SEQ ID NO: 402969 - DNA, 25 bp, Mus musculus
atgcgtccctgcgtcccacctcgcg

SEQ ID NO: 402970 - DNA, 25 bp, Mus musculus
cgccaccgcctgagtttctccatca

SEQ ID NO: 402971 - DNA, 25 bp, Mus musculus
aggtaagcgagacgcggccacagct

SEQ ID NO: 402972 - DNA, 25 bp, Mus musculus
ctcatggtaggagtgctttggctga

SEQ ID NO: 402973 - DNA, 25 bp, Mus musculus
aagccacgcgtgtcctaaccgaagg

SEQ ID NO: 402974 - DNA, 25 bp, Mus musculus
ggttccagctaaagccacgcgtgtc

SEQ ID NO: 402975 - DNA, 25 bp, Mus musculus
gctcatgcggtgtggttccagctaa

SEQ ID NO: 402976 - DNA, 25 bp, Mus musculus
ctgcgctctggcagaggctcatgcg

SEQ ID NO: 402977 - DNA, 25 bp, Mus musculus
tgccggctcggaagacagtagtgac

SEQ ID NO: 402978 - DNA, 25 bp, Mus musculus
tcatgggcggtagctttgtggtccc

SEQ ID NO: 402979 - DNA, 25 bp, Mus musculus
ttctcgctcctgtccagcgtggtca

SEQ ID NO: 402980 - DNA, 25 bp, Mus musculus
cccgagtggacctcatggtaggagt

SEQ ID NO: 402981 - DNA, 25 bp, Mus musculus
gcggctgtcacctccgcttgattct

SEQ ID NO: 402982 - DNA, 25 bp, Mus musculus
gacgctccctatcggatcgcggctg

SEQ ID NO: 402983 - DNA, 25 bp, Mus musculus
gtggatactagttcctcgacgctcc

SEQ ID NO: 402984 - DNA, 25 bp, Mus musculus
gggtcactgtccagcgtggatacta

SEQ ID NO: 402985 - DNA, 25 bp, Mus musculus
tcagtctttccggtgtctgccgcag

SEQ ID NO: 402986 - DNA, 25 bp, Mus musculus
gccacatggctgctcttggtcgtcg

SEQ ID NO: 402987 - DNA, 25 bp, Mus musculus
gggctcttcctgtcgtcactgccag

SEQ ID NO: 402988 - DNA, 25 bp, Mus musculus
tgtcgtcactgccaggattggcgtt

SEQ ID NO: 402989 - DNA, 25 bp, Mus musculus
gttactcggagcagctcgggacgct

SEQ ID NO: 402990 - DNA, 25 bp, Mus musculus
tgcggcccgttactcggagcagctc

SEQ ID NO: 402991 - DNA, 25 bp, Mus musculus
agtggtttcttatcccgagggtgcg

SEQ ID NO: 402992 - DNA, 25 bp, Mus musculus
aaagggcgggctcttcctgtcgtca

SEQ ID NO: 402993 - DNA, 25 bp, Mus musculus
cgtggtctgcggctcaggtaccacc

SEQ ID NO: 402994 - DNA, 25 bp, Mus musculus
agacgctccagggacggtccgcact

SEQ ID NO: 402995 - DNA, 25 bp, Mus musculus
tccatggcgggaggaatcaaagtgt

SEQ ID NO: 402996 - DNA, 25 bp, Mus musculus
ctgcccgttcggagacagttgctga

SEQ ID NO: 402997 - DNA, 25 bp, Mus musculus
actgccaggattggcgttgctagga

SEQ ID NO: 402998 - DNA, 25 bp, Mus musculus
tcgggacgctgagtgagacgctcca

SEQ ID NO: 402999 - DNA, 25 bp, Mus musculus
tgcggctcaggtaccacccgggcag

SEQ ID NO: 403000 - DNA, 25 bp, Mus musculus
ccacttccggtctcgccgccgggag

SEQ ID NO: 403001 - DNA, 25 bp, Mus musculus
attggacccactcctcggcgctgcc

SEQ ID NO: 403002 - DNA, 25 bp, Mus musculus
gctgtgaaggccagcgcgactcagt

SEQ ID NO: 403003 - DNA, 25 bp, Mus musculus
catggttttgggtgccggctcgcct

SEQ ID NO: 403004 - DNA, 25 bp, Mus musculus
cctgactcgcggtgctcaggtaagc

SEQ ID NO: 403005 - DNA, 25 bp, Mus musculus
ctcgcggtgctcaggtaagctggtc

SEQ ID NO: 403006 - DNA, 25 bp, Mus musculus
gactgaggccgaggctcctgtcgcc

SEQ ID NO: 403007 - DNA, 25 bp, Mus musculus
cccgcaaggtcacggtgcggagctc

SEQ ID NO: 403008 - DNA, 25 bp, Mus musculus
cctgacccggttccgcggcgtgtca

SEQ ID NO: 403009 - DNA, 25 bp, Mus musculus
tcggccggctcagtttcctccgtct

SEQ ID NO: 403010 - DNA, 25 bp, Mus musculus
cctccgtctccggtgggcattggac

SEQ ID NO: 403011 - DNA, 25 bp, Mus musculus
tctccggtgggcattggacccactc

SEQ ID NO: 403012 - DNA, 25 bp, Mus musculus
aggccagcgcgactcagtgccgctg

SEQ ID NO: 403013 - DNA, 25 bp, Mus musculus
gtgggcattggacccactcctcggc

SEQ ID NO: 403014 - DNA, 25 bp, Mus musculus
gaatcgccgctgcttagagtctagg

SEQ ID NO: 403015 - DNA, 25 bp, Mus musculus
ctggcagccgaatcgcgattatctg

SEQ ID NO: 403016 - DNA, 25 bp, Mus musculus
agcacccagatgactcgccatgagc

SEQ ID NO: 403017 - DNA, 25 bp, Mus musculus
ggtatcctatgtccagcgagcacta

SEQ ID NO: 403018 - DNA, 25 bp, Mus musculus
tgcaccgcgcatcctaacactttta

SEQ ID NO: 403019 - DNA, 25 bp, Mus musculus
ttccatgaactttgcggcgaccggt

SEQ ID NO: 403020 - DNA, 25 bp, Mus musculus
gtcactagtgacagcccagggaggt

SEQ ID NO: 403021 - DNA, 25 bp, Mus musculus
cgcgctttgccgatgaccggttaga

SEQ ID NO: 403022 - DNA, 25 bp, Mus musculus
gcggtggccctactaaggtagtctc

SEQ ID NO: 403023 - DNA, 25 bp, Mus musculus
ccgtgcggctcacagattggccaaa

SEQ ID NO: 403024 - DNA, 25 bp, Mus musculus
ccattcagagacttcggggcgctca

SEQ ID NO: 403025 - DNA, 25 bp, Mus musculus
caactgtgccgagtgtggccacatc

SEQ ID NO: 403026 - DNA, 25 bp, Mus musculus
gagaacaggctaccgcccaagctga

SEQ ID NO: 403027 - DNA, 25 bp, Mus musculus
cgaccggtgaagtcactggtccttc

SEQ ID NO: 403028 - DNA, 25 bp, Mus musculus
tgtctccggagcagttcttgccgca

SEQ ID NO: 403029 - DNA, 25 bp, Mus musculus
tgggcacctggaaagccatcatggc

SEQ ID NO: 403030 - DNA, 25 bp, Mus musculus
ttggaagaagtcagcctacacgccc

SEQ ID NO: 403031 - DNA, 25 bp, Mus musculus
gtcatgctcttcctcggccattgga

SEQ ID NO: 403032 - DNA, 25 bp, Mus musculus
cgcaaggagcgcatcgtcatgctct

SEQ ID NO: 403033 - DNA, 25 bp, Mus musculus
ccttgaactcgggtccctgtgagct

SEQ ID NO: 403034 - DNA, 25 bp, Mus musculus
tccaagagtgcggagtgtcagttcg

SEQ ID NO: 403035 - DNA, 25 bp, Mus musculus
ccgcaggacctaggcaaggagacca

SEQ ID NO: 403036 - DNA, 25 bp, Mus musculus
gcccttctggtgcagccacatcggt

SEQ ID NO: 403037 - DNA, 25 bp, Mus musculus
aggttttcgagcatctgggcgcaca

SEQ ID NO: 403038 - DNA, 25 bp, Mus musculus
ccacctgctgtgcttcgaggttttc

SEQ ID NO: 403039 - DNA, 25 bp, Mus musculus
ttccagctcctggagtgcgacctgc

SEQ ID NO: 403040 - DNA, 25 bp, Mus musculus
cgctggacctcttcatgcttggcta

SEQ ID NO: 403041 - DNA, 25 bp, Mus musculus
ccttccataaggcagtgaccgacga

SEQ ID NO: 403042 - DNA, 25 bp, Mus musculus
acagcccgccggtaagacgcagccg

SEQ ID NO: 403043 - DNA, 25 bp, Mus musculus
acctgaccagccgtgctctttactg

SEQ ID NO: 403044 - DNA, 25 bp, Mus musculus
tgcgcagtgtccaacactggggata

SEQ ID NO: 403045 - DNA, 25 bp, Mus musculus
agtgtccaacactggggatacgtcg

SEQ ID NO: 403046 - DNA, 25 bp, Mus musculus
agcgcgttataaggcgccgacctga

SEQ ID NO: 403047 - DNA, 25 bp, Mus musculus
ttataaggcgccgacctgaccagcc

SEQ ID NO: 403048 - DNA, 25 bp, Mus musculus
tgaccagccgtgctctttactgccg

SEQ ID NO: 403049 - DNA, 25 bp, Mus musculus
tgcgccagcctactcgccgccatgg

SEQ ID NO: 403050 - DNA, 25 bp, Mus musculus
catgggcctcggtgtccctgagtcc

SEQ ID NO: 403051 - DNA, 25 bp, Mus musculus
gtggggactcatgcacgcccgcagc

SEQ ID NO: 403052 - DNA, 25 bp, Mus musculus
ccttgctgcgcagtgtccaacactg

SEQ ID NO: 403053 - DNA, 25 bp, Mus musculus
cctgtgcctgcagagcgtgccctag

SEQ ID NO: 403054 - DNA, 25 bp, Mus musculus
ggattcaagcgcgttataaggcgcc

SEQ ID NO: 403055 - DNA, 25 bp, Mus musculus
gagcccgtggggactcatgcacgcc

SEQ ID NO: 403056 - DNA, 25 bp, Mus musculus
ctcccgtgagagctgagaacgtctg

SEQ ID NO: 403057 - DNA, 25 bp, Mus musculus
cccacggtggcccagaacattcagg

SEQ ID NO: 403058 - DNA, 25 bp, Mus musculus
ggggtctcacgtaactgtccgaatc

SEQ ID NO: 403059 - DNA, 25 bp, Mus musculus
tctgcctctgagaacaccgagcgtc

SEQ ID NO: 403060 - DNA, 25 bp, Mus musculus
ctggacggtctaaaatacgtgcctc

SEQ ID NO: 403061 - DNA, 25 bp, Mus musculus
agcgtgggctgtcatcacggagaca

SEQ ID NO: 403062 - DNA, 25 bp, Mus musculus
atgcggtcgattggcacctttcacc

SEQ ID NO: 403063 - DNA, 25 bp, Mus musculus
tttcgcgctctttccagtccctggt

SEQ ID NO: 403064 - DNA, 25 bp, Mus musculus
ggccagaccctgcaatcttcgcttt

SEQ ID NO: 403065 - DNA, 25 bp, Mus musculus
gggctcattccgcacaccgttggga

SEQ ID NO: 403066 - DNA, 25 bp, Mus musculus
ctgtccgaatctctgtctaatcgtg

SEQ ID NO: 403067 - DNA, 25 bp, Mus musculus
cctagctgagtttttccgcggcgaa

SEQ ID NO: 403068 - DNA, 25 bp, Mus musculus
ccgcggcgaagcaggaagtaaactg

SEQ ID NO: 403069 - DNA, 25 bp, Mus musculus
cgggcaccaaaaggcgcagtctctt

SEQ ID NO: 403070 - DNA, 25 bp, Mus musculus
ttggcggccactatcttacgacttg

SEQ ID NO: 403071 - DNA, 25 bp, Mus musculus
agagcggcagccatctctctatcta

SEQ ID NO: 403072 - DNA, 25 bp, Mus musculus
ccctgccacgtgactgcgtgagctg

SEQ ID NO: 403073 - DNA, 25 bp, Mus musculus
gtggcgtttacctgctgccggtccc

SEQ ID NO: 403074 - DNA, 25 bp, Mus musculus
accaggtacgtgttggtgccttgca

SEQ ID NO: 403075 - DNA, 25 bp, Mus musculus
tgggacccgggttgcagcccaacac

SEQ ID NO: 403076 - DNA, 25 bp, Mus musculus
cacccgactggacagctgctcgatg

SEQ ID NO: 403077 - DNA, 25 bp, Mus musculus
acagctgctcgatgcgctgcagagc

SEQ ID NO: 403078 - DNA, 25 bp, Mus musculus
gccatctctctatctacctcggtga

SEQ ID NO: 403079 - DNA, 25 bp, Mus musculus
ggcacccgaattccaagtcactcag

SEQ ID NO: 403080 - DNA, 25 bp, Mus musculus
cccggagcggattggcggccactat

SEQ ID NO: 403081 - DNA, 25 bp, Mus musculus
atcttacgacttgctggcacgcccg

SEQ ID NO: 403082 - DNA, 25 bp, Mus musculus
tggcacgcccgtcagccaagtgacg

SEQ ID NO: 403083 - DNA, 25 bp, Mus musculus
agtcactcagcgtgctgcgacctca

SEQ ID NO: 403084 - DNA, 25 bp, Mus musculus
tgtagccaaattaaagccagagtgc

SEQ ID NO: 403085 - DNA, 25 bp, Mus musculus
cggtttttaacctatgcctctgcga

SEQ ID NO: 403086 - DNA, 25 bp, Mus musculus
tgcctctgcgatcagaactgaactc

SEQ ID NO: 403087 - DNA, 25 bp, Mus musculus
ggcaaaggctgggtcctcttcacct

SEQ ID NO: 403088 - DNA, 25 bp, Mus musculus
ttcctattccgtgccaaagaccttc

SEQ ID NO: 403089 - DNA, 25 bp, Mus musculus
accttcccaaaacgtgggctgcaga

SEQ ID NO: 403090 - DNA, 25 bp, Mus musculus
cccaggtctttctcactagtcttcg

SEQ ID NO: 403091 - DNA, 25 bp, Mus musculus
ttatctagccgtagcgccctgcatt

SEQ ID NO: 403092 - DNA, 25 bp, Mus musculus
cctgggcattaggtcccgtgataaa

SEQ ID NO: 403093 - DNA, 25 bp, Mus musculus
ggcgccgagcctgacatccagacag

SEQ ID NO: 403094 - DNA, 25 bp, Mus musculus
tccactgttccctgtgtgaccgagc

SEQ ID NO: 403095 - DNA, 25 bp, Mus musculus
aaagcaccttctgaccgcccgggag

SEQ ID NO: 403096 - DNA, 25 bp, Mus musculus
tctcggggtttccaggacgcaaaca

SEQ ID NO: 403097 - DNA, 25 bp, Mus musculus
cgctgggagtcttgctgtagccaaa

SEQ ID NO: 403098 - DNA, 25 bp, Mus musculus
tcccgcaccgtgagcagtgactatc

SEQ ID NO: 403099 - DNA, 25 bp, Mus musculus
cacgaacgtgtgcacctcatgcatg

SEQ ID NO: 403100 - DNA, 25 bp, Mus musculus
aagcgctcgcttgcttcagcctgca

SEQ ID NO: 403101 - DNA, 25 bp, Mus musculus
agtgactatcgtggctcggacgatc

SEQ ID NO: 403102 - DNA, 25 bp, Mus musculus
ctcacccaggagacacagtagcgtg

SEQ ID NO: 403103 - DNA, 25 bp, Mus musculus
ggaagcccttgccatggataggacc

SEQ ID NO: 403104 - DNA, 25 bp, Mus musculus
cgttctctagcttggcctgcacctg

SEQ ID NO: 403105 - DNA, 25 bp, Mus musculus
ccgcagctcctgaagactctcgttg

SEQ ID NO: 403106 - DNA, 25 bp, Mus musculus
agactctcgttgatccgtgcgcgtc

SEQ ID NO: 403107 - DNA, 25 bp, Mus musculus
ggcgccctagtgcaaactactcagc

SEQ ID NO: 403108 - DNA, 25 bp, Mus musculus
catgtcaatgcaccgattggctgtg

SEQ ID NO: 403109 - DNA, 25 bp, Mus musculus
ccgtgaggcagcctgtagccaatga

SEQ ID NO: 403110 - DNA, 25 bp, Mus musculus
cggtcagctccagaacctcggcgtt

SEQ ID NO: 403111 - DNA, 25 bp, Mus musculus
ctcatgcatgcactggatgtagcca

SEQ ID NO: 403112 - DNA, 25 bp, Mus musculus
aggcacgcctgtgtcggccagacgc

SEQ ID NO: 403113 - DNA, 25 bp, Mus musculus
aacaggcacgcctgtgtcggccaga

SEQ ID NO: 403114 - DNA, 25 bp, Mus musculus
gagaaaagcggcaggccggccagga

SEQ ID NO: 403115 - DNA, 25 bp, Mus musculus
tgcaggctgcaacaggcacgcctgt

SEQ ID NO: 403116 - DNA, 25 bp, Mus musculus
ctgtgtcggccagacgcccaagccc

SEQ ID NO: 403117 - DNA, 25 bp, Mus musculus
gtcctgcaggctgcaacaggcacgc

SEQ ID NO: 403118 - DNA, 25 bp, Mus musculus
tagctggctttgtcctgcaggctgc

SEQ ID NO: 403119 - DNA, 25 bp, Mus musculus
tctagctggctttgtcctgcaggct

SEQ ID NO: 403120 - DNA, 25 bp, Mus musculus
tgtctagctggctttgtcctgcagg

SEQ ID NO: 403121 - DNA, 25 bp, Mus musculus
cctttgtctagctggctttgtcctg

SEQ ID NO: 403122 - DNA, 25 bp, Mus musculus
gcgcctttgtctagctggctttgtc

SEQ ID NO: 403123 - DNA, 25 bp, Mus musculus
gccgcgcctttgtctagctggcttt

SEQ ID NO: 403124 - DNA, 25 bp, Mus musculus
agcgacaggtgttggccgcgccttt

SEQ ID NO: 403125 - DNA, 25 bp, Mus musculus
tcggcggtccatctgccggccctgc

SEQ ID NO: 403126 - DNA, 25 bp, Mus musculus
tgcgcaactcacagccggcagagac

SEQ ID NO: 403127 - DNA, 25 bp, Mus musculus
gtcggagtgccacctcatttgcata

SEQ ID NO: 403128 - DNA, 25 bp, Mus musculus
gttccatctacattctgccgagttg

SEQ ID NO: 403129 - DNA, 25 bp, Mus musculus
ctgccgagttgcagccgtttgcaca

SEQ ID NO: 403130 - DNA, 25 bp, Mus musculus
acagtcggcaactcctggctcagga

SEQ ID NO: 403131 - DNA, 25 bp, Mus musculus
gacgacgtgaccagcctcggtaatc

SEQ ID NO: 403132 - DNA, 25 bp, Mus musculus
gccctccgctgtcacatagtggaaa

SEQ ID NO: 403133 - DNA, 25 bp, Mus musculus
gcggaacctgagagctacgctcatc

SEQ ID NO: 403134 - DNA, 25 bp, Mus musculus
tcatcaattggtggagacgcccgtc

SEQ ID NO: 403135 - DNA, 25 bp, Mus musculus
gacgcccgtcgctctctttacataa

SEQ ID NO: 403136 - DNA, 25 bp, Mus musculus
atggaactccatgttcgccgcccgg

SEQ ID NO: 403137 - DNA, 25 bp, Mus musculus
gcgggacttccattcacctggcacg

SEQ ID NO: 403138 - DNA, 25 bp, Mus musculus
cggcctatcacctgcgacgacgtga

SEQ ID NO: 403139 - DNA, 25 bp, Mus musculus
ccgcccgggttcctcaatgaagatg

SEQ ID NO: 403140 - DNA, 25 bp, Mus musculus
ttggggcgtactccttgcaagttgt

SEQ ID NO: 403141 - DNA, 25 bp, Mus musculus
aagcgcgatcgggtccagccggact

SEQ ID NO: 403142 - DNA, 25 bp, Mus musculus
cggactcccgctcggcctttctgtc

SEQ ID NO: 403143 - DNA, 25 bp, Mus musculus
agcccgcgctgtctgtggcgaccga

SEQ ID NO: 403144 - DNA, 25 bp, Mus musculus
tgtggcgaccgaggtgcgccttccc

SEQ ID NO: 403145 - DNA, 25 bp, Mus musculus
cggtgctgtccctgccctggcggat

SEQ ID NO: 403146 - DNA, 25 bp, Mus musculus
gcagacctttggttggggcgtactc

SEQ ID NO: 403147 - DNA, 25 bp, Mus musculus
gggcgtactccttgcaagttgtata

SEQ ID NO: 403148 - DNA, 25 bp, Mus musculus
ccttgcaagttgtatatccatgggg

SEQ ID NO: 403149 - DNA, 25 bp, Mus musculus
aagttgtatatccatggggtgcccg

SEQ ID NO: 403150 - DNA, 25 bp, Mus musculus
tatatccatggggtgcccggagcct

SEQ ID NO: 403151 - DNA, 25 bp, Mus musculus
ccggagcctcccaccgtggatgagt

SEQ ID NO: 403152 - DNA, 25 bp, Mus musculus
tcccaccgtggatgagtgaccgcca

SEQ ID NO: 403153 - DNA, 25 bp, Mus musculus
gagaccgcggcacgggcagaccttt

SEQ ID NO: 403154 - DNA, 25 bp, Mus musculus
cagcgccatgaacgccgcagtggtg

SEQ ID NO: 403155 - DNA, 25 bp, Mus musculus
cggagcgcgtgtgtcctccagagca

SEQ ID NO: 403156 - DNA, 25 bp, Mus musculus
tcaccgagaagctgctcaacaagcc

SEQ ID NO: 403157 - DNA, 25 bp, Mus musculus
atcatcaccgaggtaggcgcgggct

SEQ ID NO: 403158 - DNA, 25 bp, Mus musculus
tgcacgacatcatcaccgaggtagg

SEQ ID NO: 403159 - DNA, 25 bp, Mus musculus
tacctgcacgacatcatcaccgagg

SEQ ID NO: 403160 - DNA, 25 bp, Mus musculus
acaagccaccgttccgctacctgca

SEQ ID NO: 403161 - DNA, 25 bp, Mus musculus
gaagctgctcaacaagccaccgttc

SEQ ID NO: 403162 - DNA, 25 bp, Mus musculus
ggaggccgccgctcaccgagaagct

SEQ ID NO: 403163 - DNA, 25 bp, Mus musculus
cggcagcgccatgaacgccgcagtg

SEQ ID NO: 403164 - DNA, 25 bp, Mus musculus
ctccagagcagctagagaggccgga

SEQ ID NO: 403165 - DNA, 25 bp, Mus musculus
tcaggttcaagcagccacagaggcg

SEQ ID NO: 403166 - DNA, 25 bp, Mus musculus
gcaggctcaggttcaagcagccaca

SEQ ID NO: 403167 - DNA, 25 bp, Mus musculus
cgcgcgtccgttgccaaggccgcgc

SEQ ID NO: 403168 - DNA, 25 bp, Mus musculus
gaatcgaccaaccaggagttcctga

SEQ ID NO: 403169 - DNA, 25 bp, Mus musculus
tcgtagaaaggacagcagcgcagcc

SEQ ID NO: 403170 - DNA, 25 bp, Mus musculus
aaggcaccgtttggagtctcgtaga

SEQ ID NO: 403171 - DNA, 25 bp, Mus musculus
tcagccgctgcgatagcggaccaca

SEQ ID NO: 403172 - DNA, 25 bp, Mus musculus
tgggcgggaacagaatcgaccaacc

SEQ ID NO: 403173 - DNA, 25 bp, Mus musculus
tcgcaggccagatccgaggaatcgc

SEQ ID NO: 403174 - DNA, 25 bp, Mus musculus
gagttcctgaggcatgcaaataagc

SEQ ID NO: 403175 - DNA, 25 bp, Mus musculus
cctcgggagacgcagtttggtcaac

SEQ ID NO: 403176 - DNA, 25 bp, Mus musculus
tcagcaatcaagtccgttagccagg

SEQ ID NO: 403177 - DNA, 25 bp, Mus musculus
ctccgtccggagcaggaagtacgaa

SEQ ID NO: 403178 - DNA, 25 bp, Mus musculus
cggtgcttctctgacagcgttgctc

SEQ ID NO: 403179 - DNA, 25 bp, Mus musculus
cagcgttgctctctgacaggattgc

SEQ ID NO: 403180 - DNA, 25 bp, Mus musculus
tcagtaagtgtggacgttaggctcc

SEQ ID NO: 403181 - DNA, 25 bp, Mus musculus
ccacagtccactgggccgtaacggt

SEQ ID NO: 403182 - DNA, 25 bp, Mus musculus
gggccagtgtatctctcctcgtgaa

SEQ ID NO: 403183 - DNA, 25 bp, Mus musculus
ctcgctcctgacagctatttagcaa

SEQ ID NO: 403184 - DNA, 25 bp, Mus musculus
ggccgccaggtacatagacttcctc

SEQ ID NO: 403185 - DNA, 25 bp, Mus musculus
acgtggctcacgagcgtctcagcta

SEQ ID NO: 403186 - DNA, 25 bp, Mus musculus
tctaccaggttctccagagcgacga

SEQ ID NO: 403187 - DNA, 25 bp, Mus musculus
tgaccagctgcagctacgtggctca

SEQ ID NO: 403188 - DNA, 25 bp, Mus musculus
tacctcaggcaaccgcacagggatg

SEQ ID NO: 403189 - DNA, 25 bp, Mus musculus
agacgctcaagctggccgccaggta

SEQ ID NO: 403190 - DNA, 25 bp, Mus musculus
atcgagcgaagatggcagcccgacc

SEQ ID NO: 403191 - DNA, 25 bp, Mus musculus
ggaagcggcgctacagcaagaaatc

SEQ ID NO: 403192 - DNA, 25 bp, Mus musculus
gccggcctcgaaatcagagcctttg

SEQ ID NO: 403193 - DNA, 25 bp, Mus musculus
ctcccggagacctcggttttgcaca

SEQ ID NO: 403194 - DNA, 25 bp, Mus musculus
caacccagccgggatagagtttcca

SEQ ID NO: 403195 - DNA, 25 bp, Mus musculus
tctcctcgtgaaggtacctcaggca

SEQ ID NO: 403196 - DNA, 25 bp, Mus musculus
agagcacagactaaggcgagggccc

SEQ ID NO: 403197 - DNA, 25 bp, Mus musculus
agcgcctgtctcatgctctaagggg

SEQ ID NO: 403198 - DNA, 25 bp, Mus musculus
gcccgggtcaatacagtgtgcctga

SEQ ID NO: 403199 - DNA, 25 bp, Mus musculus
tgattgaagccgtggacagacctcc

SEQ ID NO: 403200 - DNA, 25 bp, Mus musculus
agctggtgcgcgaactgattgaagc

SEQ ID NO: 403201 - DNA, 25 bp, Mus musculus
tgacccacgttgaaccatgatgctg

SEQ ID NO: 403202 - DNA, 25 bp, Mus musculus
tcaattctaatgagcggggcgtacc

SEQ ID NO: 403203 - DNA, 25 bp, Mus musculus
ccattggctacaacggctttgcgtc

SEQ ID NO: 403204 - DNA, 25 bp, Mus musculus
ccctgcctggtttctaatgaagaaa

SEQ ID NO: 403205 - DNA, 25 bp, Mus musculus
gaaagcgtcaattacggctcggccc

SEQ ID NO: 403206 - DNA, 25 bp, Mus musculus
cccttccattggtccgagagtccta

SEQ ID NO: 403207 - DNA, 25 bp, Mus musculus
ttggctcccagcattgtcaattcta

SEQ ID NO: 403208 - DNA, 25 bp, Mus musculus
cgctctgagagcttttgctgtttta

SEQ ID NO: 403209 - DNA, 25 bp, Mus musculus
gggcgtaccgaagactctccaggcg

SEQ ID NO: 403210 - DNA, 25 bp, Mus musculus
gacgctctagttgcttgagcttaga

SEQ ID NO: 403211 - DNA, 25 bp, Mus musculus
acatgaacgcgacggggtcctagct

SEQ ID NO: 403212 - DNA, 25 bp, Mus musculus
tcgcggcgcctgtcgaaaaaagaaa

SEQ ID NO: 403213 - DNA, 25 bp, Mus musculus
ggagcttaggcttgtcgacgctcta

SEQ ID NO: 403214 - DNA, 25 bp, Mus musculus
tgccatgacgtcaccactgagtgtt

SEQ ID NO: 403215 - DNA, 25 bp, Mus musculus
cgtctgcgccggctcaaggaccaga

SEQ ID NO: 403216 - DNA, 25 bp, Mus musculus
caaggccatgacttcgccgtctgcg

SEQ ID NO: 403217 - DNA, 25 bp, Mus musculus
gagtctcagcaacctcaaggccatg

SEQ ID NO: 403218 - DNA, 25 bp, Mus musculus
cgacaggccgagatccaagcaagga

SEQ ID NO: 403219 - DNA, 25 bp, Mus musculus
cacgggtctgacagacgccgccgga

SEQ ID NO: 403220 - DNA, 25 bp, Mus musculus
aagtgagtcccgctgcaccggtgct

SEQ ID NO: 403221 - DNA, 25 bp, Mus musculus
tctccgtatgcagccgggaaagtga

SEQ ID NO: 403222 - DNA, 25 bp, Mus musculus
cggcatctcggctctccgtatgcag

SEQ ID NO: 403223 - DNA, 25 bp, Mus musculus
tcaccactgagtgttcgcggcgcct

SEQ ID NO: 403224 - DNA, 25 bp, Mus musculus
tttcatctcgacaaggcggcgttgc

SEQ ID NO: 403225 - DNA, 25 bp, Mus musculus
actgcgggtttcatctcgacaaggc

SEQ ID NO: 403226 - DNA, 25 bp, Mus musculus
cgctgcagttcacgttaacagtcgc

SEQ ID NO: 403227 - DNA, 25 bp, Mus musculus
tcacgttaacagtcgcgggccctgc

SEQ ID NO: 403228 - DNA, 25 bp, Mus musculus
ctctgaatccccaaaggcctgggct

SEQ ID NO: 403229 - DNA, 25 bp, Mus musculus
acctcatccaggtccacatagggcc

SEQ ID NO: 403230 - DNA, 25 bp, Mus musculus
tcggggaacatctcatccactgcgg

SEQ ID NO: 403231 - DNA, 25 bp, Mus musculus
catctcatccactgcgggtttcatc

SEQ ID NO: 403232 - DNA, 25 bp, Mus musculus
gcggcgttgcgctcacttccggcca

SEQ ID NO: 403233 - DNA, 25 bp, Mus musculus
tctacttccggcgttcttccgagca

SEQ ID NO: 403234 - DNA, 25 bp, Mus musculus
ggcgttcttccgagcacgtctagac

SEQ ID NO: 403235 - DNA, 25 bp, Mus musculus
agcacgtctagacctcggaggaccg

SEQ ID NO: 403236 - DNA, 25 bp, Mus musculus
agacctcggaggaccgcgcctcggt

SEQ ID NO: 403237 - DNA, 25 bp, Mus musculus
atccactgcgggtttcatctcgaca

SEQ ID NO: 403238 - DNA, 25 bp, Mus musculus
cccgccaccgcgcaccgccacagga

SEQ ID NO: 403239 - DNA, 25 bp, Mus musculus
tggagcgactgagcgcgatcgcctt

SEQ ID NO: 403240 - DNA, 25 bp, Mus musculus
tgcaggctcgggctgtggagcgact

SEQ ID NO: 403241 - DNA, 25 bp, Mus musculus
gcaccgccacaggaaggcttccagt

SEQ ID NO: 403242 - DNA, 25 bp, Mus musculus
gcagaggccggggattgcccggctc

SEQ ID NO: 403243 - DNA, 25 bp, Mus musculus
ggctttgcgccccagcgaacggcag

SEQ ID NO: 403244 - DNA, 25 bp, Mus musculus
tctgtttgggaacggctttgcgccc

SEQ ID NO: 403245 - DNA, 25 bp, Mus musculus
cagctcgccgcggtctgtttgggaa

SEQ ID NO: 403246 - DNA, 25 bp, Mus musculus
gagccatcagctcgccgcggtctgt

SEQ ID NO: 403247 - DNA, 25 bp, Mus musculus
tgcacactcgctacctcgccgcaag

SEQ ID NO: 403248 - DNA, 25 bp, Mus musculus
ggaagtggccctgcacactcgctac

SEQ ID NO: 403249 - DNA, 25 bp, Mus musculus
ccagtcggaagtggccctgcacact

SEQ ID NO: 403250 - DNA, 25 bp, Mus musculus
gcttccagtcggaagtggccctgca

SEQ ID NO: 403251 - DNA, 25 bp, Mus musculus
ctctcagaggcgctgtgacgcggct

SEQ ID NO: 403252 - DNA, 25 bp, Mus musculus
ggcaacggagcacatcgcctgggct

SEQ ID NO: 403253 - DNA, 25 bp, Mus musculus
atctcacccaggcaacggagcacat

SEQ ID NO: 403254 - DNA, 25 bp, Mus musculus
ggactcggcctttgcactccaggct

SEQ ID NO: 403255 - DNA, 25 bp, Mus musculus
cccacaggtggtgccgccgccctgg

SEQ ID NO: 403256 - DNA, 25 bp, Mus musculus
tccggcgagggaagccctgcctcag

SEQ ID NO: 403257 - DNA, 25 bp, Mus musculus
tcacgtccggcgagggaagccctgc

SEQ ID NO: 403258 - DNA, 25 bp, Mus musculus
ccagcggaggacgtgatgtcacgtc

SEQ ID NO: 403259 - DNA, 25 bp, Mus musculus
ggcggggaagctcctgattggccag

SEQ ID NO: 403260 - DNA, 25 bp, Mus musculus
ggctgagagaacattccctcctctc

SEQ ID NO: 403261 - DNA, 25 bp, Mus musculus
cctctccctccggagagcgaagggg

SEQ ID NO: 403262 - DNA, 25 bp, Mus musculus
tgggctgagagaacattccctcctc

SEQ ID NO: 403263 - DNA, 25 bp, Mus musculus
gagcacatcgcctgggctgagagaa

SEQ ID NO: 403264 - DNA, 25 bp, Mus musculus
gcctgggctgagagaacattccctc

SEQ ID NO: 403265 - DNA, 25 bp, Mus musculus
atcgcctgggctgagagaacattcc

SEQ ID NO: 403266 - DNA, 25 bp, Mus musculus
tttacgcggatccacagcaggagcc

SEQ ID NO: 403267 - DNA, 25 bp, Mus musculus
tacctaggaacttgtgcccgccagc

SEQ ID NO: 403268 - DNA, 25 bp, Mus musculus
ttgcagtgggctaggaacttctcta

SEQ ID NO: 403269 - DNA, 25 bp, Mus musculus
tatgcggatctctcccagaggcgtc

SEQ ID NO: 403270 - DNA, 25 bp, Mus musculus
tagcacactcgtggtctgaccgggc

SEQ ID NO: 403271 - DNA, 25 bp, Mus musculus
ggggagatcctacacttcaagcctg

SEQ ID NO: 403272 - DNA, 25 bp, Mus musculus
ttctaaggaaatgtgagcccgctgc

SEQ ID NO: 403273 - DNA, 25 bp, Mus musculus
ccagaggcgtcaagggttctgctta

SEQ ID NO: 403274 - DNA, 25 bp, Mus musculus
agcaatctgcgctccctttgggtta

SEQ ID NO: 403275 - DNA, 25 bp, Mus musculus
tgcctcaggcagagatctcgggtga

SEQ ID NO: 403276 - DNA, 25 bp, Mus musculus
gctttagcctgagcgatgtgcctca

SEQ ID NO: 403277 - DNA, 25 bp, Mus musculus
agatctacggggctaagggctttag

SEQ ID NO: 403278 - DNA, 25 bp, Mus musculus
cttgcggcgaagcaagcggtagctc

SEQ ID NO: 403279 - DNA, 25 bp, Mus musculus
tattgggtcgcatatcccggttgca

SEQ ID NO: 403280 - DNA, 25 bp, Mus musculus
cagccgcgcccactgcaccagcgcc

SEQ ID NO: 403281 - DNA, 25 bp, Mus musculus
ctccctcctttttctgccgccgcgc

SEQ ID NO: 403282 - DNA, 25 bp, Mus musculus
ccatccccgttgcagaggaggcagc

SEQ ID NO: 403283 - DNA, 25 bp, Mus musculus
tgccgccgcgcccactgcggcaagc

SEQ ID NO: 403284 - DNA, 25 bp, Mus musculus
cgccaatcacatcgccctctctcct

SEQ ID NO: 403285 - DNA, 25 bp, Mus musculus
atggcgctcgcttttctccctcctt

SEQ ID NO: 403286 - DNA, 25 bp, Mus musculus
ctgccgcagcactcagctctccgca

SEQ ID NO: 403287 - DNA, 25 bp, Mus musculus
cagagcaggcgcctgcatctgcagc

SEQ ID NO: 403288 - DNA, 25 bp, Mus musculus
ctgcagctccggcttatcttaccgg

SEQ ID NO: 403289 - DNA, 25 bp, Mus musculus
cggcttatcttaccggctccagctg

SEQ ID NO: 403290 - DNA, 25 bp, Mus musculus
ttatcttaccggctccagctgtaca

SEQ ID NO: 403291 - DNA, 25 bp, Mus musculus
cttaccggctccagctgtacagaac

SEQ ID NO: 403292 - DNA, 25 bp, Mus musculus
gctgtacagaaccatccccgttgca

SEQ ID NO: 403293 - DNA, 25 bp, Mus musculus
gcaggtgtcgcccaggctttgttcg

SEQ ID NO: 403294 - DNA, 25 bp, Mus musculus
actccatggcgttccgggagcacgc

SEQ ID NO: 403295 - DNA, 25 bp, Mus musculus
tccagcccggagagcacgtagccga

SEQ ID NO: 403296 - DNA, 25 bp, Mus musculus
tcggaacgccgcgactccatggcgt

SEQ ID NO: 403297 - DNA, 25 bp, Mus musculus
gagcgctcgcgttcgaccggcctgt

SEQ ID NO: 403298 - DNA, 25 bp, Mus musculus
tttgtgcccgctcggaacgccgcga

SEQ ID NO: 403299 - DNA, 25 bp, Mus musculus
aactctcgtcccaggtgagtgtggg

SEQ ID NO: 403300 - DNA, 25 bp, Mus musculus
aaagtaacaactctcgtcccaggtg

SEQ ID NO: 403301 - DNA, 25 bp, Mus musculus
cgcagcgcacggacacacacaaaga

SEQ ID NO: 403302 - DNA, 25 bp, Mus musculus
tgacacacggagtcccgtcacgtca

SEQ ID NO: 403303 - DNA, 25 bp, Mus musculus
gtgcggaaatgacacacggagtccc

SEQ ID NO: 403304 - DNA, 25 bp, Mus musculus
ggctcctgtgtccttgtgcggaaat

SEQ ID NO: 403305 - DNA, 25 bp, Mus musculus
gcgggtcccgctccgcaaagtaaca

SEQ ID NO: 403306 - DNA, 25 bp, Mus musculus
cggagagcacgtagccgagaatgcc

SEQ ID NO: 403307 - DNA, 25 bp, Mus musculus
ctttcccgtgggtgagagccgccct

SEQ ID NO: 403308 - DNA, 25 bp, Mus musculus
tctctgctaagtgaagcggctccgc

SEQ ID NO: 403309 - DNA, 25 bp, Mus musculus
ttcttgctctgcgaagtggtcctta

SEQ ID NO: 403310 - DNA, 25 bp, Mus musculus
ggctctgtgacgttccctggtaatc

SEQ ID NO: 403311 - DNA, 25 bp, Mus musculus
cagggcgaagtcagctctctgctaa

SEQ ID NO: 403312 - DNA, 25 bp, Mus musculus
cgctcacggttaggagtcagacctt

SEQ ID NO: 403313 - DNA, 25 bp, Mus musculus
ggtcacagccttaactcgcagcgtc

SEQ ID NO: 403314 - DNA, 25 bp, Mus musculus
ttaagtttaacatcgctggcggctc

SEQ ID NO: 403315 - DNA, 25 bp, Mus musculus
tgcggcaccgggcatttaagtttaa

SEQ ID NO: 403316 - DNA, 25 bp, Mus musculus
tggcgtctctgctttccatccgtag

SEQ ID NO: 403317 - DNA, 25 bp, Mus musculus
cgccatcttggttccgtgatctccg

SEQ ID NO: 403318 - DNA, 25 bp, Mus musculus
ttccttctgcaacaggcgtgggtca

SEQ ID NO: 403319 - DNA, 25 bp, Mus musculus
tagctgtttcgcatacggtcttggc

SEQ ID NO: 403320 - DNA, 25 bp, Mus musculus
ccggacgccgtcctaaacagctgta

SEQ ID NO: 403321 - DNA, 25 bp, Mus musculus
tcagaccttgggattgctgcccttg

SEQ ID NO: 403322 - DNA, 25 bp, Mus musculus
accgcagctctcttgattacagatg

SEQ ID NO: 403323 - DNA, 25 bp, Mus musculus
gtgaggtcgcctcctagaggcaacc

SEQ ID NO: 403324 - DNA, 25 bp, Mus musculus
cctggatcgcgccttccaggtgcga

SEQ ID NO: 403325 - DNA, 25 bp, Mus musculus
ctcgtgtactgcaagaacggccgca

SEQ ID NO: 403326 - DNA, 25 bp, Mus musculus
ggctcctgtctcgtgtactgcaaga

SEQ ID NO: 403327 - DNA, 25 bp, Mus musculus
tgcaccctgtactgtccatcgagtc

SEQ ID NO: 403328 - DNA, 25 bp, Mus musculus
ggagcccacctgtgccgccatggaa

SEQ ID NO: 403329 - DNA, 25 bp, Mus musculus
agctgaggacctgctgacacacctg

SEQ ID NO: 403330 - DNA, 25 bp, Mus musculus
tacccgtgttcgacgacccagctga

SEQ ID NO: 403331 - DNA, 25 bp, Mus musculus
agtggcggaactacgcgtacccgtg

SEQ ID NO: 403332 - DNA, 25 bp, Mus musculus
gcgggcatcactttgtgcgtcaatg

SEQ ID NO: 403333 - DNA, 25 bp, Mus musculus
ttatgggcacctcggaggctgcacc

SEQ ID NO: 403334 - DNA, 25 bp, Mus musculus
attacagatggtgaagagcgcccgc

SEQ ID NO: 403335 - DNA, 25 bp, Mus musculus
tcttcatcgggaatgcgcgagccgc

SEQ ID NO: 403336 - DNA, 25 bp, Mus musculus
cgctggccttcaggctggacccgtt

SEQ ID NO: 403337 - DNA, 25 bp, Mus musculus
ttgcgcctacactcggtctcgtttc

SEQ ID NO: 403338 - DNA, 25 bp, Mus musculus
gttcaccgactatggctcctctctg

SEQ ID NO: 403339 - DNA, 25 bp, Mus musculus
accgactggaagaggtgtcacctgc

SEQ ID NO: 403340 - DNA, 25 bp, Mus musculus
gtcacactgcctcccgaggtgcagg

SEQ ID NO: 403341 - DNA, 25 bp, Mus musculus
ggatttcacctagcgccggtggtca

SEQ ID NO: 403342 - DNA, 25 bp, Mus musculus
agcggagtctgccagctgcccgctg

SEQ ID NO: 403343 - DNA, 25 bp, Mus musculus
tgtcacctgcgtccctgcgaaagcg

SEQ ID NO: 403344 - DNA, 25 bp, Mus musculus
tggacccgttcaccgactatggctc

SEQ ID NO: 403345 - DNA, 25 bp, Mus musculus
tcagggtaaccacaagaatcattcc

SEQ ID NO: 403346 - DNA, 25 bp, Mus musculus
cgcaggctgaagatgcccagccttc

SEQ ID NO: 403347 - DNA, 25 bp, Mus musculus
ggcgcgacttcctgttgtgcccgcg

SEQ ID NO: 403348 - DNA, 25 bp, Mus musculus
gcccatggatttcacctagcgccgg

SEQ ID NO: 403349 - DNA, 25 bp, Mus musculus
gccatagttgcagcgcgcaggctga

SEQ ID NO: 403350 - DNA, 25 bp, Mus musculus
ctagacaacggagcttgcggcgcta

SEQ ID NO: 403351 - DNA, 25 bp, Mus musculus
ctaggctgctctgcaccagtaggtc

SEQ ID NO: 403352 - DNA, 25 bp, Mus musculus
cgtgcgagagcagaacctaccagtc

SEQ ID NO: 403353 - DNA, 25 bp, Mus musculus
tgtcatatgacgcaagcacggctcc

SEQ ID NO: 403354 - DNA, 25 bp, Mus musculus
cagctgcgttgtcccgagcactaaa

SEQ ID NO: 403355 - DNA, 25 bp, Mus musculus
tcgtgcgtgattaggcagctctgtc

SEQ ID NO: 403356 - DNA, 25 bp, Mus musculus
ctccagccgggttacctagacaacg

SEQ ID NO: 403357 - DNA, 25 bp, Mus musculus
ttcgatttcaagtggctacagctgc

SEQ ID NO: 403358 - DNA, 25 bp, Mus musculus
cctgtggtcactgagacttcgattt

SEQ ID NO: 403359 - DNA, 25 bp, Mus musculus
agtgacttttcagcttcctgtggtc

SEQ ID NO: 403360 - DNA, 25 bp, Mus musculus
tgggaagtagacaacgcctgtgatc

SEQ ID NO: 403361 - DNA, 25 bp, Mus musculus
tgcctcacaccggaaggagcgaagc

SEQ ID NO: 403362 - DNA, 25 bp, Mus musculus
cagggaggaaccaccgctttgccaa

SEQ ID NO: 403363 - DNA, 25 bp, Mus musculus
ccaccgcgacggaaggataacaacg

SEQ ID NO: 403364 - DNA, 25 bp, Mus musculus
gccttcggccagctcggagtgaccg

SEQ ID NO: 403365 - DNA, 25 bp, Mus musculus
tccaccagcagtcacttgatccaat

SEQ ID NO: 403366 - DNA, 25 bp, Mus musculus
agtgaccgcgtcttcagcgaacttg

SEQ ID NO: 403367 - DNA, 25 bp, Mus musculus
cgcgtcttcagcgaacttgcgctga

SEQ ID NO: 403368 - DNA, 25 bp, Mus musculus
aacttgcgctgaggctgcgggtccc

SEQ ID NO: 403369 - DNA, 25 bp, Mus musculus
ccaagattggactagcactggcagc

SEQ ID NO: 403370 - DNA, 25 bp, Mus musculus
gactagcactggcagcgactctccg

SEQ ID NO: 403371 - DNA, 25 bp, Mus musculus
gcagtcacttgatccaatccgcttg

SEQ ID NO: 403372 - DNA, 25 bp, Mus musculus
gatccaatccgcttgccctagcagg

SEQ ID NO: 403373 - DNA, 25 bp, Mus musculus
cgcttgccctagcaggcctttaatc

SEQ ID NO: 403374 - DNA, 25 bp, Mus musculus
ccctcttaggaaggctagccactgg

SEQ ID NO: 403375 - DNA, 25 bp, Mus musculus
ctccttagacagaggcgctgggcac

SEQ ID NO: 403376 - DNA, 25 bp, Mus musculus
agagagaaaaaattcccattcctgg

SEQ ID NO: 403377 - DNA, 25 bp, Mus musculus
cctctggtctctgagagagaaaaaa

SEQ ID NO: 403378 - DNA, 25 bp, Mus musculus
ctctcaggcgtcactggggatagcc

SEQ ID NO: 403379 - DNA, 25 bp, Mus musculus
cggacgcccgtaatcgggtgcagca

SEQ ID NO: 403380 - DNA, 25 bp, Mus musculus
atagccgtgcatgggcactggcacc

SEQ ID NO: 403381 - DNA, 25 bp, Mus musculus
cccgatcctggaactgatgcttctt

SEQ ID NO: 403382 - DNA, 25 bp, Mus musculus
ttcttactgcctgctcctggtgctg

SEQ ID NO: 403383 - DNA, 25 bp, Mus musculus
ctcagccgccagctggtttgtcgca

SEQ ID NO: 403384 - DNA, 25 bp, Mus musculus
ggcagggctgtgacatcaccagtga

SEQ ID NO: 403385 - DNA, 25 bp, Mus musculus
ggggcagtagccttacctctcaggc

SEQ ID NO: 403386 - DNA, 25 bp, Mus musculus
catttagtgcgggtgcccgatgcca

SEQ ID NO: 403387 - DNA, 25 bp, Mus musculus
ctcccatcagatgcacatttagtgc

SEQ ID NO: 403388 - DNA, 25 bp, Mus musculus
cgttggtccggaatctcccatcaga

SEQ ID NO: 403389 - DNA, 25 bp, Mus musculus
tgcgacaaggacattggcgttggtc

SEQ ID NO: 403390 - DNA, 25 bp, Mus musculus
aagcccgcgcttcgggctgcgacaa

SEQ ID NO: 403391 - DNA, 25 bp, Mus musculus
aagggaagccgcagctccaagcccg

SEQ ID NO: 403392 - DNA, 25 bp, Mus musculus
gcctctcgggacgtcccggctaata

SEQ ID NO: 403393 - DNA, 25 bp, Mus musculus
cccggctaataagtgaccctctgta

SEQ ID NO: 403394 - DNA, 25 bp, Mus musculus
atgagtcaagtttgtgctgcgccgc

SEQ ID NO: 403395 - DNA, 25 bp, Mus musculus
cgttaggaatgagtcaagtttgtgc

SEQ ID NO: 403396 - DNA, 25 bp, Mus musculus
cctctgtaaacgttaggaatgagtc

SEQ ID NO: 403397 - DNA, 25 bp, Mus musculus
ggccacagctggaacctattacgcc

SEQ ID NO: 403398 - DNA, 25 bp, Mus musculus
accgggccacagctggaacctatta

SEQ ID NO: 403399 - DNA, 25 bp, Mus musculus
cgacccatcgcaggcaccgggccac

SEQ ID NO: 403400 - DNA, 25 bp, Mus musculus
tctggctgggcgtcgacccatcgca

SEQ ID NO: 403401 - DNA, 25 bp, Mus musculus
tcgtttgcaatcctcccgcgcgcgc

SEQ ID NO: 403402 - DNA, 25 bp, Mus musculus
ctgctttcccgttagcgggtggcgc

SEQ ID NO: 403403 - DNA, 25 bp, Mus musculus
cagggcggccctcgtttgcaatcct

SEQ ID NO: 403404 - DNA, 25 bp, Mus musculus
caagtttgtgctgcgccgctgcttt

SEQ ID NO: 403405 - DNA, 25 bp, Mus musculus
tgaccctctgtaaacgttaggaatg

SEQ ID NO: 403406 - DNA, 25 bp, Mus musculus
tctccggagtgcgacgcgagctagc

SEQ ID NO: 403407 - DNA, 25 bp, Mus musculus
cagagttcgacaggcttccgcagag

SEQ ID NO: 403408 - DNA, 25 bp, Mus musculus
acctgtttgggacgttggcagagtt

SEQ ID NO: 403409 - DNA, 25 bp, Mus musculus
tgctcaaggcccgacctgtttggga

SEQ ID NO: 403410 - DNA, 25 bp, Mus musculus
gggcacctaggcgacagccaggcca

SEQ ID NO: 403411 - DNA, 25 bp, Mus musculus
aggtggaatgaggacagcgcttcct

SEQ ID NO: 403412 - DNA, 25 bp, Mus musculus
gagcactccggactctacgtgagta

SEQ ID NO: 403413 - DNA, 25 bp, Mus musculus
tcgtgcggtgactgcagccacctgc

SEQ ID NO: 403414 - DNA, 25 bp, Mus musculus
agcaacttggcaccgcggcagccag

SEQ ID NO: 403415 - DNA, 25 bp, Mus musculus
tcacgccttcctaagctgcgcgggt

SEQ ID NO: 403416 - DNA, 25 bp, Mus musculus
tccgcggaccagcaagttaaaaatg

SEQ ID NO: 403417 - DNA, 25 bp, Mus musculus
gccggctgggcaggctatttaaacc

SEQ ID NO: 403418 - DNA, 25 bp, Mus musculus
cgacttctacccgttcggcacgaag

SEQ ID NO: 403419 - DNA, 25 bp, Mus musculus
gcgagcaaccgccagggcacctagg

SEQ ID NO: 403420 - DNA, 25 bp, Mus musculus
gcgctacccaggaggatcccgaggc

SEQ ID NO: 403421 - DNA, 25 bp, Mus musculus
agaggtcctctccttggtccagtaa

SEQ ID NO: 403422 - DNA, 25 bp, Mus musculus
agggcactgtcgtctagaggtcctc

SEQ ID NO: 403423 - DNA, 25 bp, Mus musculus
gctccacgaccatctagggcactgt

SEQ ID NO: 403424 - DNA, 25 bp, Mus musculus
gaggcacgtcgaggcgctccacgac

SEQ ID NO: 403425 - DNA, 25 bp, Mus musculus
tgcaagtcacctgcggcgcccggga

SEQ ID NO: 403426 - DNA, 25 bp, Mus musculus
gacgcctgaagaggcccgggacatc

SEQ ID NO: 403427 - DNA, 25 bp, Mus musculus
ggagactacagatgggcgctaccca

SEQ ID NO: 403428 - DNA, 25 bp, Mus musculus
caggtcaacgcggtgtcgcagccac

SEQ ID NO: 403429 - DNA, 25 bp, Mus musculus
accgcggtggctgccgcaggtcaac

SEQ ID NO: 403430 - DNA, 25 bp, Mus musculus
ctgcttctgcttagcccagcgagga

SEQ ID NO: 403431 - DNA, 25 bp, Mus musculus
ggcgtctattacgagcagctgcttc

SEQ ID NO: 403432 - DNA, 25 bp, Mus musculus
tgtactctcgagcttccgagacccg

SEQ ID NO: 403433 - DNA, 25 bp, Mus musculus
ccgggacatcggactctgcaagtca

SEQ ID NO: 403434 - DNA, 25 bp, Mus musculus
acaacgtccggcctccgatctgtgt

SEQ ID NO: 403435 - DNA, 25 bp, Mus musculus
tggagaccaagcgaagaacaactgt

SEQ ID NO: 403436 - DNA, 25 bp, Mus musculus
ggcggtccttcctggctcacaacgt

SEQ ID NO: 403437 - DNA, 25 bp, Mus musculus
ctgtgtccgccgaactcccggggtg

SEQ ID NO: 403438 - DNA, 25 bp, Mus musculus
agaacaactgtgagaccggaagagg

SEQ ID NO: 403439 - DNA, 25 bp, Mus musculus
cccagcgaagccatggagaccaagc

SEQ ID NO: 403440 - DNA, 25 bp, Mus musculus
tgccttcccagcgaagccatggaga

SEQ ID NO: 403441 - DNA, 25 bp, Mus musculus
gagcccgggacctagggcaacctca

SEQ ID NO: 403442 - DNA, 25 bp, Mus musculus
gccaacagccgctgtgagcccggga

SEQ ID NO: 403443 - DNA, 25 bp, Mus musculus
cggaacaccaagaaccagcgtcagc

SEQ ID NO: 403444 - DNA, 25 bp, Mus musculus
acaaggtgcccagaccggaacacca

SEQ ID NO: 403445 - DNA, 25 bp, Mus musculus
gcgctactgccacaaggtgcccaga

SEQ ID NO: 403446 - DNA, 25 bp, Mus musculus
acccgggagcgctactgccacaagg

SEQ ID NO: 403447 - DNA, 25 bp, Mus musculus
ccggaagaggcggtccttcctggct

SEQ ID NO: 403448 - DNA, 25 bp, Mus musculus
tggcctattggacctggaatcctga

SEQ ID NO: 403449 - DNA, 25 bp, Mus musculus
ctgtagaactctcctgtccgcagta

SEQ ID NO: 403450 - DNA, 25 bp, Mus musculus
gctgagcgcgcgcaaacagttgcta

SEQ ID NO: 403451 - DNA, 25 bp, Mus musculus
gagcgacgtgcagcccttcttacga

SEQ ID NO: 403452 - DNA, 25 bp, Mus musculus
tggcaccagtgtatcagcacgcagg

SEQ ID NO: 403453 - DNA, 25 bp, Mus musculus
tcgcctaccggctcaccgtgaagtg

SEQ ID NO: 403454 - DNA, 25 bp, Mus musculus
tcggcttcacctgtggcctgtagaa

SEQ ID NO: 403455 - DNA, 25 bp, Mus musculus
gcagtacctctacgcctccgaagtt

SEQ ID NO: 403456 - DNA, 25 bp, Mus musculus
gaagtgtctcccatgctgcctaaag

SEQ ID NO: 403457 - DNA, 25 bp, Mus musculus
actttccgggatgtctgctttcttc

SEQ ID NO: 403458 - DNA, 25 bp, Mus musculus
ttcgtgctcgcctagactctactca

SEQ ID NO: 403459 - DNA, 25 bp, Mus musculus
atggcctaaggcgacagattccgga

SEQ ID NO: 403460 - DNA, 25 bp, Mus musculus
tgtcagctcgcgcttctatactttg

SEQ ID NO: 403461 - DNA, 25 bp, Mus musculus
agccggagcctgtgggaactacaat

SEQ ID NO: 403462 - DNA, 25 bp, Mus musculus
actcgtgtgtgagctttccgccatg

SEQ ID NO: 403463 - DNA, 25 bp, Mus musculus
gccttaggccctaaactcgtgtgtg

SEQ ID NO: 403464 - DNA, 25 bp, Mus musculus
agacagcctggctctctcggaactc

SEQ ID NO: 403465 - DNA, 25 bp, Mus musculus
acttttcttccctagacagcctggc

SEQ ID NO: 403466 - DNA, 25 bp, Mus musculus
cggattcctcgtgccagaaatccca

SEQ ID NO: 403467 - DNA, 25 bp, Mus musculus
catttttcctccagatgtccgtttc

SEQ ID NO: 403468 - DNA, 25 bp, Mus musculus
gccaacggcttgctaacgcgagacc

SEQ ID NO: 403469 - DNA, 25 bp, Mus musculus
agggcctgcatccttgttcctgtta

SEQ ID NO: 403470 - DNA, 25 bp, Mus musculus
gacatcccgccgacggaaggtcgtc

SEQ ID NO: 403471 - DNA, 25 bp, Mus musculus
ttcaccatgtgagtgcgacatcccg

SEQ ID NO: 403472 - DNA, 25 bp, Mus musculus
cccgggcattttgctgcgtcaccag

SEQ ID NO: 403473 - DNA, 25 bp, Mus musculus
cgcagagcctggaaacggcgattgc

SEQ ID NO: 403474 - DNA, 25 bp, Mus musculus
agagatctctagaaaaccgcgcaga

SEQ ID NO: 403475 - DNA, 25 bp, Mus musculus
cggcaggcactgctaggcaactaga

SEQ ID NO: 403476 - DNA, 25 bp, Mus musculus
gctttttgccctactcaacaactgg

SEQ ID NO: 403477 - DNA, 25 bp, Mus musculus
atcttcgtagctgcctgcccgctgg

SEQ ID NO: 403478 - DNA, 25 bp, Mus musculus
catcagcaatgtgagtgcccggctc

SEQ ID NO: 403479 - DNA, 25 bp, Mus musculus
ctcgcggtcatcagcaatgtgagtg

SEQ ID NO: 403480 - DNA, 25 bp, Mus musculus
acacacctcgcggtcatcagcaatg

SEQ ID NO: 403481 - DNA, 25 bp, Mus musculus
tggttccacatcctaacgggcctca

SEQ ID NO: 403482 - DNA, 25 bp, Mus musculus
ggcatctggttccacatcctaacgg

SEQ ID NO: 403483 - DNA, 25 bp, Mus musculus
gatccgcctagatgcgcgcaagttc

SEQ ID NO: 403484 - DNA, 25 bp, Mus musculus
ggacatcggcatctggttccacatc

SEQ ID NO: 403485 - DNA, 25 bp, Mus musculus
gagcgcgcccaggacatcggcatct

SEQ ID NO: 403486 - DNA, 25 bp, Mus musculus
tcgtgtgcgagtatcggcgcccagt

SEQ ID NO: 403487 - DNA, 25 bp, Mus musculus
gcgcgcaagttcgtgtgcgagtatc

SEQ ID NO: 403488 - DNA, 25 bp, Mus musculus
caacaactgggtggagatccgccta

SEQ ID NO: 403489 - DNA, 25 bp, Mus musculus
tggcgccgctttttgccctactcaa

SEQ ID NO: 403490 - DNA, 25 bp, Mus musculus
cccgggtgaagatcccagcttgacg

SEQ ID NO: 403491 - DNA, 25 bp, Mus musculus
cgctgctatatagggcggaggctcc

SEQ ID NO: 403492 - DNA, 25 bp, Mus musculus
tgagtgtgaccacccgagagtctgt

SEQ ID NO: 403493 - DNA, 25 bp, Mus musculus
gcccgatcctcactcgtgagtgtga

SEQ ID NO: 403494 - DNA, 25 bp, Mus musculus
gccatgcgcagagtgacacgtagcg

SEQ ID NO: 403495 - DNA, 25 bp, Mus musculus
cttgggaaagtttctgcgctccggc

SEQ ID NO: 403496 - DNA, 25 bp, Mus musculus
cagcttgacgcgaactagggcgcca

SEQ ID NO: 403497 - DNA, 25 bp, Mus musculus
cacgtagccagacgccgcaggtgaa

SEQ ID NO: 403498 - DNA, 25 bp, Mus musculus
cgggagtcctccagtgaccacgtag

SEQ ID NO: 403499 - DNA, 25 bp, Mus musculus
ctggggcgcatccaagtagtacttg

SEQ ID NO: 403500 - DNA, 25 bp, Mus musculus
atgtatttttcacccatggaccctg

SEQ ID NO: 403501 - DNA, 25 bp, Mus musculus
ccctgcctttcatccaaattcggta

SEQ ID NO: 403502 - DNA, 25 bp, Mus musculus
ttaaagggacagtatcctgctcggc

SEQ ID NO: 403503 - DNA, 25 bp, Mus musculus
agggcgccactgacctagctaggtc

SEQ ID NO: 403504 - DNA, 25 bp, Mus musculus
tgaccagcacgtagccaatcccggg

SEQ ID NO: 403505 - DNA, 25 bp, Mus musculus
tggcgtcgtcccttcgaggacaact

SEQ ID NO: 403506 - DNA, 25 bp, Mus musculus
ctgtcctgagaaagggctagagttc

SEQ ID NO: 403507 - DNA, 25 bp, Mus musculus
tggcaatgtgtacccactgtcgcgc

SEQ ID NO: 403508 - DNA, 25 bp, Mus musculus
gtgctctcgcctgacgagcgttctc

SEQ ID NO: 403509 - DNA, 25 bp, Mus musculus
cttgcgctctgcatgcaaccgcgga

SEQ ID NO: 403510 - DNA, 25 bp, Mus musculus
ctctatatggccaaccgccgtggga

SEQ ID NO: 403511 - DNA, 25 bp, Mus musculus
ccaagctcataaggtaggaactgtg

SEQ ID NO: 403512 - DNA, 25 bp, Mus musculus
aatctcgttacctgctcctctttta

SEQ ID NO: 403513 - DNA, 25 bp, Mus musculus
tcccataaagcggagaatctcgtta

SEQ ID NO: 403514 - DNA, 25 bp, Mus musculus
ggtcgtctctcgctctcaatggaca

SEQ ID NO: 403515 - DNA, 25 bp, Mus musculus
gcctatcccggctcggtgttcctag

SEQ ID NO: 403516 - DNA, 25 bp, Mus musculus
agcccgccatagagacggccgcaga

SEQ ID NO: 403517 - DNA, 25 bp, Mus musculus
gatgcccgccggcaagtcacaagcg

SEQ ID NO: 403518 - DNA, 25 bp, Mus musculus
aagcgaagactaagacggagaactc

SEQ ID NO: 403519 - DNA, 25 bp, Mus musculus
acagcccgccgaagccctgttgcac

SEQ ID NO: 403520 - DNA, 25 bp, Mus musculus
ctgtcccatgtgatcaccaatcaga

SEQ ID NO: 403521 - DNA, 25 bp, Mus musculus
acccgcggagaagctgcacagcttt

SEQ ID NO: 403522 - DNA, 25 bp, Mus musculus
gttgcacccgcggagaagctgcaca

SEQ ID NO: 403523 - DNA, 25 bp, Mus musculus
aatcagagctaggtgctgcgctcgc

SEQ ID NO: 403524 - DNA, 25 bp, Mus musculus
ggtttcctaagtcccacccagcaca

SEQ ID NO: 403525 - DNA, 25 bp, Mus musculus
tgtgatcaccaatcagagctaggtg

SEQ ID NO: 403526 - DNA, 25 bp, Mus musculus
agggccgaggacacgcacagcccgc

SEQ ID NO: 403527 - DNA, 25 bp, Mus musculus
cttctgactttatggggctccctcg

SEQ ID NO: 403528 - DNA, 25 bp, Mus musculus
ctttgcttctgactttatggggctc

SEQ ID NO: 403529 - DNA, 25 bp, Mus musculus
cggagaagctgcacagctttgcttc

SEQ ID NO: 403530 - DNA, 25 bp, Mus musculus
cgtcgccttgtcaaagcgaagacta

SEQ ID NO: 403531 - DNA, 25 bp, Mus musculus
agactaagacggagaactcgcgggt

SEQ ID NO: 403532 - DNA, 25 bp, Mus musculus
caggccgctcggtcaacagtggcca

SEQ ID NO: 403533 - DNA, 25 bp, Mus musculus
ggctcacgtcttccgcaggcgctgg

SEQ ID NO: 403534 - DNA, 25 bp, Mus musculus
ctcggcacaggccagagttccaacg

SEQ ID NO: 403535 - DNA, 25 bp, Mus musculus
gcctcaagtggacaaatccgctcca

SEQ ID NO: 403536 - DNA, 25 bp, Mus musculus
tgacgtgaccagtccgtcgcagccg

SEQ ID NO: 403537 - DNA, 25 bp, Mus musculus
tgcgagaaaccgcaggccgctcggt

SEQ ID NO: 403538 - DNA, 25 bp, Mus musculus
gcagacgttccctggggctcacgtc

SEQ ID NO: 403539 - DNA, 25 bp, Mus musculus
ccgggcacgcaaaattgagactaca

SEQ ID NO: 403540 - DNA, 25 bp, Mus musculus
gatgaggtgttacgcaagtgctccg

SEQ ID NO: 403541 - DNA, 25 bp, Mus musculus
ccctgatggcgacagactacaagtc

SEQ ID NO: 403542 - DNA, 25 bp, Mus musculus
agaggcacaaatgcgccacagattg

SEQ ID NO: 403543 - DNA, 25 bp, Mus musculus
cacagattggatccgaaccttgaga

SEQ ID NO: 403544 - DNA, 25 bp, Mus musculus
gaaccttgagatatgcccgagctgg

SEQ ID NO: 403545 - DNA, 25 bp, Mus musculus
acggcggctcacaccgcaattcggt

SEQ ID NO: 403546 - DNA, 25 bp, Mus musculus
tcagtctattcgtaggtgtggcgcc

SEQ ID NO: 403547 - DNA, 25 bp, Mus musculus
ttctgtctttgcagcggagatcatg

SEQ ID NO: 403548 - DNA, 25 bp, Mus musculus
cggtccggtctgaactcagtctatt

SEQ ID NO: 403549 - DNA, 25 bp, Mus musculus
cctcctgtgttgtttgaatcgcgca

SEQ ID NO: 403550 - DNA, 25 bp, Mus musculus
ttggggtgcaaaacgagaggctatc

SEQ ID NO: 403551 - DNA, 25 bp, Mus musculus
caccgctgggatctgcgagatttaa

SEQ ID NO: 403552 - DNA, 25 bp, Mus musculus
ctatcgccacttccctgcggtgttt

SEQ ID NO: 403553 - DNA, 25 bp, Mus musculus
gcctgggcgctgtgattaaagaacc

SEQ ID NO: 403554 - DNA, 25 bp, Mus musculus
atggacgcctttgatcgctcgccca

SEQ ID NO: 403555 - DNA, 25 bp, Mus musculus
ccgcgcagtttggagccttccttag

SEQ ID NO: 403556 - DNA, 25 bp, Mus musculus
ccctggatgtagcaccatgggaaca

SEQ ID NO: 403557 - DNA, 25 bp, Mus musculus
agcgagcgggtcctgaaaccagaac

SEQ ID NO: 403558 - DNA, 25 bp, Mus musculus
tgccgtttccttagaaggcgaagcc

SEQ ID NO: 403559 - DNA, 25 bp, Mus musculus
ctcgcccacagacaaggagctggtg

SEQ ID NO: 403560 - DNA, 25 bp, Mus musculus
gtgcccaccgccgtacggcgagatg

SEQ ID NO: 403561 - DNA, 25 bp, Mus musculus
tgcccgaaagcaaagatcaggatta

SEQ ID NO: 403562 - DNA, 25 bp, Mus musculus
gattaacctgagaaggcgcccttgc

SEQ ID NO: 403563 - DNA, 25 bp, Mus musculus
gcgcccttgcagaatactcctgaaa

SEQ ID NO: 403564 - DNA, 25 bp, Mus musculus
tcctgaaattggcagggccagccca

SEQ ID NO: 403565 - DNA, 25 bp, Mus musculus
agcccaaatcagtgcgacgcccgtt

SEQ ID NO: 403566 - DNA, 25 bp, Mus musculus
aggtcataaagctccacgacccgtc

SEQ ID NO: 403567 - DNA, 25 bp, Mus musculus
tgttggaacagttcacggccgcgca

SEQ ID NO: 403568 - DNA, 25 bp, Mus musculus
cagatcaccattgcgggcctcggtc

SEQ ID NO: 403569 - DNA, 25 bp, Mus musculus
tccggttaggaaccacacgcgccga

SEQ ID NO: 403570 - DNA, 25 bp, Mus musculus
tcgcgcagtagtccgtcggagcgac

SEQ ID NO: 403571 - DNA, 25 bp, Mus musculus
ccggcggtccaagccaaggtcataa

SEQ ID NO: 403572 - DNA, 25 bp, Mus musculus
tgagtccgtaccgagacatgcgcgg

SEQ ID NO: 403573 - DNA, 25 bp, Mus musculus
gagacagcgcgtttctcgcccttgc

SEQ ID NO: 403574 - DNA, 25 bp, Mus musculus
cgagacctgtaacggaatcaaattt

SEQ ID NO: 403575 - DNA, 25 bp, Mus musculus
gcacagcaccggtcaacttgccagg

SEQ ID NO: 403576 - DNA, 25 bp, Mus musculus
acttgccaggttcccgccaatgtta

SEQ ID NO: 403577 - DNA, 25 bp, Mus musculus
cgccaatgttagatgcagcagaagc

SEQ ID NO: 403578 - DNA, 25 bp, Mus musculus
ttggaaaacgaattctgtggcctgc

SEQ ID NO: 403579 - DNA, 25 bp, Mus musculus
aacagcttccggacgtgacgtaatc

SEQ ID NO: 403580 - DNA, 25 bp, Mus musculus
ctaagcgcgctactgaagggttcta

SEQ ID NO: 403581 - DNA, 25 bp, Mus musculus
tgacgtaatctaggcccgggagtct

SEQ ID NO: 403582 - DNA, 25 bp, Mus musculus
gagtctgcagtttagcgagcgccaa

SEQ ID NO: 403583 - DNA, 25 bp, Mus musculus
agcgagcgccaactcgcggaacttc

SEQ ID NO: 403584 - DNA, 25 bp, Mus musculus
gctcccgaagagcaccaatcttaag

SEQ ID NO: 403585 - DNA, 25 bp, Mus musculus
caatcttaaggactgtggttgcgca

SEQ ID NO: 403586 - DNA, 25 bp, Mus musculus
gctctggtcacgtggaagttcgaga

SEQ ID NO: 403587 - DNA, 25 bp, Mus musculus
cgcacagcgcggtcaccagcttgag

SEQ ID NO: 403588 - DNA, 25 bp, Mus musculus
cctcctcttccgcagaagaaatgtc

SEQ ID NO: 403589 - DNA, 25 bp, Mus musculus
ggttcacagggtgcacatagctgtc

SEQ ID NO: 403590 - DNA, 25 bp, Mus musculus
catagctgtcctcgtagcggtcctc

SEQ ID NO: 403591 - DNA, 25 bp, Mus musculus
tccagtttggaaagcttggtgtcgg

SEQ ID NO: 403592 - DNA, 25 bp, Mus musculus
acccagggcaggctggtcttcagtc

SEQ ID NO: 403593 - DNA, 25 bp, Mus musculus
cttcagtctggagaaggctttgctc

SEQ ID NO: 403594 - DNA, 25 bp, Mus musculus
aggctttgctcagcacgcgcatccg

SEQ ID NO: 403595 - DNA, 25 bp, Mus musculus
gagccggtggacatcgcctattccc

SEQ ID NO: 403596 - DNA, 25 bp, Mus musculus
gactgcttgcactctgcggccgagc

SEQ ID NO: 403597 - DNA, 25 bp, Mus musculus
aagaaatgtcgctgggcgagccgta

SEQ ID NO: 403598 - DNA, 25 bp, Mus musculus
gtaaccgcgctccatgcggagcagg

SEQ ID NO: 403599 - DNA, 25 bp, Mus musculus
atctccgagtcttcggggtcactca

SEQ ID NO: 403600 - DNA, 25 bp, Mus musculus
gggtcactcaccgagccggtggaca

SEQ ID NO: 403601 - DNA, 25 bp, Mus musculus
gcattccgctgcgactgcttgcact

SEQ ID NO: 403602 - DNA, 25 bp, Mus musculus
gacagagcttccacattgcaaactg

SEQ ID NO: 403603 - DNA, 25 bp, Mus musculus
tgcgagtcaaagcaaccgaggtcca

SEQ ID NO: 403604 - DNA, 25 bp, Mus musculus
cacaggcagcgggtgtctgaacaac

SEQ ID NO: 403605 - DNA, 25 bp, Mus musculus
cccgtcagccaggagaaaccacagg

SEQ ID NO: 403606 - DNA, 25 bp, Mus musculus
gccaatcggagcacgcggctcatga

SEQ ID NO: 403607 - DNA, 25 bp, Mus musculus
cctcgggaccagacagccacaaaga

SEQ ID NO: 403608 - DNA, 25 bp, Mus musculus
tttggcgccagcacacgtgcaagcg

SEQ ID NO: 403609 - DNA, 25 bp, Mus musculus
ggcttcttcacgaagtgcgagtcaa

SEQ ID NO: 403610 - DNA, 25 bp, Mus musculus
ccctgccagggcttggaatccggct

SEQ ID NO: 403611 - DNA, 25 bp, Mus musculus
tgcaaactgcgaaccgagcacatcg

SEQ ID NO: 403612 - DNA, 25 bp, Mus musculus
cgactgccatgtacttggagcacta

SEQ ID NO: 403613 - DNA, 25 bp, Mus musculus
ttggagcactatctggacagtaagc

SEQ ID NO: 403614 - DNA, 25 bp, Mus musculus
tggacagtaagcactctggccgagc

SEQ ID NO: 403615 - DNA, 25 bp, Mus musculus
catggaagttaaccgatgcctgtga

SEQ ID NO: 403616 - DNA, 25 bp, Mus musculus
cccggattccgccatgttgagtctt

SEQ ID NO: 403617 - DNA, 25 bp, Mus musculus
cgggtgaccttaagctgtcctaaca

SEQ ID NO: 403618 - DNA, 25 bp, Mus musculus
ggctctgccacaggcgcagcttcta

SEQ ID NO: 403619 - DNA, 25 bp, Mus musculus
agcgccttcctggaggagctagttc

SEQ ID NO: 403620 - DNA, 25 bp, Mus musculus
gggcctatcggatccgttctccata

SEQ ID NO: 403621 - DNA, 25 bp, Mus musculus
tccataaggattcccgggcagcgga

SEQ ID NO: 403622 - DNA, 25 bp, Mus musculus
gactactgtccagccgaggagtgca

SEQ ID NO: 403623 - DNA, 25 bp, Mus musculus
tcgcccgtgggagcgttgatataac

SEQ ID NO: 403624 - DNA, 25 bp, Mus musculus
cgttgatataaccagcagcgtccca

SEQ ID NO: 403625 - DNA, 25 bp, Mus musculus
cgtcccattttgtgaggctagagtg

SEQ ID NO: 403626 - DNA, 25 bp, Mus musculus
agctgcctcgaccttgaggttttga

SEQ ID NO: 403627 - DNA, 25 bp, Mus musculus
gttcccgattgcagcgtgcccttct

SEQ ID NO: 403628 - DNA, 25 bp, Mus musculus
gggttcatcctggtaagcgccttcc

SEQ ID NO: 403629 - DNA, 25 bp, Mus musculus
tgggctcagctaaccttccctcggg

SEQ ID NO: 403630 - DNA, 25 bp, Mus musculus
gttgttgttgctgcccgctctgagc

SEQ ID NO: 403631 - DNA, 25 bp, Mus musculus
aggagtccaagtctcccaagcccgg

SEQ ID NO: 403632 - DNA, 25 bp, Mus musculus
gctggtgtacttcgtggtcaggacc

SEQ ID NO: 403633 - DNA, 25 bp, Mus musculus
tggcgacaaacccatgacccagcgg

SEQ ID NO: 403634 - DNA, 25 bp, Mus musculus
agcctggccgtgagtcccagtcctg

SEQ ID NO: 403635 - DNA, 25 bp, Mus musculus
cgcggagagccgcaatgacagcatc

SEQ ID NO: 403636 - DNA, 25 bp, Mus musculus
tcggggccaagctcagtctgatgct

SEQ ID NO: 403637 - DNA, 25 bp, Mus musculus
gtgcgcaataggctcgaacctctga

SEQ ID NO: 403638 - DNA, 25 bp, Mus musculus
ctccggccttcgtgttgttgttgct

SEQ ID NO: 403639 - DNA, 25 bp, Mus musculus
ctgcggggatgtacgaacttccggt

SEQ ID NO: 403640 - DNA, 25 bp, Mus musculus
aacttccggttgtcccggcaggctg

SEQ ID NO: 403641 - DNA, 25 bp, Mus musculus
cgaacctctgacgtcactgagcgca

SEQ ID NO: 403642 - DNA, 25 bp, Mus musculus
gtcccacagctacgcgtgcgcaata

SEQ ID NO: 403643 - DNA, 25 bp, Mus musculus
ctacatattagcaaccggaggcgtc

SEQ ID NO: 403644 - DNA, 25 bp, Mus musculus
ctgccgcgcagttagcgcttaccgg

SEQ ID NO: 403645 - DNA, 25 bp, Mus musculus
ggaagctcacagtcgcacgcggacg

SEQ ID NO: 403646 - DNA, 25 bp, Mus musculus
cactatgccgggtggaggaagctca

SEQ ID NO: 403647 - DNA, 25 bp, Mus musculus
agtcgttgtgagctcggtctgcact

SEQ ID NO: 403648 - DNA, 25 bp, Mus musculus
ggctgctgttgccttgcgttactgg

SEQ ID NO: 403649 - DNA, 25 bp, Mus musculus
aaacgataagcaaggccagccaatc

SEQ ID NO: 403650 - DNA, 25 bp, Mus musculus
ctaggatgttcagcggtggagctct

SEQ ID NO: 403651 - DNA, 25 bp, Mus musculus
tcctcgccgtagcagggaaacgata

SEQ ID NO: 403652 - DNA, 25 bp, Mus musculus
tggcggtttcttctgcagctgggct

SEQ ID NO: 403653 - DNA, 25 bp, Mus musculus
tccctggggctcaggtttcttttca

SEQ ID NO: 403654 - DNA, 25 bp, Mus musculus
cgtggagccgagatcccagaatcag

SEQ ID NO: 403655 - DNA, 25 bp, Mus musculus
cggtggagctctcccggttctccag

SEQ ID NO: 403656 - DNA, 25 bp, Mus musculus
ccagaatcaggtcgctaggatgttc

SEQ ID NO: 403657 - DNA, 25 bp, Mus musculus
caaatgtgacaccttgtgcattgga

SEQ ID NO: 403658 - DNA, 25 bp, Mus musculus
ccctgggcaggtgacagcgccctaa

SEQ ID NO: 403659 - DNA, 25 bp, Mus musculus
gctggtttcttttctggctccgccc

SEQ ID NO: 403660 - DNA, 25 bp, Mus musculus
cacctcgaggtgtcagcgctgctct

SEQ ID NO: 403661 - DNA, 25 bp, Mus musculus
agcgctgctctgctctacaccggtc

SEQ ID NO: 403662 - DNA, 25 bp, Mus musculus
ccaagcgacaaccacaatgctctgt

SEQ ID NO: 403663 - DNA, 25 bp, Mus musculus
ccacaatgctctgtgtgggagtgag

SEQ ID NO: 403664 - DNA, 25 bp, Mus musculus
cctccgccaggtgagagaacagggc

SEQ ID NO: 403665 - DNA, 25 bp, Mus musculus
ggtgagagaacagggcgacactatc

SEQ ID NO: 403666 - DNA, 25 bp, Mus musculus
cagggcgacactatctcgtatgcga

SEQ ID NO: 403667 - DNA, 25 bp, Mus musculus
cgacactatctcgtatgcgagggcg

SEQ ID NO: 403668 - DNA, 25 bp, Mus musculus
ctccgggacctaggcacctcgaggt

SEQ ID NO: 403669 - DNA, 25 bp, Mus musculus
acagcgccctaaggccggactagtc

SEQ ID NO: 403670 - DNA, 25 bp, Mus musculus
aggccggactagtctccgcctcccg

SEQ ID NO: 403671 - DNA, 25 bp, Mus musculus
tgtcactgcacggtcaccgcagcta

SEQ ID NO: 403672 - DNA, 25 bp, Mus musculus
accgagccatcagccatcgcggagg

SEQ ID NO: 403673 - DNA, 25 bp, Mus musculus
actggtggccgagataaggtcgcca

SEQ ID NO: 403674 - DNA, 25 bp, Mus musculus
cagcgcgcactggtggccgagataa

SEQ ID NO: 403675 - DNA, 25 bp, Mus musculus
cagcacaaaaggttgcaggaggagt

SEQ ID NO: 403676 - DNA, 25 bp, Mus musculus
cacagtggctcgctgactggggcac

SEQ ID NO: 403677 - DNA, 25 bp, Mus musculus
cttgtacaccgttggggccagaggc

SEQ ID NO: 403678 - DNA, 25 bp, Mus musculus
ataaggtcgccaggggctgtctccc

SEQ ID NO: 403679 - DNA, 25 bp, Mus musculus
gtctcccgccgctatctgtagcccg

SEQ ID NO: 403680 - DNA, 25 bp, Mus musculus
ccacctctgcagcacaaaaggttgc

SEQ ID NO: 403681 - DNA, 25 bp, Mus musculus
cgcagccgcggcttgtacaccgttg

SEQ ID NO: 403682 - DNA, 25 bp, Mus musculus
agccattcgcaccaaggctcaggga

SEQ ID NO: 403683 - DNA, 25 bp, Mus musculus
agccgggcgagcgttacttctcaat

SEQ ID NO: 403684 - DNA, 25 bp, Mus musculus
ttacttctcaatgggcctccgccgg

SEQ ID NO: 403685 - DNA, 25 bp, Mus musculus
gacgcgctcagacttccgcaccttg

SEQ ID NO: 403686 - DNA, 25 bp, Mus musculus
aaggattagcgggacctagccctca

SEQ ID NO: 403687 - DNA, 25 bp, Mus musculus
cacggaaactgcaccggccggaaca

SEQ ID NO: 403688 - DNA, 25 bp, Mus musculus
ttcgactgctctaaggacgggtttg

SEQ ID NO: 403689 - DNA, 25 bp, Mus musculus
ggtcgttctagtgtgttctgtcata

SEQ ID NO: 403690 - DNA, 25 bp, Mus musculus
tgccgtttgcacttaggaccacttc

SEQ ID NO: 403691 - DNA, 25 bp, Mus musculus
gttccgcttccggtagcaccagata

SEQ ID NO: 403692 - DNA, 25 bp, Mus musculus
acggtccttttcctgcttaggcaag

SEQ ID NO: 403693 - DNA, 25 bp, Mus musculus
tggcactggcacacctcaggagcct

SEQ ID NO: 403694 - DNA, 25 bp, Mus musculus
cttgagcccatccaggtttcggttc

SEQ ID NO: 403695 - DNA, 25 bp, Mus musculus
gcatccgcaccgtggagcagagaca

SEQ ID NO: 403696 - DNA, 25 bp, Mus musculus
actgtccgtggctcttgcaagacca

SEQ ID NO: 403697 - DNA, 25 bp, Mus musculus
ggggatgttctgtcactcgtccaca

SEQ ID NO: 403698 - DNA, 25 bp, Mus musculus
ggcgactcggtataattgagctgtc

SEQ ID NO: 403699 - DNA, 25 bp, Mus musculus
gtgtcaaaaagcttgcggagctctc

SEQ ID NO: 403700 - DNA, 25 bp, Mus musculus
gcagacccgcgtcagtcatcattcg

SEQ ID NO: 403701 - DNA, 25 bp, Mus musculus
gctggatgagcagggtccttatcgc

SEQ ID NO: 403702 - DNA, 25 bp, Mus musculus
ccgtccgctccggacgcgtgggaag

SEQ ID NO: 403703 - DNA, 25 bp, Mus musculus
gcggccagccaggtccgctccgtcc

SEQ ID NO: 403704 - DNA, 25 bp, Mus musculus
gcagctacttcatggccccaggcga

SEQ ID NO: 403705 - DNA, 25 bp, Mus musculus
tggcggccgcagctacttcatggcc

SEQ ID NO: 403706 - DNA, 25 bp, Mus musculus
cgtccggccatgtccgcgcaggacc

SEQ ID NO: 403707 - DNA, 25 bp, Mus musculus
cttatcgctcacaacgccaggggct

SEQ ID NO: 403708 - DNA, 25 bp, Mus musculus
cgctcacaacgccaggggctgtgag

SEQ ID NO: 403709 - DNA, 25 bp, Mus musculus
gctgtgagggctatcgcgcagaccc

SEQ ID NO: 403710 - DNA, 25 bp, Mus musculus
gggtccttatcgctcacaacgccag

SEQ ID NO: 403711 - DNA, 25 bp, Mus musculus
agggctatcgcgcagacccgcgtca

SEQ ID NO: 403712 - DNA, 25 bp, Mus musculus
gcgcagacccgcgtcagtcatcatt

SEQ ID NO: 403713 - DNA, 25 bp, Mus musculus
agcagggtccttatcgctcacaacg

SEQ ID NO: 403714 - DNA, 25 bp, Mus musculus
cacgtccgtagctgtcaatctgcgc

SEQ ID NO: 403715 - DNA, 25 bp, Mus musculus
ccagggcccgatagtctctgggacg

SEQ ID NO: 403716 - DNA, 25 bp, Mus musculus
cctcagtcggtattccacgtccgta

SEQ ID NO: 403717 - DNA, 25 bp, Mus musculus
ctaacgctcaaactagtcctaagga

SEQ ID NO: 403718 - DNA, 25 bp, Mus musculus
ggggcttcgcaaccgccacttagag

SEQ ID NO: 403719 - DNA, 25 bp, Mus musculus
ccgccacttagagttgtccaaaagg

SEQ ID NO: 403720 - DNA, 25 bp, Mus musculus
acccaaggcgaatgaacaaacgcgc

SEQ ID NO: 403721 - DNA, 25 bp, Mus musculus
cccagaaaggcgagggcgcagttaa

SEQ ID NO: 403722 - DNA, 25 bp, Mus musculus
gcgcagttaaagtgccacagtgggc

SEQ ID NO: 403723 - DNA, 25 bp, Mus musculus
agtgggcacagcaccggtgaagaac

SEQ ID NO: 403724 - DNA, 25 bp, Mus musculus
aagaacgcggtggtgctgacaaccc

SEQ ID NO: 403725 - DNA, 25 bp, Mus musculus
gaagccaagggaccagcagcccgct

SEQ ID NO: 403726 - DNA, 25 bp, Mus musculus
tagtcctaaggatccactcggggtc

SEQ ID NO: 403727 - DNA, 25 bp, Mus musculus
ccgcaggctcttcccgggacggaag

SEQ ID NO: 403728 - DNA, 25 bp, Mus musculus
cggtacacgcaggaggcagccactc

SEQ ID NO: 403729 - DNA, 25 bp, Mus musculus
tgccaggtaaagctgagggctcccg

SEQ ID NO: 403730 - DNA, 25 bp, Mus musculus
actacggagtctccacgtctctgga

SEQ ID NO: 403731 - DNA, 25 bp, Mus musculus
gcagcgatatgagctggacacccgc

SEQ ID NO: 403732 - DNA, 25 bp, Mus musculus
cccaatgaggaaggcagcgatatga

SEQ ID NO: 403733 - DNA, 25 bp, Mus musculus
aggacacccgttcgcccaatgagga

SEQ ID NO: 403734 - DNA, 25 bp, Mus musculus
ccgaaggctgtaaagctgtgacact

SEQ ID NO: 403735 - DNA, 25 bp, Mus musculus
atcgagcggagactttggaaacatc

SEQ ID NO: 403736 - DNA, 25 bp, Mus musculus
tctccactgccagagatcgagcgga

SEQ ID NO: 403737 - DNA, 25 bp, Mus musculus
tgctcttgtcatcagctctccactg

SEQ ID NO: 403738 - DNA, 25 bp, Mus musculus
catcagcggatttgctgctcttgtc

SEQ ID NO: 403739 - DNA, 25 bp, Mus musculus
tttcaccctcctggcagagagctga

SEQ ID NO: 403740 - DNA, 25 bp, Mus musculus
gccactcgggctagaaaacgcgcga

SEQ ID NO: 403741 - DNA, 25 bp, Mus musculus
gaccgcgcgctggtcttaaaggacg

SEQ ID NO: 403742 - DNA, 25 bp, Mus musculus
gactccctgcagacctacatgtttg

SEQ ID NO: 403743 - DNA, 25 bp, Mus musculus
ccaagctctacgaggccgacatgga

SEQ ID NO: 403744 - DNA, 25 bp, Mus musculus
ctacatgtttgaaggggacggctct

SEQ ID NO: 403745 - DNA, 25 bp, Mus musculus
tcagcagcacggtccacagctacgt

SEQ ID NO: 403746 - DNA, 25 bp, Mus musculus
tcagccacctcggactcagagcaga

SEQ ID NO: 403747 - DNA, 25 bp, Mus musculus
agcagagctttgatttcctcacgga

SEQ ID NO: 403748 - DNA, 25 bp, Mus musculus
tccagacgttctcaaaggctgcttc

SEQ ID NO: 403749 - DNA, 25 bp, Mus musculus
aaggctgcttctcatgcccgaggcg

SEQ ID NO: 403750 - DNA, 25 bp, Mus musculus
agatcgagagcctgtcccgctacgt

SEQ ID NO: 403751 - DNA, 25 bp, Mus musculus
tgagaacatccacgagaacattgtg

SEQ ID NO: 403752 - DNA, 25 bp, Mus musculus
aggccttcgacatcgcagccatgtg

SEQ ID NO: 403753 - DNA, 25 bp, Mus musculus
aacattgtgcgctacgacgacgagg

SEQ ID NO: 403754 - DNA, 25 bp, Mus musculus
ccgcttccgaaaactggcagaactc

SEQ ID NO: 403755 - DNA, 25 bp, Mus musculus
acagctacgtgctggccaagctcta

SEQ ID NO: 403756 - DNA, 25 bp, Mus musculus
cccttgcctagtgtgtccgtgtgca

SEQ ID NO: 403757 - DNA, 25 bp, Mus musculus
tgtgtccgtgtgcaagccaccaaga

SEQ ID NO: 403758 - DNA, 25 bp, Mus musculus
tccagcgccaagtccagggctggtg

SEQ ID NO: 403759 - DNA, 25 bp, Mus musculus
actccagccctctctggtctgggcg

SEQ ID NO: 403760 - DNA, 25 bp, Mus musculus
gtgcaagccaccaagagagacaggt

SEQ ID NO: 403761 - DNA, 25 bp, Mus musculus
gcggcgcgcagagaacctcttgatt

SEQ ID NO: 403762 - DNA, 25 bp, Mus musculus
tctcgacgggcttaccagggcttcc

SEQ ID NO: 403763 - DNA, 25 bp, Mus musculus
gcagcgggatccagcgccaagtcca

SEQ ID NO: 403764 - DNA, 25 bp, Mus musculus
ggcgctgtctcctgccgagctcagg

SEQ ID NO: 403765 - DNA, 25 bp, Mus musculus
gagccagcgtcgctgctgcacagac

SEQ ID NO: 403766 - DNA, 25 bp, Mus musculus
ccgcctggtttttcgcgcggagcca

SEQ ID NO: 403767 - DNA, 25 bp, Mus musculus
agcctggcgtttcccaggaggtgcc

SEQ ID NO: 403768 - DNA, 25 bp, Mus musculus
cgggagcatctcgacgggcttacca

SEQ ID NO: 403769 - DNA, 25 bp, Mus musculus
cgcgcagagaacctcttgatttttt

SEQ ID NO: 403770 - DNA, 25 bp, Mus musculus
gccctccgccattgtgtccatcccc

SEQ ID NO: 403771 - DNA, 25 bp, Mus musculus
tgccagctgaacagatttcttgcgt

SEQ ID NO: 403772 - DNA, 25 bp, Mus musculus
ccctccgaagccacgtcccactgga

SEQ ID NO: 403773 - DNA, 25 bp, Mus musculus
ctgcagccctccgaagccacgtccc

SEQ ID NO: 403774 - DNA, 25 bp, Mus musculus
gccagctgaacagatttcttgcgta

SEQ ID NO: 403775 - DNA, 25 bp, Mus musculus
gccattgtgtccatcccctgcccgc

SEQ ID NO: 403776 - DNA, 25 bp, Mus musculus
tccgccattgtgtccatcccctgcc

SEQ ID NO: 403777 - DNA, 25 bp, Mus musculus
cctccgccattgtgtccatcccctg

SEQ ID NO: 403778 - DNA, 25 bp, Mus musculus
ccggcctcgcttgcttccgaaggct

SEQ ID NO: 403779 - DNA, 25 bp, Mus musculus
gccctccgaagccacgtcccactgg

SEQ ID NO: 403780 - DNA, 25 bp, Mus musculus
cagccctccgaagccacgtcccact

SEQ ID NO: 403781 - DNA, 25 bp, Mus musculus
gcagccctccgaagccacgtcccac

SEQ ID NO: 403782 - DNA, 25 bp, Mus musculus
tgcagccctccgaagccacgtccca

SEQ ID NO: 403783 - DNA, 25 bp, Mus musculus
ccagctgaacagatttcttgcgtaa

SEQ ID NO: 403784 - DNA, 25 bp, Mus musculus
agcaggctcggctctgttacgccgc

SEQ ID NO: 403785 - DNA, 25 bp, Mus musculus
ctccgaggaaccagagtcagctgcc

SEQ ID NO: 403786 - DNA, 25 bp, Mus musculus
atcgcgctcccaactcaaagcaaag

SEQ ID NO: 403787 - DNA, 25 bp, Mus musculus
ccgagcacggaaggaggacctgaac

SEQ ID NO: 403788 - DNA, 25 bp, Mus musculus
agtccaggaagaacctccagttata

SEQ ID NO: 403789 - DNA, 25 bp, Mus musculus
ccagttatatctcaggctaccgttg

SEQ ID NO: 403790 - DNA, 25 bp, Mus musculus
ctgggagcacactgaacaggaaaac

SEQ ID NO: 403791 - DNA, 25 bp, Mus musculus
tgacctctctcagcagcaggctcgg

SEQ ID NO: 403792 - DNA, 25 bp, Mus musculus
tgctcgtctctcctttggcttcagg

SEQ ID NO: 403793 - DNA, 25 bp, Mus musculus
caccggacactgagcggaagctttt

SEQ ID NO: 403794 - DNA, 25 bp, Mus musculus
cccagagacccaagcactgaaggga

SEQ ID NO: 403795 - DNA, 25 bp, Mus musculus
cccagtggccaacctcttggtgtgg

SEQ ID NO: 403796 - DNA, 25 bp, Mus musculus
gtagaccagcgagcacctggaccga

SEQ ID NO: 403797 - DNA, 25 bp, Mus musculus
gctgcagcaacgtcggaagcatccc

SEQ ID NO: 403798 - DNA, 25 bp, Mus musculus
ttcctgacagaataagatggcggcg

SEQ ID NO: 403799 - DNA, 25 bp, Mus musculus
ttctcgcgagactagggaccaggaa

SEQ ID NO: 403800 - DNA, 25 bp, Mus musculus
aagacgcctgcagagtcggctactg

SEQ ID NO: 403801 - DNA, 25 bp, Mus musculus
ccagtccggcctaggctctaggtga

SEQ ID NO: 403802 - DNA, 25 bp, Mus musculus
ctctcgggacctaacggggattcag

SEQ ID NO: 403803 - DNA, 25 bp, Mus musculus
cagtggtagcggagtaaatcctttc

SEQ ID NO: 403804 - DNA, 25 bp, Mus musculus
aatcgatgccatcgccgctcagctg

SEQ ID NO: 403805 - DNA, 25 bp, Mus musculus
ccgctcagctgttgcgcgatcaata

SEQ ID NO: 403806 - DNA, 25 bp, Mus musculus
gatcaatacttgctgaccgccctgg

SEQ ID NO: 403807 - DNA, 25 bp, Mus musculus
gcgagctaccacgactgcgcgatta

SEQ ID NO: 403808 - DNA, 25 bp, Mus musculus
tgcgcgattacttctccaatcctgg

SEQ ID NO: 403809 - DNA, 25 bp, Mus musculus
tcctggcaacttcgagaggcagagt

SEQ ID NO: 403810 - DNA, 25 bp, Mus musculus
cgaagatgggaccaagccagttctc

SEQ ID NO: 403811 - DNA, 25 bp, Mus musculus
gtcggcctagatcctggttctgcag

SEQ ID NO: 403812 - DNA, 25 bp, Mus musculus
tcgcgtcacgccagatctaaacgtt

SEQ ID NO: 403813 - DNA, 25 bp, Mus musculus
gtcgctggccgatttccgagagccc

SEQ ID NO: 403814 - DNA, 25 bp, Mus musculus
actcggaggcgaaggccaacggcct

SEQ ID NO: 403815 - DNA, 25 bp, Mus musculus
tggcgcgcaaggactaccactacct

SEQ ID NO: 403816 - DNA, 25 bp, Mus musculus
gcaacccgctggagctgcgctttct

SEQ ID NO: 403817 - DNA, 25 bp, Mus musculus
ggctgctggacctgtgcaacccgct

SEQ ID NO: 403818 - DNA, 25 bp, Mus musculus
cgccttgagttcatgtgcgggctgc

SEQ ID NO: 403819 - DNA, 25 bp, Mus musculus
atgaagctgccaccgaagtcgacgc

SEQ ID NO: 403820 - DNA, 25 bp, Mus musculus
cctcatcgtatacctagcgctgctg

SEQ ID NO: 403821 - DNA, 25 bp, Mus musculus
gcaccgccttagctgaggatgctga

SEQ ID NO: 403822 - DNA, 25 bp, Mus musculus
gggcaacgttcttgacggccgtgcc

SEQ ID NO: 403823 - DNA, 25 bp, Mus musculus
aggacgcgctcgtcgacttgctcct

SEQ ID NO: 403824 - DNA, 25 bp, Mus musculus
tctaaacgttgattggctggagtgc

SEQ ID NO: 403825 - DNA, 25 bp, Mus musculus
ggcaaacgagaagctcgcgtcacgc

SEQ ID NO: 403826 - DNA, 25 bp, Mus musculus
ttgctcggccctcggtgacctaagc

SEQ ID NO: 403827 - DNA, 25 bp, Mus musculus
agcccacgtgaccagtgccgttcag

SEQ ID NO: 403828 - DNA, 25 bp, Mus musculus
cagacagccgcaagtcggggttgcc

SEQ ID NO: 403829 - DNA, 25 bp, Mus musculus
gtcgcgcgtggtcgcggcccgcaga

SEQ ID NO: 403830 - DNA, 25 bp, Mus musculus
gtcctccggaggacgctggggtcgc

SEQ ID NO: 403831 - DNA, 25 bp, Mus musculus
gccgctcttggaggcgcggggtcct

SEQ ID NO: 403832 - DNA, 25 bp, Mus musculus
gctggagcgcatgccggccgctctt

SEQ ID NO: 403833 - DNA, 25 bp, Mus musculus
ccagctgttgctcggccctcggtga

SEQ ID NO: 403834 - DNA, 25 bp, Mus musculus
tgttgctcggccctcggtgacctaa

SEQ ID NO: 403835 - DNA, 25 bp, Mus musculus
cctaagcgcacagaagttagggcgc

SEQ ID NO: 403836 - DNA, 25 bp, Mus musculus
gtgacctaagcgcacagaagttagg

SEQ ID NO: 403837 - DNA, 25 bp, Mus musculus
tcggtgacctaagcgcacagaagtt

SEQ ID NO: 403838 - DNA, 25 bp, Mus musculus
cggattcccgcggtccagcccagct

SEQ ID NO: 403839 - DNA, 25 bp, Mus musculus
gtgaccagtgccgttcagccctggc

SEQ ID NO: 403840 - DNA, 25 bp, Mus musculus
cactgttggtgctgtccggggccct

SEQ ID NO: 403841 - DNA, 25 bp, Mus musculus
aagggacgtggagccaccgccctcg

SEQ ID NO: 403842 - DNA, 25 bp, Mus musculus
gcgatcagaccctggacggagagca

SEQ ID NO: 403843 - DNA, 25 bp, Mus musculus
gtctttgaccgccacatggcctcgt

SEQ ID NO: 403844 - DNA, 25 bp, Mus musculus
gctgtgtgcacgtctttgaccgcca

SEQ ID NO: 403845 - DNA, 25 bp, Mus musculus
ctgcttcagctgcagccgtcggaca

SEQ ID NO: 403846 - DNA, 25 bp, Mus musculus
gaagcaccggcagctgcttcagctg

SEQ ID NO: 403847 - DNA, 25 bp, Mus musculus
agacgctgctcctgaagcaccggca

SEQ ID NO: 403848 - DNA, 25 bp, Mus musculus
agcctggacaggaagacgctgctcc

SEQ ID NO: 403849 - DNA, 25 bp, Mus musculus
gctgaagaggaatctgtcggccgcc

SEQ ID NO: 403850 - DNA, 25 bp, Mus musculus
cccacgggtgaggaccaagccctgg

SEQ ID NO: 403851 - DNA, 25 bp, Mus musculus
ctgtgcacccggagcctggacagga

SEQ ID NO: 403852 - DNA, 25 bp, Mus musculus
gtgctctgcacgctggacaccacgg

SEQ ID NO: 403853 - DNA, 25 bp, Mus musculus
caactcgctgctgctgaagagaggg

SEQ ID NO: 403854 - DNA, 25 bp, Mus musculus
tatgtacttcatcacgatctcccgg

SEQ ID NO: 403855 - DNA, 25 bp, Mus musculus
cgtcaggtgcagctgactggacatc

SEQ ID NO: 403856 - DNA, 25 bp, Mus musculus
ggtaccaatggcacttcaagtcccg

SEQ ID NO: 403857 - DNA, 25 bp, Mus musculus
aaagaagctgcaggtaccaatggca

SEQ ID NO: 403858 - DNA, 25 bp, Mus musculus
tatcataccctgttctcccggcttg

SEQ ID NO: 403859 - DNA, 25 bp, Mus musculus
acgatctcccggttatcataccctg

SEQ ID NO: 403860 - DNA, 25 bp, Mus musculus
aggagacgtcctggcagccatgtcc

SEQ ID NO: 403861 - DNA, 25 bp, Mus musculus
catgtcccggtgcacagcgggcatt

SEQ ID NO: 403862 - DNA, 25 bp, Mus musculus
cagctgactggacatctctgcgaag

SEQ ID NO: 403863 - DNA, 25 bp, Mus musculus
gcattgggttgctctcaggctggaa

SEQ ID NO: 403864 - DNA, 25 bp, Mus musculus
ctctgcgaagtcacgacggtagcga

SEQ ID NO: 403865 - DNA, 25 bp, Mus musculus
cggtagcgacgagagaagtcatccc

SEQ ID NO: 403866 - DNA, 25 bp, Mus musculus
ggtcagatggaccacaggtggcaca

SEQ ID NO: 403867 - DNA, 25 bp, Mus musculus
cctctgtgacagcttataatgtatg

SEQ ID NO: 403868 - DNA, 25 bp, Mus musculus
gtcctgtgattctcccttcttctcg

SEQ ID NO: 403869 - DNA, 25 bp, Mus musculus
cttgcacacacacgctggagcgcag

SEQ ID NO: 403870 - DNA, 25 bp, Mus musculus
gagcgcaggcatggatccgtatcca

SEQ ID NO: 403871 - DNA, 25 bp, Mus musculus
tggatccgtatccaccggaccgctt

SEQ ID NO: 403872 - DNA, 25 bp, Mus musculus
cctccagggcagagagacacgccaa

SEQ ID NO: 403873 - DNA, 25 bp, Mus musculus
cgggaccggaatcctcttctgatta

SEQ ID NO: 403874 - DNA, 25 bp, Mus musculus
tccgaagggccaacgcgctttccga

SEQ ID NO: 403875 - DNA, 25 bp, Mus musculus
agcatttgcagaagtcctgtgattc

SEQ ID NO: 403876 - DNA, 25 bp, Mus musculus
ttgctaaatgcaggcacggacgcgc

SEQ ID NO: 403877 - DNA, 25 bp, Mus musculus
tcctaaaaaggatgactgctacgaa

SEQ ID NO: 403878 - DNA, 25 bp, Mus musculus
tctgattaaactccgaagggccaac

SEQ ID NO: 403879 - DNA, 25 bp, Mus musculus
acaatttttcagtccagcatttgca

SEQ ID NO: 403880 - DNA, 25 bp, Mus musculus
ccttcttctcggcaatttacacttg

SEQ ID NO: 403881 - DNA, 25 bp, Mus musculus
cggcggcagatgaattacaattttt

SEQ ID NO: 403882 - DNA, 25 bp, Mus musculus
gccttctccacgacactgccctgta

SEQ ID NO: 403883 - DNA, 25 bp, Mus musculus
tgggagatcacatgcaccagcagcc

SEQ ID NO: 403884 - DNA, 25 bp, Mus musculus
cgagcgactactgggagatcacatg

SEQ ID NO: 403885 - DNA, 25 bp, Mus musculus
cagcaacatctctgccgagcgacta

SEQ ID NO: 403886 - DNA, 25 bp, Mus musculus
gacaccatgtagaggagcagcacga

SEQ ID NO: 403887 - DNA, 25 bp, Mus musculus
tgggactgatgagcggcgacaccat

SEQ ID NO: 403888 - DNA, 25 bp, Mus musculus
aggaggccactcaccactacgtgcg

SEQ ID NO: 403889 - DNA, 25 bp, Mus musculus
gggcaagctcagcaacaggaggcca

SEQ ID NO: 403890 - DNA, 25 bp, Mus musculus
gcagtcctgggcaagctcagcaaca

SEQ ID NO: 403891 - DNA, 25 bp, Mus musculus
cgtggtctcgttggcccaagccggc

SEQ ID NO: 403892 - DNA, 25 bp, Mus musculus
catgcaccagcagccgggagtgttt

SEQ ID NO: 403893 - DNA, 25 bp, Mus musculus
tctccgctgtcggactagctcctgg

SEQ ID NO: 403894 - DNA, 25 bp, Mus musculus
ccaacgtcgtgggaggcttgcaaac

SEQ ID NO: 403895 - DNA, 25 bp, Mus musculus
caagccggccaagcagtcctgggca

SEQ ID NO: 403896 - DNA, 25 bp, Mus musculus
aatgagaacaggaagccgagatgcg

SEQ ID NO: 403897 - DNA, 25 bp, Mus musculus
cgcacaaaacttccgtaatttcgag

SEQ ID NO: 403898 - DNA, 25 bp, Mus musculus
gccacaaatgaactctcgcgaaatg

SEQ ID NO: 403899 - DNA, 25 bp, Mus musculus
tccggctctccagaggggcccagag

SEQ ID NO: 403900 - DNA, 25 bp, Mus musculus
accgcggtacctgcaggttggtgtt

SEQ ID NO: 403901 - DNA, 25 bp, Mus musculus
tacctgcaggttggtgttcgtggac

SEQ ID NO: 403902 - DNA, 25 bp, Mus musculus
ttcgtggacgccatggtggagatcc

SEQ ID NO: 403903 - DNA, 25 bp, Mus musculus
tactacagacaaggcccgcagcagc

SEQ ID NO: 403904 - DNA, 25 bp, Mus musculus
gggtcaccaccgcaaaccgtgcgga

SEQ ID NO: 403905 - DNA, 25 bp, Mus musculus
ctccggagccgtaaatccagcagga

SEQ ID NO: 403906 - DNA, 25 bp, Mus musculus
cgtaaatccagcaggaactccagca

SEQ ID NO: 403907 - DNA, 25 bp, Mus musculus
tctcgcgaaatgagaacaggaagcc

SEQ ID NO: 403908 - DNA, 25 bp, Mus musculus
accagtcacccaggatgcgtttcgc

SEQ ID NO: 403909 - DNA, 25 bp, Mus musculus
ccaggatgcgtttcgccacaaatga

SEQ ID NO: 403910 - DNA, 25 bp, Mus musculus
gcgcgcatgccgactaagcgtctct

SEQ ID NO: 403911 - DNA, 25 bp, Mus musculus
aagcgtctctctcttggcaatctta

SEQ ID NO: 403912 - DNA, 25 bp, Mus musculus
ggcaatcttagccaacagcgctttc

SEQ ID NO: 403913 - DNA, 25 bp, Mus musculus
cagcgctttctgtttctccaggagg

SEQ ID NO: 403914 - DNA, 25 bp, Mus musculus
ggtcctgaagtctctgtagcctctc

SEQ ID NO: 403915 - DNA, 25 bp, Mus musculus
cctctcagacaaggtgccagtggta

SEQ ID NO: 403916 - DNA, 25 bp, Mus musculus
cggcgatctgcatctccctctaatg

SEQ ID NO: 403917 - DNA, 25 bp, Mus musculus
gctccggacttggtaccctagactg

SEQ ID NO: 403918 - DNA, 25 bp, Mus musculus
ataatgatggcccttttcgtcccta

SEQ ID NO: 403919 - DNA, 25 bp, Mus musculus
gagcgggaccctagcattcaatgac

SEQ ID NO: 403920 - DNA, 25 bp, Mus musculus
cccggcgctcatagctgggagcaca

SEQ ID NO: 403921 - DNA, 25 bp, Mus musculus
cccttgccaagtgcgcattctttta

SEQ ID NO: 403922 - DNA, 25 bp, Mus musculus
aaacgccatggtttcaggtgcctga

SEQ ID NO: 403923 - DNA, 25 bp, Mus musculus
tcccaagttactgcgtgttgtgttg

SEQ ID NO: 403924 - DNA, 25 bp, Mus musculus
tcgccagaaagctctcccgcggtct

SEQ ID NO: 403925 - DNA, 25 bp, Mus musculus
ctcctcttctctggaactagcgctt

SEQ ID NO: 403926 - DNA, 25 bp, Mus musculus
tggaactagcgctttcccacgccat

SEQ ID NO: 403927 - DNA, 25 bp, Mus musculus
tacgacgcacgttacgggcgctgtc

SEQ ID NO: 403928 - DNA, 25 bp, Mus musculus
gctcacccttcaagttcagctaagt

SEQ ID NO: 403929 - DNA, 25 bp, Mus musculus
tcagctaagtctcacctaaagcttt

SEQ ID NO: 403930 - DNA, 25 bp, Mus musculus
cctaaagcttttcttgccgagtttg

SEQ ID NO: 403931 - DNA, 25 bp, Mus musculus
cgctgcgggaaccttgtgatactcc

SEQ ID NO: 403932 - DNA, 25 bp, Mus musculus
ctctgcgcccgggatccggaggctt

SEQ ID NO: 403933 - DNA, 25 bp, Mus musculus
atactccgcttcagcggctgttgcg

SEQ ID NO: 403934 - DNA, 25 bp, Mus musculus
acgcctctccgccatcctctcccgg

SEQ ID NO: 403935 - DNA, 25 bp, Mus musculus
gggatccaagctctgaccttccctg

SEQ ID NO: 403936 - DNA, 25 bp, Mus musculus
gggaaccttgtgatactccgcttca

SEQ ID NO: 403937 - DNA, 25 bp, Mus musculus
ggatccggaggcttctcacgcctct

SEQ ID NO: 403938 - DNA, 25 bp, Mus musculus
cagattcggattctccagagcagga

SEQ ID NO: 403939 - DNA, 25 bp, Mus musculus
cttcctgtttgctggaagtcctggc

SEQ ID NO: 403940 - DNA, 25 bp, Mus musculus
accggccgcttcctgtttgctggaa

SEQ ID NO: 403941 - DNA, 25 bp, Mus musculus
gagacggcgcgaaaccggccgcttc

SEQ ID NO: 403942 - DNA, 25 bp, Mus musculus
tgcgtcgcggccgagacctgcttgc

SEQ ID NO: 403943 - DNA, 25 bp, Mus musculus
ttcgtcgtactcgtgacagcgccga

SEQ ID NO: 403944 - DNA, 25 bp, Mus musculus
ccgctccgaggactttcgtcgtact

SEQ ID NO: 403945 - DNA, 25 bp, Mus musculus
tgtctctgtgccgagccttccgtga

SEQ ID NO: 403946 - DNA, 25 bp, Mus musculus
acgacgcggagctgctccagtgcca

SEQ ID NO: 403947 - DNA, 25 bp, Mus musculus
agggctggacagattcggattctcc

SEQ ID NO: 403948 - DNA, 25 bp, Mus musculus
tcggtttaacatggcggagacggtc

SEQ ID NO: 403949 - DNA, 25 bp, Mus musculus
cacggcgagcgctttcggtttaaca

SEQ ID NO: 403950 - DNA, 25 bp, Mus musculus
ggatgctcgacttcctctgcctgtc

SEQ ID NO: 403951 - DNA, 25 bp, Mus musculus
gcgagcaaatcagcgcacggcgcca

SEQ ID NO: 403952 - DNA, 25 bp, Mus musculus
tctgatccagggaggcgtgtccaga

SEQ ID NO: 403953 - DNA, 25 bp, Mus musculus
tacggaagccaagagctccgcacgc

SEQ ID NO: 403954 - DNA, 25 bp, Mus musculus
tgctcctctgggtgcggagtctcct

SEQ ID NO: 403955 - DNA, 25 bp, Mus musculus
tccgcccgtgtgctgccagggactg

SEQ ID NO: 403956 - DNA, 25 bp, Mus musculus
gctgggtctcctcagctcgggcgtc

SEQ ID NO: 403957 - DNA, 25 bp, Mus musculus
ggcttccctagagcgcgtgctttcc

SEQ ID NO: 403958 - DNA, 25 bp, Mus musculus
agtctccgctgctcctctgggtgcg

SEQ ID NO: 403959 - DNA, 25 bp, Mus musculus
cggagtctcctcagggccggatctc

SEQ ID NO: 403960 - DNA, 25 bp, Mus musculus
tctcggggatggagactcagacaca

SEQ ID NO: 403961 - DNA, 25 bp, Mus musculus
gggtgatctccaggcgctgtcttca

SEQ ID NO: 403962 - DNA, 25 bp, Mus musculus
ctgtcttcagcgcagcgacggtgac

SEQ ID NO: 403963 - DNA, 25 bp, Mus musculus
taaggcctgatgctgcctagaccgg

SEQ ID NO: 403964 - DNA, 25 bp, Mus musculus
cgggcctacggaagccaagagctcc

SEQ ID NO: 403965 - DNA, 25 bp, Mus musculus
cgacggtgacctaaggcctgatgct

SEQ ID NO: 403966 - DNA, 25 bp, Mus musculus
caagagcagcgagtcggaccgaagc

SEQ ID NO: 403967 - DNA, 25 bp, Mus musculus
cgcacagatcggcaaaggacggagt

SEQ ID NO: 403968 - DNA, 25 bp, Mus musculus
cggaggtcaagggttccataattca

SEQ ID NO: 403969 - DNA, 25 bp, Mus musculus
aagcggtactagcttccctcttcca

SEQ ID NO: 403970 - DNA, 25 bp, Mus musculus
tcgcatccctcgctcaaaagcggta

SEQ ID NO: 403971 - DNA, 25 bp, Mus musculus
aggtaggcaatcaggcggcctctga

SEQ ID NO: 403972 - DNA, 25 bp, Mus musculus
tgccgcagtcggaaggaataccagg

SEQ ID NO: 403973 - DNA, 25 bp, Mus musculus
tagacaccatacctgagccttgccg

SEQ ID NO: 403974 - DNA, 25 bp, Mus musculus
cagggtgtcgctcaccttctgcgct

SEQ ID NO: 403975 - DNA, 25 bp, Mus musculus
aggttcagctctagtccgcgacccg

SEQ ID NO: 403976 - DNA, 25 bp, Mus musculus
tcggaccgaagcctccaggttcagc

SEQ ID NO: 403977 - DNA, 25 bp, Mus musculus
ccataattcagcagcctgagttgca

SEQ ID NO: 403978 - DNA, 25 bp, Mus musculus
ttctgcgctgcctctagacaccata

SEQ ID NO: 403979 - DNA, 25 bp, Mus musculus
agagccaaggcggacacgccgcagt

SEQ ID NO: 403980 - DNA, 25 bp, Mus musculus
agcaccgccgaagaagtacgaccca

SEQ ID NO: 403981 - DNA, 25 bp, Mus musculus
aagtagcggactcgctcgcaacgcc

SEQ ID NO: 403982 - DNA, 25 bp, Mus musculus
tcttgcccagaatcccgacggcagg

SEQ ID NO: 403983 - DNA, 25 bp, Mus musculus
gcatctccggaaacagccctacgta

SEQ ID NO: 403984 - DNA, 25 bp, Mus musculus
ggccggctgataggcagctccaatt

SEQ ID NO: 403985 - DNA, 25 bp, Mus musculus
gtggggattcgcagataggcatcta

SEQ ID NO: 403986 - DNA, 25 bp, Mus musculus
ccttagggacacttggctcgtagaa

SEQ ID NO: 403987 - DNA, 25 bp, Mus musculus
gtacgacccacaaacaagtagcgga

SEQ ID NO: 403988 - DNA, 25 bp, Mus musculus
acaatcagtcagcaccggagcaccg

SEQ ID NO: 403989 - DNA, 25 bp, Mus musculus
gcgctggctgccctacaatcagtca

SEQ ID NO: 403990 - DNA, 25 bp, Mus musculus
tctcgctcacagacatggcgctggc

SEQ ID NO: 403991 - DNA, 25 bp, Mus musculus
gctccacgaagatctcgctcacaga

SEQ ID NO: 403992 - DNA, 25 bp, Mus musculus
cggatgtcctgctcggcagccaaaa

SEQ ID NO: 403993 - DNA, 25 bp, Mus musculus
taggcatctaggaaaacagccggtt

SEQ ID NO: 403994 - DNA, 25 bp, Mus musculus
tgacttgttcgggttctccagcatg

SEQ ID NO: 403995 - DNA, 25 bp, Mus musculus
acgcagatccaagggcgcacgaaga

SEQ ID NO: 403996 - DNA, 25 bp, Mus musculus
cacttccgaaggctccgcgtggatt

SEQ ID NO: 403997 - DNA, 25 bp, Mus musculus
gctcgagctgcctcaattctagaca

SEQ ID NO: 403998 - DNA, 25 bp, Mus musculus
ggctggctcgggagccaacctctca

SEQ ID NO: 403999 - DNA, 25 bp, Mus musculus
tttgagaaggctctgacgcagatcc

SEQ ID NO: 404000 - DNA, 25 bp, Mus musculus
acccgcaggaagactcgcagtttga

SEQ ID NO: 404001 - DNA, 25 bp, Mus musculus
cgagtctggcattgaacccgcagga

SEQ ID NO: 404002 - DNA, 25 bp, Mus musculus
tccagcatggctgggttagcaggcc

SEQ ID NO: 404003 - DNA, 25 bp, Mus musculus
aggctccgcgtggattgacttgttc

SEQ ID NO: 404004 - DNA, 25 bp, Mus musculus
gacgcgaaggaaacgtcacttccga

SEQ ID NO: 404005 - DNA, 25 bp, Mus musculus
acttccgcttccgagacgcgaagga

SEQ ID NO: 404006 - DNA, 25 bp, Mus musculus
cggggcctgctcttttgctacactt

SEQ ID NO: 404007 - DNA, 25 bp, Mus musculus
agccaacctctcacgggctgggaga

SEQ ID NO: 404008 - DNA, 25 bp, Mus musculus
tttcactgaagtcgcccggtaaata

SEQ ID NO: 404009 - DNA, 25 bp, Mus musculus
taaaacctgggcttccggtagcagc

SEQ ID NO: 404010 - DNA, 25 bp, Mus musculus
ggcgacgttgttgtgaaggaactta

SEQ ID NO: 404011 - DNA, 25 bp, Mus musculus
acttagaaaagaaactggcacactc

SEQ ID NO: 404012 - DNA, 25 bp, Mus musculus
gaaactggcacactctcacaccaat

SEQ ID NO: 404013 - DNA, 25 bp, Mus musculus
gccctggctcgctaaagcgcgaaga

SEQ ID NO: 404014 - DNA, 25 bp, Mus musculus
tcgctaaagcgcgaagaacggttta

SEQ ID NO: 404015 - DNA, 25 bp, Mus musculus
cttccggtagcagcgcttgtacgca

SEQ ID NO: 404016 - DNA, 25 bp, Mus musculus
gcagcgcttgtacgcatattcagga

SEQ ID NO: 404017 - DNA, 25 bp, Mus musculus
tgtacgcatattcaggacaagccca

SEQ ID NO: 404018 - DNA, 25 bp, Mus musculus
tattcaggacaagcccaacgcgctg

SEQ ID NO: 404019 - DNA, 25 bp, Mus musculus
ggggccaatttctttcactgaagtc

SEQ ID NO: 404020 - DNA, 25 bp, Mus musculus
tgaagtcgcccggtaaatagcgggc

SEQ ID NO: 404021 - DNA, 25 bp, Mus musculus
aacgcgctgtcagctacgggaagtc

SEQ ID NO: 404022 - DNA, 25 bp, Mus musculus
gtgaataatagaactgtaagtaccg

SEQ ID NO: 404023 - DNA, 25 bp, Mus musculus
gccgctctggggtgcacttttgggg

SEQ ID NO: 404024 - DNA, 25 bp, Mus musculus
tgtccagtgctgtcagccgctctgg

SEQ ID NO: 404025 - DNA, 25 bp, Mus musculus
acggtgtccagtgctgtcagccgct

SEQ ID NO: 404026 - DNA, 25 bp, Mus musculus
cctgcttcttttccgagcggcggcg

SEQ ID NO: 404027 - DNA, 25 bp, Mus musculus
gggccctgcttcttttccgagcggc

SEQ ID NO: 404028 - DNA, 25 bp, Mus musculus
cactggagggccctgcttcttttcc

SEQ ID NO: 404029 - DNA, 25 bp, Mus musculus
gagtccactggagggccctgcttct

SEQ ID NO: 404030 - DNA, 25 bp, Mus musculus
atggagtccactggagggccctgct

SEQ ID NO: 404031 - DNA, 25 bp, Mus musculus
agaatgctcagaatggagtccactg

SEQ ID NO: 404032 - DNA, 25 bp, Mus musculus
cgaagaatgctcagaatggagtcca

SEQ ID NO: 404033 - DNA, 25 bp, Mus musculus
tttaagacgaagaatgctcagaatg

SEQ ID NO: 404034 - DNA, 25 bp, Mus musculus
ccgggtttaagacgaagaatgctca

SEQ ID NO: 404035 - DNA, 25 bp, Mus musculus
atctgggtgaggacccaggacgcgc

SEQ ID NO: 404036 - DNA, 25 bp, Mus musculus
gtggctgtccggtccgcagccgcaa

SEQ ID NO: 404037 - DNA, 25 bp, Mus musculus
cgcaccaagcgcttaacctcattgg

SEQ ID NO: 404038 - DNA, 25 bp, Mus musculus
tgcgcaggcgcattttggtttttca

SEQ ID NO: 404039 - DNA, 25 bp, Mus musculus
cacagggagacctctctgcgcaggc

SEQ ID NO: 404040 - DNA, 25 bp, Mus musculus
cggtaagaggacacagggagacctc

SEQ ID NO: 404041 - DNA, 25 bp, Mus musculus
tacagtctctatggttcagcccggc

SEQ ID NO: 404042 - DNA, 25 bp, Mus musculus
ctgggctgagattacagtctctatg

SEQ ID NO: 404043 - DNA, 25 bp, Mus musculus
tagagaggaagccacctctctgggc

SEQ ID NO: 404044 - DNA, 25 bp, Mus musculus
cgttaccatagagaggaagccacct

SEQ ID NO: 404045 - DNA, 25 bp, Mus musculus
ccagcgctgggcgttaccatagaga

SEQ ID NO: 404046 - DNA, 25 bp, Mus musculus
gcggcgggacctgaaacttcatgcg

SEQ ID NO: 404047 - DNA, 25 bp, Mus musculus
ccattcgggtcaaaggcaaaggcgg

SEQ ID NO: 404048 - DNA, 25 bp, Mus musculus
cgggtcgccattcgggtcaaaggca

SEQ ID NO: 404049 - DNA, 25 bp, Mus musculus
cttaacctcattggggtggaggaga

SEQ ID NO: 404050 - DNA, 25 bp, Mus musculus
aaggccgcgcgtcacaagtctgaaa

SEQ ID NO: 404051 - DNA, 25 bp, Mus musculus
caccgctgacgctgtgcttctttgc

SEQ ID NO: 404052 - DNA, 25 bp, Mus musculus
gcccggcagccagaaagctctaagt

SEQ ID NO: 404053 - DNA, 25 bp, Mus musculus
cctgcccggtgtacagtattttctt

SEQ ID NO: 404054 - DNA, 25 bp, Mus musculus
cgactgctgcttcccacgtcgaata

SEQ ID NO: 404055 - DNA, 25 bp, Mus musculus
ctcccaaggggctttctgaagcctg

SEQ ID NO: 404056 - DNA, 25 bp, Mus musculus
agcctgcttgtctttacccagaagg

SEQ ID NO: 404057 - DNA, 25 bp, Mus musculus
aatttgcatacacgcctttctgggc

SEQ ID NO: 404058 - DNA, 25 bp, Mus musculus
agtaggctcctctaggtcgtgctgc

SEQ ID NO: 404059 - DNA, 25 bp, Mus musculus
tgctgcttcagtggagttccgcttc

SEQ ID NO: 404060 - DNA, 25 bp, Mus musculus
tccgcttcggcgagtttttcttcca

SEQ ID NO: 404061 - DNA, 25 bp, Mus musculus
gtgccgagtaccctttcctgaccag

SEQ ID NO: 404062 - DNA, 25 bp, Mus musculus
gggtgcgacctggtaaatttgcata

SEQ ID NO: 404063 - DNA, 25 bp, Mus musculus
ggggaccagctatgtcagcgccatc

SEQ ID NO: 404064 - DNA, 25 bp, Mus musculus
actctggcagctacttgcggtaaga

SEQ ID NO: 404065 - DNA, 25 bp, Mus musculus
acgcccacctgacggcctataaaag

SEQ ID NO: 404066 - DNA, 25 bp, Mus musculus
ggccgcagcccactcaggttcgagt

SEQ ID NO: 404067 - DNA, 25 bp, Mus musculus
tcaggttcgagtgggtgctgcttaa

SEQ ID NO: 404068 - DNA, 25 bp, Mus musculus
tgcggaagcctcagccatgctgttc

SEQ ID NO: 404069 - DNA, 25 bp, Mus musculus
gaacactacaaccagcacaactctg

SEQ ID NO: 404070 - DNA, 25 bp, Mus musculus
aggtttccttgccactcgctgtgtc

SEQ ID NO: 404071 - DNA, 25 bp, Mus musculus
tgcggtaagacgtggcaacacctgc

SEQ ID NO: 404072 - DNA, 25 bp, Mus musculus
acacctgcctacgatcggggtccga

SEQ ID NO: 404073 - DNA, 25 bp, Mus musculus
gggtccgagcgctgactaacctcag

SEQ ID NO: 404074 - DNA, 25 bp, Mus musculus
taacctcaggcctccagagaagggc

SEQ ID NO: 404075 - DNA, 25 bp, Mus musculus
ggctgcttcttcgaggtttccttgc

SEQ ID NO: 404076 - DNA, 25 bp, Mus musculus
tagggacggccctgcaataaccacg

SEQ ID NO: 404077 - DNA, 25 bp, Mus musculus
gctgttctggcacacgcagcccgaa

SEQ ID NO: 404078 - DNA, 25 bp, Mus musculus
cataggagtctgctgagctggcgtt

SEQ ID NO: 404079 - DNA, 25 bp, Mus musculus
tctgtacgtgcaggccacgccgatc

SEQ ID NO: 404080 - DNA, 25 bp, Mus musculus
cagggtggcagtgaacctggattca

SEQ ID NO: 404081 - DNA, 25 bp, Mus musculus
cctggattcatgttgtgggtactgt

SEQ ID NO: 404082 - DNA, 25 bp, Mus musculus
tgggtactgtggaaacgttgcactc

SEQ ID NO: 404083 - DNA, 25 bp, Mus musculus
cgttgcactcgaggcagaataaggg

SEQ ID NO: 404084 - DNA, 25 bp, Mus musculus
acctgcgtagccatggccatgacca

SEQ ID NO: 404085 - DNA, 25 bp, Mus musculus
ccatgaccatggctataggtaggcc

SEQ ID NO: 404086 - DNA, 25 bp, Mus musculus
tataggtaggcccatcgctgccacg

SEQ ID NO: 404087 - DNA, 25 bp, Mus musculus
caccaggaagtgcacgctcaggagc

SEQ ID NO: 404088 - DNA, 25 bp, Mus musculus
ctcaggagcatccagcaaggccagg

SEQ ID NO: 404089 - DNA, 25 bp, Mus musculus
gccaggcgggtacgaaggcttacac

SEQ ID NO: 404090 - DNA, 25 bp, Mus musculus
cacgcaggttgtactgctgcgcagg

SEQ ID NO: 404091 - DNA, 25 bp, Mus musculus
aggcttacacgatcgaggcccggca

SEQ ID NO: 404092 - DNA, 25 bp, Mus musculus
ctacacctgaggctcgtgcggatgg

SEQ ID NO: 404093 - DNA, 25 bp, Mus musculus
agagcctcgggtttctgttctccgg

SEQ ID NO: 404094 - DNA, 25 bp, Mus musculus
acggtgggctacacctgaggctcgt

SEQ ID NO: 404095 - DNA, 25 bp, Mus musculus
gcttcccacggtgggctacacctga

SEQ ID NO: 404096 - DNA, 25 bp, Mus musculus
agacccatccagtggcggcggaatc

SEQ ID NO: 404097 - DNA, 25 bp, Mus musculus
gcgcctcaggtgaccgggacttctc

SEQ ID NO: 404098 - DNA, 25 bp, Mus musculus
agttcctcaggcagctggcgcctca

SEQ ID NO: 404099 - DNA, 25 bp, Mus musculus
tgtccgcgggagttcctcaggcagc

SEQ ID NO: 404100 - DNA, 25 bp, Mus musculus
tcgcctcaggtttgttgggtgtgcg

SEQ ID NO: 404101 - DNA, 25 bp, Mus musculus
gagcctggccatgtgaaccgcccgt

SEQ ID NO: 404102 - DNA, 25 bp, Mus musculus
gcgcccggagcctggccatgtgaac

SEQ ID NO: 404103 - DNA, 25 bp, Mus musculus
agtctcctccctcctggcgcccgga

SEQ ID NO: 404104 - DNA, 25 bp, Mus musculus
taggacccagattcggatcggggcc

SEQ ID NO: 404105 - DNA, 25 bp, Mus musculus
cgctaggacccagattcggatcggg

SEQ ID NO: 404106 - DNA, 25 bp, Mus musculus
ggcgaacgccggcactcatgcaatc

SEQ ID NO: 404107 - DNA, 25 bp, Mus musculus
gtccctaaggacaccaggccagcag

SEQ ID NO: 404108 - DNA, 25 bp, Mus musculus
ctccgggcggctgcgatgctacgca

SEQ ID NO: 404109 - DNA, 25 bp, Mus musculus
tgcgatgctacgcacgacccgtgct

SEQ ID NO: 404110 - DNA, 25 bp, Mus musculus
ctcctcctcgaagtctcattgatga

SEQ ID NO: 404111 - DNA, 25 bp, Mus musculus
ctcattgatgagaggagtttgaaaa

SEQ ID NO: 404112 - DNA, 25 bp, Mus musculus
aaaaagtccgcggagccgtgctgcc

SEQ ID NO: 404113 - DNA, 25 bp, Mus musculus
gactcgggcagtccctaaggacacc

SEQ ID NO: 404114 - DNA, 25 bp, Mus musculus
gatcgtcgcgtccttagcttgcccg

SEQ ID NO: 404115 - DNA, 25 bp, Mus musculus
ggcactcatgcaatccatcagcgtc

SEQ ID NO: 404116 - DNA, 25 bp, Mus musculus
atccatcagcgtctctgggatggcg

SEQ ID NO: 404117 - DNA, 25 bp, Mus musculus
tgagcttgggcaaaccctgatcgtc

SEQ ID NO: 404118 - DNA, 25 bp, Mus musculus
gcaaaccctgatcgtcgcgtcctta

SEQ ID NO: 404119 - DNA, 25 bp, Mus musculus
agccgtgctgcctcggctggcgaac

SEQ ID NO: 404120 - DNA, 25 bp, Mus musculus
agccgccagaaaatggatggagccc

SEQ ID NO: 404121 - DNA, 25 bp, Mus musculus
ctgtcgtagtcgaagcagcagtccc

SEQ ID NO: 404122 - DNA, 25 bp, Mus musculus
tgagacggcaggcttggtcacagaa

SEQ ID NO: 404123 - DNA, 25 bp, Mus musculus
ctgggcacgccctgtcgtagtcgaa

SEQ ID NO: 404124 - DNA, 25 bp, Mus musculus
tggtcacagaagcatgttccataga

SEQ ID NO: 404125 - DNA, 25 bp, Mus musculus
agagcgcacagcaccatccacaggg

SEQ ID NO: 404126 - DNA, 25 bp, Mus musculus
accatccacagggtcttcatggcca

SEQ ID NO: 404127 - DNA, 25 bp, Mus musculus
ttcatggccagagctgccgcgacac

SEQ ID NO: 404128 - DNA, 25 bp, Mus musculus
cgacacttgcgaacggacccagcta

SEQ ID NO: 404129 - DNA, 25 bp, Mus musculus
gacccagctagagcctcgggcaaga

SEQ ID NO: 404130 - DNA, 25 bp, Mus musculus
tcgggcaagagctcggctcctccga

SEQ ID NO: 404131 - DNA, 25 bp, Mus musculus
aactctgcctccttaggtctgggga

SEQ ID NO: 404132 - DNA, 25 bp, Mus musculus
cgcggtagcccgtgcctgtttgcac

SEQ ID NO: 404133 - DNA, 25 bp, Mus musculus
tgtttgcacccggaaagccgccaga

SEQ ID NO: 404134 - DNA, 25 bp, Mus musculus
tggagtttggcagatccgcagatgc

SEQ ID NO: 404135 - DNA, 25 bp, Mus musculus
caagccctgttcacacgcaggcaga

SEQ ID NO: 404136 - DNA, 25 bp, Mus musculus
gtgaagggaaaacaagccctgttca

SEQ ID NO: 404137 - DNA, 25 bp, Mus musculus
ggaagtgcttcacaaaaacggagcc

SEQ ID NO: 404138 - DNA, 25 bp, Mus musculus
cgccaacagaaggaagtgcttcaca

SEQ ID NO: 404139 - DNA, 25 bp, Mus musculus
cccaaagcgccaacagaaggaagtg

SEQ ID NO: 404140 - DNA, 25 bp, Mus musculus
tgaatattcccaaagcgccaacaga

SEQ ID NO: 404141 - DNA, 25 bp, Mus musculus
ctgtgcaagccaggaatgaatattc

SEQ ID NO: 404142 - DNA, 25 bp, Mus musculus
accaacgcggctgtgcaagccagga

SEQ ID NO: 404143 - DNA, 25 bp, Mus musculus
ccaactgtcaaccaacgcggctgtg

SEQ ID NO: 404144 - DNA, 25 bp, Mus musculus
atgccctaattaagccgcgggtacg

SEQ ID NO: 404145 - DNA, 25 bp, Mus musculus
tccgcagatgccctaattaagccgc

SEQ ID NO: 404146 - DNA, 25 bp, Mus musculus
ggcagatccgcagatgccctaatta

SEQ ID NO: 404147 - DNA, 25 bp, Mus musculus
ttcacacgcaggcagacagcagccg

SEQ ID NO: 404148 - DNA, 25 bp, Mus musculus
cagcgcgtcacccggcaaagttgtc

SEQ ID NO: 404149 - DNA, 25 bp, Mus musculus
gggcgcctaggcatctgcagcctgc

SEQ ID NO: 404150 - DNA, 25 bp, Mus musculus
tgtctcttctgcctgccgcggcagt

SEQ ID NO: 404151 - DNA, 25 bp, Mus musculus
cgcgctcccactggcacacgctgca

SEQ ID NO: 404152 - DNA, 25 bp, Mus musculus
ccagaatcgagtgccctggctcgcg

SEQ ID NO: 404153 - DNA, 25 bp, Mus musculus
tggcggccaaaagtctctctgtgtc

SEQ ID NO: 404154 - DNA, 25 bp, Mus musculus
cctgccgcggcagtggcggccaaaa

SEQ ID NO: 404155 - DNA, 25 bp, Mus musculus
gtggcagggcccttctcgccgctgt

SEQ ID NO: 404156 - DNA, 25 bp, Mus musculus
ttcttacaggaggtgccgagccctc

SEQ ID NO: 404157 - DNA, 25 bp, Mus musculus
gctgcgcgggcccttcttacaggag

SEQ ID NO: 404158 - DNA, 25 bp, Mus musculus
gcggtgatgggcaggtccttctccc

SEQ ID NO: 404159 - DNA, 25 bp, Mus musculus
cctgtcgctgctcgcagcgaggaca

SEQ ID NO: 404160 - DNA, 25 bp, Mus musculus
actgaagcgaaggtgccggagaccc

SEQ ID NO: 404161 - DNA, 25 bp, Mus musculus
ctctggagactgaagcgaaggtgcc

SEQ ID NO: 404162 - DNA, 25 bp, Mus musculus
cccagtcgatttgtcattgaggagt

SEQ ID NO: 404163 - DNA, 25 bp, Mus musculus
gaactaggaggcctgcaatcgcgcg

SEQ ID NO: 404164 - DNA, 25 bp, Mus musculus
gcgtactcacttccctatcctaggg

SEQ ID NO: 404165 - DNA, 25 bp, Mus musculus
tgtccttcatgagacgtgtccctcc

SEQ ID NO: 404166 - DNA, 25 bp, Mus musculus
ctgcggggcacagcatccttacctg

SEQ ID NO: 404167 - DNA, 25 bp, Mus musculus
cagtccggggcgttgtccttcatga

SEQ ID NO: 404168 - DNA, 25 bp, Mus musculus
caatcgcgcggagagcgtactcact

SEQ ID NO: 404169 - DNA, 25 bp, Mus musculus
ctggctatgcgcacaaccagaatcg

SEQ ID NO: 404170 - DNA, 25 bp, Mus musculus
tcccaacgtggaactaggaggcctg

SEQ ID NO: 404171 - DNA, 25 bp, Mus musculus
ccaatgagaaaacacattgagtgtg

SEQ ID NO: 404172 - DNA, 25 bp, Mus musculus
tttgtcattgaggagtggtgagctc

SEQ ID NO: 404173 - DNA, 25 bp, Mus musculus
gaggccacgcctattgaccaatccg

SEQ ID NO: 404174 - DNA, 25 bp, Mus musculus
cgcctattgaccaatccgaagaggt

SEQ ID NO: 404175 - DNA, 25 bp, Mus musculus
ggtacttccaaaccttcaccaatga

SEQ ID NO: 404176 - DNA, 25 bp, Mus musculus
ccaggaagcgtcctccgaaggtctc

SEQ ID NO: 404177 - DNA, 25 bp, Mus musculus
ttccatccgtgctgggcagtcacag

SEQ ID NO: 404178 - DNA, 25 bp, Mus musculus
cttcgcgccgaacccagggtcaaag

SEQ ID NO: 404179 - DNA, 25 bp, Mus musculus
agggtcaaagccactgctcctcgcg

SEQ ID NO: 404180 - DNA, 25 bp, Mus musculus
gcagtcacagttaccggcgcgctct

SEQ ID NO: 404181 - DNA, 25 bp, Mus musculus
cctgccgggaggatgtgagctcact

SEQ ID NO: 404182 - DNA, 25 bp, Mus musculus
tcggcctcgtggctgcgaaatgaag

SEQ ID NO: 404183 - DNA, 25 bp, Mus musculus
tggagcctctaacacgcagcgggcg

SEQ ID NO: 404184 - DNA, 25 bp, Mus musculus
agctgcggtctggagcctctaacac

SEQ ID NO: 404185 - DNA, 25 bp, Mus musculus
cgtgactgctcgcacgtgttccggc

SEQ ID NO: 404186 - DNA, 25 bp, Mus musculus
gtaggcaccgtaccgttcgcggcca

SEQ ID NO: 404187 - DNA, 25 bp, Mus musculus
cgtgagcatccactgaagcctgagc

SEQ ID NO: 404188 - DNA, 25 bp, Mus musculus
cggggccagacaacgcgctgctctt

SEQ ID NO: 404189 - DNA, 25 bp, Mus musculus
aatgaaggcagacggcgtgagcatc

SEQ ID NO: 404190 - DNA, 25 bp, Mus musculus
gggaacgcacctgcctcgtacgctt

SEQ ID NO: 404191 - DNA, 25 bp, Mus musculus
tgcctcgtacgcttcccaagtttca

SEQ ID NO: 404192 - DNA, 25 bp, Mus musculus
ccaagtttcactcgaccgggagcta

SEQ ID NO: 404193 - DNA, 25 bp, Mus musculus
agctagctggcacgtcctgtctcac

SEQ ID NO: 404194 - DNA, 25 bp, Mus musculus
tgtctcaccgatgtctgcccacaat

SEQ ID NO: 404195 - DNA, 25 bp, Mus musculus
tctgcccacaatcccggcgaagtga

SEQ ID NO: 404196 - DNA, 25 bp, Mus musculus
gcgaagtgacactcgaggcgacctt

SEQ ID NO: 404197 - DNA, 25 bp, Mus musculus
ctaatcccacagctacggggaggtc

SEQ ID NO: 404198 - DNA, 25 bp, Mus musculus
ctcggctcagtgagcagggccaact

SEQ ID NO: 404199 - DNA, 25 bp, Mus musculus
agggccaactggacacccgaggcca

SEQ ID NO: 404200 - DNA, 25 bp, Mus musculus
aggccaaactcttacctgtactcgg

SEQ ID NO: 404201 - DNA, 25 bp, Mus musculus
tgaagcgacggagaccactgcgact

SEQ ID NO: 404202 - DNA, 25 bp, Mus musculus
gggtctccagagacaccgagaaatg

SEQ ID NO: 404203 - DNA, 25 bp, Mus musculus
cgaccctcggagagagatgcccagc

SEQ ID NO: 404204 - DNA, 25 bp, Mus musculus
aaaagaacaatgtcgcgtccgcgga

SEQ ID NO: 404205 - DNA, 25 bp, Mus musculus
agtgctccgacccactaagaaaagg

SEQ ID NO: 404206 - DNA, 25 bp, Mus musculus
aggtgcgcgcccacgacctgcaaag

SEQ ID NO: 404207 - DNA, 25 bp, Mus musculus
cccaaacaggccgagcgaaggaccg

SEQ ID NO: 404208 - DNA, 25 bp, Mus musculus
agcgcctctcttaccttcgttatca

SEQ ID NO: 404209 - DNA, 25 bp, Mus musculus
acctcgcggcgagatgagctaatcc

SEQ ID NO: 404210 - DNA, 25 bp, Mus musculus
agatgagctaatcccttcacacgcg

SEQ ID NO: 404211 - DNA, 25 bp, Mus musculus
gcgggccgaagtcaagtctctttca

SEQ ID NO: 404212 - DNA, 25 bp, Mus musculus
caagtctctttcaagtcccggagcc

SEQ ID NO: 404213 - DNA, 25 bp, Mus musculus
cgatttctgacagctcccgggagtc

SEQ ID NO: 404214 - DNA, 25 bp, Mus musculus
agtgcaaaggagagcctcggtcacc

SEQ ID NO: 404215 - DNA, 25 bp, Mus musculus
ggccgcagcatagcaaccgaacatg

SEQ ID NO: 404216 - DNA, 25 bp, Mus musculus
cactggtactcacaggtgcgagaga

SEQ ID NO: 404217 - DNA, 25 bp, Mus musculus
cgcctgcctagaagcactggtactc

SEQ ID NO: 404218 - DNA, 25 bp, Mus musculus
aattcagccgtgtcgcggcgccctt

SEQ ID NO: 404219 - DNA, 25 bp, Mus musculus
gcgcccttcggagccaagatagaga

SEQ ID NO: 404220 - DNA, 25 bp, Mus musculus
agcagtttgaggactttgttatcca

SEQ ID NO: 404221 - DNA, 25 bp, Mus musculus
tgctggcccggatttctgtagcgcc

SEQ ID NO: 404222 - DNA, 25 bp, Mus musculus
cgccggactgagcaggcgcaaagca

SEQ ID NO: 404223 - DNA, 25 bp, Mus musculus
cttcggagccaagatagagacctgc

SEQ ID NO: 404224 - DNA, 25 bp, Mus musculus
ttgttatccaattcagccgtgtcgc

SEQ ID NO: 404225 - DNA, 25 bp, Mus musculus
ctaaggtcttattcagggcgaggtg

SEQ ID NO: 404226 - DNA, 25 bp, Mus musculus
aggtctgctctctaaggtcttattc

SEQ ID NO: 404227 - DNA, 25 bp, Mus musculus
tctggtcctgaggtctgctctctaa

SEQ ID NO: 404228 - DNA, 25 bp, Mus musculus
ctgttctggtcctgaggtctgctct

SEQ ID NO: 404229 - DNA, 25 bp, Mus musculus
cttggagcagcgcttctgttctggt

SEQ ID NO: 404230 - DNA, 25 bp, Mus musculus
agcaggcgcaaagcacgccggtctg

SEQ ID NO: 404231 - DNA, 25 bp, Mus musculus
agatagagacctgctggcccggatt

SEQ ID NO: 404232 - DNA, 25 bp, Mus musculus
ctgctcgggttacgctgactcagca

SEQ ID NO: 404233 - DNA, 25 bp, Mus musculus
gcgccgatggccgtcatgctgcgct

SEQ ID NO: 404234 - DNA, 25 bp, Mus musculus
gctgactcagcagcgccctgggtcc

SEQ ID NO: 404235 - DNA, 25 bp, Mus musculus
ctgcgctctggtaggcagcgctgtc

SEQ ID NO: 404236 - DNA, 25 bp, Mus musculus
cagcgctgtcgcctggcctagctgt

SEQ ID NO: 404237 - DNA, 25 bp, Mus musculus
gcctagctgtcgcactcgtgcactt

SEQ ID NO: 404238 - DNA, 25 bp, Mus musculus
tgtcgcactcgtgcacttgtgctcg

SEQ ID NO: 404239 - DNA, 25 bp, Mus musculus
actcgtgcacttgtgctcggccacg

SEQ ID NO: 404240 - DNA, 25 bp, Mus musculus
tgcacttgtgctcggccacggggct

SEQ ID NO: 404241 - DNA, 25 bp, Mus musculus
gcgggtccctcaggttacctgcgcg

SEQ ID NO: 404242 - DNA, 25 bp, Mus musculus
gtcactgggctgctcgggttacgct

SEQ ID NO: 404243 - DNA, 25 bp, Mus musculus
cctcaggttacctgcgcgccgatgg

SEQ ID NO: 404244 - DNA, 25 bp, Mus musculus
ggccacggggctggccctctatctg

SEQ ID NO: 404245 - DNA, 25 bp, Mus musculus
cgtcatgctgcgctctggtaggcag

SEQ ID NO: 404246 - DNA, 25 bp, Mus musculus
aaggtcactacgtggctcccgcatc

SEQ ID NO: 404247 - DNA, 25 bp, Mus musculus
agcctgcgatgccttttcctttaga

SEQ ID NO: 404248 - DNA, 25 bp, Mus musculus
gagagcgagcgcatctcatctcctc

SEQ ID NO: 404249 - DNA, 25 bp, Mus musculus
tcgttctcgctagctccctgggagt

SEQ ID NO: 404250 - DNA, 25 bp, Mus musculus
cgcagcactcggatcagtaaggctc

SEQ ID NO: 404251 - DNA, 25 bp, Mus musculus
ccggtactacctcggtgaggccgca

SEQ ID NO: 404252 - DNA, 25 bp, Mus musculus
tgcgctccatgagggctctgcagaa

SEQ ID NO: 404253 - DNA, 25 bp, Mus musculus
agcttctcctcaatcgaacccgtgg

SEQ ID NO: 404254 - DNA, 25 bp, Mus musculus
ctcagtgattggacgcggttcctgt

SEQ ID NO: 404255 - DNA, 25 bp, Mus musculus
cagcgttcctcctcctcagtgattg

SEQ ID NO: 404256 - DNA, 25 bp, Mus musculus
tggcgcgtttccacgaactccgact

SEQ ID NO: 404257 - DNA, 25 bp, Mus musculus
tcgctctcatctctctttgaaagtg

SEQ ID NO: 404258 - DNA, 25 bp, Mus musculus
ccctggccttcgaacatggaaggtc

SEQ ID NO: 404259 - DNA, 25 bp, Mus musculus
ttttcatctgcaccagagcactccg

SEQ ID NO: 404260 - DNA, 25 bp, Mus musculus
tcaagtcacagagcgcaccagctag

SEQ ID NO: 404261 - DNA, 25 bp, Mus musculus
aagagggagtttattgcgcacgcgc

SEQ ID NO: 404262 - DNA, 25 bp, Mus musculus
gggcacacgcagtacctgagacata

SEQ ID NO: 404263 - DNA, 25 bp, Mus musculus
cctgagacatactggtgaggtgata

SEQ ID NO: 404264 - DNA, 25 bp, Mus musculus
atactggtgaggtgatacggatgcc

SEQ ID NO: 404265 - DNA, 25 bp, Mus musculus
cgaaagcgcgggagcaagctcagaa

SEQ ID NO: 404266 - DNA, 25 bp, Mus musculus
cgggagcaagctcagaagcagcagc

SEQ ID NO: 404267 - DNA, 25 bp, Mus musculus
accagctagcgcctttaaaagcaca

SEQ ID NO: 404268 - DNA, 25 bp, Mus musculus
ccggcgttccaactgagctcgggcg

SEQ ID NO: 404269 - DNA, 25 bp, Mus musculus
tccaactgagctcgggcgagcggca

SEQ ID NO: 404270 - DNA, 25 bp, Mus musculus
ccaatcagaagtcggatctgctttc

SEQ ID NO: 404271 - DNA, 25 bp, Mus musculus
gtgtccatcctagcggagcgctcca

SEQ ID NO: 404272 - DNA, 25 bp, Mus musculus
gaagcagcagcaatcaagtcacaga

SEQ ID NO: 404273 - DNA, 25 bp, Mus musculus
gacccaagagggagtttattgcgca

SEQ ID NO: 404274 - DNA, 25 bp, Mus musculus
gaagttatgcaggacctcagcgcca

SEQ ID NO: 404275 - DNA, 25 bp, Mus musculus
tcagcggtcccaagatcgccttcta

SEQ ID NO: 404276 - DNA, 25 bp, Mus musculus
gggctacccggactgcagttgacaa

SEQ ID NO: 404277 - DNA, 25 bp, Mus musculus
ttatccagggaccaaagggtgatcc

SEQ ID NO: 404278 - DNA, 25 bp, Mus musculus
caatcccagcagagcaggaaccagc

SEQ ID NO: 404279 - DNA, 25 bp, Mus musculus
aggaaccagcgcagctgagccaaca

SEQ ID NO: 404280 - DNA, 25 bp, Mus musculus
tcgggctcttcgactctccagatca

SEQ ID NO: 404281 - DNA, 25 bp, Mus musculus
gatcagttccagagcggtggcctca

SEQ ID NO: 404282 - DNA, 25 bp, Mus musculus
gcccaggtccggatacctctcgttg

SEQ ID NO: 404283 - DNA, 25 bp, Mus musculus
cctctcgttgaaatagttgggtggc

SEQ ID NO: 404284 - DNA, 25 bp, Mus musculus
tccgaacgcatagagcggggccacc

SEQ ID NO: 404285 - DNA, 25 bp, Mus musculus
cctgccgcatgatctgtgacccata

SEQ ID NO: 404286 - DNA, 25 bp, Mus musculus
agtaccgctgccctggaagttatgc

SEQ ID NO: 404287 - DNA, 25 bp, Mus musculus
atcgccttctacgtgggactcaaga

SEQ ID NO: 404288 - DNA, 25 bp, Mus musculus
aggtgccggacccacggcaccaagg

SEQ ID NO: 404289 - DNA, 25 bp, Mus musculus
tcggctgaggctagccgcgtctccg

SEQ ID NO: 404290 - DNA, 25 bp, Mus musculus
tctcggctgaggctagccgcgtctc

SEQ ID NO: 404291 - DNA, 25 bp, Mus musculus
acggccgtgggtggacgcgagctct

SEQ ID NO: 404292 - DNA, 25 bp, Mus musculus
gggcagtgtgggagccagcgacggc

SEQ ID NO: 404293 - DNA, 25 bp, Mus musculus
gtgccggacccacggcaccaaggag

SEQ ID NO: 404294 - DNA, 25 bp, Mus musculus
gcttcccgcactcaccgtccccgca

SEQ ID NO: 404295 - DNA, 25 bp, Mus musculus
gggcttcttcaggtgccggacccac

SEQ ID NO: 404296 - DNA, 25 bp, Mus musculus
tgggcttcttcaggtgccggaccca

SEQ ID NO: 404297 - DNA, 25 bp, Mus musculus
agatgggcttcttcaggtgccggac

SEQ ID NO: 404298 - DNA, 25 bp, Mus musculus
gctgtacagaggagatgggcttctt

SEQ ID NO: 404299 - DNA, 25 bp, Mus musculus
cagctgtacagaggagatgggcttc

SEQ ID NO: 404300 - DNA, 25 bp, Mus musculus
gcttcttcaggtgccggacccacgg

SEQ ID NO: 404301 - DNA, 25 bp, Mus musculus
caccaaggaggatgtctgggccagc

SEQ ID NO: 404302 - DNA, 25 bp, Mus musculus
caggcgatgaagtctacgtgaagct

SEQ ID NO: 404303 - DNA, 25 bp, Mus musculus
cacggcggcaacaataacaagtaca

SEQ ID NO: 404304 - DNA, 25 bp, Mus musculus
cctgtatccggattaggggcctaga

SEQ ID NO: 404305 - DNA, 25 bp, Mus musculus
cgggcttcctcctgtatccggatta

SEQ ID NO: 404306 - DNA, 25 bp, Mus musculus
cgggaaggctcacggcggcaacaat

SEQ ID NO: 404307 - DNA, 25 bp, Mus musculus
gtacagcacgttctcgggcttcctc

SEQ ID NO: 404308 - DNA, 25 bp, Mus musculus
taacaagtacagcacgttctcgggc

SEQ ID NO: 404309 - DNA, 25 bp, Mus musculus
tactgcacctggattcaggcgatga

SEQ ID NO: 404310 - DNA, 25 bp, Mus musculus
aggtgcgagccagcgccatagccca

SEQ ID NO: 404311 - DNA, 25 bp, Mus musculus
ccatagcccaggacgcggaccagaa

SEQ ID NO: 404312 - DNA, 25 bp, Mus musculus
gacgcggaccagaattacgactacg

SEQ ID NO: 404313 - DNA, 25 bp, Mus musculus
ttacgactacgccagcaacagcgtg

SEQ ID NO: 404314 - DNA, 25 bp, Mus musculus
cagcaacagcgtggtactgcacctg

SEQ ID NO: 404315 - DNA, 25 bp, Mus musculus
tgaagtctacgtgaagctggacggc

SEQ ID NO: 404316 - DNA, 25 bp, Mus musculus
ccgagcggcctcagtctgagtctga

SEQ ID NO: 404317 - DNA, 25 bp, Mus musculus
cggccgagcatggaagaacagcagc

SEQ ID NO: 404318 - DNA, 25 bp, Mus musculus
aaaagtcagcgcgactcgggcctcg

SEQ ID NO: 404319 - DNA, 25 bp, Mus musculus
cagggcgccaagttcccggaacaca

SEQ ID NO: 404320 - DNA, 25 bp, Mus musculus
tcgataacatcctaaggcccgattt

SEQ ID NO: 404321 - DNA, 25 bp, Mus musculus
gatttcggttgcaaaaaggaacagc

SEQ ID NO: 404322 - DNA, 25 bp, Mus musculus
tcactctctgggcacacgagcttcg

SEQ ID NO: 404323 - DNA, 25 bp, Mus musculus
ctgcctcgctcttgtgtgctccaga

SEQ ID NO: 404324 - DNA, 25 bp, Mus musculus
tcctactcatgggttcggctaacgg

SEQ ID NO: 404325 - DNA, 25 bp, Mus musculus
tgctccagatgcgaactgtggccca

SEQ ID NO: 404326 - DNA, 25 bp, Mus musculus
agcagcctcgaagccctcggacagt

SEQ ID NO: 404327 - DNA, 25 bp, Mus musculus
tactgcacacgctattcggaccgtc

SEQ ID NO: 404328 - DNA, 25 bp, Mus musculus
ggccggtggtcaagactgactcaca

SEQ ID NO: 404329 - DNA, 25 bp, Mus musculus
agcagccggagcctaaaagtcagcg

SEQ ID NO: 404330 - DNA, 25 bp, Mus musculus
ttcacggccgagcagctgcagagac

SEQ ID NO: 404331 - DNA, 25 bp, Mus musculus
ctgcagagactcaaggcggagttcc

SEQ ID NO: 404332 - DNA, 25 bp, Mus musculus
actcaaggcggagttccaggcaaac

SEQ ID NO: 404333 - DNA, 25 bp, Mus musculus
gttccaggcaaaccgctatatcacg

SEQ ID NO: 404334 - DNA, 25 bp, Mus musculus
tcgcccaggagctcagcctgaatga

SEQ ID NO: 404335 - DNA, 25 bp, Mus musculus
ccaccacggttcaggacaaagacga

SEQ ID NO: 404336 - DNA, 25 bp, Mus musculus
gtgccaagatcaagaaagccaccgg

SEQ ID NO: 404337 - DNA, 25 bp, Mus musculus
gctgcacctcatggcccagggactg

SEQ ID NO: 404338 - DNA, 25 bp, Mus musculus
caaaccgctatatcacggagcagcg

SEQ ID NO: 404339 - DNA, 25 bp, Mus musculus
gcccagggactgtacaaccactcta

SEQ ID NO: 404340 - DNA, 25 bp, Mus musculus
ttcaggacaaagacgagagcgagta

SEQ ID NO: 404341 - DNA, 25 bp, Mus musculus
agagcgagtagctgtggccagctcc

SEQ ID NO: 404342 - DNA, 25 bp, Mus musculus
agccaccggcatcaagaacggcctg

SEQ ID NO: 404343 - DNA, 25 bp, Mus musculus
ctgaatgagtcccagatcaagatct

SEQ ID NO: 404344 - DNA, 25 bp, Mus musculus
ccggagccttggattgcaaaagaaa

SEQ ID NO: 404345 - DNA, 25 bp, Mus musculus
tggcaacgacaaaggccgcggagtt

SEQ ID NO: 404346 - DNA, 25 bp, Mus musculus
cacgaagcctgaagagtggcaacga

SEQ ID NO: 404347 - DNA, 25 bp, Mus musculus
ccgcggagttctagggccctgcttt

SEQ ID NO: 404348 - DNA, 25 bp, Mus musculus
cccagccggagccttggattgcaaa

SEQ ID NO: 404349 - DNA, 25 bp, Mus musculus
gggacgcgtctcgtgttagaactgc

SEQ ID NO: 404350 - DNA, 25 bp, Mus musculus
tgcaaaagaaaacccgaatgagctc

SEQ ID NO: 404351 - DNA, 25 bp, Mus musculus
aaaacccgaatgagctctgccgagg

SEQ ID NO: 404352 - DNA, 25 bp, Mus musculus
tgagctctgccgaggtggcattttc

SEQ ID NO: 404353 - DNA, 25 bp, Mus musculus
ccgaggtggcattttcgtctctttc

SEQ ID NO: 404354 - DNA, 25 bp, Mus musculus
ggcattttcgtctctttctgtccct

SEQ ID NO: 404355 - DNA, 25 bp, Mus musculus
cctaaagccggcagccctgcgggga

SEQ ID NO: 404356 - DNA, 25 bp, Mus musculus
ctcgtgttagaactgcgcggtacgc

SEQ ID NO: 404357 - DNA, 25 bp, Mus musculus
tagggccctgcttttctccgcgagc

SEQ ID NO: 404358 - DNA, 25 bp, Mus musculus
gaggctgcgaaatcagctgttgttg

SEQ ID NO: 404359 - DNA, 25 bp, Mus musculus
ggttgtcgcctgcaacttcttcccg

SEQ ID NO: 404360 - DNA, 25 bp, Mus musculus
ccggccaaataagctcacctgagct

SEQ ID NO: 404361 - DNA, 25 bp, Mus musculus
ccacagctccgcctgagccgcactg

SEQ ID NO: 404362 - DNA, 25 bp, Mus musculus
cccggcggcttcacgctgacggtag

SEQ ID NO: 404363 - DNA, 25 bp, Mus musculus
gagcttccggttgcctctgcgcgca

SEQ ID NO: 404364 - DNA, 25 bp, Mus musculus
actgcctccgctctgcggagacggg

SEQ ID NO: 404365 - DNA, 25 bp, Mus musculus
aaggacttccggtgtgccgggcact

SEQ ID NO: 404366 - DNA, 25 bp, Mus musculus
agtcagaggttctggatgggcatct

SEQ ID NO: 404367 - DNA, 25 bp, Mus musculus
ttctggatgggcatctggactctgt

SEQ ID NO: 404368 - DNA, 25 bp, Mus musculus
gactccaccctctgcgtgggccgca

SEQ ID NO: 404369 - DNA, 25 bp, Mus musculus
ttgccagccgggtgacaggctccac

SEQ ID NO: 404370 - DNA, 25 bp, Mus musculus
aggctccacggttgtcgcctgcaac

SEQ ID NO: 404371 - DNA, 25 bp, Mus musculus
atcagctgttgttggtgccctcggg

SEQ ID NO: 404372 - DNA, 25 bp, Mus musculus
gtgaaggaagtttccgctttgcacc

SEQ ID NO: 404373 - DNA, 25 bp, Mus musculus
gcagtggttcctcgcttcagcacta

SEQ ID NO: 404374 - DNA, 25 bp, Mus musculus
ttcctcgcttcagcactagtgcgca

SEQ ID NO: 404375 - DNA, 25 bp, Mus musculus
tagtgcgcatgctccgcggggccac

SEQ ID NO: 404376 - DNA, 25 bp, Mus musculus
gggccacggttctccgacctgctgt

SEQ ID NO: 404377 - DNA, 25 bp, Mus musculus
ttctccgacctgctgtggtagtgtc

SEQ ID NO: 404378 - DNA, 25 bp, Mus musculus
cctgctgtggtagtgtcagctcctg

SEQ ID NO: 404379 - DNA, 25 bp, Mus musculus
ctcctgtgaaggaagtttccgcttt

SEQ ID NO: 404380 - DNA, 25 bp, Mus musculus
gtggttcctcgcttcagcactagtg

SEQ ID NO: 404381 - DNA, 25 bp, Mus musculus
ccacccggatcacagttcggttgta

SEQ ID NO: 404382 - DNA, 25 bp, Mus musculus
atcacagttcggttgtagggcccgc

SEQ ID NO: 404383 - DNA, 25 bp, Mus musculus
gtcagctcctgtgaaggaagtttcc

SEQ ID NO: 404384 - DNA, 25 bp, Mus musculus
agttcggttgtagggcccgctctct

SEQ ID NO: 404385 - DNA, 25 bp, Mus musculus
ttcagcactagtgcgcatgctccgc

SEQ ID NO: 404386 - DNA, 25 bp, Mus musculus
tcgcgatcatgagcgcagaagcacg

SEQ ID NO: 404387 - DNA, 25 bp, Mus musculus
agagccgccaccaggacatccgaga

SEQ ID NO: 404388 - DNA, 25 bp, Mus musculus
ggacaactcgctcaccaggctcaga

SEQ ID NO: 404389 - DNA, 25 bp, Mus musculus
cgtcgaaggagatccacacgtggca

SEQ ID NO: 404390 - DNA, 25 bp, Mus musculus
cggtgcagcacaacacgtcgaagga

SEQ ID NO: 404391 - DNA, 25 bp, Mus musculus
cgcgtgatagtccagtagcgatcca

SEQ ID NO: 404392 - DNA, 25 bp, Mus musculus
gctgtcgaggccaccaagttatgtg

SEQ ID NO: 404393 - DNA, 25 bp, Mus musculus
acagtgcccaggtgatcgcgatcat

SEQ ID NO: 404394 - DNA, 25 bp, Mus musculus
gctgcagccgagcatcataggcttc

SEQ ID NO: 404395 - DNA, 25 bp, Mus musculus
accgccagaggcaggtagaaggctc

SEQ ID NO: 404396 - DNA, 25 bp, Mus musculus
ccgtctgcggccgaatcgaaatttg

SEQ ID NO: 404397 - DNA, 25 bp, Mus musculus
ttccagtagacgaagagcaccaccg

SEQ ID NO: 404398 - DNA, 25 bp, Mus musculus
gcggctttgtatattttccagtaga

SEQ ID NO: 404399 - DNA, 25 bp, Mus musculus
cgttccagatgctggcggtgcagca

SEQ ID NO: 404400 - DNA, 25 bp, Mus musculus
caggggacaccgaccaatgactggt

SEQ ID NO: 404401 - DNA, 25 bp, Mus musculus
agctagatcaatacgtgaagagacg

SEQ ID NO: 404402 - DNA, 25 bp, Mus musculus
gtctggcgagctagatcaatacgtg

SEQ ID NO: 404403 - DNA, 25 bp, Mus musculus
cggtgatttctagtctggcgagcta

SEQ ID NO: 404404 - DNA, 25 bp, Mus musculus
atcggtatctcggtgatttctagtc

SEQ ID NO: 404405 - DNA, 25 bp, Mus musculus
agtgtcgtgagaaatcggtatctcg

SEQ ID NO: 404406 - DNA, 25 bp, Mus musculus
gaccaatgactggtccgcgcccgga

SEQ ID NO: 404407 - DNA, 25 bp, Mus musculus
gtgccacagatgcacggggcacgcc

SEQ ID NO: 404408 - DNA, 25 bp, Mus musculus
atcttgtgccacagatgcacggggc

SEQ ID NO: 404409 - DNA, 25 bp, Mus musculus
gcagcgccatcttgtgccacagatg

SEQ ID NO: 404410 - DNA, 25 bp, Mus musculus
acagcgtgcaaagggcagcgccatc

SEQ ID NO: 404411 - DNA, 25 bp, Mus musculus
ttccaacagcgtgcaaagggcagcg

SEQ ID NO: 404412 - DNA, 25 bp, Mus musculus
cagcggtacaacttccaacagcgtg

SEQ ID NO: 404413 - DNA, 25 bp, Mus musculus
cgagacgcgagtgtcgtgagaaatc

SEQ ID NO: 404414 - DNA, 25 bp, Mus musculus
acagttcctggtgagagctgggttc

SEQ ID NO: 404415 - DNA, 25 bp, Mus musculus
cgcttctcgatcttcctgcgcagga

SEQ ID NO: 404416 - DNA, 25 bp, Mus musculus
tctgtaactgcgacatcttgccagg

SEQ ID NO: 404417 - DNA, 25 bp, Mus musculus
ccagccgtctgcaccgagacagatg

SEQ ID NO: 404418 - DNA, 25 bp, Mus musculus
ctggaggacgactcgttgtgaaccc

SEQ ID NO: 404419 - DNA, 25 bp, Mus musculus
cgcaattgcaagtcggaagtgtacc

SEQ ID NO: 404420 - DNA, 25 bp, Mus musculus
tccctttggagaccgaatttcctgc

SEQ ID NO: 404421 - DNA, 25 bp, Mus musculus
cgcagcttggcattccgcttctcga

SEQ ID NO: 404422 - DNA, 25 bp, Mus musculus
ccgagacagatgcacgtgcgcaatt

SEQ ID NO: 404423 - DNA, 25 bp, Mus musculus
cttcaggtttcgctgccgcagcttg

SEQ ID NO: 404424 - DNA, 25 bp, Mus musculus
ggggttcagcacagctcaccttgca

SEQ ID NO: 404425 - DNA, 25 bp, Mus musculus
caaagggcagaaccaatgaagggtc

SEQ ID NO: 404426 - DNA, 25 bp, Mus musculus
accctgagtcgagaaagccacgccg

SEQ ID NO: 404427 - DNA, 25 bp, Mus musculus
atgcttcgggcggaaacagttcctg

SEQ ID NO: 404428 - DNA, 25 bp, Mus musculus
gccaggctttcattctaccgcagtc

SEQ ID NO: 404429 - DNA, 25 bp, Mus musculus
gcatctcccgagcaaccttaaagcg

SEQ ID NO: 404430 - DNA, 25 bp, Mus musculus
tgcagacaccagatgcgaccaagtg

SEQ ID NO: 404431 - DNA, 25 bp, Mus musculus
agcaaccttaaagcgcgcgggagac

SEQ ID NO: 404432 - DNA, 25 bp, Mus musculus
gcgggctctggataaaacccggaga

SEQ ID NO: 404433 - DNA, 25 bp, Mus musculus
ccgtcgctctcggaattggcggaag

SEQ ID NO: 404434 - DNA, 25 bp, Mus musculus
tttgcaggatccctcttttccacta

SEQ ID NO: 404435 - DNA, 25 bp, Mus musculus
agtagtctccctcttttgcaggatc

SEQ ID NO: 404436 - DNA, 25 bp, Mus musculus
gcagcagaagcaagtagtctccctc

SEQ ID NO: 404437 - DNA, 25 bp, Mus musculus
ttgcaacgccggaggagccaggctt

SEQ ID NO: 404438 - DNA, 25 bp, Mus musculus
ggggaccgtcacttggcaagcgatc

SEQ ID NO: 404439 - DNA, 25 bp, Mus musculus
ctcgcgggcacttcacactcgggga

SEQ ID NO: 404440 - DNA, 25 bp, Mus musculus
ggcaagcgatcgcatgtcacagacg

SEQ ID NO: 404441 - DNA, 25 bp, Mus musculus
cgaccaagtggcaagttagtggagc

SEQ ID NO: 404442 - DNA, 25 bp, Mus musculus
gccgtccgttccgtgctgctgagag

SEQ ID NO: 404443 - DNA, 25 bp, Mus musculus
ttccgacttgcgaagattccagttc

SEQ ID NO: 404444 - DNA, 25 bp, Mus musculus
aagattccagttcgcattttctggc

SEQ ID NO: 404445 - DNA, 25 bp, Mus musculus
gtccagaagcggctacgcatgcgca

SEQ ID NO: 404446 - DNA, 25 bp, Mus musculus
ccaagctgagcttgaagggggtcca

SEQ ID NO: 404447 - DNA, 25 bp, Mus musculus
acagtccaccacacaggccggcagc

SEQ ID NO: 404448 - DNA, 25 bp, Mus musculus
tccactttgggttttcaaatagctg

SEQ ID NO: 404449 - DNA, 25 bp, Mus musculus
ttccggatagccagaaagtccactt

SEQ ID NO: 404450 - DNA, 25 bp, Mus musculus
gctcccttccggatagccagaaagt

SEQ ID NO: 404451 - DNA, 25 bp, Mus musculus
cctttccgcggggagccaagatggc

SEQ ID NO: 404452 - DNA, 25 bp, Mus musculus
tagtacttccgcaagcccagcaggc

SEQ ID NO: 404453 - DNA, 25 bp, Mus musculus
cgagtgagcagtcggctagtacttc

SEQ ID NO: 404454 - DNA, 25 bp, Mus musculus
gctccgcttccgacttgcgaagatt

SEQ ID NO: 404455 - DNA, 25 bp, Mus musculus
atgggagctggctgaccatgcaccg

SEQ ID NO: 404456 - DNA, 25 bp, Mus musculus
atatagcgcggagtgtggagctacc

SEQ ID NO: 404457 - DNA, 25 bp, Mus musculus
cacagtccctcggttggcgaaagca

SEQ ID NO: 404458 - DNA, 25 bp, Mus musculus
ctcggttggcgaaagcagcgagacc

SEQ ID NO: 404459 - DNA, 25 bp, Mus musculus
gaagagtgatgacccgaaggtccga

SEQ ID NO: 404460 - DNA, 25 bp, Mus musculus
cgcttcccggcggtgggttatatag

SEQ ID NO: 404461 - DNA, 25 bp, Mus musculus
gtgtggagctacctcagagccggct

SEQ ID NO: 404462 - DNA, 25 bp, Mus musculus
acccgagtcgcgctggcagctcgag

SEQ ID NO: 404463 - DNA, 25 bp, Mus musculus
cagctcgagcggttggcagccctcg

SEQ ID NO: 404464 - DNA, 25 bp, Mus musculus
accctcccgcaacttgagtcaagtt

SEQ ID NO: 404465 - DNA, 25 bp, Mus musculus
gagtcaagttgacaactcccgcgtc

SEQ ID NO: 404466 - DNA, 25 bp, Mus musculus
cttcgcgtccggatcgcggtgacaa

SEQ ID NO: 404467 - DNA, 25 bp, Mus musculus
ccggggcgtcgcgatgaacatcgta

SEQ ID NO: 404468 - DNA, 25 bp, Mus musculus
gccaggtccacagtccctcggttgg

SEQ ID NO: 404469 - DNA, 25 bp, Mus musculus
tcagagccggctgggaacgctcaga

SEQ ID NO: 404470 - DNA, 25 bp, Mus musculus
caagcctgttcaaggctggcgtcca

SEQ ID NO: 404471 - DNA, 25 bp, Mus musculus
ccacgactccatcgaggggcaggaa

SEQ ID NO: 404472 - DNA, 25 bp, Mus musculus
gcgcagcttcttaagttgggcttgc

SEQ ID NO: 404473 - DNA, 25 bp, Mus musculus
aaagggcagctctaggtggtcaata

SEQ ID NO: 404474 - DNA, 25 bp, Mus musculus
cgcctagctaattgctcaaagggca

SEQ ID NO: 404475 - DNA, 25 bp, Mus musculus
gcttgactgggatctcgcctagcta

SEQ ID NO: 404476 - DNA, 25 bp, Mus musculus
gagcggttcctgtctaccgggatgc

SEQ ID NO: 404477 - DNA, 25 bp, Mus musculus
cctagagtctccaggatggggtcca

SEQ ID NO: 404478 - DNA, 25 bp, Mus musculus
tgtcacctagttggtggacaagctg

SEQ ID NO: 404479 - DNA, 25 bp, Mus musculus
cttgaccggttgactcactgagtga

SEQ ID NO: 404480 - DNA, 25 bp, Mus musculus
tggacgaactgagagctgagcttga

SEQ ID NO: 404481 - DNA, 25 bp, Mus musculus
cccaggcctagggtatggattgtca

SEQ ID NO: 404482 - DNA, 25 bp, Mus musculus
gtgacgtaacctgcgcgcccgcagt

SEQ ID NO: 404483 - DNA, 25 bp, Mus musculus
tggcgtccacactacggcaacaaga

SEQ ID NO: 404484 - DNA, 25 bp, Mus musculus
cgggcaagagcatcagagaccacga

SEQ ID NO: 404485 - DNA, 25 bp, Mus musculus
gcgatccggagcacccaaaaaagtc

SEQ ID NO: 404486 - DNA, 25 bp, Mus musculus
cttgaagaactactggcgatccgga

SEQ ID NO: 404487 - DNA, 25 bp, Mus musculus
accacgaccgcagcggaggctgttc

SEQ ID NO: 404488 - DNA, 25 bp, Mus musculus
gcagctgcagccaagagtcgcgcca

SEQ ID NO: 404489 - DNA, 25 bp, Mus musculus
tgctgcgatgccgagaacccacatc

SEQ ID NO: 404490 - DNA, 25 bp, Mus musculus
ttcatcttcttacctggaagccaga

SEQ ID NO: 404491 - DNA, 25 bp, Mus musculus
caggcagctggcctcttcatcttct

SEQ ID NO: 404492 - DNA, 25 bp, Mus musculus
gcgcctttggtctcagtttccagca

SEQ ID NO: 404493 - DNA, 25 bp, Mus musculus
agagcgtcccagtctagcgcctttg

SEQ ID NO: 404494 - DNA, 25 bp, Mus musculus
gctcccttgggtggccacaaacact

SEQ ID NO: 404495 - DNA, 25 bp, Mus musculus
gtcccaggctccttggattcgcgct

SEQ ID NO: 404496 - DNA, 25 bp, Mus musculus
aacttgactaggttggaggcttgtc

SEQ ID NO: 404497 - DNA, 25 bp, Mus musculus
tggccacaaacactgggtaacttga

SEQ ID NO: 404498 - DNA, 25 bp, Mus musculus
cctaggcttttgttgtgtcgcacgc

SEQ ID NO: 404499 - DNA, 25 bp, Mus musculus
ttgttgtgtcgcacgcctcctgtcc

SEQ ID NO: 404500 - DNA, 25 bp, Mus musculus
ggcttttgttgtgtcgcacgcctcc

SEQ ID NO: 404501 - DNA, 25 bp, Mus musculus
cgggcacctaggcttttgttgtgtc

SEQ ID NO: 404502 - DNA, 25 bp, Mus musculus
cttccctgggaatctcgagctaaaa

SEQ ID NO: 404503 - DNA, 25 bp, Mus musculus
agcaggcgcgcactcctatgggtcc

SEQ ID NO: 404504 - DNA, 25 bp, Mus musculus
agatgcccccaagccggtggtaagg

SEQ ID NO: 404505 - DNA, 25 bp, Mus musculus
ccctgggaatctcgagctaaaaaga

SEQ ID NO: 404506 - DNA, 25 bp, Mus musculus
cagcagtgccacttccctgggaatc

SEQ ID NO: 404507 - DNA, 25 bp, Mus musculus
ggggacagcagtgccacttccctgg

SEQ ID NO: 404508 - DNA, 25 bp, Mus musculus
aatctgggccacaggacctttctcc

SEQ ID NO: 404509 - DNA, 25 bp, Mus musculus
tgcaatctgggccacaggacctttc

SEQ ID NO: 404510 - DNA, 25 bp, Mus musculus
ctcccggtgtcccagtgcaatctgg

SEQ ID NO: 404511 - DNA, 25 bp, Mus musculus
ggaatctcgagctaaaaagatgccc

SEQ ID NO: 404512 - DNA, 25 bp, Mus musculus
gatgaggcagcccttatccggccca

SEQ ID NO: 404513 - DNA, 25 bp, Mus musculus
gcgttccgaattggctgagcgctct

SEQ ID NO: 404514 - DNA, 25 bp, Mus musculus
gcccggaatccctttgccttggaga

SEQ ID NO: 404515 - DNA, 25 bp, Mus musculus
cgcgagcctagaagctgagagaagt

SEQ ID NO: 404516 - DNA, 25 bp, Mus musculus
gggtagcagaaacctcgaaaagatc

SEQ ID NO: 404517 - DNA, 25 bp, Mus musculus
aaccattctgtcctgatcgtttgga

SEQ ID NO: 404518 - DNA, 25 bp, Mus musculus
tcgtttggactcaggaggaacgtcc

SEQ ID NO: 404519 - DNA, 25 bp, Mus musculus
aggaacgtccctgcttgcgtctagg

SEQ ID NO: 404520 - DNA, 25 bp, Mus musculus
cccgacagggctggtagttttcaga

SEQ ID NO: 404521 - DNA, 25 bp, Mus musculus
ccaggctcgatctagcccaggtagc

SEQ ID NO: 404522 - DNA, 25 bp, Mus musculus
aggtagccgcatctcagtctcaggg

SEQ ID NO: 404523 - DNA, 25 bp, Mus musculus
cctgggacctctgttcctggagcaa

SEQ ID NO: 404524 - DNA, 25 bp, Mus musculus
gcagggtcgagcgatcgattcagaa

SEQ ID NO: 404525 - DNA, 25 bp, Mus musculus
acccgactgctactgatggtgcttc

SEQ ID NO: 404526 - DNA, 25 bp, Mus musculus
tcccgaaaggtggaatagtcgcttc

SEQ ID NO: 404527 - DNA, 25 bp, Mus musculus
ccgggcactggtatcgatgcaccca

SEQ ID NO: 404528 - DNA, 25 bp, Mus musculus
actcacgtcgcggattggtgcccag

SEQ ID NO: 404529 - DNA, 25 bp, Mus musculus
attactctgcagtcctcggagcctg

SEQ ID NO: 404530 - DNA, 25 bp, Mus musculus
atcgcagctcatccggccttttttc

SEQ ID NO: 404531 - DNA, 25 bp, Mus musculus
ccgaccacgatggagacacgaagtc

SEQ ID NO: 404532 - DNA, 25 bp, Mus musculus
gtcttccaacccgtcgctgaactgg

SEQ ID NO: 404533 - DNA, 25 bp, Mus musculus
gtggtagctcacctcggtcttccaa

SEQ ID NO: 404534 - DNA, 25 bp, Mus musculus
agtcgcttccgctctttgcaccaag

SEQ ID NO: 404535 - DNA, 25 bp, Mus musculus
ccgaccctcatggatcccgaaaggt

SEQ ID NO: 404536 - DNA, 25 bp, Mus musculus
tcggaaaactgaaagaggctctcgg

SEQ ID NO: 404537 - DNA, 25 bp, Mus musculus
ggctggcctaagcaccctccgagat

SEQ ID NO: 404538 - DNA, 25 bp, Mus musculus
accgagagagagcttcgcccgtacc

SEQ ID NO: 404539 - DNA, 25 bp, Mus musculus
ttgcaccaagctccgcaaatagggg

SEQ ID NO: 404540 - DNA, 25 bp, Mus musculus
ttcatgttctttgggtgtgtggcgc

SEQ ID NO: 404541 - DNA, 25 bp, Mus musculus
ggggaacgcacgtagatgtttcatg

SEQ ID NO: 404542 - DNA, 25 bp, Mus musculus
acgtagagaggtcgcagatgttcca

SEQ ID NO: 404543 - DNA, 25 bp, Mus musculus
gaatagcagtgcttccctggcgaga

SEQ ID NO: 404544 - DNA, 25 bp, Mus musculus
gcccgcgttgtataacctgtgtttg

SEQ ID NO: 404545 - DNA, 25 bp, Mus musculus
gccgctccctttgccgtcttttgat

SEQ ID NO: 404546 - DNA, 25 bp, Mus musculus
tggggcaacgtctcaatgtgtatcc

SEQ ID NO: 404547 - DNA, 25 bp, Mus musculus
ctcgggaacagctggagaacacgcc

SEQ ID NO: 404548 - DNA, 25 bp, Mus musculus
ctcgctggttctttactcgggaaca

SEQ ID NO: 404549 - DNA, 25 bp, Mus musculus
gcctcgacacattggcgcggagtcc

SEQ ID NO: 404550 - DNA, 25 bp, Mus musculus
tttacggcgtctcccaatgacaaga

SEQ ID NO: 404551 - DNA, 25 bp, Mus musculus
gcgtcgaccttttctttccgagtga

SEQ ID NO: 404552 - DNA, 25 bp, Mus musculus
atcctttttctagttgcggccctgc

SEQ ID NO: 404553 - DNA, 25 bp, Mus musculus
acctcatccaggacatggggcaacg

SEQ ID NO: 404554 - DNA, 25 bp, Mus musculus
cctgcgggcggcagaggaaaccaat

SEQ ID NO: 404555 - DNA, 25 bp, Mus musculus
aggctctggcgcataggcgaagacc

SEQ ID NO: 404556 - DNA, 25 bp, Mus musculus
cagaggaaaccaatcgttatcccgg

SEQ ID NO: 404557 - DNA, 25 bp, Mus musculus
ggagagctcgcactcaggtaccgcg

SEQ ID NO: 404558 - DNA, 25 bp, Mus musculus
ccttgctctgggagagctcgcactc

SEQ ID NO: 404559 - DNA, 25 bp, Mus musculus
taaccgagtcgctctccttgctctg

SEQ ID NO: 404560 - DNA, 25 bp, Mus musculus
gcggcagaggaaaccaatcgttatc

SEQ ID NO: 404561 - DNA, 25 bp, Mus musculus
acctccgagtctctccgcctgcggg

SEQ ID NO: 404562 - DNA, 25 bp, Mus musculus
tttctgctgcacgacctccgagtct

SEQ ID NO: 404563 - DNA, 25 bp, Mus musculus
ttttctgtttctgctgcacgacctc

SEQ ID NO: 404564 - DNA, 25 bp, Mus musculus
agccgttctcgtttgcctttttctg

SEQ ID NO: 404565 - DNA, 25 bp, Mus musculus
ggtcacgaagccgttctcgtttgcc

SEQ ID NO: 404566 - DNA, 25 bp, Mus musculus
ccaagagggttggtcacgaagccgt

SEQ ID NO: 404567 - DNA, 25 bp, Mus musculus
cgcataggcgaagaccaagagggtt

SEQ ID NO: 404568 - DNA, 25 bp, Mus musculus
gtcagtggcccgcagcttactgtct

SEQ ID NO: 404569 - DNA, 25 bp, Mus musculus
ccgcagcttactgtctgtgctcttc

SEQ ID NO: 404570 - DNA, 25 bp, Mus musculus
ttactgtctgtgctcttctctgtcc

SEQ ID NO: 404571 - DNA, 25 bp, Mus musculus
gcccgagtccgaagtgtttgagatc

SEQ ID NO: 404572 - DNA, 25 bp, Mus musculus
tccgaagtgtttgagatcacagact

SEQ ID NO: 404573 - DNA, 25 bp, Mus musculus
gacagtgaggtgagttctgcgccct

SEQ ID NO: 404574 - DNA, 25 bp, Mus musculus
gagatcacagacttcaccacagcct

SEQ ID NO: 404575 - DNA, 25 bp, Mus musculus
ttcaccacagcctcggagtgggaga

SEQ ID NO: 404576 - DNA, 25 bp, Mus musculus
agtagtgtgtttggtcctgtctggc

SEQ ID NO: 404577 - DNA, 25 bp, Mus musculus
cccgggcggcatcacacaggtgacg

SEQ ID NO: 404578 - DNA, 25 bp, Mus musculus
atcacacaggtgacgctggttcgga

SEQ ID NO: 404579 - DNA, 25 bp, Mus musculus
gggtgcctctgtcacagagttctgc

SEQ ID NO: 404580 - DNA, 25 bp, Mus musculus
gggagacgcccacgcttcgtctctt

SEQ ID NO: 404581 - DNA, 25 bp, Mus musculus
gtcacagagttctgccgccgacgtc

SEQ ID NO: 404582 - DNA, 25 bp, Mus musculus
gccaaataatctgaaagcccgaaac

SEQ ID NO: 404583 - DNA, 25 bp, Mus musculus
gtcgtggtagttatgaaacgcagat

SEQ ID NO: 404584 - DNA, 25 bp, Mus musculus
caaataatctgaaagcccgaaactc

SEQ ID NO: 404585 - DNA, 25 bp, Mus musculus
aataatctgaaagcccgaaactcct

SEQ ID NO: 404586 - DNA, 25 bp, Mus musculus
taatctgaaagcccgaaactccttc

SEQ ID NO: 404587 - DNA, 25 bp, Mus musculus
caacgggctaattcaccgcaagacc

SEQ ID NO: 404588 - DNA, 25 bp, Mus musculus
cgggctaattcaccgcaagaccgtc

SEQ ID NO: 404589 - DNA, 25 bp, Mus musculus
gctaattcaccgcaagaccgtcgga

SEQ ID NO: 404590 - DNA, 25 bp, Mus musculus
taattcaccgcaagaccgtcggagt

SEQ ID NO: 404591 - DNA, 25 bp, Mus musculus
ttcaccgcaagaccgtcggagtgga

SEQ ID NO: 404592 - DNA, 25 bp, Mus musculus
caccgcaagaccgtcggagtggagc

SEQ ID NO: 404593 - DNA, 25 bp, Mus musculus
ggtcgtggtagttatgaaacgcaga

SEQ ID NO: 404594 - DNA, 25 bp, Mus musculus
cgcgcatctgcagtggatggtcgtc

SEQ ID NO: 404595 - DNA, 25 bp, Mus musculus
ggagccaaataatctgaaagcccga

SEQ ID NO: 404596 - DNA, 25 bp, Mus musculus
tgctccttctcagtaacgcgggtaa

SEQ ID NO: 404597 - DNA, 25 bp, Mus musculus
tgagactctaccttgcaaccagccg

SEQ ID NO: 404598 - DNA, 25 bp, Mus musculus
gtaacgcgggtaagagatgctgtcc

SEQ ID NO: 404599 - DNA, 25 bp, Mus musculus
ccgccaaccggtagcgctaacggag

SEQ ID NO: 404600 - DNA, 25 bp, Mus musculus
ggacaggttcccgagcgtccctgct

SEQ ID NO: 404601 - DNA, 25 bp, Mus musculus
ctgctcttgcgagccctggagatcc

SEQ ID NO: 404602 - DNA, 25 bp, Mus musculus
acggaggggaaaagcaacatagtca

SEQ ID NO: 404603 - DNA, 25 bp, Mus musculus
agcaacatagtcaggccaggctgga

SEQ ID NO: 404604 - DNA, 25 bp, Mus musculus
agcagggaccgttcgcggaactgtt

SEQ ID NO: 404605 - DNA, 25 bp, Mus musculus
cctggaccagatgcccggggctgat

SEQ ID NO: 404606 - DNA, 25 bp, Mus musculus
cgctccggggaattgtcacacacac

SEQ ID NO: 404607 - DNA, 25 bp, Mus musculus
ccaaaagggaaacagcacgtcgtgc

SEQ ID NO: 404608 - DNA, 25 bp, Mus musculus
gctggtgatggggttaattcccttc

SEQ ID NO: 404609 - DNA, 25 bp, Mus musculus
gttaattcccttccgtgagactcta

SEQ ID NO: 404610 - DNA, 25 bp, Mus musculus
tccacttcctggagtcggaacccga

SEQ ID NO: 404611 - DNA, 25 bp, Mus musculus
ggcccagtgccacttggtgcttctg

SEQ ID NO: 404612 - DNA, 25 bp, Mus musculus
ttataaggctccaggcttgctccgc

SEQ ID NO: 404613 - DNA, 25 bp, Mus musculus
ctgtccgggccagtacagctttttt

SEQ ID NO: 404614 - DNA, 25 bp, Mus musculus
ggctcagacagcctaagaccctgtc

SEQ ID NO: 404615 - DNA, 25 bp, Mus musculus
attctcgttagcgtcgagtgagcta

SEQ ID NO: 404616 - DNA, 25 bp, Mus musculus
ggcgctttgatcttgttctggattc

SEQ ID NO: 404617 - DNA, 25 bp, Mus musculus
ggccatcgcgtctgctaagaggagc

SEQ ID NO: 404618 - DNA, 25 bp, Mus musculus
tcacgtgacacaggggcgtactttt

SEQ ID NO: 404619 - DNA, 25 bp, Mus musculus
ggcgcgcacttacggacttacctag

SEQ ID NO: 404620 - DNA, 25 bp, Mus musculus
cgtagcggttagtcatccttcctga

SEQ ID NO: 404621 - DNA, 25 bp, Mus musculus
acctgtctgcatctgtgtgggaagc

SEQ ID NO: 404622 - DNA, 25 bp, Mus musculus
atcactgaaccctgcgaggagtcgc

SEQ ID NO: 404623 - DNA, 25 bp, Mus musculus
acgaggagtgtcgtcgtcacgtgac

SEQ ID NO: 404624 - DNA, 25 bp, Mus musculus
caaggccagcgaggcccgagacgca

SEQ ID NO: 404625 - DNA, 25 bp, Mus musculus
cccgcgtgtccgattggctagcgcg

SEQ ID NO: 404626 - DNA, 25 bp, Mus musculus
aagccgcctttatgccacaacttcg

SEQ ID NO: 404627 - DNA, 25 bp, Mus musculus
aggcccagaggtctcggacgccgac

SEQ ID NO: 404628 - DNA, 25 bp, Mus musculus
gctcacctgcattgacgccatgatg

SEQ ID NO: 404629 - DNA, 25 bp, Mus musculus
aagcgcacgacgaacttcgcccttt

SEQ ID NO: 404630 - DNA, 25 bp, Mus musculus
agaacgagcatgagtccggcgatcc

SEQ ID NO: 404631 - DNA, 25 bp, Mus musculus
caccgggcaccggatgaagatcaga

SEQ ID NO: 404632 - DNA, 25 bp, Mus musculus
aatgcccagagtgcgggctgataga

SEQ ID NO: 404633 - DNA, 25 bp, Mus musculus
cttcgaagaagagacgtgggctgcc

SEQ ID NO: 404634 - DNA, 25 bp, Mus musculus
ctcgcacgttgtggtagcacaggac

SEQ ID NO: 404635 - DNA, 25 bp, Mus musculus
gagcaggcccacgagctcgcacgtt

SEQ ID NO: 404636 - DNA, 25 bp, Mus musculus
cgagtttctatcgaggccgaggagc

SEQ ID NO: 404637 - DNA, 25 bp, Mus musculus
cattgacgccatgatgaaaccatcc

SEQ ID NO: 404638 - DNA, 25 bp, Mus musculus
ccaataacagggtaggagctgagct

SEQ ID NO: 404639 - DNA, 25 bp, Mus musculus
agtcgaggaggcttcggattcccgc

SEQ ID NO: 404640 - DNA, 25 bp, Mus musculus
gcgccaaaagcatacgccatgaagc

SEQ ID NO: 404641 - DNA, 25 bp, Mus musculus
gcacgcacttttcgcgccaaaagca

SEQ ID NO: 404642 - DNA, 25 bp, Mus musculus
tcaatggcggttccgtacagagccc

SEQ ID NO: 404643 - DNA, 25 bp, Mus musculus
gagctgagctacttcgcgccaaacc

SEQ ID NO: 404644 - DNA, 25 bp, Mus musculus
gccaaacccgtccaatcaatggcgg

SEQ ID NO: 404645 - DNA, 25 bp, Mus musculus
tctcacctcagccaataacagggta

SEQ ID NO: 404646 - DNA, 25 bp, Mus musculus
agagtccgcagctgcagatagcccg

SEQ ID NO: 404647 - DNA, 25 bp, Mus musculus
agaccaccgcggaggagagtccgca

SEQ ID NO: 404648 - DNA, 25 bp, Mus musculus
ggaacagcttctggcatttctcggc

SEQ ID NO: 404649 - DNA, 25 bp, Mus musculus
ttccaggaagtctaggaacagcttc

SEQ ID NO: 404650 - DNA, 25 bp, Mus musculus
gaagcttttgcccatgcgcaatgta

SEQ ID NO: 404651 - DNA, 25 bp, Mus musculus
ggaggccactcactcttccaggaag

SEQ ID NO: 404652 - DNA, 25 bp, Mus musculus
cagtctccgcgtggaaccttggctt

SEQ ID NO: 404653 - DNA, 25 bp, Mus musculus
accttggcttcggaaatatcgcgag

SEQ ID NO: 404654 - DNA, 25 bp, Mus musculus
ttaacagtcccgagtagttgaggcc

SEQ ID NO: 404655 - DNA, 25 bp, Mus musculus
ggacaggctaagaagcggctccctc

SEQ ID NO: 404656 - DNA, 25 bp, Mus musculus
cgcaggcttccgtaggacaggctaa

SEQ ID NO: 404657 - DNA, 25 bp, Mus musculus
gatttggggagtggataccaccctc

SEQ ID NO: 404658 - DNA, 25 bp, Mus musculus
tctcctgacccttacggctggcgtt

SEQ ID NO: 404659 - DNA, 25 bp, Mus musculus
tatcgcgagagccacagcgagctct

SEQ ID NO: 404660 - DNA, 25 bp, Mus musculus
ggagcactggcctgcgacgcgacac

SEQ ID NO: 404661 - DNA, 25 bp, Mus musculus
tgctgggcatcaggacactggattt

SEQ ID NO: 404662 - DNA, 25 bp, Mus musculus
gccacggtcccaagagttaacagtc

SEQ ID NO: 404663 - DNA, 25 bp, Mus musculus
cggaacacggttcttccaggccacg

SEQ ID NO: 404664 - DNA, 25 bp, Mus musculus
cacgccgcggcctgcgagtaaagcg

SEQ ID NO: 404665 - DNA, 25 bp, Mus musculus
cgagtaaagcgctgacgggagctac

SEQ ID NO: 404666 - DNA, 25 bp, Mus musculus
gtctccgagcttgcacctgttcatc

SEQ ID NO: 404667 - DNA, 25 bp, Mus musculus
acccagaatgtagtgcctacgcgtg

SEQ ID NO: 404668 - DNA, 25 bp, Mus musculus
tccggttcgaagctcacccagaatg

SEQ ID NO: 404669 - DNA, 25 bp, Mus musculus
cctctgtctgcactatggaatttca

SEQ ID NO: 404670 - DNA, 25 bp, Mus musculus
cgacgcggcagactagctcactttt

SEQ ID NO: 404671 - DNA, 25 bp, Mus musculus
caaagcgacgttctctccgcggctg

SEQ ID NO: 404672 - DNA, 25 bp, Mus musculus
agcagcatcatggtacagacttatg

SEQ ID NO: 404673 - DNA, 25 bp, Mus musculus
tggggctcagtcaaacagtctccga

SEQ ID NO: 404674 - DNA, 25 bp, Mus musculus
gctccagcgcgagcgcctttgaatt

SEQ ID NO: 404675 - DNA, 25 bp, Mus musculus
cacagcggttctaggggttcctcct

SEQ ID NO: 404676 - DNA, 25 bp, Mus musculus
ggtctacgaccaacacacagcggtt

SEQ ID NO: 404677 - DNA, 25 bp, Mus musculus
gttgcccatcatacccaggtctacg

SEQ ID NO: 404678 - DNA, 25 bp, Mus musculus
atgtccgagtcacccacctaggggc

SEQ ID NO: 404679 - DNA, 25 bp, Mus musculus
tgaccctttctcaggaacgatccta

SEQ ID NO: 404680 - DNA, 25 bp, Mus musculus
cagactttcatagccaggcaccttc

SEQ ID NO: 404681 - DNA, 25 bp, Mus musculus
cttccagctagtcgcggaacttgga

SEQ ID NO: 404682 - DNA, 25 bp, Mus musculus
aatgggtggtctcccgacacatacc

SEQ ID NO: 404683 - DNA, 25 bp, Mus musculus
gtcccttcttccagctagtcgcgga

SEQ ID NO: 404684 - DNA, 25 bp, Mus musculus
ccaccatcttcactgggaaagctcg

SEQ ID NO: 404685 - DNA, 25 bp, Mus musculus
atcttcactgggaaagctcggggct

SEQ ID NO: 404686 - DNA, 25 bp, Mus musculus
gggctcgtcggctcccagaagctgc

SEQ ID NO: 404687 - DNA, 25 bp, Mus musculus
cccagctggcatggactgatgccgc

SEQ ID NO: 404688 - DNA, 25 bp, Mus musculus
gcacagactttcatagccaggcacc

SEQ ID NO: 404689 - DNA, 25 bp, Mus musculus
cagctagtcgcggaacttggaaccg

SEQ ID NO: 404690 - DNA, 25 bp, Mus musculus
caggcaccttccctcgtcccttctt

SEQ ID NO: 404691 - DNA, 25 bp, Mus musculus
cagccgggttgccagacgctggaat

SEQ ID NO: 404692 - DNA, 25 bp, Mus musculus
ccagacgctggaatgggtggtctcc

SEQ ID NO: 404693 - DNA, 25 bp, Mus musculus
tcccgcacagactttcatagccagg

SEQ ID NO: 404694 - DNA, 25 bp, Mus musculus
gtcctccctgctgtagacccagtgt

SEQ ID NO: 404695 - DNA, 25 bp, Mus musculus
agctggcagacagactgaagtagtc

SEQ ID NO: 404696 - DNA, 25 bp, Mus musculus
cctgaagggctgcacgcccaggagc

SEQ ID NO: 404697 - DNA, 25 bp, Mus musculus
ccaggagcgtcacccggagctacac

SEQ ID NO: 404698 - DNA, 25 bp, Mus musculus
ggagctacacttcccgaaagcacga

SEQ ID NO: 404699 - DNA, 25 bp, Mus musculus
gaaagcacgaagcactgtcgctctg

SEQ ID NO: 404700 - DNA, 25 bp, Mus musculus
acgaagcactgtcgctctgcaccat

SEQ ID NO: 404701 - DNA, 25 bp, Mus musculus
gtccagactgctcaattaccgctca

SEQ ID NO: 404702 - DNA, 25 bp, Mus musculus
tcaccctatgacctgtcctattcgt

SEQ ID NO: 404703 - DNA, 25 bp, Mus musculus
gtcctattcgtcctccctgctgtag

SEQ ID NO: 404704 - DNA, 25 bp, Mus musculus
tgctgtagacccagtgtcgccaccg

SEQ ID NO: 404705 - DNA, 25 bp, Mus musculus
tagacccagtgtcgccaccggagca

SEQ ID NO: 404706 - DNA, 25 bp, Mus musculus
agcaccgggtaccaaagctggcaga

SEQ ID NO: 404707 - DNA, 25 bp, Mus musculus
cagactgaagtagtccgggctccgg

SEQ ID NO: 404708 - DNA, 25 bp, Mus musculus
cctgccgggttttcgcgggtctctg

SEQ ID NO: 404709 - DNA, 25 bp, Mus musculus
aggcgcagactggtcgctctcagcc

SEQ ID NO: 404710 - DNA, 25 bp, Mus musculus
gcagactggtcgctctcagccgagt

SEQ ID NO: 404711 - DNA, 25 bp, Mus musculus
tcgctctcagccgagtggcgggaaa

SEQ ID NO: 404712 - DNA, 25 bp, Mus musculus
acctcagggcctcaggctctgcgag

SEQ ID NO: 404713 - DNA, 25 bp, Mus musculus
ggttttcgcgggtctctgcacaccc

SEQ ID NO: 404714 - DNA, 25 bp, Mus musculus
caggaccgacaacgggcgtccctga

SEQ ID NO: 404715 - DNA, 25 bp, Mus musculus
cgcacgcgcgttctgatcctgctcc

SEQ ID NO: 404716 - DNA, 25 bp, Mus musculus
agtgagcggctactttcccgccgcg

SEQ ID NO: 404717 - DNA, 25 bp, Mus musculus
gtgaggccaggatcttcgagttccg

SEQ ID NO: 404718 - DNA, 25 bp, Mus musculus
agcggagcagtgagcggctactttc

SEQ ID NO: 404719 - DNA, 25 bp, Mus musculus
cttcagaggactcgcggagagcggg

SEQ ID NO: 404720 - DNA, 25 bp, Mus musculus
tgtgtccggaggacccaggaccgac

SEQ ID NO: 404721 - DNA, 25 bp, Mus musculus
caggctctgcgaggcttcagaggac

SEQ ID NO: 404722 - DNA, 25 bp, Mus musculus
tgcgttgccatgatgaagtgtcttc

SEQ ID NO: 404723 - DNA, 25 bp, Mus musculus
ctctcgcgatgtttggaggcgccaa

SEQ ID NO: 404724 - DNA, 25 bp, Mus musculus
gcggccgcccttgccactttaagag

SEQ ID NO: 404725 - DNA, 25 bp, Mus musculus
ctcctccctggagcataaatgctgc

SEQ ID NO: 404726 - DNA, 25 bp, Mus musculus
gctctgctagactcgggaactcctt

SEQ ID NO: 404727 - DNA, 25 bp, Mus musculus
gcgacctccctgcaaggtgacattc

SEQ ID NO: 404728 - DNA, 25 bp, Mus musculus
ccaccttttgcagggtctttccagc

SEQ ID NO: 404729 - DNA, 25 bp, Mus musculus
tggcatttgtttaccttcccgacga

SEQ ID NO: 404730 - DNA, 25 bp, Mus musculus
gggaggctgctttcatcattggcga

SEQ ID NO: 404731 - DNA, 25 bp, Mus musculus
ggcacggctgctgacctcatacagt

SEQ ID NO: 404732 - DNA, 25 bp, Mus musculus
ctggctagctatctggtcaggtctc

SEQ ID NO: 404733 - DNA, 25 bp, Mus musculus
tcccgggctacagagttggaaactg

SEQ ID NO: 404734 - DNA, 25 bp, Mus musculus
acgctttcaagttcgtctcacggga

SEQ ID NO: 404735 - DNA, 25 bp, Mus musculus
aatgaatcagttcggcgcagccacg

SEQ ID NO: 404736 - DNA, 25 bp, Mus musculus
ccgactagcgatgaggaggcgaggc

SEQ ID NO: 404737 - DNA, 25 bp, Mus musculus
tctccgcaggtaagctccgcccacc

SEQ ID NO: 404738 - DNA, 25 bp, Mus musculus
tgtctcataggtccagcggaggctc

SEQ ID NO: 404739 - DNA, 25 bp, Mus musculus
tcttctgtctcataggtccagcgga

SEQ ID NO: 404740 - DNA, 25 bp, Mus musculus
tcaccgctttcttctgtctcatagg

SEQ ID NO: 404741 - DNA, 25 bp, Mus musculus
gggtcctcaccgctttcttctgtct

SEQ ID NO: 404742 - DNA, 25 bp, Mus musculus
cacacactagcgaggcgtggagact

SEQ ID NO: 404743 - DNA, 25 bp, Mus musculus
tgagcgcacacactagcgaggcgtg

SEQ ID NO: 404744 - DNA, 25 bp, Mus musculus
acagcttgggtgagcgcacacacta

SEQ ID NO: 404745 - DNA, 25 bp, Mus musculus
accagacagcttgggtgagcgcaca

SEQ ID NO: 404746 - DNA, 25 bp, Mus musculus
cgcagaacaacgtctacagcgcctg

SEQ ID NO: 404747 - DNA, 25 bp, Mus musculus
cgcgctcgcagaacaacgtctacag

SEQ ID NO: 404748 - DNA, 25 bp, Mus musculus
gcagaggccgcgctcgcagaacaac

SEQ ID NO: 404749 - DNA, 25 bp, Mus musculus
acacagcgccgggatgcctcgcaga

SEQ ID NO: 404750 - DNA, 25 bp, Mus musculus
gagcgaacttctccaaaccgaccga

SEQ ID NO: 404751 - DNA, 25 bp, Mus musculus
gtgatggcgttctttcggatctgca

SEQ ID NO: 404752 - DNA, 25 bp, Mus musculus
caggcccgacttgacgtggaactgg

SEQ ID NO: 404753 - DNA, 25 bp, Mus musculus
gccgaggagagcgaagtcacattcc

SEQ ID NO: 404754 - DNA, 25 bp, Mus musculus
gtcacattccggctcccaaataagg

SEQ ID NO: 404755 - DNA, 25 bp, Mus musculus
gaccgaccaaccagctcaatgagta

SEQ ID NO: 404756 - DNA, 25 bp, Mus musculus
taaagggccttttgtgcccgcagaa

SEQ ID NO: 404757 - DNA, 25 bp, Mus musculus
caagagtggccaccaggctggatcc

SEQ ID NO: 404758 - DNA, 25 bp, Mus musculus
agctgcaccggatctcagcgcgatc

SEQ ID NO: 404759 - DNA, 25 bp, Mus musculus
ggcgaatttttgctgggttctcttg

SEQ ID NO: 404760 - DNA, 25 bp, Mus musculus
tcttgtcgaagatccgcagcacctt

SEQ ID NO: 404761 - DNA, 25 bp, Mus musculus
ccgttgatgcccaggccaagcactt

SEQ ID NO: 404762 - DNA, 25 bp, Mus musculus
ccaagcacttggctggtgaccttgt

SEQ ID NO: 404763 - DNA, 25 bp, Mus musculus
tgaccttgtagtcgtcggtgatggc

SEQ ID NO: 404764 - DNA, 25 bp, Mus musculus
catagacccgggctacctgtccaaa

SEQ ID NO: 404765 - DNA, 25 bp, Mus musculus
cccatccgcatcgtcgtagccaccg

SEQ ID NO: 404766 - DNA, 25 bp, Mus musculus
ggtcccggggcacatgaatataggc

SEQ ID NO: 404767 - DNA, 25 bp, Mus musculus
tcatagcggtaagccagatggtccc

SEQ ID NO: 404768 - DNA, 25 bp, Mus musculus
tgccgatgattttcagcacctcata

SEQ ID NO: 404769 - DNA, 25 bp, Mus musculus
tttgtgatcatagacccgggctacc

SEQ ID NO: 404770 - DNA, 25 bp, Mus musculus
ctgccgaagtttgtgatcatagacc

SEQ ID NO: 404771 - DNA, 25 bp, Mus musculus
ccacgtactgccgaagtttgtgatc

SEQ ID NO: 404772 - DNA, 25 bp, Mus musculus
gcaccattttcagggccacgtactg

SEQ ID NO: 404773 - DNA, 25 bp, Mus musculus
tgcgcaccattttcagggccacgta

SEQ ID NO: 404774 - DNA, 25 bp, Mus musculus
ttctcattgcgcaccattttcaggg

SEQ ID NO: 404775 - DNA, 25 bp, Mus musculus
tggaagcgtttctcattgcgcacca

SEQ ID NO: 404776 - DNA, 25 bp, Mus musculus
cctggcgatggaagcgtttctcatt

SEQ ID NO: 404777 - DNA, 25 bp, Mus musculus
tttcagcacctcatagcggtaagcc

SEQ ID NO: 404778 - DNA, 25 bp, Mus musculus
gagcggccgcgtcgcttagcaaccg

SEQ ID NO: 404779 - DNA, 25 bp, Mus musculus
cgagcggattgggttcctttagcca

SEQ ID NO: 404780 - DNA, 25 bp, Mus musculus
ttcctttagccagggcccgatgcgg

SEQ ID NO: 404781 - DNA, 25 bp, Mus musculus
aaagcggcacatggggaacaaggtc

SEQ ID NO: 404782 - DNA, 25 bp, Mus musculus
gctgggcagactctcggagcaacag

SEQ ID NO: 404783 - DNA, 25 bp, Mus musculus
cagactctcggagcaacagggcgca

SEQ ID NO: 404784 - DNA, 25 bp, Mus musculus
caacagggcgcaggtcttgcgcgca

SEQ ID NO: 404785 - DNA, 25 bp, Mus musculus
aggtcttgcgcgcaggtcccagacc

SEQ ID NO: 404786 - DNA, 25 bp, Mus musculus
cgctcaccgcgctgatggacaggca

SEQ ID NO: 404787 - DNA, 25 bp, Mus musculus
accgcgctgatggacaggcagccca

SEQ ID NO: 404788 - DNA, 25 bp, Mus musculus
agcccagacccgcaaggagtcctcc

SEQ ID NO: 404789 - DNA, 25 bp, Mus musculus
ttggcccggtgggtcgcctccagca

SEQ ID NO: 404790 - DNA, 25 bp, Mus musculus
ctggcttcgctacaagacgaggctg

SEQ ID NO: 404791 - DNA, 25 bp, Mus musculus
gcacctgctggcttcgctacaagac

SEQ ID NO: 404792 - DNA, 25 bp, Mus musculus
ataatgccattgtgtcccggcgcgg

SEQ ID NO: 404793 - DNA, 25 bp, Mus musculus
tctcagctcactgagcgctggcgcg

SEQ ID NO: 404794 - DNA, 25 bp, Mus musculus
agcgtctgcagttcccagggaaaag

SEQ ID NO: 404795 - DNA, 25 bp, Mus musculus
gggaaaaggtgctacaagccgtctc

SEQ ID NO: 404796 - DNA, 25 bp, Mus musculus
aaggtgctacaagccgtctctgccc

SEQ ID NO: 404797 - DNA, 25 bp, Mus musculus
gcaaggacaggaagcgcgcgtttct

SEQ ID NO: 404798 - DNA, 25 bp, Mus musculus
aagcgcgcgtttctgcagccgcggc

SEQ ID NO: 404799 - DNA, 25 bp, Mus musculus
gcggctggcccgagataatgccatt

SEQ ID NO: 404800 - DNA, 25 bp, Mus musculus
ccagtcagtaatgcagcctgccggg

SEQ ID NO: 404801 - DNA, 25 bp, Mus musculus
ggaaacctggccacagcaccagact

SEQ ID NO: 404802 - DNA, 25 bp, Mus musculus
gcaccagacttcgtgacttctcttt

SEQ ID NO: 404803 - DNA, 25 bp, Mus musculus
acttctcttttacgagctgcgccca

SEQ ID NO: 404804 - DNA, 25 bp, Mus musculus
tggccgggcttttgttctcagctca

SEQ ID NO: 404805 - DNA, 25 bp, Mus musculus
ctccctggctgcgagccagtcagta

SEQ ID NO: 404806 - DNA, 25 bp, Mus musculus
cgctttctgtaacgcgcgggagact

SEQ ID NO: 404807 - DNA, 25 bp, Mus musculus
gcactaactctcctagcgaaatcag

SEQ ID NO: 404808 - DNA, 25 bp, Mus musculus
tcctagcgaaatcagatcccgattc

SEQ ID NO: 404809 - DNA, 25 bp, Mus musculus
aatcagatcccgattcccaccatag

SEQ ID NO: 404810 - DNA, 25 bp, Mus musculus
atagcccgacactcactagccagtc

SEQ ID NO: 404811 - DNA, 25 bp, Mus musculus
tcactagccagtcccgcagctaccg

SEQ ID NO: 404812 - DNA, 25 bp, Mus musculus
ggcacagaaaggaattacttccgtc

SEQ ID NO: 404813 - DNA, 25 bp, Mus musculus
ggaattacttccgtcgcgtcacagc

SEQ ID NO: 404814 - DNA, 25 bp, Mus musculus
gatctgccggtaacttgcgtctgga

SEQ ID NO: 404815 - DNA, 25 bp, Mus musculus
tcacagccgctttctgtaacgcgcg

SEQ ID NO: 404816 - DNA, 25 bp, Mus musculus
tgtaacgcgcgggagactggtacct

SEQ ID NO: 404817 - DNA, 25 bp, Mus musculus
actggtacctggcaaggccgagacg

SEQ ID NO: 404818 - DNA, 25 bp, Mus musculus
ccgagacgcgatctgccggtaactt

SEQ ID NO: 404819 - DNA, 25 bp, Mus musculus
cgtcgcgtcacagccgctttctgta

SEQ ID NO: 404820 - DNA, 25 bp, Mus musculus
cgctgcgtcagttccgggccagcat

SEQ ID NO: 404821 - DNA, 25 bp, Mus musculus
cgagtctcagcatggctgcctccag

SEQ ID NO: 404822 - DNA, 25 bp, Mus musculus
tacacccggttccaagtggaagagc

SEQ ID NO: 404823 - DNA, 25 bp, Mus musculus
cgccgtatctaaagcggatggagca

SEQ ID NO: 404824 - DNA, 25 bp, Mus musculus
gagccgccactccttcgttttgttg

SEQ ID NO: 404825 - DNA, 25 bp, Mus musculus
aggctgttttttggcgccgagtctc

SEQ ID NO: 404826 - DNA, 25 bp, Mus musculus
gcggaagttccggagtctgtcccgc

SEQ ID NO: 404827 - DNA, 25 bp, Mus musculus
gcaggctcctaggtacacccggttc

SEQ ID NO: 404828 - DNA, 25 bp, Mus musculus
ctacagacccgcaggctcctaggta

SEQ ID NO: 404829 - DNA, 25 bp, Mus musculus
cacaactggcgtccctaactacaga

SEQ ID NO: 404830 - DNA, 25 bp, Mus musculus
gttgtttgcacaactggcgtcccta

SEQ ID NO: 404831 - DNA, 25 bp, Mus musculus
gaatagaactaagacgttgtttgca

SEQ ID NO: 404832 - DNA, 25 bp, Mus musculus
cggatggagcagaaagaatagaact

SEQ ID NO: 404833 - DNA, 25 bp, Mus musculus
gccactccttcgttttgttgaccgc

SEQ ID NO: 404834 - DNA, 25 bp, Mus musculus
tagcccgccgctgtcagtaaggcgg

SEQ ID NO: 404835 - DNA, 25 bp, Mus musculus
ccagactctgcagataccgcggcgg

SEQ ID NO: 404836 - DNA, 25 bp, Mus musculus
cgcagcgccagttccacgaaacggt

SEQ ID NO: 404837 - DNA, 25 bp, Mus musculus
cctctctcggccaagacgcggggat

SEQ ID NO: 404838 - DNA, 25 bp, Mus musculus
gctgctcgaagatgctcctcacgtc

SEQ ID NO: 404839 - DNA, 25 bp, Mus musculus
tgtgacccaggtcgcagccgcagtc

SEQ ID NO: 404840 - DNA, 25 bp, Mus musculus
tctcggctgcagaccgggccggaca

SEQ ID NO: 404841 - DNA, 25 bp, Mus musculus
gctaccgagcctggccaacagaagg

SEQ ID NO: 404842 - DNA, 25 bp, Mus musculus
ggctccggtcgagcgcgcttttaaa

SEQ ID NO: 404843 - DNA, 25 bp, Mus musculus
ccggaagggcaacacgcgtgactgc

SEQ ID NO: 404844 - DNA, 25 bp, Mus musculus
agccgcgtggatttaggagtgactc

SEQ ID NO: 404845 - DNA, 25 bp, Mus musculus
tttaggagtgactcggcgactaggc

SEQ ID NO: 404846 - DNA, 25 bp, Mus musculus
cccgagaggcttcgcgagctcggta

SEQ ID NO: 404847 - DNA, 25 bp, Mus musculus
aaggtccgagcacccgagaggcttc

SEQ ID NO: 404848 - DNA, 25 bp, Mus musculus
aggtgtggcgaacactagctgccta

SEQ ID NO: 404849 - DNA, 25 bp, Mus musculus
cccgagaagtattatgggctgcact

SEQ ID NO: 404850 - DNA, 25 bp, Mus musculus
tggaccgctgcaacgtgaagtgtag

SEQ ID NO: 404851 - DNA, 25 bp, Mus musculus
gttggcaactttcgggacccgcatg

SEQ ID NO: 404852 - DNA, 25 bp, Mus musculus
cccgcatgaggtttgggtatcagag

SEQ ID NO: 404853 - DNA, 25 bp, Mus musculus
ggagaaagcaccctgcaagccgtga

SEQ ID NO: 404854 - DNA, 25 bp, Mus musculus
tggacccggccaaccgtgtgcaaag

SEQ ID NO: 404855 - DNA, 25 bp, Mus musculus
aaagcagcagcatccgcaacgcgtc

SEQ ID NO: 404856 - DNA, 25 bp, Mus musculus
cccagtcccggtttgttcagtcaga

SEQ ID NO: 404857 - DNA, 25 bp, Mus musculus
tttgttcagtcagagcagcagcagc

SEQ ID NO: 404858 - DNA, 25 bp, Mus musculus
aggagactccgccaactccgcaaga

SEQ ID NO: 404859 - DNA, 25 bp, Mus musculus
aactgatccatagacgccaggagta

SEQ ID NO: 404860 - DNA, 25 bp, Mus musculus
taggcgcagtcctagagtgagctcc

SEQ ID NO: 404861 - DNA, 25 bp, Mus musculus
cgactgacggggactatagccaata

SEQ ID NO: 404862 - DNA, 25 bp, Mus musculus
tttgcagctcttcccagagctcttc

SEQ ID NO: 404863 - DNA, 25 bp, Mus musculus
tgccgccaagcggaagttagagtcg

SEQ ID NO: 404864 - DNA, 25 bp, Mus musculus
ggaagttagagtcgctgcacctgca

SEQ ID NO: 404865 - DNA, 25 bp, Mus musculus
tgcacctgcagctcatccgcaacta

SEQ ID NO: 404866 - DNA, 25 bp, Mus musculus
agcgacgtggacttctcccgcggct

SEQ ID NO: 404867 - DNA, 25 bp, Mus musculus
tcccagagctcttcagcgacgtgga

SEQ ID NO: 404868 - DNA, 25 bp, Mus musculus
tgtcgactccttttgcagctcttcc

SEQ ID NO: 404869 - DNA, 25 bp, Mus musculus
tgacctagcctgtcgactccttttg

SEQ ID NO: 404870 - DNA, 25 bp, Mus musculus
cagagcctgtcttgcggtgacctag

SEQ ID NO: 404871 - DNA, 25 bp, Mus musculus
acaaatcgccgagcagagcctgtct

SEQ ID NO: 404872 - DNA, 25 bp, Mus musculus
cagtgcctgtggctttgccgccaag

SEQ ID NO: 404873 - DNA, 25 bp, Mus musculus
tgcttccgagctgaaacaaatcgcc

SEQ ID NO: 404874 - DNA, 25 bp, Mus musculus
gctcttcagcgacgtggacttctcc

SEQ ID NO: 404875 - DNA, 25 bp, Mus musculus
cgagtaccagctcactgcttccgag

SEQ ID NO: 404876 - DNA, 25 bp, Mus musculus
cggcactggaccctcagaaggtaca

SEQ ID NO: 404877 - DNA, 25 bp, Mus musculus
gaacgccgagcgtccacagccgggt

SEQ ID NO: 404878 - DNA, 25 bp, Mus musculus
accgcttggagaattggaagttgca

SEQ ID NO: 404879 - DNA, 25 bp, Mus musculus
gagcgggcactaacgagcttctccc

SEQ ID NO: 404880 - DNA, 25 bp, Mus musculus
cgggtccttgaaccgcttggagaat

SEQ ID NO: 404881 - DNA, 25 bp, Mus musculus
tccgctgttcgctatcttggtccgc

SEQ ID NO: 404882 - DNA, 25 bp, Mus musculus
cgggtgacccattccgctgttcgct

SEQ ID NO: 404883 - DNA, 25 bp, Mus musculus
acagccgggtgatccattccgccag

SEQ ID NO: 404884 - DNA, 25 bp, Mus musculus
gccaatcactgaagtcggcggtgtg

SEQ ID NO: 404885 - DNA, 25 bp, Mus musculus
ttcagccaatgagagtgacacgcgg

SEQ ID NO: 404886 - DNA, 25 bp, Mus musculus
tttcaagcagcttgtccagcccagc

SEQ ID NO: 404887 - DNA, 25 bp, Mus musculus
aacggggttgtgtttcagccaatga

SEQ ID NO: 404888 - DNA, 25 bp, Mus musculus
ggcgtggctaagctttcggtcgccc

SEQ ID NO: 404889 - DNA, 25 bp, Mus musculus
ccagcccagcgctgaacggggttgt

SEQ ID NO: 404890 - DNA, 25 bp, Mus musculus
tggctgatgcagttgtccatcctga

SEQ ID NO: 404891 - DNA, 25 bp, Mus musculus
cgatcgccagctggccggctcaaag

SEQ ID NO: 404892 - DNA, 25 bp, Mus musculus
acactcttgtccaagtccgcgggca

SEQ ID NO: 404893 - DNA, 25 bp, Mus musculus
ctcacaggaaggcagaagcgaaatg

SEQ ID NO: 404894 - DNA, 25 bp, Mus musculus
cagcccgaggcggaatatcctgatc

SEQ ID NO: 404895 - DNA, 25 bp, Mus musculus
agcgagctcggcatctcaggcccag

SEQ ID NO: 404896 - DNA, 25 bp, Mus musculus
tcctgactctattcttgatggaggg

SEQ ID NO: 404897 - DNA, 25 bp, Mus musculus
cccttttcctgctctgattggctga

SEQ ID NO: 404898 - DNA, 25 bp, Mus musculus
ccagctcaagaaacgccggggaaat

SEQ ID NO: 404899 - DNA, 25 bp, Mus musculus
gttcccgtcactctgctgcgttttc

SEQ ID NO: 404900 - DNA, 25 bp, Mus musculus
tagcagaacgctcgccttgagaggc

SEQ ID NO: 404901 - DNA, 25 bp, Mus musculus
gtcaagattcaggagtacatgcgta

SEQ ID NO: 404902 - DNA, 25 bp, Mus musculus
gcccagaggctcactagagatagtc

SEQ ID NO: 404903 - DNA, 25 bp, Mus musculus
tttcgggtcttctggaaggcccaga

SEQ ID NO: 404904 - DNA, 25 bp, Mus musculus
aggactctgcacaacctcaattttg

SEQ ID NO: 404905 - DNA, 25 bp, Mus musculus
cgagaaagggtctaagtcatctgta

SEQ ID NO: 404906 - DNA, 25 bp, Mus musculus
agggtctaagtcatctgtacttctc

SEQ ID NO: 404907 - DNA, 25 bp, Mus musculus
gcggtccgagaaagggtctaagtca

SEQ ID NO: 404908 - DNA, 25 bp, Mus musculus
atctgtacttctctaagcaaggtgc

SEQ ID NO: 404909 - DNA, 25 bp, Mus musculus
cctcaattttgtgtgtgcggtccga

SEQ ID NO: 404910 - DNA, 25 bp, Mus musculus
gggaccggacaaggactctgcacaa

SEQ ID NO: 404911 - DNA, 25 bp, Mus musculus
tttttgacggaagactgggaagtgc

SEQ ID NO: 404912 - DNA, 25 bp, Mus musculus
caattttgtgtgtgcggtccgagaa

SEQ ID NO: 404913 - DNA, 25 bp, Mus musculus
ccacggttcaatgctggcgagcgac

SEQ ID NO: 404914 - DNA, 25 bp, Mus musculus
gcgagcgactcggaggtccctgaaa

SEQ ID NO: 404915 - DNA, 25 bp, Mus musculus
ctgaaaggaaggtgccaatcgcgga

SEQ ID NO: 404916 - DNA, 25 bp, Mus musculus
aagcaaggtgctggccacggttcaa

SEQ ID NO: 404917 - DNA, 25 bp, Mus musculus
ggtccctgaaaggaaggtgccaatc

SEQ ID NO: 404918 - DNA, 25 bp, Mus musculus
ttgcaccgcggctttggcgcatttt

SEQ ID NO: 404919 - DNA, 25 bp, Mus musculus
tagcgttttggcgagcgagttgctt

SEQ ID NO: 404920 - DNA, 25 bp, Mus musculus
aggactcggtcctccagaggctcgc

SEQ ID NO: 404921 - DNA, 25 bp, Mus musculus
ttggcgcgcaccaggcacaccatag

SEQ ID NO: 404922 - DNA, 25 bp, Mus musculus
cctggagtcgtgctcctgactacca

SEQ ID NO: 404923 - DNA, 25 bp, Mus musculus
agcgaacatgtctcggcctgtcagg

SEQ ID NO: 404924 - DNA, 25 bp, Mus musculus
gcagccgccgactcttgagaagcca

SEQ ID NO: 404925 - DNA, 25 bp, Mus musculus
cggctggtttgattcatccattttg

SEQ ID NO: 404926 - DNA, 25 bp, Mus musculus
gcgcatctgacaggagtcaccaatg

SEQ ID NO: 404927 - DNA, 25 bp, Mus musculus
tggactaatgactagggcgcatctg

SEQ ID NO: 404928 - DNA, 25 bp, Mus musculus
tctcagcgcatcttgactaacagga

SEQ ID NO: 404929 - DNA, 25 bp, Mus musculus
accatttttgttttgcggccgtgcg

SEQ ID NO: 404930 - DNA, 25 bp, Mus musculus
cgggcaatcggcgaccatttttgtt

SEQ ID NO: 404931 - DNA, 25 bp, Mus musculus
tcgtcagatccagggacctcaaacc

SEQ ID NO: 404932 - DNA, 25 bp, Mus musculus
gctgtgctgtggtgcccgctgtccc

SEQ ID NO: 404933 - DNA, 25 bp, Mus musculus
tggctttcagcaccccgcgggatgg

SEQ ID NO: 404934 - DNA, 25 bp, Mus musculus
tgacagccgcacgccgggccaggta

SEQ ID NO: 404935 - DNA, 25 bp, Mus musculus
cgtgctcggcggtggctttcagcac

SEQ ID NO: 404936 - DNA, 25 bp, Mus musculus
caggggtccgagctcgcacgcgcca

SEQ ID NO: 404937 - DNA, 25 bp, Mus musculus
gcccgaaaggggcagatgagtcacc

SEQ ID NO: 404938 - DNA, 25 bp, Mus musculus
gcgctgagtgcgcttcctcccggag

SEQ ID NO: 404939 - DNA, 25 bp, Mus musculus
ccgaaaggggcagatgagtcaccgc

SEQ ID NO: 404940 - DNA, 25 bp, Mus musculus
cccttgtctgggctgcgcccgaaag

SEQ ID NO: 404941 - DNA, 25 bp, Mus musculus
tttcttcccttgtctgggctgcgcc

SEQ ID NO: 404942 - DNA, 25 bp, Mus musculus
tgcgtttatttcttcccttgtctgg

SEQ ID NO: 404943 - DNA, 25 bp, Mus musculus
ccgccgcagagttttctttggaaag

SEQ ID NO: 404944 - DNA, 25 bp, Mus musculus
gcctcccgccgcagagttttctttg

SEQ ID NO: 404945 - DNA, 25 bp, Mus musculus
gcttcctcccggagcgctgtgctgt

SEQ ID NO: 404946 - DNA, 25 bp, Mus musculus
acagagtctcgcaccgcgttcaagg

SEQ ID NO: 404947 - DNA, 25 bp, Mus musculus
cgaatgtccggcagagcaggagtcc

SEQ ID NO: 404948 - DNA, 25 bp, Mus musculus
tgcacgggacggactaacagggtac

SEQ ID NO: 404949 - DNA, 25 bp, Mus musculus
gccgtagtgaagaacgtcgagcgca

SEQ ID NO: 404950 - DNA, 25 bp, Mus musculus
cacggcgagtggcagcttaactata

SEQ ID NO: 404951 - DNA, 25 bp, Mus musculus
agcttaactatagccacttcgccgt

SEQ ID NO: 404952 - DNA, 25 bp, Mus musculus
gcctgcgaggaagtacgaatgtccg

SEQ ID NO: 404953 - DNA, 25 bp, Mus musculus
cccgagagccctaagcaggactttg

SEQ ID NO: 404954 - DNA, 25 bp, Mus musculus
cgtgccctgcctggtgagcagcacg

SEQ ID NO: 404955 - DNA, 25 bp, Mus musculus
cccgcacctcggtgggtcgtgagaa

SEQ ID NO: 404956 - DNA, 25 bp, Mus musculus
cggttttaacttgccggagtggcag

SEQ ID NO: 404957 - DNA, 25 bp, Mus musculus
aaagtgctttcttggctcgcccacg

SEQ ID NO: 404958 - DNA, 25 bp, Mus musculus
ccgcactttgatctcggggcgcgcg

SEQ ID NO: 404959 - DNA, 25 bp, Mus musculus
ttcaaggccgaggagtcccgtgccc

SEQ ID NO: 404960 - DNA, 25 bp, Mus musculus
agagctgctgcgagaagaagaccca

SEQ ID NO: 404961 - DNA, 25 bp, Mus musculus
tggcgatctgaatccacatcacttg

SEQ ID NO: 404962 - DNA, 25 bp, Mus musculus
cgcagcctttcagcctggcgatctg

SEQ ID NO: 404963 - DNA, 25 bp, Mus musculus
agtgctaaaggctcctcgcgcccta

SEQ ID NO: 404964 - DNA, 25 bp, Mus musculus
gcgacccgccagctagtgctaaagg

SEQ ID NO: 404965 - DNA, 25 bp, Mus musculus
ttggttaattcacccgggagcgcga

SEQ ID NO: 404966 - DNA, 25 bp, Mus musculus
ttgcggcggagcagctcagacaccc

SEQ ID NO: 404967 - DNA, 25 bp, Mus musculus
ctgaagaagacgctccagtaggtga

SEQ ID NO: 404968 - DNA, 25 bp, Mus musculus
caggccgaagctgaagaagacgctc

SEQ ID NO: 404969 - DNA, 25 bp, Mus musculus
ccaggaaggcgatgcacaggccgaa

SEQ ID NO: 404970 - DNA, 25 bp, Mus musculus
aatccacatcacttggtcttggggt

SEQ ID NO: 404971 - DNA, 25 bp, Mus musculus
atctggggcaacgagctgtgcgtct

SEQ ID NO: 404972 - DNA, 25 bp, Mus musculus
ggcgcgacactcacgtcctcttgaa

SEQ ID NO: 404973 - DNA, 25 bp, Mus musculus
tctggcagcgcaggtccagaagcgt

SEQ ID NO: 404974 - DNA, 25 bp, Mus musculus
cccaaatctccagcgcaaaggcagt

SEQ ID NO: 404975 - DNA, 25 bp, Mus musculus
gcagctggggaattctgcccaaatc

SEQ ID NO: 404976 - DNA, 25 bp, Mus musculus
gctggggaattctgcccaaatctcc

SEQ ID NO: 404977 - DNA, 25 bp, Mus musculus
gggaattctgcccaaatctccagcg

SEQ ID NO: 404978 - DNA, 25 bp, Mus musculus
agcgcccatcgcctatggcagctgg

SEQ ID NO: 404979 - DNA, 25 bp, Mus musculus
tctgcccaaatctccagcgcaaagg

SEQ ID NO: 404980 - DNA, 25 bp, Mus musculus
cccatcgcctatggcagctggggaa

SEQ ID NO: 404981 - DNA, 25 bp, Mus musculus
atctccagcgcaaaggcagtcggcc

SEQ ID NO: 404982 - DNA, 25 bp, Mus musculus
gcccggcttacctttgctcagcttg

SEQ ID NO: 404983 - DNA, 25 bp, Mus musculus
ttacctttgctcagcttgcccggcg

SEQ ID NO: 404984 - DNA, 25 bp, Mus musculus
tttgctcagcttgcccggcgcggtg

SEQ ID NO: 404985 - DNA, 25 bp, Mus musculus
cggactctgcgcgtgtcccggtcgt

SEQ ID NO: 404986 - DNA, 25 bp, Mus musculus
gcgctgccaggcttaggtgccctgc

SEQ ID NO: 404987 - DNA, 25 bp, Mus musculus
gcgcaaaggcagtcggcccctttaa

SEQ ID NO: 404988 - DNA, 25 bp, Mus musculus
aggggcggagcctcatcgctcttgt

SEQ ID NO: 404989 - DNA, 25 bp, Mus musculus
cagcatggggtctgggaactccagt

SEQ ID NO: 404990 - DNA, 25 bp, Mus musculus
tagccgagtcttgcgggccacccgg

SEQ ID NO: 404991 - DNA, 25 bp, Mus musculus
gggcatctagcgctagccgagtctt

SEQ ID NO: 404992 - DNA, 25 bp, Mus musculus
ctagccgagccagagcggctccgga

SEQ ID NO: 404993 - DNA, 25 bp, Mus musculus
cctgggaggagcaggcctcgacctc

SEQ ID NO: 404994 - DNA, 25 bp, Mus musculus
tgcggcctcgctagccgagccagag

SEQ ID NO: 404995 - DNA, 25 bp, Mus musculus
ggatcgctttctggcgtgcggcctc

SEQ ID NO: 404996 - DNA, 25 bp, Mus musculus
ttctccaactcgcagcatgctgttg

SEQ ID NO: 404997 - DNA, 25 bp, Mus musculus
gctggaaactgacggccaccttctc

SEQ ID NO: 404998 - DNA, 25 bp, Mus musculus
tccttggccgcagctggaaactgac

SEQ ID NO: 404999 - DNA, 25 bp, Mus musculus
aactccagtgctgaggggacactcc

SEQ ID NO: 405000 - DNA, 25 bp, Mus musculus
cactgtcgagcggagtcgcttttgg

SEQ ID NO: 405001 - DNA, 25 bp, Mus musculus
agtcgcttttgggtgtccttggccg

SEQ ID NO: 405002 - DNA, 25 bp, Mus musculus
gctgcaaaagagaagcggaagaaaa

SEQ ID NO: 405003 - DNA, 25 bp, Mus musculus
gccggagctgtgcagtgaatgcaaa

SEQ ID NO: 405004 - DNA, 25 bp, Mus musculus
cggcccaatgagaagacagcagata

SEQ ID NO: 405005 - DNA, 25 bp, Mus musculus
gcagataatttattctctaatcccg

SEQ ID NO: 405006 - DNA, 25 bp, Mus musculus
tctaatcccggttcgggtgccgagc

SEQ ID NO: 405007 - DNA, 25 bp, Mus musculus
cacatttcctgacaattagcgagca

SEQ ID NO: 405008 - DNA, 25 bp, Mus musculus
tccggcagcgctgccgcttttgtct

SEQ ID NO: 405009 - DNA, 25 bp, Mus musculus
gaagaaaagtaaggcagcgctggcc

SEQ ID NO: 405010 - DNA, 25 bp, Mus musculus
tttgttacagcctgagtgtgagcgg

SEQ ID NO: 405011 - DNA, 25 bp, Mus musculus
cccgcgcagaactcgggcaggtagc

SEQ ID NO: 405012 - DNA, 25 bp, Mus musculus
cagacgcagctagcggctgctctta

SEQ ID NO: 405013 - DNA, 25 bp, Mus musculus
ctagcggctgctcttagatggaaac

SEQ ID NO: 405014 - DNA, 25 bp, Mus musculus
tgctcttagatggaaacccgacccg

SEQ ID NO: 405015 - DNA, 25 bp, Mus musculus
attagcgagcacaccttggccgcgc

SEQ ID NO: 405016 - DNA, 25 bp, Mus musculus
catctgtacgtcgaagtctgtcttc

SEQ ID NO: 405017 - DNA, 25 bp, Mus musculus
ccagatggcagcttcacgtttatta

SEQ ID NO: 405018 - DNA, 25 bp, Mus musculus
tgtccagcatgacttacaccctgta

SEQ ID NO: 405019 - DNA, 25 bp, Mus musculus
accctgtaaacgatgtgcacgccga

SEQ ID NO: 405020 - DNA, 25 bp, Mus musculus
tgtgcacgccgacctgtgaaacagc

SEQ ID NO: 405021 - DNA, 25 bp, Mus musculus
tgtgaaacagccacgcggcctctgc

SEQ ID NO: 405022 - DNA, 25 bp, Mus musculus
tctgcgcacagagcccaccaaagaa

SEQ ID NO: 405023 - DNA, 25 bp, Mus musculus
cagcgatgacagtgaaggtaccgtt

SEQ ID NO: 405024 - DNA, 25 bp, Mus musculus
attagcgaggttccggccttccgtg

SEQ ID NO: 405025 - DNA, 25 bp, Mus musculus
ttcatatcaaagacacggctgggtg

SEQ ID NO: 405026 - DNA, 25 bp, Mus musculus
gaccggccagtgtgcacatccttta

SEQ ID NO: 405027 - DNA, 25 bp, Mus musculus
ttacctaaaccagagtcagatcgcg

SEQ ID NO: 405028 - DNA, 25 bp, Mus musculus
tcagatcgcgtattcggagtcctta

SEQ ID NO: 405029 - DNA, 25 bp, Mus musculus
cccgggctgcaaaatcatctgtacg

SEQ ID NO: 405030 - DNA, 25 bp, Mus musculus
tggcattccgtaaccttgttttggc

SEQ ID NO: 405031 - DNA, 25 bp, Mus musculus
agatccgcgcctgattcagtttgtc

SEQ ID NO: 405032 - DNA, 25 bp, Mus musculus
ttggcggaggctacgtcactctcct

SEQ ID NO: 405033 - DNA, 25 bp, Mus musculus
aggctacgtcactctccttctcagg

SEQ ID NO: 405034 - DNA, 25 bp, Mus musculus
ttctcaggcgctgcctgtacctggc

SEQ ID NO: 405035 - DNA, 25 bp, Mus musculus
ttttctgattggctgggatgagccc

SEQ ID NO: 405036 - DNA, 25 bp, Mus musculus
cccgctgattggaagcgatggctgc

SEQ ID NO: 405037 - DNA, 25 bp, Mus musculus
gaagcgatggctgccaatccaccgt

SEQ ID NO: 405038 - DNA, 25 bp, Mus musculus
tccaccgtccgtcttgcttgggtta

SEQ ID NO: 405039 - DNA, 25 bp, Mus musculus
aaactggaatttcccgcggagctga

SEQ ID NO: 405040 - DNA, 25 bp, Mus musculus
ccgcggagctgacggcgctttctct

SEQ ID NO: 405041 - DNA, 25 bp, Mus musculus
ctactcgtttgaattccacgcgctc

SEQ ID NO: 405042 - DNA, 25 bp, Mus musculus
aattccacgcgctccaaaatatccg

SEQ ID NO: 405043 - DNA, 25 bp, Mus musculus
tttcgtaacaccaaatagatccgcg

SEQ ID NO: 405044 - DNA, 25 bp, Mus musculus
ctgctgccctagattcgccaggttc

SEQ ID NO: 405045 - DNA, 25 bp, Mus musculus
ccacgctggcaggatctgcctgtca

SEQ ID NO: 405046 - DNA, 25 bp, Mus musculus
cacccaagggacccggagaagccag

SEQ ID NO: 405047 - DNA, 25 bp, Mus musculus
attcgccaggttctttccgcggagc

SEQ ID NO: 405048 - DNA, 25 bp, Mus musculus
caaagttgaccaagggtgagctacc

SEQ ID NO: 405049 - DNA, 25 bp, Mus musculus
ggggcgcatcctgcaaagttgacca

SEQ ID NO: 405050 - DNA, 25 bp, Mus musculus
accgtgaaagcttcgcgcggctgta

SEQ ID NO: 405051 - DNA, 25 bp, Mus musculus
ctgccaggcggaccgtgaaagcttc

SEQ ID NO: 405052 - DNA, 25 bp, Mus musculus
agctcggcttctggcgaccgctctc

SEQ ID NO: 405053 - DNA, 25 bp, Mus musculus
ctcctgcccaggtgtggaagctgcg

SEQ ID NO: 405054 - DNA, 25 bp, Mus musculus
ctgtagacactgcaggccctgccct

SEQ ID NO: 405055 - DNA, 25 bp, Mus musculus
ccggctgtctccgaccctgtagaca

SEQ ID NO: 405056 - DNA, 25 bp, Mus musculus
atctgcctgtcatctgggcacccgg

SEQ ID NO: 405057 - DNA, 25 bp, Mus musculus
tctttccgcggagccaggcgtggac

SEQ ID NO: 405058 - DNA, 25 bp, Mus musculus
taattcggctctgcctccattctcg

SEQ ID NO: 405059 - DNA, 25 bp, Mus musculus
caccgctacgagttcctggagacgc

SEQ ID NO: 405060 - DNA, 25 bp, Mus musculus
cggtgaagcggcaccatcacaaaca

SEQ ID NO: 405061 - DNA, 25 bp, Mus musculus
ctctgatgaagaagcaggcggtgaa

SEQ ID NO: 405062 - DNA, 25 bp, Mus musculus
aagtcgcctaaacctctgatgaaga

SEQ ID NO: 405063 - DNA, 25 bp, Mus musculus
cggacgggctcatcaagtcgcctaa

SEQ ID NO: 405064 - DNA, 25 bp, Mus musculus
accatggagtcggtggccttactcc

SEQ ID NO: 405065 - DNA, 25 bp, Mus musculus
tagcaattcggaacgcggggctttc

SEQ ID NO: 405066 - DNA, 25 bp, Mus musculus
cctcgaaacgttttatagcaattcg

SEQ ID NO: 405067 - DNA, 25 bp, Mus musculus
ttttggtcacgagccgccggcaagt

SEQ ID NO: 405068 - DNA, 25 bp, Mus musculus
ccaatgcgagaggttttggtcacga

SEQ ID NO: 405069 - DNA, 25 bp, Mus musculus
cctttccgcgcctagccaaggggag

SEQ ID NO: 405070 - DNA, 25 bp, Mus musculus
gcattcctgggcctcgggtccaagt

SEQ ID NO: 405071 - DNA, 25 bp, Mus musculus
agctcacagcgcgtcccttgcggtg

SEQ ID NO: 405072 - DNA, 25 bp, Mus musculus
tcggcactgccgaacttgttgcgaa

SEQ ID NO: 405073 - DNA, 25 bp, Mus musculus
cagcttcaggtactctgccacgtta

SEQ ID NO: 405074 - DNA, 25 bp, Mus musculus
tgttgcgaatgaggctggcgaactc

SEQ ID NO: 405075 - DNA, 25 bp, Mus musculus
gaagccactaatgccggcacgcatg

SEQ ID NO: 405076 - DNA, 25 bp, Mus musculus
tcagcccttgctgcatatcgcgtag

SEQ ID NO: 405077 - DNA, 25 bp, Mus musculus
tatcgcgtagcacatccttgggctg

SEQ ID NO: 405078 - DNA, 25 bp, Mus musculus
cgcgagggcccattctgctcgattt

SEQ ID NO: 405079 - DNA, 25 bp, Mus musculus
cgatttccttcaggcgccgacggta

SEQ ID NO: 405080 - DNA, 25 bp, Mus musculus
ccgacggtagtgctccagttttttg

SEQ ID NO: 405081 - DNA, 25 bp, Mus musculus
ctgggcggacttctggttcttcttt

SEQ ID NO: 405082 - DNA, 25 bp, Mus musculus
acacctgcttgatgcgcgacacctg

SEQ ID NO: 405083 - DNA, 25 bp, Mus musculus
cgacacctgctgcttgtccgcattg

SEQ ID NO: 405084 - DNA, 25 bp, Mus musculus
gacaccaccgcagtgtgggtagctt

SEQ ID NO: 405085 - DNA, 25 bp, Mus musculus
tgtccgcattgttggccagcttcag

SEQ ID NO: 405086 - DNA, 25 bp, Mus musculus
ctgcagcggtccttaggcagtcact

SEQ ID NO: 405087 - DNA, 25 bp, Mus musculus
taggcttggttgcaccgcgcgtccc

SEQ ID NO: 405088 - DNA, 25 bp, Mus musculus
cgctgtaggcttggttgcaccgcgc

SEQ ID NO: 405089 - DNA, 25 bp, Mus musculus
caccgctgtaggcttggttgcaccg

SEQ ID NO: 405090 - DNA, 25 bp, Mus musculus
ggacaccgctgtaggcttggttgca

SEQ ID NO: 405091 - DNA, 25 bp, Mus musculus
cgcggacaccgctgtaggcttggtt

SEQ ID NO: 405092 - DNA, 25 bp, Mus musculus
caacggcgcgcggacaccgctgtag

SEQ ID NO: 405093 - DNA, 25 bp, Mus musculus
aaggccggagggctgcgcaacggcg

SEQ ID NO: 405094 - DNA, 25 bp, Mus musculus
cgaggcgagcgcagatggcgccgcc

SEQ ID NO: 405095 - DNA, 25 bp, Mus musculus
tcctcgtcagcagccgcgcaaggct

SEQ ID NO: 405096 - DNA, 25 bp, Mus musculus
ccgctcctcgtcagcagccgcgcaa

SEQ ID NO: 405097 - DNA, 25 bp, Mus musculus
ggctgcagcggtccttaggcagtca

SEQ ID NO: 405098 - DNA, 25 bp, Mus musculus
cagcggtccttaggcagtcactggc

SEQ ID NO: 405099 - DNA, 25 bp, Mus musculus
tccttaggcagtcactggcgcggga

SEQ ID NO: 405100 - DNA, 25 bp, Mus musculus
tcagccagccgcgaagacagctggc

SEQ ID NO: 405101 - DNA, 25 bp, Mus musculus
agggtggcatctccgtcagcaaaac

SEQ ID NO: 405102 - DNA, 25 bp, Mus musculus
cgcagcgacggtgcctctgtgagct

SEQ ID NO: 405103 - DNA, 25 bp, Mus musculus
tgcctctgtgagctcgtccctggct

SEQ ID NO: 405104 - DNA, 25 bp, Mus musculus
tgagctcgtccctggctccgctggg

SEQ ID NO: 405105 - DNA, 25 bp, Mus musculus
gggaggcggattccgccttctctga

SEQ ID NO: 405106 - DNA, 25 bp, Mus musculus
cgtcagcaaaacaactccaggagga

SEQ ID NO: 405107 - DNA, 25 bp, Mus musculus
aggaaaatcggagggtggcatctcc

SEQ ID NO: 405108 - DNA, 25 bp, Mus musculus
caggcccgatggagagaggaaaatc

SEQ ID NO: 405109 - DNA, 25 bp, Mus musculus
aagtgctcccacagccacagttgtc

SEQ ID NO: 405110 - DNA, 25 bp, Mus musculus
ccgcgaagacagctggctgagcgat

SEQ ID NO: 405111 - DNA, 25 bp, Mus musculus
gctgtgccggggcttcagccgctac

SEQ ID NO: 405112 - DNA, 25 bp, Mus musculus
gagccaggcgctctggctgctcagc

SEQ ID NO: 405113 - DNA, 25 bp, Mus musculus
gttcttccgcgacatcaagtgctcc

SEQ ID NO: 405114 - DNA, 25 bp, Mus musculus
atctctgcatcaggatgcgctcctc

SEQ ID NO: 405115 - DNA, 25 bp, Mus musculus
aacgctcggccggagatggcttcct

SEQ ID NO: 405116 - DNA, 25 bp, Mus musculus
tcagccaacgctcggccggagatgg

SEQ ID NO: 405117 - DNA, 25 bp, Mus musculus
ctcagccaacgctcggccggagatg

SEQ ID NO: 405118 - DNA, 25 bp, Mus musculus
ctcactggctggctcggctcctcag

SEQ ID NO: 405119 - DNA, 25 bp, Mus musculus
agcatctctgcatcaggatgcgctc

SEQ ID NO: 405120 - DNA, 25 bp, Mus musculus
tcggccggagatggcttcctctgcc

SEQ ID NO: 405121 - DNA, 25 bp, Mus musculus
gccttagccactggctgtcctggcg

SEQ ID NO: 405122 - DNA, 25 bp, Mus musculus
cgctcggccggagatggcttcctct

SEQ ID NO: 405123 - DNA, 25 bp, Mus musculus
tagccactggctgtcctggcgtggc

SEQ ID NO: 405124 - DNA, 25 bp, Mus musculus
cttagccactggctgtcctggcgtg

SEQ ID NO: 405125 - DNA, 25 bp, Mus musculus
gctggctcggctcctcagccaacgc

SEQ ID NO: 405126 - DNA, 25 bp, Mus musculus
tgcagcatctctgcatcaggatgcg

SEQ ID NO: 405127 - DNA, 25 bp, Mus musculus
agcgggcgagggtgcgtatgtgtgt

SEQ ID NO: 405128 - DNA, 25 bp, Mus musculus
cgagtgacggacataggacagcgcc

SEQ ID NO: 405129 - DNA, 25 bp, Mus musculus
cctcgcaggctcagcgttgagacca

SEQ ID NO: 405130 - DNA, 25 bp, Mus musculus
ctcagcgttgagaccactcccagga

SEQ ID NO: 405131 - DNA, 25 bp, Mus musculus
attggggacactgtcattctgctga

SEQ ID NO: 405132 - DNA, 25 bp, Mus musculus
ccactcccaggacaagtgtaggttg

SEQ ID NO: 405133 - DNA, 25 bp, Mus musculus
cctggccgccaacctccagccgcgg

SEQ ID NO: 405134 - DNA, 25 bp, Mus musculus
acggacataggacagcgcccgcgcg

SEQ ID NO: 405135 - DNA, 25 bp, Mus musculus
tggccttgagggtcgccgagatcct

SEQ ID NO: 405136 - DNA, 25 bp, Mus musculus
gcggcccgggctttgatgacccgat

SEQ ID NO: 405137 - DNA, 25 bp, Mus musculus
tcgccgagatgcctgcaggagagct

SEQ ID NO: 405138 - DNA, 25 bp, Mus musculus
atgcctgcaggagagctggtgattt

SEQ ID NO: 405139 - DNA, 25 bp, Mus musculus
gctagagaatgcaaaggaggtggcc

SEQ ID NO: 405140 - DNA, 25 bp, Mus musculus
gttgagaccactcccaggacaagtg

SEQ ID NO: 405141 - DNA, 25 bp, Mus musculus
gtcattctgctgacgccctcgcagg

SEQ ID NO: 405142 - DNA, 25 bp, Mus musculus
tgcattttgaaactgcgagcaacgg

SEQ ID NO: 405143 - DNA, 25 bp, Mus musculus
caccacaccttacggccgctccatg

SEQ ID NO: 405144 - DNA, 25 bp, Mus musculus
cgcccggttcctagctccgaagcct

SEQ ID NO: 405145 - DNA, 25 bp, Mus musculus
ttacggccgctccatgagtcgctcc

SEQ ID NO: 405146 - DNA, 25 bp, Mus musculus
gtggcagccggagaccctaaggcct

SEQ ID NO: 405147 - DNA, 25 bp, Mus musculus
gccggagaccctaaggcctgcactg

SEQ ID NO: 405148 - DNA, 25 bp, Mus musculus
agaccctaaggcctgcactgcattt

SEQ ID NO: 405149 - DNA, 25 bp, Mus musculus
ggcctgcactgcattttgaaactgc

SEQ ID NO: 405150 - DNA, 25 bp, Mus musculus
cagcgttcgcaagagcttccgggga

SEQ ID NO: 405151 - DNA, 25 bp, Mus musculus
ttttgaaactgcgagcaacggcagc

SEQ ID NO: 405152 - DNA, 25 bp, Mus musculus
gaaactgcgagcaacggcagcacca

SEQ ID NO: 405153 - DNA, 25 bp, Mus musculus
ctcaaacccagcgttcgcaagagct

SEQ ID NO: 405154 - DNA, 25 bp, Mus musculus
acccagcgttcgcaagagcttccgg

SEQ ID NO: 405155 - DNA, 25 bp, Mus musculus
ccctaaggcctgcactgcattttga

SEQ ID NO: 405156 - DNA, 25 bp, Mus musculus
cgccttcgtacttcatgccattgga

SEQ ID NO: 405157 - DNA, 25 bp, Mus musculus
tccgtgtccgcatggaagttgagca

SEQ ID NO: 405158 - DNA, 25 bp, Mus musculus
ttcttcttgcccagttccgtgtccg

SEQ ID NO: 405159 - DNA, 25 bp, Mus musculus
tttcatgctgccgagaagggaaccc

SEQ ID NO: 405160 - DNA, 25 bp, Mus musculus
cttggattcggacttgcggagtttc

SEQ ID NO: 405161 - DNA, 25 bp, Mus musculus
ctgctcatggctgcatcactgcgga

SEQ ID NO: 405162 - DNA, 25 bp, Mus musculus
gttggcatcgctagaactgattctg

SEQ ID NO: 405163 - DNA, 25 bp, Mus musculus
tcacagtcgacgtcaccaaagctga

SEQ ID NO: 405164 - DNA, 25 bp, Mus musculus
cttccacggggcaaaaatcacagtc

SEQ ID NO: 405165 - DNA, 25 bp, Mus musculus
tggcatccacgtgatcttccacggg

SEQ ID NO: 405166 - DNA, 25 bp, Mus musculus
taggtttccgtggtagtggcatcca

SEQ ID NO: 405167 - DNA, 25 bp, Mus musculus
agccattgcgcttatcgttcttcca

SEQ ID NO: 405168 - DNA, 25 bp, Mus musculus
gcgttcgctgatgccgaagccattg

SEQ ID NO: 405169 - DNA, 25 bp, Mus musculus
gttgagcacgaagccacctcttgtt

SEQ ID NO: 405170 - DNA, 25 bp, Mus musculus
agggagcaggcgacactgaacatca

SEQ ID NO: 405171 - DNA, 25 bp, Mus musculus
cggaacacacttcccgggtgcagct

SEQ ID NO: 405172 - DNA, 25 bp, Mus musculus
ggtcctccgagcactgcaggttgct

SEQ ID NO: 405173 - DNA, 25 bp, Mus musculus
ccaacaatggcagggccgagagccc

SEQ ID NO: 405174 - DNA, 25 bp, Mus musculus
agcgccctcttagtcggggcgacgt

SEQ ID NO: 405175 - DNA, 25 bp, Mus musculus
acagtcagggtgtcgcggcagaacc

SEQ ID NO: 405176 - DNA, 25 bp, Mus musculus
tagacacccagccacgacagtcagg

SEQ ID NO: 405177 - DNA, 25 bp, Mus musculus
tctggctcccgcgactaggcgattc

SEQ ID NO: 405178 - DNA, 25 bp, Mus musculus
tcgctcgccgttcgcgctattgtct

SEQ ID NO: 405179 - DNA, 25 bp, Mus musculus
tcgcgctattgtctcacccggggct

SEQ ID NO: 405180 - DNA, 25 bp, Mus musculus
cagctgcaagacgagctgggaccag

SEQ ID NO: 405181 - DNA, 25 bp, Mus musculus
gtcgcttgcccgtgtgtctcctgct

SEQ ID NO: 405182 - DNA, 25 bp, Mus musculus
gcctgactgcgagctcgtgcacgct

SEQ ID NO: 405183 - DNA, 25 bp, Mus musculus
gagccgcctggatcttccgagcgag

SEQ ID NO: 405184 - DNA, 25 bp, Mus musculus
tcgccacgcaagtctgggtcctcaa

SEQ ID NO: 405185 - DNA, 25 bp, Mus musculus
ttgggacccacagaaaacaaagtga

SEQ ID NO: 405186 - DNA, 25 bp, Mus musculus
agctgctagggttgggacccacaga

SEQ ID NO: 405187 - DNA, 25 bp, Mus musculus
ccgtttttcccagccagctgctagg

SEQ ID NO: 405188 - DNA, 25 bp, Mus musculus
actggccaccctgaacctggcggga

SEQ ID NO: 405189 - DNA, 25 bp, Mus musculus
ctccgcttaggtgcctagttaagtg

SEQ ID NO: 405190 - DNA, 25 bp, Mus musculus
ggaccctcagatctccgcttaggtg

SEQ ID NO: 405191 - DNA, 25 bp, Mus musculus
gggctcgcacgggaccctcagatct

SEQ ID NO: 405192 - DNA, 25 bp, Mus musculus
aagctgcctgctcgcgcgagagttt

SEQ ID NO: 405193 - DNA, 25 bp, Mus musculus
tcgctgcctcggaggcgctcctaaa

SEQ ID NO: 405194 - DNA, 25 bp, Mus musculus
cgtgaaccaattcgccacgcaagtc

SEQ ID NO: 405195 - DNA, 25 bp, Mus musculus
ctcaagtcttccaaggggtcctcgc

SEQ ID NO: 405196 - DNA, 25 bp, Mus musculus
gagtccggctgctttccagagcctg

SEQ ID NO: 405197 - DNA, 25 bp, Mus musculus
acaaagtgagagtccggctgctttc

SEQ ID NO: 405198 - DNA, 25 bp, Mus musculus
tccggctgatgcaactcgccgcgtg

SEQ ID NO: 405199 - DNA, 25 bp, Mus musculus
cgcaagcgtacatcctaggtccggc

SEQ ID NO: 405200 - DNA, 25 bp, Mus musculus
ccaatcagaggccacgcacgagggt

SEQ ID NO: 405201 - DNA, 25 bp, Mus musculus
cggctgcggccattttgagcttcgc

SEQ ID NO: 405202 - DNA, 25 bp, Mus musculus
tgagcttcgcttctttgcgccctcg

SEQ ID NO: 405203 - DNA, 25 bp, Mus musculus
tcttctctatggtggagcgatctca

SEQ ID NO: 405204 - DNA, 25 bp, Mus musculus
acgtctccttccctagccgggatgg

SEQ ID NO: 405205 - DNA, 25 bp, Mus musculus
gtccggtgcagcactcgttgcggaa

SEQ ID NO: 405206 - DNA, 25 bp, Mus musculus
cgcgggaatcggactgcagtaccca

SEQ ID NO: 405207 - DNA, 25 bp, Mus musculus
tacccactccgtggctgggcaaggc

SEQ ID NO: 405208 - DNA, 25 bp, Mus musculus
gcggagactgtgtagacctcggatc

SEQ ID NO: 405209 - DNA, 25 bp, Mus musculus
cctgtctgagaagccgccaaggaaa

SEQ ID NO: 405210 - DNA, 25 bp, Mus musculus
gatcgcacgcctgctcttcggagtt

SEQ ID NO: 405211 - DNA, 25 bp, Mus musculus
gagcgatctcacacggcctaggacg

SEQ ID NO: 405212 - DNA, 25 bp, Mus musculus
tgcgtgactcaaggctcgccctcgg

SEQ ID NO: 405213 - DNA, 25 bp, Mus musculus
tcccatcaaccgaagtggtgttatc

SEQ ID NO: 405214 - DNA, 25 bp, Mus musculus
catcccgaggctgggaagtgtcctc

SEQ ID NO: 405215 - DNA, 25 bp, Mus musculus
ctctagggcccgcagctcaagagca

SEQ ID NO: 405216 - DNA, 25 bp, Mus musculus
cgcgacggcaggagcctcctaatta

SEQ ID NO: 405217 - DNA, 25 bp, Mus musculus
aggagcctcctaattactcaccacg

SEQ ID NO: 405218 - DNA, 25 bp, Mus musculus
accacgctaattgcccagcactgaa

SEQ ID NO: 405219 - DNA, 25 bp, Mus musculus
cactgaacttcaggagccggtccga

SEQ ID NO: 405220 - DNA, 25 bp, Mus musculus
agccagctcgccttcagcgggaggc

SEQ ID NO: 405221 - DNA, 25 bp, Mus musculus
ccgcctctaggaggcgcagaaagtg

SEQ ID NO: 405222 - DNA, 25 bp, Mus musculus
ggacaccgagatggccgatgagatc

SEQ ID NO: 405223 - DNA, 25 bp, Mus musculus
atgagatcgactggctggacctgcc

SEQ ID NO: 405224 - DNA, 25 bp, Mus musculus
acctgccaggccgatggacctacgg

SEQ ID NO: 405225 - DNA, 25 bp, Mus musculus
gcgttcgacctttgttcctgcacta

SEQ ID NO: 405226 - DNA, 25 bp, Mus musculus
ggcaggatggcaccgtttggatccc

SEQ ID NO: 405227 - DNA, 25 bp, Mus musculus
tcttttatgacgagctggatgccgc

SEQ ID NO: 405228 - DNA, 25 bp, Mus musculus
gacgagctggatgccgcctctggct

SEQ ID NO: 405229 - DNA, 25 bp, Mus musculus
gcccagccagggctcctacagccgt

SEQ ID NO: 405230 - DNA, 25 bp, Mus musculus
tcctacagccgtgcccgcatctact

SEQ ID NO: 405231 - DNA, 25 bp, Mus musculus
tgcgctcacctagcgcccgttttga

SEQ ID NO: 405232 - DNA, 25 bp, Mus musculus
tagcgcccgttttgatcggctgcca

SEQ ID NO: 405233 - DNA, 25 bp, Mus musculus
ttgatcggctgccaccacgcagtga

SEQ ID NO: 405234 - DNA, 25 bp, Mus musculus
tgccaccacgcagtgaggacatcta

SEQ ID NO: 405235 - DNA, 25 bp, Mus musculus
gaggacatctatgcagatcccgctg

SEQ ID NO: 405236 - DNA, 25 bp, Mus musculus
tgcagatcccgctgcctacgtgatg

SEQ ID NO: 405237 - DNA, 25 bp, Mus musculus
atcccgctgcctacgtgatgaggcg

SEQ ID NO: 405238 - DNA, 25 bp, Mus musculus
cctcccgacagccagtcttttatga

SEQ ID NO: 405239 - DNA, 25 bp, Mus musculus
cgacagccagtcttttatgacgagc

SEQ ID NO: 405240 - DNA, 25 bp, Mus musculus
cgccggagattggaacaggcagctc

SEQ ID NO: 405241 - DNA, 25 bp, Mus musculus
ctttgcgtcattaaggcggggcatc

SEQ ID NO: 405242 - DNA, 25 bp, Mus musculus
acccagagctccaggtagcggtgga

SEQ ID NO: 405243 - DNA, 25 bp, Mus musculus
gggcgttactgcgacccatgatgtc

SEQ ID NO: 405244 - DNA, 25 bp, Mus musculus
ttgctcggttgcatcgccggagatt

SEQ ID NO: 405245 - DNA, 25 bp, Mus musculus
aggcagctcgctcatgagtcatgga

SEQ ID NO: 405246 - DNA, 25 bp, Mus musculus
gtgctcgcccttttacctgcggagg

SEQ ID NO: 405247 - DNA, 25 bp, Mus musculus
cgtcccatgcttcagcgtcacggtg

SEQ ID NO: 405248 - DNA, 25 bp, Mus musculus
gtcacggtggaacaggacgacatcc

SEQ ID NO: 405249 - DNA, 25 bp, Mus musculus
gccgcactggaagcccgaacaagtt

SEQ ID NO: 405250 - DNA, 25 bp, Mus musculus
ttgatccctatgcaaagctgggctc

SEQ ID NO: 405251 - DNA, 25 bp, Mus musculus
aagctgggctcacgcttccctggac

SEQ ID NO: 405252 - DNA, 25 bp, Mus musculus
gagccttgcccgcagtgctcatgga

SEQ ID NO: 405253 - DNA, 25 bp, Mus musculus
ccatgatgtcactgtcgcggcggac

SEQ ID NO: 405254 - DNA, 25 bp, Mus musculus
cgcgaaggggcgcacttactaatcg

SEQ ID NO: 405255 - DNA, 25 bp, Mus musculus
gctcgcacggggacatctaagctca

SEQ ID NO: 405256 - DNA, 25 bp, Mus musculus
gctcaggctgggagtgcttaaactg

SEQ ID NO: 405257 - DNA, 25 bp, Mus musculus
cttaaactgggagcgttggtcaggc

SEQ ID NO: 405258 - DNA, 25 bp, Mus musculus
aaggggctgaaaggcgcttctccga

SEQ ID NO: 405259 - DNA, 25 bp, Mus musculus
tttatttctacagtgaaaggggctg

SEQ ID NO: 405260 - DNA, 25 bp, Mus musculus
gcttctgctcagtgcgtcccggcag

SEQ ID NO: 405261 - DNA, 25 bp, Mus musculus
tcggctccgcctggcaaaaactttg

SEQ ID NO: 405262 - DNA, 25 bp, Mus musculus
gcacttactaatcggtcgggcgcgg

SEQ ID NO: 405263 - DNA, 25 bp, Mus musculus
agagagccagcgtgtccctaggaac

SEQ ID NO: 405264 - DNA, 25 bp, Mus musculus
ctgccctccaaaaggacgcgggatc

SEQ ID NO: 405265 - DNA, 25 bp, Mus musculus
gcgcgcgtgtcaaacttcgcgaggc

SEQ ID NO: 405266 - DNA, 25 bp, Mus musculus
tcaaacttcgcgaggctggggtgat

SEQ ID NO: 405267 - DNA, 25 bp, Mus musculus
tttgcccaagatggaaagtcgcgcg

SEQ ID NO: 405268 - DNA, 25 bp, Mus musculus
gcggtacgccatggtggaagtcaca

SEQ ID NO: 405269 - DNA, 25 bp, Mus musculus
tctatgctgatagactccgccggcg

SEQ ID NO: 405270 - DNA, 25 bp, Mus musculus
aggagccgctttttctctatgctga

SEQ ID NO: 405271 - DNA, 25 bp, Mus musculus
ttgaagtcgaggtcggtcctacagc

SEQ ID NO: 405272 - DNA, 25 bp, Mus musculus
gggaacgcctctctaggccaggagc

SEQ ID NO: 405273 - DNA, 25 bp, Mus musculus
gccgcctcggaaagcgacttccgga

SEQ ID NO: 405274 - DNA, 25 bp, Mus musculus
accacacgagtaggaaggccgcctc

SEQ ID NO: 405275 - DNA, 25 bp, Mus musculus
cggcgatcaaggaaaagaactacac

SEQ ID NO: 405276 - DNA, 25 bp, Mus musculus
gccgggctacatccgcaagcacaaa

SEQ ID NO: 405277 - DNA, 25 bp, Mus musculus
caagcacaaacgaccgccgggagca

SEQ ID NO: 405278 - DNA, 25 bp, Mus musculus
gctttcatcgcggatcgccagcctg

SEQ ID NO: 405279 - DNA, 25 bp, Mus musculus
cccgagttcacgcagcgtaggatac

SEQ ID NO: 405280 - DNA, 25 bp, Mus musculus
agcgtaggatacgatgggctgcacc

SEQ ID NO: 405281 - DNA, 25 bp, Mus musculus
actcaaccgctctttgaagtcgagg

SEQ ID NO: 405282 - DNA, 25 bp, Mus musculus
ctgaagtctgcctaggagcccagca

SEQ ID NO: 405283 - DNA, 25 bp, Mus musculus
tgaaagtgccagcacgacgcaaagc

SEQ ID NO: 405284 - DNA, 25 bp, Mus musculus
gggaaagtgagctgaagtctgccta

SEQ ID NO: 405285 - DNA, 25 bp, Mus musculus
ctgatgggcccggttcagacttccc

SEQ ID NO: 405286 - DNA, 25 bp, Mus musculus
gatgacaatgtctccgactcccgcg

SEQ ID NO: 405287 - DNA, 25 bp, Mus musculus
gctgccacgtctttctcttttctta

SEQ ID NO: 405288 - DNA, 25 bp, Mus musculus
ctcttttcttagctgcggtcgcccg

SEQ ID NO: 405289 - DNA, 25 bp, Mus musculus
gtcctcacagcagccgaacaagcag

SEQ ID NO: 405290 - DNA, 25 bp, Mus musculus
ccgaacaagcagaaacccaggactg

SEQ ID NO: 405291 - DNA, 25 bp, Mus musculus
cccaggactgccagcgtcaaagatg

SEQ ID NO: 405292 - DNA, 25 bp, Mus musculus
cagcgtcaaagatggcgcccggcta

SEQ ID NO: 405293 - DNA, 25 bp, Mus musculus
cccggctacaggctcgcctttaagg

SEQ ID NO: 405294 - DNA, 25 bp, Mus musculus
tttaccgaaccgatgacaatgtctc

SEQ ID NO: 405295 - DNA, 25 bp, Mus musculus
tcgcctttaaggctgggccagtgaa

SEQ ID NO: 405296 - DNA, 25 bp, Mus musculus
tgctcaccggtcagtgcgtcctgga

SEQ ID NO: 405297 - DNA, 25 bp, Mus musculus
agaggaagcgcgctacaccgggcat

SEQ ID NO: 405298 - DNA, 25 bp, Mus musculus
ttattgggaacaagcaccggactcc

SEQ ID NO: 405299 - DNA, 25 bp, Mus musculus
cgctcactgacgtcattattgggaa

SEQ ID NO: 405300 - DNA, 25 bp, Mus musculus
aggcgctgaggtcatcgctcactga

SEQ ID NO: 405301 - DNA, 25 bp, Mus musculus
ctgcgcctttcataccactcgggga

SEQ ID NO: 405302 - DNA, 25 bp, Mus musculus
acgatgatgacggtctggccacctc

SEQ ID NO: 405303 - DNA, 25 bp, Mus musculus
tcataccggtggctgaggaagtagc

SEQ ID NO: 405304 - DNA, 25 bp, Mus musculus
gtcggttctcttcccgtggctcata

SEQ ID NO: 405305 - DNA, 25 bp, Mus musculus
ttgagtctctgctcgctcacgcagc

SEQ ID NO: 405306 - DNA, 25 bp, Mus musculus
atgcccggacgtcgtctctgcacag

SEQ ID NO: 405307 - DNA, 25 bp, Mus musculus
cccgagtcctcaggagactggagag

SEQ ID NO: 405308 - DNA, 25 bp, Mus musculus
gatctccgggagcatgtcggttctc

SEQ ID NO: 405309 - DNA, 25 bp, Mus musculus
tggagcgccctactgaaaaccttga

SEQ ID NO: 405310 - DNA, 25 bp, Mus musculus
cttctcaagacgtgactggctgtgc

SEQ ID NO: 405311 - DNA, 25 bp, Mus musculus
aggtgtacggagaccgcggtgacgc

SEQ ID NO: 405312 - DNA, 25 bp, Mus musculus
tgcttgacgcgcggcggccacgtca

SEQ ID NO: 405313 - DNA, 25 bp, Mus musculus
ttcccggaggattgcttgacgcgcg

SEQ ID NO: 405314 - DNA, 25 bp, Mus musculus
cgcttcccggaggattgcttgacgc

SEQ ID NO: 405315 - DNA, 25 bp, Mus musculus
ccaaataaggacagcgcttcccgga

SEQ ID NO: 405316 - DNA, 25 bp, Mus musculus
tgcgcccaaataaggacagcgcttc

SEQ ID NO: 405317 - DNA, 25 bp, Mus musculus
gggtctgcgcccaaataaggacagc

SEQ ID NO: 405318 - DNA, 25 bp, Mus musculus
cgcaccgggtctgcgcccaaataag

SEQ ID NO: 405319 - DNA, 25 bp, Mus musculus
caagacgtgactggctgtgcgcccg

SEQ ID NO: 405320 - DNA, 25 bp, Mus musculus
acggagccagcgtcccttctcaaga

SEQ ID NO: 405321 - DNA, 25 bp, Mus musculus
gccagcgtcccttctcaagacgtga

SEQ ID NO: 405322 - DNA, 25 bp, Mus musculus
ggcggctacggccacgcaatttccc

SEQ ID NO: 405323 - DNA, 25 bp, Mus musculus
tcccttctcaagacgtgactggctg

SEQ ID NO: 405324 - DNA, 25 bp, Mus musculus
cagagcggactttcagctgctccca

SEQ ID NO: 405325 - DNA, 25 bp, Mus musculus
gtttccggacacgtgcgtctcgcgt

SEQ ID NO: 405326 - DNA, 25 bp, Mus musculus
agaccaagtggtctccctcgaaatg

SEQ ID NO: 405327 - DNA, 25 bp, Mus musculus
agacacttgcgacccagccgcgaga

SEQ ID NO: 405328 - DNA, 25 bp, Mus musculus
taactcccggggtatggacagccta

SEQ ID NO: 405329 - DNA, 25 bp, Mus musculus
ggggtgcacaagctctgccggaccc

SEQ ID NO: 405330 - DNA, 25 bp, Mus musculus
cccagtagccctggtaggtgttgcc

SEQ ID NO: 405331 - DNA, 25 bp, Mus musculus
ctgggccaggtgtagactccaacca

SEQ ID NO: 405332 - DNA, 25 bp, Mus musculus
cgtgcgaccaggagccagagtactc

SEQ ID NO: 405333 - DNA, 25 bp, Mus musculus
gcccagtctccagagcggactttca

SEQ ID NO: 405334 - DNA, 25 bp, Mus musculus
agagtactcgccctggcccttgggc

SEQ ID NO: 405335 - DNA, 25 bp, Mus musculus
aggtgccgccatcgtcgaagtcgaa

SEQ ID NO: 405336 - DNA, 25 bp, Mus musculus
gcgcgcgagaggacagcccagtctc

SEQ ID NO: 405337 - DNA, 25 bp, Mus musculus
tcggagactcccgagatgccgctca

SEQ ID NO: 405338 - DNA, 25 bp, Mus musculus
cgaccgctcctgttgcagctgtagc

SEQ ID NO: 405339 - DNA, 25 bp, Mus musculus
ccgcgataacatctgtcaaaggctc

SEQ ID NO: 405340 - DNA, 25 bp, Mus musculus
atctgtcaaaggctcagatcccgcc

SEQ ID NO: 405341 - DNA, 25 bp, Mus musculus
cctcttccattttgggccaatggtc

SEQ ID NO: 405342 - DNA, 25 bp, Mus musculus
ccattttgggccaatggtcgaggcc

SEQ ID NO: 405343 - DNA, 25 bp, Mus musculus
cgcctgtgccggtttgtctaccctt

SEQ ID NO: 405344 - DNA, 25 bp, Mus musculus
agccgcctcctttcaaccttgtccg

SEQ ID NO: 405345 - DNA, 25 bp, Mus musculus
ccttgtccgccggttggcgcggtct

SEQ ID NO: 405346 - DNA, 25 bp, Mus musculus
atcacagcggcgaccgctcctgttg

SEQ ID NO: 405347 - DNA, 25 bp, Mus musculus
ctgttgcagctgtagctctctccct

SEQ ID NO: 405348 - DNA, 25 bp, Mus musculus
gcccgccatggctctactcactgca

SEQ ID NO: 405349 - DNA, 25 bp, Mus musculus
tcactgcagcaacccggctcttggg

SEQ ID NO: 405350 - DNA, 25 bp, Mus musculus
gcaacccggctcttgggagccaagg

SEQ ID NO: 405351 - DNA, 25 bp, Mus musculus
ttggcgcggtctccatcacagcggc

SEQ ID NO: 405352 - DNA, 25 bp, Mus musculus
gacccggaggcaaggagctcaccat

SEQ ID NO: 405353 - DNA, 25 bp, Mus musculus
gcgcatcggctcatcgttctccagg

SEQ ID NO: 405354 - DNA, 25 bp, Mus musculus
ggcaaggagctcaccatcctgcctg

SEQ ID NO: 405355 - DNA, 25 bp, Mus musculus
catcctgcctgccaaccggtagggg

SEQ ID NO: 405356 - DNA, 25 bp, Mus musculus
ccgcgccgggcagggttgggttctg

SEQ ID NO: 405357 - DNA, 25 bp, Mus musculus
tcatcgttctccaggctcccgccgc

SEQ ID NO: 405358 - DNA, 25 bp, Mus musculus
gggttctgggcaccgcgcgcgcatc

SEQ ID NO: 405359 - DNA, 25 bp, Mus musculus
gcatcggctcatcgttctccaggct

SEQ ID NO: 405360 - DNA, 25 bp, Mus musculus
ggctcatcgttctccaggctcccgc

SEQ ID NO: 405361 - DNA, 25 bp, Mus musculus
ggaggcaaggagctcaccatcctgc

SEQ ID NO: 405362 - DNA, 25 bp, Mus musculus
cggaggcaaggagctcaccatcctg

SEQ ID NO: 405363 - DNA, 25 bp, Mus musculus
acccggaggcaaggagctcaccatc

SEQ ID NO: 405364 - DNA, 25 bp, Mus musculus
cgacccggaggcaaggagctcacca

SEQ ID NO: 405365 - DNA, 25 bp, Mus musculus
ccggaggcaaggagctcaccatcct

SEQ ID NO: 405366 - DNA, 25 bp, Mus musculus
cggcctttcaagcaatcacatggtg

SEQ ID NO: 405367 - DNA, 25 bp, Mus musculus
ctcagccccggacgcctttaaagag

SEQ ID NO: 405368 - DNA, 25 bp, Mus musculus
cctttcaagcaatcacatggtgtgg

SEQ ID NO: 405369 - DNA, 25 bp, Mus musculus
caatcacatggtgtggcagaggctc

SEQ ID NO: 405370 - DNA, 25 bp, Mus musculus
acatggtgtggcagaggctcagccc

SEQ ID NO: 405371 - DNA, 25 bp, Mus musculus
cctgtttcgtacctgggactggatg

SEQ ID NO: 405372 - DNA, 25 bp, Mus musculus
caggcgtgattctgagggactaagc

SEQ ID NO: 405373 - DNA, 25 bp, Mus musculus
gcgtgattctgagggactaagccca

SEQ ID NO: 405374 - DNA, 25 bp, Mus musculus
ctgagggactaagcccaggacctgg

SEQ ID NO: 405375 - DNA, 25 bp, Mus musculus
acctggcgggtccaccggctcccat

SEQ ID NO: 405376 - DNA, 25 bp, Mus musculus
tgcgcgcacgcctaccctgtgccca

SEQ ID NO: 405377 - DNA, 25 bp, Mus musculus
gtgcccacccacctgggacgccgct

SEQ ID NO: 405378 - DNA, 25 bp, Mus musculus
gcccggcctttcaagcaatcacatg

SEQ ID NO: 405379 - DNA, 25 bp, Mus musculus
tttcgtacctgggactggatggcag

SEQ ID NO: 405380 - DNA, 25 bp, Mus musculus
tgggaaaacgtgagcgtctcgaatg

SEQ ID NO: 405381 - DNA, 25 bp, Mus musculus
agggacagtaccgaggtgccgattc

SEQ ID NO: 405382 - DNA, 25 bp, Mus musculus
acagggacagtaccgaggtgccgat

SEQ ID NO: 405383 - DNA, 25 bp, Mus musculus
atccggcctcgggacagggacagta

SEQ ID NO: 405384 - DNA, 25 bp, Mus musculus
tgatgtatggatccggcctcgggac

SEQ ID NO: 405385 - DNA, 25 bp, Mus musculus
tggtgtgatgtatggatccggcctc

SEQ ID NO: 405386 - DNA, 25 bp, Mus musculus
aatggtgtgatgtatggatccggcc

SEQ ID NO: 405387 - DNA, 25 bp, Mus musculus
ctcgaatggtgtgatgtatggatcc

SEQ ID NO: 405388 - DNA, 25 bp, Mus musculus
cgtctcgaatggtgtgatgtatgga

SEQ ID NO: 405389 - DNA, 25 bp, Mus musculus
agcgtctcgaatggtgtgatgtatg

SEQ ID NO: 405390 - DNA, 25 bp, Mus musculus
tgagcgtctcgaatggtgtgatgta

SEQ ID NO: 405391 - DNA, 25 bp, Mus musculus
aacgtgagcgtctcgaatggtgtga

SEQ ID NO: 405392 - DNA, 25 bp, Mus musculus
gacagtaccgaggtgccgattcccg

SEQ ID NO: 405393 - DNA, 25 bp, Mus musculus
gaaaacgtgagcgtctcgaatggtg

SEQ ID NO: 405394 - DNA, 25 bp, Mus musculus
agcgtggacacacggaagcccgccg

SEQ ID NO: 405395 - DNA, 25 bp, Mus musculus
tgcagccaagcacgaagcgaagcgg

SEQ ID NO: 405396 - DNA, 25 bp, Mus musculus
acggggcgagcacagccacagcctg

SEQ ID NO: 405397 - DNA, 25 bp, Mus musculus
tcagcaggagtaggtccggaccgta

SEQ ID NO: 405398 - DNA, 25 bp, Mus musculus
gaccgtagagggctccagtctctgc

SEQ ID NO: 405399 - DNA, 25 bp, Mus musculus
agaacacacagagcgcgggttagtg

SEQ ID NO: 405400 - DNA, 25 bp, Mus musculus
accgcagcgttagtgcagctcagcc

SEQ ID NO: 405401 - DNA, 25 bp, Mus musculus
cggggaggaacccattaccagcatg

SEQ ID NO: 405402 - DNA, 25 bp, Mus musculus
catgatcttcttaggcggggcaggt

SEQ ID NO: 405403 - DNA, 25 bp, Mus musculus
gggtctccgctgaggtgcccaacat

SEQ ID NO: 405404 - DNA, 25 bp, Mus musculus
tgcccaacatgccaccgctatggtg

SEQ ID NO: 405405 - DNA, 25 bp, Mus musculus
cgctatggtgatcccgaggccggaa

SEQ ID NO: 405406 - DNA, 25 bp, Mus musculus
gaggccggaagcgtttcctccagga

SEQ ID NO: 405407 - DNA, 25 bp, Mus musculus
atggcactcaccttccggcatgatc

SEQ ID NO: 405408 - DNA, 25 bp, Mus musculus
tggaatcgccgaaggcccagcggta

SEQ ID NO: 405409 - DNA, 25 bp, Mus musculus
ctgtgggtgctcacctgcgtggaat

SEQ ID NO: 405410 - DNA, 25 bp, Mus musculus
cacctgcgtggaatcgccgaaggcc

SEQ ID NO: 405411 - DNA, 25 bp, Mus musculus
cgcgaggcgtcctagaggcaagcct

SEQ ID NO: 405412 - DNA, 25 bp, Mus musculus
cgtcctagaggcaagcctgcaaagg

SEQ ID NO: 405413 - DNA, 25 bp, Mus musculus
ctttgatgctgtgcgccatcttggt

SEQ ID NO: 405414 - DNA, 25 bp, Mus musculus
cctgcaaaggtagctgcagcctcca

SEQ ID NO: 405415 - DNA, 25 bp, Mus musculus
cagtaccgtggcctcaaggacccgc

SEQ ID NO: 405416 - DNA, 25 bp, Mus musculus
ccagccctggttcgcacgtgacaag

SEQ ID NO: 405417 - DNA, 25 bp, Mus musculus
ctggttcgcacgtgacaagggcgct

SEQ ID NO: 405418 - DNA, 25 bp, Mus musculus
gacaagggcgctgctttgatgctgt

SEQ ID NO: 405419 - DNA, 25 bp, Mus musculus
cgctgctttgatgctgtgcgccatc

SEQ ID NO: 405420 - DNA, 25 bp, Mus musculus
aggcaagcctgcaaaggtagctgca

SEQ ID NO: 405421 - DNA, 25 bp, Mus musculus
tgctcacctgcgtggaatcgccgaa

SEQ ID NO: 405422 - DNA, 25 bp, Mus musculus
atcaccgtcttctctggggcgtttg

SEQ ID NO: 405423 - DNA, 25 bp, Mus musculus
tgggtcccgttgattgccgacgccc

SEQ ID NO: 405424 - DNA, 25 bp, Mus musculus
agggctctgggtcccgttgattgcc

SEQ ID NO: 405425 - DNA, 25 bp, Mus musculus
tcgcgaggacttcggcgagggctct

SEQ ID NO: 405426 - DNA, 25 bp, Mus musculus
ccctctcggggagccaatcgcctcc

SEQ ID NO: 405427 - DNA, 25 bp, Mus musculus
cttctctggggcgtttggtcctcca

SEQ ID NO: 405428 - DNA, 25 bp, Mus musculus
aggccgcggctatcgcgaggacttc

SEQ ID NO: 405429 - DNA, 25 bp, Mus musculus
ccaggttcccaaagcggagcgggct

SEQ ID NO: 405430 - DNA, 25 bp, Mus musculus
tggggcgtttggtcctccagaccgc

SEQ ID NO: 405431 - DNA, 25 bp, Mus musculus
ggagtgcgttgtcaccgtcttcatc

SEQ ID NO: 405432 - DNA, 25 bp, Mus musculus
tgcgttgtcaccgtcttcatcaccg

SEQ ID NO: 405433 - DNA, 25 bp, Mus musculus
gtcttcatcaccgtcttctctgggg

SEQ ID NO: 405434 - DNA, 25 bp, Mus musculus
gttgtcaccgtcttcatcaccgtct

SEQ ID NO: 405435 - DNA, 25 bp, Mus musculus
gcagcggaggccaggttcccaaagc

SEQ ID NO: 405436 - DNA, 25 bp, Mus musculus
cccaccttggatgctggagtctcgc

SEQ ID NO: 405437 - DNA, 25 bp, Mus musculus
catggggatccagccggtaagaccc

SEQ ID NO: 405438 - DNA, 25 bp, Mus musculus
gatgctggagtctcgctgcacgagc

SEQ ID NO: 405439 - DNA, 25 bp, Mus musculus
tgccatacccaccttggatgctgga

SEQ ID NO: 405440 - DNA, 25 bp, Mus musculus
gggctgtgccatacccaccttggat

SEQ ID NO: 405441 - DNA, 25 bp, Mus musculus
ctcagctggttctgggcagtctgcc

SEQ ID NO: 405442 - DNA, 25 bp, Mus musculus
aagaccctcgttctgtgccctgagc

SEQ ID NO: 405443 - DNA, 25 bp, Mus musculus
gtaagaccctcgttctgtgccctga

SEQ ID NO: 405444 - DNA, 25 bp, Mus musculus
tccagccggtaagaccctcgttctg

SEQ ID NO: 405445 - DNA, 25 bp, Mus musculus
cgcacctctaggtcatggggatcca

SEQ ID NO: 405446 - DNA, 25 bp, Mus musculus
ggcgcattgtgggatctttccgccc

SEQ ID NO: 405447 - DNA, 25 bp, Mus musculus
cccgcggcgcattgtgggatctttc

SEQ ID NO: 405448 - DNA, 25 bp, Mus musculus
gctggagtctcgctgcacgagctgc

SEQ ID NO: 405449 - DNA, 25 bp, Mus musculus
caccggagcgggacgcacctctagg

SEQ ID NO: 405450 - DNA, 25 bp, Mus musculus
agtccgcgagtgctgtctccgcagc

SEQ ID NO: 405451 - DNA, 25 bp, Mus musculus
accgcgatccgcaggtcaaacgtga

SEQ ID NO: 405452 - DNA, 25 bp, Mus musculus
ccagccaggccgtaagtgtcccggg

SEQ ID NO: 405453 - DNA, 25 bp, Mus musculus
gcagaggcagccagccaggccgtaa

SEQ ID NO: 405454 - DNA, 25 bp, Mus musculus
tggcacgcgcaggaatgcctggatc

SEQ ID NO: 405455 - DNA, 25 bp, Mus musculus
gccctgatgattggcacgcgcagga

SEQ ID NO: 405456 - DNA, 25 bp, Mus musculus
ctgagcgcgccctgatgattggcac

SEQ ID NO: 405457 - DNA, 25 bp, Mus musculus
ggctccctcctggatagggtcggtc

SEQ ID NO: 405458 - DNA, 25 bp, Mus musculus
ggccaagctgggacagccagagcca

SEQ ID NO: 405459 - DNA, 25 bp, Mus musculus
cagtccgccagtgtagggccaagct

SEQ ID NO: 405460 - DNA, 25 bp, Mus musculus
gaggcttttgcagtccgccagtgta

SEQ ID NO: 405461 - DNA, 25 bp, Mus musculus
gagaagaggcttttgcagtccgcca

SEQ ID NO: 405462 - DNA, 25 bp, Mus musculus
ccagagccagcgattggtcagatca

SEQ ID NO: 405463 - DNA, 25 bp, Mus musculus
caggtcaaacgtgacggggctccct

SEQ ID NO: 405464 - DNA, 25 bp, Mus musculus
cgctgcaggcatagcgctgccttct

SEQ ID NO: 405465 - DNA, 25 bp, Mus musculus
ttgggtccttctggcctccagcgca

SEQ ID NO: 405466 - DNA, 25 bp, Mus musculus
aggtctctttttctgagctctcagg

SEQ ID NO: 405467 - DNA, 25 bp, Mus musculus
tgagctctcaggtaagcaggacttc

SEQ ID NO: 405468 - DNA, 25 bp, Mus musculus
aagcaggacttcttggctcggcctc

SEQ ID NO: 405469 - DNA, 25 bp, Mus musculus
ggctcggcctcctaaggtgacgtaa

SEQ ID NO: 405470 - DNA, 25 bp, Mus musculus
tgacgtaacccaggagaggcccgcc

SEQ ID NO: 405471 - DNA, 25 bp, Mus musculus
tcccgtggcgtgacgtcatcatgcc

SEQ ID NO: 405472 - DNA, 25 bp, Mus musculus
cgccgtactccgagactggagttta

SEQ ID NO: 405473 - DNA, 25 bp, Mus musculus
gagactgctccgcagcggctggtcc

SEQ ID NO: 405474 - DNA, 25 bp, Mus musculus
tctcccgagtgtggcaggaacgcag

SEQ ID NO: 405475 - DNA, 25 bp, Mus musculus
ggaccgccagtcttgggtccttctg

SEQ ID NO: 405476 - DNA, 25 bp, Mus musculus
ggaacgcagcctagcgcctgccata

SEQ ID NO: 405477 - DNA, 25 bp, Mus musculus
ctggagtttaccacggagactgctc

SEQ ID NO: 405478 - DNA, 25 bp, Mus musculus
aatagagttcagacgcctgcgcaga

SEQ ID NO: 405479 - DNA, 25 bp, Mus musculus
cttgatgctgcttagagtcgcgctg

SEQ ID NO: 405480 - DNA, 25 bp, Mus musculus
gtccggcaatagagaaaggcgcctg

SEQ ID NO: 405481 - DNA, 25 bp, Mus musculus
agggacctgcgccagcgtagttccg

SEQ ID NO: 405482 - DNA, 25 bp, Mus musculus
ttccgggtgagccagctcagatcgc

SEQ ID NO: 405483 - DNA, 25 bp, Mus musculus
ctcagatcgcgcgtgcgccgttgtg

SEQ ID NO: 405484 - DNA, 25 bp, Mus musculus
tggaaccctgcgagctgcagaacga

SEQ ID NO: 405485 - DNA, 25 bp, Mus musculus
tgcagaacgagctcgtgtcagccga

SEQ ID NO: 405486 - DNA, 25 bp, Mus musculus
tgctgtgccagcgttgtggctctcg

SEQ ID NO: 405487 - DNA, 25 bp, Mus musculus
ctgagcgacccagcggctccgggtt

SEQ ID NO: 405488 - DNA, 25 bp, Mus musculus
caggtaggaaagtgcttgatgctgc

SEQ ID NO: 405489 - DNA, 25 bp, Mus musculus
aggcgcctgcgcaatagagttcaga

SEQ ID NO: 405490 - DNA, 25 bp, Mus musculus
tgctcttttctctcgccggcaggta

SEQ ID NO: 405491 - DNA, 25 bp, Mus musculus
acgcctgcgcagaggtacagcgaga

SEQ ID NO: 405492 - DNA, 25 bp, Mus musculus
cagactgcccagtgaccgccttcgg

SEQ ID NO: 405493 - DNA, 25 bp, Mus musculus
caagctacgctgaaaggtgggtttc

SEQ ID NO: 405494 - DNA, 25 bp, Mus musculus
ctgcggggcgcaagctacgctgaaa

SEQ ID NO: 405495 - DNA, 25 bp, Mus musculus
ccagtccagcgccacgctccgggct

SEQ ID NO: 405496 - DNA, 25 bp, Mus musculus
cgccctggctgcagacccagtccag

SEQ ID NO: 405497 - DNA, 25 bp, Mus musculus
atagcggacagaaggaccgccctgg

SEQ ID NO: 405498 - DNA, 25 bp, Mus musculus
ggccacccaatagcggacagaagga

SEQ ID NO: 405499 - DNA, 25 bp, Mus musculus
tatgcggccacccaatagcggacag

SEQ ID NO: 405500 - DNA, 25 bp, Mus musculus
accgccttcggcgacacagtatgcg

SEQ ID NO: 405501 - DNA, 25 bp, Mus musculus
caagcgcggtgattgtgttgtctgc

SEQ ID NO: 405502 - DNA, 25 bp, Mus musculus
cctcacctagcaagcgcggtgattg

SEQ ID NO: 405503 - DNA, 25 bp, Mus musculus
gcggacctcacctagcaagcgcggt

SEQ ID NO: 405504 - DNA, 25 bp, Mus musculus
gctccgggctgtcgccgcaggctta

SEQ ID NO: 405505 - DNA, 25 bp, Mus musculus
gcgacacagtatgcggccacccaat

SEQ ID NO: 405506 - DNA, 25 bp, Mus musculus
ctgtggtagaaaaagatccagacta

SEQ ID NO: 405507 - DNA, 25 bp, Mus musculus
taaaggcatgcagaccgttcgggat

SEQ ID NO: 405508 - DNA, 25 bp, Mus musculus
aaaggcatgcagaccgttcgggata

SEQ ID NO: 405509 - DNA, 25 bp, Mus musculus
ggcatgcagaccgttcgggatatgt

SEQ ID NO: 405510 - DNA, 25 bp, Mus musculus
atgcagaccgttcgggatatgtggc

SEQ ID NO: 405511 - DNA, 25 bp, Mus musculus
cagaccgttcgggatatgtggctgt

SEQ ID NO: 405512 - DNA, 25 bp, Mus musculus
tgtggctgtggtagaaaaagatcca

SEQ ID NO: 405513 - DNA, 25 bp, Mus musculus
tggtagaaaaagatccagactagct

SEQ ID NO: 405514 - DNA, 25 bp, Mus musculus
gaaaaagatccagactagctagaca

SEQ ID NO: 405515 - DNA, 25 bp, Mus musculus
gatccagactagctagacaaaggtc

SEQ ID NO: 405516 - DNA, 25 bp, Mus musculus
ccagactagctagacaaaggtcgtg

SEQ ID NO: 405517 - DNA, 25 bp, Mus musculus
actagctagacaaaggtcgtggtgg

SEQ ID NO: 405518 - DNA, 25 bp, Mus musculus
ctagacaaaggtcgtggtgggacgg

SEQ ID NO: 405519 - DNA, 25 bp, Mus musculus
tatgtggctgtggtagaaaaagatc

SEQ ID NO: 405520 - DNA, 25 bp, Mus musculus
tgcactaagtgcaccagcggaaatg

SEQ ID NO: 405521 - DNA, 25 bp, Mus musculus
gcgccactaagaagcgtcgcgttcc

SEQ ID NO: 405522 - DNA, 25 bp, Mus musculus
tgcattcagaactggggtgcactaa

SEQ ID NO: 405523 - DNA, 25 bp, Mus musculus
cttgtgggcctccaagcggccggac

SEQ ID NO: 405524 - DNA, 25 bp, Mus musculus
ggtccacctcattctgtaccactgg

SEQ ID NO: 405525 - DNA, 25 bp, Mus musculus
taacggcctgtagtcaagggctgca

SEQ ID NO: 405526 - DNA, 25 bp, Mus musculus
gtgactcaggtactgccactcagga

SEQ ID NO: 405527 - DNA, 25 bp, Mus musculus
ggacgcactccttcagctctcaaaa

SEQ ID NO: 405528 - DNA, 25 bp, Mus musculus
tgcaccagcggaaatgagatgattc

SEQ ID NO: 405529 - DNA, 25 bp, Mus musculus
cgccggacaaggaggtccacctcat

SEQ ID NO: 405530 - DNA, 25 bp, Mus musculus
cactcggtttcagcaccaggacagc

SEQ ID NO: 405531 - DNA, 25 bp, Mus musculus
tagtcaagggctgcactcggtttca

SEQ ID NO: 405532 - DNA, 25 bp, Mus musculus
tgccactcaggaagcgccactaaga

SEQ ID NO: 405533 - DNA, 25 bp, Mus musculus
agctctcaaaaggtaacggcctgta

SEQ ID NO: 405534 - DNA, 25 bp, Mus musculus
gacacgtgcgctacgtgctgcgcta

SEQ ID NO: 405535 - DNA, 25 bp, Mus musculus
aagcctggtctccactgcacggcga

SEQ ID NO: 405536 - DNA, 25 bp, Mus musculus
gtagacccaacgcactaacagtaag

SEQ ID NO: 405537 - DNA, 25 bp, Mus musculus
gggagcagaaccgacacgtgcgcta

SEQ ID NO: 405538 - DNA, 25 bp, Mus musculus
gtctccactgcacggcgaccggaag

SEQ ID NO: 405539 - DNA, 25 bp, Mus musculus
cagaagcctggtctccactgcacgg

SEQ ID NO: 405540 - DNA, 25 bp, Mus musculus
cttcgcgtttggaacccagaagcct

SEQ ID NO: 405541 - DNA, 25 bp, Mus musculus
tccttcttcgcgtttggaacccaga

SEQ ID NO: 405542 - DNA, 25 bp, Mus musculus
cttctggggagccaggcctgctccc

SEQ ID NO: 405543 - DNA, 25 bp, Mus musculus
cactaacagtaaggccagggcggaa

SEQ ID NO: 405544 - DNA, 25 bp, Mus musculus
agcagaaccgacacgtgcgctacgt

SEQ ID NO: 405545 - DNA, 25 bp, Mus musculus
aaggcacacggacggcaccggagcc

SEQ ID NO: 405546 - DNA, 25 bp, Mus musculus
ccaacgcactaacagtaaggccagg

SEQ ID NO: 405547 - DNA, 25 bp, Mus musculus
gtgcgctacgtgctgcgctagccgc

SEQ ID NO: 405548 - DNA, 25 bp, Mus musculus
gttcctggagacgtggcactctgag

SEQ ID NO: 405549 - DNA, 25 bp, Mus musculus
ctctgagcgggctcggttttactcc

SEQ ID NO: 405550 - DNA, 25 bp, Mus musculus
ccgagaacctggcactgtggctccg

SEQ ID NO: 405551 - DNA, 25 bp, Mus musculus
gagaacctggcactgtggctccgcc

SEQ ID NO: 405552 - DNA, 25 bp, Mus musculus
gagcctgagaccaggcacctccagg

SEQ ID NO: 405553 - DNA, 25 bp, Mus musculus
tcgggccgtggccaatcatcgcctg

SEQ ID NO: 405554 - DNA, 25 bp, Mus musculus
ccctgcactagacaatgcgggccgg

SEQ ID NO: 405555 - DNA, 25 bp, Mus musculus
gcactagacaatgcgggccgggccc

SEQ ID NO: 405556 - DNA, 25 bp, Mus musculus
gcggagtgttgtccaagagtaagga

SEQ ID NO: 405557 - DNA, 25 bp, Mus musculus
tgggagcctgagaccaggcacctcc

SEQ ID NO: 405558 - DNA, 25 bp, Mus musculus
aatcatcgcctgtggctaggctctt

SEQ ID NO: 405559 - DNA, 25 bp, Mus musculus
cgtggccaatcatcgcctgtggcta

SEQ ID NO: 405560 - DNA, 25 bp, Mus musculus
agccggccctgcactagacaatgcg

SEQ ID NO: 405561 - DNA, 25 bp, Mus musculus
ccaggtccggcctctggggcgtcca

SEQ ID NO: 405562 - DNA, 25 bp, Mus musculus
atgctcgcaggtcctggcggacgct

SEQ ID NO: 405563 - DNA, 25 bp, Mus musculus
cccgagtgtccggtcttcgagccga

SEQ ID NO: 405564 - DNA, 25 bp, Mus musculus
cttcgagccgagctgggaagagttc

SEQ ID NO: 405565 - DNA, 25 bp, Mus musculus
gcggacgctcccacacggacttggg

SEQ ID NO: 405566 - DNA, 25 bp, Mus musculus
acttggggccggactgctttgctcc

SEQ ID NO: 405567 - DNA, 25 bp, Mus musculus
ggccctgatgctcgcaggtcctggc

SEQ ID NO: 405568 - DNA, 25 bp, Mus musculus
accaccacctggtccctcggcctct

SEQ ID NO: 405569 - DNA, 25 bp, Mus musculus
cgtcggcccgaagctgccctcacct

SEQ ID NO: 405570 - DNA, 25 bp, Mus musculus
aagttttcaatatggcggcgggagc

SEQ ID NO: 405571 - DNA, 25 bp, Mus musculus
tgtgaggaggaaagttttcaatatg

SEQ ID NO: 405572 - DNA, 25 bp, Mus musculus
tagccgagcagactgggatctgtaa

SEQ ID NO: 405573 - DNA, 25 bp, Mus musculus
aagatccggcccatagccgagcaga

SEQ ID NO: 405574 - DNA, 25 bp, Mus musculus
ttcgctttcatccacaagatccggc

SEQ ID NO: 405575 - DNA, 25 bp, Mus musculus
gctcccacacggacttggggccgga

SEQ ID NO: 405576 - DNA, 25 bp, Mus musculus
caaggggaccggacgcctgcaccgt

SEQ ID NO: 405577 - DNA, 25 bp, Mus musculus
tcggggacagcggatctctcctgcc

SEQ ID NO: 405578 - DNA, 25 bp, Mus musculus
tctgagtccagatgcagaagggatc

SEQ ID NO: 405579 - DNA, 25 bp, Mus musculus
ctccatcctggcttctgagtccaga

SEQ ID NO: 405580 - DNA, 25 bp, Mus musculus
ccctgggtcaagcttcggggatctg

SEQ ID NO: 405581 - DNA, 25 bp, Mus musculus
gatgcagaagggatctggctcctga

SEQ ID NO: 405582 - DNA, 25 bp, Mus musculus
tgcaccgtcctttgcagggagtttg

SEQ ID NO: 405583 - DNA, 25 bp, Mus musculus
ctttgcagggagtttgcctcgccac

SEQ ID NO: 405584 - DNA, 25 bp, Mus musculus
agccctggagcgagaagcaggcttc

SEQ ID NO: 405585 - DNA, 25 bp, Mus musculus
ctcccgtcggggacagcggatctct

SEQ ID NO: 405586 - DNA, 25 bp, Mus musculus
gcctgtttgcgacgtctccagcctg

SEQ ID NO: 405587 - DNA, 25 bp, Mus musculus
aagcaggcttctctgcgggtttgcg

SEQ ID NO: 405588 - DNA, 25 bp, Mus musculus
cgactctgttcctggcgtttccgtc

SEQ ID NO: 405589 - DNA, 25 bp, Mus musculus
tccaaagtttctccatcctggcttc

SEQ ID NO: 405590 - DNA, 25 bp, Mus musculus
gtgggctaccaggacaggtccctgc

SEQ ID NO: 405591 - DNA, 25 bp, Mus musculus
cgcccagcctgcaacttctgaaatg

SEQ ID NO: 405592 - DNA, 25 bp, Mus musculus
cttctgaaatgaccgcatgcggcta

SEQ ID NO: 405593 - DNA, 25 bp, Mus musculus
tgcccggtgactccaagcagcatct

SEQ ID NO: 405594 - DNA, 25 bp, Mus musculus
tccaagcagcatcttcccggggcgg

SEQ ID NO: 405595 - DNA, 25 bp, Mus musculus
ctcaagaacagggtgtgggctacca

SEQ ID NO: 405596 - DNA, 25 bp, Mus musculus
tcccggaaaagcttgcagaagcggg

SEQ ID NO: 405597 - DNA, 25 bp, Mus musculus
ccaggatctggatcggggatcgcct

SEQ ID NO: 405598 - DNA, 25 bp, Mus musculus
cgccgagaagctcccggaaaagctt

SEQ ID NO: 405599 - DNA, 25 bp, Mus musculus
aggcggatgtgaggcgcatctcaat

SEQ ID NO: 405600 - DNA, 25 bp, Mus musculus
ggaagcggatcaggttgttactact

SEQ ID NO: 405601 - DNA, 25 bp, Mus musculus
tgttactactgcagagcgcgcgagc

SEQ ID NO: 405602 - DNA, 25 bp, Mus musculus
acttcggggcggcagactcccgctg

SEQ ID NO: 405603 - DNA, 25 bp, Mus musculus
cgcggactgtcctgactcaagaaca

SEQ ID NO: 405604 - DNA, 25 bp, Mus musculus
ttggtagccctgtgtggccactgcc

SEQ ID NO: 405605 - DNA, 25 bp, Mus musculus
caccacaagactgttggtagccctg

SEQ ID NO: 405606 - DNA, 25 bp, Mus musculus
cgtccacgttgaccgtgttgatgtc

SEQ ID NO: 405607 - DNA, 25 bp, Mus musculus
atctttactcctcccgctagtagca

SEQ ID NO: 405608 - DNA, 25 bp, Mus musculus
agctgctgccaaaagtaccaccaca

SEQ ID NO: 405609 - DNA, 25 bp, Mus musculus
attgctcgagcttccgcagctgctg

SEQ ID NO: 405610 - DNA, 25 bp, Mus musculus
gcgggctcctgctctgtcagcgagc

SEQ ID NO: 405611 - DNA, 25 bp, Mus musculus
tcccgcgtctggtctgcagctggcg

SEQ ID NO: 405612 - DNA, 25 bp, Mus musculus
gcaccgtcttcgaagcggaccctgg

SEQ ID NO: 405613 - DNA, 25 bp, Mus musculus
aggcagctagaaagaccgcaccgtc

SEQ ID NO: 405614 - DNA, 25 bp, Mus musculus
gaagctttttcacctcgtccgtgtc

SEQ ID NO: 405615 - DNA, 25 bp, Mus musculus
cgcacctcttgccagaagctttttc

SEQ ID NO: 405616 - DNA, 25 bp, Mus musculus
accgtgttgatgtccgcacctcttg

SEQ ID NO: 405617 - DNA, 25 bp, Mus musculus
cctcggagggcttcagccagggaat

SEQ ID NO: 405618 - DNA, 25 bp, Mus musculus
ttccgcgtgagcacagcagaggcgc

SEQ ID NO: 405619 - DNA, 25 bp, Mus musculus
cccaggtttgctgcggaccaatcac

SEQ ID NO: 405620 - DNA, 25 bp, Mus musculus
cgggaactgagaattccggatacgc

SEQ ID NO: 405621 - DNA, 25 bp, Mus musculus
ctgagaattccggatacgcgtgcgc

SEQ ID NO: 405622 - DNA, 25 bp, Mus musculus
gaattccggatacgcgtgcgcgcgc

SEQ ID NO: 405623 - DNA, 25 bp, Mus musculus
gcgcgccaatttgagcggtgcgtga

SEQ ID NO: 405624 - DNA, 25 bp, Mus musculus
cgcaagctctgagcggtggccaata

SEQ ID NO: 405625 - DNA, 25 bp, Mus musculus
ccaatcacagtcctctcctggaagg

SEQ ID NO: 405626 - DNA, 25 bp, Mus musculus
ggggtggagtcattccaacggtctc

SEQ ID NO: 405627 - DNA, 25 bp, Mus musculus
gtctccgcggttccgcgtgagcaca

SEQ ID NO: 405628 - DNA, 25 bp, Mus musculus
ctgacgggtgctgcgagtgccacct

SEQ ID NO: 405629 - DNA, 25 bp, Mus musculus
agtgccacctgagggaacgagcccg

SEQ ID NO: 405630 - DNA, 25 bp, Mus musculus
aacgagcccgaggtcacggagagtc

SEQ ID NO: 405631 - DNA, 25 bp, Mus musculus
gtcattccaacggtctccgcggttc

SEQ ID NO: 405632 - DNA, 25 bp, Mus musculus
cacagtagagcttgatgtaggcgcc

SEQ ID NO: 405633 - DNA, 25 bp, Mus musculus
gaccacaggaaatgcccgacagggc

SEQ ID NO: 405634 - DNA, 25 bp, Mus musculus
ccaccaccaggaagcagagcgagtt

SEQ ID NO: 405635 - DNA, 25 bp, Mus musculus
gcagagcgagttcatcatcaccagg

SEQ ID NO: 405636 - DNA, 25 bp, Mus musculus
tcatcaccagggctacagcgaagcc

SEQ ID NO: 405637 - DNA, 25 bp, Mus musculus
gtggggaggcgccatactctcccac

SEQ ID NO: 405638 - DNA, 25 bp, Mus musculus
ccgacagggcgttggcgcctgccat

SEQ ID NO: 405639 - DNA, 25 bp, Mus musculus
ttcccgtaggctcggacgcaggtca

SEQ ID NO: 405640 - DNA, 25 bp, Mus musculus
tcacggagatgctgcactgcacggc

SEQ ID NO: 405641 - DNA, 25 bp, Mus musculus
ggccgccagtgtgagcagcagcacc

SEQ ID NO: 405642 - DNA, 25 bp, Mus musculus
gcgggctccatactcagcgaactga

SEQ ID NO: 405643 - DNA, 25 bp, Mus musculus
gaccataggtcaaggcgtccaccga

SEQ ID NO: 405644 - DNA, 25 bp, Mus musculus
caccgaggccaggagaccacaggaa

SEQ ID NO: 405645 - DNA, 25 bp, Mus musculus
cccgtggcaggtcacagtagagctt

SEQ ID NO: 405646 - DNA, 25 bp, Mus musculus
tcccggaaccttgtggcattttctg

SEQ ID NO: 405647 - DNA, 25 bp, Mus musculus
cgcggtttaattctgttgcgcccgg

SEQ ID NO: 405648 - DNA, 25 bp, Mus musculus
tttaattctgttgcgcccgggcgca

SEQ ID NO: 405649 - DNA, 25 bp, Mus musculus
cccgggcgcacctggagacaagaac

SEQ ID NO: 405650 - DNA, 25 bp, Mus musculus
gcgcacctggagacaagaacagcca

SEQ ID NO: 405651 - DNA, 25 bp, Mus musculus
caagaacagccaggagggcgccacc

SEQ ID NO: 405652 - DNA, 25 bp, Mus musculus
ccacctgtgcgggagatcttggggt

SEQ ID NO: 405653 - DNA, 25 bp, Mus musculus
ccggaaccttgtggcattttctgga

SEQ ID NO: 405654 - DNA, 25 bp, Mus musculus
ggaaccttgtggcattttctggagc

SEQ ID NO: 405655 - DNA, 25 bp, Mus musculus
accttgtggcattttctggagcttc

SEQ ID NO: 405656 - DNA, 25 bp, Mus musculus
cttgtggcattttctggagcttcgc

SEQ ID NO: 405657 - DNA, 25 bp, Mus musculus
gacccacctgcttgcaccgcgcctg

SEQ ID NO: 405658 - DNA, 25 bp, Mus musculus
ccgcctgccacggagcggctccggc

SEQ ID NO: 405659 - DNA, 25 bp, Mus musculus
gaacagccaggagggcgccacctgt

SEQ ID NO: 405660 - DNA, 25 bp, Mus musculus
atggctgtcgatgtccagaggaacg

SEQ ID NO: 405661 - DNA, 25 bp, Mus musculus
gcgccggataggctgtcactgaagc

SEQ ID NO: 405662 - DNA, 25 bp, Mus musculus
cccggcagagcgagaagccgcagca

SEQ ID NO: 405663 - DNA, 25 bp, Mus musculus
gaactccattcgaactcccagggca

SEQ ID NO: 405664 - DNA, 25 bp, Mus musculus
gtacgcgtatctccagaactccatt

SEQ ID NO: 405665 - DNA, 25 bp, Mus musculus
cccgagcatctagcttgtacgcgta

SEQ ID NO: 405666 - DNA, 25 bp, Mus musculus
ccaagaagtggctggcacgcacccg

SEQ ID NO: 405667 - DNA, 25 bp, Mus musculus
acacctctggcgtgaaagaaagggc

SEQ ID NO: 405668 - DNA, 25 bp, Mus musculus
agatcgcctggcacaaactacttgg

SEQ ID NO: 405669 - DNA, 25 bp, Mus musculus
actacttggcgagtctgtggtcaca

SEQ ID NO: 405670 - DNA, 25 bp, Mus musculus
acaacgctgcctgtcgggagatgta

SEQ ID NO: 405671 - DNA, 25 bp, Mus musculus
tcacaggacctgatacgtagacgca

SEQ ID NO: 405672 - DNA, 25 bp, Mus musculus
cgtgtcaacggcagatggctgtcga

SEQ ID NO: 405673 - DNA, 25 bp, Mus musculus
tcacgtcacgccgttgccagggatc

SEQ ID NO: 405674 - DNA, 25 bp, Mus musculus
tcggagcagtcagcggacagcatga

SEQ ID NO: 405675 - DNA, 25 bp, Mus musculus
ggcggccattacgaataacaggtac

SEQ ID NO: 405676 - DNA, 25 bp, Mus musculus
ggggcaggcggccattacgaataac

SEQ ID NO: 405677 - DNA, 25 bp, Mus musculus
tacgaataacaggtaccagcaggtg

SEQ ID NO: 405678 - DNA, 25 bp, Mus musculus
gtaccagcaggtgagtactcacagg

SEQ ID NO: 405679 - DNA, 25 bp, Mus musculus
ggtgagtactcacaggtaagccgtc

SEQ ID NO: 405680 - DNA, 25 bp, Mus musculus
gtactcacaggtaagccgtcagggg

SEQ ID NO: 405681 - DNA, 25 bp, Mus musculus
actgagagcccgagctcggagcagt

SEQ ID NO: 405682 - DNA, 25 bp, Mus musculus
acagcgcaaagccacagcgccagga

SEQ ID NO: 405683 - DNA, 25 bp, Mus musculus
agtcagcggacagcatgatgccgtc

SEQ ID NO: 405684 - DNA, 25 bp, Mus musculus
catgatgccgtcctcctggcagtgg

SEQ ID NO: 405685 - DNA, 25 bp, Mus musculus
atgccgtcctcctggcagtggcagg

SEQ ID NO: 405686 - DNA, 25 bp, Mus musculus
cgcgcgcgccgatgcgcacagcaca

SEQ ID NO: 405687 - DNA, 25 bp, Mus musculus
aggtccgcaggcaccactgagagcc

SEQ ID NO: 405688 - DNA, 25 bp, Mus musculus
gcgcaaccggggatcatccgcaatg

SEQ ID NO: 405689 - DNA, 25 bp, Mus musculus
gaagagccggtctctgatgtcacgc

SEQ ID NO: 405690 - DNA, 25 bp, Mus musculus
gagcgccgctttgcttgcacgcttc

SEQ ID NO: 405691 - DNA, 25 bp, Mus musculus
tgtggctaaaacacggagcgccgct

SEQ ID NO: 405692 - DNA, 25 bp, Mus musculus
ccgtgctgccgacactgtggctaaa

SEQ ID NO: 405693 - DNA, 25 bp, Mus musculus
tcactgccgcgatctcgcaaacggg

SEQ ID NO: 405694 - DNA, 25 bp, Mus musculus
gcgctttccggagacaccgactgca

SEQ ID NO: 405695 - DNA, 25 bp, Mus musculus
tccgctgccttgttgagaggaaaaa

SEQ ID NO: 405696 - DNA, 25 bp, Mus musculus
agatccctccgagaaaccgcctgga

SEQ ID NO: 405697 - DNA, 25 bp, Mus musculus
gtcgatgccgctatccctctcagat

SEQ ID NO: 405698 - DNA, 25 bp, Mus musculus
acacggtcgtatagcggtcgatgcc

SEQ ID NO: 405699 - DNA, 25 bp, Mus musculus
ttcccacgcgggtcaaacaagcaca

SEQ ID NO: 405700 - DNA, 25 bp, Mus musculus
ggctttgggccaactaccctcatct

SEQ ID NO: 405701 - DNA, 25 bp, Mus musculus
cgacccgagtttgccaggctctgag

SEQ ID NO: 405702 - DNA, 25 bp, Mus musculus
cacccgttctctggcctgggctagg

SEQ ID NO: 405703 - DNA, 25 bp, Mus musculus
ttcaagccagaaagcggtgcagtca

SEQ ID NO: 405704 - DNA, 25 bp, Mus musculus
gcaaacgagggcagcagaaaaaata

SEQ ID NO: 405705 - DNA, 25 bp, Mus musculus
aaaattacagctttctccgcaagcg

SEQ ID NO: 405706 - DNA, 25 bp, Mus musculus
acccatcggcgagcggatcctcggg

SEQ ID NO: 405707 - DNA, 25 bp, Mus musculus
cggtggcagcgaccatgatcgcttt

SEQ ID NO: 405708 - DNA, 25 bp, Mus musculus
gctttgttcaacaagctgctggact

SEQ ID NO: 405709 - DNA, 25 bp, Mus musculus
ctggactggttcaaggccctgttct

SEQ ID NO: 405710 - DNA, 25 bp, Mus musculus
cacttagggcctagcacggttcttg

SEQ ID NO: 405711 - DNA, 25 bp, Mus musculus
aaccgagcttgcgttccggagctgg

SEQ ID NO: 405712 - DNA, 25 bp, Mus musculus
cggagatgtctccacgcaccgggaa

SEQ ID NO: 405713 - DNA, 25 bp, Mus musculus
tgttgccagggtgccctagcagccc

SEQ ID NO: 405714 - DNA, 25 bp, Mus musculus
ggacaatcccgctccgcgcgtggag

SEQ ID NO: 405715 - DNA, 25 bp, Mus musculus
ccttcgtcaacgtgatcgcggtatg

SEQ ID NO: 405716 - DNA, 25 bp, Mus musculus
aaaggcacgggctctgccggcgcct

SEQ ID NO: 405717 - DNA, 25 bp, Mus musculus
ctccagctcgaagcgatcggcggca

SEQ ID NO: 405718 - DNA, 25 bp, Mus musculus
acagggcctggccatagtgcgagaa

SEQ ID NO: 405719 - DNA, 25 bp, Mus musculus
tcacctccaagcagctgtgcgagtc

SEQ ID NO: 405720 - DNA, 25 bp, Mus musculus
tgtgcgagtcgagccgcagctccga

SEQ ID NO: 405721 - DNA, 25 bp, Mus musculus
ccgaggcgccctcgggaagcaaaca

SEQ ID NO: 405722 - DNA, 25 bp, Mus musculus
ggaagcaaacaacgcagctccagcg

SEQ ID NO: 405723 - DNA, 25 bp, Mus musculus
aggccacgtccacggcttgggccga

SEQ ID NO: 405724 - DNA, 25 bp, Mus musculus
acgcggtaggtgagctccagctcga

SEQ ID NO: 405725 - DNA, 25 bp, Mus musculus
ctgtagttgcctggtccgccgctct

SEQ ID NO: 405726 - DNA, 25 bp, Mus musculus
ttgctcacccgccaggaaggtcggt

SEQ ID NO: 405727 - DNA, 25 bp, Mus musculus
aaggtcggtcgctcctcgggtcttg

SEQ ID NO: 405728 - DNA, 25 bp, Mus musculus
gtcttggcaggctccgcctcgaggc

SEQ ID NO: 405729 - DNA, 25 bp, Mus musculus
tgccggaaggccacgcacagggcct

SEQ ID NO: 405730 - DNA, 25 bp, Mus musculus
gccaatggcaatcggactccttgta

SEQ ID NO: 405731 - DNA, 25 bp, Mus musculus
cctgccgcagccaatggcaatcgga

SEQ ID NO: 405732 - DNA, 25 bp, Mus musculus
attggagcatctcttcctgccgcag

SEQ ID NO: 405733 - DNA, 25 bp, Mus musculus
acggggattggagcatctcttcctg

SEQ ID NO: 405734 - DNA, 25 bp, Mus musculus
ctactggacggggattggagcatct

SEQ ID NO: 405735 - DNA, 25 bp, Mus musculus
ggagctccgcttgcacctcagactc

SEQ ID NO: 405736 - DNA, 25 bp, Mus musculus
tcagactccgaccacggcggatgga

SEQ ID NO: 405737 - DNA, 25 bp, Mus musculus
tgatcccaggcggaggcgtgctact

SEQ ID NO: 405738 - DNA, 25 bp, Mus musculus
ttgatccccgcgacggaagtgatcc

SEQ ID NO: 405739 - DNA, 25 bp, Mus musculus
ctacggcacgctgggcggaaattga

SEQ ID NO: 405740 - DNA, 25 bp, Mus musculus
aacccgcgcgagagtctacggcacg

SEQ ID NO: 405741 - DNA, 25 bp, Mus musculus
tctctcgcgtattcctccatcttgg

SEQ ID NO: 405742 - DNA, 25 bp, Mus musculus
gcggcaactcaccacggctctctcg

SEQ ID NO: 405743 - DNA, 25 bp, Mus musculus
gcaatcggactccttgtagacccgg

SEQ ID NO: 405744 - DNA, 25 bp, Mus musculus
gggcacagccaacagctggtcactg

SEQ ID NO: 405745 - DNA, 25 bp, Mus musculus
atggacacccggaagatagcctctg

SEQ ID NO: 405746 - DNA, 25 bp, Mus musculus
acccggaagatagcctctgaggaca

SEQ ID NO: 405747 - DNA, 25 bp, Mus musculus
tagcctctgaggacatggctggtcc

SEQ ID NO: 405748 - DNA, 25 bp, Mus musculus
gacatggctggtccctttcacctct

SEQ ID NO: 405749 - DNA, 25 bp, Mus musculus
gtgtcgctctccatcccttacccag

SEQ ID NO: 405750 - DNA, 25 bp, Mus musculus
caccagcaggacgacggctgcgagc

SEQ ID NO: 405751 - DNA, 25 bp, Mus musculus
ccgcaggacaaagctggacgaagcc

SEQ ID NO: 405752 - DNA, 25 bp, Mus musculus
ccaacagctggtcactgcggtcagg

SEQ ID NO: 405753 - DNA, 25 bp, Mus musculus
gtctgagcccttaagggcacagcca

SEQ ID NO: 405754 - DNA, 25 bp, Mus musculus
gtgactcctttagtctgagccctta

SEQ ID NO: 405755 - DNA, 25 bp, Mus musculus
ccacaacagtgtggtgactccttta

SEQ ID NO: 405756 - DNA, 25 bp, Mus musculus
tgctctctctgtccacaacagtgtg

SEQ ID NO: 405757 - DNA, 25 bp, Mus musculus
acaaagctggacgaagccggccggc

SEQ ID NO: 405758 - DNA, 25 bp, Mus musculus
aagtcgcacgcgctgttagaaaacg

SEQ ID NO: 405759 - DNA, 25 bp, Mus musculus
gccagcaccacgtcgaacttcattt

SEQ ID NO: 405760 - DNA, 25 bp, Mus musculus
gaacttcatttctgtcctcggcaga

SEQ ID NO: 405761 - DNA, 25 bp, Mus musculus
aaatccctacggtcagcggactgtg

SEQ ID NO: 405762 - DNA, 25 bp, Mus musculus
tggtccgaaccatcctcgtgacggt

SEQ ID NO: 405763 - DNA, 25 bp, Mus musculus
tcctgcaccggggacaggattccgg

SEQ ID NO: 405764 - DNA, 25 bp, Mus musculus
ttccggtgagggtatccaccaacgc

SEQ ID NO: 405765 - DNA, 25 bp, Mus musculus
accgaatgacggctcccgcgtacgg

SEQ ID NO: 405766 - DNA, 25 bp, Mus musculus
cctgcgcacctaagtacgcgggagc

SEQ ID NO: 405767 - DNA, 25 bp, Mus musculus
tctgctgccggaaccgaaccgcgat

SEQ ID NO: 405768 - DNA, 25 bp, Mus musculus
caggaaagctttgggcgtctatgca

SEQ ID NO: 405769 - DNA, 25 bp, Mus musculus
gggcgtctatgcacacacagaattc

SEQ ID NO: 405770 - DNA, 25 bp, Mus musculus
cacagaattctcataacggtttgta

SEQ ID NO: 405771 - DNA, 25 bp, Mus musculus
acggtttgtagtcctgaagtcgcac

SEQ ID NO: 405772 - DNA, 25 bp, Mus musculus
gtcgccagcctgcagccggggacta

SEQ ID NO: 405773 - DNA, 25 bp, Mus musculus
acagagggtgcgtcgccagcctgca

SEQ ID NO: 405774 - DNA, 25 bp, Mus musculus
tgggagtagtgtgcccgctcgccat

SEQ ID NO: 405775 - DNA, 25 bp, Mus musculus
gctcgccatgcatgtaccaggccgg

SEQ ID NO: 405776 - DNA, 25 bp, Mus musculus
tcgccatgcatgtaccaggccggtg

SEQ ID NO: 405777 - DNA, 25 bp, Mus musculus
catgcatgtaccaggccggtggccc

SEQ ID NO: 405778 - DNA, 25 bp, Mus musculus
ggtggcccctcggaacgacagctcc

SEQ ID NO: 405779 - DNA, 25 bp, Mus musculus
agtgtgcccgctcgccatgcatgta

SEQ ID NO: 405780 - DNA, 25 bp, Mus musculus
cggttggagagactggacacgcttc

SEQ ID NO: 405781 - DNA, 25 bp, Mus musculus
tagcgccaagagagcggagaggagc

SEQ ID NO: 405782 - DNA, 25 bp, Mus musculus
agactggccgtagcgccaagagagc

SEQ ID NO: 405783 - DNA, 25 bp, Mus musculus
cctgcagccggggactagactggcc

SEQ ID NO: 405784 - DNA, 25 bp, Mus musculus
ccaacagagggtgcgtcgccagcct

SEQ ID NO: 405785 - DNA, 25 bp, Mus musculus
ctagactggccgtagcgccaagaga

SEQ ID NO: 405786 - DNA, 25 bp, Mus musculus
ctgcccagcattctgcctgcgagga

SEQ ID NO: 405787 - DNA, 25 bp, Mus musculus
agaggcttgacctccgcatagggtc

SEQ ID NO: 405788 - DNA, 25 bp, Mus musculus
cgaggaatccggctaggtttgccta

SEQ ID NO: 405789 - DNA, 25 bp, Mus musculus
agccacctttgggttggaagagcga

SEQ ID NO: 405790 - DNA, 25 bp, Mus musculus
cttggacagcgtcttggacatcaga

SEQ ID NO: 405791 - DNA, 25 bp, Mus musculus
acatcagaggagtctcgcggccctt

SEQ ID NO: 405792 - DNA, 25 bp, Mus musculus
ccttgggtgctttggccatatcatc

SEQ ID NO: 405793 - DNA, 25 bp, Mus musculus
ctcaggctcatacagctgcagcttt

SEQ ID NO: 405794 - DNA, 25 bp, Mus musculus
actggccttggccatactgccactg

SEQ ID NO: 405795 - DNA, 25 bp, Mus musculus
gaagaccttcagctccgctgcactg

SEQ ID NO: 405796 - DNA, 25 bp, Mus musculus
ctgcagctttttctcggagtccgtg

SEQ ID NO: 405797 - DNA, 25 bp, Mus musculus
gcgacttctgtttgcgcaggttgga

SEQ ID NO: 405798 - DNA, 25 bp, Mus musculus
ccacgctgccggacttgaagacctt

SEQ ID NO: 405799 - DNA, 25 bp, Mus musculus
gatttgccatcatcgcttaccgctg

SEQ ID NO: 405800 - DNA, 25 bp, Mus musculus
aggcgtaggcactccggcaaagcca

SEQ ID NO: 405801 - DNA, 25 bp, Mus musculus
agccactagcatcccggttattatc

SEQ ID NO: 405802 - DNA, 25 bp, Mus musculus
agcagcgcaacgcagggcgtcctgt

SEQ ID NO: 405803 - DNA, 25 bp, Mus musculus
gggctcccgctccactacgagaagg

SEQ ID NO: 405804 - DNA, 25 bp, Mus musculus
agcacctccaagtgcagagctcagc

SEQ ID NO: 405805 - DNA, 25 bp, Mus musculus
gtcactcaccggagcgcttcaggtc

SEQ ID NO: 405806 - DNA, 25 bp, Mus musculus
gcagaatcgcgcatcgcccgagcag

SEQ ID NO: 405807 - DNA, 25 bp, Mus musculus
gggtcccttccagactttgtcattg

SEQ ID NO: 405808 - DNA, 25 bp, Mus musculus
cctgtcctcgcgatcagaaagtttc

SEQ ID NO: 405809 - DNA, 25 bp, Mus musculus
tcattggaaagctattcccgtaacc

SEQ ID NO: 405810 - DNA, 25 bp, Mus musculus
gcactgtgccagcttaacccgcaga

SEQ ID NO: 405811 - DNA, 25 bp, Mus musculus
ggccttcagcctctcactagggcgg

SEQ ID NO: 405812 - DNA, 25 bp, Mus musculus
tccactacgagaaggaggcggcatc

SEQ ID NO: 405813 - DNA, 25 bp, Mus musculus
ggaggcggcatcctgaacaaagtgc

SEQ ID NO: 405814 - DNA, 25 bp, Mus musculus
tccgctctaccggagcattgtgggc

SEQ ID NO: 405815 - DNA, 25 bp, Mus musculus
acctcctggtaacgccgtggctcgg

SEQ ID NO: 405816 - DNA, 25 bp, Mus musculus
gaggcgtccgctctaccggagcatt

SEQ ID NO: 405817 - DNA, 25 bp, Mus musculus
ctgggtgagctctcgcccgctgttt

SEQ ID NO: 405818 - DNA, 25 bp, Mus musculus
gagcgagacccgactccgtgccatg

SEQ ID NO: 405819 - DNA, 25 bp, Mus musculus
cgactccgtgccatgggcctgcgag

SEQ ID NO: 405820 - DNA, 25 bp, Mus musculus
gcccgactgcaacggagggcacagc

SEQ ID NO: 405821 - DNA, 25 bp, Mus musculus
ccgctgccgcgagctcgatgcggac

SEQ ID NO: 405822 - DNA, 25 bp, Mus musculus
gggccatggggatcctcagcatcac

SEQ ID NO: 405823 - DNA, 25 bp, Mus musculus
tggggatcctcagcatcacggacca

SEQ ID NO: 405824 - DNA, 25 bp, Mus musculus
tcctcagcatcacggaccaggtcag

SEQ ID NO: 405825 - DNA, 25 bp, Mus musculus
ctccactccgtggagcgggtgtcct

SEQ ID NO: 405826 - DNA, 25 bp, Mus musculus
tcgcccgctgtttggtcctgggctc

SEQ ID NO: 405827 - DNA, 25 bp, Mus musculus
cacggcgggaatccgctgcagccag

SEQ ID NO: 405828 - DNA, 25 bp, Mus musculus
ttttccggtcctgtcgcagccctgt

SEQ ID NO: 405829 - DNA, 25 bp, Mus musculus
cccgcaactgccggagcgcctgggt

SEQ ID NO: 405830 - DNA, 25 bp, Mus musculus
ctgggtcgcaccctgcgcctattgg

SEQ ID NO: 405831 - DNA, 25 bp, Mus musculus
gggtcgcaccctgcgcctattggtt

SEQ ID NO: 405832 - DNA, 25 bp, Mus musculus
cgcaccctgcgcctattggtttttc

SEQ ID NO: 405833 - DNA, 25 bp, Mus musculus
caccctgcgcctattggtttttccg

SEQ ID NO: 405834 - DNA, 25 bp, Mus musculus
gaaacaaaacggcgcgcactccggc

SEQ ID NO: 405835 - DNA, 25 bp, Mus musculus
ttggtttttccggtcctgtcgcagc

SEQ ID NO: 405836 - DNA, 25 bp, Mus musculus
aaaacggcgcgcactccggcgcagc

SEQ ID NO: 405837 - DNA, 25 bp, Mus musculus
tccggcgcagccagtcaccgcttcc

SEQ ID NO: 405838 - DNA, 25 bp, Mus musculus
gcttccctgagagctgtcgcccgtg

SEQ ID NO: 405839 - DNA, 25 bp, Mus musculus
ttccctgagagctgtcgcccgtgcg

SEQ ID NO: 405840 - DNA, 25 bp, Mus musculus
gagctgtcgcccgtgcgcctcccag

SEQ ID NO: 405841 - DNA, 25 bp, Mus musculus
ctgccaggtgagtgttaccccgggt

SEQ ID NO: 405842 - DNA, 25 bp, Mus musculus
caaccagctccagggcgcgagaagc

SEQ ID NO: 405843 - DNA, 25 bp, Mus musculus
gggcagcccgcaggctattgagaaa

SEQ ID NO: 405844 - DNA, 25 bp, Mus musculus
ccgcaggctattgagaaagcagccc

SEQ ID NO: 405845 - DNA, 25 bp, Mus musculus
tgtaagggcacatcccgccagcagc

SEQ ID NO: 405846 - DNA, 25 bp, Mus musculus
gagagagtagcatcgcacgagcctc

SEQ ID NO: 405847 - DNA, 25 bp, Mus musculus
agcaaggccaaccagctccagggcg

SEQ ID NO: 405848 - DNA, 25 bp, Mus musculus
cagcctccagagctgtgggaacctc

SEQ ID NO: 405849 - DNA, 25 bp, Mus musculus
tgcagctcttcgaggccaagggcac

SEQ ID NO: 405850 - DNA, 25 bp, Mus musculus
gagctcagcttcgcccgcatcaaag

SEQ ID NO: 405851 - DNA, 25 bp, Mus musculus
gcatcaaagccgtggagtgcgtaga

SEQ ID NO: 405852 - DNA, 25 bp, Mus musculus
gggcgccacatctacttcacgctag

SEQ ID NO: 405853 - DNA, 25 bp, Mus musculus
acttcacgctagtgaccgaaggcgg

SEQ ID NO: 405854 - DNA, 25 bp, Mus musculus
gtgttttaagaaggggcagcccgca

SEQ ID NO: 405855 - DNA, 25 bp, Mus musculus
ctcgaccgcacagggagcaaggcca

SEQ ID NO: 405856 - DNA, 25 bp, Mus musculus
aatgcgcgggctctcaagtcctcct

SEQ ID NO: 405857 - DNA, 25 bp, Mus musculus
agatcaaagactcctgccagggccc

SEQ ID NO: 405858 - DNA, 25 bp, Mus musculus
tcacaacagtactaccagcagattc

SEQ ID NO: 405859 - DNA, 25 bp, Mus musculus
cagcagattcaccacggggagccca

SEQ ID NO: 405860 - DNA, 25 bp, Mus musculus
attaacctgcacaatgcgcgggctc

SEQ ID NO: 405861 - DNA, 25 bp, Mus musculus
tcctcctgcctggacgagcagaggc

SEQ ID NO: 405862 - DNA, 25 bp, Mus musculus
agctgggttgcctcgatgcctaccg

SEQ ID NO: 405863 - DNA, 25 bp, Mus musculus
acgacctgtccctcatgagccatgg

SEQ ID NO: 405864 - DNA, 25 bp, Mus musculus
ccctcatgagccatggctctcagta

SEQ ID NO: 405865 - DNA, 25 bp, Mus musculus
atggctctcagtatggaatgcaccc

SEQ ID NO: 405866 - DNA, 25 bp, Mus musculus
tggaatgcacccagatcaaagactc

SEQ ID NO: 405867 - DNA, 25 bp, Mus musculus
taaataagcgtgcagcgggtttgtc

SEQ ID NO: 405868 - DNA, 25 bp, Mus musculus
ggagccgacgacttgcaggtaaata

SEQ ID NO: 405869 - DNA, 25 bp, Mus musculus
gagcccaccgactttattaacctgc

SEQ ID NO: 405870 - DNA, 25 bp, Mus musculus
gagataagcggccatgtgaccctac

SEQ ID NO: 405871 - DNA, 25 bp, Mus musculus
gcgactcccagggaagacgcgggcc

SEQ ID NO: 405872 - DNA, 25 bp, Mus musculus
agctggtccaactggttctgagcag

SEQ ID NO: 405873 - DNA, 25 bp, Mus musculus
tggttctgagcaggaagtctcccgc

SEQ ID NO: 405874 - DNA, 25 bp, Mus musculus
ttctgagcaggaagtctcccgccct

SEQ ID NO: 405875 - DNA, 25 bp, Mus musculus
agctcggtgcgaccgtcccgcagag

SEQ ID NO: 405876 - DNA, 25 bp, Mus musculus
cccagcggtgatcagcgcggctttg

SEQ ID NO: 405877 - DNA, 25 bp, Mus musculus
tgatcagcgcggctttgtctgggac

SEQ ID NO: 405878 - DNA, 25 bp, Mus musculus
cggtcagcagaaaggactggtccgc

SEQ ID NO: 405879 - DNA, 25 bp, Mus musculus
gcccacacctcagaggccgctcctc

SEQ ID NO: 405880 - DNA, 25 bp, Mus musculus
taagcggccatgtgaccctacctgg

SEQ ID NO: 405881 - DNA, 25 bp, Mus musculus
tcggcagcatgtcggtcagcagaaa

SEQ ID NO: 405882 - DNA, 25 bp, Mus musculus
tgtcggtcagcagaaaggactggtc

SEQ ID NO: 405883 - DNA, 25 bp, Mus musculus
ggctttgtctgggacgcccacacct

SEQ ID NO: 405884 - DNA, 25 bp, Mus musculus
catcttttggtcagagggcaaagcc

SEQ ID NO: 405885 - DNA, 25 bp, Mus musculus
tcaaggtggacgactgggaagactt

SEQ ID NO: 405886 - DNA, 25 bp, Mus musculus
tcctggtcctggaagcattcgtacg

SEQ ID NO: 405887 - DNA, 25 bp, Mus musculus
gccctccgtcagacaggatatacca

SEQ ID NO: 405888 - DNA, 25 bp, Mus musculus
cgtccctcagtaggcactggccgga

SEQ ID NO: 405889 - DNA, 25 bp, Mus musculus
ccctttggccatagagcgctggtcc

SEQ ID NO: 405890 - DNA, 25 bp, Mus musculus
ctcagcggctccctttggccataga

SEQ ID NO: 405891 - DNA, 25 bp, Mus musculus
gagcgagcgcctgttctcctctcag

SEQ ID NO: 405892 - DNA, 25 bp, Mus musculus
cattcgtacgccagcgcggtcttga

SEQ ID NO: 405893 - DNA, 25 bp, Mus musculus
gcaaagccagcgtggagttgtcctg

SEQ ID NO: 405894 - DNA, 25 bp, Mus musculus
gacttggacttctgccgtttgacgg

SEQ ID NO: 405895 - DNA, 25 bp, Mus musculus
cctttacctcggttggagtgactca

SEQ ID NO: 405896 - DNA, 25 bp, Mus musculus
cgtcaaagcgggctgacattcagtc

SEQ ID NO: 405897 - DNA, 25 bp, Mus musculus
tgacggtcatcatcacttgctcctg

SEQ ID NO: 405898 - DNA, 25 bp, Mus musculus
cgtcaagtgcgtgaatgagggctac

SEQ ID NO: 405899 - DNA, 25 bp, Mus musculus
tccttggtggccgagtccagtggat

SEQ ID NO: 405900 - DNA, 25 bp, Mus musculus
tccagaagcgcaacgagcgagagcg

SEQ ID NO: 405901 - DNA, 25 bp, Mus musculus
gagcctgccttcatccagaagcgca

SEQ ID NO: 405902 - DNA, 25 bp, Mus musculus
tttacgactacccgttcgagcctgc

SEQ ID NO: 405903 - DNA, 25 bp, Mus musculus
ctacgacgcctacactggggtgttc

SEQ ID NO: 405904 - DNA, 25 bp, Mus musculus
gccttactacgacgcctacactggg

SEQ ID NO: 405905 - DNA, 25 bp, Mus musculus
ccggccactccgagccgccttacta

SEQ ID NO: 405906 - DNA, 25 bp, Mus musculus
cttgagcaacgtaccctttctattg

SEQ ID NO: 405907 - DNA, 25 bp, Mus musculus
agccaccgaacccttgagcaacgta

SEQ ID NO: 405908 - DNA, 25 bp, Mus musculus
tggcagccaccgaacccttgagcaa

SEQ ID NO: 405909 - DNA, 25 bp, Mus musculus
atccgctacatcaagtacctgcagg

SEQ ID NO: 405910 - DNA, 25 bp, Mus musculus
gccctgactgagaagcggctcagca

SEQ ID NO: 405911 - DNA, 25 bp, Mus musculus
cctgctggacagacgccgctggcag

SEQ ID NO: 405912 - DNA, 25 bp, Mus musculus
ttcgagctttgtctcgcgtgttctc

SEQ ID NO: 405913 - DNA, 25 bp, Mus musculus
ctttgtctcgcgtgttctcgggcgg

SEQ ID NO: 405914 - DNA, 25 bp, Mus musculus
tcaaagtggccgtcaggtaagggtc

SEQ ID NO: 405915 - DNA, 25 bp, Mus musculus
gactgctgcgtcaaagtggccgtca

SEQ ID NO: 405916 - DNA, 25 bp, Mus musculus
accatggctggccagggcgactgct

SEQ ID NO: 405917 - DNA, 25 bp, Mus musculus
acgaggtcgctttcgctagcagggt

SEQ ID NO: 405918 - DNA, 25 bp, Mus musculus
ccagcctacgaggtcgctttcgcta

SEQ ID NO: 405919 - DNA, 25 bp, Mus musculus
tcagcacctccgcgcgatggctgga

SEQ ID NO: 405920 - DNA, 25 bp, Mus musculus
ccgctgtcaacgagctcagcacctc

SEQ ID NO: 405921 - DNA, 25 bp, Mus musculus
tgcgggtctcactgcccgctgtcaa

SEQ ID NO: 405922 - DNA, 25 bp, Mus musculus
ttggggccttctattggcggcctct

SEQ ID NO: 405923 - DNA, 25 bp, Mus musculus
tctgctgctcgttggggccttctat

SEQ ID NO: 405924 - DNA, 25 bp, Mus musculus
gagcatgtcacctccagcctacgag

SEQ ID NO: 405925 - DNA, 25 bp, Mus musculus
caccgctcgagctggagtctgcagt

SEQ ID NO: 405926 - DNA, 25 bp, Mus musculus
gaaaagccttggctgcgccaccctg

SEQ ID NO: 405927 - DNA, 25 bp, Mus musculus
ccaaatggcgaatagtccggctctg

SEQ ID NO: 405928 - DNA, 25 bp, Mus musculus
tcctgatgagccaaagaaccgctga

SEQ ID NO: 405929 - DNA, 25 bp, Mus musculus
accctgcctgccgtttgccaaatgg

SEQ ID NO: 405930 - DNA, 25 bp, Mus musculus
tccggctctgttcagcgagattccg

SEQ ID NO: 405931 - DNA, 25 bp, Mus musculus
ggtgccagatcctgcctctgaaaag

SEQ ID NO: 405932 - DNA, 25 bp, Mus musculus
gctcagtccggctcctgatgagcca

SEQ ID NO: 405933 - DNA, 25 bp, Mus musculus
gaggaagcgtggtgacctcagccac

SEQ ID NO: 405934 - DNA, 25 bp, Mus musculus
gccaaagaaccgctgagctcagctc

SEQ ID NO: 405935 - DNA, 25 bp, Mus musculus
cactgttcgcttgtgagcggaggaa

SEQ ID NO: 405936 - DNA, 25 bp, Mus musculus
ctaggctccggctggctgcctttgt

SEQ ID NO: 405937 - DNA, 25 bp, Mus musculus
ctttaagtctctcggctgtggctca

SEQ ID NO: 405938 - DNA, 25 bp, Mus musculus
tcacgccagccactgttcgcttgtg

SEQ ID NO: 405939 - DNA, 25 bp, Mus musculus
gtgacctcagccacggtgccagatc

SEQ ID NO: 405940 - DNA, 25 bp, Mus musculus
ctgtcctttagtgagggtgtgcgca

SEQ ID NO: 405941 - DNA, 25 bp, Mus musculus
ataggcagcacccacggctgcacga

SEQ ID NO: 405942 - DNA, 25 bp, Mus musculus
ggctgcacgacacagctcccactcg

SEQ ID NO: 405943 - DNA, 25 bp, Mus musculus
gggtgcaccttcctcgtcataggca

SEQ ID NO: 405944 - DNA, 25 bp, Mus musculus
taacgcaggggtgcaccttcctcgt

SEQ ID NO: 405945 - DNA, 25 bp, Mus musculus
gagggtaccagtcgctggtaacgca

SEQ ID NO: 405946 - DNA, 25 bp, Mus musculus
tggccctcggccaccatcacatagc

SEQ ID NO: 405947 - DNA, 25 bp, Mus musculus
ctgctccggagacgtgcgcgttcat

SEQ ID NO: 405948 - DNA, 25 bp, Mus musculus
tcgtcataggcagcacccacggctg

SEQ ID NO: 405949 - DNA, 25 bp, Mus musculus
gcgcgttcatgccaccacttgagct

SEQ ID NO: 405950 - DNA, 25 bp, Mus musculus
tttagtgagggtgtgcgcacaatgc

SEQ ID NO: 405951 - DNA, 25 bp, Mus musculus
acttgagctcctccgagactgctgc

SEQ ID NO: 405952 - DNA, 25 bp, Mus musculus
ccggcccgcaggactgtcctttagt

SEQ ID NO: 405953 - DNA, 25 bp, Mus musculus
tccgagactgctgccttgctgagtc

SEQ ID NO: 405954 - DNA, 25 bp, Mus musculus
gggcagcgcctcctgctgcttgcga

SEQ ID NO: 405955 - DNA, 25 bp, Mus musculus
gaggggcgacgctgctccctgtctc

SEQ ID NO: 405956 - DNA, 25 bp, Mus musculus
cattcacgcagcctcgtggtgtgac

SEQ ID NO: 405957 - DNA, 25 bp, Mus musculus
cctacaaggccggtttctgaaatct

SEQ ID NO: 405958 - DNA, 25 bp, Mus musculus
ggcagttttcattccggagacccaa

SEQ ID NO: 405959 - DNA, 25 bp, Mus musculus
ccggagacccaagcgtggaagaatg

SEQ ID NO: 405960 - DNA, 25 bp, Mus musculus
aagaatgaaaggagacggcacgccc

SEQ ID NO: 405961 - DNA, 25 bp, Mus musculus
cgcctatcctttctggcggccggga

SEQ ID NO: 405962 - DNA, 25 bp, Mus musculus
tgcggcgcgatcgaaccctggtcgc

SEQ ID NO: 405963 - DNA, 25 bp, Mus musculus
aactccggctttggcggcaaggcac

SEQ ID NO: 405964 - DNA, 25 bp, Mus musculus
ggcaaggcacacactcctgggcagc

SEQ ID NO: 405965 - DNA, 25 bp, Mus musculus
gctgcttgcgacgagcccacgaaac

SEQ ID NO: 405966 - DNA, 25 bp, Mus musculus
gagcccacgaaaccatccattcatt

SEQ ID NO: 405967 - DNA, 25 bp, Mus musculus
tccattcattcaaactcgcgctttc

SEQ ID NO: 405968 - DNA, 25 bp, Mus musculus
gagcgcttacattcccggaaacgtc

SEQ ID NO: 405969 - DNA, 25 bp, Mus musculus
tgcacaccgccgagccacccgcagg

SEQ ID NO: 405970 - DNA, 25 bp, Mus musculus
gaggaacgccggagcgcttacattc

SEQ ID NO: 405971 - DNA, 25 bp, Mus musculus
cggactgtgcacaccgccgagccac

SEQ ID NO: 405972 - DNA, 25 bp, Mus musculus
cggagcgcttacattcccggaaacg

SEQ ID NO: 405973 - DNA, 25 bp, Mus musculus
tcctccagccaataaggtccgatct

SEQ ID NO: 405974 - DNA, 25 bp, Mus musculus
tccagccaataaggtccgatctgcc

SEQ ID NO: 405975 - DNA, 25 bp, Mus musculus
caataaggtccgatctgcctcccaa

SEQ ID NO: 405976 - DNA, 25 bp, Mus musculus
ccaccttcggccaccacccatccaa

SEQ ID NO: 405977 - DNA, 25 bp, Mus musculus
acccatccaatcaggctccgagatt

SEQ ID NO: 405978 - DNA, 25 bp, Mus musculus
tccaatcaggctccgagattcactt

SEQ ID NO: 405979 - DNA, 25 bp, Mus musculus
aatcaggctccgagattcacttgcc

SEQ ID NO: 405980 - DNA, 25 bp, Mus musculus
caggctccgagattcacttgccgcg

SEQ ID NO: 405981 - DNA, 25 bp, Mus musculus
acgccggagcgcttacattcccgga

SEQ ID NO: 405982 - DNA, 25 bp, Mus musculus
gcaaggccggcaaacccgccaggaa

SEQ ID NO: 405983 - DNA, 25 bp, Mus musculus
ccgagcccgaatagtcccaggacaa

SEQ ID NO: 405984 - DNA, 25 bp, Mus musculus
gcagggcacaactccacttggtcca

SEQ ID NO: 405985 - DNA, 25 bp, Mus musculus
taaggcaggttccaagcagggcaca

SEQ ID NO: 405986 - DNA, 25 bp, Mus musculus
caccgaactgtcgtccctggagagc

SEQ ID NO: 405987 - DNA, 25 bp, Mus musculus
ctctccacggtgaagatgatgcgca

SEQ ID NO: 405988 - DNA, 25 bp, Mus musculus
agcggtccaacaggaggtagatgac

SEQ ID NO: 405989 - DNA, 25 bp, Mus musculus
tgactttgcacaggccgtcgccgaa

SEQ ID NO: 405990 - DNA, 25 bp, Mus musculus
cgacacgcgccagtagcagatcagg

SEQ ID NO: 405991 - DNA, 25 bp, Mus musculus
gtgcagcacgaaggtgtccaccagc

SEQ ID NO: 405992 - DNA, 25 bp, Mus musculus
tcagtagccacaccacgaaggcgtt

SEQ ID NO: 405993 - DNA, 25 bp, Mus musculus
tgaccgggttcgcactgctattgac

SEQ ID NO: 405994 - DNA, 25 bp, Mus musculus
tgctattgacgaaagccaggcaggt

SEQ ID NO: 405995 - DNA, 25 bp, Mus musculus
ccagcgcgaagctgctgactttgca

SEQ ID NO: 405996 - DNA, 25 bp, Mus musculus
gacgacggccttcacatggtgtggc

SEQ ID NO: 405997 - DNA, 25 bp, Mus musculus
aaaagctcagctgtgctcgtcgcga

SEQ ID NO: 405998 - DNA, 25 bp, Mus musculus
cgtttagtcacacgggctcgcagga

SEQ ID NO: 405999 - DNA, 25 bp, Mus musculus
ctggacgatcacgtcgcggacagtg

SEQ ID NO: 406000 - DNA, 25 bp, Mus musculus
gagaggagttcagatcgtccgcgcc

SEQ ID NO: 406001 - DNA, 25 bp, Mus musculus
acgtcagaatcgctgcagcgcgcga

SEQ ID NO: 406002 - DNA, 25 bp, Mus musculus
cgcaaatcaaatcacgggccctcgg

SEQ ID NO: 406003 - DNA, 25 bp, Mus musculus
ggctcctgccttatcgggcttgtcc

SEQ ID NO: 406004 - DNA, 25 bp, Mus musculus
gggcttgtcctcgtattttccgcta

SEQ ID NO: 406005 - DNA, 25 bp, Mus musculus
tctgtacatccgcagctttgggctg

SEQ ID NO: 406006 - DNA, 25 bp, Mus musculus
gtcttgcgccgccatgcgcactgag

SEQ ID NO: 406007 - DNA, 25 bp, Mus musculus
tatccattaatcagcacagtgcccg

SEQ ID NO: 406008 - DNA, 25 bp, Mus musculus
cgctggattggacgttctgtacatc

SEQ ID NO: 406009 - DNA, 25 bp, Mus musculus
cccgccgcggaaaacgtcagaatcg

SEQ ID NO: 406010 - DNA, 25 bp, Mus musculus
ctaccctgtgcaccgccctccgcag

SEQ ID NO: 406011 - DNA, 25 bp, Mus musculus
ggcgtggccagatgaagctccgcct

SEQ ID NO: 406012 - DNA, 25 bp, Mus musculus
tactcggccggaaactcggccctgc

SEQ ID NO: 406013 - DNA, 25 bp, Mus musculus
ggattgcggagcttcccggctactc

SEQ ID NO: 406014 - DNA, 25 bp, Mus musculus
caaaccctggctgggattgcggagc

SEQ ID NO: 406015 - DNA, 25 bp, Mus musculus
aggttgtcggctctgccgccccgag

SEQ ID NO: 406016 - DNA, 25 bp, Mus musculus
gggtcctcgtgacgtgcgcgtgcct

SEQ ID NO: 406017 - DNA, 25 bp, Mus musculus
aagtcacgccgctcgccggggtcct

SEQ ID NO: 406018 - DNA, 25 bp, Mus musculus
acggcggctgcggactaagtcacgc

SEQ ID NO: 406019 - DNA, 25 bp, Mus musculus
tgtgctccggcgtaacctgcgtgct

SEQ ID NO: 406020 - DNA, 25 bp, Mus musculus
tccggcgtaacctgcgtgctggacg

SEQ ID NO: 406021 - DNA, 25 bp, Mus musculus
gagcttcccggctactcggccggaa

SEQ ID NO: 406022 - DNA, 25 bp, Mus musculus
gccctcaaaccctggctgggattgc

SEQ ID NO: 406023 - DNA, 25 bp, Mus musculus
gctgcggactaagtcacgccgctcg

SEQ ID NO: 406024 - DNA, 25 bp, Mus musculus
gacgccaccgagagcttccggagtc

SEQ ID NO: 406025 - DNA, 25 bp, Mus musculus
acagatgagggatcccgcgccacaa

SEQ ID NO: 406026 - DNA, 25 bp, Mus musculus
gagagagcgcggtttgttatttttg

SEQ ID NO: 406027 - DNA, 25 bp, Mus musculus
gtcgtattttgattctttgcgggtc

SEQ ID NO: 406028 - DNA, 25 bp, Mus musculus
attctttgcgggtcagtggttccaa

SEQ ID NO: 406029 - DNA, 25 bp, Mus musculus
tcagtggttccaagcagagatggca

SEQ ID NO: 406030 - DNA, 25 bp, Mus musculus
ttccaagcagagatggcagccgcca

SEQ ID NO: 406031 - DNA, 25 bp, Mus musculus
agcttccggagtccgcgtcgagcga

SEQ ID NO: 406032 - DNA, 25 bp, Mus musculus
tcgagcgaggctgtccggctgccct

SEQ ID NO: 406033 - DNA, 25 bp, Mus musculus
gcaagcgcatccctcccgtgctttt

SEQ ID NO: 406034 - DNA, 25 bp, Mus musculus
cttgtcggacgccaccgagagcttc

SEQ ID NO: 406035 - DNA, 25 bp, Mus musculus
gccgccagcgtgtgggcatttttaa

SEQ ID NO: 406036 - DNA, 25 bp, Mus musculus
gtgcttttccctccgccttgtcgga

SEQ ID NO: 406037 - DNA, 25 bp, Mus musculus
gcatttttaacgaagcctgcccaca

SEQ ID NO: 406038 - DNA, 25 bp, Mus musculus
ttcaaattgccgcagccacgggagc

SEQ ID NO: 406039 - DNA, 25 bp, Mus musculus
gctgaggttgctcgcccagcgagcc

SEQ ID NO: 406040 - DNA, 25 bp, Mus musculus
cgggccgtcacctaggagatagggc

SEQ ID NO: 406041 - DNA, 25 bp, Mus musculus
cccagcgaccaatcaggaagcgagg

SEQ ID NO: 406042 - DNA, 25 bp, Mus musculus
tgtccacccggaagccgagaacagc

SEQ ID NO: 406043 - DNA, 25 bp, Mus musculus
agagcgttgcggtgtttgcccagca

SEQ ID NO: 406044 - DNA, 25 bp, Mus musculus
tgagagcgctgaggttgctcgccca

SEQ ID NO: 406045 - DNA, 25 bp, Mus musculus
agcgcctccgagctgagagcgctga

SEQ ID NO: 406046 - DNA, 25 bp, Mus musculus
aattgccgcagccacgggagcctgt

SEQ ID NO: 406047 - DNA, 25 bp, Mus musculus
aagcgaggcgcgcattcaaattgcc

SEQ ID NO: 406048 - DNA, 25 bp, Mus musculus
gctacgcccagcgaccaatcaggaa

SEQ ID NO: 406049 - DNA, 25 bp, Mus musculus
cggtagaagctgcacttccggggat

SEQ ID NO: 406050 - DNA, 25 bp, Mus musculus
tgtgtctcgcggtagaagctgcact

SEQ ID NO: 406051 - DNA, 25 bp, Mus musculus
gggcgtcgctctgtccacccggaag

SEQ ID NO: 406052 - DNA, 25 bp, Mus musculus
cctcagcagggccaccaatcacgtc

SEQ ID NO: 406053 - DNA, 25 bp, Mus musculus
cgccacgctgcaacacgctctcctg

SEQ ID NO: 406054 - DNA, 25 bp, Mus musculus
ctccggagcgccttctccctagaaa

SEQ ID NO: 406055 - DNA, 25 bp, Mus musculus
tccctagaaaccctcagccactgtc

SEQ ID NO: 406056 - DNA, 25 bp, Mus musculus
cctcgctgcggaagaccctccgctg

SEQ ID NO: 406057 - DNA, 25 bp, Mus musculus
gaccctccgctgtccgcctccaagt

SEQ ID NO: 406058 - DNA, 25 bp, Mus musculus
aaccgcccgcttgattgacaggcta

SEQ ID NO: 406059 - DNA, 25 bp, Mus musculus
gcccgcttgattgacaggctagcca

SEQ ID NO: 406060 - DNA, 25 bp, Mus musculus
tgacaggctagccaggcggaaactg

SEQ ID NO: 406061 - DNA, 25 bp, Mus musculus
ccggtcgaggacttcccggcagaca

SEQ ID NO: 406062 - DNA, 25 bp, Mus musculus
cgcagaagcggggaggcttttaatt

SEQ ID NO: 406063 - DNA, 25 bp, Mus musculus
agcggggaggcttttaattccattg

SEQ ID NO: 406064 - DNA, 25 bp, Mus musculus
gaggcttttaattccattgtggaga

SEQ ID NO: 406065 - DNA, 25 bp, Mus musculus
ctagccaggcggaaactgaggcgca

SEQ ID NO: 406066 - DNA, 25 bp, Mus musculus
cggttctgggtaccaccgatgctgt

SEQ ID NO: 406067 - DNA, 25 bp, Mus musculus
aatagctgatataggcccggtccgg

SEQ ID NO: 406068 - DNA, 25 bp, Mus musculus
atagctgatataggcccggtccggg

SEQ ID NO: 406069 - DNA, 25 bp, Mus musculus
cgtaatagctgatataggcccggtc

SEQ ID NO: 406070 - DNA, 25 bp, Mus musculus
tgtcgtaatagctgatataggcccg

SEQ ID NO: 406071 - DNA, 25 bp, Mus musculus
catgtcgtaatagctgatataggcc

SEQ ID NO: 406072 - DNA, 25 bp, Mus musculus
ttcatgtcgtaatagctgatatagg

SEQ ID NO: 406073 - DNA, 25 bp, Mus musculus
taatagctgatataggcccggtccg

SEQ ID NO: 406074 - DNA, 25 bp, Mus musculus
ctgatataggcccggtccgggctga

SEQ ID NO: 406075 - DNA, 25 bp, Mus musculus
gtaatagctgatataggcccggtcc

SEQ ID NO: 406076 - DNA, 25 bp, Mus musculus
gttctgggtaccaccgatgctgtgc

SEQ ID NO: 406077 - DNA, 25 bp, Mus musculus
ttctgggtaccaccgatgctgtgca

SEQ ID NO: 406078 - DNA, 25 bp, Mus musculus
ctgggtaccaccgatgctgtgcagg

SEQ ID NO: 406079 - DNA, 25 bp, Mus musculus
aacagcggtgcaggggccaggactc

SEQ ID NO: 406080 - DNA, 25 bp, Mus musculus
tcaactccagcggaaagagagaagg

SEQ ID NO: 406081 - DNA, 25 bp, Mus musculus
agctagactaagaagaccgcgttcc

SEQ ID NO: 406082 - DNA, 25 bp, Mus musculus
tcaaagctgtccctaagctgagcgc

SEQ ID NO: 406083 - DNA, 25 bp, Mus musculus
ctgctactgctgcagcggctgaacg

SEQ ID NO: 406084 - DNA, 25 bp, Mus musculus
gacacgggcagcagagattcaactc

SEQ ID NO: 406085 - DNA, 25 bp, Mus musculus
ggtccggaagcccagcacctggaca

SEQ ID NO: 406086 - DNA, 25 bp, Mus musculus
cgtctccactttgggcagcatgaca

SEQ ID NO: 406087 - DNA, 25 bp, Mus musculus
cgatcggaccagtcctggggcttcc

SEQ ID NO: 406088 - DNA, 25 bp, Mus musculus
ccttgcatgttttctggcatctgcc

SEQ ID NO: 406089 - DNA, 25 bp, Mus musculus
aaaaccaggaaccagagcgccgcgc

SEQ ID NO: 406090 - DNA, 25 bp, Mus musculus
ttagcccgagagtgtaaaaccagga

SEQ ID NO: 406091 - DNA, 25 bp, Mus musculus
tgcccatgctgcagaaggctgaagc

SEQ ID NO: 406092 - DNA, 25 bp, Mus musculus
cacaactgccagctgggctgctctg

SEQ ID NO: 406093 - DNA, 25 bp, Mus musculus
gggagatcccggctaccaagctaga

SEQ ID NO: 406094 - DNA, 25 bp, Mus musculus
attttatccagcctcggcgttcccg

SEQ ID NO: 406095 - DNA, 25 bp, Mus musculus
tcccgcagccttgatgagcccgaga

SEQ ID NO: 406096 - DNA, 25 bp, Mus musculus
cagccttgatgagcccgagaagcgc

SEQ ID NO: 406097 - DNA, 25 bp, Mus musculus
cttgatgagcccgagaagcgcaggc

SEQ ID NO: 406098 - DNA, 25 bp, Mus musculus
ccgagaagcgcaggcctggcatatt

SEQ ID NO: 406099 - DNA, 25 bp, Mus musculus
ggcctggcatattttatccagcctc

SEQ ID NO: 406100 - DNA, 25 bp, Mus musculus
gcatattttatccagcctcggcgtt

SEQ ID NO: 406101 - DNA, 25 bp, Mus musculus
tgcaactgcaagttctcctccggtc

SEQ ID NO: 406102 - DNA, 25 bp, Mus musculus
actgcaagttctcctccggtcttct

SEQ ID NO: 406103 - DNA, 25 bp, Mus musculus
ttctcccttcccgaggttgcgcgcc

SEQ ID NO: 406104 - DNA, 25 bp, Mus musculus
cacccagctggctggagctgaggcg

SEQ ID NO: 406105 - DNA, 25 bp, Mus musculus
ggagctgaggcggtctcgcactccc

SEQ ID NO: 406106 - DNA, 25 bp, Mus musculus
cacgaggatgcaactgcaagttctc

SEQ ID NO: 406107 - DNA, 25 bp, Mus musculus
ccacccacgaggatgcaactgcaag

SEQ ID NO: 406108 - DNA, 25 bp, Mus musculus
gccaaggtgaccaatgagctcagcc

SEQ ID NO: 406109 - DNA, 25 bp, Mus musculus
cggtttcaatcggacctcgacctga

SEQ ID NO: 406110 - DNA, 25 bp, Mus musculus
cgtgaacttcacttttctaaactgg

SEQ ID NO: 406111 - DNA, 25 bp, Mus musculus
ttctaaactgggctgcagccgaatc

SEQ ID NO: 406112 - DNA, 25 bp, Mus musculus
tgagccaatcctcgagctgtaaata

SEQ ID NO: 406113 - DNA, 25 bp, Mus musculus
ggtcttcgctggagttcctcctgtc

SEQ ID NO: 406114 - DNA, 25 bp, Mus musculus
caccaccgtcgtggagcttcctggg

SEQ ID NO: 406115 - DNA, 25 bp, Mus musculus
ggactctgagctcctgcagccagcg

SEQ ID NO: 406116 - DNA, 25 bp, Mus musculus
gggccgtacatactcaccggggcgc

SEQ ID NO: 406117 - DNA, 25 bp, Mus musculus
gcgcttcccactgcgaggttagcgg

SEQ ID NO: 406118 - DNA, 25 bp, Mus musculus
tcaggagggtaaacatcccggcatc

SEQ ID NO: 406119 - DNA, 25 bp, Mus musculus
acgctaccactttcccgagaactgg

SEQ ID NO: 406120 - DNA, 25 bp, Mus musculus
cgagaactggggtgtgcctcgctta

SEQ ID NO: 406121 - DNA, 25 bp, Mus musculus
agccgaatcggttgagccaatcctc

SEQ ID NO: 406122 - DNA, 25 bp, Mus musculus
gccgctcgcaaggagcatccaggcg

SEQ ID NO: 406123 - DNA, 25 bp, Mus musculus
cccagcaccaagtaactctgcaagg

SEQ ID NO: 406124 - DNA, 25 bp, Mus musculus
aagtaactctgcaaggcgggacacc

SEQ ID NO: 406125 - DNA, 25 bp, Mus musculus
cctgaagcacatagagccctccctc

SEQ ID NO: 406126 - DNA, 25 bp, Mus musculus
ccaaaaggctacactgtccgtccta

SEQ ID NO: 406127 - DNA, 25 bp, Mus musculus
ctacactgtccgtcctaagaacttc

SEQ ID NO: 406128 - DNA, 25 bp, Mus musculus
acagcgaggagtggtcggaaccttc

SEQ ID NO: 406129 - DNA, 25 bp, Mus musculus
tcctaagaacttccggcccagagcg

SEQ ID NO: 406130 - DNA, 25 bp, Mus musculus
gaaaggctgagaccgggcacacagt

SEQ ID NO: 406131 - DNA, 25 bp, Mus musculus
ctgagaccgggcacacagtgtgcta

SEQ ID NO: 406132 - DNA, 25 bp, Mus musculus
acacagtgtgctacgcggccgccgt

SEQ ID NO: 406133 - DNA, 25 bp, Mus musculus
gtccggagaaaccaggctgcgttcc

SEQ ID NO: 406134 - DNA, 25 bp, Mus musculus
tctcataggccgctcgcaaggagca

SEQ ID NO: 406135 - DNA, 25 bp, Mus musculus
caggcgccgccgagttaaatagaga

SEQ ID NO: 406136 - DNA, 25 bp, Mus musculus
ttgcgaacatccctaggcaaaagtc

SEQ ID NO: 406137 - DNA, 25 bp, Mus musculus
ctcagtcttggatctgcgctccatc

SEQ ID NO: 406138 - DNA, 25 bp, Mus musculus
ttcgagtgaagaagcaaaagcgacc

SEQ ID NO: 406139 - DNA, 25 bp, Mus musculus
ctggggctctcagttcattcgagtg

SEQ ID NO: 406140 - DNA, 25 bp, Mus musculus
ttccataaacacacgcctggggctc

SEQ ID NO: 406141 - DNA, 25 bp, Mus musculus
cacgaattgttttcggctcggcacc

SEQ ID NO: 406142 - DNA, 25 bp, Mus musculus
tgataccttggatgtggcctccgga

SEQ ID NO: 406143 - DNA, 25 bp, Mus musculus
ccgttgagctgagtgcctttggtca

SEQ ID NO: 406144 - DNA, 25 bp, Mus musculus
cggctcgggatcagctgctatacaa

SEQ ID NO: 406145 - DNA, 25 bp, Mus musculus
gcctctcgtgaaaaccttgcgaaca

SEQ ID NO: 406146 - DNA, 25 bp, Mus musculus
ttgcctagcaagcacgcctctcgtg

SEQ ID NO: 406147 - DNA, 25 bp, Mus musculus
tcttagacacctcgattcggaaagg

SEQ ID NO: 406148 - DNA, 25 bp, Mus musculus
ctggagagctcaggactacaacatc

SEQ ID NO: 406149 - DNA, 25 bp, Mus musculus
cctttggtcagacgggcctcagtct

SEQ ID NO: 406150 - DNA, 25 bp, Mus musculus
aaagctggagaagcaccccgcggca

SEQ ID NO: 406151 - DNA, 25 bp, Mus musculus
atgccaggagcagcgacgggaactt

SEQ ID NO: 406152 - DNA, 25 bp, Mus musculus
ccaggagcagcgacgggaacttaat

SEQ ID NO: 406153 - DNA, 25 bp, Mus musculus
gagcagcgacgggaacttaatccga

SEQ ID NO: 406154 - DNA, 25 bp, Mus musculus
cagcgacgggaacttaatccgaaag

SEQ ID NO: 406155 - DNA, 25 bp, Mus musculus
agggaagaaagcctggccgctcccg

SEQ ID NO: 406156 - DNA, 25 bp, Mus musculus
tgtctagaaagctggagaagcaccc

SEQ ID NO: 406157 - DNA, 25 bp, Mus musculus
ggaagaaagcctggccgctcccgct

SEQ ID NO: 406158 - DNA, 25 bp, Mus musculus
cctctctgcctgctcgccagtctcg

SEQ ID NO: 406159 - DNA, 25 bp, Mus musculus
gccagtctcggcttcaccaccactt

SEQ ID NO: 406160 - DNA, 25 bp, Mus musculus
ccacttctcgggcttgcgggcgagc

SEQ ID NO: 406161 - DNA, 25 bp, Mus musculus
cttctcgggcttgcgggcgagcatc

SEQ ID NO: 406162 - DNA, 25 bp, Mus musculus
cgagcatcggggcttctgtctagaa

SEQ ID NO: 406163 - DNA, 25 bp, Mus musculus
ggcttctgtctagaaagctggagaa

SEQ ID NO: 406164 - DNA, 25 bp, Mus musculus
tcgacgatgtgcctctccgctgcag

SEQ ID NO: 406165 - DNA, 25 bp, Mus musculus
caagcctttagctgggacgcagatc

SEQ ID NO: 406166 - DNA, 25 bp, Mus musculus
ggacgcagatcaaaaaccgagcctc

SEQ ID NO: 406167 - DNA, 25 bp, Mus musculus
atctcagggcagacacctctctgtc

SEQ ID NO: 406168 - DNA, 25 bp, Mus musculus
cctctctgtccggaacgcaaaagtg

SEQ ID NO: 406169 - DNA, 25 bp, Mus musculus
cgcaaaagtgcgaccgggtttctcg

SEQ ID NO: 406170 - DNA, 25 bp, Mus musculus
cccggtgcagctcgacgatgtgcct

SEQ ID NO: 406171 - DNA, 25 bp, Mus musculus
tccgctgcagttaactctcggctcg

SEQ ID NO: 406172 - DNA, 25 bp, Mus musculus
taactctcggctcgctggatgcctt

SEQ ID NO: 406173 - DNA, 25 bp, Mus musculus
tggatgccttggttctccttcgggc

SEQ ID NO: 406174 - DNA, 25 bp, Mus musculus
gccgcgggctccttcggaagtcgaa

SEQ ID NO: 406175 - DNA, 25 bp, Mus musculus
ctgctgtcggaaaccttcggcccga

SEQ ID NO: 406176 - DNA, 25 bp, Mus musculus
aggcggtggcctcccaagcgatacc

SEQ ID NO: 406177 - DNA, 25 bp, Mus musculus
tttctcgcaggaccctctgagcgga

SEQ ID NO: 406178 - DNA, 25 bp, Mus musculus
ccatggaccgcaggaccaggtgagc

SEQ ID NO: 406179 - DNA, 25 bp, Mus musculus
atgtgaccatggaccgcaggaccag

SEQ ID NO: 406180 - DNA, 25 bp, Mus musculus
cccgcagcgacatgtgaccatggac

SEQ ID NO: 406181 - DNA, 25 bp, Mus musculus
tttccgagagagcactaccggggcc

SEQ ID NO: 406182 - DNA, 25 bp, Mus musculus
cgccgacttcctggttcgcggaagg

SEQ ID NO: 406183 - DNA, 25 bp, Mus musculus
agtgaggcggaagtcagagcatcca

SEQ ID NO: 406184 - DNA, 25 bp, Mus musculus
cggaagtcagagcatccactcgagc

SEQ ID NO: 406185 - DNA, 25 bp, Mus musculus
cactcgagctcccaatttgcaatga

SEQ ID NO: 406186 - DNA, 25 bp, Mus musculus
cgagctcccaatttgcaatgaatgg

SEQ ID NO: 406187 - DNA, 25 bp, Mus musculus
tttgcaatgaatgggagtcgtgatg

SEQ ID NO: 406188 - DNA, 25 bp, Mus musculus
ggcagaagtgctttcccaggccggg

SEQ ID NO: 406189 - DNA, 25 bp, Mus musculus
aggtcggcgctaggccgcaaagcct

SEQ ID NO: 406190 - DNA, 25 bp, Mus musculus
ctctgcgagcggtggttagggaacc

SEQ ID NO: 406191 - DNA, 25 bp, Mus musculus
cccaggacagcaggagggcaggtcc

SEQ ID NO: 406192 - DNA, 25 bp, Mus musculus
gagactctctcaactgggctctgtg

SEQ ID NO: 406193 - DNA, 25 bp, Mus musculus
aactgggctctgtgtcccaaggacc

SEQ ID NO: 406194 - DNA, 25 bp, Mus musculus
gtgtcccaaggaccctactcaagcg

SEQ ID NO: 406195 - DNA, 25 bp, Mus musculus
taccaccagagtcaagacccgtact

SEQ ID NO: 406196 - DNA, 25 bp, Mus musculus
acggcaacgccaagaagtgggctca

SEQ ID NO: 406197 - DNA, 25 bp, Mus musculus
aagggactaccactctgtccgccgg

SEQ ID NO: 406198 - DNA, 25 bp, Mus musculus
cggacgtgctgctgcattccgcaca

SEQ ID NO: 406199 - DNA, 25 bp, Mus musculus
tgcattccgcacatcacggcctgga

SEQ ID NO: 406200 - DNA, 25 bp, Mus musculus
acatcacggcctggacgccggcatg

SEQ ID NO: 406201 - DNA, 25 bp, Mus musculus
ccggcatgggcgacagcctctcgtt

SEQ ID NO: 406202 - DNA, 25 bp, Mus musculus
acagcctctcgttgcacggccttgg

SEQ ID NO: 406203 - DNA, 25 bp, Mus musculus
cggccttgggcatcccggcatggaa

SEQ ID NO: 406204 - DNA, 25 bp, Mus musculus
caggaccggcacgatggcgtcccaa

SEQ ID NO: 406205 - DNA, 25 bp, Mus musculus
ggcgtcccaagccatagctcgagac

SEQ ID NO: 406206 - DNA, 25 bp, Mus musculus
gcctgggaagactcggcttcctgca

SEQ ID NO: 406207 - DNA, 25 bp, Mus musculus
gtctgtcgctcaggagccatgccgc

SEQ ID NO: 406208 - DNA, 25 bp, Mus musculus
tggatttcggaaggtctgtcgctca

SEQ ID NO: 406209 - DNA, 25 bp, Mus musculus
gagacttgcgtttcgtggccgcgct

SEQ ID NO: 406210 - DNA, 25 bp, Mus musculus
gccgcgctggccttattgtcaaggt

SEQ ID NO: 406211 - DNA, 25 bp, Mus musculus
cttattgtcaaggtcccagcaccca

SEQ ID NO: 406212 - DNA, 25 bp, Mus musculus
taatgggcctgtgggacgcttgccc

SEQ ID NO: 406213 - DNA, 25 bp, Mus musculus
cacccagggcaggaaagaaagctca

SEQ ID NO: 406214 - DNA, 25 bp, Mus musculus
cagcacccaaatcgggactgcggtc

SEQ ID NO: 406215 - DNA, 25 bp, Mus musculus
ccgccgtgcctagtggatttcggaa

SEQ ID NO: 406216 - DNA, 25 bp, Mus musculus
ttcctgcagtcgtcgcccgtgctga

SEQ ID NO: 406217 - DNA, 25 bp, Mus musculus
agtctgccttgtttgcggtctcggc

SEQ ID NO: 406218 - DNA, 25 bp, Mus musculus
tcgcccggggaaagcatgctaatgg

SEQ ID NO: 406219 - DNA, 25 bp, Mus musculus
aaagaaagctcacggagcatgcgca

SEQ ID NO: 406220 - DNA, 25 bp, Mus musculus
acagcgggtacctgactgcccggta

SEQ ID NO: 406221 - DNA, 25 bp, Mus musculus
ccatggcgacgatgcaggcagcctc

SEQ ID NO: 406222 - DNA, 25 bp, Mus musculus
cgcttcctcattggccaggcgcttt

SEQ ID NO: 406223 - DNA, 25 bp, Mus musculus
gccaggcgctttcgttcgctcattg

SEQ ID NO: 406224 - DNA, 25 bp, Mus musculus
cgctcattggctctttttagtgatg

SEQ ID NO: 406225 - DNA, 25 bp, Mus musculus
tttctcctcgctggttggtgctgta

SEQ ID NO: 406226 - DNA, 25 bp, Mus musculus
tcccattggtggaggcgcgatattt

SEQ ID NO: 406227 - DNA, 25 bp, Mus musculus
ggcgcgatatttgaaccgagcaaaa

SEQ ID NO: 406228 - DNA, 25 bp, Mus musculus
agcaaaagcggctgggctactttcc

SEQ ID NO: 406229 - DNA, 25 bp, Mus musculus
cacgaggaacctctgcaggtggagc

SEQ ID NO: 406230 - DNA, 25 bp, Mus musculus
tggtcctgcacaacccgcacgagga

SEQ ID NO: 406231 - DNA, 25 bp, Mus musculus
tcccttcctctgcttcggggatgtc

SEQ ID NO: 406232 - DNA, 25 bp, Mus musculus
ctttgtccttgtcctggtcgttggc

SEQ ID NO: 406233 - DNA, 25 bp, Mus musculus
ttgctcagccacttctgcggcgttc

SEQ ID NO: 406234 - DNA, 25 bp, Mus musculus
tctcaaggctcgcacggggcgagcg

SEQ ID NO: 406235 - DNA, 25 bp, Mus musculus
ccacactcaacagccggccgcgtct

SEQ ID NO: 406236 - DNA, 25 bp, Mus musculus
gtctacgacagcagcacgggcagaa

SEQ ID NO: 406237 - DNA, 25 bp, Mus musculus
acgacagcagcacgggcagaagcca

SEQ ID NO: 406238 - DNA, 25 bp, Mus musculus
gcagcacgggcagaagccacccagg

SEQ ID NO: 406239 - DNA, 25 bp, Mus musculus
gaggaccccgcgctatataaggcaa

SEQ ID NO: 406240 - DNA, 25 bp, Mus musculus
ctatataaggcaaggccccgccgcg

SEQ ID NO: 406241 - DNA, 25 bp, Mus musculus
ggccgcgtctacgacagcagcacgg

SEQ ID NO: 406242 - DNA, 25 bp, Mus musculus
acctgctgggcgcttccgcgctttt

SEQ ID NO: 406243 - DNA, 25 bp, Mus musculus
gcttccgcgcttttcaatcccagag

SEQ ID NO: 406244 - DNA, 25 bp, Mus musculus
gcgcttttcaatcccagagcgcgcg

SEQ ID NO: 406245 - DNA, 25 bp, Mus musculus
ggtgatttaaactttccctgcgcca

SEQ ID NO: 406246 - DNA, 25 bp, Mus musculus
gagcacacgcgccacccagacgccc

SEQ ID NO: 406247 - DNA, 25 bp, Mus musculus
ggagaacgcctgactgacccacgct

SEQ ID NO: 406248 - DNA, 25 bp, Mus musculus
aactcggcaggcaggtgagtgcctc

SEQ ID NO: 406249 - DNA, 25 bp, Mus musculus
acctttggctatgtcctggcgccgc

SEQ ID NO: 406250 - DNA, 25 bp, Mus musculus
tgccggggacctttggctatgtcct

SEQ ID NO: 406251 - DNA, 25 bp, Mus musculus
cgatcgcctgctgctctcccggagg

SEQ ID NO: 406252 - DNA, 25 bp, Mus musculus
cgtggtcgcgatcgcctgctgctct

SEQ ID NO: 406253 - DNA, 25 bp, Mus musculus
ccatcgtcgtggtcgcgatcgcctg

SEQ ID NO: 406254 - DNA, 25 bp, Mus musculus
cgaggatgcgaacctgcaggctcgc

SEQ ID NO: 406255 - DNA, 25 bp, Mus musculus
tctaccgccgaggatgcgaacctgc

SEQ ID NO: 406256 - DNA, 25 bp, Mus musculus
aggcaggtgagtgcctcgctctacc

SEQ ID NO: 406257 - DNA, 25 bp, Mus musculus
tagagatcggaagaactcggcaggc

SEQ ID NO: 406258 - DNA, 25 bp, Mus musculus
aactcggtagagatcggaagaactc

SEQ ID NO: 406259 - DNA, 25 bp, Mus musculus
agctcgggagaactcggtagagatc

SEQ ID NO: 406260 - DNA, 25 bp, Mus musculus
tttggctatgtcctggcgccgcgcg

SEQ ID NO: 406261 - DNA, 25 bp, Mus musculus
tgagtgcctcgctctaccgccgagg

SEQ ID NO: 406262 - DNA, 25 bp, Mus musculus
gaagtcggtccatgctctcctccgg

SEQ ID NO: 406263 - DNA, 25 bp, Mus musculus
aaatgttcagatgcgaagtcggtcc

SEQ ID NO: 406264 - DNA, 25 bp, Mus musculus
gaaggctttgcctggcctctgacgc

SEQ ID NO: 406265 - DNA, 25 bp, Mus musculus
cctcaagtgcccaggatcgctggga

SEQ ID NO: 406266 - DNA, 25 bp, Mus musculus
gctgggactgcccaaaacgcggttc

SEQ ID NO: 406267 - DNA, 25 bp, Mus musculus
gcaggcctgcagtgacccaccttta

SEQ ID NO: 406268 - DNA, 25 bp, Mus musculus
acctttacctggaaggtgatgctca

SEQ ID NO: 406269 - DNA, 25 bp, Mus musculus
accatgtcgagcaatgccggggagt

SEQ ID NO: 406270 - DNA, 25 bp, Mus musculus
agtggtgtctcatggaaagcgaccc

SEQ ID NO: 406271 - DNA, 25 bp, Mus musculus
ccggggtcttcaccgagctcattaa

SEQ ID NO: 406272 - DNA, 25 bp, Mus musculus
tcattaaaggattcggtgagcacca

SEQ ID NO: 406273 - DNA, 25 bp, Mus musculus
cccggcgtcggagaagtgacttcag

SEQ ID NO: 406274 - DNA, 25 bp, Mus musculus
gaaagcctgcgtcgcaccaggaata

SEQ ID NO: 406275 - DNA, 25 bp, Mus musculus
gaaagtagggcttctgccgcgtcct

SEQ ID NO: 406276 - DNA, 25 bp, Mus musculus
tcgccagccgactcctaaagcggag

SEQ ID NO: 406277 - DNA, 25 bp, Mus musculus
cttgaacctgggtcgaagaatcggg

SEQ ID NO: 406278 - DNA, 25 bp, Mus musculus
ccacaatgcttgaacctgggtcgaa

SEQ ID NO: 406279 - DNA, 25 bp, Mus musculus
gcaccttcgcgccacaatgcttgaa

SEQ ID NO: 406280 - DNA, 25 bp, Mus musculus
cgcgcgcttacagaaagggtccgca

SEQ ID NO: 406281 - DNA, 25 bp, Mus musculus
ctcctaaagcggaggcgtctggcga

SEQ ID NO: 406282 - DNA, 25 bp, Mus musculus
cgtctggcgagacccgaagatcaga

SEQ ID NO: 406283 - DNA, 25 bp, Mus musculus
aagaatcggggctcgccagccgact

SEQ ID NO: 406284 - DNA, 25 bp, Mus musculus
cgtcagggacactcgtgggttgaaa

SEQ ID NO: 406285 - DNA, 25 bp, Mus musculus
ctcgtgggttgaaacaggaatggtt

SEQ ID NO: 406286 - DNA, 25 bp, Mus musculus
atggttggaaggaacttattggagc

SEQ ID NO: 406287 - DNA, 25 bp, Mus musculus
cttattggagcgaaagagttccacg

SEQ ID NO: 406288 - DNA, 25 bp, Mus musculus
tggagcgaaagagttccacgggaac

SEQ ID NO: 406289 - DNA, 25 bp, Mus musculus
tacagaaagggtccgcacgggtgac

SEQ ID NO: 406290 - DNA, 25 bp, Mus musculus
gagttcttggcttttcctttactga

SEQ ID NO: 406291 - DNA, 25 bp, Mus musculus
tgaagggtctccgagttcttggctt

SEQ ID NO: 406292 - DNA, 25 bp, Mus musculus
cagccacgcggtgaagggtctccga

SEQ ID NO: 406293 - DNA, 25 bp, Mus musculus
cgcggccaccgcagctgtttgaggc

SEQ ID NO: 406294 - DNA, 25 bp, Mus musculus
ctgaagaccgtaccttttactcgtg

SEQ ID NO: 406295 - DNA, 25 bp, Mus musculus
gcacttcgggcagccacgcggtgaa

SEQ ID NO: 406296 - DNA, 25 bp, Mus musculus
tttggtaggcacttcgggcagccac

SEQ ID NO: 406297 - DNA, 25 bp, Mus musculus
cacagagagatttggtaggcacttc

SEQ ID NO: 406298 - DNA, 25 bp, Mus musculus
atcctcgtgcgcacacagggtggga

SEQ ID NO: 406299 - DNA, 25 bp, Mus musculus
gctgttgacgtaggcgccgcatcct

SEQ ID NO: 406300 - DNA, 25 bp, Mus musculus
attggctcgctgcagacggcacgag

SEQ ID NO: 406301 - DNA, 25 bp, Mus musculus
cccaagagagcgcggattggctcgc

SEQ ID NO: 406302 - DNA, 25 bp, Mus musculus
ccaccgcagctgtttgaggccggga

SEQ ID NO: 406303 - DNA, 25 bp, Mus musculus
cgtaccttttactcgtgtgcgtgtg

SEQ ID NO: 406304 - DNA, 25 bp, Mus musculus
tggagcgcccggaactgaacaaact

SEQ ID NO: 406305 - DNA, 25 bp, Mus musculus
agtggccacagaggagtacccatga

SEQ ID NO: 406306 - DNA, 25 bp, Mus musculus
gtgcagactgatgacgcaagccgtc

SEQ ID NO: 406307 - DNA, 25 bp, Mus musculus
gcagctcttctacccaagcgaggga

SEQ ID NO: 406308 - DNA, 25 bp, Mus musculus
ccgttaagatcgtggcggtagccca

SEQ ID NO: 406309 - DNA, 25 bp, Mus musculus
agcctgtcgagacaccctgccgtga

SEQ ID NO: 406310 - DNA, 25 bp, Mus musculus
ggctcggcttctagaagtggccaca

SEQ ID NO: 406311 - DNA, 25 bp, Mus musculus
tacccatgacatcccggggttttga

SEQ ID NO: 406312 - DNA, 25 bp, Mus musculus
aggtcgtcttgctcctccgggataa

SEQ ID NO: 406313 - DNA, 25 bp, Mus musculus
gcgggcactcgtcacagccatagga

SEQ ID NO: 406314 - DNA, 25 bp, Mus musculus
gcgggtgagaaatacactacatttc

SEQ ID NO: 406315 - DNA, 25 bp, Mus musculus
ggctgcacctaacgcgggactctct

SEQ ID NO: 406316 - DNA, 25 bp, Mus musculus
tgccgaagtcgacgcagaacaaact

SEQ ID NO: 406317 - DNA, 25 bp, Mus musculus
aggctgctgtgaactcgctttccca

SEQ ID NO: 406318 - DNA, 25 bp, Mus musculus
agtctctccagtaccggggaagcgc

SEQ ID NO: 406319 - DNA, 25 bp, Mus musculus
cttttgtccggctgggtaggtcctg

SEQ ID NO: 406320 - DNA, 25 bp, Mus musculus
gtctctccagtaccggggaagcgct

SEQ ID NO: 406321 - DNA, 25 bp, Mus musculus
ccggcgcgacctctccttctgattg

SEQ ID NO: 406322 - DNA, 25 bp, Mus musculus
ccttggaggcgaagcccggcgcgac

SEQ ID NO: 406323 - DNA, 25 bp, Mus musculus
ctagccccttggaggcgaagcccgg

SEQ ID NO: 406324 - DNA, 25 bp, Mus musculus
aactttccacagctagccccttgga

SEQ ID NO: 406325 - DNA, 25 bp, Mus musculus
cgctccaggccagcgactgagcctc

SEQ ID NO: 406326 - DNA, 25 bp, Mus musculus
acgctgcgagcctgcggtgccgcct

SEQ ID NO: 406327 - DNA, 25 bp, Mus musculus
ctgcgagtagccgagcgcccgcaga

SEQ ID NO: 406328 - DNA, 25 bp, Mus musculus
ccgcgtgcagggagctgcgagtagc

SEQ ID NO: 406329 - DNA, 25 bp, Mus musculus
cctgggctctaagcggccgcgtgca

SEQ ID NO: 406330 - DNA, 25 bp, Mus musculus
ggagggcgactttccccctctgtga

SEQ ID NO: 406331 - DNA, 25 bp, Mus musculus
taggtcctgggctctaagcggccgc

SEQ ID NO: 406332 - DNA, 25 bp, Mus musculus
cccgtcgaagctctggagatgaatt

SEQ ID NO: 406333 - DNA, 25 bp, Mus musculus
cacgttgcccgcttttcttgccaag

SEQ ID NO: 406334 - DNA, 25 bp, Mus musculus
ggctgccctgacgtgtcagctctga

SEQ ID NO: 406335 - DNA, 25 bp, Mus musculus
tgtcagctctgagtgactgcgccgc

SEQ ID NO: 406336 - DNA, 25 bp, Mus musculus
ctcttcagagatgacccaggtaacg

SEQ ID NO: 406337 - DNA, 25 bp, Mus musculus
gccctcagagcgcatcggttccagg

SEQ ID NO: 406338 - DNA, 25 bp, Mus musculus
ggtcctttgttcgagctccacgttg

SEQ ID NO: 406339 - DNA, 25 bp, Mus musculus
atgaatttcgccatctcttcagaga

SEQ ID NO: 406340 - DNA, 25 bp, Mus musculus
gccaccgaggactgtagacatcgtt

SEQ ID NO: 406341 - DNA, 25 bp, Mus musculus
agttcccgcgagtacccactggtct

SEQ ID NO: 406342 - DNA, 25 bp, Mus musculus
tcagagcgggatcttcccgggagct

SEQ ID NO: 406343 - DNA, 25 bp, Mus musculus
tgacccaggtaacgcgctgtacgcg

SEQ ID NO: 406344 - DNA, 25 bp, Mus musculus
gtagacatcgtttcccgctgtcagg

SEQ ID NO: 406345 - DNA, 25 bp, Mus musculus
tcgcctgtgattcgctcaggcatca

SEQ ID NO: 406346 - DNA, 25 bp, Mus musculus
aagctgtcgcccagagagatgtcca

SEQ ID NO: 406347 - DNA, 25 bp, Mus musculus
taacttacctgagtccgcggcagca

SEQ ID NO: 406348 - DNA, 25 bp, Mus musculus
agagcccgctgcacactgggaaatg

SEQ ID NO: 406349 - DNA, 25 bp, Mus musculus
gaaatgtagttctgtactcggaccc

SEQ ID NO: 406350 - DNA, 25 bp, Mus musculus
gagccgaacgctccaggcaattcta

SEQ ID NO: 406351 - DNA, 25 bp, Mus musculus
ggcaattctagagttctcggcgctc

SEQ ID NO: 406352 - DNA, 25 bp, Mus musculus
gcgctctgtgtgtgtttcctccaag

SEQ ID NO: 406353 - DNA, 25 bp, Mus musculus
gaccggaactgagcaccgcccatga

SEQ ID NO: 406354 - DNA, 25 bp, Mus musculus
cggaactctttttcctcattggaca

SEQ ID NO: 406355 - DNA, 25 bp, Mus musculus
gagctccgccgtttgtctgtggcac

SEQ ID NO: 406356 - DNA, 25 bp, Mus musculus
ggcacgcgtacagccttcccaattg

SEQ ID NO: 406357 - DNA, 25 bp, Mus musculus
gccctgtgtgcattaacgtctatta

SEQ ID NO: 406358 - DNA, 25 bp, Mus musculus
cagatacggctctggactcggctcc

SEQ ID NO: 406359 - DNA, 25 bp, Mus musculus
accgcctcaggtccagctggagcaa

SEQ ID NO: 406360 - DNA, 25 bp, Mus musculus
agggcgcgagccgtacaggcccttc

SEQ ID NO: 406361 - DNA, 25 bp, Mus musculus
tcgagagacgcgatggatgcgcctt

SEQ ID NO: 406362 - DNA, 25 bp, Mus musculus
cccacgcgtgtgacatcgagagacg

SEQ ID NO: 406363 - DNA, 25 bp, Mus musculus
ctcggcctcaccctaagggctaagg

SEQ ID NO: 406364 - DNA, 25 bp, Mus musculus
tggatgcgccttgctcttactgtgc

SEQ ID NO: 406365 - DNA, 25 bp, Mus musculus
gcgccttgctcttactgtgcaggtc

SEQ ID NO: 406366 - DNA, 25 bp, Mus musculus
gctcttactgtgcaggtcctgggaa

SEQ ID NO: 406367 - DNA, 25 bp, Mus musculus
acatgtgggccactgaagcccagtg

SEQ ID NO: 406368 - DNA, 25 bp, Mus musculus
gaagcccagtggtgttgaggacata

SEQ ID NO: 406369 - DNA, 25 bp, Mus musculus
ccagtggtgttgaggacatagaatc

SEQ ID NO: 406370 - DNA, 25 bp, Mus musculus
catagaatcagcagctgctgagggc

SEQ ID NO: 406371 - DNA, 25 bp, Mus musculus
gcgagccgtacaggcccttcttgct

SEQ ID NO: 406372 - DNA, 25 bp, Mus musculus
cctaagggctaaggcagccgcgaag

SEQ ID NO: 406373 - DNA, 25 bp, Mus musculus
gaggacatagaatcagcagctgctg

SEQ ID NO: 406374 - DNA, 25 bp, Mus musculus
cgaagcagctcgaacccacggagtc

SEQ ID NO: 406375 - DNA, 25 bp, Mus musculus
caggggccgctcaatattcatgaga

SEQ ID NO: 406376 - DNA, 25 bp, Mus musculus
cgcaatggagctcgggaaatacaac

SEQ ID NO: 406377 - DNA, 25 bp, Mus musculus
cgagtctcggcttccgcaatggagc

SEQ ID NO: 406378 - DNA, 25 bp, Mus musculus
gccgccgcacaatatggcgagtctc

SEQ ID NO: 406379 - DNA, 25 bp, Mus musculus
gagactcgagaatcaaccgccggcg

SEQ ID NO: 406380 - DNA, 25 bp, Mus musculus
tcacgggccgcgaacaatgagccct

SEQ ID NO: 406381 - DNA, 25 bp, Mus musculus
agggctaagttctcccagcgctccg

SEQ ID NO: 406382 - DNA, 25 bp, Mus musculus
cgcgagcaagcccagggctaagttc

SEQ ID NO: 406383 - DNA, 25 bp, Mus musculus
cggcaacagatactccggggcaggc

SEQ ID NO: 406384 - DNA, 25 bp, Mus musculus
cccggggtcaaaacgcgaagcagct

SEQ ID NO: 406385 - DNA, 25 bp, Mus musculus
agtggaccaaggatttcggcaaaca

SEQ ID NO: 406386 - DNA, 25 bp, Mus musculus
tttcggcaaacacagcccggggtca

SEQ ID NO: 406387 - DNA, 25 bp, Mus musculus
tgccaggtcccaaaggagagctgtc

SEQ ID NO: 406388 - DNA, 25 bp, Mus musculus
ggccctttaattacagagccagttc

SEQ ID NO: 406389 - DNA, 25 bp, Mus musculus
cggtgtcctgtttcaagcacccgcg

SEQ ID NO: 406390 - DNA, 25 bp, Mus musculus
gcactggctagctggtgctaccggc

SEQ ID NO: 406391 - DNA, 25 bp, Mus musculus
gcctctcaaggaagttggcccttta

SEQ ID NO: 406392 - DNA, 25 bp, Mus musculus
gcagttggtgtcagtcctctgcctc

SEQ ID NO: 406393 - DNA, 25 bp, Mus musculus
gcggctcagcttccagccagctgga

SEQ ID NO: 406394 - DNA, 25 bp, Mus musculus
cctacatccgaggtacggcggccag

SEQ ID NO: 406395 - DNA, 25 bp, Mus musculus
tgacacatccaccttcagcggcaag

SEQ ID NO: 406396 - DNA, 25 bp, Mus musculus
gccagggctagcctggtcacctgca

SEQ ID NO: 406397 - DNA, 25 bp, Mus musculus
gccggcgacgcctctcaaggaagtt

SEQ ID NO: 406398 - DNA, 25 bp, Mus musculus
tcacctgcacgctgatcttccgagg

SEQ ID NO: 406399 - DNA, 25 bp, Mus musculus
ctgatcttccgagggagcactggct

SEQ ID NO: 406400 - DNA, 25 bp, Mus musculus
tgggctcctagacttgcgctcgcct

SEQ ID NO: 406401 - DNA, 25 bp, Mus musculus
ggcaagtgcgcctacatccgaggta

SEQ ID NO: 406402 - DNA, 25 bp, Mus musculus
ctgtggtgactgtaacagctggtga

SEQ ID NO: 406403 - DNA, 25 bp, Mus musculus
cgaggctatctcacttcggctctac

SEQ ID NO: 406404 - DNA, 25 bp, Mus musculus
gtccaggacgatgggagctgatccc

SEQ ID NO: 406405 - DNA, 25 bp, Mus musculus
cggcgcactgtggactttttctgtg

SEQ ID NO: 406406 - DNA, 25 bp, Mus musculus
ccgcgcccatgagtagggaagagaa

SEQ ID NO: 406407 - DNA, 25 bp, Mus musculus
cccagcgagcgtcatggagcctggt

SEQ ID NO: 406408 - DNA, 25 bp, Mus musculus
accggctcggtgacttcggcaaaca

SEQ ID NO: 406409 - DNA, 25 bp, Mus musculus
cctagactacgacaccggaaagctg

SEQ ID NO: 406410 - DNA, 25 bp, Mus musculus
ctctacccggaagtagccttggaga

SEQ ID NO: 406411 - DNA, 25 bp, Mus musculus
tgtctccattggtcccgaggctatc

SEQ ID NO: 406412 - DNA, 25 bp, Mus musculus
ctctccgaggctgtctccattggtc

SEQ ID NO: 406413 - DNA, 25 bp, Mus musculus
tctctgggccaatgctaggtcctgt

SEQ ID NO: 406414 - DNA, 25 bp, Mus musculus
ttttgtccacgtcccgcttctctgg

SEQ ID NO: 406415 - DNA, 25 bp, Mus musculus
cttggagaggcggtttcctagacta

SEQ ID NO: 406416 - DNA, 25 bp, Mus musculus
ggctcccatcccttcggcagacacc

SEQ ID NO: 406417 - DNA, 25 bp, Mus musculus
cccaggcctcgatgtgacgaaagtc

SEQ ID NO: 406418 - DNA, 25 bp, Mus musculus
cacccaggcctcgatgtgacgaaag

SEQ ID NO: 406419 - DNA, 25 bp, Mus musculus
aggcctcgatgtgacgaaagtcgtc

SEQ ID NO: 406420 - DNA, 25 bp, Mus musculus
acgaaagtcgtcagcagccctaacc

SEQ ID NO: 406421 - DNA, 25 bp, Mus musculus
aagtcgtcagcagccctaaccgcat

SEQ ID NO: 406422 - DNA, 25 bp, Mus musculus
tggctccggtcccttgcagcgagca

SEQ ID NO: 406423 - DNA, 25 bp, Mus musculus
ccgggatcgcggctcccatcccttc

SEQ ID NO: 406424 - DNA, 25 bp, Mus musculus
ctaaagtgtgaaagaagcggtggcc

SEQ ID NO: 406425 - DNA, 25 bp, Mus musculus
cccgcttaccttgggcgctcgcggg

SEQ ID NO: 406426 - DNA, 25 bp, Mus musculus
tcctccctacagtgtggccggggct

SEQ ID NO: 406427 - DNA, 25 bp, Mus musculus
cggctcgcggcaactaaagtgtgaa

SEQ ID NO: 406428 - DNA, 25 bp, Mus musculus
ctcgcggcaactaaagtgtgaaaga

SEQ ID NO: 406429 - DNA, 25 bp, Mus musculus
cagccagagaagagcgccggcagca

SEQ ID NO: 406430 - DNA, 25 bp, Mus musculus
caacgcaaggtccatgtgcctggcc

SEQ ID NO: 406431 - DNA, 25 bp, Mus musculus
ccgggacctagcaagttacgcaatc

SEQ ID NO: 406432 - DNA, 25 bp, Mus musculus
cgatcctaccagcagcaacgcaagg

SEQ ID NO: 406433 - DNA, 25 bp, Mus musculus
ggacacggagcagcgccgatcctac

SEQ ID NO: 406434 - DNA, 25 bp, Mus musculus
ttcgtaggcaagctggacgagcgct

SEQ ID NO: 406435 - DNA, 25 bp, Mus musculus
tggaccctggagttcgtaggcaagc

SEQ ID NO: 406436 - DNA, 25 bp, Mus musculus
aagaacgaccgcgtgtggaccctgg

SEQ ID NO: 406437 - DNA, 25 bp, Mus musculus
tacccgagagccaagaacgaccgcg

SEQ ID NO: 406438 - DNA, 25 bp, Mus musculus
tacgtgcagctcctctacccgagag

SEQ ID NO: 406439 - DNA, 25 bp, Mus musculus
ggatccggcccgcatcaggctgatc

SEQ ID NO: 406440 - DNA, 25 bp, Mus musculus
caagaagcagctggatccggcccgc

SEQ ID NO: 406441 - DNA, 25 bp, Mus musculus
cagcggctccctgggcaagaagcag

SEQ ID NO: 406442 - DNA, 25 bp, Mus musculus
cgcaagcagtacaactgcagcggct

SEQ ID NO: 406443 - DNA, 25 bp, Mus musculus
cccacgagaacctgcgcaagcagta

SEQ ID NO: 406444 - DNA, 25 bp, Mus musculus
tgctttgtgtacgtcctgagacaga

SEQ ID NO: 406445 - DNA, 25 bp, Mus musculus
ccagacgccagagcggcccaggcct

SEQ ID NO: 406446 - DNA, 25 bp, Mus musculus
cccggtggtgctttgtgtacgtcct

SEQ ID NO: 406447 - DNA, 25 bp, Mus musculus
tggtgctttgtgtacgtcctgagac

SEQ ID NO: 406448 - DNA, 25 bp, Mus musculus
ggtgctttgtgtacgtcctgagaca

SEQ ID NO: 406449 - DNA, 25 bp, Mus musculus
ctttgtgtacgtcctgagacagatg

SEQ ID NO: 406450 - DNA, 25 bp, Mus musculus
tgtgtacgtcctgagacagatggca

SEQ ID NO: 406451 - DNA, 25 bp, Mus musculus
tgtacgtcctgagacagatggcaga

SEQ ID NO: 406452 - DNA, 25 bp, Mus musculus
tacgtcctgagacagatggcagagc

SEQ ID NO: 406453 - DNA, 25 bp, Mus musculus
acgtcctgagacagatggcagagca

SEQ ID NO: 406454 - DNA, 25 bp, Mus musculus
tcctgagacagatggcagagcagga

SEQ ID NO: 406455 - DNA, 25 bp, Mus musculus
cagatggcagagcaggagggtagac

SEQ ID NO: 406456 - DNA, 25 bp, Mus musculus
cgccgagccagacgccagagcggcc

SEQ ID NO: 406457 - DNA, 25 bp, Mus musculus
ttgtgtacgtcctgagacagatggc

SEQ ID NO: 406458 - DNA, 25 bp, Mus musculus
cgggcgaccagtggccttgcactcg

SEQ ID NO: 406459 - DNA, 25 bp, Mus musculus
ctctgactagggaccggcaccagcg

SEQ ID NO: 406460 - DNA, 25 bp, Mus musculus
ggagttccgcttcccgccgcgcaca

SEQ ID NO: 406461 - DNA, 25 bp, Mus musculus
gccagaagcagacggtccagcgcgc

SEQ ID NO: 406462 - DNA, 25 bp, Mus musculus
cgctcggccagaagcagacggtcca

SEQ ID NO: 406463 - DNA, 25 bp, Mus musculus
agaaagccgtggtgcaccgcaaacc

SEQ ID NO: 406464 - DNA, 25 bp, Mus musculus
atgccgcccgcgcagaaagccgtgg

SEQ ID NO: 406465 - DNA, 25 bp, Mus musculus
gtaggtttggaatcgctgcgctcct

SEQ ID NO: 406466 - DNA, 25 bp, Mus musculus
caggcccgctacatcccggggtagg

SEQ ID NO: 406467 - DNA, 25 bp, Mus musculus
aggcgtcctccggagcccatgtgtg

SEQ ID NO: 406468 - DNA, 25 bp, Mus musculus
ggtgtgtgcccatccaggcgtcctc

SEQ ID NO: 406469 - DNA, 25 bp, Mus musculus
gcctcctgaccttagggtgtgtgcc

SEQ ID NO: 406470 - DNA, 25 bp, Mus musculus
ctcgcgcctcctgaccttagggtgt

SEQ ID NO: 406471 - DNA, 25 bp, Mus musculus
actagggaccggcaccagcgcggat

SEQ ID NO: 406472 - DNA, 25 bp, Mus musculus
cccgcagaaacccacggtgttcgtg

SEQ ID NO: 406473 - DNA, 25 bp, Mus musculus
ccacggtgttcgtggtcgttctcgc

SEQ ID NO: 406474 - DNA, 25 bp, Mus musculus
gtcgcctgcgcgctgttcctgctgt

SEQ ID NO: 406475 - DNA, 25 bp, Mus musculus
gccttacttcctcggctgcctggaa

SEQ ID NO: 406476 - DNA, 25 bp, Mus musculus
atacgctgccttacttcctcggctg

SEQ ID NO: 406477 - DNA, 25 bp, Mus musculus
ttcgtggtcgttctcgcccgcaacg

SEQ ID NO: 406478 - DNA, 25 bp, Mus musculus
ccgccgagcccgactcggatgagga

SEQ ID NO: 406479 - DNA, 25 bp, Mus musculus
tacggaacatggctgcgcgcctcgc

SEQ ID NO: 406480 - DNA, 25 bp, Mus musculus
tcccgccggctacggaacatggctg

SEQ ID NO: 406481 - DNA, 25 bp, Mus musculus
aaatcagtgccggtgcacgctcccg

SEQ ID NO: 406482 - DNA, 25 bp, Mus musculus
tcctgcgagcctcagaaatcagtgc

SEQ ID NO: 406483 - DNA, 25 bp, Mus musculus
cgggtcctgcgagcctcagaaatca

SEQ ID NO: 406484 - DNA, 25 bp, Mus musculus
ctcccggagtcgacctgtctgcagg

SEQ ID NO: 406485 - DNA, 25 bp, Mus musculus
gcaacgctgcgcatacgctgcctta

SEQ ID NO: 406486 - DNA, 25 bp, Mus musculus
ggggagctggcgttaccattttagc

SEQ ID NO: 406487 - DNA, 25 bp, Mus musculus
tgagcgcactctccctttcggaagc

SEQ ID NO: 406488 - DNA, 25 bp, Mus musculus
ctttccggcacacggacgctgcatg

SEQ ID NO: 406489 - DNA, 25 bp, Mus musculus
gcgttaccattttagcttgccaaag

SEQ ID NO: 406490 - DNA, 25 bp, Mus musculus
gcttgccaaagtaatttcattctca

SEQ ID NO: 406491 - DNA, 25 bp, Mus musculus
ttcattctcagttttctttccggca

SEQ ID NO: 406492 - DNA, 25 bp, Mus musculus
ctcagttttctttccggcacacgga

SEQ ID NO: 406493 - DNA, 25 bp, Mus musculus
acacggacgctgcatggtgcgccct

SEQ ID NO: 406494 - DNA, 25 bp, Mus musculus
ttcccacgcgccttgctgcccgact

SEQ ID NO: 406495 - DNA, 25 bp, Mus musculus
cgcgaccgggccacaaaggagcgcc

SEQ ID NO: 406496 - DNA, 25 bp, Mus musculus
gccgctccgtgatgtcaggctttcc

SEQ ID NO: 406497 - DNA, 25 bp, Mus musculus
ctccgtgatgtcaggctttcctgtt

SEQ ID NO: 406498 - DNA, 25 bp, Mus musculus
tttgtgcttgtgagcgcactctccc

SEQ ID NO: 406499 - DNA, 25 bp, Mus musculus
ctttcctgtttgtgcttgtgagcgc

SEQ ID NO: 406500 - DNA, 25 bp, Mus musculus
ggaccgcagaaaagcgtttctatgg

SEQ ID NO: 406501 - DNA, 25 bp, Mus musculus
tttctatgggaacgtcccgggcatc

SEQ ID NO: 406502 - DNA, 25 bp, Mus musculus
acggcaatatccttacgctcgcggc

SEQ ID NO: 406503 - DNA, 25 bp, Mus musculus
tggactcgtgcctacggcaatatcc

SEQ ID NO: 406504 - DNA, 25 bp, Mus musculus
actaggttctgcagccagtccatcg

SEQ ID NO: 406505 - DNA, 25 bp, Mus musculus
cgctagcgcgcaggcccagaagctt

SEQ ID NO: 406506 - DNA, 25 bp, Mus musculus
cccgcaaggcaggaccgcagaaaag

SEQ ID NO: 406507 - DNA, 25 bp, Mus musculus
acgtcccgggcatcacgtgatgctc

SEQ ID NO: 406508 - DNA, 25 bp, Mus musculus
ccagaagcttgcaagccgcggctgc

SEQ ID NO: 406509 - DNA, 25 bp, Mus musculus
accgctggtgtcctagtgggcacct

SEQ ID NO: 406510 - DNA, 25 bp, Mus musculus
ctgcagactgcaggggactaggttc

SEQ ID NO: 406511 - DNA, 25 bp, Mus musculus
tagttccgagctgggcatcactttg

SEQ ID NO: 406512 - DNA, 25 bp, Mus musculus
cgattcctcaggtgcgcggtcctaa

SEQ ID NO: 406513 - DNA, 25 bp, Mus musculus
ctttgcctcatactcctgcagactg

SEQ ID NO: 406514 - DNA, 25 bp, Mus musculus
gactcctcctcgcttggcgcggggt

SEQ ID NO: 406515 - DNA, 25 bp, Mus musculus
gacagggtgaccctcccgtagagaa

SEQ ID NO: 406516 - DNA, 25 bp, Mus musculus
gctcaccggagatactgcgcgctct

SEQ ID NO: 406517 - DNA, 25 bp, Mus musculus
aagcctccgtgggtctctcaggctc

SEQ ID NO: 406518 - DNA, 25 bp, Mus musculus
actgccgtgtgtagacagggtgacc

SEQ ID NO: 406519 - DNA, 25 bp, Mus musculus
aaggaagtcgggttcgctctcgcga

SEQ ID NO: 406520 - DNA, 25 bp, Mus musculus
tcgcgagacttcagcagcgccggtc

SEQ ID NO: 406521 - DNA, 25 bp, Mus musculus
tctgggtgctttccgccgctctgta

SEQ ID NO: 406522 - DNA, 25 bp, Mus musculus
ctctgtagcgctccctcttgggatc

SEQ ID NO: 406523 - DNA, 25 bp, Mus musculus
accgcggacatcgagcccagagcag

SEQ ID NO: 406524 - DNA, 25 bp, Mus musculus
caggccgctgccatggaaactggag

SEQ ID NO: 406525 - DNA, 25 bp, Mus musculus
aggctgtggttgtattgtcatagta

SEQ ID NO: 406526 - DNA, 25 bp, Mus musculus
atactgcgcgctctgcaggctcatc

SEQ ID NO: 406527 - DNA, 25 bp, Mus musculus
attgtcatagtaactgccgtgtgta

SEQ ID NO: 406528 - DNA, 25 bp, Mus musculus
agacccacgttatcctgctggcctg

SEQ ID NO: 406529 - DNA, 25 bp, Mus musculus
tgcggcagcttcaatcccatcacta

SEQ ID NO: 406530 - DNA, 25 bp, Mus musculus
cattcagatgttcggtgagtcctcc

SEQ ID NO: 406531 - DNA, 25 bp, Mus musculus
cagggctttccaaggcgattgagca

SEQ ID NO: 406532 - DNA, 25 bp, Mus musculus
cgagccgacgcaaactgcgtttttt

SEQ ID NO: 406533 - DNA, 25 bp, Mus musculus
tttccaggcttctctagcgtggggc

SEQ ID NO: 406534 - DNA, 25 bp, Mus musculus
tgtgcctcggagacacaaacactcg

SEQ ID NO: 406535 - DNA, 25 bp, Mus musculus
tcgcacacgacacaccagtggcagg

SEQ ID NO: 406536 - DNA, 25 bp, Mus musculus
tggggcttcaaggagactaatactg

SEQ ID NO: 406537 - DNA, 25 bp, Mus musculus
gagattgtagctttggtggcccaga

SEQ ID NO: 406538 - DNA, 25 bp, Mus musculus
cccagagcggtggatgttggctaat

SEQ ID NO: 406539 - DNA, 25 bp, Mus musculus
cccaagttggccaaggttctgccca

SEQ ID NO: 406540 - DNA, 25 bp, Mus musculus
ggcggcgatgacaaccggcatcctt

SEQ ID NO: 406541 - DNA, 25 bp, Mus musculus
tactctcgccaatatcagggctttc

SEQ ID NO: 406542 - DNA, 25 bp, Mus musculus
gccgcgcttctcaccgtccctgtta

SEQ ID NO: 406543 - DNA, 25 bp, Mus musculus
gcttctcaccgtccctgttaccacc

SEQ ID NO: 406544 - DNA, 25 bp, Mus musculus
ctcctgtagccggacgtcttccagg

SEQ ID NO: 406545 - DNA, 25 bp, Mus musculus
cctgtagccggacgtcttccaggaa

SEQ ID NO: 406546 - DNA, 25 bp, Mus musculus
tgtagccggacgtcttccaggaact

SEQ ID NO: 406547 - DNA, 25 bp, Mus musculus
tagccggacgtcttccaggaactgg

SEQ ID NO: 406548 - DNA, 25 bp, Mus musculus
gccggacgtcttccaggaactggtc

SEQ ID NO: 406549 - DNA, 25 bp, Mus musculus
cggacgtcttccaggaactggtcga

SEQ ID NO: 406550 - DNA, 25 bp, Mus musculus
gacgtcttccaggaactggtcgacc

SEQ ID NO: 406551 - DNA, 25 bp, Mus musculus
cgtcttccaggaactggtcgacctc

SEQ ID NO: 406552 - DNA, 25 bp, Mus musculus
tcttccaggaactggtcgacctcta

SEQ ID NO: 406553 - DNA, 25 bp, Mus musculus
tccaggaactggtcgacctctaacc

SEQ ID NO: 406554 - DNA, 25 bp, Mus musculus
cctcagagcgggatccaccgaggtc

SEQ ID NO: 406555 - DNA, 25 bp, Mus musculus
ctcagagcgggatccaccgaggtcg

SEQ ID NO: 406556 - DNA, 25 bp, Mus musculus
tgacaccgccttggcgccaaaactt

SEQ ID NO: 406557 - DNA, 25 bp, Mus musculus
gcgtgacaccgccttggcgccaaaa

SEQ ID NO: 406558 - DNA, 25 bp, Mus musculus
ccaaacagtccggaaacgcgtgaca

SEQ ID NO: 406559 - DNA, 25 bp, Mus musculus
gaaatcgccggccaccaaacagtcc

SEQ ID NO: 406560 - DNA, 25 bp, Mus musculus
catgtcgcagctccgaaatcgccgg

SEQ ID NO: 406561 - DNA, 25 bp, Mus musculus
tccagcactactgtgcccgccatgt

SEQ ID NO: 406562 - DNA, 25 bp, Mus musculus
gcgcttcccgcagctccacatcatc

SEQ ID NO: 406563 - DNA, 25 bp, Mus musculus
aagtagtctctctgcgcttcccgca

SEQ ID NO: 406564 - DNA, 25 bp, Mus musculus
aggaagtccaagtagtctctctgcg

SEQ ID NO: 406565 - DNA, 25 bp, Mus musculus
tcatccaggaagtccaagtagtctc

SEQ ID NO: 406566 - DNA, 25 bp, Mus musculus
cctcgtcatccaggaagtccaagta

SEQ ID NO: 406567 - DNA, 25 bp, Mus musculus
gagcctcacctcgtcatccaggaag

SEQ ID NO: 406568 - DNA, 25 bp, Mus musculus
cccatcagccgtgcccggtcacccg

SEQ ID NO: 406569 - DNA, 25 bp, Mus musculus
tccggaaacgcgtgacaccgccttg

SEQ ID NO: 406570 - DNA, 25 bp, Mus musculus
agcagctgagccagagcgcaggcat

SEQ ID NO: 406571 - DNA, 25 bp, Mus musculus
gtgttttatcgactcttctccctga

SEQ ID NO: 406572 - DNA, 25 bp, Mus musculus
aaggcagcagctgagccagagcgca

SEQ ID NO: 406573 - DNA, 25 bp, Mus musculus
cactcagcgcatgccgagcagtaaa

SEQ ID NO: 406574 - DNA, 25 bp, Mus musculus
ccgagtcttcgctctgctgtgcctt

SEQ ID NO: 406575 - DNA, 25 bp, Mus musculus
tgctgtgccttccttttccctcgat

SEQ ID NO: 406576 - DNA, 25 bp, Mus musculus
tttccctcgatcaggtgttttatcg

SEQ ID NO: 406577 - DNA, 25 bp, Mus musculus
tgccgagcagtaaacccgctcgctg

SEQ ID NO: 406578 - DNA, 25 bp, Mus musculus
tcctgacaggaagagagccggtgtt

SEQ ID NO: 406579 - DNA, 25 bp, Mus musculus
cggggcgtgactcacctgtgaacaa

SEQ ID NO: 406580 - DNA, 25 bp, Mus musculus
ctcacctgtgaacaaggaggaccca

SEQ ID NO: 406581 - DNA, 25 bp, Mus musculus
aggaggacccaaccctccgaggcag

SEQ ID NO: 406582 - DNA, 25 bp, Mus musculus
tccgaggcagacaaacactcagcgc

SEQ ID NO: 406583 - DNA, 25 bp, Mus musculus
ttctccctgactcagtcctgacagg

SEQ ID NO: 406584 - DNA, 25 bp, Mus musculus
cgtcgcacaggtgacaggacttagt

SEQ ID NO: 406585 - DNA, 25 bp, Mus musculus
gggctgtcatcgcttacccaggtgc

SEQ ID NO: 406586 - DNA, 25 bp, Mus musculus
tacccaggtgcagcgtgaggttgat

SEQ ID NO: 406587 - DNA, 25 bp, Mus musculus
atctggcggtggagaaaacccaagg

SEQ ID NO: 406588 - DNA, 25 bp, Mus musculus
ttgtagtcggtcaggaaggctgccc

SEQ ID NO: 406589 - DNA, 25 bp, Mus musculus
caggacttagtgactccggtcaccc

SEQ ID NO: 406590 - DNA, 25 bp, Mus musculus
agtctgcacgcagtactcctcgggc

SEQ ID NO: 406591 - DNA, 25 bp, Mus musculus
gttggtagccaccacggtcacattg

SEQ ID NO: 406592 - DNA, 25 bp, Mus musculus
cacggtcacattgaaggcggcatta

SEQ ID NO: 406593 - DNA, 25 bp, Mus musculus
ggcggcattaacaaactccggcatg

SEQ ID NO: 406594 - DNA, 25 bp, Mus musculus
acaaactccggcatgcagcgctgcg

SEQ ID NO: 406595 - DNA, 25 bp, Mus musculus
cctagcggcgtatcccgaggccgat

SEQ ID NO: 406596 - DNA, 25 bp, Mus musculus
cggagtcccacacgtgttggtagcc

SEQ ID NO: 406597 - DNA, 25 bp, Mus musculus
ccagcatagtctggctttgccacca

SEQ ID NO: 406598 - DNA, 25 bp, Mus musculus
gcgaggccgaaaagcacgaaaccta

SEQ ID NO: 406599 - DNA, 25 bp, Mus musculus
cgctaacgggacgatgcaaagtctg

SEQ ID NO: 406600 - DNA, 25 bp, Mus musculus
cagatgtactgctgtagtccgagga

SEQ ID NO: 406601 - DNA, 25 bp, Mus musculus
ggaagagctatactgcaccaagggc

SEQ ID NO: 406602 - DNA, 25 bp, Mus musculus
ccaagggctgaagtggtaactcacc

SEQ ID NO: 406603 - DNA, 25 bp, Mus musculus
ctcacccaggcaggtagttcccggt

SEQ ID NO: 406604 - DNA, 25 bp, Mus musculus
ttcccggtggctcatataaagcgtc

SEQ ID NO: 406605 - DNA, 25 bp, Mus musculus
atataaagcgtctctgcggtgatcc

SEQ ID NO: 406606 - DNA, 25 bp, Mus musculus
aggctccgttctttcccatcgcgga

SEQ ID NO: 406607 - DNA, 25 bp, Mus musculus
ggtgcgtcccagcacacaagcgcta

SEQ ID NO: 406608 - DNA, 25 bp, Mus musculus
gattccgtggaaggatccgctctgc

SEQ ID NO: 406609 - DNA, 25 bp, Mus musculus
acgaaacctacgctaagacccgctg

SEQ ID NO: 406610 - DNA, 25 bp, Mus musculus
gcccgaaggaagtcagcaccgccag

SEQ ID NO: 406611 - DNA, 25 bp, Mus musculus
gagcattctacacgcttggctggga

SEQ ID NO: 406612 - DNA, 25 bp, Mus musculus
cgcacaggctgcgtggtcccacgag

SEQ ID NO: 406613 - DNA, 25 bp, Mus musculus
ctctgtactgcgaccaggtgctaca

SEQ ID NO: 406614 - DNA, 25 bp, Mus musculus
agaaggtggctctgtactgcgacca

SEQ ID NO: 406615 - DNA, 25 bp, Mus musculus
cgcagcgagaaggtggctctgtact

SEQ ID NO: 406616 - DNA, 25 bp, Mus musculus
aaacatgtgacgaggagcccgtgcc

SEQ ID NO: 406617 - DNA, 25 bp, Mus musculus
ccaagccgaaacatgtgacgaggag

SEQ ID NO: 406618 - DNA, 25 bp, Mus musculus
gctccagctcccaccggtcacccaa

SEQ ID NO: 406619 - DNA, 25 bp, Mus musculus
cttagccaccctccgggactcggtg

SEQ ID NO: 406620 - DNA, 25 bp, Mus musculus
ggagcagactgtcttagccaccctc

SEQ ID NO: 406621 - DNA, 25 bp, Mus musculus
gctcgccagcggagcagactgtctt

SEQ ID NO: 406622 - DNA, 25 bp, Mus musculus
cccaaggcctcggtcgggagtgaca

SEQ ID NO: 406623 - DNA, 25 bp, Mus musculus
agtcggatgccacgacctcagagcc

SEQ ID NO: 406624 - DNA, 25 bp, Mus musculus
gcgcgaacatggagtcggatgccac

SEQ ID NO: 406625 - DNA, 25 bp, Mus musculus
accaggtgctacagggctcgaaggt

SEQ ID NO: 406626 - DNA, 25 bp, Mus musculus
accgttatctacagcggggctatcc

SEQ ID NO: 406627 - DNA, 25 bp, Mus musculus
ggcttgaaccacttccgggcgccaa

SEQ ID NO: 406628 - DNA, 25 bp, Mus musculus
ggctatcccgttgcgcggtgtaatt

SEQ ID NO: 406629 - DNA, 25 bp, Mus musculus
catgcattcattttcctaccacctg

SEQ ID NO: 406630 - DNA, 25 bp, Mus musculus
tgtcccggattagaaccgcggacga

SEQ ID NO: 406631 - DNA, 25 bp, Mus musculus
agcggccagtctgtgcaaggaaccc

SEQ ID NO: 406632 - DNA, 25 bp, Mus musculus
tttccgtgcccgagagcacagcctt

SEQ ID NO: 406633 - DNA, 25 bp, Mus musculus
agcacagccttcttaggcgagttcg

SEQ ID NO: 406634 - DNA, 25 bp, Mus musculus
taggcgagttcgcagcgccaacctt

SEQ ID NO: 406635 - DNA, 25 bp, Mus musculus
cttccacgagaacggcgaaagaaca

SEQ ID NO: 406636 - DNA, 25 bp, Mus musculus
gaaagaacacacctcacccgcatgg

SEQ ID NO: 406637 - DNA, 25 bp, Mus musculus
cccgcatggaagcagcggcgaaatg

SEQ ID NO: 406638 - DNA, 25 bp, Mus musculus
cgcggtgtaattccgccatcactta

SEQ ID NO: 406639 - DNA, 25 bp, Mus musculus
cggcgaaatggctccgactgcagga

SEQ ID NO: 406640 - DNA, 25 bp, Mus musculus
gctacgcgggtctgcaaagaatccc

SEQ ID NO: 406641 - DNA, 25 bp, Mus musculus
gtcccaaagctaccctgcccagcgt

SEQ ID NO: 406642 - DNA, 25 bp, Mus musculus
tgcccagcgtacctgacttcactcc

SEQ ID NO: 406643 - DNA, 25 bp, Mus musculus
ttcactcctctgctcggtggcgccg

SEQ ID NO: 406644 - DNA, 25 bp, Mus musculus
cacctaggctgctgtgcactggaga

SEQ ID NO: 406645 - DNA, 25 bp, Mus musculus
caggctacgcgggtctgcaaagaat

SEQ ID NO: 406646 - DNA, 25 bp, Mus musculus
tgtgcactggagacgcgatctcctc

SEQ ID NO: 406647 - DNA, 25 bp, Mus musculus
gagacgcgatctcctctgagcagcg

SEQ ID NO: 406648 - DNA, 25 bp, Mus musculus
ctgagcagcgcggttgcgcttttaa

SEQ ID NO: 406649 - DNA, 25 bp, Mus musculus
gcgcggttgcgcttttaactcaggg

SEQ ID NO: 406650 - DNA, 25 bp, Mus musculus
tgcgcttttaactcaggggctgcgg

SEQ ID NO: 406651 - DNA, 25 bp, Mus musculus
ggagctgcttcaccggctggaatcc

SEQ ID NO: 406652 - DNA, 25 bp, Mus musculus
cgctcacctaggctgctgtgcactg

SEQ ID NO: 406653 - DNA, 25 bp, Mus musculus
agggtcgccctcagtcccaaagcta

SEQ ID NO: 406654 - DNA, 25 bp, Mus musculus
gcagagtgtctgaacagcacgctca

SEQ ID NO: 406655 - DNA, 25 bp, Mus musculus
tggagattctcggtcctcagagtcc

SEQ ID NO: 406656 - DNA, 25 bp, Mus musculus
ctgttctatacttgcggccggaggc

SEQ ID NO: 406657 - DNA, 25 bp, Mus musculus
aggcgccttgatcctctcttcctgg

SEQ ID NO: 406658 - DNA, 25 bp, Mus musculus
cggctctgcttggtgttcctaggac

SEQ ID NO: 406659 - DNA, 25 bp, Mus musculus
gccaccgctctggtaagcgcacgga

SEQ ID NO: 406660 - DNA, 25 bp, Mus musculus
ccggacattttagtgggaaggctgc

SEQ ID NO: 406661 - DNA, 25 bp, Mus musculus
ccagcgaccctgcagagcggagaat

SEQ ID NO: 406662 - DNA, 25 bp, Mus musculus
gcgggttgttttgatctgttctata

SEQ ID NO: 406663 - DNA, 25 bp, Mus musculus
aggctgctttcaaagtggattgccc

SEQ ID NO: 406664 - DNA, 25 bp, Mus musculus
gtcctaagcgttgatggcaccactc

SEQ ID NO: 406665 - DNA, 25 bp, Mus musculus
cgccgtgtcctaggcctttaccata

SEQ ID NO: 406666 - DNA, 25 bp, Mus musculus
cgcggcaccgactttccggacattt

SEQ ID NO: 406667 - DNA, 25 bp, Mus musculus
ctgtggggtcgcactctacttccca

SEQ ID NO: 406668 - DNA, 25 bp, Mus musculus
ggattccacgaaacctccaacatca

SEQ ID NO: 406669 - DNA, 25 bp, Mus musculus
ttgccaaccgcggtgccagtatccg

SEQ ID NO: 406670 - DNA, 25 bp, Mus musculus
ttttctgccggtgttgccaaccgcg

SEQ ID NO: 406671 - DNA, 25 bp, Mus musculus
aaccgcggtgccagtatccgcattc

SEQ ID NO: 406672 - DNA, 25 bp, Mus musculus
gtccgcacgtgtctcctcaacgaaa

SEQ ID NO: 406673 - DNA, 25 bp, Mus musculus
cggccaggagaagaagggctacttt

SEQ ID NO: 406674 - DNA, 25 bp, Mus musculus
ccggcgtctgactggattccacgaa

SEQ ID NO: 406675 - DNA, 25 bp, Mus musculus
acaacgcccggcgtctgactggatt

SEQ ID NO: 406676 - DNA, 25 bp, Mus musculus
aacgacttttctgccggtgttgcca

SEQ ID NO: 406677 - DNA, 25 bp, Mus musculus
gctactttgaagaccgtcggccttc

SEQ ID NO: 406678 - DNA, 25 bp, Mus musculus
accgtcggccttctgccaattgtga

SEQ ID NO: 406679 - DNA, 25 bp, Mus musculus
tgacagaagccatcgtccgcacgtg

SEQ ID NO: 406680 - DNA, 25 bp, Mus musculus
tgtctcctcaacgaaacaggcgacg

SEQ ID NO: 406681 - DNA, 25 bp, Mus musculus
acctccaacatcaacgacttttctg

SEQ ID NO: 406682 - DNA, 25 bp, Mus musculus
taacctgcaggagcaccagacgctg

SEQ ID NO: 406683 - DNA, 25 bp, Mus musculus
agcgacaccagcagatccattcagg

SEQ ID NO: 406684 - DNA, 25 bp, Mus musculus
ccattcaggggacaaggacttcctc

SEQ ID NO: 406685 - DNA, 25 bp, Mus musculus
ttccttgtgctgaatgcggccaggc

SEQ ID NO: 406686 - DNA, 25 bp, Mus musculus
ctggcgagaggccatttccttgtgc

SEQ ID NO: 406687 - DNA, 25 bp, Mus musculus
ccgactgcggtgtaaccttcgcgca

SEQ ID NO: 406688 - DNA, 25 bp, Mus musculus
aggcccttcaaatgcaccgactgcg

SEQ ID NO: 406689 - DNA, 25 bp, Mus musculus
cagcaatgacaagcccttcccgtgt

SEQ ID NO: 406690 - DNA, 25 bp, Mus musculus
aaaccctatgggtgcccggactgcg

SEQ ID NO: 406691 - DNA, 25 bp, Mus musculus
agcatatccgcactcacacgggcga

SEQ ID NO: 406692 - DNA, 25 bp, Mus musculus
tggtcctccgatcaccgcaagcata

SEQ ID NO: 406693 - DNA, 25 bp, Mus musculus
acaaggcgtacacctggtcctccga

SEQ ID NO: 406694 - DNA, 25 bp, Mus musculus
cagtgcggcttgaccttcaacaggc

SEQ ID NO: 406695 - DNA, 25 bp, Mus musculus
ggtgtcccttctgcgacaaggcgta

SEQ ID NO: 406696 - DNA, 25 bp, Mus musculus
aagaagttgtcgaagccggccaccg

SEQ ID NO: 406697 - DNA, 25 bp, Mus musculus
ttggcctcgagcagggcgcactgct

SEQ ID NO: 406698 - DNA, 25 bp, Mus musculus
tcgtcggaggcattggcctcgagca

SEQ ID NO: 406699 - DNA, 25 bp, Mus musculus
tgcccacctcgtcggaggcattggc

SEQ ID NO: 406700 - DNA, 25 bp, Mus musculus
tcgtgggccttgatgatgtcccgct

SEQ ID NO: 406701 - DNA, 25 bp, Mus musculus
cgcggggaagcaggcaacatgccca

SEQ ID NO: 406702 - DNA, 25 bp, Mus musculus
tcatcaggcagagccaggacgtggc

SEQ ID NO: 406703 - DNA, 25 bp, Mus musculus
tcgggcagccttcggcctgggctca

SEQ ID NO: 406704 - DNA, 25 bp, Mus musculus
caccgggaagaagttgtcgaagccg

SEQ ID NO: 406705 - DNA, 25 bp, Mus musculus
agcctgcatccagcgtggtgctgcc

SEQ ID NO: 406706 - DNA, 25 bp, Mus musculus
tgcatcttgtgtgcctcgtgggcct

SEQ ID NO: 406707 - DNA, 25 bp, Mus musculus
cttcatgacctctgggctcacagga

SEQ ID NO: 406708 - DNA, 25 bp, Mus musculus
gggccttgatgatgtcccgctgctc

SEQ ID NO: 406709 - DNA, 25 bp, Mus musculus
aggcaacatgcccacctcgtcggag

SEQ ID NO: 406710 - DNA, 25 bp, Mus musculus
ggctcaaactccgaccgcggcagga

SEQ ID NO: 406711 - DNA, 25 bp, Mus musculus
cgttcccatggcgaccaggcagcga

SEQ ID NO: 406712 - DNA, 25 bp, Mus musculus
cagcgggaacctcttgcccgcgggg

SEQ ID NO: 406713 - DNA, 25 bp, Mus musculus
agcgctccggtaaccctggcaacgg

SEQ ID NO: 406714 - DNA, 25 bp, Mus musculus
ttcccatggcgaccaggcagcgact

SEQ ID NO: 406715 - DNA, 25 bp, Mus musculus
gttggaaataactgcgccgttccca

SEQ ID NO: 406716 - DNA, 25 bp, Mus musculus
ctggcagcgcgccactggcacggcc

SEQ ID NO: 406717 - DNA, 25 bp, Mus musculus
gcaataccctcgcaccctggcagcg

SEQ ID NO: 406718 - DNA, 25 bp, Mus musculus
gattgccgctgtcctgcaataccct

SEQ ID NO: 406719 - DNA, 25 bp, Mus musculus
agcagattgccgctgtcctgcaata

SEQ ID NO: 406720 - DNA, 25 bp, Mus musculus
ggccgcagcagattgccgctgtcct

SEQ ID NO: 406721 - DNA, 25 bp, Mus musculus
gggcgcattgttacgccctcggccg

SEQ ID NO: 406722 - DNA, 25 bp, Mus musculus
ccagaaggggcgcattgttacgccc

SEQ ID NO: 406723 - DNA, 25 bp, Mus musculus
cagagcgctccggtaaccctggcaa

SEQ ID NO: 406724 - DNA, 25 bp, Mus musculus
cggcgtcagtcaacttcctcggctg

SEQ ID NO: 406725 - DNA, 25 bp, Mus musculus
cagtcaacttcctcggctgggctgc

SEQ ID NO: 406726 - DNA, 25 bp, Mus musculus
tggctgtagcagcagagtgtgcacc

SEQ ID NO: 406727 - DNA, 25 bp, Mus musculus
tgggcgtcgccatccgggttgtccc

SEQ ID NO: 406728 - DNA, 25 bp, Mus musculus
tcggggaggctcagaaagagctctc

SEQ ID NO: 406729 - DNA, 25 bp, Mus musculus
agggtgcaggtctccactgagatgc

SEQ ID NO: 406730 - DNA, 25 bp, Mus musculus
tggtgttcgtaagtcccgactgtgg

SEQ ID NO: 406731 - DNA, 25 bp, Mus musculus
gtctccactgagatgctggggagtc

SEQ ID NO: 406732 - DNA, 25 bp, Mus musculus
gcgctggtgttcgtaagtcccgact

SEQ ID NO: 406733 - DNA, 25 bp, Mus musculus
gaggctcagaaagagctctcccgga

SEQ ID NO: 406734 - DNA, 25 bp, Mus musculus
atttcggcgtagaggagcgcctgac

SEQ ID NO: 406735 - DNA, 25 bp, Mus musculus
atgctggggagtctctgccagagcc

SEQ ID NO: 406736 - DNA, 25 bp, Mus musculus
agctcggccgcgctggtgttcgtaa

SEQ ID NO: 406737 - DNA, 25 bp, Mus musculus
cagaaagagctctcccggagctgga

SEQ ID NO: 406738 - DNA, 25 bp, Mus musculus
gatcaggtcttcctctgtggttgta

SEQ ID NO: 406739 - DNA, 25 bp, Mus musculus
ggtgaacgcctgcttgccttctgaa

SEQ ID NO: 406740 - DNA, 25 bp, Mus musculus
ttccagacgatagggtgaacgcctg

SEQ ID NO: 406741 - DNA, 25 bp, Mus musculus
atcctgccttcgcttccagacgata

SEQ ID NO: 406742 - DNA, 25 bp, Mus musculus
tgacgatgcggtgagcctccagctt

SEQ ID NO: 406743 - DNA, 25 bp, Mus musculus
atcttgcccagggagatgctgacga

SEQ ID NO: 406744 - DNA, 25 bp, Mus musculus
agcaccggcttgtcgcagcagatct

SEQ ID NO: 406745 - DNA, 25 bp, Mus musculus
tttccgtaggagtcccgagaagcta

SEQ ID NO: 406746 - DNA, 25 bp, Mus musculus
tcccgagaagctagacccgaagatg

SEQ ID NO: 406747 - DNA, 25 bp, Mus musculus
atgctgatgaggtttgccacgttcc

SEQ ID NO: 406748 - DNA, 25 bp, Mus musculus
tgactggctgctcctccgagttccg

SEQ ID NO: 406749 - DNA, 25 bp, Mus musculus
cagcaccaacgacaccaagaggttc

SEQ ID NO: 406750 - DNA, 25 bp, Mus musculus
acccgcgagttgtagatcttgccca

SEQ ID NO: 406751 - DNA, 25 bp, Mus musculus
gctcatgtctctcagcaccggcttg

SEQ ID NO: 406752 - DNA, 25 bp, Mus musculus
cgtcaggttctacgcagtggtaccc

SEQ ID NO: 406753 - DNA, 25 bp, Mus musculus
tctgtaacttaacctcgggcgcaca

SEQ ID NO: 406754 - DNA, 25 bp, Mus musculus
gcgctgtgaacgcaccaactctgta

SEQ ID NO: 406755 - DNA, 25 bp, Mus musculus
cccaaaacgtaggagtggcgctgtg

SEQ ID NO: 406756 - DNA, 25 bp, Mus musculus
ccggaactccgctcagcgtcaggtt

SEQ ID NO: 406757 - DNA, 25 bp, Mus musculus
tcaccatggtaacaggactccgccg

SEQ ID NO: 406758 - DNA, 25 bp, Mus musculus
ggaagctcccaacaagccttgcgca

SEQ ID NO: 406759 - DNA, 25 bp, Mus musculus
ctatggtccaacttgcgtgctagta

SEQ ID NO: 406760 - DNA, 25 bp, Mus musculus
agacgctctagctaccagacccgga

SEQ ID NO: 406761 - DNA, 25 bp, Mus musculus
gccggtcctctagcttcgacaaaga

SEQ ID NO: 406762 - DNA, 25 bp, Mus musculus
gtcagtgagaaaaggggctctgtcc

SEQ ID NO: 406763 - DNA, 25 bp, Mus musculus
tccctggaagtcttctggcttggcc

SEQ ID NO: 406764 - DNA, 25 bp, Mus musculus
cagacccggaaacacactctatggt

SEQ ID NO: 406765 - DNA, 25 bp, Mus musculus
caccctagagttcacgaaaagtcct

SEQ ID NO: 406766 - DNA, 25 bp, Mus musculus
tctcgggcctagtgacgcaagctag

SEQ ID NO: 406767 - DNA, 25 bp, Mus musculus
ggccgacagcatctgggcaggaaaa

SEQ ID NO: 406768 - DNA, 25 bp, Mus musculus
tgtgctcggacaccgcgcgtcgttt

SEQ ID NO: 406769 - DNA, 25 bp, Mus musculus
gcgacacagcctctgtgctcggaca

SEQ ID NO: 406770 - DNA, 25 bp, Mus musculus
ccttctttgtagtgaaggggtgagt

SEQ ID NO: 406771 - DNA, 25 bp, Mus musculus
ccgggcgccatgtccatggaggacc

SEQ ID NO: 406772 - DNA, 25 bp, Mus musculus
ccacggtagacctcagggagggctc

SEQ ID NO: 406773 - DNA, 25 bp, Mus musculus
gtctgcgcgcactgctgctccgggt

SEQ ID NO: 406774 - DNA, 25 bp, Mus musculus
cgctgaccgactgctggaccgacgg

SEQ ID NO: 406775 - DNA, 25 bp, Mus musculus
ccatgattggtagtggcgaaggttc

SEQ ID NO: 406776 - DNA, 25 bp, Mus musculus
tgcggtacgcgtccatgattggtag

SEQ ID NO: 406777 - DNA, 25 bp, Mus musculus
cgatctgggtcacgtgagcctgagt

SEQ ID NO: 406778 - DNA, 25 bp, Mus musculus
tagtgacgcaagctaggctccgccc

SEQ ID NO: 406779 - DNA, 25 bp, Mus musculus
tccattgtggagtcgtggagctagc

SEQ ID NO: 406780 - DNA, 25 bp, Mus musculus
ccggagcgcaaaaggcgacaagctt

SEQ ID NO: 406781 - DNA, 25 bp, Mus musculus
aaaggcgacaagcttcagccgactc

SEQ ID NO: 406782 - DNA, 25 bp, Mus musculus
cgggtcctctcggtactcactgaga

SEQ ID NO: 406783 - DNA, 25 bp, Mus musculus
gcctggagccgtagcgaccgctact

SEQ ID NO: 406784 - DNA, 25 bp, Mus musculus
gaccgctacttcatagctttgcttg

SEQ ID NO: 406785 - DNA, 25 bp, Mus musculus
tagctttgcttgaaggtgaaaggcc

SEQ ID NO: 406786 - DNA, 25 bp, Mus musculus
aggtgaaaggcccagccagcggcct

SEQ ID NO: 406787 - DNA, 25 bp, Mus musculus
actcctggagccagggccgcctaga

SEQ ID NO: 406788 - DNA, 25 bp, Mus musculus
cctagacggccggaggatgcgccct

SEQ ID NO: 406789 - DNA, 25 bp, Mus musculus
tgcgccctgaatttggggctcactg

SEQ ID NO: 406790 - DNA, 25 bp, Mus musculus
tcggtactcactgagagcggcgcgc

SEQ ID NO: 406791 - DNA, 25 bp, Mus musculus
caccggctccgctggagcgagaagc

SEQ ID NO: 406792 - DNA, 25 bp, Mus musculus
cgagaagctgaggaccggactttgt

SEQ ID NO: 406793 - DNA, 25 bp, Mus musculus
cggactttgtgtggagaacgtttcg

SEQ ID NO: 406794 - DNA, 25 bp, Mus musculus
atggtaaccgcctacgccgctccga

SEQ ID NO: 406795 - DNA, 25 bp, Mus musculus
gcgctgcgcgaagctgcgcttctct

SEQ ID NO: 406796 - DNA, 25 bp, Mus musculus
gccctctagacgtcatcgccatggt

SEQ ID NO: 406797 - DNA, 25 bp, Mus musculus
tcaggggctttccttcttgctccgc

SEQ ID NO: 406798 - DNA, 25 bp, Mus musculus
tctagacgtcatcgccatggtaacc

SEQ ID NO: 406799 - DNA, 25 bp, Mus musculus
gccgccgcctgcatatccgttaccc

SEQ ID NO: 406800 - DNA, 25 bp, Mus musculus
ggcggcaacagcgactccgactcct

SEQ ID NO: 406801 - DNA, 25 bp, Mus musculus
aggtgctcggcgaacttcatcctgc

SEQ ID NO: 406802 - DNA, 25 bp, Mus musculus
tcctccactcgggagtgatgtgcgc

SEQ ID NO: 406803 - DNA, 25 bp, Mus musculus
gatgtactgcttcctccactcggga

SEQ ID NO: 406804 - DNA, 25 bp, Mus musculus
catactggatgtactgcttcctcca

SEQ ID NO: 406805 - DNA, 25 bp, Mus musculus
cccaggtacctcatactggatgtac

SEQ ID NO: 406806 - DNA, 25 bp, Mus musculus
gtcgcagctagggagatgacagccc

SEQ ID NO: 406807 - DNA, 25 bp, Mus musculus
ggcctcaggggctttccttcttgct

SEQ ID NO: 406808 - DNA, 25 bp, Mus musculus
accggccacagcgagctagtgaaca

SEQ ID NO: 406809 - DNA, 25 bp, Mus musculus
tttggccgagctgtttgagaaggct

SEQ ID NO: 406810 - DNA, 25 bp, Mus musculus
taggcggagtggcagaatcacctga

SEQ ID NO: 406811 - DNA, 25 bp, Mus musculus
ggcagaatcacctgagaccgccaga

SEQ ID NO: 406812 - DNA, 25 bp, Mus musculus
tgagaccgccagacagctcactgcg

SEQ ID NO: 406813 - DNA, 25 bp, Mus musculus
tccgcacccggaccggtggatcagg

SEQ ID NO: 406814 - DNA, 25 bp, Mus musculus
gcgagctagtgaacatggccacacc

SEQ ID NO: 406815 - DNA, 25 bp, Mus musculus
agtgaacatggccacaccgttccta

SEQ ID NO: 406816 - DNA, 25 bp, Mus musculus
gggacgactctggtgatatggaatc

SEQ ID NO: 406817 - DNA, 25 bp, Mus musculus
tccggagtttgtgactccgaagtcc

SEQ ID NO: 406818 - DNA, 25 bp, Mus musculus
ggtgatatggaatccttccagaccc

SEQ ID NO: 406819 - DNA, 25 bp, Mus musculus
ggtgagttccggagtttgtgactcc

SEQ ID NO: 406820 - DNA, 25 bp, Mus musculus
agctgtttgagaaggctgccgcaca

SEQ ID NO: 406821 - DNA, 25 bp, Mus musculus
tgtctgtcaccgaggcccgtatctc

SEQ ID NO: 406822 - DNA, 25 bp, Mus musculus
tcagtcctggccgaagctcagaaac

SEQ ID NO: 406823 - DNA, 25 bp, Mus musculus
aggtcaaacgggtcacgctcccaga

SEQ ID NO: 406824 - DNA, 25 bp, Mus musculus
ttgcaagagcgcgaaaaggaatccc

SEQ ID NO: 406825 - DNA, 25 bp, Mus musculus
cacacacttgtacaggagcacgcta

SEQ ID NO: 406826 - DNA, 25 bp, Mus musculus
tggcacctgcctacatcggcgactg

SEQ ID NO: 406827 - DNA, 25 bp, Mus musculus
atcctgaaggactatcgcgctggca

SEQ ID NO: 406828 - DNA, 25 bp, Mus musculus
gctcggccaccgcagttagatcaga

SEQ ID NO: 406829 - DNA, 25 bp, Mus musculus
tcggtccaccgagagtctttatttg

SEQ ID NO: 406830 - DNA, 25 bp, Mus musculus
tcctcaacaagggagccgagattcg

SEQ ID NO: 406831 - DNA, 25 bp, Mus musculus
ccgcctccttgctaggggaagaagc

SEQ ID NO: 406832 - DNA, 25 bp, Mus musculus
cttccaagaggcgaacagcgttttc

SEQ ID NO: 406833 - DNA, 25 bp, Mus musculus
ggcgccactcttcgcttcggtcttt

SEQ ID NO: 406834 - DNA, 25 bp, Mus musculus
aggtcgcagcacagcctctttggca

SEQ ID NO: 406835 - DNA, 25 bp, Mus musculus
agcaccaaattagagccggattccc

SEQ ID NO: 406836 - DNA, 25 bp, Mus musculus
gggtgtcttacgttgcatcggcaca

SEQ ID NO: 406837 - DNA, 25 bp, Mus musculus
ggcagcaagtcgcagtctaccgaga

SEQ ID NO: 406838 - DNA, 25 bp, Mus musculus
cgctctgcatcatcttggagccaga

SEQ ID NO: 406839 - DNA, 25 bp, Mus musculus
gttcagagcttctccagcccacgga

SEQ ID NO: 406840 - DNA, 25 bp, Mus musculus
atcggcacaccgagcatctccggga

SEQ ID NO: 406841 - DNA, 25 bp, Mus musculus
acccgctgaggctgttagctgtctt

SEQ ID NO: 406842 - DNA, 25 bp, Mus musculus
ccctctggctggattcggaaatttg

SEQ ID NO: 406843 - DNA, 25 bp, Mus musculus
accaggccgctgaagtcacagagga

SEQ ID NO: 406844 - DNA, 25 bp, Mus musculus
ccgccagtcctcaggctgtttcaaa

SEQ ID NO: 406845 - DNA, 25 bp, Mus musculus
cacatcccgggttgaggagacactg

SEQ ID NO: 406846 - DNA, 25 bp, Mus musculus
ggagacactgttgctgcagctctgg

SEQ ID NO: 406847 - DNA, 25 bp, Mus musculus
ccgcggtcacccaggcattttgatt

SEQ ID NO: 406848 - DNA, 25 bp, Mus musculus
attcattcacactgcaggagcggcc

SEQ ID NO: 406849 - DNA, 25 bp, Mus musculus
agcatcggtcctctaggatcaagga

SEQ ID NO: 406850 - DNA, 25 bp, Mus musculus
gcggcttgaatgtccacctccttca

SEQ ID NO: 406851 - DNA, 25 bp, Mus musculus
gtcggggaaggcctccacttctcac

SEQ ID NO: 406852 - DNA, 25 bp, Mus musculus
tttcacgtcgttagcaagctccttc

SEQ ID NO: 406853 - DNA, 25 bp, Mus musculus
caagctccttccacgtcggggcgaa

SEQ ID NO: 406854 - DNA, 25 bp, Mus musculus
cagtggccacaccaggaggcgaaga

SEQ ID NO: 406855 - DNA, 25 bp, Mus musculus
cagtgggacgcaccgaatcagcatc

SEQ ID NO: 406856 - DNA, 25 bp, Mus musculus
tatcctacggaagcggagtccgttg

SEQ ID NO: 406857 - DNA, 25 bp, Mus musculus
aatcagcatccagcagcgtcagcgg

SEQ ID NO: 406858 - DNA, 25 bp, Mus musculus
ctccgagctgggtccggaaacgagt

SEQ ID NO: 406859 - DNA, 25 bp, Mus musculus
acctcctcatcctaggcggcttgaa

SEQ ID NO: 406860 - DNA, 25 bp, Mus musculus
acctccttcaagtttgtgactagtc

SEQ ID NO: 406861 - DNA, 25 bp, Mus musculus
tgactagtcagtatccggagcctgc

SEQ ID NO: 406862 - DNA, 25 bp, Mus musculus
cctcaggccgcactcgaggtcgttg

SEQ ID NO: 406863 - DNA, 25 bp, Mus musculus
tcagaggacgagtagagcactgaga

SEQ ID NO: 406864 - DNA, 25 bp, Mus musculus
agcggcggcccagtcgccattacag

SEQ ID NO: 406865 - DNA, 25 bp, Mus musculus
cggatcggagtaaccgcagctttgc

SEQ ID NO: 406866 - DNA, 25 bp, Mus musculus
gaatcgtcactctaggcggatcgga

SEQ ID NO: 406867 - DNA, 25 bp, Mus musculus
ggacccggcagacgattcagaagga

SEQ ID NO: 406868 - DNA, 25 bp, Mus musculus
cttgacaagggtgacccagggatcc

SEQ ID NO: 406869 - DNA, 25 bp, Mus musculus
cgagccaaaacacgctgaggacttg

SEQ ID NO: 406870 - DNA, 25 bp, Mus musculus
agccagagtctatccgcagaggaga

SEQ ID NO: 406871 - DNA, 25 bp, Mus musculus
ccaaacctcgcgagaactgtccgga

SEQ ID NO: 406872 - DNA, 25 bp, Mus musculus
cctttgacgctaattgggccttctg

SEQ ID NO: 406873 - DNA, 25 bp, Mus musculus
gggagagagactcgccaaacctcgc

SEQ ID NO: 406874 - DNA, 25 bp, Mus musculus
tacagctcaacaactgacacggagg

SEQ ID NO: 406875 - DNA, 25 bp, Mus musculus
ttccgcaggaatgcaaccctgggtg

SEQ ID NO: 406876 - DNA, 25 bp, Mus musculus
aagccatctttggtgtggcgctttg

SEQ ID NO: 406877 - DNA, 25 bp, Mus musculus
tgggaccgcggacagagacatccga

SEQ ID NO: 406878 - DNA, 25 bp, Mus musculus
ctgctgtgagtgctgctcaaggcga

SEQ ID NO: 406879 - DNA, 25 bp, Mus musculus
gattggccgcagatagattccgctg

SEQ ID NO: 406880 - DNA, 25 bp, Mus musculus
cccgccatagttgtttacgtagctg

SEQ ID NO: 406881 - DNA, 25 bp, Mus musculus
gcgcgtcactgctgtcgccatttcg

SEQ ID NO: 406882 - DNA, 25 bp, Mus musculus
ggggctcgaagtcgccgtacacttc

SEQ ID NO: 406883 - DNA, 25 bp, Mus musculus
cgaaggttgtaagcgctttctctca

SEQ ID NO: 406884 - DNA, 25 bp, Mus musculus
ggcgagcagacctccgcgtcttcat

SEQ ID NO: 406885 - DNA, 25 bp, Mus musculus
ttaccttcgcggtcctcactggagg

SEQ ID NO: 406886 - DNA, 25 bp, Mus musculus
cactggaggacggagagtcccgtaa

SEQ ID NO: 406887 - DNA, 25 bp, Mus musculus
cactgcgtccttccctcttgagggt

SEQ ID NO: 406888 - DNA, 25 bp, Mus musculus
actcaatccgggagtgcgcgcccaa

SEQ ID NO: 406889 - DNA, 25 bp, Mus musculus
caaagggccgcagaaatcaccagga

SEQ ID NO: 406890 - DNA, 25 bp, Mus musculus
agcccgcagccgagactgttacctt

SEQ ID NO: 406891 - DNA, 25 bp, Mus musculus
gtcttcatctcctcggcttcctggg

SEQ ID NO: 406892 - DNA, 25 bp, Mus musculus
tcctagacatcagcccggtggcaca

SEQ ID NO: 406893 - DNA, 25 bp, Mus musculus
acggacatcaaatcttccacgcctt

SEQ ID NO: 406894 - DNA, 25 bp, Mus musculus
cgtcctagacatcagcccggtggca

SEQ ID NO: 406895 - DNA, 25 bp, Mus musculus
gccacctggccggttgccaggagca

SEQ ID NO: 406896 - DNA, 25 bp, Mus musculus
ggtaccacacccttcagatcctctt

SEQ ID NO: 406897 - DNA, 25 bp, Mus musculus
tcttcttcctcgtcagcgcatactt

SEQ ID NO: 406898 - DNA, 25 bp, Mus musculus
tcgtcagcgcatacttcttctcgtg

SEQ ID NO: 406899 - DNA, 25 bp, Mus musculus
gcgcatacttcttctcgtgccctgt

SEQ ID NO: 406900 - DNA, 25 bp, Mus musculus
tctcgtgccctgtccccgagaagta

SEQ ID NO: 406901 - DNA, 25 bp, Mus musculus
ccggttcctgtgacattgtgggcca

SEQ ID NO: 406902 - DNA, 25 bp, Mus musculus
cctgtgacattgtgggccacggaca

SEQ ID NO: 406903 - DNA, 25 bp, Mus musculus
tgtgggccacggacatcaaatcttc

SEQ ID NO: 406904 - DNA, 25 bp, Mus musculus
ggagcaggcggcctggtaccacacc

SEQ ID NO: 406905 - DNA, 25 bp, Mus musculus
ggccacggacatcaaatcttccacg

SEQ ID NO: 406906 - DNA, 25 bp, Mus musculus
gagggaggcctactgctatttaatg

SEQ ID NO: 406907 - DNA, 25 bp, Mus musculus
tctggaagcccgcagaggaaccatg

SEQ ID NO: 406908 - DNA, 25 bp, Mus musculus
gaacacccgaggcaaaccgtctgga

SEQ ID NO: 406909 - DNA, 25 bp, Mus musculus
gggctgctcgagacagcgacttccg

SEQ ID NO: 406910 - DNA, 25 bp, Mus musculus
ctatttaatggcgtgctcggtgtcg

SEQ ID NO: 406911 - DNA, 25 bp, Mus musculus
cccgcgactaaccaaggaagatggc

SEQ ID NO: 406912 - DNA, 25 bp, Mus musculus
ggtgcccgattcaccacctaagagc

SEQ ID NO: 406913 - DNA, 25 bp, Mus musculus
ggtcggatgttaacggattgcactg

SEQ ID NO: 406914 - DNA, 25 bp, Mus musculus
tagcccgctgtgatgatagtgaatg

SEQ ID NO: 406915 - DNA, 25 bp, Mus musculus
ggaaaaatgccgttagcccgctgtg

SEQ ID NO: 406916 - DNA, 25 bp, Mus musculus
cggggactaggtgcccgattcacca

SEQ ID NO: 406917 - DNA, 25 bp, Mus musculus
tggcgcaggagtctctagagagaaa

SEQ ID NO: 406918 - DNA, 25 bp, Mus musculus
gattgcactggaaacccgaacgcca

SEQ ID NO: 406919 - DNA, 25 bp, Mus musculus
tcggtgtcgtcacttccgagccggc

SEQ ID NO: 406920 - DNA, 25 bp, Mus musculus
ggcacatccacgcaccgagcccaga

SEQ ID NO: 406921 - DNA, 25 bp, Mus musculus
cccacgtgaggctgctctgcccgcc

SEQ ID NO: 406922 - DNA, 25 bp, Mus musculus
tgccctggactctgcgcgccttcct

SEQ ID NO: 406923 - DNA, 25 bp, Mus musculus
tcccactcagcgctgccctggactc

SEQ ID NO: 406924 - DNA, 25 bp, Mus musculus
ggctcttgccgtggctcccactcag

SEQ ID NO: 406925 - DNA, 25 bp, Mus musculus
ttctctccgccgtggctcttgccgt

SEQ ID NO: 406926 - DNA, 25 bp, Mus musculus
gcgtaggaaattgcctcctgggtcc

SEQ ID NO: 406927 - DNA, 25 bp, Mus musculus
gcctcactccctctgcgtaggaaat

SEQ ID NO: 406928 - DNA, 25 bp, Mus musculus
gacagcgctctagcgccgggcacat

SEQ ID NO: 406929 - DNA, 25 bp, Mus musculus
cgcttacctaggtgttcaggcgccc

SEQ ID NO: 406930 - DNA, 25 bp, Mus musculus
ggcgcgcttacctaggtgttcaggc

SEQ ID NO: 406931 - DNA, 25 bp, Mus musculus
cggttaaggcgggtgctctgcgcaa

SEQ ID NO: 406932 - DNA, 25 bp, Mus musculus
caccagcgcctttaggagctgctgc

SEQ ID NO: 406933 - DNA, 25 bp, Mus musculus
ctccctctgcgtaggaaattgcctc

SEQ ID NO: 406934 - DNA, 25 bp, Mus musculus
aagcgtgagcggatcgcagaccgcc

SEQ ID NO: 406935 - DNA, 25 bp, Mus musculus
agcggatcgcagaccgcctggtcgc

SEQ ID NO: 406936 - DNA, 25 bp, Mus musculus
tcgcctccatggactcgggaagggt

SEQ ID NO: 406937 - DNA, 25 bp, Mus musculus
aggcacatgcggatcctgcggatcc

SEQ ID NO: 406938 - DNA, 25 bp, Mus musculus
gaagacgcaggtgccgctggaccac

SEQ ID NO: 406939 - DNA, 25 bp, Mus musculus
tcctgcggatccaggactagtgccc

SEQ ID NO: 406940 - DNA, 25 bp, Mus musculus
accgcggtagcgtatccctctgcgg

SEQ ID NO: 406941 - DNA, 25 bp, Mus musculus
gaggaccgcggtagcgtatccctct

SEQ ID NO: 406942 - DNA, 25 bp, Mus musculus
ctggtcgcctccatggactcgggaa

SEQ ID NO: 406943 - DNA, 25 bp, Mus musculus
tctgagtcatgctgaggaccgcggt

SEQ ID NO: 406944 - DNA, 25 bp, Mus musculus
cttcccgtgatctgagtcatgctga

SEQ ID NO: 406945 - DNA, 25 bp, Mus musculus
cgtgctcttcccgtgatctgagtca

SEQ ID NO: 406946 - DNA, 25 bp, Mus musculus
tccctccttcagctggtcctcccgt

SEQ ID NO: 406947 - DNA, 25 bp, Mus musculus
gccgctggaccaccctccacctgag

SEQ ID NO: 406948 - DNA, 25 bp, Mus musculus
ttccggaacgccctgcgtcgtcata

SEQ ID NO: 406949 - DNA, 25 bp, Mus musculus
gggctcccacggttctttcagcaaa

SEQ ID NO: 406950 - DNA, 25 bp, Mus musculus
ataggctctcgaaaccgcgcttccg

SEQ ID NO: 406951 - DNA, 25 bp, Mus musculus
ttgtctcggaatgggataggctctc

SEQ ID NO: 406952 - DNA, 25 bp, Mus musculus
tattgaatcgggttgttgtctcgga

SEQ ID NO: 406953 - DNA, 25 bp, Mus musculus
ttccgtgtgtttttagtcatgggta

SEQ ID NO: 406954 - DNA, 25 bp, Mus musculus
tacactctctagaagtttccgtgtg

SEQ ID NO: 406955 - DNA, 25 bp, Mus musculus
cactgtaggagtgcacgacaccggc

SEQ ID NO: 406956 - DNA, 25 bp, Mus musculus
cgtcgtcatagcaacgcagcacatt

SEQ ID NO: 406957 - DNA, 25 bp, Mus musculus
ccacaagttgtgtttgccgcctggc

SEQ ID NO: 406958 - DNA, 25 bp, Mus musculus
caaagtcctaggactgcactgtagg

SEQ ID NO: 406959 - DNA, 25 bp, Mus musculus
gcctccctacagactgcgggcgggt

SEQ ID NO: 406960 - DNA, 25 bp, Mus musculus
accggccgctgtacccacaagttgt

SEQ ID NO: 406961 - DNA, 25 bp, Mus musculus
ccggcagagccgtcaaaagaaaaga

SEQ ID NO: 406962 - DNA, 25 bp, Mus musculus
tcggagactaggatgtcccttcgcc

SEQ ID NO: 406963 - DNA, 25 bp, Mus musculus
cagggtggacctggtcaggaaagga

SEQ ID NO: 406964 - DNA, 25 bp, Mus musculus
agcggaagcttgaggttacctgcga

SEQ ID NO: 406965 - DNA, 25 bp, Mus musculus
acggtcggagactaggatgtccctt

SEQ ID NO: 406966 - DNA, 25 bp, Mus musculus
agactaggatgtcccttcgccggcc

SEQ ID NO: 406967 - DNA, 25 bp, Mus musculus
ccagccgggctacggaggaagataa

SEQ ID NO: 406968 - DNA, 25 bp, Mus musculus
tacggaggaagataaagcgcaggcc

SEQ ID NO: 406969 - DNA, 25 bp, Mus musculus
cgcggctgcgtcacgcgcatcgccc

SEQ ID NO: 406970 - DNA, 25 bp, Mus musculus
cccgagctccgggatgccattggtg

SEQ ID NO: 406971 - DNA, 25 bp, Mus musculus
gctccgggatgccattggtggtcct

SEQ ID NO: 406972 - DNA, 25 bp, Mus musculus
atgccattggtggtcctgcggcgtc

SEQ ID NO: 406973 - DNA, 25 bp, Mus musculus
cggcgtccggcaacgcccactgcca

SEQ ID NO: 406974 - DNA, 25 bp, Mus musculus
cttcttctcgggctcagggtggacc

SEQ ID NO: 406975 - DNA, 25 bp, Mus musculus
aagcttgaggttacctgcgagcgga

SEQ ID NO: 406976 - DNA, 25 bp, Mus musculus
cgcccaccgagtagcggaggtgctt

SEQ ID NO: 406977 - DNA, 25 bp, Mus musculus
ccctgtgctcggtggtttaaagatg

SEQ ID NO: 406978 - DNA, 25 bp, Mus musculus
ggcgtaccgcagacgccggcttcaa

SEQ ID NO: 406979 - DNA, 25 bp, Mus musculus
gcagacgccggcttcaacgtcttca

SEQ ID NO: 406980 - DNA, 25 bp, Mus musculus
ttcaacgtcttcacccagcacggtg

SEQ ID NO: 406981 - DNA, 25 bp, Mus musculus
ccagtcacgggaggcgaggcacacc

SEQ ID NO: 406982 - DNA, 25 bp, Mus musculus
gcacgtggtggcttctcagcctctt

SEQ ID NO: 406983 - DNA, 25 bp, Mus musculus
cgaaagcttcgctgaccctgtgggc

SEQ ID NO: 406984 - DNA, 25 bp, Mus musculus
cacccagcacggtgagtgtgtccgg

SEQ ID NO: 406985 - DNA, 25 bp, Mus musculus
ctcttctgatttgacaggtggaggt

SEQ ID NO: 406986 - DNA, 25 bp, Mus musculus
cacgctcgccctgtgctcggtggtt

SEQ ID NO: 406987 - DNA, 25 bp, Mus musculus
ctcgagggccctcgaaagcttcgct

SEQ ID NO: 406988 - DNA, 25 bp, Mus musculus
tagcagtaaaagcactcgagggccc

SEQ ID NO: 406989 - DNA, 25 bp, Mus musculus
cacagtcctccaagtggggcagtgt

SEQ ID NO: 406990 - DNA, 25 bp, Mus musculus
acaaggtgcagctgaaaagctccca

SEQ ID NO: 406991 - DNA, 25 bp, Mus musculus
ccagtaccgtttggagagggcaccg

SEQ ID NO: 406992 - DNA, 25 bp, Mus musculus
ttggagagggcaccggccttcctca

SEQ ID NO: 406993 - DNA, 25 bp, Mus musculus
agctgaaaagctcccagtaccgttt

SEQ ID NO: 406994 - DNA, 25 bp, Mus musculus
gtctcctggtcttcacagtgatcgg

SEQ ID NO: 406995 - DNA, 25 bp, Mus musculus
cttcacagtgatcgggccacaaggt

SEQ ID NO: 406996 - DNA, 25 bp, Mus musculus
attggcgtcgccgtggtgaccgctc

SEQ ID NO: 406997 - DNA, 25 bp, Mus musculus
cggcggggaccgctcttacccagag

SEQ ID NO: 406998 - DNA, 25 bp, Mus musculus
gaaacatgaccggagcgagcgcttc

SEQ ID NO: 406999 - DNA, 25 bp, Mus musculus
gagagcgccaagaaacatgaccgga

SEQ ID NO: 407000 - DNA, 25 bp, Mus musculus
agcagcaaccagagagcgccaagaa

SEQ ID NO: 407001 - DNA, 25 bp, Mus musculus
ttcaggcctttgacgctcggccaag

SEQ ID NO: 407002 - DNA, 25 bp, Mus musculus
gagcgagcgcttccgcctccaagag

SEQ ID NO: 407003 - DNA, 25 bp, Mus musculus
cgctcttacccagaggcggcacggg

SEQ ID NO: 407004 - DNA, 25 bp, Mus musculus
ccaggagcctctggggaccgtcctt

SEQ ID NO: 407005 - DNA, 25 bp, Mus musculus
gaccgtccttagcagcgagcaccgg

SEQ ID NO: 407006 - DNA, 25 bp, Mus musculus
tgacagaagggcgacaccagggcca

SEQ ID NO: 407007 - DNA, 25 bp, Mus musculus
cttcgtgtgacagaagggcgacacc

SEQ ID NO: 407008 - DNA, 25 bp, Mus musculus
gccgacaccggcttcgtgtgacaga

SEQ ID NO: 407009 - DNA, 25 bp, Mus musculus
gctctgagcgcacgaccgcaggaca

SEQ ID NO: 407010 - DNA, 25 bp, Mus musculus
ctctgcacagtctcatcctaagttg

SEQ ID NO: 407011 - DNA, 25 bp, Mus musculus
ccggaaatgaaaccgccagcgcagc

SEQ ID NO: 407012 - DNA, 25 bp, Mus musculus
ggctcgctcttaatcgccgggccat

SEQ ID NO: 407013 - DNA, 25 bp, Mus musculus
caacgtctgggctcgctcttaatcg

SEQ ID NO: 407014 - DNA, 25 bp, Mus musculus
tcttcaaggcaacgtctgggctcgc

SEQ ID NO: 407015 - DNA, 25 bp, Mus musculus
gcattcatcttcaaggcaacgtctg

SEQ ID NO: 407016 - DNA, 25 bp, Mus musculus
gccgggccatcacacccggaaatga

SEQ ID NO: 407017 - DNA, 25 bp, Mus musculus
tagcagcgagcaccggtcaccgcaa

SEQ ID NO: 407018 - DNA, 25 bp, Mus musculus
gccagaggacaaaagtctggaaacg

SEQ ID NO: 407019 - DNA, 25 bp, Mus musculus
caaccgagcagtcggcgtctctcat

SEQ ID NO: 407020 - DNA, 25 bp, Mus musculus
gagcagtcggcgtctctcattcagc

SEQ ID NO: 407021 - DNA, 25 bp, Mus musculus
tacgagcccgcctaagcccacacag

SEQ ID NO: 407022 - DNA, 25 bp, Mus musculus
cgcaacaggtcacccgcctcggctc

SEQ ID NO: 407023 - DNA, 25 bp, Mus musculus
gtcggcgtctctcattcagcgcctg

SEQ ID NO: 407024 - DNA, 25 bp, Mus musculus
cagcaccggccgcaaggacgagccg

SEQ ID NO: 407025 - DNA, 25 bp, Mus musculus
acgagccgcagggttcaggacggac

SEQ ID NO: 407026 - DNA, 25 bp, Mus musculus
cccggctcacctgagaggctgaggc

SEQ ID NO: 407027 - DNA, 25 bp, Mus musculus
cgctcgggccagaggacaaaagtct

SEQ ID NO: 407028 - DNA, 25 bp, Mus musculus
tctggaaacgcttggcccccagatc

SEQ ID NO: 407029 - DNA, 25 bp, Mus musculus
ctacaccgcacacggcggcaggaaa

SEQ ID NO: 407030 - DNA, 25 bp, Mus musculus
gcacgccacgccgacctgtgcagcc

SEQ ID NO: 407031 - DNA, 25 bp, Mus musculus
ccgaggcaatcgctcgcccaaccga

SEQ ID NO: 407032 - DNA, 25 bp, Mus musculus
ctttcctaagactatcctgctccga

SEQ ID NO: 407033 - DNA, 25 bp, Mus musculus
gaccgcctctcggtgcggggatcct

SEQ ID NO: 407034 - DNA, 25 bp, Mus musculus
ctgccgccgaagacagcaaaaatcg

SEQ ID NO: 407035 - DNA, 25 bp, Mus musculus
tccagtaaccgagcggaggaggaac

SEQ ID NO: 407036 - DNA, 25 bp, Mus musculus
gccgcgtgtgcaatccagtaaccga

SEQ ID NO: 407037 - DNA, 25 bp, Mus musculus
gccgaagcaatcgagtgccgagctc

SEQ ID NO: 407038 - DNA, 25 bp, Mus musculus
tcccagggtgataggccgaagcaat

SEQ ID NO: 407039 - DNA, 25 bp, Mus musculus
tctgagaaacccacaagcccggcag

SEQ ID NO: 407040 - DNA, 25 bp, Mus musculus
cgcagcccacctgcaagcggagggt

SEQ ID NO: 407041 - DNA, 25 bp, Mus musculus
ggagacagctccatggtgtcccaga

SEQ ID NO: 407042 - DNA, 25 bp, Mus musculus
gcggctcctccggacgacggagaca

SEQ ID NO: 407043 - DNA, 25 bp, Mus musculus
tgactgggacgaccgcgtccagatc

SEQ ID NO: 407044 - DNA, 25 bp, Mus musculus
actgctccgctgactgggacgaccg

SEQ ID NO: 407045 - DNA, 25 bp, Mus musculus
tcgggcaccgaaatactcagcgggc

SEQ ID NO: 407046 - DNA, 25 bp, Mus musculus
gcaggcggattccatcctggagctg

SEQ ID NO: 407047 - DNA, 25 bp, Mus musculus
ggcaggtgcatttccaagtcctccg

SEQ ID NO: 407048 - DNA, 25 bp, Mus musculus
caggtgcatttccaagtcctccgga

SEQ ID NO: 407049 - DNA, 25 bp, Mus musculus
aggtgcatttccaagtcctccggaa

SEQ ID NO: 407050 - DNA, 25 bp, Mus musculus
gtgcatttccaagtcctccggaacc

SEQ ID NO: 407051 - DNA, 25 bp, Mus musculus
tccggaacccgtcgagctcagcgga

SEQ ID NO: 407052 - DNA, 25 bp, Mus musculus
acccgtcgagctcagcggaggcgct

SEQ ID NO: 407053 - DNA, 25 bp, Mus musculus
aggcgctgcgggttgagccgcgagc

SEQ ID NO: 407054 - DNA, 25 bp, Mus musculus
gcaggcaggcggattccatcctgga

SEQ ID NO: 407055 - DNA, 25 bp, Mus musculus
aggcaggcggattccatcctggagc

SEQ ID NO: 407056 - DNA, 25 bp, Mus musculus
ctgaggacctgctggtgtcctcgga

SEQ ID NO: 407057 - DNA, 25 bp, Mus musculus
cgcgcggcaggtgcatttccaagtc

SEQ ID NO: 407058 - DNA, 25 bp, Mus musculus
gggctccttcggctgcctgaggacc

SEQ ID NO: 407059 - DNA, 25 bp, Mus musculus
gcggcaggtgcatttccaagtcctc

SEQ ID NO: 407060 - DNA, 25 bp, Mus musculus
ttaccaaccgcccagggtcggagca

SEQ ID NO: 407061 - DNA, 25 bp, Mus musculus
ccgcactcacggttggcgatgtcgc

SEQ ID NO: 407062 - DNA, 25 bp, Mus musculus
tcggcgatagtttgctcctgctgct

SEQ ID NO: 407063 - DNA, 25 bp, Mus musculus
cgacatcttcctactgctactactg

SEQ ID NO: 407064 - DNA, 25 bp, Mus musculus
tactgcagcttcactttccctgagc

SEQ ID NO: 407065 - DNA, 25 bp, Mus musculus
agccacaggctgtagctagagtctc

SEQ ID NO: 407066 - DNA, 25 bp, Mus musculus
ctagagtctcttcgatccgcgagga

SEQ ID NO: 407067 - DNA, 25 bp, Mus musculus
tggctcactcggcaagacccagacg

SEQ ID NO: 407068 - DNA, 25 bp, Mus musculus
agcttgagggaaagcgtggtctctc

SEQ ID NO: 407069 - DNA, 25 bp, Mus musculus
gccgaccctgagctcgtaacagcga

SEQ ID NO: 407070 - DNA, 25 bp, Mus musculus
tcgggagcatagatccggacagacc

SEQ ID NO: 407071 - DNA, 25 bp, Mus musculus
ctcactgctgccagtcgggagcata

SEQ ID NO: 407072 - DNA, 25 bp, Mus musculus
acagctggccgcttccttttcgagg

SEQ ID NO: 407073 - DNA, 25 bp, Mus musculus
ctcgcgggctctagaactacaattc

SEQ ID NO: 407074 - DNA, 25 bp, Mus musculus
ggctcgtcctttacagactccacgg

SEQ ID NO: 407075 - DNA, 25 bp, Mus musculus
gctccgtcgtcctcgcgcatcccag

SEQ ID NO: 407076 - DNA, 25 bp, Mus musculus
tccttcattccgcaggctccgtcgt

SEQ ID NO: 407077 - DNA, 25 bp, Mus musculus
tggctcgcctctgcgctccttcatt

SEQ ID NO: 407078 - DNA, 25 bp, Mus musculus
aagggttctccacttggctcgcctc

SEQ ID NO: 407079 - DNA, 25 bp, Mus musculus
ctttacagactccacggtgagggcc

SEQ ID NO: 407080 - DNA, 25 bp, Mus musculus
ttctcccgggctcgtcctttacaga

SEQ ID NO: 407081 - DNA, 25 bp, Mus musculus
agcgatggggaccaacccggtgcac

SEQ ID NO: 407082 - DNA, 25 bp, Mus musculus
aaaggcaaccgaggtggcagctgca

SEQ ID NO: 407083 - DNA, 25 bp, Mus musculus
ccgagcggcaaaaggcaaccgaggt

SEQ ID NO: 407084 - DNA, 25 bp, Mus musculus
ttgccagggtaacccgagcggcaaa

SEQ ID NO: 407085 - DNA, 25 bp, Mus musculus
gcagtttgttgccagggtaacccga

SEQ ID NO: 407086 - DNA, 25 bp, Mus musculus
cgagtgcagtttgttgccagggtaa

SEQ ID NO: 407087 - DNA, 25 bp, Mus musculus
ccagcccgaagggttctccacttgg

SEQ ID NO: 407088 - DNA, 25 bp, Mus musculus
gctggagtgcaagctcaagagcatc

SEQ ID NO: 407089 - DNA, 25 bp, Mus musculus
ccttcctgcgcgagaacgacctgag

SEQ ID NO: 407090 - DNA, 25 bp, Mus musculus
tgagcatcatgcacagtccctcggc

SEQ ID NO: 407091 - DNA, 25 bp, Mus musculus
aagcttctcttctccgtgcgcaatg

SEQ ID NO: 407092 - DNA, 25 bp, Mus musculus
ccctatttcgtgctgggtgagtccc

SEQ ID NO: 407093 - DNA, 25 bp, Mus musculus
acggagctaccctatttcgtgctgg

SEQ ID NO: 407094 - DNA, 25 bp, Mus musculus
cgtgcgcaatgacttcccgggagaa

SEQ ID NO: 407095 - DNA, 25 bp, Mus musculus
tcgtggtggacgacctagagaacac

SEQ ID NO: 407096 - DNA, 25 bp, Mus musculus
gcgcgagaacgacctgagcatcatg

SEQ ID NO: 407097 - DNA, 25 bp, Mus musculus
aagctcaagagcatcactgtgtcgg

SEQ ID NO: 407098 - DNA, 25 bp, Mus musculus
gcatcactgtgtcggcactgccctt

SEQ ID NO: 407099 - DNA, 25 bp, Mus musculus
ccggcgacgtggatccatccaagga

SEQ ID NO: 407100 - DNA, 25 bp, Mus musculus
gccagggctcaagatggctttagcc

SEQ ID NO: 407101 - DNA, 25 bp, Mus musculus
cgacctagagaacacggagctaccc

SEQ ID NO: 407102 - DNA, 25 bp, Mus musculus
tccaccctttggctccatgaaaacg

SEQ ID NO: 407103 - DNA, 25 bp, Mus musculus
ctctactacgtcagaaaggaaatca

SEQ ID NO: 407104 - DNA, 25 bp, Mus musculus
ctcggagaactacacgctcggcatc

SEQ ID NO: 407105 - DNA, 25 bp, Mus musculus
taataatccatagccgcatgcgcgc

SEQ ID NO: 407106 - DNA, 25 bp, Mus musculus
tcctcggcagtcatggctcctcgga

SEQ ID NO: 407107 - DNA, 25 bp, Mus musculus
ggaaatcagctttccactcggagaa

SEQ ID NO: 407108 - DNA, 25 bp, Mus musculus
agcagttgcttttcgagcgttcccg

SEQ ID NO: 407109 - DNA, 25 bp, Mus musculus
ccggggcacgcttaagcagttgctt

SEQ ID NO: 407110 - DNA, 25 bp, Mus musculus
tgaaaacggccatctctctactacg

SEQ ID NO: 407111 - DNA, 25 bp, Mus musculus
acaagtgagcttagtattttccaga

SEQ ID NO: 407112 - DNA, 25 bp, Mus musculus
cgcgaagccgcaagagaacacaagt

SEQ ID NO: 407113 - DNA, 25 bp, Mus musculus
ggctcctcggatgtgatagtttccc

SEQ ID NO: 407114 - DNA, 25 bp, Mus musculus
ccgccgcagttttagctgggcaatc

SEQ ID NO: 407115 - DNA, 25 bp, Mus musculus
agcgttcccggtccactagaccaga

SEQ ID NO: 407116 - DNA, 25 bp, Mus musculus
gggtggcgccaacgcgcagaacaca

SEQ ID NO: 407117 - DNA, 25 bp, Mus musculus
aacagcaagggccaggagagatcgc

SEQ ID NO: 407118 - DNA, 25 bp, Mus musculus
ggagagatcgcgcaggctcactatt

SEQ ID NO: 407119 - DNA, 25 bp, Mus musculus
ctgtgggtccctcgtaaccctgtca

SEQ ID NO: 407120 - DNA, 25 bp, Mus musculus
gcgcaggctcactattctcctactg

SEQ ID NO: 407121 - DNA, 25 bp, Mus musculus
ccttccctgatttccgtgtcctgtg

SEQ ID NO: 407122 - DNA, 25 bp, Mus musculus
gcggtccgcatggatgatttgctta

SEQ ID NO: 407123 - DNA, 25 bp, Mus musculus
cgcgagagttatttcaaatcccgca

SEQ ID NO: 407124 - DNA, 25 bp, Mus musculus
ctccctctctataggctaaatcctg

SEQ ID NO: 407125 - DNA, 25 bp, Mus musculus
gcctccacagaacctgtttccggtg

SEQ ID NO: 407126 - DNA, 25 bp, Mus musculus
cctgtttccggtgttgtactgcggc

SEQ ID NO: 407127 - DNA, 25 bp, Mus musculus
ctgctgcggaccttccggcaggtca

SEQ ID NO: 407128 - DNA, 25 bp, Mus musculus
ccctgtcacctgtaatgcgcacgga

SEQ ID NO: 407129 - DNA, 25 bp, Mus musculus
tctcctactgcctaagtgggcggtc

SEQ ID NO: 407130 - DNA, 25 bp, Mus musculus
acgagacggctctggaaccttcgca

SEQ ID NO: 407131 - DNA, 25 bp, Mus musculus
cggtgcaccgaagcagacaggaaaa

SEQ ID NO: 407132 - DNA, 25 bp, Mus musculus
gcctagcaacgctcaattctcgcga

SEQ ID NO: 407133 - DNA, 25 bp, Mus musculus
ggaaccttcgcaaggctccaccgga

SEQ ID NO: 407134 - DNA, 25 bp, Mus musculus
cgatcgaatgctcaggaggcgtcca

SEQ ID NO: 407135 - DNA, 25 bp, Mus musculus
ttggggacccgataggaagtgtctc

SEQ ID NO: 407136 - DNA, 25 bp, Mus musculus
aagtgtctcgagaagggctgcttcc

SEQ ID NO: 407137 - DNA, 25 bp, Mus musculus
ttgtcttcggcagctctgaggtatc

SEQ ID NO: 407138 - DNA, 25 bp, Mus musculus
tatcgggaaagaacaaaggagcgcc

SEQ ID NO: 407139 - DNA, 25 bp, Mus musculus
ggctcctaagtagaacaatggcttt

SEQ ID NO: 407140 - DNA, 25 bp, Mus musculus
gcgtcctgcgtctagcaccgttgac

SEQ ID NO: 407141 - DNA, 25 bp, Mus musculus
ccatctcgtgggactgtaggaaggt

SEQ ID NO: 407142 - DNA, 25 bp, Mus musculus
ttccaaaacggaagccatgccgtcg

SEQ ID NO: 407143 - DNA, 25 bp, Mus musculus
cccagcgattgagacgtcgttccgc

SEQ ID NO: 407144 - DNA, 25 bp, Mus musculus
ggcccacgcggtcaactttgaagcg

SEQ ID NO: 407145 - DNA, 25 bp, Mus musculus
tccacaggctcgcttgactcggctt

SEQ ID NO: 407146 - DNA, 25 bp, Mus musculus
aggtgccttctctgcctaagtcggc

SEQ ID NO: 407147 - DNA, 25 bp, Mus musculus
aacaactctgtcagacgcccgagtc

SEQ ID NO: 407148 - DNA, 25 bp, Mus musculus
gcggccgtgccggaacaacaactct

SEQ ID NO: 407149 - DNA, 25 bp, Mus musculus
tgaaccagccgggtccacctcaaaa

SEQ ID NO: 407150 - DNA, 25 bp, Mus musculus
cagccacacggagaacccgggtgtc

SEQ ID NO: 407151 - DNA, 25 bp, Mus musculus
cgcgacgagccagccacacggagaa

SEQ ID NO: 407152 - DNA, 25 bp, Mus musculus
gcaatgtcaggagggcacacttgga

SEQ ID NO: 407153 - DNA, 25 bp, Mus musculus
gggatccaaccgacgctttcaagtg

SEQ ID NO: 407154 - DNA, 25 bp, Mus musculus
cgccagcaggaacggagcaaagtgc

SEQ ID NO: 407155 - DNA, 25 bp, Mus musculus
caaaaccacaagcatcgccagcagg

SEQ ID NO: 407156 - DNA, 25 bp, Mus musculus
tgcccaaaaaacagcctatcccaga

SEQ ID NO: 407157 - DNA, 25 bp, Mus musculus
ttcctggcaggtagagatctgccca

SEQ ID NO: 407158 - DNA, 25 bp, Mus musculus
cggccgcggccgagaacaataggca

SEQ ID NO: 407159 - DNA, 25 bp, Mus musculus
cgcgacagcgctcgagacacgggcg

SEQ ID NO: 407160 - DNA, 25 bp, Mus musculus
gcgtcgcccgctcccgacagggcgt

SEQ ID NO: 407161 - DNA, 25 bp, Mus musculus
ggtgactcagagctttcctcccggc

SEQ ID NO: 407162 - DNA, 25 bp, Mus musculus
gggaggccgaccaacaagatggccc

SEQ ID NO: 407163 - DNA, 25 bp, Mus musculus
acaagatggcccctgctgcaggagc

SEQ ID NO: 407164 - DNA, 25 bp, Mus musculus
gcctgggacagagtcagagtcgatg

SEQ ID NO: 407165 - DNA, 25 bp, Mus musculus
ctgctcggaccagagcggtgagcaa

SEQ ID NO: 407166 - DNA, 25 bp, Mus musculus
ccgagaacaataggcagcgactgcg

SEQ ID NO: 407167 - DNA, 25 bp, Mus musculus
atggggctgtcctcacccgccctgc

SEQ ID NO: 407168 - DNA, 25 bp, Mus musculus
agtggccggcgtcctttaggcctca

SEQ ID NO: 407169 - DNA, 25 bp, Mus musculus
ggccggcgtcctttaggcctcaggc

SEQ ID NO: 407170 - DNA, 25 bp, Mus musculus
aggcctcaggcctccgcgtgcctcc

SEQ ID NO: 407171 - DNA, 25 bp, Mus musculus
ggactcggagctgagaggagctgct

SEQ ID NO: 407172 - DNA, 25 bp, Mus musculus
cgagcgacgtgccggaaggaaatca

SEQ ID NO: 407173 - DNA, 25 bp, Mus musculus
agtggacgcagcaagcagctttgcg

SEQ ID NO: 407174 - DNA, 25 bp, Mus musculus
gcgagctcgacagcccggagccaaa

SEQ ID NO: 407175 - DNA, 25 bp, Mus musculus
ctcgacagcccggagccaaaggggc

SEQ ID NO: 407176 - DNA, 25 bp, Mus musculus
ctggctgcaacccagacgcggcccg

SEQ ID NO: 407177 - DNA, 25 bp, Mus musculus
ggaacgagcccagtcaaggagcagc

SEQ ID NO: 407178 - DNA, 25 bp, Mus musculus
gagcccagtcaaggagcagcaccta

SEQ ID NO: 407179 - DNA, 25 bp, Mus musculus
gcagctttgcgtcttgacgtcacga

SEQ ID NO: 407180 - DNA, 25 bp, Mus musculus
cttgacgtcacgaagaccttatata

SEQ ID NO: 407181 - DNA, 25 bp, Mus musculus
gaagaccttatatactcgactcagc

SEQ ID NO: 407182 - DNA, 25 bp, Mus musculus
ttatatactcgactcagccgccatc

SEQ ID NO: 407183 - DNA, 25 bp, Mus musculus
gccatctcagcctttcggagctgtg

SEQ ID NO: 407184 - DNA, 25 bp, Mus musculus
cgggcctatcgtgcccgcggcaact

SEQ ID NO: 407185 - DNA, 25 bp, Mus musculus
ggtttaagtggacgcagcaagcagc

SEQ ID NO: 407186 - DNA, 25 bp, Mus musculus
gattgaagccttccaagccttgccc

SEQ ID NO: 407187 - DNA, 25 bp, Mus musculus
cccggcgagcgccaaagttacgcaa

SEQ ID NO: 407188 - DNA, 25 bp, Mus musculus
tacgcaaggattccggccaatcagg

SEQ ID NO: 407189 - DNA, 25 bp, Mus musculus
gccatgtttattgtgggcggcagta

SEQ ID NO: 407190 - DNA, 25 bp, Mus musculus
aacggaagaacaacgcggcgcaata

SEQ ID NO: 407191 - DNA, 25 bp, Mus musculus
agccttgccctcagttaaaatgacg

SEQ ID NO: 407192 - DNA, 25 bp, Mus musculus
acgacttcagttgctttcagttacg

SEQ ID NO: 407193 - DNA, 25 bp, Mus musculus
ccgcagggcaagtcgggaaatgatt

SEQ ID NO: 407194 - DNA, 25 bp, Mus musculus
cgtgtgtggaaaagcgcctagacga

SEQ ID NO: 407195 - DNA, 25 bp, Mus musculus
cctagacgagcggaactttcaagtc

SEQ ID NO: 407196 - DNA, 25 bp, Mus musculus
cagcttccgaagagcgaggatcata

SEQ ID NO: 407197 - DNA, 25 bp, Mus musculus
cgaggatcatagagccgggcagctt

SEQ ID NO: 407198 - DNA, 25 bp, Mus musculus
tcagttacgtgaaatcggagggcca

SEQ ID NO: 407199 - DNA, 25 bp, Mus musculus
atgcgggaaagtttcgcaccggttg

SEQ ID NO: 407200 - DNA, 25 bp, Mus musculus
atcactacgggatcctggcgtcagg

SEQ ID NO: 407201 - DNA, 25 bp, Mus musculus
tcggggaaccgccatgctctttcca

SEQ ID NO: 407202 - DNA, 25 bp, Mus musculus
cagggaagggagaactctcaagccc

SEQ ID NO: 407203 - DNA, 25 bp, Mus musculus
cgattccagggaagggagaactctc

SEQ ID NO: 407204 - DNA, 25 bp, Mus musculus
caggcagaaagtcgagggcgattcc

SEQ ID NO: 407205 - DNA, 25 bp, Mus musculus
catcctgccgcagcaaaagggcagg

SEQ ID NO: 407206 - DNA, 25 bp, Mus musculus
ggctttgctcatccttccgcggctt

SEQ ID NO: 407207 - DNA, 25 bp, Mus musculus
acctttgtgtgtccggtgggctttg

SEQ ID NO: 407208 - DNA, 25 bp, Mus musculus
gtgggcgtcatccaaggtatgctca

SEQ ID NO: 407209 - DNA, 25 bp, Mus musculus
cgcatcatcactacgggatcctggc

SEQ ID NO: 407210 - DNA, 25 bp, Mus musculus
gaaccgccatgctctttccacgtga

SEQ ID NO: 407211 - DNA, 25 bp, Mus musculus
gcagcaaaagggcaggcagaaagtc

SEQ ID NO: 407212 - DNA, 25 bp, Mus musculus
aaggtatgctcaacctttgtgtgtc

SEQ ID NO: 407213 - DNA, 25 bp, Mus musculus
tccttccgcggctttgatcatcctg

SEQ ID NO: 407214 - DNA, 25 bp, Mus musculus
caatattggaccagggcgtggtggt

SEQ ID NO: 407215 - DNA, 25 bp, Mus musculus
gccaagctgagaatgacaaatagtg

SEQ ID NO: 407216 - DNA, 25 bp, Mus musculus
gtaagccaagctgagaatgacaaat

SEQ ID NO: 407217 - DNA, 25 bp, Mus musculus
agcaaagtaagccaagctgagaatg

SEQ ID NO: 407218 - DNA, 25 bp, Mus musculus
tgttaagcaaagtaagccaagctga

SEQ ID NO: 407219 - DNA, 25 bp, Mus musculus
ctatgttaagcaaagtaagccaagc

SEQ ID NO: 407220 - DNA, 25 bp, Mus musculus
ccactatgttaagcaaagtaagcca

SEQ ID NO: 407221 - DNA, 25 bp, Mus musculus
ctgagaatgacaaatagtgtgtagt

SEQ ID NO: 407222 - DNA, 25 bp, Mus musculus
gaatgacaaatagtgtgtagtaaaa

SEQ ID NO: 407223 - DNA, 25 bp, Mus musculus
gtaaaaatgtacttataagtctgac

SEQ ID NO: 407224 - DNA, 25 bp, Mus musculus
tgtacttataagtctgacaatattg

SEQ ID NO: 407225 - DNA, 25 bp, Mus musculus
cttataagtctgacaatattggacc

SEQ ID NO: 407226 - DNA, 25 bp, Mus musculus
caagctgagaatgacaaatagtgtg

SEQ ID NO: 407227 - DNA, 25 bp, Mus musculus
tataagtctgacaatattggaccag

SEQ ID NO: 407228 - DNA, 25 bp, Mus musculus
tgcctcgtatgatagaacttttatc

SEQ ID NO: 407229 - DNA, 25 bp, Mus musculus
tgccagaactgacctagtgtctaac

SEQ ID NO: 407230 - DNA, 25 bp, Mus musculus
agtgtctaacttttcacgctctaga

SEQ ID NO: 407231 - DNA, 25 bp, Mus musculus
cgctctagatgtcaaactgatgttt

SEQ ID NO: 407232 - DNA, 25 bp, Mus musculus
acattaaacattgtaaaagggcaca

SEQ ID NO: 407233 - DNA, 25 bp, Mus musculus
taaaagggcacaggttcgaatctcc

SEQ ID NO: 407234 - DNA, 25 bp, Mus musculus
aggttcgaatctccgcccgcgcgag

SEQ ID NO: 407235 - DNA, 25 bp, Mus musculus
agctgcagggtgcaacctggagccc

SEQ ID NO: 407236 - DNA, 25 bp, Mus musculus
cagcagacgggtgcacagccagaag

SEQ ID NO: 407237 - DNA, 25 bp, Mus musculus
gttacacgttttctcattttatgcc

SEQ ID NO: 407238 - DNA, 25 bp, Mus musculus
ctgccgcctattgatctggcagctc

SEQ ID NO: 407239 - DNA, 25 bp, Mus musculus
ctcattttatgcctcgtatgataga

SEQ ID NO: 407240 - DNA, 25 bp, Mus musculus
gaacttttatcatatgccagaactg

SEQ ID NO: 407241 - DNA, 25 bp, Mus musculus
tgcacagccagaaggaagagtttgg

SEQ ID NO: 407242 - DNA, 25 bp, Mus musculus
gaagccctgtcctccggctttgaga

SEQ ID NO: 407243 - DNA, 25 bp, Mus musculus
gaatccctgtctgcgcctcggagga

SEQ ID NO: 407244 - DNA, 25 bp, Mus musculus
agtgggccgggatcccactcctagc

SEQ ID NO: 407245 - DNA, 25 bp, Mus musculus
gctcccgagctgctggacaggaagt

SEQ ID NO: 407246 - DNA, 25 bp, Mus musculus
tgaacctcgctgagacgcgggaatg

SEQ ID NO: 407247 - DNA, 25 bp, Mus musculus
gggtacactcttccgtgaacctcgc

SEQ ID NO: 407248 - DNA, 25 bp, Mus musculus
cagcccagcgcggaacaacttcggg

SEQ ID NO: 407249 - DNA, 25 bp, Mus musculus
ttcgtcctcctacggaaagccatgg

SEQ ID NO: 407250 - DNA, 25 bp, Mus musculus
gctgaagagcgggtaacttttcgtc

SEQ ID NO: 407251 - DNA, 25 bp, Mus musculus
tggatgatgaactcctggctgaaga

SEQ ID NO: 407252 - DNA, 25 bp, Mus musculus
ccgatgtctgcatggttgtggatga

SEQ ID NO: 407253 - DNA, 25 bp, Mus musculus
taagcccgatgaggacgcagagcac

SEQ ID NO: 407254 - DNA, 25 bp, Mus musculus
ccagcccagatgaggtccgggaatc

SEQ ID NO: 407255 - DNA, 25 bp, Mus musculus
gcagagcaccaagcagaaaccgatg

SEQ ID NO: 407256 - DNA, 25 bp, Mus musculus
gtggccacttacgaatctcccagga

SEQ ID NO: 407257 - DNA, 25 bp, Mus musculus
acgctgagaacaaggaggcgcagcc

SEQ ID NO: 407258 - DNA, 25 bp, Mus musculus
caaccctccgggcatggcggcagtg

SEQ ID NO: 407259 - DNA, 25 bp, Mus musculus
cgagaagcaaccctccgggcatggc

SEQ ID NO: 407260 - DNA, 25 bp, Mus musculus
cggccgagcgcaacccggaaagaag

SEQ ID NO: 407261 - DNA, 25 bp, Mus musculus
aatctcccaggaaatcgtggaagcg

SEQ ID NO: 407262 - DNA, 25 bp, Mus musculus
gctcctgcggagacctagatcagtg

SEQ ID NO: 407263 - DNA, 25 bp, Mus musculus
gacctagatcagtgctggccgagtg

SEQ ID NO: 407264 - DNA, 25 bp, Mus musculus
aacgcggtggccacttacgaatctc

SEQ ID NO: 407265 - DNA, 25 bp, Mus musculus
ggacccgtcacctggcagggcaacg

SEQ ID NO: 407266 - DNA, 25 bp, Mus musculus
aggggctaagccagagacccgccgc

SEQ ID NO: 407267 - DNA, 25 bp, Mus musculus
gcaggtagctctggggacccgtcac

SEQ ID NO: 407268 - DNA, 25 bp, Mus musculus
caacccggaaagaagcgaggcaggt

SEQ ID NO: 407269 - DNA, 25 bp, Mus musculus
ccgatggtggtattggcctcaaagt

SEQ ID NO: 407270 - DNA, 25 bp, Mus musculus
ggcgcggtgcaatgtcacccccgga

SEQ ID NO: 407271 - DNA, 25 bp, Mus musculus
gtgcatccgaaaaacacagcagccc

SEQ ID NO: 407272 - DNA, 25 bp, Mus musculus
cgaacgcgacgaaggtgcatccgaa

SEQ ID NO: 407273 - DNA, 25 bp, Mus musculus
caaggaaggcgaaagggagctgcgc

SEQ ID NO: 407274 - DNA, 25 bp, Mus musculus
aaaaacacagcagcccccatgactg

SEQ ID NO: 407275 - DNA, 25 bp, Mus musculus
aggtgcatccgaaaaacacagcagc

SEQ ID NO: 407276 - DNA, 25 bp, Mus musculus
gaaggtgcatccgaaaaacacagca

SEQ ID NO: 407277 - DNA, 25 bp, Mus musculus
gacgaaggtgcatccgaaaaacaca

SEQ ID NO: 407278 - DNA, 25 bp, Mus musculus
cgacgaaggtgcatccgaaaaacac

SEQ ID NO: 407279 - DNA, 25 bp, Mus musculus
gcgacgaaggtgcatccgaaaaaca

SEQ ID NO: 407280 - DNA, 25 bp, Mus musculus
cgcgacgaaggtgcatccgaaaaac

SEQ ID NO: 407281 - DNA, 25 bp, Mus musculus
aacgcgacgaaggtgcatccgaaaa

SEQ ID NO: 407282 - DNA, 25 bp, Mus musculus
gaacgcgacgaaggtgcatccgaaa

SEQ ID NO: 407283 - DNA, 25 bp, Mus musculus
cccatgactgggcagctggggaagg

SEQ ID NO: 407284 - DNA, 25 bp, Mus musculus
atagggacgcttcacaggagcgctc

SEQ ID NO: 407285 - DNA, 25 bp, Mus musculus
ggggcttgtagtcctcctgcccgaa

SEQ ID NO: 407286 - DNA, 25 bp, Mus musculus
ctccgcgcacgggtatctggggctt

SEQ ID NO: 407287 - DNA, 25 bp, Mus musculus
aatggcctgcccactctcgctggca

SEQ ID NO: 407288 - DNA, 25 bp, Mus musculus
cggtcttccgcctttcaatggcctg

SEQ ID NO: 407289 - DNA, 25 bp, Mus musculus
caggaagtcctgtaaccctcggtct

SEQ ID NO: 407290 - DNA, 25 bp, Mus musculus
cactccactgagctgggtggaagga

SEQ ID NO: 407291 - DNA, 25 bp, Mus musculus
cggctcgcgctccacaagtcacagc

SEQ ID NO: 407292 - DNA, 25 bp, Mus musculus
gctgacaaagctccaaaacgccaca

SEQ ID NO: 407293 - DNA, 25 bp, Mus musculus
cactcgctggcgctcgaacaggaag

SEQ ID NO: 407294 - DNA, 25 bp, Mus musculus
cgcgtactcgcctctcagcagccaa

SEQ ID NO: 407295 - DNA, 25 bp, Mus musculus
tggcgctcgaacaggaagtcctgta

SEQ ID NO: 407296 - DNA, 25 bp, Mus musculus
acctcgcactccactgagctgggtg

SEQ ID NO: 407297 - DNA, 25 bp, Mus musculus
ggaaggagacgcgtcacccacgtcc

SEQ ID NO: 407298 - DNA, 25 bp, Mus musculus
tgagtggtagcccaagacccttcgc

SEQ ID NO: 407299 - DNA, 25 bp, Mus musculus
ttttaaagcaaaggtctatcctagc

SEQ ID NO: 407300 - DNA, 25 bp, Mus musculus
ctgtgagcgcttccggctgatccaa

SEQ ID NO: 407301 - DNA, 25 bp, Mus musculus
ctttggccgccgagtgctgcggatc

SEQ ID NO: 407302 - DNA, 25 bp, Mus musculus
aggtctatcctagcctccacgaaaa

SEQ ID NO: 407303 - DNA, 25 bp, Mus musculus
tcccagtgcgtgagggccgactcca

SEQ ID NO: 407304 - DNA, 25 bp, Mus musculus
cttccggctgatccaaggctggggc

SEQ ID NO: 407305 - DNA, 25 bp, Mus musculus
ttccggcgtccttcgctgtgagcgc

SEQ ID NO: 407306 - DNA, 25 bp, Mus musculus
tagaagtagctaggcggccgctctt

SEQ ID NO: 407307 - DNA, 25 bp, Mus musculus
cgtcccggatgtagaagtagctagg

SEQ ID NO: 407308 - DNA, 25 bp, Mus musculus
ttccaagccggcgtcccggatgtag

SEQ ID NO: 407309 - DNA, 25 bp, Mus musculus
ggaagtgctcctccacagtagtccc

SEQ ID NO: 407310 - DNA, 25 bp, Mus musculus
gatccggaagtgctcctccacagta

SEQ ID NO: 407311 - DNA, 25 bp, Mus musculus
ctccacgaaaaatacagacggtccg

SEQ ID NO: 407312 - DNA, 25 bp, Mus musculus
cagcctctgtgagctgcgctctatc

SEQ ID NO: 407313 - DNA, 25 bp, Mus musculus
cagaagaggcttgcttcgtggaacc

SEQ ID NO: 407314 - DNA, 25 bp, Mus musculus
gcagcggcgggaatcttagccacta

SEQ ID NO: 407315 - DNA, 25 bp, Mus musculus
tgagcggcgtcttcgacactgctcc

SEQ ID NO: 407316 - DNA, 25 bp, Mus musculus
agccactacaggcaccatagatttg

SEQ ID NO: 407317 - DNA, 25 bp, Mus musculus
gcaccatagatttgttctgcacgca

SEQ ID NO: 407318 - DNA, 25 bp, Mus musculus
gttctgcacgcaaaacccaaccgaa

SEQ ID NO: 407319 - DNA, 25 bp, Mus musculus
gaaccgggccctgtgcagcagacgc

SEQ ID NO: 407320 - DNA, 25 bp, Mus musculus
agcagacgcgcggacgaaccactga

SEQ ID NO: 407321 - DNA, 25 bp, Mus musculus
gacgaaccactgagctggccacgcg

SEQ ID NO: 407322 - DNA, 25 bp, Mus musculus
ccgcagctacactcagaacctagaa

SEQ ID NO: 407323 - DNA, 25 bp, Mus musculus
tcagaacctagaaaccatatccggg

SEQ ID NO: 407324 - DNA, 25 bp, Mus musculus
ccatatccgggtaagaggtctcgtg

SEQ ID NO: 407325 - DNA, 25 bp, Mus musculus
cgacactgctcctggtgacagatca

SEQ ID NO: 407326 - DNA, 25 bp, Mus musculus
agcccatcggagaccgcaggtatcc

SEQ ID NO: 407327 - DNA, 25 bp, Mus musculus
agctttgagatcgagttgccctcca

SEQ ID NO: 407328 - DNA, 25 bp, Mus musculus
agaggctcgcctgaggtccttcctc

SEQ ID NO: 407329 - DNA, 25 bp, Mus musculus
ccgctgtgcttagaatgacccgggg

SEQ ID NO: 407330 - DNA, 25 bp, Mus musculus
tggaggtgaatccttacacgtaaca

SEQ ID NO: 407331 - DNA, 25 bp, Mus musculus
cgtaacaggttttgcgagtaagatt

SEQ ID NO: 407332 - DNA, 25 bp, Mus musculus
caaaggaaagccgtgcccagccaga

SEQ ID NO: 407333 - DNA, 25 bp, Mus musculus
gagtaagatttccagtcacgatttg

SEQ ID NO: 407334 - DNA, 25 bp, Mus musculus
gcccagccagattcgagctttttta

SEQ ID NO: 407335 - DNA, 25 bp, Mus musculus
tttgtcgaggtaaaaagccagtgta

SEQ ID NO: 407336 - DNA, 25 bp, Mus musculus
caacaggttagaagtgcgttacatg

SEQ ID NO: 407337 - DNA, 25 bp, Mus musculus
gcgttacatgtaaagccacggaata

SEQ ID NO: 407338 - DNA, 25 bp, Mus musculus
cacgatttgcgtggaactgttacca

SEQ ID NO: 407339 - DNA, 25 bp, Mus musculus
ctgttaccagccgagactgcagatg

SEQ ID NO: 407340 - DNA, 25 bp, Mus musculus
gtaaggcaaatctccgcaagaccgc

SEQ ID NO: 407341 - DNA, 25 bp, Mus musculus
cgcaggcactaagagcgctcggagc

SEQ ID NO: 407342 - DNA, 25 bp, Mus musculus
tccacgccgtggaaaaacggcgcgc

SEQ ID NO: 407343 - DNA, 25 bp, Mus musculus
acacgccgcgcacatgggcgacgag

SEQ ID NO: 407344 - DNA, 25 bp, Mus musculus
gggcgacgagccctgctccggatct

SEQ ID NO: 407345 - DNA, 25 bp, Mus musculus
atcgggcctcttcacggtccggacg

SEQ ID NO: 407346 - DNA, 25 bp, Mus musculus
cccgccagggttgagaaccaagtct

SEQ ID NO: 407347 - DNA, 25 bp, Mus musculus
agaaccaagtctgcgcgcttccaag

SEQ ID NO: 407348 - DNA, 25 bp, Mus musculus
gattgcctcgagagaccgtccgcag

SEQ ID NO: 407349 - DNA, 25 bp, Mus musculus
cgtacaaaccgccaaagcactttcg

SEQ ID NO: 407350 - DNA, 25 bp, Mus musculus
agcactttcgctacctcctgagagg

SEQ ID NO: 407351 - DNA, 25 bp, Mus musculus
ccctacgtgctacgtcatgacgttg

SEQ ID NO: 407352 - DNA, 25 bp, Mus musculus
catgacgttgcgtacgtaaggcaaa

SEQ ID NO: 407353 - DNA, 25 bp, Mus musculus
accacaggagcatccgcaggcacta

SEQ ID NO: 407354 - DNA, 25 bp, Mus musculus
tgcgatcagcaaccagccacttttc

SEQ ID NO: 407355 - DNA, 25 bp, Mus musculus
gcctgcctgcgggatttctgaccgc

SEQ ID NO: 407356 - DNA, 25 bp, Mus musculus
cgctccgcccgaactggagatgcag

SEQ ID NO: 407357 - DNA, 25 bp, Mus musculus
agtggtggccgcagaatccctgcat

SEQ ID NO: 407358 - DNA, 25 bp, Mus musculus
cagcgcccgcttggcttacagcatt

SEQ ID NO: 407359 - DNA, 25 bp, Mus musculus
ctcatcggtctttctgcgatcagca

SEQ ID NO: 407360 - DNA, 25 bp, Mus musculus
tcctaacttcttaacgccttgtctc

SEQ ID NO: 407361 - DNA, 25 bp, Mus musculus
cgaaaccgaagcctggaacacgctc

SEQ ID NO: 407362 - DNA, 25 bp, Mus musculus
ctgccactggtcagtcccggtgact

SEQ ID NO: 407363 - DNA, 25 bp, Mus musculus
tcgcccacactttcgtctgcttgtg

SEQ ID NO: 407364 - DNA, 25 bp, Mus musculus
ctcctccaggtctagcaggtgactg

SEQ ID NO: 407365 - DNA, 25 bp, Mus musculus
gcaggtgactgacggagaagttctt

SEQ ID NO: 407366 - DNA, 25 bp, Mus musculus
gaagttctttttcgcctgcagggtg

SEQ ID NO: 407367 - DNA, 25 bp, Mus musculus
gggagccctctttttctcatcggtc

SEQ ID NO: 407368 - DNA, 25 bp, Mus musculus
taagcaggctgtgtcgctgcgaatg

SEQ ID NO: 407369 - DNA, 25 bp, Mus musculus
tcttggagttcagcctcagagcccg

SEQ ID NO: 407370 - DNA, 25 bp, Mus musculus
ctgatgactctgacgtttgacgccc

SEQ ID NO: 407371 - DNA, 25 bp, Mus musculus
ggctccggctcctacacattgatac

SEQ ID NO: 407372 - DNA, 25 bp, Mus musculus
cccacgtggccgtgggctccggctc

SEQ ID NO: 407373 - DNA, 25 bp, Mus musculus
gccctctgatgactctgacgtttga

SEQ ID NO: 407374 - DNA, 25 bp, Mus musculus
tggccctctgatgactctgacgttt

SEQ ID NO: 407375 - DNA, 25 bp, Mus musculus
cgctgcgaatggtaggcactgtccc

SEQ ID NO: 407376 - DNA, 25 bp, Mus musculus
agcccgtcacatggccctctgatga

SEQ ID NO: 407377 - DNA, 25 bp, Mus musculus
ctctcttggagttcagcctcagagc

SEQ ID NO: 407378 - DNA, 25 bp, Mus musculus
cacattgatactctctcttggagtt

SEQ ID NO: 407379 - DNA, 25 bp, Mus musculus
ggctcctacacattgatactctctc

SEQ ID NO: 407380 - DNA, 25 bp, Mus musculus
atgggacgggagaactgttcgcgac

SEQ ID NO: 407381 - DNA, 25 bp, Mus musculus
tcacatggccctctgatgactctga

SEQ ID NO: 407382 - DNA, 25 bp, Mus musculus
agacacacgcagagaggcttccctg

SEQ ID NO: 407383 - DNA, 25 bp, Mus musculus
gcagagaggcttccctgccgccaga

SEQ ID NO: 407384 - DNA, 25 bp, Mus musculus
cgcgccctcgcagcacctgtgcggc

SEQ ID NO: 407385 - DNA, 25 bp, Mus musculus
tctagctcggttccgggttcgcgcc

SEQ ID NO: 407386 - DNA, 25 bp, Mus musculus
atgaactcaaaagcggctggttaaa

SEQ ID NO: 407387 - DNA, 25 bp, Mus musculus
cgtcggaggaactgaaggcccggct

SEQ ID NO: 407388 - DNA, 25 bp, Mus musculus
aaggcccggctgttgagccgcttcc

SEQ ID NO: 407389 - DNA, 25 bp, Mus musculus
gcccgcaggtaaccgggagccgtgc

SEQ ID NO: 407390 - DNA, 25 bp, Mus musculus
cccgacgagcgtccacactcagccc

SEQ ID NO: 407391 - DNA, 25 bp, Mus musculus
cctgtgcggccgctctagctcggtt

SEQ ID NO: 407392 - DNA, 25 bp, Mus musculus
caaacatgaaaaccgggatgcccct

SEQ ID NO: 407393 - DNA, 25 bp, Mus musculus
cgggcggaaatgaactcaaaagcgg

SEQ ID NO: 407394 - DNA, 25 bp, Mus musculus
gtcgggctgaagacacacgcagaga

SEQ ID NO: 407395 - DNA, 25 bp, Mus musculus
cctgcagtcgggctgaagacacacg

SEQ ID NO: 407396 - DNA, 25 bp, Mus musculus
ggcgtctgactttccaatgctgaga

SEQ ID NO: 407397 - DNA, 25 bp, Mus musculus
atcgtccgacaatgctaggcgcgcc

SEQ ID NO: 407398 - DNA, 25 bp, Mus musculus
gttgtcctcgttcccttaaccatca

SEQ ID NO: 407399 - DNA, 25 bp, Mus musculus
agttcgaatcccaggctgcccgcgt

SEQ ID NO: 407400 - DNA, 25 bp, Mus musculus
cgctcagcgccctccaaggatatga

SEQ ID NO: 407401 - DNA, 25 bp, Mus musculus
atctcctccgaccagctgctgagtt

SEQ ID NO: 407402 - DNA, 25 bp, Mus musculus
cgccgtcccagcaggctttgagaga

SEQ ID NO: 407403 - DNA, 25 bp, Mus musculus
aggctgaaggcgagtttctccggta

SEQ ID NO: 407404 - DNA, 25 bp, Mus musculus
tcaggtttgctatcctcagtccggg

SEQ ID NO: 407405 - DNA, 25 bp, Mus musculus
cgacgcgtagtttcaagggtgacct

SEQ ID NO: 407406 - DNA, 25 bp, Mus musculus
gctgaggccaggaatgactctactc

SEQ ID NO: 407407 - DNA, 25 bp, Mus musculus
gattttactggcgtgcgtgcttccg

SEQ ID NO: 407408 - DNA, 25 bp, Mus musculus
tcctgccaagtgaacggagatccca

SEQ ID NO: 407409 - DNA, 25 bp, Mus musculus
tcggggccctctctagctattggag

SEQ ID NO: 407410 - DNA, 25 bp, Mus musculus
atggcatcaccacgggcaccgcgag

SEQ ID NO: 407411 - DNA, 25 bp, Mus musculus
cggtctcccaggatgagtttggttc

SEQ ID NO: 407412 - DNA, 25 bp, Mus musculus
gcagaataccggcttgaccctaagt

SEQ ID NO: 407413 - DNA, 25 bp, Mus musculus
cacccagcagggttcgagtctgtct

SEQ ID NO: 407414 - DNA, 25 bp, Mus musculus
tcctttagtctggtggctgccactc

SEQ ID NO: 407415 - DNA, 25 bp, Mus musculus
gtgtccctcgctttcctttagtctg

SEQ ID NO: 407416 - DNA, 25 bp, Mus musculus
ggcgtcactttgtgaggtgtccctc

SEQ ID NO: 407417 - DNA, 25 bp, Mus musculus
tccaattccaaatccggacctgttg

SEQ ID NO: 407418 - DNA, 25 bp, Mus musculus
gtccggatttctgccgcttccaatt

SEQ ID NO: 407419 - DNA, 25 bp, Mus musculus
tctgcaggaggaaacccgcagccga

SEQ ID NO: 407420 - DNA, 25 bp, Mus musculus
ttcttcctgggactcggagctgtcc

SEQ ID NO: 407421 - DNA, 25 bp, Mus musculus
gccggtacttgacgttgcgccgaca

SEQ ID NO: 407422 - DNA, 25 bp, Mus musculus
acagatagttctgcacccgccggta

SEQ ID NO: 407423 - DNA, 25 bp, Mus musculus
cgggtactcacacgaacgcgtggta

SEQ ID NO: 407424 - DNA, 25 bp, Mus musculus
aaaatgcctggtgaccgatccgacc

SEQ ID NO: 407425 - DNA, 25 bp, Mus musculus
cccaagcggcctttctgtcttttga

SEQ ID NO: 407426 - DNA, 25 bp, Mus musculus
tgagccactggccaatagggaagca

SEQ ID NO: 407427 - DNA, 25 bp, Mus musculus
tttctgtcttttgagccactggcca

SEQ ID NO: 407428 - DNA, 25 bp, Mus musculus
tcgccacagagtccagacatggccc

SEQ ID NO: 407429 - DNA, 25 bp, Mus musculus
cgctgcgatgaagcacacatccggg

SEQ ID NO: 407430 - DNA, 25 bp, Mus musculus
gcctggtgaccgatccgaccaggga

SEQ ID NO: 407431 - DNA, 25 bp, Mus musculus
tgaagcacacatccggggatcccgc

SEQ ID NO: 407432 - DNA, 25 bp, Mus musculus
acatccggggatcccgctctaggga

SEQ ID NO: 407433 - DNA, 25 bp, Mus musculus
gtgtgtagggtcctcgccacagagt

SEQ ID NO: 407434 - DNA, 25 bp, Mus musculus
gatcccgctctagggagccttccgg

SEQ ID NO: 407435 - DNA, 25 bp, Mus musculus
gccttccggacgtgtgatcggaaaa

SEQ ID NO: 407436 - DNA, 25 bp, Mus musculus
tgtgatcggaaaatgcctggtgacc

SEQ ID NO: 407437 - DNA, 25 bp, Mus musculus
ccactggccaatagggaagcaggga

SEQ ID NO: 407438 - DNA, 25 bp, Mus musculus
cgggctacgcagatatctgttcgga

SEQ ID NO: 407439 - DNA, 25 bp, Mus musculus
acgttccgtgcgagactaagcaaga

SEQ ID NO: 407440 - DNA, 25 bp, Mus musculus
tttgcgtttctagcacgttccgtgc

SEQ ID NO: 407441 - DNA, 25 bp, Mus musculus
agtggccttactctttgcgtttcta

SEQ ID NO: 407442 - DNA, 25 bp, Mus musculus
tctgctcgcttggaaaagtggcctt

SEQ ID NO: 407443 - DNA, 25 bp, Mus musculus
ctgttcggatttctgctcgcttgga

SEQ ID NO: 407444 - DNA, 25 bp, Mus musculus
cccggagcgggctacgcagatatct

SEQ ID NO: 407445 - DNA, 25 bp, Mus musculus
catgtcagatgtttgtggagggtct

SEQ ID NO: 407446 - DNA, 25 bp, Mus musculus
aggccgagcatgtcagatgtttgtg

SEQ ID NO: 407447 - DNA, 25 bp, Mus musculus
cgtatgtggataacccggttctgcc

SEQ ID NO: 407448 - DNA, 25 bp, Mus musculus
actaagcaagatgggccgcagccca

SEQ ID NO: 407449 - DNA, 25 bp, Mus musculus
cgcagcccacgtgcatgtgtgtttc

SEQ ID NO: 407450 - DNA, 25 bp, Mus musculus
tttcaggccgtatgtggataacccg

SEQ ID NO: 407451 - DNA, 25 bp, Mus musculus
cgtgcatgtgtgtttcaggccgtat

SEQ ID NO: 407452 - DNA, 25 bp, Mus musculus
tcgcgttgccccaggcgatgaggca

SEQ ID NO: 407453 - DNA, 25 bp, Mus musculus
aacttccgggtcactaccagccaga

SEQ ID NO: 407454 - DNA, 25 bp, Mus musculus
tatggacgcttaaacttccgggtca

SEQ ID NO: 407455 - DNA, 25 bp, Mus musculus
gggtcactaccagccagacggaagt

SEQ ID NO: 407456 - DNA, 25 bp, Mus musculus
cagacggaagtgaacgcgttggaac

SEQ ID NO: 407457 - DNA, 25 bp, Mus musculus
ttcgaggcggcgtcttcgaagcagt

SEQ ID NO: 407458 - DNA, 25 bp, Mus musculus
caaagggtggatctttgagtgaatg

SEQ ID NO: 407459 - DNA, 25 bp, Mus musculus
atgggcggggcctaattactcccag

SEQ ID NO: 407460 - DNA, 25 bp, Mus musculus
ggggcctaattactcccagccaatg

SEQ ID NO: 407461 - DNA, 25 bp, Mus musculus
tcccagccaatggagacgaagcagc

SEQ ID NO: 407462 - DNA, 25 bp, Mus musculus
gccaatggagacgaagcagcttcga

SEQ ID NO: 407463 - DNA, 25 bp, Mus musculus
aagcagcttcgaggcggcgtcttcg

SEQ ID NO: 407464 - DNA, 25 bp, Mus musculus
cggggcttgcgttgccagagtaacc

SEQ ID NO: 407465 - DNA, 25 bp, Mus musculus
ccagccagacggaagtgaacgcgtt

SEQ ID NO: 407466 - DNA, 25 bp, Mus musculus
agctgcaccactctgcttgctgtga

SEQ ID NO: 407467 - DNA, 25 bp, Mus musculus
ctctctgggaacctcggagacctca

SEQ ID NO: 407468 - DNA, 25 bp, Mus musculus
acgcgcctcctaagaaaagccaagg

SEQ ID NO: 407469 - DNA, 25 bp, Mus musculus
gcggagcgcgtacttacaccaacta

SEQ ID NO: 407470 - DNA, 25 bp, Mus musculus
tccttcttctccgagttccagatga

SEQ ID NO: 407471 - DNA, 25 bp, Mus musculus
agatgaatttcttccagctgccttc

SEQ ID NO: 407472 - DNA, 25 bp, Mus musculus
tctccgaaagcgagacgcgccgctg

SEQ ID NO: 407473 - DNA, 25 bp, Mus musculus
tgctgcttcaagctgtagctgcacc

SEQ ID NO: 407474 - DNA, 25 bp, Mus musculus
gggcgcacgccctacctttactata

SEQ ID NO: 407475 - DNA, 25 bp, Mus musculus
gggtgagtactgctcccgcagctct

SEQ ID NO: 407476 - DNA, 25 bp, Mus musculus
agctgtgcctggacaatcctcctcg

SEQ ID NO: 407477 - DNA, 25 bp, Mus musculus
tcgccaatgctgtggcctgcacctg

SEQ ID NO: 407478 - DNA, 25 bp, Mus musculus
ctgcacctgcatcgctctctgggaa

SEQ ID NO: 407479 - DNA, 25 bp, Mus musculus
tgctgtgacctctggcgagatggac

SEQ ID NO: 407480 - DNA, 25 bp, Mus musculus
gccgctcagaactttcttcagcttg

SEQ ID NO: 407481 - DNA, 25 bp, Mus musculus
actcccactccacagatttctgagg

SEQ ID NO: 407482 - DNA, 25 bp, Mus musculus
ttctgaggtcttgcttcagagcctc

SEQ ID NO: 407483 - DNA, 25 bp, Mus musculus
ttcagagcctcaagcccttcggagg

SEQ ID NO: 407484 - DNA, 25 bp, Mus musculus
gttcgggagccacgccttccacaaa

SEQ ID NO: 407485 - DNA, 25 bp, Mus musculus
acaaagctcgcgctgccacctgtgg

SEQ ID NO: 407486 - DNA, 25 bp, Mus musculus
cctgtggctgtgtcccggcagagct

SEQ ID NO: 407487 - DNA, 25 bp, Mus musculus
cagctgtccaagaaatgccaactcc

SEQ ID NO: 407488 - DNA, 25 bp, Mus musculus
tcctcggtgtcctggccgctcagaa

SEQ ID NO: 407489 - DNA, 25 bp, Mus musculus
gcctaccactcttcggggtgcgcag

SEQ ID NO: 407490 - DNA, 25 bp, Mus musculus
cggcggtggatccttccacgaaggc

SEQ ID NO: 407491 - DNA, 25 bp, Mus musculus
ttcagcttgtccatgtcagggtccc

SEQ ID NO: 407492 - DNA, 25 bp, Mus musculus
tcggacagaccgctgcggtcctcgg

SEQ ID NO: 407493 - DNA, 25 bp, Mus musculus
ccctgaacgagctccttggggtcac

SEQ ID NO: 407494 - DNA, 25 bp, Mus musculus
gcgagcagggaacaggaccatttac

SEQ ID NO: 407495 - DNA, 25 bp, Mus musculus
ttgcccgcaagggaacaggtcatcg

SEQ ID NO: 407496 - DNA, 25 bp, Mus musculus
cgcccagaaaggttgcgcaggctta

SEQ ID NO: 407497 - DNA, 25 bp, Mus musculus
gtgaagtccaccaaaacagccgcgc

SEQ ID NO: 407498 - DNA, 25 bp, Mus musculus
tacagttccagcaagcagaggtcgc

SEQ ID NO: 407499 - DNA, 25 bp, Mus musculus
tgtcaatcaacggtcggtcagaggg

SEQ ID NO: 407500 - DNA, 25 bp, Mus musculus
acttcatgatgtgggtcttggacgc

SEQ ID NO: 407501 - DNA, 25 bp, Mus musculus
tccaaggcccgaaggagaagtcctg

SEQ ID NO: 407502 - DNA, 25 bp, Mus musculus
gctgctctgaaagccgtggatcatc

SEQ ID NO: 407503 - DNA, 25 bp, Mus musculus
tcatcatggcagaagcggagccgca

SEQ ID NO: 407504 - DNA, 25 bp, Mus musculus
agccgcagggttactcggagcaagc

SEQ ID NO: 407505 - DNA, 25 bp, Mus musculus
ttacttccgggaccactagctcagg

SEQ ID NO: 407506 - DNA, 25 bp, Mus musculus
ctagctcagggtgacacacgtctta

SEQ ID NO: 407507 - DNA, 25 bp, Mus musculus
agccgcgctcagttcaaccctgaga

SEQ ID NO: 407508 - DNA, 25 bp, Mus musculus
tccaatcggccagaggctcttcaga

SEQ ID NO: 407509 - DNA, 25 bp, Mus musculus
agaagcccacctggttctgctgggt

SEQ ID NO: 407510 - DNA, 25 bp, Mus musculus
cccagggaagggagagcatcagttc

SEQ ID NO: 407511 - DNA, 25 bp, Mus musculus
gcggctacaaccctcggctggaacc

SEQ ID NO: 407512 - DNA, 25 bp, Mus musculus
agaggctcttcagaagcccacctgg

SEQ ID NO: 407513 - DNA, 25 bp, Mus musculus
ttggagctctttgtgggaagagcct

SEQ ID NO: 407514 - DNA, 25 bp, Mus musculus
ctggctttggagctctttgtgggaa

SEQ ID NO: 407515 - DNA, 25 bp, Mus musculus
tttgcgtctggctttggagctcttt

SEQ ID NO: 407516 - DNA, 25 bp, Mus musculus
cggagtctcattcccggctgtaccg

SEQ ID NO: 407517 - DNA, 25 bp, Mus musculus
cgtcggagtctcattcccggctgta

SEQ ID NO: 407518 - DNA, 25 bp, Mus musculus
ttcggcgttccgcttctcccggagc

SEQ ID NO: 407519 - DNA, 25 bp, Mus musculus
gcagctgcgctgaaggcattgtgct

SEQ ID NO: 407520 - DNA, 25 bp, Mus musculus
ctgggtgcagccggttccattcctt

SEQ ID NO: 407521 - DNA, 25 bp, Mus musculus
gaagggagagcatcagttcgtgccc

SEQ ID NO: 407522 - DNA, 25 bp, Mus musculus
tgcaaactgcaaccggagccgtagt

SEQ ID NO: 407523 - DNA, 25 bp, Mus musculus
gaaatcgcactgtctccggccgctt

SEQ ID NO: 407524 - DNA, 25 bp, Mus musculus
cccggaggctgcgtgaaatcgcact

SEQ ID NO: 407525 - DNA, 25 bp, Mus musculus
cgtaactcatgtacccagctcggga

SEQ ID NO: 407526 - DNA, 25 bp, Mus musculus
gcctagcgttcatgccacctcagtt

SEQ ID NO: 407527 - DNA, 25 bp, Mus musculus
tcgagtgggaggttgtttttcagcc

SEQ ID NO: 407528 - DNA, 25 bp, Mus musculus
ccctagccggttggatcacttgagg

SEQ ID NO: 407529 - DNA, 25 bp, Mus musculus
gaaagctggcctcgcccattaacca

SEQ ID NO: 407530 - DNA, 25 bp, Mus musculus
cccggagatggttaagaggagatca

SEQ ID NO: 407531 - DNA, 25 bp, Mus musculus
gaggggtctcactccagcaatttcc

SEQ ID NO: 407532 - DNA, 25 bp, Mus musculus
agcccacagcttggccaagagggtc

SEQ ID NO: 407533 - DNA, 25 bp, Mus musculus
cgcggggaagtcaccgcacatgacc

SEQ ID NO: 407534 - DNA, 25 bp, Mus musculus
tcctgatggttgtagcccgagacac

SEQ ID NO: 407535 - DNA, 25 bp, Mus musculus
cggcctcccgagagaacagctgtct

SEQ ID NO: 407536 - DNA, 25 bp, Mus musculus
gggcgctctagcctactccttaatg

SEQ ID NO: 407537 - DNA, 25 bp, Mus musculus
ttttcctcacgtcccacaacaggtg

SEQ ID NO: 407538 - DNA, 25 bp, Mus musculus
acatctagagatcggcaacagtccc

SEQ ID NO: 407539 - DNA, 25 bp, Mus musculus
cccttctcgcgagaggatgcacacg

SEQ ID NO: 407540 - DNA, 25 bp, Mus musculus
agaagccgctgtgcgtcacgattgc

SEQ ID NO: 407541 - DNA, 25 bp, Mus musculus
ccctcaccctaggagaggagcttga

SEQ ID NO: 407542 - DNA, 25 bp, Mus musculus
aagccgctgaggttgtcttgctcac

SEQ ID NO: 407543 - DNA, 25 bp, Mus musculus
tgctcacgcctctcgagtcaaagga

SEQ ID NO: 407544 - DNA, 25 bp, Mus musculus
ggcgtgatgacccatgcatgcaatc

SEQ ID NO: 407545 - DNA, 25 bp, Mus musculus
ccatagcgagatccaagccagcctg

SEQ ID NO: 407546 - DNA, 25 bp, Mus musculus
gcctggggtacacagcgaagacacc

SEQ ID NO: 407547 - DNA, 25 bp, Mus musculus
agtccgacaggtatccagcgtcatc

SEQ ID NO: 407548 - DNA, 25 bp, Mus musculus
aggagatgatttctggccacgcctc

SEQ ID NO: 407549 - DNA, 25 bp, Mus musculus
ccagcgtcatcttcagttcgggaga

SEQ ID NO: 407550 - DNA, 25 bp, Mus musculus
cgccctctacgcaaagggatccaaa

SEQ ID NO: 407551 - DNA, 25 bp, Mus musculus
ggtcctcctggcaacctgggaaaga

SEQ ID NO: 407552 - DNA, 25 bp, Mus musculus
agcatcgcggctagcaccgaccaca

SEQ ID NO: 407553 - DNA, 25 bp, Mus musculus
ggggccgcaatcagtgccacggctc

SEQ ID NO: 407554 - DNA, 25 bp, Mus musculus
gcaatcagtgccacggctccgacgg

SEQ ID NO: 407555 - DNA, 25 bp, Mus musculus
gtcggctggcttgccttagaccaca

SEQ ID NO: 407556 - DNA, 25 bp, Mus musculus
ggcttgccttagaccacacagctct

SEQ ID NO: 407557 - DNA, 25 bp, Mus musculus
acacagctctgtccggatcgcggct

SEQ ID NO: 407558 - DNA, 25 bp, Mus musculus
ggctgcgagcgcgaggacacctcca

SEQ ID NO: 407559 - DNA, 25 bp, Mus musculus
actgctcgctcattggtcctcctgg

SEQ ID NO: 407560 - DNA, 25 bp, Mus musculus
ttggacaactcgactccctgtcagc

SEQ ID NO: 407561 - DNA, 25 bp, Mus musculus
tcctggcaacctgggaaagaagcca

SEQ ID NO: 407562 - DNA, 25 bp, Mus musculus
aagaagccattggacaactcgactc

SEQ ID NO: 407563 - DNA, 25 bp, Mus musculus
tccaaagaaagaggttcctcggctc

SEQ ID NO: 407564 - DNA, 25 bp, Mus musculus
ccgctcacagcggaaccgagctggg

SEQ ID NO: 407565 - DNA, 25 bp, Mus musculus
ggctgacctggtccggaaaccatct

SEQ ID NO: 407566 - DNA, 25 bp, Mus musculus
gtccggaaaccatctcgcgcgaaca

SEQ ID NO: 407567 - DNA, 25 bp, Mus musculus
ccatctcgcgcgaacagttcttttg

SEQ ID NO: 407568 - DNA, 25 bp, Mus musculus
gatcaggccggaagagaatcagtgc

SEQ ID NO: 407569 - DNA, 25 bp, Mus musculus
gaaccggcttggaagggatcaggcc

SEQ ID NO: 407570 - DNA, 25 bp, Mus musculus
acagcggaaccgagctgggttcgcc

SEQ ID NO: 407571 - DNA, 25 bp, Mus musculus
cctttgcccagaggacggctctgga

SEQ ID NO: 407572 - DNA, 25 bp, Mus musculus
gctctcagggcctcccttaaggctt

SEQ ID NO: 407573 - DNA, 25 bp, Mus musculus
acagttcttttggttccgaggctct

SEQ ID NO: 407574 - DNA, 25 bp, Mus musculus
tcccttaaggcttccgcggggctga

SEQ ID NO: 407575 - DNA, 25 bp, Mus musculus
ctcgcgcgaacagttcttttggttc

SEQ ID NO: 407576 - DNA, 25 bp, Mus musculus
acgggcatccggtcctcggccaccg

SEQ ID NO: 407577 - DNA, 25 bp, Mus musculus
gcgcctttgcccagaggacggctct

SEQ ID NO: 407578 - DNA, 25 bp, Mus musculus
gctttctcgcgcttggccttgcgca

SEQ ID NO: 407579 - DNA, 25 bp, Mus musculus
tctgctgcaaacgtccgggaacatc

SEQ ID NO: 407580 - DNA, 25 bp, Mus musculus
gcaccacagacttggggacacgttt

SEQ ID NO: 407581 - DNA, 25 bp, Mus musculus
ggtagtcctgagagcgccctttctc

SEQ ID NO: 407582 - DNA, 25 bp, Mus musculus
tgcgcatctgctgttcctccagcgg

SEQ ID NO: 407583 - DNA, 25 bp, Mus musculus
cgagtcgttccgcagcatgctttcc

SEQ ID NO: 407584 - DNA, 25 bp, Mus musculus
ctgatcggagctcagcgagtcgttc

SEQ ID NO: 407585 - DNA, 25 bp, Mus musculus
atggccgcaccgactcggactgatc

SEQ ID NO: 407586 - DNA, 25 bp, Mus musculus
ctcggagctgctcaccgacatctga

SEQ ID NO: 407587 - DNA, 25 bp, Mus musculus
agctcgtgtactccggcgtggacac

SEQ ID NO: 407588 - DNA, 25 bp, Mus musculus
cgggaacatcactcccgcgcaggtg

SEQ ID NO: 407589 - DNA, 25 bp, Mus musculus
tctaagtgcggctcacaggcatgcc

SEQ ID NO: 407590 - DNA, 25 bp, Mus musculus
ctgtgcgtctggtacgcagggacct

SEQ ID NO: 407591 - DNA, 25 bp, Mus musculus
cgctgcggtacctagtctgatactc

SEQ ID NO: 407592 - DNA, 25 bp, Mus musculus
ctttcggctgcgtgctccctgctga

SEQ ID NO: 407593 - DNA, 25 bp, Mus musculus
tctctcgggttaagagcccacgatc

SEQ ID NO: 407594 - DNA, 25 bp, Mus musculus
tgctccctgctgagagcaggaacgg

SEQ ID NO: 407595 - DNA, 25 bp, Mus musculus
ccagcccgggtcactttcggggctg

SEQ ID NO: 407596 - DNA, 25 bp, Mus musculus
gttaagagcccacgatccccgctgt

SEQ ID NO: 407597 - DNA, 25 bp, Mus musculus
tctcgggttaagagcccacgatccc

SEQ ID NO: 407598 - DNA, 25 bp, Mus musculus
cgctctctcgggttaagagcccacg

SEQ ID NO: 407599 - DNA, 25 bp, Mus musculus
ctgcgtgctccctgctgagagcagg

SEQ ID NO: 407600 - DNA, 25 bp, Mus musculus
cggctgcggatacgcccgctctctc

SEQ ID NO: 407601 - DNA, 25 bp, Mus musculus
tgtcctccaggtagtcttcctccgg

SEQ ID NO: 407602 - DNA, 25 bp, Mus musculus
tccatgtcctccaggtagtcttcct

SEQ ID NO: 407603 - DNA, 25 bp, Mus musculus
ctgctgagagcaggaacggcgacct

SEQ ID NO: 407604 - DNA, 25 bp, Mus musculus
tgggcaggagcgctctgacctccct

SEQ ID NO: 407605 - DNA, 25 bp, Mus musculus
cgccggtcttttacctccatgtcct

SEQ ID NO: 407606 - DNA, 25 bp, Mus musculus
tccagtttagctcgctggggagagc

SEQ ID NO: 407607 - DNA, 25 bp, Mus musculus
ctcacgtctcagactggggctcgct

SEQ ID NO: 407608 - DNA, 25 bp, Mus musculus
actccgcagtcagcgtcatggctgc

SEQ ID NO: 407609 - DNA, 25 bp, Mus musculus
cggaacaacgggcaggcaatagtta

SEQ ID NO: 407610 - DNA, 25 bp, Mus musculus
ggacaggcgattgcctccgctgcca

SEQ ID NO: 407611 - DNA, 25 bp, Mus musculus
gtggcccgcttcgtgactcacgtct

SEQ ID NO: 407612 - DNA, 25 bp, Mus musculus
ctggccactatctccacaataaagg

SEQ ID NO: 407613 - DNA, 25 bp, Mus musculus
tggcccttcgcggacatcatctcaa

SEQ ID NO: 407614 - DNA, 25 bp, Mus musculus
tctcaatcagtgacggtcctccggg

SEQ ID NO: 407615 - DNA, 25 bp, Mus musculus
ggcgagccctacatgtacctgagtc

SEQ ID NO: 407616 - DNA, 25 bp, Mus musculus
ctgagtccactgcagcaagccgtga

SEQ ID NO: 407617 - DNA, 25 bp, Mus musculus
aggaaaccagcgtctccagtttagc

SEQ ID NO: 407618 - DNA, 25 bp, Mus musculus
tcatggctgcccgtgctcctgagct

SEQ ID NO: 407619 - DNA, 25 bp, Mus musculus
ccagacccggcagagcaggaaacca

SEQ ID NO: 407620 - DNA, 25 bp, Mus musculus
gcggctgagtgtgagcggttcagat

SEQ ID NO: 407621 - DNA, 25 bp, Mus musculus
gctggaggctctgcgaaaggtccgg

SEQ ID NO: 407622 - DNA, 25 bp, Mus musculus
tcagatgggagatcactggcgataa

SEQ ID NO: 407623 - DNA, 25 bp, Mus musculus
atgggagatcactggcgataacccg

SEQ ID NO: 407624 - DNA, 25 bp, Mus musculus
agatcactggcgataacccggcccg

SEQ ID NO: 407625 - DNA, 25 bp, Mus musculus
cactggcgataacccggcccgggat

SEQ ID NO: 407626 - DNA, 25 bp, Mus musculus
atggcgacgctcgacaggaaacctc

SEQ ID NO: 407627 - DNA, 25 bp, Mus musculus
cgacaggaaacctcgagcaagcagg

SEQ ID NO: 407628 - DNA, 25 bp, Mus musculus
aacctcgagcaagcagggagccagc

SEQ ID NO: 407629 - DNA, 25 bp, Mus musculus
agcagggagccagctgcgggccaag

SEQ ID NO: 407630 - DNA, 25 bp, Mus musculus
gggtgactttcggtaaccgcacagc

SEQ ID NO: 407631 - DNA, 25 bp, Mus musculus
tttcggtaaccgcacagcagccggc

SEQ ID NO: 407632 - DNA, 25 bp, Mus musculus
taaccgcacagcagccggcgggaca

SEQ ID NO: 407633 - DNA, 25 bp, Mus musculus
ggcgacgctcgacaggaaacctcga

SEQ ID NO: 407634 - DNA, 25 bp, Mus musculus
catctcctcgccgttaattataata

SEQ ID NO: 407635 - DNA, 25 bp, Mus musculus
atgtctttattgtcctctcccggtg

SEQ ID NO: 407636 - DNA, 25 bp, Mus musculus
gcctgccgtggacccgcttagattc

SEQ ID NO: 407637 - DNA, 25 bp, Mus musculus
cttagattcgggcaccgtgcgagga

SEQ ID NO: 407638 - DNA, 25 bp, Mus musculus
gagcccggctcgagtatgaatatga

SEQ ID NO: 407639 - DNA, 25 bp, Mus musculus
tgtaaaatgctgtaatgattacctg

SEQ ID NO: 407640 - DNA, 25 bp, Mus musculus
cgccagcccagcagctatgaatatg

SEQ ID NO: 407641 - DNA, 25 bp, Mus musculus
gaactctcatcttgactcgctgctc

SEQ ID NO: 407642 - DNA, 25 bp, Mus musculus
taggaagcgcatgcgcgtctcttcg

SEQ ID NO: 407643 - DNA, 25 bp, Mus musculus
cctccgtccgccattttgaatattt

SEQ ID NO: 407644 - DNA, 25 bp, Mus musculus
cgcagttttctccacgcgccggaga

SEQ ID NO: 407645 - DNA, 25 bp, Mus musculus
tgccaatcatctcttccttgttttg

SEQ ID NO: 407646 - DNA, 25 bp, Mus musculus
taataaattatgctaagtcgcgggg

SEQ ID NO: 407647 - DNA, 25 bp, Mus musculus
gccgcggctgaactctcatcttgac

SEQ ID NO: 407648 - DNA, 25 bp, Mus musculus
cacttggccaatcagggtgcagcgc

SEQ ID NO: 407649 - DNA, 25 bp, Mus musculus
cctcgccggcgcagttcgggaatct

SEQ ID NO: 407650 - DNA, 25 bp, Mus musculus
cgcagttcgggaatcttctcctgta

SEQ ID NO: 407651 - DNA, 25 bp, Mus musculus
tctcctgtacgaagaaatagtaggc

SEQ ID NO: 407652 - DNA, 25 bp, Mus musculus
gaagaaatagtaggcattgcggctg

SEQ ID NO: 407653 - DNA, 25 bp, Mus musculus
ctccagagacgcagcaagcagccgg

SEQ ID NO: 407654 - DNA, 25 bp, Mus musculus
cgcccttagtaaccgagctcggagc

SEQ ID NO: 407655 - DNA, 25 bp, Mus musculus
ttcagcccggcacttggccaatcag

SEQ ID NO: 407656 - DNA, 25 bp, Mus musculus
caatcagggtgcagcgcgcagccgc

SEQ ID NO: 407657 - DNA, 25 bp, Mus musculus
ggggtgaaaacagcctgaaactgga

SEQ ID NO: 407658 - DNA, 25 bp, Mus musculus
agagcactgtgattggctgactcgc

SEQ ID NO: 407659 - DNA, 25 bp, Mus musculus
gattggctgactcgcttgcccggta

SEQ ID NO: 407660 - DNA, 25 bp, Mus musculus
taaccgagctcggagcctgcgcgcg

SEQ ID NO: 407661 - DNA, 25 bp, Mus musculus
aaactggattccacctcgtgcgtga

SEQ ID NO: 407662 - DNA, 25 bp, Mus musculus
ggcacgtgaccgagaaactttggcg

SEQ ID NO: 407663 - DNA, 25 bp, Mus musculus
atcggactctagagccagcggcagc

SEQ ID NO: 407664 - DNA, 25 bp, Mus musculus
caatcggactctagagccagcggca

SEQ ID NO: 407665 - DNA, 25 bp, Mus musculus
gcccaatcggactctagagccagcg

SEQ ID NO: 407666 - DNA, 25 bp, Mus musculus
gcagcccaatcggactctagagcca

SEQ ID NO: 407667 - DNA, 25 bp, Mus musculus
ccgcgcagcctgtgcgtgcgggaac

SEQ ID NO: 407668 - DNA, 25 bp, Mus musculus
cacgtgaccgagaaactttggcggg

SEQ ID NO: 407669 - DNA, 25 bp, Mus musculus
cccgccacatggtccgccctctggg

SEQ ID NO: 407670 - DNA, 25 bp, Mus musculus
gacggcacgtgaccgagaaactttg

SEQ ID NO: 407671 - DNA, 25 bp, Mus musculus
ggagacggcacgtgaccgagaaact

SEQ ID NO: 407672 - DNA, 25 bp, Mus musculus
cgctgctaggctctgacctcccagc

SEQ ID NO: 407673 - DNA, 25 bp, Mus musculus
cctctggggtggacttcgctgctag

SEQ ID NO: 407674 - DNA, 25 bp, Mus musculus
ccgccctctggggtggacttcgctg

SEQ ID NO: 407675 - DNA, 25 bp, Mus musculus
tcggactctagagccagcggcagcg

SEQ ID NO: 407676 - DNA, 25 bp, Mus musculus
cccgacccgcttatatagtacgaga

SEQ ID NO: 407677 - DNA, 25 bp, Mus musculus
gcggcttgcccgacccgcttatata

SEQ ID NO: 407678 - DNA, 25 bp, Mus musculus
gactcgaaagaggatccggcggctt

SEQ ID NO: 407679 - DNA, 25 bp, Mus musculus
taccgtccatagatctacttctacc

SEQ ID NO: 407680 - DNA, 25 bp, Mus musculus
caggtccctaccgtccatagatcta

SEQ ID NO: 407681 - DNA, 25 bp, Mus musculus
gactctgactttcaggtccctaccg

SEQ ID NO: 407682 - DNA, 25 bp, Mus musculus
tttctcctccaagactctgactttc

SEQ ID NO: 407683 - DNA, 25 bp, Mus musculus
gctggacggaccctttgtcactttc

SEQ ID NO: 407684 - DNA, 25 bp, Mus musculus
cgagcacgccaagtccgggctggac

SEQ ID NO: 407685 - DNA, 25 bp, Mus musculus
gtacaagtcccgagcacgccaagtc

SEQ ID NO: 407686 - DNA, 25 bp, Mus musculus
cgacagagacccgtacaagtcccga

SEQ ID NO: 407687 - DNA, 25 bp, Mus musculus
tctgagaatggaaagagacgctatt

SEQ ID NO: 407688 - DNA, 25 bp, Mus musculus
atagtacgagattcctacgctcacg

SEQ ID NO: 407689 - DNA, 25 bp, Mus musculus
gagaattcagcccttcctggccggc

SEQ ID NO: 407690 - DNA, 25 bp, Mus musculus
ttcgcagactcgtacggccagcggt

SEQ ID NO: 407691 - DNA, 25 bp, Mus musculus
tgccaccctacagcgagctggagct

SEQ ID NO: 407692 - DNA, 25 bp, Mus musculus
cggaagaactttgccacgggcgtgc

SEQ ID NO: 407693 - DNA, 25 bp, Mus musculus
gatgaggacgcgctgccaccctaca

SEQ ID NO: 407694 - DNA, 25 bp, Mus musculus
tggtcgccgccaaccacatacaaag

SEQ ID NO: 407695 - DNA, 25 bp, Mus musculus
agacgccgtccaagctgggcgcgca

SEQ ID NO: 407696 - DNA, 25 bp, Mus musculus
acctgagcagcgtgctggagcgcca

SEQ ID NO: 407697 - DNA, 25 bp, Mus musculus
tacgatcactcgtacctgagcagcg

SEQ ID NO: 407698 - DNA, 25 bp, Mus musculus
acggtgccttctaccaggacggctc

SEQ ID NO: 407699 - DNA, 25 bp, Mus musculus
cgcgccaatggcaacagccacgagg

SEQ ID NO: 407700 - DNA, 25 bp, Mus musculus
ccagcagcgctccaaatctgagatg

SEQ ID NO: 407701 - DNA, 25 bp, Mus musculus
ggacgagctggcagccttcgcagac

SEQ ID NO: 407702 - DNA, 25 bp, Mus musculus
tctgagatgctgtcgcggaagaact

SEQ ID NO: 407703 - DNA, 25 bp, Mus musculus
gacggctcgctggatgagtactacg

SEQ ID NO: 407704 - DNA, 25 bp, Mus musculus
cgcccaccaggggaagcgggtcacg

SEQ ID NO: 407705 - DNA, 25 bp, Mus musculus
cacgcaacgtctccctagcggatgg

SEQ ID NO: 407706 - DNA, 25 bp, Mus musculus
tttcccaactgcgagacggcggggc

SEQ ID NO: 407707 - DNA, 25 bp, Mus musculus
tgctttcccaactgcgagacggcgg

SEQ ID NO: 407708 - DNA, 25 bp, Mus musculus
ggtgctttcccaactgcgagacggc

SEQ ID NO: 407709 - DNA, 25 bp, Mus musculus
tgggtgctttcccaactgcgagacg

SEQ ID NO: 407710 - DNA, 25 bp, Mus musculus
gctgggtgctttcccaactgcgaga

SEQ ID NO: 407711 - DNA, 25 bp, Mus musculus
tttggctgggtgctttcccaactgc

SEQ ID NO: 407712 - DNA, 25 bp, Mus musculus
aagcgggtcacgtgagccaagaggc

SEQ ID NO: 407713 - DNA, 25 bp, Mus musculus
cgcaacgtctccctagcggatgggg

SEQ ID NO: 407714 - DNA, 25 bp, Mus musculus
cgtaggttgggcacgcgcccaccag

SEQ ID NO: 407715 - DNA, 25 bp, Mus musculus
ggagttggcgaagggagtttggctg

SEQ ID NO: 407716 - DNA, 25 bp, Mus musculus
gcgtaggttgggcacgcgcccacca

SEQ ID NO: 407717 - DNA, 25 bp, Mus musculus
cccaactgcgagacggcggggccaa

SEQ ID NO: 407718 - DNA, 25 bp, Mus musculus
caagtgaagtcggtcggtcacccac

SEQ ID NO: 407719 - DNA, 25 bp, Mus musculus
cctgagatcggcacagttcgtactc

SEQ ID NO: 407720 - DNA, 25 bp, Mus musculus
ctcagacctgagatcggcacagttc

SEQ ID NO: 407721 - DNA, 25 bp, Mus musculus
cagtgttccacacgggccagccaat

SEQ ID NO: 407722 - DNA, 25 bp, Mus musculus
gtaggacgcctttcccagtgttcca

SEQ ID NO: 407723 - DNA, 25 bp, Mus musculus
tgaagtcggtcggtcacccacctta

SEQ ID NO: 407724 - DNA, 25 bp, Mus musculus
ggccagccaatcctcagacctgaga

SEQ ID NO: 407725 - DNA, 25 bp, Mus musculus
aagcgggttcggaaggcacagagac

SEQ ID NO: 407726 - DNA, 25 bp, Mus musculus
ctagaagagctgtgaaagcgggttc

SEQ ID NO: 407727 - DNA, 25 bp, Mus musculus
ctcaggggccagctagaagagctgt

SEQ ID NO: 407728 - DNA, 25 bp, Mus musculus
gcccgcgttgctcaggggccagcta

SEQ ID NO: 407729 - DNA, 25 bp, Mus musculus
ccgacaccggtgatacccgcgtggg

SEQ ID NO: 407730 - DNA, 25 bp, Mus musculus
ctgggcgtcccgacaccggtgatac

SEQ ID NO: 407731 - DNA, 25 bp, Mus musculus
cacagcatccaagggggcggctgcc

SEQ ID NO: 407732 - DNA, 25 bp, Mus musculus
acctcggtgcttcgagccgcgttag

SEQ ID NO: 407733 - DNA, 25 bp, Mus musculus
gcttccggcgacctcggtgcttcga

SEQ ID NO: 407734 - DNA, 25 bp, Mus musculus
tcaggcatccagaaatgctctgtgc

SEQ ID NO: 407735 - DNA, 25 bp, Mus musculus
ggaggaacaccgcagcctttccgct

SEQ ID NO: 407736 - DNA, 25 bp, Mus musculus
tgctcggaggaacaccgcagccttt

SEQ ID NO: 407737 - DNA, 25 bp, Mus musculus
ttcgagccgcgttagcccggtggct

SEQ ID NO: 407738 - DNA, 25 bp, Mus musculus
attcaccgcgccatcgtctccaccg

SEQ ID NO: 407739 - DNA, 25 bp, Mus musculus
gacgaaggctgtggcccggcattca

SEQ ID NO: 407740 - DNA, 25 bp, Mus musculus
ggcgacagcccacgccgcctacctc

SEQ ID NO: 407741 - DNA, 25 bp, Mus musculus
ctaaggtcctcggtccacctgcggg

SEQ ID NO: 407742 - DNA, 25 bp, Mus musculus
ttgcccgctccagccatcttgtcca

SEQ ID NO: 407743 - DNA, 25 bp, Mus musculus
acctgaacttggccgcggcctgtgc

SEQ ID NO: 407744 - DNA, 25 bp, Mus musculus
tggctggctcacttgcggccgccga

SEQ ID NO: 407745 - DNA, 25 bp, Mus musculus
gtgggcatttgctcggaggaacacc

SEQ ID NO: 407746 - DNA, 25 bp, Mus musculus
tgctgctgctctcgcagacataagc

SEQ ID NO: 407747 - DNA, 25 bp, Mus musculus
cccacggccgaggacatttttcgtg

SEQ ID NO: 407748 - DNA, 25 bp, Mus musculus
ccgagcccggatgctgcctttgttt

SEQ ID NO: 407749 - DNA, 25 bp, Mus musculus
gtctctcatgatgctctgcctcccg

SEQ ID NO: 407750 - DNA, 25 bp, Mus musculus
ggacagcgaggacccagtctctcat

SEQ ID NO: 407751 - DNA, 25 bp, Mus musculus
gctccgctgcctccagtttggggct

SEQ ID NO: 407752 - DNA, 25 bp, Mus musculus
atgctgcctttgtttgggtcgccct

SEQ ID NO: 407753 - DNA, 25 bp, Mus musculus
ttcgctcccgggtgatgctgctgct

SEQ ID NO: 407754 - DNA, 25 bp, Mus musculus
ccctgctttccacgctcacagcgaa

SEQ ID NO: 407755 - DNA, 25 bp, Mus musculus
tcgcagacataagctgccagccact

SEQ ID NO: 407756 - DNA, 25 bp, Mus musculus
tggctctcacctttcggattcacgc

SEQ ID NO: 407757 - DNA, 25 bp, Mus musculus
ggctctggctctcacctttcggatt

SEQ ID NO: 407758 - DNA, 25 bp, Mus musculus
aggacatttttcgtggcctgcccgc

SEQ ID NO: 407759 - DNA, 25 bp, Mus musculus
gcggagtctcggagcttcgctcccg

SEQ ID NO: 407760 - DNA, 25 bp, Mus musculus
cggaaacagacaaaccgggcgctgc

SEQ ID NO: 407761 - DNA, 25 bp, Mus musculus
agggacaaactcatggcgtacagcc

SEQ ID NO: 407762 - DNA, 25 bp, Mus musculus
ctcatggcgtacagccagtctcttc

SEQ ID NO: 407763 - DNA, 25 bp, Mus musculus
agccagtctcttccgcggagcttgt

SEQ ID NO: 407764 - DNA, 25 bp, Mus musculus
tgccgccgcggaaacagacaaaccg

SEQ ID NO: 407765 - DNA, 25 bp, Mus musculus
cggcagccgaagagggacaaactca

SEQ ID NO: 407766 - DNA, 25 bp, Mus musculus
atccggcgcgagaacttgtggtgta

SEQ ID NO: 407767 - DNA, 25 bp, Mus musculus
cgcgagaacttgtggtgtacgatgt

SEQ ID NO: 407768 - DNA, 25 bp, Mus musculus
ggtgtacgatgtgtgcgccaccatc

SEQ ID NO: 407769 - DNA, 25 bp, Mus musculus
cccacgcgcatcgaggagacctcgc

SEQ ID NO: 407770 - DNA, 25 bp, Mus musculus
tcgcccatcgtcctgcgctacaaga

SEQ ID NO: 407771 - DNA, 25 bp, Mus musculus
ttacttcaaagcctcggcccgtgtg

SEQ ID NO: 407772 - DNA, 25 bp, Mus musculus
aagcctcggcccgtgtggtcatgcc

SEQ ID NO: 407773 - DNA, 25 bp, Mus musculus
ccgcggtgcagcagaggttcatgca

SEQ ID NO: 407774 - DNA, 25 bp, Mus musculus
ggctgctggactctgacgcctgcct

SEQ ID NO: 407775 - DNA, 25 bp, Mus musculus
acgatgaggttgatggccactgtga

SEQ ID NO: 407776 - DNA, 25 bp, Mus musculus
ctgacgcctgcctcttgcgggaagg

SEQ ID NO: 407777 - DNA, 25 bp, Mus musculus
cccgttgaggatgtcctggatgtgt

SEQ ID NO: 407778 - DNA, 25 bp, Mus musculus
gtgtagccgttgagatagccgttcg

SEQ ID NO: 407779 - DNA, 25 bp, Mus musculus
agtcaatgtggtcggctgctggact

SEQ ID NO: 407780 - DNA, 25 bp, Mus musculus
tgagatagccgttcgtctgccgctt

SEQ ID NO: 407781 - DNA, 25 bp, Mus musculus
agccgttcgtctgccgcttggagag

SEQ ID NO: 407782 - DNA, 25 bp, Mus musculus
aggttgatggccactgtgagacaga

SEQ ID NO: 407783 - DNA, 25 bp, Mus musculus
acagagaccggcagtgttagggaca

SEQ ID NO: 407784 - DNA, 25 bp, Mus musculus
agccgttgagatagccgttcgtctg

SEQ ID NO: 407785 - DNA, 25 bp, Mus musculus
cctggatgtgttgcacgatgaggtt

SEQ ID NO: 407786 - DNA, 25 bp, Mus musculus
ttgcacgatgaggttgatggccact

SEQ ID NO: 407787 - DNA, 25 bp, Mus musculus
actctgacgcctgcctcttgcggga

SEQ ID NO: 407788 - DNA, 25 bp, Mus musculus
tgcggttttctcttctaagcataaa

SEQ ID NO: 407789 - DNA, 25 bp, Mus musculus
cgctcacgccgatcaggaagggctc

SEQ ID NO: 407790 - DNA, 25 bp, Mus musculus
agaaccatctgggagggctccaccc

SEQ ID NO: 407791 - DNA, 25 bp, Mus musculus
cacctgcagtaaagacccgaggtta

SEQ ID NO: 407792 - DNA, 25 bp, Mus musculus
cctcgctgccgtgcaggagaaaata

SEQ ID NO: 407793 - DNA, 25 bp, Mus musculus
aggttcctcgcaaagtcagactcgg

SEQ ID NO: 407794 - DNA, 25 bp, Mus musculus
ttccctgcgatccaaggagcgagcg

SEQ ID NO: 407795 - DNA, 25 bp, Mus musculus
agcgacccggacaccgaagagcatg

SEQ ID NO: 407796 - DNA, 25 bp, Mus musculus
agcatggagcctgtacaactttctc

SEQ ID NO: 407797 - DNA, 25 bp, Mus musculus
tctcactgagactgatgcggttttc

SEQ ID NO: 407798 - DNA, 25 bp, Mus musculus
atccgtgactgtgcccatcgagctt

SEQ ID NO: 407799 - DNA, 25 bp, Mus musculus
gaaccagcgagggagcgcaccatcc

SEQ ID NO: 407800 - DNA, 25 bp, Mus musculus
tggcaggctgcaactgacacggccc

SEQ ID NO: 407801 - DNA, 25 bp, Mus musculus
ttgtaggaggaacccgcatcctgga

SEQ ID NO: 407802 - DNA, 25 bp, Mus musculus
ctggtttaaccagcgcccgaggact

SEQ ID NO: 407803 - DNA, 25 bp, Mus musculus
cccatgagcaaagatcgggagcctc

SEQ ID NO: 407804 - DNA, 25 bp, Mus musculus
ggctgtttccttggacgtttgatta

SEQ ID NO: 407805 - DNA, 25 bp, Mus musculus
atcgtctttatctccgtgtgcaccg

SEQ ID NO: 407806 - DNA, 25 bp, Mus musculus
gcagacacgctgctcatcgtcttta

SEQ ID NO: 407807 - DNA, 25 bp, Mus musculus
atgagcaccatgtttgcagacacgc

SEQ ID NO: 407808 - DNA, 25 bp, Mus musculus
gacctggctttccaactctcgcgag

SEQ ID NO: 407809 - DNA, 25 bp, Mus musculus
caagcgagttgtgcagcccttctcc

SEQ ID NO: 407810 - DNA, 25 bp, Mus musculus
gcacgcggtggcctaacttttcggc

SEQ ID NO: 407811 - DNA, 25 bp, Mus musculus
cccggcatcataaaggctggtttaa

SEQ ID NO: 407812 - DNA, 25 bp, Mus musculus
gcgtggtccgttgcaagaaatcccg

SEQ ID NO: 407813 - DNA, 25 bp, Mus musculus
ctgtcaaagttgtagcgctcctcga

SEQ ID NO: 407814 - DNA, 25 bp, Mus musculus
ccagccaccgtgtgacagggttcta

SEQ ID NO: 407815 - DNA, 25 bp, Mus musculus
taacgcactgccgaggtcgcaacgc

SEQ ID NO: 407816 - DNA, 25 bp, Mus musculus
aagtcaaatttgtgctatctatata

SEQ ID NO: 407817 - DNA, 25 bp, Mus musculus
ggagcatggctaaactctcagtggc

SEQ ID NO: 407818 - DNA, 25 bp, Mus musculus
ctatatactcactggagcatggcta

SEQ ID NO: 407819 - DNA, 25 bp, Mus musculus
atagaactgagtccttcacctccca

SEQ ID NO: 407820 - DNA, 25 bp, Mus musculus
tggctaaactctcagtggcctgccc

SEQ ID NO: 407821 - DNA, 25 bp, Mus musculus
ctcactggagcatggctaaactctc

SEQ ID NO: 407822 - DNA, 25 bp, Mus musculus
gtgctatctatatactcactggagc

SEQ ID NO: 407823 - DNA, 25 bp, Mus musculus
tggctggaccggcaggcttgctccc

SEQ ID NO: 407824 - DNA, 25 bp, Mus musculus
tatcatcatggctggaccggcaggc

SEQ ID NO: 407825 - DNA, 25 bp, Mus musculus
gcttatcatcatggctggaccggca

SEQ ID NO: 407826 - DNA, 25 bp, Mus musculus
acaggcttatcatcatggctggacc

SEQ ID NO: 407827 - DNA, 25 bp, Mus musculus
gctgcttacaggcttatcatcatgg

SEQ ID NO: 407828 - DNA, 25 bp, Mus musculus
aggggtgctgcttacaggcttatca

SEQ ID NO: 407829 - DNA, 25 bp, Mus musculus
cccttaaatagaactgagtccttca

SEQ ID NO: 407830 - DNA, 25 bp, Mus musculus
agccactcaccttccaggaagcgtg

SEQ ID NO: 407831 - DNA, 25 bp, Mus musculus
ccgccttggaaacggcgagggagtg

SEQ ID NO: 407832 - DNA, 25 bp, Mus musculus
catgtctgcgtctcggtggcaggca

SEQ ID NO: 407833 - DNA, 25 bp, Mus musculus
aggggtgagcccagccactcacctt

SEQ ID NO: 407834 - DNA, 25 bp, Mus musculus
ctcaccttccaggaagcgtggattc

SEQ ID NO: 407835 - DNA, 25 bp, Mus musculus
accttccaggaagcgtggattcctg

SEQ ID NO: 407836 - DNA, 25 bp, Mus musculus
ccaggaagcgtggattcctggaagt

SEQ ID NO: 407837 - DNA, 25 bp, Mus musculus
gattcctggaagtgaggggaaccgc

SEQ ID NO: 407838 - DNA, 25 bp, Mus musculus
gggaaccgccgtcatttcgcaggca

SEQ ID NO: 407839 - DNA, 25 bp, Mus musculus
aaccgccgtcatttcgcaggcagtg

SEQ ID NO: 407840 - DNA, 25 bp, Mus musculus
gccgtcatttcgcaggcagtggcag

SEQ ID NO: 407841 - DNA, 25 bp, Mus musculus
cagtggcagccgcacggtgagcagg

SEQ ID NO: 407842 - DNA, 25 bp, Mus musculus
ggcccacggctgcagccggcagaac

SEQ ID NO: 407843 - DNA, 25 bp, Mus musculus
caggcaggggtgagcccagccactc

SEQ ID NO: 407844 - DNA, 25 bp, Mus musculus
cttccgagctctccgccaagggttg

SEQ ID NO: 407845 - DNA, 25 bp, Mus musculus
ccctccagtagtaatctgctggggc

SEQ ID NO: 407846 - DNA, 25 bp, Mus musculus
tagtaatctgctggggcttccggac

SEQ ID NO: 407847 - DNA, 25 bp, Mus musculus
ttccggacgctttgcacgcgtagca

SEQ ID NO: 407848 - DNA, 25 bp, Mus musculus
tttgcacgcgtagcagatgatcctc

SEQ ID NO: 407849 - DNA, 25 bp, Mus musculus
agatgatcctcggtgcagtcggttc

SEQ ID NO: 407850 - DNA, 25 bp, Mus musculus
cggtgcagtcggttctgtgctgacc

SEQ ID NO: 407851 - DNA, 25 bp, Mus musculus
agtcgccgccatgagtactggcacc

SEQ ID NO: 407852 - DNA, 25 bp, Mus musculus
gtactggcaccttcgtcgtgtcgca

SEQ ID NO: 407853 - DNA, 25 bp, Mus musculus
atgcttccggcacggagaaagcgtt

SEQ ID NO: 407854 - DNA, 25 bp, Mus musculus
ttcgagccagccaccggtaacctgg

SEQ ID NO: 407855 - DNA, 25 bp, Mus musculus
tctccgccaagggttgctgaacttg

SEQ ID NO: 407856 - DNA, 25 bp, Mus musculus
gctgaacttgcgtggtcgcagcacg

SEQ ID NO: 407857 - DNA, 25 bp, Mus musculus
cacggagaaagcgttcgagccagcc

SEQ ID NO: 407858 - DNA, 25 bp, Mus musculus
agagcacaggcgcaccctcttgtgc

SEQ ID NO: 407859 - DNA, 25 bp, Mus musculus
ttggcgcgtacctcagctctgccta

SEQ ID NO: 407860 - DNA, 25 bp, Mus musculus
cgacagtaacgcgttagtaatttgt

SEQ ID NO: 407861 - DNA, 25 bp, Mus musculus
gctcgcccaggtatttcttcccgga

SEQ ID NO: 407862 - DNA, 25 bp, Mus musculus
gtacctcagctctgcctacacggtg

SEQ ID NO: 407863 - DNA, 25 bp, Mus musculus
acttaacaaagagcacaggcgcacc

SEQ ID NO: 407864 - DNA, 25 bp, Mus musculus
aactgtgggagttcccttagcctgc

SEQ ID NO: 407865 - DNA, 25 bp, Mus musculus
gtgtctcacttttggactctcttgg

SEQ ID NO: 407866 - DNA, 25 bp, Mus musculus
ggaaggcgtgtgtctcacttttgga

SEQ ID NO: 407867 - DNA, 25 bp, Mus musculus
tagagcgtagtttatggagagcttg

SEQ ID NO: 407868 - DNA, 25 bp, Mus musculus
cgtgcgcagaaagtagagcgtagtt

SEQ ID NO: 407869 - DNA, 25 bp, Mus musculus
tgtaactcagcttgctgcgcgtgcg

SEQ ID NO: 407870 - DNA, 25 bp, Mus musculus
ccggcagggcactgtaactcagctt

SEQ ID NO: 407871 - DNA, 25 bp, Mus musculus
gggctcctatggcttggctcgccca

SEQ ID NO: 407872 - DNA, 25 bp, Mus musculus
tccaaggctgggtcgcccaagggcc

SEQ ID NO: 407873 - DNA, 25 bp, Mus musculus
tccgtttaccacgtgcaggtgggcg

SEQ ID NO: 407874 - DNA, 25 bp, Mus musculus
cgactccgtttaccacgtgcaggtg

SEQ ID NO: 407875 - DNA, 25 bp, Mus musculus
cgggcgactccgtttaccacgtgca

SEQ ID NO: 407876 - DNA, 25 bp, Mus musculus
gctaaaggacctggctctgtccctg

SEQ ID NO: 407877 - DNA, 25 bp, Mus musculus
tgtggctaaaggacctggctctgtc

SEQ ID NO: 407878 - DNA, 25 bp, Mus musculus
ctaggtccaaggctgggtcgcccaa

SEQ ID NO: 407879 - DNA, 25 bp, Mus musculus
gccaggagcgcctaggtccaaggct

SEQ ID NO: 407880 - DNA, 25 bp, Mus musculus
agattatggagcgtgctccgcgctg

SEQ ID NO: 407881 - DNA, 25 bp, Mus musculus
cctgggaagattatggagcgtgctc

SEQ ID NO: 407882 - DNA, 25 bp, Mus musculus
tccctccctgtggtttggcacggaa

SEQ ID NO: 407883 - DNA, 25 bp, Mus musculus
ctgtggtttggcacggaaagcgtct

SEQ ID NO: 407884 - DNA, 25 bp, Mus musculus
ctccctgtggtttggcacggaaagc

SEQ ID NO: 407885 - DNA, 25 bp, Mus musculus
cacggaaagcgtctgggcagtcctg

SEQ ID NO: 407886 - DNA, 25 bp, Mus musculus
gcgagctcgcccatcaggtaaggaa

SEQ ID NO: 407887 - DNA, 25 bp, Mus musculus
ctgaggttagtcatcacttacggtg

SEQ ID NO: 407888 - DNA, 25 bp, Mus musculus
ttacggtgcagatccgagagcaacc

SEQ ID NO: 407889 - DNA, 25 bp, Mus musculus
catcccgcccgcgtgaagtctaggt

SEQ ID NO: 407890 - DNA, 25 bp, Mus musculus
tggcacggatctctgccgagtctgg

SEQ ID NO: 407891 - DNA, 25 bp, Mus musculus
aaggcgactcctttgctcctgcaga

SEQ ID NO: 407892 - DNA, 25 bp, Mus musculus
agccaagccggggaaacagagcacc

SEQ ID NO: 407893 - DNA, 25 bp, Mus musculus
cgggcgtgtttctgaaagttgattt

SEQ ID NO: 407894 - DNA, 25 bp, Mus musculus
gttccaccgccgatcttggagcagc

SEQ ID NO: 407895 - DNA, 25 bp, Mus musculus
agccagcggccactgtcagaaaccg

SEQ ID NO: 407896 - DNA, 25 bp, Mus musculus
gggcaaccgttccacgtggagagaa

SEQ ID NO: 407897 - DNA, 25 bp, Mus musculus
cagactggagcatcaggctgtagcc

SEQ ID NO: 407898 - DNA, 25 bp, Mus musculus
catccaagagtgaaccgggccagtc

SEQ ID NO: 407899 - DNA, 25 bp, Mus musculus
cgcgacctccaggtgtctgaggtta

SEQ ID NO: 407900 - DNA, 25 bp, Mus musculus
ggagagccgcaatgcggggtttttg

SEQ ID NO: 407901 - DNA, 25 bp, Mus musculus
ggccagtaaatctcgcgcatccgcg

SEQ ID NO: 407902 - DNA, 25 bp, Mus musculus
aaatctcgcgcatccgcgttcggta

SEQ ID NO: 407903 - DNA, 25 bp, Mus musculus
cgggttgcgggaagtccatccgtat

SEQ ID NO: 407904 - DNA, 25 bp, Mus musculus
tgcgggaagtccatccgtatgcaca

SEQ ID NO: 407905 - DNA, 25 bp, Mus musculus
agtccatccgtatgcacaacttggg

SEQ ID NO: 407906 - DNA, 25 bp, Mus musculus
ccggagcgcgcccactcacctccac

SEQ ID NO: 407907 - DNA, 25 bp, Mus musculus
ccgtatgcacaacttggggcccggg

SEQ ID NO: 407908 - DNA, 25 bp, Mus musculus
cactcgcaggaaaggccagtaaatc

SEQ ID NO: 407909 - DNA, 25 bp, Mus musculus
cctcttcgaggaggcactcgcagga

SEQ ID NO: 407910 - DNA, 25 bp, Mus musculus
tgcaccctcttcgaggaggcactcg

SEQ ID NO: 407911 - DNA, 25 bp, Mus musculus
gggaccgtgtcctcctgcaccctct

SEQ ID NO: 407912 - DNA, 25 bp, Mus musculus
actcacctccacgggtgtgcgctgg

SEQ ID NO: 407913 - DNA, 25 bp, Mus musculus
aggaaaggccagtaaatctcgcgca

SEQ ID NO: 407914 - DNA, 25 bp, Mus musculus
ccagtgagctgttctaagatccagt

SEQ ID NO: 407915 - DNA, 25 bp, Mus musculus
taagagttcgtccacatcgatctcg

SEQ ID NO: 407916 - DNA, 25 bp, Mus musculus
atcgatctcgagctctgggatttcc

SEQ ID NO: 407917 - DNA, 25 bp, Mus musculus
gggtatcgtcgctttccatgtctaa

SEQ ID NO: 407918 - DNA, 25 bp, Mus musculus
tgggatttcctcttccttgcagtcg

SEQ ID NO: 407919 - DNA, 25 bp, Mus musculus
cttgcagtcgtagagaccagtgagc

SEQ ID NO: 407920 - DNA, 25 bp, Mus musculus
ctcggggcctggatcagtcaaagct

SEQ ID NO: 407921 - DNA, 25 bp, Mus musculus
aagatccagtcgtccaggttgaggc

SEQ ID NO: 407922 - DNA, 25 bp, Mus musculus
cggtcgtacttgacgatgatcttat

SEQ ID NO: 407923 - DNA, 25 bp, Mus musculus
gatgatcttatctggcctatgtggc

SEQ ID NO: 407924 - DNA, 25 bp, Mus musculus
tgtggccgtctcacctggtcatctt

SEQ ID NO: 407925 - DNA, 25 bp, Mus musculus
ctggtcatctttatccgggttgttc

SEQ ID NO: 407926 - DNA, 25 bp, Mus musculus
gccctgtgttggcactgcctggctc

SEQ ID NO: 407927 - DNA, 25 bp, Mus musculus
ccgctggggccacgtatgagcctgc

SEQ ID NO: 407928 - DNA, 25 bp, Mus musculus
cgggctgggtcgctgcgaggtcgtc

SEQ ID NO: 407929 - DNA, 25 bp, Mus musculus
cgcagacttaattaaaagtaatgcc

SEQ ID NO: 407930 - DNA, 25 bp, Mus musculus
cacggtaaatccgctggctctggct

SEQ ID NO: 407931 - DNA, 25 bp, Mus musculus
gccacggtaaatccgctggctctgg

SEQ ID NO: 407932 - DNA, 25 bp, Mus musculus
aatgccacggtaaatccgctggctc

SEQ ID NO: 407933 - DNA, 25 bp, Mus musculus
gtaatgccacggtaaatccgctggc

SEQ ID NO: 407934 - DNA, 25 bp, Mus musculus
agtaatgccacggtaaatccgctgg

SEQ ID NO: 407935 - DNA, 25 bp, Mus musculus
ctgcgaggtcgtcgggtccgcgcct

SEQ ID NO: 407936 - DNA, 25 bp, Mus musculus
gccgcagacttaattaaaagtaatg

SEQ ID NO: 407937 - DNA, 25 bp, Mus musculus
cgccgcagacttaattaaaagtaat

SEQ ID NO: 407938 - DNA, 25 bp, Mus musculus
gcgccgcagacttaattaaaagtaa

SEQ ID NO: 407939 - DNA, 25 bp, Mus musculus
gcgccttcccaggtgacgtcaggcg

SEQ ID NO: 407940 - DNA, 25 bp, Mus musculus
aaagtaatgccacggtaaatccgct

SEQ ID NO: 407941 - DNA, 25 bp, Mus musculus
agacttaattaaaagtaatgccacg

SEQ ID NO: 407942 - DNA, 25 bp, Mus musculus
ctggcccgcgtgtcacagccaatta

SEQ ID NO: 407943 - DNA, 25 bp, Mus musculus
agagagaaaggagtgacaccgtgta

SEQ ID NO: 407944 - DNA, 25 bp, Mus musculus
gcgtgtcacagccaattaggctttg

SEQ ID NO: 407945 - DNA, 25 bp, Mus musculus
gctaattaatcaccttggccaccga

SEQ ID NO: 407946 - DNA, 25 bp, Mus musculus
tgacaccgtgtattgacccccgctg

SEQ ID NO: 407947 - DNA, 25 bp, Mus musculus
gcgctccacctctctcaacagctgg

SEQ ID NO: 407948 - DNA, 25 bp, Mus musculus
ggccacgccgctaattaatcacctt

SEQ ID NO: 407949 - DNA, 25 bp, Mus musculus
attaatcaccttggccaccgagtcg

SEQ ID NO: 407950 - DNA, 25 bp, Mus musculus
accttggccaccgagtcgtgacagc

SEQ ID NO: 407951 - DNA, 25 bp, Mus musculus
ccaccgagtcgtgacagcgctttgc

SEQ ID NO: 407952 - DNA, 25 bp, Mus musculus
cgagtcgtgacagcgctttgctttg

SEQ ID NO: 407953 - DNA, 25 bp, Mus musculus
cagccaattaggctttggagggagt

SEQ ID NO: 407954 - DNA, 25 bp, Mus musculus
aaaggagtgacaccgtgtattgacc

SEQ ID NO: 407955 - DNA, 25 bp, Mus musculus
agatgtggaggccagcacgcggccc

SEQ ID NO: 407956 - DNA, 25 bp, Mus musculus
tggaggcctagcagctcacggaaaa

SEQ ID NO: 407957 - DNA, 25 bp, Mus musculus
acttgacgagttgcgcagcgagcca

SEQ ID NO: 407958 - DNA, 25 bp, Mus musculus
ggaaccgcgattccgccagaccagg

SEQ ID NO: 407959 - DNA, 25 bp, Mus musculus
ttatagtttctagccggaaccgcga

SEQ ID NO: 407960 - DNA, 25 bp, Mus musculus
agcggaatcattcttcagggttata

SEQ ID NO: 407961 - DNA, 25 bp, Mus musculus
aggctccagatcagcggaatcattc

SEQ ID NO: 407962 - DNA, 25 bp, Mus musculus
tgcgcagcgagccaggctccagatc

SEQ ID NO: 407963 - DNA, 25 bp, Mus musculus
cgacggatgccgagaaggctcagaa

SEQ ID NO: 407964 - DNA, 25 bp, Mus musculus
agcgcgcttccttcgcgacggatgc

SEQ ID NO: 407965 - DNA, 25 bp, Mus musculus
cgaaagccgctgaccgttgtcattt

SEQ ID NO: 407966 - DNA, 25 bp, Mus musculus
gcagctcacggaaaaacagttaaaa

SEQ ID NO: 407967 - DNA, 25 bp, Mus musculus
cgctcaaactcacctggaggcctag

SEQ ID NO: 407968 - DNA, 25 bp, Mus musculus
aaggctcagaagacccacggtgggt

SEQ ID NO: 407969 - DNA, 25 bp, Mus musculus
gagcgtccaaccgaaagccgctgac

SEQ ID NO: 407970 - DNA, 25 bp, Mus musculus
acgccctgcaccgaagtagaactgc

SEQ ID NO: 407971 - DNA, 25 bp, Mus musculus
agccacgtgacacaagggtcctata

SEQ ID NO: 407972 - DNA, 25 bp, Mus musculus
gttaggcccgccaatcgcgactcgg

SEQ ID NO: 407973 - DNA, 25 bp, Mus musculus
ctgcgtcatccggtccgcgcgttag

SEQ ID NO: 407974 - DNA, 25 bp, Mus musculus
ggcaggcatgaccacacctcttgga

SEQ ID NO: 407975 - DNA, 25 bp, Mus musculus
gcaccggggttctcttagcctgaac

SEQ ID NO: 407976 - DNA, 25 bp, Mus musculus
gggtcctatagccaatccaggcagt

SEQ ID NO: 407977 - DNA, 25 bp, Mus musculus
tttgttctgagtgaagcaagcgggc

SEQ ID NO: 407978 - DNA, 25 bp, Mus musculus
gggttccataggaggtctcacctgc

SEQ ID NO: 407979 - DNA, 25 bp, Mus musculus
cccgcatagactccggggttccata

SEQ ID NO: 407980 - DNA, 25 bp, Mus musculus
caccgagcaccaagcgaggcaggca

SEQ ID NO: 407981 - DNA, 25 bp, Mus musculus
cgaagtgaatcaccgacctgcgctt

SEQ ID NO: 407982 - DNA, 25 bp, Mus musculus
cacctcttggaaagccagggaacgg

SEQ ID NO: 407983 - DNA, 25 bp, Mus musculus
gcctgaaccttgatccgtgaccacg

SEQ ID NO: 407984 - DNA, 25 bp, Mus musculus
ggacgcacagcctgggccagcttaa

SEQ ID NO: 407985 - DNA, 25 bp, Mus musculus
gtctgcagcttgctgcacccaagtc

SEQ ID NO: 407986 - DNA, 25 bp, Mus musculus
gctgggagtggatccacgttcctta

SEQ ID NO: 407987 - DNA, 25 bp, Mus musculus
ttccttagcgtgtcaccgctctgta

SEQ ID NO: 407988 - DNA, 25 bp, Mus musculus
accgctctgtaagacccgggcctgg

SEQ ID NO: 407989 - DNA, 25 bp, Mus musculus
gttggttgggtctacagctacgaaa

SEQ ID NO: 407990 - DNA, 25 bp, Mus musculus
ttcccttctgcggacgtcggaagcg

SEQ ID NO: 407991 - DNA, 25 bp, Mus musculus
gtcggaagcggacttctacacaaga

SEQ ID NO: 407992 - DNA, 25 bp, Mus musculus
ttcgagaggcgtccctaggcaaccc

SEQ ID NO: 407993 - DNA, 25 bp, Mus musculus
ccgagtcagtgtgtctgcagcttgc

SEQ ID NO: 407994 - DNA, 25 bp, Mus musculus
tgggccagcttaattcccacggtcc

SEQ ID NO: 407995 - DNA, 25 bp, Mus musculus
cctaggcgcatctgagcacggtggt

SEQ ID NO: 407996 - DNA, 25 bp, Mus musculus
cttggaggaccacgctgttgaggtc

SEQ ID NO: 407997 - DNA, 25 bp, Mus musculus
ggtcaaaggaaactggacactccca

SEQ ID NO: 407998 - DNA, 25 bp, Mus musculus
ccactctggtccaggtggcccaccg

SEQ ID NO: 407999 - DNA, 25 bp, Mus musculus
cgacaggcgactgggccaaacaccg

SEQ ID NO: 408000 - DNA, 25 bp, Mus musculus
ggcgactgggccaaacaccgagcgc

SEQ ID NO: 408001 - DNA, 25 bp, Mus musculus
actctttcgcgacaggcgactgggc

SEQ ID NO: 408002 - DNA, 25 bp, Mus musculus
ccactctttcgcgacaggcgactgg

SEQ ID NO: 408003 - DNA, 25 bp, Mus musculus
ggtcccactctttcgcgacaggcga

SEQ ID NO: 408004 - DNA, 25 bp, Mus musculus
ggcttcacctgaggagggaccggcc

SEQ ID NO: 408005 - DNA, 25 bp, Mus musculus
tctccatcaggggcttcacctgagg

SEQ ID NO: 408006 - DNA, 25 bp, Mus musculus
gcggtggcggctccatctccatcag

SEQ ID NO: 408007 - DNA, 25 bp, Mus musculus
ttgcccggatttgggtgctcagcgg

SEQ ID NO: 408008 - DNA, 25 bp, Mus musculus
gtatggggtcactgaggcggcggca

SEQ ID NO: 408009 - DNA, 25 bp, Mus musculus
agaggggtgaggagtcccccactct

SEQ ID NO: 408010 - DNA, 25 bp, Mus musculus
ctcacctgaggcgtctcggcgcgcg

SEQ ID NO: 408011 - DNA, 25 bp, Mus musculus
ttcgcgacaggcgactgggccaaac

SEQ ID NO: 408012 - DNA, 25 bp, Mus musculus
ttcaagtgacggatttccgaacgcc

SEQ ID NO: 408013 - DNA, 25 bp, Mus musculus
ggcgccaccttaaggacaaactgca

SEQ ID NO: 408014 - DNA, 25 bp, Mus musculus
ccgcgcccgcctggaatatatactg

SEQ ID NO: 408015 - DNA, 25 bp, Mus musculus
gcgctggcagtgagtcttcaagtga

SEQ ID NO: 408016 - DNA, 25 bp, Mus musculus
ggacaaactgcagggcgggtcctct

SEQ ID NO: 408017 - DNA, 25 bp, Mus musculus
gaggtgaggccaggcgccaccttaa

SEQ ID NO: 408018 - DNA, 25 bp, Mus musculus
atcctgtcagtctgtggtaccgccc

SEQ ID NO: 408019 - DNA, 25 bp, Mus musculus
aggatggccaaggatcctgtcagtc

SEQ ID NO: 408020 - DNA, 25 bp, Mus musculus
agactcttgcccaataggatggcca

SEQ ID NO: 408021 - DNA, 25 bp, Mus musculus
ctctttacgtcactcagactcttgc

SEQ ID NO: 408022 - DNA, 25 bp, Mus musculus
aggaggagcctctttacgtcactca

SEQ ID NO: 408023 - DNA, 25 bp, Mus musculus
gtcagcgaccgagaacagccaaagg

SEQ ID NO: 408024 - DNA, 25 bp, Mus musculus
atatatactgtcatccgaggggccg

SEQ ID NO: 408025 - DNA, 25 bp, Mus musculus
tcacccggggcggatcagagcgcct

SEQ ID NO: 408026 - DNA, 25 bp, Mus musculus
tctttgcggaaaccatactccgcgg

SEQ ID NO: 408027 - DNA, 25 bp, Mus musculus
tttgcggaaaccatactccgcggcc

SEQ ID NO: 408028 - DNA, 25 bp, Mus musculus
ccggagtgcactcggacccagccgg

SEQ ID NO: 408029 - DNA, 25 bp, Mus musculus
atgacaccggaagccggagtgcact

SEQ ID NO: 408030 - DNA, 25 bp, Mus musculus
ctgcagcgctccgaccgactccccg

SEQ ID NO: 408031 - DNA, 25 bp, Mus musculus
ggaaaccatactccgcggccgaggc

SEQ ID NO: 408032 - DNA, 25 bp, Mus musculus
cggaaaccatactccgcggccgagg

SEQ ID NO: 408033 - DNA, 25 bp, Mus musculus
ctctctttgcggaaaccatactccg

SEQ ID NO: 408034 - DNA, 25 bp, Mus musculus
cgccgccctctctttgcggaaacca

SEQ ID NO: 408035 - DNA, 25 bp, Mus musculus
ttgagccgggacatgggcaggacat

SEQ ID NO: 408036 - DNA, 25 bp, Mus musculus
cggaggacgcttatgcttgagccgg

SEQ ID NO: 408037 - DNA, 25 bp, Mus musculus
ccaggcggaggacgcttatgcttga

SEQ ID NO: 408038 - DNA, 25 bp, Mus musculus
tgcggaaaccatactccgcggccga

SEQ ID NO: 408039 - DNA, 25 bp, Mus musculus
acaactagtgaggcccgatcctctc

SEQ ID NO: 408040 - DNA, 25 bp, Mus musculus
acagccacaattaccgatgttcctg

SEQ ID NO: 408041 - DNA, 25 bp, Mus musculus
agatggggtgtagcacagtagtaaa

SEQ ID NO: 408042 - DNA, 25 bp, Mus musculus
aaacttaattattagagatggggtg

SEQ ID NO: 408043 - DNA, 25 bp, Mus musculus
gaggacacgcgagccgacacgacgc

SEQ ID NO: 408044 - DNA, 25 bp, Mus musculus
ggacctgccacagccgcccgaaggc

SEQ ID NO: 408045 - DNA, 25 bp, Mus musculus
gcacccggtacaccgaggccgacga

SEQ ID NO: 408046 - DNA, 25 bp, Mus musculus
atgttcctgtgaccctgcaactgct

SEQ ID NO: 408047 - DNA, 25 bp, Mus musculus
gccacaattaccgatgttcctgtga

SEQ ID NO: 408048 - DNA, 25 bp, Mus musculus
cccaggcggctctggacctgccaca

SEQ ID NO: 408049 - DNA, 25 bp, Mus musculus
ggacagccacaattaccgatgttcc

SEQ ID NO: 408050 - DNA, 25 bp, Mus musculus
ggggacagccacaattaccgatgtt

SEQ ID NO: 408051 - DNA, 25 bp, Mus musculus
tgtagcacagtagtaaagtgcttgc

SEQ ID NO: 408052 - DNA, 25 bp, Mus musculus
cacaattaccgatgttcctgtgacc

SEQ ID NO: 408053 - DNA, 25 bp, Mus musculus
cgcagcaccgcacccggtacaccga

SEQ ID NO: 408054 - DNA, 25 bp, Mus musculus
ctgcagcgccctgaccgactccctg

SEQ ID NO: 408055 - DNA, 25 bp, Mus musculus
tgtggagcggaatgctaacaccttc

SEQ ID NO: 408056 - DNA, 25 bp, Mus musculus
gggcctaagagaggcgggcctccag

SEQ ID NO: 408057 - DNA, 25 bp, Mus musculus
tgaccgactccctggacctcaggct

SEQ ID NO: 408058 - DNA, 25 bp, Mus musculus
aactgctcagcgcagccccggtggt

SEQ ID NO: 408059 - DNA, 25 bp, Mus musculus
cgattatgcttggaccgggacatgg

SEQ ID NO: 408060 - DNA, 25 bp, Mus musculus
gcggaatgctaacaccttccaccta

SEQ ID NO: 408061 - DNA, 25 bp, Mus musculus
agacgattatgcttggaccgggaca

SEQ ID NO: 408062 - DNA, 25 bp, Mus musculus
tccaggccgaagacgattatgcttg

SEQ ID NO: 408063 - DNA, 25 bp, Mus musculus
gaccaaaggccagggtccaggccga

SEQ ID NO: 408064 - DNA, 25 bp, Mus musculus
ctacaggaccaaaggccagggtcca

SEQ ID NO: 408065 - DNA, 25 bp, Mus musculus
atgctaacaccttccacctacagga

SEQ ID NO: 408066 - DNA, 25 bp, Mus musculus
caggtaactgtggagcggaatgcta

SEQ ID NO: 408067 - DNA, 25 bp, Mus musculus
agtgtaccggaagtgggagtgtagc

SEQ ID NO: 408068 - DNA, 25 bp, Mus musculus
ggcgcagtccgcttaactagtagtg

SEQ ID NO: 408069 - DNA, 25 bp, Mus musculus
cagaccgcaggagcgtggcgatcca

SEQ ID NO: 408070 - DNA, 25 bp, Mus musculus
gcgcgcgcccagcaggtgaaagtcc

SEQ ID NO: 408071 - DNA, 25 bp, Mus musculus
gtgcctgtcacggagacgccggatc

SEQ ID NO: 408072 - DNA, 25 bp, Mus musculus
gactagaccgggagtccgatcccga

SEQ ID NO: 408073 - DNA, 25 bp, Mus musculus
ctggaaggcgtcctcgttgtgcaaa

SEQ ID NO: 408074 - DNA, 25 bp, Mus musculus
cgcacggccagaagcgggactagac

SEQ ID NO: 408075 - DNA, 25 bp, Mus musculus
ggatccgtagatcgtgcccatcgtc

SEQ ID NO: 408076 - DNA, 25 bp, Mus musculus
cgtgcccatcgtccacaaggttgta

SEQ ID NO: 408077 - DNA, 25 bp, Mus musculus
aggttgtacttggttttgctgggca

SEQ ID NO: 408078 - DNA, 25 bp, Mus musculus
ggcgagaccctgtgcagagaacagt

SEQ ID NO: 408079 - DNA, 25 bp, Mus musculus
cgacgagaaagagctggcgagaccc

SEQ ID NO: 408080 - DNA, 25 bp, Mus musculus
cttaactagtagtggcgaaacggca

SEQ ID NO: 408081 - DNA, 25 bp, Mus musculus
tcctcgttgtgcaaagggatccgta

SEQ ID NO: 408082 - DNA, 25 bp, Mus musculus
ttgcctcctgcgctgtggccactgt

SEQ ID NO: 408083 - DNA, 25 bp, Mus musculus
gtgtttctccgctgtcccggttgca

SEQ ID NO: 408084 - DNA, 25 bp, Mus musculus
cggttgcagtccagggagcaagtca

SEQ ID NO: 408085 - DNA, 25 bp, Mus musculus
gagctcgggcgtgaagaaaactcga

SEQ ID NO: 408086 - DNA, 25 bp, Mus musculus
ctcgagaaaaggcacacggagtccc

SEQ ID NO: 408087 - DNA, 25 bp, Mus musculus
cggagtccctctcggatgaccattt

SEQ ID NO: 408088 - DNA, 25 bp, Mus musculus
cggatgaccatttacaatcagatgc

SEQ ID NO: 408089 - DNA, 25 bp, Mus musculus
tacaatcagatgcaaggccagcagc

SEQ ID NO: 408090 - DNA, 25 bp, Mus musculus
gcttaagcgcagtggctgaacccta

SEQ ID NO: 408091 - DNA, 25 bp, Mus musculus
ttctgcccggcacaatagaggctcc

SEQ ID NO: 408092 - DNA, 25 bp, Mus musculus
catcttgcgcccagtctccgggtgt

SEQ ID NO: 408093 - DNA, 25 bp, Mus musculus
gtgtcccgagtttcccggcgctagc

SEQ ID NO: 408094 - DNA, 25 bp, Mus musculus
ggctgcatctttctgcccggcacaa

SEQ ID NO: 408095 - DNA, 25 bp, Mus musculus
gcgcagcgcccaagtctgtgcgctt

SEQ ID NO: 408096 - DNA, 25 bp, Mus musculus
cccagtcttcatctggtccatgagg

SEQ ID NO: 408097 - DNA, 25 bp, Mus musculus
gccgggcggaggcaaactatctcac

SEQ ID NO: 408098 - DNA, 25 bp, Mus musculus
aagctgaacgctgacacggacggtg

SEQ ID NO: 408099 - DNA, 25 bp, Mus musculus
gcggccggaggacaaaataagctga

SEQ ID NO: 408100 - DNA, 25 bp, Mus musculus
tgagtaacctgaaacggcggcggcc

SEQ ID NO: 408101 - DNA, 25 bp, Mus musculus
ctcggatgggtgagtaacctgaaac

SEQ ID NO: 408102 - DNA, 25 bp, Mus musculus
ctctccctcacaactcggatgggtg

SEQ ID NO: 408103 - DNA, 25 bp, Mus musculus
tggcgccggcaacacaagccggctt

SEQ ID NO: 408104 - DNA, 25 bp, Mus musculus
aggcgactccatggcgccggcaaca

SEQ ID NO: 408105 - DNA, 25 bp, Mus musculus
tggtccatgaggaagaaccggacta

SEQ ID NO: 408106 - DNA, 25 bp, Mus musculus
ctcgggtacattcgcagatccactc

SEQ ID NO: 408107 - DNA, 25 bp, Mus musculus
ggacacgggtcgtccacacctgtca

SEQ ID NO: 408108 - DNA, 25 bp, Mus musculus
cggcccgacctagctcgggtacatt

SEQ ID NO: 408109 - DNA, 25 bp, Mus musculus
aaccggactaaaaggcgactccatg

SEQ ID NO: 408110 - DNA, 25 bp, Mus musculus
tggaccaatgatttaaccgcttaga

SEQ ID NO: 408111 - DNA, 25 bp, Mus musculus
ggatcaggtcccacctctgggctct

SEQ ID NO: 408112 - DNA, 25 bp, Mus musculus
tctgggctctgagcggttcgctctt

SEQ ID NO: 408113 - DNA, 25 bp, Mus musculus
cggttcgctcttcgaggatcagggc

SEQ ID NO: 408114 - DNA, 25 bp, Mus musculus
gtcgcttcctattggccgacttgcc

SEQ ID NO: 408115 - DNA, 25 bp, Mus musculus
cgggcgtccggacatctgattggac

SEQ ID NO: 408116 - DNA, 25 bp, Mus musculus
gcaagaagagctcgccgcagtcctt

SEQ ID NO: 408117 - DNA, 25 bp, Mus musculus
actccgcgacgtgcgagccgggaaa

SEQ ID NO: 408118 - DNA, 25 bp, Mus musculus
cgaggcgtgaggagagcctttaata

SEQ ID NO: 408119 - DNA, 25 bp, Mus musculus
agaacaaatacaagtgcggtcgggc

SEQ ID NO: 408120 - DNA, 25 bp, Mus musculus
ttagaaggtcgcagagctgcgctgc

SEQ ID NO: 408121 - DNA, 25 bp, Mus musculus
tgcgctgcttgcgactggctctgct

SEQ ID NO: 408122 - DNA, 25 bp, Mus musculus
aaccgcttagatcacctcgtgggtg

SEQ ID NO: 408123 - DNA, 25 bp, Mus musculus
ggctctgcttgaccttggaccaatg

SEQ ID NO: 408124 - DNA, 25 bp, Mus musculus
cctctgcagagaggcgagacccggt

SEQ ID NO: 408125 - DNA, 25 bp, Mus musculus
agtgactgactcctgtgtcggaata

SEQ ID NO: 408126 - DNA, 25 bp, Mus musculus
cgccaccaagtcaccggctagagtg

SEQ ID NO: 408127 - DNA, 25 bp, Mus musculus
aaccctgcgcttccaacatggcaga

SEQ ID NO: 408128 - DNA, 25 bp, Mus musculus
gccatggttagaaccctgcgcttcc

SEQ ID NO: 408129 - DNA, 25 bp, Mus musculus
tccaccgtcagcacggcggtgatgc

SEQ ID NO: 408130 - DNA, 25 bp, Mus musculus
gaaagccggttcagagtccaccgtc

SEQ ID NO: 408131 - DNA, 25 bp, Mus musculus
gaggctccggagaccttcgaaccca

SEQ ID NO: 408132 - DNA, 25 bp, Mus musculus
gtccagcgccggcacgaagaggctc

SEQ ID NO: 408133 - DNA, 25 bp, Mus musculus
agcaggtcggtctcgggtttgtcca

SEQ ID NO: 408134 - DNA, 25 bp, Mus musculus
acgcagcgatccaggtggctgagca

SEQ ID NO: 408135 - DNA, 25 bp, Mus musculus
ccgatgaaggccacgcagcgatcca

SEQ ID NO: 408136 - DNA, 25 bp, Mus musculus
ccttcggagcgagcctggccgatga

SEQ ID NO: 408137 - DNA, 25 bp, Mus musculus
tcggaatagctccagccgctcagca

SEQ ID NO: 408138 - DNA, 25 bp, Mus musculus
tggcggcctcacaccagtacgattc

SEQ ID NO: 408139 - DNA, 25 bp, Mus musculus
tcagcaccggtgtctggaacagctc

SEQ ID NO: 408140 - DNA, 25 bp, Mus musculus
cagaaggcctttgagcagctgcatc

SEQ ID NO: 408141 - DNA, 25 bp, Mus musculus
catctcgcgaagcaggaggtccacc

SEQ ID NO: 408142 - DNA, 25 bp, Mus musculus
tccaccttgggctgaagagcttcgc

SEQ ID NO: 408143 - DNA, 25 bp, Mus musculus
tgcagccctgcaaaggtgctgttcg

SEQ ID NO: 408144 - DNA, 25 bp, Mus musculus
tggaagtgactgactgaacggatct

SEQ ID NO: 408145 - DNA, 25 bp, Mus musculus
aacggatctggacactggggtcttc

SEQ ID NO: 408146 - DNA, 25 bp, Mus musculus
tcttccggaaggaaagcggcttgtc

SEQ ID NO: 408147 - DNA, 25 bp, Mus musculus
gcgtttccgtacactccggctggtg

SEQ ID NO: 408148 - DNA, 25 bp, Mus musculus
ccggccggctgtacttgtagaaggc

SEQ ID NO: 408149 - DNA, 25 bp, Mus musculus
cttgtagaaggcgaactgcagcggc

SEQ ID NO: 408150 - DNA, 25 bp, Mus musculus
tgcgggcttaacgtcctcagcaccg

SEQ ID NO: 408151 - DNA, 25 bp, Mus musculus
gggcctgcaacgcaacacgcctggt

SEQ ID NO: 408152 - DNA, 25 bp, Mus musculus
tggaaatatctcacagcctggccgt

SEQ ID NO: 408153 - DNA, 25 bp, Mus musculus
agaacatgggcgcactctccactgg

SEQ ID NO: 408154 - DNA, 25 bp, Mus musculus
ctctccactgggatacgcatggtgc

SEQ ID NO: 408155 - DNA, 25 bp, Mus musculus
tacgcatggtgccagagcactggta

SEQ ID NO: 408156 - DNA, 25 bp, Mus musculus
agcactggtagtgaccgctgtcgct

SEQ ID NO: 408157 - DNA, 25 bp, Mus musculus
ctcgcgcttgcagcaccgtgtagtt

SEQ ID NO: 408158 - DNA, 25 bp, Mus musculus
tggtgctagagtggaaatatctcac

SEQ ID NO: 408159 - DNA, 25 bp, Mus musculus
atctcacagcctggccgtcgtggta

SEQ ID NO: 408160 - DNA, 25 bp, Mus musculus
cgtcgtggtagtagtgaagtttgta

SEQ ID NO: 408161 - DNA, 25 bp, Mus musculus
agtgaagtttgtagacgactttgtc

SEQ ID NO: 408162 - DNA, 25 bp, Mus musculus
cgactttgtcgtaccagccacggca

SEQ ID NO: 408163 - DNA, 25 bp, Mus musculus
tttgtcgtaccagccacggcagcgc

SEQ ID NO: 408164 - DNA, 25 bp, Mus musculus
acggcagcgcatcaccaagggctct

SEQ ID NO: 408165 - DNA, 25 bp, Mus musculus
gcagcaccgtgtagttggtgctaga

SEQ ID NO: 408166 - DNA, 25 bp, Mus musculus
tggatgtcggcagcggaacaatttc

SEQ ID NO: 408167 - DNA, 25 bp, Mus musculus
cttacccggctggatgtcggcagcg

SEQ ID NO: 408168 - DNA, 25 bp, Mus musculus
cccttacccggctggatgtcggcag

SEQ ID NO: 408169 - DNA, 25 bp, Mus musculus
tcctttctctcccggtcgcagtccc

SEQ ID NO: 408170 - DNA, 25 bp, Mus musculus
cactggccgccttggtcccaccgtt

SEQ ID NO: 408171 - DNA, 25 bp, Mus musculus
tgtcggcagcggaacaatttcaccc

SEQ ID NO: 408172 - DNA, 25 bp, Mus musculus
ctcggccgtgacgtgtacagtttgt

SEQ ID NO: 408173 - DNA, 25 bp, Mus musculus
ggccgtgacgtgtacagtttgtgca

SEQ ID NO: 408174 - DNA, 25 bp, Mus musculus
cgtgacgtgtacagtttgtgcaggc

SEQ ID NO: 408175 - DNA, 25 bp, Mus musculus
acgtgtacagtttgtgcaggcgtcc

SEQ ID NO: 408176 - DNA, 25 bp, Mus musculus
tgtacagtttgtgcaggcgtcctga

SEQ ID NO: 408177 - DNA, 25 bp, Mus musculus
acagtttgtgcaggcgtcctgacgc

SEQ ID NO: 408178 - DNA, 25 bp, Mus musculus
tcggcagcggaacaatttcacccgc

SEQ ID NO: 408179 - DNA, 25 bp, Mus musculus
cgtgcagggctagagcggcccagag

SEQ ID NO: 408180 - DNA, 25 bp, Mus musculus
cggcgaccgctttcgtttcgtctct

SEQ ID NO: 408181 - DNA, 25 bp, Mus musculus
aggagaactggtcgctaagagatca

SEQ ID NO: 408182 - DNA, 25 bp, Mus musculus
ataagcgacttagaacgaccggtgg

SEQ ID NO: 408183 - DNA, 25 bp, Mus musculus
cggcaccggttccataagcgactta

SEQ ID NO: 408184 - DNA, 25 bp, Mus musculus
cgttctcggttccaggctccgcaaa

SEQ ID NO: 408185 - DNA, 25 bp, Mus musculus
tgttcaccgcctgacgttctcggtt

SEQ ID NO: 408186 - DNA, 25 bp, Mus musculus
ccagaaggaaatatttcctccgctt

SEQ ID NO: 408187 - DNA, 25 bp, Mus musculus
tccgtgagaaaattcggcgtcaacc

SEQ ID NO: 408188 - DNA, 25 bp, Mus musculus
caaatttaaaaatggattccgtgag

SEQ ID NO: 408189 - DNA, 25 bp, Mus musculus
tgtatctgttttccgcaaatttaaa

SEQ ID NO: 408190 - DNA, 25 bp, Mus musculus
agcatgtttgtatctgttttccgca

SEQ ID NO: 408191 - DNA, 25 bp, Mus musculus
ggaagaaatttactgagcatgtttg

SEQ ID NO: 408192 - DNA, 25 bp, Mus musculus
tcgtttcgtctctttaatagaagga

SEQ ID NO: 408193 - DNA, 25 bp, Mus musculus
taagagatcatctgcggcctgactc

SEQ ID NO: 408194 - DNA, 25 bp, Mus musculus
cgccgactgacagactgactccgga

SEQ ID NO: 408195 - DNA, 25 bp, Mus musculus
ccacgacgacgcctaccgctgactt

SEQ ID NO: 408196 - DNA, 25 bp, Mus musculus
agagcccagagccttccacgacgac

SEQ ID NO: 408197 - DNA, 25 bp, Mus musculus
cacttgtctttccaaaaaggacgct

SEQ ID NO: 408198 - DNA, 25 bp, Mus musculus
cgcgcttagcgcactcgcacgcaca

SEQ ID NO: 408199 - DNA, 25 bp, Mus musculus
actgactccggacagagcccagagc

SEQ ID NO: 408200 - DNA, 25 bp, Mus musculus
ctgcaccgctgggacggcgcccaca

SEQ ID NO: 408201 - DNA, 25 bp, Mus musculus
aaaacgtgggcacgctgcgttggcc

SEQ ID NO: 408202 - DNA, 25 bp, Mus musculus
accttggcaaaacgtgggcacgctg

SEQ ID NO: 408203 - DNA, 25 bp, Mus musculus
cagggctcgggaccttggcaaaacg

SEQ ID NO: 408204 - DNA, 25 bp, Mus musculus
cgacaagcacaagctcagaggcgcc

SEQ ID NO: 408205 - DNA, 25 bp, Mus musculus
ggcgacaagcacaagctcagaggcg

SEQ ID NO: 408206 - DNA, 25 bp, Mus musculus
cttgggcttcgctcgctagcgcagc

SEQ ID NO: 408207 - DNA, 25 bp, Mus musculus
cgagcggccagaaaaagggtttgag

SEQ ID NO: 408208 - DNA, 25 bp, Mus musculus
ccgcaggatctgctggcacctctcc

SEQ ID NO: 408209 - DNA, 25 bp, Mus musculus
tgtgccgcccgcaggatctgctggc

SEQ ID NO: 408210 - DNA, 25 bp, Mus musculus
actcacatccgccacagtggcttta

SEQ ID NO: 408211 - DNA, 25 bp, Mus musculus
gtgccgcccgcaggatctgctggca

SEQ ID NO: 408212 - DNA, 25 bp, Mus musculus
gccgcccgcaggatctgctggcacc

SEQ ID NO: 408213 - DNA, 25 bp, Mus musculus
tcacatccgccacagtggctttaca

SEQ ID NO: 408214 - DNA, 25 bp, Mus musculus
ggtttctttcccgactcacatccgc

SEQ ID NO: 408215 - DNA, 25 bp, Mus musculus
aggtttctttcccgactcacatccg

SEQ ID NO: 408216 - DNA, 25 bp, Mus musculus
caaaggtttctttcccgactcacat

SEQ ID NO: 408217 - DNA, 25 bp, Mus musculus
gcaaaggtttctttcccgactcaca

SEQ ID NO: 408218 - DNA, 25 bp, Mus musculus
catccgctgggcaaaggtttctttc

SEQ ID NO: 408219 - DNA, 25 bp, Mus musculus
tctgctggcacctctccccatgtta

SEQ ID NO: 408220 - DNA, 25 bp, Mus musculus
cgcaggatctgctggcacctctccc

SEQ ID NO: 408221 - DNA, 25 bp, Mus musculus
cacatccgccacagtggctttacaa

SEQ ID NO: 408222 - DNA, 25 bp, Mus musculus
agtcccttctggatgccctttcgga

SEQ ID NO: 408223 - DNA, 25 bp, Mus musculus
tacccattgaggtggagcacagtcc

SEQ ID NO: 408224 - DNA, 25 bp, Mus musculus
tcagcactcaggatccggcactgtg

SEQ ID NO: 408225 - DNA, 25 bp, Mus musculus
gctcagcactcaggatccggcactg

SEQ ID NO: 408226 - DNA, 25 bp, Mus musculus
gtggagcacagtcctccgctcagca

SEQ ID NO: 408227 - DNA, 25 bp, Mus musculus
attgaggtggagcacagtcctccgc

SEQ ID NO: 408228 - DNA, 25 bp, Mus musculus
tcgggtcggaataagcactgtgtgt

SEQ ID NO: 408229 - DNA, 25 bp, Mus musculus
cccaggaatcgcctttggtggcagg

SEQ ID NO: 408230 - DNA, 25 bp, Mus musculus
tggcgcccaggaatcgcctttggtg

SEQ ID NO: 408231 - DNA, 25 bp, Mus musculus
atccggcactgtgctggcagggtca

SEQ ID NO: 408232 - DNA, 25 bp, Mus musculus
cttctggatgccctttcggactggt

SEQ ID NO: 408233 - DNA, 25 bp, Mus musculus
ctcaggatccggcactgtgctggca

SEQ ID NO: 408234 - DNA, 25 bp, Mus musculus
gcacagtcccttctggatgcccttt

SEQ ID NO: 408235 - DNA, 25 bp, Mus musculus
tggatgccctttcggactggtgccc

SEQ ID NO: 408236 - DNA, 25 bp, Mus musculus
caggttctgctggtacctctcacca

SEQ ID NO: 408237 - DNA, 25 bp, Mus musculus
caggatcccgagaaacagtggcttt

SEQ ID NO: 408238 - DNA, 25 bp, Mus musculus
ggacaccaggatcccgagaaacagt

SEQ ID NO: 408239 - DNA, 25 bp, Mus musculus
ctcaccatactacccattgaggtgg

SEQ ID NO: 408240 - DNA, 25 bp, Mus musculus
tggccaggacaccaggatcccgaga

SEQ ID NO: 408241 - DNA, 25 bp, Mus musculus
atcccgagaaacagtggctttacaa

SEQ ID NO: 408242 - DNA, 25 bp, Mus musculus
cactgtggccaggacaccaggatcc

SEQ ID NO: 408243 - DNA, 25 bp, Mus musculus
caccactgtggccaggacaccagga

SEQ ID NO: 408244 - DNA, 25 bp, Mus musculus
tttccgactcgcatccaccactgtg

SEQ ID NO: 408245 - DNA, 25 bp, Mus musculus
ggttctgctggtacctctcaccata

SEQ ID NO: 408246 - DNA, 25 bp, Mus musculus
ccgcaggttctgctggtacctctca

SEQ ID NO: 408247 - DNA, 25 bp, Mus musculus
tctgctggtacctctcaccatacta

SEQ ID NO: 408248 - DNA, 25 bp, Mus musculus
ttccgcccgcaggttctgctggtac

SEQ ID NO: 408249 - DNA, 25 bp, Mus musculus
catccgctgtgcaaaggtttttttt

SEQ ID NO: 408250 - DNA, 25 bp, Mus musculus
ggcgcctgccaacacgctaccctca

SEQ ID NO: 408251 - DNA, 25 bp, Mus musculus
ggtcctcaaagccttttgctggccg

SEQ ID NO: 408252 - DNA, 25 bp, Mus musculus
gccccatgggcgctctcccttatac

SEQ ID NO: 408253 - DNA, 25 bp, Mus musculus
ctcccttatactcacgccctacacg

SEQ ID NO: 408254 - DNA, 25 bp, Mus musculus
tatactcacgccctacacgcagacc

SEQ ID NO: 408255 - DNA, 25 bp, Mus musculus
tacacgcagacccagataatccagc

SEQ ID NO: 408256 - DNA, 25 bp, Mus musculus
agataatccagccccgcacgatgtc

SEQ ID NO: 408257 - DNA, 25 bp, Mus musculus
gtcctcaaagccttttgctggccgc

SEQ ID NO: 408258 - DNA, 25 bp, Mus musculus
cctcaaagccttttgctggccgctg

SEQ ID NO: 408259 - DNA, 25 bp, Mus musculus
ctcaaagccttttgctggccgctgg

SEQ ID NO: 408260 - DNA, 25 bp, Mus musculus
tcaaagccttttgctggccgctggc

SEQ ID NO: 408261 - DNA, 25 bp, Mus musculus
cctgccaacacgctaccctcagccc

SEQ ID NO: 408262 - DNA, 25 bp, Mus musculus
gccctggcgcctgccaacacgctac

SEQ ID NO: 408263 - DNA, 25 bp, Mus musculus
gcccagcgccctggcgcctgccaac

SEQ ID NO: 408264 - DNA, 25 bp, Mus musculus
cccaggctaaagtcacctcagcaag

SEQ ID NO: 408265 - DNA, 25 bp, Mus musculus
tcggccacacacagtgtgacctcta

SEQ ID NO: 408266 - DNA, 25 bp, Mus musculus
cctcagcaagaacgcagccatcttg

SEQ ID NO: 408267 - DNA, 25 bp, Mus musculus
ttccggcctggacggaaatgacgca

SEQ ID NO: 408268 - DNA, 25 bp, Mus musculus
cgcagccatcttgagttccggcctg

SEQ ID NO: 408269 - DNA, 25 bp, Mus musculus
agaacgcagccatcttgagttccgg

SEQ ID NO: 408270 - DNA, 25 bp, Mus musculus
agtcacctcagcaagaacgcagcca

SEQ ID NO: 408271 - DNA, 25 bp, Mus musculus
ggcgtggactcctagccccaggcta

SEQ ID NO: 408272 - DNA, 25 bp, Mus musculus
tcagggactaattcaggttccccca

SEQ ID NO: 408273 - DNA, 25 bp, Mus musculus
gctgtcaccccctcagggactaatt

SEQ ID NO: 408274 - DNA, 25 bp, Mus musculus
cccgcaaggcacacaccgctgtcac

SEQ ID NO: 408275 - DNA, 25 bp, Mus musculus
tgcacacccgcaggtcctttccctg

SEQ ID NO: 408276 - DNA, 25 bp, Mus musculus
gtgtgacctctaagcccttccgagc

SEQ ID NO: 408277 - DNA, 25 bp, Mus musculus
acacagtgtgacctctaagcccttc

SEQ ID NO: 408278 - DNA, 25 bp, Mus musculus
ggcgtccatccagagagtaactcta

SEQ ID NO: 408279 - DNA, 25 bp, Mus musculus
gtgcacgctgcgagctgttgcttaa

SEQ ID NO: 408280 - DNA, 25 bp, Mus musculus
cccaaagcactattgcaattgttag

SEQ ID NO: 408281 - DNA, 25 bp, Mus musculus
gcagtggcgtccatccagagagtaa

SEQ ID NO: 408282 - DNA, 25 bp, Mus musculus
agtaactctagcttcccgggacctg

SEQ ID NO: 408283 - DNA, 25 bp, Mus musculus
cggggtatgccaagtggcaccactc

SEQ ID NO: 408284 - DNA, 25 bp, Mus musculus
cctcggagatgcgtgcgtgaaccgc

SEQ ID NO: 408285 - DNA, 25 bp, Mus musculus
tctgacctggtcctgtcagcagctc

SEQ ID NO: 408286 - DNA, 25 bp, Mus musculus
tggtcctgtcagcagctccgggcgc

SEQ ID NO: 408287 - DNA, 25 bp, Mus musculus
gccttgaccggctccaccttttata

SEQ ID NO: 408288 - DNA, 25 bp, Mus musculus
tgaccggctccaccttttatagtga

SEQ ID NO: 408289 - DNA, 25 bp, Mus musculus
tttatagtgagctgcggtccctgcc

SEQ ID NO: 408290 - DNA, 25 bp, Mus musculus
ttgcaattgttaggctaaaagcacc

SEQ ID NO: 408291 - DNA, 25 bp, Mus musculus
tgcgagctgttgcttaatgctgccc

SEQ ID NO: 408292 - DNA, 25 bp, Mus musculus
gcagttcagtttaaacgcaattttg

SEQ ID NO: 408293 - DNA, 25 bp, Mus musculus
gactccgcgttgctttacggctccg

SEQ ID NO: 408294 - DNA, 25 bp, Mus musculus
caggaagcggcgtagactccgcgtt

SEQ ID NO: 408295 - DNA, 25 bp, Mus musculus
ccatgacccgcggtgcttcaagggc

SEQ ID NO: 408296 - DNA, 25 bp, Mus musculus
tctcggcaaggaccgcagcaggtcc

SEQ ID NO: 408297 - DNA, 25 bp, Mus musculus
tggccaggctcactctcggcaagga

SEQ ID NO: 408298 - DNA, 25 bp, Mus musculus
ttaggactgggcttcaggttggcca

SEQ ID NO: 408299 - DNA, 25 bp, Mus musculus
gcacgcgtccatcgccagagtgacg

SEQ ID NO: 408300 - DNA, 25 bp, Mus musculus
tagcatccttaacactgggcgcacg

SEQ ID NO: 408301 - DNA, 25 bp, Mus musculus
gagtgtgtaccctccgcctgcttag

SEQ ID NO: 408302 - DNA, 25 bp, Mus musculus
atcgtctgcagttcccgagtgtgta

SEQ ID NO: 408303 - DNA, 25 bp, Mus musculus
tgtcgtgctgcagagcgaccgcatc

SEQ ID NO: 408304 - DNA, 25 bp, Mus musculus
cgcaattttggatgaatcgtctgca

SEQ ID NO: 408305 - DNA, 25 bp, Mus musculus
acgataggcacttgctaagcagttc

SEQ ID NO: 408306 - DNA, 25 bp, Mus musculus
ctcgggctccgaatcggtctggcca

SEQ ID NO: 408307 - DNA, 25 bp, Mus musculus
ccgggccaagcacgccgagcatccc

SEQ ID NO: 408308 - DNA, 25 bp, Mus musculus
ggagcacgacctcgccgggcccacc

SEQ ID NO: 408309 - DNA, 25 bp, Mus musculus
ggctgctccggctcgtcgtgctgct

SEQ ID NO: 408310 - DNA, 25 bp, Mus musculus
cggcaccagctccaccgggacgcgc

SEQ ID NO: 408311 - DNA, 25 bp, Mus musculus
tccgaatcggtctggccagtggagt

SEQ ID NO: 408312 - DNA, 25 bp, Mus musculus
ctggccagtggagtcgcatcctcca

SEQ ID NO: 408313 - DNA, 25 bp, Mus musculus
cgccgatgcaggttgcccatgaaga

SEQ ID NO: 408314 - DNA, 25 bp, Mus musculus
cgcgccgcacagctcagcgcggccg

SEQ ID NO: 408315 - DNA, 25 bp, Mus musculus
gcaggctcccttaggtcgggtgccc

SEQ ID NO: 408316 - DNA, 25 bp, Mus musculus
aggcgtcccagctagcccatatcgt

SEQ ID NO: 408317 - DNA, 25 bp, Mus musculus
cagctagcccatatcgtcgccgccc

SEQ ID NO: 408318 - DNA, 25 bp, Mus musculus
agccaacccactcccgagcgcgcgg

SEQ ID NO: 408319 - DNA, 25 bp, Mus musculus
gctctctcgggaggttgcttgggct

SEQ ID NO: 408320 - DNA, 25 bp, Mus musculus
tcccacggcttctctgggcgtgaga

SEQ ID NO: 408321 - DNA, 25 bp, Mus musculus
ttcccttcttatcgccacaacggag

SEQ ID NO: 408322 - DNA, 25 bp, Mus musculus
gcaacttcgcgcagaatccagcact

SEQ ID NO: 408323 - DNA, 25 bp, Mus musculus
tctgggcgtgagagatttactgctc

SEQ ID NO: 408324 - DNA, 25 bp, Mus musculus
tcatctttagtaagggcgtccctcc

SEQ ID NO: 408325 - DNA, 25 bp, Mus musculus
acgactgccgtcatctttagtaagg

SEQ ID NO: 408326 - DNA, 25 bp, Mus musculus
cgtttcaataacgacgactgccgtc

SEQ ID NO: 408327 - DNA, 25 bp, Mus musculus
tctcagcttcacttgcgtttcaata

SEQ ID NO: 408328 - DNA, 25 bp, Mus musculus
atccggattccgcttctcagcttca

SEQ ID NO: 408329 - DNA, 25 bp, Mus musculus
gccgccatctttaccgggctgcaga

SEQ ID NO: 408330 - DNA, 25 bp, Mus musculus
cctggtgggcttcccttcttatcgc

SEQ ID NO: 408331 - DNA, 25 bp, Mus musculus
tgcgaacggaacaacatccggattc

SEQ ID NO: 408332 - DNA, 25 bp, Mus musculus
cagggaggtcaattgcgaacggaac

SEQ ID NO: 408333 - DNA, 25 bp, Mus musculus
actgctctctcctgaggcaacttcg

SEQ ID NO: 408334 - DNA, 25 bp, Mus musculus
gctccatcagctcggtacctggggc

SEQ ID NO: 408335 - DNA, 25 bp, Mus musculus
agctcggtacctggggctccgtatc

SEQ ID NO: 408336 - DNA, 25 bp, Mus musculus
tccatcagctcggtacctggggctc

SEQ ID NO: 408337 - DNA, 25 bp, Mus musculus
aggcctgtgggacagccccttcggc

SEQ ID NO: 408338 - DNA, 25 bp, Mus musculus
cactaggcctgtgggacagcccctt

SEQ ID NO: 408339 - DNA, 25 bp, Mus musculus
ctcagcgcccactaggcctgtggga

SEQ ID NO: 408340 - DNA, 25 bp, Mus musculus
tgccgatcacctcctcagcgcccac

SEQ ID NO: 408341 - DNA, 25 bp, Mus musculus
ggctcccagccctgccgatcacctc

SEQ ID NO: 408342 - DNA, 25 bp, Mus musculus
cccaactagaggctcggctcccagc

SEQ ID NO: 408343 - DNA, 25 bp, Mus musculus
gaacccagccgcctcccaactagag

SEQ ID NO: 408344 - DNA, 25 bp, Mus musculus
aggccggccctggtcctcaccggct

SEQ ID NO: 408345 - DNA, 25 bp, Mus musculus
cgcggtgctcagagtcccgaggccg

SEQ ID NO: 408346 - DNA, 25 bp, Mus musculus
atcagctcggtacctggggctccgt

SEQ ID NO: 408347 - DNA, 25 bp, Mus musculus
cagcgcccactaggcctgtgggaca

SEQ ID NO: 408348 - DNA, 25 bp, Mus musculus
cttccaagatggctgcagcgatacc

SEQ ID NO: 408349 - DNA, 25 bp, Mus musculus
gtgcgggccaccaactaaggactgg

SEQ ID NO: 408350 - DNA, 25 bp, Mus musculus
actgcgaagtcgagaggaagcaccg

SEQ ID NO: 408351 - DNA, 25 bp, Mus musculus
caccgggacctgagacttctctgca

SEQ ID NO: 408352 - DNA, 25 bp, Mus musculus
caccaactaaggactggcaagcttg

SEQ ID NO: 408353 - DNA, 25 bp, Mus musculus
cgggaagagaagaagttctgagtca

SEQ ID NO: 408354 - DNA, 25 bp, Mus musculus
gttctgagtcaaggctgaaaaatca

SEQ ID NO: 408355 - DNA, 25 bp, Mus musculus
aatcagattgagcacggacagggtc

SEQ ID NO: 408356 - DNA, 25 bp, Mus musculus
cacggacagggtctcggatggaaat

SEQ ID NO: 408357 - DNA, 25 bp, Mus musculus
gggccggttgctttcacattgcaca

SEQ ID NO: 408358 - DNA, 25 bp, Mus musculus
gctttcacattgcacagtaggggca

SEQ ID NO: 408359 - DNA, 25 bp, Mus musculus
acagtaggggcaagcgcaagagacc

SEQ ID NO: 408360 - DNA, 25 bp, Mus musculus
cttcccttcgcgtgcaaggctctga

SEQ ID NO: 408361 - DNA, 25 bp, Mus musculus
cccgttaggagactgcgaagtcgag

SEQ ID NO: 408362 - DNA, 25 bp, Mus musculus
tcacagtctcttaggcgcctgcgcg

SEQ ID NO: 408363 - DNA, 25 bp, Mus musculus
gcggtccgagaatgccgttcttcca

SEQ ID NO: 408364 - DNA, 25 bp, Mus musculus
gttcttccagcccagttctcccagg

SEQ ID NO: 408365 - DNA, 25 bp, Mus musculus
gcgagcatccccctttgtggtgaac

SEQ ID NO: 408366 - DNA, 25 bp, Mus musculus
tctggggtctggatccatcctccct

SEQ ID NO: 408367 - DNA, 25 bp, Mus musculus
ccgggctgcagctttagccgcagct

SEQ ID NO: 408368 - DNA, 25 bp, Mus musculus
gcccagcttgctcccgccgcaaggg

SEQ ID NO: 408369 - DNA, 25 bp, Mus musculus
cgccatctttgttggtgccgcccgg

SEQ ID NO: 408370 - DNA, 25 bp, Mus musculus
accggcttcacagtctcttaggcgc

SEQ ID NO: 408371 - DNA, 25 bp, Mus musculus
ggggtctggatccatcctccctcgg

SEQ ID NO: 408372 - DNA, 25 bp, Mus musculus
gcgcgcccacactcggaatcctccc

SEQ ID NO: 408373 - DNA, 25 bp, Mus musculus
cacctacctcctcggcgcttgcgtg

SEQ ID NO: 408374 - DNA, 25 bp, Mus musculus
ggccaccggcttcacagtctcttag

SEQ ID NO: 408375 - DNA, 25 bp, Mus musculus
ttagccgcagctgttgcccagcttg

SEQ ID NO: 408376 - DNA, 25 bp, Mus musculus
tcctttagtcgctgcacccacaatt

SEQ ID NO: 408377 - DNA, 25 bp, Mus musculus
ttcagcaccgggatctcagacacga

SEQ ID NO: 408378 - DNA, 25 bp, Mus musculus
atctcagacacgacccgccgagtgg

SEQ ID NO: 408379 - DNA, 25 bp, Mus musculus
tccgccatcttggaccagggagcag

SEQ ID NO: 408380 - DNA, 25 bp, Mus musculus
ctgcggaagtgcagttgcttgtcac

SEQ ID NO: 408381 - DNA, 25 bp, Mus musculus
tgcttgtcacttactcacggcgtcg

SEQ ID NO: 408382 - DNA, 25 bp, Mus musculus
gttggtcttcagcaccgggatctca

SEQ ID NO: 408383 - DNA, 25 bp, Mus musculus
ctgatattcctcctttagtcgctgc

SEQ ID NO: 408384 - DNA, 25 bp, Mus musculus
tgacccggatcagggactgatattc

SEQ ID NO: 408385 - DNA, 25 bp, Mus musculus
cacaggagtaaaactgacccggatc

SEQ ID NO: 408386 - DNA, 25 bp, Mus musculus
cgcggtcaagcacaggagtaaaact

SEQ ID NO: 408387 - DNA, 25 bp, Mus musculus
aagcggcttccacccggagccaatt

SEQ ID NO: 408388 - DNA, 25 bp, Mus musculus
caattcccgatctcggggtccggcg

SEQ ID NO: 408389 - DNA, 25 bp, Mus musculus
ctctgctacgcggtcaagcacagga

SEQ ID NO: 408390 - DNA, 25 bp, Mus musculus
cgtcagagtgacaggaagttcaagg

SEQ ID NO: 408391 - DNA, 25 bp, Mus musculus
cgttatggtctcgaagccgacacta

SEQ ID NO: 408392 - DNA, 25 bp, Mus musculus
tgcgaggttcgggtttcagaacgtc

SEQ ID NO: 408393 - DNA, 25 bp, Mus musculus
ggtgaactccagatcgtgacctttc

SEQ ID NO: 408394 - DNA, 25 bp, Mus musculus
gccgattccgcccttacgtatcatg

SEQ ID NO: 408395 - DNA, 25 bp, Mus musculus
gagggccttcgagcccgataccagc

SEQ ID NO: 408396 - DNA, 25 bp, Mus musculus
ggcttccaccttcaaatacgttctc

SEQ ID NO: 408397 - DNA, 25 bp, Mus musculus
ccgttaggagaaccctgcgttgcca

SEQ ID NO: 408398 - DNA, 25 bp, Mus musculus
tccagcctctcttgccgacgtgaag

SEQ ID NO: 408399 - DNA, 25 bp, Mus musculus
tcttgccgacgtgaagctacccact

SEQ ID NO: 408400 - DNA, 25 bp, Mus musculus
aggctgccctcacctagtatggctc

SEQ ID NO: 408401 - DNA, 25 bp, Mus musculus
acctagtatggctcctccgctcatg

SEQ ID NO: 408402 - DNA, 25 bp, Mus musculus
tttcacctcagttcaccgggcagtc

SEQ ID NO: 408403 - DNA, 25 bp, Mus musculus
tccgctcatgcctcgttatggtctc

SEQ ID NO: 408404 - DNA, 25 bp, Mus musculus
atctcaagagctgccaggagccagg

SEQ ID NO: 408405 - DNA, 25 bp, Mus musculus
gttaaagcatcgcaggtggaattca

SEQ ID NO: 408406 - DNA, 25 bp, Mus musculus
caggtggaattcaccgcagcgggca

SEQ ID NO: 408407 - DNA, 25 bp, Mus musculus
cagggtttgggagtaggtcctacat

SEQ ID NO: 408408 - DNA, 25 bp, Mus musculus
taggtcctacatgaagacacagcca

SEQ ID NO: 408409 - DNA, 25 bp, Mus musculus
tctctgttgcacaagttaaagcatc

SEQ ID NO: 408410 - DNA, 25 bp, Mus musculus
ccattcacggggtcggatctcaaga

SEQ ID NO: 408411 - DNA, 25 bp, Mus musculus
cccgggcaagaatctctgttgcaca

SEQ ID NO: 408412 - DNA, 25 bp, Mus musculus
cggtgtcgaattcgtgtagaagata

SEQ ID NO: 408413 - DNA, 25 bp, Mus musculus
tcgtgtagaagataagatttgtggc

SEQ ID NO: 408414 - DNA, 25 bp, Mus musculus
atttgtggctcgaaggggcctttag

SEQ ID NO: 408415 - DNA, 25 bp, Mus musculus
tttagtcctttccacggtctccatg

SEQ ID NO: 408416 - DNA, 25 bp, Mus musculus
tttccacggtctccatgggcacgca

SEQ ID NO: 408417 - DNA, 25 bp, Mus musculus
gacacagccaaaaccattcacgggg

SEQ ID NO: 408418 - DNA, 25 bp, Mus musculus
cgagatgtggggaagccagtaaata

SEQ ID NO: 408419 - DNA, 25 bp, Mus musculus
agtgcgaccgctgcaaactgaaggt

SEQ ID NO: 408420 - DNA, 25 bp, Mus musculus
aagagacctggttaagctaccgcga

SEQ ID NO: 408421 - DNA, 25 bp, Mus musculus
gtcgcaaagcgcctgttaccttgga

SEQ ID NO: 408422 - DNA, 25 bp, Mus musculus
gctaccgcgatcttacagtgatgtc

SEQ ID NO: 408423 - DNA, 25 bp, Mus musculus
ctgcagggactacagtgcgaccgct

SEQ ID NO: 408424 - DNA, 25 bp, Mus musculus
cttacagtgatgtcgtcaggggaac

SEQ ID NO: 408425 - DNA, 25 bp, Mus musculus
tggggaagccagtaaatatcctaaa

SEQ ID NO: 408426 - DNA, 25 bp, Mus musculus
tatcctaaaggatttgggctccgaa

SEQ ID NO: 408427 - DNA, 25 bp, Mus musculus
ggctccgaaaggctagaaaccggca

SEQ ID NO: 408428 - DNA, 25 bp, Mus musculus
tagaaaccggcagttcgttagacga

SEQ ID NO: 408429 - DNA, 25 bp, Mus musculus
ggcagttcgttagacgaacccaata

SEQ ID NO: 408430 - DNA, 25 bp, Mus musculus
tgttaccttggaaacaagagacctg

SEQ ID NO: 408431 - DNA, 25 bp, Mus musculus
ccgctgcaaactgaaggtcgcaaag

SEQ ID NO: 408432 - DNA, 25 bp, Mus musculus
agacgcgtcgttctcgggcaaggtc

SEQ ID NO: 408433 - DNA, 25 bp, Mus musculus
atgagcagctgtctatggagagacc

SEQ ID NO: 408434 - DNA, 25 bp, Mus musculus
gggactgcgcatgagcagctgtcta

SEQ ID NO: 408435 - DNA, 25 bp, Mus musculus
catcagatttgaagcgagcggaagt

SEQ ID NO: 408436 - DNA, 25 bp, Mus musculus
cgctctagcgggcatcagatttgaa

SEQ ID NO: 408437 - DNA, 25 bp, Mus musculus
aaatcggcgactgaagcggcctggc

SEQ ID NO: 408438 - DNA, 25 bp, Mus musculus
gcacctttgctttggctggcgtttc

SEQ ID NO: 408439 - DNA, 25 bp, Mus musculus
cgcctgggcacggagcctttgtttt

SEQ ID NO: 408440 - DNA, 25 bp, Mus musculus
atccaaagacggagaaggctgccgg

SEQ ID NO: 408441 - DNA, 25 bp, Mus musculus
ttctctcctgctttgtgggccgagc

SEQ ID NO: 408442 - DNA, 25 bp, Mus musculus
cagccgcctgcggtgggtatccagc

SEQ ID NO: 408443 - DNA, 25 bp, Mus musculus
ggtatccagcttcgagccgcaggcc

SEQ ID NO: 408444 - DNA, 25 bp, Mus musculus
cctactactagtcggtgggcctgca

SEQ ID NO: 408445 - DNA, 25 bp, Mus musculus
tggagagacctagatccaaagacgg

SEQ ID NO: 408446 - DNA, 25 bp, Mus musculus
tgagtcactcatcggagctccctct

SEQ ID NO: 408447 - DNA, 25 bp, Mus musculus
agccggtgatctgtgaccctacctc

SEQ ID NO: 408448 - DNA, 25 bp, Mus musculus
tgcacctgcgtacggtgagtcactc

SEQ ID NO: 408449 - DNA, 25 bp, Mus musculus
ctcttttcaccaatcggaacgcggg

SEQ ID NO: 408450 - DNA, 25 bp, Mus musculus
ctgctagagtccagcccagggcagt

SEQ ID NO: 408451 - DNA, 25 bp, Mus musculus
tccagcccagggcagtggatcgcga

SEQ ID NO: 408452 - DNA, 25 bp, Mus musculus
atcgcgaggctgttcccattggagt

SEQ ID NO: 408453 - DNA, 25 bp, Mus musculus
ttcccattggagttgctgtgcccgt

SEQ ID NO: 408454 - DNA, 25 bp, Mus musculus
tgcccgtcgcgtcgggattgtaact

SEQ ID NO: 408455 - DNA, 25 bp, Mus musculus
attgtaactgtaatgggcaccgagg

SEQ ID NO: 408456 - DNA, 25 bp, Mus musculus
actgttgtttctcttcacgtctatg

SEQ ID NO: 408457 - DNA, 25 bp, Mus musculus
cacgtctatgatcctgggtgagttc

SEQ ID NO: 408458 - DNA, 25 bp, Mus musculus
ggcttaacctggctgctagagtcca

SEQ ID NO: 408459 - DNA, 25 bp, Mus musculus
atcctgggtgagttcctagagtttt

SEQ ID NO: 408460 - DNA, 25 bp, Mus musculus
gtgcctcgaatttgtcccagatgtc

SEQ ID NO: 408461 - DNA, 25 bp, Mus musculus
gcttgtgattccagcaccggtcgga

SEQ ID NO: 408462 - DNA, 25 bp, Mus musculus
ctatgaagcagtacaagggcgtccc

SEQ ID NO: 408463 - DNA, 25 bp, Mus musculus
gagtactttctggtctgcaccgcga

SEQ ID NO: 408464 - DNA, 25 bp, Mus musculus
cggacaagtggcagcacgacctatt

SEQ ID NO: 408465 - DNA, 25 bp, Mus musculus
tgccaagctgctcgtgtcaaacctg

SEQ ID NO: 408466 - DNA, 25 bp, Mus musculus
ggaactctttgctgaatttggaacg

SEQ ID NO: 408467 - DNA, 25 bp, Mus musculus
aaaaagccgctgtggactacgatcg

SEQ ID NO: 408468 - DNA, 25 bp, Mus musculus
ctacgatcgctctggacgaagttta

SEQ ID NO: 408469 - DNA, 25 bp, Mus musculus
ggacggcggatgtacactttgaacg

SEQ ID NO: 408470 - DNA, 25 bp, Mus musculus
cagcttgtcacgtcacagatcgatc

SEQ ID NO: 408471 - DNA, 25 bp, Mus musculus
gccagattcacaagcgcacagactt

SEQ ID NO: 408472 - DNA, 25 bp, Mus musculus
ggccgccctatggacatccagcttg

SEQ ID NO: 408473 - DNA, 25 bp, Mus musculus
cactttgaacggagggcagatgccc

SEQ ID NO: 408474 - DNA, 25 bp, Mus musculus
agacgctgccgctgtcctaactgca

SEQ ID NO: 408475 - DNA, 25 bp, Mus musculus
tggatcctcttagccctcagcgacg

SEQ ID NO: 408476 - DNA, 25 bp, Mus musculus
gagcggcaaggtacaacgcctggta

SEQ ID NO: 408477 - DNA, 25 bp, Mus musculus
ttccaggctcgcactcgggaaaaga

SEQ ID NO: 408478 - DNA, 25 bp, Mus musculus
gcttgcactcggcacaactccggga

SEQ ID NO: 408479 - DNA, 25 bp, Mus musculus
cttgcggcttctccctgattgcaga

SEQ ID NO: 408480 - DNA, 25 bp, Mus musculus
cgacatgtgacggaggaaagccctc

SEQ ID NO: 408481 - DNA, 25 bp, Mus musculus
ctacccggagcctagtccttgcagg

SEQ ID NO: 408482 - DNA, 25 bp, Mus musculus
cctgccctggatcctgattgtcatc

SEQ ID NO: 408483 - DNA, 25 bp, Mus musculus
tcatcatcatgttggacgtggaccc

SEQ ID NO: 408484 - DNA, 25 bp, Mus musculus
cccggtgcagaaagccgagctcact

SEQ ID NO: 408485 - DNA, 25 bp, Mus musculus
cgcagttgcactggatcctggtgga

SEQ ID NO: 408486 - DNA, 25 bp, Mus musculus
agggacgcagcatcctcggtgtcca

SEQ ID NO: 408487 - DNA, 25 bp, Mus musculus
ttcccgccgacttcatccagagtga

SEQ ID NO: 408488 - DNA, 25 bp, Mus musculus
ggtagagcctccacggtcggccaac

SEQ ID NO: 408489 - DNA, 25 bp, Mus musculus
acagccaagaggtccgggcaaagga

SEQ ID NO: 408490 - DNA, 25 bp, Mus musculus
ggacagtctcctccggtagagcctc

SEQ ID NO: 408491 - DNA, 25 bp, Mus musculus
ggatcttcttaagcgccacaacttc

SEQ ID NO: 408492 - DNA, 25 bp, Mus musculus
ggctttgtacaccactccgtacgtg

SEQ ID NO: 408493 - DNA, 25 bp, Mus musculus
cactcacgtgtcgagccggatcttc

SEQ ID NO: 408494 - DNA, 25 bp, Mus musculus
gttctccatggagcgctagtgaggc

SEQ ID NO: 408495 - DNA, 25 bp, Mus musculus
gtcccagctcgggatggaacgcaag

SEQ ID NO: 408496 - DNA, 25 bp, Mus musculus
agagctcagcccttgacaatttgtc

SEQ ID NO: 408497 - DNA, 25 bp, Mus musculus
acttgaaacaatgttgccgcctccc

SEQ ID NO: 408498 - DNA, 25 bp, Mus musculus
ttccgattggttcacgtcacgaggg

SEQ ID NO: 408499 - DNA, 25 bp, Mus musculus
agccgcggggcagctgcacaacttt

SEQ ID NO: 408500 - DNA, 25 bp, Mus musculus
cgcagttcctggtttaggctccgca

SEQ ID NO: 408501 - DNA, 25 bp, Mus musculus
tccaccttttggaagttctccatgg

SEQ ID NO: 408502 - DNA, 25 bp, Mus musculus
ggccaaaaattctcacacccgagtc

SEQ ID NO: 408503 - DNA, 25 bp, Mus musculus
gccaccacagccacataatcatttt

SEQ ID NO: 408504 - DNA, 25 bp, Mus musculus
cccgagtctgtgtgggtcatttgta

SEQ ID NO: 408505 - DNA, 25 bp, Mus musculus
ccttctaatagtgccaagccttata

SEQ ID NO: 408506 - DNA, 25 bp, Mus musculus
gccagcaaggccactccttctaata

SEQ ID NO: 408507 - DNA, 25 bp, Mus musculus
ttggcacatgaatgcgcccacacga

SEQ ID NO: 408508 - DNA, 25 bp, Mus musculus
tctgcgcagaacctgagcgtccaag

SEQ ID NO: 408509 - DNA, 25 bp, Mus musculus
ggtcctaagagaagctctgcgcaga

SEQ ID NO: 408510 - DNA, 25 bp, Mus musculus
ggcaaagtatgctggtgtttctgaa

SEQ ID NO: 408511 - DNA, 25 bp, Mus musculus
ttgcaccgtcttttgaggcaaagta

SEQ ID NO: 408512 - DNA, 25 bp, Mus musculus
aggagccatccttgtttgcaccgtc

SEQ ID NO: 408513 - DNA, 25 bp, Mus musculus
gtgcaaaggaaccaccacaggagcc

SEQ ID NO: 408514 - DNA, 25 bp, Mus musculus
ccaggcttcctaacattggcacatg

SEQ ID NO: 408515 - DNA, 25 bp, Mus musculus
ggtcatttgtattcaagccaccaca

SEQ ID NO: 408516 - DNA, 25 bp, Mus musculus
ggcactcaggctcccatggcgggac

SEQ ID NO: 408517 - DNA, 25 bp, Mus musculus
cgctgctgcgtccattgtctgcggc

SEQ ID NO: 408518 - DNA, 25 bp, Mus musculus
ccactgcgaacagcccggtggactg

SEQ ID NO: 408519 - DNA, 25 bp, Mus musculus
tccgcgcctttgtatccgcagcgca

SEQ ID NO: 408520 - DNA, 25 bp, Mus musculus
gcagcgcacccggtctttccgaact

SEQ ID NO: 408521 - DNA, 25 bp, Mus musculus
gtctttccgaactccgcgctccaga

SEQ ID NO: 408522 - DNA, 25 bp, Mus musculus
ctccagaaccggcagcgcgggcgat

SEQ ID NO: 408523 - DNA, 25 bp, Mus musculus
tccgtcccagaccactcgcctgttt

SEQ ID NO: 408524 - DNA, 25 bp, Mus musculus
ggactgcagggcactcaggctccca

SEQ ID NO: 408525 - DNA, 25 bp, Mus musculus
gcgggacccagaaccaagcaatcgg

SEQ ID NO: 408526 - DNA, 25 bp, Mus musculus
caagcaatcggggatcaggaatcag

SEQ ID NO: 408527 - DNA, 25 bp, Mus musculus
cccagaaccaagcaatcggggatca

SEQ ID NO: 408528 - DNA, 25 bp, Mus musculus
tcaggaatcagatctggagccggcg

SEQ ID NO: 408529 - DNA, 25 bp, Mus musculus
tgcgtccattgtctgcggcccggct

SEQ ID NO: 408530 - DNA, 25 bp, Mus musculus
acgactcaagtgctgcaggtctttg

SEQ ID NO: 408531 - DNA, 25 bp, Mus musculus
acagtcgctaaagcccgactcggtc

SEQ ID NO: 408532 - DNA, 25 bp, Mus musculus
ccggatccagcaccatcggggcccg

SEQ ID NO: 408533 - DNA, 25 bp, Mus musculus
tgagctccggacctggaccactcct

SEQ ID NO: 408534 - DNA, 25 bp, Mus musculus
tgcggccggactctccaagctctga

SEQ ID NO: 408535 - DNA, 25 bp, Mus musculus
tctttgcggccggactctccaagct

SEQ ID NO: 408536 - DNA, 25 bp, Mus musculus
tcaagtgctgcaggtctttgcggcc

SEQ ID NO: 408537 - DNA, 25 bp, Mus musculus
cctcacgactcaagtgctgcaggtc

SEQ ID NO: 408538 - DNA, 25 bp, Mus musculus
tgcgctcctcacgactcaagtgctg

SEQ ID NO: 408539 - DNA, 25 bp, Mus musculus
acgcggatgcgctcccgcgtggcgt

SEQ ID NO: 408540 - DNA, 25 bp, Mus musculus
tgaaggcttccacgcggatgcgctc

SEQ ID NO: 408541 - DNA, 25 bp, Mus musculus
taggttgaaggcttccacgcggatg

SEQ ID NO: 408542 - DNA, 25 bp, Mus musculus
cgaaggctaggttgaaggcttccac

SEQ ID NO: 408543 - DNA, 25 bp, Mus musculus
ctgcaggtctttgcggccggactct

SEQ ID NO: 408544 - DNA, 25 bp, Mus musculus
cggaagtccttgtccgaggagcttc

SEQ ID NO: 408545 - DNA, 25 bp, Mus musculus
tccggacggctcctcttaaagacca

SEQ ID NO: 408546 - DNA, 25 bp, Mus musculus
tcacctgccagtaccacggaaaaag

SEQ ID NO: 408547 - DNA, 25 bp, Mus musculus
tagtcgtagccatcttgcctctccg

SEQ ID NO: 408548 - DNA, 25 bp, Mus musculus
tcaggtcccttccagactcgtagcg

SEQ ID NO: 408549 - DNA, 25 bp, Mus musculus
ggcttccgctagcatcgtctctgtg

SEQ ID NO: 408550 - DNA, 25 bp, Mus musculus
ggacccgctaacctgacctaggagc

SEQ ID NO: 408551 - DNA, 25 bp, Mus musculus
cccgaggcctgaaggatgctaacca

SEQ ID NO: 408552 - DNA, 25 bp, Mus musculus
ctgtcactaaggcaggactcgctga

SEQ ID NO: 408553 - DNA, 25 bp, Mus musculus
cttagggttagtggagtagtctgca

SEQ ID NO: 408554 - DNA, 25 bp, Mus musculus
agtctgcagtccgtgctgcttcgta

SEQ ID NO: 408555 - DNA, 25 bp, Mus musculus
gctgcttcgtatgtcctggaactta

SEQ ID NO: 408556 - DNA, 25 bp, Mus musculus
atcgtgtcgtggctcgttaacctta

SEQ ID NO: 408557 - DNA, 25 bp, Mus musculus
actcgtagcggcctctctaggcttc

SEQ ID NO: 408558 - DNA, 25 bp, Mus musculus
aggactcgtcctctgcccgggtcgg

SEQ ID NO: 408559 - DNA, 25 bp, Mus musculus
cttctcgttcgtccggtgacccatt

SEQ ID NO: 408560 - DNA, 25 bp, Mus musculus
ccatgactcacaggggcttctcgtt

SEQ ID NO: 408561 - DNA, 25 bp, Mus musculus
gtgctgggaggactcgtcctctgcc

SEQ ID NO: 408562 - DNA, 25 bp, Mus musculus
caggacaggcccgatccctttccta

SEQ ID NO: 408563 - DNA, 25 bp, Mus musculus
tgtttcgtccggctcggcctgttcc

SEQ ID NO: 408564 - DNA, 25 bp, Mus musculus
tcgccagctcccgtgcttgtaactg

SEQ ID NO: 408565 - DNA, 25 bp, Mus musculus
agaaggatgaccctagatgggaagc

SEQ ID NO: 408566 - DNA, 25 bp, Mus musculus
gctggcagaaggatgaccctagatg

SEQ ID NO: 408567 - DNA, 25 bp, Mus musculus
acagtcggagcatccgctggcagaa

SEQ ID NO: 408568 - DNA, 25 bp, Mus musculus
ctgggcctggaacagtcggagcatc

SEQ ID NO: 408569 - DNA, 25 bp, Mus musculus
ccgctggccagtgtaagatggcggc

SEQ ID NO: 408570 - DNA, 25 bp, Mus musculus
agtctcctccagcacagcgtcgcaa

SEQ ID NO: 408571 - DNA, 25 bp, Mus musculus
gactcacaggggcttctcgttcgtc

SEQ ID NO: 408572 - DNA, 25 bp, Mus musculus
ggccagccgtgaccaggattcatca

SEQ ID NO: 408573 - DNA, 25 bp, Mus musculus
cgaggcttgtggagctagagtcttt

SEQ ID NO: 408574 - DNA, 25 bp, Mus musculus
tgcccgctttgtgtacgaggcttgt

SEQ ID NO: 408575 - DNA, 25 bp, Mus musculus
gaactgggttccagtgcccgctttg

SEQ ID NO: 408576 - DNA, 25 bp, Mus musculus
atcttcagagacaacagccttaccc

SEQ ID NO: 408577 - DNA, 25 bp, Mus musculus
ctgggtatcttcagagacaacagcc

SEQ ID NO: 408578 - DNA, 25 bp, Mus musculus
cgagccctggaagactgggtatctt

SEQ ID NO: 408579 - DNA, 25 bp, Mus musculus
cgtgaccaggattcatcagatgatg

SEQ ID NO: 408580 - DNA, 25 bp, Mus musculus
tggacagcgcaaacgggccagccgt

SEQ ID NO: 408581 - DNA, 25 bp, Mus musculus
tgtacagcgtttccgtttgcagcac

SEQ ID NO: 408582 - DNA, 25 bp, Mus musculus
ggagctagagtctttgtacagcgtt

SEQ ID NO: 408583 - DNA, 25 bp, Mus musculus
aacaacctcggcaccgtggacagcg

SEQ ID NO: 408584 - DNA, 25 bp, Mus musculus
gaagaggacgaggaacaacctcggc

SEQ ID NO: 408585 - DNA, 25 bp, Mus musculus
catcagatgatgagcgagccctgga

SEQ ID NO: 408586 - DNA, 25 bp, Mus musculus
gctctgcgcacccacgcttcactgc

SEQ ID NO: 408587 - DNA, 25 bp, Mus musculus
aagccaggtggtggtcgccgcgtcc

SEQ ID NO: 408588 - DNA, 25 bp, Mus musculus
ctaatacttggtaagccaggtggtg

SEQ ID NO: 408589 - DNA, 25 bp, Mus musculus
ctgctaatacttggtaagccaggtg

SEQ ID NO: 408590 - DNA, 25 bp, Mus musculus
tgctgctaatacttggtaagccagg

SEQ ID NO: 408591 - DNA, 25 bp, Mus musculus
gccgctgagttcgctcctgctgctg

SEQ ID NO: 408592 - DNA, 25 bp, Mus musculus
cccacgccgctgagttcgctcctgc

SEQ ID NO: 408593 - DNA, 25 bp, Mus musculus
cctacgcagaatgggcgtccctagc

SEQ ID NO: 408594 - DNA, 25 bp, Mus musculus
cgcctacgcagaatgggcgtcccta

SEQ ID NO: 408595 - DNA, 25 bp, Mus musculus
agccgcctacgcagaatgggcgtcc

SEQ ID NO: 408596 - DNA, 25 bp, Mus musculus
tcagagccgcctacgcagaatgggc

SEQ ID NO: 408597 - DNA, 25 bp, Mus musculus
cctcagagccgcctacgcagaatgg

SEQ ID NO: 408598 - DNA, 25 bp, Mus musculus
aatacttggtaagccaggtggtggt

SEQ ID NO: 408599 - DNA, 25 bp, Mus musculus
acgcttcactgctccgctttctgcc

SEQ ID NO: 408600 - DNA, 25 bp, Mus musculus
gtccttctccacgtagcgctggcga

SEQ ID NO: 408601 - DNA, 25 bp, Mus musculus
gaaagcggcgttctcctgcgccatg

SEQ ID NO: 408602 - DNA, 25 bp, Mus musculus
tgtcaaagcccacgctgaggtcggt

SEQ ID NO: 408603 - DNA, 25 bp, Mus musculus
tcggtctggtgcaaagggatgaact

SEQ ID NO: 408604 - DNA, 25 bp, Mus musculus
gatgaactcgccctcgagcgtctga

SEQ ID NO: 408605 - DNA, 25 bp, Mus musculus
tcgcccacgcgaaacatgagacaga

SEQ ID NO: 408606 - DNA, 25 bp, Mus musculus
ttgggctgcgagatcttgacgaaca

SEQ ID NO: 408607 - DNA, 25 bp, Mus musculus
atgcagcccaccatgaaagcgttca

SEQ ID NO: 408608 - DNA, 25 bp, Mus musculus
caccatggagcccaggatagcctgc

SEQ ID NO: 408609 - DNA, 25 bp, Mus musculus
tgatgacccggtgcccatagccgat

SEQ ID NO: 408610 - DNA, 25 bp, Mus musculus
ccacgaagccgttgaggttgttgac

SEQ ID NO: 408611 - DNA, 25 bp, Mus musculus
cggcatcgatttcgtggctgatgac

SEQ ID NO: 408612 - DNA, 25 bp, Mus musculus
ggacgttgccctgctgcacgttaca

SEQ ID NO: 408613 - DNA, 25 bp, Mus musculus
tccaccatgccctcgagaatgacta

SEQ ID NO: 408614 - DNA, 25 bp, Mus musculus
atcttgccagctcggcttctatcgc

SEQ ID NO: 408615 - DNA, 25 bp, Mus musculus
tggcgctccgatctgccattggccg

SEQ ID NO: 408616 - DNA, 25 bp, Mus musculus
tggttcctccattctgacacggccg

SEQ ID NO: 408617 - DNA, 25 bp, Mus musculus
ctcggcttctatcgctacgcgtatc

SEQ ID NO: 408618 - DNA, 25 bp, Mus musculus
tacgcgtatcgtctcttcatctctc

SEQ ID NO: 408619 - DNA, 25 bp, Mus musculus
tcatctctctttctccgggactctg

SEQ ID NO: 408620 - DNA, 25 bp, Mus musculus
ctctttctccgggactctgtctggg

SEQ ID NO: 408621 - DNA, 25 bp, Mus musculus
actctgtctgggtctctgttcttcg

SEQ ID NO: 408622 - DNA, 25 bp, Mus musculus
gttcttcgagtgtttctgcacccta

SEQ ID NO: 408623 - DNA, 25 bp, Mus musculus
tgtttctgcaccctagtccgtctgg

SEQ ID NO: 408624 - DNA, 25 bp, Mus musculus
ccctagtccgtctgggtttgcgctt

SEQ ID NO: 408625 - DNA, 25 bp, Mus musculus
ccgtctgggtttgcgcttcctatcc

SEQ ID NO: 408626 - DNA, 25 bp, Mus musculus
ccaggcgctgatctggcgctccgat

SEQ ID NO: 408627 - DNA, 25 bp, Mus musculus
tcgtcctggttcctccattctgaca

SEQ ID NO: 408628 - DNA, 25 bp, Mus musculus
ccaatcccgaggaaggcaatcgttc

SEQ ID NO: 408629 - DNA, 25 bp, Mus musculus
aaccctttgcccatggcggtgtcca

SEQ ID NO: 408630 - DNA, 25 bp, Mus musculus
ggttctctttccaggctcgtttgta

SEQ ID NO: 408631 - DNA, 25 bp, Mus musculus
gcttcgcggtgcacatgaagatgta

SEQ ID NO: 408632 - DNA, 25 bp, Mus musculus
gttctctcgaccctgtacttcatag

SEQ ID NO: 408633 - DNA, 25 bp, Mus musculus
ggctactgcgtcttctggcttctca

SEQ ID NO: 408634 - DNA, 25 bp, Mus musculus
tcggcaagtttctcttcatcagctg

SEQ ID NO: 408635 - DNA, 25 bp, Mus musculus
acgtctacctcagcgaactcttcgg

SEQ ID NO: 408636 - DNA, 25 bp, Mus musculus
accggactctgctggtgaggtacac

SEQ ID NO: 408637 - DNA, 25 bp, Mus musculus
tacggtgtcttccaggaccggactc

SEQ ID NO: 408638 - DNA, 25 bp, Mus musculus
aatcgttccgcggagacagctgaga

SEQ ID NO: 408639 - DNA, 25 bp, Mus musculus
agctgcggacgctagacagccaatc

SEQ ID NO: 408640 - DNA, 25 bp, Mus musculus
cggacagcggaagcgtcgccaataa

SEQ ID NO: 408641 - DNA, 25 bp, Mus musculus
ttcttcctgtcggtgctgtagcaga

SEQ ID NO: 408642 - DNA, 25 bp, Mus musculus
gcttaccccggtcttgcgtcttgcg

SEQ ID NO: 408643 - DNA, 25 bp, Mus musculus
gctcctgacgacacactgcccgccc

SEQ ID NO: 408644 - DNA, 25 bp, Mus musculus
ggccgcccagctcctgacgacacac

SEQ ID NO: 408645 - DNA, 25 bp, Mus musculus
cccaagagagcgcacggtcagagca

SEQ ID NO: 408646 - DNA, 25 bp, Mus musculus
ccttgacccaagagagcgcacggtc

SEQ ID NO: 408647 - DNA, 25 bp, Mus musculus
ggggctctaccttgacccaagagag

SEQ ID NO: 408648 - DNA, 25 bp, Mus musculus
ttccgctgcccttttggccgggtgc

SEQ ID NO: 408649 - DNA, 25 bp, Mus musculus
acgccgcagccctcacccagtcggt

SEQ ID NO: 408650 - DNA, 25 bp, Mus musculus
tgtcaacgcttccttctctggacgc

SEQ ID NO: 408651 - DNA, 25 bp, Mus musculus
agctgtcaacgcttccttctctgga

SEQ ID NO: 408652 - DNA, 25 bp, Mus musculus
agcttccagctgtcaacgcttcctt

SEQ ID NO: 408653 - DNA, 25 bp, Mus musculus
gtcccagcgcaaacccttccagcag

SEQ ID NO: 408654 - DNA, 25 bp, Mus musculus
gcagcgctacggcagtcccggagtc

SEQ ID NO: 408655 - DNA, 25 bp, Mus musculus
gcgtcttgcgcagcgctacggcagt

SEQ ID NO: 408656 - DNA, 25 bp, Mus musculus
taagggcgactccacccacggagtc

SEQ ID NO: 408657 - DNA, 25 bp, Mus musculus
gacagggacctaagggcgactccac

SEQ ID NO: 408658 - DNA, 25 bp, Mus musculus
agtcggcgcagtacttgttgtcctc

SEQ ID NO: 408659 - DNA, 25 bp, Mus musculus
ttgttgtcctcctccctcagcagtt

SEQ ID NO: 408660 - DNA, 25 bp, Mus musculus
tacctttggcctcgcagtcggcgca

SEQ ID NO: 408661 - DNA, 25 bp, Mus musculus
acctccgtgctagccgagagccaga

SEQ ID NO: 408662 - DNA, 25 bp, Mus musculus
ccacccacggagtcgctgaggctga

SEQ ID NO: 408663 - DNA, 25 bp, Mus musculus
tccctcagcagtttggacaggatga

SEQ ID NO: 408664 - DNA, 25 bp, Mus musculus
atgagctggtgctgctcgttcagct

SEQ ID NO: 408665 - DNA, 25 bp, Mus musculus
gcttctgagccttctcccgacagga

SEQ ID NO: 408666 - DNA, 25 bp, Mus musculus
cccgacaggagcgtgtcgccatgtc

SEQ ID NO: 408667 - DNA, 25 bp, Mus musculus
ccgggagactcccaaggtgattcca

SEQ ID NO: 408668 - DNA, 25 bp, Mus musculus
tgattccagagaagcgtctgacgct

SEQ ID NO: 408669 - DNA, 25 bp, Mus musculus
aggagggctcccacagccctatcag

SEQ ID NO: 408670 - DNA, 25 bp, Mus musculus
cttagttgtacagagctccacgagg

SEQ ID NO: 408671 - DNA, 25 bp, Mus musculus
ctctgttggctccaattggtcgccg

SEQ ID NO: 408672 - DNA, 25 bp, Mus musculus
tctgttggctccaattggtcgccgc

SEQ ID NO: 408673 - DNA, 25 bp, Mus musculus
tctttctctctcgaaactacaactc

SEQ ID NO: 408674 - DNA, 25 bp, Mus musculus
gcgtctttctctctcgaaactacaa

SEQ ID NO: 408675 - DNA, 25 bp, Mus musculus
agcccacgtgcgaccgcgtctttct

SEQ ID NO: 408676 - DNA, 25 bp, Mus musculus
tagttgtacagagctccacgagggg

SEQ ID NO: 408677 - DNA, 25 bp, Mus musculus
cgcttagttgtacagagctccacga

SEQ ID NO: 408678 - DNA, 25 bp, Mus musculus
cccgcttagttgtacagagctccac

SEQ ID NO: 408679 - DNA, 25 bp, Mus musculus
ggcgatcagcctttccccgcttagt

SEQ ID NO: 408680 - DNA, 25 bp, Mus musculus
cgggaagcggcgatcagcctttccc

SEQ ID NO: 408681 - DNA, 25 bp, Mus musculus
attggcggtctccagggcgacggga

SEQ ID NO: 408682 - DNA, 25 bp, Mus musculus
gaccagagcccacgtgcgaccgcgt

SEQ ID NO: 408683 - DNA, 25 bp, Mus musculus
acgggaggcgctcggggcatctaag

SEQ ID NO: 408684 - DNA, 25 bp, Mus musculus
cttgagacttgcttctgggagcgtg

SEQ ID NO: 408685 - DNA, 25 bp, Mus musculus
tcctgctagttcgtttgtccgggta

SEQ ID NO: 408686 - DNA, 25 bp, Mus musculus
gcgcgctccggtccatgaatttacc

SEQ ID NO: 408687 - DNA, 25 bp, Mus musculus
ctgagtggccgcaagaactaggttc

SEQ ID NO: 408688 - DNA, 25 bp, Mus musculus
agccgtttgctccagcgttgagttc

SEQ ID NO: 408689 - DNA, 25 bp, Mus musculus
aggcaagttttacgggtgcacaaga

SEQ ID NO: 408690 - DNA, 25 bp, Mus musculus
ttcagcagttaagcaaggcaagttt

SEQ ID NO: 408691 - DNA, 25 bp, Mus musculus
ccgtgctgtcaggtccggttcccaa

SEQ ID NO: 408692 - DNA, 25 bp, Mus musculus
tgtggtctgtagaaagcaagaagcc

SEQ ID NO: 408693 - DNA, 25 bp, Mus musculus
atccagccctcttggacggtgagca

SEQ ID NO: 408694 - DNA, 25 bp, Mus musculus
tgaccacctatcttaagcgctccag

SEQ ID NO: 408695 - DNA, 25 bp, Mus musculus
tccgcaggtcctttacggctcattc

SEQ ID NO: 408696 - DNA, 25 bp, Mus musculus
agaccttttgcagcggcgccaagga

SEQ ID NO: 408697 - DNA, 25 bp, Mus musculus
cggttcccaagccttctctgcattg

SEQ ID NO: 408698 - DNA, 25 bp, Mus musculus
ggtacccgacgcagaacgtcagccg

SEQ ID NO: 408699 - DNA, 25 bp, Mus musculus
acgcgcccgcctgttgttttccaga

SEQ ID NO: 408700 - DNA, 25 bp, Mus musculus
cccgcctgttgttttccagagtgga

SEQ ID NO: 408701 - DNA, 25 bp, Mus musculus
ctggggtacccgacgcagaacgtca

SEQ ID NO: 408702 - DNA, 25 bp, Mus musculus
tccctgcgccgcaagtacgcgcctc

SEQ ID NO: 408703 - DNA, 25 bp, Mus musculus
cgcctcctgcgaagcgggtccctcc

SEQ ID NO: 408704 - DNA, 25 bp, Mus musculus
cccgtctacatcaaggtcaagagcg

SEQ ID NO: 408705 - DNA, 25 bp, Mus musculus
actgcgccgactgtgcccaggtcga

SEQ ID NO: 408706 - DNA, 25 bp, Mus musculus
gctcgtgcaaggacggcctcttagt

SEQ ID NO: 408707 - DNA, 25 bp, Mus musculus
gacggcctcttagtgtgagcgcaca

SEQ ID NO: 408708 - DNA, 25 bp, Mus musculus
cctcttagtgtgagcgcacagcacc

SEQ ID NO: 408709 - DNA, 25 bp, Mus musculus
tagtgtgagcgcacagcaccgggct

SEQ ID NO: 408710 - DNA, 25 bp, Mus musculus
cccaggtcgagcagcgctcgtgcaa

SEQ ID NO: 408711 - DNA, 25 bp, Mus musculus
tgttttccagagtggacgccgaggc

SEQ ID NO: 408712 - DNA, 25 bp, Mus musculus
acggctccaaggcaggcagagaaac

SEQ ID NO: 408713 - DNA, 25 bp, Mus musculus
gcagagaaaccctacagcccaacgg

SEQ ID NO: 408714 - DNA, 25 bp, Mus musculus
tccgtcagggacaccaggtgccgca

SEQ ID NO: 408715 - DNA, 25 bp, Mus musculus
tttactcagggcgaggctggccttt

SEQ ID NO: 408716 - DNA, 25 bp, Mus musculus
gctggcctttcctactctgccggga

SEQ ID NO: 408717 - DNA, 25 bp, Mus musculus
tggctcacgagcgtgctgacctctc

SEQ ID NO: 408718 - DNA, 25 bp, Mus musculus
ctactctgccgggagattgggtcac

SEQ ID NO: 408719 - DNA, 25 bp, Mus musculus
gggccacgtagtctcttggaccctc

SEQ ID NO: 408720 - DNA, 25 bp, Mus musculus
cccacccagggttggctgaacagcg

SEQ ID NO: 408721 - DNA, 25 bp, Mus musculus
cgggcaaaagtcagggatgcgcatt

SEQ ID NO: 408722 - DNA, 25 bp, Mus musculus
caaattggtcgatctgttccgggga

SEQ ID NO: 408723 - DNA, 25 bp, Mus musculus
agcacttgccctagcgggccacgta

SEQ ID NO: 408724 - DNA, 25 bp, Mus musculus
gggcattggcctcgtccacgatctt

SEQ ID NO: 408725 - DNA, 25 bp, Mus musculus
cgtccacgatcttcacaaattggtc

SEQ ID NO: 408726 - DNA, 25 bp, Mus musculus
ataggaggtgcacacgccggcacac

SEQ ID NO: 408727 - DNA, 25 bp, Mus musculus
cggtcgtgtacataggaggtgcaca

SEQ ID NO: 408728 - DNA, 25 bp, Mus musculus
cccacggtcctcagagacagcgatg

SEQ ID NO: 408729 - DNA, 25 bp, Mus musculus
agacagcgatgctcagagacagaca

SEQ ID NO: 408730 - DNA, 25 bp, Mus musculus
cagagacagacacaagggtattcca

SEQ ID NO: 408731 - DNA, 25 bp, Mus musculus
gggtattccaagaggctggcgactt

SEQ ID NO: 408732 - DNA, 25 bp, Mus musculus
ggctggcgacttgaaccctcgcttc

SEQ ID NO: 408733 - DNA, 25 bp, Mus musculus
tcaccgtcctgggaaagattggccc

SEQ ID NO: 408734 - DNA, 25 bp, Mus musculus
tggcgagcctagatctccggggact

SEQ ID NO: 408735 - DNA, 25 bp, Mus musculus
tgcagtcgccgggattaaatagggc

SEQ ID NO: 408736 - DNA, 25 bp, Mus musculus
ttaaatagggcgctcggagcaaacc

SEQ ID NO: 408737 - DNA, 25 bp, Mus musculus
gcgctcggagcaaaccattcggttg

SEQ ID NO: 408738 - DNA, 25 bp, Mus musculus
tcgcttccaaacaaagccaacaggc

SEQ ID NO: 408739 - DNA, 25 bp, Mus musculus
cgtagacatacacagtcggtcgtgt

SEQ ID NO: 408740 - DNA, 25 bp, Mus musculus
ccagctgcctgaattgtcccggaca

SEQ ID NO: 408741 - DNA, 25 bp, Mus musculus
gctgaccctttcgaggtgatccatc

SEQ ID NO: 408742 - DNA, 25 bp, Mus musculus
tatcggataccgagtgtgctgaccc

SEQ ID NO: 408743 - DNA, 25 bp, Mus musculus
tctccgctgaggagacaggcctatc

SEQ ID NO: 408744 - DNA, 25 bp, Mus musculus
gctggacagcgctcactctatagtc

SEQ ID NO: 408745 - DNA, 25 bp, Mus musculus
gctggactcacaggccctgccgatt

SEQ ID NO: 408746 - DNA, 25 bp, Mus musculus
cctgaccaaggggaaaggtgcctgc

SEQ ID NO: 408747 - DNA, 25 bp, Mus musculus
ggtgttttccaacctgcggatcaga

SEQ ID NO: 408748 - DNA, 25 bp, Mus musculus
cccagggatgcggaaatcacaaaga

SEQ ID NO: 408749 - DNA, 25 bp, Mus musculus
agtgcgcgctgaactgagcatgttc

SEQ ID NO: 408750 - DNA, 25 bp, Mus musculus
tgatccatcccggtgcttctaggcc

SEQ ID NO: 408751 - DNA, 25 bp, Mus musculus
aagcgcaggtgatgcctcccacgaa

SEQ ID NO: 408752 - DNA, 25 bp, Mus musculus
cgattctagagcctcggtgttttcc

SEQ ID NO: 408753 - DNA, 25 bp, Mus musculus
agagccaccgcgcattatgcaaagc

SEQ ID NO: 408754 - DNA, 25 bp, Mus musculus
gccaaggcacctggggctccagcga

SEQ ID NO: 408755 - DNA, 25 bp, Mus musculus
tcacgggcggcctcagccgctcagc

SEQ ID NO: 408756 - DNA, 25 bp, Mus musculus
agccgctcagccgactggaccgagg

SEQ ID NO: 408757 - DNA, 25 bp, Mus musculus
tgtactggccgccaaggcacctggg

SEQ ID NO: 408758 - DNA, 25 bp, Mus musculus
gacccttccgtgagccggagctcca

SEQ ID NO: 408759 - DNA, 25 bp, Mus musculus
acctggggctccagcgacagctgat

SEQ ID NO: 408760 - DNA, 25 bp, Mus musculus
ctccagcgacagctgatggctttca

SEQ ID NO: 408761 - DNA, 25 bp, Mus musculus
cagcgacagctgatggctttcagaa

SEQ ID NO: 408762 - DNA, 25 bp, Mus musculus
tgatggctttcagaacgtgttcaca

SEQ ID NO: 408763 - DNA, 25 bp, Mus musculus
tcagaacgtgttcacaggtgagcgc

SEQ ID NO: 408764 - DNA, 25 bp, Mus musculus
aggtgagcgcgcctgccacgtatct

SEQ ID NO: 408765 - DNA, 25 bp, Mus musculus
gcgcctgccacgtatctccgggtgg

SEQ ID NO: 408766 - DNA, 25 bp, Mus musculus
tgccacgtatctccgggtggcaggt

SEQ ID NO: 408767 - DNA, 25 bp, Mus musculus
cgctcagccgactggaccgaggagc

SEQ ID NO: 408768 - DNA, 25 bp, Mus musculus
ttgcactggccgtagcagaagcggt

SEQ ID NO: 408769 - DNA, 25 bp, Mus musculus
cccgggcattcgagctctacgatga

SEQ ID NO: 408770 - DNA, 25 bp, Mus musculus
tcgagacccgggcattcgagctcta

SEQ ID NO: 408771 - DNA, 25 bp, Mus musculus
tctacgatgacagaggtgacacgct

SEQ ID NO: 408772 - DNA, 25 bp, Mus musculus
acacgctggggcttgcagaaagcgc

SEQ ID NO: 408773 - DNA, 25 bp, Mus musculus
tcgcgggatgtagaaggagttgcac

SEQ ID NO: 408774 - DNA, 25 bp, Mus musculus
tgcgtcttgcaccagtcactcttga

SEQ ID NO: 408775 - DNA, 25 bp, Mus musculus
cactggccgtagcagaagcggttga

SEQ ID NO: 408776 - DNA, 25 bp, Mus musculus
gatggtgcggctgcggcaaccctcc

SEQ ID NO: 408777 - DNA, 25 bp, Mus musculus
tcgctcactgtctgccgcagaggct

SEQ ID NO: 408778 - DNA, 25 bp, Mus musculus
ctgtctgccgcagaggctgcgtctt

SEQ ID NO: 408779 - DNA, 25 bp, Mus musculus
agaggctgcgtcttgcaccagtcac

SEQ ID NO: 408780 - DNA, 25 bp, Mus musculus
gtcactcttgaggtacttgcgctcg

SEQ ID NO: 408781 - DNA, 25 bp, Mus musculus
ttcttcacgtgtcgcgggatgtaga

SEQ ID NO: 408782 - DNA, 25 bp, Mus musculus
cactcattggggaccgtgactcccg

SEQ ID NO: 408783 - DNA, 25 bp, Mus musculus
ccgcgctggcaagcccacgcgccgc

SEQ ID NO: 408784 - DNA, 25 bp, Mus musculus
gacgcccgaaggtgccggctcggac

SEQ ID NO: 408785 - DNA, 25 bp, Mus musculus
acagtcacgtgggacagggacgccc

SEQ ID NO: 408786 - DNA, 25 bp, Mus musculus
gcgggagtcgagacgcctggcccgt

SEQ ID NO: 408787 - DNA, 25 bp, Mus musculus
ggactgggaccagtcgagcgcgcgc

SEQ ID NO: 408788 - DNA, 25 bp, Mus musculus
tcacactcgcgctgctcaggccacc

SEQ ID NO: 408789 - DNA, 25 bp, Mus musculus
cagggcagcctcatcacactcgcgc

SEQ ID NO: 408790 - DNA, 25 bp, Mus musculus
caggcgctgtcagctggctgcgagc

SEQ ID NO: 408791 - DNA, 25 bp, Mus musculus
ctcccctccgggtgtgctgagggca

SEQ ID NO: 408792 - DNA, 25 bp, Mus musculus
cgtgactcccgtcgtcgcagggcga

SEQ ID NO: 408793 - DNA, 25 bp, Mus musculus
cattggggaccgtgactcccgtcgt

SEQ ID NO: 408794 - DNA, 25 bp, Mus musculus
cgcgccactcattggggaccgtgac

SEQ ID NO: 408795 - DNA, 25 bp, Mus musculus
gggaccgtgactcccgtcgtcgcag

SEQ ID NO: 408796 - DNA, 25 bp, Mus musculus
tggcgactccctatgtaactgacga

SEQ ID NO: 408797 - DNA, 25 bp, Mus musculus
ttcgggttctcaagatggcgactcc

SEQ ID NO: 408798 - DNA, 25 bp, Mus musculus
tggggcgcggctaattagaatactg

SEQ ID NO: 408799 - DNA, 25 bp, Mus musculus
ctgacccgagaggatccagtactga

SEQ ID NO: 408800 - DNA, 25 bp, Mus musculus
agttcagtcatggaaaccgccagca

SEQ ID NO: 408801 - DNA, 25 bp, Mus musculus
cccttcgtaggtctctgatcagtta

SEQ ID NO: 408802 - DNA, 25 bp, Mus musculus
tgccgagtagacctgcccactttta

SEQ ID NO: 408803 - DNA, 25 bp, Mus musculus
tggggcttctttgcccatgccaaca

SEQ ID NO: 408804 - DNA, 25 bp, Mus musculus
gcgaggggccttgcatattcctttc

SEQ ID NO: 408805 - DNA, 25 bp, Mus musculus
cgagccctagggattgttttatata

SEQ ID NO: 408806 - DNA, 25 bp, Mus musculus
acatcaggaggtcaacagtggcgtc

SEQ ID NO: 408807 - DNA, 25 bp, Mus musculus
agcccatgactgtgagcgtcttaca

SEQ ID NO: 408808 - DNA, 25 bp, Mus musculus
cccgcgtcagagaaatggtgcagtc

SEQ ID NO: 408809 - DNA, 25 bp, Mus musculus
cttgctaggatgaggactccacttc

SEQ ID NO: 408810 - DNA, 25 bp, Mus musculus
agattccggccacgctcgtaaccaa

SEQ ID NO: 408811 - DNA, 25 bp, Mus musculus
ttcgcgcgacgttcggagcacaccg

SEQ ID NO: 408812 - DNA, 25 bp, Mus musculus
ggacacccgggacactctgacgtga

SEQ ID NO: 408813 - DNA, 25 bp, Mus musculus
cccgggacactctgacgtgaaggtc

SEQ ID NO: 408814 - DNA, 25 bp, Mus musculus
ggacactctgacgtgaaggtcaccc

SEQ ID NO: 408815 - DNA, 25 bp, Mus musculus
ccgagatgcccgctcaccattcgcg

SEQ ID NO: 408816 - DNA, 25 bp, Mus musculus
accattcgcgcgacgttcggagcac

SEQ ID NO: 408817 - DNA, 25 bp, Mus musculus
agggtggtcgcttccccagacactg

SEQ ID NO: 408818 - DNA, 25 bp, Mus musculus
acactgcagcaccggcggacggaac

SEQ ID NO: 408819 - DNA, 25 bp, Mus musculus
tgcgcggtacatggtgctgctgtac

SEQ ID NO: 408820 - DNA, 25 bp, Mus musculus
ggaaagctgagcctgagccacgccc

SEQ ID NO: 408821 - DNA, 25 bp, Mus musculus
ggccacgctcgtaaccaatcaaacg

SEQ ID NO: 408822 - DNA, 25 bp, Mus musculus
atacgtcagattccggccacgctcg

SEQ ID NO: 408823 - DNA, 25 bp, Mus musculus
cctaatacgtcagattccggccacg

SEQ ID NO: 408824 - DNA, 25 bp, Mus musculus
gcggatggccttacttgctgctctc

SEQ ID NO: 408825 - DNA, 25 bp, Mus musculus
cgtatttttctagccgcatctaaga

SEQ ID NO: 408826 - DNA, 25 bp, Mus musculus
gctctccagacgaaagtcatccgtg

SEQ ID NO: 408827 - DNA, 25 bp, Mus musculus
ctctgcgcaggcgtcaacgagggca

SEQ ID NO: 408828 - DNA, 25 bp, Mus musculus
gtggagaccattgcgccggctccca

SEQ ID NO: 408829 - DNA, 25 bp, Mus musculus
aaagggtcgtggagaccattgcgcc

SEQ ID NO: 408830 - DNA, 25 bp, Mus musculus
agacgaaagtcatccgtgaaacgga

SEQ ID NO: 408831 - DNA, 25 bp, Mus musculus
gccttacttgctgctctccagacga

SEQ ID NO: 408832 - DNA, 25 bp, Mus musculus
gcatttcggaactcggcttcccacg

SEQ ID NO: 408833 - DNA, 25 bp, Mus musculus
tgcgccctcgcatttcggaactcgg

SEQ ID NO: 408834 - DNA, 25 bp, Mus musculus
gcttctgtagccaccgcggcagcgt

SEQ ID NO: 408835 - DNA, 25 bp, Mus musculus
ctaatgcttctgtagccaccgcggc

SEQ ID NO: 408836 - DNA, 25 bp, Mus musculus
gccaagcaccgctaatgcttctgta

SEQ ID NO: 408837 - DNA, 25 bp, Mus musculus
ccgcatctaagagcgaggcgctttt

SEQ ID NO: 408838 - DNA, 25 bp, Mus musculus
cggcatacagctccgccttcttaga

SEQ ID NO: 408839 - DNA, 25 bp, Mus musculus
cgcccaggctcaggttgaccaggaa

SEQ ID NO: 408840 - DNA, 25 bp, Mus musculus
acggaggcccagagctgatgtaccc

SEQ ID NO: 408841 - DNA, 25 bp, Mus musculus
cgactcaccaaagaggctgccgcta

SEQ ID NO: 408842 - DNA, 25 bp, Mus musculus
agccgttccgcaggcacgacgcgaa

SEQ ID NO: 408843 - DNA, 25 bp, Mus musculus
cgcgaaggtgaaggtgactccgaac

SEQ ID NO: 408844 - DNA, 25 bp, Mus musculus
ctccgaacagggataccagcaggtc

SEQ ID NO: 408845 - DNA, 25 bp, Mus musculus
cgcagtctcgggaacttggagtaga

SEQ ID NO: 408846 - DNA, 25 bp, Mus musculus
tagagaagcagcaccagcaggttgc

SEQ ID NO: 408847 - DNA, 25 bp, Mus musculus
agtagccctggtcgccactacggtt

SEQ ID NO: 408848 - DNA, 25 bp, Mus musculus
cccgaacagggtggatctcacgctc

SEQ ID NO: 408849 - DNA, 25 bp, Mus musculus
aagactcttccgcagtctggcctgc

SEQ ID NO: 408850 - DNA, 25 bp, Mus musculus
ttagaacctctgaccgcgcctctga

SEQ ID NO: 408851 - DNA, 25 bp, Mus musculus
ggcctcatccatacggcagccgttt

SEQ ID NO: 408852 - DNA, 25 bp, Mus musculus
ttgtatatgctctctcctgtgcagg

SEQ ID NO: 408853 - DNA, 25 bp, Mus musculus
cctggaatggacttgtgtgctatgc

SEQ ID NO: 408854 - DNA, 25 bp, Mus musculus
ttaccaacactcgtacctagcgatg

SEQ ID NO: 408855 - DNA, 25 bp, Mus musculus
gacttttcgcttctagcgtcgccga

SEQ ID NO: 408856 - DNA, 25 bp, Mus musculus
gtgctatgcctgttcgttcgggaga

SEQ ID NO: 408857 - DNA, 25 bp, Mus musculus
cctagcgatgaattccctttgtata

SEQ ID NO: 408858 - DNA, 25 bp, Mus musculus
gggctgacgtgtgtccttaccaaca

SEQ ID NO: 408859 - DNA, 25 bp, Mus musculus
tgactctgatccacgtgccttctgc

SEQ ID NO: 408860 - DNA, 25 bp, Mus musculus
tcccgcgcaaatcgaaaggtccatg

SEQ ID NO: 408861 - DNA, 25 bp, Mus musculus
acgcccagggacgtcatgtccgctg

SEQ ID NO: 408862 - DNA, 25 bp, Mus musculus
ctcggctaagaggaaagtcgggtca

SEQ ID NO: 408863 - DNA, 25 bp, Mus musculus
cggcggacttcctaccttgcaagga

SEQ ID NO: 408864 - DNA, 25 bp, Mus musculus
gcgtcgccgagttcgagatggcatt

SEQ ID NO: 408865 - DNA, 25 bp, Mus musculus
gctgctgctgttacctcgggtacca

SEQ ID NO: 408866 - DNA, 25 bp, Mus musculus
gtgccgatcgccctcggagaacacg

SEQ ID NO: 408867 - DNA, 25 bp, Mus musculus
cggcaaaccaccgagcggctggtga

SEQ ID NO: 408868 - DNA, 25 bp, Mus musculus
agcccgcaggttgatgcagtgagca

SEQ ID NO: 408869 - DNA, 25 bp, Mus musculus
aacacggggtgctgatcttccaagg

SEQ ID NO: 408870 - DNA, 25 bp, Mus musculus
cccactcgggataggagcaaggagc

SEQ ID NO: 408871 - DNA, 25 bp, Mus musculus
ccatcctgacatgaccaggcggctg

SEQ ID NO: 408872 - DNA, 25 bp, Mus musculus
tctttccttcggagccagacgctgg

SEQ ID NO: 408873 - DNA, 25 bp, Mus musculus
tgcctgctcccgagtggcagaagtc

SEQ ID NO: 408874 - DNA, 25 bp, Mus musculus
tggtccttacgtgttccagtttatc

SEQ ID NO: 408875 - DNA, 25 bp, Mus musculus
gtgctgccggatctccatcctgaca

SEQ ID NO: 408876 - DNA, 25 bp, Mus musculus
gcgctgtagtcctgctgcttgacac

SEQ ID NO: 408877 - DNA, 25 bp, Mus musculus
ctgctgtagaagttcgcgcccactc

SEQ ID NO: 408878 - DNA, 25 bp, Mus musculus
ggcggcttttcaacctcatctgctc

SEQ ID NO: 408879 - DNA, 25 bp, Mus musculus
ctcatctgctcgaagccctcgtggg

SEQ ID NO: 408880 - DNA, 25 bp, Mus musculus
gcaggcgtgccctcaagacagtctt

SEQ ID NO: 408881 - DNA, 25 bp, Mus musculus
tgcagtgaatgcttgcgagggctca

SEQ ID NO: 408882 - DNA, 25 bp, Mus musculus
gccggagctatggatgtgcagaatc

SEQ ID NO: 408883 - DNA, 25 bp, Mus musculus
gttccgctgggcaataacgttattc

SEQ ID NO: 408884 - DNA, 25 bp, Mus musculus
cacacatagcgggaacggcagcgaa

SEQ ID NO: 408885 - DNA, 25 bp, Mus musculus
gcaggcgccagacccagcaatgaaa

SEQ ID NO: 408886 - DNA, 25 bp, Mus musculus
tttgcagagggtctcacccacacgc

SEQ ID NO: 408887 - DNA, 25 bp, Mus musculus
cggctacacaaagcgggagtgaaca

SEQ ID NO: 408888 - DNA, 25 bp, Mus musculus
cttgaacaataaagagccgcttggc

SEQ ID NO: 408889 - DNA, 25 bp, Mus musculus
gtgggaccgcaaccaaccaggacta

SEQ ID NO: 408890 - DNA, 25 bp, Mus musculus
ccaggactacgattcccagcgggca

SEQ ID NO: 408891 - DNA, 25 bp, Mus musculus
gtccgtcactttcacagtttggctg

SEQ ID NO: 408892 - DNA, 25 bp, Mus musculus
cgagggctcagggatcaactccaca

SEQ ID NO: 408893 - DNA, 25 bp, Mus musculus
aggctaggagttgcagtgtccgtca

SEQ ID NO: 408894 - DNA, 25 bp, Mus musculus
agacgcgcagctcacggtaccgcta

SEQ ID NO: 408895 - DNA, 25 bp, Mus musculus
ttcgattcatcactagaaaacacgg

SEQ ID NO: 408896 - DNA, 25 bp, Mus musculus
gggacccggctcgagctaaacaaga

SEQ ID NO: 408897 - DNA, 25 bp, Mus musculus
tcgagctaaacaagagccctaaagg

SEQ ID NO: 408898 - DNA, 25 bp, Mus musculus
atcactagaaaacacggctcgggcg

SEQ ID NO: 408899 - DNA, 25 bp, Mus musculus
cggctacaaattcgattcatcacta

SEQ ID NO: 408900 - DNA, 25 bp, Mus musculus
cggatgtcggctacaaattcgattc

SEQ ID NO: 408901 - DNA, 25 bp, Mus musculus
ctctacttgggaatcggatgtcggc

SEQ ID NO: 408902 - DNA, 25 bp, Mus musculus
gaggcggagactctacttgggaatc

SEQ ID NO: 408903 - DNA, 25 bp, Mus musculus
gtggctgttacctgcaaaggcggcg

SEQ ID NO: 408904 - DNA, 25 bp, Mus musculus
ctacggccccaaagcttcaggagga

SEQ ID NO: 408905 - DNA, 25 bp, Mus musculus
atgtccgtgtcacccacgcggggca

SEQ ID NO: 408906 - DNA, 25 bp, Mus musculus
cacggtaccgctaggccaggaacac

SEQ ID NO: 408907 - DNA, 25 bp, Mus musculus
tcgcctcgcctcagggacccagcag

SEQ ID NO: 408908 - DNA, 25 bp, Mus musculus
agcagggccgtggtaaatacgcatc

SEQ ID NO: 408909 - DNA, 25 bp, Mus musculus
catttgtcatcaaggggcaggctgc

SEQ ID NO: 408910 - DNA, 25 bp, Mus musculus
cgctgaatggaacagggctatgtgc

SEQ ID NO: 408911 - DNA, 25 bp, Mus musculus
cgggcttgcacggattagcttgctt

SEQ ID NO: 408912 - DNA, 25 bp, Mus musculus
gattagcttgctttcccatgaacta

SEQ ID NO: 408913 - DNA, 25 bp, Mus musculus
cccatgaactacaaaagaatgctcg

SEQ ID NO: 408914 - DNA, 25 bp, Mus musculus
aatgctcgaatctggggcatttgtc

SEQ ID NO: 408915 - DNA, 25 bp, Mus musculus
caggctgcgcaggatgcaaggtaac

SEQ ID NO: 408916 - DNA, 25 bp, Mus musculus
ggatgcaaggtaaccggagcttttc

SEQ ID NO: 408917 - DNA, 25 bp, Mus musculus
ttttcccgggctgccgcagtctttg

SEQ ID NO: 408918 - DNA, 25 bp, Mus musculus
agtctttggggacgcgggtcactct

SEQ ID NO: 408919 - DNA, 25 bp, Mus musculus
gggtcactctaatccttcctgttta

SEQ ID NO: 408920 - DNA, 25 bp, Mus musculus
tgaacgcgtcgcagcgaggcttaag

SEQ ID NO: 408921 - DNA, 25 bp, Mus musculus
ctgtttatattgtgaacgcgtcgca

SEQ ID NO: 408922 - DNA, 25 bp, Mus musculus
ggcccagggcctcgctggaattcgc

SEQ ID NO: 408923 - DNA, 25 bp, Mus musculus
tggaattcgccacccgcccggcact

SEQ ID NO: 408924 - DNA, 25 bp, Mus musculus
cggcactgcccggtgcacgatcgag

SEQ ID NO: 408925 - DNA, 25 bp, Mus musculus
tgtgtaacctcgctcattcctctcg

SEQ ID NO: 408926 - DNA, 25 bp, Mus musculus
cccggtgcacgatcgagagacttaa

SEQ ID NO: 408927 - DNA, 25 bp, Mus musculus
cgctcattcctctcgtgcctttgaa

SEQ ID NO: 408928 - DNA, 25 bp, Mus musculus
gcggctgataatgcgcccctgtgta

SEQ ID NO: 408929 - DNA, 25 bp, Mus musculus
cacaaagaggggattatggtcctgc

SEQ ID NO: 408930 - DNA, 25 bp, Mus musculus
tgcagcgagcacaaagaggggatta

SEQ ID NO: 408931 - DNA, 25 bp, Mus musculus
acaagtggctctgcgcttgcagcga

SEQ ID NO: 408932 - DNA, 25 bp, Mus musculus
aagggagaggaattacaagtggctc

SEQ ID NO: 408933 - DNA, 25 bp, Mus musculus
taagagtcaggctggtctccacggc

SEQ ID NO: 408934 - DNA, 25 bp, Mus musculus
tgcacgatcgagagacttaagagtc

SEQ ID NO: 408935 - DNA, 25 bp, Mus musculus
tctcgtgcctttgaagatttccgcg

SEQ ID NO: 408936 - DNA, 25 bp, Mus musculus
ctcaatcgctgagcggccggcaagg

SEQ ID NO: 408937 - DNA, 25 bp, Mus musculus
ttctcacggccaagtcacccagagg

SEQ ID NO: 408938 - DNA, 25 bp, Mus musculus
agcaccgcaggagggccagacccag

SEQ ID NO: 408939 - DNA, 25 bp, Mus musculus
aaaagtatacttatggccgtcgcgg

SEQ ID NO: 408940 - DNA, 25 bp, Mus musculus
atacttatggccgtcgcggtgcacg

SEQ ID NO: 408941 - DNA, 25 bp, Mus musculus
agcgcgcttgtctccagccgggaag

SEQ ID NO: 408942 - DNA, 25 bp, Mus musculus
gcgggctcctttcactttctcacgg

SEQ ID NO: 408943 - DNA, 25 bp, Mus musculus
gaagaccacgcccacccaacagtcg

SEQ ID NO: 408944 - DNA, 25 bp, Mus musculus
aacagtcgccgtctgcgattggcgc

SEQ ID NO: 408945 - DNA, 25 bp, Mus musculus
accgccactcctattggtcgagctg

SEQ ID NO: 408946 - DNA, 25 bp, Mus musculus
gactcgggccgctccgtgtgagtcc

SEQ ID NO: 408947 - DNA, 25 bp, Mus musculus
gccgctttcgctcaatcgctgagcg

SEQ ID NO: 408948 - DNA, 25 bp, Mus musculus
ggaggacgcccacaagtccagcggc

SEQ ID NO: 408949 - DNA, 25 bp, Mus musculus
cggaacaccgcgcttctactgggcg

SEQ ID NO: 408950 - DNA, 25 bp, Mus musculus
gaggtaacgtgagacggccgggctg

SEQ ID NO: 408951 - DNA, 25 bp, Mus musculus
aaggcagctgtggagccagcggcgg

SEQ ID NO: 408952 - DNA, 25 bp, Mus musculus
gacccagagccctacatgcggggac

SEQ ID NO: 408953 - DNA, 25 bp, Mus musculus
tgacccagagccctacatgcgggga

SEQ ID NO: 408954 - DNA, 25 bp, Mus musculus
gagtgacccagagccctacatgcgg

SEQ ID NO: 408955 - DNA, 25 bp, Mus musculus
cgcggagtgacccagagccctacat

SEQ ID NO: 408956 - DNA, 25 bp, Mus musculus
cgacgcggagtgacccagagcccta

SEQ ID NO: 408957 - DNA, 25 bp, Mus musculus
aatgcagggttcagtgcgacgcgga

SEQ ID NO: 408958 - DNA, 25 bp, Mus musculus
aacgggaatgcagggttcagtgcga

SEQ ID NO: 408959 - DNA, 25 bp, Mus musculus
tcgtatgtgtggaaacgggaatgca

SEQ ID NO: 408960 - DNA, 25 bp, Mus musculus
cagcccgggagcgtgtcgtatgtgt

SEQ ID NO: 408961 - DNA, 25 bp, Mus musculus
gcatcctgcctgcgcgggaggtaac

SEQ ID NO: 408962 - DNA, 25 bp, Mus musculus
gaccgctagaggggacagtcgtccc

SEQ ID NO: 408963 - DNA, 25 bp, Mus musculus
agccccttcggactgtgcgtgtgcg

SEQ ID NO: 408964 - DNA, 25 bp, Mus musculus
catgcctgcaagtggtgcgagcgca

SEQ ID NO: 408965 - DNA, 25 bp, Mus musculus
gcacttccgagagcaggatggcatc

SEQ ID NO: 408966 - DNA, 25 bp, Mus musculus
atgccgtggtgcacacccgcgagaa

SEQ ID NO: 408967 - DNA, 25 bp, Mus musculus
acaacctgagccgtcatgccgtggt

SEQ ID NO: 408968 - DNA, 25 bp, Mus musculus
gtttccagtactcgcacaacctgag

SEQ ID NO: 408969 - DNA, 25 bp, Mus musculus
cccaatgcggcaagagtttccagta

SEQ ID NO: 408970 - DNA, 25 bp, Mus musculus
tacacgtgcacccaatgcggcaaga

SEQ ID NO: 408971 - DNA, 25 bp, Mus musculus
tcaagcgccacgagaggactcactc

SEQ ID NO: 408972 - DNA, 25 bp, Mus musculus
tttctcctgcatgtacaccctcaag

SEQ ID NO: 408973 - DNA, 25 bp, Mus musculus
ctccctgtgtgggaagactttctcc

SEQ ID NO: 408974 - DNA, 25 bp, Mus musculus
cgatgtcaatgtgcccacgtgctcc

SEQ ID NO: 408975 - DNA, 25 bp, Mus musculus
aagcctgccgccgatgtcaatgtgc

SEQ ID NO: 408976 - DNA, 25 bp, Mus musculus
aggatggcatccgtagcaagcctgc

SEQ ID NO: 408977 - DNA, 25 bp, Mus musculus
tgcgagcgcaggttcacgcagtccg

SEQ ID NO: 408978 - DNA, 25 bp, Mus musculus
tctagccagagtcccgagcaggcct

SEQ ID NO: 408979 - DNA, 25 bp, Mus musculus
cgaaatgcagctccaacatcgcgca

SEQ ID NO: 408980 - DNA, 25 bp, Mus musculus
ctgctctcggagatcgacatggctc

SEQ ID NO: 408981 - DNA, 25 bp, Mus musculus
caggttcctccagagtcacccggag

SEQ ID NO: 408982 - DNA, 25 bp, Mus musculus
gtcacccggagcgtcaccggagact

SEQ ID NO: 408983 - DNA, 25 bp, Mus musculus
ccgagggacgcacctcaaggtgaca

SEQ ID NO: 408984 - DNA, 25 bp, Mus musculus
tgtcggcgtcctgcgccagtagatc

SEQ ID NO: 408985 - DNA, 25 bp, Mus musculus
tcgggcggaagctccctcaactctg

SEQ ID NO: 408986 - DNA, 25 bp, Mus musculus
taacggagagttccgccctctgtgc

SEQ ID NO: 408987 - DNA, 25 bp, Mus musculus
gccaccagccacatgcggaggaaga

SEQ ID NO: 408988 - DNA, 25 bp, Mus musculus
gaacggaacgtgaacccaactgctg

SEQ ID NO: 408989 - DNA, 25 bp, Mus musculus
tcccggcagggcagaagagccttaa

SEQ ID NO: 408990 - DNA, 25 bp, Mus musculus
cagcggcacacgatgtcggcgtcct

SEQ ID NO: 408991 - DNA, 25 bp, Mus musculus
aacatcgcgcatcttccaggttcct

SEQ ID NO: 408992 - DNA, 25 bp, Mus musculus
cacagtcgagggaccgagctggacc

SEQ ID NO: 408993 - DNA, 25 bp, Mus musculus
ttcccgcgagaacgggagacttgcg

SEQ ID NO: 408994 - DNA, 25 bp, Mus musculus
agcatgcgcagtcgcgtcggtccca

SEQ ID NO: 408995 - DNA, 25 bp, Mus musculus
gcaaagccaagagccggctcgtctc

SEQ ID NO: 408996 - DNA, 25 bp, Mus musculus
taggcgtccttagccaggtccgcac

SEQ ID NO: 408997 - DNA, 25 bp, Mus musculus
gacagcgaggggctcacctctcaac

SEQ ID NO: 408998 - DNA, 25 bp, Mus musculus
cagacgaggcgaggaggccacttcc

SEQ ID NO: 408999 - DNA, 25 bp, Mus musculus
cggcgccaaccgagatttgaagatt

SEQ ID NO: 409000 - DNA, 25 bp, Mus musculus
agagctcgaccgacgtcgagggacc

SEQ ID NO: 409001 - DNA, 25 bp, Mus musculus
gccgagcgctacctgcgttcaacag

SEQ ID NO: 409002 - DNA, 25 bp, Mus musculus
agaggttaacgactggggatgcaca

SEQ ID NO: 409003 - DNA, 25 bp, Mus musculus
atcggcgacggccaagaggttaacg

SEQ ID NO: 409004 - DNA, 25 bp, Mus musculus
cgaggaaactgatcggcgacggcca

SEQ ID NO: 409005 - DNA, 25 bp, Mus musculus
cgggagacttgcgtcaataaaaagc

SEQ ID NO: 409006 - DNA, 25 bp, Mus musculus
tctacgacgtggtgagtgaggcacc

SEQ ID NO: 409007 - DNA, 25 bp, Mus musculus
taggaatcgcgggtttccgctctcc

SEQ ID NO: 409008 - DNA, 25 bp, Mus musculus
aggaatcgcgggtttccgctctcct

SEQ ID NO: 409009 - DNA, 25 bp, Mus musculus
cgcgggtttccgctctcctttctgg

SEQ ID NO: 409010 - DNA, 25 bp, Mus musculus
ctgcagagcctgagaacctcaagac

SEQ ID NO: 409011 - DNA, 25 bp, Mus musculus
tgcagagcctgagaacctcaagacg

SEQ ID NO: 409012 - DNA, 25 bp, Mus musculus
cagagcctgagaacctcaagacgca

SEQ ID NO: 409013 - DNA, 25 bp, Mus musculus
gagcctgagaacctcaagacgcagg

SEQ ID NO: 409014 - DNA, 25 bp, Mus musculus
ctgagaacctcaagacgcaggcggg

SEQ ID NO: 409015 - DNA, 25 bp, Mus musculus
agaacctcaagacgcaggcgggctc

SEQ ID NO: 409016 - DNA, 25 bp, Mus musculus
aacctcaagacgcaggcgggctcat

SEQ ID NO: 409017 - DNA, 25 bp, Mus musculus
agccgggtcctcatacaggttcctg

SEQ ID NO: 409018 - DNA, 25 bp, Mus musculus
ctagccgggtcctcatacaggttcc

SEQ ID NO: 409019 - DNA, 25 bp, Mus musculus
tctagccgggtcctcatacaggttc

SEQ ID NO: 409020 - DNA, 25 bp, Mus musculus
gtcgcgctgtcttctaatcccgaga

SEQ ID NO: 409021 - DNA, 25 bp, Mus musculus
tttctgggaacggtagtctttctgc

SEQ ID NO: 409022 - DNA, 25 bp, Mus musculus
cggtagtctttctgcgacctcgagc

SEQ ID NO: 409023 - DNA, 25 bp, Mus musculus
cgacctcgagccaccagggtgaaga

SEQ ID NO: 409024 - DNA, 25 bp, Mus musculus
aggcatccggcctgtcgccatttta

SEQ ID NO: 409025 - DNA, 25 bp, Mus musculus
tcgccattttaggtctccagctgca

SEQ ID NO: 409026 - DNA, 25 bp, Mus musculus
gcaggcgggctcatccctggatcct

SEQ ID NO: 409027 - DNA, 25 bp, Mus musculus
ctgacagcgtctcccgggagcggtc

SEQ ID NO: 409028 - DNA, 25 bp, Mus musculus
tatccgcgaagcttcggtcgcaggg

SEQ ID NO: 409029 - DNA, 25 bp, Mus musculus
tccgcctccagcttagttctcaggg

SEQ ID NO: 409030 - DNA, 25 bp, Mus musculus
tggaggtgtcccagtcagtccgaaa

SEQ ID NO: 409031 - DNA, 25 bp, Mus musculus
tcagtccgaaagagggcttgggctc

SEQ ID NO: 409032 - DNA, 25 bp, Mus musculus
ggatgagccgtgtcctatccgcgaa

SEQ ID NO: 409033 - DNA, 25 bp, Mus musculus
accagttagtggtgctcaacgtcta

SEQ ID NO: 409034 - DNA, 25 bp, Mus musculus
gcagagcctgagagcctcaacgcgc

SEQ ID NO: 409035 - DNA, 25 bp, Mus musculus
gaatcgcgggttctccctctgcttt

SEQ ID NO: 409036 - DNA, 25 bp, Mus musculus
gagcctgagagcctcaacgcgcagg

SEQ ID NO: 409037 - DNA, 25 bp, Mus musculus
cgacatggtgagtgcgtcccctggc

SEQ ID NO: 409038 - DNA, 25 bp, Mus musculus
gtctacgacatggtgagtgcgtccc

SEQ ID NO: 409039 - DNA, 25 bp, Mus musculus
cgtctacgacatggtgagtgcgtcc

SEQ ID NO: 409040 - DNA, 25 bp, Mus musculus
acgtctacgacatggtgagtgcgtc

SEQ ID NO: 409041 - DNA, 25 bp, Mus musculus
agcctcaacgcgcaggcgggctcat

SEQ ID NO: 409042 - DNA, 25 bp, Mus musculus
cctgagagcctcaacgcgcaggcgg

SEQ ID NO: 409043 - DNA, 25 bp, Mus musculus
cagagcctgagagcctcaacgcgca

SEQ ID NO: 409044 - DNA, 25 bp, Mus musculus
atcgcgggttctccctctgctttct

SEQ ID NO: 409045 - DNA, 25 bp, Mus musculus
aggaatcgcgggttctccctctgct

SEQ ID NO: 409046 - DNA, 25 bp, Mus musculus
taggaatcgcgggttctccctctgc

SEQ ID NO: 409047 - DNA, 25 bp, Mus musculus
cgcgggttctccctctgctttctgg

SEQ ID NO: 409048 - DNA, 25 bp, Mus musculus
ctcgccgcaggtaacgccgccgcca

SEQ ID NO: 409049 - DNA, 25 bp, Mus musculus
ttctctagcagctcgtgctgcacgc

SEQ ID NO: 409050 - DNA, 25 bp, Mus musculus
acgagcagcgggatctcctctaggc

SEQ ID NO: 409051 - DNA, 25 bp, Mus musculus
aagccaccagcggtgcagctctgcg

SEQ ID NO: 409052 - DNA, 25 bp, Mus musculus
attcgggaagccaccagcggtgcag

SEQ ID NO: 409053 - DNA, 25 bp, Mus musculus
gggccgtcgattcgggaagccacca

SEQ ID NO: 409054 - DNA, 25 bp, Mus musculus
ccgcacctccgccatgggctggctc

SEQ ID NO: 409055 - DNA, 25 bp, Mus musculus
tgcaggcgcgccaccttctctagca

SEQ ID NO: 409056 - DNA, 25 bp, Mus musculus
cgccgccagcaccagaagcccgagc

SEQ ID NO: 409057 - DNA, 25 bp, Mus musculus
gagaacttgcccttcctccggcgcg

SEQ ID NO: 409058 - DNA, 25 bp, Mus musculus
cgcccacacgctgcgctccgacgtg

SEQ ID NO: 409059 - DNA, 25 bp, Mus musculus
ccgccacgtcgccaacctctgcaac

SEQ ID NO: 409060 - DNA, 25 bp, Mus musculus
tccagcacgagcagcgggatctcct

SEQ ID NO: 409061 - DNA, 25 bp, Mus musculus
tgcaacagcctctgcaggcccgggg

SEQ ID NO: 409062 - DNA, 25 bp, Mus musculus
cagtgtggccggttccatggaacaa

SEQ ID NO: 409063 - DNA, 25 bp, Mus musculus
ggcgcttctctaggttgccaccact

SEQ ID NO: 409064 - DNA, 25 bp, Mus musculus
cgagcggcgcgctatttttaaccta

SEQ ID NO: 409065 - DNA, 25 bp, Mus musculus
gcggccgcctccattttgtcctgag

SEQ ID NO: 409066 - DNA, 25 bp, Mus musculus
acggtctgggtttctacccgctatg

SEQ ID NO: 409067 - DNA, 25 bp, Mus musculus
ctggctgacacttggacccaaacga

SEQ ID NO: 409068 - DNA, 25 bp, Mus musculus
ccatcgcctgctgaactggctgaca

SEQ ID NO: 409069 - DNA, 25 bp, Mus musculus
ccgaaaacggagtcgccatcgcctg

SEQ ID NO: 409070 - DNA, 25 bp, Mus musculus
ctgcacaatgacaggccgggacatt

SEQ ID NO: 409071 - DNA, 25 bp, Mus musculus
aaaggcggcatgactctgcacaatg

SEQ ID NO: 409072 - DNA, 25 bp, Mus musculus
gcgtgcagcacgttacatgaaaggc

SEQ ID NO: 409073 - DNA, 25 bp, Mus musculus
ccactcgcgttcctcatggtcggtt

SEQ ID NO: 409074 - DNA, 25 bp, Mus musculus
cgcacaacggttgaaatggcggtta

SEQ ID NO: 409075 - DNA, 25 bp, Mus musculus
agtttctcggtgctccttgactcgg

SEQ ID NO: 409076 - DNA, 25 bp, Mus musculus
cgccacctaggtcgagactgccgtt

SEQ ID NO: 409077 - DNA, 25 bp, Mus musculus
gctcttagaagccacctttcggtta

SEQ ID NO: 409078 - DNA, 25 bp, Mus musculus
gaccgcgcaaatggaggctcttaga

SEQ ID NO: 409079 - DNA, 25 bp, Mus musculus
cggcgccgcgcacgtaatataggcg

SEQ ID NO: 409080 - DNA, 25 bp, Mus musculus
agcacgcaacgtcctctcgcagggg

SEQ ID NO: 409081 - DNA, 25 bp, Mus musculus
ttcgcgaggcaagacgcggagactc

SEQ ID NO: 409082 - DNA, 25 bp, Mus musculus
ctttcaccgagttcgcgaggcaaga

SEQ ID NO: 409083 - DNA, 25 bp, Mus musculus
gaacggcgccaattcctttcaccga

SEQ ID NO: 409084 - DNA, 25 bp, Mus musculus
ccgcctggtgtcgaacggcgccaat

SEQ ID NO: 409085 - DNA, 25 bp, Mus musculus
ctgagtgctgctgcagaacggaccc

SEQ ID NO: 409086 - DNA, 25 bp, Mus musculus
cttgacattaacaggcgaagaactc

SEQ ID NO: 409087 - DNA, 25 bp, Mus musculus
cgacaccttcagcttcttgacatta

SEQ ID NO: 409088 - DNA, 25 bp, Mus musculus
tgagatcggccttgaggcccttgtc

SEQ ID NO: 409089 - DNA, 25 bp, Mus musculus
cggcctggagtcgatccatgagatc

SEQ ID NO: 409090 - DNA, 25 bp, Mus musculus
ggactcgtgacgcttgcttccgcga

SEQ ID NO: 409091 - DNA, 25 bp, Mus musculus
ctgggcgcgcgtccacatcgcgtca

SEQ ID NO: 409092 - DNA, 25 bp, Mus musculus
caacccacttgacaaatgcgcgggg

SEQ ID NO: 409093 - DNA, 25 bp, Mus musculus
caggcaccaacccacttgacaaatg

SEQ ID NO: 409094 - DNA, 25 bp, Mus musculus
ttcctgggaactgcgagcccagagc

SEQ ID NO: 409095 - DNA, 25 bp, Mus musculus
gcacttcctgggaactgcgagccca

SEQ ID NO: 409096 - DNA, 25 bp, Mus musculus
cgcacattgcacttcctgggaactg

SEQ ID NO: 409097 - DNA, 25 bp, Mus musculus
ggcggtgcgcacattgcacttcctg

SEQ ID NO: 409098 - DNA, 25 bp, Mus musculus
acaggcggtgcgcacattgcacttc

SEQ ID NO: 409099 - DNA, 25 bp, Mus musculus
aatcgtgagacaggcggtgcgcaca

SEQ ID NO: 409100 - DNA, 25 bp, Mus musculus
cttgccgcacgggagggactcgtga

SEQ ID NO: 409101 - DNA, 25 bp, Mus musculus
gtgacgcttgcttccgcgacagatg

SEQ ID NO: 409102 - DNA, 25 bp, Mus musculus
ttgcttccgcgacagatgcttgccg

SEQ ID NO: 409103 - DNA, 25 bp, Mus musculus
cacatcgcgtcacgtgcgcgcggtg

SEQ ID NO: 409104 - DNA, 25 bp, Mus musculus
ccggagccttgttaataaatgacgc

SEQ ID NO: 409105 - DNA, 25 bp, Mus musculus
gcgcacctgagacggccgggaaaaa

SEQ ID NO: 409106 - DNA, 25 bp, Mus musculus
ttgacagtcacaatcaggcccaggc

SEQ ID NO: 409107 - DNA, 25 bp, Mus musculus
gccaccgtgcatccaggggctttct

SEQ ID NO: 409108 - DNA, 25 bp, Mus musculus
ggaggttcataatggcgtccttgtc

SEQ ID NO: 409109 - DNA, 25 bp, Mus musculus
cctcatggaggactggagctgcgac

SEQ ID NO: 409110 - DNA, 25 bp, Mus musculus
tgcgactagaacctggcgggatcct

SEQ ID NO: 409111 - DNA, 25 bp, Mus musculus
agcgcagcctccaggtcagactggg

SEQ ID NO: 409112 - DNA, 25 bp, Mus musculus
gggtcgcgctagagccttgcataag

SEQ ID NO: 409113 - DNA, 25 bp, Mus musculus
gccttgcataaggaacacgcacttt

SEQ ID NO: 409114 - DNA, 25 bp, Mus musculus
aggcacactacgtccttgacagtca

SEQ ID NO: 409115 - DNA, 25 bp, Mus musculus
tgactggcagagtggctccgctcag

SEQ ID NO: 409116 - DNA, 25 bp, Mus musculus
gacgtcgcctctgcgcctgaggaag

SEQ ID NO: 409117 - DNA, 25 bp, Mus musculus
ctccgctcaggagagggtgacgcca

SEQ ID NO: 409118 - DNA, 25 bp, Mus musculus
cgaggagtacagttcgcaggcttca

SEQ ID NO: 409119 - DNA, 25 bp, Mus musculus
tacgctggactaggttctgagctcc

SEQ ID NO: 409120 - DNA, 25 bp, Mus musculus
ctcgccagttgggtccaggagaagt

SEQ ID NO: 409121 - DNA, 25 bp, Mus musculus
ggggctagctagtccgggacacaca

SEQ ID NO: 409122 - DNA, 25 bp, Mus musculus
acttctccgcaacctcttggctgga

SEQ ID NO: 409123 - DNA, 25 bp, Mus musculus
atctccgtttcagcagcgacgacga

SEQ ID NO: 409124 - DNA, 25 bp, Mus musculus
tctgagctccgtggaaccaggtacc

SEQ ID NO: 409125 - DNA, 25 bp, Mus musculus
cttcagctcgcttacggcgggacct

SEQ ID NO: 409126 - DNA, 25 bp, Mus musculus
ccgcgcaagtgagagcctcggctaa

SEQ ID NO: 409127 - DNA, 25 bp, Mus musculus
agcctcggctaagcgcttttctctt

SEQ ID NO: 409128 - DNA, 25 bp, Mus musculus
ttaccgctgctgctcggtacgtcgc

SEQ ID NO: 409129 - DNA, 25 bp, Mus musculus
ctcgggtaatcttttgcaggggcac

SEQ ID NO: 409130 - DNA, 25 bp, Mus musculus
ctgtctgcacgccaaagacggtgtg

SEQ ID NO: 409131 - DNA, 25 bp, Mus musculus
ccaggagaagtgtcgcgtctcttta

SEQ ID NO: 409132 - DNA, 25 bp, Mus musculus
agccaccatgaattcggtagccgga

SEQ ID NO: 409133 - DNA, 25 bp, Mus musculus
ccgtttgcacggcttttcaaaggca

SEQ ID NO: 409134 - DNA, 25 bp, Mus musculus
cagaccttttggatgtagccttgtg

SEQ ID NO: 409135 - DNA, 25 bp, Mus musculus
tagccttgtgggaacatttagaccc

SEQ ID NO: 409136 - DNA, 25 bp, Mus musculus
cctttcctctggaagagccaccatg

SEQ ID NO: 409137 - DNA, 25 bp, Mus musculus
gaaatcttgacttgaggaccaaccc

SEQ ID NO: 409138 - DNA, 25 bp, Mus musculus
ggggtccatttgctttcattcttcc

SEQ ID NO: 409139 - DNA, 25 bp, Mus musculus
ggtgctattacttctggggtccatt

SEQ ID NO: 409140 - DNA, 25 bp, Mus musculus
ggcagagagatgagaagacccatta

SEQ ID NO: 409141 - DNA, 25 bp, Mus musculus
agcgatctggatgtgaccgcgaaga

SEQ ID NO: 409142 - DNA, 25 bp, Mus musculus
cccgagtctggatccttatattttg

SEQ ID NO: 409143 - DNA, 25 bp, Mus musculus
acggcgcatattggctcggcgacac

SEQ ID NO: 409144 - DNA, 25 bp, Mus musculus
aagcgccgcgccgtaaatggatcgc

SEQ ID NO: 409145 - DNA, 25 bp, Mus musculus
tgcgcgcaactgtcaggagaaaacg

SEQ ID NO: 409146 - DNA, 25 bp, Mus musculus
gcagcgatcacagactacgccacga

SEQ ID NO: 409147 - DNA, 25 bp, Mus musculus
cgaactgcgtccctcagcttgagtc

SEQ ID NO: 409148 - DNA, 25 bp, Mus musculus
gatccgaactgcgtccctcagcttg

SEQ ID NO: 409149 - DNA, 25 bp, Mus musculus
ccagtaggcagcgatcacagactac

SEQ ID NO: 409150 - DNA, 25 bp, Mus musculus
tgcacacagtgtaagccaaggggtc

SEQ ID NO: 409151 - DNA, 25 bp, Mus musculus
gcgcagtggagccacagcacgcagc

SEQ ID NO: 409152 - DNA, 25 bp, Mus musculus
tggagccacagcacgcagcccgttt

SEQ ID NO: 409153 - DNA, 25 bp, Mus musculus
cggttggcagtcgtgaacttttcca

SEQ ID NO: 409154 - DNA, 25 bp, Mus musculus
tctcgtgttttctgactgcgcgcct

SEQ ID NO: 409155 - DNA, 25 bp, Mus musculus
agatccacacctcagatccgaactg

SEQ ID NO: 409156 - DNA, 25 bp, Mus musculus
ctcagcttgagtctcgtgttttctg

SEQ ID NO: 409157 - DNA, 25 bp, Mus musculus
tgttttctgactgcgcgcctgcgtc

SEQ ID NO: 409158 - DNA, 25 bp, Mus musculus
cttcagtgcctccatccttcctcag

SEQ ID NO: 409159 - DNA, 25 bp, Mus musculus
tgcgtcctgcgcttgcgtacaccag

SEQ ID NO: 409160 - DNA, 25 bp, Mus musculus
ccaaatcagaatcaggcaacggctc

SEQ ID NO: 409161 - DNA, 25 bp, Mus musculus
cggatgcccaggtaagaccagcagc

SEQ ID NO: 409162 - DNA, 25 bp, Mus musculus
ggtagcccttgcattgcctcggatg

SEQ ID NO: 409163 - DNA, 25 bp, Mus musculus
tagaggtgtccgatcctccagtgcc

SEQ ID NO: 409164 - DNA, 25 bp, Mus musculus
tagccgcggtctcgcactctatgct

SEQ ID NO: 409165 - DNA, 25 bp, Mus musculus
gtgtccgtgctggaactctatggtc

SEQ ID NO: 409166 - DNA, 25 bp, Mus musculus
cgcatgcgaacgacctagcctcagt

SEQ ID NO: 409167 - DNA, 25 bp, Mus musculus
accaccacactaggccgggcggaag

SEQ ID NO: 409168 - DNA, 25 bp, Mus musculus
ttaaggtagcctctgcgaagaacgc

SEQ ID NO: 409169 - DNA, 25 bp, Mus musculus
gcgtaggctccgatcgattcctgga

SEQ ID NO: 409170 - DNA, 25 bp, Mus musculus
gcaacggctctatattgaagtcaga

SEQ ID NO: 409171 - DNA, 25 bp, Mus musculus
acggggacgactcctccaaatcaga

SEQ ID NO: 409172 - DNA, 25 bp, Mus musculus
cttctactccgcgtcggtgtctctg

SEQ ID NO: 409173 - DNA, 25 bp, Mus musculus
gctccggaccctagaatgcaagatg

SEQ ID NO: 409174 - DNA, 25 bp, Mus musculus
gcagcgtgtcaaagtggcctgatct

SEQ ID NO: 409175 - DNA, 25 bp, Mus musculus
ggacgcacaaacacgagccacatta

SEQ ID NO: 409176 - DNA, 25 bp, Mus musculus
cgtagcttgctctgttcgtttaccc

SEQ ID NO: 409177 - DNA, 25 bp, Mus musculus
gcatcagcatcgcatacacttctgc

SEQ ID NO: 409178 - DNA, 25 bp, Mus musculus
aactaaagtggaacgcgcgagcccg

SEQ ID NO: 409179 - DNA, 25 bp, Mus musculus
agcccgcgtgacctggacgcacaaa

SEQ ID NO: 409180 - DNA, 25 bp, Mus musculus
cgagccacattataggcagcgtgtc

SEQ ID NO: 409181 - DNA, 25 bp, Mus musculus
ctgatctggccaaatgcactcggtc

SEQ ID NO: 409182 - DNA, 25 bp, Mus musculus
taactccaccgggtacacgagcgtc

SEQ ID NO: 409183 - DNA, 25 bp, Mus musculus
gccaacaaacttctccaggaccatg

SEQ ID NO: 409184 - DNA, 25 bp, Mus musculus
tccgcgacagcctaagccgggcttg

SEQ ID NO: 409185 - DNA, 25 bp, Mus musculus
tggctttcacctctcccggttacag

SEQ ID NO: 409186 - DNA, 25 bp, Mus musculus
cggttacagcatccaaccctagaga

SEQ ID NO: 409187 - DNA, 25 bp, Mus musculus
cgcactctgcgtgttgaaggagaca

SEQ ID NO: 409188 - DNA, 25 bp, Mus musculus
ctgcagctcgctgtggactcgtcat

SEQ ID NO: 409189 - DNA, 25 bp, Mus musculus
agcagatagcctcggagcagagctc

SEQ ID NO: 409190 - DNA, 25 bp, Mus musculus
agcaagtgctggagaaggctgccca

SEQ ID NO: 409191 - DNA, 25 bp, Mus musculus
ggctgcccagaaactgggtaacacg

SEQ ID NO: 409192 - DNA, 25 bp, Mus musculus
tagcgtgcgcctgcatcgagccctg

SEQ ID NO: 409193 - DNA, 25 bp, Mus musculus
tgttcggcgcctctggcttcaccgg

SEQ ID NO: 409194 - DNA, 25 bp, Mus musculus
cgacggagcagaggcctttccacct

SEQ ID NO: 409195 - DNA, 25 bp, Mus musculus
accgaagcggacgtgcagcccgagc

SEQ ID NO: 409196 - DNA, 25 bp, Mus musculus
tcctgtcagccaccgaagcggacgt

SEQ ID NO: 409197 - DNA, 25 bp, Mus musculus
cgatgattcgggtggccagattgat

SEQ ID NO: 409198 - DNA, 25 bp, Mus musculus
tctgcttcaggggaaccaagaggac

SEQ ID NO: 409199 - DNA, 25 bp, Mus musculus
cttccaagctccagttctcggcgtg

SEQ ID NO: 409200 - DNA, 25 bp, Mus musculus
gcttcaccggccagttcgtgacgga

SEQ ID NO: 409201 - DNA, 25 bp, Mus musculus
ctttccacctggtggtgttcggcgc

SEQ ID NO: 409202 - DNA, 25 bp, Mus musculus
gcgactcgacttactgggctggcac

SEQ ID NO: 409203 - DNA, 25 bp, Mus musculus
atgtggagctcacgccaacgccgga

SEQ ID NO: 409204 - DNA, 25 bp, Mus musculus
cccggggtctcgagtcagactcgtc

SEQ ID NO: 409205 - DNA, 25 bp, Mus musculus
cacccgccgccagggttatgtaact

SEQ ID NO: 409206 - DNA, 25 bp, Mus musculus
gcttccgtgcggtccgtcacagcat

SEQ ID NO: 409207 - DNA, 25 bp, Mus musculus
gcctctccgcccagggaaggatcgt

SEQ ID NO: 409208 - DNA, 25 bp, Mus musculus
gggatccgatcgcagatcgcgctgc

SEQ ID NO: 409209 - DNA, 25 bp, Mus musculus
ctactaggcctttcgcaaagggaga

SEQ ID NO: 409210 - DNA, 25 bp, Mus musculus
cgacgccgggaagaaagattcattt

SEQ ID NO: 409211 - DNA, 25 bp, Mus musculus
tcatttacgtacagcagggtctctc

SEQ ID NO: 409212 - DNA, 25 bp, Mus musculus
tctccgcctcctaggagcagatagg

SEQ ID NO: 409213 - DNA, 25 bp, Mus musculus
ggcgaaagactacaagtcccatagg

SEQ ID NO: 409214 - DNA, 25 bp, Mus musculus
ggcctaatctagtggcggttcctgc

SEQ ID NO: 409215 - DNA, 25 bp, Mus musculus
ttatgtaactaacgcccgagcgctg

SEQ ID NO: 409216 - DNA, 25 bp, Mus musculus
ccctaggaagaaagagctcggagcg

SEQ ID NO: 409217 - DNA, 25 bp, Mus musculus
tcagccgcctgcgtccgtcgggaaa

SEQ ID NO: 409218 - DNA, 25 bp, Mus musculus
tccgtcgggaaagatgccctcagcc

SEQ ID NO: 409219 - DNA, 25 bp, Mus musculus
tgccctcagcccaaggctgggaaga

SEQ ID NO: 409220 - DNA, 25 bp, Mus musculus
gaagaagggactcgagtcgccgccc

SEQ ID NO: 409221 - DNA, 25 bp, Mus musculus
cgcgtcctctgaattcgtcagcgca

SEQ ID NO: 409222 - DNA, 25 bp, Mus musculus
gaagatgacgcgtcctcgccgcagt

SEQ ID NO: 409223 - DNA, 25 bp, Mus musculus
cgccgcagtccgctggaagcaagac

SEQ ID NO: 409224 - DNA, 25 bp, Mus musculus
ccgggagaactgctccggcagctgc

SEQ ID NO: 409225 - DNA, 25 bp, Mus musculus
cgctgcaaagccctaggaagaaaga

SEQ ID NO: 409226 - DNA, 25 bp, Mus musculus
ccgacggcatctccgcagaagtgga

SEQ ID NO: 409227 - DNA, 25 bp, Mus musculus
tacccttgcgggaccgacggcatct

SEQ ID NO: 409228 - DNA, 25 bp, Mus musculus
cgctggaagcaagactcgctgcaaa

SEQ ID NO: 409229 - DNA, 25 bp, Mus musculus
gccattttggatccggacggtccgc

SEQ ID NO: 409230 - DNA, 25 bp, Mus musculus
tggacgacgcagaggccacaagcaa

SEQ ID NO: 409231 - DNA, 25 bp, Mus musculus
tgcgcctgcgttctgaagattgaca

SEQ ID NO: 409232 - DNA, 25 bp, Mus musculus
aagcctgcagttgttctgcgcctgc

SEQ ID NO: 409233 - DNA, 25 bp, Mus musculus
tgttagctgtcttttctcccgggca

SEQ ID NO: 409234 - DNA, 25 bp, Mus musculus
cgcggtccctaatctgcctgttagc

SEQ ID NO: 409235 - DNA, 25 bp, Mus musculus
agcaaccaatgagaggccgcccttg

SEQ ID NO: 409236 - DNA, 25 bp, Mus musculus
gcgtgcgcagctcacagccaatagg

SEQ ID NO: 409237 - DNA, 25 bp, Mus musculus
ctgagccgctgtttgttagctgccc

SEQ ID NO: 409238 - DNA, 25 bp, Mus musculus
gtttaccttctagcccgggtgcgca

SEQ ID NO: 409239 - DNA, 25 bp, Mus musculus
ggaaggtagctcctccgtccgcaac

SEQ ID NO: 409240 - DNA, 25 bp, Mus musculus
agccttaccgggctgcaggaaggta

SEQ ID NO: 409241 - DNA, 25 bp, Mus musculus
cgctagctcagcttcctaggggtcg

SEQ ID NO: 409242 - DNA, 25 bp, Mus musculus
ggccgcactgtcacttgaaagtata

SEQ ID NO: 409243 - DNA, 25 bp, Mus musculus
gacaagcgttcacctggcagccacg

SEQ ID NO: 409244 - DNA, 25 bp, Mus musculus
cggtgggggacacgcccacttcctg

SEQ ID NO: 409245 - DNA, 25 bp, Mus musculus
cccggttcgccagcgcctcagacac

SEQ ID NO: 409246 - DNA, 25 bp, Mus musculus
tcggtgacaggtacccggccgcaca

SEQ ID NO: 409247 - DNA, 25 bp, Mus musculus
acccgcgatcggtgacaggtacccg

SEQ ID NO: 409248 - DNA, 25 bp, Mus musculus
tgtcccgtcccttgggcggtgccag

SEQ ID NO: 409249 - DNA, 25 bp, Mus musculus
atgctgccggctacccgcgatcggt

SEQ ID NO: 409250 - DNA, 25 bp, Mus musculus
ccctgtgcacttgcgccttcatcgt

SEQ ID NO: 409251 - DNA, 25 bp, Mus musculus
agctgcaccctacgctccttccaag

SEQ ID NO: 409252 - DNA, 25 bp, Mus musculus
gccgcagaggccgagatcgccgcag

SEQ ID NO: 409253 - DNA, 25 bp, Mus musculus
ccgcagcttggagcccagaccctga

SEQ ID NO: 409254 - DNA, 25 bp, Mus musculus
cgtgcgcacgaagggcctcgctgca

SEQ ID NO: 409255 - DNA, 25 bp, Mus musculus
aagggcctcgctgcatccgggctct

SEQ ID NO: 409256 - DNA, 25 bp, Mus musculus
gcatccgggctctccatgctgccgg

SEQ ID NO: 409257 - DNA, 25 bp, Mus musculus
gccagaggcccagagctgcacccta

SEQ ID NO: 409258 - DNA, 25 bp, Mus musculus
agtagggagccaccaggattgattc

SEQ ID NO: 409259 - DNA, 25 bp, Mus musculus
cgatagccggtgtttgctctggcca

SEQ ID NO: 409260 - DNA, 25 bp, Mus musculus
tagtgctgaaaagtgcctggactgc

SEQ ID NO: 409261 - DNA, 25 bp, Mus musculus
tttcataggccgagaggcatagccc

SEQ ID NO: 409262 - DNA, 25 bp, Mus musculus
gttccctgtgacttggcctctgatg

SEQ ID NO: 409263 - DNA, 25 bp, Mus musculus
cacacttgtttggagacagacagac

SEQ ID NO: 409264 - DNA, 25 bp, Mus musculus
gggttgcctgtcatcctcgatagcc

SEQ ID NO: 409265 - DNA, 25 bp, Mus musculus
ggctccctttgctctctgctttctg

SEQ ID NO: 409266 - DNA, 25 bp, Mus musculus
gggaaccagcgagttgcacctcctc

SEQ ID NO: 409267 - DNA, 25 bp, Mus musculus
cagctgggtcctcgctaacaggatg

SEQ ID NO: 409268 - DNA, 25 bp, Mus musculus
ttgtgtctccacagccgcgaaatcg

SEQ ID NO: 409269 - DNA, 25 bp, Mus musculus
cccttgatgccttcgggaattctga

SEQ ID NO: 409270 - DNA, 25 bp, Mus musculus
tgtaggctagacatccaggggcacc

SEQ ID NO: 409271 - DNA, 25 bp, Mus musculus
cgcgtggctaccgagactaatttca

SEQ ID NO: 409272 - DNA, 25 bp, Mus musculus
gggcccatacctgccagcttcagga

SEQ ID NO: 409273 - DNA, 25 bp, Mus musculus
ctctcgaatctaaggttgtcgtttc

SEQ ID NO: 409274 - DNA, 25 bp, Mus musculus
cgctggctcttacacctgtggtctc

SEQ ID NO: 409275 - DNA, 25 bp, Mus musculus
tggtctccaggaagtggccgacttt

SEQ ID NO: 409276 - DNA, 25 bp, Mus musculus
gcgctctccctattggcggaacaga

SEQ ID NO: 409277 - DNA, 25 bp, Mus musculus
cccaatcattggttggttacgcaat

SEQ ID NO: 409278 - DNA, 25 bp, Mus musculus
tggagacgtacaattggtcgccttt

SEQ ID NO: 409279 - DNA, 25 bp, Mus musculus
ggtcgccttttctctcgttaggcca

SEQ ID NO: 409280 - DNA, 25 bp, Mus musculus
ccgccgctgactaatgggaagagcc

SEQ ID NO: 409281 - DNA, 25 bp, Mus musculus
aacagcgattggttggatgagccta

SEQ ID NO: 409282 - DNA, 25 bp, Mus musculus
gctccacaagctgaaggtaccgtta

SEQ ID NO: 409283 - DNA, 25 bp, Mus musculus
tcctggagcctaaattctacgcggg

SEQ ID NO: 409284 - DNA, 25 bp, Mus musculus
tgcgcggccttattccacgtgtttt

SEQ ID NO: 409285 - DNA, 25 bp, Mus musculus
cctggatccacctttttagagagcc

SEQ ID NO: 409286 - DNA, 25 bp, Mus musculus
ttcttctcgcgaacctgcacgacca

SEQ ID NO: 409287 - DNA, 25 bp, Mus musculus
tctttgtgcaaaggctccatggctg

SEQ ID NO: 409288 - DNA, 25 bp, Mus musculus
ttctcaggaggccagtgcgctccgg

SEQ ID NO: 409289 - DNA, 25 bp, Mus musculus
ctgcgggctcctggcagcgcgctat

SEQ ID NO: 409290 - DNA, 25 bp, Mus musculus
tctccaggaaccctgcagccgcccg

SEQ ID NO: 409291 - DNA, 25 bp, Mus musculus
tggctggacgcgctctccaggaacc

SEQ ID NO: 409292 - DNA, 25 bp, Mus musculus
tgcaaaggctccatggctggacgcg

SEQ ID NO: 409293 - DNA, 25 bp, Mus musculus
tttgtgcaaaggctccatggctgga

SEQ ID NO: 409294 - DNA, 25 bp, Mus musculus
tctcggcgtctttgtgcaaaggctc

SEQ ID NO: 409295 - DNA, 25 bp, Mus musculus
cgcggtctcggcgtctttgtgcaaa

SEQ ID NO: 409296 - DNA, 25 bp, Mus musculus
ctggacgacgatgccccccggggat

SEQ ID NO: 409297 - DNA, 25 bp, Mus musculus
gctatgcgcccttctcaggaggcca

SEQ ID NO: 409298 - DNA, 25 bp, Mus musculus
gtgacactctgtgacagcgctccct

SEQ ID NO: 409299 - DNA, 25 bp, Mus musculus
gggcagcgtgacactctgtgacagc

SEQ ID NO: 409300 - DNA, 25 bp, Mus musculus
tgcagcgagagtattcccaaggact

SEQ ID NO: 409301 - DNA, 25 bp, Mus musculus
acctcccaaggacacgtgctgaagc

SEQ ID NO: 409302 - DNA, 25 bp, Mus musculus
aatctatcctgagcggaggcggctc

SEQ ID NO: 409303 - DNA, 25 bp, Mus musculus
accgacacgttagcggagcgcacca

SEQ ID NO: 409304 - DNA, 25 bp, Mus musculus
agaggctttatcgagtggagtacgc

SEQ ID NO: 409305 - DNA, 25 bp, Mus musculus
gggcgcgcctcttgcaagaaatgca

SEQ ID NO: 409306 - DNA, 25 bp, Mus musculus
cccgccgctaggcatcagtaatcta

SEQ ID NO: 409307 - DNA, 25 bp, Mus musculus
gggacattgcgcttaccctgcaaga

SEQ ID NO: 409308 - DNA, 25 bp, Mus musculus
ccgggaagtaagagcatctggcgta

SEQ ID NO: 409309 - DNA, 25 bp, Mus musculus
atctggcgtaagtgcctctggcttt

SEQ ID NO: 409310 - DNA, 25 bp, Mus musculus
tttgtaaagacaaggggcctgcctc

SEQ ID NO: 409311 - DNA, 25 bp, Mus musculus
atttcactgccttctcggcgtcggg

SEQ ID NO: 409312 - DNA, 25 bp, Mus musculus
atggccatcatggtgcaggtgcgac

SEQ ID NO: 409313 - DNA, 25 bp, Mus musculus
ggtcgcagagtttttgtttatttca

SEQ ID NO: 409314 - DNA, 25 bp, Mus musculus
tgcttctgcaggcacttgtgatcgc

SEQ ID NO: 409315 - DNA, 25 bp, Mus musculus
gggcctccgatctgatcctctgacg

SEQ ID NO: 409316 - DNA, 25 bp, Mus musculus
ctcgcccgcccggttatgtaactcg

SEQ ID NO: 409317 - DNA, 25 bp, Mus musculus
tccagcctgtcctgacggagtcggc

SEQ ID NO: 409318 - DNA, 25 bp, Mus musculus
accggggacacagcccctcttggtg

SEQ ID NO: 409319 - DNA, 25 bp, Mus musculus
gagtccagcctgtcctgacggagtc

SEQ ID NO: 409320 - DNA, 25 bp, Mus musculus
cgggagtccagcctgtcctgacgga

SEQ ID NO: 409321 - DNA, 25 bp, Mus musculus
tgctctcccggagcgactgctgtcg

SEQ ID NO: 409322 - DNA, 25 bp, Mus musculus
cttctgcaggcacttgtgatcgctc

SEQ ID NO: 409323 - DNA, 25 bp, Mus musculus
tcctgacggagtcggcggctgctct

SEQ ID NO: 409324 - DNA, 25 bp, Mus musculus
ctctgacggctcctgcttctgcagg

SEQ ID NO: 409325 - DNA, 25 bp, Mus musculus
tctgatcctctgacggctcctgctt

SEQ ID NO: 409326 - DNA, 25 bp, Mus musculus
cgatctgatcctctgacggctcctg

SEQ ID NO: 409327 - DNA, 25 bp, Mus musculus
tctgcaggcacttgtgatcgctccc

SEQ ID NO: 409328 - DNA, 25 bp, Mus musculus
tttggaaagcactgcgtggctgctg

SEQ ID NO: 409329 - DNA, 25 bp, Mus musculus
actggagtcgcggtttggaaagcac

SEQ ID NO: 409330 - DNA, 25 bp, Mus musculus
agctgctccgagctgaacgacgtgc

SEQ ID NO: 409331 - DNA, 25 bp, Mus musculus
gaagacgagctccagcaactgcagc

SEQ ID NO: 409332 - DNA, 25 bp, Mus musculus
agctgcgaccgcgactcacctggat

SEQ ID NO: 409333 - DNA, 25 bp, Mus musculus
aaagcggcgccttctgcgaactgga

SEQ ID NO: 409334 - DNA, 25 bp, Mus musculus
gcctgcagttatagcggcccggagc

SEQ ID NO: 409335 - DNA, 25 bp, Mus musculus
aagccgcgtctcgtctcctcggggt

SEQ ID NO: 409336 - DNA, 25 bp, Mus musculus
tcccgcaagtggatgtctgggtaca

SEQ ID NO: 409337 - DNA, 25 bp, Mus musculus
cagacgccgcgggaataatcgcttc

SEQ ID NO: 409338 - DNA, 25 bp, Mus musculus
ggaataatcgcttccgctgacccgg

SEQ ID NO: 409339 - DNA, 25 bp, Mus musculus
aatccacatacctcgaaccgctttg

SEQ ID NO: 409340 - DNA, 25 bp, Mus musculus
tctgggtacatggtctgtcggaaga

SEQ ID NO: 409341 - DNA, 25 bp, Mus musculus
acctggatcctggactcgggtagca

SEQ ID NO: 409342 - DNA, 25 bp, Mus musculus
ggctgcgcagttccgggtccctctt

SEQ ID NO: 409343 - DNA, 25 bp, Mus musculus
aagaggcgctgatcctccgcggtct

SEQ ID NO: 409344 - DNA, 25 bp, Mus musculus
cctgctctctgctgggtccgcgagg

SEQ ID NO: 409345 - DNA, 25 bp, Mus musculus
tcttgtctgagaatgtagctggcgg

SEQ ID NO: 409346 - DNA, 25 bp, Mus musculus
cgctccgagttctcccagggtgagg

SEQ ID NO: 409347 - DNA, 25 bp, Mus musculus
aggggaggcgctccgagttctccca

SEQ ID NO: 409348 - DNA, 25 bp, Mus musculus
gctggtgatcggctggtgcatcttc

SEQ ID NO: 409349 - DNA, 25 bp, Mus musculus
aacctttaggctgcgcagttccggg

SEQ ID NO: 409350 - DNA, 25 bp, Mus musculus
tatccggaccggaagcgaagatggc

SEQ ID NO: 409351 - DNA, 25 bp, Mus musculus
gccagcttctgtctcttgtctgaga

SEQ ID NO: 409352 - DNA, 25 bp, Mus musculus
ccctttaacctttaggctgcgcagt

SEQ ID NO: 409353 - DNA, 25 bp, Mus musculus
tctccttggcaaccctccgctctgc

SEQ ID NO: 409354 - DNA, 25 bp, Mus musculus
ttcctaacttcagccagcttctgtc

SEQ ID NO: 409355 - DNA, 25 bp, Mus musculus
ctggtgcatcttcggcctcttgctc

SEQ ID NO: 409356 - DNA, 25 bp, Mus musculus
cctgagagacctagaaccctggttt

SEQ ID NO: 409357 - DNA, 25 bp, Mus musculus
tttggcctggaggagctttacggcc

SEQ ID NO: 409358 - DNA, 25 bp, Mus musculus
aacaccgctgcttggggttcacctc

SEQ ID NO: 409359 - DNA, 25 bp, Mus musculus
cagcaggaagtcgatacgtggccgc

SEQ ID NO: 409360 - DNA, 25 bp, Mus musculus
agttttctggtttccacgagctaga

SEQ ID NO: 409361 - DNA, 25 bp, Mus musculus
gtcgctcgacggtctcacgctgagc

SEQ ID NO: 409362 - DNA, 25 bp, Mus musculus
ctggcgctgcgcttctacaaaagtg

SEQ ID NO: 409363 - DNA, 25 bp, Mus musculus
ttctacaaaagtgagcgggtcactc

SEQ ID NO: 409364 - DNA, 25 bp, Mus musculus
cttggtggcaccgagagtttgtcac

SEQ ID NO: 409365 - DNA, 25 bp, Mus musculus
cggggctcctattctgggatggatt

SEQ ID NO: 409366 - DNA, 25 bp, Mus musculus
atgtatcggtttttcacggctcacg

SEQ ID NO: 409367 - DNA, 25 bp, Mus musculus
tcacggctcacgacaacatcgaagc

SEQ ID NO: 409368 - DNA, 25 bp, Mus musculus
tagcagcccgtgtcgcctagttgct

SEQ ID NO: 409369 - DNA, 25 bp, Mus musculus
cgtagagcagctcgaggtgtcgctc

SEQ ID NO: 409370 - DNA, 25 bp, Mus musculus
acccatggagctgtggctcacgaga

SEQ ID NO: 409371 - DNA, 25 bp, Mus musculus
ccgattgccattcctcgggagcgcg

SEQ ID NO: 409372 - DNA, 25 bp, Mus musculus
taaattaggcgttggagccgcgacg

SEQ ID NO: 409373 - DNA, 25 bp, Mus musculus
gctgggctcgccttggtaaattagg

SEQ ID NO: 409374 - DNA, 25 bp, Mus musculus
ctgaggttcattggttggggaccca

SEQ ID NO: 409375 - DNA, 25 bp, Mus musculus
ggcctagcggcctctggtaaccgat

SEQ ID NO: 409376 - DNA, 25 bp, Mus musculus
ggacccacaggagccagggacattt

SEQ ID NO: 409377 - DNA, 25 bp, Mus musculus
agattttcgtcttcgcggtaaatga

SEQ ID NO: 409378 - DNA, 25 bp, Mus musculus
gctgctgccaggaacagcaatatta

SEQ ID NO: 409379 - DNA, 25 bp, Mus musculus
acactaggcggtagaagcagctgca

SEQ ID NO: 409380 - DNA, 25 bp, Mus musculus
ccttgagcatccgagcaggtcctgc

SEQ ID NO: 409381 - DNA, 25 bp, Mus musculus
tcccagctcttggtttgcgccttgg

SEQ ID NO: 409382 - DNA, 25 bp, Mus musculus
ggtaaccgatgcaaggatccctctc

SEQ ID NO: 409383 - DNA, 25 bp, Mus musculus
ggcaggtcacagacaccgtagggca

SEQ ID NO: 409384 - DNA, 25 bp, Mus musculus
ctgaggtcagggcacccgcaggatt

SEQ ID NO: 409385 - DNA, 25 bp, Mus musculus
cttatagggatgcactggagcgatg

SEQ ID NO: 409386 - DNA, 25 bp, Mus musculus
caccacgcagcgaccgggatttgcg

SEQ ID NO: 409387 - DNA, 25 bp, Mus musculus
acacaccacgcagcgaccgggattt

SEQ ID NO: 409388 - DNA, 25 bp, Mus musculus
aggattagccttccgacacaccacg

SEQ ID NO: 409389 - DNA, 25 bp, Mus musculus
gcaggattagccttccgacacacca

SEQ ID NO: 409390 - DNA, 25 bp, Mus musculus
ggcacccgcaggattagccttccga

SEQ ID NO: 409391 - DNA, 25 bp, Mus musculus
aggagcgggaagagccagctccagg

SEQ ID NO: 409392 - DNA, 25 bp, Mus musculus
agtttgcaccggtccccaggacaca

SEQ ID NO: 409393 - DNA, 25 bp, Mus musculus
cacccggagaaccagtttgcaccgg

SEQ ID NO: 409394 - DNA, 25 bp, Mus musculus
aatccacccggagaaccagtttgca

SEQ ID NO: 409395 - DNA, 25 bp, Mus musculus
gctccttccggagggtacaaatcca

SEQ ID NO: 409396 - DNA, 25 bp, Mus musculus
agctccgctccttccggagggtaca

SEQ ID NO: 409397 - DNA, 25 bp, Mus musculus
tcagggcacccgcaggattagcctt

SEQ ID NO: 409398 - DNA, 25 bp, Mus musculus
aagatggctgacaccgaggctttcc

SEQ ID NO: 409399 - DNA, 25 bp, Mus musculus
tggtgaagctcaggcacaactgtgg

SEQ ID NO: 409400 - DNA, 25 bp, Mus musculus
caactgtggagaggcagcaaaaagc

SEQ ID NO: 409401 - DNA, 25 bp, Mus musculus
cagcaaaaagcgagttagcccgggg

SEQ ID NO: 409402 - DNA, 25 bp, Mus musculus
cagttaagaggctcgcgcgggacat

SEQ ID NO: 409403 - DNA, 25 bp, Mus musculus
cagcgggagggatttcaccgaagaa

SEQ ID NO: 409404 - DNA, 25 bp, Mus musculus
ttctgcgccaaaaagtttgcgggtc

SEQ ID NO: 409405 - DNA, 25 bp, Mus musculus
cttctccttcggctggagctcggca

SEQ ID NO: 409406 - DNA, 25 bp, Mus musculus
gtcggtgaccagagaagagagacaa

SEQ ID NO: 409407 - DNA, 25 bp, Mus musculus
tgcgaacacaattgaaagatggctg

SEQ ID NO: 409408 - DNA, 25 bp, Mus musculus
cagccaatcacacacaatggaggga

SEQ ID NO: 409409 - DNA, 25 bp, Mus musculus
ccgcctctcgcggtgtgtacaaaca

SEQ ID NO: 409410 - DNA, 25 bp, Mus musculus
tcggacgcaggcgttaagtgagccc

SEQ ID NO: 409411 - DNA, 25 bp, Mus musculus
cgcggcgaaggctgcgaacacaatt

SEQ ID NO: 409412 - DNA, 25 bp, Mus musculus
tccgtgcgcgatgtgatctaccgac

SEQ ID NO: 409413 - DNA, 25 bp, Mus musculus
cgcagagcgcaaacatgcaaaaata

SEQ ID NO: 409414 - DNA, 25 bp, Mus musculus
ccagaggttccgtcaccagacgaaa

SEQ ID NO: 409415 - DNA, 25 bp, Mus musculus
acgagccgaacgtgatggaaggaac

SEQ ID NO: 409416 - DNA, 25 bp, Mus musculus
acctctagggaactacgcaggccgg

SEQ ID NO: 409417 - DNA, 25 bp, Mus musculus
gccgttctctaggactgggaggcct

SEQ ID NO: 409418 - DNA, 25 bp, Mus musculus
aaatagctgcacaaaccggagtggc

SEQ ID NO: 409419 - DNA, 25 bp, Mus musculus
cagccaaagcgctgtagcccaagcg

SEQ ID NO: 409420 - DNA, 25 bp, Mus musculus
tcgccctttatagccagtcccttga

SEQ ID NO: 409421 - DNA, 25 bp, Mus musculus
atcggcctcaggcaggcctttcctg

SEQ ID NO: 409422 - DNA, 25 bp, Mus musculus
acgaggccttccgtcatcgagatgc

SEQ ID NO: 409423 - DNA, 25 bp, Mus musculus
tagtgcctgtcgcagtccagaggtt

SEQ ID NO: 409424 - DNA, 25 bp, Mus musculus
atctaccgacactgccaggaacagg

SEQ ID NO: 409425 - DNA, 25 bp, Mus musculus
tcatcgagatgcgaccggatggctg

SEQ ID NO: 409426 - DNA, 25 bp, Mus musculus
tcgccttggaagtcgtgcagatcca

SEQ ID NO: 409427 - DNA, 25 bp, Mus musculus
tcaggatctgcgacttgatgctctc

SEQ ID NO: 409428 - DNA, 25 bp, Mus musculus
ttgatgctctctaggcgcagctcgc

SEQ ID NO: 409429 - DNA, 25 bp, Mus musculus
gcgcctccttgagccgcagtttgct

SEQ ID NO: 409430 - DNA, 25 bp, Mus musculus
ctagaacggggcgtgcactcaactc

SEQ ID NO: 409431 - DNA, 25 bp, Mus musculus
gcgccttgggcagcagctgcttcac

SEQ ID NO: 409432 - DNA, 25 bp, Mus musculus
tgcttcactacctcccggctgatgt

SEQ ID NO: 409433 - DNA, 25 bp, Mus musculus
aagtcctcaggctgcagcgcgtcgc

SEQ ID NO: 409434 - DNA, 25 bp, Mus musculus
ttatgaccgtctcggtggtagcgtg

SEQ ID NO: 409435 - DNA, 25 bp, Mus musculus
tctcctgggccatgcttatgaccgt

SEQ ID NO: 409436 - DNA, 25 bp, Mus musculus
tcaagttttcgcagaaagggcttcc

SEQ ID NO: 409437 - DNA, 25 bp, Mus musculus
cccaatccgtcaagttttcgcagaa

SEQ ID NO: 409438 - DNA, 25 bp, Mus musculus
gcagtttgctcaggatctgcgactt

SEQ ID NO: 409439 - DNA, 25 bp, Mus musculus
tcttctccgctcaaaaagttgtgtg

SEQ ID NO: 409440 - DNA, 25 bp, Mus musculus
agttgggaagtgagggactcgccca

SEQ ID NO: 409441 - DNA, 25 bp, Mus musculus
cgacgtgaccgaggccgtgaacttc

SEQ ID NO: 409442 - DNA, 25 bp, Mus musculus
aagtgagggactcgcccatgcaggg

SEQ ID NO: 409443 - DNA, 25 bp, Mus musculus
tgaccgaggccgtgaacttctggca

SEQ ID NO: 409444 - DNA, 25 bp, Mus musculus
ctgtgtctcaggctcgtgtccatcc

SEQ ID NO: 409445 - DNA, 25 bp, Mus musculus
tgtctcaggctcgtgtccatccacg

SEQ ID NO: 409446 - DNA, 25 bp, Mus musculus
tcgtgtccatccacgagagcggctg

SEQ ID NO: 409447 - DNA, 25 bp, Mus musculus
tccatccacgagagcggctggaagg

SEQ ID NO: 409448 - DNA, 25 bp, Mus musculus
ccacgagagcggctggaaggccttc

SEQ ID NO: 409449 - DNA, 25 bp, Mus musculus
gctggaaggccttcgacgtgaccga

SEQ ID NO: 409450 - DNA, 25 bp, Mus musculus
ccttcgacgtgaccgaggccgtgaa

SEQ ID NO: 409451 - DNA, 25 bp, Mus musculus
ggcagcagctgagccggccgaggca

SEQ ID NO: 409452 - DNA, 25 bp, Mus musculus
cgctgctgctccaggtgtcggtgca

SEQ ID NO: 409453 - DNA, 25 bp, Mus musculus
ctcaggctcgtgtccatccacgaga

SEQ ID NO: 409454 - DNA, 25 bp, Mus musculus
agttcatctggtgcatcccggtttg

SEQ ID NO: 409455 - DNA, 25 bp, Mus musculus
ttcatcggcgcaggccagctggcct

SEQ ID NO: 409456 - DNA, 25 bp, Mus musculus
cgcaccagcggagctaacaggttcc

SEQ ID NO: 409457 - DNA, 25 bp, Mus musculus
taacaggttccacccgctgcgcgat

SEQ ID NO: 409458 - DNA, 25 bp, Mus musculus
gcctgacggcgatgccgattggtcc

SEQ ID NO: 409459 - DNA, 25 bp, Mus musculus
acccgagcctcggattggttgcctt

SEQ ID NO: 409460 - DNA, 25 bp, Mus musculus
tggttgccttggacacgtggccaac

SEQ ID NO: 409461 - DNA, 25 bp, Mus musculus
ttggggcctctctagcagttcatct

SEQ ID NO: 409462 - DNA, 25 bp, Mus musculus
tcccggtttgaaagctgttccgagc

SEQ ID NO: 409463 - DNA, 25 bp, Mus musculus
ctgttccgagcaattcgggtccatc

SEQ ID NO: 409464 - DNA, 25 bp, Mus musculus
gggtccatctttttccacgcgcgga

SEQ ID NO: 409465 - DNA, 25 bp, Mus musculus
ctcgccgggatcctgcggccatgag

SEQ ID NO: 409466 - DNA, 25 bp, Mus musculus
ccatgagcgtgggtttcatcggcgc

SEQ ID NO: 409467 - DNA, 25 bp, Mus musculus
ccaaccggaggctgcgtatttggcg

SEQ ID NO: 409468 - DNA, 25 bp, Mus musculus
gcttcgtactgtccgggtgaccact

SEQ ID NO: 409469 - DNA, 25 bp, Mus musculus
gctgggacttcctgacagctcttgg

SEQ ID NO: 409470 - DNA, 25 bp, Mus musculus
tggctggagagtgccaatcaagccc

SEQ ID NO: 409471 - DNA, 25 bp, Mus musculus
taacttttaagtggtgcggacgcca

SEQ ID NO: 409472 - DNA, 25 bp, Mus musculus
gaggagccggagtttcactttgtaa

SEQ ID NO: 409473 - DNA, 25 bp, Mus musculus
cgtggacacagttctgcgcatgtgc

SEQ ID NO: 409474 - DNA, 25 bp, Mus musculus
ccaaattaggtaacgcgtggacaca

SEQ ID NO: 409475 - DNA, 25 bp, Mus musculus
gcctaacccgaagggcagcgtcgga

SEQ ID NO: 409476 - DNA, 25 bp, Mus musculus
ggcgcgagcgaagagtccaaattag

SEQ ID NO: 409477 - DNA, 25 bp, Mus musculus
accacattggggttcactgcccggc

SEQ ID NO: 409478 - DNA, 25 bp, Mus musculus
ggaccagcgttagagaaccacattg

SEQ ID NO: 409479 - DNA, 25 bp, Mus musculus
tagacctccgtgaggacggccacgc

SEQ ID NO: 409480 - DNA, 25 bp, Mus musculus
ggagacgtcctctcccagccttgtg

SEQ ID NO: 409481 - DNA, 25 bp, Mus musculus
tccttacgaggctagacccggcttg

SEQ ID NO: 409482 - DNA, 25 bp, Mus musculus
acgcgtggtccctagcaccggaagt

SEQ ID NO: 409483 - DNA, 25 bp, Mus musculus
tagggaggactacgctgctcacgga

SEQ ID NO: 409484 - DNA, 25 bp, Mus musculus
gctccgcctgtagggaggactacgc

SEQ ID NO: 409485 - DNA, 25 bp, Mus musculus
ccgcaacttttcctcagcacgaaag

SEQ ID NO: 409486 - DNA, 25 bp, Mus musculus
gggaaagactgccacagccgcgctc

SEQ ID NO: 409487 - DNA, 25 bp, Mus musculus
cttgttaccgggaaagactgccaca

SEQ ID NO: 409488 - DNA, 25 bp, Mus musculus
gcacgggcgcctcttgttaccggga

SEQ ID NO: 409489 - DNA, 25 bp, Mus musculus
ccgggtctaggcttcatgatgctgc

SEQ ID NO: 409490 - DNA, 25 bp, Mus musculus
gcacctgaatgacccgctgcttcag

SEQ ID NO: 409491 - DNA, 25 bp, Mus musculus
gagatgcagtgtccgcagacacaca

SEQ ID NO: 409492 - DNA, 25 bp, Mus musculus
cgcaaatggagatgcagtgtccgca

SEQ ID NO: 409493 - DNA, 25 bp, Mus musculus
gcagccgcgcgcaaatggagatgca

SEQ ID NO: 409494 - DNA, 25 bp, Mus musculus
gctgcttcagtttcctgtctacgaa

SEQ ID NO: 409495 - DNA, 25 bp, Mus musculus
tcagcacgaaagctccgcctgtagg

SEQ ID NO: 409496 - DNA, 25 bp, Mus musculus
cgcgagggcacgagatagtaaagct

SEQ ID NO: 409497 - DNA, 25 bp, Mus musculus
accgctgaggctggtcgccaccaag

SEQ ID NO: 409498 - DNA, 25 bp, Mus musculus
gccaccaagtgtaggagaaagtccc

SEQ ID NO: 409499 - DNA, 25 bp, Mus musculus
gaagtaaacgctggactcgatcatc

SEQ ID NO: 409500 - DNA, 25 bp, Mus musculus
ctcgatcatctgtctgctgccattc

SEQ ID NO: 409501 - DNA, 25 bp, Mus musculus
tgctgccattcagagcggacctgcc

SEQ ID NO: 409502 - DNA, 25 bp, Mus musculus
aaaccgatcttttctgcgcctggga

SEQ ID NO: 409503 - DNA, 25 bp, Mus musculus
gctactcaaacccaaacacgtctgg

SEQ ID NO: 409504 - DNA, 25 bp, Mus musculus
cgacgtcgggaagctgtttgaatgc

SEQ ID NO: 409505 - DNA, 25 bp, Mus musculus
cctccctgccaggtactgatggacg

SEQ ID NO: 409506 - DNA, 25 bp, Mus musculus
caacaaacggattggccaagaagcc

SEQ ID NO: 409507 - DNA, 25 bp, Mus musculus
caaaaaagcgctgagaagtggccgg

SEQ ID NO: 409508 - DNA, 25 bp, Mus musculus
cgcctgggaggttttcgcatcctca

SEQ ID NO: 409509 - DNA, 25 bp, Mus musculus
agcaggagccgtttgcttgcttggt

SEQ ID NO: 409510 - DNA, 25 bp, Mus musculus
gcctgaggctttgccgccttctcta

SEQ ID NO: 409511 - DNA, 25 bp, Mus musculus
tcctcgactgttgcgcgctcatctt

SEQ ID NO: 409512 - DNA, 25 bp, Mus musculus
agcgaagccgttcaggggcatagcc

SEQ ID NO: 409513 - DNA, 25 bp, Mus musculus
gccgctcgttcccagggctaccgcc

SEQ ID NO: 409514 - DNA, 25 bp, Mus musculus
cccgaagctggtttgacgggcggag

SEQ ID NO: 409515 - DNA, 25 bp, Mus musculus
gcggaggtggcgtttttggaccaca

SEQ ID NO: 409516 - DNA, 25 bp, Mus musculus
cgtatccttggttgaagcgggccgc

SEQ ID NO: 409517 - DNA, 25 bp, Mus musculus
tgccgcctatcccagcggcgcggcc

SEQ ID NO: 409518 - DNA, 25 bp, Mus musculus
atggaggcggtggtgttcctcttct

SEQ ID NO: 409519 - DNA, 25 bp, Mus musculus
ggtggtgttcctcttctcgctcctc

SEQ ID NO: 409520 - DNA, 25 bp, Mus musculus
atcttcctctccgtctacttcgtat

SEQ ID NO: 409521 - DNA, 25 bp, Mus musculus
ccgtctacttcgtatccttggttga

SEQ ID NO: 409522 - DNA, 25 bp, Mus musculus
ttcgtatccttggttgaagcgggcc

SEQ ID NO: 409523 - DNA, 25 bp, Mus musculus
aactcccggcatgccgcctatccca

SEQ ID NO: 409524 - DNA, 25 bp, Mus musculus
gcctaatgacatcctcatcggactg

SEQ ID NO: 409525 - DNA, 25 bp, Mus musculus
ggaaatgcctatactgccctcctcg

SEQ ID NO: 409526 - DNA, 25 bp, Mus musculus
gctggcgtcacaggaaatgcctata

SEQ ID NO: 409527 - DNA, 25 bp, Mus musculus
cccagctgctgtctaatggagtccg

SEQ ID NO: 409528 - DNA, 25 bp, Mus musculus
cgctccctggtgtgttgattcttcc

SEQ ID NO: 409529 - DNA, 25 bp, Mus musculus
aggccagagtttcctcgccgagaga

SEQ ID NO: 409530 - DNA, 25 bp, Mus musculus
ttctgcgccgacaggcaggcgagct

SEQ ID NO: 409531 - DNA, 25 bp, Mus musculus
tgttgctattgttgccagcggcgga

SEQ ID NO: 409532 - DNA, 25 bp, Mus musculus
tcttcttgaggctgctgcccagctc

SEQ ID NO: 409533 - DNA, 25 bp, Mus musculus
tcatcggactgcgagagccgcttct

SEQ ID NO: 409534 - DNA, 25 bp, Mus musculus
gctgtcctatgagcctaatgacatc

SEQ ID NO: 409535 - DNA, 25 bp, Mus musculus
cttccggcagcaggtatggaaccta

SEQ ID NO: 409536 - DNA, 25 bp, Mus musculus
cccgttattgacactcaggctgttg

SEQ ID NO: 409537 - DNA, 25 bp, Mus musculus
cgagagccgcttcttcttcttgagg

SEQ ID NO: 409538 - DNA, 25 bp, Mus musculus
gccgacgcgttgtcgccatagcctt

SEQ ID NO: 409539 - DNA, 25 bp, Mus musculus
ctcagtgcgcatagctgcgctggga

SEQ ID NO: 409540 - DNA, 25 bp, Mus musculus
atgcatctcagtgcgcatagctgcg

SEQ ID NO: 409541 - DNA, 25 bp, Mus musculus
ggccggatgcatctcagtgcgcata

SEQ ID NO: 409542 - DNA, 25 bp, Mus musculus
ccattcagctgcgagccgctcttgg

SEQ ID NO: 409543 - DNA, 25 bp, Mus musculus
gtcccagcgccgcattcctcgcggc

SEQ ID NO: 409544 - DNA, 25 bp, Mus musculus
ggcgggcgagcaccgcatcttctct

SEQ ID NO: 409545 - DNA, 25 bp, Mus musculus
tttcctacgagaggcgggcgagcac

SEQ ID NO: 409546 - DNA, 25 bp, Mus musculus
cgcaagtttcctacgagaggcgggc

SEQ ID NO: 409547 - DNA, 25 bp, Mus musculus
gggccgcaagtttcctacgagaggc

SEQ ID NO: 409548 - DNA, 25 bp, Mus musculus
gcgcacgtgctcaaagagtccctgc

SEQ ID NO: 409549 - DNA, 25 bp, Mus musculus
cgggcgcacgtgctcaaagagtccc

SEQ ID NO: 409550 - DNA, 25 bp, Mus musculus
cttcccactctctccgggcgcacgt

SEQ ID NO: 409551 - DNA, 25 bp, Mus musculus
cgccatagccttccgccttcccact

SEQ ID NO: 409552 - DNA, 25 bp, Mus musculus
tcacccggctctcggtccgtgtgta

SEQ ID NO: 409553 - DNA, 25 bp, Mus musculus
caggacagtcaccagcagccagcgg

SEQ ID NO: 409554 - DNA, 25 bp, Mus musculus
cagcgcgcactgagtggccctcgaa

SEQ ID NO: 409555 - DNA, 25 bp, Mus musculus
ctgagtggccctcgaagctgctgga

SEQ ID NO: 409556 - DNA, 25 bp, Mus musculus
cgaggtccgctgtcaccgcgcagaa

SEQ ID NO: 409557 - DNA, 25 bp, Mus musculus
tgtcaccgcgcagaagcactcagga

SEQ ID NO: 409558 - DNA, 25 bp, Mus musculus
aagcactcaggaggcccggataggc

SEQ ID NO: 409559 - DNA, 25 bp, Mus musculus
tggtccctcgaccttttgaatcatc

SEQ ID NO: 409560 - DNA, 25 bp, Mus musculus
ccttttgaatcatcgccggcgctgg

SEQ ID NO: 409561 - DNA, 25 bp, Mus musculus
acccggtttatctccgcagcccagg

SEQ ID NO: 409562 - DNA, 25 bp, Mus musculus
ctcctgcggagcgatctaggccggc

SEQ ID NO: 409563 - DNA, 25 bp, Mus musculus
tccgtgtgtaacctcgggagccagc

SEQ ID NO: 409564 - DNA, 25 bp, Mus musculus
aaaagcgtccgctgctgtcacccgg

SEQ ID NO: 409565 - DNA, 25 bp, Mus musculus
tcgcgcgacgccaggcaaaagcgtc

SEQ ID NO: 409566 - DNA, 25 bp, Mus musculus
gcgcgatgcttgatgcagcactaga

SEQ ID NO: 409567 - DNA, 25 bp, Mus musculus
ccgcggcttcgacttttcgtgttgg

SEQ ID NO: 409568 - DNA, 25 bp, Mus musculus
agtcgcctgcgcctgtgcatgcagc

SEQ ID NO: 409569 - DNA, 25 bp, Mus musculus
tgcatgcagcctgcccggggaaacc

SEQ ID NO: 409570 - DNA, 25 bp, Mus musculus
cggggaaaccctagctgtgccagag

SEQ ID NO: 409571 - DNA, 25 bp, Mus musculus
cacgtcacggctattgtggctgtcc

SEQ ID NO: 409572 - DNA, 25 bp, Mus musculus
tggctgtcccggtatataaggtccc

SEQ ID NO: 409573 - DNA, 25 bp, Mus musculus
agcttagcagatctccacttaccga

SEQ ID NO: 409574 - DNA, 25 bp, Mus musculus
gaacatctagagagtcgcgccgcgc

SEQ ID NO: 409575 - DNA, 25 bp, Mus musculus
gttgctgcttctggcactgctccta

SEQ ID NO: 409576 - DNA, 25 bp, Mus musculus
tacccacgcaggtgagaccctgttc

SEQ ID NO: 409577 - DNA, 25 bp, Mus musculus
accctgttctcgattgggcactgga

SEQ ID NO: 409578 - DNA, 25 bp, Mus musculus
ggatcctggcgatccctgccgtgca

SEQ ID NO: 409579 - DNA, 25 bp, Mus musculus
tgcagccggcacttgacaaaaacca

SEQ ID NO: 409580 - DNA, 25 bp, Mus musculus
cggcaggagagtactgagaagcgtc

SEQ ID NO: 409581 - DNA, 25 bp, Mus musculus
tactgagaagcgtcggggagcgcag

SEQ ID NO: 409582 - DNA, 25 bp, Mus musculus
agacggcggctgagccgcggcagga

SEQ ID NO: 409583 - DNA, 25 bp, Mus musculus
gggcaactttgcctcgaagttcgcg

SEQ ID NO: 409584 - DNA, 25 bp, Mus musculus
acgtgggtctgaccgcgggtttctg

SEQ ID NO: 409585 - DNA, 25 bp, Mus musculus
actttgcctcgaagttcgcggggcg

SEQ ID NO: 409586 - DNA, 25 bp, Mus musculus
tgcctcgaagttcgcggggcgccat

SEQ ID NO: 409587 - DNA, 25 bp, Mus musculus
gcggggcgccatccgcgccgcaccc

SEQ ID NO: 409588 - DNA, 25 bp, Mus musculus
gcctgtcgggatcggggatcgggaa

SEQ ID NO: 409589 - DNA, 25 bp, Mus musculus
gggatcgggaatcggcgctgtgcag

SEQ ID NO: 409590 - DNA, 25 bp, Mus musculus
tcccgggatcccgagatcccgaggc

SEQ ID NO: 409591 - DNA, 25 bp, Mus musculus
ccgcgcagggaaggctgcgaaggcc

SEQ ID NO: 409592 - DNA, 25 bp, Mus musculus
gcaactttgcctcgaagttcgcggg

SEQ ID NO: 409593 - DNA, 25 bp, Mus musculus
cgtgcgtcccgggatcccgagatcc

SEQ ID NO: 409594 - DNA, 25 bp, Mus musculus
agcattggacattctgcgctctcgc

SEQ ID NO: 409595 - DNA, 25 bp, Mus musculus
taggaggtgcgcgtgtcgcgcatgc

SEQ ID NO: 409596 - DNA, 25 bp, Mus musculus
ctctcgctcccactccacttgctcc

SEQ ID NO: 409597 - DNA, 25 bp, Mus musculus
acgtgctccctttcctgccgctgcc

SEQ ID NO: 409598 - DNA, 25 bp, Mus musculus
gctccacgtgctccctttcctgccg

SEQ ID NO: 409599 - DNA, 25 bp, Mus musculus
tcccactccacttgctcccgctcca

SEQ ID NO: 409600 - DNA, 25 bp, Mus musculus
attggacattctgcgctctcgctcc

SEQ ID NO: 409601 - DNA, 25 bp, Mus musculus
ccagcattggacattctgcgctctc

SEQ ID NO: 409602 - DNA, 25 bp, Mus musculus
cttaccagcattggacattctgcgc

SEQ ID NO: 409603 - DNA, 25 bp, Mus musculus
ctccttaccagcattggacattctg

SEQ ID NO: 409604 - DNA, 25 bp, Mus musculus
gactccttaccagcattggacattc

SEQ ID NO: 409605 - DNA, 25 bp, Mus musculus
gcagactccttaccagcattggaca

SEQ ID NO: 409606 - DNA, 25 bp, Mus musculus
gcatgcgcgtctgcagactccttac

SEQ ID NO: 409607 - DNA, 25 bp, Mus musculus
gcgcatgcgcgtctgcagactcctt

SEQ ID NO: 409608 - DNA, 25 bp, Mus musculus
gctaacgcatcggtgtcgggaaacg

SEQ ID NO: 409609 - DNA, 25 bp, Mus musculus
acgcgcgcacagtactgggatgact

SEQ ID NO: 409610 - DNA, 25 bp, Mus musculus
gggatgactgcacaaacacacgcgc

SEQ ID NO: 409611 - DNA, 25 bp, Mus musculus
ccgggctacaccatctccgcgcgca

SEQ ID NO: 409612 - DNA, 25 bp, Mus musculus
gtactgggatgactgcacaaacaca

SEQ ID NO: 409613 - DNA, 25 bp, Mus musculus
ggatccggccgacgcgcgcacagta

SEQ ID NO: 409614 - DNA, 25 bp, Mus musculus
cacgcaaaacgtggccatcgtcgtc

SEQ ID NO: 409615 - DNA, 25 bp, Mus musculus
gagagttccgaacacgcaaaacgtg

SEQ ID NO: 409616 - DNA, 25 bp, Mus musculus
cgggatgtaggagagttccgaacac

SEQ ID NO: 409617 - DNA, 25 bp, Mus musculus
cccacccgtgggatgtaggcgggat

SEQ ID NO: 409618 - DNA, 25 bp, Mus musculus
cgccgcgatgtgattccctcccacc

SEQ ID NO: 409619 - DNA, 25 bp, Mus musculus
ggccacggccctttgttgccgccca

SEQ ID NO: 409620 - DNA, 25 bp, Mus musculus
cctcgtccgccgcttcagacgggag

SEQ ID NO: 409621 - DNA, 25 bp, Mus musculus
cacagctaacgcatcggtgtcggga

SEQ ID NO: 409622 - DNA, 25 bp, Mus musculus
tcctgcccattggacaggcgcgcgg

SEQ ID NO: 409623 - DNA, 25 bp, Mus musculus
atctggttggtttacgtgtcgctga

SEQ ID NO: 409624 - DNA, 25 bp, Mus musculus
ggtgccactgtcccttcgtctgctt

SEQ ID NO: 409625 - DNA, 25 bp, Mus musculus
tcgtctgcttccgactgacccggag

SEQ ID NO: 409626 - DNA, 25 bp, Mus musculus
gagacccagtgacccagcgaggcga

SEQ ID NO: 409627 - DNA, 25 bp, Mus musculus
gggagctcctaacttccgctcggga

SEQ ID NO: 409628 - DNA, 25 bp, Mus musculus
acttccgctcgggatctggttggtt

SEQ ID NO: 409629 - DNA, 25 bp, Mus musculus
ttacgtgtcgctgagtgggctcctc

SEQ ID NO: 409630 - DNA, 25 bp, Mus musculus
tgcaccgtcgctttcctgtccgtcg

SEQ ID NO: 409631 - DNA, 25 bp, Mus musculus
gcgcggcctgagcacgcccaggaaa

SEQ ID NO: 409632 - DNA, 25 bp, Mus musculus
caggaaacagtcggcccacccggtg

SEQ ID NO: 409633 - DNA, 25 bp, Mus musculus
ccaatggcgtgagcgctcgtgagcc

SEQ ID NO: 409634 - DNA, 25 bp, Mus musculus
tcctctcccgacctctcagagcgga

SEQ ID NO: 409635 - DNA, 25 bp, Mus musculus
ttctctacccttggcgcggcctgag

SEQ ID NO: 409636 - DNA, 25 bp, Mus musculus
ttcgaactcctctcgggacacgcgg

SEQ ID NO: 409637 - DNA, 25 bp, Mus musculus
gccggtcccgcagatcactggaata

SEQ ID NO: 409638 - DNA, 25 bp, Mus musculus
tcacaggagccatccggtctgggaa

SEQ ID NO: 409639 - DNA, 25 bp, Mus musculus
tctgggaagcctagggtcacccgaa

SEQ ID NO: 409640 - DNA, 25 bp, Mus musculus
tgactggaccacgtgattgaggctc

SEQ ID NO: 409641 - DNA, 25 bp, Mus musculus
tggaccacgccctgagccaagcagg

SEQ ID NO: 409642 - DNA, 25 bp, Mus musculus
tacctggggaccctcagctcacagg

SEQ ID NO: 409643 - DNA, 25 bp, Mus musculus
ggcggaggcctccaacacatgacca

SEQ ID NO: 409644 - DNA, 25 bp, Mus musculus
acatgaccatcgaagggctagcagc

SEQ ID NO: 409645 - DNA, 25 bp, Mus musculus
ccacgcgcacataacggggtccagt

SEQ ID NO: 409646 - DNA, 25 bp, Mus musculus
cggggtccagtcttcacctaagatc

SEQ ID NO: 409647 - DNA, 25 bp, Mus musculus
ggctggtccgtgtagacccattcga

SEQ ID NO: 409648 - DNA, 25 bp, Mus musculus
tcgaggcccggctctagtcgataag

SEQ ID NO: 409649 - DNA, 25 bp, Mus musculus
acctaagatctccttgcgccgggcg

SEQ ID NO: 409650 - DNA, 25 bp, Mus musculus
ttacttctcgcaggcgggcgcgtcc

SEQ ID NO: 409651 - DNA, 25 bp, Mus musculus
cgtcgccagcgccacttcccggctg

SEQ ID NO: 409652 - DNA, 25 bp, Mus musculus
cctcaccaggcggagctggctaatt

SEQ ID NO: 409653 - DNA, 25 bp, Mus musculus
tcagccatccgctcctcagacgccg

SEQ ID NO: 409654 - DNA, 25 bp, Mus musculus
ggcagcgccaccagtgtgttgtttt

SEQ ID NO: 409655 - DNA, 25 bp, Mus musculus
ctggctaatttcgtcgtaggacata

SEQ ID NO: 409656 - DNA, 25 bp, Mus musculus
ctgaggatgttctcgatggctacga

SEQ ID NO: 409657 - DNA, 25 bp, Mus musculus
gacataaagctgaggatgttctcga

SEQ ID NO: 409658 - DNA, 25 bp, Mus musculus
cgctccgttacttctcgcaggcggg

SEQ ID NO: 409659 - DNA, 25 bp, Mus musculus
tcgtcgtaggacataaagctgagga

SEQ ID NO: 409660 - DNA, 25 bp, Mus musculus
cgatggctacgatgggcagcgccac

SEQ ID NO: 409661 - DNA, 25 bp, Mus musculus
ccaggcggagctggctaatttcgtc

SEQ ID NO: 409662 - DNA, 25 bp, Mus musculus
agccggcagccgaacaggagccgcc

SEQ ID NO: 409663 - DNA, 25 bp, Mus musculus
ccaccagtgtgttgttttggggcag

SEQ ID NO: 409664 - DNA, 25 bp, Mus musculus
tcgggtcacttctgctcggccaggc

SEQ ID NO: 409665 - DNA, 25 bp, Mus musculus
ccttctgtcaggaacgtgctccggc

SEQ ID NO: 409666 - DNA, 25 bp, Mus musculus
ttcgaggctctgaggctccgtccct

SEQ ID NO: 409667 - DNA, 25 bp, Mus musculus
gcttccatgcggttcgggtccaaaa

SEQ ID NO: 409668 - DNA, 25 bp, Mus musculus
agacaaagccgcgtcccggagacgg

SEQ ID NO: 409669 - DNA, 25 bp, Mus musculus
ttacctcaagccttggggcgcgccg

SEQ ID NO: 409670 - DNA, 25 bp, Mus musculus
gcatcttcctccctcggagcaaagg

SEQ ID NO: 409671 - DNA, 25 bp, Mus musculus
acgattattgttctcctgcggcgcc

SEQ ID NO: 409672 - DNA, 25 bp, Mus musculus
aaccgccaaggaggtgagggacaca

SEQ ID NO: 409673 - DNA, 25 bp, Mus musculus
tctcttgagcaactcggaaccgcca

SEQ ID NO: 409674 - DNA, 25 bp, Mus musculus
taaggcaaagggctcaactctcttg

SEQ ID NO: 409675 - DNA, 25 bp, Mus musculus
gctggttcatggttcctaaggcaaa

SEQ ID NO: 409676 - DNA, 25 bp, Mus musculus
cggactcgcaggtctccatcttgtg

SEQ ID NO: 409677 - DNA, 25 bp, Mus musculus
cgggtccaaaatgatgccggtaagc

SEQ ID NO: 409678 - DNA, 25 bp, Mus musculus
aacccggagtagtccgcgacgcctg

SEQ ID NO: 409679 - DNA, 25 bp, Mus musculus
aaagcgcgcgatccgcagcctcaga

SEQ ID NO: 409680 - DNA, 25 bp, Mus musculus
ggggaacacacgctggttgctacgc

SEQ ID NO: 409681 - DNA, 25 bp, Mus musculus
tggaacccggagtagtccgcgacgc

SEQ ID NO: 409682 - DNA, 25 bp, Mus musculus
acagagacccggcacgctcgcgggc

SEQ ID NO: 409683 - DNA, 25 bp, Mus musculus
gaggccgaacggcccgggaatatca

SEQ ID NO: 409684 - DNA, 25 bp, Mus musculus
cccgggaatatcaggcggccgctgc

SEQ ID NO: 409685 - DNA, 25 bp, Mus musculus
ctgccaccggcagccagaggaagat

SEQ ID NO: 409686 - DNA, 25 bp, Mus musculus
cagtcgctgcttccctgagcccggg

SEQ ID NO: 409687 - DNA, 25 bp, Mus musculus
agagcccgcagccatcggcttgcgg

SEQ ID NO: 409688 - DNA, 25 bp, Mus musculus
gtcacgtgacgccactgtttaccgt

SEQ ID NO: 409689 - DNA, 25 bp, Mus musculus
cctctgcggccgagcggggaacaca

SEQ ID NO: 409690 - DNA, 25 bp, Mus musculus
cgtgacgccactgtttaccgttccg

SEQ ID NO: 409691 - DNA, 25 bp, Mus musculus
ccaccggcagccagaggaagatgga

SEQ ID NO: 409692 - DNA, 25 bp, Mus musculus
taccgtgggccgcttccattcgatg

SEQ ID NO: 409693 - DNA, 25 bp, Mus musculus
ccggttggcgcactgcacggagaaa

SEQ ID NO: 409694 - DNA, 25 bp, Mus musculus
atgcccgccatggtagcgatccggt

SEQ ID NO: 409695 - DNA, 25 bp, Mus musculus
tccttggccagctttatcgcgatgc

SEQ ID NO: 409696 - DNA, 25 bp, Mus musculus
ggtacttgatggctctctcatgcga

SEQ ID NO: 409697 - DNA, 25 bp, Mus musculus
ctcgtagtcctggttgaggtacttg

SEQ ID NO: 409698 - DNA, 25 bp, Mus musculus
gcactcgttccgcagcgtctcgtag

SEQ ID NO: 409699 - DNA, 25 bp, Mus musculus
gcggagcactactaagcagggacta

SEQ ID NO: 409700 - DNA, 25 bp, Mus musculus
ctccttatagcccaaggatgacggc

SEQ ID NO: 409701 - DNA, 25 bp, Mus musculus
gccagggacttgcagcctcccggaa

SEQ ID NO: 409702 - DNA, 25 bp, Mus musculus
ctgtccagaaaacatcggatgagtc

SEQ ID NO: 409703 - DNA, 25 bp, Mus musculus
gatgctgccaccttcggacggctct

SEQ ID NO: 409704 - DNA, 25 bp, Mus musculus
aaggaaggatcctggaagagcgccc

SEQ ID NO: 409705 - DNA, 25 bp, Mus musculus
agtgccagcccgaccgtgaggacta

SEQ ID NO: 409706 - DNA, 25 bp, Mus musculus
gcatacgcgtatgcgcgtgtgtgaa

SEQ ID NO: 409707 - DNA, 25 bp, Mus musculus
tgcctgggtatgtgtgcgtgcatac

SEQ ID NO: 409708 - DNA, 25 bp, Mus musculus
atcgcggcgcagacctgcggtgtgt

SEQ ID NO: 409709 - DNA, 25 bp, Mus musculus
ccagaggccactggtgaaggatcgc

SEQ ID NO: 409710 - DNA, 25 bp, Mus musculus
ctccagaggccactggtgaaggatc

SEQ ID NO: 409711 - DNA, 25 bp, Mus musculus
ctaagggctccagaggccactggtg

SEQ ID NO: 409712 - DNA, 25 bp, Mus musculus
cacacacggggctaagggctccaga

SEQ ID NO: 409713 - DNA, 25 bp, Mus musculus
agcccggcagccgtggccctcgtca

SEQ ID NO: 409714 - DNA, 25 bp, Mus musculus
atgtgtgcgtgcatacgcgtatgcg

SEQ ID NO: 409715 - DNA, 25 bp, Mus musculus
gcctggcgactcgtgcccgacaggt

SEQ ID NO: 409716 - DNA, 25 bp, Mus musculus
cgactcgtgcccgacaggtgcaggc

SEQ ID NO: 409717 - DNA, 25 bp, Mus musculus
gcgccggcttcccattggccacggc

SEQ ID NO: 409718 - DNA, 25 bp, Mus musculus
cgctcccgagctcaggtagcgggcg

SEQ ID NO: 409719 - DNA, 25 bp, Mus musculus
cctgggtatgtgtgcgtgcatacgc

SEQ ID NO: 409720 - DNA, 25 bp, Mus musculus
cgctcattctggctgttcaacccga

SEQ ID NO: 409721 - DNA, 25 bp, Mus musculus
tgggcccttccatgctcctcaagcg

SEQ ID NO: 409722 - DNA, 25 bp, Mus musculus
tgttcaacccgagctctggctcctt

SEQ ID NO: 409723 - DNA, 25 bp, Mus musculus
agtcgggctcctgagaacaggttgg

SEQ ID NO: 409724 - DNA, 25 bp, Mus musculus
ccttcgggatcggagtcgggctcct

SEQ ID NO: 409725 - DNA, 25 bp, Mus musculus
agtagctctccggagtgccgccttc

SEQ ID NO: 409726 - DNA, 25 bp, Mus musculus
ctcctccgagtagctctccggagtg

SEQ ID NO: 409727 - DNA, 25 bp, Mus musculus
ggcgcccacgctgcccttcaacacc

SEQ ID NO: 409728 - DNA, 25 bp, Mus musculus
cgggctccaaaacatcgcacagggg

SEQ ID NO: 409729 - DNA, 25 bp, Mus musculus
atggactgcgggctccaaaacatcg

SEQ ID NO: 409730 - DNA, 25 bp, Mus musculus
aggctggcgctccttggctcgccga

SEQ ID NO: 409731 - DNA, 25 bp, Mus musculus
cgccggcgcttgctgttccaggctg

SEQ ID NO: 409732 - DNA, 25 bp, Mus musculus
tctggctgttcaacccgagctctgg

SEQ ID NO: 409733 - DNA, 25 bp, Mus musculus
ctcaagcgccgctcattctggctgt

SEQ ID NO: 409734 - DNA, 25 bp, Mus musculus
gttctttgagcaggcgggacagcat

SEQ ID NO: 409735 - DNA, 25 bp, Mus musculus
ccctctccttgatctgggaggttac

SEQ ID NO: 409736 - DNA, 25 bp, Mus musculus
gacggagtttccagaagtgccgccc

SEQ ID NO: 409737 - DNA, 25 bp, Mus musculus
tccttgatctgggaggttacccgag

SEQ ID NO: 409738 - DNA, 25 bp, Mus musculus
aggttacccgaggtccaggcctctg

SEQ ID NO: 409739 - DNA, 25 bp, Mus musculus
tccaggcctctggaagaagctaggc

SEQ ID NO: 409740 - DNA, 25 bp, Mus musculus
cctgcagctccttgcgttcgttctg

SEQ ID NO: 409741 - DNA, 25 bp, Mus musculus
ctgcttggcttggtgttctttgagc

SEQ ID NO: 409742 - DNA, 25 bp, Mus musculus
aggcgtcacgtgatcgcagtatcac

SEQ ID NO: 409743 - DNA, 25 bp, Mus musculus
ccctccctaaggctgcaggaactgg

SEQ ID NO: 409744 - DNA, 25 bp, Mus musculus
gctgcaggaactggactatgccttg

SEQ ID NO: 409745 - DNA, 25 bp, Mus musculus
ggactatgccttggctcacccggaa

SEQ ID NO: 409746 - DNA, 25 bp, Mus musculus
gctcacccggaaggcgtcacgtgat

SEQ ID NO: 409747 - DNA, 25 bp, Mus musculus
tccttgcgttcgttctgcttggctt

SEQ ID NO: 409748 - DNA, 25 bp, Mus musculus
aatgacatcaccacccgcgcgaaga

SEQ ID NO: 409749 - DNA, 25 bp, Mus musculus
ccgggctagcacttttaagaatttg

SEQ ID NO: 409750 - DNA, 25 bp, Mus musculus
gaagaaccagtttcagccggagcga

SEQ ID NO: 409751 - DNA, 25 bp, Mus musculus
cggagcgaccagagcaagccattga

SEQ ID NO: 409752 - DNA, 25 bp, Mus musculus
agccattgacacttcagtcccagga

SEQ ID NO: 409753 - DNA, 25 bp, Mus musculus
aggaagggttaaccgcgtcctgctg

SEQ ID NO: 409754 - DNA, 25 bp, Mus musculus
gtcctgctgcctaggtttacatgta

SEQ ID NO: 409755 - DNA, 25 bp, Mus musculus
gaagcacaccaaacccactagcggg

SEQ ID NO: 409756 - DNA, 25 bp, Mus musculus
tggtcagagaccactgtgatgtagc

SEQ ID NO: 409757 - DNA, 25 bp, Mus musculus
ctctgggtcttcattggcgtatcgc

SEQ ID NO: 409758 - DNA, 25 bp, Mus musculus
ccaaagcttacatttacgctgtagc

SEQ ID NO: 409759 - DNA, 25 bp, Mus musculus
taactctgtgttgctgctggggatc

SEQ ID NO: 409760 - DNA, 25 bp, Mus musculus
ctggggatcaatgaagctgagtgaa

SEQ ID NO: 409761 - DNA, 25 bp, Mus musculus
ttacatgtaaatagagagccgctgc

SEQ ID NO: 409762 - DNA, 25 bp, Mus musculus
tggccatttcttcccgcactagtaa

SEQ ID NO: 409763 - DNA, 25 bp, Mus musculus
gaacgcggtagcagcgttagaactc

SEQ ID NO: 409764 - DNA, 25 bp, Mus musculus
aacggagagctcagctccttggaca

SEQ ID NO: 409765 - DNA, 25 bp, Mus musculus
gtctagccgctgcaagaacgcggta

SEQ ID NO: 409766 - DNA, 25 bp, Mus musculus
ttcttcccgcactagtaactgcagc

SEQ ID NO: 409767 - DNA, 25 bp, Mus musculus
agctctcagcgctggccatttcttc

SEQ ID NO: 409768 - DNA, 25 bp, Mus musculus
cgttagaactctgcgcgttgcctgc

SEQ ID NO: 409769 - DNA, 25 bp, Mus musculus
ctgaagatcccagcgcctcgacttt

SEQ ID NO: 409770 - DNA, 25 bp, Mus musculus
tccttggacaacgtccggaggtggc

SEQ ID NO: 409771 - DNA, 25 bp, Mus musculus
ggcagggcttgtacagctgtctagc

SEQ ID NO: 409772 - DNA, 25 bp, Mus musculus
cagcttgcggcctgaagatcccagc

SEQ ID NO: 409773 - DNA, 25 bp, Mus musculus
tctggagccagaaagtatacacaca

SEQ ID NO: 409774 - DNA, 25 bp, Mus musculus
gcgcctcgactttctggtgcacaca

SEQ ID NO: 409775 - DNA, 25 bp, Mus musculus
tctggtgcacacagctctggagcca

SEQ ID NO: 409776 - DNA, 25 bp, Mus musculus
gctgaggccttgatgaccgtggttt

SEQ ID NO: 409777 - DNA, 25 bp, Mus musculus
tggggctcctctcctcccgttcacc

SEQ ID NO: 409778 - DNA, 25 bp, Mus musculus
accgtggtttgatgcagggacctct

SEQ ID NO: 409779 - DNA, 25 bp, Mus musculus
gtttgatgcagggacctctccgttc

SEQ ID NO: 409780 - DNA, 25 bp, Mus musculus
tgatgcagggacctctccgttccct

SEQ ID NO: 409781 - DNA, 25 bp, Mus musculus
cctcagtccgttccgtgtcgctggg

SEQ ID NO: 409782 - DNA, 25 bp, Mus musculus
gtccagggactccgagtcactgctc

SEQ ID NO: 409783 - DNA, 25 bp, Mus musculus
ttcgccctcagaacggctggggctc

SEQ ID NO: 409784 - DNA, 25 bp, Mus musculus
gggactccgccggaaggcttctcgc

SEQ ID NO: 409785 - DNA, 25 bp, Mus musculus
gaaggcttctcgcccgcttccttgt

SEQ ID NO: 409786 - DNA, 25 bp, Mus musculus
ccttgtccttgtccttctgcgcctg

SEQ ID NO: 409787 - DNA, 25 bp, Mus musculus
cgcctccttagagtgccgccacttc

SEQ ID NO: 409788 - DNA, 25 bp, Mus musculus
tcggcttcgccctcagaacggctgg

SEQ ID NO: 409789 - DNA, 25 bp, Mus musculus
gccttgatgaccgtggtttgatgca

SEQ ID NO: 409790 - DNA, 25 bp, Mus musculus
tctgctactccgcagaagccgggga

SEQ ID NO: 409791 - DNA, 25 bp, Mus musculus
ggtttcttgacagcggctgggtcca

SEQ ID NO: 409792 - DNA, 25 bp, Mus musculus
ggcggctgaccagagactaaagttg

SEQ ID NO: 409793 - DNA, 25 bp, Mus musculus
cggctgcgaacatcctggcaggatc

SEQ ID NO: 409794 - DNA, 25 bp, Mus musculus
gagctgctttcggttcttcgcccgc

SEQ ID NO: 409795 - DNA, 25 bp, Mus musculus
tttggcaggagctttcgagtcagac

SEQ ID NO: 409796 - DNA, 25 bp, Mus musculus
accttgatccgtgcgctcattggac

SEQ ID NO: 409797 - DNA, 25 bp, Mus musculus
cgctcattggacgtcttcgtgacca

SEQ ID NO: 409798 - DNA, 25 bp, Mus musculus
ttcgtgaccaatgggactccggagt

SEQ ID NO: 409799 - DNA, 25 bp, Mus musculus
cctggccacgccaaagtgttttctg

SEQ ID NO: 409800 - DNA, 25 bp, Mus musculus
ccaaagtgttttctgcggcagcgtg

SEQ ID NO: 409801 - DNA, 25 bp, Mus musculus
cagcgtgggctaagctgagtactga

SEQ ID NO: 409802 - DNA, 25 bp, Mus musculus
tgagtactgagcgtctctgggagcc

SEQ ID NO: 409803 - DNA, 25 bp, Mus musculus
gtccgcgatgcagaaagagggtttc

SEQ ID NO: 409804 - DNA, 25 bp, Mus musculus
gcgcacgacgccaggccactgtccc

SEQ ID NO: 409805 - DNA, 25 bp, Mus musculus
cagcctaggtcagcgtggtgatgct

SEQ ID NO: 409806 - DNA, 25 bp, Mus musculus
acccacacagcctaggtcagcgtgg

SEQ ID NO: 409807 - DNA, 25 bp, Mus musculus
gtgatgctcggtgctcagcgtacct

SEQ ID NO: 409808 - DNA, 25 bp, Mus musculus
tcggtgctcagcgtacctgtcgcgc

SEQ ID NO: 409809 - DNA, 25 bp, Mus musculus
atggcagtgcactctgcctcgctca

SEQ ID NO: 409810 - DNA, 25 bp, Mus musculus
ggacttgattgggtagatccagagc

SEQ ID NO: 409811 - DNA, 25 bp, Mus musculus
accgttcccacttgctgtagccgcc

SEQ ID NO: 409812 - DNA, 25 bp, Mus musculus
atgagcgcttgatacacctccggcg

SEQ ID NO: 409813 - DNA, 25 bp, Mus musculus
cccgaaacgcggagaagccgaagag

SEQ ID NO: 409814 - DNA, 25 bp, Mus musculus
agaagccgaagagggtcagcgccca

SEQ ID NO: 409815 - DNA, 25 bp, Mus musculus
cccgcacccatgactggagagggcg

SEQ ID NO: 409816 - DNA, 25 bp, Mus musculus
gcgggatgagcgcttgatacacctc

SEQ ID NO: 409817 - DNA, 25 bp, Mus musculus
attgggtagatccagagctgtgcca

SEQ ID NO: 409818 - DNA, 25 bp, Mus musculus
gtacctgtcgcgcactttgccacag

SEQ ID NO: 409819 - DNA, 25 bp, Mus musculus
acgtccagatcagtgtcggcggagc

SEQ ID NO: 409820 - DNA, 25 bp, Mus musculus
tgctgctcacgtccagatcagtgtc

SEQ ID NO: 409821 - DNA, 25 bp, Mus musculus
ctgtcaaacttatgctgctcacgtc

SEQ ID NO: 409822 - DNA, 25 bp, Mus musculus
agccgcactgcctgtcaaacttatg

SEQ ID NO: 409823 - DNA, 25 bp, Mus musculus
catgttacactatcccgggcaggcc

SEQ ID NO: 409824 - DNA, 25 bp, Mus musculus
ggaggaacccatgttacactatccc

SEQ ID NO: 409825 - DNA, 25 bp, Mus musculus
cgaggcgagccagagccgtagagct

SEQ ID NO: 409826 - DNA, 25 bp, Mus musculus
acgcgtgcgacgccaagctacggtc

SEQ ID NO: 409827 - DNA, 25 bp, Mus musculus
tagatccaaaccttcgacaccgtgc

SEQ ID NO: 409828 - DNA, 25 bp, Mus musculus
cttgatcgggtagatccaaaccttc

SEQ ID NO: 409829 - DNA, 25 bp, Mus musculus
atgtccgtgcactcggtctcacaca

SEQ ID NO: 409830 - DNA, 25 bp, Mus musculus
tgtcgcgcactttgccacagcgcag

SEQ ID NO: 409831 - DNA, 25 bp, Mus musculus
tcagtgtcggcggagcctggcccac

SEQ ID NO: 409832 - DNA, 25 bp, Mus musculus
ctcctagtgatggtcccggaggcca

SEQ ID NO: 409833 - DNA, 25 bp, Mus musculus
cagcacacccatgcggtggggtcca

SEQ ID NO: 409834 - DNA, 25 bp, Mus musculus
cagctacacaccctcctagtgatgg

SEQ ID NO: 409835 - DNA, 25 bp, Mus musculus
gggatgcgggcacaactccacccag

SEQ ID NO: 409836 - DNA, 25 bp, Mus musculus
gcgactcccggttctgtctggatca

SEQ ID NO: 409837 - DNA, 25 bp, Mus musculus
tgccgtacttcttcagttttcgccg

SEQ ID NO: 409838 - DNA, 25 bp, Mus musculus
cggtacctcttcttgggcttgtcgc

SEQ ID NO: 409839 - DNA, 25 bp, Mus musculus
agcgcagccaggtgcaccctgcgtg

SEQ ID NO: 409840 - DNA, 25 bp, Mus musculus
tccaggtgctccacgatggcatctg

SEQ ID NO: 409841 - DNA, 25 bp, Mus musculus
atggcatctgtctcctcgtcaccgg

SEQ ID NO: 409842 - DNA, 25 bp, Mus musculus
gggcccaggctatgaggcaaccttt

SEQ ID NO: 409843 - DNA, 25 bp, Mus musculus
atgaggcaacctttgctccacgctc

SEQ ID NO: 409844 - DNA, 25 bp, Mus musculus
tccgggaaccagaggtcgcagcaca

SEQ ID NO: 409845 - DNA, 25 bp, Mus musculus
ctcctccagggagtcgtagcgctca

SEQ ID NO: 409846 - DNA, 25 bp, Mus musculus
cgcacagtcgcgaggtccgcaatca

SEQ ID NO: 409847 - DNA, 25 bp, Mus musculus
accagacgaccatgcagtgagctgc

SEQ ID NO: 409848 - DNA, 25 bp, Mus musculus
gccgccaccggtgcgaaccggttga

SEQ ID NO: 409849 - DNA, 25 bp, Mus musculus
aaacgctccggtcgctagagccgcg

SEQ ID NO: 409850 - DNA, 25 bp, Mus musculus
agagccgcgagttcgcctcaacttg

SEQ ID NO: 409851 - DNA, 25 bp, Mus musculus
ctactcattgaagattgtggcctaa

SEQ ID NO: 409852 - DNA, 25 bp, Mus musculus
cgcggtactcacaggaatatgtcta

SEQ ID NO: 409853 - DNA, 25 bp, Mus musculus
ctcggtcgctcgctctaacaaaggc

SEQ ID NO: 409854 - DNA, 25 bp, Mus musculus
tcgctcaacaggagccgcgcagttc

SEQ ID NO: 409855 - DNA, 25 bp, Mus musculus
ggtccgcaatcacgggttcacggtg

SEQ ID NO: 409856 - DNA, 25 bp, Mus musculus
cctgttgctccagcccaagagcgga

SEQ ID NO: 409857 - DNA, 25 bp, Mus musculus
gcctaatcatacagccggtcccgag

SEQ ID NO: 409858 - DNA, 25 bp, Mus musculus
cgcgcggcttctcggaacaaaggcc

SEQ ID NO: 409859 - DNA, 25 bp, Mus musculus
tggaaatttcagctcgccagcggtg

SEQ ID NO: 409860 - DNA, 25 bp, Mus musculus
ttaaccacaccaggctcaacgaaca

SEQ ID NO: 409861 - DNA, 25 bp, Mus musculus
tactactgagttcaataaagtttca

SEQ ID NO: 409862 - DNA, 25 bp, Mus musculus
tttttatgaatatactactgagttc

SEQ ID NO: 409863 - DNA, 25 bp, Mus musculus
ggctcaacgaacatttctggtcctc

SEQ ID NO: 409864 - DNA, 25 bp, Mus musculus
cccagttacattctgaagagaaaaa

SEQ ID NO: 409865 - DNA, 25 bp, Mus musculus
gaaaaatgccaagtcgactcttaag

SEQ ID NO: 409866 - DNA, 25 bp, Mus musculus
cgactcttaagatacctcatgttca

SEQ ID NO: 409867 - DNA, 25 bp, Mus musculus
gatacctcatgttcagctcacacaa

SEQ ID NO: 409868 - DNA, 25 bp, Mus musculus
cagcacctgcccttccttaaccaca

SEQ ID NO: 409869 - DNA, 25 bp, Mus musculus
tctggtcctcctattgctatttgta

SEQ ID NO: 409870 - DNA, 25 bp, Mus musculus
actcaactacgtggcaactgtatac

SEQ ID NO: 409871 - DNA, 25 bp, Mus musculus
cccagaccttaaactcaactacgtg

SEQ ID NO: 409872 - DNA, 25 bp, Mus musculus
gctatttgtaacaaggtacttatta

SEQ ID NO: 409873 - DNA, 25 bp, Mus musculus
ggtcctcctattgctatttgtaaca

SEQ ID NO: 409874 - DNA, 25 bp, Mus musculus
aagctttcggggctccgtgctgtca

SEQ ID NO: 409875 - DNA, 25 bp, Mus musculus
gacaagctcgcccaagaaagaatgc

SEQ ID NO: 409876 - DNA, 25 bp, Mus musculus
cccaagaaagaatgcggccaggctc

SEQ ID NO: 409877 - DNA, 25 bp, Mus musculus
atgcggccaggctccacgtctaact

SEQ ID NO: 409878 - DNA, 25 bp, Mus musculus
tccgccacaagaccgcgagtcacgt

SEQ ID NO: 409879 - DNA, 25 bp, Mus musculus
cgagtcacgtgtccgaagctgcacc

SEQ ID NO: 409880 - DNA, 25 bp, Mus musculus
ccctcgcgaggagtgctgacagctt

SEQ ID NO: 409881 - DNA, 25 bp, Mus musculus
gcgcgacttcctattccctcacctg

SEQ ID NO: 409882 - DNA, 25 bp, Mus musculus
tccgtgctgtcagccttcgggtgga

SEQ ID NO: 409883 - DNA, 25 bp, Mus musculus
gccatggcctgctccatcgtccagt

SEQ ID NO: 409884 - DNA, 25 bp, Mus musculus
aggacctgcagtccgcgcgcgactt

SEQ ID NO: 409885 - DNA, 25 bp, Mus musculus
ctgaagagggacccgagtaagtgtc

SEQ ID NO: 409886 - DNA, 25 bp, Mus musculus
gtagctgaagctttcggggctccgt

SEQ ID NO: 409887 - DNA, 25 bp, Mus musculus
tgctgacagcttccggtctggcgtc

SEQ ID NO: 409888 - DNA, 25 bp, Mus musculus
ttgcgcctgagtctatctgctgctg

SEQ ID NO: 409889 - DNA, 25 bp, Mus musculus
acccggcagcctattcggcttttcg

SEQ ID NO: 409890 - DNA, 25 bp, Mus musculus
caatctggatgtgatgggtgccata

SEQ ID NO: 409891 - DNA, 25 bp, Mus musculus
ccggctatcgccttcaatctggatg

SEQ ID NO: 409892 - DNA, 25 bp, Mus musculus
ggactgttcttaccaccggctatcg

SEQ ID NO: 409893 - DNA, 25 bp, Mus musculus
tacttccttgctcgctggactgttc

SEQ ID NO: 409894 - DNA, 25 bp, Mus musculus
ccaggattccgaggtgcgattttct

SEQ ID NO: 409895 - DNA, 25 bp, Mus musculus
agcgttgatcccatggccaggattc

SEQ ID NO: 409896 - DNA, 25 bp, Mus musculus
ctcgcactagctgggagagcgttga

SEQ ID NO: 409897 - DNA, 25 bp, Mus musculus
ggcgcgcgacgatttcctcgcacta

SEQ ID NO: 409898 - DNA, 25 bp, Mus musculus
ttggaagacccggaaagatcagcta

SEQ ID NO: 409899 - DNA, 25 bp, Mus musculus
agtagttgtacttagctggtcctgg

SEQ ID NO: 409900 - DNA, 25 bp, Mus musculus
gctcccaaggcgtgcagtagttgta

SEQ ID NO: 409901 - DNA, 25 bp, Mus musculus
ggtggccctgcaccgacaattacag

SEQ ID NO: 409902 - DNA, 25 bp, Mus musculus
agacccttgaagagctcggcggcga

SEQ ID NO: 409903 - DNA, 25 bp, Mus musculus
ctaaaggtagagacccttgaagagc

SEQ ID NO: 409904 - DNA, 25 bp, Mus musculus
ccagacaccctaggcggctgggcaa

SEQ ID NO: 409905 - DNA, 25 bp, Mus musculus
ggccacggatcgtaccacgagcctc

SEQ ID NO: 409906 - DNA, 25 bp, Mus musculus
tatctgccgcctttcgagctgctct

SEQ ID NO: 409907 - DNA, 25 bp, Mus musculus
ccgtgtcacggtatctgccgccttt

SEQ ID NO: 409908 - DNA, 25 bp, Mus musculus
ttcatcgggaagctggtctgcggca

SEQ ID NO: 409909 - DNA, 25 bp, Mus musculus
gcggcccagcagcttcatcgggaag

SEQ ID NO: 409910 - DNA, 25 bp, Mus musculus
atgtcggactgctggcggcccagca

SEQ ID NO: 409911 - DNA, 25 bp, Mus musculus
ggatctccagctccatgtcggactg

SEQ ID NO: 409912 - DNA, 25 bp, Mus musculus
cgtccggtacctgctggatctccag

SEQ ID NO: 409913 - DNA, 25 bp, Mus musculus
gtctgcggcagcagcaccgtgtcac

SEQ ID NO: 409914 - DNA, 25 bp, Mus musculus
cccagaagctcccagccgcggcgac

SEQ ID NO: 409915 - DNA, 25 bp, Mus musculus
cggcctgcagggttcccgcagagct

SEQ ID NO: 409916 - DNA, 25 bp, Mus musculus
tctgcgttatactggggagtcggaa

SEQ ID NO: 409917 - DNA, 25 bp, Mus musculus
cgaagctgaccatcataggggaaga

SEQ ID NO: 409918 - DNA, 25 bp, Mus musculus
tggcccggaagttcccgaagctgac

SEQ ID NO: 409919 - DNA, 25 bp, Mus musculus
agcatatgctcttccctggcccgga

SEQ ID NO: 409920 - DNA, 25 bp, Mus musculus
cgaccgcttggtgcagatgagcata

SEQ ID NO: 409921 - DNA, 25 bp, Mus musculus
ctgcagaccaaagccgaccgcttgg

SEQ ID NO: 409922 - DNA, 25 bp, Mus musculus
cttggttacagacctcggccaccga

SEQ ID NO: 409923 - DNA, 25 bp, Mus musculus
cccgatttgtactgatacggagatt

SEQ ID NO: 409924 - DNA, 25 bp, Mus musculus
ggattcataccctacctgccattga

SEQ ID NO: 409925 - DNA, 25 bp, Mus musculus
gagccgtaggttatggtcagtctta

SEQ ID NO: 409926 - DNA, 25 bp, Mus musculus
acggagatttgcattcttggttaca

SEQ ID NO: 409927 - DNA, 25 bp, Mus musculus
ggcactaacgttccaacacaaagcg

SEQ ID NO: 409928 - DNA, 25 bp, Mus musculus
gtcagtcttagcgttggcactaacg

SEQ ID NO: 409929 - DNA, 25 bp, Mus musculus
aggcgcgcgccacttggattcatac

SEQ ID NO: 409930 - DNA, 25 bp, Mus musculus
cgacgcacggcgattacgttcaata

SEQ ID NO: 409931 - DNA, 25 bp, Mus musculus
tgcctcacggtgaacgccggaaacc

SEQ ID NO: 409932 - DNA, 25 bp, Mus musculus
acgagtagaccgcagctcctgggag

SEQ ID NO: 409933 - DNA, 25 bp, Mus musculus
cgccaggaaggcagcccgacgagta

SEQ ID NO: 409934 - DNA, 25 bp, Mus musculus
gcgcacacgttgcatctccttgctt

SEQ ID NO: 409935 - DNA, 25 bp, Mus musculus
ggtgccttcggtcgcgcgcacacgt

SEQ ID NO: 409936 - DNA, 25 bp, Mus musculus
ttatgacgtgtcgtagcgtgcgcac

SEQ ID NO: 409937 - DNA, 25 bp, Mus musculus
ccttggcgggcgcatatttatgacg

SEQ ID NO: 409938 - DNA, 25 bp, Mus musculus
cttgacctctctgcagtcgtggcgc

SEQ ID NO: 409939 - DNA, 25 bp, Mus musculus
gcacagagtagcctgccttgacctc

SEQ ID NO: 409940 - DNA, 25 bp, Mus musculus
gcgcgcagcgatgacgcacagagta

SEQ ID NO: 409941 - DNA, 25 bp, Mus musculus
tcgccagacgtcagtatccgcgggc

SEQ ID NO: 409942 - DNA, 25 bp, Mus musculus
gttcaatagcgttcgccagacgtca

SEQ ID NO: 409943 - DNA, 25 bp, Mus musculus
acccgcgcgggttgcatcagcgcgt

SEQ ID NO: 409944 - DNA, 25 bp, Mus musculus
ggctgtagagatgggccgttactca

SEQ ID NO: 409945 - DNA, 25 bp, Mus musculus
gtcctcggccggaagaaagcagcag

SEQ ID NO: 409946 - DNA, 25 bp, Mus musculus
cgcgagctggaagcataaaaggtcc

SEQ ID NO: 409947 - DNA, 25 bp, Mus musculus
tgggccgttactcaggcaagacgtg

SEQ ID NO: 409948 - DNA, 25 bp, Mus musculus
ttacctgggcaactccatcgcgctg

SEQ ID NO: 409949 - DNA, 25 bp, Mus musculus
tctcggactcgttcaacatgctgtc

SEQ ID NO: 409950 - DNA, 25 bp, Mus musculus
acctgatctcgctgtgcgtgggcct

SEQ ID NO: 409951 - DNA, 25 bp, Mus musculus
cagtgccacctacggctacgtgcgg

SEQ ID NO: 409952 - DNA, 25 bp, Mus musculus
caccatcttcgtggaggccgtgttg

SEQ ID NO: 409953 - DNA, 25 bp, Mus musculus
agcgcatcgacgacccggagctggt

SEQ ID NO: 409954 - DNA, 25 bp, Mus musculus
ggggctgctcatcttccaggactgc

SEQ ID NO: 409955 - DNA, 25 bp, Mus musculus
gaggctgcgacagccacagctcctg

SEQ ID NO: 409956 - DNA, 25 bp, Mus musculus
gctgctgttcatgctggtgctcacc

SEQ ID NO: 409957 - DNA, 25 bp, Mus musculus
ctcgggcacagcagtgactctccgg

SEQ ID NO: 409958 - DNA, 25 bp, Mus musculus
gagactgtaatgcacctgagccgtg

SEQ ID NO: 409959 - DNA, 25 bp, Mus musculus
ccgagaagagggtgcttcccctact

SEQ ID NO: 409960 - DNA, 25 bp, Mus musculus
gaccacgagactgtaatgcacctga

SEQ ID NO: 409961 - DNA, 25 bp, Mus musculus
acctgagccgtgcaggaagatcagc

SEQ ID NO: 409962 - DNA, 25 bp, Mus musculus
tgcaggaagatcagcgaggcactgt

SEQ ID NO: 409963 - DNA, 25 bp, Mus musculus
gatcagcgaggcactgtgtctcccg

SEQ ID NO: 409964 - DNA, 25 bp, Mus musculus
gtgtctcccggtcggggacaccaca

SEQ ID NO: 409965 - DNA, 25 bp, Mus musculus
tcggggacaccacacaacgcggcag

SEQ ID NO: 409966 - DNA, 25 bp, Mus musculus
cacaacgcggcaggtgaacagcgct

SEQ ID NO: 409967 - DNA, 25 bp, Mus musculus
aacagcgctgggcacagcagccatg

SEQ ID NO: 409968 - DNA, 25 bp, Mus musculus
gccacgtccctagcgtcacggggcc

SEQ ID NO: 409969 - DNA, 25 bp, Mus musculus
gcaggcaagcagcaccagcatgggt

SEQ ID NO: 409970 - DNA, 25 bp, Mus musculus
caccagcatgggtgtgcgcatgcgc

SEQ ID NO: 409971 - DNA, 25 bp, Mus musculus
ggtcggagaccacgagactgtaatg

SEQ ID NO: 409972 - DNA, 25 bp, Mus musculus
aacgggagcgaagcgatcaggaccc

SEQ ID NO: 409973 - DNA, 25 bp, Mus musculus
ggtgggacggcatgtcgattttata

SEQ ID NO: 409974 - DNA, 25 bp, Mus musculus
ggacggcatgtcgattttataaacc

SEQ ID NO: 409975 - DNA, 25 bp, Mus musculus
tagtactcctcgtcgctccgctcgc

SEQ ID NO: 409976 - DNA, 25 bp, Mus musculus
aacctccttggcgtagtactcctcg

SEQ ID NO: 409977 - DNA, 25 bp, Mus musculus
tataaacctccttggcgtagtactc

SEQ ID NO: 409978 - DNA, 25 bp, Mus musculus
ggccaaccttagactcggggatgga

SEQ ID NO: 409979 - DNA, 25 bp, Mus musculus
tgtcgattttataaacctccttggc

SEQ ID NO: 409980 - DNA, 25 bp, Mus musculus
aagggcgaacgcctaaggctgctgt

SEQ ID NO: 409981 - DNA, 25 bp, Mus musculus
cttagactcggggatggaaaagtcg

SEQ ID NO: 409982 - DNA, 25 bp, Mus musculus
agctccgggccaaccttagactcgg

SEQ ID NO: 409983 - DNA, 25 bp, Mus musculus
tggatctgaggagctccgggccaac

SEQ ID NO: 409984 - DNA, 25 bp, Mus musculus
cctaaggctgctgtggatctgagga

SEQ ID NO: 409985 - DNA, 25 bp, Mus musculus
acgcctaaggctgctgtggatctga

SEQ ID NO: 409986 - DNA, 25 bp, Mus musculus
cctgccttccacacgtgtgtggatg

SEQ ID NO: 409987 - DNA, 25 bp, Mus musculus
gctcggtccttcagatcctcctttt

SEQ ID NO: 409988 - DNA, 25 bp, Mus musculus
cgctgctgcctgcaaagagggccag

SEQ ID NO: 409989 - DNA, 25 bp, Mus musculus
tgtggaacaacaccgcctcctgggc

SEQ ID NO: 409990 - DNA, 25 bp, Mus musculus
gctgggtcgctccacgttgcagccg

SEQ ID NO: 409991 - DNA, 25 bp, Mus musculus
cgctgtggcctacacccggctgggt

SEQ ID NO: 409992 - DNA, 25 bp, Mus musculus
ccggagatccacagaggccggagca

SEQ ID NO: 409993 - DNA, 25 bp, Mus musculus
agactcggtgggatactgtccgccc

SEQ ID NO: 409994 - DNA, 25 bp, Mus musculus
ctcactcggagactcggtgggatac

SEQ ID NO: 409995 - DNA, 25 bp, Mus musculus
gtggctgatctgaactccgatcctc

SEQ ID NO: 409996 - DNA, 25 bp, Mus musculus
gatcctccggccaaaagggacgaga

SEQ ID NO: 409997 - DNA, 25 bp, Mus musculus
tgcgccgggctctaactgagaagtt

SEQ ID NO: 409998 - DNA, 25 bp, Mus musculus
ctgagaagttcaaagaccgagcggc

SEQ ID NO: 409999 - DNA, 25 bp, Mus musculus
aagggcgacagcgatcggccacctc

SEQ ID NO: 410000 - DNA, 25 bp, Mus musculus
gtgagtcctgaacggccgcagccat

SEQ ID NO: 410001 - DNA, 25 bp, Mus musculus
ggcagagtcggttcctggcctcacc

SEQ ID NO: 410002 - DNA, 25 bp, Mus musculus
ccctgggctcacacgtgagtcctga

SEQ ID NO: 410003 - DNA, 25 bp, Mus musculus
tggctcgccggaagtgccacctgat

SEQ ID NO: 410004 - DNA, 25 bp, Mus musculus
agtgccacctgataattccgtcgtg

SEQ ID NO: 410005 - DNA, 25 bp, Mus musculus
gataattccgtcgtgttgcaacaca

SEQ ID NO: 410006 - DNA, 25 bp, Mus musculus
tgttgcaacacacggaacttcctcc

SEQ ID NO: 410007 - DNA, 25 bp, Mus musculus
tcctcctctagttccggaacagttg

SEQ ID NO: 410008 - DNA, 25 bp, Mus musculus
cggaacagttgtcccgcctgaagtt

SEQ ID NO: 410009 - DNA, 25 bp, Mus musculus
cctgaagttccgctgtgggagcctc

SEQ ID NO: 410010 - DNA, 25 bp, Mus musculus
ggacggagagaggacacgacctacc

SEQ ID NO: 410011 - DNA, 25 bp, Mus musculus
ctaccggttttctccggcagagtcg

SEQ ID NO: 410012 - DNA, 25 bp, Mus musculus
cgccggaagtgccacctgataattc

SEQ ID NO: 410013 - DNA, 25 bp, Mus musculus
ttttctccggcagagtcggttcctg

SEQ ID NO: 410014 - DNA, 25 bp, Mus musculus
cacgcgtcaagcgcgcaggggacca

SEQ ID NO: 410015 - DNA, 25 bp, Mus musculus
caggggaccacagcaagagctcgcc

SEQ ID NO: 410016 - DNA, 25 bp, Mus musculus
tcccagcagcggtccctgctacctg

SEQ ID NO: 410017 - DNA, 25 bp, Mus musculus
gctacctgccgctggtccaggcact

SEQ ID NO: 410018 - DNA, 25 bp, Mus musculus
gacagcgagaggttagcagcggccc

SEQ ID NO: 410019 - DNA, 25 bp, Mus musculus
tgcgggaaggctcactatgacgcgc

SEQ ID NO: 410020 - DNA, 25 bp, Mus musculus
aaggctcactatgacgcgcacgcgc

SEQ ID NO: 410021 - DNA, 25 bp, Mus musculus
ccgaacgcgaggaacagtgcagggc

SEQ ID NO: 410022 - DNA, 25 bp, Mus musculus
gttcccttccgcttccgacgcactg

SEQ ID NO: 410023 - DNA, 25 bp, Mus musculus
cgcactgtccgccagccggtggatg

SEQ ID NO: 410024 - DNA, 25 bp, Mus musculus
gtggatgtgcggcaacaacatgtcc

SEQ ID NO: 410025 - DNA, 25 bp, Mus musculus
ggcaacaacatgtccgctccgatgc

SEQ ID NO: 410026 - DNA, 25 bp, Mus musculus
accagcgagacccaggccgccgcgc

SEQ ID NO: 410027 - DNA, 25 bp, Mus musculus
ccagccggtggatgtgcggcaacaa

SEQ ID NO: 410028 - DNA, 25 bp, Mus musculus
cccgcccaatgatagtccatagtct

SEQ ID NO: 410029 - DNA, 25 bp, Mus musculus
acttgcctgagctgatggcagagaa

SEQ ID NO: 410030 - DNA, 25 bp, Mus musculus
cagagaaggatagcctggatccatc

SEQ ID NO: 410031 - DNA, 25 bp, Mus musculus
ggccaggagagtgcgcttgcacttc

SEQ ID NO: 410032 - DNA, 25 bp, Mus musculus
cacgcgtcgcgccttctggcggaag

SEQ ID NO: 410033 - DNA, 25 bp, Mus musculus
tgccactcaggcgactcgacttgcg

SEQ ID NO: 410034 - DNA, 25 bp, Mus musculus
atagtccatagtctccgcgtgcgcc

SEQ ID NO: 410035 - DNA, 25 bp, Mus musculus
tggatccatcttttgtgcacgcgtc

SEQ ID NO: 410036 - DNA, 25 bp, Mus musculus
gcacgggcatcctctccagctgagg

SEQ ID NO: 410037 - DNA, 25 bp, Mus musculus
caggcgctagagctgcgctctacgg

SEQ ID NO: 410038 - DNA, 25 bp, Mus musculus
gcgctctacggtggaagaacggttc

SEQ ID NO: 410039 - DNA, 25 bp, Mus musculus
gaaattgcgcctgaccgggcacggt

SEQ ID NO: 410040 - DNA, 25 bp, Mus musculus
ccgaagtccgcgctatgggagaaga

SEQ ID NO: 410041 - DNA, 25 bp, Mus musculus
gaagagaaatacttgcctgagctga

SEQ ID NO: 410042 - DNA, 25 bp, Mus musculus
gcgcaaggccgacctccaactctct

SEQ ID NO: 410043 - DNA, 25 bp, Mus musculus
caagtggagtccagtcctgcacagt

SEQ ID NO: 410044 - DNA, 25 bp, Mus musculus
ccattgaagagacagcggagggcgc

SEQ ID NO: 410045 - DNA, 25 bp, Mus musculus
cctgcacagtggtgtgctcgcggaa

SEQ ID NO: 410046 - DNA, 25 bp, Mus musculus
agtcctgcacagtggtgtgctcgcg

SEQ ID NO: 410047 - DNA, 25 bp, Mus musculus
tccagtcctgcacagtggtgtgctc

SEQ ID NO: 410048 - DNA, 25 bp, Mus musculus
gtggagtccagtcctgcacagtggt

SEQ ID NO: 410049 - DNA, 25 bp, Mus musculus
gctccggctctaaatcggtaggcca

SEQ ID NO: 410050 - DNA, 25 bp, Mus musculus
tcgggctccggctctaaatcggtag

SEQ ID NO: 410051 - DNA, 25 bp, Mus musculus
ctccggaggtttcttgggctgctcg

SEQ ID NO: 410052 - DNA, 25 bp, Mus musculus
actctctccggaggtttcttgggct

SEQ ID NO: 410053 - DNA, 25 bp, Mus musculus
ctccaactctctccggaggtttctt

SEQ ID NO: 410054 - DNA, 25 bp, Mus musculus
gcgcctctgcgtggtccttgggcac

SEQ ID NO: 410055 - DNA, 25 bp, Mus musculus
caactctctccggaggtttcttggg

SEQ ID NO: 410056 - DNA, 25 bp, Mus musculus
ctgttccgccgctgtaagtctgaca

SEQ ID NO: 410057 - DNA, 25 bp, Mus musculus
ggcctgaccaggaagtctcgcgaga

SEQ ID NO: 410058 - DNA, 25 bp, Mus musculus
cgggcagaagccatagcgttagctt

SEQ ID NO: 410059 - DNA, 25 bp, Mus musculus
gacctctgaggtgaaaccatagctc

SEQ ID NO: 410060 - DNA, 25 bp, Mus musculus
cagcagttggctggcctagacctga

SEQ ID NO: 410061 - DNA, 25 bp, Mus musculus
ttgaggacttccaaggcacgcacgg

SEQ ID NO: 410062 - DNA, 25 bp, Mus musculus
tagacctgacgtctcgggacagcca

SEQ ID NO: 410063 - DNA, 25 bp, Mus musculus
cgaggatgactggtcgaaaccgctc

SEQ ID NO: 410064 - DNA, 25 bp, Mus musculus
tctacgacaaagacggctcacggtg

SEQ ID NO: 410065 - DNA, 25 bp, Mus musculus
tcccgcagcgacacgagagccaagt

SEQ ID NO: 410066 - DNA, 25 bp, Mus musculus
gagccaagtccagtttcttcagtga

SEQ ID NO: 410067 - DNA, 25 bp, Mus musculus
cgggaacagtcgctggtgtgacaaa

SEQ ID NO: 410068 - DNA, 25 bp, Mus musculus
gggctgccgtgtacatctaactcca

SEQ ID NO: 410069 - DNA, 25 bp, Mus musculus
cacgcacggaggaaatcgcggatta

SEQ ID NO: 410070 - DNA, 25 bp, Mus musculus
gcgctcccgggtgtcgttgatgttt

SEQ ID NO: 410071 - DNA, 25 bp, Mus musculus
gccgcgttcccgttgtccctgccaa

SEQ ID NO: 410072 - DNA, 25 bp, Mus musculus
tccagccggcttccggaagttgctc

SEQ ID NO: 410073 - DNA, 25 bp, Mus musculus
cggcttccggaagttgctctcaaaa

SEQ ID NO: 410074 - DNA, 25 bp, Mus musculus
ccggaagttgctctcaaaatgctga

SEQ ID NO: 410075 - DNA, 25 bp, Mus musculus
gctctcaaaatgctgaagtcctgtg

SEQ ID NO: 410076 - DNA, 25 bp, Mus musculus
ctgaagtcctgtgtggaattggccg

SEQ ID NO: 410077 - DNA, 25 bp, Mus musculus
gtcctcgggcctgagcctcgaggcc

SEQ ID NO: 410078 - DNA, 25 bp, Mus musculus
gcgcccagcgatcggaaccgccgcc

SEQ ID NO: 410079 - DNA, 25 bp, Mus musculus
ctccgggtcagagacggccgtgcac

SEQ ID NO: 410080 - DNA, 25 bp, Mus musculus
gccgtgcaccaagtttcttcaggcc

SEQ ID NO: 410081 - DNA, 25 bp, Mus musculus
aaccgccgccgggaagagctggtga

SEQ ID NO: 410082 - DNA, 25 bp, Mus musculus
caagtttcttcaggccgcgttcccg

SEQ ID NO: 410083 - DNA, 25 bp, Mus musculus
caccaagtttcttcaggccgcgttc

SEQ ID NO: 410084 - DNA, 25 bp, Mus musculus
acaggtgcgtatcattgggtgcgca

SEQ ID NO: 410085 - DNA, 25 bp, Mus musculus
ggatcccgcgtttcctggcttctgt

SEQ ID NO: 410086 - DNA, 25 bp, Mus musculus
tgtcccagtcttggggcgccttcaa

SEQ ID NO: 410087 - DNA, 25 bp, Mus musculus
tggggcgccttcaatgtctttctga

SEQ ID NO: 410088 - DNA, 25 bp, Mus musculus
cttcaatgtctttctgagcccaggc

SEQ ID NO: 410089 - DNA, 25 bp, Mus musculus
atgtctttctgagcccaggcagggg

SEQ ID NO: 410090 - DNA, 25 bp, Mus musculus
caaatggcgcccgggaaggacttct

SEQ ID NO: 410091 - DNA, 25 bp, Mus musculus
ccagacaaggaaggatgttgaggcg

SEQ ID NO: 410092 - DNA, 25 bp, Mus musculus
gccggcgcggttgtgtccaaagctc

SEQ ID NO: 410093 - DNA, 25 bp, Mus musculus
cgcggttgtgtccaaagctcgagtg

SEQ ID NO: 410094 - DNA, 25 bp, Mus musculus
caggagcacaggcttggcagaggct

SEQ ID NO: 410095 - DNA, 25 bp, Mus musculus
aaggccaggacaggtgcgtatcatt

SEQ ID NO: 410096 - DNA, 25 bp, Mus musculus
gcgtatcattgggtgcgcaagtcag

SEQ ID NO: 410097 - DNA, 25 bp, Mus musculus
tcctggcttctgtcccagtcttggg

SEQ ID NO: 410098 - DNA, 25 bp, Mus musculus
ctctgcacgagggaccttgtgagtt

SEQ ID NO: 410099 - DNA, 25 bp, Mus musculus
ctcccgagagctcggagagcggctc

SEQ ID NO: 410100 - DNA, 25 bp, Mus musculus
agccgggcgctctaacttgctcttt

SEQ ID NO: 410101 - DNA, 25 bp, Mus musculus
ttgctgtcacacatacacccttttc

SEQ ID NO: 410102 - DNA, 25 bp, Mus musculus
acacccttttcatttctgtgcgcac

SEQ ID NO: 410103 - DNA, 25 bp, Mus musculus
tgctgtcaacttaaagccgagtttg

SEQ ID NO: 410104 - DNA, 25 bp, Mus musculus
gccgagtttgcttctagactctaga

SEQ ID NO: 410105 - DNA, 25 bp, Mus musculus
attccgatccgagggcgcccggatc

SEQ ID NO: 410106 - DNA, 25 bp, Mus musculus
tcccgccaagtgtgtcctccagggg

SEQ ID NO: 410107 - DNA, 25 bp, Mus musculus
gacgaagtgcgtccatctgaggacc

SEQ ID NO: 410108 - DNA, 25 bp, Mus musculus
aggaccttgccctcagtcactttgg

SEQ ID NO: 410109 - DNA, 25 bp, Mus musculus
tggcctccggtgacttgttttgtgt

SEQ ID NO: 410110 - DNA, 25 bp, Mus musculus
gaccaagcggacatcctcggggacc

SEQ ID NO: 410111 - DNA, 25 bp, Mus musculus
cgtagcctgacggtctggagccact

SEQ ID NO: 410112 - DNA, 25 bp, Mus musculus
caaaaagctgtagcgccggcgcttc

SEQ ID NO: 410113 - DNA, 25 bp, Mus musculus
cagcccggcctctcctcagagccca

SEQ ID NO: 410114 - DNA, 25 bp, Mus musculus
agggtaccccacctggccgtgcaga

SEQ ID NO: 410115 - DNA, 25 bp, Mus musculus
ggctgtaacacctatcccacctagg

SEQ ID NO: 410116 - DNA, 25 bp, Mus musculus
taggctggcacatgccactcctaca

SEQ ID NO: 410117 - DNA, 25 bp, Mus musculus
atgccactcctacagcagcgggcgt

SEQ ID NO: 410118 - DNA, 25 bp, Mus musculus
ggccggagcacactcggaacgccga

SEQ ID NO: 410119 - DNA, 25 bp, Mus musculus
tcacgcttacgaagaaggagtgggc

SEQ ID NO: 410120 - DNA, 25 bp, Mus musculus
ccactacgtgttcgtggcctccgcc

SEQ ID NO: 410121 - DNA, 25 bp, Mus musculus
tcagagcccactcgcctccatggcg

SEQ ID NO: 410122 - DNA, 25 bp, Mus musculus
acaaccatctggaggacgggtcgcc

SEQ ID NO: 410123 - DNA, 25 bp, Mus musculus
cgcgagggacaaaaagctgtagcgc

SEQ ID NO: 410124 - DNA, 25 bp, Mus musculus
cgccggcgcttcacgcttacgaaga

SEQ ID NO: 410125 - DNA, 25 bp, Mus musculus
ggagcacactcggaacgccgagcct

SEQ ID NO: 410126 - DNA, 25 bp, Mus musculus
ctcccagccctatgcgcgtccgcgt

SEQ ID NO: 410127 - DNA, 25 bp, Mus musculus
cgctccgagctgcacgggtaggcat

SEQ ID NO: 410128 - DNA, 25 bp, Mus musculus
gagctgcacgggtaggcattttccc

SEQ ID NO: 410129 - DNA, 25 bp, Mus musculus
gagcgtgagaagaaacgaaatcgcc

SEQ ID NO: 410130 - DNA, 25 bp, Mus musculus
cgaaatcgccggaaggagaggacac

SEQ ID NO: 410131 - DNA, 25 bp, Mus musculus
atcgccggaaggagaggacaccagc

SEQ ID NO: 410132 - DNA, 25 bp, Mus musculus
ccaagttgggatcggacgacgacgc

SEQ ID NO: 410133 - DNA, 25 bp, Mus musculus
atgggtcaccccgattgcgtggccg

SEQ ID NO: 410134 - DNA, 25 bp, Mus musculus
gtgatcactgcagcccgtgcggccg

SEQ ID NO: 410135 - DNA, 25 bp, Mus musculus
ccgagcacccgggtgtctttgtgcc

SEQ ID NO: 410136 - DNA, 25 bp, Mus musculus
ccgggtgtctttgtgccgcggccct

SEQ ID NO: 410137 - DNA, 25 bp, Mus musculus
ccctctccgcatgtctttgtgaggc

SEQ ID NO: 410138 - DNA, 25 bp, Mus musculus
ctccgcatgtctttgtgaggcgccc

SEQ ID NO: 410139 - DNA, 25 bp, Mus musculus
tcgcctcgccgctcttccctccttt

SEQ ID NO: 410140 - DNA, 25 bp, Mus musculus
ggccatggcgagaggctttcgacca

SEQ ID NO: 410141 - DNA, 25 bp, Mus musculus
acagaacctggctccgggctctgcg

SEQ ID NO: 410142 - DNA, 25 bp, Mus musculus
ccgaccagcacgagcgattcaaact

SEQ ID NO: 410143 - DNA, 25 bp, Mus musculus
gcgagaggctttcgaccagtcctca

SEQ ID NO: 410144 - DNA, 25 bp, Mus musculus
gtgagccgcctctgattggcccttt

SEQ ID NO: 410145 - DNA, 25 bp, Mus musculus
tgattggcccttttggacgactgtt

SEQ ID NO: 410146 - DNA, 25 bp, Mus musculus
ttaaaaacaagcagagccggcggcg

SEQ ID NO: 410147 - DNA, 25 bp, Mus musculus
agcctgcgcagacgtcggatgcact

SEQ ID NO: 410148 - DNA, 25 bp, Mus musculus
ggatgcactggcgttgcctagagac

SEQ ID NO: 410149 - DNA, 25 bp, Mus musculus
ctgcgggtctgaatgagggttaaac

SEQ ID NO: 410150 - DNA, 25 bp, Mus musculus
atgagggttaaaccctgagcggctg

SEQ ID NO: 410151 - DNA, 25 bp, Mus musculus
aggccgctcgctctaaccgtaggac

SEQ ID NO: 410152 - DNA, 25 bp, Mus musculus
cgctcgctctaaccgtaggacaagc

SEQ ID NO: 410153 - DNA, 25 bp, Mus musculus
cgttgcctagagacgggctccgcac

SEQ ID NO: 410154 - DNA, 25 bp, Mus musculus
tgcttaggttcttggccctttctcc

SEQ ID NO: 410155 - DNA, 25 bp, Mus musculus
aagctagccggtcgggagcagatac

SEQ ID NO: 410156 - DNA, 25 bp, Mus musculus
actcccgggccatgtaagcaggtaa

SEQ ID NO: 410157 - DNA, 25 bp, Mus musculus
actccaggcagagccaacttcgttc

SEQ ID NO: 410158 - DNA, 25 bp, Mus musculus
cggattccagcgctgtgacgtccct

SEQ ID NO: 410159 - DNA, 25 bp, Mus musculus
ctctgccagctcctggaagccagtg

SEQ ID NO: 410160 - DNA, 25 bp, Mus musculus
actccctgatggtcaacgtgcggca

SEQ ID NO: 410161 - DNA, 25 bp, Mus musculus
gcagcctggcattcctcggattcca

SEQ ID NO: 410162 - DNA, 25 bp, Mus musculus
gccggttctcttcgctagcagtgct

SEQ ID NO: 410163 - DNA, 25 bp, Mus musculus
tccggaggctcaagttctgcacaac

SEQ ID NO: 410164 - DNA, 25 bp, Mus musculus
caggtcctcgtggagcatctggtac

SEQ ID NO: 410165 - DNA, 25 bp, Mus musculus
ccaaagctagcccattaaaagtgca

SEQ ID NO: 410166 - DNA, 25 bp, Mus musculus
catctggtaccaagtggccgctggc

SEQ ID NO: 410167 - DNA, 25 bp, Mus musculus
taaaagtgcacgacttctgcccggc

SEQ ID NO: 410168 - DNA, 25 bp, Mus musculus
cttcaaggaactcggcgctctgctc

SEQ ID NO: 410169 - DNA, 25 bp, Mus musculus
gggagccgcccatctcaggacagct

SEQ ID NO: 410170 - DNA, 25 bp, Mus musculus
catctcaggacagctcgggaggcct

SEQ ID NO: 410171 - DNA, 25 bp, Mus musculus
cggccttcaaggaactcggcgctct

SEQ ID NO: 410172 - DNA, 25 bp, Mus musculus
aagcgtccctggctgatcgggtcat

SEQ ID NO: 410173 - DNA, 25 bp, Mus musculus
tgatcgggtcatcactccctagggg

SEQ ID NO: 410174 - DNA, 25 bp, Mus musculus
acctaagctagaacggacacgcgtg

SEQ ID NO: 410175 - DNA, 25 bp, Mus musculus
cgtacctggcgaagcagcactcgca

SEQ ID NO: 410176 - DNA, 25 bp, Mus musculus
cgaagcagcactcgcagtggtggcc

SEQ ID NO: 410177 - DNA, 25 bp, Mus musculus
cccgctcgcccacggtgagcacgca

SEQ ID NO: 410178 - DNA, 25 bp, Mus musculus
caggagaagaggaggtcgcccacgt

SEQ ID NO: 410179 - DNA, 25 bp, Mus musculus
cgcactgcagaagcgctccaggccg

SEQ ID NO: 410180 - DNA, 25 bp, Mus musculus
cgggaccacagagaacctaagctag

SEQ ID NO: 410181 - DNA, 25 bp, Mus musculus
tggctgatcgggtcatcactcccta

SEQ ID NO: 410182 - DNA, 25 bp, Mus musculus
acccaagcgtgccagtaatggctgg

SEQ ID NO: 410183 - DNA, 25 bp, Mus musculus
gccctcttcggtgcggcgtccaggt

SEQ ID NO: 410184 - DNA, 25 bp, Mus musculus
tatgggcggcccaagcacaacccga

SEQ ID NO: 410185 - DNA, 25 bp, Mus musculus
ttcttctcgtctatgggcggcccaa

SEQ ID NO: 410186 - DNA, 25 bp, Mus musculus
tcagtgcttcccagcgcggcgcaag

SEQ ID NO: 410187 - DNA, 25 bp, Mus musculus
taatggctgggagcttcttctcgtc

SEQ ID NO: 410188 - DNA, 25 bp, Mus musculus
ccctgaggctctcgggcaaactccc

SEQ ID NO: 410189 - DNA, 25 bp, Mus musculus
acacagaggaaagtcaccgggcgcc

SEQ ID NO: 410190 - DNA, 25 bp, Mus musculus
cccggcgctgagcacacagaggaaa

SEQ ID NO: 410191 - DNA, 25 bp, Mus musculus
ctctgttgcagagctgggtgcaagc

SEQ ID NO: 410192 - DNA, 25 bp, Mus musculus
caactcgtctctcctctgttgcaga

SEQ ID NO: 410193 - DNA, 25 bp, Mus musculus
gctcgctcctccgtaccggaccgtc

SEQ ID NO: 410194 - DNA, 25 bp, Mus musculus
caagcagactgggtggactggcacc

SEQ ID NO: 410195 - DNA, 25 bp, Mus musculus
tgggagcttcttctcgtctatgggc

SEQ ID NO: 410196 - DNA, 25 bp, Mus musculus
gccaagtggagtcgcagatctccac

SEQ ID NO: 410197 - DNA, 25 bp, Mus musculus
ctgctccgcctcattatgctgctgg

SEQ ID NO: 410198 - DNA, 25 bp, Mus musculus
cgcctcattatgctgctggccctcg

SEQ ID NO: 410199 - DNA, 25 bp, Mus musculus
cgcgtggtcctccagcacggtctgg

SEQ ID NO: 410200 - DNA, 25 bp, Mus musculus
aggccaagtggagtcgcagatctcc

SEQ ID NO: 410201 - DNA, 25 bp, Mus musculus
ggactgctccgcctcattatgctgc

SEQ ID NO: 410202 - DNA, 25 bp, Mus musculus
gcttggactgctccgcctcattatg

SEQ ID NO: 410203 - DNA, 25 bp, Mus musculus
ttgcttggactgctccgcctcatta

SEQ ID NO: 410204 - DNA, 25 bp, Mus musculus
aagttgcttggactgctccgcctca

SEQ ID NO: 410205 - DNA, 25 bp, Mus musculus
tctccggaagttgcttggactgctc

SEQ ID NO: 410206 - DNA, 25 bp, Mus musculus
agcgctctccggaagttgcttggac

SEQ ID NO: 410207 - DNA, 25 bp, Mus musculus
catccagcgctctccggaagttgct

SEQ ID NO: 410208 - DNA, 25 bp, Mus musculus
tggtcctccagcacggtctggcgcg

SEQ ID NO: 410209 - DNA, 25 bp, Mus musculus
agtcgcagatctccacggtggtggg

SEQ ID NO: 410210 - DNA, 25 bp, Mus musculus
ccgtcccaaataaagccgcagtaga

SEQ ID NO: 410211 - DNA, 25 bp, Mus musculus
aggctgaaagaaacacccgcgctga

SEQ ID NO: 410212 - DNA, 25 bp, Mus musculus
atgtctcgcaccgaagcccaggcta

SEQ ID NO: 410213 - DNA, 25 bp, Mus musculus
gcaacacccgccctaagatatcttg

SEQ ID NO: 410214 - DNA, 25 bp, Mus musculus
cgctgcagccagagtcagggtaact

SEQ ID NO: 410215 - DNA, 25 bp, Mus musculus
attgtttaaccagccagcagccagg

SEQ ID NO: 410216 - DNA, 25 bp, Mus musculus
gtccgctttgcccacgacacaagga

SEQ ID NO: 410217 - DNA, 25 bp, Mus musculus
ggactgtccctcctcgttgttagca

SEQ ID NO: 410218 - DNA, 25 bp, Mus musculus
tgccttcatcttccggacgagaaaa

SEQ ID NO: 410219 - DNA, 25 bp, Mus musculus
aacacgcgagcgagcatagacttcg

SEQ ID NO: 410220 - DNA, 25 bp, Mus musculus
tgcaggacttagcaaaaagcgctcc

SEQ ID NO: 410221 - DNA, 25 bp, Mus musculus
aggccagctaggtggcgtcctaaga

SEQ ID NO: 410222 - DNA, 25 bp, Mus musculus
gctgcagtgcaaacggcaaacattc

SEQ ID NO: 410223 - DNA, 25 bp, Mus musculus
gacggatgtgagttcttttgagacc

SEQ ID NO: 410224 - DNA, 25 bp, Mus musculus
tcccactgacgtacccggtcccagc

SEQ ID NO: 410225 - DNA, 25 bp, Mus musculus
cagctgaaggaaacaggaagactgc

SEQ ID NO: 410226 - DNA, 25 bp, Mus musculus
ccatctgcgggcgttgtgcaccgcg

SEQ ID NO: 410227 - DNA, 25 bp, Mus musculus
cgaggcaagagaacttgtgaggaaa

SEQ ID NO: 410228 - DNA, 25 bp, Mus musculus
gatagcgaggcaagagaacttgtga

SEQ ID NO: 410229 - DNA, 25 bp, Mus musculus
atcgcgaggcgccttcggattcaag

SEQ ID NO: 410230 - DNA, 25 bp, Mus musculus
ccggtcccagcacccaatcgcgagg

SEQ ID NO: 410231 - DNA, 25 bp, Mus musculus
acaggaagactgcacgtcacagtcc

SEQ ID NO: 410232 - DNA, 25 bp, Mus musculus
tgcagtggccgtcgctttcccagcg

SEQ ID NO: 410233 - DNA, 25 bp, Mus musculus
atttactttaagacacagctgaagg

SEQ ID NO: 410234 - DNA, 25 bp, Mus musculus
ccgctccacaacaagatttacttta

SEQ ID NO: 410235 - DNA, 25 bp, Mus musculus
gggctccgctccacaacaagattta

SEQ ID NO: 410236 - DNA, 25 bp, Mus musculus
ctgagggctccgctccacaacaaga

SEQ ID NO: 410237 - DNA, 25 bp, Mus musculus
tgcacgtcacagtcccactgacgta

SEQ ID NO: 410238 - DNA, 25 bp, Mus musculus
gcagagggacaaaataggcctgaca

SEQ ID NO: 410239 - DNA, 25 bp, Mus musculus
agtcatttatcaatctcgcagaggg

SEQ ID NO: 410240 - DNA, 25 bp, Mus musculus
ctttgcacatgacacgattgggatc

SEQ ID NO: 410241 - DNA, 25 bp, Mus musculus
cgttcggacgcacgctttgcacatg

SEQ ID NO: 410242 - DNA, 25 bp, Mus musculus
ggttccaagccgcactagagcagtc

SEQ ID NO: 410243 - DNA, 25 bp, Mus musculus
tggccagggcttaagcggagctccc

SEQ ID NO: 410244 - DNA, 25 bp, Mus musculus
aactgtccaggccacgcgtgagcca

SEQ ID NO: 410245 - DNA, 25 bp, Mus musculus
ctgaaaggtttagccgagccctgtc

SEQ ID NO: 410246 - DNA, 25 bp, Mus musculus
cagcccgcagtagggcacaggagct

SEQ ID NO: 410247 - DNA, 25 bp, Mus musculus
agcctgcgcctctgaggctcagctg

SEQ ID NO: 410248 - DNA, 25 bp, Mus musculus
ggggtaaccaccagacagacaagca

SEQ ID NO: 410249 - DNA, 25 bp, Mus musculus
gcctgacataaagctggggtaacca

SEQ ID NO: 410250 - DNA, 25 bp, Mus musculus
tgcgtgccctcaaataagtcattta

SEQ ID NO: 410251 - DNA, 25 bp, Mus musculus
ggaaaagtttcctgcgtgccctcaa

SEQ ID NO: 410252 - DNA, 25 bp, Mus musculus
agagtgctcgtgtcagcagactcca

SEQ ID NO: 410253 - DNA, 25 bp, Mus musculus
aagctgcctttcagctcggttcgcc

SEQ ID NO: 410254 - DNA, 25 bp, Mus musculus
ctccttccttagcagccataagctg

SEQ ID NO: 410255 - DNA, 25 bp, Mus musculus
ggatagatgctgtggcttgttcgcc

SEQ ID NO: 410256 - DNA, 25 bp, Mus musculus
cttctccgttggttcgcagcatcca

SEQ ID NO: 410257 - DNA, 25 bp, Mus musculus
ccgctgtactggaaaaactatggga

SEQ ID NO: 410258 - DNA, 25 bp, Mus musculus
tgcgaggaacactcccgctgtactg

SEQ ID NO: 410259 - DNA, 25 bp, Mus musculus
tttccaaagcctgcgaggaacactc

SEQ ID NO: 410260 - DNA, 25 bp, Mus musculus
tgttgtcttcatgcccaaggccacc

SEQ ID NO: 410261 - DNA, 25 bp, Mus musculus
ccgcgtggccttctgttgtcttcat

SEQ ID NO: 410262 - DNA, 25 bp, Mus musculus
aatgctctacgagagtggccgcgtg

SEQ ID NO: 410263 - DNA, 25 bp, Mus musculus
agcctggcagggttgtaatgctcta

SEQ ID NO: 410264 - DNA, 25 bp, Mus musculus
ggcgcacaccggaccgaacagggca

SEQ ID NO: 410265 - DNA, 25 bp, Mus musculus
tgggcaaaatcacgccaagcctctg

SEQ ID NO: 410266 - DNA, 25 bp, Mus musculus
tccacgcttcccagtcgtggaagca

SEQ ID NO: 410267 - DNA, 25 bp, Mus musculus
gacatccaggacagccgcgtctctg

SEQ ID NO: 410268 - DNA, 25 bp, Mus musculus
agccgcgtctctgcacacgtgcatg

SEQ ID NO: 410269 - DNA, 25 bp, Mus musculus
cgaggcgctgactccacaggagaac

SEQ ID NO: 410270 - DNA, 25 bp, Mus musculus
ctgctctgccaagcgaggcgctgac

SEQ ID NO: 410271 - DNA, 25 bp, Mus musculus
gactccacaggagaaccgtcctgtc

SEQ ID NO: 410272 - DNA, 25 bp, Mus musculus
aagcatttggctcgcctgcccgtgc

SEQ ID NO: 410273 - DNA, 25 bp, Mus musculus
gcatggctgcgctgatggatccagc

SEQ ID NO: 410274 - DNA, 25 bp, Mus musculus
tcccagtcgtggaagcatttggctc

SEQ ID NO: 410275 - DNA, 25 bp, Mus musculus
tggatccagcgcaagcccgcagact

SEQ ID NO: 410276 - DNA, 25 bp, Mus musculus
ctgatggatccagcgcaagcccgca

SEQ ID NO: 410277 - DNA, 25 bp, Mus musculus
tgcacacgtgcatgtgagcctcctg

SEQ ID NO: 410278 - DNA, 25 bp, Mus musculus
atgtgagcctcctgtcacgggcagg

SEQ ID NO: 410279 - DNA, 25 bp, Mus musculus
tcgtggaagcatttggctcgcctgc

SEQ ID NO: 410280 - DNA, 25 bp, Mus musculus
ggatcaccacacagacttccgggtc

SEQ ID NO: 410281 - DNA, 25 bp, Mus musculus
gcgcctagctcagtcgccatggata

SEQ ID NO: 410282 - DNA, 25 bp, Mus musculus
gctgtggttactagcgcctagctca

SEQ ID NO: 410283 - DNA, 25 bp, Mus musculus
gagctgtatcgtccgctgtggttac

SEQ ID NO: 410284 - DNA, 25 bp, Mus musculus
gtcatcccggtcgacgttcgggata

SEQ ID NO: 410285 - DNA, 25 bp, Mus musculus
agaaggtgcggctctggatcctctc

SEQ ID NO: 410286 - DNA, 25 bp, Mus musculus
gcttggatctgcttccggatcacca

SEQ ID NO: 410287 - DNA, 25 bp, Mus musculus
gcactaagcacgagcaccgcgaaga

SEQ ID NO: 410288 - DNA, 25 bp, Mus musculus
gtgccggactccacgcagcactaag

SEQ ID NO: 410289 - DNA, 25 bp, Mus musculus
ggtaaccttatagacagtgtagccc

SEQ ID NO: 410290 - DNA, 25 bp, Mus musculus
cacccgtgcggtaaccttatagaca

SEQ ID NO: 410291 - DNA, 25 bp, Mus musculus
ctatccagaaactcacccgtgcggt

SEQ ID NO: 410292 - DNA, 25 bp, Mus musculus
ctctggatcctctccgagctgtatc

SEQ ID NO: 410293 - DNA, 25 bp, Mus musculus
ctcagtcgccatggataccggaggc

SEQ ID NO: 410294 - DNA, 25 bp, Mus musculus
gcgttgggcgctcacagagagccaa

SEQ ID NO: 410295 - DNA, 25 bp, Mus musculus
aaggcaagatggtgaccgggcctgc

SEQ ID NO: 410296 - DNA, 25 bp, Mus musculus
cgagacgctcctcccagcatgccta

SEQ ID NO: 410297 - DNA, 25 bp, Mus musculus
agcggccgaagctgaggtgcagccg

SEQ ID NO: 410298 - DNA, 25 bp, Mus musculus
tgggcgctcacagagagccaagatg

SEQ ID NO: 410299 - DNA, 25 bp, Mus musculus
tcacagagagccaagatggagacgt

SEQ ID NO: 410300 - DNA, 25 bp, Mus musculus
gtcgcactgcttaaaggaactgccc

SEQ ID NO: 410301 - DNA, 25 bp, Mus musculus
tcccagcatgcctagcggccggccg

SEQ ID NO: 410302 - DNA, 25 bp, Mus musculus
cccggagtcgcactgcttaaaggaa

SEQ ID NO: 410303 - DNA, 25 bp, Mus musculus
catgcccggagtcgcactgcttaaa

SEQ ID NO: 410304 - DNA, 25 bp, Mus musculus
tagccttccgccctaccaggaaatg

SEQ ID NO: 410305 - DNA, 25 bp, Mus musculus
accaggaaatggctgtccgcgcacg

SEQ ID NO: 410306 - DNA, 25 bp, Mus musculus
ggaaatggctgtccgcgcacgctct

SEQ ID NO: 410307 - DNA, 25 bp, Mus musculus
tccgccctaccaggaaatggctgtc

SEQ ID NO: 410308 - DNA, 25 bp, Mus musculus
cgcagcagcctctgcttgttaggga

SEQ ID NO: 410309 - DNA, 25 bp, Mus musculus
gcctttaactctcgcggccgtagga

SEQ ID NO: 410310 - DNA, 25 bp, Mus musculus
accgggcctgaaagcagtggaaaca

SEQ ID NO: 410311 - DNA, 25 bp, Mus musculus
gcagacactgcagctcaataagaca

SEQ ID NO: 410312 - DNA, 25 bp, Mus musculus
acccttcaggactaacgcgagcttc

SEQ ID NO: 410313 - DNA, 25 bp, Mus musculus
ccgattacctagcaaggcggctgga

SEQ ID NO: 410314 - DNA, 25 bp, Mus musculus
tcacacccagctgcactcggggatg

SEQ ID NO: 410315 - DNA, 25 bp, Mus musculus
cctcattgctgcagaaggctgttgg

SEQ ID NO: 410316 - DNA, 25 bp, Mus musculus
gacatataactgagtcacccgggca

SEQ ID NO: 410317 - DNA, 25 bp, Mus musculus
cgccgatgttccgaatgcggccatt

SEQ ID NO: 410318 - DNA, 25 bp, Mus musculus
cggccattggacaccgcaacaaaga

SEQ ID NO: 410319 - DNA, 25 bp, Mus musculus
tgggactctacaacccggagctctg

SEQ ID NO: 410320 - DNA, 25 bp, Mus musculus
tggactgccacggtcccacagcgag

SEQ ID NO: 410321 - DNA, 25 bp, Mus musculus
tgtagcaagaagactcgagggtccc

SEQ ID NO: 410322 - DNA, 25 bp, Mus musculus
tgatgctgctgtactggatccactg

SEQ ID NO: 410323 - DNA, 25 bp, Mus musculus
caatcattgagcgtttcggaagtcc

SEQ ID NO: 410324 - DNA, 25 bp, Mus musculus
tccagaaaaccaatcggggagttgc

SEQ ID NO: 410325 - DNA, 25 bp, Mus musculus
gagcccaaggcaggcgttctctacg

SEQ ID NO: 410326 - DNA, 25 bp, Mus musculus
tctctacgctgtggtttgctggagc

SEQ ID NO: 410327 - DNA, 25 bp, Mus musculus
ccgcagcgtttagcctcaggttatc

SEQ ID NO: 410328 - DNA, 25 bp, Mus musculus
cccagggcatctcgtatcgcgtagt

SEQ ID NO: 410329 - DNA, 25 bp, Mus musculus
ggcacgtaggccaccatgtacacca

SEQ ID NO: 410330 - DNA, 25 bp, Mus musculus
tcgtagaagtcctcgaacacgttgc

SEQ ID NO: 410331 - DNA, 25 bp, Mus musculus
tggatccactggaaggcgttcacca

SEQ ID NO: 410332 - DNA, 25 bp, Mus musculus
tcaggcccgttttgcggtaccaagc

SEQ ID NO: 410333 - DNA, 25 bp, Mus musculus
cttgggcactggaaggtatcccttc

SEQ ID NO: 410334 - DNA, 25 bp, Mus musculus
tgcgccgcttgctgactaagtgaag

SEQ ID NO: 410335 - DNA, 25 bp, Mus musculus
tgcagcggcgacacctcgtagaagt

SEQ ID NO: 410336 - DNA, 25 bp, Mus musculus
atagctactcctgcaggcttctcga

SEQ ID NO: 410337 - DNA, 25 bp, Mus musculus
gaagatggcggctgtctctgaaaca

SEQ ID NO: 410338 - DNA, 25 bp, Mus musculus
ggtctcagcgattcccgccttagtt

SEQ ID NO: 410339 - DNA, 25 bp, Mus musculus
agcatccttccggtctcagcgattc

SEQ ID NO: 410340 - DNA, 25 bp, Mus musculus
aatgtcagttccaggacgctggttc

SEQ ID NO: 410341 - DNA, 25 bp, Mus musculus
gcttctcgactgcaagccaggcggc

SEQ ID NO: 410342 - DNA, 25 bp, Mus musculus
tctctgaaacagtgctcgtctccgc

SEQ ID NO: 410343 - DNA, 25 bp, Mus musculus
ttccgagtgcgctgcaccttgaaga

SEQ ID NO: 410344 - DNA, 25 bp, Mus musculus
agatggcagtgacagtccactaacc

SEQ ID NO: 410345 - DNA, 25 bp, Mus musculus
atacgttgtcaaagtccgaggcgga

SEQ ID NO: 410346 - DNA, 25 bp, Mus musculus
cgccgtgtaagatgaggaatgtcag

SEQ ID NO: 410347 - DNA, 25 bp, Mus musculus
gtcgccatagactaggtacggtctg

SEQ ID NO: 410348 - DNA, 25 bp, Mus musculus
acgctggttcgaaagggtcgccata

SEQ ID NO: 410349 - DNA, 25 bp, Mus musculus
gttccagggagggaagcatccttcc

SEQ ID NO: 410350 - DNA, 25 bp, Mus musculus
ttcccgaagccgctggcgaagtcct

SEQ ID NO: 410351 - DNA, 25 bp, Mus musculus
tatccctactgggatgcccgagccg

SEQ ID NO: 410352 - DNA, 25 bp, Mus musculus
gatgaagataaaacgggtccgctcc

SEQ ID NO: 410353 - DNA, 25 bp, Mus musculus
cccaaggctcgagctcggtttctcg

SEQ ID NO: 410354 - DNA, 25 bp, Mus musculus
ctcgctttgttgttccgggtacagg

SEQ ID NO: 410355 - DNA, 25 bp, Mus musculus
cccgcgacaataaatagactagacg

SEQ ID NO: 410356 - DNA, 25 bp, Mus musculus
ggggatcccggctagccactcactt

SEQ ID NO: 410357 - DNA, 25 bp, Mus musculus
cggtttattttccagctcctcgttg

SEQ ID NO: 410358 - DNA, 25 bp, Mus musculus
ctcctcgttggcgagcagcatgaca

SEQ ID NO: 410359 - DNA, 25 bp, Mus musculus
gcagcatgacacaaatgggctttca

SEQ ID NO: 410360 - DNA, 25 bp, Mus musculus
ttcctgtaaaccagaactgtgcctg

SEQ ID NO: 410361 - DNA, 25 bp, Mus musculus
gacgagctcagctagcagccactgg

SEQ ID NO: 410362 - DNA, 25 bp, Mus musculus
agccactgggcccttagtcgtgacc

SEQ ID NO: 410363 - DNA, 25 bp, Mus musculus
gggatcccggccttactcatcgagg

SEQ ID NO: 410364 - DNA, 25 bp, Mus musculus
agactcggcgccgaacacgtgggtc

SEQ ID NO: 410365 - DNA, 25 bp, Mus musculus
ggcccttagcggaaagcagcgactt

SEQ ID NO: 410366 - DNA, 25 bp, Mus musculus
ccgcagtggaaaagccctgaggctc

SEQ ID NO: 410367 - DNA, 25 bp, Mus musculus
gccgtgcgcctcaagcgcttgggaa

SEQ ID NO: 410368 - DNA, 25 bp, Mus musculus
aaagcagcgacttgggtgggatcct

SEQ ID NO: 410369 - DNA, 25 bp, Mus musculus
tgccacgtgacttccacgaagagcg

SEQ ID NO: 410370 - DNA, 25 bp, Mus musculus
cttcggtgctgccacgtgacttcca

SEQ ID NO: 410371 - DNA, 25 bp, Mus musculus
ccactcggggtcttctccgtgggtg

SEQ ID NO: 410372 - DNA, 25 bp, Mus musculus
ccaaacttcccaggagcggccggag

SEQ ID NO: 410373 - DNA, 25 bp, Mus musculus
tcactggtgcttctcacccaaactt

SEQ ID NO: 410374 - DNA, 25 bp, Mus musculus
gctgcgaagggacattgaagccacc

SEQ ID NO: 410375 - DNA, 25 bp, Mus musculus
caggtgccgcctcgcccggaagaaa

SEQ ID NO: 410376 - DNA, 25 bp, Mus musculus
cccatagcgcggacggtctctgctg

SEQ ID NO: 410377 - DNA, 25 bp, Mus musculus
aaccagccgcaggtattggacaagg

SEQ ID NO: 410378 - DNA, 25 bp, Mus musculus
atcccagtgccttctgtaacgggcg

SEQ ID NO: 410379 - DNA, 25 bp, Mus musculus
gttcgctagagactcataatcgttc

SEQ ID NO: 410380 - DNA, 25 bp, Mus musculus
tgcgcagaccaggtggcgcatgctc

SEQ ID NO: 410381 - DNA, 25 bp, Mus musculus
caggtggcgcatgctcctcagcgcg

SEQ ID NO: 410382 - DNA, 25 bp, Mus musculus
tcggcaaggagtagctcggtgaacc

SEQ ID NO: 410383 - DNA, 25 bp, Mus musculus
gtagctcggtgaacccggatactaa

SEQ ID NO: 410384 - DNA, 25 bp, Mus musculus
cccggatactaataaagttcgctag

SEQ ID NO: 410385 - DNA, 25 bp, Mus musculus
cataatcgttctgaaagagcggagc

SEQ ID NO: 410386 - DNA, 25 bp, Mus musculus
tctgctctcgcgtcctcgtggggac

SEQ ID NO: 410387 - DNA, 25 bp, Mus musculus
aaccgccgtggcttcccaggagcgg

SEQ ID NO: 410388 - DNA, 25 bp, Mus musculus
tggcttcccaggagcgggaacccga

SEQ ID NO: 410389 - DNA, 25 bp, Mus musculus
acccgagagtgggagaacttgatgc

SEQ ID NO: 410390 - DNA, 25 bp, Mus musculus
tgggacgatcccagtgccttctgta

SEQ ID NO: 410391 - DNA, 25 bp, Mus musculus
gactccgcctgggacgatcccagtg

SEQ ID NO: 410392 - DNA, 25 bp, Mus musculus
gatcaagcgtagaccgcacccgaga

SEQ ID NO: 410393 - DNA, 25 bp, Mus musculus
agcacccctacttcgaggcgcagta

SEQ ID NO: 410394 - DNA, 25 bp, Mus musculus
acccgagagtctctggcatcgcagc

SEQ ID NO: 410395 - DNA, 25 bp, Mus musculus
agcgtagaccgcacccgagagtctc

SEQ ID NO: 410396 - DNA, 25 bp, Mus musculus
agagtctctggcatcgcagcggccc

SEQ ID NO: 410397 - DNA, 25 bp, Mus musculus
ctgggtcggagatcaagcgtagacc

SEQ ID NO: 410398 - DNA, 25 bp, Mus musculus
cccggtcctagaggtgaggctgggt

SEQ ID NO: 410399 - DNA, 25 bp, Mus musculus
gaacagcggtttccaagctctcgcc

SEQ ID NO: 410400 - DNA, 25 bp, Mus musculus
cgtccgcggggaatggaacagcggt

SEQ ID NO: 410401 - DNA, 25 bp, Mus musculus
tgcggctgaggtctgcaccagcacg

SEQ ID NO: 410402 - DNA, 25 bp, Mus musculus
cttgcgctgcggctgaggtctgcac

SEQ ID NO: 410403 - DNA, 25 bp, Mus musculus
agtgtcgagaagtctgcctggaccg

SEQ ID NO: 410404 - DNA, 25 bp, Mus musculus
cccgagtgtcgagaagtctgcctgg

SEQ ID NO: 410405 - DNA, 25 bp, Mus musculus
tagaccgcacccgagagtctctggc

SEQ ID NO: 410406 - DNA, 25 bp, Mus musculus
aaaatgtgccttctttgaccagcgg

SEQ ID NO: 410407 - DNA, 25 bp, Mus musculus
cggtgacaatctcccgcgtgaagga

SEQ ID NO: 410408 - DNA, 25 bp, Mus musculus
ggtgcccaaagttacactccgatga

SEQ ID NO: 410409 - DNA, 25 bp, Mus musculus
gcgggcacgacctttctctaaaatg

SEQ ID NO: 410410 - DNA, 25 bp, Mus musculus
tgagccaatggtgcccaagccagcg

SEQ ID NO: 410411 - DNA, 25 bp, Mus musculus
gctgcgtgttccaggcatgagccaa

SEQ ID NO: 410412 - DNA, 25 bp, Mus musculus
accgccagatgtgcgtattcgccgc

SEQ ID NO: 410413 - DNA, 25 bp, Mus musculus
ctccaggttaccaatcccaggctga

SEQ ID NO: 410414 - DNA, 25 bp, Mus musculus
cagggagcccgcttaactccaggtt

SEQ ID NO: 410415 - DNA, 25 bp, Mus musculus
cttttaaagccctcgcgttggcagg

SEQ ID NO: 410416 - DNA, 25 bp, Mus musculus
gtgtggctctaactcacctccagtc

SEQ ID NO: 410417 - DNA, 25 bp, Mus musculus
tggcacggacactagggcttcagtc

SEQ ID NO: 410418 - DNA, 25 bp, Mus musculus
tttaccagctaagaacggcagcggc

SEQ ID NO: 410419 - DNA, 25 bp, Mus musculus
cccaggctgacgtaatgctattaat

SEQ ID NO: 410420 - DNA, 25 bp, Mus musculus
cctgccaggatctgacgggattaca

SEQ ID NO: 410421 - DNA, 25 bp, Mus musculus
tgcacccgggttcctcaagtccaag

SEQ ID NO: 410422 - DNA, 25 bp, Mus musculus
tccagccgacctgccggcaggtaaa

SEQ ID NO: 410423 - DNA, 25 bp, Mus musculus
ttgccttggaaacggctctcggggc

SEQ ID NO: 410424 - DNA, 25 bp, Mus musculus
atgttttgctttgggttttgccttg

SEQ ID NO: 410425 - DNA, 25 bp, Mus musculus
agcgccaggctaatgttttgctttg

SEQ ID NO: 410426 - DNA, 25 bp, Mus musculus
gcgggaagcgccaggctaatgtttt

SEQ ID NO: 410427 - DNA, 25 bp, Mus musculus
ttcctcaagtccaaggcagagtctc

SEQ ID NO: 410428 - DNA, 25 bp, Mus musculus
tctgacgggattacagcagcatcgc

SEQ ID NO: 410429 - DNA, 25 bp, Mus musculus
gggatcctctcagatcctgccagga

SEQ ID NO: 410430 - DNA, 25 bp, Mus musculus
gagtctctcggtccttgctggcccg

SEQ ID NO: 410431 - DNA, 25 bp, Mus musculus
ttcacaggcctctgccctccatcga

SEQ ID NO: 410432 - DNA, 25 bp, Mus musculus
aaggcagagtctcgcccttcacagg

SEQ ID NO: 410433 - DNA, 25 bp, Mus musculus
attacagcagcatcgcgcgggaagc

SEQ ID NO: 410434 - DNA, 25 bp, Mus musculus
tagcgtagacagaagtcggcagagc

SEQ ID NO: 410435 - DNA, 25 bp, Mus musculus
aagtcggcagagcttcgtgggcacc

SEQ ID NO: 410436 - DNA, 25 bp, Mus musculus
accgtggaaggatagcgtagacaga

SEQ ID NO: 410437 - DNA, 25 bp, Mus musculus
ttacggattaaattggcgttctatg

SEQ ID NO: 410438 - DNA, 25 bp, Mus musculus
agcttcgtgggcacctggtcatgac

SEQ ID NO: 410439 - DNA, 25 bp, Mus musculus
tggaaggatagcgtagacagaagtc

SEQ ID NO: 410440 - DNA, 25 bp, Mus musculus
gctccatcagaaccgtggaaggata

SEQ ID NO: 410441 - DNA, 25 bp, Mus musculus
aagacccgctccatcagaaccgtgg

SEQ ID NO: 410442 - DNA, 25 bp, Mus musculus
aagtggaaggcacggccgacagcct

SEQ ID NO: 410443 - DNA, 25 bp, Mus musculus
cttcaagtggaaggcacggccgaca

SEQ ID NO: 410444 - DNA, 25 bp, Mus musculus
gggtcttgtcttcaagtggaaggca

SEQ ID NO: 410445 - DNA, 25 bp, Mus musculus
atggaggtgggtcttgtcttcaagt

SEQ ID NO: 410446 - DNA, 25 bp, Mus musculus
ttaaattggcgttctatggaggtgg

SEQ ID NO: 410447 - DNA, 25 bp, Mus musculus
ggcacctggtcatgaccgtggtgcc

SEQ ID NO: 410448 - DNA, 25 bp, Mus musculus
tcacagcgttctccgtgaaggggcg

SEQ ID NO: 410449 - DNA, 25 bp, Mus musculus
gacagcgaaactcgaactttctatc

SEQ ID NO: 410450 - DNA, 25 bp, Mus musculus
ccaggttcatctgaggtgaggcgtt

SEQ ID NO: 410451 - DNA, 25 bp, Mus musculus
ctcaggagtgggtcgccaggttcat

SEQ ID NO: 410452 - DNA, 25 bp, Mus musculus
aggtctccacagctcggacacggga

SEQ ID NO: 410453 - DNA, 25 bp, Mus musculus
gtgaagtgactgcacaaggtctcca

SEQ ID NO: 410454 - DNA, 25 bp, Mus musculus
tcttcaggtcacgtgaagtgactgc

SEQ ID NO: 410455 - DNA, 25 bp, Mus musculus
gcaagccctggtcctcttggtgagc

SEQ ID NO: 410456 - DNA, 25 bp, Mus musculus
tcacgtgactccgtgaggcggcatg

SEQ ID NO: 410457 - DNA, 25 bp, Mus musculus
gtctaattttagctctgaggtgtca

SEQ ID NO: 410458 - DNA, 25 bp, Mus musculus
tctccgggtcacgtaggtgcacccg

SEQ ID NO: 410459 - DNA, 25 bp, Mus musculus
tgatgactcacgcagtcgggcctcc

SEQ ID NO: 410460 - DNA, 25 bp, Mus musculus
ggcagcgcgcttacgtcacagcgtt

SEQ ID NO: 410461 - DNA, 25 bp, Mus musculus
cgccgctccgcctgtctaattttag

SEQ ID NO: 410462 - DNA, 25 bp, Mus musculus
ggcgcgccatagacagcgaggagca

SEQ ID NO: 410463 - DNA, 25 bp, Mus musculus
ccagcccaggctgagggcactggga

SEQ ID NO: 410464 - DNA, 25 bp, Mus musculus
gccctgcctccacccggcctcgcgt

SEQ ID NO: 410465 - DNA, 25 bp, Mus musculus
ccgccaccagtcagctcgggacagc

SEQ ID NO: 410466 - DNA, 25 bp, Mus musculus
caccagtcagctcgggacagccgcc

SEQ ID NO: 410467 - DNA, 25 bp, Mus musculus
gccgcctacctcctcgccgccgtag

SEQ ID NO: 410468 - DNA, 25 bp, Mus musculus
ctcgccgccgtagcgggccagctcc

SEQ ID NO: 410469 - DNA, 25 bp, Mus musculus
gcgccatagacagcgaggagcaggc

SEQ ID NO: 410470 - DNA, 25 bp, Mus musculus
agctcctcctcggtgaagagccgca

SEQ ID NO: 410471 - DNA, 25 bp, Mus musculus
gctgagggcactgggaccagagcca

SEQ ID NO: 410472 - DNA, 25 bp, Mus musculus
ggcgtcagggcgacgccctgcctcc

SEQ ID NO: 410473 - DNA, 25 bp, Mus musculus
gtctgcccagcccaggctgagggca

SEQ ID NO: 410474 - DNA, 25 bp, Mus musculus
ctcctcggtgaagagccgcaccggg

SEQ ID NO: 410475 - DNA, 25 bp, Mus musculus
gagccagcgccaggacgagcgccgc

SEQ ID NO: 410476 - DNA, 25 bp, Mus musculus
tgatccgacaagaactctccacgtc

SEQ ID NO: 410477 - DNA, 25 bp, Mus musculus
cgggcacatcttggagctcgcgcct

SEQ ID NO: 410478 - DNA, 25 bp, Mus musculus
cggtagactagagcgggtcttgctt

SEQ ID NO: 410479 - DNA, 25 bp, Mus musculus
cacgcctggtcttgggcggtagact

SEQ ID NO: 410480 - DNA, 25 bp, Mus musculus
atgcgcatgcgttgagcgccgccac

SEQ ID NO: 410481 - DNA, 25 bp, Mus musculus
ttctgttcctctggtgtggggcttc

SEQ ID NO: 410482 - DNA, 25 bp, Mus musculus
tcttgcttagtagagcgggcacatc

SEQ ID NO: 410483 - DNA, 25 bp, Mus musculus
ggccagtgccatgatccgacaagaa

SEQ ID NO: 410484 - DNA, 25 bp, Mus musculus
tccacgtcctaccaggaggtgcgga

SEQ ID NO: 410485 - DNA, 25 bp, Mus musculus
tgcaggtggatgattggcactccgt

SEQ ID NO: 410486 - DNA, 25 bp, Mus musculus
cactccgtggcatgcgggctctgca

SEQ ID NO: 410487 - DNA, 25 bp, Mus musculus
cacgcggggataacaagggaccctg

SEQ ID NO: 410488 - DNA, 25 bp, Mus musculus
accactgtccaggtttgctcgaggc

SEQ ID NO: 410489 - DNA, 25 bp, Mus musculus
cggcggcagcaaaagatgcgcatgc

SEQ ID NO: 410490 - DNA, 25 bp, Mus musculus
gcgggccacaaccaatcgcaagtga

SEQ ID NO: 410491 - DNA, 25 bp, Mus musculus
cccggctgtctatcaagagtccata

SEQ ID NO: 410492 - DNA, 25 bp, Mus musculus
gctacgtgacagacgcgggccacaa

SEQ ID NO: 410493 - DNA, 25 bp, Mus musculus
ccaatcgcaagtgaaggcagtgagc

SEQ ID NO: 410494 - DNA, 25 bp, Mus musculus
ggggtgccttgtgcgtcacaactgt

SEQ ID NO: 410495 - DNA, 25 bp, Mus musculus
gtcacaactgtaaaggaaagctctc

SEQ ID NO: 410496 - DNA, 25 bp, Mus musculus
actgtaaaggaaagctctcgggagg

SEQ ID NO: 410497 - DNA, 25 bp, Mus musculus
ccgcgccgctgtcggctcttgtgta

SEQ ID NO: 410498 - DNA, 25 bp, Mus musculus
cggctcttgtgtacgcctgcgctag

SEQ ID NO: 410499 - DNA, 25 bp, Mus musculus
gtggcctcccggctgtctatcaaga

SEQ ID NO: 410500 - DNA, 25 bp, Mus musculus
caatcgcagggctaagcggcagacg

SEQ ID NO: 410501 - DNA, 25 bp, Mus musculus
ctcggccaatcgcagggctaagcgg

SEQ ID NO: 410502 - DNA, 25 bp, Mus musculus
gggaaagcatgccagtgccctcggc

SEQ ID NO: 410503 - DNA, 25 bp, Mus musculus
atcaagagtccatagctgggtggga

SEQ ID NO: 410504 - DNA, 25 bp, Mus musculus
gtcttgagcctggagaaggccttgc

SEQ ID NO: 410505 - DNA, 25 bp, Mus musculus
ggagacccgttctcgcagttggagc

SEQ ID NO: 410506 - DNA, 25 bp, Mus musculus
agcgggcttttcttagtgggcgcct

SEQ ID NO: 410507 - DNA, 25 bp, Mus musculus
cagttggagccctcctcggtgctct

SEQ ID NO: 410508 - DNA, 25 bp, Mus musculus
gcgttgcgctggacctgcttgccct

SEQ ID NO: 410509 - DNA, 25 bp, Mus musculus
cgcgggaggactcaccaggttgact

SEQ ID NO: 410510 - DNA, 25 bp, Mus musculus
cgctcacgagcattggccgcgttgc

SEQ ID NO: 410511 - DNA, 25 bp, Mus musculus
ggatctgccttaagtgagcgatgta

SEQ ID NO: 410512 - DNA, 25 bp, Mus musculus
cgttggccaggatctgccttaagtg

SEQ ID NO: 410513 - DNA, 25 bp, Mus musculus
ctgggtgaatgtaaccgttctcgta

SEQ ID NO: 410514 - DNA, 25 bp, Mus musculus
cggcgatttaacgagtcacgctctc

SEQ ID NO: 410515 - DNA, 25 bp, Mus musculus
cccagagatgctagggcggcgattt

SEQ ID NO: 410516 - DNA, 25 bp, Mus musculus
ccgttctcgtacttgtcgttggcca

SEQ ID NO: 410517 - DNA, 25 bp, Mus musculus
acgccagcctgagagtgtccagctt

SEQ ID NO: 410518 - DNA, 25 bp, Mus musculus
tccgctcttatggaactggacaaag

SEQ ID NO: 410519 - DNA, 25 bp, Mus musculus
cgcgcgatattgacgtaagcagcca

SEQ ID NO: 410520 - DNA, 25 bp, Mus musculus
gtccggaaggaacccaagcacgatg

SEQ ID NO: 410521 - DNA, 25 bp, Mus musculus
agcacgatgttcttcggcggtcctc

SEQ ID NO: 410522 - DNA, 25 bp, Mus musculus
ggccgttactcaccgttcctcagga

SEQ ID NO: 410523 - DNA, 25 bp, Mus musculus
gcggagtaccgagttgaagagcatc

SEQ ID NO: 410524 - DNA, 25 bp, Mus musculus
actgacgtcacgctttctgattggc

SEQ ID NO: 410525 - DNA, 25 bp, Mus musculus
gaacccaaggttcacaggctccctg

SEQ ID NO: 410526 - DNA, 25 bp, Mus musculus
aggcgcatgcgtacactgcctgaca

SEQ ID NO: 410527 - DNA, 25 bp, Mus musculus
tgcaatctttgtgactgggcgagtc

SEQ ID NO: 410528 - DNA, 25 bp, Mus musculus
aactgtccgggtcatggcgtcaaac

SEQ ID NO: 410529 - DNA, 25 bp, Mus musculus
tgcactctctagttaacgcgcgata

SEQ ID NO: 410530 - DNA, 25 bp, Mus musculus
gctggacgctaattccgctcttatg

SEQ ID NO: 410531 - DNA, 25 bp, Mus musculus
ggcgtcaaactcaaccaagtcgttc

SEQ ID NO: 410532 - DNA, 25 bp, Mus musculus
gacccggaggccgtccggctcctca

SEQ ID NO: 410533 - DNA, 25 bp, Mus musculus
ccgcgccttcgttagagggcgctca

SEQ ID NO: 410534 - DNA, 25 bp, Mus musculus
agcgagtctccacgccgcccgggac

SEQ ID NO: 410535 - DNA, 25 bp, Mus musculus
cttccgccggccatgcattcttccg

SEQ ID NO: 410536 - DNA, 25 bp, Mus musculus
ctgcccaaggtaaacctggggcgcg

SEQ ID NO: 410537 - DNA, 25 bp, Mus musculus
accgaggatgaggtaggcctgaaga

SEQ ID NO: 410538 - DNA, 25 bp, Mus musculus
gggagcgggtcatcgcccgcctccc

SEQ ID NO: 410539 - DNA, 25 bp, Mus musculus
ccaccgcgcctctgtccgcaggcag

SEQ ID NO: 410540 - DNA, 25 bp, Mus musculus
cgcagccgcgtccatgaccgcgacc

SEQ ID NO: 410541 - DNA, 25 bp, Mus musculus
tcggcttcaccttctggtcccgctc

SEQ ID NO: 410542 - DNA, 25 bp, Mus musculus
gcccactgaggtgagcccgccgagg

SEQ ID NO: 410543 - DNA, 25 bp, Mus musculus
gggagccctctgtggagagcccgct

SEQ ID NO: 410544 - DNA, 25 bp, Mus musculus
ggctcctcacctgaggaaaccgctg

SEQ ID NO: 410545 - DNA, 25 bp, Mus musculus
cccgccgaggaggatacctggccga

SEQ ID NO: 410546 - DNA, 25 bp, Mus musculus
cttcgcctgggccatgagctccggg

SEQ ID NO: 410547 - DNA, 25 bp, Mus musculus
ccacggttcacagcaaggacgaagt

SEQ ID NO: 410548 - DNA, 25 bp, Mus musculus
tcacagcaaggacgaagtgggtgca

SEQ ID NO: 410549 - DNA, 25 bp, Mus musculus
gcctcggccggtcctcccagcaccc

SEQ ID NO: 410550 - DNA, 25 bp, Mus musculus
ccaaacaagggcaggcgcggtcgca

SEQ ID NO: 410551 - DNA, 25 bp, Mus musculus
cccgaggccgtgcggccaaacaagg

SEQ ID NO: 410552 - DNA, 25 bp, Mus musculus
tcgccgtcaccacgggcgccgctga

SEQ ID NO: 410553 - DNA, 25 bp, Mus musculus
tgatcttcgcctgggccatgagctc

SEQ ID NO: 410554 - DNA, 25 bp, Mus musculus
ttggcgctgatcttcgcctgggcca

SEQ ID NO: 410555 - DNA, 25 bp, Mus musculus
tgggccttggcgctgatcttcgcct

SEQ ID NO: 410556 - DNA, 25 bp, Mus musculus
aagacgagcggcagaagcggccctc

SEQ ID NO: 410557 - DNA, 25 bp, Mus musculus
agcggtcggccatggaagacgagcg

SEQ ID NO: 410558 - DNA, 25 bp, Mus musculus
gcacccacggttcacagcaaggacg

SEQ ID NO: 410559 - DNA, 25 bp, Mus musculus
gccgctgacgcggacggcaccgccc

SEQ ID NO: 410560 - DNA, 25 bp, Mus musculus
cattttcccaggatgcctagcagtg

SEQ ID NO: 410561 - DNA, 25 bp, Mus musculus
gctttgcgatcccaaatcccagggg

SEQ ID NO: 410562 - DNA, 25 bp, Mus musculus
gttaccatagcgacttcagccaagg

SEQ ID NO: 410563 - DNA, 25 bp, Mus musculus
ggcgcggctcgtattccgtagagca

SEQ ID NO: 410564 - DNA, 25 bp, Mus musculus
cggttgcctagcgacacgcattttc

SEQ ID NO: 410565 - DNA, 25 bp, Mus musculus
cgggctgtagcctcctaagaaggga

SEQ ID NO: 410566 - DNA, 25 bp, Mus musculus
cctagcagtgttgtgttttctcagc

SEQ ID NO: 410567 - DNA, 25 bp, Mus musculus
gccaatcagagttgagatgcacctt

SEQ ID NO: 410568 - DNA, 25 bp, Mus musculus
gatgcaccttcgctgtggaccaata

SEQ ID NO: 410569 - DNA, 25 bp, Mus musculus
ccaatagaatgcgaggccgaagccc

SEQ ID NO: 410570 - DNA, 25 bp, Mus musculus
ggactacgaggtgctgcacagcatc

SEQ ID NO: 410571 - DNA, 25 bp, Mus musculus
ctgaactctcgtgaaggaccgggct

SEQ ID NO: 410572 - DNA, 25 bp, Mus musculus
cgcggcgagcagaaagacgagctca

SEQ ID NO: 410573 - DNA, 25 bp, Mus musculus
gtagagcagctagacgcagacacca

SEQ ID NO: 410574 - DNA, 25 bp, Mus musculus
gctgtgcttcgccatcctgctggaa

SEQ ID NO: 410575 - DNA, 25 bp, Mus musculus
ggccaacaccagcaattccaacggg

SEQ ID NO: 410576 - DNA, 25 bp, Mus musculus
tcacgctcgggtccgtgtgaaaacg

SEQ ID NO: 410577 - DNA, 25 bp, Mus musculus
gctgctgctgaccttcatgttcatg

SEQ ID NO: 410578 - DNA, 25 bp, Mus musculus
gactccttccacatgctgtcggacg

SEQ ID NO: 410579 - DNA, 25 bp, Mus musculus
tcacgccacgcagaagaacacgttc

SEQ ID NO: 410580 - DNA, 25 bp, Mus musculus
gaacacgttcggctggatccgcgct

SEQ ID NO: 410581 - DNA, 25 bp, Mus musculus
gcgcactggtgaacgccatcttcct

SEQ ID NO: 410582 - DNA, 25 bp, Mus musculus
gcgcttcatcgagccgcatgagatg

SEQ ID NO: 410583 - DNA, 25 bp, Mus musculus
cgcatgagatgcagcagccgctcgt

SEQ ID NO: 410584 - DNA, 25 bp, Mus musculus
gggctctgtctgttccaccatcaca

SEQ ID NO: 410585 - DNA, 25 bp, Mus musculus
tgttccaccatcacagcggcgaggg

SEQ ID NO: 410586 - DNA, 25 bp, Mus musculus
cgccggaccaggaggagaccaacac

SEQ ID NO: 410587 - DNA, 25 bp, Mus musculus
gctggaagccgtcgagcgcttcatc

SEQ ID NO: 410588 - DNA, 25 bp, Mus musculus
gcggcagcctgtcgtccttcaagac

SEQ ID NO: 410589 - DNA, 25 bp, Mus musculus
catccgaaccatctcggaggatgtg

SEQ ID NO: 410590 - DNA, 25 bp, Mus musculus
tgccagtgacatccgaaccatctcg

SEQ ID NO: 410591 - DNA, 25 bp, Mus musculus
gcaccctttgccagtgacatccgaa

SEQ ID NO: 410592 - DNA, 25 bp, Mus musculus
gcatcgcaccctttgccagtgacat

SEQ ID NO: 410593 - DNA, 25 bp, Mus musculus
tcaagacccgcgctcgcatcgcacc

SEQ ID NO: 410594 - DNA, 25 bp, Mus musculus
aggcccataagctgacacgtcagtg

SEQ ID NO: 410595 - DNA, 25 bp, Mus musculus
gaggaggaggcccataagctgacac

SEQ ID NO: 410596 - DNA, 25 bp, Mus musculus
caggaggccctggagaagatgaagc

SEQ ID NO: 410597 - DNA, 25 bp, Mus musculus
tccgctccgtgttgcaggaggccct

SEQ ID NO: 410598 - DNA, 25 bp, Mus musculus
ctgttccgctccgtgttgcaggagg

SEQ ID NO: 410599 - DNA, 25 bp, Mus musculus
aaccatctcggaggatgtggagcgc

SEQ ID NO: 410600 - DNA, 25 bp, Mus musculus
cgcacctggagcatgccggagttca

SEQ ID NO: 410601 - DNA, 25 bp, Mus musculus
gacacgtcagtggagcttgaggccc

SEQ ID NO: 410602 - DNA, 25 bp, Mus musculus
ctgagttgctttcggtttctgagga

SEQ ID NO: 410603 - DNA, 25 bp, Mus musculus
gcgtggttatgtctcccgagaggca

SEQ ID NO: 410604 - DNA, 25 bp, Mus musculus
ttcgcctcagcagcgggttaggcca

SEQ ID NO: 410605 - DNA, 25 bp, Mus musculus
ggcactaggctgcttcgcctcagca

SEQ ID NO: 410606 - DNA, 25 bp, Mus musculus
gacggttagctcacccggacttcgc

SEQ ID NO: 410607 - DNA, 25 bp, Mus musculus
ggctcaccaccctgagttgctttcg

SEQ ID NO: 410608 - DNA, 25 bp, Mus musculus
aagtcttgcaaaagtgccctcggcc

SEQ ID NO: 410609 - DNA, 25 bp, Mus musculus
agctcacgttaacgggctgtgctca

SEQ ID NO: 410610 - DNA, 25 bp, Mus musculus
agaccctggcattaagctcacgtta

SEQ ID NO: 410611 - DNA, 25 bp, Mus musculus
cgcaggctcgagaccctggcattaa

SEQ ID NO: 410612 - DNA, 25 bp, Mus musculus
atcgagcacgcgctatagcaccggc

SEQ ID NO: 410613 - DNA, 25 bp, Mus musculus
cgggttctgtttccaatcgagcacg

SEQ ID NO: 410614 - DNA, 25 bp, Mus musculus
gctgtgctcacaagtcttgcaaaag

SEQ ID NO: 410615 - DNA, 25 bp, Mus musculus
ggacttcgccacttgcggggctcgc

SEQ ID NO: 410616 - DNA, 25 bp, Mus musculus
ttggtattcagctccgactctcatc

SEQ ID NO: 410617 - DNA, 25 bp, Mus musculus
aggtgttaatatggagccgccatca

SEQ ID NO: 410618 - DNA, 25 bp, Mus musculus
cctttctccatcatgccgggcatgg

SEQ ID NO: 410619 - DNA, 25 bp, Mus musculus
ccgagaagtgcagcccgccgttggc

SEQ ID NO: 410620 - DNA, 25 bp, Mus musculus
tctcgggctccgagaagtgcagccc

SEQ ID NO: 410621 - DNA, 25 bp, Mus musculus
aggcagagactctccagccgcggga

SEQ ID NO: 410622 - DNA, 25 bp, Mus musculus
ctgcaaagcaatgccaagatatatg

SEQ ID NO: 410623 - DNA, 25 bp, Mus musculus
atcccaacatctgcaaagcaatgcc

SEQ ID NO: 410624 - DNA, 25 bp, Mus musculus
ctgtgagcaaatatatctacctgga

SEQ ID NO: 410625 - DNA, 25 bp, Mus musculus
ttcagggatccgagcttggtattca

SEQ ID NO: 410626 - DNA, 25 bp, Mus musculus
tctacctggatcgaattcagggatc

SEQ ID NO: 410627 - DNA, 25 bp, Mus musculus
cgcgggagggaaccatgttcacctt

SEQ ID NO: 410628 - DNA, 25 bp, Mus musculus
gggttttcctgtgagcaaatatatc

SEQ ID NO: 410629 - DNA, 25 bp, Mus musculus
gttcaccttgccatgcacacatcta

SEQ ID NO: 410630 - DNA, 25 bp, Mus musculus
ccgtggctcttggttacggctgtgt

SEQ ID NO: 410631 - DNA, 25 bp, Mus musculus
ggagaacatcgtgcggcggtccaac

SEQ ID NO: 410632 - DNA, 25 bp, Mus musculus
cgtttctggagaacatcgtgcggcg

SEQ ID NO: 410633 - DNA, 25 bp, Mus musculus
ctagtggccccgcagaacacgtttc

SEQ ID NO: 410634 - DNA, 25 bp, Mus musculus
ttctggagaacatcgtgcggcggtc

SEQ ID NO: 410635 - DNA, 25 bp, Mus musculus
tggctcttggttacggctgtgtccc

SEQ ID NO: 410636 - DNA, 25 bp, Mus musculus
ctgtgtccccgagggatgcgcgcac

SEQ ID NO: 410637 - DNA, 25 bp, Mus musculus
cgagcccggggcactcgagcgcaca

SEQ ID NO: 410638 - DNA, 25 bp, Mus musculus
cactcgagcgcacacccgggcgggc

SEQ ID NO: 410639 - DNA, 25 bp, Mus musculus
ccaggaacgcttgcgggctgcgcac

SEQ ID NO: 410640 - DNA, 25 bp, Mus musculus
ccgcctgctgcggtgagacacggcg

SEQ ID NO: 410641 - DNA, 25 bp, Mus musculus
cccagagtccggcagtcgggaggat

SEQ ID NO: 410642 - DNA, 25 bp, Mus musculus
agtcgggaggatgaccatggctggc

SEQ ID NO: 410643 - DNA, 25 bp, Mus musculus
gaacacgtttctggagaacatcgtg

SEQ ID NO: 410644 - DNA, 25 bp, Mus musculus
cgaaatcacctggatcgcagtgtgc

SEQ ID NO: 410645 - DNA, 25 bp, Mus musculus
ccctgtctgtctcgcgcgggcgaaa

SEQ ID NO: 410646 - DNA, 25 bp, Mus musculus
cctgagatgttgtgcccgggttccc

SEQ ID NO: 410647 - DNA, 25 bp, Mus musculus
agcgcctggcctgagatgttgtgcc

SEQ ID NO: 410648 - DNA, 25 bp, Mus musculus
acctggatcgcagtgtgcagagctg

SEQ ID NO: 410649 - DNA, 25 bp, Mus musculus
gccctctgaccctgcggggcctcac

SEQ ID NO: 410650 - DNA, 25 bp, Mus musculus
ggactccgtgcctttgtgtcgccgc

SEQ ID NO: 410651 - DNA, 25 bp, Mus musculus
cctgtctccgcgcaggttaagtcgt

SEQ ID NO: 410652 - DNA, 25 bp, Mus musculus
gcgcaggttaagtcgtggcagcctt

SEQ ID NO: 410653 - DNA, 25 bp, Mus musculus
gtggcagcctttgcaaccacaggcc

SEQ ID NO: 410654 - DNA, 25 bp, Mus musculus
gagcctcccacgacctgctgcggca

SEQ ID NO: 410655 - DNA, 25 bp, Mus musculus
cgggaagcggaaacgctattgcgtt

SEQ ID NO: 410656 - DNA, 25 bp, Mus musculus
cacggacacgggaagcggaaacgct

SEQ ID NO: 410657 - DNA, 25 bp, Mus musculus
cgccctccagcacgcggacacggac

SEQ ID NO: 410658 - DNA, 25 bp, Mus musculus
cgacctgggcaaggatgctctggaa

SEQ ID NO: 410659 - DNA, 25 bp, Mus musculus
gatgggcagcaacagtcggagaccc

SEQ ID NO: 410660 - DNA, 25 bp, Mus musculus
cccatcatcgatgggcagcaacagt

SEQ ID NO: 410661 - DNA, 25 bp, Mus musculus
agcgagctgcagcacatctccgact

SEQ ID NO: 410662 - DNA, 25 bp, Mus musculus
gacagcgagctgcagcacatctccg

SEQ ID NO: 410663 - DNA, 25 bp, Mus musculus
gcaaggatgctctggaagtaccgga

SEQ ID NO: 410664 - DNA, 25 bp, Mus musculus
caatgcggccgacctgggcaaggat

SEQ ID NO: 410665 - DNA, 25 bp, Mus musculus
tctctgcagcaatgcggccgacctg

SEQ ID NO: 410666 - DNA, 25 bp, Mus musculus
tgtctctctgcagcaatgcggccga

SEQ ID NO: 410667 - DNA, 25 bp, Mus musculus
gtacccttcactgcgggcccgccag

SEQ ID NO: 410668 - DNA, 25 bp, Mus musculus
tgcagatccacaccggggtaccctt

SEQ ID NO: 410669 - DNA, 25 bp, Mus musculus
gcctgcgggagcacctgcagatcca

SEQ ID NO: 410670 - DNA, 25 bp, Mus musculus
cgtcgcttcacgctgcgcagcagcc

SEQ ID NO: 410671 - DNA, 25 bp, Mus musculus
cggggatgatcagcgacagcgagct

SEQ ID NO: 410672 - DNA, 25 bp, Mus musculus
agacgctcagccagtctgcagtaga

SEQ ID NO: 410673 - DNA, 25 bp, Mus musculus
aggtgcacatcggttctggagccca

SEQ ID NO: 410674 - DNA, 25 bp, Mus musculus
aggcgctgaggtgcacatcggttct

SEQ ID NO: 410675 - DNA, 25 bp, Mus musculus
aagcgtgcagccaagtgaccgcgga

SEQ ID NO: 410676 - DNA, 25 bp, Mus musculus
ccgccaggagcaagcgtgcagccaa

SEQ ID NO: 410677 - DNA, 25 bp, Mus musculus
atcgatgcctggctcccgccaggag

SEQ ID NO: 410678 - DNA, 25 bp, Mus musculus
tctcctccctgtggggagacgctca

SEQ ID NO: 410679 - DNA, 25 bp, Mus musculus
cagccagtctgcagtagagttcatc

SEQ ID NO: 410680 - DNA, 25 bp, Mus musculus
gacggctgatctcaatcactctcct

SEQ ID NO: 410681 - DNA, 25 bp, Mus musculus
ccctgtggatgacacggagcttcga

SEQ ID NO: 410682 - DNA, 25 bp, Mus musculus
tgacacggagcttcgagatgacata

SEQ ID NO: 410683 - DNA, 25 bp, Mus musculus
tcgagatgacatagccggacggctg

SEQ ID NO: 410684 - DNA, 25 bp, Mus musculus
gccggacggctgatctcaatcactc

SEQ ID NO: 410685 - DNA, 25 bp, Mus musculus
tagagttcatcgatgcctggctccc

SEQ ID NO: 410686 - DNA, 25 bp, Mus musculus
cggctctttgttatgttaattccct

SEQ ID NO: 410687 - DNA, 25 bp, Mus musculus
ggaggaccgtgcaccctatgtggat

SEQ ID NO: 410688 - DNA, 25 bp, Mus musculus
accgtgcaccctatgtggatggggc

SEQ ID NO: 410689 - DNA, 25 bp, Mus musculus
ctagtcccgctgagtgaacgctgcg

SEQ ID NO: 410690 - DNA, 25 bp, Mus musculus
gttatgttaattcccttcccagctg

SEQ ID NO: 410691 - DNA, 25 bp, Mus musculus
catgccggcgaaaccgcgcttctga

SEQ ID NO: 410692 - DNA, 25 bp, Mus musculus
cctgcggagcgagctctgatgcttt

SEQ ID NO: 410693 - DNA, 25 bp, Mus musculus
gagcgagctctgatgctttccagtc

SEQ ID NO: 410694 - DNA, 25 bp, Mus musculus
tgcctgcacaatgggcgcccggagc

SEQ ID NO: 410695 - DNA, 25 bp, Mus musculus
ccggtgcacgacagccggcgaccgc

SEQ ID NO: 410696 - DNA, 25 bp, Mus musculus
acccactgtctgtgcctcgcgaggc

SEQ ID NO: 410697 - DNA, 25 bp, Mus musculus
catacgcctgcacccactgtctgtg

SEQ ID NO: 410698 - DNA, 25 bp, Mus musculus
acggcgtcaccgacatacgcctgca

SEQ ID NO: 410699 - DNA, 25 bp, Mus musculus
aaaccgcgcttctgaggcctgcgga

SEQ ID NO: 410700 - DNA, 25 bp, Mus musculus
ttgttccgcggaacgcgcatccctg

SEQ ID NO: 410701 - DNA, 25 bp, Mus musculus
cccgctgtgtccagctgcgccctag

SEQ ID NO: 410702 - DNA, 25 bp, Mus musculus
acaaggtgtcagctccggcagcggc

SEQ ID NO: 410703 - DNA, 25 bp, Mus musculus
gcgcgccctggggtcacggctctta

SEQ ID NO: 410704 - DNA, 25 bp, Mus musculus
gactcgccgccacggggtcttcgcc

SEQ ID NO: 410705 - DNA, 25 bp, Mus musculus
caggccgaccctcctgctacccggg

SEQ ID NO: 410706 - DNA, 25 bp, Mus musculus
gcagcggcgccttgttccgcggaac

SEQ ID NO: 410707 - DNA, 25 bp, Mus musculus
gacacaaggtgtcagctccggcagc

SEQ ID NO: 410708 - DNA, 25 bp, Mus musculus
ctgcggcccggcactcgggaaagtt

SEQ ID NO: 410709 - DNA, 25 bp, Mus musculus
ggtggaccttggtgccccgctcctg

SEQ ID NO: 410710 - DNA, 25 bp, Mus musculus
tgccctggtccttcgccgagctgct

SEQ ID NO: 410711 - DNA, 25 bp, Mus musculus
tggcggggccacactccagcccgca

SEQ ID NO: 410712 - DNA, 25 bp, Mus musculus
ccagcccgcagctgccctggtcctt

SEQ ID NO: 410713 - DNA, 25 bp, Mus musculus
gcactcgggaaagttgcggggccga

SEQ ID NO: 410714 - DNA, 25 bp, Mus musculus
gaccgccattgttgaggactccacg

SEQ ID NO: 410715 - DNA, 25 bp, Mus musculus
ccggtctcgaggctgacgaccgcgt

SEQ ID NO: 410716 - DNA, 25 bp, Mus musculus
gagtcgtagtttccgccggtctcga

SEQ ID NO: 410717 - DNA, 25 bp, Mus musculus
cgctagcttccagcgccgctttgta

SEQ ID NO: 410718 - DNA, 25 bp, Mus musculus
gcgcggcctcactgccgctagcttc

SEQ ID NO: 410719 - DNA, 25 bp, Mus musculus
tgcgtgagcgcccacgcagctgacg

SEQ ID NO: 410720 - DNA, 25 bp, Mus musculus
gccacgacttccctctcgcccggcg

SEQ ID NO: 410721 - DNA, 25 bp, Mus musculus
acggcctgtcagcaccacgctcccg

SEQ ID NO: 410722 - DNA, 25 bp, Mus musculus
gtctcccatttctcccacggcctgt

SEQ ID NO: 410723 - DNA, 25 bp, Mus musculus
gcccaaagctgagaagacaaaccaa

SEQ ID NO: 410724 - DNA, 25 bp, Mus musculus
ccggctgagcccaaagctgagaaga

SEQ ID NO: 410725 - DNA, 25 bp, Mus musculus
acgcagacgtgcaccaggcccggag

SEQ ID NO: 410726 - DNA, 25 bp, Mus musculus
tgttgaggactccacgcagacgtgc

SEQ ID NO: 410727 - DNA, 25 bp, Mus musculus
ggagctcggcgctcatctgcatctc

SEQ ID NO: 410728 - DNA, 25 bp, Mus musculus
agcttgctcttcttaggcctcgggc

SEQ ID NO: 410729 - DNA, 25 bp, Mus musculus
gcgcctaggccggtgtcccgcatta

SEQ ID NO: 410730 - DNA, 25 bp, Mus musculus
ggtcgcgcaccgtcggcacgtgaca

SEQ ID NO: 410731 - DNA, 25 bp, Mus musculus
tagtttggcccacaacctcgactta

SEQ ID NO: 410732 - DNA, 25 bp, Mus musculus
aagcggaaccttccacggtcgcgca

SEQ ID NO: 410733 - DNA, 25 bp, Mus musculus
tcttcttaggcctcgggccagaggg

SEQ ID NO: 410734 - DNA, 25 bp, Mus musculus
gcattagcttcccttacagtccgga

SEQ ID NO: 410735 - DNA, 25 bp, Mus musculus
ggggcgtcttctccgcgcatcgctt

SEQ ID NO: 410736 - DNA, 25 bp, Mus musculus
gcttgccttccacttaccttcgatc

SEQ ID NO: 410737 - DNA, 25 bp, Mus musculus
accttcgatcgccatgatgcgctcg

SEQ ID NO: 410738 - DNA, 25 bp, Mus musculus
gccatgatgcgctcgccatggaccg

SEQ ID NO: 410739 - DNA, 25 bp, Mus musculus
gggtaagtgctggagcttgctcttc

SEQ ID NO: 410740 - DNA, 25 bp, Mus musculus
ccctcgcaacaactatagtttggcc

SEQ ID NO: 410741 - DNA, 25 bp, Mus musculus
ggtgtcccgcattagcttcccttac

SEQ ID NO: 410742 - DNA, 25 bp, Mus musculus
cccgacctgtcgtagaaggggtgct

SEQ ID NO: 410743 - DNA, 25 bp, Mus musculus
cgggagccgtaaagcaaagctgctt

SEQ ID NO: 410744 - DNA, 25 bp, Mus musculus
tcgcacgtgggcacgctggctttac

SEQ ID NO: 410745 - DNA, 25 bp, Mus musculus
ttcccagtggcaagttgtcgctgtc

SEQ ID NO: 410746 - DNA, 25 bp, Mus musculus
ggaaacgtcaagctcgccacaaaca

SEQ ID NO: 410747 - DNA, 25 bp, Mus musculus
ccggcgtttgcccatagcggaaacg

SEQ ID NO: 410748 - DNA, 25 bp, Mus musculus
ccgaagtcgcggaggtgcttcttct

SEQ ID NO: 410749 - DNA, 25 bp, Mus musculus
aaagctgctttacgcccagagagta

SEQ ID NO: 410750 - DNA, 25 bp, Mus musculus
cccagagagtacgacaggcgttaca

SEQ ID NO: 410751 - DNA, 25 bp, Mus musculus
cctggctgggctaagctgcgatttc

SEQ ID NO: 410752 - DNA, 25 bp, Mus musculus
taggcgtgtctacgcatgcgtgatc

SEQ ID NO: 410753 - DNA, 25 bp, Mus musculus
ctgccggagcgcctctagcacatag

SEQ ID NO: 410754 - DNA, 25 bp, Mus musculus
ggcgttacaccctctggtcgctata

SEQ ID NO: 410755 - DNA, 25 bp, Mus musculus
cttcttggtcatggtgctgagcatc

SEQ ID NO: 410756 - DNA, 25 bp, Mus musculus
ggacgccggcgttggcaagccacct

SEQ ID NO: 410757 - DNA, 25 bp, Mus musculus
tcctgagcacggactgaggccaggt

SEQ ID NO: 410758 - DNA, 25 bp, Mus musculus
ttggcaagccacctgagggaggaca

SEQ ID NO: 410759 - DNA, 25 bp, Mus musculus
aggggcgacgctcttctatttcgac

SEQ ID NO: 410760 - DNA, 25 bp, Mus musculus
gccacacctggagggcgtgaccaga

SEQ ID NO: 410761 - DNA, 25 bp, Mus musculus
ttcgacgtgaactcctagaaccctc

SEQ ID NO: 410762 - DNA, 25 bp, Mus musculus
ggtgaggcccacacagggaccgctc

SEQ ID NO: 410763 - DNA, 25 bp, Mus musculus
acagggaccgctccctcggtggcag

SEQ ID NO: 410764 - DNA, 25 bp, Mus musculus
gcccaggaacgcagaggatcagatt

SEQ ID NO: 410765 - DNA, 25 bp, Mus musculus
ttgtgcacctgctcctgagcacgga

SEQ ID NO: 410766 - DNA, 25 bp, Mus musculus
aatgcaccaatcctgaactccgggg

SEQ ID NO: 410767 - DNA, 25 bp, Mus musculus
gctgtggcatccagggctaggctct

SEQ ID NO: 410768 - DNA, 25 bp, Mus musculus
cggcggtgtgaactcttgtgcacct

SEQ ID NO: 410769 - DNA, 25 bp, Mus musculus
ggatcagatttctcgcaatgcacca

SEQ ID NO: 410770 - DNA, 25 bp, Mus musculus
tccgtccgcagcctcttcaaaggtt

SEQ ID NO: 410771 - DNA, 25 bp, Mus musculus
ctcttcaaaggttctggcttgcgtt

SEQ ID NO: 410772 - DNA, 25 bp, Mus musculus
ctggcttgcgtttgcttttcaaatg

SEQ ID NO: 410773 - DNA, 25 bp, Mus musculus
gcggagtaagccagtgcgcatgcac

SEQ ID NO: 410774 - DNA, 25 bp, Mus musculus
gcgcatgcacgtcaggctgtctttc

SEQ ID NO: 410775 - DNA, 25 bp, Mus musculus
ggcttctgcacacactgtcgggttt

SEQ ID NO: 410776 - DNA, 25 bp, Mus musculus
tgtcgggttttcacagtaccgagtg

SEQ ID NO: 410777 - DNA, 25 bp, Mus musculus
aacctgcggcggaaatgctagccga

SEQ ID NO: 410778 - DNA, 25 bp, Mus musculus
ctagccgagtgtcttgaggcagagc

SEQ ID NO: 410779 - DNA, 25 bp, Mus musculus
ggcagagcgcttccttttgtaacta

SEQ ID NO: 410780 - DNA, 25 bp, Mus musculus
tttgtaactagtctaccaccgcgta

SEQ ID NO: 410781 - DNA, 25 bp, Mus musculus
gtctaccaccgcgtaggcacgtgtg

SEQ ID NO: 410782 - DNA, 25 bp, Mus musculus
cgcggactgacaactggcggtccca

SEQ ID NO: 410783 - DNA, 25 bp, Mus musculus
tctaaggtggctttacctcccactc

SEQ ID NO: 410784 - DNA, 25 bp, Mus musculus
tccttcagctgaagacgagcgatca

SEQ ID NO: 410785 - DNA, 25 bp, Mus musculus
agactccagcggctctggtggttcc

SEQ ID NO: 410786 - DNA, 25 bp, Mus musculus
aggcttccgggccatagactccagc

SEQ ID NO: 410787 - DNA, 25 bp, Mus musculus
agctgcagtctcctgtccaggcttc

SEQ ID NO: 410788 - DNA, 25 bp, Mus musculus
gtgatccgccactttcgcagctgca

SEQ ID NO: 410789 - DNA, 25 bp, Mus musculus
cagacactgccgagctgggtaagca

SEQ ID NO: 410790 - DNA, 25 bp, Mus musculus
cctgggttacatgtggaactggctg

SEQ ID NO: 410791 - DNA, 25 bp, Mus musculus
cgcgggccgaggattttaatgatcc

SEQ ID NO: 410792 - DNA, 25 bp, Mus musculus
ccctgcgcacaagcgactgggacga

SEQ ID NO: 410793 - DNA, 25 bp, Mus musculus
tggagaaaactgaagacacccggct

SEQ ID NO: 410794 - DNA, 25 bp, Mus musculus
tgatgtcagagcagcccggaaagtc

SEQ ID NO: 410795 - DNA, 25 bp, Mus musculus
ctggcagcggttcctggaggaaata

SEQ ID NO: 410796 - DNA, 25 bp, Mus musculus
atcagatctggtggacccgtgagcc

SEQ ID NO: 410797 - DNA, 25 bp, Mus musculus
gggcctccgtggcactagcaagata

SEQ ID NO: 410798 - DNA, 25 bp, Mus musculus
actcggcttcccagtaggcggcgag

SEQ ID NO: 410799 - DNA, 25 bp, Mus musculus
gggcgcaagaacctgaacggtgccc

SEQ ID NO: 410800 - DNA, 25 bp, Mus musculus
aaggaccggcgcagtgcattcgaga

SEQ ID NO: 410801 - DNA, 25 bp, Mus musculus
tcaacgccgaacttggccgcagggt

SEQ ID NO: 410802 - DNA, 25 bp, Mus musculus
cattcgagacgtagaagcttgctcc

SEQ ID NO: 410803 - DNA, 25 bp, Mus musculus
ggcgaccgcgttcccagaagtctca

SEQ ID NO: 410804 - DNA, 25 bp, Mus musculus
agcttgctccttctagctcttcaga

SEQ ID NO: 410805 - DNA, 25 bp, Mus musculus
gcgcatgacctctccttgccggatc

SEQ ID NO: 410806 - DNA, 25 bp, Mus musculus
cgattgctgtgcagcgtcggaagcc

SEQ ID NO: 410807 - DNA, 25 bp, Mus musculus
ttctagctcttcagaggatcggagg

SEQ ID NO: 410808 - DNA, 25 bp, Mus musculus
cggagctctcgaagcggagtccgca

SEQ ID NO: 410809 - DNA, 25 bp, Mus musculus
cccagaagtctcaacgccgaacttg

SEQ ID NO: 410810 - DNA, 25 bp, Mus musculus
cagaccggggcgcaagaacctgaac

SEQ ID NO: 410811 - DNA, 25 bp, Mus musculus
ggagtccgcagtgttgcgcctccgc

SEQ ID NO: 410812 - DNA, 25 bp, Mus musculus
caggaggctccctgaatggtccctg

SEQ ID NO: 410813 - DNA, 25 bp, Mus musculus
cgcacacggaggtgccccacgtgta

SEQ ID NO: 410814 - DNA, 25 bp, Mus musculus
cccacgtgtagctgcgcagaaacca

SEQ ID NO: 410815 - DNA, 25 bp, Mus musculus
cgtgtagctgcgcagaaaccaaaac

SEQ ID NO: 410816 - DNA, 25 bp, Mus musculus
agctgcgcagaaaccaaaacacacg

SEQ ID NO: 410817 - DNA, 25 bp, Mus musculus
aaaacacacgccacgcgcttggtga

SEQ ID NO: 410818 - DNA, 25 bp, Mus musculus
acgcgcttggtgagccgccacctag

SEQ ID NO: 410819 - DNA, 25 bp, Mus musculus
gccctcgagttcaggaggctccctg

SEQ ID NO: 410820 - DNA, 25 bp, Mus musculus
aggctccctgaatggtccctgcgtt

SEQ ID NO: 410821 - DNA, 25 bp, Mus musculus
gctccctgaatggtccctgcgttgt

SEQ ID NO: 410822 - DNA, 25 bp, Mus musculus
tggtccctgcgttgtccgggagaaa

SEQ ID NO: 410823 - DNA, 25 bp, Mus musculus
aaaggagaaggccacgccgatccca

SEQ ID NO: 410824 - DNA, 25 bp, Mus musculus
ccacgccgatcccacccaaaccgca

SEQ ID NO: 410825 - DNA, 25 bp, Mus musculus
ggtgagccgccacctaggttgtccc

SEQ ID NO: 410826 - DNA, 25 bp, Mus musculus
tggtcaatcggtcagcacaattagg

SEQ ID NO: 410827 - DNA, 25 bp, Mus musculus
ccgaactaagtgaacgcgggctaga

SEQ ID NO: 410828 - DNA, 25 bp, Mus musculus
tcctccggagctcaggatgggacac

SEQ ID NO: 410829 - DNA, 25 bp, Mus musculus
tggagaaacgtgtcaccactaggtg

SEQ ID NO: 410830 - DNA, 25 bp, Mus musculus
ggtagggacttcctgtcctcataga

SEQ ID NO: 410831 - DNA, 25 bp, Mus musculus
tctggccagctctaggtagggactt

SEQ ID NO: 410832 - DNA, 25 bp, Mus musculus
atgacaccacctccgggacaaagga

SEQ ID NO: 410833 - DNA, 25 bp, Mus musculus
caaagtacgtggctggtcaatcggt

SEQ ID NO: 410834 - DNA, 25 bp, Mus musculus
acaggcgaaattgttctctaagtca

SEQ ID NO: 410835 - DNA, 25 bp, Mus musculus
ggagatgcctgttccaccttactta

SEQ ID NO: 410836 - DNA, 25 bp, Mus musculus
tccgggacaaaggaagcacatgctg

SEQ ID NO: 410837 - DNA, 25 bp, Mus musculus
gcacaattaggggagcatagaacca

SEQ ID NO: 410838 - DNA, 25 bp, Mus musculus
tacttaggtctccttttcagaaaca

SEQ ID NO: 410839 - DNA, 25 bp, Mus musculus
tagaaccaaaacagggagtgcaggg

SEQ ID NO: 410840 - DNA, 25 bp, Mus musculus
ctgtcaagtgtccagcccacaactg

SEQ ID NO: 410841 - DNA, 25 bp, Mus musculus
gctaaggccgcaacacgctgcaggc

SEQ ID NO: 410842 - DNA, 25 bp, Mus musculus
gctttggctttctcgccaggtggca

SEQ ID NO: 410843 - DNA, 25 bp, Mus musculus
gctttctcgccaggtggcagaggcc

SEQ ID NO: 410844 - DNA, 25 bp, Mus musculus
ggcagaggccctccgcaaaagagca

SEQ ID NO: 410845 - DNA, 25 bp, Mus musculus
cagtttttgcggattgtaacggaat

SEQ ID NO: 410846 - DNA, 25 bp, Mus musculus
tcacgccttgccttcttcgttggca

SEQ ID NO: 410847 - DNA, 25 bp, Mus musculus
ttgccttcttcgttggcaccgaatc

SEQ ID NO: 410848 - DNA, 25 bp, Mus musculus
ccgaatcagcgatcactgtcaagtg

SEQ ID NO: 410849 - DNA, 25 bp, Mus musculus
gtccagcccacaactgcgatacagt

SEQ ID NO: 410850 - DNA, 25 bp, Mus musculus
actgcgatacagtttttgcggattg

SEQ ID NO: 410851 - DNA, 25 bp, Mus musculus
tgtgtacccgagtgtgaccgatcgc

SEQ ID NO: 410852 - DNA, 25 bp, Mus musculus
taacggaatgtaagggaagctggaa

SEQ ID NO: 410853 - DNA, 25 bp, Mus musculus
tggcaccgaatcagcgatcactgtc

SEQ ID NO: 410854 - DNA, 25 bp, Mus musculus
gaccagcttggagatggcccttcca

SEQ ID NO: 410855 - DNA, 25 bp, Mus musculus
aaaccaaatagctcaccctgctgca

SEQ ID NO: 410856 - DNA, 25 bp, Mus musculus
aggtgctcgcgcctccatgcgcagg

SEQ ID NO: 410857 - DNA, 25 bp, Mus musculus
aaggtccgcggaggcttacacaggc

SEQ ID NO: 410858 - DNA, 25 bp, Mus musculus
agctcaccctgctgcatcctccgag

SEQ ID NO: 410859 - DNA, 25 bp, Mus musculus
cagcttggagatggcccttccaggt

SEQ ID NO: 410860 - DNA, 25 bp, Mus musculus
ttggaccagcttggagatggccctt

SEQ ID NO: 410861 - DNA, 25 bp, Mus musculus
tcctaagattggaccagcttggaga

SEQ ID NO: 410862 - DNA, 25 bp, Mus musculus
cctttcctaagattggaccagcttg

SEQ ID NO: 410863 - DNA, 25 bp, Mus musculus
gccgcctttcctaagattggaccag

SEQ ID NO: 410864 - DNA, 25 bp, Mus musculus
gtgccgcctttcctaagattggacc

SEQ ID NO: 410865 - DNA, 25 bp, Mus musculus
gcgtgccgcctttcctaagattgga

SEQ ID NO: 410866 - DNA, 25 bp, Mus musculus
gcggcgtgccgcctttcctaagatt

SEQ ID NO: 410867 - DNA, 25 bp, Mus musculus
cctccagcagaaggtccgcggaggc

SEQ ID NO: 410868 - DNA, 25 bp, Mus musculus
tgagaccctacagcatccaatgtgc

SEQ ID NO: 410869 - DNA, 25 bp, Mus musculus
ccaatgtgctctcttcctcttgttg

SEQ ID NO: 410870 - DNA, 25 bp, Mus musculus
ttcctcgttttgctgagaccctaca

SEQ ID NO: 410871 - DNA, 25 bp, Mus musculus
agggagacatccgatgaaatcggtc

SEQ ID NO: 410872 - DNA, 25 bp, Mus musculus
ttccagaagcagaggtaagacacgc

SEQ ID NO: 410873 - DNA, 25 bp, Mus musculus
cgccgctttcctcgttttgctgaga

SEQ ID NO: 410874 - DNA, 25 bp, Mus musculus
cgatgaaatcggtcttttcgggtcg

SEQ ID NO: 410875 - DNA, 25 bp, Mus musculus
cgcaagctccagaaagggagacatc

SEQ ID NO: 410876 - DNA, 25 bp, Mus musculus
tggcaccgcaagctccagaaaggga

SEQ ID NO: 410877 - DNA, 25 bp, Mus musculus
gtcttcttctgctgctggcaccgca

SEQ ID NO: 410878 - DNA, 25 bp, Mus musculus
gcaccgtcgccaccatcgtcttctt

SEQ ID NO: 410879 - DNA, 25 bp, Mus musculus
tgttgctcctgctgggcaccgtcgc

SEQ ID NO: 410880 - DNA, 25 bp, Mus musculus
ttcctcttgttgctcctgctgggca

SEQ ID NO: 410881 - DNA, 25 bp, Mus musculus
cttttcgggtcgttccagaagcaga

SEQ ID NO: 410882 - DNA, 25 bp, Mus musculus
gatcgtaatcgatggtcttcagtga

SEQ ID NO: 410883 - DNA, 25 bp, Mus musculus
tcctcctctgcggatttttctgacg

SEQ ID NO: 410884 - DNA, 25 bp, Mus musculus
tcagagctccgggaacgcgtcctac

SEQ ID NO: 410885 - DNA, 25 bp, Mus musculus
gggaacgcgtcctaccgctgttcta

SEQ ID NO: 410886 - DNA, 25 bp, Mus musculus
gctgttctatgtcctcctctgcgga

SEQ ID NO: 410887 - DNA, 25 bp, Mus musculus
ttctcctgtgtcatcctcctcagag

SEQ ID NO: 410888 - DNA, 25 bp, Mus musculus
ggtagctaatgcttctcctgtgtca

SEQ ID NO: 410889 - DNA, 25 bp, Mus musculus
cgagcggtcggtagctaatgcttct

SEQ ID NO: 410890 - DNA, 25 bp, Mus musculus
cgatggtcttcagtgagtgatgctc

SEQ ID NO: 410891 - DNA, 25 bp, Mus musculus
ggcagagtgatcgtaatcgatggtc

SEQ ID NO: 410892 - DNA, 25 bp, Mus musculus
taccgctgttctatgtcctcctctg

SEQ ID NO: 410893 - DNA, 25 bp, Mus musculus
gacggcgcagcgcaatttagaggtg

SEQ ID NO: 410894 - DNA, 25 bp, Mus musculus
tgtcatcctcctcagagctccggga

SEQ ID NO: 410895 - DNA, 25 bp, Mus musculus
cagtgagtgatgctcgtttgcgagc

SEQ ID NO: 410896 - DNA, 25 bp, Mus musculus
ggcttgtccaacgtccgcgcagctt

SEQ ID NO: 410897 - DNA, 25 bp, Mus musculus
agctctgccttacacccacttggta

SEQ ID NO: 410898 - DNA, 25 bp, Mus musculus
cgctttaagccctcggcaatgcctg

SEQ ID NO: 410899 - DNA, 25 bp, Mus musculus
caatgcctgtcctgcgtcccagaga

SEQ ID NO: 410900 - DNA, 25 bp, Mus musculus
tcgatggaactcgtagcaacctacc

SEQ ID NO: 410901 - DNA, 25 bp, Mus musculus
actgcctgatccctctggcgtgaaa

SEQ ID NO: 410902 - DNA, 25 bp, Mus musculus
tagggccggaagttccagactgctg

SEQ ID NO: 410903 - DNA, 25 bp, Mus musculus
gcctgagcgagccacttctactttc

SEQ ID NO: 410904 - DNA, 25 bp, Mus musculus
ctttccagtctcctgcgatcgattc

SEQ ID NO: 410905 - DNA, 25 bp, Mus musculus
cgatcgattcgtagtgcctgtgtgg

SEQ ID NO: 410906 - DNA, 25 bp, Mus musculus
cgaggtggttcgcattgccaagaag

SEQ ID NO: 410907 - DNA, 25 bp, Mus musculus
cggtcagttgcagacgggccgtaaa

SEQ ID NO: 410908 - DNA, 25 bp, Mus musculus
tgagcccaggactgaagccctcgac

SEQ ID NO: 410909 - DNA, 25 bp, Mus musculus
aaagtgtgtttatcccagctctgcc

SEQ ID NO: 410910 - DNA, 25 bp, Mus musculus
gcagcgcgctcctctgcagcgccgt

SEQ ID NO: 410911 - DNA, 25 bp, Mus musculus
tgccggagcccaacgctgccgctcc

SEQ ID NO: 410912 - DNA, 25 bp, Mus musculus
cagcccggagatgccgcagaagcgc

SEQ ID NO: 410913 - DNA, 25 bp, Mus musculus
cgcgctgggactagcggcgggcggt

SEQ ID NO: 410914 - DNA, 25 bp, Mus musculus
ctgcccgcccggagccaccgcctgc

SEQ ID NO: 410915 - DNA, 25 bp, Mus musculus
cccgaagccttccttggggacgctg

SEQ ID NO: 410916 - DNA, 25 bp, Mus musculus
cccaggcatggcggggtacctgtcc

SEQ ID NO: 410917 - DNA, 25 bp, Mus musculus
ccgaagccttccttggggacgctgc

SEQ ID NO: 410918 - DNA, 25 bp, Mus musculus
gaagccttccttggggacgctgccc

SEQ ID NO: 410919 - DNA, 25 bp, Mus musculus
gcgctgatcctccagcccggggttg

SEQ ID NO: 410920 - DNA, 25 bp, Mus musculus
gctgatcctccagcccggggttgct

SEQ ID NO: 410921 - DNA, 25 bp, Mus musculus
atcctccagcccggggttgctgacg

SEQ ID NO: 410922 - DNA, 25 bp, Mus musculus
cggggttgctgacgcctccacccgg

SEQ ID NO: 410923 - DNA, 25 bp, Mus musculus
cgcagcccggagatgccgcagaagc

SEQ ID NO: 410924 - DNA, 25 bp, Mus musculus
cgagagcgaggccaagcagtaccgc

SEQ ID NO: 410925 - DNA, 25 bp, Mus musculus
agcagtaccgccgtgagctggagac

SEQ ID NO: 410926 - DNA, 25 bp, Mus musculus
gaagacatcgccctgcagaagctga

SEQ ID NO: 410927 - DNA, 25 bp, Mus musculus
ccgcggtggaggagaacctccgcaa

SEQ ID NO: 410928 - DNA, 25 bp, Mus musculus
aaggaggccgccgaaaatgaactga

SEQ ID NO: 410929 - DNA, 25 bp, Mus musculus
accgccgtgagctggagacgatcgt

SEQ ID NO: 410930 - DNA, 25 bp, Mus musculus
tggaggagaacctccgcaacttccg

SEQ ID NO: 410931 - DNA, 25 bp, Mus musculus
aggccaagcagtaccgccgtgagct

SEQ ID NO: 410932 - DNA, 25 bp, Mus musculus
tcgccctgcagaagctgagggccga

SEQ ID NO: 410933 - DNA, 25 bp, Mus musculus
aacgtggaagacatcgccctgcaga

SEQ ID NO: 410934 - DNA, 25 bp, Mus musculus
gcaacagaggaacgtggaagacatc

SEQ ID NO: 410935 - DNA, 25 bp, Mus musculus
actgaggaagcaacagaggaacgtg

SEQ ID NO: 410936 - DNA, 25 bp, Mus musculus
ccgccgaaaatgaactgaggaagca

SEQ ID NO: 410937 - DNA, 25 bp, Mus musculus
agacgatcgtgagggagaaggaagc

SEQ ID NO: 410938 - DNA, 25 bp, Mus musculus
tgcctgaccagctcaagcaccggtg

SEQ ID NO: 410939 - DNA, 25 bp, Mus musculus
gccatgcgcacagttcctgctttta

SEQ ID NO: 410940 - DNA, 25 bp, Mus musculus
gatggctaccaaaagtcggacctta

SEQ ID NO: 410941 - DNA, 25 bp, Mus musculus
cactgagcagctgtaggcacttgga

SEQ ID NO: 410942 - DNA, 25 bp, Mus musculus
cctggagcgggatacttctcgaatc

SEQ ID NO: 410943 - DNA, 25 bp, Mus musculus
ctgtcaccagccaggacgcggatta

SEQ ID NO: 410944 - DNA, 25 bp, Mus musculus
caaaggcttcaacttccgggtgatc

SEQ ID NO: 410945 - DNA, 25 bp, Mus musculus
gcggccatgtgcatgacagccaata

SEQ ID NO: 410946 - DNA, 25 bp, Mus musculus
gccgcagacggactaactaatcagg

SEQ ID NO: 410947 - DNA, 25 bp, Mus musculus
tcgtgacccggaagtcaaaggcttc

SEQ ID NO: 410948 - DNA, 25 bp, Mus musculus
gttgcccgtctgaccaatcaccttg

SEQ ID NO: 410949 - DNA, 25 bp, Mus musculus
tgaccctgtgtgttctctagctccg

SEQ ID NO: 410950 - DNA, 25 bp, Mus musculus
gcgcagcgatccgttcaggagaaga

SEQ ID NO: 410951 - DNA, 25 bp, Mus musculus
cggtcttagaccacgtgacatccca

SEQ ID NO: 410952 - DNA, 25 bp, Mus musculus
gaccgccttggactcccgaagttca

SEQ ID NO: 410953 - DNA, 25 bp, Mus musculus
ggccaccgaggcctttagactgaag

SEQ ID NO: 410954 - DNA, 25 bp, Mus musculus
ttcgatctctggaaactgcctgtta

SEQ ID NO: 410955 - DNA, 25 bp, Mus musculus
ttagactgaagggaccagcccgcca

SEQ ID NO: 410956 - DNA, 25 bp, Mus musculus
gcgggtccgatctacgtatttactc

SEQ ID NO: 410957 - DNA, 25 bp, Mus musculus
gaagttcaattgtctgtcccagcca

SEQ ID NO: 410958 - DNA, 25 bp, Mus musculus
gtcggatgaagagaggacactcacc

SEQ ID NO: 410959 - DNA, 25 bp, Mus musculus
gcagaagccctctctttttattcga

SEQ ID NO: 410960 - DNA, 25 bp, Mus musculus
tgtctaagttttcccttcgcgctgt

SEQ ID NO: 410961 - DNA, 25 bp, Mus musculus
ccagccagtgatctgcgggtccgat

SEQ ID NO: 410962 - DNA, 25 bp, Mus musculus
aaggagccgaaccaaagtccgagca

SEQ ID NO: 410963 - DNA, 25 bp, Mus musculus
ctctggtaaaaacaggacatccctt

SEQ ID NO: 410964 - DNA, 25 bp, Mus musculus
tcgctttccttccagtgtctaagtt

SEQ ID NO: 410965 - DNA, 25 bp, Mus musculus
agcggcgttagcgagcagaagaaaa

SEQ ID NO: 410966 - DNA, 25 bp, Mus musculus
caggactccggagcaaccttgggaa

SEQ ID NO: 410967 - DNA, 25 bp, Mus musculus
actgtgaacctcagcgctcgcagga

SEQ ID NO: 410968 - DNA, 25 bp, Mus musculus
tgcgagattgagagcgcagccatcc

SEQ ID NO: 410969 - DNA, 25 bp, Mus musculus
ccgcagctacttggacggccagttc

SEQ ID NO: 410970 - DNA, 25 bp, Mus musculus
gagtgaactcctagtgccattggcc

SEQ ID NO: 410971 - DNA, 25 bp, Mus musculus
aggagcctgccaattaccggtcttc

SEQ ID NO: 410972 - DNA, 25 bp, Mus musculus
tcgcagtggctaaattctcggagtc

SEQ ID NO: 410973 - DNA, 25 bp, Mus musculus
ggatcactccttgtgggagacctca

SEQ ID NO: 410974 - DNA, 25 bp, Mus musculus
gtcgcagcatgagtcgccatacgga

SEQ ID NO: 410975 - DNA, 25 bp, Mus musculus
ccatacggacttggtgaggagcttc

SEQ ID NO: 410976 - DNA, 25 bp, Mus musculus
gtgagtgacactccagccatcaagc

SEQ ID NO: 410977 - DNA, 25 bp, Mus musculus
ggcaatcctcgctcgtgagttcagc

SEQ ID NO: 410978 - DNA, 25 bp, Mus musculus
taccggtcttcattggctgctggaa

SEQ ID NO: 410979 - DNA, 25 bp, Mus musculus
ctcatattccgctgtcgcacgactg

SEQ ID NO: 410980 - DNA, 25 bp, Mus musculus
tggctgacacttacgctgtggtgca

SEQ ID NO: 410981 - DNA, 25 bp, Mus musculus
gacgcacaggggacaacggcactgc

SEQ ID NO: 410982 - DNA, 25 bp, Mus musculus
acacggaggacgcacaggggacaac

SEQ ID NO: 410983 - DNA, 25 bp, Mus musculus
accggtggcacacacggaggacgca

SEQ ID NO: 410984 - DNA, 25 bp, Mus musculus
aggtggctccacgtgcccagcgacc

SEQ ID NO: 410985 - DNA, 25 bp, Mus musculus
tctacagccaggtggctccacgtgc

SEQ ID NO: 410986 - DNA, 25 bp, Mus musculus
agaagcgtggcgcttcggcgggcac

SEQ ID NO: 410987 - DNA, 25 bp, Mus musculus
acttacgctgtggtgcagaagcgtg

SEQ ID NO: 410988 - DNA, 25 bp, Mus musculus
ctgacacttacgctgtggtgcagaa

SEQ ID NO: 410989 - DNA, 25 bp, Mus musculus
cccatggctgacacttacgctgtgg

SEQ ID NO: 410990 - DNA, 25 bp, Mus musculus
cacaggggacaacggcactgcgccg

SEQ ID NO: 410991 - DNA, 25 bp, Mus musculus
cacacacggaggacgcacaggggac

SEQ ID NO: 410992 - DNA, 25 bp, Mus musculus
gacacttacgctgtggtgcagaagc

SEQ ID NO: 410993 - DNA, 25 bp, Mus musculus
ccagcgaccggtggcacacacggag

SEQ ID NO: 410994 - DNA, 25 bp, Mus musculus
gaggctcgggcgcgcactcgttcct

SEQ ID NO: 410995 - DNA, 25 bp, Mus musculus
gcagtggcggctaagtctcctcgct

SEQ ID NO: 410996 - DNA, 25 bp, Mus musculus
tcgctggtcctcatcgggagctagg

SEQ ID NO: 410997 - DNA, 25 bp, Mus musculus
cctcgctggtcctcatcgggagcta

SEQ ID NO: 410998 - DNA, 25 bp, Mus musculus
tgcgttggtccctgcctcgctggtc

SEQ ID NO: 410999 - DNA, 25 bp, Mus musculus
aggctgcgttggtccctgcctcgct

SEQ ID NO: 411000 - DNA, 25 bp, Mus musculus
gcactcgttcctggctcgggcacgg

SEQ ID NO: 411001 - DNA, 25 bp, Mus musculus
tggccgtggtgctgacgcgaggctc

SEQ ID NO: 411002 - DNA, 25 bp, Mus musculus
cggcgcggaacctggagctggccgt

SEQ ID NO: 411003 - DNA, 25 bp, Mus musculus
cggtcaccgccctcccaagcgcggc

SEQ ID NO: 411004 - DNA, 25 bp, Mus musculus
cgctcctccgctactcgccagcgtc

SEQ ID NO: 411005 - DNA, 25 bp, Mus musculus
gctaagtctcctcgctcctccgcta

SEQ ID NO: 411006 - DNA, 25 bp, Mus musculus
cgcagtggcggctaagtctcctcgc

SEQ ID NO: 411007 - DNA, 25 bp, Mus musculus
cgagaggctgcgttggtccctgcct

SEQ ID NO: 411008 - DNA, 25 bp, Mus musculus
gctcgccagcgcagtcaggagcagc

SEQ ID NO: 411009 - DNA, 25 bp, Mus musculus
agctcggctcgccagcgcagtcagg

SEQ ID NO: 411010 - DNA, 25 bp, Mus musculus
tcctcggcggtccagggcagaccat

SEQ ID NO: 411011 - DNA, 25 bp, Mus musculus
gatccgcgcggcagtcgcagcttct

SEQ ID NO: 411012 - DNA, 25 bp, Mus musculus
tagtgcccgggcagcaccatgctcg

SEQ ID NO: 411013 - DNA, 25 bp, Mus musculus
accatgctcggtgtggtgcacttcc

SEQ ID NO: 411014 - DNA, 25 bp, Mus musculus
tgtggtgcacttccttcgcagcttc

SEQ ID NO: 411015 - DNA, 25 bp, Mus musculus
tcgcagcttctttaaggtgagagac

SEQ ID NO: 411016 - DNA, 25 bp, Mus musculus
ctttaaggtgagagacgtggtcccg

SEQ ID NO: 411017 - DNA, 25 bp, Mus musculus
tcaaaaccgggtttgcttgcagagt

SEQ ID NO: 411018 - DNA, 25 bp, Mus musculus
accgggtttgcttgcagagttttgc

SEQ ID NO: 411019 - DNA, 25 bp, Mus musculus
ctgtttgtgggtgcctaagaggtac

SEQ ID NO: 411020 - DNA, 25 bp, Mus musculus
ctaagaggtacccaagaacgatccg

SEQ ID NO: 411021 - DNA, 25 bp, Mus musculus
gcacttccttcgcagcttctttaag

SEQ ID NO: 411022 - DNA, 25 bp, Mus musculus
ttcgttcgtggcaccactgaggtca

SEQ ID NO: 411023 - DNA, 25 bp, Mus musculus
ccgggttccgactcggacagcagcg

SEQ ID NO: 411024 - DNA, 25 bp, Mus musculus
taccagcggcgatctgggcacaagc

SEQ ID NO: 411025 - DNA, 25 bp, Mus musculus
agcgagtccagtggccctaccagcg

SEQ ID NO: 411026 - DNA, 25 bp, Mus musculus
ctgctcagaggagcaccgcgatgtc

SEQ ID NO: 411027 - DNA, 25 bp, Mus musculus
agggcgcattcttctccctgatgcc

SEQ ID NO: 411028 - DNA, 25 bp, Mus musculus
agcccttgaggagcgagcgtccctc

SEQ ID NO: 411029 - DNA, 25 bp, Mus musculus
ggggcgctctcttagcccttgagga

SEQ ID NO: 411030 - DNA, 25 bp, Mus musculus
gggaccctttgattgcacttggcgg

SEQ ID NO: 411031 - DNA, 25 bp, Mus musculus
ttacctgcggggaccctttgattgc

SEQ ID NO: 411032 - DNA, 25 bp, Mus musculus
acctgtgcacgagggcgcacccagg

SEQ ID NO: 411033 - DNA, 25 bp, Mus musculus
gcgggtaagggcaccacctgctctc

SEQ ID NO: 411034 - DNA, 25 bp, Mus musculus
ggtcaccgctcacctgtgcacgagg

SEQ ID NO: 411035 - DNA, 25 bp, Mus musculus
ggcgatctgggcacaagcagcagca

SEQ ID NO: 411036 - DNA, 25 bp, Mus musculus
ccggctccagccttgagctgggatc

SEQ ID NO: 411037 - DNA, 25 bp, Mus musculus
aggcagctccgcctcctttccggcg

SEQ ID NO: 411038 - DNA, 25 bp, Mus musculus
ggtgagtggcaccttccagctgctg

SEQ ID NO: 411039 - DNA, 25 bp, Mus musculus
gatctcccggcgataggagcccgga

SEQ ID NO: 411040 - DNA, 25 bp, Mus musculus
cccagcgcgtggtggtctccgctgt

SEQ ID NO: 411041 - DNA, 25 bp, Mus musculus
tggtctccgctgtgctggcgttgct

SEQ ID NO: 411042 - DNA, 25 bp, Mus musculus
gctggcgttgctggtcctcatcaac

SEQ ID NO: 411043 - DNA, 25 bp, Mus musculus
ctggtcctcatcaacgccgtgctga

SEQ ID NO: 411044 - DNA, 25 bp, Mus musculus
caacgccgtgctgatattcctactg

SEQ ID NO: 411045 - DNA, 25 bp, Mus musculus
cgtgctgatattcctactggccttc

SEQ ID NO: 411046 - DNA, 25 bp, Mus musculus
gatattcctactggccttccgctga

SEQ ID NO: 411047 - DNA, 25 bp, Mus musculus
ttcctactggccttccgctgagctg

SEQ ID NO: 411048 - DNA, 25 bp, Mus musculus
aaccgcgcagggtgagtggcacctt

SEQ ID NO: 411049 - DNA, 25 bp, Mus musculus
cagctgctgtcaccgcacgaacgtg

SEQ ID NO: 411050 - DNA, 25 bp, Mus musculus
ccgaagcccacgttttccagcgaga

SEQ ID NO: 411051 - DNA, 25 bp, Mus musculus
gcctccgctcaagctccggctaaaa

SEQ ID NO: 411052 - DNA, 25 bp, Mus musculus
agcccacgttttccagcgagagggg

SEQ ID NO: 411053 - DNA, 25 bp, Mus musculus
acgggcagtgcccagacgacgctcg

SEQ ID NO: 411054 - DNA, 25 bp, Mus musculus
ttgctaaggtaccctccgaagccca

SEQ ID NO: 411055 - DNA, 25 bp, Mus musculus
agacgacgctcggttgcggccgacc

SEQ ID NO: 411056 - DNA, 25 bp, Mus musculus
tttcagatgaacctgggccacggcc

SEQ ID NO: 411057 - DNA, 25 bp, Mus musculus
gcagacaccgcagcccacgacctca

SEQ ID NO: 411058 - DNA, 25 bp, Mus musculus
cccgagaggcttgcgcgagatgccc

SEQ ID NO: 411059 - DNA, 25 bp, Mus musculus
cttgcgcgagatgcccggatgctag

SEQ ID NO: 411060 - DNA, 25 bp, Mus musculus
ccggatgctaggacgcgcgcctaga

SEQ ID NO: 411061 - DNA, 25 bp, Mus musculus
ttcccgtactcacggtggcctgagc

SEQ ID NO: 411062 - DNA, 25 bp, Mus musculus
ggacgcgcgcctagactgcgagcct

SEQ ID NO: 411063 - DNA, 25 bp, Mus musculus
gctggcaggtcgtccttctcttttt

SEQ ID NO: 411064 - DNA, 25 bp, Mus musculus
gagcatctccgagccggcggatact

SEQ ID NO: 411065 - DNA, 25 bp, Mus musculus
gcaggtcgacattggcaccaatccc

SEQ ID NO: 411066 - DNA, 25 bp, Mus musculus
cgcatctgcaggatgcaggtcgaca

SEQ ID NO: 411067 - DNA, 25 bp, Mus musculus
ttctccgagcggacctgcaagttca

SEQ ID NO: 411068 - DNA, 25 bp, Mus musculus
agttcacaggtcgagactgggagcc

SEQ ID NO: 411069 - DNA, 25 bp, Mus musculus
tgggagccgagtgagatcttagcct

SEQ ID NO: 411070 - DNA, 25 bp, Mus musculus
atcttagcctctcgggctgcgtgca

SEQ ID NO: 411071 - DNA, 25 bp, Mus musculus
gctaccgcagggttggagcatctcc

SEQ ID NO: 411072 - DNA, 25 bp, Mus musculus
gtgctcccttgtccctgagctgcgg

SEQ ID NO: 411073 - DNA, 25 bp, Mus musculus
tactggtggataccggtcgatactg

SEQ ID NO: 411074 - DNA, 25 bp, Mus musculus
gatactggtggttgcggttcttcct

SEQ ID NO: 411075 - DNA, 25 bp, Mus musculus
ggttcttcctgggacccttgcgagc

SEQ ID NO: 411076 - DNA, 25 bp, Mus musculus
ccttgcgagctgagagccagggaca

SEQ ID NO: 411077 - DNA, 25 bp, Mus musculus
agtaccctgggctgtattgagtggc

SEQ ID NO: 411078 - DNA, 25 bp, Mus musculus
ggagtcaatctctgccaccggcgtt

SEQ ID NO: 411079 - DNA, 25 bp, Mus musculus
actccacggctcaggggttcaaact

SEQ ID NO: 411080 - DNA, 25 bp, Mus musculus
tgatctctgcacacgattggctcgc

SEQ ID NO: 411081 - DNA, 25 bp, Mus musculus
gcgcagacatcttggctcctcttta

SEQ ID NO: 411082 - DNA, 25 bp, Mus musculus
cccggaacagaggaaggagtcaatc

SEQ ID NO: 411083 - DNA, 25 bp, Mus musculus
gccatgtccactcacttctcggaga

SEQ ID NO: 411084 - DNA, 25 bp, Mus musculus
tcccactcaggaatgtaggcggtcg

SEQ ID NO: 411085 - DNA, 25 bp, Mus musculus
actcagcgtgtacggtaagagctta

SEQ ID NO: 411086 - DNA, 25 bp, Mus musculus
cgttctgactctaggggattgactc

SEQ ID NO: 411087 - DNA, 25 bp, Mus musculus
cgtccctaagcgagcacagcagcga

SEQ ID NO: 411088 - DNA, 25 bp, Mus musculus
actgagatggcttgtctgagaaacc

SEQ ID NO: 411089 - DNA, 25 bp, Mus musculus
acctctccctaatcgcgcgggttga

SEQ ID NO: 411090 - DNA, 25 bp, Mus musculus
gcgggttgactgtcgttccactcca

SEQ ID NO: 411091 - DNA, 25 bp, Mus musculus
tctttaacaacgagcgcctggattg

SEQ ID NO: 411092 - DNA, 25 bp, Mus musculus
ccgtggtaagaacgcggctggattt

SEQ ID NO: 411093 - DNA, 25 bp, Mus musculus
ttcacttttgaagccaaggcgcagt

SEQ ID NO: 411094 - DNA, 25 bp, Mus musculus
tgaacgcactgaaagacaaaacatc

SEQ ID NO: 411095 - DNA, 25 bp, Mus musculus
tagacacgctatcgccggcgcacga

SEQ ID NO: 411096 - DNA, 25 bp, Mus musculus
cgctcgacttctgtgcgcatgtgca

SEQ ID NO: 411097 - DNA, 25 bp, Mus musculus
ggtatttaagcgctccgctcgactt

SEQ ID NO: 411098 - DNA, 25 bp, Mus musculus
tgtgcaactcctcccactaaagagg

SEQ ID NO: 411099 - DNA, 25 bp, Mus musculus
acttccgcctttaggagcgtccgtg

SEQ ID NO: 411100 - DNA, 25 bp, Mus musculus
ggctggatttctagcaggcatcgca

SEQ ID NO: 411101 - DNA, 25 bp, Mus musculus
cgatccgctcctacggaacacgaga

SEQ ID NO: 411102 - DNA, 25 bp, Mus musculus
cggtggccgcatgacggtatttaag

SEQ ID NO: 411103 - DNA, 25 bp, Mus musculus
gaggagccaaactactgccgttttc

SEQ ID NO: 411104 - DNA, 25 bp, Mus musculus
ggcgcacgagctgggatcacactca

SEQ ID NO: 411105 - DNA, 25 bp, Mus musculus
gccgtgccttaggagtttccacttc

SEQ ID NO: 411106 - DNA, 25 bp, Mus musculus
acgtcgaaggcctcctctctgcagg

SEQ ID NO: 411107 - DNA, 25 bp, Mus musculus
ggaggcccaagcagcacgacctgca

SEQ ID NO: 411108 - DNA, 25 bp, Mus musculus
cattgtggcggaggcccaagcagca

SEQ ID NO: 411109 - DNA, 25 bp, Mus musculus
acgcttttgtgtcgcgcccgggcct

SEQ ID NO: 411110 - DNA, 25 bp, Mus musculus
gtcaccaagacgctgcaggagcccg

SEQ ID NO: 411111 - DNA, 25 bp, Mus musculus
ttggaaggcagtcaccaagacgctg

SEQ ID NO: 411112 - DNA, 25 bp, Mus musculus
tgccacgtttggaaggcagtcacca

SEQ ID NO: 411113 - DNA, 25 bp, Mus musculus
gcctgctcggctgccacgtttggaa

SEQ ID NO: 411114 - DNA, 25 bp, Mus musculus
tgagcaagtccgctgcgctgctgct

SEQ ID NO: 411115 - DNA, 25 bp, Mus musculus
cggagatgagcaagtccgctgcgct

SEQ ID NO: 411116 - DNA, 25 bp, Mus musculus
ccgccaggtggcaccacggacccag

SEQ ID NO: 411117 - DNA, 25 bp, Mus musculus
tttggaggcgcctgggactcccgca

SEQ ID NO: 411118 - DNA, 25 bp, Mus musculus
tctctgcaggaatagccaggggttt

SEQ ID NO: 411119 - DNA, 25 bp, Mus musculus
aagcagcacgacctgcatcgcggtc

SEQ ID NO: 411120 - DNA, 25 bp, Mus musculus
cggccagccagcagagcctagagct

SEQ ID NO: 411121 - DNA, 25 bp, Mus musculus
ggacgaccaggacacgtgcggaata

SEQ ID NO: 411122 - DNA, 25 bp, Mus musculus
ggccgcagactcgagactcggtgcc

SEQ ID NO: 411123 - DNA, 25 bp, Mus musculus
actgcatagacaggcgggagcctca

SEQ ID NO: 411124 - DNA, 25 bp, Mus musculus
ctcgactgcctaagtgggagaactg

SEQ ID NO: 411125 - DNA, 25 bp, Mus musculus
gagccggtcttcacccgctaaaata

SEQ ID NO: 411126 - DNA, 25 bp, Mus musculus
cgtgcggaatagacggagacaatga

SEQ ID NO: 411127 - DNA, 25 bp, Mus musculus
gagacaatgaggaggagaccgaaca

SEQ ID NO: 411128 - DNA, 25 bp, Mus musculus
ttggcatccttctagttctttcgcg

SEQ ID NO: 411129 - DNA, 25 bp, Mus musculus
gtcgttccacttgtgccttggcatc

SEQ ID NO: 411130 - DNA, 25 bp, Mus musculus
acttagcaaggacgcaaggcccttc

SEQ ID NO: 411131 - DNA, 25 bp, Mus musculus
gcgagggagatgcaagtcgttccac

SEQ ID NO: 411132 - DNA, 25 bp, Mus musculus
cctgtagagaggaaacccgcagagc

SEQ ID NO: 411133 - DNA, 25 bp, Mus musculus
catcccgagaccattgtgaggtgca

SEQ ID NO: 411134 - DNA, 25 bp, Mus musculus
gcccgccgtgcctttaaaggcggca

SEQ ID NO: 411135 - DNA, 25 bp, Mus musculus
cagcctaggccgagctccacgcggc

SEQ ID NO: 411136 - DNA, 25 bp, Mus musculus
gccgccaccgggagcagcatttttt

SEQ ID NO: 411137 - DNA, 25 bp, Mus musculus
ttaaattcaggcgacgcttaaggga

SEQ ID NO: 411138 - DNA, 25 bp, Mus musculus
ttcaggcgacgcttaagggagccca

SEQ ID NO: 411139 - DNA, 25 bp, Mus musculus
gcttaaaggggaatagcgggccgca

SEQ ID NO: 411140 - DNA, 25 bp, Mus musculus
gccacgcaggggttaatcttttcgc

SEQ ID NO: 411141 - DNA, 25 bp, Mus musculus
tttcgcccgccgacatttttgtgtg

SEQ ID NO: 411142 - DNA, 25 bp, Mus musculus
cgccgacatttttgtgtggcggcgc

SEQ ID NO: 411143 - DNA, 25 bp, Mus musculus
tgcagcatggccctgccggtggcct

SEQ ID NO: 411144 - DNA, 25 bp, Mus musculus
ctttaaaggcggcagcctgagactt

SEQ ID NO: 411145 - DNA, 25 bp, Mus musculus
ggcagcctgagacttaaggtgtccc

SEQ ID NO: 411146 - DNA, 25 bp, Mus musculus
aaggtgtcccctgagtggcatcctc

SEQ ID NO: 411147 - DNA, 25 bp, Mus musculus
gcgctctgccttagccgcccagtgt

SEQ ID NO: 411148 - DNA, 25 bp, Mus musculus
gcttagcgtatttgcggacgacgtt

SEQ ID NO: 411149 - DNA, 25 bp, Mus musculus
tggatgcccgcacacaaacgcaggc

SEQ ID NO: 411150 - DNA, 25 bp, Mus musculus
ttgcagtcagcacgcgcacagacct

SEQ ID NO: 411151 - DNA, 25 bp, Mus musculus
agcgctcacacctgcatagactcgg

SEQ ID NO: 411152 - DNA, 25 bp, Mus musculus
atagactcggattcgccctcccgtg

SEQ ID NO: 411153 - DNA, 25 bp, Mus musculus
agctggctgcccaagaccaagtgca

SEQ ID NO: 411154 - DNA, 25 bp, Mus musculus
ccaagtgcacgaagggacaagtctc

SEQ ID NO: 411155 - DNA, 25 bp, Mus musculus
atggccattcggtgatgcgcttagc

SEQ ID NO: 411156 - DNA, 25 bp, Mus musculus
aagcctagccaatccgcgtcagtca

SEQ ID NO: 411157 - DNA, 25 bp, Mus musculus
gccacgccctataaggggtcggtca

SEQ ID NO: 411158 - DNA, 25 bp, Mus musculus
actgcttgtacaggacccgctggcc

SEQ ID NO: 411159 - DNA, 25 bp, Mus musculus
cgctgcgcaatggactgcttgtaca

SEQ ID NO: 411160 - DNA, 25 bp, Mus musculus
acgacgttgtcctcgctgaagacga

SEQ ID NO: 411161 - DNA, 25 bp, Mus musculus
cggttgacggtgaagcagttctgct

SEQ ID NO: 411162 - DNA, 25 bp, Mus musculus
ggtgggctagacacacggacaaccc

SEQ ID NO: 411163 - DNA, 25 bp, Mus musculus
cacccagaactggaacttgcctttc

SEQ ID NO: 411164 - DNA, 25 bp, Mus musculus
ctagtgagcagggacacgcacgccc

SEQ ID NO: 411165 - DNA, 25 bp, Mus musculus
gaaacacaccattcggacacacatc

SEQ ID NO: 411166 - DNA, 25 bp, Mus musculus
gagcccgtcttgaccggcacataca

SEQ ID NO: 411167 - DNA, 25 bp, Mus musculus
ttgaccggcacatacaccacttggc

SEQ ID NO: 411168 - DNA, 25 bp, Mus musculus
cacttggcccatcttgggttcccgg

SEQ ID NO: 411169 - DNA, 25 bp, Mus musculus
gaagcccttggagcgcacccagaac

SEQ ID NO: 411170 - DNA, 25 bp, Mus musculus
tgtcttggttttagccgagtcgccg

SEQ ID NO: 411171 - DNA, 25 bp, Mus musculus
caggacctcggcgatccgctggtat

SEQ ID NO: 411172 - DNA, 25 bp, Mus musculus
gccatggcccgatcagcggcgcaga

SEQ ID NO: 411173 - DNA, 25 bp, Mus musculus
atccgctggtatttgctgcgtgtca

SEQ ID NO: 411174 - DNA, 25 bp, Mus musculus
gctgcgtgtcactgtcttggtttta

SEQ ID NO: 411175 - DNA, 25 bp, Mus musculus
agtcgccgtaggtgcgcaggcacca

SEQ ID NO: 411176 - DNA, 25 bp, Mus musculus
tcgcttcctccacccgggtctcgct

SEQ ID NO: 411177 - DNA, 25 bp, Mus musculus
agctgctgcatgtctccgcgcacgg

SEQ ID NO: 411178 - DNA, 25 bp, Mus musculus
gtctcgctgcgcttccgcagccgca

SEQ ID NO: 411179 - DNA, 25 bp, Mus musculus
cgggcagcgacgctcgcttcctcca

SEQ ID NO: 411180 - DNA, 25 bp, Mus musculus
atggtgccaggaaccccgcaaccgg

SEQ ID NO: 411181 - DNA, 25 bp, Mus musculus
aggcggcccatggtgccaggaaccc

SEQ ID NO: 411182 - DNA, 25 bp, Mus musculus
tcctgcgtgcagtgcaggcggccca

SEQ ID NO: 411183 - DNA, 25 bp, Mus musculus
cagccgcggttctcgtgacagcgca

SEQ ID NO: 411184 - DNA, 25 bp, Mus musculus
gcccagctggttcagctgctgcatg

SEQ ID NO: 411185 - DNA, 25 bp, Mus musculus
acctgagcgcccagctggttcagct

SEQ ID NO: 411186 - DNA, 25 bp, Mus musculus
tccgcccattcctgagcccgcccgc

SEQ ID NO: 411187 - DNA, 25 bp, Mus musculus
gttctcgtgacagcgcacgcgcgac

SEQ ID NO: 411188 - DNA, 25 bp, Mus musculus
cgcagccgcactttcgccacactcc

SEQ ID NO: 411189 - DNA, 25 bp, Mus musculus
ttcagctgctgcatgtctccgcgca

SEQ ID NO: 411190 - DNA, 25 bp, Mus musculus
gctacagccagcctcacgacaggtg

SEQ ID NO: 411191 - DNA, 25 bp, Mus musculus
gcgaacccgacactccgcgccgccc

SEQ ID NO: 411192 - DNA, 25 bp, Mus musculus
agcctcacgacaggtgagcgccacg

SEQ ID NO: 411193 - DNA, 25 bp, Mus musculus
cagaggaagcgaagtccccgctgca

SEQ ID NO: 411194 - DNA, 25 bp, Mus musculus
agcccgcgtggacgctctcgcctga

SEQ ID NO: 411195 - DNA, 25 bp, Mus musculus
actagcccgggtggcccactggcgc

SEQ ID NO: 411196 - DNA, 25 bp, Mus musculus
acgggcgctccagtccggcagcgcc

SEQ ID NO: 411197 - DNA, 25 bp, Mus musculus
ggagattcgcgaacccgacactccg

SEQ ID NO: 411198 - DNA, 25 bp, Mus musculus
cccaagtaaacgtagcgcagcgatc

SEQ ID NO: 411199 - DNA, 25 bp, Mus musculus
caagtaaacgtagcgcagcgatcgg

SEQ ID NO: 411200 - DNA, 25 bp, Mus musculus
cgatcggcgccggagattcgcgaac

SEQ ID NO: 411201 - DNA, 25 bp, Mus musculus
gcgccggagattcgcgaacccgaca

SEQ ID NO: 411202 - DNA, 25 bp, Mus musculus
taagcggcccaagtaaacgtagcgc

SEQ ID NO: 411203 - DNA, 25 bp, Mus musculus
cggcccgtagcgtcctcgtcgccgc

SEQ ID NO: 411204 - DNA, 25 bp, Mus musculus
gtgaccggcgaagtcctgactttgc

SEQ ID NO: 411205 - DNA, 25 bp, Mus musculus
gtcattggtcgcaactgaccacgtg

SEQ ID NO: 411206 - DNA, 25 bp, Mus musculus
tgaccacgtgcccaacaggcttgct

SEQ ID NO: 411207 - DNA, 25 bp, Mus musculus
gggcatgccagctgtcgatcaagca

SEQ ID NO: 411208 - DNA, 25 bp, Mus musculus
cagctgtcgatcaagcattcggccc

SEQ ID NO: 411209 - DNA, 25 bp, Mus musculus
tcgcaggccagtccgtctctataaa

SEQ ID NO: 411210 - DNA, 25 bp, Mus musculus
caggccagtccgtctctataaaagg

SEQ ID NO: 411211 - DNA, 25 bp, Mus musculus
cagtccgtctctataaaaggccggg

SEQ ID NO: 411212 - DNA, 25 bp, Mus musculus
tccgacggtttgaacgagacgaaga

SEQ ID NO: 411213 - DNA, 25 bp, Mus musculus
tgaacgagacgaagacggaaccgga

SEQ ID NO: 411214 - DNA, 25 bp, Mus musculus
acgcgggtcctgagaaagccggtga

SEQ ID NO: 411215 - DNA, 25 bp, Mus musculus
gaattcacgggaggcggctcctcgt

SEQ ID NO: 411216 - DNA, 25 bp, Mus musculus
ctcctcgtgagcagtgcggagccgc

SEQ ID NO: 411217 - DNA, 25 bp, Mus musculus
ctgcctagtggtgaccggcgaagtc

SEQ ID NO: 411218 - DNA, 25 bp, Mus musculus
ggccacgtggagagtagttttcctc

SEQ ID NO: 411219 - DNA, 25 bp, Mus musculus
tcccagacgaggttaacgtctcatc

SEQ ID NO: 411220 - DNA, 25 bp, Mus musculus
cgcacatttgtctttcccagacgag

SEQ ID NO: 411221 - DNA, 25 bp, Mus musculus
cacgcgcacatttgtctttcccaga

SEQ ID NO: 411222 - DNA, 25 bp, Mus musculus
aatttcagcgcctgtcctacccacg

SEQ ID NO: 411223 - DNA, 25 bp, Mus musculus
agttttcctccagccgcaatttcag

SEQ ID NO: 411224 - DNA, 25 bp, Mus musculus
ggagagtagttttcctccagccgca

SEQ ID NO: 411225 - DNA, 25 bp, Mus musculus
ttcggccacgtggagagtagttttc

SEQ ID NO: 411226 - DNA, 25 bp, Mus musculus
aaccagttgccgcttcggccacgtg

SEQ ID NO: 411227 - DNA, 25 bp, Mus musculus
cccacctactctcgccaaccagttg

SEQ ID NO: 411228 - DNA, 25 bp, Mus musculus
cctgctagccgcctgcctctggccc

SEQ ID NO: 411229 - DNA, 25 bp, Mus musculus
cgctgtagtcctaggcgaaggagca

SEQ ID NO: 411230 - DNA, 25 bp, Mus musculus
cagacgaggttaacgtctcatctcg

SEQ ID NO: 411231 - DNA, 25 bp, Mus musculus
agtagttttcctccagccgcaattt

SEQ ID NO: 411232 - DNA, 25 bp, Mus musculus
tccgaaaccggaaactgtcgatctg

SEQ ID NO: 411233 - DNA, 25 bp, Mus musculus
ttcacagggcaaatactagggctta

SEQ ID NO: 411234 - DNA, 25 bp, Mus musculus
acatccaagcgtgtgagtgctaggc

SEQ ID NO: 411235 - DNA, 25 bp, Mus musculus
aggacgctgtgacttggccaagagc

SEQ ID NO: 411236 - DNA, 25 bp, Mus musculus
ctgagctacactcgcagcggtccta

SEQ ID NO: 411237 - DNA, 25 bp, Mus musculus
cagcggtcctactcaaggcctaaca

SEQ ID NO: 411238 - DNA, 25 bp, Mus musculus
gtgataccttctcctagcgcttctg

SEQ ID NO: 411239 - DNA, 25 bp, Mus musculus
cacaactgcaaggtccgcgtccgaa

SEQ ID NO: 411240 - DNA, 25 bp, Mus musculus
aatggtagtgtttcctgccggcttc

SEQ ID NO: 411241 - DNA, 25 bp, Mus musculus
aactgtcgatctgcgtgggttccct

SEQ ID NO: 411242 - DNA, 25 bp, Mus musculus
tgggttcccttctcaggagtcctcc

SEQ ID NO: 411243 - DNA, 25 bp, Mus musculus
tgcaacttctgttccgccgtgactt

SEQ ID NO: 411244 - DNA, 25 bp, Mus musculus
ctttcgcccgcggtgttctaatggt

SEQ ID NO: 411245 - DNA, 25 bp, Mus musculus
gggtcacccgcaggacactaaactc

SEQ ID NO: 411246 - DNA, 25 bp, Mus musculus
cagcatgggcggagaccactgctcc

SEQ ID NO: 411247 - DNA, 25 bp, Mus musculus
ctgcacgcccaagctcccgtgggtc

SEQ ID NO: 411248 - DNA, 25 bp, Mus musculus
ctggaccggaatgcggagtccgatc

SEQ ID NO: 411249 - DNA, 25 bp, Mus musculus
ccaaggatcagcgaggtttcttgtc

SEQ ID NO: 411250 - DNA, 25 bp, Mus musculus
agcgaggtttcttgtcccggctcaa

SEQ ID NO: 411251 - DNA, 25 bp, Mus musculus
ttcttgtcccggctcaagtcttcac

SEQ ID NO: 411252 - DNA, 25 bp, Mus musculus
gctcaagtcttcacctctggaccgg

SEQ ID NO: 411253 - DNA, 25 bp, Mus musculus
aagtcttcacctctggaccggaatg

SEQ ID NO: 411254 - DNA, 25 bp, Mus musculus
cttcacctctggaccggaatgcgga

SEQ ID NO: 411255 - DNA, 25 bp, Mus musculus
gtgactgttttcagcgcgtagctcg

SEQ ID NO: 411256 - DNA, 25 bp, Mus musculus
aggaggtgactgttttcagcgcgta

SEQ ID NO: 411257 - DNA, 25 bp, Mus musculus
cccgagagcggctcatggacgaggc

SEQ ID NO: 411258 - DNA, 25 bp, Mus musculus
cacctcgcccgctgagcctggagcg

SEQ ID NO: 411259 - DNA, 25 bp, Mus musculus
cggttccaaggatcagcgaggtttc

SEQ ID NO: 411260 - DNA, 25 bp, Mus musculus
gcgggactcacggtcagcgcgtcct

SEQ ID NO: 411261 - DNA, 25 bp, Mus musculus
ccgtcgaggattggaccgtagctcg

SEQ ID NO: 411262 - DNA, 25 bp, Mus musculus
aggatccagttctgtgcgccgtcga

SEQ ID NO: 411263 - DNA, 25 bp, Mus musculus
tggggcaacacaaggatccagttct

SEQ ID NO: 411264 - DNA, 25 bp, Mus musculus
ccggattctatggatggggcaacac

SEQ ID NO: 411265 - DNA, 25 bp, Mus musculus
tgcggaacataaaggggccggattc

SEQ ID NO: 411266 - DNA, 25 bp, Mus musculus
tcacggccacagttagaggaggttg

SEQ ID NO: 411267 - DNA, 25 bp, Mus musculus
agtgggtcagaaccgcgttccctca

SEQ ID NO: 411268 - DNA, 25 bp, Mus musculus
gatcacttgggagtgggtcagaacc

SEQ ID NO: 411269 - DNA, 25 bp, Mus musculus
ctaaagatgtgcagcgggatcactt

SEQ ID NO: 411270 - DNA, 25 bp, Mus musculus
ctgaagagacgctacccggtaaact

SEQ ID NO: 411271 - DNA, 25 bp, Mus musculus
ttcgcctcgaagtcccagtacactg

SEQ ID NO: 411272 - DNA, 25 bp, Mus musculus
gcagcgcagttccagcaacccggtg

SEQ ID NO: 411273 - DNA, 25 bp, Mus musculus
gcgtcctccgccagagagagcaaca

SEQ ID NO: 411274 - DNA, 25 bp, Mus musculus
ctgtccgcgagagaagtattgtttt

SEQ ID NO: 411275 - DNA, 25 bp, Mus musculus
tacaaggcctgcacctgaaacgtcc

SEQ ID NO: 411276 - DNA, 25 bp, Mus musculus
ggccacatccggaagtctggagctc

SEQ ID NO: 411277 - DNA, 25 bp, Mus musculus
tccaggataggacgcagcctggcgc

SEQ ID NO: 411278 - DNA, 25 bp, Mus musculus
cccgtcttccgcgtgcgttggtctg

SEQ ID NO: 411279 - DNA, 25 bp, Mus musculus
agcggcgctcgcgacagactgcgct

SEQ ID NO: 411280 - DNA, 25 bp, Mus musculus
ctccataggcgggaggctttgcaga

SEQ ID NO: 411281 - DNA, 25 bp, Mus musculus
cactggatccaaggtcatgcggctc

SEQ ID NO: 411282 - DNA, 25 bp, Mus musculus
cgccctatggactgtccgcgagaga

SEQ ID NO: 411283 - DNA, 25 bp, Mus musculus
gtcaaagcgttacaaggcctgcacc

SEQ ID NO: 411284 - DNA, 25 bp, Mus musculus
tattgttttgttttcgcggcatcgg

SEQ ID NO: 411285 - DNA, 25 bp, Mus musculus
catcggggctgaaagtccggtcccg

SEQ ID NO: 411286 - DNA, 25 bp, Mus musculus
gaaacacgccggaattggagcgacg

SEQ ID NO: 411287 - DNA, 25 bp, Mus musculus
ctatcccggcgcttcctgtggggct

SEQ ID NO: 411288 - DNA, 25 bp, Mus musculus
tcgggcacggaagaagcctcaggcc

SEQ ID NO: 411289 - DNA, 25 bp, Mus musculus
ccacgagggcatgttcttcccttca

SEQ ID NO: 411290 - DNA, 25 bp, Mus musculus
acgtgctgacccaacgcgatgcctg

SEQ ID NO: 411291 - DNA, 25 bp, Mus musculus
cagccgctgtatgcgcacgtgctga

SEQ ID NO: 411292 - DNA, 25 bp, Mus musculus
cgcagtgctggcagccgctgtatgc

SEQ ID NO: 411293 - DNA, 25 bp, Mus musculus
atgaaaaggatcctggtgctgctgc

SEQ ID NO: 411294 - DNA, 25 bp, Mus musculus
gagggcatgttcttcccttcacacc

SEQ ID NO: 411295 - DNA, 25 bp, Mus musculus
cgcgctcgggagatgaaaaggatcc

SEQ ID NO: 411296 - DNA, 25 bp, Mus musculus
cttcccagcggtggcgcctatgcta

SEQ ID NO: 411297 - DNA, 25 bp, Mus musculus
tgcggccaactgaggacccgctcgg

SEQ ID NO: 411298 - DNA, 25 bp, Mus musculus
cccgctggacaagcggcagcagctg

SEQ ID NO: 411299 - DNA, 25 bp, Mus musculus
tgcttttcccgctggacaagcggca

SEQ ID NO: 411300 - DNA, 25 bp, Mus musculus
ccaacgcgatgcctgtggtgaaggc

SEQ ID NO: 411301 - DNA, 25 bp, Mus musculus
ccagaccaagatcgtgctgcttttc

SEQ ID NO: 411302 - DNA, 25 bp, Mus musculus
agggcctgtttttgcctgggcaatg

SEQ ID NO: 411303 - DNA, 25 bp, Mus musculus
gggcctgtcccgcaagaccgttaca

SEQ ID NO: 411304 - DNA, 25 bp, Mus musculus
caggcagtaccctgtcgcgctactt

SEQ ID NO: 411305 - DNA, 25 bp, Mus musculus
gcatgcccagatcttcagctgcagg

SEQ ID NO: 411306 - DNA, 25 bp, Mus musculus
cgctgctgctatgtgtcgctagatt

SEQ ID NO: 411307 - DNA, 25 bp, Mus musculus
gtcgctagatttccagggtgatatc

SEQ ID NO: 411308 - DNA, 25 bp, Mus musculus
ggtgatatctgtgaccctgcccgcc

SEQ ID NO: 411309 - DNA, 25 bp, Mus musculus
tgcccgccaccagagggcctgtttt

SEQ ID NO: 411310 - DNA, 25 bp, Mus musculus
agaccgttacacagctcaagaagcg

SEQ ID NO: 411311 - DNA, 25 bp, Mus musculus
tctacgcgggtcactcatggcacaa

SEQ ID NO: 411312 - DNA, 25 bp, Mus musculus
ttccgtctgaatgtggcaggcagta

SEQ ID NO: 411313 - DNA, 25 bp, Mus musculus
gtcgcgctactttcgagatttgcta

SEQ ID NO: 411314 - DNA, 25 bp, Mus musculus
agatttgctagtggcagcatgccca

SEQ ID NO: 411315 - DNA, 25 bp, Mus musculus
tggcacaaggccaccttccgtctga

SEQ ID NO: 411316 - DNA, 25 bp, Mus musculus
aactatcccgcagaaagagcagagg

SEQ ID NO: 411317 - DNA, 25 bp, Mus musculus
cgtctacgccgcaaaaaccaggaag

SEQ ID NO: 411318 - DNA, 25 bp, Mus musculus
cagagggaaagccaccacgcgaaca

SEQ ID NO: 411319 - DNA, 25 bp, Mus musculus
tccgggaagacagcggtccctctct

SEQ ID NO: 411320 - DNA, 25 bp, Mus musculus
caactctagtgcgttctgaggaccc

SEQ ID NO: 411321 - DNA, 25 bp, Mus musculus
gctctcgcggcgagtgaaaggtcac

SEQ ID NO: 411322 - DNA, 25 bp, Mus musculus
tttccttaaagatggtgccacgctc

SEQ ID NO: 411323 - DNA, 25 bp, Mus musculus
cacgcgaacaaaagaccgctaattc

SEQ ID NO: 411324 - DNA, 25 bp, Mus musculus
ccgccgctttagtgccattggtgaa

SEQ ID NO: 411325 - DNA, 25 bp, Mus musculus
tgttgcaatcacagccgtggcctgc

SEQ ID NO: 411326 - DNA, 25 bp, Mus musculus
acttgggtccgcagacattcctctg

SEQ ID NO: 411327 - DNA, 25 bp, Mus musculus
gtcaccctgctgcagcggctttgtg

SEQ ID NO: 411328 - DNA, 25 bp, Mus musculus
ggtccactttgccttttgtctccgc

SEQ ID NO: 411329 - DNA, 25 bp, Mus musculus
acattcctctgtcgagcgtgctgcc

SEQ ID NO: 411330 - DNA, 25 bp, Mus musculus
ttgcggttaccaggccgcccaggct

SEQ ID NO: 411331 - DNA, 25 bp, Mus musculus
ggtgccccactcacgtcctggaaaa

SEQ ID NO: 411332 - DNA, 25 bp, Mus musculus
gtaagcagcccggcgcacgccatgg

SEQ ID NO: 411333 - DNA, 25 bp, Mus musculus
gcaaggctgcgggttgcggttacca

SEQ ID NO: 411334 - DNA, 25 bp, Mus musculus
ctggaaaagcgcgtgtcccgcggca

SEQ ID NO: 411335 - DNA, 25 bp, Mus musculus
ccatggctcggaggcttgcaaggct

SEQ ID NO: 411336 - DNA, 25 bp, Mus musculus
caggcgcagagtgtcgcggctgctg

SEQ ID NO: 411337 - DNA, 25 bp, Mus musculus
cgcaggtggcccgagcaggcacaca

SEQ ID NO: 411338 - DNA, 25 bp, Mus musculus
gtggcccgagcaggcacacagtaag

SEQ ID NO: 411339 - DNA, 25 bp, Mus musculus
ggcccgagcaggcacacagtaagca

SEQ ID NO: 411340 - DNA, 25 bp, Mus musculus
cccgagcaggcacacagtaagcagc

SEQ ID NO: 411341 - DNA, 25 bp, Mus musculus
agcaggcacacagtaagcagcccgg

SEQ ID NO: 411342 - DNA, 25 bp, Mus musculus
ggcacacagtaagcagcccggcgca

SEQ ID NO: 411343 - DNA, 25 bp, Mus musculus
cacgccatggctcggaggcttgcaa

SEQ ID NO: 411344 - DNA, 25 bp, Mus musculus
cgggtctggcgaagcgaacaaactt

SEQ ID NO: 411345 - DNA, 25 bp, Mus musculus
caaacttcgtactcggttctgcacg

SEQ ID NO: 411346 - DNA, 25 bp, Mus musculus
tctcgccgtgccctgcaggaggcgt

SEQ ID NO: 411347 - DNA, 25 bp, Mus musculus
ggctcagcaaacagacaggcaaggc

SEQ ID NO: 411348 - DNA, 25 bp, Mus musculus
ttcaccgcccactcgatgggtggcg

SEQ ID NO: 411349 - DNA, 25 bp, Mus musculus
ttttgccgcgaaagagccacgcgcc

SEQ ID NO: 411350 - DNA, 25 bp, Mus musculus
gccaaatcctttttgccgcgaaaga

SEQ ID NO: 411351 - DNA, 25 bp, Mus musculus
gctgcctgcaaagtccgggccactt

SEQ ID NO: 411352 - DNA, 25 bp, Mus musculus
ctgcgaggagtcgagcagccgcaac

SEQ ID NO: 411353 - DNA, 25 bp, Mus musculus
agatgatgacgatctgcgaggagtc

SEQ ID NO: 411354 - DNA, 25 bp, Mus musculus
gcacgtcagaatcgcgagggccagt

SEQ ID NO: 411355 - DNA, 25 bp, Mus musculus
tggcgaagagcagcacgtcagaatc

SEQ ID NO: 411356 - DNA, 25 bp, Mus musculus
caggcaaggcagtcagtcaatgcgc

SEQ ID NO: 411357 - DNA, 25 bp, Mus musculus
acgctccggtgaagacgccgaggcc

SEQ ID NO: 411358 - DNA, 25 bp, Mus musculus
gctgggatgtagtcctactaagtcc

SEQ ID NO: 411359 - DNA, 25 bp, Mus musculus
agccctgcacgcgtgtgcctgcttg

SEQ ID NO: 411360 - DNA, 25 bp, Mus musculus
gtaaacacagggcacccaccgtgct

SEQ ID NO: 411361 - DNA, 25 bp, Mus musculus
gtctgggagagaccaccggcccaaa

SEQ ID NO: 411362 - DNA, 25 bp, Mus musculus
cgtatgtctgtgtagaattggaact

SEQ ID NO: 411363 - DNA, 25 bp, Mus musculus
tcctactaagtccagagcagagaag

SEQ ID NO: 411364 - DNA, 25 bp, Mus musculus
ggctactctggtctccgatcgaatc

SEQ ID NO: 411365 - DNA, 25 bp, Mus musculus
ggattcgattctgtgatctgcaaga

SEQ ID NO: 411366 - DNA, 25 bp, Mus musculus
tcagaacgtcccgagacccacggtg

SEQ ID NO: 411367 - DNA, 25 bp, Mus musculus
agtcgggcgcccgaaccactcagaa

SEQ ID NO: 411368 - DNA, 25 bp, Mus musculus
atcatggggtgcgtgttgaagaact

SEQ ID NO: 411369 - DNA, 25 bp, Mus musculus
cagctccaagatggcgcaggcgatc

SEQ ID NO: 411370 - DNA, 25 bp, Mus musculus
ccgcggttctcacaatgcttgcgta

SEQ ID NO: 411371 - DNA, 25 bp, Mus musculus
gccgcctgtgtgcacagcggagtct

SEQ ID NO: 411372 - DNA, 25 bp, Mus musculus
acttctttcgttgtccagccgagcc

SEQ ID NO: 411373 - DNA, 25 bp, Mus musculus
caggcccggactccactttgtctaa

SEQ ID NO: 411374 - DNA, 25 bp, Mus musculus
aaccatgtcggtgttcgggaagctg

SEQ ID NO: 411375 - DNA, 25 bp, Mus musculus
gaactctccggccagacttctttcg

SEQ ID NO: 411376 - DNA, 25 bp, Mus musculus
tgtctaactcgtttcggggtctctc

SEQ ID NO: 411377 - DNA, 25 bp, Mus musculus
agactctccactggctctcctaagg

SEQ ID NO: 411378 - DNA, 25 bp, Mus musculus
aaaataaacgcggtgagacggctgg

SEQ ID NO: 411379 - DNA, 25 bp, Mus musculus
agcacggcaccaaaaataaacgcgg

SEQ ID NO: 411380 - DNA, 25 bp, Mus musculus
ctgacggctgccaagaagcacggca

SEQ ID NO: 411381 - DNA, 25 bp, Mus musculus
aatcgaacaggagctgacggctgcc

SEQ ID NO: 411382 - DNA, 25 bp, Mus musculus
gttaagcaagaagcaggagttcctg

SEQ ID NO: 411383 - DNA, 25 bp, Mus musculus
gacacggaggagatgttaagcaaga

SEQ ID NO: 411384 - DNA, 25 bp, Mus musculus
ccatccagcggcttcgggacacgga

SEQ ID NO: 411385 - DNA, 25 bp, Mus musculus
ggggtctctctcgactctggaactc

SEQ ID NO: 411386 - DNA, 25 bp, Mus musculus
ttcagcacccggctggtggaagcca

SEQ ID NO: 411387 - DNA, 25 bp, Mus musculus
aagttggagtcttttgtgctgcgcc

SEQ ID NO: 411388 - DNA, 25 bp, Mus musculus
tgcccgctcggaagttggagtcttt

SEQ ID NO: 411389 - DNA, 25 bp, Mus musculus
gacgcctggtattcgcagctcgcct

SEQ ID NO: 411390 - DNA, 25 bp, Mus musculus
cctgggagccggagtaactctcggc

SEQ ID NO: 411391 - DNA, 25 bp, Mus musculus
tagaaactctttctctccgcggtcc

SEQ ID NO: 411392 - DNA, 25 bp, Mus musculus
ttccgtgtgcctttttcgttcctca

SEQ ID NO: 411393 - DNA, 25 bp, Mus musculus
ttcctccagacctcggcgcgggtga

SEQ ID NO: 411394 - DNA, 25 bp, Mus musculus
aagcggtcgcgactctcgcgcgtgt

SEQ ID NO: 411395 - DNA, 25 bp, Mus musculus
gtggcaggatcctattcggaggacc

SEQ ID NO: 411396 - DNA, 25 bp, Mus musculus
agcccacgcgtttggagagcccggc

SEQ ID NO: 411397 - DNA, 25 bp, Mus musculus
tggacctttccaaagcccggcgcga

SEQ ID NO: 411398 - DNA, 25 bp, Mus musculus
ctggtggaagccacaaactcctttc

SEQ ID NO: 411399 - DNA, 25 bp, Mus musculus
gcgccgaagctctggacctttccaa

SEQ ID NO: 411400 - DNA, 25 bp, Mus musculus
cagaaagggaaacgcgatgggccct

SEQ ID NO: 411401 - DNA, 25 bp, Mus musculus
gatgggccctggtcatctggccaca

SEQ ID NO: 411402 - DNA, 25 bp, Mus musculus
tggtcatctggccacaggttcgttc

SEQ ID NO: 411403 - DNA, 25 bp, Mus musculus
catctggccacaggttcgttccgcg

SEQ ID NO: 411404 - DNA, 25 bp, Mus musculus
gcgggagggacacctcagaactgca

SEQ ID NO: 411405 - DNA, 25 bp, Mus musculus
acctcagaactgcagctcgctagtg

SEQ ID NO: 411406 - DNA, 25 bp, Mus musculus
ctgcagctcgctagtggttgctttg

SEQ ID NO: 411407 - DNA, 25 bp, Mus musculus
actccgggacgcgacgtgcgagcac

SEQ ID NO: 411408 - DNA, 25 bp, Mus musculus
ggggaccggatactaccgccagatc

SEQ ID NO: 411409 - DNA, 25 bp, Mus musculus
accgccagatcctggcaggctacga

SEQ ID NO: 411410 - DNA, 25 bp, Mus musculus
ggcaggctacgaccgtgttcccatt

SEQ ID NO: 411411 - DNA, 25 bp, Mus musculus
gctacgaccgtgttcccattctctg

SEQ ID NO: 411412 - DNA, 25 bp, Mus musculus
tctctgtcaacttctcctccgaaga

SEQ ID NO: 411413 - DNA, 25 bp, Mus musculus
ttctcctccgaagaacagaaaggga

SEQ ID NO: 411414 - DNA, 25 bp, Mus musculus
gttcggcttcctgcctcagtcctta

SEQ ID NO: 411415 - DNA, 25 bp, Mus musculus
tttggctagaaaagaccggcgcttg

SEQ ID NO: 411416 - DNA, 25 bp, Mus musculus
cgggcaaactaactcggcattcaac

SEQ ID NO: 411417 - DNA, 25 bp, Mus musculus
ttccgaaacgccgatcaccgtggga

SEQ ID NO: 411418 - DNA, 25 bp, Mus musculus
atccgcccggaaaaggcagcctaca

SEQ ID NO: 411419 - DNA, 25 bp, Mus musculus
ttcggcagggatgaaaagtcaaacc

SEQ ID NO: 411420 - DNA, 25 bp, Mus musculus
ggagtcagcgtagctcccaccgata

SEQ ID NO: 411421 - DNA, 25 bp, Mus musculus
agcaccgcactaggctcttgcatca

SEQ ID NO: 411422 - DNA, 25 bp, Mus musculus
tgcatcagcgaaagggagcgacacc

SEQ ID NO: 411423 - DNA, 25 bp, Mus musculus
tctcaaacgttggaagtgcgcctgc

SEQ ID NO: 411424 - DNA, 25 bp, Mus musculus
ctcgccaaagcgcaggcgtacagta

SEQ ID NO: 411425 - DNA, 25 bp, Mus musculus
accttacgtgcttctcgtggcgcga

SEQ ID NO: 411426 - DNA, 25 bp, Mus musculus
tggcgcgagttattcggcgactccc

SEQ ID NO: 411427 - DNA, 25 bp, Mus musculus
ccctttccgagaggacggctcaaca

SEQ ID NO: 411428 - DNA, 25 bp, Mus musculus
caggatggcgtagcccgttcagtag

SEQ ID NO: 411429 - DNA, 25 bp, Mus musculus
tgacgcagcttcttcgctgcgcgcg

SEQ ID NO: 411430 - DNA, 25 bp, Mus musculus
gtcgagtactcaaccccaactgctg

SEQ ID NO: 411431 - DNA, 25 bp, Mus musculus
cgcctgcacctgtcgagtactcaac

SEQ ID NO: 411432 - DNA, 25 bp, Mus musculus
agtgccgtttcttcggcagcgcctg

SEQ ID NO: 411433 - DNA, 25 bp, Mus musculus
cacccgcgacagctgcaagccaccc

SEQ ID NO: 411434 - DNA, 25 bp, Mus musculus
ccaccttcgccctgcgtggccaccc

SEQ ID NO: 411435 - DNA, 25 bp, Mus musculus
cagaaaaaggcttcgatgaagaagg

SEQ ID NO: 411436 - DNA, 25 bp, Mus musculus
acgtctctcctacagaaaaaggctt

SEQ ID NO: 411437 - DNA, 25 bp, Mus musculus
tagtcctcaacgtctctcctacaga

SEQ ID NO: 411438 - DNA, 25 bp, Mus musculus
gttcagtagtcctcaacgtctctcc

SEQ ID NO: 411439 - DNA, 25 bp, Mus musculus
gcgtagcccgttcagtagtcctcaa

SEQ ID NO: 411440 - DNA, 25 bp, Mus musculus
aactgctgacgcagcttcttcgctg

SEQ ID NO: 411441 - DNA, 25 bp, Mus musculus
ttcgatgaagaaggtggcaaggccc

SEQ ID NO: 411442 - DNA, 25 bp, Mus musculus
cggaggactgaacccttgggactca

SEQ ID NO: 411443 - DNA, 25 bp, Mus musculus
cccttgggactcaccgactttgtag

SEQ ID NO: 411444 - DNA, 25 bp, Mus musculus
ctctcggcggcgtgtggactccaat

SEQ ID NO: 411445 - DNA, 25 bp, Mus musculus
gcacgctgcccgaccaaagatcaca

SEQ ID NO: 411446 - DNA, 25 bp, Mus musculus
cacctaaacaagacgcaggtcggta

SEQ ID NO: 411447 - DNA, 25 bp, Mus musculus
cgcaggtcggtactgacaacaaacc

SEQ ID NO: 411448 - DNA, 25 bp, Mus musculus
tactgacaacaaacccaggacggga

SEQ ID NO: 411449 - DNA, 25 bp, Mus musculus
acccaggacgggagccgagtcgcca

SEQ ID NO: 411450 - DNA, 25 bp, Mus musculus
gaagccgccacctaaacaagacgca

SEQ ID NO: 411451 - DNA, 25 bp, Mus musculus
caccgactttgtagggcagtttatc

SEQ ID NO: 411452 - DNA, 25 bp, Mus musculus
cagtttatcagacatgctggcggcg

SEQ ID NO: 411453 - DNA, 25 bp, Mus musculus
cggcgcttccgctaggactgatgaa

SEQ ID NO: 411454 - DNA, 25 bp, Mus musculus
ccgctaggactgatgaactcagtga

SEQ ID NO: 411455 - DNA, 25 bp, Mus musculus
agccgagtcgccacggaggactgaa

SEQ ID NO: 411456 - DNA, 25 bp, Mus musculus
actggggtcatttctgtggcttgga

SEQ ID NO: 411457 - DNA, 25 bp, Mus musculus
ctgcgcactaggtgtgaagtagctc

SEQ ID NO: 411458 - DNA, 25 bp, Mus musculus
tgaagtagctctagtcgctgtagtc

SEQ ID NO: 411459 - DNA, 25 bp, Mus musculus
ctctagtcgctgtagtcggggctcg

SEQ ID NO: 411460 - DNA, 25 bp, Mus musculus
gctcgggaccggctgccatcttagc

SEQ ID NO: 411461 - DNA, 25 bp, Mus musculus
gctgccatcttagcggagggactga

SEQ ID NO: 411462 - DNA, 25 bp, Mus musculus
cgcaggcagactggggtcatttctg

SEQ ID NO: 411463 - DNA, 25 bp, Mus musculus
cctgtagtccggactgcgccgagga

SEQ ID NO: 411464 - DNA, 25 bp, Mus musculus
tggcgctcgagtctggacctagagc

SEQ ID NO: 411465 - DNA, 25 bp, Mus musculus
tctggacctagagccggggctgctc

SEQ ID NO: 411466 - DNA, 25 bp, Mus musculus
gtcagcaggtcgagccgaactgcta

SEQ ID NO: 411467 - DNA, 25 bp, Mus musculus
actgctagtgcttggcctaggcgtc

SEQ ID NO: 411468 - DNA, 25 bp, Mus musculus
tcgagccgaactgctagtgcttggc

SEQ ID NO: 411469 - DNA, 25 bp, Mus musculus
gagtcccggtaaacacgcgcaggca

SEQ ID NO: 411470 - DNA, 25 bp, Mus musculus
tgaagtccggcatatggcaggcacc

SEQ ID NO: 411471 - DNA, 25 bp, Mus musculus
cgggctgcgacgttttctgaagtcc

SEQ ID NO: 411472 - DNA, 25 bp, Mus musculus
cgagtacagttttgctttttggtca

SEQ ID NO: 411473 - DNA, 25 bp, Mus musculus
ccctccggctcgagtacagttttgc

SEQ ID NO: 411474 - DNA, 25 bp, Mus musculus
cctttagtcccagccgaggcggagc

SEQ ID NO: 411475 - DNA, 25 bp, Mus musculus
tgagtgtccacccaaggcggcggta

SEQ ID NO: 411476 - DNA, 25 bp, Mus musculus
atccgtccgagatggtgagtgtcca

SEQ ID NO: 411477 - DNA, 25 bp, Mus musculus
ctaagtgttggcgattcggagctgc

SEQ ID NO: 411478 - DNA, 25 bp, Mus musculus
tcgatctgtccgtctccacaaagga

SEQ ID NO: 411479 - DNA, 25 bp, Mus musculus
ctcctgataggctgctcgatctgtc

SEQ ID NO: 411480 - DNA, 25 bp, Mus musculus
gcccatcactgctggctcctgatag

SEQ ID NO: 411481 - DNA, 25 bp, Mus musculus
ccgtctccacaaaggactgtgcgca

SEQ ID NO: 411482 - DNA, 25 bp, Mus musculus
ggcaccctgggcgtaagcgcttacg

SEQ ID NO: 411483 - DNA, 25 bp, Mus musculus
tcggagctgcaggatccgtccgaga

SEQ ID NO: 411484 - DNA, 25 bp, Mus musculus
aagaactgggccaccgagctgcccg

SEQ ID NO: 411485 - DNA, 25 bp, Mus musculus
acgcctgctagagtagtggcttcga

SEQ ID NO: 411486 - DNA, 25 bp, Mus musculus
cgccgcggtctgacgcctgctagag

SEQ ID NO: 411487 - DNA, 25 bp, Mus musculus
gcggatctcgaagagctgcaccctc

SEQ ID NO: 411488 - DNA, 25 bp, Mus musculus
ctgactcaggcggatctcgaagagc

SEQ ID NO: 411489 - DNA, 25 bp, Mus musculus
gaccgtagacgacgcggccctgact

SEQ ID NO: 411490 - DNA, 25 bp, Mus musculus
aggcgcaagtgcacggtcccagcca

SEQ ID NO: 411491 - DNA, 25 bp, Mus musculus
cccacctcggaagggcagtggcgct

SEQ ID NO: 411492 - DNA, 25 bp, Mus musculus
caccgcaggtaagaacgcgtctacc

SEQ ID NO: 411493 - DNA, 25 bp, Mus musculus
taagaacccagtcgcagagcccact

SEQ ID NO: 411494 - DNA, 25 bp, Mus musculus
gcttcctggagactaagaacccagt

SEQ ID NO: 411495 - DNA, 25 bp, Mus musculus
tcccagaactgcctgttcctggtgc

SEQ ID NO: 411496 - DNA, 25 bp, Mus musculus
tgccctccgtgagcctcccagaact

SEQ ID NO: 411497 - DNA, 25 bp, Mus musculus
agagtagtggcttcgaggcccgccc

SEQ ID NO: 411498 - DNA, 25 bp, Mus musculus
ctcgatgaaggtgcggtgaactact

SEQ ID NO: 411499 - DNA, 25 bp, Mus musculus
ctccactccaggtgatcatcgagcg

SEQ ID NO: 411500 - DNA, 25 bp, Mus musculus
tccttctcgaatgctaaactcgatg

SEQ ID NO: 411501 - DNA, 25 bp, Mus musculus
tactccgcagcgtcgagagactgga

SEQ ID NO: 411502 - DNA, 25 bp, Mus musculus
aggagcttgccatcgtgacgtcaca

SEQ ID NO: 411503 - DNA, 25 bp, Mus musculus
tcacagaactgtgacgcgccctgga

SEQ ID NO: 411504 - DNA, 25 bp, Mus musculus
ccctttaaggaatgttgtgacctga

SEQ ID NO: 411505 - DNA, 25 bp, Mus musculus
tgacgtcacccaggcgagttacctc

SEQ ID NO: 411506 - DNA, 25 bp, Mus musculus
gaaccgcagacgcatctctgagccg

SEQ ID NO: 411507 - DNA, 25 bp, Mus musculus
gctgggcctcacacagagctctgtc

SEQ ID NO: 411508 - DNA, 25 bp, Mus musculus
ccgaccgctgtaaggaggtgcagca

SEQ ID NO: 411509 - DNA, 25 bp, Mus musculus
gtaagatcccggtgagtctctagca

SEQ ID NO: 411510 - DNA, 25 bp, Mus musculus
atggaggcgacaaatgcctggcttc

SEQ ID NO: 411511 - DNA, 25 bp, Mus musculus
caggtcccgcccttggcttacgagt

SEQ ID NO: 411512 - DNA, 25 bp, Mus musculus
acagactttaggactaccattccca

SEQ ID NO: 411513 - DNA, 25 bp, Mus musculus
ctggagcgaaacaaggccgccctca

SEQ ID NO: 411514 - DNA, 25 bp, Mus musculus
atgaactcggccaaactggagcgaa

SEQ ID NO: 411515 - DNA, 25 bp, Mus musculus
tcccagaaagccctgcggcgagtcg

SEQ ID NO: 411516 - DNA, 25 bp, Mus musculus
cgcgcaggcaatgcggaagagcctc

SEQ ID NO: 411517 - DNA, 25 bp, Mus musculus
ccgtggctgttgctggagcacacag

SEQ ID NO: 411518 - DNA, 25 bp, Mus musculus
agtacctccgtggaacgagtgccgt

SEQ ID NO: 411519 - DNA, 25 bp, Mus musculus
cacactgtagtacctccgtggaacg

SEQ ID NO: 411520 - DNA, 25 bp, Mus musculus
gtcacggccaccacaagcaccaggg

SEQ ID NO: 411521 - DNA, 25 bp, Mus musculus
caagggagccgccatgataactgag

SEQ ID NO: 411522 - DNA, 25 bp, Mus musculus
tgcggaagagcctcaagacttgcgc

SEQ ID NO: 411523 - DNA, 25 bp, Mus musculus
ccatgataactgaggcgggcgcgca

SEQ ID NO: 411524 - DNA, 25 bp, Mus musculus
agacttgcgcgccacactgtagtac

SEQ ID NO: 411525 - DNA, 25 bp, Mus musculus
gcacacagactttaggactaccatt

SEQ ID NO: 411526 - DNA, 25 bp, Mus musculus
ccctattggttgctccaagccggta

SEQ ID NO: 411527 - DNA, 25 bp, Mus musculus
acgctgaaagacaagcgggatccga

SEQ ID NO: 411528 - DNA, 25 bp, Mus musculus
cttccaggcttgcatgggtgcttgt

SEQ ID NO: 411529 - DNA, 25 bp, Mus musculus
attgagacgtcaccaaggccagccc

SEQ ID NO: 411530 - DNA, 25 bp, Mus musculus
ctccaagccggtaggccatgacgtt

SEQ ID NO: 411531 - DNA, 25 bp, Mus musculus
agctgcgttcttggctccctattgg

SEQ ID NO: 411532 - DNA, 25 bp, Mus musculus
gcacaactacctcagcgcagcggtt

SEQ ID NO: 411533 - DNA, 25 bp, Mus musculus
cggtatgcggctccagttgtgagca

SEQ ID NO: 411534 - DNA, 25 bp, Mus musculus
tgaagcgttcggatttgtgccctga

SEQ ID NO: 411535 - DNA, 25 bp, Mus musculus
tgtgacgtcacaatcagctgttgaa

SEQ ID NO: 411536 - DNA, 25 bp, Mus musculus
ggaaagagcattcggcgcctgtgat

SEQ ID NO: 411537 - DNA, 25 bp, Mus musculus
acagaggctccgagagcagctcccg

SEQ ID NO: 411538 - DNA, 25 bp, Mus musculus
cgttctttgtctgtctccgccggcg

SEQ ID NO: 411539 - DNA, 25 bp, Mus musculus
gccatgacgttgctttatttgcata

SEQ ID NO: 411540 - DNA, 25 bp, Mus musculus
aatccctcgccgactcctggtccca

SEQ ID NO: 411541 - DNA, 25 bp, Mus musculus
cgacagcgggctgagcgccacacat

SEQ ID NO: 411542 - DNA, 25 bp, Mus musculus
ccgctcgagctgtgctgctggagaa

SEQ ID NO: 411543 - DNA, 25 bp, Mus musculus
tcctatgcccgctcgagctgtgctg

SEQ ID NO: 411544 - DNA, 25 bp, Mus musculus
cttgcaccacgcagctgctcctatg

SEQ ID NO: 411545 - DNA, 25 bp, Mus musculus
gctaaagtgttgcaacggcagaatc

SEQ ID NO: 411546 - DNA, 25 bp, Mus musculus
caacggcagaatcgcgcccgggaga

SEQ ID NO: 411547 - DNA, 25 bp, Mus musculus
agcaccagggcagctttatttacca

SEQ ID NO: 411548 - DNA, 25 bp, Mus musculus
gcgccacacattgagtgctaaagtg

SEQ ID NO: 411549 - DNA, 25 bp, Mus musculus
agggcagctttatttaccagccgtg

SEQ ID NO: 411550 - DNA, 25 bp, Mus musculus
ctttatttaccagccgtgccagcgc

SEQ ID NO: 411551 - DNA, 25 bp, Mus musculus
cgtgccagcgccagttcaactactg

SEQ ID NO: 411552 - DNA, 25 bp, Mus musculus
agcgccagttcaactactgagcgcc

SEQ ID NO: 411553 - DNA, 25 bp, Mus musculus
gctgagcgccacacattgagtgcta

SEQ ID NO: 411554 - DNA, 25 bp, Mus musculus
tcctcgatcccgaaggcaagtactg

SEQ ID NO: 411555 - DNA, 25 bp, Mus musculus
ggcagcgcagtccacccaaaggtga

SEQ ID NO: 411556 - DNA, 25 bp, Mus musculus
tccctgcgctgggatcgccctagaa

SEQ ID NO: 411557 - DNA, 25 bp, Mus musculus
ctccaggtaagctcgggtcccttcg

SEQ ID NO: 411558 - DNA, 25 bp, Mus musculus
catggccgcggcagacatcgtggta

SEQ ID NO: 411559 - DNA, 25 bp, Mus musculus
gctacgtgggcttcggcttctcgcc

SEQ ID NO: 411560 - DNA, 25 bp, Mus musculus
acgcacgaacggctacgtgggcttc

SEQ ID NO: 411561 - DNA, 25 bp, Mus musculus
cgatgggcagcgcagtccacccaaa

SEQ ID NO: 411562 - DNA, 25 bp, Mus musculus
ccgaaggcaagtactggctgcactg

SEQ ID NO: 411563 - DNA, 25 bp, Mus musculus
accgcgtggtcctcgatcccgaagg

SEQ ID NO: 411564 - DNA, 25 bp, Mus musculus
ccactgcttgtgctgtgggcgctgc

SEQ ID NO: 411565 - DNA, 25 bp, Mus musculus
ccaaaggtgaggctgatacgggctc

SEQ ID NO: 411566 - DNA, 25 bp, Mus musculus
tgtgcggctggccactgcttgtgct

SEQ ID NO: 411567 - DNA, 25 bp, Mus musculus
ccttccgtctggaggtacgcacgaa

SEQ ID NO: 411568 - DNA, 25 bp, Mus musculus
tcccaagaaggcgtcctcgtcctta

SEQ ID NO: 411569 - DNA, 25 bp, Mus musculus
agcagtgtcctagtatgactcgccc

SEQ ID NO: 411570 - DNA, 25 bp, Mus musculus
ggtctcccaagaaggcgtcctcgtc

SEQ ID NO: 411571 - DNA, 25 bp, Mus musculus
caagaaggcgtcctcgtccttacgg

SEQ ID NO: 411572 - DNA, 25 bp, Mus musculus
gaagctggtgatgctcatatagtcc

SEQ ID NO: 411573 - DNA, 25 bp, Mus musculus
ctggtgatgctcatatagtccactg

SEQ ID NO: 411574 - DNA, 25 bp, Mus musculus
tgatgctcatatagtccactggtga

SEQ ID NO: 411575 - DNA, 25 bp, Mus musculus
tatagtccactggtgagtaggcgcc

SEQ ID NO: 411576 - DNA, 25 bp, Mus musculus
agtccactggtgagtaggcgcctag

SEQ ID NO: 411577 - DNA, 25 bp, Mus musculus
gctctcctggctagcctcgttctca

SEQ ID NO: 411578 - DNA, 25 bp, Mus musculus
ttctcagccgccatcctcgccctaa

SEQ ID NO: 411579 - DNA, 25 bp, Mus musculus
ccaccgtcagcagtgtcctagtatg

SEQ ID NO: 411580 - DNA, 25 bp, Mus musculus
tcctccggcagcctcgggaagctgg

SEQ ID NO: 411581 - DNA, 25 bp, Mus musculus
cgtcagcagtgtcctagtatgactc

SEQ ID NO: 411582 - DNA, 25 bp, Mus musculus
caccggcgttctgtggaggagccac

SEQ ID NO: 411583 - DNA, 25 bp, Mus musculus
tgtcttcagcggtttttgctgaccc

SEQ ID NO: 411584 - DNA, 25 bp, Mus musculus
ggccctacccactattggatgccta

SEQ ID NO: 411585 - DNA, 25 bp, Mus musculus
tattggatgcctagagcacggcctc

SEQ ID NO: 411586 - DNA, 25 bp, Mus musculus
agagcacggcctctagcctcaggct

SEQ ID NO: 411587 - DNA, 25 bp, Mus musculus
ttccggcaagacagctccgccctta

SEQ ID NO: 411588 - DNA, 25 bp, Mus musculus
cagcgaccgcaacggcggacaaggt

SEQ ID NO: 411589 - DNA, 25 bp, Mus musculus
cggacaaggtgttcggaacttgatg

SEQ ID NO: 411590 - DNA, 25 bp, Mus musculus
ttcggaacttgatgcgatggggctt

SEQ ID NO: 411591 - DNA, 25 bp, Mus musculus
acttgatgcgatggggcttcccgag

SEQ ID NO: 411592 - DNA, 25 bp, Mus musculus
tctctgcagcgctaccgcgagctgc

SEQ ID NO: 411593 - DNA, 25 bp, Mus musculus
agtccgagggagatttaccgagctc

SEQ ID NO: 411594 - DNA, 25 bp, Mus musculus
gaggtcagacgctcggcgcacgtcc

SEQ ID NO: 411595 - DNA, 25 bp, Mus musculus
cccttgtcttcagcggtttttgctg

SEQ ID NO: 411596 - DNA, 25 bp, Mus musculus
ctgggaaccggcgatctggaaatct

SEQ ID NO: 411597 - DNA, 25 bp, Mus musculus
cgctaacagtgtccgagctgggaac

SEQ ID NO: 411598 - DNA, 25 bp, Mus musculus
ccggcgatctggaaatctaggttca

SEQ ID NO: 411599 - DNA, 25 bp, Mus musculus
tggaaatctaggttcagcacgccca

SEQ ID NO: 411600 - DNA, 25 bp, Mus musculus
ctaggttcagcacgcccagcacaag

SEQ ID NO: 411601 - DNA, 25 bp, Mus musculus
cctcactggacacaagtttcccggt

SEQ ID NO: 411602 - DNA, 25 bp, Mus musculus
ggacacaagtttcccggtgctcgcc

SEQ ID NO: 411603 - DNA, 25 bp, Mus musculus
tcgccgcgttctaatcgctctcaga

SEQ ID NO: 411604 - DNA, 25 bp, Mus musculus
aaggaaacttgaccctcgccagccg

SEQ ID NO: 411605 - DNA, 25 bp, Mus musculus
gacttactcgctcgttgtccagctg

SEQ ID NO: 411606 - DNA, 25 bp, Mus musculus
tgtccagctgctcgccaagctcaaa

SEQ ID NO: 411607 - DNA, 25 bp, Mus musculus
caagctcaaactccgcacgccgtta

SEQ ID NO: 411608 - DNA, 25 bp, Mus musculus
ggcttcggtacgacccagtgcgcct

SEQ ID NO: 411609 - DNA, 25 bp, Mus musculus
agccaccgcgtcatctgcccgctcg

SEQ ID NO: 411610 - DNA, 25 bp, Mus musculus
cctgcagcgcatccggcagaaactg

SEQ ID NO: 411611 - DNA, 25 bp, Mus musculus
aaactctggcccgtggcaaggtctg

SEQ ID NO: 411612 - DNA, 25 bp, Mus musculus
cgtggaaactctggcccgtggcaag

SEQ ID NO: 411613 - DNA, 25 bp, Mus musculus
cgatctgggcgccagcgtggaaact

SEQ ID NO: 411614 - DNA, 25 bp, Mus musculus
cggcagaaactggaaaaggagaaga

SEQ ID NO: 411615 - DNA, 25 bp, Mus musculus
gcgcatccggcagaaactggaaaag

SEQ ID NO: 411616 - DNA, 25 bp, Mus musculus
aggcacgaggccactgtggctgccc

SEQ ID NO: 411617 - DNA, 25 bp, Mus musculus
tgtggctgccctgcgccgcaagcag

SEQ ID NO: 411618 - DNA, 25 bp, Mus musculus
aggcagttctgaggcacgaggccac

SEQ ID NO: 411619 - DNA, 25 bp, Mus musculus
caggtggacagcctgcagcgcatcc

SEQ ID NO: 411620 - DNA, 25 bp, Mus musculus
atagcgctgcagagctgagcgagca

SEQ ID NO: 411621 - DNA, 25 bp, Mus musculus
aagcaggccgatagcgctgcagagc

SEQ ID NO: 411622 - DNA, 25 bp, Mus musculus
tgcgccgcaagcaggccgatagcgc

SEQ ID NO: 411623 - DNA, 25 bp, Mus musculus
tctggcccgtggcaaggtctgcctc

SEQ ID NO: 411624 - DNA, 25 bp, Mus musculus
cgcagcggcctggaaaggcctcttc

SEQ ID NO: 411625 - DNA, 25 bp, Mus musculus
cccggagccgtgtcgatttctacgg

SEQ ID NO: 411626 - DNA, 25 bp, Mus musculus
cagggaaatgaggatctagaaactc

SEQ ID NO: 411627 - DNA, 25 bp, Mus musculus
ggatctagaaactcggcccagggct

SEQ ID NO: 411628 - DNA, 25 bp, Mus musculus
ccagggcttagacgcgccatcaata

SEQ ID NO: 411629 - DNA, 25 bp, Mus musculus
gctcgactccactcggcccagaccc

SEQ ID NO: 411630 - DNA, 25 bp, Mus musculus
aacgcggctgacagcgtccggaccg

SEQ ID NO: 411631 - DNA, 25 bp, Mus musculus
gacagcgtccggaccgcacacagga

SEQ ID NO: 411632 - DNA, 25 bp, Mus musculus
ctcgtacctgcaccgcccggaccag

SEQ ID NO: 411633 - DNA, 25 bp, Mus musculus
atgtctcctcgtccgacaaacagga

SEQ ID NO: 411634 - DNA, 25 bp, Mus musculus
ctgcagcaggatgttacccggccgc

SEQ ID NO: 411635 - DNA, 25 bp, Mus musculus
aacaggaagcaagcggtcccggagc

SEQ ID NO: 411636 - DNA, 25 bp, Mus musculus
gcggcggaggactctctacatcgcc

SEQ ID NO: 411637 - DNA, 25 bp, Mus musculus
tccgacaaacaggaagcaagcggtc

SEQ ID NO: 411638 - DNA, 25 bp, Mus musculus
tgtcctgtcagtgccgccgcagcag

SEQ ID NO: 411639 - DNA, 25 bp, Mus musculus
tccgagccgcggctggttcttccgg

SEQ ID NO: 411640 - DNA, 25 bp, Mus musculus
gcagccaccgccaccagctcatcct

SEQ ID NO: 411641 - DNA, 25 bp, Mus musculus
cccagccgtagagagcgggagcctg

SEQ ID NO: 411642 - DNA, 25 bp, Mus musculus
agagctcgtgtcctgtcagtgccgc

SEQ ID NO: 411643 - DNA, 25 bp, Mus musculus
catagagctcgtgtcctgtcagtgc

SEQ ID NO: 411644 - DNA, 25 bp, Mus musculus
aaaggcatagagctcgtgtcctgtc

SEQ ID NO: 411645 - DNA, 25 bp, Mus musculus
atgagtagccggaaaggcatagagc

SEQ ID NO: 411646 - DNA, 25 bp, Mus musculus
tagcagcacgcacacgaggccgagc

SEQ ID NO: 411647 - DNA, 25 bp, Mus musculus
tgcaggggtagcagcacgcacacga

SEQ ID NO: 411648 - DNA, 25 bp, Mus musculus
caccatggtgcaggggtagcagcac

SEQ ID NO: 411649 - DNA, 25 bp, Mus musculus
ggggatacgcaccacgacgcctgcg

SEQ ID NO: 411650 - DNA, 25 bp, Mus musculus
ccttcacctgtagtgggcggggtcg

SEQ ID NO: 411651 - DNA, 25 bp, Mus musculus
gccggaaaggcatagagctcgtgtc

SEQ ID NO: 411652 - DNA, 25 bp, Mus musculus
gcgcacaaagcttcccgcgaaattg

SEQ ID NO: 411653 - DNA, 25 bp, Mus musculus
tgtacacaactcagaggcgcgaacg

SEQ ID NO: 411654 - DNA, 25 bp, Mus musculus
taacgttggccacgttcggtcactc

SEQ ID NO: 411655 - DNA, 25 bp, Mus musculus
cgggctgcacctgcggtttaaacgc

SEQ ID NO: 411656 - DNA, 25 bp, Mus musculus
agttccttggggttcatcctgtgcc

SEQ ID NO: 411657 - DNA, 25 bp, Mus musculus
ccgactttaaattgggcatcgtgcg

SEQ ID NO: 411658 - DNA, 25 bp, Mus musculus
ggcctggccatgaccgactttaaat

SEQ ID NO: 411659 - DNA, 25 bp, Mus musculus
agtcccattggtcacttggccgcgg

SEQ ID NO: 411660 - DNA, 25 bp, Mus musculus
ctgcgtctgtttcctagtcccattg

SEQ ID NO: 411661 - DNA, 25 bp, Mus musculus
ggcgcgaacgcaagcagctagtctc

SEQ ID NO: 411662 - DNA, 25 bp, Mus musculus
cgcgaaattgacgttgcgccggccg

SEQ ID NO: 411663 - DNA, 25 bp, Mus musculus
cgggtaaggacatacgttctacact

SEQ ID NO: 411664 - DNA, 25 bp, Mus musculus
tctcaggaagaagctgcgacctact

SEQ ID NO: 411665 - DNA, 25 bp, Mus musculus
ttggttctttttcactgcgcctgcg

SEQ ID NO: 411666 - DNA, 25 bp, Mus musculus
cgcgggccgggctccgttcagcacc

SEQ ID NO: 411667 - DNA, 25 bp, Mus musculus
cggacgcgcccttcgctgggcaggt

SEQ ID NO: 411668 - DNA, 25 bp, Mus musculus
ctgcccgcgctctgctgcctcgcgg

SEQ ID NO: 411669 - DNA, 25 bp, Mus musculus
gagtaaatagtaagcgcagccagtg

SEQ ID NO: 411670 - DNA, 25 bp, Mus musculus
tgtgtgtgagggaaaccgtacgcct

SEQ ID NO: 411671 - DNA, 25 bp, Mus musculus
agccgaggatgttggagctggagaa

SEQ ID NO: 411672 - DNA, 25 bp, Mus musculus
cgtacgcctcggagtaaatagtaag

SEQ ID NO: 411673 - DNA, 25 bp, Mus musculus
cctcggagtaaatagtaagcgcagc

SEQ ID NO: 411674 - DNA, 25 bp, Mus musculus
atagtaagcgcagccagtgtgttgt

SEQ ID NO: 411675 - DNA, 25 bp, Mus musculus
aagggccgtcgggataggcgagatc

SEQ ID NO: 411676 - DNA, 25 bp, Mus musculus
tgtggcctgcaaggctgtgtgtgag

SEQ ID NO: 411677 - DNA, 25 bp, Mus musculus
accggatcgcggtcttggtagctga

SEQ ID NO: 411678 - DNA, 25 bp, Mus musculus
taggcgagatcagcgtggccccacc

SEQ ID NO: 411679 - DNA, 25 bp, Mus musculus
tgtgtgagggaaaccgtacgcctcg

SEQ ID NO: 411680 - DNA, 25 bp, Mus musculus
tcaggcagtaaagtgaaagcagagc

SEQ ID NO: 411681 - DNA, 25 bp, Mus musculus
cgttatgacgcagccgagacagaga

SEQ ID NO: 411682 - DNA, 25 bp, Mus musculus
cctcacctcaggcagtaaagtgaaa

SEQ ID NO: 411683 - DNA, 25 bp, Mus musculus
aaagcagagctgcacggaagccgtc

SEQ ID NO: 411684 - DNA, 25 bp, Mus musculus
agctgcacggaagccgtctggcctg

SEQ ID NO: 411685 - DNA, 25 bp, Mus musculus
taccatgccagagcaagtgtcaccc

SEQ ID NO: 411686 - DNA, 25 bp, Mus musculus
gccgagacagagaaggaaggccttc

SEQ ID NO: 411687 - DNA, 25 bp, Mus musculus
tgcaggcgattagaaagcgcacgtc

SEQ ID NO: 411688 - DNA, 25 bp, Mus musculus
agaaggaaggccttcgcacgccagg

SEQ ID NO: 411689 - DNA, 25 bp, Mus musculus
gcccatggtctgtaatagaagccca

SEQ ID NO: 411690 - DNA, 25 bp, Mus musculus
gaagcccatttggtaccatgccaga

SEQ ID NO: 411691 - DNA, 25 bp, Mus musculus
tcagtaccaggacgtgcaggcgatt

SEQ ID NO: 411692 - DNA, 25 bp, Mus musculus
caggagagcgcccatggtctgtaat

SEQ ID NO: 411693 - DNA, 25 bp, Mus musculus
aggagcagcgttatgacgcagccga

SEQ ID NO: 411694 - DNA, 25 bp, Mus musculus
ggtgggtcgctcttttcagacctct

SEQ ID NO: 411695 - DNA, 25 bp, Mus musculus
gctgcaacaacttctcccgtaacta

SEQ ID NO: 411696 - DNA, 25 bp, Mus musculus
gcgactccaatgtctacacgctgca

SEQ ID NO: 411697 - DNA, 25 bp, Mus musculus
gttctgggccgacagatccactccg

SEQ ID NO: 411698 - DNA, 25 bp, Mus musculus
cgacctcacagttgttctcgaacga

SEQ ID NO: 411699 - DNA, 25 bp, Mus musculus
gtttggcaaaacaaccgacctcaca

SEQ ID NO: 411700 - DNA, 25 bp, Mus musculus
ctcgatggttactaggtgactccgc

SEQ ID NO: 411701 - DNA, 25 bp, Mus musculus
gaagctctcgcctcacctatagaag

SEQ ID NO: 411702 - DNA, 25 bp, Mus musculus
cctgcgacccggaactgacttttgc

SEQ ID NO: 411703 - DNA, 25 bp, Mus musculus
aacacggattcgctgcttactgggg

SEQ ID NO: 411704 - DNA, 25 bp, Mus musculus
ggagagctcaccctcgaacacactg

SEQ ID NO: 411705 - DNA, 25 bp, Mus musculus
cccaccctttgggaggactcgatgg

SEQ ID NO: 411706 - DNA, 25 bp, Mus musculus
agaagttctctgagcctccgatggc

SEQ ID NO: 411707 - DNA, 25 bp, Mus musculus
gaacgacgctctgaccgccatgaga

SEQ ID NO: 411708 - DNA, 25 bp, Mus musculus
aatgtcagtgcgcagccgaagcagc

SEQ ID NO: 411709 - DNA, 25 bp, Mus musculus
ctcccgggagcgtataaaagccagc

SEQ ID NO: 411710 - DNA, 25 bp, Mus musculus
gagcgtataaaagccagcgccgccc

SEQ ID NO: 411711 - DNA, 25 bp, Mus musculus
gcccgcctagtctcacacagctctt

SEQ ID NO: 411712 - DNA, 25 bp, Mus musculus
ttctctccaagaagactcagccaga

SEQ ID NO: 411713 - DNA, 25 bp, Mus musculus
gaagactcagccagatccactccag

SEQ ID NO: 411714 - DNA, 25 bp, Mus musculus
gatcatgctcgcctccgtcgcaggt

SEQ ID NO: 411715 - DNA, 25 bp, Mus musculus
tgagctgcgatcacagactgacctc

SEQ ID NO: 411716 - DNA, 25 bp, Mus musculus
agggcctcttctgcgatttcggctc

SEQ ID NO: 411717 - DNA, 25 bp, Mus musculus
gccaggactgcagcgcgcaatgtca

SEQ ID NO: 411718 - DNA, 25 bp, Mus musculus
cgtctgcgccaagcagctgggagaa

SEQ ID NO: 411719 - DNA, 25 bp, Mus musculus
ccaagcagctgggagaactgtgtac

SEQ ID NO: 411720 - DNA, 25 bp, Mus musculus
acacaagggcctcttctgcgatttc

SEQ ID NO: 411721 - DNA, 25 bp, Mus musculus
ccgcagcctgctatgggccaggact

SEQ ID NO: 411722 - DNA, 25 bp, Mus musculus
ggactcgcaccagcaacgccatgtt

SEQ ID NO: 411723 - DNA, 25 bp, Mus musculus
aagcccaacctggagacgcgcgtgc

SEQ ID NO: 411724 - DNA, 25 bp, Mus musculus
cgtctctagaaaagtactcctgcac

SEQ ID NO: 411725 - DNA, 25 bp, Mus musculus
taagtcgctgctgcgcgtcacaagg

SEQ ID NO: 411726 - DNA, 25 bp, Mus musculus
actcctcgccggtcttaagtcgctg

SEQ ID NO: 411727 - DNA, 25 bp, Mus musculus
atgaggttccaggacgcgagactcc

SEQ ID NO: 411728 - DNA, 25 bp, Mus musculus
cctgccgtggatctgaatgaggttc

SEQ ID NO: 411729 - DNA, 25 bp, Mus musculus
ttcgcaactgcgcacccgcggtttt

SEQ ID NO: 411730 - DNA, 25 bp, Mus musculus
caggcgtagttttcgcaactgcgca

SEQ ID NO: 411731 - DNA, 25 bp, Mus musculus
acgccatgttcctccacaatcattt

SEQ ID NO: 411732 - DNA, 25 bp, Mus musculus
tgggcttccggaatcccgattgtca

SEQ ID NO: 411733 - DNA, 25 bp, Mus musculus
gtactcctgcactcacaaggactcg

SEQ ID NO: 411734 - DNA, 25 bp, Mus musculus
tccacaatcatttccgggtgaaagg

SEQ ID NO: 411735 - DNA, 25 bp, Mus musculus
ccttgctaaaggtagtcaggctctg

SEQ ID NO: 411736 - DNA, 25 bp, Mus musculus
actgcagcgagccttgaggttcttg

SEQ ID NO: 411737 - DNA, 25 bp, Mus musculus
ggacagcttcagttgggcaacccgc

SEQ ID NO: 411738 - DNA, 25 bp, Mus musculus
cggagcgcacatccagcaaggctgc

SEQ ID NO: 411739 - DNA, 25 bp, Mus musculus
gatgtcgaacacctcccagccagat

SEQ ID NO: 411740 - DNA, 25 bp, Mus musculus
cggaagagcttccagatgtcgaaca

SEQ ID NO: 411741 - DNA, 25 bp, Mus musculus
gctgcgctgagttcttaaaatttcg

SEQ ID NO: 411742 - DNA, 25 bp, Mus musculus
gcagtgcgttcaaagcccaggccac

SEQ ID NO: 411743 - DNA, 25 bp, Mus musculus
ggaacaaggctttctcgtggacctg

SEQ ID NO: 411744 - DNA, 25 bp, Mus musculus
ttggtacgaccaaacactaggaaca

SEQ ID NO: 411745 - DNA, 25 bp, Mus musculus
atctcattaaagaacaggtcccgtt

SEQ ID NO: 411746 - DNA, 25 bp, Mus musculus
gccagagcgggccttaatctcatta

SEQ ID NO: 411747 - DNA, 25 bp, Mus musculus
acacagtcttgtcatcctggccaga

SEQ ID NO: 411748 - DNA, 25 bp, Mus musculus
gtccaagggcttcttccgtaagatc

SEQ ID NO: 411749 - DNA, 25 bp, Mus musculus
tccgccgctggctgaacaaatattc

SEQ ID NO: 411750 - DNA, 25 bp, Mus musculus
tttgcagcggcgcactcattcccgg

SEQ ID NO: 411751 - DNA, 25 bp, Mus musculus
acccgggagttttgcagcgccctgt

SEQ ID NO: 411752 - DNA, 25 bp, Mus musculus
atcacgctccgtgcacccgggagtt

SEQ ID NO: 411753 - DNA, 25 bp, Mus musculus
agatgctgcgcgccctgcggatcac

SEQ ID NO: 411754 - DNA, 25 bp, Mus musculus
tagcccggagctgacgggatgagat

SEQ ID NO: 411755 - DNA, 25 bp, Mus musculus
tcacactcgggtggcccactgtcgt

SEQ ID NO: 411756 - DNA, 25 bp, Mus musculus
gacagcggcttcctgtatcccggga

SEQ ID NO: 411757 - DNA, 25 bp, Mus musculus
gatgtcgcctggacagcggcttcct

SEQ ID NO: 411758 - DNA, 25 bp, Mus musculus
ctgagcgtaacggtccgaggtccag

SEQ ID NO: 411759 - DNA, 25 bp, Mus musculus
ctggcctccagactgagggcggccc

SEQ ID NO: 411760 - DNA, 25 bp, Mus musculus
gtggcccactgtcgtagcccggagc

SEQ ID NO: 411761 - DNA, 25 bp, Mus musculus
gagaggtttgcagcggcgcactcat

SEQ ID NO: 411762 - DNA, 25 bp, Mus musculus
gatccccgggaaccgactctggtga

SEQ ID NO: 411763 - DNA, 25 bp, Mus musculus
cccagagaacctcacactcgggtgg

SEQ ID NO: 411764 - DNA, 25 bp, Mus musculus
aagcagttcgatgcctaccctaaga

SEQ ID NO: 411765 - DNA, 25 bp, Mus musculus
gcaccgccctctgtgctcccagccc

SEQ ID NO: 411766 - DNA, 25 bp, Mus musculus
gagcactgcccaatccgcgcgagga

SEQ ID NO: 411767 - DNA, 25 bp, Mus musculus
caatccgcgcgaggaggcgtgacaa

SEQ ID NO: 411768 - DNA, 25 bp, Mus musculus
cgaggaggcgtgacaatgtccacaa

SEQ ID NO: 411769 - DNA, 25 bp, Mus musculus
atgtccacaagctagactgcctttg

SEQ ID NO: 411770 - DNA, 25 bp, Mus musculus
aagctagactgcctttgaggaggca

SEQ ID NO: 411771 - DNA, 25 bp, Mus musculus
ttacgcaccgctacgcctgcgcaag

SEQ ID NO: 411772 - DNA, 25 bp, Mus musculus
gttgcaaggagggagctgtcctcgc

SEQ ID NO: 411773 - DNA, 25 bp, Mus musculus
aggacttccgggtcaagacctgcgg

SEQ ID NO: 411774 - DNA, 25 bp, Mus musculus
actctggaggacttccgggtcaaga

SEQ ID NO: 411775 - DNA, 25 bp, Mus musculus
gttcgatgcctaccctaagactctg

SEQ ID NO: 411776 - DNA, 25 bp, Mus musculus
aagctgaagcagttcgatgcctacc

SEQ ID NO: 411777 - DNA, 25 bp, Mus musculus
tgcctaccctaagactctggaggac

SEQ ID NO: 411778 - DNA, 25 bp, Mus musculus
acgtgctcgacacgtgtccctcggg

SEQ ID NO: 411779 - DNA, 25 bp, Mus musculus
aatagttcccacagcgcgacttcgg

SEQ ID NO: 411780 - DNA, 25 bp, Mus musculus
tctacagcgagaacagcaatagttc

SEQ ID NO: 411781 - DNA, 25 bp, Mus musculus
aggctcggccgcatcctctcataat

SEQ ID NO: 411782 - DNA, 25 bp, Mus musculus
cgacttcggcttcccagaggggtag

SEQ ID NO: 411783 - DNA, 25 bp, Mus musculus
acaacagcacagcagcgggagggtc

SEQ ID NO: 411784 - DNA, 25 bp, Mus musculus
cggctcctctgtgacggtgacaaca

SEQ ID NO: 411785 - DNA, 25 bp, Mus musculus
gagtgtgaccctagtccggccgcac

SEQ ID NO: 411786 - DNA, 25 bp, Mus musculus
aaatcctgtgcctgggcatggctga

SEQ ID NO: 411787 - DNA, 25 bp, Mus musculus
caggaatgcccggaggagacacatg

SEQ ID NO: 411788 - DNA, 25 bp, Mus musculus
agacacatgggcaggaagctctcgg

SEQ ID NO: 411789 - DNA, 25 bp, Mus musculus
tgagcccgccttaagcccaggaatg

SEQ ID NO: 411790 - DNA, 25 bp, Mus musculus
gaagctggcgcctcggagccacaat

SEQ ID NO: 411791 - DNA, 25 bp, Mus musculus
agccacaatgggcagaccgcctgtg

SEQ ID NO: 411792 - DNA, 25 bp, Mus musculus
ccgccgcgaccctttgtgttgggcg

SEQ ID NO: 411793 - DNA, 25 bp, Mus musculus
acgtcacctgatgggagacgcaggc

SEQ ID NO: 411794 - DNA, 25 bp, Mus musculus
ctgccgacgtcacctgatgggagac

SEQ ID NO: 411795 - DNA, 25 bp, Mus musculus
tccacagccgcttcacaaaatggcc

SEQ ID NO: 411796 - DNA, 25 bp, Mus musculus
ccggagcccactgcagccaacacct

SEQ ID NO: 411797 - DNA, 25 bp, Mus musculus
agtgcctcagccctgcggccgacag

SEQ ID NO: 411798 - DNA, 25 bp, Mus musculus
accctttgtgttgggcgctcgcggc

SEQ ID NO: 411799 - DNA, 25 bp, Mus musculus
ggcacgcagactccacctttcgcat

SEQ ID NO: 411800 - DNA, 25 bp, Mus musculus
taaggccctgctcccacttcggcac

SEQ ID NO: 411801 - DNA, 25 bp, Mus musculus
aggccacccgatgctggccgcttcc

SEQ ID NO: 411802 - DNA, 25 bp, Mus musculus
cgacccggtagttcgcaggccgcga

SEQ ID NO: 411803 - DNA, 25 bp, Mus musculus
gtgcaggcgttttcatcgcaatccc

SEQ ID NO: 411804 - DNA, 25 bp, Mus musculus
cccactaagcgtgcaggcgttttca

SEQ ID NO: 411805 - DNA, 25 bp, Mus musculus
agcttgcgcggcaccagaacccaga

SEQ ID NO: 411806 - DNA, 25 bp, Mus musculus
gttcgctcctccagaaaccgtggga

SEQ ID NO: 411807 - DNA, 25 bp, Mus musculus
gtgcttagcagcaccgacccaaggg

SEQ ID NO: 411808 - DNA, 25 bp, Mus musculus
ctccaagcggctcgcagcagcatgt

SEQ ID NO: 411809 - DNA, 25 bp, Mus musculus
ggcgcttgcaagtcctcagcccatg

SEQ ID NO: 411810 - DNA, 25 bp, Mus musculus
tcagcccatgctcccggaagtaact

SEQ ID NO: 411811 - DNA, 25 bp, Mus musculus
aagtaactgcgctgtgctccggaag

SEQ ID NO: 411812 - DNA, 25 bp, Mus musculus
cctagcattcggagtgagacgtcga

SEQ ID NO: 411813 - DNA, 25 bp, Mus musculus
cttctgacccgggtgctatgtgacc

SEQ ID NO: 411814 - DNA, 25 bp, Mus musculus
ggtgaccaggccctcactgtcctag

SEQ ID NO: 411815 - DNA, 25 bp, Mus musculus
tgtcctagcactctcgccgcagatg

SEQ ID NO: 411816 - DNA, 25 bp, Mus musculus
cccagctgcttcgaccgcgtgaaga

SEQ ID NO: 411817 - DNA, 25 bp, Mus musculus
ccgcgtgaagatgggcttcgtcatg

SEQ ID NO: 411818 - DNA, 25 bp, Mus musculus
gttcggcaccttctcctgtctcagg

SEQ ID NO: 411819 - DNA, 25 bp, Mus musculus
aggatccgcaataatgcagtgctta

SEQ ID NO: 411820 - DNA, 25 bp, Mus musculus
cgcacttggcacgactgtgtatcgt

SEQ ID NO: 411821 - DNA, 25 bp, Mus musculus
agacactgagcttaccgcggactcg

SEQ ID NO: 411822 - DNA, 25 bp, Mus musculus
ctgcaggcagtagacactgagctta

SEQ ID NO: 411823 - DNA, 25 bp, Mus musculus
ttgcgagtcctgcaggcagtagaca

SEQ ID NO: 411824 - DNA, 25 bp, Mus musculus
tagccacgcagggacgttgcgagtc

SEQ ID NO: 411825 - DNA, 25 bp, Mus musculus
ttctggctcaatggcgggtagccac

SEQ ID NO: 411826 - DNA, 25 bp, Mus musculus
tgcatcctttggttctggctcaatg

SEQ ID NO: 411827 - DNA, 25 bp, Mus musculus
tgtggcgcatgcatcctttggttct

SEQ ID NO: 411828 - DNA, 25 bp, Mus musculus
ctctgtaccgggaatcttcggaggg

SEQ ID NO: 411829 - DNA, 25 bp, Mus musculus
agcgtctctgtaccgggaatcttcg

SEQ ID NO: 411830 - DNA, 25 bp, Mus musculus
cgcagcgtctctgtaccgggaatct

SEQ ID NO: 411831 - DNA, 25 bp, Mus musculus
tatggtcctccagcctgtaggcggc

SEQ ID NO: 411832 - DNA, 25 bp, Mus musculus
tgttcctatggtcctccagcctgta

SEQ ID NO: 411833 - DNA, 25 bp, Mus musculus
actgtgtatcgtgttcctatggtcc

SEQ ID NO: 411834 - DNA, 25 bp, Mus musculus
gacagcgtcggctagctccctgaaa

SEQ ID NO: 411835 - DNA, 25 bp, Mus musculus
ggcgtctaggcccaagcgaatctaa

SEQ ID NO: 411836 - DNA, 25 bp, Mus musculus
tgctgtcgctactgttaagccacta

SEQ ID NO: 411837 - DNA, 25 bp, Mus musculus
gcaggactccaggtcgaatttcaaa

SEQ ID NO: 411838 - DNA, 25 bp, Mus musculus
aaaagcctcggcatcgcggagcacc

SEQ ID NO: 411839 - DNA, 25 bp, Mus musculus
tccagactggaaagcacgaactatc

SEQ ID NO: 411840 - DNA, 25 bp, Mus musculus
tgtacctaagacaggagcaggactc

SEQ ID NO: 411841 - DNA, 25 bp, Mus musculus
ttgggtacgccaagtgtcacgttcc

SEQ ID NO: 411842 - DNA, 25 bp, Mus musculus
ccacgacgtccttgcccgagatgaa

SEQ ID NO: 411843 - DNA, 25 bp, Mus musculus
cgaatttcaaaagcccgcccgcgag

SEQ ID NO: 411844 - DNA, 25 bp, Mus musculus
cccgcgctgccattttagcggcgga

SEQ ID NO: 411845 - DNA, 25 bp, Mus musculus
ccctcggaaggacagatctttatct

SEQ ID NO: 411846 - DNA, 25 bp, Mus musculus
ttgcgccacagatgatcacagtttc

SEQ ID NO: 411847 - DNA, 25 bp, Mus musculus
cgtggcccaatctcgcgcaatgatt

SEQ ID NO: 411848 - DNA, 25 bp, Mus musculus
gctcaggccaatcagcggggcccga

SEQ ID NO: 411849 - DNA, 25 bp, Mus musculus
cgcggcgacgcgaagccagctggtt

SEQ ID NO: 411850 - DNA, 25 bp, Mus musculus
gtgcgcagcgcgcacagtccttctg

SEQ ID NO: 411851 - DNA, 25 bp, Mus musculus
gcacagtccttctgtcggttggtct

SEQ ID NO: 411852 - DNA, 25 bp, Mus musculus
ggactcggcgttcccgcttcaggga

SEQ ID NO: 411853 - DNA, 25 bp, Mus musculus
ggcgtgcgagcgtcgcccaatcact

SEQ ID NO: 411854 - DNA, 25 bp, Mus musculus
gagcgtcgcccaatcactgcggcta

SEQ ID NO: 411855 - DNA, 25 bp, Mus musculus
gaatgacggccgctcaggccaatca

SEQ ID NO: 411856 - DNA, 25 bp, Mus musculus
tgctgaggctgcaccccctgcttag

SEQ ID NO: 411857 - DNA, 25 bp, Mus musculus
ccctgcttagtccgcgagatagggg

SEQ ID NO: 411858 - DNA, 25 bp, Mus musculus
ggaggcctaagctgctgcctctgcc

SEQ ID NO: 411859 - DNA, 25 bp, Mus musculus
gcgcgcacagtccttctgtcggttg

SEQ ID NO: 411860 - DNA, 25 bp, Mus musculus
gctacccgcgggaatgacggccgct

SEQ ID NO: 411861 - DNA, 25 bp, Mus musculus
tcacgtggtgcgcagcgcgcacagt

SEQ ID NO: 411862 - DNA, 25 bp, Mus musculus
gcttcctgtctgatttcgggccctg

SEQ ID NO: 411863 - DNA, 25 bp, Mus musculus
gtgactcgagctcgcgaccgtttcc

SEQ ID NO: 411864 - DNA, 25 bp, Mus musculus
gtggcaccctacgaacccttgcgga

SEQ ID NO: 411865 - DNA, 25 bp, Mus musculus
tgaccagggaaatgcaaacgagcgc

SEQ ID NO: 411866 - DNA, 25 bp, Mus musculus
agcagacctgctttgaccagggaaa

SEQ ID NO: 411867 - DNA, 25 bp, Mus musculus
ccgaggtctcaaaggccggacaccg

SEQ ID NO: 411868 - DNA, 25 bp, Mus musculus
cccaaaagtgagaggatgcagcgac

SEQ ID NO: 411869 - DNA, 25 bp, Mus musculus
ctggaatcgctgtgtggtctgcaaa

SEQ ID NO: 411870 - DNA, 25 bp, Mus musculus
cgcgtagcccaacgaggactggact

SEQ ID NO: 411871 - DNA, 25 bp, Mus musculus
gcgtgggctattttgggtccctgac

SEQ ID NO: 411872 - DNA, 25 bp, Mus musculus
ccgcgggccgagctttaataggctc

SEQ ID NO: 411873 - DNA, 25 bp, Mus musculus
ggctcctctcctaggtccatgggcg

SEQ ID NO: 411874 - DNA, 25 bp, Mus musculus
ccagcgacagcactttgtaggtgtt

SEQ ID NO: 411875 - DNA, 25 bp, Mus musculus
ccgggtatttggcttcctgtctgat

SEQ ID NO: 411876 - DNA, 25 bp, Mus musculus
tcctctaccagtcacgtgaagtttg

SEQ ID NO: 411877 - DNA, 25 bp, Mus musculus
aagctcctcggtggccggaaatgaa

SEQ ID NO: 411878 - DNA, 25 bp, Mus musculus
tccacgatctgctccttggtgcgga

SEQ ID NO: 411879 - DNA, 25 bp, Mus musculus
tcctggtagcgaaactgccggaagc

SEQ ID NO: 411880 - DNA, 25 bp, Mus musculus
ccatgactacggctgttggcgtccc

SEQ ID NO: 411881 - DNA, 25 bp, Mus musculus
gcgtctgcaccggaaggaggtaaca

SEQ ID NO: 411882 - DNA, 25 bp, Mus musculus
ggaaatgaaccgatccgcgaatccg

SEQ ID NO: 411883 - DNA, 25 bp, Mus musculus
cgtgaagtttgatctggggaagtcc

SEQ ID NO: 411884 - DNA, 25 bp, Mus musculus
gggaagtccgtagacatcagctcta

SEQ ID NO: 411885 - DNA, 25 bp, Mus musculus
cagctctactgacactaaggatggc

SEQ ID NO: 411886 - DNA, 25 bp, Mus musculus
tcggacacgacagagtcgaaatctg

SEQ ID NO: 411887 - DNA, 25 bp, Mus musculus
ctgagtcgggatcggattccagatc

SEQ ID NO: 411888 - DNA, 25 bp, Mus musculus
cgcctccggtagaatggcctgcagc

SEQ ID NO: 411889 - DNA, 25 bp, Mus musculus
gtccggcctcgattaaggagataaa

SEQ ID NO: 411890 - DNA, 25 bp, Mus musculus
cacatctccgggtgtgcgtttaatg

SEQ ID NO: 411891 - DNA, 25 bp, Mus musculus
gtacgtgtcggggtccacatctccg

SEQ ID NO: 411892 - DNA, 25 bp, Mus musculus
attcgtgtctttgcgggtacgtgtc

SEQ ID NO: 411893 - DNA, 25 bp, Mus musculus
cgtggccgaagctacgattcgtgtc

SEQ ID NO: 411894 - DNA, 25 bp, Mus musculus
ttgctacgtcccgagctcgcgtgct

SEQ ID NO: 411895 - DNA, 25 bp, Mus musculus
agaccgagcaggctgttgctacgtc

SEQ ID NO: 411896 - DNA, 25 bp, Mus musculus
gccactggacgaagggactcagaga

SEQ ID NO: 411897 - DNA, 25 bp, Mus musculus
cggggcatttctgcgcagctccgga

SEQ ID NO: 411898 - DNA, 25 bp, Mus musculus
tctgagctctgcctaggctctggtg

SEQ ID NO: 411899 - DNA, 25 bp, Mus musculus
ctccgtggagagtctcgtcttcgtg

SEQ ID NO: 411900 - DNA, 25 bp, Mus musculus
tgaacgccaagctctcagtcaaagg

SEQ ID NO: 411901 - DNA, 25 bp, Mus musculus
actctctaggaggtggagtaaggcc

SEQ ID NO: 411902 - DNA, 25 bp, Mus musculus
tcaaaggcgaggtgaagcagacttg

SEQ ID NO: 411903 - DNA, 25 bp, Mus musculus
cgtttaatgtgaacgcgcgtgtgtc

SEQ ID NO: 411904 - DNA, 25 bp, Mus musculus
tcccggatcctctgacgggcagtgg

SEQ ID NO: 411905 - DNA, 25 bp, Mus musculus
ccggccctccatccgcaggcggctg

SEQ ID NO: 411906 - DNA, 25 bp, Mus musculus
ggccgctcacatggccacgggaggc

SEQ ID NO: 411907 - DNA, 25 bp, Mus musculus
gccgagcgaccctggcacctgggct

SEQ ID NO: 411908 - DNA, 25 bp, Mus musculus
gctcgtactcccttcccgggatctc

SEQ ID NO: 411909 - DNA, 25 bp, Mus musculus
acagatgcgctcagcgacggggtct

SEQ ID NO: 411910 - DNA, 25 bp, Mus musculus
cggggcttccttgccttcagcctgc

SEQ ID NO: 411911 - DNA, 25 bp, Mus musculus
gtcaagaccctcctccgaggctaga

SEQ ID NO: 411912 - DNA, 25 bp, Mus musculus
gcaggagcggttcccggccctccat

SEQ ID NO: 411913 - DNA, 25 bp, Mus musculus
cctccgatgctgtcggcccttccct

SEQ ID NO: 411914 - DNA, 25 bp, Mus musculus
agcgacggggtctcccggatcctct

SEQ ID NO: 411915 - DNA, 25 bp, Mus musculus
cccgggacagatgcgctcagcgacg

SEQ ID NO: 411916 - DNA, 25 bp, Mus musculus
accctcctccgaggctagatcgggg

SEQ ID NO: 411917 - DNA, 25 bp, Mus musculus
ttcagcctgccgcacgctcgtactc

SEQ ID NO: 411918 - DNA, 25 bp, Mus musculus
ggcgtccactgggtcactattccca

SEQ ID NO: 411919 - DNA, 25 bp, Mus musculus
tcactattcccacaccacggcgtcc

SEQ ID NO: 411920 - DNA, 25 bp, Mus musculus
accacggcgtccactgggtcactat

SEQ ID NO: 411921 - DNA, 25 bp, Mus musculus
tgggtcactattcccacaccacggc

SEQ ID NO: 411922 - DNA, 25 bp, Mus musculus
acggcgtccactgggccactattcc

SEQ ID NO: 411923 - DNA, 25 bp, Mus musculus
tattcccacaccacggcgtccactg

SEQ ID NO: 411924 - DNA, 25 bp, Mus musculus
attcccacaccacggcgtccactgg

SEQ ID NO: 411925 - DNA, 25 bp, Mus musculus
acggcgtccactgggtcactattcc

SEQ ID NO: 411926 - DNA, 25 bp, Mus musculus
gcatccactgggtcactattcccac

SEQ ID NO: 411927 - DNA, 25 bp, Mus musculus
ccacaccacggcgtccactgggtca

SEQ ID NO: 411928 - DNA, 25 bp, Mus musculus
caccacggcgtccactgggtcacta

SEQ ID NO: 411929 - DNA, 25 bp, Mus musculus
actgggtcactattcccacaccacg

SEQ ID NO: 411930 - DNA, 25 bp, Mus musculus
ccacggcgtccactgggtcactatt

SEQ ID NO: 411931 - DNA, 25 bp, Mus musculus
gtcactattcccacaccacggcgtc

SEQ ID NO: 411932 - DNA, 25 bp, Mus musculus
gccgccagtccatccgtcactccgt

SEQ ID NO: 411933 - DNA, 25 bp, Mus musculus
acccgcgtgcgggacagaaagccca

SEQ ID NO: 411934 - DNA, 25 bp, Mus musculus
ttccgtccttctgtcgggccactgg

SEQ ID NO: 411935 - DNA, 25 bp, Mus musculus
ctccctcgctccaggatctcgggtc

SEQ ID NO: 411936 - DNA, 25 bp, Mus musculus
tccctagctcgctgtctctttgtct

SEQ ID NO: 411937 - DNA, 25 bp, Mus musculus
cgtgtctccgctgagcccgctttgt

SEQ ID NO: 411938 - DNA, 25 bp, Mus musculus
ttctgtcgggccactggccctcggg

SEQ ID NO: 411939 - DNA, 25 bp, Mus musculus
gtccgtctgtccgacccacgtcgtc

SEQ ID NO: 411940 - DNA, 25 bp, Mus musculus
ggcgcgcactccctttcaagaccgg

SEQ ID NO: 411941 - DNA, 25 bp, Mus musculus
ccctcactcgggcatgcgcgagttg

SEQ ID NO: 411942 - DNA, 25 bp, Mus musculus
tgcgttccagctggaaccggtttgg

SEQ ID NO: 411943 - DNA, 25 bp, Mus musculus
actcccgtacagaccacgcattgcg

SEQ ID NO: 411944 - DNA, 25 bp, Mus musculus
tttccctacctacagcgaggcgtcg

SEQ ID NO: 411945 - DNA, 25 bp, Mus musculus
agaaagcccacggtgggctctctcc

SEQ ID NO: 411946 - DNA, 25 bp, Mus musculus
tggcgccctcctcagagtagggaaa

SEQ ID NO: 411947 - DNA, 25 bp, Mus musculus
tcgtccttttttctctctgatcgtg

SEQ ID NO: 411948 - DNA, 25 bp, Mus musculus
tctgatcgtgtaaaggagaggacta

SEQ ID NO: 411949 - DNA, 25 bp, Mus musculus
agaggactagaaggagcggttccca

SEQ ID NO: 411950 - DNA, 25 bp, Mus musculus
tctcggaggacaacggaccaaaagc

SEQ ID NO: 411951 - DNA, 25 bp, Mus musculus
cggaccaaaagcgatcgatgtgatg

SEQ ID NO: 411952 - DNA, 25 bp, Mus musculus
agcgatcgatgtgatggcgccctcc

SEQ ID NO: 411953 - DNA, 25 bp, Mus musculus
gtagggaaagccagtcatctccatc

SEQ ID NO: 411954 - DNA, 25 bp, Mus musculus
cgaatgagcagtgcccggcttaacc

SEQ ID NO: 411955 - DNA, 25 bp, Mus musculus
acctggccctacttgggcctacgtg

SEQ ID NO: 411956 - DNA, 25 bp, Mus musculus
tgggcctacgtgcagtgtctgcatg

SEQ ID NO: 411957 - DNA, 25 bp, Mus musculus
cagtgtctgcatgcctcgtgtccgt

SEQ ID NO: 411958 - DNA, 25 bp, Mus musculus
tctgtccacatgtctgtttgcgtcg

SEQ ID NO: 411959 - DNA, 25 bp, Mus musculus
tcgtgtccgtctgtccacatgtctg

SEQ ID NO: 411960 - DNA, 25 bp, Mus musculus
aagtctgtctccgaggcatctgtca

SEQ ID NO: 411961 - DNA, 25 bp, Mus musculus
acgtcaggtcgcgaggtgctttcca

SEQ ID NO: 411962 - DNA, 25 bp, Mus musculus
ccaagagtcaccctgcgcggagtac

SEQ ID NO: 411963 - DNA, 25 bp, Mus musculus
ttcggagcacaaagccgagcgcgca

SEQ ID NO: 411964 - DNA, 25 bp, Mus musculus
ccaacatggagtccaggcgcagagt

SEQ ID NO: 411965 - DNA, 25 bp, Mus musculus
tttggaacaaaggaaagtctgtctc

SEQ ID NO: 411966 - DNA, 25 bp, Mus musculus
ctccgggccgagttcggagcacaaa

SEQ ID NO: 411967 - DNA, 25 bp, Mus musculus
aagtgcacgttgctaaccgccggca

SEQ ID NO: 411968 - DNA, 25 bp, Mus musculus
gtttggtttcaaaagtgcacgttgc

SEQ ID NO: 411969 - DNA, 25 bp, Mus musculus
cccaaagctcctctgggagagggca

SEQ ID NO: 411970 - DNA, 25 bp, Mus musculus
gggagggctcggctcccaaagctcc

SEQ ID NO: 411971 - DNA, 25 bp, Mus musculus
gcgcgcggacaacttggaaagtttc

SEQ ID NO: 411972 - DNA, 25 bp, Mus musculus
accctgcgcggagtaccagggaacg

SEQ ID NO: 411973 - DNA, 25 bp, Mus musculus
ctttccagccgcgagctgtcaggcg

SEQ ID NO: 411974 - DNA, 25 bp, Mus musculus
aacgtacaatctcggctttcctcgg

SEQ ID NO: 411975 - DNA, 25 bp, Mus musculus
caggatccggagtagttagcgcttc

SEQ ID NO: 411976 - DNA, 25 bp, Mus musculus
ccggagtagttagcgcttctgaaga

SEQ ID NO: 411977 - DNA, 25 bp, Mus musculus
caacggggccctcaaggtgtccgtg

SEQ ID NO: 411978 - DNA, 25 bp, Mus musculus
cctgctccgtggagcttagcgagcc

SEQ ID NO: 411979 - DNA, 25 bp, Mus musculus
gcttctgaagactgcgcacgtgccg

SEQ ID NO: 411980 - DNA, 25 bp, Mus musculus
tcgcgtcgaggcgtcgccgagcttc

SEQ ID NO: 411981 - DNA, 25 bp, Mus musculus
cgcacgtgccgggtgcggaatccct

SEQ ID NO: 411982 - DNA, 25 bp, Mus musculus
cgtttgctccgcaggatccggagta

SEQ ID NO: 411983 - DNA, 25 bp, Mus musculus
aatctcggctttcctcggaggggct

SEQ ID NO: 411984 - DNA, 25 bp, Mus musculus
tcagccggcaaggaaacgtacaatc

SEQ ID NO: 411985 - DNA, 25 bp, Mus musculus
acttcttctttgtgtcgctccgggg

SEQ ID NO: 411986 - DNA, 25 bp, Mus musculus
gagcaggatgcaaggccacttcttc

SEQ ID NO: 411987 - DNA, 25 bp, Mus musculus
gtccgccggaagcttctgtcacttc

SEQ ID NO: 411988 - DNA, 25 bp, Mus musculus
cctatggagcggtcgctcttagctg

SEQ ID NO: 411989 - DNA, 25 bp, Mus musculus
gcgctatcgaggaccggccagcgac

SEQ ID NO: 411990 - DNA, 25 bp, Mus musculus
cgaactgtcgcgctatcgaggaccg

SEQ ID NO: 411991 - DNA, 25 bp, Mus musculus
cggtcgctcttagctgtcgtcagcc

SEQ ID NO: 411992 - DNA, 25 bp, Mus musculus
ggcacagcaaggtcctccctgcgtt

SEQ ID NO: 411993 - DNA, 25 bp, Mus musculus
gaaccctttcgacctgagacagctc

SEQ ID NO: 411994 - DNA, 25 bp, Mus musculus
gggagaaccctttcgacctgagaca

SEQ ID NO: 411995 - DNA, 25 bp, Mus musculus
accgacctgggctgacggctctaga

SEQ ID NO: 411996 - DNA, 25 bp, Mus musculus
gaaacgctcataccgacctgggctg

SEQ ID NO: 411997 - DNA, 25 bp, Mus musculus
gtggcgccaactggaaacgctcata

SEQ ID NO: 411998 - DNA, 25 bp, Mus musculus
gaagatacgagaagccacgggcgca

SEQ ID NO: 411999 - DNA, 25 bp, Mus musculus
gccgctctgctctgtcgccttgagg

SEQ ID NO: 412000 - DNA, 25 bp, Mus musculus
cagcgccttagtccggccgtgggac

SEQ ID NO: 412001 - DNA, 25 bp, Mus musculus
ggtcactccttccaaggcacagcaa

SEQ ID NO: 412002 - DNA, 25 bp, Mus musculus
tcacctgaagcgctagcgcggggcc

SEQ ID NO: 412003 - DNA, 25 bp, Mus musculus
ttccagcgacggagggtgcagacct

SEQ ID NO: 412004 - DNA, 25 bp, Mus musculus
agggtgcagacctctgtagcgacgc

SEQ ID NO: 412005 - DNA, 25 bp, Mus musculus
tagcgcggggccgtcaatctacagc

SEQ ID NO: 412006 - DNA, 25 bp, Mus musculus
tcactcacctgaagcgctagcgcgg

SEQ ID NO: 412007 - DNA, 25 bp, Mus musculus
ggcgctcactcacctgaagcgctag

SEQ ID NO: 412008 - DNA, 25 bp, Mus musculus
cagcgcacagaggagcgacacccgg

SEQ ID NO: 412009 - DNA, 25 bp, Mus musculus
ccatcggtccgcagcgcacagagga

SEQ ID NO: 412010 - DNA, 25 bp, Mus musculus
tcagagaaggccgaccgcgaggacc

SEQ ID NO: 412011 - DNA, 25 bp, Mus musculus
aggccgggctgaacgcgataggctc

SEQ ID NO: 412012 - DNA, 25 bp, Mus musculus
ctccgccgactaggtaccggcaggg

SEQ ID NO: 412013 - DNA, 25 bp, Mus musculus
caggtcacacgctgccctccgccga

SEQ ID NO: 412014 - DNA, 25 bp, Mus musculus
gcagacctctgtagcgacgccggac

SEQ ID NO: 412015 - DNA, 25 bp, Mus musculus
gggccgtcaatctacagcagcagcg

SEQ ID NO: 412016 - DNA, 25 bp, Mus musculus
accaacaggctgagatacagatttc

SEQ ID NO: 412017 - DNA, 25 bp, Mus musculus
ccataaaagtgtcgtgctctatctg

SEQ ID NO: 412018 - DNA, 25 bp, Mus musculus
agaaagtgctgttagttcccgccgc

SEQ ID NO: 412019 - DNA, 25 bp, Mus musculus
ccggactgctgccagatctaagaaa

SEQ ID NO: 412020 - DNA, 25 bp, Mus musculus
ctatgttgacataggcgtctgaacc

SEQ ID NO: 412021 - DNA, 25 bp, Mus musculus
tgagtgccactgtccgtaagccaga

SEQ ID NO: 412022 - DNA, 25 bp, Mus musculus
actgcagagcattttcgaggaggtg

SEQ ID NO: 412023 - DNA, 25 bp, Mus musculus
ccgatggagacgcaactgcagagca

SEQ ID NO: 412024 - DNA, 25 bp, Mus musculus
tcgcctggcaccgaaggaagtaaca

SEQ ID NO: 412025 - DNA, 25 bp, Mus musculus
cgggatcaagcagcgctgtcagctt

SEQ ID NO: 412026 - DNA, 25 bp, Mus musculus
tcagcttacggggtcacctctacga

SEQ ID NO: 412027 - DNA, 25 bp, Mus musculus
ctctacgagcggaaccaacaggctg

SEQ ID NO: 412028 - DNA, 25 bp, Mus musculus
gctctatctgtattgcccgggaata

SEQ ID NO: 412029 - DNA, 25 bp, Mus musculus
tacagatttcagaggggctggtaac

SEQ ID NO: 412030 - DNA, 25 bp, Mus musculus
ctgtcaggagaaagtctctgagccc

SEQ ID NO: 412031 - DNA, 25 bp, Mus musculus
tcaggggagaaccacatccgggtcc

SEQ ID NO: 412032 - DNA, 25 bp, Mus musculus
gcagaaggtcctctcccgcgtcagt

SEQ ID NO: 412033 - DNA, 25 bp, Mus musculus
gcgtcctgtcaggagaaagtctctg

SEQ ID NO: 412034 - DNA, 25 bp, Mus musculus
tggccttctttcaggcgtcctgtca

SEQ ID NO: 412035 - DNA, 25 bp, Mus musculus
agcgtgacgccggtctagcccagct

SEQ ID NO: 412036 - DNA, 25 bp, Mus musculus
cacctctgcaaactcggcgtcgccg

SEQ ID NO: 412037 - DNA, 25 bp, Mus musculus
gctgcctccgctacttacgaaactc

SEQ ID NO: 412038 - DNA, 25 bp, Mus musculus
gcgcctgcgtactccgggatttaac

SEQ ID NO: 412039 - DNA, 25 bp, Mus musculus
ggatttaacgttctggcccaagcgc

SEQ ID NO: 412040 - DNA, 25 bp, Mus musculus
aacgttctggcccaagcgcaccttg

SEQ ID NO: 412041 - DNA, 25 bp, Mus musculus
ctgaaccagtaagcccaaggtcacc

SEQ ID NO: 412042 - DNA, 25 bp, Mus musculus
gaggagtggccttctttcaggcgtc

SEQ ID NO: 412043 - DNA, 25 bp, Mus musculus
cgcgttcctgaaccagtaagcccaa

SEQ ID NO: 412044 - DNA, 25 bp, Mus musculus
agccgctgccgggagaaattgcaaa

SEQ ID NO: 412045 - DNA, 25 bp, Mus musculus
tgttgcccgacatctcaaagtcatg

SEQ ID NO: 412046 - DNA, 25 bp, Mus musculus
gatctccttcatgtcgtcactcatg

SEQ ID NO: 412047 - DNA, 25 bp, Mus musculus
cgcacgcagttggtgatctccttca

SEQ ID NO: 412048 - DNA, 25 bp, Mus musculus
cctctccagagagccggagcgcatg

SEQ ID NO: 412049 - DNA, 25 bp, Mus musculus
gtgttctttaccttcctctccagag

SEQ ID NO: 412050 - DNA, 25 bp, Mus musculus
ccgtctggctggatgtgttctttac

SEQ ID NO: 412051 - DNA, 25 bp, Mus musculus
agacctacactgaccgtccgaatgg

SEQ ID NO: 412052 - DNA, 25 bp, Mus musculus
tgaccagctcttgctgtggaggctg

SEQ ID NO: 412053 - DNA, 25 bp, Mus musculus
tgcgcacagacacaagcgaggagct

SEQ ID NO: 412054 - DNA, 25 bp, Mus musculus
ggaagagatctgcttgctgcgcaca

SEQ ID NO: 412055 - DNA, 25 bp, Mus musculus
ccgctcaatgcgagaatggaccttg

SEQ ID NO: 412056 - DNA, 25 bp, Mus musculus
gtgagccgtacttgggcgagcaaca

SEQ ID NO: 412057 - DNA, 25 bp, Mus musculus
aaagccaccggctgtaggagctctc

SEQ ID NO: 412058 - DNA, 25 bp, Mus musculus
tccagcgtctcacccagaggggcag

SEQ ID NO: 412059 - DNA, 25 bp, Mus musculus
tccagctcagctgaggagcgcctca

SEQ ID NO: 412060 - DNA, 25 bp, Mus musculus
ttccacgaactgcaggtggcgccgc

SEQ ID NO: 412061 - DNA, 25 bp, Mus musculus
gcagcaacttgttctggtcctccag

SEQ ID NO: 412062 - DNA, 25 bp, Mus musculus
tggccagctcgttcagcagcaactt

SEQ ID NO: 412063 - DNA, 25 bp, Mus musculus
tgctccgagcggtatttggccagct

SEQ ID NO: 412064 - DNA, 25 bp, Mus musculus
aggccaggtcacagcgctgcagatt

SEQ ID NO: 412065 - DNA, 25 bp, Mus musculus
tggtccttcatgtcgtccatctcgg

SEQ ID NO: 412066 - DNA, 25 bp, Mus musculus
cgtcgatggccttgctgaccaaagc

SEQ ID NO: 412067 - DNA, 25 bp, Mus musculus
ttggcatcagccaccaggacgtcga

SEQ ID NO: 412068 - DNA, 25 bp, Mus musculus
gccgactgagaagccattggcatca

SEQ ID NO: 412069 - DNA, 25 bp, Mus musculus
agcacactcattgtccaggcacagg

SEQ ID NO: 412070 - DNA, 25 bp, Mus musculus
cgtgcagtcgcaagtcagcacactc

SEQ ID NO: 412071 - DNA, 25 bp, Mus musculus
cttcttgaccttgccgctgagctcg

SEQ ID NO: 412072 - DNA, 25 bp, Mus musculus
tcggcgaacaaaaggcggacgcggc

SEQ ID NO: 412073 - DNA, 25 bp, Mus musculus
cggactcccagtccggctgaggcca

SEQ ID NO: 412074 - DNA, 25 bp, Mus musculus
ctcccgccgctcaggccgcgactgc

SEQ ID NO: 412075 - DNA, 25 bp, Mus musculus
agctactgtccgtgaggctgggcgg

SEQ ID NO: 412076 - DNA, 25 bp, Mus musculus
gtgcctcgggtaccaggagccaccg

SEQ ID NO: 412077 - DNA, 25 bp, Mus musculus
ccttcttgtcgggcctcgccgagga

SEQ ID NO: 412078 - DNA, 25 bp, Mus musculus
gtgccacaggctgtagcggagcccg

SEQ ID NO: 412079 - DNA, 25 bp, Mus musculus
tgatggcgcgcggtggcttttcttc

SEQ ID NO: 412080 - DNA, 25 bp, Mus musculus
cgctggcgtctccatcgcggcctcc

SEQ ID NO: 412081 - DNA, 25 bp, Mus musculus
gcctctccgccactcggtgctctca

SEQ ID NO: 412082 - DNA, 25 bp, Mus musculus
ctgctcggcgatcgccgcctcggac

SEQ ID NO: 412083 - DNA, 25 bp, Mus musculus
tcctctgcgggctgggggatcacac

SEQ ID NO: 412084 - DNA, 25 bp, Mus musculus
agggatccgcgaggcaacagcgacc

SEQ ID NO: 412085 - DNA, 25 bp, Mus musculus
cgccgatgactctcccgctggcgtc

SEQ ID NO: 412086 - DNA, 25 bp, Mus musculus
tcgcttagctggctgctccaagggt

SEQ ID NO: 412087 - DNA, 25 bp, Mus musculus
ttggaagtcgtcgtctgcagacaga

SEQ ID NO: 412088 - DNA, 25 bp, Mus musculus
tctctaagaaggagcacacgtcctc

SEQ ID NO: 412089 - DNA, 25 bp, Mus musculus
ttctctcggaaaccacgattctcta

SEQ ID NO: 412090 - DNA, 25 bp, Mus musculus
agatgtccagcactttcttctctcg

SEQ ID NO: 412091 - DNA, 25 bp, Mus musculus
agacagattagctgttgcaggagga

SEQ ID NO: 412092 - DNA, 25 bp, Mus musculus
gtgcgctctgcatggctacctccga

SEQ ID NO: 412093 - DNA, 25 bp, Mus musculus
ctgcgaagttaagtaccgcggcacc

SEQ ID NO: 412094 - DNA, 25 bp, Mus musculus
gtccattcagttttgccagcctcca

SEQ ID NO: 412095 - DNA, 25 bp, Mus musculus
caggcccgctacctctgaagatgtc

SEQ ID NO: 412096 - DNA, 25 bp, Mus musculus
cttaggatgcctcccatgtggactc

SEQ ID NO: 412097 - DNA, 25 bp, Mus musculus
agcccgtgtgttcgcatcccgacag

SEQ ID NO: 412098 - DNA, 25 bp, Mus musculus
tgcccacctcgggtagcccgtgtgt

SEQ ID NO: 412099 - DNA, 25 bp, Mus musculus
aaccgatgggcttgcacttcacctg

SEQ ID NO: 412100 - DNA, 25 bp, Mus musculus
tggacctcggactctaacggagatc

SEQ ID NO: 412101 - DNA, 25 bp, Mus musculus
gcgcttccctcgtccaggttcagtt

SEQ ID NO: 412102 - DNA, 25 bp, Mus musculus
gcggcgcgcagaaatcaagtttgaa

SEQ ID NO: 412103 - DNA, 25 bp, Mus musculus
agaaccggcggctcactttccgatc

SEQ ID NO: 412104 - DNA, 25 bp, Mus musculus
cggtttcccgcctcaatccaaatgg

SEQ ID NO: 412105 - DNA, 25 bp, Mus musculus
cgccgctcacctctaggctgtagtt

SEQ ID NO: 412106 - DNA, 25 bp, Mus musculus
tggccgtgaagtcatccagggcttc

SEQ ID NO: 412107 - DNA, 25 bp, Mus musculus
gtgggaagccttctccatgacactg

SEQ ID NO: 412108 - DNA, 25 bp, Mus musculus
actgagctttgaccctcgatggagg

SEQ ID NO: 412109 - DNA, 25 bp, Mus musculus
gcccgtctcccggaatgggataaga

SEQ ID NO: 412110 - DNA, 25 bp, Mus musculus
taacggagatctagctcgggccctg

SEQ ID NO: 412111 - DNA, 25 bp, Mus musculus
gcgagtccgttcacgctagtgggaa

SEQ ID NO: 412112 - DNA, 25 bp, Mus musculus
tgtggaccctaggtttgtcagctcc

SEQ ID NO: 412113 - DNA, 25 bp, Mus musculus
ttcagttcctggcacagggcctgca

SEQ ID NO: 412114 - DNA, 25 bp, Mus musculus
cgactgacctttgccgggagcccat

SEQ ID NO: 412115 - DNA, 25 bp, Mus musculus
agtcactgtcactggccaatcagag

SEQ ID NO: 412116 - DNA, 25 bp, Mus musculus
agagaaccgtgagtgacagcgcgtc

SEQ ID NO: 412117 - DNA, 25 bp, Mus musculus
acggcttggcaagcaggacccgtga

SEQ ID NO: 412118 - DNA, 25 bp, Mus musculus
tgccaagcgggaccgccgcgactga

SEQ ID NO: 412119 - DNA, 25 bp, Mus musculus
tggcctcctccattcattcgagtag

SEQ ID NO: 412120 - DNA, 25 bp, Mus musculus
agcccattctggcaagtggcgtgtg

SEQ ID NO: 412121 - DNA, 25 bp, Mus musculus
gctcttggagccacttcccggagcg

SEQ ID NO: 412122 - DNA, 25 bp, Mus musculus
tcccggagcggaagtctgcctgctc

SEQ ID NO: 412123 - DNA, 25 bp, Mus musculus
acctgctcggaggaatggcgccgcc

SEQ ID NO: 412124 - DNA, 25 bp, Mus musculus
tgaggcgttgcgcatggctcaatag

SEQ ID NO: 412125 - DNA, 25 bp, Mus musculus
tgcgcatggctcaatagtggggccc

SEQ ID NO: 412126 - DNA, 25 bp, Mus musculus
tcattcgagtagtaccagcggccta

SEQ ID NO: 412127 - DNA, 25 bp, Mus musculus
gacccgtgagtgaggttcgcacgcc

SEQ ID NO: 412128 - DNA, 25 bp, Mus musculus
ttccgggaggtaagtattgaggctc

SEQ ID NO: 412129 - DNA, 25 bp, Mus musculus
ccgcagaaggctcccttgggcctgt

SEQ ID NO: 412130 - DNA, 25 bp, Mus musculus
gtggacctggtaaaacccgctgagc

SEQ ID NO: 412131 - DNA, 25 bp, Mus musculus
acccgctgagcggaatctgctgctg

SEQ ID NO: 412132 - DNA, 25 bp, Mus musculus
gctgagcggaatctgctgctgctcc

SEQ ID NO: 412133 - DNA, 25 bp, Mus musculus
gctgctcccagcacatcgcttccgg

SEQ ID NO: 412134 - DNA, 25 bp, Mus musculus
cttccgggtcacgagggatcacttc

SEQ ID NO: 412135 - DNA, 25 bp, Mus musculus
cacgagggatcacttccggtgcggc

SEQ ID NO: 412136 - DNA, 25 bp, Mus musculus
gttgcggagggcagttatctgtaaa

SEQ ID NO: 412137 - DNA, 25 bp, Mus musculus
gttatctgtaaaggcagtctgcgtt

SEQ ID NO: 412138 - DNA, 25 bp, Mus musculus
aaggcagtctgcgttccgaggagac

SEQ ID NO: 412139 - DNA, 25 bp, Mus musculus
tgccctggatggctgtgttacctcg

SEQ ID NO: 412140 - DNA, 25 bp, Mus musculus
tgttacctcgggcatctcgatcttc

SEQ ID NO: 412141 - DNA, 25 bp, Mus musculus
tattgaggctcggataacccggccg

SEQ ID NO: 412142 - DNA, 25 bp, Mus musculus
gctcggttaggccacatttgaaaac

SEQ ID NO: 412143 - DNA, 25 bp, Mus musculus
cggacagtgctagccaccggtgcgt

SEQ ID NO: 412144 - DNA, 25 bp, Mus musculus
caccggtgcgtagctcaggtagcta

SEQ ID NO: 412145 - DNA, 25 bp, Mus musculus
agctcaggtagctagggttgaacgc

SEQ ID NO: 412146 - DNA, 25 bp, Mus musculus
ctcaggtagctagggttgaacgcta

SEQ ID NO: 412147 - DNA, 25 bp, Mus musculus
gctagggttgaacgctaacgtggtc

SEQ ID NO: 412148 - DNA, 25 bp, Mus musculus
cccggctcgcacagcaggtctcccg

SEQ ID NO: 412149 - DNA, 25 bp, Mus musculus
cacagcaggtctcccgggtcgccgg

SEQ ID NO: 412150 - DNA, 25 bp, Mus musculus
tccggagctcacggtcgccgtgcag

SEQ ID NO: 412151 - DNA, 25 bp, Mus musculus
cgccctgcccactctacgccgcggc

SEQ ID NO: 412152 - DNA, 25 bp, Mus musculus
ccctggctcggttaggccacatttg

SEQ ID NO: 412153 - DNA, 25 bp, Mus musculus
ccacatttgaaaacccggccgatcg

SEQ ID NO: 412154 - DNA, 25 bp, Mus musculus
cacatttgaaaacccggccgatcgg

SEQ ID NO: 412155 - DNA, 25 bp, Mus musculus
cccgccgcggccttttgttgggatg

SEQ ID NO: 412156 - DNA, 25 bp, Mus musculus
cgctgaggagcgaggccatgtcctc

SEQ ID NO: 412157 - DNA, 25 bp, Mus musculus
tccagccgcgctctcctacagtggc

SEQ ID NO: 412158 - DNA, 25 bp, Mus musculus
tgggccgggctgaccggctactgct

SEQ ID NO: 412159 - DNA, 25 bp, Mus musculus
ctcggtagcggccaaagtaaggtga

SEQ ID NO: 412160 - DNA, 25 bp, Mus musculus
gccatgtcctcggtagcggccaaag

SEQ ID NO: 412161 - DNA, 25 bp, Mus musculus
cgccgtgaccatgggtgccgccgcc

SEQ ID NO: 412162 - DNA, 25 bp, Mus musculus
tagcgcgacctcaggcgccgtacgg

SEQ ID NO: 412163 - DNA, 25 bp, Mus musculus
ggctgagacctagcgcgacctcagg

SEQ ID NO: 412164 - DNA, 25 bp, Mus musculus
ccctgaccctgaggctgagacctag

SEQ ID NO: 412165 - DNA, 25 bp, Mus musculus
tgaccctgaccctgaggctgagacc

SEQ ID NO: 412166 - DNA, 25 bp, Mus musculus
agtctgaccctgaccctgaggctga

SEQ ID NO: 412167 - DNA, 25 bp, Mus musculus
ggcctaagtctgaccctgaccctga

SEQ ID NO: 412168 - DNA, 25 bp, Mus musculus
ggcctgggcctaagtctgaccctga

SEQ ID NO: 412169 - DNA, 25 bp, Mus musculus
atgtcctcggtagcggccaaagtaa

SEQ ID NO: 412170 - DNA, 25 bp, Mus musculus
ggacagacaccctcgcacgttttct

SEQ ID NO: 412171 - DNA, 25 bp, Mus musculus
tttttctcggcgctggcagctgagg

SEQ ID NO: 412172 - DNA, 25 bp, Mus musculus
gttgaggttggcatctcgggatccc

SEQ ID NO: 412173 - DNA, 25 bp, Mus musculus
gaaataaccgagtcggtggcgttga

SEQ ID NO: 412174 - DNA, 25 bp, Mus musculus
gctacgaggaggaaataaccgagtc

SEQ ID NO: 412175 - DNA, 25 bp, Mus musculus
tcaggggctacgaggaggaaataac

SEQ ID NO: 412176 - DNA, 25 bp, Mus musculus
agcagtttaggtgagctgcaggtca

SEQ ID NO: 412177 - DNA, 25 bp, Mus musculus
cgagccttccagctcggacaccagg

SEQ ID NO: 412178 - DNA, 25 bp, Mus musculus
tttctgcggcgagccttccagctcg

SEQ ID NO: 412179 - DNA, 25 bp, Mus musculus
agacaccctcgcacgttttctgcgg

SEQ ID NO: 412180 - DNA, 25 bp, Mus musculus
ctcaaccccagacgtctgcggtgga

SEQ ID NO: 412181 - DNA, 25 bp, Mus musculus
tgaggacagacaccctcgcacgttt

SEQ ID NO: 412182 - DNA, 25 bp, Mus musculus
agctgaggacagacaccctcgcacg

SEQ ID NO: 412183 - DNA, 25 bp, Mus musculus
tcgcacgttttctgcggcgagcctt

SEQ ID NO: 412184 - DNA, 25 bp, Mus musculus
cgtaaactggaaagcggggctcctg

SEQ ID NO: 412185 - DNA, 25 bp, Mus musculus
gcctggagccctcggaaaacgtgca

SEQ ID NO: 412186 - DNA, 25 bp, Mus musculus
ccaagctcttcggaggcttcaactc

SEQ ID NO: 412187 - DNA, 25 bp, Mus musculus
cccttgctgtgtgtccctgagctgt

SEQ ID NO: 412188 - DNA, 25 bp, Mus musculus
ggctgcacgcccatgcgtgcaaatc

SEQ ID NO: 412189 - DNA, 25 bp, Mus musculus
ctgtggtgcaccctctctgggttct

SEQ ID NO: 412190 - DNA, 25 bp, Mus musculus
ggactcggttttcccgaggctgcga

SEQ ID NO: 412191 - DNA, 25 bp, Mus musculus
cgggctcccaggttcagagtatata

SEQ ID NO: 412192 - DNA, 25 bp, Mus musculus
gatggaccgccacggactagctgcc

SEQ ID NO: 412193 - DNA, 25 bp, Mus musculus
tttgttcctggctctgctgtgcgat

SEQ ID NO: 412194 - DNA, 25 bp, Mus musculus
ggtgactcacgctcctgcatgcatg

SEQ ID NO: 412195 - DNA, 25 bp, Mus musculus
atgcatggctacacacccacacgtg

SEQ ID NO: 412196 - DNA, 25 bp, Mus musculus
tctgacggagccatactcacggctg

SEQ ID NO: 412197 - DNA, 25 bp, Mus musculus
cgtgcaaatcccacactctgacgga

SEQ ID NO: 412198 - DNA, 25 bp, Mus musculus
cgcccagccgggaacaaagactcag

SEQ ID NO: 412199 - DNA, 25 bp, Mus musculus
gcaggtgagtatgtacccgggcttt

SEQ ID NO: 412200 - DNA, 25 bp, Mus musculus
gcgcatgcgcacttaggtggcaaga

SEQ ID NO: 412201 - DNA, 25 bp, Mus musculus
caagagggtacttaaggcacggcca

SEQ ID NO: 412202 - DNA, 25 bp, Mus musculus
gcggactccgagaccagtagacctc

SEQ ID NO: 412203 - DNA, 25 bp, Mus musculus
gtagacctcggcgaacccttgctct

SEQ ID NO: 412204 - DNA, 25 bp, Mus musculus
ctttcggaaccatggccgcagtggc

SEQ ID NO: 412205 - DNA, 25 bp, Mus musculus
gcagcctcggcagaactgctcatca

SEQ ID NO: 412206 - DNA, 25 bp, Mus musculus
tacccgctatattcaggctcgatcc

SEQ ID NO: 412207 - DNA, 25 bp, Mus musculus
acatcttccgcgtgctgctgcaggt

SEQ ID NO: 412208 - DNA, 25 bp, Mus musculus
gccgcaatccctgtgtaccaaagtg

SEQ ID NO: 412209 - DNA, 25 bp, Mus musculus
aagtgccgcggtggtactatttgtc

SEQ ID NO: 412210 - DNA, 25 bp, Mus musculus
gacgatcgcgaccaacgcggtaaga

SEQ ID NO: 412211 - DNA, 25 bp, Mus musculus
gctcatcatcggctggtacatcttc

SEQ ID NO: 412212 - DNA, 25 bp, Mus musculus
aaggtgaccccggagggctaacatg

SEQ ID NO: 412213 - DNA, 25 bp, Mus musculus
accttggaggccagagtgacagcta

SEQ ID NO: 412214 - DNA, 25 bp, Mus musculus
agaggccaagcgacgcctaaggtga

SEQ ID NO: 412215 - DNA, 25 bp, Mus musculus
gaggccagagtgacagctaaggaac

SEQ ID NO: 412216 - DNA, 25 bp, Mus musculus
cgcggccgcaccgagcgctctcacc

SEQ ID NO: 412217 - DNA, 25 bp, Mus musculus
agcgctctcaccctgcccaggcggg

SEQ ID NO: 412218 - DNA, 25 bp, Mus musculus
ggcgggcgacgccacgatacctgcg

SEQ ID NO: 412219 - DNA, 25 bp, Mus musculus
acgaaaaggggaggtcatctgacgc

SEQ ID NO: 412220 - DNA, 25 bp, Mus musculus
cgccaaggtccggaacagaggaggt

SEQ ID NO: 412221 - DNA, 25 bp, Mus musculus
aggggaggtcatctgacgccagaca

SEQ ID NO: 412222 - DNA, 25 bp, Mus musculus
gaggtcatctgacgccagacaaggg

SEQ ID NO: 412223 - DNA, 25 bp, Mus musculus
atctgacgccagacaagggtgcgcc

SEQ ID NO: 412224 - DNA, 25 bp, Mus musculus
gacgccagacaagggtgcgcccgac

SEQ ID NO: 412225 - DNA, 25 bp, Mus musculus
cggcgagaggccaagcgacgcctaa

SEQ ID NO: 412226 - DNA, 25 bp, Mus musculus
ggaagcagaattgtcaaaacgcggc

SEQ ID NO: 412227 - DNA, 25 bp, Mus musculus
ccttcaggttacaggcggaagcaga

SEQ ID NO: 412228 - DNA, 25 bp, Mus musculus
cgctttacggcagcgcgtcctttta

SEQ ID NO: 412229 - DNA, 25 bp, Mus musculus
gcgcgtccttttacggcagtgtggc

SEQ ID NO: 412230 - DNA, 25 bp, Mus musculus
cggccacgcgctcttttactctatt

SEQ ID NO: 412231 - DNA, 25 bp, Mus musculus
cctggcgctttacggcagtgtgtca

SEQ ID NO: 412232 - DNA, 25 bp, Mus musculus
cggcagtgtgtcaggaaaagcctct

SEQ ID NO: 412233 - DNA, 25 bp, Mus musculus
ctcttttactctattggttctgggg

SEQ ID NO: 412234 - DNA, 25 bp, Mus musculus
aaaagcctctgagcggcccgtggtt

SEQ ID NO: 412235 - DNA, 25 bp, Mus musculus
agtggaggcaaccagggtaccctgt

SEQ ID NO: 412236 - DNA, 25 bp, Mus musculus
accctgtgctgattgggtccggaac

SEQ ID NO: 412237 - DNA, 25 bp, Mus musculus
tccggaaccatggacgtgggcgaac

SEQ ID NO: 412238 - DNA, 25 bp, Mus musculus
cgtgggcgaacttttaagctaccag

SEQ ID NO: 412239 - DNA, 25 bp, Mus musculus
gctaccaggtaagagcagttggcga

SEQ ID NO: 412240 - DNA, 25 bp, Mus musculus
acgtctccggacacggtgagtttgc

SEQ ID NO: 412241 - DNA, 25 bp, Mus musculus
tgataaatcaagctgcggatccctc

SEQ ID NO: 412242 - DNA, 25 bp, Mus musculus
gaggccagttgcgagtaccgcttta

SEQ ID NO: 412243 - DNA, 25 bp, Mus musculus
ccatacagatgtctccaaccgcgga

SEQ ID NO: 412244 - DNA, 25 bp, Mus musculus
ggatacacacacctctgcgaccata

SEQ ID NO: 412245 - DNA, 25 bp, Mus musculus
aaggggttcccaagagcacactcgc

SEQ ID NO: 412246 - DNA, 25 bp, Mus musculus
tcctatcggggccagctctgcgaga

SEQ ID NO: 412247 - DNA, 25 bp, Mus musculus
tgggacaaccacgtctccggacacg

SEQ ID NO: 412248 - DNA, 25 bp, Mus musculus
ggtgctcgaacctgcgccgactgat

SEQ ID NO: 412249 - DNA, 25 bp, Mus musculus
tcccagcctgggcaaaactttgatg

SEQ ID NO: 412250 - DNA, 25 bp, Mus musculus
gatttcgactcccaacaccctagtg

SEQ ID NO: 412251 - DNA, 25 bp, Mus musculus
tggcacttttcctgcaactcggcgg

SEQ ID NO: 412252 - DNA, 25 bp, Mus musculus
ccgactgatgctatggcccagagtt

SEQ ID NO: 412253 - DNA, 25 bp, Mus musculus
cgctttaaaaatcccagcctgggca

SEQ ID NO: 412254 - DNA, 25 bp, Mus musculus
tattactccattagcgccttgtagg

SEQ ID NO: 412255 - DNA, 25 bp, Mus musculus
cgatggcttctcctaactcactaga

SEQ ID NO: 412256 - DNA, 25 bp, Mus musculus
tatccgtgagggaaacagatgttga

SEQ ID NO: 412257 - DNA, 25 bp, Mus musculus
gataattaatatccgtgagggaaac

SEQ ID NO: 412258 - DNA, 25 bp, Mus musculus
agggttgacaaatgaaggataatta

SEQ ID NO: 412259 - DNA, 25 bp, Mus musculus
actcactagagagtgtggcgggacc

SEQ ID NO: 412260 - DNA, 25 bp, Mus musculus
ccattagcgccttgtagggttgaca

SEQ ID NO: 412261 - DNA, 25 bp, Mus musculus
acagatgttgaggtaattcgctccc

SEQ ID NO: 412262 - DNA, 25 bp, Mus musculus
gcgctacgtattattactccattag

SEQ ID NO: 412263 - DNA, 25 bp, Mus musculus
cggctcccagcgctacgtattatta

SEQ ID NO: 412264 - DNA, 25 bp, Mus musculus
tgaggtaattcgctcccgctgcgca

SEQ ID NO: 412265 - DNA, 25 bp, Mus musculus
aattcgctcccgctgcgcatttgcg

SEQ ID NO: 412266 - DNA, 25 bp, Mus musculus
tgcgcatttgcgatggcttctccta

SEQ ID NO: 412267 - DNA, 25 bp, Mus musculus
gcgccttgtagggttgacaaatgaa

SEQ ID NO: 412268 - DNA, 25 bp, Mus musculus
aggtggtgggcagcaacatctccca

SEQ ID NO: 412269 - DNA, 25 bp, Mus musculus
agtgccgcgtgatcgacttcagcga

SEQ ID NO: 412270 - DNA, 25 bp, Mus musculus
gttagcaccagcaggctcgctcagg

SEQ ID NO: 412271 - DNA, 25 bp, Mus musculus
cattctacctggaaccggctccgga

SEQ ID NO: 412272 - DNA, 25 bp, Mus musculus
tcctgttcctcatcattctacctgg

SEQ ID NO: 412273 - DNA, 25 bp, Mus musculus
ccgcgtgtgctttgcttgcttatcc

SEQ ID NO: 412274 - DNA, 25 bp, Mus musculus
tcaaagcatacctgcgggtgcagcc

SEQ ID NO: 412275 - DNA, 25 bp, Mus musculus
cccggcatcacaaggtcaaagcata

SEQ ID NO: 412276 - DNA, 25 bp, Mus musculus
ggcaaggcccggcatcacaaggtca

SEQ ID NO: 412277 - DNA, 25 bp, Mus musculus
atcgacttcagcgacggcaaggccc

SEQ ID NO: 412278 - DNA, 25 bp, Mus musculus
aggcacctacgagtgccgcgtgatc

SEQ ID NO: 412279 - DNA, 25 bp, Mus musculus
tgaagcccacggacgaaggcaccta

SEQ ID NO: 412280 - DNA, 25 bp, Mus musculus
gggcagcaacatctcccacaagctt

SEQ ID NO: 412281 - DNA, 25 bp, Mus musculus
acaagcttcggctgtcccgggtgaa

SEQ ID NO: 412282 - DNA, 25 bp, Mus musculus
ctgcctcagtgtgtcctaaggattc

SEQ ID NO: 412283 - DNA, 25 bp, Mus musculus
caggacccatcgtctccgtgtggca

SEQ ID NO: 412284 - DNA, 25 bp, Mus musculus
gattcgtttctggacgctcctaagc

SEQ ID NO: 412285 - DNA, 25 bp, Mus musculus
gcaccctaggcggaaatgacgacta

SEQ ID NO: 412286 - DNA, 25 bp, Mus musculus
acgactaagtagtgcgtcgcgccgc

SEQ ID NO: 412287 - DNA, 25 bp, Mus musculus
cgccgcgccagaaaggttctgcgga

SEQ ID NO: 412288 - DNA, 25 bp, Mus musculus
cgcattttcggtgttcgaggacctg

SEQ ID NO: 412289 - DNA, 25 bp, Mus musculus
cagggaccaaggatactgccgcctc

SEQ ID NO: 412290 - DNA, 25 bp, Mus musculus
ctgccgcctcctaaggatcgttttc

SEQ ID NO: 412291 - DNA, 25 bp, Mus musculus
cggcgctggaaaagaagctctcaga

SEQ ID NO: 412292 - DNA, 25 bp, Mus musculus
gcgcgagcggttaaagcgcattttc

SEQ ID NO: 412293 - DNA, 25 bp, Mus musculus
cgcgagctccgcaaaggtgatcacc

SEQ ID NO: 412294 - DNA, 25 bp, Mus musculus
ctccttctcagaatcggcgctggaa

SEQ ID NO: 412295 - DNA, 25 bp, Mus musculus
gacctggatttgttccctcggcctg

SEQ ID NO: 412296 - DNA, 25 bp, Mus musculus
ctcctagctctggagagagtgcgaa

SEQ ID NO: 412297 - DNA, 25 bp, Mus musculus
ctggagaaaacccagcagagtgagg

SEQ ID NO: 412298 - DNA, 25 bp, Mus musculus
cccaggagggcgttaccatggtgat

SEQ ID NO: 412299 - DNA, 25 bp, Mus musculus
cgaagctctggctctcctagctctg

SEQ ID NO: 412300 - DNA, 25 bp, Mus musculus
accatggtgatgctcctctggtccc

SEQ ID NO: 412301 - DNA, 25 bp, Mus musculus
ccacaccaggaaccgagggtctcta

SEQ ID NO: 412302 - DNA, 25 bp, Mus musculus
aggagtactcctaacccggcctcat

SEQ ID NO: 412303 - DNA, 25 bp, Mus musculus
gaagggcgagaggagtactcctaac

SEQ ID NO: 412304 - DNA, 25 bp, Mus musculus
acaggagcccgacgttggtccactc

SEQ ID NO: 412305 - DNA, 25 bp, Mus musculus
gcagttaagcaacgacccacaccag

SEQ ID NO: 412306 - DNA, 25 bp, Mus musculus
ggccctttgtgcgacgccttgctct

SEQ ID NO: 412307 - DNA, 25 bp, Mus musculus
ggcctcatcccgaggggcagccaga

SEQ ID NO: 412308 - DNA, 25 bp, Mus musculus
cgggagctgcgcacgcagttaagca

SEQ ID NO: 412309 - DNA, 25 bp, Mus musculus
ccaccggaacagtctaggggtgtct

SEQ ID NO: 412310 - DNA, 25 bp, Mus musculus
catgcaccttgcactcaccttggtg

SEQ ID NO: 412311 - DNA, 25 bp, Mus musculus
ccttggtgccctgtattggggagac

SEQ ID NO: 412312 - DNA, 25 bp, Mus musculus
actcaccttggtgccctgtattggg

SEQ ID NO: 412313 - DNA, 25 bp, Mus musculus
gcgctggcggaagaacaaatgacaa

SEQ ID NO: 412314 - DNA, 25 bp, Mus musculus
acatgcgggatgtctgtagatttgg

SEQ ID NO: 412315 - DNA, 25 bp, Mus musculus
ggaaacggcgctgcccatgcacctt

SEQ ID NO: 412316 - DNA, 25 bp, Mus musculus
gcagcccggtttccttgatggagga

SEQ ID NO: 412317 - DNA, 25 bp, Mus musculus
acaaagcacgctgcagcctagagca

SEQ ID NO: 412318 - DNA, 25 bp, Mus musculus
aactgtggtcttcacgatgggcgct

SEQ ID NO: 412319 - DNA, 25 bp, Mus musculus
cacgcgacaggaaactgtggtcttc

SEQ ID NO: 412320 - DNA, 25 bp, Mus musculus
gaggaaacacatccacgcgacagga

SEQ ID NO: 412321 - DNA, 25 bp, Mus musculus
gcaatggccagagaggaaacacatc

SEQ ID NO: 412322 - DNA, 25 bp, Mus musculus
tccttgatggaggaaacggcgctgc

SEQ ID NO: 412323 - DNA, 25 bp, Mus musculus
cctagagcagcatctccgagcggcg

SEQ ID NO: 412324 - DNA, 25 bp, Mus musculus
tcggccgcccagttggagaggggta

SEQ ID NO: 412325 - DNA, 25 bp, Mus musculus
ggggcgcactactcacaacataagt

SEQ ID NO: 412326 - DNA, 25 bp, Mus musculus
acataagttactccaccagggcatg

SEQ ID NO: 412327 - DNA, 25 bp, Mus musculus
taagttactccaccagggcatggtg

SEQ ID NO: 412328 - DNA, 25 bp, Mus musculus
ctggtggcccggaacagcggcccga

SEQ ID NO: 412329 - DNA, 25 bp, Mus musculus
tcacaacataagttactccaccagg

SEQ ID NO: 412330 - DNA, 25 bp, Mus musculus
ggcgcactactcacaacataagtta

SEQ ID NO: 412331 - DNA, 25 bp, Mus musculus
ccatcgcggggcaccaaccggccgc

SEQ ID NO: 412332 - DNA, 25 bp, Mus musculus
ctacatacgtcacagaggccgggca

SEQ ID NO: 412333 - DNA, 25 bp, Mus musculus
acatacgtcacagaggccgggcatt

SEQ ID NO: 412334 - DNA, 25 bp, Mus musculus
ggacggctacatacgtcacagaggc

SEQ ID NO: 412335 - DNA, 25 bp, Mus musculus
tggggacggctacatacgtcacaga

SEQ ID NO: 412336 - DNA, 25 bp, Mus musculus
cttggggacggctacatacgtcaca

SEQ ID NO: 412337 - DNA, 25 bp, Mus musculus
atacgtcacagaggccgggcattgt

SEQ ID NO: 412338 - DNA, 25 bp, Mus musculus
tttgcttttgaatccccgccggcgc

SEQ ID NO: 412339 - DNA, 25 bp, Mus musculus
cggcgccctgagtggccctttcaaa

SEQ ID NO: 412340 - DNA, 25 bp, Mus musculus
ggcgccctgagtggccctttcaaag

SEQ ID NO: 412341 - DNA, 25 bp, Mus musculus
ccctgagtggccctttcaaaggcag

SEQ ID NO: 412342 - DNA, 25 bp, Mus musculus
cctgagtggccctttcaaaggcagt

SEQ ID NO: 412343 - DNA, 25 bp, Mus musculus
tgagtggccctttcaaaggcagtga

SEQ ID NO: 412344 - DNA, 25 bp, Mus musculus
agtggccctttcaaaggcagtgacg

SEQ ID NO: 412345 - DNA, 25 bp, Mus musculus
tggccctttcaaaggcagtgacggg

SEQ ID NO: 412346 - DNA, 25 bp, Mus musculus
cctcctcccgctttcccacgcctgc

SEQ ID NO: 412347 - DNA, 25 bp, Mus musculus
gctttcccacgcctgcccgtccggc

SEQ ID NO: 412348 - DNA, 25 bp, Mus musculus
cacgcctgcccgtccggcgcgttct

SEQ ID NO: 412349 - DNA, 25 bp, Mus musculus
ggcgcgttctcacggccgctgccca

SEQ ID NO: 412350 - DNA, 25 bp, Mus musculus
cagtggcggccgtttgcttttgaat

SEQ ID NO: 412351 - DNA, 25 bp, Mus musculus
tggcggccgtttgcttttgaatccc

SEQ ID NO: 412352 - DNA, 25 bp, Mus musculus
tgcgcagtcccgcactgcggcactc

SEQ ID NO: 412353 - DNA, 25 bp, Mus musculus
cgatggcgcagtaagcatttcggtt

SEQ ID NO: 412354 - DNA, 25 bp, Mus musculus
aagtcacctcggctctgcgctcttg

SEQ ID NO: 412355 - DNA, 25 bp, Mus musculus
tgcggcactcactcacgcactcagc

SEQ ID NO: 412356 - DNA, 25 bp, Mus musculus
tgctaggcaagtcacctcggctctg

SEQ ID NO: 412357 - DNA, 25 bp, Mus musculus
cactgcggttttcggggagtgtcct

SEQ ID NO: 412358 - DNA, 25 bp, Mus musculus
ttgcgcaaaggcgaagctggagact

SEQ ID NO: 412359 - DNA, 25 bp, Mus musculus
tggccagttgcgcaaaggcgaagct

SEQ ID NO: 412360 - DNA, 25 bp, Mus musculus
acgcccactggccagttgcgcaaag

SEQ ID NO: 412361 - DNA, 25 bp, Mus musculus
cggttctactcctgcaggggacgct

SEQ ID NO: 412362 - DNA, 25 bp, Mus musculus
atttcggttctactcctgcagggga

SEQ ID NO: 412363 - DNA, 25 bp, Mus musculus
gtaagcatttcggttctactcctgc

SEQ ID NO: 412364 - DNA, 25 bp, Mus musculus
tggcgcagtaagcatttcggttcta

SEQ ID NO: 412365 - DNA, 25 bp, Mus musculus
cgcactcagcctgctaggcaagtca

SEQ ID NO: 412366 - DNA, 25 bp, Mus musculus
cgcgatgacgtaagtgtccgtcact

SEQ ID NO: 412367 - DNA, 25 bp, Mus musculus
gagcacagtcctggcccgcggattc

SEQ ID NO: 412368 - DNA, 25 bp, Mus musculus
cgcattcctgggttctgaagtggcc

SEQ ID NO: 412369 - DNA, 25 bp, Mus musculus
aggggctctttgaacctccgctgct

SEQ ID NO: 412370 - DNA, 25 bp, Mus musculus
tcagcagctactgaggcaggggctc

SEQ ID NO: 412371 - DNA, 25 bp, Mus musculus
gccaagcgaccggtgttcgtcgtcc

SEQ ID NO: 412372 - DNA, 25 bp, Mus musculus
gaagttgcttgaacggagcccagcc

SEQ ID NO: 412373 - DNA, 25 bp, Mus musculus
ccctggcagtcggaagttgcttgaa

SEQ ID NO: 412374 - DNA, 25 bp, Mus musculus
tggggaattatttgacgccaccgcc

SEQ ID NO: 412375 - DNA, 25 bp, Mus musculus
cgcagtagtcccttcggctggggaa

SEQ ID NO: 412376 - DNA, 25 bp, Mus musculus
tactgcccagggcacggtgacgctt

SEQ ID NO: 412377 - DNA, 25 bp, Mus musculus
tcccttcagaagtcgcgggtcagca

SEQ ID NO: 412378 - DNA, 25 bp, Mus musculus
agacttatttgacgctgcccactcg

SEQ ID NO: 412379 - DNA, 25 bp, Mus musculus
cggctccaggctcggagacttattt

SEQ ID NO: 412380 - DNA, 25 bp, Mus musculus
ctgaccttctcagataagcatttgc

SEQ ID NO: 412381 - DNA, 25 bp, Mus musculus
ctaatgcgatgtctttgtctctgga

SEQ ID NO: 412382 - DNA, 25 bp, Mus musculus
tcgccttgcctttcgtctatcctga

SEQ ID NO: 412383 - DNA, 25 bp, Mus musculus
gcgcactcgcatgacactcaacaga

SEQ ID NO: 412384 - DNA, 25 bp, Mus musculus
tggccgagcgtacccatgtttctga

SEQ ID NO: 412385 - DNA, 25 bp, Mus musculus
acatccaagctctctcagtccgggg

SEQ ID NO: 412386 - DNA, 25 bp, Mus musculus
cagcacgaacgcaaggcaactcctt

SEQ ID NO: 412387 - DNA, 25 bp, Mus musculus
tttcagaagcgccagctcggcaatg

SEQ ID NO: 412388 - DNA, 25 bp, Mus musculus
ctcggcaatgaaactcggctgcgca

SEQ ID NO: 412389 - DNA, 25 bp, Mus musculus
tgcgcagcaaaccacacacggaata

SEQ ID NO: 412390 - DNA, 25 bp, Mus musculus
ggaatacgcacggttaccaaagctg

SEQ ID NO: 412391 - DNA, 25 bp, Mus musculus
ccaaagctgccgctcagagttcaca

SEQ ID NO: 412392 - DNA, 25 bp, Mus musculus
cgccaacccacagctgtatctaatg

SEQ ID NO: 412393 - DNA, 25 bp, Mus musculus
tggatctctttcgtcttcgtgcccg

SEQ ID NO: 412394 - DNA, 25 bp, Mus musculus
cgccagcctcgcgtagctgttctga

SEQ ID NO: 412395 - DNA, 25 bp, Mus musculus
gtggccacctccgtgtccaacaagt

SEQ ID NO: 412396 - DNA, 25 bp, Mus musculus
acattcattatcagcgcggcggcgc

SEQ ID NO: 412397 - DNA, 25 bp, Mus musculus
cccgtcgagggagacattcattatc

SEQ ID NO: 412398 - DNA, 25 bp, Mus musculus
tcctgaaatcggaaggcgagccctg

SEQ ID NO: 412399 - DNA, 25 bp, Mus musculus
gcgcactgcgacgatctcgactttg

SEQ ID NO: 412400 - DNA, 25 bp, Mus musculus
tccaacaagtcccaggccaaggtga

SEQ ID NO: 412401 - DNA, 25 bp, Mus musculus
cgcagcaagctgaccaatgtggcca

SEQ ID NO: 412402 - DNA, 25 bp, Mus musculus
gacccagcggagatagcagtcctcg

SEQ ID NO: 412403 - DNA, 25 bp, Mus musculus
ggtcccaccaagagccagactgtcg

SEQ ID NO: 412404 - DNA, 25 bp, Mus musculus
ctctggctccaaggaccaggccgtg

SEQ ID NO: 412405 - DNA, 25 bp, Mus musculus
gtcgcgcttccgaaacctttggtgc

SEQ ID NO: 412406 - DNA, 25 bp, Mus musculus
ggtcacgacaaacccaagatcacgg

SEQ ID NO: 412407 - DNA, 25 bp, Mus musculus
ggccagcctcgaacgtcaggcgcga

SEQ ID NO: 412408 - DNA, 25 bp, Mus musculus
gctgccctgcgccttcctgaagaat

SEQ ID NO: 412409 - DNA, 25 bp, Mus musculus
cgggactcgtatgtggccatagcta

SEQ ID NO: 412410 - DNA, 25 bp, Mus musculus
cgtggtcaatgtggcgcagatcatc

SEQ ID NO: 412411 - DNA, 25 bp, Mus musculus
ctcatcgcgtgcctgtacgaggaga

SEQ ID NO: 412412 - DNA, 25 bp, Mus musculus
gtggtgagcggcaacctcatgtaca

SEQ ID NO: 412413 - DNA, 25 bp, Mus musculus
tgtacaacagtttcccggggctgcc

SEQ ID NO: 412414 - DNA, 25 bp, Mus musculus
tggtccatcatagccacagcggtgc

SEQ ID NO: 412415 - DNA, 25 bp, Mus musculus
catcctggtcatcgcttactgtctc

SEQ ID NO: 412416 - DNA, 25 bp, Mus musculus
ccattggcatcatcgtgttcagcta

SEQ ID NO: 412417 - DNA, 25 bp, Mus musculus
gttcagctacacgtcgcagatcttc

SEQ ID NO: 412418 - DNA, 25 bp, Mus musculus
tgcagcagcccagcgaattccactg

SEQ ID NO: 412419 - DNA, 25 bp, Mus musculus
ccaggtcttcttcgatgtggccatc

SEQ ID NO: 412420 - DNA, 25 bp, Mus musculus
ctcaaggccgtgtccaagttcagtc

SEQ ID NO: 412421 - DNA, 25 bp, Mus musculus
ccgtcgaagtgctggagaagtctct

SEQ ID NO: 412422 - DNA, 25 bp, Mus musculus
aactgctgctggactacagcttcca

SEQ ID NO: 412423 - DNA, 25 bp, Mus musculus
ctcgtggacagccagttagcgcgaa

SEQ ID NO: 412424 - DNA, 25 bp, Mus musculus
ttagcgcgaagaggcgtggccacaa

SEQ ID NO: 412425 - DNA, 25 bp, Mus musculus
acaaggaggctgttgcggacaagct

SEQ ID NO: 412426 - DNA, 25 bp, Mus musculus
acaagctggagctacggttggactt

SEQ ID NO: 412427 - DNA, 25 bp, Mus musculus
gctgaaaccagcgagtcctcccgta

SEQ ID NO: 412428 - DNA, 25 bp, Mus musculus
cgcttcggggcccagagactcagac

SEQ ID NO: 412429 - DNA, 25 bp, Mus musculus
caagatggaggccaacgtgttccgc

SEQ ID NO: 412430 - DNA, 25 bp, Mus musculus
caacgtgttccgcttccgagatgcc

SEQ ID NO: 412431 - DNA, 25 bp, Mus musculus
ctggacaacgggtcgttccaggctc

SEQ ID NO: 412432 - DNA, 25 bp, Mus musculus
gtggctacgcctccatgttcggagc

SEQ ID NO: 412433 - DNA, 25 bp, Mus musculus
cctggaactgcaggaactgctgctg

SEQ ID NO: 412434 - DNA, 25 bp, Mus musculus
cacagaaagttctggagcgccaggc

SEQ ID NO: 412435 - DNA, 25 bp, Mus musculus
acgtcccggtcaacctggaactgca

SEQ ID NO: 412436 - DNA, 25 bp, Mus musculus
gtctcccacatctcgctatcggatg

SEQ ID NO: 412437 - DNA, 25 bp, Mus musculus
ggcaaacctgacctagtgcgggatc

SEQ ID NO: 412438 - DNA, 25 bp, Mus musculus
tgtctcgggcccttccagtctggct

SEQ ID NO: 412439 - DNA, 25 bp, Mus musculus
aaggtcacgcagagcaccctgatcg

SEQ ID NO: 412440 - DNA, 25 bp, Mus musculus
tgctggaaaggtgcagtctcccaca

SEQ ID NO: 412441 - DNA, 25 bp, Mus musculus
tccgccttaagggaggagtcaagag

SEQ ID NO: 412442 - DNA, 25 bp, Mus musculus
gggctactgtctgccagggttacaa

SEQ ID NO: 412443 - DNA, 25 bp, Mus musculus
gcaggcgtccctaagggcaaacctg

SEQ ID NO: 412444 - DNA, 25 bp, Mus musculus
cagaagggatgctctcggcctcttc

SEQ ID NO: 412445 - DNA, 25 bp, Mus musculus
cccgagcgcccaagacaggcagaaa

SEQ ID NO: 412446 - DNA, 25 bp, Mus musculus
gacaggcagaaacggcgcagcccta

SEQ ID NO: 412447 - DNA, 25 bp, Mus musculus
cccagaggtcaactgaggggtctcc

SEQ ID NO: 412448 - DNA, 25 bp, Mus musculus
aggggtctcccacaaggtcacgcag

SEQ ID NO: 412449 - DNA, 25 bp, Mus musculus
ccaagggagggtggcttaagataat

SEQ ID NO: 412450 - DNA, 25 bp, Mus musculus
caggacctgcttcatcgcaagcgca

SEQ ID NO: 412451 - DNA, 25 bp, Mus musculus
tcatcgcaagcgcaagcatgagcgg

SEQ ID NO: 412452 - DNA, 25 bp, Mus musculus
gaagcctcactgaggaatgacgccg

SEQ ID NO: 412453 - DNA, 25 bp, Mus musculus
tagcgttgctggaagcctcactgag

SEQ ID NO: 412454 - DNA, 25 bp, Mus musculus
ccagtgtagcgttgctggaagcctc

SEQ ID NO: 412455 - DNA, 25 bp, Mus musculus
aaggtgtccttcgaggccagtgtag

SEQ ID NO: 412456 - DNA, 25 bp, Mus musculus
tggacgtcgcaagaaggtgtccttc

SEQ ID NO: 412457 - DNA, 25 bp, Mus musculus
gggccatggccagccacgtggacct

SEQ ID NO: 412458 - DNA, 25 bp, Mus musculus
cagccacgtggacctgctcacagag

SEQ ID NO: 412459 - DNA, 25 bp, Mus musculus
gacctgctcacagagctgcagctgc

SEQ ID NO: 412460 - DNA, 25 bp, Mus musculus
agaaggtgcctacgctggagcgcct

SEQ ID NO: 412461 - DNA, 25 bp, Mus musculus
agctgaagaagtgggcacagtacga

SEQ ID NO: 412462 - DNA, 25 bp, Mus musculus
ggcacagtacgagcaggacctgctt

SEQ ID NO: 412463 - DNA, 25 bp, Mus musculus
caagcatgagcggaagcgcagcacg

SEQ ID NO: 412464 - DNA, 25 bp, Mus musculus
ttccggagcagtcggacctggaacc

SEQ ID NO: 412465 - DNA, 25 bp, Mus musculus
agcagttgcgctccgcccgagaggt

SEQ ID NO: 412466 - DNA, 25 bp, Mus musculus
ttcgagctgttggacgaccttcccg

SEQ ID NO: 412467 - DNA, 25 bp, Mus musculus
cccacggagctgttcagcgaggcgc

SEQ ID NO: 412468 - DNA, 25 bp, Mus musculus
tctggctctcgagcagctgctggcc

SEQ ID NO: 412469 - DNA, 25 bp, Mus musculus
cctgggccgccttcttacggcgtga

SEQ ID NO: 412470 - DNA, 25 bp, Mus musculus
ttcctcaacgccgacgaggtgcgcg

SEQ ID NO: 412471 - DNA, 25 bp, Mus musculus
ggactcgttcggctcctctcacgaa

SEQ ID NO: 412472 - DNA, 25 bp, Mus musculus
ctcacgaatgctcgtcgggcaccta

SEQ ID NO: 412473 - DNA, 25 bp, Mus musculus
tcgggcacctactttccggagcagt

SEQ ID NO: 412474 - DNA, 25 bp, Mus musculus
tcggctggccttccttctaccaggg

SEQ ID NO: 412475 - DNA, 25 bp, Mus musculus
gccacgcgtgtcgaggctcatttcc

SEQ ID NO: 412476 - DNA, 25 bp, Mus musculus
cttctaccagggtgcctaccgcggt

SEQ ID NO: 412477 - DNA, 25 bp, Mus musculus
gcccgtatggctgcaaggatgcgct

SEQ ID NO: 412478 - DNA, 25 bp, Mus musculus
tgacttgtgcgaggtcacgtcagtc

SEQ ID NO: 412479 - DNA, 25 bp, Mus musculus
ttgtgcgaggtcacatcagtcaggg

SEQ ID NO: 412480 - DNA, 25 bp, Mus musculus
gacttgtgcgaggtcacgtcagtca

SEQ ID NO: 412481 - DNA, 25 bp, Mus musculus
cttgtgcgaggtcacatcagtcagg

SEQ ID NO: 412482 - DNA, 25 bp, Mus musculus
tgtgcgaggtcacatcagtcagggt

SEQ ID NO: 412483 - DNA, 25 bp, Mus musculus
tcatatgacttgtgcgaggtcacgt

SEQ ID NO: 412484 - DNA, 25 bp, Mus musculus
tcggggacggagttcatatgacttg

SEQ ID NO: 412485 - DNA, 25 bp, Mus musculus
cggggacggagttcatatgacttgt

SEQ ID NO: 412486 - DNA, 25 bp, Mus musculus
tgacttgtgcgaggtcacatcagtc

SEQ ID NO: 412487 - DNA, 25 bp, Mus musculus
gacttgtgcgaggtcacatcagtca

SEQ ID NO: 412488 - DNA, 25 bp, Mus musculus
acttgtgcgaggtcacgtcagtcag

SEQ ID NO: 412489 - DNA, 25 bp, Mus musculus
catatgacttgtgcgaggtcacgtc

SEQ ID NO: 412490 - DNA, 25 bp, Mus musculus
ggcggagttcatatgacttgtgcga

SEQ ID NO: 412491 - DNA, 25 bp, Mus musculus
caggggcggagttcatatgacttgt

SEQ ID NO: 412492 - DNA, 25 bp, Mus musculus
gagtcttcttcgtgacctttcaccc

SEQ ID NO: 412493 - DNA, 25 bp, Mus musculus
tcacgtgggccaaggagaggccctc

SEQ ID NO: 412494 - DNA, 25 bp, Mus musculus
gcgtggcttcttttcgctctacccg

SEQ ID NO: 412495 - DNA, 25 bp, Mus musculus
ggccctcaaaggcaagccaaagcga

SEQ ID NO: 412496 - DNA, 25 bp, Mus musculus
cgagagacaatatggccgcgcggca

SEQ ID NO: 412497 - DNA, 25 bp, Mus musculus
tgcgcccttgggaccagtgaaattc

SEQ ID NO: 412498 - DNA, 25 bp, Mus musculus
cccttgggaccagtgaaattctgga

SEQ ID NO: 412499 - DNA, 25 bp, Mus musculus
ggtagatgcccggacatgactttcg

SEQ ID NO: 412500 - DNA, 25 bp, Mus musculus
ggcaccactcctccgcgcgcaagga

SEQ ID NO: 412501 - DNA, 25 bp, Mus musculus
ggcggagtcttcttcgtgacctttc

SEQ ID NO: 412502 - DNA, 25 bp, Mus musculus
gccaaagcgagctgcgatcacgtga

SEQ ID NO: 412503 - DNA, 25 bp, Mus musculus
ctgcgatcacgtgatccatagtggg

SEQ ID NO: 412504 - DNA, 25 bp, Mus musculus
ttgccggaaggcgtggcttcttttc

SEQ ID NO: 412505 - DNA, 25 bp, Mus musculus
ccggacatgactttcggcctgggga

SEQ ID NO: 412506 - DNA, 25 bp, Mus musculus
gcgcaggctccagtccgttttgaaa

SEQ ID NO: 412507 - DNA, 25 bp, Mus musculus
cagggttcggctctccgcaaaagag

SEQ ID NO: 412508 - DNA, 25 bp, Mus musculus
ggccacgaccaaagtagcgcatccg

SEQ ID NO: 412509 - DNA, 25 bp, Mus musculus
taagtctctacgtccgcggccacga

SEQ ID NO: 412510 - DNA, 25 bp, Mus musculus
ccgcgtggaaatcgggctaagtctc

SEQ ID NO: 412511 - DNA, 25 bp, Mus musculus
ccaggacatcgtgctctatctcatc

SEQ ID NO: 412512 - DNA, 25 bp, Mus musculus
ggagcgcgctacacatcgccgcttt

SEQ ID NO: 412513 - DNA, 25 bp, Mus musculus
ttcggagccgacatccgcctagcta

SEQ ID NO: 412514 - DNA, 25 bp, Mus musculus
agtcagtcatcgacggcaacctgga

SEQ ID NO: 412515 - DNA, 25 bp, Mus musculus
gggccagacagcactacaccagtca

SEQ ID NO: 412516 - DNA, 25 bp, Mus musculus
tcgctgctgcagaacatgactaact

SEQ ID NO: 412517 - DNA, 25 bp, Mus musculus
agacgcagcgcatcttccaggaagc

SEQ ID NO: 412518 - DNA, 25 bp, Mus musculus
cagccctagctctgcggcaacatga

SEQ ID NO: 412519 - DNA, 25 bp, Mus musculus
tctcacaccgggagacttcggaatc

SEQ ID NO: 412520 - DNA, 25 bp, Mus musculus
gggtcttcggttcagtcggactgaa

SEQ ID NO: 412521 - DNA, 25 bp, Mus musculus
ctggtcatcagagaagcggtcctcc

SEQ ID NO: 412522 - DNA, 25 bp, Mus musculus
gaagcggtcctccacactaccgttg

SEQ ID NO: 412523 - DNA, 25 bp, Mus musculus
tggcccaggtcatcgtgagtcacac

SEQ ID NO: 412524 - DNA, 25 bp, Mus musculus
tcgtgagtcacacctgctcctgggt

SEQ ID NO: 412525 - DNA, 25 bp, Mus musculus
ctacggaagccgtcgaagctctgca

SEQ ID NO: 412526 - DNA, 25 bp, Mus musculus
gttcatctgctggtagttgctcgcc

SEQ ID NO: 412527 - DNA, 25 bp, Mus musculus
gtacaggtcctcgagatgggtcttc

SEQ ID NO: 412528 - DNA, 25 bp, Mus musculus
gtggacgacaccgagccagcaggct

SEQ ID NO: 412529 - DNA, 25 bp, Mus musculus
caggggctccttcttcacgtcgaac

SEQ ID NO: 412530 - DNA, 25 bp, Mus musculus
cgtcgaacttgagaaggtcgaagtc

SEQ ID NO: 412531 - DNA, 25 bp, Mus musculus
ctccgcggccatcgctaaaagcgag

SEQ ID NO: 412532 - DNA, 25 bp, Mus musculus
taaaagcgaggctcagccgccgctg

SEQ ID NO: 412533 - DNA, 25 bp, Mus musculus
agttgctcgccatccagtacaggtc

SEQ ID NO: 412534 - DNA, 25 bp, Mus musculus
atccgagacgcagcgcttcccgagt

SEQ ID NO: 412535 - DNA, 25 bp, Mus musculus
tctcttaacactcatggggctccag

SEQ ID NO: 412536 - DNA, 25 bp, Mus musculus
gcatactctcttaacactcatgggg

SEQ ID NO: 412537 - DNA, 25 bp, Mus musculus
ggctcgaccaccacacgcatactct

SEQ ID NO: 412538 - DNA, 25 bp, Mus musculus
gggtttcaggctcgaccaccacacg

SEQ ID NO: 412539 - DNA, 25 bp, Mus musculus
ctgcaaaccggggtttcaggctcga

SEQ ID NO: 412540 - DNA, 25 bp, Mus musculus
tagagttccgggtctctgcaaaccg

SEQ ID NO: 412541 - DNA, 25 bp, Mus musculus
catcaggtttagagttccgggtctc

SEQ ID NO: 412542 - DNA, 25 bp, Mus musculus
ggggacgttgagaccatcaggttta

SEQ ID NO: 412543 - DNA, 25 bp, Mus musculus
gctcagccaggggacgttgagacca

SEQ ID NO: 412544 - DNA, 25 bp, Mus musculus
gagagcgcgctctcggacctcggct

SEQ ID NO: 412545 - DNA, 25 bp, Mus musculus
cctaagagtcgcagctgcggtcctg

SEQ ID NO: 412546 - DNA, 25 bp, Mus musculus
agacgcagcgcttcccgagtacgcg

SEQ ID NO: 412547 - DNA, 25 bp, Mus musculus
atggggctccagctttaacctcgcc

SEQ ID NO: 412548 - DNA, 25 bp, Mus musculus
gacagacatggcgtcccagagacta

SEQ ID NO: 412549 - DNA, 25 bp, Mus musculus
cgcagtgaggggaaatgcgaactta

SEQ ID NO: 412550 - DNA, 25 bp, Mus musculus
ctctgtctcccggacctctaagaga

SEQ ID NO: 412551 - DNA, 25 bp, Mus musculus
gcgaacttaggctgttacacaactg

SEQ ID NO: 412552 - DNA, 25 bp, Mus musculus
tacacaactgctggggtctgttctc

SEQ ID NO: 412553 - DNA, 25 bp, Mus musculus
tctgttcgtgcttctcaggagcttc

SEQ ID NO: 412554 - DNA, 25 bp, Mus musculus
gcggagttaagtccgtatgctaata

SEQ ID NO: 412555 - DNA, 25 bp, Mus musculus
gcggggaccatctccacaacgattc

SEQ ID NO: 412556 - DNA, 25 bp, Mus musculus
acaacgattcccaggtgcgaccagc

SEQ ID NO: 412557 - DNA, 25 bp, Mus musculus
tgtgccggttgtttcatcttccctc

SEQ ID NO: 412558 - DNA, 25 bp, Mus musculus
ttttctttcctcagatcgaagcgga

SEQ ID NO: 412559 - DNA, 25 bp, Mus musculus
tttccgattgaatggtgagtgtgcc

SEQ ID NO: 412560 - DNA, 25 bp, Mus musculus
agcctctttccacgagcgctgacgt

SEQ ID NO: 412561 - DNA, 25 bp, Mus musculus
tcccatttaaaagcggccgcgcagg

SEQ ID NO: 412562 - DNA, 25 bp, Mus musculus
gccagatcacatggagccgcggcgc

SEQ ID NO: 412563 - DNA, 25 bp, Mus musculus
gtcactcacggcctgttagccaatc

SEQ ID NO: 412564 - DNA, 25 bp, Mus musculus
ctgttagccaatccacgagtgcgcc

SEQ ID NO: 412565 - DNA, 25 bp, Mus musculus
cagccttgccaggtaaccgggttcg

SEQ ID NO: 412566 - DNA, 25 bp, Mus musculus
aagctcggccgaaccgaggtgtcca

SEQ ID NO: 412567 - DNA, 25 bp, Mus musculus
agcgtctttgttcccggcgcgctga

SEQ ID NO: 412568 - DNA, 25 bp, Mus musculus
ggtgggcaccgtcatgactttgttc

SEQ ID NO: 412569 - DNA, 25 bp, Mus musculus
ctttgttctactccaagaagtcgca

SEQ ID NO: 412570 - DNA, 25 bp, Mus musculus
tcgcagcggccagaacggaagacct

SEQ ID NO: 412571 - DNA, 25 bp, Mus musculus
tagaacccgtctgtctgctcaagcc

SEQ ID NO: 412572 - DNA, 25 bp, Mus musculus
gtcaagttggagacgcgccagatca

SEQ ID NO: 412573 - DNA, 25 bp, Mus musculus
aaatcgaggggtccagtaagtgcgc

SEQ ID NO: 412574 - DNA, 25 bp, Mus musculus
ctcaagcccttgcaaaagacgtctg

SEQ ID NO: 412575 - DNA, 25 bp, Mus musculus
cggaagaccttccaggtcaagttgg

SEQ ID NO: 412576 - DNA, 25 bp, Mus musculus
gatgctgaggccctaagcggttccc

SEQ ID NO: 412577 - DNA, 25 bp, Mus musculus
ctgcgggccagcgttctctgtgttg

SEQ ID NO: 412578 - DNA, 25 bp, Mus musculus
ggaccttacccagagcgcatgcgca

SEQ ID NO: 412579 - DNA, 25 bp, Mus musculus
tcgcggggagcggaccttacccaga

SEQ ID NO: 412580 - DNA, 25 bp, Mus musculus
cgaagacgagcagcaccaactgact

SEQ ID NO: 412581 - DNA, 25 bp, Mus musculus
cacggactgcttctggggcgaagac

SEQ ID NO: 412582 - DNA, 25 bp, Mus musculus
gcgacgccagatccacggactgctt

SEQ ID NO: 412583 - DNA, 25 bp, Mus musculus
acagacgcccgggactgacagctct

SEQ ID NO: 412584 - DNA, 25 bp, Mus musculus
gggagacacacagacgcccgggact

SEQ ID NO: 412585 - DNA, 25 bp, Mus musculus
tcgcagacacacaggggctgacagg

SEQ ID NO: 412586 - DNA, 25 bp, Mus musculus
gggatgcggacacacgcacccacgg

SEQ ID NO: 412587 - DNA, 25 bp, Mus musculus
gctcatttcaccagacgcaccggtg

SEQ ID NO: 412588 - DNA, 25 bp, Mus musculus
ggttcgagtcccgacgctcatttca

SEQ ID NO: 412589 - DNA, 25 bp, Mus musculus
tgggcaaggaggattccactgtacc

SEQ ID NO: 412590 - DNA, 25 bp, Mus musculus
ccatccggtggtgtagaggctgtaa

SEQ ID NO: 412591 - DNA, 25 bp, Mus musculus
cagcgcagctggaaaatgttacttc

SEQ ID NO: 412592 - DNA, 25 bp, Mus musculus
tgttacttcgctggaaaggtttcca

SEQ ID NO: 412593 - DNA, 25 bp, Mus musculus
tcggctgacttgttcttcgccaacc

SEQ ID NO: 412594 - DNA, 25 bp, Mus musculus
ctggggtacccatatctcgacgcct

SEQ ID NO: 412595 - DNA, 25 bp, Mus musculus
acggtgcacagccacacggacagac

SEQ ID NO: 412596 - DNA, 25 bp, Mus musculus
gcgggctctgcacggattagcataa

SEQ ID NO: 412597 - DNA, 25 bp, Mus musculus
attagcataaacttggggccgcgcc

SEQ ID NO: 412598 - DNA, 25 bp, Mus musculus
cagctccaagctgacgcccgaaggg

SEQ ID NO: 412599 - DNA, 25 bp, Mus musculus
agggccgcgtgcaaacacgaggtta

SEQ ID NO: 412600 - DNA, 25 bp, Mus musculus
cacgaggttaagaaacgagcaggcg

SEQ ID NO: 412601 - DNA, 25 bp, Mus musculus
cagggcgctaaattccaggaggctc

SEQ ID NO: 412602 - DNA, 25 bp, Mus musculus
cctggagtttgctcacagcgcagct

SEQ ID NO: 412603 - DNA, 25 bp, Mus musculus
cctacccgcgcaaagaatcgtgtcg

SEQ ID NO: 412604 - DNA, 25 bp, Mus musculus
tacctaaaatggctcctgcagcagc

SEQ ID NO: 412605 - DNA, 25 bp, Mus musculus
ttgtcggggccaggcaggaaaataa

SEQ ID NO: 412606 - DNA, 25 bp, Mus musculus
tcaagcttgcttgcaggagcgagtg

SEQ ID NO: 412607 - DNA, 25 bp, Mus musculus
gagaagatgtactggggtcccacga

SEQ ID NO: 412608 - DNA, 25 bp, Mus musculus
caagcaagctggaaaacccgggatt

SEQ ID NO: 412609 - DNA, 25 bp, Mus musculus
ctcaacctgcaggtggaggtctcgc

SEQ ID NO: 412610 - DNA, 25 bp, Mus musculus
ggtgctgcgctctgttttgcaagca

SEQ ID NO: 412611 - DNA, 25 bp, Mus musculus
gggcttgctccattgtgctcgtatt

SEQ ID NO: 412612 - DNA, 25 bp, Mus musculus
tgccgatcagacagaagcccgtttc

SEQ ID NO: 412613 - DNA, 25 bp, Mus musculus
tttcgcctgcccaaaacacaggttc

SEQ ID NO: 412614 - DNA, 25 bp, Mus musculus
cctgccgcgctattgggtttcgcct

SEQ ID NO: 412615 - DNA, 25 bp, Mus musculus
tgcaaggacaccctaacccagcttg

SEQ ID NO: 412616 - DNA, 25 bp, Mus musculus
agtttagctcagacaccctgcaagg

SEQ ID NO: 412617 - DNA, 25 bp, Mus musculus
ctcgtatttgcatggatgtgatcgc

SEQ ID NO: 412618 - DNA, 25 bp, Mus musculus
gacacagcagctgcgtccggaggtt

SEQ ID NO: 412619 - DNA, 25 bp, Mus musculus
cacccagctgagcatcgctttcagg

SEQ ID NO: 412620 - DNA, 25 bp, Mus musculus
atctgcggggtattcgcctcttcgc

SEQ ID NO: 412621 - DNA, 25 bp, Mus musculus
cacacacaggatctgcggggtattc

SEQ ID NO: 412622 - DNA, 25 bp, Mus musculus
cccgaaacactcgagtgacaggttc

SEQ ID NO: 412623 - DNA, 25 bp, Mus musculus
agcgcgtacacacatcgctcttgca

SEQ ID NO: 412624 - DNA, 25 bp, Mus musculus
tgagcatcgctttcaggctaccctg

SEQ ID NO: 412625 - DNA, 25 bp, Mus musculus
atcgctttcaggctaccctgcgggg

SEQ ID NO: 412626 - DNA, 25 bp, Mus musculus
atattcgcaacagccgcgcaaagtt

SEQ ID NO: 412627 - DNA, 25 bp, Mus musculus
tggaaatattcgcaacagccgcgca

SEQ ID NO: 412628 - DNA, 25 bp, Mus musculus
agcccaggaagctgcccgggtgaca

SEQ ID NO: 412629 - DNA, 25 bp, Mus musculus
tgggaggcagcaagtggaaatattc

SEQ ID NO: 412630 - DNA, 25 bp, Mus musculus
ctcgagtgacaggttccgacaagtg

SEQ ID NO: 412631 - DNA, 25 bp, Mus musculus
atcgctcttgcacacacaggatctg

SEQ ID NO: 412632 - DNA, 25 bp, Mus musculus
caacgttagcactttggtgggatgc

SEQ ID NO: 412633 - DNA, 25 bp, Mus musculus
acacctctcgctgtctctggttgga

SEQ ID NO: 412634 - DNA, 25 bp, Mus musculus
ttgctcaagtagatgtccaacgtta

SEQ ID NO: 412635 - DNA, 25 bp, Mus musculus
gtccacctgagccacctcagttttg

SEQ ID NO: 412636 - DNA, 25 bp, Mus musculus
aatcgaggccggctcgtccacctga

SEQ ID NO: 412637 - DNA, 25 bp, Mus musculus
tttccatgtcgtccgaatcctcgca

SEQ ID NO: 412638 - DNA, 25 bp, Mus musculus
cggccgcttgacctcttttccatgt

SEQ ID NO: 412639 - DNA, 25 bp, Mus musculus
tcggtggatttctgcgacttcctcc

SEQ ID NO: 412640 - DNA, 25 bp, Mus musculus
aagcagttctcagccgcagcgtctg

SEQ ID NO: 412641 - DNA, 25 bp, Mus musculus
tttcctttccgccaagcagttctca

SEQ ID NO: 412642 - DNA, 25 bp, Mus musculus
tcgggaaccgcttgtaccgatttca

SEQ ID NO: 412643 - DNA, 25 bp, Mus musculus
caacgagctgcttttgacggtgagc

SEQ ID NO: 412644 - DNA, 25 bp, Mus musculus
cttgatctcgggcagcaacgagctg

SEQ ID NO: 412645 - DNA, 25 bp, Mus musculus
ccctcttgtgctctggcttgatctc

SEQ ID NO: 412646 - DNA, 25 bp, Mus musculus
ggcccagtcgccaagctgtgcaaga

SEQ ID NO: 412647 - DNA, 25 bp, Mus musculus
tctcatcaccgtcggacgcgagttc

SEQ ID NO: 412648 - DNA, 25 bp, Mus musculus
ccaggcgatctgcttcatctgaagg

SEQ ID NO: 412649 - DNA, 25 bp, Mus musculus
aacaaagtaccgcttccaggcgatc

SEQ ID NO: 412650 - DNA, 25 bp, Mus musculus
tggcgcccatacaaaacccatttgg

SEQ ID NO: 412651 - DNA, 25 bp, Mus musculus
aagttgtacttctagcgccgggatg

SEQ ID NO: 412652 - DNA, 25 bp, Mus musculus
tgcggtcaccaaaggaagatgagtc

SEQ ID NO: 412653 - DNA, 25 bp, Mus musculus
gcaagagctgcgtgcaggacccacc

SEQ ID NO: 412654 - DNA, 25 bp, Mus musculus
gggacccagacggtgctaatcgcac

SEQ ID NO: 412655 - DNA, 25 bp, Mus musculus
tgggcttggttcctgatgaattcta

SEQ ID NO: 412656 - DNA, 25 bp, Mus musculus
gatcgcagctaaggcgtctccgccg

SEQ ID NO: 412657 - DNA, 25 bp, Mus musculus
ccgaggccagggcaaaagatcgcag

SEQ ID NO: 412658 - DNA, 25 bp, Mus musculus
gggctcttcgctctcacagctgtcg

SEQ ID NO: 412659 - DNA, 25 bp, Mus musculus
cgccctggctgcaaagttgtacttc

SEQ ID NO: 412660 - DNA, 25 bp, Mus musculus
gaaagatcctggctgcccggcagaa

SEQ ID NO: 412661 - DNA, 25 bp, Mus musculus
tccacgtggcagacaatgaggtcgt

SEQ ID NO: 412662 - DNA, 25 bp, Mus musculus
gacgaggtccttgctgagctgagca

SEQ ID NO: 412663 - DNA, 25 bp, Mus musculus
atgccttccgaaagatcctggctgc

SEQ ID NO: 412664 - DNA, 25 bp, Mus musculus
gacaatgaggtcgtggatgccttcc

SEQ ID NO: 412665 - DNA, 25 bp, Mus musculus
agcgggtccacgtggcagacaatga

SEQ ID NO: 412666 - DNA, 25 bp, Mus musculus
cggtgagctggcaggagctaaggca

SEQ ID NO: 412667 - DNA, 25 bp, Mus musculus
acgacctgctgaggttggcaaagga

SEQ ID NO: 412668 - DNA, 25 bp, Mus musculus
cgcaccaagaagcacgacctgctga

SEQ ID NO: 412669 - DNA, 25 bp, Mus musculus
tcggtgcacacagccgcaccaagaa

SEQ ID NO: 412670 - DNA, 25 bp, Mus musculus
aaggcactcggtgcacacagccgca

SEQ ID NO: 412671 - DNA, 25 bp, Mus musculus
tgagctgaaggcactcggtgcacac

SEQ ID NO: 412672 - DNA, 25 bp, Mus musculus
ctgagctgagcaaacggcaggctga

SEQ ID NO: 412673 - DNA, 25 bp, Mus musculus
ggtcgtggatgccttccgaaagatc

SEQ ID NO: 412674 - DNA, 25 bp, Mus musculus
caggggacatgacagtagcgaaatc

SEQ ID NO: 412675 - DNA, 25 bp, Mus musculus
acggaagccgcagtgagtccttacc

SEQ ID NO: 412676 - DNA, 25 bp, Mus musculus
cgaccgcgatggctacagctacgga

SEQ ID NO: 412677 - DNA, 25 bp, Mus musculus
ccgacgatgccgtgtacgagctcaa

SEQ ID NO: 412678 - DNA, 25 bp, Mus musculus
tcgagatcgacctcaaaaatgggtg

SEQ ID NO: 412679 - DNA, 25 bp, Mus musculus
cgcgagaaggacatccagcgctttt

SEQ ID NO: 412680 - DNA, 25 bp, Mus musculus
cgcaccattgtgtggctgactcggc

SEQ ID NO: 412681 - DNA, 25 bp, Mus musculus
ctgacagcccggacaaccaatgaga

SEQ ID NO: 412682 - DNA, 25 bp, Mus musculus
ggctgtttacgctgatggctgcaca

SEQ ID NO: 412683 - DNA, 25 bp, Mus musculus
gcacgactcaaaaggtccgggcctc

SEQ ID NO: 412684 - DNA, 25 bp, Mus musculus
cgtgcctgggcacaagaacagttta

SEQ ID NO: 412685 - DNA, 25 bp, Mus musculus
taaaactcgttctccgcgtgcctgg

SEQ ID NO: 412686 - DNA, 25 bp, Mus musculus
gaccaagatggcctagactgacagc

SEQ ID NO: 412687 - DNA, 25 bp, Mus musculus
gcctgagctacaacgtccgcgagaa

SEQ ID NO: 412688 - DNA, 25 bp, Mus musculus
gacgcttctcttagtggctcgggta

SEQ ID NO: 412689 - DNA, 25 bp, Mus musculus
cggcgcattcttctggttggatgtc

SEQ ID NO: 412690 - DNA, 25 bp, Mus musculus
cgggtactctcggtactcgtgtgca

SEQ ID NO: 412691 - DNA, 25 bp, Mus musculus
gcctgggacccgtagctacttagga

SEQ ID NO: 412692 - DNA, 25 bp, Mus musculus
accagctgtcgtctgctcgaggtca

SEQ ID NO: 412693 - DNA, 25 bp, Mus musculus
tatgagggcagagaccagctgtcgt

SEQ ID NO: 412694 - DNA, 25 bp, Mus musculus
cactgcccggctcggtatgagggca

SEQ ID NO: 412695 - DNA, 25 bp, Mus musculus
tctttacattcaaagccagcggggc

SEQ ID NO: 412696 - DNA, 25 bp, Mus musculus
gcgggcaagcactcacaaaggcaga

SEQ ID NO: 412697 - DNA, 25 bp, Mus musculus
ctgctatgctaatgaggacggcggc

SEQ ID NO: 412698 - DNA, 25 bp, Mus musculus
gctcggcgagcagctgctatgctaa

SEQ ID NO: 412699 - DNA, 25 bp, Mus musculus
agccgcggcccattcattccggagg

SEQ ID NO: 412700 - DNA, 25 bp, Mus musculus
gtcggtctttcttctttcgcccgca

SEQ ID NO: 412701 - DNA, 25 bp, Mus musculus
ggatgtccttccgacagtaccctgc

SEQ ID NO: 412702 - DNA, 25 bp, Mus musculus
tgggcgctcccaggtcgccacaccc

SEQ ID NO: 412703 - DNA, 25 bp, Mus musculus
aggctcccacggtcggtcgctcggt

SEQ ID NO: 412704 - DNA, 25 bp, Mus musculus
cgcccgctctgcagggaacaggccc

SEQ ID NO: 412705 - DNA, 25 bp, Mus musculus
aggtccttttccagctcctgcggca

SEQ ID NO: 412706 - DNA, 25 bp, Mus musculus
tcacggcgaatcctggggtcccgca

SEQ ID NO: 412707 - DNA, 25 bp, Mus musculus
gtcctcacggcgaatcctggggtcc

SEQ ID NO: 412708 - DNA, 25 bp, Mus musculus
ccaatcccggtcctcacggcgaatc

SEQ ID NO: 412709 - DNA, 25 bp, Mus musculus
aagaacggggcagtggtctctggct

SEQ ID NO: 412710 - DNA, 25 bp, Mus musculus
tagccatgcaggtaagaacggggca

SEQ ID NO: 412711 - DNA, 25 bp, Mus musculus
accgctagccatgcaggtaagaacg

SEQ ID NO: 412712 - DNA, 25 bp, Mus musculus
gcaaccgctagccatgcaggtaaga

SEQ ID NO: 412713 - DNA, 25 bp, Mus musculus
gcggcaaccgctagccatgcaggta

SEQ ID NO: 412714 - DNA, 25 bp, Mus musculus
tgcgggcggcaaccgctagccatgc

SEQ ID NO: 412715 - DNA, 25 bp, Mus musculus
aggcgcgcgccgcaccaggctccca

SEQ ID NO: 412716 - DNA, 25 bp, Mus musculus
tcctggcgatgatgtagaatttcta

SEQ ID NO: 412717 - DNA, 25 bp, Mus musculus
cccgaggtcggcagaggtaaactga

SEQ ID NO: 412718 - DNA, 25 bp, Mus musculus
ctggtcctggcgatgatgtagaatt

SEQ ID NO: 412719 - DNA, 25 bp, Mus musculus
cggccttggatacctggcggcctct

SEQ ID NO: 412720 - DNA, 25 bp, Mus musculus
cagacacagcacgtctgtcgcgctg

SEQ ID NO: 412721 - DNA, 25 bp, Mus musculus
ccagcgtccgcagccaccagacaca

SEQ ID NO: 412722 - DNA, 25 bp, Mus musculus
ccctaggccagccttgtgggaatcc

SEQ ID NO: 412723 - DNA, 25 bp, Mus musculus
tctggctggagacgatgacggcctc

SEQ ID NO: 412724 - DNA, 25 bp, Mus musculus
tcgtcatcacgccacgacggaagtc

SEQ ID NO: 412725 - DNA, 25 bp, Mus musculus
ccagccttgtgggaatcccgaggtc

SEQ ID NO: 412726 - DNA, 25 bp, Mus musculus
gtagaatttctagctcctcggactg

SEQ ID NO: 412727 - DNA, 25 bp, Mus musculus
acgtctgtcgcgctgtcgtcatcac

SEQ ID NO: 412728 - DNA, 25 bp, Mus musculus
agctcctcggactgcgcggatttgt

SEQ ID NO: 412729 - DNA, 25 bp, Mus musculus
cacgacggaagtcactcggggcccg

SEQ ID NO: 412730 - DNA, 25 bp, Mus musculus
attcgttgtctcatggggtttcggc

SEQ ID NO: 412731 - DNA, 25 bp, Mus musculus
cagttcctgggaacgtgcgaccaga

SEQ ID NO: 412732 - DNA, 25 bp, Mus musculus
ctttcttgttagcattccgggaagc

SEQ ID NO: 412733 - DNA, 25 bp, Mus musculus
gctcgaatttgctggcgttcctttc

SEQ ID NO: 412734 - DNA, 25 bp, Mus musculus
cacttgtcgatcaagagtggctcga

SEQ ID NO: 412735 - DNA, 25 bp, Mus musculus
tgcgaccagacctgcagacacgctg

SEQ ID NO: 412736 - DNA, 25 bp, Mus musculus
tcccttctccttgggtcggcaagcg

SEQ ID NO: 412737 - DNA, 25 bp, Mus musculus
cccattactgggtagggagaatgtc

SEQ ID NO: 412738 - DNA, 25 bp, Mus musculus
tcatctcccgcctaattgcagggtg

SEQ ID NO: 412739 - DNA, 25 bp, Mus musculus
taggaaagtggttctgtgcgctccc

SEQ ID NO: 412740 - DNA, 25 bp, Mus musculus
ctccctaggcagctgcagttcctgg

SEQ ID NO: 412741 - DNA, 25 bp, Mus musculus
gcgcgcgccacgttaagaggctatc

SEQ ID NO: 412742 - DNA, 25 bp, Mus musculus
cagaagcctgggagacacttgtcga

SEQ ID NO: 412743 - DNA, 25 bp, Mus musculus
gcagacacgctgacgcctgagagca

SEQ ID NO: 412744 - DNA, 25 bp, Mus musculus
gccgtttactaattggccgtcacta

SEQ ID NO: 412745 - DNA, 25 bp, Mus musculus
aaggcctatcccttccctggattgg

SEQ ID NO: 412746 - DNA, 25 bp, Mus musculus
cccgtggcgcctctgattttatgcc

SEQ ID NO: 412747 - DNA, 25 bp, Mus musculus
cgctgagcattaattgggccgttta

SEQ ID NO: 412748 - DNA, 25 bp, Mus musculus
ggttttaacttctcggcgctgagca

SEQ ID NO: 412749 - DNA, 25 bp, Mus musculus
ccagggacagtcacaggctccagca

SEQ ID NO: 412750 - DNA, 25 bp, Mus musculus
tgtacacgttcggtcacgcagatcc

SEQ ID NO: 412751 - DNA, 25 bp, Mus musculus
ccacgcacagggctacgataacata

SEQ ID NO: 412752 - DNA, 25 bp, Mus musculus
gtcacggtgccagtcatttatcctc

SEQ ID NO: 412753 - DNA, 25 bp, Mus musculus
gcattcattcacaagccgacgcgca

SEQ ID NO: 412754 - DNA, 25 bp, Mus musculus
agcccgacagcttcccgtaagacga

SEQ ID NO: 412755 - DNA, 25 bp, Mus musculus
cggggacacgcacacaacatcttgg

SEQ ID NO: 412756 - DNA, 25 bp, Mus musculus
ttcgcagctgctgtcacatccagtg

SEQ ID NO: 412757 - DNA, 25 bp, Mus musculus
gccggtgtcgtccaatcaaggccta

SEQ ID NO: 412758 - DNA, 25 bp, Mus musculus
acattgctacctcgggctcctgcga

SEQ ID NO: 412759 - DNA, 25 bp, Mus musculus
ttcttcttggcaccggccttgctca

SEQ ID NO: 412760 - DNA, 25 bp, Mus musculus
ccagagtggcttgcttggcaggcac

SEQ ID NO: 412761 - DNA, 25 bp, Mus musculus
ttccttacggcccttcttcttggca

SEQ ID NO: 412762 - DNA, 25 bp, Mus musculus
gcgtagctatggtagccgcggtaca

SEQ ID NO: 412763 - DNA, 25 bp, Mus musculus
cgcctcgatggccatgtgctccgag

SEQ ID NO: 412764 - DNA, 25 bp, Mus musculus
ctggactcagcaggccgtcctttga

SEQ ID NO: 412765 - DNA, 25 bp, Mus musculus
ggggctccagcaagctctcagagtt

SEQ ID NO: 412766 - DNA, 25 bp, Mus musculus
tctcagagttctccaggatctcctg

SEQ ID NO: 412767 - DNA, 25 bp, Mus musculus
atctcctggagcagccgacgcttct

SEQ ID NO: 412768 - DNA, 25 bp, Mus musculus
cgacgcttctgatactccggacctg

SEQ ID NO: 412769 - DNA, 25 bp, Mus musculus
tactccggacctgccggggacaaca

SEQ ID NO: 412770 - DNA, 25 bp, Mus musculus
cagagaggtaggcttcgaacccaca

SEQ ID NO: 412771 - DNA, 25 bp, Mus musculus
gctcatcctccaagggcggaggctc

SEQ ID NO: 412772 - DNA, 25 bp, Mus musculus
ctgccatcccgtagggcacgctttg

SEQ ID NO: 412773 - DNA, 25 bp, Mus musculus
accgttccattgctgtgctcgctgc

SEQ ID NO: 412774 - DNA, 25 bp, Mus musculus
ggtgagtccggagccaccgttccat

SEQ ID NO: 412775 - DNA, 25 bp, Mus musculus
ccagcagagtgagcgcgaaaccacc

SEQ ID NO: 412776 - DNA, 25 bp, Mus musculus
acccagcagtgtgccacgcgtgaac

SEQ ID NO: 412777 - DNA, 25 bp, Mus musculus
tggtgcccttgaccagcacattgtg

SEQ ID NO: 412778 - DNA, 25 bp, Mus musculus
gtgattctgagcgtcgcagccgacc

SEQ ID NO: 412779 - DNA, 25 bp, Mus musculus
gctgcccagtgatgtgcgtgattct

SEQ ID NO: 412780 - DNA, 25 bp, Mus musculus
tgagaaagctcaagcggctccgctg

SEQ ID NO: 412781 - DNA, 25 bp, Mus musculus
gctccggaactcagctcgctcttga

SEQ ID NO: 412782 - DNA, 25 bp, Mus musculus
cgagcgcttgtcgttcttccactcg

SEQ ID NO: 412783 - DNA, 25 bp, Mus musculus
cgctttggcgcacaccgtagccatg

SEQ ID NO: 412784 - DNA, 25 bp, Mus musculus
cacattgtggcggtacttgccctcc

SEQ ID NO: 412785 - DNA, 25 bp, Mus musculus
tgccgttggtgaattggccttgata

SEQ ID NO: 412786 - DNA, 25 bp, Mus musculus
ctagagttgtactgcgcctgcgcaa

SEQ ID NO: 412787 - DNA, 25 bp, Mus musculus
cggccaaccacggactccgagagga

SEQ ID NO: 412788 - DNA, 25 bp, Mus musculus
gagctgtctcggcttttaccctgtc

SEQ ID NO: 412789 - DNA, 25 bp, Mus musculus
tcttacatgcaaccaagggcgcttg

SEQ ID NO: 412790 - DNA, 25 bp, Mus musculus
gaaggccgcgcaacttggcactcca

SEQ ID NO: 412791 - DNA, 25 bp, Mus musculus
tggcccgcgcctctagagttgtact

SEQ ID NO: 412792 - DNA, 25 bp, Mus musculus
atgcttggcggagtttcttacatgc

SEQ ID NO: 412793 - DNA, 25 bp, Mus musculus
agcacgtgcgtcttaagtcatttcc

SEQ ID NO: 412794 - DNA, 25 bp, Mus musculus
aggcttttgggcgtgcctacttcct

SEQ ID NO: 412795 - DNA, 25 bp, Mus musculus
ctacttcctcttcgctgtcacgtga

SEQ ID NO: 412796 - DNA, 25 bp, Mus musculus
ttgccttgcagctatcgagccgctg

SEQ ID NO: 412797 - DNA, 25 bp, Mus musculus
ctgcttccttcttgtcctcttgaag

SEQ ID NO: 412798 - DNA, 25 bp, Mus musculus
agtatttgcgccagctgatgcctcc

SEQ ID NO: 412799 - DNA, 25 bp, Mus musculus
cgcgtctgtctgacccggatccaaa

SEQ ID NO: 412800 - DNA, 25 bp, Mus musculus
cggggagagcacacacgcaaactct

SEQ ID NO: 412801 - DNA, 25 bp, Mus musculus
agtagcccatgagcgcagatcggcg

SEQ ID NO: 412802 - DNA, 25 bp, Mus musculus
cgtacttggacttgtcgcgctcgcc

SEQ ID NO: 412803 - DNA, 25 bp, Mus musculus
cggcggtaaacaagttgcaggctcc

SEQ ID NO: 412804 - DNA, 25 bp, Mus musculus
cgcgttccctaaaagcactttcctg

SEQ ID NO: 412805 - DNA, 25 bp, Mus musculus
cagcggaggctttatttctttcttc

SEQ ID NO: 412806 - DNA, 25 bp, Mus musculus
ttccgtgcaactttcccaaaatggc

SEQ ID NO: 412807 - DNA, 25 bp, Mus musculus
tggcggaaattggaggcgatctcta

SEQ ID NO: 412808 - DNA, 25 bp, Mus musculus
tggaggcgatctctaggaaattctc

SEQ ID NO: 412809 - DNA, 25 bp, Mus musculus
agcgtggaccagacagtagcccatg

SEQ ID NO: 412810 - DNA, 25 bp, Mus musculus
ggaaattctcccacagtcggcggcg

SEQ ID NO: 412811 - DNA, 25 bp, Mus musculus
ggcgagcaaagtggcccggcctctt

SEQ ID NO: 412812 - DNA, 25 bp, Mus musculus
actgcctcggtctcccgtacttgga

SEQ ID NO: 412813 - DNA, 25 bp, Mus musculus
tctgccacattcaaccagtcggttc

SEQ ID NO: 412814 - DNA, 25 bp, Mus musculus
ccagtccttcagctcgcagaaggta

SEQ ID NO: 412815 - DNA, 25 bp, Mus musculus
cccgacgcgcccgaggcatccagcc

SEQ ID NO: 412816 - DNA, 25 bp, Mus musculus
tggacccagtccttcagctcgcaga

SEQ ID NO: 412817 - DNA, 25 bp, Mus musculus
gagagcctggttctgtaccactgga

SEQ ID NO: 412818 - DNA, 25 bp, Mus musculus
cttcagctcgcagaaggtagagcgg

SEQ ID NO: 412819 - DNA, 25 bp, Mus musculus
cccaaggagagcctggttctgtacc

SEQ ID NO: 412820 - DNA, 25 bp, Mus musculus
cgatgcagccaagccggtggagacc

SEQ ID NO: 412821 - DNA, 25 bp, Mus musculus
ccatctcggcactggagagcgatgc

SEQ ID NO: 412822 - DNA, 25 bp, Mus musculus
ggcccatctcggcactggagagcga

SEQ ID NO: 412823 - DNA, 25 bp, Mus musculus
cagctggtggcccatctcggcactg

SEQ ID NO: 412824 - DNA, 25 bp, Mus musculus
accaactgcagctggtggcccatct

SEQ ID NO: 412825 - DNA, 25 bp, Mus musculus
gatcgcgggctgtcatggcgacccc

SEQ ID NO: 412826 - DNA, 25 bp, Mus musculus
ccttcctccttcctcggatcgcggg

SEQ ID NO: 412827 - DNA, 25 bp, Mus musculus
aactgcagctggtggcccatctcgg

SEQ ID NO: 412828 - DNA, 25 bp, Mus musculus
ggggacagctccttgacgaccgagc

SEQ ID NO: 412829 - DNA, 25 bp, Mus musculus
cgcttgttgctgaggtagctctcgg

SEQ ID NO: 412830 - DNA, 25 bp, Mus musculus
cacacgttgaggacgttgcgcttgt

SEQ ID NO: 412831 - DNA, 25 bp, Mus musculus
ggagcccgatgcactcacacgttga

SEQ ID NO: 412832 - DNA, 25 bp, Mus musculus
catccaactggcttcttggggcgcg

SEQ ID NO: 412833 - DNA, 25 bp, Mus musculus
gacgcgcctgtcaagacagggctcc

SEQ ID NO: 412834 - DNA, 25 bp, Mus musculus
ccgactcgatcctcctatcggaatg

SEQ ID NO: 412835 - DNA, 25 bp, Mus musculus
agggtcccagtgtcgcgacacgcgc

SEQ ID NO: 412836 - DNA, 25 bp, Mus musculus
cttgctttcccagggtcccagtgtc

SEQ ID NO: 412837 - DNA, 25 bp, Mus musculus
aatgtcacttgctttcccagggtcc

SEQ ID NO: 412838 - DNA, 25 bp, Mus musculus
ctaggcgcgaatgtcacttgctttc

SEQ ID NO: 412839 - DNA, 25 bp, Mus musculus
tgctcacatactaggcgcgaatgtc

SEQ ID NO: 412840 - DNA, 25 bp, Mus musculus
tcctcctatcggaatgctcacatac

SEQ ID NO: 412841 - DNA, 25 bp, Mus musculus
agaaaccacgcgcagcgctccaggt

SEQ ID NO: 412842 - DNA, 25 bp, Mus musculus
tgatgtagaacactaggcatatggc

SEQ ID NO: 412843 - DNA, 25 bp, Mus musculus
cactaggcatatggcagtgtgttcc

SEQ ID NO: 412844 - DNA, 25 bp, Mus musculus
atggcagtgtgttccagcttccctc

SEQ ID NO: 412845 - DNA, 25 bp, Mus musculus
ccaggtggtgtcaagccccaagtca

SEQ ID NO: 412846 - DNA, 25 bp, Mus musculus
gtcagcactacaaagttcactcatg

SEQ ID NO: 412847 - DNA, 25 bp, Mus musculus
cgctgtcagcggctcgcaggtctct

SEQ ID NO: 412848 - DNA, 25 bp, Mus musculus
ttcactcatgcgcattcccggatgg

SEQ ID NO: 412849 - DNA, 25 bp, Mus musculus
ctcgcaggtctctggggctccgaga

SEQ ID NO: 412850 - DNA, 25 bp, Mus musculus
agagatggcttcctgcctcctgttg

SEQ ID NO: 412851 - DNA, 25 bp, Mus musculus
ctgcctcctgttgttgtggacgaga

SEQ ID NO: 412852 - DNA, 25 bp, Mus musculus
agggtgtcaggctttatttcctgtc

SEQ ID NO: 412853 - DNA, 25 bp, Mus musculus
atttcctgtccatcacgtcgttgtc

SEQ ID NO: 412854 - DNA, 25 bp, Mus musculus
acgtcgttgtcgaggctgacagcca

SEQ ID NO: 412855 - DNA, 25 bp, Mus musculus
cctacacgcggctcgagcgtcactt

SEQ ID NO: 412856 - DNA, 25 bp, Mus musculus
ccaaaggtcgcctgctccgctggat

SEQ ID NO: 412857 - DNA, 25 bp, Mus musculus
ctgctccgctggatccagatctcgg

SEQ ID NO: 412858 - DNA, 25 bp, Mus musculus
tcgacgcgttcatttgtggaggacg

SEQ ID NO: 412859 - DNA, 25 bp, Mus musculus
gctggatccagatctcggcgccttt

SEQ ID NO: 412860 - DNA, 25 bp, Mus musculus
tgacgtcgacgcgttcatttgtgga

SEQ ID NO: 412861 - DNA, 25 bp, Mus musculus
ggatccagatctcggcgcctttgcc

SEQ ID NO: 412862 - DNA, 25 bp, Mus musculus
ccaatccctgcgtggatgcccagag

SEQ ID NO: 412863 - DNA, 25 bp, Mus musculus
gtggatgcccagagttccggacaca

SEQ ID NO: 412864 - DNA, 25 bp, Mus musculus
atgcccagagttccggacacacgca

SEQ ID NO: 412865 - DNA, 25 bp, Mus musculus
ctcttcccggtccacagcggatccc

SEQ ID NO: 412866 - DNA, 25 bp, Mus musculus
cacagcggatcccgccaaaaaacta

SEQ ID NO: 412867 - DNA, 25 bp, Mus musculus
ctaaattgggctccgcccaactctg

SEQ ID NO: 412868 - DNA, 25 bp, Mus musculus
ccaactctgacgtcgacgcgttcat

SEQ ID NO: 412869 - DNA, 25 bp, Mus musculus
cttgcccgttccagcctcggccaaa

SEQ ID NO: 412870 - DNA, 25 bp, Mus musculus
tcaatggcgttgagaacctggaacc

SEQ ID NO: 412871 - DNA, 25 bp, Mus musculus
cttctccagcccgtcgaggtcgtaa

SEQ ID NO: 412872 - DNA, 25 bp, Mus musculus
cgaggtcgtaacgttgtgcattatc

SEQ ID NO: 412873 - DNA, 25 bp, Mus musculus
agacaacgctgtgcacgactctgcc

SEQ ID NO: 412874 - DNA, 25 bp, Mus musculus
cgtgactcttgcctacaccactggg

SEQ ID NO: 412875 - DNA, 25 bp, Mus musculus
ggcacttccgtgaggtttctgggta

SEQ ID NO: 412876 - DNA, 25 bp, Mus musculus
tgcacatgtgtagccaggtagtctc

SEQ ID NO: 412877 - DNA, 25 bp, Mus musculus
agagaactacccgactacgcctgcg

SEQ ID NO: 412878 - DNA, 25 bp, Mus musculus
gggtgtcctagaagtcagctctgtc

SEQ ID NO: 412879 - DNA, 25 bp, Mus musculus
gctctgtcaggctgtcgaaggtgaa

SEQ ID NO: 412880 - DNA, 25 bp, Mus musculus
atttaggttggtctaggtcggcacg

SEQ ID NO: 412881 - DNA, 25 bp, Mus musculus
tcggcacgtagagtgcccaagctgc

SEQ ID NO: 412882 - DNA, 25 bp, Mus musculus
tgggcccaagtgtccctgtcccaga

SEQ ID NO: 412883 - DNA, 25 bp, Mus musculus
tggctgtccaaacacagaacgctgc

SEQ ID NO: 412884 - DNA, 25 bp, Mus musculus
ctctgttagcctcagagagtggagg

SEQ ID NO: 412885 - DNA, 25 bp, Mus musculus
tgaggcgtcgcctcagaaacgcgac

SEQ ID NO: 412886 - DNA, 25 bp, Mus musculus
tcctaactgctgactgaggcgtcgc

SEQ ID NO: 412887 - DNA, 25 bp, Mus musculus
gaggcctcgggactcacccagctgg

SEQ ID NO: 412888 - DNA, 25 bp, Mus musculus
gcctgcccgctcctctctgttagcc

SEQ ID NO: 412889 - DNA, 25 bp, Mus musculus
tacaactccgggctcgcttggggcg

SEQ ID NO: 412890 - DNA, 25 bp, Mus musculus
cgagcggatcctaactgctgactga

SEQ ID NO: 412891 - DNA, 25 bp, Mus musculus
tcagaaacgcgacggatcctcaagc

SEQ ID NO: 412892 - DNA, 25 bp, Mus musculus
gcgacggatcctcaagccggaaaca

SEQ ID NO: 412893 - DNA, 25 bp, Mus musculus
cgcaggacgcccagtttacgtcatt

SEQ ID NO: 412894 - DNA, 25 bp, Mus musculus
gcccagtttacgtcattgggtggcc

SEQ ID NO: 412895 - DNA, 25 bp, Mus musculus
acgtagagggttcgtggcatacaac

SEQ ID NO: 412896 - DNA, 25 bp, Mus musculus
tggcatacaactccgggctcgcttg

SEQ ID NO: 412897 - DNA, 25 bp, Mus musculus
gttcgtggcatacaactccgggctc

SEQ ID NO: 412898 - DNA, 25 bp, Mus musculus
gtgggtgcgctttccgcttttattc

SEQ ID NO: 412899 - DNA, 25 bp, Mus musculus
agaacgtctgcgtgtgtcgctcttc

SEQ ID NO: 412900 - DNA, 25 bp, Mus musculus
ctgcgtgtgtcgctcttcgttggtg

SEQ ID NO: 412901 - DNA, 25 bp, Mus musculus
agctaggaactgaagagaacgtctg

SEQ ID NO: 412902 - DNA, 25 bp, Mus musculus
tcgcggagtagctaggaactgaaga

SEQ ID NO: 412903 - DNA, 25 bp, Mus musculus
ctcctattttatgagggttggtcgc

SEQ ID NO: 412904 - DNA, 25 bp, Mus musculus
ctggagcctcactcgaaagttttcc

SEQ ID NO: 412905 - DNA, 25 bp, Mus musculus
tcgcgtcgcctaggcaacggctcgg

SEQ ID NO: 412906 - DNA, 25 bp, Mus musculus
ttcggcagtcgcgtcgcctaggcaa

SEQ ID NO: 412907 - DNA, 25 bp, Mus musculus
ttcccggccgccgtagagcaagcga

SEQ ID NO: 412908 - DNA, 25 bp, Mus musculus
cccattgctcccagtcgcgtccctt

SEQ ID NO: 412909 - DNA, 25 bp, Mus musculus
gctttccttcctccgcccattgctc

SEQ ID NO: 412910 - DNA, 25 bp, Mus musculus
cgctttccgcttttattcctatgta

SEQ ID NO: 412911 - DNA, 25 bp, Mus musculus
attcctatgtatctctggagcctca

SEQ ID NO: 412912 - DNA, 25 bp, Mus musculus
gatggctctcagagaccgcggcccg

SEQ ID NO: 412913 - DNA, 25 bp, Mus musculus
ccatgcttctaggttaaaggcgcca

SEQ ID NO: 412914 - DNA, 25 bp, Mus musculus
aacccgaaggccgactggaggcact

SEQ ID NO: 412915 - DNA, 25 bp, Mus musculus
tggaggcactcccaggttcgcatag

SEQ ID NO: 412916 - DNA, 25 bp, Mus musculus
tcccaggttcgcatagacagcagcc

SEQ ID NO: 412917 - DNA, 25 bp, Mus musculus
gacagcagccgaacccgaaggccga

SEQ ID NO: 412918 - DNA, 25 bp, Mus musculus
tctcgctcgacatcccggaagcaag

SEQ ID NO: 412919 - DNA, 25 bp, Mus musculus
cgggacagaaccctggcaacggagc

SEQ ID NO: 412920 - DNA, 25 bp, Mus musculus
cttactttgggtttgttgaatgcgg

SEQ ID NO: 412921 - DNA, 25 bp, Mus musculus
tctgggccatggttccgagcgtgtt

SEQ ID NO: 412922 - DNA, 25 bp, Mus musculus
ttccgagcgtgttcccggttctctc

SEQ ID NO: 412923 - DNA, 25 bp, Mus musculus
gccacgctcttttttaccgggctgc

SEQ ID NO: 412924 - DNA, 25 bp, Mus musculus
tcgcttcccgatggctctcagagac

SEQ ID NO: 412925 - DNA, 25 bp, Mus musculus
ctctctgggtctgcgttggctcgct

SEQ ID NO: 412926 - DNA, 25 bp, Mus musculus
gctgttttcgatgcgctggaatccg

SEQ ID NO: 412927 - DNA, 25 bp, Mus musculus
cgtcgggagagctcagagcccgccc

SEQ ID NO: 412928 - DNA, 25 bp, Mus musculus
agttccgcagaaagtaccgcttctc

SEQ ID NO: 412929 - DNA, 25 bp, Mus musculus
gacgactaccgcgagctggagcgcc

SEQ ID NO: 412930 - DNA, 25 bp, Mus musculus
cgccgacgactaccgcgagctggag

SEQ ID NO: 412931 - DNA, 25 bp, Mus musculus
gaaagtaccgcttctccgccgacga

SEQ ID NO: 412932 - DNA, 25 bp, Mus musculus
gggcgagttccgcagaaagtaccgc

SEQ ID NO: 412933 - DNA, 25 bp, Mus musculus
ccgctgttttcgatgcgctggaatc

SEQ ID NO: 412934 - DNA, 25 bp, Mus musculus
acctgctggtgggtgccgctgtttt

SEQ ID NO: 412935 - DNA, 25 bp, Mus musculus
tgcatcctgtcctacctgctggtgg

SEQ ID NO: 412936 - DNA, 25 bp, Mus musculus
cgctcattctgtgcatcctgtccta

SEQ ID NO: 412937 - DNA, 25 bp, Mus musculus
gcacggcggcgctcattctgtgcat

SEQ ID NO: 412938 - DNA, 25 bp, Mus musculus
cgatgaggaagcagagcgcgcgcac

SEQ ID NO: 412939 - DNA, 25 bp, Mus musculus
tcggggcgcacggaaaccggcactc

SEQ ID NO: 412940 - DNA, 25 bp, Mus musculus
tctgcatgttctatgccctcctggg

SEQ ID NO: 412941 - DNA, 25 bp, Mus musculus
acggactcgggcaaagtgttctgca

SEQ ID NO: 412942 - DNA, 25 bp, Mus musculus
aaacacactggtgcggtgtctgctg

SEQ ID NO: 412943 - DNA, 25 bp, Mus musculus
gctgctgacagccaagcgctgcctg

SEQ ID NO: 412944 - DNA, 25 bp, Mus musculus
cggccgcacgtctctgctgagaaca

SEQ ID NO: 412945 - DNA, 25 bp, Mus musculus
ctctgctgagaacatggtggtggcc

SEQ ID NO: 412946 - DNA, 25 bp, Mus musculus
ctggccctaggtgccattgccttcg

SEQ ID NO: 412947 - DNA, 25 bp, Mus musculus
attgccttcgcgcacttcgagggct

SEQ ID NO: 412948 - DNA, 25 bp, Mus musculus
agggctggaccttcttccacgccta

SEQ ID NO: 412949 - DNA, 25 bp, Mus musculus
caccataggcttcggcgacttcgtg

SEQ ID NO: 412950 - DNA, 25 bp, Mus musculus
acttcgtggcgttgcagagagatga

SEQ ID NO: 412951 - DNA, 25 bp, Mus musculus
gcctgggcgagcgtctaaacacact

SEQ ID NO: 412952 - DNA, 25 bp, Mus musculus
ggtgccttcctcaacctggtggtcc

SEQ ID NO: 412953 - DNA, 25 bp, Mus musculus
tacgtggccttcagcttcctctaca

SEQ ID NO: 412954 - DNA, 25 bp, Mus musculus
gcccacagttctgcctctcagagtt

SEQ ID NO: 412955 - DNA, 25 bp, Mus musculus
gcctctcagagttgaatctcaggga

SEQ ID NO: 412956 - DNA, 25 bp, Mus musculus
caccgagcccaggtggcgaacaaag

SEQ ID NO: 412957 - DNA, 25 bp, Mus musculus
agcaaactaactctggactaccctg

SEQ ID NO: 412958 - DNA, 25 bp, Mus musculus
taactctggactaccctgagcagcc

SEQ ID NO: 412959 - DNA, 25 bp, Mus musculus
ctgagcagcctctgcctagcatgga

SEQ ID NO: 412960 - DNA, 25 bp, Mus musculus
acgctggagacgctttcgcccgcga

SEQ ID NO: 412961 - DNA, 25 bp, Mus musculus
ttcgcccgcgaggtagttggccgac

SEQ ID NO: 412962 - DNA, 25 bp, Mus musculus
gccgacgttgcgcaaggacgaaagt

SEQ ID NO: 412963 - DNA, 25 bp, Mus musculus
tggctggcggatttcaccgcgattc

SEQ ID NO: 412964 - DNA, 25 bp, Mus musculus
ggctctttgcaaagctgcttgaaac

SEQ ID NO: 412965 - DNA, 25 bp, Mus musculus
tgaaacttctcccaaactcgccatg

SEQ ID NO: 412966 - DNA, 25 bp, Mus musculus
aactcgccatggatgtggcggccgc

SEQ ID NO: 412967 - DNA, 25 bp, Mus musculus
cgtctccctagcaggaggcggcagt

SEQ ID NO: 412968 - DNA, 25 bp, Mus musculus
agtagatggcgagcgcctcgaagga

SEQ ID NO: 412969 - DNA, 25 bp, Mus musculus
tgcggctgaacctccggtgcccgct

SEQ ID NO: 412970 - DNA, 25 bp, Mus musculus
gcaaggctgtctgcgcccggctgct

SEQ ID NO: 412971 - DNA, 25 bp, Mus musculus
tgccaaccgggcaggtgcacgagcc

SEQ ID NO: 412972 - DNA, 25 bp, Mus musculus
attcttgacgcggagtacggcgcgc

SEQ ID NO: 412973 - DNA, 25 bp, Mus musculus
gctctgcgagcgctccatgcccgcg

SEQ ID NO: 412974 - DNA, 25 bp, Mus musculus
acagtggccgcctctctcgggcgct

SEQ ID NO: 412975 - DNA, 25 bp, Mus musculus
ttcatgcacgggaagtagatggcga

SEQ ID NO: 412976 - DNA, 25 bp, Mus musculus
cgaaggagttcatgcacgggaagta

SEQ ID NO: 412977 - DNA, 25 bp, Mus musculus
cctcatcatcgaaggagttcatgca

SEQ ID NO: 412978 - DNA, 25 bp, Mus musculus
tcacctgcgtcctcatcatcgaagg

SEQ ID NO: 412979 - DNA, 25 bp, Mus musculus
gtccctggcttctggaccgggagac

SEQ ID NO: 412980 - DNA, 25 bp, Mus musculus
gcttgggcagcttggccgccccatt

SEQ ID NO: 412981 - DNA, 25 bp, Mus musculus
ccgagggtccctggcttctggaccg

SEQ ID NO: 412982 - DNA, 25 bp, Mus musculus
tccggcaccatctctgctcggcgcc

SEQ ID NO: 412983 - DNA, 25 bp, Mus musculus
attgaaatgttagtcgaaggcgggc

SEQ ID NO: 412984 - DNA, 25 bp, Mus musculus
ccctccagtcctccgcggtgagtgc

SEQ ID NO: 412985 - DNA, 25 bp, Mus musculus
cggccaggctcactgtcgccgccag

SEQ ID NO: 412986 - DNA, 25 bp, Mus musculus
ttctctctcggcgcgccgtacgggg

SEQ ID NO: 412987 - DNA, 25 bp, Mus musculus
gaagcgcctttgctccctccagtcc

SEQ ID NO: 412988 - DNA, 25 bp, Mus musculus
ccgggaaggacgcagtcgctgccct

SEQ ID NO: 412989 - DNA, 25 bp, Mus musculus
cgagccatccttctgggcctgtcaa

SEQ ID NO: 412990 - DNA, 25 bp, Mus musculus
tctgggcctgtcaacctctctcatt

SEQ ID NO: 412991 - DNA, 25 bp, Mus musculus
ctctctcattctttgtggctttcaa

SEQ ID NO: 412992 - DNA, 25 bp, Mus musculus
tttgtggctttcaaaaattgaaatg

SEQ ID NO: 412993 - DNA, 25 bp, Mus musculus
gatcttcccggaagcgcctttgctc

SEQ ID NO: 412994 - DNA, 25 bp, Mus musculus
tcgctgccctctgatcttcccggaa

SEQ ID NO: 412995 - DNA, 25 bp, Mus musculus
ggcgagttcccgagccgcgacgccc

SEQ ID NO: 412996 - DNA, 25 bp, Mus musculus
cggatgcgtgcccttaaggcccgca

SEQ ID NO: 412997 - DNA, 25 bp, Mus musculus
tgcgcggagctcttccacagagtct

SEQ ID NO: 412998 - DNA, 25 bp, Mus musculus
ctcttccacagagtctgagagtttg

SEQ ID NO: 412999 - DNA, 25 bp, Mus musculus
gccatcccgggaggccggcaaacaa

SEQ ID NO: 413000 - DNA, 25 bp, Mus musculus
cccgccgaggagtgcgcaacagctt

SEQ ID NO: 413001 - DNA, 25 bp, Mus musculus
cggaaactctggttgccggctgcgc

SEQ ID NO: 413002 - DNA, 25 bp, Mus musculus
ttaaggcccgcagccgactggcctg

SEQ ID NO: 413003 - DNA, 25 bp, Mus musculus
tcgtacagcgccgaggcttcgccgt

SEQ ID NO: 413004 - DNA, 25 bp, Mus musculus
cttcgccgtactggccattgcggaa

SEQ ID NO: 413005 - DNA, 25 bp, Mus musculus
cattgcggaagttctggttgccggc

SEQ ID NO: 413006 - DNA, 25 bp, Mus musculus
gcagcgcggagctgttccacggaat

SEQ ID NO: 413007 - DNA, 25 bp, Mus musculus
gcgtactggccgttgcggaaactct

SEQ ID NO: 413008 - DNA, 25 bp, Mus musculus
ggagcgggttcctacctcgcgcctg

SEQ ID NO: 413009 - DNA, 25 bp, Mus musculus
tcgtacagcgccgaagcctcggcgt

SEQ ID NO: 413010 - DNA, 25 bp, Mus musculus
tgacactcgggccactagaggccgc

SEQ ID NO: 413011 - DNA, 25 bp, Mus musculus
cctgttgcttcgctttcgaggcaga

SEQ ID NO: 413012 - DNA, 25 bp, Mus musculus
cactctctgggcaacgtgcggacaa

SEQ ID NO: 413013 - DNA, 25 bp, Mus musculus
ggttttgcttagagagagcactctc

SEQ ID NO: 413014 - DNA, 25 bp, Mus musculus
cccgggcagaagtggttttgcttag

SEQ ID NO: 413015 - DNA, 25 bp, Mus musculus
tgcagtagcacctgccgagagagga

SEQ ID NO: 413016 - DNA, 25 bp, Mus musculus
gctgaggaacccaccgcgcaggtga

SEQ ID NO: 413017 - DNA, 25 bp, Mus musculus
catggagaccgtgcagctgaggaac

SEQ ID NO: 413018 - DNA, 25 bp, Mus musculus
ctcctctcgcttccggtaggggcgg

SEQ ID NO: 413019 - DNA, 25 bp, Mus musculus
cacctcttcggctttctgacttctg

SEQ ID NO: 413020 - DNA, 25 bp, Mus musculus
gagaggcacctcttcggctttctga

SEQ ID NO: 413021 - DNA, 25 bp, Mus musculus
ctggtgaccgggctgcagtagcacc

SEQ ID NO: 413022 - DNA, 25 bp, Mus musculus
agcgaggacttaaccctgttgcttc

SEQ ID NO: 413023 - DNA, 25 bp, Mus musculus
tagaggccgcccgagaggcacctct

SEQ ID NO: 413024 - DNA, 25 bp, Mus musculus
gccagcttgagcacgcggaagatgc

SEQ ID NO: 413025 - DNA, 25 bp, Mus musculus
tccatggtgagccagagacgacggc

SEQ ID NO: 413026 - DNA, 25 bp, Mus musculus
cagcgagtagcctggattctccatg

SEQ ID NO: 413027 - DNA, 25 bp, Mus musculus
ccacgccgatggatacgcagctgaa

SEQ ID NO: 413028 - DNA, 25 bp, Mus musculus
ccaagcgatgcagaagtactccagg

SEQ ID NO: 413029 - DNA, 25 bp, Mus musculus
ggcgcgacgacacctcgaagctgaa

SEQ ID NO: 413030 - DNA, 25 bp, Mus musculus
gggcagcaccgacacgatgtcaatg

SEQ ID NO: 413031 - DNA, 25 bp, Mus musculus
cgcatgaggcggaacacttgcacta

SEQ ID NO: 413032 - DNA, 25 bp, Mus musculus
ctcctggccgaaggcgaagacgcac

SEQ ID NO: 413033 - DNA, 25 bp, Mus musculus
agctcgtctaggacgtgcaggtgcc

SEQ ID NO: 413034 - DNA, 25 bp, Mus musculus
cagtgtgagatagaagggcagcacc

SEQ ID NO: 413035 - DNA, 25 bp, Mus musculus
caaagtagaactcgtgcgccgctgc

SEQ ID NO: 413036 - DNA, 25 bp, Mus musculus
gcacgtccgagatctcgtcgggaca

SEQ ID NO: 413037 - DNA, 25 bp, Mus musculus
agcccggatgccgatcaaagtagaa

SEQ ID NO: 413038 - DNA, 25 bp, Mus musculus
cgtacgcattttgcttggccgcagc

SEQ ID NO: 413039 - DNA, 25 bp, Mus musculus
atctccggaggccttagccactcta

SEQ ID NO: 413040 - DNA, 25 bp, Mus musculus
cttgctacccagtgagaggtcgtga

SEQ ID NO: 413041 - DNA, 25 bp, Mus musculus
gcaggttccgagcagcgacttgcta

SEQ ID NO: 413042 - DNA, 25 bp, Mus musculus
gactgcctaggtccagcagccaata

SEQ ID NO: 413043 - DNA, 25 bp, Mus musculus
ccagatcgcgtcagcagagcagctc

SEQ ID NO: 413044 - DNA, 25 bp, Mus musculus
gtctctttcaggtcctcgccattgg

SEQ ID NO: 413045 - DNA, 25 bp, Mus musculus
cgccgaattgtgtccagcttcccta

SEQ ID NO: 413046 - DNA, 25 bp, Mus musculus
ttagcgcctccatccaagcgtcggg

SEQ ID NO: 413047 - DNA, 25 bp, Mus musculus
gggtccctagcgcagaacctttagc

SEQ ID NO: 413048 - DNA, 25 bp, Mus musculus
cactcagttactcagcgggtcccta

SEQ ID NO: 413049 - DNA, 25 bp, Mus musculus
ccgagtactagggtccgccatagta

SEQ ID NO: 413050 - DNA, 25 bp, Mus musculus
cggacaccacggatgccgagtacta

SEQ ID NO: 413051 - DNA, 25 bp, Mus musculus
tctagcccgcgctcttgtcagtacg

SEQ ID NO: 413052 - DNA, 25 bp, Mus musculus
ccgcgggaggctccttacctgtatt

SEQ ID NO: 413053 - DNA, 25 bp, Mus musculus
ctgaggccgcatcgatcgctgccgg

SEQ ID NO: 413054 - DNA, 25 bp, Mus musculus
gccctgcatcccacgctcctagcca

SEQ ID NO: 413055 - DNA, 25 bp, Mus musculus
gggaggctccttacctgtattggtc

SEQ ID NO: 413056 - DNA, 25 bp, Mus musculus
ccttacctgtattggtctccaggga

SEQ ID NO: 413057 - DNA, 25 bp, Mus musculus
cctgtattggtctccagggattcca

SEQ ID NO: 413058 - DNA, 25 bp, Mus musculus
tattggtctccagggattccagcgc

SEQ ID NO: 413059 - DNA, 25 bp, Mus musculus
tctccagggattccagcgcgcttgt

SEQ ID NO: 413060 - DNA, 25 bp, Mus musculus
gattccagcgcgcttgtccctcaag

SEQ ID NO: 413061 - DNA, 25 bp, Mus musculus
caagtcgccgccctggactgttttc

SEQ ID NO: 413062 - DNA, 25 bp, Mus musculus
tcgccgccctggactgttttctgtc

SEQ ID NO: 413063 - DNA, 25 bp, Mus musculus
ccgctgcgcctcactactgcggagg

SEQ ID NO: 413064 - DNA, 25 bp, Mus musculus
ggctccttacctgtattggtctcca

SEQ ID NO: 413065 - DNA, 25 bp, Mus musculus
cggctgaggccgcatcgatcgctgc

SEQ ID NO: 413066 - DNA, 25 bp, Mus musculus
tttcgcattcgcagggactccgaag

SEQ ID NO: 413067 - DNA, 25 bp, Mus musculus
tcactttcggctagccagctggttc

SEQ ID NO: 413068 - DNA, 25 bp, Mus musculus
tcggctagccagctggttctccagc

SEQ ID NO: 413069 - DNA, 25 bp, Mus musculus
caggcgctctgtcagccgagccagt

SEQ ID NO: 413070 - DNA, 25 bp, Mus musculus
tcagccgagccagtgagcggttaag

SEQ ID NO: 413071 - DNA, 25 bp, Mus musculus
agcggttaaggaagatgtggtctca

SEQ ID NO: 413072 - DNA, 25 bp, Mus musculus
gtggtctcagagatcccttcacccg

SEQ ID NO: 413073 - DNA, 25 bp, Mus musculus
caaaggatatggttctgcgtcaggc

SEQ ID NO: 413074 - DNA, 25 bp, Mus musculus
tatggttctgcgtcaggctctcgag

SEQ ID NO: 413075 - DNA, 25 bp, Mus musculus
tccacgaggctttcgcattcgcagg

SEQ ID NO: 413076 - DNA, 25 bp, Mus musculus
ctcggtctcgcgtggctgctcagac

SEQ ID NO: 413077 - DNA, 25 bp, Mus musculus
tggctgctcagacagcgtgcgaccc

SEQ ID NO: 413078 - DNA, 25 bp, Mus musculus
agcgtgcgaccctcactttcggcta

SEQ ID NO: 413079 - DNA, 25 bp, Mus musculus
cggccctggaactccacgaggcttt

SEQ ID NO: 413080 - DNA, 25 bp, Mus musculus
cgaagcgcttcaccagctcgaagtt

SEQ ID NO: 413081 - DNA, 25 bp, Mus musculus
gtcaaggaaatccacaatctggttc

SEQ ID NO: 413082 - DNA, 25 bp, Mus musculus
tgctccaccatgtgacgcagggcca

SEQ ID NO: 413083 - DNA, 25 bp, Mus musculus
cctcgggagacacgtcaaggaaatc

SEQ ID NO: 413084 - DNA, 25 bp, Mus musculus
gcccaacacgtgtgccctcgggaga

SEQ ID NO: 413085 - DNA, 25 bp, Mus musculus
gagaactgcaccagcccaacacgtg

SEQ ID NO: 413086 - DNA, 25 bp, Mus musculus
tgcgcacccggctggagaactgcac

SEQ ID NO: 413087 - DNA, 25 bp, Mus musculus
gcttcacctcagctgcggtgccata

SEQ ID NO: 413088 - DNA, 25 bp, Mus musculus
tccatgtactccacggccaaaactg

SEQ ID NO: 413089 - DNA, 25 bp, Mus musculus
atggtgccgcgctccatgtactcca

SEQ ID NO: 413090 - DNA, 25 bp, Mus musculus
accagctcgaagttctgtgggcgca

SEQ ID NO: 413091 - DNA, 25 bp, Mus musculus
cctgcgcctcagagaagctgtgctc

SEQ ID NO: 413092 - DNA, 25 bp, Mus musculus
agagaagctgtgctccaccatgtga

SEQ ID NO: 413093 - DNA, 25 bp, Mus musculus
cacaatctggttcacgaagcgcttc

SEQ ID NO: 413094 - DNA, 25 bp, Mus musculus
tcggaagccacgcaaccctcggaag

SEQ ID NO: 413095 - DNA, 25 bp, Mus musculus
cctcggaagccacgcaaccctcgga

SEQ ID NO: 413096 - DNA, 25 bp, Mus musculus
ctgaagccacacaaccctcggaagc

SEQ ID NO: 413097 - DNA, 25 bp, Mus musculus
cggaagccacgcaaccctcggaagc

SEQ ID NO: 413098 - DNA, 25 bp, Mus musculus
tcggaagccacacaaccctcggaag

SEQ ID NO: 413099 - DNA, 25 bp, Mus musculus
tcggaagccacaccaccctcggaag

SEQ ID NO: 413100 - DNA, 25 bp, Mus musculus
cggaagccactccaccctcggaagc

SEQ ID NO: 413101 - DNA, 25 bp, Mus musculus
ctcggaagccacacaaccctcggaa

SEQ ID NO: 413102 - DNA, 25 bp, Mus musculus
tcggaagccacgcaacctcctgaag

SEQ ID NO: 413103 - DNA, 25 bp, Mus musculus
tcagaagccacacaacctccagaag

SEQ ID NO: 413104 - DNA, 25 bp, Mus musculus
cagaagccacgcaaccctcagaagc

SEQ ID NO: 413105 - DNA, 25 bp, Mus musculus
tcggaagccactccaccctcggaag

SEQ ID NO: 413106 - DNA, 25 bp, Mus musculus
cggaagccacaccaccctcggaagc

SEQ ID NO: 413107 - DNA, 25 bp, Mus musculus
gaagccacgcaacctgcggaagcca

SEQ ID NO: 413108 - DNA, 25 bp, Mus musculus
tgcagcagaaagcagcagcgagctc

SEQ ID NO: 413109 - DNA, 25 bp, Mus musculus
gctaggcctagggacaattctcttc

SEQ ID NO: 413110 - DNA, 25 bp, Mus musculus
acaagataaccggtcggagcacctc

SEQ ID NO: 413111 - DNA, 25 bp, Mus musculus
aattctcttcgtcagaccgccgggg

SEQ ID NO: 413112 - DNA, 25 bp, Mus musculus
ctcaattctgttcggcagcagcagc

SEQ ID NO: 413113 - DNA, 25 bp, Mus musculus
gggtcggccctaagctcaattctgt

SEQ ID NO: 413114 - DNA, 25 bp, Mus musculus
ttccatctcaagaaggagcgggcgg

SEQ ID NO: 413115 - DNA, 25 bp, Mus musculus
gccgcggctcagatgcacactaaaa

SEQ ID NO: 413116 - DNA, 25 bp, Mus musculus
cagaaactctggtagcggcagcaca

SEQ ID NO: 413117 - DNA, 25 bp, Mus musculus
cccggcccaggtagcagaaactctg

SEQ ID NO: 413118 - DNA, 25 bp, Mus musculus
aaggcggtgccctccatacccaaag

SEQ ID NO: 413119 - DNA, 25 bp, Mus musculus
gagcacctctgggaccggctccaga

SEQ ID NO: 413120 - DNA, 25 bp, Mus musculus
gcagcaacagcagggtaacaagata

SEQ ID NO: 413121 - DNA, 25 bp, Mus musculus
cagtctgagctcatccagttccatc

SEQ ID NO: 413122 - DNA, 25 bp, Mus musculus
agagagcccacgtcagctcgctgta

SEQ ID NO: 413123 - DNA, 25 bp, Mus musculus
ggtcgcccgtctgtcacgatgacca

SEQ ID NO: 413124 - DNA, 25 bp, Mus musculus
acttcggccactcggtcttgaggtc

SEQ ID NO: 413125 - DNA, 25 bp, Mus musculus
tctcaaactcgaaggggcgcacgct

SEQ ID NO: 413126 - DNA, 25 bp, Mus musculus
catagatctcaatgccgcgggcgcg

SEQ ID NO: 413127 - DNA, 25 bp, Mus musculus
aagccatggtgcgaagagagcccac

SEQ ID NO: 413128 - DNA, 25 bp, Mus musculus
acgatgaccaagacgcgcggcactc

SEQ ID NO: 413129 - DNA, 25 bp, Mus musculus
ttcggcctcgctgaaggccacgttc

SEQ ID NO: 413130 - DNA, 25 bp, Mus musculus
ggccacgttcatagcgtactggatc

SEQ ID NO: 413131 - DNA, 25 bp, Mus musculus
gttccatgtcctcgcggcgcgaaaa

SEQ ID NO: 413132 - DNA, 25 bp, Mus musculus
cccaggggaaagacgctctgcactt

SEQ ID NO: 413133 - DNA, 25 bp, Mus musculus
ctgcacttgactagaatactggatc

SEQ ID NO: 413134 - DNA, 25 bp, Mus musculus
aacgcgcgtggcgttcagacccacg

SEQ ID NO: 413135 - DNA, 25 bp, Mus musculus
ggaactgcctcatggtctcaaactc

SEQ ID NO: 413136 - DNA, 25 bp, Mus musculus
gggccctttgactcacctgagcctg

SEQ ID NO: 413137 - DNA, 25 bp, Mus musculus
tctggaatcctacacgagacacttc

SEQ ID NO: 413138 - DNA, 25 bp, Mus musculus
gcagccggaatgctctggaatccta

SEQ ID NO: 413139 - DNA, 25 bp, Mus musculus
cgacactccgggcagccggaatgct

SEQ ID NO: 413140 - DNA, 25 bp, Mus musculus
ccggaattgggctacagctggagtc

SEQ ID NO: 413141 - DNA, 25 bp, Mus musculus
cagctgcatttaacctggagcggga

SEQ ID NO: 413142 - DNA, 25 bp, Mus musculus
gagcccaagcggcagctgcatttaa

SEQ ID NO: 413143 - DNA, 25 bp, Mus musculus
ctaagtggggaatgccagacagcca

SEQ ID NO: 413144 - DNA, 25 bp, Mus musculus
caggttgccctaagtggggaatgcc

SEQ ID NO: 413145 - DNA, 25 bp, Mus musculus
cacgtaggctgttaagacttgtccc

SEQ ID NO: 413146 - DNA, 25 bp, Mus musculus
gacagctcagaggtgcggctacaga

SEQ ID NO: 413147 - DNA, 25 bp, Mus musculus
ttttacgctggcttccctgcagacc

SEQ ID NO: 413148 - DNA, 25 bp, Mus musculus
tacacgagacacttcccagaggaga

SEQ ID NO: 413149 - DNA, 25 bp, Mus musculus
ggctacagagcgacgggcccagcct

SEQ ID NO: 413150 - DNA, 25 bp, Mus musculus
agagcatccaccacgagttcacacg

SEQ ID NO: 413151 - DNA, 25 bp, Mus musculus
ccacaggagccctcgttccttggtg

SEQ ID NO: 413152 - DNA, 25 bp, Mus musculus
aggagccctcgttccttggtgtgcg

SEQ ID NO: 413153 - DNA, 25 bp, Mus musculus
cgtagtgccagacgtggcggccttc

SEQ ID NO: 413154 - DNA, 25 bp, Mus musculus
ccttggtgtgcgtagtgccagacgt

SEQ ID NO: 413155 - DNA, 25 bp, Mus musculus
ccttcggcagcgactggcgttggct

SEQ ID NO: 413156 - DNA, 25 bp, Mus musculus
gcagcgactggcgttggctccgcac

SEQ ID NO: 413157 - DNA, 25 bp, Mus musculus
atcaccgtgcccgtgagcttgctgc

SEQ ID NO: 413158 - DNA, 25 bp, Mus musculus
gctgcgcgcggatgcgctcttctac

SEQ ID NO: 413159 - DNA, 25 bp, Mus musculus
gaatacagcgcgctgccacggctgc

SEQ ID NO: 413160 - DNA, 25 bp, Mus musculus
ctgcccaacgcgcaagagcctgccc

SEQ ID NO: 413161 - DNA, 25 bp, Mus musculus
ccgacgcggacacgctcctggagag

SEQ ID NO: 413162 - DNA, 25 bp, Mus musculus
cggacacgctcctggagagcatcca

SEQ ID NO: 413163 - DNA, 25 bp, Mus musculus
tcctggagagcatccaccacgagtt

SEQ ID NO: 413164 - DNA, 25 bp, Mus musculus
gggcgcgcagcccttcttataggca

SEQ ID NO: 413165 - DNA, 25 bp, Mus musculus
caagctggaaaccactggggtggga

SEQ ID NO: 413166 - DNA, 25 bp, Mus musculus
gcttcaacagcgcaaaccagtggcc

SEQ ID NO: 413167 - DNA, 25 bp, Mus musculus
ttcaacagcgcaaaccagtggcccg

SEQ ID NO: 413168 - DNA, 25 bp, Mus musculus
tgggcaagctggaaaccactggggt

SEQ ID NO: 413169 - DNA, 25 bp, Mus musculus
gcccttcttataggcagcagccctg

SEQ ID NO: 413170 - DNA, 25 bp, Mus musculus
gcgcgcagcccttcttataggcagc

SEQ ID NO: 413171 - DNA, 25 bp, Mus musculus
ggcaggcgccatggcttcaacagcg

SEQ ID NO: 413172 - DNA, 25 bp, Mus musculus
cagcgcaaaccagtggcccggagcg

SEQ ID NO: 413173 - DNA, 25 bp, Mus musculus
acagcgcaaaccagtggcccggagc

SEQ ID NO: 413174 - DNA, 25 bp, Mus musculus
caacagcgcaaaccagtggcccgga

SEQ ID NO: 413175 - DNA, 25 bp, Mus musculus
caggcgccatggcttcaacagcgca

SEQ ID NO: 413176 - DNA, 25 bp, Mus musculus
ggacccgcccacagcgtgcctgccg

SEQ ID NO: 413177 - DNA, 25 bp, Mus musculus
gcgcagcccttcttataggcagcag

SEQ ID NO: 413178 - DNA, 25 bp, Mus musculus
cagttccgcagctacgtgtgggacc

SEQ ID NO: 413179 - DNA, 25 bp, Mus musculus
ggtgcccatctgtaaaacggaacga

SEQ ID NO: 413180 - DNA, 25 bp, Mus musculus
gcaagacccacggttttgtgcctca

SEQ ID NO: 413181 - DNA, 25 bp, Mus musculus
tgtgcctcatttccgtttgccttca

SEQ ID NO: 413182 - DNA, 25 bp, Mus musculus
tacgcatgtgcagagtttatttccg

SEQ ID NO: 413183 - DNA, 25 bp, Mus musculus
atggcgtgtagggttcatccactgc

SEQ ID NO: 413184 - DNA, 25 bp, Mus musculus
gggccgcagctattcggcctctcta

SEQ ID NO: 413185 - DNA, 25 bp, Mus musculus
tccgctccatggtcctgtctgtcag

SEQ ID NO: 413186 - DNA, 25 bp, Mus musculus
gacccgttgctaatcctgtcgcaga

SEQ ID NO: 413187 - DNA, 25 bp, Mus musculus
agaccgtctactatggctctctggg

SEQ ID NO: 413188 - DNA, 25 bp, Mus musculus
gcccgtccctggaccagatgttcga

SEQ ID NO: 413189 - DNA, 25 bp, Mus musculus
gggcaccgccgagctctaaatccgg

SEQ ID NO: 413190 - DNA, 25 bp, Mus musculus
ctgtcgcagatcgtactcatgcaga

SEQ ID NO: 413191 - DNA, 25 bp, Mus musculus
tccggctgggccaagttctcatttt

SEQ ID NO: 413192 - DNA, 25 bp, Mus musculus
agggaatccaaggtccatgcacttg

SEQ ID NO: 413193 - DNA, 25 bp, Mus musculus
ttcagcctggtaagaccacaacgtc

SEQ ID NO: 413194 - DNA, 25 bp, Mus musculus
tccttaggccagctgagggaatcca

SEQ ID NO: 413195 - DNA, 25 bp, Mus musculus
catgcacttgactcgctgggcagca

SEQ ID NO: 413196 - DNA, 25 bp, Mus musculus
ctctggagtcggagagcatcaagtg

SEQ ID NO: 413197 - DNA, 25 bp, Mus musculus
ccggcgtttagaggagctgtcctcc

SEQ ID NO: 413198 - DNA, 25 bp, Mus musculus
cagcacgggaacttggggtgccctc

SEQ ID NO: 413199 - DNA, 25 bp, Mus musculus
agggaattctttgcctcttgcctcc

SEQ ID NO: 413200 - DNA, 25 bp, Mus musculus
cagagggcgttcgttctccatttcc

SEQ ID NO: 413201 - DNA, 25 bp, Mus musculus
cccagtacctatggtcgtgtaaaca

SEQ ID NO: 413202 - DNA, 25 bp, Mus musculus
cgtgtaaacaactacctagctctgg

SEQ ID NO: 413203 - DNA, 25 bp, Mus musculus
cttctggagaagtgtgcgcgtaacc

SEQ ID NO: 413204 - DNA, 25 bp, Mus musculus
tgtggacagtcccttcagcctggta

SEQ ID NO: 413205 - DNA, 25 bp, Mus musculus
cctagctctgggaattggctccgca

SEQ ID NO: 413206 - DNA, 25 bp, Mus musculus
ctgcgctgttttggcgtcctggtaa

SEQ ID NO: 413207 - DNA, 25 bp, Mus musculus
gctttcagaacgaggccacgaatta

SEQ ID NO: 413208 - DNA, 25 bp, Mus musculus
cgccgcagtgctcaatccattgggt

SEQ ID NO: 413209 - DNA, 25 bp, Mus musculus
ctcgtcagcacaggattgggctttc

SEQ ID NO: 413210 - DNA, 25 bp, Mus musculus
ccgacgctctgccaacatttatata

SEQ ID NO: 413211 - DNA, 25 bp, Mus musculus
gtacgccggtatccaggacgcaatg

SEQ ID NO: 413212 - DNA, 25 bp, Mus musculus
taccggtggcttcgttgtagtacac

SEQ ID NO: 413213 - DNA, 25 bp, Mus musculus
gctcgtcgctgattacctcccagaa

SEQ ID NO: 413214 - DNA, 25 bp, Mus musculus
cactccgagagcctgacactattgg

SEQ ID NO: 413215 - DNA, 25 bp, Mus musculus
tgccagtgggatcaatgccatgctc

SEQ ID NO: 413216 - DNA, 25 bp, Mus musculus
aggtcgctatctccgtggtaagtgc

SEQ ID NO: 413217 - DNA, 25 bp, Mus musculus
agtacacgttgatgcgctccagctg

SEQ ID NO: 413218 - DNA, 25 bp, Mus musculus
tggggcccgccttcccaacaatata

SEQ ID NO: 413219 - DNA, 25 bp, Mus musculus
tattggtcacgcttgcctacggctc

SEQ ID NO: 413220 - DNA, 25 bp, Mus musculus
cttcaggccaggtcggcaaaatcca

SEQ ID NO: 413221 - DNA, 25 bp, Mus musculus
ggtcggcaaaatccacgatctgttg

SEQ ID NO: 413222 - DNA, 25 bp, Mus musculus
tccacgatctgttgacggacctccg

SEQ ID NO: 413223 - DNA, 25 bp, Mus musculus
tctgttgacggacctccgtgtccct

SEQ ID NO: 413224 - DNA, 25 bp, Mus musculus
aggtatggcggctgccatgccgctc

SEQ ID NO: 413225 - DNA, 25 bp, Mus musculus
ttccgcacgcgttgggattcggatc

SEQ ID NO: 413226 - DNA, 25 bp, Mus musculus
atgccgctcggtttgccgttgcggt

SEQ ID NO: 413227 - DNA, 25 bp, Mus musculus
cgttgcggttactggtgctgttgct

SEQ ID NO: 413228 - DNA, 25 bp, Mus musculus
gcccacgcgacagcctgcgagaaga

SEQ ID NO: 413229 - DNA, 25 bp, Mus musculus
cagcctgcgagaagagctcgttatc

SEQ ID NO: 413230 - DNA, 25 bp, Mus musculus
gagctcgttatcactccactgcctt

SEQ ID NO: 413231 - DNA, 25 bp, Mus musculus
cacattccagttccgcacgcgttgg

SEQ ID NO: 413232 - DNA, 25 bp, Mus musculus
cttcctattggatgaccgcctttgg

SEQ ID NO: 413233 - DNA, 25 bp, Mus musculus
gacggcgccggaagtcctctctcat

SEQ ID NO: 413234 - DNA, 25 bp, Mus musculus
tggtgtaccccctctctagtccggc

SEQ ID NO: 413235 - DNA, 25 bp, Mus musculus
tgtgagcccgtggtgtaccccctct

SEQ ID NO: 413236 - DNA, 25 bp, Mus musculus
tctagtcctgtgagcccgtggtgta

SEQ ID NO: 413237 - DNA, 25 bp, Mus musculus
tctctagtcctgtgagcccgtggtg

SEQ ID NO: 413238 - DNA, 25 bp, Mus musculus
gtggtgtaccccctctctagtcctg

SEQ ID NO: 413239 - DNA, 25 bp, Mus musculus
tctagtccggcgtgcccgtggtgta

SEQ ID NO: 413240 - DNA, 25 bp, Mus musculus
ctctagtccggcgagcccgtggtgt

SEQ ID NO: 413241 - DNA, 25 bp, Mus musculus
ctagtcctgtgagcccgtggtgtac

SEQ ID NO: 413242 - DNA, 25 bp, Mus musculus
ctctagtcctgtgagcccgtggtgt

SEQ ID NO: 413243 - DNA, 25 bp, Mus musculus
cctctctagtcctgtgagcccgtgg

SEQ ID NO: 413244 - DNA, 25 bp, Mus musculus
tggtgtaccccctctctagtcctgt

SEQ ID NO: 413245 - DNA, 25 bp, Mus musculus
ctagtccggcgtgcccgtggtgtac

SEQ ID NO: 413246 - DNA, 25 bp, Mus musculus
ctctagtccggcgtgcccgtggtgt

SEQ ID NO: 413247 - DNA, 25 bp, Mus musculus
ctagtccggcgagcccgtggtgtgc

SEQ ID NO: 413248 - DNA, 25 bp, Mus musculus
cgaacctttcacatcgaagagccca

SEQ ID NO: 413249 - DNA, 25 bp, Mus musculus
gccgtgtgctatggctccttctaca

SEQ ID NO: 413250 - DNA, 25 bp, Mus musculus
gtgtgctatggctccttctacaatc

SEQ ID NO: 413251 - DNA, 25 bp, Mus musculus
gtgctatggctccttctacaatctc

SEQ ID NO: 413252 - DNA, 25 bp, Mus musculus
tatggctccttctacaatctcctca

SEQ ID NO: 413253 - DNA, 25 bp, Mus musculus
ctggccaagcggctggctaacctca

SEQ ID NO: 413254 - DNA, 25 bp, Mus musculus
acccgaacctttcacatcgaagagc

SEQ ID NO: 413255 - DNA, 25 bp, Mus musculus
ggccgtgtgctatggctccttctac

SEQ ID NO: 413256 - DNA, 25 bp, Mus musculus
cctttcacatcgaagagcccaagtc

SEQ ID NO: 413257 - DNA, 25 bp, Mus musculus
agcccaagtcgggcggcctggccaa

SEQ ID NO: 413258 - DNA, 25 bp, Mus musculus
acctcatccgccgtgcccgtggtgt

SEQ ID NO: 413259 - DNA, 25 bp, Mus musculus
ggctggctaacctcatccgccgtgc

SEQ ID NO: 413260 - DNA, 25 bp, Mus musculus
ggccaagcggctggctaacctcatc

SEQ ID NO: 413261 - DNA, 25 bp, Mus musculus
tcacccgaacctttcacatcgaaga

SEQ ID NO: 413262 - DNA, 25 bp, Mus musculus
gcggcagttcggttcccatagcaac

SEQ ID NO: 413263 - DNA, 25 bp, Mus musculus
aagtgtatgctctgctgccctcaca

SEQ ID NO: 413264 - DNA, 25 bp, Mus musculus
tcacaccgccctcgtcccttgactg

SEQ ID NO: 413265 - DNA, 25 bp, Mus musculus
cccgctgaagtgtatgctctgctgc

SEQ ID NO: 413266 - DNA, 25 bp, Mus musculus
ggctgagtcgagctgaggttgttgt

SEQ ID NO: 413267 - DNA, 25 bp, Mus musculus
cgccgctttccggtggctgagtcga

SEQ ID NO: 413268 - DNA, 25 bp, Mus musculus
ggcagttcggttcccatagcaaccc

SEQ ID NO: 413269 - DNA, 25 bp, Mus musculus
cagccgttgtctcccaggggtctgg

SEQ ID NO: 413270 - DNA, 25 bp, Mus musculus
ctaggcggcagttcggttcccatag

SEQ ID NO: 413271 - DNA, 25 bp, Mus musculus
ccaaagacgaggtggctcctaggcg

SEQ ID NO: 413272 - DNA, 25 bp, Mus musculus
cccgacaccaaagacgaggtggctc

SEQ ID NO: 413273 - DNA, 25 bp, Mus musculus
ggtctggaagcctcaacgtcgtccc

SEQ ID NO: 413274 - DNA, 25 bp, Mus musculus
gtcccttgactgaatggcccccgaa

SEQ ID NO: 413275 - DNA, 25 bp, Mus musculus
gtcacggcgccgctttccggtggct

SEQ ID NO: 413276 - DNA, 25 bp, Mus musculus
tacgcgcagactggggaaattgatg

SEQ ID NO: 413277 - DNA, 25 bp, Mus musculus
tgagggatactttcttcgaggagga

SEQ ID NO: 413278 - DNA, 25 bp, Mus musculus
gatggacgagatgagggatactttc

SEQ ID NO: 413279 - DNA, 25 bp, Mus musculus
tctcagaacgagatcgatgagctga

SEQ ID NO: 413280 - DNA, 25 bp, Mus musculus
ctccgcaaagccgagcgcaaaaggc

SEQ ID NO: 413281 - DNA, 25 bp, Mus musculus
ccgctacgcgcagactggggaaatt

SEQ ID NO: 413282 - DNA, 25 bp, Mus musculus
aactgccggattctgcagtaccgcc

SEQ ID NO: 413283 - DNA, 25 bp, Mus musculus
gcgagccaacaaaaactgccggatt

SEQ ID NO: 413284 - DNA, 25 bp, Mus musculus
cgccatgagttggagcgagccaaca

SEQ ID NO: 413285 - DNA, 25 bp, Mus musculus
caggaaatgcgccatgagttggagc

SEQ ID NO: 413286 - DNA, 25 bp, Mus musculus
gtcaactgcaggaaatgcgccatga

SEQ ID NO: 413287 - DNA, 25 bp, Mus musculus
ttcgaggaggatgcctgtcaactgc

SEQ ID NO: 413288 - DNA, 25 bp, Mus musculus
actttcttcgaggaggatgcctgtc

SEQ ID NO: 413289 - DNA, 25 bp, Mus musculus
agcgcaaaaggctccgctacgcgca

SEQ ID NO: 413290 - DNA, 25 bp, Mus musculus
gtcggcgtcgtccaaaggccaccaa

SEQ ID NO: 413291 - DNA, 25 bp, Mus musculus
tccgccaccgattcgttagttaatg

SEQ ID NO: 413292 - DNA, 25 bp, Mus musculus
atggcagctttcttcaccaattggc

SEQ ID NO: 413293 - DNA, 25 bp, Mus musculus
caccaattggctagctgaggcacgc

SEQ ID NO: 413294 - DNA, 25 bp, Mus musculus
gccgtccaatcgtggcgcgttactg

SEQ ID NO: 413295 - DNA, 25 bp, Mus musculus
gcgaatacacgtggaccggtccttg

SEQ ID NO: 413296 - DNA, 25 bp, Mus musculus
gggcgtcccattggctggatcaaac

SEQ ID NO: 413297 - DNA, 25 bp, Mus musculus
ctggatcaaacctaagcgagccttt

SEQ ID NO: 413298 - DNA, 25 bp, Mus musculus
cgagcctttgattggctagcgcagc

SEQ ID NO: 413299 - DNA, 25 bp, Mus musculus
gcagcgggagggttgcaattcaaac

SEQ ID NO: 413300 - DNA, 25 bp, Mus musculus
tgtctcggtgccagtacctctggga

SEQ ID NO: 413301 - DNA, 25 bp, Mus musculus
ctgggatggcctcacaaaaccgcga

SEQ ID NO: 413302 - DNA, 25 bp, Mus musculus
ttgccgcggttcgaaaaggagccga

SEQ ID NO: 413303 - DNA, 25 bp, Mus musculus
ttactggggaggacctagcagttgc

SEQ ID NO: 413304 - DNA, 25 bp, Mus musculus
tgcctgggcggagagcctcttaaat

SEQ ID NO: 413305 - DNA, 25 bp, Mus musculus
tcgccgccctcaggagacggggcat

SEQ ID NO: 413306 - DNA, 25 bp, Mus musculus
ggccaccacgatccggctgggtttc

SEQ ID NO: 413307 - DNA, 25 bp, Mus musculus
tgggattctaacagctccgggagag

SEQ ID NO: 413308 - DNA, 25 bp, Mus musculus
ggagagcctcttaaatccgccaggc

SEQ ID NO: 413309 - DNA, 25 bp, Mus musculus
aggctgctgcaccaaatcccgggag

SEQ ID NO: 413310 - DNA, 25 bp, Mus musculus
gggtgccatggcctcgcggctccta

SEQ ID NO: 413311 - DNA, 25 bp, Mus musculus
gcccagaggccgagcagttccctga

SEQ ID NO: 413312 - DNA, 25 bp, Mus musculus
gcagttccctgagagctcagagctg

SEQ ID NO: 413313 - DNA, 25 bp, Mus musculus
ctcagagctggaggacgatgacgcc

SEQ ID NO: 413314 - DNA, 25 bp, Mus musculus
acgatgacgccgagggcctgtcctc

SEQ ID NO: 413315 - DNA, 25 bp, Mus musculus
agtggcaccctcagcttcactagtg

SEQ ID NO: 413316 - DNA, 25 bp, Mus musculus
tcactagtgcggaggatgaccctga

SEQ ID NO: 413317 - DNA, 25 bp, Mus musculus
cagcggcttgggattctaacagctc

SEQ ID NO: 413318 - DNA, 25 bp, Mus musculus
tgcttgtcaatttcagagtgggcgc

SEQ ID NO: 413319 - DNA, 25 bp, Mus musculus
attgtgattggtcgatgtgcttgtc

SEQ ID NO: 413320 - DNA, 25 bp, Mus musculus
ctcgtgaccagcacactacggaggt

SEQ ID NO: 413321 - DNA, 25 bp, Mus musculus
tcgaggttgagcacgctcgtgacca

SEQ ID NO: 413322 - DNA, 25 bp, Mus musculus
gagatcttcatctagcggctcgagg

SEQ ID NO: 413323 - DNA, 25 bp, Mus musculus
ctaccggctacctgtagagatcttc

SEQ ID NO: 413324 - DNA, 25 bp, Mus musculus
ctatactgaaagaggggtgcgagcc

SEQ ID NO: 413325 - DNA, 25 bp, Mus musculus
agcgagacgcagattgtgattggtc

SEQ ID NO: 413326 - DNA, 25 bp, Mus musculus
ggcgtcgccatgagcatctcccaga

SEQ ID NO: 413327 - DNA, 25 bp, Mus musculus
tatataggctcccagcgcttccgga

SEQ ID NO: 413328 - DNA, 25 bp, Mus musculus
acgcggaaacttatataggctccca

SEQ ID NO: 413329 - DNA, 25 bp, Mus musculus
ctgcggttgagagaaacgcggaaac

SEQ ID NO: 413330 - DNA, 25 bp, Mus musculus
gaccctctggcgctgacattttcac

SEQ ID NO: 413331 - DNA, 25 bp, Mus musculus
tgcgagcctagttcagaggcgctac

SEQ ID NO: 413332 - DNA, 25 bp, Mus musculus
ggcttgaacacgaacctcagccttc

SEQ ID NO: 413333 - DNA, 25 bp, Mus musculus
cgctgggcttgaacacgaacctcag

SEQ ID NO: 413334 - DNA, 25 bp, Mus musculus
ctccgctgggcttgaacacgaacct

SEQ ID NO: 413335 - DNA, 25 bp, Mus musculus
atttcggctccgctgggcttgaaca

SEQ ID NO: 413336 - DNA, 25 bp, Mus musculus
accagtggaaggtggatttcggctc

SEQ ID NO: 413337 - DNA, 25 bp, Mus musculus
agtgcattcagcttccaccagtgga

SEQ ID NO: 413338 - DNA, 25 bp, Mus musculus
attggcgaggctggacgtcagtcag

SEQ ID NO: 413339 - DNA, 25 bp, Mus musculus
gcgactagtgcattcagcttccacc

SEQ ID NO: 413340 - DNA, 25 bp, Mus musculus
cgggtctcagcgactagtgcattca

SEQ ID NO: 413341 - DNA, 25 bp, Mus musculus
gtgaagccgggtctcagcgactagt

SEQ ID NO: 413342 - DNA, 25 bp, Mus musculus
ctgccgcgtctgccggtgcgcgaat

SEQ ID NO: 413343 - DNA, 25 bp, Mus musculus
gcccagtgggaggaatggctgccgc

SEQ ID NO: 413344 - DNA, 25 bp, Mus musculus
cttccaccagtggaaggtggatttc

SEQ ID NO: 413345 - DNA, 25 bp, Mus musculus
ctcagcgactagtgcattcagcttc

SEQ ID NO: 413346 - DNA, 25 bp, Mus musculus
agcggtcaggccaagacgtaagtgc

SEQ ID NO: 413347 - DNA, 25 bp, Mus musculus
gcgtgtgatagcgaagacccaactg

SEQ ID NO: 413348 - DNA, 25 bp, Mus musculus
tccatgcggatgttggctccatgca

SEQ ID NO: 413349 - DNA, 25 bp, Mus musculus
gcgaaactctccacgcgtgtggctc

SEQ ID NO: 413350 - DNA, 25 bp, Mus musculus
agcacacaccgtgggcgaaactctc

SEQ ID NO: 413351 - DNA, 25 bp, Mus musculus
caggggctcacgactgaagcacaca

SEQ ID NO: 413352 - DNA, 25 bp, Mus musculus
agcccagctctttttcctcaatttc

SEQ ID NO: 413353 - DNA, 25 bp, Mus musculus
cccaactgtggccaaggctgaccaa

SEQ ID NO: 413354 - DNA, 25 bp, Mus musculus
cccgttgatgatgatgtgcatgtcg

SEQ ID NO: 413355 - DNA, 25 bp, Mus musculus
gctgcctccgcttctggttgacctt

SEQ ID NO: 413356 - DNA, 25 bp, Mus musculus
ctcgatgcgcagatagggttcaacc

SEQ ID NO: 413357 - DNA, 25 bp, Mus musculus
aggcagcacgttttgttcatagagc

SEQ ID NO: 413358 - DNA, 25 bp, Mus musculus
gcagaagagaacacccaagcggctt

SEQ ID NO: 413359 - DNA, 25 bp, Mus musculus
tgaaaactcgggtacagcggccaga

SEQ ID NO: 413360 - DNA, 25 bp, Mus musculus
tgctcctgtcctgggcgtcccggaa

SEQ ID NO: 413361 - DNA, 25 bp, Mus musculus
atactccggctacctcagagcatcg

SEQ ID NO: 413362 - DNA, 25 bp, Mus musculus
gcaatactccggctacctcagagca

SEQ ID NO: 413363 - DNA, 25 bp, Mus musculus
aagcagccctctttccggcaatact

SEQ ID NO: 413364 - DNA, 25 bp, Mus musculus
gaccaggatgaaatcgattgtctcc

SEQ ID NO: 413365 - DNA, 25 bp, Mus musculus
ggcgtcccggaacgaagcagctccg

SEQ ID NO: 413366 - DNA, 25 bp, Mus musculus
tcccggagatgtgcgccatcgtctc

SEQ ID NO: 413367 - DNA, 25 bp, Mus musculus
actgctcttgttgctgctcctgtcc

SEQ ID NO: 413368 - DNA, 25 bp, Mus musculus
gtctccactgctcttgttgctgctc

SEQ ID NO: 413369 - DNA, 25 bp, Mus musculus
gcagatgcccggaaccgcgctgtct

SEQ ID NO: 413370 - DNA, 25 bp, Mus musculus
tccaccgatgcttcctcctgcagat

SEQ ID NO: 413371 - DNA, 25 bp, Mus musculus
gtaaacaaacatcctccaccgatgc

SEQ ID NO: 413372 - DNA, 25 bp, Mus musculus
gcttctcccggagatgtgcgccatc

SEQ ID NO: 413373 - DNA, 25 bp, Mus musculus
aacgaagcagctccggaccaggatg

SEQ ID NO: 413374 - DNA, 25 bp, Mus musculus
cgcgggtccagcagcctttataagt

SEQ ID NO: 413375 - DNA, 25 bp, Mus musculus
gagccacacaactcacgagggtctg

SEQ ID NO: 413376 - DNA, 25 bp, Mus musculus
ccacctggatttagtgagccacaca

SEQ ID NO: 413377 - DNA, 25 bp, Mus musculus
actccgctataacgcattctgtctg

SEQ ID NO: 413378 - DNA, 25 bp, Mus musculus
tcctgctgagtagcttgaggtctcc

SEQ ID NO: 413379 - DNA, 25 bp, Mus musculus
ggcgacgaccacaagcgcattcctg

SEQ ID NO: 413380 - DNA, 25 bp, Mus musculus
ctgacttgtgcgttggtatggcgac

SEQ ID NO: 413381 - DNA, 25 bp, Mus musculus
ctgcctcgtgacaagtttggatctc

SEQ ID NO: 413382 - DNA, 25 bp, Mus musculus
cacgataagacttgcgccctgcttc

SEQ ID NO: 413383 - DNA, 25 bp, Mus musculus
accgaggttccgaagcacgataaga

SEQ ID NO: 413384 - DNA, 25 bp, Mus musculus
ggggcactcggaaccaatcatcttg

SEQ ID NO: 413385 - DNA, 25 bp, Mus musculus
ttggtcatgcaactagaacggagtg

SEQ ID NO: 413386 - DNA, 25 bp, Mus musculus
cgcaggtgtcatctgagaggctcaa

SEQ ID NO: 413387 - DNA, 25 bp, Mus musculus
gcctttataagtctgggcctccgac

SEQ ID NO: 413388 - DNA, 25 bp, Mus musculus
aggaccgggtttggactgatccttg

SEQ ID NO: 413389 - DNA, 25 bp, Mus musculus
cttattctcctacggggcgtggctt

SEQ ID NO: 413390 - DNA, 25 bp, Mus musculus
tcctacggggcgtggcttcgtttca

SEQ ID NO: 413391 - DNA, 25 bp, Mus musculus
ctcagctcagaacggccgtggagtt

SEQ ID NO: 413392 - DNA, 25 bp, Mus musculus
accgctcagctcagaacggccgtgg

SEQ ID NO: 413393 - DNA, 25 bp, Mus musculus
cgggtttggactgatccttggctca

SEQ ID NO: 413394 - DNA, 25 bp, Mus musculus
agaagcctccgcgctcctgggtttc

SEQ ID NO: 413395 - DNA, 25 bp, Mus musculus
ggtgctcagtggaaacttaattccc

SEQ ID NO: 413396 - DNA, 25 bp, Mus musculus
gccgaggtgctcagtggaaacttaa

SEQ ID NO: 413397 - DNA, 25 bp, Mus musculus
gtaaaccaggccgaggtgctcagtg

SEQ ID NO: 413398 - DNA, 25 bp, Mus musculus
atgcgtaaaccaggccgaggtgctc

SEQ ID NO: 413399 - DNA, 25 bp, Mus musculus
cgggagcatgcgtaaaccaggccga

SEQ ID NO: 413400 - DNA, 25 bp, Mus musculus
ccctagccgggagcatgcgtaaacc

SEQ ID NO: 413401 - DNA, 25 bp, Mus musculus
ggactgatccttggctcacaccgct

SEQ ID NO: 413402 - DNA, 25 bp, Mus musculus
ccttcagaggcggtaccgacgcatg

SEQ ID NO: 413403 - DNA, 25 bp, Mus musculus
tctggtatgtgatcccgcccatgtt

SEQ ID NO: 413404 - DNA, 25 bp, Mus musculus
ctgcttgcgcagatacagttgtttg

SEQ ID NO: 413405 - DNA, 25 bp, Mus musculus
tttctagtccgagttccgctgcttg

SEQ ID NO: 413406 - DNA, 25 bp, Mus musculus
ccggaatcggatgcattttctagtc

SEQ ID NO: 413407 - DNA, 25 bp, Mus musculus
atgttcctccaatcccggaatcgga

SEQ ID NO: 413408 - DNA, 25 bp, Mus musculus
gggcgttatgattggtactctggta

SEQ ID NO: 413409 - DNA, 25 bp, Mus musculus
gtcgggctccgactcagagtcgcct

SEQ ID NO: 413410 - DNA, 25 bp, Mus musculus
ggcctctagggtcccttcgctgctg

SEQ ID NO: 413411 - DNA, 25 bp, Mus musculus
ggtctctttcgtcgccgccatctta

SEQ ID NO: 413412 - DNA, 25 bp, Mus musculus
caaaacgggcggtcgagcagaacgt

SEQ ID NO: 413413 - DNA, 25 bp, Mus musculus
ttgtctctagactacgctgcgcttc

SEQ ID NO: 413414 - DNA, 25 bp, Mus musculus
ctgcgcttctccgactttggtatgc

SEQ ID NO: 413415 - DNA, 25 bp, Mus musculus
cgagcagaacgtgtggccgcatccc

SEQ ID NO: 413416 - DNA, 25 bp, Mus musculus
agaagtcacatgctgcccggtgtta

SEQ ID NO: 413417 - DNA, 25 bp, Mus musculus
tgctcctcccagaggcatgaatcga

SEQ ID NO: 413418 - DNA, 25 bp, Mus musculus
cgtcgggtccaggaggactctagaa

SEQ ID NO: 413419 - DNA, 25 bp, Mus musculus
atctgcggggtttcagaaggcctct

SEQ ID NO: 413420 - DNA, 25 bp, Mus musculus
tccgactccggcatcgacgaggtcg

SEQ ID NO: 413421 - DNA, 25 bp, Mus musculus
catgaatcgaccctgggcggacaca

SEQ ID NO: 413422 - DNA, 25 bp, Mus musculus
ggtttccgctcaggcaaatgcgaga

SEQ ID NO: 413423 - DNA, 25 bp, Mus musculus
ttccagaaaagaatagggacgcctg

SEQ ID NO: 413424 - DNA, 25 bp, Mus musculus
tgcaaagactgagcatcggactaga

SEQ ID NO: 413425 - DNA, 25 bp, Mus musculus
ccggtgtgcccattctgcagatgca

SEQ ID NO: 413426 - DNA, 25 bp, Mus musculus
ccatggttgcaacaagtggtccacc

SEQ ID NO: 413427 - DNA, 25 bp, Mus musculus
tttcactctgctgggcgatacgacc

SEQ ID NO: 413428 - DNA, 25 bp, Mus musculus
cctccattggttctggggaccgact

SEQ ID NO: 413429 - DNA, 25 bp, Mus musculus
cctctcaggctaggaccctttggga

SEQ ID NO: 413430 - DNA, 25 bp, Mus musculus
tccgtgagtcaggtacagttctgcc

SEQ ID NO: 413431 - DNA, 25 bp, Mus musculus
ggccctggcccaagagcttctcaga

SEQ ID NO: 413432 - DNA, 25 bp, Mus musculus
tacaagtacaagtccagcggccatg

SEQ ID NO: 413433 - DNA, 25 bp, Mus musculus
gcgcgcctgcagatcaatgagctga

SEQ ID NO: 413434 - DNA, 25 bp, Mus musculus
gaaccgcgtgctcatgtccaacatg

SEQ ID NO: 413435 - DNA, 25 bp, Mus musculus
agtccttatcggagctgcgacagca

SEQ ID NO: 413436 - DNA, 25 bp, Mus musculus
tctacgtggctaatggggacctgtt

SEQ ID NO: 413437 - DNA, 25 bp, Mus musculus
tcgtatccgagaacacgagctgctc

SEQ ID NO: 413438 - DNA, 25 bp, Mus musculus
atcaacgcgcagatgaaggccttcc

SEQ ID NO: 413439 - DNA, 25 bp, Mus musculus
ctgcggagctcaacaagtacaagta

SEQ ID NO: 413440 - DNA, 25 bp, Mus musculus
gcagaggagcccatatccgtgagtc

SEQ ID NO: 413441 - DNA, 25 bp, Mus musculus
tggcctcacacctgggtatccgtgg

SEQ ID NO: 413442 - DNA, 25 bp, Mus musculus
gtgcccaaatctgcggatgaccgag

SEQ ID NO: 413443 - DNA, 25 bp, Mus musculus
gggcaagaccatcgatcggctcatc

SEQ ID NO: 413444 - DNA, 25 bp, Mus musculus
acagcagatctgtccgctcttatgc

SEQ ID NO: 413445 - DNA, 25 bp, Mus musculus
tccctagtcgctgcttccacaaatg

SEQ ID NO: 413446 - DNA, 25 bp, Mus musculus
gctttggagtcgcagtcacctcttc

SEQ ID NO: 413447 - DNA, 25 bp, Mus musculus
ttctcaaagtctggtgcgctgctca

SEQ ID NO: 413448 - DNA, 25 bp, Mus musculus
ctcagcgggagacacagtcgctttc

SEQ ID NO: 413449 - DNA, 25 bp, Mus musculus
gtacggacccgaagcggacattgtc

SEQ ID NO: 413450 - DNA, 25 bp, Mus musculus
ggagatgcccatttcgacgacgacg

SEQ ID NO: 413451 - DNA, 25 bp, Mus musculus
tttgtaatccgtgcatgcccgatcc

SEQ ID NO: 413452 - DNA, 25 bp, Mus musculus
agacgggtatcccttcgacggcaag

SEQ ID NO: 413453 - DNA, 25 bp, Mus musculus
gtcgctttcagtctcttgcccttaa

SEQ ID NO: 413454 - DNA, 25 bp, Mus musculus
gcgagacatgatcgatgacgccttc

SEQ ID NO: 413455 - DNA, 25 bp, Mus musculus
ctctgaagacttgccgcgagacatg

SEQ ID NO: 413456 - DNA, 25 bp, Mus musculus
gattgagtcccttcctctccgatgg

SEQ ID NO: 413457 - DNA, 25 bp, Mus musculus
cgacgctggcttttcacctccagga

SEQ ID NO: 413458 - DNA, 25 bp, Mus musculus
cttgaagtctcagaaggtggatccc

SEQ ID NO: 413459 - DNA, 25 bp, Mus musculus
tcccgcgtcgtctcgggaaggctct

SEQ ID NO: 413460 - DNA, 25 bp, Mus musculus
aaggctctgctgttcagcaaggggc

SEQ ID NO: 413461 - DNA, 25 bp, Mus musculus
ctgctgttcagcaaggggcgtgtct

SEQ ID NO: 413462 - DNA, 25 bp, Mus musculus
gaggtaagagcgaccgaggccacca

SEQ ID NO: 413463 - DNA, 25 bp, Mus musculus
agccctagcgccactctcccgcagc

SEQ ID NO: 413464 - DNA, 25 bp, Mus musculus
agcgggagaggctcatcgcttgtcc

SEQ ID NO: 413465 - DNA, 25 bp, Mus musculus
ggagaggctcatcgcttgtccacct

SEQ ID NO: 413466 - DNA, 25 bp, Mus musculus
ggcttctcccgcgtcgtctcgggaa

SEQ ID NO: 413467 - DNA, 25 bp, Mus musculus
tgcagattcgacttgaagtctcaga

SEQ ID NO: 413468 - DNA, 25 bp, Mus musculus
ggtggatccccagagcgtcattcgc

SEQ ID NO: 413469 - DNA, 25 bp, Mus musculus
agaggctcatcgcttgtccaccttc

SEQ ID NO: 413470 - DNA, 25 bp, Mus musculus
caccttcctgcagattcgacttgaa

SEQ ID NO: 413471 - DNA, 25 bp, Mus musculus
tcctgcagattcgacttgaagtctc

SEQ ID NO: 413472 - DNA, 25 bp, Mus musculus
tgagccgcaggttcacggtcacctc

SEQ ID NO: 413473 - DNA, 25 bp, Mus musculus
aagctcttggcgctccagcagcccg

SEQ ID NO: 413474 - DNA, 25 bp, Mus musculus
cggggaagctcttggcgctccagca

SEQ ID NO: 413475 - DNA, 25 bp, Mus musculus
tcttggcgctccagcagcccggctg

SEQ ID NO: 413476 - DNA, 25 bp, Mus musculus
ggctgcggccacttgtgcgatcccg

SEQ ID NO: 413477 - DNA, 25 bp, Mus musculus
ggccacttgtgcgatcccgccgccc

SEQ ID NO: 413478 - DNA, 25 bp, Mus musculus
gccatgagccgcaggttcacggtca

SEQ ID NO: 413479 - DNA, 25 bp, Mus musculus
atgagccgcaggttcacggtcacct

SEQ ID NO: 413480 - DNA, 25 bp, Mus musculus
gtcccgccggcattcggtggccgat

SEQ ID NO: 413481 - DNA, 25 bp, Mus musculus
gagccgcaggttcacggtcacctcg

SEQ ID NO: 413482 - DNA, 25 bp, Mus musculus
caggttcacggtcacctcgctgccc

SEQ ID NO: 413483 - DNA, 25 bp, Mus musculus
ctgacccagagtcccgccggcattc

SEQ ID NO: 413484 - DNA, 25 bp, Mus musculus
agtcccgccggcattcggtggccga

SEQ ID NO: 413485 - DNA, 25 bp, Mus musculus
catgagccgcaggttcacggtcacc

SEQ ID NO: 413486 - DNA, 25 bp, Mus musculus
cgcgacctagttccctgccgttatt

SEQ ID NO: 413487 - DNA, 25 bp, Mus musculus
aatagctagaacagggctgacgtgc

SEQ ID NO: 413488 - DNA, 25 bp, Mus musculus
ggggcagacttggattagctaaacc

SEQ ID NO: 413489 - DNA, 25 bp, Mus musculus
cgcgctccgaggcagattcggaact

SEQ ID NO: 413490 - DNA, 25 bp, Mus musculus
tgtccacggttctggaatgcgccgc

SEQ ID NO: 413491 - DNA, 25 bp, Mus musculus
ctccattggaatgcgctaggcgctg

SEQ ID NO: 413492 - DNA, 25 bp, Mus musculus
ctgcagggaggctagctccattgga

SEQ ID NO: 413493 - DNA, 25 bp, Mus musculus
ggggccgcctcctgcagagaacagc

SEQ ID NO: 413494 - DNA, 25 bp, Mus musculus
tgctcaacaacctgacggactgcga

SEQ ID NO: 413495 - DNA, 25 bp, Mus musculus
gcagcttcttcctccgtggagcgga

SEQ ID NO: 413496 - DNA, 25 bp, Mus musculus
tcctgcatacgggatgaggtgagca

SEQ ID NO: 413497 - DNA, 25 bp, Mus musculus
agtggctcacgcctcctgcatacgg

SEQ ID NO: 413498 - DNA, 25 bp, Mus musculus
ctccaaagaaaacccgccagtggct

SEQ ID NO: 413499 - DNA, 25 bp, Mus musculus
ctgacgtgctgttcgacgtgcagga

SEQ ID NO: 413500 - DNA, 25 bp, Mus musculus
agtgcctgctgtctgcgctcagcgc

SEQ ID NO: 413501 - DNA, 25 bp, Mus musculus
atctccagtgcctgctgtctgcgct

SEQ ID NO: 413502 - DNA, 25 bp, Mus musculus
gcgcatctccagtgcctgctgtctg

SEQ ID NO: 413503 - DNA, 25 bp, Mus musculus
actagcgcatctccagtgcctgctg

SEQ ID NO: 413504 - DNA, 25 bp, Mus musculus
agcggtctcagccatccatcacggc

SEQ ID NO: 413505 - DNA, 25 bp, Mus musculus
gctccgaggtcttggggccagccac

SEQ ID NO: 413506 - DNA, 25 bp, Mus musculus
gggtgcaaagacttgccaggagcta

SEQ ID NO: 413507 - DNA, 25 bp, Mus musculus
tttctctgctccgaggtcttggggc

SEQ ID NO: 413508 - DNA, 25 bp, Mus musculus
ccctttactgccgtttctctgctcc

SEQ ID NO: 413509 - DNA, 25 bp, Mus musculus
gcaaatccgtgtgctgttccgtttc

SEQ ID NO: 413510 - DNA, 25 bp, Mus musculus
tctggagcaaatccgtgtgctgttc

SEQ ID NO: 413511 - DNA, 25 bp, Mus musculus
gggctctggagcaaatccgtgtgct

SEQ ID NO: 413512 - DNA, 25 bp, Mus musculus
acttgccaggagctaaggggctctg

SEQ ID NO: 413513 - DNA, 25 bp, Mus musculus
tgtctgcgctcagcgccttcaaacg

SEQ ID NO: 413514 - DNA, 25 bp, Mus musculus
agaccggcgccaggcctcctagtta

SEQ ID NO: 413515 - DNA, 25 bp, Mus musculus
cggcgccaggcctcctagttacggg

SEQ ID NO: 413516 - DNA, 25 bp, Mus musculus
gtcggtcctcgctgtcgccatggag

SEQ ID NO: 413517 - DNA, 25 bp, Mus musculus
gcggtcggtcctcgctgtcgccatg

SEQ ID NO: 413518 - DNA, 25 bp, Mus musculus
gttacataagtggttgcgggcgcgt

SEQ ID NO: 413519 - DNA, 25 bp, Mus musculus
ccgcgttacataagtggttgcgggc

SEQ ID NO: 413520 - DNA, 25 bp, Mus musculus
cgcgccgcgttacataagtggttgc

SEQ ID NO: 413521 - DNA, 25 bp, Mus musculus
gtagtctggctaagcgttgcgcgcc

SEQ ID NO: 413522 - DNA, 25 bp, Mus musculus
cctgtagtctggctaagcgttgcgc

SEQ ID NO: 413523 - DNA, 25 bp, Mus musculus
cgggcctgtagtctggctaagcgtt

SEQ ID NO: 413524 - DNA, 25 bp, Mus musculus
gatcgggcctgtagtctggctaagc

SEQ ID NO: 413525 - DNA, 25 bp, Mus musculus
aacccaggacgagcctaccaagctg

SEQ ID NO: 413526 - DNA, 25 bp, Mus musculus
tggaaaggcggaacccaggacgagc

SEQ ID NO: 413527 - DNA, 25 bp, Mus musculus
gttgcgcgccgcgttacataagtgg

SEQ ID NO: 413528 - DNA, 25 bp, Mus musculus
aactgaggcccgtgcccaccgagga

SEQ ID NO: 413529 - DNA, 25 bp, Mus musculus
ggctcctcgccaaagactgaattcg

SEQ ID NO: 413530 - DNA, 25 bp, Mus musculus
cccgccggagcagacgttgcaataa

SEQ ID NO: 413531 - DNA, 25 bp, Mus musculus
cgctcggtcgcgctatacatagtgt

SEQ ID NO: 413532 - DNA, 25 bp, Mus musculus
tacatagtgtacaggagacatcgcg

SEQ ID NO: 413533 - DNA, 25 bp, Mus musculus
ggagacatcgcgtgtatttttaatg

SEQ ID NO: 413534 - DNA, 25 bp, Mus musculus
ctgtaactagaaacgcaacggactc

SEQ ID NO: 413535 - DNA, 25 bp, Mus musculus
cccgagctgagagccaagtgcttta

SEQ ID NO: 413536 - DNA, 25 bp, Mus musculus
ccaagtgctttaaggccggcgctct

SEQ ID NO: 413537 - DNA, 25 bp, Mus musculus
aggcgtctctcctctcttggcttgc

SEQ ID NO: 413538 - DNA, 25 bp, Mus musculus
cggcttcggtggatgcgagcttcca

SEQ ID NO: 413539 - DNA, 25 bp, Mus musculus
aagtcctgcccggtgccttcgtgga

SEQ ID NO: 413540 - DNA, 25 bp, Mus musculus
cgtttacataagacccagttgccca

SEQ ID NO: 413541 - DNA, 25 bp, Mus musculus
ccctccagttcttggcggacaaagg

SEQ ID NO: 413542 - DNA, 25 bp, Mus musculus
tcctcgaattggagagcgatcacgc

SEQ ID NO: 413543 - DNA, 25 bp, Mus musculus
ttcacgtacacttctgctgtctctg

SEQ ID NO: 413544 - DNA, 25 bp, Mus musculus
gggcttcacgtacacttctgctgtc

SEQ ID NO: 413545 - DNA, 25 bp, Mus musculus
ttggagagcgatcacgccttgtatc

SEQ ID NO: 413546 - DNA, 25 bp, Mus musculus
ctgtgatcccgaatgtccctgctgt

SEQ ID NO: 413547 - DNA, 25 bp, Mus musculus
aatgtccctgctgtctctgcggtcc

SEQ ID NO: 413548 - DNA, 25 bp, Mus musculus
gcggtcccgcaaatcccgaggatct

SEQ ID NO: 413549 - DNA, 25 bp, Mus musculus
ccgaggatctcgaatgtctctgcta

SEQ ID NO: 413550 - DNA, 25 bp, Mus musculus
aatccctcaggtcccgggcttcacg

SEQ ID NO: 413551 - DNA, 25 bp, Mus musculus
tgtctctgctatcacgggcatcccg

SEQ ID NO: 413552 - DNA, 25 bp, Mus musculus
cggccatttctgccatccctgggtt

SEQ ID NO: 413553 - DNA, 25 bp, Mus musculus
tccttggacttcctcgaattggaga

SEQ ID NO: 413554 - DNA, 25 bp, Mus musculus
ctgtctctgtgatcccgaatgtccc

SEQ ID NO: 413555 - DNA, 25 bp, Mus musculus
tccctgggttctctccttggacttc

SEQ ID NO: 413556 - DNA, 25 bp, Mus musculus
acgccgagccttgcgtccagcacca

SEQ ID NO: 413557 - DNA, 25 bp, Mus musculus
ggattctgaccagccggtagctagc

SEQ ID NO: 413558 - DNA, 25 bp, Mus musculus
gcacggggattctgaccagccggta

SEQ ID NO: 413559 - DNA, 25 bp, Mus musculus
ctgaccagccggtagctagctggga

SEQ ID NO: 413560 - DNA, 25 bp, Mus musculus
tcgacactgggagccgacgccagac

SEQ ID NO: 413561 - DNA, 25 bp, Mus musculus
cgacgccagaccaggcgtagatcga

SEQ ID NO: 413562 - DNA, 25 bp, Mus musculus
tgggtgctgtctgcgcccgccatcg

SEQ ID NO: 413563 - DNA, 25 bp, Mus musculus
gccatcgcccgaggtctccactgga

SEQ ID NO: 413564 - DNA, 25 bp, Mus musculus
agccgcgggagctatcggagtcact

SEQ ID NO: 413565 - DNA, 25 bp, Mus musculus
ctatcggagtcactagagcaaggtg

SEQ ID NO: 413566 - DNA, 25 bp, Mus musculus
tcactagagcaaggtgtgagcgccg

SEQ ID NO: 413567 - DNA, 25 bp, Mus musculus
tttgagacaacctctgctgcggcgg

SEQ ID NO: 413568 - DNA, 25 bp, Mus musculus
agcgctcgcgccctgggtgctgtct

SEQ ID NO: 413569 - DNA, 25 bp, Mus musculus
gccgcatccgggcctgcctttgaga

SEQ ID NO: 413570 - DNA, 25 bp, Mus musculus
aacgccagcggttgcctagtaacgg

SEQ ID NO: 413571 - DNA, 25 bp, Mus musculus
acagcgctccctaggctgcttggcg

SEQ ID NO: 413572 - DNA, 25 bp, Mus musculus
acatctcgagaatacgcccagggcg

SEQ ID NO: 413573 - DNA, 25 bp, Mus musculus
atgggcgagctgtcacacaagttga

SEQ ID NO: 413574 - DNA, 25 bp, Mus musculus
gcctagggtccacgtccatagaatg

SEQ ID NO: 413575 - DNA, 25 bp, Mus musculus
ggcacaatttctctcgcccggttct

SEQ ID NO: 413576 - DNA, 25 bp, Mus musculus
gtgtccgtacgaacctccggcacaa

SEQ ID NO: 413577 - DNA, 25 bp, Mus musculus
tccagtgccactgactcacaagagc

SEQ ID NO: 413578 - DNA, 25 bp, Mus musculus
gagcgacttcacagactctcgagtg

SEQ ID NO: 413579 - DNA, 25 bp, Mus musculus
gcctcagcagcttgcgaccgaaacg

SEQ ID NO: 413580 - DNA, 25 bp, Mus musculus
agtactacgcctcggcggacggcca

SEQ ID NO: 413581 - DNA, 25 bp, Mus musculus
accaaccgactagcgcgggcacgag

SEQ ID NO: 413582 - DNA, 25 bp, Mus musculus
agtgtcgtaaagagcctgcgggttt

SEQ ID NO: 413583 - DNA, 25 bp, Mus musculus
cagggcgtgctcgatcctacaaaga

SEQ ID NO: 413584 - DNA, 25 bp, Mus musculus
aggcgcactgccctctgctggctct

SEQ ID NO: 413585 - DNA, 25 bp, Mus musculus
gacacggaagcgcaagtcagagcca

SEQ ID NO: 413586 - DNA, 25 bp, Mus musculus
gaagccggaagaggctcgcgcgcag

SEQ ID NO: 413587 - DNA, 25 bp, Mus musculus
ctggccagcgcgctgtggcgtgatt

SEQ ID NO: 413588 - DNA, 25 bp, Mus musculus
tctcaggacacggaagcgcaagtca

SEQ ID NO: 413589 - DNA, 25 bp, Mus musculus
tcaggacacggaagcgcaagtcaga

SEQ ID NO: 413590 - DNA, 25 bp, Mus musculus
cacggaagcgcaagtcagagccagg

SEQ ID NO: 413591 - DNA, 25 bp, Mus musculus
caagtcagagccaggggctgcgggc

SEQ ID NO: 413592 - DNA, 25 bp, Mus musculus
agggtctcaggacacggaagcgcaa

SEQ ID NO: 413593 - DNA, 25 bp, Mus musculus
ccaagtgacaggccgcggagatgtc

SEQ ID NO: 413594 - DNA, 25 bp, Mus musculus
cggctgcgcacacgctcaccgcgca

SEQ ID NO: 413595 - DNA, 25 bp, Mus musculus
cctttgcgggccaatgcagagcgag

SEQ ID NO: 413596 - DNA, 25 bp, Mus musculus
tggcgcgcctttgcgggccaatgca

SEQ ID NO: 413597 - DNA, 25 bp, Mus musculus
ggcggtaaggctgcggccaagtgac

SEQ ID NO: 413598 - DNA, 25 bp, Mus musculus
ataggcctcggtgtcctgctcgccg

SEQ ID NO: 413599 - DNA, 25 bp, Mus musculus
gcgcccctgagtcttccgcaagata

SEQ ID NO: 413600 - DNA, 25 bp, Mus musculus
catgtcataggcctcggtgtcctgc

SEQ ID NO: 413601 - DNA, 25 bp, Mus musculus
cgctgacatgtcataggcctcggtg

SEQ ID NO: 413602 - DNA, 25 bp, Mus musculus
gctccgtagcgctgacatgtcatag

SEQ ID NO: 413603 - DNA, 25 bp, Mus musculus
cccaaaatcgtagaggctccgtagc

SEQ ID NO: 413604 - DNA, 25 bp, Mus musculus
tgaacaccgagaagtccggctcggg

SEQ ID NO: 413605 - DNA, 25 bp, Mus musculus
tgaagtccctgaacaccgagaagtc

SEQ ID NO: 413606 - DNA, 25 bp, Mus musculus
gcggctgatgaagtccctgaacacc

SEQ ID NO: 413607 - DNA, 25 bp, Mus musculus
gccaccttgcggctgatgaagtccc

SEQ ID NO: 413608 - DNA, 25 bp, Mus musculus
gaggcaccgataggtccgcgtccgc

SEQ ID NO: 413609 - DNA, 25 bp, Mus musculus
gccctcgaacgcgtaggtctggaag

SEQ ID NO: 413610 - DNA, 25 bp, Mus musculus
tgctccgagccggtcgagccgctgt

SEQ ID NO: 413611 - DNA, 25 bp, Mus musculus
agaaaggcgaagtcctgctccgagc

SEQ ID NO: 413612 - DNA, 25 bp, Mus musculus
tcacagccgcagatgcggatggtga

SEQ ID NO: 413613 - DNA, 25 bp, Mus musculus
atctgcaccggaggagaagcggaca

SEQ ID NO: 413614 - DNA, 25 bp, Mus musculus
aagcccacgtgctgcgtgtgcaccg

SEQ ID NO: 413615 - DNA, 25 bp, Mus musculus
cagctgtgttatctgcaccggagga

SEQ ID NO: 413616 - DNA, 25 bp, Mus musculus
cgtgtgcaccgcagctgtgttatct

SEQ ID NO: 413617 - DNA, 25 bp, Mus musculus
aggaggaacacgtcctgctcttgcc

SEQ ID NO: 413618 - DNA, 25 bp, Mus musculus
tgctcttgccggttgaagcccacgt

SEQ ID NO: 413619 - DNA, 25 bp, Mus musculus
acacgtcctgctcttgccggttgaa

SEQ ID NO: 413620 - DNA, 25 bp, Mus musculus
gtggcccgctgtccacaacgaggat

SEQ ID NO: 413621 - DNA, 25 bp, Mus musculus
aagcggacagtgtgtaactcgaggc

SEQ ID NO: 413622 - DNA, 25 bp, Mus musculus
atggtaccggagctgtcacagccgc

SEQ ID NO: 413623 - DNA, 25 bp, Mus musculus
gactggatggtaccggagctgtcac

SEQ ID NO: 413624 - DNA, 25 bp, Mus musculus
taactcgaggctggcgtcggaccct

SEQ ID NO: 413625 - DNA, 25 bp, Mus musculus
ctgtccacaacgaggatgggcagga

SEQ ID NO: 413626 - DNA, 25 bp, Mus musculus
cggaatgtgcctaggtcggcgaagc

SEQ ID NO: 413627 - DNA, 25 bp, Mus musculus
agggagcccacctgcgcgtcctcct

SEQ ID NO: 413628 - DNA, 25 bp, Mus musculus
tcctgcacctccagtaggccggagg

SEQ ID NO: 413629 - DNA, 25 bp, Mus musculus
ctgcacctccagtaggccggagggt

SEQ ID NO: 413630 - DNA, 25 bp, Mus musculus
ggaactcggggggttcatccacatc

SEQ ID NO: 413631 - DNA, 25 bp, Mus musculus
ggggttcatccacatcggtcacggc

SEQ ID NO: 413632 - DNA, 25 bp, Mus musculus
atcggtcacggccacgcgcacgatt

SEQ ID NO: 413633 - DNA, 25 bp, Mus musculus
ggtcccgcgccgtcaccacgccgac

SEQ ID NO: 413634 - DNA, 25 bp, Mus musculus
gcgcacgattgcctggtctcggaat

SEQ ID NO: 413635 - DNA, 25 bp, Mus musculus
cacgcgcacgattgcctggtctcgg

SEQ ID NO: 413636 - DNA, 25 bp, Mus musculus
ggccacgcgcacgattgcctggtct

SEQ ID NO: 413637 - DNA, 25 bp, Mus musculus
ggttcatccacatcggtcacggcca

SEQ ID NO: 413638 - DNA, 25 bp, Mus musculus
cgtcaccacgccgaccagggagccc

SEQ ID NO: 413639 - DNA, 25 bp, Mus musculus
acggccacgcgcacgattgcctggt

SEQ ID NO: 413640 - DNA, 25 bp, Mus musculus
aatcaggcggctcccgagtaccgaa

SEQ ID NO: 413641 - DNA, 25 bp, Mus musculus
ccacataaatcaggcggctcccgag

SEQ ID NO: 413642 - DNA, 25 bp, Mus musculus
gttattgcccacataaatcaggcgg

SEQ ID NO: 413643 - DNA, 25 bp, Mus musculus
accggggcgcgttattgcccacata

SEQ ID NO: 413644 - DNA, 25 bp, Mus musculus
cactgctttaaaaagcgcggggccg

SEQ ID NO: 413645 - DNA, 25 bp, Mus musculus
cccattagcactgctttaaaaagcg

SEQ ID NO: 413646 - DNA, 25 bp, Mus musculus
gtgacatgccttcccagcagaagcc

SEQ ID NO: 413647 - DNA, 25 bp, Mus musculus
caaacagctgatgggagtgaagttc

SEQ ID NO: 413648 - DNA, 25 bp, Mus musculus
cgctgtgctgtgacatgccttccca

SEQ ID NO: 413649 - DNA, 25 bp, Mus musculus
tttcatttcggtggccgctgtgctg

SEQ ID NO: 413650 - DNA, 25 bp, Mus musculus
tagcttttcatttcggtggccgctg

SEQ ID NO: 413651 - DNA, 25 bp, Mus musculus
cgggatcgttattaatagcttttca

SEQ ID NO: 413652 - DNA, 25 bp, Mus musculus
tgaagttccgggatcgttattaata

SEQ ID NO: 413653 - DNA, 25 bp, Mus musculus
cacctttaaacaaacagctgatggg

SEQ ID NO: 413654 - DNA, 25 bp, Mus musculus
tgtacgccctcacagtcgcaaggtc

SEQ ID NO: 413655 - DNA, 25 bp, Mus musculus
atcacagccaggtccggctctggcg

SEQ ID NO: 413656 - DNA, 25 bp, Mus musculus
caagggtcctcatagcctgtccagc

SEQ ID NO: 413657 - DNA, 25 bp, Mus musculus
ggtccgcgccttgggacgccagcaa

SEQ ID NO: 413658 - DNA, 25 bp, Mus musculus
gatgggcgcgcttcagctgttgccc

SEQ ID NO: 413659 - DNA, 25 bp, Mus musculus
ccgcgcgctcttaccttggggagcg

SEQ ID NO: 413660 - DNA, 25 bp, Mus musculus
agctcaggacacagggaccgcgact

SEQ ID NO: 413661 - DNA, 25 bp, Mus musculus
ccgtacagaggctggattctccatc

SEQ ID NO: 413662 - DNA, 25 bp, Mus musculus
tcggcagggccacaagggtcctcat

SEQ ID NO: 413663 - DNA, 25 bp, Mus musculus
gggtagagctacctctcaatctcca

SEQ ID NO: 413664 - DNA, 25 bp, Mus musculus
tccttctccgtggtggggacagagt

SEQ ID NO: 413665 - DNA, 25 bp, Mus musculus
tgagcctgtgaagcccggtccttct

SEQ ID NO: 413666 - DNA, 25 bp, Mus musculus
cgtgctttggacgtgagcctgtgaa

SEQ ID NO: 413667 - DNA, 25 bp, Mus musculus
tggacgtgggaaagtccctgtctcc

SEQ ID NO: 413668 - DNA, 25 bp, Mus musculus
cgaatgccaggcgaacgggcccaga

SEQ ID NO: 413669 - DNA, 25 bp, Mus musculus
ggctgggtccgcaagttctccctgg

SEQ ID NO: 413670 - DNA, 25 bp, Mus musculus
ctgcaacgccacgtacagccgtgtg

SEQ ID NO: 413671 - DNA, 25 bp, Mus musculus
gtacagccgtgtgcccggaacatca

SEQ ID NO: 413672 - DNA, 25 bp, Mus musculus
tcctcctcggcaaggcaacctgatg

SEQ ID NO: 413673 - DNA, 25 bp, Mus musculus
aacctgatgctctctgctctggtcc

SEQ ID NO: 413674 - DNA, 25 bp, Mus musculus
gcgcgtggcacttaacaccgcgtga

SEQ ID NO: 413675 - DNA, 25 bp, Mus musculus
accgcgtgacgactgtgtttgctca

SEQ ID NO: 413676 - DNA, 25 bp, Mus musculus
ctgtgcctcaggaggcgagacttcc

SEQ ID NO: 413677 - DNA, 25 bp, Mus musculus
cctcgtacgtgctcggcgaatgcca

SEQ ID NO: 413678 - DNA, 25 bp, Mus musculus
cccagagccactggaaagctgggga

SEQ ID NO: 413679 - DNA, 25 bp, Mus musculus
agaaggcaggggaccgcccacacgc

SEQ ID NO: 413680 - DNA, 25 bp, Mus musculus
agcctcctgccggaagctcgaggtg

SEQ ID NO: 413681 - DNA, 25 bp, Mus musculus
ctgctcggcagtatccacctggttc

SEQ ID NO: 413682 - DNA, 25 bp, Mus musculus
gcattgcaatgctgcgggaagaagc

SEQ ID NO: 413683 - DNA, 25 bp, Mus musculus
accagatctgcagggcccggaaaaa

SEQ ID NO: 413684 - DNA, 25 bp, Mus musculus
ggcccgggcttctattgctccgctt

SEQ ID NO: 413685 - DNA, 25 bp, Mus musculus
tctgtcaataaaagggaggcgggcc

SEQ ID NO: 413686 - DNA, 25 bp, Mus musculus
cactgggttgtttgtctgtcaataa

SEQ ID NO: 413687 - DNA, 25 bp, Mus musculus
tctcgctttcactgggttgtttgtc

SEQ ID NO: 413688 - DNA, 25 bp, Mus musculus
ctgtcaagatgaaaagtctcgcttt

SEQ ID NO: 413689 - DNA, 25 bp, Mus musculus
gctccgctttgctgtcaagatgaaa

SEQ ID NO: 413690 - DNA, 25 bp, Mus musculus
gggcttctattgctccgctttgctg

SEQ ID NO: 413691 - DNA, 25 bp, Mus musculus
ggattaccggatcggcaccgtgccc

SEQ ID NO: 413692 - DNA, 25 bp, Mus musculus
gggtggaaaccagcaccggagcacc

SEQ ID NO: 413693 - DNA, 25 bp, Mus musculus
gcgaaggaccagatctgcagggccc

SEQ ID NO: 413694 - DNA, 25 bp, Mus musculus
aaggaacagaaccaggccgggagca

SEQ ID NO: 413695 - DNA, 25 bp, Mus musculus
cccgggcattgcaatgctgcgggaa

SEQ ID NO: 413696 - DNA, 25 bp, Mus musculus
cctgtcctggggaccgggtctctga

SEQ ID NO: 413697 - DNA, 25 bp, Mus musculus
cactcgaggcaggtgttgacacgta

SEQ ID NO: 413698 - DNA, 25 bp, Mus musculus
gcaggtgttgacacgtaagcctccc

SEQ ID NO: 413699 - DNA, 25 bp, Mus musculus
gcctggcaatgcaaccctccaaatg

SEQ ID NO: 413700 - DNA, 25 bp, Mus musculus
aaatgggctctcacccttaggcgcg

SEQ ID NO: 413701 - DNA, 25 bp, Mus musculus
ccttaggcgcgcctgtcctggggac

SEQ ID NO: 413702 - DNA, 25 bp, Mus musculus
cccgaggatctgagggtttcctctg

SEQ ID NO: 413703 - DNA, 25 bp, Mus musculus
atctgagggtttcctctgcgctcag

SEQ ID NO: 413704 - DNA, 25 bp, Mus musculus
cgcgggagtgaacaatgaagatgaa

SEQ ID NO: 413705 - DNA, 25 bp, Mus musculus
tgaagatgaactgcacatgcgcagc

SEQ ID NO: 413706 - DNA, 25 bp, Mus musculus
agatgctagggacccgttcccgcga

SEQ ID NO: 413707 - DNA, 25 bp, Mus musculus
gcctgcgcgaagcacactcgaggca

SEQ ID NO: 413708 - DNA, 25 bp, Mus musculus
cgggtctctgagcagcgcgtagacc

SEQ ID NO: 413709 - DNA, 25 bp, Mus musculus
gcacatgcgcagcagagatgctagg

SEQ ID NO: 413710 - DNA, 25 bp, Mus musculus
actcgtgcacgttgtccttggcgtc

SEQ ID NO: 413711 - DNA, 25 bp, Mus musculus
ttgccacattcgttgcaggcgtacg

SEQ ID NO: 413712 - DNA, 25 bp, Mus musculus
tgtggatcctcttgtgcacggtgaa

SEQ ID NO: 413713 - DNA, 25 bp, Mus musculus
cgacttgtggcggaaggacttccca

SEQ ID NO: 413714 - DNA, 25 bp, Mus musculus
gctccgtgaaggagaccttttggca

SEQ ID NO: 413715 - DNA, 25 bp, Mus musculus
ccttttggcagaaggtcttcccaca

SEQ ID NO: 413716 - DNA, 25 bp, Mus musculus
ggtgcctgagagctgacttcctgca

SEQ ID NO: 413717 - DNA, 25 bp, Mus musculus
tgacttcctgcagtaggtccgccca

SEQ ID NO: 413718 - DNA, 25 bp, Mus musculus
tcgtaaggcctctcccatatggttc

SEQ ID NO: 413719 - DNA, 25 bp, Mus musculus
gcttgtggtcgtgacactcgtgcac

SEQ ID NO: 413720 - DNA, 25 bp, Mus musculus
cttctgctcgctgcagttgggcttc

SEQ ID NO: 413721 - DNA, 25 bp, Mus musculus
tctcgcccgtgtgtattttctggtg

SEQ ID NO: 413722 - DNA, 25 bp, Mus musculus
ctggtgttcagtcagcgtccagagg

SEQ ID NO: 413723 - DNA, 25 bp, Mus musculus
catatggttctcttgtgcgcgaagc

SEQ ID NO: 413724 - DNA, 25 bp, Mus musculus
cactgcgagtggatggcttgactcc

SEQ ID NO: 413725 - DNA, 25 bp, Mus musculus
ttccgctgtcaacaggaaatgacgc

SEQ ID NO: 413726 - DNA, 25 bp, Mus musculus
gtaccagtctggctgccgaaaagca

SEQ ID NO: 413727 - DNA, 25 bp, Mus musculus
ccaggagctgtggaacctgcattac

SEQ ID NO: 413728 - DNA, 25 bp, Mus musculus
tgcattactgcacacgccggccaga

SEQ ID NO: 413729 - DNA, 25 bp, Mus musculus
ttaagcaggcgcgatgttattctcg

SEQ ID NO: 413730 - DNA, 25 bp, Mus musculus
tgggcttcgccacctttgagatatt

SEQ ID NO: 413731 - DNA, 25 bp, Mus musculus
ttgagatattcgtgcacctgctggc

SEQ ID NO: 413732 - DNA, 25 bp, Mus musculus
gttctccgtactgttggcactgcga

SEQ ID NO: 413733 - DNA, 25 bp, Mus musculus
gcccgagcctcaccacggagtaaga

SEQ ID NO: 413734 - DNA, 25 bp, Mus musculus
gccgacgggctcagtacctacttca

SEQ ID NO: 413735 - DNA, 25 bp, Mus musculus
ctctcctggtggaacgtctttgtgc

SEQ ID NO: 413736 - DNA, 25 bp, Mus musculus
tctttgtgccctttttcgccgccga

SEQ ID NO: 413737 - DNA, 25 bp, Mus musculus
agtaagagtccaaagcctgcacgcg

SEQ ID NO: 413738 - DNA, 25 bp, Mus musculus
acctcgcagtcttttctcctccgct

SEQ ID NO: 413739 - DNA, 25 bp, Mus musculus
tctgtcccttgctgcgaccgggctg

SEQ ID NO: 413740 - DNA, 25 bp, Mus musculus
ccctcaccgtgatcccgcgcgcggc

SEQ ID NO: 413741 - DNA, 25 bp, Mus musculus
cgccgcagccacctcgcagtctttt

SEQ ID NO: 413742 - DNA, 25 bp, Mus musculus
cgctcctcaccggtccggcccggag

SEQ ID NO: 413743 - DNA, 25 bp, Mus musculus
tcgcagccaacgaagccgcagtgcc

SEQ ID NO: 413744 - DNA, 25 bp, Mus musculus
cgagcgccgcctcgcagccaacgaa

SEQ ID NO: 413745 - DNA, 25 bp, Mus musculus
ccgcgcccgtcacagtccgggctgc

SEQ ID NO: 413746 - DNA, 25 bp, Mus musculus
ggaagatagcatgcagcccgtggcc

SEQ ID NO: 413747 - DNA, 25 bp, Mus musculus
gcaggcggaagatagcatgcagccc

SEQ ID NO: 413748 - DNA, 25 bp, Mus musculus
cactgggcaagacccagaggcacag

SEQ ID NO: 413749 - DNA, 25 bp, Mus musculus
acgactccgggcactgggcaagacc

SEQ ID NO: 413750 - DNA, 25 bp, Mus musculus
tgttccggtcctccctcaccctctg

SEQ ID NO: 413751 - DNA, 25 bp, Mus musculus
tgctccttgtccctgttccggtcct

SEQ ID NO: 413752 - DNA, 25 bp, Mus musculus
aaggcgctggttcttctgatcctgc

SEQ ID NO: 413753 - DNA, 25 bp, Mus musculus
catgcgcagagtctcggagcggcca

SEQ ID NO: 413754 - DNA, 25 bp, Mus musculus
gggatccgctttttgcacgcacaca

SEQ ID NO: 413755 - DNA, 25 bp, Mus musculus
atccgcaggactgctgggatccgct

SEQ ID NO: 413756 - DNA, 25 bp, Mus musculus
cgaagctttaccgggccaagggcat

SEQ ID NO: 413757 - DNA, 25 bp, Mus musculus
ggccaagggcatccgcaggactgct

SEQ ID NO: 413758 - DNA, 25 bp, Mus musculus
catagagcctaggagaccgcgcatg

SEQ ID NO: 413759 - DNA, 25 bp, Mus musculus
cggaaacgcatccatagagcctagg

SEQ ID NO: 413760 - DNA, 25 bp, Mus musculus
cccacgaaacggaaacgcatccata

SEQ ID NO: 413761 - DNA, 25 bp, Mus musculus
ccaggcaattgtggcgcacagaggc

SEQ ID NO: 413762 - DNA, 25 bp, Mus musculus
ctcgcttcttttgtagctcccagaa

SEQ ID NO: 413763 - DNA, 25 bp, Mus musculus
ctcaggggaaacctcgcttcttttg

SEQ ID NO: 413764 - DNA, 25 bp, Mus musculus
gagtcgccacccggaattcctctgg

SEQ ID NO: 413765 - DNA, 25 bp, Mus musculus
cccaggaaggcgctggttcttctga

SEQ ID NO: 413766 - DNA, 25 bp, Mus musculus
cgccgccagagcagcggtgacacgg

SEQ ID NO: 413767 - DNA, 25 bp, Mus musculus
gctgcatggaggcaaacacgctctc

SEQ ID NO: 413768 - DNA, 25 bp, Mus musculus
aggcaaacacgctctccaccggagg

SEQ ID NO: 413769 - DNA, 25 bp, Mus musculus
acacgctctccaccggaggttggtt

SEQ ID NO: 413770 - DNA, 25 bp, Mus musculus
tctccaccggaggttggttgaggac

SEQ ID NO: 413771 - DNA, 25 bp, Mus musculus
ctcccactggaaggagcgctgcatg

SEQ ID NO: 413772 - DNA, 25 bp, Mus musculus
tgaagcgcagctcccactggaagga

SEQ ID NO: 413773 - DNA, 25 bp, Mus musculus
aaggagcgctgcatggaggcaaaca

SEQ ID NO: 413774 - DNA, 25 bp, Mus musculus
gttgagcctgtggtagatgacagtc

SEQ ID NO: 413775 - DNA, 25 bp, Mus musculus
ccgccagcagttgcagggcgcccgc

SEQ ID NO: 413776 - DNA, 25 bp, Mus musculus
tgtagcaccaaggtggcgcccgcca

SEQ ID NO: 413777 - DNA, 25 bp, Mus musculus
taggcctgtagcaccaaggtggcgc

SEQ ID NO: 413778 - DNA, 25 bp, Mus musculus
caggcgtaggcctgtagcaccaagg

SEQ ID NO: 413779 - DNA, 25 bp, Mus musculus
gcgtgaagcgcagctcccactggaa

SEQ ID NO: 413780 - DNA, 25 bp, Mus musculus
tcacgtgggaaatggggcaaagccc

SEQ ID NO: 413781 - DNA, 25 bp, Mus musculus
gggactaaaggcctcagcaccgtca

SEQ ID NO: 413782 - DNA, 25 bp, Mus musculus
tcatcccactgtccaaccctgtagg

SEQ ID NO: 413783 - DNA, 25 bp, Mus musculus
cagtagcaccaagcaagccgtcaga

SEQ ID NO: 413784 - DNA, 25 bp, Mus musculus
agcccaggtgggactaaaggcctca

SEQ ID NO: 413785 - DNA, 25 bp, Mus musculus
ctgtgaagggctatataccccagta

SEQ ID NO: 413786 - DNA, 25 bp, Mus musculus
ccgcgcctccttggtctggacaagg

SEQ ID NO: 413787 - DNA, 25 bp, Mus musculus
catccgcgcgatcgctggagaccag

SEQ ID NO: 413788 - DNA, 25 bp, Mus musculus
gcagcagagccagcggcaccagcag

SEQ ID NO: 413789 - DNA, 25 bp, Mus musculus
tgctcctaggggtaggcaggctcaa

SEQ ID NO: 413790 - DNA, 25 bp, Mus musculus
tcaaactttagaagagtgggaggac

SEQ ID NO: 413791 - DNA, 25 bp, Mus musculus
gcaagccgtcagagctcaaacttta

SEQ ID NO: 413792 - DNA, 25 bp, Mus musculus
ccgtcagagctcaaactttagaaga

SEQ ID NO: 413793 - DNA, 25 bp, Mus musculus
ccactctggactcacgtgggaaatg

SEQ ID NO: 413794 - DNA, 25 bp, Mus musculus
tgtcgccttgagtccttaagcattg

SEQ ID NO: 413795 - DNA, 25 bp, Mus musculus
aacagaatggcgtcctgactgtcgc

SEQ ID NO: 413796 - DNA, 25 bp, Mus musculus
cgccttgagtccttaagcattgcca

SEQ ID NO: 413797 - DNA, 25 bp, Mus musculus
tgagtccttaagcattgccatctga

SEQ ID NO: 413798 - DNA, 25 bp, Mus musculus
cttaagcattgccatctgatcctgt

SEQ ID NO: 413799 - DNA, 25 bp, Mus musculus
aagcattgccatctgatcctgtccc

SEQ ID NO: 413800 - DNA, 25 bp, Mus musculus
atcctgtcccctagaaatcggagcc

SEQ ID NO: 413801 - DNA, 25 bp, Mus musculus
tccgcctccgaggacgtgccagcca

SEQ ID NO: 413802 - DNA, 25 bp, Mus musculus
cgaggacgtgccagccatgcctccg

SEQ ID NO: 413803 - DNA, 25 bp, Mus musculus
aatggcgtcctgactgtcgccttga

SEQ ID NO: 413804 - DNA, 25 bp, Mus musculus
cccgcgaaccaaacagaatggcgtc

SEQ ID NO: 413805 - DNA, 25 bp, Mus musculus
cctgactgtcgccttgagtccttaa

SEQ ID NO: 413806 - DNA, 25 bp, Mus musculus
ggagggacccgagcgctaaacaagc

SEQ ID NO: 413807 - DNA, 25 bp, Mus musculus
accaaacagaatggcgtcctgactg

SEQ ID NO: 413808 - DNA, 25 bp, Mus musculus
aagtcgcggccacggatctcgatcc

SEQ ID NO: 413809 - DNA, 25 bp, Mus musculus
ctagctatgggtaagtcgcggccac

SEQ ID NO: 413810 - DNA, 25 bp, Mus musculus
tactcgctagctatgggtaagtcgc

SEQ ID NO: 413811 - DNA, 25 bp, Mus musculus
cagcgctactcgctagctatgggta

SEQ ID NO: 413812 - DNA, 25 bp, Mus musculus
gcccagcgctactcgctagctatgg

SEQ ID NO: 413813 - DNA, 25 bp, Mus musculus
aggacacgcgggacccagagcccag

SEQ ID NO: 413814 - DNA, 25 bp, Mus musculus
atttgaccaggacacgcgggaccca

SEQ ID NO: 413815 - DNA, 25 bp, Mus musculus
ctacagcggggatttgaccaggaca

SEQ ID NO: 413816 - DNA, 25 bp, Mus musculus
cgccactgctacagcggggatttga

SEQ ID NO: 413817 - DNA, 25 bp, Mus musculus
aagtttgtccgccactgctacagcg

SEQ ID NO: 413818 - DNA, 25 bp, Mus musculus
ccctggaccctgcgaaaggcagggc

SEQ ID NO: 413819 - DNA, 25 bp, Mus musculus
cccaggctcagaccgggctggccaa

SEQ ID NO: 413820 - DNA, 25 bp, Mus musculus
ctctggggaaagtttgtccgccact

SEQ ID NO: 413821 - DNA, 25 bp, Mus musculus
gggaaagtttgtccgccactgctac

SEQ ID NO: 413822 - DNA, 25 bp, Mus musculus
catcaattagaccttggcagcgctt

SEQ ID NO: 413823 - DNA, 25 bp, Mus musculus
tgcgcggagtcacaatcggtgcagt

SEQ ID NO: 413824 - DNA, 25 bp, Mus musculus
cacctgctggggacatttctcatca

SEQ ID NO: 413825 - DNA, 25 bp, Mus musculus
cacaatcggtgcagtgtttccagtg

SEQ ID NO: 413826 - DNA, 25 bp, Mus musculus
acctgcgcggcgcagatggtatcgc

SEQ ID NO: 413827 - DNA, 25 bp, Mus musculus
cgcagatggtatcgcccgcggcagc

SEQ ID NO: 413828 - DNA, 25 bp, Mus musculus
gcgatgccaggagtcagtgacctta

SEQ ID NO: 413829 - DNA, 25 bp, Mus musculus
tcagtgaccttaggggcccgcagac

SEQ ID NO: 413830 - DNA, 25 bp, Mus musculus
tggggacatttctcatcaattagac

SEQ ID NO: 413831 - DNA, 25 bp, Mus musculus
cttggcagcgcttgaatggggccca

SEQ ID NO: 413832 - DNA, 25 bp, Mus musculus
gcctccggagacaggttcgcacctg

SEQ ID NO: 413833 - DNA, 25 bp, Mus musculus
gggctttcgggcttcctggaatgcc

SEQ ID NO: 413834 - DNA, 25 bp, Mus musculus
agtcgcccgcgtgcacagatggcag

SEQ ID NO: 413835 - DNA, 25 bp, Mus musculus
aggttcgcacctgctggggacattt

SEQ ID NO: 413836 - DNA, 25 bp, Mus musculus
cgactctgcactgtgcgggtgagta

SEQ ID NO: 413837 - DNA, 25 bp, Mus musculus
tgctgactctctggggccgcgcctg

SEQ ID NO: 413838 - DNA, 25 bp, Mus musculus
cgcctggccacggtgaggacgctgc

SEQ ID NO: 413839 - DNA, 25 bp, Mus musculus
cagcgcgcactgcagggccgactcc

SEQ ID NO: 413840 - DNA, 25 bp, Mus musculus
tgccgcagccctgcgacattcgctc

SEQ ID NO: 413841 - DNA, 25 bp, Mus musculus
gcgacattcgctccgcgtgccatct

SEQ ID NO: 413842 - DNA, 25 bp, Mus musculus
tccgcgtgccatctcccggcctggc

SEQ ID NO: 413843 - DNA, 25 bp, Mus musculus
ctcgggacgactctgcactgtgcgg

SEQ ID NO: 413844 - DNA, 25 bp, Mus musculus
actctgcactgtgcgggtgagtacc

SEQ ID NO: 413845 - DNA, 25 bp, Mus musculus
cactgtgcgggtgagtaccgcgctc

SEQ ID NO: 413846 - DNA, 25 bp, Mus musculus
cgtagacactaaaggagcggaaact

SEQ ID NO: 413847 - DNA, 25 bp, Mus musculus
tagacactaaaggagcggaaactcg

SEQ ID NO: 413848 - DNA, 25 bp, Mus musculus
gacactaaaggagcggaaactcggc

SEQ ID NO: 413849 - DNA, 25 bp, Mus musculus
ccgctcgggacgactctgcactgtg

SEQ ID NO: 413850 - DNA, 25 bp, Mus musculus
tgatacagcggacacaggggcccga

SEQ ID NO: 413851 - DNA, 25 bp, Mus musculus
cgagacacagcggacacaggagcct

SEQ ID NO: 413852 - DNA, 25 bp, Mus musculus
acccagcggacacaggggcccgaga

SEQ ID NO: 413853 - DNA, 25 bp, Mus musculus
agacacagcggacacaggggcctga

SEQ ID NO: 413854 - DNA, 25 bp, Mus musculus
cgagacacagcggacacaggggccc

SEQ ID NO: 413855 - DNA, 25 bp, Mus musculus
agacacagcggacacaggggcccga

SEQ ID NO: 413856 - DNA, 25 bp, Mus musculus
tacagcggacacaggggcccgagac

SEQ ID NO: 413857 - DNA, 25 bp, Mus musculus
agacccagcggacacaggggcccga

SEQ ID NO: 413858 - DNA, 25 bp, Mus musculus
agacacagcggacacaggagcctga

SEQ ID NO: 413859 - DNA, 25 bp, Mus musculus
acacaggagcctgatacagcggaca

SEQ ID NO: 413860 - DNA, 25 bp, Mus musculus
atacagcggacacaggggcccgaga

SEQ ID NO: 413861 - DNA, 25 bp, Mus musculus
acacagcggacacaggagcctgata

SEQ ID NO: 413862 - DNA, 25 bp, Mus musculus
acaggagcctgatacagcggacaca

SEQ ID NO: 413863 - DNA, 25 bp, Mus musculus
acacagcggacacaggggcccgaga

SEQ ID NO: 413864 - DNA, 25 bp, Mus musculus
ggtaagagcggcctctgcttcttca

SEQ ID NO: 413865 - DNA, 25 bp, Mus musculus
tgcacagctgggacagtctccttcg

SEQ ID NO: 413866 - DNA, 25 bp, Mus musculus
cagctgggacagtctccttcggtaa

SEQ ID NO: 413867 - DNA, 25 bp, Mus musculus
tgggacagtctccttcggtaagagc

SEQ ID NO: 413868 - DNA, 25 bp, Mus musculus
cagtctccttcggtaagagcggcct

SEQ ID NO: 413869 - DNA, 25 bp, Mus musculus
agagcggcctctgcttcttcaccgg

SEQ ID NO: 413870 - DNA, 25 bp, Mus musculus
tcttcaccgggcttcccgtgacggc

SEQ ID NO: 413871 - DNA, 25 bp, Mus musculus
tgccgtgactgtgacggtagacatc

SEQ ID NO: 413872 - DNA, 25 bp, Mus musculus
actgtgacggtagacatcgtgctgg

SEQ ID NO: 413873 - DNA, 25 bp, Mus musculus
acggtgaccccagccgcgggtgctt

SEQ ID NO: 413874 - DNA, 25 bp, Mus musculus
agactggttgcccgccgaagtggac

SEQ ID NO: 413875 - DNA, 25 bp, Mus musculus
acgacccgctgcacagctgggacag

SEQ ID NO: 413876 - DNA, 25 bp, Mus musculus
tgagcgggtgagtaccggtgtctct

SEQ ID NO: 413877 - DNA, 25 bp, Mus musculus
cgctgcacagctgggacagtctcct

SEQ ID NO: 413878 - DNA, 25 bp, Mus musculus
cattacagatctacaaggtcccttc

SEQ ID NO: 413879 - DNA, 25 bp, Mus musculus
gcatgatagaaaacgtgagccggtc

SEQ ID NO: 413880 - DNA, 25 bp, Mus musculus
gctcccaaggctcggggacaggcaa

SEQ ID NO: 413881 - DNA, 25 bp, Mus musculus
caaaaggcgtcaaccattacagatc

SEQ ID NO: 413882 - DNA, 25 bp, Mus musculus
ggtctcaaagcgctcgctcccaagg

SEQ ID NO: 413883 - DNA, 25 bp, Mus musculus
aaggtcccttccaaggcactcacgg

SEQ ID NO: 413884 - DNA, 25 bp, Mus musculus
actcacggcagaagcagcagacgca

SEQ ID NO: 413885 - DNA, 25 bp, Mus musculus
cgcacaacgcggcaggtctcaaagc

SEQ ID NO: 413886 - DNA, 25 bp, Mus musculus
caaggccgaagaatgggaggaaaca

SEQ ID NO: 413887 - DNA, 25 bp, Mus musculus
cagcaggctactggcgaggagtcaa

SEQ ID NO: 413888 - DNA, 25 bp, Mus musculus
tacagcggtcttcccagcaggctac

SEQ ID NO: 413889 - DNA, 25 bp, Mus musculus
tcgtggaacacacactacagcggtc

SEQ ID NO: 413890 - DNA, 25 bp, Mus musculus
tgagccggtcacctcgtggaacaca

SEQ ID NO: 413891 - DNA, 25 bp, Mus musculus
ggaggaaacacagcgcgggatcttt

SEQ ID NO: 413892 - DNA, 25 bp, Mus musculus
cgagctgcttctggcgttctgagca

SEQ ID NO: 413893 - DNA, 25 bp, Mus musculus
agagacccgagctgcttctggcgtt

SEQ ID NO: 413894 - DNA, 25 bp, Mus musculus
taccgcagccatggtcaaggggcgc

SEQ ID NO: 413895 - DNA, 25 bp, Mus musculus
cggacgccgtgggtaccgcagccat

SEQ ID NO: 413896 - DNA, 25 bp, Mus musculus
cggaatccaggcgagcagtggcccc

SEQ ID NO: 413897 - DNA, 25 bp, Mus musculus
cctcggttgcacagcagcggcggct

SEQ ID NO: 413898 - DNA, 25 bp, Mus musculus
cgagcgaaggttgcaggagcctcct

SEQ ID NO: 413899 - DNA, 25 bp, Mus musculus
ttctggcgttctgagcaggagccgc

SEQ ID NO: 413900 - DNA, 25 bp, Mus musculus
tgtccgaacacagccggctgctctg

SEQ ID NO: 413901 - DNA, 25 bp, Mus musculus
tgcattctcaaattgtccgaacaca

SEQ ID NO: 413902 - DNA, 25 bp, Mus musculus
gtggaccgggaaaccaacaattgca

SEQ ID NO: 413903 - DNA, 25 bp, Mus musculus
gcaggttagcctcggttgcacagca

SEQ ID NO: 413904 - DNA, 25 bp, Mus musculus
cgggaaaccaacaattgcattctca

SEQ ID NO: 413905 - DNA, 25 bp, Mus musculus
ggtggctgtcatcgccgcgagcgaa

SEQ ID NO: 413906 - DNA, 25 bp, Mus musculus
ggcagcaactctttcactgttcacc

SEQ ID NO: 413907 - DNA, 25 bp, Mus musculus
gcgcactcctaccaatcggtcgttg

SEQ ID NO: 413908 - DNA, 25 bp, Mus musculus
gcgcttgcccaattggaggctacca

SEQ ID NO: 413909 - DNA, 25 bp, Mus musculus
cccgcctggaaacgggagatccttg

SEQ ID NO: 413910 - DNA, 25 bp, Mus musculus
cccggcgcagcgactttttacagaa

SEQ ID NO: 413911 - DNA, 25 bp, Mus musculus
ttttacagaagaccggcagcaactc

SEQ ID NO: 413912 - DNA, 25 bp, Mus musculus
gccgcctgctggaaaagttcgactc

SEQ ID NO: 413913 - DNA, 25 bp, Mus musculus
aggtagtagtgtacgaggcgccaca

SEQ ID NO: 413914 - DNA, 25 bp, Mus musculus
catcatcgagtcagcgccaggcttc

SEQ ID NO: 413915 - DNA, 25 bp, Mus musculus
gcggaccattcgagcggacaacatc

SEQ ID NO: 413916 - DNA, 25 bp, Mus musculus
agaacccgttcatgcgacttgagtc

SEQ ID NO: 413917 - DNA, 25 bp, Mus musculus
ggtccactaagccagaacccgttca

SEQ ID NO: 413918 - DNA, 25 bp, Mus musculus
ctggccgagagtctgggtccactaa

SEQ ID NO: 413919 - DNA, 25 bp, Mus musculus
tccttgagcggaggcgagctaaact

SEQ ID NO: 413920 - DNA, 25 bp, Mus musculus
tgccacaatgaggtaagatcaattc

SEQ ID NO: 413921 - DNA, 25 bp, Mus musculus
tgaggtaagatcaattccgctccgc

SEQ ID NO: 413922 - DNA, 25 bp, Mus musculus
gtgccacaatgaggtaagatcaatt

SEQ ID NO: 413923 - DNA, 25 bp, Mus musculus
ccacaatgaggtaagatcaattccg

SEQ ID NO: 413924 - DNA, 25 bp, Mus musculus
gaggtaagatcaattccgctccgct

SEQ ID NO: 413925 - DNA, 25 bp, Mus musculus
aatgaggtaagatcaattccgctcc

SEQ ID NO: 413926 - DNA, 25 bp, Mus musculus
ccgtgccacaatgaggtaagatcaa

SEQ ID NO: 413927 - DNA, 25 bp, Mus musculus
cccgtgccacaatgaggtaagatca

SEQ ID NO: 413928 - DNA, 25 bp, Mus musculus
ggtaagatcaattccgctccgctcg

SEQ ID NO: 413929 - DNA, 25 bp, Mus musculus
gtaagatcaattccgctccgctcgt

SEQ ID NO: 413930 - DNA, 25 bp, Mus musculus
acccgtgccacaatgaggtaagatc

SEQ ID NO: 413931 - DNA, 25 bp, Mus musculus
gccacaatgaggtaagatcaattcc

SEQ ID NO: 413932 - DNA, 25 bp, Mus musculus
caatgaggtaagatcaattccgctc

SEQ ID NO: 413933 - DNA, 25 bp, Mus musculus
aattccgctccgctcgtccaatccc

SEQ ID NO: 413934 - DNA, 25 bp, Mus musculus
gcacagtcccatgcagtgatgcgcc

SEQ ID NO: 413935 - DNA, 25 bp, Mus musculus
ccatgcagtgatgcgccaaactcac

SEQ ID NO: 413936 - DNA, 25 bp, Mus musculus
cccatgcagtgatgcgccaaactca

SEQ ID NO: 413937 - DNA, 25 bp, Mus musculus
ccccgtgccacaatgaggtaagatc

SEQ ID NO: 413938 - DNA, 25 bp, Mus musculus
ccctacccgtgccacaatgaggtaa

SEQ ID NO: 413939 - DNA, 25 bp, Mus musculus
ctacccgtgccacaatgaggtaaga

SEQ ID NO: 413940 - DNA, 25 bp, Mus musculus
gcatagcagcctcaccccacccgtg

SEQ ID NO: 413941 - DNA, 25 bp, Mus musculus
cccacccgtgccacaatgaggtaag

SEQ ID NO: 413942 - DNA, 25 bp, Mus musculus
ccgcacagtcccatgcagtgatgcg

SEQ ID NO: 413943 - DNA, 25 bp, Mus musculus
cacagtcccatgcagtgatgcgcca

SEQ ID NO: 413944 - DNA, 25 bp, Mus musculus
cagtcccatgcagtgatgcgccaaa

SEQ ID NO: 413945 - DNA, 25 bp, Mus musculus
agtcccatgcagtgatgcgccaaac

SEQ ID NO: 413946 - DNA, 25 bp, Mus musculus
tcccatgcagtgatgcgccaaactc

SEQ ID NO: 413947 - DNA, 25 bp, Mus musculus
ccacccgtgccacaatgaggtaaga

SEQ ID NO: 413948 - DNA, 25 bp, Mus musculus
aatctcgggtcggagaagctcagcc

SEQ ID NO: 413949 - DNA, 25 bp, Mus musculus
tgagtttccgatcgagaacagcgtt

SEQ ID NO: 413950 - DNA, 25 bp, Mus musculus
acgggcggctcctccggccgaagct

SEQ ID NO: 413951 - DNA, 25 bp, Mus musculus
tctccctctctgtgcggcgtggata

SEQ ID NO: 413952 - DNA, 25 bp, Mus musculus
tcggccgtctgtatgggatgagtgt

SEQ ID NO: 413953 - DNA, 25 bp, Mus musculus
cgcgatgtctccagggtggatgctt

SEQ ID NO: 413954 - DNA, 25 bp, Mus musculus
tgagtgcaaggtctgcggtctgtgc

SEQ ID NO: 413955 - DNA, 25 bp, Mus musculus
cggagaagctcagccgagtctcctc

SEQ ID NO: 413956 - DNA, 25 bp, Mus musculus
cccgccgaatctcgggtcggagaag

SEQ ID NO: 413957 - DNA, 25 bp, Mus musculus
ccagtaacgcgcggcgcaggcgaca

SEQ ID NO: 413958 - DNA, 25 bp, Mus musculus
tccgatcgagaacagcgttggggaa

SEQ ID NO: 413959 - DNA, 25 bp, Mus musculus
ctgagctgtgagtttccgatcgaga

SEQ ID NO: 413960 - DNA, 25 bp, Mus musculus
ttcagcggcggctgcctcagctcct

SEQ ID NO: 413961 - DNA, 25 bp, Mus musculus
gaacccaggcctcgcggccacgccc

SEQ ID NO: 413962 - DNA, 25 bp, Mus musculus
cctcgtaatgacacgttaataaatg

SEQ ID NO: 413963 - DNA, 25 bp, Mus musculus
aagtgttccctgaggcgtgcgacag

SEQ ID NO: 413964 - DNA, 25 bp, Mus musculus
ctcccagcagcgaggagccaagtgt

SEQ ID NO: 413965 - DNA, 25 bp, Mus musculus
tggcgcgcagagaatccagcctctt

SEQ ID NO: 413966 - DNA, 25 bp, Mus musculus
ggggcgcatctcttagtccaccaga

SEQ ID NO: 413967 - DNA, 25 bp, Mus musculus
ccctggaatctgtgatccgggcccg

SEQ ID NO: 413968 - DNA, 25 bp, Mus musculus
acctgaaccgtgctcgccctggaat

SEQ ID NO: 413969 - DNA, 25 bp, Mus musculus
ccagccttgcagacggggtcaaatc

SEQ ID NO: 413970 - DNA, 25 bp, Mus musculus
acctcaaggggtcaaccgggccatg

SEQ ID NO: 413971 - DNA, 25 bp, Mus musculus
ttcttttatccgctttcacaggggc

SEQ ID NO: 413972 - DNA, 25 bp, Mus musculus
agccacacgtggtctggcttctagc

SEQ ID NO: 413973 - DNA, 25 bp, Mus musculus
ttagtccaccagacaccggcgcgaa

SEQ ID NO: 413974 - DNA, 25 bp, Mus musculus
gctggccctctggatctaaacctca

SEQ ID NO: 413975 - DNA, 25 bp, Mus musculus
gggacccggcgattcagccatcgct

SEQ ID NO: 413976 - DNA, 25 bp, Mus musculus
cccagtcaggtcgtggttctgctga

SEQ ID NO: 413977 - DNA, 25 bp, Mus musculus
gcaggaaacgcaaggtgcccacgta

SEQ ID NO: 413978 - DNA, 25 bp, Mus musculus
cccaggatctcgttgagtacgcaca

SEQ ID NO: 413979 - DNA, 25 bp, Mus musculus
ttgagtacgcacagacggaggcgca

SEQ ID NO: 413980 - DNA, 25 bp, Mus musculus
tcaatctgctagtgggcggggatct

SEQ ID NO: 413981 - DNA, 25 bp, Mus musculus
gcggcacctcatgcggaaactgggc

SEQ ID NO: 413982 - DNA, 25 bp, Mus musculus
cgggagctcaccgactgcaggaaac

SEQ ID NO: 413983 - DNA, 25 bp, Mus musculus
cgccgcacagtcagagtttggggct

SEQ ID NO: 413984 - DNA, 25 bp, Mus musculus
gttctgctgagtctgtaggccaaga

SEQ ID NO: 413985 - DNA, 25 bp, Mus musculus
agacccattcagcagttctgcaaga

SEQ ID NO: 413986 - DNA, 25 bp, Mus musculus
ttctgcaagagcagctcgcgccatc

SEQ ID NO: 413987 - DNA, 25 bp, Mus musculus
tcgcgccatccacccgtaaggagtg

SEQ ID NO: 413988 - DNA, 25 bp, Mus musculus
gctggagccggatcagcgaccacca

SEQ ID NO: 413989 - DNA, 25 bp, Mus musculus
tgacgcccggaagagcagctcgacg

SEQ ID NO: 413990 - DNA, 25 bp, Mus musculus
ggatttgtagttccaaggccacgcc

SEQ ID NO: 413991 - DNA, 25 bp, Mus musculus
tcctcagcgcggctcccaagaggaa

SEQ ID NO: 413992 - DNA, 25 bp, Mus musculus
cagcgcggctcccaagaggaaacta

SEQ ID NO: 413993 - DNA, 25 bp, Mus musculus
cgcggctcccaagaggaaactagct

SEQ ID NO: 413994 - DNA, 25 bp, Mus musculus
gctcccaagaggaaactagctgctc

SEQ ID NO: 413995 - DNA, 25 bp, Mus musculus
tcccaagaggaaactagctgctccc

SEQ ID NO: 413996 - DNA, 25 bp, Mus musculus
aggaaactagctgctccctccgggc

SEQ ID NO: 413997 - DNA, 25 bp, Mus musculus
cctccgggctatcgacccggactcg

SEQ ID NO: 413998 - DNA, 25 bp, Mus musculus
tccgggataccgacaccgactaagc

SEQ ID NO: 413999 - DNA, 25 bp, Mus musculus
gacaccgactaagcccgggcatctt

SEQ ID NO: 414000 - DNA, 25 bp, Mus musculus
taagcccgggcatcttggtgggcca

SEQ ID NO: 414001 - DNA, 25 bp, Mus musculus
ccgggcatcttggtgggccaccagt

SEQ ID NO: 414002 - DNA, 25 bp, Mus musculus
atttgtagttccaaggccacgccca

SEQ ID NO: 414003 - DNA, 25 bp, Mus musculus
ggccaccagtgctctgaggagctga

SEQ ID NO: 414004 - DNA, 25 bp, Mus musculus
tgggagcggtgttcatggcggaaga

SEQ ID NO: 414005 - DNA, 25 bp, Mus musculus
ttaagcatctgtcctgccaggcgcg

SEQ ID NO: 414006 - DNA, 25 bp, Mus musculus
tttaagcatctgtcctgccaggcgc

SEQ ID NO: 414007 - DNA, 25 bp, Mus musculus
ttttaagcatctgtcctgccaggcg

SEQ ID NO: 414008 - DNA, 25 bp, Mus musculus
gtagttttaagcatctgtcctgcca

SEQ ID NO: 414009 - DNA, 25 bp, Mus musculus
ggtagttttaagcatctgtcctgcc

SEQ ID NO: 414010 - DNA, 25 bp, Mus musculus
tgggtagttttaagcatctgtcctg

SEQ ID NO: 414011 - DNA, 25 bp, Mus musculus
cctgggtagttttaagcatctgtcc

SEQ ID NO: 414012 - DNA, 25 bp, Mus musculus
ccctgggtagttttaagcatctgtc

SEQ ID NO: 414013 - DNA, 25 bp, Mus musculus
cgccctgggtagttttaagcatctg

SEQ ID NO: 414014 - DNA, 25 bp, Mus musculus
acgccctgggtagttttaagcatct

SEQ ID NO: 414015 - DNA, 25 bp, Mus musculus
tggctggtgtgtcctcggaggcgga

SEQ ID NO: 414016 - DNA, 25 bp, Mus musculus
agtgtgttgtgggagcggtgttcat

SEQ ID NO: 414017 - DNA, 25 bp, Mus musculus
caacgccctgggtagttttaagcat

SEQ ID NO: 414018 - DNA, 25 bp, Mus musculus
tggagaagatcctagctgacaagga

SEQ ID NO: 414019 - DNA, 25 bp, Mus musculus
ccggggccatgcaggaaagccagac

SEQ ID NO: 414020 - DNA, 25 bp, Mus musculus
agcactcccagctgcgtagggcctg

SEQ ID NO: 414021 - DNA, 25 bp, Mus musculus
cacgtggtcacgtgacgcgctgcaa

SEQ ID NO: 414022 - DNA, 25 bp, Mus musculus
gaccgacgctcagcagacgcagcga

SEQ ID NO: 414023 - DNA, 25 bp, Mus musculus
tctcttcctgacagggcggcgcgca

SEQ ID NO: 414024 - DNA, 25 bp, Mus musculus
gacaccgccagtcacgtggtcacgt

SEQ ID NO: 414025 - DNA, 25 bp, Mus musculus
gccatgcaggaaagccagaccaaga

SEQ ID NO: 414026 - DNA, 25 bp, Mus musculus
gccagaccaagagcatgttcgtgtc

SEQ ID NO: 414027 - DNA, 25 bp, Mus musculus
ccaagagcatgttcgtgtcccgggc

SEQ ID NO: 414028 - DNA, 25 bp, Mus musculus
tcctagctgacaaggaggtgaagcg

SEQ ID NO: 414029 - DNA, 25 bp, Mus musculus
tcacagggtcgaccgacgctcagca

SEQ ID NO: 414030 - DNA, 25 bp, Mus musculus
ggaccagcaccactcgcgtaggccc

SEQ ID NO: 414031 - DNA, 25 bp, Mus musculus
acgcgctgcaacttggcggcgccgt

SEQ ID NO: 414032 - DNA, 25 bp, Mus musculus
ggtggggccaaagcattcctggctc

SEQ ID NO: 414033 - DNA, 25 bp, Mus musculus
ccctcgggtttcagctggctgtgac

SEQ ID NO: 414034 - DNA, 25 bp, Mus musculus
tttggcctccgccagagtggacttg

SEQ ID NO: 414035 - DNA, 25 bp, Mus musculus
agatcgcccactctgacttcgcggg

SEQ ID NO: 414036 - DNA, 25 bp, Mus musculus
ctggttctaaaagaggccggagatc

SEQ ID NO: 414037 - DNA, 25 bp, Mus musculus
gcgtccgcggattggtcaagcccgc

SEQ ID NO: 414038 - DNA, 25 bp, Mus musculus
ttcccttccagcgttgctgggattg

SEQ ID NO: 414039 - DNA, 25 bp, Mus musculus
cttgggattccctcctcggtctcgg

SEQ ID NO: 414040 - DNA, 25 bp, Mus musculus
ttttgccagggtttgaatgtgaggc

SEQ ID NO: 414041 - DNA, 25 bp, Mus musculus
cggtctcactcgcacatgcgcagtg

SEQ ID NO: 414042 - DNA, 25 bp, Mus musculus
gcaatggttccgattggccctcgca

SEQ ID NO: 414043 - DNA, 25 bp, Mus musculus
gacgtcaccgcagacccgagcaatg

SEQ ID NO: 414044 - DNA, 25 bp, Mus musculus
aaaggcacggtctcttgtgacgtca

SEQ ID NO: 414045 - DNA, 25 bp, Mus musculus
tagccgccgcgccattttgccaggg

SEQ ID NO: 414046 - DNA, 25 bp, Mus musculus
gttaactccggcacagggcccacga

SEQ ID NO: 414047 - DNA, 25 bp, Mus musculus
gccgagccgggaattggcacctcat

SEQ ID NO: 414048 - DNA, 25 bp, Mus musculus
ggaattggcacctcatcccgcggct

SEQ ID NO: 414049 - DNA, 25 bp, Mus musculus
ctgtgcatagcaccgaaacccgggg

SEQ ID NO: 414050 - DNA, 25 bp, Mus musculus
acgcaaggcccacaagggccgggca

SEQ ID NO: 414051 - DNA, 25 bp, Mus musculus
tgacgccgtgcctgcgtgggtcctt

SEQ ID NO: 414052 - DNA, 25 bp, Mus musculus
agcaagtgaagacggcgaggaaaaa

SEQ ID NO: 414053 - DNA, 25 bp, Mus musculus
gggagcgcacacagacgcgacgaca

SEQ ID NO: 414054 - DNA, 25 bp, Mus musculus
gacgcgacgacagccagcgcaaacg

SEQ ID NO: 414055 - DNA, 25 bp, Mus musculus
cagcgcaaacgctgaagagcggctc

SEQ ID NO: 414056 - DNA, 25 bp, Mus musculus
tacacaccgcggcaggaaccacaag

SEQ ID NO: 414057 - DNA, 25 bp, Mus musculus
cgcatgcgctctctaggcacgcaag

SEQ ID NO: 414058 - DNA, 25 bp, Mus musculus
tctaggcacgcaaggcccacaaggg

SEQ ID NO: 414059 - DNA, 25 bp, Mus musculus
actggccgcgacactgtgcatagca

SEQ ID NO: 414060 - DNA, 25 bp, Mus musculus
ttttatgtttgtcgggtggcccagc

SEQ ID NO: 414061 - DNA, 25 bp, Mus musculus
gactcgcacacacagtggtcagacg

SEQ ID NO: 414062 - DNA, 25 bp, Mus musculus
ggactcgcacacacagtggtcagac

SEQ ID NO: 414063 - DNA, 25 bp, Mus musculus
gggactcgcacacacagtggtcaga

SEQ ID NO: 414064 - DNA, 25 bp, Mus musculus
tgggactcgcacacacagtggtcag

SEQ ID NO: 414065 - DNA, 25 bp, Mus musculus
gtgggactcgcacacacagtggtca

SEQ ID NO: 414066 - DNA, 25 bp, Mus musculus
ccgtgggactcgcacacacagtggt

SEQ ID NO: 414067 - DNA, 25 bp, Mus musculus
tgtcgggtggcccagcgagtggaca

SEQ ID NO: 414068 - DNA, 25 bp, Mus musculus
actcgcacacacagtggtcagacgg

SEQ ID NO: 414069 - DNA, 25 bp, Mus musculus
acgggtgggcagctcagggccatct

SEQ ID NO: 414070 - DNA, 25 bp, Mus musculus
acacacagtggtcagacgggtgggc

SEQ ID NO: 414071 - DNA, 25 bp, Mus musculus
cgcacacacagtggtcagacgggtg

SEQ ID NO: 414072 - DNA, 25 bp, Mus musculus
tcgcacacacagtggtcagacgggt

SEQ ID NO: 414073 - DNA, 25 bp, Mus musculus
ctcgcacacacagtggtcagacggg

SEQ ID NO: 414074 - DNA, 25 bp, Mus musculus
ccatcggcgagaatgacgaggtgcc

SEQ ID NO: 414075 - DNA, 25 bp, Mus musculus
caggcccgcgaagtctcaaagtgcc

SEQ ID NO: 414076 - DNA, 25 bp, Mus musculus
agcggaagtgacgtgaagcacatgc

SEQ ID NO: 414077 - DNA, 25 bp, Mus musculus
acgtgaagcacatgcgcgcgacgcc

SEQ ID NO: 414078 - DNA, 25 bp, Mus musculus
gccgcactcgctacgtccggaagtg

SEQ ID NO: 414079 - DNA, 25 bp, Mus musculus
tcaccaagctgtgcggagtcgaact

SEQ ID NO: 414080 - DNA, 25 bp, Mus musculus
acgtccggaagtggctgcttcttca

SEQ ID NO: 414081 - DNA, 25 bp, Mus musculus
ctgtgcggagtcgaacttcgcaggc

SEQ ID NO: 414082 - DNA, 25 bp, Mus musculus
tgcttcttcagcatgctggcggagc

SEQ ID NO: 414083 - DNA, 25 bp, Mus musculus
ttcatccggaccatcggcgagaatg

SEQ ID NO: 414084 - DNA, 25 bp, Mus musculus
agcccgagtcggactccggagacga

SEQ ID NO: 414085 - DNA, 25 bp, Mus musculus
catgcaggccgtgtcaccaagctgt

SEQ ID NO: 414086 - DNA, 25 bp, Mus musculus
aggccctcctcagcgtgctcaggtg

SEQ ID NO: 414087 - DNA, 25 bp, Mus musculus
agctcggcttcatccggaccatcgg

SEQ ID NO: 414088 - DNA, 25 bp, Mus musculus
gtcctcctcttgctggatctgccgg

SEQ ID NO: 414089 - DNA, 25 bp, Mus musculus
ctcacacttgaccaactcgttgttg

SEQ ID NO: 414090 - DNA, 25 bp, Mus musculus
ttctgcgatggtccggtcaaactcg

SEQ ID NO: 414091 - DNA, 25 bp, Mus musculus
gagctgcctcacctcattctgtagc

SEQ ID NO: 414092 - DNA, 25 bp, Mus musculus
ctcgttgttgtagttctgcagcgcc

SEQ ID NO: 414093 - DNA, 25 bp, Mus musculus
ttcagtgcccgacgctcacacttga

SEQ ID NO: 414094 - DNA, 25 bp, Mus musculus
tcgtgaggcatgtccacgcagcctc

SEQ ID NO: 414095 - DNA, 25 bp, Mus musculus
accagcaatgacagaggggcaggcc

SEQ ID NO: 414096 - DNA, 25 bp, Mus musculus
tgacacaactcctcgatgcctaggg

SEQ ID NO: 414097 - DNA, 25 bp, Mus musculus
tctgtagccgctgcttttcgtcctc

SEQ ID NO: 414098 - DNA, 25 bp, Mus musculus
gcgggccaacttctccgtgagctgc

SEQ ID NO: 414099 - DNA, 25 bp, Mus musculus
aggttctcgttgacgcgggccaact

SEQ ID NO: 414100 - DNA, 25 bp, Mus musculus
aactcgttgcgagaggcgatcttgc

SEQ ID NO: 414101 - DNA, 25 bp, Mus musculus
tgaacgtcacggctgcgccacaggt

SEQ ID NO: 414102 - DNA, 25 bp, Mus musculus
ttgttcccgatatgtctcgtccctc

SEQ ID NO: 414103 - DNA, 25 bp, Mus musculus
aagcgacgcgccatgggcacagtgc

SEQ ID NO: 414104 - DNA, 25 bp, Mus musculus
gagcgtttgctttgttcccgatatg

SEQ ID NO: 414105 - DNA, 25 bp, Mus musculus
atataaggaaggttcgccgccgctc

SEQ ID NO: 414106 - DNA, 25 bp, Mus musculus
gcacgcgccgccaaggtctatataa

SEQ ID NO: 414107 - DNA, 25 bp, Mus musculus
acatggcgcggaagccgagaagccc

SEQ ID NO: 414108 - DNA, 25 bp, Mus musculus
aaccattagctagctggggccgggc

SEQ ID NO: 414109 - DNA, 25 bp, Mus musculus
acatttcccaggacgccaagcggtc

SEQ ID NO: 414110 - DNA, 25 bp, Mus musculus
gggctagacactggctggacaacca

SEQ ID NO: 414111 - DNA, 25 bp, Mus musculus
cgtgatagggcggaggccactcacc

SEQ ID NO: 414112 - DNA, 25 bp, Mus musculus
gcgcgtcctccgcagggctagagct

SEQ ID NO: 414113 - DNA, 25 bp, Mus musculus
ggcggctcctagagcgtttgctttg

SEQ ID NO: 414114 - DNA, 25 bp, Mus musculus
tcgtgcgtgccaagcgcgacatggc

SEQ ID NO: 414115 - DNA, 25 bp, Mus musculus
gaactttcggtttccagtccctgca

SEQ ID NO: 414116 - DNA, 25 bp, Mus musculus
gctgcgcctcctctgttcctaagag

SEQ ID NO: 414117 - DNA, 25 bp, Mus musculus
gtcgatgctagacatgctgcgcatg

SEQ ID NO: 414118 - DNA, 25 bp, Mus musculus
ccgtggcgcagctgatgaagctgtc

SEQ ID NO: 414119 - DNA, 25 bp, Mus musculus
agaatctggtggcttcagggaagtc

SEQ ID NO: 414120 - DNA, 25 bp, Mus musculus
ccagacttgccggagagggatgcca

SEQ ID NO: 414121 - DNA, 25 bp, Mus musculus
gttggtctccatgagtctcccgccg

SEQ ID NO: 414122 - DNA, 25 bp, Mus musculus
ggggctctccacgaagaaaccagag

SEQ ID NO: 414123 - DNA, 25 bp, Mus musculus
ggttgtgggtcttcatggaactccg

SEQ ID NO: 414124 - DNA, 25 bp, Mus musculus
tgcgcatgtcgatgacgccctctgt

SEQ ID NO: 414125 - DNA, 25 bp, Mus musculus
ggcatgctgcccatctccagttctt

SEQ ID NO: 414126 - DNA, 25 bp, Mus musculus
gaagttaaccttgagcgctcgcagc

SEQ ID NO: 414127 - DNA, 25 bp, Mus musculus
tgggatcgccctccaggaagttaac

SEQ ID NO: 414128 - DNA, 25 bp, Mus musculus
atacaagcccagagccggtagcagc

SEQ ID NO: 414129 - DNA, 25 bp, Mus musculus
tcctaagaggatcgtgatacaagcc

SEQ ID NO: 414130 - DNA, 25 bp, Mus musculus
tcccggcgatggctttttataactc

SEQ ID NO: 414131 - DNA, 25 bp, Mus musculus
cagcggaatcttctggcctttcgga

SEQ ID NO: 414132 - DNA, 25 bp, Mus musculus
gactgtggaggctaccagatgccca

SEQ ID NO: 414133 - DNA, 25 bp, Mus musculus
gggcttgctttttctaaatcttaga

SEQ ID NO: 414134 - DNA, 25 bp, Mus musculus
tcaagattttgggtgggagcataac

SEQ ID NO: 414135 - DNA, 25 bp, Mus musculus
tataactccgggttctgcgcctttg

SEQ ID NO: 414136 - DNA, 25 bp, Mus musculus
tccgtcccgtcgagtgctgaaactc

SEQ ID NO: 414137 - DNA, 25 bp, Mus musculus
aggacggatggctgctgttcctccc

SEQ ID NO: 414138 - DNA, 25 bp, Mus musculus
cttcccaaggcttaagcggctcagg

SEQ ID NO: 414139 - DNA, 25 bp, Mus musculus
cagaaagcgaaagcggacacgggtc

SEQ ID NO: 414140 - DNA, 25 bp, Mus musculus
cacgggtcagcgaaccgtactgtga

SEQ ID NO: 414141 - DNA, 25 bp, Mus musculus
ttcctcccgccggtgctgaagtcag

SEQ ID NO: 414142 - DNA, 25 bp, Mus musculus
catcccgacggctgcgaggcagaaa

SEQ ID NO: 414143 - DNA, 25 bp, Mus musculus
tgaaactccctgctctcgggctgga

SEQ ID NO: 414144 - DNA, 25 bp, Mus musculus
tagtaccaacactgtccgggtccca

SEQ ID NO: 414145 - DNA, 25 bp, Mus musculus
accgtggccaggcatcgcggccagt

SEQ ID NO: 414146 - DNA, 25 bp, Mus musculus
cgatcagtgtgaccgtggccaggca

SEQ ID NO: 414147 - DNA, 25 bp, Mus musculus
ccgggatggagccacagaaagtcta

SEQ ID NO: 414148 - DNA, 25 bp, Mus musculus
cacagaaagtctaggagtccagggc

SEQ ID NO: 414149 - DNA, 25 bp, Mus musculus
aggctacagagtgggtagtaccaac

SEQ ID NO: 414150 - DNA, 25 bp, Mus musculus
gccgaccctgaatttcacctggcgt

SEQ ID NO: 414151 - DNA, 25 bp, Mus musculus
tgaatttcacctggcgtcctttccg

SEQ ID NO: 414152 - DNA, 25 bp, Mus musculus
gcaccctgacgggtcacggggaata

SEQ ID NO: 414153 - DNA, 25 bp, Mus musculus
tcacggggaatactcaccgcgcgcg

SEQ ID NO: 414154 - DNA, 25 bp, Mus musculus
acagcaatagcacggccaggaggcc

SEQ ID NO: 414155 - DNA, 25 bp, Mus musculus
tgcagggtggcaacaagtcaccgcc

SEQ ID NO: 414156 - DNA, 25 bp, Mus musculus
tccgactggaaaacgtggatggaga

SEQ ID NO: 414157 - DNA, 25 bp, Mus musculus
cgtgggacaccgtgcaggctacaga

SEQ ID NO: 414158 - DNA, 25 bp, Mus musculus
ggcctgatgttaagggtgcctccgc

SEQ ID NO: 414159 - DNA, 25 bp, Mus musculus
acgaagtagagcagcgaggacgaca

SEQ ID NO: 414160 - DNA, 25 bp, Mus musculus
agggtcgccttcctacctatgccgg

SEQ ID NO: 414161 - DNA, 25 bp, Mus musculus
ccgggcgccacatagacgaagtaga

SEQ ID NO: 414162 - DNA, 25 bp, Mus musculus
taccagacctgaggcaggcctgatg

SEQ ID NO: 414163 - DNA, 25 bp, Mus musculus
ggtgcctccgcgagcctgagaacac

SEQ ID NO: 414164 - DNA, 25 bp, Mus musculus
gggccgggagcataacaagcatttt

SEQ ID NO: 414165 - DNA, 25 bp, Mus musculus
aacaagcattttgcgggagcctgag

SEQ ID NO: 414166 - DNA, 25 bp, Mus musculus
ggttcacgcgcgagcactctagccg

SEQ ID NO: 414167 - DNA, 25 bp, Mus musculus
actctagccgcaagatcctcgagcg

SEQ ID NO: 414168 - DNA, 25 bp, Mus musculus
tcgctagtacgacttggttcccgtg

SEQ ID NO: 414169 - DNA, 25 bp, Mus musculus
tgtgtgaatagccaggtagcccgcc

SEQ ID NO: 414170 - DNA, 25 bp, Mus musculus
cgccgctgcagcagagcaaggatgc

SEQ ID NO: 414171 - DNA, 25 bp, Mus musculus
ccgacgaccagaggagctcagcggc

SEQ ID NO: 414172 - DNA, 25 bp, Mus musculus
ctcccaggccacagagaggacagcg

SEQ ID NO: 414173 - DNA, 25 bp, Mus musculus
cggcgccgaactctgtagtctcgga

SEQ ID NO: 414174 - DNA, 25 bp, Mus musculus
tgtagtctcggaagctcgcaggata

SEQ ID NO: 414175 - DNA, 25 bp, Mus musculus
tggccggaaaaagcccacagaaagc

SEQ ID NO: 414176 - DNA, 25 bp, Mus musculus
gacattgctgaccacgcgcaggcct

SEQ ID NO: 414177 - DNA, 25 bp, Mus musculus
cggacggcttggctcacagctgagt

SEQ ID NO: 414178 - DNA, 25 bp, Mus musculus
cctcccggaggtccgacattgctga

SEQ ID NO: 414179 - DNA, 25 bp, Mus musculus
tcgtcacacagcctggccggaaaaa

SEQ ID NO: 414180 - DNA, 25 bp, Mus musculus
gtcccaaggccagatcgtcacacag

SEQ ID NO: 414181 - DNA, 25 bp, Mus musculus
aaagtccggatgtcccaaggccaga

SEQ ID NO: 414182 - DNA, 25 bp, Mus musculus
gagtcacccagatctcaaaagtttc

SEQ ID NO: 414183 - DNA, 25 bp, Mus musculus
ggctcacagctgagtcacccagatc

SEQ ID NO: 414184 - DNA, 25 bp, Mus musculus
ggaagccgcgaacgtccttcctgct

SEQ ID NO: 414185 - DNA, 25 bp, Mus musculus
ccagatctcaaaagtttcctccaaa

SEQ ID NO: 414186 - DNA, 25 bp, Mus musculus
ctcctccatagaccgggagaccaag

SEQ ID NO: 414187 - DNA, 25 bp, Mus musculus
gggacctgtcataacatcgctgctg

SEQ ID NO: 414188 - DNA, 25 bp, Mus musculus
caaggatcccgaagcagagcgactc

SEQ ID NO: 414189 - DNA, 25 bp, Mus musculus
ggtcactcggtaaatccaaagctag

SEQ ID NO: 414190 - DNA, 25 bp, Mus musculus
tccctactgagagccatagcgcggt

SEQ ID NO: 414191 - DNA, 25 bp, Mus musculus
aaagcgagcgcctccaaagcacagg

SEQ ID NO: 414192 - DNA, 25 bp, Mus musculus
aagcagcccggaagtatttgttccg

SEQ ID NO: 414193 - DNA, 25 bp, Mus musculus
tagaaccggacctcactcctaggga

SEQ ID NO: 414194 - DNA, 25 bp, Mus musculus
ggcacgagcggaacccggaagcaaa

SEQ ID NO: 414195 - DNA, 25 bp, Mus musculus
cccggaagcaaattaactggaagtg

SEQ ID NO: 414196 - DNA, 25 bp, Mus musculus
aagtgacgcgcggagcttcaccgac

SEQ ID NO: 414197 - DNA, 25 bp, Mus musculus
catggaaacaggttgctgagcgagc

SEQ ID NO: 414198 - DNA, 25 bp, Mus musculus
agggcaagcgcttctccgtagaacc

SEQ ID NO: 414199 - DNA, 25 bp, Mus musculus
tgtcactgaaataccgggacctgtc

SEQ ID NO: 414200 - DNA, 25 bp, Mus musculus
ccgggtgaatcaaagtgcaagtgtc

SEQ ID NO: 414201 - DNA, 25 bp, Mus musculus
cccgtgtgcctggaagtattcgaga

SEQ ID NO: 414202 - DNA, 25 bp, Mus musculus
gggacgccatctacacacctggtgg

SEQ ID NO: 414203 - DNA, 25 bp, Mus musculus
ggtgggcggcagctttcaaaagctc

SEQ ID NO: 414204 - DNA, 25 bp, Mus musculus
ggcgttgtggactccgcccatctca

SEQ ID NO: 414205 - DNA, 25 bp, Mus musculus
cgacgctcctcagcggcaagatggc

SEQ ID NO: 414206 - DNA, 25 bp, Mus musculus
tcagccgctttacgtgtcccgtgtg

SEQ ID NO: 414207 - DNA, 25 bp, Mus musculus
ttccctggctcctgtgaccgcttag

SEQ ID NO: 414208 - DNA, 25 bp, Mus musculus
accgcttagcgggatttgaatccca

SEQ ID NO: 414209 - DNA, 25 bp, Mus musculus
aagagcctgaggatgctcgaccacg

SEQ ID NO: 414210 - DNA, 25 bp, Mus musculus
tgccgctcacccaggaatcgggctt

SEQ ID NO: 414211 - DNA, 25 bp, Mus musculus
tgcaagtgtcaagggtcgctcattc

SEQ ID NO: 414212 - DNA, 25 bp, Mus musculus
gagtgccagcctttttccgggtgaa

SEQ ID NO: 414213 - DNA, 25 bp, Mus musculus
cagcacccttttttgggcgcacagg

SEQ ID NO: 414214 - DNA, 25 bp, Mus musculus
tgtgcctcttctgcgggctcagact

SEQ ID NO: 414215 - DNA, 25 bp, Mus musculus
ggacgaactttgcaaaaccggctga

SEQ ID NO: 414216 - DNA, 25 bp, Mus musculus
tgcaaaaccggctgagccacggagc

SEQ ID NO: 414217 - DNA, 25 bp, Mus musculus
ggggatcggaacactcagcgcttac

SEQ ID NO: 414218 - DNA, 25 bp, Mus musculus
gaacactcagcgcttacctggtctc

SEQ ID NO: 414219 - DNA, 25 bp, Mus musculus
cccacagctggacgatggagactgc

SEQ ID NO: 414220 - DNA, 25 bp, Mus musculus
ggacgatggagactgcttcttcttg

SEQ ID NO: 414221 - DNA, 25 bp, Mus musculus
gcttcttcttggagcgccagatatg

SEQ ID NO: 414222 - DNA, 25 bp, Mus musculus
tcgccctgcgatggtggcgacaacg

SEQ ID NO: 414223 - DNA, 25 bp, Mus musculus
ggcatctcctcttgtgcctcttctg

SEQ ID NO: 414224 - DNA, 25 bp, Mus musculus
gaagaactcacctgggcgctcgctt

SEQ ID NO: 414225 - DNA, 25 bp, Mus musculus
ttaaaggacagcgactaagcaaggc

SEQ ID NO: 414226 - DNA, 25 bp, Mus musculus
ccctaccggacatgtcgggaactgc

SEQ ID NO: 414227 - DNA, 25 bp, Mus musculus
cgatggtggcgacaacggcatctcc

SEQ ID NO: 414228 - DNA, 25 bp, Mus musculus
tccaccagggggagaaggatgcata

SEQ ID NO: 414229 - DNA, 25 bp, Mus musculus
tggtggctcacgtcggtaatctccg

SEQ ID NO: 414230 - DNA, 25 bp, Mus musculus
tctcttttcattgcgtggtggctca

SEQ ID NO: 414231 - DNA, 25 bp, Mus musculus
aagtgtctcttttcattgcgtggtg

SEQ ID NO: 414232 - DNA, 25 bp, Mus musculus
accggtgtgagacggaaaagtgtct

SEQ ID NO: 414233 - DNA, 25 bp, Mus musculus
agttacaactcctgcatgggaccgg

SEQ ID NO: 414234 - DNA, 25 bp, Mus musculus
actcagcggagctctccaccagggg

SEQ ID NO: 414235 - DNA, 25 bp, Mus musculus
taagcgaagcacgagctggagaatc

SEQ ID NO: 414236 - DNA, 25 bp, Mus musculus
tctgcgcagactagtaagcgaagca

SEQ ID NO: 414237 - DNA, 25 bp, Mus musculus
cgtggatctgcgcagactagtaagc

SEQ ID NO: 414238 - DNA, 25 bp, Mus musculus
atcgaacgtggatctgcgcagacta

SEQ ID NO: 414239 - DNA, 25 bp, Mus musculus
ccctgaatcgaacgtggatctgcgc

SEQ ID NO: 414240 - DNA, 25 bp, Mus musculus
ctggagaatcactcagcggagctct

SEQ ID NO: 414241 - DNA, 25 bp, Mus musculus
caactcctgcatgggaccggtgtga

SEQ ID NO: 414242 - DNA, 25 bp, Mus musculus
gaagcgggtcactagttacaactcc

SEQ ID NO: 414243 - DNA, 25 bp, Mus musculus
agaccctgcagaaacagcgcgagtg

SEQ ID NO: 414244 - DNA, 25 bp, Mus musculus
ccgtgactgcgagcgaccttacgca

SEQ ID NO: 414245 - DNA, 25 bp, Mus musculus
tccacgcatggaccagagccttgtg

SEQ ID NO: 414246 - DNA, 25 bp, Mus musculus
agccttgtgggtaggcagcatctcc

SEQ ID NO: 414247 - DNA, 25 bp, Mus musculus
gcatctcctgcacttctacagaaga

SEQ ID NO: 414248 - DNA, 25 bp, Mus musculus
ccgaccaagccgttccaggacaaag

SEQ ID NO: 414249 - DNA, 25 bp, Mus musculus
tccaggacaaagttcctaggaacgc

SEQ ID NO: 414250 - DNA, 25 bp, Mus musculus
caagggcgagccagtcaaaagctgg

SEQ ID NO: 414251 - DNA, 25 bp, Mus musculus
tcgtacctgagggaggtgactcctc

SEQ ID NO: 414252 - DNA, 25 bp, Mus musculus
cagcagacgctagacagaggtggta

SEQ ID NO: 414253 - DNA, 25 bp, Mus musculus
tagtgcgctctgtcttccaggaaac

SEQ ID NO: 414254 - DNA, 25 bp, Mus musculus
ccctgaagtttctgcgcttctgaga

SEQ ID NO: 414255 - DNA, 25 bp, Mus musculus
gagacttctctctaagctcggcttc

SEQ ID NO: 414256 - DNA, 25 bp, Mus musculus
atccaccgagggtgtctttgacccg

SEQ ID NO: 414257 - DNA, 25 bp, Mus musculus
cctcatctgggactctctcctggta

SEQ ID NO: 414258 - DNA, 25 bp, Mus musculus
gccagccattggctcagccttgaca

SEQ ID NO: 414259 - DNA, 25 bp, Mus musculus
gtctcttctcttcccgcagagttca

SEQ ID NO: 414260 - DNA, 25 bp, Mus musculus
tgacaaaggggcgtgaccaacagta

SEQ ID NO: 414261 - DNA, 25 bp, Mus musculus
cagccctggtacttaaaggaatttg

SEQ ID NO: 414262 - DNA, 25 bp, Mus musculus
aatttgctgctgctaggggatcgta

SEQ ID NO: 414263 - DNA, 25 bp, Mus musculus
gagttgactaccgaccttgcgcgac

SEQ ID NO: 414264 - DNA, 25 bp, Mus musculus
ctaggtcgctctggccaacatgccg

SEQ ID NO: 414265 - DNA, 25 bp, Mus musculus
ttcctggtcaggaagccgtccgacc

SEQ ID NO: 414266 - DNA, 25 bp, Mus musculus
gagaatccgctcagctgactccctg

SEQ ID NO: 414267 - DNA, 25 bp, Mus musculus
tagagctgacctcgctgtccgatga

SEQ ID NO: 414268 - DNA, 25 bp, Mus musculus
tccgatgaggacagtggcaaaagct

SEQ ID NO: 414269 - DNA, 25 bp, Mus musculus
agcccaactatagcgagctgcagga

SEQ ID NO: 414270 - DNA, 25 bp, Mus musculus
gtgaacggcctgttctgccctgtgc

SEQ ID NO: 414271 - DNA, 25 bp, Mus musculus
cgggtccgagaagaaaggcagcctt

SEQ ID NO: 414272 - DNA, 25 bp, Mus musculus
ctgcctggctccagcctgctggctc

SEQ ID NO: 414273 - DNA, 25 bp, Mus musculus
tcagccagccttggggtgaacggcc

SEQ ID NO: 414274 - DNA, 25 bp, Mus musculus
acggacggcaatccctcgtgcctgg

SEQ ID NO: 414275 - DNA, 25 bp, Mus musculus
cctgttctgccctgtgcccgggagg

SEQ ID NO: 414276 - DNA, 25 bp, Mus musculus
gctttatcaaaagcggctgtgagga

SEQ ID NO: 414277 - DNA, 25 bp, Mus musculus
cgcacagaggggctttatcaaaagc

SEQ ID NO: 414278 - DNA, 25 bp, Mus musculus
cccacgcacagaggggctttatcaa

SEQ ID NO: 414279 - DNA, 25 bp, Mus musculus
gcctccagatgtgcgctggctccag

SEQ ID NO: 414280 - DNA, 25 bp, Mus musculus
gcctctgctggcctccagatgtgcg

SEQ ID NO: 414281 - DNA, 25 bp, Mus musculus
aagaaaggcagccttgtgggcgaaa

SEQ ID NO: 414282 - DNA, 25 bp, Mus musculus
gtccgagaagaaaggcagccttgtg

SEQ ID NO: 414283 - DNA, 25 bp, Mus musculus
ccggcttcggatttcagccagcctt

SEQ ID NO: 414284 - DNA, 25 bp, Mus musculus
ggcgcgctgctatacctagatctga

SEQ ID NO: 414285 - DNA, 25 bp, Mus musculus
tgttgcaatggctggacctgagctc

SEQ ID NO: 414286 - DNA, 25 bp, Mus musculus
cagctggaaactctgcctcctggca

SEQ ID NO: 414287 - DNA, 25 bp, Mus musculus
tgggcccgcttccattactgcgagt

SEQ ID NO: 414288 - DNA, 25 bp, Mus musculus
tcagcctgcaggacaattcactatc

SEQ ID NO: 414289 - DNA, 25 bp, Mus musculus
cactatcggcaatcgaggcgggttt

SEQ ID NO: 414290 - DNA, 25 bp, Mus musculus
ctgccctcgatgtgttgcgcttgca

SEQ ID NO: 414291 - DNA, 25 bp, Mus musculus
ccctttgcacttggctgcgtaagca

SEQ ID NO: 414292 - DNA, 25 bp, Mus musculus
gtgtcccgcagaaactgagaccctg

SEQ ID NO: 414293 - DNA, 25 bp, Mus musculus
agaccctgctctgcgtgtctccaag

SEQ ID NO: 414294 - DNA, 25 bp, Mus musculus
tactgacagcttttccggatgccgc

SEQ ID NO: 414295 - DNA, 25 bp, Mus musculus
tcagtcactagcagcgcgagacctg

SEQ ID NO: 414296 - DNA, 25 bp, Mus musculus
gccgccttcaaacagtgcactcagt

SEQ ID NO: 414297 - DNA, 25 bp, Mus musculus
ttgctgaataacttgcctgccctcg

SEQ ID NO: 414298 - DNA, 25 bp, Mus musculus
tcaccacgtagcgaaaatgaaaccg

SEQ ID NO: 414299 - DNA, 25 bp, Mus musculus
atttccctgggaagcgaccaccacg

SEQ ID NO: 414300 - DNA, 25 bp, Mus musculus
agcgaccaccacgatgagagcagcc

SEQ ID NO: 414301 - DNA, 25 bp, Mus musculus
tgttccctagggttgcgcccgcgta

SEQ ID NO: 414302 - DNA, 25 bp, Mus musculus
tcagcccgtgcaggtgcccggattt

SEQ ID NO: 414303 - DNA, 25 bp, Mus musculus
ttctgaaacctatccctggtctctg

SEQ ID NO: 414304 - DNA, 25 bp, Mus musculus
atggcctccgctagaccgggaccaa

SEQ ID NO: 414305 - DNA, 25 bp, Mus musculus
cctgtgtcctcaccacgtagcgaaa

SEQ ID NO: 414306 - DNA, 25 bp, Mus musculus
gcgcctgttcccaggctgtttccgt

SEQ ID NO: 414307 - DNA, 25 bp, Mus musculus
cccgagtcttcagtgagcgagcatg

SEQ ID NO: 414308 - DNA, 25 bp, Mus musculus
gcgcagccgcaaacggtgccgctga

SEQ ID NO: 414309 - DNA, 25 bp, Mus musculus
ccttgagtttttctccgggcgctag

SEQ ID NO: 414310 - DNA, 25 bp, Mus musculus
catcttgcgtcgctgtcgctcgaag

SEQ ID NO: 414311 - DNA, 25 bp, Mus musculus
gcagccaaacgcagccgcagggaca

SEQ ID NO: 414312 - DNA, 25 bp, Mus musculus
gcagatcgtgcattcgctaggaagc

SEQ ID NO: 414313 - DNA, 25 bp, Mus musculus
gaagcgcctacggagtgcatggcta

SEQ ID NO: 414314 - DNA, 25 bp, Mus musculus
catggctactgcagatcgtgcattc

SEQ ID NO: 414315 - DNA, 25 bp, Mus musculus
cgccgagcacccatcagatcgcagg

SEQ ID NO: 414316 - DNA, 25 bp, Mus musculus
acggggcagcacatcggctgcacgc

SEQ ID NO: 414317 - DNA, 25 bp, Mus musculus
cgcgaactcgcgtaccgcgctggag

SEQ ID NO: 414318 - DNA, 25 bp, Mus musculus
cagctggacgcagctggacgcggaa

SEQ ID NO: 414319 - DNA, 25 bp, Mus musculus
aggccttcgggcctcagccaaccgc

SEQ ID NO: 414320 - DNA, 25 bp, Mus musculus
gcggcgatatcacgccgcccaatga

SEQ ID NO: 414321 - DNA, 25 bp, Mus musculus
ggagtacgcgctgcgaagcgcctac

SEQ ID NO: 414322 - DNA, 25 bp, Mus musculus
cggccctccgccgtctcgtcctcgt

SEQ ID NO: 414323 - DNA, 25 bp, Mus musculus
atccgtcctacctggcgagtaaagc

SEQ ID NO: 414324 - DNA, 25 bp, Mus musculus
gatcgcaggccctccatccgtccta

SEQ ID NO: 414325 - DNA, 25 bp, Mus musculus
gcctacggagtgcatggctactgca

SEQ ID NO: 414326 - DNA, 25 bp, Mus musculus
ggccaagatgcgcaacctggagacg

SEQ ID NO: 414327 - DNA, 25 bp, Mus musculus
aagtggccaacttctactacgagcc

SEQ ID NO: 414328 - DNA, 25 bp, Mus musculus
ccgagccggccattggcgagcacga

SEQ ID NO: 414329 - DNA, 25 bp, Mus musculus
agccgagcaagaagccggccgacta

SEQ ID NO: 414330 - DNA, 25 bp, Mus musculus
actacggttacgtgagcctcggccg

SEQ ID NO: 414331 - DNA, 25 bp, Mus musculus
ttcgaacccgcggactgcaagcgcg

SEQ ID NO: 414332 - DNA, 25 bp, Mus musculus
tacctgggctaccaggcgacgccga

SEQ ID NO: 414333 - DNA, 25 bp, Mus musculus
ggcagcctgtccacgtcgtcgtcgt

SEQ ID NO: 414334 - DNA, 25 bp, Mus musculus
ctgagcgacgagtacaagatgcggc

SEQ ID NO: 414335 - DNA, 25 bp, Mus musculus
gctcagcaccctgcggaacttgttc

SEQ ID NO: 414336 - DNA, 25 bp, Mus musculus
acctggagacgcagcacaaggtgct

SEQ ID NO: 414337 - DNA, 25 bp, Mus musculus
cgccgcctttagacccatggaagtg

SEQ ID NO: 414338 - DNA, 25 bp, Mus musculus
caagaagacggtggacaagctgagc

SEQ ID NO: 414339 - DNA, 25 bp, Mus musculus
cgactgcctggcctacggggccaag

SEQ ID NO: 414340 - DNA, 25 bp, Mus musculus
ttcccagatttcacaacccgggctg

SEQ ID NO: 414341 - DNA, 25 bp, Mus musculus
ggtaccccgtgtgcctgctggccgt

SEQ ID NO: 414342 - DNA, 25 bp, Mus musculus
gcttccctttcccagacggccatcc

SEQ ID NO: 414343 - DNA, 25 bp, Mus musculus
tggcccacaagattcccagatttca

SEQ ID NO: 414344 - DNA, 25 bp, Mus musculus
gctgacgcagctgtgacgtcagagc

SEQ ID NO: 414345 - DNA, 25 bp, Mus musculus
cagatttcacaacccgggctggcgc

SEQ ID NO: 414346 - DNA, 25 bp, Mus musculus
gctggcgctgactcacgtacagtaa

SEQ ID NO: 414347 - DNA, 25 bp, Mus musculus
cgctgactcacgtacagtaagttcg

SEQ ID NO: 414348 - DNA, 25 bp, Mus musculus
cacgtacagtaagttcggggagaga

SEQ ID NO: 414349 - DNA, 25 bp, Mus musculus
tcggggagagaaactcccggctgcc

SEQ ID NO: 414350 - DNA, 25 bp, Mus musculus
gcctggcgtcccgtcctgggacaag

SEQ ID NO: 414351 - DNA, 25 bp, Mus musculus
tggcgtcccgtcctgggacaagccg

SEQ ID NO: 414352 - DNA, 25 bp, Mus musculus
cggctgctgacgcagctgtgacgtc

SEQ ID NO: 414353 - DNA, 25 bp, Mus musculus
tggcctggcccacaagattcccaga

SEQ ID NO: 414354 - DNA, 25 bp, Mus musculus
gcggctcgtgagcatcaaggcttca

SEQ ID NO: 414355 - DNA, 25 bp, Mus musculus
cgatgttcgttcacgcgggaacttc

SEQ ID NO: 414356 - DNA, 25 bp, Mus musculus
tgcccacccgatcgatgttcgttca

SEQ ID NO: 414357 - DNA, 25 bp, Mus musculus
cgcaaatgcccacccgatcgatgtt

SEQ ID NO: 414358 - DNA, 25 bp, Mus musculus
cgcagtatcgttccgcaaatgccca

SEQ ID NO: 414359 - DNA, 25 bp, Mus musculus
tcatggaccgcagtatcgttccgca

SEQ ID NO: 414360 - DNA, 25 bp, Mus musculus
cgcctggaactgctcatggaccgca

SEQ ID NO: 414361 - DNA, 25 bp, Mus musculus
gcagcgccttccgaccgctgggaag

SEQ ID NO: 414362 - DNA, 25 bp, Mus musculus
ggttcaaacagtgcgtcaccggctc

SEQ ID NO: 414363 - DNA, 25 bp, Mus musculus
cgactggatgagcttggttcaaaca

SEQ ID NO: 414364 - DNA, 25 bp, Mus musculus
ggagaccgaccgactggatgagctt

SEQ ID NO: 414365 - DNA, 25 bp, Mus musculus
gaagcaacctaacctgggagaccga

SEQ ID NO: 414366 - DNA, 25 bp, Mus musculus
gcttcagaagcaacctaacctggga

SEQ ID NO: 414367 - DNA, 25 bp, Mus musculus
cgtgagcatcaaggcttcagaagca

SEQ ID NO: 414368 - DNA, 25 bp, Mus musculus
cgcagcaagtctgctcctcgggttc

SEQ ID NO: 414369 - DNA, 25 bp, Mus musculus
ggggactcctgtcgcgcatcctcgt

SEQ ID NO: 414370 - DNA, 25 bp, Mus musculus
gcggctatttaccaggtgcggagcc

SEQ ID NO: 414371 - DNA, 25 bp, Mus musculus
aactgggcggctatttaccaggtgc

SEQ ID NO: 414372 - DNA, 25 bp, Mus musculus
agaaggagttcgaggagatcgacaa

SEQ ID NO: 414373 - DNA, 25 bp, Mus musculus
acccgtcccgccatggagatggaga

SEQ ID NO: 414374 - DNA, 25 bp, Mus musculus
tgaggctcgaactcaggatactccc

SEQ ID NO: 414375 - DNA, 25 bp, Mus musculus
tgggaactcgggcagccgacccgtc

SEQ ID NO: 414376 - DNA, 25 bp, Mus musculus
cggcttgacatgcagaagccgctgc

SEQ ID NO: 414377 - DNA, 25 bp, Mus musculus
cgtacttccggctgccggcttgaca

SEQ ID NO: 414378 - DNA, 25 bp, Mus musculus
tcctcccgtacagagggcggagctc

SEQ ID NO: 414379 - DNA, 25 bp, Mus musculus
tagctgactggtcctcccgtacaga

SEQ ID NO: 414380 - DNA, 25 bp, Mus musculus
gccgccttttcgctagctgactggt

SEQ ID NO: 414381 - DNA, 25 bp, Mus musculus
tcaaccggcgggcttgaggctcgaa

SEQ ID NO: 414382 - DNA, 25 bp, Mus musculus
gttctgggaatgcactcggtggccc

SEQ ID NO: 414383 - DNA, 25 bp, Mus musculus
gcgacgacactcaccgtggagccgg

SEQ ID NO: 414384 - DNA, 25 bp, Mus musculus
acactcaccgtggagccggtctgga

SEQ ID NO: 414385 - DNA, 25 bp, Mus musculus
cggtctggacctccgggaccgagct

SEQ ID NO: 414386 - DNA, 25 bp, Mus musculus
gcgccggctggttgtcactgaccgc

SEQ ID NO: 414387 - DNA, 25 bp, Mus musculus
tccctgcagccctctgaccaccgcg

SEQ ID NO: 414388 - DNA, 25 bp, Mus musculus
ccaccgcggatgctggttctgggaa

SEQ ID NO: 414389 - DNA, 25 bp, Mus musculus
ccctgtatccggctgttcccggctc

SEQ ID NO: 414390 - DNA, 25 bp, Mus musculus
tctggccgctgcgatagagcttatc

SEQ ID NO: 414391 - DNA, 25 bp, Mus musculus
gccgctgcgatagagcttatctggc

SEQ ID NO: 414392 - DNA, 25 bp, Mus musculus
gatagagcttatctggcgggtgtca

SEQ ID NO: 414393 - DNA, 25 bp, Mus musculus
cggatgccgcgctggcccgtcgtat

SEQ ID NO: 414394 - DNA, 25 bp, Mus musculus
cccgtcgtatcaccgcgctgcgcgg

SEQ ID NO: 414395 - DNA, 25 bp, Mus musculus
ctgaccaccgcggatgctggttctg

SEQ ID NO: 414396 - DNA, 25 bp, Mus musculus
cccgtcctcaggaatgtgcgggagc

SEQ ID NO: 414397 - DNA, 25 bp, Mus musculus
gaccgttcctgccacgaagccggag

SEQ ID NO: 414398 - DNA, 25 bp, Mus musculus
cgttcctgccacgaagccggagggt

SEQ ID NO: 414399 - DNA, 25 bp, Mus musculus
cagctttcccatataaggccgggcc

SEQ ID NO: 414400 - DNA, 25 bp, Mus musculus
ccaggcacagcaatggcgcgcacgg

SEQ ID NO: 414401 - DNA, 25 bp, Mus musculus
cagtcagctgggcacagctttccca

SEQ ID NO: 414402 - DNA, 25 bp, Mus musculus
ccctgtcccgtgcagcccaccaccc

SEQ ID NO: 414403 - DNA, 25 bp, Mus musculus
gcagcgtgcctgtccttaggtgccc

SEQ ID NO: 414404 - DNA, 25 bp, Mus musculus
caggcagcgtgcctgtccttaggtg

SEQ ID NO: 414405 - DNA, 25 bp, Mus musculus
ggcacaggcagcgtgcctgtcctta

SEQ ID NO: 414406 - DNA, 25 bp, Mus musculus
gctccaggcacagcaatggcgcgca

SEQ ID NO: 414407 - DNA, 25 bp, Mus musculus
ggtgggaccctcacagctccaggca

SEQ ID NO: 414408 - DNA, 25 bp, Mus musculus
cgggaggtggcagacgtgcaaacac

SEQ ID NO: 414409 - DNA, 25 bp, Mus musculus
cacagctttcccatataaggccggg

SEQ ID NO: 414410 - DNA, 25 bp, Mus musculus
gggcactcagcatgaaccgcggcca

SEQ ID NO: 414411 - DNA, 25 bp, Mus musculus
ctgcgtgccgattggctgacgccgc

SEQ ID NO: 414412 - DNA, 25 bp, Mus musculus
agccggcgaaaacgctcgcgcgcat

SEQ ID NO: 414413 - DNA, 25 bp, Mus musculus
aggacctcagcaggtgccgtgacga

SEQ ID NO: 414414 - DNA, 25 bp, Mus musculus
caggtgcgcgcttcccattgggtgt

SEQ ID NO: 414415 - DNA, 25 bp, Mus musculus
cctccctcgcaaggcaggaccaatc

SEQ ID NO: 414416 - DNA, 25 bp, Mus musculus
cggaaactctacagccggcgcatgc

SEQ ID NO: 414417 - DNA, 25 bp, Mus musculus
ttctcggggcggaaactctacagcc

SEQ ID NO: 414418 - DNA, 25 bp, Mus musculus
ccatcgccttctcggggcggaaact

SEQ ID NO: 414419 - DNA, 25 bp, Mus musculus
ggcagtccaggtgcgctcgcgcttc

SEQ ID NO: 414420 - DNA, 25 bp, Mus musculus
tcctgaacggcagtccaggtgcgct

SEQ ID NO: 414421 - DNA, 25 bp, Mus musculus
gcaaaatacacaccctcctgaacgg

SEQ ID NO: 414422 - DNA, 25 bp, Mus musculus
cgctcgcgcgcatgcgcaaaataca

SEQ ID NO: 414423 - DNA, 25 bp, Mus musculus
cggctgtagggctgtgctccgccct

SEQ ID NO: 414424 - DNA, 25 bp, Mus musculus
cacgggcctgctagctgtcaacgat

SEQ ID NO: 414425 - DNA, 25 bp, Mus musculus
ctcagctttgagtccggacagaacg

SEQ ID NO: 414426 - DNA, 25 bp, Mus musculus
tgacgcagatcgagctcagctttga

SEQ ID NO: 414427 - DNA, 25 bp, Mus musculus
tcattgaagacagtggcgagccgca

SEQ ID NO: 414428 - DNA, 25 bp, Mus musculus
gcgacgaggacgacatcatcattga

SEQ ID NO: 414429 - DNA, 25 bp, Mus musculus
aggaacaacgtggtgcgcaacagtc

SEQ ID NO: 414430 - DNA, 25 bp, Mus musculus
accaggtgactgacatgatgatagc

SEQ ID NO: 414431 - DNA, 25 bp, Mus musculus
cggcatcttcatatctcggctcgtc

SEQ ID NO: 414432 - DNA, 25 bp, Mus musculus
ctgggcttctacatccgggatggct

SEQ ID NO: 414433 - DNA, 25 bp, Mus musculus
atcgacgtggacatcctcccagaga

SEQ ID NO: 414434 - DNA, 25 bp, Mus musculus
ggcccgtgtcatccatcatcgacgt

SEQ ID NO: 414435 - DNA, 25 bp, Mus musculus
ccggaagaagcctcacatcgtcatc

SEQ ID NO: 414436 - DNA, 25 bp, Mus musculus
tgcgtcccgacaaccaccggaagaa

SEQ ID NO: 414437 - DNA, 25 bp, Mus musculus
tgcgcccggccaaccagaggaacaa

SEQ ID NO: 414438 - DNA, 25 bp, Mus musculus
agcacccgagcttcccgcgttgtgg

SEQ ID NO: 414439 - DNA, 25 bp, Mus musculus
gagagacttcgacttcaccgcgcca

SEQ ID NO: 414440 - DNA, 25 bp, Mus musculus
cgagcttcccgcgttgtggccgctg

SEQ ID NO: 414441 - DNA, 25 bp, Mus musculus
accaggtcagggcagggcatccttc

SEQ ID NO: 414442 - DNA, 25 bp, Mus musculus
gcatccttctggacgccgatcagct

SEQ ID NO: 414443 - DNA, 25 bp, Mus musculus
ttctggacgccgatcagcttgagcc

SEQ ID NO: 414444 - DNA, 25 bp, Mus musculus
cgatcagcttgagccggtgagcact

SEQ ID NO: 414445 - DNA, 25 bp, Mus musculus
actggggcacgcgagttcgcgctct

SEQ ID NO: 414446 - DNA, 25 bp, Mus musculus
gctctccctgactccggagtctgag

SEQ ID NO: 414447 - DNA, 25 bp, Mus musculus
ccctgactccggagtctgaggcgga

SEQ ID NO: 414448 - DNA, 25 bp, Mus musculus
ctccagcttggggatcgtggccctg

SEQ ID NO: 414449 - DNA, 25 bp, Mus musculus
atcgtggccctgaacccggagagac

SEQ ID NO: 414450 - DNA, 25 bp, Mus musculus
acctccgggctatggcaccaggtca

SEQ ID NO: 414451 - DNA, 25 bp, Mus musculus
cctgaacccggagagacttcgactt

SEQ ID NO: 414452 - DNA, 25 bp, Mus musculus
ggccgctgtcccgtgcgtctgtctg

SEQ ID NO: 414453 - DNA, 25 bp, Mus musculus
cgtcgcggcagcactgtgtcttttt

SEQ ID NO: 414454 - DNA, 25 bp, Mus musculus
gctctccctatgacgggaacacagc

SEQ ID NO: 414455 - DNA, 25 bp, Mus musculus
tcaatagcgcgtcgcggcagcactg

SEQ ID NO: 414456 - DNA, 25 bp, Mus musculus
ccctcctccctctcaatagcgcgtc

SEQ ID NO: 414457 - DNA, 25 bp, Mus musculus
gacgggaacacagctgcagctggcc

SEQ ID NO: 414458 - DNA, 25 bp, Mus musculus
ccctatgacgggaacacagctgcag

SEQ ID NO: 414459 - DNA, 25 bp, Mus musculus
cagctctccctatgacgggaacaca

SEQ ID NO: 414460 - DNA, 25 bp, Mus musculus
tctcagctctccctatgacgggaac

SEQ ID NO: 414461 - DNA, 25 bp, Mus musculus
tcgcggcagcactgtgtctttttgg

SEQ ID NO: 414462 - DNA, 25 bp, Mus musculus
tatgacgggaacacagctgcagctg

SEQ ID NO: 414463 - DNA, 25 bp, Mus musculus
tttggttttgcaaagcgccgcgtcc

SEQ ID NO: 414464 - DNA, 25 bp, Mus musculus
gcggcagcactgtgtctttttggtt

SEQ ID NO: 414465 - DNA, 25 bp, Mus musculus
tggttttgcaaagcgccgcgtccac

SEQ ID NO: 414466 - DNA, 25 bp, Mus musculus
ccagcctctcctgggtgagattata

SEQ ID NO: 414467 - DNA, 25 bp, Mus musculus
gaacgtggaggctttgccattgccc

SEQ ID NO: 414468 - DNA, 25 bp, Mus musculus
aggcgccgtggataatggccgcact

SEQ ID NO: 414469 - DNA, 25 bp, Mus musculus
gataatggccgcactgcgctcctgg

SEQ ID NO: 414470 - DNA, 25 bp, Mus musculus
cactttccttatggcagggtggccc

SEQ ID NO: 414471 - DNA, 25 bp, Mus musculus
cccaagggagagctcttcggtcctc

SEQ ID NO: 414472 - DNA, 25 bp, Mus musculus
ctcattagcataagaggactcattg

SEQ ID NO: 414473 - DNA, 25 bp, Mus musculus
atacaagcgcctcagagcaagtccc

SEQ ID NO: 414474 - DNA, 25 bp, Mus musculus
ctcagcagacaatacaagcgcctca

SEQ ID NO: 414475 - DNA, 25 bp, Mus musculus
gcttaccttggctcggcctcgaggc

SEQ ID NO: 414476 - DNA, 25 bp, Mus musculus
cgagcacaatgaccgcgcccgggat

SEQ ID NO: 414477 - DNA, 25 bp, Mus musculus
cggaagtgacgtaagcgactcatta

SEQ ID NO: 414478 - DNA, 25 bp, Mus musculus
aaaagcccatggtggccggccggca

SEQ ID NO: 414479 - DNA, 25 bp, Mus musculus
cgaacctgccctagccaaaatggcg

SEQ ID NO: 414480 - DNA, 25 bp, Mus musculus
tgcccacgcgctacctggtgaacga

SEQ ID NO: 414481 - DNA, 25 bp, Mus musculus
tggtgaccgtttcaagccaatcgtg

SEQ ID NO: 414482 - DNA, 25 bp, Mus musculus
ttcgtttcactttcaagggccagga

SEQ ID NO: 414483 - DNA, 25 bp, Mus musculus
gcgtcttcgttttccagtcgctaag

SEQ ID NO: 414484 - DNA, 25 bp, Mus musculus
tcgctaagagacaggcaaccggaaa

SEQ ID NO: 414485 - DNA, 25 bp, Mus musculus
tctttccggaagaggctgtcatggc

SEQ ID NO: 414486 - DNA, 25 bp, Mus musculus
ttacaggctgaaatcacccggcggg

SEQ ID NO: 414487 - DNA, 25 bp, Mus musculus
tcgcgggacgagatcctccgctaca

SEQ ID NO: 414488 - DNA, 25 bp, Mus musculus
cgggaaacttccagatatggtgacc

SEQ ID NO: 414489 - DNA, 25 bp, Mus musculus
gcagactgctgcgacaacgtgccca

SEQ ID NO: 414490 - DNA, 25 bp, Mus musculus
gaagagctagcttcgctcaagcgga

SEQ ID NO: 414491 - DNA, 25 bp, Mus musculus
cgccggaagcggacttacgtcatcc

SEQ ID NO: 414492 - DNA, 25 bp, Mus musculus
gacacgggccgtaccaaatctcgga

SEQ ID NO: 414493 - DNA, 25 bp, Mus musculus
tgggcaacagcaccgagtacttgtc

SEQ ID NO: 414494 - DNA, 25 bp, Mus musculus
tccaccagcagtgtgacatagtaag

SEQ ID NO: 414495 - DNA, 25 bp, Mus musculus
acgcatcacgtagaggatgcgcagc

SEQ ID NO: 414496 - DNA, 25 bp, Mus musculus
aatgccgggccagacgcatcacgta

SEQ ID NO: 414497 - DNA, 25 bp, Mus musculus
gccgtgaggcccagtgtctgcagcc

SEQ ID NO: 414498 - DNA, 25 bp, Mus musculus
accttgtccaggtagctgttgccgg

SEQ ID NO: 414499 - DNA, 25 bp, Mus musculus
gcactagcccaaccttgtccaggta

SEQ ID NO: 414500 - DNA, 25 bp, Mus musculus
tctagggagaaccagcccacgcaca

SEQ ID NO: 414501 - DNA, 25 bp, Mus musculus
acgcacaccgactcgacgatgaaga

SEQ ID NO: 414502 - DNA, 25 bp, Mus musculus
gcaggaactctagggagaaccagcc

SEQ ID NO: 414503 - DNA, 25 bp, Mus musculus
tgcctggatgaagcgcagcaggaac

SEQ ID NO: 414504 - DNA, 25 bp, Mus musculus
actccgcaggaaggcgaacttgctg

SEQ ID NO: 414505 - DNA, 25 bp, Mus musculus
tcgatgagggtcagcggactccgca

SEQ ID NO: 414506 - DNA, 25 bp, Mus musculus
acatagtaaggcaggatggccacca

SEQ ID NO: 414507 - DNA, 25 bp, Mus musculus
cgaattcacgcgtgcagcgccgtgc

SEQ ID NO: 414508 - DNA, 25 bp, Mus musculus
agccgcgtcagtgggaactcatcca

SEQ ID NO: 414509 - DNA, 25 bp, Mus musculus
agtgtggccgctccaccatgtcacg

SEQ ID NO: 414510 - DNA, 25 bp, Mus musculus
aacggacaggcaggcaaacaccttg

SEQ ID NO: 414511 - DNA, 25 bp, Mus musculus
tctcttgatcctcgctgtccagcgg

SEQ ID NO: 414512 - DNA, 25 bp, Mus musculus
agcaaactcctcgattttctgcagg

SEQ ID NO: 414513 - DNA, 25 bp, Mus musculus
aggtgaggatggtgccaaaagctcc

SEQ ID NO: 414514 - DNA, 25 bp, Mus musculus
agaactcgttgcaggttacgtcata

SEQ ID NO: 414515 - DNA, 25 bp, Mus musculus
cacgctcaggatgtcgtcgaagttg

SEQ ID NO: 414516 - DNA, 25 bp, Mus musculus
ctgtagtcatagtgcgagttgtctc

SEQ ID NO: 414517 - DNA, 25 bp, Mus musculus
aactcatccagggtggtccaaggta

SEQ ID NO: 414518 - DNA, 25 bp, Mus musculus
tgagtacttgatgccacccacgttg

SEQ ID NO: 414519 - DNA, 25 bp, Mus musculus
tagaagacgcccttgatggcctggc

SEQ ID NO: 414520 - DNA, 25 bp, Mus musculus
ggcgcagcttagagcgctgtagtca

SEQ ID NO: 414521 - DNA, 25 bp, Mus musculus
gtcatagtcatcacacacgctcagg

SEQ ID NO: 414522 - DNA, 25 bp, Mus musculus
cgcaaagtcagagcgcactacgcat

SEQ ID NO: 414523 - DNA, 25 bp, Mus musculus
tggccggaccaaactgcggccgcgt

SEQ ID NO: 414524 - DNA, 25 bp, Mus musculus
atccgtggccggaccaaactgcggc

SEQ ID NO: 414525 - DNA, 25 bp, Mus musculus
gatccgtggccggaccaaactgcgg

SEQ ID NO: 414526 - DNA, 25 bp, Mus musculus
tggaaaggatccgtggccggaccaa

SEQ ID NO: 414527 - DNA, 25 bp, Mus musculus
agcgcactacgcattccggggaccc

SEQ ID NO: 414528 - DNA, 25 bp, Mus musculus
gagcgcactacgcattccggggacc

SEQ ID NO: 414529 - DNA, 25 bp, Mus musculus
cagagcgcactacgcattccgggga

SEQ ID NO: 414530 - DNA, 25 bp, Mus musculus
tcagagcgcactacgcattccgggg

SEQ ID NO: 414531 - DNA, 25 bp, Mus musculus
gtcagagcgcactacgcattccggg

SEQ ID NO: 414532 - DNA, 25 bp, Mus musculus
agtcagagcgcactacgcattccgg

SEQ ID NO: 414533 - DNA, 25 bp, Mus musculus
aagtcagagcgcactacgcattccg

SEQ ID NO: 414534 - DNA, 25 bp, Mus musculus
aaagtcagagcgcactacgcattcc

SEQ ID NO: 414535 - DNA, 25 bp, Mus musculus
ccggaccaaactgcggccgcgtggg

SEQ ID NO: 414536 - DNA, 25 bp, Mus musculus
gccgggctgcaagtgcgccggcaac

SEQ ID NO: 414537 - DNA, 25 bp, Mus musculus
cggccgcgtgggtgcatgccgcatc

SEQ ID NO: 414538 - DNA, 25 bp, Mus musculus
tgcatgccgcatcgcccgggcggcc

SEQ ID NO: 414539 - DNA, 25 bp, Mus musculus
tctccggggctcctaggtatccgca

SEQ ID NO: 414540 - DNA, 25 bp, Mus musculus
ggctcctaggtatccgcagagggta

SEQ ID NO: 414541 - DNA, 25 bp, Mus musculus
cctaggtatccgcagagggtaccgg

SEQ ID NO: 414542 - DNA, 25 bp, Mus musculus
gcggccacgtgcagagcccggagcg

SEQ ID NO: 414543 - DNA, 25 bp, Mus musculus
cgcttgcaggagcagggtcccgcca

SEQ ID NO: 414544 - DNA, 25 bp, Mus musculus
gcagcccgcgaagttcccaccttaa

SEQ ID NO: 414545 - DNA, 25 bp, Mus musculus
cccgcctaggagctagccgggccgc

SEQ ID NO: 414546 - DNA, 25 bp, Mus musculus
agctagccgggccgcagctctgtct

SEQ ID NO: 414547 - DNA, 25 bp, Mus musculus
agctctgtctcccggcgcagcgatg

SEQ ID NO: 414548 - DNA, 25 bp, Mus musculus
agcaagcggcacgtgggacccgctt

SEQ ID NO: 414549 - DNA, 25 bp, Mus musculus
gccggggctgcccgcaaactttggc

SEQ ID NO: 414550 - DNA, 25 bp, Mus musculus
accagtcttctgtccttaggtccaa

SEQ ID NO: 414551 - DNA, 25 bp, Mus musculus
tagcggaacgcagtgctgcactctc

SEQ ID NO: 414552 - DNA, 25 bp, Mus musculus
cgaccttttaagtcccagcgctgct

SEQ ID NO: 414553 - DNA, 25 bp, Mus musculus
tgaggcgcatccacttctccagttt

SEQ ID NO: 414554 - DNA, 25 bp, Mus musculus
tctccagttttctcagtggtcgtgg

SEQ ID NO: 414555 - DNA, 25 bp, Mus musculus
gtcgtgggacgctcttccaccctag

SEQ ID NO: 414556 - DNA, 25 bp, Mus musculus
caccctaggctcagcgagtaccagg

SEQ ID NO: 414557 - DNA, 25 bp, Mus musculus
taggctcagcgagtaccaggacccg

SEQ ID NO: 414558 - DNA, 25 bp, Mus musculus
ggaacgccaccgaaccagtcttctg

SEQ ID NO: 414559 - DNA, 25 bp, Mus musculus
ccagagtccaggtcctagcggaacg

SEQ ID NO: 414560 - DNA, 25 bp, Mus musculus
ttaggtccaacctcacgctgaactg

SEQ ID NO: 414561 - DNA, 25 bp, Mus musculus
acgctgaactgtcacggacactgca

SEQ ID NO: 414562 - DNA, 25 bp, Mus musculus
tcacggacactgcagatgtcacgtc

SEQ ID NO: 414563 - DNA, 25 bp, Mus musculus
tgagtcgctatcgtgggaacgccac

SEQ ID NO: 414564 - DNA, 25 bp, Mus musculus
gcaccgccgcccttggctaattata

SEQ ID NO: 414565 - DNA, 25 bp, Mus musculus
ggccgcctaagtgcgggttccgcac

SEQ ID NO: 414566 - DNA, 25 bp, Mus musculus
cctacctgaagtggcgaccgcagta

SEQ ID NO: 414567 - DNA, 25 bp, Mus musculus
cgggcttggcgtttcattcataata

SEQ ID NO: 414568 - DNA, 25 bp, Mus musculus
ttcataatacttgcaccagcgtgga

SEQ ID NO: 414569 - DNA, 25 bp, Mus musculus
tctgtttaataaaatcccggccatg

SEQ ID NO: 414570 - DNA, 25 bp, Mus musculus
ggccatgcaaccgaaagggaaaatg

SEQ ID NO: 414571 - DNA, 25 bp, Mus musculus
aaatgatcccggagtatgctgcccg

SEQ ID NO: 414572 - DNA, 25 bp, Mus musculus
gagattgtgcaatgggcccgagcca

SEQ ID NO: 414573 - DNA, 25 bp, Mus musculus
ctcggctcccttggcacagcgggta

SEQ ID NO: 414574 - DNA, 25 bp, Mus musculus
tgctcgcccgagcatagtgatgcag

SEQ ID NO: 414575 - DNA, 25 bp, Mus musculus
aggaactgataaaccggcgcgcgag

SEQ ID NO: 414576 - DNA, 25 bp, Mus musculus
ctcgagcgccggtcattgagaaata

SEQ ID NO: 414577 - DNA, 25 bp, Mus musculus
tggctaattataccggagattgtgc

SEQ ID NO: 414578 - DNA, 25 bp, Mus musculus
ggctcaagcaaagcggctcgcggta

SEQ ID NO: 414579 - DNA, 25 bp, Mus musculus
cgggtcaggactggtcttccatatc

SEQ ID NO: 414580 - DNA, 25 bp, Mus musculus
tccatatcttggaggggatcccgca

SEQ ID NO: 414581 - DNA, 25 bp, Mus musculus
tccatgagaacagcagagccggccg

SEQ ID NO: 414582 - DNA, 25 bp, Mus musculus
atgctgtcgtcctgcagtgccacgt

SEQ ID NO: 414583 - DNA, 25 bp, Mus musculus
tgcgggcagaggagcaaccaaagcc

SEQ ID NO: 414584 - DNA, 25 bp, Mus musculus
aaccaaagcctctgcgcacgaatgc

SEQ ID NO: 414585 - DNA, 25 bp, Mus musculus
cgaatgcctccgcttggcaccgggt

SEQ ID NO: 414586 - DNA, 25 bp, Mus musculus
ttgaaactggggacacaggtcgtcg

SEQ ID NO: 414587 - DNA, 25 bp, Mus musculus
cctgcctgcatcagttcgtgggatg

SEQ ID NO: 414588 - DNA, 25 bp, Mus musculus
ttcgtgggatggagtgatctcgatc

SEQ ID NO: 414589 - DNA, 25 bp, Mus musculus
ctgctggcttgaccgggctcagaaa

SEQ ID NO: 414590 - DNA, 25 bp, Mus musculus
agttctggaaccctatactatccgg

SEQ ID NO: 414591 - DNA, 25 bp, Mus musculus
aggctggttcgaggtgacattattg

SEQ ID NO: 414592 - DNA, 25 bp, Mus musculus
gagcttcctgctcaaggcacctgtt

SEQ ID NO: 414593 - DNA, 25 bp, Mus musculus
cttcctgctcaaggcacctgttgca

SEQ ID NO: 414594 - DNA, 25 bp, Mus musculus
ggcgcgagcttcctgctcaaggcac

SEQ ID NO: 414595 - DNA, 25 bp, Mus musculus
gtggcggcgcgagcttcctgctcaa

SEQ ID NO: 414596 - DNA, 25 bp, Mus musculus
tcacggcgcagtgggtcctggacgc

SEQ ID NO: 414597 - DNA, 25 bp, Mus musculus
gaggccgaggatggctcacggcgca

SEQ ID NO: 414598 - DNA, 25 bp, Mus musculus
caccgtatctgtggcgcacggtgag

SEQ ID NO: 414599 - DNA, 25 bp, Mus musculus
ggtcaccgtatctgtggcgcacggt

SEQ ID NO: 414600 - DNA, 25 bp, Mus musculus
aggggtcaccgtatctgtggcgcac

SEQ ID NO: 414601 - DNA, 25 bp, Mus musculus
gcagagcaggggtcaccgtatctgt

SEQ ID NO: 414602 - DNA, 25 bp, Mus musculus
ttcgtatagagtcgcggggcgcaga

SEQ ID NO: 414603 - DNA, 25 bp, Mus musculus
ttcgggatgcgggttcgtatagagt

SEQ ID NO: 414604 - DNA, 25 bp, Mus musculus
tgcggctccgggacgtccatggctc

SEQ ID NO: 414605 - DNA, 25 bp, Mus musculus
tgctcaaggcacctgttgcagcctg

SEQ ID NO: 414606 - DNA, 25 bp, Mus musculus
aacctgcctggagacgcttcctaga

SEQ ID NO: 414607 - DNA, 25 bp, Mus musculus
ggcgcgattacctcggtccgcagac

SEQ ID NO: 414608 - DNA, 25 bp, Mus musculus
ttactccagaggcaacgcgacttcc

SEQ ID NO: 414609 - DNA, 25 bp, Mus musculus
cgcgctccgtgtttataggctttca

SEQ ID NO: 414610 - DNA, 25 bp, Mus musculus
tgcagtaaaataacgggattccctc

SEQ ID NO: 414611 - DNA, 25 bp, Mus musculus
gggattccctcactgtttcctcctg

SEQ ID NO: 414612 - DNA, 25 bp, Mus musculus
tcctgtttactcagcgccatggaaa

SEQ ID NO: 414613 - DNA, 25 bp, Mus musculus
tccatctccaaaactaagggctttc

SEQ ID NO: 414614 - DNA, 25 bp, Mus musculus
gggctttcctgaaaacttcacactc

SEQ ID NO: 414615 - DNA, 25 bp, Mus musculus
ggccgccaagcacaagtccctgatt

SEQ ID NO: 414616 - DNA, 25 bp, Mus musculus
tccctgattgttcggggcagagaaa

SEQ ID NO: 414617 - DNA, 25 bp, Mus musculus
ccctgcaggagctgcgtgcaaactc

SEQ ID NO: 414618 - DNA, 25 bp, Mus musculus
ttcctagaatcaccaccggcgacgg

SEQ ID NO: 414619 - DNA, 25 bp, Mus musculus
atctgtgcttctacctgcgagcggg

SEQ ID NO: 414620 - DNA, 25 bp, Mus musculus
acactcccatattacacacgcgtgc

SEQ ID NO: 414621 - DNA, 25 bp, Mus musculus
attacacacgcgtgccacagcccac

SEQ ID NO: 414622 - DNA, 25 bp, Mus musculus
cccacactcccatattacacacgcg

SEQ ID NO: 414623 - DNA, 25 bp, Mus musculus
ttacacacgcgtgccacagcccaca

SEQ ID NO: 414624 - DNA, 25 bp, Mus musculus
tcccatattacacacgcgtgccaca

SEQ ID NO: 414625 - DNA, 25 bp, Mus musculus
ccacactcccatattacacacgcgt

SEQ ID NO: 414626 - DNA, 25 bp, Mus musculus
cccatattacacacgcgtgccacag

SEQ ID NO: 414627 - DNA, 25 bp, Mus musculus
acagcccacactcccatattacaca

SEQ ID NO: 414628 - DNA, 25 bp, Mus musculus
gcccacactcccatattacacacgc

SEQ ID NO: 414629 - DNA, 25 bp, Mus musculus
ccatattacacacgcgtgccacagc

SEQ ID NO: 414630 - DNA, 25 bp, Mus musculus
agcccacactcccatattacacacg

SEQ ID NO: 414631 - DNA, 25 bp, Mus musculus
actcccatattacacacgcgtgcca

SEQ ID NO: 414632 - DNA, 25 bp, Mus musculus
tattacacacgcgtgccacagccca

SEQ ID NO: 414633 - DNA, 25 bp, Mus musculus
acacacgcgtgccacagcccacact

SEQ ID NO: 414634 - DNA, 25 bp, Mus musculus
agcttcgtcacccttcccgcggcag

SEQ ID NO: 414635 - DNA, 25 bp, Mus musculus
ccgctcagctgaccgcagcgcccgc

SEQ ID NO: 414636 - DNA, 25 bp, Mus musculus
tctggatgccgacgcccgccaggga

SEQ ID NO: 414637 - DNA, 25 bp, Mus musculus
tgtcccaaagctctggatgccgacg

SEQ ID NO: 414638 - DNA, 25 bp, Mus musculus
tcgttggtattttgtcccaaagctc

SEQ ID NO: 414639 - DNA, 25 bp, Mus musculus
cactgcttcgttggtattttgtccc

SEQ ID NO: 414640 - DNA, 25 bp, Mus musculus
cttaggtcactgcttcgttggtatt

SEQ ID NO: 414641 - DNA, 25 bp, Mus musculus
ctcctcttaggtcactgcttcgttg

SEQ ID NO: 414642 - DNA, 25 bp, Mus musculus
gggatcctctcctcttaggtcactg

SEQ ID NO: 414643 - DNA, 25 bp, Mus musculus
ggccacagggatcctctcctcttag

SEQ ID NO: 414644 - DNA, 25 bp, Mus musculus
agagtcgccgcgctcagtcagcgcc

SEQ ID NO: 414645 - DNA, 25 bp, Mus musculus
acggcgacagcgagaaccgctgcca

SEQ ID NO: 414646 - DNA, 25 bp, Mus musculus
ccggaagacggcgacagcgagaacc

SEQ ID NO: 414647 - DNA, 25 bp, Mus musculus
tagccaagaaatttcccagaccacg

SEQ ID NO: 414648 - DNA, 25 bp, Mus musculus
agcttagagactggactggcctaca

SEQ ID NO: 414649 - DNA, 25 bp, Mus musculus
cactcaccgtcaggagcgtagcgca

SEQ ID NO: 414650 - DNA, 25 bp, Mus musculus
agcgcagggcattcccagagatctc

SEQ ID NO: 414651 - DNA, 25 bp, Mus musculus
tatacggtggcagcgtcgtcctcgc

SEQ ID NO: 414652 - DNA, 25 bp, Mus musculus
cacgtacccagagccagtcatgttc

SEQ ID NO: 414653 - DNA, 25 bp, Mus musculus
tccgatgatgcctgcgcgggaccct

SEQ ID NO: 414654 - DNA, 25 bp, Mus musculus
ccgttgattagctgaagtccgatga

SEQ ID NO: 414655 - DNA, 25 bp, Mus musculus
gccgactcgttcttgccgttgatta

SEQ ID NO: 414656 - DNA, 25 bp, Mus musculus
acagcgtcactgatgtgggccgact

SEQ ID NO: 414657 - DNA, 25 bp, Mus musculus
agctcgtggactgcctgtgccacca

SEQ ID NO: 414658 - DNA, 25 bp, Mus musculus
cttttctaggagctcgtggactgcc

SEQ ID NO: 414659 - DNA, 25 bp, Mus musculus
atcagtgatgttctccttttctagg

SEQ ID NO: 414660 - DNA, 25 bp, Mus musculus
ccgcggtggatcagtgatgttctcc

SEQ ID NO: 414661 - DNA, 25 bp, Mus musculus
tcagcatcgcggctgcgcggtatac

SEQ ID NO: 414662 - DNA, 25 bp, Mus musculus
cccgcctgccaggacggactcccgg

SEQ ID NO: 414663 - DNA, 25 bp, Mus musculus
ttctctccagctcgacctctgtccc

SEQ ID NO: 414664 - DNA, 25 bp, Mus musculus
ggactctgcattctctccagctcga

SEQ ID NO: 414665 - DNA, 25 bp, Mus musculus
cgtcccacggccgagctacagggaa

SEQ ID NO: 414666 - DNA, 25 bp, Mus musculus
cttcttgtggcgcacgggctgcagc

SEQ ID NO: 414667 - DNA, 25 bp, Mus musculus
cggcctactgtccacccgcttcttg

SEQ ID NO: 414668 - DNA, 25 bp, Mus musculus
ctgggactctgcattctctccagct

SEQ ID NO: 414669 - DNA, 25 bp, Mus musculus
ctagaaacgcacctcccaggtccca

SEQ ID NO: 414670 - DNA, 25 bp, Mus musculus
tgcgcggccctagaaacgcacctcc

SEQ ID NO: 414671 - DNA, 25 bp, Mus musculus
agcgccttacctgcgcggccctaga

SEQ ID NO: 414672 - DNA, 25 bp, Mus musculus
tacagggaaccggagagacggcgcc

SEQ ID NO: 414673 - DNA, 25 bp, Mus musculus
ccgagctacagggaaccggagagac

SEQ ID NO: 414674 - DNA, 25 bp, Mus musculus
cacggccgagctacagggaaccgga

SEQ ID NO: 414675 - DNA, 25 bp, Mus musculus
acccgcttcttgtggcgcacgggct

SEQ ID NO: 414676 - DNA, 25 bp, Mus musculus
tgggcatgctcacaccggtctgaga

SEQ ID NO: 414677 - DNA, 25 bp, Mus musculus
tggaaaacacctcgggcgctctctt

SEQ ID NO: 414678 - DNA, 25 bp, Mus musculus
ggatgcctccgctctggatcacgga

SEQ ID NO: 414679 - DNA, 25 bp, Mus musculus
ttcaggacgctggtgtactggttcc

SEQ ID NO: 414680 - DNA, 25 bp, Mus musculus
ggacaggagctccttggaaaacacc

SEQ ID NO: 414681 - DNA, 25 bp, Mus musculus
gtcgggaacagcgagcttttctccg

SEQ ID NO: 414682 - DNA, 25 bp, Mus musculus
actcagcgcggccatggggttctct

SEQ ID NO: 414683 - DNA, 25 bp, Mus musculus
ccatggggttctctatggccagctt

SEQ ID NO: 414684 - DNA, 25 bp, Mus musculus
gtgccattgctcaccacagagctgg

SEQ ID NO: 414685 - DNA, 25 bp, Mus musculus
cgctctggatcacggagatctcgtt

SEQ ID NO: 414686 - DNA, 25 bp, Mus musculus
agatctcgttggtcttcatggccag

SEQ ID NO: 414687 - DNA, 25 bp, Mus musculus
accggtctgagagccgtcaagcttg

SEQ ID NO: 414688 - DNA, 25 bp, Mus musculus
gcttttctccgttcccgctcatggg

SEQ ID NO: 414689 - DNA, 25 bp, Mus musculus
cgtcaagcttggaaatcgtgccatt

SEQ ID NO: 414690 - DNA, 25 bp, Mus musculus
ctgcggctgcgatgctagcaaaggc

SEQ ID NO: 414691 - DNA, 25 bp, Mus musculus
ctcgtggatctgcagggcactggca

SEQ ID NO: 414692 - DNA, 25 bp, Mus musculus
gcactggcagacgagaagttctttc

SEQ ID NO: 414693 - DNA, 25 bp, Mus musculus
cgagaagttctttccacaccgtgtg

SEQ ID NO: 414694 - DNA, 25 bp, Mus musculus
tccacaccgtgtgcagcagtgctgc

SEQ ID NO: 414695 - DNA, 25 bp, Mus musculus
caccgtgtgcagcagtgctgcttgg

SEQ ID NO: 414696 - DNA, 25 bp, Mus musculus
tgtgtgttcgctcgtggatctgcag

SEQ ID NO: 414697 - DNA, 25 bp, Mus musculus
cgatgctagcaaaggcggcataccc

SEQ ID NO: 414698 - DNA, 25 bp, Mus musculus
atatgttacacacgaaaggcttctc

SEQ ID NO: 414699 - DNA, 25 bp, Mus musculus
cgcccgcatatgttacacacgaaag

SEQ ID NO: 414700 - DNA, 25 bp, Mus musculus
aaggcccgcccgcatatgttacaca

SEQ ID NO: 414701 - DNA, 25 bp, Mus musculus
acccaccttcaggttgcctttcgtg

SEQ ID NO: 414702 - DNA, 25 bp, Mus musculus
acacacgaaaggcttctctcccgtg

SEQ ID NO: 414703 - DNA, 25 bp, Mus musculus
ttgcctttcgtggtgaaggcccgcc

SEQ ID NO: 414704 - DNA, 25 bp, Mus musculus
tcaggcttcaaggtgaaggacgtta

SEQ ID NO: 414705 - DNA, 25 bp, Mus musculus
tgttcacctggacgcgaatctgttc

SEQ ID NO: 414706 - DNA, 25 bp, Mus musculus
aacccgtgtcccgtcaggcttcaag

SEQ ID NO: 414707 - DNA, 25 bp, Mus musculus
acgctggcatgaggtagcttggctt

SEQ ID NO: 414708 - DNA, 25 bp, Mus musculus
ttcaaggcatcgagcgacagagctg

SEQ ID NO: 414709 - DNA, 25 bp, Mus musculus
catcgagcgacagagctgggtttga

SEQ ID NO: 414710 - DNA, 25 bp, Mus musculus
acggcagccgacacctgctgggaca

SEQ ID NO: 414711 - DNA, 25 bp, Mus musculus
gacacctgctgggacacggacactt

SEQ ID NO: 414712 - DNA, 25 bp, Mus musculus
tgggacacggacacttgctgagaca

SEQ ID NO: 414713 - DNA, 25 bp, Mus musculus
cacttgctgagacacatggctgctt

SEQ ID NO: 414714 - DNA, 25 bp, Mus musculus
gacacatggctgcttaaggccttca

SEQ ID NO: 414715 - DNA, 25 bp, Mus musculus
cttaaggccttcagcgtgtcggccc

SEQ ID NO: 414716 - DNA, 25 bp, Mus musculus
agcttggcttgtttcaaggcatcga

SEQ ID NO: 414717 - DNA, 25 bp, Mus musculus
tgcgctgcccacatgttcacctgga

SEQ ID NO: 414718 - DNA, 25 bp, Mus musculus
gttgcgcttttcgttcccagagttc

SEQ ID NO: 414719 - DNA, 25 bp, Mus musculus
tttgttgcgcttttcgttcccagag

SEQ ID NO: 414720 - DNA, 25 bp, Mus musculus
ttttgttgcgcttttcgttcccaga

SEQ ID NO: 414721 - DNA, 25 bp, Mus musculus
tgttgcgcttttcgttcccagagtt

SEQ ID NO: 414722 - DNA, 25 bp, Mus musculus
acgccgaaactcctcttctatcctg

SEQ ID NO: 414723 - DNA, 25 bp, Mus musculus
gcgaccgcaaacacgcgcccgacgc

SEQ ID NO: 414724 - DNA, 25 bp, Mus musculus
ttgcgcttttcgttcccagagttcc

SEQ ID NO: 414725 - DNA, 25 bp, Mus musculus
caacactcgcgcgaccgcaaacacg

SEQ ID NO: 414726 - DNA, 25 bp, Mus musculus
tgcgcttttcgttcccagagttccg

SEQ ID NO: 414727 - DNA, 25 bp, Mus musculus
gcgcttttcgttcccagagttccgc

SEQ ID NO: 414728 - DNA, 25 bp, Mus musculus
tttcgttcccagagttccgcggaga

SEQ ID NO: 414729 - DNA, 25 bp, Mus musculus
ttcgttcccagagttccgcggagac

SEQ ID NO: 414730 - DNA, 25 bp, Mus musculus
tcgttcccagagttccgcggagacc

SEQ ID NO: 414731 - DNA, 25 bp, Mus musculus
gcccgacgccgaaactcctcttcta

SEQ ID NO: 414732 - DNA, 25 bp, Mus musculus
cagaaaactcgcttcccaaggctgg

SEQ ID NO: 414733 - DNA, 25 bp, Mus musculus
gtgtgcgggtctccggcctagctaa

SEQ ID NO: 414734 - DNA, 25 bp, Mus musculus
tagctaacctcactcaccaggtgtg

SEQ ID NO: 414735 - DNA, 25 bp, Mus musculus
cactcaccaggtgtgtgtcgcagtc

SEQ ID NO: 414736 - DNA, 25 bp, Mus musculus
ccaggtgtgtgtcgcagtccgcaca

SEQ ID NO: 414737 - DNA, 25 bp, Mus musculus
gtcgcagtccgcacatggccggtct

SEQ ID NO: 414738 - DNA, 25 bp, Mus musculus
acatggccggtctccagagggcgcc

SEQ ID NO: 414739 - DNA, 25 bp, Mus musculus
ctccgaccgcgagtgatccgcagaa

SEQ ID NO: 414740 - DNA, 25 bp, Mus musculus
agtgatccgcagaaaactcgcttcc

SEQ ID NO: 414741 - DNA, 25 bp, Mus musculus
gcccagcggcctcagggtgcagcca

SEQ ID NO: 414742 - DNA, 25 bp, Mus musculus
ggtgcagccaggttaactacgactc

SEQ ID NO: 414743 - DNA, 25 bp, Mus musculus
gccaggttaactacgactccagcca

SEQ ID NO: 414744 - DNA, 25 bp, Mus musculus
gttaactacgactccagccagcgga

SEQ ID NO: 414745 - DNA, 25 bp, Mus musculus
accgcgagtgatccgcagaaaactc

SEQ ID NO: 414746 - DNA, 25 bp, Mus musculus
cacctcccgggcgtgtgctgagcag

SEQ ID NO: 414747 - DNA, 25 bp, Mus musculus
tctctttcttttaaaagcggcgcca

SEQ ID NO: 414748 - DNA, 25 bp, Mus musculus
cgctggccgcggttatttttagata

SEQ ID NO: 414749 - DNA, 25 bp, Mus musculus
tcaaagatggctggaggtcaggccc

SEQ ID NO: 414750 - DNA, 25 bp, Mus musculus
gcgtaggtgggtgcttatgtatcca

SEQ ID NO: 414751 - DNA, 25 bp, Mus musculus
tgcttatgtatccaaaggagggaaa

SEQ ID NO: 414752 - DNA, 25 bp, Mus musculus
aggagggaaaccaattatgggactg

SEQ ID NO: 414753 - DNA, 25 bp, Mus musculus
ccaattatgggactgtggacgagga

SEQ ID NO: 414754 - DNA, 25 bp, Mus musculus
gaggcagaatgtggaatcaacttta

SEQ ID NO: 414755 - DNA, 25 bp, Mus musculus
tggaatcaactttacaataagaggg

SEQ ID NO: 414756 - DNA, 25 bp, Mus musculus
cgcatctctcctttcctggaacaga

SEQ ID NO: 414757 - DNA, 25 bp, Mus musculus
tttcctggaacagagtccggaatcc

SEQ ID NO: 414758 - DNA, 25 bp, Mus musculus
ggggcgcgtgcaacagatcgccctc

SEQ ID NO: 414759 - DNA, 25 bp, Mus musculus
tagatagtcggaaatcaaagatggc

SEQ ID NO: 414760 - DNA, 25 bp, Mus musculus
aggaggcaccgcacttgtcgcatcc

SEQ ID NO: 414761 - DNA, 25 bp, Mus musculus
catttctccgggtggtcggcctgat

SEQ ID NO: 414762 - DNA, 25 bp, Mus musculus
acactcgggacatttctccgggtgg

SEQ ID NO: 414763 - DNA, 25 bp, Mus musculus
gcaggagtagctacactcgggacat

SEQ ID NO: 414764 - DNA, 25 bp, Mus musculus
agtggactctgctgtgtacgcgcag

SEQ ID NO: 414765 - DNA, 25 bp, Mus musculus
tccgtgcagtggactctgctgtgta

SEQ ID NO: 414766 - DNA, 25 bp, Mus musculus
gctgcagaagtcacatttgaagggc

SEQ ID NO: 414767 - DNA, 25 bp, Mus musculus
ttatcgatgtgtttggccaggctgc

SEQ ID NO: 414768 - DNA, 25 bp, Mus musculus
gcgccttctctgtgcaccttatcga

SEQ ID NO: 414769 - DNA, 25 bp, Mus musculus
cctgttctcagtcttggcgccttct

SEQ ID NO: 414770 - DNA, 25 bp, Mus musculus
catccttgcccggaggggccctgtt

SEQ ID NO: 414771 - DNA, 25 bp, Mus musculus
ctctctgggtgctgacgttgggcac

SEQ ID NO: 414772 - DNA, 25 bp, Mus musculus
cttgtcgcatccgaaggctctctgg

SEQ ID NO: 414773 - DNA, 25 bp, Mus musculus
caggcgactgtgctccagcaggtct

SEQ ID NO: 414774 - DNA, 25 bp, Mus musculus
cgcgtttcccgactttggaggcaca

SEQ ID NO: 414775 - DNA, 25 bp, Mus musculus
cgcttgggcggcagccaggacctca

SEQ ID NO: 414776 - DNA, 25 bp, Mus musculus
gtcggagccactgtccctggtgtcc

SEQ ID NO: 414777 - DNA, 25 bp, Mus musculus
gccgggctcattgcgctcgagctgc

SEQ ID NO: 414778 - DNA, 25 bp, Mus musculus
gtttggcttgcttgcgccgcgacat

SEQ ID NO: 414779 - DNA, 25 bp, Mus musculus
ttgcgccgcgacatggcgcgaagat

SEQ ID NO: 414780 - DNA, 25 bp, Mus musculus
ccaagagtggcctccagaacagcgc

SEQ ID NO: 414781 - DNA, 25 bp, Mus musculus
agaacagcgcgcgtttcccgacttt

SEQ ID NO: 414782 - DNA, 25 bp, Mus musculus
ccacagcgggccgaatcgcgcatgt

SEQ ID NO: 414783 - DNA, 25 bp, Mus musculus
ccggtagggcgatttatcaagcgtc

SEQ ID NO: 414784 - DNA, 25 bp, Mus musculus
gggcgatttatcaagcgtcctgaca

SEQ ID NO: 414785 - DNA, 25 bp, Mus musculus
atttatcaagcgtcctgacagccgc

SEQ ID NO: 414786 - DNA, 25 bp, Mus musculus
cgtcagcccggtagggcgatttatc

SEQ ID NO: 414787 - DNA, 25 bp, Mus musculus
tcctgacagccgcttgggcggcagc

SEQ ID NO: 414788 - DNA, 25 bp, Mus musculus
gttgcttggtatcgaagctgcagta

SEQ ID NO: 414789 - DNA, 25 bp, Mus musculus
ccggagcctcgttcttgagcatgtc

SEQ ID NO: 414790 - DNA, 25 bp, Mus musculus
cgtccgagttcttactgtggtactc

SEQ ID NO: 414791 - DNA, 25 bp, Mus musculus
tactcactgtgctgccgtttgtggc

SEQ ID NO: 414792 - DNA, 25 bp, Mus musculus
tcccgcataaacgaggcgtcacaga

SEQ ID NO: 414793 - DNA, 25 bp, Mus musculus
cagtggatgcgctcgtgcacgcgca

SEQ ID NO: 414794 - DNA, 25 bp, Mus musculus
gaacgtcttcttggcatccagcctg

SEQ ID NO: 414795 - DNA, 25 bp, Mus musculus
agcatgtcggcgtggaacttcttca

SEQ ID NO: 414796 - DNA, 25 bp, Mus musculus
gaacttcttcatgtgcttgctcagg

SEQ ID NO: 414797 - DNA, 25 bp, Mus musculus
tgcagtagctgcacttgaacgggcg

SEQ ID NO: 414798 - DNA, 25 bp, Mus musculus
gcgcagccttgctggaacaggagta

SEQ ID NO: 414799 - DNA, 25 bp, Mus musculus
acaggagtagctgcactcgggacac

SEQ ID NO: 414800 - DNA, 25 bp, Mus musculus
acacttctccgggtgctccgactgg

SEQ ID NO: 414801 - DNA, 25 bp, Mus musculus
acagatgtcgcagtggaacgtcttc

SEQ ID NO: 414802 - DNA, 25 bp, Mus musculus
ccgcacacctcacacttgtggggtt

SEQ ID NO: 414803 - DNA, 25 bp, Mus musculus
aagcgcaccgctgcttacccgtgtg

SEQ ID NO: 414804 - DNA, 25 bp, Mus musculus
gcaccgctgcttacccgtgtgcgag

SEQ ID NO: 414805 - DNA, 25 bp, Mus musculus
tggcgtagggacagatctggcactt

SEQ ID NO: 414806 - DNA, 25 bp, Mus musculus
agatctggcacttgaagggtcgctc

SEQ ID NO: 414807 - DNA, 25 bp, Mus musculus
cacttgaagggtcgctcgtccgagt

SEQ ID NO: 414808 - DNA, 25 bp, Mus musculus
atgcgcaggtgcttgttaaggctgc

SEQ ID NO: 414809 - DNA, 25 bp, Mus musculus
ggtgcttgttaaggctgctgctgtc

SEQ ID NO: 414810 - DNA, 25 bp, Mus musculus
ccgcgtagtcgcacgtcttgcactt

SEQ ID NO: 414811 - DNA, 25 bp, Mus musculus
gtcgcacgtcttgcacttgtagggc

SEQ ID NO: 414812 - DNA, 25 bp, Mus musculus
ggcagcgcatgtgcgtcttcagctt

SEQ ID NO: 414813 - DNA, 25 bp, Mus musculus
cacacttgtggggtttgtcaccttc

SEQ ID NO: 414814 - DNA, 25 bp, Mus musculus
gcttgacgcccgtgtggcagcgcat

SEQ ID NO: 414815 - DNA, 25 bp, Mus musculus
gtttgtcaccttccggtgcacgcgc

SEQ ID NO: 414816 - DNA, 25 bp, Mus musculus
ggcacgtacctggagctcgcaaaca

SEQ ID NO: 414817 - DNA, 25 bp, Mus musculus
tgcatatataccttgggtccgcgct

SEQ ID NO: 414818 - DNA, 25 bp, Mus musculus
cacgtctgcagacgggcacgtacct

SEQ ID NO: 414819 - DNA, 25 bp, Mus musculus
tcctcggcacgtctgcagacgggca

SEQ ID NO: 414820 - DNA, 25 bp, Mus musculus
tgacggcgctaaagcaatcacacca

SEQ ID NO: 414821 - DNA, 25 bp, Mus musculus
tataaacggttgaaaatgacggcgc

SEQ ID NO: 414822 - DNA, 25 bp, Mus musculus
tgcagacacagaagaagattataaa

SEQ ID NO: 414823 - DNA, 25 bp, Mus musculus
tttactctgatgaataatgtgcaca

SEQ ID NO: 414824 - DNA, 25 bp, Mus musculus
cagttggtcgaggttttcatagttc

SEQ ID NO: 414825 - DNA, 25 bp, Mus musculus
cataggacagttggtcgaggttttc

SEQ ID NO: 414826 - DNA, 25 bp, Mus musculus
ggtccgcgcttgttgtcataggaca

SEQ ID NO: 414827 - DNA, 25 bp, Mus musculus
aaagcacccagtggctgaggcaccg

SEQ ID NO: 414828 - DNA, 25 bp, Mus musculus
tggcgtgcacgtccatgcatatata

SEQ ID NO: 414829 - DNA, 25 bp, Mus musculus
ctcgcaaacaccgagacccggggtg

SEQ ID NO: 414830 - DNA, 25 bp, Mus musculus
aaaggtgtctccttccacgctcgcg

SEQ ID NO: 414831 - DNA, 25 bp, Mus musculus
tggagtctaagacccgagtacaccg

SEQ ID NO: 414832 - DNA, 25 bp, Mus musculus
aggcatgcaaggtgcgccgtcaccc

SEQ ID NO: 414833 - DNA, 25 bp, Mus musculus
tttgcatcgatccagaaaaggtgtc

SEQ ID NO: 414834 - DNA, 25 bp, Mus musculus
cctagggcagatccggcagcgtaac

SEQ ID NO: 414835 - DNA, 25 bp, Mus musculus
cacggctcgctctacattatgcaaa

SEQ ID NO: 414836 - DNA, 25 bp, Mus musculus
agacttttctcctgcatatttcccg

SEQ ID NO: 414837 - DNA, 25 bp, Mus musculus
agccagtcttctcccaactctgtga

SEQ ID NO: 414838 - DNA, 25 bp, Mus musculus
gacggatgtacaaccagcgccactt

SEQ ID NO: 414839 - DNA, 25 bp, Mus musculus
tcccaggcatgccagggactctgtg

SEQ ID NO: 414840 - DNA, 25 bp, Mus musculus
cctttgcatcttgccctcctggaga

SEQ ID NO: 414841 - DNA, 25 bp, Mus musculus
cccagctgcgtctgttcagtactta

SEQ ID NO: 414842 - DNA, 25 bp, Mus musculus
gagacgctcattccttcgcagatgc

SEQ ID NO: 414843 - DNA, 25 bp, Mus musculus
ccctggggtactgcaagagttccag

SEQ ID NO: 414844 - DNA, 25 bp, Mus musculus
ctcatgcttgtgtagacgacccctc

SEQ ID NO: 414845 - DNA, 25 bp, Mus musculus
ctccgctcatgcttgtgtagacgac

SEQ ID NO: 414846 - DNA, 25 bp, Mus musculus
tccgctcatgcttgtgtagacgacc

SEQ ID NO: 414847 - DNA, 25 bp, Mus musculus
gctcatgcttgtgtagacgacccct

SEQ ID NO: 414848 - DNA, 25 bp, Mus musculus
tgtgtagacgacccctccgctcatg

SEQ ID NO: 414849 - DNA, 25 bp, Mus musculus
cctccgctcatgcttgtgtagacga

SEQ ID NO: 414850 - DNA, 25 bp, Mus musculus
ccgctcatgcttgtgtagacgaccc

SEQ ID NO: 414851 - DNA, 25 bp, Mus musculus
tgcttgtgtagacgacccctccgct

SEQ ID NO: 414852 - DNA, 25 bp, Mus musculus
atgcttgtgtagacgacccctccgc

SEQ ID NO: 414853 - DNA, 25 bp, Mus musculus
ccctccgctcatgcttgtgtagacg

SEQ ID NO: 414854 - DNA, 25 bp, Mus musculus
catgcttgtgtagacgacccctccg

SEQ ID NO: 414855 - DNA, 25 bp, Mus musculus
tcatgcttgtgtagacgacccctcc

SEQ ID NO: 414856 - DNA, 25 bp, Mus musculus
cgctcatgcttgtgtagacgacccc

SEQ ID NO: 414857 - DNA, 25 bp, Mus musculus
tagacgacccctccgctcatgcttg

SEQ ID NO: 414858 - DNA, 25 bp, Mus musculus
cgagtgacgtcctaggagccacaga

SEQ ID NO: 414859 - DNA, 25 bp, Mus musculus
gccacagaaagacgagcgagactgc

SEQ ID NO: 414860 - DNA, 25 bp, Mus musculus
acagaggccgagtgacgtcctagga

SEQ ID NO: 414861 - DNA, 25 bp, Mus musculus
cggcaggtaagagatggctccgctc

SEQ ID NO: 414862 - DNA, 25 bp, Mus musculus
tgacgtcctaggagccacagaaaga

SEQ ID NO: 414863 - DNA, 25 bp, Mus musculus
agaaagacgagcgagactgcggccc

SEQ ID NO: 414864 - DNA, 25 bp, Mus musculus
aagtgagactggagctaagtagagc

SEQ ID NO: 414865 - DNA, 25 bp, Mus musculus
tcctaggagccacagaaagacgagc

SEQ ID NO: 414866 - DNA, 25 bp, Mus musculus
gtagagcgatgccaaggaggaaaca

SEQ ID NO: 414867 - DNA, 25 bp, Mus musculus
ccaaggaggaaacagcaggcaccca

SEQ ID NO: 414868 - DNA, 25 bp, Mus musculus
ggaggaaacagcaggcacccaagcg

SEQ ID NO: 414869 - DNA, 25 bp, Mus musculus
gcgctttcaagagggttagcgtgcg

SEQ ID NO: 414870 - DNA, 25 bp, Mus musculus
caggtaagagatggctccgctccgg

SEQ ID NO: 414871 - DNA, 25 bp, Mus musculus
ctggagctaagtagagcgatgccaa

SEQ ID NO: 414872 - DNA, 25 bp, Mus musculus
ttccggctccgttcagtcgttgact

SEQ ID NO: 414873 - DNA, 25 bp, Mus musculus
cggctccgttcagtcgttgacttga

SEQ ID NO: 414874 - DNA, 25 bp, Mus musculus
ctgagacgggaacattgtagtaagt

SEQ ID NO: 414875 - DNA, 25 bp, Mus musculus
ttgtagtaagttctagcctgggcta

SEQ ID NO: 414876 - DNA, 25 bp, Mus musculus
agcctgggctacagtaagagacgta

SEQ ID NO: 414877 - DNA, 25 bp, Mus musculus
ggctacagtaagagacgtagtctca

SEQ ID NO: 414878 - DNA, 25 bp, Mus musculus
gacgtagtctcaaacaaggaaatgc

SEQ ID NO: 414879 - DNA, 25 bp, Mus musculus
gtctcaaacaaggaaatgcgctata

SEQ ID NO: 414880 - DNA, 25 bp, Mus musculus
taaataagatggagcttcaatggtc

SEQ ID NO: 414881 - DNA, 25 bp, Mus musculus
agatggagcttcaatggtctgtgca

SEQ ID NO: 414882 - DNA, 25 bp, Mus musculus
ggagcttcaatggtctgtgcataac

SEQ ID NO: 414883 - DNA, 25 bp, Mus musculus
ttcaatggtctgtgcataactgggg

SEQ ID NO: 414884 - DNA, 25 bp, Mus musculus
ttgaaggagccttccaaaggctggg

SEQ ID NO: 414885 - DNA, 25 bp, Mus musculus
ttcagtcgttgacttgagctgggcg

SEQ ID NO: 414886 - DNA, 25 bp, Mus musculus
gtgtcccgccatccggcctaacgtg

SEQ ID NO: 414887 - DNA, 25 bp, Mus musculus
tggttggcaggacgcagctcccgca

SEQ ID NO: 414888 - DNA, 25 bp, Mus musculus
caagaatgcgcttcccgtgcgccga

SEQ ID NO: 414889 - DNA, 25 bp, Mus musculus
cccgctcgcgttgaggctaaactga

SEQ ID NO: 414890 - DNA, 25 bp, Mus musculus
cgttgaggctaaactgaggcgcacg

SEQ ID NO: 414891 - DNA, 25 bp, Mus musculus
cacgaacttcccacgggagtttgcg

SEQ ID NO: 414892 - DNA, 25 bp, Mus musculus
ccttccttggttggcaggacgcagc

SEQ ID NO: 414893 - DNA, 25 bp, Mus musculus
gggcaggccattgtctcggccgtcc

SEQ ID NO: 414894 - DNA, 25 bp, Mus musculus
tgcgcttcccgtgcgccgagggtct

SEQ ID NO: 414895 - DNA, 25 bp, Mus musculus
cgcggcctttgtgcgtctgccgcta

SEQ ID NO: 414896 - DNA, 25 bp, Mus musculus
ggcagaaagtgctcgcagcagctgt

SEQ ID NO: 414897 - DNA, 25 bp, Mus musculus
gggcggttccagtgacaggtattct

SEQ ID NO: 414898 - DNA, 25 bp, Mus musculus
tccagtgacaggtattctggggatg

SEQ ID NO: 414899 - DNA, 25 bp, Mus musculus
actgttggggcagaaagtgctcgca

SEQ ID NO: 414900 - DNA, 25 bp, Mus musculus
ctgaaaaatcgaacgttggtctcca

SEQ ID NO: 414901 - DNA, 25 bp, Mus musculus
ctaaaggaatcaggtgccggaggac

SEQ ID NO: 414902 - DNA, 25 bp, Mus musculus
ggctgcgctacctctaaaggaatca

SEQ ID NO: 414903 - DNA, 25 bp, Mus musculus
cctcgcgttgatttgggacacaatt

SEQ ID NO: 414904 - DNA, 25 bp, Mus musculus
tcccaggctgcgctacctctaaagg

SEQ ID NO: 414905 - DNA, 25 bp, Mus musculus
atcgaacgttggtctccacggcctt

SEQ ID NO: 414906 - DNA, 25 bp, Mus musculus
ccactcctgggcgaagtggaaactg

SEQ ID NO: 414907 - DNA, 25 bp, Mus musculus
tcgtaataagcagctaagaactccc

SEQ ID NO: 414908 - DNA, 25 bp, Mus musculus
cgtttggtttcgtaataagcagcta

SEQ ID NO: 414909 - DNA, 25 bp, Mus musculus
gaaagtcacagaagaacccgaggga

SEQ ID NO: 414910 - DNA, 25 bp, Mus musculus
cacaattaaaagtcggaaagtcaca

SEQ ID NO: 414911 - DNA, 25 bp, Mus musculus
agccacgcagagtgggacccggttt

SEQ ID NO: 414912 - DNA, 25 bp, Mus musculus
tgggcgaagtggaaactgaaaaatc

SEQ ID NO: 414913 - DNA, 25 bp, Mus musculus
ggaggctcgtgcctcgcgttgattt

SEQ ID NO: 414914 - DNA, 25 bp, Mus musculus
cacaggatcatcagcccgtaggctt

SEQ ID NO: 414915 - DNA, 25 bp, Mus musculus
atgcaccgagtcgaaggagcccagc

SEQ ID NO: 414916 - DNA, 25 bp, Mus musculus
ggagcccagcttcatccggaaaatc

SEQ ID NO: 414917 - DNA, 25 bp, Mus musculus
cagaggggactgactcacaggatca

SEQ ID NO: 414918 - DNA, 25 bp, Mus musculus
ccgataggctttccagggtttgatc

SEQ ID NO: 414919 - DNA, 25 bp, Mus musculus
tctgtgcggtacagagcttccagca

SEQ ID NO: 414920 - DNA, 25 bp, Mus musculus
ggcacctcttttggcgcacgcttca

SEQ ID NO: 414921 - DNA, 25 bp, Mus musculus
tctcaccgtcggtcatcagcgggca

SEQ ID NO: 414922 - DNA, 25 bp, Mus musculus
tggccatacttcttgtggtactctg

SEQ ID NO: 414923 - DNA, 25 bp, Mus musculus
aaaaatctccagtaggctgcccagc

SEQ ID NO: 414924 - DNA, 25 bp, Mus musculus
ttctgcctcgagctgctgacctgag

SEQ ID NO: 414925 - DNA, 25 bp, Mus musculus
accagtgtgtcgtgctgtttcttca

SEQ ID NO: 414926 - DNA, 25 bp, Mus musculus
cacgcttcacgtgcgccttggatgt

SEQ ID NO: 414927 - DNA, 25 bp, Mus musculus
gttgtccatacgtcccagggaactc

SEQ ID NO: 414928 - DNA, 25 bp, Mus musculus
gtgcgctgcgagcacgcctcctctc

SEQ ID NO: 414929 - DNA, 25 bp, Mus musculus
tcctgaggacagtgcggaagaccgc

SEQ ID NO: 414930 - DNA, 25 bp, Mus musculus
aatcgccactcagggcgggcaaggt

SEQ ID NO: 414931 - DNA, 25 bp, Mus musculus
ttgcacaatcgccactcagggcggg

SEQ ID NO: 414932 - DNA, 25 bp, Mus musculus
tgcgcttgcacaatcgccactcagg

SEQ ID NO: 414933 - DNA, 25 bp, Mus musculus
caaggctgcgcttgcacaatcgcca

SEQ ID NO: 414934 - DNA, 25 bp, Mus musculus
tcctgcaggttgcagccggccttgc

SEQ ID NO: 414935 - DNA, 25 bp, Mus musculus
aaaggcgagtcgagcccagggttca

SEQ ID NO: 414936 - DNA, 25 bp, Mus musculus
taacctgagaaaggcgagtcgagcc

SEQ ID NO: 414937 - DNA, 25 bp, Mus musculus
cccggagataacctgagaaaggcga

SEQ ID NO: 414938 - DNA, 25 bp, Mus musculus
gcggacgcaccgtggtggactccac

SEQ ID NO: 414939 - DNA, 25 bp, Mus musculus
tcgggtgaccgacacgctgctggcc

SEQ ID NO: 414940 - DNA, 25 bp, Mus musculus
ggcctcgggtgaccgacacgctgct

SEQ ID NO: 414941 - DNA, 25 bp, Mus musculus
cagccggccttgcaggagcccaagg

SEQ ID NO: 414942 - DNA, 25 bp, Mus musculus
ctccgggcttttcccagccattagg

SEQ ID NO: 414943 - DNA, 25 bp, Mus musculus
ccagccattaggaaggacacgggtc

SEQ ID NO: 414944 - DNA, 25 bp, Mus musculus
attgacgttgagagcagtcggcccg

SEQ ID NO: 414945 - DNA, 25 bp, Mus musculus
gcaccgagtgtctaattgacgttga

SEQ ID NO: 414946 - DNA, 25 bp, Mus musculus
ccaccatgaagaaggcggtgagtgc

SEQ ID NO: 414947 - DNA, 25 bp, Mus musculus
gctccgtgcaccgagtgtctaattg

SEQ ID NO: 414948 - DNA, 25 bp, Mus musculus
ggtccacgctccgtgcaccgagtgt

SEQ ID NO: 414949 - DNA, 25 bp, Mus musculus
gcgtcgtctgctaccgcacctctgt

SEQ ID NO: 414950 - DNA, 25 bp, Mus musculus
tcgtgcatctcctcgggcaccgggt

SEQ ID NO: 414951 - DNA, 25 bp, Mus musculus
ctcacctgctcagggtcgtgcatct

SEQ ID NO: 414952 - DNA, 25 bp, Mus musculus
gccgtcagggcaaccgcctcacctg

SEQ ID NO: 414953 - DNA, 25 bp, Mus musculus
gtacaggggtgcttctgtccgctcc

SEQ ID NO: 414954 - DNA, 25 bp, Mus musculus
tgacgcacgcccgagtggttttccc

SEQ ID NO: 414955 - DNA, 25 bp, Mus musculus
cccgtggttcagtccaagatggcgg

SEQ ID NO: 414956 - DNA, 25 bp, Mus musculus
gaagtctcccttcgaactggctggc

SEQ ID NO: 414957 - DNA, 25 bp, Mus musculus
cctttaaggagctcatgcagaactc

SEQ ID NO: 414958 - DNA, 25 bp, Mus musculus
aatcagttttgcctggggccacggc

SEQ ID NO: 414959 - DNA, 25 bp, Mus musculus
ccaagcactcctggtgaagcacaga

SEQ ID NO: 414960 - DNA, 25 bp, Mus musculus
ctctggttggcgcaggaacaaatta

SEQ ID NO: 414961 - DNA, 25 bp, Mus musculus
taggatgctagcgacttccacttgc

SEQ ID NO: 414962 - DNA, 25 bp, Mus musculus
tccacttgcgcttggtcaaaaattc

SEQ ID NO: 414963 - DNA, 25 bp, Mus musculus
gtgcccgtcgccaaaagcagttcta

SEQ ID NO: 414964 - DNA, 25 bp, Mus musculus
gcgtccctgcgcacaactttgtgtc

SEQ ID NO: 414965 - DNA, 25 bp, Mus musculus
actttgtgtctcagcgtgcagtgca

SEQ ID NO: 414966 - DNA, 25 bp, Mus musculus
ggcacccgcgcgctatttataggag

SEQ ID NO: 414967 - DNA, 25 bp, Mus musculus
tgctgcctgcagatggctttggctc

SEQ ID NO: 414968 - DNA, 25 bp, Mus musculus
gcgcctgtgtgacgttgaacgcacc

SEQ ID NO: 414969 - DNA, 25 bp, Mus musculus
tgccaaggtctgaggtcacttgatc

SEQ ID NO: 414970 - DNA, 25 bp, Mus musculus
aagagagcgagcgtctccagatgcc

SEQ ID NO: 414971 - DNA, 25 bp, Mus musculus
gcccactccgcttcaggaggcggaa

SEQ ID NO: 414972 - DNA, 25 bp, Mus musculus
tcaggaggcggaacttagccaagga

SEQ ID NO: 414973 - DNA, 25 bp, Mus musculus
cgctgtgttggagctgattcccgag

SEQ ID NO: 414974 - DNA, 25 bp, Mus musculus
tgtctcagccgccaggtaagactcc

SEQ ID NO: 414975 - DNA, 25 bp, Mus musculus
tagccttgtcccatccggttccgga

SEQ ID NO: 414976 - DNA, 25 bp, Mus musculus
gctctgggccttagccttgtcccat

SEQ ID NO: 414977 - DNA, 25 bp, Mus musculus
ctgttgacgctgcttggcccggcag

SEQ ID NO: 414978 - DNA, 25 bp, Mus musculus
aaaacctgcgctccgctatagagcc

SEQ ID NO: 414979 - DNA, 25 bp, Mus musculus
ctgattcccgagtgggcacactgga

SEQ ID NO: 414980 - DNA, 25 bp, Mus musculus
cacccactcatggataggctgcttc

SEQ ID NO: 414981 - DNA, 25 bp, Mus musculus
ggtggagcccaaaacctgcgctccg

SEQ ID NO: 414982 - DNA, 25 bp, Mus musculus
ctcatggataggctgcttctgcgga

SEQ ID NO: 414983 - DNA, 25 bp, Mus musculus
cccaccgcgctgtgttggagctgat

SEQ ID NO: 414984 - DNA, 25 bp, Mus musculus
tacagagaaccagggacagtcatcc

SEQ ID NO: 414985 - DNA, 25 bp, Mus musculus
tggtcccgacttgcgatagctgagc

SEQ ID NO: 414986 - DNA, 25 bp, Mus musculus
ctgagccgggtttcttatcaccacg

SEQ ID NO: 414987 - DNA, 25 bp, Mus musculus
cctggactgtgcgactggtcccgat

SEQ ID NO: 414988 - DNA, 25 bp, Mus musculus
cacgcgcgttagcatacagagaacc

SEQ ID NO: 414989 - DNA, 25 bp, Mus musculus
gcctgcgttggcgtaaatgcttgga

SEQ ID NO: 414990 - DNA, 25 bp, Mus musculus
gctgctcgaacacccgcgcggaaaa

SEQ ID NO: 414991 - DNA, 25 bp, Mus musculus
agcacccgcggattcttcaggagcc

SEQ ID NO: 414992 - DNA, 25 bp, Mus musculus
gcgagcgcgaccacctcgcgatgta

SEQ ID NO: 414993 - DNA, 25 bp, Mus musculus
tgtcagcaggtgcatggtgctcatg

SEQ ID NO: 414994 - DNA, 25 bp, Mus musculus
gcaccgcgccgatgttgacaatctt

SEQ ID NO: 414995 - DNA, 25 bp, Mus musculus
gaacatctgctcgtgcttgcgcgtg

SEQ ID NO: 414996 - DNA, 25 bp, Mus musculus
ctggtttactgcctcgcggaacatc

SEQ ID NO: 414997 - DNA, 25 bp, Mus musculus
cgtgtcgcttattggcctggtttac

SEQ ID NO: 414998 - DNA, 25 bp, Mus musculus
gggcacgattcgctcctccattttt

SEQ ID NO: 414999 - DNA, 25 bp, Mus musculus
gccgttctgtgattggctcaccgta

SEQ ID NO: 415000 - DNA, 25 bp, Mus musculus
ccgtaaacgcgactatgggaagctc

SEQ ID NO: 415001 - DNA, 25 bp, Mus musculus
gaagctcgttccctgccgtagctgg

SEQ ID NO: 415002 - DNA, 25 bp, Mus musculus
tcaggcgttcgccagtcacacacag

SEQ ID NO: 415003 - DNA, 25 bp, Mus musculus
cacacagccctttggattcaaggca

SEQ ID NO: 415004 - DNA, 25 bp, Mus musculus
agcgtctcgaacgtgccagtgagta

SEQ ID NO: 415005 - DNA, 25 bp, Mus musculus
tccgagcgatcgatcgggcacgatt

SEQ ID NO: 415006 - DNA, 25 bp, Mus musculus
agaccgagaccctgatctgcgggta

SEQ ID NO: 415007 - DNA, 25 bp, Mus musculus
ttggctagggtctgtagtggatcac

SEQ ID NO: 415008 - DNA, 25 bp, Mus musculus
atcacgtgaaggaccggggctaacg

SEQ ID NO: 415009 - DNA, 25 bp, Mus musculus
caagtccgtgtcctagagttggccg

SEQ ID NO: 415010 - DNA, 25 bp, Mus musculus
attccgccctgagcagaagtggtcg

SEQ ID NO: 415011 - DNA, 25 bp, Mus musculus
gcatgccctttgcacgtgcgcactg

SEQ ID NO: 415012 - DNA, 25 bp, Mus musculus
ctcgtctttgctaaggcttctggtt

SEQ ID NO: 415013 - DNA, 25 bp, Mus musculus
tctgatttcggctttgggatgggtt

SEQ ID NO: 415014 - DNA, 25 bp, Mus musculus
aggcccaagcttacggaaccacaga

SEQ ID NO: 415015 - DNA, 25 bp, Mus musculus
gctacggtttctgatttcggctttg

SEQ ID NO: 415016 - DNA, 25 bp, Mus musculus
cttctggtttttgctacggtttctg

SEQ ID NO: 415017 - DNA, 25 bp, Mus musculus
tgtgcgtcatcaaggagcgccggaa

SEQ ID NO: 415018 - DNA, 25 bp, Mus musculus
cggaagcgacggcttctcgtctttg

SEQ ID NO: 415019 - DNA, 25 bp, Mus musculus
gcgcgctggttgtgtgcgtcatcaa

SEQ ID NO: 415020 - DNA, 25 bp, Mus musculus
ccggacaagattttcaagacaattg

SEQ ID NO: 415021 - DNA, 25 bp, Mus musculus
gcccaactcccggacaagattttca

SEQ ID NO: 415022 - DNA, 25 bp, Mus musculus
gatgctccagcacgtcgccctgaaa

SEQ ID NO: 415023 - DNA, 25 bp, Mus musculus
accggaagtggacgcactccaagga

SEQ ID NO: 415024 - DNA, 25 bp, Mus musculus
cagggaccgcccacgaccggaagtg

SEQ ID NO: 415025 - DNA, 25 bp, Mus musculus
gacaattggtgtggaccaaggcctc

SEQ ID NO: 415026 - DNA, 25 bp, Mus musculus
ggagcagcggcactgcaaagtccgc

SEQ ID NO: 415027 - DNA, 25 bp, Mus musculus
ttactttgggcacactgcccgaccg

SEQ ID NO: 415028 - DNA, 25 bp, Mus musculus
attgggccgcgtcgtgtgacgtcac

SEQ ID NO: 415029 - DNA, 25 bp, Mus musculus
gcactgcaaagtccgctgtggctga

SEQ ID NO: 415030 - DNA, 25 bp, Mus musculus
taaaggagggtgtctggaccatgca

SEQ ID NO: 415031 - DNA, 25 bp, Mus musculus
ggtgtctggaccatgcaaaggcgcc

SEQ ID NO: 415032 - DNA, 25 bp, Mus musculus
caaaggcgccggcttgcggggctta

SEQ ID NO: 415033 - DNA, 25 bp, Mus musculus
tgtggtggtggtcaaagcgcccgca

SEQ ID NO: 415034 - DNA, 25 bp, Mus musculus
ccaccgttgtgggtatgcggtgctt

SEQ ID NO: 415035 - DNA, 25 bp, Mus musculus
ggtgcttgtgggagcccgacccaca

SEQ ID NO: 415036 - DNA, 25 bp, Mus musculus
gacccacatcggtgctcttactttg

SEQ ID NO: 415037 - DNA, 25 bp, Mus musculus
cacatcggtgctcttactttgggca

SEQ ID NO: 415038 - DNA, 25 bp, Mus musculus
gctgagacgcgacgagtcggtgtct

SEQ ID NO: 415039 - DNA, 25 bp, Mus musculus
tgctcttactttgggcacactgccc

SEQ ID NO: 415040 - DNA, 25 bp, Mus musculus
ggcccgcagccagatacagcttcgg

SEQ ID NO: 415041 - DNA, 25 bp, Mus musculus
atggaggtttattctgcctggaacc

SEQ ID NO: 415042 - DNA, 25 bp, Mus musculus
attctgcctggaacctcttttcctg

SEQ ID NO: 415043 - DNA, 25 bp, Mus musculus
gaacctcttttcctgggcgagtaga

SEQ ID NO: 415044 - DNA, 25 bp, Mus musculus
ttttcctgggcgagtagaggcttct

SEQ ID NO: 415045 - DNA, 25 bp, Mus musculus
agtagaggcttctgaagagccgccc

SEQ ID NO: 415046 - DNA, 25 bp, Mus musculus
ggcttctgaagagccgcccgtgaca

SEQ ID NO: 415047 - DNA, 25 bp, Mus musculus
gagccgcccgtgacagctgcagaac

SEQ ID NO: 415048 - DNA, 25 bp, Mus musculus
agcttcgggctatagctgcagcacg

SEQ ID NO: 415049 - DNA, 25 bp, Mus musculus
gtctcctccagccacggcccgcagc

SEQ ID NO: 415050 - DNA, 25 bp, Mus musculus
gcccgtggcgatggaggtttattct

SEQ ID NO: 415051 - DNA, 25 bp, Mus musculus
gccagatacagcttcgggctatagc

SEQ ID NO: 415052 - DNA, 25 bp, Mus musculus
ctccgcagggctgggcatcgcagca

SEQ ID NO: 415053 - DNA, 25 bp, Mus musculus
ctatagctgcagcacgcggttgtcc

SEQ ID NO: 415054 - DNA, 25 bp, Mus musculus
cattccttctctacaccgggatgtg

SEQ ID NO: 415055 - DNA, 25 bp, Mus musculus
ggtctctccggacgacattactatg

SEQ ID NO: 415056 - DNA, 25 bp, Mus musculus
cttggctagcaaggatcacagctcc

SEQ ID NO: 415057 - DNA, 25 bp, Mus musculus
aagacctcacttcctaaggcgcaga

SEQ ID NO: 415058 - DNA, 25 bp, Mus musculus
agtctcctccaaggaaggcttgtca

SEQ ID NO: 415059 - DNA, 25 bp, Mus musculus
accgggatgtgtgagaaccttgacc

SEQ ID NO: 415060 - DNA, 25 bp, Mus musculus
gccttacctgagagtgtcacttccg

SEQ ID NO: 415061 - DNA, 25 bp, Mus musculus
tcggcgttgcgcattatccgcgcta

SEQ ID NO: 415062 - DNA, 25 bp, Mus musculus
ccagtttggcagagtcttttcattc

SEQ ID NO: 415063 - DNA, 25 bp, Mus musculus
aattaagtctgaccgccttggggcg

SEQ ID NO: 415064 - DNA, 25 bp, Mus musculus
ctgccagcgacacctttgaggagtc

SEQ ID NO: 415065 - DNA, 25 bp, Mus musculus
ccctgggactgatgaagacacatct

SEQ ID NO: 415066 - DNA, 25 bp, Mus musculus
cgcgagtactctagcctgtcggaca

SEQ ID NO: 415067 - DNA, 25 bp, Mus musculus
aaccttgaccatggccgggctggaa

SEQ ID NO: 415068 - DNA, 25 bp, Mus musculus
cgccgcctttgagccgcgagtgaca

SEQ ID NO: 415069 - DNA, 25 bp, Mus musculus
gccgggctcttttgcatgcagcctt

SEQ ID NO: 415070 - DNA, 25 bp, Mus musculus
cggatgcctgcaccgggataatgaa

SEQ ID NO: 415071 - DNA, 25 bp, Mus musculus
ttcagcctttgaatgggccgccgcc

SEQ ID NO: 415072 - DNA, 25 bp, Mus musculus
tgcagccttgctgaatgggacgcct

SEQ ID NO: 415073 - DNA, 25 bp, Mus musculus
ttacgatgatctaacggccgggctc

SEQ ID NO: 415074 - DNA, 25 bp, Mus musculus
ggccgtgtcgatgggataattacga

SEQ ID NO: 415075 - DNA, 25 bp, Mus musculus
acagccctgggctgctgatgtcaga

SEQ ID NO: 415076 - DNA, 25 bp, Mus musculus
gcgccaagtgtgtgcaataaaagtg

SEQ ID NO: 415077 - DNA, 25 bp, Mus musculus
attccaataagtgtcgcccgggagg

SEQ ID NO: 415078 - DNA, 25 bp, Mus musculus
gaggggccaacgtctattacattcc

SEQ ID NO: 415079 - DNA, 25 bp, Mus musculus
tattggcatcctcgctgggccctgt

SEQ ID NO: 415080 - DNA, 25 bp, Mus musculus
aagcaagcggcggttattggcatcc

SEQ ID NO: 415081 - DNA, 25 bp, Mus musculus
ctgcattgaggctggccggtgtaaa

SEQ ID NO: 415082 - DNA, 25 bp, Mus musculus
cgccactcacctaggttgacgaagc

SEQ ID NO: 415083 - DNA, 25 bp, Mus musculus
tgtcctttactcagttctggcccgg

SEQ ID NO: 415084 - DNA, 25 bp, Mus musculus
gtcacttgctgcaggcgagcttcaa

SEQ ID NO: 415085 - DNA, 25 bp, Mus musculus
agcggtccacgacccgaggtcactt

SEQ ID NO: 415086 - DNA, 25 bp, Mus musculus
gcacctcgttgtccaggctgaaatc

SEQ ID NO: 415087 - DNA, 25 bp, Mus musculus
accctaagatggacaggatctcccg

SEQ ID NO: 415088 - DNA, 25 bp, Mus musculus
ccgccatggcgttgtacaggtccaa

SEQ ID NO: 415089 - DNA, 25 bp, Mus musculus
gtggctgtaagcagagaccctctcc

SEQ ID NO: 415090 - DNA, 25 bp, Mus musculus
ctggcgggcactgatgctttgcaaa

SEQ ID NO: 415091 - DNA, 25 bp, Mus musculus
tccgagacgcacagagcttaaagtc

SEQ ID NO: 415092 - DNA, 25 bp, Mus musculus
ctccgagccagcaagacttatccga

SEQ ID NO: 415093 - DNA, 25 bp, Mus musculus
cccagccgggcgctttgaactaagc

SEQ ID NO: 415094 - DNA, 25 bp, Mus musculus
tgaagccggttcagctcacatgacc

SEQ ID NO: 415095 - DNA, 25 bp, Mus musculus
ggcgccgaattatgctttccctgga

SEQ ID NO: 415096 - DNA, 25 bp, Mus musculus
caggaggcctcagagcggctccgca

SEQ ID NO: 415097 - DNA, 25 bp, Mus musculus
agcgtcggaggccacgtccgagccc

SEQ ID NO: 415098 - DNA, 25 bp, Mus musculus
cagcagctcggcagggccatggaaa

SEQ ID NO: 415099 - DNA, 25 bp, Mus musculus
ggcctctaggtacagcagctcggca

SEQ ID NO: 415100 - DNA, 25 bp, Mus musculus
acccgcgtggcctctaggtacagca

SEQ ID NO: 415101 - DNA, 25 bp, Mus musculus
ggcttccctgttggccatggtgaag

SEQ ID NO: 415102 - DNA, 25 bp, Mus musculus
ctggatcggcacagggcttccctgt

SEQ ID NO: 415103 - DNA, 25 bp, Mus musculus
ctcgttcttcgacgccctggatcgg

SEQ ID NO: 415104 - DNA, 25 bp, Mus musculus
ggcctcgttcttcgacgccctggat

SEQ ID NO: 415105 - DNA, 25 bp, Mus musculus
cctatggggcccgaggcctcgttct

SEQ ID NO: 415106 - DNA, 25 bp, Mus musculus
cattatggcgttcgcgcctatgggg

SEQ ID NO: 415107 - DNA, 25 bp, Mus musculus
agagcggctccgcatccgccattat

SEQ ID NO: 415108 - DNA, 25 bp, Mus musculus
catgcgcgtggctagagcgcggaaa

SEQ ID NO: 415109 - DNA, 25 bp, Mus musculus
cgccattatggcgttcgcgcctatg

SEQ ID NO: 415110 - DNA, 25 bp, Mus musculus
cgtgcgcatggtgatctgaaactaa

SEQ ID NO: 415111 - DNA, 25 bp, Mus musculus
taagtcctcaagtaaattgcacggg

SEQ ID NO: 415112 - DNA, 25 bp, Mus musculus
aacaacgccctctctcaactagttg

SEQ ID NO: 415113 - DNA, 25 bp, Mus musculus
actgcgctggccgactttccacaaa

SEQ ID NO: 415114 - DNA, 25 bp, Mus musculus
tttccacaaacgcacaactgctggc

SEQ ID NO: 415115 - DNA, 25 bp, Mus musculus
ctgctggcataaacacttcctctcg

SEQ ID NO: 415116 - DNA, 25 bp, Mus musculus
ctcagcagggcttctgcgcatgtgc

SEQ ID NO: 415117 - DNA, 25 bp, Mus musculus
tgctctgacgctttccgggcagtcc

SEQ ID NO: 415118 - DNA, 25 bp, Mus musculus
tgcttctgtggtaacggggcagttt

SEQ ID NO: 415119 - DNA, 25 bp, Mus musculus
agtttccaccggcttgaggcggacg

SEQ ID NO: 415120 - DNA, 25 bp, Mus musculus
acgcttgggagcagcccgagctaac

SEQ ID NO: 415121 - DNA, 25 bp, Mus musculus
cgagctaacccagtcagccaggaga

SEQ ID NO: 415122 - DNA, 25 bp, Mus musculus
ggtacgcccttgctcttctcacgtg

SEQ ID NO: 415123 - DNA, 25 bp, Mus musculus
gcgtgcggatcccagcacacactgg

SEQ ID NO: 415124 - DNA, 25 bp, Mus musculus
acagacaagctgataccggcgagca

SEQ ID NO: 415125 - DNA, 25 bp, Mus musculus
ctagtcgctcgggtgtaaaccactg

SEQ ID NO: 415126 - DNA, 25 bp, Mus musculus
ggcgagcacctaggggctaagtcac

SEQ ID NO: 415127 - DNA, 25 bp, Mus musculus
gggctaagtcacctcattcgccgga

SEQ ID NO: 415128 - DNA, 25 bp, Mus musculus
ggcacgcgggacgtacttagaacta

SEQ ID NO: 415129 - DNA, 25 bp, Mus musculus
tgtcttaaacgagaggggcgtgacc

SEQ ID NO: 415130 - DNA, 25 bp, Mus musculus
ggaactcggattcggcctgggacac

SEQ ID NO: 415131 - DNA, 25 bp, Mus musculus
gccatgcacggctcacagaaggaca

SEQ ID NO: 415132 - DNA, 25 bp, Mus musculus
ccaccgacgcatcgctcagaaagta

SEQ ID NO: 415133 - DNA, 25 bp, Mus musculus
ctcagaaagtacttcgagggcttcg

SEQ ID NO: 415134 - DNA, 25 bp, Mus musculus
aagtcccgcggctacggcttcgtga

SEQ ID NO: 415135 - DNA, 25 bp, Mus musculus
cgtaagctgttagcgccagcgactt

SEQ ID NO: 415136 - DNA, 25 bp, Mus musculus
gcttggaatataccggaccgtgcgc

SEQ ID NO: 415137 - DNA, 25 bp, Mus musculus
aaaccactgaatcaagcaacgcttg

SEQ ID NO: 415138 - DNA, 25 bp, Mus musculus
gtgtgccccctaacctgtgcgcggg

SEQ ID NO: 415139 - DNA, 25 bp, Mus musculus
cgcactgtcatgtcgttgcggcagt

SEQ ID NO: 415140 - DNA, 25 bp, Mus musculus
atgtcgttgcggcagttggccacgc

SEQ ID NO: 415141 - DNA, 25 bp, Mus musculus
ggcagttggccacgcggaacagctc

SEQ ID NO: 415142 - DNA, 25 bp, Mus musculus
cccagtctcctccagcttcacccgc

SEQ ID NO: 415143 - DNA, 25 bp, Mus musculus
gcttcacccgcaggacatagacgtc

SEQ ID NO: 415144 - DNA, 25 bp, Mus musculus
tcacccgcaggacatagacgtcagg

SEQ ID NO: 415145 - DNA, 25 bp, Mus musculus
cgcaggacatagacgtcaggagtca

SEQ ID NO: 415146 - DNA, 25 bp, Mus musculus
catagacgtcaggagtcaagtctgg

SEQ ID NO: 415147 - DNA, 25 bp, Mus musculus
aggcaagcgggtcccctgtgtgccc

SEQ ID NO: 415148 - DNA, 25 bp, Mus musculus
acgtctgccgccctccgcatggccc

SEQ ID NO: 415149 - DNA, 25 bp, Mus musculus
gcatggcccgcgtcatcccgcgcgt

SEQ ID NO: 415150 - DNA, 25 bp, Mus musculus
gtcatcccgcgcgtcatcgccgccc

SEQ ID NO: 415151 - DNA, 25 bp, Mus musculus
caagtctggcgacacggtggaggca

SEQ ID NO: 415152 - DNA, 25 bp, Mus musculus
actccggcaagggtgatagtccaca

SEQ ID NO: 415153 - DNA, 25 bp, Mus musculus
cgcgcacggaaaagtgaggtcgttt

SEQ ID NO: 415154 - DNA, 25 bp, Mus musculus
atggtcgcagaaagggtcgctccca

SEQ ID NO: 415155 - DNA, 25 bp, Mus musculus
agtttctgtgctgcgtctggttctc

SEQ ID NO: 415156 - DNA, 25 bp, Mus musculus
gttcgtgtctcttccagcgtccaga

SEQ ID NO: 415157 - DNA, 25 bp, Mus musculus
tacctagctggagcgttcgtgtctc

SEQ ID NO: 415158 - DNA, 25 bp, Mus musculus
ccttaccgagggaagtacctagctg

SEQ ID NO: 415159 - DNA, 25 bp, Mus musculus
ggccggcttcgcagttatgtaccca

SEQ ID NO: 415160 - DNA, 25 bp, Mus musculus
tccagcaagcgaggtcttttgggcc

SEQ ID NO: 415161 - DNA, 25 bp, Mus musculus
ccgcggtctttctcagtcttgggct

SEQ ID NO: 415162 - DNA, 25 bp, Mus musculus
gatgccttcgttatggcagcccgcg

SEQ ID NO: 415163 - DNA, 25 bp, Mus musculus
tgagcttgcgcaacgaccgataaga

SEQ ID NO: 415164 - DNA, 25 bp, Mus musculus
tccggtcaggagttttgcgtttcac

SEQ ID NO: 415165 - DNA, 25 bp, Mus musculus
tgcgcgcgattcagcgacgtaagga

SEQ ID NO: 415166 - DNA, 25 bp, Mus musculus
ccgctttgatcttttcccgcaggtc

SEQ ID NO: 415167 - DNA, 25 bp, Mus musculus
tttcgctacatctacccgtcgcttt

SEQ ID NO: 415168 - DNA, 25 bp, Mus musculus
ttctccctcgatctttctcggcagg

SEQ ID NO: 415169 - DNA, 25 bp, Mus musculus
ccgtcgcttttcctcgctaggtctt

SEQ ID NO: 415170 - DNA, 25 bp, Mus musculus
cgtggttcttctttctagaccgctt

SEQ ID NO: 415171 - DNA, 25 bp, Mus musculus
cgccgttcctcgctagatctttttc

SEQ ID NO: 415172 - DNA, 25 bp, Mus musculus
gctctttctcggcaggtcttttcct

SEQ ID NO: 415173 - DNA, 25 bp, Mus musculus
cttcgctcctgctcgctaggttttc

SEQ ID NO: 415174 - DNA, 25 bp, Mus musculus
tgctcgctaatttttcccgctttga

SEQ ID NO: 415175 - DNA, 25 bp, Mus musculus
cctcgcttctgctcgctgttttttg

SEQ ID NO: 415176 - DNA, 25 bp, Mus musculus
cctctcgatctttctcggcaggttt

SEQ ID NO: 415177 - DNA, 25 bp, Mus musculus
ctgctcgctaggtttgtgttgtttt

SEQ ID NO: 415178 - DNA, 25 bp, Mus musculus
ttcgcccgctctttctcaatcttta

SEQ ID NO: 415179 - DNA, 25 bp, Mus musculus
tttgcacgcgggcagaggaaatgaa

SEQ ID NO: 415180 - DNA, 25 bp, Mus musculus
tgtagccatggctgtagccgtggcc

SEQ ID NO: 415181 - DNA, 25 bp, Mus musculus
agaccaaagggaagttgtagccatg

SEQ ID NO: 415182 - DNA, 25 bp, Mus musculus
acccggaagtggaagctgtggcttc

SEQ ID NO: 415183 - DNA, 25 bp, Mus musculus
ggcgcgctgagattgatccttaaaa

SEQ ID NO: 415184 - DNA, 25 bp, Mus musculus
tagaggccgccactgaacgaacagc

SEQ ID NO: 415185 - DNA, 25 bp, Mus musculus
tgaacgaacagcgtaactcagtgcg

SEQ ID NO: 415186 - DNA, 25 bp, Mus musculus
gtaactcagtgcgtctggcccgtct

SEQ ID NO: 415187 - DNA, 25 bp, Mus musculus
gcccgtctgtgggaacttcctgcca

SEQ ID NO: 415188 - DNA, 25 bp, Mus musculus
cgctgatccttacaaagacggttaa

SEQ ID NO: 415189 - DNA, 25 bp, Mus musculus
aggcgctgttcagtcgcgcaggcca

SEQ ID NO: 415190 - DNA, 25 bp, Mus musculus
gtcgccctctgctgacggatcacag

SEQ ID NO: 415191 - DNA, 25 bp, Mus musculus
caaaagagacgagcgccgacccgga

SEQ ID NO: 415192 - DNA, 25 bp, Mus musculus
ttgacgtccctgtaaacaaaagaga

SEQ ID NO: 415193 - DNA, 25 bp, Mus musculus
tcctgccagatctcgctgatcctta

SEQ ID NO: 415194 - DNA, 25 bp, Mus musculus
cactccttagagaagatggggctga

SEQ ID NO: 415195 - DNA, 25 bp, Mus musculus
cttaaagtgtgcctgctcggggtaa

SEQ ID NO: 415196 - DNA, 25 bp, Mus musculus
ccatggcgctgagggaacttaaagt

SEQ ID NO: 415197 - DNA, 25 bp, Mus musculus
gttgaggtgactccgccggacaagt

SEQ ID NO: 415198 - DNA, 25 bp, Mus musculus
gtgtcccggctgttgaggtgactcc

SEQ ID NO: 415199 - DNA, 25 bp, Mus musculus
ggtgacccagctggcgtcccaagat

SEQ ID NO: 415200 - DNA, 25 bp, Mus musculus
tgaggctccgcccattggtgctccg

SEQ ID NO: 415201 - DNA, 25 bp, Mus musculus
cccgcccactccttagagaagatgg

SEQ ID NO: 415202 - DNA, 25 bp, Mus musculus
gcgtggtagcttcaagattacgccc

SEQ ID NO: 415203 - DNA, 25 bp, Mus musculus
ctagaggcgtggtagcttcaagatt

SEQ ID NO: 415204 - DNA, 25 bp, Mus musculus
ggaacttaaagtgtgcctgctcggg

SEQ ID NO: 415205 - DNA, 25 bp, Mus musculus
actcacccgccatcttaggatgtgc

SEQ ID NO: 415206 - DNA, 25 bp, Mus musculus
cctttacgctcagcgcgggacgcag

SEQ ID NO: 415207 - DNA, 25 bp, Mus musculus
ccatcttaggatgtgccagagggcg

SEQ ID NO: 415208 - DNA, 25 bp, Mus musculus
ccatggcgaaggtggaacaggtcct

SEQ ID NO: 415209 - DNA, 25 bp, Mus musculus
aacaggtcctgagcctcgagccaca

SEQ ID NO: 415210 - DNA, 25 bp, Mus musculus
agccacaacacgagctcaagttccg

SEQ ID NO: 415211 - DNA, 25 bp, Mus musculus
tcaagttccgaggtaagcggccggc

SEQ ID NO: 415212 - DNA, 25 bp, Mus musculus
gacactgtccgcttgaggcccgcat

SEQ ID NO: 415213 - DNA, 25 bp, Mus musculus
accaggcgtctaatgcatgcatgtg

SEQ ID NO: 415214 - DNA, 25 bp, Mus musculus
agtcagtgcatggaaacggtttgcc

SEQ ID NO: 415215 - DNA, 25 bp, Mus musculus
ggtttgcctgagtacccttccatca

SEQ ID NO: 415216 - DNA, 25 bp, Mus musculus
agctgccggggttacagcccacgaa

SEQ ID NO: 415217 - DNA, 25 bp, Mus musculus
gcgcagtctcccttttgtcgctgga

SEQ ID NO: 415218 - DNA, 25 bp, Mus musculus
agtggccctgaacaccctgcgcatg

SEQ ID NO: 415219 - DNA, 25 bp, Mus musculus
cgcaggcgcttactgaacagtctca

SEQ ID NO: 415220 - DNA, 25 bp, Mus musculus
ccggcatctgctacgtacgtgcgta

SEQ ID NO: 415221 - DNA, 25 bp, Mus musculus
aggcccgcatgcaccaggcgtctaa

SEQ ID NO: 415222 - DNA, 25 bp, Mus musculus
agctgtagacgctcctttgtcgttg

SEQ ID NO: 415223 - DNA, 25 bp, Mus musculus
tctccaggacgtttgatttcgacgc

SEQ ID NO: 415224 - DNA, 25 bp, Mus musculus
cgagtgctttgagatccgagccagc

SEQ ID NO: 415225 - DNA, 25 bp, Mus musculus
cgccagcacctttggggaggtctta

SEQ ID NO: 415226 - DNA, 25 bp, Mus musculus
cctgtttggagcaggccttttgtga

SEQ ID NO: 415227 - DNA, 25 bp, Mus musculus
cgcgcttaggcggattgcaaaatcg

SEQ ID NO: 415228 - DNA, 25 bp, Mus musculus
ctcaggcgactatatgggagctgta

SEQ ID NO: 415229 - DNA, 25 bp, Mus musculus
gcctcagtaggctcaggcgactata

SEQ ID NO: 415230 - DNA, 25 bp, Mus musculus
gggaatgctagagcccgggaccact

SEQ ID NO: 415231 - DNA, 25 bp, Mus musculus
cacccgcgaggaacggacaggaaga

SEQ ID NO: 415232 - DNA, 25 bp, Mus musculus
agcaatctcatgaatgtcgcagggg

SEQ ID NO: 415233 - DNA, 25 bp, Mus musculus
cgctcccggaacgttgcaagcaatc

SEQ ID NO: 415234 - DNA, 25 bp, Mus musculus
gcagggcaataagggagctcccgct

SEQ ID NO: 415235 - DNA, 25 bp, Mus musculus
aaactcggagttagagccacatgcc

SEQ ID NO: 415236 - DNA, 25 bp, Mus musculus
gcctaattgtcaggccactgcagta

SEQ ID NO: 415237 - DNA, 25 bp, Mus musculus
agtagccagagctggagcgcttcca

SEQ ID NO: 415238 - DNA, 25 bp, Mus musculus
cctgctgctgttgggccagctgcaa

SEQ ID NO: 415239 - DNA, 25 bp, Mus musculus
gaacctactgccagccgggccaggg

SEQ ID NO: 415240 - DNA, 25 bp, Mus musculus
tcgagtccaggaacctactgccagc

SEQ ID NO: 415241 - DNA, 25 bp, Mus musculus
aagtgaggcttcctcgagtccagga

SEQ ID NO: 415242 - DNA, 25 bp, Mus musculus
tccctggcaagtgaggcttcctcga

SEQ ID NO: 415243 - DNA, 25 bp, Mus musculus
aggccactgcagtagccacggctgt

SEQ ID NO: 415244 - DNA, 25 bp, Mus musculus
ggggatccgagtgcctaattgtcag

SEQ ID NO: 415245 - DNA, 25 bp, Mus musculus
agccacggctgtccctggcaagtga

SEQ ID NO: 415246 - DNA, 25 bp, Mus musculus
agtggcggctttccgcgtggcctct

SEQ ID NO: 415247 - DNA, 25 bp, Mus musculus
ctgcagaaggcccagtggcggcttt

SEQ ID NO: 415248 - DNA, 25 bp, Mus musculus
tgttgggccagctgcaacacctgca

SEQ ID NO: 415249 - DNA, 25 bp, Mus musculus
tgccctggagccacgtccgcgggaa

SEQ ID NO: 415250 - DNA, 25 bp, Mus musculus
tgtggctgacatgaagaactccgtg

SEQ ID NO: 415251 - DNA, 25 bp, Mus musculus
cgtgctcaccaacagcgccgagtgg

SEQ ID NO: 415252 - DNA, 25 bp, Mus musculus
gggacctggtccacccgctagtcta

SEQ ID NO: 415253 - DNA, 25 bp, Mus musculus
cgctagtctactgccctgagctgca

SEQ ID NO: 415254 - DNA, 25 bp, Mus musculus
gtctactgccctgagctgcacttca

SEQ ID NO: 415255 - DNA, 25 bp, Mus musculus
gccctgagctgcacttcagcgaatt

SEQ ID NO: 415256 - DNA, 25 bp, Mus musculus
tgcacttcagcgaattcacctcggc

SEQ ID NO: 415257 - DNA, 25 bp, Mus musculus
attcacctcggctgtggctgacatg

SEQ ID NO: 415258 - DNA, 25 bp, Mus musculus
tgacatgaagaactccgtggcggta

SEQ ID NO: 415259 - DNA, 25 bp, Mus musculus
tatgtgagcgagaagaccagtgttc

SEQ ID NO: 415260 - DNA, 25 bp, Mus musculus
aagaccagtgttcccaagctccaga

SEQ ID NO: 415261 - DNA, 25 bp, Mus musculus
gtgttcccaagctccagacgccgta

SEQ ID NO: 415262 - DNA, 25 bp, Mus musculus
tccagacgccgtacagagtccgacg

SEQ ID NO: 415263 - DNA, 25 bp, Mus musculus
gcgaattcacctcggctgtggctga

SEQ ID NO: 415264 - DNA, 25 bp, Mus musculus
cccgagtgcctagagtacgatcagg

SEQ ID NO: 415265 - DNA, 25 bp, Mus musculus
cgccgagctcgccataattacaacg

SEQ ID NO: 415266 - DNA, 25 bp, Mus musculus
cggtgagcacctaagagaatggatc

SEQ ID NO: 415267 - DNA, 25 bp, Mus musculus
agctgccgcacaggtactccctgag

SEQ ID NO: 415268 - DNA, 25 bp, Mus musculus
tctgatcacgagcacgaggaggttg

SEQ ID NO: 415269 - DNA, 25 bp, Mus musculus
agcgagggcccttagatcaggatcc

SEQ ID NO: 415270 - DNA, 25 bp, Mus musculus
tacgatcaggacgactacgagaccg

SEQ ID NO: 415271 - DNA, 25 bp, Mus musculus
agaccgattctgagaccgagcctga

SEQ ID NO: 415272 - DNA, 25 bp, Mus musculus
ccgagcctgagtccgatatcgaatc

SEQ ID NO: 415273 - DNA, 25 bp, Mus musculus
tccgagaccgaaatcgagaccgagc

SEQ ID NO: 415274 - DNA, 25 bp, Mus musculus
ggggtgccaccttcaaccagtcact

SEQ ID NO: 415275 - DNA, 25 bp, Mus musculus
agcgtctgcacgctctgaagttgca

SEQ ID NO: 415276 - DNA, 25 bp, Mus musculus
ccagaggagcgcaaggaggaaaaca

SEQ ID NO: 415277 - DNA, 25 bp, Mus musculus
tccctgagtcctctgaatctgagtc

SEQ ID NO: 415278 - DNA, 25 bp, Mus musculus
gccgtgcaagtagtcttggttaata

SEQ ID NO: 415279 - DNA, 25 bp, Mus musculus
ctcccgtgcgtcctaaagccaacct

SEQ ID NO: 415280 - DNA, 25 bp, Mus musculus
tcagccggcgcggagcctggaaatc

SEQ ID NO: 415281 - DNA, 25 bp, Mus musculus
cctggaaatcgggtaccggcatggc

SEQ ID NO: 415282 - DNA, 25 bp, Mus musculus
atcgggtaccggcatggccaatttg

SEQ ID NO: 415283 - DNA, 25 bp, Mus musculus
accggcatggccaatttggggccgc

SEQ ID NO: 415284 - DNA, 25 bp, Mus musculus
cgggaccctggagccagtgcctccc

SEQ ID NO: 415285 - DNA, 25 bp, Mus musculus
cccacgccgtgcaagtagtcttggt

SEQ ID NO: 415286 - DNA, 25 bp, Mus musculus
ggttaataccgctcacctctggagg

SEQ ID NO: 415287 - DNA, 25 bp, Mus musculus
ataccgctcacctctggaggttcga

SEQ ID NO: 415288 - DNA, 25 bp, Mus musculus
tcgaggaggcctgagatcgtgaaaa

SEQ ID NO: 415289 - DNA, 25 bp, Mus musculus
cctgagatcgtgaaaaggggcgcgc

SEQ ID NO: 415290 - DNA, 25 bp, Mus musculus
gcgcgcacctctcccgtgcgtccta

SEQ ID NO: 415291 - DNA, 25 bp, Mus musculus
caagtagtcttggttaataccgctc

SEQ ID NO: 415292 - DNA, 25 bp, Mus musculus
cttacccaaagtcgggagcagccgg

SEQ ID NO: 415293 - DNA, 25 bp, Mus musculus
cgtcttgcgtcacgtgtcccagcaa

SEQ ID NO: 415294 - DNA, 25 bp, Mus musculus
cggcagagaaagagttctatttacg

SEQ ID NO: 415295 - DNA, 25 bp, Mus musculus
ctctggcggcagagaaagagttcta

SEQ ID NO: 415296 - DNA, 25 bp, Mus musculus
cggagccggctcagcactgagacct

SEQ ID NO: 415297 - DNA, 25 bp, Mus musculus
gaggacggagccgaacgtccctaca

SEQ ID NO: 415298 - DNA, 25 bp, Mus musculus
agagactcggaatcagtccgggaga

SEQ ID NO: 415299 - DNA, 25 bp, Mus musculus
aagcgagctagagagactcggaatc

SEQ ID NO: 415300 - DNA, 25 bp, Mus musculus
ctctggccagggaaaaagcgagcta

SEQ ID NO: 415301 - DNA, 25 bp, Mus musculus
gcaacgcaagagagctcgctcgctc

SEQ ID NO: 415302 - DNA, 25 bp, Mus musculus
cgtgtcccagcaacgcaagagagct

SEQ ID NO: 415303 - DNA, 25 bp, Mus musculus
acgattttcgagacgaatcggcacg

SEQ ID NO: 415304 - DNA, 25 bp, Mus musculus
ctatttacgattttcgagacgaatc

SEQ ID NO: 415305 - DNA, 25 bp, Mus musculus
agcactgagacctgcgtcctctggc

SEQ ID NO: 415306 - DNA, 25 bp, Mus musculus
ggcagcctatgcaggtccactggtc

SEQ ID NO: 415307 - DNA, 25 bp, Mus musculus
cggtctatccgagtgtacccgatca

SEQ ID NO: 415308 - DNA, 25 bp, Mus musculus
accggatctgatgctggagctccta

SEQ ID NO: 415309 - DNA, 25 bp, Mus musculus
tcgggagcaacccagtccgcaactt

SEQ ID NO: 415310 - DNA, 25 bp, Mus musculus
cttccagtggcttctgcggcgaaac

SEQ ID NO: 415311 - DNA, 25 bp, Mus musculus
tgcgagatcgagtcctccagtgatg

SEQ ID NO: 415312 - DNA, 25 bp, Mus musculus
acgaggcatcgtctggcatctgcga

SEQ ID NO: 415313 - DNA, 25 bp, Mus musculus
ggccgactgcctggcctgacaagta

SEQ ID NO: 415314 - DNA, 25 bp, Mus musculus
agcaatgtcagcctctgctagggca

SEQ ID NO: 415315 - DNA, 25 bp, Mus musculus
gccgagtccgagtctgaaggcagca

SEQ ID NO: 415316 - DNA, 25 bp, Mus musculus
gaacgccttcagatctccagtcgga

SEQ ID NO: 415317 - DNA, 25 bp, Mus musculus
acggattccgcgatgctcacagata

SEQ ID NO: 415318 - DNA, 25 bp, Mus musculus
gggagccaggtcactctcagctact

SEQ ID NO: 415319 - DNA, 25 bp, Mus musculus
gagatccaggttgctgacccgccta

SEQ ID NO: 415320 - DNA, 25 bp, Mus musculus
ataggctctaactcttccggcctca

SEQ ID NO: 415321 - DNA, 25 bp, Mus musculus
aggagatggtcctggcccgcacgct

SEQ ID NO: 415322 - DNA, 25 bp, Mus musculus
cgcctcagcctgtactcgtgacttt

SEQ ID NO: 415323 - DNA, 25 bp, Mus musculus
tccgagtccatactgcaactgcagc

SEQ ID NO: 415324 - DNA, 25 bp, Mus musculus
tgtgcgcgtacatccctctccgagt

SEQ ID NO: 415325 - DNA, 25 bp, Mus musculus
cacgctgcagctgtgcgcgtacatc

SEQ ID NO: 415326 - DNA, 25 bp, Mus musculus
tgtactcgtgactttctgaccaatg

SEQ ID NO: 415327 - DNA, 25 bp, Mus musculus
gcatagaagcgcaggagatggtcct

SEQ ID NO: 415328 - DNA, 25 bp, Mus musculus
gcgagctccgctagcagtgcggctc

SEQ ID NO: 415329 - DNA, 25 bp, Mus musculus
tccaatgaggcgagctccgctagca

SEQ ID NO: 415330 - DNA, 25 bp, Mus musculus
agcgcgtcggcctccaatgaggcga

SEQ ID NO: 415331 - DNA, 25 bp, Mus musculus
atcgcgctgcccacgcgttctgggg

SEQ ID NO: 415332 - DNA, 25 bp, Mus musculus
tctcttggtcacagcggatcgcgct

SEQ ID NO: 415333 - DNA, 25 bp, Mus musculus
tgaccaatgtcacgagaccaggccg

SEQ ID NO: 415334 - DNA, 25 bp, Mus musculus
cccgaactgggttacataagacgtg

SEQ ID NO: 415335 - DNA, 25 bp, Mus musculus
tagggcactcgctggtccaagtatc

SEQ ID NO: 415336 - DNA, 25 bp, Mus musculus
ctggtccaagtatccgcctttcatc

SEQ ID NO: 415337 - DNA, 25 bp, Mus musculus
aggcagttcgcacacggtcccggga

SEQ ID NO: 415338 - DNA, 25 bp, Mus musculus
cgatcgcgaggctttggatcggaca

SEQ ID NO: 415339 - DNA, 25 bp, Mus musculus
ttggatcggacagcgaaacttctcc

SEQ ID NO: 415340 - DNA, 25 bp, Mus musculus
aacttctccgactcgctgggacctg

SEQ ID NO: 415341 - DNA, 25 bp, Mus musculus
aaaggaggtcccacctgctcccttg

SEQ ID NO: 415342 - DNA, 25 bp, Mus musculus
acctgctcccttgagctggggttgg

SEQ ID NO: 415343 - DNA, 25 bp, Mus musculus
tgacacaactaaggtggcggggcta

SEQ ID NO: 415344 - DNA, 25 bp, Mus musculus
cctgctcagcccgaactgggttaca

SEQ ID NO: 415345 - DNA, 25 bp, Mus musculus
ttacataagacgtgtgtgtgcgtgt

SEQ ID NO: 415346 - DNA, 25 bp, Mus musculus
aagcggggaaatcacagacactctc

SEQ ID NO: 415347 - DNA, 25 bp, Mus musculus
tgtctgctttctgcagccctgctca

SEQ ID NO: 415348 - DNA, 25 bp, Mus musculus
aataggttaccttgtgatttgcgcc

SEQ ID NO: 415349 - DNA, 25 bp, Mus musculus
tgggtaatctgctgggccgatgact

SEQ ID NO: 415350 - DNA, 25 bp, Mus musculus
ccatggcgcggccaaaactttccgt

SEQ ID NO: 415351 - DNA, 25 bp, Mus musculus
gcggccaaaactttccgtgctggta

SEQ ID NO: 415352 - DNA, 25 bp, Mus musculus
ttccgtgctggtacactctgtaata

SEQ ID NO: 415353 - DNA, 25 bp, Mus musculus
ctggtacactctgtaataacctgtg

SEQ ID NO: 415354 - DNA, 25 bp, Mus musculus
ccgccgattttatatttgtactcta

SEQ ID NO: 415355 - DNA, 25 bp, Mus musculus
aataacctgtgtgcagactctctgc

SEQ ID NO: 415356 - DNA, 25 bp, Mus musculus
gtgcagactctctgcagcgagcaga

SEQ ID NO: 415357 - DNA, 25 bp, Mus musculus
tctgcagcgagcagagggaaaacgc

SEQ ID NO: 415358 - DNA, 25 bp, Mus musculus
agcagagggaaaacgcgcaggcaac

SEQ ID NO: 415359 - DNA, 25 bp, Mus musculus
gcgtggcatcctgggtaatctgctg

SEQ ID NO: 415360 - DNA, 25 bp, Mus musculus
taccttgtgatttgcgccatggcgc

SEQ ID NO: 415361 - DNA, 25 bp, Mus musculus
atcctgggtaatctgctgggccgat

SEQ ID NO: 415362 - DNA, 25 bp, Mus musculus
ccgcaaagttgctgaccgacaaaga

SEQ ID NO: 415363 - DNA, 25 bp, Mus musculus
catgggtgcttaacttcctgctaca

SEQ ID NO: 415364 - DNA, 25 bp, Mus musculus
agaatgtgccagaagctccgccaga

SEQ ID NO: 415365 - DNA, 25 bp, Mus musculus
ttcctgctacagaggcgcacagagc

SEQ ID NO: 415366 - DNA, 25 bp, Mus musculus
ggcgacctgctgcttcagagtgttc

SEQ ID NO: 415367 - DNA, 25 bp, Mus musculus
tctccttcctgagtggtcgcgccaa

SEQ ID NO: 415368 - DNA, 25 bp, Mus musculus
acgagcggctcatctagtcagcctc

SEQ ID NO: 415369 - DNA, 25 bp, Mus musculus
cattgctgtgtagtgtggatcttta

SEQ ID NO: 415370 - DNA, 25 bp, Mus musculus
agtgcttgtgtgtggacacattttc

SEQ ID NO: 415371 - DNA, 25 bp, Mus musculus
tggttgctctgtcctatgcttagtg

SEQ ID NO: 415372 - DNA, 25 bp, Mus musculus
agtgctctcctagcttttctccaag

SEQ ID NO: 415373 - DNA, 25 bp, Mus musculus
tccctgctttctggctctctcagtg

SEQ ID NO: 415374 - DNA, 25 bp, Mus musculus
ggccgaatgggacagtgacactgat

SEQ ID NO: 415375 - DNA, 25 bp, Mus musculus
agaagatgatgcctactacgcgcct

SEQ ID NO: 415376 - DNA, 25 bp, Mus musculus
gcacgcgctcttccatttgttgtgt

SEQ ID NO: 415377 - DNA, 25 bp, Mus musculus
tccggcgccgggtacaattatggga

SEQ ID NO: 415378 - DNA, 25 bp, Mus musculus
cgggtacaattatgggagaagacta

SEQ ID NO: 415379 - DNA, 25 bp, Mus musculus
agaagactacttcgggaatgcctca

SEQ ID NO: 415380 - DNA, 25 bp, Mus musculus
tacttcgggaatgcctcagagtggg

SEQ ID NO: 415381 - DNA, 25 bp, Mus musculus
gccgtaggcgttccgccaggaagcc

SEQ ID NO: 415382 - DNA, 25 bp, Mus musculus
caggaagccgggtttgtgtcctgtc

SEQ ID NO: 415383 - DNA, 25 bp, Mus musculus
tttgtgtcctgtcctcgcggctcct

SEQ ID NO: 415384 - DNA, 25 bp, Mus musculus
ggacccgtgacccttgactccctga

SEQ ID NO: 415385 - DNA, 25 bp, Mus musculus
ctagcaaagcgggtccaggaactgc

SEQ ID NO: 415386 - DNA, 25 bp, Mus musculus
gtccaggaactgcactcagggcttc

SEQ ID NO: 415387 - DNA, 25 bp, Mus musculus
aggaactgcactcagggcttcgggc

SEQ ID NO: 415388 - DNA, 25 bp, Mus musculus
tccatttgttgtgtccggcgcacgc

SEQ ID NO: 415389 - DNA, 25 bp, Mus musculus
cactcagggcttcgggccggtcctg

SEQ ID NO: 415390 - DNA, 25 bp, Mus musculus
cgggccaattcggatcctggatcac

SEQ ID NO: 415391 - DNA, 25 bp, Mus musculus
gatcctggatcacgcgcagcacctt

SEQ ID NO: 415392 - DNA, 25 bp, Mus musculus
ctgctccgggccaattcggatcctg

SEQ ID NO: 415393 - DNA, 25 bp, Mus musculus
ccgcgaatgggatggtagcaagtct

SEQ ID NO: 415394 - DNA, 25 bp, Mus musculus
gcagcaccttcgacctcttgacccg

SEQ ID NO: 415395 - DNA, 25 bp, Mus musculus
tcctttaggaggcgcccaagttgga

SEQ ID NO: 415396 - DNA, 25 bp, Mus musculus
acatcagcagcaccaggggcagctg

SEQ ID NO: 415397 - DNA, 25 bp, Mus musculus
agcaacatcagcagcaccaggggca

SEQ ID NO: 415398 - DNA, 25 bp, Mus musculus
gccgcactcgccaacagcaacatca

SEQ ID NO: 415399 - DNA, 25 bp, Mus musculus
gaagtagagtctggcccgtgccgca

SEQ ID NO: 415400 - DNA, 25 bp, Mus musculus
cccgagcggaagtagagtctggccc

SEQ ID NO: 415401 - DNA, 25 bp, Mus musculus
caagtctggcccgagcggaagtaga

SEQ ID NO: 415402 - DNA, 25 bp, Mus musculus
cgacgacgccatgctcctgctccgg

SEQ ID NO: 415403 - DNA, 25 bp, Mus musculus
aatgggatggtagcaagtctggccc

SEQ ID NO: 415404 - DNA, 25 bp, Mus musculus
cccgcaacatcatggctgcctgtga

SEQ ID NO: 415405 - DNA, 25 bp, Mus musculus
gacttcactgcgctttcccggtcag

SEQ ID NO: 415406 - DNA, 25 bp, Mus musculus
atttgtttccgcaccctgaggctga

SEQ ID NO: 415407 - DNA, 25 bp, Mus musculus
tgaggctgacgacacccacctacgg

SEQ ID NO: 415408 - DNA, 25 bp, Mus musculus
acggggatctcaaccacctggtgtc

SEQ ID NO: 415409 - DNA, 25 bp, Mus musculus
cctggtgtccttgaccatgagcgga

SEQ ID NO: 415410 - DNA, 25 bp, Mus musculus
ctggccgtgaatatggtgccctttc

SEQ ID NO: 415411 - DNA, 25 bp, Mus musculus
tgagcggaatcacgacttcactgcg

SEQ ID NO: 415412 - DNA, 25 bp, Mus musculus
caacagatgttcgatgcccgcaaca

SEQ ID NO: 415413 - DNA, 25 bp, Mus musculus
gtagcggagctcacccaacagatgt

SEQ ID NO: 415414 - DNA, 25 bp, Mus musculus
taccgagccctctcagtagcggagc

SEQ ID NO: 415415 - DNA, 25 bp, Mus musculus
tcacagcccagggtagccagcagta

SEQ ID NO: 415416 - DNA, 25 bp, Mus musculus
tggtgccctttcctcgtcttcactt

SEQ ID NO: 415417 - DNA, 25 bp, Mus musculus
gacaacgaagcgctctatgacattt

SEQ ID NO: 415418 - DNA, 25 bp, Mus musculus
accggaagctgtggccgtagagaca

SEQ ID NO: 415419 - DNA, 25 bp, Mus musculus
gcccttgccaaccaggagccaatag

SEQ ID NO: 415420 - DNA, 25 bp, Mus musculus
aagagccttgtccacggcgacgcca

SEQ ID NO: 415421 - DNA, 25 bp, Mus musculus
ttggccgtctcgtacggcctggtga

SEQ ID NO: 415422 - DNA, 25 bp, Mus musculus
aggccttcccaacgctttctgggcg

SEQ ID NO: 415423 - DNA, 25 bp, Mus musculus
cccattggccgagcggctaccggaa

SEQ ID NO: 415424 - DNA, 25 bp, Mus musculus
gaggccgctgcatgccggtcacctt

SEQ ID NO: 415425 - DNA, 25 bp, Mus musculus
gccgtagagacacctgggaaagcga

SEQ ID NO: 415426 - DNA, 25 bp, Mus musculus
ggtcaccttccaggtgctgcgggca

SEQ ID NO: 415427 - DNA, 25 bp, Mus musculus
tcgccagtacgccaccatggtgtct

SEQ ID NO: 415428 - DNA, 25 bp, Mus musculus
ctgagtccagcctgtcgccagtacg

SEQ ID NO: 415429 - DNA, 25 bp, Mus musculus
cgctttctgggcgtacctgagtcca

SEQ ID NO: 415430 - DNA, 25 bp, Mus musculus
ctgggtcgcttcagagtagcctcaa

SEQ ID NO: 415431 - DNA, 25 bp, Mus musculus
agagtagcctcaaaccggcccggca

SEQ ID NO: 415432 - DNA, 25 bp, Mus musculus
tcgctacacccgacgccaggaagtt

SEQ ID NO: 415433 - DNA, 25 bp, Mus musculus
ggcgcaatcaagtccctccttcgtg

SEQ ID NO: 415434 - DNA, 25 bp, Mus musculus
cgcactacgcatgcgcgggccttgg

SEQ ID NO: 415435 - DNA, 25 bp, Mus musculus
ctccttcgtgaaggctcagtgcgcc

SEQ ID NO: 415436 - DNA, 25 bp, Mus musculus
gcccagtcttcttggctcagagcaa

SEQ ID NO: 415437 - DNA, 25 bp, Mus musculus
tagccaagccgggtttggctccgcc

SEQ ID NO: 415438 - DNA, 25 bp, Mus musculus
taggacgcccggaagtgccatcccg

SEQ ID NO: 415439 - DNA, 25 bp, Mus musculus
acagtgaggcacagaagttcgccgg

SEQ ID NO: 415440 - DNA, 25 bp, Mus musculus
tccagatcttcatggtgccagctgc

SEQ ID NO: 415441 - DNA, 25 bp, Mus musculus
acactcactcaaagacgtgctccga

SEQ ID NO: 415442 - DNA, 25 bp, Mus musculus
cgctcttgtcttccgtcagtggcga

SEQ ID NO: 415443 - DNA, 25 bp, Mus musculus
tcacttccggatcaggctcgacggc

SEQ ID NO: 415444 - DNA, 25 bp, Mus musculus
ctgtgaagccctcgggcctcgtgct

SEQ ID NO: 415445 - DNA, 25 bp, Mus musculus
gacgtgctccgaagtccagatcttc

SEQ ID NO: 415446 - DNA, 25 bp, Mus musculus
acccttttgcggtcacaagcggcca

SEQ ID NO: 415447 - DNA, 25 bp, Mus musculus
agccagtctcactacccttttgcgg

SEQ ID NO: 415448 - DNA, 25 bp, Mus musculus
actcgaaagctgtagccagtctcac

SEQ ID NO: 415449 - DNA, 25 bp, Mus musculus
acaaaaggaagccaggcgcgggtct

SEQ ID NO: 415450 - DNA, 25 bp, Mus musculus
taagcctggggcgaatgcgcctctg

SEQ ID NO: 415451 - DNA, 25 bp, Mus musculus
gctcccgcgcctgatcggggttcat

SEQ ID NO: 415452 - DNA, 25 bp, Mus musculus
tcaggcagcgacaggactcgaaagc

SEQ ID NO: 415453 - DNA, 25 bp, Mus musculus
agccaagtaactctgagccgggacg

SEQ ID NO: 415454 - DNA, 25 bp, Mus musculus
gttcgtgaccgcctcagccaagtaa

SEQ ID NO: 415455 - DNA, 25 bp, Mus musculus
cagcgcgctctgaaagttcgtgacc

SEQ ID NO: 415456 - DNA, 25 bp, Mus musculus
aaaagcctgagccacagccggccag

SEQ ID NO: 415457 - DNA, 25 bp, Mus musculus
gcgggagccagaaaagcctgagcca

SEQ ID NO: 415458 - DNA, 25 bp, Mus musculus
ggcgaatgcgcctctggtcagctcc

SEQ ID NO: 415459 - DNA, 25 bp, Mus musculus
tccacgcgggagtgcacacaaaagg

SEQ ID NO: 415460 - DNA, 25 bp, Mus musculus
gacgcagcccggagtctcacgggtc

SEQ ID NO: 415461 - DNA, 25 bp, Mus musculus
gtactgcccttgactgccgtgcaca

SEQ ID NO: 415462 - DNA, 25 bp, Mus musculus
accttactggtactgcccttgactg

SEQ ID NO: 415463 - DNA, 25 bp, Mus musculus
ggcgacctgtccagaaccttactgg

SEQ ID NO: 415464 - DNA, 25 bp, Mus musculus
gctgggcgacctgtccagaacctta

SEQ ID NO: 415465 - DNA, 25 bp, Mus musculus
caaggtaagtgcgaaggggatctaa

SEQ ID NO: 415466 - DNA, 25 bp, Mus musculus
ccaccggaggcttggagcaaggtaa

SEQ ID NO: 415467 - DNA, 25 bp, Mus musculus
aagacaccaccaccggaggcttgga

SEQ ID NO: 415468 - DNA, 25 bp, Mus musculus
gctcactgctgcgtgcctttgggcc

SEQ ID NO: 415469 - DNA, 25 bp, Mus musculus
tctgcgctcactgctgcgtgccttt

SEQ ID NO: 415470 - DNA, 25 bp, Mus musculus
cttgactgccgtgcacagctcggat

SEQ ID NO: 415471 - DNA, 25 bp, Mus musculus
cccggagtctcacgggtctggcctt

SEQ ID NO: 415472 - DNA, 25 bp, Mus musculus
agaaggggccgagcctttcaaggcg

SEQ ID NO: 415473 - DNA, 25 bp, Mus musculus
ggccttcagggagatgcgtggccaa

SEQ ID NO: 415474 - DNA, 25 bp, Mus musculus
cagcagctgccttgtgtcgcggggc

SEQ ID NO: 415475 - DNA, 25 bp, Mus musculus
cggtgaccttggccgcctaggatgc

SEQ ID NO: 415476 - DNA, 25 bp, Mus musculus
ccgcctaggatgctctgattccgca

SEQ ID NO: 415477 - DNA, 25 bp, Mus musculus
gcctaggatgctctgattccgcatc

SEQ ID NO: 415478 - DNA, 25 bp, Mus musculus
aggatgctctgattccgcatctccc

SEQ ID NO: 415479 - DNA, 25 bp, Mus musculus
tgattccgcatctccctccaacttg

SEQ ID NO: 415480 - DNA, 25 bp, Mus musculus
ccctgcgtcgcctttcccatggccg

SEQ ID NO: 415481 - DNA, 25 bp, Mus musculus
gccgcatccgaggacggcagcagct

SEQ ID NO: 415482 - DNA, 25 bp, Mus musculus
aggcaggtggcatggggaccatgtc

SEQ ID NO: 415483 - DNA, 25 bp, Mus musculus
ggacagcgatccgattcaggtgcca

SEQ ID NO: 415484 - DNA, 25 bp, Mus musculus
gcgatccgattcaggtgccacgagg

SEQ ID NO: 415485 - DNA, 25 bp, Mus musculus
atccgattcaggtgccacgagggcc

SEQ ID NO: 415486 - DNA, 25 bp, Mus musculus
cagcgatccgattcaggtgccacga

SEQ ID NO: 415487 - DNA, 25 bp, Mus musculus
ttcccatggccgcatccgaggacgg

SEQ ID NO: 415488 - DNA, 25 bp, Mus musculus
ctggatgccactcgaggtggaaatg

SEQ ID NO: 415489 - DNA, 25 bp, Mus musculus
ctgtgcaaacgcgacaattgactgc

SEQ ID NO: 415490 - DNA, 25 bp, Mus musculus
ggagcccacacaaatagccgccggg

SEQ ID NO: 415491 - DNA, 25 bp, Mus musculus
cgcgcgccgggctatttcagcctgg

SEQ ID NO: 415492 - DNA, 25 bp, Mus musculus
cgggctatttcagcctggcgctgtg

SEQ ID NO: 415493 - DNA, 25 bp, Mus musculus
tcagcctggcgctgtgcaaacgcga

SEQ ID NO: 415494 - DNA, 25 bp, Mus musculus
acgcgacaattgactgcggcccaca

SEQ ID NO: 415495 - DNA, 25 bp, Mus musculus
ctgcggcccacaggggcccaaatta

SEQ ID NO: 415496 - DNA, 25 bp, Mus musculus
ccacaggggcccaaattacaatcgg

SEQ ID NO: 415497 - DNA, 25 bp, Mus musculus
caggggcccaaattacaatcggagc

SEQ ID NO: 415498 - DNA, 25 bp, Mus musculus
cgacaattgactgcggcccacaggg

SEQ ID NO: 415499 - DNA, 25 bp, Mus musculus
aatcggagcccacacaaatagccgc

SEQ ID NO: 415500 - DNA, 25 bp, Mus musculus
aaatagccgccgggcttggcctgcc

SEQ ID NO: 415501 - DNA, 25 bp, Mus musculus
gcccaaattacaatcggagcccaca

SEQ ID NO: 415502 - DNA, 25 bp, Mus musculus
atcccggaacagatgggccagtttc

SEQ ID NO: 415503 - DNA, 25 bp, Mus musculus
tcgacatcctggacgaccggcaacg

SEQ ID NO: 415504 - DNA, 25 bp, Mus musculus
gggctaccgcgagcctttctccaga

SEQ ID NO: 415505 - DNA, 25 bp, Mus musculus
ccgctcctagtacagaggggctacc

SEQ ID NO: 415506 - DNA, 25 bp, Mus musculus
tgcaggttctgccatctggtcttgc

SEQ ID NO: 415507 - DNA, 25 bp, Mus musculus
ggcggcgaccagctcttcattcaaa

SEQ ID NO: 415508 - DNA, 25 bp, Mus musculus
ctgagcaaggcgctggagcaaatcc

SEQ ID NO: 415509 - DNA, 25 bp, Mus musculus
aatcaaactgggactggtggctgcg

SEQ ID NO: 415510 - DNA, 25 bp, Mus musculus
ggccagtttcgaccaatagccgctg

SEQ ID NO: 415511 - DNA, 25 bp, Mus musculus
tattaatgaaagctgacgcggcggc

SEQ ID NO: 415512 - DNA, 25 bp, Mus musculus
tggctacctgaccttcgagcgtttc

SEQ ID NO: 415513 - DNA, 25 bp, Mus musculus
tcccggaaccctgagctgttatgtg

SEQ ID NO: 415514 - DNA, 25 bp, Mus musculus
cgttaagtctcccaagggccggatg

SEQ ID NO: 415515 - DNA, 25 bp, Mus musculus
tgcgcacctcgctgctgaaagccga

SEQ ID NO: 415516 - DNA, 25 bp, Mus musculus
cacacgcagcgcttctgggaagggt

SEQ ID NO: 415517 - DNA, 25 bp, Mus musculus
gccgtcgagtaatggcgcctcctcg

SEQ ID NO: 415518 - DNA, 25 bp, Mus musculus
gactccaggcgcagccacgtggtca

SEQ ID NO: 415519 - DNA, 25 bp, Mus musculus
tgccctgtccacgatgggtcagccg

SEQ ID NO: 415520 - DNA, 25 bp, Mus musculus
acactttaggctgtgggcgcacacg

SEQ ID NO: 415521 - DNA, 25 bp, Mus musculus
ccttacccgcagacactttaggctg

SEQ ID NO: 415522 - DNA, 25 bp, Mus musculus
cgccaacggaaagtgggaagcgctc

SEQ ID NO: 415523 - DNA, 25 bp, Mus musculus
cccgcaagggccgtcgagtaatggc

SEQ ID NO: 415524 - DNA, 25 bp, Mus musculus
attggcgtgaccagtgccgcccaca

SEQ ID NO: 415525 - DNA, 25 bp, Mus musculus
ttgccctggattggcgtgaccagtg

SEQ ID NO: 415526 - DNA, 25 bp, Mus musculus
tcacaaactcctccctgtatggttg

SEQ ID NO: 415527 - DNA, 25 bp, Mus musculus
agccacgtggtcacgctctttacca

SEQ ID NO: 415528 - DNA, 25 bp, Mus musculus
cctccctgtatggttgccctggatt

SEQ ID NO: 415529 - DNA, 25 bp, Mus musculus
gaagcgctcgcccaatcagagccag

SEQ ID NO: 415530 - DNA, 25 bp, Mus musculus
cgatccatgtccgagaggcagctga

SEQ ID NO: 415531 - DNA, 25 bp, Mus musculus
cgaaggcgaagatgtcctcggtacc

SEQ ID NO: 415532 - DNA, 25 bp, Mus musculus
tcggtaccttcagcacctgcaggtc

SEQ ID NO: 415533 - DNA, 25 bp, Mus musculus
gtgtagcgcaccgtcacctgcttct

SEQ ID NO: 415534 - DNA, 25 bp, Mus musculus
acctgcttctcgaaggccacgttgc

SEQ ID NO: 415535 - DNA, 25 bp, Mus musculus
ggtgacacgttccaggcacacaagc

SEQ ID NO: 415536 - DNA, 25 bp, Mus musculus
actgcagcgtgaactccagatcctg

SEQ ID NO: 415537 - DNA, 25 bp, Mus musculus
ctgctgcagcacaggtctgagttga

SEQ ID NO: 415538 - DNA, 25 bp, Mus musculus
gttaaacaccttgacctgcgccagc

SEQ ID NO: 415539 - DNA, 25 bp, Mus musculus
gagccttttgacatggcccagctgg

SEQ ID NO: 415540 - DNA, 25 bp, Mus musculus
caccgccgagccactaggctttagg

SEQ ID NO: 415541 - DNA, 25 bp, Mus musculus
ccgcacccaacacggagactgtgtt

SEQ ID NO: 415542 - DNA, 25 bp, Mus musculus
acggatcgtcgcctgcgttaaacac

SEQ ID NO: 415543 - DNA, 25 bp, Mus musculus
tcctctgagctcttacgggaaggcc

SEQ ID NO: 415544 - DNA, 25 bp, Mus musculus
tatcgggaatacgtcagggccgtcc

SEQ ID NO: 415545 - DNA, 25 bp, Mus musculus
acccgccatggtgtgattgatcgct

SEQ ID NO: 415546 - DNA, 25 bp, Mus musculus
cgctgcgtattaaccgaggttatta

SEQ ID NO: 415547 - DNA, 25 bp, Mus musculus
tggtgtgattgatcgctgcgtatta

SEQ ID NO: 415548 - DNA, 25 bp, Mus musculus
ggggtgttccgacgagtattgatct

SEQ ID NO: 415549 - DNA, 25 bp, Mus musculus
ttccgacgagtattgatctgccatc

SEQ ID NO: 415550 - DNA, 25 bp, Mus musculus
attgatctgccatcgcagtcccagg

SEQ ID NO: 415551 - DNA, 25 bp, Mus musculus
catcgcagtcccaggcgttcaggga

SEQ ID NO: 415552 - DNA, 25 bp, Mus musculus
ggcaagctaaaaaacacccgccatg

SEQ ID NO: 415553 - DNA, 25 bp, Mus musculus
gcccttctgctttgtatcgggaata

SEQ ID NO: 415554 - DNA, 25 bp, Mus musculus
cgtcagggccgtccacattaaacca

SEQ ID NO: 415555 - DNA, 25 bp, Mus musculus
gtccacattaaaccacctcatatcg

SEQ ID NO: 415556 - DNA, 25 bp, Mus musculus
cctcatatcgataagccggcaagct

SEQ ID NO: 415557 - DNA, 25 bp, Mus musculus
gggaccggccatagcccttctgctt

SEQ ID NO: 415558 - DNA, 25 bp, Mus musculus
ctagcaggtcctcccgacttagaga

SEQ ID NO: 415559 - DNA, 25 bp, Mus musculus
tggtgtctcccggtcttctcaaacc

SEQ ID NO: 415560 - DNA, 25 bp, Mus musculus
ctcggttaactccagctcgctgcgg

SEQ ID NO: 415561 - DNA, 25 bp, Mus musculus
caagagcatttcagagctgcgatcc

SEQ ID NO: 415562 - DNA, 25 bp, Mus musculus
cgacttttgtctcccgcgggctgca

SEQ ID NO: 415563 - DNA, 25 bp, Mus musculus
ttctctgcgatgaaccagggttggc

SEQ ID NO: 415564 - DNA, 25 bp, Mus musculus
gctgccacgccgaggtattctctgc

SEQ ID NO: 415565 - DNA, 25 bp, Mus musculus
gtttccgcacagtctctgcgcggtc

SEQ ID NO: 415566 - DNA, 25 bp, Mus musculus
ggcagtcgcgcatcccgagttccag

SEQ ID NO: 415567 - DNA, 25 bp, Mus musculus
gccgccctccgtagtgtagtactcg

SEQ ID NO: 415568 - DNA, 25 bp, Mus musculus
aggtgccatctcgttgcccgatctg

SEQ ID NO: 415569 - DNA, 25 bp, Mus musculus
gatcgcaggcgatctgggaacccgt

SEQ ID NO: 415570 - DNA, 25 bp, Mus musculus
taagttgccgcctctccgatcgcag

SEQ ID NO: 415571 - DNA, 25 bp, Mus musculus
gaccacaggctctgtgctgccgctg

SEQ ID NO: 415572 - DNA, 25 bp, Mus musculus
cgaggcagctgtcttcccagctgta

SEQ ID NO: 415573 - DNA, 25 bp, Mus musculus
acagccgtcagtgcagtcgtggcct

SEQ ID NO: 415574 - DNA, 25 bp, Mus musculus
cgcgccttcataccagtggtgtggg

SEQ ID NO: 415575 - DNA, 25 bp, Mus musculus
cagtgcagtcgtggcctgcgaagca

SEQ ID NO: 415576 - DNA, 25 bp, Mus musculus
agcaccacagccgtcagtgcagtcg

SEQ ID NO: 415577 - DNA, 25 bp, Mus musculus
gtacgctgcactgagctgctcagca

SEQ ID NO: 415578 - DNA, 25 bp, Mus musculus
gctgtacgctgcactgagctgctca

SEQ ID NO: 415579 - DNA, 25 bp, Mus musculus
ccttcataccagtggtgtgggcggc

SEQ ID NO: 415580 - DNA, 25 bp, Mus musculus
gctgtcttcccagctgtacgctgca

SEQ ID NO: 415581 - DNA, 25 bp, Mus musculus
cgctggtcaccgaggcagctgtctt

SEQ ID NO: 415582 - DNA, 25 bp, Mus musculus
ctggctctgctggataaaggccgcg

SEQ ID NO: 415583 - DNA, 25 bp, Mus musculus
gcttgccaacgccaacctgtgtggg

SEQ ID NO: 415584 - DNA, 25 bp, Mus musculus
ttcccagctgtacgctgcactgagc

SEQ ID NO: 415585 - DNA, 25 bp, Mus musculus
acgccaacctgtgtgggctgcgtga

SEQ ID NO: 415586 - DNA, 25 bp, Mus musculus
cagggcagcctggtgcacccgccct

SEQ ID NO: 415587 - DNA, 25 bp, Mus musculus
agcacggtgggcgtcagcgtggccc

SEQ ID NO: 415588 - DNA, 25 bp, Mus musculus
cagctggaagttctggatgttggtc

SEQ ID NO: 415589 - DNA, 25 bp, Mus musculus
cagcgtggcccggatagcgccggtg

SEQ ID NO: 415590 - DNA, 25 bp, Mus musculus
aacttcctggaacgccagggcagcc

SEQ ID NO: 415591 - DNA, 25 bp, Mus musculus
gcccagaacttcctggaacgccagg

SEQ ID NO: 415592 - DNA, 25 bp, Mus musculus
atgcagcccagaacttcctggaacg

SEQ ID NO: 415593 - DNA, 25 bp, Mus musculus
agaatgcagcccagaacttcctgga

SEQ ID NO: 415594 - DNA, 25 bp, Mus musculus
gtcccagaatgcagcccagaacttc

SEQ ID NO: 415595 - DNA, 25 bp, Mus musculus
cggtcccagaatgcagcccagaact

SEQ ID NO: 415596 - DNA, 25 bp, Mus musculus
gcacggtcccagaatgcagcccaga

SEQ ID NO: 415597 - DNA, 25 bp, Mus musculus
gccacccgactagggcacggtccca

SEQ ID NO: 415598 - DNA, 25 bp, Mus musculus
cctctcgggccacccgactagggca

SEQ ID NO: 415599 - DNA, 25 bp, Mus musculus
aagttctggatgttggtcgggttct

SEQ ID NO: 415600 - DNA, 25 bp, Mus musculus
gctgcggcgggctcttaaaagacgc

SEQ ID NO: 415601 - DNA, 25 bp, Mus musculus
cctgtggcctccgattggctgcggc

SEQ ID NO: 415602 - DNA, 25 bp, Mus musculus
tgcgactcgagcgagcccaccagat

SEQ ID NO: 415603 - DNA, 25 bp, Mus musculus
tggccgccagctgcgactcgagcga

SEQ ID NO: 415604 - DNA, 25 bp, Mus musculus
actttctcgtccacctcgctgttga

SEQ ID NO: 415605 - DNA, 25 bp, Mus musculus
cggttagtacgagggccgtgcacac

SEQ ID NO: 415606 - DNA, 25 bp, Mus musculus
ccctgacttacagcggttagtacga

SEQ ID NO: 415607 - DNA, 25 bp, Mus musculus
acgccgcggacacgacgggtcagct

SEQ ID NO: 415608 - DNA, 25 bp, Mus musculus
tgtctgcacccttccaaaatggctg

SEQ ID NO: 415609 - DNA, 25 bp, Mus musculus
gcggggttcgccctttgtctgcacc

SEQ ID NO: 415610 - DNA, 25 bp, Mus musculus
cctcgctgttgaagaagacctcgtc

SEQ ID NO: 415611 - DNA, 25 bp, Mus musculus
aaagacgcggccaatggctgcgagc

SEQ ID NO: 415612 - DNA, 25 bp, Mus musculus
ggctcttaaaagacgcggccaatgg

SEQ ID NO: 415613 - DNA, 25 bp, Mus musculus
agaagacctcgtccagcagatccga

SEQ ID NO: 415614 - DNA, 25 bp, Mus musculus
ccctattaacacctgggccagaagg

SEQ ID NO: 415615 - DNA, 25 bp, Mus musculus
gcgctctccttggaaccccttggta

SEQ ID NO: 415616 - DNA, 25 bp, Mus musculus
gaagactgacaactccgccctatta

SEQ ID NO: 415617 - DNA, 25 bp, Mus musculus
acacctgggccagaagggtgccagc

SEQ ID NO: 415618 - DNA, 25 bp, Mus musculus
ccggcagcttccaaatgcgcaggcg

SEQ ID NO: 415619 - DNA, 25 bp, Mus musculus
ctgcggcgcggccatatttaaaggg

SEQ ID NO: 415620 - DNA, 25 bp, Mus musculus
catatttaaagggagccggcagcga

SEQ ID NO: 415621 - DNA, 25 bp, Mus musculus
gctcccttcagactcgggctaagcg

SEQ ID NO: 415622 - DNA, 25 bp, Mus musculus
agactcgggctaagcgcctcgctct

SEQ ID NO: 415623 - DNA, 25 bp, Mus musculus
tccaccgtggcgctcgccaaaggta

SEQ ID NO: 415624 - DNA, 25 bp, Mus musculus
tggcgctcgccaaaggtagcggccc

SEQ ID NO: 415625 - DNA, 25 bp, Mus musculus
agcggaccaggatcctgccggtgtc

SEQ ID NO: 415626 - DNA, 25 bp, Mus musculus
tttgcaaacagtggcctcccgcctg

SEQ ID NO: 415627 - DNA, 25 bp, Mus musculus
ggcggctttgaagccgtggacctcc

SEQ ID NO: 415628 - DNA, 25 bp, Mus musculus
ccaggaaagcctgcgccaactttgc

SEQ ID NO: 415629 - DNA, 25 bp, Mus musculus
tcagcagaccatccagaaggtgggc

SEQ ID NO: 415630 - DNA, 25 bp, Mus musculus
ggcacgaacaaagccggggcacagc

SEQ ID NO: 415631 - DNA, 25 bp, Mus musculus
tcctgcgcgtactccacttggaaga

SEQ ID NO: 415632 - DNA, 25 bp, Mus musculus
tcactgcggacgcactagctcgggc

SEQ ID NO: 415633 - DNA, 25 bp, Mus musculus
tggagccctttttgaccgcctcctg

SEQ ID NO: 415634 - DNA, 25 bp, Mus musculus
cggaaccaccgaagctcagcacagg

SEQ ID NO: 415635 - DNA, 25 bp, Mus musculus
caactttgctggaggcactggcagc

SEQ ID NO: 415636 - DNA, 25 bp, Mus musculus
gtgtaccggctaccggctggacgaa

SEQ ID NO: 415637 - DNA, 25 bp, Mus musculus
ctccgcgcggtatcctgacctggga

SEQ ID NO: 415638 - DNA, 25 bp, Mus musculus
cccgctctgcggagaatgggcacct

SEQ ID NO: 415639 - DNA, 25 bp, Mus musculus
aatgatcacgggctgagtccgcgcc

SEQ ID NO: 415640 - DNA, 25 bp, Mus musculus
cgcggtcgtagctcatcactgcgga

SEQ ID NO: 415641 - DNA, 25 bp, Mus musculus
cccaggcagcagacgcaacagagcg

SEQ ID NO: 415642 - DNA, 25 bp, Mus musculus
ccaactcggtgaccggcttggcgct

SEQ ID NO: 415643 - DNA, 25 bp, Mus musculus
cataggcgcgggctcgctctagtag

SEQ ID NO: 415644 - DNA, 25 bp, Mus musculus
ctctagtaggcgttctccagctccg

SEQ ID NO: 415645 - DNA, 25 bp, Mus musculus
tccagctccgcctggttggctttgg

SEQ ID NO: 415646 - DNA, 25 bp, Mus musculus
actcggacacatctgcggagagagg

SEQ ID NO: 415647 - DNA, 25 bp, Mus musculus
gcggcagctgtactcggacacatct

SEQ ID NO: 415648 - DNA, 25 bp, Mus musculus
tgtagtgcagctcgcggcagctgta

SEQ ID NO: 415649 - DNA, 25 bp, Mus musculus
gtctccggcccgaagtccttgagct

SEQ ID NO: 415650 - DNA, 25 bp, Mus musculus
tggccggagcacaccaactcggtga

SEQ ID NO: 415651 - DNA, 25 bp, Mus musculus
ttcacgcgcccgatggcgttgggca

SEQ ID NO: 415652 - DNA, 25 bp, Mus musculus
atgcagcggaaatccggtccgttcg

SEQ ID NO: 415653 - DNA, 25 bp, Mus musculus
agcgatccgggatgcagcggaaatc

SEQ ID NO: 415654 - DNA, 25 bp, Mus musculus
cttgcacttgcacgaggccaccaga

SEQ ID NO: 415655 - DNA, 25 bp, Mus musculus
ccttgagctccgactggttgtggaa

SEQ ID NO: 415656 - DNA, 25 bp, Mus musculus
taaagttggtttctgaaagactcgc

SEQ ID NO: 415657 - DNA, 25 bp, Mus musculus
ttggtttctgaaagactcgctctcg

SEQ ID NO: 415658 - DNA, 25 bp, Mus musculus
cggtgcctcgccttccggtttgctg

SEQ ID NO: 415659 - DNA, 25 bp, Mus musculus
acccggaaccagtcgagcgagcgga

SEQ ID NO: 415660 - DNA, 25 bp, Mus musculus
cggcattgcacgggtgtgcgttctc

SEQ ID NO: 415661 - DNA, 25 bp, Mus musculus
ggatctctctctgtgtgcggtggct

SEQ ID NO: 415662 - DNA, 25 bp, Mus musculus
ctctctctgtgtgcggtggctctaa

SEQ ID NO: 415663 - DNA, 25 bp, Mus musculus
ctctgtgtgcggtggctctaatgag

SEQ ID NO: 415664 - DNA, 25 bp, Mus musculus
gtggctctaatgaggagagcccgtc

SEQ ID NO: 415665 - DNA, 25 bp, Mus musculus
aggagagcccgtccggcctgatcgc

SEQ ID NO: 415666 - DNA, 25 bp, Mus musculus
ccgtccggcctgatcgccgtaaagt

SEQ ID NO: 415667 - DNA, 25 bp, Mus musculus
gtccggcctgatcgccgtaaagttg

SEQ ID NO: 415668 - DNA, 25 bp, Mus musculus
gcctgatcgccgtaaagttggtttc

SEQ ID NO: 415669 - DNA, 25 bp, Mus musculus
gatcgccgtaaagttggtttctgaa

SEQ ID NO: 415670 - DNA, 25 bp, Mus musculus
tttcggcttcgcgatggagctgcaa

SEQ ID NO: 415671 - DNA, 25 bp, Mus musculus
gcttccggagctccaaggcactgga

SEQ ID NO: 415672 - DNA, 25 bp, Mus musculus
cgcgtgctcccatggctggaaagtt

SEQ ID NO: 415673 - DNA, 25 bp, Mus musculus
aaagttggtgtcactggtgccaccc

SEQ ID NO: 415674 - DNA, 25 bp, Mus musculus
tgctactgtgcgtccctacccaaga

SEQ ID NO: 415675 - DNA, 25 bp, Mus musculus
gctctcacaccagcgcgggactgtg

SEQ ID NO: 415676 - DNA, 25 bp, Mus musculus
gagctttcttcctgctcccttcatg

SEQ ID NO: 415677 - DNA, 25 bp, Mus musculus
cacttcgttttactgagtccgcggg

SEQ ID NO: 415678 - DNA, 25 bp, Mus musculus
ctggaggcaaagttcgtgggaattc

SEQ ID NO: 415679 - DNA, 25 bp, Mus musculus
gaattcccttctttcggcttcgcga

SEQ ID NO: 415680 - DNA, 25 bp, Mus musculus
caagagcggcagaggagctttcttc

SEQ ID NO: 415681 - DNA, 25 bp, Mus musculus
agtccagcgccatttccaggcagca

SEQ ID NO: 415682 - DNA, 25 bp, Mus musculus
tttccaggcagcatttcgagcacgc

SEQ ID NO: 415683 - DNA, 25 bp, Mus musculus
ccggtcctagattccgcacttcgtt

SEQ ID NO: 415684 - DNA, 25 bp, Mus musculus
cgctgcctttgtttggttcggcgca

SEQ ID NO: 415685 - DNA, 25 bp, Mus musculus
ctggtatcggaatctgagcagagtg

SEQ ID NO: 415686 - DNA, 25 bp, Mus musculus
tgctcttgagcctaatctttgccgg

SEQ ID NO: 415687 - DNA, 25 bp, Mus musculus
tccatggcccagcaggctcacaggg

SEQ ID NO: 415688 - DNA, 25 bp, Mus musculus
cgcagccaggacagcggtccaggca

SEQ ID NO: 415689 - DNA, 25 bp, Mus musculus
ggccacgatgagcagcgccatgagc

SEQ ID NO: 415690 - DNA, 25 bp, Mus musculus
ttgcccagcactgtggccacgatga

SEQ ID NO: 415691 - DNA, 25 bp, Mus musculus
cgccacgaaggcgagcatgaccagc

SEQ ID NO: 415692 - DNA, 25 bp, Mus musculus
cggaggctcgaatccgccacgaagg

SEQ ID NO: 415693 - DNA, 25 bp, Mus musculus
cgaggttgagcagaaagaagttgtt

SEQ ID NO: 415694 - DNA, 25 bp, Mus musculus
tttacccacgaggaagtcggagatg

SEQ ID NO: 415695 - DNA, 25 bp, Mus musculus
ggtttctagagctcctctcccaagg

SEQ ID NO: 415696 - DNA, 25 bp, Mus musculus
ttcggcgcaggagccaacgctgcac

SEQ ID NO: 415697 - DNA, 25 bp, Mus musculus
tgcagcgagagcaaagccgagctcc

SEQ ID NO: 415698 - DNA, 25 bp, Mus musculus
tcctccgagacgctgcggccgagtg

SEQ ID NO: 415699 - DNA, 25 bp, Mus musculus
gaacgtgatcggcatggttccgccc

SEQ ID NO: 415700 - DNA, 25 bp, Mus musculus
ccgcacttccgcttgggtgtcagag

SEQ ID NO: 415701 - DNA, 25 bp, Mus musculus
ctcggggaggcccatttgccaccta

SEQ ID NO: 415702 - DNA, 25 bp, Mus musculus
catttgccacctaggccgcggctgg

SEQ ID NO: 415703 - DNA, 25 bp, Mus musculus
ggactccggcgttctccctttgctg

SEQ ID NO: 415704 - DNA, 25 bp, Mus musculus
cccgtgtgagccggattatgatagg

SEQ ID NO: 415705 - DNA, 25 bp, Mus musculus
gttctccctttgctgggcgagccgc

SEQ ID NO: 415706 - DNA, 25 bp, Mus musculus
cgtggcctcaggtccgagggcctat

SEQ ID NO: 415707 - DNA, 25 bp, Mus musculus
tccacagcagagtcggagcgcgcct

SEQ ID NO: 415708 - DNA, 25 bp, Mus musculus
cgagggcctatgtctccacagcaga

SEQ ID NO: 415709 - DNA, 25 bp, Mus musculus
gtcggagcgcgccttcagacctgca

SEQ ID NO: 415710 - DNA, 25 bp, Mus musculus
agaagctgtccggagaacgtgatcg

SEQ ID NO: 415711 - DNA, 25 bp, Mus musculus
ttcagacctgcaccagcgaggcagc

SEQ ID NO: 415712 - DNA, 25 bp, Mus musculus
accagggccaatcgggacctggtcg

SEQ ID NO: 415713 - DNA, 25 bp, Mus musculus
ttcaggcgctctgttcccaagcctg

SEQ ID NO: 415714 - DNA, 25 bp, Mus musculus
ttttcaggatgacgacttcaggcgc

SEQ ID NO: 415715 - DNA, 25 bp, Mus musculus
ggacattgagcacgcgacgcggaac

SEQ ID NO: 415716 - DNA, 25 bp, Mus musculus
gccgcgcggctgacggaactcaatc

SEQ ID NO: 415717 - DNA, 25 bp, Mus musculus
cgatggacggtgaccagggccaatc

SEQ ID NO: 415718 - DNA, 25 bp, Mus musculus
acagcaacaataggggccgctctgg

SEQ ID NO: 415719 - DNA, 25 bp, Mus musculus
tatgacacagcaacaataggggccg

SEQ ID NO: 415720 - DNA, 25 bp, Mus musculus
gccctttctgcgagtcgtggaggcc

SEQ ID NO: 415721 - DNA, 25 bp, Mus musculus
ttggtgtacggtccggtgcccatca

SEQ ID NO: 415722 - DNA, 25 bp, Mus musculus
cccacgagcacgttggtgtacggtc

SEQ ID NO: 415723 - DNA, 25 bp, Mus musculus
ccagggtacgtgtcacagctcaacc

SEQ ID NO: 415724 - DNA, 25 bp, Mus musculus
ggacatccgtcccagggtacgtgtc

SEQ ID NO: 415725 - DNA, 25 bp, Mus musculus
acggaactcaatccgcggcgagagc

SEQ ID NO: 415726 - DNA, 25 bp, Mus musculus
gtctgattgggatctccgccagcca

SEQ ID NO: 415727 - DNA, 25 bp, Mus musculus
caaccagcttgcagtagaggtcctc

SEQ ID NO: 415728 - DNA, 25 bp, Mus musculus
ggaggccaacaggttcctgcctgtc

SEQ ID NO: 415729 - DNA, 25 bp, Mus musculus
cttacggctgccgaggactgatcac

SEQ ID NO: 415730 - DNA, 25 bp, Mus musculus
tccgcgagtcggacacttcattggc

SEQ ID NO: 415731 - DNA, 25 bp, Mus musculus
ctcttccagaggcacgtgccgtgtc

SEQ ID NO: 415732 - DNA, 25 bp, Mus musculus
ctgcacgagtttcggtagccgcatc

SEQ ID NO: 415733 - DNA, 25 bp, Mus musculus
agcgccagtccagccagcagcagta

SEQ ID NO: 415734 - DNA, 25 bp, Mus musculus
cgcccgagccttatgccctggagag

SEQ ID NO: 415735 - DNA, 25 bp, Mus musculus
tgggagagtcagtccgtacttactc

SEQ ID NO: 415736 - DNA, 25 bp, Mus musculus
ccctacgagatgtctgggttccggc

SEQ ID NO: 415737 - DNA, 25 bp, Mus musculus
ccgcgctcacctggattgtctgatt

SEQ ID NO: 415738 - DNA, 25 bp, Mus musculus
ccttagtccatcaaaacatggggcc

SEQ ID NO: 415739 - DNA, 25 bp, Mus musculus
atggtgtaaccagctcctccgtgcc

SEQ ID NO: 415740 - DNA, 25 bp, Mus musculus
tgccgcggaaatggtgagcatctgc

SEQ ID NO: 415741 - DNA, 25 bp, Mus musculus
ggaccacgcgtccatccagatgaac

SEQ ID NO: 415742 - DNA, 25 bp, Mus musculus
catcattgctgccaaggaccacgcg

SEQ ID NO: 415743 - DNA, 25 bp, Mus musculus
ccactgttcttttgcgacctattaa

SEQ ID NO: 415744 - DNA, 25 bp, Mus musculus
acggcctcaggatgcagaacgacgc

SEQ ID NO: 415745 - DNA, 25 bp, Mus musculus
ctcaagacctgcgtggtaactctgc

SEQ ID NO: 415746 - DNA, 25 bp, Mus musculus
gcgggcctgaccagtctcaagacct

SEQ ID NO: 415747 - DNA, 25 bp, Mus musculus
tttctgcgctctcgctggacaagtg

SEQ ID NO: 415748 - DNA, 25 bp, Mus musculus
ggaggcacgagctacttcctttctg

SEQ ID NO: 415749 - DNA, 25 bp, Mus musculus
tggatacgagtaccctgacccggaa

SEQ ID NO: 415750 - DNA, 25 bp, Mus musculus
aacaggcctccggtatggtggatac

SEQ ID NO: 415751 - DNA, 25 bp, Mus musculus
agagccaggctttctttgcaccgga

SEQ ID NO: 415752 - DNA, 25 bp, Mus musculus
ccgatgcctgtgctttgtgcggaaa

SEQ ID NO: 415753 - DNA, 25 bp, Mus musculus
agctccgcaagcaaccgcatcattg

SEQ ID NO: 415754 - DNA, 25 bp, Mus musculus
cttgtggcttacccgaacccatagg

SEQ ID NO: 415755 - DNA, 25 bp, Mus musculus
acctggctcaccaccaccggtgccc

SEQ ID NO: 415756 - DNA, 25 bp, Mus musculus
gacctggctcaccaccaccggtgcc

SEQ ID NO: 415757 - DNA, 25 bp, Mus musculus
ggacctggctcaccaccaccggtgc

SEQ ID NO: 415758 - DNA, 25 bp, Mus musculus
gggacctggctcaccaccaccggtg

SEQ ID NO: 415759 - DNA, 25 bp, Mus musculus
agggacctggctcaccaccaccggt

SEQ ID NO: 415760 - DNA, 25 bp, Mus musculus
caactaccccacaacctgggaggag

SEQ ID NO: 415761 - DNA, 25 bp, Mus musculus
tcaactaccccacaacctgggagga

SEQ ID NO: 415762 - DNA, 25 bp, Mus musculus
gtggcttacccgaacccataggtca

SEQ ID NO: 415763 - DNA, 25 bp, Mus musculus
gcttgtggcttacccgaacccatag

SEQ ID NO: 415764 - DNA, 25 bp, Mus musculus
ctggctcaccaccaccggtgccccg

SEQ ID NO: 415765 - DNA, 25 bp, Mus musculus
tggcttacccgaacccataggtcaa

SEQ ID NO: 415766 - DNA, 25 bp, Mus musculus
ataggtcaactaccccacaacctgg

SEQ ID NO: 415767 - DNA, 25 bp, Mus musculus
tgtggcttacccgaacccataggtc

SEQ ID NO: 415768 - DNA, 25 bp, Mus musculus
tgccaaggccataggtcacacagcc

SEQ ID NO: 415769 - DNA, 25 bp, Mus musculus
ctgccaaggccataggtcacacagc

SEQ ID NO: 415770 - DNA, 25 bp, Mus musculus
caaggccataggtcacacagccgga

SEQ ID NO: 415771 - DNA, 25 bp, Mus musculus
ggccataggtcacacagccggagtg

SEQ ID NO: 415772 - DNA, 25 bp, Mus musculus
ccataggtcacacagccggagtgct

SEQ ID NO: 415773 - DNA, 25 bp, Mus musculus
ataggtcacacagccggagtgctgg

SEQ ID NO: 415774 - DNA, 25 bp, Mus musculus
tcacacagccggagtgctggttagg

SEQ ID NO: 415775 - DNA, 25 bp, Mus musculus
cacagccggagtgctggttaggcct

SEQ ID NO: 415776 - DNA, 25 bp, Mus musculus
agccggagtgctggttaggcctcta

SEQ ID NO: 415777 - DNA, 25 bp, Mus musculus
gagtgctggttaggcctctaggcca

SEQ ID NO: 415778 - DNA, 25 bp, Mus musculus
tgctggttaggcctctaggccacca

SEQ ID NO: 415779 - DNA, 25 bp, Mus musculus
gctggttaggcctctaggccaccac

SEQ ID NO: 415780 - DNA, 25 bp, Mus musculus
ccgtccagcccactcacctttggcg

SEQ ID NO: 415781 - DNA, 25 bp, Mus musculus
agcccactcacctttggcgctgccc

SEQ ID NO: 415782 - DNA, 25 bp, Mus musculus
ggcgcgcctgcatgcaaatgaggct

SEQ ID NO: 415783 - DNA, 25 bp, Mus musculus
cggcgcgcctgcatgcaaatgaggc

SEQ ID NO: 415784 - DNA, 25 bp, Mus musculus
cgcggcgcgcttgcatgcaaatacc

SEQ ID NO: 415785 - DNA, 25 bp, Mus musculus
gtcactcccgcccattggccgcggc

SEQ ID NO: 415786 - DNA, 25 bp, Mus musculus
ccatatgtaaatatagttccgcggt

SEQ ID NO: 415787 - DNA, 25 bp, Mus musculus
cctgtctattggttgcggcgcgcct

SEQ ID NO: 415788 - DNA, 25 bp, Mus musculus
ccatatgcaaatatagttccgcggt

SEQ ID NO: 415789 - DNA, 25 bp, Mus musculus
ctctgagcccttcgatcggctagcg

SEQ ID NO: 415790 - DNA, 25 bp, Mus musculus
tgagcccttcgatcggctagcgata

SEQ ID NO: 415791 - DNA, 25 bp, Mus musculus
cccttcgatcggctagcgatatgtg

SEQ ID NO: 415792 - DNA, 25 bp, Mus musculus
cttcgatcggctagcgatatgtggc

SEQ ID NO: 415793 - DNA, 25 bp, Mus musculus
cgatcggctagcgatatgtggcttg

SEQ ID NO: 415794 - DNA, 25 bp, Mus musculus
tcggctagcgatatgtggcttgccc

SEQ ID NO: 415795 - DNA, 25 bp, Mus musculus
cctgtccattggttgcggcgcgcct

SEQ ID NO: 415796 - DNA, 25 bp, Mus musculus
cgcgagcttgacctgcagagaagaa

SEQ ID NO: 415797 - DNA, 25 bp, Mus musculus
aaggggctacgtcggaactcatgta

SEQ ID NO: 415798 - DNA, 25 bp, Mus musculus
cggcaactgcttgtgtccagctgga

SEQ ID NO: 415799 - DNA, 25 bp, Mus musculus
ctcacacgaaggcaggtacggcagc

SEQ ID NO: 415800 - DNA, 25 bp, Mus musculus
ggctctgggctaacgccaagctttg

SEQ ID NO: 415801 - DNA, 25 bp, Mus musculus
ctctgtagggaatcccgggaacttg

SEQ ID NO: 415802 - DNA, 25 bp, Mus musculus
acgtctagggcaggatcactgggcc

SEQ ID NO: 415803 - DNA, 25 bp, Mus musculus
tccacttttttgagtcggttcacca

SEQ ID NO: 415804 - DNA, 25 bp, Mus musculus
ctcctctgggtggaatgacagggtt

SEQ ID NO: 415805 - DNA, 25 bp, Mus musculus
gaacgaggtccttgccttgcgcaga

SEQ ID NO: 415806 - DNA, 25 bp, Mus musculus
ttgcgcagagatcgccagccaaagc

SEQ ID NO: 415807 - DNA, 25 bp, Mus musculus
tgggtctccacagagccgctctgta

SEQ ID NO: 415808 - DNA, 25 bp, Mus musculus
cgtgacccgaacaggctctgctgtc

SEQ ID NO: 415809 - DNA, 25 bp, Mus musculus
agccggttcccgaagagtgcagaaa

SEQ ID NO: 415810 - DNA, 25 bp, Mus musculus
gccacgtggtcttggtgacgtcatc

SEQ ID NO: 415811 - DNA, 25 bp, Mus musculus
cgggaacaccaacgactgcgttctg

SEQ ID NO: 415812 - DNA, 25 bp, Mus musculus
tctgtccatccaagaagaaaaccgg

SEQ ID NO: 415813 - DNA, 25 bp, Mus musculus
cggcaaactcgttccgagttcaggc

SEQ ID NO: 415814 - DNA, 25 bp, Mus musculus
agttcaggcgctccctgtgtgtctg

SEQ ID NO: 415815 - DNA, 25 bp, Mus musculus
aactcaggtcttgccaggttgggcc

SEQ ID NO: 415816 - DNA, 25 bp, Mus musculus
cgctgcggttcactctggttccgag

SEQ ID NO: 415817 - DNA, 25 bp, Mus musculus
tgcccgtcgggctgttttctgaccc

SEQ ID NO: 415818 - DNA, 25 bp, Mus musculus
gcgcactgggacttctgctcctgcg

SEQ ID NO: 415819 - DNA, 25 bp, Mus musculus
cgcctctgcaggacagtgtgatccc

SEQ ID NO: 415820 - DNA, 25 bp, Mus musculus
tgtgatcccggcagacagaacccga

SEQ ID NO: 415821 - DNA, 25 bp, Mus musculus
ccggcacctcgggtagggctcatgt

SEQ ID NO: 415822 - DNA, 25 bp, Mus musculus
agcggcccgtgtaaagagcgcaccc

SEQ ID NO: 415823 - DNA, 25 bp, Mus musculus
tctgcgcacgctcaggagcaactca

SEQ ID NO: 415824 - DNA, 25 bp, Mus musculus
gagactcacgcgttgcccacgtaga

SEQ ID NO: 415825 - DNA, 25 bp, Mus musculus
agaccctcgggacgacctcgttgca

SEQ ID NO: 415826 - DNA, 25 bp, Mus musculus
ctgtagcagccgctgccatccgaga

SEQ ID NO: 415827 - DNA, 25 bp, Mus musculus
catccgagagcaggtcgttgagatc

SEQ ID NO: 415828 - DNA, 25 bp, Mus musculus
cgttgagatcttgcaccgagagttc

SEQ ID NO: 415829 - DNA, 25 bp, Mus musculus
accgagagttcgaacgagctggaca

SEQ ID NO: 415830 - DNA, 25 bp, Mus musculus
ctgcggtcacgctaggcagcgcaga

SEQ ID NO: 415831 - DNA, 25 bp, Mus musculus
cgagatgccatcactcccgtgtcat

SEQ ID NO: 415832 - DNA, 25 bp, Mus musculus
gggcacgttcctggccgagatgcca

SEQ ID NO: 415833 - DNA, 25 bp, Mus musculus
gggtttggccctcccagagactcac

SEQ ID NO: 415834 - DNA, 25 bp, Mus musculus
cccaagtagtagtcggggcccgctg

SEQ ID NO: 415835 - DNA, 25 bp, Mus musculus
tctgggcatgcggagtccagctcct

SEQ ID NO: 415836 - DNA, 25 bp, Mus musculus
tcctccgcttcatgcgcggggagta

SEQ ID NO: 415837 - DNA, 25 bp, Mus musculus
tcttgctctcaggtcggcgaccgcg

SEQ ID NO: 415838 - DNA, 25 bp, Mus musculus
ggtctggctccgtactagatgcctc

SEQ ID NO: 415839 - DNA, 25 bp, Mus musculus
tgcctcctaggtatgccagactccg

SEQ ID NO: 415840 - DNA, 25 bp, Mus musculus
gcgtgtgtacgccaacgagagttcg

SEQ ID NO: 415841 - DNA, 25 bp, Mus musculus
ggtaccttcacgcagctctccgatg

SEQ ID NO: 415842 - DNA, 25 bp, Mus musculus
ctttgtccctacgaggagcgcggat

SEQ ID NO: 415843 - DNA, 25 bp, Mus musculus
agttgctcactagtggcgggctttg

SEQ ID NO: 415844 - DNA, 25 bp, Mus musculus
ttgctaagaccgagggaaacgtgga

SEQ ID NO: 415845 - DNA, 25 bp, Mus musculus
tttgctagtatacgcaggtgcgagc

SEQ ID NO: 415846 - DNA, 25 bp, Mus musculus
tctcactgcacatgagggaagctgc

SEQ ID NO: 415847 - DNA, 25 bp, Mus musculus
caagggagccggatgcagaattcac

SEQ ID NO: 415848 - DNA, 25 bp, Mus musculus
gtctgaagacacatcccggggaacc

SEQ ID NO: 415849 - DNA, 25 bp, Mus musculus
ctggactgctttgaggtctcggacc

SEQ ID NO: 415850 - DNA, 25 bp, Mus musculus
agactccgacctgctgacgtcagga

SEQ ID NO: 415851 - DNA, 25 bp, Mus musculus
ctgcgggtctgttcagcgacagatc

SEQ ID NO: 415852 - DNA, 25 bp, Mus musculus
cagccgccagctcagtggaagcgcg

SEQ ID NO: 415853 - DNA, 25 bp, Mus musculus
cagagctcccaggatctcctggata

SEQ ID NO: 415854 - DNA, 25 bp, Mus musculus
agtggatccctgagccggcacgtct

SEQ ID NO: 415855 - DNA, 25 bp, Mus musculus
agaaagaagagtggatccctgagcc

SEQ ID NO: 415856 - DNA, 25 bp, Mus musculus
gatcccagactctgaaggagaaaga

SEQ ID NO: 415857 - DNA, 25 bp, Mus musculus
tgcgggaagagctccaagcagaaga

SEQ ID NO: 415858 - DNA, 25 bp, Mus musculus
cccgatctaggcaggctcggagcca

SEQ ID NO: 415859 - DNA, 25 bp, Mus musculus
cagaatctggaggtcggtagcagcc

SEQ ID NO: 415860 - DNA, 25 bp, Mus musculus
gtgcagagaaccaaccacagaatct

SEQ ID NO: 415861 - DNA, 25 bp, Mus musculus
ctgaggacatcgctgccacccagga

SEQ ID NO: 415862 - DNA, 25 bp, Mus musculus
cacaagccagcagggtcgcggtcct

SEQ ID NO: 415863 - DNA, 25 bp, Mus musculus
acaggctcgcccaacgaagcacaag

SEQ ID NO: 415864 - DNA, 25 bp, Mus musculus
atctcctggatagctggcttcgccg

SEQ ID NO: 415865 - DNA, 25 bp, Mus musculus
gaaccggaaagcagatcccagactc

SEQ ID NO: 415866 - DNA, 25 bp, Mus musculus
atcccggatccattgccgcaacgtc

SEQ ID NO: 415867 - DNA, 25 bp, Mus musculus
ccgcgcctccatcccatcccggatc

SEQ ID NO: 415868 - DNA, 25 bp, Mus musculus
tgccgcaacgtcagcgccaccgcct

SEQ ID NO: 415869 - DNA, 25 bp, Mus musculus
cgcttcccggcttctccagtcgcag

SEQ ID NO: 415870 - DNA, 25 bp, Mus musculus
gcgccgccctggttttccctgccac

SEQ ID NO: 415871 - DNA, 25 bp, Mus musculus
ttgcggggcggagaatcctgccccc

SEQ ID NO: 415872 - DNA, 25 bp, Mus musculus
gagcggccctgaatggtgccaccgc

SEQ ID NO: 415873 - DNA, 25 bp, Mus musculus
cctcatcctgggagcggccctgaat

SEQ ID NO: 415874 - DNA, 25 bp, Mus musculus
ggcacctgcggctgctacggctgct

SEQ ID NO: 415875 - DNA, 25 bp, Mus musculus
atggcgacgcccgtccctccgcctt

SEQ ID NO: 415876 - DNA, 25 bp, Mus musculus
gcgctgaagcatggcgacgcccgtc

SEQ ID NO: 415877 - DNA, 25 bp, Mus musculus
tcgcagttcccggagtgggtaccga

SEQ ID NO: 415878 - DNA, 25 bp, Mus musculus
ccagtcgcagttcccggagtgggta

SEQ ID NO: 415879 - DNA, 25 bp, Mus musculus
ggcgcactcccgacacttttctctg

SEQ ID NO: 415880 - DNA, 25 bp, Mus musculus
agtgcgcgccctccacaccaagtgc

SEQ ID NO: 415881 - DNA, 25 bp, Mus musculus
agtgtgcctcttccacgccatgctg

SEQ ID NO: 415882 - DNA, 25 bp, Mus musculus
agtcgctgctgcaccggaagccagt

SEQ ID NO: 415883 - DNA, 25 bp, Mus musculus
cgccttctccggacagagccgtagg

SEQ ID NO: 415884 - DNA, 25 bp, Mus musculus
gccatgctgggccacaagcctgtcg

SEQ ID NO: 415885 - DNA, 25 bp, Mus musculus
ccctgaggtggaagtgtgcctcttc

SEQ ID NO: 415886 - DNA, 25 bp, Mus musculus
gcgctcgtcaatcgccggcggccat

SEQ ID NO: 415887 - DNA, 25 bp, Mus musculus
ctgcgcggagcctgtagtattttcc

SEQ ID NO: 415888 - DNA, 25 bp, Mus musculus
cggaagccagtcttcgctgcgcctg

SEQ ID NO: 415889 - DNA, 25 bp, Mus musculus
caccaggagtcgctgctgcaccgga

SEQ ID NO: 415890 - DNA, 25 bp, Mus musculus
gcagtaaaaggttcaaccaccagga

SEQ ID NO: 415891 - DNA, 25 bp, Mus musculus
cagagccgtaggcagtaaaaggttc

SEQ ID NO: 415892 - DNA, 25 bp, Mus musculus
tctccggacagagccgtaggcagta

SEQ ID NO: 415893 - DNA, 25 bp, Mus musculus
tgctgggccacaagcctgtcggtga

SEQ ID NO: 415894 - DNA, 25 bp, Mus musculus
ctggtgacgtcaaggaagcgactga

SEQ ID NO: 415895 - DNA, 25 bp, Mus musculus
atggacgacccggaatgcgattcca

SEQ ID NO: 415896 - DNA, 25 bp, Mus musculus
atagaggcaggaatcccggtgcacg

SEQ ID NO: 415897 - DNA, 25 bp, Mus musculus
cgcctccagggttgtccttctgggc

SEQ ID NO: 415898 - DNA, 25 bp, Mus musculus
actgccttctccaggacaccgcttc

SEQ ID NO: 415899 - DNA, 25 bp, Mus musculus
gcttcccgcctagctccgagcgtag

SEQ ID NO: 415900 - DNA, 25 bp, Mus musculus
aaagcgggtccagcctgtcgagtat

SEQ ID NO: 415901 - DNA, 25 bp, Mus musculus
ccagcctgtcgagtatggacgaccc

SEQ ID NO: 415902 - DNA, 25 bp, Mus musculus
tgcgattccacctgggaggacgaga

SEQ ID NO: 415903 - DNA, 25 bp, Mus musculus
gccaggcggatgatacgaccgatga

SEQ ID NO: 415904 - DNA, 25 bp, Mus musculus
tacgaccgatgaggacacgggcgac

SEQ ID NO: 415905 - DNA, 25 bp, Mus musculus
gccaagcctgttccaggtgcggtgc

SEQ ID NO: 415906 - DNA, 25 bp, Mus musculus
accggagggcgacaggacaacgcca

SEQ ID NO: 415907 - DNA, 25 bp, Mus musculus
aggacaacgccaggccgtgatcgcc

SEQ ID NO: 415908 - DNA, 25 bp, Mus musculus
ggacaactcgagtcccttgggccaa

SEQ ID NO: 415909 - DNA, 25 bp, Mus musculus
aggaccctcgaggacatctgtggca

SEQ ID NO: 415910 - DNA, 25 bp, Mus musculus
cgccaaggaccctcgaggacatctg

SEQ ID NO: 415911 - DNA, 25 bp, Mus musculus
ccaacacctgagtcccgccgccaag

SEQ ID NO: 415912 - DNA, 25 bp, Mus musculus
agtcccttgggccaacacctgagtc

SEQ ID NO: 415913 - DNA, 25 bp, Mus musculus
agagcgcctgccagccatgaccgga

SEQ ID NO: 415914 - DNA, 25 bp, Mus musculus
cgaacagcctgggacaactcgagtc

SEQ ID NO: 415915 - DNA, 25 bp, Mus musculus
acgtcgaaccgaacagcctgggaca

SEQ ID NO: 415916 - DNA, 25 bp, Mus musculus
cctcgaggacatctgtggcagtctc

SEQ ID NO: 415917 - DNA, 25 bp, Mus musculus
gccggacgtcgaaccgaacagcctg

SEQ ID NO: 415918 - DNA, 25 bp, Mus musculus
ggacatctgtggcagtctcttcacc

SEQ ID NO: 415919 - DNA, 25 bp, Mus musculus
atctgtggcagtctcttcaccgcct

SEQ ID NO: 415920 - DNA, 25 bp, Mus musculus
gagcgcctgccctagccctgctgct

SEQ ID NO: 415921 - DNA, 25 bp, Mus musculus
tgacggccacctccgcgcaggtgag

SEQ ID NO: 415922 - DNA, 25 bp, Mus musculus
cggctcggccggcatactgttgaag

SEQ ID NO: 415923 - DNA, 25 bp, Mus musculus
agctcctggaagtcgacgtggccca

SEQ ID NO: 415924 - DNA, 25 bp, Mus musculus
gttcaaaccatggacaggccacgcc

SEQ ID NO: 415925 - DNA, 25 bp, Mus musculus
ccagtggccttgagttcaaaccatg

SEQ ID NO: 415926 - DNA, 25 bp, Mus musculus
accgctgagcacctcaggagcagtg

SEQ ID NO: 415927 - DNA, 25 bp, Mus musculus
tccaccaggctcaggtcggtggtcg

SEQ ID NO: 415928 - DNA, 25 bp, Mus musculus
tgcgtgtactccacttccgtcatct

SEQ ID NO: 415929 - DNA, 25 bp, Mus musculus
atgtgctgcagctgcgtgtactcca

SEQ ID NO: 415930 - DNA, 25 bp, Mus musculus
tccgccgcctccatgtgcgagtaga

SEQ ID NO: 415931 - DNA, 25 bp, Mus musculus
agcagcatcatacgcagctcctgga

SEQ ID NO: 415932 - DNA, 25 bp, Mus musculus
gtcctccagacggacgcgtacggtc

SEQ ID NO: 415933 - DNA, 25 bp, Mus musculus
ggcatactgttgaagcggtcctcca

SEQ ID NO: 415934 - DNA, 25 bp, Mus musculus
ttgttgagcgccacgcccgactcgg

SEQ ID NO: 415935 - DNA, 25 bp, Mus musculus
ctccatgtgcgagtagaggatgtgc

SEQ ID NO: 415936 - DNA, 25 bp, Mus musculus
tttcggcagaaaccagacgcagacc

SEQ ID NO: 415937 - DNA, 25 bp, Mus musculus
tgccctaccgcaagtgtcgagaacc

SEQ ID NO: 415938 - DNA, 25 bp, Mus musculus
gcgcggcaagcggaagaaatcgacc

SEQ ID NO: 415939 - DNA, 25 bp, Mus musculus
ggcacgcttgacagattcccgcgtc

SEQ ID NO: 415940 - DNA, 25 bp, Mus musculus
ccgactcagaatcaagggctccaca

SEQ ID NO: 415941 - DNA, 25 bp, Mus musculus
ttggactacacaagacaaccggtga

SEQ ID NO: 415942 - DNA, 25 bp, Mus musculus
gacgccattttctcggcgccatcgg

SEQ ID NO: 415943 - DNA, 25 bp, Mus musculus
agtccaagtgccgttcgggtccaca

SEQ ID NO: 415944 - DNA, 25 bp, Mus musculus
ctccttcacagtacagagtcactta

SEQ ID NO: 415945 - DNA, 25 bp, Mus musculus
cgggatcccgcagccatttccagag

SEQ ID NO: 415946 - DNA, 25 bp, Mus musculus
gccatttccagagctaccacggata

SEQ ID NO: 415947 - DNA, 25 bp, Mus musculus
ccacggatatagagcagagaccagc

SEQ ID NO: 415948 - DNA, 25 bp, Mus musculus
gcgagactaccgtcctagagtggta

SEQ ID NO: 415949 - DNA, 25 bp, Mus musculus
cagacccagaccatcttggactaca

SEQ ID NO: 415950 - DNA, 25 bp, Mus musculus
cggaataaatcctaggagctcgctc

SEQ ID NO: 415951 - DNA, 25 bp, Mus musculus
gtcgattcgcgagaggattccattg

SEQ ID NO: 415952 - DNA, 25 bp, Mus musculus
gttcgcacgtctctgccattaaagg

SEQ ID NO: 415953 - DNA, 25 bp, Mus musculus
gccgggacccgaatagttactgcaa

SEQ ID NO: 415954 - DNA, 25 bp, Mus musculus
tccattggttgccagttcgcatctc

SEQ ID NO: 415955 - DNA, 25 bp, Mus musculus
gcagctactgcgctaaaagtcatcc

SEQ ID NO: 415956 - DNA, 25 bp, Mus musculus
gccctgccgaagagttctgcgcaaa

SEQ ID NO: 415957 - DNA, 25 bp, Mus musculus
gcagcagccatcttgcgcaaaagcg

SEQ ID NO: 415958 - DNA, 25 bp, Mus musculus
gcgctagcactcagtacgcgaatgc

SEQ ID NO: 415959 - DNA, 25 bp, Mus musculus
tgggaccttcgtttcgaactcagtc

SEQ ID NO: 415960 - DNA, 25 bp, Mus musculus
tacaagccggggaatgccctcctca

SEQ ID NO: 415961 - DNA, 25 bp, Mus musculus
ctcacatccggaggccttgtctttg

SEQ ID NO: 415962 - DNA, 25 bp, Mus musculus
caggcctcgattacaacgttcccgg

SEQ ID NO: 415963 - DNA, 25 bp, Mus musculus
gccgttctgacgctgatcaggcctc

SEQ ID NO: 415964 - DNA, 25 bp, Mus musculus
cgatgggacttcacgccgtccaatc

SEQ ID NO: 415965 - DNA, 25 bp, Mus musculus
ggatgtagtttttggccagcagaag

SEQ ID NO: 415966 - DNA, 25 bp, Mus musculus
ggcttctcgccgcagtgtttgcaaa

SEQ ID NO: 415967 - DNA, 25 bp, Mus musculus
ttgcaaagcgccgagggcgatcctg

SEQ ID NO: 415968 - DNA, 25 bp, Mus musculus
atcctgagaaggtggcacacttgtc

SEQ ID NO: 415969 - DNA, 25 bp, Mus musculus
acgggtaaatcgctgcctggccaaa

SEQ ID NO: 415970 - DNA, 25 bp, Mus musculus
gaggtatgctaccaagcgccgcatc

SEQ ID NO: 415971 - DNA, 25 bp, Mus musculus
ccagcagaagtgtggctatcttgga

SEQ ID NO: 415972 - DNA, 25 bp, Mus musculus
ttcaggtcatgcatgcgtcgccgtt

SEQ ID NO: 415973 - DNA, 25 bp, Mus musculus
gacagcgacttgagctcggccatga

SEQ ID NO: 415974 - DNA, 25 bp, Mus musculus
ccgctacggcagtatggcttcttgc

SEQ ID NO: 415975 - DNA, 25 bp, Mus musculus
acccacgggcctgaagatgggagcc

SEQ ID NO: 415976 - DNA, 25 bp, Mus musculus
ttcgtttttaagctgctgaggctcc

SEQ ID NO: 415977 - DNA, 25 bp, Mus musculus
ctcccactcgtattggcttcgtttt

SEQ ID NO: 415978 - DNA, 25 bp, Mus musculus
ctccagccggtttcccagaggagct

SEQ ID NO: 415979 - DNA, 25 bp, Mus musculus
ctgcgtggagcaccagtcacatcga

SEQ ID NO: 415980 - DNA, 25 bp, Mus musculus
tggagcaccagtcacatcgaaggca

SEQ ID NO: 415981 - DNA, 25 bp, Mus musculus
caccagtcacatcgaaggcagaaga

SEQ ID NO: 415982 - DNA, 25 bp, Mus musculus
catcgaaggcagaagaatggtaccc

SEQ ID NO: 415983 - DNA, 25 bp, Mus musculus
gaaggcagaagaatggtacccgacc

SEQ ID NO: 415984 - DNA, 25 bp, Mus musculus
tccgctgctactggctccgcctccg

SEQ ID NO: 415985 - DNA, 25 bp, Mus musculus
cggctccagccggtttcccagagga

SEQ ID NO: 415986 - DNA, 25 bp, Mus musculus
ccgccgcgcaccaggtcccttgtgt

SEQ ID NO: 415987 - DNA, 25 bp, Mus musculus
caggtcccttgtgtgccacgcgctg

SEQ ID NO: 415988 - DNA, 25 bp, Mus musculus
gtgtgccacgcgctgcttcttacct

SEQ ID NO: 415989 - DNA, 25 bp, Mus musculus
tgcttcttacctcgtcgcgccagga

SEQ ID NO: 415990 - DNA, 25 bp, Mus musculus
ttcttacctcgtcgcgccaggatct

SEQ ID NO: 415991 - DNA, 25 bp, Mus musculus
ccctcggcggcttccagctgcggcc

SEQ ID NO: 415992 - DNA, 25 bp, Mus musculus
aggctctttgggagtgcctcctcca

SEQ ID NO: 415993 - DNA, 25 bp, Mus musculus
agggatggtaaagggtctgctgtcc

SEQ ID NO: 415994 - DNA, 25 bp, Mus musculus
gtagcaagcgcgctcctaaatccga

SEQ ID NO: 415995 - DNA, 25 bp, Mus musculus
ccctccgaatagaaacgagatctgg

SEQ ID NO: 415996 - DNA, 25 bp, Mus musculus
gcgctcctaaatccgaggctctttg

SEQ ID NO: 415997 - DNA, 25 bp, Mus musculus
gcgcaccctccgaatagaaacgaga

SEQ ID NO: 415998 - DNA, 25 bp, Mus musculus
aacgagatctgggcaggctagaagc

SEQ ID NO: 415999 - DNA, 25 bp, Mus musculus
ctagaagcggagatgtgttagacca

SEQ ID NO: 416000 - DNA, 25 bp, Mus musculus
tagaccactgcaaaagccgagggtg

SEQ ID NO: 416001 - DNA, 25 bp, Mus musculus
tcctgggagcgccttttctgggcga

SEQ ID NO: 416002 - DNA, 25 bp, Mus musculus
agcgccttttctgggcgaggatcca

SEQ ID NO: 416003 - DNA, 25 bp, Mus musculus
ttttctgggcgaggatccaggctcc

SEQ ID NO: 416004 - DNA, 25 bp, Mus musculus
ccaggctccgcggatgggaagcgat

SEQ ID NO: 416005 - DNA, 25 bp, Mus musculus
cggagatgtgttagaccactgcaaa

SEQ ID NO: 416006 - DNA, 25 bp, Mus musculus
ggccctcaggaatttgcccggcttc

SEQ ID NO: 416007 - DNA, 25 bp, Mus musculus
ccgccgctcctttctcatggaaatg

SEQ ID NO: 416008 - DNA, 25 bp, Mus musculus
tctatacaattaaggcacgcggtga

SEQ ID NO: 416009 - DNA, 25 bp, Mus musculus
tctgcgtgttcacagcggaccttga

SEQ ID NO: 416010 - DNA, 25 bp, Mus musculus
cagcactgccagcttagcgcggagc

SEQ ID NO: 416011 - DNA, 25 bp, Mus musculus
aaggaaaactggctcctcggagttg

SEQ ID NO: 416012 - DNA, 25 bp, Mus musculus
tccgaggggtccctactgcaggaac

SEQ ID NO: 416013 - DNA, 25 bp, Mus musculus
gctctgcacccgtcagaagactgca

SEQ ID NO: 416014 - DNA, 25 bp, Mus musculus
gttctttattttcaccgcactcacg

SEQ ID NO: 416015 - DNA, 25 bp, Mus musculus
catctccgaacatcgaggttcttta

SEQ ID NO: 416016 - DNA, 25 bp, Mus musculus
agagactgcttttcatctccgaaca

SEQ ID NO: 416017 - DNA, 25 bp, Mus musculus
ccagaggcgtaagagaagagagctc

SEQ ID NO: 416018 - DNA, 25 bp, Mus musculus
cagcttctcgccagccagaggcgta

SEQ ID NO: 416019 - DNA, 25 bp, Mus musculus
ttctcatggaaatggcccgggagcc

SEQ ID NO: 416020 - DNA, 25 bp, Mus musculus
caggatatgcgggtggacaccaccc

SEQ ID NO: 416021 - DNA, 25 bp, Mus musculus
gactcgagagtcacgtggggctcct

SEQ ID NO: 416022 - DNA, 25 bp, Mus musculus
agatctcccacactttgatcacagc

SEQ ID NO: 416023 - DNA, 25 bp, Mus musculus
tggcccggcctggtattcagatctt

SEQ ID NO: 416024 - DNA, 25 bp, Mus musculus
gtattcagatcttcgacccggcctc

SEQ ID NO: 416025 - DNA, 25 bp, Mus musculus
cacggcctgctctcgtgaccgtggt

SEQ ID NO: 416026 - DNA, 25 bp, Mus musculus
tctcgtgaccgtggtcccgagacgc

SEQ ID NO: 416027 - DNA, 25 bp, Mus musculus
gtccacgctggtggccgacatgctt

SEQ ID NO: 416028 - DNA, 25 bp, Mus musculus
tggtggccgacatgcttcatgaaca

SEQ ID NO: 416029 - DNA, 25 bp, Mus musculus
atgcttcatgaacagcgcggcgcgg

SEQ ID NO: 416030 - DNA, 25 bp, Mus musculus
gctgggacgaagctacgcgacgtca

SEQ ID NO: 416031 - DNA, 25 bp, Mus musculus
tcctcgcccaggatttcgcgcttgg

SEQ ID NO: 416032 - DNA, 25 bp, Mus musculus
tttgatcacagccaagcccagcgac

SEQ ID NO: 416033 - DNA, 25 bp, Mus musculus
ttcgcgcttgggactcagtctcgcg

SEQ ID NO: 416034 - DNA, 25 bp, Mus musculus
tcgggactacatcactgagaagttc

SEQ ID NO: 416035 - DNA, 25 bp, Mus musculus
tgcctttgtacacgtggacgacttc

SEQ ID NO: 416036 - DNA, 25 bp, Mus musculus
agagtcgttatcgtggcttctttgc

SEQ ID NO: 416037 - DNA, 25 bp, Mus musculus
gcgctaattgtctgctgcccacttt

SEQ ID NO: 416038 - DNA, 25 bp, Mus musculus
ttttgtgccaccagatgcctttgta

SEQ ID NO: 416039 - DNA, 25 bp, Mus musculus
ttgagaactcacagcatcgggacta

SEQ ID NO: 416040 - DNA, 25 bp, Mus musculus
actgagaagttctggcgcaatgccc

SEQ ID NO: 416041 - DNA, 25 bp, Mus musculus
cgggccacctacgaggcttttgtgc

SEQ ID NO: 416042 - DNA, 25 bp, Mus musculus
gcttctttgcttggcgagaccggct

SEQ ID NO: 416043 - DNA, 25 bp, Mus musculus
ggacgacttcagctctgcccgtgaa

SEQ ID NO: 416044 - DNA, 25 bp, Mus musculus
gctctgcccgtgaactggctgtctt

SEQ ID NO: 416045 - DNA, 25 bp, Mus musculus
ctggctgtcttcctcgtcagcatga

SEQ ID NO: 416046 - DNA, 25 bp, Mus musculus
tcgtcagcatgaatgagagtcgtta

SEQ ID NO: 416047 - DNA, 25 bp, Mus musculus
cttctacctggcctttgagaactca

SEQ ID NO: 416048 - DNA, 25 bp, Mus musculus
agcagggacgctactccccaagcaa

SEQ ID NO: 416049 - DNA, 25 bp, Mus musculus
tcccaggaaccacccgaggctggtg

SEQ ID NO: 416050 - DNA, 25 bp, Mus musculus
gtgcaagccgtcatcccaggaacca

SEQ ID NO: 416051 - DNA, 25 bp, Mus musculus
agccaagtgcaagccgtcatcccag

SEQ ID NO: 416052 - DNA, 25 bp, Mus musculus
gctgcagcaaccacagccaagtgca

SEQ ID NO: 416053 - DNA, 25 bp, Mus musculus
cacaaatcggctgcagcaaccacag

SEQ ID NO: 416054 - DNA, 25 bp, Mus musculus
cgggtccggaaagccacgcaggaca

SEQ ID NO: 416055 - DNA, 25 bp, Mus musculus
agcaaacagcgcaccgtgacagctc

SEQ ID NO: 416056 - DNA, 25 bp, Mus musculus
gccggagcaaaagcccatggtattc

SEQ ID NO: 416057 - DNA, 25 bp, Mus musculus
ttgcacgccacaaatcggctgcagc

SEQ ID NO: 416058 - DNA, 25 bp, Mus musculus
aagcccatggtattcacttcgcccg

SEQ ID NO: 416059 - DNA, 25 bp, Mus musculus
ggactcaccagctgcagagcgcaga

SEQ ID NO: 416060 - DNA, 25 bp, Mus musculus
gagcgcagagcgcaagaagcgtgca

SEQ ID NO: 416061 - DNA, 25 bp, Mus musculus
gaaagccacgcaggacacccggact

SEQ ID NO: 416062 - DNA, 25 bp, Mus musculus
ggctctcagatcacccagttcctgg

SEQ ID NO: 416063 - DNA, 25 bp, Mus musculus
gttcctggccctgtaatcctcgatt

SEQ ID NO: 416064 - DNA, 25 bp, Mus musculus
aatcctcgattctgcagccctaggc

SEQ ID NO: 416065 - DNA, 25 bp, Mus musculus
ggttctccagtccttcgacccgtga

SEQ ID NO: 416066 - DNA, 25 bp, Mus musculus
ttcagcctagcggttgcagggacct

SEQ ID NO: 416067 - DNA, 25 bp, Mus musculus
aggcctcccatgagcccttgcaaag

SEQ ID NO: 416068 - DNA, 25 bp, Mus musculus
gcctgtgagctttaccgcccttcag

SEQ ID NO: 416069 - DNA, 25 bp, Mus musculus
tggcgctcagccgaaggtttagaca

SEQ ID NO: 416070 - DNA, 25 bp, Mus musculus
gaggcaaccctgcaaacctggcgct

SEQ ID NO: 416071 - DNA, 25 bp, Mus musculus
aatcccgctggagatagcgcagccc

SEQ ID NO: 416072 - DNA, 25 bp, Mus musculus
gtcgagaccgtggacgccctagaat

SEQ ID NO: 416073 - DNA, 25 bp, Mus musculus
tcggagttcgagttgacagaagcca

SEQ ID NO: 416074 - DNA, 25 bp, Mus musculus
cttgcaaagcgcgacgtagccggaa

SEQ ID NO: 416075 - DNA, 25 bp, Mus musculus
tctgagcgcctagtccagcttggca

SEQ ID NO: 416076 - DNA, 25 bp, Mus musculus
ccgtgatgacaatggagagggtgac

SEQ ID NO: 416077 - DNA, 25 bp, Mus musculus
gatgcacagcgtgaccttctcgccg

SEQ ID NO: 416078 - DNA, 25 bp, Mus musculus
caccgagatgcacagcgtgaccttc

SEQ ID NO: 416079 - DNA, 25 bp, Mus musculus
agcagcaccgagatgcacagcgtga

SEQ ID NO: 416080 - DNA, 25 bp, Mus musculus
gtgagagaaagcagcaccgagatgc

SEQ ID NO: 416081 - DNA, 25 bp, Mus musculus
gaagacggtgagagaaagcagcacc

SEQ ID NO: 416082 - DNA, 25 bp, Mus musculus
atgatctcggtgatgagcagcagga

SEQ ID NO: 416083 - DNA, 25 bp, Mus musculus
accagcgaggtggacgggatgatct

SEQ ID NO: 416084 - DNA, 25 bp, Mus musculus
gtgacgaagatcatggtgaagagca

SEQ ID NO: 416085 - DNA, 25 bp, Mus musculus
acgaagaccgtgatgacaatggaga

SEQ ID NO: 416086 - DNA, 25 bp, Mus musculus
gtgtacattgagcacgaagaccgtg

SEQ ID NO: 416087 - DNA, 25 bp, Mus musculus
agcgtgaccttctcgccgcactccg

SEQ ID NO: 416088 - DNA, 25 bp, Mus musculus
agcggtggtgtacattgagcacgaa

SEQ ID NO: 416089 - DNA, 25 bp, Mus musculus
tactcgccgatgagcgggatgacca

SEQ ID NO: 416090 - DNA, 25 bp, Mus musculus
gccggtccctaagagcagcaggagc

SEQ ID NO: 416091 - DNA, 25 bp, Mus musculus
ctcccggcagtaccgcgcctccgct

SEQ ID NO: 416092 - DNA, 25 bp, Mus musculus
cacagaacgggctctagacgagggc

SEQ ID NO: 416093 - DNA, 25 bp, Mus musculus
tggctcacagaacgggctctagacg

SEQ ID NO: 416094 - DNA, 25 bp, Mus musculus
ccggagtcctaggtgccaggacccg

SEQ ID NO: 416095 - DNA, 25 bp, Mus musculus
cgatctccatggctcacagaacggg

SEQ ID NO: 416096 - DNA, 25 bp, Mus musculus
agacccgcgcgcacccaacttcatg

SEQ ID NO: 416097 - DNA, 25 bp, Mus musculus
cccaaaccgggctccgcagctcgtc

SEQ ID NO: 416098 - DNA, 25 bp, Mus musculus
ttaccaggcaagaggccggtcccta

SEQ ID NO: 416099 - DNA, 25 bp, Mus musculus
ttcgaaacttaccaggcaagaggcc

SEQ ID NO: 416100 - DNA, 25 bp, Mus musculus
gttgctcgcacccgcggcttggaac

SEQ ID NO: 416101 - DNA, 25 bp, Mus musculus
ttcgcgtttcgaaacttaccaggca

SEQ ID NO: 416102 - DNA, 25 bp, Mus musculus
tcctaggtgccaggacccgggagaa

SEQ ID NO: 416103 - DNA, 25 bp, Mus musculus
tccatggctcacagaacgggctcta

SEQ ID NO: 416104 - DNA, 25 bp, Mus musculus
cgttgcgcgacttctgcaccatggt

SEQ ID NO: 416105 - DNA, 25 bp, Mus musculus
tgctcaaaacgctgccgcgcttggg

SEQ ID NO: 416106 - DNA, 25 bp, Mus musculus
cgagactgcaatgccacgacccaaa

SEQ ID NO: 416107 - DNA, 25 bp, Mus musculus
gggtacacgccaccgttgcgcgact

SEQ ID NO: 416108 - DNA, 25 bp, Mus musculus
agcccgcgatgagtagcgcgccgtc

SEQ ID NO: 416109 - DNA, 25 bp, Mus musculus
cgtccgcggcttgctcaaaacgctg

SEQ ID NO: 416110 - DNA, 25 bp, Mus musculus
cttgcggtagaaggcgttgcgcttc

SEQ ID NO: 416111 - DNA, 25 bp, Mus musculus
aggaaattctgcagcttgcggtaga

SEQ ID NO: 416112 - DNA, 25 bp, Mus musculus
cacgttgtagaggaaattctgcagc

SEQ ID NO: 416113 - DNA, 25 bp, Mus musculus
gccgctctagcacgttgtagaggaa

SEQ ID NO: 416114 - DNA, 25 bp, Mus musculus
taggcgtggtagatgaacgcccagc

SEQ ID NO: 416115 - DNA, 25 bp, Mus musculus
gggccacttacacgtaggcgtggta

SEQ ID NO: 416116 - DNA, 25 bp, Mus musculus
cgctcaccacatcgcgggccactta

SEQ ID NO: 416117 - DNA, 25 bp, Mus musculus
cgaagcccaccttgagcttcttttc

SEQ ID NO: 416118 - DNA, 25 bp, Mus musculus
acgttcttgatgacgcccacggcca

SEQ ID NO: 416119 - DNA, 25 bp, Mus musculus
acttgcccgctttctgagccttctg

SEQ ID NO: 416120 - DNA, 25 bp, Mus musculus
acagtctgccgcatgtcgcgcacgg

SEQ ID NO: 416121 - DNA, 25 bp, Mus musculus
ctgtggggagagatgcgtaaactac

SEQ ID NO: 416122 - DNA, 25 bp, Mus musculus
gatgcgtaaactaccgggacgccca

SEQ ID NO: 416123 - DNA, 25 bp, Mus musculus
taaactaccgggacgcccaggatgc

SEQ ID NO: 416124 - DNA, 25 bp, Mus musculus
taccgggacgcccaggatgcagtat

SEQ ID NO: 416125 - DNA, 25 bp, Mus musculus
acgcccaggatgcagtatgcaggtg

SEQ ID NO: 416126 - DNA, 25 bp, Mus musculus
cagtatgcaggtgcattgggcgacc

SEQ ID NO: 416127 - DNA, 25 bp, Mus musculus
gctcttcttctccacgttcttgatg

SEQ ID NO: 416128 - DNA, 25 bp, Mus musculus
gcggacttggtgaccttgcctgcgc

SEQ ID NO: 416129 - DNA, 25 bp, Mus musculus
ccttctgtgcggacttggtgacctt

SEQ ID NO: 416130 - DNA, 25 bp, Mus musculus
tccacgttcttgatgacgcccacgg

SEQ ID NO: 416131 - DNA, 25 bp, Mus musculus
ttcacttgcccgctttctgagcctt

SEQ ID NO: 416132 - DNA, 25 bp, Mus musculus
gacgaacgcctgacaaaggcacttt

SEQ ID NO: 416133 - DNA, 25 bp, Mus musculus
tgcccacaggagaacggcagtgcca

SEQ ID NO: 416134 - DNA, 25 bp, Mus musculus
agaaggttctttgcttgcgtgcccg

SEQ ID NO: 416135 - DNA, 25 bp, Mus musculus
tgttgcgagccatcaaagaaggttc

SEQ ID NO: 416136 - DNA, 25 bp, Mus musculus
cgtgcccgcactcacaatcagattg

SEQ ID NO: 416137 - DNA, 25 bp, Mus musculus
gaactgtagataactgaggactgga

SEQ ID NO: 416138 - DNA, 25 bp, Mus musculus
actttggagccggacacggttatgg

SEQ ID NO: 416139 - DNA, 25 bp, Mus musculus
actcagagaggtgcgaaagacgaac

SEQ ID NO: 416140 - DNA, 25 bp, Mus musculus
cagcttcaaagagagagatttcctc

SEQ ID NO: 416141 - DNA, 25 bp, Mus musculus
tgtgtaggtgaagcccgccagcttc

SEQ ID NO: 416142 - DNA, 25 bp, Mus musculus
aaaccagcatcacggcgcccaaaag

SEQ ID NO: 416143 - DNA, 25 bp, Mus musculus
gggcccagtcatcacgaaaccagca

SEQ ID NO: 416144 - DNA, 25 bp, Mus musculus
cgctccatcggtgcagactcagaga

SEQ ID NO: 416145 - DNA, 25 bp, Mus musculus
gcaagctagcctggttccgtgccaa

SEQ ID NO: 416146 - DNA, 25 bp, Mus musculus
cgaggactcagtcagaaggactggt

SEQ ID NO: 416147 - DNA, 25 bp, Mus musculus
cgtaatgaggatccgagaggacgca

SEQ ID NO: 416148 - DNA, 25 bp, Mus musculus
ctggcagatgggatgcgaaagatgc

SEQ ID NO: 416149 - DNA, 25 bp, Mus musculus
cctgcagtacggcaatgcggtaccg

SEQ ID NO: 416150 - DNA, 25 bp, Mus musculus
ccggcggttttatctctccaggagg

SEQ ID NO: 416151 - DNA, 25 bp, Mus musculus
acccagagccgaggactcagtcaga

SEQ ID NO: 416152 - DNA, 25 bp, Mus musculus
gggatgtgcgtccttacccagagcc

SEQ ID NO: 416153 - DNA, 25 bp, Mus musculus
ccgagaggacgcagctgcaatgatg

SEQ ID NO: 416154 - DNA, 25 bp, Mus musculus
cagctgcaatgatgcaccggagcga

SEQ ID NO: 416155 - DNA, 25 bp, Mus musculus
gaaccagtgagcgagaacgcagacc

SEQ ID NO: 416156 - DNA, 25 bp, Mus musculus
cgcagaccaggagagaaaaacaggc

SEQ ID NO: 416157 - DNA, 25 bp, Mus musculus
aaaacaggcaaaagggcggtgcagc

SEQ ID NO: 416158 - DNA, 25 bp, Mus musculus
agcgagaacgcagaccaggagagaa

SEQ ID NO: 416159 - DNA, 25 bp, Mus musculus
tccacctattgacggtgccggcgca

SEQ ID NO: 416160 - DNA, 25 bp, Mus musculus
cggaagggcagagttcacgtcctaa

SEQ ID NO: 416161 - DNA, 25 bp, Mus musculus
cgcctcccagtggtgcgtcttttgc

SEQ ID NO: 416162 - DNA, 25 bp, Mus musculus
ccgggtaagtgcagaaccagccagc

SEQ ID NO: 416163 - DNA, 25 bp, Mus musculus
cccatgactactatcggcgtaagta

SEQ ID NO: 416164 - DNA, 25 bp, Mus musculus
cgctcgtggctacccatgactacta

SEQ ID NO: 416165 - DNA, 25 bp, Mus musculus
tcggtcctgaagcatggcagccatc

SEQ ID NO: 416166 - DNA, 25 bp, Mus musculus
gtgaccagggcccacattctgctct

SEQ ID NO: 416167 - DNA, 25 bp, Mus musculus
gcttggaaacctggcactgtcagga

SEQ ID NO: 416168 - DNA, 25 bp, Mus musculus
cgaagcctgcaaggaaggggttctc

SEQ ID NO: 416169 - DNA, 25 bp, Mus musculus
cctggtggcctaaaaacgaagcctg

SEQ ID NO: 416170 - DNA, 25 bp, Mus musculus
atctttgcaaatgggctccgcggcc

SEQ ID NO: 416171 - DNA, 25 bp, Mus musculus
ggtgtttcgtgggttatctttgcaa

SEQ ID NO: 416172 - DNA, 25 bp, Mus musculus
aagctactaagtacgcgcgtgcgca

SEQ ID NO: 416173 - DNA, 25 bp, Mus musculus
cttttgcggtgcaggaaagctacta

SEQ ID NO: 416174 - DNA, 25 bp, Mus musculus
gcccgccagcctgacgccgccgcgc

SEQ ID NO: 416175 - DNA, 25 bp, Mus musculus
tcttgtgcgcctgcgcgtgtggtct

SEQ ID NO: 416176 - DNA, 25 bp, Mus musculus
actcttgtgcgcctgcgcgtgtggt

SEQ ID NO: 416177 - DNA, 25 bp, Mus musculus
taggactcttgtgcgcctgcgcgtg

SEQ ID NO: 416178 - DNA, 25 bp, Mus musculus
cccgtaggactcttgtgcgcctgcg

SEQ ID NO: 416179 - DNA, 25 bp, Mus musculus
tggtgagatactgcccccgtaggac

SEQ ID NO: 416180 - DNA, 25 bp, Mus musculus
cgaacagtgtggtgagatactgccc

SEQ ID NO: 416181 - DNA, 25 bp, Mus musculus
agcgaacagtgtggtgagatactgc

SEQ ID NO: 416182 - DNA, 25 bp, Mus musculus
cgtaacgtcctgacgctccgcaggg

SEQ ID NO: 416183 - DNA, 25 bp, Mus musculus
gaagcgagccgccttcgcgagccct

SEQ ID NO: 416184 - DNA, 25 bp, Mus musculus
cctgcctctggcgaggccaagatgg

SEQ ID NO: 416185 - DNA, 25 bp, Mus musculus
gaccctgcctctggcgaggccaaga

SEQ ID NO: 416186 - DNA, 25 bp, Mus musculus
gcctcggctttcacggacgacccga

SEQ ID NO: 416187 - DNA, 25 bp, Mus musculus
gtaacgtcctgacgctccgcaggga

SEQ ID NO: 416188 - DNA, 25 bp, Mus musculus
cttaagtctaggaagcgaccagaga

SEQ ID NO: 416189 - DNA, 25 bp, Mus musculus
agcacgggcggaatcgcatcccagc

SEQ ID NO: 416190 - DNA, 25 bp, Mus musculus
ccctcacagtgcctgacggaacaag

SEQ ID NO: 416191 - DNA, 25 bp, Mus musculus
cacccgtacctgctcagatcttgga

SEQ ID NO: 416192 - DNA, 25 bp, Mus musculus
gtccgcctctcctgctagttttcaa

SEQ ID NO: 416193 - DNA, 25 bp, Mus musculus
gaaccagcagctgaagccacttccg

SEQ ID NO: 416194 - DNA, 25 bp, Mus musculus
ttcaaatgtgtagcctcgcggatcc

SEQ ID NO: 416195 - DNA, 25 bp, Mus musculus
ccgcctcttctgttaaaatccctga

SEQ ID NO: 416196 - DNA, 25 bp, Mus musculus
cgatgccatcgctgaccacgtgcta

SEQ ID NO: 416197 - DNA, 25 bp, Mus musculus
tgggccactcccacttaatgtcatc

SEQ ID NO: 416198 - DNA, 25 bp, Mus musculus
atgcaccatcaattcggagtcctga

SEQ ID NO: 416199 - DNA, 25 bp, Mus musculus
ttcggagtcctgaaaagcccgtggc

SEQ ID NO: 416200 - DNA, 25 bp, Mus musculus
aggtacttccggcagcttcggctct

SEQ ID NO: 416201 - DNA, 25 bp, Mus musculus
aacgcggccggcgacttaagtctag

SEQ ID NO: 416202 - DNA, 25 bp, Mus musculus
aacgtgacgctgaagcgccggagcc

SEQ ID NO: 416203 - DNA, 25 bp, Mus musculus
ctgctctggaagaacgtgacgctga

SEQ ID NO: 416204 - DNA, 25 bp, Mus musculus
cgcgacgagtctctgtagctgcggc

SEQ ID NO: 416205 - DNA, 25 bp, Mus musculus
acgagtctctgtagctgcggccgcc

SEQ ID NO: 416206 - DNA, 25 bp, Mus musculus
cctgcgagcagcaggtcctggactc

SEQ ID NO: 416207 - DNA, 25 bp, Mus musculus
agcaggtcctggactctcgagcgcc

SEQ ID NO: 416208 - DNA, 25 bp, Mus musculus
catgggcttcctgcaccagctgcag

SEQ ID NO: 416209 - DNA, 25 bp, Mus musculus
caatttgccggtgcgctctccgcgt

SEQ ID NO: 416210 - DNA, 25 bp, Mus musculus
tctccgcgtgcacgtgcagtgtcca

SEQ ID NO: 416211 - DNA, 25 bp, Mus musculus
cacgtgcagtgtccaggcgcgcgca

SEQ ID NO: 416212 - DNA, 25 bp, Mus musculus
agggcgccaccggagaccctgttcg

SEQ ID NO: 416213 - DNA, 25 bp, Mus musculus
gctgacactcgcagcgcacggctga

SEQ ID NO: 416214 - DNA, 25 bp, Mus musculus
actcgcagcgcacggctgagtcacg

SEQ ID NO: 416215 - DNA, 25 bp, Mus musculus
tgcagctgctgctctggaagaacgt

SEQ ID NO: 416216 - DNA, 25 bp, Mus musculus
tggagtatcacaacgctatggtagt

SEQ ID NO: 416217 - DNA, 25 bp, Mus musculus
aggcggaggatggttctgcgtgcgt

SEQ ID NO: 416218 - DNA, 25 bp, Mus musculus
agtgggcgccgaagaggcggaggat

SEQ ID NO: 416219 - DNA, 25 bp, Mus musculus
caacgctatggtagtgggcgccgaa

SEQ ID NO: 416220 - DNA, 25 bp, Mus musculus
gtatcacaacgctatggtagtgggc

SEQ ID NO: 416221 - DNA, 25 bp, Mus musculus
gctggagtatcacaacgctatggta

SEQ ID NO: 416222 - DNA, 25 bp, Mus musculus
acgctggagtatcacaacgctatgg

SEQ ID NO: 416223 - DNA, 25 bp, Mus musculus
cacgctggagtatcacaacgctatg

SEQ ID NO: 416224 - DNA, 25 bp, Mus musculus
ggcacgctggagtatcacaacgcta

SEQ ID NO: 416225 - DNA, 25 bp, Mus musculus
gggcacgctggagtatcacaacgct

SEQ ID NO: 416226 - DNA, 25 bp, Mus musculus
cttggggcacgctggagtatcacaa

SEQ ID NO: 416227 - DNA, 25 bp, Mus musculus
actacagcgcttggggcacgctgga

SEQ ID NO: 416228 - DNA, 25 bp, Mus musculus
cctactacagcgcttggggcacgct

SEQ ID NO: 416229 - DNA, 25 bp, Mus musculus
tcacaacgctatggtagtgggcgcc

SEQ ID NO: 416230 - DNA, 25 bp, Mus musculus
ggcacagtaaccagggctgcagctg

SEQ ID NO: 416231 - DNA, 25 bp, Mus musculus
acttagcgactttcgggcgcgctga

SEQ ID NO: 416232 - DNA, 25 bp, Mus musculus
ggaaagcgcgtctcccaaacttagc

SEQ ID NO: 416233 - DNA, 25 bp, Mus musculus
ggaaccgtcgcggaaagcgcgtctc

SEQ ID NO: 416234 - DNA, 25 bp, Mus musculus
acgagactgggtcacgactgtgccc

SEQ ID NO: 416235 - DNA, 25 bp, Mus musculus
actgtccctggggacgcacgagact

SEQ ID NO: 416236 - DNA, 25 bp, Mus musculus
ccgcgatgtctgtgcactgtccctg

SEQ ID NO: 416237 - DNA, 25 bp, Mus musculus
aagttcaccgcagcagggtcgggta

SEQ ID NO: 416238 - DNA, 25 bp, Mus musculus
tgggctgggcaagttcaccgcagca

SEQ ID NO: 416239 - DNA, 25 bp, Mus musculus
caaccagagaccacctgatgggaga

SEQ ID NO: 416240 - DNA, 25 bp, Mus musculus
cccacgagagtctcacaaccagaga

SEQ ID NO: 416241 - DNA, 25 bp, Mus musculus
cctcccatgggcttgcgagtggcaa

SEQ ID NO: 416242 - DNA, 25 bp, Mus musculus
atgagccggcgcagcttacctgtga

SEQ ID NO: 416243 - DNA, 25 bp, Mus musculus
cgctgagcggagaaaacgcgctcta

SEQ ID NO: 416244 - DNA, 25 bp, Mus musculus
ccgctggctacgtgccagcaacttg

SEQ ID NO: 416245 - DNA, 25 bp, Mus musculus
tccttggttcgtgggccaaggtctg

SEQ ID NO: 416246 - DNA, 25 bp, Mus musculus
gcaccgtggtaacccgctggctacg

SEQ ID NO: 416247 - DNA, 25 bp, Mus musculus
ccagcaacttggctcaagaaactgc

SEQ ID NO: 416248 - DNA, 25 bp, Mus musculus
tgcattatatgcacgctaccgcgtt

SEQ ID NO: 416249 - DNA, 25 bp, Mus musculus
cacgctaccgcgttgatgatgagtg

SEQ ID NO: 416250 - DNA, 25 bp, Mus musculus
ccgcgttgatgatgagtggtgctta

SEQ ID NO: 416251 - DNA, 25 bp, Mus musculus
tgatgatgagtggtgcttagcaaca

SEQ ID NO: 416252 - DNA, 25 bp, Mus musculus
ggtgcttagcaacacttcgttctta

SEQ ID NO: 416253 - DNA, 25 bp, Mus musculus
gcaacacttcgttcttatcgtgaga

SEQ ID NO: 416254 - DNA, 25 bp, Mus musculus
cgttcttatcgtgagagatgccaga

SEQ ID NO: 416255 - DNA, 25 bp, Mus musculus
tatcgtgagagatgccagaaggagc

SEQ ID NO: 416256 - DNA, 25 bp, Mus musculus
ttggctcaagaaactgcattatatg

SEQ ID NO: 416257 - DNA, 25 bp, Mus musculus
atgccagaaggagctggacgatgcc

SEQ ID NO: 416258 - DNA, 25 bp, Mus musculus
ctgccagcttgcagtcctcggggct

SEQ ID NO: 416259 - DNA, 25 bp, Mus musculus
gattacgtaagcgactgcggcccta

SEQ ID NO: 416260 - DNA, 25 bp, Mus musculus
gactgcggccctacagttccactgg

SEQ ID NO: 416261 - DNA, 25 bp, Mus musculus
agttccactggctcgtgtgtacgaa

SEQ ID NO: 416262 - DNA, 25 bp, Mus musculus
ctcgtgtgtacgaagctgccagctt

SEQ ID NO: 416263 - DNA, 25 bp, Mus musculus
cttcggagcactgcgaagcggcgtt

SEQ ID NO: 416264 - DNA, 25 bp, Mus musculus
ggctcctgtaggacctgcgatccca

SEQ ID NO: 416265 - DNA, 25 bp, Mus musculus
agctgccgcctgaacatggactctg

SEQ ID NO: 416266 - DNA, 25 bp, Mus musculus
tggactctgctagccaaggtacccg

SEQ ID NO: 416267 - DNA, 25 bp, Mus musculus
cggcgcgtcgctgattacgtaagcg

SEQ ID NO: 416268 - DNA, 25 bp, Mus musculus
aaggtacccgcaccgtggatgggca

SEQ ID NO: 416269 - DNA, 25 bp, Mus musculus
atccgctgtttctcttcggccaaga

SEQ ID NO: 416270 - DNA, 25 bp, Mus musculus
tcttcggccaagaggcccttgacct

SEQ ID NO: 416271 - DNA, 25 bp, Mus musculus
aaggctcccgatggtcttgctgtgt

SEQ ID NO: 416272 - DNA, 25 bp, Mus musculus
cagcaggaggtgaaagctgcccgca

SEQ ID NO: 416273 - DNA, 25 bp, Mus musculus
gtgccacttgcctgccttccagagg

SEQ ID NO: 416274 - DNA, 25 bp, Mus musculus
aacccttcccggtgatcgtcaactg

SEQ ID NO: 416275 - DNA, 25 bp, Mus musculus
ttccagaggcgaacccgcaagccta

SEQ ID NO: 416276 - DNA, 25 bp, Mus musculus
ccgggctgtagcttccggcttagta

SEQ ID NO: 416277 - DNA, 25 bp, Mus musculus
gagacgaggctttccgggccaactc

SEQ ID NO: 416278 - DNA, 25 bp, Mus musculus
tctccagtggctctcaaattaggtg

SEQ ID NO: 416279 - DNA, 25 bp, Mus musculus
gtgccgacaggtgagctcactctcc

SEQ ID NO: 416280 - DNA, 25 bp, Mus musculus
cccgggatcctcaggccgagcagta

SEQ ID NO: 416281 - DNA, 25 bp, Mus musculus
acctgccagaacacacgtctttttc

SEQ ID NO: 416282 - DNA, 25 bp, Mus musculus
ttctaggcgcttgcgcagccagctc

SEQ ID NO: 416283 - DNA, 25 bp, Mus musculus
ggcgctgccacattggctccgacta

SEQ ID NO: 416284 - DNA, 25 bp, Mus musculus
gaccgagttctaccggagctccgga

SEQ ID NO: 416285 - DNA, 25 bp, Mus musculus
tgatcgtcaactggggcgcaacctt

SEQ ID NO: 416286 - DNA, 25 bp, Mus musculus
aaccgcctggggtctgcaagtccag

SEQ ID NO: 416287 - DNA, 25 bp, Mus musculus
tctgtgtgcatggtgactttgtgac

SEQ ID NO: 416288 - DNA, 25 bp, Mus musculus
aagcgcgctcctggcatgtatgtga

SEQ ID NO: 416289 - DNA, 25 bp, Mus musculus
cattcataaaaacacggaggagttg

SEQ ID NO: 416290 - DNA, 25 bp, Mus musculus
gctctcatttgcataccacattttc

SEQ ID NO: 416291 - DNA, 25 bp, Mus musculus
gggctccgccatttcgttttcttga

SEQ ID NO: 416292 - DNA, 25 bp, Mus musculus
gactttgtgactcctggcactgctg

SEQ ID NO: 416293 - DNA, 25 bp, Mus musculus
tctgcaagtccaggtcgcagcccgg

SEQ ID NO: 416294 - DNA, 25 bp, Mus musculus
tatgcgcgaggctcttgacttggct

SEQ ID NO: 416295 - DNA, 25 bp, Mus musculus
cacacccggacgagtaagttagccg

SEQ ID NO: 416296 - DNA, 25 bp, Mus musculus
ggacaggcgtctaggtgaacaagaa

SEQ ID NO: 416297 - DNA, 25 bp, Mus musculus
ggagcggaagctctgacgccctcca

SEQ ID NO: 416298 - DNA, 25 bp, Mus musculus
cgcaaatgacctcggggcggtcctc

SEQ ID NO: 416299 - DNA, 25 bp, Mus musculus
caccaccaaatcaggagatgtcgga

SEQ ID NO: 416300 - DNA, 25 bp, Mus musculus
ggcaggcacgctgcggactacaatc

SEQ ID NO: 416301 - DNA, 25 bp, Mus musculus
ccgtcccggctctaggaagagatgc

SEQ ID NO: 416302 - DNA, 25 bp, Mus musculus
ctctaggaagagatgcaagccgtgc

SEQ ID NO: 416303 - DNA, 25 bp, Mus musculus
gaagagatgcaagccgtgctccgac

SEQ ID NO: 416304 - DNA, 25 bp, Mus musculus
cccggctctaggaagagatgcaagc

SEQ ID NO: 416305 - DNA, 25 bp, Mus musculus
cctgccttattcaggcccgcgccta

SEQ ID NO: 416306 - DNA, 25 bp, Mus musculus
ccgcgcctaccggtcctcgcacgcc

SEQ ID NO: 416307 - DNA, 25 bp, Mus musculus
tcgcacgccgtttcattctgctcgg

SEQ ID NO: 416308 - DNA, 25 bp, Mus musculus
ccgtttcattctgctcggcctggcg

SEQ ID NO: 416309 - DNA, 25 bp, Mus musculus
gccaggcacgtctggggccacagca

SEQ ID NO: 416310 - DNA, 25 bp, Mus musculus
acgtctggggccacagcagactgca

SEQ ID NO: 416311 - DNA, 25 bp, Mus musculus
ccacagcagactgcaggggcgaagg

SEQ ID NO: 416312 - DNA, 25 bp, Mus musculus
ccatggcgtcccgaacctggcggag

SEQ ID NO: 416313 - DNA, 25 bp, Mus musculus
gagccgtcccggctctaggaagaga

SEQ ID NO: 416314 - DNA, 25 bp, Mus musculus
aatggcgactttttctggaggagga

SEQ ID NO: 416315 - DNA, 25 bp, Mus musculus
gcctccagggccgagcgatcggtca

SEQ ID NO: 416316 - DNA, 25 bp, Mus musculus
tgccgcggacgcaggccactccgcc

SEQ ID NO: 416317 - DNA, 25 bp, Mus musculus
cgagcgcagccaagaggcgcacctg

SEQ ID NO: 416318 - DNA, 25 bp, Mus musculus
ccaagaggcgcacctggaggcccgt

SEQ ID NO: 416319 - DNA, 25 bp, Mus musculus
aggcccgtggccacccacctgtcac

SEQ ID NO: 416320 - DNA, 25 bp, Mus musculus
acctgtcacctgaggccggacgcgg

SEQ ID NO: 416321 - DNA, 25 bp, Mus musculus
ggcagtgaaccaaaatggcgacttt

SEQ ID NO: 416322 - DNA, 25 bp, Mus musculus
cgcttacctgcagcgcccaaggggt

SEQ ID NO: 416323 - DNA, 25 bp, Mus musculus
cctcctacctttgacagttttactg

SEQ ID NO: 416324 - DNA, 25 bp, Mus musculus
ctacctttgacagttttactgcggg

SEQ ID NO: 416325 - DNA, 25 bp, Mus musculus
ccgtgctgcgcacatgcgcgctccc

SEQ ID NO: 416326 - DNA, 25 bp, Mus musculus
aactctcgcggtattcacgcggccg

SEQ ID NO: 416327 - DNA, 25 bp, Mus musculus
ggggcgaactctcgcggtattcacg

SEQ ID NO: 416328 - DNA, 25 bp, Mus musculus
ggctcagcttggaccgcagctcggt

SEQ ID NO: 416329 - DNA, 25 bp, Mus musculus
tgcttaggatgtccgccagagcgaa

SEQ ID NO: 416330 - DNA, 25 bp, Mus musculus
gctgcgtatgcttaggatgtccgcc

SEQ ID NO: 416331 - DNA, 25 bp, Mus musculus
ccataacgctggacaaaggcccttg

SEQ ID NO: 416332 - DNA, 25 bp, Mus musculus
tggactctagtaaaaagacttcctc

SEQ ID NO: 416333 - DNA, 25 bp, Mus musculus
agcccgctgctcacgatattcctgt

SEQ ID NO: 416334 - DNA, 25 bp, Mus musculus
tgggtccatcccagctcaccgtcca

SEQ ID NO: 416335 - DNA, 25 bp, Mus musculus
cttggaccgcagctcggtgaacatg

SEQ ID NO: 416336 - DNA, 25 bp, Mus musculus
tccgccagagcgaaaggcgtccttg

SEQ ID NO: 416337 - DNA, 25 bp, Mus musculus
gcagctcggtgaacatggagcccgc

SEQ ID NO: 416338 - DNA, 25 bp, Mus musculus
tcgcggagcaccaggcagccagtgt

SEQ ID NO: 416339 - DNA, 25 bp, Mus musculus
gagtctgcgcggcaaagcacctgcc

SEQ ID NO: 416340 - DNA, 25 bp, Mus musculus
ggacaaaggcccttggactctagta

SEQ ID NO: 416341 - DNA, 25 bp, Mus musculus
tcacgatattcctgtgcctgggtcc

SEQ ID NO: 416342 - DNA, 25 bp, Mus musculus
cgacacccggaggactctgagtctt

SEQ ID NO: 416343 - DNA, 25 bp, Mus musculus
tgcaccggaacgctcctgaacagga

SEQ ID NO: 416344 - DNA, 25 bp, Mus musculus
aagtggcttcgcagccttgcttgca

SEQ ID NO: 416345 - DNA, 25 bp, Mus musculus
gcgctggccggaaacactttgcaaa

SEQ ID NO: 416346 - DNA, 25 bp, Mus musculus
tggcgcgataccgaataccgtcacg

SEQ ID NO: 416347 - DNA, 25 bp, Mus musculus
gaacccacgtccttgtggcgcgata

SEQ ID NO: 416348 - DNA, 25 bp, Mus musculus
aggactaatgcgttccggctccgcg

SEQ ID NO: 416349 - DNA, 25 bp, Mus musculus
gggctttccgtgacccagctctcta

SEQ ID NO: 416350 - DNA, 25 bp, Mus musculus
tgacttccgcccgaagctctaggtg

SEQ ID NO: 416351 - DNA, 25 bp, Mus musculus
aagaagccgttcctgggcatgcctg

SEQ ID NO: 416352 - DNA, 25 bp, Mus musculus
ctgcttttctgtgtttcggtcaata

SEQ ID NO: 416353 - DNA, 25 bp, Mus musculus
ggccgcatacggttcagtacagtaa

SEQ ID NO: 416354 - DNA, 25 bp, Mus musculus
agtgcctgcatctcttactgctgcg

SEQ ID NO: 416355 - DNA, 25 bp, Mus musculus
ccgcgtcaaggctggcatgaaaatc

SEQ ID NO: 416356 - DNA, 25 bp, Mus musculus
accttgcgcgcctgttttttgcggc

SEQ ID NO: 416357 - DNA, 25 bp, Mus musculus
gagctgaccctgacgctgcagcgaa

SEQ ID NO: 416358 - DNA, 25 bp, Mus musculus
atggtcgcgcaagtgctgcacacgc

SEQ ID NO: 416359 - DNA, 25 bp, Mus musculus
attccaggggcccatgcacagtcgc

SEQ ID NO: 416360 - DNA, 25 bp, Mus musculus
gccaaagccatagcgccctgattcg

SEQ ID NO: 416361 - DNA, 25 bp, Mus musculus
ccttccacgctttgcctgtaggcga

SEQ ID NO: 416362 - DNA, 25 bp, Mus musculus
agtgtcgggcgcacgactagccaaa

SEQ ID NO: 416363 - DNA, 25 bp, Mus musculus
actagccaaaccgtcgtgcgccttg

SEQ ID NO: 416364 - DNA, 25 bp, Mus musculus
gcgaccagccataaaatcccgaatc

SEQ ID NO: 416365 - DNA, 25 bp, Mus musculus
ttcgaggctctcacccagcatcttg

SEQ ID NO: 416366 - DNA, 25 bp, Mus musculus
gcatcttgctcagtactgcgttgtg

SEQ ID NO: 416367 - DNA, 25 bp, Mus musculus
tccggattttgttgcgccagtcgct

SEQ ID NO: 416368 - DNA, 25 bp, Mus musculus
cgaatgcgcaactcgtcggcagttt

SEQ ID NO: 416369 - DNA, 25 bp, Mus musculus
cgcggcgtgaaacatggcatagacc

SEQ ID NO: 416370 - DNA, 25 bp, Mus musculus
cgttacgttttccttctaaagcatg

SEQ ID NO: 416371 - DNA, 25 bp, Mus musculus
gcattggtttcagaatttgtcacca

SEQ ID NO: 416372 - DNA, 25 bp, Mus musculus
cagaatttgtcaccatgcctagaga

SEQ ID NO: 416373 - DNA, 25 bp, Mus musculus
accatgcctagagactgtggacctc

SEQ ID NO: 416374 - DNA, 25 bp, Mus musculus
ctagagactgtggacctctgaagga

SEQ ID NO: 416375 - DNA, 25 bp, Mus musculus
ctctgaaggaagtcctgtgaacaca

SEQ ID NO: 416376 - DNA, 25 bp, Mus musculus
tgtgaacacagaccagagggcctga

SEQ ID NO: 416377 - DNA, 25 bp, Mus musculus
gtgggatgttgactactgatgagca

SEQ ID NO: 416378 - DNA, 25 bp, Mus musculus
ctgatgagcagtgcacaggaaatta

SEQ ID NO: 416379 - DNA, 25 bp, Mus musculus
gaccgaggagaagagttagcgttac

SEQ ID NO: 416380 - DNA, 25 bp, Mus musculus
ttccttctaaagcatgaacatggtt

SEQ ID NO: 416381 - DNA, 25 bp, Mus musculus
ggttaatattccttagcctacacta

SEQ ID NO: 416382 - DNA, 25 bp, Mus musculus
ctacactaaagatagccaggcagca

SEQ ID NO: 416383 - DNA, 25 bp, Mus musculus
acaggaaattagtggagaccgagga

SEQ ID NO: 416384 - DNA, 25 bp, Mus musculus
acaatctaaggtgttcgctcggcgg

SEQ ID NO: 416385 - DNA, 25 bp, Mus musculus
tcaggcgagaagcaggtgctccaga

SEQ ID NO: 416386 - DNA, 25 bp, Mus musculus
tgtcaggcaccgtgcccgctatgct

SEQ ID NO: 416387 - DNA, 25 bp, Mus musculus
ccactcactagaggttgaagtcgtc

SEQ ID NO: 416388 - DNA, 25 bp, Mus musculus
cgctcgcagtagcacaccaggcggg

SEQ ID NO: 416389 - DNA, 25 bp, Mus musculus
cgaacccggcggcagaatacaaagc

SEQ ID NO: 416390 - DNA, 25 bp, Mus musculus
cgacaacaacggaggagccatgaca

SEQ ID NO: 416391 - DNA, 25 bp, Mus musculus
agccatgacagcagggcggtctcgc

SEQ ID NO: 416392 - DNA, 25 bp, Mus musculus
cgccgcaggagccaagttagatgtg

SEQ ID NO: 416393 - DNA, 25 bp, Mus musculus
ccaggcattaagtaagaggctgact

SEQ ID NO: 416394 - DNA, 25 bp, Mus musculus
ctcggtgactcacaatctaaggtgt

SEQ ID NO: 416395 - DNA, 25 bp, Mus musculus
tgggcggtactcaaggttgacattg

SEQ ID NO: 416396 - DNA, 25 bp, Mus musculus
cattgtttccgggtaccaggcatta

SEQ ID NO: 416397 - DNA, 25 bp, Mus musculus
cctgcgcagaagtacaaactcggtg

SEQ ID NO: 416398 - DNA, 25 bp, Mus musculus
gtccggcggagatacctgcggaact

SEQ ID NO: 416399 - DNA, 25 bp, Mus musculus
tgcggaactaccttttccagcgggc

SEQ ID NO: 416400 - DNA, 25 bp, Mus musculus
aaatggtgaccaggaagaacgcggt

SEQ ID NO: 416401 - DNA, 25 bp, Mus musculus
gagaccgtctgagcctaccctcggg

SEQ ID NO: 416402 - DNA, 25 bp, Mus musculus
ccgccaccgaggtagtgatgggcaa

SEQ ID NO: 416403 - DNA, 25 bp, Mus musculus
caaggaggaagagattgctcgtatc

SEQ ID NO: 416404 - DNA, 25 bp, Mus musculus
accctcgggcagagtgatacctagc

SEQ ID NO: 416405 - DNA, 25 bp, Mus musculus
cccggaggctggacaaaatggtgac

SEQ ID NO: 416406 - DNA, 25 bp, Mus musculus
ctaccttttccagcgggcaatcagg

SEQ ID NO: 416407 - DNA, 25 bp, Mus musculus
gatacctagcccagtcagtcgagac

SEQ ID NO: 416408 - DNA, 25 bp, Mus musculus
tgtcctgggactgccgcttcgcaat

SEQ ID NO: 416409 - DNA, 25 bp, Mus musculus
cttcgcaatggacgccgcgttgacc

SEQ ID NO: 416410 - DNA, 25 bp, Mus musculus
cgcgttgaccgaaagctaccctctg

SEQ ID NO: 416411 - DNA, 25 bp, Mus musculus
agattgctcgtatcgcccggaggct

SEQ ID NO: 416412 - DNA, 25 bp, Mus musculus
tccgggaacagagccggcatctata

SEQ ID NO: 416413 - DNA, 25 bp, Mus musculus
gcattcacccttatggctcaccggg

SEQ ID NO: 416414 - DNA, 25 bp, Mus musculus
gctcaccgggccaactgctagcgga

SEQ ID NO: 416415 - DNA, 25 bp, Mus musculus
actgctagcggacccaactcgaagg

SEQ ID NO: 416416 - DNA, 25 bp, Mus musculus
caggagacgcggaaacctgggttct

SEQ ID NO: 416417 - DNA, 25 bp, Mus musculus
atcacttctcaacgctctgagctga

SEQ ID NO: 416418 - DNA, 25 bp, Mus musculus
aaaaggggaaccttgctgcggctct

SEQ ID NO: 416419 - DNA, 25 bp, Mus musculus
tgggtctggtcctactgcgacctag

SEQ ID NO: 416420 - DNA, 25 bp, Mus musculus
tcctactgcgacctagatccacgtg

SEQ ID NO: 416421 - DNA, 25 bp, Mus musculus
ccggtcactgaagtccgggaacaga

SEQ ID NO: 416422 - DNA, 25 bp, Mus musculus
cggcatctatatcgccagggcccgt

SEQ ID NO: 416423 - DNA, 25 bp, Mus musculus
gcgcgctccgaagtcctgctggtcg

SEQ ID NO: 416424 - DNA, 25 bp, Mus musculus
ccgggcacgaggtagaaaggctcac

SEQ ID NO: 416425 - DNA, 25 bp, Mus musculus
tagatccacgtggaccggtcactga

SEQ ID NO: 416426 - DNA, 25 bp, Mus musculus
aagtcgccaaagagcaggtggcgtt

SEQ ID NO: 416427 - DNA, 25 bp, Mus musculus
tcgtcaagaaagtcgccaaagagca

SEQ ID NO: 416428 - DNA, 25 bp, Mus musculus
tgcctatgtcgtcaagaaagtcgcc

SEQ ID NO: 416429 - DNA, 25 bp, Mus musculus
ggccaccttgcctatgtcgtcaaga

SEQ ID NO: 416430 - DNA, 25 bp, Mus musculus
cgtggaaacatggaggccaccttgc

SEQ ID NO: 416431 - DNA, 25 bp, Mus musculus
ccaccgactcgcgtggaaacatgga

SEQ ID NO: 416432 - DNA, 25 bp, Mus musculus
gtcaggcatgtcgtagggtaactcc

SEQ ID NO: 416433 - DNA, 25 bp, Mus musculus
atgctcagatggtagatttaatgcc

SEQ ID NO: 416434 - DNA, 25 bp, Mus musculus
ccgattttgatgctcagatggtaga

SEQ ID NO: 416435 - DNA, 25 bp, Mus musculus
ggcccagaaaccgattttgatgctc

SEQ ID NO: 416436 - DNA, 25 bp, Mus musculus
cgcattcgggtgtagcgcaaccgca

SEQ ID NO: 416437 - DNA, 25 bp, Mus musculus
tagggtaactccaccgactcgcgtg

SEQ ID NO: 416438 - DNA, 25 bp, Mus musculus
gcaaccgcagggtatggactcggcc

SEQ ID NO: 416439 - DNA, 25 bp, Mus musculus
agatttaatgcctgtgaccaggtgc

SEQ ID NO: 416440 - DNA, 25 bp, Mus musculus
gaaactgagcgcgatgggatcaccc

SEQ ID NO: 416441 - DNA, 25 bp, Mus musculus
aagcggcaaggtctcctaggagcga

SEQ ID NO: 416442 - DNA, 25 bp, Mus musculus
gacacggaagggacgcggcaaccta

SEQ ID NO: 416443 - DNA, 25 bp, Mus musculus
cggcaacctacggtccactgtaaag

SEQ ID NO: 416444 - DNA, 25 bp, Mus musculus
tggtggttaacaggcaccgcaaagc

SEQ ID NO: 416445 - DNA, 25 bp, Mus musculus
accaacgtgtgttacttggcgcgta

SEQ ID NO: 416446 - DNA, 25 bp, Mus musculus
aagggcgatgatgtttaataaaaga

SEQ ID NO: 416447 - DNA, 25 bp, Mus musculus
cgggaccgcttagtccagcgtacca

SEQ ID NO: 416448 - DNA, 25 bp, Mus musculus
actgtaaagtaatctcccaggagca

SEQ ID NO: 416449 - DNA, 25 bp, Mus musculus
cgcgctcttaaagcggcaaggtctc

SEQ ID NO: 416450 - DNA, 25 bp, Mus musculus
ttacttggcgcgtaggaattcttta

SEQ ID NO: 416451 - DNA, 25 bp, Mus musculus
gcgctccgcggttattgcttgtcaa

SEQ ID NO: 416452 - DNA, 25 bp, Mus musculus
ttgtcaatcgctagccgcgctctta

SEQ ID NO: 416453 - DNA, 25 bp, Mus musculus
tgagcaggaccaacgtgtgttactt

SEQ ID NO: 416454 - DNA, 25 bp, Mus musculus
gcgtctgaagaactgctctccgaga

SEQ ID NO: 416455 - DNA, 25 bp, Mus musculus
ccagcgtccgtgtatcttaccatct

SEQ ID NO: 416456 - DNA, 25 bp, Mus musculus
catatcccttctccagctctggtta

SEQ ID NO: 416457 - DNA, 25 bp, Mus musculus
ctcggcccttccctccatatccctt

SEQ ID NO: 416458 - DNA, 25 bp, Mus musculus
ctgctctccgagactcaatacgggg

SEQ ID NO: 416459 - DNA, 25 bp, Mus musculus
cgtgtatcttaccatctccgagagt

SEQ ID NO: 416460 - DNA, 25 bp, Mus musculus
taccatctccgagagtttcgaaccc

SEQ ID NO: 416461 - DNA, 25 bp, Mus musculus
agcgccgaggtagagccgtctctgc

SEQ ID NO: 416462 - DNA, 25 bp, Mus musculus
cgcagaggtagcagcggatgtttac

SEQ ID NO: 416463 - DNA, 25 bp, Mus musculus
agcagcggatgtttacagcggctga

SEQ ID NO: 416464 - DNA, 25 bp, Mus musculus
tgtttacagcggctgaggtccgtcc

SEQ ID NO: 416465 - DNA, 25 bp, Mus musculus
tgaggtccgtccgaagcgacagaag

SEQ ID NO: 416466 - DNA, 25 bp, Mus musculus
tccgtccgaagcgacagaagcgtct

SEQ ID NO: 416467 - DNA, 25 bp, Mus musculus
gcgacagaagcgtctgaagaactgc

SEQ ID NO: 416468 - DNA, 25 bp, Mus musculus
aagtccagcagtcgctgctccagtg

SEQ ID NO: 416469 - DNA, 25 bp, Mus musculus
ccacggaagcgccagacagaagcga

SEQ ID NO: 416470 - DNA, 25 bp, Mus musculus
acggcttttgattgggcgcctgcac

SEQ ID NO: 416471 - DNA, 25 bp, Mus musculus
atcccgggttgccagttacggagca

SEQ ID NO: 416472 - DNA, 25 bp, Mus musculus
gcagtgcctactgggaacgtcttga

SEQ ID NO: 416473 - DNA, 25 bp, Mus musculus
aaaggattatctgcggtgaccaatg

SEQ ID NO: 416474 - DNA, 25 bp, Mus musculus
cagtatgctgttgttctgcccgggc

SEQ ID NO: 416475 - DNA, 25 bp, Mus musculus
tttcagctagggagacgtgtgcaca

SEQ ID NO: 416476 - DNA, 25 bp, Mus musculus
cgtccataatatcacccgtaaggta

SEQ ID NO: 416477 - DNA, 25 bp, Mus musculus
ggtccagtcctcttggcgtttcagc

SEQ ID NO: 416478 - DNA, 25 bp, Mus musculus
tgtgcacacgcgcagaaacgacagg

SEQ ID NO: 416479 - DNA, 25 bp, Mus musculus
aagttccacagacgggtgccttctc

SEQ ID NO: 416480 - DNA, 25 bp, Mus musculus
ctgctttctgggaggcacagcaagc

SEQ ID NO: 416481 - DNA, 25 bp, Mus musculus
gctcagaccttcctgcaggcttttg

SEQ ID NO: 416482 - DNA, 25 bp, Mus musculus
aacggtccatcgatgcctcggggct

SEQ ID NO: 416483 - DNA, 25 bp, Mus musculus
tccatcgatgcctcggggctctcag

SEQ ID NO: 416484 - DNA, 25 bp, Mus musculus
agaggcaccgcggtgagtcccggct

SEQ ID NO: 416485 - DNA, 25 bp, Mus musculus
cataaagacgtggaggtggagacta

SEQ ID NO: 416486 - DNA, 25 bp, Mus musculus
cctggcgcctccataaagacgtgga

SEQ ID NO: 416487 - DNA, 25 bp, Mus musculus
cgagcctggcgcctccataaagacg

SEQ ID NO: 416488 - DNA, 25 bp, Mus musculus
agcgtcgagcctggcgcctccataa

SEQ ID NO: 416489 - DNA, 25 bp, Mus musculus
acgctggctgctagtcggagcctga

SEQ ID NO: 416490 - DNA, 25 bp, Mus musculus
agaaacgctggctgctagtcggagc

SEQ ID NO: 416491 - DNA, 25 bp, Mus musculus
ggcgcataagaaacgctggctgcta

SEQ ID NO: 416492 - DNA, 25 bp, Mus musculus
ttgcgcaggcgcataagaaacgctg

SEQ ID NO: 416493 - DNA, 25 bp, Mus musculus
aagtaagagtttgcgcaggcgcata

SEQ ID NO: 416494 - DNA, 25 bp, Mus musculus
cgctcggaaagtaagagtttgcgca

SEQ ID NO: 416495 - DNA, 25 bp, Mus musculus
ctcggggctctcagcgtcgagcctg

SEQ ID NO: 416496 - DNA, 25 bp, Mus musculus
ccgcagagagcggtgattagtcaga

SEQ ID NO: 416497 - DNA, 25 bp, Mus musculus
gactttcagtttccggctccgcggc

SEQ ID NO: 416498 - DNA, 25 bp, Mus musculus
acgcgcctaccaggagctcacaggg

SEQ ID NO: 416499 - DNA, 25 bp, Mus musculus
tgcggacgtcgcgaacttttccggc

SEQ ID NO: 416500 - DNA, 25 bp, Mus musculus
taccaggagctcacagggagcagca

SEQ ID NO: 416501 - DNA, 25 bp, Mus musculus
gcagcggccgtcgatttgtcaaata

SEQ ID NO: 416502 - DNA, 25 bp, Mus musculus
cgatttgtcaaataggccgccttga

SEQ ID NO: 416503 - DNA, 25 bp, Mus musculus
aaataggccgccttgactctgcccg

SEQ ID NO: 416504 - DNA, 25 bp, Mus musculus
tgactctgcccgctgacagacggaa

SEQ ID NO: 416505 - DNA, 25 bp, Mus musculus
cccgctgacagacggaagcaggaac

SEQ ID NO: 416506 - DNA, 25 bp, Mus musculus
taccaggaacgagcacggaaccgca

SEQ ID NO: 416507 - DNA, 25 bp, Mus musculus
agcaccgctgcggacgtcgcgaact

SEQ ID NO: 416508 - DNA, 25 bp, Mus musculus
ggctccgcggctccgaaaagtctac

SEQ ID NO: 416509 - DNA, 25 bp, Mus musculus
ggcagggaccgtactgctgtaaccc

SEQ ID NO: 416510 - DNA, 25 bp, Mus musculus
acaccgtgacggtgctgcgcaagaa

SEQ ID NO: 416511 - DNA, 25 bp, Mus musculus
cggcgatcaggcgtcgccctccacg

SEQ ID NO: 416512 - DNA, 25 bp, Mus musculus
gtccctagactagccgggtgcggat

SEQ ID NO: 416513 - DNA, 25 bp, Mus musculus
gggctcctggaaccaccgaccaatg

SEQ ID NO: 416514 - DNA, 25 bp, Mus musculus
tggaaccaccgaccaatgggaacca

SEQ ID NO: 416515 - DNA, 25 bp, Mus musculus
cgacgaagggacgtcgcgtcgccgc

SEQ ID NO: 416516 - DNA, 25 bp, Mus musculus
tgccagagccgccggacggatcgct

SEQ ID NO: 416517 - DNA, 25 bp, Mus musculus
tctaagcaggtgctcagccagcggg

SEQ ID NO: 416518 - DNA, 25 bp, Mus musculus
ccgagagtgactgggacaccgtgac

SEQ ID NO: 416519 - DNA, 25 bp, Mus musculus
agccacagggacacgggactggaac

SEQ ID NO: 416520 - DNA, 25 bp, Mus musculus
cacggccgcacaggccaagtctaag

SEQ ID NO: 416521 - DNA, 25 bp, Mus musculus
caggccaagtctaagcaggtgctca

SEQ ID NO: 416522 - DNA, 25 bp, Mus musculus
ccaagtctaagcaggtgctcagcca

SEQ ID NO: 416523 - DNA, 25 bp, Mus musculus
ccatggccgagagtgactgggacac

SEQ ID NO: 416524 - DNA, 25 bp, Mus musculus
tcagcccatttgtagccacgcacga

SEQ ID NO: 416525 - DNA, 25 bp, Mus musculus
gggccctttggcagccacggccaat

SEQ ID NO: 416526 - DNA, 25 bp, Mus musculus
cccgacccaggcctatgcgtaggga

SEQ ID NO: 416527 - DNA, 25 bp, Mus musculus
atctgaccgaggtccgccgccatgt

SEQ ID NO: 416528 - DNA, 25 bp, Mus musculus
atcaggaatctgaccgaggtccgcc

SEQ ID NO: 416529 - DNA, 25 bp, Mus musculus
cgaatcaatgtctacatcaggaatc

SEQ ID NO: 416530 - DNA, 25 bp, Mus musculus
tgaagacgccatccgaatcaatgtc

SEQ ID NO: 416531 - DNA, 25 bp, Mus musculus
tcagcacatacttgaagacgccatc

SEQ ID NO: 416532 - DNA, 25 bp, Mus musculus
tggactcgaatcagcacatacttga

SEQ ID NO: 416533 - DNA, 25 bp, Mus musculus
ggctctgctaagtggactcgaatca

SEQ ID NO: 416534 - DNA, 25 bp, Mus musculus
ccagaaggctctgctaagtggactc

SEQ ID NO: 416535 - DNA, 25 bp, Mus musculus
gatttccttgcactccttcgccgga

SEQ ID NO: 416536 - DNA, 25 bp, Mus musculus
tttgtagccacgcacgatttccttg

SEQ ID NO: 416537 - DNA, 25 bp, Mus musculus
ctcaccgtggtactcagcccatttg

SEQ ID NO: 416538 - DNA, 25 bp, Mus musculus
tgatggtaatctctggcgtgacgta

SEQ ID NO: 416539 - DNA, 25 bp, Mus musculus
accaggtcagtgatgagctcgtcca

SEQ ID NO: 416540 - DNA, 25 bp, Mus musculus
tcactacgactggtggacgccgacc

SEQ ID NO: 416541 - DNA, 25 bp, Mus musculus
gacgccgaccttcaggggatgaacc

SEQ ID NO: 416542 - DNA, 25 bp, Mus musculus
cctcgcgtcccaggaggttctcata

SEQ ID NO: 416543 - DNA, 25 bp, Mus musculus
ctagaggatcttcacgacgaggacc

SEQ ID NO: 416544 - DNA, 25 bp, Mus musculus
agctaggatgttgtcccaggatcga

SEQ ID NO: 416545 - DNA, 25 bp, Mus musculus
gtccgagccagtacatcgcgttctc

SEQ ID NO: 416546 - DNA, 25 bp, Mus musculus
atcgcgttctcggtacctcccaaag

SEQ ID NO: 416547 - DNA, 25 bp, Mus musculus
ccaaagtcctcggtgtagaaagtgc

SEQ ID NO: 416548 - DNA, 25 bp, Mus musculus
ctcttctgggacataccggggaacg

SEQ ID NO: 416549 - DNA, 25 bp, Mus musculus
ataccgtaggctcgagttgtctccc

SEQ ID NO: 416550 - DNA, 25 bp, Mus musculus
aggtgcgtacttcgccagcatagta

SEQ ID NO: 416551 - DNA, 25 bp, Mus musculus
caggtcgttgtctgtgatggtaatc

SEQ ID NO: 416552 - DNA, 25 bp, Mus musculus
agctgttctctggaggtctcctgtc

SEQ ID NO: 416553 - DNA, 25 bp, Mus musculus
taggtcccgcccttttctagcatct

SEQ ID NO: 416554 - DNA, 25 bp, Mus musculus
ctaaaagggacacgtagccgccgca

SEQ ID NO: 416555 - DNA, 25 bp, Mus musculus
acatgttcctgctggacgtgcgagc

SEQ ID NO: 416556 - DNA, 25 bp, Mus musculus
tcttcaacgcggagaacatgttcct

SEQ ID NO: 416557 - DNA, 25 bp, Mus musculus
ctctgcagcgcctggttcatggact

SEQ ID NO: 416558 - DNA, 25 bp, Mus musculus
gcggcccgcactcactgttatactg

SEQ ID NO: 416559 - DNA, 25 bp, Mus musculus
tccagaccctagtaggctgggtggc

SEQ ID NO: 416560 - DNA, 25 bp, Mus musculus
gtctcctgtcaggtgatgtccctca

SEQ ID NO: 416561 - DNA, 25 bp, Mus musculus
tagtgtcgccgcacagctgttctct

SEQ ID NO: 416562 - DNA, 25 bp, Mus musculus
tgtaatggtctctctccgcagggta

SEQ ID NO: 416563 - DNA, 25 bp, Mus musculus
cgcgcgcaccctcgggttatgtaat

SEQ ID NO: 416564 - DNA, 25 bp, Mus musculus
ctccgactttcaggagcctcaagtg

SEQ ID NO: 416565 - DNA, 25 bp, Mus musculus
tgtccctcaaggaacgaccactact

SEQ ID NO: 416566 - DNA, 25 bp, Mus musculus
ttagtagcatcaggttggttccgta

SEQ ID NO: 416567 - DNA, 25 bp, Mus musculus
gccgcagttcgtccttagtagcatc

SEQ ID NO: 416568 - DNA, 25 bp, Mus musculus
tccattgatcatgctgtggagcggc

SEQ ID NO: 416569 - DNA, 25 bp, Mus musculus
cggtcacctgaagctgccgcagttc

SEQ ID NO: 416570 - DNA, 25 bp, Mus musculus
agctgcaagctctccaacttctgtc

SEQ ID NO: 416571 - DNA, 25 bp, Mus musculus
ttggttccgtaagctggccagctcc

SEQ ID NO: 416572 - DNA, 25 bp, Mus musculus
cgtcgccgaaccaggtggatcagta

SEQ ID NO: 416573 - DNA, 25 bp, Mus musculus
ttcacacggtcaaagacgtacttgc

SEQ ID NO: 416574 - DNA, 25 bp, Mus musculus
gacgtacttgcgcagcttctcccga

SEQ ID NO: 416575 - DNA, 25 bp, Mus musculus
ccttctgccggctctgtagccttta

SEQ ID NO: 416576 - DNA, 25 bp, Mus musculus
cccgagaggggcaagggatcctctc

SEQ ID NO: 416577 - DNA, 25 bp, Mus musculus
acctccaaagtactgcggccgtgtg

SEQ ID NO: 416578 - DNA, 25 bp, Mus musculus
gccagcctcatggacgtatcctttc

SEQ ID NO: 416579 - DNA, 25 bp, Mus musculus
gtatcctttccgcaggccttggaga

SEQ ID NO: 416580 - DNA, 25 bp, Mus musculus
tgagcctcgctaacggcaaccgcga

SEQ ID NO: 416581 - DNA, 25 bp, Mus musculus
ctctccgtaaggtggcgcgatactt

SEQ ID NO: 416582 - DNA, 25 bp, Mus musculus
cgcgatactttgagcgtggcgtctg

SEQ ID NO: 416583 - DNA, 25 bp, Mus musculus
gaccttcgtgaagaacatcatcctg

SEQ ID NO: 416584 - DNA, 25 bp, Mus musculus
tcctgtgcacgtaggatgcagcgcc

SEQ ID NO: 416585 - DNA, 25 bp, Mus musculus
gcaaccgcgacctggactatgactc

SEQ ID NO: 416586 - DNA, 25 bp, Mus musculus
ccgccaagctggtctccaagctgga

SEQ ID NO: 416587 - DNA, 25 bp, Mus musculus
ctaccaggctgtgcgcaaagaaggc

SEQ ID NO: 416588 - DNA, 25 bp, Mus musculus
aggactgtatgtggaatggcttctc

SEQ ID NO: 416589 - DNA, 25 bp, Mus musculus
cgacccggatgacgagaccttcgtg

SEQ ID NO: 416590 - DNA, 25 bp, Mus musculus
agcagagcttcgtctgcgacccgga

SEQ ID NO: 416591 - DNA, 25 bp, Mus musculus
tgatagcttctccatcgcagacctg

SEQ ID NO: 416592 - DNA, 25 bp, Mus musculus
cagggaccacgacggtgatagcttc

SEQ ID NO: 416593 - DNA, 25 bp, Mus musculus
tgactcggtgcagccatacttcatg

SEQ ID NO: 416594 - DNA, 25 bp, Mus musculus
gtagtagcggctcagctcctccggg

SEQ ID NO: 416595 - DNA, 25 bp, Mus musculus
accgtgacgggccaaggcctgcgca

SEQ ID NO: 416596 - DNA, 25 bp, Mus musculus
cattgcgaccgtgacgggccaaggc

SEQ ID NO: 416597 - DNA, 25 bp, Mus musculus
attagcagcattgcgaccgtgacgg

SEQ ID NO: 416598 - DNA, 25 bp, Mus musculus
agcaggattagcagcattgcgaccg

SEQ ID NO: 416599 - DNA, 25 bp, Mus musculus
caggcgagcaggattagcagcattg

SEQ ID NO: 416600 - DNA, 25 bp, Mus musculus
tcccagacaggcgagcaggattagc

SEQ ID NO: 416601 - DNA, 25 bp, Mus musculus
accagggctcccagacaggcgagca

SEQ ID NO: 416602 - DNA, 25 bp, Mus musculus
cagggtaggcgtccaccagggctcc

SEQ ID NO: 416603 - DNA, 25 bp, Mus musculus
cgtcttcgccgggagcctctggttt

SEQ ID NO: 416604 - DNA, 25 bp, Mus musculus
caccgctgccgggtgaccaggttga

SEQ ID NO: 416605 - DNA, 25 bp, Mus musculus
gcgtagtagcggctcagctcctccg

SEQ ID NO: 416606 - DNA, 25 bp, Mus musculus
cctgccctctccagcgctcaccgct

SEQ ID NO: 416607 - DNA, 25 bp, Mus musculus
ttcgccgggagcctctggtttggca

SEQ ID NO: 416608 - DNA, 25 bp, Mus musculus
tttgaggatcagtcagatctgcacg

SEQ ID NO: 416609 - DNA, 25 bp, Mus musculus
tgccgccaaggtaccgattccgtga

SEQ ID NO: 416610 - DNA, 25 bp, Mus musculus
gtgcctgcaggcgaccctgctcagg

SEQ ID NO: 416611 - DNA, 25 bp, Mus musculus
accctgctcagggaaagtcggccgc

SEQ ID NO: 416612 - DNA, 25 bp, Mus musculus
gccgcctcacaatgaacgacctgga

SEQ ID NO: 416613 - DNA, 25 bp, Mus musculus
aacgacctggacacggaggtgctgc

SEQ ID NO: 416614 - DNA, 25 bp, Mus musculus
aggtgctgcccttgccgccaaggta

SEQ ID NO: 416615 - DNA, 25 bp, Mus musculus
gtaccgattccgtgacctgctttta

SEQ ID NO: 416616 - DNA, 25 bp, Mus musculus
cctgcttttaggagaccagccattc

SEQ ID NO: 416617 - DNA, 25 bp, Mus musculus
gagaccagccattcccgaacgacga

SEQ ID NO: 416618 - DNA, 25 bp, Mus musculus
tcccgaacgacgataggtaagtggc

SEQ ID NO: 416619 - DNA, 25 bp, Mus musculus
cagatctgcacgcacgatggtcgca

SEQ ID NO: 416620 - DNA, 25 bp, Mus musculus
ccagcgctccactgatttgaggatc

SEQ ID NO: 416621 - DNA, 25 bp, Mus musculus
cacaacgttcttcaactttctcggt

SEQ ID NO: 416622 - DNA, 25 bp, Mus musculus
gacccttgagcgaaggctgccgcgc

SEQ ID NO: 416623 - DNA, 25 bp, Mus musculus
tccaggccgaagagctagccgtgca

SEQ ID NO: 416624 - DNA, 25 bp, Mus musculus
tagccgagaccatcgtgtatgccaa

SEQ ID NO: 416625 - DNA, 25 bp, Mus musculus
gaccatcgtgtatgccaaggtgctg

SEQ ID NO: 416626 - DNA, 25 bp, Mus musculus
ccgagctagccgagaccatcgtgta

SEQ ID NO: 416627 - DNA, 25 bp, Mus musculus
tggagacccttgagcgaaggctgcc

SEQ ID NO: 416628 - DNA, 25 bp, Mus musculus
cagctgccgtcggagtggagaccct

SEQ ID NO: 416629 - DNA, 25 bp, Mus musculus
gaagagctagccgtgcacccagctc

SEQ ID NO: 416630 - DNA, 25 bp, Mus musculus
tcatggtgatccaggccgaagagct

SEQ ID NO: 416631 - DNA, 25 bp, Mus musculus
aaggcccggtcatggtgatccaggc

SEQ ID NO: 416632 - DNA, 25 bp, Mus musculus
ctctggaccctttttaagcgtggcg

SEQ ID NO: 416633 - DNA, 25 bp, Mus musculus
caatctccgcccgtcccgtcgcgtc

SEQ ID NO: 416634 - DNA, 25 bp, Mus musculus
ttcctcccgggagttctgcacgggc

SEQ ID NO: 416635 - DNA, 25 bp, Mus musculus
gctagagcgtagccgccggcatgcc

SEQ ID NO: 416636 - DNA, 25 bp, Mus musculus
ctggcgttgcctgtagccctggaga

SEQ ID NO: 416637 - DNA, 25 bp, Mus musculus
cccttgcttagtggttgaacctagg

SEQ ID NO: 416638 - DNA, 25 bp, Mus musculus
tttgtttagcactggctctgctccc

SEQ ID NO: 416639 - DNA, 25 bp, Mus musculus
gcctggcttggggagacttagaccc

SEQ ID NO: 416640 - DNA, 25 bp, Mus musculus
gagagggcgtcctggagtcccacca

SEQ ID NO: 416641 - DNA, 25 bp, Mus musculus
gtacactggaactgcgtcctccctg

SEQ ID NO: 416642 - DNA, 25 bp, Mus musculus
cgcgtcgttcgcattttgtttagca

SEQ ID NO: 416643 - DNA, 25 bp, Mus musculus
tgaggagccacacgggctcagcccg

SEQ ID NO: 416644 - DNA, 25 bp, Mus musculus
cgtcctccctgaggcatccaggttg

SEQ ID NO: 416645 - DNA, 25 bp, Mus musculus
tgcacggggagccaagctgacaccc

SEQ ID NO: 416646 - DNA, 25 bp, Mus musculus
ggacaagagcctggagccgaccttg

SEQ ID NO: 416647 - DNA, 25 bp, Mus musculus
ggcatccaggttgggacaagagcct

SEQ ID NO: 416648 - DNA, 25 bp, Mus musculus
gaccattccactgtgctgcgcgttg

SEQ ID NO: 416649 - DNA, 25 bp, Mus musculus
gtcggggtaagacagctgtacactg

SEQ ID NO: 416650 - DNA, 25 bp, Mus musculus
cggtcgcatccgaaaccagtgcgtt

SEQ ID NO: 416651 - DNA, 25 bp, Mus musculus
gctgcatacacgctagtccatccgg

SEQ ID NO: 416652 - DNA, 25 bp, Mus musculus
ccgtccgtctccctgtaatcccatc

SEQ ID NO: 416653 - DNA, 25 bp, Mus musculus
aagcgcagtaggcaccgcccgtaac

SEQ ID NO: 416654 - DNA, 25 bp, Mus musculus
tcctcctgaaggctccgtacctgtc

SEQ ID NO: 416655 - DNA, 25 bp, Mus musculus
cccttcttcagatgctctgggtaca

SEQ ID NO: 416656 - DNA, 25 bp, Mus musculus
cagatgctctgggtacaccctcagc

SEQ ID NO: 416657 - DNA, 25 bp, Mus musculus
cccagccctggtcctgcagagtagg

SEQ ID NO: 416658 - DNA, 25 bp, Mus musculus
taacctagcccagtccgtgtcctta

SEQ ID NO: 416659 - DNA, 25 bp, Mus musculus
ccagtccgtgtccttagtagctatg

SEQ ID NO: 416660 - DNA, 25 bp, Mus musculus
tagtagctatggacacaccctcggc

SEQ ID NO: 416661 - DNA, 25 bp, Mus musculus
tctacttcgtcctcaaggctgcata

SEQ ID NO: 416662 - DNA, 25 bp, Mus musculus
cgccgcgtcacgcaggcgcacttac

SEQ ID NO: 416663 - DNA, 25 bp, Mus musculus
cctcaaggctgcatacacgctagtc

SEQ ID NO: 416664 - DNA, 25 bp, Mus musculus
aaggggcaggagctgtacccttgct

SEQ ID NO: 416665 - DNA, 25 bp, Mus musculus
agccgaagcaccttgcccgcgaaga

SEQ ID NO: 416666 - DNA, 25 bp, Mus musculus
cgaagatcttctcctcctgcacgaa

SEQ ID NO: 416667 - DNA, 25 bp, Mus musculus
tcctgcacgaacatcgcgccgccgc

SEQ ID NO: 416668 - DNA, 25 bp, Mus musculus
tccgccgcccgtcactgaaggggca

SEQ ID NO: 416669 - DNA, 25 bp, Mus musculus
cagccgcgccggaagtgcgtaatga

SEQ ID NO: 416670 - DNA, 25 bp, Mus musculus
ccggaagtgcgtaatgagcgcccgt

SEQ ID NO: 416671 - DNA, 25 bp, Mus musculus
ttttttggcaggcattctgctgttg

SEQ ID NO: 416672 - DNA, 25 bp, Mus musculus
ggcaggcattctgctgttgcccacc

SEQ ID NO: 416673 - DNA, 25 bp, Mus musculus
cgcaccgcgccggaaataggtaaag

SEQ ID NO: 416674 - DNA, 25 bp, Mus musculus
ccgcgccggaaataggtaaagtgca

SEQ ID NO: 416675 - DNA, 25 bp, Mus musculus
aataggtaaagtgcaccaaggcacg

SEQ ID NO: 416676 - DNA, 25 bp, Mus musculus
tgcgcagatgtgcagccgaagcacc

SEQ ID NO: 416677 - DNA, 25 bp, Mus musculus
gccgcccgaaccagtgaaggtcact

SEQ ID NO: 416678 - DNA, 25 bp, Mus musculus
tcaaacacctgtggagccgcagatg

SEQ ID NO: 416679 - DNA, 25 bp, Mus musculus
accctctggaagcatggacttgatc

SEQ ID NO: 416680 - DNA, 25 bp, Mus musculus
ttggtacacatgtctgcggcaatca

SEQ ID NO: 416681 - DNA, 25 bp, Mus musculus
gacacggcgagcattggtacacatg

SEQ ID NO: 416682 - DNA, 25 bp, Mus musculus
cagccagcgcttacggacacggcga

SEQ ID NO: 416683 - DNA, 25 bp, Mus musculus
gcatggacttgatcttgggcagcca

SEQ ID NO: 416684 - DNA, 25 bp, Mus musculus
gacattcaccgcatcagttctcaga

SEQ ID NO: 416685 - DNA, 25 bp, Mus musculus
gacgcacccatgacgctacggtaca

SEQ ID NO: 416686 - DNA, 25 bp, Mus musculus
gtctgcggcaatcacgttcatctcg

SEQ ID NO: 416687 - DNA, 25 bp, Mus musculus
gatgcgctgctcaaacacctgtgga

SEQ ID NO: 416688 - DNA, 25 bp, Mus musculus
tcgtcgctcagcatagatgcgctgc

SEQ ID NO: 416689 - DNA, 25 bp, Mus musculus
ggtggctgcatcacttcgtcgctca

SEQ ID NO: 416690 - DNA, 25 bp, Mus musculus
tcagttctcagagccacgatggtgg

SEQ ID NO: 416691 - DNA, 25 bp, Mus musculus
ggtacatctccacaccctctggaag

SEQ ID NO: 416692 - DNA, 25 bp, Mus musculus
aagacctaccttcagcggctgtggc

SEQ ID NO: 416693 - DNA, 25 bp, Mus musculus
tctgcagagccgcacaaagggccgc

SEQ ID NO: 416694 - DNA, 25 bp, Mus musculus
caggccctggcccaactctgcagag

SEQ ID NO: 416695 - DNA, 25 bp, Mus musculus
acggagccaccctgcgccaggagtt

SEQ ID NO: 416696 - DNA, 25 bp, Mus musculus
ccaccctgcgccaggagttgggcag

SEQ ID NO: 416697 - DNA, 25 bp, Mus musculus
cccgctactgagaagttgttgggct

SEQ ID NO: 416698 - DNA, 25 bp, Mus musculus
ccggagaggaaagacctaccttcag

SEQ ID NO: 416699 - DNA, 25 bp, Mus musculus
tgtggccggcggcagacactgccca

SEQ ID NO: 416700 - DNA, 25 bp, Mus musculus
tgctcggggaatgcagcaaggaacc

SEQ ID NO: 416701 - DNA, 25 bp, Mus musculus
aatgcagcaaggaaccctgaggtgg

SEQ ID NO: 416702 - DNA, 25 bp, Mus musculus
gcgcgcagcatctcaatgaagcagc

SEQ ID NO: 416703 - DNA, 25 bp, Mus musculus
tgaagcagccggatgcagacgaaca

SEQ ID NO: 416704 - DNA, 25 bp, Mus musculus
gatgcagacgaacatccaggcagct

SEQ ID NO: 416705 - DNA, 25 bp, Mus musculus
ctactgagaagttgttgggctggcc

SEQ ID NO: 416706 - DNA, 25 bp, Mus musculus
atctgatgcgcagacgcgctgcctc

SEQ ID NO: 416707 - DNA, 25 bp, Mus musculus
tagcgttcaagcctgcaccgggcac

SEQ ID NO: 416708 - DNA, 25 bp, Mus musculus
tccgagcacttagcgttcaagcctg

SEQ ID NO: 416709 - DNA, 25 bp, Mus musculus
tgcgtggtgccttccgagcacttag

SEQ ID NO: 416710 - DNA, 25 bp, Mus musculus
atcccgagagttgctgcgtggtgcc

SEQ ID NO: 416711 - DNA, 25 bp, Mus musculus
caagttggccgtacctgcgggcacc

SEQ ID NO: 416712 - DNA, 25 bp, Mus musculus
cgcgacgcgcgccaagttggccgta

SEQ ID NO: 416713 - DNA, 25 bp, Mus musculus
agcgagcagatctagcgcggcccgt

SEQ ID NO: 416714 - DNA, 25 bp, Mus musculus
cacccggagtgccagttttggccgg

SEQ ID NO: 416715 - DNA, 25 bp, Mus musculus
aggaaggcactagcgcacccggagt

SEQ ID NO: 416716 - DNA, 25 bp, Mus musculus
ccaacgggaaaggaaggcactagcg

SEQ ID NO: 416717 - DNA, 25 bp, Mus musculus
aggccagtgtcatcggggctttccc

SEQ ID NO: 416718 - DNA, 25 bp, Mus musculus
gacacgggccgaatctgatgcgcag

SEQ ID NO: 416719 - DNA, 25 bp, Mus musculus
tcggggctttccctcccgtgcagga

SEQ ID NO: 416720 - DNA, 25 bp, Mus musculus
ggtcttgacataaacatcgaagttg

SEQ ID NO: 416721 - DNA, 25 bp, Mus musculus
tactgtaggcagaagagcgcggcca

SEQ ID NO: 416722 - DNA, 25 bp, Mus musculus
ttcatgaggcggaagtccacgcgcc

SEQ ID NO: 416723 - DNA, 25 bp, Mus musculus
actgacagcttgagctggaagcgca

SEQ ID NO: 416724 - DNA, 25 bp, Mus musculus
aagcgcagcagtacgcggacaccca

SEQ ID NO: 416725 - DNA, 25 bp, Mus musculus
agttgttgtacttggtgcgagccag

SEQ ID NO: 416726 - DNA, 25 bp, Mus musculus
acacccaggtactgtaggcagaaga

SEQ ID NO: 416727 - DNA, 25 bp, Mus musculus
agtgctgttttgcagtggcggtgca

SEQ ID NO: 416728 - DNA, 25 bp, Mus musculus
ctgcagctgaagtagagcaggaagc

SEQ ID NO: 416729 - DNA, 25 bp, Mus musculus
agagcaggaagcgtataaagccata

SEQ ID NO: 416730 - DNA, 25 bp, Mus musculus
tataaagccatagagccagcgggtc

SEQ ID NO: 416731 - DNA, 25 bp, Mus musculus
gccagcgggtcttgacataaacatc

SEQ ID NO: 416732 - DNA, 25 bp, Mus musculus
acatcgaagttgttgtacttggtgc

SEQ ID NO: 416733 - DNA, 25 bp, Mus musculus
tacgcggacacccaggtactgtagg

SEQ ID NO: 416734 - DNA, 25 bp, Mus musculus
tttacccagctagacagggcaatgg

SEQ ID NO: 416735 - DNA, 25 bp, Mus musculus
ttctcgctgtggtgtgagcttgtct

SEQ ID NO: 416736 - DNA, 25 bp, Mus musculus
agcgtgagtttagctctcccgcgca

SEQ ID NO: 416737 - DNA, 25 bp, Mus musculus
tcattatccgaggacgcgcactagc

SEQ ID NO: 416738 - DNA, 25 bp, Mus musculus
cgacgacacggtgaagcctcgcagc

SEQ ID NO: 416739 - DNA, 25 bp, Mus musculus
gcgcggagcatccaggaattcctca

SEQ ID NO: 416740 - DNA, 25 bp, Mus musculus
ggagatacgaccctcactagccata

SEQ ID NO: 416741 - DNA, 25 bp, Mus musculus
ctaactcggcgcgtggagatacgac

SEQ ID NO: 416742 - DNA, 25 bp, Mus musculus
gcacgggaccctagagcaggacatc

SEQ ID NO: 416743 - DNA, 25 bp, Mus musculus
gagcttgtctcctttctggtggtgc

SEQ ID NO: 416744 - DNA, 25 bp, Mus musculus
cctcattcaggcgtgtcactggaca

SEQ ID NO: 416745 - DNA, 25 bp, Mus musculus
ggaggcttagctatgttttacccag

SEQ ID NO: 416746 - DNA, 25 bp, Mus musculus
gatgcggtctgcagcaggtgtactc

SEQ ID NO: 416747 - DNA, 25 bp, Mus musculus
ggcggccaccgtagcacggtcttca

SEQ ID NO: 416748 - DNA, 25 bp, Mus musculus
cagatcactggtgcagcgggacatc

SEQ ID NO: 416749 - DNA, 25 bp, Mus musculus
cgctaagggtcgtgtccagtctcct

SEQ ID NO: 416750 - DNA, 25 bp, Mus musculus
ttcctgaaccagtgtggtgccagcc

SEQ ID NO: 416751 - DNA, 25 bp, Mus musculus
tccagagcgaccgtcacctgtgggt

SEQ ID NO: 416752 - DNA, 25 bp, Mus musculus
gcaccgccagggctcacgcagagga

SEQ ID NO: 416753 - DNA, 25 bp, Mus musculus
agtctcctgcggtcgaggagccgtc

SEQ ID NO: 416754 - DNA, 25 bp, Mus musculus
gagccgtcgtggacaccgcttccaa

SEQ ID NO: 416755 - DNA, 25 bp, Mus musculus
agcgggacatccaggccttcctgaa

SEQ ID NO: 416756 - DNA, 25 bp, Mus musculus
gggaagcacgccactggctcacgca

SEQ ID NO: 416757 - DNA, 25 bp, Mus musculus
ggctcacgcaattccagacctgcta

SEQ ID NO: 416758 - DNA, 25 bp, Mus musculus
cagacctgctaccattcggtggaca

SEQ ID NO: 416759 - DNA, 25 bp, Mus musculus
tcgccgtcatggaggtaagccgatc

SEQ ID NO: 416760 - DNA, 25 bp, Mus musculus
tggacaagcccttcgccgtcatgga

SEQ ID NO: 416761 - DNA, 25 bp, Mus musculus
cagcggccagaaggttgcgcagccc

SEQ ID NO: 416762 - DNA, 25 bp, Mus musculus
ttgcgcatcgctgccatacacggtc

SEQ ID NO: 416763 - DNA, 25 bp, Mus musculus
agcgcttcatattgcggaaatactg

SEQ ID NO: 416764 - DNA, 25 bp, Mus musculus
ggccagcgtctttcttcagtctctt

SEQ ID NO: 416765 - DNA, 25 bp, Mus musculus
cagtctcttttccttagcccggcga

SEQ ID NO: 416766 - DNA, 25 bp, Mus musculus
ggcgaagtgttgtaggcgctcttca

SEQ ID NO: 416767 - DNA, 25 bp, Mus musculus
tctgtattaggaacccgcagctttg

SEQ ID NO: 416768 - DNA, 25 bp, Mus musculus
tgtgtggatcaggtcttcatggtca

SEQ ID NO: 416769 - DNA, 25 bp, Mus musculus
ttgggctgctaattctctcaaagcg

SEQ ID NO: 416770 - DNA, 25 bp, Mus musculus
ggcaacctcctgttttccgccgatg

SEQ ID NO: 416771 - DNA, 25 bp, Mus musculus
gcgaagcaatgcaggtggtacacga

SEQ ID NO: 416772 - DNA, 25 bp, Mus musculus
agcgtttccctcatcgcccttgaga

SEQ ID NO: 416773 - DNA, 25 bp, Mus musculus
acctcgctgcttggctgtttcgtag

SEQ ID NO: 416774 - DNA, 25 bp, Mus musculus
ttccgccgatgtgactgctactgca

SEQ ID NO: 416775 - DNA, 25 bp, Mus musculus
ttccatgaggtagaactcgtcgccc

SEQ ID NO: 416776 - DNA, 25 bp, Mus musculus
ctccgagctggcgtcggagcgactc

SEQ ID NO: 416777 - DNA, 25 bp, Mus musculus
aagcaagttcgctaagcctcccgga

SEQ ID NO: 416778 - DNA, 25 bp, Mus musculus
taagcctcccggaaggctgaggtcc

SEQ ID NO: 416779 - DNA, 25 bp, Mus musculus
ggagggaactgcgttctctttgctc

SEQ ID NO: 416780 - DNA, 25 bp, Mus musculus
ttgctcacgtttagactctgaaccg

SEQ ID NO: 416781 - DNA, 25 bp, Mus musculus
gcgcagtaaccactcaaggcttcct

SEQ ID NO: 416782 - DNA, 25 bp, Mus musculus
acttcccgaggacggagacagcgca

SEQ ID NO: 416783 - DNA, 25 bp, Mus musculus
aagccgtctggcttgcacttcccga

SEQ ID NO: 416784 - DNA, 25 bp, Mus musculus
aaccgaggtgcctagaagccgtctg

SEQ ID NO: 416785 - DNA, 25 bp, Mus musculus
ggccactggagactgtgcacctttc

SEQ ID NO: 416786 - DNA, 25 bp, Mus musculus
cgaggccaccgttgcagggactccg

SEQ ID NO: 416787 - DNA, 25 bp, Mus musculus
tcaaggcttcctacagatgctcgcc

SEQ ID NO: 416788 - DNA, 25 bp, Mus musculus
cccgcgagcttccatggggccaggt

SEQ ID NO: 416789 - DNA, 25 bp, Mus musculus
tgtgcacctttcagccggaaccgag

SEQ ID NO: 416790 - DNA, 25 bp, Mus musculus
ttctgctactttcttgcctggctcc

SEQ ID NO: 416791 - DNA, 25 bp, Mus musculus
cgggctttccctcttcgagcaggag

SEQ ID NO: 416792 - DNA, 25 bp, Mus musculus
ggctctaatttctactgctctccgg

SEQ ID NO: 416793 - DNA, 25 bp, Mus musculus
tcctcttcggcagtttcctctttcg

SEQ ID NO: 416794 - DNA, 25 bp, Mus musculus
cagactaatgctgtagggcggccga

SEQ ID NO: 416795 - DNA, 25 bp, Mus musculus
gttctcccgggccatggcagactaa

SEQ ID NO: 416796 - DNA, 25 bp, Mus musculus
tctgcttgctttttccaggaggagc

SEQ ID NO: 416797 - DNA, 25 bp, Mus musculus
actgctctccggcaaagacttcctg

SEQ ID NO: 416798 - DNA, 25 bp, Mus musculus
tgaggacgcatcgaccagccagttt

SEQ ID NO: 416799 - DNA, 25 bp, Mus musculus
cggactatgggacaatgaggacgca

SEQ ID NO: 416800 - DNA, 25 bp, Mus musculus
tgcagcacttgaccacggagccacg

SEQ ID NO: 416801 - DNA, 25 bp, Mus musculus
gagccctagcctttagggagcttta

SEQ ID NO: 416802 - DNA, 25 bp, Mus musculus
ggggcgccttcgcatacccaagagc

SEQ ID NO: 416803 - DNA, 25 bp, Mus musculus
gagggtctccttgaactcgaagatc

SEQ ID NO: 416804 - DNA, 25 bp, Mus musculus
aatccgctaatcttcccaggcacta

SEQ ID NO: 416805 - DNA, 25 bp, Mus musculus
atcttcccaggcactactcttcgtt

SEQ ID NO: 416806 - DNA, 25 bp, Mus musculus
tggccgcaccacgacgagtggaact

SEQ ID NO: 416807 - DNA, 25 bp, Mus musculus
cgtagccgatgcagtggccgcacca

SEQ ID NO: 416808 - DNA, 25 bp, Mus musculus
ttgcgtcggaggaacgtccaccggc

SEQ ID NO: 416809 - DNA, 25 bp, Mus musculus
ccacgtagctgttgcgtcggaggaa

SEQ ID NO: 416810 - DNA, 25 bp, Mus musculus
ccacgacgagtggaactgcaccagc

SEQ ID NO: 416811 - DNA, 25 bp, Mus musculus
gctgccgcgcataagctcctggatc

SEQ ID NO: 416812 - DNA, 25 bp, Mus musculus
aagagacggtggctgccgcgcataa

SEQ ID NO: 416813 - DNA, 25 bp, Mus musculus
acacggcgtctgagccctcgcggta

SEQ ID NO: 416814 - DNA, 25 bp, Mus musculus
gagctgttgcccgtggccgaccgca

SEQ ID NO: 416815 - DNA, 25 bp, Mus musculus
agccacgcggctgagctgttgcccg

SEQ ID NO: 416816 - DNA, 25 bp, Mus musculus
tggaactgcaccagccacgcggctg

SEQ ID NO: 416817 - DNA, 25 bp, Mus musculus
aggtcccgcacagctcgcttttttg

SEQ ID NO: 416818 - DNA, 25 bp, Mus musculus
agaacaaaggctgctgcggcgacgc

SEQ ID NO: 416819 - DNA, 25 bp, Mus musculus
tgacatcacagctctggcgggaggg

SEQ ID NO: 416820 - DNA, 25 bp, Mus musculus
cagcacatcacttcctcggcgtctc

SEQ ID NO: 416821 - DNA, 25 bp, Mus musculus
acttcctcggcgtctcccgcggacg

SEQ ID NO: 416822 - DNA, 25 bp, Mus musculus
tccaggcgcctctactccaggtagt

SEQ ID NO: 416823 - DNA, 25 bp, Mus musculus
aggcgcctctactccaggtagttca

SEQ ID NO: 416824 - DNA, 25 bp, Mus musculus
gcctctactccaggtagttcaagga

SEQ ID NO: 416825 - DNA, 25 bp, Mus musculus
gaacggggacctgagcggcagacgc

SEQ ID NO: 416826 - DNA, 25 bp, Mus musculus
ccagggcccaaagatcagtttcgcg

SEQ ID NO: 416827 - DNA, 25 bp, Mus musculus
ggcccagaacaaaggctgctgcggc

SEQ ID NO: 416828 - DNA, 25 bp, Mus musculus
acgcgcctccctggatctgcgtagg

SEQ ID NO: 416829 - DNA, 25 bp, Mus musculus
cctccctggatctgcgtagggagcg

SEQ ID NO: 416830 - DNA, 25 bp, Mus musculus
gcccagggcccaaagatcagtttcg

SEQ ID NO: 416831 - DNA, 25 bp, Mus musculus
cgggaggctgccggcccagaacaaa

SEQ ID NO: 416832 - DNA, 25 bp, Mus musculus
tgaagctgcgtcgaccattttggta

SEQ ID NO: 416833 - DNA, 25 bp, Mus musculus
tctctccgcggtctttaggcgagcc

SEQ ID NO: 416834 - DNA, 25 bp, Mus musculus
cgccaccggtgcactgctttctgtt

SEQ ID NO: 416835 - DNA, 25 bp, Mus musculus
acctgcggtagttctcgaagctctc

SEQ ID NO: 416836 - DNA, 25 bp, Mus musculus
ccagctgttctgcatcttgcggagc

SEQ ID NO: 416837 - DNA, 25 bp, Mus musculus
gtcgctgcctgtcgtattcccgcga

SEQ ID NO: 416838 - DNA, 25 bp, Mus musculus
tttcacaattccacagatgctcagc

SEQ ID NO: 416839 - DNA, 25 bp, Mus musculus
acaggctcagctcggtgattatttt

SEQ ID NO: 416840 - DNA, 25 bp, Mus musculus
ttgcatatccaaccaacaggctcag

SEQ ID NO: 416841 - DNA, 25 bp, Mus musculus
accattttggtaacgggcgcagcgg

SEQ ID NO: 416842 - DNA, 25 bp, Mus musculus
ccgggtccgcacactacgaagtagt

SEQ ID NO: 416843 - DNA, 25 bp, Mus musculus
acgagttgatagtggtccgcttcca

SEQ ID NO: 416844 - DNA, 25 bp, Mus musculus
ccttgcaggtgtagacgagttgata

SEQ ID NO: 416845 - DNA, 25 bp, Mus musculus
gcctgcgaatccttagccacctttt

SEQ ID NO: 416846 - DNA, 25 bp, Mus musculus
acagctggcatcatcgcccgggcga

SEQ ID NO: 416847 - DNA, 25 bp, Mus musculus
gctgcagcgcatgcaaccggttaga

SEQ ID NO: 416848 - DNA, 25 bp, Mus musculus
caaccggttagagcagcggttcgga

SEQ ID NO: 416849 - DNA, 25 bp, Mus musculus
ttcggagcacagcacggagcaaatc

SEQ ID NO: 416850 - DNA, 25 bp, Mus musculus
cacggagcaaatccggtcctgcatc

SEQ ID NO: 416851 - DNA, 25 bp, Mus musculus
gtcctgcatctcaccagctagggga

SEQ ID NO: 416852 - DNA, 25 bp, Mus musculus
tctcaccagctaggggacctcggct

SEQ ID NO: 416853 - DNA, 25 bp, Mus musculus
cgggctctccactccagcaatgtcg

SEQ ID NO: 416854 - DNA, 25 bp, Mus musculus
ccaaacttcacagctggcatcatcg

SEQ ID NO: 416855 - DNA, 25 bp, Mus musculus
ggcgaccacacgcagatcatgcttc

SEQ ID NO: 416856 - DNA, 25 bp, Mus musculus
agtaggcttgcaccggaagtcccac

SEQ ID NO: 416857 - DNA, 25 bp, Mus musculus
catgcttctagcagtcgcggaagtc

SEQ ID NO: 416858 - DNA, 25 bp, Mus musculus
tcgcggaagtcagtaggcttgcacc

SEQ ID NO: 416859 - DNA, 25 bp, Mus musculus
ttctaggcatcccttccaaacttca

SEQ ID NO: 416860 - DNA, 25 bp, Mus musculus
gtagcccgacatcgccgcgccctaa

SEQ ID NO: 416861 - DNA, 25 bp, Mus musculus
tcacctgtgtctcctaccgaagcca

SEQ ID NO: 416862 - DNA, 25 bp, Mus musculus
acaaggctccgcgtccgcgatagag

SEQ ID NO: 416863 - DNA, 25 bp, Mus musculus
gctcaccgtcgggaaccacaaggct

SEQ ID NO: 416864 - DNA, 25 bp, Mus musculus
ccagcaccgggctgggcacatagca

SEQ ID NO: 416865 - DNA, 25 bp, Mus musculus
agcgacaacgagagcggcttcaccg

SEQ ID NO: 416866 - DNA, 25 bp, Mus musculus
acgcaggagctgtaagcgacaacga

SEQ ID NO: 416867 - DNA, 25 bp, Mus musculus
gcgctcatagaacgcaggagctgta

SEQ ID NO: 416868 - DNA, 25 bp, Mus musculus
acaagaccggcgctcatagaacgca

SEQ ID NO: 416869 - DNA, 25 bp, Mus musculus
ctcacagtctagctgggggagacaa

SEQ ID NO: 416870 - DNA, 25 bp, Mus musculus
acgtcggccgaaagccgaagagatg

SEQ ID NO: 416871 - DNA, 25 bp, Mus musculus
tagcacataaacgtcggccgaaagc

SEQ ID NO: 416872 - DNA, 25 bp, Mus musculus
tgggcacatagcacataaacgtcgg

SEQ ID NO: 416873 - DNA, 25 bp, Mus musculus
aacgagagcggcttcaccgcgggcc

SEQ ID NO: 416874 - DNA, 25 bp, Mus musculus
cgctagtcttaaaagcgacttcgtg

SEQ ID NO: 416875 - DNA, 25 bp, Mus musculus
cggagctgcacaagtctgtccagca

SEQ ID NO: 416876 - DNA, 25 bp, Mus musculus
tagtcttccggagaactgcccggcc

SEQ ID NO: 416877 - DNA, 25 bp, Mus musculus
cgccggacgcccgaggtctgattca

SEQ ID NO: 416878 - DNA, 25 bp, Mus musculus
aggtctgattcagccgggcccagcg

SEQ ID NO: 416879 - DNA, 25 bp, Mus musculus
cggacctaggccagtcacggtggca

SEQ ID NO: 416880 - DNA, 25 bp, Mus musculus
cagtcacggtggcagctggaacaac

SEQ ID NO: 416881 - DNA, 25 bp, Mus musculus
taaaagcgacttcgtgagaacaggc

SEQ ID NO: 416882 - DNA, 25 bp, Mus musculus
gaagtcagctcgctagtcttaaaag

SEQ ID NO: 416883 - DNA, 25 bp, Mus musculus
gcagctggaacaacgactgcggccc

SEQ ID NO: 416884 - DNA, 25 bp, Mus musculus
tcagtctagtggtcaccctggctca

SEQ ID NO: 416885 - DNA, 25 bp, Mus musculus
ccctggctcaggttccgttctgtag

SEQ ID NO: 416886 - DNA, 25 bp, Mus musculus
ttccgttctgtagtcttccggagaa

SEQ ID NO: 416887 - DNA, 25 bp, Mus musculus
gggctgcacttcacggagctgcaca

SEQ ID NO: 416888 - DNA, 25 bp, Mus musculus
tctaggatttgactggacaggattc

SEQ ID NO: 416889 - DNA, 25 bp, Mus musculus
tttaaatgcgctcgccactccgggc

SEQ ID NO: 416890 - DNA, 25 bp, Mus musculus
agtctttcgctgcttcacccattgc

SEQ ID NO: 416891 - DNA, 25 bp, Mus musculus
ccagaagttccgctgagtccagagc

SEQ ID NO: 416892 - DNA, 25 bp, Mus musculus
ctggttacgctggttctgtcctaca

SEQ ID NO: 416893 - DNA, 25 bp, Mus musculus
cgcctttcgttcgtctccagtcttt

SEQ ID NO: 416894 - DNA, 25 bp, Mus musculus
gagcctttcgtagtgtcccttttga

SEQ ID NO: 416895 - DNA, 25 bp, Mus musculus
ctaggcccgatgctcactgagcctg

SEQ ID NO: 416896 - DNA, 25 bp, Mus musculus
cgtcttcggcgcgtcaatcatacca

SEQ ID NO: 416897 - DNA, 25 bp, Mus musculus
atcttggcacatccggctccaggtg

SEQ ID NO: 416898 - DNA, 25 bp, Mus musculus
tcaggcgccgcgaactgaaacccag

SEQ ID NO: 416899 - DNA, 25 bp, Mus musculus
accctgtgagctgtggttggcttct

SEQ ID NO: 416900 - DNA, 25 bp, Mus musculus
tgcgccaccctgctcgagtagctag

SEQ ID NO: 416901 - DNA, 25 bp, Mus musculus
cccaggcctgactgtgtctctttaa

SEQ ID NO: 416902 - DNA, 25 bp, Mus musculus
cctttcagcgtacaacataagttgg

SEQ ID NO: 416903 - DNA, 25 bp, Mus musculus
tgcatgatcagctgcagcatccagc

SEQ ID NO: 416904 - DNA, 25 bp, Mus musculus
gcagcatccagcgtctcgatccaat

SEQ ID NO: 416905 - DNA, 25 bp, Mus musculus
cgatccaatcttcgaagccatcttg

SEQ ID NO: 416906 - DNA, 25 bp, Mus musculus
catcttgggaaagggcagtccgcta

SEQ ID NO: 416907 - DNA, 25 bp, Mus musculus
acaacataagttggctgaagcagcc

SEQ ID NO: 416908 - DNA, 25 bp, Mus musculus
agcacggaacccagctgcatgatca

SEQ ID NO: 416909 - DNA, 25 bp, Mus musculus
aagggcagtccgctacggcctcagc

SEQ ID NO: 416910 - DNA, 25 bp, Mus musculus
cagcgcgtgagcagcacggaaccca

SEQ ID NO: 416911 - DNA, 25 bp, Mus musculus
ctcggccctttcagcgtacaacata

SEQ ID NO: 416912 - DNA, 25 bp, Mus musculus
tgatacaggcaacttccggtccctg

SEQ ID NO: 416913 - DNA, 25 bp, Mus musculus
caccgcattcgacgacttcgtgggc

SEQ ID NO: 416914 - DNA, 25 bp, Mus musculus
aggcaacttccggtccctgactgtt

SEQ ID NO: 416915 - DNA, 25 bp, Mus musculus
ttcgacgacttcgtgggcgcgctca

SEQ ID NO: 416916 - DNA, 25 bp, Mus musculus
ccacgtacatgaggtgcagctgcga

SEQ ID NO: 416917 - DNA, 25 bp, Mus musculus
cacaaagaacaggagcacgaaggcg

SEQ ID NO: 416918 - DNA, 25 bp, Mus musculus
gcggccgctgccacgtacatgaggt

SEQ ID NO: 416919 - DNA, 25 bp, Mus musculus
gccgctgccacgtacatgaggtgca

SEQ ID NO: 416920 - DNA, 25 bp, Mus musculus
ccgctgccacgtacatgaggtgcag

SEQ ID NO: 416921 - DNA, 25 bp, Mus musculus
ctgccacgtacatgaggtgcagctg

SEQ ID NO: 416922 - DNA, 25 bp, Mus musculus
tgccacgtacatgaggtgcagctgc

SEQ ID NO: 416923 - DNA, 25 bp, Mus musculus
cacgtacatgaggtgcagctgcgag

SEQ ID NO: 416924 - DNA, 25 bp, Mus musculus
cagcggaggctccaccggctcacct

SEQ ID NO: 416925 - DNA, 25 bp, Mus musculus
ctccaccggctcacctgcgggcagg

SEQ ID NO: 416926 - DNA, 25 bp, Mus musculus
aggcaagcacccctcgtcaggcgtg

SEQ ID NO: 416927 - DNA, 25 bp, Mus musculus
cacccctcgtcaggcgtggtgatgc

SEQ ID NO: 416928 - DNA, 25 bp, Mus musculus
ccacaaagaacaggagcacgaaggc

SEQ ID NO: 416929 - DNA, 25 bp, Mus musculus
tacatgaggtgcagctgcgagggca

SEQ ID NO: 416930 - DNA, 25 bp, Mus musculus
tgcgcagggcgcaacagaagtttct

SEQ ID NO: 416931 - DNA, 25 bp, Mus musculus
ctctgatgccctctttcctggcggg

SEQ ID NO: 416932 - DNA, 25 bp, Mus musculus
ctgagctcgagcgtcacataaaacc

SEQ ID NO: 416933 - DNA, 25 bp, Mus musculus
tcctatctacccaaagcgtgcgcag

SEQ ID NO: 416934 - DNA, 25 bp, Mus musculus
gcagctggtcccttactcctatcta

SEQ ID NO: 416935 - DNA, 25 bp, Mus musculus
tggctctcaactctggcagctggtc

SEQ ID NO: 416936 - DNA, 25 bp, Mus musculus
gaagggtcctcctcacacgccagga

SEQ ID NO: 416937 - DNA, 25 bp, Mus musculus
ggcgctatgagaaaagtgggtaccc

SEQ ID NO: 416938 - DNA, 25 bp, Mus musculus
cttccagcgtctttgggcgctatga

SEQ ID NO: 416939 - DNA, 25 bp, Mus musculus
agcgtctacccaagtgcgagccagg

SEQ ID NO: 416940 - DNA, 25 bp, Mus musculus
ccatactaggagtccagggcacatc

SEQ ID NO: 416941 - DNA, 25 bp, Mus musculus
ttccgaaatgagtcagtcccacgcc

SEQ ID NO: 416942 - DNA, 25 bp, Mus musculus
ggctcccgttccaatcagcacagga

SEQ ID NO: 416943 - DNA, 25 bp, Mus musculus
ggcaggcagttctctccttcgatta

SEQ ID NO: 416944 - DNA, 25 bp, Mus musculus
atcgggggcggccactcaggcaact

SEQ ID NO: 416945 - DNA, 25 bp, Mus musculus
actcaggcaactccgggcgatcgca

SEQ ID NO: 416946 - DNA, 25 bp, Mus musculus
ctggtcacagcaccccatagcgtag

SEQ ID NO: 416947 - DNA, 25 bp, Mus musculus
caactccgggcgatcgcagggaccg

SEQ ID NO: 416948 - DNA, 25 bp, Mus musculus
acccggactgtcgggtgccgagatc

SEQ ID NO: 416949 - DNA, 25 bp, Mus musculus
cccatagcgtagctcagtccggtcg

SEQ ID NO: 416950 - DNA, 25 bp, Mus musculus
ccttacccatcttggctatacgacc

SEQ ID NO: 416951 - DNA, 25 bp, Mus musculus
cagcggtcctgagaaatggcgaccc

SEQ ID NO: 416952 - DNA, 25 bp, Mus musculus
gcccagcggtcctgagaaatggcga

SEQ ID NO: 416953 - DNA, 25 bp, Mus musculus
atgagcccagcggtcctgagaaatg

SEQ ID NO: 416954 - DNA, 25 bp, Mus musculus
ccgggaaaatgagcccagcggtcct

SEQ ID NO: 416955 - DNA, 25 bp, Mus musculus
agccatggctgagccgcgcttggac

SEQ ID NO: 416956 - DNA, 25 bp, Mus musculus
cgagagccatggctgagccgcgctt

SEQ ID NO: 416957 - DNA, 25 bp, Mus musculus
atagcgtagctcagtccggtcggtc

SEQ ID NO: 416958 - DNA, 25 bp, Mus musculus
gggcgcgagccaacctcggtactaa

SEQ ID NO: 416959 - DNA, 25 bp, Mus musculus
tctgtatgcacctcgacccggaagg

SEQ ID NO: 416960 - DNA, 25 bp, Mus musculus
ggtccgtaaaagtccgctggcgcta

SEQ ID NO: 416961 - DNA, 25 bp, Mus musculus
gaagtgccgaccgagccgtcttaaa

SEQ ID NO: 416962 - DNA, 25 bp, Mus musculus
tgtatgcttagcgtgcccacacaga

SEQ ID NO: 416963 - DNA, 25 bp, Mus musculus
acatctccgctttcgtctgtatgca

SEQ ID NO: 416964 - DNA, 25 bp, Mus musculus
cccggaaggtaatcatctgaagcta

SEQ ID NO: 416965 - DNA, 25 bp, Mus musculus
agctagctgagcttctacgggtgcc

SEQ ID NO: 416966 - DNA, 25 bp, Mus musculus
aggacgtgtgcacatcctccttgca

SEQ ID NO: 416967 - DNA, 25 bp, Mus musculus
tggcgcctgattctacggagactgc

SEQ ID NO: 416968 - DNA, 25 bp, Mus musculus
cacatcccacagtttagtgtaggta

SEQ ID NO: 416969 - DNA, 25 bp, Mus musculus
cgctagactctagagccatggtaga

SEQ ID NO: 416970 - DNA, 25 bp, Mus musculus
cacaaccgatggtgcccagagtaca

SEQ ID NO: 416971 - DNA, 25 bp, Mus musculus
cggagactgcagcttctgcctgatc

SEQ ID NO: 416972 - DNA, 25 bp, Mus musculus
cggctcagctgcacaagcagcaaca

SEQ ID NO: 416973 - DNA, 25 bp, Mus musculus
gagcacgcagtagagaccgaccttg

SEQ ID NO: 416974 - DNA, 25 bp, Mus musculus
tccctctcccaaagctagcggcgcg

SEQ ID NO: 416975 - DNA, 25 bp, Mus musculus
tagaacctggctgtgcggctcagct

SEQ ID NO: 416976 - DNA, 25 bp, Mus musculus
tagagaccgaccttggcgtagaacc

SEQ ID NO: 416977 - DNA, 25 bp, Mus musculus
acaggcagagcacgcagtagagacc

SEQ ID NO: 416978 - DNA, 25 bp, Mus musculus
atgttatccacggtgcggccgccgt

SEQ ID NO: 416979 - DNA, 25 bp, Mus musculus
cccttgcctcatgttatccacggtg

SEQ ID NO: 416980 - DNA, 25 bp, Mus musculus
tcagaagttaggaaagcggaagcgc

SEQ ID NO: 416981 - DNA, 25 bp, Mus musculus
aagaacgcgaggagctcagaagtta

SEQ ID NO: 416982 - DNA, 25 bp, Mus musculus
tacaagcggcgcacatcgtgacacg

SEQ ID NO: 416983 - DNA, 25 bp, Mus musculus
agggccgagccctacaagcggcgca

SEQ ID NO: 416984 - DNA, 25 bp, Mus musculus
ggcgcgcgcaaacccgacactccac

SEQ ID NO: 416985 - DNA, 25 bp, Mus musculus
accgaccttggcgtagaacctggct

SEQ ID NO: 416986 - DNA, 25 bp, Mus musculus
ggaccttacaggtcctcagcgccag

SEQ ID NO: 416987 - DNA, 25 bp, Mus musculus
cgtcgcggtccttgctcagaaaggc

SEQ ID NO: 416988 - DNA, 25 bp, Mus musculus
aaggcacgcgccttgcctttaacgc

SEQ ID NO: 416989 - DNA, 25 bp, Mus musculus
ccggccaggtgctaccacacgggga

SEQ ID NO: 416990 - DNA, 25 bp, Mus musculus
cttgctcagaaaggcacgcgccttg

SEQ ID NO: 416991 - DNA, 25 bp, Mus musculus
gcgcttggtgcacctagtgctcctc

SEQ ID NO: 416992 - DNA, 25 bp, Mus musculus
caggcggggaccttacaggtcctca

SEQ ID NO: 416993 - DNA, 25 bp, Mus musculus
cggtgtttcatgctcacacagggtt

SEQ ID NO: 416994 - DNA, 25 bp, Mus musculus
ttccgtttgtctccacacgcgcgcg

SEQ ID NO: 416995 - DNA, 25 bp, Mus musculus
cccagcgggagagctagactagccg

SEQ ID NO: 416996 - DNA, 25 bp, Mus musculus
ttggtgcacctagtgctcctctgcc

SEQ ID NO: 416997 - DNA, 25 bp, Mus musculus
tcacacagggttgccgtagcgggtc

SEQ ID NO: 416998 - DNA, 25 bp, Mus musculus
cctttaacgcgagccgaggacgagc

SEQ ID NO: 416999 - DNA, 25 bp, Mus musculus
ttcatgctcacacagggttgccgta

SEQ ID NO: 417000 - DNA, 25 bp, Mus musculus
cgatacaaacatagagccgccatgg

SEQ ID NO: 417001 - DNA, 25 bp, Mus musculus
cacgccacgtcctttatagtactga

SEQ ID NO: 417002 - DNA, 25 bp, Mus musculus
ccgcggcgtcccaacggtaacaatg

SEQ ID NO: 417003 - DNA, 25 bp, Mus musculus
taccacgcggttagcctgctgcaca

SEQ ID NO: 417004 - DNA, 25 bp, Mus musculus
atagtactgactacggcagcccgcg

SEQ ID NO: 417005 - DNA, 25 bp, Mus musculus
ccaacggtaacaatggcgatacaaa

SEQ ID NO: 417006 - DNA, 25 bp, Mus musculus
ccggccaagggtatatagggtcatc

SEQ ID NO: 417007 - DNA, 25 bp, Mus musculus
gcagtcttcccggtagccggccaag

SEQ ID NO: 417008 - DNA, 25 bp, Mus musculus
cgatcgtcaggagacgcagtcttcc

SEQ ID NO: 417009 - DNA, 25 bp, Mus musculus
gcacggtacatcttcgttacgatcg

SEQ ID NO: 417010 - DNA, 25 bp, Mus musculus
tctcagaaggaaagcacggtacatc

SEQ ID NO: 417011 - DNA, 25 bp, Mus musculus
ttagggcgactaaactctcagaagg

SEQ ID NO: 417012 - DNA, 25 bp, Mus musculus
cctgctgcacatattagggcgacta

SEQ ID NO: 417013 - DNA, 25 bp, Mus musculus
agggactttcactgtcctccgagtg

SEQ ID NO: 417014 - DNA, 25 bp, Mus musculus
acgaccctgactcgcggtcattccc

SEQ ID NO: 417015 - DNA, 25 bp, Mus musculus
tctgtcatccctgtgcctcaccgtg

SEQ ID NO: 417016 - DNA, 25 bp, Mus musculus
ttccaccgcgtcaatcacccccagg

SEQ ID NO: 417017 - DNA, 25 bp, Mus musculus
ggtgccgccgccgatgccatccccc

SEQ ID NO: 417018 - DNA, 25 bp, Mus musculus
ctgcctcatagcctcccttagctcc

SEQ ID NO: 417019 - DNA, 25 bp, Mus musculus
tagcctcccttagctcccgggcatc

SEQ ID NO: 417020 - DNA, 25 bp, Mus musculus
cctgcctctgtcatccctgtgcctc

SEQ ID NO: 417021 - DNA, 25 bp, Mus musculus
atccctgtgcctcaccgtgtccagc

SEQ ID NO: 417022 - DNA, 25 bp, Mus musculus
cgtgtccagccgctcgtgggcttct

SEQ ID NO: 417023 - DNA, 25 bp, Mus musculus
gtgtccagccgctcgtgggcttctc

SEQ ID NO: 417024 - DNA, 25 bp, Mus musculus
gtccagccgctcgtgggcttctccc

SEQ ID NO: 417025 - DNA, 25 bp, Mus musculus
ccacacacagtgcacgaccctgact

SEQ ID NO: 417026 - DNA, 25 bp, Mus musculus
tgcacgaccctgactcgcggtcatt

SEQ ID NO: 417027 - DNA, 25 bp, Mus musculus
agtgcacgaccctgactcgcggtca

SEQ ID NO: 417028 - DNA, 25 bp, Mus musculus
aagataggtatccttggccaggaga

SEQ ID NO: 417029 - DNA, 25 bp, Mus musculus
cttggccaagtcctgaagataggta

SEQ ID NO: 417030 - DNA, 25 bp, Mus musculus
cggaagtatcttatgcgcagacgca

SEQ ID NO: 417031 - DNA, 25 bp, Mus musculus
gctgcgcgcagatcttcttggccaa

SEQ ID NO: 417032 - DNA, 25 bp, Mus musculus
catgtgctcctctgtcgttcagggc

SEQ ID NO: 417033 - DNA, 25 bp, Mus musculus
tcccaaaagctgctcgagccggatg

SEQ ID NO: 417034 - DNA, 25 bp, Mus musculus
tactgacggcgtctgctcccaaaag

SEQ ID NO: 417035 - DNA, 25 bp, Mus musculus
taggacagcgggctccttactgacg

SEQ ID NO: 417036 - DNA, 25 bp, Mus musculus
caggagagaagccatgctgccaacc

SEQ ID NO: 417037 - DNA, 25 bp, Mus musculus
gccaaccaaggctgggaccagaata

SEQ ID NO: 417038 - DNA, 25 bp, Mus musculus
cagaataggaagctcccgcggtgga

SEQ ID NO: 417039 - DNA, 25 bp, Mus musculus
gccggaagctccgtacacgcaggta

SEQ ID NO: 417040 - DNA, 25 bp, Mus musculus
taccaccagtagagcggcgtgaccc

SEQ ID NO: 417041 - DNA, 25 bp, Mus musculus
gctcgaactcatatcccttgcgggg

SEQ ID NO: 417042 - DNA, 25 bp, Mus musculus
ggaccgggatttccgatacaacagc

SEQ ID NO: 417043 - DNA, 25 bp, Mus musculus
tctctcttccgtacagcccaaaggg

SEQ ID NO: 417044 - DNA, 25 bp, Mus musculus
gcgaccgactcacaggcaatgactc

SEQ ID NO: 417045 - DNA, 25 bp, Mus musculus
ctctcgcgatatctgcggccactta

SEQ ID NO: 417046 - DNA, 25 bp, Mus musculus
tgtcgctttaaatccgaaatcccgc

SEQ ID NO: 417047 - DNA, 25 bp, Mus musculus
ctgtcagagtccgaagtgggtcctt

SEQ ID NO: 417048 - DNA, 25 bp, Mus musculus
cgagggaacaaagcacccgcacgct

SEQ ID NO: 417049 - DNA, 25 bp, Mus musculus
ggcccaagaacttcggcattggtaa

SEQ ID NO: 417050 - DNA, 25 bp, Mus musculus
ccttgacgggcaatggactgaatga

SEQ ID NO: 417051 - DNA, 25 bp, Mus musculus
gatacaacagctccgtccacgaaca

SEQ ID NO: 417052 - DNA, 25 bp, Mus musculus
tggtccggcccgaaccgagtactga

SEQ ID NO: 417053 - DNA, 25 bp, Mus musculus
cctctgttcgagaagaggcccaaga

SEQ ID NO: 417054 - DNA, 25 bp, Mus musculus
agcaggcccttacggcgagggaaca

SEQ ID NO: 417055 - DNA, 25 bp, Mus musculus
ctgcccgatggcacgggtttctctc

SEQ ID NO: 417056 - DNA, 25 bp, Mus musculus
cggggtccacgcagagaaggatact

SEQ ID NO: 417057 - DNA, 25 bp, Mus musculus
ccgccatcttgggagagcagccgcg

SEQ ID NO: 417058 - DNA, 25 bp, Mus musculus
caccgcacctacacgccggcccggc

SEQ ID NO: 417059 - DNA, 25 bp, Mus musculus
agtactcgcccggaggtgccgccat

SEQ ID NO: 417060 - DNA, 25 bp, Mus musculus
aacgctgaagtactcgcccggaggt

SEQ ID NO: 417061 - DNA, 25 bp, Mus musculus
tggctcccaacgctgaagtactcgc

SEQ ID NO: 417062 - DNA, 25 bp, Mus musculus
gctcctggcacgtccggcacgacac

SEQ ID NO: 417063 - DNA, 25 bp, Mus musculus
ggtagtcgaaggctaccacctcgcc

SEQ ID NO: 417064 - DNA, 25 bp, Mus musculus
tttggactggtagtcgaaggctacc

SEQ ID NO: 417065 - DNA, 25 bp, Mus musculus
ccacgcagagaaggatacttagagc

SEQ ID NO: 417066 - DNA, 25 bp, Mus musculus
ccagcattttggactggtagtcgaa

SEQ ID NO: 417067 - DNA, 25 bp, Mus musculus
acacctggctcccaacgctgaagta

SEQ ID NO: 417068 - DNA, 25 bp, Mus musculus
aggatacttagagccagcattttgg

SEQ ID NO: 417069 - DNA, 25 bp, Mus musculus
atctcacggccatgcgcatgcgccc

SEQ ID NO: 417070 - DNA, 25 bp, Mus musculus
gcccagcacaaagaatcggtacgta

SEQ ID NO: 417071 - DNA, 25 bp, Mus musculus
cttccgggaccgagaaatctgcttc

SEQ ID NO: 417072 - DNA, 25 bp, Mus musculus
aatctgcttccttccgggacggcgc

SEQ ID NO: 417073 - DNA, 25 bp, Mus musculus
agatgggcatctccgatcatggacg

SEQ ID NO: 417074 - DNA, 25 bp, Mus musculus
catggacgaaccaccctctgatgtg

SEQ ID NO: 417075 - DNA, 25 bp, Mus musculus
cccgcaaggtcggaagagaaccgtg

SEQ ID NO: 417076 - DNA, 25 bp, Mus musculus
gacccgggagtattgtgcctggaaa

SEQ ID NO: 417077 - DNA, 25 bp, Mus musculus
tgaccagatgctcatccgcaggttc

SEQ ID NO: 417078 - DNA, 25 bp, Mus musculus
ttcgctgctccctaactggccatga

SEQ ID NO: 417079 - DNA, 25 bp, Mus musculus
cgtctgcccgagctccaggaataca

SEQ ID NO: 417080 - DNA, 25 bp, Mus musculus
cggcaagaagtaccaacggctgtca

SEQ ID NO: 417081 - DNA, 25 bp, Mus musculus
agcagccatctttgagcacttccgg

SEQ ID NO: 417082 - DNA, 25 bp, Mus musculus
tacgcagctttcgagccacacattg

SEQ ID NO: 417083 - DNA, 25 bp, Mus musculus
acggctgtcaagttccttctctaac

SEQ ID NO: 417084 - DNA, 25 bp, Mus musculus
cctggtcggcgaagtcctcggccgt

SEQ ID NO: 417085 - DNA, 25 bp, Mus musculus
atcaggtcgttctgtcccatggcgg

SEQ ID NO: 417086 - DNA, 25 bp, Mus musculus
ctagaacccgaagcgctgaccactt

SEQ ID NO: 417087 - DNA, 25 bp, Mus musculus
ttcagcctctagaacccgaagcgct

SEQ ID NO: 417088 - DNA, 25 bp, Mus musculus
tgccacgtaggccaagccttaaagg

SEQ ID NO: 417089 - DNA, 25 bp, Mus musculus
ctgctctagcggctgccacgtaggc

SEQ ID NO: 417090 - DNA, 25 bp, Mus musculus
tctccgtagagctaggcaggacggc

SEQ ID NO: 417091 - DNA, 25 bp, Mus musculus
ctcagctggcaggtcctgggcgctc

SEQ ID NO: 417092 - DNA, 25 bp, Mus musculus
cagcgtggacccagatcgggcaacc

SEQ ID NO: 417093 - DNA, 25 bp, Mus musculus
tcggccgtgcccatcaggtcgttct

SEQ ID NO: 417094 - DNA, 25 bp, Mus musculus
caggccgcacctggtcggcgaagtc

SEQ ID NO: 417095 - DNA, 25 bp, Mus musculus
ccctcggatttctccgtagagctag

SEQ ID NO: 417096 - DNA, 25 bp, Mus musculus
ccacgcaaagaaggaagggccagga

SEQ ID NO: 417097 - DNA, 25 bp, Mus musculus
tgcggcctccacaggaagtacccgg

SEQ ID NO: 417098 - DNA, 25 bp, Mus musculus
gcgcggtggccttcgtcttcatctc

SEQ ID NO: 417099 - DNA, 25 bp, Mus musculus
gcgtgctccactgcgcatgcgggaa

SEQ ID NO: 417100 - DNA, 25 bp, Mus musculus
ggttgctgttctcttcgcgacctgc

SEQ ID NO: 417101 - DNA, 25 bp, Mus musculus
atttcccagggtgcaagcgtgctcc

SEQ ID NO: 417102 - DNA, 25 bp, Mus musculus
cacgtatgcggactctgcgactagc

SEQ ID NO: 417103 - DNA, 25 bp, Mus musculus
cgcagtcggaaccaccagggaagag

SEQ ID NO: 417104 - DNA, 25 bp, Mus musculus
cgagcttcctgataggcccaggttg

SEQ ID NO: 417105 - DNA, 25 bp, Mus musculus
cttggctttcttcctagcgagcttc

SEQ ID NO: 417106 - DNA, 25 bp, Mus musculus
ttgctcttcctgaacttcttcttgg

SEQ ID NO: 417107 - DNA, 25 bp, Mus musculus
acttcctgccagagctttgctcttc

SEQ ID NO: 417108 - DNA, 25 bp, Mus musculus
ctgcatctttggttccgcacgtatg

SEQ ID NO: 417109 - DNA, 25 bp, Mus musculus
cgcgacctgctagaaaccgagactg

SEQ ID NO: 417110 - DNA, 25 bp, Mus musculus
tgcaacgccttccaattttgagaaa

SEQ ID NO: 417111 - DNA, 25 bp, Mus musculus
gaagagaccgcgactccagcaaccg

SEQ ID NO: 417112 - DNA, 25 bp, Mus musculus
tccaccgccggaactcgatggctta

SEQ ID NO: 417113 - DNA, 25 bp, Mus musculus
gactcacagaggacgcgcgtctgcc

SEQ ID NO: 417114 - DNA, 25 bp, Mus musculus
ccgcgcgcgggtggacacgtctctt

SEQ ID NO: 417115 - DNA, 25 bp, Mus musculus
gtggacacgtctctttgtgcgcgcc

SEQ ID NO: 417116 - DNA, 25 bp, Mus musculus
acacgtctctttgtgcgcgcctggg

SEQ ID NO: 417117 - DNA, 25 bp, Mus musculus
gctgcgcgcagcgtttagcatgagc

SEQ ID NO: 417118 - DNA, 25 bp, Mus musculus
cgcagcgtttagcatgagcggctcg

SEQ ID NO: 417119 - DNA, 25 bp, Mus musculus
gcatgacttggtggtaccgctggct

SEQ ID NO: 417120 - DNA, 25 bp, Mus musculus
tcgatggcttactgcccagttgttg

SEQ ID NO: 417121 - DNA, 25 bp, Mus musculus
tactgcccagttgttgcggccctga

SEQ ID NO: 417122 - DNA, 25 bp, Mus musculus
ttgcggccctgatcagaggaaatga

SEQ ID NO: 417123 - DNA, 25 bp, Mus musculus
ccctgatcagaggaaatgagactca

SEQ ID NO: 417124 - DNA, 25 bp, Mus musculus
atgagactcacagaggacgcgcgtc

SEQ ID NO: 417125 - DNA, 25 bp, Mus musculus
ccggaactcgatggcttactgccca

SEQ ID NO: 417126 - DNA, 25 bp, Mus musculus
ggagcaaaccgggacttctgagttc

SEQ ID NO: 417127 - DNA, 25 bp, Mus musculus
ctcctcgcctcctaaggggagcaaa

SEQ ID NO: 417128 - DNA, 25 bp, Mus musculus
accgcgttgctatggtcaccgttgg

SEQ ID NO: 417129 - DNA, 25 bp, Mus musculus
gacgtccaccgcgttgctatggtca

SEQ ID NO: 417130 - DNA, 25 bp, Mus musculus
atgtgacatgcgctctaggctcctc

SEQ ID NO: 417131 - DNA, 25 bp, Mus musculus
tccgcccacagagtcatgtgacatg

SEQ ID NO: 417132 - DNA, 25 bp, Mus musculus
tcctcacgactctggcctaggcggc

SEQ ID NO: 417133 - DNA, 25 bp, Mus musculus
ggacttctgagttcccgtgacccgc

SEQ ID NO: 417134 - DNA, 25 bp, Mus musculus
tgagttcccgtgacccgccgggcaa

SEQ ID NO: 417135 - DNA, 25 bp, Mus musculus
gttcgcgctccagccaccacactca

SEQ ID NO: 417136 - DNA, 25 bp, Mus musculus
tgcccacagcccgaaaggacccgcg

SEQ ID NO: 417137 - DNA, 25 bp, Mus musculus
ttgctatggtcaccgttggcgcggc

SEQ ID NO: 417138 - DNA, 25 bp, Mus musculus
cccaaggagtaagcgactccactgc

SEQ ID NO: 417139 - DNA, 25 bp, Mus musculus
gagtaagcgactccactgcccacag

SEQ ID NO: 417140 - DNA, 25 bp, Mus musculus
tgagccctcagcacagcaggcgaag

SEQ ID NO: 417141 - DNA, 25 bp, Mus musculus
gtgtcccatcgcgtgcgccttgagg

SEQ ID NO: 417142 - DNA, 25 bp, Mus musculus
cacgcctcggatgcagggtgcgatc

SEQ ID NO: 417143 - DNA, 25 bp, Mus musculus
tgtccaatgagacagccgcacgcct

SEQ ID NO: 417144 - DNA, 25 bp, Mus musculus
tgcagagccgtgctgtccaatgaga

SEQ ID NO: 417145 - DNA, 25 bp, Mus musculus
agcaggcgaagctccgccctacaga

SEQ ID NO: 417146 - DNA, 25 bp, Mus musculus
gcgctggattctgccggggaaaccc

SEQ ID NO: 417147 - DNA, 25 bp, Mus musculus
gctaaagcatctgcctgagccctca

SEQ ID NO: 417148 - DNA, 25 bp, Mus musculus
cgggactccactgcagagctaaagc

SEQ ID NO: 417149 - DNA, 25 bp, Mus musculus
gatggtcagatacagcgggactcca

SEQ ID NO: 417150 - DNA, 25 bp, Mus musculus
ctcggttcttagcaggggttcctgc

SEQ ID NO: 417151 - DNA, 25 bp, Mus musculus
tcatagtcgagtccctcggttctta

SEQ ID NO: 417152 - DNA, 25 bp, Mus musculus
acctcggggaaggtatcatagtcga

SEQ ID NO: 417153 - DNA, 25 bp, Mus musculus
cgccctacagatgcgattggctgca

SEQ ID NO: 417154 - DNA, 25 bp, Mus musculus
aatgcacagcgaagtcgggttcctc

SEQ ID NO: 417155 - DNA, 25 bp, Mus musculus
cgttggtcaacacgaggttgcggtt

SEQ ID NO: 417156 - DNA, 25 bp, Mus musculus
aggcccgttggtcaacacgaggttg

SEQ ID NO: 417157 - DNA, 25 bp, Mus musculus
cagctgggtagagagcaggcccgtt

SEQ ID NO: 417158 - DNA, 25 bp, Mus musculus
cttttggctgaaagaggtggtggca

SEQ ID NO: 417159 - DNA, 25 bp, Mus musculus
cctgcggggacttttggctgaaaga

SEQ ID NO: 417160 - DNA, 25 bp, Mus musculus
gcggctcgtagtgggagcagctgcg

SEQ ID NO: 417161 - DNA, 25 bp, Mus musculus
caggaagaaggtgggcggctcgtag

SEQ ID NO: 417162 - DNA, 25 bp, Mus musculus
aagtcttcgtcctctggctcctgca

SEQ ID NO: 417163 - DNA, 25 bp, Mus musculus
caaagtcttcgtcctctggctcctg

SEQ ID NO: 417164 - DNA, 25 bp, Mus musculus
gttgcgcacaccctcaaagtcttcg

SEQ ID NO: 417165 - DNA, 25 bp, Mus musculus
cagcgaagtcgggttcctcctcgtc

SEQ ID NO: 417166 - DNA, 25 bp, Mus musculus
gcacagcgaagtcgggttcctcctc

SEQ ID NO: 417167 - DNA, 25 bp, Mus musculus
caacacgaggttgcggttggaatgc

SEQ ID NO: 417168 - DNA, 25 bp, Mus musculus
gcgttgcttgctctcacaccgtgac

SEQ ID NO: 417169 - DNA, 25 bp, Mus musculus
ccctggtgctgacgctggtccgcgt

SEQ ID NO: 417170 - DNA, 25 bp, Mus musculus
gggcttcccagcctgcgttgcttgc

SEQ ID NO: 417171 - DNA, 25 bp, Mus musculus
ttgcttgctctcacaccgtgacctg

SEQ ID NO: 417172 - DNA, 25 bp, Mus musculus
cttgaaccatgggaaccacgctgcc

SEQ ID NO: 417173 - DNA, 25 bp, Mus musculus
ctctgtccggggcacagcgagtagc

SEQ ID NO: 417174 - DNA, 25 bp, Mus musculus
ggcacagcgagtagcagcaaatgca

SEQ ID NO: 417175 - DNA, 25 bp, Mus musculus
agcagcaaatgcagcccaggccgag

SEQ ID NO: 417176 - DNA, 25 bp, Mus musculus
ctggcaaagtgagcgccaagagact

SEQ ID NO: 417177 - DNA, 25 bp, Mus musculus
agcgccaagagactcctggaggccc

SEQ ID NO: 417178 - DNA, 25 bp, Mus musculus
caagtgcgtggccaggagagactct

SEQ ID NO: 417179 - DNA, 25 bp, Mus musculus
gccaggagagactctctgccagctg

SEQ ID NO: 417180 - DNA, 25 bp, Mus musculus
cgcttggcccttaccttgaaccatg

SEQ ID NO: 417181 - DNA, 25 bp, Mus musculus
acacccagctgcctctctgcgagcg

SEQ ID NO: 417182 - DNA, 25 bp, Mus musculus
atgtccttaaggtcgatggaaccgg

SEQ ID NO: 417183 - DNA, 25 bp, Mus musculus
gcaggaccttgcagtcgatgagcca

SEQ ID NO: 417184 - DNA, 25 bp, Mus musculus
agcgctccggccaaagtgcggtgac

SEQ ID NO: 417185 - DNA, 25 bp, Mus musculus
ggtcgaagaccaccgccgagggcca

SEQ ID NO: 417186 - DNA, 25 bp, Mus musculus
agcgcctgcgccaggtcgaagacca

SEQ ID NO: 417187 - DNA, 25 bp, Mus musculus
agcgtgcggggtccctctttcacac

SEQ ID NO: 417188 - DNA, 25 bp, Mus musculus
tcctgcagtcgcagcgcttctcgat

SEQ ID NO: 417189 - DNA, 25 bp, Mus musculus
ctttagccaacttcgcgccttcggg

SEQ ID NO: 417190 - DNA, 25 bp, Mus musculus
accgccgctctctagagcgggaaga

SEQ ID NO: 417191 - DNA, 25 bp, Mus musculus
gggatgtgacctgctctgcactgac

SEQ ID NO: 417192 - DNA, 25 bp, Mus musculus
tgagccagaagctccggccagagaa

SEQ ID NO: 417193 - DNA, 25 bp, Mus musculus
tcacctgggacatctgcggccggaa

SEQ ID NO: 417194 - DNA, 25 bp, Mus musculus
tgcggccggaagttgatgtccttaa

SEQ ID NO: 417195 - DNA, 25 bp, Mus musculus
tggcacagaaggacgccgtcgcgca

SEQ ID NO: 417196 - DNA, 25 bp, Mus musculus
ctgcttcgctggagcatccgggcaa

SEQ ID NO: 417197 - DNA, 25 bp, Mus musculus
gagcatccgggcaagcggtgacttt

SEQ ID NO: 417198 - DNA, 25 bp, Mus musculus
cgcccacagaatgatcgatgtgtcc

SEQ ID NO: 417199 - DNA, 25 bp, Mus musculus
atgatcgatgtgtccgtctgcaggc

SEQ ID NO: 417200 - DNA, 25 bp, Mus musculus
tgtccgtctgcaggctggtcctcgg

SEQ ID NO: 417201 - DNA, 25 bp, Mus musculus
acgcctgcgacgctgccatggagac

SEQ ID NO: 417202 - DNA, 25 bp, Mus musculus
gacgctgccatggagacgtagccgc

SEQ ID NO: 417203 - DNA, 25 bp, Mus musculus
catggagacgtagccgcggcctcct

SEQ ID NO: 417204 - DNA, 25 bp, Mus musculus
ggacctggatcccttgcgtcagcag

SEQ ID NO: 417205 - DNA, 25 bp, Mus musculus
tggatcccttgcgtcagcaggccca

SEQ ID NO: 417206 - DNA, 25 bp, Mus musculus
gagcgccggtggcaaagtctgcttc

SEQ ID NO: 417207 - DNA, 25 bp, Mus musculus
cggtggcaaagtctgcttcgctgga

SEQ ID NO: 417208 - DNA, 25 bp, Mus musculus
gcaaagtctgcttcgctggagcatc

SEQ ID NO: 417209 - DNA, 25 bp, Mus musculus
caagcggtgactttgctggccgctg

SEQ ID NO: 417210 - DNA, 25 bp, Mus musculus
cccggtctgaaactcgggactctga

SEQ ID NO: 417211 - DNA, 25 bp, Mus musculus
cgactcgttgggagagttcatgccg

SEQ ID NO: 417212 - DNA, 25 bp, Mus musculus
agttcatgccggctctgggcctgca

SEQ ID NO: 417213 - DNA, 25 bp, Mus musculus
gagctgctgtgatgtcaagagagac

SEQ ID NO: 417214 - DNA, 25 bp, Mus musculus
caagagagacagacgataacagaca

SEQ ID NO: 417215 - DNA, 25 bp, Mus musculus
agacagacgataacagacagacgga

SEQ ID NO: 417216 - DNA, 25 bp, Mus musculus
agcccagggccgcagtgcctctaat

SEQ ID NO: 417217 - DNA, 25 bp, Mus musculus
cagtgcctctaatgcccatccaagg

SEQ ID NO: 417218 - DNA, 25 bp, Mus musculus
ggcgaggcagtcaggcactcagaac

SEQ ID NO: 417219 - DNA, 25 bp, Mus musculus
aattttggagcgatcgagcatctcg

SEQ ID NO: 417220 - DNA, 25 bp, Mus musculus
actcagaacggcatccctggggaga

SEQ ID NO: 417221 - DNA, 25 bp, Mus musculus
actcgggactctgagagacaatttt

SEQ ID NO: 417222 - DNA, 25 bp, Mus musculus
gagacaattttggagcgatcgagca

SEQ ID NO: 417223 - DNA, 25 bp, Mus musculus
agtcaggcactcagaacggcatccc

SEQ ID NO: 417224 - DNA, 25 bp, Mus musculus
aaaggcgtacttggcctaggcggct

SEQ ID NO: 417225 - DNA, 25 bp, Mus musculus
aacgcagttagcaccctggggtcac

SEQ ID NO: 417226 - DNA, 25 bp, Mus musculus
tccagaagcctaggaaaacgtggga

SEQ ID NO: 417227 - DNA, 25 bp, Mus musculus
ataagaactggtgggcggatttcca

SEQ ID NO: 417228 - DNA, 25 bp, Mus musculus
cgttctcagccacacgcagggaata

SEQ ID NO: 417229 - DNA, 25 bp, Mus musculus
gcgcgccttcactttagcgttctca

SEQ ID NO: 417230 - DNA, 25 bp, Mus musculus
aggcgacgctggaaccttggcccgc

SEQ ID NO: 417231 - DNA, 25 bp, Mus musculus
gaggcgcacggactacatgtcccgg

SEQ ID NO: 417232 - DNA, 25 bp, Mus musculus
gcagcataatagacgcgccggagct

SEQ ID NO: 417233 - DNA, 25 bp, Mus musculus
gaggcctgcaccatgcgttccgggc

SEQ ID NO: 417234 - DNA, 25 bp, Mus musculus
cgccgcccagagtgtacaaggaaac

SEQ ID NO: 417235 - DNA, 25 bp, Mus musculus
gttccgggccgtgttctctcagcca

SEQ ID NO: 417236 - DNA, 25 bp, Mus musculus
gctttgttgcatcgcggccgcgcac

SEQ ID NO: 417237 - DNA, 25 bp, Mus musculus
agctgtacagggctcatgcgctacg

SEQ ID NO: 417238 - DNA, 25 bp, Mus musculus
cactgggagtggaattctctgtctc

SEQ ID NO: 417239 - DNA, 25 bp, Mus musculus
tgccgcctagtccagcagatcgtct

SEQ ID NO: 417240 - DNA, 25 bp, Mus musculus
taggaagcgagaaccacagacggcc

SEQ ID NO: 417241 - DNA, 25 bp, Mus musculus
gctccgcctcctctagtttttctga

SEQ ID NO: 417242 - DNA, 25 bp, Mus musculus
tagtttttctgaccctcgtcgccgc

SEQ ID NO: 417243 - DNA, 25 bp, Mus musculus
ccagtagcggtcaaataggaagcga

SEQ ID NO: 417244 - DNA, 25 bp, Mus musculus
ttctctgtctcatcggggacaccca

SEQ ID NO: 417245 - DNA, 25 bp, Mus musculus
tcacacctcagactggcgtcactgg

SEQ ID NO: 417246 - DNA, 25 bp, Mus musculus
tgcgagcttctcgagactcacacct

SEQ ID NO: 417247 - DNA, 25 bp, Mus musculus
cctagacccttagtcctgcgagctt

SEQ ID NO: 417248 - DNA, 25 bp, Mus musculus
acagcgccgcacgtgttccgagggc

SEQ ID NO: 417249 - DNA, 25 bp, Mus musculus
tagggctagccgacgcgacgccaga

SEQ ID NO: 417250 - DNA, 25 bp, Mus musculus
agcagatcgtctgctctcgcgcgta

SEQ ID NO: 417251 - DNA, 25 bp, Mus musculus
ggtttccttggccacttggcgcctc

SEQ ID NO: 417252 - DNA, 25 bp, Mus musculus
accgtgtctccgcatgcgcagcgaa

SEQ ID NO: 417253 - DNA, 25 bp, Mus musculus
gcacgaatcagaggacgagcgcctg

SEQ ID NO: 417254 - DNA, 25 bp, Mus musculus
cgagcgcctgttaatccttcctaga

SEQ ID NO: 417255 - DNA, 25 bp, Mus musculus
atccttcctagatttccgggcgacg

SEQ ID NO: 417256 - DNA, 25 bp, Mus musculus
cgacgggttgtaaacgctgaaagtg

SEQ ID NO: 417257 - DNA, 25 bp, Mus musculus
gctgtgtacggagtctgcgcatact

SEQ ID NO: 417258 - DNA, 25 bp, Mus musculus
ggagtctgcgcatactcctcggctc

SEQ ID NO: 417259 - DNA, 25 bp, Mus musculus
tttgtatccacgtccggggatcttc

SEQ ID NO: 417260 - DNA, 25 bp, Mus musculus
gcggttgtccctgcttttgtatcca

SEQ ID NO: 417261 - DNA, 25 bp, Mus musculus
ctgttctacacgacggcggttgtcc

SEQ ID NO: 417262 - DNA, 25 bp, Mus musculus
aggaagggaaggactgttctacacg

SEQ ID NO: 417263 - DNA, 25 bp, Mus musculus
acacgtcagctgtcgctcaggattc

SEQ ID NO: 417264 - DNA, 25 bp, Mus musculus
cgcagcgaaggctggctacacgtca

SEQ ID NO: 417265 - DNA, 25 bp, Mus musculus
cgtccaaccgggacacgcttgcgga

SEQ ID NO: 417266 - DNA, 25 bp, Mus musculus
cgagtgggcacagggcaacttttcc

SEQ ID NO: 417267 - DNA, 25 bp, Mus musculus
gttgggcgacttttgcaacaactcg

SEQ ID NO: 417268 - DNA, 25 bp, Mus musculus
atttcctgccgctcggtgagtgctg

SEQ ID NO: 417269 - DNA, 25 bp, Mus musculus
taccgagagttagcgcgccgggccc

SEQ ID NO: 417270 - DNA, 25 bp, Mus musculus
cccatgtgtccaccgggatgcgcag

SEQ ID NO: 417271 - DNA, 25 bp, Mus musculus
gctgggcatgagttagtcgcagaca

SEQ ID NO: 417272 - DNA, 25 bp, Mus musculus
caagtagtttacattgttgggcgac

SEQ ID NO: 417273 - DNA, 25 bp, Mus musculus
cgcgcgcaggcacaagtagtttaca

SEQ ID NO: 417274 - DNA, 25 bp, Mus musculus
cttgcaagtttgcagggcgctcaca

SEQ ID NO: 417275 - DNA, 25 bp, Mus musculus
cctgggaacccttggcagatgcaaa

SEQ ID NO: 417276 - DNA, 25 bp, Mus musculus
gcctctttgtgtgtccgcgcagaca

SEQ ID NO: 417277 - DNA, 25 bp, Mus musculus
ggagccttgcaggaccagggtcctc

SEQ ID NO: 417278 - DNA, 25 bp, Mus musculus
cctcggctcttctgcagggagcctt

SEQ ID NO: 417279 - DNA, 25 bp, Mus musculus
gtcgcagacatggacaccaaacatt

SEQ ID NO: 417280 - DNA, 25 bp, Mus musculus
gaatccacagcctccgcgttgtctg

SEQ ID NO: 417281 - DNA, 25 bp, Mus musculus
cctgtggaatgcaccgggcaagaca

SEQ ID NO: 417282 - DNA, 25 bp, Mus musculus
agaactttcctccttggcctgtgga

SEQ ID NO: 417283 - DNA, 25 bp, Mus musculus
cgagcctgcagaactttcctccttg

SEQ ID NO: 417284 - DNA, 25 bp, Mus musculus
taagaggtgcgcagaacctccgcgc

SEQ ID NO: 417285 - DNA, 25 bp, Mus musculus
cgagccgcgcaggtaagagtgctct

SEQ ID NO: 417286 - DNA, 25 bp, Mus musculus
tacacacccgctggaaagctgcgcg

SEQ ID NO: 417287 - DNA, 25 bp, Mus musculus
gcatggacgtacacacccgctggaa

SEQ ID NO: 417288 - DNA, 25 bp, Mus musculus
atgactccctgaagttgtcgtgctc

SEQ ID NO: 417289 - DNA, 25 bp, Mus musculus
gtgccgagcttcctatgactccctg

SEQ ID NO: 417290 - DNA, 25 bp, Mus musculus
ccgggcaagacaacgaataccattc

SEQ ID NO: 417291 - DNA, 25 bp, Mus musculus
cgaaggcgaggtccgcactcctggt

SEQ ID NO: 417292 - DNA, 25 bp, Mus musculus
gaaaagtgctcagcgccgaaggcga

SEQ ID NO: 417293 - DNA, 25 bp, Mus musculus
acagtcgatccctgcgccgtgggcg

SEQ ID NO: 417294 - DNA, 25 bp, Mus musculus
taaccgcgccggagaagcagaacgg

SEQ ID NO: 417295 - DNA, 25 bp, Mus musculus
ctcttggctttcctaggccggtatc

SEQ ID NO: 417296 - DNA, 25 bp, Mus musculus
tgcaggagaggagacccgaacacac

SEQ ID NO: 417297 - DNA, 25 bp, Mus musculus
aggctctccgctcttggctttccta

SEQ ID NO: 417298 - DNA, 25 bp, Mus musculus
aaataagagctacaaccaaggagag

SEQ ID NO: 417299 - DNA, 25 bp, Mus musculus
gacgccgtggaagaatagaaaaata

SEQ ID NO: 417300 - DNA, 25 bp, Mus musculus
tccaatctggggtcgaagacgccgt

SEQ ID NO: 417301 - DNA, 25 bp, Mus musculus
gaggagacccgaacacaccacgtga

SEQ ID NO: 417302 - DNA, 25 bp, Mus musculus
acagtggcggccgatgccatatcca

SEQ ID NO: 417303 - DNA, 25 bp, Mus musculus
tccgtctggtaaccgcgccggagaa

SEQ ID NO: 417304 - DNA, 25 bp, Mus musculus
ttcctaggccggtatccatagacgc

SEQ ID NO: 417305 - DNA, 25 bp, Mus musculus
tctgaggacccgtcccaggataacg

SEQ ID NO: 417306 - DNA, 25 bp, Mus musculus
acacaccacgtgagtctgaggaccc

SEQ ID NO: 417307 - DNA, 25 bp, Mus musculus
ccgatgccatatccaatctggggtc

SEQ ID NO: 417308 - DNA, 25 bp, Mus musculus
ggctgtgagacatgcaaccggcccg

SEQ ID NO: 417309 - DNA, 25 bp, Mus musculus
agcggaggctcagcgcagcacagcc

SEQ ID NO: 417310 - DNA, 25 bp, Mus musculus
atatgcagagcggaggctcagcgca

SEQ ID NO: 417311 - DNA, 25 bp, Mus musculus
ccataaatatgcagagcggaggctc

SEQ ID NO: 417312 - DNA, 25 bp, Mus musculus
ccgggaccataaatatgcagagcgg

SEQ ID NO: 417313 - DNA, 25 bp, Mus musculus
cccgagaggcagtcgcgccggaacc

SEQ ID NO: 417314 - DNA, 25 bp, Mus musculus
cgcgcagggaaagcaagcgcagccc

SEQ ID NO: 417315 - DNA, 25 bp, Mus musculus
ttttggcaccgctgcagcccgggcg

SEQ ID NO: 417316 - DNA, 25 bp, Mus musculus
aaacttttggcaccgctgcagcccg

SEQ ID NO: 417317 - DNA, 25 bp, Mus musculus
cgagcaaacttttggcaccgctgca

SEQ ID NO: 417318 - DNA, 25 bp, Mus musculus
ccgcacgccaggtcgtcggagtggc

SEQ ID NO: 417319 - DNA, 25 bp, Mus musculus
gcaagcaaggcgcacgggtccctcg

SEQ ID NO: 417320 - DNA, 25 bp, Mus musculus
tcaccgagcaaacttttggcaccgc

SEQ ID NO: 417321 - DNA, 25 bp, Mus musculus
tcggagtggctgtgagacatgcaac

SEQ ID NO: 417322 - DNA, 25 bp, Mus musculus
gccactcgcactctggcgtttcggg

SEQ ID NO: 417323 - DNA, 25 bp, Mus musculus
tcagaacccggtggcccttctcgag

SEQ ID NO: 417324 - DNA, 25 bp, Mus musculus
tgggtgaccctaactcttcggccga

SEQ ID NO: 417325 - DNA, 25 bp, Mus musculus
ggccgaccggtttgcagacctcgct

SEQ ID NO: 417326 - DNA, 25 bp, Mus musculus
agccggagctcggaggaaaaatcca

SEQ ID NO: 417327 - DNA, 25 bp, Mus musculus
atccacccatttcctgggcagattg

SEQ ID NO: 417328 - DNA, 25 bp, Mus musculus
atttcctgggcagattgcgtcggcc

SEQ ID NO: 417329 - DNA, 25 bp, Mus musculus
cgtgctaagcaccatggccatgatc

SEQ ID NO: 417330 - DNA, 25 bp, Mus musculus
ggccatgatcaccaactggatgtcc

SEQ ID NO: 417331 - DNA, 25 bp, Mus musculus
tgccctcgctggtgggcctcaatac

SEQ ID NO: 417332 - DNA, 25 bp, Mus musculus
acgctggaccgcagcaccggcgtaa

SEQ ID NO: 417333 - DNA, 25 bp, Mus musculus
gcgttttatccgtcctcctgggtga

SEQ ID NO: 417334 - DNA, 25 bp, Mus musculus
tgcagccaagcagtgccttcagctg

SEQ ID NO: 417335 - DNA, 25 bp, Mus musculus
accggcgtaagtgcgcccgccttga

SEQ ID NO: 417336 - DNA, 25 bp, Mus musculus
ccctaccatcaccacgtgcggcaca

SEQ ID NO: 417337 - DNA, 25 bp, Mus musculus
cctaccatcaccacgtgcggcacag

SEQ ID NO: 417338 - DNA, 25 bp, Mus musculus
ccacgtgcggcacagcaccgggttc

SEQ ID NO: 417339 - DNA, 25 bp, Mus musculus
taccatcaccacgtgcggcacagca

SEQ ID NO: 417340 - DNA, 25 bp, Mus musculus
ctaccatcaccacgtgcggcacagc

SEQ ID NO: 417341 - DNA, 25 bp, Mus musculus
cacgtgcggcacagcaccgggttct

SEQ ID NO: 417342 - DNA, 25 bp, Mus musculus
gtgcggcacagcaccgggttctggc

SEQ ID NO: 417343 - DNA, 25 bp, Mus musculus
ggttctggcaccaatgcccctacca

SEQ ID NO: 417344 - DNA, 25 bp, Mus musculus
accacgtgcggcacagcaccgggtt

SEQ ID NO: 417345 - DNA, 25 bp, Mus musculus
cgggttctggcaccaatgcccctac

SEQ ID NO: 417346 - DNA, 25 bp, Mus musculus
tgcggcacagcaccgggttctggca

SEQ ID NO: 417347 - DNA, 25 bp, Mus musculus
ccgggttctggcaccaatgccccta

SEQ ID NO: 417348 - DNA, 25 bp, Mus musculus
caccacgtgcggcacagcaccgggt

SEQ ID NO: 417349 - DNA, 25 bp, Mus musculus
acgtgcggcacagcaccgggttctg

SEQ ID NO: 417350 - DNA, 25 bp, Mus musculus
cattcccatgatgcccagccaccgg

SEQ ID NO: 417351 - DNA, 25 bp, Mus musculus
tggccttcaaggctgccttctcgac

SEQ ID NO: 417352 - DNA, 25 bp, Mus musculus
ctgcgttcctcgagagccagcgggc

SEQ ID NO: 417353 - DNA, 25 bp, Mus musculus
ttgttgcgccctgcgttcctcgaga

SEQ ID NO: 417354 - DNA, 25 bp, Mus musculus
atgcctggcgcttgttgcgccctgc

SEQ ID NO: 417355 - DNA, 25 bp, Mus musculus
cctctcgcggatgcctggcgcttgt

SEQ ID NO: 417356 - DNA, 25 bp, Mus musculus
gggagtgtccgtgcttccccgctct

SEQ ID NO: 417357 - DNA, 25 bp, Mus musculus
cgacctgccacgaacagcttcgaga

SEQ ID NO: 417358 - DNA, 25 bp, Mus musculus
gaactcggccgtgccattcccatga

SEQ ID NO: 417359 - DNA, 25 bp, Mus musculus
cgccgcggccgtttccaagctgccc

SEQ ID NO: 417360 - DNA, 25 bp, Mus musculus
ccaacttgccgacgcgcgcgacctc

SEQ ID NO: 417361 - DNA, 25 bp, Mus musculus
acgcctctcgccgtggccaacttgc

SEQ ID NO: 417362 - DNA, 25 bp, Mus musculus
ctccttctcttcacggccacgcctc

SEQ ID NO: 417363 - DNA, 25 bp, Mus musculus
ctggtgttatcacgggagagggtcc

SEQ ID NO: 417364 - DNA, 25 bp, Mus musculus
ctcggcctcgaacgttccaagcaga

SEQ ID NO: 417365 - DNA, 25 bp, Mus musculus
catcagcagccggtagccttcaagg

SEQ ID NO: 417366 - DNA, 25 bp, Mus musculus
attagtacacctcggcagcccagga

SEQ ID NO: 417367 - DNA, 25 bp, Mus musculus
aggctccggttcttcctggccgcag

SEQ ID NO: 417368 - DNA, 25 bp, Mus musculus
tcaggcagtcagtgaaccgagtacg

SEQ ID NO: 417369 - DNA, 25 bp, Mus musculus
aagtggttcgggagcacgcatttct

SEQ ID NO: 417370 - DNA, 25 bp, Mus musculus
acgcatttctgggagccgtggcctc

SEQ ID NO: 417371 - DNA, 25 bp, Mus musculus
ctcctgaagggctccggagtgccga

SEQ ID NO: 417372 - DNA, 25 bp, Mus musculus
tgcagcagcacccacggtcagggcg

SEQ ID NO: 417373 - DNA, 25 bp, Mus musculus
gagctcagccgaccgccttagcgat

SEQ ID NO: 417374 - DNA, 25 bp, Mus musculus
gaccgccttagcgatgcgggctgca

SEQ ID NO: 417375 - DNA, 25 bp, Mus musculus
gctgcagctgcgacatcttgcctgc

SEQ ID NO: 417376 - DNA, 25 bp, Mus musculus
ccggccatttgtgacgctgtgatgg

SEQ ID NO: 417377 - DNA, 25 bp, Mus musculus
gggctgcgcccagcgccattagtac

SEQ ID NO: 417378 - DNA, 25 bp, Mus musculus
tcacttctttggcctcgcagcgggc

SEQ ID NO: 417379 - DNA, 25 bp, Mus musculus
ccagaacgtggtggtacagactcca

SEQ ID NO: 417380 - DNA, 25 bp, Mus musculus
cgtctccgtgcggagccagaacgtg

SEQ ID NO: 417381 - DNA, 25 bp, Mus musculus
acgtccgcggtctcggagcgccgtt

SEQ ID NO: 417382 - DNA, 25 bp, Mus musculus
ggtacagactccactctctgggcca

SEQ ID NO: 417383 - DNA, 25 bp, Mus musculus
agtctcggtcgggaggccacaaacg

SEQ ID NO: 417384 - DNA, 25 bp, Mus musculus
ggaggccacaaacggagcgctagct

SEQ ID NO: 417385 - DNA, 25 bp, Mus musculus
aacggagcgctagctccggggccca

SEQ ID NO: 417386 - DNA, 25 bp, Mus musculus
cccgcgcaagcgacgccgggaaatg

SEQ ID NO: 417387 - DNA, 25 bp, Mus musculus
agcgacgccgggaaatgcccacatc

SEQ ID NO: 417388 - DNA, 25 bp, Mus musculus
cctgactggggctgattgcgctgac

SEQ ID NO: 417389 - DNA, 25 bp, Mus musculus
ttgcgctgaccggagccgagccctg

SEQ ID NO: 417390 - DNA, 25 bp, Mus musculus
tttcacgcaaggttgcaccaaaccg

SEQ ID NO: 417391 - DNA, 25 bp, Mus musculus
aggttgcaccaaaccggcctcactt

SEQ ID NO: 417392 - DNA, 25 bp, Mus musculus
tgcaacggattatgagccgccgggg

SEQ ID NO: 417393 - DNA, 25 bp, Mus musculus
ccggggaggagacaaatcagacatc

SEQ ID NO: 417394 - DNA, 25 bp, Mus musculus
agacaaatcagacatccccggccgg

SEQ ID NO: 417395 - DNA, 25 bp, Mus musculus
cccggccggtctgcgggacatttgg

SEQ ID NO: 417396 - DNA, 25 bp, Mus musculus
tcccttacctgcagagaaggagccc

SEQ ID NO: 417397 - DNA, 25 bp, Mus musculus
tacctgcagagaaggagccctgcaa

SEQ ID NO: 417398 - DNA, 25 bp, Mus musculus
gcgcggcgagccaaaggcgacactc

SEQ ID NO: 417399 - DNA, 25 bp, Mus musculus
ggcagcgcctcctcgacggctcctc

SEQ ID NO: 417400 - DNA, 25 bp, Mus musculus
ctcctccatctttgcggcggctcct

SEQ ID NO: 417401 - DNA, 25 bp, Mus musculus
ccaacaacaacattcggagacgtca

SEQ ID NO: 417402 - DNA, 25 bp, Mus musculus
acaacattcggagacgtcactctcg

SEQ ID NO: 417403 - DNA, 25 bp, Mus musculus
cggagacgtcactctcgtcacgtga

SEQ ID NO: 417404 - DNA, 25 bp, Mus musculus
atgggcgggaccaatagcgccaccg

SEQ ID NO: 417405 - DNA, 25 bp, Mus musculus
gagacgtcactctcgtcacgtgacc

SEQ ID NO: 417406 - DNA, 25 bp, Mus musculus
ctgcagaaggcgatcccgggccctg

SEQ ID NO: 417407 - DNA, 25 bp, Mus musculus
cggtgcacagcggagagggtcctcc

SEQ ID NO: 417408 - DNA, 25 bp, Mus musculus
gcagaatggtaggaaggtcacggga

SEQ ID NO: 417409 - DNA, 25 bp, Mus musculus
acggtaaagatcagcgggtggagct

SEQ ID NO: 417410 - DNA, 25 bp, Mus musculus
cccaggatggcgacggtaaagatca

SEQ ID NO: 417411 - DNA, 25 bp, Mus musculus
ccgcagtcagcgagccccaggatgg

SEQ ID NO: 417412 - DNA, 25 bp, Mus musculus
gccctgcggagcagaatggtaggaa

SEQ ID NO: 417413 - DNA, 25 bp, Mus musculus
ggtttcctgcagaaggcgatcccgg

SEQ ID NO: 417414 - DNA, 25 bp, Mus musculus
gccaggtttcctgcagaaggcgatc

SEQ ID NO: 417415 - DNA, 25 bp, Mus musculus
tctttccccgcaggtgtgcggcgct

SEQ ID NO: 417416 - DNA, 25 bp, Mus musculus
tgagcgcggtgaatctcggagatgg

SEQ ID NO: 417417 - DNA, 25 bp, Mus musculus
cgtgctgacccggctgctgtgtgca

SEQ ID NO: 417418 - DNA, 25 bp, Mus musculus
cgctcagaggaggaggcgctctgcc

SEQ ID NO: 417419 - DNA, 25 bp, Mus musculus
gtcctccgggccagcaagcggcgct

SEQ ID NO: 417420 - DNA, 25 bp, Mus musculus
cggcgcagacaatggaagcggcatt

SEQ ID NO: 417421 - DNA, 25 bp, Mus musculus
tgcacttaacgctgttccgcgtcca

SEQ ID NO: 417422 - DNA, 25 bp, Mus musculus
gtgagtcgacatggggccctgtacc

SEQ ID NO: 417423 - DNA, 25 bp, Mus musculus
gccctgtaccagtgggtgtgaatga

SEQ ID NO: 417424 - DNA, 25 bp, Mus musculus
ggtgtgaatgaagcccgcacccacc

SEQ ID NO: 417425 - DNA, 25 bp, Mus musculus
agcgtccacgcagagcgtgcactta

SEQ ID NO: 417426 - DNA, 25 bp, Mus musculus
gtagattgccaggtgagtcgacatg

SEQ ID NO: 417427 - DNA, 25 bp, Mus musculus
aagaggccgagcgtgtcctcgagct

SEQ ID NO: 417428 - DNA, 25 bp, Mus musculus
taatcgcctgcgaccggcggggaaa

SEQ ID NO: 417429 - DNA, 25 bp, Mus musculus
gacgtcccaggtctaatcgcctgcg

SEQ ID NO: 417430 - DNA, 25 bp, Mus musculus
caacctgtccaaccgggtacaatcg

SEQ ID NO: 417431 - DNA, 25 bp, Mus musculus
cgggtacaatcgagcaactgaggtc

SEQ ID NO: 417432 - DNA, 25 bp, Mus musculus
actgaggtctggaaagaggcatgcc

SEQ ID NO: 417433 - DNA, 25 bp, Mus musculus
tccggagacaaacccagagaggcgt

SEQ ID NO: 417434 - DNA, 25 bp, Mus musculus
cgcgccaccgtgagtcgtccatggt

SEQ ID NO: 417435 - DNA, 25 bp, Mus musculus
cgcagctcgaccctgatctgccgcg

SEQ ID NO: 417436 - DNA, 25 bp, Mus musculus
tgctgcacagcttcacgcagctcga

SEQ ID NO: 417437 - DNA, 25 bp, Mus musculus
tggtgctgcacagcttcacgcagct

SEQ ID NO: 417438 - DNA, 25 bp, Mus musculus
cagtggtgctgcacagcttcacgca

SEQ ID NO: 417439 - DNA, 25 bp, Mus musculus
tgcccagtggtgctgcacagcttca

SEQ ID NO: 417440 - DNA, 25 bp, Mus musculus
gctgcccagtggtgctgcacagctt

SEQ ID NO: 417441 - DNA, 25 bp, Mus musculus
acagctgcccagtggtgctgcacag

SEQ ID NO: 417442 - DNA, 25 bp, Mus musculus
gcagcgtgtgggacgccgtgcgcct

SEQ ID NO: 417443 - DNA, 25 bp, Mus musculus
cccatagggggcaccgagccgttgt

SEQ ID NO: 417444 - DNA, 25 bp, Mus musculus
catggtgcagcgcatgtgggctgag

SEQ ID NO: 417445 - DNA, 25 bp, Mus musculus
cgtgagtcgtccatggtgcagcgca

SEQ ID NO: 417446 - DNA, 25 bp, Mus musculus
caccgtgagtcgtccatggtgcagc

SEQ ID NO: 417447 - DNA, 25 bp, Mus musculus
cttcacgcagctcgaccctgatctg

SEQ ID NO: 417448 - DNA, 25 bp, Mus musculus
ggtcccgcccattcagtagacacga

SEQ ID NO: 417449 - DNA, 25 bp, Mus musculus
cggagtttcccagctccttactcga

SEQ ID NO: 417450 - DNA, 25 bp, Mus musculus
tgcgtcgccgcaactgtttattttg

SEQ ID NO: 417451 - DNA, 25 bp, Mus musculus
ccagggtctgtagcatcttggcctc

SEQ ID NO: 417452 - DNA, 25 bp, Mus musculus
agacaagccaggattcgaccgggtt

SEQ ID NO: 417453 - DNA, 25 bp, Mus musculus
tccttactcgagagacgctttcctc

SEQ ID NO: 417454 - DNA, 25 bp, Mus musculus
ttttccggatatcccgtccaatgag

SEQ ID NO: 417455 - DNA, 25 bp, Mus musculus
ggcctccaggaagaagtgcgtcgcc

SEQ ID NO: 417456 - DNA, 25 bp, Mus musculus
aggcctcacctcaaaggttccgcga

SEQ ID NO: 417457 - DNA, 25 bp, Mus musculus
ggtccgttctcaaatggctccgcga

SEQ ID NO: 417458 - DNA, 25 bp, Mus musculus
cgccgccatgcctactagtctggtt

SEQ ID NO: 417459 - DNA, 25 bp, Mus musculus
gttcccgccgcaggtccacagggat

SEQ ID NO: 417460 - DNA, 25 bp, Mus musculus
tcttggcctcgttacgtactacgcc

SEQ ID NO: 417461 - DNA, 25 bp, Mus musculus
tccaatgagagcttgaagacgtgcc

SEQ ID NO: 417462 - DNA, 25 bp, Mus musculus
ggcctccttcagagtcacaagatct

SEQ ID NO: 417463 - DNA, 25 bp, Mus musculus
ctggccatctggcattaggctcgga

SEQ ID NO: 417464 - DNA, 25 bp, Mus musculus
ccctcgcttgctgcggtgacaggct

SEQ ID NO: 417465 - DNA, 25 bp, Mus musculus
gtcgcggctcgagcctctactgcag

SEQ ID NO: 417466 - DNA, 25 bp, Mus musculus
aatagggactctttttcatagcgga

SEQ ID NO: 417467 - DNA, 25 bp, Mus musculus
tcggagcgtagtagagacccgaata

SEQ ID NO: 417468 - DNA, 25 bp, Mus musculus
atcctgtcctgtctggagaggctga

SEQ ID NO: 417469 - DNA, 25 bp, Mus musculus
tcgtcataagtggtatatcctgtcc

SEQ ID NO: 417470 - DNA, 25 bp, Mus musculus
ctcggccagcttgtatcgtcataag

SEQ ID NO: 417471 - DNA, 25 bp, Mus musculus
ttcggttttatttatctcggccagc

SEQ ID NO: 417472 - DNA, 25 bp, Mus musculus
acaagatctctcagtgggctcccac

SEQ ID NO: 417473 - DNA, 25 bp, Mus musculus
tggagaatgaatgaaggccgcctgt

SEQ ID NO: 417474 - DNA, 25 bp, Mus musculus
cgggacttctttcggcctccttcag

SEQ ID NO: 417475 - DNA, 25 bp, Mus musculus
gcctccacattaaaatctctttcgg

SEQ ID NO: 417476 - DNA, 25 bp, Mus musculus
gagtgcccagaagcttgcagtgcct

SEQ ID NO: 417477 - DNA, 25 bp, Mus musculus
tggcaacccggtcacatgactcggc

SEQ ID NO: 417478 - DNA, 25 bp, Mus musculus
ggtgctatggcaacccggtcacatg

SEQ ID NO: 417479 - DNA, 25 bp, Mus musculus
cacaggtgctatggcaacccggtca

SEQ ID NO: 417480 - DNA, 25 bp, Mus musculus
tgtgaccacaggtgctatggcaacc

SEQ ID NO: 417481 - DNA, 25 bp, Mus musculus
tggccgattgtgaccacaggtgcta

SEQ ID NO: 417482 - DNA, 25 bp, Mus musculus
caggcttggccgattgtgaccacag

SEQ ID NO: 417483 - DNA, 25 bp, Mus musculus
ccatagaggccaggcaggcttggcc

SEQ ID NO: 417484 - DNA, 25 bp, Mus musculus
gcctcacagagtgcccagaagcttg

SEQ ID NO: 417485 - DNA, 25 bp, Mus musculus
ttcgcctcacagagtgcccagaagc

SEQ ID NO: 417486 - DNA, 25 bp, Mus musculus
tggactggccttcgcctcacagagt

SEQ ID NO: 417487 - DNA, 25 bp, Mus musculus
gtttgacttggactggccttcgcct

SEQ ID NO: 417488 - DNA, 25 bp, Mus musculus
accctggtttgacttggactggcct

SEQ ID NO: 417489 - DNA, 25 bp, Mus musculus
acagagtgcccagaagcttgcagtg

SEQ ID NO: 417490 - DNA, 25 bp, Mus musculus
ttctatgcctccttagagttccgcc

SEQ ID NO: 417491 - DNA, 25 bp, Mus musculus
cgttcctcacgttcgcatcaggcaa

SEQ ID NO: 417492 - DNA, 25 bp, Mus musculus
tgacgaccaatccacttcccgcctc

SEQ ID NO: 417493 - DNA, 25 bp, Mus musculus
ggcgctttccctttcctgacgacca

SEQ ID NO: 417494 - DNA, 25 bp, Mus musculus
atctccaattcaggcgctttccctt

SEQ ID NO: 417495 - DNA, 25 bp, Mus musculus
agccgtgaatcgcttgcgcctgcgc

SEQ ID NO: 417496 - DNA, 25 bp, Mus musculus
tcacgttcgcatcaggcaaccttcg

SEQ ID NO: 417497 - DNA, 25 bp, Mus musculus
accactcttctatgcctccttagag

SEQ ID NO: 417498 - DNA, 25 bp, Mus musculus
gtaattctactatcccaccactctt

SEQ ID NO: 417499 - DNA, 25 bp, Mus musculus
ttgacctcgacagcgccccgtaatt

SEQ ID NO: 417500 - DNA, 25 bp, Mus musculus
gttaccaaccttgacctcgacagcg

SEQ ID NO: 417501 - DNA, 25 bp, Mus musculus
tcaggcaaccttcggagaactaagt

SEQ ID NO: 417502 - DNA, 25 bp, Mus musculus
gttcgcatcaggcaaccttcggaga

SEQ ID NO: 417503 - DNA, 25 bp, Mus musculus
tgcgcatctccaattcaggcgcttt

SEQ ID NO: 417504 - DNA, 25 bp, Mus musculus
tcaggcgcccgaggatagggaatac

SEQ ID NO: 417505 - DNA, 25 bp, Mus musculus
atgatgcaggtgatcaggcgcccga

SEQ ID NO: 417506 - DNA, 25 bp, Mus musculus
tgatgcaggtgatcaggcgcccgag

SEQ ID NO: 417507 - DNA, 25 bp, Mus musculus
gatgcaggtgatcaggcgcccgagg

SEQ ID NO: 417508 - DNA, 25 bp, Mus musculus
atcaggcgcccgaggatagggaata

SEQ ID NO: 417509 - DNA, 25 bp, Mus musculus
ccgaggatagggaatacggctaccg

SEQ ID NO: 417510 - DNA, 25 bp, Mus musculus
caggcgcccgaggatagggaatacg

SEQ ID NO: 417511 - DNA, 25 bp, Mus musculus
aggcgcccgaggatagggaatacgg

SEQ ID NO: 417512 - DNA, 25 bp, Mus musculus
ggcgcccgaggatagggaatacggc

SEQ ID NO: 417513 - DNA, 25 bp, Mus musculus
gcgcccgaggatagggaatacggct

SEQ ID NO: 417514 - DNA, 25 bp, Mus musculus
cgcccgaggatagggaatacggcta

SEQ ID NO: 417515 - DNA, 25 bp, Mus musculus
gcccgaggatagggaatacggctac

SEQ ID NO: 417516 - DNA, 25 bp, Mus musculus
cgaggatagggaatacggctaccgg

SEQ ID NO: 417517 - DNA, 25 bp, Mus musculus
atgcaggtgatcaggcgcccgagga

SEQ ID NO: 417518 - DNA, 25 bp, Mus musculus
atggaatccgggaccaggactcgcc

SEQ ID NO: 417519 - DNA, 25 bp, Mus musculus
ctacattttcgagatgatgcaggtg

SEQ ID NO: 417520 - DNA, 25 bp, Mus musculus
ggggaagactactacattttcgaga

SEQ ID NO: 417521 - DNA, 25 bp, Mus musculus
cctcagtacggggaagactactaca

SEQ ID NO: 417522 - DNA, 25 bp, Mus musculus
cggaaatgcctcagtacggggaaga

SEQ ID NO: 417523 - DNA, 25 bp, Mus musculus
ccgttactaaggagcggagcgctgt

SEQ ID NO: 417524 - DNA, 25 bp, Mus musculus
gcgctgtcggaaacatggatgcaac

SEQ ID NO: 417525 - DNA, 25 bp, Mus musculus
tggcgtcccagcaacgccgttacta

SEQ ID NO: 417526 - DNA, 25 bp, Mus musculus
gcttggcgtcccagcaacgccgtta

SEQ ID NO: 417527 - DNA, 25 bp, Mus musculus
tgacgcatagcttggcgtcccagca

SEQ ID NO: 417528 - DNA, 25 bp, Mus musculus
caccgatgacgcatagcttggcgtc

SEQ ID NO: 417529 - DNA, 25 bp, Mus musculus
gcgctcaccgatgacgcatagcttg

SEQ ID NO: 417530 - DNA, 25 bp, Mus musculus
ggaaacatggatgcaaccacagccc

SEQ ID NO: 417531 - DNA, 25 bp, Mus musculus
ccagcaacgccgttactaaggagcg

SEQ ID NO: 417532 - DNA, 25 bp, Mus musculus
tcatcttactaggagcgaggaggtc

SEQ ID NO: 417533 - DNA, 25 bp, Mus musculus
cctgggttgtgcacatcgcagataa

SEQ ID NO: 417534 - DNA, 25 bp, Mus musculus
tggtccgcctcgctcatcttactag

SEQ ID NO: 417535 - DNA, 25 bp, Mus musculus
gctactgtctgcagcactttgcctg

SEQ ID NO: 417536 - DNA, 25 bp, Mus musculus
tcgggttaccggcacactgaacgct

SEQ ID NO: 417537 - DNA, 25 bp, Mus musculus
taggcaacgccaccctgctagatgg

SEQ ID NO: 417538 - DNA, 25 bp, Mus musculus
gctgcctgtctggaaagtgcgctcc

SEQ ID NO: 417539 - DNA, 25 bp, Mus musculus
gacactgggtgctaggtccgactaa

SEQ ID NO: 417540 - DNA, 25 bp, Mus musculus
agcctccgtgggtgactgaaaagct

SEQ ID NO: 417541 - DNA, 25 bp, Mus musculus
accggcgatagttgcgaagatcctc

SEQ ID NO: 417542 - DNA, 25 bp, Mus musculus
tccgcacttgggctttggctactgt

SEQ ID NO: 417543 - DNA, 25 bp, Mus musculus
tcaggtccggtcgagttctttaaga

SEQ ID NO: 417544 - DNA, 25 bp, Mus musculus
ggcgcttcagagagtccctttccta

SEQ ID NO: 417545 - DNA, 25 bp, Mus musculus
tattgcagcttcacggcaggctccc

SEQ ID NO: 417546 - DNA, 25 bp, Mus musculus
tgacctcctaagaccgtgtggaaac

SEQ ID NO: 417547 - DNA, 25 bp, Mus musculus
cagatgagtcggctcagtgagtgct

SEQ ID NO: 417548 - DNA, 25 bp, Mus musculus
tgagtcggctcagtgagtgcttcgc

SEQ ID NO: 417549 - DNA, 25 bp, Mus musculus
cggctcagtgagtgcttcgcggcct

SEQ ID NO: 417550 - DNA, 25 bp, Mus musculus
ctcagtgagtgcttcgcggcctgtc

SEQ ID NO: 417551 - DNA, 25 bp, Mus musculus
cttcgcggcctgtcgcgcagcagag

SEQ ID NO: 417552 - DNA, 25 bp, Mus musculus
gcgccctggcctgagccagatgagt

SEQ ID NO: 417553 - DNA, 25 bp, Mus musculus
cagagggaggccgagcgttggcctc

SEQ ID NO: 417554 - DNA, 25 bp, Mus musculus
cgagcgttggcctcgcccgtgacct

SEQ ID NO: 417555 - DNA, 25 bp, Mus musculus
cgtgacctcctaagaccgtgtggaa

SEQ ID NO: 417556 - DNA, 25 bp, Mus musculus
tcggagtccatctgtctgccccgcg

SEQ ID NO: 417557 - DNA, 25 bp, Mus musculus
ctggcctgagccagatgagtcggct

SEQ ID NO: 417558 - DNA, 25 bp, Mus musculus
tgagccagatgagtcggctcagtga

SEQ ID NO: 417559 - DNA, 25 bp, Mus musculus
cccgtgacctcctaagaccgtgtgg

SEQ ID NO: 417560 - DNA, 25 bp, Mus musculus
ctcttggaccttgctctgggaatgc

SEQ ID NO: 417561 - DNA, 25 bp, Mus musculus
tccctttaaggctgcggcggaaggc

SEQ ID NO: 417562 - DNA, 25 bp, Mus musculus
agaaggactttgtgtcggcaggata

SEQ ID NO: 417563 - DNA, 25 bp, Mus musculus
cggcaggataaaaattggtgccttc

SEQ ID NO: 417564 - DNA, 25 bp, Mus musculus
gagctattgttttggcggcggcttt

SEQ ID NO: 417565 - DNA, 25 bp, Mus musculus
ctagtctgctaggacgggatctgcc

SEQ ID NO: 417566 - DNA, 25 bp, Mus musculus
atctgcctggtagagactgagtgta

SEQ ID NO: 417567 - DNA, 25 bp, Mus musculus
gtttccgctgcggtcttaaagacgc

SEQ ID NO: 417568 - DNA, 25 bp, Mus musculus
ggcgaccgagagacctttgattttc

SEQ ID NO: 417569 - DNA, 25 bp, Mus musculus
gaatgcgaccggacatagttcccta

SEQ ID NO: 417570 - DNA, 25 bp, Mus musculus
gttccctactctacgtctgggtcga

SEQ ID NO: 417571 - DNA, 25 bp, Mus musculus
tgaacccttgagtctgacacggccg

SEQ ID NO: 417572 - DNA, 25 bp, Mus musculus
tggtaatgccgcgtctaagccgccc

SEQ ID NO: 417573 - DNA, 25 bp, Mus musculus
ccacggcctgtcgttatggtaatgc

SEQ ID NO: 417574 - DNA, 25 bp, Mus musculus
atgcggggcaccagaggtctctgaa

SEQ ID NO: 417575 - DNA, 25 bp, Mus musculus
cccttcctagtgattggcaccgaga

SEQ ID NO: 417576 - DNA, 25 bp, Mus musculus
caagacagacgaagggatcacaacc

SEQ ID NO: 417577 - DNA, 25 bp, Mus musculus
tcctaggaaccgaaatcaagacaga

SEQ ID NO: 417578 - DNA, 25 bp, Mus musculus
gcttccatttagtcctaggaaccga

SEQ ID NO: 417579 - DNA, 25 bp, Mus musculus
acggccgtctgtcgcttccatttag

SEQ ID NO: 417580 - DNA, 25 bp, Mus musculus
gagtaattgcctgcctccgctagca

SEQ ID NO: 417581 - DNA, 25 bp, Mus musculus
ctctggagcgccgagtaattgcctg

SEQ ID NO: 417582 - DNA, 25 bp, Mus musculus
taaggcgacgggaacattctctgga

SEQ ID NO: 417583 - DNA, 25 bp, Mus musculus
ctctgcgggtagaaataaggcgacg

SEQ ID NO: 417584 - DNA, 25 bp, Mus musculus
gattggaaaccagactctgcgggta

SEQ ID NO: 417585 - DNA, 25 bp, Mus musculus
gcaccggggtccagattggaaacca

SEQ ID NO: 417586 - DNA, 25 bp, Mus musculus
cgcggtacagatagagtgcggcacc

SEQ ID NO: 417587 - DNA, 25 bp, Mus musculus
accgagagccgcgagatggccaacg

SEQ ID NO: 417588 - DNA, 25 bp, Mus musculus
cgcccaaccgatcccgccccacagc

SEQ ID NO: 417589 - DNA, 25 bp, Mus musculus
ggcggctagctccatgcggtcttgc

SEQ ID NO: 417590 - DNA, 25 bp, Mus musculus
cgaaacctcacctgcggttctggta

SEQ ID NO: 417591 - DNA, 25 bp, Mus musculus
acctcacctgcggttctggtaccag

SEQ ID NO: 417592 - DNA, 25 bp, Mus musculus
cctcacctgcggttctggtaccagg

SEQ ID NO: 417593 - DNA, 25 bp, Mus musculus
ctcacctgcggttctggtaccaggt

SEQ ID NO: 417594 - DNA, 25 bp, Mus musculus
tcacctgcggttctggtaccaggtc

SEQ ID NO: 417595 - DNA, 25 bp, Mus musculus
cacctgcggttctggtaccaggtct

SEQ ID NO: 417596 - DNA, 25 bp, Mus musculus
acctgcggttctggtaccaggtctt

SEQ ID NO: 417597 - DNA, 25 bp, Mus musculus
ttgacctgcgtgtcggtgaggttga

SEQ ID NO: 417598 - DNA, 25 bp, Mus musculus
tcggtgaggttgagcgaggcggcta

SEQ ID NO: 417599 - DNA, 25 bp, Mus musculus
cgaggcggctagctccatgcggtct

SEQ ID NO: 417600 - DNA, 25 bp, Mus musculus
gaaacctcacctgcggttctggtac

SEQ ID NO: 417601 - DNA, 25 bp, Mus musculus
gaggcggctagctccatgcggtctt

SEQ ID NO: 417602 - DNA, 25 bp, Mus musculus
cccgagagctggagatctcgcggtc

SEQ ID NO: 417603 - DNA, 25 bp, Mus musculus
tgcgtggctttttcaggcgcaccgg

SEQ ID NO: 417604 - DNA, 25 bp, Mus musculus
gctttgcgtggctttttcaggcgca

SEQ ID NO: 417605 - DNA, 25 bp, Mus musculus
tgcgtgctttgcgtggctttttcag

SEQ ID NO: 417606 - DNA, 25 bp, Mus musculus
ctgcgccagctgatggtcggtgaag

SEQ ID NO: 417607 - DNA, 25 bp, Mus musculus
gaagctacgctccagctgcgccagc

SEQ ID NO: 417608 - DNA, 25 bp, Mus musculus
gtatttctgccgctcgaagctacgc

SEQ ID NO: 417609 - DNA, 25 bp, Mus musculus
ccatgcggtcttgcacgctcaggta

SEQ ID NO: 417610 - DNA, 25 bp, Mus musculus
tgcggtcttgcacgctcaggtattt

SEQ ID NO: 417611 - DNA, 25 bp, Mus musculus
ggtcttgcacgctcaggtatttctg

SEQ ID NO: 417612 - DNA, 25 bp, Mus musculus
ttgcacgctcaggtatttctgccgc

SEQ ID NO: 417613 - DNA, 25 bp, Mus musculus
acgctcaggtatttctgccgctcga

SEQ ID NO: 417614 - DNA, 25 bp, Mus musculus
ctcaggtatttctgccgctcgaagc

SEQ ID NO: 417615 - DNA, 25 bp, Mus musculus
atttctgccgctcgaagctacgctc

SEQ ID NO: 417616 - DNA, 25 bp, Mus musculus
ccagtttcgaactaagcggatggaa

SEQ ID NO: 417617 - DNA, 25 bp, Mus musculus
actaagcggatggaaagccggcatg

SEQ ID NO: 417618 - DNA, 25 bp, Mus musculus
tggaaagccggcatggtcggcatct

SEQ ID NO: 417619 - DNA, 25 bp, Mus musculus
aagccggcatggtcggcatctgaga

SEQ ID NO: 417620 - DNA, 25 bp, Mus musculus
tcggcatctgagagcgctcggagct

SEQ ID NO: 417621 - DNA, 25 bp, Mus musculus
agcgctcggagctgcgagaaatacc

SEQ ID NO: 417622 - DNA, 25 bp, Mus musculus
tcggagctgcgagaaatacctatgt

SEQ ID NO: 417623 - DNA, 25 bp, Mus musculus
agctgcgagaaatacctatgttgtc

SEQ ID NO: 417624 - DNA, 25 bp, Mus musculus
gaaatacctatgttgtccctgggca

SEQ ID NO: 417625 - DNA, 25 bp, Mus musculus
tacctatgttgtccctgggcacgaa

SEQ ID NO: 417626 - DNA, 25 bp, Mus musculus
cctgggcacgaagggctgcgtgcat

SEQ ID NO: 417627 - DNA, 25 bp, Mus musculus
ctgcgtgcatcgcagaggtcccggc

SEQ ID NO: 417628 - DNA, 25 bp, Mus musculus
gtgcatcgcagaggtcccggcttcg

SEQ ID NO: 417629 - DNA, 25 bp, Mus musculus
agaccagtttcgaactaagcggatg

SEQ ID NO: 417630 - DNA, 25 bp, Mus musculus
ggaacataattgtgcccacgcctca

SEQ ID NO: 417631 - DNA, 25 bp, Mus musculus
tttgggcgcaaagctcgcgtagaga

SEQ ID NO: 417632 - DNA, 25 bp, Mus musculus
cgaccttgcgttagccaggaatcta

SEQ ID NO: 417633 - DNA, 25 bp, Mus musculus
ctcaccgaccttgcgttagccagga

SEQ ID NO: 417634 - DNA, 25 bp, Mus musculus
ccatcgtctcgaagggaacataatt

SEQ ID NO: 417635 - DNA, 25 bp, Mus musculus
cttgcgttagccaggaatctacaga

SEQ ID NO: 417636 - DNA, 25 bp, Mus musculus
cgttagccaggaatctacagagatg

SEQ ID NO: 417637 - DNA, 25 bp, Mus musculus
ccaggaatctacagagatggcttcc

SEQ ID NO: 417638 - DNA, 25 bp, Mus musculus
acagagatggcttcctagaccagtt

SEQ ID NO: 417639 - DNA, 25 bp, Mus musculus
atggcttcctagaccagtttcgaac

SEQ ID NO: 417640 - DNA, 25 bp, Mus musculus
tcagcatcccatcgtctcgaaggga

SEQ ID NO: 417641 - DNA, 25 bp, Mus musculus
acaaaaccctatttgttcctcagca

SEQ ID NO: 417642 - DNA, 25 bp, Mus musculus
gctcgcgtagagaaacaaaacccta

SEQ ID NO: 417643 - DNA, 25 bp, Mus musculus
cgtctcgaagggaacataattgtgc

SEQ ID NO: 417644 - DNA, 25 bp, Mus musculus
ttaggcacagaagaaacacgaggtt

SEQ ID NO: 417645 - DNA, 25 bp, Mus musculus
gcgcgccaagttggggagagccaaa

SEQ ID NO: 417646 - DNA, 25 bp, Mus musculus
acacgaggttgatggaatctgaata

SEQ ID NO: 417647 - DNA, 25 bp, Mus musculus
ggaatctgaataaagatcgtctttt

SEQ ID NO: 417648 - DNA, 25 bp, Mus musculus
gcacgcttcctccaggcaaacggta

SEQ ID NO: 417649 - DNA, 25 bp, Mus musculus
tccaggcaaacggtagcccagggca

SEQ ID NO: 417650 - DNA, 25 bp, Mus musculus
caggggtcagcacggccgatagcaa

SEQ ID NO: 417651 - DNA, 25 bp, Mus musculus
gtcagcacggccgatagcaaccggc

SEQ ID NO: 417652 - DNA, 25 bp, Mus musculus
ccgcgttacgggcaggcagaacaga

SEQ ID NO: 417653 - DNA, 25 bp, Mus musculus
cgggcaggcagaacagagcgcacct

SEQ ID NO: 417654 - DNA, 25 bp, Mus musculus
cagaacagagcgcacctggaggcct

SEQ ID NO: 417655 - DNA, 25 bp, Mus musculus
acagagcgcacctggaggcctcagc

SEQ ID NO: 417656 - DNA, 25 bp, Mus musculus
gaacggcccgaggatcccttaggca

SEQ ID NO: 417657 - DNA, 25 bp, Mus musculus
tcccttaggcacagaagaaacacga

SEQ ID NO: 417658 - DNA, 25 bp, Mus musculus
ctctgctccggtcggcagattggaa

SEQ ID NO: 417659 - DNA, 25 bp, Mus musculus
accaaggccgccgtagaatcgttca

SEQ ID NO: 417660 - DNA, 25 bp, Mus musculus
tgcgagagagcggagttgcgcatct

SEQ ID NO: 417661 - DNA, 25 bp, Mus musculus
ctcgcggggagtccagactttcctc

SEQ ID NO: 417662 - DNA, 25 bp, Mus musculus
tccagactttcctcttcggctcgcc

SEQ ID NO: 417663 - DNA, 25 bp, Mus musculus
cctgggaaactatccgtggcccgcg

SEQ ID NO: 417664 - DNA, 25 bp, Mus musculus
gctcggcgaccaaggccgccgtaga

SEQ ID NO: 417665 - DNA, 25 bp, Mus musculus
caaggccgccgtagaatcgttcagc

SEQ ID NO: 417666 - DNA, 25 bp, Mus musculus
ccgtagaatcgttcagcgccgcagc

SEQ ID NO: 417667 - DNA, 25 bp, Mus musculus
tagaatcgttcagcgccgcagcccg

SEQ ID NO: 417668 - DNA, 25 bp, Mus musculus
cgcaaacgcgatctcggccgggagt

SEQ ID NO: 417669 - DNA, 25 bp, Mus musculus
agctcggctgcaagctgtcggggag

SEQ ID NO: 417670 - DNA, 25 bp, Mus musculus
aactttgtcctctgccgggatgggc

SEQ ID NO: 417671 - DNA, 25 bp, Mus musculus
ctcgaagcgagcaaaacggaaactt

SEQ ID NO: 417672 - DNA, 25 bp, Mus musculus
gcgatgcacgggctgcttcttcttt

SEQ ID NO: 417673 - DNA, 25 bp, Mus musculus
ggtcccgagagttcagcagctggaa

SEQ ID NO: 417674 - DNA, 25 bp, Mus musculus
ggtttcgccggatcaggcatcccag

SEQ ID NO: 417675 - DNA, 25 bp, Mus musculus
agttctgcgctgtctgaggactcca

SEQ ID NO: 417676 - DNA, 25 bp, Mus musculus
ggctgcaaagcccacagagttctgc

SEQ ID NO: 417677 - DNA, 25 bp, Mus musculus
ctccgggattagaccttggctgcaa

SEQ ID NO: 417678 - DNA, 25 bp, Mus musculus
tttccatgccgtgaggtctttcccg

SEQ ID NO: 417679 - DNA, 25 bp, Mus musculus
agatctggctgaccgtgcgatgcac

SEQ ID NO: 417680 - DNA, 25 bp, Mus musculus
acggatgtcgaccaccgtcagcggc

SEQ ID NO: 417681 - DNA, 25 bp, Mus musculus
ttctccatgcccgtacggatgtcga

SEQ ID NO: 417682 - DNA, 25 bp, Mus musculus
cgggttctgaaacatggagtcacgc

SEQ ID NO: 417683 - DNA, 25 bp, Mus musculus
caccttgacgatgagcgggttctga

SEQ ID NO: 417684 - DNA, 25 bp, Mus musculus
atgatcgtgcccaggcgctcacctt

SEQ ID NO: 417685 - DNA, 25 bp, Mus musculus
tcagcagctggaacccatcggcggc

SEQ ID NO: 417686 - DNA, 25 bp, Mus musculus
cgtagcgtcacgaccatagatagac

SEQ ID NO: 417687 - DNA, 25 bp, Mus musculus
ggctttcgcaccgaggctagtcatc

SEQ ID NO: 417688 - DNA, 25 bp, Mus musculus
tccgtgactgtaccctgataaagtg

SEQ ID NO: 417689 - DNA, 25 bp, Mus musculus
ggacccagtttggagtccgtgactg

SEQ ID NO: 417690 - DNA, 25 bp, Mus musculus
cttctcgagaaactgccgggctgtt

SEQ ID NO: 417691 - DNA, 25 bp, Mus musculus
ctccgtagttgaagctgagcgcttc

SEQ ID NO: 417692 - DNA, 25 bp, Mus musculus
gcgggttccttctagtctgttcctc

SEQ ID NO: 417693 - DNA, 25 bp, Mus musculus
tgagctttccttgagtttctgcgcc

SEQ ID NO: 417694 - DNA, 25 bp, Mus musculus
acgagcgctacattgtcgctgggta

SEQ ID NO: 417695 - DNA, 25 bp, Mus musculus
cttccgggttggaagacgagcgcta

SEQ ID NO: 417696 - DNA, 25 bp, Mus musculus
tggccggaagtcagtacagtatttc

SEQ ID NO: 417697 - DNA, 25 bp, Mus musculus
atccttgcgcgcctccatgttacta

SEQ ID NO: 417698 - DNA, 25 bp, Mus musculus
tagtcatcgggcttaacggcatcgc

SEQ ID NO: 417699 - DNA, 25 bp, Mus musculus
tgttactatggcagccggatgcgca

SEQ ID NO: 417700 - DNA, 25 bp, Mus musculus
gggactcgagccacaggcacgcacg

SEQ ID NO: 417701 - DNA, 25 bp, Mus musculus
gagaccagccggaaagaacctcagg

SEQ ID NO: 417702 - DNA, 25 bp, Mus musculus
cgcatcacacaacacgacggaagga

SEQ ID NO: 417703 - DNA, 25 bp, Mus musculus
aggacgaaggggtacccgcatcaca

SEQ ID NO: 417704 - DNA, 25 bp, Mus musculus
accctagaaaggctgtcagcagcag

SEQ ID NO: 417705 - DNA, 25 bp, Mus musculus
aagaacctcagggagagcgggctct

SEQ ID NO: 417706 - DNA, 25 bp, Mus musculus
ggagaccacgtgacggatcgcttca

SEQ ID NO: 417707 - DNA, 25 bp, Mus musculus
ccttgatttgggaagagaccctaga

SEQ ID NO: 417708 - DNA, 25 bp, Mus musculus
gcgcctgcactgagcgtgcgcagaa

SEQ ID NO: 417709 - DNA, 25 bp, Mus musculus
ctgagcgtgcgcagaacacgagctc

SEQ ID NO: 417710 - DNA, 25 bp, Mus musculus
atcgcgtcacagagaccttgatttg

SEQ ID NO: 417711 - DNA, 25 bp, Mus musculus
tcggtcactaccaggaaccactgcg

SEQ ID NO: 417712 - DNA, 25 bp, Mus musculus
cttcactacagcaactcggtcacta

SEQ ID NO: 417713 - DNA, 25 bp, Mus musculus
cgtgacggatcgcttcactacagca

SEQ ID NO: 417714 - DNA, 25 bp, Mus musculus
gcgagcagtggagggacgagcggat

SEQ ID NO: 417715 - DNA, 25 bp, Mus musculus
cgagctcggcggtccggagggaagc

SEQ ID NO: 417716 - DNA, 25 bp, Mus musculus
ccgacgatagggacgagctggtgcg

SEQ ID NO: 417717 - DNA, 25 bp, Mus musculus
agggctaccggtccggactcctgct

SEQ ID NO: 417718 - DNA, 25 bp, Mus musculus
cccgagaggcgactccgcactccag

SEQ ID NO: 417719 - DNA, 25 bp, Mus musculus
gactccgcactccagctctccgggg

SEQ ID NO: 417720 - DNA, 25 bp, Mus musculus
acgagcggatcggacgtcgtcctcc

SEQ ID NO: 417721 - DNA, 25 bp, Mus musculus
ggatcggacgtcgtcctcctcagac

SEQ ID NO: 417722 - DNA, 25 bp, Mus musculus
aggccggcgtgaggggcgatagaag

SEQ ID NO: 417723 - DNA, 25 bp, Mus musculus
cgatagaagaggtgtctgccccgca

SEQ ID NO: 417724 - DNA, 25 bp, Mus musculus
gaagaggtgtctgccccgcatgcct

SEQ ID NO: 417725 - DNA, 25 bp, Mus musculus
catgcctgggcccagcgtcggggct

SEQ ID NO: 417726 - DNA, 25 bp, Mus musculus
agcggatcggacgtcgtcctcctca

SEQ ID NO: 417727 - DNA, 25 bp, Mus musculus
gcgtggaagagtgcgaggagaggct

SEQ ID NO: 417728 - DNA, 25 bp, Mus musculus
gcactaggtgagttccggggatcct

SEQ ID NO: 417729 - DNA, 25 bp, Mus musculus
caacaggcactaggtgagttccggg

SEQ ID NO: 417730 - DNA, 25 bp, Mus musculus
tgacaacaggcactaggtgagttcc

SEQ ID NO: 417731 - DNA, 25 bp, Mus musculus
taatgttgacaacaggcactaggtg

SEQ ID NO: 417732 - DNA, 25 bp, Mus musculus
aaggcgggccctcgtctgcgagagc

SEQ ID NO: 417733 - DNA, 25 bp, Mus musculus
cctagcagcccggccgcgttggtga

SEQ ID NO: 417734 - DNA, 25 bp, Mus musculus
tttccttttccctctgcgctccgcc

SEQ ID NO: 417735 - DNA, 25 bp, Mus musculus
agtcgtgcgggcagccttttccttt

SEQ ID NO: 417736 - DNA, 25 bp, Mus musculus
ccatttggactaggcagtcgtgcgg

SEQ ID NO: 417737 - DNA, 25 bp, Mus musculus
gaccggagacgaaggtccatttgga

SEQ ID NO: 417738 - DNA, 25 bp, Mus musculus
ggtccatttggactaggcagtcgtg

SEQ ID NO: 417739 - DNA, 25 bp, Mus musculus
gacgaaggtccatttggactaggca

SEQ ID NO: 417740 - DNA, 25 bp, Mus musculus
cggagacgaaggtccatttggacta

SEQ ID NO: 417741 - DNA, 25 bp, Mus musculus
cactaggtgagttccggggatcctc

SEQ ID NO: 417742 - DNA, 25 bp, Mus musculus
cttgcagaatcacgcacacatttta

SEQ ID NO: 417743 - DNA, 25 bp, Mus musculus
ttcggacggaaacgtgacagacgtc

SEQ ID NO: 417744 - DNA, 25 bp, Mus musculus
aagggaaccagcaggtaagcatctc

SEQ ID NO: 417745 - DNA, 25 bp, Mus musculus
cgctcctttggacgggagtccttga

SEQ ID NO: 417746 - DNA, 25 bp, Mus musculus
tgcccttccgtctgctgttctagcg

SEQ ID NO: 417747 - DNA, 25 bp, Mus musculus
cctcggctaatttaccgctcctttg

SEQ ID NO: 417748 - DNA, 25 bp, Mus musculus
cggcttactgccgttgggaacttgc

SEQ ID NO: 417749 - DNA, 25 bp, Mus musculus
cctgctgtgacccttctggagagct

SEQ ID NO: 417750 - DNA, 25 bp, Mus musculus
ttggtgtttcctgcaagcgaggccc

SEQ ID NO: 417751 - DNA, 25 bp, Mus musculus
gatctctgctgttctggcatcagca

SEQ ID NO: 417752 - DNA, 25 bp, Mus musculus
ggccctgggcaacgatgtacagcga

SEQ ID NO: 417753 - DNA, 25 bp, Mus musculus
tgtacagcgaggacccttagcttcg

SEQ ID NO: 417754 - DNA, 25 bp, Mus musculus
ggtgtaccacaacaagccggctctg

SEQ ID NO: 417755 - DNA, 25 bp, Mus musculus
aagtgacgccactcagcggtcaggc

SEQ ID NO: 417756 - DNA, 25 bp, Mus musculus
ctggagcagagggaccaggcagcag

SEQ ID NO: 417757 - DNA, 25 bp, Mus musculus
gtcgcaagcgtcacacgccactgca

SEQ ID NO: 417758 - DNA, 25 bp, Mus musculus
agagacggcgctaaacgctgcgtgc

SEQ ID NO: 417759 - DNA, 25 bp, Mus musculus
tgcggacgtggctctgcgcaccagc

SEQ ID NO: 417760 - DNA, 25 bp, Mus musculus
caacgcctgtgctaatggctgcgga

SEQ ID NO: 417761 - DNA, 25 bp, Mus musculus
gccactgcacaacgcctgtgctaat

SEQ ID NO: 417762 - DNA, 25 bp, Mus musculus
caggctgccggtcgcaagcgtcaca

SEQ ID NO: 417763 - DNA, 25 bp, Mus musculus
gctcctggaagctggggctgatccc

SEQ ID NO: 417764 - DNA, 25 bp, Mus musculus
cgcagcgcgacagctcctggaagct

SEQ ID NO: 417765 - DNA, 25 bp, Mus musculus
agcacgaggccgcagcgcgacagct

SEQ ID NO: 417766 - DNA, 25 bp, Mus musculus
gacggcgctaaacgctgcgtgcgct

SEQ ID NO: 417767 - DNA, 25 bp, Mus musculus
cagccagggagagacggcgctaaac

SEQ ID NO: 417768 - DNA, 25 bp, Mus musculus
ctctgcgcaccagccagggagagac

SEQ ID NO: 417769 - DNA, 25 bp, Mus musculus
tgcacaacgcctgtgctaatggctg

SEQ ID NO: 417770 - DNA, 25 bp, Mus musculus
tgccgccattctggcagagcagctg

SEQ ID NO: 417771 - DNA, 25 bp, Mus musculus
cgggaggactctgcgagtagcacct

SEQ ID NO: 417772 - DNA, 25 bp, Mus musculus
aggactctgcgagtagcacctggga

SEQ ID NO: 417773 - DNA, 25 bp, Mus musculus
cctggacccttagaacgggctcagc

SEQ ID NO: 417774 - DNA, 25 bp, Mus musculus
ttagaacgggctcagcaggccagac

SEQ ID NO: 417775 - DNA, 25 bp, Mus musculus
ccgagcagcagcaggcatccgagca

SEQ ID NO: 417776 - DNA, 25 bp, Mus musculus
agcggggctgctcacagcgaatgcc

SEQ ID NO: 417777 - DNA, 25 bp, Mus musculus
gctgctcacagcgaatgccggtgta

SEQ ID NO: 417778 - DNA, 25 bp, Mus musculus
ctcacagcgaatgccggtgtagccg

SEQ ID NO: 417779 - DNA, 25 bp, Mus musculus
ttctgctggcaggtgccgccattct

SEQ ID NO: 417780 - DNA, 25 bp, Mus musculus
aagtccgccgggtcagggctccaca

SEQ ID NO: 417781 - DNA, 25 bp, Mus musculus
agagcagctggtcatcgtcgcacac

SEQ ID NO: 417782 - DNA, 25 bp, Mus musculus
tggtcatcgtcgcacacattggctg

SEQ ID NO: 417783 - DNA, 25 bp, Mus musculus
tcgtcgcacacattggctgcgggcc

SEQ ID NO: 417784 - DNA, 25 bp, Mus musculus
gcaaagatggcaaagcggtccctta

SEQ ID NO: 417785 - DNA, 25 bp, Mus musculus
caggtcagtgaaggtgaagaactcc

SEQ ID NO: 417786 - DNA, 25 bp, Mus musculus
agcgcacatgcttctctttcttgga

SEQ ID NO: 417787 - DNA, 25 bp, Mus musculus
cgtgagtactcctcggtgcagagca

SEQ ID NO: 417788 - DNA, 25 bp, Mus musculus
ttggaccctgcccagcgtgagtact

SEQ ID NO: 417789 - DNA, 25 bp, Mus musculus
atgcttctctttcttggaccctgcc

SEQ ID NO: 417790 - DNA, 25 bp, Mus musculus
ggtcccttacctcaaagcgcacatg

SEQ ID NO: 417791 - DNA, 25 bp, Mus musculus
ttacgcaggtcagggccggcaaaga

SEQ ID NO: 417792 - DNA, 25 bp, Mus musculus
caggttgtccatgttacgcaggtca

SEQ ID NO: 417793 - DNA, 25 bp, Mus musculus
cctcgtgtacaggttgtccatgtta

SEQ ID NO: 417794 - DNA, 25 bp, Mus musculus
tgaaggtgaagaactccttgaggcc

SEQ ID NO: 417795 - DNA, 25 bp, Mus musculus
taggtgccacccagcgcaggacgca

SEQ ID NO: 417796 - DNA, 25 bp, Mus musculus
cacgtaggtgccacccagcgcagga

SEQ ID NO: 417797 - DNA, 25 bp, Mus musculus
gctctccatcctcgtgtacaggttg

SEQ ID NO: 417798 - DNA, 25 bp, Mus musculus
gggacgacctgagcgccaggctgcg

SEQ ID NO: 417799 - DNA, 25 bp, Mus musculus
ctcctgacggctggggacgacctga

SEQ ID NO: 417800 - DNA, 25 bp, Mus musculus
cggctcccgactgttcactaacagg

SEQ ID NO: 417801 - DNA, 25 bp, Mus musculus
gctcccgactgttcactaacaggta

SEQ ID NO: 417802 - DNA, 25 bp, Mus musculus
tcccgactgttcactaacaggtagg

SEQ ID NO: 417803 - DNA, 25 bp, Mus musculus
tgttcactaacaggtagggcgctcc

SEQ ID NO: 417804 - DNA, 25 bp, Mus musculus
ttcactaacaggtagggcgctcctg

SEQ ID NO: 417805 - DNA, 25 bp, Mus musculus
cactaacaggtagggcgctcctgac

SEQ ID NO: 417806 - DNA, 25 bp, Mus musculus
agcagccggcttcatctgcagggcc

SEQ ID NO: 417807 - DNA, 25 bp, Mus musculus
cgctcctgacggctggggacgacct

SEQ ID NO: 417808 - DNA, 25 bp, Mus musculus
tgcggctctcaaggcgggcccagca

SEQ ID NO: 417809 - DNA, 25 bp, Mus musculus
agccggcttcatctgcagggccggc

SEQ ID NO: 417810 - DNA, 25 bp, Mus musculus
ctgggacagcgctggattccggctc

SEQ ID NO: 417811 - DNA, 25 bp, Mus musculus
tcctggctgggacagcgctggattc

SEQ ID NO: 417812 - DNA, 25 bp, Mus musculus
gataactttgcgtccgaacctcggc

SEQ ID NO: 417813 - DNA, 25 bp, Mus musculus
cgtcgccgaagccttttcaaaatga

SEQ ID NO: 417814 - DNA, 25 bp, Mus musculus
tgaaagcaccctggcgaaactgcgg

SEQ ID NO: 417815 - DNA, 25 bp, Mus musculus
tggccaccctcagatctgggctggg

SEQ ID NO: 417816 - DNA, 25 bp, Mus musculus
tcttaaagatgctgcacccggcgcg

SEQ ID NO: 417817 - DNA, 25 bp, Mus musculus
ccctccacagcaccgaaagaagttt

SEQ ID NO: 417818 - DNA, 25 bp, Mus musculus
tagcagccgccaccagataactttg

SEQ ID NO: 417819 - DNA, 25 bp, Mus musculus
agcagcgttattgcaacagcccatc

SEQ ID NO: 417820 - DNA, 25 bp, Mus musculus
agagttctccttgcgcctttagagc

SEQ ID NO: 417821 - DNA, 25 bp, Mus musculus
ttctaacctgactggccaagagttc

SEQ ID NO: 417822 - DNA, 25 bp, Mus musculus
cccacacaggcgctcggatagaaaa

SEQ ID NO: 417823 - DNA, 25 bp, Mus musculus
acccgagatctggaggtccacttcc

SEQ ID NO: 417824 - DNA, 25 bp, Mus musculus
ttcccgtctttgctctccctggagt

SEQ ID NO: 417825 - DNA, 25 bp, Mus musculus
ccgatcgggaggtcgctgttaacaa

SEQ ID NO: 417826 - DNA, 25 bp, Mus musculus
ccgctcaggctgtggactctggaaa

SEQ ID NO: 417827 - DNA, 25 bp, Mus musculus
agtcacgggcctctctcctttattc

SEQ ID NO: 417828 - DNA, 25 bp, Mus musculus
ttgaggacccttctggcacctgtcc

SEQ ID NO: 417829 - DNA, 25 bp, Mus musculus
caagtaggtactggctgaaaggatc

SEQ ID NO: 417830 - DNA, 25 bp, Mus musculus
ttgcattccgtcaaccgggacctca

SEQ ID NO: 417831 - DNA, 25 bp, Mus musculus
gcgaacttccaggacaacttgcatt

SEQ ID NO: 417832 - DNA, 25 bp, Mus musculus
cgagaaggccttcatcgcgaacttc

SEQ ID NO: 417833 - DNA, 25 bp, Mus musculus
ccttaaggatggcatgcgcaacaaa

SEQ ID NO: 417834 - DNA, 25 bp, Mus musculus
acgctctagcgtgagtagggtcttc

SEQ ID NO: 417835 - DNA, 25 bp, Mus musculus
ctggaggccttttcgcaggctatta

SEQ ID NO: 417836 - DNA, 25 bp, Mus musculus
acgtgctgagcgttggtgtgaacct

SEQ ID NO: 417837 - DNA, 25 bp, Mus musculus
tgacagctgcaacatggcggacgtg

SEQ ID NO: 417838 - DNA, 25 bp, Mus musculus
ggactctggaaagccggctgtgaca

SEQ ID NO: 417839 - DNA, 25 bp, Mus musculus
agtccgctgtcactttcgctcatct

SEQ ID NO: 417840 - DNA, 25 bp, Mus musculus
gcgagcaccggtccagtagagcggc

SEQ ID NO: 417841 - DNA, 25 bp, Mus musculus
gggccatctttgaaccgggcctgcc

SEQ ID NO: 417842 - DNA, 25 bp, Mus musculus
gagcccgccatgacggcgcgagtgt

SEQ ID NO: 417843 - DNA, 25 bp, Mus musculus
gcgccggcctcttatcccgcagcgg

SEQ ID NO: 417844 - DNA, 25 bp, Mus musculus
ggcctccggcgcagcccggaaatgt

SEQ ID NO: 417845 - DNA, 25 bp, Mus musculus
cggcgcagcccggaaatgtccggca

SEQ ID NO: 417846 - DNA, 25 bp, Mus musculus
gcccggaaatgtccggcaagatcga

SEQ ID NO: 417847 - DNA, 25 bp, Mus musculus
aaatgtccggcaagatcgagaaagc

SEQ ID NO: 417848 - DNA, 25 bp, Mus musculus
tgtccggcaagatcgagaaagcagg

SEQ ID NO: 417849 - DNA, 25 bp, Mus musculus
ccggcaagatcgagaaagcaggtga

SEQ ID NO: 417850 - DNA, 25 bp, Mus musculus
cctcctggcctcgtgcgctagaccc

SEQ ID NO: 417851 - DNA, 25 bp, Mus musculus
cagcgacgccgcgagggccatcttt

SEQ ID NO: 417852 - DNA, 25 bp, Mus musculus
ccgggccctgatgagcagcggcctc

SEQ ID NO: 417853 - DNA, 25 bp, Mus musculus
cgagggccatctttgaaccgggcct

SEQ ID NO: 417854 - DNA, 25 bp, Mus musculus
cccggcgccggctggaacagcaccg

SEQ ID NO: 417855 - DNA, 25 bp, Mus musculus
ctcgccggacacagacgcgggttct

SEQ ID NO: 417856 - DNA, 25 bp, Mus musculus
tgccagtggccttaggcccgggacc

SEQ ID NO: 417857 - DNA, 25 bp, Mus musculus
agtactgccagtggccttaggcccg

SEQ ID NO: 417858 - DNA, 25 bp, Mus musculus
cggcccagtactgccagtggcctta

SEQ ID NO: 417859 - DNA, 25 bp, Mus musculus
gctcgctgccttctgcggcctcggt

SEQ ID NO: 417860 - DNA, 25 bp, Mus musculus
aggctcgcccacgaagccgatgggc

SEQ ID NO: 417861 - DNA, 25 bp, Mus musculus
tggaggctcgcccacgaagccgatg

SEQ ID NO: 417862 - DNA, 25 bp, Mus musculus
ggcctcggtccgatcctcctctggc

SEQ ID NO: 417863 - DNA, 25 bp, Mus musculus
aacagcaccggcacctgcggaaagg

SEQ ID NO: 417864 - DNA, 25 bp, Mus musculus
cgatgggcggcccagtactgccagt

SEQ ID NO: 417865 - DNA, 25 bp, Mus musculus
gcgggtagagtagcgccactgcctt

SEQ ID NO: 417866 - DNA, 25 bp, Mus musculus
gtgctgcgctggtcctcggcagctt

SEQ ID NO: 417867 - DNA, 25 bp, Mus musculus
cgcgtcttcttccagcagctgcggg

SEQ ID NO: 417868 - DNA, 25 bp, Mus musculus
gcaccggctcgggtttcctggtgcc

SEQ ID NO: 417869 - DNA, 25 bp, Mus musculus
atcgatccctttgcggattcgcccg

SEQ ID NO: 417870 - DNA, 25 bp, Mus musculus
ctgtgcagccttgatcgatcccttt

SEQ ID NO: 417871 - DNA, 25 bp, Mus musculus
gaatagctagagctgcagcggaccc

SEQ ID NO: 417872 - DNA, 25 bp, Mus musculus
gtcctcttggcttggaatagctaga

SEQ ID NO: 417873 - DNA, 25 bp, Mus musculus
ccaccctaagtcctcttggcttgga

SEQ ID NO: 417874 - DNA, 25 bp, Mus musculus
tccacggctgagtcaacacctcgtt

SEQ ID NO: 417875 - DNA, 25 bp, Mus musculus
ggcaggttaataattggccgccttg

SEQ ID NO: 417876 - DNA, 25 bp, Mus musculus
gtgctcacaggctgtgctgctcagg

SEQ ID NO: 417877 - DNA, 25 bp, Mus musculus
atcaacgtgggtgctcacaggctgt

SEQ ID NO: 417878 - DNA, 25 bp, Mus musculus
cctccatggccggatcaacgtgggt

SEQ ID NO: 417879 - DNA, 25 bp, Mus musculus
agtattgcctcgctcttgtccgcac

SEQ ID NO: 417880 - DNA, 25 bp, Mus musculus
agggcgggagcttctgagttatccc

SEQ ID NO: 417881 - DNA, 25 bp, Mus musculus
ggccgccttgtttgtccacggctga

SEQ ID NO: 417882 - DNA, 25 bp, Mus musculus
tgcagccgagctaggccagaagaac

SEQ ID NO: 417883 - DNA, 25 bp, Mus musculus
tccgcgtcggagttctcacctttaa

SEQ ID NO: 417884 - DNA, 25 bp, Mus musculus
ggcaaacgaaccacgtgacctcact

SEQ ID NO: 417885 - DNA, 25 bp, Mus musculus
gttcaacatcatccagaagcgggga

SEQ ID NO: 417886 - DNA, 25 bp, Mus musculus
ggctggaactcagcggttcaacatc

SEQ ID NO: 417887 - DNA, 25 bp, Mus musculus
cagaaagaactaaagcaaaaccgtg

SEQ ID NO: 417888 - DNA, 25 bp, Mus musculus
cagaagaacccatggctggaactca

SEQ ID NO: 417889 - DNA, 25 bp, Mus musculus
tcggagttctcacctttaagcagtt

SEQ ID NO: 417890 - DNA, 25 bp, Mus musculus
gaggtttatagacagcgaagagccc

SEQ ID NO: 417891 - DNA, 25 bp, Mus musculus
cccggaggtttatagacagcgaaga

SEQ ID NO: 417892 - DNA, 25 bp, Mus musculus
cggtctcacgcaagtgcagccactt

SEQ ID NO: 417893 - DNA, 25 bp, Mus musculus
gcagttgcaactccacggtctcacg

SEQ ID NO: 417894 - DNA, 25 bp, Mus musculus
tttaagcagttgcaactccacggtc

SEQ ID NO: 417895 - DNA, 25 bp, Mus musculus
gtgacctcactccacatcagaaaga

SEQ ID NO: 417896 - DNA, 25 bp, Mus musculus
tgctctgtctgcacagcccgggact

SEQ ID NO: 417897 - DNA, 25 bp, Mus musculus
aagcgatggaccttgggtgctgact

SEQ ID NO: 417898 - DNA, 25 bp, Mus musculus
ggtgcgtgctccatccgcagagcca

SEQ ID NO: 417899 - DNA, 25 bp, Mus musculus
cactgtgatgccctgcggccggaaa

SEQ ID NO: 417900 - DNA, 25 bp, Mus musculus
cctcgtgtacgctctggaagccgtt

SEQ ID NO: 417901 - DNA, 25 bp, Mus musculus
ttctgccaccgctcttctgatgatg

SEQ ID NO: 417902 - DNA, 25 bp, Mus musculus
ctcttctgatgatgtgtcgcccgca

SEQ ID NO: 417903 - DNA, 25 bp, Mus musculus
ccgcagcgatgaaggacatgccgtt

SEQ ID NO: 417904 - DNA, 25 bp, Mus musculus
catgccgttgatgttggccaggacc

SEQ ID NO: 417905 - DNA, 25 bp, Mus musculus
cctgcacattgacagccgccttgga

SEQ ID NO: 417906 - DNA, 25 bp, Mus musculus
aagtccttgcctgcgctgttggtca

SEQ ID NO: 417907 - DNA, 25 bp, Mus musculus
ctgttggtcacgcttatgttgctgg

SEQ ID NO: 417908 - DNA, 25 bp, Mus musculus
ccgccttggagatggtcttgttgaa

SEQ ID NO: 417909 - DNA, 25 bp, Mus musculus
gtcgatgccacacgccgacatggtc

SEQ ID NO: 417910 - DNA, 25 bp, Mus musculus
cgtggtcttactgccggaggtccga

SEQ ID NO: 417911 - DNA, 25 bp, Mus musculus
cgcctccgacctccaggaggtccga

SEQ ID NO: 417912 - DNA, 25 bp, Mus musculus
ttaacagcttccgagaaaagccgga

SEQ ID NO: 417913 - DNA, 25 bp, Mus musculus
cctggatgttaacagcttccgagaa

SEQ ID NO: 417914 - DNA, 25 bp, Mus musculus
tcctgtcctggatgttaacagcttc

SEQ ID NO: 417915 - DNA, 25 bp, Mus musculus
cgggacttcctgtcctggatgttaa

SEQ ID NO: 417916 - DNA, 25 bp, Mus musculus
ttgcgtcatcagtacaaggcgggga

SEQ ID NO: 417917 - DNA, 25 bp, Mus musculus
cgtagctttgcgtcatcagtacaag

SEQ ID NO: 417918 - DNA, 25 bp, Mus musculus
agtccgccttacgtagctttgcgtc

SEQ ID NO: 417919 - DNA, 25 bp, Mus musculus
cgtcagtccgccttacgtagctttg

SEQ ID NO: 417920 - DNA, 25 bp, Mus musculus
agattacgtttacgtcagtccgcct

SEQ ID NO: 417921 - DNA, 25 bp, Mus musculus
cgcggcgcaacctggcccttttatt

SEQ ID NO: 417922 - DNA, 25 bp, Mus musculus
gaggtccgaaatcccgccaacaatg

SEQ ID NO: 417923 - DNA, 25 bp, Mus musculus
tcttactgccggaggtccgaaatcc

SEQ ID NO: 417924 - DNA, 25 bp, Mus musculus
gcccgcctgctgtacccggaccaca

SEQ ID NO: 417925 - DNA, 25 bp, Mus musculus
cccgtacgcggccagctgtaggtga

SEQ ID NO: 417926 - DNA, 25 bp, Mus musculus
aaccacgcggacgtccgctgccatg

SEQ ID NO: 417927 - DNA, 25 bp, Mus musculus
ctgtaggtgagcagctctgattcca

SEQ ID NO: 417928 - DNA, 25 bp, Mus musculus
cagctctgattccagtgtccgcggc

SEQ ID NO: 417929 - DNA, 25 bp, Mus musculus
ctcttttctgctcgcagatgtaccc

SEQ ID NO: 417930 - DNA, 25 bp, Mus musculus
cgggcctccgtagtacctgcggagc

SEQ ID NO: 417931 - DNA, 25 bp, Mus musculus
cccgctgcaaaagatgctgctggct

SEQ ID NO: 417932 - DNA, 25 bp, Mus musculus
ctgcaaaagatgctgctggctgcgg

SEQ ID NO: 417933 - DNA, 25 bp, Mus musculus
cggcgggaatggctctctacaaccc

SEQ ID NO: 417934 - DNA, 25 bp, Mus musculus
gtttactcttcggtctcgaaagctg

SEQ ID NO: 417935 - DNA, 25 bp, Mus musculus
ctcttcggtctcgaaagctgggacc

SEQ ID NO: 417936 - DNA, 25 bp, Mus musculus
acctttacctcttttctgctcgcag

SEQ ID NO: 417937 - DNA, 25 bp, Mus musculus
gcgcctccaccgcagtcttcggccc

SEQ ID NO: 417938 - DNA, 25 bp, Mus musculus
tatctagaggcaatcggtccgtggc

SEQ ID NO: 417939 - DNA, 25 bp, Mus musculus
ggctcagcctaccactcccagcggg

SEQ ID NO: 417940 - DNA, 25 bp, Mus musculus
ggactcagaagctcgccctctgcgg

SEQ ID NO: 417941 - DNA, 25 bp, Mus musculus
ggtacagaccctacaaggacgagga

SEQ ID NO: 417942 - DNA, 25 bp, Mus musculus
ccctacaaggacgaggagtgggcca

SEQ ID NO: 417943 - DNA, 25 bp, Mus musculus
ccagacgcaccgaggctcggctgtg

SEQ ID NO: 417944 - DNA, 25 bp, Mus musculus
caccgcactccgctgccgcaaccgg

SEQ ID NO: 417945 - DNA, 25 bp, Mus musculus
caaccgggccgcatcctgacggggc

SEQ ID NO: 417946 - DNA, 25 bp, Mus musculus
tttctgagcggggaaaatgtgccag

SEQ ID NO: 417947 - DNA, 25 bp, Mus musculus
cgagaacgctctgatgtcctggcta

SEQ ID NO: 417948 - DNA, 25 bp, Mus musculus
aacgctctgatgtcctggctatcta

SEQ ID NO: 417949 - DNA, 25 bp, Mus musculus
ctgatgtcctggctatctagaggca

SEQ ID NO: 417950 - DNA, 25 bp, Mus musculus
cctggctatctagaggcaatcggtc

SEQ ID NO: 417951 - DNA, 25 bp, Mus musculus
cggggcagaggtacagaccctacaa

SEQ ID NO: 417952 - DNA, 25 bp, Mus musculus
tctgtatcatgtaggactgggaggc

SEQ ID NO: 417953 - DNA, 25 bp, Mus musculus
agcttctaaggggagcgcacgagta

SEQ ID NO: 417954 - DNA, 25 bp, Mus musculus
tcgccttgtctggtttttgagcttc

SEQ ID NO: 417955 - DNA, 25 bp, Mus musculus
cattgacagtgagcaggcggtcttc

SEQ ID NO: 417956 - DNA, 25 bp, Mus musculus
ggaatccttcgccttgctctgtatc

SEQ ID NO: 417957 - DNA, 25 bp, Mus musculus
tagggagatgcgtttggaatccttc

SEQ ID NO: 417958 - DNA, 25 bp, Mus musculus
agtccgagagttgaggcgcacacac

SEQ ID NO: 417959 - DNA, 25 bp, Mus musculus
gtcgccctccgagagccgggataat

SEQ ID NO: 417960 - DNA, 25 bp, Mus musculus
ggaattccggacctctcttggcctg

SEQ ID NO: 417961 - DNA, 25 bp, Mus musculus
tggtttcctaaacatggcggcgccc

SEQ ID NO: 417962 - DNA, 25 bp, Mus musculus
ttccgtttacgcttcctggtggcga

SEQ ID NO: 417963 - DNA, 25 bp, Mus musculus
agctgagcagtaacgaacggatttc

SEQ ID NO: 417964 - DNA, 25 bp, Mus musculus
gggtgccttcgtccaatagctgagc

SEQ ID NO: 417965 - DNA, 25 bp, Mus musculus
ggtcttccggcatgtttcacccgtg

SEQ ID NO: 417966 - DNA, 25 bp, Mus musculus
agtgggccgctccaacaatacgggc

SEQ ID NO: 417967 - DNA, 25 bp, Mus musculus
cgaggccggtagcatctcttgagcc

SEQ ID NO: 417968 - DNA, 25 bp, Mus musculus
cccagcttggaggaataccctgtca

SEQ ID NO: 417969 - DNA, 25 bp, Mus musculus
tccctagagtaacccgcgttgtgtc

SEQ ID NO: 417970 - DNA, 25 bp, Mus musculus
tacctcgcagaagctcggcaatcgc

SEQ ID NO: 417971 - DNA, 25 bp, Mus musculus
ctgggttctgcctggctccttaaaa

SEQ ID NO: 417972 - DNA, 25 bp, Mus musculus
ttaaaagcgcacaccagatctcggg

SEQ ID NO: 417973 - DNA, 25 bp, Mus musculus
gatgtccagccacaattctcggttg

SEQ ID NO: 417974 - DNA, 25 bp, Mus musculus
agcccggagctcaaccacagatgtc

SEQ ID NO: 417975 - DNA, 25 bp, Mus musculus
agcgtggacctcgtctctgtagagc

SEQ ID NO: 417976 - DNA, 25 bp, Mus musculus
cacaatgatcgttctgggacctgcc

SEQ ID NO: 417977 - DNA, 25 bp, Mus musculus
cccagcgtaatcgaccggaggactc

SEQ ID NO: 417978 - DNA, 25 bp, Mus musculus
tcgggagctgcgtatcggaatacct

SEQ ID NO: 417979 - DNA, 25 bp, Mus musculus
tggccgcagactcgtacaagaattg

SEQ ID NO: 417980 - DNA, 25 bp, Mus musculus
gacagcggagcgtacaggcgcctaa

SEQ ID NO: 417981 - DNA, 25 bp, Mus musculus
gaacctgggctcctcgcgaagactg

SEQ ID NO: 417982 - DNA, 25 bp, Mus musculus
aagactgcagcctccacggctgaga

SEQ ID NO: 417983 - DNA, 25 bp, Mus musculus
ctccacggctgagaggcagagagcc

SEQ ID NO: 417984 - DNA, 25 bp, Mus musculus
aatcccgggtgtcagtattccagga

SEQ ID NO: 417985 - DNA, 25 bp, Mus musculus
tattccaggagtgagatgaacgccc

SEQ ID NO: 417986 - DNA, 25 bp, Mus musculus
gagtgagatgaacgcccatggtaca

SEQ ID NO: 417987 - DNA, 25 bp, Mus musculus
tggtacaagcggtccaccatggccc

SEQ ID NO: 417988 - DNA, 25 bp, Mus musculus
aagcggtccaccatggcccacggat

SEQ ID NO: 417989 - DNA, 25 bp, Mus musculus
acggatccttccttccgtgccaacg

SEQ ID NO: 417990 - DNA, 25 bp, Mus musculus
acgccttccgaggtccacacggaga

SEQ ID NO: 417991 - DNA, 25 bp, Mus musculus
cttccgaggtccacacggagaaggc

SEQ ID NO: 417992 - DNA, 25 bp, Mus musculus
ctaaccctggacctctagggcctgg

SEQ ID NO: 417993 - DNA, 25 bp, Mus musculus
tggagcaggtgcctaaccctggacc

SEQ ID NO: 417994 - DNA, 25 bp, Mus musculus
ttgaactggccaatgggcgagctgc

SEQ ID NO: 417995 - DNA, 25 bp, Mus musculus
ttctccctggtagctattctgccgg

SEQ ID NO: 417996 - DNA, 25 bp, Mus musculus
ccttccatctattggttctccctgg

SEQ ID NO: 417997 - DNA, 25 bp, Mus musculus
atccaggagcggtctggctctccat

SEQ ID NO: 417998 - DNA, 25 bp, Mus musculus
cctccagaccagctccagggatgtg

SEQ ID NO: 417999 - DNA, 25 bp, Mus musculus
tgggccgcagcagttacatgcgctc

SEQ ID NO: 418000 - DNA, 25 bp, Mus musculus
agggctgcgcccttctatgggcaga

SEQ ID NO: 418001 - DNA, 25 bp, Mus musculus
agtctaggcgcgctccttcctgcgt

SEQ ID NO: 418002 - DNA, 25 bp, Mus musculus
cgacttcataaggagacggttctgg

SEQ ID NO: 418003 - DNA, 25 bp, Mus musculus
ggcctccgacttcaacgacttcata

SEQ ID NO: 418004 - DNA, 25 bp, Mus musculus
aggcgtcgcgtgtctccctgacgac

SEQ ID NO: 418005 - DNA, 25 bp, Mus musculus
tggacaggcctcgtgacccagaagt

SEQ ID NO: 418006 - DNA, 25 bp, Mus musculus
ctaaatggcgaaacccgagaggctc

SEQ ID NO: 418007 - DNA, 25 bp, Mus musculus
ttcaggattcaggaggaccagggca

SEQ ID NO: 418008 - DNA, 25 bp, Mus musculus
caggctccctagtgaccgcggtgga

SEQ ID NO: 418009 - DNA, 25 bp, Mus musculus
gtttagcctcaatcccgcattcttg

SEQ ID NO: 418010 - DNA, 25 bp, Mus musculus
atcccgcattcttgctctggccagg

SEQ ID NO: 418011 - DNA, 25 bp, Mus musculus
tgacggacaggttctgcgaccgtta

SEQ ID NO: 418012 - DNA, 25 bp, Mus musculus
tctgcgaccgttacggagaggctgc

SEQ ID NO: 418013 - DNA, 25 bp, Mus musculus
cggattcgagggtttgttgtcagtc

SEQ ID NO: 418014 - DNA, 25 bp, Mus musculus
tgttgtcagtcgtgtcagctggtga

SEQ ID NO: 418015 - DNA, 25 bp, Mus musculus
tcagctggtgacatgccatgccgtc

SEQ ID NO: 418016 - DNA, 25 bp, Mus musculus
acatgccatgccgtccgatggtcgc

SEQ ID NO: 418017 - DNA, 25 bp, Mus musculus
ccgatggtcgctgctgggaaactct

SEQ ID NO: 418018 - DNA, 25 bp, Mus musculus
gggaaactctgagggcgctccgcaa

SEQ ID NO: 418019 - DNA, 25 bp, Mus musculus
gggcgctccgcaacaccagcaaagg

SEQ ID NO: 418020 - DNA, 25 bp, Mus musculus
gcccgcgtttagcaggctccctagt

SEQ ID NO: 418021 - DNA, 25 bp, Mus musculus
cgtaggctcgctagtttagcctcaa

SEQ ID NO: 418022 - DNA, 25 bp, Mus musculus
cacagattctctgcagggcggactg

SEQ ID NO: 418023 - DNA, 25 bp, Mus musculus
ggcaggattgctcgggtcccacgcc

SEQ ID NO: 418024 - DNA, 25 bp, Mus musculus
tcggtcctctccgtactgcagtgga

SEQ ID NO: 418025 - DNA, 25 bp, Mus musculus
cagtggagcagcgagtcccgcctct

SEQ ID NO: 418026 - DNA, 25 bp, Mus musculus
cgcgcgcggccgcttataaaagcca

SEQ ID NO: 418027 - DNA, 25 bp, Mus musculus
ttataaaagccacagtgcgcgcgcg

SEQ ID NO: 418028 - DNA, 25 bp, Mus musculus
gcggcgcatctttttcctcagcagc

SEQ ID NO: 418029 - DNA, 25 bp, Mus musculus
tcacggtccgccgaaggtacgcgaa

SEQ ID NO: 418030 - DNA, 25 bp, Mus musculus
tcggagcctcctgtctgcagtgaag

SEQ ID NO: 418031 - DNA, 25 bp, Mus musculus
gcagtgaagggctcgctgaccttaa

SEQ ID NO: 418032 - DNA, 25 bp, Mus musculus
gggctcgctgaccttaatttcatcc

SEQ ID NO: 418033 - DNA, 25 bp, Mus musculus
aatttcatcctgtgtggcggtcccg

SEQ ID NO: 418034 - DNA, 25 bp, Mus musculus
tgcccttcgccgcagtctcggaagg

SEQ ID NO: 418035 - DNA, 25 bp, Mus musculus
gtcactatccgctgcggagcgaacg

SEQ ID NO: 418036 - DNA, 25 bp, Mus musculus
gccaatacaacaaaaccgcagcgat

SEQ ID NO: 418037 - DNA, 25 bp, Mus musculus
ccgaaaaggcctgggcgacgcgcac

SEQ ID NO: 418038 - DNA, 25 bp, Mus musculus
cagcgcttccaacgcgccgaaaagg

SEQ ID NO: 418039 - DNA, 25 bp, Mus musculus
tcatcctgaagaggcgcaggccgcc

SEQ ID NO: 418040 - DNA, 25 bp, Mus musculus
cacgcccagggtctcatcctgaaga

SEQ ID NO: 418041 - DNA, 25 bp, Mus musculus
tgcgccctggaacgtgaccttagcg

SEQ ID NO: 418042 - DNA, 25 bp, Mus musculus
tacagcatcgtctttaaggcccaga

SEQ ID NO: 418043 - DNA, 25 bp, Mus musculus
cgcgcacattgccatggcgacggtc

SEQ ID NO: 418044 - DNA, 25 bp, Mus musculus
accgcagcgatttgggattgcccta

SEQ ID NO: 418045 - DNA, 25 bp, Mus musculus
cggaacagctcttcgtggtataagg

SEQ ID NO: 418046 - DNA, 25 bp, Mus musculus
cgtgggctccaggttcaaagatggc

SEQ ID NO: 418047 - DNA, 25 bp, Mus musculus
accgccgcaggcctagtgggccatg

SEQ ID NO: 418048 - DNA, 25 bp, Mus musculus
cgtgaaaacacaacgctgcgccagg

SEQ ID NO: 418049 - DNA, 25 bp, Mus musculus
cgccgtttttgaactggttacagca

SEQ ID NO: 418050 - DNA, 25 bp, Mus musculus
tgcgatcctgcctcagcccaagaaa

SEQ ID NO: 418051 - DNA, 25 bp, Mus musculus
cccgaagcggcagtctgcgatcctg

SEQ ID NO: 418052 - DNA, 25 bp, Mus musculus
aagctggaggacaagtcggcctctc

SEQ ID NO: 418053 - DNA, 25 bp, Mus musculus
cgacttaaatctcccgcacctgagg

SEQ ID NO: 418054 - DNA, 25 bp, Mus musculus
tcctgtgagtttcttcctgctgtga

SEQ ID NO: 418055 - DNA, 25 bp, Mus musculus
tgctgtgaacatcagggctctgggc

SEQ ID NO: 418056 - DNA, 25 bp, Mus musculus
tgaggccgcctcagttcctgtgagt

SEQ ID NO: 418057 - DNA, 25 bp, Mus musculus
cccaagaaacccagaccggctgctg

SEQ ID NO: 418058 - DNA, 25 bp, Mus musculus
cccgccgcgaacaactcaaagaagt

SEQ ID NO: 418059 - DNA, 25 bp, Mus musculus
actcaaagaagtttctgctgattgg

SEQ ID NO: 418060 - DNA, 25 bp, Mus musculus
gggtgtgtgtcccactgtcatgtaa

SEQ ID NO: 418061 - DNA, 25 bp, Mus musculus
tgtcccactgtcatgtaaatatccc

SEQ ID NO: 418062 - DNA, 25 bp, Mus musculus
ggctgcgaggccgacttaaatctcc

SEQ ID NO: 418063 - DNA, 25 bp, Mus musculus
gagtttcttcctgctgtgaacatca

SEQ ID NO: 418064 - DNA, 25 bp, Mus musculus
cccgggctgtaacactgtctggttt

SEQ ID NO: 418065 - DNA, 25 bp, Mus musculus
gtctttggcagccagccggctgtca

SEQ ID NO: 418066 - DNA, 25 bp, Mus musculus
tgctgtaccactgtatgtccgaccc

SEQ ID NO: 418067 - DNA, 25 bp, Mus musculus
ggacagcatgctgtaccactgtatg

SEQ ID NO: 418068 - DNA, 25 bp, Mus musculus
tggtgcgcggacagcatgctgtacc

SEQ ID NO: 418069 - DNA, 25 bp, Mus musculus
tgcattcgccgggtgagctgtatgt

SEQ ID NO: 418070 - DNA, 25 bp, Mus musculus
agaacttgcattcgccgggtgagct

SEQ ID NO: 418071 - DNA, 25 bp, Mus musculus
tatgtttaatcacgaagagaaccga

SEQ ID NO: 418072 - DNA, 25 bp, Mus musculus
gcagggatatgtttaatcacgaaga

SEQ ID NO: 418073 - DNA, 25 bp, Mus musculus
tgtgtgtactgcagggatatgttta

SEQ ID NO: 418074 - DNA, 25 bp, Mus musculus
ttatgaagactaccggcacgcgccg

SEQ ID NO: 418075 - DNA, 25 bp, Mus musculus
tggatgaccggttatgaagactacc

SEQ ID NO: 418076 - DNA, 25 bp, Mus musculus
ttttccctgaacagcggttgccgcg

SEQ ID NO: 418077 - DNA, 25 bp, Mus musculus
ctggtttttccctgaacagcggttg

SEQ ID NO: 418078 - DNA, 25 bp, Mus musculus
gcgcagtccgctccaggaaaggtaa

SEQ ID NO: 418079 - DNA, 25 bp, Mus musculus
actccagtcggccagaggtagtctg

SEQ ID NO: 418080 - DNA, 25 bp, Mus musculus
ggccagcaagtcgtgcacgcacgca

SEQ ID NO: 418081 - DNA, 25 bp, Mus musculus
gcctcgctcagtagggcggaactca

SEQ ID NO: 418082 - DNA, 25 bp, Mus musculus
ctggatgatcccgacagctgctgcc

SEQ ID NO: 418083 - DNA, 25 bp, Mus musculus
aggtgaaaagccacacgtcgcgatc

SEQ ID NO: 418084 - DNA, 25 bp, Mus musculus
ggtaagggaccaaagactcaactca

SEQ ID NO: 418085 - DNA, 25 bp, Mus musculus
aaggacacggtcctcacgcgcagtc

SEQ ID NO: 418086 - DNA, 25 bp, Mus musculus
atctccgggtttcagcctcgcaaag

SEQ ID NO: 418087 - DNA, 25 bp, Mus musculus
tactggtttaacaggtggctctggc

SEQ ID NO: 418088 - DNA, 25 bp, Mus musculus
aggattcgctcaggatactggttta

SEQ ID NO: 418089 - DNA, 25 bp, Mus musculus
gcatggaaaacctgccgaaggattc

SEQ ID NO: 418090 - DNA, 25 bp, Mus musculus
cgcgattcagttacctgcggggaac

SEQ ID NO: 418091 - DNA, 25 bp, Mus musculus
acgagccactctcgctctcgggaaa

SEQ ID NO: 418092 - DNA, 25 bp, Mus musculus
gcgtttcttacacacagcttcgagt

SEQ ID NO: 418093 - DNA, 25 bp, Mus musculus
tccagcttctcgctctgagcctaag

SEQ ID NO: 418094 - DNA, 25 bp, Mus musculus
agcctgcacacgtacttgccctatg

SEQ ID NO: 418095 - DNA, 25 bp, Mus musculus
ttatctgaaacgctgctggccgcac

SEQ ID NO: 418096 - DNA, 25 bp, Mus musculus
cccttgcaagcacttttcttcgctt

SEQ ID NO: 418097 - DNA, 25 bp, Mus musculus
ttcttcgctttccattcagacagtg

SEQ ID NO: 418098 - DNA, 25 bp, Mus musculus
ttcagacagtggttttcatgcctgc

SEQ ID NO: 418099 - DNA, 25 bp, Mus musculus
tgcacttttcgcctcctctgttgac

SEQ ID NO: 418100 - DNA, 25 bp, Mus musculus
ggggagtcgctttccagcttctcgc

SEQ ID NO: 418101 - DNA, 25 bp, Mus musculus
gaccgtgagagctgcgtttcttaca

SEQ ID NO: 418102 - DNA, 25 bp, Mus musculus
agcttcgagtcgtggtgtagttttc

SEQ ID NO: 418103 - DNA, 25 bp, Mus musculus
cctatgccaggaaactcgggtttga

SEQ ID NO: 418104 - DNA, 25 bp, Mus musculus
gagcctaagcgctccttatctgaaa

SEQ ID NO: 418105 - DNA, 25 bp, Mus musculus
ttcgcctcctctgttgaccgtgaga

SEQ ID NO: 418106 - DNA, 25 bp, Mus musculus
cggcgccttttttgtgtgcggcccg

SEQ ID NO: 418107 - DNA, 25 bp, Mus musculus
cacgacggggccgacgagacctcag

SEQ ID NO: 418108 - DNA, 25 bp, Mus musculus
aggcggctcagggcaatccagaagc

SEQ ID NO: 418109 - DNA, 25 bp, Mus musculus
cggagggcaccatgtctgcgccgac

SEQ ID NO: 418110 - DNA, 25 bp, Mus musculus
tgcgccgacggccaaagccagtaaa

SEQ ID NO: 418111 - DNA, 25 bp, Mus musculus
cctctctttattgtgctccgccatg

SEQ ID NO: 418112 - DNA, 25 bp, Mus musculus
actccaatcacgacggggccgacga

SEQ ID NO: 418113 - DNA, 25 bp, Mus musculus
cgcggccaatcgctgtacggcgcga

SEQ ID NO: 418114 - DNA, 25 bp, Mus musculus
gcgccgccatctttcggcccggacc

SEQ ID NO: 418115 - DNA, 25 bp, Mus musculus
agagccggcgccttttttgtgtgcg

SEQ ID NO: 418116 - DNA, 25 bp, Mus musculus
tcccgagaagcctctctttattgtg

SEQ ID NO: 418117 - DNA, 25 bp, Mus musculus
ttgtgctccgccatgatgcctcgct

SEQ ID NO: 418118 - DNA, 25 bp, Mus musculus
atgatgcctcgctcccatcagccgc

SEQ ID NO: 418119 - DNA, 25 bp, Mus musculus
ggagctcaactccaatcacgacggg

SEQ ID NO: 418120 - DNA, 25 bp, Mus musculus
ccaagcgcacgcagcgaccgtgttt

SEQ ID NO: 418121 - DNA, 25 bp, Mus musculus
cctgttaccgtggaatatgccaccg

SEQ ID NO: 418122 - DNA, 25 bp, Mus musculus
gcagcgaccgtgtttgcaactctga

SEQ ID NO: 418123 - DNA, 25 bp, Mus musculus
tttgcaactctgagcacacggtgct

SEQ ID NO: 418124 - DNA, 25 bp, Mus musculus
aagtcaggcactgagacccgggctt

SEQ ID NO: 418125 - DNA, 25 bp, Mus musculus
tgagacccgggcttccggaaccgca

SEQ ID NO: 418126 - DNA, 25 bp, Mus musculus
ctgtgcgccaggtgaaccaagcgca

SEQ ID NO: 418127 - DNA, 25 bp, Mus musculus
tttcaagtttgaaagtcaggcactg

SEQ ID NO: 418128 - DNA, 25 bp, Mus musculus
acacggtgctcggatcttcacacta

SEQ ID NO: 418129 - DNA, 25 bp, Mus musculus
tcttcacactattctggcctctctg

SEQ ID NO: 418130 - DNA, 25 bp, Mus musculus
ctctctgcctgagccctgggttaag

SEQ ID NO: 418131 - DNA, 25 bp, Mus musculus
ttaagacgctctggtgcccaggtcc

SEQ ID NO: 418132 - DNA, 25 bp, Mus musculus
gcagcacgcctgttaccgtggaata

SEQ ID NO: 418133 - DNA, 25 bp, Mus musculus
cagagcgtgacgctgctcccgcgtg

SEQ ID NO: 418134 - DNA, 25 bp, Mus musculus
cccaggtcagcacggtgtgcccagt

SEQ ID NO: 418135 - DNA, 25 bp, Mus musculus
tgcaggaagagcaccagagtgattc

SEQ ID NO: 418136 - DNA, 25 bp, Mus musculus
tacccacgcgtgatcgggtgggctc

SEQ ID NO: 418137 - DNA, 25 bp, Mus musculus
agtccgcaccagcatcccagagtta

SEQ ID NO: 418138 - DNA, 25 bp, Mus musculus
tcccagagttaagcggcggccaaag

SEQ ID NO: 418139 - DNA, 25 bp, Mus musculus
gcccacccggaagaagcgcgcagaa

SEQ ID NO: 418140 - DNA, 25 bp, Mus musculus
aggctgtctattgggtgccaccggc

SEQ ID NO: 418141 - DNA, 25 bp, Mus musculus
gcgcgcacagcctacaactccctaa

SEQ ID NO: 418142 - DNA, 25 bp, Mus musculus
tccgcctcctgtgggccaggtaact

SEQ ID NO: 418143 - DNA, 25 bp, Mus musculus
tgtgggccaggtaactttgcaaaac

SEQ ID NO: 418144 - DNA, 25 bp, Mus musculus
cgcatgcgtgcccatctttgatccc

SEQ ID NO: 418145 - DNA, 25 bp, Mus musculus
gaggccacgcggagcttgctcccaa

SEQ ID NO: 418146 - DNA, 25 bp, Mus musculus
cggccaaagagccatggccttggcc

SEQ ID NO: 418147 - DNA, 25 bp, Mus musculus
ccggctcaccggtgtcgtgcaggaa

SEQ ID NO: 418148 - DNA, 25 bp, Mus musculus
gaggggttctctcgtcttgtcccgc

SEQ ID NO: 418149 - DNA, 25 bp, Mus musculus
ttcgcaggcttacaagcggaggctg

SEQ ID NO: 418150 - DNA, 25 bp, Mus musculus
ccaaagcgccgcaggaggtcggatc

SEQ ID NO: 418151 - DNA, 25 bp, Mus musculus
ccctcaacggggagacaggatgctt

SEQ ID NO: 418152 - DNA, 25 bp, Mus musculus
cggcatttaggacgtaccctaggag

SEQ ID NO: 418153 - DNA, 25 bp, Mus musculus
ttggctcggcatttaggacgtaccc

SEQ ID NO: 418154 - DNA, 25 bp, Mus musculus
cgtctcttggctcggcatttaggac

SEQ ID NO: 418155 - DNA, 25 bp, Mus musculus
agacaggatgcttcgcaggcttaca

SEQ ID NO: 418156 - DNA, 25 bp, Mus musculus
tcctgttccgaaggcttggagagcc

SEQ ID NO: 418157 - DNA, 25 bp, Mus musculus
cgggtgtgctgtcaacaaagcgtca

SEQ ID NO: 418158 - DNA, 25 bp, Mus musculus
tgtgctgtcaacaaagcgtcacttc

SEQ ID NO: 418159 - DNA, 25 bp, Mus musculus
cccttagcagcagaggaggggttct

SEQ ID NO: 418160 - DNA, 25 bp, Mus musculus
cccgatcctgttccgaaggcttgga

SEQ ID NO: 418161 - DNA, 25 bp, Mus musculus
tgtcaacaaagcgtcacttccgggc

SEQ ID NO: 418162 - DNA, 25 bp, Mus musculus
gtcctgacgctcaactgacggtttg

SEQ ID NO: 418163 - DNA, 25 bp, Mus musculus
gcggaacgcgcacgctccaagttct

SEQ ID NO: 418164 - DNA, 25 bp, Mus musculus
agccggtaaggagacctgaggtcaa

SEQ ID NO: 418165 - DNA, 25 bp, Mus musculus
ctcagcgcatgtgcggccaagaaca

SEQ ID NO: 418166 - DNA, 25 bp, Mus musculus
tccaagttctgcttcctgccggagg

SEQ ID NO: 418167 - DNA, 25 bp, Mus musculus
cttcctgccggaggcttttgcccag

SEQ ID NO: 418168 - DNA, 25 bp, Mus musculus
tcgggagtccggaagtcaacaccat

SEQ ID NO: 418169 - DNA, 25 bp, Mus musculus
ggaagtcaacaccatgtcgagtctg

SEQ ID NO: 418170 - DNA, 25 bp, Mus musculus
gccttcgcacagagagagctgctca

SEQ ID NO: 418171 - DNA, 25 bp, Mus musculus
tgtcgagtctgcacaagagccggta

SEQ ID NO: 418172 - DNA, 25 bp, Mus musculus
aggtcaagactgcacccagaccgct

SEQ ID NO: 418173 - DNA, 25 bp, Mus musculus
tccaggccgggccttcgcacagaga

SEQ ID NO: 418174 - DNA, 25 bp, Mus musculus
gctcaactgacggtttgcctagcct

SEQ ID NO: 418175 - DNA, 25 bp, Mus musculus
tcacgtgacccttgggcggacccag

SEQ ID NO: 418176 - DNA, 25 bp, Mus musculus
tgtgctaacatcagtagcgtccttg

SEQ ID NO: 418177 - DNA, 25 bp, Mus musculus
agcgtccttgtcctccggtaggcat

SEQ ID NO: 418178 - DNA, 25 bp, Mus musculus
cttaaaagggcagctgaagggcgtc

SEQ ID NO: 418179 - DNA, 25 bp, Mus musculus
cgacttccgcgaggatgactctgtg

SEQ ID NO: 418180 - DNA, 25 bp, Mus musculus
atgactctgtgcacgcgtaccaccg

SEQ ID NO: 418181 - DNA, 25 bp, Mus musculus
ccgcgagtcctacgtgcttagctac

SEQ ID NO: 418182 - DNA, 25 bp, Mus musculus
ggcaccaggacccagctacgtctta

SEQ ID NO: 418183 - DNA, 25 bp, Mus musculus
cccgacgtggaacgaccaatggcaa

SEQ ID NO: 418184 - DNA, 25 bp, Mus musculus
tcttactttacacgtgcaccgtggc

SEQ ID NO: 418185 - DNA, 25 bp, Mus musculus
actgcagcgtctagatcttacttta

SEQ ID NO: 418186 - DNA, 25 bp, Mus musculus
tagcgcctcaggtagtctcggaccc

SEQ ID NO: 418187 - DNA, 25 bp, Mus musculus
ttctacctgagcaacgtagcgcctc

SEQ ID NO: 418188 - DNA, 25 bp, Mus musculus
ggccatggacgacaccttctacctg

SEQ ID NO: 418189 - DNA, 25 bp, Mus musculus
ctaccgcggcagtggctttgaccgc

SEQ ID NO: 418190 - DNA, 25 bp, Mus musculus
cccgcgaatgaatgtagatcggacc

SEQ ID NO: 418191 - DNA, 25 bp, Mus musculus
tgtagatcggaccagctaactctgc

SEQ ID NO: 418192 - DNA, 25 bp, Mus musculus
ctgtctccagggcaacgagttcgca

SEQ ID NO: 418193 - DNA, 25 bp, Mus musculus
tctgcaagctcaggctacgggagag

SEQ ID NO: 418194 - DNA, 25 bp, Mus musculus
gggccgacaccactgtgacacgctg

SEQ ID NO: 418195 - DNA, 25 bp, Mus musculus
cggaccagctaactctgcaagctca

SEQ ID NO: 418196 - DNA, 25 bp, Mus musculus
tgacacgctgcagattccaggccta

SEQ ID NO: 418197 - DNA, 25 bp, Mus musculus
gctgcagattccaggcctagcccgg

SEQ ID NO: 418198 - DNA, 25 bp, Mus musculus
cccggaacccatcggtccgcacata

SEQ ID NO: 418199 - DNA, 25 bp, Mus musculus
ctgaggcggagctcagaaacgccac

SEQ ID NO: 418200 - DNA, 25 bp, Mus musculus
cagaaacgccacgtgcgagtgcgga

SEQ ID NO: 418201 - DNA, 25 bp, Mus musculus
tgctgcgttggtaccctgtctccag

SEQ ID NO: 418202 - DNA, 25 bp, Mus musculus
cgagttcgcagcactacgctgtccg

SEQ ID NO: 418203 - DNA, 25 bp, Mus musculus
aagacccgggccgacaccactgtga

SEQ ID NO: 418204 - DNA, 25 bp, Mus musculus
tccgctcgcacctctcacccgagtt

SEQ ID NO: 418205 - DNA, 25 bp, Mus musculus
gactggctgtgggtagccagaccca

SEQ ID NO: 418206 - DNA, 25 bp, Mus musculus
gctgtcacctccctgaatccaatga

SEQ ID NO: 418207 - DNA, 25 bp, Mus musculus
agacccaggactagggctgcctgcg

SEQ ID NO: 418208 - DNA, 25 bp, Mus musculus
ctgtgggtagccagacccaggacta

SEQ ID NO: 418209 - DNA, 25 bp, Mus musculus
agccaaagacccacggcgcgactgg

SEQ ID NO: 418210 - DNA, 25 bp, Mus musculus
acaaggagccaaagacccacggcgc

SEQ ID NO: 418211 - DNA, 25 bp, Mus musculus
ggagacctaagaagcggtacaaaca

SEQ ID NO: 418212 - DNA, 25 bp, Mus musculus
ggcggagacctaagaagcggtacaa

SEQ ID NO: 418213 - DNA, 25 bp, Mus musculus
cgctcggtgacatcacttccggggc

SEQ ID NO: 418214 - DNA, 25 bp, Mus musculus
cgccgcggtccctgcagatccacgc

SEQ ID NO: 418215 - DNA, 25 bp, Mus musculus
ctgaatccaatgacgcgggcccgac

SEQ ID NO: 418216 - DNA, 25 bp, Mus musculus
tcggtgacatcacttccggggcgga

SEQ ID NO: 418217 - DNA, 25 bp, Mus musculus
aagggacgcgctgtcacctccctga

SEQ ID NO: 418218 - DNA, 25 bp, Mus musculus
ctagaagggcccgagcgcgtgcatc

SEQ ID NO: 418219 - DNA, 25 bp, Mus musculus
ctcccttctcgtcccgtcgccgcct

SEQ ID NO: 418220 - DNA, 25 bp, Mus musculus
gcgcgagcgcgctccaacctcctcc

SEQ ID NO: 418221 - DNA, 25 bp, Mus musculus
cctcttcctcctttcgctttcgcgc

SEQ ID NO: 418222 - DNA, 25 bp, Mus musculus
ctttcgcgcgcccagcgactgctcg

SEQ ID NO: 418223 - DNA, 25 bp, Mus musculus
cagcgactgctcgcgcctgctagaa

SEQ ID NO: 418224 - DNA, 25 bp, Mus musculus
ccgcagctcggcagcatttgctcca

SEQ ID NO: 418225 - DNA, 25 bp, Mus musculus
aaggggcgctgacccagacctgggg

SEQ ID NO: 418226 - DNA, 25 bp, Mus musculus
cggcggcctctcagggccgcgtcct

SEQ ID NO: 418227 - DNA, 25 bp, Mus musculus
ggccaatcgcggagtgtcctcggcc

SEQ ID NO: 418228 - DNA, 25 bp, Mus musculus
agtccggccaatcgcggagtgtcct

SEQ ID NO: 418229 - DNA, 25 bp, Mus musculus
tccgtagacgagtccggccaatcgc

SEQ ID NO: 418230 - DNA, 25 bp, Mus musculus
gggcctccgtagacgagtccggcca

SEQ ID NO: 418231 - DNA, 25 bp, Mus musculus
cacgccgccgtccaaagtaccggcg

SEQ ID NO: 418232 - DNA, 25 bp, Mus musculus
caactgtgtttattgcagcggcggc

SEQ ID NO: 418233 - DNA, 25 bp, Mus musculus
cccttcaagttctgcggggctctcg

SEQ ID NO: 418234 - DNA, 25 bp, Mus musculus
ccttaacagacatggcgacggccgg

SEQ ID NO: 418235 - DNA, 25 bp, Mus musculus
gggtgaagccgcctcaagctttccc

SEQ ID NO: 418236 - DNA, 25 bp, Mus musculus
cccttaagttgcagggatccctgtc

SEQ ID NO: 418237 - DNA, 25 bp, Mus musculus
tctggccagagtaacgcatccctta

SEQ ID NO: 418238 - DNA, 25 bp, Mus musculus
cggatacttgcgtcagcttgggtca

SEQ ID NO: 418239 - DNA, 25 bp, Mus musculus
acgctggcccaatggcgatcggaac

SEQ ID NO: 418240 - DNA, 25 bp, Mus musculus
actaaaggtatgaggacgctggccc

SEQ ID NO: 418241 - DNA, 25 bp, Mus musculus
gcgagtcagctaacgagcagcacta

SEQ ID NO: 418242 - DNA, 25 bp, Mus musculus
ggcagttacatttgcgggcacctga

SEQ ID NO: 418243 - DNA, 25 bp, Mus musculus
attatgcggcttttcagggacaacc

SEQ ID NO: 418244 - DNA, 25 bp, Mus musculus
ggcggagaagccattcagttaactc

SEQ ID NO: 418245 - DNA, 25 bp, Mus musculus
ttccacccggggttctcttgacagc

SEQ ID NO: 418246 - DNA, 25 bp, Mus musculus
gcactggtcccagcccgtgagtagc

SEQ ID NO: 418247 - DNA, 25 bp, Mus musculus
tgccgcaagaactttggagcagccc

SEQ ID NO: 418248 - DNA, 25 bp, Mus musculus
gcccgtgagtagctctggagcgatc

SEQ ID NO: 418249 - DNA, 25 bp, Mus musculus
ggagcctcctggaagggaaacaatg

SEQ ID NO: 418250 - DNA, 25 bp, Mus musculus
aacttccttttctcttcagccgctg

SEQ ID NO: 418251 - DNA, 25 bp, Mus musculus
ttcagccgctgctacaggggctggc

SEQ ID NO: 418252 - DNA, 25 bp, Mus musculus
gacgtgtctcccttgcaagtttcag

SEQ ID NO: 418253 - DNA, 25 bp, Mus musculus
caagtttcagttgcgtcctgcggga

SEQ ID NO: 418254 - DNA, 25 bp, Mus musculus
tgggcaggacccaggcaaacttcgt

SEQ ID NO: 418255 - DNA, 25 bp, Mus musculus
gacccaggcaaacttcgttcgctga

SEQ ID NO: 418256 - DNA, 25 bp, Mus musculus
cttcgttcgctgagacgattgcctg

SEQ ID NO: 418257 - DNA, 25 bp, Mus musculus
gagacgattgcctgggatgccgcaa

SEQ ID NO: 418258 - DNA, 25 bp, Mus musculus
cctcttcatgcagaggggctcgggc

SEQ ID NO: 418259 - DNA, 25 bp, Mus musculus
tgggatgccgcaagaactttggagc

SEQ ID NO: 418260 - DNA, 25 bp, Mus musculus
cgcctcaaggtgctgcgactcaaga

SEQ ID NO: 418261 - DNA, 25 bp, Mus musculus
tgcgggagctcaaacgcctcaaggt

SEQ ID NO: 418262 - DNA, 25 bp, Mus musculus
cctgagtgcagagaacaaccgctac

SEQ ID NO: 418263 - DNA, 25 bp, Mus musculus
gggccctgcacatcaagttcacgga

SEQ ID NO: 418264 - DNA, 25 bp, Mus musculus
cctcaaggagctgtggctgtaccac

SEQ ID NO: 418265 - DNA, 25 bp, Mus musculus
agctggagctgatacccgacgtgac

SEQ ID NO: 418266 - DNA, 25 bp, Mus musculus
acctggttgagctcgaggtcctgaa

SEQ ID NO: 418267 - DNA, 25 bp, Mus musculus
aacaacgagtggacgctggacaagc

SEQ ID NO: 418268 - DNA, 25 bp, Mus musculus
tcgatccgagaggagagcagctaca

SEQ ID NO: 418269 - DNA, 25 bp, Mus musculus
tgttcatgctcagcggcatcccgga

SEQ ID NO: 418270 - DNA, 25 bp, Mus musculus
caagctggagctgcacctgttcatg

SEQ ID NO: 418271 - DNA, 25 bp, Mus musculus
cggacactgtgtttgacctggttga

SEQ ID NO: 418272 - DNA, 25 bp, Mus musculus
atgttgcacctcatcgaccagtatg

SEQ ID NO: 418273 - DNA, 25 bp, Mus musculus
ggcgctccctcaagaagtactcgtt

SEQ ID NO: 418274 - DNA, 25 bp, Mus musculus
caagcagaggggcagcaatttcacc

SEQ ID NO: 418275 - DNA, 25 bp, Mus musculus
ccaggagtatcggtcccacactgca

SEQ ID NO: 418276 - DNA, 25 bp, Mus musculus
gtactggacgtagaaggcctgcacc

SEQ ID NO: 418277 - DNA, 25 bp, Mus musculus
cacactgcagcgtggatgctcaaca

SEQ ID NO: 418278 - DNA, 25 bp, Mus musculus
gccggtcccacttgtactggacgta

SEQ ID NO: 418279 - DNA, 25 bp, Mus musculus
tctggcgctcttgggagaagaagtt

SEQ ID NO: 418280 - DNA, 25 bp, Mus musculus
agatgtttgccctcttcaccgctca

SEQ ID NO: 418281 - DNA, 25 bp, Mus musculus
ttctccagcttccaaaagggtgttc

SEQ ID NO: 418282 - DNA, 25 bp, Mus musculus
ggtgttccaccacgggccactctga

SEQ ID NO: 418283 - DNA, 25 bp, Mus musculus
gcctccgctgtcaacctacggtgta

SEQ ID NO: 418284 - DNA, 25 bp, Mus musculus
acctacggtgtagcagatgtttgcc

SEQ ID NO: 418285 - DNA, 25 bp, Mus musculus
gcttgctccaccacgttgcctgtag

SEQ ID NO: 418286 - DNA, 25 bp, Mus musculus
ctgaggacacttttggagcgggcct

SEQ ID NO: 418287 - DNA, 25 bp, Mus musculus
actgtcgggtcatgtctctaggtct

SEQ ID NO: 418288 - DNA, 25 bp, Mus musculus
atgagcggcgtcgtgccaggcctca

SEQ ID NO: 418289 - DNA, 25 bp, Mus musculus
ccagcgggctgttcgctctaatcaa

SEQ ID NO: 418290 - DNA, 25 bp, Mus musculus
caccagcgggctgttcgctctaatc

SEQ ID NO: 418291 - DNA, 25 bp, Mus musculus
cgcccacctgctgcctgcgcccgcc

SEQ ID NO: 418292 - DNA, 25 bp, Mus musculus
cgcccgtacgcagggccgccacgcc

SEQ ID NO: 418293 - DNA, 25 bp, Mus musculus
gttcgctctaatcaacgttttacta

SEQ ID NO: 418294 - DNA, 25 bp, Mus musculus
tcttcatgttgaagtccatggcgcg

SEQ ID NO: 418295 - DNA, 25 bp, Mus musculus
acgccagcttcttcatgttgaagtc

SEQ ID NO: 418296 - DNA, 25 bp, Mus musculus
ccgacgccagcttcttcatgttgaa

SEQ ID NO: 418297 - DNA, 25 bp, Mus musculus
gcgtccgacgccagcttcttcatgt

SEQ ID NO: 418298 - DNA, 25 bp, Mus musculus
agtgaagaagatgcccgcgtccgac

SEQ ID NO: 418299 - DNA, 25 bp, Mus musculus
ccgcccgagtgaagaagatgcccgc

SEQ ID NO: 418300 - DNA, 25 bp, Mus musculus
ctgcaccgcccgagtgaagaagatg

SEQ ID NO: 418301 - DNA, 25 bp, Mus musculus
gggctgttcgctctaatcaacgttt

SEQ ID NO: 418302 - DNA, 25 bp, Mus musculus
catccagcggcgtggtttggttgta

SEQ ID NO: 418303 - DNA, 25 bp, Mus musculus
agtctgcgtgatcacgtagctcacc

SEQ ID NO: 418304 - DNA, 25 bp, Mus musculus
ctcattggtcagagctgtgttggcc

SEQ ID NO: 418305 - DNA, 25 bp, Mus musculus
tttggttgtattgccgcctggaaag

SEQ ID NO: 418306 - DNA, 25 bp, Mus musculus
gcctggaaaggagacgctgcccttc

SEQ ID NO: 418307 - DNA, 25 bp, Mus musculus
cccagcgatgggatccctggtgagt

SEQ ID NO: 418308 - DNA, 25 bp, Mus musculus
atccctggtgagtgacggccactgc

SEQ ID NO: 418309 - DNA, 25 bp, Mus musculus
cactgcgcgggcgaccagatcagca

SEQ ID NO: 418310 - DNA, 25 bp, Mus musculus
atcagcagggctagaagcgaggctt

SEQ ID NO: 418311 - DNA, 25 bp, Mus musculus
acgccggggtctgcgatccagccag

SEQ ID NO: 418312 - DNA, 25 bp, Mus musculus
cagccagcccgcgaaggtgtccaag

SEQ ID NO: 418313 - DNA, 25 bp, Mus musculus
gcctggaacgctgcgagcatctaaa

SEQ ID NO: 418314 - DNA, 25 bp, Mus musculus
gctgcgagcatctaaaagtatggtc

SEQ ID NO: 418315 - DNA, 25 bp, Mus musculus
gcgatatggagacgctcattggtca

SEQ ID NO: 418316 - DNA, 25 bp, Mus musculus
tctcttgattggttagtcaactacc

SEQ ID NO: 418317 - DNA, 25 bp, Mus musculus
atagcgcctgattggctcgcccttc

SEQ ID NO: 418318 - DNA, 25 bp, Mus musculus
gccgagctaagcttaccttttgatt

SEQ ID NO: 418319 - DNA, 25 bp, Mus musculus
cgctgcgagtgctccattctcttga

SEQ ID NO: 418320 - DNA, 25 bp, Mus musculus
gtcaactacctgaactcgcacggga

SEQ ID NO: 418321 - DNA, 25 bp, Mus musculus
tcgcacgggattggacactggcaaa

SEQ ID NO: 418322 - DNA, 25 bp, Mus musculus
agcctcacgacctgcacactgaatg

SEQ ID NO: 418323 - DNA, 25 bp, Mus musculus
atggctgcgccactacctgcaatcg

SEQ ID NO: 418324 - DNA, 25 bp, Mus musculus
cccggcgtgataggtcaggaccacc

SEQ ID NO: 418325 - DNA, 25 bp, Mus musculus
cattggctgctctgcgaagcccggt

SEQ ID NO: 418326 - DNA, 25 bp, Mus musculus
cgaataccctgcaggtaagagcctg

SEQ ID NO: 418327 - DNA, 25 bp, Mus musculus
aaccgcggtgggaactgtcaaacag

SEQ ID NO: 418328 - DNA, 25 bp, Mus musculus
acactggcaaagctgcgcgagtccc

SEQ ID NO: 418329 - DNA, 25 bp, Mus musculus
ccttttgattggctgttctgcgctc

SEQ ID NO: 418330 - DNA, 25 bp, Mus musculus
gccttcgcgcgagtgactgtaattc

SEQ ID NO: 418331 - DNA, 25 bp, Mus musculus
ttctaggttcaaggtcgccgagtca

SEQ ID NO: 418332 - DNA, 25 bp, Mus musculus
agtcactgccgctagccagtagagg

SEQ ID NO: 418333 - DNA, 25 bp, Mus musculus
ttgcggagacggacctctagctcag

SEQ ID NO: 418334 - DNA, 25 bp, Mus musculus
tctagctcagctgttagcagcccgg

SEQ ID NO: 418335 - DNA, 25 bp, Mus musculus
gccaccttagctgtcgaggcggtca

SEQ ID NO: 418336 - DNA, 25 bp, Mus musculus
cgtgcgttcaagtctgactggtgtc

SEQ ID NO: 418337 - DNA, 25 bp, Mus musculus
cttgaacgtcactctaggaatggca

SEQ ID NO: 418338 - DNA, 25 bp, Mus musculus
tggcaggagaacacaactgttgact

SEQ ID NO: 418339 - DNA, 25 bp, Mus musculus
actggggactgtctcagattgcttg

SEQ ID NO: 418340 - DNA, 25 bp, Mus musculus
gcagccgttagtgcgcatgctcctc

SEQ ID NO: 418341 - DNA, 25 bp, Mus musculus
ggcttccggtcctagccagtcagcg

SEQ ID NO: 418342 - DNA, 25 bp, Mus musculus
agtcagcgctcatttccctgctgga

SEQ ID NO: 418343 - DNA, 25 bp, Mus musculus
caggtggccttgctccgcaagaata

SEQ ID NO: 418344 - DNA, 25 bp, Mus musculus
cctctcgtctggacttgggacgctg

SEQ ID NO: 418345 - DNA, 25 bp, Mus musculus
ttggagtgtccccaagaacttcgcc

SEQ ID NO: 418346 - DNA, 25 bp, Mus musculus
agaacttcgccacgcgcgacagcga

SEQ ID NO: 418347 - DNA, 25 bp, Mus musculus
gccacgcgcgacagcgagatccaga

SEQ ID NO: 418348 - DNA, 25 bp, Mus musculus
gagtgaataacatccgcctctcgtc

SEQ ID NO: 418349 - DNA, 25 bp, Mus musculus
ctttcacccagcgaggcttatgggg

SEQ ID NO: 418350 - DNA, 25 bp, Mus musculus
gacgctgggcgacagcgcctccttt

SEQ ID NO: 418351 - DNA, 25 bp, Mus musculus
atccgcctctcgtctggacttggga

SEQ ID NO: 418352 - DNA, 25 bp, Mus musculus
aacatccgcctctcgtctggacttg

SEQ ID NO: 418353 - DNA, 25 bp, Mus musculus
ccctgagagtgaataacatccgcct

SEQ ID NO: 418354 - DNA, 25 bp, Mus musculus
ttcacccagcgaggcttatggggtg

SEQ ID NO: 418355 - DNA, 25 bp, Mus musculus
gcgacagcgagatccagagccgaga

SEQ ID NO: 418356 - DNA, 25 bp, Mus musculus
ctcctttcacccagcgaggcttatg

SEQ ID NO: 418357 - DNA, 25 bp, Mus musculus
agcgagatccagagccgagaggccc

SEQ ID NO: 418358 - DNA, 25 bp, Mus musculus
atgctgatcaggctctgggcgtcca

SEQ ID NO: 418359 - DNA, 25 bp, Mus musculus
taacgctcgctcaggtagagctggc

SEQ ID NO: 418360 - DNA, 25 bp, Mus musculus
gcgttgcggagcacgtaggacacca

SEQ ID NO: 418361 - DNA, 25 bp, Mus musculus
atcttgcgcagggagatgctgatca

SEQ ID NO: 418362 - DNA, 25 bp, Mus musculus
gtagagctcggcgtaacgctcgctc

SEQ ID NO: 418363 - DNA, 25 bp, Mus musculus
aagtcggccgcgctggccggcattc

SEQ ID NO: 418364 - DNA, 25 bp, Mus musculus
cggctgcagcggctccaagtgctgc

SEQ ID NO: 418365 - DNA, 25 bp, Mus musculus
gctgctgcagtgcacgccgaagtcc

SEQ ID NO: 418366 - DNA, 25 bp, Mus musculus
ccagcacggtggtctggctgctgca

SEQ ID NO: 418367 - DNA, 25 bp, Mus musculus
accacgtgagtgtccaggtccagca

SEQ ID NO: 418368 - DNA, 25 bp, Mus musculus
tagccgttttctaccgtggtcacca

SEQ ID NO: 418369 - DNA, 25 bp, Mus musculus
agtcctggtgcaagtagccgttttc

SEQ ID NO: 418370 - DNA, 25 bp, Mus musculus
ccagggtaatacttgcgcttgcaac

SEQ ID NO: 418371 - DNA, 25 bp, Mus musculus
ttcctcctggccagggtaatacttg

SEQ ID NO: 418372 - DNA, 25 bp, Mus musculus
aagctgaaagcttcccttcttccgg

SEQ ID NO: 418373 - DNA, 25 bp, Mus musculus
ggtcagttcgctttcggagagctca

SEQ ID NO: 418374 - DNA, 25 bp, Mus musculus
caagtcgttccacatgcgggccaga

SEQ ID NO: 418375 - DNA, 25 bp, Mus musculus
gaccttcttcttctcggacaagtcg

SEQ ID NO: 418376 - DNA, 25 bp, Mus musculus
ccaggagacccttagggaagagtag

SEQ ID NO: 418377 - DNA, 25 bp, Mus musculus
taaccgcgcgcatggaagtggccca

SEQ ID NO: 418378 - DNA, 25 bp, Mus musculus
tgattcacttctggtgccggggagc

SEQ ID NO: 418379 - DNA, 25 bp, Mus musculus
cccagcaattgagcccgggtacacg

SEQ ID NO: 418380 - DNA, 25 bp, Mus musculus
tccaagggagccaacaaggaagctg

SEQ ID NO: 418381 - DNA, 25 bp, Mus musculus
gggcagcagtgacgtccaccaagct

SEQ ID NO: 418382 - DNA, 25 bp, Mus musculus
attcgttgccggctccctgttgagg

SEQ ID NO: 418383 - DNA, 25 bp, Mus musculus
caaggatgttaacattcgggccacc

SEQ ID NO: 418384 - DNA, 25 bp, Mus musculus
tcccgggccttgtatttagcctata

SEQ ID NO: 418385 - DNA, 25 bp, Mus musculus
cgggtacacggtacacgtgtgattc

SEQ ID NO: 418386 - DNA, 25 bp, Mus musculus
tacacgagacctgcggcgctgctgg

SEQ ID NO: 418387 - DNA, 25 bp, Mus musculus
tcccattggcctccgtttccatggt

SEQ ID NO: 418388 - DNA, 25 bp, Mus musculus
aatttgacaggggaccatgtgcgcg

SEQ ID NO: 418389 - DNA, 25 bp, Mus musculus
ccgcgggcagcgctggcctcccatt

SEQ ID NO: 418390 - DNA, 25 bp, Mus musculus
gcccggaatttgacaggggaccatg

SEQ ID NO: 418391 - DNA, 25 bp, Mus musculus
ccggaatttgacaggggaccatgtg

SEQ ID NO: 418392 - DNA, 25 bp, Mus musculus
gtttccatggttacacgagacctgc

SEQ ID NO: 418393 - DNA, 25 bp, Mus musculus
gccagacaaagacggggaggcggtg

SEQ ID NO: 418394 - DNA, 25 bp, Mus musculus
cattggcctccgtttccatggttac

SEQ ID NO: 418395 - DNA, 25 bp, Mus musculus
ccacggagccgcccggaatttgaca

SEQ ID NO: 418396 - DNA, 25 bp, Mus musculus
ttcccgacacgtgtcccacggagcc

SEQ ID NO: 418397 - DNA, 25 bp, Mus musculus
gcgctgctggcttcccgacacgtgt

SEQ ID NO: 418398 - DNA, 25 bp, Mus musculus
catggttacacgagacctgcggcgc

SEQ ID NO: 418399 - DNA, 25 bp, Mus musculus
aagcccggtggagagacgaagccag

SEQ ID NO: 418400 - DNA, 25 bp, Mus musculus
gaaacgcttccactgtgttttaata

SEQ ID NO: 418401 - DNA, 25 bp, Mus musculus
cctctccacggctgtcgcgggagaa

SEQ ID NO: 418402 - DNA, 25 bp, Mus musculus
gcggccagggcgaacaataacagta

SEQ ID NO: 418403 - DNA, 25 bp, Mus musculus
cggccgagctgagtaactccgttgc

SEQ ID NO: 418404 - DNA, 25 bp, Mus musculus
tgcctcgtcagcgtcataaaaacgg

SEQ ID NO: 418405 - DNA, 25 bp, Mus musculus
tgtgttttaataagcgtcgcccatc

SEQ ID NO: 418406 - DNA, 25 bp, Mus musculus
tcagccgactgacgcatgcgcagta

SEQ ID NO: 418407 - DNA, 25 bp, Mus musculus
tggcccgtggagaccagtgctactc

SEQ ID NO: 418408 - DNA, 25 bp, Mus musculus
ccatggcgacgtggccgcaaggaac

SEQ ID NO: 418409 - DNA, 25 bp, Mus musculus
tttgggagccttctcgcctcggctt

SEQ ID NO: 418410 - DNA, 25 bp, Mus musculus
ggcttctggcaaaggcagtgctttc

SEQ ID NO: 418411 - DNA, 25 bp, Mus musculus
tttccaagcatgcagcgggcaggga

SEQ ID NO: 418412 - DNA, 25 bp, Mus musculus
ccgacctgttctgagtgacagcaga

SEQ ID NO: 418413 - DNA, 25 bp, Mus musculus
taacagtaaataacgctgcctcgtc

SEQ ID NO: 418414 - DNA, 25 bp, Mus musculus
ccgggaggaaatccagcttgaaggc

SEQ ID NO: 418415 - DNA, 25 bp, Mus musculus
tcggccactcacattctgtcagcaa

SEQ ID NO: 418416 - DNA, 25 bp, Mus musculus
cggccgctgcctctgaggagacgac

SEQ ID NO: 418417 - DNA, 25 bp, Mus musculus
ttctgtcagcaacgagcaggcggcc

SEQ ID NO: 418418 - DNA, 25 bp, Mus musculus
cgaccatcatgtccgggaggaaatc

SEQ ID NO: 418419 - DNA, 25 bp, Mus musculus
ttcccacggccactcggagagcgaa

SEQ ID NO: 418420 - DNA, 25 bp, Mus musculus
gaaatccagcttgaaggcagaagtc

SEQ ID NO: 418421 - DNA, 25 bp, Mus musculus
aggcagaagtcatgttctcggcgca

SEQ ID NO: 418422 - DNA, 25 bp, Mus musculus
aagtcatgttctcggcgcacgcagc

SEQ ID NO: 418423 - DNA, 25 bp, Mus musculus
cgccgaagcgggcacttgtcacatt

SEQ ID NO: 418424 - DNA, 25 bp, Mus musculus
agcgggcacttgtcacattctctcc

SEQ ID NO: 418425 - DNA, 25 bp, Mus musculus
ttgtcacattctctccctcgcgcgc

SEQ ID NO: 418426 - DNA, 25 bp, Mus musculus
tggggaccggcatcgcacgcgacct

SEQ ID NO: 418427 - DNA, 25 bp, Mus musculus
agcaggcggccctcgaccatcatgt

SEQ ID NO: 418428 - DNA, 25 bp, Mus musculus
acggaatttgaaatcccagcgagtc

SEQ ID NO: 418429 - DNA, 25 bp, Mus musculus
tgtgcgcatttacatctccggctcc

SEQ ID NO: 418430 - DNA, 25 bp, Mus musculus
cgtgagcgccgctgataaacagccc

SEQ ID NO: 418431 - DNA, 25 bp, Mus musculus
cgctgataaacagcccggagcggcg

SEQ ID NO: 418432 - DNA, 25 bp, Mus musculus
ctggcaggcgcgcaagaagctgtcc

SEQ ID NO: 418433 - DNA, 25 bp, Mus musculus
aggcgcgcaagaagctgtcccggcc

SEQ ID NO: 418434 - DNA, 25 bp, Mus musculus
gggaaagtgtttgcttcagccctta

SEQ ID NO: 418435 - DNA, 25 bp, Mus musculus
cttcagcccttaatcacggaatttg

SEQ ID NO: 418436 - DNA, 25 bp, Mus musculus
cccagcgagtcggtgccatttattt

SEQ ID NO: 418437 - DNA, 25 bp, Mus musculus
gtgccatttattttcagagcctgtc

SEQ ID NO: 418438 - DNA, 25 bp, Mus musculus
ttcagagcctgtcaaggctggtttc

SEQ ID NO: 418439 - DNA, 25 bp, Mus musculus
caaggctggtttcggcgtttagaag

SEQ ID NO: 418440 - DNA, 25 bp, Mus musculus
aaaggaggctgtgcgcatttacatc

SEQ ID NO: 418441 - DNA, 25 bp, Mus musculus
tttgaaatcccagcgagtcggtgcc

SEQ ID NO: 418442 - DNA, 25 bp, Mus musculus
ggagagagtttctgctcctagtctc

SEQ ID NO: 418443 - DNA, 25 bp, Mus musculus
gttgcggttttaatgaggagcccgc

SEQ ID NO: 418444 - DNA, 25 bp, Mus musculus
gcggttttaatgaggagcccgcgcc

SEQ ID NO: 418445 - DNA, 25 bp, Mus musculus
ctcccgggactgctaggagagagtt

SEQ ID NO: 418446 - DNA, 25 bp, Mus musculus
actgctaggagagagtttctgctcc

SEQ ID NO: 418447 - DNA, 25 bp, Mus musculus
ttctctcccagccgcgtgagagcag

SEQ ID NO: 418448 - DNA, 25 bp, Mus musculus
gagtttctgctcctagtctcggttc

SEQ ID NO: 418449 - DNA, 25 bp, Mus musculus
gtttctgctcctagtctcggttccc

SEQ ID NO: 418450 - DNA, 25 bp, Mus musculus
ccggctcggtgtaggtatccgccct

SEQ ID NO: 418451 - DNA, 25 bp, Mus musculus
gctcggtgtaggtatccgccctccg

SEQ ID NO: 418452 - DNA, 25 bp, Mus musculus
tgtaggtatccgccctccgcctggg

SEQ ID NO: 418453 - DNA, 25 bp, Mus musculus
ctgggttctgccagcgcctcctttc

SEQ ID NO: 418454 - DNA, 25 bp, Mus musculus
ccgggactgctaggagagagtttct

SEQ ID NO: 418455 - DNA, 25 bp, Mus musculus
agagagtttctgctcctagtctcgg

SEQ ID NO: 418456 - DNA, 25 bp, Mus musculus
ccggggccactgaacaatcgttggg

SEQ ID NO: 418457 - DNA, 25 bp, Mus musculus
actgaacaatcgttggggcggtaga

SEQ ID NO: 418458 - DNA, 25 bp, Mus musculus
tagagatgaacgagtgtcgcgcgcc

SEQ ID NO: 418459 - DNA, 25 bp, Mus musculus
ccgccggggccactgaacaatcgtt

SEQ ID NO: 418460 - DNA, 25 bp, Mus musculus
cgccctgtccctagagtgggcgcgc

SEQ ID NO: 418461 - DNA, 25 bp, Mus musculus
cccacgatgctgctggaacccgccc

SEQ ID NO: 418462 - DNA, 25 bp, Mus musculus
atgaacgagtgtcgcgcgccctgtc

SEQ ID NO: 418463 - DNA, 25 bp, Mus musculus
aggacctgtgggctgcacagcgccc

SEQ ID NO: 418464 - DNA, 25 bp, Mus musculus
ctcgaggacctgtgggctgcacagc

SEQ ID NO: 418465 - DNA, 25 bp, Mus musculus
ttctcacatcaggaccccgggcgtg

SEQ ID NO: 418466 - DNA, 25 bp, Mus musculus
cccgaaacagctttctcacatcagg

SEQ ID NO: 418467 - DNA, 25 bp, Mus musculus
cgcagccgcctcttgcgcagctacc

SEQ ID NO: 418468 - DNA, 25 bp, Mus musculus
ccctccgcggtcgagctgggaggtc

SEQ ID NO: 418469 - DNA, 25 bp, Mus musculus
aaacagctttctcacatcaggaccc

SEQ ID NO: 418470 - DNA, 25 bp, Mus musculus
agagcgcgcacctgcggttctaggt

SEQ ID NO: 418471 - DNA, 25 bp, Mus musculus
ggccgcacagctgggacgatgccac

SEQ ID NO: 418472 - DNA, 25 bp, Mus musculus
gacgtgtttgtgcagaaccaggctc

SEQ ID NO: 418473 - DNA, 25 bp, Mus musculus
cccgagacgtgtttgtgcagaacca

SEQ ID NO: 418474 - DNA, 25 bp, Mus musculus
gagccctggcccgagacgtgtttgt

SEQ ID NO: 418475 - DNA, 25 bp, Mus musculus
taaaatgcagggacgcagcaggatg

SEQ ID NO: 418476 - DNA, 25 bp, Mus musculus
gggatgaagcccacgactcagcgag

SEQ ID NO: 418477 - DNA, 25 bp, Mus musculus
ccctcgagtcccggctcatgaatat

SEQ ID NO: 418478 - DNA, 25 bp, Mus musculus
agcccacgactcagcgaggaagagg

SEQ ID NO: 418479 - DNA, 25 bp, Mus musculus
tgcggttctaggttcagatgcgacg

SEQ ID NO: 418480 - DNA, 25 bp, Mus musculus
tcagaggctcaaaactttccgcttc

SEQ ID NO: 418481 - DNA, 25 bp, Mus musculus
ttgctccgctgagcgccaactgttg

SEQ ID NO: 418482 - DNA, 25 bp, Mus musculus
tcatgaatattaatgcggcggtaat

SEQ ID NO: 418483 - DNA, 25 bp, Mus musculus
cggcggtaattaaaatgcagggacg

SEQ ID NO: 418484 - DNA, 25 bp, Mus musculus
ataactaatttcagcgccgcagccg

SEQ ID NO: 418485 - DNA, 25 bp, Mus musculus
gcgttcggttgaccctttgcttctc

SEQ ID NO: 418486 - DNA, 25 bp, Mus musculus
cgtgttgaggatggccctgaggcct

SEQ ID NO: 418487 - DNA, 25 bp, Mus musculus
gatcaattgacaccgccaccgggcg

SEQ ID NO: 418488 - DNA, 25 bp, Mus musculus
gcgatcaattgacaccgccaccggg

SEQ ID NO: 418489 - DNA, 25 bp, Mus musculus
ccgcccgcgcgcgatcaattgacac

SEQ ID NO: 418490 - DNA, 25 bp, Mus musculus
attgcgcgccggcagctgcgagcca

SEQ ID NO: 418491 - DNA, 25 bp, Mus musculus
tttttcccgataattgcgcgccggc

SEQ ID NO: 418492 - DNA, 25 bp, Mus musculus
gatcgataactaatttcagcgccgc

SEQ ID NO: 418493 - DNA, 25 bp, Mus musculus
gccgagggatcgataactaatttca

SEQ ID NO: 418494 - DNA, 25 bp, Mus musculus
cccgccgagggatcgataactaatt

SEQ ID NO: 418495 - DNA, 25 bp, Mus musculus
gtctgcagccgtcagcgacgagcgc

SEQ ID NO: 418496 - DNA, 25 bp, Mus musculus
tcaactgagcgccagtggaccgcgg

SEQ ID NO: 418497 - DNA, 25 bp, Mus musculus
ttcccgataattgcgcgccggcagc

SEQ ID NO: 418498 - DNA, 25 bp, Mus musculus
gctgggacatcaaagcggccgccgc

SEQ ID NO: 418499 - DNA, 25 bp, Mus musculus
gggctccctttcatcccggctggga

SEQ ID NO: 418500 - DNA, 25 bp, Mus musculus
ggctccctttcatcccggctgggag

SEQ ID NO: 418501 - DNA, 25 bp, Mus musculus
tttcatcccggctgggagccgactc

SEQ ID NO: 418502 - DNA, 25 bp, Mus musculus
tgggccttggggaggtggcttcgcc

SEQ ID NO: 418503 - DNA, 25 bp, Mus musculus
gtcctgggaagacccggctgcgcgg

SEQ ID NO: 418504 - DNA, 25 bp, Mus musculus
ctgggacatcaaagcggccgccgcg

SEQ ID NO: 418505 - DNA, 25 bp, Mus musculus
ccccagcgagggctgggacatcaaa

SEQ ID NO: 418506 - DNA, 25 bp, Mus musculus
caccctttcaagtcggcctgggagt

SEQ ID NO: 418507 - DNA, 25 bp, Mus musculus
ctcaccctttcaagtcggcctggga

SEQ ID NO: 418508 - DNA, 25 bp, Mus musculus
ggctcaccctttcaagtcggcctgg

SEQ ID NO: 418509 - DNA, 25 bp, Mus musculus
ggctgcgcggctcaccctttcaagt

SEQ ID NO: 418510 - DNA, 25 bp, Mus musculus
gtggcttcgccgggctccctttcat

SEQ ID NO: 418511 - DNA, 25 bp, Mus musculus
ccgccgcgggatccggttgcggaag

SEQ ID NO: 418512 - DNA, 25 bp, Mus musculus
tctggtccctaaaatgaccggccca

SEQ ID NO: 418513 - DNA, 25 bp, Mus musculus
cctgaaagctcagaaagggaccgag

SEQ ID NO: 418514 - DNA, 25 bp, Mus musculus
cagcccagcgctgatgacgttgatg

SEQ ID NO: 418515 - DNA, 25 bp, Mus musculus
cgagagctgaagtttcgcggcgcaa

SEQ ID NO: 418516 - DNA, 25 bp, Mus musculus
ccagcgctgatgacgttgatgcatc

SEQ ID NO: 418517 - DNA, 25 bp, Mus musculus
tgacgttgatgcatcgcgtcgcatg

SEQ ID NO: 418518 - DNA, 25 bp, Mus musculus
gcatgccgggtcagcccttcatcat

SEQ ID NO: 418519 - DNA, 25 bp, Mus musculus
actccactccgcaccgagtccgaga

SEQ ID NO: 418520 - DNA, 25 bp, Mus musculus
ccacgtcttgggtcacagcctgaaa

SEQ ID NO: 418521 - DNA, 25 bp, Mus musculus
cagggattccacgtcttgggtcaca

SEQ ID NO: 418522 - DNA, 25 bp, Mus musculus
tccagagaaacagggattccacgtc

SEQ ID NO: 418523 - DNA, 25 bp, Mus musculus
cggcgcgcagcactccagagaaaca

SEQ ID NO: 418524 - DNA, 25 bp, Mus musculus
gcggcgcaaagccaggccaacactg

SEQ ID NO: 418525 - DNA, 25 bp, Mus musculus
tgatgcatcgcgtcgcatgccgggt

SEQ ID NO: 418526 - DNA, 25 bp, Mus musculus
gcgggcggctaaagcgacctcgcca

SEQ ID NO: 418527 - DNA, 25 bp, Mus musculus
gaaaagcacaaagcacagcgccctc

SEQ ID NO: 418528 - DNA, 25 bp, Mus musculus
agggaagacacgcagccgcccggat

SEQ ID NO: 418529 - DNA, 25 bp, Mus musculus
ctccgcagaacacccgtgaaactta

SEQ ID NO: 418530 - DNA, 25 bp, Mus musculus
gtgccggcaaccctgctctggagct

SEQ ID NO: 418531 - DNA, 25 bp, Mus musculus
tgctctggagctctcttccaggctc

SEQ ID NO: 418532 - DNA, 25 bp, Mus musculus
ggctctcccagcttaagctcggttt

SEQ ID NO: 418533 - DNA, 25 bp, Mus musculus
tcctcgcggcgaaaagcacaaagca

SEQ ID NO: 418534 - DNA, 25 bp, Mus musculus
ggtttcccggcctagtcctcatctg

SEQ ID NO: 418535 - DNA, 25 bp, Mus musculus
ctcggttcccttatgctccgcagaa

SEQ ID NO: 418536 - DNA, 25 bp, Mus musculus
gagcgggctagcgaccaccctggtc

SEQ ID NO: 418537 - DNA, 25 bp, Mus musculus
cgtggctaccggcttgggactcacg

SEQ ID NO: 418538 - DNA, 25 bp, Mus musculus
cggcttgggactcacgctcccggat

SEQ ID NO: 418539 - DNA, 25 bp, Mus musculus
ggtgcgaggtttcggcgcctacctc

SEQ ID NO: 418540 - DNA, 25 bp, Mus musculus
acacggccttcgagcattggcagca

SEQ ID NO: 418541 - DNA, 25 bp, Mus musculus
tgacatgagctagagcacgcggagc

SEQ ID NO: 418542 - DNA, 25 bp, Mus musculus
gcggaacttgttgggcagcagcttc

SEQ ID NO: 418543 - DNA, 25 bp, Mus musculus
gcggctgtgacgttgacatgagcta

SEQ ID NO: 418544 - DNA, 25 bp, Mus musculus
gcagcatcggcagccgcttaacagg

SEQ ID NO: 418545 - DNA, 25 bp, Mus musculus
atatcccttgggcttgtaggccggg

SEQ ID NO: 418546 - DNA, 25 bp, Mus musculus
cctccatggactggcgccggaacat

SEQ ID NO: 418547 - DNA, 25 bp, Mus musculus
tcagagctcggctcaggacaccttc

SEQ ID NO: 418548 - DNA, 25 bp, Mus musculus
ggccgcaggaaggtcgtattccagc

SEQ ID NO: 418549 - DNA, 25 bp, Mus musculus
ggtcgtattccagcccgcagtccat

SEQ ID NO: 418550 - DNA, 25 bp, Mus musculus
cccgcagtccatagcgccgggaagg

SEQ ID NO: 418551 - DNA, 25 bp, Mus musculus
cggcaggaccctagcctgctgtgtc

SEQ ID NO: 418552 - DNA, 25 bp, Mus musculus
aacgccagccctttggggcggctgt

SEQ ID NO: 418553 - DNA, 25 bp, Mus musculus
ctggcgccggaacatcctgagtcag

SEQ ID NO: 418554 - DNA, 25 bp, Mus musculus
tcaaaccttggagtgcggcgatctg

SEQ ID NO: 418555 - DNA, 25 bp, Mus musculus
actctggtgaccacggattgggttg

SEQ ID NO: 418556 - DNA, 25 bp, Mus musculus
ttcaccgatcagacctgggcaggga

SEQ ID NO: 418557 - DNA, 25 bp, Mus musculus
acgtcccatggaggttcaccgatca

SEQ ID NO: 418558 - DNA, 25 bp, Mus musculus
cccacgtgcacgtcccatggaggtt

SEQ ID NO: 418559 - DNA, 25 bp, Mus musculus
cccgtcgtcaagtgacctgggcctg

SEQ ID NO: 418560 - DNA, 25 bp, Mus musculus
cccgacccaggtaagtatcgcgagg

SEQ ID NO: 418561 - DNA, 25 bp, Mus musculus
tgggctacggtctttgccagcctcc

SEQ ID NO: 418562 - DNA, 25 bp, Mus musculus
ggcggagcgatcttgagtccagccc

SEQ ID NO: 418563 - DNA, 25 bp, Mus musculus
tcccgaaggaaaaggcgatctggcc

SEQ ID NO: 418564 - DNA, 25 bp, Mus musculus
actagctggtcttgtgtttgggcga

SEQ ID NO: 418565 - DNA, 25 bp, Mus musculus
atctggccgaagaatagggcgatca

SEQ ID NO: 418566 - DNA, 25 bp, Mus musculus
tggaggctggcaagacgtatcttca

SEQ ID NO: 418567 - DNA, 25 bp, Mus musculus
gacgatctggacgtgagctgcctgt

SEQ ID NO: 418568 - DNA, 25 bp, Mus musculus
tgcagcttgaagctcttgaggcaga

SEQ ID NO: 418569 - DNA, 25 bp, Mus musculus
cacagcccgggtgcgagcagagcct

SEQ ID NO: 418570 - DNA, 25 bp, Mus musculus
acttggaagcagaagcggttgatca

SEQ ID NO: 418571 - DNA, 25 bp, Mus musculus
gcaagagctgcgtgacttggaagca

SEQ ID NO: 418572 - DNA, 25 bp, Mus musculus
tgggccagcaagagctgcgtgactt

SEQ ID NO: 418573 - DNA, 25 bp, Mus musculus
aagctcttgaggcagatgtgcgtga

SEQ ID NO: 418574 - DNA, 25 bp, Mus musculus
agttgtaggcggctccggactccag

SEQ ID NO: 418575 - DNA, 25 bp, Mus musculus
atgcaccgtgcagggagcagttgta

SEQ ID NO: 418576 - DNA, 25 bp, Mus musculus
ccagaccaacaggatgcaccgtgca

SEQ ID NO: 418577 - DNA, 25 bp, Mus musculus
tgaagccagaccaacaggatgcacc

SEQ ID NO: 418578 - DNA, 25 bp, Mus musculus
caaaaacgaggttgaagccagacca

SEQ ID NO: 418579 - DNA, 25 bp, Mus musculus
gcagagcctctcaaaaacgaggttg

SEQ ID NO: 418580 - DNA, 25 bp, Mus musculus
gggtgcgagcagagcctctcaaaaa

SEQ ID NO: 418581 - DNA, 25 bp, Mus musculus
caccgtgggccagcaagagctgcgt

SEQ ID NO: 418582 - DNA, 25 bp, Mus musculus
tccctgtgatgccagcgatggcggc

SEQ ID NO: 418583 - DNA, 25 bp, Mus musculus
acagcgacgggtctggggagacgtc

SEQ ID NO: 418584 - DNA, 25 bp, Mus musculus
cggcatacctggctccctgtgatgc

SEQ ID NO: 418585 - DNA, 25 bp, Mus musculus
aggcgggcggcatacctggctccct

SEQ ID NO: 418586 - DNA, 25 bp, Mus musculus
ccagggcagagatccgtgcagcaga

SEQ ID NO: 418587 - DNA, 25 bp, Mus musculus
cagccagggcagagatccgtgcagc

SEQ ID NO: 418588 - DNA, 25 bp, Mus musculus
atccagccagggcagagatccgtgc

SEQ ID NO: 418589 - DNA, 25 bp, Mus musculus
gccatccagccagggcagagatccg

SEQ ID NO: 418590 - DNA, 25 bp, Mus musculus
ggctgctcagggctttgccgccatc

SEQ ID NO: 418591 - DNA, 25 bp, Mus musculus
acgtcttggagaaggggctgaggtt

SEQ ID NO: 418592 - DNA, 25 bp, Mus musculus
agccgtggtggatggacgtcttgga

SEQ ID NO: 418593 - DNA, 25 bp, Mus musculus
gcatacctggctccctgtgatgcca

SEQ ID NO: 418594 - DNA, 25 bp, Mus musculus
gccgccagagaagaggatgaagccg

SEQ ID NO: 418595 - DNA, 25 bp, Mus musculus
taaacggacagaggccccggagagc

SEQ ID NO: 418596 - DNA, 25 bp, Mus musculus
ttccgcaccggaagttatcctacca

SEQ ID NO: 418597 - DNA, 25 bp, Mus musculus
gaccgcagcgacttactcatccagg

SEQ ID NO: 418598 - DNA, 25 bp, Mus musculus
tccactaggggctggtactcaaaga

SEQ ID NO: 418599 - DNA, 25 bp, Mus musculus
tgggtgctcgcttgtctctgtagca

SEQ ID NO: 418600 - DNA, 25 bp, Mus musculus
agggcgccaaggatggcgtccacta

SEQ ID NO: 418601 - DNA, 25 bp, Mus musculus
cgacaaccacagaggaccgcagcga

SEQ ID NO: 418602 - DNA, 25 bp, Mus musculus
gggtcttctgccctacaagacactc

SEQ ID NO: 418603 - DNA, 25 bp, Mus musculus
agccaggacgtctccagcatccatg

SEQ ID NO: 418604 - DNA, 25 bp, Mus musculus
gaggcctgctgtctgccgaaagtcc

SEQ ID NO: 418605 - DNA, 25 bp, Mus musculus
agggcacacggaccacaccggcttg

SEQ ID NO: 418606 - DNA, 25 bp, Mus musculus
ccgagtacccaaggaggtctgcaca

SEQ ID NO: 418607 - DNA, 25 bp, Mus musculus
tccgaaggcgtagcgctccgagtac

SEQ ID NO: 418608 - DNA, 25 bp, Mus musculus
tctgtagcacaagcactccgaaggc

SEQ ID NO: 418609 - DNA, 25 bp, Mus musculus
atgatcctgcggaagccgtgcaaga

SEQ ID NO: 418610 - DNA, 25 bp, Mus musculus
gcgggactcggactacagcactccg

SEQ ID NO: 418611 - DNA, 25 bp, Mus musculus
cggccagggcatggacagcgcggcc

SEQ ID NO: 418612 - DNA, 25 bp, Mus musculus
ctggctagtgagcggtccgcccgta

SEQ ID NO: 418613 - DNA, 25 bp, Mus musculus
cccgaccgactgacttgagatccgg

SEQ ID NO: 418614 - DNA, 25 bp, Mus musculus
accgactgacttgagatccggcaca

SEQ ID NO: 418615 - DNA, 25 bp, Mus musculus
actgacttgagatccggcacagtga

SEQ ID NO: 418616 - DNA, 25 bp, Mus musculus
ttgagatccggcacagtgagcagcg

SEQ ID NO: 418617 - DNA, 25 bp, Mus musculus
cgccttcgccctagacccgccagcg

SEQ ID NO: 418618 - DNA, 25 bp, Mus musculus
cccgcacccggcgattgcgcccagg

SEQ ID NO: 418619 - DNA, 25 bp, Mus musculus
cgattgcgcccaggcgcgcaagaac

SEQ ID NO: 418620 - DNA, 25 bp, Mus musculus
cgcaagaacttctcggtgagccacc

SEQ ID NO: 418621 - DNA, 25 bp, Mus musculus
gcaagaacttctcggtgagccacct

SEQ ID NO: 418622 - DNA, 25 bp, Mus musculus
cggcgggactcggactacagcactc

SEQ ID NO: 418623 - DNA, 25 bp, Mus musculus
cggtgagccacctcctggacctgga

SEQ ID NO: 418624 - DNA, 25 bp, Mus musculus
cagggccgcgcctggaaccagatgt

SEQ ID NO: 418625 - DNA, 25 bp, Mus musculus
ggccggagtgacgagaacaggactc

SEQ ID NO: 418626 - DNA, 25 bp, Mus musculus
accccaggccggagtgacgagaaca

SEQ ID NO: 418627 - DNA, 25 bp, Mus musculus
gcacacatggcaggcgtctgagggc

SEQ ID NO: 418628 - DNA, 25 bp, Mus musculus
gtagtacccgggatgcgacagggca

SEQ ID NO: 418629 - DNA, 25 bp, Mus musculus
tggcgcacacatggcaggcgtctga

SEQ ID NO: 418630 - DNA, 25 bp, Mus musculus
ctcggcctggcgcacacatggcagg

SEQ ID NO: 418631 - DNA, 25 bp, Mus musculus
ccagggccgcgcctggaaccagatg

SEQ ID NO: 418632 - DNA, 25 bp, Mus musculus
gctgttaacggtgtctgggccgcgg

SEQ ID NO: 418633 - DNA, 25 bp, Mus musculus
ccaggctgttaacggtgtctgggcc

SEQ ID NO: 418634 - DNA, 25 bp, Mus musculus
cgcgccaggctgttaacggtgtctg

SEQ ID NO: 418635 - DNA, 25 bp, Mus musculus
gcgcgccaggctgttaacggtgtct

SEQ ID NO: 418636 - DNA, 25 bp, Mus musculus
tacccgggatgcgacagggcagggc

SEQ ID NO: 418637 - DNA, 25 bp, Mus musculus
cctggcgcacacatggcaggcgtct

SEQ ID NO: 418638 - DNA, 25 bp, Mus musculus
ttccctgcgtgcgatgagacgaatc

SEQ ID NO: 418639 - DNA, 25 bp, Mus musculus
ctggagaactgaacgcaacggggcc

SEQ ID NO: 418640 - DNA, 25 bp, Mus musculus
cggctttctagctaagcggaagtga

SEQ ID NO: 418641 - DNA, 25 bp, Mus musculus
agtgacagcgccgtaccggaagttc

SEQ ID NO: 418642 - DNA, 25 bp, Mus musculus
ggccttgcaatgaccacctggagaa

SEQ ID NO: 418643 - DNA, 25 bp, Mus musculus
cctgggactgaatcctgcgctcgga

SEQ ID NO: 418644 - DNA, 25 bp, Mus musculus
tgcgatgagacgaatcggagcgttt

SEQ ID NO: 418645 - DNA, 25 bp, Mus musculus
gcccgtaagcgtgggcatcgccatc

SEQ ID NO: 418646 - DNA, 25 bp, Mus musculus
ggctacctgtcctataccgatttct

SEQ ID NO: 418647 - DNA, 25 bp, Mus musculus
tttctactgccgcttcaccgagtgc

SEQ ID NO: 418648 - DNA, 25 bp, Mus musculus
tcaccgagtgctgccatgaggaacg

SEQ ID NO: 418649 - DNA, 25 bp, Mus musculus
cgggagacacacacggccgggacct

SEQ ID NO: 418650 - DNA, 25 bp, Mus musculus
tcaacacgtcgggtatgtgcccgcg

SEQ ID NO: 418651 - DNA, 25 bp, Mus musculus
accggaagttcagtccctgggactg

SEQ ID NO: 418652 - DNA, 25 bp, Mus musculus
ttgtccggggcaggcagtctaccga

SEQ ID NO: 418653 - DNA, 25 bp, Mus musculus
tggtgctgcgaactctgcccttcct

SEQ ID NO: 418654 - DNA, 25 bp, Mus musculus
ctgagggaccctggtgctgcgaact

SEQ ID NO: 418655 - DNA, 25 bp, Mus musculus
ggcccggccaagcttcataaccgga

SEQ ID NO: 418656 - DNA, 25 bp, Mus musculus
ctcgtatttccggttcctgctggcg

SEQ ID NO: 418657 - DNA, 25 bp, Mus musculus
caaagccaagcggaagaggtgccgt

SEQ ID NO: 418658 - DNA, 25 bp, Mus musculus
cccagactcgtatttccggttcctg

SEQ ID NO: 418659 - DNA, 25 bp, Mus musculus
cagactcaggctgatgggctccacc

SEQ ID NO: 418660 - DNA, 25 bp, Mus musculus
atataggtggtgagtacgccggcca

SEQ ID NO: 418661 - DNA, 25 bp, Mus musculus
atctggccgcagcactcggcgaaga

SEQ ID NO: 418662 - DNA, 25 bp, Mus musculus
gctgaggctccgcatctggccgcag

SEQ ID NO: 418663 - DNA, 25 bp, Mus musculus
ccggccaaagtctggcctggcagcg

SEQ ID NO: 418664 - DNA, 25 bp, Mus musculus
aggcctccggccaaagtctggcctg

SEQ ID NO: 418665 - DNA, 25 bp, Mus musculus
cgccctctttgtccggggcaggcag

SEQ ID NO: 418666 - DNA, 25 bp, Mus musculus
ccctctagtaggctgtgacctgtga

SEQ ID NO: 418667 - DNA, 25 bp, Mus musculus
agacccttggcgctgcgttaccaga

SEQ ID NO: 418668 - DNA, 25 bp, Mus musculus
agcctgtctcagcaacacgtaccga

SEQ ID NO: 418669 - DNA, 25 bp, Mus musculus
gcgccggcggaatgttttcccagta

SEQ ID NO: 418670 - DNA, 25 bp, Mus musculus
tccgcatagcggaaccagacccttg

SEQ ID NO: 418671 - DNA, 25 bp, Mus musculus
gcgtagtccagggaacctctctctt

SEQ ID NO: 418672 - DNA, 25 bp, Mus musculus
ctccgaaaagcaagggcaggtattg

SEQ ID NO: 418673 - DNA, 25 bp, Mus musculus
gtaaccatgctcaccgctcaacagg

SEQ ID NO: 418674 - DNA, 25 bp, Mus musculus
ccgcgatgtggccttatccctagga

SEQ ID NO: 418675 - DNA, 25 bp, Mus musculus
gactcccggcatgcttgggcactca

SEQ ID NO: 418676 - DNA, 25 bp, Mus musculus
tggccggtatccagtcccaagcctg

SEQ ID NO: 418677 - DNA, 25 bp, Mus musculus
tggcataggctctcccgattggacg

SEQ ID NO: 418678 - DNA, 25 bp, Mus musculus
gacggccttcgaaccacacggtgaa

SEQ ID NO: 418679 - DNA, 25 bp, Mus musculus
cgtaccgaacctcctctgattcttg

SEQ ID NO: 418680 - DNA, 25 bp, Mus musculus
ttagagcaaaatcccagcgcgtttg

SEQ ID NO: 418681 - DNA, 25 bp, Mus musculus
catccctttaccctgggcttcagta

SEQ ID NO: 418682 - DNA, 25 bp, Mus musculus
ttaccctgggcttcagtaactaggc

SEQ ID NO: 418683 - DNA, 25 bp, Mus musculus
ccctgggcttcagtaactaggccgc

SEQ ID NO: 418684 - DNA, 25 bp, Mus musculus
ctgggcttcagtaactaggccgcga

SEQ ID NO: 418685 - DNA, 25 bp, Mus musculus
ggcttcagtaactaggccgcgaccg

SEQ ID NO: 418686 - DNA, 25 bp, Mus musculus
cttcagtaactaggccgcgaccggg

SEQ ID NO: 418687 - DNA, 25 bp, Mus musculus
gtttagagcaaaatcccagcgcgtt

SEQ ID NO: 418688 - DNA, 25 bp, Mus musculus
agagcaaaatcccagcgcgtttgtg

SEQ ID NO: 418689 - DNA, 25 bp, Mus musculus
agcaaaatcccagcgcgtttgtgcg

SEQ ID NO: 418690 - DNA, 25 bp, Mus musculus
aatcccagcgcgtttgtgcgaaaga

SEQ ID NO: 418691 - DNA, 25 bp, Mus musculus
tcccagcgcgtttgtgcgaaagagc

SEQ ID NO: 418692 - DNA, 25 bp, Mus musculus
ccagcgcgtttgtgcgaaagagctg

SEQ ID NO: 418693 - DNA, 25 bp, Mus musculus
taggggtttagagcaaaatcccagc

SEQ ID NO: 418694 - DNA, 25 bp, Mus musculus
cgcctcgtttgggtctcggtgcccg

SEQ ID NO: 418695 - DNA, 25 bp, Mus musculus
ccggcgagggccttccggatttcag

SEQ ID NO: 418696 - DNA, 25 bp, Mus musculus
gagggccttccggatttcagagcca

SEQ ID NO: 418697 - DNA, 25 bp, Mus musculus
ccttccggatttcagagccagtctt

SEQ ID NO: 418698 - DNA, 25 bp, Mus musculus
ttccggatttcagagccagtcttgg

SEQ ID NO: 418699 - DNA, 25 bp, Mus musculus
tgggttgttctcgatgtcccccatc

SEQ ID NO: 418700 - DNA, 25 bp, Mus musculus
tcttcaccggccgtatgatccgagg

SEQ ID NO: 418701 - DNA, 25 bp, Mus musculus
ccggccgtatgatccgaggagttaa

SEQ ID NO: 418702 - DNA, 25 bp, Mus musculus
ccgtatgatccgaggagttaagaac

SEQ ID NO: 418703 - DNA, 25 bp, Mus musculus
tgatccgaggagttaagaacaaaaa

SEQ ID NO: 418704 - DNA, 25 bp, Mus musculus
ccctgtgtcgtagtagggtgtcagt

SEQ ID NO: 418705 - DNA, 25 bp, Mus musculus
ttggggaggtttttcaagaagcagc

SEQ ID NO: 418706 - DNA, 25 bp, Mus musculus
tttttcaagaagcagcggaacggcc

SEQ ID NO: 418707 - DNA, 25 bp, Mus musculus
tttcaagaagcagcggaacggccat

SEQ ID NO: 418708 - DNA, 25 bp, Mus musculus
cctcactttcagagagaagacctta

SEQ ID NO: 418709 - DNA, 25 bp, Mus musculus
ggaccggactgacagctcgtgcata

SEQ ID NO: 418710 - DNA, 25 bp, Mus musculus
cggtattcggcaaccagcgagccca

SEQ ID NO: 418711 - DNA, 25 bp, Mus musculus
gggactcctgctcgtcatcggtatt

SEQ ID NO: 418712 - DNA, 25 bp, Mus musculus
aaggaaggatcctcgcaagattatc

SEQ ID NO: 418713 - DNA, 25 bp, Mus musculus
tcctctgggcagcaggacagaacca

SEQ ID NO: 418714 - DNA, 25 bp, Mus musculus
atcgtccctccgtgctatcttatga

SEQ ID NO: 418715 - DNA, 25 bp, Mus musculus
ttcagaatctgagctgtctccaaga

SEQ ID NO: 418716 - DNA, 25 bp, Mus musculus
cttgtgaatgcggaaagcccgccgc

SEQ ID NO: 418717 - DNA, 25 bp, Mus musculus
ctcggggctaaagtcctcactttca

SEQ ID NO: 418718 - DNA, 25 bp, Mus musculus
agaagaccttacctctcgctaccgg

SEQ ID NO: 418719 - DNA, 25 bp, Mus musculus
gcacctccaagcgtatagatcggcc

SEQ ID NO: 418720 - DNA, 25 bp, Mus musculus
ctgcggccctccgaaccttgtgaat

SEQ ID NO: 418721 - DNA, 25 bp, Mus musculus
gtctccaagatacaagtgcgctcca

SEQ ID NO: 418722 - DNA, 25 bp, Mus musculus
gcagctggtgatgctggaacaaaca

SEQ ID NO: 418723 - DNA, 25 bp, Mus musculus
ccagagttgcgttttgcagtaaaac

SEQ ID NO: 418724 - DNA, 25 bp, Mus musculus
ttctgcctgcggctgctacgactgc

SEQ ID NO: 418725 - DNA, 25 bp, Mus musculus
cccgtagggatggactacgccgtgc

SEQ ID NO: 418726 - DNA, 25 bp, Mus musculus
cagcccagcgggatctcctaagttc

SEQ ID NO: 418727 - DNA, 25 bp, Mus musculus
tgtcccgggctgagccaacttcagc

SEQ ID NO: 418728 - DNA, 25 bp, Mus musculus
ctggcgctcaaagtaaggcctggca

SEQ ID NO: 418729 - DNA, 25 bp, Mus musculus
tggaacaaacatggccgtcccggta

SEQ ID NO: 418730 - DNA, 25 bp, Mus musculus
gacgacgcactttgacccggaagtg

SEQ ID NO: 418731 - DNA, 25 bp, Mus musculus
gagcacctccgggacgacgcacttt

SEQ ID NO: 418732 - DNA, 25 bp, Mus musculus
gcagtaaaacgatctcaaggacctc

SEQ ID NO: 418733 - DNA, 25 bp, Mus musculus
tcaggtccctgcgtgaccagagttg

SEQ ID NO: 418734 - DNA, 25 bp, Mus musculus
caattgaagagtgccgaggtggtcc

SEQ ID NO: 418735 - DNA, 25 bp, Mus musculus
tccgtcctgggaggccaattgaaga

SEQ ID NO: 418736 - DNA, 25 bp, Mus musculus
ttggcctcgttcacgtccgattttc

SEQ ID NO: 418737 - DNA, 25 bp, Mus musculus
atgagtggcggctccgagtccaccc

SEQ ID NO: 418738 - DNA, 25 bp, Mus musculus
cgcagcagtagcgagcatgtgctac

SEQ ID NO: 418739 - DNA, 25 bp, Mus musculus
gcatgtgctacgcagcccagtaacc

SEQ ID NO: 418740 - DNA, 25 bp, Mus musculus
cagtaaccagggacgaccgcggcaa

SEQ ID NO: 418741 - DNA, 25 bp, Mus musculus
gccgccgagcatggggaaatccaac

SEQ ID NO: 418742 - DNA, 25 bp, Mus musculus
tggggaaatccaacagcaagttgaa

SEQ ID NO: 418743 - DNA, 25 bp, Mus musculus
gcaagttgaagcctgaagttgtgga

SEQ ID NO: 418744 - DNA, 25 bp, Mus musculus
tgtggaggagctgaccagaaaaacc

SEQ ID NO: 418745 - DNA, 25 bp, Mus musculus
agaaaaacctactgtgagtgagccc

SEQ ID NO: 418746 - DNA, 25 bp, Mus musculus
gtcagcgtgctccagggaccactct

SEQ ID NO: 418747 - DNA, 25 bp, Mus musculus
caacgcggagctcgcgcctgtcgga

SEQ ID NO: 418748 - DNA, 25 bp, Mus musculus
ctcctgtccgaaggacccgggctgt

SEQ ID NO: 418749 - DNA, 25 bp, Mus musculus
gaccactctgggtcctcagggcatc

SEQ ID NO: 418750 - DNA, 25 bp, Mus musculus
tggtcacgtctgacgcgcccacgaa

SEQ ID NO: 418751 - DNA, 25 bp, Mus musculus
gctgggaaagtttgagtcacgccgc

SEQ ID NO: 418752 - DNA, 25 bp, Mus musculus
cagccgggtcatcgccaactatgcg

SEQ ID NO: 418753 - DNA, 25 bp, Mus musculus
taacctcggggctggaccagagagc

SEQ ID NO: 418754 - DNA, 25 bp, Mus musculus
tagccttcgtcttcgatgtcaccgg

SEQ ID NO: 418755 - DNA, 25 bp, Mus musculus
gctagagcgagactgcactgccatc

SEQ ID NO: 418756 - DNA, 25 bp, Mus musculus
tcaccatgacgcctggggcgcagct

SEQ ID NO: 418757 - DNA, 25 bp, Mus musculus
gctgctcgtggcgatctctacagca

SEQ ID NO: 418758 - DNA, 25 bp, Mus musculus
cgatctctacagcagtggcggcggt

SEQ ID NO: 418759 - DNA, 25 bp, Mus musculus
actatgcgctggtgcctttccacga

SEQ ID NO: 418760 - DNA, 25 bp, Mus musculus
atcgacggcgcctcgcgcattctgg

SEQ ID NO: 418761 - DNA, 25 bp, Mus musculus
gctccatgtgggatgacctgatgca

SEQ ID NO: 418762 - DNA, 25 bp, Mus musculus
atgtcaccggctccatgtgggatga

SEQ ID NO: 418763 - DNA, 25 bp, Mus musculus
cccgcagaagggcttgcaggtgtcc

SEQ ID NO: 418764 - DNA, 25 bp, Mus musculus
caaacgcggatccaaaaggttccag

SEQ ID NO: 418765 - DNA, 25 bp, Mus musculus
tccatgtacgaatggccgaggcccg

SEQ ID NO: 418766 - DNA, 25 bp, Mus musculus
tactgagcttccatgtacgaatggc

SEQ ID NO: 418767 - DNA, 25 bp, Mus musculus
ttccgtcagcggatactgagcttcc

SEQ ID NO: 418768 - DNA, 25 bp, Mus musculus
aaagtacgtccacctcttccgtcag

SEQ ID NO: 418769 - DNA, 25 bp, Mus musculus
ccatcgatgttaaaaagtacgtcca

SEQ ID NO: 418770 - DNA, 25 bp, Mus musculus
gtggttgccttgaccatcgatgtta

SEQ ID NO: 418771 - DNA, 25 bp, Mus musculus
gacgggacgtggttgccttgaccat

SEQ ID NO: 418772 - DNA, 25 bp, Mus musculus
ctgacggagtttccgtagtaggacg

SEQ ID NO: 418773 - DNA, 25 bp, Mus musculus
tgcaccgtagccctgacggagtttc

SEQ ID NO: 418774 - DNA, 25 bp, Mus musculus
ggtcggaggatacctctgcaccgta

SEQ ID NO: 418775 - DNA, 25 bp, Mus musculus
tccagcgccaaggtggactcaccgt

SEQ ID NO: 418776 - DNA, 25 bp, Mus musculus
tccaaaaggttccagcgccaaggtg

SEQ ID NO: 418777 - DNA, 25 bp, Mus musculus
tgatggtggctcacccagcgcggct

SEQ ID NO: 418778 - DNA, 25 bp, Mus musculus
tctgtgtcaccctcaggacctgctt

SEQ ID NO: 418779 - DNA, 25 bp, Mus musculus
gctaatcgcagtgtcgccttacccg

SEQ ID NO: 418780 - DNA, 25 bp, Mus musculus
aacgagcttgtctgtgtcaccctca

SEQ ID NO: 418781 - DNA, 25 bp, Mus musculus
tgctctcaggactgcagcgccagcg

SEQ ID NO: 418782 - DNA, 25 bp, Mus musculus
tggccgccttctccgaggctggcat

SEQ ID NO: 418783 - DNA, 25 bp, Mus musculus
accgcacggagctcaccgtgctgga

SEQ ID NO: 418784 - DNA, 25 bp, Mus musculus
gccagctacgcgctggacaaggcgc

SEQ ID NO: 418785 - DNA, 25 bp, Mus musculus
cgcgctggacaaggcgcggtctaca

SEQ ID NO: 418786 - DNA, 25 bp, Mus musculus
aaggcgcggtctacacccgcagagc

SEQ ID NO: 418787 - DNA, 25 bp, Mus musculus
gcgccgggctctaccgcttgactgt

SEQ ID NO: 418788 - DNA, 25 bp, Mus musculus
tctaccgcttgactgtgcgcgcagc

SEQ ID NO: 418789 - DNA, 25 bp, Mus musculus
caccagagcgtctacatcctgctaa

SEQ ID NO: 418790 - DNA, 25 bp, Mus musculus
gtctacactgcagtaccgcctgctg

SEQ ID NO: 418791 - DNA, 25 bp, Mus musculus
cgtctacatcctgctaatcgcagtg

SEQ ID NO: 418792 - DNA, 25 bp, Mus musculus
cctgtgcttataaccctggatgcgc

SEQ ID NO: 418793 - DNA, 25 bp, Mus musculus
caggccctgtgcttataaccctgga

SEQ ID NO: 418794 - DNA, 25 bp, Mus musculus
gcttataaccctggatgcgcgcctc

SEQ ID NO: 418795 - DNA, 25 bp, Mus musculus
tataaccctggatgcgcgcctctct

SEQ ID NO: 418796 - DNA, 25 bp, Mus musculus
tctctcagccctgctccgccgtctg

SEQ ID NO: 418797 - DNA, 25 bp, Mus musculus
ccgcaggtggcctcgagccctgaga

SEQ ID NO: 418798 - DNA, 25 bp, Mus musculus
taaattgcaagagcccacgcccgtg

SEQ ID NO: 418799 - DNA, 25 bp, Mus musculus
ggacctaaattgcaagagcccacgc

SEQ ID NO: 418800 - DNA, 25 bp, Mus musculus
tcaggggacctaaattgcaagagcc

SEQ ID NO: 418801 - DNA, 25 bp, Mus musculus
tcaggatcaggggacctaaattgca

SEQ ID NO: 418802 - DNA, 25 bp, Mus musculus
cgggtcaggatcaggggacctaaat

SEQ ID NO: 418803 - DNA, 25 bp, Mus musculus
caggcgccaccagcgggtcaggatc

SEQ ID NO: 418804 - DNA, 25 bp, Mus musculus
ctgccgccctcccaggcgccaccag

SEQ ID NO: 418805 - DNA, 25 bp, Mus musculus
ggccctgtgcttataaccctggatg

SEQ ID NO: 418806 - DNA, 25 bp, Mus musculus
ggacagcggtcacgtgctttgagac

SEQ ID NO: 418807 - DNA, 25 bp, Mus musculus
aagcttttgccaagcgctcctggcg

SEQ ID NO: 418808 - DNA, 25 bp, Mus musculus
cggggccagaggaagcttttgccaa

SEQ ID NO: 418809 - DNA, 25 bp, Mus musculus
tttgacggacatctgcctgtgccca

SEQ ID NO: 418810 - DNA, 25 bp, Mus musculus
acctggtctttttgacggacatctg

SEQ ID NO: 418811 - DNA, 25 bp, Mus musculus
cggtggcggtcccacgcttgctaaa

SEQ ID NO: 418812 - DNA, 25 bp, Mus musculus
cccgcctcacagacgctgctttccc

SEQ ID NO: 418813 - DNA, 25 bp, Mus musculus
tctgtctccctctgagctagcagtg

SEQ ID NO: 418814 - DNA, 25 bp, Mus musculus
ctctgagctagcagtgccttccctt

SEQ ID NO: 418815 - DNA, 25 bp, Mus musculus
agctagcagtgccttcccttcgctt

SEQ ID NO: 418816 - DNA, 25 bp, Mus musculus
ctgagggctttgtggatgccctgca

SEQ ID NO: 418817 - DNA, 25 bp, Mus musculus
tggatgccctgcaccgggtccggca

SEQ ID NO: 418818 - DNA, 25 bp, Mus musculus
ggactataaggccgcacctgcgccg

SEQ ID NO: 418819 - DNA, 25 bp, Mus musculus
ccacgcttgctaaaggcctggggcc

SEQ ID NO: 418820 - DNA, 25 bp, Mus musculus
gaccctcttggtgttccttggctca

SEQ ID NO: 418821 - DNA, 25 bp, Mus musculus
ttggctcagccaccctttctgatcg

SEQ ID NO: 418822 - DNA, 25 bp, Mus musculus
agatggtgggacgacaaatctctcc

SEQ ID NO: 418823 - DNA, 25 bp, Mus musculus
gctcattccggtcgatcgatacctg

SEQ ID NO: 418824 - DNA, 25 bp, Mus musculus
cccgccgctaatatctttttaatga

SEQ ID NO: 418825 - DNA, 25 bp, Mus musculus
agccgattgattcgttccgcccaga

SEQ ID NO: 418826 - DNA, 25 bp, Mus musculus
cgatctgccctccagggtggatttt

SEQ ID NO: 418827 - DNA, 25 bp, Mus musculus
gctccctgccagaggcaacaagttg

SEQ ID NO: 418828 - DNA, 25 bp, Mus musculus
ggcaagggcaggagactttcttcta

SEQ ID NO: 418829 - DNA, 25 bp, Mus musculus
tcttggcggacaatgggcttctttt

SEQ ID NO: 418830 - DNA, 25 bp, Mus musculus
ttcttttctcctagcgcctccggga

SEQ ID NO: 418831 - DNA, 25 bp, Mus musculus
gtccgaatggcccaacctggtcatc

SEQ ID NO: 418832 - DNA, 25 bp, Mus musculus
ggtcatcaaggagcaaagcccattc

SEQ ID NO: 418833 - DNA, 25 bp, Mus musculus
ggggcttaaagccagcacgatctgc

SEQ ID NO: 418834 - DNA, 25 bp, Mus musculus
cggaagacttcctatcgccggcttg

SEQ ID NO: 418835 - DNA, 25 bp, Mus musculus
aagacttcctatcgccggcttggcg

SEQ ID NO: 418836 - DNA, 25 bp, Mus musculus
tatcgccggcttggcgctttagtct

SEQ ID NO: 418837 - DNA, 25 bp, Mus musculus
gcttggcgctttagtctcccgcctg

SEQ ID NO: 418838 - DNA, 25 bp, Mus musculus
tgtaaggaactcttacccgccggca

SEQ ID NO: 418839 - DNA, 25 bp, Mus musculus
gttctgcttcggaagacttcctatc

SEQ ID NO: 418840 - DNA, 25 bp, Mus musculus
ccagaggttctgcttcggaagactt

SEQ ID NO: 418841 - DNA, 25 bp, Mus musculus
cactgggctccagaggttctgcttc

SEQ ID NO: 418842 - DNA, 25 bp, Mus musculus
cgccggcagcccttgctcctctgca

SEQ ID NO: 418843 - DNA, 25 bp, Mus musculus
tcaccggcggcatctgtaaggaact

SEQ ID NO: 418844 - DNA, 25 bp, Mus musculus
gaaaggatttaactcaccggcggca

SEQ ID NO: 418845 - DNA, 25 bp, Mus musculus
tctccactgggctccagaggttctg

SEQ ID NO: 418846 - DNA, 25 bp, Mus musculus
ggatttaactcaccggcggcatctg

SEQ ID NO: 418847 - DNA, 25 bp, Mus musculus
cggcggcatctgtaaggaactctta

SEQ ID NO: 418848 - DNA, 25 bp, Mus musculus
aaactctgcgccctttgcggattgg

SEQ ID NO: 418849 - DNA, 25 bp, Mus musculus
tcccgcaacgtgatcgtggagcgca

SEQ ID NO: 418850 - DNA, 25 bp, Mus musculus
aagaaagcatcttcccgcaacgtga

SEQ ID NO: 418851 - DNA, 25 bp, Mus musculus
gggctgccctccaagaaagcatctt

SEQ ID NO: 418852 - DNA, 25 bp, Mus musculus
ggctctggggctgccctccaagaaa

SEQ ID NO: 418853 - DNA, 25 bp, Mus musculus
ctttgtccagaccaccatggctctg

SEQ ID NO: 418854 - DNA, 25 bp, Mus musculus
agcgagctttgtccagaccaccatg

SEQ ID NO: 418855 - DNA, 25 bp, Mus musculus
gcacatctggatggaagcgagcttt

SEQ ID NO: 418856 - DNA, 25 bp, Mus musculus
gcggcgacagcagtggccgcacatc

SEQ ID NO: 418857 - DNA, 25 bp, Mus musculus
gacggcccagccgtgatcctgcgag

SEQ ID NO: 418858 - DNA, 25 bp, Mus musculus
cggccttgttttgctccggaatcgc

SEQ ID NO: 418859 - DNA, 25 bp, Mus musculus
ttatggccctgacgtcaccggccga

SEQ ID NO: 418860 - DNA, 25 bp, Mus musculus
ctttgcggattggtcccgggctgcc

SEQ ID NO: 418861 - DNA, 25 bp, Mus musculus
cgtggagcgcaggaacctgatcacc

SEQ ID NO: 418862 - DNA, 25 bp, Mus musculus
ggcagaggtcatcacctccgacatc

SEQ ID NO: 418863 - DNA, 25 bp, Mus musculus
tgagtgtgccgtcggggctccactc

SEQ ID NO: 418864 - DNA, 25 bp, Mus musculus
tccttctcaggaggtgagtgtgccg

SEQ ID NO: 418865 - DNA, 25 bp, Mus musculus
ggtcctggcgcagtccttctcagga

SEQ ID NO: 418866 - DNA, 25 bp, Mus musculus
aacgtgctaggcgaacagctgctgg

SEQ ID NO: 418867 - DNA, 25 bp, Mus musculus
tggcgcaacgtgctaggcgaacagc

SEQ ID NO: 418868 - DNA, 25 bp, Mus musculus
ttatatggccgatggcgcaacgtgc

SEQ ID NO: 418869 - DNA, 25 bp, Mus musculus
ctccgacatcctgcacagtttctta

SEQ ID NO: 418870 - DNA, 25 bp, Mus musculus
ttggcgctggcagaggtcatcacct

SEQ ID NO: 418871 - DNA, 25 bp, Mus musculus
ctcaaaacagggctgaaggctccgg

SEQ ID NO: 418872 - DNA, 25 bp, Mus musculus
agctgaggccctggtgctcaaaaca

SEQ ID NO: 418873 - DNA, 25 bp, Mus musculus
ctgtgctcccagctgaggccctggt

SEQ ID NO: 418874 - DNA, 25 bp, Mus musculus
tccgccgcccatgatgggctctgtg

SEQ ID NO: 418875 - DNA, 25 bp, Mus musculus
cacagtttcttatatggccgatggc

SEQ ID NO: 418876 - DNA, 25 bp, Mus musculus
gcgtgacaaattgccggccgctccg

SEQ ID NO: 418877 - DNA, 25 bp, Mus musculus
atcctctcggggttagggaccgctg

SEQ ID NO: 418878 - DNA, 25 bp, Mus musculus
tgaatgcgatcactttaacagcgtg

SEQ ID NO: 418879 - DNA, 25 bp, Mus musculus
aacgacttcagagctcgcctgatcc

SEQ ID NO: 418880 - DNA, 25 bp, Mus musculus
cgctggttcttcctcgcccattaaa

SEQ ID NO: 418881 - DNA, 25 bp, Mus musculus
tcagagctcgcctgatccgggtgcc

SEQ ID NO: 418882 - DNA, 25 bp, Mus musculus
accttgtaagacatggaggccgccc

SEQ ID NO: 418883 - DNA, 25 bp, Mus musculus
ttagaggggaaccttgtaagacatg

SEQ ID NO: 418884 - DNA, 25 bp, Mus musculus
ccaggtagcttagaggggaaccttg

SEQ ID NO: 418885 - DNA, 25 bp, Mus musculus
gctccgcaatggacaccgtttaacc

SEQ ID NO: 418886 - DNA, 25 bp, Mus musculus
gccgctccgcaatggacaccgttta

SEQ ID NO: 418887 - DNA, 25 bp, Mus musculus
tggaaccgaatgaatgcgatcactt

SEQ ID NO: 418888 - DNA, 25 bp, Mus musculus
tttaacagcgtgacaaattgccggc

SEQ ID NO: 418889 - DNA, 25 bp, Mus musculus
cctcgcccattaaaacgacttcaga

SEQ ID NO: 418890 - DNA, 25 bp, Mus musculus
cgagcgtccctacaagtgccaggtg

SEQ ID NO: 418891 - DNA, 25 bp, Mus musculus
gggccgcatgcgctgcgtcatctgc

SEQ ID NO: 418892 - DNA, 25 bp, Mus musculus
agcaacctgcgctcgcacatgcgta

SEQ ID NO: 418893 - DNA, 25 bp, Mus musculus
cgcacatgcgtatccacacgctgga

SEQ ID NO: 418894 - DNA, 25 bp, Mus musculus
acacgctggacaagcccttcgtgtg

SEQ ID NO: 418895 - DNA, 25 bp, Mus musculus
aagcccttcgtgtgccgcttctgca

SEQ ID NO: 418896 - DNA, 25 bp, Mus musculus
agagcgcctactcgcagctggccgg

SEQ ID NO: 418897 - DNA, 25 bp, Mus musculus
cactcctgatccgtcttgcagagga

SEQ ID NO: 418898 - DNA, 25 bp, Mus musculus
tgtcctctcttcttgagagtcggtc

SEQ ID NO: 418899 - DNA, 25 bp, Mus musculus
gtgctaaccgggctgctttctttcc

SEQ ID NO: 418900 - DNA, 25 bp, Mus musculus
gtgtctcacggcgtgggtgctaacc

SEQ ID NO: 418901 - DNA, 25 bp, Mus musculus
gccaggtgtgccagagcgcctactc

SEQ ID NO: 418902 - DNA, 25 bp, Mus musculus
catctcggagtgtccctcctgcagg

SEQ ID NO: 418903 - DNA, 25 bp, Mus musculus
ccacctgccggccatggtgctgtga

SEQ ID NO: 418904 - DNA, 25 bp, Mus musculus
tgcgcaagtcattggcgccaagatg

SEQ ID NO: 418905 - DNA, 25 bp, Mus musculus
tcggagcatccatactagttccctc

SEQ ID NO: 418906 - DNA, 25 bp, Mus musculus
gttacccgggacacatcggagcatc

SEQ ID NO: 418907 - DNA, 25 bp, Mus musculus
tcctgtcccgttgtatctaagtccc

SEQ ID NO: 418908 - DNA, 25 bp, Mus musculus
agagctctctgcacgtggcccgctg

SEQ ID NO: 418909 - DNA, 25 bp, Mus musculus
cccaaggcctcaggaggcggctgca

SEQ ID NO: 418910 - DNA, 25 bp, Mus musculus
ggcttcatgcggtacgtgaggattt

SEQ ID NO: 418911 - DNA, 25 bp, Mus musculus
gatcaccacggacacaggcttcatg

SEQ ID NO: 418912 - DNA, 25 bp, Mus musculus
tctaagaaacacttggtggtgccgg

SEQ ID NO: 418913 - DNA, 25 bp, Mus musculus
ttgggccgcgactctaagaaacact

SEQ ID NO: 418914 - DNA, 25 bp, Mus musculus
acctctcagtgagagcttgggccgc

SEQ ID NO: 418915 - DNA, 25 bp, Mus musculus
cctaaagctcgcaaacctctcagtg

SEQ ID NO: 418916 - DNA, 25 bp, Mus musculus
ttggagatgaggctccctaaagctc

SEQ ID NO: 418917 - DNA, 25 bp, Mus musculus
tttgcgagcctcacgcttctgactc

SEQ ID NO: 418918 - DNA, 25 bp, Mus musculus
agtttgccacggagtccctcattca

SEQ ID NO: 418919 - DNA, 25 bp, Mus musculus
ccctgcctgggaagtctctttctca

SEQ ID NO: 418920 - DNA, 25 bp, Mus musculus
ggaacaccctgtttcctgaggagga

SEQ ID NO: 418921 - DNA, 25 bp, Mus musculus
agagtggtctctgtttctccttacc

SEQ ID NO: 418922 - DNA, 25 bp, Mus musculus
ctagtcctgctctggctctgggaca

SEQ ID NO: 418923 - DNA, 25 bp, Mus musculus
ggcacacaccctcactggctggaga

SEQ ID NO: 418924 - DNA, 25 bp, Mus musculus
tcaagagatcttcggggcgtcctcc

SEQ ID NO: 418925 - DNA, 25 bp, Mus musculus
ctgaggactcctaacgcggcacaca

SEQ ID NO: 418926 - DNA, 25 bp, Mus musculus
tggcgcggctcgtaatccattatgg

SEQ ID NO: 418927 - DNA, 25 bp, Mus musculus
gcctgtggtctatcggacctcgctc

SEQ ID NO: 418928 - DNA, 25 bp, Mus musculus
cgcgctcactggctaactggatggt

SEQ ID NO: 418929 - DNA, 25 bp, Mus musculus
tggcaccaccgatcgctgctaactg

SEQ ID NO: 418930 - DNA, 25 bp, Mus musculus
gggcgtcctcccagattgctttcgc

SEQ ID NO: 418931 - DNA, 25 bp, Mus musculus
gagaccgcctttcgctcgatttcaa

SEQ ID NO: 418932 - DNA, 25 bp, Mus musculus
ggtctgacccgccttgctcgcaaat

SEQ ID NO: 418933 - DNA, 25 bp, Mus musculus
acgccacactgggtttgacgtcacg

SEQ ID NO: 418934 - DNA, 25 bp, Mus musculus
actgacagtgggtaattgggaaaga

SEQ ID NO: 418935 - DNA, 25 bp, Mus musculus
tcggctccgagacccaccgggaaga

SEQ ID NO: 418936 - DNA, 25 bp, Mus musculus
cacactgggtttgacgtcacgggcc

SEQ ID NO: 418937 - DNA, 25 bp, Mus musculus
gacccgccttgctcgcaaatgcagg

SEQ ID NO: 418938 - DNA, 25 bp, Mus musculus
tcgccgacgccacactgggtttgac

SEQ ID NO: 418939 - DNA, 25 bp, Mus musculus
ttgctcttttgatggcccgcgccgg

SEQ ID NO: 418940 - DNA, 25 bp, Mus musculus
acgttgctcttttgatggcccgcgc

SEQ ID NO: 418941 - DNA, 25 bp, Mus musculus
aggacgttgctcttttgatggcccg

SEQ ID NO: 418942 - DNA, 25 bp, Mus musculus
gtaattgggaaagaggacgttgctc

SEQ ID NO: 418943 - DNA, 25 bp, Mus musculus
cctgttcccggactgacagtgggta

SEQ ID NO: 418944 - DNA, 25 bp, Mus musculus
tcccggactgacagtgggtaattgg

SEQ ID NO: 418945 - DNA, 25 bp, Mus musculus
cccagagtcagaaacacagagcagg

SEQ ID NO: 418946 - DNA, 25 bp, Mus musculus
ggggctacgccagcgcagctacgca

SEQ ID NO: 418947 - DNA, 25 bp, Mus musculus
gtattcggtattcctgtgggttcca

SEQ ID NO: 418948 - DNA, 25 bp, Mus musculus
ccgcgtccggtattcggtattcctg

SEQ ID NO: 418949 - DNA, 25 bp, Mus musculus
tgggttccagccctgactgttcaca

SEQ ID NO: 418950 - DNA, 25 bp, Mus musculus
cctgactgttcacattcctcagata

SEQ ID NO: 418951 - DNA, 25 bp, Mus musculus
tcctcagatacccactttaggttta

SEQ ID NO: 418952 - DNA, 25 bp, Mus musculus
tttaggtttaatcacagtcgctccc

SEQ ID NO: 418953 - DNA, 25 bp, Mus musculus
gagaggaatttgcatttccaccgac

SEQ ID NO: 418954 - DNA, 25 bp, Mus musculus
ctggaaggtaaatcctggcctgggc

SEQ ID NO: 418955 - DNA, 25 bp, Mus musculus
gcgtggagccttcccttggcctgga

SEQ ID NO: 418956 - DNA, 25 bp, Mus musculus
ccacgggaccatgttggagatctgt

SEQ ID NO: 418957 - DNA, 25 bp, Mus musculus
gggctgcaaatccaagaaggggctc

SEQ ID NO: 418958 - DNA, 25 bp, Mus musculus
ccagctgctacctggaaggtaaatc

SEQ ID NO: 418959 - DNA, 25 bp, Mus musculus
cctggtaacttgagaggaatttgca

SEQ ID NO: 418960 - DNA, 25 bp, Mus musculus
ttgttctccgagtggtcgctgtccc

SEQ ID NO: 418961 - DNA, 25 bp, Mus musculus
gaggcgtgtgcaccacgcaggtact

SEQ ID NO: 418962 - DNA, 25 bp, Mus musculus
tactggccattgaggttggatgtgt

SEQ ID NO: 418963 - DNA, 25 bp, Mus musculus
ttggatgtgtgacagttgcggtacc

SEQ ID NO: 418964 - DNA, 25 bp, Mus musculus
tgacagttgcggtaccaccaggctc

SEQ ID NO: 418965 - DNA, 25 bp, Mus musculus
accaccaggctcctcggtagaaggc

SEQ ID NO: 418966 - DNA, 25 bp, Mus musculus
cggcacagttgttctccgagtggtc

SEQ ID NO: 418967 - DNA, 25 bp, Mus musculus
actcgacgccgtctgcgtaggaggc

SEQ ID NO: 418968 - DNA, 25 bp, Mus musculus
ctcctcggtagaaggcggcacagtt

SEQ ID NO: 418969 - DNA, 25 bp, Mus musculus
gaatactgccatcccgtccaagagg

SEQ ID NO: 418970 - DNA, 25 bp, Mus musculus
ggccggatcttcatctccgagaact

SEQ ID NO: 418971 - DNA, 25 bp, Mus musculus
tccgagaacttgagtgaatactgcc

SEQ ID NO: 418972 - DNA, 25 bp, Mus musculus
gcaccacgcaggtactggccattga

SEQ ID NO: 418973 - DNA, 25 bp, Mus musculus
gtccaagaggaccactcgacgccgt

SEQ ID NO: 418974 - DNA, 25 bp, Mus musculus
acaaagtccttaatctgcgcggtta

SEQ ID NO: 418975 - DNA, 25 bp, Mus musculus
ctcggaccctcagggccttttattg

SEQ ID NO: 418976 - DNA, 25 bp, Mus musculus
ggctctaagagtgactcccgctcta

SEQ ID NO: 418977 - DNA, 25 bp, Mus musculus
cccgagcagccttcggaggtaattg

SEQ ID NO: 418978 - DNA, 25 bp, Mus musculus
tcagtctccgcgtcttcgtctcgga

SEQ ID NO: 418979 - DNA, 25 bp, Mus musculus
aaagcgtttaatccgcccgagcagc

SEQ ID NO: 418980 - DNA, 25 bp, Mus musculus
gcctggagctatcccaaccgcggga

SEQ ID NO: 418981 - DNA, 25 bp, Mus musculus
taatctccagccctgtggcctggtg

SEQ ID NO: 418982 - DNA, 25 bp, Mus musculus
taggcagagaccgtgtgaccctttc

SEQ ID NO: 418983 - DNA, 25 bp, Mus musculus
tctcgggtgggactcgtctaagtcc

SEQ ID NO: 418984 - DNA, 25 bp, Mus musculus
cgcgcaaacttcctctcgggtggga

SEQ ID NO: 418985 - DNA, 25 bp, Mus musculus
gacagccacgggctcctcgaggaac

SEQ ID NO: 418986 - DNA, 25 bp, Mus musculus
aacgagctgctgttgtgactccgac

SEQ ID NO: 418987 - DNA, 25 bp, Mus musculus
ggactattcagcagcagcgagcgtg

SEQ ID NO: 418988 - DNA, 25 bp, Mus musculus
agggtcctgtccctcctggcaacgg

SEQ ID NO: 418989 - DNA, 25 bp, Mus musculus
ctcagatgccgtcgggttccgcctg

SEQ ID NO: 418990 - DNA, 25 bp, Mus musculus
cccggaggacttctgtccacacgtg

SEQ ID NO: 418991 - DNA, 25 bp, Mus musculus
ggctaagcgcagaccgcagcgtaga

SEQ ID NO: 418992 - DNA, 25 bp, Mus musculus
catggctgtatccagggtcctgtcc

SEQ ID NO: 418993 - DNA, 25 bp, Mus musculus
gttccgcctgcaggggaggactcca

SEQ ID NO: 418994 - DNA, 25 bp, Mus musculus
gctacagtgccagcgctgcgacgat

SEQ ID NO: 418995 - DNA, 25 bp, Mus musculus
ccctcctggcaacggtggcatcgat

SEQ ID NO: 418996 - DNA, 25 bp, Mus musculus
catcgatggcgctggtgattcagga

SEQ ID NO: 418997 - DNA, 25 bp, Mus musculus
tgattcaggagacacacttcgcggc

SEQ ID NO: 418998 - DNA, 25 bp, Mus musculus
acatgggctcttgctacgacggtgt

SEQ ID NO: 418999 - DNA, 25 bp, Mus musculus
cacagcgctgtctgcctgagttcga

SEQ ID NO: 419000 - DNA, 25 bp, Mus musculus
ctgtctgcctgagttcgagaacgcg

SEQ ID NO: 419001 - DNA, 25 bp, Mus musculus
accgcagcgtagagtggatcccgga

SEQ ID NO: 419002 - DNA, 25 bp, Mus musculus
gacggtctgattcactcctaccagc

SEQ ID NO: 419003 - DNA, 25 bp, Mus musculus
tccctgccgggctgagcagtactga

SEQ ID NO: 419004 - DNA, 25 bp, Mus musculus
gctgagcagtactgacgcgcacctc

SEQ ID NO: 419005 - DNA, 25 bp, Mus musculus
gagcagtactgacgcgcacctcggc

SEQ ID NO: 419006 - DNA, 25 bp, Mus musculus
tgctcttgcgtctccgcgacactgg

SEQ ID NO: 419007 - DNA, 25 bp, Mus musculus
cgtctccgcgacactggagggccga

SEQ ID NO: 419008 - DNA, 25 bp, Mus musculus
tcactgcagcagtgtctgtgcgagc

SEQ ID NO: 419009 - DNA, 25 bp, Mus musculus
actgcagcagtgtctgtgcgagcga

SEQ ID NO: 419010 - DNA, 25 bp, Mus musculus
agtgagcgagcgactgactactctt

SEQ ID NO: 419011 - DNA, 25 bp, Mus musculus
gagcgagcgactgactactcttccc

SEQ ID NO: 419012 - DNA, 25 bp, Mus musculus
cctgccgcagacttctttaccaata

SEQ ID NO: 419013 - DNA, 25 bp, Mus musculus
ccaatactgacggtctgattcactc

SEQ ID NO: 419014 - DNA, 25 bp, Mus musculus
tcactcctaccagccgccgcgatgg

SEQ ID NO: 419015 - DNA, 25 bp, Mus musculus
cttctttaccaatactgacggtctg

SEQ ID NO: 419016 - DNA, 25 bp, Mus musculus
gctcctaagctacgactacctgacg

SEQ ID NO: 419017 - DNA, 25 bp, Mus musculus
caaaatcagcgtgagaagcgggagc

SEQ ID NO: 419018 - DNA, 25 bp, Mus musculus
acgactacctgacggatgaggagga

SEQ ID NO: 419019 - DNA, 25 bp, Mus musculus
ccgagagcagcaccagcgaggacaa

SEQ ID NO: 419020 - DNA, 25 bp, Mus musculus
ccagcgaggacaactcaccagagca

SEQ ID NO: 419021 - DNA, 25 bp, Mus musculus
acctgcctctcgtcaccgatgaaga

SEQ ID NO: 419022 - DNA, 25 bp, Mus musculus
tcgtcaccgatgaagacagttggta

SEQ ID NO: 419023 - DNA, 25 bp, Mus musculus
agttggtacaacaagtggcacaaga

SEQ ID NO: 419024 - DNA, 25 bp, Mus musculus
tggcacaagatggaacagaagtttc

SEQ ID NO: 419025 - DNA, 25 bp, Mus musculus
acagaagtttcgcattgtctacgca

SEQ ID NO: 419026 - DNA, 25 bp, Mus musculus
tcgcattgtctacgcacagaaggtg

SEQ ID NO: 419027 - DNA, 25 bp, Mus musculus
ttgtctacgcacagaaggtgcgcgg

SEQ ID NO: 419028 - DNA, 25 bp, Mus musculus
aggcacagtgccgagagcagcacca

SEQ ID NO: 419029 - DNA, 25 bp, Mus musculus
aggccgcggcacaaaatcagcgtga

SEQ ID NO: 419030 - DNA, 25 bp, Mus musculus
tgtcggtcgcactcagcaacaggtt

SEQ ID NO: 419031 - DNA, 25 bp, Mus musculus
gaaggcgttcggtttgctcaaagcc

SEQ ID NO: 419032 - DNA, 25 bp, Mus musculus
gccgactctttgtctcccgcaggag

SEQ ID NO: 419033 - DNA, 25 bp, Mus musculus
ggtttgctcaaagcccggcaggaga

SEQ ID NO: 419034 - DNA, 25 bp, Mus musculus
tcgccacctgtgtgcgctgtgcggc

SEQ ID NO: 419035 - DNA, 25 bp, Mus musculus
gacgtccctgggtcgccacctgtgt

SEQ ID NO: 419036 - DNA, 25 bp, Mus musculus
agcaacaggttccaaggtaggcgcc

SEQ ID NO: 419037 - DNA, 25 bp, Mus musculus
tcgggctcataccatgtcggtcgca

SEQ ID NO: 419038 - DNA, 25 bp, Mus musculus
gccttgtccggagtcgggctcatac

SEQ ID NO: 419039 - DNA, 25 bp, Mus musculus
cagacgacttttcctccctgttgtc

SEQ ID NO: 419040 - DNA, 25 bp, Mus musculus
ggtctggaccagacgacttttcctc

SEQ ID NO: 419041 - DNA, 25 bp, Mus musculus
cgggctaagcgtccggctaaacagc

SEQ ID NO: 419042 - DNA, 25 bp, Mus musculus
ctcgaggagatcaatcgggtaagcc

SEQ ID NO: 419043 - DNA, 25 bp, Mus musculus
cacacgctgccgaaggtctggacca

SEQ ID NO: 419044 - DNA, 25 bp, Mus musculus
gcacactaaaaaccggcctgggtga

SEQ ID NO: 419045 - DNA, 25 bp, Mus musculus
tcctgcagttcgcagggtcgcgatc

SEQ ID NO: 419046 - DNA, 25 bp, Mus musculus
gtagtcctggagttgccttggagcc

SEQ ID NO: 419047 - DNA, 25 bp, Mus musculus
atccctgagcgggagatgaaggtta

SEQ ID NO: 419048 - DNA, 25 bp, Mus musculus
gagacgagatggatgccatgatccc

SEQ ID NO: 419049 - DNA, 25 bp, Mus musculus
tgaacaccctgaaggcggcacgatg

SEQ ID NO: 419050 - DNA, 25 bp, Mus musculus
agcgccagcagcagctacttgaaca

SEQ ID NO: 419051 - DNA, 25 bp, Mus musculus
atcgagagtctcaggaaggccgagc

SEQ ID NO: 419052 - DNA, 25 bp, Mus musculus
cgagcgtgcctctctctaaggaaga

SEQ ID NO: 419053 - DNA, 25 bp, Mus musculus
attaaatagcgaggctgcgcacgca

SEQ ID NO: 419054 - DNA, 25 bp, Mus musculus
tgcgcacgcagcatccaaaggaagg

SEQ ID NO: 419055 - DNA, 25 bp, Mus musculus
tcgactgcctccgagcacactaaaa

SEQ ID NO: 419056 - DNA, 25 bp, Mus musculus
tgagcggcctgagctgtgtttgaaa

SEQ ID NO: 419057 - DNA, 25 bp, Mus musculus
ccaatggggccttgtggattggcaa

SEQ ID NO: 419058 - DNA, 25 bp, Mus musculus
caccgcagtgggtcactaggacctc

SEQ ID NO: 419059 - DNA, 25 bp, Mus musculus
tggacaccaagaaggcgtgttgccc

SEQ ID NO: 419060 - DNA, 25 bp, Mus musculus
aggccggtcttttaaggcattctgc

SEQ ID NO: 419061 - DNA, 25 bp, Mus musculus
gctcttatctactagggtccgggga

SEQ ID NO: 419062 - DNA, 25 bp, Mus musculus
cgttcctctgccactgtcgctgtag

SEQ ID NO: 419063 - DNA, 25 bp, Mus musculus
caagcttgagccttagctgagccca

SEQ ID NO: 419064 - DNA, 25 bp, Mus musculus
ctccgccgaggaactttggcagtca

SEQ ID NO: 419065 - DNA, 25 bp, Mus musculus
atcattatgagcgtgctgtcaccgc

SEQ ID NO: 419066 - DNA, 25 bp, Mus musculus
cccgagcgcctccttattttatgat

SEQ ID NO: 419067 - DNA, 25 bp, Mus musculus
ggtcgttcagactgccaccgcagtg

SEQ ID NO: 419068 - DNA, 25 bp, Mus musculus
gcgaataatcgcctcccgtgacatc

SEQ ID NO: 419069 - DNA, 25 bp, Mus musculus
ggcggcaaagttgagccgaacttta

SEQ ID NO: 419070 - DNA, 25 bp, Mus musculus
ggctccgggactgcactcggatatc

SEQ ID NO: 419071 - DNA, 25 bp, Mus musculus
tctccgctgacaccggtttagctcg

SEQ ID NO: 419072 - DNA, 25 bp, Mus musculus
tgacgccaccctacgtgtgcggatc

SEQ ID NO: 419073 - DNA, 25 bp, Mus musculus
gtgcccaacgcgctgagtccgtaag

SEQ ID NO: 419074 - DNA, 25 bp, Mus musculus
accgggaaagtgatccctggcgcgc

SEQ ID NO: 419075 - DNA, 25 bp, Mus musculus
gcagccttagaaatgtgaaccggga

SEQ ID NO: 419076 - DNA, 25 bp, Mus musculus
taacccagcagcagccttagaaatg

SEQ ID NO: 419077 - DNA, 25 bp, Mus musculus
agcgaaggatcaggtttcccgacca

SEQ ID NO: 419078 - DNA, 25 bp, Mus musculus
gagagttctccaaggtgctaaaata

SEQ ID NO: 419079 - DNA, 25 bp, Mus musculus
ccagcccagggtgagcggtgcccat

SEQ ID NO: 419080 - DNA, 25 bp, Mus musculus
atgcctctcagtgtgcacggtctcc

SEQ ID NO: 419081 - DNA, 25 bp, Mus musculus
atcggcggctaagggacccactctg

SEQ ID NO: 419082 - DNA, 25 bp, Mus musculus
atccggtgcggcactgagagttctc

SEQ ID NO: 419083 - DNA, 25 bp, Mus musculus
gctttctggcagttgatgcctctca

SEQ ID NO: 419084 - DNA, 25 bp, Mus musculus
ctgagtccgtaaggctagagctttc

SEQ ID NO: 419085 - DNA, 25 bp, Mus musculus
gtgtgcccgcattcgtgtgcccaac

SEQ ID NO: 419086 - DNA, 25 bp, Mus musculus
agccaataacaaccgggcgctgcca

SEQ ID NO: 419087 - DNA, 25 bp, Mus musculus
cgcacagcagccaataacaaccggg

SEQ ID NO: 419088 - DNA, 25 bp, Mus musculus
cacaatctgccggacgtcgcagtac

SEQ ID NO: 419089 - DNA, 25 bp, Mus musculus
ggacgtcgcagtacggatgacctca

SEQ ID NO: 419090 - DNA, 25 bp, Mus musculus
gatgacctcacagcgcgtcgcggaa

SEQ ID NO: 419091 - DNA, 25 bp, Mus musculus
cgtcgcggaatctcagccaatcgga

SEQ ID NO: 419092 - DNA, 25 bp, Mus musculus
atcggagcaaatttctgggagagag

SEQ ID NO: 419093 - DNA, 25 bp, Mus musculus
ggagagaggcagaaacttcacccaa

SEQ ID NO: 419094 - DNA, 25 bp, Mus musculus
ggcagaaacttcacccaatcgctta

SEQ ID NO: 419095 - DNA, 25 bp, Mus musculus
gaccatagctcgtccaatcacaatg

SEQ ID NO: 419096 - DNA, 25 bp, Mus musculus
caatcacaatgcgagacagtaaacc

SEQ ID NO: 419097 - DNA, 25 bp, Mus musculus
cgcgataacacggatctgcgcatgc

SEQ ID NO: 419098 - DNA, 25 bp, Mus musculus
tcagccaatcggagcaaatttctgg

SEQ ID NO: 419099 - DNA, 25 bp, Mus musculus
cgaggaaacccgctgcggccggatc

SEQ ID NO: 419100 - DNA, 25 bp, Mus musculus
tcctctccatctaggtccctctctt

SEQ ID NO: 419101 - DNA, 25 bp, Mus musculus
gccgccgcccgaccgccatcgcccg

SEQ ID NO: 419102 - DNA, 25 bp, Mus musculus
aggctccagcgagcgccgaggagcg

SEQ ID NO: 419103 - DNA, 25 bp, Mus musculus
gccattgttgtgtcttcgcggccag

SEQ ID NO: 419104 - DNA, 25 bp, Mus musculus
tcgccattgttgtgtcttcgcggcc

SEQ ID NO: 419105 - DNA, 25 bp, Mus musculus
cgtcgcgcgcggacgcagaccaggt

SEQ ID NO: 419106 - DNA, 25 bp, Mus musculus
caaggctcggggtcgggatcgagcc

SEQ ID NO: 419107 - DNA, 25 bp, Mus musculus
attgttgtgtcttcgcggccagggc

SEQ ID NO: 419108 - DNA, 25 bp, Mus musculus
tccagccgagcctcctctccatcta

SEQ ID NO: 419109 - DNA, 25 bp, Mus musculus
ctctgcaccgcggcccagctcgctc

SEQ ID NO: 419110 - DNA, 25 bp, Mus musculus
atctaggtccctctcttccgcagcc

SEQ ID NO: 419111 - DNA, 25 bp, Mus musculus
gtggtgttttcacggcacccggagc

SEQ ID NO: 419112 - DNA, 25 bp, Mus musculus
agccacagcgccgaggctccagcga

SEQ ID NO: 419113 - DNA, 25 bp, Mus musculus
agaggccggggttgcgctttgtctc

SEQ ID NO: 419114 - DNA, 25 bp, Mus musculus
aaccaccgagatgcgtttaattcga

SEQ ID NO: 419115 - DNA, 25 bp, Mus musculus
gtatccgttttaacagtggccattg

SEQ ID NO: 419116 - DNA, 25 bp, Mus musculus
cggaggtctacatcgcctcggacta

SEQ ID NO: 419117 - DNA, 25 bp, Mus musculus
gctcgatcaatcttccttccatgcg

SEQ ID NO: 419118 - DNA, 25 bp, Mus musculus
gagcagcaccgaaggccagaaatta

SEQ ID NO: 419119 - DNA, 25 bp, Mus musculus
tctgatggcgcggttaccgactgaa

SEQ ID NO: 419120 - DNA, 25 bp, Mus musculus
tatagttactaatcctgggcagggg

SEQ ID NO: 419121 - DNA, 25 bp, Mus musculus
tacttagggactttgcacgccgagc

SEQ ID NO: 419122 - DNA, 25 bp, Mus musculus
tgcctagggctgtcatttgagcgtg

SEQ ID NO: 419123 - DNA, 25 bp, Mus musculus
agccctccagagagtgacctgcaaa

SEQ ID NO: 419124 - DNA, 25 bp, Mus musculus
gccgagatgcgaaaagatgctactt

SEQ ID NO: 419125 - DNA, 25 bp, Mus musculus
tagaaagcgtgcctcggaatgccta

SEQ ID NO: 419126 - DNA, 25 bp, Mus musculus
tttaattcgattccgtgcacgctgc

SEQ ID NO: 419127 - DNA, 25 bp, Mus musculus
cacgccgagcgcaagcggaatagta

SEQ ID NO: 419128 - DNA, 25 bp, Mus musculus
cacaagtggtctttgtggcacgggt

SEQ ID NO: 419129 - DNA, 25 bp, Mus musculus
tgccctgaaggactcatggcgctcc

SEQ ID NO: 419130 - DNA, 25 bp, Mus musculus
tctgagcatagccacgagggcatgc

SEQ ID NO: 419131 - DNA, 25 bp, Mus musculus
aagagctgcccaagaggcgccggca

SEQ ID NO: 419132 - DNA, 25 bp, Mus musculus
tcacagcgagggctctgagtatgaa

SEQ ID NO: 419133 - DNA, 25 bp, Mus musculus
cgtcgcattgccagcgagactcaca

SEQ ID NO: 419134 - DNA, 25 bp, Mus musculus
cagagccaagccaaggcgtcgcatt

SEQ ID NO: 419135 - DNA, 25 bp, Mus musculus
ttcagagagttcaccttccggggcg

SEQ ID NO: 419136 - DNA, 25 bp, Mus musculus
gtctcgtggcatgtacagtagtggc

SEQ ID NO: 419137 - DNA, 25 bp, Mus musculus
agaacttacaccgaggaccagggcg

SEQ ID NO: 419138 - DNA, 25 bp, Mus musculus
ctgcaggcagcagcacaagtggtct

SEQ ID NO: 419139 - DNA, 25 bp, Mus musculus
ccagggcggtatagacacccgcagc

SEQ ID NO: 419140 - DNA, 25 bp, Mus musculus
tacagtagtggccagcgcagtaacc

SEQ ID NO: 419141 - DNA, 25 bp, Mus musculus
tcatggcgctccaacagaacttaca

SEQ ID NO: 419142 - DNA, 25 bp, Mus musculus
ctgcagagtaatcgagcggcctcgc

SEQ ID NO: 419143 - DNA, 25 bp, Mus musculus
tgcccgtaagctaacgcgctgctta

SEQ ID NO: 419144 - DNA, 25 bp, Mus musculus
gcgctgcttaacgaaaccgctaaag

SEQ ID NO: 419145 - DNA, 25 bp, Mus musculus
atcctggctgagcaagtcgtttcca

SEQ ID NO: 419146 - DNA, 25 bp, Mus musculus
agtgccagatttgagagccctcctg

SEQ ID NO: 419147 - DNA, 25 bp, Mus musculus
aacgctcgtaggttttggagtgcca

SEQ ID NO: 419148 - DNA, 25 bp, Mus musculus
ctccacatggggagccactctacgg

SEQ ID NO: 419149 - DNA, 25 bp, Mus musculus
aactagttgagcgtcgatccgtggc

SEQ ID NO: 419150 - DNA, 25 bp, Mus musculus
tcggccgcgtagacacaactagttg

SEQ ID NO: 419151 - DNA, 25 bp, Mus musculus
cccaactttgatggccggtgagcac

SEQ ID NO: 419152 - DNA, 25 bp, Mus musculus
aggacagtcagtatgcccaactttg

SEQ ID NO: 419153 - DNA, 25 bp, Mus musculus
gctccgagcacgtgaacagcttgtg

SEQ ID NO: 419154 - DNA, 25 bp, Mus musculus
ccgctaaagtagacgcgaggcccga

SEQ ID NO: 419155 - DNA, 25 bp, Mus musculus
tctacgggactcgaagaaacgctcg

SEQ ID NO: 419156 - DNA, 25 bp, Mus musculus
ggcgctcaccttgccactagcggtg

SEQ ID NO: 419157 - DNA, 25 bp, Mus musculus
cgcttccggggacatgagcgcatgc

SEQ ID NO: 419158 - DNA, 25 bp, Mus musculus
ctgtgcgcatcgcttccggggacat

SEQ ID NO: 419159 - DNA, 25 bp, Mus musculus
tgacggatgctgtgcgcatcgcttc

SEQ ID NO: 419160 - DNA, 25 bp, Mus musculus
acgtagtgacggatgctgtgcgcat

SEQ ID NO: 419161 - DNA, 25 bp, Mus musculus
atgcgcgcatgaggcgcggcactca

SEQ ID NO: 419162 - DNA, 25 bp, Mus musculus
ctcccgcctggacgtagtgacggat

SEQ ID NO: 419163 - DNA, 25 bp, Mus musculus
acggacatacattcaccgactctgc

SEQ ID NO: 419164 - DNA, 25 bp, Mus musculus
ccggagcgacggacatacattcacc

SEQ ID NO: 419165 - DNA, 25 bp, Mus musculus
agccatatccggagcgacggacata

SEQ ID NO: 419166 - DNA, 25 bp, Mus musculus
cgccgaagccatatccggagcgacg

SEQ ID NO: 419167 - DNA, 25 bp, Mus musculus
ctcacgccgatgaggaacggccgcg

SEQ ID NO: 419168 - DNA, 25 bp, Mus musculus
cctggcaatccctccgcgaggccca

SEQ ID NO: 419169 - DNA, 25 bp, Mus musculus
acatgagcgcatgcgcgcatgaggc

SEQ ID NO: 419170 - DNA, 25 bp, Mus musculus
cacgccctgcaggagtgttgtccgg

SEQ ID NO: 419171 - DNA, 25 bp, Mus musculus
cgtccttttacgaggcagctgccgc

SEQ ID NO: 419172 - DNA, 25 bp, Mus musculus
tgctgctccgcgtccttttacgagg

SEQ ID NO: 419173 - DNA, 25 bp, Mus musculus
ctgaccgcttgggtattgctgctcc

SEQ ID NO: 419174 - DNA, 25 bp, Mus musculus
tggaactttcctgaccgcttgggta

SEQ ID NO: 419175 - DNA, 25 bp, Mus musculus
tgttgtccggggagtccagacctgc

SEQ ID NO: 419176 - DNA, 25 bp, Mus musculus
ctgcccacgccctgcaggagtgttg

SEQ ID NO: 419177 - DNA, 25 bp, Mus musculus
acccggctccagtagctctcctctg

SEQ ID NO: 419178 - DNA, 25 bp, Mus musculus
gactggacggcgcttgcacccggct

SEQ ID NO: 419179 - DNA, 25 bp, Mus musculus
tcaaggtcgccgactggacggcgct

SEQ ID NO: 419180 - DNA, 25 bp, Mus musculus
ccgcgcgcacggagtgcaacgagct

SEQ ID NO: 419181 - DNA, 25 bp, Mus musculus
tgcccaggcccagtaaaggggttca

SEQ ID NO: 419182 - DNA, 25 bp, Mus musculus
actccatgcccaggcccagtaaagg

SEQ ID NO: 419183 - DNA, 25 bp, Mus musculus
cagacctgcgatcgctggaactttc

SEQ ID NO: 419184 - DNA, 25 bp, Mus musculus
ctgtctaagaccagaggatcaagga

SEQ ID NO: 419185 - DNA, 25 bp, Mus musculus
tctgtgtccttccactagaaaatga

SEQ ID NO: 419186 - DNA, 25 bp, Mus musculus
gttattctttcttagtgattcccaa

SEQ ID NO: 419187 - DNA, 25 bp, Mus musculus
agaaaatgaatactgtctaagacca

SEQ ID NO: 419188 - DNA, 25 bp, Mus musculus
gtgtccttccactagaaaatgaata

SEQ ID NO: 419189 - DNA, 25 bp, Mus musculus
ttcaaccttggtctgtgtccttcca

SEQ ID NO: 419190 - DNA, 25 bp, Mus musculus
cccagagattttcaaccttggtctg

SEQ ID NO: 419191 - DNA, 25 bp, Mus musculus
gctcacatttatttctccccagaga

SEQ ID NO: 419192 - DNA, 25 bp, Mus musculus
cctgacaaaaatgggagctcacatt

SEQ ID NO: 419193 - DNA, 25 bp, Mus musculus
gagggacctcctgacaaaaatggga

SEQ ID NO: 419194 - DNA, 25 bp, Mus musculus
agggagggacctcctgacaaaaatg

SEQ ID NO: 419195 - DNA, 25 bp, Mus musculus
caagtgtccttatcccttactaggg

SEQ ID NO: 419196 - DNA, 25 bp, Mus musculus
ttcttagtgattcccaagtgtcctt

SEQ ID NO: 419197 - DNA, 25 bp, Mus musculus
tccactagaaaatgaatactgcttc

SEQ ID NO: 419198 - DNA, 25 bp, Mus musculus
ggggctgatatactcaccggtgatc

SEQ ID NO: 419199 - DNA, 25 bp, Mus musculus
tccaacggcaggacccatgaccaga

SEQ ID NO: 419200 - DNA, 25 bp, Mus musculus
tggctgcggccaagaaaaaggtaaa

SEQ ID NO: 419201 - DNA, 25 bp, Mus musculus
ccgggatgtcggaagaaaccaggca

SEQ ID NO: 419202 - DNA, 25 bp, Mus musculus
ccgtagcttccggaagcagtttcgc

SEQ ID NO: 419203 - DNA, 25 bp, Mus musculus
ctctggcccttgtagagaagccgta

SEQ ID NO: 419204 - DNA, 25 bp, Mus musculus
tcacgctgggtttccgagcgtccaa

SEQ ID NO: 419205 - DNA, 25 bp, Mus musculus
tcatcgttctcatcagccaatgggc

SEQ ID NO: 419206 - DNA, 25 bp, Mus musculus
cctgcttcccataggccgctgtgag

SEQ ID NO: 419207 - DNA, 25 bp, Mus musculus
gtcaggctgcgcacgcaccaagtta

SEQ ID NO: 419208 - DNA, 25 bp, Mus musculus
gctgcttcagggaactagaaaccga

SEQ ID NO: 419209 - DNA, 25 bp, Mus musculus
aaagtcggctgaattctgactcacc

SEQ ID NO: 419210 - DNA, 25 bp, Mus musculus
atcggtagccgccatggtaaagtcg

SEQ ID NO: 419211 - DNA, 25 bp, Mus musculus
accagagtccgagtctttcccgaga

SEQ ID NO: 419212 - DNA, 25 bp, Mus musculus
ggccgcaggtcccttggccttgcat

SEQ ID NO: 419213 - DNA, 25 bp, Mus musculus
gtggtacatgcgcagcatctcgtcg

SEQ ID NO: 419214 - DNA, 25 bp, Mus musculus
cccaacgcctaagatggagagggtc

SEQ ID NO: 419215 - DNA, 25 bp, Mus musculus
ggccgaggatctatccgactctacc

SEQ ID NO: 419216 - DNA, 25 bp, Mus musculus
gacgtgggcgatctaccggcgacaa

SEQ ID NO: 419217 - DNA, 25 bp, Mus musculus
taccggcgacaagagcagaagaagc

SEQ ID NO: 419218 - DNA, 25 bp, Mus musculus
ccacagcggccttagcgtgggagcc

SEQ ID NO: 419219 - DNA, 25 bp, Mus musculus
agcgtgggagcctaagccggatccc

SEQ ID NO: 419220 - DNA, 25 bp, Mus musculus
tggtacctgcgtccggccggtacgc

SEQ ID NO: 419221 - DNA, 25 bp, Mus musculus
tctgcacctgcagccaggagtcgtc

SEQ ID NO: 419222 - DNA, 25 bp, Mus musculus
ggtcgtgttgatgtcgccgataata

SEQ ID NO: 419223 - DNA, 25 bp, Mus musculus
gccgataatactgagcgcctccttc

SEQ ID NO: 419224 - DNA, 25 bp, Mus musculus
tcgcttctgctgctaggccgaggat

SEQ ID NO: 419225 - DNA, 25 bp, Mus musculus
cgcctccttcagtgcgtggtacatg

SEQ ID NO: 419226 - DNA, 25 bp, Mus musculus
tcgctctacagacgatggggtgaac

SEQ ID NO: 419227 - DNA, 25 bp, Mus musculus
gggactccactgatatccgcgggct

SEQ ID NO: 419228 - DNA, 25 bp, Mus musculus
cgccatgggtgttgtcgttttcttc

SEQ ID NO: 419229 - DNA, 25 bp, Mus musculus
actatgcgcagacgcaacgcggggc

SEQ ID NO: 419230 - DNA, 25 bp, Mus musculus
gactggtcactatgcgcagacgcaa

SEQ ID NO: 419231 - DNA, 25 bp, Mus musculus
cggggattcgcggactggtcactat

SEQ ID NO: 419232 - DNA, 25 bp, Mus musculus
ctccactgatatccgcgggctggcg

SEQ ID NO: 419233 - DNA, 25 bp, Mus musculus
gatccgagcggagcgcttctccagg

SEQ ID NO: 419234 - DNA, 25 bp, Mus musculus
tgcagccgaatatcccgactgcgtg

SEQ ID NO: 419235 - DNA, 25 bp, Mus musculus
ggcttcgcggctgcagccgaatatc

SEQ ID NO: 419236 - DNA, 25 bp, Mus musculus
gaaattctccagcaccgagctcttg

SEQ ID NO: 419237 - DNA, 25 bp, Mus musculus
tgatgcgggtgtccgcgccgctcct

SEQ ID NO: 419238 - DNA, 25 bp, Mus musculus
gtcgttttcttcttctgcggctttc

SEQ ID NO: 419239 - DNA, 25 bp, Mus musculus
tcggtccgctagagcagcgcccaga

SEQ ID NO: 419240 - DNA, 25 bp, Mus musculus
agtgatctgtcctctgcggtcccta

SEQ ID NO: 419241 - DNA, 25 bp, Mus musculus
cctgactgcgcagtagtgatctgtc

SEQ ID NO: 419242 - DNA, 25 bp, Mus musculus
tcaggttagcgcagtcacctgactg

SEQ ID NO: 419243 - DNA, 25 bp, Mus musculus
gagtcccgagcctcaggttagcgca

SEQ ID NO: 419244 - DNA, 25 bp, Mus musculus
aggtcccagtggagcgagaactctc

SEQ ID NO: 419245 - DNA, 25 bp, Mus musculus
gccaacaactgcgaaagaggtccca

SEQ ID NO: 419246 - DNA, 25 bp, Mus musculus
tttccgaccgatgaatttactcctg

SEQ ID NO: 419247 - DNA, 25 bp, Mus musculus
tagtgctattaacgccaacaactgc

SEQ ID NO: 419248 - DNA, 25 bp, Mus musculus
ccaggatgagccactttagtgctat

SEQ ID NO: 419249 - DNA, 25 bp, Mus musculus
ttcaagcttcctaaacacgcagacc

SEQ ID NO: 419250 - DNA, 25 bp, Mus musculus
tcaaggatgattacgccattcaagc

SEQ ID NO: 419251 - DNA, 25 bp, Mus musculus
tagatacgcctatccttcaaggatg

SEQ ID NO: 419252 - DNA, 25 bp, Mus musculus
tttactcctgtcacttagatacgcc

SEQ ID NO: 419253 - DNA, 25 bp, Mus musculus
gagcggccagtcctctcagtctaca

SEQ ID NO: 419254 - DNA, 25 bp, Mus musculus
tggaccgcagggatagcggctactt

SEQ ID NO: 419255 - DNA, 25 bp, Mus musculus
gttaagtggcgttggctatatctgc

SEQ ID NO: 419256 - DNA, 25 bp, Mus musculus
ggcgcctcatagcacctgggagcca

SEQ ID NO: 419257 - DNA, 25 bp, Mus musculus
ccaccgcggctctagcgattgcaga

SEQ ID NO: 419258 - DNA, 25 bp, Mus musculus
gcgattgcagattggtcgcggtccc

SEQ ID NO: 419259 - DNA, 25 bp, Mus musculus
agccgctgggccttcggagtgtccc

SEQ ID NO: 419260 - DNA, 25 bp, Mus musculus
gtcagctcgtggctttcacggtttc

SEQ ID NO: 419261 - DNA, 25 bp, Mus musculus
agcggctacttgcagagagcctacg

SEQ ID NO: 419262 - DNA, 25 bp, Mus musculus
ttgcagagagcctacgggctttgtg

SEQ ID NO: 419263 - DNA, 25 bp, Mus musculus
ggcgaggccacaggattagttaagt

SEQ ID NO: 419264 - DNA, 25 bp, Mus musculus
cccttcccgatgctgggatctgggg

SEQ ID NO: 419265 - DNA, 25 bp, Mus musculus
ctgccagataaacagacggccgtgg

SEQ ID NO: 419266 - DNA, 25 bp, Mus musculus
tcagttgggatctgaccgactgtcg

SEQ ID NO: 419267 - DNA, 25 bp, Mus musculus
agcccgccttacgagtcagctcgtg

SEQ ID NO: 419268 - DNA, 25 bp, Mus musculus
gattccagaccctcggacagtactc

SEQ ID NO: 419269 - DNA, 25 bp, Mus musculus
attgctcgccatcgcctccgaggtg

SEQ ID NO: 419270 - DNA, 25 bp, Mus musculus
agtgagacatctccttagtccctcc

SEQ ID NO: 419271 - DNA, 25 bp, Mus musculus
cagtactcccggcaatgcaaaggtc

SEQ ID NO: 419272 - DNA, 25 bp, Mus musculus
tgcaaaggtcgcctcagcaacacca

SEQ ID NO: 419273 - DNA, 25 bp, Mus musculus
cagaggccacgcgaagatggaactt

SEQ ID NO: 419274 - DNA, 25 bp, Mus musculus
aagatggaacttggcgatcgtcgcg

SEQ ID NO: 419275 - DNA, 25 bp, Mus musculus
gcttgggcgctctatcgcgctcaca

SEQ ID NO: 419276 - DNA, 25 bp, Mus musculus
tatcgcgctcacaaacatggctccg

SEQ ID NO: 419277 - DNA, 25 bp, Mus musculus
gcagtggagaccctggcccgctagt

SEQ ID NO: 419278 - DNA, 25 bp, Mus musculus
ccgctagtgcttgggatgtgtttga

SEQ ID NO: 419279 - DNA, 25 bp, Mus musculus
tgtgtttgaggctccatcctgctgc

SEQ ID NO: 419280 - DNA, 25 bp, Mus musculus
ccagagccactcaggcagagtgaga

SEQ ID NO: 419281 - DNA, 25 bp, Mus musculus
tgtggggacaactccagagccactc

SEQ ID NO: 419282 - DNA, 25 bp, Mus musculus
cgagaccctcaacaacgacctagag

SEQ ID NO: 419283 - DNA, 25 bp, Mus musculus
atgagagagaccgaagcactggtcc

SEQ ID NO: 419284 - DNA, 25 bp, Mus musculus
gcagccgacccgagacaatgagaga

SEQ ID NO: 419285 - DNA, 25 bp, Mus musculus
gcactggtccaggagcagcatcggt

SEQ ID NO: 419286 - DNA, 25 bp, Mus musculus
ggcacctaagggatgactggagttc

SEQ ID NO: 419287 - DNA, 25 bp, Mus musculus
aggggcaaaggtgtcactcgtgacc

SEQ ID NO: 419288 - DNA, 25 bp, Mus musculus
cagagttcagagtaccgatggcagc

SEQ ID NO: 419289 - DNA, 25 bp, Mus musculus
gcctggcagatctgcgccaccgaga

SEQ ID NO: 419290 - DNA, 25 bp, Mus musculus
tcgtctcgggatcgactctagagcc

SEQ ID NO: 419291 - DNA, 25 bp, Mus musculus
tagagtaactctcgcacatcccgct

SEQ ID NO: 419292 - DNA, 25 bp, Mus musculus
ctcaaagcctcagcagcacggagcg

SEQ ID NO: 419293 - DNA, 25 bp, Mus musculus
gcgccagcctgagagccgccatttt

SEQ ID NO: 419294 - DNA, 25 bp, Mus musculus
agtacgagcagaaggccgagagata

SEQ ID NO: 419295 - DNA, 25 bp, Mus musculus
cccagctgctgcagatagcgctgca

SEQ ID NO: 419296 - DNA, 25 bp, Mus musculus
tcgggcgctccgttaagacaagtaa

SEQ ID NO: 419297 - DNA, 25 bp, Mus musculus
ttaaggaatcctagagccgccctgg

SEQ ID NO: 419298 - DNA, 25 bp, Mus musculus
ggcgtcatcgttaccctaggcaaca

SEQ ID NO: 419299 - DNA, 25 bp, Mus musculus
actctggtcctacttggcgtcatcg

SEQ ID NO: 419300 - DNA, 25 bp, Mus musculus
gcatgcgctctcagatccctcaagg

SEQ ID NO: 419301 - DNA, 25 bp, Mus musculus
gtaccctcagaagacagcgacgcca

SEQ ID NO: 419302 - DNA, 25 bp, Mus musculus
atgcacgatgtggaaacgcccgacc

SEQ ID NO: 419303 - DNA, 25 bp, Mus musculus
gaccaatgttctccctgccatcgta

SEQ ID NO: 419304 - DNA, 25 bp, Mus musculus
tcggaccttttctggggagtgaatg

SEQ ID NO: 419305 - DNA, 25 bp, Mus musculus
tgagacaatgcagccacccactgga

SEQ ID NO: 419306 - DNA, 25 bp, Mus musculus
tggttcgcatcatagcagcagagta

SEQ ID NO: 419307 - DNA, 25 bp, Mus musculus
ggccatttccgcgacacgtggtttc

SEQ ID NO: 419308 - DNA, 25 bp, Mus musculus
taaattcgcaaaggcctggggtgtc

SEQ ID NO: 419309 - DNA, 25 bp, Mus musculus
ggccattttggttttgcgcgctcgc

SEQ ID NO: 419310 - DNA, 25 bp, Mus musculus
ctacagaaagcagcccgagaagtcc

SEQ ID NO: 419311 - DNA, 25 bp, Mus musculus
ccggtatgtcggctccgggatcaat

SEQ ID NO: 419312 - DNA, 25 bp, Mus musculus
tgccgaccaatcataggccggtatg

SEQ ID NO: 419313 - DNA, 25 bp, Mus musculus
acactgctcaccatcgggcgcgagg

SEQ ID NO: 419314 - DNA, 25 bp, Mus musculus
gctccacaggcgtagctggtggtcc

SEQ ID NO: 419315 - DNA, 25 bp, Mus musculus
tcgagtgtctggaagaggctccaca

SEQ ID NO: 419316 - DNA, 25 bp, Mus musculus
caccgccaggtcgttgacacacagg

SEQ ID NO: 419317 - DNA, 25 bp, Mus musculus
gagtcaccgtgccagctcgaaggcg

SEQ ID NO: 419318 - DNA, 25 bp, Mus musculus
tggcgtcggtctctctcctcaagac

SEQ ID NO: 419319 - DNA, 25 bp, Mus musculus
agcgcggaagcacgccggctttcct

SEQ ID NO: 419320 - DNA, 25 bp, Mus musculus
gcgtccgtcgaaacctgacaggcta

SEQ ID NO: 419321 - DNA, 25 bp, Mus musculus
gctcagctctagcagcgtccgtcga

SEQ ID NO: 419322 - DNA, 25 bp, Mus musculus
ggcgcacgcagacttacccggagct

SEQ ID NO: 419323 - DNA, 25 bp, Mus musculus
ggaggccacgcagcggcacaacaca

SEQ ID NO: 419324 - DNA, 25 bp, Mus musculus
tccaagctaaaacggtgttaacaga

SEQ ID NO: 419325 - DNA, 25 bp, Mus musculus
actggttgcagaccgcgctggagcc

SEQ ID NO: 419326 - DNA, 25 bp, Mus musculus
cccaactggttgcagaccgcgctgg

SEQ ID NO: 419327 - DNA, 25 bp, Mus musculus
ggctttgacgtcactaccgtctccg

SEQ ID NO: 419328 - DNA, 25 bp, Mus musculus
gccgcggctttgacgtcactaccgt

SEQ ID NO: 419329 - DNA, 25 bp, Mus musculus
aaaaggccgcggctttgacgtcact

SEQ ID NO: 419330 - DNA, 25 bp, Mus musculus
cagaaactggaacacgcggtgtgag

SEQ ID NO: 419331 - DNA, 25 bp, Mus musculus
ctaagacttccaagctaaaacggtg

SEQ ID NO: 419332 - DNA, 25 bp, Mus musculus
ctcgcctctaagacttccaagctaa

SEQ ID NO: 419333 - DNA, 25 bp, Mus musculus
cgcaccagctcagtacccggcaccc

SEQ ID NO: 419334 - DNA, 25 bp, Mus musculus
gcgctgtttccgcaccagctcagta

SEQ ID NO: 419335 - DNA, 25 bp, Mus musculus
gtgggcttgcaaacagcgctgtttc

SEQ ID NO: 419336 - DNA, 25 bp, Mus musculus
ctgccttccccggtgggcttgcaaa

SEQ ID NO: 419337 - DNA, 25 bp, Mus musculus
gcggtgtgaggctgcacctttaaga

SEQ ID NO: 419338 - DNA, 25 bp, Mus musculus
caatcgcaggttggctgtgagcctc

SEQ ID NO: 419339 - DNA, 25 bp, Mus musculus
ccgccagccaatagaaattcgtgtt

SEQ ID NO: 419340 - DNA, 25 bp, Mus musculus
gggcttcggcattctccgagcagcg

SEQ ID NO: 419341 - DNA, 25 bp, Mus musculus
tgtgctccagcggtgctaaccgagg

SEQ ID NO: 419342 - DNA, 25 bp, Mus musculus
tgctaaccgaggcagaagccatccg

SEQ ID NO: 419343 - DNA, 25 bp, Mus musculus
agtcggcctgtccaatcgcaggttg

SEQ ID NO: 419344 - DNA, 25 bp, Mus musculus
acgccaccgccagccaatagaaatt

SEQ ID NO: 419345 - DNA, 25 bp, Mus musculus
tttacatgtcagtggagcccgggtt

SEQ ID NO: 419346 - DNA, 25 bp, Mus musculus
accgcgcttctcaaggaggcgggtc

SEQ ID NO: 419347 - DNA, 25 bp, Mus musculus
aattcgtgttcgtacagtcggcctg

SEQ ID NO: 419348 - DNA, 25 bp, Mus musculus
gccgcacctcgctgtttacatgtca

SEQ ID NO: 419349 - DNA, 25 bp, Mus musculus
gagagcagccggctcactggacctg

SEQ ID NO: 419350 - DNA, 25 bp, Mus musculus
ctcactggacctggggctccgaact

SEQ ID NO: 419351 - DNA, 25 bp, Mus musculus
tggggctccgaactcagatcctctc

SEQ ID NO: 419352 - DNA, 25 bp, Mus musculus
acgtccacagttcgggaggaaattg

SEQ ID NO: 419353 - DNA, 25 bp, Mus musculus
cgcgattggtcgttcgccatgcaga

SEQ ID NO: 419354 - DNA, 25 bp, Mus musculus
cacagtggtaacaagagcgtcgcga

SEQ ID NO: 419355 - DNA, 25 bp, Mus musculus
cctttcgaagattgggcacagtggt

SEQ ID NO: 419356 - DNA, 25 bp, Mus musculus
tcagagttctgagtatgctgcatcc

SEQ ID NO: 419357 - DNA, 25 bp, Mus musculus
tcgtgcaaccgtgacaaggcctttc

SEQ ID NO: 419358 - DNA, 25 bp, Mus musculus
ggacccgcaggccaaggtcatcgtc

SEQ ID NO: 419359 - DNA, 25 bp, Mus musculus
tcaggatgcagaggatcctacatcc

SEQ ID NO: 419360 - DNA, 25 bp, Mus musculus
ctcggtccgaccacgatcaggatgc

SEQ ID NO: 419361 - DNA, 25 bp, Mus musculus
gcaaccgcaacaagaaggcattttc

SEQ ID NO: 419362 - DNA, 25 bp, Mus musculus
ctcgcagattccgtgcaaagcgtgc

SEQ ID NO: 419363 - DNA, 25 bp, Mus musculus
ccagaaccgggattcagaggatgct

SEQ ID NO: 419364 - DNA, 25 bp, Mus musculus
gagaatcatttctccggcacctcca

SEQ ID NO: 419365 - DNA, 25 bp, Mus musculus
cgagacaccgccaaagccagagaag

SEQ ID NO: 419366 - DNA, 25 bp, Mus musculus
ccaacgctattttctgggcttagtg

SEQ ID NO: 419367 - DNA, 25 bp, Mus musculus
tgtcagcccggctcactacgcccgt

SEQ ID NO: 419368 - DNA, 25 bp, Mus musculus
ggatgctgcccgaccttcccaatgc

SEQ ID NO: 419369 - DNA, 25 bp, Mus musculus
ttcccaatgccctccatatcttgga

SEQ ID NO: 419370 - DNA, 25 bp, Mus musculus
tccatatcttggacgggccagacca

SEQ ID NO: 419371 - DNA, 25 bp, Mus musculus
gacgggccagaccaacgctattttc

SEQ ID NO: 419372 - DNA, 25 bp, Mus musculus
tctgggcttagtggatatgactacc

SEQ ID NO: 419373 - DNA, 25 bp, Mus musculus
tatgggtttcgcaaacggctggaac

SEQ ID NO: 419374 - DNA, 25 bp, Mus musculus
cgcaaacggctggaacatgtgtgga

SEQ ID NO: 419375 - DNA, 25 bp, Mus musculus
catgtgtggaagatggtacgctatc

SEQ ID NO: 419376 - DNA, 25 bp, Mus musculus
aagatggtacgctatccaggccaga

SEQ ID NO: 419377 - DNA, 25 bp, Mus musculus
tatccaggccagagcgtctccactg

SEQ ID NO: 419378 - DNA, 25 bp, Mus musculus
tatgactaccgtgtatgggtttcgc

SEQ ID NO: 419379 - DNA, 25 bp, Mus musculus
aggccagagcgtctccactgtcagc

SEQ ID NO: 419380 - DNA, 25 bp, Mus musculus
gcagcaccgcctcctacccggggcc

SEQ ID NO: 419381 - DNA, 25 bp, Mus musculus
cgccctcgacgtcgagacctcgccc

SEQ ID NO: 419382 - DNA, 25 bp, Mus musculus
cagcccggaggtctctgagacatcc

SEQ ID NO: 419383 - DNA, 25 bp, Mus musculus
aggtctctgagacatccacgcgccg

SEQ ID NO: 419384 - DNA, 25 bp, Mus musculus
ctgcgctgctctagcttcaggcttc

SEQ ID NO: 419385 - DNA, 25 bp, Mus musculus
cgctgctctagcttcaggcttcaga

SEQ ID NO: 419386 - DNA, 25 bp, Mus musculus
ctagcttcaggcttcagaagctgcg

SEQ ID NO: 419387 - DNA, 25 bp, Mus musculus
tctggcccggcgcactggacatgga

SEQ ID NO: 419388 - DNA, 25 bp, Mus musculus
cactggacatggagctccgagcagc

SEQ ID NO: 419389 - DNA, 25 bp, Mus musculus
aatccgctcgttcggttagcgccca

SEQ ID NO: 419390 - DNA, 25 bp, Mus musculus
ctcgttcggttagcgcccagcttgg

SEQ ID NO: 419391 - DNA, 25 bp, Mus musculus
gaagctagccgggtgaaaacctcac

SEQ ID NO: 419392 - DNA, 25 bp, Mus musculus
agccgggtgaaaacctcacatcctg

SEQ ID NO: 419393 - DNA, 25 bp, Mus musculus
gggtgaaaacctcacatcctgcccg

SEQ ID NO: 419394 - DNA, 25 bp, Mus musculus
acactatttccagcatgcccgagac

SEQ ID NO: 419395 - DNA, 25 bp, Mus musculus
gcgcgtgatctctcacacaagtgtg

SEQ ID NO: 419396 - DNA, 25 bp, Mus musculus
acacgctctacgtggtgtggggcca

SEQ ID NO: 419397 - DNA, 25 bp, Mus musculus
tctgcgcaactactcacactatttc

SEQ ID NO: 419398 - DNA, 25 bp, Mus musculus
tgcttctgcgcaactactcacacta

SEQ ID NO: 419399 - DNA, 25 bp, Mus musculus
gtgtgccattgcttctgcgcaacta

SEQ ID NO: 419400 - DNA, 25 bp, Mus musculus
acacaagtgtgccattgcttctgcg

SEQ ID NO: 419401 - DNA, 25 bp, Mus musculus
tatttccagcatgcccgagacacgc

SEQ ID NO: 419402 - DNA, 25 bp, Mus musculus
aggacgtgggccagcgcagcactct

SEQ ID NO: 419403 - DNA, 25 bp, Mus musculus
atgaaccaggcacccaccgtgggct

SEQ ID NO: 419404 - DNA, 25 bp, Mus musculus
gtgcgtgctacgcatgaaccaggca

SEQ ID NO: 419405 - DNA, 25 bp, Mus musculus
atggcgcagagtgcgtgctacgcat

SEQ ID NO: 419406 - DNA, 25 bp, Mus musculus
gcatgcccgagacacgctctacgtg

SEQ ID NO: 419407 - DNA, 25 bp, Mus musculus
agcactctgcgcgtgatctctcaca

SEQ ID NO: 419408 - DNA, 25 bp, Mus musculus
gggcttgtgcttgcgcctcggcagt

SEQ ID NO: 419409 - DNA, 25 bp, Mus musculus
tctcctctctggcacctccctgggg

SEQ ID NO: 419410 - DNA, 25 bp, Mus musculus
gagagcgtctctcctctctggcacc

SEQ ID NO: 419411 - DNA, 25 bp, Mus musculus
gggccatccgcagcctgaggctccg

SEQ ID NO: 419412 - DNA, 25 bp, Mus musculus
ctcccggcgccatgtgacggggtgc

SEQ ID NO: 419413 - DNA, 25 bp, Mus musculus
gattctttgggcctctcgtgttgga

SEQ ID NO: 419414 - DNA, 25 bp, Mus musculus
ctcggcagtggggagccgctgataa

SEQ ID NO: 419415 - DNA, 25 bp, Mus musculus
cgagacccactctgcttgctaactg

SEQ ID NO: 419416 - DNA, 25 bp, Mus musculus
agacccactctgcttgctaactgca

SEQ ID NO: 419417 - DNA, 25 bp, Mus musculus
tgcttgctaactgcaccccgagatc

SEQ ID NO: 419418 - DNA, 25 bp, Mus musculus
gagatctagcgggattctttgggcc

SEQ ID NO: 419419 - DNA, 25 bp, Mus musculus
atctagcgggattctttgggcctct

SEQ ID NO: 419420 - DNA, 25 bp, Mus musculus
ctttgggcctctcgtgttggagatg

SEQ ID NO: 419421 - DNA, 25 bp, Mus musculus
tcgctcggccctaacgggactgcga

SEQ ID NO: 419422 - DNA, 25 bp, Mus musculus
ctatcctcggcaacaaggtagagca

SEQ ID NO: 419423 - DNA, 25 bp, Mus musculus
caatacccgtatgcctcctcttaga

SEQ ID NO: 419424 - DNA, 25 bp, Mus musculus
cgaggtcttccactacggctccctg

SEQ ID NO: 419425 - DNA, 25 bp, Mus musculus
cgcgtcggccagtcaacctcaagaa

SEQ ID NO: 419426 - DNA, 25 bp, Mus musculus
gtcggccagtcaacctcaagaagtg

SEQ ID NO: 419427 - DNA, 25 bp, Mus musculus
tcaacctcaagaagtggagtttctc

SEQ ID NO: 419428 - DNA, 25 bp, Mus musculus
tggagtttctccagcgcctacttcc

SEQ ID NO: 419429 - DNA, 25 bp, Mus musculus
tacttccctatcctcggcaacaagg

SEQ ID NO: 419430 - DNA, 25 bp, Mus musculus
ggcaacaaggtagagcagctcctga

SEQ ID NO: 419431 - DNA, 25 bp, Mus musculus
tagagcagctcctgaggggcgttcc

SEQ ID NO: 419432 - DNA, 25 bp, Mus musculus
aggggcgttccctgacctctgctag

SEQ ID NO: 419433 - DNA, 25 bp, Mus musculus
ggggcgttccccgaacactgatagc

SEQ ID NO: 419434 - DNA, 25 bp, Mus musculus
aactcttctttccaatacccgtatg

SEQ ID NO: 419435 - DNA, 25 bp, Mus musculus
cctcggcaacaaggtagagcagctc

SEQ ID NO: 419436 - DNA, 25 bp, Mus musculus
ggcgggcctcatgttcccgaacatg

SEQ ID NO: 419437 - DNA, 25 bp, Mus musculus
agggcagcctcctgcgcgtcatcca

SEQ ID NO: 419438 - DNA, 25 bp, Mus musculus
gcatgaacgatgctcccacctctgg

SEQ ID NO: 419439 - DNA, 25 bp, Mus musculus
acctctggctactcggctgacgtcg

SEQ ID NO: 419440 - DNA, 25 bp, Mus musculus
tactcggctgacgtcggaaacaaaa

SEQ ID NO: 419441 - DNA, 25 bp, Mus musculus
cttccgcgtagtggcccattccagt

SEQ ID NO: 419442 - DNA, 25 bp, Mus musculus
ggcccattccagtgtattccgtgtg

SEQ ID NO: 419443 - DNA, 25 bp, Mus musculus
atggaggcctatgccgtctctcccg

SEQ ID NO: 419444 - DNA, 25 bp, Mus musculus
agacggtgttcatcttctggggacc

SEQ ID NO: 419445 - DNA, 25 bp, Mus musculus
tgttcccgaacatggaggcctatgc

SEQ ID NO: 419446 - DNA, 25 bp, Mus musculus
tgcagcagtttgacgacctcttccg

SEQ ID NO: 419447 - DNA, 25 bp, Mus musculus
ttgacgacctcttccggggtgagac

SEQ ID NO: 419448 - DNA, 25 bp, Mus musculus
ccgcccgcatgcagcagtttgacga

SEQ ID NO: 419449 - DNA, 25 bp, Mus musculus
tgtattccgtgtgctgcggaagccc

SEQ ID NO: 419450 - DNA, 25 bp, Mus musculus
ttctctactcgggatcttgagctga

SEQ ID NO: 419451 - DNA, 25 bp, Mus musculus
gttggcgctgctcactaatgctcgc

SEQ ID NO: 419452 - DNA, 25 bp, Mus musculus
agagttctctgcagaggggattccc

SEQ ID NO: 419453 - DNA, 25 bp, Mus musculus
tgtgcgcatgcacaagggccaggct

SEQ ID NO: 419454 - DNA, 25 bp, Mus musculus
cgcttctgggtctttgtgcgcatgc

SEQ ID NO: 419455 - DNA, 25 bp, Mus musculus
gctatccgcgattaccctcgttcag

SEQ ID NO: 419456 - DNA, 25 bp, Mus musculus
ccacgtgagcgagccaagcccagtt

SEQ ID NO: 419457 - DNA, 25 bp, Mus musculus
cggccggtccacgtgagcgagccaa

SEQ ID NO: 419458 - DNA, 25 bp, Mus musculus
tcgtgttctctactcgggatcttga

SEQ ID NO: 419459 - DNA, 25 bp, Mus musculus
gccggtgtaaccggcgcgtctccta

SEQ ID NO: 419460 - DNA, 25 bp, Mus musculus
atcttgagctgagacagccaggggc

SEQ ID NO: 419461 - DNA, 25 bp, Mus musculus
acagccaggggccaactgttacggc

SEQ ID NO: 419462 - DNA, 25 bp, Mus musculus
ctcactaatgctcgctgttgaaagc

SEQ ID NO: 419463 - DNA, 25 bp, Mus musculus
cagcggtgttcgtgttctctactcg

SEQ ID NO: 419464 - DNA, 25 bp, Mus musculus
cggagttgatcgaaacccagatggc

SEQ ID NO: 419465 - DNA, 25 bp, Mus musculus
tccagctccacgagaagtggtcgca

SEQ ID NO: 419466 - DNA, 25 bp, Mus musculus
atgccgcgacgaggtaagtgactca

SEQ ID NO: 419467 - DNA, 25 bp, Mus musculus
tggtactgccagatgtgccaaaagc

SEQ ID NO: 419468 - DNA, 25 bp, Mus musculus
agtccaaagggctccagaagcttcg

SEQ ID NO: 419469 - DNA, 25 bp, Mus musculus
tcgccatgggcaagtcggattttct

SEQ ID NO: 419470 - DNA, 25 bp, Mus musculus
cgcttccgaccgctttgtagttgta

SEQ ID NO: 419471 - DNA, 25 bp, Mus musculus
ctgctgtcaatttcggtcccgcctg

SEQ ID NO: 419472 - DNA, 25 bp, Mus musculus
tcctcggtctcgctaaatctcgtga

SEQ ID NO: 419473 - DNA, 25 bp, Mus musculus
cgcgagaacatggtggagccttgaa

SEQ ID NO: 419474 - DNA, 25 bp, Mus musculus
tggtcctaccattgcggctgcacgg

SEQ ID NO: 419475 - DNA, 25 bp, Mus musculus
gaccgtgaccttgttctctttgacc

SEQ ID NO: 419476 - DNA, 25 bp, Mus musculus
gccgttccagtctcaggggatcaga

SEQ ID NO: 419477 - DNA, 25 bp, Mus musculus
ggtcgcagacaagcactcactgatc

SEQ ID NO: 419478 - DNA, 25 bp, Mus musculus
tgtccttgaggtggtcgatggaacc

SEQ ID NO: 419479 - DNA, 25 bp, Mus musculus
gcgcacttgtgaattggaacgtccg

SEQ ID NO: 419480 - DNA, 25 bp, Mus musculus
cggtattcgtccaggctgggctcca

SEQ ID NO: 419481 - DNA, 25 bp, Mus musculus
cccttgtggcccagataatggtcga

SEQ ID NO: 419482 - DNA, 25 bp, Mus musculus
tcttctcggttagagcctgcagctc

SEQ ID NO: 419483 - DNA, 25 bp, Mus musculus
cgcagaaaatgagctggcccggttg

SEQ ID NO: 419484 - DNA, 25 bp, Mus musculus
gccatggtggactcgttgaacagca

SEQ ID NO: 419485 - DNA, 25 bp, Mus musculus
acattgcggtacacgttgtccttga

SEQ ID NO: 419486 - DNA, 25 bp, Mus musculus
gatcaccagggtgggcatgacattg

SEQ ID NO: 419487 - DNA, 25 bp, Mus musculus
cgcacatagtgtgcggggatcacca

SEQ ID NO: 419488 - DNA, 25 bp, Mus musculus
gtccgtccagggatacgaaccaggc

SEQ ID NO: 419489 - DNA, 25 bp, Mus musculus
gggtgaggcttcactcccagttcca

SEQ ID NO: 419490 - DNA, 25 bp, Mus musculus
ggctctgtgtcttcgctgagcgcca

SEQ ID NO: 419491 - DNA, 25 bp, Mus musculus
gccagctggtctaccgactgtgaca

SEQ ID NO: 419492 - DNA, 25 bp, Mus musculus
gggccacctgagctcaactttccgg

SEQ ID NO: 419493 - DNA, 25 bp, Mus musculus
gtgcgctgctctcgccatgcttcta

SEQ ID NO: 419494 - DNA, 25 bp, Mus musculus
agaattcccacatcgggccacctga

SEQ ID NO: 419495 - DNA, 25 bp, Mus musculus
ccacgtgtcagtacgggaccgtttg

SEQ ID NO: 419496 - DNA, 25 bp, Mus musculus
agaaacctgatactccatgcccggc

SEQ ID NO: 419497 - DNA, 25 bp, Mus musculus
tccgtcgttgcaccacgcgcagaaa

SEQ ID NO: 419498 - DNA, 25 bp, Mus musculus
cgcgcagaaacagctgccagggaca

SEQ ID NO: 419499 - DNA, 25 bp, Mus musculus
ccgcgcccacgacatagtcttaatg

SEQ ID NO: 419500 - DNA, 25 bp, Mus musculus
taatgccaccgcaagctaggcctgg

SEQ ID NO: 419501 - DNA, 25 bp, Mus musculus
agacccaccaatccgagtctctaga

SEQ ID NO: 419502 - DNA, 25 bp, Mus musculus
gtctctagattttcccggaccaatg

SEQ ID NO: 419503 - DNA, 25 bp, Mus musculus
cggaccaatgagaagcagcgcctta

SEQ ID NO: 419504 - DNA, 25 bp, Mus musculus
ccgcgggaacggtcagaaacctgat

SEQ ID NO: 419505 - DNA, 25 bp, Mus musculus
cagcgccttatcacggccatctttg

SEQ ID NO: 419506 - DNA, 25 bp, Mus musculus
gggtccagcaccagcagcttgtcaa

SEQ ID NO: 419507 - DNA, 25 bp, Mus musculus
actgtcaatccgctgcgcggggtcc

SEQ ID NO: 419508 - DNA, 25 bp, Mus musculus
tgtcaatccgctgcgcggggtccag

SEQ ID NO: 419509 - DNA, 25 bp, Mus musculus
cacgtaggccttcagacggtccttc

SEQ ID NO: 419510 - DNA, 25 bp, Mus musculus
cagcaccagcagcttgtcaatgagg

SEQ ID NO: 419511 - DNA, 25 bp, Mus musculus
caccagcagcttgtcaatgaggtcc

SEQ ID NO: 419512 - DNA, 25 bp, Mus musculus
cagcagcttgtcaatgaggtccaga

SEQ ID NO: 419513 - DNA, 25 bp, Mus musculus
cagcttgtcaatgaggtccagagca

SEQ ID NO: 419514 - DNA, 25 bp, Mus musculus
gcttgtcaatgaggtccagagcata

SEQ ID NO: 419515 - DNA, 25 bp, Mus musculus
gtcactgtcaatccgctgcgcgggg

SEQ ID NO: 419516 - DNA, 25 bp, Mus musculus
tcaatgaggtccagagcataggggt

SEQ ID NO: 419517 - DNA, 25 bp, Mus musculus
taggccttcagacggtccttcacct

SEQ ID NO: 419518 - DNA, 25 bp, Mus musculus
ccttcagacggtccttcaccttccg

SEQ ID NO: 419519 - DNA, 25 bp, Mus musculus
gtccagcaccagcagcttgtcaatg

SEQ ID NO: 419520 - DNA, 25 bp, Mus musculus
tcggagtggctctcagcaaccctac

SEQ ID NO: 419521 - DNA, 25 bp, Mus musculus
tggccgctcacattcggagtggctc

SEQ ID NO: 419522 - DNA, 25 bp, Mus musculus
cgcggccgagcaagaccgggcaaca

SEQ ID NO: 419523 - DNA, 25 bp, Mus musculus
cgggcaacagccacgaaaacagaag

SEQ ID NO: 419524 - DNA, 25 bp, Mus musculus
aaacagaagcttccggaccacctcg

SEQ ID NO: 419525 - DNA, 25 bp, Mus musculus
acgtcggccctggaaagtgcaggtc

SEQ ID NO: 419526 - DNA, 25 bp, Mus musculus
cgcggcctaatcttacccgaatgtg

SEQ ID NO: 419527 - DNA, 25 bp, Mus musculus
cccgaatgtgccttggccgatcttg

SEQ ID NO: 419528 - DNA, 25 bp, Mus musculus
ggccgatcttggcaagtttctcgta

SEQ ID NO: 419529 - DNA, 25 bp, Mus musculus
gtttctcgtacttggtgacctcatc

SEQ ID NO: 419530 - DNA, 25 bp, Mus musculus
tggtgacctcatcgcagaacgggca

SEQ ID NO: 419531 - DNA, 25 bp, Mus musculus
agaacgggcattccaccgagtcgta

SEQ ID NO: 419532 - DNA, 25 bp, Mus musculus
caccgagtcgtactgcttggccatg

SEQ ID NO: 419533 - DNA, 25 bp, Mus musculus
tcggatccgggacgcggtcattcca

SEQ ID NO: 419534 - DNA, 25 bp, Mus musculus
cccgaccaggcgatgaggtaatcgc

SEQ ID NO: 419535 - DNA, 25 bp, Mus musculus
ctcacctcggggtgaccagggcgct

SEQ ID NO: 419536 - DNA, 25 bp, Mus musculus
gtcgccatagctcacctcggggtga

SEQ ID NO: 419537 - DNA, 25 bp, Mus musculus
tcgtgcagtccggacagccagcgaa

SEQ ID NO: 419538 - DNA, 25 bp, Mus musculus
cccgcagggtcgtgcagtccggaca

SEQ ID NO: 419539 - DNA, 25 bp, Mus musculus
tcagtccaagagcatccccgcaggg

SEQ ID NO: 419540 - DNA, 25 bp, Mus musculus
atggggacctcagtccaagagcatc

SEQ ID NO: 419541 - DNA, 25 bp, Mus musculus
cccgccgctgagatggggacctcag

SEQ ID NO: 419542 - DNA, 25 bp, Mus musculus
accgtggctcgctggtacaggtgca

SEQ ID NO: 419543 - DNA, 25 bp, Mus musculus
ctgcttctaccgtggctcgctggta

SEQ ID NO: 419544 - DNA, 25 bp, Mus musculus
ttgcagcctgtggagtgcgctgtcc

SEQ ID NO: 419545 - DNA, 25 bp, Mus musculus
caccatgaccgagcgttgcagcctg

SEQ ID NO: 419546 - DNA, 25 bp, Mus musculus
taatcgcgccgctgagaggcacgcg

SEQ ID NO: 419547 - DNA, 25 bp, Mus musculus
ctggccgcaccatgaccgagcgttg

SEQ ID NO: 419548 - DNA, 25 bp, Mus musculus
gggccgctagttacccgtgaccatg

SEQ ID NO: 419549 - DNA, 25 bp, Mus musculus
tgcagtactgctgcgagacaacctg

SEQ ID NO: 419550 - DNA, 25 bp, Mus musculus
cgagacaacctgtgggttttagagc

SEQ ID NO: 419551 - DNA, 25 bp, Mus musculus
tggctgcctcggagcggtgcacacc

SEQ ID NO: 419552 - DNA, 25 bp, Mus musculus
cgggagctgtagttcacaggttctg

SEQ ID NO: 419553 - DNA, 25 bp, Mus musculus
ggcctctgaccgaaatcgggcctca

SEQ ID NO: 419554 - DNA, 25 bp, Mus musculus
aatcgggcctcaaccggatggcggt

SEQ ID NO: 419555 - DNA, 25 bp, Mus musculus
cctggggctcgatcctcgggctgct

SEQ ID NO: 419556 - DNA, 25 bp, Mus musculus
acgtggcttctctgcgctgcacctt

SEQ ID NO: 419557 - DNA, 25 bp, Mus musculus
ctgcaccttcggctcgttctgcgaa

SEQ ID NO: 419558 - DNA, 25 bp, Mus musculus
gctcgttctgcgaatgcgacttctg

SEQ ID NO: 419559 - DNA, 25 bp, Mus musculus
gcgaatgcgacttctggcccgactt

SEQ ID NO: 419560 - DNA, 25 bp, Mus musculus
cccaggaggcctatttgcagtactg

SEQ ID NO: 419561 - DNA, 25 bp, Mus musculus
ccgtgaccatggcaacgcgggactg

SEQ ID NO: 419562 - DNA, 25 bp, Mus musculus
agtcggcacgttgaagtccggtctt

SEQ ID NO: 419563 - DNA, 25 bp, Mus musculus
ctggacatgtcgtgatgctattggc

SEQ ID NO: 419564 - DNA, 25 bp, Mus musculus
tattggcttagggatgcctgacgtc

SEQ ID NO: 419565 - DNA, 25 bp, Mus musculus
cgtcgctggacatgtcgtgatgcta

SEQ ID NO: 419566 - DNA, 25 bp, Mus musculus
aacccagcctggattgggcgtcgct

SEQ ID NO: 419567 - DNA, 25 bp, Mus musculus
ccgcagagacatggcggacgccaaa

SEQ ID NO: 419568 - DNA, 25 bp, Mus musculus
cgcggaggaatgcacccagacactc

SEQ ID NO: 419569 - DNA, 25 bp, Mus musculus
gctgagccatacagggtgacgcgtc

SEQ ID NO: 419570 - DNA, 25 bp, Mus musculus
agccctcgagcaaaggccgagcaaa

SEQ ID NO: 419571 - DNA, 25 bp, Mus musculus
ttaacgaggtaccagccctcgagca

SEQ ID NO: 419572 - DNA, 25 bp, Mus musculus
ttgagccggcaggtttccgaggctc

SEQ ID NO: 419573 - DNA, 25 bp, Mus musculus
ctttttagtccagggatgcggcgga

SEQ ID NO: 419574 - DNA, 25 bp, Mus musculus
ccggtctttttagtccagggatgcg

SEQ ID NO: 419575 - DNA, 25 bp, Mus musculus
aaggccgagcaaaggctgagccata

SEQ ID NO: 419576 - DNA, 25 bp, Mus musculus
agagccttgcggaagcagtgccaca

SEQ ID NO: 419577 - DNA, 25 bp, Mus musculus
ctcccaggtgggtctctgcagccgg

SEQ ID NO: 419578 - DNA, 25 bp, Mus musculus
agccgctcccaggtgggtctctgca

SEQ ID NO: 419579 - DNA, 25 bp, Mus musculus
gcagtgccacaggaaaaccccgtgt

SEQ ID NO: 419580 - DNA, 25 bp, Mus musculus
cggaagcagtgccacaggaaaaccc

SEQ ID NO: 419581 - DNA, 25 bp, Mus musculus
tgcggaagcagtgccacaggaaaac

SEQ ID NO: 419582 - DNA, 25 bp, Mus musculus
ccttgcggaagcagtgccacaggaa

SEQ ID NO: 419583 - DNA, 25 bp, Mus musculus
tctaagggttcggaccagctaagac

SEQ ID NO: 419584 - DNA, 25 bp, Mus musculus
gatttctaagggttcggaccagcta

SEQ ID NO: 419585 - DNA, 25 bp, Mus musculus
ctcccgcgacactccgaaactgctc

SEQ ID NO: 419586 - DNA, 25 bp, Mus musculus
tggggccactcctcccgcgacactc

SEQ ID NO: 419587 - DNA, 25 bp, Mus musculus
acaagcagcgagactgcagactgcg

SEQ ID NO: 419588 - DNA, 25 bp, Mus musculus
gtcccacaagcagcgagactgcaga

SEQ ID NO: 419589 - DNA, 25 bp, Mus musculus
ctgagtcccacaagcagcgagactg

SEQ ID NO: 419590 - DNA, 25 bp, Mus musculus
gggcagcacccggacgccacttact

SEQ ID NO: 419591 - DNA, 25 bp, Mus musculus
gcgcgctgccgccaatagaagcgcg

SEQ ID NO: 419592 - DNA, 25 bp, Mus musculus
cgcgccagccgtcatcgtcacccgc

SEQ ID NO: 419593 - DNA, 25 bp, Mus musculus
ccaaagcgaggctgtgtagcggcca

SEQ ID NO: 419594 - DNA, 25 bp, Mus musculus
actcgggccaaagcgaggctgtgta

SEQ ID NO: 419595 - DNA, 25 bp, Mus musculus
tcgggaccgactgacgcgcggactc

SEQ ID NO: 419596 - DNA, 25 bp, Mus musculus
cgcagtcgcgctcgggaccgactga

SEQ ID NO: 419597 - DNA, 25 bp, Mus musculus
gctcctcccgcgacaccgtcgcctc

SEQ ID NO: 419598 - DNA, 25 bp, Mus musculus
gagtcttcgggctccgatgctcctc

SEQ ID NO: 419599 - DNA, 25 bp, Mus musculus
cgttcttcgagtcttcgggctccga

SEQ ID NO: 419600 - DNA, 25 bp, Mus musculus
gggccatggcgttcttcgagtcttc

SEQ ID NO: 419601 - DNA, 25 bp, Mus musculus
cgaccaccgccttgaggccaatggg

SEQ ID NO: 419602 - DNA, 25 bp, Mus musculus
tgccgccaatagaagcgcggcccgg

SEQ ID NO: 419603 - DNA, 25 bp, Mus musculus
ggacgccacttactctctccgacca

SEQ ID NO: 419604 - DNA, 25 bp, Mus musculus
cgccatgggagacgtactgtccaca

SEQ ID NO: 419605 - DNA, 25 bp, Mus musculus
aacttgttctctctcggtctggacg

SEQ ID NO: 419606 - DNA, 25 bp, Mus musculus
ggagacgtactgtccacacacctgg

SEQ ID NO: 419607 - DNA, 25 bp, Mus musculus
cttactcttcctccgaacttgttct

SEQ ID NO: 419608 - DNA, 25 bp, Mus musculus
tgtccacacacctggatgacgcacg

SEQ ID NO: 419609 - DNA, 25 bp, Mus musculus
ggccacgcctccgatctcatgggga

SEQ ID NO: 419610 - DNA, 25 bp, Mus musculus
cacggcgccagcacatcgcaggtga

SEQ ID NO: 419611 - DNA, 25 bp, Mus musculus
tctcctcgccatgggagacgtactg

SEQ ID NO: 419612 - DNA, 25 bp, Mus musculus
gccagcacatcgcaggtgagcaccg

SEQ ID NO: 419613 - DNA, 25 bp, Mus musculus
gagagccggccagacccttactctt

SEQ ID NO: 419614 - DNA, 25 bp, Mus musculus
gtactcgagagtcaaggcccaggtc

SEQ ID NO: 419615 - DNA, 25 bp, Mus musculus
atctcatggggagcggtactcgaga

SEQ ID NO: 419616 - DNA, 25 bp, Mus musculus
gcctccgatctcatggggagcggta

SEQ ID NO: 419617 - DNA, 25 bp, Mus musculus
acacctggatgacgcacggcgccag

SEQ ID NO: 419618 - DNA, 25 bp, Mus musculus
cagacgcctgcccataagaaacagg

SEQ ID NO: 419619 - DNA, 25 bp, Mus musculus
cccgtgcgccttagggtaaggcctg

SEQ ID NO: 419620 - DNA, 25 bp, Mus musculus
gcgaccagggtgtcgcccagagact

SEQ ID NO: 419621 - DNA, 25 bp, Mus musculus
cggttctcgcgagagctgagctttt

SEQ ID NO: 419622 - DNA, 25 bp, Mus musculus
cgagagctgagcttttccgcctata

SEQ ID NO: 419623 - DNA, 25 bp, Mus musculus
tttccgcctatatccggcgtgggcg

SEQ ID NO: 419624 - DNA, 25 bp, Mus musculus
gcaggatccgtcttttcggctttcg

SEQ ID NO: 419625 - DNA, 25 bp, Mus musculus
ggccttggctgccacgtgtgtaaga

SEQ ID NO: 419626 - DNA, 25 bp, Mus musculus
taagtcgtcgctcccgagccgtaga

SEQ ID NO: 419627 - DNA, 25 bp, Mus musculus
gggacatctgaagcccgacggcagc

SEQ ID NO: 419628 - DNA, 25 bp, Mus musculus
cctgcgccgcagaggttctgatttt

SEQ ID NO: 419629 - DNA, 25 bp, Mus musculus
tttgctttttcttcagtgtacctga

SEQ ID NO: 419630 - DNA, 25 bp, Mus musculus
tcctctgggtctggtaagtcgtcgc

SEQ ID NO: 419631 - DNA, 25 bp, Mus musculus
acgaggtcaaagtcggtgcgtgccc

SEQ ID NO: 419632 - DNA, 25 bp, Mus musculus
cgccatcctgggagcagaatgcatc

SEQ ID NO: 419633 - DNA, 25 bp, Mus musculus
gagaccctcgccctctccattgtgt

SEQ ID NO: 419634 - DNA, 25 bp, Mus musculus
tgcatcccaagtcactagcaccgtg

SEQ ID NO: 419635 - DNA, 25 bp, Mus musculus
caagtcactagcaccgtgaagaggg

SEQ ID NO: 419636 - DNA, 25 bp, Mus musculus
tggcagccgatcacagggtacaggc

SEQ ID NO: 419637 - DNA, 25 bp, Mus musculus
tcacagggtacaggcccacgatcgc

SEQ ID NO: 419638 - DNA, 25 bp, Mus musculus
tcgaggccgatactcaccctgcggg

SEQ ID NO: 419639 - DNA, 25 bp, Mus musculus
ccgatactcaccctgcgggctgggg

SEQ ID NO: 419640 - DNA, 25 bp, Mus musculus
gggccctagcggtccatcgttgccg

SEQ ID NO: 419641 - DNA, 25 bp, Mus musculus
tgcaccgctctgtgcagctccgggt

SEQ ID NO: 419642 - DNA, 25 bp, Mus musculus
ctcggcgcgattgtctctgcccgga

SEQ ID NO: 419643 - DNA, 25 bp, Mus musculus
gcgattgtctctgcccggagcggcc

SEQ ID NO: 419644 - DNA, 25 bp, Mus musculus
gagcagaatgcatcccaagtcacta

SEQ ID NO: 419645 - DNA, 25 bp, Mus musculus
agaagcaccgatctcaggtcgcctt

SEQ ID NO: 419646 - DNA, 25 bp, Mus musculus
gctggagaggaaatgagaagcactt

SEQ ID NO: 419647 - DNA, 25 bp, Mus musculus
tgcactcgctttagcggcgcagcct

SEQ ID NO: 419648 - DNA, 25 bp, Mus musculus
cttcctcgtttatgcactcgcttta

SEQ ID NO: 419649 - DNA, 25 bp, Mus musculus
gtcctcctccgggtgcagtctgttc

SEQ ID NO: 419650 - DNA, 25 bp, Mus musculus
gagtctgtccggagttgcaaagtga

SEQ ID NO: 419651 - DNA, 25 bp, Mus musculus
cgactcccggctctgaaaagccagg

SEQ ID NO: 419652 - DNA, 25 bp, Mus musculus
gcgctctgggttgtcattttttctc

SEQ ID NO: 419653 - DNA, 25 bp, Mus musculus
agcacttgagcgaagcctctaactc

SEQ ID NO: 419654 - DNA, 25 bp, Mus musculus
ttaaagaaggaagctcgagccagtc

SEQ ID NO: 419655 - DNA, 25 bp, Mus musculus
tgagtgtgccgaaaggcgtcttttt

SEQ ID NO: 419656 - DNA, 25 bp, Mus musculus
cgcgagcagatctctggcccgcagg

SEQ ID NO: 419657 - DNA, 25 bp, Mus musculus
caaacttaatcaggtaggacgccgc

SEQ ID NO: 419658 - DNA, 25 bp, Mus musculus
aggttccaccattcctggcaggaca

SEQ ID NO: 419659 - DNA, 25 bp, Mus musculus
tctaactcctctctgcgctctgggt

SEQ ID NO: 419660 - DNA, 25 bp, Mus musculus
aatgtgaccctcgttgcctcgtggt

SEQ ID NO: 419661 - DNA, 25 bp, Mus musculus
gggcgcaacagaactgcgccacttc

SEQ ID NO: 419662 - DNA, 25 bp, Mus musculus
gccacttccgacatggctctgtaga

SEQ ID NO: 419663 - DNA, 25 bp, Mus musculus
atggctctgtagactggctcctctg

SEQ ID NO: 419664 - DNA, 25 bp, Mus musculus
ggctcctctgcagtcttctcggtcg

SEQ ID NO: 419665 - DNA, 25 bp, Mus musculus
ttctcggtcgccaggaatgtgaccc

SEQ ID NO: 419666 - DNA, 25 bp, Mus musculus
cctcgtggtgtgtgacagaagcctc

SEQ ID NO: 419667 - DNA, 25 bp, Mus musculus
acgcagatcaccctgtttcaggcgc

SEQ ID NO: 419668 - DNA, 25 bp, Mus musculus
tgggtcccacgacgggccacgatat

SEQ ID NO: 419669 - DNA, 25 bp, Mus musculus
aagcttctgggacgtgtgggtccca

SEQ ID NO: 419670 - DNA, 25 bp, Mus musculus
gtcggcacacggagcacacgggcca

SEQ ID NO: 419671 - DNA, 25 bp, Mus musculus
gctcagaccgcttgtggaaagcgtt

SEQ ID NO: 419672 - DNA, 25 bp, Mus musculus
gccacgatatgtgggcgcaacagaa

SEQ ID NO: 419673 - DNA, 25 bp, Mus musculus
tgcgcacatctggagaacaactgca

SEQ ID NO: 419674 - DNA, 25 bp, Mus musculus
cagcaggacctgacccgcgaactgt

SEQ ID NO: 419675 - DNA, 25 bp, Mus musculus
cctcgggagacatgtcagcaggacc

SEQ ID NO: 419676 - DNA, 25 bp, Mus musculus
gtggccgcaatagcggctgcgtctc

SEQ ID NO: 419677 - DNA, 25 bp, Mus musculus
ggagtcctcacctggcttccggtgg

SEQ ID NO: 419678 - DNA, 25 bp, Mus musculus
agctgtagccgagcgcgaagccgaa

SEQ ID NO: 419679 - DNA, 25 bp, Mus musculus
aggccgcattgtctccgaggcgcag

SEQ ID NO: 419680 - DNA, 25 bp, Mus musculus
cccgaaccaggaggccgcattgtct

SEQ ID NO: 419681 - DNA, 25 bp, Mus musculus
aagaggctcagcttgcgccctgcac

SEQ ID NO: 419682 - DNA, 25 bp, Mus musculus
agcttgcgccctgcacggtccagga

SEQ ID NO: 419683 - DNA, 25 bp, Mus musculus
agcaaagccagtcacgaagggcacg

SEQ ID NO: 419684 - DNA, 25 bp, Mus musculus
ccgcggtgatgacagcaaagccagt

SEQ ID NO: 419685 - DNA, 25 bp, Mus musculus
gtgccactagtgaggcgactccgca

SEQ ID NO: 419686 - DNA, 25 bp, Mus musculus
tgcagcagcgcccagggtcacgacg

SEQ ID NO: 419687 - DNA, 25 bp, Mus musculus
tcacgaagggcacggtgcagagcaa

SEQ ID NO: 419688 - DNA, 25 bp, Mus musculus
gctctgcgccgactccctcccacgc

SEQ ID NO: 419689 - DNA, 25 bp, Mus musculus
ttcggacgtccacatcatctgccgg

SEQ ID NO: 419690 - DNA, 25 bp, Mus musculus
tgttcggccggacgctcagctagcg

SEQ ID NO: 419691 - DNA, 25 bp, Mus musculus
gcacactcgggtgggctcgggcctc

SEQ ID NO: 419692 - DNA, 25 bp, Mus musculus
gcagcgccgccctcttctgccgcag

SEQ ID NO: 419693 - DNA, 25 bp, Mus musculus
acctgggactctcaaagctgcaccc

SEQ ID NO: 419694 - DNA, 25 bp, Mus musculus
ggcaacggtacctgggactctcaaa

SEQ ID NO: 419695 - DNA, 25 bp, Mus musculus
gtggcccggccgctctactgggctc

SEQ ID NO: 419696 - DNA, 25 bp, Mus musculus
agccctcccgctgggcactccctca

SEQ ID NO: 419697 - DNA, 25 bp, Mus musculus
aggtctctagccctcccgctgggca

SEQ ID NO: 419698 - DNA, 25 bp, Mus musculus
ctgccggccggacacaggtctctag

SEQ ID NO: 419699 - DNA, 25 bp, Mus musculus
ctctactgggctctgcgccgactcc

SEQ ID NO: 419700 - DNA, 25 bp, Mus musculus
ggcttcggacgtccacatcatctgc

SEQ ID NO: 419701 - DNA, 25 bp, Mus musculus
cgaggcttcggacgtccacatcatc

SEQ ID NO: 419702 - DNA, 25 bp, Mus musculus
ttgagccaggcgcaagcttgaaacg

SEQ ID NO: 419703 - DNA, 25 bp, Mus musculus
aaccggctggttgcaccagtgcgca

SEQ ID NO: 419704 - DNA, 25 bp, Mus musculus
aaggatgctctgctgttctcgtcgg

SEQ ID NO: 419705 - DNA, 25 bp, Mus musculus
cagacgctcaggcttgcaaggatgc

SEQ ID NO: 419706 - DNA, 25 bp, Mus musculus
tgcgcttcggtcttgcagacgctca

SEQ ID NO: 419707 - DNA, 25 bp, Mus musculus
gtgcccagccgcagtaggaaccgtc

SEQ ID NO: 419708 - DNA, 25 bp, Mus musculus
ggttctccaaccagcttgccgtagg

SEQ ID NO: 419709 - DNA, 25 bp, Mus musculus
gcggcaccataccagggttctccaa

SEQ ID NO: 419710 - DNA, 25 bp, Mus musculus
aggaaccgtccactcctgggcctga

SEQ ID NO: 419711 - DNA, 25 bp, Mus musculus
gcaagcttgaaacgcgaggccgacg

SEQ ID NO: 419712 - DNA, 25 bp, Mus musculus
tcttcatggtcttgcgagaggccca

SEQ ID NO: 419713 - DNA, 25 bp, Mus musculus
tagtccgggctggtcaccttgacga

SEQ ID NO: 419714 - DNA, 25 bp, Mus musculus
tggctgccaccgcttcttcatggtc

SEQ ID NO: 419715 - DNA, 25 bp, Mus musculus
gacacgcaaatgaaccggctggttg

SEQ ID NO: 419716 - DNA, 25 bp, Mus musculus
gctctccggggacaacggtcactaa

SEQ ID NO: 419717 - DNA, 25 bp, Mus musculus
tcgatatggccggacttctcgcggc

SEQ ID NO: 419718 - DNA, 25 bp, Mus musculus
gggccggtcggaatcccagctcctg

SEQ ID NO: 419719 - DNA, 25 bp, Mus musculus
aatcccagctcctggctagtgctgc

SEQ ID NO: 419720 - DNA, 25 bp, Mus musculus
gctagtgctgcaggccgaccagtag

SEQ ID NO: 419721 - DNA, 25 bp, Mus musculus
acgggcgggtagctgaacagcaacc

SEQ ID NO: 419722 - DNA, 25 bp, Mus musculus
acagcaacccgggtttggagcctga

SEQ ID NO: 419723 - DNA, 25 bp, Mus musculus
gaaatcccgactctgcggcccgtgg

SEQ ID NO: 419724 - DNA, 25 bp, Mus musculus
gaccacccaggccaagcttaacacg

SEQ ID NO: 419725 - DNA, 25 bp, Mus musculus
ttggctccacctgctggccggagca

SEQ ID NO: 419726 - DNA, 25 bp, Mus musculus
agcaggactcgaccgtgtgcacccg

SEQ ID NO: 419727 - DNA, 25 bp, Mus musculus
tttggagcctgaaatcccgactctg

SEQ ID NO: 419728 - DNA, 25 bp, Mus musculus
cgcctgtttacctggcacacggcga

SEQ ID NO: 419729 - DNA, 25 bp, Mus musculus
tttacctggcacacggcgatggcca

SEQ ID NO: 419730 - DNA, 25 bp, Mus musculus
ggtactggcgtctgcgcaatggtct

SEQ ID NO: 419731 - DNA, 25 bp, Mus musculus
cgcaatggtctcgaagagtgagata

SEQ ID NO: 419732 - DNA, 25 bp, Mus musculus
ttcaggagagcacgcgcagggtact

SEQ ID NO: 419733 - DNA, 25 bp, Mus musculus
tgcgcatgctccaggcgtgctttcg

SEQ ID NO: 419734 - DNA, 25 bp, Mus musculus
acgctgggatgtgcgcatgctccag

SEQ ID NO: 419735 - DNA, 25 bp, Mus musculus
aaattgccagtgcttccggaggcgt

SEQ ID NO: 419736 - DNA, 25 bp, Mus musculus
gatcccgccctcgaaattgccagtg

SEQ ID NO: 419737 - DNA, 25 bp, Mus musculus
cggtctgacaaagaggcgaaactca

SEQ ID NO: 419738 - DNA, 25 bp, Mus musculus
cgaaactcagggcagcgaggttctc

SEQ ID NO: 419739 - DNA, 25 bp, Mus musculus
cagcgaggttctccttcgcggcgtc

SEQ ID NO: 419740 - DNA, 25 bp, Mus musculus
gggcggattctccaagagctccagg

SEQ ID NO: 419741 - DNA, 25 bp, Mus musculus
agtgtcccgtgtcgcggccactcgt

SEQ ID NO: 419742 - DNA, 25 bp, Mus musculus
gttgccgtaccaaggccttattctc

SEQ ID NO: 419743 - DNA, 25 bp, Mus musculus
ctcgtccctcggatacgctttctga

SEQ ID NO: 419744 - DNA, 25 bp, Mus musculus
tcacccggagcgcatagagccgggc

SEQ ID NO: 419745 - DNA, 25 bp, Mus musculus
gcgaagtgtctctctcacctcttta

SEQ ID NO: 419746 - DNA, 25 bp, Mus musculus
gtgtctctctcacctctttaaattt

SEQ ID NO: 419747 - DNA, 25 bp, Mus musculus
ctgctgaggtttctgcgaagtgtct

SEQ ID NO: 419748 - DNA, 25 bp, Mus musculus
aattttatggcgcttggcccgtggc

SEQ ID NO: 419749 - DNA, 25 bp, Mus musculus
gaggccttatttcatttccccgcgc

SEQ ID NO: 419750 - DNA, 25 bp, Mus musculus
cggacacccgagaaaggcatgggac

SEQ ID NO: 419751 - DNA, 25 bp, Mus musculus
ctgaaggctccatccatcactgggg

SEQ ID NO: 419752 - DNA, 25 bp, Mus musculus
tgtggtcgcagtgccggctctctct

SEQ ID NO: 419753 - DNA, 25 bp, Mus musculus
ggggtgctccgtcccatccatcacc

SEQ ID NO: 419754 - DNA, 25 bp, Mus musculus
cccggctcgcagatcttatcctgtt

SEQ ID NO: 419755 - DNA, 25 bp, Mus musculus
atccatcacccggagcgcatagagc

SEQ ID NO: 419756 - DNA, 25 bp, Mus musculus
tctttaaattttatggcgcttggcc

SEQ ID NO: 419757 - DNA, 25 bp, Mus musculus
atcttatcctgttcatttccgcccg

SEQ ID NO: 419758 - DNA, 25 bp, Mus musculus
gctgcccgctagagccgcttaatca

SEQ ID NO: 419759 - DNA, 25 bp, Mus musculus
cgtgtgcacgctttcgattgggatc

SEQ ID NO: 419760 - DNA, 25 bp, Mus musculus
ttagcaccgaacgtgcgtgtgcacg

SEQ ID NO: 419761 - DNA, 25 bp, Mus musculus
ccctagcgtttagcaccgaacgtgc

SEQ ID NO: 419762 - DNA, 25 bp, Mus musculus
ttgacaattaaaaagcgcctagctt

SEQ ID NO: 419763 - DNA, 25 bp, Mus musculus
cgcccgcagtcatttgacaattaaa

SEQ ID NO: 419764 - DNA, 25 bp, Mus musculus
gctaatcgcccgcagtcatttgaca

SEQ ID NO: 419765 - DNA, 25 bp, Mus musculus
agcgattattgaggaagctgccagc

SEQ ID NO: 419766 - DNA, 25 bp, Mus musculus
tcccagcaggtacagagaagagcga

SEQ ID NO: 419767 - DNA, 25 bp, Mus musculus
tgttttttaattaagctcccagcag

SEQ ID NO: 419768 - DNA, 25 bp, Mus musculus
atggcctttaaattgagcctctttg

SEQ ID NO: 419769 - DNA, 25 bp, Mus musculus
tgcattagcatagtaatggccttta

SEQ ID NO: 419770 - DNA, 25 bp, Mus musculus
acgctttcgattgggatccggggct

SEQ ID NO: 419771 - DNA, 25 bp, Mus musculus
ccgcccggctgcattagcatagtaa

SEQ ID NO: 419772 - DNA, 25 bp, Mus musculus
cccgaggtctttctgagcagactgc

SEQ ID NO: 419773 - DNA, 25 bp, Mus musculus
agctaataatgggagctcggagccg

SEQ ID NO: 419774 - DNA, 25 bp, Mus musculus
tctgagcagactgctaagcactggc

SEQ ID NO: 419775 - DNA, 25 bp, Mus musculus
atctccgcgattttttctcttccct

SEQ ID NO: 419776 - DNA, 25 bp, Mus musculus
cccggagagccgagaacagagataa

SEQ ID NO: 419777 - DNA, 25 bp, Mus musculus
gccgagaacagagataaaatgatta

SEQ ID NO: 419778 - DNA, 25 bp, Mus musculus
atgattaaaaactgccaagcgggcc

SEQ ID NO: 419779 - DNA, 25 bp, Mus musculus
tgccaagcgggcctggcaatcactc

SEQ ID NO: 419780 - DNA, 25 bp, Mus musculus
aagcgggcctggcaatcactcgctc

SEQ ID NO: 419781 - DNA, 25 bp, Mus musculus
atcgcagcgcgctccgaagagcaca

SEQ ID NO: 419782 - DNA, 25 bp, Mus musculus
cgctgtcagcccgacacaagacaaa

SEQ ID NO: 419783 - DNA, 25 bp, Mus musculus
cgacacaagacaaatctccgcgatt

SEQ ID NO: 419784 - DNA, 25 bp, Mus musculus
gctccgaagagcacagctaataatg

SEQ ID NO: 419785 - DNA, 25 bp, Mus musculus
gactgctaagcactggctgtctccc

SEQ ID NO: 419786 - DNA, 25 bp, Mus musculus
aatggagacctcctcgccaccgagg

SEQ ID NO: 419787 - DNA, 25 bp, Mus musculus
tcgcctcgttctgcttccggggctg

SEQ ID NO: 419788 - DNA, 25 bp, Mus musculus
gccgagaaggccaatgagagctgtc

SEQ ID NO: 419789 - DNA, 25 bp, Mus musculus
ctgtccatggttcgtcctggtgagc

SEQ ID NO: 419790 - DNA, 25 bp, Mus musculus
tttctctgcggaacccgtttcctgc

SEQ ID NO: 419791 - DNA, 25 bp, Mus musculus
ggacagggcctctcaccgtctagac

SEQ ID NO: 419792 - DNA, 25 bp, Mus musculus
ggcggctctgaccaagttgtctcgg

SEQ ID NO: 419793 - DNA, 25 bp, Mus musculus
tgaccaagttgtctcgggacctagg

SEQ ID NO: 419794 - DNA, 25 bp, Mus musculus
tatggacgaacacaggcgagcctcg

SEQ ID NO: 419795 - DNA, 25 bp, Mus musculus
ccgctaggtcttgtatggacgaaca

SEQ ID NO: 419796 - DNA, 25 bp, Mus musculus
gcacttcctcttttctctgcggaac

SEQ ID NO: 419797 - DNA, 25 bp, Mus musculus
cggcatctttcgctacacaggaaga

SEQ ID NO: 419798 - DNA, 25 bp, Mus musculus
ttcctgcctcgcattcggcatcttt

SEQ ID NO: 419799 - DNA, 25 bp, Mus musculus
ttcctgccctggctgtccatggttc

SEQ ID NO: 419800 - DNA, 25 bp, Mus musculus
gaacccaagagctgtggcgaggccc

SEQ ID NO: 419801 - DNA, 25 bp, Mus musculus
tgcggtgagccgcattgccagtccc

SEQ ID NO: 419802 - DNA, 25 bp, Mus musculus
tggaacactgcacagacccgggctg

SEQ ID NO: 419803 - DNA, 25 bp, Mus musculus
aggcgagctcctggaacactgcaca

SEQ ID NO: 419804 - DNA, 25 bp, Mus musculus
cctagctgcttcactccggggaaaa

SEQ ID NO: 419805 - DNA, 25 bp, Mus musculus
cgggagcctgcataccctagctgct

SEQ ID NO: 419806 - DNA, 25 bp, Mus musculus
ctgctccatctacggaggagcccgg

SEQ ID NO: 419807 - DNA, 25 bp, Mus musculus
cctggtgacaccgaaattcatcaac

SEQ ID NO: 419808 - DNA, 25 bp, Mus musculus
tgcgcgtattagagcgcgcggttcc

SEQ ID NO: 419809 - DNA, 25 bp, Mus musculus
gcccgtcctggatcggatcgaattc

SEQ ID NO: 419810 - DNA, 25 bp, Mus musculus
cttaactgcgaaggaacccaagagc

SEQ ID NO: 419811 - DNA, 25 bp, Mus musculus
tcggaagattccttaactgcgaagg

SEQ ID NO: 419812 - DNA, 25 bp, Mus musculus
agagcctccaagcttcggaagattc

SEQ ID NO: 419813 - DNA, 25 bp, Mus musculus
tccttcataaatcagcggccgggtg

SEQ ID NO: 419814 - DNA, 25 bp, Mus musculus
tcgctagggtgtgtttaaagaagcc

SEQ ID NO: 419815 - DNA, 25 bp, Mus musculus
tgtacaaactctgcacgtgcagtcg

SEQ ID NO: 419816 - DNA, 25 bp, Mus musculus
tcggtcgctagggtgtgtttaaaga

SEQ ID NO: 419817 - DNA, 25 bp, Mus musculus
cgccaacgtgcgtacgagtctcgga

SEQ ID NO: 419818 - DNA, 25 bp, Mus musculus
tgcgtacgagtctcggaaccagact

SEQ ID NO: 419819 - DNA, 25 bp, Mus musculus
ggaaccagactctgccacgatctga

SEQ ID NO: 419820 - DNA, 25 bp, Mus musculus
acgatctgacgtgacaaactgctga

SEQ ID NO: 419821 - DNA, 25 bp, Mus musculus
caaactgctgacacgaggtgcatca

SEQ ID NO: 419822 - DNA, 25 bp, Mus musculus
acgaggtgcatcatccacgagggca

SEQ ID NO: 419823 - DNA, 25 bp, Mus musculus
catcatccacgagggcagagggaat

SEQ ID NO: 419824 - DNA, 25 bp, Mus musculus
gggcagagggaatgattaatttccc

SEQ ID NO: 419825 - DNA, 25 bp, Mus musculus
ctttcttcctcagcgttgaatcctg

SEQ ID NO: 419826 - DNA, 25 bp, Mus musculus
cagcgttgaatcctgcgtggaatgg

SEQ ID NO: 419827 - DNA, 25 bp, Mus musculus
actctgcacgtgcagtcggtcgcta

SEQ ID NO: 419828 - DNA, 25 bp, Mus musculus
agagacccggcagccctagacagca

SEQ ID NO: 419829 - DNA, 25 bp, Mus musculus
tccagcggatggtgttattaccaac

SEQ ID NO: 419830 - DNA, 25 bp, Mus musculus
tattaccaacgagaaggagctccgc

SEQ ID NO: 419831 - DNA, 25 bp, Mus musculus
agcacgctcctttccgtaagctggg

SEQ ID NO: 419832 - DNA, 25 bp, Mus musculus
gtccaacatcttggcgcagtccgtc

SEQ ID NO: 419833 - DNA, 25 bp, Mus musculus
tcccgggctctaaggagacaacttg

SEQ ID NO: 419834 - DNA, 25 bp, Mus musculus
ttgctatatccatgggacgcccggc

SEQ ID NO: 419835 - DNA, 25 bp, Mus musculus
agacaacttggttctccagcatccc

SEQ ID NO: 419836 - DNA, 25 bp, Mus musculus
cccagctcagtccagtgtagcagca

SEQ ID NO: 419837 - DNA, 25 bp, Mus musculus
tagcagcactagaacccagacccgg

SEQ ID NO: 419838 - DNA, 25 bp, Mus musculus
tcctctgtctaggtgacgtccctga

SEQ ID NO: 419839 - DNA, 25 bp, Mus musculus
ctctgtctcggtgtgcttgttaccc

SEQ ID NO: 419840 - DNA, 25 bp, Mus musculus
actattcgagcgttgcgacccagca

SEQ ID NO: 419841 - DNA, 25 bp, Mus musculus
cccacgatgctgttggaaccttcta

SEQ ID NO: 419842 - DNA, 25 bp, Mus musculus
cgacagcgggcaacgcaaggccagc

SEQ ID NO: 419843 - DNA, 25 bp, Mus musculus
tcccgcctcgcggaagctattgaga

SEQ ID NO: 419844 - DNA, 25 bp, Mus musculus
tgtctgtgtgtgtccgcgctcccgc

SEQ ID NO: 419845 - DNA, 25 bp, Mus musculus
cccagtacctgcgtgtgtgtcggtg

SEQ ID NO: 419846 - DNA, 25 bp, Mus musculus
gctttgtggaggattagcggtcacc

SEQ ID NO: 419847 - DNA, 25 bp, Mus musculus
atcagatttggagcctgagggaggc

SEQ ID NO: 419848 - DNA, 25 bp, Mus musculus
ggtcccagggcaggagttaacagcc

SEQ ID NO: 419849 - DNA, 25 bp, Mus musculus
tttcgtcctggaatagcaggaggga

SEQ ID NO: 419850 - DNA, 25 bp, Mus musculus
tcgcatcgggaaacagggtaccttc

SEQ ID NO: 419851 - DNA, 25 bp, Mus musculus
actagaagacgtcgcatcgggaaac

SEQ ID NO: 419852 - DNA, 25 bp, Mus musculus
atccgcgagaaaactagaagacgtc

SEQ ID NO: 419853 - DNA, 25 bp, Mus musculus
tccggccagacatccgcgagaaaac

SEQ ID NO: 419854 - DNA, 25 bp, Mus musculus
agactcctgggtgcatccggccaga

SEQ ID NO: 419855 - DNA, 25 bp, Mus musculus
aagctattgagaacgtgtgcacccg

SEQ ID NO: 419856 - DNA, 25 bp, Mus musculus
tcacttaactgttccccgctggggc

SEQ ID NO: 419857 - DNA, 25 bp, Mus musculus
tggctccaccctcggagcgctgctg

SEQ ID NO: 419858 - DNA, 25 bp, Mus musculus
tctgacgcagaagcagcttctcatc

SEQ ID NO: 419859 - DNA, 25 bp, Mus musculus
tcggctctgctaggcctcgccgtcc

SEQ ID NO: 419860 - DNA, 25 bp, Mus musculus
gcctccgctcggctctgctaggcct

SEQ ID NO: 419861 - DNA, 25 bp, Mus musculus
aagcagcttctcatcgcccgggcgg

SEQ ID NO: 419862 - DNA, 25 bp, Mus musculus
agaagcagcttctcatcgcccgggc

SEQ ID NO: 419863 - DNA, 25 bp, Mus musculus
gcgcgggcctcacttaactgttccc

SEQ ID NO: 419864 - DNA, 25 bp, Mus musculus
ggtggagatcgtcgcccctcacctg

SEQ ID NO: 419865 - DNA, 25 bp, Mus musculus
tgtccccagcgtgtgccccggtgga

SEQ ID NO: 419866 - DNA, 25 bp, Mus musculus
caggcgagtcaagggaactgtcccc

SEQ ID NO: 419867 - DNA, 25 bp, Mus musculus
tccgcacccacgtgacagctgagag

SEQ ID NO: 419868 - DNA, 25 bp, Mus musculus
atccgcacccacgtgacagctgaga

SEQ ID NO: 419869 - DNA, 25 bp, Mus musculus
gtcccggctccgtctgacgcagaag

SEQ ID NO: 419870 - DNA, 25 bp, Mus musculus
tgttttgcaacgaggccgaattggg

SEQ ID NO: 419871 - DNA, 25 bp, Mus musculus
tccttcaggatggaaggcgactggc

SEQ ID NO: 419872 - DNA, 25 bp, Mus musculus
ggggcacagatcttcattagcgccc

SEQ ID NO: 419873 - DNA, 25 bp, Mus musculus
taaagacttgttttgcaacgaggcc

SEQ ID NO: 419874 - DNA, 25 bp, Mus musculus
gcgccaattccctaataaagacttg

SEQ ID NO: 419875 - DNA, 25 bp, Mus musculus
acgagcaggcgccaattccctaata

SEQ ID NO: 419876 - DNA, 25 bp, Mus musculus
tccagcctgcgtggtaggacgagca

SEQ ID NO: 419877 - DNA, 25 bp, Mus musculus
gttaattcatgtcacccttcgcacc

SEQ ID NO: 419878 - DNA, 25 bp, Mus musculus
caggggccgctgttaattcatgtca

SEQ ID NO: 419879 - DNA, 25 bp, Mus musculus
tctgtctctgcaccgccagcgaggg

SEQ ID NO: 419880 - DNA, 25 bp, Mus musculus
ggagccgaacccgtctgtctctgca

SEQ ID NO: 419881 - DNA, 25 bp, Mus musculus
atggtggcaggagccgaacccgtct

SEQ ID NO: 419882 - DNA, 25 bp, Mus musculus
cttgtcaaccagacgctggatggtg

SEQ ID NO: 419883 - DNA, 25 bp, Mus musculus
ggcgactggcgccttgtcaaccaga

SEQ ID NO: 419884 - DNA, 25 bp, Mus musculus
tccgcaaagtttgccaagcggccct

SEQ ID NO: 419885 - DNA, 25 bp, Mus musculus
aggagtgacccgtgcatgaggctcc

SEQ ID NO: 419886 - DNA, 25 bp, Mus musculus
ccagcgggcggctaataatcagcgg

SEQ ID NO: 419887 - DNA, 25 bp, Mus musculus
agcggccctccctctagagaacttg

SEQ ID NO: 419888 - DNA, 25 bp, Mus musculus
ctctagagaacttggcgctcccgca

SEQ ID NO: 419889 - DNA, 25 bp, Mus musculus
gcaggcggagaaagttgcacttccc

SEQ ID NO: 419890 - DNA, 25 bp, Mus musculus
cagggcacggacgaagcaatgatcg

SEQ ID NO: 419891 - DNA, 25 bp, Mus musculus
gcgagcaactttgcccgcgcgatgg

SEQ ID NO: 419892 - DNA, 25 bp, Mus musculus
gcttaatgagacgacaccaactttg

SEQ ID NO: 419893 - DNA, 25 bp, Mus musculus
gaggatgtcgccgatgtcctgcttc

SEQ ID NO: 419894 - DNA, 25 bp, Mus musculus
cagagtctgcagcatcctggattga

SEQ ID NO: 419895 - DNA, 25 bp, Mus musculus
tggattgatcgtccatcccgccgcg

SEQ ID NO: 419896 - DNA, 25 bp, Mus musculus
aatgatcgagtttgtcccgagcccg

SEQ ID NO: 419897 - DNA, 25 bp, Mus musculus
caacgcccaagctccacaagaggag

SEQ ID NO: 419898 - DNA, 25 bp, Mus musculus
gtcccaattggagcgttcgaaagtc

SEQ ID NO: 419899 - DNA, 25 bp, Mus musculus
cacagggccaatcgcattgcgctca

SEQ ID NO: 419900 - DNA, 25 bp, Mus musculus
cttcatatcaagaggtggtaccctc

SEQ ID NO: 419901 - DNA, 25 bp, Mus musculus
ctgggatactttcccgctcttcata

SEQ ID NO: 419902 - DNA, 25 bp, Mus musculus
gcctcggacagtgcctgggatactt

SEQ ID NO: 419903 - DNA, 25 bp, Mus musculus
ttgcatgagatgagcttcacgcctc

SEQ ID NO: 419904 - DNA, 25 bp, Mus musculus
taaagtgtacccgtagccgacagcg

SEQ ID NO: 419905 - DNA, 25 bp, Mus musculus
gcccgtcccacggtcgctatggtaa

SEQ ID NO: 419906 - DNA, 25 bp, Mus musculus
tccacagatggtcggtcagtccagc

SEQ ID NO: 419907 - DNA, 25 bp, Mus musculus
cctattattagcagttggggactta

SEQ ID NO: 419908 - DNA, 25 bp, Mus musculus
agcccgggagccttatgggctactc

SEQ ID NO: 419909 - DNA, 25 bp, Mus musculus
gcggagccttctctcattgggcttt

SEQ ID NO: 419910 - DNA, 25 bp, Mus musculus
ggatcctgctccttccctattatta

SEQ ID NO: 419911 - DNA, 25 bp, Mus musculus
tcagtccagccagcaaagtgttgtc

SEQ ID NO: 419912 - DNA, 25 bp, Mus musculus
taggactgccgaggacttcgtaggc

SEQ ID NO: 419913 - DNA, 25 bp, Mus musculus
gcgggaccctccgacctctcagcac

SEQ ID NO: 419914 - DNA, 25 bp, Mus musculus
gagcagcttcaggtaaaggttgccc

SEQ ID NO: 419915 - DNA, 25 bp, Mus musculus
tagtgtgggagcagcttcaggtaaa

SEQ ID NO: 419916 - DNA, 25 bp, Mus musculus
tcgggacctccctcagggacgtgtc

SEQ ID NO: 419917 - DNA, 25 bp, Mus musculus
ctctgggtaacagggctgctgttgc

SEQ ID NO: 419918 - DNA, 25 bp, Mus musculus
ttgcagatcggggacttccggtacg

SEQ ID NO: 419919 - DNA, 25 bp, Mus musculus
ccagccaaaggcgtcttgcagatcg

SEQ ID NO: 419920 - DNA, 25 bp, Mus musculus
gctctggggcttgcgcactgcgtcc

SEQ ID NO: 419921 - DNA, 25 bp, Mus musculus
cttctcgttcctggctctggggctt

SEQ ID NO: 419922 - DNA, 25 bp, Mus musculus
agcgacttctcgttcctggctctgg

SEQ ID NO: 419923 - DNA, 25 bp, Mus musculus
cgggaggcagcgacttctcgttcct

SEQ ID NO: 419924 - DNA, 25 bp, Mus musculus
gcacgcatgcgcaaccacccaccag

SEQ ID NO: 419925 - DNA, 25 bp, Mus musculus
tccctcagggacgtgtcccgggcga

SEQ ID NO: 419926 - DNA, 25 bp, Mus musculus
ttgccaggacctgtacgccgatcct

SEQ ID NO: 419927 - DNA, 25 bp, Mus musculus
tggcggcgctcccaagccattcggt

SEQ ID NO: 419928 - DNA, 25 bp, Mus musculus
caagccattcggtccgctcctggcc

SEQ ID NO: 419929 - DNA, 25 bp, Mus musculus
gcccacagaggcgacccgcgctact

SEQ ID NO: 419930 - DNA, 25 bp, Mus musculus
gcttcccacccgagcgacgccgggc

SEQ ID NO: 419931 - DNA, 25 bp, Mus musculus
ggacgcgcactcaccggtgaggtca

SEQ ID NO: 419932 - DNA, 25 bp, Mus musculus
cactcaccggtgaggtcatgcggag

SEQ ID NO: 419933 - DNA, 25 bp, Mus musculus
aggtcctcgctggactgcctctcgg

SEQ ID NO: 419934 - DNA, 25 bp, Mus musculus
tgcctctcggcctcggagccgtcgc

SEQ ID NO: 419935 - DNA, 25 bp, Mus musculus
cgccctcgctgcgaactgccaccgc

SEQ ID NO: 419936 - DNA, 25 bp, Mus musculus
gccgccacagatcgccagtcggttt

SEQ ID NO: 419937 - DNA, 25 bp, Mus musculus
acagatcgccagtcggtttccctgc

SEQ ID NO: 419938 - DNA, 25 bp, Mus musculus
gcgaaccgccttgccaggacctgta

SEQ ID NO: 419939 - DNA, 25 bp, Mus musculus
agtcggtttccctgcctcctgcggc

SEQ ID NO: 419940 - DNA, 25 bp, Mus musculus
tggagatggccgcaatccaagcccg

SEQ ID NO: 419941 - DNA, 25 bp, Mus musculus
tgacaggcgcttaccacagctaatc

SEQ ID NO: 419942 - DNA, 25 bp, Mus musculus
cgctgacagcaggagaaccagggtc

SEQ ID NO: 419943 - DNA, 25 bp, Mus musculus
aggcctggagatggccgcaatccaa

SEQ ID NO: 419944 - DNA, 25 bp, Mus musculus
ggcgcttaccacagctaatcgaggc

SEQ ID NO: 419945 - DNA, 25 bp, Mus musculus
tgctcctgcggcctctgtatggggc

SEQ ID NO: 419946 - DNA, 25 bp, Mus musculus
acaaactgctcctgcggcctctgta

SEQ ID NO: 419947 - DNA, 25 bp, Mus musculus
cgtgcgactgcagcacaaactgctc

SEQ ID NO: 419948 - DNA, 25 bp, Mus musculus
agacgttgaaccaggcgtgcgactg

SEQ ID NO: 419949 - DNA, 25 bp, Mus musculus
tgggcaagctgaccaccggcaccga

SEQ ID NO: 419950 - DNA, 25 bp, Mus musculus
ttacccgagcttgcccactgggcaa

SEQ ID NO: 419951 - DNA, 25 bp, Mus musculus
accagggtctcttacccgagcttgc

SEQ ID NO: 419952 - DNA, 25 bp, Mus musculus
agcaggagaaccagggtctcttacc

SEQ ID NO: 419953 - DNA, 25 bp, Mus musculus
cacagctaatcgaggcctggagatg

SEQ ID NO: 419954 - DNA, 25 bp, Mus musculus
acactgacctggacacttgggcttc

SEQ ID NO: 419955 - DNA, 25 bp, Mus musculus
aaggccgcgtacttcttcagagtga

SEQ ID NO: 419956 - DNA, 25 bp, Mus musculus
atcacgccgtcgtatgtggccttca

SEQ ID NO: 419957 - DNA, 25 bp, Mus musculus
gccgcgtggagatcatagccaacga

SEQ ID NO: 419958 - DNA, 25 bp, Mus musculus
ggcagctgctgaaccaataggacca

SEQ ID NO: 419959 - DNA, 25 bp, Mus musculus
ccgtcagcgtcggtgtgttcaagaa

SEQ ID NO: 419960 - DNA, 25 bp, Mus musculus
cggcatcgacttggggaccacctat

SEQ ID NO: 419961 - DNA, 25 bp, Mus musculus
ctcagcgccggcatgatgaagttca

SEQ ID NO: 419962 - DNA, 25 bp, Mus musculus
cctaagactcctgcctgactgctga

SEQ ID NO: 419963 - DNA, 25 bp, Mus musculus
gagtctgcttcgtgtctcctcctga

SEQ ID NO: 419964 - DNA, 25 bp, Mus musculus
tactggccgagacaacactgacctg

SEQ ID NO: 419965 - DNA, 25 bp, Mus musculus
gcggcctccaacgagtagcgacttc

SEQ ID NO: 419966 - DNA, 25 bp, Mus musculus
tgcctctcattggtggccgttaaga

SEQ ID NO: 419967 - DNA, 25 bp, Mus musculus
gccacagcctgttgctggactccta

SEQ ID NO: 419968 - DNA, 25 bp, Mus musculus
cggagcttaggagcccgtcctcttc

SEQ ID NO: 419969 - DNA, 25 bp, Mus musculus
ggcatccggtccataactccaattt

SEQ ID NO: 419970 - DNA, 25 bp, Mus musculus
aggccaaccgctctacgcctccggg

SEQ ID NO: 419971 - DNA, 25 bp, Mus musculus
gtactggttggcatccggtccataa

SEQ ID NO: 419972 - DNA, 25 bp, Mus musculus
atccggtccataactccaatttcgg

SEQ ID NO: 419973 - DNA, 25 bp, Mus musculus
ctctgcgtactggttggcatccggt

SEQ ID NO: 419974 - DNA, 25 bp, Mus musculus
aactctgcgtactggttggcatccg

SEQ ID NO: 419975 - DNA, 25 bp, Mus musculus
ctccgggactacgcgccaaacttag

SEQ ID NO: 419976 - DNA, 25 bp, Mus musculus
cgccaaacttagtcagggcctcccg

SEQ ID NO: 419977 - DNA, 25 bp, Mus musculus
gcctcccggaactctgcgtactggt

SEQ ID NO: 419978 - DNA, 25 bp, Mus musculus
ggttggcatccggtccataactcca

SEQ ID NO: 419979 - DNA, 25 bp, Mus musculus
ctcccggaactctgcgtactggttg

SEQ ID NO: 419980 - DNA, 25 bp, Mus musculus
ccggaactctgcgtactggttggca

SEQ ID NO: 419981 - DNA, 25 bp, Mus musculus
accgctctacgcctccgggtctccg

SEQ ID NO: 419982 - DNA, 25 bp, Mus musculus
gcaccggccaggtctgtagttactg

SEQ ID NO: 419983 - DNA, 25 bp, Mus musculus
tgggtcactcagactctgcaaagtc

SEQ ID NO: 419984 - DNA, 25 bp, Mus musculus
gtgtccacgacgcagcaaaggagta

SEQ ID NO: 419985 - DNA, 25 bp, Mus musculus
agccgcgggtccagcagaaaagacc

SEQ ID NO: 419986 - DNA, 25 bp, Mus musculus
ccctaggagagtgggcgttagtcac

SEQ ID NO: 419987 - DNA, 25 bp, Mus musculus
ttagtcacgcgccagtcgcttgtgg

SEQ ID NO: 419988 - DNA, 25 bp, Mus musculus
accgcagggagacctgagcgattgc

SEQ ID NO: 419989 - DNA, 25 bp, Mus musculus
gaggaatttactccgccagcgactg

SEQ ID NO: 419990 - DNA, 25 bp, Mus musculus
agataggaattacagaccgcaggga

SEQ ID NO: 419991 - DNA, 25 bp, Mus musculus
ttactgcgacaacgtggtcactcgg

SEQ ID NO: 419992 - DNA, 25 bp, Mus musculus
tgagggctcctctgggaggaattta

SEQ ID NO: 419993 - DNA, 25 bp, Mus musculus
atttcgtcttcccaagcggagcgcg

SEQ ID NO: 419994 - DNA, 25 bp, Mus musculus
gtttcaagaagccagagggtgattc

SEQ ID NO: 419995 - DNA, 25 bp, Mus musculus
gcgggacaggatgcatttcgtcttc

SEQ ID NO: 419996 - DNA, 25 bp, Mus musculus
cagcgatgcggtttgttctccctaa

SEQ ID NO: 419997 - DNA, 25 bp, Mus musculus
cgtgtcggggttctgaagagagtca

SEQ ID NO: 419998 - DNA, 25 bp, Mus musculus
ctgaagagagtcaggctttgacgtc

SEQ ID NO: 419999 - DNA, 25 bp, Mus musculus
agagtcaggctttgacgtcactgcg

SEQ ID NO: 420000 - DNA, 25 bp, Mus musculus
cgggttctcgtggagacccgacgcg

SEQ ID NO: 420001 - DNA, 25 bp, Mus musculus
tcaggctttgacgtcactgcgcaga

SEQ ID NO: 420002 - DNA, 25 bp, Mus musculus
gcgatgcggtttgttctccctaaaa

SEQ ID NO: 420003 - DNA, 25 bp, Mus musculus
tgcggtttgttctccctaaaatggc

SEQ ID NO: 420004 - DNA, 25 bp, Mus musculus
ccgctggcagcgatgcggtttgttc

SEQ ID NO: 420005 - DNA, 25 bp, Mus musculus
ctccgccgctggcagcgatgcggtt

SEQ ID NO: 420006 - DNA, 25 bp, Mus musculus
gcgcagactccactcacgggtcgga

SEQ ID NO: 420007 - DNA, 25 bp, Mus musculus
aggctttgacgtcactgcgcagact

SEQ ID NO: 420008 - DNA, 25 bp, Mus musculus
agtcaggctttgacgtcactgcgca

SEQ ID NO: 420009 - DNA, 25 bp, Mus musculus
gatgcggtttgttctccctaaaatg

SEQ ID NO: 420010 - DNA, 25 bp, Mus musculus
agatcccgggggatgtcacgatccc

SEQ ID NO: 420011 - DNA, 25 bp, Mus musculus
ctggacaagtatgtggagatagcgc

SEQ ID NO: 420012 - DNA, 25 bp, Mus musculus
gagatagcgcggcagtgcaagtacc

SEQ ID NO: 420013 - DNA, 25 bp, Mus musculus
atagcgcggcagtgcaagtaccttc

SEQ ID NO: 420014 - DNA, 25 bp, Mus musculus
aggccgtccagcttgcgaggcaagc

SEQ ID NO: 420015 - DNA, 25 bp, Mus musculus
tgacgcggagaaccaggggagcccg

SEQ ID NO: 420016 - DNA, 25 bp, Mus musculus
gggagcccggatcccccgaatgctg

SEQ ID NO: 420017 - DNA, 25 bp, Mus musculus
ccgaatgctgtccagttctttgagg

SEQ ID NO: 420018 - DNA, 25 bp, Mus musculus
aacaggagccgctgtctgctccagg

SEQ ID NO: 420019 - DNA, 25 bp, Mus musculus
gtccagttctttgaggggagatccc

SEQ ID NO: 420020 - DNA, 25 bp, Mus musculus
tgaccctcacgggactccgagctta

SEQ ID NO: 420021 - DNA, 25 bp, Mus musculus
gaccctcacgggactccgagcttaa

SEQ ID NO: 420022 - DNA, 25 bp, Mus musculus
gccgagcgggtagtgctcccgggat

SEQ ID NO: 420023 - DNA, 25 bp, Mus musculus
ctgtccagttctttgaggggagatc

SEQ ID NO: 420024 - DNA, 25 bp, Mus musculus
gcgctggggattcctgtccagcccg

SEQ ID NO: 420025 - DNA, 25 bp, Mus musculus
ttccgcgcggcactgacctgagcga

SEQ ID NO: 420026 - DNA, 25 bp, Mus musculus
ccggccaatcgcaaatacagacctg

SEQ ID NO: 420027 - DNA, 25 bp, Mus musculus
cgtcgggcggaagcggctctacttc

SEQ ID NO: 420028 - DNA, 25 bp, Mus musculus
tctccgcgcgccattccggcgccca

SEQ ID NO: 420029 - DNA, 25 bp, Mus musculus
ggtgctgctgcgtcatctccgcgcg

SEQ ID NO: 420030 - DNA, 25 bp, Mus musculus
ccgcagcctcacaggggagcggctt

SEQ ID NO: 420031 - DNA, 25 bp, Mus musculus
tacagacctggacctacggccgctg

SEQ ID NO: 420032 - DNA, 25 bp, Mus musculus
tcgcaaatacagacctggacctacg

SEQ ID NO: 420033 - DNA, 25 bp, Mus musculus
cggcccggccaatcgcaaatacaga

SEQ ID NO: 420034 - DNA, 25 bp, Mus musculus
cgggctcacaccgactaggcgcgct

SEQ ID NO: 420035 - DNA, 25 bp, Mus musculus
tcctggagccgtgttccgcgcggca

SEQ ID NO: 420036 - DNA, 25 bp, Mus musculus
tcagcccgttcgtgactcccttggt

SEQ ID NO: 420037 - DNA, 25 bp, Mus musculus
ccacagccatggcgcctgcggggaa

SEQ ID NO: 420038 - DNA, 25 bp, Mus musculus
cgcgagatcttacggagcgaagcct

SEQ ID NO: 420039 - DNA, 25 bp, Mus musculus
agtctcgcgagatcctttctcaacg

SEQ ID NO: 420040 - DNA, 25 bp, Mus musculus
tgcaccactgactgcagcgcacgaa

SEQ ID NO: 420041 - DNA, 25 bp, Mus musculus
tgtgcaggaagttttcggcatcttc

SEQ ID NO: 420042 - DNA, 25 bp, Mus musculus
cctgattaagagaagtttggggccg

SEQ ID NO: 420043 - DNA, 25 bp, Mus musculus
cgccggtttgacgtctgtcagccaa

SEQ ID NO: 420044 - DNA, 25 bp, Mus musculus
ccgggatgactgaacccgagtccga

SEQ ID NO: 420045 - DNA, 25 bp, Mus musculus
cctccgtgacggaaccgggatgact

SEQ ID NO: 420046 - DNA, 25 bp, Mus musculus
ctttgtgcacgctctccgcagaggc

SEQ ID NO: 420047 - DNA, 25 bp, Mus musculus
gccgggagactaagagactgagacc

SEQ ID NO: 420048 - DNA, 25 bp, Mus musculus
agcctcccagcagatctgtcaagtc

SEQ ID NO: 420049 - DNA, 25 bp, Mus musculus
gagcgcctctctgaatctcgcgaga

SEQ ID NO: 420050 - DNA, 25 bp, Mus musculus
cttccagagtctgcgcgtgacgtaa

SEQ ID NO: 420051 - DNA, 25 bp, Mus musculus
accgcccaggggatcaagaggcttt

SEQ ID NO: 420052 - DNA, 25 bp, Mus musculus
cccatcggcacagaaatgcttgttt

SEQ ID NO: 420053 - DNA, 25 bp, Mus musculus
cgcatgattcatgcgccgaggcctc

SEQ ID NO: 420054 - DNA, 25 bp, Mus musculus
caggaagcgcgcatgattcatgcgc

SEQ ID NO: 420055 - DNA, 25 bp, Mus musculus
tccagttcaaatccgcggcactggg

SEQ ID NO: 420056 - DNA, 25 bp, Mus musculus
gattggctgattcaaacccatcggc

SEQ ID NO: 420057 - DNA, 25 bp, Mus musculus
attcaaacccatcggcacagaaatg

SEQ ID NO: 420058 - DNA, 25 bp, Mus musculus
ttcccgtcggagtccagttcaaatc

SEQ ID NO: 420059 - DNA, 25 bp, Mus musculus
cacagaaatgcttgtttgcgggttc

SEQ ID NO: 420060 - DNA, 25 bp, Mus musculus
agaaatgcttgtttgcgggttcccg

SEQ ID NO: 420061 - DNA, 25 bp, Mus musculus
attcatgcgccgaggcctctccagg

SEQ ID NO: 420062 - DNA, 25 bp, Mus musculus
tcaaatccgcggcactgggcgcgcg

SEQ ID NO: 420063 - DNA, 25 bp, Mus musculus
ccgtcggagtccagttcaaatccgc

SEQ ID NO: 420064 - DNA, 25 bp, Mus musculus
tggctgattcaaacccatcggcaca

SEQ ID NO: 420065 - DNA, 25 bp, Mus musculus
ggagtccagttcaaatccgcggcac

SEQ ID NO: 420066 - DNA, 25 bp, Mus musculus
cccatcccacaagcgcgcagcctcc

SEQ ID NO: 420067 - DNA, 25 bp, Mus musculus
gagggtaccgctcgggctccatctc

SEQ ID NO: 420068 - DNA, 25 bp, Mus musculus
gcccggggatcctagggctcaatct

SEQ ID NO: 420069 - DNA, 25 bp, Mus musculus
tagggctcaatctaggtttctagga

SEQ ID NO: 420070 - DNA, 25 bp, Mus musculus
caatctaggtttctaggagaggggt

SEQ ID NO: 420071 - DNA, 25 bp, Mus musculus
tcgtgtgcagggattaaagcgtgaa

SEQ ID NO: 420072 - DNA, 25 bp, Mus musculus
tgcagggattaaagcgtgaaacgcg

SEQ ID NO: 420073 - DNA, 25 bp, Mus musculus
ctgccctgagggtaccgctcgggct

SEQ ID NO: 420074 - DNA, 25 bp, Mus musculus
tgaaacgcggacactcccggggcgc

SEQ ID NO: 420075 - DNA, 25 bp, Mus musculus
gggacttaccgcgaggcagcgcgtc

SEQ ID NO: 420076 - DNA, 25 bp, Mus musculus
agccggtcccacttggagtctggcc

SEQ ID NO: 420077 - DNA, 25 bp, Mus musculus
tcccacttggagtctggccaccagg

SEQ ID NO: 420078 - DNA, 25 bp, Mus musculus
gagtctggccaccaggcacatcggc

SEQ ID NO: 420079 - DNA, 25 bp, Mus musculus
ttaaagcgtgaaacgcggacactcc

SEQ ID NO: 420080 - DNA, 25 bp, Mus musculus
aggtgtgccggctccggacgcattc

SEQ ID NO: 420081 - DNA, 25 bp, Mus musculus
cgtcccgtccactagtccgtgtcgg

SEQ ID NO: 420082 - DNA, 25 bp, Mus musculus
accaagctggccctctcggcaaccg

SEQ ID NO: 420083 - DNA, 25 bp, Mus musculus
cggcaaccggcacaacacaacaaaa

SEQ ID NO: 420084 - DNA, 25 bp, Mus musculus
tcggtctcctgaggggaagtatccc

SEQ ID NO: 420085 - DNA, 25 bp, Mus musculus
tgaggggaagtatcccggcgtctcc

SEQ ID NO: 420086 - DNA, 25 bp, Mus musculus
gctaggccgttccttcccgtgctga

SEQ ID NO: 420087 - DNA, 25 bp, Mus musculus
ttccttcccgtgctgaggcggtgag

SEQ ID NO: 420088 - DNA, 25 bp, Mus musculus
gtgagtgtacttcggcgtccggacc

SEQ ID NO: 420089 - DNA, 25 bp, Mus musculus
agggctgaccacagcccgccaggtt

SEQ ID NO: 420090 - DNA, 25 bp, Mus musculus
aaagccctggtccagcgtgaggtgt

SEQ ID NO: 420091 - DNA, 25 bp, Mus musculus
cgccaggttcatacccggaagcttc

SEQ ID NO: 420092 - DNA, 25 bp, Mus musculus
ggttcatacccggaagcttcgcacc

SEQ ID NO: 420093 - DNA, 25 bp, Mus musculus
gcaaaggccggaaagccctggtcca

SEQ ID NO: 420094 - DNA, 25 bp, Mus musculus
atcttcctcgggctggcccaagatg

SEQ ID NO: 420095 - DNA, 25 bp, Mus musculus
gaggtgggaacacaccctccctgca

SEQ ID NO: 420096 - DNA, 25 bp, Mus musculus
acgccgaagcgctgccttttgttga

SEQ ID NO: 420097 - DNA, 25 bp, Mus musculus
cgctgccttttgttgaggccctgta

SEQ ID NO: 420098 - DNA, 25 bp, Mus musculus
ttctaagggttgacagtgtctgtcc

SEQ ID NO: 420099 - DNA, 25 bp, Mus musculus
gcctcccggcggagttactgcgcag

SEQ ID NO: 420100 - DNA, 25 bp, Mus musculus
aatccgtcagccgaggccctggcag

SEQ ID NO: 420101 - DNA, 25 bp, Mus musculus
tcgcacgctgttttctaagggttga

SEQ ID NO: 420102 - DNA, 25 bp, Mus musculus
caagcgtagtcgtgtgccacgcctc

SEQ ID NO: 420103 - DNA, 25 bp, Mus musculus
tggagactaacctgacggccacgcc

SEQ ID NO: 420104 - DNA, 25 bp, Mus musculus
cgcaatgggccggaccacaaaagaa

SEQ ID NO: 420105 - DNA, 25 bp, Mus musculus
ggcgctccctgcacagggtttcctg

SEQ ID NO: 420106 - DNA, 25 bp, Mus musculus
tccctcaggatcttcctcgggctgg

SEQ ID NO: 420107 - DNA, 25 bp, Mus musculus
tactgcgcaggttcgcacgctgttt

SEQ ID NO: 420108 - DNA, 25 bp, Mus musculus
gttggcgcgacagggcgagtactct

SEQ ID NO: 420109 - DNA, 25 bp, Mus musculus
gcttgtctccgcctacaagaggcaa

SEQ ID NO: 420110 - DNA, 25 bp, Mus musculus
tctccgcctacaagaggcaagcggg

SEQ ID NO: 420111 - DNA, 25 bp, Mus musculus
cagccaaggggaggtcccccgaatg

SEQ ID NO: 420112 - DNA, 25 bp, Mus musculus
cccgaatgtgcgcttaagccaagag

SEQ ID NO: 420113 - DNA, 25 bp, Mus musculus
gaatgtgcgcttaagccaagagccc

SEQ ID NO: 420114 - DNA, 25 bp, Mus musculus
cttaagccaagagccccgcgtgggc

SEQ ID NO: 420115 - DNA, 25 bp, Mus musculus
agtgggcggagcgaatggcaaacca

SEQ ID NO: 420116 - DNA, 25 bp, Mus musculus
tggcaaaccagagcttacgaaaact

SEQ ID NO: 420117 - DNA, 25 bp, Mus musculus
agagcttacgaaaactctctgcgta

SEQ ID NO: 420118 - DNA, 25 bp, Mus musculus
cgaaaactctctgcgtaaacggagc

SEQ ID NO: 420119 - DNA, 25 bp, Mus musculus
actctctgcgtaaacggagctcatg

SEQ ID NO: 420120 - DNA, 25 bp, Mus musculus
ctgcgtaaacggagctcatggtgtt

SEQ ID NO: 420121 - DNA, 25 bp, Mus musculus
taaacggagctcatggtgttggcgc

SEQ ID NO: 420122 - DNA, 25 bp, Mus musculus
cgcctagattcggtatgctgcagca

SEQ ID NO: 420123 - DNA, 25 bp, Mus musculus
gtcgtggtccgagctgaatttcctc

SEQ ID NO: 420124 - DNA, 25 bp, Mus musculus
catcaggtaaggaagcgggccgccc

SEQ ID NO: 420125 - DNA, 25 bp, Mus musculus
ccagctctgctgcatcaggtaagga

SEQ ID NO: 420126 - DNA, 25 bp, Mus musculus
tcccgtgcccatccgagatcgggtg

SEQ ID NO: 420127 - DNA, 25 bp, Mus musculus
ggagaaaagaggtgctcgctcactt

SEQ ID NO: 420128 - DNA, 25 bp, Mus musculus
gctgcagcaccggacctcacattga

SEQ ID NO: 420129 - DNA, 25 bp, Mus musculus
tggctttcttctaagggacctagga

SEQ ID NO: 420130 - DNA, 25 bp, Mus musculus
tctaagggacctaggactgtggctg

SEQ ID NO: 420131 - DNA, 25 bp, Mus musculus
cgaagaggagcggtgctaccgccac

SEQ ID NO: 420132 - DNA, 25 bp, Mus musculus
gtgctaccgccacgcctagattcgg

SEQ ID NO: 420133 - DNA, 25 bp, Mus musculus
agcacacagctggactgagccgtcg

SEQ ID NO: 420134 - DNA, 25 bp, Mus musculus
cccaaggccaggaaccagctgagca

SEQ ID NO: 420135 - DNA, 25 bp, Mus musculus
gctcgctcactttggctttcttcta

SEQ ID NO: 420136 - DNA, 25 bp, Mus musculus
ggtcctcagctagggcgggatggga

SEQ ID NO: 420137 - DNA, 25 bp, Mus musculus
ggcgaccaagggtccgcggccgcag

SEQ ID NO: 420138 - DNA, 25 bp, Mus musculus
ctcaccgtcgccatggctccgtacc

SEQ ID NO: 420139 - DNA, 25 bp, Mus musculus
acatcacggggcagggcccaagaga

SEQ ID NO: 420140 - DNA, 25 bp, Mus musculus
gcagccaccacatcacggggcaggg

SEQ ID NO: 420141 - DNA, 25 bp, Mus musculus
tgcagccaccacatcacggggcagg

SEQ ID NO: 420142 - DNA, 25 bp, Mus musculus
gtcgccttcccatgcagccaccaca

SEQ ID NO: 420143 - DNA, 25 bp, Mus musculus
gcactgtcgccttcccatgcagcca

SEQ ID NO: 420144 - DNA, 25 bp, Mus musculus
gctgtgcgcactgtcgccttcccat

SEQ ID NO: 420145 - DNA, 25 bp, Mus musculus
ccgctcttcactgctctgcgcgctg

SEQ ID NO: 420146 - DNA, 25 bp, Mus musculus
gccatggctccgtaccgctcttcac

SEQ ID NO: 420147 - DNA, 25 bp, Mus musculus
ccctgctgggcggtcctcagctagg

SEQ ID NO: 420148 - DNA, 25 bp, Mus musculus
cgcgggccgcaaggccctccctgct

SEQ ID NO: 420149 - DNA, 25 bp, Mus musculus
tccgtaccgctcttcactgctctgc

SEQ ID NO: 420150 - DNA, 25 bp, Mus musculus
cagggatccgctgagactggacatg

SEQ ID NO: 420151 - DNA, 25 bp, Mus musculus
gtatcagcccgagaacccaggaatg

SEQ ID NO: 420152 - DNA, 25 bp, Mus musculus
caggaatgaagaagacgacggctct

SEQ ID NO: 420153 - DNA, 25 bp, Mus musculus
tgcgccctcttgactgccatgcagg

SEQ ID NO: 420154 - DNA, 25 bp, Mus musculus
ctcacctctgaaggactcagggatc

SEQ ID NO: 420155 - DNA, 25 bp, Mus musculus
ggctcaagctctggtgcagtcccgc

SEQ ID NO: 420156 - DNA, 25 bp, Mus musculus
gctggactgccgtttgtcagacata

SEQ ID NO: 420157 - DNA, 25 bp, Mus musculus
catagtgctggagtcagagtcgctc

SEQ ID NO: 420158 - DNA, 25 bp, Mus musculus
gagtcgctcaaaaactcgtcagttc

SEQ ID NO: 420159 - DNA, 25 bp, Mus musculus
tcgtcagttcccaaagccggagctt

SEQ ID NO: 420160 - DNA, 25 bp, Mus musculus
gccggagctttactgagagccgtta

SEQ ID NO: 420161 - DNA, 25 bp, Mus musculus
ccgttagcaacgaaggggctcaagc

SEQ ID NO: 420162 - DNA, 25 bp, Mus musculus
cccgcccaataggtgcccgggaatg

SEQ ID NO: 420163 - DNA, 25 bp, Mus musculus
tctgcgaagcgcacacagtgcagtg

SEQ ID NO: 420164 - DNA, 25 bp, Mus musculus
cagcaggaggaaggccgagagcgct

SEQ ID NO: 420165 - DNA, 25 bp, Mus musculus
atccgagcaacagcggcgctgctct

SEQ ID NO: 420166 - DNA, 25 bp, Mus musculus
caccggagtacccttgggtcgccag

SEQ ID NO: 420167 - DNA, 25 bp, Mus musculus
ccctctggccggtgccgccaccgga

SEQ ID NO: 420168 - DNA, 25 bp, Mus musculus
agagcgctcgcggaacgcaaccagg

SEQ ID NO: 420169 - DNA, 25 bp, Mus musculus
cgacaagtggccagtgaggcgtgag

SEQ ID NO: 420170 - DNA, 25 bp, Mus musculus
tcccagtcgcggcagagcgacaagt

SEQ ID NO: 420171 - DNA, 25 bp, Mus musculus
cttcatccagacctcctgcagcctc

SEQ ID NO: 420172 - DNA, 25 bp, Mus musculus
gtgactgcttcatccagacctcctg

SEQ ID NO: 420173 - DNA, 25 bp, Mus musculus
cttcgcgctgcctgcggcgtcgctc

SEQ ID NO: 420174 - DNA, 25 bp, Mus musculus
tgaggctctggcgtccgtcccgctt

SEQ ID NO: 420175 - DNA, 25 bp, Mus musculus
ttctggcactcaggcggctgaggct

SEQ ID NO: 420176 - DNA, 25 bp, Mus musculus
cctttctggcactcaggcggctgag

SEQ ID NO: 420177 - DNA, 25 bp, Mus musculus
agcgctcgcggaacgcaaccaggcg

SEQ ID NO: 420178 - DNA, 25 bp, Mus musculus
cggcgtgatgcacgtgtgatgcatc

SEQ ID NO: 420179 - DNA, 25 bp, Mus musculus
ttcagtgtcagacgcccggcgggac

SEQ ID NO: 420180 - DNA, 25 bp, Mus musculus
aagccctcgcgtggcttcagtgtca

SEQ ID NO: 420181 - DNA, 25 bp, Mus musculus
ccaacacaacgtccggcgtgatgca

SEQ ID NO: 420182 - DNA, 25 bp, Mus musculus
gggagcctagagagtccactcccac

SEQ ID NO: 420183 - DNA, 25 bp, Mus musculus
agtgggagcctagagagtccactcc

SEQ ID NO: 420184 - DNA, 25 bp, Mus musculus
aggcaagtggcgtgcgccgacccga

SEQ ID NO: 420185 - DNA, 25 bp, Mus musculus
ctgcgctgtaggagacccggccgct

SEQ ID NO: 420186 - DNA, 25 bp, Mus musculus
tctgctgcgctggagacgggaccac

SEQ ID NO: 420187 - DNA, 25 bp, Mus musculus
aaagcaggccgggtgtgtgttgtct

SEQ ID NO: 420188 - DNA, 25 bp, Mus musculus
aacgtccggcgtgatgcacgtgtga

SEQ ID NO: 420189 - DNA, 25 bp, Mus musculus
ggcgggacccacctgatccgcaaaa

SEQ ID NO: 420190 - DNA, 25 bp, Mus musculus
tcgcgtggcttcagtgtcagacgcc

SEQ ID NO: 420191 - DNA, 25 bp, Mus musculus
gacccacctgatccgcaaaagcagg

SEQ ID NO: 420192 - DNA, 25 bp, Mus musculus
tcccacgcgaacttggtgtacttgg

SEQ ID NO: 420193 - DNA, 25 bp, Mus musculus
gagacatggtacctcggtccgcgtc

SEQ ID NO: 420194 - DNA, 25 bp, Mus musculus
gggcgcgaagctgcacacctcccca

SEQ ID NO: 420195 - DNA, 25 bp, Mus musculus
cgaagctgcacacctccccatcatg

SEQ ID NO: 420196 - DNA, 25 bp, Mus musculus
catggtacctcggtccgcgtccgct

SEQ ID NO: 420197 - DNA, 25 bp, Mus musculus
agacatggtacctcggtccgcgtcc

SEQ ID NO: 420198 - DNA, 25 bp, Mus musculus
tggtacctcggtccgcgtccgctcg

SEQ ID NO: 420199 - DNA, 25 bp, Mus musculus
tgagacatggtacctcggtccgcgt

SEQ ID NO: 420200 - DNA, 25 bp, Mus musculus
cttggcgcccgctgtgtctcggctc

SEQ ID NO: 420201 - DNA, 25 bp, Mus musculus
tggtgaggcgcccttggcgcccgct

SEQ ID NO: 420202 - DNA, 25 bp, Mus musculus
ccacgcgaacttggtgtacttggtg

SEQ ID NO: 420203 - DNA, 25 bp, Mus musculus
cccacgcgaacttggtgtacttggt

SEQ ID NO: 420204 - DNA, 25 bp, Mus musculus
gtcccacgcgaacttggtgtacttg

SEQ ID NO: 420205 - DNA, 25 bp, Mus musculus
gacatggtacctcggtccgcgtccg

SEQ ID NO: 420206 - DNA, 25 bp, Mus musculus
aacttggggaacatggagcagaaca

SEQ ID NO: 420207 - DNA, 25 bp, Mus musculus
tcggggataagagccaagcgaactc

SEQ ID NO: 420208 - DNA, 25 bp, Mus musculus
agcgaactcttgtcaactcacctgc

SEQ ID NO: 420209 - DNA, 25 bp, Mus musculus
cctgccaaacgatcgcaaaagcctt

SEQ ID NO: 420210 - DNA, 25 bp, Mus musculus
cgatgaaatctgtgtgggccaagga

SEQ ID NO: 420211 - DNA, 25 bp, Mus musculus
gtcgattgaccaaacaggtgcgccc

SEQ ID NO: 420212 - DNA, 25 bp, Mus musculus
agctggacctggctaagtagggcca

SEQ ID NO: 420213 - DNA, 25 bp, Mus musculus
tccttgggctacagcaaagaaggca

SEQ ID NO: 420214 - DNA, 25 bp, Mus musculus
cggtcatctctctgtccttgggcta

SEQ ID NO: 420215 - DNA, 25 bp, Mus musculus
ggtacctgcctcaaagcctgaagtt

SEQ ID NO: 420216 - DNA, 25 bp, Mus musculus
cactctgcggggacacgctctgcag

SEQ ID NO: 420217 - DNA, 25 bp, Mus musculus
acggtccttttctcaggcactggta

SEQ ID NO: 420218 - DNA, 25 bp, Mus musculus
taaggaaagagaagcttcggtcatc

SEQ ID NO: 420219 - DNA, 25 bp, Mus musculus
acagatcgggatgtcctggagttta

SEQ ID NO: 420220 - DNA, 25 bp, Mus musculus
ctttgtagggcagccttggtcttgc

SEQ ID NO: 420221 - DNA, 25 bp, Mus musculus
gctgcagcgacagaggagccgctcc

SEQ ID NO: 420222 - DNA, 25 bp, Mus musculus
atcctactactaccggctgctgcgg

SEQ ID NO: 420223 - DNA, 25 bp, Mus musculus
cgggaggccatcctactactaccgg

SEQ ID NO: 420224 - DNA, 25 bp, Mus musculus
cggcggcaacgccaggaagagcacc

SEQ ID NO: 420225 - DNA, 25 bp, Mus musculus
gggcagccttggtcttgcctgctgc

SEQ ID NO: 420226 - DNA, 25 bp, Mus musculus
agcgacagaggagccgctcccgcag

SEQ ID NO: 420227 - DNA, 25 bp, Mus musculus
agctactttgtagggcagccttggt

SEQ ID NO: 420228 - DNA, 25 bp, Mus musculus
gttggagctactttgtagggcagcc

SEQ ID NO: 420229 - DNA, 25 bp, Mus musculus
gactttccgggcgggtgccagccca

SEQ ID NO: 420230 - DNA, 25 bp, Mus musculus
ggccaggattttgcccgcactgact

SEQ ID NO: 420231 - DNA, 25 bp, Mus musculus
actccaggccaggattttgcccgca

SEQ ID NO: 420232 - DNA, 25 bp, Mus musculus
ccggacgactccaggccaggatttt

SEQ ID NO: 420233 - DNA, 25 bp, Mus musculus
cctgctgctgcaccagagcgcggga

SEQ ID NO: 420234 - DNA, 25 bp, Mus musculus
gcatcctcggccacggtcggaggca

SEQ ID NO: 420235 - DNA, 25 bp, Mus musculus
gcactcggctctgtcgccatggcaa

SEQ ID NO: 420236 - DNA, 25 bp, Mus musculus
aagggctccatcaagcgcaccaaga

SEQ ID NO: 420237 - DNA, 25 bp, Mus musculus
gcaccaagagccagcccaaactgga

SEQ ID NO: 420238 - DNA, 25 bp, Mus musculus
gacaatgagaggtgagcccgtcgcc

SEQ ID NO: 420239 - DNA, 25 bp, Mus musculus
gcacatctgcgctaagtagggcacg

SEQ ID NO: 420240 - DNA, 25 bp, Mus musculus
tggtttttgcccagacccggcagcg

SEQ ID NO: 420241 - DNA, 25 bp, Mus musculus
gctgtccgatacaaaaggcattttc

SEQ ID NO: 420242 - DNA, 25 bp, Mus musculus
cgagtccctcgctgtccgatacaaa

SEQ ID NO: 420243 - DNA, 25 bp, Mus musculus
gaagtggtgcctccaccctcaggac

SEQ ID NO: 420244 - DNA, 25 bp, Mus musculus
cattgttttctgagcagtgctgtgc

SEQ ID NO: 420245 - DNA, 25 bp, Mus musculus
cagcaagtgccctctcgggcatgtg

SEQ ID NO: 420246 - DNA, 25 bp, Mus musculus
cgaggtgggcattgttttctgagca

SEQ ID NO: 420247 - DNA, 25 bp, Mus musculus
gggactgtacccttcgttgctttca

SEQ ID NO: 420248 - DNA, 25 bp, Mus musculus
gagcccgttgccatgatctctcagg

SEQ ID NO: 420249 - DNA, 25 bp, Mus musculus
ccgcgaccaaactgccgccgccgtc

SEQ ID NO: 420250 - DNA, 25 bp, Mus musculus
gctgctgcgccgcatgacgctcagg

SEQ ID NO: 420251 - DNA, 25 bp, Mus musculus
agtctccgccggtagcgactcggtc

SEQ ID NO: 420252 - DNA, 25 bp, Mus musculus
tgctgcttctcagtctccgccggta

SEQ ID NO: 420253 - DNA, 25 bp, Mus musculus
cgccagcgtccacgccctgctgctt

SEQ ID NO: 420254 - DNA, 25 bp, Mus musculus
ggatccggcccacgtccttgggctg

SEQ ID NO: 420255 - DNA, 25 bp, Mus musculus
cgtgccttcacgagctggctcaggg

SEQ ID NO: 420256 - DNA, 25 bp, Mus musculus
agctgtccacggtgaccggccgcat

SEQ ID NO: 420257 - DNA, 25 bp, Mus musculus
gactgatcttgagcgcgtccaggga

SEQ ID NO: 420258 - DNA, 25 bp, Mus musculus
acctgagctggcgaagactgatctt

SEQ ID NO: 420259 - DNA, 25 bp, Mus musculus
ctccttccacctgagctggcgaaga

SEQ ID NO: 420260 - DNA, 25 bp, Mus musculus
cggttgacagggatagtcgccgcct

SEQ ID NO: 420261 - DNA, 25 bp, Mus musculus
gacctcacaagcgagcgcgtccacg

SEQ ID NO: 420262 - DNA, 25 bp, Mus musculus
cgggagaagcggtccgccattttgc

SEQ ID NO: 420263 - DNA, 25 bp, Mus musculus
tcacatcgctcggtttcacgcccgg

SEQ ID NO: 420264 - DNA, 25 bp, Mus musculus
ccgagccgaagaagcggcgtgaata

SEQ ID NO: 420265 - DNA, 25 bp, Mus musculus
tggtcctcggcgacgcccgtgttta

SEQ ID NO: 420266 - DNA, 25 bp, Mus musculus
ccaggagcaaaataggaggaaagcc

SEQ ID NO: 420267 - DNA, 25 bp, Mus musculus
ggaggcggaaccttcctctcacatc

SEQ ID NO: 420268 - DNA, 25 bp, Mus musculus
cgcccgtgtttacctgaaagtctcg

SEQ ID NO: 420269 - DNA, 25 bp, Mus musculus
aaagtctcggtcctcgttgaagcgg

SEQ ID NO: 420270 - DNA, 25 bp, Mus musculus
ctcggtcctcgttgaagcgggagaa

SEQ ID NO: 420271 - DNA, 25 bp, Mus musculus
cgcaggcctggaggcggaaccttcc

SEQ ID NO: 420272 - DNA, 25 bp, Mus musculus
tccgacgggaatcccgaaggcgcgc

SEQ ID NO: 420273 - DNA, 25 bp, Mus musculus
tcctcctcaggacgacgctctccgg

SEQ ID NO: 420274 - DNA, 25 bp, Mus musculus
ttttgccgctctcactcctcctcag

SEQ ID NO: 420275 - DNA, 25 bp, Mus musculus
aataggaggaaagccgagccgaaga

SEQ ID NO: 420276 - DNA, 25 bp, Mus musculus
cctgggactaaatttggctttgcct

SEQ ID NO: 420277 - DNA, 25 bp, Mus musculus
tccatgcaaaggagagacgaaatga

SEQ ID NO: 420278 - DNA, 25 bp, Mus musculus
cgaaatgaatatgcagcgcgggctg

SEQ ID NO: 420279 - DNA, 25 bp, Mus musculus
ccgccgcactataattttccaaaca

SEQ ID NO: 420280 - DNA, 25 bp, Mus musculus
ttccaaacaggatcttgcaatcagg

SEQ ID NO: 420281 - DNA, 25 bp, Mus musculus
ggatcttgcaatcagggccttattc

SEQ ID NO: 420282 - DNA, 25 bp, Mus musculus
tcagggccttattcattagcgcata

SEQ ID NO: 420283 - DNA, 25 bp, Mus musculus
ttcattagcgcataaacaattttgt

SEQ ID NO: 420284 - DNA, 25 bp, Mus musculus
aacaattttgtttctcggcactcga

SEQ ID NO: 420285 - DNA, 25 bp, Mus musculus
ttgtttctcggcactcgagcctgtc

SEQ ID NO: 420286 - DNA, 25 bp, Mus musculus
cggcactcgagcctgtcaatcatgc

SEQ ID NO: 420287 - DNA, 25 bp, Mus musculus
gtcaatcatgccgagagggaacatc

SEQ ID NO: 420288 - DNA, 25 bp, Mus musculus
ccgagagggaacatcttggccgaag

SEQ ID NO: 420289 - DNA, 25 bp, Mus musculus
cgcccgttcatctccatgcaaagga

SEQ ID NO: 420290 - DNA, 25 bp, Mus musculus
tgcccggtaccatctgcgcatgcgt

SEQ ID NO: 420291 - DNA, 25 bp, Mus musculus
ggcgaagcgtaagccattccaggaa

SEQ ID NO: 420292 - DNA, 25 bp, Mus musculus
gaagcgtaagccattccaggaagtc

SEQ ID NO: 420293 - DNA, 25 bp, Mus musculus
gcaagcgcactgctctagggccgct

SEQ ID NO: 420294 - DNA, 25 bp, Mus musculus
ttccaggaagtctagcggtcccgag

SEQ ID NO: 420295 - DNA, 25 bp, Mus musculus
gtaccatctgcgcatgcgtctccag

SEQ ID NO: 420296 - DNA, 25 bp, Mus musculus
ggctggccaagactgcccggtacca

SEQ ID NO: 420297 - DNA, 25 bp, Mus musculus
cctttggctggccaagactgcccgg

SEQ ID NO: 420298 - DNA, 25 bp, Mus musculus
gtgtcgcccgtctccttcaagtccc

SEQ ID NO: 420299 - DNA, 25 bp, Mus musculus
tgaccaggtgccctcggccgtgtcg

SEQ ID NO: 420300 - DNA, 25 bp, Mus musculus
gccattccaggaagtctagcggtcc

SEQ ID NO: 420301 - DNA, 25 bp, Mus musculus
cgtaagccattccaggaagtctagc

SEQ ID NO: 420302 - DNA, 25 bp, Mus musculus
gcggtagccgcgaccctgaccaggt

SEQ ID NO: 420303 - DNA, 25 bp, Mus musculus
atctgcgcatgcgtctccagcgacg

SEQ ID NO: 420304 - DNA, 25 bp, Mus musculus
ttcaccctagacctgaaggccgaga

SEQ ID NO: 420305 - DNA, 25 bp, Mus musculus
ctgactgtcctgttccgagggcact

SEQ ID NO: 420306 - DNA, 25 bp, Mus musculus
ctcaatgtagccgtgcaaggtgacc

SEQ ID NO: 420307 - DNA, 25 bp, Mus musculus
ggtgtatgctttttatgacgcgctc

SEQ ID NO: 420308 - DNA, 25 bp, Mus musculus
tgacgcgctcggcagttttgaaacc

SEQ ID NO: 420309 - DNA, 25 bp, Mus musculus
ctctcagtaatcaaggaaaagggtc

SEQ ID NO: 420310 - DNA, 25 bp, Mus musculus
gtaccactacgagcttcagcgcttc

SEQ ID NO: 420311 - DNA, 25 bp, Mus musculus
gcgcttccctaaggttcaccctaga

SEQ ID NO: 420312 - DNA, 25 bp, Mus musculus
aggcccgtcatgtccgctagcttct

SEQ ID NO: 420313 - DNA, 25 bp, Mus musculus
gaactgcgcctgcataacctgtggg

SEQ ID NO: 420314 - DNA, 25 bp, Mus musculus
cagcttcatccttggagcggcctca

SEQ ID NO: 420315 - DNA, 25 bp, Mus musculus
gggcggagtcacaagtcccgaacaa

SEQ ID NO: 420316 - DNA, 25 bp, Mus musculus
cctgcaattgctctgcggtgaagga

SEQ ID NO: 420317 - DNA, 25 bp, Mus musculus
ccacctggatgaccctgcgactgag

SEQ ID NO: 420318 - DNA, 25 bp, Mus musculus
ttccaaatcggctgcgggacaaagg

SEQ ID NO: 420319 - DNA, 25 bp, Mus musculus
ggccctcttgaggttctcgatcatg

SEQ ID NO: 420320 - DNA, 25 bp, Mus musculus
tcatggtgtcgtaatggatgcggca

SEQ ID NO: 420321 - DNA, 25 bp, Mus musculus
tggatgcggcaaagcaccttctcct

SEQ ID NO: 420322 - DNA, 25 bp, Mus musculus
accttctcctcaacgaggccgaatt

SEQ ID NO: 420323 - DNA, 25 bp, Mus musculus
aggccgaattcctcaccggtggata

SEQ ID NO: 420324 - DNA, 25 bp, Mus musculus
agcaggcgaaacatgccaggtggta

SEQ ID NO: 420325 - DNA, 25 bp, Mus musculus
catgccaggtggtaggcattgccgc

SEQ ID NO: 420326 - DNA, 25 bp, Mus musculus
cgcacccagtcactggcatagattt

SEQ ID NO: 420327 - DNA, 25 bp, Mus musculus
gcaccgggcgcacttggttccaaat

SEQ ID NO: 420328 - DNA, 25 bp, Mus musculus
aataatgtttagaccgggctcgtct

SEQ ID NO: 420329 - DNA, 25 bp, Mus musculus
gggctcgtctttatcctgctctatc

SEQ ID NO: 420330 - DNA, 25 bp, Mus musculus
atcctgctctatcgtccagggttcg

SEQ ID NO: 420331 - DNA, 25 bp, Mus musculus
catagatttgtctgccgcaccgggc

SEQ ID NO: 420332 - DNA, 25 bp, Mus musculus
gctctgctttcgtcagacgtacgta

SEQ ID NO: 420333 - DNA, 25 bp, Mus musculus
tacgtacgtactgatgatgctctgc

SEQ ID NO: 420334 - DNA, 25 bp, Mus musculus
ggcgtacgtactgatgatgctctgt

SEQ ID NO: 420335 - DNA, 25 bp, Mus musculus
cgtgatcagtcgtcaggcgtacgta

SEQ ID NO: 420336 - DNA, 25 bp, Mus musculus
tgctgggtcagaagtacaaccattc

SEQ ID NO: 420337 - DNA, 25 bp, Mus musculus
gagctgttccactccatccgcatgg

SEQ ID NO: 420338 - DNA, 25 bp, Mus musculus
ttcagccttggaagcgtgatcagtc

SEQ ID NO: 420339 - DNA, 25 bp, Mus musculus
attccgtcgactggtggtccttcgg

SEQ ID NO: 420340 - DNA, 25 bp, Mus musculus
gtacgtactaatgatgctctctctg

SEQ ID NO: 420341 - DNA, 25 bp, Mus musculus
cggagccatttcgaaccggcgcttg

SEQ ID NO: 420342 - DNA, 25 bp, Mus musculus
ttgccagaagatagcgtcctcagtc

SEQ ID NO: 420343 - DNA, 25 bp, Mus musculus
cgtcctcagtcgagcctgtagatca

SEQ ID NO: 420344 - DNA, 25 bp, Mus musculus
ggtaagacctgaagccaaagcctgg

SEQ ID NO: 420345 - DNA, 25 bp, Mus musculus
ctcgtttatgagatgctgattggcc

SEQ ID NO: 420346 - DNA, 25 bp, Mus musculus
ccgaaagcaggaccgaaaggactca

SEQ ID NO: 420347 - DNA, 25 bp, Mus musculus
aaggctcaacgagaggcggctccta

SEQ ID NO: 420348 - DNA, 25 bp, Mus musculus
gcaggaagcagccaaagctcacatt

SEQ ID NO: 420349 - DNA, 25 bp, Mus musculus
cgccctaggctggagtacaagaatg

SEQ ID NO: 420350 - DNA, 25 bp, Mus musculus
ccgaaatgtgccagggatgtcgcgc

SEQ ID NO: 420351 - DNA, 25 bp, Mus musculus
cgcgcaccgactgacaccgaaatgt

SEQ ID NO: 420352 - DNA, 25 bp, Mus musculus
tgaatctggtttcctcgcgcaccga

SEQ ID NO: 420353 - DNA, 25 bp, Mus musculus
agcgaagcgcttagccgagtactca

SEQ ID NO: 420354 - DNA, 25 bp, Mus musculus
tctgcgtctgactgagcctgaaatg

SEQ ID NO: 420355 - DNA, 25 bp, Mus musculus
gtccttgtccagagcgcctgccaag

SEQ ID NO: 420356 - DNA, 25 bp, Mus musculus
gggaggctctaccttcgtccttgtc

SEQ ID NO: 420357 - DNA, 25 bp, Mus musculus
gaaaggactcaccatggcaggcgga

SEQ ID NO: 420358 - DNA, 25 bp, Mus musculus
ctgctgaactggctcggagctgtca

SEQ ID NO: 420359 - DNA, 25 bp, Mus musculus
ctatcggcagttttccagcgcaggg

SEQ ID NO: 420360 - DNA, 25 bp, Mus musculus
cgattcaaacgcctttggagggcca

SEQ ID NO: 420361 - DNA, 25 bp, Mus musculus
ggcgctctcatgcttccagtacatg

SEQ ID NO: 420362 - DNA, 25 bp, Mus musculus
gcggggatattgacaccgattcaaa

SEQ ID NO: 420363 - DNA, 25 bp, Mus musculus
ccaagccaaagagggcgagatcggc

SEQ ID NO: 420364 - DNA, 25 bp, Mus musculus
ggaaagagaaccctccagactcttg

SEQ ID NO: 420365 - DNA, 25 bp, Mus musculus
tccagactcttggagctcccgggac

SEQ ID NO: 420366 - DNA, 25 bp, Mus musculus
gatcctcagcgttgcgccggcacaa

SEQ ID NO: 420367 - DNA, 25 bp, Mus musculus
aacctctggcgcatcggcgctatca

SEQ ID NO: 420368 - DNA, 25 bp, Mus musculus
tcggcgctatcagcgtctattcaga

SEQ ID NO: 420369 - DNA, 25 bp, Mus musculus
agacggacaatactggcctcgcctc

SEQ ID NO: 420370 - DNA, 25 bp, Mus musculus
tcgcctcctcttgattcgcctatgt

SEQ ID NO: 420371 - DNA, 25 bp, Mus musculus
cgcctatgtctttgctaaatcgctt

SEQ ID NO: 420372 - DNA, 25 bp, Mus musculus
tcggcgagtgaaatgaggccaaaaa

SEQ ID NO: 420373 - DNA, 25 bp, Mus musculus
gcataatgtgttcccgctttccgcg

SEQ ID NO: 420374 - DNA, 25 bp, Mus musculus
aaagcagcttccgacgctggggtcc

SEQ ID NO: 420375 - DNA, 25 bp, Mus musculus
agcgaagtcactaatgggattgtta

SEQ ID NO: 420376 - DNA, 25 bp, Mus musculus
cgcttattcttacacgttaaccacg

SEQ ID NO: 420377 - DNA, 25 bp, Mus musculus
cggggtcaggccaacaaccacggca

SEQ ID NO: 420378 - DNA, 25 bp, Mus musculus
ccgattcctggcagcgaagtcacta

SEQ ID NO: 420379 - DNA, 25 bp, Mus musculus
gggattgttatttccggccagagac

SEQ ID NO: 420380 - DNA, 25 bp, Mus musculus
ttccggccagagacaggacaatccg

SEQ ID NO: 420381 - DNA, 25 bp, Mus musculus
cccgcggccaggatggcactgagct

SEQ ID NO: 420382 - DNA, 25 bp, Mus musculus
ggtactcacctgctagcctcagagc

SEQ ID NO: 420383 - DNA, 25 bp, Mus musculus
agcgaaggacctgaggttacctctg

SEQ ID NO: 420384 - DNA, 25 bp, Mus musculus
tgaggttacctctgccgaaacaccg

SEQ ID NO: 420385 - DNA, 25 bp, Mus musculus
ctgtcccgcgtgtgtttctctatag

SEQ ID NO: 420386 - DNA, 25 bp, Mus musculus
gcgtgtgtttctctatagtcccggc

SEQ ID NO: 420387 - DNA, 25 bp, Mus musculus
tggcactgagcttcgggtactcacc

SEQ ID NO: 420388 - DNA, 25 bp, Mus musculus
gcttggcacccacagaccgcgaccg

SEQ ID NO: 420389 - DNA, 25 bp, Mus musculus
gcgaccgccagggtttaccgagcac

SEQ ID NO: 420390 - DNA, 25 bp, Mus musculus
tgaggcggcgcggaaacctcaagct

SEQ ID NO: 420391 - DNA, 25 bp, Mus musculus
gcgcggaaacctcaagctgctcttc

SEQ ID NO: 420392 - DNA, 25 bp, Mus musculus
ctgctcttcgtagcagctgtgactg

SEQ ID NO: 420393 - DNA, 25 bp, Mus musculus
cttcgtagcagctgtgactgggttc

SEQ ID NO: 420394 - DNA, 25 bp, Mus musculus
agcagctgtgactgggttctttctg

SEQ ID NO: 420395 - DNA, 25 bp, Mus musculus
actgggttctttctgcgtggtgaga

SEQ ID NO: 420396 - DNA, 25 bp, Mus musculus
agaggcgggttgctttgtgcaccga

SEQ ID NO: 420397 - DNA, 25 bp, Mus musculus
gtgcaccgaggcctcagctgattgt

SEQ ID NO: 420398 - DNA, 25 bp, Mus musculus
ccgaggcctcagctgattgtggcca

SEQ ID NO: 420399 - DNA, 25 bp, Mus musculus
ctcagctgattgtggccaggcgctt

SEQ ID NO: 420400 - DNA, 25 bp, Mus musculus
tggccaggcgcttggcacccacaga

SEQ ID NO: 420401 - DNA, 25 bp, Mus musculus
tgcgcagcgcgccagcccaatctcg

SEQ ID NO: 420402 - DNA, 25 bp, Mus musculus
gacctcctgtacctgcacgggggac

SEQ ID NO: 420403 - DNA, 25 bp, Mus musculus
agaagagagcagcgcccgcctgcaa

SEQ ID NO: 420404 - DNA, 25 bp, Mus musculus
ccctggcatccgctcagccctgaag

SEQ ID NO: 420405 - DNA, 25 bp, Mus musculus
ccgcctgcaacacgcgctccgctga

SEQ ID NO: 420406 - DNA, 25 bp, Mus musculus
tggcatccgctcagccctgaagctc

SEQ ID NO: 420407 - DNA, 25 bp, Mus musculus
ggggcgcgacctcctgtacctgcac

SEQ ID NO: 420408 - DNA, 25 bp, Mus musculus
agcagcgcccgcctgcaacacgcgc

SEQ ID NO: 420409 - DNA, 25 bp, Mus musculus
caggaagccgggcattgttccctgg

SEQ ID NO: 420410 - DNA, 25 bp, Mus musculus
ggaagccgggcattgttccctggca

SEQ ID NO: 420411 - DNA, 25 bp, Mus musculus
aagccgggcattgttccctggcaga

SEQ ID NO: 420412 - DNA, 25 bp, Mus musculus
ccgggcattgttccctggcagaggc

SEQ ID NO: 420413 - DNA, 25 bp, Mus musculus
gggagttcccggttcgcgcgcactg

SEQ ID NO: 420414 - DNA, 25 bp, Mus musculus
cggttcgcgcgcactggggagaaga

SEQ ID NO: 420415 - DNA, 25 bp, Mus musculus
gccgcggaggatcccccctgcggtc

SEQ ID NO: 420416 - DNA, 25 bp, Mus musculus
gttacgccactctggagcacccttt

SEQ ID NO: 420417 - DNA, 25 bp, Mus musculus
cttctcagaggacggttatcgcacg

SEQ ID NO: 420418 - DNA, 25 bp, Mus musculus
cgtggtatgcaatgagcgcttctca

SEQ ID NO: 420419 - DNA, 25 bp, Mus musculus
cttcgttctccaggagcgcgtggta

SEQ ID NO: 420420 - DNA, 25 bp, Mus musculus
gtggcctacattgcgggcttcgttc

SEQ ID NO: 420421 - DNA, 25 bp, Mus musculus
tacaccatggtgtcagtggcctaca

SEQ ID NO: 420422 - DNA, 25 bp, Mus musculus
ccatcatctttctgtccggctgcta

SEQ ID NO: 420423 - DNA, 25 bp, Mus musculus
tatttagtggacatgcagcgatttc

SEQ ID NO: 420424 - DNA, 25 bp, Mus musculus
tgctgcgcttccactttcttcacgg

SEQ ID NO: 420425 - DNA, 25 bp, Mus musculus
tctggatcctcacatggtcggtgtt

SEQ ID NO: 420426 - DNA, 25 bp, Mus musculus
caagaggagactcgttttgcccgtc

SEQ ID NO: 420427 - DNA, 25 bp, Mus musculus
gacggctctatgttcttctcgcaag

SEQ ID NO: 420428 - DNA, 25 bp, Mus musculus
aggtgccgtcctatctcagctataa

SEQ ID NO: 420429 - DNA, 25 bp, Mus musculus
ttcgtgggcctcaatagcctggacc

SEQ ID NO: 420430 - DNA, 25 bp, Mus musculus
cgccggatgcccgtgaaaattccaa

SEQ ID NO: 420431 - DNA, 25 bp, Mus musculus
ccgtgaaaattccaagtcctgcgcc

SEQ ID NO: 420432 - DNA, 25 bp, Mus musculus
cctgcaggcggagccttgaacgcta

SEQ ID NO: 420433 - DNA, 25 bp, Mus musculus
gccgtgggcttggtccatctccctt

SEQ ID NO: 420434 - DNA, 25 bp, Mus musculus
gggtgccctcaccaggtaggtgccc

SEQ ID NO: 420435 - DNA, 25 bp, Mus musculus
cccttccaggcggactccctgattc

SEQ ID NO: 420436 - DNA, 25 bp, Mus musculus
cacgcgtcccggaattcggtggcct

SEQ ID NO: 420437 - DNA, 25 bp, Mus musculus
tcccggaattcggtggcctgcaggc

SEQ ID NO: 420438 - DNA, 25 bp, Mus musculus
gcagatcctggggtgccctcaccag

SEQ ID NO: 420439 - DNA, 25 bp, Mus musculus
ctcggtcctgctcgcagatcctggg

SEQ ID NO: 420440 - DNA, 25 bp, Mus musculus
gaaggagtctctcgctctggtttcc

SEQ ID NO: 420441 - DNA, 25 bp, Mus musculus
cttctgcaggaaggagtctctcgct

SEQ ID NO: 420442 - DNA, 25 bp, Mus musculus
gccttgaacgctaggctcaactctc

SEQ ID NO: 420443 - DNA, 25 bp, Mus musculus
tcaactctctcttccttctgcagga

SEQ ID NO: 420444 - DNA, 25 bp, Mus musculus
acgctcgcctagagaaagagaagtg

SEQ ID NO: 420445 - DNA, 25 bp, Mus musculus
gaagcaaagtagttcgcccaaggcg

SEQ ID NO: 420446 - DNA, 25 bp, Mus musculus
atctcggcgtctgaggaggagctac

SEQ ID NO: 420447 - DNA, 25 bp, Mus musculus
cacaagaagcttatctcggcgtctg

SEQ ID NO: 420448 - DNA, 25 bp, Mus musculus
ggacgcacgctacccaatcacaaga

SEQ ID NO: 420449 - DNA, 25 bp, Mus musculus
aaaagctgccgtggactctgcggac

SEQ ID NO: 420450 - DNA, 25 bp, Mus musculus
agagaagtggccgaaagccttgagc

SEQ ID NO: 420451 - DNA, 25 bp, Mus musculus
gtcaccaacaaaggacgctcgccta

SEQ ID NO: 420452 - DNA, 25 bp, Mus musculus
agactagcagctcctgtcaccaaca

SEQ ID NO: 420453 - DNA, 25 bp, Mus musculus
gctccttctagactagcagctcctg

SEQ ID NO: 420454 - DNA, 25 bp, Mus musculus
cgctcagtctgctccttctagacta

SEQ ID NO: 420455 - DNA, 25 bp, Mus musculus
gcagttagttacctcgcctcgctca

SEQ ID NO: 420456 - DNA, 25 bp, Mus musculus
tagttcgcccaaggcgcgtaaactc

SEQ ID NO: 420457 - DNA, 25 bp, Mus musculus
cttgagcgacagagaaaaagctgcc

SEQ ID NO: 420458 - DNA, 25 bp, Mus musculus
tcctcaccacggaggcggacctgga

SEQ ID NO: 420459 - DNA, 25 bp, Mus musculus
aagatactgttcacttcacgcgaga

SEQ ID NO: 420460 - DNA, 25 bp, Mus musculus
agctctcgcgagaagatactgttca

SEQ ID NO: 420461 - DNA, 25 bp, Mus musculus
cggacctggagggatcccgatttag

SEQ ID NO: 420462 - DNA, 25 bp, Mus musculus
ttcgcatcaaaaagccctaccagag

SEQ ID NO: 420463 - DNA, 25 bp, Mus musculus
ctccatcgggagctacagggacagc

SEQ ID NO: 420464 - DNA, 25 bp, Mus musculus
gcgagattacgcaagcccgggagtt

SEQ ID NO: 420465 - DNA, 25 bp, Mus musculus
ctgttcacttcacgcgagattacgc

SEQ ID NO: 420466 - DNA, 25 bp, Mus musculus
tttcagggcctcaaactccatcggg

SEQ ID NO: 420467 - DNA, 25 bp, Mus musculus
ctcggcggcggtttcagggcctcaa

SEQ ID NO: 420468 - DNA, 25 bp, Mus musculus
ctctctgtcgtgtcaggtgcggccc

SEQ ID NO: 420469 - DNA, 25 bp, Mus musculus
agcgaggggcctctctgtcgtgtca

SEQ ID NO: 420470 - DNA, 25 bp, Mus musculus
tcaaaaagccctaccagagcgaggg

SEQ ID NO: 420471 - DNA, 25 bp, Mus musculus
tcccgatttagctctcgcgagaaga

SEQ ID NO: 420472 - DNA, 25 bp, Mus musculus
cccggaagaacatcctgagatgctc

SEQ ID NO: 420473 - DNA, 25 bp, Mus musculus
aaccgccaaggagccaaggagttga

SEQ ID NO: 420474 - DNA, 25 bp, Mus musculus
ctgtttgctgcgagcgaagaacgct

SEQ ID NO: 420475 - DNA, 25 bp, Mus musculus
cctgctccggtatgaagctgtttgc

SEQ ID NO: 420476 - DNA, 25 bp, Mus musculus
tatctaaatatcagcgagccgggtc

SEQ ID NO: 420477 - DNA, 25 bp, Mus musculus
ccgctgcaggaaagacagaaaaata

SEQ ID NO: 420478 - DNA, 25 bp, Mus musculus
agctttattcttcgcggagactgtc

SEQ ID NO: 420479 - DNA, 25 bp, Mus musculus
cttccggagtcaaccagctttattc

SEQ ID NO: 420480 - DNA, 25 bp, Mus musculus
cccaggccggaagatggacttagcc

SEQ ID NO: 420481 - DNA, 25 bp, Mus musculus
aaaactggctttgaggcttccgcgg

SEQ ID NO: 420482 - DNA, 25 bp, Mus musculus
ttcacttaccgactagcaaaactgg

SEQ ID NO: 420483 - DNA, 25 bp, Mus musculus
gggtgtactcactccttcagcctca

SEQ ID NO: 420484 - DNA, 25 bp, Mus musculus
gcacacggttcccaagtcgagcctt

SEQ ID NO: 420485 - DNA, 25 bp, Mus musculus
agcatgtctccgtcactttcactta

SEQ ID NO: 420486 - DNA, 25 bp, Mus musculus
cctgtctgcgaacaagccgtggtaa

SEQ ID NO: 420487 - DNA, 25 bp, Mus musculus
tcccgcccagggatgtggactcgct

SEQ ID NO: 420488 - DNA, 25 bp, Mus musculus
accgttgcctgcatgggcctgagca

SEQ ID NO: 420489 - DNA, 25 bp, Mus musculus
tcacgaagtgctcccgctgaccgtt

SEQ ID NO: 420490 - DNA, 25 bp, Mus musculus
tcttcttcgcggctgcagtcacgaa

SEQ ID NO: 420491 - DNA, 25 bp, Mus musculus
aaggcgggcccgagctctcttcttc

SEQ ID NO: 420492 - DNA, 25 bp, Mus musculus
tgagctctgctgcttgtggttcttc

SEQ ID NO: 420493 - DNA, 25 bp, Mus musculus
ccaatcggaatgctcggaggacgac

SEQ ID NO: 420494 - DNA, 25 bp, Mus musculus
ccatggtcatctccgccaatcggaa

SEQ ID NO: 420495 - DNA, 25 bp, Mus musculus
agacaacttccaggtcccatggtca

SEQ ID NO: 420496 - DNA, 25 bp, Mus musculus
agccctggccggacaaagacaactt

SEQ ID NO: 420497 - DNA, 25 bp, Mus musculus
ggggaaggtcgccatctacatctgg

SEQ ID NO: 420498 - DNA, 25 bp, Mus musculus
ctcgggtggcctccgaacttacaga

SEQ ID NO: 420499 - DNA, 25 bp, Mus musculus
ccctgagagggactttccgcgttgt

SEQ ID NO: 420500 - DNA, 25 bp, Mus musculus
gcactgcccggccttttaagatctg

SEQ ID NO: 420501 - DNA, 25 bp, Mus musculus
tgcacacacaatggccgggctctgc

SEQ ID NO: 420502 - DNA, 25 bp, Mus musculus
tcccgcagaggggaaccggcacaaa

SEQ ID NO: 420503 - DNA, 25 bp, Mus musculus
ctgggtcagttccaacggcatcttc

SEQ ID NO: 420504 - DNA, 25 bp, Mus musculus
cggcatcttcgtagctgtattcggc

SEQ ID NO: 420505 - DNA, 25 bp, Mus musculus
ggcgctcccttgcactgctttggaa

SEQ ID NO: 420506 - DNA, 25 bp, Mus musculus
actgctgactagtcggctctgttca

SEQ ID NO: 420507 - DNA, 25 bp, Mus musculus
tctgttcaaaagctcagggatgctc

SEQ ID NO: 420508 - DNA, 25 bp, Mus musculus
cacacaggaggtttccggagccaca

SEQ ID NO: 420509 - DNA, 25 bp, Mus musculus
tctccagttctgtcgggatgccaca

SEQ ID NO: 420510 - DNA, 25 bp, Mus musculus
tcgacgggcacccagatcttctgta

SEQ ID NO: 420511 - DNA, 25 bp, Mus musculus
agccaggtctctccagcctctggga

SEQ ID NO: 420512 - DNA, 25 bp, Mus musculus
gcctgcactcacatctgggcaacga

SEQ ID NO: 420513 - DNA, 25 bp, Mus musculus
tgcacgcggcgcaatctacaaccta

SEQ ID NO: 420514 - DNA, 25 bp, Mus musculus
aaggagccacttcacgtgagcaggg

SEQ ID NO: 420515 - DNA, 25 bp, Mus musculus
ctccgccgcagtcgctgtgttagct

SEQ ID NO: 420516 - DNA, 25 bp, Mus musculus
cccagttagaatccggctgccttct

SEQ ID NO: 420517 - DNA, 25 bp, Mus musculus
gcaggtccggtacagtcgccgttcc

SEQ ID NO: 420518 - DNA, 25 bp, Mus musculus
gcagcaggtccggtacagtcgccgt

SEQ ID NO: 420519 - DNA, 25 bp, Mus musculus
cggagcctccctgacggcgctcggc

SEQ ID NO: 420520 - DNA, 25 bp, Mus musculus
cggaaggagccacttcacgtgagca

SEQ ID NO: 420521 - DNA, 25 bp, Mus musculus
gaagctccgcctcgcgggagaacgc

SEQ ID NO: 420522 - DNA, 25 bp, Mus musculus
aggaagctccgcctcgcgggagaac

SEQ ID NO: 420523 - DNA, 25 bp, Mus musculus
ggatcctggggcaggctccgagccc

SEQ ID NO: 420524 - DNA, 25 bp, Mus musculus
ttagctgaggctcagccctgcgcgc

SEQ ID NO: 420525 - DNA, 25 bp, Mus musculus
ctcgaccgaccgagccctgagggga

SEQ ID NO: 420526 - DNA, 25 bp, Mus musculus
cagtcgctgtgttagctgaggctca

SEQ ID NO: 420527 - DNA, 25 bp, Mus musculus
tcgctgtgttagctgaggctcagcc

SEQ ID NO: 420528 - DNA, 25 bp, Mus musculus
cgccgctgctaaggacgcacaacaa

SEQ ID NO: 420529 - DNA, 25 bp, Mus musculus
tgcccacgccctcgggaggttcagg

SEQ ID NO: 420530 - DNA, 25 bp, Mus musculus
ccacaaagctcaagccgcggggctg

SEQ ID NO: 420531 - DNA, 25 bp, Mus musculus
cacaacaaacaatgcggggcccggg

SEQ ID NO: 420532 - DNA, 25 bp, Mus musculus
atccgagctcggcttcggcagcgac

SEQ ID NO: 420533 - DNA, 25 bp, Mus musculus
agcacgcccattggccgatccaggg

SEQ ID NO: 420534 - DNA, 25 bp, Mus musculus
gcctgcgtcaactgcgcacctggga

SEQ ID NO: 420535 - DNA, 25 bp, Mus musculus
cgagaccgcttacgtaaactgcgtc

SEQ ID NO: 420536 - DNA, 25 bp, Mus musculus
ctgggcggaggccaactgctgaaaa

SEQ ID NO: 420537 - DNA, 25 bp, Mus musculus
actgctgaaaagagctaagcgcgca

SEQ ID NO: 420538 - DNA, 25 bp, Mus musculus
taagcgcgcattaacttcgtaactg

SEQ ID NO: 420539 - DNA, 25 bp, Mus musculus
aacttcgtaactgcaggttctgaga

SEQ ID NO: 420540 - DNA, 25 bp, Mus musculus
ctgcacctgcgagaccgcttacgta

SEQ ID NO: 420541 - DNA, 25 bp, Mus musculus
cgcggcggcgaccacaaagctcaag

SEQ ID NO: 420542 - DNA, 25 bp, Mus musculus
ctgcgggatgtgcacgcgctcagct

SEQ ID NO: 420543 - DNA, 25 bp, Mus musculus
cgcacggtggcgtgtgtcacgacct

SEQ ID NO: 420544 - DNA, 25 bp, Mus musculus
tggcgtgtgtcacgacctggtcaac

SEQ ID NO: 420545 - DNA, 25 bp, Mus musculus
tcacgacctggtcaacgggtgagcc

SEQ ID NO: 420546 - DNA, 25 bp, Mus musculus
cctggtcaacgggtgagcccttggc

SEQ ID NO: 420547 - DNA, 25 bp, Mus musculus
acgagtgccagagccagccgtgcgc

SEQ ID NO: 420548 - DNA, 25 bp, Mus musculus
cgccagtttccggtgcgactgcgcg

SEQ ID NO: 420549 - DNA, 25 bp, Mus musculus
cgactgcgcggacacgggttacgaa

SEQ ID NO: 420550 - DNA, 25 bp, Mus musculus
acgtggacgagtgccagagccagcc

SEQ ID NO: 420551 - DNA, 25 bp, Mus musculus
acaacgcgtcctgcctcgacggctt

SEQ ID NO: 420552 - DNA, 25 bp, Mus musculus
cgaactgtcagctggacgtggacga

SEQ ID NO: 420553 - DNA, 25 bp, Mus musculus
ggttcctaccgctgcgtgtgcgcgc

SEQ ID NO: 420554 - DNA, 25 bp, Mus musculus
tggacgagtgctcgtcagcgccctg

SEQ ID NO: 420555 - DNA, 25 bp, Mus musculus
atacgccggtgcgaactgtcagctg

SEQ ID NO: 420556 - DNA, 25 bp, Mus musculus
tcgacgcctttgcttgctcctgcgg

SEQ ID NO: 420557 - DNA, 25 bp, Mus musculus
cacccgtggccttgcacggcttggg

SEQ ID NO: 420558 - DNA, 25 bp, Mus musculus
gagggccctcctgctgtgttcacag

SEQ ID NO: 420559 - DNA, 25 bp, Mus musculus
tgttcacaggccacaacgtgtcctc

SEQ ID NO: 420560 - DNA, 25 bp, Mus musculus
caacgtgtcctcatcgctcagcggg

SEQ ID NO: 420561 - DNA, 25 bp, Mus musculus
cgcaggtgcccactccaatatctgg

SEQ ID NO: 420562 - DNA, 25 bp, Mus musculus
caatatctggttggcggtgcgcaac

SEQ ID NO: 420563 - DNA, 25 bp, Mus musculus
cgacctgggctttctgcagggtccg

SEQ ID NO: 420564 - DNA, 25 bp, Mus musculus
cagtgcctctgctactggctgagaa

SEQ ID NO: 420565 - DNA, 25 bp, Mus musculus
actggctgagaacttcacgggctgc

SEQ ID NO: 420566 - DNA, 25 bp, Mus musculus
tggcacttggcgacttcccgttacc

SEQ ID NO: 420567 - DNA, 25 bp, Mus musculus
gagatccgcgctgacccatgtcgct

SEQ ID NO: 420568 - DNA, 25 bp, Mus musculus
gcgacctcttcgacgcctttgcttg

SEQ ID NO: 420569 - DNA, 25 bp, Mus musculus
cgtggcggacccgtatgttcaccct

SEQ ID NO: 420570 - DNA, 25 bp, Mus musculus
ctggcactcactttcactttctgcg

SEQ ID NO: 420571 - DNA, 25 bp, Mus musculus
tcttggcggggaaaccggattgctc

SEQ ID NO: 420572 - DNA, 25 bp, Mus musculus
cgagtcgaacccgttcatggctggg

SEQ ID NO: 420573 - DNA, 25 bp, Mus musculus
gagaaacgagtcgaacccgttcatg

SEQ ID NO: 420574 - DNA, 25 bp, Mus musculus
tttttgaggcaaccagtgcaagagg

SEQ ID NO: 420575 - DNA, 25 bp, Mus musculus
cacgcacgaatgataactttttgtt

SEQ ID NO: 420576 - DNA, 25 bp, Mus musculus
ctttcactttctgcgctggaggttc

SEQ ID NO: 420577 - DNA, 25 bp, Mus musculus
gggctaactcgcctacaaccggcga

SEQ ID NO: 420578 - DNA, 25 bp, Mus musculus
gagcactgcacatacctggcactca

SEQ ID NO: 420579 - DNA, 25 bp, Mus musculus
agtccgcggagcactgcacatacct

SEQ ID NO: 420580 - DNA, 25 bp, Mus musculus
ggacagcctctagccacgtgaccag

SEQ ID NO: 420581 - DNA, 25 bp, Mus musculus
tccaggattggacagcctctagcca

SEQ ID NO: 420582 - DNA, 25 bp, Mus musculus
tcccaacctgggacctccaggattg

SEQ ID NO: 420583 - DNA, 25 bp, Mus musculus
gctggaggttcacgcacgaatgata

SEQ ID NO: 420584 - DNA, 25 bp, Mus musculus
ggctaactgctccttcttagtcttg

SEQ ID NO: 420585 - DNA, 25 bp, Mus musculus
atctgcagttagacggcccaggcta

SEQ ID NO: 420586 - DNA, 25 bp, Mus musculus
aatcccgagcgagcttcctttgagc

SEQ ID NO: 420587 - DNA, 25 bp, Mus musculus
cctttgagcgggaaacatcttcagc

SEQ ID NO: 420588 - DNA, 25 bp, Mus musculus
ttcagccctggcctgagagcaagcc

SEQ ID NO: 420589 - DNA, 25 bp, Mus musculus
cctagggcgaagtcggctaactgct

SEQ ID NO: 420590 - DNA, 25 bp, Mus musculus
aacagaccctggaggcggtcgccca

SEQ ID NO: 420591 - DNA, 25 bp, Mus musculus
agctgttaactagctcaggaggagc

SEQ ID NO: 420592 - DNA, 25 bp, Mus musculus
cgtccctcagcgtgcttcttcttta

SEQ ID NO: 420593 - DNA, 25 bp, Mus musculus
ccaacatgtcgtcgggccgagtcgc

SEQ ID NO: 420594 - DNA, 25 bp, Mus musculus
gagggttgacctcccagaggcttca

SEQ ID NO: 420595 - DNA, 25 bp, Mus musculus
acctcggtcagccagtcgcaatggc

SEQ ID NO: 420596 - DNA, 25 bp, Mus musculus
cggggagcaatgtaacggcctcttc

SEQ ID NO: 420597 - DNA, 25 bp, Mus musculus
tcgcgcgtctcagagctgaggcgca

SEQ ID NO: 420598 - DNA, 25 bp, Mus musculus
atcctggagcccatggtcccggggc

SEQ ID NO: 420599 - DNA, 25 bp, Mus musculus
cctagggagccaccgcgtcagcagt

SEQ ID NO: 420600 - DNA, 25 bp, Mus musculus
gccgacaggcctccctcaggagctc

SEQ ID NO: 420601 - DNA, 25 bp, Mus musculus
tagtccactcgcgtgagggtggccc

SEQ ID NO: 420602 - DNA, 25 bp, Mus musculus
tgggaagtgtagtccactcgcgtga

SEQ ID NO: 420603 - DNA, 25 bp, Mus musculus
ttaaagtactcgctccagccgggcg

SEQ ID NO: 420604 - DNA, 25 bp, Mus musculus
ggcctcctcatggacccgcgggccc

SEQ ID NO: 420605 - DNA, 25 bp, Mus musculus
tcacttgatcctggagcccatggtc

SEQ ID NO: 420606 - DNA, 25 bp, Mus musculus
cggccgcactcacttgatcctggag

SEQ ID NO: 420607 - DNA, 25 bp, Mus musculus
acggcctgcagctctagcccagcct

SEQ ID NO: 420608 - DNA, 25 bp, Mus musculus
tgggcaacaagtcccccaagcgcgg

SEQ ID NO: 420609 - DNA, 25 bp, Mus musculus
ttcccgcatcaccatggcaaccgtc

SEQ ID NO: 420610 - DNA, 25 bp, Mus musculus
agggggcatctgatcatccgcgccc

SEQ ID NO: 420611 - DNA, 25 bp, Mus musculus
accgcgtcagcagttcccgccctca

SEQ ID NO: 420612 - DNA, 25 bp, Mus musculus
tccacggaccctgattgatttgtca

SEQ ID NO: 420613 - DNA, 25 bp, Mus musculus
ctccgatccctgagcggcccggact

SEQ ID NO: 420614 - DNA, 25 bp, Mus musculus
ccctccagcgttcaccctgctgctg

SEQ ID NO: 420615 - DNA, 25 bp, Mus musculus
tggagcgccctactggccccaggag

SEQ ID NO: 420616 - DNA, 25 bp, Mus musculus
gagccagcagccactccgatccctg

SEQ ID NO: 420617 - DNA, 25 bp, Mus musculus
attgatttgtcagctcaggcgagcc

SEQ ID NO: 420618 - DNA, 25 bp, Mus musculus
ccaccgcgggcacccgcaggtcgtc

SEQ ID NO: 420619 - DNA, 25 bp, Mus musculus
cgggactccacggaccctgattgat

SEQ ID NO: 420620 - DNA, 25 bp, Mus musculus
tcagggtggcaactcccgggactcc

SEQ ID NO: 420621 - DNA, 25 bp, Mus musculus
cgtgccgcagtcagggtggcaactc

SEQ ID NO: 420622 - DNA, 25 bp, Mus musculus
cgtcagctggcagctcggggctcac

SEQ ID NO: 420623 - DNA, 25 bp, Mus musculus
ctgccgagggctcacgaaggtaaga

SEQ ID NO: 420624 - DNA, 25 bp, Mus musculus
cccactggaggcgaccgtcagctgg

SEQ ID NO: 420625 - DNA, 25 bp, Mus musculus
gtcagctcaggcgagccagcagcca

SEQ ID NO: 420626 - DNA, 25 bp, Mus musculus
cgcgcacaatgaaatagttgcctgc

SEQ ID NO: 420627 - DNA, 25 bp, Mus musculus
caattagttggcgattccgagggta

SEQ ID NO: 420628 - DNA, 25 bp, Mus musculus
gattccgagggtatttgcgtggccc

SEQ ID NO: 420629 - DNA, 25 bp, Mus musculus
atttgcgtggccctgctttggccgc

SEQ ID NO: 420630 - DNA, 25 bp, Mus musculus
ctttggccgctctaataacgggaca

SEQ ID NO: 420631 - DNA, 25 bp, Mus musculus
ataacgggacagagcgccgggaaca

SEQ ID NO: 420632 - DNA, 25 bp, Mus musculus
ggaacagcgcgcagatcaatcaccc

SEQ ID NO: 420633 - DNA, 25 bp, Mus musculus
atcaatcaccctggttccgctgcgg

SEQ ID NO: 420634 - DNA, 25 bp, Mus musculus
cagcctggcctcactttctccctgg

SEQ ID NO: 420635 - DNA, 25 bp, Mus musculus
cgccagggctggtggcccttttgtt

SEQ ID NO: 420636 - DNA, 25 bp, Mus musculus
tctgagttagtcacggtggccggct

SEQ ID NO: 420637 - DNA, 25 bp, Mus musculus
cggctggaggctgctacctcattat

SEQ ID NO: 420638 - DNA, 25 bp, Mus musculus
ctacctcattatgcggcgggtctgc

SEQ ID NO: 420639 - DNA, 25 bp, Mus musculus
gttgcctgcagcgtcaattagttgg

SEQ ID NO: 420640 - DNA, 25 bp, Mus musculus
aattctcccagtggctcggctcagc

SEQ ID NO: 420641 - DNA, 25 bp, Mus musculus
accgcagggccaagagcgaggctcc

SEQ ID NO: 420642 - DNA, 25 bp, Mus musculus
tcatcgacgagatggaccgcagggc

SEQ ID NO: 420643 - DNA, 25 bp, Mus musculus
cacggggtcatcgacgagatggacc

SEQ ID NO: 420644 - DNA, 25 bp, Mus musculus
tgctgttccacagtctgtcgggccc

SEQ ID NO: 420645 - DNA, 25 bp, Mus musculus
cgccgcgatgctgttccacagtctg

SEQ ID NO: 420646 - DNA, 25 bp, Mus musculus
agctagcgatgcctgcggcgtgaaa

SEQ ID NO: 420647 - DNA, 25 bp, Mus musculus
ctgatttgcgccctgggcgccagaa

SEQ ID NO: 420648 - DNA, 25 bp, Mus musculus
ccaccgccgcctggggcagagtttg

SEQ ID NO: 420649 - DNA, 25 bp, Mus musculus
tcagctcgcaggcttcgcggagacc

SEQ ID NO: 420650 - DNA, 25 bp, Mus musculus
ctcttcaattctcccagtggctcgg

SEQ ID NO: 420651 - DNA, 25 bp, Mus musculus
ctgcggcgtgaaagcgcccacagcg

SEQ ID NO: 420652 - DNA, 25 bp, Mus musculus
ccctactccagttcgcctttggttg

SEQ ID NO: 420653 - DNA, 25 bp, Mus musculus
ggcgccagaacccagctagcgatgc

SEQ ID NO: 420654 - DNA, 25 bp, Mus musculus
ttacaacgccggtgagtgcaagacc

SEQ ID NO: 420655 - DNA, 25 bp, Mus musculus
tgcaagaccgtctgaagccttggcg

SEQ ID NO: 420656 - DNA, 25 bp, Mus musculus
ctcggcctcagagatggtgatgcgc

SEQ ID NO: 420657 - DNA, 25 bp, Mus musculus
cggggcagatctggcagcttacaac

SEQ ID NO: 420658 - DNA, 25 bp, Mus musculus
gaggccgagaaagcgcaagagtcca

SEQ ID NO: 420659 - DNA, 25 bp, Mus musculus
tcttccctactacaacggcgtgggc

SEQ ID NO: 420660 - DNA, 25 bp, Mus musculus
gggctaatccgctgggtcttcccta

SEQ ID NO: 420661 - DNA, 25 bp, Mus musculus
gggcgaatacccagcacactttaac

SEQ ID NO: 420662 - DNA, 25 bp, Mus musculus
ttgccgcttgcacttcgaggctctg

SEQ ID NO: 420663 - DNA, 25 bp, Mus musculus
acagcctggtctattgccgcttgca

SEQ ID NO: 420664 - DNA, 25 bp, Mus musculus
ccggcgaccatttcggcatgaagga

SEQ ID NO: 420665 - DNA, 25 bp, Mus musculus
acaagatgctgacgaccggcgacca

SEQ ID NO: 420666 - DNA, 25 bp, Mus musculus
cgctcgggacttggtttatcacctc

SEQ ID NO: 420667 - DNA, 25 bp, Mus musculus
acactttaaccatgccgacgtggca

SEQ ID NO: 420668 - DNA, 25 bp, Mus musculus
tttgcggagctatttgcgcgccaca

SEQ ID NO: 420669 - DNA, 25 bp, Mus musculus
cccggacatgcactttgcggagcta

SEQ ID NO: 420670 - DNA, 25 bp, Mus musculus
tgcaggtcagcttggggctcatgat

SEQ ID NO: 420671 - DNA, 25 bp, Mus musculus
ctccagaggcaggatgcaaatctcc

SEQ ID NO: 420672 - DNA, 25 bp, Mus musculus
cgctgacctcgctccagaggcagga

SEQ ID NO: 420673 - DNA, 25 bp, Mus musculus
acggaccctctggtcttggcgcgct

SEQ ID NO: 420674 - DNA, 25 bp, Mus musculus
caggcctcaggtcttagggtcgtaa

SEQ ID NO: 420675 - DNA, 25 bp, Mus musculus
gcttctggaagagtgacccaggcct

SEQ ID NO: 420676 - DNA, 25 bp, Mus musculus
gctgtcctatcgagggaggtagatc

SEQ ID NO: 420677 - DNA, 25 bp, Mus musculus
acggacactttgcaaatcggctggg

SEQ ID NO: 420678 - DNA, 25 bp, Mus musculus
tacccaggggccagacacacggaca

SEQ ID NO: 420679 - DNA, 25 bp, Mus musculus
cttcggattgcgaggacaccagttt

SEQ ID NO: 420680 - DNA, 25 bp, Mus musculus
tttgcgtgtgtaagcgccctgtacc

SEQ ID NO: 420681 - DNA, 25 bp, Mus musculus
tgctcgtggaagaaggcttcggatt

SEQ ID NO: 420682 - DNA, 25 bp, Mus musculus
cagaagatctgccttgcttagcgca

SEQ ID NO: 420683 - DNA, 25 bp, Mus musculus
ccagagttcatttattcagcgacga

SEQ ID NO: 420684 - DNA, 25 bp, Mus musculus
cagtggaaaagtctgcgcagaggct

SEQ ID NO: 420685 - DNA, 25 bp, Mus musculus
cccacactgcagtggaaaagtctgc

SEQ ID NO: 420686 - DNA, 25 bp, Mus musculus
acacgtcgcggtgaagctgagctgt

SEQ ID NO: 420687 - DNA, 25 bp, Mus musculus
ttgcttagcgcaagctgcacacgtc

SEQ ID NO: 420688 - DNA, 25 bp, Mus musculus
ggaagcctccgctcagaagatctgc

SEQ ID NO: 420689 - DNA, 25 bp, Mus musculus
cgttgaaccgccagagttcatttat

SEQ ID NO: 420690 - DNA, 25 bp, Mus musculus
tgtgattttagcgaaggaagcctcc

SEQ ID NO: 420691 - DNA, 25 bp, Mus musculus
gaggccgtggagacaagacacttta

SEQ ID NO: 420692 - DNA, 25 bp, Mus musculus
atctttcggtgaggaccgctgcacg

SEQ ID NO: 420693 - DNA, 25 bp, Mus musculus
tctaagggatctttcggtgaggacc

SEQ ID NO: 420694 - DNA, 25 bp, Mus musculus
tcagcgacgatctaagggatctttc

SEQ ID NO: 420695 - DNA, 25 bp, Mus musculus
cgcaagctgcacacgtcgcggtgaa

SEQ ID NO: 420696 - DNA, 25 bp, Mus musculus
cggctgaaccaagcggactagctgc

SEQ ID NO: 420697 - DNA, 25 bp, Mus musculus
ggcggctgaaccaagcggactagct

SEQ ID NO: 420698 - DNA, 25 bp, Mus musculus
acgttcccgagtgagtgtgtgcaca

SEQ ID NO: 420699 - DNA, 25 bp, Mus musculus
cagcgccgccaactcgcgtgtgacc

SEQ ID NO: 420700 - DNA, 25 bp, Mus musculus
caactcgcgtgtgacccgcgctccg

SEQ ID NO: 420701 - DNA, 25 bp, Mus musculus
gactgtcacccgaggcgttgtgggc

SEQ ID NO: 420702 - DNA, 25 bp, Mus musculus
tgcgtgcgtgtgcacatcaggggcc

SEQ ID NO: 420703 - DNA, 25 bp, Mus musculus
cgagtgtttaccgtggatgccaagg

SEQ ID NO: 420704 - DNA, 25 bp, Mus musculus
tttaccgtggatgccaaggagtacg

SEQ ID NO: 420705 - DNA, 25 bp, Mus musculus
atgccaaggagtacgtgtgcccacg

SEQ ID NO: 420706 - DNA, 25 bp, Mus musculus
cgtgtgcccacgtgtctgaacgttc

SEQ ID NO: 420707 - DNA, 25 bp, Mus musculus
tgcccacgtgtctgaacgttcccga

SEQ ID NO: 420708 - DNA, 25 bp, Mus musculus
gtgtctgaacgttcccgagtgagtg

SEQ ID NO: 420709 - DNA, 25 bp, Mus musculus
atccgtttatcgagtgtttaccgtg

SEQ ID NO: 420710 - DNA, 25 bp, Mus musculus
gcccagttccgatccggcgtacaga

SEQ ID NO: 420711 - DNA, 25 bp, Mus musculus
tgccaagaaagtgtttccgggccga

SEQ ID NO: 420712 - DNA, 25 bp, Mus musculus
aacttagcacttccggcgccgcgag

SEQ ID NO: 420713 - DNA, 25 bp, Mus musculus
ccgccatcttgccaagaaagtgttt

SEQ ID NO: 420714 - DNA, 25 bp, Mus musculus
gtggctgaaacaccgacacagccgc

SEQ ID NO: 420715 - DNA, 25 bp, Mus musculus
ccgaccggtggctgaaacaccgaca

SEQ ID NO: 420716 - DNA, 25 bp, Mus musculus
agaaaagcctccgaccggtggctga

SEQ ID NO: 420717 - DNA, 25 bp, Mus musculus
ctgcgacaattatcaaaagaaaagc

SEQ ID NO: 420718 - DNA, 25 bp, Mus musculus
gggcatgaacacacctgcgacaatt

SEQ ID NO: 420719 - DNA, 25 bp, Mus musculus
tggggcccgattccctgagtcacac

SEQ ID NO: 420720 - DNA, 25 bp, Mus musculus
cgatccggcgtacagagttcccact

SEQ ID NO: 420721 - DNA, 25 bp, Mus musculus
attccctgagtcacacggccgcggg

SEQ ID NO: 420722 - DNA, 25 bp, Mus musculus
aaagaacttagcacttccggcgccg

SEQ ID NO: 420723 - DNA, 25 bp, Mus musculus
tacagagttcccactcgggtcccga

SEQ ID NO: 420724 - DNA, 25 bp, Mus musculus
cggctgtggccaacgcactgcagct

SEQ ID NO: 420725 - DNA, 25 bp, Mus musculus
aacgtgcaagggctcagggactaag

SEQ ID NO: 420726 - DNA, 25 bp, Mus musculus
tcaccgatgggaggcaacgtgcaag

SEQ ID NO: 420727 - DNA, 25 bp, Mus musculus
cactaggagctgttcaccgatggga

SEQ ID NO: 420728 - DNA, 25 bp, Mus musculus
tcttccgagctgacagtcgctggca

SEQ ID NO: 420729 - DNA, 25 bp, Mus musculus
ccttcaatgccatcttccgagctga

SEQ ID NO: 420730 - DNA, 25 bp, Mus musculus
actgcagctgcgcaccttcgtggaa

SEQ ID NO: 420731 - DNA, 25 bp, Mus musculus
gctcagggactaagcacaggccacc

SEQ ID NO: 420732 - DNA, 25 bp, Mus musculus
tgaggtgaccactcttctccctggc

SEQ ID NO: 420733 - DNA, 25 bp, Mus musculus
ggatgagacagcaactgaggtgacc

SEQ ID NO: 420734 - DNA, 25 bp, Mus musculus
cgtgcatgttcagtgggatgagaca

SEQ ID NO: 420735 - DNA, 25 bp, Mus musculus
cgttcacggcttgcgtgcatgttca

SEQ ID NO: 420736 - DNA, 25 bp, Mus musculus
gtactgcccgcgctggcggcgttca

SEQ ID NO: 420737 - DNA, 25 bp, Mus musculus
gaggcggccaccatgtgcccttcaa

SEQ ID NO: 420738 - DNA, 25 bp, Mus musculus
aaccgtccgtcaagccaggatccaa

SEQ ID NO: 420739 - DNA, 25 bp, Mus musculus
ggcacccaggaacaccggcaggtga

SEQ ID NO: 420740 - DNA, 25 bp, Mus musculus
tggtcgcatgggcacccaggaacac

SEQ ID NO: 420741 - DNA, 25 bp, Mus musculus
cttctcggtgtaagcgtggtcgcat

SEQ ID NO: 420742 - DNA, 25 bp, Mus musculus
tcgcagctagcgcttctcggtgtaa

SEQ ID NO: 420743 - DNA, 25 bp, Mus musculus
ggtatctttatgtcctcgcagctag

SEQ ID NO: 420744 - DNA, 25 bp, Mus musculus
gtgcctaccgcagtgcctgtcgggc

SEQ ID NO: 420745 - DNA, 25 bp, Mus musculus
acaccggcaggtgagttttgaaccg

SEQ ID NO: 420746 - DNA, 25 bp, Mus musculus
tccgtcaagccaggatccaaaagcc

SEQ ID NO: 420747 - DNA, 25 bp, Mus musculus
cggttcgttatagttggcaacgatc

SEQ ID NO: 420748 - DNA, 25 bp, Mus musculus
taagcggcgtaaacggctcggtcca

SEQ ID NO: 420749 - DNA, 25 bp, Mus musculus
cgccaaggatgtaagcggcgtaaac

SEQ ID NO: 420750 - DNA, 25 bp, Mus musculus
ttgaaccggttcgttatagttggca

SEQ ID NO: 420751 - DNA, 25 bp, Mus musculus
cggacccgagggtgcctaccgcagt

SEQ ID NO: 420752 - DNA, 25 bp, Mus musculus
ccctgcaggcagatcaggggcgcag

SEQ ID NO: 420753 - DNA, 25 bp, Mus musculus
ctaggcaagatcagagcgcgcagct

SEQ ID NO: 420754 - DNA, 25 bp, Mus musculus
ggcaagatcagagcgcgcagctgcc

SEQ ID NO: 420755 - DNA, 25 bp, Mus musculus
cccacccgcaagcacaaccgtctgc

SEQ ID NO: 420756 - DNA, 25 bp, Mus musculus
caaccgtctgcgagaacaagagcca

SEQ ID NO: 420757 - DNA, 25 bp, Mus musculus
gtctgcgagaacaagagccactgca

SEQ ID NO: 420758 - DNA, 25 bp, Mus musculus
agaacaagagccactgcagcgcctc

SEQ ID NO: 420759 - DNA, 25 bp, Mus musculus
aagagccactgcagcgcctctgtgc

SEQ ID NO: 420760 - DNA, 25 bp, Mus musculus
cctttgtctctgctgaatgggtgcg

SEQ ID NO: 420761 - DNA, 25 bp, Mus musculus
tctctgctgaatgggtgcgttgcta

SEQ ID NO: 420762 - DNA, 25 bp, Mus musculus
gcgttgctagggctgctcgtagcaa

SEQ ID NO: 420763 - DNA, 25 bp, Mus musculus
ctagggctgctcgtagcaacgaagc

SEQ ID NO: 420764 - DNA, 25 bp, Mus musculus
cgtagcaacgaagccgcttccactt

SEQ ID NO: 420765 - DNA, 25 bp, Mus musculus
tgctcgtagcaacgaagccgcttcc

SEQ ID NO: 420766 - DNA, 25 bp, Mus musculus
cgggaccctcggattcgatgcattt

SEQ ID NO: 420767 - DNA, 25 bp, Mus musculus
agacaggctgcggtagacctcagac

SEQ ID NO: 420768 - DNA, 25 bp, Mus musculus
ctgggtccgcagacaaagccacgca

SEQ ID NO: 420769 - DNA, 25 bp, Mus musculus
ggccgaccctgagaagcagagaacc

SEQ ID NO: 420770 - DNA, 25 bp, Mus musculus
gagacaccctggaaagaccgcggca

SEQ ID NO: 420771 - DNA, 25 bp, Mus musculus
tgacaggcccaacgagaaaaccacg

SEQ ID NO: 420772 - DNA, 25 bp, Mus musculus
tgccaacgacattgggagagattcg

SEQ ID NO: 420773 - DNA, 25 bp, Mus musculus
acagggacaggaatgcggtgccaac

SEQ ID NO: 420774 - DNA, 25 bp, Mus musculus
actgctcaacggagaggggatcctg

SEQ ID NO: 420775 - DNA, 25 bp, Mus musculus
gagactccagccagtactgctcaac

SEQ ID NO: 420776 - DNA, 25 bp, Mus musculus
agtagggcacacagctggattgttc

SEQ ID NO: 420777 - DNA, 25 bp, Mus musculus
aaatcagataggctcggacgcgggc

SEQ ID NO: 420778 - DNA, 25 bp, Mus musculus
atgcatttccatccagattcgtttg

SEQ ID NO: 420779 - DNA, 25 bp, Mus musculus
gacctcagacggagagtccaaatcc

SEQ ID NO: 420780 - DNA, 25 bp, Mus musculus
ggggctatcgcctgcgctaattgct

SEQ ID NO: 420781 - DNA, 25 bp, Mus musculus
cgtagtcgtcgtcctggtcttccac

SEQ ID NO: 420782 - DNA, 25 bp, Mus musculus
gctaattgctccagggcgctttcca

SEQ ID NO: 420783 - DNA, 25 bp, Mus musculus
aacattccgccgcaaacaccgaggg

SEQ ID NO: 420784 - DNA, 25 bp, Mus musculus
cgggccaggtgaggaattctcagca

SEQ ID NO: 420785 - DNA, 25 bp, Mus musculus
tgagccagcagaaagtcgtcgccta

SEQ ID NO: 420786 - DNA, 25 bp, Mus musculus
tcgtcgcctagaagaatgagtctga

SEQ ID NO: 420787 - DNA, 25 bp, Mus musculus
caccgaggtccgagaaggaccatta

SEQ ID NO: 420788 - DNA, 25 bp, Mus musculus
cattaccggtctgcccagaggcgga

SEQ ID NO: 420789 - DNA, 25 bp, Mus musculus
tctgcgagctccctggtgaaggaag

SEQ ID NO: 420790 - DNA, 25 bp, Mus musculus
tcctcactgaggagctgcccggcat

SEQ ID NO: 420791 - DNA, 25 bp, Mus musculus
gcatcccggagctagagtcagctta

SEQ ID NO: 420792 - DNA, 25 bp, Mus musculus
ggcgctttccaagttcaaaagttca

SEQ ID NO: 420793 - DNA, 25 bp, Mus musculus
tccgccatgacttgcgccttcgtag

SEQ ID NO: 420794 - DNA, 25 bp, Mus musculus
gcctgtcactttggcgacccgaagc

SEQ ID NO: 420795 - DNA, 25 bp, Mus musculus
atcgtccagttgtttcaacagctcc

SEQ ID NO: 420796 - DNA, 25 bp, Mus musculus
aagctgggacaattccaccttcaga

SEQ ID NO: 420797 - DNA, 25 bp, Mus musculus
gcacggccaatagcgtcgcggtttg

SEQ ID NO: 420798 - DNA, 25 bp, Mus musculus
cgacttcctcaactactgccgggtg

SEQ ID NO: 420799 - DNA, 25 bp, Mus musculus
gaagcagcctggttcgagagaaaga

SEQ ID NO: 420800 - DNA, 25 bp, Mus musculus
tcggcgttgttcacggctgaagcag

SEQ ID NO: 420801 - DNA, 25 bp, Mus musculus
cgcagcctcaccatttcggcgttgt

SEQ ID NO: 420802 - DNA, 25 bp, Mus musculus
gcgactctatgggtcacggagctcc

SEQ ID NO: 420803 - DNA, 25 bp, Mus musculus
tcttggcctgcaatgaggagcgact

SEQ ID NO: 420804 - DNA, 25 bp, Mus musculus
gcgcaggtcccgagccttaatcttg

SEQ ID NO: 420805 - DNA, 25 bp, Mus musculus
caccttcagatcgtccagttgtttc

SEQ ID NO: 420806 - DNA, 25 bp, Mus musculus
tggcgacccgaagctgggacaattc

SEQ ID NO: 420807 - DNA, 25 bp, Mus musculus
cgagccttaatcttggcctgcaatg

SEQ ID NO: 420808 - DNA, 25 bp, Mus musculus
gttacggctgcaacgcctgacacca

SEQ ID NO: 420809 - DNA, 25 bp, Mus musculus
ctaagatttcttcctccggagcgga

SEQ ID NO: 420810 - DNA, 25 bp, Mus musculus
ctgccatcccttagctctaagattt

SEQ ID NO: 420811 - DNA, 25 bp, Mus musculus
tttcttcctccggagcggacagaag

SEQ ID NO: 420812 - DNA, 25 bp, Mus musculus
cttcggagaggacagagttacggct

SEQ ID NO: 420813 - DNA, 25 bp, Mus musculus
tagacgggctcctgcggcaatatcc

SEQ ID NO: 420814 - DNA, 25 bp, Mus musculus
agttccgcccacaagagcttccggt

SEQ ID NO: 420815 - DNA, 25 bp, Mus musculus
caagagcttccggttccggcgcatc

SEQ ID NO: 420816 - DNA, 25 bp, Mus musculus
ccggttccggcgcatcccggaagtg

SEQ ID NO: 420817 - DNA, 25 bp, Mus musculus
ccgccgcgtggatatcgacgaattt

SEQ ID NO: 420818 - DNA, 25 bp, Mus musculus
tttgacgagaacaaattcgtagacg

SEQ ID NO: 420819 - DNA, 25 bp, Mus musculus
tcgtagacgagcacgaagaggcagc

SEQ ID NO: 420820 - DNA, 25 bp, Mus musculus
tgcggcaatatccttcccggcgcgg

SEQ ID NO: 420821 - DNA, 25 bp, Mus musculus
gctggctataccagcagcccggctt

SEQ ID NO: 420822 - DNA, 25 bp, Mus musculus
ggatcggcaccttcccttctgaaga

SEQ ID NO: 420823 - DNA, 25 bp, Mus musculus
ttcccttctgaagagggaggagccc

SEQ ID NO: 420824 - DNA, 25 bp, Mus musculus
cacgtcagcgagaggcaccgcaatc

SEQ ID NO: 420825 - DNA, 25 bp, Mus musculus
tggccggccactgacacgtcagcga

SEQ ID NO: 420826 - DNA, 25 bp, Mus musculus
gggcacctctacctgtgttggccgg

SEQ ID NO: 420827 - DNA, 25 bp, Mus musculus
tgccgttgggctgaaacggctaccg

SEQ ID NO: 420828 - DNA, 25 bp, Mus musculus
ccgtgtgcgattcagcggcgcgcaa

SEQ ID NO: 420829 - DNA, 25 bp, Mus musculus
gcttggttctcagcgcgcgcatgcg

SEQ ID NO: 420830 - DNA, 25 bp, Mus musculus
gcagcgcgtcggcttggttctcagc

SEQ ID NO: 420831 - DNA, 25 bp, Mus musculus
ctccgcggactctcgagggcgcttg

SEQ ID NO: 420832 - DNA, 25 bp, Mus musculus
ccagtagtgcacttgctgtgtggga

SEQ ID NO: 420833 - DNA, 25 bp, Mus musculus
tccagggactccagtagtgcacttg

SEQ ID NO: 420834 - DNA, 25 bp, Mus musculus
gcctacttgcgtccagggactccag

SEQ ID NO: 420835 - DNA, 25 bp, Mus musculus
cgcatgcgcccgtgtgcgattcagc

SEQ ID NO: 420836 - DNA, 25 bp, Mus musculus
agaacggggacttacatctccggcg

SEQ ID NO: 420837 - DNA, 25 bp, Mus musculus
ctccgtgtgccagaacggggactta

SEQ ID NO: 420838 - DNA, 25 bp, Mus musculus
agaggagccctgagcgcctccgtgt

SEQ ID NO: 420839 - DNA, 25 bp, Mus musculus
cttaaagactgctagcagagcgaga

SEQ ID NO: 420840 - DNA, 25 bp, Mus musculus
tggcggcagaggtgccttaaagact

SEQ ID NO: 420841 - DNA, 25 bp, Mus musculus
ttaggccgtcatgtcccgcgtggcc

SEQ ID NO: 420842 - DNA, 25 bp, Mus musculus
accgctgattgggtgcttaggccgt

SEQ ID NO: 420843 - DNA, 25 bp, Mus musculus
tctagaaatccgaccgctgattggg

SEQ ID NO: 420844 - DNA, 25 bp, Mus musculus
cgaccaagcgcctgggactcactag

SEQ ID NO: 420845 - DNA, 25 bp, Mus musculus
tcggtttctattggccacaacggca

SEQ ID NO: 420846 - DNA, 25 bp, Mus musculus
cccgagatgctgagtgcctgtaccc

SEQ ID NO: 420847 - DNA, 25 bp, Mus musculus
gctgctgggactgccgggctcctct

SEQ ID NO: 420848 - DNA, 25 bp, Mus musculus
cacaacggcagggtatctagaaatc

SEQ ID NO: 420849 - DNA, 25 bp, Mus musculus
aggtcggcctcattgtctgcccaga

SEQ ID NO: 420850 - DNA, 25 bp, Mus musculus
gcgtcccgagctgacctcttcagga

SEQ ID NO: 420851 - DNA, 25 bp, Mus musculus
ccatgcctgcggtgcacagacacgt

SEQ ID NO: 420852 - DNA, 25 bp, Mus musculus
gcctctcggttcctctacagttatt

SEQ ID NO: 420853 - DNA, 25 bp, Mus musculus
ttacaaagcgtagcggctcccaggc

SEQ ID NO: 420854 - DNA, 25 bp, Mus musculus
gctcccaggccttcttggaaaattc

SEQ ID NO: 420855 - DNA, 25 bp, Mus musculus
ttccctttgccaggaaggcgaccca

SEQ ID NO: 420856 - DNA, 25 bp, Mus musculus
ggaagcccagggactgcaagccctc

SEQ ID NO: 420857 - DNA, 25 bp, Mus musculus
acagacacgtgcgtgcgacaactgg

SEQ ID NO: 420858 - DNA, 25 bp, Mus musculus
cgacaactgggagcacagacgggca

SEQ ID NO: 420859 - DNA, 25 bp, Mus musculus
cgtgaactcagcgtgccgtacagtc

SEQ ID NO: 420860 - DNA, 25 bp, Mus musculus
gtgcgccgcagccaatctacgcaga

SEQ ID NO: 420861 - DNA, 25 bp, Mus musculus
acctcttcaggatggtgagacagcg

SEQ ID NO: 420862 - DNA, 25 bp, Mus musculus
tttgttgccagctgctgcgtcccga

SEQ ID NO: 420863 - DNA, 25 bp, Mus musculus
atctacgcagacctgcttctaggcc

SEQ ID NO: 420864 - DNA, 25 bp, Mus musculus
ttaggaagaacaagccgcggcgaca

SEQ ID NO: 420865 - DNA, 25 bp, Mus musculus
gccattttaggaagaacaagccgcg

SEQ ID NO: 420866 - DNA, 25 bp, Mus musculus
tgggacccgtagctctctgccgcgg

SEQ ID NO: 420867 - DNA, 25 bp, Mus musculus
aacctactgggacccgtagctctct

SEQ ID NO: 420868 - DNA, 25 bp, Mus musculus
atctccaagagaacccggaggtcct

SEQ ID NO: 420869 - DNA, 25 bp, Mus musculus
ggccacggatctatctccaagagaa

SEQ ID NO: 420870 - DNA, 25 bp, Mus musculus
ccgggccacggatctatctccaaga

SEQ ID NO: 420871 - DNA, 25 bp, Mus musculus
gtctgcgaagcgacgtaaaagcctg

SEQ ID NO: 420872 - DNA, 25 bp, Mus musculus
ggaattccgggccacggatctatct

SEQ ID NO: 420873 - DNA, 25 bp, Mus musculus
ctctctcaggcggaattccgggcca

SEQ ID NO: 420874 - DNA, 25 bp, Mus musculus
gctctctctctcaggcggaattccg

SEQ ID NO: 420875 - DNA, 25 bp, Mus musculus
agcctgacccgttccgctctctctc

SEQ ID NO: 420876 - DNA, 25 bp, Mus musculus
cgaagcgacgtaaaagcctgacccg

SEQ ID NO: 420877 - DNA, 25 bp, Mus musculus
ccgatccgtgagtggcgtctgcgaa

SEQ ID NO: 420878 - DNA, 25 bp, Mus musculus
tcttacatcacgcaagaggggcaga

SEQ ID NO: 420879 - DNA, 25 bp, Mus musculus
cggagccgcgtcatttacaaatgtc

SEQ ID NO: 420880 - DNA, 25 bp, Mus musculus
gcagggtacgtctgatcttacatca

SEQ ID NO: 420881 - DNA, 25 bp, Mus musculus
caggctctgtgtgtctggacttttc

SEQ ID NO: 420882 - DNA, 25 bp, Mus musculus
gatgcccgccgatgggaattcacta

SEQ ID NO: 420883 - DNA, 25 bp, Mus musculus
cccgccgatgggaattcactattaa

SEQ ID NO: 420884 - DNA, 25 bp, Mus musculus
tcactattaatcaccgagtcctccg

SEQ ID NO: 420885 - DNA, 25 bp, Mus musculus
tggacttttcgatgcagggtacgtc

SEQ ID NO: 420886 - DNA, 25 bp, Mus musculus
ccgccttgctctgccaggagcagga

SEQ ID NO: 420887 - DNA, 25 bp, Mus musculus
gtgggtccagccagtccgccttgct

SEQ ID NO: 420888 - DNA, 25 bp, Mus musculus
gaaatccctggtcggtgggtccagc

SEQ ID NO: 420889 - DNA, 25 bp, Mus musculus
tacaaatgtcactggaaatccctgg

SEQ ID NO: 420890 - DNA, 25 bp, Mus musculus
agcctggaacggagccgcgtcattt

SEQ ID NO: 420891 - DNA, 25 bp, Mus musculus
cgagcgccagccaggctctgtgtgt

SEQ ID NO: 420892 - DNA, 25 bp, Mus musculus
ggctctgctgctgttaccgcttctc

SEQ ID NO: 420893 - DNA, 25 bp, Mus musculus
gtgcttccacccacctgtccggatc

SEQ ID NO: 420894 - DNA, 25 bp, Mus musculus
tttcctgcagagctccgggtgacag

SEQ ID NO: 420895 - DNA, 25 bp, Mus musculus
ttctgctgcagccacattttcctgc

SEQ ID NO: 420896 - DNA, 25 bp, Mus musculus
caggcgtttgcagcggtttctgctg

SEQ ID NO: 420897 - DNA, 25 bp, Mus musculus
atcgcggctctgctgctgttaccgc

SEQ ID NO: 420898 - DNA, 25 bp, Mus musculus
tatgagcgaaccatgaggcggctgc

SEQ ID NO: 420899 - DNA, 25 bp, Mus musculus
cccggaggattatgagcgaaccatg

SEQ ID NO: 420900 - DNA, 25 bp, Mus musculus
ccggacccggaggattatgagcgaa

SEQ ID NO: 420901 - DNA, 25 bp, Mus musculus
tttgccgctcgcctcttaacccggc

SEQ ID NO: 420902 - DNA, 25 bp, Mus musculus
aaagctcacgtgctttgccgctcgc

SEQ ID NO: 420903 - DNA, 25 bp, Mus musculus
cgggcccaaagctcacgtgctttgc

SEQ ID NO: 420904 - DNA, 25 bp, Mus musculus
tccggccagccctaccgcggccatc

SEQ ID NO: 420905 - DNA, 25 bp, Mus musculus
cagcggtttctgctgcagccacatt

SEQ ID NO: 420906 - DNA, 25 bp, Mus musculus
ccgagggctgagagtagccacctca

SEQ ID NO: 420907 - DNA, 25 bp, Mus musculus
ccctgctttttgagcgccaaggtgc

SEQ ID NO: 420908 - DNA, 25 bp, Mus musculus
cggtgccctgctttttgagcgccaa

SEQ ID NO: 420909 - DNA, 25 bp, Mus musculus
aactccggtgccctgctttttgagc

SEQ ID NO: 420910 - DNA, 25 bp, Mus musculus
cgcggaaaaactccggtgccctgct

SEQ ID NO: 420911 - DNA, 25 bp, Mus musculus
cctgcgctcatgagggcagcgggac

SEQ ID NO: 420912 - DNA, 25 bp, Mus musculus
ccgagtcggcgaaaccctgggctcg

SEQ ID NO: 420913 - DNA, 25 bp, Mus musculus
tgaagcccgagtcggcgaaaccctg

SEQ ID NO: 420914 - DNA, 25 bp, Mus musculus
atgctgaagcccgagtcggcgaaac

SEQ ID NO: 420915 - DNA, 25 bp, Mus musculus
tgcccgtgaacaggcagggatgctg

SEQ ID NO: 420916 - DNA, 25 bp, Mus musculus
cctcagtgcgcagtgcccgtgaaca

SEQ ID NO: 420917 - DNA, 25 bp, Mus musculus
acaacccggtcctcagtgcgcagtg

SEQ ID NO: 420918 - DNA, 25 bp, Mus musculus
gagagtagccacctcacaacccggt

SEQ ID NO: 420919 - DNA, 25 bp, Mus musculus
gccaaggtgctgctcgcccttgtca

SEQ ID NO: 420920 - DNA, 25 bp, Mus musculus
aggcctatgccgaatcctctaatga

SEQ ID NO: 420921 - DNA, 25 bp, Mus musculus
cacgttctcaggcaggtggctagcc

SEQ ID NO: 420922 - DNA, 25 bp, Mus musculus
gacttattaactccaagagcccttc

SEQ ID NO: 420923 - DNA, 25 bp, Mus musculus
agagcccttcctcgctttagaaagc

SEQ ID NO: 420924 - DNA, 25 bp, Mus musculus
caggcgggatcctgcggaaacatca

SEQ ID NO: 420925 - DNA, 25 bp, Mus musculus
tcctgcggaaacatcaggcctatgc

SEQ ID NO: 420926 - DNA, 25 bp, Mus musculus
atcccgagtaggaaagcgcaggcca

SEQ ID NO: 420927 - DNA, 25 bp, Mus musculus
ccaagctccgcgctagggaaaagca

SEQ ID NO: 420928 - DNA, 25 bp, Mus musculus
tagggaaaagcatcgcccggggcca

SEQ ID NO: 420929 - DNA, 25 bp, Mus musculus
ctccacgcctagtcggtgactcaga

SEQ ID NO: 420930 - DNA, 25 bp, Mus musculus
gcgaactctccacggtggcgcggct

SEQ ID NO: 420931 - DNA, 25 bp, Mus musculus
cgcgtacgctttccagtcaggccag

SEQ ID NO: 420932 - DNA, 25 bp, Mus musculus
agccatggcacgatgtcccagtgtc

SEQ ID NO: 420933 - DNA, 25 bp, Mus musculus
ttcggcttttccgtactctctctca

SEQ ID NO: 420934 - DNA, 25 bp, Mus musculus
caagaaactttgaggctggcggaga

SEQ ID NO: 420935 - DNA, 25 bp, Mus musculus
ccagcgactccagcaagaaactttg

SEQ ID NO: 420936 - DNA, 25 bp, Mus musculus
aggtccgatcggcagcgctccgagc

SEQ ID NO: 420937 - DNA, 25 bp, Mus musculus
ttcctcctgggattggcttgtttgc

SEQ ID NO: 420938 - DNA, 25 bp, Mus musculus
attggcttgtttgcgcctcttgcac

SEQ ID NO: 420939 - DNA, 25 bp, Mus musculus
atccgccatgatcggctgcttcatt

SEQ ID NO: 420940 - DNA, 25 bp, Mus musculus
gctgcttcattgataagagcggatc

SEQ ID NO: 420941 - DNA, 25 bp, Mus musculus
atcagatggcagttcgcatggactc

SEQ ID NO: 420942 - DNA, 25 bp, Mus musculus
ctgcttcggcagcacgcaggctcga

SEQ ID NO: 420943 - DNA, 25 bp, Mus musculus
gcaggctcgatctagcaaccaaaca

SEQ ID NO: 420944 - DNA, 25 bp, Mus musculus
caaacacagcgacaatgtgggcatc

SEQ ID NO: 420945 - DNA, 25 bp, Mus musculus
tgtgggcatcgtccgcgcccattga

SEQ ID NO: 420946 - DNA, 25 bp, Mus musculus
agcgccaaagcgaaacttcggcggc

SEQ ID NO: 420947 - DNA, 25 bp, Mus musculus
cgaaccgttacttggcgcacagaga

SEQ ID NO: 420948 - DNA, 25 bp, Mus musculus
gcgactgtcagtctcacaaaagggg

SEQ ID NO: 420949 - DNA, 25 bp, Mus musculus
gcgaacttcgctccctctgtcggtc

SEQ ID NO: 420950 - DNA, 25 bp, Mus musculus
agtaaaggcttcatctcggctttgg

SEQ ID NO: 420951 - DNA, 25 bp, Mus musculus
ggggtgtttgccaacgtctctactg

SEQ ID NO: 420952 - DNA, 25 bp, Mus musculus
gtctctactgacaggaaccagcaaa

SEQ ID NO: 420953 - DNA, 25 bp, Mus musculus
accagcaaacttcaggactcaaatg

SEQ ID NO: 420954 - DNA, 25 bp, Mus musculus
atttattgatgcaaagcaggtctgc

SEQ ID NO: 420955 - DNA, 25 bp, Mus musculus
gggctgattatcatgagaaaggctg

SEQ ID NO: 420956 - DNA, 25 bp, Mus musculus
attatcatgagaaaggctgtgcctg

SEQ ID NO: 420957 - DNA, 25 bp, Mus musculus
ctggaggagtcaccagaaaacttgc

SEQ ID NO: 420958 - DNA, 25 bp, Mus musculus
aaaaggggctctggaggagtcacca

SEQ ID NO: 420959 - DNA, 25 bp, Mus musculus
gtcaccagaaaacttgcagcaagtt

SEQ ID NO: 420960 - DNA, 25 bp, Mus musculus
gctgtgcctggaaaagcctcctcca

SEQ ID NO: 420961 - DNA, 25 bp, Mus musculus
ggactcaaatgagcatcttaattta

SEQ ID NO: 420962 - DNA, 25 bp, Mus musculus
ccagggaactggatatctagcgaga

SEQ ID NO: 420963 - DNA, 25 bp, Mus musculus
cttccagcttcaggacggaaccgga

SEQ ID NO: 420964 - DNA, 25 bp, Mus musculus
gccggagccacagcctggaccagaa

SEQ ID NO: 420965 - DNA, 25 bp, Mus musculus
cagccaggcgttttgttcgctgaga

SEQ ID NO: 420966 - DNA, 25 bp, Mus musculus
agcggagctgacagtgattttgaca

SEQ ID NO: 420967 - DNA, 25 bp, Mus musculus
tgacagtgattccaacccgcttttg

SEQ ID NO: 420968 - DNA, 25 bp, Mus musculus
cggggcttccgaatatgttttatga

SEQ ID NO: 420969 - DNA, 25 bp, Mus musculus
ttatgacggttgattttacaccagg

SEQ ID NO: 420970 - DNA, 25 bp, Mus musculus
ttacaccaggaggtttgtctccgag

SEQ ID NO: 420971 - DNA, 25 bp, Mus musculus
ggcgttcgccgtctttcttatctct

SEQ ID NO: 420972 - DNA, 25 bp, Mus musculus
tctccgaggaagacccagggaactg

SEQ ID NO: 420973 - DNA, 25 bp, Mus musculus
tctagcgagaacttcctacggcttc

SEQ ID NO: 420974 - DNA, 25 bp, Mus musculus
cctcgggaaaatgggagctgctgca

SEQ ID NO: 420975 - DNA, 25 bp, Mus musculus
agctgctgcaaagttggcgttcgcc

SEQ ID NO: 420976 - DNA, 25 bp, Mus musculus
ctaaatcgggcaaagccggccgccg

SEQ ID NO: 420977 - DNA, 25 bp, Mus musculus
gggcaggcctcctgctttaggccta

SEQ ID NO: 420978 - DNA, 25 bp, Mus musculus
aggatgttcaccaccttctcagtcc

SEQ ID NO: 420979 - DNA, 25 bp, Mus musculus
cacgtgacctgctttcaggtcggtc

SEQ ID NO: 420980 - DNA, 25 bp, Mus musculus
agcatgcacggcgaccggccggctt

SEQ ID NO: 420981 - DNA, 25 bp, Mus musculus
accgcgcacagcaactcccagcatg

SEQ ID NO: 420982 - DNA, 25 bp, Mus musculus
tgaggaccgaaggatgttcaccacc

SEQ ID NO: 420983 - DNA, 25 bp, Mus musculus
tcaagcctgcctaaatcgggcaaag

SEQ ID NO: 420984 - DNA, 25 bp, Mus musculus
tcccagtcaagcctgcctaaatcgg

SEQ ID NO: 420985 - DNA, 25 bp, Mus musculus
agaccggccttacctctcccagtca

SEQ ID NO: 420986 - DNA, 25 bp, Mus musculus
cctcagattgtccacccgcccgtag

SEQ ID NO: 420987 - DNA, 25 bp, Mus musculus
agagccaggggcaggcctcctgctt

SEQ ID NO: 420988 - DNA, 25 bp, Mus musculus
ttcgtccacagcagctcccggaagc

SEQ ID NO: 420989 - DNA, 25 bp, Mus musculus
tgcggccctcaccttgcctacgaga

SEQ ID NO: 420990 - DNA, 25 bp, Mus musculus
ggccgccatgttgttgcgtcccagt

SEQ ID NO: 420991 - DNA, 25 bp, Mus musculus
gtccttgggctaaggcgctattttc

SEQ ID NO: 420992 - DNA, 25 bp, Mus musculus
gccgctgtggtaatgtccgccatgt

SEQ ID NO: 420993 - DNA, 25 bp, Mus musculus
ctgttcctgtaaggcggggagacaa

SEQ ID NO: 420994 - DNA, 25 bp, Mus musculus
agtaaactctccttccgagcgcggg

SEQ ID NO: 420995 - DNA, 25 bp, Mus musculus
taccgcggcaaggacatgcctgatc

SEQ ID NO: 420996 - DNA, 25 bp, Mus musculus
catgcctgatctcaacgactgcgtc

SEQ ID NO: 420997 - DNA, 25 bp, Mus musculus
aacgactgcgtctccatcaaccggg

SEQ ID NO: 420998 - DNA, 25 bp, Mus musculus
tcggtagggactcgagtgtttatta

SEQ ID NO: 420999 - DNA, 25 bp, Mus musculus
gggcctcgccattcacagagcgctt

SEQ ID NO: 421000 - DNA, 25 bp, Mus musculus
tgcgtcccagtgttgtgattagctc

SEQ ID NO: 421001 - DNA, 25 bp, Mus musculus
gcacttggcgtacagcctctgttta

SEQ ID NO: 421002 - DNA, 25 bp, Mus musculus
gtgattagctctcggcgccgcttac

SEQ ID NO: 421003 - DNA, 25 bp, Mus musculus
ttacctcgtagacatctcgccggga

SEQ ID NO: 421004 - DNA, 25 bp, Mus musculus
ttacacccagggtgaggcggatctc

SEQ ID NO: 421005 - DNA, 25 bp, Mus musculus
aaaagagcccttgcctggtgactcc

SEQ ID NO: 421006 - DNA, 25 bp, Mus musculus
tcgcgggtggatcgtaaaagagccc

SEQ ID NO: 421007 - DNA, 25 bp, Mus musculus
gggatcttccggacgctacctccga

SEQ ID NO: 421008 - DNA, 25 bp, Mus musculus
caccatagcctgagtggggatcttc

SEQ ID NO: 421009 - DNA, 25 bp, Mus musculus
ggtaagtggccttggtgtcttgccc

SEQ ID NO: 421010 - DNA, 25 bp, Mus musculus
cccaaattcaaaggcgaggagacgg

SEQ ID NO: 421011 - DNA, 25 bp, Mus musculus
atcaaagtgatgtgccggttccggc

SEQ ID NO: 421012 - DNA, 25 bp, Mus musculus
gcggatccagccgaatgcagcatca

SEQ ID NO: 421013 - DNA, 25 bp, Mus musculus
gtccagcgcaggcttgagatgacct

SEQ ID NO: 421014 - DNA, 25 bp, Mus musculus
agggcggcccacctgatacgctgct

SEQ ID NO: 421015 - DNA, 25 bp, Mus musculus
attgctccctgagcatcgcctagtc

SEQ ID NO: 421016 - DNA, 25 bp, Mus musculus
aggcggatctctgcagtgacgtcac

SEQ ID NO: 421017 - DNA, 25 bp, Mus musculus
tcgggtgggcctattgttcccactc

SEQ ID NO: 421018 - DNA, 25 bp, Mus musculus
aagtacggcgattagcgctgcgctc

SEQ ID NO: 421019 - DNA, 25 bp, Mus musculus
cgggagtcgcgtcacccgtgagctc

SEQ ID NO: 421020 - DNA, 25 bp, Mus musculus
tttggtcacagcttggcacgtcacg

SEQ ID NO: 421021 - DNA, 25 bp, Mus musculus
ggggaaagggacatatttggtcaca

SEQ ID NO: 421022 - DNA, 25 bp, Mus musculus
caggcggacgtccaagtggcagccc

SEQ ID NO: 421023 - DNA, 25 bp, Mus musculus
gacactcgggcaggcggacgtccaa

SEQ ID NO: 421024 - DNA, 25 bp, Mus musculus
gcgcagggatctggcccgcgacact

SEQ ID NO: 421025 - DNA, 25 bp, Mus musculus
tacctttcctgaagggcatcgcgcc

SEQ ID NO: 421026 - DNA, 25 bp, Mus musculus
cccgagagacgctacctttcctgaa

SEQ ID NO: 421027 - DNA, 25 bp, Mus musculus
ggaccagggtctcaacacacgggac

SEQ ID NO: 421028 - DNA, 25 bp, Mus musculus
gcggacactactaggctgccaggga

SEQ ID NO: 421029 - DNA, 25 bp, Mus musculus
ccacgtggtgtagccgcggacacta

SEQ ID NO: 421030 - DNA, 25 bp, Mus musculus
ggttcccgcatccacgtggtgtagc

SEQ ID NO: 421031 - DNA, 25 bp, Mus musculus
tcacccgtgagctctgggagcttgc

SEQ ID NO: 421032 - DNA, 25 bp, Mus musculus
agctcctctttgcacgggtgcatta

SEQ ID NO: 421033 - DNA, 25 bp, Mus musculus
accgccaagtgcgagccagctcccg

SEQ ID NO: 421034 - DNA, 25 bp, Mus musculus
tgggaacagctcctctttgcacggg

SEQ ID NO: 421035 - DNA, 25 bp, Mus musculus
cgggtgcattaaacgacctactcgc

SEQ ID NO: 421036 - DNA, 25 bp, Mus musculus
ttcactgggcttggtgccaccgggc

SEQ ID NO: 421037 - DNA, 25 bp, Mus musculus
tctccgggacgacccaggtggctcg

SEQ ID NO: 421038 - DNA, 25 bp, Mus musculus
ggccacagccatcgccagcccggag

SEQ ID NO: 421039 - DNA, 25 bp, Mus musculus
gctgcggcgagcactgcgaaacgcc

SEQ ID NO: 421040 - DNA, 25 bp, Mus musculus
cccgcggagcatggggactctccga

SEQ ID NO: 421041 - DNA, 25 bp, Mus musculus
agcatggggactctccgaaccgcag

SEQ ID NO: 421042 - DNA, 25 bp, Mus musculus
caggggagcgcagctgcccacatct

SEQ ID NO: 421043 - DNA, 25 bp, Mus musculus
cccacatctggatgggggaccgagc

SEQ ID NO: 421044 - DNA, 25 bp, Mus musculus
gacctactcgcgttcactgggcttg

SEQ ID NO: 421045 - DNA, 25 bp, Mus musculus
agctgcgtggtctcccggtgactcc

SEQ ID NO: 421046 - DNA, 25 bp, Mus musculus
ctctcgcccgtctaggttctatttg

SEQ ID NO: 421047 - DNA, 25 bp, Mus musculus
gctctttgtcccgaggttcaggaga

SEQ ID NO: 421048 - DNA, 25 bp, Mus musculus
gcgttccgacactgggctctttgtc

SEQ ID NO: 421049 - DNA, 25 bp, Mus musculus
ggattgattgtcgtgcaacctcagg

SEQ ID NO: 421050 - DNA, 25 bp, Mus musculus
ccaagtctctcgaggaagggctgtc

SEQ ID NO: 421051 - DNA, 25 bp, Mus musculus
tcgccgctgcaaggtgaggacctag

SEQ ID NO: 421052 - DNA, 25 bp, Mus musculus
tctcgcgctgcagcatcgacgaata

SEQ ID NO: 421053 - DNA, 25 bp, Mus musculus
caaccagtttctgcaggagggaggc

SEQ ID NO: 421054 - DNA, 25 bp, Mus musculus
gcgggagctgcctgttcaacaagcc

SEQ ID NO: 421055 - DNA, 25 bp, Mus musculus
ccctcaaggtactagcgcggagaac

SEQ ID NO: 421056 - DNA, 25 bp, Mus musculus
cgaccctcaggagtgcagccgagca

SEQ ID NO: 421057 - DNA, 25 bp, Mus musculus
tgcaccttgacgcacgacgccatgt

SEQ ID NO: 421058 - DNA, 25 bp, Mus musculus
aagaaacgattggatgccctcgata

SEQ ID NO: 421059 - DNA, 25 bp, Mus musculus
gcagtccttcggtctccttgtagta

SEQ ID NO: 421060 - DNA, 25 bp, Mus musculus
cgtggccaccgcgtttcatacaagg

SEQ ID NO: 421061 - DNA, 25 bp, Mus musculus
actcccgctggagtgagtacccagg

SEQ ID NO: 421062 - DNA, 25 bp, Mus musculus
ggcgagcacaagaaactcccgctgg

SEQ ID NO: 421063 - DNA, 25 bp, Mus musculus
ctggcgaaagcttcccaggctgcgg

SEQ ID NO: 421064 - DNA, 25 bp, Mus musculus
ctgcaagttcaaagctggcgaaagc

SEQ ID NO: 421065 - DNA, 25 bp, Mus musculus
tggagacgtcaggagctgcaagttc

SEQ ID NO: 421066 - DNA, 25 bp, Mus musculus
tacaaggcgattagctgagcgcagc

SEQ ID NO: 421067 - DNA, 25 bp, Mus musculus
ttgcccacccgaggcggtagtagga

SEQ ID NO: 421068 - DNA, 25 bp, Mus musculus
ctggcggcagggacacgagcatccc

SEQ ID NO: 421069 - DNA, 25 bp, Mus musculus
gcgggccaggccaatgaacgcatcc

SEQ ID NO: 421070 - DNA, 25 bp, Mus musculus
tgttgctgccgggttttgcccaccc

SEQ ID NO: 421071 - DNA, 25 bp, Mus musculus
ctgcacacgctgattggccctgcga

SEQ ID NO: 421072 - DNA, 25 bp, Mus musculus
aacgcatcccgcagagggctcggct

SEQ ID NO: 421073 - DNA, 25 bp, Mus musculus
gtcggtagtacgctcagcgcgcgct

SEQ ID NO: 421074 - DNA, 25 bp, Mus musculus
gagtagttgcctccgagcccatcga

SEQ ID NO: 421075 - DNA, 25 bp, Mus musculus
cccaggcctgagtagttgcctccga

SEQ ID NO: 421076 - DNA, 25 bp, Mus musculus
caggcagaggcgctgctgacgccca

SEQ ID NO: 421077 - DNA, 25 bp, Mus musculus
gcaagatggcggctactgcggtcca

SEQ ID NO: 421078 - DNA, 25 bp, Mus musculus
tgggaaccatccgtaccagtcaccg

SEQ ID NO: 421079 - DNA, 25 bp, Mus musculus
cacggtcacccgtgagtgtgcagaa

SEQ ID NO: 421080 - DNA, 25 bp, Mus musculus
gggtgggaaccatccgtaccagtca

SEQ ID NO: 421081 - DNA, 25 bp, Mus musculus
tagttgcctccgagcccatcgatgc

SEQ ID NO: 421082 - DNA, 25 bp, Mus musculus
cacccgtgagtgtgcagaagagacc

SEQ ID NO: 421083 - DNA, 25 bp, Mus musculus
cgagcccatcgatgccgtcggtcga

SEQ ID NO: 421084 - DNA, 25 bp, Mus musculus
cccagcaggtctgcgctccgagcgc

SEQ ID NO: 421085 - DNA, 25 bp, Mus musculus
agcccaggacagaggtgggtcgaca

SEQ ID NO: 421086 - DNA, 25 bp, Mus musculus
catcgatgccgtcggtcgatcttcg

SEQ ID NO: 421087 - DNA, 25 bp, Mus musculus
tgacgcccaggcctgagtagttgcc

SEQ ID NO: 421088 - DNA, 25 bp, Mus musculus
gaggctttggggatcttctcccagc

SEQ ID NO: 421089 - DNA, 25 bp, Mus musculus
agccgctctgcaccggtggcacaga

SEQ ID NO: 421090 - DNA, 25 bp, Mus musculus
gagagctggcacagagtgatccctg

SEQ ID NO: 421091 - DNA, 25 bp, Mus musculus
cattagcagacagggcaccagatcc

SEQ ID NO: 421092 - DNA, 25 bp, Mus musculus
ccgggaagtccctcaaggagccaca

SEQ ID NO: 421093 - DNA, 25 bp, Mus musculus
aggataacattttccggcggctcgg

SEQ ID NO: 421094 - DNA, 25 bp, Mus musculus
ccctgcccagaaaggataacatttt

SEQ ID NO: 421095 - DNA, 25 bp, Mus musculus
agggtcactccggacacctagcgtc

SEQ ID NO: 421096 - DNA, 25 bp, Mus musculus
gaaggacaacacaaggccatgcggc

SEQ ID NO: 421097 - DNA, 25 bp, Mus musculus
ccggcacggctccaaggaaggacaa

SEQ ID NO: 421098 - DNA, 25 bp, Mus musculus
gggcttccacgctgctctgtatgct

SEQ ID NO: 421099 - DNA, 25 bp, Mus musculus
ctggtgacacccatgaggggcttcc

SEQ ID NO: 421100 - DNA, 25 bp, Mus musculus
agaggctcctccagcagggtcactc

SEQ ID NO: 421101 - DNA, 25 bp, Mus musculus
cagcgcattcctgacagtaggcgtc

SEQ ID NO: 421102 - DNA, 25 bp, Mus musculus
tctgctttgtttcacgctctccgcg

SEQ ID NO: 421103 - DNA, 25 bp, Mus musculus
cccgttggcggaaagtgtaagcagc

SEQ ID NO: 421104 - DNA, 25 bp, Mus musculus
ctcctccccttttatggagcctggg

SEQ ID NO: 421105 - DNA, 25 bp, Mus musculus
gagaaggaaaccgatccgcctcctc

SEQ ID NO: 421106 - DNA, 25 bp, Mus musculus
tgagagaaggaaaccgatccgcctc

SEQ ID NO: 421107 - DNA, 25 bp, Mus musculus
tctcaatgagagaaggaaaccgatc

SEQ ID NO: 421108 - DNA, 25 bp, Mus musculus
ccgctccgctttctcaatgagagaa

SEQ ID NO: 421109 - DNA, 25 bp, Mus musculus
tctccgcgccgctttatacgcccag

SEQ ID NO: 421110 - DNA, 25 bp, Mus musculus
gaaagtgtaagcagcgcgccctcta

SEQ ID NO: 421111 - DNA, 25 bp, Mus musculus
ggtctgctttgtttcacgctctccg

SEQ ID NO: 421112 - DNA, 25 bp, Mus musculus
gtccaattccgatcggtctgctttg

SEQ ID NO: 421113 - DNA, 25 bp, Mus musculus
cccaagtccaattccgatcggtctg

SEQ ID NO: 421114 - DNA, 25 bp, Mus musculus
tcttcccaagtccaattccgatcgg

SEQ ID NO: 421115 - DNA, 25 bp, Mus musculus
tttatacgcccagccttccaatccg

SEQ ID NO: 421116 - DNA, 25 bp, Mus musculus
ccacgcgtgggagccagacctgctg

SEQ ID NO: 421117 - DNA, 25 bp, Mus musculus
agttccgtttccttggagactcagt

SEQ ID NO: 421118 - DNA, 25 bp, Mus musculus
tccagttccgtttccttggagactc

SEQ ID NO: 421119 - DNA, 25 bp, Mus musculus
cgggagcgctaaactggaggtgaac

SEQ ID NO: 421120 - DNA, 25 bp, Mus musculus
caggcctcggagatgttcgagcagc

SEQ ID NO: 421121 - DNA, 25 bp, Mus musculus
aaagcgacttgccaggcctcggaga

SEQ ID NO: 421122 - DNA, 25 bp, Mus musculus
ctgcaacccggggaaaagcgacttg

SEQ ID NO: 421123 - DNA, 25 bp, Mus musculus
ttcctgcactgcaacccggggaaaa

SEQ ID NO: 421124 - DNA, 25 bp, Mus musculus
cccgtgagtccctgcctattgagca

SEQ ID NO: 421125 - DNA, 25 bp, Mus musculus
ggagccagacctgctgcgcccgtga

SEQ ID NO: 421126 - DNA, 25 bp, Mus musculus
agactcagtttggaagggcggagcc

SEQ ID NO: 421127 - DNA, 25 bp, Mus musculus
gcgggtgagaaaagaggccgtatcc

SEQ ID NO: 421128 - DNA, 25 bp, Mus musculus
accgcgcaggacacgtgctccggga

SEQ ID NO: 421129 - DNA, 25 bp, Mus musculus
gacaaaacccgtgagtccctgccta

SEQ ID NO: 421130 - DNA, 25 bp, Mus musculus
gccggtgccttagaactgaactcta

SEQ ID NO: 421131 - DNA, 25 bp, Mus musculus
aacctggcttcagcgacgagcagcg

SEQ ID NO: 421132 - DNA, 25 bp, Mus musculus
actaacctggcttcagcgacgagca

SEQ ID NO: 421133 - DNA, 25 bp, Mus musculus
tcgaaaacactaacctggcttcagc

SEQ ID NO: 421134 - DNA, 25 bp, Mus musculus
tctacctcgaaaacactaacctggc

SEQ ID NO: 421135 - DNA, 25 bp, Mus musculus
gccttagaactgaactctacctcga

SEQ ID NO: 421136 - DNA, 25 bp, Mus musculus
cccggaagccggtgccttagaactg

SEQ ID NO: 421137 - DNA, 25 bp, Mus musculus
gatggatcaagcactcacccgctcg

SEQ ID NO: 421138 - DNA, 25 bp, Mus musculus
accgaggatggatcaagcactcacc

SEQ ID NO: 421139 - DNA, 25 bp, Mus musculus
cggaccgaggatggatcaagcactc

SEQ ID NO: 421140 - DNA, 25 bp, Mus musculus
accgcgcgccgggtggagcatccct

SEQ ID NO: 421141 - DNA, 25 bp, Mus musculus
cagaccccgagtcgcggcgctggaa

SEQ ID NO: 421142 - DNA, 25 bp, Mus musculus
agcgggcgagtctccaggcagcgca

SEQ ID NO: 421143 - DNA, 25 bp, Mus musculus
agaactgaactctacctcgaaaaca

SEQ ID NO: 421144 - DNA, 25 bp, Mus musculus
gccaccgcccgttggattggctcga

SEQ ID NO: 421145 - DNA, 25 bp, Mus musculus
ccgtgccaccggttactgggtgtct

SEQ ID NO: 421146 - DNA, 25 bp, Mus musculus
ccctggagccgcttctggagacttg

SEQ ID NO: 421147 - DNA, 25 bp, Mus musculus
ggagagcagacggacgcctacctaa

SEQ ID NO: 421148 - DNA, 25 bp, Mus musculus
ggacgcctacctaactctgaccagg

SEQ ID NO: 421149 - DNA, 25 bp, Mus musculus
gggccattgcctgccgagtgacgtt

SEQ ID NO: 421150 - DNA, 25 bp, Mus musculus
ctggcccgcagacgggaaagccttt

SEQ ID NO: 421151 - DNA, 25 bp, Mus musculus
cagggctttgccctgcgaacctcgg

SEQ ID NO: 421152 - DNA, 25 bp, Mus musculus
tttagttagggtctttggctcaggc

SEQ ID NO: 421153 - DNA, 25 bp, Mus musculus
ggctcaggctcgctccagtgctcat

SEQ ID NO: 421154 - DNA, 25 bp, Mus musculus
cccggcctcgaacttgtggttctgc

SEQ ID NO: 421155 - DNA, 25 bp, Mus musculus
ttctgccggagtggttgagattaca

SEQ ID NO: 421156 - DNA, 25 bp, Mus musculus
ttacaggtgcgcgagtcagcaaacc

SEQ ID NO: 421157 - DNA, 25 bp, Mus musculus
cgggctgcacgcgtgagtaaataag

SEQ ID NO: 421158 - DNA, 25 bp, Mus musculus
agggcaccttttgcgctcgcgatca

SEQ ID NO: 421159 - DNA, 25 bp, Mus musculus
agaattcccatcctcgggcagcgga

SEQ ID NO: 421160 - DNA, 25 bp, Mus musculus
tggtgattgaacagcctccagatcc

SEQ ID NO: 421161 - DNA, 25 bp, Mus musculus
ccagcctcaccctggtgattgaaca

SEQ ID NO: 421162 - DNA, 25 bp, Mus musculus
cgatcaaatcggagaaatgggtgta

SEQ ID NO: 421163 - DNA, 25 bp, Mus musculus
tccagatccgggtaaagagaattcc

SEQ ID NO: 421164 - DNA, 25 bp, Mus musculus
cgaaccagacggatccagcactagt

SEQ ID NO: 421165 - DNA, 25 bp, Mus musculus
ccaaacacaattgcgggcaggcgac

SEQ ID NO: 421166 - DNA, 25 bp, Mus musculus
ttgtctgctcgaacctcgcgggcca

SEQ ID NO: 421167 - DNA, 25 bp, Mus musculus
ccgtgcggcccaaacacaattgcgg

SEQ ID NO: 421168 - DNA, 25 bp, Mus musculus
agggtcagggccctcggtcctcact

SEQ ID NO: 421169 - DNA, 25 bp, Mus musculus
ttccgcattctgcaagccgtgggct

SEQ ID NO: 421170 - DNA, 25 bp, Mus musculus
gcactagttccagttttccgcattc

SEQ ID NO: 421171 - DNA, 25 bp, Mus musculus
gtgtatggcgggaggaacctctccc

SEQ ID NO: 421172 - DNA, 25 bp, Mus musculus
ccgtacgaggacgacatggttcaga

SEQ ID NO: 421173 - DNA, 25 bp, Mus musculus
ggcttctcggttgtcgccttcccga

SEQ ID NO: 421174 - DNA, 25 bp, Mus musculus
agcctcggggagaagtgctctccca

SEQ ID NO: 421175 - DNA, 25 bp, Mus musculus
ccgttcttgccgtacgaggacgaca

SEQ ID NO: 421176 - DNA, 25 bp, Mus musculus
ctgcggacactgaagccggagcgct

SEQ ID NO: 421177 - DNA, 25 bp, Mus musculus
atccattaacaaaacgtcgcgtgtg

SEQ ID NO: 421178 - DNA, 25 bp, Mus musculus
gagcgccgcaccttaaaggggccga

SEQ ID NO: 421179 - DNA, 25 bp, Mus musculus
caaagaagccagtgaggaccgcagc

SEQ ID NO: 421180 - DNA, 25 bp, Mus musculus
tgaactcgacacaccggggccacaa

SEQ ID NO: 421181 - DNA, 25 bp, Mus musculus
gatcttttcaacctgctcctccggg

SEQ ID NO: 421182 - DNA, 25 bp, Mus musculus
gtggtgctgccatccgatcttttca

SEQ ID NO: 421183 - DNA, 25 bp, Mus musculus
agctggtagaagtggtgctgccatc

SEQ ID NO: 421184 - DNA, 25 bp, Mus musculus
cctgtctgaggatgaagctggtaga

SEQ ID NO: 421185 - DNA, 25 bp, Mus musculus
ggctggagtcctccttgggaaccgc

SEQ ID NO: 421186 - DNA, 25 bp, Mus musculus
aggtcgcttgccatgattcttcatg

SEQ ID NO: 421187 - DNA, 25 bp, Mus musculus
ctttgacttcggaggtcgcttgcca

SEQ ID NO: 421188 - DNA, 25 bp, Mus musculus
ctggcttgttactcgctttgacttc

SEQ ID NO: 421189 - DNA, 25 bp, Mus musculus
ggccttccgtggaaactggccctgc

SEQ ID NO: 421190 - DNA, 25 bp, Mus musculus
cgcggtcagcccgaagaactcagct

SEQ ID NO: 421191 - DNA, 25 bp, Mus musculus
tttcattcaaactggcgcggtcagc

SEQ ID NO: 421192 - DNA, 25 bp, Mus musculus
gccatcttgcggagctttcattcaa

SEQ ID NO: 421193 - DNA, 25 bp, Mus musculus
acccttgaataaggcacctcgtgca

SEQ ID NO: 421194 - DNA, 25 bp, Mus musculus
gtgtgctttcctgctcacccttgaa

SEQ ID NO: 421195 - DNA, 25 bp, Mus musculus
acgcaggcaccaggggattcccttt

SEQ ID NO: 421196 - DNA, 25 bp, Mus musculus
aaagacctgacgtgcccgccacaaa

SEQ ID NO: 421197 - DNA, 25 bp, Mus musculus
cccggcttcagcatccacagaaata

SEQ ID NO: 421198 - DNA, 25 bp, Mus musculus
ataacctgcaagttccagccgggcc

SEQ ID NO: 421199 - DNA, 25 bp, Mus musculus
tgcccgccacaaaacgcaaaatagg

SEQ ID NO: 421200 - DNA, 25 bp, Mus musculus
gctcatttcctgtggcgtgattccc

SEQ ID NO: 421201 - DNA, 25 bp, Mus musculus
tgcgctaggtcagggccttggtcca

SEQ ID NO: 421202 - DNA, 25 bp, Mus musculus
gcggcccaggccgtcagacaaagac

SEQ ID NO: 421203 - DNA, 25 bp, Mus musculus
gtcagacaaagacgagcccgcccag

SEQ ID NO: 421204 - DNA, 25 bp, Mus musculus
cgccgctttcgaggcgcctcagagt

SEQ ID NO: 421205 - DNA, 25 bp, Mus musculus
ttcgaggcgcctcagagttcgcccg

SEQ ID NO: 421206 - DNA, 25 bp, Mus musculus
ttcaagccgaggctgaagccgctcc

SEQ ID NO: 421207 - DNA, 25 bp, Mus musculus
gagcgccgcgggctcatttcctgtg

SEQ ID NO: 421208 - DNA, 25 bp, Mus musculus
atggagacacgcctcacctgagttt

SEQ ID NO: 421209 - DNA, 25 bp, Mus musculus
cctcacctgagtttccagggtcgga

SEQ ID NO: 421210 - DNA, 25 bp, Mus musculus
tttccagggtcggaccgcagagctc

SEQ ID NO: 421211 - DNA, 25 bp, Mus musculus
cgcagagctccaccgttatctcgtg

SEQ ID NO: 421212 - DNA, 25 bp, Mus musculus
caccgttatctcgtgcgctaggtca

SEQ ID NO: 421213 - DNA, 25 bp, Mus musculus
gccagtgacagcgtgatggagacac

SEQ ID NO: 421214 - DNA, 25 bp, Mus musculus
tcacccggccttccgagacgattgt

SEQ ID NO: 421215 - DNA, 25 bp, Mus musculus
tcgcgtccagcgcatccgtgaaggc

SEQ ID NO: 421216 - DNA, 25 bp, Mus musculus
ttccggatcagaccgcctgccaggg

SEQ ID NO: 421217 - DNA, 25 bp, Mus musculus
gccttccgagacgattgtgcccatg

SEQ ID NO: 421218 - DNA, 25 bp, Mus musculus
acgattgtgcccatgggccacggcg

SEQ ID NO: 421219 - DNA, 25 bp, Mus musculus
gcacacccgagtctacgttccggat

SEQ ID NO: 421220 - DNA, 25 bp, Mus musculus
cgagcctccacggagtccgcaaagg

SEQ ID NO: 421221 - DNA, 25 bp, Mus musculus
cacggagtccgcaaagggatgcacc

SEQ ID NO: 421222 - DNA, 25 bp, Mus musculus
tctacgttccggatcagaccgcctg

SEQ ID NO: 421223 - DNA, 25 bp, Mus musculus
agtccgcaaagggatgcaccgcgcg

SEQ ID NO: 421224 - DNA, 25 bp, Mus musculus
cctgcgtgtgactcgcggaagcaaa

SEQ ID NO: 421225 - DNA, 25 bp, Mus musculus
ctcgcggaagcaaagctgcactctc

SEQ ID NO: 421226 - DNA, 25 bp, Mus musculus
aagcaaagctgcactctccggctcg

SEQ ID NO: 421227 - DNA, 25 bp, Mus musculus
cagcgcatccgtgaaggcgcgcaca

SEQ ID NO: 421228 - DNA, 25 bp, Mus musculus
tctctgctgtcccaaagacgtggca

SEQ ID NO: 421229 - DNA, 25 bp, Mus musculus
tgctcatgggatcccgcggttaacc

SEQ ID NO: 421230 - DNA, 25 bp, Mus musculus
tggaaacagctgtcgccttatgaga

SEQ ID NO: 421231 - DNA, 25 bp, Mus musculus
accaggtcaggtcttgctactcgga

SEQ ID NO: 421232 - DNA, 25 bp, Mus musculus
ccaggttgtgacagcagctcttctc

SEQ ID NO: 421233 - DNA, 25 bp, Mus musculus
gtggctcgggaatgtcgtttccttc

SEQ ID NO: 421234 - DNA, 25 bp, Mus musculus
cgccgagcttgcagatcctgagtgg

SEQ ID NO: 421235 - DNA, 25 bp, Mus musculus
tcccaatctcggacaggcaggagtc

SEQ ID NO: 421236 - DNA, 25 bp, Mus musculus
atccgacgcctgatcagacacggca

SEQ ID NO: 421237 - DNA, 25 bp, Mus musculus
acaccctgtagtggcctctctgctg

SEQ ID NO: 421238 - DNA, 25 bp, Mus musculus
cttggctgagctctaacaccctgta

SEQ ID NO: 421239 - DNA, 25 bp, Mus musculus
ttggcagtgaacagaggcatcacgc

SEQ ID NO: 421240 - DNA, 25 bp, Mus musculus
cacatcttgctcgaacgggttggca

SEQ ID NO: 421241 - DNA, 25 bp, Mus musculus
acctttccgcagtgaggacccgaga

SEQ ID NO: 421242 - DNA, 25 bp, Mus musculus
gagcaccatgcggatcggcgcccag

SEQ ID NO: 421243 - DNA, 25 bp, Mus musculus
tgccattgaagctgccgatgcccga

SEQ ID NO: 421244 - DNA, 25 bp, Mus musculus
cacaacgtgccattgaagctgccga

SEQ ID NO: 421245 - DNA, 25 bp, Mus musculus
gaccgatttcaaggcgcacaacgtg

SEQ ID NO: 421246 - DNA, 25 bp, Mus musculus
catggactcgcagcagaccgatttc

SEQ ID NO: 421247 - DNA, 25 bp, Mus musculus
gcacgcagccgacatgggcaacgcg

SEQ ID NO: 421248 - DNA, 25 bp, Mus musculus
aagcggcgtgcgctgagcactaacc

SEQ ID NO: 421249 - DNA, 25 bp, Mus musculus
cgatgcccgagccaggtgaactgga

SEQ ID NO: 421250 - DNA, 25 bp, Mus musculus
tgaactggaggagcgctttgccatc

SEQ ID NO: 421251 - DNA, 25 bp, Mus musculus
gctttgccatcgtgctggtgagtga

SEQ ID NO: 421252 - DNA, 25 bp, Mus musculus
attgtgggctcccagcctcgcttct

SEQ ID NO: 421253 - DNA, 25 bp, Mus musculus
ggcggccacgaacccattgtctggc

SEQ ID NO: 421254 - DNA, 25 bp, Mus musculus
aacccattgtctggcgggagcagca

SEQ ID NO: 421255 - DNA, 25 bp, Mus musculus
agaatgaaaagcaaccggcagaccc

SEQ ID NO: 421256 - DNA, 25 bp, Mus musculus
cggggccaataaactgacaggcttc

SEQ ID NO: 421257 - DNA, 25 bp, Mus musculus
ggccaaagggtaaaggctgccctga

SEQ ID NO: 421258 - DNA, 25 bp, Mus musculus
caggcttccctactgtccaatcaga

SEQ ID NO: 421259 - DNA, 25 bp, Mus musculus
caatcagagcgcgagaccgacaggc

SEQ ID NO: 421260 - DNA, 25 bp, Mus musculus
aagtttctgcgtcgagtgctctgcc

SEQ ID NO: 421261 - DNA, 25 bp, Mus musculus
tgctctgccggggaaactctaccaa

SEQ ID NO: 421262 - DNA, 25 bp, Mus musculus
ggagcggtaaagacagagatctctc

SEQ ID NO: 421263 - DNA, 25 bp, Mus musculus
aggtgcgtgcccacaggacccgaaa

SEQ ID NO: 421264 - DNA, 25 bp, Mus musculus
aataaatgagagtgttgtcgcggcg

SEQ ID NO: 421265 - DNA, 25 bp, Mus musculus
ggacagccgaccttcgcgggactct

SEQ ID NO: 421266 - DNA, 25 bp, Mus musculus
gggactctcagtctttcccgccatg

SEQ ID NO: 421267 - DNA, 25 bp, Mus musculus
cccgccatgtcgttcgtggagagtt

SEQ ID NO: 421268 - DNA, 25 bp, Mus musculus
ggcccgggtattccgactacactca

SEQ ID NO: 421269 - DNA, 25 bp, Mus musculus
agacagagatctctcgcccgaggga

SEQ ID NO: 421270 - DNA, 25 bp, Mus musculus
ctggttgcccagcactgaattcatc

SEQ ID NO: 421271 - DNA, 25 bp, Mus musculus
ggctcctgctccaagcgaacagcgg

SEQ ID NO: 421272 - DNA, 25 bp, Mus musculus
agaacctcttcagggcgcgccgcaa

SEQ ID NO: 421273 - DNA, 25 bp, Mus musculus
tcccaggtccgtaagtgtctcaaga

SEQ ID NO: 421274 - DNA, 25 bp, Mus musculus
ggctcctcagtctccctttcaaagt

SEQ ID NO: 421275 - DNA, 25 bp, Mus musculus
tgaattcatcacgagagcaagcggg

SEQ ID NO: 421276 - DNA, 25 bp, Mus musculus
ccctgctggtgatagagccttgctg

SEQ ID NO: 421277 - DNA, 25 bp, Mus musculus
ttgaccaggaacaggccagccacgt

SEQ ID NO: 421278 - DNA, 25 bp, Mus musculus
agcgcctcgctactgttgaccagga

SEQ ID NO: 421279 - DNA, 25 bp, Mus musculus
gcatgatgtacaggctgcgctcgtc

SEQ ID NO: 421280 - DNA, 25 bp, Mus musculus
cgatctgcaccacacgcatgatgta

SEQ ID NO: 421281 - DNA, 25 bp, Mus musculus
gtgagcgagagcacacacatgactg

SEQ ID NO: 421282 - DNA, 25 bp, Mus musculus
ctccggtccttcactaggaagttga

SEQ ID NO: 421283 - DNA, 25 bp, Mus musculus
cttgatcacttgtgcgcgcagggct

SEQ ID NO: 421284 - DNA, 25 bp, Mus musculus
cgtaaatgatcctagcccagtgaca

SEQ ID NO: 421285 - DNA, 25 bp, Mus musculus
ctctgccgaggtgacaatgtgctag

SEQ ID NO: 421286 - DNA, 25 bp, Mus musculus
cttgccgcgctatgagggagcatct

SEQ ID NO: 421287 - DNA, 25 bp, Mus musculus
aagtatcgcgggacttgtgcgcctc

SEQ ID NO: 421288 - DNA, 25 bp, Mus musculus
ccggggtgctggttacgtaaatgat

SEQ ID NO: 421289 - DNA, 25 bp, Mus musculus
ctggatccaggcagcatcccgtgcg

SEQ ID NO: 421290 - DNA, 25 bp, Mus musculus
ctctgctcgccgagaagtgtgaaga

SEQ ID NO: 421291 - DNA, 25 bp, Mus musculus
gcgggatcgacagccaccgtagcag

SEQ ID NO: 421292 - DNA, 25 bp, Mus musculus
ccgtagcaggtctcagtctttcttc

SEQ ID NO: 421293 - DNA, 25 bp, Mus musculus
ctcttctcttcttggtgacggtttg

SEQ ID NO: 421294 - DNA, 25 bp, Mus musculus
tttcggaccgcaggagagtccggct

SEQ ID NO: 421295 - DNA, 25 bp, Mus musculus
cggtggatctggagagtctgtctct

SEQ ID NO: 421296 - DNA, 25 bp, Mus musculus
actgggtatcgcaactgggctttgt

SEQ ID NO: 421297 - DNA, 25 bp, Mus musculus
tgtccacacactctccgggctagga

SEQ ID NO: 421298 - DNA, 25 bp, Mus musculus
gcatggtaacctgggcagcgagacc

SEQ ID NO: 421299 - DNA, 25 bp, Mus musculus
gcagcgagaccagtcgctacctttc

SEQ ID NO: 421300 - DNA, 25 bp, Mus musculus
accacttcgtcgagcggttcgggct

SEQ ID NO: 421301 - DNA, 25 bp, Mus musculus
ccggtgcaatgtgcagcatggtaac

SEQ ID NO: 421302 - DNA, 25 bp, Mus musculus
taccaggtagtgaccacttcgtcga

SEQ ID NO: 421303 - DNA, 25 bp, Mus musculus
ctgcgcctccgcttcgtgtttgaat

SEQ ID NO: 421304 - DNA, 25 bp, Mus musculus
cgcctccgcttcgtgtttgaatctg

SEQ ID NO: 421305 - DNA, 25 bp, Mus musculus
cctccgtattatgtctgcactccga

SEQ ID NO: 421306 - DNA, 25 bp, Mus musculus
tctgcactccgaaggaaatttgggg

SEQ ID NO: 421307 - DNA, 25 bp, Mus musculus
cccaagaagaaacggcagcggttcg

SEQ ID NO: 421308 - DNA, 25 bp, Mus musculus
tttggggacgattaccaggtagtga

SEQ ID NO: 421309 - DNA, 25 bp, Mus musculus
ttcgggcttacagcctcaggggcca

SEQ ID NO: 421310 - DNA, 25 bp, Mus musculus
acggcagcggttcgtggacaagaac

SEQ ID NO: 421311 - DNA, 25 bp, Mus musculus
cgtggacaagaacggccggtgcaat

SEQ ID NO: 421312 - DNA, 25 bp, Mus musculus
ctctccagggagttttgtagggcac

SEQ ID NO: 421313 - DNA, 25 bp, Mus musculus
cacgtgtacatcacgcgtacggcgt

SEQ ID NO: 421314 - DNA, 25 bp, Mus musculus
agactgacctcagatgcgggcgcaa

SEQ ID NO: 421315 - DNA, 25 bp, Mus musculus
agaaggcgcctagtccgcaccgaca

SEQ ID NO: 421316 - DNA, 25 bp, Mus musculus
gacacagggcctcagtgccctaacg

SEQ ID NO: 421317 - DNA, 25 bp, Mus musculus
aacctggccacgaggtgaacgcaga

SEQ ID NO: 421318 - DNA, 25 bp, Mus musculus
tgaacgcagagtctatggcgacctc

SEQ ID NO: 421319 - DNA, 25 bp, Mus musculus
gggatgcgggcaactttcccagcca

SEQ ID NO: 421320 - DNA, 25 bp, Mus musculus
acgccctaaggctgctggagactga

SEQ ID NO: 421321 - DNA, 25 bp, Mus musculus
atcgggatgtggacacacgtgtaca

SEQ ID NO: 421322 - DNA, 25 bp, Mus musculus
cgcgcccgttgttgcatcgggatgt

SEQ ID NO: 421323 - DNA, 25 bp, Mus musculus
aaagctgggttgaatcgccgttgcc

SEQ ID NO: 421324 - DNA, 25 bp, Mus musculus
tgcaaaatgtcctctccagggagtt

SEQ ID NO: 421325 - DNA, 25 bp, Mus musculus
gtgagtcaggaccacttgcaaaatg

SEQ ID NO: 421326 - DNA, 25 bp, Mus musculus
cgaacaccgtagtgctgacaggccg

SEQ ID NO: 421327 - DNA, 25 bp, Mus musculus
acaggccgcgttgtcaccgcaaaca

SEQ ID NO: 421328 - DNA, 25 bp, Mus musculus
acagcgcacagaccctcattggagg

SEQ ID NO: 421329 - DNA, 25 bp, Mus musculus
agggcacctgcgtgtcaagcaactg

SEQ ID NO: 421330 - DNA, 25 bp, Mus musculus
aagcaactgcgatgcgtggccgatc

SEQ ID NO: 421331 - DNA, 25 bp, Mus musculus
aagcccatggatgccggcttgcgaa

SEQ ID NO: 421332 - DNA, 25 bp, Mus musculus
aggtctgcccatccactacgtggtg

SEQ ID NO: 421333 - DNA, 25 bp, Mus musculus
tcgaagcgcatctggcagctagaca

SEQ ID NO: 421334 - DNA, 25 bp, Mus musculus
aggtgtcttcctctgctcgatcata

SEQ ID NO: 421335 - DNA, 25 bp, Mus musculus
cgatcatatgcgtagtggccacgta

SEQ ID NO: 421336 - DNA, 25 bp, Mus musculus
gccacgtagttctggtggaagttgt

SEQ ID NO: 421337 - DNA, 25 bp, Mus musculus
ccggatcgtcccacatcgggctatg

SEQ ID NO: 421338 - DNA, 25 bp, Mus musculus
gcgaagagggcttgtagtaaaccga

SEQ ID NO: 421339 - DNA, 25 bp, Mus musculus
tcgggctatgctgcacctggaagct

SEQ ID NO: 421340 - DNA, 25 bp, Mus musculus
cctttgtttatgtggctcgagctgc

SEQ ID NO: 421341 - DNA, 25 bp, Mus musculus
cgcgctcgctttggtatatttccga

SEQ ID NO: 421342 - DNA, 25 bp, Mus musculus
ctcgagctgctgctgccaacatgca

SEQ ID NO: 421343 - DNA, 25 bp, Mus musculus
agccgagcgacactgttcccaagca

SEQ ID NO: 421344 - DNA, 25 bp, Mus musculus
ctggccgccaatgtgcctttgttta

SEQ ID NO: 421345 - DNA, 25 bp, Mus musculus
ggcgaccacttgcagagaacccgtt

SEQ ID NO: 421346 - DNA, 25 bp, Mus musculus
cctttacgctagcaccggagttcca

SEQ ID NO: 421347 - DNA, 25 bp, Mus musculus
tgagaagcctggaaacctctgccgg

SEQ ID NO: 421348 - DNA, 25 bp, Mus musculus
agtccgcttctcctaaaactgtggg

SEQ ID NO: 421349 - DNA, 25 bp, Mus musculus
tttgcgcacatctccaccggcaagt

SEQ ID NO: 421350 - DNA, 25 bp, Mus musculus
cacatgttcgcgagatggagcctcc

SEQ ID NO: 421351 - DNA, 25 bp, Mus musculus
tcccggactgtttcccacatgttcg

SEQ ID NO: 421352 - DNA, 25 bp, Mus musculus
tactcgacgatatccgggaaacctc

SEQ ID NO: 421353 - DNA, 25 bp, Mus musculus
atgcacctaaagtctgcgcgcgtca

SEQ ID NO: 421354 - DNA, 25 bp, Mus musculus
tgttggtcctcaaaacgaagcgtgg

SEQ ID NO: 421355 - DNA, 25 bp, Mus musculus
aggcaacaatctctgttgcgagggc

SEQ ID NO: 421356 - DNA, 25 bp, Mus musculus
gcgttggggtctttcattctctttc

SEQ ID NO: 421357 - DNA, 25 bp, Mus musculus
ttcccacgccagaattcaatttacg

SEQ ID NO: 421358 - DNA, 25 bp, Mus musculus
taaatcgcctcttcccaagctcatg

SEQ ID NO: 421359 - DNA, 25 bp, Mus musculus
tcccaagctcatgtttcgctcgttc

SEQ ID NO: 421360 - DNA, 25 bp, Mus musculus
ctcggaggacagctctgcctaagga

SEQ ID NO: 421361 - DNA, 25 bp, Mus musculus
cctaaggaacagcttcgagaaattc

SEQ ID NO: 421362 - DNA, 25 bp, Mus musculus
ccggagacagaaatgggaaaggcca

SEQ ID NO: 421363 - DNA, 25 bp, Mus musculus
ggaaaggccaacttgttggtcctca

SEQ ID NO: 421364 - DNA, 25 bp, Mus musculus
cgaagcgtggacttctccacaaaaa

SEQ ID NO: 421365 - DNA, 25 bp, Mus musculus
aggattctgatcaggcgccttagga

SEQ ID NO: 421366 - DNA, 25 bp, Mus musculus
aaagcaaggccggaggattctgatc

SEQ ID NO: 421367 - DNA, 25 bp, Mus musculus
aggacagcctgaaaggagggccttc

SEQ ID NO: 421368 - DNA, 25 bp, Mus musculus
ggtgaagaacaacttattagtgtga

SEQ ID NO: 421369 - DNA, 25 bp, Mus musculus
gcgattccacgcgaacgaaagggaa

SEQ ID NO: 421370 - DNA, 25 bp, Mus musculus
cccgtgggcaggagcgattccacgc

SEQ ID NO: 421371 - DNA, 25 bp, Mus musculus
aacttattagtgtgagctcggcagc

SEQ ID NO: 421372 - DNA, 25 bp, Mus musculus
tgccctaatgggcgcgaggaaaaaa

SEQ ID NO: 421373 - DNA, 25 bp, Mus musculus
cgctacggctcagcggtgccctaat

SEQ ID NO: 421374 - DNA, 25 bp, Mus musculus
tgcctctccagctgctgccgctacg

SEQ ID NO: 421375 - DNA, 25 bp, Mus musculus
gtgcatcggcctccgggaaacctac

SEQ ID NO: 421376 - DNA, 25 bp, Mus musculus
tccactgtgcatcggcctccgggaa

SEQ ID NO: 421377 - DNA, 25 bp, Mus musculus
cgttgccatcgggtgccctgcggct

SEQ ID NO: 421378 - DNA, 25 bp, Mus musculus
tagcctgcacctccgcctttgccag

SEQ ID NO: 421379 - DNA, 25 bp, Mus musculus
tggggttgctcattcctagcctgca

SEQ ID NO: 421380 - DNA, 25 bp, Mus musculus
ccgggagaacaccgcggaactctcg

SEQ ID NO: 421381 - DNA, 25 bp, Mus musculus
attagtgtgagctcggcagcgtcag

SEQ ID NO: 421382 - DNA, 25 bp, Mus musculus
gcgagcacagacgactgcagacttc

SEQ ID NO: 421383 - DNA, 25 bp, Mus musculus
gtgaaccaatcgaagcactccgaac

SEQ ID NO: 421384 - DNA, 25 bp, Mus musculus
gacaggcccgtgaaccaatcgaagc

SEQ ID NO: 421385 - DNA, 25 bp, Mus musculus
caccggagacgacggacaggcccgt

SEQ ID NO: 421386 - DNA, 25 bp, Mus musculus
gagctccgcctcttcgctgccaaga

SEQ ID NO: 421387 - DNA, 25 bp, Mus musculus
cccagacagcgagcacagacgactg

SEQ ID NO: 421388 - DNA, 25 bp, Mus musculus
ggtctcacgcactatggcggcccgg

SEQ ID NO: 421389 - DNA, 25 bp, Mus musculus
tgccaagacgcaccctcccaccgga

SEQ ID NO: 421390 - DNA, 25 bp, Mus musculus
gctcagtgtcttgagagccacgccc

SEQ ID NO: 421391 - DNA, 25 bp, Mus musculus
ggacagactctggaaccaatccgta

SEQ ID NO: 421392 - DNA, 25 bp, Mus musculus
cacgcggacggacagactctggaac

SEQ ID NO: 421393 - DNA, 25 bp, Mus musculus
cactccgaactggaagggtcacgcg

SEQ ID NO: 421394 - DNA, 25 bp, Mus musculus
gaaccaatccgtacgcgaagcggga

SEQ ID NO: 421395 - DNA, 25 bp, Mus musculus
cgtctgtgctttcgccaccgcggag

SEQ ID NO: 421396 - DNA, 25 bp, Mus musculus
agcccggtccaatacacgttacctg

SEQ ID NO: 421397 - DNA, 25 bp, Mus musculus
cgaaagtgcgttacaaatcgattgc

SEQ ID NO: 421398 - DNA, 25 bp, Mus musculus
tcgattgcaatttcctagaagacgc

SEQ ID NO: 421399 - DNA, 25 bp, Mus musculus
acgcagcaaagttctccgcagcctg

SEQ ID NO: 421400 - DNA, 25 bp, Mus musculus
agcctgcttgcctgccacgtgcgag

SEQ ID NO: 421401 - DNA, 25 bp, Mus musculus
aaggaccgggctcaaggctggcctc

SEQ ID NO: 421402 - DNA, 25 bp, Mus musculus
caaggctggcctccggggccaacaa

SEQ ID NO: 421403 - DNA, 25 bp, Mus musculus
caagtccctaaaagtacctgccagg

SEQ ID NO: 421404 - DNA, 25 bp, Mus musculus
tctggactggtctcattgaagtttc

SEQ ID NO: 421405 - DNA, 25 bp, Mus musculus
agtggtcgagcagcccagctccagc

SEQ ID NO: 421406 - DNA, 25 bp, Mus musculus
gaggcgcgcgctccggttcattgtc

SEQ ID NO: 421407 - DNA, 25 bp, Mus musculus
gtgcagccggcgctataaataaccc

SEQ ID NO: 421408 - DNA, 25 bp, Mus musculus
agcggccgcggaaacaatgacccac

SEQ ID NO: 421409 - DNA, 25 bp, Mus musculus
aaagtacctgccagggcgacagtgg

SEQ ID NO: 421410 - DNA, 25 bp, Mus musculus
tgctaacattcaggcccggggtcca

SEQ ID NO: 421411 - DNA, 25 bp, Mus musculus
ccacccttgctgatttggcttgttc

SEQ ID NO: 421412 - DNA, 25 bp, Mus musculus
tggcttgttcttctcagcgggtccc

SEQ ID NO: 421413 - DNA, 25 bp, Mus musculus
tggaggatcctgactcccttgctcg

SEQ ID NO: 421414 - DNA, 25 bp, Mus musculus
ctggagcgcccacagaacacgctgg

SEQ ID NO: 421415 - DNA, 25 bp, Mus musculus
tagacgcctttctaggcccagggaa

SEQ ID NO: 421416 - DNA, 25 bp, Mus musculus
cgacgggtgatcaggtaaggcaacc

SEQ ID NO: 421417 - DNA, 25 bp, Mus musculus
ggctcagggcaggatcgataacctc

SEQ ID NO: 421418 - DNA, 25 bp, Mus musculus
gataacctcgggcatggccagccca

SEQ ID NO: 421419 - DNA, 25 bp, Mus musculus
ttccgcatttccctgccgggcagag

SEQ ID NO: 421420 - DNA, 25 bp, Mus musculus
tcagggccactctggttctcggtga

SEQ ID NO: 421421 - DNA, 25 bp, Mus musculus
ccgactccgttctggctggaggatc

SEQ ID NO: 421422 - DNA, 25 bp, Mus musculus
cgaccgatctcaggtgtgtgcgtcc

SEQ ID NO: 421423 - DNA, 25 bp, Mus musculus
tctttcctccagctagcaaggagtg

SEQ ID NO: 421424 - DNA, 25 bp, Mus musculus
gcagccgcgacacccttcggaagtg

SEQ ID NO: 421425 - DNA, 25 bp, Mus musculus
tgacacctcttgtgggcgaagagaa

SEQ ID NO: 421426 - DNA, 25 bp, Mus musculus
aggtgacacctcttgtgggcgaaga

SEQ ID NO: 421427 - DNA, 25 bp, Mus musculus
gccgcgcctccacgggtacggctgc

SEQ ID NO: 421428 - DNA, 25 bp, Mus musculus
ggctctagtgacagcgggcgctccc

SEQ ID NO: 421429 - DNA, 25 bp, Mus musculus
ttggctctagtgacagcgggcgctc

SEQ ID NO: 421430 - DNA, 25 bp, Mus musculus
cccttcggaagtgcgcggttggctc

SEQ ID NO: 421431 - DNA, 25 bp, Mus musculus
acacccttcggaagtgcgcggttgg

SEQ ID NO: 421432 - DNA, 25 bp, Mus musculus
ggcggtgcaaggcttcggggtccca

SEQ ID NO: 421433 - DNA, 25 bp, Mus musculus
agccgcgacacccttcggaagtgcg

SEQ ID NO: 421434 - DNA, 25 bp, Mus musculus
cagcgcgggccgctttgaagttccc

SEQ ID NO: 421435 - DNA, 25 bp, Mus musculus
gggcgaagagaagcgggccgcgcca

SEQ ID NO: 421436 - DNA, 25 bp, Mus musculus
cgacacccttcggaagtgcgcggtt

SEQ ID NO: 421437 - DNA, 25 bp, Mus musculus
ccgcgcgctggggtcatggccaccc

SEQ ID NO: 421438 - DNA, 25 bp, Mus musculus
cgataggcaggtgtgtgcgtccaac

SEQ ID NO: 421439 - DNA, 25 bp, Mus musculus
tgctagctgcccagagcgcgtcgag

SEQ ID NO: 421440 - DNA, 25 bp, Mus musculus
ggctccctggctcggatctctcggt

SEQ ID NO: 421441 - DNA, 25 bp, Mus musculus
gtccagggctcccagcttgcagctg

SEQ ID NO: 421442 - DNA, 25 bp, Mus musculus
agcttgcagctgcaaaccgcacgct

SEQ ID NO: 421443 - DNA, 25 bp, Mus musculus
cctcctcgcgctgccaggagttaga

SEQ ID NO: 421444 - DNA, 25 bp, Mus musculus
ccaggagttagagcgagcagctgca

SEQ ID NO: 421445 - DNA, 25 bp, Mus musculus
agcagctgcacccaacggagggtcg

SEQ ID NO: 421446 - DNA, 25 bp, Mus musculus
atagtgactgagtgcgacacccggc

SEQ ID NO: 421447 - DNA, 25 bp, Mus musculus
acccttcggcgtggatgtccctggt

SEQ ID NO: 421448 - DNA, 25 bp, Mus musculus
tgtccctggtccctggagcgacgac

SEQ ID NO: 421449 - DNA, 25 bp, Mus musculus
aggctgccgcacttcggccagtttg

SEQ ID NO: 421450 - DNA, 25 bp, Mus musculus
ctcttactccttgggaaacgagagg

SEQ ID NO: 421451 - DNA, 25 bp, Mus musculus
ctccgcctgagctggaaagtaagtg

SEQ ID NO: 421452 - DNA, 25 bp, Mus musculus
gactcgcgctgccaatgaggtcccg

SEQ ID NO: 421453 - DNA, 25 bp, Mus musculus
cccaccgtgagctgaaagtgtgtga

SEQ ID NO: 421454 - DNA, 25 bp, Mus musculus
ccttccggaacacgcgcaagggcgg

SEQ ID NO: 421455 - DNA, 25 bp, Mus musculus
aagtgtgtgattcgctcctgcaggc

SEQ ID NO: 421456 - DNA, 25 bp, Mus musculus
cgcgccgaaagctggaaactttcct

SEQ ID NO: 421457 - DNA, 25 bp, Mus musculus
ctttcctggcaggtaactctcgctg

SEQ ID NO: 421458 - DNA, 25 bp, Mus musculus
aggtaactctcgctgccggggcgcc

SEQ ID NO: 421459 - DNA, 25 bp, Mus musculus
tggggaatcgtatcgcccaccgtga

SEQ ID NO: 421460 - DNA, 25 bp, Mus musculus
cgcacagggaaggtgccttccggaa

SEQ ID NO: 421461 - DNA, 25 bp, Mus musculus
gctttcccggaataggcgcaggcac

SEQ ID NO: 421462 - DNA, 25 bp, Mus musculus
gatcacgcggcgctcaggactttcc

SEQ ID NO: 421463 - DNA, 25 bp, Mus musculus
ctcttcggtcccttggctagacagg

SEQ ID NO: 421464 - DNA, 25 bp, Mus musculus
caagttcccgggagaacttcagcgg

SEQ ID NO: 421465 - DNA, 25 bp, Mus musculus
ccagcgggagctttcccggaatagg

SEQ ID NO: 421466 - DNA, 25 bp, Mus musculus
tctgaggtcaccaagtctgcactgc

SEQ ID NO: 421467 - DNA, 25 bp, Mus musculus
ctctctcggcgcacaagaggccggg

SEQ ID NO: 421468 - DNA, 25 bp, Mus musculus
cacctggcgtgcagcccacactcac

SEQ ID NO: 421469 - DNA, 25 bp, Mus musculus
cacttccctcgcacccggactgaga

SEQ ID NO: 421470 - DNA, 25 bp, Mus musculus
gctccggggtcgaggtcacgcacct

SEQ ID NO: 421471 - DNA, 25 bp, Mus musculus
cgtgttacctaactgaggtgggcgt

SEQ ID NO: 421472 - DNA, 25 bp, Mus musculus
tccgggttctgaggtcaccaagtct

SEQ ID NO: 421473 - DNA, 25 bp, Mus musculus
tgctcactaggcagagcccgactca

SEQ ID NO: 421474 - DNA, 25 bp, Mus musculus
gcccgactcactgggtcacgtgtta

SEQ ID NO: 421475 - DNA, 25 bp, Mus musculus
actgggtcacgtgttacctaactga

SEQ ID NO: 421476 - DNA, 25 bp, Mus musculus
agcgagagactttccgaaccggctc

SEQ ID NO: 421477 - DNA, 25 bp, Mus musculus
tgccaatgcagcgagagactttccg

SEQ ID NO: 421478 - DNA, 25 bp, Mus musculus
cccggagtgccaatgcagcgagaga

SEQ ID NO: 421479 - DNA, 25 bp, Mus musculus
aggtcacgcacctccgggttctgag

SEQ ID NO: 421480 - DNA, 25 bp, Mus musculus
gtgcgcgtccctggtgcccacagtg

SEQ ID NO: 421481 - DNA, 25 bp, Mus musculus
gtgcccacagtgcaccgtgcgcgtc

SEQ ID NO: 421482 - DNA, 25 bp, Mus musculus
tggtgcccacagtgcaccgtgcgcg

SEQ ID NO: 421483 - DNA, 25 bp, Mus musculus
tgcgcgtccctggtgcccacagtgc

SEQ ID NO: 421484 - DNA, 25 bp, Mus musculus
ccgtgcgcgtccctggtgcccacag

SEQ ID NO: 421485 - DNA, 25 bp, Mus musculus
ggtgcccacagtgcaccgtgcgcgt

SEQ ID NO: 421486 - DNA, 25 bp, Mus musculus
gcccacagtgcaccgtgcgcgtccc

SEQ ID NO: 421487 - DNA, 25 bp, Mus musculus
gcgcgtccctggtgcccacagtgca

SEQ ID NO: 421488 - DNA, 25 bp, Mus musculus
ctggtgcccacagtgcaccgtgcgc

SEQ ID NO: 421489 - DNA, 25 bp, Mus musculus
tgcccacagtgcaccgtgcgcgtcc

SEQ ID NO: 421490 - DNA, 25 bp, Mus musculus
cgtgcgcgtccctggtgtccacagt

SEQ ID NO: 421491 - DNA, 25 bp, Mus musculus
tgcgcgtccctggtgtccacagtgc

SEQ ID NO: 421492 - DNA, 25 bp, Mus musculus
cctggtgcccacagtgcaccgtgcg

SEQ ID NO: 421493 - DNA, 25 bp, Mus musculus
cccacagtgcaccgtgcgcgtccct

SEQ ID NO: 421494 - DNA, 25 bp, Mus musculus
ggccacttctgcggcgcatccggag

SEQ ID NO: 421495 - DNA, 25 bp, Mus musculus
gaaaggcagcgtcggactccattcc

SEQ ID NO: 421496 - DNA, 25 bp, Mus musculus
gtcggactccattccgtaaacagtc

SEQ ID NO: 421497 - DNA, 25 bp, Mus musculus
cgtaaacagtccctgcgccacttgc

SEQ ID NO: 421498 - DNA, 25 bp, Mus musculus
cgccacttgccgagcgcagagaaaa

SEQ ID NO: 421499 - DNA, 25 bp, Mus musculus
acgcccgcacgtcgccgaccgtctg

SEQ ID NO: 421500 - DNA, 25 bp, Mus musculus
aacggctgccgcagtcagagcacca

SEQ ID NO: 421501 - DNA, 25 bp, Mus musculus
cgccattgtgcttcgtcgccgactt

SEQ ID NO: 421502 - DNA, 25 bp, Mus musculus
tcgtcgccgacttctctgccggtag

SEQ ID NO: 421503 - DNA, 25 bp, Mus musculus
acttctctgccggtagcccgagagc

SEQ ID NO: 421504 - DNA, 25 bp, Mus musculus
actccctgcagcggagtgctcggtg

SEQ ID NO: 421505 - DNA, 25 bp, Mus musculus
caggaaggctggctctcctgacccg

SEQ ID NO: 421506 - DNA, 25 bp, Mus musculus
ggtgtaaggggccgactctagacac

SEQ ID NO: 421507 - DNA, 25 bp, Mus musculus
ttaccgtggcgcctcgcagcttccc

SEQ ID NO: 421508 - DNA, 25 bp, Mus musculus
gtcggccttagccaatccgctaggg

SEQ ID NO: 421509 - DNA, 25 bp, Mus musculus
tgatgacatcaacacagcccggtcg

SEQ ID NO: 421510 - DNA, 25 bp, Mus musculus
tgtccagcatgaatcccgaatagtg

SEQ ID NO: 421511 - DNA, 25 bp, Mus musculus
ggcagctgcagtgacatgtccagca

SEQ ID NO: 421512 - DNA, 25 bp, Mus musculus
ctttccattacctgtggcgcggaga

SEQ ID NO: 421513 - DNA, 25 bp, Mus musculus
ctctaccggaacagcttagctcatt

SEQ ID NO: 421514 - DNA, 25 bp, Mus musculus
ggtcgacgtttgctctaccggaaca

SEQ ID NO: 421515 - DNA, 25 bp, Mus musculus
ggctgctgattgtgttctaagggtc

SEQ ID NO: 421516 - DNA, 25 bp, Mus musculus
cggccattttgggtggaagcgatca

SEQ ID NO: 421517 - DNA, 25 bp, Mus musculus
gcggtgtgctcatgactctctttcc

SEQ ID NO: 421518 - DNA, 25 bp, Mus musculus
cctagtgggaagctgagtgcagaca

SEQ ID NO: 421519 - DNA, 25 bp, Mus musculus
cgggctacaagctcgaaagtgcgca

SEQ ID NO: 421520 - DNA, 25 bp, Mus musculus
agtccgagcgaagtcctagccagca

SEQ ID NO: 421521 - DNA, 25 bp, Mus musculus
ctgctgccacgtctcactgatgaca

SEQ ID NO: 421522 - DNA, 25 bp, Mus musculus
actctgcactctccggggcgcggca

SEQ ID NO: 421523 - DNA, 25 bp, Mus musculus
aagcttaccggcgacgatggcagtg

SEQ ID NO: 421524 - DNA, 25 bp, Mus musculus
tgggacgctcagatccccaagcggc

SEQ ID NO: 421525 - DNA, 25 bp, Mus musculus
gaggacgaggcacgtggccatcggt

SEQ ID NO: 421526 - DNA, 25 bp, Mus musculus
ccagggtcgcactgctgggacgctc

SEQ ID NO: 421527 - DNA, 25 bp, Mus musculus
acagcgctgcgtggggcatgactgc

SEQ ID NO: 421528 - DNA, 25 bp, Mus musculus
agttgcgacgcctcccactcgaggc

SEQ ID NO: 421529 - DNA, 25 bp, Mus musculus
cccagctcagttgcgacgcctccca

SEQ ID NO: 421530 - DNA, 25 bp, Mus musculus
tgcgcagctcccagctcagttgcga

SEQ ID NO: 421531 - DNA, 25 bp, Mus musculus
tcgggtgcgcagctcccagctcagt

SEQ ID NO: 421532 - DNA, 25 bp, Mus musculus
gtgcttgtcgggtgcgcagctccca

SEQ ID NO: 421533 - DNA, 25 bp, Mus musculus
agtggcgaggctcagcagcacgagc

SEQ ID NO: 421534 - DNA, 25 bp, Mus musculus
agcagcacgagcgaggacagcgctg

SEQ ID NO: 421535 - DNA, 25 bp, Mus musculus
tcgcactgctgggacgctcagatcc

SEQ ID NO: 421536 - DNA, 25 bp, Mus musculus
ttctacatttggagactgtgacttc

SEQ ID NO: 421537 - DNA, 25 bp, Mus musculus
gtcgcctgaggggacaccattctac

SEQ ID NO: 421538 - DNA, 25 bp, Mus musculus
ggagactgtgacttccaaaccaggg

SEQ ID NO: 421539 - DNA, 25 bp, Mus musculus
cccaccctgacgagtacgcgtgtgt

SEQ ID NO: 421540 - DNA, 25 bp, Mus musculus
tccaaaccagggcaagaagcattaa

SEQ ID NO: 421541 - DNA, 25 bp, Mus musculus
ctgtgacttccaaaccagggcaaga

SEQ ID NO: 421542 - DNA, 25 bp, Mus musculus
ctgaggggacaccattctacatttg

SEQ ID NO: 421543 - DNA, 25 bp, Mus musculus
catgttgtcgcctgaggggacacca

SEQ ID NO: 421544 - DNA, 25 bp, Mus musculus
ctacgagtgtgcatgttgtcgcctg

SEQ ID NO: 421545 - DNA, 25 bp, Mus musculus
ccagaatgacctacgagtgtgcatg

SEQ ID NO: 421546 - DNA, 25 bp, Mus musculus
cggtaaccagaatgacctacgagtg

SEQ ID NO: 421547 - DNA, 25 bp, Mus musculus
tgcgcggtaaccagaatgacctacg

SEQ ID NO: 421548 - DNA, 25 bp, Mus musculus
acgcgtgtgtgatgcgcggtaacca

SEQ ID NO: 421549 - DNA, 25 bp, Mus musculus
ggggacaccattctacatttggaga

SEQ ID NO: 421550 - DNA, 25 bp, Mus musculus
gggcaacctctgaggcgcgcagacc

SEQ ID NO: 421551 - DNA, 25 bp, Mus musculus
cgcccggttacctgagctctcagaa

SEQ ID NO: 421552 - DNA, 25 bp, Mus musculus
tcggccaatcagagctccgctttgg

SEQ ID NO: 421553 - DNA, 25 bp, Mus musculus
gccaatcagagctccgctttgggtc

SEQ ID NO: 421554 - DNA, 25 bp, Mus musculus
gtccgcatctccagtcccaagcctc

SEQ ID NO: 421555 - DNA, 25 bp, Mus musculus
acgcctctggggcaacctctgaggc

SEQ ID NO: 421556 - DNA, 25 bp, Mus musculus
ccaagcctctcctgcccgcaccggc

SEQ ID NO: 421557 - DNA, 25 bp, Mus musculus
cccgaaggaggcaaatgctcagagc

SEQ ID NO: 421558 - DNA, 25 bp, Mus musculus
cagcagcgtcgaggtcgcccggtta

SEQ ID NO: 421559 - DNA, 25 bp, Mus musculus
ggttacctgagctctcagaaggctc

SEQ ID NO: 421560 - DNA, 25 bp, Mus musculus
tcagaaggctccacaagcccgaagg

SEQ ID NO: 421561 - DNA, 25 bp, Mus musculus
aagcccgaaggaccgcagcaacagc

SEQ ID NO: 421562 - DNA, 25 bp, Mus musculus
agcaacagcaggagtagccccgccg

SEQ ID NO: 421563 - DNA, 25 bp, Mus musculus
ggcaaatgctcagagcagcagcgtc

SEQ ID NO: 421564 - DNA, 25 bp, Mus musculus
tgccgctggggaagatcatctcggg

SEQ ID NO: 421565 - DNA, 25 bp, Mus musculus
ccaggcgtcgccgtggcttcgcacc

SEQ ID NO: 421566 - DNA, 25 bp, Mus musculus
tgccccttttaagggcatcgcttcg

SEQ ID NO: 421567 - DNA, 25 bp, Mus musculus
cgcatgcctcacattcctgggagca

SEQ ID NO: 421568 - DNA, 25 bp, Mus musculus
ccgcgcaatggttggctctggcgcc

SEQ ID NO: 421569 - DNA, 25 bp, Mus musculus
aagcagccgcgcaccgcctagtgcc

SEQ ID NO: 421570 - DNA, 25 bp, Mus musculus
ctgcgtgccatggaccggagttcgc

SEQ ID NO: 421571 - DNA, 25 bp, Mus musculus
cgccctgcgtgccatggaccggagt

SEQ ID NO: 421572 - DNA, 25 bp, Mus musculus
gccggcgactctcgagcagctccgg

SEQ ID NO: 421573 - DNA, 25 bp, Mus musculus
gcgctccgggaactccctctctcgc

SEQ ID NO: 421574 - DNA, 25 bp, Mus musculus
cctgcttgcggtagggcgtcctgca

SEQ ID NO: 421575 - DNA, 25 bp, Mus musculus
agcctcacctgcttgcggtagggcg

SEQ ID NO: 421576 - DNA, 25 bp, Mus musculus
tgcctcacattcctgggagcagcca

SEQ ID NO: 421577 - DNA, 25 bp, Mus musculus
cgccctaaaagtgcggcgcgacgcg

SEQ ID NO: 421578 - DNA, 25 bp, Mus musculus
tgttgtttccacactttgcccatga

SEQ ID NO: 421579 - DNA, 25 bp, Mus musculus
tggctgtcctttcctgtctagtcgc

SEQ ID NO: 421580 - DNA, 25 bp, Mus musculus
aggccctggagaggtctgaaacaca

SEQ ID NO: 421581 - DNA, 25 bp, Mus musculus
cccaggccagcgctatagttagcaa

SEQ ID NO: 421582 - DNA, 25 bp, Mus musculus
tactgagggtacatctgttgtttcc

SEQ ID NO: 421583 - DNA, 25 bp, Mus musculus
cccagctaggagtgatcaatacaag

SEQ ID NO: 421584 - DNA, 25 bp, Mus musculus
ttgcccatgaagctggaaggaagcc

SEQ ID NO: 421585 - DNA, 25 bp, Mus musculus
tgggttttccaagtcccgatctctc

SEQ ID NO: 421586 - DNA, 25 bp, Mus musculus
ctccttccaggcagacagaaagaca

SEQ ID NO: 421587 - DNA, 25 bp, Mus musculus
cagggcgctcccaaggagtttcctc

SEQ ID NO: 421588 - DNA, 25 bp, Mus musculus
agtttcctctgggagcccgactgta

SEQ ID NO: 421589 - DNA, 25 bp, Mus musculus
cgactgtacccgagctgccaagggc

SEQ ID NO: 421590 - DNA, 25 bp, Mus musculus
caatacaagtggaaagtacggcggc

SEQ ID NO: 421591 - DNA, 25 bp, Mus musculus
gcctccttaccttggcttgcagata

SEQ ID NO: 421592 - DNA, 25 bp, Mus musculus
cagccggaaccctccactgtgagta

SEQ ID NO: 421593 - DNA, 25 bp, Mus musculus
atcccggagtcctcgacttcgcaga

SEQ ID NO: 421594 - DNA, 25 bp, Mus musculus
atggaaggtgaagcgttaatgactc

SEQ ID NO: 421595 - DNA, 25 bp, Mus musculus
ttaatgactcagagcgcagtcgctg

SEQ ID NO: 421596 - DNA, 25 bp, Mus musculus
gctgccctctgaactggaacggaaa

SEQ ID NO: 421597 - DNA, 25 bp, Mus musculus
ggaaagctacttccggttgcagtca

SEQ ID NO: 421598 - DNA, 25 bp, Mus musculus
ttgcagtcattctgccgggcaccgg

SEQ ID NO: 421599 - DNA, 25 bp, Mus musculus
acctgtggcgtgagcgagcacagcc

SEQ ID NO: 421600 - DNA, 25 bp, Mus musculus
gcaccgaagtctcctccgagaagta

SEQ ID NO: 421601 - DNA, 25 bp, Mus musculus
cctccgagaagtagagctgcggccc

SEQ ID NO: 421602 - DNA, 25 bp, Mus musculus
acagcgcgattttgagcgagagaaa

SEQ ID NO: 421603 - DNA, 25 bp, Mus musculus
ccgagctgaccctgtggggctttcc

SEQ ID NO: 421604 - DNA, 25 bp, Mus musculus
gtgacctcagctccgcgacgacagt

SEQ ID NO: 421605 - DNA, 25 bp, Mus musculus
tccactgtgagtaaaagcggagaca

SEQ ID NO: 421606 - DNA, 25 bp, Mus musculus
atccgtctcatttgagaagagcagc

SEQ ID NO: 421607 - DNA, 25 bp, Mus musculus
tcgcctgagctgtcggcatggtcaa

SEQ ID NO: 421608 - DNA, 25 bp, Mus musculus
ttccaaccttggtgcgagctgccga

SEQ ID NO: 421609 - DNA, 25 bp, Mus musculus
ggtctttaccgcataggcttccaac

SEQ ID NO: 421610 - DNA, 25 bp, Mus musculus
gccgagctgggtctttaccgcatag

SEQ ID NO: 421611 - DNA, 25 bp, Mus musculus
aaacaaagccagatccgggccgagc

SEQ ID NO: 421612 - DNA, 25 bp, Mus musculus
ccggggacaaaccaaagagagccag

SEQ ID NO: 421613 - DNA, 25 bp, Mus musculus
tctgtgaggggacccgagtcacgcc

SEQ ID NO: 421614 - DNA, 25 bp, Mus musculus
gcccgggacccacgtttaatgcgca

SEQ ID NO: 421615 - DNA, 25 bp, Mus musculus
gcgagcgctgctgcatgctaatcag

SEQ ID NO: 421616 - DNA, 25 bp, Mus musculus
tgttaaaacaatggagccgggcgcg

SEQ ID NO: 421617 - DNA, 25 bp, Mus musculus
agcagcatttgaggcagcagcgttc

SEQ ID NO: 421618 - DNA, 25 bp, Mus musculus
cgtgcggggcaactaattatccgtc

SEQ ID NO: 421619 - DNA, 25 bp, Mus musculus
tcgcctgctgaacggtgacagattg

SEQ ID NO: 421620 - DNA, 25 bp, Mus musculus
actcttttgaatggaatcgggctga

SEQ ID NO: 421621 - DNA, 25 bp, Mus musculus
ctccaattggcggtagaagaaagga

SEQ ID NO: 421622 - DNA, 25 bp, Mus musculus
gggaacccggaagtacttctctgca

SEQ ID NO: 421623 - DNA, 25 bp, Mus musculus
aagtacttctctgcagaggcctggg

SEQ ID NO: 421624 - DNA, 25 bp, Mus musculus
ggcctgggcgactcttttgaatgga

SEQ ID NO: 421625 - DNA, 25 bp, Mus musculus
ccaggtaggatgcagaccgcgagct

SEQ ID NO: 421626 - DNA, 25 bp, Mus musculus
acgtccgggagcctgcctcgctagg

SEQ ID NO: 421627 - DNA, 25 bp, Mus musculus
atcgggctgattcatcgcctgttct

SEQ ID NO: 421628 - DNA, 25 bp, Mus musculus
cgagccaggtccttgttgagtgtga

SEQ ID NO: 421629 - DNA, 25 bp, Mus musculus
ttgttgagtgtgaggcgctgccctc

SEQ ID NO: 421630 - DNA, 25 bp, Mus musculus
cggcggactccaattggcggtagaa

SEQ ID NO: 421631 - DNA, 25 bp, Mus musculus
gcgtcgccacaaggccaggtaggat

SEQ ID NO: 421632 - DNA, 25 bp, Mus musculus
atgcagaccgcgagctctcttcagg

SEQ ID NO: 421633 - DNA, 25 bp, Mus musculus
gcgagctctcttcaggcggcctcag

SEQ ID NO: 421634 - DNA, 25 bp, Mus musculus
aatgctactttcttggctgccgctg

SEQ ID NO: 421635 - DNA, 25 bp, Mus musculus
ctgggcgaacgcacccaagttgtga

SEQ ID NO: 421636 - DNA, 25 bp, Mus musculus
caccgagcactgatccctgttggtc

SEQ ID NO: 421637 - DNA, 25 bp, Mus musculus
ccggtcattaccaacggagcttaca

SEQ ID NO: 421638 - DNA, 25 bp, Mus musculus
cccggcaaggcgcaagtatacctgt

SEQ ID NO: 421639 - DNA, 25 bp, Mus musculus
gcagtacggccactcctaccaagga

SEQ ID NO: 421640 - DNA, 25 bp, Mus musculus
ggccactttggctgaaatttcatcg

SEQ ID NO: 421641 - DNA, 25 bp, Mus musculus
tcctaggcattcagagcgacgcatc

SEQ ID NO: 421642 - DNA, 25 bp, Mus musculus
gcgacgcatcaaagctggcccgagc

SEQ ID NO: 421643 - DNA, 25 bp, Mus musculus
acgcggcgaggacaagttttgctta

SEQ ID NO: 421644 - DNA, 25 bp, Mus musculus
gacatttcgttcagacacgcggcga

SEQ ID NO: 421645 - DNA, 25 bp, Mus musculus
cctttcctagatcagcagacatttc

SEQ ID NO: 421646 - DNA, 25 bp, Mus musculus
cggtcggagaaccagtcagtggcta

SEQ ID NO: 421647 - DNA, 25 bp, Mus musculus
tgctgtccaactcttcgccgcaggg

SEQ ID NO: 421648 - DNA, 25 bp, Mus musculus
gcatggcgctcttcctgttcgcgca

SEQ ID NO: 421649 - DNA, 25 bp, Mus musculus
agttggcggcgatagtcgttagctt

SEQ ID NO: 421650 - DNA, 25 bp, Mus musculus
atcgcaggtcaaggcctgcagttgg

SEQ ID NO: 421651 - DNA, 25 bp, Mus musculus
gcagggactccagatcgcaggtcaa

SEQ ID NO: 421652 - DNA, 25 bp, Mus musculus
aaccagtggttcctgtcggtgctca

SEQ ID NO: 421653 - DNA, 25 bp, Mus musculus
ttccaggtacttcttgggtggcagc

SEQ ID NO: 421654 - DNA, 25 bp, Mus musculus
gtctgtcttagcctatgccacccga

SEQ ID NO: 421655 - DNA, 25 bp, Mus musculus
cagatcccgtctgtcttagcctatg

SEQ ID NO: 421656 - DNA, 25 bp, Mus musculus
ttgccgccaacttttcagatcccgt

SEQ ID NO: 421657 - DNA, 25 bp, Mus musculus
aagattcgagaagcttcgaggcccg

SEQ ID NO: 421658 - DNA, 25 bp, Mus musculus
gacagatcgcttggccggaagattc

SEQ ID NO: 421659 - DNA, 25 bp, Mus musculus
ttctgcgggatggaacggacagatc

SEQ ID NO: 421660 - DNA, 25 bp, Mus musculus
gttcgcgcatttgccgctctaggga

SEQ ID NO: 421661 - DNA, 25 bp, Mus musculus
tcgttagcttcgtgcttggcttggc

SEQ ID NO: 421662 - DNA, 25 bp, Mus musculus
tcgactccagcgactcggggattta

SEQ ID NO: 421663 - DNA, 25 bp, Mus musculus
gtgccgcacaccaacgggctgctgt

SEQ ID NO: 421664 - DNA, 25 bp, Mus musculus
ttcgtgagcaactacgccaaggccc

SEQ ID NO: 421665 - DNA, 25 bp, Mus musculus
gctggttcgtcacgccggccaacaa

SEQ ID NO: 421666 - DNA, 25 bp, Mus musculus
aaggacctgtccgactccagctgga

SEQ ID NO: 421667 - DNA, 25 bp, Mus musculus
tgacacgccggtgtctgagagctcg

SEQ ID NO: 421668 - DNA, 25 bp, Mus musculus
actgcgccaaggacataggcggcta

SEQ ID NO: 421669 - DNA, 25 bp, Mus musculus
aggcggctactatggcttctactcg

SEQ ID NO: 421670 - DNA, 25 bp, Mus musculus
cgctctttcacttgaccctcgatga

SEQ ID NO: 421671 - DNA, 25 bp, Mus musculus
ctctttcctgcaagaccagttcgtg

SEQ ID NO: 421672 - DNA, 25 bp, Mus musculus
cccaggatctacacgggctgcgaca

SEQ ID NO: 421673 - DNA, 25 bp, Mus musculus
ggctgcgacatggaccgcttgaccc

SEQ ID NO: 421674 - DNA, 25 bp, Mus musculus
aacaaccggctggacttcgcggcct

SEQ ID NO: 421675 - DNA, 25 bp, Mus musculus
cgggactgcgagaagaactgcgcca

SEQ ID NO: 421676 - DNA, 25 bp, Mus musculus
cgatttcacaggaacggagcgcctc

SEQ ID NO: 421677 - DNA, 25 bp, Mus musculus
agggaaagctgcagccacgcgctcc

SEQ ID NO: 421678 - DNA, 25 bp, Mus musculus
catctgctgtgtggactgagtcagc

SEQ ID NO: 421679 - DNA, 25 bp, Mus musculus
gcagctccgccatctgctgtgtgga

SEQ ID NO: 421680 - DNA, 25 bp, Mus musculus
ggcgaggtcgtttccctcgcagctc

SEQ ID NO: 421681 - DNA, 25 bp, Mus musculus
agcttcaaaaacactggcgaggtcg

SEQ ID NO: 421682 - DNA, 25 bp, Mus musculus
gcctcgtgcagcaaaacgcgcctta

SEQ ID NO: 421683 - DNA, 25 bp, Mus musculus
agagcgcgctactcgggtctgccct

SEQ ID NO: 421684 - DNA, 25 bp, Mus musculus
cccttagcttccgaggagcgatttc

SEQ ID NO: 421685 - DNA, 25 bp, Mus musculus
atgcgtaagcgaagcccttagcttc

SEQ ID NO: 421686 - DNA, 25 bp, Mus musculus
ccggagtggtgtcaaatgcgtaagc

SEQ ID NO: 421687 - DNA, 25 bp, Mus musculus
aacgcgccttagctgctcttagcca

SEQ ID NO: 421688 - DNA, 25 bp, Mus musculus
cgtctccacgcaagggaagaaggca

SEQ ID NO: 421689 - DNA, 25 bp, Mus musculus
ttcccaatggcgtctccacgcaagg

SEQ ID NO: 421690 - DNA, 25 bp, Mus musculus
cggcctgagttaaacattagttagc

SEQ ID NO: 421691 - DNA, 25 bp, Mus musculus
gcggggtgcactcaccttcatggtc

SEQ ID NO: 421692 - DNA, 25 bp, Mus musculus
actcaccttcatggtcgggcggctc

SEQ ID NO: 421693 - DNA, 25 bp, Mus musculus
tcgggcggctccttgaaactgaact

SEQ ID NO: 421694 - DNA, 25 bp, Mus musculus
actaggcgagccaggaagtagcacg

SEQ ID NO: 421695 - DNA, 25 bp, Mus musculus
cgcggtaggaccactaggcgagcca

SEQ ID NO: 421696 - DNA, 25 bp, Mus musculus
ccttgaaactgaactctgaagcttg

SEQ ID NO: 421697 - DNA, 25 bp, Mus musculus
cattagttagcgcaaggcgggcttc

SEQ ID NO: 421698 - DNA, 25 bp, Mus musculus
cgccgccaagtttcggcctgagtta

SEQ ID NO: 421699 - DNA, 25 bp, Mus musculus
tctgcacgcagtcaccctgagctcg

SEQ ID NO: 421700 - DNA, 25 bp, Mus musculus
cactgcgcgcagagacggacgtcct

SEQ ID NO: 421701 - DNA, 25 bp, Mus musculus
gcaggcagaagtcactgcgcgcaga

SEQ ID NO: 421702 - DNA, 25 bp, Mus musculus
ctctgaagcttgagcgcaggcagaa

SEQ ID NO: 421703 - DNA, 25 bp, Mus musculus
cgacccagcgcggtaggaccactag

SEQ ID NO: 421704 - DNA, 25 bp, Mus musculus
cgtacctagtggaggcttggagtat

SEQ ID NO: 421705 - DNA, 25 bp, Mus musculus
cgtgcgctacctcctgggccgaggt

SEQ ID NO: 421706 - DNA, 25 bp, Mus musculus
tgcaagagggccgactgcgtgacct

SEQ ID NO: 421707 - DNA, 25 bp, Mus musculus
actgcgtgaccttcaggaggaactg

SEQ ID NO: 421708 - DNA, 25 bp, Mus musculus
ccttcaggaggaactggcggtagct

SEQ ID NO: 421709 - DNA, 25 bp, Mus musculus
cagcacgccacggacgccaggatat

SEQ ID NO: 421710 - DNA, 25 bp, Mus musculus
acggacgccaggatatcctagcgta

SEQ ID NO: 421711 - DNA, 25 bp, Mus musculus
tcctagcgtacctagtggaggcttg

SEQ ID NO: 421712 - DNA, 25 bp, Mus musculus
acatcgaggctaccaaccgagacta

SEQ ID NO: 421713 - DNA, 25 bp, Mus musculus
accgagactacaagcggcctctgca

SEQ ID NO: 421714 - DNA, 25 bp, Mus musculus
gcctctgcacgaagctgcctctatg

SEQ ID NO: 421715 - DNA, 25 bp, Mus musculus
aagctgcctctatgggccaccggga

SEQ ID NO: 421716 - DNA, 25 bp, Mus musculus
cctctatgggccaccgggactgcgt

SEQ ID NO: 421717 - DNA, 25 bp, Mus musculus
cttggagtatggacatcgaggctac

SEQ ID NO: 421718 - DNA, 25 bp, Mus musculus
gccctggcagtgacctctggtacca

SEQ ID NO: 421719 - DNA, 25 bp, Mus musculus
ggaccttccgcacctgtcgcacgca

SEQ ID NO: 421720 - DNA, 25 bp, Mus musculus
gcgctgacgctgacttactggtgac

SEQ ID NO: 421721 - DNA, 25 bp, Mus musculus
tactggtgacgcgttactttcgatc

SEQ ID NO: 421722 - DNA, 25 bp, Mus musculus
cgcgttactttcgatcgcctggtca

SEQ ID NO: 421723 - DNA, 25 bp, Mus musculus
ttcgatcgcctggtcatggcctacc

SEQ ID NO: 421724 - DNA, 25 bp, Mus musculus
ggtcatggcctacccgggatacgga

SEQ ID NO: 421725 - DNA, 25 bp, Mus musculus
taagtcctcgcgagctgtggcgacc

SEQ ID NO: 421726 - DNA, 25 bp, Mus musculus
ccgtaaggtgctagaagctagggct

SEQ ID NO: 421727 - DNA, 25 bp, Mus musculus
accatgcggagttcaccctgtggcc

SEQ ID NO: 421728 - DNA, 25 bp, Mus musculus
tgacctctggtaccaggcgacgccg

SEQ ID NO: 421729 - DNA, 25 bp, Mus musculus
ctggtaccaggcgacgccgggacac

SEQ ID NO: 421730 - DNA, 25 bp, Mus musculus
cgccgggacaccgtaaggtgctaga

SEQ ID NO: 421731 - DNA, 25 bp, Mus musculus
cgggccgcatcaccatgcggagttc

SEQ ID NO: 421732 - DNA, 25 bp, Mus musculus
ttctttggggagcagaaatctcttc

SEQ ID NO: 421733 - DNA, 25 bp, Mus musculus
ccatcccgctcaccttccggagggg

SEQ ID NO: 421734 - DNA, 25 bp, Mus musculus
gccgaagtccaatccatcccgctca

SEQ ID NO: 421735 - DNA, 25 bp, Mus musculus
agacacccgcgttctccgccgaagt

SEQ ID NO: 421736 - DNA, 25 bp, Mus musculus
ggagcagaaatctcttcccattagc

SEQ ID NO: 421737 - DNA, 25 bp, Mus musculus
cagcgcatcttctttggggagcaga

SEQ ID NO: 421738 - DNA, 25 bp, Mus musculus
ctctttgtggcagcgcatcttcttt

SEQ ID NO: 421739 - DNA, 25 bp, Mus musculus
aagccgctctttgtggcagcgcatc

SEQ ID NO: 421740 - DNA, 25 bp, Mus musculus
ggccggcgcgcaagccgctctttgt

SEQ ID NO: 421741 - DNA, 25 bp, Mus musculus
atgtctcccgggctagagcccaggc

SEQ ID NO: 421742 - DNA, 25 bp, Mus musculus
gctcagagttctcccgggatgtctc

SEQ ID NO: 421743 - DNA, 25 bp, Mus musculus
cgagcgctccgagctcagagttctc

SEQ ID NO: 421744 - DNA, 25 bp, Mus musculus
gggtcttcgccgagcgctccgagct

SEQ ID NO: 421745 - DNA, 25 bp, Mus musculus
ttcccattagcaccacttcgagaca

SEQ ID NO: 421746 - DNA, 25 bp, Mus musculus
accctaagtatctaggtgtgcggtc

SEQ ID NO: 421747 - DNA, 25 bp, Mus musculus
taggtgtgcggtcccctctcaagct

SEQ ID NO: 421748 - DNA, 25 bp, Mus musculus
tggggaggcagatcagcttgaaccc

SEQ ID NO: 421749 - DNA, 25 bp, Mus musculus
ccagtccgaaaatgactttatctgc

SEQ ID NO: 421750 - DNA, 25 bp, Mus musculus
ccgcaccagtccgaaaatgacttta

SEQ ID NO: 421751 - DNA, 25 bp, Mus musculus
accaccgtagcctggccagccctcc

SEQ ID NO: 421752 - DNA, 25 bp, Mus musculus
cggccgccgggtcatgttacacggc

SEQ ID NO: 421753 - DNA, 25 bp, Mus musculus
ggtcatgttacacggcccgggcctc

SEQ ID NO: 421754 - DNA, 25 bp, Mus musculus
tgactttatctgctagggagaggca

SEQ ID NO: 421755 - DNA, 25 bp, Mus musculus
ggcagatcagcttgaacccacttca

SEQ ID NO: 421756 - DNA, 25 bp, Mus musculus
gtcctccggtcaccaccgtagcctg

SEQ ID NO: 421757 - DNA, 25 bp, Mus musculus
gagaaagagacgcaggcggccgcgc

SEQ ID NO: 421758 - DNA, 25 bp, Mus musculus
ttatctgctagggagaggcaagttg

SEQ ID NO: 421759 - DNA, 25 bp, Mus musculus
agatcagcttgaacccacttcaccg

SEQ ID NO: 421760 - DNA, 25 bp, Mus musculus
cgctctgcccgtcttgcagggacgt

SEQ ID NO: 421761 - DNA, 25 bp, Mus musculus
cacaaggctgaaagtcccgcgggcc

SEQ ID NO: 421762 - DNA, 25 bp, Mus musculus
actgccagcggcgaatcctgggcgc

SEQ ID NO: 421763 - DNA, 25 bp, Mus musculus
tgggcaacgcggcacacctgcactg

SEQ ID NO: 421764 - DNA, 25 bp, Mus musculus
tgggcgtctcccttgccctgggcaa

SEQ ID NO: 421765 - DNA, 25 bp, Mus musculus
ctacctgtctatggcaccgcggagg

SEQ ID NO: 421766 - DNA, 25 bp, Mus musculus
gcccgtcttgcagggacgtggtcat

SEQ ID NO: 421767 - DNA, 25 bp, Mus musculus
tctagggagtcatcgaccgcgaggc

SEQ ID NO: 421768 - DNA, 25 bp, Mus musculus
cgaccgcgaggcgaaagctacgaag

SEQ ID NO: 421769 - DNA, 25 bp, Mus musculus
gctggtgtcactctcctgaagcgtg

SEQ ID NO: 421770 - DNA, 25 bp, Mus musculus
ctgaagcgtggggacctcgacctca

SEQ ID NO: 421771 - DNA, 25 bp, Mus musculus
caccgccgctttcccaagtgggtga

SEQ ID NO: 421772 - DNA, 25 bp, Mus musculus
agtgggtgacccagcacaaggctga

SEQ ID NO: 421773 - DNA, 25 bp, Mus musculus
ccacgaagctgcctacctgtctatg

SEQ ID NO: 421774 - DNA, 25 bp, Mus musculus
acgctgcggtccatcgcgctgctgg

SEQ ID NO: 421775 - DNA, 25 bp, Mus musculus
ctgccattcgcctggccttccgtaa

SEQ ID NO: 421776 - DNA, 25 bp, Mus musculus
tcgtccgggaggacgcagtctcccg

SEQ ID NO: 421777 - DNA, 25 bp, Mus musculus
tgcgcaccaactgaatcccgtgcaa

SEQ ID NO: 421778 - DNA, 25 bp, Mus musculus
gatccgggacgctgcggtccatcgc

SEQ ID NO: 421779 - DNA, 25 bp, Mus musculus
agtgcttgggctccagcggcccgct

SEQ ID NO: 421780 - DNA, 25 bp, Mus musculus
acgtggagcgaggaggaatttccta

SEQ ID NO: 421781 - DNA, 25 bp, Mus musculus
agcatcggagcgagcagagcagcca

SEQ ID NO: 421782 - DNA, 25 bp, Mus musculus
ctcgctctgcagaagtgagggtgac

SEQ ID NO: 421783 - DNA, 25 bp, Mus musculus
cggccacctcgctctgcagaagtga

SEQ ID NO: 421784 - DNA, 25 bp, Mus musculus
ggaggagctgcgaaccacagcgccc

SEQ ID NO: 421785 - DNA, 25 bp, Mus musculus
acttttccggaggagctgcgaacca

SEQ ID NO: 421786 - DNA, 25 bp, Mus musculus
ctgaatcccgtgcaaacttttccgg

SEQ ID NO: 421787 - DNA, 25 bp, Mus musculus
gggaggcttacttaccctgcggagc

SEQ ID NO: 421788 - DNA, 25 bp, Mus musculus
gagcgccttccaaaccagtcggcaa

SEQ ID NO: 421789 - DNA, 25 bp, Mus musculus
ttggcaagccttgagcagcgcctcc

SEQ ID NO: 421790 - DNA, 25 bp, Mus musculus
tgctagcccaagttggcaagccttg

SEQ ID NO: 421791 - DNA, 25 bp, Mus musculus
agtgggcaggcaacctgctagccca

SEQ ID NO: 421792 - DNA, 25 bp, Mus musculus
ttagcggggaaagttgcccggcaca

SEQ ID NO: 421793 - DNA, 25 bp, Mus musculus
atctaggactgtctgggcttagcgg

SEQ ID NO: 421794 - DNA, 25 bp, Mus musculus
cagtcggcaagcttcgtgatggctc

SEQ ID NO: 421795 - DNA, 25 bp, Mus musculus
acccggcgacaggagtgatcggtat

SEQ ID NO: 421796 - DNA, 25 bp, Mus musculus
gggagcaactgaaacccgctctcga

SEQ ID NO: 421797 - DNA, 25 bp, Mus musculus
cggtcctacctgagcgctccaggtg

SEQ ID NO: 421798 - DNA, 25 bp, Mus musculus
ctggtacccagagcccactggcagg

SEQ ID NO: 421799 - DNA, 25 bp, Mus musculus
cactggcagggacgctgagaaatct

SEQ ID NO: 421800 - DNA, 25 bp, Mus musculus
cgctgagaaatctgagccgcacttc

SEQ ID NO: 421801 - DNA, 25 bp, Mus musculus
gctgccgccgttttccaatctagga

SEQ ID NO: 421802 - DNA, 25 bp, Mus musculus
cacgatcggctgcattctcggtgta

SEQ ID NO: 421803 - DNA, 25 bp, Mus musculus
ttggccaaatcaaaccggacggagc

SEQ ID NO: 421804 - DNA, 25 bp, Mus musculus
accgtgggacgcagagatcacgatc

SEQ ID NO: 421805 - DNA, 25 bp, Mus musculus
tctcggtgtaaaggaagtgccctcc

SEQ ID NO: 421806 - DNA, 25 bp, Mus musculus
tgctgattcgggttccagacaactg

SEQ ID NO: 421807 - DNA, 25 bp, Mus musculus
gacaactgcagcgagcccgcgcaaa

SEQ ID NO: 421808 - DNA, 25 bp, Mus musculus
gcgcaaacgacagctctgcaccgag

SEQ ID NO: 421809 - DNA, 25 bp, Mus musculus
cctcggacaggagccctcggattca

SEQ ID NO: 421810 - DNA, 25 bp, Mus musculus
ccctcggattcaggagagagctccc

SEQ ID NO: 421811 - DNA, 25 bp, Mus musculus
gcgttcaaactagccggtccgctca

SEQ ID NO: 421812 - DNA, 25 bp, Mus musculus
gctcatccgcgcttctcattggtca

SEQ ID NO: 421813 - DNA, 25 bp, Mus musculus
ttggctgtttcctaagtaacaaaga

SEQ ID NO: 421814 - DNA, 25 bp, Mus musculus
cctgacctgcccaaacaagtgctga

SEQ ID NO: 421815 - DNA, 25 bp, Mus musculus
gcgcgccttgggtttctttggccaa

SEQ ID NO: 421816 - DNA, 25 bp, Mus musculus
ttaaccgcaaggcagtggttgagcc

SEQ ID NO: 421817 - DNA, 25 bp, Mus musculus
tcgcagtccactcgccctgcccacg

SEQ ID NO: 421818 - DNA, 25 bp, Mus musculus
ttcagacccacttcccgggccctca

SEQ ID NO: 421819 - DNA, 25 bp, Mus musculus
gtggcccgatctccattggttgtcg

SEQ ID NO: 421820 - DNA, 25 bp, Mus musculus
atctccattggttgtcggcgtgagg

SEQ ID NO: 421821 - DNA, 25 bp, Mus musculus
cggagcttagttgtaggactaggaa

SEQ ID NO: 421822 - DNA, 25 bp, Mus musculus
ggctggaatccgctgagcattgagt

SEQ ID NO: 421823 - DNA, 25 bp, Mus musculus
aatccgctgagcattgagtgctgcc

SEQ ID NO: 421824 - DNA, 25 bp, Mus musculus
tgagcattgagtgctgccgagttgt

SEQ ID NO: 421825 - DNA, 25 bp, Mus musculus
gagccaccctgtacctcgcagtcca

SEQ ID NO: 421826 - DNA, 25 bp, Mus musculus
aggctctcaccatcagctgcccgag

SEQ ID NO: 421827 - DNA, 25 bp, Mus musculus
ccgccaaggccgcaggctctcacca

SEQ ID NO: 421828 - DNA, 25 bp, Mus musculus
ttgagccctcgggatcatcccggcg

SEQ ID NO: 421829 - DNA, 25 bp, Mus musculus
agtggttgagccctcgggatcatcc

SEQ ID NO: 421830 - DNA, 25 bp, Mus musculus
cctcggctgccaaccgcgtcgctag

SEQ ID NO: 421831 - DNA, 25 bp, Mus musculus
tcgcacagcctctcacccgcggcca

SEQ ID NO: 421832 - DNA, 25 bp, Mus musculus
gaggtgggtcgcacagcctctcacc

SEQ ID NO: 421833 - DNA, 25 bp, Mus musculus
acaggaggtgggtcgcacagcctct

SEQ ID NO: 421834 - DNA, 25 bp, Mus musculus
tctatactccgtgctagaagaaggg

SEQ ID NO: 421835 - DNA, 25 bp, Mus musculus
ggcagcctctatactccgtgctaga

SEQ ID NO: 421836 - DNA, 25 bp, Mus musculus
gatgcggcagcctctatactccgtg

SEQ ID NO: 421837 - DNA, 25 bp, Mus musculus
tagggatgcggcagcctctatactc

SEQ ID NO: 421838 - DNA, 25 bp, Mus musculus
tgatgctagggatgcggcagcctct

SEQ ID NO: 421839 - DNA, 25 bp, Mus musculus
agacctggcgattgggcgtggtgat

SEQ ID NO: 421840 - DNA, 25 bp, Mus musculus
ctcccagcccggtagacggtgcagg

SEQ ID NO: 421841 - DNA, 25 bp, Mus musculus
tcgatgctccctgagctctcgggtc

SEQ ID NO: 421842 - DNA, 25 bp, Mus musculus
cgtcgctaggcctcctcgatgctcc

SEQ ID NO: 421843 - DNA, 25 bp, Mus musculus
ccacctctctgggtggggtgtgtgc

SEQ ID NO: 421844 - DNA, 25 bp, Mus musculus
tgtcagtcgccgaggccagaaccgt

SEQ ID NO: 421845 - DNA, 25 bp, Mus musculus
cagtgacagactttgacagcgcgtg

SEQ ID NO: 421846 - DNA, 25 bp, Mus musculus
gccttctggcttaggcagtgacaga

SEQ ID NO: 421847 - DNA, 25 bp, Mus musculus
atgctcgcgccggtgcggcttcagc

SEQ ID NO: 421848 - DNA, 25 bp, Mus musculus
tgcctggccaggctgatgctcgcgc

SEQ ID NO: 421849 - DNA, 25 bp, Mus musculus
tttgggacctagacagcgagttctg

SEQ ID NO: 421850 - DNA, 25 bp, Mus musculus
tccggacaaggatgtttgggaccta

SEQ ID NO: 421851 - DNA, 25 bp, Mus musculus
tcctagtggccggagcatccggaca

SEQ ID NO: 421852 - DNA, 25 bp, Mus musculus
ggggtgcttacaagctcctagtggc

SEQ ID NO: 421853 - DNA, 25 bp, Mus musculus
ccgccttgtaatcttggggtgctta

SEQ ID NO: 421854 - DNA, 25 bp, Mus musculus
gtgcggctctccagaccgccttgta

SEQ ID NO: 421855 - DNA, 25 bp, Mus musculus
cagaacggccagagacggcgcgtcc

SEQ ID NO: 421856 - DNA, 25 bp, Mus musculus
tttgacagcgcgtggatggcattgt

SEQ ID NO: 421857 - DNA, 25 bp, Mus musculus
gcggcagcggagaataagcatcttc

SEQ ID NO: 421858 - DNA, 25 bp, Mus musculus
ataaaataactgttgaagccggtag

SEQ ID NO: 421859 - DNA, 25 bp, Mus musculus
atgggccagccgaccgcctgagctg

SEQ ID NO: 421860 - DNA, 25 bp, Mus musculus
gccggcggacgaccttccacttgaa

SEQ ID NO: 421861 - DNA, 25 bp, Mus musculus
ctgctgggaaagctggacgtgcaca

SEQ ID NO: 421862 - DNA, 25 bp, Mus musculus
aggacgcgtttcacccagcacggcg

SEQ ID NO: 421863 - DNA, 25 bp, Mus musculus
catccgcgtggtcagcggccacgag

SEQ ID NO: 421864 - DNA, 25 bp, Mus musculus
atgcggcgttactgggttccagctc

SEQ ID NO: 421865 - DNA, 25 bp, Mus musculus
cggcgatccgggagataaaagtttg

SEQ ID NO: 421866 - DNA, 25 bp, Mus musculus
cgtacgcgtccctgcagatgggcca

SEQ ID NO: 421867 - DNA, 25 bp, Mus musculus
cagctcgtctgcagtgcgagtcaca

SEQ ID NO: 421868 - DNA, 25 bp, Mus musculus
cgctctgcctctgggcgtgcaggca

SEQ ID NO: 421869 - DNA, 25 bp, Mus musculus
cgcactgaccgataacctcctggag

SEQ ID NO: 421870 - DNA, 25 bp, Mus musculus
taacctcctggagctcgtacgcgtc

SEQ ID NO: 421871 - DNA, 25 bp, Mus musculus
ccgggagataaaagtttgcagcctg

SEQ ID NO: 421872 - DNA, 25 bp, Mus musculus
gacgcaacagagacgcgcgaacgga

SEQ ID NO: 421873 - DNA, 25 bp, Mus musculus
tgagtagccgaagtagctgccctcg

SEQ ID NO: 421874 - DNA, 25 bp, Mus musculus
ccgaacgctgttcacccgggatcgg

SEQ ID NO: 421875 - DNA, 25 bp, Mus musculus
agtgcctgttgagcccgctagattt

SEQ ID NO: 421876 - DNA, 25 bp, Mus musculus
tctagcggctagttctcaggctgca

SEQ ID NO: 421877 - DNA, 25 bp, Mus musculus
gctaggagcgtccacagtgacagtc

SEQ ID NO: 421878 - DNA, 25 bp, Mus musculus
cccagaggagaaggcctgacgctcc

SEQ ID NO: 421879 - DNA, 25 bp, Mus musculus
accacagtgggttcccgcagacatc

SEQ ID NO: 421880 - DNA, 25 bp, Mus musculus
acgccagacacgcaggggaccacag

SEQ ID NO: 421881 - DNA, 25 bp, Mus musculus
gtccacatccaagttgaacgccaga

SEQ ID NO: 421882 - DNA, 25 bp, Mus musculus
ccctcggggccactgtacacagtga

SEQ ID NO: 421883 - DNA, 25 bp, Mus musculus
cgcgcatcaggtatgtagaagtcca

SEQ ID NO: 421884 - DNA, 25 bp, Mus musculus
cagcaacttacgtgcgcgcatcagg

SEQ ID NO: 421885 - DNA, 25 bp, Mus musculus
gtacacagtgagcttgtccacatcc

SEQ ID NO: 421886 - DNA, 25 bp, Mus musculus
ctgcatcttcatggtgcggctcatc

SEQ ID NO: 421887 - DNA, 25 bp, Mus musculus
agcctgagagtgcagcggccacaga

SEQ ID NO: 421888 - DNA, 25 bp, Mus musculus
agtgccctgagctgcagagagctcg

SEQ ID NO: 421889 - DNA, 25 bp, Mus musculus
caccggagtggacaaagcaagatgg

SEQ ID NO: 421890 - DNA, 25 bp, Mus musculus
gcagggatcttagcctggttctgga

SEQ ID NO: 421891 - DNA, 25 bp, Mus musculus
cggttttggcttccgcacaatgtca

SEQ ID NO: 421892 - DNA, 25 bp, Mus musculus
cacaatgtcacctgggcagacctga

SEQ ID NO: 421893 - DNA, 25 bp, Mus musculus
tcctcctagagagggtcggcgaaca

SEQ ID NO: 421894 - DNA, 25 bp, Mus musculus
aggaagccacctttccgcaggcgga

SEQ ID NO: 421895 - DNA, 25 bp, Mus musculus
tagggagctagagagggtccaactc

SEQ ID NO: 421896 - DNA, 25 bp, Mus musculus
gcggctcatcttcgagaggtaagaa

SEQ ID NO: 421897 - DNA, 25 bp, Mus musculus
aagaagggccgaagtgcctgctctc

SEQ ID NO: 421898 - DNA, 25 bp, Mus musculus
caacctttgtgttctctgtggggtc

SEQ ID NO: 421899 - DNA, 25 bp, Mus musculus
ggccaggctgacttctagggagcta

SEQ ID NO: 421900 - DNA, 25 bp, Mus musculus
gaactccgcggctaacagcggacgc

SEQ ID NO: 421901 - DNA, 25 bp, Mus musculus
agcgcgcagtctttcaatttcaaac

SEQ ID NO: 421902 - DNA, 25 bp, Mus musculus
aggctctgcggacccacgccgacat

SEQ ID NO: 421903 - DNA, 25 bp, Mus musculus
aggacccgaactccgcggctaacag

SEQ ID NO: 421904 - DNA, 25 bp, Mus musculus
ttgatatcggcctgcggaattctcg

SEQ ID NO: 421905 - DNA, 25 bp, Mus musculus
ggctcccgacctgagcggccaggaa

SEQ ID NO: 421906 - DNA, 25 bp, Mus musculus
ggaacgccgcggtctccaccagact

SEQ ID NO: 421907 - DNA, 25 bp, Mus musculus
caccagactggacctgtccggcagg

SEQ ID NO: 421908 - DNA, 25 bp, Mus musculus
tcctccagcgcgcagtctttcaatt

SEQ ID NO: 421909 - DNA, 25 bp, Mus musculus
tctgattggctgacagggcagactc

SEQ ID NO: 421910 - DNA, 25 bp, Mus musculus
agggcagactctccgtgcaaggatt

SEQ ID NO: 421911 - DNA, 25 bp, Mus musculus
ctccgtgcaaggattggttgatatc

SEQ ID NO: 421912 - DNA, 25 bp, Mus musculus
caaggattggttgatatcggcctgc

SEQ ID NO: 421913 - DNA, 25 bp, Mus musculus
gactggacctgtccggcaggaacca

SEQ ID NO: 421914 - DNA, 25 bp, Mus musculus
tcactgacaataatcgccgctgctc

SEQ ID NO: 421915 - DNA, 25 bp, Mus musculus
ttcccgtgggaacaaaggcacgata

SEQ ID NO: 421916 - DNA, 25 bp, Mus musculus
cccaaccagtacaagaagcggcgct

SEQ ID NO: 421917 - DNA, 25 bp, Mus musculus
gctgcagtcatctctcctggggtca

SEQ ID NO: 421918 - DNA, 25 bp, Mus musculus
accgcttaccttggccactgactgg

SEQ ID NO: 421919 - DNA, 25 bp, Mus musculus
aggcaggttactccgctccggaaca

SEQ ID NO: 421920 - DNA, 25 bp, Mus musculus
tccggaacaggagtcttgctcagca

SEQ ID NO: 421921 - DNA, 25 bp, Mus musculus
ctcctagaggcagaaagccggtccc

SEQ ID NO: 421922 - DNA, 25 bp, Mus musculus
tgaggcatcccgttttctacccgcg

SEQ ID NO: 421923 - DNA, 25 bp, Mus musculus
cccggaactagcatgcgggaatcca

SEQ ID NO: 421924 - DNA, 25 bp, Mus musculus
acacttgcgcgctagcacatgcaca

SEQ ID NO: 421925 - DNA, 25 bp, Mus musculus
tcgtgcatgctctcacccaggagca

SEQ ID NO: 421926 - DNA, 25 bp, Mus musculus
ggctccgggaacacaaaactgcctc

SEQ ID NO: 421927 - DNA, 25 bp, Mus musculus
agccttgagggtcaggactaattcc

SEQ ID NO: 421928 - DNA, 25 bp, Mus musculus
acactacctggtggaagcttgggcc

SEQ ID NO: 421929 - DNA, 25 bp, Mus musculus
tgtgcgcccatcaaggctgtgaccc

SEQ ID NO: 421930 - DNA, 25 bp, Mus musculus
gggaaaagagcgcacactacctggt

SEQ ID NO: 421931 - DNA, 25 bp, Mus musculus
cgcccgccgtagatgtcgtgacaaa

SEQ ID NO: 421932 - DNA, 25 bp, Mus musculus
gcgcgttgccttggcgcccataaga

SEQ ID NO: 421933 - DNA, 25 bp, Mus musculus
ttggcgcccataagacgccgccgag

SEQ ID NO: 421934 - DNA, 25 bp, Mus musculus
ccgccgagcagccactgtggatttc

SEQ ID NO: 421935 - DNA, 25 bp, Mus musculus
actgtggatttcatcggcgagctcc

SEQ ID NO: 421936 - DNA, 25 bp, Mus musculus
agctccctcggtcaccatgtctgtg

SEQ ID NO: 421937 - DNA, 25 bp, Mus musculus
caccatgtctgtgctggacgtgttg

SEQ ID NO: 421938 - DNA, 25 bp, Mus musculus
acgtgcgcttcgacgtgtcctcgca

SEQ ID NO: 421939 - DNA, 25 bp, Mus musculus
acgtgtcctcgcagtgagtctcagg

SEQ ID NO: 421940 - DNA, 25 bp, Mus musculus
atgtcgtgacaaagccggcgcgttg

SEQ ID NO: 421941 - DNA, 25 bp, Mus musculus
agcggcctatctcagtgtgcgccca

SEQ ID NO: 421942 - DNA, 25 bp, Mus musculus
cttcagaaccgggagacggagcgct

SEQ ID NO: 421943 - DNA, 25 bp, Mus musculus
gcatcatttcgggagcgctgtgaca

SEQ ID NO: 421944 - DNA, 25 bp, Mus musculus
ttttggaggcttcagaaccgggaga

SEQ ID NO: 421945 - DNA, 25 bp, Mus musculus
atttgaagcgctttccaggaccggg

SEQ ID NO: 421946 - DNA, 25 bp, Mus musculus
tcctgacggcggtagatttgaagcg

SEQ ID NO: 421947 - DNA, 25 bp, Mus musculus
gggctttagcgcctttcctgacggc

SEQ ID NO: 421948 - DNA, 25 bp, Mus musculus
atgctgacgtcagcccgggaacgcc

SEQ ID NO: 421949 - DNA, 25 bp, Mus musculus
agctcaaggagaagatgctgacgtc

SEQ ID NO: 421950 - DNA, 25 bp, Mus musculus
aggcagaagagaccctacaagctca

SEQ ID NO: 421951 - DNA, 25 bp, Mus musculus
tcagaaaccatcaagcgacccgtcg

SEQ ID NO: 421952 - DNA, 25 bp, Mus musculus
cgatccaatcaactctcagaaacca

SEQ ID NO: 421953 - DNA, 25 bp, Mus musculus
tgacggatccacaccgatccaatca

SEQ ID NO: 421954 - DNA, 25 bp, Mus musculus
gcgctgtgacattctgacggatcca

SEQ ID NO: 421955 - DNA, 25 bp, Mus musculus
ttttcctcccgtaggacagcggctg

SEQ ID NO: 421956 - DNA, 25 bp, Mus musculus
agcaccgggatgagcaccaccagca

SEQ ID NO: 421957 - DNA, 25 bp, Mus musculus
gctgcttgcgctgcggagcccagca

SEQ ID NO: 421958 - DNA, 25 bp, Mus musculus
tgaaaaagtaggtgccaggaatgtt

SEQ ID NO: 421959 - DNA, 25 bp, Mus musculus
caggaatgttgcatgtaaacttgcc

SEQ ID NO: 421960 - DNA, 25 bp, Mus musculus
taaacttgccgctggccgcatcgta

SEQ ID NO: 421961 - DNA, 25 bp, Mus musculus
ctggccgcatcgtagttgttgccta

SEQ ID NO: 421962 - DNA, 25 bp, Mus musculus
tgttgcctaggttggtgaccacgtc

SEQ ID NO: 421963 - DNA, 25 bp, Mus musculus
tgagcacctcgtaaccctcatgagg

SEQ ID NO: 421964 - DNA, 25 bp, Mus musculus
cctcatgagggttcttgaggccggc

SEQ ID NO: 421965 - DNA, 25 bp, Mus musculus
cgtagaaggccacgcgtggcaccgt

SEQ ID NO: 421966 - DNA, 25 bp, Mus musculus
ccacgcgtggcaccgtggtataggt

SEQ ID NO: 421967 - DNA, 25 bp, Mus musculus
gaccaggcttgcctggttcaccctt

SEQ ID NO: 421968 - DNA, 25 bp, Mus musculus
agcatctcatagtggccgtccgggc

SEQ ID NO: 421969 - DNA, 25 bp, Mus musculus
ggtgcccagcatctcatagtggccg

SEQ ID NO: 421970 - DNA, 25 bp, Mus musculus
cactcgctgcgctagtttggaaccg

SEQ ID NO: 421971 - DNA, 25 bp, Mus musculus
agcgcacctgcatctttaacaaagc

SEQ ID NO: 421972 - DNA, 25 bp, Mus musculus
tttaacaaagctgatcccgcgagtc

SEQ ID NO: 421973 - DNA, 25 bp, Mus musculus
atcccgcgagtccagagcaggtgat

SEQ ID NO: 421974 - DNA, 25 bp, Mus musculus
gcaggtgatactacttccaagctga

SEQ ID NO: 421975 - DNA, 25 bp, Mus musculus
agctgaagtcagctactgagcgata

SEQ ID NO: 421976 - DNA, 25 bp, Mus musculus
ctgagcgataactaaaccatttggt

SEQ ID NO: 421977 - DNA, 25 bp, Mus musculus
agtgacgtcagtctccaatccagga

SEQ ID NO: 421978 - DNA, 25 bp, Mus musculus
ccaatccaggaaccaggaaggagcc

SEQ ID NO: 421979 - DNA, 25 bp, Mus musculus
aaggagccctgtccgcggctgaacc

SEQ ID NO: 421980 - DNA, 25 bp, Mus musculus
gcgctagcagttcaccggctgcgta

SEQ ID NO: 421981 - DNA, 25 bp, Mus musculus
gctgcgtaaggcacgagaaccaacc

SEQ ID NO: 421982 - DNA, 25 bp, Mus musculus
aaccaaccggccgacgctggtgctg

SEQ ID NO: 421983 - DNA, 25 bp, Mus musculus
ctgggtgcgagcttctactctgcgc

SEQ ID NO: 421984 - DNA, 25 bp, Mus musculus
ctaccaaagatggtcagagggtcgg

SEQ ID NO: 421985 - DNA, 25 bp, Mus musculus
ttccgcgccgccagcgaggtaggtc

SEQ ID NO: 421986 - DNA, 25 bp, Mus musculus
ctgcagaagctagctcgggcccggc

SEQ ID NO: 421987 - DNA, 25 bp, Mus musculus
ccggccgctagtccggagtctgcgt

SEQ ID NO: 421988 - DNA, 25 bp, Mus musculus
tccggctttctcctagcaggcagtg

SEQ ID NO: 421989 - DNA, 25 bp, Mus musculus
tagtccggagtctgcgttccgcgcc

SEQ ID NO: 421990 - DNA, 25 bp, Mus musculus
tttctcctagcaggcagtgcgatgg

SEQ ID NO: 421991 - DNA, 25 bp, Mus musculus
ggactccggctttctcctagcaggc

SEQ ID NO: 421992 - DNA, 25 bp, Mus musculus
cgttggctggggactccggctttct

SEQ ID NO: 421993 - DNA, 25 bp, Mus musculus
cagagaaggtaagggtacacactcc

SEQ ID NO: 421994 - DNA, 25 bp, Mus musculus
ccagggccggcaagaggacagagaa

SEQ ID NO: 421995 - DNA, 25 bp, Mus musculus
gtttcgccttcttctctcggcactt

SEQ ID NO: 421996 - DNA, 25 bp, Mus musculus
gtagtttcgccttcttctctcggca

SEQ ID NO: 421997 - DNA, 25 bp, Mus musculus
cgccgcgcgctaccaaagatggtca

SEQ ID NO: 421998 - DNA, 25 bp, Mus musculus
tgttcttgaagctgtggtgaccgtg

SEQ ID NO: 421999 - DNA, 25 bp, Mus musculus
cctttcctgactggccagaggcgga

SEQ ID NO: 422000 - DNA, 25 bp, Mus musculus
tccgaatctttgaggtgagcttctt

SEQ ID NO: 422001 - DNA, 25 bp, Mus musculus
cttggaaactgaggagaaggtacga

SEQ ID NO: 422002 - DNA, 25 bp, Mus musculus
ctgtgctatgcgcaggcctcacctt

SEQ ID NO: 422003 - DNA, 25 bp, Mus musculus
ctttccacgtggcagggatcccggc

SEQ ID NO: 422004 - DNA, 25 bp, Mus musculus
caggcgcttctgtcgttgttcttga

SEQ ID NO: 422005 - DNA, 25 bp, Mus musculus
cctttaggcagaggctcgccgcatc

SEQ ID NO: 422006 - DNA, 25 bp, Mus musculus
atctttaagcgcgtttggctggccc

SEQ ID NO: 422007 - DNA, 25 bp, Mus musculus
atcctcacggcgtcctttcggtttg

SEQ ID NO: 422008 - DNA, 25 bp, Mus musculus
gcgtcctttcggtttgttccttgca

SEQ ID NO: 422009 - DNA, 25 bp, Mus musculus
tcctcctccgaggattgtgggaggc

SEQ ID NO: 422010 - DNA, 25 bp, Mus musculus
agaggcggatgtttcggaccattta

SEQ ID NO: 422011 - DNA, 25 bp, Mus musculus
gtgaccgtgggatccgaatctttga

SEQ ID NO: 422012 - DNA, 25 bp, Mus musculus
gatcccacgagcctcgcggggatcg

SEQ ID NO: 422013 - DNA, 25 bp, Mus musculus
ggaagtaccgacacgcatgcacgcc

SEQ ID NO: 422014 - DNA, 25 bp, Mus musculus
gacgctccaggaaagcactcgtatg

SEQ ID NO: 422015 - DNA, 25 bp, Mus musculus
ctcgtatgcctctagctggtcctcg

SEQ ID NO: 422016 - DNA, 25 bp, Mus musculus
aggaaagcactcgtatgcctctagc

SEQ ID NO: 422017 - DNA, 25 bp, Mus musculus
ccgcagtgccggaagtaccgacacg

SEQ ID NO: 422018 - DNA, 25 bp, Mus musculus
tgccgggctccctggttccgacgag

SEQ ID NO: 422019 - DNA, 25 bp, Mus musculus
cctggttccgacgaggaccagagtg

SEQ ID NO: 422020 - DNA, 25 bp, Mus musculus
tttttggtccgcgtgggcgccatcg

SEQ ID NO: 422021 - DNA, 25 bp, Mus musculus
gcgccatcggaagaagcggtcttca

SEQ ID NO: 422022 - DNA, 25 bp, Mus musculus
gaagcggtcttcatcggcgatcaca

SEQ ID NO: 422023 - DNA, 25 bp, Mus musculus
ttcatcggcgatcacaaaccagcct

SEQ ID NO: 422024 - DNA, 25 bp, Mus musculus
caaaccagcctccaccaagcccggg

SEQ ID NO: 422025 - DNA, 25 bp, Mus musculus
atgcctctagctggtcctcgcggtc

SEQ ID NO: 422026 - DNA, 25 bp, Mus musculus
gactgcggggacagcaacgtaatgc

SEQ ID NO: 422027 - DNA, 25 bp, Mus musculus
ggaccgcgcagaagtgctctgcagc

SEQ ID NO: 422028 - DNA, 25 bp, Mus musculus
ggcctggactctgcaaattctgagc

SEQ ID NO: 422029 - DNA, 25 bp, Mus musculus
ttctgagctctcatcatggcggcgg

SEQ ID NO: 422030 - DNA, 25 bp, Mus musculus
cgcaggggctggctttagacaaagc

SEQ ID NO: 422031 - DNA, 25 bp, Mus musculus
gctttagacaaagcggccaccgccg

SEQ ID NO: 422032 - DNA, 25 bp, Mus musculus
ctcagccggccggataaccgtgcgg

SEQ ID NO: 422033 - DNA, 25 bp, Mus musculus
atgccctggagtggtgtaagtgcct

SEQ ID NO: 422034 - DNA, 25 bp, Mus musculus
tctggacggccaacttcgtggccta

SEQ ID NO: 422035 - DNA, 25 bp, Mus musculus
taccgctgccggacgtgcggcatct

SEQ ID NO: 422036 - DNA, 25 bp, Mus musculus
ccctgcatgtcgctgtgcgcggagt

SEQ ID NO: 422037 - DNA, 25 bp, Mus musculus
gagtgcttccaccagggcgaccaca

SEQ ID NO: 422038 - DNA, 25 bp, Mus musculus
gacttcaacatgttccgcagccagg

SEQ ID NO: 422039 - DNA, 25 bp, Mus musculus
ggcgaccacactggacacgacttca

SEQ ID NO: 422040 - DNA, 25 bp, Mus musculus
tgcggatactagagggactgaagcc

SEQ ID NO: 422041 - DNA, 25 bp, Mus musculus
agcagctctttggtcacttcggaca

SEQ ID NO: 422042 - DNA, 25 bp, Mus musculus
cttcggacatgatgggaactggaca

SEQ ID NO: 422043 - DNA, 25 bp, Mus musculus
gcgaagcggcaactaggagtttccc

SEQ ID NO: 422044 - DNA, 25 bp, Mus musculus
acagtccgggactgctcttggtgcc

SEQ ID NO: 422045 - DNA, 25 bp, Mus musculus
accttgcgtccagcggcagaagatg

SEQ ID NO: 422046 - DNA, 25 bp, Mus musculus
agaccgcctgtcaagccgggcgaag

SEQ ID NO: 422047 - DNA, 25 bp, Mus musculus
gagccctgccttggtaccttgcgtc

SEQ ID NO: 422048 - DNA, 25 bp, Mus musculus
taatgggaccgaaagaggcgtcctg

SEQ ID NO: 422049 - DNA, 25 bp, Mus musculus
ccaagcgccaggtacccgaggtgat

SEQ ID NO: 422050 - DNA, 25 bp, Mus musculus
ttactgggaccaagcacgggtactg

SEQ ID NO: 422051 - DNA, 25 bp, Mus musculus
cccgagtgcctaaagcgtggttact

SEQ ID NO: 422052 - DNA, 25 bp, Mus musculus
agccgggatactaagcgcgagcaca

SEQ ID NO: 422053 - DNA, 25 bp, Mus musculus
tctcggactccggtcccggaacata

SEQ ID NO: 422054 - DNA, 25 bp, Mus musculus
tcacgaccggtgtcggttcatctcg

SEQ ID NO: 422055 - DNA, 25 bp, Mus musculus
agccgtcgcgttccgggctgtcttt

SEQ ID NO: 422056 - DNA, 25 bp, Mus musculus
caggctaagcggagatgtcacgacc

SEQ ID NO: 422057 - DNA, 25 bp, Mus musculus
gcgccgcctccagaaggagccggaa

SEQ ID NO: 422058 - DNA, 25 bp, Mus musculus
ctgcgaaggtagaaacgcgccgaga

SEQ ID NO: 422059 - DNA, 25 bp, Mus musculus
agataagtcttgtctgctccggggc

SEQ ID NO: 422060 - DNA, 25 bp, Mus musculus
tgcaagtgccacgtcccaagagcta

SEQ ID NO: 422061 - DNA, 25 bp, Mus musculus
tcccaagagctacgcggagtcgcca

SEQ ID NO: 422062 - DNA, 25 bp, Mus musculus
tgggctcctcgcagagcgtcgagat

SEQ ID NO: 422063 - DNA, 25 bp, Mus musculus
caccgagggctaccacgttttgcgg

SEQ ID NO: 422064 - DNA, 25 bp, Mus musculus
cgcactggcctgagcttcagagtta

SEQ ID NO: 422065 - DNA, 25 bp, Mus musculus
cctgagcttcagagttaggaagagc

SEQ ID NO: 422066 - DNA, 25 bp, Mus musculus
gctgcgaccaaatacccttctgcga

SEQ ID NO: 422067 - DNA, 25 bp, Mus musculus
aacgcgccgagataagtcttgtctg

SEQ ID NO: 422068 - DNA, 25 bp, Mus musculus
cccacgagcataacgttcaaacatg

SEQ ID NO: 422069 - DNA, 25 bp, Mus musculus
ggaacctgccggcacctctgcagtg

SEQ ID NO: 422070 - DNA, 25 bp, Mus musculus
aagctactttctgggagcccgactc

SEQ ID NO: 422071 - DNA, 25 bp, Mus musculus
tggacactcatcaagctactttctg

SEQ ID NO: 422072 - DNA, 25 bp, Mus musculus
cttccactgctactttggacactca

SEQ ID NO: 422073 - DNA, 25 bp, Mus musculus
cgactcggatccgaggcagcccaga

SEQ ID NO: 422074 - DNA, 25 bp, Mus musculus
cttgcccacgagtcggtctgccgtt

SEQ ID NO: 422075 - DNA, 25 bp, Mus musculus
acgagcagccttgcccacgagtcgg

SEQ ID NO: 422076 - DNA, 25 bp, Mus musculus
gaaggaaagttgcaaccatctgggg

SEQ ID NO: 422077 - DNA, 25 bp, Mus musculus
ttcaaacatgcaggagccgatggcg

SEQ ID NO: 422078 - DNA, 25 bp, Mus musculus
cgagcgtacttgcaacccacgagca

SEQ ID NO: 422079 - DNA, 25 bp, Mus musculus
aggctgcaccgcgagggcaaaccca

SEQ ID NO: 422080 - DNA, 25 bp, Mus musculus
tggcgaaggaaggaaagttgcaacc

SEQ ID NO: 422081 - DNA, 25 bp, Mus musculus
tcggtctgccgttgggatcgctcta

SEQ ID NO: 422082 - DNA, 25 bp, Mus musculus
aggtgcagcgttaatcccgagagca

SEQ ID NO: 422083 - DNA, 25 bp, Mus musculus
tccgtgtcccgcaattagggtatta

SEQ ID NO: 422084 - DNA, 25 bp, Mus musculus
ccgggctgcagttttttacgcgctc

SEQ ID NO: 422085 - DNA, 25 bp, Mus musculus
tcgctctgcctgacgggaattgtag

SEQ ID NO: 422086 - DNA, 25 bp, Mus musculus
tgcagaggacgaacctgggcatcct

SEQ ID NO: 422087 - DNA, 25 bp, Mus musculus
ctctgggcttctatgcacgcgacgc

SEQ ID NO: 422088 - DNA, 25 bp, Mus musculus
acccggaaggccaatgtgtgccgca

SEQ ID NO: 422089 - DNA, 25 bp, Mus musculus
ccgcgtcagccttcctttgaggttc

SEQ ID NO: 422090 - DNA, 25 bp, Mus musculus
gtgtgtcgctacctcttgatctctg

SEQ ID NO: 422091 - DNA, 25 bp, Mus musculus
ggcgccgttgattctgttcctttgc

SEQ ID NO: 422092 - DNA, 25 bp, Mus musculus
acggcgcagcctattagggccagga

SEQ ID NO: 422093 - DNA, 25 bp, Mus musculus
gaaaataggtactcaggtccgccgc

SEQ ID NO: 422094 - DNA, 25 bp, Mus musculus
caaggggactacatttccgggagag

SEQ ID NO: 422095 - DNA, 25 bp, Mus musculus
ttcctttgcgtcaaatccgtgtgtc

SEQ ID NO: 422096 - DNA, 25 bp, Mus musculus
ctgcacttccgagaggggcttggct

SEQ ID NO: 422097 - DNA, 25 bp, Mus musculus
ccacagcctgttaccctaagaaagc

SEQ ID NO: 422098 - DNA, 25 bp, Mus musculus
ggcagccagagctcacggtgcagcc

SEQ ID NO: 422099 - DNA, 25 bp, Mus musculus
caacaccaagttctccagcaggctg

SEQ ID NO: 422100 - DNA, 25 bp, Mus musculus
ctccagcaggctgtcgtggagcatg

SEQ ID NO: 422101 - DNA, 25 bp, Mus musculus
tccgcgctgctcgtgggcttcctgt

SEQ ID NO: 422102 - DNA, 25 bp, Mus musculus
cttcctgtcggtgatcttcgtgctc

SEQ ID NO: 422103 - DNA, 25 bp, Mus musculus
tcatctgggtcctgcacttccgaga

SEQ ID NO: 422104 - DNA, 25 bp, Mus musculus
ccagggcatcggtactgggatcctc

SEQ ID NO: 422105 - DNA, 25 bp, Mus musculus
aacggcagcgggctcgagtttaact

SEQ ID NO: 422106 - DNA, 25 bp, Mus musculus
tcgagtttaactggcacccggtgct

SEQ ID NO: 422107 - DNA, 25 bp, Mus musculus
gtgaccggcttcgtcttcatccagg

SEQ ID NO: 422108 - DNA, 25 bp, Mus musculus
ttcgtcttcatccagggcatcggta

SEQ ID NO: 422109 - DNA, 25 bp, Mus musculus
atcttcgtgctcatctgggtcctgc

SEQ ID NO: 422110 - DNA, 25 bp, Mus musculus
cgacagcgtcttcctgcttggcgca

SEQ ID NO: 422111 - DNA, 25 bp, Mus musculus
gtccacgcccgtggtcaacgccgct

SEQ ID NO: 422112 - DNA, 25 bp, Mus musculus
agcctgaacctagcgggcggcctcg

SEQ ID NO: 422113 - DNA, 25 bp, Mus musculus
accgcgacgagacctccgtgagtac

SEQ ID NO: 422114 - DNA, 25 bp, Mus musculus
acgtgtaccgcgacgagacctccgt

SEQ ID NO: 422115 - DNA, 25 bp, Mus musculus
tgtccttccagtaccccgacgtgta

SEQ ID NO: 422116 - DNA, 25 bp, Mus musculus
atccggccatgctgtccttccagta

SEQ ID NO: 422117 - DNA, 25 bp, Mus musculus
agcgtcttcctgcttggcgcactgc

SEQ ID NO: 422118 - DNA, 25 bp, Mus musculus
cttgccgacagcgtcttcctgcttg

SEQ ID NO: 422119 - DNA, 25 bp, Mus musculus
gactccgctccctcttgtcgccgct

SEQ ID NO: 422120 - DNA, 25 bp, Mus musculus
ctcctgcagagggagctgtgcgccc

SEQ ID NO: 422121 - DNA, 25 bp, Mus musculus
gcaaagttttccttcctgggcgcga

SEQ ID NO: 422122 - DNA, 25 bp, Mus musculus
ctaggtcagggaagaggcaaagttt

SEQ ID NO: 422123 - DNA, 25 bp, Mus musculus
cccaccgtgagtccgcccgtgcacg

SEQ ID NO: 422124 - DNA, 25 bp, Mus musculus
cgttcgttagctgcccgaagctgtg

SEQ ID NO: 422125 - DNA, 25 bp, Mus musculus
gggaacaatccaccagtctgcggcg

SEQ ID NO: 422126 - DNA, 25 bp, Mus musculus
ggggaacaatccaccagtctgcggc

SEQ ID NO: 422127 - DNA, 25 bp, Mus musculus
aacaatccaccagtctgcggcggca

SEQ ID NO: 422128 - DNA, 25 bp, Mus musculus
caatccaccagtctgcggcggcaga

SEQ ID NO: 422129 - DNA, 25 bp, Mus musculus
atccaccagtctgcggcggcagagg

SEQ ID NO: 422130 - DNA, 25 bp, Mus musculus
ggggacggaaggcagccacctcacc

SEQ ID NO: 422131 - DNA, 25 bp, Mus musculus
gctcgccggggcgtccgagaggcgc

SEQ ID NO: 422132 - DNA, 25 bp, Mus musculus
gcggtgtggcgtctctgtcagccca

SEQ ID NO: 422133 - DNA, 25 bp, Mus musculus
gtgtggcgtctctgtcagcccagcc

SEQ ID NO: 422134 - DNA, 25 bp, Mus musculus
gcgtctctgtcagcccagccggatt

SEQ ID NO: 422135 - DNA, 25 bp, Mus musculus
gcccagccggattctccccgcttcg

SEQ ID NO: 422136 - DNA, 25 bp, Mus musculus
cgttagctgcccgaagctgtggctt

SEQ ID NO: 422137 - DNA, 25 bp, Mus musculus
tagctgcccgaagctgtggcttggc

SEQ ID NO: 422138 - DNA, 25 bp, Mus musculus
cggtgtatctgtttcaaccgggaga

SEQ ID NO: 422139 - DNA, 25 bp, Mus musculus
ggaccctcgggatttgtcctgcacc

SEQ ID NO: 422140 - DNA, 25 bp, Mus musculus
cggcccgggtgactcaaagcggcct

SEQ ID NO: 422141 - DNA, 25 bp, Mus musculus
cgatattctgacagcgccggcccgg

SEQ ID NO: 422142 - DNA, 25 bp, Mus musculus
ggccgcccggccgatattctgacag

SEQ ID NO: 422143 - DNA, 25 bp, Mus musculus
tttgcctctgatggccgctttggag

SEQ ID NO: 422144 - DNA, 25 bp, Mus musculus
tccttcaagtcccttttgcctctga

SEQ ID NO: 422145 - DNA, 25 bp, Mus musculus
agagaaagcgatctccactccgcca

SEQ ID NO: 422146 - DNA, 25 bp, Mus musculus
gttaccggccagagaaagcgatctc

SEQ ID NO: 422147 - DNA, 25 bp, Mus musculus
attctgtgtgagaccgcgtctcggc

SEQ ID NO: 422148 - DNA, 25 bp, Mus musculus
gctgggcggcaaagactctgattct

SEQ ID NO: 422149 - DNA, 25 bp, Mus musculus
tacaaaaggtaagtcacggagaggc

SEQ ID NO: 422150 - DNA, 25 bp, Mus musculus
tcaaccgggagattctgttttacaa

SEQ ID NO: 422151 - DNA, 25 bp, Mus musculus
atttgtcctgcacccgtctggtgga

SEQ ID NO: 422152 - DNA, 25 bp, Mus musculus
agcgtgtactggctttctgtgtcct

SEQ ID NO: 422153 - DNA, 25 bp, Mus musculus
gtactggctttctgtgtccttagga

SEQ ID NO: 422154 - DNA, 25 bp, Mus musculus
cttaggatgcgtgcagcgtgcactg

SEQ ID NO: 422155 - DNA, 25 bp, Mus musculus
ttcagccgcagtgcgcttaggacgt

SEQ ID NO: 422156 - DNA, 25 bp, Mus musculus
cttgacgtttgtcatgagggacgcg

SEQ ID NO: 422157 - DNA, 25 bp, Mus musculus
ccgcagtgcgcttaggacgtgtgca

SEQ ID NO: 422158 - DNA, 25 bp, Mus musculus
gcttaggacgtgtgcagcgtgtact

SEQ ID NO: 422159 - DNA, 25 bp, Mus musculus
cgcattcagccgcagtgcgcttagg

SEQ ID NO: 422160 - DNA, 25 bp, Mus musculus
tgcgtgcagcgtgcactggctttct

SEQ ID NO: 422161 - DNA, 25 bp, Mus musculus
atgcgtgcagcgtgcactggctttc

SEQ ID NO: 422162 - DNA, 25 bp, Mus musculus
gctttctgtgtccttgacgtttgtc

SEQ ID NO: 422163 - DNA, 25 bp, Mus musculus
tctgtgtccttgacgtttgtcatga

SEQ ID NO: 422164 - DNA, 25 bp, Mus musculus
ccttgacgtttgtcatgagggacgc

SEQ ID NO: 422165 - DNA, 25 bp, Mus musculus
agggacgcggctcacttggcagccg

SEQ ID NO: 422166 - DNA, 25 bp, Mus musculus
cgcccgtctatatgcaaatgagcta

SEQ ID NO: 422167 - DNA, 25 bp, Mus musculus
gccgcgcccgtctatatgcaaatga

SEQ ID NO: 422168 - DNA, 25 bp, Mus musculus
gcgccgcgcccgtctatatgcaaat

SEQ ID NO: 422169 - DNA, 25 bp, Mus musculus
gcgctccctcctgtcgcagcgccgc

SEQ ID NO: 422170 - DNA, 25 bp, Mus musculus
atatgcaaatgagctagagcgcgtc

SEQ ID NO: 422171 - DNA, 25 bp, Mus musculus
tggccttggttgatccatcagcggg

SEQ ID NO: 422172 - DNA, 25 bp, Mus musculus
ttggttgatccatcagcgggccggc

SEQ ID NO: 422173 - DNA, 25 bp, Mus musculus
cagtcgcacctcttgcgggggacac

SEQ ID NO: 422174 - DNA, 25 bp, Mus musculus
cagagctccggtcgccggattccaa

SEQ ID NO: 422175 - DNA, 25 bp, Mus musculus
aagccgggaacgagcgagtgagcga

SEQ ID NO: 422176 - DNA, 25 bp, Mus musculus
ccatgctgtgctcggaagccgggaa

SEQ ID NO: 422177 - DNA, 25 bp, Mus musculus
tgcaaatgagctagagcgcgtcggt

SEQ ID NO: 422178 - DNA, 25 bp, Mus musculus
gcaccgagtggccttggttgatcca

SEQ ID NO: 422179 - DNA, 25 bp, Mus musculus
ccgagtggccttggttgatccatca

SEQ ID NO: 422180 - DNA, 25 bp, Mus musculus
ggaccttctccctctcattggttcg

SEQ ID NO: 422181 - DNA, 25 bp, Mus musculus
tcaggcaaggcgctcagtttggtct

SEQ ID NO: 422182 - DNA, 25 bp, Mus musculus
ctcccgggccttgagctcaggcaag

SEQ ID NO: 422183 - DNA, 25 bp, Mus musculus
gaggttccagaaggcctctcccttc

SEQ ID NO: 422184 - DNA, 25 bp, Mus musculus
ttcgggctctagcagaggttccaga

SEQ ID NO: 422185 - DNA, 25 bp, Mus musculus
gccgcctggaactttcgggctctag

SEQ ID NO: 422186 - DNA, 25 bp, Mus musculus
gatttgtccttcctcagctgcgggc

SEQ ID NO: 422187 - DNA, 25 bp, Mus musculus
cgcgggttgatttgtccttcctcag

SEQ ID NO: 422188 - DNA, 25 bp, Mus musculus
gcgtaagtccttgcggtcacttccg

SEQ ID NO: 422189 - DNA, 25 bp, Mus musculus
aagacatggggtgagggcatcctca

SEQ ID NO: 422190 - DNA, 25 bp, Mus musculus
tctcattggttcgtggctcgccgag

SEQ ID NO: 422191 - DNA, 25 bp, Mus musculus
ctcacgtgcggtggctaggcaaccg

SEQ ID NO: 422192 - DNA, 25 bp, Mus musculus
agggcatcctcacgtgcggtggcta

SEQ ID NO: 422193 - DNA, 25 bp, Mus musculus
ggaaacgcgtaagtccttgcggtca

SEQ ID NO: 422194 - DNA, 25 bp, Mus musculus
gccggagccagcctctcctggtgga

SEQ ID NO: 422195 - DNA, 25 bp, Mus musculus
actgcttcagcgcttctgggctttg

SEQ ID NO: 422196 - DNA, 25 bp, Mus musculus
ttcagcgcttctgggctttgagagc

SEQ ID NO: 422197 - DNA, 25 bp, Mus musculus
ccacgtgaccggagccaacatggcg

SEQ ID NO: 422198 - DNA, 25 bp, Mus musculus
ctgctcgtccgtggaggtaagcgat

SEQ ID NO: 422199 - DNA, 25 bp, Mus musculus
tggaggtaagcgatcggcatacgac

SEQ ID NO: 422200 - DNA, 25 bp, Mus musculus
gatcggcatacgaccgctccagggc

SEQ ID NO: 422201 - DNA, 25 bp, Mus musculus
ccagagacacgtccgcgcgtgggct

SEQ ID NO: 422202 - DNA, 25 bp, Mus musculus
acgcacgtgcgtactttcagtcgga

SEQ ID NO: 422203 - DNA, 25 bp, Mus musculus
gcgtactttcagtcggacccgcgta

SEQ ID NO: 422204 - DNA, 25 bp, Mus musculus
gtcggacccgcgtataccatacacg

SEQ ID NO: 422205 - DNA, 25 bp, Mus musculus
tgctggcctcgacaccagaggcact

SEQ ID NO: 422206 - DNA, 25 bp, Mus musculus
cgcgtataccatacacgttggcacg

SEQ ID NO: 422207 - DNA, 25 bp, Mus musculus
ctctcctggtggaagcgagctggcc

SEQ ID NO: 422208 - DNA, 25 bp, Mus musculus
tgggttgtcgcccagtgcgcgactc

SEQ ID NO: 422209 - DNA, 25 bp, Mus musculus
tgcaggctacctgggttgtcgccca

SEQ ID NO: 422210 - DNA, 25 bp, Mus musculus
cgggccctcaggactccacgctgag

SEQ ID NO: 422211 - DNA, 25 bp, Mus musculus
ctggagcgcgctgagctaggcacaa

SEQ ID NO: 422212 - DNA, 25 bp, Mus musculus
gctaggcacaagacgctcagaagga

SEQ ID NO: 422213 - DNA, 25 bp, Mus musculus
gccgagcccgagcttctcggaccaa

SEQ ID NO: 422214 - DNA, 25 bp, Mus musculus
gcgatccagagaccgcggccggact

SEQ ID NO: 422215 - DNA, 25 bp, Mus musculus
cggcgctccgcaccggactaggtga

SEQ ID NO: 422216 - DNA, 25 bp, Mus musculus
cgcaccggactaggtgacctcaaga

SEQ ID NO: 422217 - DNA, 25 bp, Mus musculus
tgacctcaagaagaagtggtccggg

SEQ ID NO: 422218 - DNA, 25 bp, Mus musculus
agtcgcgcgccttcgaggttcctgc

SEQ ID NO: 422219 - DNA, 25 bp, Mus musculus
gcagcccattgtgcgtcccgctccg

SEQ ID NO: 422220 - DNA, 25 bp, Mus musculus
acgtgtggaccggattctccccagg

SEQ ID NO: 422221 - DNA, 25 bp, Mus musculus
agacgctcagaaggaccgctggctg

SEQ ID NO: 422222 - DNA, 25 bp, Mus musculus
ggggacctcttcagagccgaaaaca

SEQ ID NO: 422223 - DNA, 25 bp, Mus musculus
gggccgatcctcttgtctgcttttg

SEQ ID NO: 422224 - DNA, 25 bp, Mus musculus
gatgaggatgaccagcagaagcacc

SEQ ID NO: 422225 - DNA, 25 bp, Mus musculus
taaaaggcgatcttgggcaccgtgc

SEQ ID NO: 422226 - DNA, 25 bp, Mus musculus
tcgtagccttcgtgctgccgtttga

SEQ ID NO: 422227 - DNA, 25 bp, Mus musculus
ttccgagattggttaccacgtcgtc

SEQ ID NO: 422228 - DNA, 25 bp, Mus musculus
tgggatcatagtggtttccgagatt

SEQ ID NO: 422229 - DNA, 25 bp, Mus musculus
tgaacttgcccgtggtgggatcata

SEQ ID NO: 422230 - DNA, 25 bp, Mus musculus
ggtgaagaagtagatacccggtatg

SEQ ID NO: 422231 - DNA, 25 bp, Mus musculus
gctgccgtttgaggccagcgtaaaa

SEQ ID NO: 422232 - DNA, 25 bp, Mus musculus
ccgcgctcacctggttgtttttgca

SEQ ID NO: 422233 - DNA, 25 bp, Mus musculus
ttgtttttgcagagatcagcccaca

SEQ ID NO: 422234 - DNA, 25 bp, Mus musculus
acccggtatggagcaggtgaacttg

SEQ ID NO: 422235 - DNA, 25 bp, Mus musculus
ctcgcctttgggaccctggatgaaa

SEQ ID NO: 422236 - DNA, 25 bp, Mus musculus
ccgccgagtgccaggttcggtgact

SEQ ID NO: 422237 - DNA, 25 bp, Mus musculus
gtgcatctcagcgacctctttggcc

SEQ ID NO: 422238 - DNA, 25 bp, Mus musculus
ctcctttgcccactgcagggcgaaa

SEQ ID NO: 422239 - DNA, 25 bp, Mus musculus
cgagcgcggctggtttcccagtgta

SEQ ID NO: 422240 - DNA, 25 bp, Mus musculus
ccctggttcctgcaccctcctttgc

SEQ ID NO: 422241 - DNA, 25 bp, Mus musculus
tagagagcgggtgcatctcagcgac

SEQ ID NO: 422242 - DNA, 25 bp, Mus musculus
ccctcacgtctagagagcgggtgca

SEQ ID NO: 422243 - DNA, 25 bp, Mus musculus
cggctttgtttctctccctagccca

SEQ ID NO: 422244 - DNA, 25 bp, Mus musculus
ctgatcacagggcttggcgtctctg

SEQ ID NO: 422245 - DNA, 25 bp, Mus musculus
cctactttggggagcgcaagttagt

SEQ ID NO: 422246 - DNA, 25 bp, Mus musculus
tttcattcctactttggggagcgca

SEQ ID NO: 422247 - DNA, 25 bp, Mus musculus
agggagccgaaatcgccgcttccca

SEQ ID NO: 422248 - DNA, 25 bp, Mus musculus
tttcccagtgtagggagccgaaatc

SEQ ID NO: 422249 - DNA, 25 bp, Mus musculus
ttgcccactgcagggcgaaaggcgc

SEQ ID NO: 422250 - DNA, 25 bp, Mus musculus
ctcatggccattgcagcctcggaaa

SEQ ID NO: 422251 - DNA, 25 bp, Mus musculus
gcgctgagtgactcacgccgcctta

SEQ ID NO: 422252 - DNA, 25 bp, Mus musculus
cagttttgttcatccgattccgggg

SEQ ID NO: 422253 - DNA, 25 bp, Mus musculus
tgtgcagttttgttcatccgattcc

SEQ ID NO: 422254 - DNA, 25 bp, Mus musculus
cagcctcggaaaggtgtaaatgtgc

SEQ ID NO: 422255 - DNA, 25 bp, Mus musculus
ctgtgcgcatctcatggccattgca

SEQ ID NO: 422256 - DNA, 25 bp, Mus musculus
catctcggactgtgcgcatctcatg

SEQ ID NO: 422257 - DNA, 25 bp, Mus musculus
ctcggaaaggtgtaaatgtgcagtt

SEQ ID NO: 422258 - DNA, 25 bp, Mus musculus
gtacccatctcggactgtgcgcatc

SEQ ID NO: 422259 - DNA, 25 bp, Mus musculus
ggccgtagtacccatctcggactgt

SEQ ID NO: 422260 - DNA, 25 bp, Mus musculus
ttcaccgaggccgtagtacccatct

SEQ ID NO: 422261 - DNA, 25 bp, Mus musculus
agctgaacccttcaccgaggccgta

SEQ ID NO: 422262 - DNA, 25 bp, Mus musculus
ggggaggagctgaacccttcaccga

SEQ ID NO: 422263 - DNA, 25 bp, Mus musculus
ctcacgccgccttaggctgaagaac

SEQ ID NO: 422264 - DNA, 25 bp, Mus musculus
agctctaagtatgtgaccaaggttc

SEQ ID NO: 422265 - DNA, 25 bp, Mus musculus
atgcttacccggctcgttgttgacc

SEQ ID NO: 422266 - DNA, 25 bp, Mus musculus
gcaccctagatgcttgcgatgctta

SEQ ID NO: 422267 - DNA, 25 bp, Mus musculus
tgcaaggctagagctccggactgcc

SEQ ID NO: 422268 - DNA, 25 bp, Mus musculus
gcagcaaagctatgcgctacccaca

SEQ ID NO: 422269 - DNA, 25 bp, Mus musculus
aggaggccttcccaacttcagcacg

SEQ ID NO: 422270 - DNA, 25 bp, Mus musculus
ctttagagacttgaggaggccttcc

SEQ ID NO: 422271 - DNA, 25 bp, Mus musculus
ccttgtctgcaacgaaaagtgagtg

SEQ ID NO: 422272 - DNA, 25 bp, Mus musculus
tggcagggccagatactgggtcttc

SEQ ID NO: 422273 - DNA, 25 bp, Mus musculus
tcccaccttgctcacctgagtttgg

SEQ ID NO: 422274 - DNA, 25 bp, Mus musculus
agaaagcaggccatctcccaccttg

SEQ ID NO: 422275 - DNA, 25 bp, Mus musculus
cggacgtgcccgcttcctagagaaa

SEQ ID NO: 422276 - DNA, 25 bp, Mus musculus
caggtcagttatggaacccgcttta

SEQ ID NO: 422277 - DNA, 25 bp, Mus musculus
ttgttgaccggagacgaactggtgc

SEQ ID NO: 422278 - DNA, 25 bp, Mus musculus
atatttggtttctgcttctgcctgc

SEQ ID NO: 422279 - DNA, 25 bp, Mus musculus
caggccctgacacgggccgggtaat

SEQ ID NO: 422280 - DNA, 25 bp, Mus musculus
ccgggtaattgatctggaggtgcca

SEQ ID NO: 422281 - DNA, 25 bp, Mus musculus
ttgcagcaactaaatatttggtttc

SEQ ID NO: 422282 - DNA, 25 bp, Mus musculus
cctcgctctgctcaaacaaacttca

SEQ ID NO: 422283 - DNA, 25 bp, Mus musculus
ttaaaagcgataagcaagcgtgggg

SEQ ID NO: 422284 - DNA, 25 bp, Mus musculus
ccacggccggatcgatggcaccgag

SEQ ID NO: 422285 - DNA, 25 bp, Mus musculus
atcgatggcaccgagcctgcgggct

SEQ ID NO: 422286 - DNA, 25 bp, Mus musculus
ccttatgagggcaggatcggcgccc

SEQ ID NO: 422287 - DNA, 25 bp, Mus musculus
aggatcggcgccctctttcggatcg

SEQ ID NO: 422288 - DNA, 25 bp, Mus musculus
cctctttcggatcgccgagcactgg

SEQ ID NO: 422289 - DNA, 25 bp, Mus musculus
tcggatcgccgagcactgggcgcac

SEQ ID NO: 422290 - DNA, 25 bp, Mus musculus
gcggtaggcacctccttatgagggc

SEQ ID NO: 422291 - DNA, 25 bp, Mus musculus
tctggaggtgccaatttgcagcaac

SEQ ID NO: 422292 - DNA, 25 bp, Mus musculus
gggcagccaccgcaaagcctgcgga

SEQ ID NO: 422293 - DNA, 25 bp, Mus musculus
gctctgcgccattgctctgtctgcg

SEQ ID NO: 422294 - DNA, 25 bp, Mus musculus
accgcaaagcctgcggatgggaccg

SEQ ID NO: 422295 - DNA, 25 bp, Mus musculus
ctcgcgtcaccgttagggacaccgt

SEQ ID NO: 422296 - DNA, 25 bp, Mus musculus
ggacaccgtggggtctctcatggat

SEQ ID NO: 422297 - DNA, 25 bp, Mus musculus
ccgtggggtctctcatggatcggaa

SEQ ID NO: 422298 - DNA, 25 bp, Mus musculus
catggatcggaaggagaaatggctc

SEQ ID NO: 422299 - DNA, 25 bp, Mus musculus
aaatggctccgaggatcctgcgtgc

SEQ ID NO: 422300 - DNA, 25 bp, Mus musculus
aggatcctgcgtgcgccctgaaagc

SEQ ID NO: 422301 - DNA, 25 bp, Mus musculus
tgcgccctgaaagcgcgtggtcttg

SEQ ID NO: 422302 - DNA, 25 bp, Mus musculus
cgcgctcctttccagagtgggcaca

SEQ ID NO: 422303 - DNA, 25 bp, Mus musculus
ctcctttccagagtgggcacagggc

SEQ ID NO: 422304 - DNA, 25 bp, Mus musculus
gacccactcgcgtcaccgttaggga

SEQ ID NO: 422305 - DNA, 25 bp, Mus musculus
cacagggcggctctgcgccattgct

SEQ ID NO: 422306 - DNA, 25 bp, Mus musculus
cgctcgccatgcactggcagttgca

SEQ ID NO: 422307 - DNA, 25 bp, Mus musculus
tcttccagggaaatgcaggcctttc

SEQ ID NO: 422308 - DNA, 25 bp, Mus musculus
tcccggtcactcgataaaacgcttg

SEQ ID NO: 422309 - DNA, 25 bp, Mus musculus
gtctccagagaacaacgggctcatt

SEQ ID NO: 422310 - DNA, 25 bp, Mus musculus
gggctcattgagcagcagctagctg

SEQ ID NO: 422311 - DNA, 25 bp, Mus musculus
cagttgtgcctgctctacctgtccg

SEQ ID NO: 422312 - DNA, 25 bp, Mus musculus
agcccggctgggtacagccttcaac

SEQ ID NO: 422313 - DNA, 25 bp, Mus musculus
tggacacccgcgaggacaacgtgat

SEQ ID NO: 422314 - DNA, 25 bp, Mus musculus
ccaagacttgagagatccgggcccg

SEQ ID NO: 422315 - DNA, 25 bp, Mus musculus
tgctttccgcggttctccacttcgg

SEQ ID NO: 422316 - DNA, 25 bp, Mus musculus
ccacttcgggcttagtttgcaggga

SEQ ID NO: 422317 - DNA, 25 bp, Mus musculus
gtggcacgctttgctgagcttcacg

SEQ ID NO: 422318 - DNA, 25 bp, Mus musculus
gagcttcacgtgtgcactagggaca

SEQ ID NO: 422319 - DNA, 25 bp, Mus musculus
cagagcctatccgtgggctagccca

SEQ ID NO: 422320 - DNA, 25 bp, Mus musculus
gtcgccactctccatgaagcagttc

SEQ ID NO: 422321 - DNA, 25 bp, Mus musculus
cgatctcgcacagcctagagctttt

SEQ ID NO: 422322 - DNA, 25 bp, Mus musculus
gcctagagcttttccgctgagactg

SEQ ID NO: 422323 - DNA, 25 bp, Mus musculus
caaaggggtgcaacacagcgcaagc

SEQ ID NO: 422324 - DNA, 25 bp, Mus musculus
acagcgcaagctggatcgtttaagc

SEQ ID NO: 422325 - DNA, 25 bp, Mus musculus
ctggatcgtttaagccgggctccca

SEQ ID NO: 422326 - DNA, 25 bp, Mus musculus
actcgctccgggtggtttcagctgc

SEQ ID NO: 422327 - DNA, 25 bp, Mus musculus
tgctgtccgtgctccgcctacgggg

SEQ ID NO: 422328 - DNA, 25 bp, Mus musculus
cagccttccgcgcacgtgcgtaggt

SEQ ID NO: 422329 - DNA, 25 bp, Mus musculus
gtggacttctatgcgcgcttctcgc

SEQ ID NO: 422330 - DNA, 25 bp, Mus musculus
ctgcgtcttaggtgcttccttcctc

SEQ ID NO: 422331 - DNA, 25 bp, Mus musculus
cacgtaacagggacgtgcgactata

SEQ ID NO: 422332 - DNA, 25 bp, Mus musculus
ggacgtgcgactatagtgtgtttaa

SEQ ID NO: 422333 - DNA, 25 bp, Mus musculus
ggcatacagccgcaggttggcgccc

SEQ ID NO: 422334 - DNA, 25 bp, Mus musculus
atcgcctgcctggataaaaggtacg

SEQ ID NO: 422335 - DNA, 25 bp, Mus musculus
cactctcagtcctcggccgagtgga

SEQ ID NO: 422336 - DNA, 25 bp, Mus musculus
cagtcctcggccgagtggatcgcct

SEQ ID NO: 422337 - DNA, 25 bp, Mus musculus
gagtggatcgcctgcctggataaaa

SEQ ID NO: 422338 - DNA, 25 bp, Mus musculus
ggatcgcctgcctggataaaaggta

SEQ ID NO: 422339 - DNA, 25 bp, Mus musculus
gggacaaggtgccagcctgccctgg

SEQ ID NO: 422340 - DNA, 25 bp, Mus musculus
ccgggaacagaatgcggcgccgtgg

SEQ ID NO: 422341 - DNA, 25 bp, Mus musculus
tccacgtgccgggaacagaatgcgg

SEQ ID NO: 422342 - DNA, 25 bp, Mus musculus
agcattccacgtgccgggaacagaa

SEQ ID NO: 422343 - DNA, 25 bp, Mus musculus
gagagcattccacgtgccgggaaca

SEQ ID NO: 422344 - DNA, 25 bp, Mus musculus
ctgcgggagagcattccacgtgccg

SEQ ID NO: 422345 - DNA, 25 bp, Mus musculus
cctgcctggataaaaggtacgtggg

SEQ ID NO: 422346 - DNA, 25 bp, Mus musculus
cgcctgcctggataaaaggtacgtg

SEQ ID NO: 422347 - DNA, 25 bp, Mus musculus
gggtccactcgtggggtgccacctg

SEQ ID NO: 422348 - DNA, 25 bp, Mus musculus
tgctgttgccgcgacgtcttcctca

SEQ ID NO: 422349 - DNA, 25 bp, Mus musculus
aggcggaatgttcaactcctgactc

SEQ ID NO: 422350 - DNA, 25 bp, Mus musculus
tcaactcctgactccggcggaagcg

SEQ ID NO: 422351 - DNA, 25 bp, Mus musculus
agtcccttgccgctgggccgaggac

SEQ ID NO: 422352 - DNA, 25 bp, Mus musculus
ctcggtgcccggaagagtccggcct

SEQ ID NO: 422353 - DNA, 25 bp, Mus musculus
aagagtccggcctggcacagctcgc

SEQ ID NO: 422354 - DNA, 25 bp, Mus musculus
ttccacgctcggaggtaggtggtgc

SEQ ID NO: 422355 - DNA, 25 bp, Mus musculus
tgccgcgacgtcttcctcattggcg

SEQ ID NO: 422356 - DNA, 25 bp, Mus musculus
gtcttcctcattggcgccgcgcgga

SEQ ID NO: 422357 - DNA, 25 bp, Mus musculus
cgcggagaggcggaatgttcaactc

SEQ ID NO: 422358 - DNA, 25 bp, Mus musculus
acagctcgcggcgatcccggggaac

SEQ ID NO: 422359 - DNA, 25 bp, Mus musculus
caccctcgccttccgtgggagcaca

SEQ ID NO: 422360 - DNA, 25 bp, Mus musculus
atctacaccagggtgggcactgggt

SEQ ID NO: 422361 - DNA, 25 bp, Mus musculus
aatgttcaactcctgactccggcgg

SEQ ID NO: 422362 - DNA, 25 bp, Mus musculus
tggccttgtgagcatttcttgagaa

SEQ ID NO: 422363 - DNA, 25 bp, Mus musculus
cgcgggttagctccgctcacttgtc

SEQ ID NO: 422364 - DNA, 25 bp, Mus musculus
gcgctcctgattgtcgccaggttga

SEQ ID NO: 422365 - DNA, 25 bp, Mus musculus
tcgccaggttgagggaaatcacaga

SEQ ID NO: 422366 - DNA, 25 bp, Mus musculus
cccaggataactcaaggccaaggtg

SEQ ID NO: 422367 - DNA, 25 bp, Mus musculus
ttacctacgcgtgcactagtggccc

SEQ ID NO: 422368 - DNA, 25 bp, Mus musculus
gtggccctgggatcgatcctctttt

SEQ ID NO: 422369 - DNA, 25 bp, Mus musculus
tgctggtgtgttccgacgaactatc

SEQ ID NO: 422370 - DNA, 25 bp, Mus musculus
ttgctccaacggaagccagaactta

SEQ ID NO: 422371 - DNA, 25 bp, Mus musculus
cctaggctgtggtcagatgcaattt

SEQ ID NO: 422372 - DNA, 25 bp, Mus musculus
tcgtgtgccgcgaccgtttagtaac

SEQ ID NO: 422373 - DNA, 25 bp, Mus musculus
ttttcttcccggcttgcagctgcga

SEQ ID NO: 422374 - DNA, 25 bp, Mus musculus
gctgcgagctggaacgtaactcttt

SEQ ID NO: 422375 - DNA, 25 bp, Mus musculus
accactctggatctgcgggtttagc

SEQ ID NO: 422376 - DNA, 25 bp, Mus musculus
cgggagaacctcaagaccggcacgg

SEQ ID NO: 422377 - DNA, 25 bp, Mus musculus
aagccatggcttccaaactcctgcg

SEQ ID NO: 422378 - DNA, 25 bp, Mus musculus
gcttccaaactcctgcgcgcggtca

SEQ ID NO: 422379 - DNA, 25 bp, Mus musculus
ctggccaccgccaaagccatggctt

SEQ ID NO: 422380 - DNA, 25 bp, Mus musculus
cccggctctggcaagggcaccgttt

SEQ ID NO: 422381 - DNA, 25 bp, Mus musculus
ctctggcaagggcaccgtttgcgaa

SEQ ID NO: 422382 - DNA, 25 bp, Mus musculus
caagggcaccgtttgcgaaaggatc

SEQ ID NO: 422383 - DNA, 25 bp, Mus musculus
accgtttgcgaaaggatcgcccaga

SEQ ID NO: 422384 - DNA, 25 bp, Mus musculus
ttgcgaaaggatcgcccagaacttt

SEQ ID NO: 422385 - DNA, 25 bp, Mus musculus
aaggatcgcccagaactttggcctc

SEQ ID NO: 422386 - DNA, 25 bp, Mus musculus
agaactttggcctccagcatctctc

SEQ ID NO: 422387 - DNA, 25 bp, Mus musculus
agcatctctccagcggccacttgtt

SEQ ID NO: 422388 - DNA, 25 bp, Mus musculus
cacttgttgcgggagaacctcaaga

SEQ ID NO: 422389 - DNA, 25 bp, Mus musculus
ttgttgcgggagaacctcaagaccg

SEQ ID NO: 422390 - DNA, 25 bp, Mus musculus
aattctgcctgggtaccacctgcca

SEQ ID NO: 422391 - DNA, 25 bp, Mus musculus
aagaggaggctgacaaacgcgcgcc

SEQ ID NO: 422392 - DNA, 25 bp, Mus musculus
ctgggtaccacctgccaggagaaga

SEQ ID NO: 422393 - DNA, 25 bp, Mus musculus
acgcagaattctgcctgggtaccac

SEQ ID NO: 422394 - DNA, 25 bp, Mus musculus
aacgagagagctgaacgcagaattc

SEQ ID NO: 422395 - DNA, 25 bp, Mus musculus
cgccgccgaaaagctgaacgagaga

SEQ ID NO: 422396 - DNA, 25 bp, Mus musculus
acagaggagataggagctagccagc

SEQ ID NO: 422397 - DNA, 25 bp, Mus musculus
taggagctagccagcagcatcgaga

SEQ ID NO: 422398 - DNA, 25 bp, Mus musculus
ccaggagaagaggaggctgacaaac

SEQ ID NO: 422399 - DNA, 25 bp, Mus musculus
agcatcgagagcctcgccgccgaaa

SEQ ID NO: 422400 - DNA, 25 bp, Mus musculus
agatgcgcggagcaatggcaattcg

SEQ ID NO: 422401 - DNA, 25 bp, Mus musculus
tggcaattcgcaggatccgcggctc

SEQ ID NO: 422402 - DNA, 25 bp, Mus musculus
ggatccgcggctcagagaagctcag

SEQ ID NO: 422403 - DNA, 25 bp, Mus musculus
ctcagagaagctcagggacagagga

SEQ ID NO: 422404 - DNA, 25 bp, Mus musculus
cccgccgccttacacatggtgagaa

SEQ ID NO: 422405 - DNA, 25 bp, Mus musculus
tagtgtgtttaggacagctcaggcg

SEQ ID NO: 422406 - DNA, 25 bp, Mus musculus
ccggtcatagtgtgtttaggacagc

SEQ ID NO: 422407 - DNA, 25 bp, Mus musculus
tttcacgggcttttcgggagctgca

SEQ ID NO: 422408 - DNA, 25 bp, Mus musculus
gctgctgtagatactcgccgtggcc

SEQ ID NO: 422409 - DNA, 25 bp, Mus musculus
acgtccaaggcagccatttcctctt

SEQ ID NO: 422410 - DNA, 25 bp, Mus musculus
ttacacatggtgagaagcgaaggcg

SEQ ID NO: 422411 - DNA, 25 bp, Mus musculus
ggcagccatttcctcttgtttcacg

SEQ ID NO: 422412 - DNA, 25 bp, Mus musculus
tcggctttacgtaccggtcatagtg

SEQ ID NO: 422413 - DNA, 25 bp, Mus musculus
gcgagccgcggccacattagtgagc

SEQ ID NO: 422414 - DNA, 25 bp, Mus musculus
ccacattagtgagcgccgggcggcc

SEQ ID NO: 422415 - DNA, 25 bp, Mus musculus
gagtgcggctttctgcctccgccga

SEQ ID NO: 422416 - DNA, 25 bp, Mus musculus
aggcagcgagggttgctctctctcg

SEQ ID NO: 422417 - DNA, 25 bp, Mus musculus
gctctctctcggctttacgtaccgg

SEQ ID NO: 422418 - DNA, 25 bp, Mus musculus
gcgtcccgccctgaggcaagacttt

SEQ ID NO: 422419 - DNA, 25 bp, Mus musculus
tgggcttccaccgagcctccaggtt

SEQ ID NO: 422420 - DNA, 25 bp, Mus musculus
gcgtctctctacacgtgggcttcca

SEQ ID NO: 422421 - DNA, 25 bp, Mus musculus
gcaccgggtttctgcgtctctctac

SEQ ID NO: 422422 - DNA, 25 bp, Mus musculus
cagggtcacgcccattggcccggat

SEQ ID NO: 422423 - DNA, 25 bp, Mus musculus
tcccggactgcaaagaccggtgtcg

SEQ ID NO: 422424 - DNA, 25 bp, Mus musculus
gctaacgatcgcacggggtcccgga

SEQ ID NO: 422425 - DNA, 25 bp, Mus musculus
gactcaccgtgcaccgggctaacga

SEQ ID NO: 422426 - DNA, 25 bp, Mus musculus
ggctccttcggggactcaccgtgca

SEQ ID NO: 422427 - DNA, 25 bp, Mus musculus
agcctcggaaccactggcccgggag

SEQ ID NO: 422428 - DNA, 25 bp, Mus musculus
cgagggcgcctcattcatccacatg

SEQ ID NO: 422429 - DNA, 25 bp, Mus musculus
agagccaatctcgtggccgcgcggc

SEQ ID NO: 422430 - DNA, 25 bp, Mus musculus
ccagactgcggcgagagccaatctc

SEQ ID NO: 422431 - DNA, 25 bp, Mus musculus
aggtttctttcagctccactgctcc

SEQ ID NO: 422432 - DNA, 25 bp, Mus musculus
actccatggagcgttccagcttggc

SEQ ID NO: 422433 - DNA, 25 bp, Mus musculus
tgaggctccactcgcccgagttgtc

SEQ ID NO: 422434 - DNA, 25 bp, Mus musculus
ttgtccagaacgtgattggccatgc

SEQ ID NO: 422435 - DNA, 25 bp, Mus musculus
aacgtgattggccatgcgggccttg

SEQ ID NO: 422436 - DNA, 25 bp, Mus musculus
cgggccttgtccttcaggggcagct

SEQ ID NO: 422437 - DNA, 25 bp, Mus musculus
gggcgttgatcctcgcctctgcatc

SEQ ID NO: 422438 - DNA, 25 bp, Mus musculus
tgcatcctcccggttcaggttgttc

SEQ ID NO: 422439 - DNA, 25 bp, Mus musculus
cggttcaggttgttccgcttcatca

SEQ ID NO: 422440 - DNA, 25 bp, Mus musculus
ggttgttccgcttcatcagccgcgc

SEQ ID NO: 422441 - DNA, 25 bp, Mus musculus
ctgcgaggcccgtcaggaacccaag

SEQ ID NO: 422442 - DNA, 25 bp, Mus musculus
gcctggcgtctggtgaggctccact

SEQ ID NO: 422443 - DNA, 25 bp, Mus musculus
gtcaggaacccaagccgcagcggca

SEQ ID NO: 422444 - DNA, 25 bp, Mus musculus
cgcagcggcagatactccatggagc

SEQ ID NO: 422445 - DNA, 25 bp, Mus musculus
cgcccgagttgtccagaacgtgatt

SEQ ID NO: 422446 - DNA, 25 bp, Mus musculus
cctcattgggcgagaggcgcagcca

SEQ ID NO: 422447 - DNA, 25 bp, Mus musculus
agccgccaggcttaacaccgctccg

SEQ ID NO: 422448 - DNA, 25 bp, Mus musculus
cgcagacttgactggcacgcgccag

SEQ ID NO: 422449 - DNA, 25 bp, Mus musculus
acttgactggcacgcgccaggagcc

SEQ ID NO: 422450 - DNA, 25 bp, Mus musculus
tgcggggcagctcccgtctgctctg

SEQ ID NO: 422451 - DNA, 25 bp, Mus musculus
cctgcgccctcattgggcgagaggc

SEQ ID NO: 422452 - DNA, 25 bp, Mus musculus
gaggcgcagccagcggcacttcaaa

SEQ ID NO: 422453 - DNA, 25 bp, Mus musculus
tcaaagcgggtgctcctcgcactta

SEQ ID NO: 422454 - DNA, 25 bp, Mus musculus
gctcctcgcacttaggctgagtttt

SEQ ID NO: 422455 - DNA, 25 bp, Mus musculus
cacttaggctgagttttgccggcgg

SEQ ID NO: 422456 - DNA, 25 bp, Mus musculus
ttttgccggcgggagcccagagtcc

SEQ ID NO: 422457 - DNA, 25 bp, Mus musculus
cgcgcgggacctgaatcgtgattcc

SEQ ID NO: 422458 - DNA, 25 bp, Mus musculus
cagcggcacttcaaagcgggtgctc

SEQ ID NO: 422459 - DNA, 25 bp, Mus musculus
ctgaatcgtgattcccagcagccgc

SEQ ID NO: 422460 - DNA, 25 bp, Mus musculus
aagtcgggcttccactcgaccctag

SEQ ID NO: 422461 - DNA, 25 bp, Mus musculus
cagctgtcacatcccgggctgtggc

SEQ ID NO: 422462 - DNA, 25 bp, Mus musculus
gcgcacccgtacgagtcgtggtaca

SEQ ID NO: 422463 - DNA, 25 bp, Mus musculus
ggcaaaaagggcagcgacagtgaca

SEQ ID NO: 422464 - DNA, 25 bp, Mus musculus
ctgccctgtgtgcaacaagcgtttc

SEQ ID NO: 422465 - DNA, 25 bp, Mus musculus
ccttcagcagcgactatggcggcct

SEQ ID NO: 422466 - DNA, 25 bp, Mus musculus
agcctacgccgcaaggggctgcaca

SEQ ID NO: 422467 - DNA, 25 bp, Mus musculus
ggccgccagcgctatgatttcgggc

SEQ ID NO: 422468 - DNA, 25 bp, Mus musculus
tcttactcggactccagcgcagcgg

SEQ ID NO: 422469 - DNA, 25 bp, Mus musculus
ttcaagccggtgctgccctcttact

SEQ ID NO: 422470 - DNA, 25 bp, Mus musculus
tgcactctcagctgggcacctacaa

SEQ ID NO: 422471 - DNA, 25 bp, Mus musculus
agtcgtggtacaagtcgggcttcca

SEQ ID NO: 422472 - DNA, 25 bp, Mus musculus
tatggcggccttttctccaactcgg

SEQ ID NO: 422473 - DNA, 25 bp, Mus musculus
gaccacctgagcaaacacattaaga

SEQ ID NO: 422474 - DNA, 25 bp, Mus musculus
cccaggcagctttgtttcttgttga

SEQ ID NO: 422475 - DNA, 25 bp, Mus musculus
ctccgcaggccagtgatcaaggcct

SEQ ID NO: 422476 - DNA, 25 bp, Mus musculus
ctcccggaggggctccctccgcagg

SEQ ID NO: 422477 - DNA, 25 bp, Mus musculus
tggctgtgcaggtctcgctcccgga

SEQ ID NO: 422478 - DNA, 25 bp, Mus musculus
gcagatcaaagggcctggctgtgca

SEQ ID NO: 422479 - DNA, 25 bp, Mus musculus
ttcttgttgataataaaggcagatc

SEQ ID NO: 422480 - DNA, 25 bp, Mus musculus
gtcccaggcagctttgtttcttgtt

SEQ ID NO: 422481 - DNA, 25 bp, Mus musculus
ccgggacgtcggtcccaggcagctt

SEQ ID NO: 422482 - DNA, 25 bp, Mus musculus
cccgtgcgtctagggtctgcaggct

SEQ ID NO: 422483 - DNA, 25 bp, Mus musculus
gccagtgatcaaggcctctgcgcgc

SEQ ID NO: 422484 - DNA, 25 bp, Mus musculus
caacgtccatcaccgcggctccggt

SEQ ID NO: 422485 - DNA, 25 bp, Mus musculus
cgcgggtcagccaacgtccatcacc

SEQ ID NO: 422486 - DNA, 25 bp, Mus musculus
cgtcccgtgcgtctagggtctgcag

SEQ ID NO: 422487 - DNA, 25 bp, Mus musculus
cgcaggccagtgatcaaggcctctg

SEQ ID NO: 422488 - DNA, 25 bp, Mus musculus
aagccgctgccaggcaaaggccaga

SEQ ID NO: 422489 - DNA, 25 bp, Mus musculus
cgagaatcccggaaaagtcccagag

SEQ ID NO: 422490 - DNA, 25 bp, Mus musculus
aaagtcccagagaacgcggtgtgcc

SEQ ID NO: 422491 - DNA, 25 bp, Mus musculus
tgccctggcatctacggatggccta

SEQ ID NO: 422492 - DNA, 25 bp, Mus musculus
gatggcctagcgacacctgatcagc

SEQ ID NO: 422493 - DNA, 25 bp, Mus musculus
gacacctgatcagcctatcctttgg

SEQ ID NO: 422494 - DNA, 25 bp, Mus musculus
agcctatcctttgggttccgtgtga

SEQ ID NO: 422495 - DNA, 25 bp, Mus musculus
gttccgtgtgataccctttcaagtg

SEQ ID NO: 422496 - DNA, 25 bp, Mus musculus
accctttcaagtggagatctgaccg

SEQ ID NO: 422497 - DNA, 25 bp, Mus musculus
tctattacaatcagaccttcgcgtc

SEQ ID NO: 422498 - DNA, 25 bp, Mus musculus
agatctgaccggctccgaaggcctc

SEQ ID NO: 422499 - DNA, 25 bp, Mus musculus
gcaaaggccagaggttttccctgtc

SEQ ID NO: 422500 - DNA, 25 bp, Mus musculus
ttttccctgtcttgagtcgcgggta

SEQ ID NO: 422501 - DNA, 25 bp, Mus musculus
ggcgactaggcagtttggtcaaatc

SEQ ID NO: 422502 - DNA, 25 bp, Mus musculus
ggctctgctgcgtcagcttcgatcc

SEQ ID NO: 422503 - DNA, 25 bp, Mus musculus
gctaggtcttctcggaacgtaaaca

SEQ ID NO: 422504 - DNA, 25 bp, Mus musculus
cggtcagcccgaacaagcgaggtct

SEQ ID NO: 422505 - DNA, 25 bp, Mus musculus
tctggcaacgccgactccagttgca

SEQ ID NO: 422506 - DNA, 25 bp, Mus musculus
tcgagcccagcactttctggcaacg

SEQ ID NO: 422507 - DNA, 25 bp, Mus musculus
agcgaggtctcgaggttcgagccca

SEQ ID NO: 422508 - DNA, 25 bp, Mus musculus
agcttcgatccgagcgcggtcagcc

SEQ ID NO: 422509 - DNA, 25 bp, Mus musculus
ctctcttccggcagtcgcttctggt

SEQ ID NO: 422510 - DNA, 25 bp, Mus musculus
acttccgtggtttgacgcttggcac

SEQ ID NO: 422511 - DNA, 25 bp, Mus musculus
tcgggaggatgactacttccgtggt

SEQ ID NO: 422512 - DNA, 25 bp, Mus musculus
gcttcaccggaactgctaggcaagt

SEQ ID NO: 422513 - DNA, 25 bp, Mus musculus
aagccaaccgctaggtcttctcgga

SEQ ID NO: 422514 - DNA, 25 bp, Mus musculus
tctgagtcggagaagccaaccgcta

SEQ ID NO: 422515 - DNA, 25 bp, Mus musculus
ctaggcaagtttgggcgagaacttc

SEQ ID NO: 422516 - DNA, 25 bp, Mus musculus
gaggtccgcgtttcaaatctccacc

SEQ ID NO: 422517 - DNA, 25 bp, Mus musculus
cgtagctgtacttccggcttttctc

SEQ ID NO: 422518 - DNA, 25 bp, Mus musculus
ccgaaccctcttgtagcggcgtgtg

SEQ ID NO: 422519 - DNA, 25 bp, Mus musculus
tgtgccagcggcagatgcccaacca

SEQ ID NO: 422520 - DNA, 25 bp, Mus musculus
atgcccaaccacgttccgagaaagg

SEQ ID NO: 422521 - DNA, 25 bp, Mus musculus
ctgcggtcctgtcagctaccttagg

SEQ ID NO: 422522 - DNA, 25 bp, Mus musculus
ctaccttaggcgtctgcagcccggt

SEQ ID NO: 422523 - DNA, 25 bp, Mus musculus
ctggaggtcagagaagccggtctcc

SEQ ID NO: 422524 - DNA, 25 bp, Mus musculus
gaagccggtctccattctgccgtga

SEQ ID NO: 422525 - DNA, 25 bp, Mus musculus
ccagcatggaggtccgcgtttcaaa

SEQ ID NO: 422526 - DNA, 25 bp, Mus musculus
taagctccagtgctacactgcactc

SEQ ID NO: 422527 - DNA, 25 bp, Mus musculus
atgcgggtctccacctcgcctttag

SEQ ID NO: 422528 - DNA, 25 bp, Mus musculus
ccctagccagaaggcccgaatgcgg

SEQ ID NO: 422529 - DNA, 25 bp, Mus musculus
tggccgccggtctcccgtagctgta

SEQ ID NO: 422530 - DNA, 25 bp, Mus musculus
ggcgcaaagccctgacccgagctgg

SEQ ID NO: 422531 - DNA, 25 bp, Mus musculus
cccaagacgctgtccctagaaacta

SEQ ID NO: 422532 - DNA, 25 bp, Mus musculus
gagccggacctggaagggataccca

SEQ ID NO: 422533 - DNA, 25 bp, Mus musculus
gaacttcgccgagatgtgcgccctc

SEQ ID NO: 422534 - DNA, 25 bp, Mus musculus
aggctgcgaccatccgggaacttcg

SEQ ID NO: 422535 - DNA, 25 bp, Mus musculus
ggaaacttctctctgggtccgcagg

SEQ ID NO: 422536 - DNA, 25 bp, Mus musculus
accgcggttagatccatcgggtcca

SEQ ID NO: 422537 - DNA, 25 bp, Mus musculus
agatggagttgcagatgcggttccc

SEQ ID NO: 422538 - DNA, 25 bp, Mus musculus
aagtcacccgccctcggtggagatg

SEQ ID NO: 422539 - DNA, 25 bp, Mus musculus
tctgggagccctaaactccaaagtc

SEQ ID NO: 422540 - DNA, 25 bp, Mus musculus
agcactggagccaagttctgggagc

SEQ ID NO: 422541 - DNA, 25 bp, Mus musculus
cataggcacctagagcgcgcccata

SEQ ID NO: 422542 - DNA, 25 bp, Mus musculus
ggccgccctttcaggagcagacata

SEQ ID NO: 422543 - DNA, 25 bp, Mus musculus
cagggaaagccttttccggtcatct

SEQ ID NO: 422544 - DNA, 25 bp, Mus musculus
ctcggggacctctcaagtgaccaca

SEQ ID NO: 422545 - DNA, 25 bp, Mus musculus
cacgaaaggcgggaagcaggtccaa

SEQ ID NO: 422546 - DNA, 25 bp, Mus musculus
acgcgagtgattgggcgaaaagcac

SEQ ID NO: 422547 - DNA, 25 bp, Mus musculus
ggaaccaaagaacactcggacgcga

SEQ ID NO: 422548 - DNA, 25 bp, Mus musculus
gtgactccgtcgtgcctcggaaaaa

SEQ ID NO: 422549 - DNA, 25 bp, Mus musculus
ttcctgctttccaccgagggagcgc

SEQ ID NO: 422550 - DNA, 25 bp, Mus musculus
cgcgagatccgactgacaaaccttc

SEQ ID NO: 422551 - DNA, 25 bp, Mus musculus
aggcttccgtcctctctcgcgagat

SEQ ID NO: 422552 - DNA, 25 bp, Mus musculus
tcgcactttaaaggccacgggctcc

SEQ ID NO: 422553 - DNA, 25 bp, Mus musculus
ggagagggctgaatcgcactttaaa

SEQ ID NO: 422554 - DNA, 25 bp, Mus musculus
gcgacgtcgccatgttagcaccttc

SEQ ID NO: 422555 - DNA, 25 bp, Mus musculus
agccgcagcgcgttacctaacggtc

SEQ ID NO: 422556 - DNA, 25 bp, Mus musculus
gttattccttctcgctcaggcttgg

SEQ ID NO: 422557 - DNA, 25 bp, Mus musculus
gtttcggtaaccagggaactgcaga

SEQ ID NO: 422558 - DNA, 25 bp, Mus musculus
tcagccgaaaacaggatcccgcagc

SEQ ID NO: 422559 - DNA, 25 bp, Mus musculus
agactccgccctacgctgaggaacg

SEQ ID NO: 422560 - DNA, 25 bp, Mus musculus
agcgatgaactggatcagccgaaaa

SEQ ID NO: 422561 - DNA, 25 bp, Mus musculus
acaggatcccgcagcaggaacacac

SEQ ID NO: 422562 - DNA, 25 bp, Mus musculus
gcaggcgcacacaaaatccggccaa

SEQ ID NO: 422563 - DNA, 25 bp, Mus musculus
ccggcctgacacttcccaaattagg

SEQ ID NO: 422564 - DNA, 25 bp, Mus musculus
ttaggagaactgtttcccagctgtg

SEQ ID NO: 422565 - DNA, 25 bp, Mus musculus
aactgtttcccagctgtggctccag

SEQ ID NO: 422566 - DNA, 25 bp, Mus musculus
cgaggctctgcccactgaagaaagt

SEQ ID NO: 422567 - DNA, 25 bp, Mus musculus
tctgcccactgaagaaagtggaccc

SEQ ID NO: 422568 - DNA, 25 bp, Mus musculus
ccgaggcggaccaatcgtacacgtt

SEQ ID NO: 422569 - DNA, 25 bp, Mus musculus
tcgtacacgttttagtctcagagac

SEQ ID NO: 422570 - DNA, 25 bp, Mus musculus
ggaacacaccctgtcccagcgatcg

SEQ ID NO: 422571 - DNA, 25 bp, Mus musculus
ttagtctcagagactccgccctacg

SEQ ID NO: 422572 - DNA, 25 bp, Mus musculus
cgcgctccacgagcaaggaggctgt

SEQ ID NO: 422573 - DNA, 25 bp, Mus musculus
ccgcttcctctctgcggagcgaaaa

SEQ ID NO: 422574 - DNA, 25 bp, Mus musculus
ttggcgcaggcgaacatctttcttc

SEQ ID NO: 422575 - DNA, 25 bp, Mus musculus
ccgaggcccgggttacgcaccagag

SEQ ID NO: 422576 - DNA, 25 bp, Mus musculus
tccctcggcgtgaatgctgggccga

SEQ ID NO: 422577 - DNA, 25 bp, Mus musculus
acacatggccgggaactgtctgcgg

SEQ ID NO: 422578 - DNA, 25 bp, Mus musculus
aggctgtgacctacgcccagaaggc

SEQ ID NO: 422579 - DNA, 25 bp, Mus musculus
tgcaggcaactaggcctcagctgcc

SEQ ID NO: 422580 - DNA, 25 bp, Mus musculus
acgggaaacgctgtgcaggcaacta

SEQ ID NO: 422581 - DNA, 25 bp, Mus musculus
gtttgacctacagacgcgcacggga

SEQ ID NO: 422582 - DNA, 25 bp, Mus musculus
tctgcggagcgaaaagaggcttaag

SEQ ID NO: 422583 - DNA, 25 bp, Mus musculus
cgcaagcgcggtgcggctcttatcc

SEQ ID NO: 422584 - DNA, 25 bp, Mus musculus
cgcgccgcagcacccggatggagaa

SEQ ID NO: 422585 - DNA, 25 bp, Mus musculus
cgcccagaaggcctgtcagctaggc

SEQ ID NO: 422586 - DNA, 25 bp, Mus musculus
ctggctcgctgcacacaggcgggac

SEQ ID NO: 422587 - DNA, 25 bp, Mus musculus
aatgcgccaactcggccgcagcatc

SEQ ID NO: 422588 - DNA, 25 bp, Mus musculus
ggcggagcgccacccgaggaaacaa

SEQ ID NO: 422589 - DNA, 25 bp, Mus musculus
ggagcgccacccgaggaaacaaagc

SEQ ID NO: 422590 - DNA, 25 bp, Mus musculus
acccgaggaaacaaagcggctgctc

SEQ ID NO: 422591 - DNA, 25 bp, Mus musculus
aaacaaagcggctgctcgccgctgc

SEQ ID NO: 422592 - DNA, 25 bp, Mus musculus
cggcttcctttcacccgcgccgcta

SEQ ID NO: 422593 - DNA, 25 bp, Mus musculus
taccgggtctccgactcggcctcag

SEQ ID NO: 422594 - DNA, 25 bp, Mus musculus
gcctcagcctccgtcgctagcccaa

SEQ ID NO: 422595 - DNA, 25 bp, Mus musculus
gctagcccaatctccgctgcgctta

SEQ ID NO: 422596 - DNA, 25 bp, Mus musculus
gcgcttactggctggctcgctgcac

SEQ ID NO: 422597 - DNA, 25 bp, Mus musculus
ctcgctgcacacaggcgggactcgg

SEQ ID NO: 422598 - DNA, 25 bp, Mus musculus
agcgtgcacgccgaccgggcgtcca

SEQ ID NO: 422599 - DNA, 25 bp, Mus musculus
atctccgctgcgcttactggctggc

SEQ ID NO: 422600 - DNA, 25 bp, Mus musculus
gccaccgcgtagagcctctggagca

SEQ ID NO: 422601 - DNA, 25 bp, Mus musculus
ctgttcagggcgatccacgagagaa

SEQ ID NO: 422602 - DNA, 25 bp, Mus musculus
atcctccgcgctagtgtaggctgtc

SEQ ID NO: 422603 - DNA, 25 bp, Mus musculus
gatttaggctgagtatcctccgcgc

SEQ ID NO: 422604 - DNA, 25 bp, Mus musculus
ggcccagccgttggtgcctcagagc

SEQ ID NO: 422605 - DNA, 25 bp, Mus musculus
tccacgagagaaggcggcaacagtg

SEQ ID NO: 422606 - DNA, 25 bp, Mus musculus
gagcaggcagcagcacctacagata

SEQ ID NO: 422607 - DNA, 25 bp, Mus musculus
cggaatccctgagaacatacccgga

SEQ ID NO: 422608 - DNA, 25 bp, Mus musculus
cctgggcgtccactcggggaagcct

SEQ ID NO: 422609 - DNA, 25 bp, Mus musculus
tcctacctgagaaaagcgggcgccg

SEQ ID NO: 422610 - DNA, 25 bp, Mus musculus
cggagactggttcccgctgtccgga

SEQ ID NO: 422611 - DNA, 25 bp, Mus musculus
caccaagctctaggccacttggcag

SEQ ID NO: 422612 - DNA, 25 bp, Mus musculus
caacagtgtacggagggcagcagcc

SEQ ID NO: 422613 - DNA, 25 bp, Mus musculus
acctacagatagagcgctgggcccg

SEQ ID NO: 422614 - DNA, 25 bp, Mus musculus
ggcgctgcagccaaagtccgagcca

SEQ ID NO: 422615 - DNA, 25 bp, Mus musculus
cgtagttatctggtgagcggcgcct

SEQ ID NO: 422616 - DNA, 25 bp, Mus musculus
tgacggcggtcttgctgagcaccgc

SEQ ID NO: 422617 - DNA, 25 bp, Mus musculus
gcagactggctgctgtgacaactga

SEQ ID NO: 422618 - DNA, 25 bp, Mus musculus
ctgtgacaactgaggcacgagcagg

SEQ ID NO: 422619 - DNA, 25 bp, Mus musculus
gaagctgcagagcagttccggccgc

SEQ ID NO: 422620 - DNA, 25 bp, Mus musculus
agttccggccgcgaataaggatgtg

SEQ ID NO: 422621 - DNA, 25 bp, Mus musculus
cggccgcgaataaggatgtgaaagc

SEQ ID NO: 422622 - DNA, 25 bp, Mus musculus
ataaggatgtgaaagcgcacggaag

SEQ ID NO: 422623 - DNA, 25 bp, Mus musculus
acgcccacgtgcgggtagtagtgca

SEQ ID NO: 422624 - DNA, 25 bp, Mus musculus
gctggatgcggccacgacatggcca

SEQ ID NO: 422625 - DNA, 25 bp, Mus musculus
atgcggccacgacatggccaggcgc

SEQ ID NO: 422626 - DNA, 25 bp, Mus musculus
aggcgctgccgtttgtccttcatgc

SEQ ID NO: 422627 - DNA, 25 bp, Mus musculus
tcgtccctctggtccggcgggctga

SEQ ID NO: 422628 - DNA, 25 bp, Mus musculus
tccatgcagactaccgaggcccgag

SEQ ID NO: 422629 - DNA, 25 bp, Mus musculus
acggtatcgccgcacctgatcggcg

SEQ ID NO: 422630 - DNA, 25 bp, Mus musculus
cgggcatgcgctggaatagatacct

SEQ ID NO: 422631 - DNA, 25 bp, Mus musculus
cgggcgtgagacaaatcaacccaag

SEQ ID NO: 422632 - DNA, 25 bp, Mus musculus
gtgaatgccgtacggtatcgccgca

SEQ ID NO: 422633 - DNA, 25 bp, Mus musculus
atctgttcgcgggtgaatgccgtac

SEQ ID NO: 422634 - DNA, 25 bp, Mus musculus
taccgaggcccgagccggaagccga

SEQ ID NO: 422635 - DNA, 25 bp, Mus musculus
ctccaggcgcgcgatctgttcgcgg

SEQ ID NO: 422636 - DNA, 25 bp, Mus musculus
tagaactctttctccaggcgcgcga

SEQ ID NO: 422637 - DNA, 25 bp, Mus musculus
gtagttctccctgtagaactctttc

SEQ ID NO: 422638 - DNA, 25 bp, Mus musculus
cgctggaatagataccttgatggtg

SEQ ID NO: 422639 - DNA, 25 bp, Mus musculus
gccgagacacgtagttctccctgta

SEQ ID NO: 422640 - DNA, 25 bp, Mus musculus
ataccttgatggtggtttcgggcag

SEQ ID NO: 422641 - DNA, 25 bp, Mus musculus
aagccgacgtcgtggtgcccgcgac

SEQ ID NO: 422642 - DNA, 25 bp, Mus musculus
cgcttcggaataatgactaggcttc

SEQ ID NO: 422643 - DNA, 25 bp, Mus musculus
cttcggaataatgactaggcttctt

SEQ ID NO: 422644 - DNA, 25 bp, Mus musculus
gtcgctgctcatgtcggcctcggcg

SEQ ID NO: 422645 - DNA, 25 bp, Mus musculus
ccgcttcggaataatgactaggctt

SEQ ID NO: 422646 - DNA, 25 bp, Mus musculus
ggccgcttcggaataatgactaggc

SEQ ID NO: 422647 - DNA, 25 bp, Mus musculus
cggccgcttcggaataatgactagg

SEQ ID NO: 422648 - DNA, 25 bp, Mus musculus
gcggccgcttcggaataatgactag

SEQ ID NO: 422649 - DNA, 25 bp, Mus musculus
cggcggccgcttcggaataatgact

SEQ ID NO: 422650 - DNA, 25 bp, Mus musculus
ctcggcggccgcttcggaataatga

SEQ ID NO: 422651 - DNA, 25 bp, Mus musculus
cctcggcggccgcttcggaataatg

SEQ ID NO: 422652 - DNA, 25 bp, Mus musculus
gagcgcagtgcggagcagcccacct

SEQ ID NO: 422653 - DNA, 25 bp, Mus musculus
cgcagtgcggagcagcccacctcca

SEQ ID NO: 422654 - DNA, 25 bp, Mus musculus
acgtcgctgctcatgtcggcctcgg

SEQ ID NO: 422655 - DNA, 25 bp, Mus musculus
ttcggaataatgactaggcttcttg

SEQ ID NO: 422656 - DNA, 25 bp, Mus musculus
tgctgcgaattttccagggcctcga

SEQ ID NO: 422657 - DNA, 25 bp, Mus musculus
gcgaattttccagggcctcgagcac

SEQ ID NO: 422658 - DNA, 25 bp, Mus musculus
caatttcggaggagacggtgctttc

SEQ ID NO: 422659 - DNA, 25 bp, Mus musculus
tttcggaggagacggtgctttcgct

SEQ ID NO: 422660 - DNA, 25 bp, Mus musculus
ctcgggtgctgcaggttgaacaaag

SEQ ID NO: 422661 - DNA, 25 bp, Mus musculus
tgctgcaggttgaacaaagtgtcta

SEQ ID NO: 422662 - DNA, 25 bp, Mus musculus
gcaggttgaacaaagtgtctatttc

SEQ ID NO: 422663 - DNA, 25 bp, Mus musculus
agtgtctatttcgaatttgcctttg

SEQ ID NO: 422664 - DNA, 25 bp, Mus musculus
cctttggcggggaggtctcccagag

SEQ ID NO: 422665 - DNA, 25 bp, Mus musculus
gcttcttgcggctctcggtagcgga

SEQ ID NO: 422666 - DNA, 25 bp, Mus musculus
gagccgggtgctgcgaattttccag

SEQ ID NO: 422667 - DNA, 25 bp, Mus musculus
tgactaggcttcttgcggctctcgg

SEQ ID NO: 422668 - DNA, 25 bp, Mus musculus
ctatttcgaatttgcctttggcggg

SEQ ID NO: 422669 - DNA, 25 bp, Mus musculus
tctcggtagcggaggcaatttcgga

SEQ ID NO: 422670 - DNA, 25 bp, Mus musculus
ggtgaaattgacagtctgattaata

SEQ ID NO: 422671 - DNA, 25 bp, Mus musculus
tcccagccagttctgctcgcccggg

SEQ ID NO: 422672 - DNA, 25 bp, Mus musculus
agccagttctgctcgcccgggggtt

SEQ ID NO: 422673 - DNA, 25 bp, Mus musculus
gcctcgggggtgaaattgacagtct

SEQ ID NO: 422674 - DNA, 25 bp, Mus musculus
ggggtgaaattgacagtctgattaa

SEQ ID NO: 422675 - DNA, 25 bp, Mus musculus
ttgacagtctgattaatagagcacg

SEQ ID NO: 422676 - DNA, 25 bp, Mus musculus
tgacagtctgattaatagagcacgc

SEQ ID NO: 422677 - DNA, 25 bp, Mus musculus
gacagtctgattaatagagcacgcc

SEQ ID NO: 422678 - DNA, 25 bp, Mus musculus
cagtctgattaatagagcacgccgc

SEQ ID NO: 422679 - DNA, 25 bp, Mus musculus
gtctgattaatagagcacgccgcgg

SEQ ID NO: 422680 - DNA, 25 bp, Mus musculus
ccgctcccagccagttctgctcgcc

SEQ ID NO: 422681 - DNA, 25 bp, Mus musculus
tctgattaatagagcacgccgcggc

SEQ ID NO: 422682 - DNA, 25 bp, Mus musculus
ctgattaatagagcacgccgcggcg

SEQ ID NO: 422683 - DNA, 25 bp, Mus musculus
agtctgattaatagagcacgccgcg

SEQ ID NO: 422684 - DNA, 25 bp, Mus musculus
gacgccgttcgaataatcatttatt

SEQ ID NO: 422685 - DNA, 25 bp, Mus musculus
agaaggctccggtcctttgcccgct

SEQ ID NO: 422686 - DNA, 25 bp, Mus musculus
tccaggtaggagacgagaagacacg

SEQ ID NO: 422687 - DNA, 25 bp, Mus musculus
agcagacaaatagatccaggtagga

SEQ ID NO: 422688 - DNA, 25 bp, Mus musculus
ggcgacttcagagcagacaaataga

SEQ ID NO: 422689 - DNA, 25 bp, Mus musculus
tcagtgggtaatgaaggcgacttca

SEQ ID NO: 422690 - DNA, 25 bp, Mus musculus
acacgctcctgtcagtgggtaatga

SEQ ID NO: 422691 - DNA, 25 bp, Mus musculus
aagcaaataaatacacgctcctgtc

SEQ ID NO: 422692 - DNA, 25 bp, Mus musculus
acgagaagacacgagaagtgaggaa

SEQ ID NO: 422693 - DNA, 25 bp, Mus musculus
catttattgtaacaggtttataagc

SEQ ID NO: 422694 - DNA, 25 bp, Mus musculus
attcatcaaaaagtagcgcccgctc

SEQ ID NO: 422695 - DNA, 25 bp, Mus musculus
cgagtcggagatgtcattcatcaaa

SEQ ID NO: 422696 - DNA, 25 bp, Mus musculus
tagcgcccgctcgtcattaaggtac

SEQ ID NO: 422697 - DNA, 25 bp, Mus musculus
cattaaggtacgaatgacgccgttc

SEQ ID NO: 422698 - DNA, 25 bp, Mus musculus
tcccgcgatgagctaacctgttgga

SEQ ID NO: 422699 - DNA, 25 bp, Mus musculus
tttttataaacgtcccgcgatgagc

SEQ ID NO: 422700 - DNA, 25 bp, Mus musculus
ggcggcagcatccagcttcgcttac

SEQ ID NO: 422701 - DNA, 25 bp, Mus musculus
gcttcgcttacccagggacctctga

SEQ ID NO: 422702 - DNA, 25 bp, Mus musculus
cacaggctcttcgtcgtcgtcgtca

SEQ ID NO: 422703 - DNA, 25 bp, Mus musculus
gtcatcctcggctgtgatcgccact

SEQ ID NO: 422704 - DNA, 25 bp, Mus musculus
ctcctgtggccaaagagtgtcccgc

SEQ ID NO: 422705 - DNA, 25 bp, Mus musculus
ctgggctatggctaccacttcggca

SEQ ID NO: 422706 - DNA, 25 bp, Mus musculus
ccacttcggcaacggttactacagc

SEQ ID NO: 422707 - DNA, 25 bp, Mus musculus
gttactacagctgccgcatgtcgca

SEQ ID NO: 422708 - DNA, 25 bp, Mus musculus
atgtcgcacggcgtaggcttacagc

SEQ ID NO: 422709 - DNA, 25 bp, Mus musculus
tacagcagaacgctctcaagtcgtc

SEQ ID NO: 422710 - DNA, 25 bp, Mus musculus
gcacgcttctctcggaggtttcccg

SEQ ID NO: 422711 - DNA, 25 bp, Mus musculus
tttcccggtggagaagtacatggac

SEQ ID NO: 422712 - DNA, 25 bp, Mus musculus
cccgaagaccaggtcaagttctata

SEQ ID NO: 422713 - DNA, 25 bp, Mus musculus
tacttgaccggctctgggccaattg

SEQ ID NO: 422714 - DNA, 25 bp, Mus musculus
gcttctctcagccttacttgaccgg

SEQ ID NO: 422715 - DNA, 25 bp, Mus musculus
tctgggccaattggcctgcagtctc

SEQ ID NO: 422716 - DNA, 25 bp, Mus musculus
ctgcagtctccaggcgccaaggacg

SEQ ID NO: 422717 - DNA, 25 bp, Mus musculus
caccaagtatgactacgcgggtgtg

SEQ ID NO: 422718 - DNA, 25 bp, Mus musculus
gcgccaaggacggacccgaagacca

SEQ ID NO: 422719 - DNA, 25 bp, Mus musculus
tctgcctttggaggcttctctcagc

SEQ ID NO: 422720 - DNA, 25 bp, Mus musculus
tcaagttctatacgcctgatgcgcc

SEQ ID NO: 422721 - DNA, 25 bp, Mus musculus
ctgatgcgcccaccgcatctgagga

SEQ ID NO: 422722 - DNA, 25 bp, Mus musculus
gcatctgaggaacgcagccggacta

SEQ ID NO: 422723 - DNA, 25 bp, Mus musculus
cccgagtctagtctggttcattcgg

SEQ ID NO: 422724 - DNA, 25 bp, Mus musculus
gtctggttcattcggctctcaaagg

SEQ ID NO: 422725 - DNA, 25 bp, Mus musculus
tcggctctcaaaggcaccaagtatg

SEQ ID NO: 422726 - DNA, 25 bp, Mus musculus
gccgtgagtgctcccagtgtttcaa

SEQ ID NO: 422727 - DNA, 25 bp, Mus musculus
ctaaagagcaaagcgggttgggtca

SEQ ID NO: 422728 - DNA, 25 bp, Mus musculus
agctatcgttctcggagctgctggc

SEQ ID NO: 422729 - DNA, 25 bp, Mus musculus
ttcatgggttttcggggtgatgacc

SEQ ID NO: 422730 - DNA, 25 bp, Mus musculus
ccagtgtttcaagtaggatcgaata

SEQ ID NO: 422731 - DNA, 25 bp, Mus musculus
caagtaggatcgaataagcaaggac

SEQ ID NO: 422732 - DNA, 25 bp, Mus musculus
gcaaggacaaggacacaacgctcgg

SEQ ID NO: 422733 - DNA, 25 bp, Mus musculus
cgcgctgcgcagaaagctatcgttc

SEQ ID NO: 422734 - DNA, 25 bp, Mus musculus
tcttcacggtaggttctctagcgga

SEQ ID NO: 422735 - DNA, 25 bp, Mus musculus
gcatcgcgtctacgcgctgcgcaga

SEQ ID NO: 422736 - DNA, 25 bp, Mus musculus
ttctctagcggaacgcgcgggtgca

SEQ ID NO: 422737 - DNA, 25 bp, Mus musculus
ccctatgtgctagcgcgctgctgca

SEQ ID NO: 422738 - DNA, 25 bp, Mus musculus
cacaacgctcgggtcttcacggtag

SEQ ID NO: 422739 - DNA, 25 bp, Mus musculus
ttcggggtgatgaccaaagcagaga

SEQ ID NO: 422740 - DNA, 25 bp, Mus musculus
catggcgtcacgtgacataattacc

SEQ ID NO: 422741 - DNA, 25 bp, Mus musculus
tctaacttctacagcgccgtgggtc

SEQ ID NO: 422742 - DNA, 25 bp, Mus musculus
cagacgtgctcttcaaggctcccga

SEQ ID NO: 422743 - DNA, 25 bp, Mus musculus
aggcggccatgcaacgagatctgct

SEQ ID NO: 422744 - DNA, 25 bp, Mus musculus
tggcctttcgcgactacggcctgga

SEQ ID NO: 422745 - DNA, 25 bp, Mus musculus
ggacttcgccagcaagccgtcgttc

SEQ ID NO: 422746 - DNA, 25 bp, Mus musculus
acgccgcgcagccatgaacgacttt

SEQ ID NO: 422747 - DNA, 25 bp, Mus musculus
gttggcgagcgctgatatagatata

SEQ ID NO: 422748 - DNA, 25 bp, Mus musculus
atgaattgcacgtcagcgcccggtg

SEQ ID NO: 422749 - DNA, 25 bp, Mus musculus
taaggacatttctctccatggcgtc

SEQ ID NO: 422750 - DNA, 25 bp, Mus musculus
tgaacgactttgacgagtgcggccc

SEQ ID NO: 422751 - DNA, 25 bp, Mus musculus
cccagggctttgatcagttctacga

SEQ ID NO: 422752 - DNA, 25 bp, Mus musculus
tttgcttagttgatcctggcccaag

SEQ ID NO: 422753 - DNA, 25 bp, Mus musculus
gcccaagcctcttgtgcaatcgatg

SEQ ID NO: 422754 - DNA, 25 bp, Mus musculus
gagttcaagaacacccgcaccaacg

SEQ ID NO: 422755 - DNA, 25 bp, Mus musculus
tcctcctaccgcaggatgttcggtg

SEQ ID NO: 422756 - DNA, 25 bp, Mus musculus
cgaagccatgtctaccaggtctgtg

SEQ ID NO: 422757 - DNA, 25 bp, Mus musculus
tgcagtttttccagccgcagcaagc

SEQ ID NO: 422758 - DNA, 25 bp, Mus musculus
cgccctcattcccttgttgcagttt

SEQ ID NO: 422759 - DNA, 25 bp, Mus musculus
tgcgagagaagtaaggcctgaccta

SEQ ID NO: 422760 - DNA, 25 bp, Mus musculus
acaacctggccgaggacatcatgcg

SEQ ID NO: 422761 - DNA, 25 bp, Mus musculus
gtggatcagctcaccaacgacaagg

SEQ ID NO: 422762 - DNA, 25 bp, Mus musculus
cctcgagcagcagaacaaaatcctg

SEQ ID NO: 422763 - DNA, 25 bp, Mus musculus
tggccgacgccatcaacactgagtt

SEQ ID NO: 422764 - DNA, 25 bp, Mus musculus
tgcttcaagactcggtggacttctc

SEQ ID NO: 422765 - DNA, 25 bp, Mus musculus
ccaaccggagctatgtgaccacgtc

SEQ ID NO: 422766 - DNA, 25 bp, Mus musculus
ctgcaggagctgaatgaccgctttg

SEQ ID NO: 422767 - DNA, 25 bp, Mus musculus
cgacaaggtgcgcttcctcgagcag

SEQ ID NO: 422768 - DNA, 25 bp, Mus musculus
atcaaggcagggtcagacgtcagcc

SEQ ID NO: 422769 - DNA, 25 bp, Mus musculus
tgccacgtgcgtgagcggatcttga

SEQ ID NO: 422770 - DNA, 25 bp, Mus musculus
cgctccttgtgccacgtgcgtgagc

SEQ ID NO: 422771 - DNA, 25 bp, Mus musculus
tgcagccggtacagccgctccttgt

SEQ ID NO: 422772 - DNA, 25 bp, Mus musculus
gcgccgctgaaaccacacgctcagg

SEQ ID NO: 422773 - DNA, 25 bp, Mus musculus
tgacccacacccacatatgtgctta

SEQ ID NO: 422774 - DNA, 25 bp, Mus musculus
ctgcacgaagactgtgatcaaggca

SEQ ID NO: 422775 - DNA, 25 bp, Mus musculus
gcctcgatgtgctgcacgaagactg

SEQ ID NO: 422776 - DNA, 25 bp, Mus musculus
tcccggacagcctcgatgtgctgca

SEQ ID NO: 422777 - DNA, 25 bp, Mus musculus
gcaggccctccgactgatgaccctc

SEQ ID NO: 422778 - DNA, 25 bp, Mus musculus
gtccaggttcttgcggcggcccttg

SEQ ID NO: 422779 - DNA, 25 bp, Mus musculus
gcgctgccaggtccaggttcttgcg

SEQ ID NO: 422780 - DNA, 25 bp, Mus musculus
gctggctcatggcatccaggcgcgc

SEQ ID NO: 422781 - DNA, 25 bp, Mus musculus
cacacccacatatgtgcttagaagc

SEQ ID NO: 422782 - DNA, 25 bp, Mus musculus
ttgcttctgtaaaacgacctttctc

SEQ ID NO: 422783 - DNA, 25 bp, Mus musculus
catcgaccgcgcatctggctgtgcg

SEQ ID NO: 422784 - DNA, 25 bp, Mus musculus
cttcggtttcagtctaattgggtga

SEQ ID NO: 422785 - DNA, 25 bp, Mus musculus
gatgcccggctctgtctgtcttgct

SEQ ID NO: 422786 - DNA, 25 bp, Mus musculus
ttctcagggcctaacttcggtttca

SEQ ID NO: 422787 - DNA, 25 bp, Mus musculus
tctgtaaaacgacctttctcagggc

SEQ ID NO: 422788 - DNA, 25 bp, Mus musculus
tgcgcggtccacagtgtcattcctc

SEQ ID NO: 422789 - DNA, 25 bp, Mus musculus
tgccggttggctttgcttctgtaaa

SEQ ID NO: 422790 - DNA, 25 bp, Mus musculus
tgtctgtcttgctgccgtgccggtt

SEQ ID NO: 422791 - DNA, 25 bp, Mus musculus
gtttcagtctaattgggtgagaccc

SEQ ID NO: 422792 - DNA, 25 bp, Mus musculus
ccaaatgtcgttgtgttcctttgta

SEQ ID NO: 422793 - DNA, 25 bp, Mus musculus
gtgttcctttgtaggcagcttcatc

SEQ ID NO: 422794 - DNA, 25 bp, Mus musculus
tttgtaggcagcttcatcgaccgcg

SEQ ID NO: 422795 - DNA, 25 bp, Mus musculus
ggcagcttcatcgaccgcgcatctg

SEQ ID NO: 422796 - DNA, 25 bp, Mus musculus
tcaagcctttccttccgctggcggg

SEQ ID NO: 422797 - DNA, 25 bp, Mus musculus
ttgtccgtgcttacgcggccagccg

SEQ ID NO: 422798 - DNA, 25 bp, Mus musculus
agatgtcgctgttgtccgtgcttac

SEQ ID NO: 422799 - DNA, 25 bp, Mus musculus
cgcttagtagatgtcgctgttgtcc

SEQ ID NO: 422800 - DNA, 25 bp, Mus musculus
cgcgcactatcacaggcgcttagta

SEQ ID NO: 422801 - DNA, 25 bp, Mus musculus
cggttgtctccaacgcgcactatca

SEQ ID NO: 422802 - DNA, 25 bp, Mus musculus
agctctgggccggttgtctccaacg

SEQ ID NO: 422803 - DNA, 25 bp, Mus musculus
tcgaatcaagcctttccttccgctg

SEQ ID NO: 422804 - DNA, 25 bp, Mus musculus
tcagtacgcgtgtcctcccggaggc

SEQ ID NO: 422805 - DNA, 25 bp, Mus musculus
gctctgactttcctcagtacgcgtg

SEQ ID NO: 422806 - DNA, 25 bp, Mus musculus
gcaggcgccacagcgctctgacttt

SEQ ID NO: 422807 - DNA, 25 bp, Mus musculus
agcgcttctgtgagcaggcgccaca

SEQ ID NO: 422808 - DNA, 25 bp, Mus musculus
aaccggccctcttgggcgcgttctg

SEQ ID NO: 422809 - DNA, 25 bp, Mus musculus
tcttgggcgcgttctgcctgggtat

SEQ ID NO: 422810 - DNA, 25 bp, Mus musculus
aggaaagcaaaggtcggtatgaaca

SEQ ID NO: 422811 - DNA, 25 bp, Mus musculus
tcggctgcccagctgcagatggaaa

SEQ ID NO: 422812 - DNA, 25 bp, Mus musculus
ctgcagatggaaaagaagatgaacg

SEQ ID NO: 422813 - DNA, 25 bp, Mus musculus
aagaagatgaacgaaagcgcgagcg

SEQ ID NO: 422814 - DNA, 25 bp, Mus musculus
ggagcccactaaagtctcccaagtg

SEQ ID NO: 422815 - DNA, 25 bp, Mus musculus
ctaaagtctcccaagtggagagccc

SEQ ID NO: 422816 - DNA, 25 bp, Mus musculus
gccaaaggcggccttccagaagaca

SEQ ID NO: 422817 - DNA, 25 bp, Mus musculus
cccgaagtgcaggagaaggaaagca

SEQ ID NO: 422818 - DNA, 25 bp, Mus musculus
ctggctgaggtttccgtgtccagtc

SEQ ID NO: 422819 - DNA, 25 bp, Mus musculus
gtcggtatgaacagagttgccaccc

SEQ ID NO: 422820 - DNA, 25 bp, Mus musculus
gcgtgcagtccggtaaaacctcgaa

SEQ ID NO: 422821 - DNA, 25 bp, Mus musculus
acctcgaaaagggagcgctcgggtg

SEQ ID NO: 422822 - DNA, 25 bp, Mus musculus
ttccgtgtccagtcccgaagtgcag

SEQ ID NO: 422823 - DNA, 25 bp, Mus musculus
tgtccagtcccgaagtgcaggagaa

SEQ ID NO: 422824 - DNA, 25 bp, Mus musculus
cgggcgccactacgggattaagcct

SEQ ID NO: 422825 - DNA, 25 bp, Mus musculus
agcgagcggcgcctcaccatgtcgt

SEQ ID NO: 422826 - DNA, 25 bp, Mus musculus
tcctccaaaaggactgagtgctccg

SEQ ID NO: 422827 - DNA, 25 bp, Mus musculus
ggcggcccagaattcccgtgcaact

SEQ ID NO: 422828 - DNA, 25 bp, Mus musculus
tgcaactcgttcctgcgggacaagg

SEQ ID NO: 422829 - DNA, 25 bp, Mus musculus
gctgcagcctgcgaactagtcggcg

SEQ ID NO: 422830 - DNA, 25 bp, Mus musculus
gtggcaccctcagcaactactacgt

SEQ ID NO: 422831 - DNA, 25 bp, Mus musculus
gtggactcgctcataggccatgagg

SEQ ID NO: 422832 - DNA, 25 bp, Mus musculus
gccgagttcgcctcgtgtagttttg

SEQ ID NO: 422833 - DNA, 25 bp, Mus musculus
aaatcgtccgtgttctccgcctcgt

SEQ ID NO: 422834 - DNA, 25 bp, Mus musculus
agcggcctgtaccacccgtacgtgt

SEQ ID NO: 422835 - DNA, 25 bp, Mus musculus
acgctacgtacgctcctggatggag

SEQ ID NO: 422836 - DNA, 25 bp, Mus musculus
gattaagcctgaaaccggagcggcc

SEQ ID NO: 422837 - DNA, 25 bp, Mus musculus
gtccgagccctcagcttgcagcgat

SEQ ID NO: 422838 - DNA, 25 bp, Mus musculus
tctatggcaacagcgccgccggctt

SEQ ID NO: 422839 - DNA, 25 bp, Mus musculus
cccgatgagctcgtacttcgtgaac

SEQ ID NO: 422840 - DNA, 25 bp, Mus musculus
gctcgtacttcgtgaacccgctgta

SEQ ID NO: 422841 - DNA, 25 bp, Mus musculus
tcgtgaacccgctgtactccaagta

SEQ ID NO: 422842 - DNA, 25 bp, Mus musculus
cgggcgaggccatcaatcccactta

SEQ ID NO: 422843 - DNA, 25 bp, Mus musculus
tcaatcccacttactacgactgtca

SEQ ID NO: 422844 - DNA, 25 bp, Mus musculus
tacgactgtcattttgcacccgagg

SEQ ID NO: 422845 - DNA, 25 bp, Mus musculus
actgtcattttgcacccgaggtcag

SEQ ID NO: 422846 - DNA, 25 bp, Mus musculus
aggactacttccacgccggcgcggg

SEQ ID NO: 422847 - DNA, 25 bp, Mus musculus
cttttcgtctccctgcagagcgggg

SEQ ID NO: 422848 - DNA, 25 bp, Mus musculus
gtgtgttctcttttcgtctccctgc

SEQ ID NO: 422849 - DNA, 25 bp, Mus musculus
accgggcagagggtgtgttctcttt

SEQ ID NO: 422850 - DNA, 25 bp, Mus musculus
cgcgaaaatgcctcgccggcgcgca

SEQ ID NO: 422851 - DNA, 25 bp, Mus musculus
tactccaagtacaaggcggcggccg

SEQ ID NO: 422852 - DNA, 25 bp, Mus musculus
tttgtctctgcagaggtgggctcta

SEQ ID NO: 422853 - DNA, 25 bp, Mus musculus
caaacctgccgaggatggtgagcgc

SEQ ID NO: 422854 - DNA, 25 bp, Mus musculus
accgcctcgggcaatgggtgccact

SEQ ID NO: 422855 - DNA, 25 bp, Mus musculus
ctccgggtaagagccaccctgctgg

SEQ ID NO: 422856 - DNA, 25 bp, Mus musculus
cgcagttcggcaccctccgggtaag

SEQ ID NO: 422857 - DNA, 25 bp, Mus musculus
ggattccagccacagtccgggccga

SEQ ID NO: 422858 - DNA, 25 bp, Mus musculus
cagcgccggatggattccagccaca

SEQ ID NO: 422859 - DNA, 25 bp, Mus musculus
gtcgtcattggctgcggctggtcat

SEQ ID NO: 422860 - DNA, 25 bp, Mus musculus
cgattgcggccgcttccagagccgg

SEQ ID NO: 422861 - DNA, 25 bp, Mus musculus
ttcctgatttcccaggcgaatttgc

SEQ ID NO: 422862 - DNA, 25 bp, Mus musculus
cgccttcacggcctttttcctgatt

SEQ ID NO: 422863 - DNA, 25 bp, Mus musculus
tggtcatgtgcaggcgccgctcgcc

SEQ ID NO: 422864 - DNA, 25 bp, Mus musculus
gcaacatgagcccaaacctgccgag

SEQ ID NO: 422865 - DNA, 25 bp, Mus musculus
gcagggagccgaccgcctgcttcaa

SEQ ID NO: 422866 - DNA, 25 bp, Mus musculus
cgctgcccgcgaggggtcacggaca

SEQ ID NO: 422867 - DNA, 25 bp, Mus musculus
ggtgcacagggcgccgacttccagc

SEQ ID NO: 422868 - DNA, 25 bp, Mus musculus
tacccacggcccgacttcggcgagc

SEQ ID NO: 422869 - DNA, 25 bp, Mus musculus
gacttcggcgagcaacccttcggag

SEQ ID NO: 422870 - DNA, 25 bp, Mus musculus
atatttgcagggtggctacctaggc

SEQ ID NO: 422871 - DNA, 25 bp, Mus musculus
agccgagcggcccgggaagtcatta

SEQ ID NO: 422872 - DNA, 25 bp, Mus musculus
gaagtcattacggtgccccgggaga

SEQ ID NO: 422873 - DNA, 25 bp, Mus musculus
cgaggaatatttgcagggtggctac

SEQ ID NO: 422874 - DNA, 25 bp, Mus musculus
agccgactactacggcagcggtgca

SEQ ID NO: 422875 - DNA, 25 bp, Mus musculus
ctacctaggcgagcagggagccgac

SEQ ID NO: 422876 - DNA, 25 bp, Mus musculus
aggcgagcagggagccgactactac

SEQ ID NO: 422877 - DNA, 25 bp, Mus musculus
actactacggcagcggtgcacaggg

SEQ ID NO: 422878 - DNA, 25 bp, Mus musculus
gagcagggagccgactactacggca

SEQ ID NO: 422879 - DNA, 25 bp, Mus musculus
ttcggcgagcaacccttcggaggcg

SEQ ID NO: 422880 - DNA, 25 bp, Mus musculus
ggcgaaataattaattcagcacgtc

SEQ ID NO: 422881 - DNA, 25 bp, Mus musculus
ggaccctcggcagacggcgccatgt

SEQ ID NO: 422882 - DNA, 25 bp, Mus musculus
acggcgccatgttggggagccctcc

SEQ ID NO: 422883 - DNA, 25 bp, Mus musculus
gagggccgctcataaccggagaatt

SEQ ID NO: 422884 - DNA, 25 bp, Mus musculus
ccggagaattttcaaagtgcgagga

SEQ ID NO: 422885 - DNA, 25 bp, Mus musculus
gtgcgaggaagatgataagaataga

SEQ ID NO: 422886 - DNA, 25 bp, Mus musculus
tcagcacgtcccttaagaaacacgg

SEQ ID NO: 422887 - DNA, 25 bp, Mus musculus
acacggagtcgtcattaatctgcca

SEQ ID NO: 422888 - DNA, 25 bp, Mus musculus
taatctgccacgcaaagggctctct

SEQ ID NO: 422889 - DNA, 25 bp, Mus musculus
gcaaagggctctctccgacttggaa

SEQ ID NO: 422890 - DNA, 25 bp, Mus musculus
ctccgacttggaaagtgcagggatc

SEQ ID NO: 422891 - DNA, 25 bp, Mus musculus
tgcagggatcccgagaacacggccc

SEQ ID NO: 422892 - DNA, 25 bp, Mus musculus
cgcgaccacgtgattggcgaaataa

SEQ ID NO: 422893 - DNA, 25 bp, Mus musculus
tagatttctacaagtcgcgaccacg

SEQ ID NO: 422894 - DNA, 25 bp, Mus musculus
ttggactgccgagcacagctgctac

SEQ ID NO: 422895 - DNA, 25 bp, Mus musculus
ctggcgccggccactttatataatc

SEQ ID NO: 422896 - DNA, 25 bp, Mus musculus
tgcgatcctctctttccaacttgga

SEQ ID NO: 422897 - DNA, 25 bp, Mus musculus
ttcttttgccgtgctgcctcctacg

SEQ ID NO: 422898 - DNA, 25 bp, Mus musculus
gattcttttgccgtgctgcctccta

SEQ ID NO: 422899 - DNA, 25 bp, Mus musculus
agtaggggattcttttgccgtgctg

SEQ ID NO: 422900 - DNA, 25 bp, Mus musculus
ggcgccggccactttatataatccc

SEQ ID NO: 422901 - DNA, 25 bp, Mus musculus
ctgctactaggccaggctggcgccg

SEQ ID NO: 422902 - DNA, 25 bp, Mus musculus
agcacagctgctactaggccaggct

SEQ ID NO: 422903 - DNA, 25 bp, Mus musculus
tttccaacttggactgccgagcaca

SEQ ID NO: 422904 - DNA, 25 bp, Mus musculus
gggcttgcgatcctctctttccaac

SEQ ID NO: 422905 - DNA, 25 bp, Mus musculus
cctagagtccgagaccaggcgggca

SEQ ID NO: 422906 - DNA, 25 bp, Mus musculus
gagcctcctagagtccgagaccagg

SEQ ID NO: 422907 - DNA, 25 bp, Mus musculus
cagctcgcacgcagggtgtgtaaac

SEQ ID NO: 422908 - DNA, 25 bp, Mus musculus
agcccaatatgtacggcctggccgc

SEQ ID NO: 422909 - DNA, 25 bp, Mus musculus
ggctaagggcatcctgcattctcca

SEQ ID NO: 422910 - DNA, 25 bp, Mus musculus
atgcctcacgagtggcttccagcgg

SEQ ID NO: 422911 - DNA, 25 bp, Mus musculus
agcgcagcccacctcttggaggagc

SEQ ID NO: 422912 - DNA, 25 bp, Mus musculus
gctttcgccaaatcgcagcccaata

SEQ ID NO: 422913 - DNA, 25 bp, Mus musculus
cacggcgtacacgagtgctcagctg

SEQ ID NO: 422914 - DNA, 25 bp, Mus musculus
tgcctcagcagaagcggtacccggc

SEQ ID NO: 422915 - DNA, 25 bp, Mus musculus
ggcggcaacttcgtcgactccatgg

SEQ ID NO: 422916 - DNA, 25 bp, Mus musculus
ccgggccggtcttcaatctgggcca

SEQ ID NO: 422917 - DNA, 25 bp, Mus musculus
tcttcggccagcgtggactacagtt

SEQ ID NO: 422918 - DNA, 25 bp, Mus musculus
gttgcgccgcgcaaatccctggcaa

SEQ ID NO: 422919 - DNA, 25 bp, Mus musculus
acacatctgtagctgttgccgccgg

SEQ ID NO: 422920 - DNA, 25 bp, Mus musculus
aggcgcaattacctctctggttttg

SEQ ID NO: 422921 - DNA, 25 bp, Mus musculus
gtcctcctttgggtgactcgccata

SEQ ID NO: 422922 - DNA, 25 bp, Mus musculus
agcccaggccttttggtgctgctgt

SEQ ID NO: 422923 - DNA, 25 bp, Mus musculus
cggacccatccttgtgtgtcactga

SEQ ID NO: 422924 - DNA, 25 bp, Mus musculus
gacccatcttcttcagtgcccgtag

SEQ ID NO: 422925 - DNA, 25 bp, Mus musculus
ctgcgcgccctggtgtctacgcgtt

SEQ ID NO: 422926 - DNA, 25 bp, Mus musculus
ctaagaaacttagcggcgccctagg

SEQ ID NO: 422927 - DNA, 25 bp, Mus musculus
agccaccgcacagcatggtctcgaa

SEQ ID NO: 422928 - DNA, 25 bp, Mus musculus
cgcggtccggagctaagaaacttag

SEQ ID NO: 422929 - DNA, 25 bp, Mus musculus
gagaaccgggcaacgggaacacagc

SEQ ID NO: 422930 - DNA, 25 bp, Mus musculus
gatctgtgcgtgagaaccgggcaac

SEQ ID NO: 422931 - DNA, 25 bp, Mus musculus
cacagcatggtctcgaagggcccag

SEQ ID NO: 422932 - DNA, 25 bp, Mus musculus
gctccgtccaggttgtccctagaga

SEQ ID NO: 422933 - DNA, 25 bp, Mus musculus
ggcgagcggcgactccttttccagc

SEQ ID NO: 422934 - DNA, 25 bp, Mus musculus
ttcagtgcccgtagcccaggccttt

SEQ ID NO: 422935 - DNA, 25 bp, Mus musculus
tgtccctagagacagtgcgcgccca

SEQ ID NO: 422936 - DNA, 25 bp, Mus musculus
gtatctcgaaccctgtgctggcgca

SEQ ID NO: 422937 - DNA, 25 bp, Mus musculus
cgcctttcatcagaacggttagcca

SEQ ID NO: 422938 - DNA, 25 bp, Mus musculus
gcggtgcatcagtccaactgctctg

SEQ ID NO: 422939 - DNA, 25 bp, Mus musculus
tgagcgccgttcatcagagccaatg

SEQ ID NO: 422940 - DNA, 25 bp, Mus musculus
cccggaagagggtcattagctcctc

SEQ ID NO: 422941 - DNA, 25 bp, Mus musculus
gtaaacgccggtctgctcaagctca

SEQ ID NO: 422942 - DNA, 25 bp, Mus musculus
aactgctctggtgaccttttgcgcc

SEQ ID NO: 422943 - DNA, 25 bp, Mus musculus
gtcgcagccaatcaacataaggatg

SEQ ID NO: 422944 - DNA, 25 bp, Mus musculus
tcaggcactgcggagacttcacgtt

SEQ ID NO: 422945 - DNA, 25 bp, Mus musculus
cggcagctcaacgaaggacccttca

SEQ ID NO: 422946 - DNA, 25 bp, Mus musculus
cagcttcccaggctcaccttgtaga

SEQ ID NO: 422947 - DNA, 25 bp, Mus musculus
tgccacttgcttgcacgcacggttc

SEQ ID NO: 422948 - DNA, 25 bp, Mus musculus
tttgcgccgggttttgtatctcgaa

SEQ ID NO: 422949 - DNA, 25 bp, Mus musculus
ccgatgacccggagcccagaaaaca

SEQ ID NO: 422950 - DNA, 25 bp, Mus musculus
tcggctgggcaccagagcatacgca

SEQ ID NO: 422951 - DNA, 25 bp, Mus musculus
cctaccctcaaggagctgcttagtc

SEQ ID NO: 422952 - DNA, 25 bp, Mus musculus
agtcaaaagtctaaagtggtcagtc

SEQ ID NO: 422953 - DNA, 25 bp, Mus musculus
aagctcgtcgcttgtcctcccggag

SEQ ID NO: 422954 - DNA, 25 bp, Mus musculus
ggaagcaacacccagagcacagcgt

SEQ ID NO: 422955 - DNA, 25 bp, Mus musculus
tcaaaccaagacatccggccaagcg

SEQ ID NO: 422956 - DNA, 25 bp, Mus musculus
ccagagcatacgcaggaggagcagc

SEQ ID NO: 422957 - DNA, 25 bp, Mus musculus
agcagcagcatcaggctgcctatga

SEQ ID NO: 422958 - DNA, 25 bp, Mus musculus
gcctatgagggcgaacagcgtgccc

SEQ ID NO: 422959 - DNA, 25 bp, Mus musculus
gatctcatcctgagccacgggcgtc

SEQ ID NO: 422960 - DNA, 25 bp, Mus musculus
ttcgggctcgctcgcttcttccaag

SEQ ID NO: 422961 - DNA, 25 bp, Mus musculus
ggacagctagcggatgacgattctc

SEQ ID NO: 422962 - DNA, 25 bp, Mus musculus
gacgattctccaagctcgtcgcttg

SEQ ID NO: 422963 - DNA, 25 bp, Mus musculus
agtggtcagtcacccggatctttcc

SEQ ID NO: 422964 - DNA, 25 bp, Mus musculus
ggcacactcactcctagcgtgggtg

SEQ ID NO: 422965 - DNA, 25 bp, Mus musculus
gcgagtcacgtgacaggcacactca

SEQ ID NO: 422966 - DNA, 25 bp, Mus musculus
cgagttctgggagggcacactccca

SEQ ID NO: 422967 - DNA, 25 bp, Mus musculus
atagcagctctatccaccgaggcgc

SEQ ID NO: 422968 - DNA, 25 bp, Mus musculus
aacgctctccgaagggtccaagtgc

SEQ ID NO: 422969 - DNA, 25 bp, Mus musculus
cccgggaaggtcacaatagcagctc

SEQ ID NO: 422970 - DNA, 25 bp, Mus musculus
gggcagtacacactccgctgggttc

SEQ ID NO: 422971 - DNA, 25 bp, Mus musculus
ctgcactcgaggcttgcacacagtc

SEQ ID NO: 422972 - DNA, 25 bp, Mus musculus
gcccgaggttgcaagcctttattta

SEQ ID NO: 422973 - DNA, 25 bp, Mus musculus
tgggcccgcggcacaaccatttaaa

SEQ ID NO: 422974 - DNA, 25 bp, Mus musculus
gccgccttggccttcgccataaatt

SEQ ID NO: 422975 - DNA, 25 bp, Mus musculus
tccgctcctcttgagcctgcaatta

SEQ ID NO: 422976 - DNA, 25 bp, Mus musculus
cctgcaattagtgttaggaagcacc

SEQ ID NO: 422977 - DNA, 25 bp, Mus musculus
ttcgccataaattccgctcctcttg

SEQ ID NO: 422978 - DNA, 25 bp, Mus musculus
gagttaatcaccctaccggctggcg

SEQ ID NO: 422979 - DNA, 25 bp, Mus musculus
aggttagtcctattaagagttcatc

SEQ ID NO: 422980 - DNA, 25 bp, Mus musculus
agagttcatcaatcacccggtgtgc

SEQ ID NO: 422981 - DNA, 25 bp, Mus musculus
cggtgtgcacttttcgctcgacagc

SEQ ID NO: 422982 - DNA, 25 bp, Mus musculus
cgacagcggttcctcctactttaga

SEQ ID NO: 422983 - DNA, 25 bp, Mus musculus
ctttagagcaagtctgggccagctg

SEQ ID NO: 422984 - DNA, 25 bp, Mus musculus
ggccagctgggagccgaccagaaac

SEQ ID NO: 422985 - DNA, 25 bp, Mus musculus
gccgaccagaaaccgcaagcgaagg

SEQ ID NO: 422986 - DNA, 25 bp, Mus musculus
cgctcggcacaaagccggcttggtc

SEQ ID NO: 422987 - DNA, 25 bp, Mus musculus
gctgcccaggatagcgctccaggca

SEQ ID NO: 422988 - DNA, 25 bp, Mus musculus
gcgtccacctggaactcttcgagaa

SEQ ID NO: 422989 - DNA, 25 bp, Mus musculus
tggaactcttcgagaaagacaaacg

SEQ ID NO: 422990 - DNA, 25 bp, Mus musculus
tcggtggacatctctgtgcggcacc

SEQ ID NO: 422991 - DNA, 25 bp, Mus musculus
gggcgacacacagtcctgcggctgc

SEQ ID NO: 422992 - DNA, 25 bp, Mus musculus
tggaaccgcactccagtcgggaccg

SEQ ID NO: 422993 - DNA, 25 bp, Mus musculus
gccgccggtatatgaagccactatt

SEQ ID NO: 422994 - DNA, 25 bp, Mus musculus
agccactatttacctcgggctcgct

SEQ ID NO: 422995 - DNA, 25 bp, Mus musculus
tgcggagcgagccatgagctcttac

SEQ ID NO: 422996 - DNA, 25 bp, Mus musculus
tcttacctggagtacgtgtcgtgcg

SEQ ID NO: 422997 - DNA, 25 bp, Mus musculus
acgtgctcggcttcgcacccaagtt

SEQ ID NO: 422998 - DNA, 25 bp, Mus musculus
tgcaccctggaaggcgcctacgagc

SEQ ID NO: 422999 - DNA, 25 bp, Mus musculus
cgcccacagcactttcgagtggatg

SEQ ID NO: 423000 - DNA, 25 bp, Mus musculus
cggcgtttgacttcccgggcgcact

SEQ ID NO: 423001 - DNA, 25 bp, Mus musculus
ggggatcattcctgctcagcggcca

SEQ ID NO: 423002 - DNA, 25 bp, Mus musculus
gacttcgctgcctttggcgagcctg

SEQ ID NO: 423003 - DNA, 25 bp, Mus musculus
cgcgtgtctcaaggagcccgcagac

SEQ ID NO: 423004 - DNA, 25 bp, Mus musculus
agccactttggctaagttggcagca

SEQ ID NO: 423005 - DNA, 25 bp, Mus musculus
cctctgccgccgagtatggcttctt

SEQ ID NO: 423006 - DNA, 25 bp, Mus musculus
gccaaggtcaccctgcagggacaga

SEQ ID NO: 423007 - DNA, 25 bp, Mus musculus
cgttgtcagcgacgccggaagtgct

SEQ ID NO: 423008 - DNA, 25 bp, Mus musculus
agggacagagtcctgacctcactcc

SEQ ID NO: 423009 - DNA, 25 bp, Mus musculus
aactgaggacacatggccaaggtca

SEQ ID NO: 423010 - DNA, 25 bp, Mus musculus
aggcttggcctcactttctggatga

SEQ ID NO: 423011 - DNA, 25 bp, Mus musculus
gtcgagggtgctgagtctacagccc

SEQ ID NO: 423012 - DNA, 25 bp, Mus musculus
ctggagtttccctgtagccgtgggt

SEQ ID NO: 423013 - DNA, 25 bp, Mus musculus
ggaagcgttcgtctcccagatcgca

SEQ ID NO: 423014 - DNA, 25 bp, Mus musculus
ccgacatgtctctggtggcggaagc

SEQ ID NO: 423015 - DNA, 25 bp, Mus musculus
gcaggacctcgcagccgacatgtct

SEQ ID NO: 423016 - DNA, 25 bp, Mus musculus
ttggcccagcgaagctcgtcagctg

SEQ ID NO: 423017 - DNA, 25 bp, Mus musculus
ctcgtcttagcgttggcccagcgaa

SEQ ID NO: 423018 - DNA, 25 bp, Mus musculus
ccgaggtgagctctgctcgtcttag

SEQ ID NO: 423019 - DNA, 25 bp, Mus musculus
ctcccagatcgcaggtagcccgtgt

SEQ ID NO: 423020 - DNA, 25 bp, Mus musculus
cttccgatttggagaaaatgtcaca

SEQ ID NO: 423021 - DNA, 25 bp, Mus musculus
ggcagcgacccagagccagacgatt

SEQ ID NO: 423022 - DNA, 25 bp, Mus musculus
gggtcactctgatctcccggggcag

SEQ ID NO: 423023 - DNA, 25 bp, Mus musculus
tcgttctggagctgatgcacttgtc

SEQ ID NO: 423024 - DNA, 25 bp, Mus musculus
ctaagacgagctggacatcggcctc

SEQ ID NO: 423025 - DNA, 25 bp, Mus musculus
tcgtgtcatcttcggccttactttg

SEQ ID NO: 423026 - DNA, 25 bp, Mus musculus
ttagcatcacagtggacaacgtctc

SEQ ID NO: 423027 - DNA, 25 bp, Mus musculus
accctgctggagattcccggtctca

SEQ ID NO: 423028 - DNA, 25 bp, Mus musculus
gcggcaaagctcgacctacacttca

SEQ ID NO: 423029 - DNA, 25 bp, Mus musculus
gggagaccctcgcactgtaaatatg

SEQ ID NO: 423030 - DNA, 25 bp, Mus musculus
gtccatacctgtcccgggtggaatg

SEQ ID NO: 423031 - DNA, 25 bp, Mus musculus
ccacatccaggctcttgatccgaaa

SEQ ID NO: 423032 - DNA, 25 bp, Mus musculus
ttggcccaacaagacgagacgacag

SEQ ID NO: 423033 - DNA, 25 bp, Mus musculus
ctcagcgatgggctcagaggagact

SEQ ID NO: 423034 - DNA, 25 bp, Mus musculus
tcggtcccatattgaactcgagttg

SEQ ID NO: 423035 - DNA, 25 bp, Mus musculus
gatcgtcccgcgctttgcgctgagg

SEQ ID NO: 423036 - DNA, 25 bp, Mus musculus
cgcgttacgaaatggcgcagtggcc

SEQ ID NO: 423037 - DNA, 25 bp, Mus musculus
gccaacgcggtggaccagtcgcgct

SEQ ID NO: 423038 - DNA, 25 bp, Mus musculus
ctgcgcggcctgacttagcgaggcc

SEQ ID NO: 423039 - DNA, 25 bp, Mus musculus
agcgtgactttccatttggctctgg

SEQ ID NO: 423040 - DNA, 25 bp, Mus musculus
gaggcgagtccggtctcaaaatgga

SEQ ID NO: 423041 - DNA, 25 bp, Mus musculus
cgcggatagcacatcacgtggtgac

SEQ ID NO: 423042 - DNA, 25 bp, Mus musculus
ctgccgctgacgtaagcgtcgctgc

SEQ ID NO: 423043 - DNA, 25 bp, Mus musculus
tctcgccattggtcgagctgccgct

SEQ ID NO: 423044 - DNA, 25 bp, Mus musculus
gtcacgcggctttctcccgacgtgg

SEQ ID NO: 423045 - DNA, 25 bp, Mus musculus
ttctctaagctgacgcgcggtcacg

SEQ ID NO: 423046 - DNA, 25 bp, Mus musculus
ttggctctggaatggaggtgaactc

SEQ ID NO: 423047 - DNA, 25 bp, Mus musculus
cggcggccgcattgacattgatccg

SEQ ID NO: 423048 - DNA, 25 bp, Mus musculus
tacagaccagctctcgggctgaggc

SEQ ID NO: 423049 - DNA, 25 bp, Mus musculus
ggcacatttttaccggcaccgaatc

SEQ ID NO: 423050 - DNA, 25 bp, Mus musculus
ggcaccgaatcagggaaactacgct

SEQ ID NO: 423051 - DNA, 25 bp, Mus musculus
ggcgccggtttagaccgccagcatc

SEQ ID NO: 423052 - DNA, 25 bp, Mus musculus
tcgtagtcctggctcagactgtccc

SEQ ID NO: 423053 - DNA, 25 bp, Mus musculus
agctcctgccggcttcttggcacag

SEQ ID NO: 423054 - DNA, 25 bp, Mus musculus
ggcggtggcaactccaagtccatca

SEQ ID NO: 423055 - DNA, 25 bp, Mus musculus
ccaagtccatcatgctgagggcgga

SEQ ID NO: 423056 - DNA, 25 bp, Mus musculus
ccgagcagcggagaactaggagata

SEQ ID NO: 423057 - DNA, 25 bp, Mus musculus
gggcttttctggatcaagacggaca

SEQ ID NO: 423058 - DNA, 25 bp, Mus musculus
gggcaagagcttggaatcgcgtaca

SEQ ID NO: 423059 - DNA, 25 bp, Mus musculus
cggacaggcgtgatcttacagacca

SEQ ID NO: 423060 - DNA, 25 bp, Mus musculus
agatagcctgctcgctggagtggca

SEQ ID NO: 423061 - DNA, 25 bp, Mus musculus
cggccgagctcaccaagtcgtagaa

SEQ ID NO: 423062 - DNA, 25 bp, Mus musculus
actgccgggatgcgccgcagcgaat

SEQ ID NO: 423063 - DNA, 25 bp, Mus musculus
cgccgctactcctgccgcaccagag

SEQ ID NO: 423064 - DNA, 25 bp, Mus musculus
caatgagtgcaaagcgcggagagcc

SEQ ID NO: 423065 - DNA, 25 bp, Mus musculus
cccaagaagcggtgagtagcggccc

SEQ ID NO: 423066 - DNA, 25 bp, Mus musculus
tccgagtaccaatgagtgcaaagcg

SEQ ID NO: 423067 - DNA, 25 bp, Mus musculus
ttctgtcgggccatctgctgggccg

SEQ ID NO: 423068 - DNA, 25 bp, Mus musculus
ccaggaggctccgagtaccaatgag

SEQ ID NO: 423069 - DNA, 25 bp, Mus musculus
cggggacagagcccgttgaagctcc

SEQ ID NO: 423070 - DNA, 25 bp, Mus musculus
ccgcaccagagtcgggcaccatccc

SEQ ID NO: 423071 - DNA, 25 bp, Mus musculus
cctgccgccagtcgccgcggtgact

SEQ ID NO: 423072 - DNA, 25 bp, Mus musculus
ggcgccgctctgagtgacctttcac

SEQ ID NO: 423073 - DNA, 25 bp, Mus musculus
tgagtgacctttcacccgagcccag

SEQ ID NO: 423074 - DNA, 25 bp, Mus musculus
ctgcgggttctgtcgggccatctgc

SEQ ID NO: 423075 - DNA, 25 bp, Mus musculus
cgttgaagctccaggcgcaaggccc

SEQ ID NO: 423076 - DNA, 25 bp, Mus musculus
attggctacgttgcacggcgcgcga

SEQ ID NO: 423077 - DNA, 25 bp, Mus musculus
aagcttctatatataagaggcgccg

SEQ ID NO: 423078 - DNA, 25 bp, Mus musculus
ttcttcagcgagagctaagcgatgg

SEQ ID NO: 423079 - DNA, 25 bp, Mus musculus
tgggcggggcttacaagcttctata

SEQ ID NO: 423080 - DNA, 25 bp, Mus musculus
tggactccgttacgcatgcgcatgg

SEQ ID NO: 423081 - DNA, 25 bp, Mus musculus
cggggcttacaagcttctatatata

SEQ ID NO: 423082 - DNA, 25 bp, Mus musculus
atgattggctacgttgcacggcgcg

SEQ ID NO: 423083 - DNA, 25 bp, Mus musculus
tctatgattggctacgttgcacggc

SEQ ID NO: 423084 - DNA, 25 bp, Mus musculus
acgcattctatgattggctacgttg

SEQ ID NO: 423085 - DNA, 25 bp, Mus musculus
gctaagcgatggaagaaggcggcct

SEQ ID NO: 423086 - DNA, 25 bp, Mus musculus
cgtttcttcagcgagagctaagcga

SEQ ID NO: 423087 - DNA, 25 bp, Mus musculus
tcagcgagagctaagcgatggaaga

SEQ ID NO: 423088 - DNA, 25 bp, Mus musculus
ccctacgcattctatgattggctac

SEQ ID NO: 423089 - DNA, 25 bp, Mus musculus
gactccgttacgcatgcgcatgggc

SEQ ID NO: 423090 - DNA, 25 bp, Mus musculus
accgcctctgagtagcgggagtcgc

SEQ ID NO: 423091 - DNA, 25 bp, Mus musculus
gctcgaactcctgcaggcggtagta

SEQ ID NO: 423092 - DNA, 25 bp, Mus musculus
ctcctgcaggcggtagtagcagtag

SEQ ID NO: 423093 - DNA, 25 bp, Mus musculus
ttagcagctgcaccgcctctgagta

SEQ ID NO: 423094 - DNA, 25 bp, Mus musculus
agtcgcggatgagcctgtacaccac

SEQ ID NO: 423095 - DNA, 25 bp, Mus musculus
tgagcctgtacaccaccgctgtgaa

SEQ ID NO: 423096 - DNA, 25 bp, Mus musculus
accgctgtgaactcaccgtcgggaa

SEQ ID NO: 423097 - DNA, 25 bp, Mus musculus
ccgtcgggaactttagagctgcttt

SEQ ID NO: 423098 - DNA, 25 bp, Mus musculus
tttagagctgctttgccacgccata

SEQ ID NO: 423099 - DNA, 25 bp, Mus musculus
tgccacgccatagccgccaaaattg

SEQ ID NO: 423100 - DNA, 25 bp, Mus musculus
cgccaaaattgtagcgcgtgctagt

SEQ ID NO: 423101 - DNA, 25 bp, Mus musculus
tagcgcgtgctagtttccaaggaaa

SEQ ID NO: 423102 - DNA, 25 bp, Mus musculus
aacggaagttcatccagcgggtggc

SEQ ID NO: 423103 - DNA, 25 bp, Mus musculus
agctctgcgcttagcagctgcaccg

SEQ ID NO: 423104 - DNA, 25 bp, Mus musculus
ctaaggagtccaagggcgtggcctt

SEQ ID NO: 423105 - DNA, 25 bp, Mus musculus
atgagccgcccaacagccgcatttt

SEQ ID NO: 423106 - DNA, 25 bp, Mus musculus
tgcgcgacaagcacactaaggagtc

SEQ ID NO: 423107 - DNA, 25 bp, Mus musculus
catccaggacatctgggtggtgcgc

SEQ ID NO: 423108 - DNA, 25 bp, Mus musculus
tctcgcccttcggagacatccagga

SEQ ID NO: 423109 - DNA, 25 bp, Mus musculus
acatccgaattggtgctgagggagc

SEQ ID NO: 423110 - DNA, 25 bp, Mus musculus
gatcagcaagcacacatccgaattg

SEQ ID NO: 423111 - DNA, 25 bp, Mus musculus
cagccgcatttttctagtgatcagc

SEQ ID NO: 423112 - DNA, 25 bp, Mus musculus
tagacagcctggatgagccgcccaa

SEQ ID NO: 423113 - DNA, 25 bp, Mus musculus
tccggaagcggagctgcttaccggc

SEQ ID NO: 423114 - DNA, 25 bp, Mus musculus
ctctcggctcttccggaagcggagc

SEQ ID NO: 423115 - DNA, 25 bp, Mus musculus
cgctgcagaatgttcccggaagccc

SEQ ID NO: 423116 - DNA, 25 bp, Mus musculus
gcgtggccttcgtcaagttcgcgcg

SEQ ID NO: 423117 - DNA, 25 bp, Mus musculus
aacctgccgggtgaacagggcctgc

SEQ ID NO: 423118 - DNA, 25 bp, Mus musculus
acccggccgtcatggcgatattgta

SEQ ID NO: 423119 - DNA, 25 bp, Mus musculus
ctgagcgcgccactgaagtgccgct

SEQ ID NO: 423120 - DNA, 25 bp, Mus musculus
tccttctcgtcgctggcctcggagg

SEQ ID NO: 423121 - DNA, 25 bp, Mus musculus
cgatattgtagaaggtgagccaggc

SEQ ID NO: 423122 - DNA, 25 bp, Mus musculus
gttggtgccgtcctcctcactggac

SEQ ID NO: 423123 - DNA, 25 bp, Mus musculus
tggaaggaccttcgcgcgcacgtac

SEQ ID NO: 423124 - DNA, 25 bp, Mus musculus
agcccggatcgctgagggaccgcac

SEQ ID NO: 423125 - DNA, 25 bp, Mus musculus
tccgatcgcaagtggccgggcacac

SEQ ID NO: 423126 - DNA, 25 bp, Mus musculus
tcccagagtgctccgatcgcaagtg

SEQ ID NO: 423127 - DNA, 25 bp, Mus musculus
ccgtattaggcaatgcccagcgagc

SEQ ID NO: 423128 - DNA, 25 bp, Mus musculus
gcgccacaccgtgcaccgtattagg

SEQ ID NO: 423129 - DNA, 25 bp, Mus musculus
gtcatggcttccaggcagtgtcacg

SEQ ID NO: 423130 - DNA, 25 bp, Mus musculus
tcggtccagcgctccatgtgcgacg

SEQ ID NO: 423131 - DNA, 25 bp, Mus musculus
tggccagtaagcctaggcgtctccg

SEQ ID NO: 423132 - DNA, 25 bp, Mus musculus
gatgtaattgtcagcggagaaccga

SEQ ID NO: 423133 - DNA, 25 bp, Mus musculus
cacggattcccgtggacgccaggca

SEQ ID NO: 423134 - DNA, 25 bp, Mus musculus
agatgggcgctggatcccgcacgaa

SEQ ID NO: 423135 - DNA, 25 bp, Mus musculus
agcagagcgggacaccatggagccc

SEQ ID NO: 423136 - DNA, 25 bp, Mus musculus
ctggagaccacagctcggcacaggc

SEQ ID NO: 423137 - DNA, 25 bp, Mus musculus
ccgggcagatagcacgggccatctc

SEQ ID NO: 423138 - DNA, 25 bp, Mus musculus
accctggcgatacccgagtgggcag

SEQ ID NO: 423139 - DNA, 25 bp, Mus musculus
caaggcatcgctgtctccagaggca

SEQ ID NO: 423140 - DNA, 25 bp, Mus musculus
actgcggactgtcctcgcgagcact

SEQ ID NO: 423141 - DNA, 25 bp, Mus musculus
gccgggaggactgatgtaattgtca

SEQ ID NO: 423142 - DNA, 25 bp, Mus musculus
gcctacgagagctgacgcctacgct

SEQ ID NO: 423143 - DNA, 25 bp, Mus musculus
tgacgcctacgctgcacctttcagg

SEQ ID NO: 423144 - DNA, 25 bp, Mus musculus
cacctttcagggaatccgggagccg

SEQ ID NO: 423145 - DNA, 25 bp, Mus musculus
ggaatccggcttccttttacacgca

SEQ ID NO: 423146 - DNA, 25 bp, Mus musculus
cccgctctctagttgggttcccaga

SEQ ID NO: 423147 - DNA, 25 bp, Mus musculus
gctggccacagcaatcaagagaagt

SEQ ID NO: 423148 - DNA, 25 bp, Mus musculus
cgttccgcttccaaagcttctgagc

SEQ ID NO: 423149 - DNA, 25 bp, Mus musculus
gccaagtttctgtccttcccagcta

SEQ ID NO: 423150 - DNA, 25 bp, Mus musculus
actttgccacagtgctcagcccttt

SEQ ID NO: 423151 - DNA, 25 bp, Mus musculus
ccctcgatgttcttgctccactttg

SEQ ID NO: 423152 - DNA, 25 bp, Mus musculus
agagaagtgtggatctgggtcctcc

SEQ ID NO: 423153 - DNA, 25 bp, Mus musculus
tcggcacgatgcctgctatgggaca

SEQ ID NO: 423154 - DNA, 25 bp, Mus musculus
tgacctgaaggtcccgctgtcctcg

SEQ ID NO: 423155 - DNA, 25 bp, Mus musculus
gagctttacccagaatgctgcccga

SEQ ID NO: 423156 - DNA, 25 bp, Mus musculus
cggctagctgcctagggtcactaga

SEQ ID NO: 423157 - DNA, 25 bp, Mus musculus
ctgatcaagtcctcccgatcggcta

SEQ ID NO: 423158 - DNA, 25 bp, Mus musculus
ggtctgcgcctcaacactgatcaag

SEQ ID NO: 423159 - DNA, 25 bp, Mus musculus
ccacgtcggccagttcccgagagga

SEQ ID NO: 423160 - DNA, 25 bp, Mus musculus
cttcgattgggagttcgagactgcg

SEQ ID NO: 423161 - DNA, 25 bp, Mus musculus
tcaatgaaaacaagccgggaagccc

SEQ ID NO: 423162 - DNA, 25 bp, Mus musculus
aggcgaggccttcggcagccgcctt

SEQ ID NO: 423163 - DNA, 25 bp, Mus musculus
ggcagccgccttgtgcaggatgccc

SEQ ID NO: 423164 - DNA, 25 bp, Mus musculus
gccggcccctttcatccaggaagtg

SEQ ID NO: 423165 - DNA, 25 bp, Mus musculus
tgaaagcgacgtcggggtcaatgaa

SEQ ID NO: 423166 - DNA, 25 bp, Mus musculus
gacgtcggggtcaatgaaaacaagc

SEQ ID NO: 423167 - DNA, 25 bp, Mus musculus
caagtggaccaactatctcacaggt

SEQ ID NO: 423168 - DNA, 25 bp, Mus musculus
aactatctcacaggtacggggcggg

SEQ ID NO: 423169 - DNA, 25 bp, Mus musculus
gcggcactcagttccgcgctcgatg

SEQ ID NO: 423170 - DNA, 25 bp, Mus musculus
tcgatgccctccgacccttccactg

SEQ ID NO: 423171 - DNA, 25 bp, Mus musculus
ctcgtggggcccattacgggcctct

SEQ ID NO: 423172 - DNA, 25 bp, Mus musculus
tacgggcctcttcgattgggagttc

SEQ ID NO: 423173 - DNA, 25 bp, Mus musculus
gttcccgctggggatgtccgcgcct

SEQ ID NO: 423174 - DNA, 25 bp, Mus musculus
cccgtagagcttgaccgcgtgggtg

SEQ ID NO: 423175 - DNA, 25 bp, Mus musculus
ggcagctaccggcacacacaaagga

SEQ ID NO: 423176 - DNA, 25 bp, Mus musculus
cccatgaatccaggctgacactcaa

SEQ ID NO: 423177 - DNA, 25 bp, Mus musculus
tcaaacctgttgctggattcggggc

SEQ ID NO: 423178 - DNA, 25 bp, Mus musculus
acctgttgctggattcggggcccag

SEQ ID NO: 423179 - DNA, 25 bp, Mus musculus
gcacctcgggcgctttgtctgcggc

SEQ ID NO: 423180 - DNA, 25 bp, Mus musculus
cggcaaatcgctgcccggccctccg

SEQ ID NO: 423181 - DNA, 25 bp, Mus musculus
tccgcgcgacctcgcgtgcgcccgt

SEQ ID NO: 423182 - DNA, 25 bp, Mus musculus
ccgcgtcccgcaccggcagctaccg

SEQ ID NO: 423183 - DNA, 25 bp, Mus musculus
cttgggattgacgtcctgtggtccc

SEQ ID NO: 423184 - DNA, 25 bp, Mus musculus
accggcacacacaaaggagcgggcc

SEQ ID NO: 423185 - DNA, 25 bp, Mus musculus
cacttgggattgacgtcctgtggtc

SEQ ID NO: 423186 - DNA, 25 bp, Mus musculus
ccggagaagccgagccctacggcaa

SEQ ID NO: 423187 - DNA, 25 bp, Mus musculus
aggctgacactcaaacctgttgctg

SEQ ID NO: 423188 - DNA, 25 bp, Mus musculus
gctggcgggcgacacagatcagcct

SEQ ID NO: 423189 - DNA, 25 bp, Mus musculus
tacgtcctactccttgactcgaggg

SEQ ID NO: 423190 - DNA, 25 bp, Mus musculus
cccagcaaggacctgcgaggctcgt

SEQ ID NO: 423191 - DNA, 25 bp, Mus musculus
ggcgacacagatcagcctccgcggg

SEQ ID NO: 423192 - DNA, 25 bp, Mus musculus
tgctcgccaccaagtatgggctctg

SEQ ID NO: 423193 - DNA, 25 bp, Mus musculus
actcttcttggagatgctcgccacc

SEQ ID NO: 423194 - DNA, 25 bp, Mus musculus
tgcgctggagctccgcgcagacgct

SEQ ID NO: 423195 - DNA, 25 bp, Mus musculus
cacctactggccgagcggactaaaa

SEQ ID NO: 423196 - DNA, 25 bp, Mus musculus
gccgacgtgtcacctactggccgag

SEQ ID NO: 423197 - DNA, 25 bp, Mus musculus
aaggcgggacgcaaacctcgcgcgc

SEQ ID NO: 423198 - DNA, 25 bp, Mus musculus
ctactccttgactcgaggggctagg

SEQ ID NO: 423199 - DNA, 25 bp, Mus musculus
gccgagcggactaaaactcttcttg

SEQ ID NO: 423200 - DNA, 25 bp, Mus musculus
ccagggcttcgcagcccagcaagga

SEQ ID NO: 423201 - DNA, 25 bp, Mus musculus
ccaggcgcctgcctctacaagtggg

SEQ ID NO: 423202 - DNA, 25 bp, Mus musculus
gctcacacggcacctcgcgggccgc

SEQ ID NO: 423203 - DNA, 25 bp, Mus musculus
gcgcagccacatgaggaaagcaagg

SEQ ID NO: 423204 - DNA, 25 bp, Mus musculus
ccacatgaggaaagcaaggcccacc

SEQ ID NO: 423205 - DNA, 25 bp, Mus musculus
atgaggaaagcaaggcccaccgggc

SEQ ID NO: 423206 - DNA, 25 bp, Mus musculus
atcataccggaagagcgtcagttcc

SEQ ID NO: 423207 - DNA, 25 bp, Mus musculus
gagaggtgttcaccgacaacccaga

SEQ ID NO: 423208 - DNA, 25 bp, Mus musculus
agccacatgaggaaagcaaggccca

SEQ ID NO: 423209 - DNA, 25 bp, Mus musculus
cataccggaagagcgtcagttccct

SEQ ID NO: 423210 - DNA, 25 bp, Mus musculus
ccatcataccggaagagcgtcagtt

SEQ ID NO: 423211 - DNA, 25 bp, Mus musculus
gaatttattaatgccagccccggga

SEQ ID NO: 423212 - DNA, 25 bp, Mus musculus
taccagaatttattaatgccagccc

SEQ ID NO: 423213 - DNA, 25 bp, Mus musculus
cgcgttaccagaatttattaatgcc

SEQ ID NO: 423214 - DNA, 25 bp, Mus musculus
acatgaggaaagcaaggcccaccgg

SEQ ID NO: 423215 - DNA, 25 bp, Mus musculus
aggagaggtgttcaccgacaaccca

SEQ ID NO: 423216 - DNA, 25 bp, Mus musculus
gaccaaggtcgacgcgcgcacagct

SEQ ID NO: 423217 - DNA, 25 bp, Mus musculus
tctccgcggatcgaaggcttgcggt

SEQ ID NO: 423218 - DNA, 25 bp, Mus musculus
cgttcactgggccatggaagcagca

SEQ ID NO: 423219 - DNA, 25 bp, Mus musculus
cacgcaggcccacgcggatagcaag

SEQ ID NO: 423220 - DNA, 25 bp, Mus musculus
ggagcttctttctccgctgtccgga

SEQ ID NO: 423221 - DNA, 25 bp, Mus musculus
gctcgtatctgccatgggaacccgc

SEQ ID NO: 423222 - DNA, 25 bp, Mus musculus
ttcaccaatccacagctcgtatctg

SEQ ID NO: 423223 - DNA, 25 bp, Mus musculus
tctccgttcggatgcttcaccaatc

SEQ ID NO: 423224 - DNA, 25 bp, Mus musculus
tgaagcaaccaatccaaactctccg

SEQ ID NO: 423225 - DNA, 25 bp, Mus musculus
cacggtccgcaagatggaggcgaac

SEQ ID NO: 423226 - DNA, 25 bp, Mus musculus
tcctcctccggatgcgttcactggg

SEQ ID NO: 423227 - DNA, 25 bp, Mus musculus
cgcacagctgcatggggctgccaga

SEQ ID NO: 423228 - DNA, 25 bp, Mus musculus
atggaagcagcagccgtccagacgc

SEQ ID NO: 423229 - DNA, 25 bp, Mus musculus
cacgcggatagcaaggcgcgctctc

SEQ ID NO: 423230 - DNA, 25 bp, Mus musculus
cgccttcgccttcggccggcagagc

SEQ ID NO: 423231 - DNA, 25 bp, Mus musculus
ctgcgactttcgatgttccacactc

SEQ ID NO: 423232 - DNA, 25 bp, Mus musculus
ccgctcgctcggaacttgctgactg

SEQ ID NO: 423233 - DNA, 25 bp, Mus musculus
ccctccgccaggcaagcagcgagca

SEQ ID NO: 423234 - DNA, 25 bp, Mus musculus
aacttgctgactgcgcgaccgggag

SEQ ID NO: 423235 - DNA, 25 bp, Mus musculus
acggccgcctgcgactttcgatgtt

SEQ ID NO: 423236 - DNA, 25 bp, Mus musculus
gatgttccacactcccgggccggag

SEQ ID NO: 423237 - DNA, 25 bp, Mus musculus
gagcctcggcggcggcttcttttcc

SEQ ID NO: 423238 - DNA, 25 bp, Mus musculus
caggctgcctccatttcctcaagga

SEQ ID NO: 423239 - DNA, 25 bp, Mus musculus
aggaaggttcctcggcgctctccct

SEQ ID NO: 423240 - DNA, 25 bp, Mus musculus
agtccgccgcgctagtcagtcagcg

SEQ ID NO: 423241 - DNA, 25 bp, Mus musculus
gggccgcgccaatttgttgcacttc

SEQ ID NO: 423242 - DNA, 25 bp, Mus musculus
gcgccaatttgttgcacttctgggg

SEQ ID NO: 423243 - DNA, 25 bp, Mus musculus
ctcggaacttgctgactgcgcgacc

SEQ ID NO: 423244 - DNA, 25 bp, Mus musculus
gcgtgggccagagcctgaagcatcc

SEQ ID NO: 423245 - DNA, 25 bp, Mus musculus
cacagccacgggtcgaagcgctggt

SEQ ID NO: 423246 - DNA, 25 bp, Mus musculus
ggctactcggtggtgctgcacagcc

SEQ ID NO: 423247 - DNA, 25 bp, Mus musculus
ccggcacgctgtttggctactcggt

SEQ ID NO: 423248 - DNA, 25 bp, Mus musculus
ggacccggagaatgcactgctgtac

SEQ ID NO: 423249 - DNA, 25 bp, Mus musculus
tcggggtgccaaccgggcactccta

SEQ ID NO: 423250 - DNA, 25 bp, Mus musculus
agcggtgatgctgttgttgtacttc

SEQ ID NO: 423251 - DNA, 25 bp, Mus musculus
gaatgttctccaccaagagcgcatg

SEQ ID NO: 423252 - DNA, 25 bp, Mus musculus
agtggccgttttgtgttgaatgttc

SEQ ID NO: 423253 - DNA, 25 bp, Mus musculus
atcctgtgcaactctggtcagtggc

SEQ ID NO: 423254 - DNA, 25 bp, Mus musculus
ttggccaaccgtcgcatcctgtgca

SEQ ID NO: 423255 - DNA, 25 bp, Mus musculus
tggggcgctcttctctttggccaac

SEQ ID NO: 423256 - DNA, 25 bp, Mus musculus
acgctgctgcacttcatctcttggg

SEQ ID NO: 423257 - DNA, 25 bp, Mus musculus
tgaagcatccctggccactacgatc

SEQ ID NO: 423258 - DNA, 25 bp, Mus musculus
aagatgccacgcagcaaaacccgct

SEQ ID NO: 423259 - DNA, 25 bp, Mus musculus
gtctcccccggaacatggtgacgcg

SEQ ID NO: 423260 - DNA, 25 bp, Mus musculus
gccgccactcaccagccgggagctc

SEQ ID NO: 423261 - DNA, 25 bp, Mus musculus
agctcgggctggatgcgtcgccacc

SEQ ID NO: 423262 - DNA, 25 bp, Mus musculus
gcagggcccgctcgcccaacgccac

SEQ ID NO: 423263 - DNA, 25 bp, Mus musculus
tcgcccaacgccacatcgcagcttt

SEQ ID NO: 423264 - DNA, 25 bp, Mus musculus
gcagctttccctccggatctcgaag

SEQ ID NO: 423265 - DNA, 25 bp, Mus musculus
gctttccctccggatctcgaagatg

SEQ ID NO: 423266 - DNA, 25 bp, Mus musculus
ttccctccggatctcgaagatgcca

SEQ ID NO: 423267 - DNA, 25 bp, Mus musculus
tccggatctcgaagatgccacgcag

SEQ ID NO: 423268 - DNA, 25 bp, Mus musculus
aaacccgctcgggttcagcagctgc

SEQ ID NO: 423269 - DNA, 25 bp, Mus musculus
agctgcctttgggttctccggaggc

SEQ ID NO: 423270 - DNA, 25 bp, Mus musculus
ttcagcagctgcctttgggttctcc

SEQ ID NO: 423271 - DNA, 25 bp, Mus musculus
tgcctttgggttctccggaggcgcc

SEQ ID NO: 423272 - DNA, 25 bp, Mus musculus
ggtgcgcctgaaggacctcgtcctc

SEQ ID NO: 423273 - DNA, 25 bp, Mus musculus
gcgttcgttcattctggattcccga

SEQ ID NO: 423274 - DNA, 25 bp, Mus musculus
cgtcccactgcgttcgttcattctg

SEQ ID NO: 423275 - DNA, 25 bp, Mus musculus
gatgttggtaagtgttttcaccgcc

SEQ ID NO: 423276 - DNA, 25 bp, Mus musculus
cccttcgaccaggatgttggtaagt

SEQ ID NO: 423277 - DNA, 25 bp, Mus musculus
gcggacatgcctctctttgccacca

SEQ ID NO: 423278 - DNA, 25 bp, Mus musculus
tgtgtttgtacctgaggggcctcct

SEQ ID NO: 423279 - DNA, 25 bp, Mus musculus
gcgcccttgctgtgtttgtacctga

SEQ ID NO: 423280 - DNA, 25 bp, Mus musculus
gcctgttccgcttctcggctgttgc

SEQ ID NO: 423281 - DNA, 25 bp, Mus musculus
ggcagcgctcaagtcgcctacattc

SEQ ID NO: 423282 - DNA, 25 bp, Mus musculus
gcagtgttcaggcagcgctcaagtc

SEQ ID NO: 423283 - DNA, 25 bp, Mus musculus
atggaaaagccgagaacctagccgc

SEQ ID NO: 423284 - DNA, 25 bp, Mus musculus
gggacatggaaaagccgagaaccta

SEQ ID NO: 423285 - DNA, 25 bp, Mus musculus
tcattctggattcccgaggccgagc

SEQ ID NO: 423286 - DNA, 25 bp, Mus musculus
aagttgccattgatgctgagcggcg

SEQ ID NO: 423287 - DNA, 25 bp, Mus musculus
cgtgtttgaaagagaagttgccatt

SEQ ID NO: 423288 - DNA, 25 bp, Mus musculus
tcaaactcggcggatggttcgtgtt

SEQ ID NO: 423289 - DNA, 25 bp, Mus musculus
tcgctgcagggtagtgcatggtaaa

SEQ ID NO: 423290 - DNA, 25 bp, Mus musculus
gcggcaccggaagagaagattgatc

SEQ ID NO: 423291 - DNA, 25 bp, Mus musculus
taatgttgtctatggggatctcgca

SEQ ID NO: 423292 - DNA, 25 bp, Mus musculus
atggctatcgaaagacataatgttg

SEQ ID NO: 423293 - DNA, 25 bp, Mus musculus
ctcgctcatgatgcgaatggctatc

SEQ ID NO: 423294 - DNA, 25 bp, Mus musculus
attaagctgggcactcatgactcgc

SEQ ID NO: 423295 - DNA, 25 bp, Mus musculus
ctgacgtgcctctaatcgtgaaaga

SEQ ID NO: 423296 - DNA, 25 bp, Mus musculus
ggggctttcaaagaagggctccaga

SEQ ID NO: 423297 - DNA, 25 bp, Mus musculus
tcccgggaatagtgaaactgacgtg

SEQ ID NO: 423298 - DNA, 25 bp, Mus musculus
tgtccgggttctgctcaggcaagaa

SEQ ID NO: 423299 - DNA, 25 bp, Mus musculus
gcacagtggattcgtttcccgggaa

SEQ ID NO: 423300 - DNA, 25 bp, Mus musculus
ccaagagccgggaaccacgtgacct

SEQ ID NO: 423301 - DNA, 25 bp, Mus musculus
cgaattcctcgtgtcccggtggcgc

SEQ ID NO: 423302 - DNA, 25 bp, Mus musculus
ggcgctagggttatatagccgagtt

SEQ ID NO: 423303 - DNA, 25 bp, Mus musculus
tagccgagttgctgatgctgagcgc

SEQ ID NO: 423304 - DNA, 25 bp, Mus musculus
agctgagcaacgagcaggtccctgc

SEQ ID NO: 423305 - DNA, 25 bp, Mus musculus
gcgcacgcgtccagactgaacgact

SEQ ID NO: 423306 - DNA, 25 bp, Mus musculus
ggcatgcgccatatggtcttcccgg

SEQ ID NO: 423307 - DNA, 25 bp, Mus musculus
gcgccatatggtcttcccggtccag

SEQ ID NO: 423308 - DNA, 25 bp, Mus musculus
gtatgccgcggagcgctccattccg

SEQ ID NO: 423309 - DNA, 25 bp, Mus musculus
cagttagagactccgcggacctgtt

SEQ ID NO: 423310 - DNA, 25 bp, Mus musculus
tgtggccagaagaaagtggcccatc

SEQ ID NO: 423311 - DNA, 25 bp, Mus musculus
tgcctatttgtatgccgcggagcgc

SEQ ID NO: 423312 - DNA, 25 bp, Mus musculus
cacgtgacctgcctatttgtatgcc

SEQ ID NO: 423313 - DNA, 25 bp, Mus musculus
tggcccatctgtcgccagttagaga

SEQ ID NO: 423314 - DNA, 25 bp, Mus musculus
ttcgacttcgtctctgggtcccgtg

SEQ ID NO: 423315 - DNA, 25 bp, Mus musculus
cggagaccgaggatctgtccacaga

SEQ ID NO: 423316 - DNA, 25 bp, Mus musculus
cgatatggctcaaagactgccggta

SEQ ID NO: 423317 - DNA, 25 bp, Mus musculus
tgcccaacgagaagatcgcgatatg

SEQ ID NO: 423318 - DNA, 25 bp, Mus musculus
tcccgcaggaaacgtgcccaacgag

SEQ ID NO: 423319 - DNA, 25 bp, Mus musculus
ggtctttaacgagctgtcccttcgc

SEQ ID NO: 423320 - DNA, 25 bp, Mus musculus
cctctgagtacttatgtttggggtc

SEQ ID NO: 423321 - DNA, 25 bp, Mus musculus
gagtgtcaggatggcacagcctctg

SEQ ID NO: 423322 - DNA, 25 bp, Mus musculus
cagattctcctgcaagggagtgtca

SEQ ID NO: 423323 - DNA, 25 bp, Mus musculus
tacgggttgccagggcagattctcc

SEQ ID NO: 423324 - DNA, 25 bp, Mus musculus
tccagcatgtgcacctggctgccgg

SEQ ID NO: 423325 - DNA, 25 bp, Mus musculus
cgaactttaaatgcgcgcgtgaccc

SEQ ID NO: 423326 - DNA, 25 bp, Mus musculus
tgtccacagagacgacgacgcagga

SEQ ID NO: 423327 - DNA, 25 bp, Mus musculus
cccgtggtcactgtaagctaggaac

SEQ ID NO: 423328 - DNA, 25 bp, Mus musculus
agaaggccacgtcagcctcggcggt

SEQ ID NO: 423329 - DNA, 25 bp, Mus musculus
ttccttccgccagcggttgactacg

SEQ ID NO: 423330 - DNA, 25 bp, Mus musculus
agcggttgactacggccgcaagatg

SEQ ID NO: 423331 - DNA, 25 bp, Mus musculus
cgcgctgcgggatgcttccctatct

SEQ ID NO: 423332 - DNA, 25 bp, Mus musculus
cgggatgcttccctatctctggcta

SEQ ID NO: 423333 - DNA, 25 bp, Mus musculus
gcagccacacagaaggccacgtcag

SEQ ID NO: 423334 - DNA, 25 bp, Mus musculus
cttcgcccacgcctttcccacaatg

SEQ ID NO: 423335 - DNA, 25 bp, Mus musculus
agaattgctgctgcgcgcgttcgca

SEQ ID NO: 423336 - DNA, 25 bp, Mus musculus
gcgttcgcaggcagcgtccggtcct

SEQ ID NO: 423337 - DNA, 25 bp, Mus musculus
gaggacgccagacccatcccaccgc

SEQ ID NO: 423338 - DNA, 25 bp, Mus musculus
ctcgcactttctaactcggggtctc

SEQ ID NO: 423339 - DNA, 25 bp, Mus musculus
gcactttctaactcggggtctctct

SEQ ID NO: 423340 - DNA, 25 bp, Mus musculus
gtccgacctgggacctcaaggcgca

SEQ ID NO: 423341 - DNA, 25 bp, Mus musculus
gcttccctatctctggctaggagcg

SEQ ID NO: 423342 - DNA, 25 bp, Mus musculus
gggccgcagcagaccatggtcccag

SEQ ID NO: 423343 - DNA, 25 bp, Mus musculus
ggccgcagcagaccatggtcccagc

SEQ ID NO: 423344 - DNA, 25 bp, Mus musculus
catggtcccagcaggatggggcagg

SEQ ID NO: 423345 - DNA, 25 bp, Mus musculus
ccatggtcccagcaggatggggcag

SEQ ID NO: 423346 - DNA, 25 bp, Mus musculus
accatggtcccagcaggatggggca

SEQ ID NO: 423347 - DNA, 25 bp, Mus musculus
gccgcagcagaccatggtcccagca

SEQ ID NO: 423348 - DNA, 25 bp, Mus musculus
cgcagcagaccatggtcccagcagg

SEQ ID NO: 423349 - DNA, 25 bp, Mus musculus
agaccatggtcccagcaggatgggg

SEQ ID NO: 423350 - DNA, 25 bp, Mus musculus
cagaccatggtcccagcaggatggg

SEQ ID NO: 423351 - DNA, 25 bp, Mus musculus
gcagaccatggtcccagcaggatgg

SEQ ID NO: 423352 - DNA, 25 bp, Mus musculus
agcagaccatggtcccagcaggatg

SEQ ID NO: 423353 - DNA, 25 bp, Mus musculus
gtcccagcaggatggggcagggcgc

SEQ ID NO: 423354 - DNA, 25 bp, Mus musculus
gcagcagaccatggtcccagcagga

SEQ ID NO: 423355 - DNA, 25 bp, Mus musculus
cagcagaccatggtcccagcaggat

SEQ ID NO: 423356 - DNA, 25 bp, Mus musculus
tcccaagcgtctaagcctctaggcg

SEQ ID NO: 423357 - DNA, 25 bp, Mus musculus
gacgcgggagacactttcgttccga

SEQ ID NO: 423358 - DNA, 25 bp, Mus musculus
ggagacactttcgttccgaagtctc

SEQ ID NO: 423359 - DNA, 25 bp, Mus musculus
ctgcggttccgaggggtgatcccaa

SEQ ID NO: 423360 - DNA, 25 bp, Mus musculus
tccgaggggtgatcccaacgacctg

SEQ ID NO: 423361 - DNA, 25 bp, Mus musculus
tgatcccaacgacctggggagctgc

SEQ ID NO: 423362 - DNA, 25 bp, Mus musculus
ccctgggacaatcacagttctcttg

SEQ ID NO: 423363 - DNA, 25 bp, Mus musculus
gggacaatcacagttctcttggatc

SEQ ID NO: 423364 - DNA, 25 bp, Mus musculus
atcacagttctcttggatccaagtg

SEQ ID NO: 423365 - DNA, 25 bp, Mus musculus
cgacggacgcgggagacactttcgt

SEQ ID NO: 423366 - DNA, 25 bp, Mus musculus
tcccaggtccggtccactagcttgg

SEQ ID NO: 423367 - DNA, 25 bp, Mus musculus
tccggtccactagcttggcggagcc

SEQ ID NO: 423368 - DNA, 25 bp, Mus musculus
gtccactagcttggcggagcccggt

SEQ ID NO: 423369 - DNA, 25 bp, Mus musculus
ggctgctcttcccaagcgtctaagc

SEQ ID NO: 423370 - DNA, 25 bp, Mus musculus
tgcagaaagtcagacaggaaggcgc

SEQ ID NO: 423371 - DNA, 25 bp, Mus musculus
tttcctcacagcaaacccgagcgca

SEQ ID NO: 423372 - DNA, 25 bp, Mus musculus
acagcaaacccgagcgcacctccgc

SEQ ID NO: 423373 - DNA, 25 bp, Mus musculus
accgtccctcgttgcccgcagctct

SEQ ID NO: 423374 - DNA, 25 bp, Mus musculus
cgcgagcccacaccgtccctcgttg

SEQ ID NO: 423375 - DNA, 25 bp, Mus musculus
acggtctcaacgcaccacagagatg

SEQ ID NO: 423376 - DNA, 25 bp, Mus musculus
gcacctccgcctgcagaaagtcaga

SEQ ID NO: 423377 - DNA, 25 bp, Mus musculus
ccacgggagaaacggtctcaacgca

SEQ ID NO: 423378 - DNA, 25 bp, Mus musculus
gatccatagacgaacccttggtccc

SEQ ID NO: 423379 - DNA, 25 bp, Mus musculus
tggatccatagacgaacccttggtc

SEQ ID NO: 423380 - DNA, 25 bp, Mus musculus
ctctggatccatagacgaacccttg

SEQ ID NO: 423381 - DNA, 25 bp, Mus musculus
cccggctctggatccatagacgaac

SEQ ID NO: 423382 - DNA, 25 bp, Mus musculus
cctccgcctgcagaaagtcagacag

SEQ ID NO: 423383 - DNA, 25 bp, Mus musculus
tctcaacgcaccacagagatgcgca

SEQ ID NO: 423384 - DNA, 25 bp, Mus musculus
gcctgaggaactgggagctcgggtt

SEQ ID NO: 423385 - DNA, 25 bp, Mus musculus
tcgggttggagcgacacccgtggaa

SEQ ID NO: 423386 - DNA, 25 bp, Mus musculus
gactttaaccccttgtgggctctgc

SEQ ID NO: 423387 - DNA, 25 bp, Mus musculus
ggctctgcggcaggggatttaaccc

SEQ ID NO: 423388 - DNA, 25 bp, Mus musculus
cctttgtggattcggcccctccgag

SEQ ID NO: 423389 - DNA, 25 bp, Mus musculus
ccctccgaggcagcgtcatcgggta

SEQ ID NO: 423390 - DNA, 25 bp, Mus musculus
ccgaggcagcgtcatcgggtagttt

SEQ ID NO: 423391 - DNA, 25 bp, Mus musculus
ctcctcgtctgtgggagcactcggc

SEQ ID NO: 423392 - DNA, 25 bp, Mus musculus
attggacttaaacctcctctccttg

SEQ ID NO: 423393 - DNA, 25 bp, Mus musculus
tggacttaaacctcctctccttgcg

SEQ ID NO: 423394 - DNA, 25 bp, Mus musculus
ttgcgcaccaactcctcgtctgtgg

SEQ ID NO: 423395 - DNA, 25 bp, Mus musculus
caccaactcctcgtctgtgggagca

SEQ ID NO: 423396 - DNA, 25 bp, Mus musculus
caactcctcgtctgtgggagcactc

SEQ ID NO: 423397 - DNA, 25 bp, Mus musculus
aggcagcgtcatcgggtagttttaa

SEQ ID NO: 423398 - DNA, 25 bp, Mus musculus
cacgccttgacagacgctccaggga

SEQ ID NO: 423399 - DNA, 25 bp, Mus musculus
acgctccagggagaacgcggcagat

SEQ ID NO: 423400 - DNA, 25 bp, Mus musculus
tggcggctccgagcttgttttcctc

SEQ ID NO: 423401 - DNA, 25 bp, Mus musculus
gaccggcgctcggtcacctgatcgg

SEQ ID NO: 423402 - DNA, 25 bp, Mus musculus
tttcccggctcctccgctaggtgtg

SEQ ID NO: 423403 - DNA, 25 bp, Mus musculus
cccacccgcgccgtgacacagcagc

SEQ ID NO: 423404 - DNA, 25 bp, Mus musculus
cttctgctgactgggctgcagcacg

SEQ ID NO: 423405 - DNA, 25 bp, Mus musculus
tccgccagcttctgctgactgggct

SEQ ID NO: 423406 - DNA, 25 bp, Mus musculus
atggtgagcttctccgccagcttct

SEQ ID NO: 423407 - DNA, 25 bp, Mus musculus
gtcgttgaggatggtgagcttctcc

SEQ ID NO: 423408 - DNA, 25 bp, Mus musculus
cttcttgatgttgtagaggcgcgtg

SEQ ID NO: 423409 - DNA, 25 bp, Mus musculus
ggcccgtgcgcaccttcttgatgtt

SEQ ID NO: 423410 - DNA, 25 bp, Mus musculus
gagccgggaaatggctcccgcctgc

SEQ ID NO: 423411 - DNA, 25 bp, Mus musculus
acgcggcagatgtgtgctccgcacg

SEQ ID NO: 423412 - DNA, 25 bp, Mus musculus
ctggtcgctgtagtaaccggttgcc

SEQ ID NO: 423413 - DNA, 25 bp, Mus musculus
tcagcctccgcagagagcatgaccg

SEQ ID NO: 423414 - DNA, 25 bp, Mus musculus
ccgcagagagcatgaccggaagttg

SEQ ID NO: 423415 - DNA, 25 bp, Mus musculus
gcatgaccggaagttgcgcaaccca

SEQ ID NO: 423416 - DNA, 25 bp, Mus musculus
gaagttgcgcaacccataaggctga

SEQ ID NO: 423417 - DNA, 25 bp, Mus musculus
aacccataaggctgagcggctctta

SEQ ID NO: 423418 - DNA, 25 bp, Mus musculus
ctgagcggctcttacggtgataaga

SEQ ID NO: 423419 - DNA, 25 bp, Mus musculus
gtgataagagtttccgccatttttg

SEQ ID NO: 423420 - DNA, 25 bp, Mus musculus
tttttgaaaactgggaagctcattg

SEQ ID NO: 423421 - DNA, 25 bp, Mus musculus
aactgggaagctcattgctggagta

SEQ ID NO: 423422 - DNA, 25 bp, Mus musculus
acagccagcgcgctgttgacccgga

SEQ ID NO: 423423 - DNA, 25 bp, Mus musculus
ttgacccggaggtgtcacacgccac

SEQ ID NO: 423424 - DNA, 25 bp, Mus musculus
tgagccactggtcgctgtagtaacc

SEQ ID NO: 423425 - DNA, 25 bp, Mus musculus
cccgaaagcatgcacgaggatgggc

SEQ ID NO: 423426 - DNA, 25 bp, Mus musculus
taataacactcatgcctgccagcgg

SEQ ID NO: 423427 - DNA, 25 bp, Mus musculus
cctgccagcggcagcgactgcgagt

SEQ ID NO: 423428 - DNA, 25 bp, Mus musculus
gccgggcataaggaacccgcgtgcc

SEQ ID NO: 423429 - DNA, 25 bp, Mus musculus
actccaacccgcagagcagaagctg

SEQ ID NO: 423430 - DNA, 25 bp, Mus musculus
cagaagctgcggtcgcgttgctccc

SEQ ID NO: 423431 - DNA, 25 bp, Mus musculus
gcacctcgcaggagtctcgcacttg

SEQ ID NO: 423432 - DNA, 25 bp, Mus musculus
agtctcgcacttgtaaccggccgtc

SEQ ID NO: 423433 - DNA, 25 bp, Mus musculus
tggcgggtgacagatgtactcctct

SEQ ID NO: 423434 - DNA, 25 bp, Mus musculus
tgtactcctctgacagctctcagta

SEQ ID NO: 423435 - DNA, 25 bp, Mus musculus
gctctcagtatcagcccagtggctc

SEQ ID NO: 423436 - DNA, 25 bp, Mus musculus
ccctgccattggctcagtgcgatgg

SEQ ID NO: 423437 - DNA, 25 bp, Mus musculus
tcagtgcgatggaccagcaacgccg

SEQ ID NO: 423438 - DNA, 25 bp, Mus musculus
agcaacgccgcgcactataataaca

SEQ ID NO: 423439 - DNA, 25 bp, Mus musculus
tatctccaggcgagcactgcgccgg

SEQ ID NO: 423440 - DNA, 25 bp, Mus musculus
catagcggcgccgtgctgtcgcaaa

SEQ ID NO: 423441 - DNA, 25 bp, Mus musculus
gtgctgtcgcaaaggccacatccgg

SEQ ID NO: 423442 - DNA, 25 bp, Mus musculus
atgagcgagtcgctttccgtgcgct

SEQ ID NO: 423443 - DNA, 25 bp, Mus musculus
ggagaagatcatcgaggtacgtccc

SEQ ID NO: 423444 - DNA, 25 bp, Mus musculus
gacggtagccatctgcgtcgcagtc

SEQ ID NO: 423445 - DNA, 25 bp, Mus musculus
ccacagtgcatagcggcgccgtgct

SEQ ID NO: 423446 - DNA, 25 bp, Mus musculus
cgcgcctttcccagttcccacgtct

SEQ ID NO: 423447 - DNA, 25 bp, Mus musculus
aggaggcgtcacacgccgcgccttt

SEQ ID NO: 423448 - DNA, 25 bp, Mus musculus
ctcaccaaaaggaggcgtcacacgc

SEQ ID NO: 423449 - DNA, 25 bp, Mus musculus
gtggcaagcgcctcaccaaaaggag

SEQ ID NO: 423450 - DNA, 25 bp, Mus musculus
caagcaagtggcaagcgcctcacca

SEQ ID NO: 423451 - DNA, 25 bp, Mus musculus
atgaaggacgaagccaagcaagtgg

SEQ ID NO: 423452 - DNA, 25 bp, Mus musculus
gtgctaatgaaggacgaagccaagc

SEQ ID NO: 423453 - DNA, 25 bp, Mus musculus
catctgcgtcgcagtcggcccggtg

SEQ ID NO: 423454 - DNA, 25 bp, Mus musculus
ctggaccggctcaagatcgtgagtc

SEQ ID NO: 423455 - DNA, 25 bp, Mus musculus
ttcgaaaactttccagcgcgagtgc

SEQ ID NO: 423456 - DNA, 25 bp, Mus musculus
cctgccctggagaagcacatggaga

SEQ ID NO: 423457 - DNA, 25 bp, Mus musculus
ctttgctttctgaaaagccagtggg

SEQ ID NO: 423458 - DNA, 25 bp, Mus musculus
ccttctgctggctttgtgagcctca

SEQ ID NO: 423459 - DNA, 25 bp, Mus musculus
tggtccaaagcgacacgtccaagtc

SEQ ID NO: 423460 - DNA, 25 bp, Mus musculus
cgactttttgccgatggtccaaagc

SEQ ID NO: 423461 - DNA, 25 bp, Mus musculus
cgcagccttggagtcgactttttgc

SEQ ID NO: 423462 - DNA, 25 bp, Mus musculus
agagcctccgatcctggggcgaaga

SEQ ID NO: 423463 - DNA, 25 bp, Mus musculus
tgcaacatgcttcagcggcgtcgcg

SEQ ID NO: 423464 - DNA, 25 bp, Mus musculus
gcctagtctaggctttgcaacatgc

SEQ ID NO: 423465 - DNA, 25 bp, Mus musculus
gcgggcccagaagctccaaagaact

SEQ ID NO: 423466 - DNA, 25 bp, Mus musculus
gtggtttgtcactctcgctttccga

SEQ ID NO: 423467 - DNA, 25 bp, Mus musculus
ctcccgcgaagaacttttcggagtg

SEQ ID NO: 423468 - DNA, 25 bp, Mus musculus
agcgcacagcacagctcggcagttc

SEQ ID NO: 423469 - DNA, 25 bp, Mus musculus
gacgtcgaaagtcccgccgagtatg

SEQ ID NO: 423470 - DNA, 25 bp, Mus musculus
tcctttggatctgggccgcagtccc

SEQ ID NO: 423471 - DNA, 25 bp, Mus musculus
cagtcccgggacagcctcggaggac

SEQ ID NO: 423472 - DNA, 25 bp, Mus musculus
gccttctcctgtgggaggccaccgt

SEQ ID NO: 423473 - DNA, 25 bp, Mus musculus
agcgcgacttcctctttcggcgggg

SEQ ID NO: 423474 - DNA, 25 bp, Mus musculus
ctcacggttccgaggtactgtgctc

SEQ ID NO: 423475 - DNA, 25 bp, Mus musculus
ggtcggacaccgctcctcctgggtg

SEQ ID NO: 423476 - DNA, 25 bp, Mus musculus
gccttcaacctggacgtcgaaagtc

SEQ ID NO: 423477 - DNA, 25 bp, Mus musculus
actgaagtctttcggctctgcgccc

SEQ ID NO: 423478 - DNA, 25 bp, Mus musculus
tcccgccgagtatgcgggtcccgag

SEQ ID NO: 423479 - DNA, 25 bp, Mus musculus
ttacttcggattcgccgtggacttc

SEQ ID NO: 423480 - DNA, 25 bp, Mus musculus
tggacttcttcgagcccagcacgtc

SEQ ID NO: 423481 - DNA, 25 bp, Mus musculus
cagcacgtcctcgtaagtggccgcg

SEQ ID NO: 423482 - DNA, 25 bp, Mus musculus
ccgggttccgcagccctggcgcccg

SEQ ID NO: 423483 - DNA, 25 bp, Mus musculus
cgaaagcgggctcgccatcctcttg

SEQ ID NO: 423484 - DNA, 25 bp, Mus musculus
cttcgccatggcgaggctctgccgt

SEQ ID NO: 423485 - DNA, 25 bp, Mus musculus
ctcctgccgaggctgtgcaccgcag

SEQ ID NO: 423486 - DNA, 25 bp, Mus musculus
gctagagccgaactcagtcgctccg

SEQ ID NO: 423487 - DNA, 25 bp, Mus musculus
gtcacgtgcgcgaggatgcgaaagc

SEQ ID NO: 423488 - DNA, 25 bp, Mus musculus
aatatgcctccgtggctccctggct

SEQ ID NO: 423489 - DNA, 25 bp, Mus musculus
gtggctccctggctcttcgccatgg

SEQ ID NO: 423490 - DNA, 25 bp, Mus musculus
tcgccatcctcttgccggcccgctc

SEQ ID NO: 423491 - DNA, 25 bp, Mus musculus
tccctggctcttcgccatggcgagg

SEQ ID NO: 423492 - DNA, 25 bp, Mus musculus
cgcggccgctagagccgaactcagt

SEQ ID NO: 423493 - DNA, 25 bp, Mus musculus
gcctggccgctgtgctgctgaaggc

SEQ ID NO: 423494 - DNA, 25 bp, Mus musculus
atggcgaggctctgccgtcgcgtcc

SEQ ID NO: 423495 - DNA, 25 bp, Mus musculus
tgcgaaagcgggctcgccatcctct

SEQ ID NO: 423496 - DNA, 25 bp, Mus musculus
ccggtgggtcttgcttttctcacgt

SEQ ID NO: 423497 - DNA, 25 bp, Mus musculus
ttgaagaatgaatgacagacttccg

SEQ ID NO: 423498 - DNA, 25 bp, Mus musculus
aagaatgaatgacagacttccggta

SEQ ID NO: 423499 - DNA, 25 bp, Mus musculus
gaatgaatgacagacttccggtatg

SEQ ID NO: 423500 - DNA, 25 bp, Mus musculus
tgaatgacagacttccggtatgatg

SEQ ID NO: 423501 - DNA, 25 bp, Mus musculus
gcccggtgggtcttgcttttctcac

SEQ ID NO: 423502 - DNA, 25 bp, Mus musculus
cggtgggtcttgcttttctcacgtg

SEQ ID NO: 423503 - DNA, 25 bp, Mus musculus
gtgggtcttgcttttctcacgtggc

SEQ ID NO: 423504 - DNA, 25 bp, Mus musculus
gggtcttgcttttctcacgtggctg

SEQ ID NO: 423505 - DNA, 25 bp, Mus musculus
ggtcttgcttttctcacgtggctgc

SEQ ID NO: 423506 - DNA, 25 bp, Mus musculus
tcttgcttttctcacgtggctgcgc

SEQ ID NO: 423507 - DNA, 25 bp, Mus musculus
tctccaccgacggcctgcgaggtgt

SEQ ID NO: 423508 - DNA, 25 bp, Mus musculus
cggcctgcgaggtgtggtgtgagcc

SEQ ID NO: 423509 - DNA, 25 bp, Mus musculus
gaatgacagacttccggtatgatgg

SEQ ID NO: 423510 - DNA, 25 bp, Mus musculus
ggagcctgatctcaaaaccggcctt

SEQ ID NO: 423511 - DNA, 25 bp, Mus musculus
agcgagcgcctctttccaagttcgg

SEQ ID NO: 423512 - DNA, 25 bp, Mus musculus
tccagctgctgaccgagaacgaact

SEQ ID NO: 423513 - DNA, 25 bp, Mus musculus
gcaagcaggagctcatcaaagagta

SEQ ID NO: 423514 - DNA, 25 bp, Mus musculus
cacgccgagagcctgcagaacatga

SEQ ID NO: 423515 - DNA, 25 bp, Mus musculus
tctcggagacgtacgagcggtacca

SEQ ID NO: 423516 - DNA, 25 bp, Mus musculus
ccgacgacaccagcgatgaggattt

SEQ ID NO: 423517 - DNA, 25 bp, Mus musculus
ccacgcagttcctcatggatgacca

SEQ ID NO: 423518 - DNA, 25 bp, Mus musculus
ggccagccagttgcgccctataaca

SEQ ID NO: 423519 - DNA, 25 bp, Mus musculus
cgagatgttcgccaagggccagcca

SEQ ID NO: 423520 - DNA, 25 bp, Mus musculus
ggaagccctactacaagctgacttg

SEQ ID NO: 423521 - DNA, 25 bp, Mus musculus
ccaggtcatgactcggaggccacca

SEQ ID NO: 423522 - DNA, 25 bp, Mus musculus
agcgagtttctgcagcgggacttct

SEQ ID NO: 423523 - DNA, 25 bp, Mus musculus
ccgatgtcagagtccctcgtgcagc

SEQ ID NO: 423524 - DNA, 25 bp, Mus musculus
ggcgccaaggagaaactacagaacc

SEQ ID NO: 423525 - DNA, 25 bp, Mus musculus
tgaggatgacgtattccggacgcgc

SEQ ID NO: 423526 - DNA, 25 bp, Mus musculus
tcgtcgtcatcactcccagtgcatg

SEQ ID NO: 423527 - DNA, 25 bp, Mus musculus
tcggcgtcaactccctggagacttc

SEQ ID NO: 423528 - DNA, 25 bp, Mus musculus
gcggccgtccaatgaggatgacgta

SEQ ID NO: 423529 - DNA, 25 bp, Mus musculus
aggaaggaagcagtcaggaaccctc

SEQ ID NO: 423530 - DNA, 25 bp, Mus musculus
agtcaggaaccctcgacgcccggag

SEQ ID NO: 423531 - DNA, 25 bp, Mus musculus
gtggcctcagacctcgtcgtcatca

SEQ ID NO: 423532 - DNA, 25 bp, Mus musculus
actcccagtgcatgtgggtgctgga

SEQ ID NO: 423533 - DNA, 25 bp, Mus musculus
ggagaaactacagaacccgtgtgga

SEQ ID NO: 423534 - DNA, 25 bp, Mus musculus
cagaacccgtgtggacgaagccagc

SEQ ID NO: 423535 - DNA, 25 bp, Mus musculus
agggccagccctgatttcaggcctc

SEQ ID NO: 423536 - DNA, 25 bp, Mus musculus
atttcaggcctccactagcgccttg

SEQ ID NO: 423537 - DNA, 25 bp, Mus musculus
cctcgtctgattggctcgcccagga

SEQ ID NO: 423538 - DNA, 25 bp, Mus musculus
gaacttcattttggcggctgcgatc

SEQ ID NO: 423539 - DNA, 25 bp, Mus musculus
cgaacgttatacttctgtctcaact

SEQ ID NO: 423540 - DNA, 25 bp, Mus musculus
cgcgaacaacctgaacttcgtcatc

SEQ ID NO: 423541 - DNA, 25 bp, Mus musculus
aacctgaacttcgtcatccttccga

SEQ ID NO: 423542 - DNA, 25 bp, Mus musculus
gaccgaacgttatacttctgtctca

SEQ ID NO: 423543 - DNA, 25 bp, Mus musculus
gcatagaccgaacgttatacttctg

SEQ ID NO: 423544 - DNA, 25 bp, Mus musculus
tgggcatagaccgaacgttatactt

SEQ ID NO: 423545 - DNA, 25 bp, Mus musculus
gaatgggcatagaccgaacgttata

SEQ ID NO: 423546 - DNA, 25 bp, Mus musculus
ccgaatgggcatagaccgaacgtta

SEQ ID NO: 423547 - DNA, 25 bp, Mus musculus
cttccgaatgggcatagaccgaacg

SEQ ID NO: 423548 - DNA, 25 bp, Mus musculus
atccttccgaatgggcatagaccga

SEQ ID NO: 423549 - DNA, 25 bp, Mus musculus
cgtcatccttccgaatgggcataga

SEQ ID NO: 423550 - DNA, 25 bp, Mus musculus
gaacttcgtcatccttccgaatggg

SEQ ID NO: 423551 - DNA, 25 bp, Mus musculus
ttcattttggcggctgcgatccacc

SEQ ID NO: 423552 - DNA, 25 bp, Mus musculus
gccgtacacgcgtcagctcgtacta

SEQ ID NO: 423553 - DNA, 25 bp, Mus musculus
tccactcacggctgttgtccgagcg

SEQ ID NO: 423554 - DNA, 25 bp, Mus musculus
cctccagttgcagagcctggctcaa

SEQ ID NO: 423555 - DNA, 25 bp, Mus musculus
ctcgtactacagacacaagcgattg

SEQ ID NO: 423556 - DNA, 25 bp, Mus musculus
caagcgattgcaaatggggtctctc

SEQ ID NO: 423557 - DNA, 25 bp, Mus musculus
ggtctctctggtctcagccgccaga

SEQ ID NO: 423558 - DNA, 25 bp, Mus musculus
ccaatgctcaatgaccacggtcgcg

SEQ ID NO: 423559 - DNA, 25 bp, Mus musculus
ttgtccaccgtctccataggcgcgg

SEQ ID NO: 423560 - DNA, 25 bp, Mus musculus
tgcaactccggagagacaaaccagc

SEQ ID NO: 423561 - DNA, 25 bp, Mus musculus
gccgggaatcacagatgcaaagttc

SEQ ID NO: 423562 - DNA, 25 bp, Mus musculus
aaagttcaaatctcgcagcaaaggg

SEQ ID NO: 423563 - DNA, 25 bp, Mus musculus
cacgtgatctgaaggcgggcccttc

SEQ ID NO: 423564 - DNA, 25 bp, Mus musculus
actacgctatcaaaagggagtcggc

SEQ ID NO: 423565 - DNA, 25 bp, Mus musculus
acgggttcacttgcacaggtagctc

SEQ ID NO: 423566 - DNA, 25 bp, Mus musculus
caccgccaccaagcgccctaggctt

SEQ ID NO: 423567 - DNA, 25 bp, Mus musculus
atcccgggtaaccaggagcgcagag

SEQ ID NO: 423568 - DNA, 25 bp, Mus musculus
ccgatcccgggtaaccaggagcgca

SEQ ID NO: 423569 - DNA, 25 bp, Mus musculus
atggagaacttcacggcactgtttg

SEQ ID NO: 423570 - DNA, 25 bp, Mus musculus
tgctatggagaacttcacggcactg

SEQ ID NO: 423571 - DNA, 25 bp, Mus musculus
gcagagtgctatggagaacttcacg

SEQ ID NO: 423572 - DNA, 25 bp, Mus musculus
agcgcagagtgctatggagaacttc

SEQ ID NO: 423573 - DNA, 25 bp, Mus musculus
agaacttcacggcactgtttggagc

SEQ ID NO: 423574 - DNA, 25 bp, Mus musculus
acttcacggcactgtttggagctca

SEQ ID NO: 423575 - DNA, 25 bp, Mus musculus
ttcacggcactgtttggagctcaga

SEQ ID NO: 423576 - DNA, 25 bp, Mus musculus
tcggcccccgcaggagcggataagt

SEQ ID NO: 423577 - DNA, 25 bp, Mus musculus
cactgtttggagctcagactgaccc

SEQ ID NO: 423578 - DNA, 25 bp, Mus musculus
tcctccgggaggtggtccaggcgca

SEQ ID NO: 423579 - DNA, 25 bp, Mus musculus
cggcactgtttggagctcagactga

SEQ ID NO: 423580 - DNA, 25 bp, Mus musculus
tagcccagcacttccggttccgcag

SEQ ID NO: 423581 - DNA, 25 bp, Mus musculus
ccagcagtgccgtctggcctctgag

SEQ ID NO: 423582 - DNA, 25 bp, Mus musculus
cctggcccagaaaacacggaatcca

SEQ ID NO: 423583 - DNA, 25 bp, Mus musculus
ctccggtctgtagcctcacgacgtt

SEQ ID NO: 423584 - DNA, 25 bp, Mus musculus
aacacggaatccaccgcgcgcaggg

SEQ ID NO: 423585 - DNA, 25 bp, Mus musculus
cggccgcggctctcttagtctgcgg

SEQ ID NO: 423586 - DNA, 25 bp, Mus musculus
ctctcttagtctgcgggcgtccgtt

SEQ ID NO: 423587 - DNA, 25 bp, Mus musculus
ccgtcgttgtcaccgccgtcgttgt

SEQ ID NO: 423588 - DNA, 25 bp, Mus musculus
aacacgtagtgacacgggagcgcgc

SEQ ID NO: 423589 - DNA, 25 bp, Mus musculus
tgtagcctcacgacgttcccattgg

SEQ ID NO: 423590 - DNA, 25 bp, Mus musculus
acggcgccgcaaacacgtagtgaca

SEQ ID NO: 423591 - DNA, 25 bp, Mus musculus
tgccgtctggcctctgagaggcagc

SEQ ID NO: 423592 - DNA, 25 bp, Mus musculus
ctctcgcggggcacgttcttctcat

SEQ ID NO: 423593 - DNA, 25 bp, Mus musculus
ttcttctcattcatgcggctcgcgc

SEQ ID NO: 423594 - DNA, 25 bp, Mus musculus
ttgcgcagtagtagaagacgcgatc

SEQ ID NO: 423595 - DNA, 25 bp, Mus musculus
ttcaaggattgttcggtgacccgcg

SEQ ID NO: 423596 - DNA, 25 bp, Mus musculus
ctctgggaaatatagttcaaggatt

SEQ ID NO: 423597 - DNA, 25 bp, Mus musculus
tggccctctgggaaatatagttcaa

SEQ ID NO: 423598 - DNA, 25 bp, Mus musculus
gcaaaccacgaataacgttcaccta

SEQ ID NO: 423599 - DNA, 25 bp, Mus musculus
agacgcgatcgcgtgatgcatcttg

SEQ ID NO: 423600 - DNA, 25 bp, Mus musculus
agcgccgtcactttgtgtgggaaga

SEQ ID NO: 423601 - DNA, 25 bp, Mus musculus
gaggagaagttgctggttcgccctc

SEQ ID NO: 423602 - DNA, 25 bp, Mus musculus
tccgcaattgcgcagtagtagaaga

SEQ ID NO: 423603 - DNA, 25 bp, Mus musculus
gcaaaggcggttccgcaattgcgca

SEQ ID NO: 423604 - DNA, 25 bp, Mus musculus
ctcggacctcagcaaaccacgaata

SEQ ID NO: 423605 - DNA, 25 bp, Mus musculus
aaatactagccggaaagcaaaggcg

SEQ ID NO: 423606 - DNA, 25 bp, Mus musculus
tcacctaaatactagccggaaagca

SEQ ID NO: 423607 - DNA, 25 bp, Mus musculus
gccgcttggccctctgggaaatata

SEQ ID NO: 423608 - DNA, 25 bp, Mus musculus
agttcattgccacccttcagtacat

SEQ ID NO: 423609 - DNA, 25 bp, Mus musculus
ttccggaggcagacgacatccagta

SEQ ID NO: 423610 - DNA, 25 bp, Mus musculus
ccgccaaagtgatagaagaagtctc

SEQ ID NO: 423611 - DNA, 25 bp, Mus musculus
tgctcatccacgtggacaccaaggc

SEQ ID NO: 423612 - DNA, 25 bp, Mus musculus
ccttcagtacatcgtgggccgcagc

SEQ ID NO: 423613 - DNA, 25 bp, Mus musculus
tagatactcgccactacacaatgtg

SEQ ID NO: 423614 - DNA, 25 bp, Mus musculus
acggctgaccacgacgaccgcgtgg

SEQ ID NO: 423615 - DNA, 25 bp, Mus musculus
ccgctgcactcactgaagttcattg

SEQ ID NO: 423616 - DNA, 25 bp, Mus musculus
gaagtctcggatatgtttgcgttca

SEQ ID NO: 423617 - DNA, 25 bp, Mus musculus
tttgcgttcatagcacggtgcctga

SEQ ID NO: 423618 - DNA, 25 bp, Mus musculus
tacacaatgtgaagcttccggaggc

SEQ ID NO: 423619 - DNA, 25 bp, Mus musculus
agacgacatccagtacccgtccatg

SEQ ID NO: 423620 - DNA, 25 bp, Mus musculus
gtggtcccgctgcactcactgaagt

SEQ ID NO: 423621 - DNA, 25 bp, Mus musculus
ttcatagcacggtgcctgaacatcg

SEQ ID NO: 423622 - DNA, 25 bp, Mus musculus
acagcagaggggaagccgtcttact

SEQ ID NO: 423623 - DNA, 25 bp, Mus musculus
ctgcgagccagggtctccaactggc

SEQ ID NO: 423624 - DNA, 25 bp, Mus musculus
gcagacctcggcctcaggatcacgt

SEQ ID NO: 423625 - DNA, 25 bp, Mus musculus
atcacgtcccggtggaagcacagca

SEQ ID NO: 423626 - DNA, 25 bp, Mus musculus
tgttgacaaaagtcgggagactggc

SEQ ID NO: 423627 - DNA, 25 bp, Mus musculus
ttactggcctctcctctgctgggat

SEQ ID NO: 423628 - DNA, 25 bp, Mus musculus
cccaaaaggccgctctcaaaggcga

SEQ ID NO: 423629 - DNA, 25 bp, Mus musculus
gcgggtccagttgtgcttccgcaca

SEQ ID NO: 423630 - DNA, 25 bp, Mus musculus
gctagggaatccctccgcgcgcaag

SEQ ID NO: 423631 - DNA, 25 bp, Mus musculus
ggcagacaagcgacccaatcaaaga

SEQ ID NO: 423632 - DNA, 25 bp, Mus musculus
gcgaccggatctctatttctccctg

SEQ ID NO: 423633 - DNA, 25 bp, Mus musculus
tggtaaagcctaacgccatcaatga

SEQ ID NO: 423634 - DNA, 25 bp, Mus musculus
tctttaattgagctctgacagggcg

SEQ ID NO: 423635 - DNA, 25 bp, Mus musculus
gcttccgcacagctagttgttgaca

SEQ ID NO: 423636 - DNA, 25 bp, Mus musculus
gaccgaggctccaggataagctggc

SEQ ID NO: 423637 - DNA, 25 bp, Mus musculus
gccctctcgtatcccgctagcctct

SEQ ID NO: 423638 - DNA, 25 bp, Mus musculus
gaaaagcgccgagctcccaatacct

SEQ ID NO: 423639 - DNA, 25 bp, Mus musculus
caggaccgaggctccaggataagct

SEQ ID NO: 423640 - DNA, 25 bp, Mus musculus
cccgccaggctcgagtcctcgccgg

SEQ ID NO: 423641 - DNA, 25 bp, Mus musculus
tctcacgccctctcgtatcccgcta

SEQ ID NO: 423642 - DNA, 25 bp, Mus musculus
acatcgctcttcttaggttcctctg

SEQ ID NO: 423643 - DNA, 25 bp, Mus musculus
acacatcgctcttcttaggttcctc

SEQ ID NO: 423644 - DNA, 25 bp, Mus musculus
ctacacatcgctcttcttaggttcc

SEQ ID NO: 423645 - DNA, 25 bp, Mus musculus
atacctacacatcgctcttcttagg

SEQ ID NO: 423646 - DNA, 25 bp, Mus musculus
caatacctacacatcgctcttctta

SEQ ID NO: 423647 - DNA, 25 bp, Mus musculus
gcgccgagctcccaatacctacaca

SEQ ID NO: 423648 - DNA, 25 bp, Mus musculus
aaaagcgccgagctcccaataccta

SEQ ID NO: 423649 - DNA, 25 bp, Mus musculus
ccaggctcgagtcctcgccggccgc

SEQ ID NO: 423650 - DNA, 25 bp, Mus musculus
gtaaatacagctatcaactccgcag

SEQ ID NO: 423651 - DNA, 25 bp, Mus musculus
aggacggttcccagatccactgctt

SEQ ID NO: 423652 - DNA, 25 bp, Mus musculus
ggcgccaggacggttcccagatcca

SEQ ID NO: 423653 - DNA, 25 bp, Mus musculus
ttcacctatctgtggcgccaggacg

SEQ ID NO: 423654 - DNA, 25 bp, Mus musculus
tggcttcccggcttcacctatctgt

SEQ ID NO: 423655 - DNA, 25 bp, Mus musculus
tatcaactccgcagatcgcgtagtc

SEQ ID NO: 423656 - DNA, 25 bp, Mus musculus
tgctcccaacgcctgtaaatacagc

SEQ ID NO: 423657 - DNA, 25 bp, Mus musculus
tgcatgaaactcgacctaaggggtg

SEQ ID NO: 423658 - DNA, 25 bp, Mus musculus
cacgtgtgcatgaaactcgacctaa

SEQ ID NO: 423659 - DNA, 25 bp, Mus musculus
ccaacaggcgagtcacgtgtgcatg

SEQ ID NO: 423660 - DNA, 25 bp, Mus musculus
atctggggaccaacaggcgagtcac

SEQ ID NO: 423661 - DNA, 25 bp, Mus musculus
taagaaaagtatctggggaccaaca

SEQ ID NO: 423662 - DNA, 25 bp, Mus musculus
gggcgcactgggtaagaaaagtatc

SEQ ID NO: 423663 - DNA, 25 bp, Mus musculus
gatcgcgtagtccatgccctggctt

SEQ ID NO: 423664 - DNA, 25 bp, Mus musculus
aggaagttgcttcgctcagaccaga

SEQ ID NO: 423665 - DNA, 25 bp, Mus musculus
aggagtagaatgaaaggcgtaacta

SEQ ID NO: 423666 - DNA, 25 bp, Mus musculus
aggcgtaactagaatagagggtctc

SEQ ID NO: 423667 - DNA, 25 bp, Mus musculus
ctcctgctcgcttctgagaatccga

SEQ ID NO: 423668 - DNA, 25 bp, Mus musculus
ttctgagaatccgatctggtgccta

SEQ ID NO: 423669 - DNA, 25 bp, Mus musculus
atctggtgcctagaggctggctagc

SEQ ID NO: 423670 - DNA, 25 bp, Mus musculus
cccttggtgactttgagagactttg

SEQ ID NO: 423671 - DNA, 25 bp, Mus musculus
ctttgagagactttgggaacttggg

SEQ ID NO: 423672 - DNA, 25 bp, Mus musculus
ccggcagcgcgccaggaagttgctt

SEQ ID NO: 423673 - DNA, 25 bp, Mus musculus
cttcgctcagaccagacctttctgg

SEQ ID NO: 423674 - DNA, 25 bp, Mus musculus
cagtggcgcgttcgctcctggcact

SEQ ID NO: 423675 - DNA, 25 bp, Mus musculus
ccctccacgtggcagccgtgggatt

SEQ ID NO: 423676 - DNA, 25 bp, Mus musculus
tttctggttcctgatagcgccctgc

SEQ ID NO: 423677 - DNA, 25 bp, Mus musculus
tttctacccgggctctggagaggag

SEQ ID NO: 423678 - DNA, 25 bp, Mus musculus
tcatctcttcccagaaagaggggcg

SEQ ID NO: 423679 - DNA, 25 bp, Mus musculus
aagctagagccgtgtttgtcgcggc

SEQ ID NO: 423680 - DNA, 25 bp, Mus musculus
agccgtgtttgtcgcggcgctgcct

SEQ ID NO: 423681 - DNA, 25 bp, Mus musculus
cgctgcctagaggaacagatggctg

SEQ ID NO: 423682 - DNA, 25 bp, Mus musculus
atgaggaacgaggaatttcgacgcc

SEQ ID NO: 423683 - DNA, 25 bp, Mus musculus
cggaagcaagctagagccgtgtttg

SEQ ID NO: 423684 - DNA, 25 bp, Mus musculus
tcttcccagaaagaggggcgggcaa

SEQ ID NO: 423685 - DNA, 25 bp, Mus musculus
gcaagcgcctgtggtttcccaagga

SEQ ID NO: 423686 - DNA, 25 bp, Mus musculus
gcgcctgtggtttcccaaggagccc

SEQ ID NO: 423687 - DNA, 25 bp, Mus musculus
cctttgagaggtccaccgcccaggg

SEQ ID NO: 423688 - DNA, 25 bp, Mus musculus
ctcgcttgctccttcggagggactg

SEQ ID NO: 423689 - DNA, 25 bp, Mus musculus
cttgctccttcggagggactggcta

SEQ ID NO: 423690 - DNA, 25 bp, Mus musculus
gctctctgggttgggagcgagttca

SEQ ID NO: 423691 - DNA, 25 bp, Mus musculus
gaggaatttcgacgcccgagtctcc

SEQ ID NO: 423692 - DNA, 25 bp, Mus musculus
ccaaggcgtggcctcttccgtctaa

SEQ ID NO: 423693 - DNA, 25 bp, Mus musculus
aacacgtgctccgtgagcagccgca

SEQ ID NO: 423694 - DNA, 25 bp, Mus musculus
aagccgcggaacacgtgctccgtga

SEQ ID NO: 423695 - DNA, 25 bp, Mus musculus
ggttcccgtgcagcaacagccggtc

SEQ ID NO: 423696 - DNA, 25 bp, Mus musculus
agcgaggccaggctgttgttgaaca

SEQ ID NO: 423697 - DNA, 25 bp, Mus musculus
cgttgagccgcaggaactcgagcgc

SEQ ID NO: 423698 - DNA, 25 bp, Mus musculus
gcgcgctggaaccaagcccagagcg

SEQ ID NO: 423699 - DNA, 25 bp, Mus musculus
caggtcacgtcggagctggacaccc

SEQ ID NO: 423700 - DNA, 25 bp, Mus musculus
cacgcttggaaatcggagtcgcgca

SEQ ID NO: 423701 - DNA, 25 bp, Mus musculus
ccacgccgtacaggtggttggaaga

SEQ ID NO: 423702 - DNA, 25 bp, Mus musculus
tcctcggcgggcagatctcggtaga

SEQ ID NO: 423703 - DNA, 25 bp, Mus musculus
cccagtagtcgtcctcggtgggcgc

SEQ ID NO: 423704 - DNA, 25 bp, Mus musculus
ttccgtctaagcaccgcagtcagag

SEQ ID NO: 423705 - DNA, 25 bp, Mus musculus
aagcaccgcagtcagaggtgatgga

SEQ ID NO: 423706 - DNA, 25 bp, Mus musculus
tcctagaccctcagggcggtttgca

SEQ ID NO: 423707 - DNA, 25 bp, Mus musculus
gaaggctgtgttcccgtagcctctg

SEQ ID NO: 423708 - DNA, 25 bp, Mus musculus
gcgctaagcggttttttgctcccta

SEQ ID NO: 423709 - DNA, 25 bp, Mus musculus
ggtgtccctaccttgcagcaggcgc

SEQ ID NO: 423710 - DNA, 25 bp, Mus musculus
cgggcagcatcttgtctcgacgatc

SEQ ID NO: 423711 - DNA, 25 bp, Mus musculus
taaccctttgctggctactaggagg

SEQ ID NO: 423712 - DNA, 25 bp, Mus musculus
agggagtagttctccatctagacca

SEQ ID NO: 423713 - DNA, 25 bp, Mus musculus
gcggcgccatgcctttagagaaatc

SEQ ID NO: 423714 - DNA, 25 bp, Mus musculus
tagagaaatcccttcttggtgtgtg

SEQ ID NO: 423715 - DNA, 25 bp, Mus musculus
cgcgcgcatgcagtagtgttaagtc

SEQ ID NO: 423716 - DNA, 25 bp, Mus musculus
tcagggtgaggatttcccaactttc

SEQ ID NO: 423717 - DNA, 25 bp, Mus musculus
ctttcccagaagatatgcagtttca

SEQ ID NO: 423718 - DNA, 25 bp, Mus musculus
tcgcgatcgtttgcgtcccttaaag

SEQ ID NO: 423719 - DNA, 25 bp, Mus musculus
tgcagtttcagagcagtttcccact

SEQ ID NO: 423720 - DNA, 25 bp, Mus musculus
tcgctaaactgtggagccttttttg

SEQ ID NO: 423721 - DNA, 25 bp, Mus musculus
cggcgctggcaagtccagattgaga

SEQ ID NO: 423722 - DNA, 25 bp, Mus musculus
ctcatgatggggctgatcttcgcta

SEQ ID NO: 423723 - DNA, 25 bp, Mus musculus
ccgccgagtgctgcccaggaagtct

SEQ ID NO: 423724 - DNA, 25 bp, Mus musculus
aagcttcgctggactcttgaggctc

SEQ ID NO: 423725 - DNA, 25 bp, Mus musculus
ctccgcggaggaccaaagcttcgct

SEQ ID NO: 423726 - DNA, 25 bp, Mus musculus
cagcgcgctgcgaacaaaggagtct

SEQ ID NO: 423727 - DNA, 25 bp, Mus musculus
tcacgtgccgaccttccggcgatgg

SEQ ID NO: 423728 - DNA, 25 bp, Mus musculus
accatccgcacaccggaagtgtaca

SEQ ID NO: 423729 - DNA, 25 bp, Mus musculus
cgcgtttcttcagagtggcaggaga

SEQ ID NO: 423730 - DNA, 25 bp, Mus musculus
tctggacctcagtccgcgtttcttc

SEQ ID NO: 423731 - DNA, 25 bp, Mus musculus
accgcgccagctgaggttcctcagg

SEQ ID NO: 423732 - DNA, 25 bp, Mus musculus
cgcttcagtcagaggaccgcgccag

SEQ ID NO: 423733 - DNA, 25 bp, Mus musculus
ggacgcacccgatggccaggaatcc

SEQ ID NO: 423734 - DNA, 25 bp, Mus musculus
gggctcctcttcatacctgtgcctg

SEQ ID NO: 423735 - DNA, 25 bp, Mus musculus
ccatctggatgcagtcggaccctgc

SEQ ID NO: 423736 - DNA, 25 bp, Mus musculus
ggatgcagtcggaccctgcctgcga

SEQ ID NO: 423737 - DNA, 25 bp, Mus musculus
gtggagcggaggaacccttagtcca

SEQ ID NO: 423738 - DNA, 25 bp, Mus musculus
agcggaggaacccttagtccaggca

SEQ ID NO: 423739 - DNA, 25 bp, Mus musculus
gaacccttagtccaggcacgggctc

SEQ ID NO: 423740 - DNA, 25 bp, Mus musculus
cttagtccaggcacgggctcctctt

SEQ ID NO: 423741 - DNA, 25 bp, Mus musculus
ccagggccatctggatgcagtcgga

SEQ ID NO: 423742 - DNA, 25 bp, Mus musculus
cgctgtgcacggcatacagtcggcg

SEQ ID NO: 423743 - DNA, 25 bp, Mus musculus
tcctcttcatacctgtgcctgggtc

SEQ ID NO: 423744 - DNA, 25 bp, Mus musculus
tgtgcctgggtccaacgctgtgcac

SEQ ID NO: 423745 - DNA, 25 bp, Mus musculus
ggtccaacgctgtgcacggcataca

SEQ ID NO: 423746 - DNA, 25 bp, Mus musculus
ccaacgctgtgcacggcatacagtc

SEQ ID NO: 423747 - DNA, 25 bp, Mus musculus
ggcacgggctcctcttcatacctgt

SEQ ID NO: 423748 - DNA, 25 bp, Mus musculus
gatttggcgtccttccccggaatga

SEQ ID NO: 423749 - DNA, 25 bp, Mus musculus
atatcacaagatgcggagacagacg

SEQ ID NO: 423750 - DNA, 25 bp, Mus musculus
cggggagcgaaatatcacaagatgc

SEQ ID NO: 423751 - DNA, 25 bp, Mus musculus
tcccggggagcgaaatatcacaaga

SEQ ID NO: 423752 - DNA, 25 bp, Mus musculus
ctggctcccggggagcgaaatatca

SEQ ID NO: 423753 - DNA, 25 bp, Mus musculus
tccggagcgcaatggggctggctcc

SEQ ID NO: 423754 - DNA, 25 bp, Mus musculus
tgtttgccgagctgcctccggagcg

SEQ ID NO: 423755 - DNA, 25 bp, Mus musculus
atttgtttgccgagctgcctccgga

SEQ ID NO: 423756 - DNA, 25 bp, Mus musculus
cgctggatttgtttgccgagctgcc

SEQ ID NO: 423757 - DNA, 25 bp, Mus musculus
atctgtcgctggatttgtttgccga

SEQ ID NO: 423758 - DNA, 25 bp, Mus musculus
ggcacaatctgtcgctggatttgtt

SEQ ID NO: 423759 - DNA, 25 bp, Mus musculus
cgcggcacaatctgtcgctggattt

SEQ ID NO: 423760 - DNA, 25 bp, Mus musculus
aatgagccgcggcacaatctgtcgc

SEQ ID NO: 423761 - DNA, 25 bp, Mus musculus
cacaagatgcggagacagacgctga

SEQ ID NO: 423762 - DNA, 25 bp, Mus musculus
cgtgggattccatagcaagcctctc

SEQ ID NO: 423763 - DNA, 25 bp, Mus musculus
gcctgtccgtggaacgtaccgagag

SEQ ID NO: 423764 - DNA, 25 bp, Mus musculus
agcctctcgctttagccgaccaggg

SEQ ID NO: 423765 - DNA, 25 bp, Mus musculus
ctctaggcgaatgtacccgttggtc

SEQ ID NO: 423766 - DNA, 25 bp, Mus musculus
cggatgatgccgttctagccaagtc

SEQ ID NO: 423767 - DNA, 25 bp, Mus musculus
agtcttcctctctatggtccgtgcg

SEQ ID NO: 423768 - DNA, 25 bp, Mus musculus
tcgcgaggctgcagctcttagaggt

SEQ ID NO: 423769 - DNA, 25 bp, Mus musculus
atcggaatggatcgatccgcgttca

SEQ ID NO: 423770 - DNA, 25 bp, Mus musculus
tccgcgttcaaattcgcgggcaatg

SEQ ID NO: 423771 - DNA, 25 bp, Mus musculus
cgggcaatgggcgaatccattttaa

SEQ ID NO: 423772 - DNA, 25 bp, Mus musculus
gggtctctgcgatcaggacactacc

SEQ ID NO: 423773 - DNA, 25 bp, Mus musculus
gacactaccctctgagcggagttga

SEQ ID NO: 423774 - DNA, 25 bp, Mus musculus
agtgccgacgctctaggcgaatgta

SEQ ID NO: 423775 - DNA, 25 bp, Mus musculus
cgggtctcaggttccgccgattgtt

SEQ ID NO: 423776 - DNA, 25 bp, Mus musculus
cttaggtttctaaggcgcgcgcgga

SEQ ID NO: 423777 - DNA, 25 bp, Mus musculus
atgacaggggctccgcatgcgtccc

SEQ ID NO: 423778 - DNA, 25 bp, Mus musculus
acctcagcgccaccttaggtttcta

SEQ ID NO: 423779 - DNA, 25 bp, Mus musculus
cagaagttcgaaaatcgccgagggg

SEQ ID NO: 423780 - DNA, 25 bp, Mus musculus
cgcgcgcggattggttggacaatct

SEQ ID NO: 423781 - DNA, 25 bp, Mus musculus
cggagaactgcggtttgcgcgcacc

SEQ ID NO: 423782 - DNA, 25 bp, Mus musculus
gagcggcagcagaagttcgaaaatc

SEQ ID NO: 423783 - DNA, 25 bp, Mus musculus
gctgagccgagagccacctagccaa

SEQ ID NO: 423784 - DNA, 25 bp, Mus musculus
ggaaaactggatctccgaggctgga

SEQ ID NO: 423785 - DNA, 25 bp, Mus musculus
accaccatgggcaacgcggctggca

SEQ ID NO: 423786 - DNA, 25 bp, Mus musculus
aacgcggctggcagcgccgaacagc

SEQ ID NO: 423787 - DNA, 25 bp, Mus musculus
caagcaaccaatgccggcggccggg

SEQ ID NO: 423788 - DNA, 25 bp, Mus musculus
gtgtgacctgatgcgcaccaggagc

SEQ ID NO: 423789 - DNA, 25 bp, Mus musculus
attggttggacaatcttccgcccgg

SEQ ID NO: 423790 - DNA, 25 bp, Mus musculus
caccgagtcctcgtcgtcagtcctc

SEQ ID NO: 423791 - DNA, 25 bp, Mus musculus
tccgtgcagtgagccagaagaaagc

SEQ ID NO: 423792 - DNA, 25 bp, Mus musculus
tccgtctgttccttcgagggctgct

SEQ ID NO: 423793 - DNA, 25 bp, Mus musculus
tagccgctcggtgtccgtaagctcc

SEQ ID NO: 423794 - DNA, 25 bp, Mus musculus
tcctcttcggctagccgctcggtgt

SEQ ID NO: 423795 - DNA, 25 bp, Mus musculus
tggcatctcgctcagtcttccgctg

SEQ ID NO: 423796 - DNA, 25 bp, Mus musculus
ggctgcttggcatctcgctcagtct

SEQ ID NO: 423797 - DNA, 25 bp, Mus musculus
ttccttcgagggctgcttggcatct

SEQ ID NO: 423798 - DNA, 25 bp, Mus musculus
tgcctcgctgagtggagccggtccc

SEQ ID NO: 423799 - DNA, 25 bp, Mus musculus
aaggcgtccgtgcagtgagccagaa

SEQ ID NO: 423800 - DNA, 25 bp, Mus musculus
tcaccaggaaagtttgcgagggcct

SEQ ID NO: 423801 - DNA, 25 bp, Mus musculus
cctagcagccgggaccttagattgg

SEQ ID NO: 423802 - DNA, 25 bp, Mus musculus
gggcatggaaagaacccggcgccta

SEQ ID NO: 423803 - DNA, 25 bp, Mus musculus
gtcagtcctccgtctgttccttcga

SEQ ID NO: 423804 - DNA, 25 bp, Mus musculus
ttgttcctcgctgcctgaagccacg

SEQ ID NO: 423805 - DNA, 25 bp, Mus musculus
gcggccttgttcctcgctgcctgaa

SEQ ID NO: 423806 - DNA, 25 bp, Mus musculus
ggccttgttcctcgctgcctgaagc

SEQ ID NO: 423807 - DNA, 25 bp, Mus musculus
ctctacctggcggaccccatgaagg

SEQ ID NO: 423808 - DNA, 25 bp, Mus musculus
gttcctcgctgcctgaagccacgat

SEQ ID NO: 423809 - DNA, 25 bp, Mus musculus
gcctgaagccacgatgcctcagttc

SEQ ID NO: 423810 - DNA, 25 bp, Mus musculus
ctgaagccacgatgcctcagttcca

SEQ ID NO: 423811 - DNA, 25 bp, Mus musculus
tctacctggcggaccccatgaaggt

SEQ ID NO: 423812 - DNA, 25 bp, Mus musculus
aagccacgatgcctcagttccagac

SEQ ID NO: 423813 - DNA, 25 bp, Mus musculus
cacgatgcctcagttccagacctgg

SEQ ID NO: 423814 - DNA, 25 bp, Mus musculus
cagacctgggaggagttcagccggg

SEQ ID NO: 423815 - DNA, 25 bp, Mus musculus
gggaggagttcagccgggcggccga

SEQ ID NO: 423816 - DNA, 25 bp, Mus musculus
tgaagccacgatgcctcagttccag

SEQ ID NO: 423817 - DNA, 25 bp, Mus musculus
cggccttgttcctcgctgcctgaag

SEQ ID NO: 423818 - DNA, 25 bp, Mus musculus
cttacctggccctggcgtagcaaca

SEQ ID NO: 423819 - DNA, 25 bp, Mus musculus
gaaggctcccaggaccacgatctct

SEQ ID NO: 423820 - DNA, 25 bp, Mus musculus
atctctcagaccctcgccgggtgtt

SEQ ID NO: 423821 - DNA, 25 bp, Mus musculus
gcgatgccaattcggcccgcgtctt

SEQ ID NO: 423822 - DNA, 25 bp, Mus musculus
cctgcagcccatgcgggagcttcta

SEQ ID NO: 423823 - DNA, 25 bp, Mus musculus
acgtgaccagctccgggaaaggccg

SEQ ID NO: 423824 - DNA, 25 bp, Mus musculus
aggcccactcgagagcttacctggc

SEQ ID NO: 423825 - DNA, 25 bp, Mus musculus
cccatgcgggagcttctatggaaga

SEQ ID NO: 423826 - DNA, 25 bp, Mus musculus
ttctatggaagagtcaacgggcacg

SEQ ID NO: 423827 - DNA, 25 bp, Mus musculus
ccaggaggaaggctcccaggaccac

SEQ ID NO: 423828 - DNA, 25 bp, Mus musculus
cgcggccttagactcgcaggggctt

SEQ ID NO: 423829 - DNA, 25 bp, Mus musculus
tcctggaacgggtgacacccgggca

SEQ ID NO: 423830 - DNA, 25 bp, Mus musculus
aggtgcaggcgatgccaattcggcc

SEQ ID NO: 423831 - DNA, 25 bp, Mus musculus
gctggccagacgtgaccagctccgg

SEQ ID NO: 423832 - DNA, 25 bp, Mus musculus
gaattcacagtctgcgacattggta

SEQ ID NO: 423833 - DNA, 25 bp, Mus musculus
tgaccgcgagtcaaggcatcttctt

SEQ ID NO: 423834 - DNA, 25 bp, Mus musculus
ctcagcctcattctcgcggtgaaaa

SEQ ID NO: 423835 - DNA, 25 bp, Mus musculus
tgaaaagccgcagatgagcctccga

SEQ ID NO: 423836 - DNA, 25 bp, Mus musculus
gcggtcctcaggcagccaaaatcgc

SEQ ID NO: 423837 - DNA, 25 bp, Mus musculus
cccggaagtgacgagccgacgtgac

SEQ ID NO: 423838 - DNA, 25 bp, Mus musculus
cttcgtggaactgagcggagctgaa

SEQ ID NO: 423839 - DNA, 25 bp, Mus musculus
gcccaggcactttcgggaattcaca

SEQ ID NO: 423840 - DNA, 25 bp, Mus musculus
cacgccaacgctctaacggagggga

SEQ ID NO: 423841 - DNA, 25 bp, Mus musculus
cgctgaacgatgaagaggctggata

SEQ ID NO: 423842 - DNA, 25 bp, Mus musculus
gcccgcgcccgcttttcaaaatgaa

SEQ ID NO: 423843 - DNA, 25 bp, Mus musculus
gttcccgcaagctgggagtgtgccc

SEQ ID NO: 423844 - DNA, 25 bp, Mus musculus
agaggctggataacaacttacacgc

SEQ ID NO: 423845 - DNA, 25 bp, Mus musculus
ctgaacgcgaaaggcccaggcactt

SEQ ID NO: 423846 - DNA, 25 bp, Mus musculus
tccctttgctattggctaccgagtc

SEQ ID NO: 423847 - DNA, 25 bp, Mus musculus
gtacacctcggctgccagcgatctg

SEQ ID NO: 423848 - DNA, 25 bp, Mus musculus
cgagtccgtctcaagtcaaaacagc

SEQ ID NO: 423849 - DNA, 25 bp, Mus musculus
agccaatcgccttttccctgaacaa

SEQ ID NO: 423850 - DNA, 25 bp, Mus musculus
ggcggtgccacggttcatgaatatt

SEQ ID NO: 423851 - DNA, 25 bp, Mus musculus
tgaatattgattacgcaccggggcg

SEQ ID NO: 423852 - DNA, 25 bp, Mus musculus
cccggactcatctgaggcgcctttg

SEQ ID NO: 423853 - DNA, 25 bp, Mus musculus
actaatctgccgtcgttcgctgctc

SEQ ID NO: 423854 - DNA, 25 bp, Mus musculus
cgctccggctcatgatggggaagaa

SEQ ID NO: 423855 - DNA, 25 bp, Mus musculus
cccgatccggatcccgaggcagatt

SEQ ID NO: 423856 - DNA, 25 bp, Mus musculus
cagaggactcgccttcagaaggtaa

SEQ ID NO: 423857 - DNA, 25 bp, Mus musculus
cctgcttttatttgggacgtctgaa

SEQ ID NO: 423858 - DNA, 25 bp, Mus musculus
tctgaaactcgagcacggggcttgc

SEQ ID NO: 423859 - DNA, 25 bp, Mus musculus
cactattggcgcgaagtcctgtctt

SEQ ID NO: 423860 - DNA, 25 bp, Mus musculus
acactccgaggcagggcgctcagaa

SEQ ID NO: 423861 - DNA, 25 bp, Mus musculus
gtagccaggcagcgcggtgtcaccc

SEQ ID NO: 423862 - DNA, 25 bp, Mus musculus
gggctccggtggaaacttctgctct

SEQ ID NO: 423863 - DNA, 25 bp, Mus musculus
tccggtggaaacttctgctctgtcc

SEQ ID NO: 423864 - DNA, 25 bp, Mus musculus
tctgtccttccttgggcttgcctct

SEQ ID NO: 423865 - DNA, 25 bp, Mus musculus
tgggcttgcctctgggcagtccaca

SEQ ID NO: 423866 - DNA, 25 bp, Mus musculus
agtccacactccgaggcagggcgct

SEQ ID NO: 423867 - DNA, 25 bp, Mus musculus
cagggcgctcagaactgaacgtttc

SEQ ID NO: 423868 - DNA, 25 bp, Mus musculus
cgctcagaactgaacgtttccaggg

SEQ ID NO: 423869 - DNA, 25 bp, Mus musculus
actgaacgtttccagggctctcgct

SEQ ID NO: 423870 - DNA, 25 bp, Mus musculus
tttcaactgctctgaggcgactctg

SEQ ID NO: 423871 - DNA, 25 bp, Mus musculus
caactgctctgaggcgactctgcgc

SEQ ID NO: 423872 - DNA, 25 bp, Mus musculus
gctctgaggcgactctgcgcgtgcc

SEQ ID NO: 423873 - DNA, 25 bp, Mus musculus
tctgggcagtccacactccgaggca

SEQ ID NO: 423874 - DNA, 25 bp, Mus musculus
ctgtcccagccgctcatgtacgtga

SEQ ID NO: 423875 - DNA, 25 bp, Mus musculus
ttgcgcaggcgcaagagaaatcgcc

SEQ ID NO: 423876 - DNA, 25 bp, Mus musculus
gttggctctgcgtcccaggccttca

SEQ ID NO: 423877 - DNA, 25 bp, Mus musculus
ccctctgcgcctttgggttggctct

SEQ ID NO: 423878 - DNA, 25 bp, Mus musculus
tccaggtatgagtcgtcgccctttc

SEQ ID NO: 423879 - DNA, 25 bp, Mus musculus
cgtgaaagtgctcatccaggtatga

SEQ ID NO: 423880 - DNA, 25 bp, Mus musculus
ccgctcatgtacgtgaaagtgctca

SEQ ID NO: 423881 - DNA, 25 bp, Mus musculus
ggccttcaccctctcgagatgctgc

SEQ ID NO: 423882 - DNA, 25 bp, Mus musculus
aaccggctgtgtcgcttggtgactc

SEQ ID NO: 423883 - DNA, 25 bp, Mus musculus
acgtgatctggaaccggctgtgtcg

SEQ ID NO: 423884 - DNA, 25 bp, Mus musculus
cgagcgcctgccgtttctttgggcg

SEQ ID NO: 423885 - DNA, 25 bp, Mus musculus
gagaaatcgcctttcctagaggcgc

SEQ ID NO: 423886 - DNA, 25 bp, Mus musculus
tcgcttggtgactccgtctgtccgt

SEQ ID NO: 423887 - DNA, 25 bp, Mus musculus
gcctttcctagaggcgcgaggagcc

SEQ ID NO: 423888 - DNA, 25 bp, Mus musculus
tcagccttgggcgaagcaaagaaga

SEQ ID NO: 423889 - DNA, 25 bp, Mus musculus
attagatctgttttgaacccagtgg

SEQ ID NO: 423890 - DNA, 25 bp, Mus musculus
ccggcgcagccagtggaattagatc

SEQ ID NO: 423891 - DNA, 25 bp, Mus musculus
cctcttgaatctggaacagcaccgg

SEQ ID NO: 423892 - DNA, 25 bp, Mus musculus
tgctcagcgccctcttgaatctgga

SEQ ID NO: 423893 - DNA, 25 bp, Mus musculus
tgggaaagttcctccggtgctcagc

SEQ ID NO: 423894 - DNA, 25 bp, Mus musculus
ccgccggggccagacctaagtctgg

SEQ ID NO: 423895 - DNA, 25 bp, Mus musculus
gcctagcccggaggggctctcttac

SEQ ID NO: 423896 - DNA, 25 bp, Mus musculus
gaggggtttctccagcctccactaa

SEQ ID NO: 423897 - DNA, 25 bp, Mus musculus
aaacttgtcagaggggtttctccag

SEQ ID NO: 423898 - DNA, 25 bp, Mus musculus
tcacagcagctggtgcattcccggc

SEQ ID NO: 423899 - DNA, 25 bp, Mus musculus
tcttaccaggctgcaacctcacttt

SEQ ID NO: 423900 - DNA, 25 bp, Mus musculus
aggggctctcttaccaggctgcaac

SEQ ID NO: 423901 - DNA, 25 bp, Mus musculus
cgctcggaagtcaccgtctgtgggc

SEQ ID NO: 423902 - DNA, 25 bp, Mus musculus
cgcggcacccggtgggtaacgctca

SEQ ID NO: 423903 - DNA, 25 bp, Mus musculus
gggcgcaggcttctcttctatgcga

SEQ ID NO: 423904 - DNA, 25 bp, Mus musculus
ctcaccgagcaggatagccggctgg

SEQ ID NO: 423905 - DNA, 25 bp, Mus musculus
cgtcctcaccgagcaggatagccgg

SEQ ID NO: 423906 - DNA, 25 bp, Mus musculus
cgaccagtgtgtagcccggcgtcct

SEQ ID NO: 423907 - DNA, 25 bp, Mus musculus
cctggaggcccggtcaagccgcagc

SEQ ID NO: 423908 - DNA, 25 bp, Mus musculus
ttcccacttgctcacgcctcccttg

SEQ ID NO: 423909 - DNA, 25 bp, Mus musculus
ttctgctgtccttcccacttgctca

SEQ ID NO: 423910 - DNA, 25 bp, Mus musculus
cgcccttgcgtttctccgcttcagc

SEQ ID NO: 423911 - DNA, 25 bp, Mus musculus
gtcccatgctcagcgcaggctcggt

SEQ ID NO: 423912 - DNA, 25 bp, Mus musculus
aatgaggaagggtcccatgctcagc

SEQ ID NO: 423913 - DNA, 25 bp, Mus musculus
gatccaggaatgaggaagggtccca

SEQ ID NO: 423914 - DNA, 25 bp, Mus musculus
gtgggtaacgctcaggatccaggaa

SEQ ID NO: 423915 - DNA, 25 bp, Mus musculus
aggcttctcttctatgcgagcgggg

SEQ ID NO: 423916 - DNA, 25 bp, Mus musculus
ttggccttcgacaccgagctggtaa

SEQ ID NO: 423917 - DNA, 25 bp, Mus musculus
aggcttcctggtgtaccctgacctc

SEQ ID NO: 423918 - DNA, 25 bp, Mus musculus
cttcgacaaggtgtacgtgaacatc

SEQ ID NO: 423919 - DNA, 25 bp, Mus musculus
ccgcacaagagcctgtcggtgatgc

SEQ ID NO: 423920 - DNA, 25 bp, Mus musculus
ccatgctgcagctcgactacggcga

SEQ ID NO: 423921 - DNA, 25 bp, Mus musculus
accttcagcggctacctggtgtacg

SEQ ID NO: 423922 - DNA, 25 bp, Mus musculus
gctggtaaacataggtggcgacttc

SEQ ID NO: 423923 - DNA, 25 bp, Mus musculus
cgacgaggtgcaggccatgatttac

SEQ ID NO: 423924 - DNA, 25 bp, Mus musculus
ccatgatttacgacgacggcgcttc

SEQ ID NO: 423925 - DNA, 25 bp, Mus musculus
ggctacttagccacgatcacgatgg

SEQ ID NO: 423926 - DNA, 25 bp, Mus musculus
tcacgatggctatggcgcctacagc

SEQ ID NO: 423927 - DNA, 25 bp, Mus musculus
gcgcctacagcaaccacggcaagta

SEQ ID NO: 423928 - DNA, 25 bp, Mus musculus
ttctccttcacgctgggcaagctgc

SEQ ID NO: 423929 - DNA, 25 bp, Mus musculus
gtacatcactttctcaggcttcctg

SEQ ID NO: 423930 - DNA, 25 bp, Mus musculus
tggaactcgagccttgcgttctggc

SEQ ID NO: 423931 - DNA, 25 bp, Mus musculus
aactcgagccttgcgttctggcctt

SEQ ID NO: 423932 - DNA, 25 bp, Mus musculus
gcccggcgaggttggggatctgagt

SEQ ID NO: 423933 - DNA, 25 bp, Mus musculus
ctcgagccttgcgttctggccttgg

SEQ ID NO: 423934 - DNA, 25 bp, Mus musculus
ggttccgagcgcacaagctcatccg

SEQ ID NO: 423935 - DNA, 25 bp, Mus musculus
gtgaggcccgtgtgcgcacgcgcag

SEQ ID NO: 423936 - DNA, 25 bp, Mus musculus
cttggcagaagaaggtgaggcccgt

SEQ ID NO: 423937 - DNA, 25 bp, Mus musculus
cgcgcagcttggcagaagaaggtga

SEQ ID NO: 423938 - DNA, 25 bp, Mus musculus
atcggctcggggcgcacctgctctg

SEQ ID NO: 423939 - DNA, 25 bp, Mus musculus
ccagcccgtggatcggctcggggcg

SEQ ID NO: 423940 - DNA, 25 bp, Mus musculus
tgggctacggatgacccggagcatc

SEQ ID NO: 423941 - DNA, 25 bp, Mus musculus
ctgggctacggatgacccggagcat

SEQ ID NO: 423942 - DNA, 25 bp, Mus musculus
ctgagtgtaggggctgcgcccacct

SEQ ID NO: 423943 - DNA, 25 bp, Mus musculus
agccttgcgttctggccttgggcgc

SEQ ID NO: 423944 - DNA, 25 bp, Mus musculus
gccgccatgttccttagtgtgccga

SEQ ID NO: 423945 - DNA, 25 bp, Mus musculus
cgcacatactcacggcgcttgtcag

SEQ ID NO: 423946 - DNA, 25 bp, Mus musculus
cgtggtctcaacctgctgctgttcc

SEQ ID NO: 423947 - DNA, 25 bp, Mus musculus
atgtgcagtgactcttcttccgggc

SEQ ID NO: 423948 - DNA, 25 bp, Mus musculus
ccctggcatgaaaggaggtatcgca

SEQ ID NO: 423949 - DNA, 25 bp, Mus musculus
gtatcgcaggtaagaaagacccgca

SEQ ID NO: 423950 - DNA, 25 bp, Mus musculus
accgtgaggtgtacgtagccctatc

SEQ ID NO: 423951 - DNA, 25 bp, Mus musculus
acagggttatggacttccttgtgcc

SEQ ID NO: 423952 - DNA, 25 bp, Mus musculus
gaagacgcaacgaaccgcaccggtg

SEQ ID NO: 423953 - DNA, 25 bp, Mus musculus
gttctaagttctacaccgcgccggc

SEQ ID NO: 423954 - DNA, 25 bp, Mus musculus
cgcgccggctcttgagctaagcttt

SEQ ID NO: 423955 - DNA, 25 bp, Mus musculus
gtttcctaggcgactccaggtggca

SEQ ID NO: 423956 - DNA, 25 bp, Mus musculus
cacggtcagattgcacagggttatg

SEQ ID NO: 423957 - DNA, 25 bp, Mus musculus
cgtagccctatctcggtacagcgga

SEQ ID NO: 423958 - DNA, 25 bp, Mus musculus
ttgcacaggaatcgggtctcgtact

SEQ ID NO: 423959 - DNA, 25 bp, Mus musculus
ctgcccgagggatcccggaacagga

SEQ ID NO: 423960 - DNA, 25 bp, Mus musculus
gttctcgtccagtaccagctgccga

SEQ ID NO: 423961 - DNA, 25 bp, Mus musculus
acccggcgcgtcatgttcttcagcg

SEQ ID NO: 423962 - DNA, 25 bp, Mus musculus
tcatgttcttcagcggcagcgcgcc

SEQ ID NO: 423963 - DNA, 25 bp, Mus musculus
cccagcagaaccgtgtggtcgatgc

SEQ ID NO: 423964 - DNA, 25 bp, Mus musculus
cccggacactgtgtagagcagcgtc

SEQ ID NO: 423965 - DNA, 25 bp, Mus musculus
atgcctcccgactcttcgaagctga

SEQ ID NO: 423966 - DNA, 25 bp, Mus musculus
tcgcgaccagccaccgcgagaagga

SEQ ID NO: 423967 - DNA, 25 bp, Mus musculus
gagctgagggccacctgatgcctcc

SEQ ID NO: 423968 - DNA, 25 bp, Mus musculus
cgggtcctcaccttcgaggtgttgc

SEQ ID NO: 423969 - DNA, 25 bp, Mus musculus
accttcgaggtgttgcacaggaatc

SEQ ID NO: 423970 - DNA, 25 bp, Mus musculus
agcagcgtcgggtagaagagcaccc

SEQ ID NO: 423971 - DNA, 25 bp, Mus musculus
ggtctcgtactcctcgttcatagtg

SEQ ID NO: 423972 - DNA, 25 bp, Mus musculus
tagaaggcagcgctcctctcgatcc

SEQ ID NO: 423973 - DNA, 25 bp, Mus musculus
accaggccgcggactgctcgggact

SEQ ID NO: 423974 - DNA, 25 bp, Mus musculus
gattcggcctcagcagcgaggcagc

SEQ ID NO: 423975 - DNA, 25 bp, Mus musculus
tcctctccgggtccgctgggcgaga

SEQ ID NO: 423976 - DNA, 25 bp, Mus musculus
ggtgtcctagattcccgcccctaga

SEQ ID NO: 423977 - DNA, 25 bp, Mus musculus
cagggctcgaatctcgcacccagga

SEQ ID NO: 423978 - DNA, 25 bp, Mus musculus
tcgatcctccggagctcttgcagtt

SEQ ID NO: 423979 - DNA, 25 bp, Mus musculus
tcctccggagctcttgcagttctcg

SEQ ID NO: 423980 - DNA, 25 bp, Mus musculus
gcagttctcgccctggggccgcttt

SEQ ID NO: 423981 - DNA, 25 bp, Mus musculus
atcaggtgctcgctcgcccagtcaa

SEQ ID NO: 423982 - DNA, 25 bp, Mus musculus
tcgctcgcccagtcaaggcctagta

SEQ ID NO: 423983 - DNA, 25 bp, Mus musculus
aaggcctagtagcagggctcgaatc

SEQ ID NO: 423984 - DNA, 25 bp, Mus musculus
aatctcgcacccaggagcggggacg

SEQ ID NO: 423985 - DNA, 25 bp, Mus musculus
agatcgcggctgtctacccgagacg

SEQ ID NO: 423986 - DNA, 25 bp, Mus musculus
caggaatcgcgggtgaagttctcca

SEQ ID NO: 423987 - DNA, 25 bp, Mus musculus
gccgacgcccgagagtccagtgact

SEQ ID NO: 423988 - DNA, 25 bp, Mus musculus
ccgcctcttccggttgtgcagcaag

SEQ ID NO: 423989 - DNA, 25 bp, Mus musculus
tgtacgccggccaatagcagcccag

SEQ ID NO: 423990 - DNA, 25 bp, Mus musculus
tagcctcggtttggttcgtggagtc

SEQ ID NO: 423991 - DNA, 25 bp, Mus musculus
cccagcggcagattcgctcggagac

SEQ ID NO: 423992 - DNA, 25 bp, Mus musculus
cggagacgcggacagaacccgttct

SEQ ID NO: 423993 - DNA, 25 bp, Mus musculus
aacccgttctgtcgcgtcaggaatc

SEQ ID NO: 423994 - DNA, 25 bp, Mus musculus
agaagacgttgagaaaggctgcgct

SEQ ID NO: 423995 - DNA, 25 bp, Mus musculus
ggctcgtgcgcactcccagtttcgg

SEQ ID NO: 423996 - DNA, 25 bp, Mus musculus
ccagtttcggcctcttcatgcagga

SEQ ID NO: 423997 - DNA, 25 bp, Mus musculus
ggcctcttcatgcaggaaatgaatc

SEQ ID NO: 423998 - DNA, 25 bp, Mus musculus
gaaatgaatctgctgccgacgcccg

SEQ ID NO: 423999 - DNA, 25 bp, Mus musculus
tctccacgggtggagagaagacgtt

SEQ ID NO: 424000 - DNA, 25 bp, Mus musculus
aagtgggtaccctcgtgggcatcgc

SEQ ID NO: 424001 - DNA, 25 bp, Mus musculus
cttcagtgtggcgtccttctgagga

SEQ ID NO: 424002 - DNA, 25 bp, Mus musculus
gtcgcgacaggtttgggaactgaca

SEQ ID NO: 424003 - DNA, 25 bp, Mus musculus
tgggaactgacacggtccatcccgc

SEQ ID NO: 424004 - DNA, 25 bp, Mus musculus
acgccggcctgagggtccagcgatc

SEQ ID NO: 424005 - DNA, 25 bp, Mus musculus
gagggtccagcgatcactcaccgcg

SEQ ID NO: 424006 - DNA, 25 bp, Mus musculus
tcactcaccgcgcagtggcagaggt

SEQ ID NO: 424007 - DNA, 25 bp, Mus musculus
gggcccggccatccagctgcagtgt

SEQ ID NO: 424008 - DNA, 25 bp, Mus musculus
tgcagccacgtcacacgggacagtc

SEQ ID NO: 424009 - DNA, 25 bp, Mus musculus
aggcgcttccgcctcataccatggg

SEQ ID NO: 424010 - DNA, 25 bp, Mus musculus
gtgggcatcgcgtttagccaagtta

SEQ ID NO: 424011 - DNA, 25 bp, Mus musculus
cgtttagccaagttaagctagggtg

SEQ ID NO: 424012 - DNA, 25 bp, Mus musculus
cccacgcgggaaccgggatcaacag

SEQ ID NO: 424013 - DNA, 25 bp, Mus musculus
ttctgaggatgcagttccagcagtg

SEQ ID NO: 424014 - DNA, 25 bp, Mus musculus
cctaccagttcagcggcgaggtgct

SEQ ID NO: 424015 - DNA, 25 bp, Mus musculus
ctggggcatccagaagggcaaccgc

SEQ ID NO: 424016 - DNA, 25 bp, Mus musculus
acctaccagaagatggcgcgcgcgc

SEQ ID NO: 424017 - DNA, 25 bp, Mus musculus
cgcgctgcgcaactacggcaagaca

SEQ ID NO: 424018 - DNA, 25 bp, Mus musculus
actacggcaagacaggcgaggtgaa

SEQ ID NO: 424019 - DNA, 25 bp, Mus musculus
caagacaggcgaggtgaagaaagtc

SEQ ID NO: 424020 - DNA, 25 bp, Mus musculus
ggcaaccgcaagaagatgacctacc

SEQ ID NO: 424021 - DNA, 25 bp, Mus musculus
agctcacctaccagttcagcggcga

SEQ ID NO: 424022 - DNA, 25 bp, Mus musculus
actgatcgcccgcagagaccgccag

SEQ ID NO: 424023 - DNA, 25 bp, Mus musculus
gccatagcattaacccgtcgcccgg

SEQ ID NO: 424024 - DNA, 25 bp, Mus musculus
cgctttgcctcccaccaggactcta

SEQ ID NO: 424025 - DNA, 25 bp, Mus musculus
tctagcccgctccaagggccgcctg

SEQ ID NO: 424026 - DNA, 25 bp, Mus musculus
cgcaagaagatgacctaccagaaga

SEQ ID NO: 424027 - DNA, 25 bp, Mus musculus
gtcaagaagaagctcacctaccagt

SEQ ID NO: 424028 - DNA, 25 bp, Mus musculus
cgcacacacgccaggcgccggtgcc

SEQ ID NO: 424029 - DNA, 25 bp, Mus musculus
ggcgacgctcacacctttcgtcgtg

SEQ ID NO: 424030 - DNA, 25 bp, Mus musculus
ctggggccgtaccattcgccgcgcg

SEQ ID NO: 424031 - DNA, 25 bp, Mus musculus
agcgggcgccagttccgcgtctgca

SEQ ID NO: 424032 - DNA, 25 bp, Mus musculus
cgctcctcgcttcctagccgggcgc

SEQ ID NO: 424033 - DNA, 25 bp, Mus musculus
gctgccaggcccacccgacgtctcc

SEQ ID NO: 424034 - DNA, 25 bp, Mus musculus
acctactctcggaggaggctgccag

SEQ ID NO: 424035 - DNA, 25 bp, Mus musculus
tcagctacctactctcggaggaggc

SEQ ID NO: 424036 - DNA, 25 bp, Mus musculus
gggcgctcagctacctactctcgga

SEQ ID NO: 424037 - DNA, 25 bp, Mus musculus
gcctcagagaccctctcctcccgga

SEQ ID NO: 424038 - DNA, 25 bp, Mus musculus
ctcgctcctccagggccgcctcaga

SEQ ID NO: 424039 - DNA, 25 bp, Mus musculus
cgcctcactttctcagcaggctcca

SEQ ID NO: 424040 - DNA, 25 bp, Mus musculus
ctcacctgctggacagctcctcgtc

SEQ ID NO: 424041 - DNA, 25 bp, Mus musculus
tcacacctttcgtcgtgggagtggg

SEQ ID NO: 424042 - DNA, 25 bp, Mus musculus
ccctcgttcatcaccgccaatcgca

SEQ ID NO: 424043 - DNA, 25 bp, Mus musculus
ggctgcagcaggtaccgcccaaggc

SEQ ID NO: 424044 - DNA, 25 bp, Mus musculus
gtcgcgcaacagtcccaccctcgtt

SEQ ID NO: 424045 - DNA, 25 bp, Mus musculus
gccaatcgcaaaccttctccatttg

SEQ ID NO: 424046 - DNA, 25 bp, Mus musculus
tgcattccctcccaaattccgcctt

SEQ ID NO: 424047 - DNA, 25 bp, Mus musculus
cgccttctcccaccagactttctca

SEQ ID NO: 424048 - DNA, 25 bp, Mus musculus
gactttctcattcccggtctcccgc

SEQ ID NO: 424049 - DNA, 25 bp, Mus musculus
tctcccgcaacccaaagaaagatgg

SEQ ID NO: 424050 - DNA, 25 bp, Mus musculus
cccaaagaaagatggcgaaggctgc

SEQ ID NO: 424051 - DNA, 25 bp, Mus musculus
gcgaaggctgcacttccggcaagtg

SEQ ID NO: 424052 - DNA, 25 bp, Mus musculus
tccggcaagtgtccttacgaatgca

SEQ ID NO: 424053 - DNA, 25 bp, Mus musculus
agtgtccttacgaatgcatccgggc

SEQ ID NO: 424054 - DNA, 25 bp, Mus musculus
tcgcaaaccttctccatttgcattc

SEQ ID NO: 424055 - DNA, 25 bp, Mus musculus
ttacgaatgcatccgggcggctgca

SEQ ID NO: 424056 - DNA, 25 bp, Mus musculus
tcaggcgctgtcaaactggcctgga

SEQ ID NO: 424057 - DNA, 25 bp, Mus musculus
agaagggcttcaggcgctgtcaaac

SEQ ID NO: 424058 - DNA, 25 bp, Mus musculus
cgctcggcgacgctggcactaggct

SEQ ID NO: 424059 - DNA, 25 bp, Mus musculus
acgctggcactaggctccggcttgg

SEQ ID NO: 424060 - DNA, 25 bp, Mus musculus
gctctgcgtcgctagcgctccaggt

SEQ ID NO: 424061 - DNA, 25 bp, Mus musculus
ctccaggtaccggtgactcacaagc

SEQ ID NO: 424062 - DNA, 25 bp, Mus musculus
ccaaagggcagaaaaccagcctgtc

SEQ ID NO: 424063 - DNA, 25 bp, Mus musculus
aaccagcctgtctggcaccaaggga

SEQ ID NO: 424064 - DNA, 25 bp, Mus musculus
tgtctggcaccaagggacagaggac

SEQ ID NO: 424065 - DNA, 25 bp, Mus musculus
cagccacccatgaggcctggggagc

SEQ ID NO: 424066 - DNA, 25 bp, Mus musculus
tcccaggtgggcgtcagcgacaaag

SEQ ID NO: 424067 - DNA, 25 bp, Mus musculus
tgaggcctggggagccgacacccac

SEQ ID NO: 424068 - DNA, 25 bp, Mus musculus
gtaccggtgactcacaagcactcgc

SEQ ID NO: 424069 - DNA, 25 bp, Mus musculus
actggggattcattgtcgcggttcc

SEQ ID NO: 424070 - DNA, 25 bp, Mus musculus
tttctgggcatttcttgggagccat

SEQ ID NO: 424071 - DNA, 25 bp, Mus musculus
tcctccgggctgctttacttttagc

SEQ ID NO: 424072 - DNA, 25 bp, Mus musculus
agctaagacaccttcgcgccaaacg

SEQ ID NO: 424073 - DNA, 25 bp, Mus musculus
ccgtcgcaggtagcgcagctaagac

SEQ ID NO: 424074 - DNA, 25 bp, Mus musculus
aagggactacgtatgaggcagcgcc

SEQ ID NO: 424075 - DNA, 25 bp, Mus musculus
gagtggaaaagcctccgtggagaaa

SEQ ID NO: 424076 - DNA, 25 bp, Mus musculus
caagctctgtggcaaaataacgaag

SEQ ID NO: 424077 - DNA, 25 bp, Mus musculus
ggagccatgacgtactcggtgaaga

SEQ ID NO: 424078 - DNA, 25 bp, Mus musculus
ctcctgaggagcaccgcaacgtcgg

SEQ ID NO: 424079 - DNA, 25 bp, Mus musculus
agcttcttggcttcgggctccagct

SEQ ID NO: 424080 - DNA, 25 bp, Mus musculus
gggaccctgcacacgcagcttcttg

SEQ ID NO: 424081 - DNA, 25 bp, Mus musculus
ctcggtgaagagatatcaagctctg

SEQ ID NO: 424082 - DNA, 25 bp, Mus musculus
tcctgaggacctctgcgacttttgc

SEQ ID NO: 424083 - DNA, 25 bp, Mus musculus
tctgcgacttttgctcctgaggagc

SEQ ID NO: 424084 - DNA, 25 bp, Mus musculus
tccagtgcgctctttggctagcccg

SEQ ID NO: 424085 - DNA, 25 bp, Mus musculus
accactcggccgcctgctcgcacct

SEQ ID NO: 424086 - DNA, 25 bp, Mus musculus
ctgtgatgctgcggcttctgtgacg

SEQ ID NO: 424087 - DNA, 25 bp, Mus musculus
gcctgtgatgctgcggcttctgtga

SEQ ID NO: 424088 - DNA, 25 bp, Mus musculus
gcgcctgtgatgctgcggcttctgt

SEQ ID NO: 424089 - DNA, 25 bp, Mus musculus
ctggcgcctgtgatgctgcggcttc

SEQ ID NO: 424090 - DNA, 25 bp, Mus musculus
cagtgcgctctttggctagcccggt

SEQ ID NO: 424091 - DNA, 25 bp, Mus musculus
ctgccggaggctctgtcagggaggc

SEQ ID NO: 424092 - DNA, 25 bp, Mus musculus
cccatgctgccggaggctctgtcag

SEQ ID NO: 424093 - DNA, 25 bp, Mus musculus
gcctcccaccactcggccgcctgct

SEQ ID NO: 424094 - DNA, 25 bp, Mus musculus
tctggcgcctcccaccactcggccg

SEQ ID NO: 424095 - DNA, 25 bp, Mus musculus
ccattctggcgcctcccaccactcg

SEQ ID NO: 424096 - DNA, 25 bp, Mus musculus
ccatgctgccggaggctctgtcagg

SEQ ID NO: 424097 - DNA, 25 bp, Mus musculus
gcctccagtgcgctctttggctagc

SEQ ID NO: 424098 - DNA, 25 bp, Mus musculus
aaatgtgcgtgctggatagagagca

SEQ ID NO: 424099 - DNA, 25 bp, Mus musculus
tctctcgggtcaggggcaccgctgc

SEQ ID NO: 424100 - DNA, 25 bp, Mus musculus
gcgcgcacgtactcacacttctaag

SEQ ID NO: 424101 - DNA, 25 bp, Mus musculus
ctcacacttctaagggcgtggaggg

SEQ ID NO: 424102 - DNA, 25 bp, Mus musculus
atagagagcagctaggccggttgct

SEQ ID NO: 424103 - DNA, 25 bp, Mus musculus
ctaggccggttgcttcccagagcgc

SEQ ID NO: 424104 - DNA, 25 bp, Mus musculus
gttgcttcccagagcgcgcacggtc

SEQ ID NO: 424105 - DNA, 25 bp, Mus musculus
cttgggctctccaacccggagcgaa

SEQ ID NO: 424106 - DNA, 25 bp, Mus musculus
ctccaacccggagcgaactgtgact

SEQ ID NO: 424107 - DNA, 25 bp, Mus musculus
cggagcgaactgtgactccaggacc

SEQ ID NO: 424108 - DNA, 25 bp, Mus musculus
cctgagcaccagaggcctgggaccc

SEQ ID NO: 424109 - DNA, 25 bp, Mus musculus
gttccctcctgtctctcgggtcagg

SEQ ID NO: 424110 - DNA, 25 bp, Mus musculus
cctcctgtctctcgggtcaggggca

SEQ ID NO: 424111 - DNA, 25 bp, Mus musculus
gcacgtactcacacttctaagggcg

SEQ ID NO: 424112 - DNA, 25 bp, Mus musculus
tcccgagccacctggcgcagggatg

SEQ ID NO: 424113 - DNA, 25 bp, Mus musculus
ccctgagaggacacggtgagtgctt

SEQ ID NO: 424114 - DNA, 25 bp, Mus musculus
cgaagcgctccaggaggcggtggcc

SEQ ID NO: 424115 - DNA, 25 bp, Mus musculus
gccacctggcgcagggatgcctgca

SEQ ID NO: 424116 - DNA, 25 bp, Mus musculus
ttggcaatgggacggactcccgcgc

SEQ ID NO: 424117 - DNA, 25 bp, Mus musculus
ctgaagttggcaatgggacggactc

SEQ ID NO: 424118 - DNA, 25 bp, Mus musculus
ttcgactcctgaagttggcaatggg

SEQ ID NO: 424119 - DNA, 25 bp, Mus musculus
ttggtccttcgactcctgaagttgg

SEQ ID NO: 424120 - DNA, 25 bp, Mus musculus
tgctctttggtccttcgactcctga

SEQ ID NO: 424121 - DNA, 25 bp, Mus musculus
ggcatggtggctctagcttgctctt

SEQ ID NO: 424122 - DNA, 25 bp, Mus musculus
tccgaactgagcgtggccagatccc

SEQ ID NO: 424123 - DNA, 25 bp, Mus musculus
actccgaactgagcgtggccagatc

SEQ ID NO: 424124 - DNA, 25 bp, Mus musculus
agtggtaggactccgaactgagcgt

SEQ ID NO: 424125 - DNA, 25 bp, Mus musculus
ggtggctctagcttgctctttggtc

SEQ ID NO: 424126 - DNA, 25 bp, Mus musculus
gcccagatctggtcgaatcactcca

SEQ ID NO: 424127 - DNA, 25 bp, Mus musculus
gcccgacgttcattggcccagatct

SEQ ID NO: 424128 - DNA, 25 bp, Mus musculus
tccacttaggcctgtttcgattgtg

SEQ ID NO: 424129 - DNA, 25 bp, Mus musculus
gttcgcttgtcgtcttttccactta

SEQ ID NO: 424130 - DNA, 25 bp, Mus musculus
actctgggccctaaccgttcgcttg

SEQ ID NO: 424131 - DNA, 25 bp, Mus musculus
aggctttcttgtggtttctagcgcc

SEQ ID NO: 424132 - DNA, 25 bp, Mus musculus
ccggcggagaagacgtctcttgtcc

SEQ ID NO: 424133 - DNA, 25 bp, Mus musculus
tcgcgcaattcccaccaacaaggtg

SEQ ID NO: 424134 - DNA, 25 bp, Mus musculus
gactatttttaagagacttcgcgca

SEQ ID NO: 424135 - DNA, 25 bp, Mus musculus
cgagcccgagcaagaccgaaatcca

SEQ ID NO: 424136 - DNA, 25 bp, Mus musculus
atcactccactcgtaggcgggtcgg

SEQ ID NO: 424137 - DNA, 25 bp, Mus musculus
tccagcaggaactcgtgaggaagtt

SEQ ID NO: 424138 - DNA, 25 bp, Mus musculus
aagtttgggccagtccacgagccgt

SEQ ID NO: 424139 - DNA, 25 bp, Mus musculus
gctcccggctgctaacgtcatgttt

SEQ ID NO: 424140 - DNA, 25 bp, Mus musculus
tgtcctccgaacctttgaacctgtg

SEQ ID NO: 424141 - DNA, 25 bp, Mus musculus
agtgggctttcagtgttcataaacc

SEQ ID NO: 424142 - DNA, 25 bp, Mus musculus
cattgtaaacagatgtgcagctgtc

SEQ ID NO: 424143 - DNA, 25 bp, Mus musculus
gctgtaagacttagagtgggctttc

SEQ ID NO: 424144 - DNA, 25 bp, Mus musculus
tgaacctgtgcactgacgtctcttg

SEQ ID NO: 424145 - DNA, 25 bp, Mus musculus
atcagcccttacaggagagccagcc

SEQ ID NO: 424146 - DNA, 25 bp, Mus musculus
tgcagctgtccatgatgtgtgcttc

SEQ ID NO: 424147 - DNA, 25 bp, Mus musculus
taaagtcacagctcatcagccctta

SEQ ID NO: 424148 - DNA, 25 bp, Mus musculus
atgagcactggcttcaactaaagtc

SEQ ID NO: 424149 - DNA, 25 bp, Mus musculus
ctcaggggccctaggattttcagaa

SEQ ID NO: 424150 - DNA, 25 bp, Mus musculus
agagttactgtgcttctcaggggcc

SEQ ID NO: 424151 - DNA, 25 bp, Mus musculus
cgagcacaggcagaggagagttact

SEQ ID NO: 424152 - DNA, 25 bp, Mus musculus
cacaggtaggtgtgcttcgtgtgcc

SEQ ID NO: 424153 - DNA, 25 bp, Mus musculus
gcttcatgtacagagcacaggtagg

SEQ ID NO: 424154 - DNA, 25 bp, Mus musculus
tggggcctgaagtcccaccctcgag

SEQ ID NO: 424155 - DNA, 25 bp, Mus musculus
ctcggcttccatcgctgctctttaa

SEQ ID NO: 424156 - DNA, 25 bp, Mus musculus
tcttctagcacgagaggggacagcg

SEQ ID NO: 424157 - DNA, 25 bp, Mus musculus
cgagcggaggaaagcaatagcagcc

SEQ ID NO: 424158 - DNA, 25 bp, Mus musculus
ttcgagcaccaaccctggcagagcg

SEQ ID NO: 424159 - DNA, 25 bp, Mus musculus
tcgctgcaggactcgcctcctggga

SEQ ID NO: 424160 - DNA, 25 bp, Mus musculus
cctgagactggtcgctgcaggactc

SEQ ID NO: 424161 - DNA, 25 bp, Mus musculus
ccgggaaagtttgtccctgagactg

SEQ ID NO: 424162 - DNA, 25 bp, Mus musculus
cctgctctgcgcacacggtaagcgg

SEQ ID NO: 424163 - DNA, 25 bp, Mus musculus
gggcggcttcaactccggcagtaca

SEQ ID NO: 424164 - DNA, 25 bp, Mus musculus
cgctgctctttaacgagccaggggc

SEQ ID NO: 424165 - DNA, 25 bp, Mus musculus
tggaagaagacccaagacgctctct

SEQ ID NO: 424166 - DNA, 25 bp, Mus musculus
ttcaactccggcagtacaggaggca

SEQ ID NO: 424167 - DNA, 25 bp, Mus musculus
cccgcagctcttctagcacgagagg

SEQ ID NO: 424168 - DNA, 25 bp, Mus musculus
tgtgcggcggcccaagcggttttaa

SEQ ID NO: 424169 - DNA, 25 bp, Mus musculus
cgcgcctgaaggctgagctgtccga

SEQ ID NO: 424170 - DNA, 25 bp, Mus musculus
ctgctgcagcttcggaggttcgctg

SEQ ID NO: 424171 - DNA, 25 bp, Mus musculus
ctcgcttgtgttggtgacccgggct

SEQ ID NO: 424172 - DNA, 25 bp, Mus musculus
gcgttctcgcgaacccggcaggtct

SEQ ID NO: 424173 - DNA, 25 bp, Mus musculus
ggcagtgggtctcacctgccggcct

SEQ ID NO: 424174 - DNA, 25 bp, Mus musculus
agcggttttaaacggcttagagcag

SEQ ID NO: 424175 - DNA, 25 bp, Mus musculus
ggaccaatgaacaacgaggacactg

SEQ ID NO: 424176 - DNA, 25 bp, Mus musculus
aggcggttctccgaggaccaatgaa

SEQ ID NO: 424177 - DNA, 25 bp, Mus musculus
caataaaggggcgataggcggttct

SEQ ID NO: 424178 - DNA, 25 bp, Mus musculus
cacagctctttcaaacggaccaata

SEQ ID NO: 424179 - DNA, 25 bp, Mus musculus
ggcgcgtgcccacagctctttcaaa

SEQ ID NO: 424180 - DNA, 25 bp, Mus musculus
cgcgcgttccctttaaggccgcagg

SEQ ID NO: 424181 - DNA, 25 bp, Mus musculus
ccctcggttctgacccggcagaggt

SEQ ID NO: 424182 - DNA, 25 bp, Mus musculus
gacttcttctcgaacaaaggccgca

SEQ ID NO: 424183 - DNA, 25 bp, Mus musculus
tgtaagagtcaagaagctccttttc

SEQ ID NO: 424184 - DNA, 25 bp, Mus musculus
ccgcatcggtggtgcgtcccgcgat

SEQ ID NO: 424185 - DNA, 25 bp, Mus musculus
cgatgcgcccgtctatgtaagagtc

SEQ ID NO: 424186 - DNA, 25 bp, Mus musculus
ggttgtgtctttcaacgacttcttc

SEQ ID NO: 424187 - DNA, 25 bp, Mus musculus
aaggccgcaggccacagtctgcaga

SEQ ID NO: 424188 - DNA, 25 bp, Mus musculus
gcaggccacagtctgcagagcaaga

SEQ ID NO: 424189 - DNA, 25 bp, Mus musculus
caagacagacggtgaggggcccatc

SEQ ID NO: 424190 - DNA, 25 bp, Mus musculus
agcctcgtgtcccactgagacgcga

SEQ ID NO: 424191 - DNA, 25 bp, Mus musculus
gagacgcgagtgtctcacctgcctc

SEQ ID NO: 424192 - DNA, 25 bp, Mus musculus
cccaaggccgaaggtcttctcattg

SEQ ID NO: 424193 - DNA, 25 bp, Mus musculus
ctcattgaagaaggtgtggaactcc

SEQ ID NO: 424194 - DNA, 25 bp, Mus musculus
agaaggtgtggaactccgcatcggt

SEQ ID NO: 424195 - DNA, 25 bp, Mus musculus
agctccttttcggttgtgtctttca

SEQ ID NO: 424196 - DNA, 25 bp, Mus musculus
tcgctgccgggatttttcccatttc

SEQ ID NO: 424197 - DNA, 25 bp, Mus musculus
cactcactttaggtagcggcgagtc

SEQ ID NO: 424198 - DNA, 25 bp, Mus musculus
cgatgggcgatacgaacctaggatt

SEQ ID NO: 424199 - DNA, 25 bp, Mus musculus
aacctaggatttcagaggcccgcta

SEQ ID NO: 424200 - DNA, 25 bp, Mus musculus
gaggcccgctagtttcctgcatctg

SEQ ID NO: 424201 - DNA, 25 bp, Mus musculus
cctgcatctggaaaagcggaaccca

SEQ ID NO: 424202 - DNA, 25 bp, Mus musculus
agcggaacccaactcactcacttta

SEQ ID NO: 424203 - DNA, 25 bp, Mus musculus
gcgagtcggacagctcggctaatta

SEQ ID NO: 424204 - DNA, 25 bp, Mus musculus
ctcggctaattaacctcacattttg

SEQ ID NO: 424205 - DNA, 25 bp, Mus musculus
cacattttgtcaggtgattgccgga

SEQ ID NO: 424206 - DNA, 25 bp, Mus musculus
aagccttgtttggtccgggcagcaa

SEQ ID NO: 424207 - DNA, 25 bp, Mus musculus
tcccatctcggagccggatgtttgc

SEQ ID NO: 424208 - DNA, 25 bp, Mus musculus
cggatgtttgccgagctttgacagg

SEQ ID NO: 424209 - DNA, 25 bp, Mus musculus
gctgctctggtcaacggaaggaatt

SEQ ID NO: 424210 - DNA, 25 bp, Mus musculus
agtgctccggttaatccggtagcta

SEQ ID NO: 424211 - DNA, 25 bp, Mus musculus
gagactgggcttcgtgtagaatgta

SEQ ID NO: 424212 - DNA, 25 bp, Mus musculus
gaaaggcggcttatttccagaaata

SEQ ID NO: 424213 - DNA, 25 bp, Mus musculus
tgcctaaattcagctgcactttcgc

SEQ ID NO: 424214 - DNA, 25 bp, Mus musculus
cggaggaaatgcagctgcctaaatt

SEQ ID NO: 424215 - DNA, 25 bp, Mus musculus
tgttttcatccgcttcagtgcaggc

SEQ ID NO: 424216 - DNA, 25 bp, Mus musculus
tcaaaagtgagtacctgcgaagcta

SEQ ID NO: 424217 - DNA, 25 bp, Mus musculus
ctcacgctaacgaggctccgggatc

SEQ ID NO: 424218 - DNA, 25 bp, Mus musculus
tggcgatcagcgttcggttattctg

SEQ ID NO: 424219 - DNA, 25 bp, Mus musculus
gcacaggtcgcagagagatatctca

SEQ ID NO: 424220 - DNA, 25 bp, Mus musculus
aagctacggcacagagagtggctcc

SEQ ID NO: 424221 - DNA, 25 bp, Mus musculus
gccatccttagtgtttgttttcatc

SEQ ID NO: 424222 - DNA, 25 bp, Mus musculus
gactggtgtggactggtttttctca

SEQ ID NO: 424223 - DNA, 25 bp, Mus musculus
tccgggatcccagaactgaaaaagc

SEQ ID NO: 424224 - DNA, 25 bp, Mus musculus
cccagggaccatcggccatccaccc

SEQ ID NO: 424225 - DNA, 25 bp, Mus musculus
cgactttcgcttgcggtttgcaacc

SEQ ID NO: 424226 - DNA, 25 bp, Mus musculus
gtttgcaacccccatggcgggtctg

SEQ ID NO: 424227 - DNA, 25 bp, Mus musculus
aggcacctgcccaagcgagctttgc

SEQ ID NO: 424228 - DNA, 25 bp, Mus musculus
gagctttgcccgcagctgcctagcg

SEQ ID NO: 424229 - DNA, 25 bp, Mus musculus
gctgcctagcgtgtggactccgctt

SEQ ID NO: 424230 - DNA, 25 bp, Mus musculus
ggactccgcttctcaggcgctaaca

SEQ ID NO: 424231 - DNA, 25 bp, Mus musculus
gggcggttcccaggcccagtgccca

SEQ ID NO: 424232 - DNA, 25 bp, Mus musculus
ggagttcccacggtgtgaattatcc

SEQ ID NO: 424233 - DNA, 25 bp, Mus musculus
tcccacggtgtgaattatccgcaca

SEQ ID NO: 424234 - DNA, 25 bp, Mus musculus
ttatccgcacactcaatgccagcag

SEQ ID NO: 424235 - DNA, 25 bp, Mus musculus
ggccttcaagccctgtgcgttccag

SEQ ID NO: 424236 - DNA, 25 bp, Mus musculus
gtgcgttccagtcccggctctcctc

SEQ ID NO: 424237 - DNA, 25 bp, Mus musculus
cctagcgtgtggactccgcttctca

SEQ ID NO: 424238 - DNA, 25 bp, Mus musculus
actgtttccggccagggtatccagc

SEQ ID NO: 424239 - DNA, 25 bp, Mus musculus
ttggttgaactacacatgcgctctc

SEQ ID NO: 424240 - DNA, 25 bp, Mus musculus
gcattcccggcttcggctttggtta

SEQ ID NO: 424241 - DNA, 25 bp, Mus musculus
cgactgtacgcatgcgtgggcattc

SEQ ID NO: 424242 - DNA, 25 bp, Mus musculus
ctgcattctttttgaggttacggga

SEQ ID NO: 424243 - DNA, 25 bp, Mus musculus
ctggcaaatcttacgggctgcattc

SEQ ID NO: 424244 - DNA, 25 bp, Mus musculus
cggctgaactcgatggcacggatgt

SEQ ID NO: 424245 - DNA, 25 bp, Mus musculus
cactcctcagcagcgattggctagc

SEQ ID NO: 424246 - DNA, 25 bp, Mus musculus
aaaacgccttgatccggtcggcctg

SEQ ID NO: 424247 - DNA, 25 bp, Mus musculus
gatcccacccattcctataagttag

SEQ ID NO: 424248 - DNA, 25 bp, Mus musculus
ctcaaacaagcgagtgtggcgcttc

SEQ ID NO: 424249 - DNA, 25 bp, Mus musculus
gcggagcgccgttgtcctcaaacaa

SEQ ID NO: 424250 - DNA, 25 bp, Mus musculus
tgcgagcgggttagaccgtagtcac

SEQ ID NO: 424251 - DNA, 25 bp, Mus musculus
atgcgctctcgccttctggcaaatc

SEQ ID NO: 424252 - DNA, 25 bp, Mus musculus
ctggactgagttatcccggaggccc

SEQ ID NO: 424253 - DNA, 25 bp, Mus musculus
ctcggctgcagtgccttgaacgatt

SEQ ID NO: 424254 - DNA, 25 bp, Mus musculus
agctctcactctcctcgcaggtagg

SEQ ID NO: 424255 - DNA, 25 bp, Mus musculus
ggctttcgggccgagctctcactct

SEQ ID NO: 424256 - DNA, 25 bp, Mus musculus
gctccgtgcgctcgctggctttcgg

SEQ ID NO: 424257 - DNA, 25 bp, Mus musculus
gccttgaacgattgctggggcgctc

SEQ ID NO: 424258 - DNA, 25 bp, Mus musculus
tctggccgctttcttccgctggtcg

SEQ ID NO: 424259 - DNA, 25 bp, Mus musculus
ctgtgccaggtcctggactgagtta

SEQ ID NO: 424260 - DNA, 25 bp, Mus musculus
cttcttggttgatgtctccggagcg

SEQ ID NO: 424261 - DNA, 25 bp, Mus musculus
cggcgtcttcttggttgatgtctcc

SEQ ID NO: 424262 - DNA, 25 bp, Mus musculus
ttcgatgatcttttgcggcgtcttc

SEQ ID NO: 424263 - DNA, 25 bp, Mus musculus
tgggcgttcgtgtgttcgatgatct

SEQ ID NO: 424264 - DNA, 25 bp, Mus musculus
gggcgctcttcctttgatgtctggg

SEQ ID NO: 424265 - DNA, 25 bp, Mus musculus
ttccgctggtcggtcgagcggaccc

SEQ ID NO: 424266 - DNA, 25 bp, Mus musculus
cgatgaactcattcgcggctggata

SEQ ID NO: 424267 - DNA, 25 bp, Mus musculus
tccagcggctatcaggcagcgctct

SEQ ID NO: 424268 - DNA, 25 bp, Mus musculus
taggagactcgtgccatcttcagtc

SEQ ID NO: 424269 - DNA, 25 bp, Mus musculus
gtctcacagctaatgcgcgtccctt

SEQ ID NO: 424270 - DNA, 25 bp, Mus musculus
tgacaagatctttagccagggtaga

SEQ ID NO: 424271 - DNA, 25 bp, Mus musculus
cacgattggctgcttccctgtgaca

SEQ ID NO: 424272 - DNA, 25 bp, Mus musculus
acggctgcagtcttttggctgtcca

SEQ ID NO: 424273 - DNA, 25 bp, Mus musculus
tggggccaaaccctcaagaccagga

SEQ ID NO: 424274 - DNA, 25 bp, Mus musculus
caggatttaacctcaggcggaacga

SEQ ID NO: 424275 - DNA, 25 bp, Mus musculus
caagccgtggagaggttcgaaaaca

SEQ ID NO: 424276 - DNA, 25 bp, Mus musculus
gaggctaatcctccctggcgactgt

SEQ ID NO: 424277 - DNA, 25 bp, Mus musculus
agcatcaagggtgcctgacactcca

SEQ ID NO: 424278 - DNA, 25 bp, Mus musculus
ctgtcccgacagaagcacgttgcta

SEQ ID NO: 424279 - DNA, 25 bp, Mus musculus
cagggtagatgctcgcctgtccagt

SEQ ID NO: 424280 - DNA, 25 bp, Mus musculus
tctagcccgttggagtcctctgtcc

SEQ ID NO: 424281 - DNA, 25 bp, Mus musculus
acgctctagcccgttggagtcctct

SEQ ID NO: 424282 - DNA, 25 bp, Mus musculus
cagtacgctctagcccgttggagtc

SEQ ID NO: 424283 - DNA, 25 bp, Mus musculus
ctccagtacgctctagcccgttgga

SEQ ID NO: 424284 - DNA, 25 bp, Mus musculus
accgggagcctccagtacgctctag

SEQ ID NO: 424285 - DNA, 25 bp, Mus musculus
aagatgaagccccaaagcgcccgtt

SEQ ID NO: 424286 - DNA, 25 bp, Mus musculus
tcttcaaggcgccggaagatgaagc

SEQ ID NO: 424287 - DNA, 25 bp, Mus musculus
gctcttcttcaaggcgccggaagat

SEQ ID NO: 424288 - DNA, 25 bp, Mus musculus
ctcccgttggctcttcttcaaggcg

SEQ ID NO: 424289 - DNA, 25 bp, Mus musculus
gggtcaggacccacactccctcact

SEQ ID NO: 424290 - DNA, 25 bp, Mus musculus
agcagccgtcgggtcaggacccaca

SEQ ID NO: 424291 - DNA, 25 bp, Mus musculus
gcccgttggagtcctctgtccgcga

SEQ ID NO: 424292 - DNA, 25 bp, Mus musculus
ttggctcttcttcaaggcgccggaa

SEQ ID NO: 424293 - DNA, 25 bp, Mus musculus
cagagcagccgtcgggtcaggaccc

SEQ ID NO: 424294 - DNA, 25 bp, Mus musculus
tactagtgtctactcgagctcccga

SEQ ID NO: 424295 - DNA, 25 bp, Mus musculus
tgcgggtggaatcccgacgccctaa

SEQ ID NO: 424296 - DNA, 25 bp, Mus musculus
gagctcccgagtagtcacacacaaa

SEQ ID NO: 424297 - DNA, 25 bp, Mus musculus
tggcacatgcaaacagctactagtg

SEQ ID NO: 424298 - DNA, 25 bp, Mus musculus
cggggcgcacactggcacatgcaaa

SEQ ID NO: 424299 - DNA, 25 bp, Mus musculus
ttcaaaggcgcaccggtatccaggc

SEQ ID NO: 424300 - DNA, 25 bp, Mus musculus
gcgctggtatgctcacacgttcaaa

SEQ ID NO: 424301 - DNA, 25 bp, Mus musculus
agctctatggccagacacgcacaca

SEQ ID NO: 424302 - DNA, 25 bp, Mus musculus
cggttacggccacccaagctctatg

SEQ ID NO: 424303 - DNA, 25 bp, Mus musculus
gctcccgcacacaaattcgcggtta

SEQ ID NO: 424304 - DNA, 25 bp, Mus musculus
ggtcattcgctgatagtccagcatt

SEQ ID NO: 424305 - DNA, 25 bp, Mus musculus
tcccgccatgggaactggtcattcg

SEQ ID NO: 424306 - DNA, 25 bp, Mus musculus
cacgtgtccacatggcgctggtatg

SEQ ID NO: 424307 - DNA, 25 bp, Mus musculus
acacgttccttgatgggtgccttgc

SEQ ID NO: 424308 - DNA, 25 bp, Mus musculus
ccactcccaggtgccggggaagcag

SEQ ID NO: 424309 - DNA, 25 bp, Mus musculus
tgccggggaagcagcctccgcttca

SEQ ID NO: 424310 - DNA, 25 bp, Mus musculus
agcagcctccgcttcaggaagtgcc

SEQ ID NO: 424311 - DNA, 25 bp, Mus musculus
tccgcttcaggaagtgccgacagcc

SEQ ID NO: 424312 - DNA, 25 bp, Mus musculus
tcaggaagtgccgacagccgcggcc

SEQ ID NO: 424313 - DNA, 25 bp, Mus musculus
tcacctgtgcccaaagagccgcagc

SEQ ID NO: 424314 - DNA, 25 bp, Mus musculus
gaagcacactaccagccggtgccag

SEQ ID NO: 424315 - DNA, 25 bp, Mus musculus
tgctggcctcaagccacgtcgcaag

SEQ ID NO: 424316 - DNA, 25 bp, Mus musculus
gcaccgcccgccaagctcatggcga

SEQ ID NO: 424317 - DNA, 25 bp, Mus musculus
agccacgtcgcaaggccgtcgagga

SEQ ID NO: 424318 - DNA, 25 bp, Mus musculus
gatacccacgctgggacagcctgtc

SEQ ID NO: 424319 - DNA, 25 bp, Mus musculus
ggcgcttggatacccacgctgggac

SEQ ID NO: 424320 - DNA, 25 bp, Mus musculus
ctgtgcctggcgcttggatacccac

SEQ ID NO: 424321 - DNA, 25 bp, Mus musculus
aggccgactccgagtcgctgctccg

SEQ ID NO: 424322 - DNA, 25 bp, Mus musculus
agtgcccctggcagctcggcttctt

SEQ ID NO: 424323 - DNA, 25 bp, Mus musculus
tctttccgcacttcctgacgtgggg

SEQ ID NO: 424324 - DNA, 25 bp, Mus musculus
cgggagcgccacatctgcctcagtg

SEQ ID NO: 424325 - DNA, 25 bp, Mus musculus
gaccacagggcttgtcggcgccttc

SEQ ID NO: 424326 - DNA, 25 bp, Mus musculus
ctggcagctcggcttctttcgtccc

SEQ ID NO: 424327 - DNA, 25 bp, Mus musculus
cagcaccttcgcggggcccagagca

SEQ ID NO: 424328 - DNA, 25 bp, Mus musculus
agcagcagccacatcgcagcctccc

SEQ ID NO: 424329 - DNA, 25 bp, Mus musculus
tgcgctcatcctgcccagcaactct

SEQ ID NO: 424330 - DNA, 25 bp, Mus musculus
aggaccacagggcttgtcggcgcct

SEQ ID NO: 424331 - DNA, 25 bp, Mus musculus
tgcccagcaactctcttcctctttc

SEQ ID NO: 424332 - DNA, 25 bp, Mus musculus
ctctttccgcacttcctgacgtggg

SEQ ID NO: 424333 - DNA, 25 bp, Mus musculus
ctggaggctcaagccgaggaccaca

SEQ ID NO: 424334 - DNA, 25 bp, Mus musculus
ggcttgctgctagaggccggctgga

SEQ ID NO: 424335 - DNA, 25 bp, Mus musculus
gagcgggagcgccacatctgcctca

SEQ ID NO: 424336 - DNA, 25 bp, Mus musculus
ccaaagttcagagtctcgagcgctc

SEQ ID NO: 424337 - DNA, 25 bp, Mus musculus
tgaatcgctcttccaccaggggtcc

SEQ ID NO: 424338 - DNA, 25 bp, Mus musculus
ggtgcatctggctgaatcgctcttc

SEQ ID NO: 424339 - DNA, 25 bp, Mus musculus
acctgctttcgaaggtgcatctggc

SEQ ID NO: 424340 - DNA, 25 bp, Mus musculus
ccttacctgtatgacacctgctttc

SEQ ID NO: 424341 - DNA, 25 bp, Mus musculus
gcaccagggtgtcaccttagagaca

SEQ ID NO: 424342 - DNA, 25 bp, Mus musculus
acacgctgctagttcagtgctgatg

SEQ ID NO: 424343 - DNA, 25 bp, Mus musculus
ggcgcgtcgtgaacacacgctgcta

SEQ ID NO: 424344 - DNA, 25 bp, Mus musculus
ccggagccttgtagctgtcgccgca

SEQ ID NO: 424345 - DNA, 25 bp, Mus musculus
gcagccacatttcgggaaccctcgg

SEQ ID NO: 424346 - DNA, 25 bp, Mus musculus
tctgccggagaacccaccaaagttc

SEQ ID NO: 424347 - DNA, 25 bp, Mus musculus
atccttctgcggaacggctccgtgc

SEQ ID NO: 424348 - DNA, 25 bp, Mus musculus
agagacactcgccaagccgtagggt

SEQ ID NO: 424349 - DNA, 25 bp, Mus musculus
ccctggggagactgtgtccttggaa

SEQ ID NO: 424350 - DNA, 25 bp, Mus musculus
gcgccggttccactccctggaagga

SEQ ID NO: 424351 - DNA, 25 bp, Mus musculus
gcccgcctgaccaggaacgcggttg

SEQ ID NO: 424352 - DNA, 25 bp, Mus musculus
ccattggtgagagcagagaagctcc

SEQ ID NO: 424353 - DNA, 25 bp, Mus musculus
cagagaagctcctggccaatgatag

SEQ ID NO: 424354 - DNA, 25 bp, Mus musculus
caggaatcccgcttgccattggtga

SEQ ID NO: 424355 - DNA, 25 bp, Mus musculus
tccactccctggaaggagaggtccc

SEQ ID NO: 424356 - DNA, 25 bp, Mus musculus
ctccggctctcaggccggcaccctg

SEQ ID NO: 424357 - DNA, 25 bp, Mus musculus
tgcttctctccttggcgctacagct

SEQ ID NO: 424358 - DNA, 25 bp, Mus musculus
cctgctcgctcagtgctgcagttac

SEQ ID NO: 424359 - DNA, 25 bp, Mus musculus
ctcagtgctgcagttacgtggctta

SEQ ID NO: 424360 - DNA, 25 bp, Mus musculus
tgctgcagttacgtggcttaatcgg

SEQ ID NO: 424361 - DNA, 25 bp, Mus musculus
tacgtggcttaatcggcctcttggg

SEQ ID NO: 424362 - DNA, 25 bp, Mus musculus
cctggccaatgataggaggctgcga

SEQ ID NO: 424363 - DNA, 25 bp, Mus musculus
cccgcttgccattggtgagagcaga

SEQ ID NO: 424364 - DNA, 25 bp, Mus musculus
tgcgctttcctcactccagggcggc

SEQ ID NO: 424365 - DNA, 25 bp, Mus musculus
aatattaatgagtagagggcgtggc

SEQ ID NO: 424366 - DNA, 25 bp, Mus musculus
cccacatcaatattcacgataactc

SEQ ID NO: 424367 - DNA, 25 bp, Mus musculus
gctggttaacccagctggcccgggc

SEQ ID NO: 424368 - DNA, 25 bp, Mus musculus
cactttccggagtctgaaactggga

SEQ ID NO: 424369 - DNA, 25 bp, Mus musculus
ggcttctgtcactttccggagtctg

SEQ ID NO: 424370 - DNA, 25 bp, Mus musculus
tgcgcggcttctgtcactttccgga

SEQ ID NO: 424371 - DNA, 25 bp, Mus musculus
ctgggtctcttcctctgcgcggctt

SEQ ID NO: 424372 - DNA, 25 bp, Mus musculus
tgccgagtcgcagagatctctctgg

SEQ ID NO: 424373 - DNA, 25 bp, Mus musculus
tggctgccgagtcgcagagatctct

SEQ ID NO: 424374 - DNA, 25 bp, Mus musculus
cgcagctggcttccatggggagccc

SEQ ID NO: 424375 - DNA, 25 bp, Mus musculus
cggcgccgaaagcaccgtgggcttt

SEQ ID NO: 424376 - DNA, 25 bp, Mus musculus
gaaaggttccaagacggcgtccatc

SEQ ID NO: 424377 - DNA, 25 bp, Mus musculus
cgtgggctttcagccgactcctcct

SEQ ID NO: 424378 - DNA, 25 bp, Mus musculus
ccgcgttgcaaactgttgcatcaga

SEQ ID NO: 424379 - DNA, 25 bp, Mus musculus
catcagacagcaagcagcgggccgc

SEQ ID NO: 424380 - DNA, 25 bp, Mus musculus
taattcggctcagatcgcaagcgcg

SEQ ID NO: 424381 - DNA, 25 bp, Mus musculus
caaactgttgcatcagacagcaagc

SEQ ID NO: 424382 - DNA, 25 bp, Mus musculus
tcccagaaccgcgttgcaaactgtt

SEQ ID NO: 424383 - DNA, 25 bp, Mus musculus
ccagaaccgcgttgcaaactgttgc

SEQ ID NO: 424384 - DNA, 25 bp, Mus musculus
gcaccacaggcctccactcccagaa

SEQ ID NO: 424385 - DNA, 25 bp, Mus musculus
tcagcggcccgagtgccgcaccaca

SEQ ID NO: 424386 - DNA, 25 bp, Mus musculus
cccgcacatctggtgaaaagattcc

SEQ ID NO: 424387 - DNA, 25 bp, Mus musculus
tgccaaaaggtcttcgcgcctccgg

SEQ ID NO: 424388 - DNA, 25 bp, Mus musculus
cgatctgccaaaaggtcttcgcgcc

SEQ ID NO: 424389 - DNA, 25 bp, Mus musculus
agcgcgatctgccaaaaggtcttcg

SEQ ID NO: 424390 - DNA, 25 bp, Mus musculus
tcgcaagcgcgatctgccaaaaggt

SEQ ID NO: 424391 - DNA, 25 bp, Mus musculus
ctggtgaaaagattcccgccgcggg

SEQ ID NO: 424392 - DNA, 25 bp, Mus musculus
gggtctccctgagtcatgcggagct

SEQ ID NO: 424393 - DNA, 25 bp, Mus musculus
actcagggcgcaggcagcctaggaa

SEQ ID NO: 424394 - DNA, 25 bp, Mus musculus
ggcagcctaggaacgcccgctcagt

SEQ ID NO: 424395 - DNA, 25 bp, Mus musculus
gtcctcggctgtgccctcgcctgcc

SEQ ID NO: 424396 - DNA, 25 bp, Mus musculus
gagtcatgcggagctgtcctcggct

SEQ ID NO: 424397 - DNA, 25 bp, Mus musculus
ctgagtcatgcggagctgtcctcgg

SEQ ID NO: 424398 - DNA, 25 bp, Mus musculus
ctccctgagtcatgcggagctgtcc

SEQ ID NO: 424399 - DNA, 25 bp, Mus musculus
taggaacgcccgctcagtggatggg

SEQ ID NO: 424400 - DNA, 25 bp, Mus musculus
ggtctccctgagtcatgcggagctg

SEQ ID NO: 424401 - DNA, 25 bp, Mus musculus
gcagcctaggaacgcccgctcagtg

SEQ ID NO: 424402 - DNA, 25 bp, Mus musculus
cccttggcccgccaccttcctgagc

SEQ ID NO: 424403 - DNA, 25 bp, Mus musculus
tccctgagtcatgcggagctgtcct

SEQ ID NO: 424404 - DNA, 25 bp, Mus musculus
gcctaggaacgcccgctcagtggat

SEQ ID NO: 424405 - DNA, 25 bp, Mus musculus
tctccctgagtcatgcggagctgtc

SEQ ID NO: 424406 - DNA, 25 bp, Mus musculus
ttgcacagtgaagggtcccgtgtcc

SEQ ID NO: 424407 - DNA, 25 bp, Mus musculus
agctttccgtcattcgggccagaga

SEQ ID NO: 424408 - DNA, 25 bp, Mus musculus
cagaccctttgttctccaggttggg

SEQ ID NO: 424409 - DNA, 25 bp, Mus musculus
cgaccctcagttctcgcctttagag

SEQ ID NO: 424410 - DNA, 25 bp, Mus musculus
gaccacgtctacttccaggcgctga

SEQ ID NO: 424411 - DNA, 25 bp, Mus musculus
aggcgctgagaaactcctgggactc

SEQ ID NO: 424412 - DNA, 25 bp, Mus musculus
ccggcacagcctctcttcgtgagga

SEQ ID NO: 424413 - DNA, 25 bp, Mus musculus
ccaggagtctgattgcaaacgaacg

SEQ ID NO: 424414 - DNA, 25 bp, Mus musculus
gcactgcttatccaggcccagaatc

SEQ ID NO: 424415 - DNA, 25 bp, Mus musculus
cttacttgtttgaaggcgtcgcgga

SEQ ID NO: 424416 - DNA, 25 bp, Mus musculus
gaggcgctagcaccatggagctttc

SEQ ID NO: 424417 - DNA, 25 bp, Mus musculus
ggacatcctcggaccttgggcgcat

SEQ ID NO: 424418 - DNA, 25 bp, Mus musculus
gggcgattgtgtctccctgagtaca

SEQ ID NO: 424419 - DNA, 25 bp, Mus musculus
gacattgtatgtcgcgcccaggagt

SEQ ID NO: 424420 - DNA, 25 bp, Mus musculus
tgggacttgggaagccttgaacgaa

SEQ ID NO: 424421 - DNA, 25 bp, Mus musculus
taggcagaggggacggaaactccat

SEQ ID NO: 424422 - DNA, 25 bp, Mus musculus
aaagccactgcaggcggctgtaggc

SEQ ID NO: 424423 - DNA, 25 bp, Mus musculus
tcaaatgggactcgggattccttcc

SEQ ID NO: 424424 - DNA, 25 bp, Mus musculus
acccgccgctggtcaaatgggactc

SEQ ID NO: 424425 - DNA, 25 bp, Mus musculus
ccttgaacgaatgtcaatcggtcta

SEQ ID NO: 424426 - DNA, 25 bp, Mus musculus
cggtctaaagaagccggtctaaatg

SEQ ID NO: 424427 - DNA, 25 bp, Mus musculus
tctaaatgcggcgtgggctcagtca

SEQ ID NO: 424428 - DNA, 25 bp, Mus musculus
cgccctctgctggttatatggtgca

SEQ ID NO: 424429 - DNA, 25 bp, Mus musculus
tcacctggagaaggaaagccactgc

SEQ ID NO: 424430 - DNA, 25 bp, Mus musculus
acggaaactccatgcgcgagcggca

SEQ ID NO: 424431 - DNA, 25 bp, Mus musculus
ttatatggtgcaaatccggagccta

SEQ ID NO: 424432 - DNA, 25 bp, Mus musculus
gtgcaaatccggagcctagacccgc

SEQ ID NO: 424433 - DNA, 25 bp, Mus musculus
tgggctcagtcacctggagaaggaa

SEQ ID NO: 424434 - DNA, 25 bp, Mus musculus
tggtgctcgctctgacagactcctc

SEQ ID NO: 424435 - DNA, 25 bp, Mus musculus
tactccagctacgtggatgcccggc

SEQ ID NO: 424436 - DNA, 25 bp, Mus musculus
tcagagcctcggtgacgtctctagg

SEQ ID NO: 424437 - DNA, 25 bp, Mus musculus
ctgcgcacgccaggcgtctgcagtg

SEQ ID NO: 424438 - DNA, 25 bp, Mus musculus
cggaggctgctctgcatcaacataa

SEQ ID NO: 424439 - DNA, 25 bp, Mus musculus
tggtttgctacgcacgcatctccaa

SEQ ID NO: 424440 - DNA, 25 bp, Mus musculus
ccgtcgcagtgaaggtgacaccacc

SEQ ID NO: 424441 - DNA, 25 bp, Mus musculus
atccctcagggcctcagctcagatt

SEQ ID NO: 424442 - DNA, 25 bp, Mus musculus
aaaagcctccctgggtcagaccctg

SEQ ID NO: 424443 - DNA, 25 bp, Mus musculus
ggatgcccggctgggaaaagcctcc

SEQ ID NO: 424444 - DNA, 25 bp, Mus musculus
aagtccacttggtttgctacgcacg

SEQ ID NO: 424445 - DNA, 25 bp, Mus musculus
gcatctccaactcgctgcatcttgt

SEQ ID NO: 424446 - DNA, 25 bp, Mus musculus
ccgttactctccgtcgcagtgaagg

SEQ ID NO: 424447 - DNA, 25 bp, Mus musculus
tcagattctcctcccttggtgctcg

SEQ ID NO: 424448 - DNA, 25 bp, Mus musculus
tcccggtcagaatcgcgaactagcc

SEQ ID NO: 424449 - DNA, 25 bp, Mus musculus
cctgcagtcaggtcccggtcagaat

SEQ ID NO: 424450 - DNA, 25 bp, Mus musculus
tggctccgggaaggccctgttcctc

SEQ ID NO: 424451 - DNA, 25 bp, Mus musculus
tagcaagatgagcactggaccgcgg

SEQ ID NO: 424452 - DNA, 25 bp, Mus musculus
gcggaccaaggaccatagcaagatg

SEQ ID NO: 424453 - DNA, 25 bp, Mus musculus
cgaccctgcggaccaaggaccatag

SEQ ID NO: 424454 - DNA, 25 bp, Mus musculus
ggaagaagccaaccactagcaacag

SEQ ID NO: 424455 - DNA, 25 bp, Mus musculus
agctccggcgcttacaatccgggtc

SEQ ID NO: 424456 - DNA, 25 bp, Mus musculus
tccatctgaaaagacacgtggcgtg

SEQ ID NO: 424457 - DNA, 25 bp, Mus musculus
agcagttgtgcccagtccatctgaa

SEQ ID NO: 424458 - DNA, 25 bp, Mus musculus
tcttcatcgagggtagcagttgtgc

SEQ ID NO: 424459 - DNA, 25 bp, Mus musculus
actcctgtacgggtcttcatcgagg

SEQ ID NO: 424460 - DNA, 25 bp, Mus musculus
aggttgcgactcctgtacgggtctt

SEQ ID NO: 424461 - DNA, 25 bp, Mus musculus
cagcggtcacacagggtcccttctt

SEQ ID NO: 424462 - DNA, 25 bp, Mus musculus
agcctccgctaccaggagtatgtga

SEQ ID NO: 424463 - DNA, 25 bp, Mus musculus
ctccgcgggtctaagtcctcctggg

SEQ ID NO: 424464 - DNA, 25 bp, Mus musculus
ccacggcccagttggagacggctgt

SEQ ID NO: 424465 - DNA, 25 bp, Mus musculus
cgccacggcccagttggagacggct

SEQ ID NO: 424466 - DNA, 25 bp, Mus musculus
aggagtatgtgactcgtcatccagc

SEQ ID NO: 424467 - DNA, 25 bp, Mus musculus
tcctcctgggctgcggaagttgagc

SEQ ID NO: 424468 - DNA, 25 bp, Mus musculus
ctgagcctccgctaccaggagtatg

SEQ ID NO: 424469 - DNA, 25 bp, Mus musculus
agaagctacggctcctgagcctccg

SEQ ID NO: 424470 - DNA, 25 bp, Mus musculus
atggagaagctacggctcctgagcc

SEQ ID NO: 424471 - DNA, 25 bp, Mus musculus
agcaggatggagaagctacggctcc

SEQ ID NO: 424472 - DNA, 25 bp, Mus musculus
gctgccagccttgctgtcggccggt

SEQ ID NO: 424473 - DNA, 25 bp, Mus musculus
gcttagggccggaagcaggaaggag

SEQ ID NO: 424474 - DNA, 25 bp, Mus musculus
cctgggctgcggaagttgagcaacc

SEQ ID NO: 424475 - DNA, 25 bp, Mus musculus
tatgtgactcgtcatccagccgcca

SEQ ID NO: 424476 - DNA, 25 bp, Mus musculus
taggtgtctccgctgcctgtgcccg

SEQ ID NO: 424477 - DNA, 25 bp, Mus musculus
ctcccaatcggacgagtccattctg

SEQ ID NO: 424478 - DNA, 25 bp, Mus musculus
attctgcggccgcaaggggagaaac

SEQ ID NO: 424479 - DNA, 25 bp, Mus musculus
agacagaagcactgggcctctcccg

SEQ ID NO: 424480 - DNA, 25 bp, Mus musculus
cctcttgggtcggtaggtgtctccg

SEQ ID NO: 424481 - DNA, 25 bp, Mus musculus
ccggatcctggttggactccgcttt

SEQ ID NO: 424482 - DNA, 25 bp, Mus musculus
tcctggttggactccgctttgggag

SEQ ID NO: 424483 - DNA, 25 bp, Mus musculus
tccctactccagctagcacagagaa

SEQ ID NO: 424484 - DNA, 25 bp, Mus musculus
cccactcctggtcgttgggcagcga

SEQ ID NO: 424485 - DNA, 25 bp, Mus musculus
tgggcagcgagctcgtcgtcctcct

SEQ ID NO: 424486 - DNA, 25 bp, Mus musculus
ccggagtgtcacctgccgcgtcgat

SEQ ID NO: 424487 - DNA, 25 bp, Mus musculus
gccgcgtcgatcaggtccatctgca

SEQ ID NO: 424488 - DNA, 25 bp, Mus musculus
cgatcaggtccatctgcagcatctc

SEQ ID NO: 424489 - DNA, 25 bp, Mus musculus
aaaggttgagcgtggtaggcctctt

SEQ ID NO: 424490 - DNA, 25 bp, Mus musculus
cagggtctccaaggatcccgaggtt

SEQ ID NO: 424491 - DNA, 25 bp, Mus musculus
gcgacgcgatgtgcagtcccaggaa

SEQ ID NO: 424492 - DNA, 25 bp, Mus musculus
cagccctggccatccgggcggagag

SEQ ID NO: 424493 - DNA, 25 bp, Mus musculus
cgctccgccattccggggtgcagcc

SEQ ID NO: 424494 - DNA, 25 bp, Mus musculus
aggccgctctctcgctccgccattc

SEQ ID NO: 424495 - DNA, 25 bp, Mus musculus
acctgaaattgggaggcgacgcgat

SEQ ID NO: 424496 - DNA, 25 bp, Mus musculus
ccttacctgaaattgggaggcgacg

SEQ ID NO: 424497 - DNA, 25 bp, Mus musculus
tcgatccttacctgaaattgggagg

SEQ ID NO: 424498 - DNA, 25 bp, Mus musculus
gcctcgatccttacctgaaattggg

SEQ ID NO: 424499 - DNA, 25 bp, Mus musculus
gggcctcgatccttacctgaaattg

SEQ ID NO: 424500 - DNA, 25 bp, Mus musculus
gatcccgaggttccgggcctcgatc

SEQ ID NO: 424501 - DNA, 25 bp, Mus musculus
cctcagggtctccaaggatcccgag

SEQ ID NO: 424502 - DNA, 25 bp, Mus musculus
ccgccgcggggttcggactgagctg

SEQ ID NO: 424503 - DNA, 25 bp, Mus musculus
tccgggcctcgatccttacctgaaa

SEQ ID NO: 424504 - DNA, 25 bp, Mus musculus
tcgaggatgtagacgcagcgcacac

SEQ ID NO: 424505 - DNA, 25 bp, Mus musculus
tgcccacagacgaggaggccgcgaa

SEQ ID NO: 424506 - DNA, 25 bp, Mus musculus
tcggatctcctacgcatttcgcgtc

SEQ ID NO: 424507 - DNA, 25 bp, Mus musculus
tggagccgtagtcctttgcggaacc

SEQ ID NO: 424508 - DNA, 25 bp, Mus musculus
ctttgcggaaccagtgcaccgagga

SEQ ID NO: 424509 - DNA, 25 bp, Mus musculus
aaccagtgcaccgaggacgcgccgt

SEQ ID NO: 424510 - DNA, 25 bp, Mus musculus
cgcccatcgattgcgcggggaccgt

SEQ ID NO: 424511 - DNA, 25 bp, Mus musculus
atcgccgcctggactgggtctcggt

SEQ ID NO: 424512 - DNA, 25 bp, Mus musculus
tgggaccctccctctgttccattgg

SEQ ID NO: 424513 - DNA, 25 bp, Mus musculus
ctgttccattggtcagcagcgtcgg

SEQ ID NO: 424514 - DNA, 25 bp, Mus musculus
ttcccaccatgtgtggtcccgcttg

SEQ ID NO: 424515 - DNA, 25 bp, Mus musculus
gcttggtagccacccgccggtgacg

SEQ ID NO: 424516 - DNA, 25 bp, Mus musculus
tctggagggacctcggatctcctac

SEQ ID NO: 424517 - DNA, 25 bp, Mus musculus
atcgcctctgtgattgggtgagacc

SEQ ID NO: 424518 - DNA, 25 bp, Mus musculus
atcaccgaggctcaggaaggcgtct

SEQ ID NO: 424519 - DNA, 25 bp, Mus musculus
cgaattcaagttccggctcagcgac

SEQ ID NO: 424520 - DNA, 25 bp, Mus musculus
ttcaagttccggctcagcgacgcgg

SEQ ID NO: 424521 - DNA, 25 bp, Mus musculus
gcgcatttcctgacacgcctacgag

SEQ ID NO: 424522 - DNA, 25 bp, Mus musculus
gacacgcctacgagccgccttaaag

SEQ ID NO: 424523 - DNA, 25 bp, Mus musculus
ccttaaagggccagctcgcaggccg

SEQ ID NO: 424524 - DNA, 25 bp, Mus musculus
agggccagctcgcaggccgttgcca

SEQ ID NO: 424525 - DNA, 25 bp, Mus musculus
ccgttgccacttcccgcggccgtca

SEQ ID NO: 424526 - DNA, 25 bp, Mus musculus
ccctgcggttgccacgagccgaatt

SEQ ID NO: 424527 - DNA, 25 bp, Mus musculus
ggaagcacccgcagagccgaaagga

SEQ ID NO: 424528 - DNA, 25 bp, Mus musculus
ctcaggaaggcgtctcgagggacac

SEQ ID NO: 424529 - DNA, 25 bp, Mus musculus
tgctgcagggagatcaccgaggctc

SEQ ID NO: 424530 - DNA, 25 bp, Mus musculus
tgccacgagccgaattcaagttccg

SEQ ID NO: 424531 - DNA, 25 bp, Mus musculus
ctgaccggagcaaggccctgcggtt

SEQ ID NO: 424532 - DNA, 25 bp, Mus musculus
tgggataaacgtctgcccggggctc

SEQ ID NO: 424533 - DNA, 25 bp, Mus musculus
tgttctgctgctgcggtacccgctc

SEQ ID NO: 424534 - DNA, 25 bp, Mus musculus
tgcaacagcctgctagacccgagcg

SEQ ID NO: 424535 - DNA, 25 bp, Mus musculus
tctgctccgggttgatcatgcaaca

SEQ ID NO: 424536 - DNA, 25 bp, Mus musculus
ctcctctggtgagggcagcaaactt

SEQ ID NO: 424537 - DNA, 25 bp, Mus musculus
gtacccgctcgggtgtctgctccgg

SEQ ID NO: 424538 - DNA, 25 bp, Mus musculus
tgcccggggctcctgttctgctgct

SEQ ID NO: 424539 - DNA, 25 bp, Mus musculus
gggcagcaaacttgggataaacgtc

SEQ ID NO: 424540 - DNA, 25 bp, Mus musculus
tcctgacctcctcctctggtgaggg

SEQ ID NO: 424541 - DNA, 25 bp, Mus musculus
ggagagctccgcgatcgctcctgac

SEQ ID NO: 424542 - DNA, 25 bp, Mus musculus
ggctagtagccctccggagagctcc

SEQ ID NO: 424543 - DNA, 25 bp, Mus musculus
cggactgcaccgcaacagccgggag

SEQ ID NO: 424544 - DNA, 25 bp, Mus musculus
cccggagagcctgactctagactaa

SEQ ID NO: 424545 - DNA, 25 bp, Mus musculus
tctagactaaggatggagccagcgc

SEQ ID NO: 424546 - DNA, 25 bp, Mus musculus
gccggactctgctcaagtcgctttc

SEQ ID NO: 424547 - DNA, 25 bp, Mus musculus
gcgctgccttgtctgcgcatgcata

SEQ ID NO: 424548 - DNA, 25 bp, Mus musculus
agtgggtcgtctctgtaggaattta

SEQ ID NO: 424549 - DNA, 25 bp, Mus musculus
aatttacggagcttgtgccggactc

SEQ ID NO: 424550 - DNA, 25 bp, Mus musculus
aggctgtcacagaccgaactcagtc

SEQ ID NO: 424551 - DNA, 25 bp, Mus musculus
tcagcaggtggcagtaatggcccta

SEQ ID NO: 424552 - DNA, 25 bp, Mus musculus
tagactctaaccagggcatcacttc

SEQ ID NO: 424553 - DNA, 25 bp, Mus musculus
gccagcttccgaggcgctcactgga

SEQ ID NO: 424554 - DNA, 25 bp, Mus musculus
tcccgcaaagactgcagagtgggtc

SEQ ID NO: 424555 - DNA, 25 bp, Mus musculus
agcgcgcatccaaacacctggtctg

SEQ ID NO: 424556 - DNA, 25 bp, Mus musculus
tgatgtagcccttgtcccgcaaaga

SEQ ID NO: 424557 - DNA, 25 bp, Mus musculus
tcacacagttgagccagcgcgcatc

SEQ ID NO: 424558 - DNA, 25 bp, Mus musculus
gcattgctgcacgaagcgtggcaca

SEQ ID NO: 424559 - DNA, 25 bp, Mus musculus
aactgcaggtacctttgatgtagcc

SEQ ID NO: 424560 - DNA, 25 bp, Mus musculus
tgccgacacatgcaccccaagaagg

SEQ ID NO: 424561 - DNA, 25 bp, Mus musculus
agcctccgcctctgacgtccttaca

SEQ ID NO: 424562 - DNA, 25 bp, Mus musculus
gacgtccttacagccatccttcctc

SEQ ID NO: 424563 - DNA, 25 bp, Mus musculus
tccttcctcccagctggctgcgtcc

SEQ ID NO: 424564 - DNA, 25 bp, Mus musculus
cgccctcggagtctagagagcggct

SEQ ID NO: 424565 - DNA, 25 bp, Mus musculus
caggcaccatggtgctgtcggtgcc

SEQ ID NO: 424566 - DNA, 25 bp, Mus musculus
ccatggtgctgtcggtgcctgtgat

SEQ ID NO: 424567 - DNA, 25 bp, Mus musculus
tgcctgtgatcgcgctgggcgccac

SEQ ID NO: 424568 - DNA, 25 bp, Mus musculus
agcatccttgcgctgtgcggggtca

SEQ ID NO: 424569 - DNA, 25 bp, Mus musculus
atccttgcgctgtgcggggtcactt

SEQ ID NO: 424570 - DNA, 25 bp, Mus musculus
gggtcacttgcctgtgccgacacat

SEQ ID NO: 424571 - DNA, 25 bp, Mus musculus
tcacttgcctgtgccgacacatgca

SEQ ID NO: 424572 - DNA, 25 bp, Mus musculus
tgccgcgggaccgtgagcccgaccc

SEQ ID NO: 424573 - DNA, 25 bp, Mus musculus
aggcaaggcccggtgtgcttcaggc

SEQ ID NO: 424574 - DNA, 25 bp, Mus musculus
gaaccgccctctcgccacctcggtg

SEQ ID NO: 424575 - DNA, 25 bp, Mus musculus
cgccacttaattctgacgcgcgagg

SEQ ID NO: 424576 - DNA, 25 bp, Mus musculus
acttaattctgacgcgcgaggccgc

SEQ ID NO: 424577 - DNA, 25 bp, Mus musculus
acgggcttcttactccggcgttgca

SEQ ID NO: 424578 - DNA, 25 bp, Mus musculus
tccggcgttgcaaccgccgtcggaa

SEQ ID NO: 424579 - DNA, 25 bp, Mus musculus
ctaaggtgccgggtaccaacgccag

SEQ ID NO: 424580 - DNA, 25 bp, Mus musculus
ggtgccgggtaccaacgccagcagc

SEQ ID NO: 424581 - DNA, 25 bp, Mus musculus
agcgcgcctttgtgcgaggtaggct

SEQ ID NO: 424582 - DNA, 25 bp, Mus musculus
gtaggctggccccacacttacttct

SEQ ID NO: 424583 - DNA, 25 bp, Mus musculus
cttacttctcacacaaagacgaggg

SEQ ID NO: 424584 - DNA, 25 bp, Mus musculus
tgacttagtgatgactcagcggccc

SEQ ID NO: 424585 - DNA, 25 bp, Mus musculus
ggaccctgtcgttggcctgcagggc

SEQ ID NO: 424586 - DNA, 25 bp, Mus musculus
cacaaagacgaggggcttgcaaggc

SEQ ID NO: 424587 - DNA, 25 bp, Mus musculus
gttgggcgtgacttagtgatgactc

SEQ ID NO: 424588 - DNA, 25 bp, Mus musculus
tgcaggaaacccgagctccctgcga

SEQ ID NO: 424589 - DNA, 25 bp, Mus musculus
cgggattcatgcaaacgcgacagcc

SEQ ID NO: 424590 - DNA, 25 bp, Mus musculus
acgcgcttttccctttctcagcaag

SEQ ID NO: 424591 - DNA, 25 bp, Mus musculus
aaaggcctgatctctcagggagctg

SEQ ID NO: 424592 - DNA, 25 bp, Mus musculus
gacagcctcgcaggctcgggctact

SEQ ID NO: 424593 - DNA, 25 bp, Mus musculus
ctcagcaagcgggaaaggcctgatc

SEQ ID NO: 424594 - DNA, 25 bp, Mus musculus
tcgggctacttgcaacacccttttg

SEQ ID NO: 424595 - DNA, 25 bp, Mus musculus
ttccgcgcacgagcagaggtgacaa

SEQ ID NO: 424596 - DNA, 25 bp, Mus musculus
gggtcgtgatcgatcaatttaaagt

SEQ ID NO: 424597 - DNA, 25 bp, Mus musculus
agagggaaagcttcccgcggcctgc

SEQ ID NO: 424598 - DNA, 25 bp, Mus musculus
ttgtcctcgctacccggggcttctg

SEQ ID NO: 424599 - DNA, 25 bp, Mus musculus
atggaggtctcggagcctgttaacc

SEQ ID NO: 424600 - DNA, 25 bp, Mus musculus
tccgcagggaggctgagcatctccg

SEQ ID NO: 424601 - DNA, 25 bp, Mus musculus
acagaaggtggagtcactctcggga

SEQ ID NO: 424602 - DNA, 25 bp, Mus musculus
ccggcagcccggcattccttgcggg

SEQ ID NO: 424603 - DNA, 25 bp, Mus musculus
cgccgcgttttgctccacctcccgg

SEQ ID NO: 424604 - DNA, 25 bp, Mus musculus
ctgttcgaccgcgtgtgtggcccgc

SEQ ID NO: 424605 - DNA, 25 bp, Mus musculus
ccggccgtcacccaccttcgcggcg

SEQ ID NO: 424606 - DNA, 25 bp, Mus musculus
gaccgcaggggacagggcgccctgc

SEQ ID NO: 424607 - DNA, 25 bp, Mus musculus
gtcacccaccttcgcggcggggcgc

SEQ ID NO: 424608 - DNA, 25 bp, Mus musculus
ccgcggctgctgttcgaccgcgtgt

SEQ ID NO: 424609 - DNA, 25 bp, Mus musculus
tccttgcgggggcatgtggcttctt

SEQ ID NO: 424610 - DNA, 25 bp, Mus musculus
cggggctcgcaggacacgagcggcg

SEQ ID NO: 424611 - DNA, 25 bp, Mus musculus
acagccccgggttcacgcgcggatg

SEQ ID NO: 424612 - DNA, 25 bp, Mus musculus
gttcacgcgcggatggtcgcgcgcg

SEQ ID NO: 424613 - DNA, 25 bp, Mus musculus
ccgacacccacctcggccaccgcag

SEQ ID NO: 424614 - DNA, 25 bp, Mus musculus
gtgcgagcgccgcgttttgctccac

SEQ ID NO: 424615 - DNA, 25 bp, Mus musculus
ggccttggcgatggctcccttgcca

SEQ ID NO: 424616 - DNA, 25 bp, Mus musculus
ctagaaagttgtggcgtttgcgcaa

SEQ ID NO: 424617 - DNA, 25 bp, Mus musculus
ccctgctttgaccaccatcttatta

SEQ ID NO: 424618 - DNA, 25 bp, Mus musculus
ggcaaagtttcagcgccagcggcag

SEQ ID NO: 424619 - DNA, 25 bp, Mus musculus
ccgtgctgcaaccaagacttaaaat

SEQ ID NO: 424620 - DNA, 25 bp, Mus musculus
tgttcacgttcatggccacggtggc

SEQ ID NO: 424621 - DNA, 25 bp, Mus musculus
agcgggctgcgccaactttgtgcct

SEQ ID NO: 424622 - DNA, 25 bp, Mus musculus
agcgtcttccgaagccatgttcacg

SEQ ID NO: 424623 - DNA, 25 bp, Mus musculus
ccgaggaaaaggctacagtggaaca

SEQ ID NO: 424624 - DNA, 25 bp, Mus musculus
tctctttgcgaacgccgggcccgaa

SEQ ID NO: 424625 - DNA, 25 bp, Mus musculus
cctgtctacgcgctctctttgcgaa

SEQ ID NO: 424626 - DNA, 25 bp, Mus musculus
ggtccctgcaactaggccagcggct

SEQ ID NO: 424627 - DNA, 25 bp, Mus musculus
agataaaaggcacgccctccctctg

SEQ ID NO: 424628 - DNA, 25 bp, Mus musculus
tttgcgcaagcccatccgagggtgc

SEQ ID NO: 424629 - DNA, 25 bp, Mus musculus
tcacagagaggcatgcggtccctaa

SEQ ID NO: 424630 - DNA, 25 bp, Mus musculus
gacgcctttgttgctgcgatccgcc

SEQ ID NO: 424631 - DNA, 25 bp, Mus musculus
gcgccggagagacgcctttgttgct

SEQ ID NO: 424632 - DNA, 25 bp, Mus musculus
agagacgcctttgttgctgcgatcc

SEQ ID NO: 424633 - DNA, 25 bp, Mus musculus
caagcttctcgccagcgcccttccc

SEQ ID NO: 424634 - DNA, 25 bp, Mus musculus
tgttgctgcgatccgcctcggcagc

SEQ ID NO: 424635 - DNA, 25 bp, Mus musculus
tcggcagcgccgagtattaataaac

SEQ ID NO: 424636 - DNA, 25 bp, Mus musculus
gcagcgccgagtattaataaaccga

SEQ ID NO: 424637 - DNA, 25 bp, Mus musculus
agcgccgagtattaataaaccgatc

SEQ ID NO: 424638 - DNA, 25 bp, Mus musculus
cgagtattaataaaccgatcgcccg

SEQ ID NO: 424639 - DNA, 25 bp, Mus musculus
gagggagcgacacccacagcgtcct

SEQ ID NO: 424640 - DNA, 25 bp, Mus musculus
cccgcaggaggagactgattctccc

SEQ ID NO: 424641 - DNA, 25 bp, Mus musculus
caggaggagactgattctccctcca

SEQ ID NO: 424642 - DNA, 25 bp, Mus musculus
gattctccctccaagcttctcgcca

SEQ ID NO: 424643 - DNA, 25 bp, Mus musculus
ccttcccttcctcgcccacctgcct

SEQ ID NO: 424644 - DNA, 25 bp, Mus musculus
gggctttatctctttgattcggagc

SEQ ID NO: 424645 - DNA, 25 bp, Mus musculus
gcagaaaagtgtttgggcctgaccc

SEQ ID NO: 424646 - DNA, 25 bp, Mus musculus
tcggcgcggagatgaagatagatca

SEQ ID NO: 424647 - DNA, 25 bp, Mus musculus
gtcgcggactctcgcttcacaaagt

SEQ ID NO: 424648 - DNA, 25 bp, Mus musculus
tgcgcggtgtaaacttgcgagtttc

SEQ ID NO: 424649 - DNA, 25 bp, Mus musculus
tgtcttcagcgcttggttctcggtc

SEQ ID NO: 424650 - DNA, 25 bp, Mus musculus
cgcgcgccaggaacgtaagtctgct

SEQ ID NO: 424651 - DNA, 25 bp, Mus musculus
tgagagcggagagtaaagcagtttc

SEQ ID NO: 424652 - DNA, 25 bp, Mus musculus
cccaggggctgtttatttcgctctc

SEQ ID NO: 424653 - DNA, 25 bp, Mus musculus
cttgcactgactcggtttccctttc

SEQ ID NO: 424654 - DNA, 25 bp, Mus musculus
ggcactgtcctctgtccttttcgtt

SEQ ID NO: 424655 - DNA, 25 bp, Mus musculus
gctgagctcctactggcactgtcct

SEQ ID NO: 424656 - DNA, 25 bp, Mus musculus
gggcatcgagcaccctgcgaacgac

SEQ ID NO: 424657 - DNA, 25 bp, Mus musculus
tttatcccggggtctctgtcttcag

SEQ ID NO: 424658 - DNA, 25 bp, Mus musculus
cttcggaatcgcacagcgttgcgtc

SEQ ID NO: 424659 - DNA, 25 bp, Mus musculus
tctaggagcgttctccaggccctgc

SEQ ID NO: 424660 - DNA, 25 bp, Mus musculus
acctgcttgtgtgcagggtcacttg

SEQ ID NO: 424661 - DNA, 25 bp, Mus musculus
tgctaccagggtcccacgaaggcga

SEQ ID NO: 424662 - DNA, 25 bp, Mus musculus
ctcgggtgcgagagcaaaatctagg

SEQ ID NO: 424663 - DNA, 25 bp, Mus musculus
cagaatggctgcacctgacctgggc

SEQ ID NO: 424664 - DNA, 25 bp, Mus musculus
ttgaatcctacctggcagaggctcg

SEQ ID NO: 424665 - DNA, 25 bp, Mus musculus
cacagaggggctcagtgattgaatc

SEQ ID NO: 424666 - DNA, 25 bp, Mus musculus
tgggacccgcactgatctgggatct

SEQ ID NO: 424667 - DNA, 25 bp, Mus musculus
caggggagtcgcttcagaacttggt

SEQ ID NO: 424668 - DNA, 25 bp, Mus musculus
agacaactctcccagcgcaagcagg

SEQ ID NO: 424669 - DNA, 25 bp, Mus musculus
taggtctccacatccacggagctgg

SEQ ID NO: 424670 - DNA, 25 bp, Mus musculus
cggagctggacatcttcccgcgcaa

SEQ ID NO: 424671 - DNA, 25 bp, Mus musculus
ttcccgcgcaaggaatgataactcg

SEQ ID NO: 424672 - DNA, 25 bp, Mus musculus
gccaggcatgaacgctgagacttgc

SEQ ID NO: 424673 - DNA, 25 bp, Mus musculus
gtctaacgcttcgagggcgtccctg

SEQ ID NO: 424674 - DNA, 25 bp, Mus musculus
cgtcgcgaagctcctgcaagtctgt

SEQ ID NO: 424675 - DNA, 25 bp, Mus musculus
tgtccggagaaccaggcacctcaga

SEQ ID NO: 424676 - DNA, 25 bp, Mus musculus
gcagtctcccgggtctgaattagaa

SEQ ID NO: 424677 - DNA, 25 bp, Mus musculus
gctagaagcttctcccgctgcattc

SEQ ID NO: 424678 - DNA, 25 bp, Mus musculus
tcaaacttttcgctttgcgctgccc

SEQ ID NO: 424679 - DNA, 25 bp, Mus musculus
ggacggtagcctcaagctccaggag

SEQ ID NO: 424680 - DNA, 25 bp, Mus musculus
tctctacttgcagaggggcgcctgc

SEQ ID NO: 424681 - DNA, 25 bp, Mus musculus
ctttaacaagttccagccgcagccg

SEQ ID NO: 424682 - DNA, 25 bp, Mus musculus
cccaggaggcgacaagttcggtaca

SEQ ID NO: 424683 - DNA, 25 bp, Mus musculus
acttgcgtctcttactgcgagtccc

SEQ ID NO: 424684 - DNA, 25 bp, Mus musculus
ggcacctcagaaaacccgagtcctg

SEQ ID NO: 424685 - DNA, 25 bp, Mus musculus
atggacgcctactacagcccggtgt

SEQ ID NO: 424686 - DNA, 25 bp, Mus musculus
gggcgcccaggtctcagaacgctac

SEQ ID NO: 424687 - DNA, 25 bp, Mus musculus
tggggcgttcggctccacaatcctc

SEQ ID NO: 424688 - DNA, 25 bp, Mus musculus
cagcctcgcgggtatctctgaggtt

SEQ ID NO: 424689 - DNA, 25 bp, Mus musculus
cgggtatctctgaggttgcggctca

SEQ ID NO: 424690 - DNA, 25 bp, Mus musculus
gttgcggctcagctggacacagtcc

SEQ ID NO: 424691 - DNA, 25 bp, Mus musculus
tcgctttcgattcggtgcacgcagg

SEQ ID NO: 424692 - DNA, 25 bp, Mus musculus
ttcggtgcacgcaggttttcgttga

SEQ ID NO: 424693 - DNA, 25 bp, Mus musculus
cgcaggttttcgttgagtgcaattt

SEQ ID NO: 424694 - DNA, 25 bp, Mus musculus
cgttgagtgcaatttgggacctcca

SEQ ID NO: 424695 - DNA, 25 bp, Mus musculus
tgggacctccaacagcccatctgga

SEQ ID NO: 424696 - DNA, 25 bp, Mus musculus
tctggaatgcagagctctgggcgcc

SEQ ID NO: 424697 - DNA, 25 bp, Mus musculus
gtctcagaacgctacggcctggctc

SEQ ID NO: 424698 - DNA, 25 bp, Mus musculus
ccaccgaggggcatattctgatttt

SEQ ID NO: 424699 - DNA, 25 bp, Mus musculus
agcccatctggaatgcagagctctg

SEQ ID NO: 424700 - DNA, 25 bp, Mus musculus
aaggggtgttccaccagcacgtaca

SEQ ID NO: 424701 - DNA, 25 bp, Mus musculus
cgcgcgccaagtcatccagggactg

SEQ ID NO: 424702 - DNA, 25 bp, Mus musculus
ccgtctttgccggtgtactcgaagg

SEQ ID NO: 424703 - DNA, 25 bp, Mus musculus
aacgctcgttcggttggatggcgat

SEQ ID NO: 424704 - DNA, 25 bp, Mus musculus
caagtccggaatggcctcgtagaca

SEQ ID NO: 424705 - DNA, 25 bp, Mus musculus
agcccgccacgctggaggccttgaa

SEQ ID NO: 424706 - DNA, 25 bp, Mus musculus
cgacctacctgctttgggctctctg

SEQ ID NO: 424707 - DNA, 25 bp, Mus musculus
cgcacgtaaaggcaggcgggccctc

SEQ ID NO: 424708 - DNA, 25 bp, Mus musculus
agccaggctgttgcgctggccaccg

SEQ ID NO: 424709 - DNA, 25 bp, Mus musculus
ctcacgaagcggtagtcgtaggcca

SEQ ID NO: 424710 - DNA, 25 bp, Mus musculus
cgggcagctcgcgtacgtactgcgc

SEQ ID NO: 424711 - DNA, 25 bp, Mus musculus
acgtgccaccagtgctcggtgctgc

SEQ ID NO: 424712 - DNA, 25 bp, Mus musculus
cgcagcagtcggtaacgctcgttcg

SEQ ID NO: 424713 - DNA, 25 bp, Mus musculus
acattctccgagtcgctaggcgcca

SEQ ID NO: 424714 - DNA, 25 bp, Mus musculus
cggtggcgagctgaaataagaaatg

SEQ ID NO: 424715 - DNA, 25 bp, Mus musculus
atcttgctaacgtcccatagggctt

SEQ ID NO: 424716 - DNA, 25 bp, Mus musculus
ccatagggctttggtttcagcggca

SEQ ID NO: 424717 - DNA, 25 bp, Mus musculus
cagacggacttttctggagagtgcc

SEQ ID NO: 424718 - DNA, 25 bp, Mus musculus
gagagtgccttgattccgtttgagg

SEQ ID NO: 424719 - DNA, 25 bp, Mus musculus
tttcttttggaagcgccgcggagca

SEQ ID NO: 424720 - DNA, 25 bp, Mus musculus
cggagcagcttagtcgcgtagtttc

SEQ ID NO: 424721 - DNA, 25 bp, Mus musculus
tggaaaacctccgtagcagctggga

SEQ ID NO: 424722 - DNA, 25 bp, Mus musculus
ttgtctgctggtgccgcgcacctca

SEQ ID NO: 424723 - DNA, 25 bp, Mus musculus
acctcagtcccgaggcagcaggcag

SEQ ID NO: 424724 - DNA, 25 bp, Mus musculus
gggacaatacgggagagctaatttc

SEQ ID NO: 424725 - DNA, 25 bp, Mus musculus
cgccgtgcattaaatcttgctaacg

SEQ ID NO: 424726 - DNA, 25 bp, Mus musculus
agctaatttccggagccttccgccg

SEQ ID NO: 424727 - DNA, 25 bp, Mus musculus
ccgccggcctgcgataaggcgctag

SEQ ID NO: 424728 - DNA, 25 bp, Mus musculus
cgcactgcgcatgcgaagcggtagc

SEQ ID NO: 424729 - DNA, 25 bp, Mus musculus
gcgctcacctcggaaccggccgctt

SEQ ID NO: 424730 - DNA, 25 bp, Mus musculus
gatcgcgcggtgacgggagcccgcc

SEQ ID NO: 424731 - DNA, 25 bp, Mus musculus
cagcgcacgtgagcattcccgttcg

SEQ ID NO: 424732 - DNA, 25 bp, Mus musculus
gtcagcgcacgtgagcattcccgtt

SEQ ID NO: 424733 - DNA, 25 bp, Mus musculus
aggagtcagcgcacgtgagcattcc

SEQ ID NO: 424734 - DNA, 25 bp, Mus musculus
actgcgcatgcgaagcggtagcgcc

SEQ ID NO: 424735 - DNA, 25 bp, Mus musculus
ccgcgagccacggctgtgtcggatc

SEQ ID NO: 424736 - DNA, 25 bp, Mus musculus
cgcgcactgcgcatgcgaagcggta

SEQ ID NO: 424737 - DNA, 25 bp, Mus musculus
cccacggctgacacggcgcgcactg

SEQ ID NO: 424738 - DNA, 25 bp, Mus musculus
gggaagcctgcgccggcctccagtt

SEQ ID NO: 424739 - DNA, 25 bp, Mus musculus
agcaccaggtaccctggagccagcg

SEQ ID NO: 424740 - DNA, 25 bp, Mus musculus
gccgccagcaccaggtaccctggag

SEQ ID NO: 424741 - DNA, 25 bp, Mus musculus
ccctgctggacaggaggagtcagcg

SEQ ID NO: 424742 - DNA, 25 bp, Mus musculus
aaggtcaccggctgcgtcttgaagc

SEQ ID NO: 424743 - DNA, 25 bp, Mus musculus
ggcggcccgcctagccgcttatata

SEQ ID NO: 424744 - DNA, 25 bp, Mus musculus
tagccgcttatatagcccgcctctg

SEQ ID NO: 424745 - DNA, 25 bp, Mus musculus
cttggtagctggagcagatgcccat

SEQ ID NO: 424746 - DNA, 25 bp, Mus musculus
tgcgggaactcatcggtcaggcaca

SEQ ID NO: 424747 - DNA, 25 bp, Mus musculus
ctcctggatctcgtcgaaggtcacc

SEQ ID NO: 424748 - DNA, 25 bp, Mus musculus
aagctctgcaggaacgacttcttgg

SEQ ID NO: 424749 - DNA, 25 bp, Mus musculus
tctgcagcgacaggctctgcgtgct

SEQ ID NO: 424750 - DNA, 25 bp, Mus musculus
tcctcagtttgcagctgccgagcgg

SEQ ID NO: 424751 - DNA, 25 bp, Mus musculus
ggagtccaggctgttcctcagtttg

SEQ ID NO: 424752 - DNA, 25 bp, Mus musculus
gccgggctacagtcccaaggagtga

SEQ ID NO: 424753 - DNA, 25 bp, Mus musculus
cagagttcggactgggaaagagtta

SEQ ID NO: 424754 - DNA, 25 bp, Mus musculus
gcgcacactcacagcagagttcgga

SEQ ID NO: 424755 - DNA, 25 bp, Mus musculus
aagtgtggcatcaccgcttggtagc

SEQ ID NO: 424756 - DNA, 25 bp, Mus musculus
aaagctgggtagtcttgtcactttc

SEQ ID NO: 424757 - DNA, 25 bp, Mus musculus
gcggccatttactgccctctgattg

SEQ ID NO: 424758 - DNA, 25 bp, Mus musculus
caggcatttcggagagggtctgcca

SEQ ID NO: 424759 - DNA, 25 bp, Mus musculus
gcttcccgcggctggagaagaacta

SEQ ID NO: 424760 - DNA, 25 bp, Mus musculus
ctggagaagaactagagacaaagcc

SEQ ID NO: 424761 - DNA, 25 bp, Mus musculus
agacaaagccgggatccaaggcctt

SEQ ID NO: 424762 - DNA, 25 bp, Mus musculus
aggccttccagcgaggctccaatca

SEQ ID NO: 424763 - DNA, 25 bp, Mus musculus
cgggtgctcgcgagttcaaaacaca

SEQ ID NO: 424764 - DNA, 25 bp, Mus musculus
cgcgagttcaaaacacactctctca

SEQ ID NO: 424765 - DNA, 25 bp, Mus musculus
actctctcattaattaaaagctggg

SEQ ID NO: 424766 - DNA, 25 bp, Mus musculus
tgtcactttctttcctagccaagga

SEQ ID NO: 424767 - DNA, 25 bp, Mus musculus
ccaaggaagcgcctcgagaagtccc

SEQ ID NO: 424768 - DNA, 25 bp, Mus musculus
ctttggaggtcgagcggccatttac

SEQ ID NO: 424769 - DNA, 25 bp, Mus musculus
cttggccctcgcgtgaggctttgga

SEQ ID NO: 424770 - DNA, 25 bp, Mus musculus
ttcctgcggtgggaggctaattgca

SEQ ID NO: 424771 - DNA, 25 bp, Mus musculus
cagcctctcggaagggcaaggtatt

SEQ ID NO: 424772 - DNA, 25 bp, Mus musculus
ggcaaggtattatgtgctctggttg

SEQ ID NO: 424773 - DNA, 25 bp, Mus musculus
tattatgtgctctggttggggaccc

SEQ ID NO: 424774 - DNA, 25 bp, Mus musculus
ttatgtgctctggttggggaccctg

SEQ ID NO: 424775 - DNA, 25 bp, Mus musculus
gcgagctcgtcactgcacgcccacg

SEQ ID NO: 424776 - DNA, 25 bp, Mus musculus
gccttcctgcggtgggaggctaatt

SEQ ID NO: 424777 - DNA, 25 bp, Mus musculus
gcccgtcgcttcctcttgcctgcgc

SEQ ID NO: 424778 - DNA, 25 bp, Mus musculus
gaggctaattgcagccccggtcacg

SEQ ID NO: 424779 - DNA, 25 bp, Mus musculus
cttttcttctacctagtggtgaggc

SEQ ID NO: 424780 - DNA, 25 bp, Mus musculus
cggtcacgcggctctccagcgctct

SEQ ID NO: 424781 - DNA, 25 bp, Mus musculus
tctccagcgctctcgcggcccgtcg

SEQ ID NO: 424782 - DNA, 25 bp, Mus musculus
ttctacctagtggtgaggctggcgc

SEQ ID NO: 424783 - DNA, 25 bp, Mus musculus
cactgcacgcccacggccttcctgc

SEQ ID NO: 424784 - DNA, 25 bp, Mus musculus
agcagaggtcccgacacgaccctaa

SEQ ID NO: 424785 - DNA, 25 bp, Mus musculus
tcaggcctctccctcaagcaggaga

SEQ ID NO: 424786 - DNA, 25 bp, Mus musculus
cgcatccctggcaactaaagggccg

SEQ ID NO: 424787 - DNA, 25 bp, Mus musculus
tgcgcgtagttcctcttaggtgaca

SEQ ID NO: 424788 - DNA, 25 bp, Mus musculus
acgaccctaatcagccgtctggacg

SEQ ID NO: 424789 - DNA, 25 bp, Mus musculus
aaccacaggcctccgttgcgcgtag

SEQ ID NO: 424790 - DNA, 25 bp, Mus musculus
ttaggtgacatactgccaccgcttc

SEQ ID NO: 424791 - DNA, 25 bp, Mus musculus
ggaaccttcagagtgaggcaccaac

SEQ ID NO: 424792 - DNA, 25 bp, Mus musculus
cggctcgcggccagcaagccaggaa

SEQ ID NO: 424793 - DNA, 25 bp, Mus musculus
gaaacggaccctcgggcagtcctca

SEQ ID NO: 424794 - DNA, 25 bp, Mus musculus
gctaacagccttctgatggcccaga

SEQ ID NO: 424795 - DNA, 25 bp, Mus musculus
ctgaggtacagagaaatggctaaca

SEQ ID NO: 424796 - DNA, 25 bp, Mus musculus
tcccgccctcgaggctgaggtacag

SEQ ID NO: 424797 - DNA, 25 bp, Mus musculus
aagcaggagacagtcccgccctcga

SEQ ID NO: 424798 - DNA, 25 bp, Mus musculus
cgcagcgaatagacgtgattttttg

SEQ ID NO: 424799 - DNA, 25 bp, Mus musculus
cgcggcttgtggttccactcacctg

SEQ ID NO: 424800 - DNA, 25 bp, Mus musculus
caccacacctggaaggccctgaaga

SEQ ID NO: 424801 - DNA, 25 bp, Mus musculus
ggctcgtgactaggcctcactacta

SEQ ID NO: 424802 - DNA, 25 bp, Mus musculus
tccatgtgtctattggtgacttctc

SEQ ID NO: 424803 - DNA, 25 bp, Mus musculus
acccgcctacatagtcatatccatg

SEQ ID NO: 424804 - DNA, 25 bp, Mus musculus
tctcattggcagaggcggcccttac

SEQ ID NO: 424805 - DNA, 25 bp, Mus musculus
gaagcgcagggatctctcattggca

SEQ ID NO: 424806 - DNA, 25 bp, Mus musculus
tcacaagccgctcaacgtttggctc

SEQ ID NO: 424807 - DNA, 25 bp, Mus musculus
ccgtattaagacagtggctcgctca

SEQ ID NO: 424808 - DNA, 25 bp, Mus musculus
cgctcagagccgcatttccgtatta

SEQ ID NO: 424809 - DNA, 25 bp, Mus musculus
tattggttagccttcgtttcgtagc

SEQ ID NO: 424810 - DNA, 25 bp, Mus musculus
agcgtactatgtctcctattggtta

SEQ ID NO: 424811 - DNA, 25 bp, Mus musculus
gagcgcactccatggctcgtgacta

SEQ ID NO: 424812 - DNA, 25 bp, Mus musculus
cgcgccctccgcgaatgctttttgg

SEQ ID NO: 424813 - DNA, 25 bp, Mus musculus
gcccagaccgcaaaaagattcgcga

SEQ ID NO: 424814 - DNA, 25 bp, Mus musculus
agaaaaactggggaagtctcggatg

SEQ ID NO: 424815 - DNA, 25 bp, Mus musculus
gcctttagcccagcatgtctccgaa

SEQ ID NO: 424816 - DNA, 25 bp, Mus musculus
agattcgcgaaaggcagtctacccg

SEQ ID NO: 424817 - DNA, 25 bp, Mus musculus
ctgtggtacaaagtcgactaaaaag

SEQ ID NO: 424818 - DNA, 25 bp, Mus musculus
agttatgtacagcaagcccagaccg

SEQ ID NO: 424819 - DNA, 25 bp, Mus musculus
gggcttccggctattgagttatgta

SEQ ID NO: 424820 - DNA, 25 bp, Mus musculus
ctggtagctgcagtcacgtcgccga

SEQ ID NO: 424821 - DNA, 25 bp, Mus musculus
aagagctgattcttccgtggaaaac

SEQ ID NO: 424822 - DNA, 25 bp, Mus musculus
acggggaggaaagagctgattcttc

SEQ ID NO: 424823 - DNA, 25 bp, Mus musculus
agtgatcaaagcctcgcggagcgcg

SEQ ID NO: 424824 - DNA, 25 bp, Mus musculus
catgtctcgggaaagcgagtgatca

SEQ ID NO: 424825 - DNA, 25 bp, Mus musculus
aaaggcagtctacccgcttcttcgg

SEQ ID NO: 424826 - DNA, 25 bp, Mus musculus
ctctcgcggctgctgacgtagcagc

SEQ ID NO: 424827 - DNA, 25 bp, Mus musculus
cgtgctggcagaattccgcagcgca

SEQ ID NO: 424828 - DNA, 25 bp, Mus musculus
gtgctctcccggagctgacgatgtc

SEQ ID NO: 424829 - DNA, 25 bp, Mus musculus
tcatcaagtccttgtagggcgaggg

SEQ ID NO: 424830 - DNA, 25 bp, Mus musculus
cctcctatctcatcaagtccttgta

SEQ ID NO: 424831 - DNA, 25 bp, Mus musculus
gctgacgtagcagccggagccagcc

SEQ ID NO: 424832 - DNA, 25 bp, Mus musculus
cctcccacgcgtggaagcggagctg

SEQ ID NO: 424833 - DNA, 25 bp, Mus musculus
aagacttttcttcagccgcagcggc

SEQ ID NO: 424834 - DNA, 25 bp, Mus musculus
tgcggctgcagatagaagacttttc

SEQ ID NO: 424835 - DNA, 25 bp, Mus musculus
cccaaactggggagatcgtgcggct

SEQ ID NO: 424836 - DNA, 25 bp, Mus musculus
ggagctgacgatgtcctgctccctc

SEQ ID NO: 424837 - DNA, 25 bp, Mus musculus
ctctgcttcgtgctggcagaattcc

SEQ ID NO: 424838 - DNA, 25 bp, Mus musculus
ggctcggctcgtgactctgcttcgt

SEQ ID NO: 424839 - DNA, 25 bp, Mus musculus
agcgtcccaaactggggagatcgtg

SEQ ID NO: 424840 - DNA, 25 bp, Mus musculus
tccagcggctccaaaggcagaacta

SEQ ID NO: 424841 - DNA, 25 bp, Mus musculus
aggcagaactaatgatgaatccgtg

SEQ ID NO: 424842 - DNA, 25 bp, Mus musculus
acctgctttctacttcctcggggag

SEQ ID NO: 424843 - DNA, 25 bp, Mus musculus
tgaatccgtgactcctaacccggga

SEQ ID NO: 424844 - DNA, 25 bp, Mus musculus
ctaacccgggagctcaagtctcagc

SEQ ID NO: 424845 - DNA, 25 bp, Mus musculus
cccaaggtggaaggctgagaagttc

SEQ ID NO: 424846 - DNA, 25 bp, Mus musculus
tggccgctacctgctgttggatctt

SEQ ID NO: 424847 - DNA, 25 bp, Mus musculus
tgacgacccagtgcgtagtggccaa

SEQ ID NO: 424848 - DNA, 25 bp, Mus musculus
gagccaccacgctcagcaaagcgga

SEQ ID NO: 424849 - DNA, 25 bp, Mus musculus
agcggaaaggctgagaagccaaccc

SEQ ID NO: 424850 - DNA, 25 bp, Mus musculus
ccggagcgaggtagcagctcgaacc

SEQ ID NO: 424851 - DNA, 25 bp, Mus musculus
gactccttgcggtccgccatcttgg

SEQ ID NO: 424852 - DNA, 25 bp, Mus musculus
tgcctcggagacgataccggtccct

SEQ ID NO: 424853 - DNA, 25 bp, Mus musculus
catcttggggaggtcgcctctggaa

SEQ ID NO: 424854 - DNA, 25 bp, Mus musculus
ccatgtaggcgcacctccgatgtta

SEQ ID NO: 424855 - DNA, 25 bp, Mus musculus
tgtcgttgcccaccgctctaagcgg

SEQ ID NO: 424856 - DNA, 25 bp, Mus musculus
gcacagcgctgcgatttgcccatcg

SEQ ID NO: 424857 - DNA, 25 bp, Mus musculus
tggcgccgaaaaaagctagcacagc

SEQ ID NO: 424858 - DNA, 25 bp, Mus musculus
cggcaggatgatcatgcgcagcatg

SEQ ID NO: 424859 - DNA, 25 bp, Mus musculus
tggtgaggccgaagtaagcaacagc

SEQ ID NO: 424860 - DNA, 25 bp, Mus musculus
gcagttcttctcctcagctggtgga

SEQ ID NO: 424861 - DNA, 25 bp, Mus musculus
gtctggaacgcctcggcagttcttc

SEQ ID NO: 424862 - DNA, 25 bp, Mus musculus
cctccgatgttacgaccaattagaa

SEQ ID NO: 424863 - DNA, 25 bp, Mus musculus
ccgctgcaggctggagatgatgcaa

SEQ ID NO: 424864 - DNA, 25 bp, Mus musculus
gtgagtccctacaggaacacttttc

SEQ ID NO: 424865 - DNA, 25 bp, Mus musculus
ggcttccgagctctgtgagtcccta

SEQ ID NO: 424866 - DNA, 25 bp, Mus musculus
agcggtaacactcaaggaacttgga

SEQ ID NO: 424867 - DNA, 25 bp, Mus musculus
cctggcagctttcagtcctactgtc

SEQ ID NO: 424868 - DNA, 25 bp, Mus musculus
ggatgccgtagttgcggtacagctc

SEQ ID NO: 424869 - DNA, 25 bp, Mus musculus
acgtctacgcagagactggcgcgtc

SEQ ID NO: 424870 - DNA, 25 bp, Mus musculus
tatctgagccgtcgaccgcactagt

SEQ ID NO: 424871 - DNA, 25 bp, Mus musculus
accgtcggcatgctgagcgccaagt

SEQ ID NO: 424872 - DNA, 25 bp, Mus musculus
accagtcaccgcgtacagcacggta

SEQ ID NO: 424873 - DNA, 25 bp, Mus musculus
tttccatttcatcaacagcccggga

SEQ ID NO: 424874 - DNA, 25 bp, Mus musculus
tctgcctccagaaccgacaatttcg

SEQ ID NO: 424875 - DNA, 25 bp, Mus musculus
aaccctgcatccgactctttctaga

SEQ ID NO: 424876 - DNA, 25 bp, Mus musculus
gggcctcgtccacgctttgcacaaa

SEQ ID NO: 424877 - DNA, 25 bp, Mus musculus
taagtccaggcaattgggcctcgtc

SEQ ID NO: 424878 - DNA, 25 bp, Mus musculus
gccgcgtgtgagagttcctatctaa

SEQ ID NO: 424879 - DNA, 25 bp, Mus musculus
cgcaaaaaggcgctcggaacgaacg

SEQ ID NO: 424880 - DNA, 25 bp, Mus musculus
cgcgcatcgctaatcgccagagaga

SEQ ID NO: 424881 - DNA, 25 bp, Mus musculus
gccgcctccacggaacttatctgag

SEQ ID NO: 424882 - DNA, 25 bp, Mus musculus
agtgagcggcttcgaactagagttc

SEQ ID NO: 424883 - DNA, 25 bp, Mus musculus
atcggtgagtgagcggcttcgaact

SEQ ID NO: 424884 - DNA, 25 bp, Mus musculus
agtttggcgtcggagccacttggtc

SEQ ID NO: 424885 - DNA, 25 bp, Mus musculus
cttcgaactagagttccggcggccg

SEQ ID NO: 424886 - DNA, 25 bp, Mus musculus
agccttcccagttggttgtgaagtc

SEQ ID NO: 424887 - DNA, 25 bp, Mus musculus
ctcagcgtgtacgatcggtgagtga

SEQ ID NO: 424888 - DNA, 25 bp, Mus musculus
ttgtgaagtctcagcgtgtacgatc

SEQ ID NO: 424889 - DNA, 25 bp, Mus musculus
gggaagccttcccagttggttgtga

SEQ ID NO: 424890 - DNA, 25 bp, Mus musculus
cagcccggggaagccttcccagttg

SEQ ID NO: 424891 - DNA, 25 bp, Mus musculus
ttggtctcggagtgccgtgtatgta

SEQ ID NO: 424892 - DNA, 25 bp, Mus musculus
gagccacttggtctcggagtgccgt

SEQ ID NO: 424893 - DNA, 25 bp, Mus musculus
tcccacagataggactggccatctc

SEQ ID NO: 424894 - DNA, 25 bp, Mus musculus
gagccctcgcttcccacagatagga

SEQ ID NO: 424895 - DNA, 25 bp, Mus musculus
gataggactggccatctccacgtcc

SEQ ID NO: 424896 - DNA, 25 bp, Mus musculus
ggatcctttgtaagcacacctagtc

SEQ ID NO: 424897 - DNA, 25 bp, Mus musculus
tctgagcgctcaggaaaaagtttcc

SEQ ID NO: 424898 - DNA, 25 bp, Mus musculus
atgatgacttcaggccctccaggga

SEQ ID NO: 424899 - DNA, 25 bp, Mus musculus
tattttccgagcctgcgaagttgca

SEQ ID NO: 424900 - DNA, 25 bp, Mus musculus
tcacgccaggcgagttattttccga

SEQ ID NO: 424901 - DNA, 25 bp, Mus musculus
catccgatgcggaggttccttaacc

SEQ ID NO: 424902 - DNA, 25 bp, Mus musculus
aaagggttcacagcgcttcctctcc

SEQ ID NO: 424903 - DNA, 25 bp, Mus musculus
tagcttactagggtcccacgcttgg

SEQ ID NO: 424904 - DNA, 25 bp, Mus musculus
cttgggaggatggtgcagatacatt

SEQ ID NO: 424905 - DNA, 25 bp, Mus musculus
ctgagcactcatgactgtagatctg

SEQ ID NO: 424906 - DNA, 25 bp, Mus musculus
caggcgagtagcctcctgagcactc

SEQ ID NO: 424907 - DNA, 25 bp, Mus musculus
gcagtgaactgtcccgagcttctca

SEQ ID NO: 424908 - DNA, 25 bp, Mus musculus
agtccttgtcgctgtccaggcacga

SEQ ID NO: 424909 - DNA, 25 bp, Mus musculus
ccaggcacgaactctgggaaccgta

SEQ ID NO: 424910 - DNA, 25 bp, Mus musculus
tgacgggaccaggtgatgagacgca

SEQ ID NO: 424911 - DNA, 25 bp, Mus musculus
gacgcatgacgggactaggtgatga

SEQ ID NO: 424912 - DNA, 25 bp, Mus musculus
catgacgggaccaggtgatgagacg

SEQ ID NO: 424913 - DNA, 25 bp, Mus musculus
gtgatgagacgcatgacgggactag

SEQ ID NO: 424914 - DNA, 25 bp, Mus musculus
catgacgggactaggtgatgagacg

SEQ ID NO: 424915 - DNA, 25 bp, Mus musculus
gtgatgagacgcatgacgggaccag

SEQ ID NO: 424916 - DNA, 25 bp, Mus musculus
atgacgggaccaggtgatgggacgc

SEQ ID NO: 424917 - DNA, 25 bp, Mus musculus
gaccaggtgatgagacgcatgacgg

SEQ ID NO: 424918 - DNA, 25 bp, Mus musculus
ggtgatgggacgcatgacgggacca

SEQ ID NO: 424919 - DNA, 25 bp, Mus musculus
gacgcatgacgggaccaggtgatgg

SEQ ID NO: 424920 - DNA, 25 bp, Mus musculus
gggaccaggtgatgggacgcatgac

SEQ ID NO: 424921 - DNA, 25 bp, Mus musculus
tgagacgcatgacgggaccaggtga

SEQ ID NO: 424922 - DNA, 25 bp, Mus musculus
ctaggtgatgagacgcatgacggga

SEQ ID NO: 424923 - DNA, 25 bp, Mus musculus
gacgcatgacgggaccaggtgatga

SEQ ID NO: 424924 - DNA, 25 bp, Mus musculus
tgctgcacagcaggctccgaaaata

SEQ ID NO: 424925 - DNA, 25 bp, Mus musculus
cgcgtggaaggcgatactgttgatt

SEQ ID NO: 424926 - DNA, 25 bp, Mus musculus
cgcttgcgcttgcagcggtaagtca

SEQ ID NO: 424927 - DNA, 25 bp, Mus musculus
ttcagatgatccatgcgcttgtgca

SEQ ID NO: 424928 - DNA, 25 bp, Mus musculus
ctgttgattgctttgagtttccgca

SEQ ID NO: 424929 - DNA, 25 bp, Mus musculus
cggtaagtcaggctcactgggcctc

SEQ ID NO: 424930 - DNA, 25 bp, Mus musculus
cgcttctacgtcttcccgggagatg

SEQ ID NO: 424931 - DNA, 25 bp, Mus musculus
ttgcaggatgtgtagagcgcttcta

SEQ ID NO: 424932 - DNA, 25 bp, Mus musculus
agcacacgctcggttttgcaggatg

SEQ ID NO: 424933 - DNA, 25 bp, Mus musculus
tccttcgcttggtcttgagcacacg

SEQ ID NO: 424934 - DNA, 25 bp, Mus musculus
ccgccaaagttggtgcttgtccttc

SEQ ID NO: 424935 - DNA, 25 bp, Mus musculus
ggagctgggcagtttcatagtttaa

SEQ ID NO: 424936 - DNA, 25 bp, Mus musculus
aggcgacgtagtttccctggagctg

SEQ ID NO: 424937 - DNA, 25 bp, Mus musculus
ctccagatcgcagtggtgctttttc

SEQ ID NO: 424938 - DNA, 25 bp, Mus musculus
gtgcgccggcccacacaatagcgcg

SEQ ID NO: 424939 - DNA, 25 bp, Mus musculus
gctgcctcaggggtcaaattgcgag

SEQ ID NO: 424940 - DNA, 25 bp, Mus musculus
cggatccagtttttgctgcctcagg

SEQ ID NO: 424941 - DNA, 25 bp, Mus musculus
gaatgtggccgcctgagctctcctc

SEQ ID NO: 424942 - DNA, 25 bp, Mus musculus
ctcacagttgaatgtggccgcctga

SEQ ID NO: 424943 - DNA, 25 bp, Mus musculus
gccaagttctgcacgctcacagttg

SEQ ID NO: 424944 - DNA, 25 bp, Mus musculus
agagagctcagccaagttctgcacg

SEQ ID NO: 424945 - DNA, 25 bp, Mus musculus
tcctcggttcccagcacacagagcc

SEQ ID NO: 424946 - DNA, 25 bp, Mus musculus
agacccgaaatcaagagtggagtcc

SEQ ID NO: 424947 - DNA, 25 bp, Mus musculus
ccgggaagacccgaaatcaagagtg

SEQ ID NO: 424948 - DNA, 25 bp, Mus musculus
gtatgttaaaggctgagggaatccg

SEQ ID NO: 424949 - DNA, 25 bp, Mus musculus
ctgaggcagaaaagtgtatgttaaa

SEQ ID NO: 424950 - DNA, 25 bp, Mus musculus
aaattgcgaggaattcttaactgcc

SEQ ID NO: 424951 - DNA, 25 bp, Mus musculus
gtccggcggatccagtttttgctgc

SEQ ID NO: 424952 - DNA, 25 bp, Mus musculus
taaagcggcaaggacccttttctgc

SEQ ID NO: 424953 - DNA, 25 bp, Mus musculus
acttcctgagtcacttaaagcggca

SEQ ID NO: 424954 - DNA, 25 bp, Mus musculus
cgtcttcggggagcgcgtcgtctcc

SEQ ID NO: 424955 - DNA, 25 bp, Mus musculus
ctgaggaacttctggcgatgcgcgt

SEQ ID NO: 424956 - DNA, 25 bp, Mus musculus
cggcagtagcagaagccgcagtcgc

SEQ ID NO: 424957 - DNA, 25 bp, Mus musculus
gcactcgtcacacgtgccgtcggga

SEQ ID NO: 424958 - DNA, 25 bp, Mus musculus
tagcggctggcgtgctctccgcctt

SEQ ID NO: 424959 - DNA, 25 bp, Mus musculus
tttctgcgttttcccgcggggctga

SEQ ID NO: 424960 - DNA, 25 bp, Mus musculus
cccggaaggagaagctcgagcgcaa

SEQ ID NO: 424961 - DNA, 25 bp, Mus musculus
tcgagcgcaatctctcctcgcagag

SEQ ID NO: 424962 - DNA, 25 bp, Mus musculus
ctctcctcgcagagcagggcgacgg

SEQ ID NO: 424963 - DNA, 25 bp, Mus musculus
gccctccctggaggtgtcaacctga

SEQ ID NO: 424964 - DNA, 25 bp, Mus musculus
aacctgaccgaaaaccactagcctg

SEQ ID NO: 424965 - DNA, 25 bp, Mus musculus
agcggcctcctttcacttcctgagt

SEQ ID NO: 424966 - DNA, 25 bp, Mus musculus
gtgcataacgcgtgggtcccactgt

SEQ ID NO: 424967 - DNA, 25 bp, Mus musculus
tgaagaggttgctcacaagccggtc

SEQ ID NO: 424968 - DNA, 25 bp, Mus musculus
ggtcccactgtaagctgaagaggtt

SEQ ID NO: 424969 - DNA, 25 bp, Mus musculus
gttgatgccgtagcgtacacaggca

SEQ ID NO: 424970 - DNA, 25 bp, Mus musculus
ccctgtatctgctctgggttgatgc

SEQ ID NO: 424971 - DNA, 25 bp, Mus musculus
ttggccgtcaggtaatcgaagagga

SEQ ID NO: 424972 - DNA, 25 bp, Mus musculus
ggtccattgtaccaagtccaccagc

SEQ ID NO: 424973 - DNA, 25 bp, Mus musculus
ctgctgcttgggcttcggaaaagcc

SEQ ID NO: 424974 - DNA, 25 bp, Mus musculus
gagcagcgcccggaaagttttcagg

SEQ ID NO: 424975 - DNA, 25 bp, Mus musculus
gccgccactctggatcggatgcgga

SEQ ID NO: 424976 - DNA, 25 bp, Mus musculus
tcctggtgcctcctaggcgggttat

SEQ ID NO: 424977 - DNA, 25 bp, Mus musculus
acaagccggtcaaagttggccgtca

SEQ ID NO: 424978 - DNA, 25 bp, Mus musculus
gtcagcagcgagctcaaagccagca

SEQ ID NO: 424979 - DNA, 25 bp, Mus musculus
tcgaagaggatcagatcggtccatt

SEQ ID NO: 424980 - DNA, 25 bp, Mus musculus
atcaacagaggggtgagagcttttc

SEQ ID NO: 424981 - DNA, 25 bp, Mus musculus
cccacgccatggcatcaacagaggg

SEQ ID NO: 424982 - DNA, 25 bp, Mus musculus
cgtctccagaccgtgcccgggagga

SEQ ID NO: 424983 - DNA, 25 bp, Mus musculus
aggctgcccgttaaataccgctctc

SEQ ID NO: 424984 - DNA, 25 bp, Mus musculus
cggagagaggctgcccgttaaatac

SEQ ID NO: 424985 - DNA, 25 bp, Mus musculus
gccgaggcgctaaagggcttaccca

SEQ ID NO: 424986 - DNA, 25 bp, Mus musculus
ccggccactcctggtaccggtctgc

SEQ ID NO: 424987 - DNA, 25 bp, Mus musculus
tgagagcttttctgggtgcccatgg

SEQ ID NO: 424988 - DNA, 25 bp, Mus musculus
tggacaaaaatagagagggatcgcc

SEQ ID NO: 424989 - DNA, 25 bp, Mus musculus
atagagagggatcgcctgcaaatcc

SEQ ID NO: 424990 - DNA, 25 bp, Mus musculus
ggctaaaccttgcaatccctcttcg

SEQ ID NO: 424991 - DNA, 25 bp, Mus musculus
ctccggctgggctaaaccttgcaat

SEQ ID NO: 424992 - DNA, 25 bp, Mus musculus
ccgcggcgaagcacacagacacgca

SEQ ID NO: 424993 - DNA, 25 bp, Mus musculus
tgtcagctctggacaaaaatagaga

SEQ ID NO: 424994 - DNA, 25 bp, Mus musculus
tcccagaaggtaccgaagcagcggc

SEQ ID NO: 424995 - DNA, 25 bp, Mus musculus
aacggagcagagtcagaaccatgtc

SEQ ID NO: 424996 - DNA, 25 bp, Mus musculus
aagctcaaggagactgttgctcgcg

SEQ ID NO: 424997 - DNA, 25 bp, Mus musculus
cagcggctggttacagtgaagcctc

SEQ ID NO: 424998 - DNA, 25 bp, Mus musculus
tgtcgcctaatagcgttctgccggc

SEQ ID NO: 424999 - DNA, 25 bp, Mus musculus
gacggctgctaaatcccagaaggta

SEQ ID NO: 425000 - DNA, 25 bp, Mus musculus
ccaggagctctaggcggctaattcc

SEQ ID NO: 425001 - DNA, 25 bp, Mus musculus
catgtctggctgtcaagctcaagga

SEQ ID NO: 425002 - DNA, 25 bp, Mus musculus
ttctgccggccgctcagacttggaa

SEQ ID NO: 425003 - DNA, 25 bp, Mus musculus
aggctgcccgctctgtcgcctaata

SEQ ID NO: 425004 - DNA, 25 bp, Mus musculus
gcagattctccaaagggacgaggtc

SEQ ID NO: 425005 - DNA, 25 bp, Mus musculus
ccttggactggaggactagtccttc

SEQ ID NO: 425006 - DNA, 25 bp, Mus musculus
caagtcaactagattggcggcctca

SEQ ID NO: 425007 - DNA, 25 bp, Mus musculus
tttctccgggaaagctcgcaagtca

SEQ ID NO: 425008 - DNA, 25 bp, Mus musculus
tgctccggcgatgccctgtttcctg

SEQ ID NO: 425009 - DNA, 25 bp, Mus musculus
caatataaccggcggagagcgctcg

SEQ ID NO: 425010 - DNA, 25 bp, Mus musculus
ttcaacaatataaccggcggagagc

SEQ ID NO: 425011 - DNA, 25 bp, Mus musculus
gccctgtttcctgttcaacaatata

SEQ ID NO: 425012 - DNA, 25 bp, Mus musculus
ctttcccgccctcccaatactcagc

SEQ ID NO: 425013 - DNA, 25 bp, Mus musculus
tgctccacagccctgctccggcgat

SEQ ID NO: 425014 - DNA, 25 bp, Mus musculus
gtccgcgtccggagctgcctgctcc

SEQ ID NO: 425015 - DNA, 25 bp, Mus musculus
ggcaccttagaactttcgcccgctg

SEQ ID NO: 425016 - DNA, 25 bp, Mus musculus
tagcttccacttgtcccggcagacg

SEQ ID NO: 425017 - DNA, 25 bp, Mus musculus
gccctcccaatactcagcgccatcc

SEQ ID NO: 425018 - DNA, 25 bp, Mus musculus
ctttcgcccgctggcctagcttcca

SEQ ID NO: 425019 - DNA, 25 bp, Mus musculus
gcaccttagaactttcgcccgctgg

SEQ ID NO: 425020 - DNA, 25 bp, Mus musculus
cacttgtcccggcagacgcgcgtgg

SEQ ID NO: 425021 - DNA, 25 bp, Mus musculus
tcctgttcaacaatataaccggcgg

SEQ ID NO: 425022 - DNA, 25 bp, Mus musculus
ctcagcgcaggccacccaagggaag

SEQ ID NO: 425023 - DNA, 25 bp, Mus musculus
cctgctgccagcgaaaagctgtaag

SEQ ID NO: 425024 - DNA, 25 bp, Mus musculus
cactgcttcatctggtcgctggctg

SEQ ID NO: 425025 - DNA, 25 bp, Mus musculus
cagagctgcggaacgtgagacagca

SEQ ID NO: 425026 - DNA, 25 bp, Mus musculus
acacggggtacctgcgaggcccgct

SEQ ID NO: 425027 - DNA, 25 bp, Mus musculus
tggctgggtcccgactgtccgacat

SEQ ID NO: 425028 - DNA, 25 bp, Mus musculus
gaaaagctgtaagcccgcagtccca

SEQ ID NO: 425029 - DNA, 25 bp, Mus musculus
tctccgcagaatggaacggttcgtg

SEQ ID NO: 425030 - DNA, 25 bp, Mus musculus
gggacagaaagcagccactcgagcg

SEQ ID NO: 425031 - DNA, 25 bp, Mus musculus
cgactgtccgacatggtgtaggatt

SEQ ID NO: 425032 - DNA, 25 bp, Mus musculus
cagccagtggtgcagcctcagcgca

SEQ ID NO: 425033 - DNA, 25 bp, Mus musculus
cgcccacattctcgtgaggctctgg

SEQ ID NO: 425034 - DNA, 25 bp, Mus musculus
ttctcgtgaggctctggggaacacg

SEQ ID NO: 425035 - DNA, 25 bp, Mus musculus
agcagccactcgagcgcagccagtg

SEQ ID NO: 425036 - DNA, 25 bp, Mus musculus
gagagcctagagctggtttccgccc

SEQ ID NO: 425037 - DNA, 25 bp, Mus musculus
gtcaaggcgttgtccctctacagca

SEQ ID NO: 425038 - DNA, 25 bp, Mus musculus
cacgctaagtgcacccgcttcgagg

SEQ ID NO: 425039 - DNA, 25 bp, Mus musculus
aggatcccgaagtggccgacctctt

SEQ ID NO: 425040 - DNA, 25 bp, Mus musculus
tgaacacagtgctgcccgaggatcc

SEQ ID NO: 425041 - DNA, 25 bp, Mus musculus
caacagctgggacacggtgaacaca

SEQ ID NO: 425042 - DNA, 25 bp, Mus musculus
gtgctactccggctccatgaacagc

SEQ ID NO: 425043 - DNA, 25 bp, Mus musculus
aactcgcaggcgctcaactcttcgg

SEQ ID NO: 425044 - DNA, 25 bp, Mus musculus
tcgctcagcctttcgtcttccaagt

SEQ ID NO: 425045 - DNA, 25 bp, Mus musculus
ggccgggacatacagctccacattg

SEQ ID NO: 425046 - DNA, 25 bp, Mus musculus
atggactctccggacgctctgtaag

SEQ ID NO: 425047 - DNA, 25 bp, Mus musculus
cccgtagaagtttgtggagcgcttt

SEQ ID NO: 425048 - DNA, 25 bp, Mus musculus
agcgctttctcagcggctggtccca

SEQ ID NO: 425049 - DNA, 25 bp, Mus musculus
ctctggaggacttgaccttggactc

SEQ ID NO: 425050 - DNA, 25 bp, Mus musculus
ccgacccagtcccttgcaaagagta

SEQ ID NO: 425051 - DNA, 25 bp, Mus musculus
ctggctatgacaggcggaagtaatc

SEQ ID NO: 425052 - DNA, 25 bp, Mus musculus
ttcgccatttgctgcgggtaacctg

SEQ ID NO: 425053 - DNA, 25 bp, Mus musculus
ggatctccgctacgcttgcgcacta

SEQ ID NO: 425054 - DNA, 25 bp, Mus musculus
tgacgtaagaacacgccgcggatct

SEQ ID NO: 425055 - DNA, 25 bp, Mus musculus
gtatcccggaccaggaacgtctgtc

SEQ ID NO: 425056 - DNA, 25 bp, Mus musculus
tccaggcgaagagtccgaagataca

SEQ ID NO: 425057 - DNA, 25 bp, Mus musculus
gagccagccctaccggccagtgaaa

SEQ ID NO: 425058 - DNA, 25 bp, Mus musculus
gacaccgagttgctacccaggctga

SEQ ID NO: 425059 - DNA, 25 bp, Mus musculus
caggctgaccaatctgctggagaaa

SEQ ID NO: 425060 - DNA, 25 bp, Mus musculus
gccgctgcacgtgaatccgcttaag

SEQ ID NO: 425061 - DNA, 25 bp, Mus musculus
cttccatggcttcgacgcttagtga

SEQ ID NO: 425062 - DNA, 25 bp, Mus musculus
gatatccgggtgtctcgcatttgcc

SEQ ID NO: 425063 - DNA, 25 bp, Mus musculus
aggcaccagccggtacagaagcttc

SEQ ID NO: 425064 - DNA, 25 bp, Mus musculus
gagggaaggacaagaccagcaagtc

SEQ ID NO: 425065 - DNA, 25 bp, Mus musculus
aggacacccaggtacagcggccttc

SEQ ID NO: 425066 - DNA, 25 bp, Mus musculus
ctcgcacctttttcttctccaggtt

SEQ ID NO: 425067 - DNA, 25 bp, Mus musculus
tgagaacagagacgtgcgctccgtg

SEQ ID NO: 425068 - DNA, 25 bp, Mus musculus
agccagccagcgctctgcaacgagg

SEQ ID NO: 425069 - DNA, 25 bp, Mus musculus
tcttgtcgattacgccgagaatctg

SEQ ID NO: 425070 - DNA, 25 bp, Mus musculus
agtggcacccgttgccttgcgagaa

SEQ ID NO: 425071 - DNA, 25 bp, Mus musculus
cccttcggcgcctttgatccgggat

SEQ ID NO: 425072 - DNA, 25 bp, Mus musculus
ctctgagctgctcctagtgggacaa

SEQ ID NO: 425073 - DNA, 25 bp, Mus musculus
gccgagggcatctttagaccgagaa

SEQ ID NO: 425074 - DNA, 25 bp, Mus musculus
cggtcccgacgatttgctgccgctt

SEQ ID NO: 425075 - DNA, 25 bp, Mus musculus
gaatctgcttcatggcctcggtctg

SEQ ID NO: 425076 - DNA, 25 bp, Mus musculus
tctccaggttccgaagtttcttgtc

SEQ ID NO: 425077 - DNA, 25 bp, Mus musculus
ccttgcgagaacgagagggacaaag

SEQ ID NO: 425078 - DNA, 25 bp, Mus musculus
ccggacaccatctcgttatggagaa

SEQ ID NO: 425079 - DNA, 25 bp, Mus musculus
tccggacaccatctcgttatggaga

SEQ ID NO: 425080 - DNA, 25 bp, Mus musculus
ggacaccatctcgttatggagaagc

SEQ ID NO: 425081 - DNA, 25 bp, Mus musculus
caccatctcgttatggagaagcaaa

SEQ ID NO: 425082 - DNA, 25 bp, Mus musculus
ccatctcgttatggagaagcaaaaa

SEQ ID NO: 425083 - DNA, 25 bp, Mus musculus
ctcgttatggagaagcaaaaacaac

SEQ ID NO: 425084 - DNA, 25 bp, Mus musculus
tatggagaagcaaaaacaacgcctc

SEQ ID NO: 425085 - DNA, 25 bp, Mus musculus
ggagaagcaaaaacaacgcctcgtc

SEQ ID NO: 425086 - DNA, 25 bp, Mus musculus
agaagcaaaaacaacgcctcgtccg

SEQ ID NO: 425087 - DNA, 25 bp, Mus musculus
gaagcaaaaacaacgcctcgtccgc

SEQ ID NO: 425088 - DNA, 25 bp, Mus musculus
caaaaacaacgcctcgtccgccatt

SEQ ID NO: 425089 - DNA, 25 bp, Mus musculus
gttatggagaagcaaaaacaacgcc

SEQ ID NO: 425090 - DNA, 25 bp, Mus musculus
actccggacaccatctcgttatgga

SEQ ID NO: 425091 - DNA, 25 bp, Mus musculus
cgatccctccagcgccgagtcggct

SEQ ID NO: 425092 - DNA, 25 bp, Mus musculus
tatttaagtccttcgcctctggcgg

SEQ ID NO: 425093 - DNA, 25 bp, Mus musculus
ggatcaccaaatgaagcgccacatg

SEQ ID NO: 425094 - DNA, 25 bp, Mus musculus
gcaactgttaaagctgggatcacca

SEQ ID NO: 425095 - DNA, 25 bp, Mus musculus
tgaagaccacttctggagaccaagg

SEQ ID NO: 425096 - DNA, 25 bp, Mus musculus
gcctaacgctggcaaagagacgtga

SEQ ID NO: 425097 - DNA, 25 bp, Mus musculus
cggaaggagacagcaactcagccta

SEQ ID NO: 425098 - DNA, 25 bp, Mus musculus
cgagcgacgcgcttcggattttatt

SEQ ID NO: 425099 - DNA, 25 bp, Mus musculus
aaaccctgctttctgcgtcggcctg

SEQ ID NO: 425100 - DNA, 25 bp, Mus musculus
ttcctcggaaagtatcgtcacgcgc

SEQ ID NO: 425101 - DNA, 25 bp, Mus musculus
tgaggccgacctgcaaactcctcgg

SEQ ID NO: 425102 - DNA, 25 bp, Mus musculus
aggtggtgctgtatttccttctaga

SEQ ID NO: 425103 - DNA, 25 bp, Mus musculus
ctgggcacatcttctccaccgaagg

SEQ ID NO: 425104 - DNA, 25 bp, Mus musculus
aggcctggacctgttgactgccatt

SEQ ID NO: 425105 - DNA, 25 bp, Mus musculus
ccgaaggcattcgttggagagttta

SEQ ID NO: 425106 - DNA, 25 bp, Mus musculus
gaaggttaagtcctgagcagcggca

SEQ ID NO: 425107 - DNA, 25 bp, Mus musculus
tcctcggccatcgaaaggaagagcc

SEQ ID NO: 425108 - DNA, 25 bp, Mus musculus
cgaaaatagaccttcgcgagagagg

SEQ ID NO: 425109 - DNA, 25 bp, Mus musculus
tggatgattcgctctctctctttgg

SEQ ID NO: 425110 - DNA, 25 bp, Mus musculus
ctctctttggcgtttgaagggagcg

SEQ ID NO: 425111 - DNA, 25 bp, Mus musculus
ctcgccagcggagcgaccgagcaag

SEQ ID NO: 425112 - DNA, 25 bp, Mus musculus
gagtccaggcagctagccagccacg

SEQ ID NO: 425113 - DNA, 25 bp, Mus musculus
gttctctttcctcgcgggtgactct

SEQ ID NO: 425114 - DNA, 25 bp, Mus musculus
gtaactgggatcgaccctgcggacc

SEQ ID NO: 425115 - DNA, 25 bp, Mus musculus
gcgggtgactctggaaacaccgaga

SEQ ID NO: 425116 - DNA, 25 bp, Mus musculus
cccaaacagggtcccaggctaggcg

SEQ ID NO: 425117 - DNA, 25 bp, Mus musculus
ctgagtaagtgtggcgcttctgttc

SEQ ID NO: 425118 - DNA, 25 bp, Mus musculus
gaagagcctggacccgtctgagtaa

SEQ ID NO: 425119 - DNA, 25 bp, Mus musculus
cggaagctgtaactgggatcgaccc

SEQ ID NO: 425120 - DNA, 25 bp, Mus musculus
ctaatcaagtaatggggcggtgctc

SEQ ID NO: 425121 - DNA, 25 bp, Mus musculus
gggccgggtgacagttacataacta

SEQ ID NO: 425122 - DNA, 25 bp, Mus musculus
ctagcgctgtggaaaggccactgtc

SEQ ID NO: 425123 - DNA, 25 bp, Mus musculus
agaggtggctccctggtcctgcacc

SEQ ID NO: 425124 - DNA, 25 bp, Mus musculus
agcggtctgggcatccaggtcttac

SEQ ID NO: 425125 - DNA, 25 bp, Mus musculus
cttcgtggactacagggacctaatc

SEQ ID NO: 425126 - DNA, 25 bp, Mus musculus
tcgcgggcagcatacactttgtctt

SEQ ID NO: 425127 - DNA, 25 bp, Mus musculus
tctgatgccatcgtgatcgcgggca

SEQ ID NO: 425128 - DNA, 25 bp, Mus musculus
gcctgcgaccttctgactctgatgc

SEQ ID NO: 425129 - DNA, 25 bp, Mus musculus
ccagagccctcgtgggcaggtagaa

SEQ ID NO: 425130 - DNA, 25 bp, Mus musculus
tggggtccctgatgaccagagccct

SEQ ID NO: 425131 - DNA, 25 bp, Mus musculus
tgctgctcatcttatccttcgtgga

SEQ ID NO: 425132 - DNA, 25 bp, Mus musculus
taactaacctgtgctagcggccgcc

SEQ ID NO: 425133 - DNA, 25 bp, Mus musculus
tgcaaggcggccgttatcccgcata

SEQ ID NO: 425134 - DNA, 25 bp, Mus musculus
ctggagctgctcacaatcactgggg

SEQ ID NO: 425135 - DNA, 25 bp, Mus musculus
tgtgcgagctagagatccggattaa

SEQ ID NO: 425136 - DNA, 25 bp, Mus musculus
cgagatggcaacttcggccctggtc

SEQ ID NO: 425137 - DNA, 25 bp, Mus musculus
cggcctggcttctattccctacgag

SEQ ID NO: 425138 - DNA, 25 bp, Mus musculus
gaagaagctcttcgtgccgctgaag

SEQ ID NO: 425139 - DNA, 25 bp, Mus musculus
ctccgctgagcgattttaacatctg

SEQ ID NO: 425140 - DNA, 25 bp, Mus musculus
tttccgtcgctctacgaccggggca

SEQ ID NO: 425141 - DNA, 25 bp, Mus musculus
cacgcagcctcccattcaaaagatg

SEQ ID NO: 425142 - DNA, 25 bp, Mus musculus
cgaactcctagacacggggctttgg

SEQ ID NO: 425143 - DNA, 25 bp, Mus musculus
ggcctgtggaatctccgaactccta

SEQ ID NO: 425144 - DNA, 25 bp, Mus musculus
ctcctaggggcgtagctagagcgaa

SEQ ID NO: 425145 - DNA, 25 bp, Mus musculus
tagctttgcccgaagctgactcgtg

SEQ ID NO: 425146 - DNA, 25 bp, Mus musculus
acaatcactggggacggcttcgact

SEQ ID NO: 425147 - DNA, 25 bp, Mus musculus
ccagcgctgtgcgtgactgccaaac

SEQ ID NO: 425148 - DNA, 25 bp, Mus musculus
gggactggacacctagataccttca

SEQ ID NO: 425149 - DNA, 25 bp, Mus musculus
tgcgcccaggtctctatctctgtcg

SEQ ID NO: 425150 - DNA, 25 bp, Mus musculus
ctgccaagcgcttaccggagtcggc

SEQ ID NO: 425151 - DNA, 25 bp, Mus musculus
ggcagccagcagcaagagtcccagc

SEQ ID NO: 425152 - DNA, 25 bp, Mus musculus
tcctgcagagccatagggactgttc

SEQ ID NO: 425153 - DNA, 25 bp, Mus musculus
gactgttcatacatccaggccgctg

SEQ ID NO: 425154 - DNA, 25 bp, Mus musculus
ccggatgctacacctcgagcgcgag

SEQ ID NO: 425155 - DNA, 25 bp, Mus musculus
tctctgtcggttcactggatcgcta

SEQ ID NO: 425156 - DNA, 25 bp, Mus musculus
actggatcgctaggctctggctcca

SEQ ID NO: 425157 - DNA, 25 bp, Mus musculus
ggctccagccgcgaaagctactgca

SEQ ID NO: 425158 - DNA, 25 bp, Mus musculus
ccgagcggcgcctcattgacaaaga

SEQ ID NO: 425159 - DNA, 25 bp, Mus musculus
ataccttcacggtcgacggtcaacg

SEQ ID NO: 425160 - DNA, 25 bp, Mus musculus
ctgggatagccctctgaccggagaa

SEQ ID NO: 425161 - DNA, 25 bp, Mus musculus
cccagggttcccagatcgtgagaag

SEQ ID NO: 425162 - DNA, 25 bp, Mus musculus
agttccgcaccctgctggcacccgc

SEQ ID NO: 425163 - DNA, 25 bp, Mus musculus
gaccagtgctccagaaccttcgcgg

SEQ ID NO: 425164 - DNA, 25 bp, Mus musculus
gagcggctctgatcggctgcgccct

SEQ ID NO: 425165 - DNA, 25 bp, Mus musculus
ttttcgagtcaccagagccgcctgc

SEQ ID NO: 425166 - DNA, 25 bp, Mus musculus
ctgccactgctcactcggctggaaa

SEQ ID NO: 425167 - DNA, 25 bp, Mus musculus
ctcggctggaaagttctacgggctc

SEQ ID NO: 425168 - DNA, 25 bp, Mus musculus
gctggaaagttctacgggctccatc

SEQ ID NO: 425169 - DNA, 25 bp, Mus musculus
ttctacgggctccatcgggagcgtc

SEQ ID NO: 425170 - DNA, 25 bp, Mus musculus
gagtggcagcccagcaacttcgcag

SEQ ID NO: 425171 - DNA, 25 bp, Mus musculus
cagcaacttcgcagggctgcccgga

SEQ ID NO: 425172 - DNA, 25 bp, Mus musculus
aacttcgcagggctgcccggaccgg

SEQ ID NO: 425173 - DNA, 25 bp, Mus musculus
ggaaaggctcagacccccgttgcgc

SEQ ID NO: 425174 - DNA, 25 bp, Mus musculus
gaccgtgggttttcgagtcaccaga

SEQ ID NO: 425175 - DNA, 25 bp, Mus musculus
caacgaagctgccagaccagtgctc

SEQ ID NO: 425176 - DNA, 25 bp, Mus musculus
gactcactcaccgaagggatcagga

SEQ ID NO: 425177 - DNA, 25 bp, Mus musculus
caactgggctaaagaggggtcacga

SEQ ID NO: 425178 - DNA, 25 bp, Mus musculus
ctacacttttgcaagaccggtggtt

SEQ ID NO: 425179 - DNA, 25 bp, Mus musculus
gttccgagcagaagctgcggctcca

SEQ ID NO: 425180 - DNA, 25 bp, Mus musculus
tgcggctccaaaggcactgacaaca

SEQ ID NO: 425181 - DNA, 25 bp, Mus musculus
ggcgtctgacgccatcacgtcggct

SEQ ID NO: 425182 - DNA, 25 bp, Mus musculus
caatcactgggcctagaggagccga

SEQ ID NO: 425183 - DNA, 25 bp, Mus musculus
ggcttcttggctcaggtgagcgatc

SEQ ID NO: 425184 - DNA, 25 bp, Mus musculus
gtgagcgatcctgccgctctcgcta

SEQ ID NO: 425185 - DNA, 25 bp, Mus musculus
ctactctggctctgggtagcgcaga

SEQ ID NO: 425186 - DNA, 25 bp, Mus musculus
acccttggagcttcgggacttctgc

SEQ ID NO: 425187 - DNA, 25 bp, Mus musculus
tcgcatctgtgcaactttggggttg

SEQ ID NO: 425188 - DNA, 25 bp, Mus musculus
ttaatccgaaaatgcgccctgttgc

SEQ ID NO: 425189 - DNA, 25 bp, Mus musculus
gggtcacgagtgaggctacactttt

SEQ ID NO: 425190 - DNA, 25 bp, Mus musculus
caagcgcgcgcggaaagcacgcgca

SEQ ID NO: 425191 - DNA, 25 bp, Mus musculus
cgtgcacgttggtcttcgctcccat

SEQ ID NO: 425192 - DNA, 25 bp, Mus musculus
tgcctggcttccttaccttcctaga

SEQ ID NO: 425193 - DNA, 25 bp, Mus musculus
gcttctctggctgccgatcgccggg

SEQ ID NO: 425194 - DNA, 25 bp, Mus musculus
cggctgagaggaaacggcgaaacac

SEQ ID NO: 425195 - DNA, 25 bp, Mus musculus
tgccatcttgtcctggcggctgaga

SEQ ID NO: 425196 - DNA, 25 bp, Mus musculus
gagagccgtcgctccgagggttccc

SEQ ID NO: 425197 - DNA, 25 bp, Mus musculus
agccgttgcgcaacctaggcttggg

SEQ ID NO: 425198 - DNA, 25 bp, Mus musculus
tgggaagagccgttgcgcaacctag

SEQ ID NO: 425199 - DNA, 25 bp, Mus musculus
caaaacttcggttgctgggaagagc

SEQ ID NO: 425200 - DNA, 25 bp, Mus musculus
cctagagccgccgagccgaaacggg

SEQ ID NO: 425201 - DNA, 25 bp, Mus musculus
acgaggtctccgtagtgacggccta

SEQ ID NO: 425202 - DNA, 25 bp, Mus musculus
ccatcaatgaaaggaacgaggtctc

SEQ ID NO: 425203 - DNA, 25 bp, Mus musculus
ggtcttcgctcccatcaatgaaagg

SEQ ID NO: 425204 - DNA, 25 bp, Mus musculus
agacgtcgctgctgtttgcagccgc

SEQ ID NO: 425205 - DNA, 25 bp, Mus musculus
cgcagacgtcgctgctgtttgcagc

SEQ ID NO: 425206 - DNA, 25 bp, Mus musculus
ggccgccattgctgttgctcggcgc

SEQ ID NO: 425207 - DNA, 25 bp, Mus musculus
gccattgctgttgctcggcgctccg

SEQ ID NO: 425208 - DNA, 25 bp, Mus musculus
attgctgttgctcggcgctccgcgc

SEQ ID NO: 425209 - DNA, 25 bp, Mus musculus
cgctctgcgcagacgtcgctgctgt

SEQ ID NO: 425210 - DNA, 25 bp, Mus musculus
ctctgcgcagacgtcgctgctgttt

SEQ ID NO: 425211 - DNA, 25 bp, Mus musculus
cgctgctgtttgcagccgcccttga

SEQ ID NO: 425212 - DNA, 25 bp, Mus musculus
ctgcgcagacgtcgctgctgtttgc

SEQ ID NO: 425213 - DNA, 25 bp, Mus musculus
gtcgctgctgtttgcagccgccctt

SEQ ID NO: 425214 - DNA, 25 bp, Mus musculus
ctgctgtttgcagccgcccttgagg

SEQ ID NO: 425215 - DNA, 25 bp, Mus musculus
agcctgccgctcagtacacccacag

SEQ ID NO: 425216 - DNA, 25 bp, Mus musculus
gctcagtacacccacagcgcgagag

SEQ ID NO: 425217 - DNA, 25 bp, Mus musculus
tttgcagccgcccttgaggcggcag

SEQ ID NO: 425218 - DNA, 25 bp, Mus musculus
cggaaatctggacagcggcgtcatc

SEQ ID NO: 425219 - DNA, 25 bp, Mus musculus
gtgttccggtagtcccagattgttc

SEQ ID NO: 425220 - DNA, 25 bp, Mus musculus
tcggtcgggacggtgtatttcatac

SEQ ID NO: 425221 - DNA, 25 bp, Mus musculus
tcgccctggccattgcagtttcttc

SEQ ID NO: 425222 - DNA, 25 bp, Mus musculus
cttctctgtggcgttcgtacgaata

SEQ ID NO: 425223 - DNA, 25 bp, Mus musculus
aattcaaatctgagtgggcggcggc

SEQ ID NO: 425224 - DNA, 25 bp, Mus musculus
gggcgcagccattttaattcaaatc

SEQ ID NO: 425225 - DNA, 25 bp, Mus musculus
ctgcgcttgtgcacctccaataatc

SEQ ID NO: 425226 - DNA, 25 bp, Mus musculus
tcccaggccaatcgggtggatcttt

SEQ ID NO: 425227 - DNA, 25 bp, Mus musculus
aaattccaagaagcgcgggagctcc

SEQ ID NO: 425228 - DNA, 25 bp, Mus musculus
ggctctgcaactcagtcgtgaaatt

SEQ ID NO: 425229 - DNA, 25 bp, Mus musculus
cggaagtgaatacggaagcgcctca

SEQ ID NO: 425230 - DNA, 25 bp, Mus musculus
gttctaacgtgtatctgcgctggca

SEQ ID NO: 425231 - DNA, 25 bp, Mus musculus
ataatccgggagttaagcctcagcc

SEQ ID NO: 425232 - DNA, 25 bp, Mus musculus
gtccagaaaccggagcgctttcgcc

SEQ ID NO: 425233 - DNA, 25 bp, Mus musculus
cgcgcagttaaaagtgtggtaaagc

SEQ ID NO: 425234 - DNA, 25 bp, Mus musculus
agcgaaaagaaaagatctctgaccc

SEQ ID NO: 425235 - DNA, 25 bp, Mus musculus
ggaaccgcgttcagatttcgtcgta

SEQ ID NO: 425236 - DNA, 25 bp, Mus musculus
taaacagctgtttcggtcggcgagg

SEQ ID NO: 425237 - DNA, 25 bp, Mus musculus
gccggcccaagctgaacacaaaaga

SEQ ID NO: 425238 - DNA, 25 bp, Mus musculus
accggcatctgtcggagctgcacgc

SEQ ID NO: 425239 - DNA, 25 bp, Mus musculus
ggcgccatgctcctgtacggaccgg

SEQ ID NO: 425240 - DNA, 25 bp, Mus musculus
cccgctgtcaccaaggggctcggga

SEQ ID NO: 425241 - DNA, 25 bp, Mus musculus
ggagctgagcttcactacgtttttg

SEQ ID NO: 425242 - DNA, 25 bp, Mus musculus
cgccatgttgaggttgggcaaaagc

SEQ ID NO: 425243 - DNA, 25 bp, Mus musculus
cacaaaagaatcctccagaaagggt

SEQ ID NO: 425244 - DNA, 25 bp, Mus musculus
agatttcgtcgtaaacagctgtttc

SEQ ID NO: 425245 - DNA, 25 bp, Mus musculus
ggtcactccggctgcgagtaccgcg

SEQ ID NO: 425246 - DNA, 25 bp, Mus musculus
acaagtcaggctgtggagcctaacc

SEQ ID NO: 425247 - DNA, 25 bp, Mus musculus
tctctcgaaccgtggccatgtcagc

SEQ ID NO: 425248 - DNA, 25 bp, Mus musculus
ctgtgcagagccgacaggttcagcg

SEQ ID NO: 425249 - DNA, 25 bp, Mus musculus
gacccacccggaggtctctgtgcag

SEQ ID NO: 425250 - DNA, 25 bp, Mus musculus
cccactgcgagcgaagtttggtaaa

SEQ ID NO: 425251 - DNA, 25 bp, Mus musculus
tgcgagcgaagtttggtaaagttcc

SEQ ID NO: 425252 - DNA, 25 bp, Mus musculus
aaagttcctaaaacgccgagctctg

SEQ ID NO: 425253 - DNA, 25 bp, Mus musculus
cacgtgtttcacagactggctccaa

SEQ ID NO: 425254 - DNA, 25 bp, Mus musculus
ccctggcgatcacgtgtttcacaga

SEQ ID NO: 425255 - DNA, 25 bp, Mus musculus
ccacccaggaggagaaagcggatcc

SEQ ID NO: 425256 - DNA, 25 bp, Mus musculus
cctaaaacgccgagctctggctgcg

SEQ ID NO: 425257 - DNA, 25 bp, Mus musculus
ttcacagactggctccaagcctctg

SEQ ID NO: 425258 - DNA, 25 bp, Mus musculus
agaaagcggatcctcgcggccgcgc

SEQ ID NO: 425259 - DNA, 25 bp, Mus musculus
cgcgcgtgtcacaagtcaggctgtg

SEQ ID NO: 425260 - DNA, 25 bp, Mus musculus
ccctagcggtgaagagaaggcctac

SEQ ID NO: 425261 - DNA, 25 bp, Mus musculus
acaggagagggcttgccagcactgt

SEQ ID NO: 425262 - DNA, 25 bp, Mus musculus
cccatgttgttggatttcccaggat

SEQ ID NO: 425263 - DNA, 25 bp, Mus musculus
aagagaaggcctacgcgccggagca

SEQ ID NO: 425264 - DNA, 25 bp, Mus musculus
aggagcgaatcctgcaccatgcgcc

SEQ ID NO: 425265 - DNA, 25 bp, Mus musculus
ttaccatgtgggagtccagcaccga

SEQ ID NO: 425266 - DNA, 25 bp, Mus musculus
agcccggagcttaaactttaccatg

SEQ ID NO: 425267 - DNA, 25 bp, Mus musculus
ccagataccgaggtcagcccggagc

SEQ ID NO: 425268 - DNA, 25 bp, Mus musculus
tggatttcccaggatgcacctcccg

SEQ ID NO: 425269 - DNA, 25 bp, Mus musculus
aatggaatgtcactgcccaggactc

SEQ ID NO: 425270 - DNA, 25 bp, Mus musculus
cggccacccagattccaatacaatg

SEQ ID NO: 425271 - DNA, 25 bp, Mus musculus
acattgtcggccacccagattccaa

SEQ ID NO: 425272 - DNA, 25 bp, Mus musculus
gctgctccgtggacgccctagcggt

SEQ ID NO: 425273 - DNA, 25 bp, Mus musculus
tacgcgccggagcacccgcatgggt

SEQ ID NO: 425274 - DNA, 25 bp, Mus musculus
ttgcgtttgctcagacgagagaggc

SEQ ID NO: 425275 - DNA, 25 bp, Mus musculus
acatggctcctgactcctgtgcgga

SEQ ID NO: 425276 - DNA, 25 bp, Mus musculus
actcctgtgcggaacgtgagtgact

SEQ ID NO: 425277 - DNA, 25 bp, Mus musculus
aacgtgagtgactgagcggcaaagc

SEQ ID NO: 425278 - DNA, 25 bp, Mus musculus
ccaactccctcttagatggtctcta

SEQ ID NO: 425279 - DNA, 25 bp, Mus musculus
tagatggtctctagcgaccggcccg

SEQ ID NO: 425280 - DNA, 25 bp, Mus musculus
accggcccgtgtcactggaggacga

SEQ ID NO: 425281 - DNA, 25 bp, Mus musculus
gaggacgaggtctcccatagtatga

SEQ ID NO: 425282 - DNA, 25 bp, Mus musculus
ctgggccgagaacccgctggtttat

SEQ ID NO: 425283 - DNA, 25 bp, Mus musculus
aatgattggaggctgttgcgtttgc

SEQ ID NO: 425284 - DNA, 25 bp, Mus musculus
gagtcagcaaggacatggctcctga

SEQ ID NO: 425285 - DNA, 25 bp, Mus musculus
ccgctggtttattgcgacgggcacg

SEQ ID NO: 425286 - DNA, 25 bp, Mus musculus
agcgtcgcggtgcatcaaggtaaac

SEQ ID NO: 425287 - DNA, 25 bp, Mus musculus
tcccatagtatgaaggaaatgattg

SEQ ID NO: 425288 - DNA, 25 bp, Mus musculus
cgagacatcgtctctggatgactct

SEQ ID NO: 425289 - DNA, 25 bp, Mus musculus
cgaggttaccttcggtcagctgttc

SEQ ID NO: 425290 - DNA, 25 bp, Mus musculus
tttggcggcctatcagagcgccctc

SEQ ID NO: 425291 - DNA, 25 bp, Mus musculus
agacccggacgctcacactttggcg

SEQ ID NO: 425292 - DNA, 25 bp, Mus musculus
ccaccgctaccggacgaggaggtca

SEQ ID NO: 425293 - DNA, 25 bp, Mus musculus
caccaggacgcaaaagaggcgccca

SEQ ID NO: 425294 - DNA, 25 bp, Mus musculus
agctcttcgcggctccaaggcgaca

SEQ ID NO: 425295 - DNA, 25 bp, Mus musculus
ggcgacagtcggagcctagctcttc

SEQ ID NO: 425296 - DNA, 25 bp, Mus musculus
gaaccgagttatccgcttggcccga

SEQ ID NO: 425297 - DNA, 25 bp, Mus musculus
gctggaatgccactgtcgagacatc

SEQ ID NO: 425298 - DNA, 25 bp, Mus musculus
tcgcccacgctgacaggcagctagg

SEQ ID NO: 425299 - DNA, 25 bp, Mus musculus
cacgggtcgctcttaatctatggga

SEQ ID NO: 425300 - DNA, 25 bp, Mus musculus
aactgagtcaacaacgacctgttgc

SEQ ID NO: 425301 - DNA, 25 bp, Mus musculus
cggacgcctctggatctcggcgaca

SEQ ID NO: 425302 - DNA, 25 bp, Mus musculus
aaaatgcatgccaccgtcgcctgtg

SEQ ID NO: 425303 - DNA, 25 bp, Mus musculus
cgcgagccaactagtaaaatgcatg

SEQ ID NO: 425304 - DNA, 25 bp, Mus musculus
tgccgtacagggttacgcacaaccg

SEQ ID NO: 425305 - DNA, 25 bp, Mus musculus
gcccgcattcacacgctcaaagttg

SEQ ID NO: 425306 - DNA, 25 bp, Mus musculus
cgggccacacgcgaacttagcagac

SEQ ID NO: 425307 - DNA, 25 bp, Mus musculus
acttagcagacgctggtccctgtcc

SEQ ID NO: 425308 - DNA, 25 bp, Mus musculus
cccgaaaagttctgggtcgtcatcg

SEQ ID NO: 425309 - DNA, 25 bp, Mus musculus
tcatcgacgactgcggacgagccct

SEQ ID NO: 425310 - DNA, 25 bp, Mus musculus
ggcccagcatcgtgcacctggtctt

SEQ ID NO: 425311 - DNA, 25 bp, Mus musculus
acctggtcttcctcgctgatatcga

SEQ ID NO: 425312 - DNA, 25 bp, Mus musculus
ctgatatcgatgaaggccgggacgc

SEQ ID NO: 425313 - DNA, 25 bp, Mus musculus
gaagacgctccgatccagaaacacg

SEQ ID NO: 425314 - DNA, 25 bp, Mus musculus
ccggaaaagagagcggtgccgtaca

SEQ ID NO: 425315 - DNA, 25 bp, Mus musculus
aaccgcttccgggtcagccacagag

SEQ ID NO: 425316 - DNA, 25 bp, Mus musculus
gatcctggacttcctcctgtcgcag

SEQ ID NO: 425317 - DNA, 25 bp, Mus musculus
gtgtctccgagatgaacgctccctc

SEQ ID NO: 425318 - DNA, 25 bp, Mus musculus
ccggtgctagtaaccgggacgagca

SEQ ID NO: 425319 - DNA, 25 bp, Mus musculus
cagcgcgctttgctgagctaggcta

SEQ ID NO: 425320 - DNA, 25 bp, Mus musculus
taaggagttcaaggcagcgcccaca

SEQ ID NO: 425321 - DNA, 25 bp, Mus musculus
gtgcgtccagcagccggagcaacct

SEQ ID NO: 425322 - DNA, 25 bp, Mus musculus
gggccaagtccagcgccgagaatcc

SEQ ID NO: 425323 - DNA, 25 bp, Mus musculus
cgagaatccgcaggatcgcaggagc

SEQ ID NO: 425324 - DNA, 25 bp, Mus musculus
agccgcacctcatgggttccgacgt

SEQ ID NO: 425325 - DNA, 25 bp, Mus musculus
cttcatcaaacaggagcccagctgg

SEQ ID NO: 425326 - DNA, 25 bp, Mus musculus
agcagtgcctgagcgccttcacctt

SEQ ID NO: 425327 - DNA, 25 bp, Mus musculus
accttgcacttctcgggccagttca

SEQ ID NO: 425328 - DNA, 25 bp, Mus musculus
ttcaccggtacagccggggcctgtc

SEQ ID NO: 425329 - DNA, 25 bp, Mus musculus
ccctcttatttgagctttgggaagc

SEQ ID NO: 425330 - DNA, 25 bp, Mus musculus
gccgctgcctgcgatcaacgaagta

SEQ ID NO: 425331 - DNA, 25 bp, Mus musculus
gccggcatgaacgtgagcttcctga

SEQ ID NO: 425332 - DNA, 25 bp, Mus musculus
gcttcctgaaccacagcggcctgga

SEQ ID NO: 425333 - DNA, 25 bp, Mus musculus
ctcaccgtggtcttcggcgttttct

SEQ ID NO: 425334 - DNA, 25 bp, Mus musculus
gtccgagagcatgatcaactttctg

SEQ ID NO: 425335 - DNA, 25 bp, Mus musculus
actttctgatgcaggagcgcaggcc

SEQ ID NO: 425336 - DNA, 25 bp, Mus musculus
cgccgccatcctgggactatactga

SEQ ID NO: 425337 - DNA, 25 bp, Mus musculus
ggccgcccttgccagagttgaagca

SEQ ID NO: 425338 - DNA, 25 bp, Mus musculus
agactacggagcctctttctcaagg

SEQ ID NO: 425339 - DNA, 25 bp, Mus musculus
ccgggtctggacaccataggactca

SEQ ID NO: 425340 - DNA, 25 bp, Mus musculus
gcgcgtcctagcctgcgttctcaga

SEQ ID NO: 425341 - DNA, 25 bp, Mus musculus
ttgaagcaccgcgaggaagagacta

SEQ ID NO: 425342 - DNA, 25 bp, Mus musculus
ctgtcatgccagactccgtcctgtg

SEQ ID NO: 425343 - DNA, 25 bp, Mus musculus
gccacgcactgttggctctctcaag

SEQ ID NO: 425344 - DNA, 25 bp, Mus musculus
accttgcggaagtgttgggaatctc

SEQ ID NO: 425345 - DNA, 25 bp, Mus musculus
ccgggcggaactgtgattcctgagc

SEQ ID NO: 425346 - DNA, 25 bp, Mus musculus
gagcccgaacacctctctttcgtta

SEQ ID NO: 425347 - DNA, 25 bp, Mus musculus
attttttaactctcgcaggagcccg

SEQ ID NO: 425348 - DNA, 25 bp, Mus musculus
cgggtcttcagtcaatgcacgagtt

SEQ ID NO: 425349 - DNA, 25 bp, Mus musculus
gaacaaatgtattggcgggtcttca

SEQ ID NO: 425350 - DNA, 25 bp, Mus musculus
cgcacaccgcacaccgaagttaggg

SEQ ID NO: 425351 - DNA, 25 bp, Mus musculus
ggaggtttcctagtcacgcacaccg

SEQ ID NO: 425352 - DNA, 25 bp, Mus musculus
ttccgcgctccttggaggtttccta

SEQ ID NO: 425353 - DNA, 25 bp, Mus musculus
aggtggccttcttcctttccgcgct

SEQ ID NO: 425354 - DNA, 25 bp, Mus musculus
gaaccaaatccctggagtgaggctg

SEQ ID NO: 425355 - DNA, 25 bp, Mus musculus
gactccaccggatacgaaccaaatc

SEQ ID NO: 425356 - DNA, 25 bp, Mus musculus
aaacagccgggctggtccgactcca

SEQ ID NO: 425357 - DNA, 25 bp, Mus musculus
tctttgccgttgagaatctaatttc

SEQ ID NO: 425358 - DNA, 25 bp, Mus musculus
gaagtcagcaatctctctgccggcc

SEQ ID NO: 425359 - DNA, 25 bp, Mus musculus
ttcctcgagccggagttccggactg

SEQ ID NO: 425360 - DNA, 25 bp, Mus musculus
cctcctcgagatgggctcagctcag

SEQ ID NO: 425361 - DNA, 25 bp, Mus musculus
gggtacagcgggttcctaatcagcc

SEQ ID NO: 425362 - DNA, 25 bp, Mus musculus
ggttcctaatcagcccgagctctga

SEQ ID NO: 425363 - DNA, 25 bp, Mus musculus
ccgagctctgataagcttctaatta

SEQ ID NO: 425364 - DNA, 25 bp, Mus musculus
tctaattaaaagagctctccctcgg

SEQ ID NO: 425365 - DNA, 25 bp, Mus musculus
taaaagagctctccctcggatcccg

SEQ ID NO: 425366 - DNA, 25 bp, Mus musculus
gctcaaggttgtcgctgcccgccaa

SEQ ID NO: 425367 - DNA, 25 bp, Mus musculus
tgcccgccaaggtttgcgggtctca

SEQ ID NO: 425368 - DNA, 25 bp, Mus musculus
caaggtttgcgggtctcatctatga

SEQ ID NO: 425369 - DNA, 25 bp, Mus musculus
tctcatctatgagaaggccagtagg

SEQ ID NO: 425370 - DNA, 25 bp, Mus musculus
ctcagctcagtcctcgggtacagcg

SEQ ID NO: 425371 - DNA, 25 bp, Mus musculus
gtgcccgcttcctcgagccggagtt

SEQ ID NO: 425372 - DNA, 25 bp, Mus musculus
acgcggccagctgacggtaagcgtt

SEQ ID NO: 425373 - DNA, 25 bp, Mus musculus
ctgacggtaagcgttgcagctcccg

SEQ ID NO: 425374 - DNA, 25 bp, Mus musculus
aagcgttgcagctcccggctctgca

SEQ ID NO: 425375 - DNA, 25 bp, Mus musculus
cggctctgcagagtcactgcgcctt

SEQ ID NO: 425376 - DNA, 25 bp, Mus musculus
accatcagggagtccggttcctgcc

SEQ ID NO: 425377 - DNA, 25 bp, Mus musculus
catgccgcatgacccgccggggttg

SEQ ID NO: 425378 - DNA, 25 bp, Mus musculus
ttcaggttcggctcggtggcttccc

SEQ ID NO: 425379 - DNA, 25 bp, Mus musculus
gtctgcactttgtcttccgctctgg

SEQ ID NO: 425380 - DNA, 25 bp, Mus musculus
gcactttgtcttccgctctggcaag

SEQ ID NO: 425381 - DNA, 25 bp, Mus musculus
agtcgggagtcgcaagcaacacgcg

SEQ ID NO: 425382 - DNA, 25 bp, Mus musculus
tcactgcgccttggaccatcaggga

SEQ ID NO: 425383 - DNA, 25 bp, Mus musculus
tcgcaagcaacacgcggccagctga

SEQ ID NO: 425384 - DNA, 25 bp, Mus musculus
gtggcttcccgtctgcactttgtct

SEQ ID NO: 425385 - DNA, 25 bp, Mus musculus
acgcgtccgggacgcatgccgcatg

SEQ ID NO: 425386 - DNA, 25 bp, Mus musculus
gcaactttgtgcctctgagcctcag

SEQ ID NO: 425387 - DNA, 25 bp, Mus musculus
tctgagcgcccgctggcaactttgt

SEQ ID NO: 425388 - DNA, 25 bp, Mus musculus
ccctgagaccaactggcgcgatttc

SEQ ID NO: 425389 - DNA, 25 bp, Mus musculus
ggcgcgatttcgctttcgctttgcg

SEQ ID NO: 425390 - DNA, 25 bp, Mus musculus
tttcgctttgcgcttgtggtcccgc

SEQ ID NO: 425391 - DNA, 25 bp, Mus musculus
gcgtggctccctctgaggtggccat

SEQ ID NO: 425392 - DNA, 25 bp, Mus musculus
tctccttgctctcgtccgggcttag

SEQ ID NO: 425393 - DNA, 25 bp, Mus musculus
tccgggcttagctgatcgaaggtct

SEQ ID NO: 425394 - DNA, 25 bp, Mus musculus
ctgatcgaaggtcttggagtcctcc

SEQ ID NO: 425395 - DNA, 25 bp, Mus musculus
ttggagtcctccttgcccaggaagg

SEQ ID NO: 425396 - DNA, 25 bp, Mus musculus
cccaggaaggcctcatgatcgtact

SEQ ID NO: 425397 - DNA, 25 bp, Mus musculus
ggcctcatgatcgtactggaagctc

SEQ ID NO: 425398 - DNA, 25 bp, Mus musculus
accgcgcgccatggtcgcgagcaaa

SEQ ID NO: 425399 - DNA, 25 bp, Mus musculus
tctcgcctccctgtgggaagctatc

SEQ ID NO: 425400 - DNA, 25 bp, Mus musculus
ccctagacagaagagcaccttcaga

SEQ ID NO: 425401 - DNA, 25 bp, Mus musculus
gccatccgcaccctagacagaagag

SEQ ID NO: 425402 - DNA, 25 bp, Mus musculus
cgccgcggttctgccaccgccatcc

SEQ ID NO: 425403 - DNA, 25 bp, Mus musculus
cagaagagcaccttcagactgaacg

SEQ ID NO: 425404 - DNA, 25 bp, Mus musculus
acaagttttaagtgagggctgggct

SEQ ID NO: 425405 - DNA, 25 bp, Mus musculus
tagaacaagttttaagtgagggctg

SEQ ID NO: 425406 - DNA, 25 bp, Mus musculus
cttactgttccagttagaacaagtt

SEQ ID NO: 425407 - DNA, 25 bp, Mus musculus
agagcaatacttactgttccagtta

SEQ ID NO: 425408 - DNA, 25 bp, Mus musculus
acggagagcaatacttactgttcca

SEQ ID NO: 425409 - DNA, 25 bp, Mus musculus
ctgaacggagagcaatacttactgt

SEQ ID NO: 425410 - DNA, 25 bp, Mus musculus
cagactgaacggagagcaatactta

SEQ ID NO: 425411 - DNA, 25 bp, Mus musculus
ccttcagactgaacggagagcaata

SEQ ID NO: 425412 - DNA, 25 bp, Mus musculus
gaccctcggacacttccgcctccca

SEQ ID NO: 425413 - DNA, 25 bp, Mus musculus
cgcaccctagacagaagagcacctt

SEQ ID NO: 425414 - DNA, 25 bp, Mus musculus
atcgttgacatttaaactctggggc

SEQ ID NO: 425415 - DNA, 25 bp, Mus musculus
cgccgggccagagagctaatctgcc

SEQ ID NO: 425416 - DNA, 25 bp, Mus musculus
cctcgcgtagaacccggttgtcaga

SEQ ID NO: 425417 - DNA, 25 bp, Mus musculus
catttaaactctggggcaggtcctc

SEQ ID NO: 425418 - DNA, 25 bp, Mus musculus
gcaccctcttttcttatcgttgaca

SEQ ID NO: 425419 - DNA, 25 bp, Mus musculus
tgccggagcaccctcttttcttatc

SEQ ID NO: 425420 - DNA, 25 bp, Mus musculus
aaagttagcgcctgccggagcaccc

SEQ ID NO: 425421 - DNA, 25 bp, Mus musculus
tattaaggaaagttagcgcctgccg

SEQ ID NO: 425422 - DNA, 25 bp, Mus musculus
gcattgctggcgtggatattaagga

SEQ ID NO: 425423 - DNA, 25 bp, Mus musculus
atccgcgcccggcaaccaatgaggg

SEQ ID NO: 425424 - DNA, 25 bp, Mus musculus
ccggcaaccaatgagggcattgctg

SEQ ID NO: 425425 - DNA, 25 bp, Mus musculus
aaactctggggcaggtcctcgcgta

SEQ ID NO: 425426 - DNA, 25 bp, Mus musculus
tctgccgagctgaacccaactctgg

SEQ ID NO: 425427 - DNA, 25 bp, Mus musculus
ccagagagctaatctgccgagctga

SEQ ID NO: 425428 - DNA, 25 bp, Mus musculus
cacaggacgaaagaatgcggccctc

SEQ ID NO: 425429 - DNA, 25 bp, Mus musculus
cccgaaaggagcacaggacgaaaga

SEQ ID NO: 425430 - DNA, 25 bp, Mus musculus
cccagcgtgtgatttgagcttcctt

SEQ ID NO: 425431 - DNA, 25 bp, Mus musculus
gttcctagcagcggcggagctcttt

SEQ ID NO: 425432 - DNA, 25 bp, Mus musculus
tcactgagctagaatgcgggctcgg

SEQ ID NO: 425433 - DNA, 25 bp, Mus musculus
tctcactgagctagaatgcgggctc

SEQ ID NO: 425434 - DNA, 25 bp, Mus musculus
tagcgattctcactgagctagaatg

SEQ ID NO: 425435 - DNA, 25 bp, Mus musculus
taataattagcgattctcactgagc

SEQ ID NO: 425436 - DNA, 25 bp, Mus musculus
acctaataattagcgattctcactg

SEQ ID NO: 425437 - DNA, 25 bp, Mus musculus
cggaagacctaataattagcgattc

SEQ ID NO: 425438 - DNA, 25 bp, Mus musculus
tccttcggaagacctaataattagc

SEQ ID NO: 425439 - DNA, 25 bp, Mus musculus
gagcttccttcggaagacctaataa

SEQ ID NO: 425440 - DNA, 25 bp, Mus musculus
gcgtgtgatttgagcttccttcgga

SEQ ID NO: 425441 - DNA, 25 bp, Mus musculus
atgcggccctccagagctgggcagc

SEQ ID NO: 425442 - DNA, 25 bp, Mus musculus
gaagcgaccaaccaggctgccggct

SEQ ID NO: 425443 - DNA, 25 bp, Mus musculus
tcgtagaagttcaactgcacctctt

SEQ ID NO: 425444 - DNA, 25 bp, Mus musculus
ttccaccaagtcgaacaactccagg

SEQ ID NO: 425445 - DNA, 25 bp, Mus musculus
aagccgggaacccacatcgcgctgg

SEQ ID NO: 425446 - DNA, 25 bp, Mus musculus
ctgccggctcgagggaagcactaac

SEQ ID NO: 425447 - DNA, 25 bp, Mus musculus
tcgcgcggatccgaagccgggaacc

SEQ ID NO: 425448 - DNA, 25 bp, Mus musculus
gaggatgactccaacccggagcgcc

SEQ ID NO: 425449 - DNA, 25 bp, Mus musculus
cacagcggccgcaccgaggatgact

SEQ ID NO: 425450 - DNA, 25 bp, Mus musculus
ctggccgcacggctgccagcaggaa

SEQ ID NO: 425451 - DNA, 25 bp, Mus musculus
ccacatcgcgctgggctcaaagagg

SEQ ID NO: 425452 - DNA, 25 bp, Mus musculus
gggaagcactaactgccgcggagcc

SEQ ID NO: 425453 - DNA, 25 bp, Mus musculus
cggcctaggaacagctggagagcca

SEQ ID NO: 425454 - DNA, 25 bp, Mus musculus
agcgctggcacccaagcggccgtgt

SEQ ID NO: 425455 - DNA, 25 bp, Mus musculus
gcttccggtgacatcacgtctccta

SEQ ID NO: 425456 - DNA, 25 bp, Mus musculus
acgagctttcagttacccggccaga

SEQ ID NO: 425457 - DNA, 25 bp, Mus musculus
agcctcagttaaaatggcgacccga

SEQ ID NO: 425458 - DNA, 25 bp, Mus musculus
tccgacgggttgaaagcctcagtta

SEQ ID NO: 425459 - DNA, 25 bp, Mus musculus
ggcctccgacgggttgaaagcctca

SEQ ID NO: 425460 - DNA, 25 bp, Mus musculus
aggacaagcgaaatgggcctccgac

SEQ ID NO: 425461 - DNA, 25 bp, Mus musculus
ctaacactggaggacaagcgaaatg

SEQ ID NO: 425462 - DNA, 25 bp, Mus musculus
tctattctaacactaacactggagg

SEQ ID NO: 425463 - DNA, 25 bp, Mus musculus
agcttcgccagcctttctattctaa

SEQ ID NO: 425464 - DNA, 25 bp, Mus musculus
gggcgcctaaaatgcagcttcgcca

SEQ ID NO: 425465 - DNA, 25 bp, Mus musculus
gaaagagtagcagagtagtagtgaa

SEQ ID NO: 425466 - DNA, 25 bp, Mus musculus
cctcgcacgggtcagagggtagaac

SEQ ID NO: 425467 - DNA, 25 bp, Mus musculus
ggccagaggaaaacccgtcctcgca

SEQ ID NO: 425468 - DNA, 25 bp, Mus musculus
agctttcagttacccggccagagga

SEQ ID NO: 425469 - DNA, 25 bp, Mus musculus
aaatggcgacccgagcgttgtctcc

SEQ ID NO: 425470 - DNA, 25 bp, Mus musculus
tgaccgccgggcctcgctgagttct

SEQ ID NO: 425471 - DNA, 25 bp, Mus musculus
ttcgggcctaggcatagttgtgcca

SEQ ID NO: 425472 - DNA, 25 bp, Mus musculus
tggggcagtgcgtccgctccgctga

SEQ ID NO: 425473 - DNA, 25 bp, Mus musculus
cgtccgctccgctgagcacggcggc

SEQ ID NO: 425474 - DNA, 25 bp, Mus musculus
aaatgccagcggtgcgggagtgggg

SEQ ID NO: 425475 - DNA, 25 bp, Mus musculus
aaaatgggcaggctcgggaggcctg

SEQ ID NO: 425476 - DNA, 25 bp, Mus musculus
cgggcctcgctgagttctcggcctg

SEQ ID NO: 425477 - DNA, 25 bp, Mus musculus
tggaggccctcttcgggcctaggca

SEQ ID NO: 425478 - DNA, 25 bp, Mus musculus
ggaggccctcttcgggcctaggcat

SEQ ID NO: 425479 - DNA, 25 bp, Mus musculus
ccctcttcgggcctaggcatagttg

SEQ ID NO: 425480 - DNA, 25 bp, Mus musculus
cctcttcgggcctaggcatagttgt

SEQ ID NO: 425481 - DNA, 25 bp, Mus musculus
ctcttcgggcctaggcatagttgtg

SEQ ID NO: 425482 - DNA, 25 bp, Mus musculus
ctggaggccctcttcgggcctaggc

SEQ ID NO: 425483 - DNA, 25 bp, Mus musculus
tcttcgggcctaggcatagttgtgc

SEQ ID NO: 425484 - DNA, 25 bp, Mus musculus
ttgcggccaagagctaccgggccca

SEQ ID NO: 425485 - DNA, 25 bp, Mus musculus
ttcggctaagagcatcgcaccaggg

SEQ ID NO: 425486 - DNA, 25 bp, Mus musculus
ctaagagatgcggagcagcccgagc

SEQ ID NO: 425487 - DNA, 25 bp, Mus musculus
gcccgagcggaaacctccacaatga

SEQ ID NO: 425488 - DNA, 25 bp, Mus musculus
gcagccctcacttgttcgtttgttg

SEQ ID NO: 425489 - DNA, 25 bp, Mus musculus
gcttttcctgcctcgaactagtccg

SEQ ID NO: 425490 - DNA, 25 bp, Mus musculus
ttcgtttgttggtataggggctcca

SEQ ID NO: 425491 - DNA, 25 bp, Mus musculus
aagtcgccggcgactctctacgtcg

SEQ ID NO: 425492 - DNA, 25 bp, Mus musculus
tcgcgaggcactgacgtcagagcct

SEQ ID NO: 425493 - DNA, 25 bp, Mus musculus
tccagctccgggattgaatcaggta

SEQ ID NO: 425494 - DNA, 25 bp, Mus musculus
tttttgctaaagtccagctccggga

SEQ ID NO: 425495 - DNA, 25 bp, Mus musculus
gaatctcacttcctcacgacgcgtg

SEQ ID NO: 425496 - DNA, 25 bp, Mus musculus
ggcctgcggcttcctcggaacacgt

SEQ ID NO: 425497 - DNA, 25 bp, Mus musculus
cttctccttggagtgtgtaattaca

SEQ ID NO: 425498 - DNA, 25 bp, Mus musculus
aaaagcgaaccgtggctcggcctca

SEQ ID NO: 425499 - DNA, 25 bp, Mus musculus
cggcgctgctttgcataaagcaata

SEQ ID NO: 425500 - DNA, 25 bp, Mus musculus
cgctgctttgcataaagcaatattt

SEQ ID NO: 425501 - DNA, 25 bp, Mus musculus
agcaatattttgtgtgggagcgagc

SEQ ID NO: 425502 - DNA, 25 bp, Mus musculus
agcgagcggtgcatttgcatgttgc

SEQ ID NO: 425503 - DNA, 25 bp, Mus musculus
gcatttgcatgttgcggagtgatta

SEQ ID NO: 425504 - DNA, 25 bp, Mus musculus
tttgaaaagcgaaccgtggctcggc

SEQ ID NO: 425505 - DNA, 25 bp, Mus musculus
cccggcgctgctttgcataaagcaa

SEQ ID NO: 425506 - DNA, 25 bp, Mus musculus
gcgaaccgtggctcggcctcatttc

SEQ ID NO: 425507 - DNA, 25 bp, Mus musculus
ctcatttcccgctctggttcaggcg

SEQ ID NO: 425508 - DNA, 25 bp, Mus musculus
ttcccgctctggttcaggcgcagga

SEQ ID NO: 425509 - DNA, 25 bp, Mus musculus
aggatgatgacagaggtcaggcttc

SEQ ID NO: 425510 - DNA, 25 bp, Mus musculus
tgacagaggtcaggcttcgctaatg

SEQ ID NO: 425511 - DNA, 25 bp, Mus musculus
agtgattagtgggtttgaaaagcga

SEQ ID NO: 425512 - DNA, 25 bp, Mus musculus
gagccagcgcgcaaagagcgcccaa

SEQ ID NO: 425513 - DNA, 25 bp, Mus musculus
gggcctgagaagtttccacgcagga

SEQ ID NO: 425514 - DNA, 25 bp, Mus musculus
gagcccaaactttctacttccagcg

SEQ ID NO: 425515 - DNA, 25 bp, Mus musculus
tacttccagcgaaagcccgcgtcgg

SEQ ID NO: 425516 - DNA, 25 bp, Mus musculus
cgagccacaacagcgcggatcttca

SEQ ID NO: 425517 - DNA, 25 bp, Mus musculus
tggctctgcaccagcgcaagtgcgg

SEQ ID NO: 425518 - DNA, 25 bp, Mus musculus
gctctcggagagcagctaggctgca

SEQ ID NO: 425519 - DNA, 25 bp, Mus musculus
ttcagcgcctccaaaagctcgcggt

SEQ ID NO: 425520 - DNA, 25 bp, Mus musculus
tcagcgcaaagggacgtagaggctc

SEQ ID NO: 425521 - DNA, 25 bp, Mus musculus
ccggagccgtctggatgggcaccac

SEQ ID NO: 425522 - DNA, 25 bp, Mus musculus
gccggcgatgcttttgtccagcccg

SEQ ID NO: 425523 - DNA, 25 bp, Mus musculus
cgctccggctttgtgcaagattctc

SEQ ID NO: 425524 - DNA, 25 bp, Mus musculus
gtgcaagattctcccggcacagaac

SEQ ID NO: 425525 - DNA, 25 bp, Mus musculus
cgcagcactcgagcaccaaagggtc

SEQ ID NO: 425526 - DNA, 25 bp, Mus musculus
caccatatgttttcgtattagaagc

SEQ ID NO: 425527 - DNA, 25 bp, Mus musculus
ccgctacactatggcctggctggca

SEQ ID NO: 425528 - DNA, 25 bp, Mus musculus
gaagctttgcggtcgaattctaggc

SEQ ID NO: 425529 - DNA, 25 bp, Mus musculus
taatcatcgccactgggcgagaacg

SEQ ID NO: 425530 - DNA, 25 bp, Mus musculus
gcgcataatcatcgccactgggcga

SEQ ID NO: 425531 - DNA, 25 bp, Mus musculus
cggtcgaattctaggcgcataatca

SEQ ID NO: 425532 - DNA, 25 bp, Mus musculus
ttttcgtattagaagctttgcggtc

SEQ ID NO: 425533 - DNA, 25 bp, Mus musculus
ggagcatccaaattgacaccatatg

SEQ ID NO: 425534 - DNA, 25 bp, Mus musculus
cgaggcgcggagcatccaaattgac

SEQ ID NO: 425535 - DNA, 25 bp, Mus musculus
ctttgtgccgctggttcccgggtgt

SEQ ID NO: 425536 - DNA, 25 bp, Mus musculus
acactatggcctggctggcaggccc

SEQ ID NO: 425537 - DNA, 25 bp, Mus musculus
gtcgcgaccgtttgccgctacacta

SEQ ID NO: 425538 - DNA, 25 bp, Mus musculus
cgaggcgctcagtcgcgaccgtttg

SEQ ID NO: 425539 - DNA, 25 bp, Mus musculus
tgtaggctttgtgccgctggttccc

SEQ ID NO: 425540 - DNA, 25 bp, Mus musculus
ccggagcggagcactgtcacaaagt

SEQ ID NO: 425541 - DNA, 25 bp, Mus musculus
ctcgtctgagtgatctacaaatagg

SEQ ID NO: 425542 - DNA, 25 bp, Mus musculus
agtgacaaggctgccacaagcgccc

SEQ ID NO: 425543 - DNA, 25 bp, Mus musculus
tccatgcatgatccggagcgacttc

SEQ ID NO: 425544 - DNA, 25 bp, Mus musculus
gtgcagttcattctcgtctgagtga

SEQ ID NO: 425545 - DNA, 25 bp, Mus musculus
atcacggtcccgtttgtcgtgacga

SEQ ID NO: 425546 - DNA, 25 bp, Mus musculus
tcccgtttgtcgtgacgatgcaatt

SEQ ID NO: 425547 - DNA, 25 bp, Mus musculus
tgtcgtgacgatgcaatttcccgga

SEQ ID NO: 425548 - DNA, 25 bp, Mus musculus
tgacgatgcaatttcccggagcgga

SEQ ID NO: 425549 - DNA, 25 bp, Mus musculus
caatttcccggagcggagcactgtc

SEQ ID NO: 425550 - DNA, 25 bp, Mus musculus
gtcacaaagtgacaaggctgccaca

SEQ ID NO: 425551 - DNA, 25 bp, Mus musculus
cccgactgatcttttcaattagcct

SEQ ID NO: 425552 - DNA, 25 bp, Mus musculus
aattagccttccatgcatgatccgg

SEQ ID NO: 425553 - DNA, 25 bp, Mus musculus
gggagccgagtgcagttcattctcg

SEQ ID NO: 425554 - DNA, 25 bp, Mus musculus
ctggaaactagaggtgccgccctga

SEQ ID NO: 425555 - DNA, 25 bp, Mus musculus
tccgtctgagtcctggccgaggaac

SEQ ID NO: 425556 - DNA, 25 bp, Mus musculus
ggcttctaaagccactgcgagttgg

SEQ ID NO: 425557 - DNA, 25 bp, Mus musculus
cgagtgcctacgttcacgagttaaa

SEQ ID NO: 425558 - DNA, 25 bp, Mus musculus
cattcttgatttgcgagtgcctacg

SEQ ID NO: 425559 - DNA, 25 bp, Mus musculus
tgggtaccgtccttcggcattcttg

SEQ ID NO: 425560 - DNA, 25 bp, Mus musculus
gccgaggaacttctgttggtgtttg

SEQ ID NO: 425561 - DNA, 25 bp, Mus musculus
ctgaaaagtgcggtgcgtaaagctg

SEQ ID NO: 425562 - DNA, 25 bp, Mus musculus
tcgcaaggcctattgctgaaaagtg

SEQ ID NO: 425563 - DNA, 25 bp, Mus musculus
tttccttgcaggtcaaccaatcgca

SEQ ID NO: 425564 - DNA, 25 bp, Mus musculus
tggcagccaatagaactgagatttc

SEQ ID NO: 425565 - DNA, 25 bp, Mus musculus
ttgaagctcctacgatgacccaatc

SEQ ID NO: 425566 - DNA, 25 bp, Mus musculus
ggccttgcccttcctctggaaacta

SEQ ID NO: 425567 - DNA, 25 bp, Mus musculus
gcctacacgccattggcagccaata

SEQ ID NO: 425568 - DNA, 25 bp, Mus musculus
agcttggcggacacgcggcgtccac

SEQ ID NO: 425569 - DNA, 25 bp, Mus musculus
cagacgcggccgctatggtaacgcg

SEQ ID NO: 425570 - DNA, 25 bp, Mus musculus
gttggtgcacattactgaaaggccc

SEQ ID NO: 425571 - DNA, 25 bp, Mus musculus
gcgccctagttgttggtgcacatta

SEQ ID NO: 425572 - DNA, 25 bp, Mus musculus
tacgtttccagtcgcgccctagttg

SEQ ID NO: 425573 - DNA, 25 bp, Mus musculus
ggagtacgtttccagtcgcgcccta

SEQ ID NO: 425574 - DNA, 25 bp, Mus musculus
gtacagcgggagtacgtttccagtc

SEQ ID NO: 425575 - DNA, 25 bp, Mus musculus
ttccgccggaagttggagtacagcg

SEQ ID NO: 425576 - DNA, 25 bp, Mus musculus
gagtccacttgctgcggcagccgga

SEQ ID NO: 425577 - DNA, 25 bp, Mus musculus
ttggagcaggagtccacttgctgcg

SEQ ID NO: 425578 - DNA, 25 bp, Mus musculus
tatggcgcttcactttggagcagga

SEQ ID NO: 425579 - DNA, 25 bp, Mus musculus
cgtcagacttatggcgcttcacttt

SEQ ID NO: 425580 - DNA, 25 bp, Mus musculus
ctggctccacacagcgtcagactta

SEQ ID NO: 425581 - DNA, 25 bp, Mus musculus
acgcggccgctatggtaacgcgtcg

SEQ ID NO: 425582 - DNA, 25 bp, Mus musculus
agtggcagtccctgtcactgcaccg

SEQ ID NO: 425583 - DNA, 25 bp, Mus musculus
ctagaaagtcccagggtcgtgcgcc

SEQ ID NO: 425584 - DNA, 25 bp, Mus musculus
tgcttcctggagctgtgctcctttg

SEQ ID NO: 425585 - DNA, 25 bp, Mus musculus
cagatcgaggctgctccggtcctct

SEQ ID NO: 425586 - DNA, 25 bp, Mus musculus
tgcacacacaaagcggagcccgggt

SEQ ID NO: 425587 - DNA, 25 bp, Mus musculus
gaccctgaggttggccgactgaaca

SEQ ID NO: 425588 - DNA, 25 bp, Mus musculus
gactgaacactcgaggacccgggga

SEQ ID NO: 425589 - DNA, 25 bp, Mus musculus
gacccggggagagcagatttgtctc

SEQ ID NO: 425590 - DNA, 25 bp, Mus musculus
cccaacaagcgagagcgaatttctt

SEQ ID NO: 425591 - DNA, 25 bp, Mus musculus
cgaatttctttacgtagctgtcctt

SEQ ID NO: 425592 - DNA, 25 bp, Mus musculus
ctccgccgggtttctcaggaaggtg

SEQ ID NO: 425593 - DNA, 25 bp, Mus musculus
gttgtccgcgaaagcctgcggcaaa

SEQ ID NO: 425594 - DNA, 25 bp, Mus musculus
gctccaagccggctcgggttgcttg

SEQ ID NO: 425595 - DNA, 25 bp, Mus musculus
gcccgggagtccgagatctgtttac

SEQ ID NO: 425596 - DNA, 25 bp, Mus musculus
tggggttaagatgccccaccgagga

SEQ ID NO: 425597 - DNA, 25 bp, Mus musculus
ggcggtcttcagtcggtgtcccgct

SEQ ID NO: 425598 - DNA, 25 bp, Mus musculus
gactcgggctctggtctgtatgctc

SEQ ID NO: 425599 - DNA, 25 bp, Mus musculus
ttctacggcggtcttcagtcggtgt

SEQ ID NO: 425600 - DNA, 25 bp, Mus musculus
tcagagcccgttttctacggcggtc

SEQ ID NO: 425601 - DNA, 25 bp, Mus musculus
cccaccgaggatggcagcgacgtca

SEQ ID NO: 425602 - DNA, 25 bp, Mus musculus
atgccagtgcgcttcggaggcttcc

SEQ ID NO: 425603 - DNA, 25 bp, Mus musculus
tggtctgtatgctcggagatgccag

SEQ ID NO: 425604 - DNA, 25 bp, Mus musculus
ctctggtctgtatgctcggagatgc

SEQ ID NO: 425605 - DNA, 25 bp, Mus musculus
tgcccagcgggtactcagcgtctac

SEQ ID NO: 425606 - DNA, 25 bp, Mus musculus
agtctactgtccttcgtgctgcctc

SEQ ID NO: 425607 - DNA, 25 bp, Mus musculus
cttcagtcggtgtcccgctgggaga

SEQ ID NO: 425608 - DNA, 25 bp, Mus musculus
gggagaaagtctactgtccttcgtg

SEQ ID NO: 425609 - DNA, 25 bp, Mus musculus
cagcgacgtcagagcccgttttcta

SEQ ID NO: 425610 - DNA, 25 bp, Mus musculus
gaacctcacgcacgtctttttcaca

SEQ ID NO: 425611 - DNA, 25 bp, Mus musculus
ccctacgtccgaggtatcaaagctc

SEQ ID NO: 425612 - DNA, 25 bp, Mus musculus
agatcttggggtaactggaggcacc

SEQ ID NO: 425613 - DNA, 25 bp, Mus musculus
gtcgctctgacatagtgtcaccctg

SEQ ID NO: 425614 - DNA, 25 bp, Mus musculus
tcatgacgagggttgtcctttcctc

SEQ ID NO: 425615 - DNA, 25 bp, Mus musculus
aaatcccatcctcgccggagctaag

SEQ ID NO: 425616 - DNA, 25 bp, Mus musculus
tttcccaaggactcggggagctagc

SEQ ID NO: 425617 - DNA, 25 bp, Mus musculus
caagccggagtaccctgaggccaga

SEQ ID NO: 425618 - DNA, 25 bp, Mus musculus
ttgcccggagctatgttgtggacca

SEQ ID NO: 425619 - DNA, 25 bp, Mus musculus
ccctccaggtgagaaggactcaggc

SEQ ID NO: 425620 - DNA, 25 bp, Mus musculus
aaggaaggaggcgaccgctccctca

SEQ ID NO: 425621 - DNA, 25 bp, Mus musculus
cgctccctcaggaccaaagcaaaaa

SEQ ID NO: 425622 - DNA, 25 bp, Mus musculus
aaaacagctagccactcgcgatcgc

SEQ ID NO: 425623 - DNA, 25 bp, Mus musculus
gatagaagccgcgtccgccactcgt

SEQ ID NO: 425624 - DNA, 25 bp, Mus musculus
ctcccacattcaagtgccatcggta

SEQ ID NO: 425625 - DNA, 25 bp, Mus musculus
cccacattcaagtgccatcggtaga

SEQ ID NO: 425626 - DNA, 25 bp, Mus musculus
agtgccatcggtagagtccactcac

SEQ ID NO: 425627 - DNA, 25 bp, Mus musculus
tagagtccactcacagccctacggc

SEQ ID NO: 425628 - DNA, 25 bp, Mus musculus
ctcacagccctacggcccgacccgg

SEQ ID NO: 425629 - DNA, 25 bp, Mus musculus
cgacccggcccggtccacctgagct

SEQ ID NO: 425630 - DNA, 25 bp, Mus musculus
ggtccacctgagctgccacgggtct

SEQ ID NO: 425631 - DNA, 25 bp, Mus musculus
gctgggctccggaagcaccgtctct

SEQ ID NO: 425632 - DNA, 25 bp, Mus musculus
tccggaagcaccgtctctgcacagg

SEQ ID NO: 425633 - DNA, 25 bp, Mus musculus
aagcaccgtctctgcacaggccaag

SEQ ID NO: 425634 - DNA, 25 bp, Mus musculus
tctctgcacaggccaagctcggctt

SEQ ID NO: 425635 - DNA, 25 bp, Mus musculus
agctcggctttccacaccaccgccg

SEQ ID NO: 425636 - DNA, 25 bp, Mus musculus
cccgcgcagaaaccgagaggacggc

SEQ ID NO: 425637 - DNA, 25 bp, Mus musculus
attcaagtgccatcggtagagtcca

SEQ ID NO: 425638 - DNA, 25 bp, Mus musculus
atcaggggtgtcaggtcaggatccc

SEQ ID NO: 425639 - DNA, 25 bp, Mus musculus
acgcgaccggcactgacccgaagta

SEQ ID NO: 425640 - DNA, 25 bp, Mus musculus
tggtagactcgagaaagggagatta

SEQ ID NO: 425641 - DNA, 25 bp, Mus musculus
cgcaagccgagctccagtctgcagt

SEQ ID NO: 425642 - DNA, 25 bp, Mus musculus
agtctgcagtctgacagccgcccgg

SEQ ID NO: 425643 - DNA, 25 bp, Mus musculus
cgggaagcgcaagggacctagactt

SEQ ID NO: 425644 - DNA, 25 bp, Mus musculus
gacctagacttggtagactcgagaa

SEQ ID NO: 425645 - DNA, 25 bp, Mus musculus
aagggagattaagtctgagcacaga

SEQ ID NO: 425646 - DNA, 25 bp, Mus musculus
tttgggagggaaatgcgccctcaaa

SEQ ID NO: 425647 - DNA, 25 bp, Mus musculus
atgcgccctcaaagcgatcggggtc

SEQ ID NO: 425648 - DNA, 25 bp, Mus musculus
agcgatcggggtccacctgagcaaa

SEQ ID NO: 425649 - DNA, 25 bp, Mus musculus
agcaaagggctgagttcgaggcctc

SEQ ID NO: 425650 - DNA, 25 bp, Mus musculus
aggcggccggtgcactctcgcatct

SEQ ID NO: 425651 - DNA, 25 bp, Mus musculus
tccacctgagcaaagggctgagttc

SEQ ID NO: 425652 - DNA, 25 bp, Mus musculus
cccggagctaccgagtgtgcatgac

SEQ ID NO: 425653 - DNA, 25 bp, Mus musculus
gcgacgcccaggaaagtaacttctc

SEQ ID NO: 425654 - DNA, 25 bp, Mus musculus
agcctctggcgccaaactgcgagtc

SEQ ID NO: 425655 - DNA, 25 bp, Mus musculus
actgcgagtcgctcaggaaaacgtc

SEQ ID NO: 425656 - DNA, 25 bp, Mus musculus
gacgtcatccgaacggcagccaatg

SEQ ID NO: 425657 - DNA, 25 bp, Mus musculus
aagctggcttgggtttgaatttgtg

SEQ ID NO: 425658 - DNA, 25 bp, Mus musculus
tttggagcgcctggaagccaactct

SEQ ID NO: 425659 - DNA, 25 bp, Mus musculus
tctgccaagttgtgacggtcacttc

SEQ ID NO: 425660 - DNA, 25 bp, Mus musculus
ggatccggtgtcaggcgacaaatta

SEQ ID NO: 425661 - DNA, 25 bp, Mus musculus
tcggtattgcggcttggaaagaccc

SEQ ID NO: 425662 - DNA, 25 bp, Mus musculus
gtgtgcatgacaaggcgagcctttc

SEQ ID NO: 425663 - DNA, 25 bp, Mus musculus
cgagcctttctcagcaccgaggttc

SEQ ID NO: 425664 - DNA, 25 bp, Mus musculus
accgaggttctaggcttcgccactg

SEQ ID NO: 425665 - DNA, 25 bp, Mus musculus
caaattagctttcggcgggcgatgc

SEQ ID NO: 425666 - DNA, 25 bp, Mus musculus
tttcgctcagagctccagggcggac

SEQ ID NO: 425667 - DNA, 25 bp, Mus musculus
gagctgggagactagcgccgatctt

SEQ ID NO: 425668 - DNA, 25 bp, Mus musculus
gaagcccacctcctggagcttgcgg

SEQ ID NO: 425669 - DNA, 25 bp, Mus musculus
tggagcttgcggcttcagttctcaa

SEQ ID NO: 425670 - DNA, 25 bp, Mus musculus
agcttgcggcttcagttctcaaccc

SEQ ID NO: 425671 - DNA, 25 bp, Mus musculus
gctgggagactagcgccgatcttcc

SEQ ID NO: 425672 - DNA, 25 bp, Mus musculus
cttcagttctcaaccccgggaagca

SEQ ID NO: 425673 - DNA, 25 bp, Mus musculus
accttttcgctcagagctccagggc

SEQ ID NO: 425674 - DNA, 25 bp, Mus musculus
cgactctggggaggaagcacggagc

SEQ ID NO: 425675 - DNA, 25 bp, Mus musculus
cccaaaatagggcagcgactctggg

SEQ ID NO: 425676 - DNA, 25 bp, Mus musculus
agcacccaaaatagggcagcgactc

SEQ ID NO: 425677 - DNA, 25 bp, Mus musculus
tacaccttttcgctcagagctccag

SEQ ID NO: 425678 - DNA, 25 bp, Mus musculus
ctagcctacaccttttcgctcagag

SEQ ID NO: 425679 - DNA, 25 bp, Mus musculus
ctcagagctccagggcggacctagc

SEQ ID NO: 425680 - DNA, 25 bp, Mus musculus
ccactacctgggtggcctggtagcc

SEQ ID NO: 425681 - DNA, 25 bp, Mus musculus
agggattggagataagctagactcc

SEQ ID NO: 425682 - DNA, 25 bp, Mus musculus
gagctgccgccactacctgggtggc

SEQ ID NO: 425683 - DNA, 25 bp, Mus musculus
gcagaccgcccagccaagcgaggtt

SEQ ID NO: 425684 - DNA, 25 bp, Mus musculus
gagccaccaatcagcggggcgcgca

SEQ ID NO: 425685 - DNA, 25 bp, Mus musculus
gcaggaccgagccaccaatcagcgg

SEQ ID NO: 425686 - DNA, 25 bp, Mus musculus
aacactcctagctccgtgcggcggc

SEQ ID NO: 425687 - DNA, 25 bp, Mus musculus
tttgtggaggtggagaagaacactc

SEQ ID NO: 425688 - DNA, 25 bp, Mus musculus
ttctagatcgaagagcccgggaacg

SEQ ID NO: 425689 - DNA, 25 bp, Mus musculus
cgggccggatgcttcattgagccca

SEQ ID NO: 425690 - DNA, 25 bp, Mus musculus
tggaaggtcctttctagatcgaaga

SEQ ID NO: 425691 - DNA, 25 bp, Mus musculus
attgagcccaggtccgagtcaggcg

SEQ ID NO: 425692 - DNA, 25 bp, Mus musculus
gccaagcgaggttgtgtccactgac

SEQ ID NO: 425693 - DNA, 25 bp, Mus musculus
cgctccggagtggaaggtcctttct

SEQ ID NO: 425694 - DNA, 25 bp, Mus musculus
acgacttgcgccatgggagctaagc

SEQ ID NO: 425695 - DNA, 25 bp, Mus musculus
cggcgctgtctgaccaatcgaagct

SEQ ID NO: 425696 - DNA, 25 bp, Mus musculus
acctccgcctgggaggctttgatga

SEQ ID NO: 425697 - DNA, 25 bp, Mus musculus
tgagacccggttccttcaactgcca

SEQ ID NO: 425698 - DNA, 25 bp, Mus musculus
ttcaactgccaccactgccttgggg

SEQ ID NO: 425699 - DNA, 25 bp, Mus musculus
ccttggggcagacgagaaagcgcac

SEQ ID NO: 425700 - DNA, 25 bp, Mus musculus
ggaccagaagcgtgacaacaatgtg

SEQ ID NO: 425701 - DNA, 25 bp, Mus musculus
caatgtgactccactgccggggatc

SEQ ID NO: 425702 - DNA, 25 bp, Mus musculus
tccgagagctttgtgtggaccctga

SEQ ID NO: 425703 - DNA, 25 bp, Mus musculus
ctgagaagttgtgggactgcagaac

SEQ ID NO: 425704 - DNA, 25 bp, Mus musculus
gactgcagaactccggcttcacctt

SEQ ID NO: 425705 - DNA, 25 bp, Mus musculus
cccttcagtgtgagagaaaaagcca

SEQ ID NO: 425706 - DNA, 25 bp, Mus musculus
agctaagcctgcgtcccggggatcc

SEQ ID NO: 425707 - DNA, 25 bp, Mus musculus
cccacgactctgagggacagtgcga

SEQ ID NO: 425708 - DNA, 25 bp, Mus musculus
cgacgacatcactggctgacacttt

SEQ ID NO: 425709 - DNA, 25 bp, Mus musculus
aggacgcggacttgtacacttcccg

SEQ ID NO: 425710 - DNA, 25 bp, Mus musculus
aggcaacttggcctacccaggtgtg

SEQ ID NO: 425711 - DNA, 25 bp, Mus musculus
agaaaaccataaggacgcggacttg

SEQ ID NO: 425712 - DNA, 25 bp, Mus musculus
tgaggaccagaaggttcggcccaac

SEQ ID NO: 425713 - DNA, 25 bp, Mus musculus
tcgaagagctgctggatgaggacca

SEQ ID NO: 425714 - DNA, 25 bp, Mus musculus
ggctgacacttttgagcacgtcatc

SEQ ID NO: 425715 - DNA, 25 bp, Mus musculus
ggcggcgcccatgaaagaagtaaac

SEQ ID NO: 425716 - DNA, 25 bp, Mus musculus
gttcgagaggtctgacgacgacatc

SEQ ID NO: 425717 - DNA, 25 bp, Mus musculus
actctggagagcgtgaatgggccca

SEQ ID NO: 425718 - DNA, 25 bp, Mus musculus
acccatgggactctggagagcgtga

SEQ ID NO: 425719 - DNA, 25 bp, Mus musculus
cctacccaggtgtgcggacccatgg

SEQ ID NO: 425720 - DNA, 25 bp, Mus musculus
aacgtccacggacaaggcaacttgg

SEQ ID NO: 425721 - DNA, 25 bp, Mus musculus
tttgagcacgtcatcgaagagctgc

SEQ ID NO: 425722 - DNA, 25 bp, Mus musculus
ggctaccgctctgcgtagttacccg

SEQ ID NO: 425723 - DNA, 25 bp, Mus musculus
tgggtctgcacctccgaagagaaga

SEQ ID NO: 425724 - DNA, 25 bp, Mus musculus
ttcatagaccctaaaagccgaggcc

SEQ ID NO: 425725 - DNA, 25 bp, Mus musculus
cagcccggcactgtctacggtcagt

SEQ ID NO: 425726 - DNA, 25 bp, Mus musculus
cgcagcatcggctttcagcttcata

SEQ ID NO: 425727 - DNA, 25 bp, Mus musculus
tgaaagctcgccagagccggccgtt

SEQ ID NO: 425728 - DNA, 25 bp, Mus musculus
cctctgtcgtcacttcctgtgggtc

SEQ ID NO: 425729 - DNA, 25 bp, Mus musculus
ctgggcgaacctgtccggctggaaa

SEQ ID NO: 425730 - DNA, 25 bp, Mus musculus
catccttctagctctcgcgttacta

SEQ ID NO: 425731 - DNA, 25 bp, Mus musculus
aggaggccacccgtcggtcgcaaag

SEQ ID NO: 425732 - DNA, 25 bp, Mus musculus
ggacgagcacagacccacgaaagga

SEQ ID NO: 425733 - DNA, 25 bp, Mus musculus
acctcaggttgttggaagtggacga

SEQ ID NO: 425734 - DNA, 25 bp, Mus musculus
acactcgggacatcggttcttttca

SEQ ID NO: 425735 - DNA, 25 bp, Mus musculus
tcgagactacgaaccgctctgcctg

SEQ ID NO: 425736 - DNA, 25 bp, Mus musculus
agactgctgaaggaagcgagcgcac

SEQ ID NO: 425737 - DNA, 25 bp, Mus musculus
tgatttgcataacccggcggccagg

SEQ ID NO: 425738 - DNA, 25 bp, Mus musculus
tgcatgtacctaaatgatttgcata

SEQ ID NO: 425739 - DNA, 25 bp, Mus musculus
gcggggttagttttgcatgtaccta

SEQ ID NO: 425740 - DNA, 25 bp, Mus musculus
ccgaggcgagcgtgcaaccctagaa

SEQ ID NO: 425741 - DNA, 25 bp, Mus musculus
agcgtgcaaccctagaagggaaaag

SEQ ID NO: 425742 - DNA, 25 bp, Mus musculus
acaaccagggtgtttgtgagagctg

SEQ ID NO: 425743 - DNA, 25 bp, Mus musculus
ccgcaaccttgaggagctgtgcggc

SEQ ID NO: 425744 - DNA, 25 bp, Mus musculus
cggccgcagcaatgccgggcccgct

SEQ ID NO: 425745 - DNA, 25 bp, Mus musculus
acctctctgcgctgcgccctgcagc

SEQ ID NO: 425746 - DNA, 25 bp, Mus musculus
cgccttcacccaagcactgtgagtg

SEQ ID NO: 425747 - DNA, 25 bp, Mus musculus
ccaagcactgtgagtgcgggcgacc

SEQ ID NO: 425748 - DNA, 25 bp, Mus musculus
acgctccggcggcagactgctgaag

SEQ ID NO: 425749 - DNA, 25 bp, Mus musculus
agaaactgcggagcgccgcgtccta

SEQ ID NO: 425750 - DNA, 25 bp, Mus musculus
cctcttagtggattccggggatcca

SEQ ID NO: 425751 - DNA, 25 bp, Mus musculus
cgggctacaagcgtcgctatgacaa

SEQ ID NO: 425752 - DNA, 25 bp, Mus musculus
gagcctgctgggagaacgcgccttc

SEQ ID NO: 425753 - DNA, 25 bp, Mus musculus
agaacgcgccttcggccttgctcgg

SEQ ID NO: 425754 - DNA, 25 bp, Mus musculus
cttgctcgggccgtttgaacttggc

SEQ ID NO: 425755 - DNA, 25 bp, Mus musculus
gccgtttgaacttggcgggcctgat

SEQ ID NO: 425756 - DNA, 25 bp, Mus musculus
taaagctggcgctgattggtcggac

SEQ ID NO: 425757 - DNA, 25 bp, Mus musculus
cacggcctaaagctggcgctgattg

SEQ ID NO: 425758 - DNA, 25 bp, Mus musculus
gtcgctatgacaacacggcctaaag

SEQ ID NO: 425759 - DNA, 25 bp, Mus musculus
ttgtcgtcgacctcttagtggattc

SEQ ID NO: 425760 - DNA, 25 bp, Mus musculus
atgtggcgctgaccgagtgcttgtc

SEQ ID NO: 425761 - DNA, 25 bp, Mus musculus
gctgaccgagtgcttgtcgccgccg

SEQ ID NO: 425762 - DNA, 25 bp, Mus musculus
gcacccgttacctcgcccgctgcaa

SEQ ID NO: 425763 - DNA, 25 bp, Mus musculus
cggccctcctcgagttttgtcgtcg

SEQ ID NO: 425764 - DNA, 25 bp, Mus musculus
tgacggtggtccacgcagcccggca

SEQ ID NO: 425765 - DNA, 25 bp, Mus musculus
gcttccagccggagaccctgggaaa

SEQ ID NO: 425766 - DNA, 25 bp, Mus musculus
catccggaaagtgaccagggcgctc

SEQ ID NO: 425767 - DNA, 25 bp, Mus musculus
ggtggccacagcatccggaaagtga

SEQ ID NO: 425768 - DNA, 25 bp, Mus musculus
cgtctgcgctcgcagggtggccaca

SEQ ID NO: 425769 - DNA, 25 bp, Mus musculus
ggcctcggcaacctgccctgacaca

SEQ ID NO: 425770 - DNA, 25 bp, Mus musculus
attatggcggcacgccgaccgggaa

SEQ ID NO: 425771 - DNA, 25 bp, Mus musculus
gacgtacacccgctaagaatcgagg

SEQ ID NO: 425772 - DNA, 25 bp, Mus musculus
taagaatcgagggatgcaagcgcgc

SEQ ID NO: 425773 - DNA, 25 bp, Mus musculus
cggcacgctcggacgccaagagctg

SEQ ID NO: 425774 - DNA, 25 bp, Mus musculus
acgccaagagctgcgacgcgcagta

SEQ ID NO: 425775 - DNA, 25 bp, Mus musculus
agtgccgcacgagccgcgctgctct

SEQ ID NO: 425776 - DNA, 25 bp, Mus musculus
caagagctgcgacgcgcagtacggc

SEQ ID NO: 425777 - DNA, 25 bp, Mus musculus
cgcgggctccattatggcggcacgc

SEQ ID NO: 425778 - DNA, 25 bp, Mus musculus
actcagtctcccgttgtcccgaagc

SEQ ID NO: 425779 - DNA, 25 bp, Mus musculus
tctgtgcaaagaggcatccagacgc

SEQ ID NO: 425780 - DNA, 25 bp, Mus musculus
catccagacgctggcggatcccggt

SEQ ID NO: 425781 - DNA, 25 bp, Mus musculus
tggcggatcccggttcctttgactc

SEQ ID NO: 425782 - DNA, 25 bp, Mus musculus
tccgggcggctttccagagcctgct

SEQ ID NO: 425783 - DNA, 25 bp, Mus musculus
ggccgcgctaggtaagcggctctcc

SEQ ID NO: 425784 - DNA, 25 bp, Mus musculus
cggttttcgcccagcccgactgtgg

SEQ ID NO: 425785 - DNA, 25 bp, Mus musculus
agggcacctacacggggccagctct

SEQ ID NO: 425786 - DNA, 25 bp, Mus musculus
tcacggcgcgctcacaatggagctc

SEQ ID NO: 425787 - DNA, 25 bp, Mus musculus
cgccaagcgggaccaatgggcgtcc

SEQ ID NO: 425788 - DNA, 25 bp, Mus musculus
ggcgagttaacacacgcactcagtc

SEQ ID NO: 425789 - DNA, 25 bp, Mus musculus
atggagctctcggagtctgtgcaaa

SEQ ID NO: 425790 - DNA, 25 bp, Mus musculus
gtcaggctggcgagttaacacacgc

SEQ ID NO: 425791 - DNA, 25 bp, Mus musculus
agcgcctcccagaccgtgcgagagg

SEQ ID NO: 425792 - DNA, 25 bp, Mus musculus
tcatctcttaccttaggccgcgggc

SEQ ID NO: 425793 - DNA, 25 bp, Mus musculus
tcaccacgtgaacgccgggtcaaag

SEQ ID NO: 425794 - DNA, 25 bp, Mus musculus
cctcttcatgatcgccggcaaactt

SEQ ID NO: 425795 - DNA, 25 bp, Mus musculus
ccaatttggtggtaagacttgcctc

SEQ ID NO: 425796 - DNA, 25 bp, Mus musculus
cggctggcagaccttcagagcctca

SEQ ID NO: 425797 - DNA, 25 bp, Mus musculus
tctcgattccttacgggcccaagtg

SEQ ID NO: 425798 - DNA, 25 bp, Mus musculus
gctccctaaacctggctcgcgtgga

SEQ ID NO: 425799 - DNA, 25 bp, Mus musculus
gtgtcccaggccagcagagaatcca

SEQ ID NO: 425800 - DNA, 25 bp, Mus musculus
ttgcccaagtttgccgggagatgcc

SEQ ID NO: 425801 - DNA, 25 bp, Mus musculus
ggcccgtgattgacaggctgaacta

SEQ ID NO: 425802 - DNA, 25 bp, Mus musculus
tggctgctcgctgacatcctcaaac

SEQ ID NO: 425803 - DNA, 25 bp, Mus musculus
tcctcggcgctgcttctaatggagc

SEQ ID NO: 425804 - DNA, 25 bp, Mus musculus
ggtcctcgctggctacccaatttgg

SEQ ID NO: 425805 - DNA, 25 bp, Mus musculus
cagtcgcgcgatctggaaacaaccc

SEQ ID NO: 425806 - DNA, 25 bp, Mus musculus
gacctgccacgaccctgcagtggga

SEQ ID NO: 425807 - DNA, 25 bp, Mus musculus
cgagacccaaggaaagccggcgaga

SEQ ID NO: 425808 - DNA, 25 bp, Mus musculus
cgtcctgtcacacgcagtgcaaaca

SEQ ID NO: 425809 - DNA, 25 bp, Mus musculus
aggaaagcgcgtcctgtcacacgca

SEQ ID NO: 425810 - DNA, 25 bp, Mus musculus
tgggagctgccctgatccgctagcc

SEQ ID NO: 425811 - DNA, 25 bp, Mus musculus
cgcagtgcaaacacggcgagcggtc

SEQ ID NO: 425812 - DNA, 25 bp, Mus musculus
cgtcgtgctccacgtgagagtcgcc

SEQ ID NO: 425813 - DNA, 25 bp, Mus musculus
gcttgagggactcgccacgacctgc

SEQ ID NO: 425814 - DNA, 25 bp, Mus musculus
acagttcccgtcgtgctccacgtga

SEQ ID NO: 425815 - DNA, 25 bp, Mus musculus
tctccggacggttaacctcgaatga

SEQ ID NO: 425816 - DNA, 25 bp, Mus musculus
tcacgtaacggcctcgggcgtctgc

SEQ ID NO: 425817 - DNA, 25 bp, Mus musculus
gctccggaacggttagcggctagta

SEQ ID NO: 425818 - DNA, 25 bp, Mus musculus
cggttagcggctagtaaacaacagc

SEQ ID NO: 425819 - DNA, 25 bp, Mus musculus
cgttcagaccctagggcggactaca

SEQ ID NO: 425820 - DNA, 25 bp, Mus musculus
tcaatggcccatttgaaccgccggc

SEQ ID NO: 425821 - DNA, 25 bp, Mus musculus
cgtgtcggagacttagacgaggccc

SEQ ID NO: 425822 - DNA, 25 bp, Mus musculus
tccgctggatctcgggccgttctag

SEQ ID NO: 425823 - DNA, 25 bp, Mus musculus
gccgttctagggtaaggatcagata

SEQ ID NO: 425824 - DNA, 25 bp, Mus musculus
ttcactcgagagactcacctgctgc

SEQ ID NO: 425825 - DNA, 25 bp, Mus musculus
ctgggtcgtcatgacagcggccgct

SEQ ID NO: 425826 - DNA, 25 bp, Mus musculus
cggccgctggctaaaagtacccaca

SEQ ID NO: 425827 - DNA, 25 bp, Mus musculus
caggtaagaactagctgcaactgca

SEQ ID NO: 425828 - DNA, 25 bp, Mus musculus
gctgcaactgcaagctctccgactt

SEQ ID NO: 425829 - DNA, 25 bp, Mus musculus
gtcacacgatcaccggaaacttcct

SEQ ID NO: 425830 - DNA, 25 bp, Mus musculus
cgcagtgcacttccggcgcataatt

SEQ ID NO: 425831 - DNA, 25 bp, Mus musculus
gcgcataattgaacgtcacacgatc

SEQ ID NO: 425832 - DNA, 25 bp, Mus musculus
gccgcttgcgttctgcaggtaagaa

SEQ ID NO: 425833 - DNA, 25 bp, Mus musculus
ggatcagataccgagcttcactcga

SEQ ID NO: 425834 - DNA, 25 bp, Mus musculus
agcggttcatcagcacagtggctga

SEQ ID NO: 425835 - DNA, 25 bp, Mus musculus
cgcccacggggtagctatcccggcg

SEQ ID NO: 425836 - DNA, 25 bp, Mus musculus
gtttgaatggctgtgagtggggccc

SEQ ID NO: 425837 - DNA, 25 bp, Mus musculus
ccgagctgccgggagcggttcatca

SEQ ID NO: 425838 - DNA, 25 bp, Mus musculus
ggagcggttcatcagcacagtggct

SEQ ID NO: 425839 - DNA, 25 bp, Mus musculus
atccgagggacgctccgagctgccg

SEQ ID NO: 425840 - DNA, 25 bp, Mus musculus
tcatcagcacagtggctgagcttgg

SEQ ID NO: 425841 - DNA, 25 bp, Mus musculus
ctgagcttgggcgctgcggtaccat

SEQ ID NO: 425842 - DNA, 25 bp, Mus musculus
ctgcggtaccatgaggcgccggtaa

SEQ ID NO: 425843 - DNA, 25 bp, Mus musculus
taccatgaggcgccggtaagtgacg

SEQ ID NO: 425844 - DNA, 25 bp, Mus musculus
cccggttggggccttcgctgctgct

SEQ ID NO: 425845 - DNA, 25 bp, Mus musculus
ttggggccttcgctgctgctcgcgc

SEQ ID NO: 425846 - DNA, 25 bp, Mus musculus
cgtcggacgcacctgtggacacgag

SEQ ID NO: 425847 - DNA, 25 bp, Mus musculus
ctgccgggagcggttcatcagcaca

SEQ ID NO: 425848 - DNA, 25 bp, Mus musculus
gcctgactcctcagagctgctgtca

SEQ ID NO: 425849 - DNA, 25 bp, Mus musculus
tcacaacttctctccggggcgtgga

SEQ ID NO: 425850 - DNA, 25 bp, Mus musculus
cctgattagtcagcggtcacaactt

SEQ ID NO: 425851 - DNA, 25 bp, Mus musculus
atgatgacgacatcggctggcgacg

SEQ ID NO: 425852 - DNA, 25 bp, Mus musculus
agagcatgtcggcttccttaagtga

SEQ ID NO: 425853 - DNA, 25 bp, Mus musculus
gacttccgggccgtaggcctgactc

SEQ ID NO: 425854 - DNA, 25 bp, Mus musculus
cttctccgtcctgcttctgttatta

SEQ ID NO: 425855 - DNA, 25 bp, Mus musculus
ctgttattatcaggagatgcccaca

SEQ ID NO: 425856 - DNA, 25 bp, Mus musculus
atgcccacagctcggaggtgcctgg

SEQ ID NO: 425857 - DNA, 25 bp, Mus musculus
gtcggcctgggagatcgttttaaga

SEQ ID NO: 425858 - DNA, 25 bp, Mus musculus
tgaagcctcaggactggatctccgc

SEQ ID NO: 425859 - DNA, 25 bp, Mus musculus
tcccgagggcagcaggaaagcgatt

SEQ ID NO: 425860 - DNA, 25 bp, Mus musculus
ttccttaagtgagcatcccgagggc

SEQ ID NO: 425861 - DNA, 25 bp, Mus musculus
atcgttttaagatcgagggacgtgc

SEQ ID NO: 425862 - DNA, 25 bp, Mus musculus
tccgcgttttgctggtgccagagtc

SEQ ID NO: 425863 - DNA, 25 bp, Mus musculus
gcctggcgtgctatcccagaagtga

SEQ ID NO: 425864 - DNA, 25 bp, Mus musculus
tgtccgggctacagcctggcgtgct

SEQ ID NO: 425865 - DNA, 25 bp, Mus musculus
ctgatggagactaacggcggcgcct

SEQ ID NO: 425866 - DNA, 25 bp, Mus musculus
tcccatggtctgatggagactaacg

SEQ ID NO: 425867 - DNA, 25 bp, Mus musculus
tgccagagtcccatggtctgatgga

SEQ ID NO: 425868 - DNA, 25 bp, Mus musculus
aagcgaccggcctccgcgttttgct

SEQ ID NO: 425869 - DNA, 25 bp, Mus musculus
gaaggactaagcgaccggcctccgc

SEQ ID NO: 425870 - DNA, 25 bp, Mus musculus
ctgcttgtggccgaaggactaagcg

SEQ ID NO: 425871 - DNA, 25 bp, Mus musculus
tgcacgtgtaccgtgcacgctcagc

SEQ ID NO: 425872 - DNA, 25 bp, Mus musculus
aggggacatgcacgtgtaccgtgca

SEQ ID NO: 425873 - DNA, 25 bp, Mus musculus
tcgccggcggcctcatgcaggctga

SEQ ID NO: 425874 - DNA, 25 bp, Mus musculus
cccagaagtgacttcctgcggagcg

SEQ ID NO: 425875 - DNA, 25 bp, Mus musculus
cggagccagcactcgggtaaggagc

SEQ ID NO: 425876 - DNA, 25 bp, Mus musculus
aagtgcgcggcagccacggactccg

SEQ ID NO: 425877 - DNA, 25 bp, Mus musculus
tgactgcactgcagagcgccaatgc

SEQ ID NO: 425878 - DNA, 25 bp, Mus musculus
ggagctgggctaacacttgactgca

SEQ ID NO: 425879 - DNA, 25 bp, Mus musculus
ccatatagggagctgggctaacact

SEQ ID NO: 425880 - DNA, 25 bp, Mus musculus
cccgaccatatagggagctgggcta

SEQ ID NO: 425881 - DNA, 25 bp, Mus musculus
cgctgactgctgctctgccgctgct

SEQ ID NO: 425882 - DNA, 25 bp, Mus musculus
tgggctaacacttgactgcactgca

SEQ ID NO: 425883 - DNA, 25 bp, Mus musculus
ccctaggcagcggcgtgcgctgact

SEQ ID NO: 425884 - DNA, 25 bp, Mus musculus
gagcgccaatgccaggcgagcagcc

SEQ ID NO: 425885 - DNA, 25 bp, Mus musculus
acggactccgcggacagcgcagcgc

SEQ ID NO: 425886 - DNA, 25 bp, Mus musculus
cgcacggcaccgcacattcggtgga

SEQ ID NO: 425887 - DNA, 25 bp, Mus musculus
accgcacattcggtggagacgcgcg

SEQ ID NO: 425888 - DNA, 25 bp, Mus musculus
gcacattcggtggagacgcgcgccc

SEQ ID NO: 425889 - DNA, 25 bp, Mus musculus
actgcagagcgccaatgccaggcga

SEQ ID NO: 425890 - DNA, 25 bp, Mus musculus
tgacagttcagcaatccagcgagga

SEQ ID NO: 425891 - DNA, 25 bp, Mus musculus
tcccaggccacgcagtgacagttca

SEQ ID NO: 425892 - DNA, 25 bp, Mus musculus
gactaccatatttgacccagcggtc

SEQ ID NO: 425893 - DNA, 25 bp, Mus musculus
gccgttcacttagacttagctcaaa

SEQ ID NO: 425894 - DNA, 25 bp, Mus musculus
ttgcctccgaggacaagatgtcgcc

SEQ ID NO: 425895 - DNA, 25 bp, Mus musculus
ccgcaccggcaagcaaggagggctt

SEQ ID NO: 425896 - DNA, 25 bp, Mus musculus
agccgctgcacattcccattggtcg

SEQ ID NO: 425897 - DNA, 25 bp, Mus musculus
ctgaggttttctgcccgccttccta

SEQ ID NO: 425898 - DNA, 25 bp, Mus musculus
agatgtcgccttcgccgttcactta

SEQ ID NO: 425899 - DNA, 25 bp, Mus musculus
ccattggtcgagatgactgtctatc

SEQ ID NO: 425900 - DNA, 25 bp, Mus musculus
tgtctatcagtccattgcacacctc

SEQ ID NO: 425901 - DNA, 25 bp, Mus musculus
cagcctgtcaagcaggcgcgtgtta

SEQ ID NO: 425902 - DNA, 25 bp, Mus musculus
tcaccgctctggctcggtactggag

SEQ ID NO: 425903 - DNA, 25 bp, Mus musculus
gcgaggaatcgcactcggtcagtta

SEQ ID NO: 425904 - DNA, 25 bp, Mus musculus
gcacagccagcacaagagtgtgtgg

SEQ ID NO: 425905 - DNA, 25 bp, Mus musculus
tggggtacagatcggccagcatcta

SEQ ID NO: 425906 - DNA, 25 bp, Mus musculus
ttaccgaggcctgtggggtacagat

SEQ ID NO: 425907 - DNA, 25 bp, Mus musculus
ctacggaagtgggaaacagccagta

SEQ ID NO: 425908 - DNA, 25 bp, Mus musculus
agcaagaggcaaagcgcgcagtaga

SEQ ID NO: 425909 - DNA, 25 bp, Mus musculus
agatcggccagcatctacggaagtg

SEQ ID NO: 425910 - DNA, 25 bp, Mus musculus
tgcactcaagcttcgaggtacccga

SEQ ID NO: 425911 - DNA, 25 bp, Mus musculus
cacaagagtgtgtggcgcgtgcact

SEQ ID NO: 425912 - DNA, 25 bp, Mus musculus
cgcagtagagcgcagtcgctagcga

SEQ ID NO: 425913 - DNA, 25 bp, Mus musculus
aaaaaagacagccacgcgccggccg

SEQ ID NO: 425914 - DNA, 25 bp, Mus musculus
cccaagaggctcaaaaaagacagcc

SEQ ID NO: 425915 - DNA, 25 bp, Mus musculus
cctgcaggtctgctgtatggaggat

SEQ ID NO: 425916 - DNA, 25 bp, Mus musculus
aaacagccagtagtggctgcccggc

SEQ ID NO: 425917 - DNA, 25 bp, Mus musculus
gcgcgtgcactcaagcttcgaggta

SEQ ID NO: 425918 - DNA, 25 bp, Mus musculus
aagacgaaggagagcgccgctacca

SEQ ID NO: 425919 - DNA, 25 bp, Mus musculus
caggtctgcgaagggcgcacctagt

SEQ ID NO: 425920 - DNA, 25 bp, Mus musculus
tcaggttcttcgctgtggacgagtg

SEQ ID NO: 425921 - DNA, 25 bp, Mus musculus
ttcttcgctgtggacgagtggcgct

SEQ ID NO: 425922 - DNA, 25 bp, Mus musculus
ctcgagccacttgggctcgacgcgg

SEQ ID NO: 425923 - DNA, 25 bp, Mus musculus
ccgctaccacggtactctgggtctc

SEQ ID NO: 425924 - DNA, 25 bp, Mus musculus
gtctccaggtctgcgaagggcgcac

SEQ ID NO: 425925 - DNA, 25 bp, Mus musculus
tctctccattggtcaggcgccgtcg

SEQ ID NO: 425926 - DNA, 25 bp, Mus musculus
ggactgcgtctctccattggtcagg

SEQ ID NO: 425927 - DNA, 25 bp, Mus musculus
tccggtttaaatgccgccagccaag

SEQ ID NO: 425928 - DNA, 25 bp, Mus musculus
catctcccggtctccggtttaaatg

SEQ ID NO: 425929 - DNA, 25 bp, Mus musculus
cctagtgtcgggcatctcccggtct

SEQ ID NO: 425930 - DNA, 25 bp, Mus musculus
ggcgcacctagtgtcgggcatctcc

SEQ ID NO: 425931 - DNA, 25 bp, Mus musculus
agaccgcggctcgagccacttgggc

SEQ ID NO: 425932 - DNA, 25 bp, Mus musculus
catcagacccgacgcgaccgcacct

SEQ ID NO: 425933 - DNA, 25 bp, Mus musculus
ccagcgccaaacagcgctccgcatc

SEQ ID NO: 425934 - DNA, 25 bp, Mus musculus
agtggctcaaatgccagcgccaaac

SEQ ID NO: 425935 - DNA, 25 bp, Mus musculus
cagtggctcaaatgccagcgccaaa

SEQ ID NO: 425936 - DNA, 25 bp, Mus musculus
cacctgagcagtggctcaaatgcca

SEQ ID NO: 425937 - DNA, 25 bp, Mus musculus
cgcacctgagcagtggctcaaatgc

SEQ ID NO: 425938 - DNA, 25 bp, Mus musculus
gcacacatcagacccgacgcgaccg

SEQ ID NO: 425939 - DNA, 25 bp, Mus musculus
ccaccttctcggcacacatcagacc

SEQ ID NO: 425940 - DNA, 25 bp, Mus musculus
cccgctaaagcttagtgactcggct

SEQ ID NO: 425941 - DNA, 25 bp, Mus musculus
ggcccgctaaagcttagtgactcgg

SEQ ID NO: 425942 - DNA, 25 bp, Mus musculus
cccggcccgctaaagcttagtgact

SEQ ID NO: 425943 - DNA, 25 bp, Mus musculus
ccctagcccatcagccttgcctgtg

SEQ ID NO: 425944 - DNA, 25 bp, Mus musculus
agcccatcagccttgcctgtggccc

SEQ ID NO: 425945 - DNA, 25 bp, Mus musculus
ggccagccggctgctcagggatccc

SEQ ID NO: 425946 - DNA, 25 bp, Mus musculus
ttcacctgcggatccttggcgcttt

SEQ ID NO: 425947 - DNA, 25 bp, Mus musculus
agcgggaacatagccctgagcgccg

SEQ ID NO: 425948 - DNA, 25 bp, Mus musculus
gagcaggcagcgctttgaacttgcg

SEQ ID NO: 425949 - DNA, 25 bp, Mus musculus
gcgctttgaacttgcgctcagcctc

SEQ ID NO: 425950 - DNA, 25 bp, Mus musculus
gtgccggccgggctgctttcacctg

SEQ ID NO: 425951 - DNA, 25 bp, Mus musculus
gctgctttcacctgcggatccttgg

SEQ ID NO: 425952 - DNA, 25 bp, Mus musculus
caggaaggtgttgaggctcgctccc

SEQ ID NO: 425953 - DNA, 25 bp, Mus musculus
aggaagacctcctgggaatgcagtg

SEQ ID NO: 425954 - DNA, 25 bp, Mus musculus
ctcctgggaatgcagtggaaatacc

SEQ ID NO: 425955 - DNA, 25 bp, Mus musculus
gcagtggaaatacccaccttgaaag

SEQ ID NO: 425956 - DNA, 25 bp, Mus musculus
ttgaaaggcaaggagcgggaacata

SEQ ID NO: 425957 - DNA, 25 bp, Mus musculus
gacgaggcgcaaggaagacctcctg

SEQ ID NO: 425958 - DNA, 25 bp, Mus musculus
gcaaggagcgggaacatagccctga

SEQ ID NO: 425959 - DNA, 25 bp, Mus musculus
acctgcggatccttggcgctttggg

SEQ ID NO: 425960 - DNA, 25 bp, Mus musculus
ccaacggaggcgagttccgaatccg

SEQ ID NO: 425961 - DNA, 25 bp, Mus musculus
tagcccggggcacttcgggatccgc

SEQ ID NO: 425962 - DNA, 25 bp, Mus musculus
cgaatccggaacaagacctagcccg

SEQ ID NO: 425963 - DNA, 25 bp, Mus musculus
gaggcgagttccgaatccggaacaa

SEQ ID NO: 425964 - DNA, 25 bp, Mus musculus
ttgctatggaaaccccaacggaggc

SEQ ID NO: 425965 - DNA, 25 bp, Mus musculus
taagtgtaagttgctatggaaaccc

SEQ ID NO: 425966 - DNA, 25 bp, Mus musculus
tgccaagtgtaagtgtaagttgcta

SEQ ID NO: 425967 - DNA, 25 bp, Mus musculus
agttgcagaggtggccggatgccaa

SEQ ID NO: 425968 - DNA, 25 bp, Mus musculus
ccagctcagcgcagagttgcagagg

SEQ ID NO: 425969 - DNA, 25 bp, Mus musculus
tcggccagctcagcgcagagttgca

SEQ ID NO: 425970 - DNA, 25 bp, Mus musculus
ctgggctcggccagctcagcgcaga

SEQ ID NO: 425971 - DNA, 25 bp, Mus musculus
ggatcggcaccctgcttccctgccc

SEQ ID NO: 425972 - DNA, 25 bp, Mus musculus
cgcgaggatcggcaccctgcttccc

SEQ ID NO: 425973 - DNA, 25 bp, Mus musculus
tccgaatccggaacaagacctagcc

SEQ ID NO: 425974 - DNA, 25 bp, Mus musculus
cccgctgcgccggagatggggagac

SEQ ID NO: 425975 - DNA, 25 bp, Mus musculus
gacagcacctcggtgccgtccgggg

SEQ ID NO: 425976 - DNA, 25 bp, Mus musculus
cctgtcactggagcgggcacctggc

SEQ ID NO: 425977 - DNA, 25 bp, Mus musculus
ggtcagatggactcccgcagtctcc

SEQ ID NO: 425978 - DNA, 25 bp, Mus musculus
actcccgcagtctcccggcgagggg

SEQ ID NO: 425979 - DNA, 25 bp, Mus musculus
tggccgagctcctgcccgcgggaga

SEQ ID NO: 425980 - DNA, 25 bp, Mus musculus
atcttgcggtctgagggagggtccg

SEQ ID NO: 425981 - DNA, 25 bp, Mus musculus
gccaccgcctctaatccgcccttaa

SEQ ID NO: 425982 - DNA, 25 bp, Mus musculus
taatccgcccttaagtagtctccgc

SEQ ID NO: 425983 - DNA, 25 bp, Mus musculus
gcccttaagtagtctccgcctgcgt

SEQ ID NO: 425984 - DNA, 25 bp, Mus musculus
cttaagtagtctccgcctgcgtcac

SEQ ID NO: 425985 - DNA, 25 bp, Mus musculus
cctgcgtcacgccaggtcggcggag

SEQ ID NO: 425986 - DNA, 25 bp, Mus musculus
gagacggtctggagtccccccgctg

SEQ ID NO: 425987 - DNA, 25 bp, Mus musculus
ccgctgtcgccgagcgtcggagccc

SEQ ID NO: 425988 - DNA, 25 bp, Mus musculus
ctctcgaaagctttcaagcagcggc

SEQ ID NO: 425989 - DNA, 25 bp, Mus musculus
gcgatcgccactgaagctgaccaga

SEQ ID NO: 425990 - DNA, 25 bp, Mus musculus
acgaactccgcgttgatctgggaca

SEQ ID NO: 425991 - DNA, 25 bp, Mus musculus
ggcacagacacgctgggctcccacg

SEQ ID NO: 425992 - DNA, 25 bp, Mus musculus
actccgcgttgatctgggacaccgt

SEQ ID NO: 425993 - DNA, 25 bp, Mus musculus
ggccacgattttcttgggctgcgca

SEQ ID NO: 425994 - DNA, 25 bp, Mus musculus
acctgagtgacgaactccgcgttga

SEQ ID NO: 425995 - DNA, 25 bp, Mus musculus
gcaggagccgccatcgcagcgatcg

SEQ ID NO: 425996 - DNA, 25 bp, Mus musculus
ctgaagctgaccagaggctcgtagc

SEQ ID NO: 425997 - DNA, 25 bp, Mus musculus
tcgtagcggcgactctcgaaagctt

SEQ ID NO: 425998 - DNA, 25 bp, Mus musculus
gcggcgactctcgaaagctttcaag

SEQ ID NO: 425999 - DNA, 25 bp, Mus musculus
ggtgccagagcgcccggcacagaca

SEQ ID NO: 426000 - DNA, 25 bp, Mus musculus
ccggggctcacctgagtgacgaact

SEQ ID NO: 426001 - DNA, 25 bp, Mus musculus
cacgattttcttgggctgcgcagga

SEQ ID NO: 426002 - DNA, 25 bp, Mus musculus
ggtcgtggcaccctgttcggatccc

SEQ ID NO: 426003 - DNA, 25 bp, Mus musculus
gcaagctcacgtccgcagggtcagc

SEQ ID NO: 426004 - DNA, 25 bp, Mus musculus
agctcttttgagtttaccgctctga

SEQ ID NO: 426005 - DNA, 25 bp, Mus musculus
tcgccaagacggcaggcaagctcac

SEQ ID NO: 426006 - DNA, 25 bp, Mus musculus
ctcagagcctgggtttcgccaagac

SEQ ID NO: 426007 - DNA, 25 bp, Mus musculus
ggacgcatctcagagcctgggtttc

SEQ ID NO: 426008 - DNA, 25 bp, Mus musculus
gcaaacgccgggcagggacgcatct

SEQ ID NO: 426009 - DNA, 25 bp, Mus musculus
aggcttctggggtcctccacactca

SEQ ID NO: 426010 - DNA, 25 bp, Mus musculus
cgggattcgttccatctcgcacgca

SEQ ID NO: 426011 - DNA, 25 bp, Mus musculus
gctctgaatgtggtccgtccggaaa

SEQ ID NO: 426012 - DNA, 25 bp, Mus musculus
ttaccgctctgacgaagcacatgca

SEQ ID NO: 426013 - DNA, 25 bp, Mus musculus
agcacatgcaaggagccgaggtcgt

SEQ ID NO: 426014 - DNA, 25 bp, Mus musculus
caagcgcggcgttcaggcgcgctct

SEQ ID NO: 426015 - DNA, 25 bp, Mus musculus
ttccatctcgcacgcaggcttctgg

SEQ ID NO: 426016 - DNA, 25 bp, Mus musculus
acacgcgcggtcctcgacctggtgt

SEQ ID NO: 426017 - DNA, 25 bp, Mus musculus
ggcgactggacctacacgcgcggtc

SEQ ID NO: 426018 - DNA, 25 bp, Mus musculus
ggatcccgcggcgactggacctaca

SEQ ID NO: 426019 - DNA, 25 bp, Mus musculus
gtgcggtaaccacagacgccaggcc

SEQ ID NO: 426020 - DNA, 25 bp, Mus musculus
acgtgcgtgcgtgcggtaaccacag

SEQ ID NO: 426021 - DNA, 25 bp, Mus musculus
atcagggccgcgaccctcattctgg

SEQ ID NO: 426022 - DNA, 25 bp, Mus musculus
tcattacctgatcagggccgcgacc

SEQ ID NO: 426023 - DNA, 25 bp, Mus musculus
cccagtcctcattacctgatcaggg

SEQ ID NO: 426024 - DNA, 25 bp, Mus musculus
caagagtaaagcgatggccccagtc

SEQ ID NO: 426025 - DNA, 25 bp, Mus musculus
caggatatagccttgcccaagagta

SEQ ID NO: 426026 - DNA, 25 bp, Mus musculus
tggccgcgtcaggatatagccttgc

SEQ ID NO: 426027 - DNA, 25 bp, Mus musculus
ggatgtttctacagtggccgcgtca

SEQ ID NO: 426028 - DNA, 25 bp, Mus musculus
cccaagaagtggctccggatgtttc

SEQ ID NO: 426029 - DNA, 25 bp, Mus musculus
cgacctggtgtctgctgcgctgcct

SEQ ID NO: 426030 - DNA, 25 bp, Mus musculus
gtacactctgctggcgcaaatagtt

SEQ ID NO: 426031 - DNA, 25 bp, Mus musculus
gcaaatagttctacagcccgcctct

SEQ ID NO: 426032 - DNA, 25 bp, Mus musculus
tactgcggctgctcagtacactctg

SEQ ID NO: 426033 - DNA, 25 bp, Mus musculus
gctagttgccttcggcccggcttac

SEQ ID NO: 426034 - DNA, 25 bp, Mus musculus
cttacccaagatggcggctagttgc

SEQ ID NO: 426035 - DNA, 25 bp, Mus musculus
ggttgctttgcccttacccaagatg

SEQ ID NO: 426036 - DNA, 25 bp, Mus musculus
gaattcggtacgcagccgccacttc

SEQ ID NO: 426037 - DNA, 25 bp, Mus musculus
tgtcttcaatgagcgtctgggttcc

SEQ ID NO: 426038 - DNA, 25 bp, Mus musculus
cgcagctggcagagtgtcttcaatg

SEQ ID NO: 426039 - DNA, 25 bp, Mus musculus
ccgtctgtgtttctcgcagctggca

SEQ ID NO: 426040 - DNA, 25 bp, Mus musculus
tgtgacccgaaacgggccgtctgtg

SEQ ID NO: 426041 - DNA, 25 bp, Mus musculus
ggctggaaaagcatccctgtgaccc

SEQ ID NO: 426042 - DNA, 25 bp, Mus musculus
tccgggtttccaactccaggctgga

SEQ ID NO: 426043 - DNA, 25 bp, Mus musculus
gttccgatctcagggaggtgttgct

SEQ ID NO: 426044 - DNA, 25 bp, Mus musculus
cttacactccggaggcggcaggata

SEQ ID NO: 426045 - DNA, 25 bp, Mus musculus
gtcagcgtcttctcccagaggcaga

SEQ ID NO: 426046 - DNA, 25 bp, Mus musculus
atggagatgggtcgcgttacctgct

SEQ ID NO: 426047 - DNA, 25 bp, Mus musculus
gttacctgcttgcttgcgccttcta

SEQ ID NO: 426048 - DNA, 25 bp, Mus musculus
gcgccttctaccctgtgcagaaatc

SEQ ID NO: 426049 - DNA, 25 bp, Mus musculus
ggagacccttctgacacggctgctt

SEQ ID NO: 426050 - DNA, 25 bp, Mus musculus
tcccaggagagagtaatctggacgc

SEQ ID NO: 426051 - DNA, 25 bp, Mus musculus
gacgctagaagtacgccgctgtgca

SEQ ID NO: 426052 - DNA, 25 bp, Mus musculus
ctctgaaaccaaacggcgcaccttg

SEQ ID NO: 426053 - DNA, 25 bp, Mus musculus
caggatattggggtgcgcttcagcc

SEQ ID NO: 426054 - DNA, 25 bp, Mus musculus
gcagagagatgaagtgcttacactc

SEQ ID NO: 426055 - DNA, 25 bp, Mus musculus
acacggctgctttgtcagcgtcttc

SEQ ID NO: 426056 - DNA, 25 bp, Mus musculus
gttccgcgtggtagattgccatgtc

SEQ ID NO: 426057 - DNA, 25 bp, Mus musculus
cgcaccttgcggtgcagagagatga

SEQ ID NO: 426058 - DNA, 25 bp, Mus musculus
tacaacaaacacactcgcgacgggg

SEQ ID NO: 426059 - DNA, 25 bp, Mus musculus
agcaggttcgtccatacaacaaaca

SEQ ID NO: 426060 - DNA, 25 bp, Mus musculus
ccattctcatcacgatttgaccgca

SEQ ID NO: 426061 - DNA, 25 bp, Mus musculus
tcatcacgatttgaccgcagagtcc

SEQ ID NO: 426062 - DNA, 25 bp, Mus musculus
cgatttgaccgcagagtccagcgct

SEQ ID NO: 426063 - DNA, 25 bp, Mus musculus
agtccagcgctgcacctttctccag

SEQ ID NO: 426064 - DNA, 25 bp, Mus musculus
cgcacgacgcccgaagttgatcact

SEQ ID NO: 426065 - DNA, 25 bp, Mus musculus
cgacgcccgaagttgatcactgaaa

SEQ ID NO: 426066 - DNA, 25 bp, Mus musculus
cgcccgaagttgatcactgaaaaaa

SEQ ID NO: 426067 - DNA, 25 bp, Mus musculus
cctccatccgtttgcagcaggttcg

SEQ ID NO: 426068 - DNA, 25 bp, Mus musculus
ttgcagcaggttcgtccatacaaca

SEQ ID NO: 426069 - DNA, 25 bp, Mus musculus
ttcgtccatacaacaaacacactcg

SEQ ID NO: 426070 - DNA, 25 bp, Mus musculus
aaacacactcgcgacggggaggccg

SEQ ID NO: 426071 - DNA, 25 bp, Mus musculus
tccgtttgcagcaggttcgtccata

SEQ ID NO: 426072 - DNA, 25 bp, Mus musculus
cgcgtttcaaaacttagaagtgtga

SEQ ID NO: 426073 - DNA, 25 bp, Mus musculus
gcttgaggcctcaggctttaggctc

SEQ ID NO: 426074 - DNA, 25 bp, Mus musculus
agccgggctagtactcgcttggacc

SEQ ID NO: 426075 - DNA, 25 bp, Mus musculus
acctcgggatgcttgaggcctcagg

SEQ ID NO: 426076 - DNA, 25 bp, Mus musculus
cggcttagctacacctcgggatgct

SEQ ID NO: 426077 - DNA, 25 bp, Mus musculus
ctttgtgttcctccgggcggcttag

SEQ ID NO: 426078 - DNA, 25 bp, Mus musculus
ggcgcgtacgccctttgtgttcctc

SEQ ID NO: 426079 - DNA, 25 bp, Mus musculus
agtgccgggcgcgtacgccctttgt

SEQ ID NO: 426080 - DNA, 25 bp, Mus musculus
aaacttagaagtgtgagtgccgggc

SEQ ID NO: 426081 - DNA, 25 bp, Mus musculus
cctcaggctttaggctcagttgctg

SEQ ID NO: 426082 - DNA, 25 bp, Mus musculus
accctcagccggaagagccgggcta

SEQ ID NO: 426083 - DNA, 25 bp, Mus musculus
tcagttgctgtttacccactgtccc

SEQ ID NO: 426084 - DNA, 25 bp, Mus musculus
aggctcagttgctgtttacccactg

SEQ ID NO: 426085 - DNA, 25 bp, Mus musculus
gctttaggctcagttgctgtttacc

SEQ ID NO: 426086 - DNA, 25 bp, Mus musculus
ccagcgagggctcctttccggctgg

SEQ ID NO: 426087 - DNA, 25 bp, Mus musculus
gtcctcgccggctccttgagagcga

SEQ ID NO: 426088 - DNA, 25 bp, Mus musculus
ttcagtcgggaaatcccgtgtcctc

SEQ ID NO: 426089 - DNA, 25 bp, Mus musculus
ctgaggcttttcagtcgggaaatcc

SEQ ID NO: 426090 - DNA, 25 bp, Mus musculus
ggatgtcagtttccaccgccctctt

SEQ ID NO: 426091 - DNA, 25 bp, Mus musculus
ggacaggcgaacactgaggcttttc

SEQ ID NO: 426092 - DNA, 25 bp, Mus musculus
cgcccgcgcacagagcggtgatgca

SEQ ID NO: 426093 - DNA, 25 bp, Mus musculus
cctgtcgcatactgcctccgttgtg

SEQ ID NO: 426094 - DNA, 25 bp, Mus musculus
ggctcatttccatgcctgtcgcata

SEQ ID NO: 426095 - DNA, 25 bp, Mus musculus
ttgagagcgaggatgtcagtttcca

SEQ ID NO: 426096 - DNA, 25 bp, Mus musculus
gagagcccgcggctcatttccatgc

SEQ ID NO: 426097 - DNA, 25 bp, Mus musculus
ttaattgcttcaaagagcccttctc

SEQ ID NO: 426098 - DNA, 25 bp, Mus musculus
agcccttctcaatggggtttcagag

SEQ ID NO: 426099 - DNA, 25 bp, Mus musculus
gccgccgtgaaacgcgctttaattg

SEQ ID NO: 426100 - DNA, 25 bp, Mus musculus
gccgcgcaattcacacgccctctgg

SEQ ID NO: 426101 - DNA, 25 bp, Mus musculus
ccggcttggctggactgctgagcca

SEQ ID NO: 426102 - DNA, 25 bp, Mus musculus
aggcctggatcaccgccgtgcgcag

SEQ ID NO: 426103 - DNA, 25 bp, Mus musculus
ccgcgcgaacaaaggcggattgagc

SEQ ID NO: 426104 - DNA, 25 bp, Mus musculus
tgcggtgtgacaccgcgcgaacaaa

SEQ ID NO: 426105 - DNA, 25 bp, Mus musculus
agccgcccgttgctacgcggtggcg

SEQ ID NO: 426106 - DNA, 25 bp, Mus musculus
tttgcgcacgtcctagcaggtgcgg

SEQ ID NO: 426107 - DNA, 25 bp, Mus musculus
acttttgcgcacgtcctagcaggtg

SEQ ID NO: 426108 - DNA, 25 bp, Mus musculus
ctggccacttttgcgcacgtcctag

SEQ ID NO: 426109 - DNA, 25 bp, Mus musculus
gtgggtcctggccacttttgcgcac

SEQ ID NO: 426110 - DNA, 25 bp, Mus musculus
cgtcccggtaccctgtgggcaggcg

SEQ ID NO: 426111 - DNA, 25 bp, Mus musculus
ttggctggactgctgagccagctct

SEQ ID NO: 426112 - DNA, 25 bp, Mus musculus
ccctgctgtgcaggtggcgcacgag

SEQ ID NO: 426113 - DNA, 25 bp, Mus musculus
ccggcggccgcattatgcgggtaat

SEQ ID NO: 426114 - DNA, 25 bp, Mus musculus
tatttcctgtgctgctggatgcgcc

SEQ ID NO: 426115 - DNA, 25 bp, Mus musculus
cgttccgcctctgttcgccaaagtt

SEQ ID NO: 426116 - DNA, 25 bp, Mus musculus
ttcgccaaagttcgtgccacacagg

SEQ ID NO: 426117 - DNA, 25 bp, Mus musculus
gttcgtgccacacaggcttctcctg

SEQ ID NO: 426118 - DNA, 25 bp, Mus musculus
gcttctcctgcgctatagttatgca

SEQ ID NO: 426119 - DNA, 25 bp, Mus musculus
gctcgcagcgggagttatttcctgt

SEQ ID NO: 426120 - DNA, 25 bp, Mus musculus
caagcactcgtgcttccagagatga

SEQ ID NO: 426121 - DNA, 25 bp, Mus musculus
tggatgcgccagattcatgtaaccc

SEQ ID NO: 426122 - DNA, 25 bp, Mus musculus
ccgggcttcaatggaagccgttctc

SEQ ID NO: 426123 - DNA, 25 bp, Mus musculus
gccgttctccattaacaagcactcg

SEQ ID NO: 426124 - DNA, 25 bp, Mus musculus
ttccagagatgaatgcccagcattg

SEQ ID NO: 426125 - DNA, 25 bp, Mus musculus
ctgtttgcgcagtgaggatcgcgct

SEQ ID NO: 426126 - DNA, 25 bp, Mus musculus
tagttatgcaacctcgctcgcagcg

SEQ ID NO: 426127 - DNA, 25 bp, Mus musculus
agcattgcatgctgtttgcgcagtg

SEQ ID NO: 426128 - DNA, 25 bp, Mus musculus
actttgagcgtgtccatctcctggg

SEQ ID NO: 426129 - DNA, 25 bp, Mus musculus
tctgcccactactgaaggtcttatt

SEQ ID NO: 426130 - DNA, 25 bp, Mus musculus
gtgtgacagagaatggagcccagct

SEQ ID NO: 426131 - DNA, 25 bp, Mus musculus
gtcataactgactcgcccaagaaca

SEQ ID NO: 426132 - DNA, 25 bp, Mus musculus
cacgctgtgtgggaagtcataactg

SEQ ID NO: 426133 - DNA, 25 bp, Mus musculus
acggatttcggcgagtctgtagcac

SEQ ID NO: 426134 - DNA, 25 bp, Mus musculus
agcaggctgcagaaaccgccatttg

SEQ ID NO: 426135 - DNA, 25 bp, Mus musculus
tccgctaatcagtgcagcaggctgc

SEQ ID NO: 426136 - DNA, 25 bp, Mus musculus
ctttggagcttggagtcccgttgtt

SEQ ID NO: 426137 - DNA, 25 bp, Mus musculus
gcaagcgcttctctgatccgggaga

SEQ ID NO: 426138 - DNA, 25 bp, Mus musculus
tgaggagcatgtctaggttcccgcc

SEQ ID NO: 426139 - DNA, 25 bp, Mus musculus
aggggacacccaatctctacgtagg

SEQ ID NO: 426140 - DNA, 25 bp, Mus musculus
ggcaggcaaggcaaacaaaccgatc

SEQ ID NO: 426141 - DNA, 25 bp, Mus musculus
caggagtatggcgtgctcactttga

SEQ ID NO: 426142 - DNA, 25 bp, Mus musculus
ctgaaacttgttatgctgcccacga

SEQ ID NO: 426143 - DNA, 25 bp, Mus musculus
tgaggcatccaccatggtgaggccc

SEQ ID NO: 426144 - DNA, 25 bp, Mus musculus
cctgatcggatcacggtgagggaaa

SEQ ID NO: 426145 - DNA, 25 bp, Mus musculus
tgttgctcctccatctcctgatcgg

SEQ ID NO: 426146 - DNA, 25 bp, Mus musculus
actttcctgaaacttgttatgctgc

SEQ ID NO: 426147 - DNA, 25 bp, Mus musculus
ctcccgctgcccgacgatttgggaa

SEQ ID NO: 426148 - DNA, 25 bp, Mus musculus
atgctgcccacgatccagagctgca

SEQ ID NO: 426149 - DNA, 25 bp, Mus musculus
ccacgatccagagctgcagtgattc

SEQ ID NO: 426150 - DNA, 25 bp, Mus musculus
ctgcagtgattcgactgcgggccgc

SEQ ID NO: 426151 - DNA, 25 bp, Mus musculus
cggcccagaagtcgcgagggactac

SEQ ID NO: 426152 - DNA, 25 bp, Mus musculus
gcgagggactacttcgcctgcctct

SEQ ID NO: 426153 - DNA, 25 bp, Mus musculus
ggcaccgctccgagtgaggcatcca

SEQ ID NO: 426154 - DNA, 25 bp, Mus musculus
tccgagtgaggcatccaccatggtg

SEQ ID NO: 426155 - DNA, 25 bp, Mus musculus
gagcagcgctgatctcggccctcgt

SEQ ID NO: 426156 - DNA, 25 bp, Mus musculus
gtgttctcgtggacaacttctcaga

SEQ ID NO: 426157 - DNA, 25 bp, Mus musculus
atggacgtagatcctgctcccgccg

SEQ ID NO: 426158 - DNA, 25 bp, Mus musculus
tcgggcccgaaaccagcatggaagg

SEQ ID NO: 426159 - DNA, 25 bp, Mus musculus
ggttgccacggctacaagtcccgga

SEQ ID NO: 426160 - DNA, 25 bp, Mus musculus
ccgcaccgcagttgcgtctggactg

SEQ ID NO: 426161 - DNA, 25 bp, Mus musculus
ggagccctttgtatggacgtagatc

SEQ ID NO: 426162 - DNA, 25 bp, Mus musculus
ttcattacattcagcctgcagccgg

SEQ ID NO: 426163 - DNA, 25 bp, Mus musculus
tgtgccggccgttttccctctttca

SEQ ID NO: 426164 - DNA, 25 bp, Mus musculus
acgttctggacaccttggaggcgct

SEQ ID NO: 426165 - DNA, 25 bp, Mus musculus
accaagcgaccatgagagggccaga

SEQ ID NO: 426166 - DNA, 25 bp, Mus musculus
tgacgaacagctttggaccaagcga

SEQ ID NO: 426167 - DNA, 25 bp, Mus musculus
cggcgggatttttagtgacgaacag

SEQ ID NO: 426168 - DNA, 25 bp, Mus musculus
agtcccggaaccttggcgtgctgac

SEQ ID NO: 426169 - DNA, 25 bp, Mus musculus
tctggactgttgtgtcgcgcatgct

SEQ ID NO: 426170 - DNA, 25 bp, Mus musculus
gcaccaaccacctgacaggcgttga

SEQ ID NO: 426171 - DNA, 25 bp, Mus musculus
aggagacgcagctactcaccgcgga

SEQ ID NO: 426172 - DNA, 25 bp, Mus musculus
ggcgccctcagttcttcttcgaatc

SEQ ID NO: 426173 - DNA, 25 bp, Mus musculus
tcgccttgcccagggttcccatggt

SEQ ID NO: 426174 - DNA, 25 bp, Mus musculus
cctgacaggcgttgatgttatcatc

SEQ ID NO: 426175 - DNA, 25 bp, Mus musculus
ttatcatcaggctggaggaaacgtg

SEQ ID NO: 426176 - DNA, 25 bp, Mus musculus
aagtttgtgcgagcgcgctccctac

SEQ ID NO: 426177 - DNA, 25 bp, Mus musculus
cacaaagtttgtgcgagcgcgctcc

SEQ ID NO: 426178 - DNA, 25 bp, Mus musculus
ccattacttggtagcgccccgagga

SEQ ID NO: 426179 - DNA, 25 bp, Mus musculus
ggctcacccgcaggcacaaagtttg

SEQ ID NO: 426180 - DNA, 25 bp, Mus musculus
agcccggagccgaccactcttggag

SEQ ID NO: 426181 - DNA, 25 bp, Mus musculus
tcacctagagcggtgggatcggctc

SEQ ID NO: 426182 - DNA, 25 bp, Mus musculus
ctggagccgtctcacctagagcggt

SEQ ID NO: 426183 - DNA, 25 bp, Mus musculus
ggttcccatggtcgcggctctctgc

SEQ ID NO: 426184 - DNA, 25 bp, Mus musculus
ccgcctcctctgtgaagatgaaaga

SEQ ID NO: 426185 - DNA, 25 bp, Mus musculus
ttgccctggcaactagaagcgcgca

SEQ ID NO: 426186 - DNA, 25 bp, Mus musculus
accgctgtctcaaagaacgctgttg

SEQ ID NO: 426187 - DNA, 25 bp, Mus musculus
ctcctctgtgaagatgaaagaggca

SEQ ID NO: 426188 - DNA, 25 bp, Mus musculus
ctggcaactagaagcgcgcagatca

SEQ ID NO: 426189 - DNA, 25 bp, Mus musculus
tctctccacttcccttcgaagggga

SEQ ID NO: 426190 - DNA, 25 bp, Mus musculus
tggacgcctagacactgactctctc

SEQ ID NO: 426191 - DNA, 25 bp, Mus musculus
aagctggacgcctagacactgactc

SEQ ID NO: 426192 - DNA, 25 bp, Mus musculus
gaagaaagctggacgcctagacact

SEQ ID NO: 426193 - DNA, 25 bp, Mus musculus
ctctgccgtggccagcggctaccaa

SEQ ID NO: 426194 - DNA, 25 bp, Mus musculus
ctcaaagaacgctgttgccctggca

SEQ ID NO: 426195 - DNA, 25 bp, Mus musculus
tagaagcgcgcagatcacagtctcg

SEQ ID NO: 426196 - DNA, 25 bp, Mus musculus
cggctaccaacctctgcccgtggtg

SEQ ID NO: 426197 - DNA, 25 bp, Mus musculus
ggcagcaggagaccgctgtctcaaa

SEQ ID NO: 426198 - DNA, 25 bp, Mus musculus
ggctgaagctatatttcaatgccgc

SEQ ID NO: 426199 - DNA, 25 bp, Mus musculus
ctagcagggaccaggtaggatgccc

SEQ ID NO: 426200 - DNA, 25 bp, Mus musculus
acagattgtcgtgacctagcaggga

SEQ ID NO: 426201 - DNA, 25 bp, Mus musculus
tccaggtcggatcttggcttggaca

SEQ ID NO: 426202 - DNA, 25 bp, Mus musculus
ggacgctcagctggggtctaatccc

SEQ ID NO: 426203 - DNA, 25 bp, Mus musculus
cactcggctgaacgccaggactctg

SEQ ID NO: 426204 - DNA, 25 bp, Mus musculus
ttcggtgacacccagctgctgttgt

SEQ ID NO: 426205 - DNA, 25 bp, Mus musculus
tcaatgccgctagtagcttcgaagc

SEQ ID NO: 426206 - DNA, 25 bp, Mus musculus
atcctctctccctagtgggatggga

SEQ ID NO: 426207 - DNA, 25 bp, Mus musculus
gtgaactggcggtacagctgagcct

SEQ ID NO: 426208 - DNA, 25 bp, Mus musculus
gcctagccagccatccgcgaggagg

SEQ ID NO: 426209 - DNA, 25 bp, Mus musculus
tgggcccgtcagcaaccacatggag

SEQ ID NO: 426210 - DNA, 25 bp, Mus musculus
cacggtcacagagcatcgctgggcc

SEQ ID NO: 426211 - DNA, 25 bp, Mus musculus
ctaaaccaagggcagccaaggctgg

SEQ ID NO: 426212 - DNA, 25 bp, Mus musculus
ccaggttcgtctcccgctggagatc

SEQ ID NO: 426213 - DNA, 25 bp, Mus musculus
tacggctcggacttccaggatctgc

SEQ ID NO: 426214 - DNA, 25 bp, Mus musculus
gcccactggccttctccggagtggg

SEQ ID NO: 426215 - DNA, 25 bp, Mus musculus
gtcggtcttcagctcgagactccgc

SEQ ID NO: 426216 - DNA, 25 bp, Mus musculus
cttctccggagtgggccaaacgagt

SEQ ID NO: 426217 - DNA, 25 bp, Mus musculus
tcccgctggagatcctgtctttaaa

SEQ ID NO: 426218 - DNA, 25 bp, Mus musculus
agatcctgtctttaaagcgcctccc

SEQ ID NO: 426219 - DNA, 25 bp, Mus musculus
ccaaacgagtcagccgcggagaacc

SEQ ID NO: 426220 - DNA, 25 bp, Mus musculus
tagacctgtcatcagctcgaggccc

SEQ ID NO: 426221 - DNA, 25 bp, Mus musculus
ctgagccacaggagagctattcgca

SEQ ID NO: 426222 - DNA, 25 bp, Mus musculus
tattcgcagcgacaggaccacgagc

SEQ ID NO: 426223 - DNA, 25 bp, Mus musculus
gcgacaggaccacgagctgcaggcc

SEQ ID NO: 426224 - DNA, 25 bp, Mus musculus
ctggaggccatttacggctcggact

SEQ ID NO: 426225 - DNA, 25 bp, Mus musculus
ccctaggtcggtcttcagctcgaga

SEQ ID NO: 426226 - DNA, 25 bp, Mus musculus
tgcgggaaaacatcaggcgacactg

SEQ ID NO: 426227 - DNA, 25 bp, Mus musculus
aggtgacactgctatcgcgcctgca

SEQ ID NO: 426228 - DNA, 25 bp, Mus musculus
agtcacgggccaggattccagcagc

SEQ ID NO: 426229 - DNA, 25 bp, Mus musculus
attgtgcgctactacaacgcctgga

SEQ ID NO: 426230 - DNA, 25 bp, Mus musculus
agcccagccacctgcgggaaaacat

SEQ ID NO: 426231 - DNA, 25 bp, Mus musculus
atcaggcgacactgaagaactgggc

SEQ ID NO: 426232 - DNA, 25 bp, Mus musculus
gatcaagggcgaggtgacactgcta

SEQ ID NO: 426233 - DNA, 25 bp, Mus musculus
acactgaagaactgggcagcgtgga

SEQ ID NO: 426234 - DNA, 25 bp, Mus musculus
agcgtggaggctgcagcaccgccac

SEQ ID NO: 426235 - DNA, 25 bp, Mus musculus
cagctcggtggagtggagcacatct

SEQ ID NO: 426236 - DNA, 25 bp, Mus musculus
tggagcacatctgcagagcgttcta

SEQ ID NO: 426237 - DNA, 25 bp, Mus musculus
atctgcagagcgttctaccagcacc

SEQ ID NO: 426238 - DNA, 25 bp, Mus musculus
cgcttcccagtcacgggccaggatt

SEQ ID NO: 426239 - DNA, 25 bp, Mus musculus
acaacgcctggatcgagcggcatga

SEQ ID NO: 426240 - DNA, 25 bp, Mus musculus
gactcgctcgataaacactgggacc

SEQ ID NO: 426241 - DNA, 25 bp, Mus musculus
gacgcttgctttcggtggttggact

SEQ ID NO: 426242 - DNA, 25 bp, Mus musculus
cggcacttctggaagagcctggtca

SEQ ID NO: 426243 - DNA, 25 bp, Mus musculus
aggcatattcttcctcactaacgga

SEQ ID NO: 426244 - DNA, 25 bp, Mus musculus
ctgacaacgggcgtcggacacactt

SEQ ID NO: 426245 - DNA, 25 bp, Mus musculus
cccggagattgcttacatttcttga

SEQ ID NO: 426246 - DNA, 25 bp, Mus musculus
tcttgagggtgatgaacacgctgcc

SEQ ID NO: 426247 - DNA, 25 bp, Mus musculus
ctggtcagctccgtcaggaactgca

SEQ ID NO: 426248 - DNA, 25 bp, Mus musculus
cagaagcctccagcggttacagccg

SEQ ID NO: 426249 - DNA, 25 bp, Mus musculus
ttacagccggaaaactcgctcgcgc

SEQ ID NO: 426250 - DNA, 25 bp, Mus musculus
ccgctttagttgcacgtcttccgtc

SEQ ID NO: 426251 - DNA, 25 bp, Mus musculus
cgtcaatcctcgcttcgctcgggtt

SEQ ID NO: 426252 - DNA, 25 bp, Mus musculus
ctcccgcgtctatccaggatgagga

SEQ ID NO: 426253 - DNA, 25 bp, Mus musculus
ttggactgcgttgtcaagctacacc

SEQ ID NO: 426254 - DNA, 25 bp, Mus musculus
ctatgaacaagcacaacaatgaagc

SEQ ID NO: 426255 - DNA, 25 bp, Mus musculus
cgtgaatcggccttcgtgcatgcca

SEQ ID NO: 426256 - DNA, 25 bp, Mus musculus
aatcggccttcgtgcatgccatcgc

SEQ ID NO: 426257 - DNA, 25 bp, Mus musculus
atgccatcgcctcggctggtgtcgc

SEQ ID NO: 426258 - DNA, 25 bp, Mus musculus
gctggtgtcgccttcgcagtcacac

SEQ ID NO: 426259 - DNA, 25 bp, Mus musculus
gcagtcacacgctcctgcgctgagg

SEQ ID NO: 426260 - DNA, 25 bp, Mus musculus
tgcgctgagggaacctccaccatct

SEQ ID NO: 426261 - DNA, 25 bp, Mus musculus
gaacctccaccatctgcggctgtga

SEQ ID NO: 426262 - DNA, 25 bp, Mus musculus
gcggctgtgactcacatcataaggg

SEQ ID NO: 426263 - DNA, 25 bp, Mus musculus
ctcacatcataaggggccacctgga

SEQ ID NO: 426264 - DNA, 25 bp, Mus musculus
aacaggccagatgcccgctcagcta

SEQ ID NO: 426265 - DNA, 25 bp, Mus musculus
gcccgctcagctatgaacaagcaca

SEQ ID NO: 426266 - DNA, 25 bp, Mus musculus
atgaagcaggccgaacggtgagaca

SEQ ID NO: 426267 - DNA, 25 bp, Mus musculus
aacggtgagacagcgacccacaact

SEQ ID NO: 426268 - DNA, 25 bp, Mus musculus
tattgtttccaaaatacgcccgctc

SEQ ID NO: 426269 - DNA, 25 bp, Mus musculus
cacaccgcgcggtattgtttccaaa

SEQ ID NO: 426270 - DNA, 25 bp, Mus musculus
tcccggaggaggtacgatccaactc

SEQ ID NO: 426271 - DNA, 25 bp, Mus musculus
aggaggtacgatccaactccgccta

SEQ ID NO: 426272 - DNA, 25 bp, Mus musculus
gaggtacgatccaactccgcctagc

SEQ ID NO: 426273 - DNA, 25 bp, Mus musculus
cgctcaccgggctgcggtgggaggc

SEQ ID NO: 426274 - DNA, 25 bp, Mus musculus
aggccacggcacaccgcgcggtatt

SEQ ID NO: 426275 - DNA, 25 bp, Mus musculus
cacttcccggaggaggtacgatcca

SEQ ID NO: 426276 - DNA, 25 bp, Mus musculus
aaatacgcccgctccgggcatcccg

SEQ ID NO: 426277 - DNA, 25 bp, Mus musculus
ccgggcatcccgcaaacagctgatg

SEQ ID NO: 426278 - DNA, 25 bp, Mus musculus
ggcatcccgcaaacagctgatgagg

SEQ ID NO: 426279 - DNA, 25 bp, Mus musculus
atcccgcaaacagctgatgaggccc

SEQ ID NO: 426280 - DNA, 25 bp, Mus musculus
cgcgcggtattgtttccaaaatacg

SEQ ID NO: 426281 - DNA, 25 bp, Mus musculus
caccgcgcggtattgtttccaaaat

SEQ ID NO: 426282 - DNA, 25 bp, Mus musculus
agagcaagtattgggaatgcaggat

SEQ ID NO: 426283 - DNA, 25 bp, Mus musculus
cactcggaggataaaggtctgcgga

SEQ ID NO: 426284 - DNA, 25 bp, Mus musculus
agactcagttagcactcggaggata

SEQ ID NO: 426285 - DNA, 25 bp, Mus musculus
gttgagggagactcagttagcactc

SEQ ID NO: 426286 - DNA, 25 bp, Mus musculus
tcttcgcagctccagagccagctga

SEQ ID NO: 426287 - DNA, 25 bp, Mus musculus
tgacgatcttcgcagctccagagcc

SEQ ID NO: 426288 - DNA, 25 bp, Mus musculus
agcacggggtgacgatcttcgcagc

SEQ ID NO: 426289 - DNA, 25 bp, Mus musculus
ctattctgagaaggaatcgggtgcg

SEQ ID NO: 426290 - DNA, 25 bp, Mus musculus
ctgcgtcaagagacgttaaatttga

SEQ ID NO: 426291 - DNA, 25 bp, Mus musculus
gcgaggctacgtctgcgtcaagaga

SEQ ID NO: 426292 - DNA, 25 bp, Mus musculus
agcgcgtgcttaaacccgggataca

SEQ ID NO: 426293 - DNA, 25 bp, Mus musculus
gtaaggaccggacgcaaattgctgc

SEQ ID NO: 426294 - DNA, 25 bp, Mus musculus
acgcaaattgctgccgctgggtgct

SEQ ID NO: 426295 - DNA, 25 bp, Mus musculus
gaggaggctattctgagaaggaatc

SEQ ID NO: 426296 - DNA, 25 bp, Mus musculus
cgtggactagcctcttagaatccga

SEQ ID NO: 426297 - DNA, 25 bp, Mus musculus
caccgcgggcaacgggtctccgcgc

SEQ ID NO: 426298 - DNA, 25 bp, Mus musculus
tccgaagttcctcggctcctttaga

SEQ ID NO: 426299 - DNA, 25 bp, Mus musculus
gctcaatccctgcttcgcaagcgat

SEQ ID NO: 426300 - DNA, 25 bp, Mus musculus
gcttcgcaagcgatcgagcggccac

SEQ ID NO: 426301 - DNA, 25 bp, Mus musculus
cctggtaggccaagggcctgcgccc

SEQ ID NO: 426302 - DNA, 25 bp, Mus musculus
ctgcgcccgggacgaatgggaagct

SEQ ID NO: 426303 - DNA, 25 bp, Mus musculus
aagctggtttccgtggactagcctc

SEQ ID NO: 426304 - DNA, 25 bp, Mus musculus
ggtttccgtggactagcctcttaga

SEQ ID NO: 426305 - DNA, 25 bp, Mus musculus
gcctcttagaatccgaagttcctcg

SEQ ID NO: 426306 - DNA, 25 bp, Mus musculus
tcctcggctcctttagaagagcaca

SEQ ID NO: 426307 - DNA, 25 bp, Mus musculus
ctcctttagaagagcacaaaaaata

SEQ ID NO: 426308 - DNA, 25 bp, Mus musculus
tgtctttgtttcctggtcgcggtgg

SEQ ID NO: 426309 - DNA, 25 bp, Mus musculus
atccctgcttcgcaagcgatcgagc

SEQ ID NO: 426310 - DNA, 25 bp, Mus musculus
ggcgtttcttggttgctcccaggct

SEQ ID NO: 426311 - DNA, 25 bp, Mus musculus
ctctcctgagcctgaggttccgagg

SEQ ID NO: 426312 - DNA, 25 bp, Mus musculus
tctcttcggagactctagcacaccg

SEQ ID NO: 426313 - DNA, 25 bp, Mus musculus
tgatgctggtcacgaaccacgggcg

SEQ ID NO: 426314 - DNA, 25 bp, Mus musculus
cgggcttgttgatgctggtcacgaa

SEQ ID NO: 426315 - DNA, 25 bp, Mus musculus
aactttgggcgagtgaaaacgcaga

SEQ ID NO: 426316 - DNA, 25 bp, Mus musculus
gttccgaggatgctcctgggagcta

SEQ ID NO: 426317 - DNA, 25 bp, Mus musculus
tcgtgggctgttcttcccactctgc

SEQ ID NO: 426318 - DNA, 25 bp, Mus musculus
gggtacgcgaccagacgcttccgca

SEQ ID NO: 426319 - DNA, 25 bp, Mus musculus
aggagaggcctctcttcggtcagcc

SEQ ID NO: 426320 - DNA, 25 bp, Mus musculus
gacttgcaaaggaggcctggccacc

SEQ ID NO: 426321 - DNA, 25 bp, Mus musculus
gccgagactcctagcgacttgcaaa

SEQ ID NO: 426322 - DNA, 25 bp, Mus musculus
ctggcctctcggttctgggccgagt

SEQ ID NO: 426323 - DNA, 25 bp, Mus musculus
gaggcggcgactcctgccgagactc

SEQ ID NO: 426324 - DNA, 25 bp, Mus musculus
tgcctgagattctaatggagaaatc

SEQ ID NO: 426325 - DNA, 25 bp, Mus musculus
agcggttgtcgcttgctccgcagct

SEQ ID NO: 426326 - DNA, 25 bp, Mus musculus
cctgatcgattgaccagaggaaggc

SEQ ID NO: 426327 - DNA, 25 bp, Mus musculus
ccgggccctgatcgattgaccagag

SEQ ID NO: 426328 - DNA, 25 bp, Mus musculus
atcccaaagtgagctggggtgcacg

SEQ ID NO: 426329 - DNA, 25 bp, Mus musculus
atggagaaatcccaaagtgagctgg

SEQ ID NO: 426330 - DNA, 25 bp, Mus musculus
aggtcgctgcctgagattctaatgg

SEQ ID NO: 426331 - DNA, 25 bp, Mus musculus
ccctacaggagcaggtcgctgcctg

SEQ ID NO: 426332 - DNA, 25 bp, Mus musculus
tgctcgcgccctacaggagcaggtc

SEQ ID NO: 426333 - DNA, 25 bp, Mus musculus
aacgttggagctgctcgcgccctac

SEQ ID NO: 426334 - DNA, 25 bp, Mus musculus
ttgccaggcaacgttggagctgctc

SEQ ID NO: 426335 - DNA, 25 bp, Mus musculus
tcgcttgctccgcagcttgaacaca

SEQ ID NO: 426336 - DNA, 25 bp, Mus musculus
gacgatatcaaaattgccaggcaac

SEQ ID NO: 426337 - DNA, 25 bp, Mus musculus
gctccgcagcttgaacacaccgggg

SEQ ID NO: 426338 - DNA, 25 bp, Mus musculus
ctcgccgcaggtcctaggagcctat

SEQ ID NO: 426339 - DNA, 25 bp, Mus musculus
gtgcggttcccaacgtcctggactc

SEQ ID NO: 426340 - DNA, 25 bp, Mus musculus
ctggactccagccagtcgcagaatc

SEQ ID NO: 426341 - DNA, 25 bp, Mus musculus
ctgcggctcagcaggcacccgagtt

SEQ ID NO: 426342 - DNA, 25 bp, Mus musculus
acaagggcgaccttcgaagtggtgc

SEQ ID NO: 426343 - DNA, 25 bp, Mus musculus
agcctatgggctccggcacacgggc

SEQ ID NO: 426344 - DNA, 25 bp, Mus musculus
cacccgagttcgctctgtcgctagg

SEQ ID NO: 426345 - DNA, 25 bp, Mus musculus
cgagctacttaacgagctgattgca

SEQ ID NO: 426346 - DNA, 25 bp, Mus musculus
cccgaagttcgggaatggctcgccg

SEQ ID NO: 426347 - DNA, 25 bp, Mus musculus
ggggattacggctctctaggaccca

SEQ ID NO: 426348 - DNA, 25 bp, Mus musculus
tctccgtggcttcccgcttggcagg

SEQ ID NO: 426349 - DNA, 25 bp, Mus musculus
aatccaggtcctggcttggcgccgc

SEQ ID NO: 426350 - DNA, 25 bp, Mus musculus
cgcggcttagtagataatccaggtc

SEQ ID NO: 426351 - DNA, 25 bp, Mus musculus
ctgattgcacaaccgcggcttagta

SEQ ID NO: 426352 - DNA, 25 bp, Mus musculus
accaggagctgcacggcgtctaagt

SEQ ID NO: 426353 - DNA, 25 bp, Mus musculus
gcggaaagagcgcaccaagaactcc

SEQ ID NO: 426354 - DNA, 25 bp, Mus musculus
tcgccgctgaactgcaccaggagct

SEQ ID NO: 426355 - DNA, 25 bp, Mus musculus
aggttcacggctgcaccttgctcca

SEQ ID NO: 426356 - DNA, 25 bp, Mus musculus
tgctccagcagcagtcgcacgaagc

SEQ ID NO: 426357 - DNA, 25 bp, Mus musculus
cgtccagcacgaaacgggccaagtg

SEQ ID NO: 426358 - DNA, 25 bp, Mus musculus
gccaagtgcactttgccggcctgca

SEQ ID NO: 426359 - DNA, 25 bp, Mus musculus
tccctcgtggcttggagcaacgcca

SEQ ID NO: 426360 - DNA, 25 bp, Mus musculus
taccgctctttccaagcggcgtgta

SEQ ID NO: 426361 - DNA, 25 bp, Mus musculus
tgtaggtggctgcaaccaagtgtcc

SEQ ID NO: 426362 - DNA, 25 bp, Mus musculus
caagtgtcctgcagttcccgctcag

SEQ ID NO: 426363 - DNA, 25 bp, Mus musculus
gggcgtcttgcttttcctccctggc

SEQ ID NO: 426364 - DNA, 25 bp, Mus musculus
aactcttgggccctcttccctgtat

SEQ ID NO: 426365 - DNA, 25 bp, Mus musculus
tgccggcctgcatggcctcaaggaa

SEQ ID NO: 426366 - DNA, 25 bp, Mus musculus
tgttgtcccacacctcggtcacgtg

SEQ ID NO: 426367 - DNA, 25 bp, Mus musculus
cttctcatgtcttcgctgcagtttc

SEQ ID NO: 426368 - DNA, 25 bp, Mus musculus
cttgaggacggagcggtactgctcc

SEQ ID NO: 426369 - DNA, 25 bp, Mus musculus
ggtactgctcctcgccttgctgctg

SEQ ID NO: 426370 - DNA, 25 bp, Mus musculus
gctccagcctgtccttcagctcctg

SEQ ID NO: 426371 - DNA, 25 bp, Mus musculus
tcctgcggaagccacgagggtacag

SEQ ID NO: 426372 - DNA, 25 bp, Mus musculus
gtacaggcggtgaaccaggctccac

SEQ ID NO: 426373 - DNA, 25 bp, Mus musculus
aactctcgaagctccttctcatgtc

SEQ ID NO: 426374 - DNA, 25 bp, Mus musculus
gtacctcttcttgcgggagcccttg

SEQ ID NO: 426375 - DNA, 25 bp, Mus musculus
gctccacggcgctccaactctcgaa

SEQ ID NO: 426376 - DNA, 25 bp, Mus musculus
tgcagtttcaccacgcccttcagtt

SEQ ID NO: 426377 - DNA, 25 bp, Mus musculus
tgtcgctgttgtcccacacctcggt

SEQ ID NO: 426378 - DNA, 25 bp, Mus musculus
ggctccaccactctcggagagggca

SEQ ID NO: 426379 - DNA, 25 bp, Mus musculus
cgtgctgctccttgcgcttgaggac

SEQ ID NO: 426380 - DNA, 25 bp, Mus musculus
gcctacgtgctctccgtgtcgctgg

SEQ ID NO: 426381 - DNA, 25 bp, Mus musculus
cacctacaccggggacaagaaggcg

SEQ ID NO: 426382 - DNA, 25 bp, Mus musculus
tggcggccaagaccaacaagaagtg

SEQ ID NO: 426383 - DNA, 25 bp, Mus musculus
ccaacaagaagtgggtccggctagc

SEQ ID NO: 426384 - DNA, 25 bp, Mus musculus
tccggctagccacggtgttcgccta

SEQ ID NO: 426385 - DNA, 25 bp, Mus musculus
agccacggtgttcgcctacgtgctc

SEQ ID NO: 426386 - DNA, 25 bp, Mus musculus
tggccgccatcgtactggccgtcta

SEQ ID NO: 426387 - DNA, 25 bp, Mus musculus
tggccgtctactacagtctcatctg

SEQ ID NO: 426388 - DNA, 25 bp, Mus musculus
tacagtctcatctggcagccggtgg

SEQ ID NO: 426389 - DNA, 25 bp, Mus musculus
gcggctccaacaccaccggcccgtc

SEQ ID NO: 426390 - DNA, 25 bp, Mus musculus
agtcgttgaatctctccgcgttggg

SEQ ID NO: 426391 - DNA, 25 bp, Mus musculus
ccaagcaggactttgcagcaggacc

SEQ ID NO: 426392 - DNA, 25 bp, Mus musculus
actttgcagcaggaccggctccgga

SEQ ID NO: 426393 - DNA, 25 bp, Mus musculus
aatctctccgcgttggggacggtcg

SEQ ID NO: 426394 - DNA, 25 bp, Mus musculus
cgaggatctgcctccaaacgagggc

SEQ ID NO: 426395 - DNA, 25 bp, Mus musculus
cgccagcagttcctgttcgaggatc

SEQ ID NO: 426396 - DNA, 25 bp, Mus musculus
tgacgcagagtatcgccagcagttc

SEQ ID NO: 426397 - DNA, 25 bp, Mus musculus
gccatccctttgaacgctttgacgc

SEQ ID NO: 426398 - DNA, 25 bp, Mus musculus
gaggccagttcttccgttctagcca

SEQ ID NO: 426399 - DNA, 25 bp, Mus musculus
tctattgccacttggaggccagttc

SEQ ID NO: 426400 - DNA, 25 bp, Mus musculus
acatctggatctgctggttcgcggc

SEQ ID NO: 426401 - DNA, 25 bp, Mus musculus
ccgtggtgctccatgagcgctactt

SEQ ID NO: 426402 - DNA, 25 bp, Mus musculus
taagtttcggtacatctggatctgc

SEQ ID NO: 426403 - DNA, 25 bp, Mus musculus
ctgccctgtggtgtcattaagtttc

SEQ ID NO: 426404 - DNA, 25 bp, Mus musculus
cggatccgtatttttcgcaagatta

SEQ ID NO: 426405 - DNA, 25 bp, Mus musculus
ggcgttgcacagacggatccgtatt

SEQ ID NO: 426406 - DNA, 25 bp, Mus musculus
agcgctacttggctcacggctgtgt

SEQ ID NO: 426407 - DNA, 25 bp, Mus musculus
tcgcctgcaactgcccattctattg

SEQ ID NO: 426408 - DNA, 25 bp, Mus musculus
agcccgacttccgtgccattggcga

SEQ ID NO: 426409 - DNA, 25 bp, Mus musculus
ctgcgggctaagtacgcgctcttca

SEQ ID NO: 426410 - DNA, 25 bp, Mus musculus
ccaccgagagggacctggtctacta

SEQ ID NO: 426411 - DNA, 25 bp, Mus musculus
ttttgtgagcccaacccagagacgg

SEQ ID NO: 426412 - DNA, 25 bp, Mus musculus
ccagagacgggctcctttggtacca

SEQ ID NO: 426413 - DNA, 25 bp, Mus musculus
taccagggaccggacttgcaatgtc

SEQ ID NO: 426414 - DNA, 25 bp, Mus musculus
atgtcacctcccacggcatcgatgg

SEQ ID NO: 426415 - DNA, 25 bp, Mus musculus
cacaacacgaggacggagaaacgga

SEQ ID NO: 426416 - DNA, 25 bp, Mus musculus
aatgccattgcgtcttccactggtg

SEQ ID NO: 426417 - DNA, 25 bp, Mus musculus
tgctatgtcagctgccaagagtgta

SEQ ID NO: 426418 - DNA, 25 bp, Mus musculus
gccaagagtgtattcgcatctacga

SEQ ID NO: 426419 - DNA, 25 bp, Mus musculus
cgcatctacgatgtgcacacctgca

SEQ ID NO: 426420 - DNA, 25 bp, Mus musculus
gccattggcgacttcctcaaggaca

SEQ ID NO: 426421 - DNA, 25 bp, Mus musculus
agaaacaccgtgagtcccgaggctg

SEQ ID NO: 426422 - DNA, 25 bp, Mus musculus
tcactcgatgccgagctgcggcttg

SEQ ID NO: 426423 - DNA, 25 bp, Mus musculus
ggggtctgtagtctatatgctagga

SEQ ID NO: 426424 - DNA, 25 bp, Mus musculus
cttgcccgcaggtgggtgtccacac

SEQ ID NO: 426425 - DNA, 25 bp, Mus musculus
ggccgaggcacaagagacagccttc

SEQ ID NO: 426426 - DNA, 25 bp, Mus musculus
gacagccttccgtacaacagggccg

SEQ ID NO: 426427 - DNA, 25 bp, Mus musculus
aacagggccgcctacagactcggag

SEQ ID NO: 426428 - DNA, 25 bp, Mus musculus
gtttccttttgaaagcgcggcggca

SEQ ID NO: 426429 - DNA, 25 bp, Mus musculus
cggcggcagactctaacgaggactg

SEQ ID NO: 426430 - DNA, 25 bp, Mus musculus
tgctgcggagcattatttgaaaggg

SEQ ID NO: 426431 - DNA, 25 bp, Mus musculus
ctggcgctgctaatatccgtcttgc

SEQ ID NO: 426432 - DNA, 25 bp, Mus musculus
gtcttgcactttcagggtccagcca

SEQ ID NO: 426433 - DNA, 25 bp, Mus musculus
acccggctacgatggccagtgctaa

SEQ ID NO: 426434 - DNA, 25 bp, Mus musculus
ctaagacggtgtgcgatgcgcagcc

SEQ ID NO: 426435 - DNA, 25 bp, Mus musculus
tgctaggactaagaaggacgaaatc

SEQ ID NO: 426436 - DNA, 25 bp, Mus musculus
cccgagccggagtaaagcaacagca

SEQ ID NO: 426437 - DNA, 25 bp, Mus musculus
gtttcccactcgtgctctggatgca

SEQ ID NO: 426438 - DNA, 25 bp, Mus musculus
gcacacagagtggagagagcgtcta

SEQ ID NO: 426439 - DNA, 25 bp, Mus musculus
ctagcacacagcgtgccctggtggg

SEQ ID NO: 426440 - DNA, 25 bp, Mus musculus
ctggaatccgcatggccatcggtta

SEQ ID NO: 426441 - DNA, 25 bp, Mus musculus
cggttatctgcttatggcggatcta

SEQ ID NO: 426442 - DNA, 25 bp, Mus musculus
ggcggatctaaagtgctctcacttc

SEQ ID NO: 426443 - DNA, 25 bp, Mus musculus
ctcacttcttaagactcctgcctta

SEQ ID NO: 426444 - DNA, 25 bp, Mus musculus
ctgccttaaagctctgcgggcggcc

SEQ ID NO: 426445 - DNA, 25 bp, Mus musculus
ccgattgcagcgaggactcccggga

SEQ ID NO: 426446 - DNA, 25 bp, Mus musculus
acccgctcagtcagcgctgcgtgga

SEQ ID NO: 426447 - DNA, 25 bp, Mus musculus
cgcggtgactttctggacgctccag

SEQ ID NO: 426448 - DNA, 25 bp, Mus musculus
agagagcgtctagcacacagcgtgc

SEQ ID NO: 426449 - DNA, 25 bp, Mus musculus
tggacgctccagtttcccactcgtg

SEQ ID NO: 426450 - DNA, 25 bp, Mus musculus
gaagttgtcagaccgcctccaagtg

SEQ ID NO: 426451 - DNA, 25 bp, Mus musculus
gcggactagcaaaagggagaggacc

SEQ ID NO: 426452 - DNA, 25 bp, Mus musculus
acggacggacgacaagaagcaggtg

SEQ ID NO: 426453 - DNA, 25 bp, Mus musculus
ctgcggtcccgccatcggggagcat

SEQ ID NO: 426454 - DNA, 25 bp, Mus musculus
ccaggcctggcctggttgtgccctg

SEQ ID NO: 426455 - DNA, 25 bp, Mus musculus
agcgagctaggtaggcggactagca

SEQ ID NO: 426456 - DNA, 25 bp, Mus musculus
tcagaccgcctccaagtgacagcgg

SEQ ID NO: 426457 - DNA, 25 bp, Mus musculus
gggaatcgaagttgtcagaccgcct

SEQ ID NO: 426458 - DNA, 25 bp, Mus musculus
accggttcgaacagcgagtgtgggc

SEQ ID NO: 426459 - DNA, 25 bp, Mus musculus
actcgatcgggtcgggctgaaggaa

SEQ ID NO: 426460 - DNA, 25 bp, Mus musculus
cctctcgtcccggtgagctaggagc

SEQ ID NO: 426461 - DNA, 25 bp, Mus musculus
cgccatcggggagcattgcgcgcct

SEQ ID NO: 426462 - DNA, 25 bp, Mus musculus
ggggttccagccgccggattccagc

SEQ ID NO: 426463 - DNA, 25 bp, Mus musculus
attgcgcgcctcgaggtgacagccc

SEQ ID NO: 426464 - DNA, 25 bp, Mus musculus
cgcagatgaggcagatgagctgccc

SEQ ID NO: 426465 - DNA, 25 bp, Mus musculus
gaggcccttaataatctgctactgg

SEQ ID NO: 426466 - DNA, 25 bp, Mus musculus
ggggcgccgcaagaactacccattg

SEQ ID NO: 426467 - DNA, 25 bp, Mus musculus
ctacccattgcgcaaacgttcactg

SEQ ID NO: 426468 - DNA, 25 bp, Mus musculus
cgcaaacgttcactggttcccgaga

SEQ ID NO: 426469 - DNA, 25 bp, Mus musculus
ctggttcccgagaagcccaaagcct

SEQ ID NO: 426470 - DNA, 25 bp, Mus musculus
gcccaaagcctgcaaagtgctgctg

SEQ ID NO: 426471 - DNA, 25 bp, Mus musculus
aagtgctgctgactcgcctggaaaa

SEQ ID NO: 426472 - DNA, 25 bp, Mus musculus
ctcgtccagtgaggatgctggtctc

SEQ ID NO: 426473 - DNA, 25 bp, Mus musculus
cccgcgaagcgcagatgaggcagat

SEQ ID NO: 426474 - DNA, 25 bp, Mus musculus
cgagtccgacctcgtccagtgagga

SEQ ID NO: 426475 - DNA, 25 bp, Mus musculus
tgaggatgctggtctcgtgcagccc

SEQ ID NO: 426476 - DNA, 25 bp, Mus musculus
gcctcccttaatgcagaggccctta

SEQ ID NO: 426477 - DNA, 25 bp, Mus musculus
ctcgcctggaaaacgtggctggccc

SEQ ID NO: 426478 - DNA, 25 bp, Mus musculus
cgttccgattccgactggttgccca

SEQ ID NO: 426479 - DNA, 25 bp, Mus musculus
gctgcagtcgggaaaaccctgcctc

SEQ ID NO: 426480 - DNA, 25 bp, Mus musculus
tgggtcggcatagaccaagtcctcc

SEQ ID NO: 426481 - DNA, 25 bp, Mus musculus
ccgcctacagggaagtgacaaccga

SEQ ID NO: 426482 - DNA, 25 bp, Mus musculus
tgacaaccgacggactgtctcgagc

SEQ ID NO: 426483 - DNA, 25 bp, Mus musculus
tgtctcgagcaacactggagtccca

SEQ ID NO: 426484 - DNA, 25 bp, Mus musculus
tggagtcccagcttatcaggtcgtc

SEQ ID NO: 426485 - DNA, 25 bp, Mus musculus
tccatcgaccattgtgatgtcatgc

SEQ ID NO: 426486 - DNA, 25 bp, Mus musculus
tgtcatgcctgggacttaactgttg

SEQ ID NO: 426487 - DNA, 25 bp, Mus musculus
ttaactgttgcgacaggacggctgc

SEQ ID NO: 426488 - DNA, 25 bp, Mus musculus
cgggccaacgcgtctatctgcctga

SEQ ID NO: 426489 - DNA, 25 bp, Mus musculus
gtgtgggtacacagagcagtcccga

SEQ ID NO: 426490 - DNA, 25 bp, Mus musculus
tcctagggtgggctactccacttcg

SEQ ID NO: 426491 - DNA, 25 bp, Mus musculus
tctctgcagtgttcgagctgtacca

SEQ ID NO: 426492 - DNA, 25 bp, Mus musculus
cctatccttggatgctggggactcg

SEQ ID NO: 426493 - DNA, 25 bp, Mus musculus
tcctaagcctagaggcctatccttg

SEQ ID NO: 426494 - DNA, 25 bp, Mus musculus
acattctcgtaagtgaccgctaccg

SEQ ID NO: 426495 - DNA, 25 bp, Mus musculus
ctgctgcgccacattctcgtaagtg

SEQ ID NO: 426496 - DNA, 25 bp, Mus musculus
acttgcaagtgagggaggacatccg

SEQ ID NO: 426497 - DNA, 25 bp, Mus musculus
tggagcgggacagatcctaagccta

SEQ ID NO: 426498 - DNA, 25 bp, Mus musculus
cgaggcatcctatcggagatgaaac

SEQ ID NO: 426499 - DNA, 25 bp, Mus musculus
gaggacatccgaaaccggaccttga

SEQ ID NO: 426500 - DNA, 25 bp, Mus musculus
ctgctcatgatcgagcgaggcatcc

SEQ ID NO: 426501 - DNA, 25 bp, Mus musculus
gcctccagcggactgctgctcatga

SEQ ID NO: 426502 - DNA, 25 bp, Mus musculus
atgttcgctgtaatcgtggcctcca

SEQ ID NO: 426503 - DNA, 25 bp, Mus musculus
gccgtccatgctgatgttcgctgta

SEQ ID NO: 426504 - DNA, 25 bp, Mus musculus
aactagctcctaggactcgggcacc

SEQ ID NO: 426505 - DNA, 25 bp, Mus musculus
accttgagggccgtgtgcggacaac

SEQ ID NO: 426506 - DNA, 25 bp, Mus musculus
tcgctcagagatgcaaagccgcggg

SEQ ID NO: 426507 - DNA, 25 bp, Mus musculus
cccggctttaaagggctgctggctg

SEQ ID NO: 426508 - DNA, 25 bp, Mus musculus
gagtcccggctttaaagggctgctg

SEQ ID NO: 426509 - DNA, 25 bp, Mus musculus
ggaaaatgttccagcctcatgcgcc

SEQ ID NO: 426510 - DNA, 25 bp, Mus musculus
tagagaactgcgctggaaaatgttc

SEQ ID NO: 426511 - DNA, 25 bp, Mus musculus
ccctgcaggaccgatagagaactgc

SEQ ID NO: 426512 - DNA, 25 bp, Mus musculus
tccgctcgctcagagatgcaaagcc

SEQ ID NO: 426513 - DNA, 25 bp, Mus musculus
ggcctccgctcgctcagagatgcaa

SEQ ID NO: 426514 - DNA, 25 bp, Mus musculus
atactcccgccaaaagccagggtgg

SEQ ID NO: 426515 - DNA, 25 bp, Mus musculus
ttctgaaatactcccgccaaaagcc

SEQ ID NO: 426516 - DNA, 25 bp, Mus musculus
aggcttctgaaatactcccgccaaa

SEQ ID NO: 426517 - DNA, 25 bp, Mus musculus
cgcacgctgggatgactgctgggat

SEQ ID NO: 426518 - DNA, 25 bp, Mus musculus
ccgccaaaagccagggtgggctccg

SEQ ID NO: 426519 - DNA, 25 bp, Mus musculus
gaccgatagagaactgcgctggaaa

SEQ ID NO: 426520 - DNA, 25 bp, Mus musculus
accgagcctctagggagctacccta

SEQ ID NO: 426521 - DNA, 25 bp, Mus musculus
cggcacacgtgtttgtataacgaca

SEQ ID NO: 426522 - DNA, 25 bp, Mus musculus
cgacaacggggttttgcatcttctg

SEQ ID NO: 426523 - DNA, 25 bp, Mus musculus
gtgcggttataatgtgttccaattc

SEQ ID NO: 426524 - DNA, 25 bp, Mus musculus
tctccacttagcttcacgccggtgg

SEQ ID NO: 426525 - DNA, 25 bp, Mus musculus
agctaccctagtgggcccatggttc

SEQ ID NO: 426526 - DNA, 25 bp, Mus musculus
gttcagcgagtgacaggaccttctc

SEQ ID NO: 426527 - DNA, 25 bp, Mus musculus
ccggtattgactcggggcatccctt

SEQ ID NO: 426528 - DNA, 25 bp, Mus musculus
gtgactccggcacttgctgcagttc

SEQ ID NO: 426529 - DNA, 25 bp, Mus musculus
cgggtcaggatcaaggtcttagtcc

SEQ ID NO: 426530 - DNA, 25 bp, Mus musculus
gtgaacccggtgctgatacagtgca

SEQ ID NO: 426531 - DNA, 25 bp, Mus musculus
cgcgagcctgagatcagcctcatta

SEQ ID NO: 426532 - DNA, 25 bp, Mus musculus
tcagcctcattagaacagcgtttta

SEQ ID NO: 426533 - DNA, 25 bp, Mus musculus
tccctcgtttggacgcaaattattc

SEQ ID NO: 426534 - DNA, 25 bp, Mus musculus
cctgcgcaaggtgcggccctattac

SEQ ID NO: 426535 - DNA, 25 bp, Mus musculus
actgtcttactacgaggccgctgtc

SEQ ID NO: 426536 - DNA, 25 bp, Mus musculus
agttccgatcccagccactgtctta

SEQ ID NO: 426537 - DNA, 25 bp, Mus musculus
cggccctattactttgacttccaga

SEQ ID NO: 426538 - DNA, 25 bp, Mus musculus
tacctactacttcgagggcggcctg

SEQ ID NO: 426539 - DNA, 25 bp, Mus musculus
gcacttcgcagagactacctactac

SEQ ID NO: 426540 - DNA, 25 bp, Mus musculus
gtgagctttagcgatgagcacttcg

SEQ ID NO: 426541 - DNA, 25 bp, Mus musculus
gtcgtgccgcctccgaagaaacggc

SEQ ID NO: 426542 - DNA, 25 bp, Mus musculus
gtcgccgactcaggcaagaggaaaa

SEQ ID NO: 426543 - DNA, 25 bp, Mus musculus
tgactgaggcactgtctgcgcaagc

SEQ ID NO: 426544 - DNA, 25 bp, Mus musculus
ctctggtcccacagctttgtccgga

SEQ ID NO: 426545 - DNA, 25 bp, Mus musculus
tcccgggctgcctacgggacattgt

SEQ ID NO: 426546 - DNA, 25 bp, Mus musculus
cagattgcgaccctgaagcggctag

SEQ ID NO: 426547 - DNA, 25 bp, Mus musculus
ggccgcagcttgttgcacgtcttca

SEQ ID NO: 426548 - DNA, 25 bp, Mus musculus
tgaactttaaattgtaggctccgtc

SEQ ID NO: 426549 - DNA, 25 bp, Mus musculus
gtctgaaggcgacgagtgaacttta

SEQ ID NO: 426550 - DNA, 25 bp, Mus musculus
acgttccctgcttccgtggtctgaa

SEQ ID NO: 426551 - DNA, 25 bp, Mus musculus
tcctttccgttctgggctcctgaga

SEQ ID NO: 426552 - DNA, 25 bp, Mus musculus
cgtctctcgccaactccttgtggta

SEQ ID NO: 426553 - DNA, 25 bp, Mus musculus
gagcgccgcgtttcgcttctccttt

SEQ ID NO: 426554 - DNA, 25 bp, Mus musculus
cccagacaagtcaagcaggtggtcg

SEQ ID NO: 426555 - DNA, 25 bp, Mus musculus
tggcgggtcagaatgctcctttccg

SEQ ID NO: 426556 - DNA, 25 bp, Mus musculus
catcatctttggtcagggctccggg

SEQ ID NO: 426557 - DNA, 25 bp, Mus musculus
atgtgtttctgaccgacgttccctg

SEQ ID NO: 426558 - DNA, 25 bp, Mus musculus
agggcggttagatttgaatacttca

SEQ ID NO: 426559 - DNA, 25 bp, Mus musculus
agcatgcgcatcactagggcggtta

SEQ ID NO: 426560 - DNA, 25 bp, Mus musculus
acgttgagaggtgacgtccgactcc

SEQ ID NO: 426561 - DNA, 25 bp, Mus musculus
gctcgggttctgtttgagtgctgaa

SEQ ID NO: 426562 - DNA, 25 bp, Mus musculus
gtgttctttaaatacggcgcctgca

SEQ ID NO: 426563 - DNA, 25 bp, Mus musculus
gtggagaatttagccgagcctgaga

SEQ ID NO: 426564 - DNA, 25 bp, Mus musculus
ggagcgactgaccagggatattgca

SEQ ID NO: 426565 - DNA, 25 bp, Mus musculus
tcgcatctgtctagtggagaattta

SEQ ID NO: 426566 - DNA, 25 bp, Mus musculus
aacaaccatagggaggaccctgtgg

SEQ ID NO: 426567 - DNA, 25 bp, Mus musculus
cttcccgattacgtttcttatcctg

SEQ ID NO: 426568 - DNA, 25 bp, Mus musculus
accagggatattgcaagtgtgtttg

SEQ ID NO: 426569 - DNA, 25 bp, Mus musculus
ccgagcctgagatgaggctaacttc

SEQ ID NO: 426570 - DNA, 25 bp, Mus musculus
aggctaacttcagcgcaggtgggac

SEQ ID NO: 426571 - DNA, 25 bp, Mus musculus
gacgagcagggtttatgcaacaatg

SEQ ID NO: 426572 - DNA, 25 bp, Mus musculus
tgcaacaatgcagagcggttccaga

SEQ ID NO: 426573 - DNA, 25 bp, Mus musculus
tagggtgtcccagaccgagtagtac

SEQ ID NO: 426574 - DNA, 25 bp, Mus musculus
cgagtagtaccaacaaccataggga

SEQ ID NO: 426575 - DNA, 25 bp, Mus musculus
acgtttcttatcctgctcgcatctg

SEQ ID NO: 426576 - DNA, 25 bp, Mus musculus
tcccacaggtgtggccaggaagact

SEQ ID NO: 426577 - DNA, 25 bp, Mus musculus
gcttcaaagccgtccggcatgtccg

SEQ ID NO: 426578 - DNA, 25 bp, Mus musculus
ttggcgggatttccgaaagtcgcgc

SEQ ID NO: 426579 - DNA, 25 bp, Mus musculus
atttccgaaagtcgcgcgccgtgcg

SEQ ID NO: 426580 - DNA, 25 bp, Mus musculus
aagccgaggcgctcccacaggtgtg

SEQ ID NO: 426581 - DNA, 25 bp, Mus musculus
gagcagggcgaccaaccgaccgacg

SEQ ID NO: 426582 - DNA, 25 bp, Mus musculus
ccctctacgctgagaaaccggagaa

SEQ ID NO: 426583 - DNA, 25 bp, Mus musculus
cagtgctcccgtagccagctttgtg

SEQ ID NO: 426584 - DNA, 25 bp, Mus musculus
tcttgagccggctcaggccagtgct

SEQ ID NO: 426585 - DNA, 25 bp, Mus musculus
cttccatggccgctcggcttcttga

SEQ ID NO: 426586 - DNA, 25 bp, Mus musculus
tgacagaggagcaacgaagcgcgtt

SEQ ID NO: 426587 - DNA, 25 bp, Mus musculus
ttttcgtagaaaacctgacagagga

SEQ ID NO: 426588 - DNA, 25 bp, Mus musculus
gccaggaagactgaaatttttcgta

SEQ ID NO: 426589 - DNA, 25 bp, Mus musculus
catgtccgtcaggttcgcagcagaa

SEQ ID NO: 426590 - DNA, 25 bp, Mus musculus
ctacatcggcgaatggacgctgtgc

SEQ ID NO: 426591 - DNA, 25 bp, Mus musculus
tagacatagtgtacctgcagcccgc

SEQ ID NO: 426592 - DNA, 25 bp, Mus musculus
ggtccgtttccatcgctggctgtaa

SEQ ID NO: 426593 - DNA, 25 bp, Mus musculus
tgcagcccgcgtaagaaacaggagc

SEQ ID NO: 426594 - DNA, 25 bp, Mus musculus
agagagtcatgaggccggccctcca

SEQ ID NO: 426595 - DNA, 25 bp, Mus musculus
gtacgtgacaacctcgcagccggct

SEQ ID NO: 426596 - DNA, 25 bp, Mus musculus
cgcaggagaccaactcagaccctta

SEQ ID NO: 426597 - DNA, 25 bp, Mus musculus
ttttgacgtccttaatccgcgccac

SEQ ID NO: 426598 - DNA, 25 bp, Mus musculus
ttgggctgtctagtgtccgagcctc

SEQ ID NO: 426599 - DNA, 25 bp, Mus musculus
gactttacccggtgctacggccaga

SEQ ID NO: 426600 - DNA, 25 bp, Mus musculus
acggccagaatgtgctccgcaaatc

SEQ ID NO: 426601 - DNA, 25 bp, Mus musculus
tggctgtaaaggacgcacaggaatc

SEQ ID NO: 426602 - DNA, 25 bp, Mus musculus
ccggcggcagtaccaagtaacagtc

SEQ ID NO: 426603 - DNA, 25 bp, Mus musculus
gcaccgcgctttcactctgtcaatg

SEQ ID NO: 426604 - DNA, 25 bp, Mus musculus
tgggtgacagcgacagccactctaa

SEQ ID NO: 426605 - DNA, 25 bp, Mus musculus
gcctcgcctcgtgcacttaagttca

SEQ ID NO: 426606 - DNA, 25 bp, Mus musculus
ttaagttcacaaggcacgcgtcctg

SEQ ID NO: 426607 - DNA, 25 bp, Mus musculus
cgtcctggtgaggacacgcagtccc

SEQ ID NO: 426608 - DNA, 25 bp, Mus musculus
ccctttagtcctcagcgcagttttc

SEQ ID NO: 426609 - DNA, 25 bp, Mus musculus
ttcgctctgctacgttttagggaca

SEQ ID NO: 426610 - DNA, 25 bp, Mus musculus
aaccgactggcatccgccggacttt

SEQ ID NO: 426611 - DNA, 25 bp, Mus musculus
tacgccatggccacaactcctagtg

SEQ ID NO: 426612 - DNA, 25 bp, Mus musculus
actcctagtgaagtccgcggggaca

SEQ ID NO: 426613 - DNA, 25 bp, Mus musculus
cagatccgtatggtgagtacctgga

SEQ ID NO: 426614 - DNA, 25 bp, Mus musculus
cacgccaaaggccaagctaagctgc

SEQ ID NO: 426615 - DNA, 25 bp, Mus musculus
cagccactctaagggactttcctga

SEQ ID NO: 426616 - DNA, 25 bp, Mus musculus
ctgctcatcagcactcagatccgta

SEQ ID NO: 426617 - DNA, 25 bp, Mus musculus
actttcctgatggtcccgcaaccgg

SEQ ID NO: 426618 - DNA, 25 bp, Mus musculus
cgcgctaagcctcctgggatgatgc

SEQ ID NO: 426619 - DNA, 25 bp, Mus musculus
acgcgaggaccgaagaactgctttg

SEQ ID NO: 426620 - DNA, 25 bp, Mus musculus
ctgctttgcctatcaagttctcacc

SEQ ID NO: 426621 - DNA, 25 bp, Mus musculus
aagttctcacctctttgtctgccgc

SEQ ID NO: 426622 - DNA, 25 bp, Mus musculus
tcctcaatgccgagcagcgcgtaca

SEQ ID NO: 426623 - DNA, 25 bp, Mus musculus
gcagcgcgtacagatccatttgtaa

SEQ ID NO: 426624 - DNA, 25 bp, Mus musculus
taagagctctttggtcaccgccatg

SEQ ID NO: 426625 - DNA, 25 bp, Mus musculus
ccgccatggttctagtccaaacttg

SEQ ID NO: 426626 - DNA, 25 bp, Mus musculus
gagccggcccaaaagcgcgctaagc

SEQ ID NO: 426627 - DNA, 25 bp, Mus musculus
gggatgatgccttccgattctcgtc

SEQ ID NO: 426628 - DNA, 25 bp, Mus musculus
cgattctcgtctgactggctgtgga

SEQ ID NO: 426629 - DNA, 25 bp, Mus musculus
cgctgcggagaatgaactacgactc

SEQ ID NO: 426630 - DNA, 25 bp, Mus musculus
ccgccttggtgagtgcaaagtcaga

SEQ ID NO: 426631 - DNA, 25 bp, Mus musculus
aactcccaggagtctgagcgtgtgc

SEQ ID NO: 426632 - DNA, 25 bp, Mus musculus
tcaccagaaactagaaaggccggga

SEQ ID NO: 426633 - DNA, 25 bp, Mus musculus
gcaggggttaatgccagtcccgccc

SEQ ID NO: 426634 - DNA, 25 bp, Mus musculus
tcagaactgcaacctggcgctggtg

SEQ ID NO: 426635 - DNA, 25 bp, Mus musculus
tacccgagctgatcaggtgtgtctc

SEQ ID NO: 426636 - DNA, 25 bp, Mus musculus
ccgaagcctcagtcagcaacggggc

SEQ ID NO: 426637 - DNA, 25 bp, Mus musculus
gccgtcctttgtgctggacaccgaa

SEQ ID NO: 426638 - DNA, 25 bp, Mus musculus
tacgcgagctcctgagcggtgctct

SEQ ID NO: 426639 - DNA, 25 bp, Mus musculus
gcgaggacgccatctctgcctgctt

SEQ ID NO: 426640 - DNA, 25 bp, Mus musculus
tctcaggtcacaagcaccctcggaa

SEQ ID NO: 426641 - DNA, 25 bp, Mus musculus
gagccgcctgcttgagccgctttac

SEQ ID NO: 426642 - DNA, 25 bp, Mus musculus
gcagccaatcttccgtgcagccaga

SEQ ID NO: 426643 - DNA, 25 bp, Mus musculus
gaggctcgcactgtgaaggtgaccc

SEQ ID NO: 426644 - DNA, 25 bp, Mus musculus
gccagcatctctgcggtcggcgtat

SEQ ID NO: 426645 - DNA, 25 bp, Mus musculus
tatggctcctttgcgcgcttggcct

SEQ ID NO: 426646 - DNA, 25 bp, Mus musculus
ctgcacagagctgaccttgttctgc

SEQ ID NO: 426647 - DNA, 25 bp, Mus musculus
gtaagctctccgtgggcgcctttcc

SEQ ID NO: 426648 - DNA, 25 bp, Mus musculus
atcgtggggctcgtaagctctccgt

SEQ ID NO: 426649 - DNA, 25 bp, Mus musculus
ttccgggagcagcatgcttataaga

SEQ ID NO: 426650 - DNA, 25 bp, Mus musculus
ccgaactcggtctaaggcagcggtt

SEQ ID NO: 426651 - DNA, 25 bp, Mus musculus
gcgcctttcccgatgtcgtcgctgg

SEQ ID NO: 426652 - DNA, 25 bp, Mus musculus
tgttctgcgcggtgtctgcttgaat

SEQ ID NO: 426653 - DNA, 25 bp, Mus musculus
cccgcagcggactttcgttttgtgc

SEQ ID NO: 426654 - DNA, 25 bp, Mus musculus
ctggccagaaaataacccgaactcg

SEQ ID NO: 426655 - DNA, 25 bp, Mus musculus
ctcaggctcacagaaggtagaatcc

SEQ ID NO: 426656 - DNA, 25 bp, Mus musculus
cgcagatgacggatcctcaggctca

SEQ ID NO: 426657 - DNA, 25 bp, Mus musculus
gacggctctacttcccggctgggcg

SEQ ID NO: 426658 - DNA, 25 bp, Mus musculus
gagcaaggacaaaccgcactacacc

SEQ ID NO: 426659 - DNA, 25 bp, Mus musculus
tcggatgcaatccaggcccagaacg

SEQ ID NO: 426660 - DNA, 25 bp, Mus musculus
atagcgcgcggggtacccattgcag

SEQ ID NO: 426661 - DNA, 25 bp, Mus musculus
aatctgtccaagctgggcacgcccg

SEQ ID NO: 426662 - DNA, 25 bp, Mus musculus
agccggacgctgacaatctgtccaa

SEQ ID NO: 426663 - DNA, 25 bp, Mus musculus
gttccgcagccggacgctgacaatc

SEQ ID NO: 426664 - DNA, 25 bp, Mus musculus
cactcggggaagcaggttccgcagc

SEQ ID NO: 426665 - DNA, 25 bp, Mus musculus
cccggaccaggctccgcggcactcg

SEQ ID NO: 426666 - DNA, 25 bp, Mus musculus
catggtccgctcctggggtagcaga

SEQ ID NO: 426667 - DNA, 25 bp, Mus musculus
cacgcatttgatgcccagctccgga

SEQ ID NO: 426668 - DNA, 25 bp, Mus musculus
accagcacgcatttgatgcccagct

SEQ ID NO: 426669 - DNA, 25 bp, Mus musculus
gatgaggctgctcttgcccaccgcg

SEQ ID NO: 426670 - DNA, 25 bp, Mus musculus
ctgacgatgaggctgctcttgccca

SEQ ID NO: 426671 - DNA, 25 bp, Mus musculus
tgtagctgacgatgaggctgctctt

SEQ ID NO: 426672 - DNA, 25 bp, Mus musculus
cggggtacccattgcaggtgtagct

SEQ ID NO: 426673 - DNA, 25 bp, Mus musculus
cccattgcaggtgtagctgacgatg

SEQ ID NO: 426674 - DNA, 25 bp, Mus musculus
ctcgcggctgaaaaacccggaagca

SEQ ID NO: 426675 - DNA, 25 bp, Mus musculus
cacgtcataagcacgcgtcacgggg

SEQ ID NO: 426676 - DNA, 25 bp, Mus musculus
ggaaatcccgggctgcctcctagcg

SEQ ID NO: 426677 - DNA, 25 bp, Mus musculus
acccggaagcacgtcataagcacgc

SEQ ID NO: 426678 - DNA, 25 bp, Mus musculus
cggaagcctaggatccgcgcaagcc

SEQ ID NO: 426679 - DNA, 25 bp, Mus musculus
taggatccgcgcaagcctgttactg

SEQ ID NO: 426680 - DNA, 25 bp, Mus musculus
gcaagcctgttactggacgccgctg

SEQ ID NO: 426681 - DNA, 25 bp, Mus musculus
tactggacgccgctgggaaatcccg

SEQ ID NO: 426682 - DNA, 25 bp, Mus musculus
gggctgcctcctagcgccaacatga

SEQ ID NO: 426683 - DNA, 25 bp, Mus musculus
gagtctccgacaacgcctccttgtg

SEQ ID NO: 426684 - DNA, 25 bp, Mus musculus
cctccttgtggaggctcaggtgccc

SEQ ID NO: 426685 - DNA, 25 bp, Mus musculus
tgcccaggactccagttaacactcg

SEQ ID NO: 426686 - DNA, 25 bp, Mus musculus
ctccagttaacactcgcggctgaaa

SEQ ID NO: 426687 - DNA, 25 bp, Mus musculus
cctcctagcgccaacatgaggaact

SEQ ID NO: 426688 - DNA, 25 bp, Mus musculus
tacgcgctgacccagagctattttg

SEQ ID NO: 426689 - DNA, 25 bp, Mus musculus
cttcagcggaaactggccggcttga

SEQ ID NO: 426690 - DNA, 25 bp, Mus musculus
gctggccgagtttcttcagcggaaa

SEQ ID NO: 426691 - DNA, 25 bp, Mus musculus
aggagattgccctcaagttcttgga

SEQ ID NO: 426692 - DNA, 25 bp, Mus musculus
tcgtcagcatcgctacctggagagc

SEQ ID NO: 426693 - DNA, 25 bp, Mus musculus
gcccgagaggctgatttctgttttc

SEQ ID NO: 426694 - DNA, 25 bp, Mus musculus
tggcgcacctacttggacatgaacc

SEQ ID NO: 426695 - DNA, 25 bp, Mus musculus
ctgattgcctggacacggtcctggc

SEQ ID NO: 426696 - DNA, 25 bp, Mus musculus
gtattgtagagagcggcctgattgc

SEQ ID NO: 426697 - DNA, 25 bp, Mus musculus
tgacctggccaaagagtattgtaga

SEQ ID NO: 426698 - DNA, 25 bp, Mus musculus
gacatgaaccgctttgacctggcca

SEQ ID NO: 426699 - DNA, 25 bp, Mus musculus
tgcggtcttccgctaccatgtgcaa

SEQ ID NO: 426700 - DNA, 25 bp, Mus musculus
ccgctaccatgtgcaacgtgaggca

SEQ ID NO: 426701 - DNA, 25 bp, Mus musculus
ctcaagttcttggaggcccggcaag

SEQ ID NO: 426702 - DNA, 25 bp, Mus musculus
tgtgaatggatcgaatgaagcagcc

SEQ ID NO: 426703 - DNA, 25 bp, Mus musculus
cgggaagctgctgcattaaattgta

SEQ ID NO: 426704 - DNA, 25 bp, Mus musculus
ggcgctgcttgctaagcgggaaacc

SEQ ID NO: 426705 - DNA, 25 bp, Mus musculus
aatcgatttattgaccggcaggtgc

SEQ ID NO: 426706 - DNA, 25 bp, Mus musculus
tcgtcttgttcctttctgtcggttc

SEQ ID NO: 426707 - DNA, 25 bp, Mus musculus
ctgtcggttcactcctaaatgcggg

SEQ ID NO: 426708 - DNA, 25 bp, Mus musculus
taaatgcggggccaaggtccgagaa

SEQ ID NO: 426709 - DNA, 25 bp, Mus musculus
acgcgccggcctcatttcaatgtga

SEQ ID NO: 426710 - DNA, 25 bp, Mus musculus
ataacaccgcgctggaggtctccga

SEQ ID NO: 426711 - DNA, 25 bp, Mus musculus
cagccatgtggcagcaacagtttgc

SEQ ID NO: 426712 - DNA, 25 bp, Mus musculus
ccgcagcagtgtctctcaaggctta

SEQ ID NO: 426713 - DNA, 25 bp, Mus musculus
cagtgtgccaggtccagatcgttgt

SEQ ID NO: 426714 - DNA, 25 bp, Mus musculus
tagccggtgagagttgagataacac

SEQ ID NO: 426715 - DNA, 25 bp, Mus musculus
gtccgagaatctgcggcgccttagt

SEQ ID NO: 426716 - DNA, 25 bp, Mus musculus
ccgggaaaatatcagtgaattgcgc

SEQ ID NO: 426717 - DNA, 25 bp, Mus musculus
ggctgccagacggatcccacaaaac

SEQ ID NO: 426718 - DNA, 25 bp, Mus musculus
tgcgcggagagtccgggaaaatatc

SEQ ID NO: 426719 - DNA, 25 bp, Mus musculus
ccgcggagctgtggacgctgacact

SEQ ID NO: 426720 - DNA, 25 bp, Mus musculus
ctcgggcaactctccgaggggtctg

SEQ ID NO: 426721 - DNA, 25 bp, Mus musculus
actctccgaggggtctgtcctcact

SEQ ID NO: 426722 - DNA, 25 bp, Mus musculus
ggccgccgggatgcctattttagtc

SEQ ID NO: 426723 - DNA, 25 bp, Mus musculus
ccgggatgcctattttagtcaaagc

SEQ ID NO: 426724 - DNA, 25 bp, Mus musculus
tagtcaaagcctccgcgaacgggga

SEQ ID NO: 426725 - DNA, 25 bp, Mus musculus
cagtgggagccacgggtcctcgcca

SEQ ID NO: 426726 - DNA, 25 bp, Mus musculus
cgagcaacttgcgatgcgcccgcgt

SEQ ID NO: 426727 - DNA, 25 bp, Mus musculus
ggacgctgacactgctgtgagagca

SEQ ID NO: 426728 - DNA, 25 bp, Mus musculus
cacggagcggccgagcaacttgcga

SEQ ID NO: 426729 - DNA, 25 bp, Mus musculus
ctagagaaacgggtggctgccagac

SEQ ID NO: 426730 - DNA, 25 bp, Mus musculus
ataggcgcaagagttcccaggaggc

SEQ ID NO: 426731 - DNA, 25 bp, Mus musculus
atttccagagcgtggtaccgtcgcc

SEQ ID NO: 426732 - DNA, 25 bp, Mus musculus
ctcccgaatgcggtgagctcccatt

SEQ ID NO: 426733 - DNA, 25 bp, Mus musculus
tgaaaccggcatttccagagcgtgg

SEQ ID NO: 426734 - DNA, 25 bp, Mus musculus
gtccagccttattgccatttccatt

SEQ ID NO: 426735 - DNA, 25 bp, Mus musculus
ttcaagtaacttcgcggacataggc

SEQ ID NO: 426736 - DNA, 25 bp, Mus musculus
gctcccattggaagatgaaaccggc

SEQ ID NO: 426737 - DNA, 25 bp, Mus musculus
ccagtcgccattttattgaggcaaa

SEQ ID NO: 426738 - DNA, 25 bp, Mus musculus
aggcaaaccgaattcctcacagcgg

SEQ ID NO: 426739 - DNA, 25 bp, Mus musculus
ccgcggccgagtagcgttttcgtga

SEQ ID NO: 426740 - DNA, 25 bp, Mus musculus
gcgttttcgtgagtggctttgtgaa

SEQ ID NO: 426741 - DNA, 25 bp, Mus musculus
ttagtttccagcgtgtcagcgggca

SEQ ID NO: 426742 - DNA, 25 bp, Mus musculus
tgccgcttgacgttcggcgggctct

SEQ ID NO: 426743 - DNA, 25 bp, Mus musculus
ccattggtcagattttttgtcattc

SEQ ID NO: 426744 - DNA, 25 bp, Mus musculus
tggccgcaggtaatgtctcacgtcc

SEQ ID NO: 426745 - DNA, 25 bp, Mus musculus
cctgcggccaggtgagtatctaact

SEQ ID NO: 426746 - DNA, 25 bp, Mus musculus
tccaagcttggcacacaccgggaga

SEQ ID NO: 426747 - DNA, 25 bp, Mus musculus
ttaaacaggctgctgcgaggcaccc

SEQ ID NO: 426748 - DNA, 25 bp, Mus musculus
agccgagctccgtaactatatcctg

SEQ ID NO: 426749 - DNA, 25 bp, Mus musculus
caccagttatgttgagccgagctcc

SEQ ID NO: 426750 - DNA, 25 bp, Mus musculus
gatcatcccggagaggctttggtta

SEQ ID NO: 426751 - DNA, 25 bp, Mus musculus
tcacctggccggtaagcacaactta

SEQ ID NO: 426752 - DNA, 25 bp, Mus musculus
cagtggtcgcaaccctctgcagttg

SEQ ID NO: 426753 - DNA, 25 bp, Mus musculus
tccttcgtcgtcagggacaagaata

SEQ ID NO: 426754 - DNA, 25 bp, Mus musculus
tccacgccggtattgggcaccaact

SEQ ID NO: 426755 - DNA, 25 bp, Mus musculus
cgagggaccctgcacctttggcaat

SEQ ID NO: 426756 - DNA, 25 bp, Mus musculus
gagttcgtcaaccagcgcggtatgc

SEQ ID NO: 426757 - DNA, 25 bp, Mus musculus
agtatctaacttctcggccacaggg

SEQ ID NO: 426758 - DNA, 25 bp, Mus musculus
gagtttctcggggacactcccactg

SEQ ID NO: 426759 - DNA, 25 bp, Mus musculus
cgtctggaggctcatgggaccgccc

SEQ ID NO: 426760 - DNA, 25 bp, Mus musculus
cacgcgtcccagggtggcctggact

SEQ ID NO: 426761 - DNA, 25 bp, Mus musculus
tcggggtcagctctccacctgccgc

SEQ ID NO: 426762 - DNA, 25 bp, Mus musculus
gccctctgctctttgttacagcctg

SEQ ID NO: 426763 - DNA, 25 bp, Mus musculus
ttacagcctgacttcctgtttgtgg

SEQ ID NO: 426764 - DNA, 25 bp, Mus musculus
agcctgacttcctgtttgtggtcgc

SEQ ID NO: 426765 - DNA, 25 bp, Mus musculus
gacttcctgtttgtggtcgccgacc

SEQ ID NO: 426766 - DNA, 25 bp, Mus musculus
aggccgcgagtttctcggggacact

SEQ ID NO: 426767 - DNA, 25 bp, Mus musculus
ttctcggggacactcccactgggtc

SEQ ID NO: 426768 - DNA, 25 bp, Mus musculus
agtcgccagacactagagggcgctg

SEQ ID NO: 426769 - DNA, 25 bp, Mus musculus
cgcgcttgtccgtctggaggctcat

SEQ ID NO: 426770 - DNA, 25 bp, Mus musculus
cagagcagtcgccagacactagagg

SEQ ID NO: 426771 - DNA, 25 bp, Mus musculus
ttgtccgtctggaggctcatgggac

SEQ ID NO: 426772 - DNA, 25 bp, Mus musculus
cgcggttaaccgagaagcaaaatct

SEQ ID NO: 426773 - DNA, 25 bp, Mus musculus
ctccctagtgtggaagccggacttt

SEQ ID NO: 426774 - DNA, 25 bp, Mus musculus
caagccctgtggattttcgggtacg

SEQ ID NO: 426775 - DNA, 25 bp, Mus musculus
gcaggagtccgcatcccagagcact

SEQ ID NO: 426776 - DNA, 25 bp, Mus musculus
gcccggcaccatgaagcaggagtcc

SEQ ID NO: 426777 - DNA, 25 bp, Mus musculus
ctcagctggaacgaccgatcggtgc

SEQ ID NO: 426778 - DNA, 25 bp, Mus musculus
tctggagggaccactcagctggaac

SEQ ID NO: 426779 - DNA, 25 bp, Mus musculus
gtgccagcagcctgacgcaatctga

SEQ ID NO: 426780 - DNA, 25 bp, Mus musculus
tgactcgcccttgctgcatgccagt

SEQ ID NO: 426781 - DNA, 25 bp, Mus musculus
gcatgccagttctggggaaaccttc

SEQ ID NO: 426782 - DNA, 25 bp, Mus musculus
gggaaaccttccctgccgttgcatc

SEQ ID NO: 426783 - DNA, 25 bp, Mus musculus
cgttgcatcactcctgccaggtctg

SEQ ID NO: 426784 - DNA, 25 bp, Mus musculus
gccgaaccaatcagcacgcgcgttg

SEQ ID NO: 426785 - DNA, 25 bp, Mus musculus
ctttgcctatagtgacagccgtgtg

SEQ ID NO: 426786 - DNA, 25 bp, Mus musculus
agaggcgccatagccaggccagaac

SEQ ID NO: 426787 - DNA, 25 bp, Mus musculus
ggccagaacaatcgagcaggtactc

SEQ ID NO: 426788 - DNA, 25 bp, Mus musculus
tgactgcgttggacgggaacgctcc

SEQ ID NO: 426789 - DNA, 25 bp, Mus musculus
taagaagcggcccagtcgtcgcccg

SEQ ID NO: 426790 - DNA, 25 bp, Mus musculus
caaccctatggggagtgtccacacc

SEQ ID NO: 426791 - DNA, 25 bp, Mus musculus
aggtctctgaggtcccaaccctatg

SEQ ID NO: 426792 - DNA, 25 bp, Mus musculus
cggcggccactttcactcactgaga

SEQ ID NO: 426793 - DNA, 25 bp, Mus musculus
gccagagatacacgacaggagagcc

SEQ ID NO: 426794 - DNA, 25 bp, Mus musculus
gcggccctgcaactgccacagaaag

SEQ ID NO: 426795 - DNA, 25 bp, Mus musculus
ctgggactggcgaagattgccgaaa

SEQ ID NO: 426796 - DNA, 25 bp, Mus musculus
gggagaccctcatctatactatctg

SEQ ID NO: 426797 - DNA, 25 bp, Mus musculus
actgctagtcgctagcccgtgtccg

SEQ ID NO: 426798 - DNA, 25 bp, Mus musculus
tcgggtggccgaggtcacccataac

SEQ ID NO: 426799 - DNA, 25 bp, Mus musculus
tcgctagagtgagcaagcagatctc

SEQ ID NO: 426800 - DNA, 25 bp, Mus musculus
gcaaaaaagttctcaacgccagcca

SEQ ID NO: 426801 - DNA, 25 bp, Mus musculus
aaaagttctcaacgccagccactga

SEQ ID NO: 426802 - DNA, 25 bp, Mus musculus
ttgacgcaaaaaagttctcaacgcc

SEQ ID NO: 426803 - DNA, 25 bp, Mus musculus
cagctttgacgcaaaaaagttctca

SEQ ID NO: 426804 - DNA, 25 bp, Mus musculus
ctttgacgcaaaaaagttctcaacg

SEQ ID NO: 426805 - DNA, 25 bp, Mus musculus
cggcacagctttgacgcaaaaaagt

SEQ ID NO: 426806 - DNA, 25 bp, Mus musculus
gcacagctttgacgcaaaaaagttc

SEQ ID NO: 426807 - DNA, 25 bp, Mus musculus
agccgcagagccgaccacgccctcg

SEQ ID NO: 426808 - DNA, 25 bp, Mus musculus
cactgaagccgcagagccgaccacg

SEQ ID NO: 426809 - DNA, 25 bp, Mus musculus
ccagccactgaagccgcagagccga

SEQ ID NO: 426810 - DNA, 25 bp, Mus musculus
aacgccagccactgaagccgcagag

SEQ ID NO: 426811 - DNA, 25 bp, Mus musculus
agttctcaacgccagccactgaagc

SEQ ID NO: 426812 - DNA, 25 bp, Mus musculus
aaaaagttctcaacgccagccactg

SEQ ID NO: 426813 - DNA, 25 bp, Mus musculus
gacgcaaaaaagttctcaacgccag

SEQ ID NO: 426814 - DNA, 25 bp, Mus musculus
gccctccgggtgaattacttgcctc

SEQ ID NO: 426815 - DNA, 25 bp, Mus musculus
caggagccatgcaaaccccaggcgg

SEQ ID NO: 426816 - DNA, 25 bp, Mus musculus
gagagcagaaaagatgctgccagga

SEQ ID NO: 426817 - DNA, 25 bp, Mus musculus
tagagagagcagaaaagatgctgcc

SEQ ID NO: 426818 - DNA, 25 bp, Mus musculus
cgccctccgggtgaattacttgcct

SEQ ID NO: 426819 - DNA, 25 bp, Mus musculus
cctccgggtgaattacttgcctctt

SEQ ID NO: 426820 - DNA, 25 bp, Mus musculus
tccgggtgaattacttgcctctttc

SEQ ID NO: 426821 - DNA, 25 bp, Mus musculus
cgggtgaattacttgcctctttccg

SEQ ID NO: 426822 - DNA, 25 bp, Mus musculus
ggtgaattacttgcctctttccgga

SEQ ID NO: 426823 - DNA, 25 bp, Mus musculus
tgaattacttgcctctttccggagg

SEQ ID NO: 426824 - DNA, 25 bp, Mus musculus
tgcctctttccggaggagccaatca

SEQ ID NO: 426825 - DNA, 25 bp, Mus musculus
tcagcgcgcagcctcgagcccattc

SEQ ID NO: 426826 - DNA, 25 bp, Mus musculus
agcctcgagcccattcccagcgccc

SEQ ID NO: 426827 - DNA, 25 bp, Mus musculus
ctcgccctccgggtgaattacttgc

SEQ ID NO: 426828 - DNA, 25 bp, Mus musculus
cccggaggagctcccgtcacggtga

SEQ ID NO: 426829 - DNA, 25 bp, Mus musculus
gcctcagtactgacagcggtcgtcg

SEQ ID NO: 426830 - DNA, 25 bp, Mus musculus
caagaaggagactggctgtgagttc

SEQ ID NO: 426831 - DNA, 25 bp, Mus musculus
gacgaagagctcgaggagatcaaga

SEQ ID NO: 426832 - DNA, 25 bp, Mus musculus
cgttattgcgggacgaagagctcga

SEQ ID NO: 426833 - DNA, 25 bp, Mus musculus
cctccacgttattgcgggacgaaga

SEQ ID NO: 426834 - DNA, 25 bp, Mus musculus
tcgggcctccacgttattgcgggac

SEQ ID NO: 426835 - DNA, 25 bp, Mus musculus
acagtgccctctcccttcttgaccc

SEQ ID NO: 426836 - DNA, 25 bp, Mus musculus
gccgcaagagaaacagtgccctctc

SEQ ID NO: 426837 - DNA, 25 bp, Mus musculus
cccgggccgcaagagaaacagtgcc

SEQ ID NO: 426838 - DNA, 25 bp, Mus musculus
attggctggtgtcgggccgccctcc

SEQ ID NO: 426839 - DNA, 25 bp, Mus musculus
gcctcgctcccgattggctggtgtc

SEQ ID NO: 426840 - DNA, 25 bp, Mus musculus
ctcccgtcacggtgatggggtctcg

SEQ ID NO: 426841 - DNA, 25 bp, Mus musculus
gggtctcgggcctccacgttattgc

SEQ ID NO: 426842 - DNA, 25 bp, Mus musculus
ccgggctcaagagcagcagaaatta

SEQ ID NO: 426843 - DNA, 25 bp, Mus musculus
cacaaaccgtacatgagcaagttcg

SEQ ID NO: 426844 - DNA, 25 bp, Mus musculus
ccgcgtttattacggagaatcgatc

SEQ ID NO: 426845 - DNA, 25 bp, Mus musculus
atcgatctgcaccagacaccgaggc

SEQ ID NO: 426846 - DNA, 25 bp, Mus musculus
acaccgaggctgctactgcggaggc

SEQ ID NO: 426847 - DNA, 25 bp, Mus musculus
agagcaaaggctcagggcatccgcc

SEQ ID NO: 426848 - DNA, 25 bp, Mus musculus
gcagaaattacgtttagtgcaaatt

SEQ ID NO: 426849 - DNA, 25 bp, Mus musculus
gctccctacttcatcctcagtggtg

SEQ ID NO: 426850 - DNA, 25 bp, Mus musculus
cacggtgtctcgcaggcagcagacc

SEQ ID NO: 426851 - DNA, 25 bp, Mus musculus
ccaccgcagcggtacgggaatcaaa

SEQ ID NO: 426852 - DNA, 25 bp, Mus musculus
ggaatcaaaggcctgacccgcagcg

SEQ ID NO: 426853 - DNA, 25 bp, Mus musculus
cgggcaggatctgcctcccggaatc

SEQ ID NO: 426854 - DNA, 25 bp, Mus musculus
gtgcaaattgctgaagctccctact

SEQ ID NO: 426855 - DNA, 25 bp, Mus musculus
ccggaatcccacaaaccgtacatga

SEQ ID NO: 426856 - DNA, 25 bp, Mus musculus
gccctggttctctgagttgcacgta

SEQ ID NO: 426857 - DNA, 25 bp, Mus musculus
ctgggcctgacagggctttgcattc

SEQ ID NO: 426858 - DNA, 25 bp, Mus musculus
tccaatcatcactcggaggcggggc

SEQ ID NO: 426859 - DNA, 25 bp, Mus musculus
caggcctcccgtgagaagcggagta

SEQ ID NO: 426860 - DNA, 25 bp, Mus musculus
agaagcggagtacttgtgctggacc

SEQ ID NO: 426861 - DNA, 25 bp, Mus musculus
gagctgagaagtccgtctgtctatc

SEQ ID NO: 426862 - DNA, 25 bp, Mus musculus
ccgtctgtctatcgggagacgagca

SEQ ID NO: 426863 - DNA, 25 bp, Mus musculus
cctccgggtatgtggccgcgtcctt

SEQ ID NO: 426864 - DNA, 25 bp, Mus musculus
gtccttcccttaccagcgctccacg

SEQ ID NO: 426865 - DNA, 25 bp, Mus musculus
tcgctttggccgctgcgtgctttgc

SEQ ID NO: 426866 - DNA, 25 bp, Mus musculus
cgtgctttgccctggttctctgagt

SEQ ID NO: 426867 - DNA, 25 bp, Mus musculus
aggtgctgtccaatcatcactcgga

SEQ ID NO: 426868 - DNA, 25 bp, Mus musculus
ctttgcattcgcagccgcgtccggt

SEQ ID NO: 426869 - DNA, 25 bp, Mus musculus
tgagttgcacgtacgccggccgtat

SEQ ID NO: 426870 - DNA, 25 bp, Mus musculus
cacgacgtgactgggtctccaagaa

SEQ ID NO: 426871 - DNA, 25 bp, Mus musculus
aatcacgctactggcccgcatcgga

SEQ ID NO: 426872 - DNA, 25 bp, Mus musculus
gcggaatagcggtcttcagccaatc

SEQ ID NO: 426873 - DNA, 25 bp, Mus musculus
agcgccagcatattggtatagtttg

SEQ ID NO: 426874 - DNA, 25 bp, Mus musculus
tggacaatgttcctgaaagacacgc

SEQ ID NO: 426875 - DNA, 25 bp, Mus musculus
ctccctgcgtcttcattggacaatg

SEQ ID NO: 426876 - DNA, 25 bp, Mus musculus
catatttctttgaagcgcgcgcctc

SEQ ID NO: 426877 - DNA, 25 bp, Mus musculus
tctccaagaagcgaagactgcggcg

SEQ ID NO: 426878 - DNA, 25 bp, Mus musculus
ggtgtatcacaagagtcacgacgtg

SEQ ID NO: 426879 - DNA, 25 bp, Mus musculus
cgcgcgcaatgaaacacggcacatc

SEQ ID NO: 426880 - DNA, 25 bp, Mus musculus
gtcccactccatggaggaggtaaga

SEQ ID NO: 426881 - DNA, 25 bp, Mus musculus
ggagaacccttccaccacctgagtg

SEQ ID NO: 426882 - DNA, 25 bp, Mus musculus
gtgacgccttcaccttagactcgga

SEQ ID NO: 426883 - DNA, 25 bp, Mus musculus
cggcgcgagagagtcgccatatttc

SEQ ID NO: 426884 - DNA, 25 bp, Mus musculus
ggttggtcacgtcccagcctcctga

SEQ ID NO: 426885 - DNA, 25 bp, Mus musculus
cacgcttccggttgtggtcccgcta

SEQ ID NO: 426886 - DNA, 25 bp, Mus musculus
tctcgcccggttcgccacgcttccg

SEQ ID NO: 426887 - DNA, 25 bp, Mus musculus
atagtccttctacttttctcgcccg

SEQ ID NO: 426888 - DNA, 25 bp, Mus musculus
ccgaatagtccttctacttttctcg

SEQ ID NO: 426889 - DNA, 25 bp, Mus musculus
gaaggttccgctcaccttctcagac

SEQ ID NO: 426890 - DNA, 25 bp, Mus musculus
cctatgagaaggttccgctcacctt

SEQ ID NO: 426891 - DNA, 25 bp, Mus musculus
tcccacctatgagaaggttccgctc

SEQ ID NO: 426892 - DNA, 25 bp, Mus musculus
tgcagttcccacctatgagaaggtt

SEQ ID NO: 426893 - DNA, 25 bp, Mus musculus
gtccctgcagttcccacctatgaga

SEQ ID NO: 426894 - DNA, 25 bp, Mus musculus
gccaggactcttcccgacctcctcg

SEQ ID NO: 426895 - DNA, 25 bp, Mus musculus
tcgaccctcacctcacccgccagga

SEQ ID NO: 426896 - DNA, 25 bp, Mus musculus
ctcctgaagctaggcgctcccgagg

SEQ ID NO: 426897 - DNA, 25 bp, Mus musculus
tgtggtcccgctacttttcctgtcc

SEQ ID NO: 426898 - DNA, 25 bp, Mus musculus
agctccggctcgtgaaggtaagaga

SEQ ID NO: 426899 - DNA, 25 bp, Mus musculus
cagattccggagatagatgcggccc

SEQ ID NO: 426900 - DNA, 25 bp, Mus musculus
ttcctccgtagaaagcttcagattc

SEQ ID NO: 426901 - DNA, 25 bp, Mus musculus
caggcgctctttcctgccggttttc

SEQ ID NO: 426902 - DNA, 25 bp, Mus musculus
aaggctctggatgggatcctgtccc

SEQ ID NO: 426903 - DNA, 25 bp, Mus musculus
tcgctgcaatctttggggccgaagc

SEQ ID NO: 426904 - DNA, 25 bp, Mus musculus
aagaaccggctttgcgcgaagaatc

SEQ ID NO: 426905 - DNA, 25 bp, Mus musculus
ggcttcggagacagagggacaactc

SEQ ID NO: 426906 - DNA, 25 bp, Mus musculus
ctctacctggacctctaaagccggg

SEQ ID NO: 426907 - DNA, 25 bp, Mus musculus
gcggcccttcatcgacttagcatct

SEQ ID NO: 426908 - DNA, 25 bp, Mus musculus
gaggaccgacctccgggtaatcaga

SEQ ID NO: 426909 - DNA, 25 bp, Mus musculus
gcaacgcattctctcactgggctcg

SEQ ID NO: 426910 - DNA, 25 bp, Mus musculus
ttggggttcaacctgacgtcctcta

SEQ ID NO: 426911 - DNA, 25 bp, Mus musculus
atgtcggagcgatcctggcatccag

SEQ ID NO: 426912 - DNA, 25 bp, Mus musculus
gggaccaccatggtaaagaagcgga

SEQ ID NO: 426913 - DNA, 25 bp, Mus musculus
ctgggcgagataggaagtatcgccc

SEQ ID NO: 426914 - DNA, 25 bp, Mus musculus
ccatggtaaagaagcggaaaggccg

SEQ ID NO: 426915 - DNA, 25 bp, Mus musculus
ccgtgtcgtgatcgactcggatacg

SEQ ID NO: 426916 - DNA, 25 bp, Mus musculus
gatcgactcggatacggaagacagc

SEQ ID NO: 426917 - DNA, 25 bp, Mus musculus
ctcggatacggaagacagcggcagt

SEQ ID NO: 426918 - DNA, 25 bp, Mus musculus
agcggcagtgacgagaacctggatc

SEQ ID NO: 426919 - DNA, 25 bp, Mus musculus
cagtgacgagaacctggatcaggtg

SEQ ID NO: 426920 - DNA, 25 bp, Mus musculus
gtgtccgtcccgctactgtagtccc

SEQ ID NO: 426921 - DNA, 25 bp, Mus musculus
cgctactgtagtcccttcctgtctc

SEQ ID NO: 426922 - DNA, 25 bp, Mus musculus
cccgctgaatcttaggcccttggag

SEQ ID NO: 426923 - DNA, 25 bp, Mus musculus
tcttaggcccttggagcccgggcca

SEQ ID NO: 426924 - DNA, 25 bp, Mus musculus
ggaaaggccgtgtcgtgatcgactc

SEQ ID NO: 426925 - DNA, 25 bp, Mus musculus
cgtcatgactgcaggcagggagatt

SEQ ID NO: 426926 - DNA, 25 bp, Mus musculus
aggacgatctgctgagcgacagtga

SEQ ID NO: 426927 - DNA, 25 bp, Mus musculus
tgcgcctgctcttcgaagcgcgctg

SEQ ID NO: 426928 - DNA, 25 bp, Mus musculus
ccggtgatccctcagctcactgtga

SEQ ID NO: 426929 - DNA, 25 bp, Mus musculus
ggagctcctggctctgctccggagc

SEQ ID NO: 426930 - DNA, 25 bp, Mus musculus
ctccggtgccgggagatgaccctgc

SEQ ID NO: 426931 - DNA, 25 bp, Mus musculus
cctcgtcgctgctcgaggactcgga

SEQ ID NO: 426932 - DNA, 25 bp, Mus musculus
ccgcggcaacgtgcagctggaaacc

SEQ ID NO: 426933 - DNA, 25 bp, Mus musculus
tgctctgctctgaccggcttgcgtt

SEQ ID NO: 426934 - DNA, 25 bp, Mus musculus
gtaactgagtgcctgggcgtctaaa

SEQ ID NO: 426935 - DNA, 25 bp, Mus musculus
ggctggcgtacctgggtaactgtca

SEQ ID NO: 426936 - DNA, 25 bp, Mus musculus
aaggggcgcgtgagcttttccctct

SEQ ID NO: 426937 - DNA, 25 bp, Mus musculus
gttgccacggtttccctctcttgag

SEQ ID NO: 426938 - DNA, 25 bp, Mus musculus
tccctctcttgagtgggagtggagc

SEQ ID NO: 426939 - DNA, 25 bp, Mus musculus
aactggctcccagctgcggggtcgc

SEQ ID NO: 426940 - DNA, 25 bp, Mus musculus
cctgctctaatctctgacacggaga

SEQ ID NO: 426941 - DNA, 25 bp, Mus musculus
actaggtactgaggcgaatgtcgcc

SEQ ID NO: 426942 - DNA, 25 bp, Mus musculus
cttggggcgactctagactaggtac

SEQ ID NO: 426943 - DNA, 25 bp, Mus musculus
cgtcctgacaccgtacgatccggta

SEQ ID NO: 426944 - DNA, 25 bp, Mus musculus
gtcctctgtgcctttcgtcctgaca

SEQ ID NO: 426945 - DNA, 25 bp, Mus musculus
gggctcagtcacgagtcctctgtgc

SEQ ID NO: 426946 - DNA, 25 bp, Mus musculus
acttcccgtcatcaggtgtaggtgc

SEQ ID NO: 426947 - DNA, 25 bp, Mus musculus
tggcactgtgactcagagacttgca

SEQ ID NO: 426948 - DNA, 25 bp, Mus musculus
tgtaacgactcgaagtggcactgtg

SEQ ID NO: 426949 - DNA, 25 bp, Mus musculus
ctggcatccctgcacactaggattg

SEQ ID NO: 426950 - DNA, 25 bp, Mus musculus
ctagacaccttgagaagagcgccga

SEQ ID NO: 426951 - DNA, 25 bp, Mus musculus
ggaggacctctgaagaacctgtacc

SEQ ID NO: 426952 - DNA, 25 bp, Mus musculus
aacctgtaccgtagatctgccactc

SEQ ID NO: 426953 - DNA, 25 bp, Mus musculus
cgcccaggttgcctagacaccttga

SEQ ID NO: 426954 - DNA, 25 bp, Mus musculus
cctttcggtcccataggtggttgca

SEQ ID NO: 426955 - DNA, 25 bp, Mus musculus
agcctgggatcctttcggtcccata

SEQ ID NO: 426956 - DNA, 25 bp, Mus musculus
ccggtgcacctacccggaagatgga

SEQ ID NO: 426957 - DNA, 25 bp, Mus musculus
gtcaggtcgcctccggtaggacctc

SEQ ID NO: 426958 - DNA, 25 bp, Mus musculus
acagcaagcgacgagcagtggcgtt

SEQ ID NO: 426959 - DNA, 25 bp, Mus musculus
tccacctgcgaagcgacagcaagcg

SEQ ID NO: 426960 - DNA, 25 bp, Mus musculus
ctctcccagacagacgagttggctc

SEQ ID NO: 426961 - DNA, 25 bp, Mus musculus
cctgggtggcaccaaggtgaaatgc

SEQ ID NO: 426962 - DNA, 25 bp, Mus musculus
aaatgctgcgtgaccagggactctc

SEQ ID NO: 426963 - DNA, 25 bp, Mus musculus
cttactccgggacaggcgtcctggc

SEQ ID NO: 426964 - DNA, 25 bp, Mus musculus
cccgcgacggaggaagaagactgct

SEQ ID NO: 426965 - DNA, 25 bp, Mus musculus
agatcctgcaggaggagagagcacc

SEQ ID NO: 426966 - DNA, 25 bp, Mus musculus
gcgtctcagtcctaggcgcctcggt

SEQ ID NO: 426967 - DNA, 25 bp, Mus musculus
agagagcaccggtccgcgtctcagt

SEQ ID NO: 426968 - DNA, 25 bp, Mus musculus
ttacacagacgctgggaacacacgc

SEQ ID NO: 426969 - DNA, 25 bp, Mus musculus
gcctgcggcgactaatctttcttta

SEQ ID NO: 426970 - DNA, 25 bp, Mus musculus
tggccgtgcggactggcacttccgc

SEQ ID NO: 426971 - DNA, 25 bp, Mus musculus
ccatcttggccgtgcggactggcac

SEQ ID NO: 426972 - DNA, 25 bp, Mus musculus
ttccgccgcctctagagttcggctt

SEQ ID NO: 426973 - DNA, 25 bp, Mus musculus
atctttctttacacagacgctggga

SEQ ID NO: 426974 - DNA, 25 bp, Mus musculus
ggagctcgagggctcccagctcagc

SEQ ID NO: 426975 - DNA, 25 bp, Mus musculus
ggctcccagctcagcgttgtgtctc

SEQ ID NO: 426976 - DNA, 25 bp, Mus musculus
cagctcagcgttgtgtctctgaacc

SEQ ID NO: 426977 - DNA, 25 bp, Mus musculus
ttgtgtctctgaacctcaagcggcg

SEQ ID NO: 426978 - DNA, 25 bp, Mus musculus
tctctgaacctcaagcggcgaagcc

SEQ ID NO: 426979 - DNA, 25 bp, Mus musculus
acctcaagcggcgaagcctgcggcg

SEQ ID NO: 426980 - DNA, 25 bp, Mus musculus
gcggcgactaatctttctttacaca

SEQ ID NO: 426981 - DNA, 25 bp, Mus musculus
tagagttcggcttccgccgagcagc

SEQ ID NO: 426982 - DNA, 25 bp, Mus musculus
aaggagcgcggtggcccagccgcag

SEQ ID NO: 426983 - DNA, 25 bp, Mus musculus
cccgctgcgccttctggaggtgggc

SEQ ID NO: 426984 - DNA, 25 bp, Mus musculus
cctgtccagggagcgaggcaggtcc

SEQ ID NO: 426985 - DNA, 25 bp, Mus musculus
ctgaggttagcgctcggctctcgcc

SEQ ID NO: 426986 - DNA, 25 bp, Mus musculus
gaggttagcgctcggctctcgccac

SEQ ID NO: 426987 - DNA, 25 bp, Mus musculus
cggcggctcgcagaagaacatgaat

SEQ ID NO: 426988 - DNA, 25 bp, Mus musculus
gcggctcgcagaagaacatgaatca

SEQ ID NO: 426989 - DNA, 25 bp, Mus musculus
aagaacatgaatcagcggcggcggc

SEQ ID NO: 426990 - DNA, 25 bp, Mus musculus
ggctggaaggccgagactaggacgc

SEQ ID NO: 426991 - DNA, 25 bp, Mus musculus
actcctcgctgctgacggcggtggc

SEQ ID NO: 426992 - DNA, 25 bp, Mus musculus
cgtcgccgccgatggcgctgaggcg

SEQ ID NO: 426993 - DNA, 25 bp, Mus musculus
tgctgctggcgggactggcttctct

SEQ ID NO: 426994 - DNA, 25 bp, Mus musculus
ctgagccgcacgactgaggggcgca

SEQ ID NO: 426995 - DNA, 25 bp, Mus musculus
tcgcagaagaacatgaatcagcggc

SEQ ID NO: 426996 - DNA, 25 bp, Mus musculus
taaagccggtaggtgtgagcgtcct

SEQ ID NO: 426997 - DNA, 25 bp, Mus musculus
cgcgtgaaggtcacatgacgaggtt

SEQ ID NO: 426998 - DNA, 25 bp, Mus musculus
tggctgctggaaacagtcgcctagc

SEQ ID NO: 426999 - DNA, 25 bp, Mus musculus
ctgagggcaagttctcggcaaaatg

SEQ ID NO: 427000 - DNA, 25 bp, Mus musculus
gcctggaaagtctggctgcgacatt

SEQ ID NO: 427001 - DNA, 25 bp, Mus musculus
cgggccctcactgtctttcgaagcg

SEQ ID NO: 427002 - DNA, 25 bp, Mus musculus
atagcctatcgcaggccgaggcgca

SEQ ID NO: 427003 - DNA, 25 bp, Mus musculus
cgtcacgtgcgcgacatagcctatc

SEQ ID NO: 427004 - DNA, 25 bp, Mus musculus
ttgagagtctgtcgtgggtattttc

SEQ ID NO: 427005 - DNA, 25 bp, Mus musculus
cagtatcgtgtactctgcgcgaggc

SEQ ID NO: 427006 - DNA, 25 bp, Mus musculus
cttcgagcaccgtgccaggtgatta

SEQ ID NO: 427007 - DNA, 25 bp, Mus musculus
tgcaagccactttcggtgccacttc

SEQ ID NO: 427008 - DNA, 25 bp, Mus musculus
cccttaatgggcagaaggaggtcta

SEQ ID NO: 427009 - DNA, 25 bp, Mus musculus
cggctcgcgagcctgtgatttcgag

SEQ ID NO: 427010 - DNA, 25 bp, Mus musculus
ttaagctgttctgtgcgctccgcca

SEQ ID NO: 427011 - DNA, 25 bp, Mus musculus
gagaatgcttctcatcctgcaccct

SEQ ID NO: 427012 - DNA, 25 bp, Mus musculus
tccctgggttccaaagggagcgcaa

SEQ ID NO: 427013 - DNA, 25 bp, Mus musculus
acccaggagatggacgcttgtcgtg

SEQ ID NO: 427014 - DNA, 25 bp, Mus musculus
cgcagaggagccttaccgaatggtt

SEQ ID NO: 427015 - DNA, 25 bp, Mus musculus
cggaacagcttcactttctgagcca

SEQ ID NO: 427016 - DNA, 25 bp, Mus musculus
tttctgagccacgaagtgcttcttc

SEQ ID NO: 427017 - DNA, 25 bp, Mus musculus
gtgcttcttcttcgtcttggtcttg

SEQ ID NO: 427018 - DNA, 25 bp, Mus musculus
ttgggcgctagcgtcatgacgcaga

SEQ ID NO: 427019 - DNA, 25 bp, Mus musculus
agcatgcctttctcgctcctgggga

SEQ ID NO: 427020 - DNA, 25 bp, Mus musculus
tccgccaccggtgctaagacgagca

SEQ ID NO: 427021 - DNA, 25 bp, Mus musculus
atgccggaccgttaagctgttctgt

SEQ ID NO: 427022 - DNA, 25 bp, Mus musculus
taagacgagcactctcctggcggcc

SEQ ID NO: 427023 - DNA, 25 bp, Mus musculus
cggagaggctcagaagcacagaaca

SEQ ID NO: 427024 - DNA, 25 bp, Mus musculus
tcgctcggagaactaactaggaaca

SEQ ID NO: 427025 - DNA, 25 bp, Mus musculus
ggaacccaagggtcctgacgctgct

SEQ ID NO: 427026 - DNA, 25 bp, Mus musculus
ggcaaagaggtgctgctcgcgcctc

SEQ ID NO: 427027 - DNA, 25 bp, Mus musculus
tcttcagctgaagcggacacacggt

SEQ ID NO: 427028 - DNA, 25 bp, Mus musculus
cacggtgtgcgaacccttcagaata

SEQ ID NO: 427029 - DNA, 25 bp, Mus musculus
actaggaacatcgacgccggagacc

SEQ ID NO: 427030 - DNA, 25 bp, Mus musculus
cttgtgtatttgaacggcttgccca

SEQ ID NO: 427031 - DNA, 25 bp, Mus musculus
tgaacagcatggcacgttccgcgtg

SEQ ID NO: 427032 - DNA, 25 bp, Mus musculus
acctcacttccgtgtcgctcggaga

SEQ ID NO: 427033 - DNA, 25 bp, Mus musculus
cccagcgttccgcagagagagcttc

SEQ ID NO: 427034 - DNA, 25 bp, Mus musculus
cttacgctgtgcagcctttggtccc

SEQ ID NO: 427035 - DNA, 25 bp, Mus musculus
tcccttgagcgagttgcgcatgtca

SEQ ID NO: 427036 - DNA, 25 bp, Mus musculus
tccgggctgtttggcctcctgatgt

SEQ ID NO: 427037 - DNA, 25 bp, Mus musculus
gcgtcgcttcaatagtggcccgatt

SEQ ID NO: 427038 - DNA, 25 bp, Mus musculus
cgtccaatcgggaaccaatctgcca

SEQ ID NO: 427039 - DNA, 25 bp, Mus musculus
aacggagctcccaagactcgggtgc

SEQ ID NO: 427040 - DNA, 25 bp, Mus musculus
tagtagggtttctgaagtaggcagt

SEQ ID NO: 427041 - DNA, 25 bp, Mus musculus
cgctgacgagtagtagggtttctga

SEQ ID NO: 427042 - DNA, 25 bp, Mus musculus
tgaagccgtcgatcgcgatgccgga

SEQ ID NO: 427043 - DNA, 25 bp, Mus musculus
cagcagagctgaagccgtcgatcgc

SEQ ID NO: 427044 - DNA, 25 bp, Mus musculus
ctgcggcagcagagctgaagccgtc

SEQ ID NO: 427045 - DNA, 25 bp, Mus musculus
gtgccaccatagctactgctgcggc

SEQ ID NO: 427046 - DNA, 25 bp, Mus musculus
ctggtgccaccatagctactgctgc

SEQ ID NO: 427047 - DNA, 25 bp, Mus musculus
cgttttgagccgctggtgccaccat

SEQ ID NO: 427048 - DNA, 25 bp, Mus musculus
ccaggctctagttcgcgttttgagc

SEQ ID NO: 427049 - DNA, 25 bp, Mus musculus
gctcggcccaggctctagttcgcgt

SEQ ID NO: 427050 - DNA, 25 bp, Mus musculus
gggaaccaatctgccacagaccgca

SEQ ID NO: 427051 - DNA, 25 bp, Mus musculus
gagcttctcgcatcggctcgggcca

SEQ ID NO: 427052 - DNA, 25 bp, Mus musculus
tcgggttctagaaaagatgactgcc

SEQ ID NO: 427053 - DNA, 25 bp, Mus musculus
ttctgtcctcgccttctgtcgatta

SEQ ID NO: 427054 - DNA, 25 bp, Mus musculus
tcgattatcaggtaagcgccgcagc

SEQ ID NO: 427055 - DNA, 25 bp, Mus musculus
ggcgcgtttctttctctgcgttctg

SEQ ID NO: 427056 - DNA, 25 bp, Mus musculus
tcccaatgtgggagctcgaagagtc

SEQ ID NO: 427057 - DNA, 25 bp, Mus musculus
agcgattctgacacggccttcactg

SEQ ID NO: 427058 - DNA, 25 bp, Mus musculus
tgattgccatcagccctaaggaagg

SEQ ID NO: 427059 - DNA, 25 bp, Mus musculus
agcgccgcagctctgaaatccagtc

SEQ ID NO: 427060 - DNA, 25 bp, Mus musculus
tggatctcagccttttgccgcaatg

SEQ ID NO: 427061 - DNA, 25 bp, Mus musculus
cgagcgaatgcgtgtatctatgagt

SEQ ID NO: 427062 - DNA, 25 bp, Mus musculus
ctgggcatcaatcaggcgcaacggc

SEQ ID NO: 427063 - DNA, 25 bp, Mus musculus
gggttgttctgtaatctggatctca

SEQ ID NO: 427064 - DNA, 25 bp, Mus musculus
gtccaggcgctgtcacgttagtcgc

SEQ ID NO: 427065 - DNA, 25 bp, Mus musculus
cggatttctctgctcctgattgcca

SEQ ID NO: 427066 - DNA, 25 bp, Mus musculus
gcgggttcttgtcccgcggccgtca

SEQ ID NO: 427067 - DNA, 25 bp, Mus musculus
agcagcgaccgcgcgaggacagcgc

SEQ ID NO: 427068 - DNA, 25 bp, Mus musculus
ttgcacctcctagagggcggaaacg

SEQ ID NO: 427069 - DNA, 25 bp, Mus musculus
tgcacctcctagagggcggaaacgg

SEQ ID NO: 427070 - DNA, 25 bp, Mus musculus
ggctgcgatcctggagcggaaatag

SEQ ID NO: 427071 - DNA, 25 bp, Mus musculus
atcctggagcggaaataggggcggg

SEQ ID NO: 427072 - DNA, 25 bp, Mus musculus
cgcggccgtcatggcggaggcggct

SEQ ID NO: 427073 - DNA, 25 bp, Mus musculus
ttcggagggcgttgcaagagttccc

SEQ ID NO: 427074 - DNA, 25 bp, Mus musculus
ggcgttgcaagagttcccggcggcg

SEQ ID NO: 427075 - DNA, 25 bp, Mus musculus
ggctcgcggtgagtgcactctcaca

SEQ ID NO: 427076 - DNA, 25 bp, Mus musculus
ctcgcggtgagtgcactctcacagg

SEQ ID NO: 427077 - DNA, 25 bp, Mus musculus
cgcggtgagtgcactctcacaggca

SEQ ID NO: 427078 - DNA, 25 bp, Mus musculus
aggcggctctggaggcagttcggag

SEQ ID NO: 427079 - DNA, 25 bp, Mus musculus
gcggtgagtgcactctcacaggcag

SEQ ID NO: 427080 - DNA, 25 bp, Mus musculus
cgactgggtggaagctctagccaat

SEQ ID NO: 427081 - DNA, 25 bp, Mus musculus
tagcgagccgacgaggcaaattacc

SEQ ID NO: 427082 - DNA, 25 bp, Mus musculus
gcatcggtctagagggctgatcccg

SEQ ID NO: 427083 - DNA, 25 bp, Mus musculus
ccgggtacatccttctggccaggtg

SEQ ID NO: 427084 - DNA, 25 bp, Mus musculus
ctagccaatggaaaggcgatccttg

SEQ ID NO: 427085 - DNA, 25 bp, Mus musculus
cctcattgggcgtttgccagcgact

SEQ ID NO: 427086 - DNA, 25 bp, Mus musculus
attcagcagcgatctcaggtccttc

SEQ ID NO: 427087 - DNA, 25 bp, Mus musculus
acgggcgcgcgctcattattcagca

SEQ ID NO: 427088 - DNA, 25 bp, Mus musculus
aatcatcagccgctgcgtcacgggc

SEQ ID NO: 427089 - DNA, 25 bp, Mus musculus
cggcagcaccttgcgctggtacaga

SEQ ID NO: 427090 - DNA, 25 bp, Mus musculus
ccagcaggatcatgggcttgttttc

SEQ ID NO: 427091 - DNA, 25 bp, Mus musculus
ttacctgatgaacgtggtcttgccc

SEQ ID NO: 427092 - DNA, 25 bp, Mus musculus
acgggccaccaagctcggagtgtaa

SEQ ID NO: 427093 - DNA, 25 bp, Mus musculus
ccttgaattattgatgacggcatcg

SEQ ID NO: 427094 - DNA, 25 bp, Mus musculus
ttccaggatcggcaccggctcgaaa

SEQ ID NO: 427095 - DNA, 25 bp, Mus musculus
aatggactgtccttagcaatcacgc

SEQ ID NO: 427096 - DNA, 25 bp, Mus musculus
cgcggagcgtccacaaatggactgt

SEQ ID NO: 427097 - DNA, 25 bp, Mus musculus
ttagcaatcacgcaagccgcccggg

SEQ ID NO: 427098 - DNA, 25 bp, Mus musculus
ggtcagacgccttgcctctctatag

SEQ ID NO: 427099 - DNA, 25 bp, Mus musculus
ctctctatagctcggcgtgaggggc

SEQ ID NO: 427100 - DNA, 25 bp, Mus musculus
cggctcgaaagcgtcatgcatggct

SEQ ID NO: 427101 - DNA, 25 bp, Mus musculus
atggctgcgggagcttcaccgccac

SEQ ID NO: 427102 - DNA, 25 bp, Mus musculus
tgccgtccgaaaacagggaagactc

SEQ ID NO: 427103 - DNA, 25 bp, Mus musculus
gaagactcgtattccaccagggacc

SEQ ID NO: 427104 - DNA, 25 bp, Mus musculus
gctacagggccttcagcaacaactc

SEQ ID NO: 427105 - DNA, 25 bp, Mus musculus
gccgccggacttcctgttgccttaa

SEQ ID NO: 427106 - DNA, 25 bp, Mus musculus
tgcaggggaagcttttccaggatcg

SEQ ID NO: 427107 - DNA, 25 bp, Mus musculus
caggcagccaggcagtcgatctgca

SEQ ID NO: 427108 - DNA, 25 bp, Mus musculus
ggagacacctgaagccacgcagcca

SEQ ID NO: 427109 - DNA, 25 bp, Mus musculus
ggaatgtgccacttcgatctatctg

SEQ ID NO: 427110 - DNA, 25 bp, Mus musculus
actcaccgacggcatcggaatgtgc

SEQ ID NO: 427111 - DNA, 25 bp, Mus musculus
tctatctgcagcaaacacgggtgcc

SEQ ID NO: 427112 - DNA, 25 bp, Mus musculus
aaacgataatgggaacggctgcgcc

SEQ ID NO: 427113 - DNA, 25 bp, Mus musculus
agaaactttgagtctactgcgcagg

SEQ ID NO: 427114 - DNA, 25 bp, Mus musculus
gccatgaagcgcctacccaaagtat

SEQ ID NO: 427115 - DNA, 25 bp, Mus musculus
cccaaagtattgagccttcttccgg

SEQ ID NO: 427116 - DNA, 25 bp, Mus musculus
ctcttccggcgctactttgtgggcg

SEQ ID NO: 427117 - DNA, 25 bp, Mus musculus
gcgctactttgtgggcgggattatc

SEQ ID NO: 427118 - DNA, 25 bp, Mus musculus
ggtccttgaaactgtgcttcttccc

SEQ ID NO: 427119 - DNA, 25 bp, Mus musculus
gtgcttcttcccacagacgctcaga

SEQ ID NO: 427120 - DNA, 25 bp, Mus musculus
aggcgtcctcctgtttccctgcgat

SEQ ID NO: 427121 - DNA, 25 bp, Mus musculus
gccggacctgcaccaagaaacgata

SEQ ID NO: 427122 - DNA, 25 bp, Mus musculus
taaacccacacaggtcagaaggggc

SEQ ID NO: 427123 - DNA, 25 bp, Mus musculus
cgcgcaggcgcacgcaactcagcac

SEQ ID NO: 427124 - DNA, 25 bp, Mus musculus
cgtccagtctgggttgcgaacagaa

SEQ ID NO: 427125 - DNA, 25 bp, Mus musculus
tgcgaacagaatcggattgcccttg

SEQ ID NO: 427126 - DNA, 25 bp, Mus musculus
attgcccttgctggaatctgtgccc

SEQ ID NO: 427127 - DNA, 25 bp, Mus musculus
cccttgctggaatctgtgcccagaa

SEQ ID NO: 427128 - DNA, 25 bp, Mus musculus
tgcccagaagccagacgcaccgctc

SEQ ID NO: 427129 - DNA, 25 bp, Mus musculus
gcaccgctcgccaataaaccctaaa

SEQ ID NO: 427130 - DNA, 25 bp, Mus musculus
gtggtcgcatgcaggcgcagctcca

SEQ ID NO: 427131 - DNA, 25 bp, Mus musculus
ggggcagaccctcgggctccgatac

SEQ ID NO: 427132 - DNA, 25 bp, Mus musculus
gccgcatcctccttactcacactca

SEQ ID NO: 427133 - DNA, 25 bp, Mus musculus
agcccgaccttcctacgccatctgg

SEQ ID NO: 427134 - DNA, 25 bp, Mus musculus
ctactaccaccatcgcgcaagcgcg

SEQ ID NO: 427135 - DNA, 25 bp, Mus musculus
catcgtagcgtggtcgcatgcaggc

SEQ ID NO: 427136 - DNA, 25 bp, Mus musculus
gagaagagagctccggccagtcctt

SEQ ID NO: 427137 - DNA, 25 bp, Mus musculus
agctccggccagtccttggtggatt

SEQ ID NO: 427138 - DNA, 25 bp, Mus musculus
tcagcgggacaggtaggatgatatc

SEQ ID NO: 427139 - DNA, 25 bp, Mus musculus
accttcagcctcacgatgtttctcg

SEQ ID NO: 427140 - DNA, 25 bp, Mus musculus
cctgcgtggcaggagatttaacacc

SEQ ID NO: 427141 - DNA, 25 bp, Mus musculus
atcgccaggcgttggcgaccagcgc

SEQ ID NO: 427142 - DNA, 25 bp, Mus musculus
tgatatcccaaggagaaaaagggtg

SEQ ID NO: 427143 - DNA, 25 bp, Mus musculus
ttctggaaagtagctgagggaacta

SEQ ID NO: 427144 - DNA, 25 bp, Mus musculus
tctagagtccgagaactgtggaggc

SEQ ID NO: 427145 - DNA, 25 bp, Mus musculus
ctgtccgatcttctagagtccgaga

SEQ ID NO: 427146 - DNA, 25 bp, Mus musculus
agggagcgcgcaccctgtccgatct

SEQ ID NO: 427147 - DNA, 25 bp, Mus musculus
tccagtggtagaggtgtgtctgccc

SEQ ID NO: 427148 - DNA, 25 bp, Mus musculus
tttaacaccctctccgcggcgattg

SEQ ID NO: 427149 - DNA, 25 bp, Mus musculus
gggtggttcggctcctcgtccctca

SEQ ID NO: 427150 - DNA, 25 bp, Mus musculus
ccacttggtagcttcgggcatagtc

SEQ ID NO: 427151 - DNA, 25 bp, Mus musculus
ctcctaccgctcagtgcaaagaaga

SEQ ID NO: 427152 - DNA, 25 bp, Mus musculus
tcgggcatagtcactaaggtacgtg

SEQ ID NO: 427153 - DNA, 25 bp, Mus musculus
ggcaggaacgccctgtgacatcatc

SEQ ID NO: 427154 - DNA, 25 bp, Mus musculus
gtgacatcatcaaaccgcgcgcctg

SEQ ID NO: 427155 - DNA, 25 bp, Mus musculus
accgcgcgcctgttcgcggtgttgc

SEQ ID NO: 427156 - DNA, 25 bp, Mus musculus
tcctcgcgccagttccagaggtgtg

SEQ ID NO: 427157 - DNA, 25 bp, Mus musculus
cagttccagaggtgtgcggaagcca

SEQ ID NO: 427158 - DNA, 25 bp, Mus musculus
gtgggacccagcgtcctcgcagact

SEQ ID NO: 427159 - DNA, 25 bp, Mus musculus
tagctgctgccggaacagggagctt

SEQ ID NO: 427160 - DNA, 25 bp, Mus musculus
tgggttactgctaaaccacttggta

SEQ ID NO: 427161 - DNA, 25 bp, Mus musculus
cagggagcttgagactcgcctccta

SEQ ID NO: 427162 - DNA, 25 bp, Mus musculus
ctcgcagactgcagctgggttactg

SEQ ID NO: 427163 - DNA, 25 bp, Mus musculus
gcaaagaagactccgccagggaaca

SEQ ID NO: 427164 - DNA, 25 bp, Mus musculus
cctagggcgaggcttgggctgcggt

SEQ ID NO: 427165 - DNA, 25 bp, Mus musculus
atggcgaatgtgcaggtggccgtga

SEQ ID NO: 427166 - DNA, 25 bp, Mus musculus
ttgtggcggagggatggcgaatgtg

SEQ ID NO: 427167 - DNA, 25 bp, Mus musculus
accgctgtgtgggtcttgggttgtg

SEQ ID NO: 427168 - DNA, 25 bp, Mus musculus
tccgccggaccgctgtgtgggtctt

SEQ ID NO: 427169 - DNA, 25 bp, Mus musculus
atgcttccgccggaccgctgtgtgg

SEQ ID NO: 427170 - DNA, 25 bp, Mus musculus
ctggacgccggccagggatgcttcc

SEQ ID NO: 427171 - DNA, 25 bp, Mus musculus
tggctgggtctgttcgctggacgcc

SEQ ID NO: 427172 - DNA, 25 bp, Mus musculus
gtgcctgtggctgggtctgttcgct

SEQ ID NO: 427173 - DNA, 25 bp, Mus musculus
ctgtggctcttgcagtgcctgtggc

SEQ ID NO: 427174 - DNA, 25 bp, Mus musculus
agtctgtggctcttgcagtgcctgt

SEQ ID NO: 427175 - DNA, 25 bp, Mus musculus
cagtctgtggctcttgcagtgcctg

SEQ ID NO: 427176 - DNA, 25 bp, Mus musculus
ggcagtctgtggctcttgcagtgcc

SEQ ID NO: 427177 - DNA, 25 bp, Mus musculus
tgagggtccggcctctcagcaagcg

SEQ ID NO: 427178 - DNA, 25 bp, Mus musculus
tctcgtggctttcggtttcacagtc

SEQ ID NO: 427179 - DNA, 25 bp, Mus musculus
gtggcagcgtcatggcgcgactgct

SEQ ID NO: 427180 - DNA, 25 bp, Mus musculus
cccgctgcctgagttgcggagcaga

SEQ ID NO: 427181 - DNA, 25 bp, Mus musculus
cctcctgtgaggtcctgagagactg

SEQ ID NO: 427182 - DNA, 25 bp, Mus musculus
gtggctttcggtttcacagtcctgg

SEQ ID NO: 427183 - DNA, 25 bp, Mus musculus
gtctctcgtggctttcggtttcaca

SEQ ID NO: 427184 - DNA, 25 bp, Mus musculus
cggcctcctgtgaggtcctgagaga

SEQ ID NO: 427185 - DNA, 25 bp, Mus musculus
tgccgtctctcgtggctttcggttt

SEQ ID NO: 427186 - DNA, 25 bp, Mus musculus
aatcgctgccgtctctcgtggcttt

SEQ ID NO: 427187 - DNA, 25 bp, Mus musculus
gtaggtcctcaatcgctgccgtctc

SEQ ID NO: 427188 - DNA, 25 bp, Mus musculus
gacacaggtaggtcctcaatcgctg

SEQ ID NO: 427189 - DNA, 25 bp, Mus musculus
aagcaaggacacaggtaggtcctca

SEQ ID NO: 427190 - DNA, 25 bp, Mus musculus
cctgagttgcggagcagagcaacgc

SEQ ID NO: 427191 - DNA, 25 bp, Mus musculus
tgcctttgctgcaggcgcctggacg

SEQ ID NO: 427192 - DNA, 25 bp, Mus musculus
gctctgaggctactgagcaggcgca

SEQ ID NO: 427193 - DNA, 25 bp, Mus musculus
ctgcctcgctggcaaggctgccgag

SEQ ID NO: 427194 - DNA, 25 bp, Mus musculus
ccatccctgtgcaggcgctctgagg

SEQ ID NO: 427195 - DNA, 25 bp, Mus musculus
cgcgcagcagcgactctaaaacggc

SEQ ID NO: 427196 - DNA, 25 bp, Mus musculus
gcgtgtccgcactgttacctccgaa

SEQ ID NO: 427197 - DNA, 25 bp, Mus musculus
gcacattccaggcaggcttgagggc

SEQ ID NO: 427198 - DNA, 25 bp, Mus musculus
ctgggagaagggactgaagcatcat

SEQ ID NO: 427199 - DNA, 25 bp, Mus musculus
ctcggagctatcctgaggaagaagc

SEQ ID NO: 427200 - DNA, 25 bp, Mus musculus
ctcagagcggccacctcggagctat

SEQ ID NO: 427201 - DNA, 25 bp, Mus musculus
ccgcagaggccgaagtgcgctcaga

SEQ ID NO: 427202 - DNA, 25 bp, Mus musculus
cggcacgaattccttccgcagaggc

SEQ ID NO: 427203 - DNA, 25 bp, Mus musculus
agttcagcaggaacggcacgaattc

SEQ ID NO: 427204 - DNA, 25 bp, Mus musculus
ctgctctgctccctcaggaagttca

SEQ ID NO: 427205 - DNA, 25 bp, Mus musculus
ggcccgggaagatctgcccagccag

SEQ ID NO: 427206 - DNA, 25 bp, Mus musculus
cgggtaagcagttttgagaccgatg

SEQ ID NO: 427207 - DNA, 25 bp, Mus musculus
cgtcgactgctcactcagattgatg

SEQ ID NO: 427208 - DNA, 25 bp, Mus musculus
ggccgaattgcccacgtcgactgct

SEQ ID NO: 427209 - DNA, 25 bp, Mus musculus
atgagcttcttaagggccgaattgc

SEQ ID NO: 427210 - DNA, 25 bp, Mus musculus
ggtggaacgccctctcccgatcaaa

SEQ ID NO: 427211 - DNA, 25 bp, Mus musculus
ttgagaccgatggatgagcttctta

SEQ ID NO: 427212 - DNA, 25 bp, Mus musculus
aggttcaaatactacccatccctcg

SEQ ID NO: 427213 - DNA, 25 bp, Mus musculus
tcgcgagcatctgaaagataggttc

SEQ ID NO: 427214 - DNA, 25 bp, Mus musculus
cgtacagtaagctcggtcttcgagg

SEQ ID NO: 427215 - DNA, 25 bp, Mus musculus
cgctgaatactggtgcgggtaagca

SEQ ID NO: 427216 - DNA, 25 bp, Mus musculus
tggttaattttaccgctgaatactg

SEQ ID NO: 427217 - DNA, 25 bp, Mus musculus
aagctcggtcttcgaggttttctgg

SEQ ID NO: 427218 - DNA, 25 bp, Mus musculus
ggcccgcctggcagaaatttcgcga

SEQ ID NO: 427219 - DNA, 25 bp, Mus musculus
ctcactcagattgatgtaggctggg

SEQ ID NO: 427220 - DNA, 25 bp, Mus musculus
acgcaggatctctgacggaggacga

SEQ ID NO: 427221 - DNA, 25 bp, Mus musculus
cgcctcagggcgtgggcataagaaa

SEQ ID NO: 427222 - DNA, 25 bp, Mus musculus
gcagggaagcttcttggagacgccc

SEQ ID NO: 427223 - DNA, 25 bp, Mus musculus
ccttcggatgccgtccgcgtctaaa

SEQ ID NO: 427224 - DNA, 25 bp, Mus musculus
gtcggttggctagtcccattgccta

SEQ ID NO: 427225 - DNA, 25 bp, Mus musculus
caccggagaattgccgctatcttca

SEQ ID NO: 427226 - DNA, 25 bp, Mus musculus
ttaccgggaaaggagcatcacaatg

SEQ ID NO: 427227 - DNA, 25 bp, Mus musculus
tcacaatgacagtgcgcgtgtgctt

SEQ ID NO: 427228 - DNA, 25 bp, Mus musculus
ggactcgtagttccagcctccgctg

SEQ ID NO: 427229 - DNA, 25 bp, Mus musculus
cggcctgtcctgaggagagatgtaa

SEQ ID NO: 427230 - DNA, 25 bp, Mus musculus
gccgacttcagtaggtgttctccta

SEQ ID NO: 427231 - DNA, 25 bp, Mus musculus
agctcagcgtgcttatggccacaga

SEQ ID NO: 427232 - DNA, 25 bp, Mus musculus
aatgctttgtcactgaggcggtcgc

SEQ ID NO: 427233 - DNA, 25 bp, Mus musculus
tccacgcctcggttgagctgaacga

SEQ ID NO: 427234 - DNA, 25 bp, Mus musculus
cgacagggacgacacttttacgacg

SEQ ID NO: 427235 - DNA, 25 bp, Mus musculus
gccgacctgccaagccggaggtttc

SEQ ID NO: 427236 - DNA, 25 bp, Mus musculus
aggctgccgacctgccaagccggag

SEQ ID NO: 427237 - DNA, 25 bp, Mus musculus
gcagcacccggagcggcttccggtc

SEQ ID NO: 427238 - DNA, 25 bp, Mus musculus
ccctgaagtcaggtttgtcgcagca

SEQ ID NO: 427239 - DNA, 25 bp, Mus musculus
gacgcgacagggacgacacttttac

SEQ ID NO: 427240 - DNA, 25 bp, Mus musculus
gcccgacgcgacagggacgacactt

SEQ ID NO: 427241 - DNA, 25 bp, Mus musculus
gctagcggaaacctgtggccggccc

SEQ ID NO: 427242 - DNA, 25 bp, Mus musculus
ggccgccagctagcggaaacctgtg

SEQ ID NO: 427243 - DNA, 25 bp, Mus musculus
tcgtccgccatcttaagggaaacga

SEQ ID NO: 427244 - DNA, 25 bp, Mus musculus
ctcttcgtccgccatcttaagggaa

SEQ ID NO: 427245 - DNA, 25 bp, Mus musculus
tcggcgccgtccatctcttcgtccg

SEQ ID NO: 427246 - DNA, 25 bp, Mus musculus
ctgacgtccatcctctcggcgccgt

SEQ ID NO: 427247 - DNA, 25 bp, Mus musculus
aagtcaggtttgtcgcagcacccgg

SEQ ID NO: 427248 - DNA, 25 bp, Mus musculus
gatactcactttgattctcacaagc

SEQ ID NO: 427249 - DNA, 25 bp, Mus musculus
ccctgctgttggagcactacggcct

SEQ ID NO: 427250 - DNA, 25 bp, Mus musculus
tttaagaggcgtcctgatactcact

SEQ ID NO: 427251 - DNA, 25 bp, Mus musculus
cgcccgtcgcatttgtactttaaga

SEQ ID NO: 427252 - DNA, 25 bp, Mus musculus
gggctcggaagccaacaacatcttc

SEQ ID NO: 427253 - DNA, 25 bp, Mus musculus
actacggcctggctgggccgactac

SEQ ID NO: 427254 - DNA, 25 bp, Mus musculus
tcactaggttgtcaaacgccgggca

SEQ ID NO: 427255 - DNA, 25 bp, Mus musculus
ttggctcttcctggtcctcactagg

SEQ ID NO: 427256 - DNA, 25 bp, Mus musculus
atgccagaccctggtggagccaggt

SEQ ID NO: 427257 - DNA, 25 bp, Mus musculus
cgcaccacggtcagggatgccagac

SEQ ID NO: 427258 - DNA, 25 bp, Mus musculus
ttacaggtgctgaggtcgcaccacg

SEQ ID NO: 427259 - DNA, 25 bp, Mus musculus
tgtcattaacttcgctttacaggtg

SEQ ID NO: 427260 - DNA, 25 bp, Mus musculus
cccgcacgcacgcaaggtgtcatta

SEQ ID NO: 427261 - DNA, 25 bp, Mus musculus
tgccgaagcccagaggctcccagag

SEQ ID NO: 427262 - DNA, 25 bp, Mus musculus
agagcctgcgatggcgagctcgaca

SEQ ID NO: 427263 - DNA, 25 bp, Mus musculus
tgccggaaacgagatgagtttttca

SEQ ID NO: 427264 - DNA, 25 bp, Mus musculus
gatgagtttttcagcaccggaagta

SEQ ID NO: 427265 - DNA, 25 bp, Mus musculus
ttcagcaccggaagtactgcggcgg

SEQ ID NO: 427266 - DNA, 25 bp, Mus musculus
ggggccaaatggcttaagcgtctta

SEQ ID NO: 427267 - DNA, 25 bp, Mus musculus
ttaagcgtcttagctggttcccaga

SEQ ID NO: 427268 - DNA, 25 bp, Mus musculus
acgcgctgtgtgttgccggaaacga

SEQ ID NO: 427269 - DNA, 25 bp, Mus musculus
atggcgagctcgacagccgcagtcc

SEQ ID NO: 427270 - DNA, 25 bp, Mus musculus
agcagctccggcacttagcagagga

SEQ ID NO: 427271 - DNA, 25 bp, Mus musculus
gctacggtcacttctgcctcgagta

SEQ ID NO: 427272 - DNA, 25 bp, Mus musculus
ctgcctcgagtacggggtgagttat

SEQ ID NO: 427273 - DNA, 25 bp, Mus musculus
tatgggaatctgcatcccgggctcc

SEQ ID NO: 427274 - DNA, 25 bp, Mus musculus
gcacttagcagaggagctacggtca

SEQ ID NO: 427275 - DNA, 25 bp, Mus musculus
ctggttcccagagagagcctgcgat

SEQ ID NO: 427276 - DNA, 25 bp, Mus musculus
gggccttcgtgtatatactcggtgc

SEQ ID NO: 427277 - DNA, 25 bp, Mus musculus
cgtgtatatactcggtgcccgctgc

SEQ ID NO: 427278 - DNA, 25 bp, Mus musculus
tatatactcggtgcccgctgcctca

SEQ ID NO: 427279 - DNA, 25 bp, Mus musculus
tgcctcagggccttcgtgtatgtac

SEQ ID NO: 427280 - DNA, 25 bp, Mus musculus
ccttcgtgtatgtactcggtgcccg

SEQ ID NO: 427281 - DNA, 25 bp, Mus musculus
tgtatgtactcggtgcccgctgcct

SEQ ID NO: 427282 - DNA, 25 bp, Mus musculus
tgcctcagggccttcgtgtatatac

SEQ ID NO: 427283 - DNA, 25 bp, Mus musculus
gcctcagggccttcgtgtatgtact

SEQ ID NO: 427284 - DNA, 25 bp, Mus musculus
gtatgtactcggtgcccgctgcctc

SEQ ID NO: 427285 - DNA, 25 bp, Mus musculus
gggccttcgtgtatgtactcggtgc

SEQ ID NO: 427286 - DNA, 25 bp, Mus musculus
cttcgtgtatatactcggtgcccgc

SEQ ID NO: 427287 - DNA, 25 bp, Mus musculus
gcctcagggccttcgtgtatatact

SEQ ID NO: 427288 - DNA, 25 bp, Mus musculus
ccttcgtgtatatactcggtgcccg

SEQ ID NO: 427289 - DNA, 25 bp, Mus musculus
ttcgtgtatgtactcggtgcccgct

SEQ ID NO: 427290 - DNA, 25 bp, Mus musculus
ccgccgctttcagacgaaaataaag

SEQ ID NO: 427291 - DNA, 25 bp, Mus musculus
tcatccgcttctgggtgcgtcactt

SEQ ID NO: 427292 - DNA, 25 bp, Mus musculus
gcgcacgtaatagccgcggtggata

SEQ ID NO: 427293 - DNA, 25 bp, Mus musculus
tagaactcgttcaggtccagggcgc

SEQ ID NO: 427294 - DNA, 25 bp, Mus musculus
ctgcaggcagtccagccagcttgaa

SEQ ID NO: 427295 - DNA, 25 bp, Mus musculus
tgggccttcacgacgggaaacagct

SEQ ID NO: 427296 - DNA, 25 bp, Mus musculus
acagctccaggccatgcaagggtga

SEQ ID NO: 427297 - DNA, 25 bp, Mus musculus
ccgctgaaagtgctgcagcatgatc

SEQ ID NO: 427298 - DNA, 25 bp, Mus musculus
cccggctgcatctgctcatagatca

SEQ ID NO: 427299 - DNA, 25 bp, Mus musculus
tcctaatcgctggagctcccgcagg

SEQ ID NO: 427300 - DNA, 25 bp, Mus musculus
gtagtccgcgctctcgaagcacaga

SEQ ID NO: 427301 - DNA, 25 bp, Mus musculus
gcccatgacgagaaggtgctcagca

SEQ ID NO: 427302 - DNA, 25 bp, Mus musculus
cccgatcttgaaaggaccggtctgc

SEQ ID NO: 427303 - DNA, 25 bp, Mus musculus
cgaagcacagagatgacgccgagtc

SEQ ID NO: 427304 - DNA, 25 bp, Mus musculus
ccgaaccaaagtcaagtgccgaaca

SEQ ID NO: 427305 - DNA, 25 bp, Mus musculus
cgaacactgggtctcttgctcgcgc

SEQ ID NO: 427306 - DNA, 25 bp, Mus musculus
tgggcttctaaattgaggtggacta

SEQ ID NO: 427307 - DNA, 25 bp, Mus musculus
ggtctcctgagaacgaggccgatgc

SEQ ID NO: 427308 - DNA, 25 bp, Mus musculus
tgggcttcgagcacagctccacagc

SEQ ID NO: 427309 - DNA, 25 bp, Mus musculus
agacgtcggcagtcggtcaaaatgc

SEQ ID NO: 427310 - DNA, 25 bp, Mus musculus
agaccctgccaaggcgtcctgagga

SEQ ID NO: 427311 - DNA, 25 bp, Mus musculus
tcagtcccgctctcaagccggaagt

SEQ ID NO: 427312 - DNA, 25 bp, Mus musculus
ggattcagggcaagagattccgctg

SEQ ID NO: 427313 - DNA, 25 bp, Mus musculus
aggtggtagatctagggactcccga

SEQ ID NO: 427314 - DNA, 25 bp, Mus musculus
tttcacctggaacaagcggagtggc

SEQ ID NO: 427315 - DNA, 25 bp, Mus musculus
tcccgagccgccctagaaatgattc

SEQ ID NO: 427316 - DNA, 25 bp, Mus musculus
cacgaactgctcttggccctgagtg

SEQ ID NO: 427317 - DNA, 25 bp, Mus musculus
tcgcgcctcccgaacgaagtaagaa

SEQ ID NO: 427318 - DNA, 25 bp, Mus musculus
gcctcgcgctggatctagaggtttc

SEQ ID NO: 427319 - DNA, 25 bp, Mus musculus
aacacggcggcgtgtttccatggta

SEQ ID NO: 427320 - DNA, 25 bp, Mus musculus
ccagcgtaagaaaaggaacacggcg

SEQ ID NO: 427321 - DNA, 25 bp, Mus musculus
aatcctatggatgataggtggctga

SEQ ID NO: 427322 - DNA, 25 bp, Mus musculus
tgtctgccactcaggaaatcctatg

SEQ ID NO: 427323 - DNA, 25 bp, Mus musculus
attcgctgctgttgtctgccactca

SEQ ID NO: 427324 - DNA, 25 bp, Mus musculus
atcggatcgcccattcgctgctgtt

SEQ ID NO: 427325 - DNA, 25 bp, Mus musculus
gtcacgcaatatcggatcgcccatt

SEQ ID NO: 427326 - DNA, 25 bp, Mus musculus
tctagaggtttctgcacgctgccca

SEQ ID NO: 427327 - DNA, 25 bp, Mus musculus
atcccggcgagaggtgcctcgcgct

SEQ ID NO: 427328 - DNA, 25 bp, Mus musculus
agcactacctggcatcccggcgaga

SEQ ID NO: 427329 - DNA, 25 bp, Mus musculus
agcccacggccctcatgcggcctca

SEQ ID NO: 427330 - DNA, 25 bp, Mus musculus
tgtttccatggtagcatggacgtcg

SEQ ID NO: 427331 - DNA, 25 bp, Mus musculus
cgtcacgtcacgcaatatcggatcg

SEQ ID NO: 427332 - DNA, 25 bp, Mus musculus
tcaacgcagacacagcctaactaga

SEQ ID NO: 427333 - DNA, 25 bp, Mus musculus
aggttggtaacctagaccctggcat

SEQ ID NO: 427334 - DNA, 25 bp, Mus musculus
ttggactccgccctcggctgggtct

SEQ ID NO: 427335 - DNA, 25 bp, Mus musculus
ggatgttgttctcgcgccttggact

SEQ ID NO: 427336 - DNA, 25 bp, Mus musculus
cagcctaactagatggatgttgttc

SEQ ID NO: 427337 - DNA, 25 bp, Mus musculus
ggaactgcctcccacactgtgctca

SEQ ID NO: 427338 - DNA, 25 bp, Mus musculus
tcgagagaagctgcggaactgcctc

SEQ ID NO: 427339 - DNA, 25 bp, Mus musculus
cccaaggttcgagagaagctgcgga

SEQ ID NO: 427340 - DNA, 25 bp, Mus musculus
gacagcgaagggcaagatggctccc

SEQ ID NO: 427341 - DNA, 25 bp, Mus musculus
gataattgccagatggagaccacga

SEQ ID NO: 427342 - DNA, 25 bp, Mus musculus
tagagacaacgataattgccagatg

SEQ ID NO: 427343 - DNA, 25 bp, Mus musculus
ctagaccctggcatgcagcgaggcg

SEQ ID NO: 427344 - DNA, 25 bp, Mus musculus
agcctgattgaccacgcccggagct

SEQ ID NO: 427345 - DNA, 25 bp, Mus musculus
actagatggatgttgttctcgcgcc

SEQ ID NO: 427346 - DNA, 25 bp, Mus musculus
ttcaattcacaaccggccgcgcttg

SEQ ID NO: 427347 - DNA, 25 bp, Mus musculus
ccatttaattagttctgggacagca

SEQ ID NO: 427348 - DNA, 25 bp, Mus musculus
tcccgaccacgagcggcacaagtgg

SEQ ID NO: 427349 - DNA, 25 bp, Mus musculus
acaagtggcgacattcccatggagc

SEQ ID NO: 427350 - DNA, 25 bp, Mus musculus
cgcagcttgccgtattcagtacggg

SEQ ID NO: 427351 - DNA, 25 bp, Mus musculus
gaccgggcgcctgacactaatagct

SEQ ID NO: 427352 - DNA, 25 bp, Mus musculus
acactaatagctcgcggctcaggta

SEQ ID NO: 427353 - DNA, 25 bp, Mus musculus
tgcgggcgccgcattcaattcacaa

SEQ ID NO: 427354 - DNA, 25 bp, Mus musculus
tgcaggtgtcgccttttgaaacagc

SEQ ID NO: 427355 - DNA, 25 bp, Mus musculus
tgttcactttctgaccgcgccacgg

SEQ ID NO: 427356 - DNA, 25 bp, Mus musculus
ggagctgattattcccttgcccaca

SEQ ID NO: 427357 - DNA, 25 bp, Mus musculus
gcacggtcctaaagcactgtcctgg

SEQ ID NO: 427358 - DNA, 25 bp, Mus musculus
ccacgggttttgtggcagcgcaaga

SEQ ID NO: 427359 - DNA, 25 bp, Mus musculus
ctgtcctgggtcgttcactacgttc

SEQ ID NO: 427360 - DNA, 25 bp, Mus musculus
tcgcttcgatcgaggtgaggctaac

SEQ ID NO: 427361 - DNA, 25 bp, Mus musculus
tgaggctaacctgaggcgctgatgc

SEQ ID NO: 427362 - DNA, 25 bp, Mus musculus
tgaggcgctgatgccgtcacattcc

SEQ ID NO: 427363 - DNA, 25 bp, Mus musculus
ggcggactgacacagcagagctaga

SEQ ID NO: 427364 - DNA, 25 bp, Mus musculus
acgtgagcgaagaactgtgtgtgca

SEQ ID NO: 427365 - DNA, 25 bp, Mus musculus
tctgcagccgccaaaccaaaaaata

SEQ ID NO: 427366 - DNA, 25 bp, Mus musculus
aggaagctccctgaccagtgacgcg

SEQ ID NO: 427367 - DNA, 25 bp, Mus musculus
ctctgtacactgcagcacacggctg

SEQ ID NO: 427368 - DNA, 25 bp, Mus musculus
gcacacggctggctgctagccctag

SEQ ID NO: 427369 - DNA, 25 bp, Mus musculus
tgaagaagctgctgcggccacacta

SEQ ID NO: 427370 - DNA, 25 bp, Mus musculus
gtgcctgatacgtgcggcagcgaca

SEQ ID NO: 427371 - DNA, 25 bp, Mus musculus
cagggccaaccgtgctctgagacgg

SEQ ID NO: 427372 - DNA, 25 bp, Mus musculus
tctgcgcctctgtttgcggaaaccg

SEQ ID NO: 427373 - DNA, 25 bp, Mus musculus
cctttaatctgaagcggagggagaa

SEQ ID NO: 427374 - DNA, 25 bp, Mus musculus
cgcagcggacgcagctagcctaaca

SEQ ID NO: 427375 - DNA, 25 bp, Mus musculus
tcggcgatatcggtacagagagtca

SEQ ID NO: 427376 - DNA, 25 bp, Mus musculus
cttgctcatcgtgatcggcgatatc

SEQ ID NO: 427377 - DNA, 25 bp, Mus musculus
cggaaatactccttgctcatcgtga

SEQ ID NO: 427378 - DNA, 25 bp, Mus musculus
tgccatggagacaactccggagctg

SEQ ID NO: 427379 - DNA, 25 bp, Mus musculus
tttccatggcgaccgaagccgggac

SEQ ID NO: 427380 - DNA, 25 bp, Mus musculus
gctagcctaacactccgcgggagtt

SEQ ID NO: 427381 - DNA, 25 bp, Mus musculus
ggcctttaagaaccgcgcgcactct

SEQ ID NO: 427382 - DNA, 25 bp, Mus musculus
agtgaccaatgaacggctcctgccg

SEQ ID NO: 427383 - DNA, 25 bp, Mus musculus
ccctagaaggcagtgaccaatgaac

SEQ ID NO: 427384 - DNA, 25 bp, Mus musculus
ctgggacctgcggaaatactccttg

SEQ ID NO: 427385 - DNA, 25 bp, Mus musculus
agcctctttgcgaggccggtgccgc

SEQ ID NO: 427386 - DNA, 25 bp, Mus musculus
cagaacccggcggagcctctttgcg

SEQ ID NO: 427387 - DNA, 25 bp, Mus musculus
acactccgcgggagtttccatggcg

SEQ ID NO: 427388 - DNA, 25 bp, Mus musculus
gaccggatgtttgcatggctgaccc

SEQ ID NO: 427389 - DNA, 25 bp, Mus musculus
tgtagatcgaacatcccgggcccta

SEQ ID NO: 427390 - DNA, 25 bp, Mus musculus
agggcctgtagatcgaacatcccgg

SEQ ID NO: 427391 - DNA, 25 bp, Mus musculus
gcaaagggcctgtagatcgaacatc

SEQ ID NO: 427392 - DNA, 25 bp, Mus musculus
actcctggcaaagggcctgtagatc

SEQ ID NO: 427393 - DNA, 25 bp, Mus musculus
ggtcacctactcctggcaaagggcc

SEQ ID NO: 427394 - DNA, 25 bp, Mus musculus
tcggcgtctggatattcggggaaaa

SEQ ID NO: 427395 - DNA, 25 bp, Mus musculus
ctcctgctcggcgtctggatattcg

SEQ ID NO: 427396 - DNA, 25 bp, Mus musculus
tgcatctcctgctcggcgtctggat

SEQ ID NO: 427397 - DNA, 25 bp, Mus musculus
tggacgggccaagcctgcatctcct

SEQ ID NO: 427398 - DNA, 25 bp, Mus musculus
aggtgcagggacgacctggccgtaa

SEQ ID NO: 427399 - DNA, 25 bp, Mus musculus
ttgagagactacgggaaaaggtgca

SEQ ID NO: 427400 - DNA, 25 bp, Mus musculus
ctcagctcagagtctgggagagttg

SEQ ID NO: 427401 - DNA, 25 bp, Mus musculus
ccgaccggatgtttgcatggctgac

SEQ ID NO: 427402 - DNA, 25 bp, Mus musculus
ggcgcgcaccggcaacagtcaggct

SEQ ID NO: 427403 - DNA, 25 bp, Mus musculus
tctcggcgccgggtcacgaatcccg

SEQ ID NO: 427404 - DNA, 25 bp, Mus musculus
cccatccagactgcactcgcttctg

SEQ ID NO: 427405 - DNA, 25 bp, Mus musculus
tcgctctccctacgctgacattgag

SEQ ID NO: 427406 - DNA, 25 bp, Mus musculus
tacgctgacattgaggcctcccggc

SEQ ID NO: 427407 - DNA, 25 bp, Mus musculus
tgacattgaggcctcccggctgcgc

SEQ ID NO: 427408 - DNA, 25 bp, Mus musculus
ggctgcgccactccgaagctgtccc

SEQ ID NO: 427409 - DNA, 25 bp, Mus musculus
tgccggcagcgacacctgacagcgg

SEQ ID NO: 427410 - DNA, 25 bp, Mus musculus
gcgacacctgacagcggcccaatca

SEQ ID NO: 427411 - DNA, 25 bp, Mus musculus
cggcccaatcaaagcgcgacttctt

SEQ ID NO: 427412 - DNA, 25 bp, Mus musculus
ttgcggtcccgccaatccgcagagg

SEQ ID NO: 427413 - DNA, 25 bp, Mus musculus
gcaccggcaacagtcaggctgcgtt

SEQ ID NO: 427414 - DNA, 25 bp, Mus musculus
cggcaacagtcaggctgcgttggcc

SEQ ID NO: 427415 - DNA, 25 bp, Mus musculus
aaagcgcgacttctttgcggtcccg

SEQ ID NO: 427416 - DNA, 25 bp, Mus musculus
caatcggcggctgccacactgcggg

SEQ ID NO: 427417 - DNA, 25 bp, Mus musculus
gcagatccggaaagcagaaagccta

SEQ ID NO: 427418 - DNA, 25 bp, Mus musculus
tgcctcattgccagtcggtggggaa

SEQ ID NO: 427419 - DNA, 25 bp, Mus musculus
ctccactatctagcaggcctggctg

SEQ ID NO: 427420 - DNA, 25 bp, Mus musculus
ccctggtgaggccactttgcgggat

SEQ ID NO: 427421 - DNA, 25 bp, Mus musculus
cggggctcatgctagtcgagttctt

SEQ ID NO: 427422 - DNA, 25 bp, Mus musculus
agagtcgcgtctccgacacgggctc

SEQ ID NO: 427423 - DNA, 25 bp, Mus musculus
cgaaaacttcgagagtcgcgtctcc

SEQ ID NO: 427424 - DNA, 25 bp, Mus musculus
tggaactgacggacgaaaacttcga

SEQ ID NO: 427425 - DNA, 25 bp, Mus musculus
agattgcgggctctcccatctcatt

SEQ ID NO: 427426 - DNA, 25 bp, Mus musculus
cgacgctgcgtgacgcagccaatcg

SEQ ID NO: 427427 - DNA, 25 bp, Mus musculus
cagaaagcctaaactccagggtagg

SEQ ID NO: 427428 - DNA, 25 bp, Mus musculus
cgccaatcggcagttaccagctgtt

SEQ ID NO: 427429 - DNA, 25 bp, Mus musculus
gccgcctccgatgtgttggaactga

SEQ ID NO: 427430 - DNA, 25 bp, Mus musculus
cctagtttctacaggctgggaccca

SEQ ID NO: 427431 - DNA, 25 bp, Mus musculus
gcgtggcaccgcactccacgtgttt

SEQ ID NO: 427432 - DNA, 25 bp, Mus musculus
ctgcccaatgaaagcgggcgcccgg

SEQ ID NO: 427433 - DNA, 25 bp, Mus musculus
cgtgagtgctgggaccttttcctct

SEQ ID NO: 427434 - DNA, 25 bp, Mus musculus
acgtgacccggcctagtttctacag

SEQ ID NO: 427435 - DNA, 25 bp, Mus musculus
tttagggagcgctctccagctgcct

SEQ ID NO: 427436 - DNA, 25 bp, Mus musculus
gctccggcgtctcactttgtacctt

SEQ ID NO: 427437 - DNA, 25 bp, Mus musculus
tgtaccttctcttcttcttaggcgg

SEQ ID NO: 427438 - DNA, 25 bp, Mus musculus
cttaggcggtaaccagcgagagctc

SEQ ID NO: 427439 - DNA, 25 bp, Mus musculus
ctcgcccgccagaagaacatgaaga

SEQ ID NO: 427440 - DNA, 25 bp, Mus musculus
catgaagaagcagagcgactcggtt

SEQ ID NO: 427441 - DNA, 25 bp, Mus musculus
actgtcccacatgaggtcactttgc

SEQ ID NO: 427442 - DNA, 25 bp, Mus musculus
tcactttgcctagtcacgtgcccgg

SEQ ID NO: 427443 - DNA, 25 bp, Mus musculus
gccgtcgccatgacccgtgagtgct

SEQ ID NO: 427444 - DNA, 25 bp, Mus musculus
acttctgagtcgctctctcccacta

SEQ ID NO: 427445 - DNA, 25 bp, Mus musculus
acgatctttctgtgtcgagccaatc

SEQ ID NO: 427446 - DNA, 25 bp, Mus musculus
ctcactgctgtcttctcgttccagg

SEQ ID NO: 427447 - DNA, 25 bp, Mus musculus
gctgacgcatcatgccacggcgccg

SEQ ID NO: 427448 - DNA, 25 bp, Mus musculus
atcttcactgatgcggttctgtaac

SEQ ID NO: 427449 - DNA, 25 bp, Mus musculus
gtgtcgagccaatcgctcttccaca

SEQ ID NO: 427450 - DNA, 25 bp, Mus musculus
tgcggttctgtaaccgccgaagtcg

SEQ ID NO: 427451 - DNA, 25 bp, Mus musculus
tcaggttccacgatctttctgtgtc

SEQ ID NO: 427452 - DNA, 25 bp, Mus musculus
ccactacttcaggttccacgatctt

SEQ ID NO: 427453 - DNA, 25 bp, Mus musculus
gtcttctcgttccaggcgccaagca

SEQ ID NO: 427454 - DNA, 25 bp, Mus musculus
tttcttcatcgtcaatctcttcctc

SEQ ID NO: 427455 - DNA, 25 bp, Mus musculus
gcgccgctcaatttcttcatcgtca

SEQ ID NO: 427456 - DNA, 25 bp, Mus musculus
acggcgccgctcaatttcttcatcg

SEQ ID NO: 427457 - DNA, 25 bp, Mus musculus
ttccacatcttcactgatgcggttc

SEQ ID NO: 427458 - DNA, 25 bp, Mus musculus
ctagggtgagatttgcgcgcctttc

SEQ ID NO: 427459 - DNA, 25 bp, Mus musculus
tttgcgcgcctttcgagcaagtttc

SEQ ID NO: 427460 - DNA, 25 bp, Mus musculus
gcggggactctccaaaacggactca

SEQ ID NO: 427461 - DNA, 25 bp, Mus musculus
tcgcttaaagggctagggtgagatt

SEQ ID NO: 427462 - DNA, 25 bp, Mus musculus
ctgagcgcggatcgcttaaagggct

SEQ ID NO: 427463 - DNA, 25 bp, Mus musculus
accagaagtacataacagaggattg

SEQ ID NO: 427464 - DNA, 25 bp, Mus musculus
ggggtagaggaaccagaagtacata

SEQ ID NO: 427465 - DNA, 25 bp, Mus musculus
ctgacagaaacaacttccggtaggg

SEQ ID NO: 427466 - DNA, 25 bp, Mus musculus
cacacagctgcgcaactgacagaaa

SEQ ID NO: 427467 - DNA, 25 bp, Mus musculus
cgaaagccctgtcccacaggctgtg

SEQ ID NO: 427468 - DNA, 25 bp, Mus musculus
cgaaaagcaaggagccgaaagccct

SEQ ID NO: 427469 - DNA, 25 bp, Mus musculus
ggactcaatcccaacaacgaaaagc

SEQ ID NO: 427470 - DNA, 25 bp, Mus musculus
tcatgagtgcgcttgggaccgacat

SEQ ID NO: 427471 - DNA, 25 bp, Mus musculus
ctttcgagcaagtttcccgccttcg

SEQ ID NO: 427472 - DNA, 25 bp, Mus musculus
caggtgtactcgctgtcgtccagca

SEQ ID NO: 427473 - DNA, 25 bp, Mus musculus
tgacctggatggtgcaggtgtactc

SEQ ID NO: 427474 - DNA, 25 bp, Mus musculus
tgcagctgtactcgcgctccagact

SEQ ID NO: 427475 - DNA, 25 bp, Mus musculus
gaaccgattagcaggaggaagatcc

SEQ ID NO: 427476 - DNA, 25 bp, Mus musculus
ggaggaagatccaatcagaataagg

SEQ ID NO: 427477 - DNA, 25 bp, Mus musculus
cgggcggaggaagcaatcatcgcaa

SEQ ID NO: 427478 - DNA, 25 bp, Mus musculus
tcatcgcaaaacagcagtagtgagc

SEQ ID NO: 427479 - DNA, 25 bp, Mus musculus
cagtagtgagcccagtcgggccagc

SEQ ID NO: 427480 - DNA, 25 bp, Mus musculus
ccaacttggccgagtctggggagcc

SEQ ID NO: 427481 - DNA, 25 bp, Mus musculus
cgtggtaccagtgcccggctgagct

SEQ ID NO: 427482 - DNA, 25 bp, Mus musculus
ccgctggctgaagaagccgagaccc

SEQ ID NO: 427483 - DNA, 25 bp, Mus musculus
aggtgctgcctatccgctggctgaa

SEQ ID NO: 427484 - DNA, 25 bp, Mus musculus
ctagctcaggatgcccgcccaaggt

SEQ ID NO: 427485 - DNA, 25 bp, Mus musculus
tccagcagccgcacggtgcagctgt

SEQ ID NO: 427486 - DNA, 25 bp, Mus musculus
ggtattaatattcgcccgccggcga

SEQ ID NO: 427487 - DNA, 25 bp, Mus musculus
atcgaccagaaggaggccgattacg

SEQ ID NO: 427488 - DNA, 25 bp, Mus musculus
cgccggcgattgctgtatgccgtca

SEQ ID NO: 427489 - DNA, 25 bp, Mus musculus
ggtggacacgcataagaagcagatc

SEQ ID NO: 427490 - DNA, 25 bp, Mus musculus
tgacaaggtaaggtcgagccctttc

SEQ ID NO: 427491 - DNA, 25 bp, Mus musculus
gtcgtccttgccttcaactactgga

SEQ ID NO: 427492 - DNA, 25 bp, Mus musculus
tcggacctcttgctcttggtggaca

SEQ ID NO: 427493 - DNA, 25 bp, Mus musculus
cccgccacgttctgcttcaggagga

SEQ ID NO: 427494 - DNA, 25 bp, Mus musculus
ctactggtagtcatcgtcgtccttg

SEQ ID NO: 427495 - DNA, 25 bp, Mus musculus
agccaccggcctcatggtgggtttc

SEQ ID NO: 427496 - DNA, 25 bp, Mus musculus
gcgtcggcggaaacgagctaatgcc

SEQ ID NO: 427497 - DNA, 25 bp, Mus musculus
agaagcccactatctcgcgagaaga

SEQ ID NO: 427498 - DNA, 25 bp, Mus musculus
tccagagaaccctcgcgagacaaga

SEQ ID NO: 427499 - DNA, 25 bp, Mus musculus
cttggagaagcgcaattcggacctc

SEQ ID NO: 427500 - DNA, 25 bp, Mus musculus
gcaattcgcgagtaccattggctga

SEQ ID NO: 427501 - DNA, 25 bp, Mus musculus
cccaggccctatggccacccgtcgc

SEQ ID NO: 427502 - DNA, 25 bp, Mus musculus
agctctacaggaccgcggggcccat

SEQ ID NO: 427503 - DNA, 25 bp, Mus musculus
gggcccatatcccagcgagctcgag

SEQ ID NO: 427504 - DNA, 25 bp, Mus musculus
atatcccagcgagctcgagtccgcg

SEQ ID NO: 427505 - DNA, 25 bp, Mus musculus
aagcccgtggccgttgaccgactcg

SEQ ID NO: 427506 - DNA, 25 bp, Mus musculus
ccgttgaccgactcgcctcaggagg

SEQ ID NO: 427507 - DNA, 25 bp, Mus musculus
cgcgtcctcagaccggccgccttca

SEQ ID NO: 427508 - DNA, 25 bp, Mus musculus
gggcagcagtgccaacggcagctcc

SEQ ID NO: 427509 - DNA, 25 bp, Mus musculus
gcacggctcaaccaagcctagagtg

SEQ ID NO: 427510 - DNA, 25 bp, Mus musculus
gcgggcaagcttccgccctcctctg

SEQ ID NO: 427511 - DNA, 25 bp, Mus musculus
cattgggccgccgagggcaattcgc

SEQ ID NO: 427512 - DNA, 25 bp, Mus musculus
ccgagggcaattcgcgagtaccatt

SEQ ID NO: 427513 - DNA, 25 bp, Mus musculus
taccattggctgagagtggacgtcc

SEQ ID NO: 427514 - DNA, 25 bp, Mus musculus
cccagcacatgtgttatgattccca

SEQ ID NO: 427515 - DNA, 25 bp, Mus musculus
aaggagctctttatggtacattacc

SEQ ID NO: 427516 - DNA, 25 bp, Mus musculus
gtacattaccagtcaagggctcagg

SEQ ID NO: 427517 - DNA, 25 bp, Mus musculus
tcaagggctcaggtaccagcgcctt

SEQ ID NO: 427518 - DNA, 25 bp, Mus musculus
taccagcgccttgtgtcggggagcc

SEQ ID NO: 427519 - DNA, 25 bp, Mus musculus
ctgtgctgcaggtgtctgctgtaca

SEQ ID NO: 427520 - DNA, 25 bp, Mus musculus
ctgctgtacagtacgcccgccgagg

SEQ ID NO: 427521 - DNA, 25 bp, Mus musculus
ggtttgtacacacggtgacctccgc

SEQ ID NO: 427522 - DNA, 25 bp, Mus musculus
ttcgttccactcacagtactctgtg

SEQ ID NO: 427523 - DNA, 25 bp, Mus musculus
gacctccgcgctctgactctgaaag

SEQ ID NO: 427524 - DNA, 25 bp, Mus musculus
tgcaggacatagaggggtttgtaca

SEQ ID NO: 427525 - DNA, 25 bp, Mus musculus
attcccacggactggcgtgctctgc

SEQ ID NO: 427526 - DNA, 25 bp, Mus musculus
cacagtactctgtgaaccgacggcg

SEQ ID NO: 427527 - DNA, 25 bp, Mus musculus
gctctgactctgaaagggcctgaaa

SEQ ID NO: 427528 - DNA, 25 bp, Mus musculus
gtcgtcacagtgaaggtaattccct

SEQ ID NO: 427529 - DNA, 25 bp, Mus musculus
gtaattcccttggtccagacgctgc

SEQ ID NO: 427530 - DNA, 25 bp, Mus musculus
ctcagcggttccagcaacgtccgta

SEQ ID NO: 427531 - DNA, 25 bp, Mus musculus
acgtccgtaggcatgcactgttggc

SEQ ID NO: 427532 - DNA, 25 bp, Mus musculus
gctgagtccagtctaactcctcggg

SEQ ID NO: 427533 - DNA, 25 bp, Mus musculus
tgttggcgccttgtacgtccactgt

SEQ ID NO: 427534 - DNA, 25 bp, Mus musculus
gccggagcccgaagacacttttctg

SEQ ID NO: 427535 - DNA, 25 bp, Mus musculus
acctattgcgcagtcgggaccatcg

SEQ ID NO: 427536 - DNA, 25 bp, Mus musculus
agcgggaaagacaccacctattgcg

SEQ ID NO: 427537 - DNA, 25 bp, Mus musculus
cttcagcctcttcacggtagtaaaa

SEQ ID NO: 427538 - DNA, 25 bp, Mus musculus
tccctaaggcggcagaaacttcagc

SEQ ID NO: 427539 - DNA, 25 bp, Mus musculus
ttcgctctggtgagttccctaaggc

SEQ ID NO: 427540 - DNA, 25 bp, Mus musculus
ctcctcgggccctaagctcattttt

SEQ ID NO: 427541 - DNA, 25 bp, Mus musculus
gaagctcagtcctctctcagggccg

SEQ ID NO: 427542 - DNA, 25 bp, Mus musculus
tatcttcgcagtccagaacctctca

SEQ ID NO: 427543 - DNA, 25 bp, Mus musculus
gctctctggcctggaacctaactgg

SEQ ID NO: 427544 - DNA, 25 bp, Mus musculus
agtatacttccatctccgtgcccga

SEQ ID NO: 427545 - DNA, 25 bp, Mus musculus
tccgtgcccgaatgctaggaggcca

SEQ ID NO: 427546 - DNA, 25 bp, Mus musculus
ggccacgggatatctgccctgtcca

SEQ ID NO: 427547 - DNA, 25 bp, Mus musculus
cggctcacgatcagccagcactaga

SEQ ID NO: 427548 - DNA, 25 bp, Mus musculus
tagaagacccactcgctagccgagc

SEQ ID NO: 427549 - DNA, 25 bp, Mus musculus
actcagactcttggggtgagcagaa

SEQ ID NO: 427550 - DNA, 25 bp, Mus musculus
gtgagcagaagttccggcccaaatg

SEQ ID NO: 427551 - DNA, 25 bp, Mus musculus
ttccggcccaaatgcgggctgtggc

SEQ ID NO: 427552 - DNA, 25 bp, Mus musculus
ctcttccgtagacgcggacacgttc

SEQ ID NO: 427553 - DNA, 25 bp, Mus musculus
tcggcccacgtgctatcttcgcagt

SEQ ID NO: 427554 - DNA, 25 bp, Mus musculus
acctaactggagacgagaagtgaca

SEQ ID NO: 427555 - DNA, 25 bp, Mus musculus
aacgcgactcgctctcttccgtaga

SEQ ID NO: 427556 - DNA, 25 bp, Mus musculus
ctgggatccgcaccagcagcatggg

SEQ ID NO: 427557 - DNA, 25 bp, Mus musculus
acctgcgcagtgattcggaccttgt

SEQ ID NO: 427558 - DNA, 25 bp, Mus musculus
cggaccttgtgactctcacgagaga

SEQ ID NO: 427559 - DNA, 25 bp, Mus musculus
aatgcgtcacggacctgcgcagtga

SEQ ID NO: 427560 - DNA, 25 bp, Mus musculus
aggcgcccgaatgcgtcacggacct

SEQ ID NO: 427561 - DNA, 25 bp, Mus musculus
tccttccggtagaggcgcccgaatg

SEQ ID NO: 427562 - DNA, 25 bp, Mus musculus
ttgtgactctcacgagagaggcggt

SEQ ID NO: 427563 - DNA, 25 bp, Mus musculus
agccatcttggcctgggcggtcctt

SEQ ID NO: 427564 - DNA, 25 bp, Mus musculus
gcagcatgggcaggacccgctccat

SEQ ID NO: 427565 - DNA, 25 bp, Mus musculus
ggagactgcccgcagccgtcaggct

SEQ ID NO: 427566 - DNA, 25 bp, Mus musculus
agggcctccagctctcggtgcagct

SEQ ID NO: 427567 - DNA, 25 bp, Mus musculus
cggcgccaaggaaagcacttggaga

SEQ ID NO: 427568 - DNA, 25 bp, Mus musculus
aagcacttggagactgcccgcagcc

SEQ ID NO: 427569 - DNA, 25 bp, Mus musculus
gaggcagcacttccgggccctggct

SEQ ID NO: 427570 - DNA, 25 bp, Mus musculus
ggctgctttctctctttactctggc

SEQ ID NO: 427571 - DNA, 25 bp, Mus musculus
cccgcgcttcgccttctctaggctc

SEQ ID NO: 427572 - DNA, 25 bp, Mus musculus
aacttgctgttcgaggggtgctagc

SEQ ID NO: 427573 - DNA, 25 bp, Mus musculus
tgcagcagcgcactgttcccgttag

SEQ ID NO: 427574 - DNA, 25 bp, Mus musculus
ctccagacccttggcggttggacga

SEQ ID NO: 427575 - DNA, 25 bp, Mus musculus
cgcctcctggctgtcaagtgcgcag

SEQ ID NO: 427576 - DNA, 25 bp, Mus musculus
ctaagtctgagtgaagtctcgtccc

SEQ ID NO: 427577 - DNA, 25 bp, Mus musculus
ctttactctggcttgctaagtctga

SEQ ID NO: 427578 - DNA, 25 bp, Mus musculus
ctccgtaggctgctttctctcttta

SEQ ID NO: 427579 - DNA, 25 bp, Mus musculus
cttaaacttgctgttcgaggggtgc

SEQ ID NO: 427580 - DNA, 25 bp, Mus musculus
gctccacctcagacttaaacttgct

SEQ ID NO: 427581 - DNA, 25 bp, Mus musculus
ttagtaacacaaaacacccgcgctc

SEQ ID NO: 427582 - DNA, 25 bp, Mus musculus
cagcgcactgttcccgttagtaaca

SEQ ID NO: 427583 - DNA, 25 bp, Mus musculus
gttggacgagcagaaccaccagctc

SEQ ID NO: 427584 - DNA, 25 bp, Mus musculus
aggcatgccgccagcttcagcgtac

SEQ ID NO: 427585 - DNA, 25 bp, Mus musculus
ttgctgcccacgctcctataaaagg

SEQ ID NO: 427586 - DNA, 25 bp, Mus musculus
tcgctgcctgcgaacagttctcgaa

SEQ ID NO: 427587 - DNA, 25 bp, Mus musculus
ttttatcactcatcccagctcgctg

SEQ ID NO: 427588 - DNA, 25 bp, Mus musculus
cgcagggctcggactttttatcact

SEQ ID NO: 427589 - DNA, 25 bp, Mus musculus
gatcacgcctctgcgcttcttagga

SEQ ID NO: 427590 - DNA, 25 bp, Mus musculus
ggtctgcgtttctttgtgaacactg

SEQ ID NO: 427591 - DNA, 25 bp, Mus musculus
aggaccctgctacctggtttggacg

SEQ ID NO: 427592 - DNA, 25 bp, Mus musculus
gtttgcatgacctcaaccagacagg

SEQ ID NO: 427593 - DNA, 25 bp, Mus musculus
ttcagttatttgcatgtctccgccc

SEQ ID NO: 427594 - DNA, 25 bp, Mus musculus
cggtcgagttaaggacaggatttca

SEQ ID NO: 427595 - DNA, 25 bp, Mus musculus
tcgcgccaccgctagcaggtgtgaa

SEQ ID NO: 427596 - DNA, 25 bp, Mus musculus
tctcgaacttcttgcaggatgactg

SEQ ID NO: 427597 - DNA, 25 bp, Mus musculus
ttcgctcttcgtcctgcctagcagg

SEQ ID NO: 427598 - DNA, 25 bp, Mus musculus
tcacgctggccaccggtgagtaccg

SEQ ID NO: 427599 - DNA, 25 bp, Mus musculus
tcacgctcttcggtgtcttcgcctt

SEQ ID NO: 427600 - DNA, 25 bp, Mus musculus
gccaatgcgctgctctccatgcccg

SEQ ID NO: 427601 - DNA, 25 bp, Mus musculus
accgacggatgcttacctggtggtg

SEQ ID NO: 427602 - DNA, 25 bp, Mus musculus
aggcctggctttgctcaccaccggt

SEQ ID NO: 427603 - DNA, 25 bp, Mus musculus
accggtgccttcacgctcttcggtg

SEQ ID NO: 427604 - DNA, 25 bp, Mus musculus
cccactctacggaggcctggctttg

SEQ ID NO: 427605 - DNA, 25 bp, Mus musculus
gtgtcttcgccttcgcctcgatttc

SEQ ID NO: 427606 - DNA, 25 bp, Mus musculus
cgatttccagcgtgccgctctgcca

SEQ ID NO: 427607 - DNA, 25 bp, Mus musculus
tccgccgtcctcacgccttactacg

SEQ ID NO: 427608 - DNA, 25 bp, Mus musculus
ttactacggcgcctccttttggctc

SEQ ID NO: 427609 - DNA, 25 bp, Mus musculus
ggcgcctccttttggctcacgctgg

SEQ ID NO: 427610 - DNA, 25 bp, Mus musculus
ccggtgagtaccgacggatgcttac

SEQ ID NO: 427611 - DNA, 25 bp, Mus musculus
tggctttgctcaccaccggtgcctt

SEQ ID NO: 427612 - DNA, 25 bp, Mus musculus
aaccgctcgctgctggcgggaagcc

SEQ ID NO: 427613 - DNA, 25 bp, Mus musculus
gcgtcggctccagcctcaatttata

SEQ ID NO: 427614 - DNA, 25 bp, Mus musculus
cggaaagtgcttttcgcaggcggcc

SEQ ID NO: 427615 - DNA, 25 bp, Mus musculus
ctcaatttatagtcgggctcgctcc

SEQ ID NO: 427616 - DNA, 25 bp, Mus musculus
agtggatgctcggaaagtgcttttc

SEQ ID NO: 427617 - DNA, 25 bp, Mus musculus
ttggtcaaaggaagcgagtggatgc

SEQ ID NO: 427618 - DNA, 25 bp, Mus musculus
ggcgcgctgcctctttgtctctcgg

SEQ ID NO: 427619 - DNA, 25 bp, Mus musculus
ggccaccagagggagctaagggaaa

SEQ ID NO: 427620 - DNA, 25 bp, Mus musculus
cacagaacctgtctgtggagcagcg

SEQ ID NO: 427621 - DNA, 25 bp, Mus musculus
ccgagggcgtctggctcccacagaa

SEQ ID NO: 427622 - DNA, 25 bp, Mus musculus
cgcagctctgcctggccgagcctct

SEQ ID NO: 427623 - DNA, 25 bp, Mus musculus
cagacaaaccgctcgctgctggcgg

SEQ ID NO: 427624 - DNA, 25 bp, Mus musculus
gtctggctcccacagaacctgtctg

SEQ ID NO: 427625 - DNA, 25 bp, Mus musculus
agcctggcgcgctgcctctttgtct

SEQ ID NO: 427626 - DNA, 25 bp, Mus musculus
agcttatgtcaactagaaatactga

SEQ ID NO: 427627 - DNA, 25 bp, Mus musculus
gctcagtagcatggggccctcccaa

SEQ ID NO: 427628 - DNA, 25 bp, Mus musculus
agctccgctcagtagcatggggccc

SEQ ID NO: 427629 - DNA, 25 bp, Mus musculus
gagcccgtaggaggagctccgctca

SEQ ID NO: 427630 - DNA, 25 bp, Mus musculus
aggtgctcccgcagccactttgcga

SEQ ID NO: 427631 - DNA, 25 bp, Mus musculus
ctcgaagtcgcggtctcgctgcagc

SEQ ID NO: 427632 - DNA, 25 bp, Mus musculus
ggtctcgacccgaatgaggcggtgc

SEQ ID NO: 427633 - DNA, 25 bp, Mus musculus
agcactcaccctgtcgctgctggca

SEQ ID NO: 427634 - DNA, 25 bp, Mus musculus
tgagtcccagccaagccacctttgt

SEQ ID NO: 427635 - DNA, 25 bp, Mus musculus
ctagaaatactgactgcgaaaggct

SEQ ID NO: 427636 - DNA, 25 bp, Mus musculus
gtcagggactaagcttatgtcaact

SEQ ID NO: 427637 - DNA, 25 bp, Mus musculus
cccgtgtcagggactaagcttatgt

SEQ ID NO: 427638 - DNA, 25 bp, Mus musculus
tagcatggggccctcccaactgagc

SEQ ID NO: 427639 - DNA, 25 bp, Mus musculus
actgactgcgaaaggctgagtccca

SEQ ID NO: 427640 - DNA, 25 bp, Mus musculus
acgcgggctgagaccgacccgctga

SEQ ID NO: 427641 - DNA, 25 bp, Mus musculus
agcccagcccagagttgtgtgaccc

SEQ ID NO: 427642 - DNA, 25 bp, Mus musculus
agagttgtgtgaccctcactgctca

SEQ ID NO: 427643 - DNA, 25 bp, Mus musculus
agcagccgcagatgcgccgcagagc

SEQ ID NO: 427644 - DNA, 25 bp, Mus musculus
cctgggttgggcactgtcgactccc

SEQ ID NO: 427645 - DNA, 25 bp, Mus musculus
accaatgggcttggggtctgcccgc

SEQ ID NO: 427646 - DNA, 25 bp, Mus musculus
ccaccacgacggaccaatgggcttg

SEQ ID NO: 427647 - DNA, 25 bp, Mus musculus
gccaggcgcggcttcactatgacct

SEQ ID NO: 427648 - DNA, 25 bp, Mus musculus
ggcttcactatgacctccgggcgcg

SEQ ID NO: 427649 - DNA, 25 bp, Mus musculus
gggcctgagcattgagcggaactaa

SEQ ID NO: 427650 - DNA, 25 bp, Mus musculus
ctcttgctctgccagccagtgcaaa

SEQ ID NO: 427651 - DNA, 25 bp, Mus musculus
ccagccagtgcaaaagacaggaaca

SEQ ID NO: 427652 - DNA, 25 bp, Mus musculus
attggccgacgcctctagccctggg

SEQ ID NO: 427653 - DNA, 25 bp, Mus musculus
ctggctcctacctgggttgggcact

SEQ ID NO: 427654 - DNA, 25 bp, Mus musculus
gggtcccgcagaaccgcgttacatg

SEQ ID NO: 427655 - DNA, 25 bp, Mus musculus
cgccagtcccgacggaaaacgagtg

SEQ ID NO: 427656 - DNA, 25 bp, Mus musculus
cgttacatggcggaacctaggtctg

SEQ ID NO: 427657 - DNA, 25 bp, Mus musculus
ggccacgcccaaagagcaaccggta

SEQ ID NO: 427658 - DNA, 25 bp, Mus musculus
aggaagtgtctcttctcagccacgc

SEQ ID NO: 427659 - DNA, 25 bp, Mus musculus
ggaaactgttgggttggatccaata

SEQ ID NO: 427660 - DNA, 25 bp, Mus musculus
tggccggaaattaccgagtgctacc

SEQ ID NO: 427661 - DNA, 25 bp, Mus musculus
ctgccgagctcttccgagcgagaca

SEQ ID NO: 427662 - DNA, 25 bp, Mus musculus
gctcatttaaactcaccagcgaccg

SEQ ID NO: 427663 - DNA, 25 bp, Mus musculus
agcaccgtcatccttgaggctcaga

SEQ ID NO: 427664 - DNA, 25 bp, Mus musculus
gacaggttcctgcagcaccgtcatc

SEQ ID NO: 427665 - DNA, 25 bp, Mus musculus
gggctagcattacctggacaggttc

SEQ ID NO: 427666 - DNA, 25 bp, Mus musculus
tgttcgctttgcgacccaggcttgg

SEQ ID NO: 427667 - DNA, 25 bp, Mus musculus
cagcaggccgcgaactcgctgttcg

SEQ ID NO: 427668 - DNA, 25 bp, Mus musculus
tcccgaggcagcgtagggactcacc

SEQ ID NO: 427669 - DNA, 25 bp, Mus musculus
tgcctcccgtactggctcaggtcag

SEQ ID NO: 427670 - DNA, 25 bp, Mus musculus
gcgctgcttttgtagccgcgcccag

SEQ ID NO: 427671 - DNA, 25 bp, Mus musculus
acaaggtcctagtcgccaagctcgc

SEQ ID NO: 427672 - DNA, 25 bp, Mus musculus
tgctgctccgcgtgcacaaggtcct

SEQ ID NO: 427673 - DNA, 25 bp, Mus musculus
gcgcagacaccgcacccgtagcatc

SEQ ID NO: 427674 - DNA, 25 bp, Mus musculus
gccgatgtagtgcaccgcctcggca

SEQ ID NO: 427675 - DNA, 25 bp, Mus musculus
agggactcacccgagagccgatgta

SEQ ID NO: 427676 - DNA, 25 bp, Mus musculus
tcctgcatcccgcagaggtcccgag

SEQ ID NO: 427677 - DNA, 25 bp, Mus musculus
gggtgtccagtctccctctgggtcc

SEQ ID NO: 427678 - DNA, 25 bp, Mus musculus
cagaccacgccaccctgttaccggg

SEQ ID NO: 427679 - DNA, 25 bp, Mus musculus
cacgggctacggaacacagaccacg

SEQ ID NO: 427680 - DNA, 25 bp, Mus musculus
gccctcacgggctacggaacacaga

SEQ ID NO: 427681 - DNA, 25 bp, Mus musculus
acccgagagccgatgtagtgcaccg

SEQ ID NO: 427682 - DNA, 25 bp, Mus musculus
gctgagggacctacccgaattgcca

SEQ ID NO: 427683 - DNA, 25 bp, Mus musculus
ctgcgcttggccataggctacatta

SEQ ID NO: 427684 - DNA, 25 bp, Mus musculus
cacgcgcctgtggatgtagttataa

SEQ ID NO: 427685 - DNA, 25 bp, Mus musculus
ttataagaatcctcgcgtgccggcc

SEQ ID NO: 427686 - DNA, 25 bp, Mus musculus
gggtactatccctctccagtgccag

SEQ ID NO: 427687 - DNA, 25 bp, Mus musculus
tgccacggatcactcacaaagcgtc

SEQ ID NO: 427688 - DNA, 25 bp, Mus musculus
tggacgccgtactcctggagcactt

SEQ ID NO: 427689 - DNA, 25 bp, Mus musculus
cccttactttgatgaggaagatttc

SEQ ID NO: 427690 - DNA, 25 bp, Mus musculus
ggaagatttcttcaccgaccagtcc

SEQ ID NO: 427691 - DNA, 25 bp, Mus musculus
agtagagttcctcagccaccagcta

SEQ ID NO: 427692 - DNA, 25 bp, Mus musculus
acgaatactgctaccgcgacggggc

SEQ ID NO: 427693 - DNA, 25 bp, Mus musculus
agcccgaggacaacgtcagctattg

SEQ ID NO: 427694 - DNA, 25 bp, Mus musculus
cagcagctgcgacaagccgctaatg

SEQ ID NO: 427695 - DNA, 25 bp, Mus musculus
tcagctccagcaagcgggtactatc

SEQ ID NO: 427696 - DNA, 25 bp, Mus musculus
gcgggtgggtcacaccgcatacccg

SEQ ID NO: 427697 - DNA, 25 bp, Mus musculus
atacccgcatcacgctcagtgacaa

SEQ ID NO: 427698 - DNA, 25 bp, Mus musculus
cttcctggacgaagtggatgccctg

SEQ ID NO: 427699 - DNA, 25 bp, Mus musculus
atcttccaacgagcccaggagctgg

SEQ ID NO: 427700 - DNA, 25 bp, Mus musculus
aacgtgcggcgcatcttccaacgag

SEQ ID NO: 427701 - DNA, 25 bp, Mus musculus
caagacccagttagtgcgggccgtg

SEQ ID NO: 427702 - DNA, 25 bp, Mus musculus
cccgacggacaacttttgaagctgc

SEQ ID NO: 427703 - DNA, 25 bp, Mus musculus
tgtcgcagctctgcacgtgatgggc

SEQ ID NO: 427704 - DNA, 25 bp, Mus musculus
caaccggcctgtgtctcggggacac

SEQ ID NO: 427705 - DNA, 25 bp, Mus musculus
aggtagtgcacgagctgctgcgcaa

SEQ ID NO: 427706 - DNA, 25 bp, Mus musculus
gtatggactgcttgcaacccgtgcc

SEQ ID NO: 427707 - DNA, 25 bp, Mus musculus
ctttgtgcagctggacccgcagtgc

SEQ ID NO: 427708 - DNA, 25 bp, Mus musculus
gctcgccgctgaggatctcgttgcc

SEQ ID NO: 427709 - DNA, 25 bp, Mus musculus
tcagtgacaagcctccgccacaggt

SEQ ID NO: 427710 - DNA, 25 bp, Mus musculus
gccgctcgcttctgggcgttaacat

SEQ ID NO: 427711 - DNA, 25 bp, Mus musculus
atggtcgaccgcaggtaaggaccgc

SEQ ID NO: 427712 - DNA, 25 bp, Mus musculus
accgcaggtaaggaccgcggtcagc

SEQ ID NO: 427713 - DNA, 25 bp, Mus musculus
gtcagcggccgtgctgcactatcgt

SEQ ID NO: 427714 - DNA, 25 bp, Mus musculus
gtgctgcactatcgtcctgcagggg

SEQ ID NO: 427715 - DNA, 25 bp, Mus musculus
cacgtgagttgactcagtgcgacgc

SEQ ID NO: 427716 - DNA, 25 bp, Mus musculus
tgactcagtgcgacgcggtcggatc

SEQ ID NO: 427717 - DNA, 25 bp, Mus musculus
ggctgcatataagggccgctcgctt

SEQ ID NO: 427718 - DNA, 25 bp, Mus musculus
gtcgcccggctttctgcgactgttg

SEQ ID NO: 427719 - DNA, 25 bp, Mus musculus
cgcttctgggcgttaacatctcctg

SEQ ID NO: 427720 - DNA, 25 bp, Mus musculus
tgggcgttaacatctcctggccgca

SEQ ID NO: 427721 - DNA, 25 bp, Mus musculus
gcgtctcctttctgaaaagttctgt

SEQ ID NO: 427722 - DNA, 25 bp, Mus musculus
tcctttctgaaaagttctgtggagc

SEQ ID NO: 427723 - DNA, 25 bp, Mus musculus
cggttggctgcatataagggccgct

SEQ ID NO: 427724 - DNA, 25 bp, Mus musculus
tcgtcggccaccacgactcgaagtt

SEQ ID NO: 427725 - DNA, 25 bp, Mus musculus
gcccatcgtgaggagaacgagaccc

SEQ ID NO: 427726 - DNA, 25 bp, Mus musculus
gcgtccctgcccatcgtgaggagaa

SEQ ID NO: 427727 - DNA, 25 bp, Mus musculus
ctctgaggtcttgtgcgctctgagc

SEQ ID NO: 427728 - DNA, 25 bp, Mus musculus
atttgaggcgcttccacgcgccggg

SEQ ID NO: 427729 - DNA, 25 bp, Mus musculus
tcagcagggatttgaggcgcttcca

SEQ ID NO: 427730 - DNA, 25 bp, Mus musculus
gcgtgtcgtctttcctcagcaggga

SEQ ID NO: 427731 - DNA, 25 bp, Mus musculus
catttaagaacagcggcgtgtcgtc

SEQ ID NO: 427732 - DNA, 25 bp, Mus musculus
cgaaggcgctggtgtcatttaagaa

SEQ ID NO: 427733 - DNA, 25 bp, Mus musculus
cctcgtccgagaagtcgaaggcgct

SEQ ID NO: 427734 - DNA, 25 bp, Mus musculus
tcgtcgctcacctcgtccgagaagt

SEQ ID NO: 427735 - DNA, 25 bp, Mus musculus
tcgaagtttattaaagcgcgaaagc

SEQ ID NO: 427736 - DNA, 25 bp, Mus musculus
ggccaccacgactcgaagtttatta

SEQ ID NO: 427737 - DNA, 25 bp, Mus musculus
ctttccggggcttccgagtcatcgt

SEQ ID NO: 427738 - DNA, 25 bp, Mus musculus
ggttatggcgacatccggtcctcta

SEQ ID NO: 427739 - DNA, 25 bp, Mus musculus
gtcccgcgaggaaacgcactgttgg

SEQ ID NO: 427740 - DNA, 25 bp, Mus musculus
gcctagagcatcctggccaggcaac

SEQ ID NO: 427741 - DNA, 25 bp, Mus musculus
ccacgccgggtacggctgttttgcg

SEQ ID NO: 427742 - DNA, 25 bp, Mus musculus
ttacggggccttccgacagcctgga

SEQ ID NO: 427743 - DNA, 25 bp, Mus musculus
atatgagtgttcctgagccaccgcc

SEQ ID NO: 427744 - DNA, 25 bp, Mus musculus
cacgcagcgcccagtgcggggatat

SEQ ID NO: 427745 - DNA, 25 bp, Mus musculus
ggtttctttgcctgtgacttctcca

SEQ ID NO: 427746 - DNA, 25 bp, Mus musculus
ctctggaacgcgttaggtttctttg

SEQ ID NO: 427747 - DNA, 25 bp, Mus musculus
ggctttcgtccggatggactctgga

SEQ ID NO: 427748 - DNA, 25 bp, Mus musculus
ttcgtcacttccgtgtgcctcggcg

SEQ ID NO: 427749 - DNA, 25 bp, Mus musculus
ttctgcgtcggaaagcgaggttttc

SEQ ID NO: 427750 - DNA, 25 bp, Mus musculus
gttccggacttgcagtaacgttctg

SEQ ID NO: 427751 - DNA, 25 bp, Mus musculus
acggctgcgcctagggcgctgacac

SEQ ID NO: 427752 - DNA, 25 bp, Mus musculus
gtgcctgctccaaggtgcgcattcc

SEQ ID NO: 427753 - DNA, 25 bp, Mus musculus
gctgtcgcccacctcggttctgtct

SEQ ID NO: 427754 - DNA, 25 bp, Mus musculus
gttaccctcctatagccgctcgctg

SEQ ID NO: 427755 - DNA, 25 bp, Mus musculus
taagacgcaccccacgacgctgtta

SEQ ID NO: 427756 - DNA, 25 bp, Mus musculus
acggtgtcgctcagcccggtaagac

SEQ ID NO: 427757 - DNA, 25 bp, Mus musculus
agtagtttctgctgcgccagcgctg

SEQ ID NO: 427758 - DNA, 25 bp, Mus musculus
ttgggtagcgccctggcggcctttc

SEQ ID NO: 427759 - DNA, 25 bp, Mus musculus
cggtgtccgtgcctgctccaaggtg

SEQ ID NO: 427760 - DNA, 25 bp, Mus musculus
gggagcaaggatcacccataccacc

SEQ ID NO: 427761 - DNA, 25 bp, Mus musculus
caggacatggggagcaaggatcacc

SEQ ID NO: 427762 - DNA, 25 bp, Mus musculus
taagaaaagcgtctaggctgcgtgg

SEQ ID NO: 427763 - DNA, 25 bp, Mus musculus
cccaggcgtaagaaaagcgtctagg

SEQ ID NO: 427764 - DNA, 25 bp, Mus musculus
ttctgagtagaggtggccttgtctg

SEQ ID NO: 427765 - DNA, 25 bp, Mus musculus
cgctccagcgccacagtagtttctg

SEQ ID NO: 427766 - DNA, 25 bp, Mus musculus
aagtgtcaaagaggcaggagtggag

SEQ ID NO: 427767 - DNA, 25 bp, Mus musculus
agtaaccggtgaagtgtcaaagagg

SEQ ID NO: 427768 - DNA, 25 bp, Mus musculus
gtgaagtgtcaaagaggcaggagtg

SEQ ID NO: 427769 - DNA, 25 bp, Mus musculus
ccggtgaagtgtcaaagaggcagga

SEQ ID NO: 427770 - DNA, 25 bp, Mus musculus
aaccggtgaagtgtcaaagaggcag

SEQ ID NO: 427771 - DNA, 25 bp, Mus musculus
taaccggtgaagtgtcaaagaggca

SEQ ID NO: 427772 - DNA, 25 bp, Mus musculus
gtaaccggtgaagtgtcaaagaggc

SEQ ID NO: 427773 - DNA, 25 bp, Mus musculus
gagtaaccggtgaagtgtcaaagag

SEQ ID NO: 427774 - DNA, 25 bp, Mus musculus
ggagtaaccggtgaagtgtcaaaga

SEQ ID NO: 427775 - DNA, 25 bp, Mus musculus
cggagtaaccggtgaagtgtcaaag

SEQ ID NO: 427776 - DNA, 25 bp, Mus musculus
gcggagtaaccggtgaagtgtcaaa

SEQ ID NO: 427777 - DNA, 25 bp, Mus musculus
gcgcagaagcacgtgggctaagggg

SEQ ID NO: 427778 - DNA, 25 bp, Mus musculus
gcgagcgcagaagcacgtgggctaa

SEQ ID NO: 427779 - DNA, 25 bp, Mus musculus
gagcgcagaagcacgtgggctaagg

SEQ ID NO: 427780 - DNA, 25 bp, Mus musculus
cagctgagcggctactagggtgtcc

SEQ ID NO: 427781 - DNA, 25 bp, Mus musculus
cctggtgcgttgacagcgcgcagct

SEQ ID NO: 427782 - DNA, 25 bp, Mus musculus
ctactagggtgtcccgggctcgcca

SEQ ID NO: 427783 - DNA, 25 bp, Mus musculus
gccaagtgcccagctccaagctgtg

SEQ ID NO: 427784 - DNA, 25 bp, Mus musculus
caagctgtgccagcgacctcgcggg

SEQ ID NO: 427785 - DNA, 25 bp, Mus musculus
cccgaagctggacacctacgagtga

SEQ ID NO: 427786 - DNA, 25 bp, Mus musculus
ctacgagtgagaaacaagaggtgct

SEQ ID NO: 427787 - DNA, 25 bp, Mus musculus
aacaagaggtgctcagccttcccgg

SEQ ID NO: 427788 - DNA, 25 bp, Mus musculus
ggtgctcagccttcccggcaagtaa

SEQ ID NO: 427789 - DNA, 25 bp, Mus musculus
tcccggcaagtaagtgtttctcgtc

SEQ ID NO: 427790 - DNA, 25 bp, Mus musculus
gtaagtgtttctcgtctccgccacc

SEQ ID NO: 427791 - DNA, 25 bp, Mus musculus
cgctgcccactcgagctcccggaaa

SEQ ID NO: 427792 - DNA, 25 bp, Mus musculus
gctcagcggcgtccagggatgctcc

SEQ ID NO: 427793 - DNA, 25 bp, Mus musculus
ccttgttgtgcctggtgcgttgaca

SEQ ID NO: 427794 - DNA, 25 bp, Mus musculus
ccacagccctgggaatttcggtgcg

SEQ ID NO: 427795 - DNA, 25 bp, Mus musculus
aggctccgagctccacctctctcca

SEQ ID NO: 427796 - DNA, 25 bp, Mus musculus
aagccactttaaggctccgagctcc

SEQ ID NO: 427797 - DNA, 25 bp, Mus musculus
cggcacagtggcaggctctgatatt

SEQ ID NO: 427798 - DNA, 25 bp, Mus musculus
ctgggaatttcggtgcggaccacag

SEQ ID NO: 427799 - DNA, 25 bp, Mus musculus
accacagggcgtcggtgcgttccag

SEQ ID NO: 427800 - DNA, 25 bp, Mus musculus
agaggaagccactttaaggctccga

SEQ ID NO: 427801 - DNA, 25 bp, Mus musculus
ttttgtgtcttaccggatcccagag

SEQ ID NO: 427802 - DNA, 25 bp, Mus musculus
atcttttgtgtcttaccggatccca

SEQ ID NO: 427803 - DNA, 25 bp, Mus musculus
tgcccatcttttgtgtcttaccgga

SEQ ID NO: 427804 - DNA, 25 bp, Mus musculus
tctgatattgcccatcttttgtgtc

SEQ ID NO: 427805 - DNA, 25 bp, Mus musculus
aggctctgatattgcccatcttttg

SEQ ID NO: 427806 - DNA, 25 bp, Mus musculus
cagtggcaggctctgatattgccca

SEQ ID NO: 427807 - DNA, 25 bp, Mus musculus
aatttcggtgcggaccacagggcgt

SEQ ID NO: 427808 - DNA, 25 bp, Mus musculus
ctgggctgcgaggaaaagtttcttc

SEQ ID NO: 427809 - DNA, 25 bp, Mus musculus
actcggagatggatcgaattacacc

SEQ ID NO: 427810 - DNA, 25 bp, Mus musculus
tagctcccgggagttcattgctctc

SEQ ID NO: 427811 - DNA, 25 bp, Mus musculus
cccatgagaggtaagacagtcgccc

SEQ ID NO: 427812 - DNA, 25 bp, Mus musculus
ccgcaactttgcgtgctttgttctc

SEQ ID NO: 427813 - DNA, 25 bp, Mus musculus
tgttctctggctgaaaaaatgctcc

SEQ ID NO: 427814 - DNA, 25 bp, Mus musculus
tgctccacagaagcgccatagaccg

SEQ ID NO: 427815 - DNA, 25 bp, Mus musculus
acaccatttgccgagcagcggtttg

SEQ ID NO: 427816 - DNA, 25 bp, Mus musculus
tcgcaagacgagacccgagaccgtg

SEQ ID NO: 427817 - DNA, 25 bp, Mus musculus
accgtgggattgctctttctgcaca

SEQ ID NO: 427818 - DNA, 25 bp, Mus musculus
tgcacactgtcttgattggctcttc

SEQ ID NO: 427819 - DNA, 25 bp, Mus musculus
gattggctcttctgtctgaccgtga

SEQ ID NO: 427820 - DNA, 25 bp, Mus musculus
gtctgaccgtgacaagcttcatttg

SEQ ID NO: 427821 - DNA, 25 bp, Mus musculus
agtgcggagccactgactgtccacg

SEQ ID NO: 427822 - DNA, 25 bp, Mus musculus
tacctgtagctctagttccagaaca

SEQ ID NO: 427823 - DNA, 25 bp, Mus musculus
gcgaactggaactgctcgtgactca

SEQ ID NO: 427824 - DNA, 25 bp, Mus musculus
ggaactgctcgtgactcagcattta

SEQ ID NO: 427825 - DNA, 25 bp, Mus musculus
gtgactcagcatttaagagcacttg

SEQ ID NO: 427826 - DNA, 25 bp, Mus musculus
cttgctgctcttacagtggacctga

SEQ ID NO: 427827 - DNA, 25 bp, Mus musculus
cttacagtggacctgagatcagttc

SEQ ID NO: 427828 - DNA, 25 bp, Mus musculus
gagatcagttcctaacacccatgtg

SEQ ID NO: 427829 - DNA, 25 bp, Mus musculus
tcctaacacccatgtgaggcagctc

SEQ ID NO: 427830 - DNA, 25 bp, Mus musculus
acccatgtgaggcagctcataacta

SEQ ID NO: 427831 - DNA, 25 bp, Mus musculus
gaggcagctcataactacctgtagc

SEQ ID NO: 427832 - DNA, 25 bp, Mus musculus
ttccagaacatataaagccatcttc

SEQ ID NO: 427833 - DNA, 25 bp, Mus musculus
agccatcttctggtctccacaaaga

SEQ ID NO: 427834 - DNA, 25 bp, Mus musculus
tggtctccacaaagatgtgcacata

SEQ ID NO: 427835 - DNA, 25 bp, Mus musculus
gaggagcactgccaagctgccgccg

SEQ ID NO: 427836 - DNA, 25 bp, Mus musculus
actatggcagctccatctctgcggg

SEQ ID NO: 427837 - DNA, 25 bp, Mus musculus
ccatctctgcgggtggatgctctac

SEQ ID NO: 427838 - DNA, 25 bp, Mus musculus
ggatgctctacgaacccgccagcga

SEQ ID NO: 427839 - DNA, 25 bp, Mus musculus
ccgatgatgtcatccctgggtcctc

SEQ ID NO: 427840 - DNA, 25 bp, Mus musculus
tgaggctagcctcgggccttttaaa

SEQ ID NO: 427841 - DNA, 25 bp, Mus musculus
gagacaatacattttaacgccgttg

SEQ ID NO: 427842 - DNA, 25 bp, Mus musculus
ttttaacgccgttggcgctgctgcg

SEQ ID NO: 427843 - DNA, 25 bp, Mus musculus
tcagccggttgctgctgcgagccgt

SEQ ID NO: 427844 - DNA, 25 bp, Mus musculus
cctcggacttgtcggcatcggccat

SEQ ID NO: 427845 - DNA, 25 bp, Mus musculus
gatgagggctccgagcgctacaatg

SEQ ID NO: 427846 - DNA, 25 bp, Mus musculus
gagaagcggtaacggatcgcgattt

SEQ ID NO: 427847 - DNA, 25 bp, Mus musculus
taacggatcgcgatttgaaaaggcc

SEQ ID NO: 427848 - DNA, 25 bp, Mus musculus
ctttggatgagaggactatggcagc

SEQ ID NO: 427849 - DNA, 25 bp, Mus musculus
ggggaaaggaccgatgatgtcatcc

SEQ ID NO: 427850 - DNA, 25 bp, Mus musculus
gcccgacggcaggaatgcaaacacc

SEQ ID NO: 427851 - DNA, 25 bp, Mus musculus
atgcctctcctaagcgtgctgctgc

SEQ ID NO: 427852 - DNA, 25 bp, Mus musculus
acctattcaggtgagagccgtggcc

SEQ ID NO: 427853 - DNA, 25 bp, Mus musculus
gctgccggctacgacctattcaggt

SEQ ID NO: 427854 - DNA, 25 bp, Mus musculus
atggcgcttctctgcgcttcgtgcg

SEQ ID NO: 427855 - DNA, 25 bp, Mus musculus
ctctgcctccaagagggctcgagcg

SEQ ID NO: 427856 - DNA, 25 bp, Mus musculus
atgccctgctcggaagatgccgcgg

SEQ ID NO: 427857 - DNA, 25 bp, Mus musculus
ttgctttctgctttttccacgcccg

SEQ ID NO: 427858 - DNA, 25 bp, Mus musculus
gctctcgcacgctcattgctttctg

SEQ ID NO: 427859 - DNA, 25 bp, Mus musculus
attttcggcgggtaggctctcgcac

SEQ ID NO: 427860 - DNA, 25 bp, Mus musculus
gcgctcgagccctttgcggaaggcc

SEQ ID NO: 427861 - DNA, 25 bp, Mus musculus
aggtcggtgcctcctctaggccgcg

SEQ ID NO: 427862 - DNA, 25 bp, Mus musculus
ccctggtctgagcaggtaacggtga

SEQ ID NO: 427863 - DNA, 25 bp, Mus musculus
tgcaaacaccgagcccgggtgcagt

SEQ ID NO: 427864 - DNA, 25 bp, Mus musculus
gcggccatgcagctctacagcagcg

SEQ ID NO: 427865 - DNA, 25 bp, Mus musculus
gtctgacgcgctccgacggcaagat

SEQ ID NO: 427866 - DNA, 25 bp, Mus musculus
agctcagcgctattctcgggctccg

SEQ ID NO: 427867 - DNA, 25 bp, Mus musculus
aaggcgaagccgtaggcacgtcccg

SEQ ID NO: 427868 - DNA, 25 bp, Mus musculus
tccgacggcaagatcccgaagccga

SEQ ID NO: 427869 - DNA, 25 bp, Mus musculus
cgcagcacgaattgggtcgcggccc

SEQ ID NO: 427870 - DNA, 25 bp, Mus musculus
gaacttccgactgagcgagcaccgc

SEQ ID NO: 427871 - DNA, 25 bp, Mus musculus
cgacgctccggacaggaacttccga

SEQ ID NO: 427872 - DNA, 25 bp, Mus musculus
gccgccttcaaggtctccttgcagt

SEQ ID NO: 427873 - DNA, 25 bp, Mus musculus
gtgtgcacccattaccctgcgggca

SEQ ID NO: 427874 - DNA, 25 bp, Mus musculus
tctacagcagcgtgtgcacccatta

SEQ ID NO: 427875 - DNA, 25 bp, Mus musculus
tccaagccgggctcgcagctataag

SEQ ID NO: 427876 - DNA, 25 bp, Mus musculus
gctattcgcggctcctgacgcggcg

SEQ ID NO: 427877 - DNA, 25 bp, Mus musculus
ccagaacggcgaaggcgaagccgta

SEQ ID NO: 427878 - DNA, 25 bp, Mus musculus
ggtagtccctgcctgtcctgcaaca

SEQ ID NO: 427879 - DNA, 25 bp, Mus musculus
cacggtcttaatggcactgattgcg

SEQ ID NO: 427880 - DNA, 25 bp, Mus musculus
gagcggactgcctacacggtcttaa

SEQ ID NO: 427881 - DNA, 25 bp, Mus musculus
gcgccaagtaccgtgtccctaggga

SEQ ID NO: 427882 - DNA, 25 bp, Mus musculus
aggaccactcgatcccaactagctg

SEQ ID NO: 427883 - DNA, 25 bp, Mus musculus
ttactcggaggaacgaggaccactc

SEQ ID NO: 427884 - DNA, 25 bp, Mus musculus
gggtcctacagctttcttctccagg

SEQ ID NO: 427885 - DNA, 25 bp, Mus musculus
tccggctgtcctgatgcagagaggt

SEQ ID NO: 427886 - DNA, 25 bp, Mus musculus
ccatggctcgtgtaggactcgagga

SEQ ID NO: 427887 - DNA, 25 bp, Mus musculus
gcagtcccggatcttgcagctgtca

SEQ ID NO: 427888 - DNA, 25 bp, Mus musculus
acccactggactagcggctcggact

SEQ ID NO: 427889 - DNA, 25 bp, Mus musculus
gccagctgcagatgctcgagacatc

SEQ ID NO: 427890 - DNA, 25 bp, Mus musculus
gcccgattggctctggtctccttca

SEQ ID NO: 427891 - DNA, 25 bp, Mus musculus
agctctccaaaaagggtcctctccg

SEQ ID NO: 427892 - DNA, 25 bp, Mus musculus
agccgcgagcaccttcccggttaca

SEQ ID NO: 427893 - DNA, 25 bp, Mus musculus
ggtccaagaaccacgggcgcgcaca

SEQ ID NO: 427894 - DNA, 25 bp, Mus musculus
gagaagggagccagcaagcacagcc

SEQ ID NO: 427895 - DNA, 25 bp, Mus musculus
ggacgcccaggctgaagatcgagaa

SEQ ID NO: 427896 - DNA, 25 bp, Mus musculus
gcagcgcccttaccaaagaactggg

SEQ ID NO: 427897 - DNA, 25 bp, Mus musculus
agcctggccgggagaccgcagtcac

SEQ ID NO: 427898 - DNA, 25 bp, Mus musculus
cacaggtctgccgatgggacgccca

SEQ ID NO: 427899 - DNA, 25 bp, Mus musculus
ccgcctcccacaaggtcggttgaga

SEQ ID NO: 427900 - DNA, 25 bp, Mus musculus
cacaaggtcggttgagaagtcgccc

SEQ ID NO: 427901 - DNA, 25 bp, Mus musculus
agaagtcgcccgcagttgcaagagc

SEQ ID NO: 427902 - DNA, 25 bp, Mus musculus
ccgcagttgcaagagcgcggctgtt

SEQ ID NO: 427903 - DNA, 25 bp, Mus musculus
aggagactcgaacgcgggtcccgat

SEQ ID NO: 427904 - DNA, 25 bp, Mus musculus
ctgaagatcgagaagggagccagca

SEQ ID NO: 427905 - DNA, 25 bp, Mus musculus
actgggtgtactcacgcagcgccct

SEQ ID NO: 427906 - DNA, 25 bp, Mus musculus
aggacgactacgagttccctgaaga

SEQ ID NO: 427907 - DNA, 25 bp, Mus musculus
tgttcctgcgaaccgcgcgagccgg

SEQ ID NO: 427908 - DNA, 25 bp, Mus musculus
gtcaatcgactgaccgaagagctcg

SEQ ID NO: 427909 - DNA, 25 bp, Mus musculus
agccaacaaggtgttcctgcgaacc

SEQ ID NO: 427910 - DNA, 25 bp, Mus musculus
cctggaggaagccaacaaggtgttc

SEQ ID NO: 427911 - DNA, 25 bp, Mus musculus
acgagttccctgaagaggagcgctg

SEQ ID NO: 427912 - DNA, 25 bp, Mus musculus
agtttgatgactgggaggacgacta

SEQ ID NO: 427913 - DNA, 25 bp, Mus musculus
ttcgctgatggttgtcaatcgactg

SEQ ID NO: 427914 - DNA, 25 bp, Mus musculus
cgaagagctgttttcgctgatggtt

SEQ ID NO: 427915 - DNA, 25 bp, Mus musculus
gaccagctagcttttatcgaagagc

SEQ ID NO: 427916 - DNA, 25 bp, Mus musculus
agccctttcgaccagctagctttta

SEQ ID NO: 427917 - DNA, 25 bp, Mus musculus
gcggtgtgagaagagccctttcgac

SEQ ID NO: 427918 - DNA, 25 bp, Mus musculus
agatgccctggatggcggctttcag

SEQ ID NO: 427919 - DNA, 25 bp, Mus musculus
gatgcacagggtgtccgccgccctg

SEQ ID NO: 427920 - DNA, 25 bp, Mus musculus
tgtcctggctgcgttctcgcatagc

SEQ ID NO: 427921 - DNA, 25 bp, Mus musculus
ggctcccttcgtccaaagacgtgat

SEQ ID NO: 427922 - DNA, 25 bp, Mus musculus
caaagacgtgatggactcgttccga

SEQ ID NO: 427923 - DNA, 25 bp, Mus musculus
ctcgttccgaaagcggctgtacttg

SEQ ID NO: 427924 - DNA, 25 bp, Mus musculus
ctgtacttggtcctgtgaagcatcc

SEQ ID NO: 427925 - DNA, 25 bp, Mus musculus
gtcctacatacagcgtgagtcctgc

SEQ ID NO: 427926 - DNA, 25 bp, Mus musculus
tcgcatagccttagcagtgctgaga

SEQ ID NO: 427927 - DNA, 25 bp, Mus musculus
ctgagactgggcaccgcagcctaaa

SEQ ID NO: 427928 - DNA, 25 bp, Mus musculus
gcctaaagtgcctcgcagtccggta

SEQ ID NO: 427929 - DNA, 25 bp, Mus musculus
ccgagactgctcaaggatgacagtc

SEQ ID NO: 427930 - DNA, 25 bp, Mus musculus
tcaaggatgacagtcccggaggacg

SEQ ID NO: 427931 - DNA, 25 bp, Mus musculus
cagctctgattgcaggccggccctt

SEQ ID NO: 427932 - DNA, 25 bp, Mus musculus
gcgacgagcccttgtttccaacgga

SEQ ID NO: 427933 - DNA, 25 bp, Mus musculus
ccaggtgcccaaagagtcctacata

SEQ ID NO: 427934 - DNA, 25 bp, Mus musculus
gcgggaccgaaagggcggaggcgca

SEQ ID NO: 427935 - DNA, 25 bp, Mus musculus
gcctttcagcttcggcggcctgccg

SEQ ID NO: 427936 - DNA, 25 bp, Mus musculus
agagcagcccgggcgcttgcgtacc

SEQ ID NO: 427937 - DNA, 25 bp, Mus musculus
ggcgcttgcgtacctgctcggccgg

SEQ ID NO: 427938 - DNA, 25 bp, Mus musculus
atggcgccggcgacaggcgccggct

SEQ ID NO: 427939 - DNA, 25 bp, Mus musculus
gcgcagtaggaaatggagatacgca

SEQ ID NO: 427940 - DNA, 25 bp, Mus musculus
gacaggcgccggctctagtcggtgt

SEQ ID NO: 427941 - DNA, 25 bp, Mus musculus
ctctagtcggtgtgcgcagcgccgc

SEQ ID NO: 427942 - DNA, 25 bp, Mus musculus
cccggcctttcagcttcggcggcct

SEQ ID NO: 427943 - DNA, 25 bp, Mus musculus
ccgcgggccgctttctccatggccc

SEQ ID NO: 427944 - DNA, 25 bp, Mus musculus
gccggacgccgactcggctacgcca

SEQ ID NO: 427945 - DNA, 25 bp, Mus musculus
cgccgactcggctacgccactggct

SEQ ID NO: 427946 - DNA, 25 bp, Mus musculus
gagggatcatctgggacggaagccg

SEQ ID NO: 427947 - DNA, 25 bp, Mus musculus
taggaaatggagatacgcaggggcg

SEQ ID NO: 427948 - DNA, 25 bp, Mus musculus
ctcgtcttccggtctctccaggaga

SEQ ID NO: 427949 - DNA, 25 bp, Mus musculus
gcgacagtttgtgtcttagcaacta

SEQ ID NO: 427950 - DNA, 25 bp, Mus musculus
gccggctcttcctgagcgacagttt

SEQ ID NO: 427951 - DNA, 25 bp, Mus musculus
ctcccaaagggagggcacagccggc

SEQ ID NO: 427952 - DNA, 25 bp, Mus musculus
gatgatttactacggctcccaaagg

SEQ ID NO: 427953 - DNA, 25 bp, Mus musculus
agcgctcgaccctgagatgatttac

SEQ ID NO: 427954 - DNA, 25 bp, Mus musculus
ctccaggagaagataaagctcattc

SEQ ID NO: 427955 - DNA, 25 bp, Mus musculus
gagaaattagagacagcctcctccc

SEQ ID NO: 427956 - DNA, 25 bp, Mus musculus
catgtcagacatcttggccggaggg

SEQ ID NO: 427957 - DNA, 25 bp, Mus musculus
atgaaatcatcctccatgtcagaca

SEQ ID NO: 427958 - DNA, 25 bp, Mus musculus
cgtagcaactacgaaatcgggcgtt

SEQ ID NO: 427959 - DNA, 25 bp, Mus musculus
ggtcgtagtcctcctcatcatcgca

SEQ ID NO: 427960 - DNA, 25 bp, Mus musculus
ctcattccggaactaaagcgctcga

SEQ ID NO: 427961 - DNA, 25 bp, Mus musculus
caggcgaggagggaaacctgtccct

SEQ ID NO: 427962 - DNA, 25 bp, Mus musculus
caagacttgagtggtctggggccta

SEQ ID NO: 427963 - DNA, 25 bp, Mus musculus
ctgttaccgtcagccgataagcaga

SEQ ID NO: 427964 - DNA, 25 bp, Mus musculus
aaccagatgtgtgctgttaccgtca

SEQ ID NO: 427965 - DNA, 25 bp, Mus musculus
tcgcgggaaaaggaaaccagatgtg

SEQ ID NO: 427966 - DNA, 25 bp, Mus musculus
ccgatctgtaattcaggctttggcg

SEQ ID NO: 427967 - DNA, 25 bp, Mus musculus
gctccctgtgagcaccgatctgtaa

SEQ ID NO: 427968 - DNA, 25 bp, Mus musculus
agtcggcgttgctcactcctggcaa

SEQ ID NO: 427969 - DNA, 25 bp, Mus musculus
tggtctggggcctaaatgaagcctt

SEQ ID NO: 427970 - DNA, 25 bp, Mus musculus
ccgccctccggtgttctgcggaaag

SEQ ID NO: 427971 - DNA, 25 bp, Mus musculus
acgggattctccctctgagcatgcg

SEQ ID NO: 427972 - DNA, 25 bp, Mus musculus
tggaacaggtcacccgggaagcgaa

SEQ ID NO: 427973 - DNA, 25 bp, Mus musculus
gctgacggttcctttggaacaggtc

SEQ ID NO: 427974 - DNA, 25 bp, Mus musculus
cggcacagcaggaagctgacggttc

SEQ ID NO: 427975 - DNA, 25 bp, Mus musculus
ccttattaggcttcccgagtcggcg

SEQ ID NO: 427976 - DNA, 25 bp, Mus musculus
aaagatggagatccgctgggccgtc

SEQ ID NO: 427977 - DNA, 25 bp, Mus musculus
tcttcccgtggcctcgagggcgcat

SEQ ID NO: 427978 - DNA, 25 bp, Mus musculus
cccggagctaggactgagaagcaga

SEQ ID NO: 427979 - DNA, 25 bp, Mus musculus
gcgaaatgccgtaggaccctgggaa

SEQ ID NO: 427980 - DNA, 25 bp, Mus musculus
ggtgcgcgaaatgccgtaggaccct

SEQ ID NO: 427981 - DNA, 25 bp, Mus musculus
aactctgggccgctctgctggcgct

SEQ ID NO: 427982 - DNA, 25 bp, Mus musculus
tctcctctagtgaacgcgggcaggt

SEQ ID NO: 427983 - DNA, 25 bp, Mus musculus
tggccgggacaactctgggccgctc

SEQ ID NO: 427984 - DNA, 25 bp, Mus musculus
tcagcctcaggcagggtccaggcgt

SEQ ID NO: 427985 - DNA, 25 bp, Mus musculus
cactcagcctcaggcagggtccagg

SEQ ID NO: 427986 - DNA, 25 bp, Mus musculus
gcaaagtttacccatcacactcagc

SEQ ID NO: 427987 - DNA, 25 bp, Mus musculus
gggcgcggtctcctctagtgaacgc

SEQ ID NO: 427988 - DNA, 25 bp, Mus musculus
gggaagattgcaaagtttacccatc

SEQ ID NO: 427989 - DNA, 25 bp, Mus musculus
gctggggaagattgcaaagtttacc

SEQ ID NO: 427990 - DNA, 25 bp, Mus musculus
ctcctccaagatgtgcggtacttcc

SEQ ID NO: 427991 - DNA, 25 bp, Mus musculus
ggggattgcgtagccctcttcatgg

SEQ ID NO: 427992 - DNA, 25 bp, Mus musculus
gcacgatcaactgggcctacgacag

SEQ ID NO: 427993 - DNA, 25 bp, Mus musculus
gcgctgcacgatcaactgggcctac

SEQ ID NO: 427994 - DNA, 25 bp, Mus musculus
gaccggcgcagcaaccaagtggcgc

SEQ ID NO: 427995 - DNA, 25 bp, Mus musculus
acgcccaggtggaccggcgcagcaa

SEQ ID NO: 427996 - DNA, 25 bp, Mus musculus
agacgctcacctacgcccaggtgga

SEQ ID NO: 427997 - DNA, 25 bp, Mus musculus
tgttccgagacgagacgctcaccta

SEQ ID NO: 427998 - DNA, 25 bp, Mus musculus
acaagcccttcctgctgttccgaga

SEQ ID NO: 427999 - DNA, 25 bp, Mus musculus
ttcctggaacaagcgcgcaagaccc

SEQ ID NO: 428000 - DNA, 25 bp, Mus musculus
cgggccttcctggaacaagcgcgca

SEQ ID NO: 428001 - DNA, 25 bp, Mus musculus
acttcctgcggctggccaacatggc

SEQ ID NO: 428002 - DNA, 25 bp, Mus musculus
aagatgtgcggtacttcctgcggct

SEQ ID NO: 428003 - DNA, 25 bp, Mus musculus
tcttcatgggcaatgagccggccta

SEQ ID NO: 428004 - DNA, 25 bp, Mus musculus
cctcaggccgccgagacaaaggagc

SEQ ID NO: 428005 - DNA, 25 bp, Mus musculus
tagcgttcggccacacaaaggctgc

SEQ ID NO: 428006 - DNA, 25 bp, Mus musculus
tcccagaagccaagcgccgggcgga

SEQ ID NO: 428007 - DNA, 25 bp, Mus musculus
aaatcgcggggatgatctgggttcc

SEQ ID NO: 428008 - DNA, 25 bp, Mus musculus
tttttaccagcgaagagatcaactt

SEQ ID NO: 428009 - DNA, 25 bp, Mus musculus
agatcaacttccacatccggtggta

SEQ ID NO: 428010 - DNA, 25 bp, Mus musculus
tccggtggtaacagggccctacaca

SEQ ID NO: 428011 - DNA, 25 bp, Mus musculus
acagacccgcactgacctggaaaag

SEQ ID NO: 428012 - DNA, 25 bp, Mus musculus
cacacagagcgcttcgctgcacagg

SEQ ID NO: 428013 - DNA, 25 bp, Mus musculus
ctgcacagggcgctattttccgaaa

SEQ ID NO: 428014 - DNA, 25 bp, Mus musculus
ttttccgaaaatgccgcgtctgctc

SEQ ID NO: 428015 - DNA, 25 bp, Mus musculus
gagggtctgcttctgactttaaacg

SEQ ID NO: 428016 - DNA, 25 bp, Mus musculus
acccggcgccttaatgcaataaaca

SEQ ID NO: 428017 - DNA, 25 bp, Mus musculus
aagccatttctagcgttcggccaca

SEQ ID NO: 428018 - DNA, 25 bp, Mus musculus
gatgtccctccctacgggacagaaa

SEQ ID NO: 428019 - DNA, 25 bp, Mus musculus
ctcgccgtgacgtttcgagacgcga

SEQ ID NO: 428020 - DNA, 25 bp, Mus musculus
cagaaaggcggagttacagggttca

SEQ ID NO: 428021 - DNA, 25 bp, Mus musculus
ggagggcccgactcttggtcgctcc

SEQ ID NO: 428022 - DNA, 25 bp, Mus musculus
cttccgacgcatgctcaggccggtt

SEQ ID NO: 428023 - DNA, 25 bp, Mus musculus
gctcaaactgtccttccgacgcatg

SEQ ID NO: 428024 - DNA, 25 bp, Mus musculus
ccagacaactggctggtccagggag

SEQ ID NO: 428025 - DNA, 25 bp, Mus musculus
tcatccgggagacgagccctgtccg

SEQ ID NO: 428026 - DNA, 25 bp, Mus musculus
tccagctgctggtcatccgggagac

SEQ ID NO: 428027 - DNA, 25 bp, Mus musculus
ccacgcaatgcgaatcgggaagagg

SEQ ID NO: 428028 - DNA, 25 bp, Mus musculus
aaggctcgttctccttctggtggtg

SEQ ID NO: 428029 - DNA, 25 bp, Mus musculus
cgaggacaccggaagcgcagcacgc

SEQ ID NO: 428030 - DNA, 25 bp, Mus musculus
gcgtctgagagcgaaggctcgttct

SEQ ID NO: 428031 - DNA, 25 bp, Mus musculus
tacagggttcactggaagctccgcc

SEQ ID NO: 428032 - DNA, 25 bp, Mus musculus
ccgaggactcgtagcagcaatggct

SEQ ID NO: 428033 - DNA, 25 bp, Mus musculus
cgtcaaagcgcagtttaagacctcc

SEQ ID NO: 428034 - DNA, 25 bp, Mus musculus
agtgccacacccgtggtggtacgca

SEQ ID NO: 428035 - DNA, 25 bp, Mus musculus
ccagctctcagtaccgcatcaagga

SEQ ID NO: 428036 - DNA, 25 bp, Mus musculus
actcaacgctggctgaggactcgcc

SEQ ID NO: 428037 - DNA, 25 bp, Mus musculus
gatgaacgccaactactcaacgctg

SEQ ID NO: 428038 - DNA, 25 bp, Mus musculus
gccactcgagctcagagcactacta

SEQ ID NO: 428039 - DNA, 25 bp, Mus musculus
acagctggcggcctgttcaaagaga

SEQ ID NO: 428040 - DNA, 25 bp, Mus musculus
aggagggccactacagcgtcaaagc

SEQ ID NO: 428041 - DNA, 25 bp, Mus musculus
agagcactactacccagcacagatg

SEQ ID NO: 428042 - DNA, 25 bp, Mus musculus
gatgagctgcgccagtggtaccagc

SEQ ID NO: 428043 - DNA, 25 bp, Mus musculus
tcgcataaggagcacagccgtctgt

SEQ ID NO: 428044 - DNA, 25 bp, Mus musculus
actatatatcgagggcagtgccaca

SEQ ID NO: 428045 - DNA, 25 bp, Mus musculus
ggtctcagatcctgcggactccttc

SEQ ID NO: 428046 - DNA, 25 bp, Mus musculus
ctcggcccgaagtaagtgcagcaga

SEQ ID NO: 428047 - DNA, 25 bp, Mus musculus
ctgcagtcctggcatgcactaaaac

SEQ ID NO: 428048 - DNA, 25 bp, Mus musculus
gggcactcttgccaccgaaagactc

SEQ ID NO: 428049 - DNA, 25 bp, Mus musculus
tgcaataagatctccgtgctggacc

SEQ ID NO: 428050 - DNA, 25 bp, Mus musculus
gcggaggctcaagcttgcaataaga

SEQ ID NO: 428051 - DNA, 25 bp, Mus musculus
catcccagggctgctaaaggtagcg

SEQ ID NO: 428052 - DNA, 25 bp, Mus musculus
gcaagtcggacagaaacagcccagt

SEQ ID NO: 428053 - DNA, 25 bp, Mus musculus
ctccaggtgacttgaaagtcgtctc

SEQ ID NO: 428054 - DNA, 25 bp, Mus musculus
aggagcctcgccaacctccaggtga

SEQ ID NO: 428055 - DNA, 25 bp, Mus musculus
tagatttcggatccagctgcgtttc

SEQ ID NO: 428056 - DNA, 25 bp, Mus musculus
agactcatttttcccttcttgcgca

SEQ ID NO: 428057 - DNA, 25 bp, Mus musculus
tgcagcagaagtttgcgtcgcttcc

SEQ ID NO: 428058 - DNA, 25 bp, Mus musculus
gcatttcgcagtcgtagctggcctg

SEQ ID NO: 428059 - DNA, 25 bp, Mus musculus
ggctgtgcgctccttgctaaggatg

SEQ ID NO: 428060 - DNA, 25 bp, Mus musculus
gcggcctgcagccatctatcggaaa

SEQ ID NO: 428061 - DNA, 25 bp, Mus musculus
cgacgcagacctggcaacgcacggt

SEQ ID NO: 428062 - DNA, 25 bp, Mus musculus
catcgcagtctacaccgtcaaaatc

SEQ ID NO: 428063 - DNA, 25 bp, Mus musculus
cgtcaaaatcgctcccgttctatta

SEQ ID NO: 428064 - DNA, 25 bp, Mus musculus
aaaatgtacctgtagagcgtctgcg

SEQ ID NO: 428065 - DNA, 25 bp, Mus musculus
agcgtctgcggcacagccaccaagt

SEQ ID NO: 428066 - DNA, 25 bp, Mus musculus
cgtaccattctcctcacggggcgga

SEQ ID NO: 428067 - DNA, 25 bp, Mus musculus
tttcataattgtgcgaccagctccg

SEQ ID NO: 428068 - DNA, 25 bp, Mus musculus
agctgctgctttccctggtgttgct

SEQ ID NO: 428069 - DNA, 25 bp, Mus musculus
cctgcctctgtccacgagaacttgt

SEQ ID NO: 428070 - DNA, 25 bp, Mus musculus
tgttccgctttaatgaccagattcc

SEQ ID NO: 428071 - DNA, 25 bp, Mus musculus
acgttggttattagcgatctcttcc

SEQ ID NO: 428072 - DNA, 25 bp, Mus musculus
cgctagcagcagaagtcgagtcttt

SEQ ID NO: 428073 - DNA, 25 bp, Mus musculus
ttgctatcgcatctgtctacgttgg

SEQ ID NO: 428074 - DNA, 25 bp, Mus musculus
cagagccgttttagctgcgtaaatc

SEQ ID NO: 428075 - DNA, 25 bp, Mus musculus
ccgcgaaacgctaggccgggactct

SEQ ID NO: 428076 - DNA, 25 bp, Mus musculus
gcggcacccggacctctagggtgca

SEQ ID NO: 428077 - DNA, 25 bp, Mus musculus
tgggtactgtcagctcctggcagag

SEQ ID NO: 428078 - DNA, 25 bp, Mus musculus
cgggcagctaggctcaggctgcgct

SEQ ID NO: 428079 - DNA, 25 bp, Mus musculus
tcggggcgatcttcgtaaatacgga

SEQ ID NO: 428080 - DNA, 25 bp, Mus musculus
agcctcggggcgatcttcgtaaata

SEQ ID NO: 428081 - DNA, 25 bp, Mus musculus
ctctgccacgtagcctcggggcgat

SEQ ID NO: 428082 - DNA, 25 bp, Mus musculus
ttcctttctggcctctgccacgtag

SEQ ID NO: 428083 - DNA, 25 bp, Mus musculus
ccattccaagccactggagcttcgg

SEQ ID NO: 428084 - DNA, 25 bp, Mus musculus
ttagctgcgtaaatcctgggttctc

SEQ ID NO: 428085 - DNA, 25 bp, Mus musculus
gtcagctcctggcagagccgtttta

SEQ ID NO: 428086 - DNA, 25 bp, Mus musculus
gatcttcgtaaatacggaacccaga

SEQ ID NO: 428087 - DNA, 25 bp, Mus musculus
tgcgtaaatcctgggttctcgttcg

SEQ ID NO: 428088 - DNA, 25 bp, Mus musculus
caggcggtgtttcccggaacttcat

SEQ ID NO: 428089 - DNA, 25 bp, Mus musculus
tggagaggacgctgaccgcactgcc

SEQ ID NO: 428090 - DNA, 25 bp, Mus musculus
ggggctcttcctgcagaaccagctg

SEQ ID NO: 428091 - DNA, 25 bp, Mus musculus
tggcgtcactgcactctcatccaag

SEQ ID NO: 428092 - DNA, 25 bp, Mus musculus
ctcatccaagcacgtatgcggcggg

SEQ ID NO: 428093 - DNA, 25 bp, Mus musculus
gacatcggtccgctggatggacgca

SEQ ID NO: 428094 - DNA, 25 bp, Mus musculus
gtccgcctcaagttgcctgtaccga

SEQ ID NO: 428095 - DNA, 25 bp, Mus musculus
ttgcctgtaccgaccgacctcagga

SEQ ID NO: 428096 - DNA, 25 bp, Mus musculus
tcaggaggccggctttctgatttgg

SEQ ID NO: 428097 - DNA, 25 bp, Mus musculus
ttctgatttggaggcccgaagaccc

SEQ ID NO: 428098 - DNA, 25 bp, Mus musculus
tcaaaacgccggaagtgactacgga

SEQ ID NO: 428099 - DNA, 25 bp, Mus musculus
ctgctccggcgcgaataaagatttc

SEQ ID NO: 428100 - DNA, 25 bp, Mus musculus
ggaacttcatcctgctcgtcctgct

SEQ ID NO: 428101 - DNA, 25 bp, Mus musculus
agagtcagcgcgaagtagcctcgta

SEQ ID NO: 428102 - DNA, 25 bp, Mus musculus
aaggctccgcctaccatctggacag

SEQ ID NO: 428103 - DNA, 25 bp, Mus musculus
aattgctcggtcaaggctccgccta

SEQ ID NO: 428104 - DNA, 25 bp, Mus musculus
catctggacagccaatcgaatccta

SEQ ID NO: 428105 - DNA, 25 bp, Mus musculus
tcgaatcctagcagcgctctgtctg

SEQ ID NO: 428106 - DNA, 25 bp, Mus musculus
ctctgtctgtagctgctgggacgct

SEQ ID NO: 428107 - DNA, 25 bp, Mus musculus
gacgctgcaatttgggcgcgctgaa

SEQ ID NO: 428108 - DNA, 25 bp, Mus musculus
ccgcgtgcccgccatcctttcggga

SEQ ID NO: 428109 - DNA, 25 bp, Mus musculus
gtgagccgctggtaaggtgagctct

SEQ ID NO: 428110 - DNA, 25 bp, Mus musculus
ctgagcgcacgaccctgagacggga

SEQ ID NO: 428111 - DNA, 25 bp, Mus musculus
cacgaccctgagacgggaggccaag

SEQ ID NO: 428112 - DNA, 25 bp, Mus musculus
ttgcggagcccttcgcaggccggac

SEQ ID NO: 428113 - DNA, 25 bp, Mus musculus
gccagcttctctttgcggagccctt

SEQ ID NO: 428114 - DNA, 25 bp, Mus musculus
ctgaagcggaagctcgtgagccgct

SEQ ID NO: 428115 - DNA, 25 bp, Mus musculus
gggactcacgggaattgctcggtca

SEQ ID NO: 428116 - DNA, 25 bp, Mus musculus
agtgaactaggtgcagcggtgaccc

SEQ ID NO: 428117 - DNA, 25 bp, Mus musculus
tctacgcgcgagtgaactaggtgca

SEQ ID NO: 428118 - DNA, 25 bp, Mus musculus
cttggacagttttgagtctacgcgc

SEQ ID NO: 428119 - DNA, 25 bp, Mus musculus
atcgcgagcgccaagcgcggtaacc

SEQ ID NO: 428120 - DNA, 25 bp, Mus musculus
agtaagttttaaatcgcgagcgcca

SEQ ID NO: 428121 - DNA, 25 bp, Mus musculus
gctctccacgtctccggagtaagtt

SEQ ID NO: 428122 - DNA, 25 bp, Mus musculus
cgcggaattctcatcttgctctcca

SEQ ID NO: 428123 - DNA, 25 bp, Mus musculus
tcgagctcacctgagcgcggaattc

SEQ ID NO: 428124 - DNA, 25 bp, Mus musculus
cgccactggcagctgcgtcctgatt

SEQ ID NO: 428125 - DNA, 25 bp, Mus musculus
ggggagtattagagcccagccgcca

SEQ ID NO: 428126 - DNA, 25 bp, Mus musculus
acccagctgaagacgtttggaaaca

SEQ ID NO: 428127 - DNA, 25 bp, Mus musculus
tttggaaacattctggcgccgagcg

SEQ ID NO: 428128 - DNA, 25 bp, Mus musculus
gccgaacacattcgtcccttctgga

SEQ ID NO: 428129 - DNA, 25 bp, Mus musculus
agcggtgacccagctgaagacgttt

SEQ ID NO: 428130 - DNA, 25 bp, Mus musculus
agcaggtgctcaccagctcagcggc

SEQ ID NO: 428131 - DNA, 25 bp, Mus musculus
cgaggacggtcttccaacgatgtcc

SEQ ID NO: 428132 - DNA, 25 bp, Mus musculus
gccagatccctcaggcggttccatg

SEQ ID NO: 428133 - DNA, 25 bp, Mus musculus
aggtctttgcgccagatccctcagg

SEQ ID NO: 428134 - DNA, 25 bp, Mus musculus
cacttcagtggctaggtctttgcgc

SEQ ID NO: 428135 - DNA, 25 bp, Mus musculus
agctcagcggcttcccagggagccg

SEQ ID NO: 428136 - DNA, 25 bp, Mus musculus
ccgggctggacacttcagtggctag

SEQ ID NO: 428137 - DNA, 25 bp, Mus musculus
cgccacctcagcgttttccaggagg

SEQ ID NO: 428138 - DNA, 25 bp, Mus musculus
aggtcacaggcccttatgaggtgtg

SEQ ID NO: 428139 - DNA, 25 bp, Mus musculus
tcggatgaggtcacaggcccttatg

SEQ ID NO: 428140 - DNA, 25 bp, Mus musculus
cctcggttggatcggatgaggtcac

SEQ ID NO: 428141 - DNA, 25 bp, Mus musculus
acgatgtccacaaccggcctcggtt

SEQ ID NO: 428142 - DNA, 25 bp, Mus musculus
agcttcgggctgatcaggtgacttc

SEQ ID NO: 428143 - DNA, 25 bp, Mus musculus
gtcttccaacgatgtccacaaccgg

SEQ ID NO: 428144 - DNA, 25 bp, Mus musculus
cggactccagcaatccacagcggtt

SEQ ID NO: 428145 - DNA, 25 bp, Mus musculus
cttcttccgggcgtacgcgatgctc

SEQ ID NO: 428146 - DNA, 25 bp, Mus musculus
tcttaaagagacagcgcgacctggc

SEQ ID NO: 428147 - DNA, 25 bp, Mus musculus
gttcatactccacacaaactgagag

SEQ ID NO: 428148 - DNA, 25 bp, Mus musculus
acaaactgagagagtccacctgacg

SEQ ID NO: 428149 - DNA, 25 bp, Mus musculus
gagtccacctgacgagctctttctg

SEQ ID NO: 428150 - DNA, 25 bp, Mus musculus
tgacgagctctttctgggtacagac

SEQ ID NO: 428151 - DNA, 25 bp, Mus musculus
tctttctgggtacagaccatgtctc

SEQ ID NO: 428152 - DNA, 25 bp, Mus musculus
gtacagaccatgtctccgaggtcca

SEQ ID NO: 428153 - DNA, 25 bp, Mus musculus
atgtctccgaggtccaaagtctgcg

SEQ ID NO: 428154 - DNA, 25 bp, Mus musculus
ccgaggtccaaagtctgcgggcagc

SEQ ID NO: 428155 - DNA, 25 bp, Mus musculus
ggcagcggactgcagcgactaccac

SEQ ID NO: 428156 - DNA, 25 bp, Mus musculus
cagcgactaccacgcggtgctggtc

SEQ ID NO: 428157 - DNA, 25 bp, Mus musculus
gtacgcgatgctcccagttcatact

SEQ ID NO: 428158 - DNA, 25 bp, Mus musculus
ccttgacccggatgtactactgtac

SEQ ID NO: 428159 - DNA, 25 bp, Mus musculus
cccgcccagaagcagtggttagtaa

SEQ ID NO: 428160 - DNA, 25 bp, Mus musculus
gtactactgtacatctccgcaaacc

SEQ ID NO: 428161 - DNA, 25 bp, Mus musculus
gaaagtctcacgtttagcgggcgtc

SEQ ID NO: 428162 - DNA, 25 bp, Mus musculus
cgtcccttacgttcgtcctgcgttg

SEQ ID NO: 428163 - DNA, 25 bp, Mus musculus
tcgtcctgcgttgtacctgttgtgc

SEQ ID NO: 428164 - DNA, 25 bp, Mus musculus
acctgttgtgccagggcggttcgct

SEQ ID NO: 428165 - DNA, 25 bp, Mus musculus
tggaaccctgagttcccggagcatc

SEQ ID NO: 428166 - DNA, 25 bp, Mus musculus
ttcccggagcatcagcagccatggc

SEQ ID NO: 428167 - DNA, 25 bp, Mus musculus
agccatggcggatgtgactgcccgc

SEQ ID NO: 428168 - DNA, 25 bp, Mus musculus
cccgcagtttgcagtacgagtacaa

SEQ ID NO: 428169 - DNA, 25 bp, Mus musculus
cgtggacagccacggacacttgagc

SEQ ID NO: 428170 - DNA, 25 bp, Mus musculus
gtctcgtcggtcaatggaatccttg

SEQ ID NO: 428171 - DNA, 25 bp, Mus musculus
cggaagcggaagcaagtccgtttct

SEQ ID NO: 428172 - DNA, 25 bp, Mus musculus
gcacaccgagagaagcaacgcgcca

SEQ ID NO: 428173 - DNA, 25 bp, Mus musculus
cgcgctgggcactatagaaccttga

SEQ ID NO: 428174 - DNA, 25 bp, Mus musculus
ctttcatggcgactgttttagggta

SEQ ID NO: 428175 - DNA, 25 bp, Mus musculus
ttgcgttgctctccacctgggtaca

SEQ ID NO: 428176 - DNA, 25 bp, Mus musculus
cccgcagtcctttggtctgtgctca

SEQ ID NO: 428177 - DNA, 25 bp, Mus musculus
gcccgttcatcctggcatgtctaca

SEQ ID NO: 428178 - DNA, 25 bp, Mus musculus
cctctgtctgataaccctggtccaa

SEQ ID NO: 428179 - DNA, 25 bp, Mus musculus
ggttactgaggcttaggtcgcaccc

SEQ ID NO: 428180 - DNA, 25 bp, Mus musculus
gtccggaactaccagtaccctgatg

SEQ ID NO: 428181 - DNA, 25 bp, Mus musculus
taactggaagcctcgcgggacagtc

SEQ ID NO: 428182 - DNA, 25 bp, Mus musculus
cctaggaattgacgtgcccgctgtt

SEQ ID NO: 428183 - DNA, 25 bp, Mus musculus
ttgagaccgtcagatgtacagcttc

SEQ ID NO: 428184 - DNA, 25 bp, Mus musculus
gcttctgcaaaatatgtcgccctag

SEQ ID NO: 428185 - DNA, 25 bp, Mus musculus
taccctgatgccctgcgcaagaaca

SEQ ID NO: 428186 - DNA, 25 bp, Mus musculus
gcgtccctgccgcagatacttagga

SEQ ID NO: 428187 - DNA, 25 bp, Mus musculus
gcttagccaatgagcgcccagggtt

SEQ ID NO: 428188 - DNA, 25 bp, Mus musculus
ctggccaatcagtgccgcttcgtga

SEQ ID NO: 428189 - DNA, 25 bp, Mus musculus
tccacagaggccgacatgttcccga

SEQ ID NO: 428190 - DNA, 25 bp, Mus musculus
tacctcagccgcttctgcaaaaagg

SEQ ID NO: 428191 - DNA, 25 bp, Mus musculus
gagttcccgccgtacacacagacgg

SEQ ID NO: 428192 - DNA, 25 bp, Mus musculus
caaacaggttaggttgcgcgcactc

SEQ ID NO: 428193 - DNA, 25 bp, Mus musculus
acggccgcctgtattccgagagctc

SEQ ID NO: 428194 - DNA, 25 bp, Mus musculus
ccctcccgggactgtagagaacagg

SEQ ID NO: 428195 - DNA, 25 bp, Mus musculus
ccagggttctgagatgcgcccaatc

SEQ ID NO: 428196 - DNA, 25 bp, Mus musculus
tagcttgctaccaggcagcccggag

SEQ ID NO: 428197 - DNA, 25 bp, Mus musculus
cgggtgagacgtccctaaatggctg

SEQ ID NO: 428198 - DNA, 25 bp, Mus musculus
cgggcctctcaggacaacggaacgc

SEQ ID NO: 428199 - DNA, 25 bp, Mus musculus
cccaatcagagtgcgggcaggacaa

SEQ ID NO: 428200 - DNA, 25 bp, Mus musculus
aggccgagcgcacgctgctgctcga

SEQ ID NO: 428201 - DNA, 25 bp, Mus musculus
tgctggatgaaagcagcgcgtctgt

SEQ ID NO: 428202 - DNA, 25 bp, Mus musculus
gccttcctgctctacccttgtatgg

SEQ ID NO: 428203 - DNA, 25 bp, Mus musculus
aagcaggaggctttgcgatgccgat

SEQ ID NO: 428204 - DNA, 25 bp, Mus musculus
aaagcagcgcgtctgtggccgagct

SEQ ID NO: 428205 - DNA, 25 bp, Mus musculus
ttgcgatgccgatcgccatggggct

SEQ ID NO: 428206 - DNA, 25 bp, Mus musculus
gctagccgcactgcagcacgagatg

SEQ ID NO: 428207 - DNA, 25 bp, Mus musculus
acccacgaccgtgtgcttcttgcga

SEQ ID NO: 428208 - DNA, 25 bp, Mus musculus
tgtgcttcttgcgaggtgagcccgc

SEQ ID NO: 428209 - DNA, 25 bp, Mus musculus
ggcccagccagagtcccacgtgaag

SEQ ID NO: 428210 - DNA, 25 bp, Mus musculus
ggggccagccctcgagtatttaagc

SEQ ID NO: 428211 - DNA, 25 bp, Mus musculus
tctacccttgtatggtgacccgagg

SEQ ID NO: 428212 - DNA, 25 bp, Mus musculus
gaccggtgccctggaacgcgctgct

SEQ ID NO: 428213 - DNA, 25 bp, Mus musculus
tttaagcccgggctcgacgaagagc

SEQ ID NO: 428214 - DNA, 25 bp, Mus musculus
cgctgcttagaacaggagaccgggc

SEQ ID NO: 428215 - DNA, 25 bp, Mus musculus
tggaagaaagcgaaggccagaaatg

SEQ ID NO: 428216 - DNA, 25 bp, Mus musculus
gccagaaatgtgagccgaacctgcc

SEQ ID NO: 428217 - DNA, 25 bp, Mus musculus
ttccgaactgcgctctgaagtttcc

SEQ ID NO: 428218 - DNA, 25 bp, Mus musculus
ctccctccggagacagcagacagat

SEQ ID NO: 428219 - DNA, 25 bp, Mus musculus
ccgtaagtaacagtcctcaaagatg

SEQ ID NO: 428220 - DNA, 25 bp, Mus musculus
ttccaagcgctttctgcgagctttc

SEQ ID NO: 428221 - DNA, 25 bp, Mus musculus
tctgaagtttccagagggagaagcc

SEQ ID NO: 428222 - DNA, 25 bp, Mus musculus
ccgggcgctggaatgcggtcttccc

SEQ ID NO: 428223 - DNA, 25 bp, Mus musculus
cagagccgtcacctgttgggcggca

SEQ ID NO: 428224 - DNA, 25 bp, Mus musculus
gtcctaggtcagcagagccgtcacc

SEQ ID NO: 428225 - DNA, 25 bp, Mus musculus
acccagcaggctgcgtcctaggtca

SEQ ID NO: 428226 - DNA, 25 bp, Mus musculus
gatggagttacacgcacgctgctta

SEQ ID NO: 428227 - DNA, 25 bp, Mus musculus
ctttctgcgagctttccgaactgcg

SEQ ID NO: 428228 - DNA, 25 bp, Mus musculus
cctttaccgagagcagggtgcgctt

SEQ ID NO: 428229 - DNA, 25 bp, Mus musculus
tcgcaggtccatgtcccgcaaagcg

SEQ ID NO: 428230 - DNA, 25 bp, Mus musculus
caccagtggcagagaacgtaagaga

SEQ ID NO: 428231 - DNA, 25 bp, Mus musculus
cagtcggttctgtgagtcctgcagc

SEQ ID NO: 428232 - DNA, 25 bp, Mus musculus
acgacggcgcgactttcctctggtc

SEQ ID NO: 428233 - DNA, 25 bp, Mus musculus
cggcagtgagacaacttggaaaact

SEQ ID NO: 428234 - DNA, 25 bp, Mus musculus
ggtctcagcacgcaccgattctctt

SEQ ID NO: 428235 - DNA, 25 bp, Mus musculus
gaaaacttctctggggcggactgca

SEQ ID NO: 428236 - DNA, 25 bp, Mus musculus
tggtccaccaggagccctactcggt

SEQ ID NO: 428237 - DNA, 25 bp, Mus musculus
atctttctctctggacatgtccggc

SEQ ID NO: 428238 - DNA, 25 bp, Mus musculus
gcgtactgtgagtttggccagcatc

SEQ ID NO: 428239 - DNA, 25 bp, Mus musculus
tggcgctttctcctgcgtactgtga

SEQ ID NO: 428240 - DNA, 25 bp, Mus musculus
gccaggctacggtgctccagagcca

SEQ ID NO: 428241 - DNA, 25 bp, Mus musculus
gtacatactcttcccagaacgccga

SEQ ID NO: 428242 - DNA, 25 bp, Mus musculus
agccggacttgtccggcttcctgcg

SEQ ID NO: 428243 - DNA, 25 bp, Mus musculus
ttcctgcgctgtcagcggacgcctg

SEQ ID NO: 428244 - DNA, 25 bp, Mus musculus
tcgcgatatggtgacgtcacgaagc

SEQ ID NO: 428245 - DNA, 25 bp, Mus musculus
ttcgcagtcgcgatatggtgacgtc

SEQ ID NO: 428246 - DNA, 25 bp, Mus musculus
ttctccaaggaatatagggaccgcc

SEQ ID NO: 428247 - DNA, 25 bp, Mus musculus
gcaagcacttaactcttctccaagg

SEQ ID NO: 428248 - DNA, 25 bp, Mus musculus
agccagtaccgctgcaagcacttaa

SEQ ID NO: 428249 - DNA, 25 bp, Mus musculus
tttacctggtcgttgcagccggact

SEQ ID NO: 428250 - DNA, 25 bp, Mus musculus
aactccctctgagttggcctagcct

SEQ ID NO: 428251 - DNA, 25 bp, Mus musculus
aacgtccggttcaactccctctgag

SEQ ID NO: 428252 - DNA, 25 bp, Mus musculus
atctgggaaccgaggtcagccactc

SEQ ID NO: 428253 - DNA, 25 bp, Mus musculus
ccctgctgatctgggaaccgaggtc

SEQ ID NO: 428254 - DNA, 25 bp, Mus musculus
gccgtgcgtgtgaccctgctgatct

SEQ ID NO: 428255 - DNA, 25 bp, Mus musculus
gggcggagaagccacagccagtacc

SEQ ID NO: 428256 - DNA, 25 bp, Mus musculus
cctatacggtccagctccagactga

SEQ ID NO: 428257 - DNA, 25 bp, Mus musculus
ccggctcaactttccaaattagcca

SEQ ID NO: 428258 - DNA, 25 bp, Mus musculus
ccaaattagccaccaaacttcgagg

SEQ ID NO: 428259 - DNA, 25 bp, Mus musculus
caccaaacttcgaggcgcggcggcg

SEQ ID NO: 428260 - DNA, 25 bp, Mus musculus
ctgctcctgggatcagtgtgagcca

SEQ ID NO: 428261 - DNA, 25 bp, Mus musculus
ggatcagtgtgagccagcagcgtcc

SEQ ID NO: 428262 - DNA, 25 bp, Mus musculus
ccattccacgcacggggcaccacga

SEQ ID NO: 428263 - DNA, 25 bp, Mus musculus
ctcattggcctaggcgcagcgacca

SEQ ID NO: 428264 - DNA, 25 bp, Mus musculus
tccttgccagcccaggaagaggcgg

SEQ ID NO: 428265 - DNA, 25 bp, Mus musculus
agaaccggtcgtgatgctggagccc

SEQ ID NO: 428266 - DNA, 25 bp, Mus musculus
ctccagactgaacctggctggtcgc

SEQ ID NO: 428267 - DNA, 25 bp, Mus musculus
actgaacctggctggtcgccacgac

SEQ ID NO: 428268 - DNA, 25 bp, Mus musculus
cagtgagcagaaccggtcgtgatgc

SEQ ID NO: 428269 - DNA, 25 bp, Mus musculus
gcgcagcgaccactctgggactcgt

SEQ ID NO: 428270 - DNA, 25 bp, Mus musculus
tcctgggcacccgagcgaatgccag

SEQ ID NO: 428271 - DNA, 25 bp, Mus musculus
gccgtgcatccttctgtagccttct

SEQ ID NO: 428272 - DNA, 25 bp, Mus musculus
accagcacggggcaggccgtgcatc

SEQ ID NO: 428273 - DNA, 25 bp, Mus musculus
ctgtcacagcttcgggcaggctcag

SEQ ID NO: 428274 - DNA, 25 bp, Mus musculus
ttgaaccacggagaggaatcgtcgc

SEQ ID NO: 428275 - DNA, 25 bp, Mus musculus
agcgaatgccaggtgctccacgcgc

SEQ ID NO: 428276 - DNA, 25 bp, Mus musculus
tggctctacaaaccggcccgacagg

SEQ ID NO: 428277 - DNA, 25 bp, Mus musculus
acaggtttgggctccggagctacca

SEQ ID NO: 428278 - DNA, 25 bp, Mus musculus
caagaggggccagctctcgtgtcct

SEQ ID NO: 428279 - DNA, 25 bp, Mus musculus
cccgacgcgcgaacaagaggggcca

SEQ ID NO: 428280 - DNA, 25 bp, Mus musculus
ttaagttgaaccacggagaggaatc

SEQ ID NO: 428281 - DNA, 25 bp, Mus musculus
cgcacggtgccatagagggagttca

SEQ ID NO: 428282 - DNA, 25 bp, Mus musculus
aggaatcgtcgcacggtgccataga

SEQ ID NO: 428283 - DNA, 25 bp, Mus musculus
ggacccgcagtcgtctgtcacagct

SEQ ID NO: 428284 - DNA, 25 bp, Mus musculus
cggctgcttacctccgcggcctcat

SEQ ID NO: 428285 - DNA, 25 bp, Mus musculus
gtcacttcctgacggagctcggccg

SEQ ID NO: 428286 - DNA, 25 bp, Mus musculus
cgcccagcgcgcgagattgaacctt

SEQ ID NO: 428287 - DNA, 25 bp, Mus musculus
gcgcgcgagattgaaccttccattc

SEQ ID NO: 428288 - DNA, 25 bp, Mus musculus
attgaaccttccattcattccgggg

SEQ ID NO: 428289 - DNA, 25 bp, Mus musculus
cgcgagcctgtcacttcctgacgga

SEQ ID NO: 428290 - DNA, 25 bp, Mus musculus
gctcgacgttgctcacgtgcgacac

SEQ ID NO: 428291 - DNA, 25 bp, Mus musculus
agctccgctcgacgttgctcacgtg

SEQ ID NO: 428292 - DNA, 25 bp, Mus musculus
aacttgtcgcgggacctgtcacacc

SEQ ID NO: 428293 - DNA, 25 bp, Mus musculus
cgcacggcaacttgtcgcgggacct

SEQ ID NO: 428294 - DNA, 25 bp, Mus musculus
gaagtacaagcacggcccgcgcctg

SEQ ID NO: 428295 - DNA, 25 bp, Mus musculus
ggtgtgaacccggaagtacaagcac

SEQ ID NO: 428296 - DNA, 25 bp, Mus musculus
gcggcctttctctccgcgtcctgtc

SEQ ID NO: 428297 - DNA, 25 bp, Mus musculus
ttcttcgggaagcttccagagccgc

SEQ ID NO: 428298 - DNA, 25 bp, Mus musculus
ctgtagcccgccctacttctgacta

SEQ ID NO: 428299 - DNA, 25 bp, Mus musculus
agacactctagctctgcagctcgag

SEQ ID NO: 428300 - DNA, 25 bp, Mus musculus
ttgctgtgccctttcagacactcta

SEQ ID NO: 428301 - DNA, 25 bp, Mus musculus
ttgtgagtctgaagaggctctgcgt

SEQ ID NO: 428302 - DNA, 25 bp, Mus musculus
ttcgcttgtgagtctgaagaggctc

SEQ ID NO: 428303 - DNA, 25 bp, Mus musculus
ctgcctgtgcttcgcttgtgagtct

SEQ ID NO: 428304 - DNA, 25 bp, Mus musculus
cggtagagacttagactcgcgagga

SEQ ID NO: 428305 - DNA, 25 bp, Mus musculus
tctttgccccgctgagtaggatcgc

SEQ ID NO: 428306 - DNA, 25 bp, Mus musculus
ctccagacctttgggttattgttct

SEQ ID NO: 428307 - DNA, 25 bp, Mus musculus
tttgcggctccagacctttgggtta

SEQ ID NO: 428308 - DNA, 25 bp, Mus musculus
cagacgttcgtgtcctttgcggctc

SEQ ID NO: 428309 - DNA, 25 bp, Mus musculus
cgcgaggaacccagacgttcgtgtc

SEQ ID NO: 428310 - DNA, 25 bp, Mus musculus
tagactcgcgaggaacccagacgtt

SEQ ID NO: 428311 - DNA, 25 bp, Mus musculus
gctcctcctaccgacgacttctgca

SEQ ID NO: 428312 - DNA, 25 bp, Mus musculus
gaagcatcaatagccggcgcgccgt

SEQ ID NO: 428313 - DNA, 25 bp, Mus musculus
cggcctctgagctccaatcatagtg

SEQ ID NO: 428314 - DNA, 25 bp, Mus musculus
gtccactcggcttcttgaacaccta

SEQ ID NO: 428315 - DNA, 25 bp, Mus musculus
cttcccagaagcatcaatagccggc

SEQ ID NO: 428316 - DNA, 25 bp, Mus musculus
agctccaatcatagtgttgcctttg

SEQ ID NO: 428317 - DNA, 25 bp, Mus musculus
ctgcgcgaagatcttcggcctctga

SEQ ID NO: 428318 - DNA, 25 bp, Mus musculus
caccgcctcgtgtcgggaaggcagt

SEQ ID NO: 428319 - DNA, 25 bp, Mus musculus
aacactcaccgcctcgtgtcgggaa

SEQ ID NO: 428320 - DNA, 25 bp, Mus musculus
gtactgggaacctgcgaacactcac

SEQ ID NO: 428321 - DNA, 25 bp, Mus musculus
caagagtactgggaacctgcgaaca

SEQ ID NO: 428322 - DNA, 25 bp, Mus musculus
ctcacctttggcaagagtactggga

SEQ ID NO: 428323 - DNA, 25 bp, Mus musculus
ctagacccgcaaccctcacctttgg

SEQ ID NO: 428324 - DNA, 25 bp, Mus musculus
ggcttcttgaacacctagacccgca

SEQ ID NO: 428325 - DNA, 25 bp, Mus musculus
gttgcctttgcatgaactacacttc

SEQ ID NO: 428326 - DNA, 25 bp, Mus musculus
ccctgagcagctgtccgaggctgag

SEQ ID NO: 428327 - DNA, 25 bp, Mus musculus
ctttccctcgggtctgtcgagtcta

SEQ ID NO: 428328 - DNA, 25 bp, Mus musculus
ctgtcgagtctaggctccaggaacg

SEQ ID NO: 428329 - DNA, 25 bp, Mus musculus
cgagaagtcgccgagtccttgatct

SEQ ID NO: 428330 - DNA, 25 bp, Mus musculus
ttgatctcagtctcccattcgggtc

SEQ ID NO: 428331 - DNA, 25 bp, Mus musculus
cattgtgtagcttgcaggcaggtga

SEQ ID NO: 428332 - DNA, 25 bp, Mus musculus
aggctgtctccctgcattgtgtagc

SEQ ID NO: 428333 - DNA, 25 bp, Mus musculus
gaacttgtgacaaggcgcggtcgca

SEQ ID NO: 428334 - DNA, 25 bp, Mus musculus
ctctgcgctgacgacgaacttgtga

SEQ ID NO: 428335 - DNA, 25 bp, Mus musculus
aatggtggccctcgagcctcagcac

SEQ ID NO: 428336 - DNA, 25 bp, Mus musculus
ggcagttttccgtgtgcgctgaatg

SEQ ID NO: 428337 - DNA, 25 bp, Mus musculus
ccgaggctgagcctgactcagtttc

SEQ ID NO: 428338 - DNA, 25 bp, Mus musculus
ctgtgtgaccttgcgcgccttctgt

SEQ ID NO: 428339 - DNA, 25 bp, Mus musculus
cctctgtggtccacgagggcagttt

SEQ ID NO: 428340 - DNA, 25 bp, Mus musculus
ctctgaagatctgcaggactgggtt

SEQ ID NO: 428341 - DNA, 25 bp, Mus musculus
tacgctcctgacctaaccctagttg

SEQ ID NO: 428342 - DNA, 25 bp, Mus musculus
gccctgaaacccgacggagtgctct

SEQ ID NO: 428343 - DNA, 25 bp, Mus musculus
cgtcggccttgggactggacacgct

SEQ ID NO: 428344 - DNA, 25 bp, Mus musculus
aaccctagttgccacctgcctgagg

SEQ ID NO: 428345 - DNA, 25 bp, Mus musculus
tgggaatctgtacgctcctgaccta

SEQ ID NO: 428346 - DNA, 25 bp, Mus musculus
actgggttgggaatctgtacgctcc

SEQ ID NO: 428347 - DNA, 25 bp, Mus musculus
cccgacggagtgctctctgaagatc

SEQ ID NO: 428348 - DNA, 25 bp, Mus musculus
acaaggctgaatcgcctctggcgcc

SEQ ID NO: 428349 - DNA, 25 bp, Mus musculus
ctgccctagaggacaaggctgaatc

SEQ ID NO: 428350 - DNA, 25 bp, Mus musculus
tctactgccctagaggacaaggctg

SEQ ID NO: 428351 - DNA, 25 bp, Mus musculus
gcgcgggttaaaagctgaaaagcca

SEQ ID NO: 428352 - DNA, 25 bp, Mus musculus
ttgggactggacacgctcgcctccg

SEQ ID NO: 428353 - DNA, 25 bp, Mus musculus
gcgcgctgcacttccctgtgttgcg

SEQ ID NO: 428354 - DNA, 25 bp, Mus musculus
ggctcagcaagatgacgctatcagc

SEQ ID NO: 428355 - DNA, 25 bp, Mus musculus
gagctgggatgtgggaccctctacc

SEQ ID NO: 428356 - DNA, 25 bp, Mus musculus
cagcttcagctcctgcccgcggcgc

SEQ ID NO: 428357 - DNA, 25 bp, Mus musculus
cggttgtcagggaaaccaaagctag

SEQ ID NO: 428358 - DNA, 25 bp, Mus musculus
tcagggaaaccaaagctagggctca

SEQ ID NO: 428359 - DNA, 25 bp, Mus musculus
gctagggctcagcaagatgacgcta

SEQ ID NO: 428360 - DNA, 25 bp, Mus musculus
atgacgctatcagcgggcgccacaa

SEQ ID NO: 428361 - DNA, 25 bp, Mus musculus
cccgtgccacaggttgcactaaacg

SEQ ID NO: 428362 - DNA, 25 bp, Mus musculus
tgccacaggttgcactaaacggtcg

SEQ ID NO: 428363 - DNA, 25 bp, Mus musculus
ctttctggaggttttatctacggcg

SEQ ID NO: 428364 - DNA, 25 bp, Mus musculus
caaggctttctggaggttttatcta

SEQ ID NO: 428365 - DNA, 25 bp, Mus musculus
ttagttgacccgcaaggctttctgg

SEQ ID NO: 428366 - DNA, 25 bp, Mus musculus
aacccggcgcttggctcccggtgag

SEQ ID NO: 428367 - DNA, 25 bp, Mus musculus
agaccgaattcttagttgacccgca

SEQ ID NO: 428368 - DNA, 25 bp, Mus musculus
gcttgaggcccgctctgagtctgcg

SEQ ID NO: 428369 - DNA, 25 bp, Mus musculus
gccattgcaaccactcagcacaaag

SEQ ID NO: 428370 - DNA, 25 bp, Mus musculus
ccaggaccactccagaggcgaaagc

SEQ ID NO: 428371 - DNA, 25 bp, Mus musculus
acggattggcgcaaggatcagatgc

SEQ ID NO: 428372 - DNA, 25 bp, Mus musculus
tagagtgagctacggattggcgcaa

SEQ ID NO: 428373 - DNA, 25 bp, Mus musculus
gatcagatgccacagcgctcgcttg

SEQ ID NO: 428374 - DNA, 25 bp, Mus musculus
tcagcacaaagtagagtgagctacg

SEQ ID NO: 428375 - DNA, 25 bp, Mus musculus
cgaaagccactagcacggacacctg

SEQ ID NO: 428376 - DNA, 25 bp, Mus musculus
cgtgcaaggacgactcctgggtcgc

SEQ ID NO: 428377 - DNA, 25 bp, Mus musculus
ggctcccacgatccgggctgcgttg

SEQ ID NO: 428378 - DNA, 25 bp, Mus musculus
caggccaggtccagctttttctgag

SEQ ID NO: 428379 - DNA, 25 bp, Mus musculus
tccagctttttctgagtcgttgcca

SEQ ID NO: 428380 - DNA, 25 bp, Mus musculus
agtcgttgccagcttgtcctgcagc

SEQ ID NO: 428381 - DNA, 25 bp, Mus musculus
tccgcttcctccagtctaggtaacg

SEQ ID NO: 428382 - DNA, 25 bp, Mus musculus
gacattttctaggttgtccatgacg

SEQ ID NO: 428383 - DNA, 25 bp, Mus musculus
cctggtgcagcgaacccgctgagga

SEQ ID NO: 428384 - DNA, 25 bp, Mus musculus
ttgctgggagacaaagtcccgcctc

SEQ ID NO: 428385 - DNA, 25 bp, Mus musculus
cctgactattggtctccgctgcggg

SEQ ID NO: 428386 - DNA, 25 bp, Mus musculus
cgcagccgcacttgtgatgtcgaac

SEQ ID NO: 428387 - DNA, 25 bp, Mus musculus
tccatgacgagaaaaaacgcgcagc

SEQ ID NO: 428388 - DNA, 25 bp, Mus musculus
gcgcctgagggacccggactctaac

SEQ ID NO: 428389 - DNA, 25 bp, Mus musculus
gcacctgaccgacacttaccgaaag

SEQ ID NO: 428390 - DNA, 25 bp, Mus musculus
ggctgcagcttgcacgtctactcga

SEQ ID NO: 428391 - DNA, 25 bp, Mus musculus
cacaaaacggtagccggctgcagct

SEQ ID NO: 428392 - DNA, 25 bp, Mus musculus
tgcccaaatcctcggcacaaaacgg

SEQ ID NO: 428393 - DNA, 25 bp, Mus musculus
tgacttcagaaggttccgcagactg

SEQ ID NO: 428394 - DNA, 25 bp, Mus musculus
cccatggagaagatacgtgacttca

SEQ ID NO: 428395 - DNA, 25 bp, Mus musculus
cgtccctcgcgtctagaggaagttc

SEQ ID NO: 428396 - DNA, 25 bp, Mus musculus
ctacgggatgtggagcttccagata

SEQ ID NO: 428397 - DNA, 25 bp, Mus musculus
gcgagcacatccctgcagctgtctg

SEQ ID NO: 428398 - DNA, 25 bp, Mus musculus
tccgggagcgagcacatccctgcag

SEQ ID NO: 428399 - DNA, 25 bp, Mus musculus
gctgggcacacaactccggctgctt

SEQ ID NO: 428400 - DNA, 25 bp, Mus musculus
agttttcggtctgcagtcacccggc

SEQ ID NO: 428401 - DNA, 25 bp, Mus musculus
gcgaggagttttcggtctgcagtca

SEQ ID NO: 428402 - DNA, 25 bp, Mus musculus
ggcaactctcagctcccggctacgg

SEQ ID NO: 428403 - DNA, 25 bp, Mus musculus
ggggcggactgctcgcgccttcctt

SEQ ID NO: 428404 - DNA, 25 bp, Mus musculus
gccacgcaacggagaacgcgggtta

SEQ ID NO: 428405 - DNA, 25 bp, Mus musculus
cgcggctcggttaatattcatgagg

SEQ ID NO: 428406 - DNA, 25 bp, Mus musculus
taggccgcggctcggttaatattca

SEQ ID NO: 428407 - DNA, 25 bp, Mus musculus
gggaaagcgacgagcaaaccaccca

SEQ ID NO: 428408 - DNA, 25 bp, Mus musculus
ccggccacctgaagcagaggggaaa

SEQ ID NO: 428409 - DNA, 25 bp, Mus musculus
ctgcagctgtctgccggacaggtct

SEQ ID NO: 428410 - DNA, 25 bp, Mus musculus
agacttaactcttcgctgacgcggg

SEQ ID NO: 428411 - DNA, 25 bp, Mus musculus
tgtctctaatgtcccgctgccctgg

SEQ ID NO: 428412 - DNA, 25 bp, Mus musculus
tgcgtgtctcgctttgtctctaatg

SEQ ID NO: 428413 - DNA, 25 bp, Mus musculus
tagcactcggtagcacatggggaca

SEQ ID NO: 428414 - DNA, 25 bp, Mus musculus
cgttcatatttggttcgtgtcggta

SEQ ID NO: 428415 - DNA, 25 bp, Mus musculus
ccgagacccgagatggtcgttcata

SEQ ID NO: 428416 - DNA, 25 bp, Mus musculus
gcactgcttgaggaaggctaactga

SEQ ID NO: 428417 - DNA, 25 bp, Mus musculus
tcgcaagcctattgcccacggggca

SEQ ID NO: 428418 - DNA, 25 bp, Mus musculus
tagccgactactcctagcccgattg

SEQ ID NO: 428419 - DNA, 25 bp, Mus musculus
gaccacttaggctacgcgtattcca

SEQ ID NO: 428420 - DNA, 25 bp, Mus musculus
tttgcgaccgtcctgtggatattga

SEQ ID NO: 428421 - DNA, 25 bp, Mus musculus
tggccatagtggtcaatttcctttc

SEQ ID NO: 428422 - DNA, 25 bp, Mus musculus
cgcccagactttgcttgtacccatt

SEQ ID NO: 428423 - DNA, 25 bp, Mus musculus
aatcgccttgccttcggctgcctga

SEQ ID NO: 428424 - DNA, 25 bp, Mus musculus
ttccaacaccaagtcgcagcgatgc

SEQ ID NO: 428425 - DNA, 25 bp, Mus musculus
tgcctatagcgaaggcggtcactta

SEQ ID NO: 428426 - DNA, 25 bp, Mus musculus
gcttttgagtgaaccgcgccacggc

SEQ ID NO: 428427 - DNA, 25 bp, Mus musculus
ccaacccggaaagcccagtctgata

SEQ ID NO: 428428 - DNA, 25 bp, Mus musculus
cagtctgatactggggttcctctca

SEQ ID NO: 428429 - DNA, 25 bp, Mus musculus
ggcacccggtgcagcgaaattccaa

SEQ ID NO: 428430 - DNA, 25 bp, Mus musculus
gcacctgaataactcgggacgcgtc

SEQ ID NO: 428431 - DNA, 25 bp, Mus musculus
ttccctcccggatgccggaggaaga

SEQ ID NO: 428432 - DNA, 25 bp, Mus musculus
cagcgggacaccaaagacttgcgaa

SEQ ID NO: 428433 - DNA, 25 bp, Mus musculus
gacttgcgaacaactcaaatggctg

SEQ ID NO: 428434 - DNA, 25 bp, Mus musculus
gctggagccatcttggatttcccga

SEQ ID NO: 428435 - DNA, 25 bp, Mus musculus
cgcctgcgcagttgaaaaaggtgtc

SEQ ID NO: 428436 - DNA, 25 bp, Mus musculus
agcgacaggaccgtcacgatgactc

SEQ ID NO: 428437 - DNA, 25 bp, Mus musculus
aggtgtctgtgcaagtgcctatagc

SEQ ID NO: 428438 - DNA, 25 bp, Mus musculus
agatggctgccgcctgtcggtctga

SEQ ID NO: 428439 - DNA, 25 bp, Mus musculus
cgcctatccgcttcagcccaagacc

SEQ ID NO: 428440 - DNA, 25 bp, Mus musculus
gcaggtgcggcgtccgcgtcaagat

SEQ ID NO: 428441 - DNA, 25 bp, Mus musculus
ctgtcggtctgaggctggcctcctt

SEQ ID NO: 428442 - DNA, 25 bp, Mus musculus
cagctgctgcgagttgccctgtgtc

SEQ ID NO: 428443 - DNA, 25 bp, Mus musculus
ctgcgagttgccctgtgtctcctgt

SEQ ID NO: 428444 - DNA, 25 bp, Mus musculus
tgccctgtgtctcctgtgctgggtc

SEQ ID NO: 428445 - DNA, 25 bp, Mus musculus
tgtgtctcctgtgctgggtcccggc

SEQ ID NO: 428446 - DNA, 25 bp, Mus musculus
ggctgtggacgcagtccccgagctc

SEQ ID NO: 428447 - DNA, 25 bp, Mus musculus
gctttggacgaggacggtcaatgac

SEQ ID NO: 428448 - DNA, 25 bp, Mus musculus
cggtcaatgacgtaagtgctctgta

SEQ ID NO: 428449 - DNA, 25 bp, Mus musculus
caatgacgtaagtgctctgtaggga

SEQ ID NO: 428450 - DNA, 25 bp, Mus musculus
gacgtaagtgctctgtagggactga

SEQ ID NO: 428451 - DNA, 25 bp, Mus musculus
gcattcacgcccgtgctctcgttcc

SEQ ID NO: 428452 - DNA, 25 bp, Mus musculus
tgggcctgaagctgcccgtttggtt

SEQ ID NO: 428453 - DNA, 25 bp, Mus musculus
ggtagctgaagcgttcgcctcccga

SEQ ID NO: 428454 - DNA, 25 bp, Mus musculus
gtggcccacaggaagtcctcgcctt

SEQ ID NO: 428455 - DNA, 25 bp, Mus musculus
aaggcgtttccgtctccggtgtcat

SEQ ID NO: 428456 - DNA, 25 bp, Mus musculus
tgtcatggcggcctccttccctgaa

SEQ ID NO: 428457 - DNA, 25 bp, Mus musculus
agagaccgcagttcgggcaccggtt

SEQ ID NO: 428458 - DNA, 25 bp, Mus musculus
acaacgtgaagtggtccgaggagca

SEQ ID NO: 428459 - DNA, 25 bp, Mus musculus
cccggagcacttggagaaaagccct

SEQ ID NO: 428460 - DNA, 25 bp, Mus musculus
tcactgacctgatggagaactccgg

SEQ ID NO: 428461 - DNA, 25 bp, Mus musculus
tttggttttcacagggacaacgtga

SEQ ID NO: 428462 - DNA, 25 bp, Mus musculus
tgcccggagaagcaaggtgcgctcc

SEQ ID NO: 428463 - DNA, 25 bp, Mus musculus
tcctccagacggcaagaaaaatggg

SEQ ID NO: 428464 - DNA, 25 bp, Mus musculus
caccgggatcgttttatcactgacc

SEQ ID NO: 428465 - DNA, 25 bp, Mus musculus
gcgtcttccatcacaatgcctggta

SEQ ID NO: 428466 - DNA, 25 bp, Mus musculus
cgcactgcggccagagaacagcgac

SEQ ID NO: 428467 - DNA, 25 bp, Mus musculus
cgcgaggcgtcgcacccgttctttt

SEQ ID NO: 428468 - DNA, 25 bp, Mus musculus
gcacccgttcttttcccagagcaga

SEQ ID NO: 428469 - DNA, 25 bp, Mus musculus
ttcttttcccagagcagaggattgg

SEQ ID NO: 428470 - DNA, 25 bp, Mus musculus
attgggcgagctcccaggcgcattc

SEQ ID NO: 428471 - DNA, 25 bp, Mus musculus
caggcgcattccaggctccacagct

SEQ ID NO: 428472 - DNA, 25 bp, Mus musculus
cgcgtcgtcgggacagtcccgtgca

SEQ ID NO: 428473 - DNA, 25 bp, Mus musculus
agtcccgcttcccaaggaggtagcg

SEQ ID NO: 428474 - DNA, 25 bp, Mus musculus
aagctgcaagggacccgcgcactgc

SEQ ID NO: 428475 - DNA, 25 bp, Mus musculus
ggccagagaacagcgacctgccttc

SEQ ID NO: 428476 - DNA, 25 bp, Mus musculus
ccagcagcaaggctgtgagtggcaa

SEQ ID NO: 428477 - DNA, 25 bp, Mus musculus
cacagcgcgcgcttttcctcctctt

SEQ ID NO: 428478 - DNA, 25 bp, Mus musculus
cgcgggctttccaggtcagtgtccc

SEQ ID NO: 428479 - DNA, 25 bp, Mus musculus
ggactagtggccttggaagctgcaa

SEQ ID NO: 428480 - DNA, 25 bp, Mus musculus
cgcagtcgctcggtgtaagttaatc

SEQ ID NO: 428481 - DNA, 25 bp, Mus musculus
gattccacctgagcagcaccacggg

SEQ ID NO: 428482 - DNA, 25 bp, Mus musculus
gcgggattccacctgagcagcacca

SEQ ID NO: 428483 - DNA, 25 bp, Mus musculus
attgcagctgcgaggcgggattcca

SEQ ID NO: 428484 - DNA, 25 bp, Mus musculus
agcgggaacagcattgcagctgcga

SEQ ID NO: 428485 - DNA, 25 bp, Mus musculus
gaggcgagcctgtcctcttcccgca

SEQ ID NO: 428486 - DNA, 25 bp, Mus musculus
tgctgtagagtacgccctgggagat

SEQ ID NO: 428487 - DNA, 25 bp, Mus musculus
ttccctgctgtagagtacgccctgg

SEQ ID NO: 428488 - DNA, 25 bp, Mus musculus
ttccttccctgctgtagagtacgcc

SEQ ID NO: 428489 - DNA, 25 bp, Mus musculus
gacattccttccctgctgtagagta

SEQ ID NO: 428490 - DNA, 25 bp, Mus musculus
atcacttgacattccttccctgctg

SEQ ID NO: 428491 - DNA, 25 bp, Mus musculus
ctcggtgtaagttaatcacttgaca

SEQ ID NO: 428492 - DNA, 25 bp, Mus musculus
gtcgctcggtgtaagttaatcactt

SEQ ID NO: 428493 - DNA, 25 bp, Mus musculus
tgagcagcaccacgggcggccacag

SEQ ID NO: 428494 - DNA, 25 bp, Mus musculus
gccggcaaagccacctcggaggtga

SEQ ID NO: 428495 - DNA, 25 bp, Mus musculus
actctctgtacttatgtccgattcg

SEQ ID NO: 428496 - DNA, 25 bp, Mus musculus
cacctcggaggtgactgacagcaaa

SEQ ID NO: 428497 - DNA, 25 bp, Mus musculus
tgcaaaggaccagaacgtggggatc

SEQ ID NO: 428498 - DNA, 25 bp, Mus musculus
tggggatcacctttcctcagggtcg

SEQ ID NO: 428499 - DNA, 25 bp, Mus musculus
tccataactcagacagggaccgttc

SEQ ID NO: 428500 - DNA, 25 bp, Mus musculus
ctccacgccgagcaggtactgaaca

SEQ ID NO: 428501 - DNA, 25 bp, Mus musculus
ggtactgaacaaccagcgaagcgga

SEQ ID NO: 428502 - DNA, 25 bp, Mus musculus
aagcggaggctacagtcgcgccaag

SEQ ID NO: 428503 - DNA, 25 bp, Mus musculus
cacgcgctcgcgctcatgttgcttg

SEQ ID NO: 428504 - DNA, 25 bp, Mus musculus
cgcatgcgcagttctcaccgttggt

SEQ ID NO: 428505 - DNA, 25 bp, Mus musculus
ctttcggtgcctgagctgcgcacgc

SEQ ID NO: 428506 - DNA, 25 bp, Mus musculus
tgacagcaaacacgttaagcgcacg

SEQ ID NO: 428507 - DNA, 25 bp, Mus musculus
gcgcacgcgcaactctctgtactta

SEQ ID NO: 428508 - DNA, 25 bp, Mus musculus
tccggcggcgaatacagactagagc

SEQ ID NO: 428509 - DNA, 25 bp, Mus musculus
tctgtgtcgctcactagtaaccgtg

SEQ ID NO: 428510 - DNA, 25 bp, Mus musculus
actggaaagtctgtgtctgtgtcgc

SEQ ID NO: 428511 - DNA, 25 bp, Mus musculus
tttaccacttcgtcacctgtcggcg

SEQ ID NO: 428512 - DNA, 25 bp, Mus musculus
ggccgttgcccagtctttgcagtta

SEQ ID NO: 428513 - DNA, 25 bp, Mus musculus
tgaggagaaatcaccgttacggcca

SEQ ID NO: 428514 - DNA, 25 bp, Mus musculus
cgccattttctgagccgcctgtttc

SEQ ID NO: 428515 - DNA, 25 bp, Mus musculus
gcggaggaattccacttgcccttta

SEQ ID NO: 428516 - DNA, 25 bp, Mus musculus
gacgggcagtttcctccaatggcta

SEQ ID NO: 428517 - DNA, 25 bp, Mus musculus
ctgccgcagcgagcgtattaaaggc

SEQ ID NO: 428518 - DNA, 25 bp, Mus musculus
tggcctcacacccatcagattgctg

SEQ ID NO: 428519 - DNA, 25 bp, Mus musculus
tccaaagccttagacgacgagtctc

SEQ ID NO: 428520 - DNA, 25 bp, Mus musculus
acagtgtgatgagtccggaactcca

SEQ ID NO: 428521 - DNA, 25 bp, Mus musculus
atctctctggcgttggttgttaata

SEQ ID NO: 428522 - DNA, 25 bp, Mus musculus
gggacaccaggtgcatcctctcctg

SEQ ID NO: 428523 - DNA, 25 bp, Mus musculus
cggaacctgatagtggacgtcgcca

SEQ ID NO: 428524 - DNA, 25 bp, Mus musculus
ggtcaggccgcccagtctgaaaagc

SEQ ID NO: 428525 - DNA, 25 bp, Mus musculus
agccgccaggtcatcaagcgaggtg

SEQ ID NO: 428526 - DNA, 25 bp, Mus musculus
ggaccagtgtctctagaggactttg

SEQ ID NO: 428527 - DNA, 25 bp, Mus musculus
ctttgggtgtctgtgaacgtgtcca

SEQ ID NO: 428528 - DNA, 25 bp, Mus musculus
tgtccagaatctggcgcagtaaccc

SEQ ID NO: 428529 - DNA, 25 bp, Mus musculus
tgcatccagtagcaggtgaccaggc

SEQ ID NO: 428530 - DNA, 25 bp, Mus musculus
tccaggacctttcgcagcttgcaca

SEQ ID NO: 428531 - DNA, 25 bp, Mus musculus
cgcgcgccaatgctccattctgaga

SEQ ID NO: 428532 - DNA, 25 bp, Mus musculus
ttctgagagagcactccggtcccta

SEQ ID NO: 428533 - DNA, 25 bp, Mus musculus
gtcgcagctgcatcaactgccggca

SEQ ID NO: 428534 - DNA, 25 bp, Mus musculus
gtaacccagcgcgaactgctcgaaa

SEQ ID NO: 428535 - DNA, 25 bp, Mus musculus
cgtccaggagctcttcgaggctctg

SEQ ID NO: 428536 - DNA, 25 bp, Mus musculus
tagcgccgcgcggaatcacggtcgt

SEQ ID NO: 428537 - DNA, 25 bp, Mus musculus
acaccttcgtggtgcgcgacgagaa

SEQ ID NO: 428538 - DNA, 25 bp, Mus musculus
cttcgccatgtacaccttcgtggtg

SEQ ID NO: 428539 - DNA, 25 bp, Mus musculus
cgtgccctggactcgtgtagcggct

SEQ ID NO: 428540 - DNA, 25 bp, Mus musculus
gcgcggccctggaattagaccgaca

SEQ ID NO: 428541 - DNA, 25 bp, Mus musculus
ccgctgcgcgcatgaatcggagagc

SEQ ID NO: 428542 - DNA, 25 bp, Mus musculus
cccagggcagacactagggtaatcc

SEQ ID NO: 428543 - DNA, 25 bp, Mus musculus
atagcagcgtctacgccgaggtctc

SEQ ID NO: 428544 - DNA, 25 bp, Mus musculus
ggccaccggctactggaagaggcta

SEQ ID NO: 428545 - DNA, 25 bp, Mus musculus
tggaagaggctacggcgagacaacc

SEQ ID NO: 428546 - DNA, 25 bp, Mus musculus
gaggaaccgactgcccttcgggaga

SEQ ID NO: 428547 - DNA, 25 bp, Mus musculus
ccttcgggagactaggtgagccctt

SEQ ID NO: 428548 - DNA, 25 bp, Mus musculus
actaggtgagcccttccctcgtggc

SEQ ID NO: 428549 - DNA, 25 bp, Mus musculus
agacactagggtaatccggaggcgc

SEQ ID NO: 428550 - DNA, 25 bp, Mus musculus
tccggtctcccgtccgggactggca

SEQ ID NO: 428551 - DNA, 25 bp, Mus musculus
acgtggactccttcaactacgcggc

SEQ ID NO: 428552 - DNA, 25 bp, Mus musculus
gagtagcgtcctagctccggtctcc

SEQ ID NO: 428553 - DNA, 25 bp, Mus musculus
gactccttcaactacgcggcgctgg

SEQ ID NO: 428554 - DNA, 25 bp, Mus musculus
tcgacggccggtggcggaacctgcc

SEQ ID NO: 428555 - DNA, 25 bp, Mus musculus
ccagcgggcccagcctaaagcattt

SEQ ID NO: 428556 - DNA, 25 bp, Mus musculus
gcgggcccagcctaaagcatttaac

SEQ ID NO: 428557 - DNA, 25 bp, Mus musculus
ctccttcaactacgcggcgctggag

SEQ ID NO: 428558 - DNA, 25 bp, Mus musculus
gtgcaggtgagtgccgtgcactgcg

SEQ ID NO: 428559 - DNA, 25 bp, Mus musculus
ggcgcacgtggactccttcaactac

SEQ ID NO: 428560 - DNA, 25 bp, Mus musculus
cagcaaaaggcagctttgcaggacc

SEQ ID NO: 428561 - DNA, 25 bp, Mus musculus
agagcagcaaaaggcagctttgcag

SEQ ID NO: 428562 - DNA, 25 bp, Mus musculus
actggcagaagcatggatgtcgacg

SEQ ID NO: 428563 - DNA, 25 bp, Mus musculus
ggcccagcctaaagcatttaaccga

SEQ ID NO: 428564 - DNA, 25 bp, Mus musculus
tctcgcggggaacgctggacagaca

SEQ ID NO: 428565 - DNA, 25 bp, Mus musculus
agcagcgcctgatgcacctgagcgc

SEQ ID NO: 428566 - DNA, 25 bp, Mus musculus
agctgtggagcagcgcctgatgcac

SEQ ID NO: 428567 - DNA, 25 bp, Mus musculus
ctcattcccaaagcggcgcgggagc

SEQ ID NO: 428568 - DNA, 25 bp, Mus musculus
gaatccagagttcgcatttaccacg

SEQ ID NO: 428569 - DNA, 25 bp, Mus musculus
aaagctgggactagagtcgagcctc

SEQ ID NO: 428570 - DNA, 25 bp, Mus musculus
ctgatgcacctgagcgcgctccggg

SEQ ID NO: 428571 - DNA, 25 bp, Mus musculus
gctccggggagcgtccctggcttac

SEQ ID NO: 428572 - DNA, 25 bp, Mus musculus
ggccacgtctctcgcggggaacgct

SEQ ID NO: 428573 - DNA, 25 bp, Mus musculus
agagtctggcgccttctcactgctc

SEQ ID NO: 428574 - DNA, 25 bp, Mus musculus
ggagcccgaatccagagttcgcatt

SEQ ID NO: 428575 - DNA, 25 bp, Mus musculus
acgacgcctcgcctagagtctggcg

SEQ ID NO: 428576 - DNA, 25 bp, Mus musculus
agttcgcatttaccacgacgcctcg

SEQ ID NO: 428577 - DNA, 25 bp, Mus musculus
gagtcgagcctcattcccaaagcgg

SEQ ID NO: 428578 - DNA, 25 bp, Mus musculus
caccgtctctgtgccgtatgtcttc

SEQ ID NO: 428579 - DNA, 25 bp, Mus musculus
gcgatgcgcaacagaaagtacaact

SEQ ID NO: 428580 - DNA, 25 bp, Mus musculus
acgaaatgttcagggtggaatccgc

SEQ ID NO: 428581 - DNA, 25 bp, Mus musculus
agtgacaccatcgacaccgtctctg

SEQ ID NO: 428582 - DNA, 25 bp, Mus musculus
tacaactgcactgtctgtggccgca

SEQ ID NO: 428583 - DNA, 25 bp, Mus musculus
ccgtcttggtctgcgatgcgcaaca

SEQ ID NO: 428584 - DNA, 25 bp, Mus musculus
ttgagaagcctcctccgtcttggtc

SEQ ID NO: 428585 - DNA, 25 bp, Mus musculus
ggcagtttgctttctccgctacttg

SEQ ID NO: 428586 - DNA, 25 bp, Mus musculus
cgctcacatgtgtgtagagtgtggc

SEQ ID NO: 428587 - DNA, 25 bp, Mus musculus
ctgaccgttctgtcgctcacatgtg

SEQ ID NO: 428588 - DNA, 25 bp, Mus musculus
ttcatgaccggcttttcaactgctc

SEQ ID NO: 428589 - DNA, 25 bp, Mus musculus
acggtacgtctttccttcttcatga

SEQ ID NO: 428590 - DNA, 25 bp, Mus musculus
atgctctgttggcacacggtacgtc

SEQ ID NO: 428591 - DNA, 25 bp, Mus musculus
tgtggccgcagtgacaccatcgaca

SEQ ID NO: 428592 - DNA, 25 bp, Mus musculus
gaagtcctgcttccggtgatcacta

SEQ ID NO: 428593 - DNA, 25 bp, Mus musculus
acgcgaccaccacaagccggaagta

SEQ ID NO: 428594 - DNA, 25 bp, Mus musculus
ctaaaatagctgacggaccggaagt

SEQ ID NO: 428595 - DNA, 25 bp, Mus musculus
cacagccatgaaggttggaccaatg

SEQ ID NO: 428596 - DNA, 25 bp, Mus musculus
ctcgacgaccggaagagtgaggcca

SEQ ID NO: 428597 - DNA, 25 bp, Mus musculus
gggcgccgccataacaacctgatac

SEQ ID NO: 428598 - DNA, 25 bp, Mus musculus
ggcgggtctcttctccctgactgat

SEQ ID NO: 428599 - DNA, 25 bp, Mus musculus
tccctgactgatcggcgcttgaatt

SEQ ID NO: 428600 - DNA, 25 bp, Mus musculus
cagcgtgtgccgagccatagtcacg

SEQ ID NO: 428601 - DNA, 25 bp, Mus musculus
tggcctcaactccagccgggaaagt

SEQ ID NO: 428602 - DNA, 25 bp, Mus musculus
ctgacctacagggaaccagctctgg

SEQ ID NO: 428603 - DNA, 25 bp, Mus musculus
aaccagctctggtgctctgtgcctg

SEQ ID NO: 428604 - DNA, 25 bp, Mus musculus
gctgctcgatcacggccgaagtcct

SEQ ID NO: 428605 - DNA, 25 bp, Mus musculus
cgagcggctgtagatctgacctaca

SEQ ID NO: 428606 - DNA, 25 bp, Mus musculus
cagctcccgtgctatgagcagccta

SEQ ID NO: 428607 - DNA, 25 bp, Mus musculus
gtcctcctctgcactgatgtagttg

SEQ ID NO: 428608 - DNA, 25 bp, Mus musculus
cttgtcggcccacaggtaggcgccg

SEQ ID NO: 428609 - DNA, 25 bp, Mus musculus
cgtcgggacggaccttgccctcgat

SEQ ID NO: 428610 - DNA, 25 bp, Mus musculus
ttccgctgtgtgcactgaagtcctc

SEQ ID NO: 428611 - DNA, 25 bp, Mus musculus
aaggtgtagggttcgtgcgtctcct

SEQ ID NO: 428612 - DNA, 25 bp, Mus musculus
gaggccgctcctcaagttcggggct

SEQ ID NO: 428613 - DNA, 25 bp, Mus musculus
tcgcctgtgtccttgccagaggcct

SEQ ID NO: 428614 - DNA, 25 bp, Mus musculus
gccagaagtccacgttcttgcccgg

SEQ ID NO: 428615 - DNA, 25 bp, Mus musculus
tcttgcccggctccagttccatgga

SEQ ID NO: 428616 - DNA, 25 bp, Mus musculus
ccagttccatggacacctggatgtc

SEQ ID NO: 428617 - DNA, 25 bp, Mus musculus
tgtcctcgagcaggtcctccatgtc

SEQ ID NO: 428618 - DNA, 25 bp, Mus musculus
ccgccaccgtgaggcggttgagaaa

SEQ ID NO: 428619 - DNA, 25 bp, Mus musculus
gctgaactgaactgcgcctcgtcct

SEQ ID NO: 428620 - DNA, 25 bp, Mus musculus
gtctcgttcttctggtctctctgtt

SEQ ID NO: 428621 - DNA, 25 bp, Mus musculus
tcctttcttctctggagtgggctcg

SEQ ID NO: 428622 - DNA, 25 bp, Mus musculus
ttcggccctcagtttcctttggtga

SEQ ID NO: 428623 - DNA, 25 bp, Mus musculus
ttcacgagtgggtagagagtccctc

SEQ ID NO: 428624 - DNA, 25 bp, Mus musculus
gtgttttcacctctcgcctgctgag

SEQ ID NO: 428625 - DNA, 25 bp, Mus musculus
gaccagcctgtggttgcgtcacatc

SEQ ID NO: 428626 - DNA, 25 bp, Mus musculus
caccggtggtgcaaaggtcctttct

SEQ ID NO: 428627 - DNA, 25 bp, Mus musculus
ggcgccgggaaactaatgacccatg

SEQ ID NO: 428628 - DNA, 25 bp, Mus musculus
ctgggaacgcaagcctatcctcgtg

SEQ ID NO: 428629 - DNA, 25 bp, Mus musculus
tggggcgcagaaccggctataaata

SEQ ID NO: 428630 - DNA, 25 bp, Mus musculus
tgctctctatatgatggccgccggc

SEQ ID NO: 428631 - DNA, 25 bp, Mus musculus
ctttccgttttcacacaagtgcgtg

SEQ ID NO: 428632 - DNA, 25 bp, Mus musculus
tggccagcgcagacaggataacccg

SEQ ID NO: 428633 - DNA, 25 bp, Mus musculus
cggccaagggcaagtctcagcacac

SEQ ID NO: 428634 - DNA, 25 bp, Mus musculus
ggtccagcgtccttaacctaactga

SEQ ID NO: 428635 - DNA, 25 bp, Mus musculus
tcgccaataaaaagacggagagggc

SEQ ID NO: 428636 - DNA, 25 bp, Mus musculus
ccgcgactttgaaattcgccaataa

SEQ ID NO: 428637 - DNA, 25 bp, Mus musculus
gctcctattggcttccgcgactttg

SEQ ID NO: 428638 - DNA, 25 bp, Mus musculus
ggcgcccgtctggacgctcctattg

SEQ ID NO: 428639 - DNA, 25 bp, Mus musculus
tgttctagtacgagaaccgggcgcc

SEQ ID NO: 428640 - DNA, 25 bp, Mus musculus
ggcgcgccttgttctagtacgagaa

SEQ ID NO: 428641 - DNA, 25 bp, Mus musculus
ttcttccttcaaagggcgcgccttg

SEQ ID NO: 428642 - DNA, 25 bp, Mus musculus
ctctacggcgacagtttcttccttc

SEQ ID NO: 428643 - DNA, 25 bp, Mus musculus
ccaccatggctctacggcgacagtt

SEQ ID NO: 428644 - DNA, 25 bp, Mus musculus
acttacccgcggctgcgctggcagt

SEQ ID NO: 428645 - DNA, 25 bp, Mus musculus
agcttctggaggctgccgaccacac

SEQ ID NO: 428646 - DNA, 25 bp, Mus musculus
cgtccttaacctaactgagctcggg

SEQ ID NO: 428647 - DNA, 25 bp, Mus musculus
gcgggataacaggaaatggacattc

SEQ ID NO: 428648 - DNA, 25 bp, Mus musculus
cccgctcgcgcttgctctccgatct

SEQ ID NO: 428649 - DNA, 25 bp, Mus musculus
gctgctctgcctgctgctctccgcg

SEQ ID NO: 428650 - DNA, 25 bp, Mus musculus
cctcgcgctggcctcgcgacggctc

SEQ ID NO: 428651 - DNA, 25 bp, Mus musculus
cctcgcgacggctccgcacagcccg

SEQ ID NO: 428652 - DNA, 25 bp, Mus musculus
gcacagcccgcactcgctctgcgag

SEQ ID NO: 428653 - DNA, 25 bp, Mus musculus
gcccgcactcgctctgcgagctgtc

SEQ ID NO: 428654 - DNA, 25 bp, Mus musculus
cgcgcttgctctccgatctccgtcc

SEQ ID NO: 428655 - DNA, 25 bp, Mus musculus
ctggctctgcgcctggctccctcgg

SEQ ID NO: 428656 - DNA, 25 bp, Mus musculus
ggcccggcgtcacgctcccggagtc

SEQ ID NO: 428657 - DNA, 25 bp, Mus musculus
cccgctcggcggcgtctcattgtgg

SEQ ID NO: 428658 - DNA, 25 bp, Mus musculus
ggccttagtcgttcgcccgcgccgc

SEQ ID NO: 428659 - DNA, 25 bp, Mus musculus
ctccctccttgctctgcagccgcgg

SEQ ID NO: 428660 - DNA, 25 bp, Mus musculus
ttccttctccctcgctatccgctcc

SEQ ID NO: 428661 - DNA, 25 bp, Mus musculus
ttgctctgcagccgcggcccatgga

SEQ ID NO: 428662 - DNA, 25 bp, Mus musculus
ggcttcatcattcatccggtcagca

SEQ ID NO: 428663 - DNA, 25 bp, Mus musculus
cgcctgtgcggcttcatcattcatc

SEQ ID NO: 428664 - DNA, 25 bp, Mus musculus
ctcattaaaatggagcgtgcccgcc

SEQ ID NO: 428665 - DNA, 25 bp, Mus musculus
ctgttttctcaagtcctcctcatta

SEQ ID NO: 428666 - DNA, 25 bp, Mus musculus
ccgccatagcgtttggcctgttttc

SEQ ID NO: 428667 - DNA, 25 bp, Mus musculus
tttgcgcaaaaagccgccatagcgt

SEQ ID NO: 428668 - DNA, 25 bp, Mus musculus
actcctcttggggtatttgcgcaaa

SEQ ID NO: 428669 - DNA, 25 bp, Mus musculus
cgggccatctcggaactcctcttgg

SEQ ID NO: 428670 - DNA, 25 bp, Mus musculus
gtacaggtcctcatgccctacctga

SEQ ID NO: 428671 - DNA, 25 bp, Mus musculus
cccatagcgtttgtacaggtcctca

SEQ ID NO: 428672 - DNA, 25 bp, Mus musculus
atagcgcttctggttgtcccacttc

SEQ ID NO: 428673 - DNA, 25 bp, Mus musculus
tgacgccgcaggaaaccaccatagc

SEQ ID NO: 428674 - DNA, 25 bp, Mus musculus
gtcccacttcagcttggggcgaatg

SEQ ID NO: 428675 - DNA, 25 bp, Mus musculus
accaccttgaactgacgccgcagga

SEQ ID NO: 428676 - DNA, 25 bp, Mus musculus
acaagcccggctcggaacggaccat

SEQ ID NO: 428677 - DNA, 25 bp, Mus musculus
gttcgcccggaagaggaacagcgcc

SEQ ID NO: 428678 - DNA, 25 bp, Mus musculus
gtcgtcctcggaagccgatctttta

SEQ ID NO: 428679 - DNA, 25 bp, Mus musculus
ggctctcctgggtttgattcacggg

SEQ ID NO: 428680 - DNA, 25 bp, Mus musculus
tcacgggactgtttacaccgggaga

SEQ ID NO: 428681 - DNA, 25 bp, Mus musculus
gatggggacgatccctacggcttta

SEQ ID NO: 428682 - DNA, 25 bp, Mus musculus
ttctgctcctgacggataagtcggc

SEQ ID NO: 428683 - DNA, 25 bp, Mus musculus
tcgagacggtggctccttcttaaag

SEQ ID NO: 428684 - DNA, 25 bp, Mus musculus
cgccggacgctttaagttcctcatc

SEQ ID NO: 428685 - DNA, 25 bp, Mus musculus
tcgcccttagatcaccatccaaggt

SEQ ID NO: 428686 - DNA, 25 bp, Mus musculus
tcctccacatctcggggctagacgg

SEQ ID NO: 428687 - DNA, 25 bp, Mus musculus
tgtcatcacaagagcagcgccgcga

SEQ ID NO: 428688 - DNA, 25 bp, Mus musculus
cgaagcccagtccagcgggtactgt

SEQ ID NO: 428689 - DNA, 25 bp, Mus musculus
ccgggagcgttgctgtcatcacaag

SEQ ID NO: 428690 - DNA, 25 bp, Mus musculus
ttctctgccacagaggcctagtcgc

SEQ ID NO: 428691 - DNA, 25 bp, Mus musculus
gacacagcccaacatcaaaatacga

SEQ ID NO: 428692 - DNA, 25 bp, Mus musculus
atacgagaagcaaggtcgcgcgcgc

SEQ ID NO: 428693 - DNA, 25 bp, Mus musculus
tccgctgctcgactccggtttcggg

SEQ ID NO: 428694 - DNA, 25 bp, Mus musculus
gggcacacactgacgcccaagttta

SEQ ID NO: 428695 - DNA, 25 bp, Mus musculus
caagtttaaagctacggaggccgcg

SEQ ID NO: 428696 - DNA, 25 bp, Mus musculus
gacacgacgtttgacggccgcgcat

SEQ ID NO: 428697 - DNA, 25 bp, Mus musculus
gtcgcagcctcacggcaagtccagg

SEQ ID NO: 428698 - DNA, 25 bp, Mus musculus
caagtccaggcctttggcgctggga

SEQ ID NO: 428699 - DNA, 25 bp, Mus musculus
tccggtctctggaacgcaattaggg

SEQ ID NO: 428700 - DNA, 25 bp, Mus musculus
gatggctcagattcccgccggattc

SEQ ID NO: 428701 - DNA, 25 bp, Mus musculus
tgctgcctgcaaaatgccgccgcta

SEQ ID NO: 428702 - DNA, 25 bp, Mus musculus
atgccgccgctagtgaagctacttc

SEQ ID NO: 428703 - DNA, 25 bp, Mus musculus
gtgaagctacttccggtccggcctc

SEQ ID NO: 428704 - DNA, 25 bp, Mus musculus
tatttgcgtagtgaaggccttagcg

SEQ ID NO: 428705 - DNA, 25 bp, Mus musculus
gccgcccggcacacgggtgacaaaa

SEQ ID NO: 428706 - DNA, 25 bp, Mus musculus
actgggaagtttgactgatggccgc

SEQ ID NO: 428707 - DNA, 25 bp, Mus musculus
agcatgcaccgcgtgttcccacgtg

SEQ ID NO: 428708 - DNA, 25 bp, Mus musculus
ctacgcgctgttggcgctgaaggaa

SEQ ID NO: 428709 - DNA, 25 bp, Mus musculus
aggttctgctgcacgtgctgttcga

SEQ ID NO: 428710 - DNA, 25 bp, Mus musculus
ccttagcgtgcgtctgggtttgcat

SEQ ID NO: 428711 - DNA, 25 bp, Mus musculus
cctctgattggtcaaaccggagaag

SEQ ID NO: 428712 - DNA, 25 bp, Mus musculus
acaatggtttcgtccgcagcctctg

SEQ ID NO: 428713 - DNA, 25 bp, Mus musculus
ccctccgaagacctgacaatggttt

SEQ ID NO: 428714 - DNA, 25 bp, Mus musculus
ggcaggagcgacaccattcactaca

SEQ ID NO: 428715 - DNA, 25 bp, Mus musculus
cagcgggaaacctgcgaggcttatc

SEQ ID NO: 428716 - DNA, 25 bp, Mus musculus
gtcccacgaggacccggaatatctg

SEQ ID NO: 428717 - DNA, 25 bp, Mus musculus
tcactacagacgcagtaccggctcg

SEQ ID NO: 428718 - DNA, 25 bp, Mus musculus
gagcttggcggttctttctcccgta

SEQ ID NO: 428719 - DNA, 25 bp, Mus musculus
atgggcgagaacgaagctggactca

SEQ ID NO: 428720 - DNA, 25 bp, Mus musculus
ctcccgtaccaatcggcggtgtgta

SEQ ID NO: 428721 - DNA, 25 bp, Mus musculus
tcctgtcagccctggcgagcttggc

SEQ ID NO: 428722 - DNA, 25 bp, Mus musculus
tgggagctggacttcctgtcagccc

SEQ ID NO: 428723 - DNA, 25 bp, Mus musculus
cgctgccatgttcggccgaggaagt

SEQ ID NO: 428724 - DNA, 25 bp, Mus musculus
cggacattgctcagcgctgccatgt

SEQ ID NO: 428725 - DNA, 25 bp, Mus musculus
cacaaggtcagatcggggacaccgc

SEQ ID NO: 428726 - DNA, 25 bp, Mus musculus
ctgcgacagacacaaggtcagatcg

SEQ ID NO: 428727 - DNA, 25 bp, Mus musculus
agatgttccgagacctctccatgcc

SEQ ID NO: 428728 - DNA, 25 bp, Mus musculus
cgtgagccgtagatgttccgagacc

SEQ ID NO: 428729 - DNA, 25 bp, Mus musculus
actcaagcgtacctggctctgggaa

SEQ ID NO: 428730 - DNA, 25 bp, Mus musculus
acgaagctggactcaagcgtacctg

SEQ ID NO: 428731 - DNA, 25 bp, Mus musculus
ctcactcgggtcagccagcggacat

SEQ ID NO: 428732 - DNA, 25 bp, Mus musculus
cctgcggtgctctgtctccacggtg

SEQ ID NO: 428733 - DNA, 25 bp, Mus musculus
tagtttccaacattcaggccgcgcc

SEQ ID NO: 428734 - DNA, 25 bp, Mus musculus
agcgcgcagtcagcgcaggcgcaga

SEQ ID NO: 428735 - DNA, 25 bp, Mus musculus
aggcggtgccgaaggcgcttccctt

SEQ ID NO: 428736 - DNA, 25 bp, Mus musculus
gttttcttggtgagttaatggagga

SEQ ID NO: 428737 - DNA, 25 bp, Mus musculus
ttaatggaggaggaatggaaagcca

SEQ ID NO: 428738 - DNA, 25 bp, Mus musculus
tggaaagccagcgagagttgttacc

SEQ ID NO: 428739 - DNA, 25 bp, Mus musculus
gccagcgagagttgttaccctagca

SEQ ID NO: 428740 - DNA, 25 bp, Mus musculus
gcgagagttgttaccctagcatccc

SEQ ID NO: 428741 - DNA, 25 bp, Mus musculus
tccacggtgcgtgcgcgagcgctac

SEQ ID NO: 428742 - DNA, 25 bp, Mus musculus
atccacctgtcgcaccggaccctgc

SEQ ID NO: 428743 - DNA, 25 bp, Mus musculus
tgctctgtctccacggtgcgtgcgc

SEQ ID NO: 428744 - DNA, 25 bp, Mus musculus
cgcacgcgtcacataatagtttcca

SEQ ID NO: 428745 - DNA, 25 bp, Mus musculus
aggcctctctttgccatccacctgt

SEQ ID NO: 428746 - DNA, 25 bp, Mus musculus
attccccagcgtggtgtggacgagc

SEQ ID NO: 428747 - DNA, 25 bp, Mus musculus
caaagatgctggagcttcgtctggt

SEQ ID NO: 428748 - DNA, 25 bp, Mus musculus
accacaaagatgctggagcttcgtc

SEQ ID NO: 428749 - DNA, 25 bp, Mus musculus
tgggaccacaaagatgctggagctt

SEQ ID NO: 428750 - DNA, 25 bp, Mus musculus
acttaggagaagaagatgggaccac

SEQ ID NO: 428751 - DNA, 25 bp, Mus musculus
gcggcgcatacttaggagaagaaga

SEQ ID NO: 428752 - DNA, 25 bp, Mus musculus
cgctaaggcgcggaggttaagccga

SEQ ID NO: 428753 - DNA, 25 bp, Mus musculus
tcctagaatcaagcgttggctgagg

SEQ ID NO: 428754 - DNA, 25 bp, Mus musculus
actcctagaatcaagcgttggctga

SEQ ID NO: 428755 - DNA, 25 bp, Mus musculus
aagggtgcagcgactcctagaatca

SEQ ID NO: 428756 - DNA, 25 bp, Mus musculus
ggcaccaagggtgcagcgactccta

SEQ ID NO: 428757 - DNA, 25 bp, Mus musculus
aagccgaggtcaagtggcaccaagg

SEQ ID NO: 428758 - DNA, 25 bp, Mus musculus
gttaagccgaggtcaagtggcacca

SEQ ID NO: 428759 - DNA, 25 bp, Mus musculus
gtggacgagctgccctgcttaggcc

SEQ ID NO: 428760 - DNA, 25 bp, Mus musculus
gtgagaagctcagcccctggacgtg

SEQ ID NO: 428761 - DNA, 25 bp, Mus musculus
ctccgcggcctgaggcgcagcccaa

SEQ ID NO: 428762 - DNA, 25 bp, Mus musculus
tccgactctgtctccacaaaggcgg

SEQ ID NO: 428763 - DNA, 25 bp, Mus musculus
actctgtctccacaaaggcgggctc

SEQ ID NO: 428764 - DNA, 25 bp, Mus musculus
tgtctccacaaaggcgggctcccga

SEQ ID NO: 428765 - DNA, 25 bp, Mus musculus
ccctcagcagccctgtcaggcgcgg

SEQ ID NO: 428766 - DNA, 25 bp, Mus musculus
tcccagccgtgcaaatctcgcgagg

SEQ ID NO: 428767 - DNA, 25 bp, Mus musculus
gccgtgcaaatctcgcgaggaaaca

SEQ ID NO: 428768 - DNA, 25 bp, Mus musculus
tctcgcgaggaaacacgcggtttca

SEQ ID NO: 428769 - DNA, 25 bp, Mus musculus
acgcggtttcactagtgtgtttaca

SEQ ID NO: 428770 - DNA, 25 bp, Mus musculus
ttcactagtgtgtttacaccgatca

SEQ ID NO: 428771 - DNA, 25 bp, Mus musculus
gtgtttacaccgatcactactaatc

SEQ ID NO: 428772 - DNA, 25 bp, Mus musculus
atcactactaatccggaccgaaccg

SEQ ID NO: 428773 - DNA, 25 bp, Mus musculus
cgcagcccaaccgtcggcctccgac

SEQ ID NO: 428774 - DNA, 25 bp, Mus musculus
tcctgcacgcctagctactggagcg

SEQ ID NO: 428775 - DNA, 25 bp, Mus musculus
agaggtaagcgctccacccgaacta

SEQ ID NO: 428776 - DNA, 25 bp, Mus musculus
ttggaccgcttagtgtcgccttcgt

SEQ ID NO: 428777 - DNA, 25 bp, Mus musculus
ttagtgtcgccttcgtcctgcacgc

SEQ ID NO: 428778 - DNA, 25 bp, Mus musculus
gggctccgctctcagtctgttcact

SEQ ID NO: 428779 - DNA, 25 bp, Mus musculus
tccacccgaactagcacgctggttg

SEQ ID NO: 428780 - DNA, 25 bp, Mus musculus
agagcgcgggcatcctggactccaa

SEQ ID NO: 428781 - DNA, 25 bp, Mus musculus
catctgaaagaggagccgctgctgc

SEQ ID NO: 428782 - DNA, 25 bp, Mus musculus
cccgcggtgggctccatctgaaaga

SEQ ID NO: 428783 - DNA, 25 bp, Mus musculus
cgcccacgaactgcgggtccttatg

SEQ ID NO: 428784 - DNA, 25 bp, Mus musculus
tcgggctgagctgagacgcccacag

SEQ ID NO: 428785 - DNA, 25 bp, Mus musculus
ttctctgagaaagcacccgcgaggc

SEQ ID NO: 428786 - DNA, 25 bp, Mus musculus
tcagtctgttcactggctctcaggc

SEQ ID NO: 428787 - DNA, 25 bp, Mus musculus
actagcacgctggttggaccgctta

SEQ ID NO: 428788 - DNA, 25 bp, Mus musculus
tctcagcagagcagctatggcagtg

SEQ ID NO: 428789 - DNA, 25 bp, Mus musculus
cgttcttgtcttcgcaggagctcct

SEQ ID NO: 428790 - DNA, 25 bp, Mus musculus
gcaacctcacctttcgccagtgagt

SEQ ID NO: 428791 - DNA, 25 bp, Mus musculus
ccgtcgtgggtatcaatgccttcag

SEQ ID NO: 428792 - DNA, 25 bp, Mus musculus
atcaatgccttcagcagccctctgg

SEQ ID NO: 428793 - DNA, 25 bp, Mus musculus
ggccatcgccgtcggggataccaca

SEQ ID NO: 428794 - DNA, 25 bp, Mus musculus
ctgccctcaatagcggtgcaacaga

SEQ ID NO: 428795 - DNA, 25 bp, Mus musculus
cggtgcaacagaagagccttgcgct

SEQ ID NO: 428796 - DNA, 25 bp, Mus musculus
ccttgcgctgccagatggttaacag

SEQ ID NO: 428797 - DNA, 25 bp, Mus musculus
ccctgtacggagtgcccagcagtaa

SEQ ID NO: 428798 - DNA, 25 bp, Mus musculus
caggctatgcccgtagctgcggcag

SEQ ID NO: 428799 - DNA, 25 bp, Mus musculus
cagtaaccaggtatggcgcctctgc

SEQ ID NO: 428800 - DNA, 25 bp, Mus musculus
tggttaacagccactctcccgcagg

SEQ ID NO: 428801 - DNA, 25 bp, Mus musculus
aggagctcctcctgaaacgtgcggc

SEQ ID NO: 428802 - DNA, 25 bp, Mus musculus
gctgactctggtgaaccgcgaggac

SEQ ID NO: 428803 - DNA, 25 bp, Mus musculus
ctggaatccgacaccctaggagggg

SEQ ID NO: 428804 - DNA, 25 bp, Mus musculus
cgcacattctgttcgactgcgcgcg

SEQ ID NO: 428805 - DNA, 25 bp, Mus musculus
ggctgcaaagtcaccgcacattctg

SEQ ID NO: 428806 - DNA, 25 bp, Mus musculus
tgtccggccctacacaggctgcaaa

SEQ ID NO: 428807 - DNA, 25 bp, Mus musculus
tggggtccagagacccaatgtcgca

SEQ ID NO: 428808 - DNA, 25 bp, Mus musculus
tcttggtgggttctcttcttcctgc

SEQ ID NO: 428809 - DNA, 25 bp, Mus musculus
cgaggttcttggtgggttctcttct

SEQ ID NO: 428810 - DNA, 25 bp, Mus musculus
ccagaccgacggaaggcgcaaaggc

SEQ ID NO: 428811 - DNA, 25 bp, Mus musculus
ggcggtcactgcgagcaagagaccc

SEQ ID NO: 428812 - DNA, 25 bp, Mus musculus
cccacatagcgggaagggtcgacga

SEQ ID NO: 428813 - DNA, 25 bp, Mus musculus
acgagcgcgctgtgccgaggttctt

SEQ ID NO: 428814 - DNA, 25 bp, Mus musculus
actctctggaatccgacaccctagg

SEQ ID NO: 428815 - DNA, 25 bp, Mus musculus
aatgtcgcagcctcaccggtgtccg

SEQ ID NO: 428816 - DNA, 25 bp, Mus musculus
agatgctcatggctcccactttcgg

SEQ ID NO: 428817 - DNA, 25 bp, Mus musculus
tggcctccggaaggatgcttagatc

SEQ ID NO: 428818 - DNA, 25 bp, Mus musculus
ctggtccttcctttgcgccaactga

SEQ ID NO: 428819 - DNA, 25 bp, Mus musculus
tttaggggcagcaatctggtccttc

SEQ ID NO: 428820 - DNA, 25 bp, Mus musculus
cgtctgccactttacgcactttagg

SEQ ID NO: 428821 - DNA, 25 bp, Mus musculus
tgccttttacaggtgagctgcccga

SEQ ID NO: 428822 - DNA, 25 bp, Mus musculus
atccactcggggactctgcctttta

SEQ ID NO: 428823 - DNA, 25 bp, Mus musculus
ttacactgcgaactggaatccactc

SEQ ID NO: 428824 - DNA, 25 bp, Mus musculus
cttgccgccagctgtactagacatg

SEQ ID NO: 428825 - DNA, 25 bp, Mus musculus
gctcagcgtagcttgcccacagttc

SEQ ID NO: 428826 - DNA, 25 bp, Mus musculus
tgcccaggttagctgtaggtacgca

SEQ ID NO: 428827 - DNA, 25 bp, Mus musculus
gtctcggcagcgatgtcctgatcta

SEQ ID NO: 428828 - DNA, 25 bp, Mus musculus
tcgcgccagttaccaagtctctcgg

SEQ ID NO: 428829 - DNA, 25 bp, Mus musculus
cccacagttctgatggccgctaagg

SEQ ID NO: 428830 - DNA, 25 bp, Mus musculus
cacagacaggctggaactttgcgga

SEQ ID NO: 428831 - DNA, 25 bp, Mus musculus
agcggtccctggatcctatcctgga

SEQ ID NO: 428832 - DNA, 25 bp, Mus musculus
aggctggaactttgcggacgtcctc

SEQ ID NO: 428833 - DNA, 25 bp, Mus musculus
tcccggaaacgtgcgggacacagac

SEQ ID NO: 428834 - DNA, 25 bp, Mus musculus
cttgtgcatcctggcaccgtggaca

SEQ ID NO: 428835 - DNA, 25 bp, Mus musculus
aggagcgcctctggcttgtgcatcc

SEQ ID NO: 428836 - DNA, 25 bp, Mus musculus
cctctcaacggccaatgacgaagcg

SEQ ID NO: 428837 - DNA, 25 bp, Mus musculus
acggccaatgacgaagcgccttaca

SEQ ID NO: 428838 - DNA, 25 bp, Mus musculus
tgacgaagcgccttacagcccaggc

SEQ ID NO: 428839 - DNA, 25 bp, Mus musculus
ttctcctcgccatggaggcgaggcc

SEQ ID NO: 428840 - DNA, 25 bp, Mus musculus
ggatcctatcctggaggagcgcctc

SEQ ID NO: 428841 - DNA, 25 bp, Mus musculus
gctcggtaagcgttcgcgcctgccg

SEQ ID NO: 428842 - DNA, 25 bp, Mus musculus
cgtcagcgaaccagcgcccgcctct

SEQ ID NO: 428843 - DNA, 25 bp, Mus musculus
cccagcgccgggctcggtaagcgtt

SEQ ID NO: 428844 - DNA, 25 bp, Mus musculus
gctgggctaggctcatctgtggccc

SEQ ID NO: 428845 - DNA, 25 bp, Mus musculus
gacagcaagagctccgcccaacagg

SEQ ID NO: 428846 - DNA, 25 bp, Mus musculus
ccgcccaacagggacgaggacagga

SEQ ID NO: 428847 - DNA, 25 bp, Mus musculus
aatccaaggtcggacgggtgcagac

SEQ ID NO: 428848 - DNA, 25 bp, Mus musculus
accgggagaccgtgcgcgctctcag

SEQ ID NO: 428849 - DNA, 25 bp, Mus musculus
gggtgctgactcgaagcccgtcctc

SEQ ID NO: 428850 - DNA, 25 bp, Mus musculus
cggacgtgcattggaccagacagca

SEQ ID NO: 428851 - DNA, 25 bp, Mus musculus
tcatgttgcgcgctctgaaccgcct

SEQ ID NO: 428852 - DNA, 25 bp, Mus musculus
cgcgctctcaggtgcgtgtgcttgt

SEQ ID NO: 428853 - DNA, 25 bp, Mus musculus
cccagcaagctgtgggtctccaagg

SEQ ID NO: 428854 - DNA, 25 bp, Mus musculus
tttagcgggcgacgcagcccagcaa

SEQ ID NO: 428855 - DNA, 25 bp, Mus musculus
tcctgcggtgtagctgtctttagcg

SEQ ID NO: 428856 - DNA, 25 bp, Mus musculus
ttcttcgtgttgaccgagcgctacc

SEQ ID NO: 428857 - DNA, 25 bp, Mus musculus
ctctacccgagagtccggacgtgca

SEQ ID NO: 428858 - DNA, 25 bp, Mus musculus
agctcagaacactgacccatttctc

SEQ ID NO: 428859 - DNA, 25 bp, Mus musculus
ggaatacctttagcgcgcttccttc

SEQ ID NO: 428860 - DNA, 25 bp, Mus musculus
tctgggaatacctttagcgcgcttc

SEQ ID NO: 428861 - DNA, 25 bp, Mus musculus
gcgctgagcccactttctgggaata

SEQ ID NO: 428862 - DNA, 25 bp, Mus musculus
agtctgccttctcggagcgctgagc

SEQ ID NO: 428863 - DNA, 25 bp, Mus musculus
cgaccctgagtctgccttctcggag

SEQ ID NO: 428864 - DNA, 25 bp, Mus musculus
actgacccatttctcttgcagatgg

SEQ ID NO: 428865 - DNA, 25 bp, Mus musculus
ccgtcgggtttgcagctcagaacac

SEQ ID NO: 428866 - DNA, 25 bp, Mus musculus
attcggattgtgcacggcgcccacc

SEQ ID NO: 428867 - DNA, 25 bp, Mus musculus
ccacagtccggattcggattgtgca

SEQ ID NO: 428868 - DNA, 25 bp, Mus musculus
tcgctctgccacagtccggattcgg

SEQ ID NO: 428869 - DNA, 25 bp, Mus musculus
cgccgtgaaggtaacgacaatgccg

SEQ ID NO: 428870 - DNA, 25 bp, Mus musculus
ttgcagatggctgccgcacagaccc

SEQ ID NO: 428871 - DNA, 25 bp, Mus musculus
ggtaacgacaatgccggagcaccca

SEQ ID NO: 428872 - DNA, 25 bp, Mus musculus
ctgtgtggcgttgcttggctcccga

SEQ ID NO: 428873 - DNA, 25 bp, Mus musculus
tgaggcggaaaaaaccgtcgtggca

SEQ ID NO: 428874 - DNA, 25 bp, Mus musculus
gtcgctgcagcagatgcccacggcg

SEQ ID NO: 428875 - DNA, 25 bp, Mus musculus
tccaagggtgcggtcccaacaatcc

SEQ ID NO: 428876 - DNA, 25 bp, Mus musculus
ccttggggctcagctccaagggtgc

SEQ ID NO: 428877 - DNA, 25 bp, Mus musculus
agctctctgaaggaagagctctgtg

SEQ ID NO: 428878 - DNA, 25 bp, Mus musculus
ggccacgcagctctctgaaggaaga

SEQ ID NO: 428879 - DNA, 25 bp, Mus musculus
agacccggggcttggcagaatccac

SEQ ID NO: 428880 - DNA, 25 bp, Mus musculus
gccgtccagctgtgtggcgttgctt

SEQ ID NO: 428881 - DNA, 25 bp, Mus musculus
gccagctgtaccagccttagcagca

SEQ ID NO: 428882 - DNA, 25 bp, Mus musculus
ggactcccgtgtcccagccagctgt

SEQ ID NO: 428883 - DNA, 25 bp, Mus musculus
ttggcagaatccacggactcccgtg

SEQ ID NO: 428884 - DNA, 25 bp, Mus musculus
cgatggctcagtagacccggggctt

SEQ ID NO: 428885 - DNA, 25 bp, Mus musculus
aaaccgtcgtggcactcgggctcgg

SEQ ID NO: 428886 - DNA, 25 bp, Mus musculus
cgcttacgttggtaccggagccgct

SEQ ID NO: 428887 - DNA, 25 bp, Mus musculus
tgaagcccgcgaaggcagctcccta

SEQ ID NO: 428888 - DNA, 25 bp, Mus musculus
ccgtgagagacgcagactcgatctc

SEQ ID NO: 428889 - DNA, 25 bp, Mus musculus
gaccagggagactgctatcacaaca

SEQ ID NO: 428890 - DNA, 25 bp, Mus musculus
ttgctagggcttcacgtgcacactg

SEQ ID NO: 428891 - DNA, 25 bp, Mus musculus
ggctaagtcactttgctagggcttc

SEQ ID NO: 428892 - DNA, 25 bp, Mus musculus
agtcaatgcacagactcctgcatca

SEQ ID NO: 428893 - DNA, 25 bp, Mus musculus
ccgaccgagaccctaggctaagtca

SEQ ID NO: 428894 - DNA, 25 bp, Mus musculus
aggcagcaagtcgagccacctcgtc

SEQ ID NO: 428895 - DNA, 25 bp, Mus musculus
ccagagtgcaggcagcaagtcgagc

SEQ ID NO: 428896 - DNA, 25 bp, Mus musculus
ataaggtgaccctagagggtgatgc

SEQ ID NO: 428897 - DNA, 25 bp, Mus musculus
tccgccgtgataaggtgaccctaga

SEQ ID NO: 428898 - DNA, 25 bp, Mus musculus
actctcacagcagtccgccgtgata

SEQ ID NO: 428899 - DNA, 25 bp, Mus musculus
cgtgcacactggaacggagagacca

SEQ ID NO: 428900 - DNA, 25 bp, Mus musculus
ctgagcagaaagacgtaagcgggct

SEQ ID NO: 428901 - DNA, 25 bp, Mus musculus
taatcccgagccgacccattgtgga

SEQ ID NO: 428902 - DNA, 25 bp, Mus musculus
cgcggtggcaacatcagctgcatca

SEQ ID NO: 428903 - DNA, 25 bp, Mus musculus
acgacctgccaagggtgagatgatg

SEQ ID NO: 428904 - DNA, 25 bp, Mus musculus
tgcgcgcttccatctccgggcgaag

SEQ ID NO: 428905 - DNA, 25 bp, Mus musculus
tcttgaacacacctcaatgagagcg

SEQ ID NO: 428906 - DNA, 25 bp, Mus musculus
taagcgggctaactatagctgctgg

SEQ ID NO: 428907 - DNA, 25 bp, Mus musculus
atggagcagcatctttggtggccgc

SEQ ID NO: 428908 - DNA, 25 bp, Mus musculus
cgccgctgagctcgcggcttggatc

SEQ ID NO: 428909 - DNA, 25 bp, Mus musculus
cttggatctgtgtgcgcgcttccat

SEQ ID NO: 428910 - DNA, 25 bp, Mus musculus
tagctgctggggatgtaacctgttt

SEQ ID NO: 428911 - DNA, 25 bp, Mus musculus
taacctgtttggctcaaggctgcga

SEQ ID NO: 428912 - DNA, 25 bp, Mus musculus
ctcaaggctgcgaggtgcgtaatcc

SEQ ID NO: 428913 - DNA, 25 bp, Mus musculus
gcatcagcatcagctcttgaacaca

SEQ ID NO: 428914 - DNA, 25 bp, Mus musculus
gccaacttggccaacttcgggagtc

SEQ ID NO: 428915 - DNA, 25 bp, Mus musculus
cttcgccacgcggtgaagttctgcg

SEQ ID NO: 428916 - DNA, 25 bp, Mus musculus
cctcctgggtaaggcgctgccaact

SEQ ID NO: 428917 - DNA, 25 bp, Mus musculus
acctgctgcgctgcgtcttgcttct

SEQ ID NO: 428918 - DNA, 25 bp, Mus musculus
agcgccgcagggatggtacccatcc

SEQ ID NO: 428919 - DNA, 25 bp, Mus musculus
acagcgctagggctgtctctgcacg

SEQ ID NO: 428920 - DNA, 25 bp, Mus musculus
ggcggtcatctgagcacagcgctag

SEQ ID NO: 428921 - DNA, 25 bp, Mus musculus
ggaggcatcacttcgtccggacccg

SEQ ID NO: 428922 - DNA, 25 bp, Mus musculus
tgtggacctcgctgatcctcttctc

SEQ ID NO: 428923 - DNA, 25 bp, Mus musculus
gcacactgggatccttgtggacctc

SEQ ID NO: 428924 - DNA, 25 bp, Mus musculus
taggggaagataaagagcgcacact

SEQ ID NO: 428925 - DNA, 25 bp, Mus musculus
tccaggcccggtctgaaaagagagg

SEQ ID NO: 428926 - DNA, 25 bp, Mus musculus
ctcgcgccagcaggagaagctgtga

SEQ ID NO: 428927 - DNA, 25 bp, Mus musculus
cggaaagttttgcagttgcttcgcc

SEQ ID NO: 428928 - DNA, 25 bp, Mus musculus
agagaagcggcagccgccacgccag

SEQ ID NO: 428929 - DNA, 25 bp, Mus musculus
ctcctccgcaaagctggcaccctgg

SEQ ID NO: 428930 - DNA, 25 bp, Mus musculus
aaagctggcaccctggcgctcacgg

SEQ ID NO: 428931 - DNA, 25 bp, Mus musculus
cgggcacgccgctcagcagccagct

SEQ ID NO: 428932 - DNA, 25 bp, Mus musculus
ccacctccctgcgtagggcccgtgt

SEQ ID NO: 428933 - DNA, 25 bp, Mus musculus
gaaaccagagaagcggcagccgcca

SEQ ID NO: 428934 - DNA, 25 bp, Mus musculus
ttggcctcgtcactctcacaggagg

SEQ ID NO: 428935 - DNA, 25 bp, Mus musculus
tcgtcactctcacaggaggccagcg

SEQ ID NO: 428936 - DNA, 25 bp, Mus musculus
gaggccagcgcctcctgtggctcga

SEQ ID NO: 428937 - DNA, 25 bp, Mus musculus
agcgcctcctgtggctcgaccaggt

SEQ ID NO: 428938 - DNA, 25 bp, Mus musculus
tcctgtggctcgaccaggtccacgg

SEQ ID NO: 428939 - DNA, 25 bp, Mus musculus
ctcgaccaggtccacgggggtcagc

SEQ ID NO: 428940 - DNA, 25 bp, Mus musculus
ctgccggcgcatcttggcctcgtca

SEQ ID NO: 428941 - DNA, 25 bp, Mus musculus
cccatcaacagaaaccagagaagcg

SEQ ID NO: 428942 - DNA, 25 bp, Mus musculus
gcccaccagcggctgcggcaaacgc

SEQ ID NO: 428943 - DNA, 25 bp, Mus musculus
cgcggttggagaaattccacccata

SEQ ID NO: 428944 - DNA, 25 bp, Mus musculus
ttaacccctttggtcgctgagcgcc

SEQ ID NO: 428945 - DNA, 25 bp, Mus musculus
ctagctgtcccgctctctggcgcag

SEQ ID NO: 428946 - DNA, 25 bp, Mus musculus
actgcctcagagtccggcgcagagg

SEQ ID NO: 428947 - DNA, 25 bp, Mus musculus
tgtatcacttactcactgcctcaga

SEQ ID NO: 428948 - DNA, 25 bp, Mus musculus
ccggcaggcctgtatcacttactca

SEQ ID NO: 428949 - DNA, 25 bp, Mus musculus
gcatggtgacctgagggagaacctg

SEQ ID NO: 428950 - DNA, 25 bp, Mus musculus
agcgtccatgacatcatcggcctca

SEQ ID NO: 428951 - DNA, 25 bp, Mus musculus
gccggttgaagcgtccatgacatca

SEQ ID NO: 428952 - DNA, 25 bp, Mus musculus
aagaggtgacataatccgggccgca

SEQ ID NO: 428953 - DNA, 25 bp, Mus musculus
tcggttctccaccaacgcgcgtggc

SEQ ID NO: 428954 - DNA, 25 bp, Mus musculus
ttggagaaattccacccatacctcc

SEQ ID NO: 428955 - DNA, 25 bp, Mus musculus
agaggctcagacaccggcgctagct

SEQ ID NO: 428956 - DNA, 25 bp, Mus musculus
taattccgagtgtgtcctaaggcgc

SEQ ID NO: 428957 - DNA, 25 bp, Mus musculus
aggaaagctcgtcagtgcatgcgca

SEQ ID NO: 428958 - DNA, 25 bp, Mus musculus
tcctaaggcgcgtgcgcaaagctcg

SEQ ID NO: 428959 - DNA, 25 bp, Mus musculus
cgtgcgcaaagctcgggccagcgca

SEQ ID NO: 428960 - DNA, 25 bp, Mus musculus
ggccagcgcacaagctcctcgtaag

SEQ ID NO: 428961 - DNA, 25 bp, Mus musculus
cctcgtaagcacaggaaagctcgtc

SEQ ID NO: 428962 - DNA, 25 bp, Mus musculus
tgcatgcgcacgagtcgagggccta

SEQ ID NO: 428963 - DNA, 25 bp, Mus musculus
tcgagggcctaccaaagcccaggaa

SEQ ID NO: 428964 - DNA, 25 bp, Mus musculus
gaactctgaaaaacggattcctcca

SEQ ID NO: 428965 - DNA, 25 bp, Mus musculus
acggattcctccagccctgggacgg

SEQ ID NO: 428966 - DNA, 25 bp, Mus musculus
ggatcaggccgatgagcaaaactgc

SEQ ID NO: 428967 - DNA, 25 bp, Mus musculus
caccatgacgacagacagccgggca

SEQ ID NO: 428968 - DNA, 25 bp, Mus musculus
cgcgctaattccgagtgtgtcctaa

SEQ ID NO: 428969 - DNA, 25 bp, Mus musculus
gatgagcaaaactgccgccaccaga

SEQ ID NO: 428970 - DNA, 25 bp, Mus musculus
gaagatcgtgtttgtgacgggaaac

SEQ ID NO: 428971 - DNA, 25 bp, Mus musculus
cgacacccgtcagggcgcgggttct

SEQ ID NO: 428972 - DNA, 25 bp, Mus musculus
cggagttgcttagcagaggatctgc

SEQ ID NO: 428973 - DNA, 25 bp, Mus musculus
atctgcgcgctgatagacctctcca

SEQ ID NO: 428974 - DNA, 25 bp, Mus musculus
caagcgcctcagacacaggctgcgg

SEQ ID NO: 428975 - DNA, 25 bp, Mus musculus
cagacacaggctgcgggatgctcat

SEQ ID NO: 428976 - DNA, 25 bp, Mus musculus
cagcagtagccggaggcaagcttca

SEQ ID NO: 428977 - DNA, 25 bp, Mus musculus
ggaggcaagcttcaggcatccgata

SEQ ID NO: 428978 - DNA, 25 bp, Mus musculus
caggcatccgatagggccggaaacc

SEQ ID NO: 428979 - DNA, 25 bp, Mus musculus
ccggcaaagggttactgggcattct

SEQ ID NO: 428980 - DNA, 25 bp, Mus musculus
ttactgggcattctggaccgtaacc

SEQ ID NO: 428981 - DNA, 25 bp, Mus musculus
tggaccgtaaccctcgcttgcaatg

SEQ ID NO: 428982 - DNA, 25 bp, Mus musculus
ctcgcttgcaatggctgcgtctttg

SEQ ID NO: 428983 - DNA, 25 bp, Mus musculus
tgcgtctttggtcgggaagaagatc

SEQ ID NO: 428984 - DNA, 25 bp, Mus musculus
tgtgtgtgtcaagaccgcgaacgca

SEQ ID NO: 428985 - DNA, 25 bp, Mus musculus
ctttctgcacttgcccgtgggctag

SEQ ID NO: 428986 - DNA, 25 bp, Mus musculus
caccttagctgtacgccactgactg

SEQ ID NO: 428987 - DNA, 25 bp, Mus musculus
ggcgcgcctgttttaaaagcttgga

SEQ ID NO: 428988 - DNA, 25 bp, Mus musculus
gacactcactggagcccggagggaa

SEQ ID NO: 428989 - DNA, 25 bp, Mus musculus
cctgggagggactacgaagtttcag

SEQ ID NO: 428990 - DNA, 25 bp, Mus musculus
cgtgaggctgcttccagccaaagtc

SEQ ID NO: 428991 - DNA, 25 bp, Mus musculus
cgcgcactgacattcggaactcttt

SEQ ID NO: 428992 - DNA, 25 bp, Mus musculus
cgcgaacgcagaacaaacacggaca

SEQ ID NO: 428993 - DNA, 25 bp, Mus musculus
cctctcccaggttaggaagtggccg

SEQ ID NO: 428994 - DNA, 25 bp, Mus musculus
gaacgcaatccggtgctgaggacac

SEQ ID NO: 428995 - DNA, 25 bp, Mus musculus
acccgcgaggtctgttctggatcct

SEQ ID NO: 428996 - DNA, 25 bp, Mus musculus
acacggacaggatgcccacggtgtc

SEQ ID NO: 428997 - DNA, 25 bp, Mus musculus
gggcttctcaatcaggactccgtgg

SEQ ID NO: 428998 - DNA, 25 bp, Mus musculus
cgtttgaaacaatcctccgcaagga

SEQ ID NO: 428999 - DNA, 25 bp, Mus musculus
aaccgcagtgggttgtcgagctaca

SEQ ID NO: 429000 - DNA, 25 bp, Mus musculus
tggggatgtcacaatggggtcttcc

SEQ ID NO: 429001 - DNA, 25 bp, Mus musculus
aacacagggcctctagcggtgggct

SEQ ID NO: 429002 - DNA, 25 bp, Mus musculus
gggagctccactcgcgtgaacacag

SEQ ID NO: 429003 - DNA, 25 bp, Mus musculus
atagcagggtccctccagaaggccg

SEQ ID NO: 429004 - DNA, 25 bp, Mus musculus
cctgtccctgggcaaacgttcttct

SEQ ID NO: 429005 - DNA, 25 bp, Mus musculus
acgttcttctcagagccgtttgaaa

SEQ ID NO: 429006 - DNA, 25 bp, Mus musculus
ggaagccatatcagaccacgccctg

SEQ ID NO: 429007 - DNA, 25 bp, Mus musculus
tctcgacgcggcatacctgacggag

SEQ ID NO: 429008 - DNA, 25 bp, Mus musculus
ccactgccaaaggtgccagcgaagc

SEQ ID NO: 429009 - DNA, 25 bp, Mus musculus
ccctaaggtctctcagtgcggtgag

SEQ ID NO: 429010 - DNA, 25 bp, Mus musculus
ggagctacagccacgctcgcggacg

SEQ ID NO: 429011 - DNA, 25 bp, Mus musculus
tcgagctacagacatagcagggtcc

SEQ ID NO: 429012 - DNA, 25 bp, Mus musculus
ctccgtagactaggcgatgttcatc

SEQ ID NO: 429013 - DNA, 25 bp, Mus musculus
atgtgaccggccgtgtgtcaacggc

SEQ ID NO: 429014 - DNA, 25 bp, Mus musculus
cagccgaggccaaggaatgtgaccg

SEQ ID NO: 429015 - DNA, 25 bp, Mus musculus
cccggctgtgtctaccgcgggtgct

SEQ ID NO: 429016 - DNA, 25 bp, Mus musculus
cagcaccgaccctgcaccgcgacag

SEQ ID NO: 429017 - DNA, 25 bp, Mus musculus
aggaagggcaggcagcaccgaccct

SEQ ID NO: 429018 - DNA, 25 bp, Mus musculus
tatgtgttcgctgggcgccggctca

SEQ ID NO: 429019 - DNA, 25 bp, Mus musculus
cttggatatggacccgccgggccac

SEQ ID NO: 429020 - DNA, 25 bp, Mus musculus
acatgctgggcacgccggaagacca

SEQ ID NO: 429021 - DNA, 25 bp, Mus musculus
agcaggtctacatgctgggcacgcc

SEQ ID NO: 429022 - DNA, 25 bp, Mus musculus
ccctggcattgagcaggtctacatg

SEQ ID NO: 429023 - DNA, 25 bp, Mus musculus
ggcgatgttcatccgcgctaagacc

SEQ ID NO: 429024 - DNA, 25 bp, Mus musculus
aagcaaagagcctccgtagactagg

SEQ ID NO: 429025 - DNA, 25 bp, Mus musculus
tccgcgctaagaccctggcattgag

SEQ ID NO: 429026 - DNA, 25 bp, Mus musculus
gcttcgcattcttcgcgccggtttc

SEQ ID NO: 429027 - DNA, 25 bp, Mus musculus
gcgctcacgttgtccaggtagttgg

SEQ ID NO: 429028 - DNA, 25 bp, Mus musculus
ccagcctacctatgaggcctgcgta

SEQ ID NO: 429029 - DNA, 25 bp, Mus musculus
cctatgaggcctgcgtagacgcgca

SEQ ID NO: 429030 - DNA, 25 bp, Mus musculus
gtagacgcgcagacaacgcgggccc

SEQ ID NO: 429031 - DNA, 25 bp, Mus musculus
cagcgattcccgtcggtaaagctcg

SEQ ID NO: 429032 - DNA, 25 bp, Mus musculus
cggaaggcttcgcattcttcgcgcc

SEQ ID NO: 429033 - DNA, 25 bp, Mus musculus
ccgcagaagagcagcgcatgcgtga

SEQ ID NO: 429034 - DNA, 25 bp, Mus musculus
caggcatcgtgccacgtactcagag

SEQ ID NO: 429035 - DNA, 25 bp, Mus musculus
tgccacgtactcagagcgcagctgc

SEQ ID NO: 429036 - DNA, 25 bp, Mus musculus
agagcgcagctgctggcaccgctcg

SEQ ID NO: 429037 - DNA, 25 bp, Mus musculus
tggcaccgctcgtctgctgtacacg

SEQ ID NO: 429038 - DNA, 25 bp, Mus musculus
tccacgcagcgattcccgtcggtaa

SEQ ID NO: 429039 - DNA, 25 bp, Mus musculus
acgcggagccttcgcagccgcagaa

SEQ ID NO: 429040 - DNA, 25 bp, Mus musculus
cacctcacaggagcgcaggagtgtg

SEQ ID NO: 429041 - DNA, 25 bp, Mus musculus
ctccgcagcggacacgagggcagca

SEQ ID NO: 429042 - DNA, 25 bp, Mus musculus
cagcggacacgagggcagcaacagc

SEQ ID NO: 429043 - DNA, 25 bp, Mus musculus
gcacctcgagcccatggctgggagt

SEQ ID NO: 429044 - DNA, 25 bp, Mus musculus
aggagtgtggccctaccctggcccg

SEQ ID NO: 429045 - DNA, 25 bp, Mus musculus
tcctatccacgctggccaagggagg

SEQ ID NO: 429046 - DNA, 25 bp, Mus musculus
actcttgctgtgctgttggctccac

SEQ ID NO: 429047 - DNA, 25 bp, Mus musculus
tttccctctcactcttgctgtgctg

SEQ ID NO: 429048 - DNA, 25 bp, Mus musculus
tctgcaacaatcctatccacgctgg

SEQ ID NO: 429049 - DNA, 25 bp, Mus musculus
cctggcgttatctgcaacaatccta

SEQ ID NO: 429050 - DNA, 25 bp, Mus musculus
atgaccctccctggcgttatctgca

SEQ ID NO: 429051 - DNA, 25 bp, Mus musculus
tgcgggagccaggatgaccctccct

SEQ ID NO: 429052 - DNA, 25 bp, Mus musculus
ctggcccgcaaaacaggagtccgcg

SEQ ID NO: 429053 - DNA, 25 bp, Mus musculus
ggctgggagtgcctttccctctcac

SEQ ID NO: 429054 - DNA, 25 bp, Mus musculus
tcaatcgttttgtgcctggccacca

SEQ ID NO: 429055 - DNA, 25 bp, Mus musculus
agcagcagagcagtcggtggcccta

SEQ ID NO: 429056 - DNA, 25 bp, Mus musculus
ttgagcgcttcgtagcagcagagca

SEQ ID NO: 429057 - DNA, 25 bp, Mus musculus
agcggcgtgtgctcatcaatctgta

SEQ ID NO: 429058 - DNA, 25 bp, Mus musculus
acccacccgagaaattgctggttcg

SEQ ID NO: 429059 - DNA, 25 bp, Mus musculus
ggtaaggcgcagctactgtcctgcg

SEQ ID NO: 429060 - DNA, 25 bp, Mus musculus
tgggcgtgctcaatcgttttgtgcc

SEQ ID NO: 429061 - DNA, 25 bp, Mus musculus
gaagccctgggcactcgtggcctgc

SEQ ID NO: 429062 - DNA, 25 bp, Mus musculus
tggtcccgcatgacgtgggcctcac

SEQ ID NO: 429063 - DNA, 25 bp, Mus musculus
ccatcctcaagggagcagtgctctt

SEQ ID NO: 429064 - DNA, 25 bp, Mus musculus
gagcagtgctcttcggccaggcacc

SEQ ID NO: 429065 - DNA, 25 bp, Mus musculus
ctcacttatggtgtgggcgtgctca

SEQ ID NO: 429066 - DNA, 25 bp, Mus musculus
tcaatctgtactgctgcgctgcgga

SEQ ID NO: 429067 - DNA, 25 bp, Mus musculus
cacggatgtctttgagcgcttcgta

SEQ ID NO: 429068 - DNA, 25 bp, Mus musculus
tgcccagccgaacgctctcggacgc

SEQ ID NO: 429069 - DNA, 25 bp, Mus musculus
gggctcccggatacagcggtcgcac

SEQ ID NO: 429070 - DNA, 25 bp, Mus musculus
atacagcggtcgcacggagcactag

SEQ ID NO: 429071 - DNA, 25 bp, Mus musculus
aacgctctcggacgcgcccgtcgcc

SEQ ID NO: 429072 - DNA, 25 bp, Mus musculus
cccaggagacaggaccctctgaagg

SEQ ID NO: 429073 - DNA, 25 bp, Mus musculus
acaggaccctctgaaggtctcccag

SEQ ID NO: 429074 - DNA, 25 bp, Mus musculus
ctgctgcctgtcacgtctctgtagg

SEQ ID NO: 429075 - DNA, 25 bp, Mus musculus
gccacgctgagaacccgtgcgcgga

SEQ ID NO: 429076 - DNA, 25 bp, Mus musculus
ctgtcacgtctctgtaggatcatga

SEQ ID NO: 429077 - DNA, 25 bp, Mus musculus
acgtctctgtaggatcatgaggctc

SEQ ID NO: 429078 - DNA, 25 bp, Mus musculus
tctgtaggatcatgaggctctcgcc

SEQ ID NO: 429079 - DNA, 25 bp, Mus musculus
ggctctcgccgaagccacgctgaga

SEQ ID NO: 429080 - DNA, 25 bp, Mus musculus
gccgaagccacgctgagaacccgtg

SEQ ID NO: 429081 - DNA, 25 bp, Mus musculus
ctgcctgtcacgtctctgtaggatc

SEQ ID NO: 429082 - DNA, 25 bp, Mus musculus
cacccgcgaggagagtcgcatcctg

SEQ ID NO: 429083 - DNA, 25 bp, Mus musculus
ctggctaacgccactctagagaccg

SEQ ID NO: 429084 - DNA, 25 bp, Mus musculus
caatcaggggccacggggcctaggc

SEQ ID NO: 429085 - DNA, 25 bp, Mus musculus
ttgcaccgccgtggctccaatcagg

SEQ ID NO: 429086 - DNA, 25 bp, Mus musculus
ttccatgggcttcggcgaaagtgga

SEQ ID NO: 429087 - DNA, 25 bp, Mus musculus
ctagagaccgagtggttccatgggc

SEQ ID NO: 429088 - DNA, 25 bp, Mus musculus
ctaacgccactctagagaccgagtg

SEQ ID NO: 429089 - DNA, 25 bp, Mus musculus
gtcgcatcctgctgcaggacctgtc

SEQ ID NO: 429090 - DNA, 25 bp, Mus musculus
cctcctccgctcaccacctggctaa

SEQ ID NO: 429091 - DNA, 25 bp, Mus musculus
aggagagtcgcatcctgctgcagga

SEQ ID NO: 429092 - DNA, 25 bp, Mus musculus
caggccacccgcgaggagagtcgca

SEQ ID NO: 429093 - DNA, 25 bp, Mus musculus
cccgcaggtcttcctccaggccacc

SEQ ID NO: 429094 - DNA, 25 bp, Mus musculus
agcaccgagtcgctgtccacgcccg

SEQ ID NO: 429095 - DNA, 25 bp, Mus musculus
atcaccttcagcaccgagtcgctgt

SEQ ID NO: 429096 - DNA, 25 bp, Mus musculus
cccatgaggtttccgatccgcggca

SEQ ID NO: 429097 - DNA, 25 bp, Mus musculus
gctggaaaccgaccagagcgacctt

SEQ ID NO: 429098 - DNA, 25 bp, Mus musculus
tctaggagttaagcagtcacctttc

SEQ ID NO: 429099 - DNA, 25 bp, Mus musculus
gtcacctttcctactggactgagtc

SEQ ID NO: 429100 - DNA, 25 bp, Mus musculus
gggcacttcagaccaatgagctgtc

SEQ ID NO: 429101 - DNA, 25 bp, Mus musculus
ccgcggcagttttgtctaggagtta

SEQ ID NO: 429102 - DNA, 25 bp, Mus musculus
attagaacaaagaaggcacgcggcg

SEQ ID NO: 429103 - DNA, 25 bp, Mus musculus
tccttcattggcttgaggggcgttg

SEQ ID NO: 429104 - DNA, 25 bp, Mus musculus
agggcccatctcaccttgcaggcga

SEQ ID NO: 429105 - DNA, 25 bp, Mus musculus
tgtctctgagatccaccaattaacg

SEQ ID NO: 429106 - DNA, 25 bp, Mus musculus
ttccacatcacgtgtgcgcggaggc

SEQ ID NO: 429107 - DNA, 25 bp, Mus musculus
gctatgttggaaccgctgctggaaa

SEQ ID NO: 429108 - DNA, 25 bp, Mus musculus
ccacccgacagggtgtgggcgtctt

SEQ ID NO: 429109 - DNA, 25 bp, Mus musculus
gagcttctgctcctggtctccaagg

SEQ ID NO: 429110 - DNA, 25 bp, Mus musculus
agccgccgggagagatcatcgatgc

SEQ ID NO: 429111 - DNA, 25 bp, Mus musculus
ggaggcactagtgagcagctcgctc

SEQ ID NO: 429112 - DNA, 25 bp, Mus musculus
ccaaccctgcgtcggcaggtgagtg

SEQ ID NO: 429113 - DNA, 25 bp, Mus musculus
tcccaaccctgcgtcggcaggtgag

SEQ ID NO: 429114 - DNA, 25 bp, Mus musculus
ggcactagtgagcagctcgctccgc

SEQ ID NO: 429115 - DNA, 25 bp, Mus musculus
cggcgcagccctggcaccgctcacc

SEQ ID NO: 429116 - DNA, 25 bp, Mus musculus
tgcaggaggcactagtgagcagctc

SEQ ID NO: 429117 - DNA, 25 bp, Mus musculus
ccgtagctgcaggaggcactagtga

SEQ ID NO: 429118 - DNA, 25 bp, Mus musculus
agcgccgtagctgcaggaggcacta

SEQ ID NO: 429119 - DNA, 25 bp, Mus musculus
tcggcgttgagcaaccccacgttcg

SEQ ID NO: 429120 - DNA, 25 bp, Mus musculus
ccgggagagatcatcgatgcgcacg

SEQ ID NO: 429121 - DNA, 25 bp, Mus musculus
accgctcaccgctgcttgcgctcgg

SEQ ID NO: 429122 - DNA, 25 bp, Mus musculus
cgttcgctcgaaccctccgcagccg

SEQ ID NO: 429123 - DNA, 25 bp, Mus musculus
ggcgggtactgggaagcccggcgca

SEQ ID NO: 429124 - DNA, 25 bp, Mus musculus
ggatgatccgcgacttctcccggaa

SEQ ID NO: 429125 - DNA, 25 bp, Mus musculus
caggatgatgcccttgaccggcagc

SEQ ID NO: 429126 - DNA, 25 bp, Mus musculus
ttggcgcacagcaaaacgctaaggc

SEQ ID NO: 429127 - DNA, 25 bp, Mus musculus
cgcttgttcttcaggatggtgctca

SEQ ID NO: 429128 - DNA, 25 bp, Mus musculus
tgctggaaccaagcgatgagaagcc

SEQ ID NO: 429129 - DNA, 25 bp, Mus musculus
agcgccttctctttcaggatgatgc

SEQ ID NO: 429130 - DNA, 25 bp, Mus musculus
cagtgaagtcgtccatgcccagctc

SEQ ID NO: 429131 - DNA, 25 bp, Mus musculus
gccagccgttggaagcagtgaagtc

SEQ ID NO: 429132 - DNA, 25 bp, Mus musculus
tgcggaagcgatccagccagccgtt

SEQ ID NO: 429133 - DNA, 25 bp, Mus musculus
agcttcgcgcccgagaacgggtcac

SEQ ID NO: 429134 - DNA, 25 bp, Mus musculus
ctgaacacgtcctgcgaggcgtagc

SEQ ID NO: 429135 - DNA, 25 bp, Mus musculus
aagtcgtaccacaggctggtctcgg

SEQ ID NO: 429136 - DNA, 25 bp, Mus musculus
gcctggtccgacagaaagtcgtacc

SEQ ID NO: 429137 - DNA, 25 bp, Mus musculus
ccctccagcttgtcgtacggggaca

SEQ ID NO: 429138 - DNA, 25 bp, Mus musculus
cagtgacgcaactggggcagatagt

SEQ ID NO: 429139 - DNA, 25 bp, Mus musculus
atcggctggtcagaagcgtgtacgt

SEQ ID NO: 429140 - DNA, 25 bp, Mus musculus
gccgcagctgatcaagggctttcta

SEQ ID NO: 429141 - DNA, 25 bp, Mus musculus
ttctagcgccttcaaagaagctttc

SEQ ID NO: 429142 - DNA, 25 bp, Mus musculus
aagaagctttccgtagccatgagcc

SEQ ID NO: 429143 - DNA, 25 bp, Mus musculus
ccctggggtaatgacgcgctcagct

SEQ ID NO: 429144 - DNA, 25 bp, Mus musculus
ttccgtagccatgagccctccaggg

SEQ ID NO: 429145 - DNA, 25 bp, Mus musculus
aagcgtgtacgtcctcgggaagtcg

SEQ ID NO: 429146 - DNA, 25 bp, Mus musculus
tcctcgggaagtcgaggaccacgcc

SEQ ID NO: 429147 - DNA, 25 bp, Mus musculus
agtcgaggaccacgccgggaccaca

SEQ ID NO: 429148 - DNA, 25 bp, Mus musculus
ggaccacaggcccatggctgaacta

SEQ ID NO: 429149 - DNA, 25 bp, Mus musculus
aagggctttctagcgccttcaaaga

SEQ ID NO: 429150 - DNA, 25 bp, Mus musculus
ctgcccgcgcgaggcagtgacgcaa

SEQ ID NO: 429151 - DNA, 25 bp, Mus musculus
aggcccatggctgaactacaaaccc

SEQ ID NO: 429152 - DNA, 25 bp, Mus musculus
ccagttacgcctgggagtccgcatg

SEQ ID NO: 429153 - DNA, 25 bp, Mus musculus
cctggctacgagcaacgacctgtgg

SEQ ID NO: 429154 - DNA, 25 bp, Mus musculus
atccttcagggagggaaccttggct

SEQ ID NO: 429155 - DNA, 25 bp, Mus musculus
aggtcggccacacacggattcgcga

SEQ ID NO: 429156 - DNA, 25 bp, Mus musculus
ggcagttccttgatccgcatccagc

SEQ ID NO: 429157 - DNA, 25 bp, Mus musculus
gcatccagcacctttagcaagcagg

SEQ ID NO: 429158 - DNA, 25 bp, Mus musculus
gtcggtgctcaggactctgtgttca

SEQ ID NO: 429159 - DNA, 25 bp, Mus musculus
ctggacagaaagaacctcggagtgc

SEQ ID NO: 429160 - DNA, 25 bp, Mus musculus
accaatagctgcgtggctggcttcg

SEQ ID NO: 429161 - DNA, 25 bp, Mus musculus
ccttcatctgcgagggctctgcaca

SEQ ID NO: 429162 - DNA, 25 bp, Mus musculus
gctctgcacagtcgaacgcggtcaa

SEQ ID NO: 429163 - DNA, 25 bp, Mus musculus
aacgcggtcaacctgttgcctagtc

SEQ ID NO: 429164 - DNA, 25 bp, Mus musculus
tgcctagtctggtttctcttggtaa

SEQ ID NO: 429165 - DNA, 25 bp, Mus musculus
cgagagtttgcccaggctggacaga

SEQ ID NO: 429166 - DNA, 25 bp, Mus musculus
gccttcatccgtccagagtgcctgt

SEQ ID NO: 429167 - DNA, 25 bp, Mus musculus
tgcacgttggcgcaacggaaaaggc

SEQ ID NO: 429168 - DNA, 25 bp, Mus musculus
attggctagctgcacgttggcgcaa

SEQ ID NO: 429169 - DNA, 25 bp, Mus musculus
tagccagctcggattggctagctgc

SEQ ID NO: 429170 - DNA, 25 bp, Mus musculus
ttggacaagacctctggaacccgcc

SEQ ID NO: 429171 - DNA, 25 bp, Mus musculus
agcctattggacaagacctctggaa

SEQ ID NO: 429172 - DNA, 25 bp, Mus musculus
ctgggagcctattggacaagacctc

SEQ ID NO: 429173 - DNA, 25 bp, Mus musculus
tggagtctgggagcctattggacaa

SEQ ID NO: 429174 - DNA, 25 bp, Mus musculus
ctctcgcggatgcacaagagagggc

SEQ ID NO: 429175 - DNA, 25 bp, Mus musculus
atccgtccagagtgcctgtcgttgg

SEQ ID NO: 429176 - DNA, 25 bp, Mus musculus
cacgatcgctcccagcctgcgctga

SEQ ID NO: 429177 - DNA, 25 bp, Mus musculus
cacggccgtcgttgtttgcgcgccg

SEQ ID NO: 429178 - DNA, 25 bp, Mus musculus
tccagagtgcctgtcgttggatggt

SEQ ID NO: 429179 - DNA, 25 bp, Mus musculus
cgcgccgaaggcctccggaagaggc

SEQ ID NO: 429180 - DNA, 25 bp, Mus musculus
agcccgaggtgacctccgggtgaca

SEQ ID NO: 429181 - DNA, 25 bp, Mus musculus
tgtgcctgtatgtggggactaaccc

SEQ ID NO: 429182 - DNA, 25 bp, Mus musculus
gcgcccggagtcagcttcttgcggt

SEQ ID NO: 429183 - DNA, 25 bp, Mus musculus
cttcttgcggtgaactgctagagcc

SEQ ID NO: 429184 - DNA, 25 bp, Mus musculus
cggtagcgactgcttagctgcggcc

SEQ ID NO: 429185 - DNA, 25 bp, Mus musculus
cggcttcattgtcggcaagtgcgca

SEQ ID NO: 429186 - DNA, 25 bp, Mus musculus
gtcccttccgctgggctactggctg

SEQ ID NO: 429187 - DNA, 25 bp, Mus musculus
ctggctgctctagaggattgattcg

SEQ ID NO: 429188 - DNA, 25 bp, Mus musculus
gattgattcgtgatgcccagctata

SEQ ID NO: 429189 - DNA, 25 bp, Mus musculus
gatgcccagctataaggttcatatc

SEQ ID NO: 429190 - DNA, 25 bp, Mus musculus
aggttcatatcttctccgctgtgta

SEQ ID NO: 429191 - DNA, 25 bp, Mus musculus
cgctgtgtagtgttttccgtgtatg

SEQ ID NO: 429192 - DNA, 25 bp, Mus musculus
aaagcttcgcttctcgtagcatccg

SEQ ID NO: 429193 - DNA, 25 bp, Mus musculus
tccgtgtatgtggacgttcgtaaga

SEQ ID NO: 429194 - DNA, 25 bp, Mus musculus
cccttttgcgagataggggagtgca

SEQ ID NO: 429195 - DNA, 25 bp, Mus musculus
cagcgctctgacagtgccggaagac

SEQ ID NO: 429196 - DNA, 25 bp, Mus musculus
tgaggcgtcccttttgcgagatagg

SEQ ID NO: 429197 - DNA, 25 bp, Mus musculus
ttgcacctgagcaaaccgcgccgtg

SEQ ID NO: 429198 - DNA, 25 bp, Mus musculus
ggctccgcaaggaaaggtaccgtgc

SEQ ID NO: 429199 - DNA, 25 bp, Mus musculus
gcaaggaaaggtaccgtgcggcctc

SEQ ID NO: 429200 - DNA, 25 bp, Mus musculus
ggacagccaccgagcctcgtaggca

SEQ ID NO: 429201 - DNA, 25 bp, Mus musculus
gccggaagacctcgtctgctttgca

SEQ ID NO: 429202 - DNA, 25 bp, Mus musculus
cgcagacaaagccggcgaggcactc

SEQ ID NO: 429203 - DNA, 25 bp, Mus musculus
gtctgccggtctccttgggacagct

SEQ ID NO: 429204 - DNA, 25 bp, Mus musculus
accttttgggtcttgcacctgagca

SEQ ID NO: 429205 - DNA, 25 bp, Mus musculus
gtgcgcggaccttttgggtcttgca

SEQ ID NO: 429206 - DNA, 25 bp, Mus musculus
ccgtggctggccctttcgtgagccg

SEQ ID NO: 429207 - DNA, 25 bp, Mus musculus
agcctcgtaggcaaggggctcccga

SEQ ID NO: 429208 - DNA, 25 bp, Mus musculus
tcacccccggggtcctgagatcgag

SEQ ID NO: 429209 - DNA, 25 bp, Mus musculus
cggtccgttgcatccactgggacca

SEQ ID NO: 429210 - DNA, 25 bp, Mus musculus
cccgtggtgagggtgatcacaatca

SEQ ID NO: 429211 - DNA, 25 bp, Mus musculus
gtcctgagatcgagccccgtggtga

SEQ ID NO: 429212 - DNA, 25 bp, Mus musculus
cggaccacgtgattgtgaccgtttc

SEQ ID NO: 429213 - DNA, 25 bp, Mus musculus
tccgttgcatccactgggaccaggc

SEQ ID NO: 429214 - DNA, 25 bp, Mus musculus
cccagcggaccacgtgattgtgacc

SEQ ID NO: 429215 - DNA, 25 bp, Mus musculus
tgatcccagcggaccacgtgattgt

SEQ ID NO: 429216 - DNA, 25 bp, Mus musculus
tgcatccactgggaccaggcctcgg

SEQ ID NO: 429217 - DNA, 25 bp, Mus musculus
attgcgaggtgatcccagcggacca

SEQ ID NO: 429218 - DNA, 25 bp, Mus musculus
aggatgagccgtggcctgtagtcgt

SEQ ID NO: 429219 - DNA, 25 bp, Mus musculus
cacaatcacgacactggggagggtg

SEQ ID NO: 429220 - DNA, 25 bp, Mus musculus
gatcacaatcacgacactggggagg

SEQ ID NO: 429221 - DNA, 25 bp, Mus musculus
acgtgattgtgaccgtttcgctggg

SEQ ID NO: 429222 - DNA, 25 bp, Mus musculus
agccgcccatcaatcgtgcgtgggg

SEQ ID NO: 429223 - DNA, 25 bp, Mus musculus
gcggctctgccggttgccgtgggaa

SEQ ID NO: 429224 - DNA, 25 bp, Mus musculus
atcaatcgtgcgtggggccggtcct

SEQ ID NO: 429225 - DNA, 25 bp, Mus musculus
acacctcactgtcttccctccttct

SEQ ID NO: 429226 - DNA, 25 bp, Mus musculus
tccctccttctagagggccctcttc

SEQ ID NO: 429227 - DNA, 25 bp, Mus musculus
ttctagagggccctcttccttctcc

SEQ ID NO: 429228 - DNA, 25 bp, Mus musculus
tttccttggcaaccgtgcctccctc

SEQ ID NO: 429229 - DNA, 25 bp, Mus musculus
gagtccacacgtgggcggctctgcc

SEQ ID NO: 429230 - DNA, 25 bp, Mus musculus
cctgtgccgctagtcgcgagggaac

SEQ ID NO: 429231 - DNA, 25 bp, Mus musculus
tcctgagtccacacgtgggcggctc

SEQ ID NO: 429232 - DNA, 25 bp, Mus musculus
ggtgggcgaagagccgcccatcaat

SEQ ID NO: 429233 - DNA, 25 bp, Mus musculus
aagagccgcccatcaatcgtgcgtg

SEQ ID NO: 429234 - DNA, 25 bp, Mus musculus
ctcgcgcggagcctgtgccgctagt

SEQ ID NO: 429235 - DNA, 25 bp, Mus musculus
cccatcaatcgtgcgtggggccggt

SEQ ID NO: 429236 - DNA, 25 bp, Mus musculus
ttcgacggccggagaccgaagcctg

SEQ ID NO: 429237 - DNA, 25 bp, Mus musculus
cctccactcccggagggcggaggct

SEQ ID NO: 429238 - DNA, 25 bp, Mus musculus
tagcggcccaagcagcctccactcc

SEQ ID NO: 429239 - DNA, 25 bp, Mus musculus
tgggtctctgtagcggcccaagcag

SEQ ID NO: 429240 - DNA, 25 bp, Mus musculus
gtcgtgggtctctgtagcggcccaa

SEQ ID NO: 429241 - DNA, 25 bp, Mus musculus
tggacaccttcgcacgcagctgggt

SEQ ID NO: 429242 - DNA, 25 bp, Mus musculus
acttatgggacaggctggacacctt

SEQ ID NO: 429243 - DNA, 25 bp, Mus musculus
cggaacttatgggacaggctggaca

SEQ ID NO: 429244 - DNA, 25 bp, Mus musculus
accttcgcacgcagctgggtcgtgg

SEQ ID NO: 429245 - DNA, 25 bp, Mus musculus
tgcgcctccggcgtgtctacggagc

SEQ ID NO: 429246 - DNA, 25 bp, Mus musculus
ccagagcggaacttatgggacaggc

SEQ ID NO: 429247 - DNA, 25 bp, Mus musculus
gacaggctggacaccttcgcacgca

SEQ ID NO: 429248 - DNA, 25 bp, Mus musculus
gctcgccagtggtggccgtagactc

SEQ ID NO: 429249 - DNA, 25 bp, Mus musculus
cagtggtggccgtagactcgccaga

SEQ ID NO: 429250 - DNA, 25 bp, Mus musculus
ttgccacagccacttggaggcgacc

SEQ ID NO: 429251 - DNA, 25 bp, Mus musculus
cactctcgtgcagggtcgaggcaaa

SEQ ID NO: 429252 - DNA, 25 bp, Mus musculus
ccggcttttggtccttcggatctga

SEQ ID NO: 429253 - DNA, 25 bp, Mus musculus
cccgggcacaggtaggaaaatcagg

SEQ ID NO: 429254 - DNA, 25 bp, Mus musculus
gcagggctaggctgatcatcaaagc

SEQ ID NO: 429255 - DNA, 25 bp, Mus musculus
caggaaacttattcgggcgcttcgc

SEQ ID NO: 429256 - DNA, 25 bp, Mus musculus
gctctctgggttaagtccgtaactg

SEQ ID NO: 429257 - DNA, 25 bp, Mus musculus
cagcgtctgcgggagtcagaaatca

SEQ ID NO: 429258 - DNA, 25 bp, Mus musculus
tctaggctttgcctcgggacgtcta

SEQ ID NO: 429259 - DNA, 25 bp, Mus musculus
ttccgattcgcttttccctgcctgg

SEQ ID NO: 429260 - DNA, 25 bp, Mus musculus
tgccaggtggcccaaaagttcacgg

SEQ ID NO: 429261 - DNA, 25 bp, Mus musculus
tgagctgctttctttctgggacacc

SEQ ID NO: 429262 - DNA, 25 bp, Mus musculus
agtctagcagaacccatggcgtctc

SEQ ID NO: 429263 - DNA, 25 bp, Mus musculus
ccctgggcagggaaagacaaaatgg

SEQ ID NO: 429264 - DNA, 25 bp, Mus musculus
cacctcctcggtgatgccgcagaaa

SEQ ID NO: 429265 - DNA, 25 bp, Mus musculus
tcaccaggccgtgaaggtcccaacg

SEQ ID NO: 429266 - DNA, 25 bp, Mus musculus
cggaaagtcatctcacggcgcagcc

SEQ ID NO: 429267 - DNA, 25 bp, Mus musculus
acgctcaggatgtcgcggaaagtca

SEQ ID NO: 429268 - DNA, 25 bp, Mus musculus
cggggtccttcgaaagtgacgctca

SEQ ID NO: 429269 - DNA, 25 bp, Mus musculus
cagccactgctaggttcacgatgaa

SEQ ID NO: 429270 - DNA, 25 bp, Mus musculus
tgcactcagtagcaggtcagccact

SEQ ID NO: 429271 - DNA, 25 bp, Mus musculus
tccatagtggctgagaagggcaaca

SEQ ID NO: 429272 - DNA, 25 bp, Mus musculus
cgcggcccatacgtcgcagaaggtc

SEQ ID NO: 429273 - DNA, 25 bp, Mus musculus
cgtaccggtccacagagatggtgca

SEQ ID NO: 429274 - DNA, 25 bp, Mus musculus
atacttgagcgagtggcgcacaccc

SEQ ID NO: 429275 - DNA, 25 bp, Mus musculus
tgcgttctgtcataatggctggata

SEQ ID NO: 429276 - DNA, 25 bp, Mus musculus
ggcactggttccttccaacctagta

SEQ ID NO: 429277 - DNA, 25 bp, Mus musculus
agcggtcccacagataccaccaagg

SEQ ID NO: 429278 - DNA, 25 bp, Mus musculus
ccctcgcccagcctagctcccgcct

SEQ ID NO: 429279 - DNA, 25 bp, Mus musculus
ttccgtcgtcaagctcggctcactg

SEQ ID NO: 429280 - DNA, 25 bp, Mus musculus
ccgcgttgtcggatcagcagaccga

SEQ ID NO: 429281 - DNA, 25 bp, Mus musculus
cgttgtcggatcagcagaccgattc

SEQ ID NO: 429282 - DNA, 25 bp, Mus musculus
tcggatcagcagaccgattctgggc

SEQ ID NO: 429283 - DNA, 25 bp, Mus musculus
tcagcagaccgattctgggcgctgc

SEQ ID NO: 429284 - DNA, 25 bp, Mus musculus
aagctcggctcactgcgcctctcgg

SEQ ID NO: 429285 - DNA, 25 bp, Mus musculus
attctgggcgctgcgtcgcatcggt

SEQ ID NO: 429286 - DNA, 25 bp, Mus musculus
cgcatcggtggcaggtaagcgggct

SEQ ID NO: 429287 - DNA, 25 bp, Mus musculus
taagcgggctgctgaagccaggcct

SEQ ID NO: 429288 - DNA, 25 bp, Mus musculus
ctgaagccaggccttggcgagcact

SEQ ID NO: 429289 - DNA, 25 bp, Mus musculus
caggccttggcgagcactcagcctt

SEQ ID NO: 429290 - DNA, 25 bp, Mus musculus
gagcactcagccttccgtcgtcaag

SEQ ID NO: 429291 - DNA, 25 bp, Mus musculus
cgcggccattggtgagcatcacgcc

SEQ ID NO: 429292 - DNA, 25 bp, Mus musculus
caggcacaagctccggaagggacaa

SEQ ID NO: 429293 - DNA, 25 bp, Mus musculus
ttgaaagcacctgcctagctcggtc

SEQ ID NO: 429294 - DNA, 25 bp, Mus musculus
cgcactcggagataaagctgggtgc

SEQ ID NO: 429295 - DNA, 25 bp, Mus musculus
cctcaggcacaagctccggaaggga

SEQ ID NO: 429296 - DNA, 25 bp, Mus musculus
tagctcggtctccagcgacctcagg

SEQ ID NO: 429297 - DNA, 25 bp, Mus musculus
tcttttgaaagcacctgcctagctc

SEQ ID NO: 429298 - DNA, 25 bp, Mus musculus
gccgtcttttgaaagcacctgccta

SEQ ID NO: 429299 - DNA, 25 bp, Mus musculus
acgagtggccaggccgtcttttgaa

SEQ ID NO: 429300 - DNA, 25 bp, Mus musculus
gcgctctaatacacgagtggccagg

SEQ ID NO: 429301 - DNA, 25 bp, Mus musculus
gtaagcgctctaatacacgagtggc

SEQ ID NO: 429302 - DNA, 25 bp, Mus musculus
tgggtgcagagtaagcgctctaata

SEQ ID NO: 429303 - DNA, 25 bp, Mus musculus
aaagctgggtgcagagtaagcgctc

SEQ ID NO: 429304 - DNA, 25 bp, Mus musculus
actcggagataaagctgggtgcaga

SEQ ID NO: 429305 - DNA, 25 bp, Mus musculus
ggtctccagcgacctcaggcacaag

SEQ ID NO: 429306 - DNA, 25 bp, Mus musculus
gctccagcgtgcttggccagtgatc

SEQ ID NO: 429307 - DNA, 25 bp, Mus musculus
tgccgatccttgaccaacccacccg

SEQ ID NO: 429308 - DNA, 25 bp, Mus musculus
tttatctgccgatccttgaccaacc

SEQ ID NO: 429309 - DNA, 25 bp, Mus musculus
ctgcctttatctgccgatccttgac

SEQ ID NO: 429310 - DNA, 25 bp, Mus musculus
ctctgcctttatctgccgatccttg

SEQ ID NO: 429311 - DNA, 25 bp, Mus musculus
gagctctgcctttatctgccgatcc

SEQ ID NO: 429312 - DNA, 25 bp, Mus musculus
ccgagctctgcctttatctgccgat

SEQ ID NO: 429313 - DNA, 25 bp, Mus musculus
acagtgcggttgagggcgggcgccc

SEQ ID NO: 429314 - DNA, 25 bp, Mus musculus
tgatccgcgggacccgctcgcttgg

SEQ ID NO: 429315 - DNA, 25 bp, Mus musculus
agtgatccgcgggacccgctcgctt

SEQ ID NO: 429316 - DNA, 25 bp, Mus musculus
ttggccagtgatccgcgggacccgc

SEQ ID NO: 429317 - DNA, 25 bp, Mus musculus
tgcttggccagtgatccgcgggacc

SEQ ID NO: 429318 - DNA, 25 bp, Mus musculus
tccagcgtgcttggccagtgatccg

SEQ ID NO: 429319 - DNA, 25 bp, Mus musculus
cgccaccctgcagttctctccccac

SEQ ID NO: 429320 - DNA, 25 bp, Mus musculus
gtgtcttgcctgtctcccggaccat

SEQ ID NO: 429321 - DNA, 25 bp, Mus musculus
gggaaagaggaccaccagcaccttg

SEQ ID NO: 429322 - DNA, 25 bp, Mus musculus
gctctcgccgcaggggttggaaagt

SEQ ID NO: 429323 - DNA, 25 bp, Mus musculus
ggaccatctgcatccgctctcgccg

SEQ ID NO: 429324 - DNA, 25 bp, Mus musculus
aaagaggaccaccagcaccttgcgc

SEQ ID NO: 429325 - DNA, 25 bp, Mus musculus
actttgagctgggtagagggaaaga

SEQ ID NO: 429326 - DNA, 25 bp, Mus musculus
gccactgagggaaaactttgagctg

SEQ ID NO: 429327 - DNA, 25 bp, Mus musculus
cacgggccactgagggaaaactttg

SEQ ID NO: 429328 - DNA, 25 bp, Mus musculus
tcagggaccggaccaggctggccac

SEQ ID NO: 429329 - DNA, 25 bp, Mus musculus
tggcaaaaggggacagggaagagtc

SEQ ID NO: 429330 - DNA, 25 bp, Mus musculus
caccttgtggcttgggtggcaaaag

SEQ ID NO: 429331 - DNA, 25 bp, Mus musculus
aagcccaccttgtggcttgggtggc

SEQ ID NO: 429332 - DNA, 25 bp, Mus musculus
ggggcagcccgcatatctaagccca

SEQ ID NO: 429333 - DNA, 25 bp, Mus musculus
ttgcgcccgcatcctgtgccagtac

SEQ ID NO: 429334 - DNA, 25 bp, Mus musculus
actccgtgtcgccttccgcaaagag

SEQ ID NO: 429335 - DNA, 25 bp, Mus musculus
tcgcgtcccgccgatcgcaccgctc

SEQ ID NO: 429336 - DNA, 25 bp, Mus musculus
tctcacctgcctgcagctcgctggg

SEQ ID NO: 429337 - DNA, 25 bp, Mus musculus
gggacgcacggcctgacactgcagc

SEQ ID NO: 429338 - DNA, 25 bp, Mus musculus
cacggcgagcccacggtggctgtcc

SEQ ID NO: 429339 - DNA, 25 bp, Mus musculus
gccagactggaaacagcaccgccat

SEQ ID NO: 429340 - DNA, 25 bp, Mus musculus
tgtcgccttccgcaaagagggaagg

SEQ ID NO: 429341 - DNA, 25 bp, Mus musculus
aaattactccgtgtcgccttccgca

SEQ ID NO: 429342 - DNA, 25 bp, Mus musculus
gcggcatctaaaattactccgtgtc

SEQ ID NO: 429343 - DNA, 25 bp, Mus musculus
cgcaaggttggtgcagcggcatcta

SEQ ID NO: 429344 - DNA, 25 bp, Mus musculus
gccagcgtgaaaggtcgcaaggttg

SEQ ID NO: 429345 - DNA, 25 bp, Mus musculus
aagagcgcaggcaacaaggcgaccc

SEQ ID NO: 429346 - DNA, 25 bp, Mus musculus
cggtcaagagcgcaggcaacaaggc

SEQ ID NO: 429347 - DNA, 25 bp, Mus musculus
agggaaggaagccagactggaaaca

SEQ ID NO: 429348 - DNA, 25 bp, Mus musculus
ctaagcgtggcgctgtggacaacct

SEQ ID NO: 429349 - DNA, 25 bp, Mus musculus
agtgctgtcaccaggaaatcgtgtc

SEQ ID NO: 429350 - DNA, 25 bp, Mus musculus
agaggcgcaccggaagtgctgtcac

SEQ ID NO: 429351 - DNA, 25 bp, Mus musculus
ttaaggacagcccagcggaagtgac

SEQ ID NO: 429352 - DNA, 25 bp, Mus musculus
gcggtcttaaggacagcccagcgga

SEQ ID NO: 429353 - DNA, 25 bp, Mus musculus
cgctcaacagccaagcggaaggggc

SEQ ID NO: 429354 - DNA, 25 bp, Mus musculus
aaggctcgctcaacagccaagcgga

SEQ ID NO: 429355 - DNA, 25 bp, Mus musculus
cgttctccgttaggcgcgctcgcaa

SEQ ID NO: 429356 - DNA, 25 bp, Mus musculus
cgtgaactaactgtctccgggaagc

SEQ ID NO: 429357 - DNA, 25 bp, Mus musculus
ctgtcaccaggaaatcgtgtcatcg

SEQ ID NO: 429358 - DNA, 25 bp, Mus musculus
tggacaacctctcgtcgccctccgc

SEQ ID NO: 429359 - DNA, 25 bp, Mus musculus
aggcgcgctcgcaaggctcgctcaa

SEQ ID NO: 429360 - DNA, 25 bp, Mus musculus
cgccgccaacgtgaactaactgtct

SEQ ID NO: 429361 - DNA, 25 bp, Mus musculus
aactaactgtctccgggaagcagcc

SEQ ID NO: 429362 - DNA, 25 bp, Mus musculus
ccttcggagcgcagagtaagctgta

SEQ ID NO: 429363 - DNA, 25 bp, Mus musculus
ctgccttgaagctggagagtatttt

SEQ ID NO: 429364 - DNA, 25 bp, Mus musculus
taggctgcagtttccatccttagga

SEQ ID NO: 429365 - DNA, 25 bp, Mus musculus
taggctgtcgtcaccgcccaagttt

SEQ ID NO: 429366 - DNA, 25 bp, Mus musculus
tcgtacccgtggtttgagcaaggcc

SEQ ID NO: 429367 - DNA, 25 bp, Mus musculus
ttttccctgcgcgaggtcatgacgc

SEQ ID NO: 429368 - DNA, 25 bp, Mus musculus
cagcgaaggcctacagcgacaacta

SEQ ID NO: 429369 - DNA, 25 bp, Mus musculus
tgtggcgactagatgagagctactc

SEQ ID NO: 429370 - DNA, 25 bp, Mus musculus
tcaggcgtgcctcaaacatggtggc

SEQ ID NO: 429371 - DNA, 25 bp, Mus musculus
ccagcaccttcttcaggatggagcc

SEQ ID NO: 429372 - DNA, 25 bp, Mus musculus
gacgtcccagcaggcctcattgatg

SEQ ID NO: 429373 - DNA, 25 bp, Mus musculus
gacgagtccatgctctgcaggttca

SEQ ID NO: 429374 - DNA, 25 bp, Mus musculus
tcgcagcggtatgtgtcgaagcctt

SEQ ID NO: 429375 - DNA, 25 bp, Mus musculus
ggagcactcattttcccgcggactc

SEQ ID NO: 429376 - DNA, 25 bp, Mus musculus
tctgacctttatcgcggccctgggt

SEQ ID NO: 429377 - DNA, 25 bp, Mus musculus
ccttcccgatgtggacgctggacac

SEQ ID NO: 429378 - DNA, 25 bp, Mus musculus
cgaggacgcacctccggaggacaag

SEQ ID NO: 429379 - DNA, 25 bp, Mus musculus
aacaggttaccttctggacccagca

SEQ ID NO: 429380 - DNA, 25 bp, Mus musculus
ccacagaccttgcttggggcccgga

SEQ ID NO: 429381 - DNA, 25 bp, Mus musculus
cttccctaggccttcccgatgtgga

SEQ ID NO: 429382 - DNA, 25 bp, Mus musculus
gaggacaaggtagaggcatcgttaa

SEQ ID NO: 429383 - DNA, 25 bp, Mus musculus
cccagcatgaccgaactacggcaga

SEQ ID NO: 429384 - DNA, 25 bp, Mus musculus
cgagagcccgtgctcactgagccga

SEQ ID NO: 429385 - DNA, 25 bp, Mus musculus
gctggggaaacagcggctccgctct

SEQ ID NO: 429386 - DNA, 25 bp, Mus musculus
tgagtgtctcgaactccgctcacgc

SEQ ID NO: 429387 - DNA, 25 bp, Mus musculus
ctaggttttgtccaatgagtgtctc

SEQ ID NO: 429388 - DNA, 25 bp, Mus musculus
ccattggttcactctgctctttttc

SEQ ID NO: 429389 - DNA, 25 bp, Mus musculus
cccggagagcgcgatgtaggctcac

SEQ ID NO: 429390 - DNA, 25 bp, Mus musculus
cctccgaatgaatgtgggaccgagg

SEQ ID NO: 429391 - DNA, 25 bp, Mus musculus
cgccgccgctgacaggaggaccgca

SEQ ID NO: 429392 - DNA, 25 bp, Mus musculus
gttcgcttgcgacgcctcagctgcg

SEQ ID NO: 429393 - DNA, 25 bp, Mus musculus
gctgcctccgaatgaatgtgggacc

SEQ ID NO: 429394 - DNA, 25 bp, Mus musculus
aggcaggctgcctccgaatgaatgt

SEQ ID NO: 429395 - DNA, 25 bp, Mus musculus
acagtgaagtgcctccggtgtcgaa

SEQ ID NO: 429396 - DNA, 25 bp, Mus musculus
tgggaaacggacagtgaagtgcctc

SEQ ID NO: 429397 - DNA, 25 bp, Mus musculus
aggggcgttcgcttgcgacgcctca

SEQ ID NO: 429398 - DNA, 25 bp, Mus musculus
cccttagaacggcaggtaagggctg

SEQ ID NO: 429399 - DNA, 25 bp, Mus musculus
agaccactggcacgcgggcttgacc

SEQ ID NO: 429400 - DNA, 25 bp, Mus musculus
tcaccggagaccactggcacgcggg

SEQ ID NO: 429401 - DNA, 25 bp, Mus musculus
ccgagcccgactgaggtgcggatcc

SEQ ID NO: 429402 - DNA, 25 bp, Mus musculus
ctcacctcccggctgtgccgcgcgc

SEQ ID NO: 429403 - DNA, 25 bp, Mus musculus
cccgactgaggtgcggatcctccgt

SEQ ID NO: 429404 - DNA, 25 bp, Mus musculus
tctggagttgctgcttcgctctgca

SEQ ID NO: 429405 - DNA, 25 bp, Mus musculus
aacccggtactcacttgcctcggtg

SEQ ID NO: 429406 - DNA, 25 bp, Mus musculus
ttgtccgtacgccttccactgagtc

SEQ ID NO: 429407 - DNA, 25 bp, Mus musculus
gccttccactgagtccgcgatttcg

SEQ ID NO: 429408 - DNA, 25 bp, Mus musculus
gcgatttcggggctccactccagtc

SEQ ID NO: 429409 - DNA, 25 bp, Mus musculus
gaggtgatctcctggaacagacgcg

SEQ ID NO: 429410 - DNA, 25 bp, Mus musculus
tctcctggaacagacgcggagtgcc

SEQ ID NO: 429411 - DNA, 25 bp, Mus musculus
cctcggtgctttcagggacgcactc

SEQ ID NO: 429412 - DNA, 25 bp, Mus musculus
ttcagggacgcactccctggccggt

SEQ ID NO: 429413 - DNA, 25 bp, Mus musculus
ggctctgggaacactagctctggtt

SEQ ID NO: 429414 - DNA, 25 bp, Mus musculus
actagctctggttgaggcttgccta

SEQ ID NO: 429415 - DNA, 25 bp, Mus musculus
cttgcctacttggtgggcgtgtgtc

SEQ ID NO: 429416 - DNA, 25 bp, Mus musculus
ctcgcatcagtctttctggagttgc

SEQ ID NO: 429417 - DNA, 25 bp, Mus musculus
ttggtcctgctctcctcgcatcagt

SEQ ID NO: 429418 - DNA, 25 bp, Mus musculus
agcagctgtcaaaaccgcgcgagtc

SEQ ID NO: 429419 - DNA, 25 bp, Mus musculus
ctccaagccggcgacgccaagggga

SEQ ID NO: 429420 - DNA, 25 bp, Mus musculus
cgcagccctaaaacgtcaccgaggg

SEQ ID NO: 429421 - DNA, 25 bp, Mus musculus
gcacggacgaggagctacacaaagc

SEQ ID NO: 429422 - DNA, 25 bp, Mus musculus
cggctgtactgtcacccggagtttc

SEQ ID NO: 429423 - DNA, 25 bp, Mus musculus
cggagtttctttcgcgggcactaat

SEQ ID NO: 429424 - DNA, 25 bp, Mus musculus
ttctaggcactttggggaaagaagc

SEQ ID NO: 429425 - DNA, 25 bp, Mus musculus
ccggacccggcagatgaagcagcac

SEQ ID NO: 429426 - DNA, 25 bp, Mus musculus
tccagctccgccgttttctttgttc

SEQ ID NO: 429427 - DNA, 25 bp, Mus musculus
atttccgtggctgtcctgggtcacg

SEQ ID NO: 429428 - DNA, 25 bp, Mus musculus
gcgctcccttaggtggcccgaggaa

SEQ ID NO: 429429 - DNA, 25 bp, Mus musculus
aagcaaggagcccagttacagccgc

SEQ ID NO: 429430 - DNA, 25 bp, Mus musculus
aaccggtttcagctgccctagacta

SEQ ID NO: 429431 - DNA, 25 bp, Mus musculus
cgcgggcactaatttctaggcactt

SEQ ID NO: 429432 - DNA, 25 bp, Mus musculus
tggagcagcgtatgctacatttgcc

SEQ ID NO: 429433 - DNA, 25 bp, Mus musculus
tctcggggaagtgcgcctggcaacc

SEQ ID NO: 429434 - DNA, 25 bp, Mus musculus
tgcgcctggcaaccgcaggtttctt

SEQ ID NO: 429435 - DNA, 25 bp, Mus musculus
gcaaccgcaggtttcttgctggccc

SEQ ID NO: 429436 - DNA, 25 bp, Mus musculus
ggcgtgccaccaggttgaatcctcc

SEQ ID NO: 429437 - DNA, 25 bp, Mus musculus
caccaggttgaatcctccggaagga

SEQ ID NO: 429438 - DNA, 25 bp, Mus musculus
tacatttgcctcacagcgctgtgcg

SEQ ID NO: 429439 - DNA, 25 bp, Mus musculus
atcctccggaaggactgcgcagacc

SEQ ID NO: 429440 - DNA, 25 bp, Mus musculus
ccaaagccagagctggtctcgggga

SEQ ID NO: 429441 - DNA, 25 bp, Mus musculus
gtacttgttgaatatcggtctccgg

SEQ ID NO: 429442 - DNA, 25 bp, Mus musculus
gttgaatatcggtctccggcccgta

SEQ ID NO: 429443 - DNA, 25 bp, Mus musculus
tctccggcccgtatttagccttaga

SEQ ID NO: 429444 - DNA, 25 bp, Mus musculus
aaaaggcccggcctggagcagcgta

SEQ ID NO: 429445 - DNA, 25 bp, Mus musculus
tggttccgcgccacagctgaagcgg

SEQ ID NO: 429446 - DNA, 25 bp, Mus musculus
tgccggtttttctgccgttctggag

SEQ ID NO: 429447 - DNA, 25 bp, Mus musculus
ttttctgccgttctggagggcggtg

SEQ ID NO: 429448 - DNA, 25 bp, Mus musculus
tctgccgttctggagggcggtggga

SEQ ID NO: 429449 - DNA, 25 bp, Mus musculus
tccggttccgggctcttgcggtcag

SEQ ID NO: 429450 - DNA, 25 bp, Mus musculus
ggaggagcggatggtttattccgcc

SEQ ID NO: 429451 - DNA, 25 bp, Mus musculus
aggagcggatggtttattccgccgg

SEQ ID NO: 429452 - DNA, 25 bp, Mus musculus
cgcccactgcgctctttttacctcg

SEQ ID NO: 429453 - DNA, 25 bp, Mus musculus
ctgccggtttttctgccgttctgga

SEQ ID NO: 429454 - DNA, 25 bp, Mus musculus
tctgccggtttttctgccgttctgg

SEQ ID NO: 429455 - DNA, 25 bp, Mus musculus
ctctgccggtttttctgccgttctg

SEQ ID NO: 429456 - DNA, 25 bp, Mus musculus
cctctgccggtttttctgccgttct

SEQ ID NO: 429457 - DNA, 25 bp, Mus musculus
gagtgacacggggctctgagaacct

SEQ ID NO: 429458 - DNA, 25 bp, Mus musculus
gggctcttgcggtcagccggtgagt

SEQ ID NO: 429459 - DNA, 25 bp, Mus musculus
cggttccgggctcttgcggtcagcc

SEQ ID NO: 429460 - DNA, 25 bp, Mus musculus
ctgctccgtgacgtcagggctgagc

SEQ ID NO: 429461 - DNA, 25 bp, Mus musculus
acacactggctgtgcttccgcccgc

SEQ ID NO: 429462 - DNA, 25 bp, Mus musculus
ctgcccttcataagagccaggcctg

SEQ ID NO: 429463 - DNA, 25 bp, Mus musculus
cccaccgcgccacagctgctctgcg

SEQ ID NO: 429464 - DNA, 25 bp, Mus musculus
tcctcctacactcagctggcgagag

SEQ ID NO: 429465 - DNA, 25 bp, Mus musculus
ctacactcagctggcgagaggcacc

SEQ ID NO: 429466 - DNA, 25 bp, Mus musculus
cgtgcctgctgggaccctgcgcaag

SEQ ID NO: 429467 - DNA, 25 bp, Mus musculus
catgcagccggctatgctcctcggc

SEQ ID NO: 429468 - DNA, 25 bp, Mus musculus
cttcttgcctgagatctacagcacc

SEQ ID NO: 429469 - DNA, 25 bp, Mus musculus
cagctggcgagaggcaccatgcagc

SEQ ID NO: 429470 - DNA, 25 bp, Mus musculus
gtcccttcttgcctgagatctacag

SEQ ID NO: 429471 - DNA, 25 bp, Mus musculus
ggacccttgtcccttcttgcctgag

SEQ ID NO: 429472 - DNA, 25 bp, Mus musculus
gcgacaatatgagccggacccttgt

SEQ ID NO: 429473 - DNA, 25 bp, Mus musculus
tgctgggaccctgcgcaaggccgca

SEQ ID NO: 429474 - DNA, 25 bp, Mus musculus
tagtcgcgtggcttccttaagcaga

SEQ ID NO: 429475 - DNA, 25 bp, Mus musculus
tccggggctcctgaaagcaggacgc

SEQ ID NO: 429476 - DNA, 25 bp, Mus musculus
gtatacggcttacggctctgtcgca

SEQ ID NO: 429477 - DNA, 25 bp, Mus musculus
ccctgcgtgagagtgtatacggctt

SEQ ID NO: 429478 - DNA, 25 bp, Mus musculus
acttcaagcgaggtccgagtttgcc

SEQ ID NO: 429479 - DNA, 25 bp, Mus musculus
tcaccgtcatggatgcagtggtccc

SEQ ID NO: 429480 - DNA, 25 bp, Mus musculus
tccttaagcagaagcgcgtcataga

SEQ ID NO: 429481 - DNA, 25 bp, Mus musculus
tttgattggctacacttcatcccgc

SEQ ID NO: 429482 - DNA, 25 bp, Mus musculus
cgtctctctgaactctttgattggc

SEQ ID NO: 429483 - DNA, 25 bp, Mus musculus
gcctggcgacttccgtctctctgaa

SEQ ID NO: 429484 - DNA, 25 bp, Mus musculus
tccgtttttgctccagccgctagga

SEQ ID NO: 429485 - DNA, 25 bp, Mus musculus
ctccatggaagccaggtaaatttca

SEQ ID NO: 429486 - DNA, 25 bp, Mus musculus
ctccgcagctgatgcctccatggaa

SEQ ID NO: 429487 - DNA, 25 bp, Mus musculus
catagacgcgccaaaaaagaacttc

SEQ ID NO: 429488 - DNA, 25 bp, Mus musculus
cggcaccgctcgacttctctagaga

SEQ ID NO: 429489 - DNA, 25 bp, Mus musculus
agccagggcgttcgatcttggtgaa

SEQ ID NO: 429490 - DNA, 25 bp, Mus musculus
tgttctgggaagttacgggcagcca

SEQ ID NO: 429491 - DNA, 25 bp, Mus musculus
tctgtcgcgacactcacccggtgtt

SEQ ID NO: 429492 - DNA, 25 bp, Mus musculus
tccgtggaggccacacggccatgtt

SEQ ID NO: 429493 - DNA, 25 bp, Mus musculus
gttctcgactcttggactccgtgga

SEQ ID NO: 429494 - DNA, 25 bp, Mus musculus
gatcttggtgaacttcaggggtccc

SEQ ID NO: 429495 - DNA, 25 bp, Mus musculus
ttctctagagaagctggcagccggt

SEQ ID NO: 429496 - DNA, 25 bp, Mus musculus
tatggagctgtccatacggcctcgg

SEQ ID NO: 429497 - DNA, 25 bp, Mus musculus
cggaaagtgccagagtgtagaaatt

SEQ ID NO: 429498 - DNA, 25 bp, Mus musculus
tcaggccacctgtataagcggaaag

SEQ ID NO: 429499 - DNA, 25 bp, Mus musculus
tgaaagctgactcccttggcggttc

SEQ ID NO: 429500 - DNA, 25 bp, Mus musculus
ctgggtgtcgtgaaaacgtcgtgaa

SEQ ID NO: 429501 - DNA, 25 bp, Mus musculus
caggggcgtctgagttctcgactct

SEQ ID NO: 429502 - DNA, 25 bp, Mus musculus
cccgcgaatgcctcctgggcgatgt

SEQ ID NO: 429503 - DNA, 25 bp, Mus musculus
atccaagagctccagtgccgccagg

SEQ ID NO: 429504 - DNA, 25 bp, Mus musculus
cagcgctgggaagcatgcaaaggtc

SEQ ID NO: 429505 - DNA, 25 bp, Mus musculus
atgcaaaggtccgtggcagcagcgc

SEQ ID NO: 429506 - DNA, 25 bp, Mus musculus
cagctcggtcagcaggttgtgactg

SEQ ID NO: 429507 - DNA, 25 bp, Mus musculus
ttgtgactgaggtcgagctcacgca

SEQ ID NO: 429508 - DNA, 25 bp, Mus musculus
agctcacgcagctcggccagcgtgt

SEQ ID NO: 429509 - DNA, 25 bp, Mus musculus
cccagtgtagcacggagatgcggtt

SEQ ID NO: 429510 - DNA, 25 bp, Mus musculus
agcacaggctcgctaagggcgcgca

SEQ ID NO: 429511 - DNA, 25 bp, Mus musculus
cgcagcaggttgtggctgccatcga

SEQ ID NO: 429512 - DNA, 25 bp, Mus musculus
ggctctccaggctgcggttcgccaa

SEQ ID NO: 429513 - DNA, 25 bp, Mus musculus
ttcgccaagttcagagtggtgactc

SEQ ID NO: 429514 - DNA, 25 bp, Mus musculus
gagtcctacacagagagagtcggta

SEQ ID NO: 429515 - DNA, 25 bp, Mus musculus
gtgccgctcagatccaagagctcca

SEQ ID NO: 429516 - DNA, 25 bp, Mus musculus
gtccagtctgcagctcgcacgtgga

SEQ ID NO: 429517 - DNA, 25 bp, Mus musculus
agcctgctaggtcttgctctcgctc

SEQ ID NO: 429518 - DNA, 25 bp, Mus musculus
cggaatataacacggacgctcggtt

SEQ ID NO: 429519 - DNA, 25 bp, Mus musculus
gtcacctgtcctttgcccattaatg

SEQ ID NO: 429520 - DNA, 25 bp, Mus musculus
cattaatgaaagcagcccgcgccga

SEQ ID NO: 429521 - DNA, 25 bp, Mus musculus
cgccgaccgaaagcgttcctgtgca

SEQ ID NO: 429522 - DNA, 25 bp, Mus musculus
agcgttcctgtgcacgatcagattc

SEQ ID NO: 429523 - DNA, 25 bp, Mus musculus
aggtgatcacctccagacaaaatta

SEQ ID NO: 429524 - DNA, 25 bp, Mus musculus
caaccgtttaactgcacagagctgc

SEQ ID NO: 429525 - DNA, 25 bp, Mus musculus
gtcccaagtcttcgcggtgagagtt

SEQ ID NO: 429526 - DNA, 25 bp, Mus musculus
cgggagagctcacctgctatggagc

SEQ ID NO: 429527 - DNA, 25 bp, Mus musculus
cgcaccaaggtacagcgggtccagt

SEQ ID NO: 429528 - DNA, 25 bp, Mus musculus
ggacctcgcgacagccagtagagct

SEQ ID NO: 429529 - DNA, 25 bp, Mus musculus
ctggctaatcccaatcctcagcggg

SEQ ID NO: 429530 - DNA, 25 bp, Mus musculus
gcacgacacgggttggaactccaga

SEQ ID NO: 429531 - DNA, 25 bp, Mus musculus
cttcttgaacttgccgggagagtga

SEQ ID NO: 429532 - DNA, 25 bp, Mus musculus
agcacttggctggagacttcttgaa

SEQ ID NO: 429533 - DNA, 25 bp, Mus musculus
tccctgaggccgacgacagcagcag

SEQ ID NO: 429534 - DNA, 25 bp, Mus musculus
tcgcggcccagctaacgcagaacgt

SEQ ID NO: 429535 - DNA, 25 bp, Mus musculus
gctggactgtctcgagaatgagccc

SEQ ID NO: 429536 - DNA, 25 bp, Mus musculus
caaaagacacttggcccgagggctc

SEQ ID NO: 429537 - DNA, 25 bp, Mus musculus
cccaggctgccacaaaagacacttg

SEQ ID NO: 429538 - DNA, 25 bp, Mus musculus
ctctgacccaggagtgagcgcccaa

SEQ ID NO: 429539 - DNA, 25 bp, Mus musculus
gtcttaccctcaatgcggggccact

SEQ ID NO: 429540 - DNA, 25 bp, Mus musculus
ggagtccggagcacagtcttaccct

SEQ ID NO: 429541 - DNA, 25 bp, Mus musculus
ctagagtcgcggaccgacgctaaga

SEQ ID NO: 429542 - DNA, 25 bp, Mus musculus
gaactccagactgtgcgcgcctggc

SEQ ID NO: 429543 - DNA, 25 bp, Mus musculus
caagacacagttccctacagggaga

SEQ ID NO: 429544 - DNA, 25 bp, Mus musculus
cggacgctcggcaggttccacgagc

SEQ ID NO: 429545 - DNA, 25 bp, Mus musculus
cttgaattcaagtcaccagcagtcc

SEQ ID NO: 429546 - DNA, 25 bp, Mus musculus
tgttctacagtacagccgcaggccc

SEQ ID NO: 429547 - DNA, 25 bp, Mus musculus
acaacacccgcgtcaggggacaagc

SEQ ID NO: 429548 - DNA, 25 bp, Mus musculus
cacccactttgttctacagtacagc

SEQ ID NO: 429549 - DNA, 25 bp, Mus musculus
ggcgaatgcagattggtccactccc

SEQ ID NO: 429550 - DNA, 25 bp, Mus musculus
gagctcagtcgtggcgaatgcagat

SEQ ID NO: 429551 - DNA, 25 bp, Mus musculus
aagggcggctcgaagccctgcctca

SEQ ID NO: 429552 - DNA, 25 bp, Mus musculus
gcaggttccacgagcctcggcgcga

SEQ ID NO: 429553 - DNA, 25 bp, Mus musculus
agcagcttcgggactggctccggac

SEQ ID NO: 429554 - DNA, 25 bp, Mus musculus
ggttcccggtctctagcttctcgct

SEQ ID NO: 429555 - DNA, 25 bp, Mus musculus
ggtctctagcttctcgctcgctact

SEQ ID NO: 429556 - DNA, 25 bp, Mus musculus
cccattctaactcgggcagacgcgg

SEQ ID NO: 429557 - DNA, 25 bp, Mus musculus
agaaagaggatccaccaggcccgca

SEQ ID NO: 429558 - DNA, 25 bp, Mus musculus
aacgtgggtgactcacgtcggccct

SEQ ID NO: 429559 - DNA, 25 bp, Mus musculus
gagagggcagccagccgcgccaaca

SEQ ID NO: 429560 - DNA, 25 bp, Mus musculus
gccctgtccgcaggtcgaccatggt

SEQ ID NO: 429561 - DNA, 25 bp, Mus musculus
ctcattccagagctgggccgcaaga

SEQ ID NO: 429562 - DNA, 25 bp, Mus musculus
gccgcaagaagttcgccgcggcatc

SEQ ID NO: 429563 - DNA, 25 bp, Mus musculus
ggccttcggaagacgtcctcagcga

SEQ ID NO: 429564 - DNA, 25 bp, Mus musculus
gacgtcctcagcgaatttgagttga

SEQ ID NO: 429565 - DNA, 25 bp, Mus musculus
cgaatttgagttgaggctgctcagc

SEQ ID NO: 429566 - DNA, 25 bp, Mus musculus
ggctgctcagcatgtttggcctgaa

SEQ ID NO: 429567 - DNA, 25 bp, Mus musculus
tttggcctgaagcagagacccaccc

SEQ ID NO: 429568 - DNA, 25 bp, Mus musculus
ccctatatgctagatctgtaccgca

SEQ ID NO: 429569 - DNA, 25 bp, Mus musculus
agatctgtaccgcaggcactcaggc

SEQ ID NO: 429570 - DNA, 25 bp, Mus musculus
acccgctgtcttctagtgttgctgc

SEQ ID NO: 429571 - DNA, 25 bp, Mus musculus
cgcaggcactcaggccagccaggag

SEQ ID NO: 429572 - DNA, 25 bp, Mus musculus
aaccgccttcacagaggtctgagga

SEQ ID NO: 429573 - DNA, 25 bp, Mus musculus
catgctcattgcgaaggccgcagcc

SEQ ID NO: 429574 - DNA, 25 bp, Mus musculus
cctgacagcgcagggcaggcaatgt

SEQ ID NO: 429575 - DNA, 25 bp, Mus musculus
ggcaggcaatgtgcgcatgctcatt

SEQ ID NO: 429576 - DNA, 25 bp, Mus musculus
tggggacactcacaatttcagcatc

SEQ ID NO: 429577 - DNA, 25 bp, Mus musculus
tccatcaccagcgtccagttggagg

SEQ ID NO: 429578 - DNA, 25 bp, Mus musculus
ccagcgtccagttggaggcggtcat

SEQ ID NO: 429579 - DNA, 25 bp, Mus musculus
gtcatgggctgcacacggctctcct

SEQ ID NO: 429580 - DNA, 25 bp, Mus musculus
ccgggacgcagaagccgcctgtcat

SEQ ID NO: 429581 - DNA, 25 bp, Mus musculus
cgcctgtgaggtagctcagctctct

SEQ ID NO: 429582 - DNA, 25 bp, Mus musculus
tgaggagaggccaacccgcctctgc

SEQ ID NO: 429583 - DNA, 25 bp, Mus musculus
cccaacgcactgtgggaaggcggtt

SEQ ID NO: 429584 - DNA, 25 bp, Mus musculus
tgggaaggcggttgccaaagcaacc

SEQ ID NO: 429585 - DNA, 25 bp, Mus musculus
ccgcctgtcatggtggcgcctgtga

SEQ ID NO: 429586 - DNA, 25 bp, Mus musculus
agcgaagcccagagcctggtgaatc

SEQ ID NO: 429587 - DNA, 25 bp, Mus musculus
caaattcgtcaagtgggatgatgta

SEQ ID NO: 429588 - DNA, 25 bp, Mus musculus
cctcaagaagggcaccaaattcgtc

SEQ ID NO: 429589 - DNA, 25 bp, Mus musculus
tgtgcgtgtccgacagcctcaagaa

SEQ ID NO: 429590 - DNA, 25 bp, Mus musculus
cttgcaactcaagcccgtgtgcgtg

SEQ ID NO: 429591 - DNA, 25 bp, Mus musculus
tggtgaatcgagagccaagcccgct

SEQ ID NO: 429592 - DNA, 25 bp, Mus musculus
ctcgcgtgtcgtcccgcttactaag

SEQ ID NO: 429593 - DNA, 25 bp, Mus musculus
gcatggcaggctgctgtaccctcgc

SEQ ID NO: 429594 - DNA, 25 bp, Mus musculus
gaggctctacagtcaccgcgggctc

SEQ ID NO: 429595 - DNA, 25 bp, Mus musculus
atgtgctgaatggtgcgcttccagg

SEQ ID NO: 429596 - DNA, 25 bp, Mus musculus
ctctgtgcacagaggatgtgctgaa

SEQ ID NO: 429597 - DNA, 25 bp, Mus musculus
gaccggagcgtgtcactcgcgcgct

SEQ ID NO: 429598 - DNA, 25 bp, Mus musculus
gttgctgacccagcgcgcaaagttg

SEQ ID NO: 429599 - DNA, 25 bp, Mus musculus
agcccggagtgcacgccttgcaact

SEQ ID NO: 429600 - DNA, 25 bp, Mus musculus
acgcggctcccgactagagccagtg

SEQ ID NO: 429601 - DNA, 25 bp, Mus musculus
tccagaagacattggggttgaggta

SEQ ID NO: 429602 - DNA, 25 bp, Mus musculus
ctgctgatcgggcatccagaagaca

SEQ ID NO: 429603 - DNA, 25 bp, Mus musculus
tgacagccggcgatccaatgaatgg

SEQ ID NO: 429604 - DNA, 25 bp, Mus musculus
accatgccaatgacagccggcgatc

SEQ ID NO: 429605 - DNA, 25 bp, Mus musculus
gcggcgtagaggtcaccatgccaat

SEQ ID NO: 429606 - DNA, 25 bp, Mus musculus
tggagcctctcggaacacgtgccgc

SEQ ID NO: 429607 - DNA, 25 bp, Mus musculus
gaacgacctggctgtgtggagcctc

SEQ ID NO: 429608 - DNA, 25 bp, Mus musculus
aaccatggctatgcgctggtcgtgc

SEQ ID NO: 429609 - DNA, 25 bp, Mus musculus
gcccgccgcgactttcagacttgaa

SEQ ID NO: 429610 - DNA, 25 bp, Mus musculus
ttctggataaaagcggacgcggctc

SEQ ID NO: 429611 - DNA, 25 bp, Mus musculus
cagttcggacgcacatttctggata

SEQ ID NO: 429612 - DNA, 25 bp, Mus musculus
ttgtcccgcgtaggacaacagttcg

SEQ ID NO: 429613 - DNA, 25 bp, Mus musculus
gcgcagccctgttaagccggggcta

SEQ ID NO: 429614 - DNA, 25 bp, Mus musculus
tgtcccgctgctggctcagctcagt

SEQ ID NO: 429615 - DNA, 25 bp, Mus musculus
gcaaacaggctctcacacgcgcgca

SEQ ID NO: 429616 - DNA, 25 bp, Mus musculus
gcacccgctgagtccgtggccagcg

SEQ ID NO: 429617 - DNA, 25 bp, Mus musculus
agcggctcaggagccgcgccgcaaa

SEQ ID NO: 429618 - DNA, 25 bp, Mus musculus
ctgggcatgctccgtagcccggcag

SEQ ID NO: 429619 - DNA, 25 bp, Mus musculus
ccggcagcgactcgcctggaagtga

SEQ ID NO: 429620 - DNA, 25 bp, Mus musculus
agcgactcgcctggaagtgacaggt

SEQ ID NO: 429621 - DNA, 25 bp, Mus musculus
ctctccggcaatcatctgctactgg

SEQ ID NO: 429622 - DNA, 25 bp, Mus musculus
cggcaatcatctgctactgggtttc

SEQ ID NO: 429623 - DNA, 25 bp, Mus musculus
tctgctactgggtttcctctgccta

SEQ ID NO: 429624 - DNA, 25 bp, Mus musculus
tttcctctgcctacccggacgttca

SEQ ID NO: 429625 - DNA, 25 bp, Mus musculus
ggacgttcaccctcttctgcgctag

SEQ ID NO: 429626 - DNA, 25 bp, Mus musculus
ttctgcgctagaaatagctcggctc

SEQ ID NO: 429627 - DNA, 25 bp, Mus musculus
gcgctagaaatagctcggctcgacg

SEQ ID NO: 429628 - DNA, 25 bp, Mus musculus
agtcgcggtacctcatctgcttctc

SEQ ID NO: 429629 - DNA, 25 bp, Mus musculus
ccgctgctgctacatctgttatatc

SEQ ID NO: 429630 - DNA, 25 bp, Mus musculus
agagaagtcgcggtacctcatctgc

SEQ ID NO: 429631 - DNA, 25 bp, Mus musculus
acatctgttatatcgctccaagcgc

SEQ ID NO: 429632 - DNA, 25 bp, Mus musculus
tatatcgctccaagcgccatgttcc

SEQ ID NO: 429633 - DNA, 25 bp, Mus musculus
atgttcctgctctccacgggcgcac

SEQ ID NO: 429634 - DNA, 25 bp, Mus musculus
acgggcgcacgccagggaactacta

SEQ ID NO: 429635 - DNA, 25 bp, Mus musculus
cctacctggtggctggctgtcagca

SEQ ID NO: 429636 - DNA, 25 bp, Mus musculus
gtgtagcaaccgtgcgcatcttggc

SEQ ID NO: 429637 - DNA, 25 bp, Mus musculus
aaccgtgcgcatcttggcaagcgcc

SEQ ID NO: 429638 - DNA, 25 bp, Mus musculus
tctggagccgctacccataagccga

SEQ ID NO: 429639 - DNA, 25 bp, Mus musculus
cataagccgacctgcccggtgctcc

SEQ ID NO: 429640 - DNA, 25 bp, Mus musculus
ctgtcagcagagaagtcgcggtacc

SEQ ID NO: 429641 - DNA, 25 bp, Mus musculus
ttctccgctgctgctacatctgtta

SEQ ID NO: 429642 - DNA, 25 bp, Mus musculus
tccggctttccaaacagcctgtgct

SEQ ID NO: 429643 - DNA, 25 bp, Mus musculus
agattcgccttagaccagagacttc

SEQ ID NO: 429644 - DNA, 25 bp, Mus musculus
cccgcggagattcgccttagaccag

SEQ ID NO: 429645 - DNA, 25 bp, Mus musculus
ctatttgttagtcctacatctgccc

SEQ ID NO: 429646 - DNA, 25 bp, Mus musculus
gccctgtcactatttgttagtccta

SEQ ID NO: 429647 - DNA, 25 bp, Mus musculus
tagaccagagacttctatgccaccc

SEQ ID NO: 429648 - DNA, 25 bp, Mus musculus
gccctcgcgtttggcgaggtgccca

SEQ ID NO: 429649 - DNA, 25 bp, Mus musculus
cgtagccgcctctgcggacagaaag

SEQ ID NO: 429650 - DNA, 25 bp, Mus musculus
tcgccttagaccagagacttctatg

SEQ ID NO: 429651 - DNA, 25 bp, Mus musculus
tttccaaacagcctgtgctcatttc

SEQ ID NO: 429652 - DNA, 25 bp, Mus musculus
gcctcctgagtcactgcggctgcgg

SEQ ID NO: 429653 - DNA, 25 bp, Mus musculus
gaggcctcctgagtcactgcggctg

SEQ ID NO: 429654 - DNA, 25 bp, Mus musculus
gcactgcacactcactgccctgtca

SEQ ID NO: 429655 - DNA, 25 bp, Mus musculus
cgagatgcggcatcccctgggtcag

SEQ ID NO: 429656 - DNA, 25 bp, Mus musculus
gtgaagctcccgcaaaggaaagctg

SEQ ID NO: 429657 - DNA, 25 bp, Mus musculus
cttacgggcagacgtgtattctgtc

SEQ ID NO: 429658 - DNA, 25 bp, Mus musculus
cagacgtgtattctgtctgtgcgcg

SEQ ID NO: 429659 - DNA, 25 bp, Mus musculus
tcaccggaaatcttacgggcagacg

SEQ ID NO: 429660 - DNA, 25 bp, Mus musculus
gcaaaggaaagctgcggccgtcacc

SEQ ID NO: 429661 - DNA, 25 bp, Mus musculus
cggggtttgcgtgaagctcccgcaa

SEQ ID NO: 429662 - DNA, 25 bp, Mus musculus
atgcgcaactctatgctcacgcgca

SEQ ID NO: 429663 - DNA, 25 bp, Mus musculus
aggcgcatgcgcaactctatgctca

SEQ ID NO: 429664 - DNA, 25 bp, Mus musculus
accacctttgccctgcgcggcaaga

SEQ ID NO: 429665 - DNA, 25 bp, Mus musculus
cagaaatcgcgcttgcacagcaacc

SEQ ID NO: 429666 - DNA, 25 bp, Mus musculus
tcaccaccagaaaccagaaatcgcg

SEQ ID NO: 429667 - DNA, 25 bp, Mus musculus
gcagctgcacctctaggtcaggcca

SEQ ID NO: 429668 - DNA, 25 bp, Mus musculus
accagcagctgcacctctaggtcag

SEQ ID NO: 429669 - DNA, 25 bp, Mus musculus
ctgcggccgtcaccggaaatcttac

SEQ ID NO: 429670 - DNA, 25 bp, Mus musculus
ggacgagagagtgcgcccgcccttc

SEQ ID NO: 429671 - DNA, 25 bp, Mus musculus
aacacgacttatagcgggctgcctc

SEQ ID NO: 429672 - DNA, 25 bp, Mus musculus
ggcctcaagcagctccgagggaaaa

SEQ ID NO: 429673 - DNA, 25 bp, Mus musculus
agatgagggcgcacgcagttgcacc

SEQ ID NO: 429674 - DNA, 25 bp, Mus musculus
gggcgcacgcagttgcacccgcaaa

SEQ ID NO: 429675 - DNA, 25 bp, Mus musculus
gttgcacccgcaaacacgacttata

SEQ ID NO: 429676 - DNA, 25 bp, Mus musculus
tgccctccggacgagagagtgcgcc

SEQ ID NO: 429677 - DNA, 25 bp, Mus musculus
tcccggggaagtttgcaaacacagc

SEQ ID NO: 429678 - DNA, 25 bp, Mus musculus
agtttgcaaacacagctgttccaga

SEQ ID NO: 429679 - DNA, 25 bp, Mus musculus
gaaccgctgggagtaaggcagcctg

SEQ ID NO: 429680 - DNA, 25 bp, Mus musculus
gcggaggttcccagactaaagcttg

SEQ ID NO: 429681 - DNA, 25 bp, Mus musculus
gggctgcctcttctaagccttacta

SEQ ID NO: 429682 - DNA, 25 bp, Mus musculus
ccagactaaagcttggacgccagcc

SEQ ID NO: 429683 - DNA, 25 bp, Mus musculus
ctaagccttactagggcgcgggaag

SEQ ID NO: 429684 - DNA, 25 bp, Mus musculus
cggctctaatatactccgtggattg

SEQ ID NO: 429685 - DNA, 25 bp, Mus musculus
ggcgcatgcgcgattgttaatattc

SEQ ID NO: 429686 - DNA, 25 bp, Mus musculus
gcccggcctccttttattattctga

SEQ ID NO: 429687 - DNA, 25 bp, Mus musculus
ccgcgcgttccagaaggcaaagagc

SEQ ID NO: 429688 - DNA, 25 bp, Mus musculus
aagccctttcaagagccgcgcgttc

SEQ ID NO: 429689 - DNA, 25 bp, Mus musculus
gcgcagccttttattccctttcaga

SEQ ID NO: 429690 - DNA, 25 bp, Mus musculus
tcaacacgcggaacaaggcgcatgc

SEQ ID NO: 429691 - DNA, 25 bp, Mus musculus
taatattcataaggggcgtgccatc

SEQ ID NO: 429692 - DNA, 25 bp, Mus musculus
ttggagcatgcacgactggaaaaca

SEQ ID NO: 429693 - DNA, 25 bp, Mus musculus
tccggaacttgcactgggagccaca

SEQ ID NO: 429694 - DNA, 25 bp, Mus musculus
ccttgtactcaagggctccggaact

SEQ ID NO: 429695 - DNA, 25 bp, Mus musculus
cctctcgggtgaaaagtcagggtca

SEQ ID NO: 429696 - DNA, 25 bp, Mus musculus
agagactcctaccttggctcgcagg

SEQ ID NO: 429697 - DNA, 25 bp, Mus musculus
ggccggctgcaggtaacacaatgac

SEQ ID NO: 429698 - DNA, 25 bp, Mus musculus
tggtggctgggttttataatccgca

SEQ ID NO: 429699 - DNA, 25 bp, Mus musculus
gcctccgctcttgatgctgtcgctg

SEQ ID NO: 429700 - DNA, 25 bp, Mus musculus
ggcactcgaccctggattgcagccg

SEQ ID NO: 429701 - DNA, 25 bp, Mus musculus
accctggattgcagccgggcaactt

SEQ ID NO: 429702 - DNA, 25 bp, Mus musculus
gcaggggcgcagcttttcgctgaaa

SEQ ID NO: 429703 - DNA, 25 bp, Mus musculus
cgctgaaagctataactcgagtgcc

SEQ ID NO: 429704 - DNA, 25 bp, Mus musculus
ccgaggtggtgatgttccagagcac

SEQ ID NO: 429705 - DNA, 25 bp, Mus musculus
atgttccagagcaccgtggccagtt

SEQ ID NO: 429706 - DNA, 25 bp, Mus musculus
caccgtggccagttgggcgcacgac

SEQ ID NO: 429707 - DNA, 25 bp, Mus musculus
gggcgcacgacaccaacatcacgga

SEQ ID NO: 429708 - DNA, 25 bp, Mus musculus
caacatcacggaggagaacgcgcga

SEQ ID NO: 429709 - DNA, 25 bp, Mus musculus
cagcaggacgcagcggccaatcaca

SEQ ID NO: 429710 - DNA, 25 bp, Mus musculus
cctagggcggacagcagacgccaga

SEQ ID NO: 429711 - DNA, 25 bp, Mus musculus
ggccgttgtcgcctccgctcttgat

SEQ ID NO: 429712 - DNA, 25 bp, Mus musculus
cgggcagacgacgtgggccaaacca

SEQ ID NO: 429713 - DNA, 25 bp, Mus musculus
cgacgtgggccaaaccacctcggtg

SEQ ID NO: 429714 - DNA, 25 bp, Mus musculus
tggcggccacttgcatcgtgcaagg

SEQ ID NO: 429715 - DNA, 25 bp, Mus musculus
gagtccgtcccgagcgcaccgagag

SEQ ID NO: 429716 - DNA, 25 bp, Mus musculus
cgagagcacctaggggcccgagcaa

SEQ ID NO: 429717 - DNA, 25 bp, Mus musculus
gagcaaacttctcccaagaaactta

SEQ ID NO: 429718 - DNA, 25 bp, Mus musculus
gggcgacgagatacccgagcttcgt

SEQ ID NO: 429719 - DNA, 25 bp, Mus musculus
caagaaacttattggggcgtggccg

SEQ ID NO: 429720 - DNA, 25 bp, Mus musculus
cacgcagaaagctgacggtgagtgc

SEQ ID NO: 429721 - DNA, 25 bp, Mus musculus
ttgcatcgtgcaaggccgagtccgt

SEQ ID NO: 429722 - DNA, 25 bp, Mus musculus
ggtagcgtccgtggccacgcagaaa

SEQ ID NO: 429723 - DNA, 25 bp, Mus musculus
atccctgagttcctggaccgggcct

SEQ ID NO: 429724 - DNA, 25 bp, Mus musculus
ggctctggatccctgagttcctgga

SEQ ID NO: 429725 - DNA, 25 bp, Mus musculus
acccgagcttcgtgcgggttacagg

SEQ ID NO: 429726 - DNA, 25 bp, Mus musculus
cccaaactcgctgctcaaggtcagg

SEQ ID NO: 429727 - DNA, 25 bp, Mus musculus
tagacgcgcgcggattgaatccaac

SEQ ID NO: 429728 - DNA, 25 bp, Mus musculus
acggtctgctgcacccagtgatcag

SEQ ID NO: 429729 - DNA, 25 bp, Mus musculus
ttccggaccgacagacaccgtgtca

SEQ ID NO: 429730 - DNA, 25 bp, Mus musculus
ggggtcgcagacacctggtttgtct

SEQ ID NO: 429731 - DNA, 25 bp, Mus musculus
cataaacttttctcaggtggcctgg

SEQ ID NO: 429732 - DNA, 25 bp, Mus musculus
ctagagcgagcagagggctagttcc

SEQ ID NO: 429733 - DNA, 25 bp, Mus musculus
agggctagttcctttgccacagcga

SEQ ID NO: 429734 - DNA, 25 bp, Mus musculus
agcgacctcggcagcaagcacttag

SEQ ID NO: 429735 - DNA, 25 bp, Mus musculus
cctcaaacggtgacaacctcggtga

SEQ ID NO: 429736 - DNA, 25 bp, Mus musculus
gcgacgaagctagaggtcccaagga

SEQ ID NO: 429737 - DNA, 25 bp, Mus musculus
gacagctcctgggattgctccgcca

SEQ ID NO: 429738 - DNA, 25 bp, Mus musculus
cagctagtgtcaagacccttccgga

SEQ ID NO: 429739 - DNA, 25 bp, Mus musculus
caagcacttagcacagccgagaagg

SEQ ID NO: 429740 - DNA, 25 bp, Mus musculus
ttccattggtcgacgtgcacacgtg

SEQ ID NO: 429741 - DNA, 25 bp, Mus musculus
ctgagtcctaatcgcctaggctata

SEQ ID NO: 429742 - DNA, 25 bp, Mus musculus
ccgcgacatctgtctgtgacacatc

SEQ ID NO: 429743 - DNA, 25 bp, Mus musculus
aacagactcagggaagctctgaccc

SEQ ID NO: 429744 - DNA, 25 bp, Mus musculus
ctaggctatagcgtctctctcttta

SEQ ID NO: 429745 - DNA, 25 bp, Mus musculus
ttaagcgtttgagctgagacactcc

SEQ ID NO: 429746 - DNA, 25 bp, Mus musculus
tccctgtagcctgggactgcacagc

SEQ ID NO: 429747 - DNA, 25 bp, Mus musculus
cgggagtggcgtaaagcctttccat

SEQ ID NO: 429748 - DNA, 25 bp, Mus musculus
acaggaagtagtcgttcgcccgttg

SEQ ID NO: 429749 - DNA, 25 bp, Mus musculus
tcagcgcagagcactcacacacagg

SEQ ID NO: 429750 - DNA, 25 bp, Mus musculus
ccggaccatacggagaccgaggcta

SEQ ID NO: 429751 - DNA, 25 bp, Mus musculus
acagcgtcagaacgagggacactca

SEQ ID NO: 429752 - DNA, 25 bp, Mus musculus
gctaacccgggctctaacagactca

SEQ ID NO: 429753 - DNA, 25 bp, Mus musculus
acctgggacacgtgagttccctgta

SEQ ID NO: 429754 - DNA, 25 bp, Mus musculus
agcagaagaattgggccgcccggca

SEQ ID NO: 429755 - DNA, 25 bp, Mus musculus
tccgcgagacgctccgtcttaacgg

SEQ ID NO: 429756 - DNA, 25 bp, Mus musculus
cgcccgggctgaagatgctgcgaaa

SEQ ID NO: 429757 - DNA, 25 bp, Mus musculus
gaggtcgcttctggtgtccctcctt

SEQ ID NO: 429758 - DNA, 25 bp, Mus musculus
ccatgaaatttgactacctgaagga

SEQ ID NO: 429759 - DNA, 25 bp, Mus musculus
cagagccctaaacatcttcgacagg

SEQ ID NO: 429760 - DNA, 25 bp, Mus musculus
ccagtctgagttcacatggagcgca

SEQ ID NO: 429761 - DNA, 25 bp, Mus musculus
gcgaaaggtcgttcttttgcgcctc

SEQ ID NO: 429762 - DNA, 25 bp, Mus musculus
agaaaccatgccctgctgtggcgcc

SEQ ID NO: 429763 - DNA, 25 bp, Mus musculus
tggcgcatgcgcctaatagaaacca

SEQ ID NO: 429764 - DNA, 25 bp, Mus musculus
gctagtcgtagtcccgttggcgcat

SEQ ID NO: 429765 - DNA, 25 bp, Mus musculus
ccgccttggaactgcgctagtcgta

SEQ ID NO: 429766 - DNA, 25 bp, Mus musculus
cgcgagctgggccaaactacttcaa

SEQ ID NO: 429767 - DNA, 25 bp, Mus musculus
gtctctgcatcgagcggcagtcgca

SEQ ID NO: 429768 - DNA, 25 bp, Mus musculus
caccatggagttctcggagaggaaa

SEQ ID NO: 429769 - DNA, 25 bp, Mus musculus
cttgcccgcaccatggagttctcgg

SEQ ID NO: 429770 - DNA, 25 bp, Mus musculus
tcccagagcttcaaactggtgagcc

SEQ ID NO: 429771 - DNA, 25 bp, Mus musculus
cgccgatcgcgacgcggaccttggt

SEQ ID NO: 429772 - DNA, 25 bp, Mus musculus
aactggtgagccgaggtaagctgcc

SEQ ID NO: 429773 - DNA, 25 bp, Mus musculus
gaaaagaagcaggaaatcccagagc

SEQ ID NO: 429774 - DNA, 25 bp, Mus musculus
atcgcgacgcggaccttggtcccgg

SEQ ID NO: 429775 - DNA, 25 bp, Mus musculus
ggctggccgccaaggagccacgatc

SEQ ID NO: 429776 - DNA, 25 bp, Mus musculus
ccaaggagccacgatccctggctta

SEQ ID NO: 429777 - DNA, 25 bp, Mus musculus
acgatccctggcttatttctaaagg

SEQ ID NO: 429778 - DNA, 25 bp, Mus musculus
gcttatttctaaaggcaggttcgcc

SEQ ID NO: 429779 - DNA, 25 bp, Mus musculus
tctaaaggcaggttcgcctccggga

SEQ ID NO: 429780 - DNA, 25 bp, Mus musculus
ccgctcccaacggaaagttgggctg

SEQ ID NO: 429781 - DNA, 25 bp, Mus musculus
agcttcaaactggtgagccgaggta

SEQ ID NO: 429782 - DNA, 25 bp, Mus musculus
ccagacgggatctcctcctctagta

SEQ ID NO: 429783 - DNA, 25 bp, Mus musculus
agagacagaggaagctgagtccgcc

SEQ ID NO: 429784 - DNA, 25 bp, Mus musculus
gcatcgcttcctctcgcattaaaga

SEQ ID NO: 429785 - DNA, 25 bp, Mus musculus
tcctctagtaacatctgcagctctg

SEQ ID NO: 429786 - DNA, 25 bp, Mus musculus
tatcagcgccctcttgccagacggg

SEQ ID NO: 429787 - DNA, 25 bp, Mus musculus
aggttctggtaactctctatcagcg

SEQ ID NO: 429788 - DNA, 25 bp, Mus musculus
atagttgttttcacagtagtccgcc

SEQ ID NO: 429789 - DNA, 25 bp, Mus musculus
cgctcaagctcctcacctgtatata

SEQ ID NO: 429790 - DNA, 25 bp, Mus musculus
acccattttctcaaggcggccactt

SEQ ID NO: 429791 - DNA, 25 bp, Mus musculus
gggtttaggcgcagacctcagccag

SEQ ID NO: 429792 - DNA, 25 bp, Mus musculus
aaacagatccctggcggggaaagcg

SEQ ID NO: 429793 - DNA, 25 bp, Mus musculus
ggaaggctgcaggaaacagatccct

SEQ ID NO: 429794 - DNA, 25 bp, Mus musculus
cgactaagaagagcggcctgcagtg

SEQ ID NO: 429795 - DNA, 25 bp, Mus musculus
cagtagtccgccacccgggtcaggt

SEQ ID NO: 429796 - DNA, 25 bp, Mus musculus
agcaacaagaagaaaaaggtgtgga

SEQ ID NO: 429797 - DNA, 25 bp, Mus musculus
tggtcaggaccccagctggcacttt

SEQ ID NO: 429798 - DNA, 25 bp, Mus musculus
ttaggttagcgcgaggcgtgaccta

SEQ ID NO: 429799 - DNA, 25 bp, Mus musculus
ggctcgcgcacttgtgggcgcacac

SEQ ID NO: 429800 - DNA, 25 bp, Mus musculus
gctagggtacaagttggtcaggacc

SEQ ID NO: 429801 - DNA, 25 bp, Mus musculus
cgcctgcgccctgaggctgaagtag

SEQ ID NO: 429802 - DNA, 25 bp, Mus musculus
cgcctccgtcgtgaagcagcctccc

SEQ ID NO: 429803 - DNA, 25 bp, Mus musculus
gcgtgacctagttgacaggctctga

SEQ ID NO: 429804 - DNA, 25 bp, Mus musculus
gggacgcagagcctttgcacttttc

SEQ ID NO: 429805 - DNA, 25 bp, Mus musculus
tttgcacttttccctcccgagtgtc

SEQ ID NO: 429806 - DNA, 25 bp, Mus musculus
cctgtttgcccgtgagcctggggaa

SEQ ID NO: 429807 - DNA, 25 bp, Mus musculus
gcctggggaacttgcagcttaaagc

SEQ ID NO: 429808 - DNA, 25 bp, Mus musculus
aacttgcagcttaaagccagccacc

SEQ ID NO: 429809 - DNA, 25 bp, Mus musculus
aacgtcctcggcgtcgagcccaagc

SEQ ID NO: 429810 - DNA, 25 bp, Mus musculus
actcacctgcgattcatgggccgga

SEQ ID NO: 429811 - DNA, 25 bp, Mus musculus
ttcaggaccgccaaggccactggca

SEQ ID NO: 429812 - DNA, 25 bp, Mus musculus
gccaaggccactggcacggccaggt

SEQ ID NO: 429813 - DNA, 25 bp, Mus musculus
tcaggggtttgtccctttcaatcca

SEQ ID NO: 429814 - DNA, 25 bp, Mus musculus
tttcaatccagaccggcctctgagc

SEQ ID NO: 429815 - DNA, 25 bp, Mus musculus
agagctttgcccttcaggaccgcca

SEQ ID NO: 429816 - DNA, 25 bp, Mus musculus
ttcatgggccggactctcacggcca

SEQ ID NO: 429817 - DNA, 25 bp, Mus musculus
tgaccgatgccatagctcatcccgg

SEQ ID NO: 429818 - DNA, 25 bp, Mus musculus
ccttcaacgcgggagagctttgccc

SEQ ID NO: 429819 - DNA, 25 bp, Mus musculus
ccgcgtgatccacgcaccggggttt

SEQ ID NO: 429820 - DNA, 25 bp, Mus musculus
acggccaccttgaccgatgccatag

SEQ ID NO: 429821 - DNA, 25 bp, Mus musculus
tttggcagctgcctacggcgcgaag

SEQ ID NO: 429822 - DNA, 25 bp, Mus musculus
ttgctaggcggccacacctgccagg

SEQ ID NO: 429823 - DNA, 25 bp, Mus musculus
acctggagttgctaggcggccacac

SEQ ID NO: 429824 - DNA, 25 bp, Mus musculus
ggcgggcgcccaacaatgaagagcc

SEQ ID NO: 429825 - DNA, 25 bp, Mus musculus
cggatcccgaaagtgccatggaact

SEQ ID NO: 429826 - DNA, 25 bp, Mus musculus
gccatggaactgaaagttggacgtc

SEQ ID NO: 429827 - DNA, 25 bp, Mus musculus
ttggacgtctgcaggacccgtgcat

SEQ ID NO: 429828 - DNA, 25 bp, Mus musculus
caacaatgaagagccgcgggtgctt

SEQ ID NO: 429829 - DNA, 25 bp, Mus musculus
cagagccggtcagcagatgtgccct

SEQ ID NO: 429830 - DNA, 25 bp, Mus musculus
tgggctgcgcctgctaaataaaccg

SEQ ID NO: 429831 - DNA, 25 bp, Mus musculus
cggtacatggctcccggaaggccgc

SEQ ID NO: 429832 - DNA, 25 bp, Mus musculus
gcgcgctgcagattggcctcgacgt

SEQ ID NO: 429833 - DNA, 25 bp, Mus musculus
tcgagccgcgcgtgctcggctgtca

SEQ ID NO: 429834 - DNA, 25 bp, Mus musculus
ttacttgctgcggaactcgtcgagc

SEQ ID NO: 429835 - DNA, 25 bp, Mus musculus
ctaaccgtgcctcttacttgctgcg

SEQ ID NO: 429836 - DNA, 25 bp, Mus musculus
tctctccgcggacagtctgcagtta

SEQ ID NO: 429837 - DNA, 25 bp, Mus musculus
tgtgtgcgggattaagccgcccata

SEQ ID NO: 429838 - DNA, 25 bp, Mus musculus
aggtgcacagactttgccgtcaggc

SEQ ID NO: 429839 - DNA, 25 bp, Mus musculus
ttgagagttctcgtcgccaagcaga

SEQ ID NO: 429840 - DNA, 25 bp, Mus musculus
tcccagcccgctcagaagataaaca

SEQ ID NO: 429841 - DNA, 25 bp, Mus musculus
gtcctggaataagcgctgactcaca

SEQ ID NO: 429842 - DNA, 25 bp, Mus musculus
cacagcactttgatcagccacggtc

SEQ ID NO: 429843 - DNA, 25 bp, Mus musculus
gcagatttttccctctcacgcgacg

SEQ ID NO: 429844 - DNA, 25 bp, Mus musculus
tccctgagagccgttttgagagttc

SEQ ID NO: 429845 - DNA, 25 bp, Mus musculus
tggccaggtggcgacttccatgtat

SEQ ID NO: 429846 - DNA, 25 bp, Mus musculus
tgtgtccacccttcacggagcagca

SEQ ID NO: 429847 - DNA, 25 bp, Mus musculus
tgtctggagactattgggactcctg

SEQ ID NO: 429848 - DNA, 25 bp, Mus musculus
gctggaactcgtgcccgcccttaat

SEQ ID NO: 429849 - DNA, 25 bp, Mus musculus
gctgccttcgatcccgaagtcggta

SEQ ID NO: 429850 - DNA, 25 bp, Mus musculus
ctgcttttgctacccggaggacgaa

SEQ ID NO: 429851 - DNA, 25 bp, Mus musculus
cttaataagctcgagctgccgcgtc

SEQ ID NO: 429852 - DNA, 25 bp, Mus musculus
gtaggcgggctaggatttatttgaa

SEQ ID NO: 429853 - DNA, 25 bp, Mus musculus
atttatttgaaatgcggggcgcctc

SEQ ID NO: 429854 - DNA, 25 bp, Mus musculus
cttaagctacagagtgaggtaggcg

SEQ ID NO: 429855 - DNA, 25 bp, Mus musculus
tcggtccgagcggaaatgcgttccg

SEQ ID NO: 429856 - DNA, 25 bp, Mus musculus
gcgctgcacttttccgaggctggcg

SEQ ID NO: 429857 - DNA, 25 bp, Mus musculus
tggagcagctcaaccgtctgacgcg

SEQ ID NO: 429858 - DNA, 25 bp, Mus musculus
gtgctgggtttgcttaagctacaga

SEQ ID NO: 429859 - DNA, 25 bp, Mus musculus
gccgcagcgagctcgctccttctcc

SEQ ID NO: 429860 - DNA, 25 bp, Mus musculus
agcatcctagcgttcctgggcgccg

SEQ ID NO: 429861 - DNA, 25 bp, Mus musculus
tcggcttagcatcctagcgttcctg

SEQ ID NO: 429862 - DNA, 25 bp, Mus musculus
ggcggactgactcggcttagcatcc

SEQ ID NO: 429863 - DNA, 25 bp, Mus musculus
gttcccagaaggcttcgcgagccca

SEQ ID NO: 429864 - DNA, 25 bp, Mus musculus
gcccagccagctcgaaactacagtt

SEQ ID NO: 429865 - DNA, 25 bp, Mus musculus
gagagagcgatggagcagctcaacc

SEQ ID NO: 429866 - DNA, 25 bp, Mus musculus
tgttccttggataacacgaacgttc

SEQ ID NO: 429867 - DNA, 25 bp, Mus musculus
cgttcctgcgaacgtgccatacgtc

SEQ ID NO: 429868 - DNA, 25 bp, Mus musculus
ctgcgaacgtgccatacgtcaggta

SEQ ID NO: 429869 - DNA, 25 bp, Mus musculus
acgtgccatacgtcaggtaagactg

SEQ ID NO: 429870 - DNA, 25 bp, Mus musculus
tgccatacgtcaggtaagactgaag

SEQ ID NO: 429871 - DNA, 25 bp, Mus musculus
gtggtcccttccggctcatgtttaa

SEQ ID NO: 429872 - DNA, 25 bp, Mus musculus
ccggctcatgtttaaactttcgtca

SEQ ID NO: 429873 - DNA, 25 bp, Mus musculus
tttaaactttcgtcactggacactc

SEQ ID NO: 429874 - DNA, 25 bp, Mus musculus
ttcgtcactggacactccacgctgg

SEQ ID NO: 429875 - DNA, 25 bp, Mus musculus
gacactccacgctggagctggttca

SEQ ID NO: 429876 - DNA, 25 bp, Mus musculus
cacgctggagctggttcagggcaca

SEQ ID NO: 429877 - DNA, 25 bp, Mus musculus
ggcacacggtgcctgggtccgctca

SEQ ID NO: 429878 - DNA, 25 bp, Mus musculus
ctttaaatgttccttggataacacg

SEQ ID NO: 429879 - DNA, 25 bp, Mus musculus
tgggtccgctcacccgctaccaaga

SEQ ID NO: 429880 - DNA, 25 bp, Mus musculus
gtactccgggaagttgctacggcca

SEQ ID NO: 429881 - DNA, 25 bp, Mus musculus
agggagcctcatcccgtactccggg

SEQ ID NO: 429882 - DNA, 25 bp, Mus musculus
atcgagctgcctcttcctattggtt

SEQ ID NO: 429883 - DNA, 25 bp, Mus musculus
ggaccagccattcatcgagctgcct

SEQ ID NO: 429884 - DNA, 25 bp, Mus musculus
ctttctgcctcggagctggcgaacg

SEQ ID NO: 429885 - DNA, 25 bp, Mus musculus
tggagtcgtggcactttctgcctcg

SEQ ID NO: 429886 - DNA, 25 bp, Mus musculus
ttcttacctgcagcgggagacgcga

SEQ ID NO: 429887 - DNA, 25 bp, Mus musculus
ctgccgacgtgtcctgtggccacag

SEQ ID NO: 429888 - DNA, 25 bp, Mus musculus
ggcccggccaagtttcttacctgca

SEQ ID NO: 429889 - DNA, 25 bp, Mus musculus
agacgtgtcactcgcggcgcgaccg

SEQ ID NO: 429890 - DNA, 25 bp, Mus musculus
gccgccgaggagacgtgtcactcgc

SEQ ID NO: 429891 - DNA, 25 bp, Mus musculus
tcttagcccaacttcggagcgcgcg

SEQ ID NO: 429892 - DNA, 25 bp, Mus musculus
tcatccggtggcttcccgaaactta

SEQ ID NO: 429893 - DNA, 25 bp, Mus musculus
ttgctacggccagtcccggacggca

SEQ ID NO: 429894 - DNA, 25 bp, Mus musculus
acgcctggcgaagatgccaggtctg

SEQ ID NO: 429895 - DNA, 25 bp, Mus musculus
aggtcgaggtgagaaccaggctctc

SEQ ID NO: 429896 - DNA, 25 bp, Mus musculus
ctctgcaaaggcggaagatgacgtg

SEQ ID NO: 429897 - DNA, 25 bp, Mus musculus
aacgtttcactcttcgctcggcggg

SEQ ID NO: 429898 - DNA, 25 bp, Mus musculus
gctgcccggaacgtttcactcttcg

SEQ ID NO: 429899 - DNA, 25 bp, Mus musculus
gctctcagggctgcccggaacgttt

SEQ ID NO: 429900 - DNA, 25 bp, Mus musculus
agaaccaggctctcagggctgcccg

SEQ ID NO: 429901 - DNA, 25 bp, Mus musculus
ctgcgtcaaggtcgaggtgagaacc

SEQ ID NO: 429902 - DNA, 25 bp, Mus musculus
tgcgggacaactgcgtcaaggtcga

SEQ ID NO: 429903 - DNA, 25 bp, Mus musculus
gcacctgcgggacaactgcgtcaag

SEQ ID NO: 429904 - DNA, 25 bp, Mus musculus
tgcacaatggcacctgcgggacaac

SEQ ID NO: 429905 - DNA, 25 bp, Mus musculus
taacccagcggctcaggatgcagcg

SEQ ID NO: 429906 - DNA, 25 bp, Mus musculus
ccgaatccagctgccagcgaggcag

SEQ ID NO: 429907 - DNA, 25 bp, Mus musculus
ggtcgcgatctaacccagcggctca

SEQ ID NO: 429908 - DNA, 25 bp, Mus musculus
ccctatccaaactcgggcacgaagg

SEQ ID NO: 429909 - DNA, 25 bp, Mus musculus
cgggaacctccagcccaggtagcga

SEQ ID NO: 429910 - DNA, 25 bp, Mus musculus
cacgaagggccacgcttgtcctgtc

SEQ ID NO: 429911 - DNA, 25 bp, Mus musculus
gccgctgaccgaccttctatttaaa

SEQ ID NO: 429912 - DNA, 25 bp, Mus musculus
ggtacagctagaaccctgccgctga

SEQ ID NO: 429913 - DNA, 25 bp, Mus musculus
tggtggcatctcaggtacagctaga

SEQ ID NO: 429914 - DNA, 25 bp, Mus musculus
cgagatctcgtgagcgcgacaacgc

SEQ ID NO: 429915 - DNA, 25 bp, Mus musculus
gctcagccagagtccaagatggcga

SEQ ID NO: 429916 - DNA, 25 bp, Mus musculus
acgcctcgagaaaggacgcgcaccg

SEQ ID NO: 429917 - DNA, 25 bp, Mus musculus
caatagaagctacgcggggagccta

SEQ ID NO: 429918 - DNA, 25 bp, Mus musculus
ccgtccatcttggagccgggcaata

SEQ ID NO: 429919 - DNA, 25 bp, Mus musculus
tgctgctccagcaactcgggaaccg

SEQ ID NO: 429920 - DNA, 25 bp, Mus musculus
aagggatctcaccttgctgcggtcc

SEQ ID NO: 429921 - DNA, 25 bp, Mus musculus
ccgcggcccgggcaatttatggctc

SEQ ID NO: 429922 - DNA, 25 bp, Mus musculus
tttggcccgcgctgcaaccaacggt

SEQ ID NO: 429923 - DNA, 25 bp, Mus musculus
ggcgtcgtgaagctctggagtttca

SEQ ID NO: 429924 - DNA, 25 bp, Mus musculus
tagacgagtctaccctagccatccg

SEQ ID NO: 429925 - DNA, 25 bp, Mus musculus
ggttctcaggccaacccacgaagca

SEQ ID NO: 429926 - DNA, 25 bp, Mus musculus
caagtttcctctcgcgcccgtggag

SEQ ID NO: 429927 - DNA, 25 bp, Mus musculus
agcggaccttcacgagcggtttaga

SEQ ID NO: 429928 - DNA, 25 bp, Mus musculus
ctgccagatgtccatcggtgccttg

SEQ ID NO: 429929 - DNA, 25 bp, Mus musculus
cggtcctgccgccaggcaatttagc

SEQ ID NO: 429930 - DNA, 25 bp, Mus musculus
ggtcccaggtttcccagcctagatc

SEQ ID NO: 429931 - DNA, 25 bp, Mus musculus
cctcacctgggatgtaagtgtctgc

SEQ ID NO: 429932 - DNA, 25 bp, Mus musculus
tgcccttttgtcatccgggagctca

SEQ ID NO: 429933 - DNA, 25 bp, Mus musculus
ggagctcatcccagctgcggacaga

SEQ ID NO: 429934 - DNA, 25 bp, Mus musculus
atggtgggatcctctcttccgactg

SEQ ID NO: 429935 - DNA, 25 bp, Mus musculus
gggctcctcctcttcaccaaaaaga

SEQ ID NO: 429936 - DNA, 25 bp, Mus musculus
agcctggcgacgatagcacttgcaa

SEQ ID NO: 429937 - DNA, 25 bp, Mus musculus
ccaggggttacgctcggcgctcgat

SEQ ID NO: 429938 - DNA, 25 bp, Mus musculus
acgctcggcgctcgattgctagagc

SEQ ID NO: 429939 - DNA, 25 bp, Mus musculus
ctcgattgctagagcctggcgacga

SEQ ID NO: 429940 - DNA, 25 bp, Mus musculus
ctctgcgctcgagaggtcgagcctg

SEQ ID NO: 429941 - DNA, 25 bp, Mus musculus
gcgacgatagcacttgcaacggctc

SEQ ID NO: 429942 - DNA, 25 bp, Mus musculus
tagcacttgcaacggctctgcgctc

SEQ ID NO: 429943 - DNA, 25 bp, Mus musculus
gcgcgttcaggacgccgacttctct

SEQ ID NO: 429944 - DNA, 25 bp, Mus musculus
caagggcgcgttcaggacgccgact

SEQ ID NO: 429945 - DNA, 25 bp, Mus musculus
tcacgtgaccgcgtcttccggggcg

SEQ ID NO: 429946 - DNA, 25 bp, Mus musculus
ccacggtggccggcgtgcatctgaa

SEQ ID NO: 429947 - DNA, 25 bp, Mus musculus
tctcggtgctgctgacggcggccac

SEQ ID NO: 429948 - DNA, 25 bp, Mus musculus
agttcgaaggcagtgctgggcctct

SEQ ID NO: 429949 - DNA, 25 bp, Mus musculus
ctagagcctggcgacgatagcactt

SEQ ID NO: 429950 - DNA, 25 bp, Mus musculus
gctaaagacatcagaagagctcaga

SEQ ID NO: 429951 - DNA, 25 bp, Mus musculus
tcagaagagctcagaaagaagcggc

SEQ ID NO: 429952 - DNA, 25 bp, Mus musculus
gctcagaaagaagcggctggcctcc

SEQ ID NO: 429953 - DNA, 25 bp, Mus musculus
aaagaagcggctggcctcctcgaca

SEQ ID NO: 429954 - DNA, 25 bp, Mus musculus
gcggctggcctcctcgacaggagca

SEQ ID NO: 429955 - DNA, 25 bp, Mus musculus
cccgtcaagttcataagccgaggcc

SEQ ID NO: 429956 - DNA, 25 bp, Mus musculus
gtcaagttcataagccgaggccgga

SEQ ID NO: 429957 - DNA, 25 bp, Mus musculus
gaggccggatctgattttggagaaa

SEQ ID NO: 429958 - DNA, 25 bp, Mus musculus
ctgattttggagaaaggagaagtga

SEQ ID NO: 429959 - DNA, 25 bp, Mus musculus
gaagtgatcgacttctcgtccctga

SEQ ID NO: 429960 - DNA, 25 bp, Mus musculus
tgatcgacttctcgtccctgagctc

SEQ ID NO: 429961 - DNA, 25 bp, Mus musculus
gtctccttctccgtctctggatttc

SEQ ID NO: 429962 - DNA, 25 bp, Mus musculus
cggtcgcgaacacaggaagctaaag

SEQ ID NO: 429963 - DNA, 25 bp, Mus musculus
gcgaacacaggaagctaaagacatc

SEQ ID NO: 429964 - DNA, 25 bp, Mus musculus
cctacagaggaaggtgtccggaagc

SEQ ID NO: 429965 - DNA, 25 bp, Mus musculus
ggcaggcgtcgagacaaaacggaca

SEQ ID NO: 429966 - DNA, 25 bp, Mus musculus
acggacaggccttgccagtcatttg

SEQ ID NO: 429967 - DNA, 25 bp, Mus musculus
ccagtcatttggctatatcaaggta

SEQ ID NO: 429968 - DNA, 25 bp, Mus musculus
tatcaaggtaaatgccgacatcgcg

SEQ ID NO: 429969 - DNA, 25 bp, Mus musculus
gcggctccaagggaagagtgactta

SEQ ID NO: 429970 - DNA, 25 bp, Mus musculus
cgcaactagatttttacgagtaatc

SEQ ID NO: 429971 - DNA, 25 bp, Mus musculus
caaaactgacgttcccagcggggcg

SEQ ID NO: 429972 - DNA, 25 bp, Mus musculus
gggcgtccttgagatttccaggcca

SEQ ID NO: 429973 - DNA, 25 bp, Mus musculus
cggggagcttcctaagtgcctacaa

SEQ ID NO: 429974 - DNA, 25 bp, Mus musculus
gggactacgccagcctacagaggaa

SEQ ID NO: 429975 - DNA, 25 bp, Mus musculus
ggcattacgttgttcaccgaccatc

SEQ ID NO: 429976 - DNA, 25 bp, Mus musculus
cacacacaggaagggtgggctacaa

SEQ ID NO: 429977 - DNA, 25 bp, Mus musculus
aagtgcctacaacgcgggcattacg

SEQ ID NO: 429978 - DNA, 25 bp, Mus musculus
ccgatccgatgaagaaggcccagcg

SEQ ID NO: 429979 - DNA, 25 bp, Mus musculus
agccagaggctcttgtccgacaagc

SEQ ID NO: 429980 - DNA, 25 bp, Mus musculus
cgccaacccgttgtcaggtttctca

SEQ ID NO: 429981 - DNA, 25 bp, Mus musculus
aggtttctcacggtctcaccacagc

SEQ ID NO: 429982 - DNA, 25 bp, Mus musculus
ccgctgcagcttgcgtttccacaga

SEQ ID NO: 429983 - DNA, 25 bp, Mus musculus
ttggcagggaaatcgacatcctagc

SEQ ID NO: 429984 - DNA, 25 bp, Mus musculus
gatccttctgcgacactttcttgta

SEQ ID NO: 429985 - DNA, 25 bp, Mus musculus
ccggatgaagaaggtccctcgcctc

SEQ ID NO: 429986 - DNA, 25 bp, Mus musculus
ggggccacttttcctctagtctcga

SEQ ID NO: 429987 - DNA, 25 bp, Mus musculus
ctagtctcgaaaactgccctcatgg

SEQ ID NO: 429988 - DNA, 25 bp, Mus musculus
ccggtggagatagaaaacaggtact

SEQ ID NO: 429989 - DNA, 25 bp, Mus musculus
tgcaataaagctaggctcccgacgc

SEQ ID NO: 429990 - DNA, 25 bp, Mus musculus
tcccgacgctaagcgagcagtcagc

SEQ ID NO: 429991 - DNA, 25 bp, Mus musculus
agaatatgccttctcggcggctgga

SEQ ID NO: 429992 - DNA, 25 bp, Mus musculus
gacaactccgggctacgcgtccctc

SEQ ID NO: 429993 - DNA, 25 bp, Mus musculus
atttggatgacggttccgcaggcgc

SEQ ID NO: 429994 - DNA, 25 bp, Mus musculus
gctggatgcatttggatgacggttc

SEQ ID NO: 429995 - DNA, 25 bp, Mus musculus
cgtcatgttgtgtcagggcggtccc

SEQ ID NO: 429996 - DNA, 25 bp, Mus musculus
acagacgtcatgttgtgtcagggcg

SEQ ID NO: 429997 - DNA, 25 bp, Mus musculus
ccctgaggcaaacagacgtcatgtt

SEQ ID NO: 429998 - DNA, 25 bp, Mus musculus
ctcttctcgcttcccggtagctagg

SEQ ID NO: 429999 - DNA, 25 bp, Mus musculus
aggctgagggcctctccggacaact

SEQ ID NO: 430000 - DNA, 25 bp, Mus musculus
caactagcggccgagactctctgtc

SEQ ID NO: 430001 - DNA, 25 bp, Mus musculus
aaagatcaccaactagcggccgaga

SEQ ID NO: 430002 - DNA, 25 bp, Mus musculus
cgcacttgctgagctcaaaaagatc

SEQ ID NO: 430003 - DNA, 25 bp, Mus musculus
gcacccgcacttgctgagctcaaaa

SEQ ID NO: 430004 - DNA, 25 bp, Mus musculus
gcgaagagaggacccgcacccgcac

SEQ ID NO: 430005 - DNA, 25 bp, Mus musculus
tagctaggcgatgagagggacttcc

SEQ ID NO: 430006 - DNA, 25 bp, Mus musculus
agccctcggaattggggtgttggtg

SEQ ID NO: 430007 - DNA, 25 bp, Mus musculus
cggtttctgactccttagccctcgg

SEQ ID NO: 430008 - DNA, 25 bp, Mus musculus
tggtgactcgaacatccggaaggac

SEQ ID NO: 430009 - DNA, 25 bp, Mus musculus
gtgactcgaacatccggaaggaccg

SEQ ID NO: 430010 - DNA, 25 bp, Mus musculus
ggtgactcgaacatccggaaggacc

SEQ ID NO: 430011 - DNA, 25 bp, Mus musculus
gtggtgactcgaacatccggaagga

SEQ ID NO: 430012 - DNA, 25 bp, Mus musculus
cttagccctcggaattggggtgttg

SEQ ID NO: 430013 - DNA, 25 bp, Mus musculus
ctccttagccctcggaattggggtg

SEQ ID NO: 430014 - DNA, 25 bp, Mus musculus
ctgactccttagccctcggaattgg

SEQ ID NO: 430015 - DNA, 25 bp, Mus musculus
tctgactccttagccctcggaattg

SEQ ID NO: 430016 - DNA, 25 bp, Mus musculus
ttctgactccttagccctcggaatt

SEQ ID NO: 430017 - DNA, 25 bp, Mus musculus
tttctgactccttagccctcggaat

SEQ ID NO: 430018 - DNA, 25 bp, Mus musculus
gtttctgactccttagccctcggaa

SEQ ID NO: 430019 - DNA, 25 bp, Mus musculus
ggtttctgactccttagccctcgga

SEQ ID NO: 430020 - DNA, 25 bp, Mus musculus
cgccgcgaaatgacgtttcggagcg

SEQ ID NO: 430021 - DNA, 25 bp, Mus musculus
agagtgactcgtccgcgccgtgcct

SEQ ID NO: 430022 - DNA, 25 bp, Mus musculus
gctcagagtgactcgtccgcgccgt

SEQ ID NO: 430023 - DNA, 25 bp, Mus musculus
gagagttgatgacccagaagccggc

SEQ ID NO: 430024 - DNA, 25 bp, Mus musculus
cagagagagttgatgacccagaagc

SEQ ID NO: 430025 - DNA, 25 bp, Mus musculus
ttgcttatgggaagaatcagagaga

SEQ ID NO: 430026 - DNA, 25 bp, Mus musculus
gtgggcttgcttatgggaagaatca

SEQ ID NO: 430027 - DNA, 25 bp, Mus musculus
ccgaagccagacaggccgaggcaag

SEQ ID NO: 430028 - DNA, 25 bp, Mus musculus
ctctgcaatggtgaaggggcgcata

SEQ ID NO: 430029 - DNA, 25 bp, Mus musculus
ttcagtcccggtgagtggctccgga

SEQ ID NO: 430030 - DNA, 25 bp, Mus musculus
atcgactgtgagctgaggtggactt

SEQ ID NO: 430031 - DNA, 25 bp, Mus musculus
gagcggtgaccaatcgactgtgagc

SEQ ID NO: 430032 - DNA, 25 bp, Mus musculus
aatgacgtttcggagcggtgaccaa

SEQ ID NO: 430033 - DNA, 25 bp, Mus musculus
gcctgagagccgacggccggtttct

SEQ ID NO: 430034 - DNA, 25 bp, Mus musculus
tctgtgagtcactgcacaacctatc

SEQ ID NO: 430035 - DNA, 25 bp, Mus musculus
gacagtcagtccatccctcggtcgg

SEQ ID NO: 430036 - DNA, 25 bp, Mus musculus
attaaatgtcttgagcgagccgagc

SEQ ID NO: 430037 - DNA, 25 bp, Mus musculus
tcattggccacaggccggcgtccat

SEQ ID NO: 430038 - DNA, 25 bp, Mus musculus
ctgccctaggactctttaaagtctg

SEQ ID NO: 430039 - DNA, 25 bp, Mus musculus
tggtctatgatcacgcccgtcacgg

SEQ ID NO: 430040 - DNA, 25 bp, Mus musculus
ggttacttgcgtgactgactcgggc

SEQ ID NO: 430041 - DNA, 25 bp, Mus musculus
ttagaagactcattgggccaggggc

SEQ ID NO: 430042 - DNA, 25 bp, Mus musculus
gcccggtgctctacagtgtccttag

SEQ ID NO: 430043 - DNA, 25 bp, Mus musculus
gcacttctagaacgaggagggcaga

SEQ ID NO: 430044 - DNA, 25 bp, Mus musculus
cggattggcggaaagcgcacttcta

SEQ ID NO: 430045 - DNA, 25 bp, Mus musculus
ggcccggctctcacacggttacttg

SEQ ID NO: 430046 - DNA, 25 bp, Mus musculus
agcgagcctcactgccattggtcta

SEQ ID NO: 430047 - DNA, 25 bp, Mus musculus
ctcccgtccagtccgtgtgcggtat

SEQ ID NO: 430048 - DNA, 25 bp, Mus musculus
acgcagctctgtggaatgggtcctc

SEQ ID NO: 430049 - DNA, 25 bp, Mus musculus
ctcatgggttcaggctccgtgcttt

SEQ ID NO: 430050 - DNA, 25 bp, Mus musculus
aatgggtcctcacggagctcttccg

SEQ ID NO: 430051 - DNA, 25 bp, Mus musculus
agccaccggcggagtcgcaaggtct

SEQ ID NO: 430052 - DNA, 25 bp, Mus musculus
gcaaggtctgaccacacagcaaatt

SEQ ID NO: 430053 - DNA, 25 bp, Mus musculus
agcaaattccagtcgctacagccgc

SEQ ID NO: 430054 - DNA, 25 bp, Mus musculus
tacagccgccgccatgaaggccgtg

SEQ ID NO: 430055 - DNA, 25 bp, Mus musculus
aaggccgtggtgcagcgcgtcactc

SEQ ID NO: 430056 - DNA, 25 bp, Mus musculus
tcactcgggctagcgtcacaggtca

SEQ ID NO: 430057 - DNA, 25 bp, Mus musculus
cgacccgctgttccgtgtgagggtt

SEQ ID NO: 430058 - DNA, 25 bp, Mus musculus
cgagttaccgggcagcctctgggca

SEQ ID NO: 430059 - DNA, 25 bp, Mus musculus
cgccgtggccgagaagatccggcac

SEQ ID NO: 430060 - DNA, 25 bp, Mus musculus
gagctcttccggtgttgccggtaga

SEQ ID NO: 430061 - DNA, 25 bp, Mus musculus
aagatccggcacgtgcctggccgct

SEQ ID NO: 430062 - DNA, 25 bp, Mus musculus
aagggtgagtgctcgccgcctgccc

SEQ ID NO: 430063 - DNA, 25 bp, Mus musculus
tggccagcgactcatagcatcccgg

SEQ ID NO: 430064 - DNA, 25 bp, Mus musculus
acaccgaacaggcacggggacactc

SEQ ID NO: 430065 - DNA, 25 bp, Mus musculus
gtacgggaagctgcgctcactctag

SEQ ID NO: 430066 - DNA, 25 bp, Mus musculus
agctgcgctcactctagctgttggc

SEQ ID NO: 430067 - DNA, 25 bp, Mus musculus
gctcactctagctgttggcgcgctc

SEQ ID NO: 430068 - DNA, 25 bp, Mus musculus
actctagctgttggcgcgctccggc

SEQ ID NO: 430069 - DNA, 25 bp, Mus musculus
ccgcgtggacactggagtgcgaccc

SEQ ID NO: 430070 - DNA, 25 bp, Mus musculus
tgctgctctggtcgctgtcgagcct

SEQ ID NO: 430071 - DNA, 25 bp, Mus musculus
cacggggacactccggtctcttgcg

SEQ ID NO: 430072 - DNA, 25 bp, Mus musculus
tgcggctccagcagttcgggctctc

SEQ ID NO: 430073 - DNA, 25 bp, Mus musculus
tgggtccagccacaccgaacaggca

SEQ ID NO: 430074 - DNA, 25 bp, Mus musculus
gtgctggccagcgactcatagcatc

SEQ ID NO: 430075 - DNA, 25 bp, Mus musculus
gctgcactcccgcagcctgaggtca

SEQ ID NO: 430076 - DNA, 25 bp, Mus musculus
ccatctcctcgcagctggacttctc

SEQ ID NO: 430077 - DNA, 25 bp, Mus musculus
gacttctccagcctgcgtggccctt

SEQ ID NO: 430078 - DNA, 25 bp, Mus musculus
cccggatccgaagtcggtctaatgc

SEQ ID NO: 430079 - DNA, 25 bp, Mus musculus
ccgaagtcggtctaatgcttgcacg

SEQ ID NO: 430080 - DNA, 25 bp, Mus musculus
tcggtctaatgcttgcacgcatctg

SEQ ID NO: 430081 - DNA, 25 bp, Mus musculus
ttgcacgcatctgaggaagaaagga

SEQ ID NO: 430082 - DNA, 25 bp, Mus musculus
gaaacaaactctggcagtggagaca

SEQ ID NO: 430083 - DNA, 25 bp, Mus musculus
ttcagggcgggtccagacaagtttg

SEQ ID NO: 430084 - DNA, 25 bp, Mus musculus
cagacaagtttgctccgggttaggt

SEQ ID NO: 430085 - DNA, 25 bp, Mus musculus
aacttttcgattcccaatccatacg

SEQ ID NO: 430086 - DNA, 25 bp, Mus musculus
cgcgcaggcgccttgttcttcaact

SEQ ID NO: 430087 - DNA, 25 bp, Mus musculus
ggcgccttgttcttcaactccaatc

SEQ ID NO: 430088 - DNA, 25 bp, Mus musculus
tgttcttcaactccaatcagctcgc

SEQ ID NO: 430089 - DNA, 25 bp, Mus musculus
tcctggtaacccggcgattgcccga

SEQ ID NO: 430090 - DNA, 25 bp, Mus musculus
ggctctgaatcacagccaccaccgt

SEQ ID NO: 430091 - DNA, 25 bp, Mus musculus
gcccagccggaggtcggagccggag

SEQ ID NO: 430092 - DNA, 25 bp, Mus musculus
cacagctgggcacgcaggtggagcc

SEQ ID NO: 430093 - DNA, 25 bp, Mus musculus
ttcctcctccgactcgctggagttc

SEQ ID NO: 430094 - DNA, 25 bp, Mus musculus
gccgcccggctctgaatcacagcca

SEQ ID NO: 430095 - DNA, 25 bp, Mus musculus
ccaccgtgccatggagccaggcaga

SEQ ID NO: 430096 - DNA, 25 bp, Mus musculus
caccgtgccatggagccaggcagag

SEQ ID NO: 430097 - DNA, 25 bp, Mus musculus
cagaggctgagcgacatgagccttt

SEQ ID NO: 430098 - DNA, 25 bp, Mus musculus
aggctgagcgacatgagcctttcca

SEQ ID NO: 430099 - DNA, 25 bp, Mus musculus
ctgagcgacatgagcctttccactt

SEQ ID NO: 430100 - DNA, 25 bp, Mus musculus
tgagcgacatgagcctttccacttc

SEQ ID NO: 430101 - DNA, 25 bp, Mus musculus
cctccgactcgctggagttcgaccg

SEQ ID NO: 430102 - DNA, 25 bp, Mus musculus
cccggggattgcacaagggcgccgc

SEQ ID NO: 430103 - DNA, 25 bp, Mus musculus
agcccgagctagagctggagttaga

SEQ ID NO: 430104 - DNA, 25 bp, Mus musculus
gttgcccagcaacctctggtccgga

SEQ ID NO: 430105 - DNA, 25 bp, Mus musculus
gggcgcggatcattaaggcaattgc

SEQ ID NO: 430106 - DNA, 25 bp, Mus musculus
cattaaggcaattgctgatttcagc

SEQ ID NO: 430107 - DNA, 25 bp, Mus musculus
ttgctgatttcagccgccagagaga

SEQ ID NO: 430108 - DNA, 25 bp, Mus musculus
cgccagagagagctacgacgctact

SEQ ID NO: 430109 - DNA, 25 bp, Mus musculus
tggcggcggcgcaatgaccacgctc

SEQ ID NO: 430110 - DNA, 25 bp, Mus musculus
gtagttctttgtcccaccccatggc

SEQ ID NO: 430111 - DNA, 25 bp, Mus musculus
gcaacctctggtccggaagtagttc

SEQ ID NO: 430112 - DNA, 25 bp, Mus musculus
tgcgacgacctgttccgcttcaaca

SEQ ID NO: 430113 - DNA, 25 bp, Mus musculus
gttccgcttcaacaacatgtgagtg

SEQ ID NO: 430114 - DNA, 25 bp, Mus musculus
acaacatgtgagtgaggcacggccg

SEQ ID NO: 430115 - DNA, 25 bp, Mus musculus
tctggtccggaagtagttctttgtc

SEQ ID NO: 430116 - DNA, 25 bp, Mus musculus
gggccttcacctgcgacgacctgtt

SEQ ID NO: 430117 - DNA, 25 bp, Mus musculus
acgacgctactcttgttgcccagca

SEQ ID NO: 430118 - DNA, 25 bp, Mus musculus
cctttgaggggcgtagaaatccatt

SEQ ID NO: 430119 - DNA, 25 bp, Mus musculus
tggccactttaggaatgcgctgttt

SEQ ID NO: 430120 - DNA, 25 bp, Mus musculus
ccgatgctttgcaaccctggaagga

SEQ ID NO: 430121 - DNA, 25 bp, Mus musculus
acctgtcttcttggaccgcggcaca

SEQ ID NO: 430122 - DNA, 25 bp, Mus musculus
accgcggcacagagatcgctgtctc

SEQ ID NO: 430123 - DNA, 25 bp, Mus musculus
gctgtctcgaatctctggtgcccga

SEQ ID NO: 430124 - DNA, 25 bp, Mus musculus
tgcccgacaccgcagatgctgttcg

SEQ ID NO: 430125 - DNA, 25 bp, Mus musculus
tgccatgactgcagccgtggaactc

SEQ ID NO: 430126 - DNA, 25 bp, Mus musculus
tcctggccgacaaccggacttgaga

SEQ ID NO: 430127 - DNA, 25 bp, Mus musculus
aaagcacttcgaaccggccggcaca

SEQ ID NO: 430128 - DNA, 25 bp, Mus musculus
ccggaacttgcgaagacgacctttg

SEQ ID NO: 430129 - DNA, 25 bp, Mus musculus
gatttgtagtctttcgagttcccgc

SEQ ID NO: 430130 - DNA, 25 bp, Mus musculus
gcgagggctcatccaggtctatctc

SEQ ID NO: 430131 - DNA, 25 bp, Mus musculus
cgccgcgtcgtttccttagcaactg

SEQ ID NO: 430132 - DNA, 25 bp, Mus musculus
tgtggaattatttaaacgggagatc

SEQ ID NO: 430133 - DNA, 25 bp, Mus musculus
tggcccgacggttcactggtgtgta

SEQ ID NO: 430134 - DNA, 25 bp, Mus musculus
gccgaacaaaggcagcggcccatgg

SEQ ID NO: 430135 - DNA, 25 bp, Mus musculus
tgctaatgtgccgaacaaaggcagc

SEQ ID NO: 430136 - DNA, 25 bp, Mus musculus
cagctttatgctaatgtgccgaaca

SEQ ID NO: 430137 - DNA, 25 bp, Mus musculus
tttaaacgggagatccgtggcagct

SEQ ID NO: 430138 - DNA, 25 bp, Mus musculus
tgcactctccttttgtgtggaatta

SEQ ID NO: 430139 - DNA, 25 bp, Mus musculus
ggagatccgtggcagctttatgcta

SEQ ID NO: 430140 - DNA, 25 bp, Mus musculus
gttcgatttctttcatgcactctcc

SEQ ID NO: 430141 - DNA, 25 bp, Mus musculus
acccttgttcgatttctttcatgca

SEQ ID NO: 430142 - DNA, 25 bp, Mus musculus
cgcggcttcacccttgttcgatttc

SEQ ID NO: 430143 - DNA, 25 bp, Mus musculus
gaggggacactcgagcgcgtccctc

SEQ ID NO: 430144 - DNA, 25 bp, Mus musculus
gcctcataatgggcgcgcggcagat

SEQ ID NO: 430145 - DNA, 25 bp, Mus musculus
gggtggataaaagcggtggcctcat

SEQ ID NO: 430146 - DNA, 25 bp, Mus musculus
tcgcggtgagttgtttggctgtttt

SEQ ID NO: 430147 - DNA, 25 bp, Mus musculus
acggcagaacttctcaggaatgggg

SEQ ID NO: 430148 - DNA, 25 bp, Mus musculus
aggctagtgggtcctccggtgactc

SEQ ID NO: 430149 - DNA, 25 bp, Mus musculus
gtgtgattggttggccggcatcttc

SEQ ID NO: 430150 - DNA, 25 bp, Mus musculus
aaagggtccgctatcacgggcggct

SEQ ID NO: 430151 - DNA, 25 bp, Mus musculus
tatcacgggcggctcaacctccaag

SEQ ID NO: 430152 - DNA, 25 bp, Mus musculus
ccaaggcctgctgctagagatgctc

SEQ ID NO: 430153 - DNA, 25 bp, Mus musculus
agatgctcttcctcgcggtgagttg

SEQ ID NO: 430154 - DNA, 25 bp, Mus musculus
acctgagttgatgtggccttgattg

SEQ ID NO: 430155 - DNA, 25 bp, Mus musculus
gctgtttttgttggctgggatgtac

SEQ ID NO: 430156 - DNA, 25 bp, Mus musculus
ttgttggctgggatgtactcttaga

SEQ ID NO: 430157 - DNA, 25 bp, Mus musculus
ctgggatgtactcttagacacgccc

SEQ ID NO: 430158 - DNA, 25 bp, Mus musculus
aaggaaccgggccacctgagttgat

SEQ ID NO: 430159 - DNA, 25 bp, Mus musculus
ctagagatgctcttcctcgcggtga

SEQ ID NO: 430160 - DNA, 25 bp, Mus musculus
aggtgggacccaaccagtgcgtcgc

SEQ ID NO: 430161 - DNA, 25 bp, Mus musculus
acgaggtgaccacgtcgccggttct

SEQ ID NO: 430162 - DNA, 25 bp, Mus musculus
ctgcacttcgaggacgaggtgacca

SEQ ID NO: 430163 - DNA, 25 bp, Mus musculus
ggccatccgcaagctgcacttcgag

SEQ ID NO: 430164 - DNA, 25 bp, Mus musculus
gagcgccaaaaagccgaaggccatc

SEQ ID NO: 430165 - DNA, 25 bp, Mus musculus
tcaagatgggcactgcgttctccgc

SEQ ID NO: 430166 - DNA, 25 bp, Mus musculus
ttcgctcccgccgagctcaagatgg

SEQ ID NO: 430167 - DNA, 25 bp, Mus musculus
gcagcttcaacctgggctcgccggt

SEQ ID NO: 430168 - DNA, 25 bp, Mus musculus
cacaagtacttcgagcgcagcttca

SEQ ID NO: 430169 - DNA, 25 bp, Mus musculus
cgcgagcacgagaagcacaagtact

SEQ ID NO: 430170 - DNA, 25 bp, Mus musculus
tctacagtcccacgcggccggtgag

SEQ ID NO: 430171 - DNA, 25 bp, Mus musculus
gcagcaagaagtccacgcccgtgtc

SEQ ID NO: 430172 - DNA, 25 bp, Mus musculus
tctggtgaagcgcagcaagaagtcc

SEQ ID NO: 430173 - DNA, 25 bp, Mus musculus
cggttctggggctcaagatcaagga

SEQ ID NO: 430174 - DNA, 25 bp, Mus musculus
acgagtcactgcatagggtcgcgac

SEQ ID NO: 430175 - DNA, 25 bp, Mus musculus
gccgcaagtgctcccgggaactgta

SEQ ID NO: 430176 - DNA, 25 bp, Mus musculus
caccttctgcgtggactttttcaca

SEQ ID NO: 430177 - DNA, 25 bp, Mus musculus
ggactttttcacatctccgtggctc

SEQ ID NO: 430178 - DNA, 25 bp, Mus musculus
ccgtggctccttcgggagaacatcc

SEQ ID NO: 430179 - DNA, 25 bp, Mus musculus
ctgcgccgcacgagtcactgcatag

SEQ ID NO: 430180 - DNA, 25 bp, Mus musculus
tcagcctcagcggaggctccaggaa

SEQ ID NO: 430181 - DNA, 25 bp, Mus musculus
catcccggactgttcacgcactagg

SEQ ID NO: 430182 - DNA, 25 bp, Mus musculus
ttcacgcactaggagcctgaggcta

SEQ ID NO: 430183 - DNA, 25 bp, Mus musculus
gcccagcttcgagtctgcgcagtga

SEQ ID NO: 430184 - DNA, 25 bp, Mus musculus
tgcgcagtgacctccaatcagattg

SEQ ID NO: 430185 - DNA, 25 bp, Mus musculus
cagattgcggtgttttccatatgac

SEQ ID NO: 430186 - DNA, 25 bp, Mus musculus
gaaggcggtgtcgatgcgaaaccct

SEQ ID NO: 430187 - DNA, 25 bp, Mus musculus
tccatatgaccaggaccgcgagctc

SEQ ID NO: 430188 - DNA, 25 bp, Mus musculus
cgtcaatttcctgggcctgtacctg

SEQ ID NO: 430189 - DNA, 25 bp, Mus musculus
accgcgtcaatttcctgggcctgta

SEQ ID NO: 430190 - DNA, 25 bp, Mus musculus
ccgcagagtccaaccgcgtcaattt

SEQ ID NO: 430191 - DNA, 25 bp, Mus musculus
tcgcgcagaaggctccaccgcagag

SEQ ID NO: 430192 - DNA, 25 bp, Mus musculus
ttcctcgctcagctcgcgcagaagg

SEQ ID NO: 430193 - DNA, 25 bp, Mus musculus
accgccctgtctccttgcttcctcg

SEQ ID NO: 430194 - DNA, 25 bp, Mus musculus
tctacaacatccgtaaccatcacag

SEQ ID NO: 430195 - DNA, 25 bp, Mus musculus
tccgtaaccatcacagcctccgccg

SEQ ID NO: 430196 - DNA, 25 bp, Mus musculus
gggcctgtacctggagccacagcag

SEQ ID NO: 430197 - DNA, 25 bp, Mus musculus
tgtacctggagccacagcaggcccg

SEQ ID NO: 430198 - DNA, 25 bp, Mus musculus
tcttcctgggcgtcgccctgctcgt

SEQ ID NO: 430199 - DNA, 25 bp, Mus musculus
tgggtctcgcccatcggctctacaa

SEQ ID NO: 430200 - DNA, 25 bp, Mus musculus
ggctctacaacatccgtaaccatca

SEQ ID NO: 430201 - DNA, 25 bp, Mus musculus
atttcctgggcctgtacctggagcc

SEQ ID NO: 430202 - DNA, 25 bp, Mus musculus
gcagcccgaagatgtctccagcggc

SEQ ID NO: 430203 - DNA, 25 bp, Mus musculus
aatatcaattaatcatgcagcgggc

SEQ ID NO: 430204 - DNA, 25 bp, Mus musculus
catgcagcgggcaaacaaggagatt

SEQ ID NO: 430205 - DNA, 25 bp, Mus musculus
caaggagatttatcccgcgacaaac

SEQ ID NO: 430206 - DNA, 25 bp, Mus musculus
ccaccgagagccgttgaatgggcgt

SEQ ID NO: 430207 - DNA, 25 bp, Mus musculus
catgtgaaaagacgagcaaaactcc

SEQ ID NO: 430208 - DNA, 25 bp, Mus musculus
gcaaaactccgtggttcaacagcta

SEQ ID NO: 430209 - DNA, 25 bp, Mus musculus
ctgggatggggaaattacttgatta

SEQ ID NO: 430210 - DNA, 25 bp, Mus musculus
tacttgattagcgtccgtcggagga

SEQ ID NO: 430211 - DNA, 25 bp, Mus musculus
gcttggaatccaactgcggaacaaa

SEQ ID NO: 430212 - DNA, 25 bp, Mus musculus
tgcggaacaaaacgcgctggtaaac

SEQ ID NO: 430213 - DNA, 25 bp, Mus musculus
cgacctgaagggacaacgcgctagc

SEQ ID NO: 430214 - DNA, 25 bp, Mus musculus
cataatgtcatcagccctggcccga

SEQ ID NO: 430215 - DNA, 25 bp, Mus musculus
gcgtcgcctttcagctcctggcggt

SEQ ID NO: 430216 - DNA, 25 bp, Mus musculus
tccgccacctctgcgcccttggcga

SEQ ID NO: 430217 - DNA, 25 bp, Mus musculus
cgctaggcgccttgtttacccgcgg

SEQ ID NO: 430218 - DNA, 25 bp, Mus musculus
ggtctccttgggcaacgctggcccg

SEQ ID NO: 430219 - DNA, 25 bp, Mus musculus
cctgcgccaggcctccgccacctct

SEQ ID NO: 430220 - DNA, 25 bp, Mus musculus
ggcgccttgtttacccgcggtgcat

SEQ ID NO: 430221 - DNA, 25 bp, Mus musculus
ccagctactacgaaagggtgggcca

SEQ ID NO: 430222 - DNA, 25 bp, Mus musculus
actacgaaagggtgggccagctcca

SEQ ID NO: 430223 - DNA, 25 bp, Mus musculus
ccagcaggctctgcgggacaggtac

SEQ ID NO: 430224 - DNA, 25 bp, Mus musculus
cactgagagcatcggggtacggtgt

SEQ ID NO: 430225 - DNA, 25 bp, Mus musculus
cggtgtccggcccacttcccgccag

SEQ ID NO: 430226 - DNA, 25 bp, Mus musculus
ttcccgccagtggttcactagtgtt

SEQ ID NO: 430227 - DNA, 25 bp, Mus musculus
cgccagtggttcactagtgttggaa

SEQ ID NO: 430228 - DNA, 25 bp, Mus musculus
tcactagtgttggaactcgcctgcg

SEQ ID NO: 430229 - DNA, 25 bp, Mus musculus
cagctgccctgtggcaatgccgcga

SEQ ID NO: 430230 - DNA, 25 bp, Mus musculus
ctcgttggttacactctcccgctgg

SEQ ID NO: 430231 - DNA, 25 bp, Mus musculus
ctttaccagagaacgcggcgagcca

SEQ ID NO: 430232 - DNA, 25 bp, Mus musculus
gagtcggctctcaaaggctttacca

SEQ ID NO: 430233 - DNA, 25 bp, Mus musculus
cactccggcagtctaaatgaacttc

SEQ ID NO: 430234 - DNA, 25 bp, Mus musculus
ccgctcctgctagtctcgttggtta

SEQ ID NO: 430235 - DNA, 25 bp, Mus musculus
gcctccgttagtttgctagtttaca

SEQ ID NO: 430236 - DNA, 25 bp, Mus musculus
tacccgtccatcattgtcaactgcg

SEQ ID NO: 430237 - DNA, 25 bp, Mus musculus
gaccgctggttggtccactgtcttg

SEQ ID NO: 430238 - DNA, 25 bp, Mus musculus
atcgcttgttttccacccgagcctg

SEQ ID NO: 430239 - DNA, 25 bp, Mus musculus
cgagcctggccatttgttgcagtta

SEQ ID NO: 430240 - DNA, 25 bp, Mus musculus
cgggcagcagctagttacgaaggac

SEQ ID NO: 430241 - DNA, 25 bp, Mus musculus
tgtgtttcacttcctgcctccgtta

SEQ ID NO: 430242 - DNA, 25 bp, Mus musculus
ccgattcgtgagtgttgcttttgtc

SEQ ID NO: 430243 - DNA, 25 bp, Mus musculus
tggtatgacgtaacttccggccgct

SEQ ID NO: 430244 - DNA, 25 bp, Mus musculus
cccgctcgttttaagtgacggcacg

SEQ ID NO: 430245 - DNA, 25 bp, Mus musculus
ctgcccatggcgctgtgcgggaact

SEQ ID NO: 430246 - DNA, 25 bp, Mus musculus
ccgcgtgcagcggtgccagcgactt

SEQ ID NO: 430247 - DNA, 25 bp, Mus musculus
cgcgatgccggtcagcgaacccatg

SEQ ID NO: 430248 - DNA, 25 bp, Mus musculus
atgccggtcagcgaacccatgccgg

SEQ ID NO: 430249 - DNA, 25 bp, Mus musculus
acccatgccggccacgttcacgccc

SEQ ID NO: 430250 - DNA, 25 bp, Mus musculus
gccgacggccccatgaacctggaga

SEQ ID NO: 430251 - DNA, 25 bp, Mus musculus
ctgcgagaaccgttcccgccgacgc

SEQ ID NO: 430252 - DNA, 25 bp, Mus musculus
cgctgaccaggacgccagcaccctc

SEQ ID NO: 430253 - DNA, 25 bp, Mus musculus
ctcacttgacgagtagcgcgggtcc

SEQ ID NO: 430254 - DNA, 25 bp, Mus musculus
aggcgggcagctcacccatgttgcc

SEQ ID NO: 430255 - DNA, 25 bp, Mus musculus
ggccgccgttgcagtagctgcccat

SEQ ID NO: 430256 - DNA, 25 bp, Mus musculus
cgttgcagtagctgcccatggcgct

SEQ ID NO: 430257 - DNA, 25 bp, Mus musculus
tgcgccccaggaggttcccgagaaa

SEQ ID NO: 430258 - DNA, 25 bp, Mus musculus
ggtaaggatcgagtcctcctcgcca

SEQ ID NO: 430259 - DNA, 25 bp, Mus musculus
agggcctaaggcctccagtcttgga

SEQ ID NO: 430260 - DNA, 25 bp, Mus musculus
aggggcggcgctcaccaagtccact

SEQ ID NO: 430261 - DNA, 25 bp, Mus musculus
caagtccactgctgggcctggacca

SEQ ID NO: 430262 - DNA, 25 bp, Mus musculus
ccgagctgtactgggcgttgtactg

SEQ ID NO: 430263 - DNA, 25 bp, Mus musculus
tgtactgcatgtgctgcagcgactg

SEQ ID NO: 430264 - DNA, 25 bp, Mus musculus
cacggtttgccgtccctgaccaaga

SEQ ID NO: 430265 - DNA, 25 bp, Mus musculus
agaggcgtcacctccatacctttct

SEQ ID NO: 430266 - DNA, 25 bp, Mus musculus
ccgggcacgtttcatcttgtagcga

SEQ ID NO: 430267 - DNA, 25 bp, Mus musculus
atcttgacctgtgtcggcgtgagac

SEQ ID NO: 430268 - DNA, 25 bp, Mus musculus
agctcgtaggtctgcgctttggaga

SEQ ID NO: 430269 - DNA, 25 bp, Mus musculus
ccctgggtctccttgtcattgtccg

SEQ ID NO: 430270 - DNA, 25 bp, Mus musculus
cattgtccggtgactcgtcagccga

SEQ ID NO: 430271 - DNA, 25 bp, Mus musculus
ctctggggatttggagctcgagtct

SEQ ID NO: 430272 - DNA, 25 bp, Mus musculus
tcttaaggggcaggctctgcacagc

SEQ ID NO: 430273 - DNA, 25 bp, Mus musculus
tggtcagcgacatggttccggaccc

SEQ ID NO: 430274 - DNA, 25 bp, Mus musculus
cccgtctttgtgttggtcagcgaca

SEQ ID NO: 430275 - DNA, 25 bp, Mus musculus
ggtccaagatgtccttgactgaaaa

SEQ ID NO: 430276 - DNA, 25 bp, Mus musculus
tgtccggaaggtccaagatgtcctt

SEQ ID NO: 430277 - DNA, 25 bp, Mus musculus
ccgtcttcatcgttggtgtccggaa

SEQ ID NO: 430278 - DNA, 25 bp, Mus musculus
agtttcgctacttacgggagtattg

SEQ ID NO: 430279 - DNA, 25 bp, Mus musculus
gcaggctctgcacagcgtccagggc

SEQ ID NO: 430280 - DNA, 25 bp, Mus musculus
tcgtagaaagggctcttaaggggca

SEQ ID NO: 430281 - DNA, 25 bp, Mus musculus
gctgctgtcgtagaaagggctctta

SEQ ID NO: 430282 - DNA, 25 bp, Mus musculus
ttgtcgctgctgtcgtagaaagggc

SEQ ID NO: 430283 - DNA, 25 bp, Mus musculus
cttacgggagtattggaggccctcg

SEQ ID NO: 430284 - DNA, 25 bp, Mus musculus
cgttgcggccaagtttcgctactta

SEQ ID NO: 430285 - DNA, 25 bp, Mus musculus
ggccaccgagccgtcttcatcgttg

SEQ ID NO: 430286 - DNA, 25 bp, Mus musculus
tgtgacagcgcctcactccgagctg

SEQ ID NO: 430287 - DNA, 25 bp, Mus musculus
aatacaaaccgattgctaagctgcg

SEQ ID NO: 430288 - DNA, 25 bp, Mus musculus
tcggacccgggcaaacacaaataca

SEQ ID NO: 430289 - DNA, 25 bp, Mus musculus
acaatggcccaggttggagcgagcc

SEQ ID NO: 430290 - DNA, 25 bp, Mus musculus
tatgtgacgtgggtgacaatggccc

SEQ ID NO: 430291 - DNA, 25 bp, Mus musculus
cccagtatgtgacgtgggtgacaat

SEQ ID NO: 430292 - DNA, 25 bp, Mus musculus
ccgagctgctcagcggctttctgca

SEQ ID NO: 430293 - DNA, 25 bp, Mus musculus
tctagagccttgtgacagcgcctca

SEQ ID NO: 430294 - DNA, 25 bp, Mus musculus
ccgggtttctagagccttgtgacag

SEQ ID NO: 430295 - DNA, 25 bp, Mus musculus
tccaagctcacagctgcttgggccg

SEQ ID NO: 430296 - DNA, 25 bp, Mus musculus
aggcatcgagtcctccaagctcaca

SEQ ID NO: 430297 - DNA, 25 bp, Mus musculus
acgctcaggcatcgagtcctccaag

SEQ ID NO: 430298 - DNA, 25 bp, Mus musculus
aagcagaacgctcaggcatcgagtc

SEQ ID NO: 430299 - DNA, 25 bp, Mus musculus
agcggctttctgcaactctctctgc

SEQ ID NO: 430300 - DNA, 25 bp, Mus musculus
cccgactccgtgactctgggacaga

SEQ ID NO: 430301 - DNA, 25 bp, Mus musculus
tgcgcgaacaggaggctcacctgga

SEQ ID NO: 430302 - DNA, 25 bp, Mus musculus
ttccttggtattctggcctctgctt

SEQ ID NO: 430303 - DNA, 25 bp, Mus musculus
tgcttaccaagctgaatcgtgagtc

SEQ ID NO: 430304 - DNA, 25 bp, Mus musculus
gtctgtggcaggtaaaacttttctc

SEQ ID NO: 430305 - DNA, 25 bp, Mus musculus
ttttctcaacgacaaatgcgaccag

SEQ ID NO: 430306 - DNA, 25 bp, Mus musculus
aggaggctgtcccttctcgaggcct

SEQ ID NO: 430307 - DNA, 25 bp, Mus musculus
ccctggtgaccagccaagtccttgg

SEQ ID NO: 430308 - DNA, 25 bp, Mus musculus
caagtccttggagggcttaagatgc

SEQ ID NO: 430309 - DNA, 25 bp, Mus musculus
taagatgcctggatctgcccacctg

SEQ ID NO: 430310 - DNA, 25 bp, Mus musculus
ctgggacagagtccatctagagatg

SEQ ID NO: 430311 - DNA, 25 bp, Mus musculus
gtggtcgcatcccagcggtagcaaa

SEQ ID NO: 430312 - DNA, 25 bp, Mus musculus
ccgagctgttcagaggcttggtcct

SEQ ID NO: 430313 - DNA, 25 bp, Mus musculus
cccgtgagcaagcatgcatgcagga

SEQ ID NO: 430314 - DNA, 25 bp, Mus musculus
gcggactccattgctgcacagctcg

SEQ ID NO: 430315 - DNA, 25 bp, Mus musculus
cggatacacgggctgtttttgtgac

SEQ ID NO: 430316 - DNA, 25 bp, Mus musculus
tatcgccgcacctccttcattctcc

SEQ ID NO: 430317 - DNA, 25 bp, Mus musculus
ctcacttgccgaggcggactccatt

SEQ ID NO: 430318 - DNA, 25 bp, Mus musculus
gggatcctactcacgcactcctcta

SEQ ID NO: 430319 - DNA, 25 bp, Mus musculus
agcaactcccgccagctagattcaa

SEQ ID NO: 430320 - DNA, 25 bp, Mus musculus
tcccgccagctagattcaaaaggtt

SEQ ID NO: 430321 - DNA, 25 bp, Mus musculus
ccagctagattcaaaaggtttcgcc

SEQ ID NO: 430322 - DNA, 25 bp, Mus musculus
tagattcaaaaggtttcgcctacgc

SEQ ID NO: 430323 - DNA, 25 bp, Mus musculus
acgtcaccgcgcgtctgcgctctgc

SEQ ID NO: 430324 - DNA, 25 bp, Mus musculus
tctgccggctccctgtaagcaggca

SEQ ID NO: 430325 - DNA, 25 bp, Mus musculus
tccctgtaagcaggcatcgacgggt

SEQ ID NO: 430326 - DNA, 25 bp, Mus musculus
ctcagccgcggatacacgggctgtt

SEQ ID NO: 430327 - DNA, 25 bp, Mus musculus
ttcattctcctcacttgccgaggcg

SEQ ID NO: 430328 - DNA, 25 bp, Mus musculus
atgccatccgcctacgaatcgtgga

SEQ ID NO: 430329 - DNA, 25 bp, Mus musculus
gcagaagggttctatgtcctcagga

SEQ ID NO: 430330 - DNA, 25 bp, Mus musculus
cctgatccactttccctgggcagaa

SEQ ID NO: 430331 - DNA, 25 bp, Mus musculus
agccatcgatgggtcagtcccttaa

SEQ ID NO: 430332 - DNA, 25 bp, Mus musculus
ccaagggctgaagagcacaatgtcc

SEQ ID NO: 430333 - DNA, 25 bp, Mus musculus
cggctggctctgtccttagatctga

SEQ ID NO: 430334 - DNA, 25 bp, Mus musculus
ttatctcagagtcgcgctagggtgc

SEQ ID NO: 430335 - DNA, 25 bp, Mus musculus
tagcacagctgggtatccgaccctg

SEQ ID NO: 430336 - DNA, 25 bp, Mus musculus
accctgtgacatcagtaggcaactg

SEQ ID NO: 430337 - DNA, 25 bp, Mus musculus
tctcatggctgcgtgagcaaaatcc

SEQ ID NO: 430338 - DNA, 25 bp, Mus musculus
atctttgcctgggagatccgtgacc

SEQ ID NO: 430339 - DNA, 25 bp, Mus musculus
ctactggctgatggcgtttgtgaca

SEQ ID NO: 430340 - DNA, 25 bp, Mus musculus
tcgcatcctgcgaaataagattggc

SEQ ID NO: 430341 - DNA, 25 bp, Mus musculus
gtgccctctgtgagctccatcagtc

SEQ ID NO: 430342 - DNA, 25 bp, Mus musculus
ggttactgaagacggcgcgcctcct

SEQ ID NO: 430343 - DNA, 25 bp, Mus musculus
cgcgcagcttggcaagcactataac

SEQ ID NO: 430344 - DNA, 25 bp, Mus musculus
cccaagattggttggctggacagcc

SEQ ID NO: 430345 - DNA, 25 bp, Mus musculus
tacttggagcccaagattggttggc

SEQ ID NO: 430346 - DNA, 25 bp, Mus musculus
aatgtggagcgaccctacttggagc

SEQ ID NO: 430347 - DNA, 25 bp, Mus musculus
ccatcggcaatgtggagcgacccta

SEQ ID NO: 430348 - DNA, 25 bp, Mus musculus
tctggtacgccatcggcaatgtgga

SEQ ID NO: 430349 - DNA, 25 bp, Mus musculus
tggctggcctgtatctggtacgcca

SEQ ID NO: 430350 - DNA, 25 bp, Mus musculus
gcgctcattgcgcactggctggcct

SEQ ID NO: 430351 - DNA, 25 bp, Mus musculus
ctcatgtgtacttttgcgctcattg

SEQ ID NO: 430352 - DNA, 25 bp, Mus musculus
gccgtactcttcctgctcatgtgta

SEQ ID NO: 430353 - DNA, 25 bp, Mus musculus
gctattctgaatacggggccgccgt

SEQ ID NO: 430354 - DNA, 25 bp, Mus musculus
cccggaagctggaccgctattctga

SEQ ID NO: 430355 - DNA, 25 bp, Mus musculus
caagcactataacggcagcgaccca

SEQ ID NO: 430356 - DNA, 25 bp, Mus musculus
gcaggctttccctctcgttccaggg

SEQ ID NO: 430357 - DNA, 25 bp, Mus musculus
tctcgttccagggaaggcaccagcc

SEQ ID NO: 430358 - DNA, 25 bp, Mus musculus
cagcggaatggggaggcattaatta

SEQ ID NO: 430359 - DNA, 25 bp, Mus musculus
caccttttaattccgccgtagagtg

SEQ ID NO: 430360 - DNA, 25 bp, Mus musculus
gaaggcaccagccacgctaggcaga

SEQ ID NO: 430361 - DNA, 25 bp, Mus musculus
ttagcctcgcctaacgtccggcagg

SEQ ID NO: 430362 - DNA, 25 bp, Mus musculus
gaggccttgcattaccagcggaatg

SEQ ID NO: 430363 - DNA, 25 bp, Mus musculus
tgacggattcgaggccttgcattac

SEQ ID NO: 430364 - DNA, 25 bp, Mus musculus
acaagtaattgacggattcgaggcc

SEQ ID NO: 430365 - DNA, 25 bp, Mus musculus
ggcgacactcgtctaatgacaagta

SEQ ID NO: 430366 - DNA, 25 bp, Mus musculus
cgtggggcgacactcgtctaatgac

SEQ ID NO: 430367 - DNA, 25 bp, Mus musculus
cgccatcaaaggctcgagggaaggc

SEQ ID NO: 430368 - DNA, 25 bp, Mus musculus
tgggctaggtgacccggcgccatca

SEQ ID NO: 430369 - DNA, 25 bp, Mus musculus
cacgctaggcagagcccggtttgga

SEQ ID NO: 430370 - DNA, 25 bp, Mus musculus
ggaggcgccgcaagtcaatatttga

SEQ ID NO: 430371 - DNA, 25 bp, Mus musculus
tcgtgcaagcctctggaatctcttg

SEQ ID NO: 430372 - DNA, 25 bp, Mus musculus
gaaatctccgttgctatcccaggta

SEQ ID NO: 430373 - DNA, 25 bp, Mus musculus
cctttggaacctcactggggcagtc

SEQ ID NO: 430374 - DNA, 25 bp, Mus musculus
ggggcagtctcaagcgaaaatcatc

SEQ ID NO: 430375 - DNA, 25 bp, Mus musculus
cccagcatactggaagccgagtgca

SEQ ID NO: 430376 - DNA, 25 bp, Mus musculus
tgtcctctattctggggtttcgtac

SEQ ID NO: 430377 - DNA, 25 bp, Mus musculus
ccgccaactcggctaggaactgtta

SEQ ID NO: 430378 - DNA, 25 bp, Mus musculus
tgtcccggcttcgtagcgacaaact

SEQ ID NO: 430379 - DNA, 25 bp, Mus musculus
gaggctcagcctcgcccagattcta

SEQ ID NO: 430380 - DNA, 25 bp, Mus musculus
ctaggggctcctcaaatcagctggc

SEQ ID NO: 430381 - DNA, 25 bp, Mus musculus
actctgttaggatagtgcgtggctc

SEQ ID NO: 430382 - DNA, 25 bp, Mus musculus
ccctggccagggcaagagcttacct

SEQ ID NO: 430383 - DNA, 25 bp, Mus musculus
cgcgcgctgccaaacataactctgt

SEQ ID NO: 430384 - DNA, 25 bp, Mus musculus
tgcgcatgacgccacctggaacatt

SEQ ID NO: 430385 - DNA, 25 bp, Mus musculus
cctggaacattggagtagaggtgtc

SEQ ID NO: 430386 - DNA, 25 bp, Mus musculus
agaggtgtctgcgaccatcccagca

SEQ ID NO: 430387 - DNA, 25 bp, Mus musculus
actggccgctggcattcagtgacca

SEQ ID NO: 430388 - DNA, 25 bp, Mus musculus
ccgagcgagcggaaacattctggca

SEQ ID NO: 430389 - DNA, 25 bp, Mus musculus
aaacattctggcagcccggggtctc

SEQ ID NO: 430390 - DNA, 25 bp, Mus musculus
ctctggctttgcaggcgctcgctct

SEQ ID NO: 430391 - DNA, 25 bp, Mus musculus
ttagcttttggaatcctaatcgcgc

SEQ ID NO: 430392 - DNA, 25 bp, Mus musculus
atcctaatcgcgctccaactgctgt

SEQ ID NO: 430393 - DNA, 25 bp, Mus musculus
caagtgctccgcgtggaagtgaaca

SEQ ID NO: 430394 - DNA, 25 bp, Mus musculus
gtgaacacagccaaacccgcgtcta

SEQ ID NO: 430395 - DNA, 25 bp, Mus musculus
cgcgtctagtctcctagctccgaga

SEQ ID NO: 430396 - DNA, 25 bp, Mus musculus
tcctagctccgagaaagggtgggtc

SEQ ID NO: 430397 - DNA, 25 bp, Mus musculus
ggtctctccctaggcctctggcttt

SEQ ID NO: 430398 - DNA, 25 bp, Mus musculus
ttcactagtgtcttctgcctcaccg

SEQ ID NO: 430399 - DNA, 25 bp, Mus musculus
ccgagacatgaacgcgccagcaact

SEQ ID NO: 430400 - DNA, 25 bp, Mus musculus
tcaccgtgctcagcgtggaccgcta

SEQ ID NO: 430401 - DNA, 25 bp, Mus musculus
cgtggacggcctgaacatgttcact

SEQ ID NO: 430402 - DNA, 25 bp, Mus musculus
tgctcagcgtgccattcgtggcctc

SEQ ID NO: 430403 - DNA, 25 bp, Mus musculus
cgtgatcctacgctatgccaagatg

SEQ ID NO: 430404 - DNA, 25 bp, Mus musculus
cgccctggtcatcttcgtgatccta

SEQ ID NO: 430405 - DNA, 25 bp, Mus musculus
agcgggcatggtcactatccagtgc

SEQ ID NO: 430406 - DNA, 25 bp, Mus musculus
cacaagagctcttcgggcaaaggca

SEQ ID NO: 430407 - DNA, 25 bp, Mus musculus
gcgcaggtaagaaaagcccacaaga

SEQ ID NO: 430408 - DNA, 25 bp, Mus musculus
tagcccggcgaaactggcaacatgg

SEQ ID NO: 430409 - DNA, 25 bp, Mus musculus
agtaaagtttctgatagcccggcga

SEQ ID NO: 430410 - DNA, 25 bp, Mus musculus
gagcgattcggagagaaccaggatc

SEQ ID NO: 430411 - DNA, 25 bp, Mus musculus
cagtgcatctatgcgctcgtgtgtc

SEQ ID NO: 430412 - DNA, 25 bp, Mus musculus
agaccgtgacgcacagagggccgca

SEQ ID NO: 430413 - DNA, 25 bp, Mus musculus
agcttcagttgctgtcgagaccgtg

SEQ ID NO: 430414 - DNA, 25 bp, Mus musculus
aaaccctgggtctcagtctcgcatg

SEQ ID NO: 430415 - DNA, 25 bp, Mus musculus
agcgtttgaaagtccgcaccactga

SEQ ID NO: 430416 - DNA, 25 bp, Mus musculus
ggtactagagatgtgggcagcctca

SEQ ID NO: 430417 - DNA, 25 bp, Mus musculus
ccacctgctgtaactggtgtggtta

SEQ ID NO: 430418 - DNA, 25 bp, Mus musculus
ggcagcctcaggatcgcgagtattc

SEQ ID NO: 430419 - DNA, 25 bp, Mus musculus
tgcctaccggcagcgtttgaaagtc

SEQ ID NO: 430420 - DNA, 25 bp, Mus musculus
cgagtattcaccgtcagaggcctgc

SEQ ID NO: 430421 - DNA, 25 bp, Mus musculus
tgcaggaagctgtgaagtaaaactc

SEQ ID NO: 430422 - DNA, 25 bp, Mus musculus
ctggtgtggttatcgccagtaaccc

SEQ ID NO: 430423 - DNA, 25 bp, Mus musculus
agtaacccactggaagccgcgcagg

SEQ ID NO: 430424 - DNA, 25 bp, Mus musculus
ctcacagaggaaaccctgggtctca

SEQ ID NO: 430425 - DNA, 25 bp, Mus musculus
agtctcgcatggcttctcttcccag

SEQ ID NO: 430426 - DNA, 25 bp, Mus musculus
gaacagaactgtgtcagcaagacga

SEQ ID NO: 430427 - DNA, 25 bp, Mus musculus
tcggattactgggttctccggacgc

SEQ ID NO: 430428 - DNA, 25 bp, Mus musculus
gtcagcaagacgacagttcctgccc

SEQ ID NO: 430429 - DNA, 25 bp, Mus musculus
ttactgggttctccggacgccttgc

SEQ ID NO: 430430 - DNA, 25 bp, Mus musculus
cagcctgggatcacctctgcgcgat

SEQ ID NO: 430431 - DNA, 25 bp, Mus musculus
tgcgttctcggattactgggttctc

SEQ ID NO: 430432 - DNA, 25 bp, Mus musculus
gggatcacctctgcgcgatgagtta

SEQ ID NO: 430433 - DNA, 25 bp, Mus musculus
cctctgcgcgatgagttaaaaagtc

SEQ ID NO: 430434 - DNA, 25 bp, Mus musculus
tgcgcgatgagttaaaaagtctgtc

SEQ ID NO: 430435 - DNA, 25 bp, Mus musculus
tgtgtcagcaagacgacagttcctg

SEQ ID NO: 430436 - DNA, 25 bp, Mus musculus
tgcaggcgccaccacagaacagaac

SEQ ID NO: 430437 - DNA, 25 bp, Mus musculus
ggctgatgctgcgttctcggattac

SEQ ID NO: 430438 - DNA, 25 bp, Mus musculus
ggcgccaccacagaacagaactgtg

SEQ ID NO: 430439 - DNA, 25 bp, Mus musculus
taaaaagtctgtctgggcgttggga

SEQ ID NO: 430440 - DNA, 25 bp, Mus musculus
cgcacattgcagcttgcggcgcgcg

SEQ ID NO: 430441 - DNA, 25 bp, Mus musculus
gcttaaccgttcctcgcctcctgga

SEQ ID NO: 430442 - DNA, 25 bp, Mus musculus
ttcctcgcctcctggacgtcggctt

SEQ ID NO: 430443 - DNA, 25 bp, Mus musculus
acgtcggcttctcaggcggagcctc

SEQ ID NO: 430444 - DNA, 25 bp, Mus musculus
gtcggcttctcaggcggagcctctg

SEQ ID NO: 430445 - DNA, 25 bp, Mus musculus
gagagaaactcttctggcccgggac

SEQ ID NO: 430446 - DNA, 25 bp, Mus musculus
accgagtcgccttggcggcgctgac

SEQ ID NO: 430447 - DNA, 25 bp, Mus musculus
gcgctgaccgagatcgagcaggtaa

SEQ ID NO: 430448 - DNA, 25 bp, Mus musculus
accgagatcgagcaggtaagtgagc

SEQ ID NO: 430449 - DNA, 25 bp, Mus musculus
tcgagcaggtaagtgagcgctcctg

SEQ ID NO: 430450 - DNA, 25 bp, Mus musculus
gcaggtaagtgagcgctcctgcctg

SEQ ID NO: 430451 - DNA, 25 bp, Mus musculus
tcctgcctggccgtctggcaacgcc

SEQ ID NO: 430452 - DNA, 25 bp, Mus musculus
gcgggaagccactaccggcgcttaa

SEQ ID NO: 430453 - DNA, 25 bp, Mus musculus
ccttggcggcgctgaccgagatcga

SEQ ID NO: 430454 - DNA, 25 bp, Mus musculus
aaatgaccacgcaggctggactctg

SEQ ID NO: 430455 - DNA, 25 bp, Mus musculus
ggaccttgccgccagagttcattct

SEQ ID NO: 430456 - DNA, 25 bp, Mus musculus
aagatcatcggtggtccgggactcg

SEQ ID NO: 430457 - DNA, 25 bp, Mus musculus
ctccctgcggctttggaagatcatc

SEQ ID NO: 430458 - DNA, 25 bp, Mus musculus
gtcctctgtcttctgtcccttggag

SEQ ID NO: 430459 - DNA, 25 bp, Mus musculus
agagttcattctccctgcggctttg

SEQ ID NO: 430460 - DNA, 25 bp, Mus musculus
cttggatagacgctggtggtaaatc

SEQ ID NO: 430461 - DNA, 25 bp, Mus musculus
cgggacaggccgaaatgaccacgca

SEQ ID NO: 430462 - DNA, 25 bp, Mus musculus
cgactggttcgtcttctaggctgtc

SEQ ID NO: 430463 - DNA, 25 bp, Mus musculus
gcgctcgtggcgaccaatccgcgga

SEQ ID NO: 430464 - DNA, 25 bp, Mus musculus
cggaaccgcctttgcagctggaggt

SEQ ID NO: 430465 - DNA, 25 bp, Mus musculus
taagatcacgtaaccaacggccgga

SEQ ID NO: 430466 - DNA, 25 bp, Mus musculus
gggccctgctcaaactcacgtaaga

SEQ ID NO: 430467 - DNA, 25 bp, Mus musculus
taaatccgggatctgctagctaggg

SEQ ID NO: 430468 - DNA, 25 bp, Mus musculus
aggaaagagtgggaagccttcactc

SEQ ID NO: 430469 - DNA, 25 bp, Mus musculus
tgggaagccttcactcgcttctcgg

SEQ ID NO: 430470 - DNA, 25 bp, Mus musculus
actagctaggctcccgggacgactt

SEQ ID NO: 430471 - DNA, 25 bp, Mus musculus
tgctgactagctaggctcccgggac

SEQ ID NO: 430472 - DNA, 25 bp, Mus musculus
agccaaagcctcctctgctgactag

SEQ ID NO: 430473 - DNA, 25 bp, Mus musculus
tgcgttgtccatgtcacccgctgca

SEQ ID NO: 430474 - DNA, 25 bp, Mus musculus
cctaagggcaagacctctggcgctc

SEQ ID NO: 430475 - DNA, 25 bp, Mus musculus
ccctaagcagttgcgcggggtactc

SEQ ID NO: 430476 - DNA, 25 bp, Mus musculus
aatcccgtaaccctaagcagttgcg

SEQ ID NO: 430477 - DNA, 25 bp, Mus musculus
gcgtgggccactgggaatcccgtaa

SEQ ID NO: 430478 - DNA, 25 bp, Mus musculus
ctacgggacccaaaacagagcgtgg

SEQ ID NO: 430479 - DNA, 25 bp, Mus musculus
gccctggatgctacgggacccaaaa

SEQ ID NO: 430480 - DNA, 25 bp, Mus musculus
cctccagcaggtgcggacacgcagg

SEQ ID NO: 430481 - DNA, 25 bp, Mus musculus
taagctggaccgcttctcgctcctt

SEQ ID NO: 430482 - DNA, 25 bp, Mus musculus
ggaatttacgttgtacatttatggc

SEQ ID NO: 430483 - DNA, 25 bp, Mus musculus
ctggacaccgagactggcctcagaa

SEQ ID NO: 430484 - DNA, 25 bp, Mus musculus
ttgacgactctggacaccgagactg

SEQ ID NO: 430485 - DNA, 25 bp, Mus musculus
ttgccttgacgactctggacaccga

SEQ ID NO: 430486 - DNA, 25 bp, Mus musculus
ttaacattgccttgacgactctgga

SEQ ID NO: 430487 - DNA, 25 bp, Mus musculus
acgtgctataattaacattgccttg

SEQ ID NO: 430488 - DNA, 25 bp, Mus musculus
tgagtttggggttatacgtgctata

SEQ ID NO: 430489 - DNA, 25 bp, Mus musculus
ctgacaagtgagtttggggttatac

SEQ ID NO: 430490 - DNA, 25 bp, Mus musculus
acagcctttcccagcgctgacaagt

SEQ ID NO: 430491 - DNA, 25 bp, Mus musculus
ttctgccaggctcagcacagccttt

SEQ ID NO: 430492 - DNA, 25 bp, Mus musculus
gcagacttctgccaggctcagcaca

SEQ ID NO: 430493 - DNA, 25 bp, Mus musculus
attctgagcgtgagggcagacttct

SEQ ID NO: 430494 - DNA, 25 bp, Mus musculus
ttgtacatttatggcgattctgagc

SEQ ID NO: 430495 - DNA, 25 bp, Mus musculus
ctggcctcagaagtagtaggctttt

SEQ ID NO: 430496 - DNA, 25 bp, Mus musculus
tgcctgcaggcggacatctgcctgc

SEQ ID NO: 430497 - DNA, 25 bp, Mus musculus
tgacgtggtcgtggccattctaggt

SEQ ID NO: 430498 - DNA, 25 bp, Mus musculus
aggcggacatctgcctgcacctgca

SEQ ID NO: 430499 - DNA, 25 bp, Mus musculus
gcgcgctcgccgtcaagttcaagac

SEQ ID NO: 430500 - DNA, 25 bp, Mus musculus
tcgccgtcaagttcaagaccacgca

SEQ ID NO: 430501 - DNA, 25 bp, Mus musculus
gtcaagttcaagaccacgcacgcgc

SEQ ID NO: 430502 - DNA, 25 bp, Mus musculus
tgcacctgggcgacgtgctttccac

SEQ ID NO: 430503 - DNA, 25 bp, Mus musculus
gggcgacgtgctttccactctctac

SEQ ID NO: 430504 - DNA, 25 bp, Mus musculus
gacgtgctttccactctctacttca

SEQ ID NO: 430505 - DNA, 25 bp, Mus musculus
gtgctttccactctctacttcatct

SEQ ID NO: 430506 - DNA, 25 bp, Mus musculus
catctcccgcggctccatcgagatc

SEQ ID NO: 430507 - DNA, 25 bp, Mus musculus
ccatcgagatcctgcgcgatgacgt

SEQ ID NO: 430508 - DNA, 25 bp, Mus musculus
tgcaccgcgctctgttgcagcactg

SEQ ID NO: 430509 - DNA, 25 bp, Mus musculus
cgatgacgtggtcgtggccattcta

SEQ ID NO: 430510 - DNA, 25 bp, Mus musculus
ctcaccacctgtatggcgcggctgt

SEQ ID NO: 430511 - DNA, 25 bp, Mus musculus
gctgcccttgttgtactcgctcaca

SEQ ID NO: 430512 - DNA, 25 bp, Mus musculus
gctcccaacattcgcgggccttgtt

SEQ ID NO: 430513 - DNA, 25 bp, Mus musculus
ccacggccaggacggccagcaggaa

SEQ ID NO: 430514 - DNA, 25 bp, Mus musculus
cagcaggaacagcaaggagcgcagc

SEQ ID NO: 430515 - DNA, 25 bp, Mus musculus
gctggccatggttggctaggacaaa

SEQ ID NO: 430516 - DNA, 25 bp, Mus musculus
aagggataaagctccaacaagactc

SEQ ID NO: 430517 - DNA, 25 bp, Mus musculus
caagactctgagttggtgcagaaca

SEQ ID NO: 430518 - DNA, 25 bp, Mus musculus
tggtgcagaacagacgctgctactc

SEQ ID NO: 430519 - DNA, 25 bp, Mus musculus
gacttttacccaaatgcgagcgtta

SEQ ID NO: 430520 - DNA, 25 bp, Mus musculus
tggtacgcatcgttgctgcccttgt

SEQ ID NO: 430521 - DNA, 25 bp, Mus musculus
cagggacacgtacctgcttacgagc

SEQ ID NO: 430522 - DNA, 25 bp, Mus musculus
tgcttacgagctctcaccacctgta

SEQ ID NO: 430523 - DNA, 25 bp, Mus musculus
gctgctactccgtgcgacttttacc

SEQ ID NO: 430524 - DNA, 25 bp, Mus musculus
cgacgtcggttagagctagtgcgtc

SEQ ID NO: 430525 - DNA, 25 bp, Mus musculus
acttggcgccttgccaccttgggta

SEQ ID NO: 430526 - DNA, 25 bp, Mus musculus
agccgctatcactggcgagggcaca

SEQ ID NO: 430527 - DNA, 25 bp, Mus musculus
gcacagctagcctggagcaaagtta

SEQ ID NO: 430528 - DNA, 25 bp, Mus musculus
ttagtggccaccttcgtgtgctgcc

SEQ ID NO: 430529 - DNA, 25 bp, Mus musculus
gcggccgcatactcttgcacacaag

SEQ ID NO: 430530 - DNA, 25 bp, Mus musculus
gccaggctccgcgagaccaaagagt

SEQ ID NO: 430531 - DNA, 25 bp, Mus musculus
accaaagagtggaacggcacatccc

SEQ ID NO: 430532 - DNA, 25 bp, Mus musculus
ccctttgtgctcctaggggccaaga

SEQ ID NO: 430533 - DNA, 25 bp, Mus musculus
cagccctgtgttcggctctcgggaa

SEQ ID NO: 430534 - DNA, 25 bp, Mus musculus
ttgtcccggaggtaagtcccgagca

SEQ ID NO: 430535 - DNA, 25 bp, Mus musculus
ccgcggtaagtcctgaagggtcgca

SEQ ID NO: 430536 - DNA, 25 bp, Mus musculus
ccggactagggagacacagtgtcgc

SEQ ID NO: 430537 - DNA, 25 bp, Mus musculus
ctagtgcgtctgtgtcttgagttcg

SEQ ID NO: 430538 - DNA, 25 bp, Mus musculus
tttggcagccaaaatcccaggaagg

SEQ ID NO: 430539 - DNA, 25 bp, Mus musculus
aaccaatgactgaggctctaagatc

SEQ ID NO: 430540 - DNA, 25 bp, Mus musculus
gctccaacctctaagacagctttgc

SEQ ID NO: 430541 - DNA, 25 bp, Mus musculus
gagatcttctgtgaaaccacaggta

SEQ ID NO: 430542 - DNA, 25 bp, Mus musculus
aaccacaggtagtgggccaggacta

SEQ ID NO: 430543 - DNA, 25 bp, Mus musculus
tgggccaggactacagcacagggcc

SEQ ID NO: 430544 - DNA, 25 bp, Mus musculus
agggccaaacatacattccatactg

SEQ ID NO: 430545 - DNA, 25 bp, Mus musculus
ttccatactggacatgcaggacctg

SEQ ID NO: 430546 - DNA, 25 bp, Mus musculus
tttggagacctcaacataaaaccag

SEQ ID NO: 430547 - DNA, 25 bp, Mus musculus
ccagatacaatgaacctaatagaag

SEQ ID NO: 430548 - DNA, 25 bp, Mus musculus
gaagagtgggatattgcctcaaaca

SEQ ID NO: 430549 - DNA, 25 bp, Mus musculus
gggatattgcctcaaacacatttgc

SEQ ID NO: 430550 - DNA, 25 bp, Mus musculus
agctttgcctggtagagatcttctg

SEQ ID NO: 430551 - DNA, 25 bp, Mus musculus
acacatttgcacagtgaaaattttc

SEQ ID NO: 430552 - DNA, 25 bp, Mus musculus
ggcgtcgaagaccgcaatgccagcc

SEQ ID NO: 430553 - DNA, 25 bp, Mus musculus
agcagcagcggccagagagcagacg

SEQ ID NO: 430554 - DNA, 25 bp, Mus musculus
tacagtagctcgagctgcaggagca

SEQ ID NO: 430555 - DNA, 25 bp, Mus musculus
tgtacagtagctcgagctgcaggag

SEQ ID NO: 430556 - DNA, 25 bp, Mus musculus
ttgtacagtagctcgagctgcagga

SEQ ID NO: 430557 - DNA, 25 bp, Mus musculus
gttgtacagtagctcgagctgcagg

SEQ ID NO: 430558 - DNA, 25 bp, Mus musculus
cagttgtacagtagctcgagctgca

SEQ ID NO: 430559 - DNA, 25 bp, Mus musculus
ccagttgtacagtagctcgagctgc

SEQ ID NO: 430560 - DNA, 25 bp, Mus musculus
gccagttgtacagtagctcgagctg

SEQ ID NO: 430561 - DNA, 25 bp, Mus musculus
tgccagttgtacagtagctcgagct

SEQ ID NO: 430562 - DNA, 25 bp, Mus musculus
ctgccagttgtacagtagctcgagc

SEQ ID NO: 430563 - DNA, 25 bp, Mus musculus
accgcaatgccagccgccagcacga

SEQ ID NO: 430564 - DNA, 25 bp, Mus musculus
tcgaagaccgcaatgccagccgcca

SEQ ID NO: 430565 - DNA, 25 bp, Mus musculus
ggccagagagcagacgcggctgacc

SEQ ID NO: 430566 - DNA, 25 bp, Mus musculus
acgaaacgcacatcgctcagcagct

SEQ ID NO: 430567 - DNA, 25 bp, Mus musculus
tccgctcaagctgcgagcacccggc

SEQ ID NO: 430568 - DNA, 25 bp, Mus musculus
tgcgcggctccgctcaagctgcgag

SEQ ID NO: 430569 - DNA, 25 bp, Mus musculus
aaggcggcgggctccacgtccggca

SEQ ID NO: 430570 - DNA, 25 bp, Mus musculus
gcagctcgatctcggccgacgtcgt

SEQ ID NO: 430571 - DNA, 25 bp, Mus musculus
tcgatctcggccgacgtcgtggcca

SEQ ID NO: 430572 - DNA, 25 bp, Mus musculus
gatctcggccgacgtcgtggccatg

SEQ ID NO: 430573 - DNA, 25 bp, Mus musculus
ccatgccgccgttgaacatggcgtc

SEQ ID NO: 430574 - DNA, 25 bp, Mus musculus
ccgccgttgaacatggcgtcgaaga

SEQ ID NO: 430575 - DNA, 25 bp, Mus musculus
gccgttgaacatggcgtcgaagacc

SEQ ID NO: 430576 - DNA, 25 bp, Mus musculus
tcggcccttgcccagcacgaaacgc

SEQ ID NO: 430577 - DNA, 25 bp, Mus musculus
agcacgaaacgcacatcgctcagca

SEQ ID NO: 430578 - DNA, 25 bp, Mus musculus
ccttggtggcctgccagttgtacag

SEQ ID NO: 430579 - DNA, 25 bp, Mus musculus
ccttgagcgacgccttggtggcctg

SEQ ID NO: 430580 - DNA, 25 bp, Mus musculus
cagtcaccttgaagccaaggctagg

SEQ ID NO: 430581 - DNA, 25 bp, Mus musculus
ccagtcaccttgaagccaaggctag

SEQ ID NO: 430582 - DNA, 25 bp, Mus musculus
cccagtcaccttgaagccaaggcta

SEQ ID NO: 430583 - DNA, 25 bp, Mus musculus
agccaccgggtcagcgcgagcagga

SEQ ID NO: 430584 - DNA, 25 bp, Mus musculus
cagagccaccgggtcagcgcgagca

SEQ ID NO: 430585 - DNA, 25 bp, Mus musculus
agtcaccttgaagccaaggctaggc

SEQ ID NO: 430586 - DNA, 25 bp, Mus musculus
cgcacgccgtcctccaccgggagac

SEQ ID NO: 430587 - DNA, 25 bp, Mus musculus
tccaccgggagaccggaccgcatgg

SEQ ID NO: 430588 - DNA, 25 bp, Mus musculus
accggaccgcatggagccgggcgcg

SEQ ID NO: 430589 - DNA, 25 bp, Mus musculus
cgcgccctggtctgcagagcccgcc

SEQ ID NO: 430590 - DNA, 25 bp, Mus musculus
agcacactgcccgtcgggctgagtc

SEQ ID NO: 430591 - DNA, 25 bp, Mus musculus
ggacaaccacgccgatcccgccgcc

SEQ ID NO: 430592 - DNA, 25 bp, Mus musculus
cacactgcccgtcgggctgagtccc

SEQ ID NO: 430593 - DNA, 25 bp, Mus musculus
ctggtctgcagagcccgccgcgtgc

SEQ ID NO: 430594 - DNA, 25 bp, Mus musculus
ccgattgtccagagcgcccttgcag

SEQ ID NO: 430595 - DNA, 25 bp, Mus musculus
agtgaccaccccgattgtccagagc

SEQ ID NO: 430596 - DNA, 25 bp, Mus musculus
cgattgtccagagcgcccttgcagg

SEQ ID NO: 430597 - DNA, 25 bp, Mus musculus
ttgtccagagcgcccttgcaggcca

SEQ ID NO: 430598 - DNA, 25 bp, Mus musculus
caggccacgcagcagtcgccccaca

SEQ ID NO: 430599 - DNA, 25 bp, Mus musculus
tgcgcgccgccatctcgcccgacgc

SEQ ID NO: 430600 - DNA, 25 bp, Mus musculus
aacgcagcccgggagtcgggtggcg

SEQ ID NO: 430601 - DNA, 25 bp, Mus musculus
tcctgggctgcctgagcgctcaacg

SEQ ID NO: 430602 - DNA, 25 bp, Mus musculus
ctgcctgagcgctcaacgcggggta

SEQ ID NO: 430603 - DNA, 25 bp, Mus musculus
cctgagcgctcaacgcggggtacga

SEQ ID NO: 430604 - DNA, 25 bp, Mus musculus
tcgagcgggacacgctcagtgacca

SEQ ID NO: 430605 - DNA, 25 bp, Mus musculus
ctcaacgcggggtacgagcctggtt

SEQ ID NO: 430606 - DNA, 25 bp, Mus musculus
tacgagcctggttgcgctgctgcag

SEQ ID NO: 430607 - DNA, 25 bp, Mus musculus
gagcgggacacgctcagtgaccacc

SEQ ID NO: 430608 - DNA, 25 bp, Mus musculus
cgaccctattgcctccgctggatct

SEQ ID NO: 430609 - DNA, 25 bp, Mus musculus
tggcaaagcttcgaaggcgagagcc

SEQ ID NO: 430610 - DNA, 25 bp, Mus musculus
tggagcgcgcatccgaaagcccatc

SEQ ID NO: 430611 - DNA, 25 bp, Mus musculus
cgacagcaggctcgggtcctgcaga

SEQ ID NO: 430612 - DNA, 25 bp, Mus musculus
tggcgccagggctctactcctggag

SEQ ID NO: 430613 - DNA, 25 bp, Mus musculus
agacgctctcgctgcgctgctggct

SEQ ID NO: 430614 - DNA, 25 bp, Mus musculus
agcaggtcattgatggcaaagcttc

SEQ ID NO: 430615 - DNA, 25 bp, Mus musculus
tccaatcccagcaggtcattgatgg

SEQ ID NO: 430616 - DNA, 25 bp, Mus musculus
ccggagttggcaggtctgcctccaa

SEQ ID NO: 430617 - DNA, 25 bp, Mus musculus
tcttagcccaggctccgccggagtt

SEQ ID NO: 430618 - DNA, 25 bp, Mus musculus
atctccgctgttggatcttagccca

SEQ ID NO: 430619 - DNA, 25 bp, Mus musculus
gctggatctccgctgttggatctta

SEQ ID NO: 430620 - DNA, 25 bp, Mus musculus
ggtcctgcagatggcagaagccgca

SEQ ID NO: 430621 - DNA, 25 bp, Mus musculus
tctactcctggagcgcgcatccgaa

SEQ ID NO: 430622 - DNA, 25 bp, Mus musculus
cggagacagcttctcggcgtctgct

SEQ ID NO: 430623 - DNA, 25 bp, Mus musculus
tcgcacgtctacaacacaccgtggg

SEQ ID NO: 430624 - DNA, 25 bp, Mus musculus
cgcctgcgtggctggcaaacgccat

SEQ ID NO: 430625 - DNA, 25 bp, Mus musculus
aaacgccatggcacacgcgcatcaa

SEQ ID NO: 430626 - DNA, 25 bp, Mus musculus
caaagtgcacgtaggcggagacagc

SEQ ID NO: 430627 - DNA, 25 bp, Mus musculus
ggtttgcttccacgcgttaaggctc

SEQ ID NO: 430628 - DNA, 25 bp, Mus musculus
cgttaaggctctgttgacgcggacc

SEQ ID NO: 430629 - DNA, 25 bp, Mus musculus
gccagcgaaatgtgcttggcccgga

SEQ ID NO: 430630 - DNA, 25 bp, Mus musculus
ctgtctttccgaccctgctgcgtag

SEQ ID NO: 430631 - DNA, 25 bp, Mus musculus
cggtccattcaactggctgtctttc

SEQ ID NO: 430632 - DNA, 25 bp, Mus musculus
tcacttgcgctctcggtccattcaa

SEQ ID NO: 430633 - DNA, 25 bp, Mus musculus
ttccaatgcctgatacctccctggg

SEQ ID NO: 430634 - DNA, 25 bp, Mus musculus
cggaggactgactacggttggtctc

SEQ ID NO: 430635 - DNA, 25 bp, Mus musculus
tgcccacccggtgacgcaaagtgca

SEQ ID NO: 430636 - DNA, 25 bp, Mus musculus
agcagcattactatgagcgggaccc

SEQ ID NO: 430637 - DNA, 25 bp, Mus musculus
tcttcgctctggcacacacagttcg

SEQ ID NO: 430638 - DNA, 25 bp, Mus musculus
acacctgcatttcacgctggtcaag

SEQ ID NO: 430639 - DNA, 25 bp, Mus musculus
gcggaagagcttcaacagacacctg

SEQ ID NO: 430640 - DNA, 25 bp, Mus musculus
cagaagcagatcagcgtgcgtggca

SEQ ID NO: 430641 - DNA, 25 bp, Mus musculus
tcttctggcgccatggcgaagccgt

SEQ ID NO: 430642 - DNA, 25 bp, Mus musculus
cacagttcgcgaccacctagtgggc

SEQ ID NO: 430643 - DNA, 25 bp, Mus musculus
cgcagcatcccagcgctagagtctt

SEQ ID NO: 430644 - DNA, 25 bp, Mus musculus
gctggatccgcacgcagcagcatta

SEQ ID NO: 430645 - DNA, 25 bp, Mus musculus
agtccttggcgccagagacaccgca

SEQ ID NO: 430646 - DNA, 25 bp, Mus musculus
ggcgcaatccgtatgagccggcctc

SEQ ID NO: 430647 - DNA, 25 bp, Mus musculus
cagcctgattgacgggctctttctc

SEQ ID NO: 430648 - DNA, 25 bp, Mus musculus
gtccacgttctcttcccggctgaaa

SEQ ID NO: 430649 - DNA, 25 bp, Mus musculus
gctagagtcttctctgctcgctcca

SEQ ID NO: 430650 - DNA, 25 bp, Mus musculus
cctgaggcggcgcagcgctcatgct

SEQ ID NO: 430651 - DNA, 25 bp, Mus musculus
tctttagaagggtcgaagaggacgc

SEQ ID NO: 430652 - DNA, 25 bp, Mus musculus
gatggaaccgtgtgatgctcccgca

SEQ ID NO: 430653 - DNA, 25 bp, Mus musculus
tgctcccgcagcagatctctgaagg

SEQ ID NO: 430654 - DNA, 25 bp, Mus musculus
cagcagatctctgaaggtgggagcc

SEQ ID NO: 430655 - DNA, 25 bp, Mus musculus
actacctgccctccaggtgaggggc

SEQ ID NO: 430656 - DNA, 25 bp, Mus musculus
ttcatgcccgcgtcggatgcgctgt

SEQ ID NO: 430657 - DNA, 25 bp, Mus musculus
tgcttcaagctgcagtcggcgtcca

SEQ ID NO: 430658 - DNA, 25 bp, Mus musculus
cgctcatgctccaaggtgacgggct

SEQ ID NO: 430659 - DNA, 25 bp, Mus musculus
tgacgggctcggtccgcttcctcat

SEQ ID NO: 430660 - DNA, 25 bp, Mus musculus
ggcagcagctctcggcgccctggtt

SEQ ID NO: 430661 - DNA, 25 bp, Mus musculus
ggccaatcagcgcacgagtccagga

SEQ ID NO: 430662 - DNA, 25 bp, Mus musculus
atcagcgcacgagtccaggaagccc

SEQ ID NO: 430663 - DNA, 25 bp, Mus musculus
ccgccagacgcaggttctgcttcaa

SEQ ID NO: 430664 - DNA, 25 bp, Mus musculus
cgtggaagagtacaacaacaaggtg

SEQ ID NO: 430665 - DNA, 25 bp, Mus musculus
tacgccatgaactggagcgtgcggc

SEQ ID NO: 430666 - DNA, 25 bp, Mus musculus
gcgctacaactgtgtcgaccaatga

SEQ ID NO: 430667 - DNA, 25 bp, Mus musculus
ctgggcagcttcgtggaagagtaca

SEQ ID NO: 430668 - DNA, 25 bp, Mus musculus
agcgtgcggccggacaagcgctttc

SEQ ID NO: 430669 - DNA, 25 bp, Mus musculus
cgccctggactgtgtacgccatgaa

SEQ ID NO: 430670 - DNA, 25 bp, Mus musculus
gatctacaaatatgaagcgccctgg

SEQ ID NO: 430671 - DNA, 25 bp, Mus musculus
cacggcaaacggaaggagatctaca

SEQ ID NO: 430672 - DNA, 25 bp, Mus musculus
accatgtccctgcacggcaaacgga

SEQ ID NO: 430673 - DNA, 25 bp, Mus musculus
gagggctaggccgttcttgaccgcc

SEQ ID NO: 430674 - DNA, 25 bp, Mus musculus
ctgcccgagctggtttgaaactggt

SEQ ID NO: 430675 - DNA, 25 bp, Mus musculus
cccaaacggaaggtggtagcgctgc

SEQ ID NO: 430676 - DNA, 25 bp, Mus musculus
ttggaaaggacgtacccggcagcca

SEQ ID NO: 430677 - DNA, 25 bp, Mus musculus
aagcgctttcgcctggcgctgggca

SEQ ID NO: 430678 - DNA, 25 bp, Mus musculus
cgaggttctcgtgagatcggcccct

SEQ ID NO: 430679 - DNA, 25 bp, Mus musculus
cggagctctggcgagccggccacga

SEQ ID NO: 430680 - DNA, 25 bp, Mus musculus
ctctggcgagccggccacgaggttc

SEQ ID NO: 430681 - DNA, 25 bp, Mus musculus
ctggcgagccggccacgaggttctc

SEQ ID NO: 430682 - DNA, 25 bp, Mus musculus
cggccacgaggttctcgtgagatcg

SEQ ID NO: 430683 - DNA, 25 bp, Mus musculus
gttctcgtgagatcggcccctccat

SEQ ID NO: 430684 - DNA, 25 bp, Mus musculus
acgaggttctcgtgagatcggcccc

SEQ ID NO: 430685 - DNA, 25 bp, Mus musculus
gaggttctcgtgagatcggcccctc

SEQ ID NO: 430686 - DNA, 25 bp, Mus musculus
aggttctcgtgagatcggcccctcc

SEQ ID NO: 430687 - DNA, 25 bp, Mus musculus
ggttctcgtgagatcggcccctcca

SEQ ID NO: 430688 - DNA, 25 bp, Mus musculus
ctccatcccaagcgcctgtgtctgc

SEQ ID NO: 430689 - DNA, 25 bp, Mus musculus
cctccatcccaagcgcctgtgtctg

SEQ ID NO: 430690 - DNA, 25 bp, Mus musculus
ccctccatcccaagcgcctgtgtct

SEQ ID NO: 430691 - DNA, 25 bp, Mus musculus
cacgaggttctcgtgagatcggccc

SEQ ID NO: 430692 - DNA, 25 bp, Mus musculus
ggacctttgagtacacctcgggata

SEQ ID NO: 430693 - DNA, 25 bp, Mus musculus
tggccggacctttgagtacacctcg

SEQ ID NO: 430694 - DNA, 25 bp, Mus musculus
cgaaaagcacagactatggcgctga

SEQ ID NO: 430695 - DNA, 25 bp, Mus musculus
cctttgagtacacctcgggatagtg

SEQ ID NO: 430696 - DNA, 25 bp, Mus musculus
tttgagtacacctcgggatagtgag

SEQ ID NO: 430697 - DNA, 25 bp, Mus musculus
tacacctcgggatagtgaggagccc

SEQ ID NO: 430698 - DNA, 25 bp, Mus musculus
ttccccgccgccgggataatcaaga

SEQ ID NO: 430699 - DNA, 25 bp, Mus musculus
acacctcgggatagtgaggagcccg

SEQ ID NO: 430700 - DNA, 25 bp, Mus musculus
ggagcccggcgaaaagcacagacta

SEQ ID NO: 430701 - DNA, 25 bp, Mus musculus
agcccggcgaaaagcacagactatg

SEQ ID NO: 430702 - DNA, 25 bp, Mus musculus
cccggcgaaaagcacagactatggc

SEQ ID NO: 430703 - DNA, 25 bp, Mus musculus
cggcgaaaagcacagactatggcgc

SEQ ID NO: 430704 - DNA, 25 bp, Mus musculus
aagcacagactatggcgctgaaacg

SEQ ID NO: 430705 - DNA, 25 bp, Mus musculus
cagagccggtgtgagaagaagagac

SEQ ID NO: 430706 - DNA, 25 bp, Mus musculus
ccctcgtcaaaagaggacgaaggcg

SEQ ID NO: 430707 - DNA, 25 bp, Mus musculus
gagactctggtgtggctttctgagc

SEQ ID NO: 430708 - DNA, 25 bp, Mus musculus
tcggccgctctttgtgtctgccggc

SEQ ID NO: 430709 - DNA, 25 bp, Mus musculus
ggctcggctctctgaacgctgagtt

SEQ ID NO: 430710 - DNA, 25 bp, Mus musculus
ccgctgcacgaggatgcggatccct

SEQ ID NO: 430711 - DNA, 25 bp, Mus musculus
tgcatcgcaagcatcggctccgctg

SEQ ID NO: 430712 - DNA, 25 bp, Mus musculus
tgcgccgcagagcagtgagactctg

SEQ ID NO: 430713 - DNA, 25 bp, Mus musculus
gttcccggtccgagtgcgccgcaga

SEQ ID NO: 430714 - DNA, 25 bp, Mus musculus
gctgagttcggtgcggaccaccgtt

SEQ ID NO: 430715 - DNA, 25 bp, Mus musculus
cccactagcacgctgagttcggtgc

SEQ ID NO: 430716 - DNA, 25 bp, Mus musculus
acgtcaaaatttggggcggcagctg

SEQ ID NO: 430717 - DNA, 25 bp, Mus musculus
cgctctctgagtacgtcaaaatttg

SEQ ID NO: 430718 - DNA, 25 bp, Mus musculus
caggcatcccgctctctgagtacgt

SEQ ID NO: 430719 - DNA, 25 bp, Mus musculus
caagcatcggctccgctgtgtaccg

SEQ ID NO: 430720 - DNA, 25 bp, Mus musculus
ctaaattttatagggtgcgcgtgca

SEQ ID NO: 430721 - DNA, 25 bp, Mus musculus
gcgactctgcagtcgtggcagttca

SEQ ID NO: 430722 - DNA, 25 bp, Mus musculus
tggcagttcagagtccagcacccgg

SEQ ID NO: 430723 - DNA, 25 bp, Mus musculus
ccacgcgcgggaaagaagctccacg

SEQ ID NO: 430724 - DNA, 25 bp, Mus musculus
gaaagaagctccacgggcacgcagc

SEQ ID NO: 430725 - DNA, 25 bp, Mus musculus
ggggacgttacctccaacatgcctc

SEQ ID NO: 430726 - DNA, 25 bp, Mus musculus
ccgtgtcgatgagtgtgttgtccag

SEQ ID NO: 430727 - DNA, 25 bp, Mus musculus
tgttgtccaggtcaaagaagaccgc

SEQ ID NO: 430728 - DNA, 25 bp, Mus musculus
caggtcaaagaagaccgcgcggacc

SEQ ID NO: 430729 - DNA, 25 bp, Mus musculus
cggagtctcggaggtcacctgaccc

SEQ ID NO: 430730 - DNA, 25 bp, Mus musculus
gaggtcacctgacccttccaaagct

SEQ ID NO: 430731 - DNA, 25 bp, Mus musculus
cttccaaagctccggggtctccgtg

SEQ ID NO: 430732 - DNA, 25 bp, Mus musculus
cgcgagattcggacactaaatttta

SEQ ID NO: 430733 - DNA, 25 bp, Mus musculus
ctccgtggcaagatcgcgcgagatt

SEQ ID NO: 430734 - DNA, 25 bp, Mus musculus
agaagacaggatactttgttttatc

SEQ ID NO: 430735 - DNA, 25 bp, Mus musculus
aaaatgttgcacacttctgatccct

SEQ ID NO: 430736 - DNA, 25 bp, Mus musculus
aagacaggatactttgttttatctc

SEQ ID NO: 430737 - DNA, 25 bp, Mus musculus
gacaggatactttgttttatctctg

SEQ ID NO: 430738 - DNA, 25 bp, Mus musculus
ccgcattgggcggagcctacgagca

SEQ ID NO: 430739 - DNA, 25 bp, Mus musculus
tggacgcggtagaacggcgggcgga

SEQ ID NO: 430740 - DNA, 25 bp, Mus musculus
tttgcagggcctctgttttcctgcg

SEQ ID NO: 430741 - DNA, 25 bp, Mus musculus
tgcagggcctctgttttcctgcggg

SEQ ID NO: 430742 - DNA, 25 bp, Mus musculus
gcagggcctctgttttcctgcgggc

SEQ ID NO: 430743 - DNA, 25 bp, Mus musculus
ggcatgtagtaaatagtcactaagg

SEQ ID NO: 430744 - DNA, 25 bp, Mus musculus
catgtagtaaatagtcactaaggaa

SEQ ID NO: 430745 - DNA, 25 bp, Mus musculus
cataaaatgttgcacacttctgatc

SEQ ID NO: 430746 - DNA, 25 bp, Mus musculus
taaaatgttgcacacttctgatccc

SEQ ID NO: 430747 - DNA, 25 bp, Mus musculus
caagaagacaggatactttgtttta

SEQ ID NO: 430748 - DNA, 25 bp, Mus musculus
aactcatcgcctggcggaggtcaca

SEQ ID NO: 430749 - DNA, 25 bp, Mus musculus
cgcagaggaaaaccgggagtagcca

SEQ ID NO: 430750 - DNA, 25 bp, Mus musculus
tcgggaagatttgaaccgtttctga

SEQ ID NO: 430751 - DNA, 25 bp, Mus musculus
tgtccaaccgtagaaactgaggctg

SEQ ID NO: 430752 - DNA, 25 bp, Mus musculus
gcagggagcctactgtccaaccgta

SEQ ID NO: 430753 - DNA, 25 bp, Mus musculus
ttggcgcagtctcgtccgccctgaa

SEQ ID NO: 430754 - DNA, 25 bp, Mus musculus
tgcactacacgggtgagtcggaccg

SEQ ID NO: 430755 - DNA, 25 bp, Mus musculus
cagtcttgtctctcctcagggcgca

SEQ ID NO: 430756 - DNA, 25 bp, Mus musculus
ctctcctggagacggtgagtagaca

SEQ ID NO: 430757 - DNA, 25 bp, Mus musculus
gcaggtggagaccatctctcctgga

SEQ ID NO: 430758 - DNA, 25 bp, Mus musculus
ggacgaagccgaacctctgaaccgc

SEQ ID NO: 430759 - DNA, 25 bp, Mus musculus
cccgcttcagggatgtgagcgcctc

SEQ ID NO: 430760 - DNA, 25 bp, Mus musculus
ggagtagccaacaggacgcgccttc

SEQ ID NO: 430761 - DNA, 25 bp, Mus musculus
gccagacctgcgtggtgcactacac

SEQ ID NO: 430762 - DNA, 25 bp, Mus musculus
tgcacatgcgtcaggggcaccacac

SEQ ID NO: 430763 - DNA, 25 bp, Mus musculus
cttccggctaagttctgaatccttg

SEQ ID NO: 430764 - DNA, 25 bp, Mus musculus
ggagacgcagcttccggctaagttc

SEQ ID NO: 430765 - DNA, 25 bp, Mus musculus
gttatagactacaagcggagacgca

SEQ ID NO: 430766 - DNA, 25 bp, Mus musculus
tgcgcaggcgttatagactacaagc

SEQ ID NO: 430767 - DNA, 25 bp, Mus musculus
gggcaccacacgcagtagctaagca

SEQ ID NO: 430768 - DNA, 25 bp, Mus musculus
caagtagacttggtgcacatgcgtc

SEQ ID NO: 430769 - DNA, 25 bp, Mus musculus
cgcgcccgcacgcaagtagacttgg

SEQ ID NO: 430770 - DNA, 25 bp, Mus musculus
ctgtcaaggtgactccgcagccgtg

SEQ ID NO: 430771 - DNA, 25 bp, Mus musculus
cccggcgcaggcacattctgcaatt

SEQ ID NO: 430772 - DNA, 25 bp, Mus musculus
tttggaaagtctgaagcccggcgca

SEQ ID NO: 430773 - DNA, 25 bp, Mus musculus
actgcattgcgggtctctttggaaa

SEQ ID NO: 430774 - DNA, 25 bp, Mus musculus
cggtcgcatattccactgcattgcg

SEQ ID NO: 430775 - DNA, 25 bp, Mus musculus
aagcaggatttctgcgcaggcgtta

SEQ ID NO: 430776 - DNA, 25 bp, Mus musculus
ctggcggtgatcagcaacctgcggc

SEQ ID NO: 430777 - DNA, 25 bp, Mus musculus
gtccactcgccctccgcagtccggc

SEQ ID NO: 430778 - DNA, 25 bp, Mus musculus
gcctggtacctctgcgggatcgcgc

SEQ ID NO: 430779 - DNA, 25 bp, Mus musculus
gggatcgcgccaccgcaagcggtct

SEQ ID NO: 430780 - DNA, 25 bp, Mus musculus
cgcaagcggtctcaaactgaccctg

SEQ ID NO: 430781 - DNA, 25 bp, Mus musculus
ggtctcaaactgaccctggcggccg

SEQ ID NO: 430782 - DNA, 25 bp, Mus musculus
gccgtggcctcctcacctgggtcca

SEQ ID NO: 430783 - DNA, 25 bp, Mus musculus
agccgcctggcggtgatcagcaacc

SEQ ID NO: 430784 - DNA, 25 bp, Mus musculus
gcagcccgcaagctcggaggacacg

SEQ ID NO: 430785 - DNA, 25 bp, Mus musculus
gcaagctcggaggacacgctgcccg

SEQ ID NO: 430786 - DNA, 25 bp, Mus musculus
ctagggcagctcctgtgcttggccg

SEQ ID NO: 430787 - DNA, 25 bp, Mus musculus
tcctcgcctggtacctctgcgggat

SEQ ID NO: 430788 - DNA, 25 bp, Mus musculus
cagtccggccggctcgcacgactcc

SEQ ID NO: 430789 - DNA, 25 bp, Mus musculus
actcccgcgccgcttggcgcagcgc

SEQ ID NO: 430790 - DNA, 25 bp, Mus musculus
ctacgagtgcgtgtgtctgtcgatt

SEQ ID NO: 430791 - DNA, 25 bp, Mus musculus
ttctgccttcacgtggcgcccgtga

SEQ ID NO: 430792 - DNA, 25 bp, Mus musculus
ccacgcaaggatgatactccggatc

SEQ ID NO: 430793 - DNA, 25 bp, Mus musculus
tgatactccggatctacagaccttg

SEQ ID NO: 430794 - DNA, 25 bp, Mus musculus
tacagaccttgaagaggaccctggg

SEQ ID NO: 430795 - DNA, 25 bp, Mus musculus
tagggaggcccgacacggctccgca

SEQ ID NO: 430796 - DNA, 25 bp, Mus musculus
atctgcgcgcctgaggctttgtgta

SEQ ID NO: 430797 - DNA, 25 bp, Mus musculus
tgaccgtccgggtctggcctgctct

SEQ ID NO: 430798 - DNA, 25 bp, Mus musculus
ggctttccgcgcagaactttgggta

SEQ ID NO: 430799 - DNA, 25 bp, Mus musculus
cctgaggctttgtgtactacgagtg

SEQ ID NO: 430800 - DNA, 25 bp, Mus musculus
ctttgggtataaccgcgtggacctg

SEQ ID NO: 430801 - DNA, 25 bp, Mus musculus
tggacctgcgtgtatgcatctgcgc

SEQ ID NO: 430802 - DNA, 25 bp, Mus musculus
ctgtgctcccgcgtgcggagactag

SEQ ID NO: 430803 - DNA, 25 bp, Mus musculus
agctcgatcggcgacgctccaggat

SEQ ID NO: 430804 - DNA, 25 bp, Mus musculus
ggccgacgcgaagagaacctcgaga

SEQ ID NO: 430805 - DNA, 25 bp, Mus musculus
ttacacgcacgctgtgcccgttgtc

SEQ ID NO: 430806 - DNA, 25 bp, Mus musculus
gcaccaggcgcgctaaagtgcggca

SEQ ID NO: 430807 - DNA, 25 bp, Mus musculus
aagtgcggcatcagaagcctcgctc

SEQ ID NO: 430808 - DNA, 25 bp, Mus musculus
tcgcccgtgcccaaggcatagtagc

SEQ ID NO: 430809 - DNA, 25 bp, Mus musculus
tcccagtgcaggaagcagacgagtg

SEQ ID NO: 430810 - DNA, 25 bp, Mus musculus
ctcgagacccgccatggatgtttgc

SEQ ID NO: 430811 - DNA, 25 bp, Mus musculus
agcgacgccttttgatgccgccttc

SEQ ID NO: 430812 - DNA, 25 bp, Mus musculus
cgcacctgcgcggaaaagtggaaac

SEQ ID NO: 430813 - DNA, 25 bp, Mus musculus
gacgcgcaccggaaatacttgttga

SEQ ID NO: 430814 - DNA, 25 bp, Mus musculus
tacttgttgactttgtgcgtgctcc

SEQ ID NO: 430815 - DNA, 25 bp, Mus musculus
ggctggaaacacctgcaccgaacta

SEQ ID NO: 430816 - DNA, 25 bp, Mus musculus
ctagaaggttccactaagaagcgcg

SEQ ID NO: 430817 - DNA, 25 bp, Mus musculus
gcatagtagccgtttgtcaccactt

SEQ ID NO: 430818 - DNA, 25 bp, Mus musculus
gccctcactcgacccaccgcgccct

SEQ ID NO: 430819 - DNA, 25 bp, Mus musculus
cctagagccggcctgtgcacgtgcg

SEQ ID NO: 430820 - DNA, 25 bp, Mus musculus
cggcgtgtgcgcttgtgtacctaga

SEQ ID NO: 430821 - DNA, 25 bp, Mus musculus
tagcgaccagcgacccgcggatgct

SEQ ID NO: 430822 - DNA, 25 bp, Mus musculus
tccctggtggccgtagcgaccagcg

SEQ ID NO: 430823 - DNA, 25 bp, Mus musculus
gcggatgctcaacgcgcgccacagg

SEQ ID NO: 430824 - DNA, 25 bp, Mus musculus
tgacgccctcactcgacccaccgcg

SEQ ID NO: 430825 - DNA, 25 bp, Mus musculus
cgcgctgacgccctcactcgaccca

SEQ ID NO: 430826 - DNA, 25 bp, Mus musculus
ccgagggttaagcgccgcccagccg

SEQ ID NO: 430827 - DNA, 25 bp, Mus musculus
ggctgcgcccgcaagggccccccga

SEQ ID NO: 430828 - DNA, 25 bp, Mus musculus
ctcaacgcgcgccacaggctgtccc

SEQ ID NO: 430829 - DNA, 25 bp, Mus musculus
ctagagccggcctgtgcacgtgcga

SEQ ID NO: 430830 - DNA, 25 bp, Mus musculus
cgtgtgcgcttgtgtacctagagcc

SEQ ID NO: 430831 - DNA, 25 bp, Mus musculus
ctggtggccgtagcgaccagcgacc

SEQ ID NO: 430832 - DNA, 25 bp, Mus musculus
tgcagcgtcaggaagagccgaacct

SEQ ID NO: 430833 - DNA, 25 bp, Mus musculus
tctgaacgtccagaccgggttgttc

SEQ ID NO: 430834 - DNA, 25 bp, Mus musculus
tcccgtgctttcgtgtgcgatgcct

SEQ ID NO: 430835 - DNA, 25 bp, Mus musculus
tgccgccagcctgagaatgaccgct

SEQ ID NO: 430836 - DNA, 25 bp, Mus musculus
cccttgtcgaagcagatgatgtctt

SEQ ID NO: 430837 - DNA, 25 bp, Mus musculus
tagctgctcatctttgcaccgcgca

SEQ ID NO: 430838 - DNA, 25 bp, Mus musculus
ctagacgggctgattttagctgctc

SEQ ID NO: 430839 - DNA, 25 bp, Mus musculus
atctgtcgtttccaagcaaccggga

SEQ ID NO: 430840 - DNA, 25 bp, Mus musculus
aagaagggttgcgtcactcctggca

SEQ ID NO: 430841 - DNA, 25 bp, Mus musculus
gcgaggcagcggaaccaactttgca

SEQ ID NO: 430842 - DNA, 25 bp, Mus musculus
caactttgcagaatccgggaacgtc

SEQ ID NO: 430843 - DNA, 25 bp, Mus musculus
agccgaacctctgagtttctggaga

SEQ ID NO: 430844 - DNA, 25 bp, Mus musculus
cttcgcggtcactcaaggcagtgca

SEQ ID NO: 430845 - DNA, 25 bp, Mus musculus
agtgtactgcaccatttagggtccc

SEQ ID NO: 430846 - DNA, 25 bp, Mus musculus
cgatgtccgagctggcccttgctaa

SEQ ID NO: 430847 - DNA, 25 bp, Mus musculus
caagtccgacttggaccgctgcagg

SEQ ID NO: 430848 - DNA, 25 bp, Mus musculus
tgctgccctggaaaagcgctcactc

SEQ ID NO: 430849 - DNA, 25 bp, Mus musculus
aaagcgctcaagatcggctgctgcc

SEQ ID NO: 430850 - DNA, 25 bp, Mus musculus
tgggtccaggccacagaagttaaaa

SEQ ID NO: 430851 - DNA, 25 bp, Mus musculus
gcccggctagagacacgatgtccga

SEQ ID NO: 430852 - DNA, 25 bp, Mus musculus
caaggtccagcacttggcccggcta

SEQ ID NO: 430853 - DNA, 25 bp, Mus musculus
cccttcagagctgcaaggtccagca

SEQ ID NO: 430854 - DNA, 25 bp, Mus musculus
ccactgtagcagagctgcggcgtga

SEQ ID NO: 430855 - DNA, 25 bp, Mus musculus
tcggcgcaccgcgacagtactgggt

SEQ ID NO: 430856 - DNA, 25 bp, Mus musculus
ccataggggacacgatccagggacc

SEQ ID NO: 430857 - DNA, 25 bp, Mus musculus
tgaagcaggcaagggacgaacgtcc

SEQ ID NO: 430858 - DNA, 25 bp, Mus musculus
gggaccgctcttccactgtagcaga

SEQ ID NO: 430859 - DNA, 25 bp, Mus musculus
agcgctcactcaagtccgacttgga

SEQ ID NO: 430860 - DNA, 25 bp, Mus musculus
gcgcgtgcgccaagtagcttttcct

SEQ ID NO: 430861 - DNA, 25 bp, Mus musculus
caccaaggactggaaagctgagagg

SEQ ID NO: 430862 - DNA, 25 bp, Mus musculus
gcagcactgcactccggaagggaca

SEQ ID NO: 430863 - DNA, 25 bp, Mus musculus
tccggaagggacatggacgtccaga

SEQ ID NO: 430864 - DNA, 25 bp, Mus musculus
cgtccagaggaagcagaaccgccta

SEQ ID NO: 430865 - DNA, 25 bp, Mus musculus
aagcagaaccgcctaagggagagag

SEQ ID NO: 430866 - DNA, 25 bp, Mus musculus
gccggagcaccaaggactggaaagc

SEQ ID NO: 430867 - DNA, 25 bp, Mus musculus
tgtcctcaccggctgctaaacttct

SEQ ID NO: 430868 - DNA, 25 bp, Mus musculus
agattaaacacacccgccgccaaag

SEQ ID NO: 430869 - DNA, 25 bp, Mus musculus
aaagagtgcgcctagcccgagcccg

SEQ ID NO: 430870 - DNA, 25 bp, Mus musculus
agcccgagcccgctctaggtgttga

SEQ ID NO: 430871 - DNA, 25 bp, Mus musculus
agcccgctctaggtgttgaggctcg

SEQ ID NO: 430872 - DNA, 25 bp, Mus musculus
gtagcttttcctgctccgaggcccg

SEQ ID NO: 430873 - DNA, 25 bp, Mus musculus
gaggctcgggcgtccagtttccgcc

SEQ ID NO: 430874 - DNA, 25 bp, Mus musculus
agcgtatccacaggcatggccgtta

SEQ ID NO: 430875 - DNA, 25 bp, Mus musculus
ccagaacagggcaggactcggcgac

SEQ ID NO: 430876 - DNA, 25 bp, Mus musculus
atccacaggcatggccgttacatac

SEQ ID NO: 430877 - DNA, 25 bp, Mus musculus
ctccggggctcagcgtatccacagg

SEQ ID NO: 430878 - DNA, 25 bp, Mus musculus
ccttggttctcaggcgaaaaggtag

SEQ ID NO: 430879 - DNA, 25 bp, Mus musculus
tagccgggaaccttggttctcaggc

SEQ ID NO: 430880 - DNA, 25 bp, Mus musculus
cttggtagcaggtagccgggaacct

SEQ ID NO: 430881 - DNA, 25 bp, Mus musculus
ctgctggccttggtagcaggtagcc

SEQ ID NO: 430882 - DNA, 25 bp, Mus musculus
ttccacagcactcggtttcctggct

SEQ ID NO: 430883 - DNA, 25 bp, Mus musculus
aggcgttccacagcactcggtttcc

SEQ ID NO: 430884 - DNA, 25 bp, Mus musculus
ttatcagcctccaggcgttccacag

SEQ ID NO: 430885 - DNA, 25 bp, Mus musculus
gacgtacttagccttatcagcctcc

SEQ ID NO: 430886 - DNA, 25 bp, Mus musculus
acgcaggctcttgacgtacttagcc

SEQ ID NO: 430887 - DNA, 25 bp, Mus musculus
tcttggcgggtgttggccacacgca

SEQ ID NO: 430888 - DNA, 25 bp, Mus musculus
ctggtggtccctgcagacctgagaa

SEQ ID NO: 430889 - DNA, 25 bp, Mus musculus
ccctgcagacctgagaaggctacta

SEQ ID NO: 430890 - DNA, 25 bp, Mus musculus
cctgagaaggctactacgtgtgaag

SEQ ID NO: 430891 - DNA, 25 bp, Mus musculus
ctactacgtgtgaagaccggcgagc

SEQ ID NO: 430892 - DNA, 25 bp, Mus musculus
gaagaccggcgagctcttccgagtg

SEQ ID NO: 430893 - DNA, 25 bp, Mus musculus
cgagctcttccgagtgggacgccct

SEQ ID NO: 430894 - DNA, 25 bp, Mus musculus
gggacgccctggctgtcccacgatt

SEQ ID NO: 430895 - DNA, 25 bp, Mus musculus
tgtcccacgattccctccgggagaa

SEQ ID NO: 430896 - DNA, 25 bp, Mus musculus
cggacttcctgattggcccgtcgct

SEQ ID NO: 430897 - DNA, 25 bp, Mus musculus
tgattggcccgtcgcttccgttcga

SEQ ID NO: 430898 - DNA, 25 bp, Mus musculus
cacccgggttgccaggcaacatcag

SEQ ID NO: 430899 - DNA, 25 bp, Mus musculus
ggcaacatcaggagccgcagatgca

SEQ ID NO: 430900 - DNA, 25 bp, Mus musculus
ctgcagcccacgtccagaggaatcc

SEQ ID NO: 430901 - DNA, 25 bp, Mus musculus
ccgaggctgacagctggtggtccct

SEQ ID NO: 430902 - DNA, 25 bp, Mus musculus
ttaactggagccaataaaacgctga

SEQ ID NO: 430903 - DNA, 25 bp, Mus musculus
taaaacgctgatggcggcgcctttg

SEQ ID NO: 430904 - DNA, 25 bp, Mus musculus
cctttgtaggcactgcgacggcatt

SEQ ID NO: 430905 - DNA, 25 bp, Mus musculus
gcattgttatggaaagtgcggtccc

SEQ ID NO: 430906 - DNA, 25 bp, Mus musculus
agtcgcccgagccacctggacggga

SEQ ID NO: 430907 - DNA, 25 bp, Mus musculus
gccgcgccgtcagctgcggaaaaca

SEQ ID NO: 430908 - DNA, 25 bp, Mus musculus
caaaactttaggtcaatggtggcac

SEQ ID NO: 430909 - DNA, 25 bp, Mus musculus
tggtggcactgaaaaccagcctgcg

SEQ ID NO: 430910 - DNA, 25 bp, Mus musculus
gccggatttttcatgggatgcgttc

SEQ ID NO: 430911 - DNA, 25 bp, Mus musculus
ccagaaaaagtgtccgcgatgctta

SEQ ID NO: 430912 - DNA, 25 bp, Mus musculus
agtgtccgcgatgcttacggaaccc

SEQ ID NO: 430913 - DNA, 25 bp, Mus musculus
cctcccgccgcagataattaactgg

SEQ ID NO: 430914 - DNA, 25 bp, Mus musculus
ttgtgcaggaaagggccgatccctc

SEQ ID NO: 430915 - DNA, 25 bp, Mus musculus
tactgcctaatgtcctggaaccgcg

SEQ ID NO: 430916 - DNA, 25 bp, Mus musculus
cgggcgcataatgaagtgtgcaaaa

SEQ ID NO: 430917 - DNA, 25 bp, Mus musculus
tcccagatgcacaaaggtggagttc

SEQ ID NO: 430918 - DNA, 25 bp, Mus musculus
tcaccacgctccttaattgggaggc

SEQ ID NO: 430919 - DNA, 25 bp, Mus musculus
tccgacagatggaccgagcccaagg

SEQ ID NO: 430920 - DNA, 25 bp, Mus musculus
cgggcgccttatcagtgagagcaga

SEQ ID NO: 430921 - DNA, 25 bp, Mus musculus
cttatcagtgagagcagaccgggcg

SEQ ID NO: 430922 - DNA, 25 bp, Mus musculus
ccgcggaccgcgaagattaattgcc

SEQ ID NO: 430923 - DNA, 25 bp, Mus musculus
taattgcccaatcaagttgtcggtg

SEQ ID NO: 430924 - DNA, 25 bp, Mus musculus
aaagttaatttgctccgcgacgcgc

SEQ ID NO: 430925 - DNA, 25 bp, Mus musculus
catcccgaggcggactgtagggacc

SEQ ID NO: 430926 - DNA, 25 bp, Mus musculus
cagtgacgaggtcgaggtctgcaaa

SEQ ID NO: 430927 - DNA, 25 bp, Mus musculus
gaggtctgcaaacctgcgatctacc

SEQ ID NO: 430928 - DNA, 25 bp, Mus musculus
ggccctggctgagcacgggctcaca

SEQ ID NO: 430929 - DNA, 25 bp, Mus musculus
tcgccgcaatcaaaggcggacgtcg

SEQ ID NO: 430930 - DNA, 25 bp, Mus musculus
ctaggtcgtacaaaggaaagtggca

SEQ ID NO: 430931 - DNA, 25 bp, Mus musculus
gacatttgatggattagagcgctga

SEQ ID NO: 430932 - DNA, 25 bp, Mus musculus
ccaacttgggctgcagcagggaacc

SEQ ID NO: 430933 - DNA, 25 bp, Mus musculus
cctggagactgcctacgtgctgcct

SEQ ID NO: 430934 - DNA, 25 bp, Mus musculus
caaagcggatggcttccagtgcagc

SEQ ID NO: 430935 - DNA, 25 bp, Mus musculus
ttcctggtgaagaagatcaaagcgg

SEQ ID NO: 430936 - DNA, 25 bp, Mus musculus
ccgcgttccttcctggtgaagaaga

SEQ ID NO: 430937 - DNA, 25 bp, Mus musculus
acagctacagcgaccgcctgtgtgc

SEQ ID NO: 430938 - DNA, 25 bp, Mus musculus
agccggagtgctgagcacagctaca

SEQ ID NO: 430939 - DNA, 25 bp, Mus musculus
gtcccatataaagccggcagccgga

SEQ ID NO: 430940 - DNA, 25 bp, Mus musculus
cagcctgcgtcccatataaagccgg

SEQ ID NO: 430941 - DNA, 25 bp, Mus musculus
ggaccacctgatctcctccagcctg

SEQ ID NO: 430942 - DNA, 25 bp, Mus musculus
agagcgctgaacagttccattgctg

SEQ ID NO: 430943 - DNA, 25 bp, Mus musculus
gaaagtggcagggtcggctcatccc

SEQ ID NO: 430944 - DNA, 25 bp, Mus musculus
acccgcaggttatgtggcgcactgt

SEQ ID NO: 430945 - DNA, 25 bp, Mus musculus
ccctctttgtcacccgcaggttatg

SEQ ID NO: 430946 - DNA, 25 bp, Mus musculus
ccagcggttacgatggcgagcagaa

SEQ ID NO: 430947 - DNA, 25 bp, Mus musculus
cggcgtccgaagagtacagcgaccc

SEQ ID NO: 430948 - DNA, 25 bp, Mus musculus
gagagcccacagtccagcctgtcgg

SEQ ID NO: 430949 - DNA, 25 bp, Mus musculus
gtgaccgacagctactccatggacg

SEQ ID NO: 430950 - DNA, 25 bp, Mus musculus
ttcttcatctctgacgggcgttcgc

SEQ ID NO: 430951 - DNA, 25 bp, Mus musculus
caccggcacgcatgcgcagagtgcg

SEQ ID NO: 430952 - DNA, 25 bp, Mus musculus
tgcggcaagacgtacgccacgtcgt

SEQ ID NO: 430953 - DNA, 25 bp, Mus musculus
aagtgcccgacgtgcggcaaggcct

SEQ ID NO: 430954 - DNA, 25 bp, Mus musculus
ggcaaggcctacgtgtccatgcccg

SEQ ID NO: 430955 - DNA, 25 bp, Mus musculus
tgccgccagtgcgacaagagcttcg

SEQ ID NO: 430956 - DNA, 25 bp, Mus musculus
tccacaagcactgcgaggctgcgtg

SEQ ID NO: 430957 - DNA, 25 bp, Mus musculus
cagttgagcctctgccatgcgggat

SEQ ID NO: 430958 - DNA, 25 bp, Mus musculus
cgggcgaggaccgaagcacacacct

SEQ ID NO: 430959 - DNA, 25 bp, Mus musculus
ctctctcccggccacgactatgcaa

SEQ ID NO: 430960 - DNA, 25 bp, Mus musculus
cgactatgcaactctcccgggcaga

SEQ ID NO: 430961 - DNA, 25 bp, Mus musculus
acgcctctttccacgtccctctgcg

SEQ ID NO: 430962 - DNA, 25 bp, Mus musculus
tgctttaagcacacgcctctttcca

SEQ ID NO: 430963 - DNA, 25 bp, Mus musculus
tctgctttaagcacacgcctctttc

SEQ ID NO: 430964 - DNA, 25 bp, Mus musculus
gactgccagccaggcgcctattggc

SEQ ID NO: 430965 - DNA, 25 bp, Mus musculus
gggcgaggaccgaagcacacacctc

SEQ ID NO: 430966 - DNA, 25 bp, Mus musculus
accgcgcttttgcatgcccgggcga

SEQ ID NO: 430967 - DNA, 25 bp, Mus musculus
cactacctcctccaccgcgcttttg

SEQ ID NO: 430968 - DNA, 25 bp, Mus musculus
gcgcctattggccaccactacctcc

SEQ ID NO: 430969 - DNA, 25 bp, Mus musculus
gccaggcgcctattggccaccacta

SEQ ID NO: 430970 - DNA, 25 bp, Mus musculus
ctatgcaactctcccgggcagaggg

SEQ ID NO: 430971 - DNA, 25 bp, Mus musculus
aagcacacacctccgcgcccacctg

SEQ ID NO: 430972 - DNA, 25 bp, Mus musculus
aattcaccctgagtcagcggccggg

SEQ ID NO: 430973 - DNA, 25 bp, Mus musculus
ggtgcacaacgtaccaatcgccgtg

SEQ ID NO: 430974 - DNA, 25 bp, Mus musculus
gcctgagtcaccacgctgtgcgtca

SEQ ID NO: 430975 - DNA, 25 bp, Mus musculus
cgcgacctgcaaattcaccctgagt

SEQ ID NO: 430976 - DNA, 25 bp, Mus musculus
ctggacccggccaaagtgcagagcc

SEQ ID NO: 430977 - DNA, 25 bp, Mus musculus
gggctgcatcgccacggtgcacaac

SEQ ID NO: 430978 - DNA, 25 bp, Mus musculus
ggcggcagcatccactcgggctgca

SEQ ID NO: 430979 - DNA, 25 bp, Mus musculus
ccaccaaggaagaggtatggggcta

SEQ ID NO: 430980 - DNA, 25 bp, Mus musculus
tacagcccggcctggtaaagaggcc

SEQ ID NO: 430981 - DNA, 25 bp, Mus musculus
ccgagcactcggtcggggcaaacgc

SEQ ID NO: 430982 - DNA, 25 bp, Mus musculus
taggatcacagcgtgggccgagcac

SEQ ID NO: 430983 - DNA, 25 bp, Mus musculus
cagctaggtcagagtgagacacgca

SEQ ID NO: 430984 - DNA, 25 bp, Mus musculus
ggcgcgtccattgagcgcatcgcga

SEQ ID NO: 430985 - DNA, 25 bp, Mus musculus
cctggtggacacgatcctggtgagc

SEQ ID NO: 430986 - DNA, 25 bp, Mus musculus
gtactcagcgctctctccgtgattg

SEQ ID NO: 430987 - DNA, 25 bp, Mus musculus
ccgccatcgccaccatgggtgagta

SEQ ID NO: 430988 - DNA, 25 bp, Mus musculus
cgcctgacaaggcatggacagttcg

SEQ ID NO: 430989 - DNA, 25 bp, Mus musculus
gtagcgggccaacctgctcatgcca

SEQ ID NO: 430990 - DNA, 25 bp, Mus musculus
tcggagcgtcttctggacttcagga

SEQ ID NO: 430991 - DNA, 25 bp, Mus musculus
cctcctggttattggctggtaatga

SEQ ID NO: 430992 - DNA, 25 bp, Mus musculus
ggcgggagtatctgacttcctcctg

SEQ ID NO: 430993 - DNA, 25 bp, Mus musculus
cgcccattggcatcctgtgagagta

SEQ ID NO: 430994 - DNA, 25 bp, Mus musculus
aaatcgccttgacttcgcccattgg

SEQ ID NO: 430995 - DNA, 25 bp, Mus musculus
gcctcaagccggagcagtgattgga

SEQ ID NO: 430996 - DNA, 25 bp, Mus musculus
gtctcagtgattggcaggctctagc

SEQ ID NO: 430997 - DNA, 25 bp, Mus musculus
agtgattggagcagcccacaccttg

SEQ ID NO: 430998 - DNA, 25 bp, Mus musculus
acacttctgggctgtagtcgccacc

SEQ ID NO: 430999 - DNA, 25 bp, Mus musculus
agccagccctcggaaatcgccttga

SEQ ID NO: 431000 - DNA, 25 bp, Mus musculus
ttagacttttgagcgcggggatatg

SEQ ID NO: 431001 - DNA, 25 bp, Mus musculus
ttctgtctcagcaaccagcgcaagg

SEQ ID NO: 431002 - DNA, 25 bp, Mus musculus
ggaccagtcgttcggctgctgcgaa

SEQ ID NO: 431003 - DNA, 25 bp, Mus musculus
gcgcacgtgctgtacccggacgtga

SEQ ID NO: 431004 - DNA, 25 bp, Mus musculus
gggtagttctattggtcccgctggc

SEQ ID NO: 431005 - DNA, 25 bp, Mus musculus
ctactgggacgctggattagacttt

SEQ ID NO: 431006 - DNA, 25 bp, Mus musculus
gacccagaggcaggcgcatagttat

SEQ ID NO: 431007 - DNA, 25 bp, Mus musculus
agctcaaacccagagcgtacggtga

SEQ ID NO: 431008 - DNA, 25 bp, Mus musculus
gatctgcgctcctggacagctcaaa

SEQ ID NO: 431009 - DNA, 25 bp, Mus musculus
accagcggtctcctaggaatccaga

SEQ ID NO: 431010 - DNA, 25 bp, Mus musculus
cccgtggaccgaaagctgtctaaga

SEQ ID NO: 431011 - DNA, 25 bp, Mus musculus
gctcactttgggacggaggaaacag

SEQ ID NO: 431012 - DNA, 25 bp, Mus musculus
ttctgacggtacatcgaagctactg

SEQ ID NO: 431013 - DNA, 25 bp, Mus musculus
caggccatgctaaaagggacctacc

SEQ ID NO: 431014 - DNA, 25 bp, Mus musculus
tcaccgaacgctcccagatgatata

SEQ ID NO: 431015 - DNA, 25 bp, Mus musculus
cggggctgaacttcctacctgctga

SEQ ID NO: 431016 - DNA, 25 bp, Mus musculus
ctggctgtcagacttcaggttcttg

SEQ ID NO: 431017 - DNA, 25 bp, Mus musculus
agtccatcccggctgcccgagaaag

SEQ ID NO: 431018 - DNA, 25 bp, Mus musculus
cgcttccaccgcaggtaccgtggga

SEQ ID NO: 431019 - DNA, 25 bp, Mus musculus
aaaggtcgcgcatgcttcgggactt

SEQ ID NO: 431020 - DNA, 25 bp, Mus musculus
ctgcgctaagtcagagcctccgagg

SEQ ID NO: 431021 - DNA, 25 bp, Mus musculus
gttctgacttaaatgcgcttctctg

SEQ ID NO: 431022 - DNA, 25 bp, Mus musculus
cgctgaagttttgtctagtcaccta

SEQ ID NO: 431023 - DNA, 25 bp, Mus musculus
tatgcctgatgggacgctgaagttt

SEQ ID NO: 431024 - DNA, 25 bp, Mus musculus
ttcggctgtgtcaaaccatcgtttg

SEQ ID NO: 431025 - DNA, 25 bp, Mus musculus
aggaaacacgccatcttcggctgtg

SEQ ID NO: 431026 - DNA, 25 bp, Mus musculus
ctcgctaggcgtagtgcaggaaaca

SEQ ID NO: 431027 - DNA, 25 bp, Mus musculus
gccgccgccatattgtctgtgtgaa

SEQ ID NO: 431028 - DNA, 25 bp, Mus musculus
acacgtgcgaaaggctccggctgca

SEQ ID NO: 431029 - DNA, 25 bp, Mus musculus
tgtgtctgcaccgtggcaccgtgca

SEQ ID NO: 431030 - DNA, 25 bp, Mus musculus
tctactgtgtctgcaccgtggcacc

SEQ ID NO: 431031 - DNA, 25 bp, Mus musculus
tgacggtgtctctactgtgtctgca

SEQ ID NO: 431032 - DNA, 25 bp, Mus musculus
tcctcctgacggtgtctctactgtg

SEQ ID NO: 431033 - DNA, 25 bp, Mus musculus
tcgatccatcgtcctcctgacggtg

SEQ ID NO: 431034 - DNA, 25 bp, Mus musculus
tgcagtgtcaagaattcgatccatc

SEQ ID NO: 431035 - DNA, 25 bp, Mus musculus
ctccggctgcagtgtcaagaattcg

SEQ ID NO: 431036 - DNA, 25 bp, Mus musculus
gagagtgacacgtgcgaaaggctcc

SEQ ID NO: 431037 - DNA, 25 bp, Mus musculus
cagtcggacggcttcgctctatcct

SEQ ID NO: 431038 - DNA, 25 bp, Mus musculus
cagcgctctagtcggaccagtcgga

SEQ ID NO: 431039 - DNA, 25 bp, Mus musculus
agcccagcgctctagtcggaccagt

SEQ ID NO: 431040 - DNA, 25 bp, Mus musculus
tgcgagtgttgtgcccggcccaagc

SEQ ID NO: 431041 - DNA, 25 bp, Mus musculus
cgactccgtgcgagtgttgtgcccg

SEQ ID NO: 431042 - DNA, 25 bp, Mus musculus
cgcacctgagctttccgctgtcaaa

SEQ ID NO: 431043 - DNA, 25 bp, Mus musculus
gacccggcacgcatgcgcgtacaag

SEQ ID NO: 431044 - DNA, 25 bp, Mus musculus
tcgctactgtccaattccagaaact

SEQ ID NO: 431045 - DNA, 25 bp, Mus musculus
cacacaaactcaaggaaagtcgcta

SEQ ID NO: 431046 - DNA, 25 bp, Mus musculus
ctctgcactcgtgaccctaaaattc

SEQ ID NO: 431047 - DNA, 25 bp, Mus musculus
tgcccgagctccgacctccactctg

SEQ ID NO: 431048 - DNA, 25 bp, Mus musculus
cagccacgtccgcagagcggatcgg

SEQ ID NO: 431049 - DNA, 25 bp, Mus musculus
atgaggaagagctgggcctcaccca

SEQ ID NO: 431050 - DNA, 25 bp, Mus musculus
cgcaggccgacggagtctatcctgc

SEQ ID NO: 431051 - DNA, 25 bp, Mus musculus
tccgctgtcaaactgcatgcgcgcg

SEQ ID NO: 431052 - DNA, 25 bp, Mus musculus
gagctttccgctgtcaaactgcatg

SEQ ID NO: 431053 - DNA, 25 bp, Mus musculus
cacgcatgcgcgtacaagcggcttc

SEQ ID NO: 431054 - DNA, 25 bp, Mus musculus
atgcgcgtacaagcggcttccaagc

SEQ ID NO: 431055 - DNA, 25 bp, Mus musculus
aaggaaagtcgctactgtccaattc

SEQ ID NO: 431056 - DNA, 25 bp, Mus musculus
cctcgtgcgtgtgttccagtccgca

SEQ ID NO: 431057 - DNA, 25 bp, Mus musculus
gttccagtccgcactcgggcagcat

SEQ ID NO: 431058 - DNA, 25 bp, Mus musculus
tcgggcagcatcacactgcccaggg

SEQ ID NO: 431059 - DNA, 25 bp, Mus musculus
cagtcccggaagtgctgcagaccga

SEQ ID NO: 431060 - DNA, 25 bp, Mus musculus
agaaagtgaaagtggcagtcccgga

SEQ ID NO: 431061 - DNA, 25 bp, Mus musculus
cgctacccggaagacagcgcgagca

SEQ ID NO: 431062 - DNA, 25 bp, Mus musculus
aggctcgcgctacccggaagacagc

SEQ ID NO: 431063 - DNA, 25 bp, Mus musculus
cacgacccaaaagcgagggacggag

SEQ ID NO: 431064 - DNA, 25 bp, Mus musculus
tgagtaaccacgacccaaaagcgag

SEQ ID NO: 431065 - DNA, 25 bp, Mus musculus
ggcgatgagtaaccacgacccaaaa

SEQ ID NO: 431066 - DNA, 25 bp, Mus musculus
ctgcaaagggcgatgagtaaccacg

SEQ ID NO: 431067 - DNA, 25 bp, Mus musculus
ccaagtctgcaaagggcgatgagta

SEQ ID NO: 431068 - DNA, 25 bp, Mus musculus
ccgagccaagtctgcaaagggcgat

SEQ ID NO: 431069 - DNA, 25 bp, Mus musculus
ccgaggccgggcactgggaaccaat

SEQ ID NO: 431070 - DNA, 25 bp, Mus musculus
taatctgctgctgacgcccagcggc

SEQ ID NO: 431071 - DNA, 25 bp, Mus musculus
aagtagcactcggagccaccgactc

SEQ ID NO: 431072 - DNA, 25 bp, Mus musculus
cccagctcctgaagtagcactcgga

SEQ ID NO: 431073 - DNA, 25 bp, Mus musculus
tgacccgcccatgtcgccgagtgag

SEQ ID NO: 431074 - DNA, 25 bp, Mus musculus
ggcccgggattgcaccatctgtgac

SEQ ID NO: 431075 - DNA, 25 bp, Mus musculus
gtaaacctgagctaatctgctgctg

SEQ ID NO: 431076 - DNA, 25 bp, Mus musculus
cccgcccggctgatgtaaacctgag

SEQ ID NO: 431077 - DNA, 25 bp, Mus musculus
tgctaaagtgctgcggcaccgggac

SEQ ID NO: 431078 - DNA, 25 bp, Mus musculus
agcctcttccgctgctaaagtgctg

SEQ ID NO: 431079 - DNA, 25 bp, Mus musculus
gtcacgtactcggcagcagcctctt

SEQ ID NO: 431080 - DNA, 25 bp, Mus musculus
gagtctcctgcacgctagtgccaga

SEQ ID NO: 431081 - DNA, 25 bp, Mus musculus
actgagcagctctcggagtctcctg

SEQ ID NO: 431082 - DNA, 25 bp, Mus musculus
gccagcctaactgagcagctctcgg

SEQ ID NO: 431083 - DNA, 25 bp, Mus musculus
gggattgcaccatctgtgacccgcc

SEQ ID NO: 431084 - DNA, 25 bp, Mus musculus
ttcttttcttaggatccgggctgga

SEQ ID NO: 431085 - DNA, 25 bp, Mus musculus
cgcacgaacgggatcttctccgagt

SEQ ID NO: 431086 - DNA, 25 bp, Mus musculus
atcttctccgagtcctgcagcagct

SEQ ID NO: 431087 - DNA, 25 bp, Mus musculus
tcgggccactggtccatgatttttc

SEQ ID NO: 431088 - DNA, 25 bp, Mus musculus
ccatgatttttctccgctcgtgctg

SEQ ID NO: 431089 - DNA, 25 bp, Mus musculus
catgaacgcgttcatcggccgctta

SEQ ID NO: 431090 - DNA, 25 bp, Mus musculus
tcggccgcttaatgtggccgctcgg

SEQ ID NO: 431091 - DNA, 25 bp, Mus musculus
gggtcttgcaccagcctggctcgcg

SEQ ID NO: 431092 - DNA, 25 bp, Mus musculus
ccgcgcattgttttgcagggccaag

SEQ ID NO: 431093 - DNA, 25 bp, Mus musculus
ccaaggactcgagcctcgtgggctc

SEQ ID NO: 431094 - DNA, 25 bp, Mus musculus
gcgtcatccgttgctgggcagagaa

SEQ ID NO: 431095 - DNA, 25 bp, Mus musculus
ggcagagaactcagcatttgcatct

SEQ ID NO: 431096 - DNA, 25 bp, Mus musculus
cggatgagataggtttcttttctta

SEQ ID NO: 431097 - DNA, 25 bp, Mus musculus
gcatctcccaatcgctggttgcttg

SEQ ID NO: 431098 - DNA, 25 bp, Mus musculus
gccggtggccatgttacctctttcc

SEQ ID NO: 431099 - DNA, 25 bp, Mus musculus
ttgagccaggtcacgatgtcctcca

SEQ ID NO: 431100 - DNA, 25 bp, Mus musculus
tcgcttctcctcgtagacgcggaga

SEQ ID NO: 431101 - DNA, 25 bp, Mus musculus
aacagggctagcttttcggcggatc

SEQ ID NO: 431102 - DNA, 25 bp, Mus musculus
cggaaactcacgtcgaactcgcggc

SEQ ID NO: 431103 - DNA, 25 bp, Mus musculus
ccggggatctgaatgaccgcgtaga

SEQ ID NO: 431104 - DNA, 25 bp, Mus musculus
tagatgtcgtcagggtccatgccga

SEQ ID NO: 431105 - DNA, 25 bp, Mus musculus
aggcactttcgtctccctggaaaca

SEQ ID NO: 431106 - DNA, 25 bp, Mus musculus
ccgctcgcgctctttttcctgtaag

SEQ ID NO: 431107 - DNA, 25 bp, Mus musculus
tccgccctcttggaagtcttgcgtg

SEQ ID NO: 431108 - DNA, 25 bp, Mus musculus
ttcttctccgccaggttcttgacca

SEQ ID NO: 431109 - DNA, 25 bp, Mus musculus
tctgaaacccgacgcttctggcttc

SEQ ID NO: 431110 - DNA, 25 bp, Mus musculus
tccacggtctcgttccggaagagga

SEQ ID NO: 431111 - DNA, 25 bp, Mus musculus
gtctgacgcctcacccgtagggtct

SEQ ID NO: 431112 - DNA, 25 bp, Mus musculus
gcgccagcggctcctgaatttttca

SEQ ID NO: 431113 - DNA, 25 bp, Mus musculus
gacagttcctcctcaaattcggccg

SEQ ID NO: 431114 - DNA, 25 bp, Mus musculus
gggacagcggagtacccagcatttg

SEQ ID NO: 431115 - DNA, 25 bp, Mus musculus
gcctccacgcgtcaaggtaaacttg

SEQ ID NO: 431116 - DNA, 25 bp, Mus musculus
ttgcctgtcctagcggagttctcca

SEQ ID NO: 431117 - DNA, 25 bp, Mus musculus
gttctccagacccttgcatgcagtg

SEQ ID NO: 431118 - DNA, 25 bp, Mus musculus
cagaactcgggactcacatccagga

SEQ ID NO: 431119 - DNA, 25 bp, Mus musculus
caggaccgcgagtggagaaagttcc

SEQ ID NO: 431120 - DNA, 25 bp, Mus musculus
ctcaacaacagctggaggccatggc

SEQ ID NO: 431121 - DNA, 25 bp, Mus musculus
ctgaatttttcacgcaggggcgggc

SEQ ID NO: 431122 - DNA, 25 bp, Mus musculus
ccatggcaccagagcactcgggtta

SEQ ID NO: 431123 - DNA, 25 bp, Mus musculus
actcgggttacagccaggagatccc

SEQ ID NO: 431124 - DNA, 25 bp, Mus musculus
tggggaaccattgcacccgacagtt

SEQ ID NO: 431125 - DNA, 25 bp, Mus musculus
ctgtcaccaaacctgttgcccggta

SEQ ID NO: 431126 - DNA, 25 bp, Mus musculus
cctgcgccgtggtgttcgactgcaa

SEQ ID NO: 431127 - DNA, 25 bp, Mus musculus
ggcacgtctgacagcacgcagcgca

SEQ ID NO: 431128 - DNA, 25 bp, Mus musculus
ccgattcctggcacgtctgacagca

SEQ ID NO: 431129 - DNA, 25 bp, Mus musculus
ttcacctcgacgacgggccagcttg

SEQ ID NO: 431130 - DNA, 25 bp, Mus musculus
ggagacaccttcacctcgacgacgg

SEQ ID NO: 431131 - DNA, 25 bp, Mus musculus
cgcctgcgccgccaggacaatgcag

SEQ ID NO: 431132 - DNA, 25 bp, Mus musculus
tcttcgagggcgtggtgcgccaact

SEQ ID NO: 431133 - DNA, 25 bp, Mus musculus
caatgtgacagagctcttcgagggc

SEQ ID NO: 431134 - DNA, 25 bp, Mus musculus
gcagcacaatgtgacagagctcttc

SEQ ID NO: 431135 - DNA, 25 bp, Mus musculus
ttcggccactctgcagcacaatgtg

SEQ ID NO: 431136 - DNA, 25 bp, Mus musculus
gttcatcgagacttcggccactctg

SEQ ID NO: 431137 - DNA, 25 bp, Mus musculus
cgactgcaagttcatcgagacttcg

SEQ ID NO: 431138 - DNA, 25 bp, Mus musculus
cgtggtgttcgactgcaagttcatc

SEQ ID NO: 431139 - DNA, 25 bp, Mus musculus
agcgcacgacgccgggcacttaaag

SEQ ID NO: 431140 - DNA, 25 bp, Mus musculus
gttgtgaacgcagtcccattagctc

SEQ ID NO: 431141 - DNA, 25 bp, Mus musculus
tgtgctttgtctttcccttgctcgc

SEQ ID NO: 431142 - DNA, 25 bp, Mus musculus
ccacggagtcctacagaggaagatg

SEQ ID NO: 431143 - DNA, 25 bp, Mus musculus
caggtccactggcagccacggagtc

SEQ ID NO: 431144 - DNA, 25 bp, Mus musculus
tgcgctcttaagacccagtagtttg

SEQ ID NO: 431145 - DNA, 25 bp, Mus musculus
tcagaaatggcctgggcctttactg

SEQ ID NO: 431146 - DNA, 25 bp, Mus musculus
taagacccagtagtttgaggcaccc

SEQ ID NO: 431147 - DNA, 25 bp, Mus musculus
tcttccggcgcggaccttcagaaat

SEQ ID NO: 431148 - DNA, 25 bp, Mus musculus
gatcgacacgcaaggctcttccggc

SEQ ID NO: 431149 - DNA, 25 bp, Mus musculus
acgagttcagcctgcgatcgacacg

SEQ ID NO: 431150 - DNA, 25 bp, Mus musculus
cagatctcgggaggagacgagttca

SEQ ID NO: 431151 - DNA, 25 bp, Mus musculus
acggcggggaccgaatcgcagatct

SEQ ID NO: 431152 - DNA, 25 bp, Mus musculus
ggcggctcgtagtccctccgtatac

SEQ ID NO: 431153 - DNA, 25 bp, Mus musculus
cctcctctgccgctcgtggagaagg

SEQ ID NO: 431154 - DNA, 25 bp, Mus musculus
gcgcgttccctgcatggcacggaaa

SEQ ID NO: 431155 - DNA, 25 bp, Mus musculus
atcctgcccacggacccgtccctgg

SEQ ID NO: 431156 - DNA, 25 bp, Mus musculus
ccctgcatggcacggaaaggcaagg

SEQ ID NO: 431157 - DNA, 25 bp, Mus musculus
caaggggaggcacgtcacttcctgt

SEQ ID NO: 431158 - DNA, 25 bp, Mus musculus
gcagtgcctcttctccgtctacgtt

SEQ ID NO: 431159 - DNA, 25 bp, Mus musculus
tctccgtctacgttcgtgctgcggc

SEQ ID NO: 431160 - DNA, 25 bp, Mus musculus
cgagcgcagcctcgccatggattcg

SEQ ID NO: 431161 - DNA, 25 bp, Mus musculus
agcctcgccatggattcggctgtca

SEQ ID NO: 431162 - DNA, 25 bp, Mus musculus
tcggctgtcagcgatccgcacaacg

SEQ ID NO: 431163 - DNA, 25 bp, Mus musculus
gtcagcgatccgcacaacggcagcg

SEQ ID NO: 431164 - DNA, 25 bp, Mus musculus
cctccacgcccgagggcatcgcgct

SEQ ID NO: 431165 - DNA, 25 bp, Mus musculus
tacggcagcctcctgctcatggcgc

SEQ ID NO: 431166 - DNA, 25 bp, Mus musculus
aaaggcaaggggaggcacgtcactt

SEQ ID NO: 431167 - DNA, 25 bp, Mus musculus
gctgcccatcttcttcggcgccctg

SEQ ID NO: 431168 - DNA, 25 bp, Mus musculus
ggagccggaaatctgaagaagaacc

SEQ ID NO: 431169 - DNA, 25 bp, Mus musculus
cagccgtaaagtacagtccgtcgga

SEQ ID NO: 431170 - DNA, 25 bp, Mus musculus
caggaacattcctattggcccgtta

SEQ ID NO: 431171 - DNA, 25 bp, Mus musculus
ctcaactcggatgctctgacgcatt

SEQ ID NO: 431172 - DNA, 25 bp, Mus musculus
gatgccggtgccatccttcctgtag

SEQ ID NO: 431173 - DNA, 25 bp, Mus musculus
tcggaccgtcttccggttagcgaca

SEQ ID NO: 431174 - DNA, 25 bp, Mus musculus
cctgtagaccgcgactcggacggtc

SEQ ID NO: 431175 - DNA, 25 bp, Mus musculus
agtcattggattttacacagccgta

SEQ ID NO: 431176 - DNA, 25 bp, Mus musculus
ccagtggggtaatcacgtgaggatc

SEQ ID NO: 431177 - DNA, 25 bp, Mus musculus
tctgacgcattttccggttcggacc

SEQ ID NO: 431178 - DNA, 25 bp, Mus musculus
gtggctgtccatccctcaactcgga

SEQ ID NO: 431179 - DNA, 25 bp, Mus musculus
cagtccgaacgcgaagtggctgtcc

SEQ ID NO: 431180 - DNA, 25 bp, Mus musculus
cagcttggcgcatgtccagtccgaa

SEQ ID NO: 431181 - DNA, 25 bp, Mus musculus
ccggttagcgacaacggccggctca

SEQ ID NO: 431182 - DNA, 25 bp, Mus musculus
gcatcctgcggggtgcgccaggaag

SEQ ID NO: 431183 - DNA, 25 bp, Mus musculus
agcgggaaggaaagcgccacctctc

SEQ ID NO: 431184 - DNA, 25 bp, Mus musculus
ccaggaagggccttgcaagcgggaa

SEQ ID NO: 431185 - DNA, 25 bp, Mus musculus
ccttgcaagcgggaaggaaagcgcc

SEQ ID NO: 431186 - DNA, 25 bp, Mus musculus
ttgcaagcgggaaggaaagcgccac

SEQ ID NO: 431187 - DNA, 25 bp, Mus musculus
caagcgggaaggaaagcgccacctc

SEQ ID NO: 431188 - DNA, 25 bp, Mus musculus
gcgggaaggaaagcgccacctctct

SEQ ID NO: 431189 - DNA, 25 bp, Mus musculus
aaggaaagcgccacctctctcgccc

SEQ ID NO: 431190 - DNA, 25 bp, Mus musculus
cagcgcctggctccagcgagtctgg

SEQ ID NO: 431191 - DNA, 25 bp, Mus musculus
tccagcgagtctgggccgccctccc

SEQ ID NO: 431192 - DNA, 25 bp, Mus musculus
agctgggctggtcgctcgcgcagct

SEQ ID NO: 431193 - DNA, 25 bp, Mus musculus
ccggccacgggaggagcggcatcct

SEQ ID NO: 431194 - DNA, 25 bp, Mus musculus
cgcggccggaagctgttcactgggg

SEQ ID NO: 431195 - DNA, 25 bp, Mus musculus
ccgccctccctacgcactgcggggg

SEQ ID NO: 431196 - DNA, 25 bp, Mus musculus
tttgtggcgggcgtccgccgcactc

SEQ ID NO: 431197 - DNA, 25 bp, Mus musculus
ccctgaccgtgcgactttgtggcgg

SEQ ID NO: 431198 - DNA, 25 bp, Mus musculus
tgtcctccctgaccgtgcgactttg

SEQ ID NO: 431199 - DNA, 25 bp, Mus musculus
atccatcaccgcaggccgaagcgcg

SEQ ID NO: 431200 - DNA, 25 bp, Mus musculus
aatcgctttcctcgctcccgacctg

SEQ ID NO: 431201 - DNA, 25 bp, Mus musculus
cggccggcccaaatcgatcacgatg

SEQ ID NO: 431202 - DNA, 25 bp, Mus musculus
cgcgggatccgaccctccttattat

SEQ ID NO: 431203 - DNA, 25 bp, Mus musculus
tattgatttcctctcactcggccgg

SEQ ID NO: 431204 - DNA, 25 bp, Mus musculus
cttcatatttgcagagaattcatct

SEQ ID NO: 431205 - DNA, 25 bp, Mus musculus
aagcgcgacttcatatttgcagaga

SEQ ID NO: 431206 - DNA, 25 bp, Mus musculus
cccgtttgctaagcgcgacttcata

SEQ ID NO: 431207 - DNA, 25 bp, Mus musculus
acaaatgtcccgtttgctaagcgcg

SEQ ID NO: 431208 - DNA, 25 bp, Mus musculus
ccgaccctccttattataacaaatg

SEQ ID NO: 431209 - DNA, 25 bp, Mus musculus
cgcactcgcactctagaagtccttc

SEQ ID NO: 431210 - DNA, 25 bp, Mus musculus
cctgacagcccgtccgggttttatg

SEQ ID NO: 431211 - DNA, 25 bp, Mus musculus
gcacccacgaggaaagcattcccag

SEQ ID NO: 431212 - DNA, 25 bp, Mus musculus
ggaaagcattcccaggcttcgcgcc

SEQ ID NO: 431213 - DNA, 25 bp, Mus musculus
ggcttcgcgccctaagtctgcaggt

SEQ ID NO: 431214 - DNA, 25 bp, Mus musculus
ccctaagtctgcaggtgacgggctc

SEQ ID NO: 431215 - DNA, 25 bp, Mus musculus
agcggagaatgctccagcccagttt

SEQ ID NO: 431216 - DNA, 25 bp, Mus musculus
gcccagtttgccgtctccatggcga

SEQ ID NO: 431217 - DNA, 25 bp, Mus musculus
cagcccgtccgggttttatgaatgg

SEQ ID NO: 431218 - DNA, 25 bp, Mus musculus
gacgtcacgggcctggcgtctaacg

SEQ ID NO: 431219 - DNA, 25 bp, Mus musculus
cgtctaacggtctgagccgcttgtt

SEQ ID NO: 431220 - DNA, 25 bp, Mus musculus
agccgcttgttcagacgctgacaca

SEQ ID NO: 431221 - DNA, 25 bp, Mus musculus
tgttcagacgctgacacagaccagc

SEQ ID NO: 431222 - DNA, 25 bp, Mus musculus
gctgacacagaccagcccgggaaag

SEQ ID NO: 431223 - DNA, 25 bp, Mus musculus
aatgctccagcccagtttgccgtct

SEQ ID NO: 431224 - DNA, 25 bp, Mus musculus
gttctcaggatcatgaaggtcgcca

SEQ ID NO: 431225 - DNA, 25 bp, Mus musculus
ctgcaggccctagctgttcgctgaa

SEQ ID NO: 431226 - DNA, 25 bp, Mus musculus
ttcacaggcggcatgtgttccagcc

SEQ ID NO: 431227 - DNA, 25 bp, Mus musculus
tcggagcaaagcgtggccatctcgc

SEQ ID NO: 431228 - DNA, 25 bp, Mus musculus
tgttccagccgacgatcgcatcttg

SEQ ID NO: 431229 - DNA, 25 bp, Mus musculus
ctccttgtcctttccagtgggtctc

SEQ ID NO: 431230 - DNA, 25 bp, Mus musculus
gggtctcatcccttatctcgctctg

SEQ ID NO: 431231 - DNA, 25 bp, Mus musculus
cattttcatcgtgcctcctggagta

SEQ ID NO: 431232 - DNA, 25 bp, Mus musculus
ttcaggcgcatagctatttaggggc

SEQ ID NO: 431233 - DNA, 25 bp, Mus musculus
tcctgctctacgacatgaacggctg

SEQ ID NO: 431234 - DNA, 25 bp, Mus musculus
tgctactcacgcctcaaggagctgg

SEQ ID NO: 431235 - DNA, 25 bp, Mus musculus
cgcaaagtgagcaaggtggagatcc

SEQ ID NO: 431236 - DNA, 25 bp, Mus musculus
ctcagcaccctgaacggcgagatca

SEQ ID NO: 431237 - DNA, 25 bp, Mus musculus
gaggtccgaggcagagtattacatt

SEQ ID NO: 431238 - DNA, 25 bp, Mus musculus
gcctgggagcgtttccatcagctgg

SEQ ID NO: 431239 - DNA, 25 bp, Mus musculus
agcgtttccatcagctgggcccgag

SEQ ID NO: 431240 - DNA, 25 bp, Mus musculus
ggccgcgctagacaaacagcggccg

SEQ ID NO: 431241 - DNA, 25 bp, Mus musculus
agcggcctgggagcgtttccatcag

SEQ ID NO: 431242 - DNA, 25 bp, Mus musculus
ggaatgcggagctatttaacctgag

SEQ ID NO: 431243 - DNA, 25 bp, Mus musculus
ggcccgaggaatgcggagctattta

SEQ ID NO: 431244 - DNA, 25 bp, Mus musculus
cacggccgcgctagacaaacagcgg

SEQ ID NO: 431245 - DNA, 25 bp, Mus musculus
ggcacggccgcgctagacaaacagc

SEQ ID NO: 431246 - DNA, 25 bp, Mus musculus
gccgactttggcacggccgcgctag

SEQ ID NO: 431247 - DNA, 25 bp, Mus musculus
tgagcatccccaggtgtacggaggc

SEQ ID NO: 431248 - DNA, 25 bp, Mus musculus
cggagctatttaacctgagcatccc

SEQ ID NO: 431249 - DNA, 25 bp, Mus musculus
tgcggagctatttaacctgagcatc

SEQ ID NO: 431250 - DNA, 25 bp, Mus musculus
tttccatcagctgggcccgaggaat

SEQ ID NO: 431251 - DNA, 25 bp, Mus musculus
ccgaggaatgcggagctatttaacc

SEQ ID NO: 431252 - DNA, 25 bp, Mus musculus
agcctcggatctgtgatctgatttc

SEQ ID NO: 431253 - DNA, 25 bp, Mus musculus
acctggctgactgctcgtgctgaat

SEQ ID NO: 431254 - DNA, 25 bp, Mus musculus
ggcttccagacactagggcgttttg

SEQ ID NO: 431255 - DNA, 25 bp, Mus musculus
cagcttagccaatccgcgggtcgag

SEQ ID NO: 431256 - DNA, 25 bp, Mus musculus
tcgtttttcctgaggccgagcccaa

SEQ ID NO: 431257 - DNA, 25 bp, Mus musculus
tcccacagtggagacctcgtttttc

SEQ ID NO: 431258 - DNA, 25 bp, Mus musculus
tctgatttcggaaagaccactcccg

SEQ ID NO: 431259 - DNA, 25 bp, Mus musculus
agtatgccgcggacttaagcctgcc

SEQ ID NO: 431260 - DNA, 25 bp, Mus musculus
ctcgtgctgaatctcccggagaagc

SEQ ID NO: 431261 - DNA, 25 bp, Mus musculus
caccgctagttgtctttgaattccc

SEQ ID NO: 431262 - DNA, 25 bp, Mus musculus
actggcatcgagacatgggagagca

SEQ ID NO: 431263 - DNA, 25 bp, Mus musculus
acggcaaaggctcccattgggccca

SEQ ID NO: 431264 - DNA, 25 bp, Mus musculus
gggaacttgcaagcgcagccacttc

SEQ ID NO: 431265 - DNA, 25 bp, Mus musculus
ctggcgagcgatttgaggagtctca

SEQ ID NO: 431266 - DNA, 25 bp, Mus musculus
gacagcctagacagcgcgcgggctt

SEQ ID NO: 431267 - DNA, 25 bp, Mus musculus
ctgaaaccgggaaagtagcgtgaag

SEQ ID NO: 431268 - DNA, 25 bp, Mus musculus
tgcaagctgaaaccgggaaagtagc

SEQ ID NO: 431269 - DNA, 25 bp, Mus musculus
gtttttccagggttctgagagggca

SEQ ID NO: 431270 - DNA, 25 bp, Mus musculus
ctttggacgccggtgacaggacttc

SEQ ID NO: 431271 - DNA, 25 bp, Mus musculus
cgggtccggacagcctagacagcgc

SEQ ID NO: 431272 - DNA, 25 bp, Mus musculus
gggtgtctgagttcaaattttcaac

SEQ ID NO: 431273 - DNA, 25 bp, Mus musculus
taccagttgagtcctgacgcggtcg

SEQ ID NO: 431274 - DNA, 25 bp, Mus musculus
tttcaaccgtaccagttgagtcctg

SEQ ID NO: 431275 - DNA, 25 bp, Mus musculus
actcgtagggttggtgcaagctgaa

SEQ ID NO: 431276 - DNA, 25 bp, Mus musculus
gtctgagttcaaattttcaaccgta

SEQ ID NO: 431277 - DNA, 25 bp, Mus musculus
ggctctctgattggtgcgttcgacc

SEQ ID NO: 431278 - DNA, 25 bp, Mus musculus
ctctctgattggtgcgttcgaccgg

SEQ ID NO: 431279 - DNA, 25 bp, Mus musculus
agtcctgacgcggtcgtgagtcgct

SEQ ID NO: 431280 - DNA, 25 bp, Mus musculus
cttgcctggcttgcggtcatcacga

SEQ ID NO: 431281 - DNA, 25 bp, Mus musculus
tgatgtagcggtagatgccactgag

SEQ ID NO: 431282 - DNA, 25 bp, Mus musculus
cggcccatgatgtagcggtagatgc

SEQ ID NO: 431283 - DNA, 25 bp, Mus musculus
ccggtaaaaggcaaagcggcccatg

SEQ ID NO: 431284 - DNA, 25 bp, Mus musculus
cggatgctgttttgccagcccggcc

SEQ ID NO: 431285 - DNA, 25 bp, Mus musculus
acactcgttgagagacaggttatgg

SEQ ID NO: 431286 - DNA, 25 bp, Mus musculus
ttgacgaaacactcgttgagagaca

SEQ ID NO: 431287 - DNA, 25 bp, Mus musculus
gcttgcggtcatcacgaggcacctt

SEQ ID NO: 431288 - DNA, 25 bp, Mus musculus
gcagtccggatccagggtccagtag

SEQ ID NO: 431289 - DNA, 25 bp, Mus musculus
aacatgtcgtggcagtccggatcca

SEQ ID NO: 431290 - DNA, 25 bp, Mus musculus
cacctgtgcgtttggtgaagcgtct

SEQ ID NO: 431291 - DNA, 25 bp, Mus musculus
ctgcggcgacggagaaagctgccat

SEQ ID NO: 431292 - DNA, 25 bp, Mus musculus
agctgccatgctggaacatgtcgtg

SEQ ID NO: 431293 - DNA, 25 bp, Mus musculus
gtcatcacgaggcaccttgacgaaa

SEQ ID NO: 431294 - DNA, 25 bp, Mus musculus
agtctggcaagagggattatccctg

SEQ ID NO: 431295 - DNA, 25 bp, Mus musculus
accgggtacctggtctaggagtcag

SEQ ID NO: 431296 - DNA, 25 bp, Mus musculus
tacctggtctaggagtcagagcgca

SEQ ID NO: 431297 - DNA, 25 bp, Mus musculus
tctaggagtcagagcgcagtaccga

SEQ ID NO: 431298 - DNA, 25 bp, Mus musculus
tcagagcgcagtaccgactccgtct

SEQ ID NO: 431299 - DNA, 25 bp, Mus musculus
gcctcctcagttttgtagccgcgct

SEQ ID NO: 431300 - DNA, 25 bp, Mus musculus
aggacacggactcggagtctggcaa

SEQ ID NO: 431301 - DNA, 25 bp, Mus musculus
ctcagttttgtagccgcgctgccgc

SEQ ID NO: 431302 - DNA, 25 bp, Mus musculus
ctcggagtctggcaagagggattat

SEQ ID NO: 431303 - DNA, 25 bp, Mus musculus
ggaggtacgcaacgtgacatgcgca

SEQ ID NO: 431304 - DNA, 25 bp, Mus musculus
tacgcaacgtgacatgcgcagtgga

SEQ ID NO: 431305 - DNA, 25 bp, Mus musculus
gacccagggagactggccgagcctc

SEQ ID NO: 431306 - DNA, 25 bp, Mus musculus
tcctcagttttgtagccgcgctgcc

SEQ ID NO: 431307 - DNA, 25 bp, Mus musculus
agggattatccctgggagcgcacca

SEQ ID NO: 431308 - DNA, 25 bp, Mus musculus
cccgcgaaggctgctgcgtcaggac

SEQ ID NO: 431309 - DNA, 25 bp, Mus musculus
cgacagcgcctgcagagaggcagca

SEQ ID NO: 431310 - DNA, 25 bp, Mus musculus
ttcctcgtcgcggaacgggatctcc

SEQ ID NO: 431311 - DNA, 25 bp, Mus musculus
acagactcacagagcggacaccgag

SEQ ID NO: 431312 - DNA, 25 bp, Mus musculus
tcacagagcggacaccgaggacaga

SEQ ID NO: 431313 - DNA, 25 bp, Mus musculus
acaccgaggacagacgcagacaagc

SEQ ID NO: 431314 - DNA, 25 bp, Mus musculus
cagacgcagacaagcgtggtggcta

SEQ ID NO: 431315 - DNA, 25 bp, Mus musculus
agaagaaagtctgcttgacgcgcgc

SEQ ID NO: 431316 - DNA, 25 bp, Mus musculus
gaaagtctgcttgacgcgcgccagc

SEQ ID NO: 431317 - DNA, 25 bp, Mus musculus
gagccctggcgacagcgcctgcaga

SEQ ID NO: 431318 - DNA, 25 bp, Mus musculus
cgatgtcgccgagccctggcgacag

SEQ ID NO: 431319 - DNA, 25 bp, Mus musculus
agcagcgcgcgcaagtcttcctcgt

SEQ ID NO: 431320 - DNA, 25 bp, Mus musculus
gcgcaagtcttcctcgtcgcggaac

SEQ ID NO: 431321 - DNA, 25 bp, Mus musculus
acttgccgcccttgcgcgacaggca

SEQ ID NO: 431322 - DNA, 25 bp, Mus musculus
ggggttccccataccttggtcatgc

SEQ ID NO: 431323 - DNA, 25 bp, Mus musculus
taggttcactgctgcccgactggcc

SEQ ID NO: 431324 - DNA, 25 bp, Mus musculus
aagcgctaggttcactgctgcccga

SEQ ID NO: 431325 - DNA, 25 bp, Mus musculus
ctatcttagcgccttcaaagcgcta

SEQ ID NO: 431326 - DNA, 25 bp, Mus musculus
ccggagcagaaggtcagcgacctgt

SEQ ID NO: 431327 - DNA, 25 bp, Mus musculus
gccttcaaagcgctaggttcactgc

SEQ ID NO: 431328 - DNA, 25 bp, Mus musculus
gctgccgctgtaggctcctcctact

SEQ ID NO: 431329 - DNA, 25 bp, Mus musculus
cccgcgggacaacggcagcttgttg

SEQ ID NO: 431330 - DNA, 25 bp, Mus musculus
caacggcagcttgttgcggccgcgt

SEQ ID NO: 431331 - DNA, 25 bp, Mus musculus
tcctcctactccctcggtcatgtgg

SEQ ID NO: 431332 - DNA, 25 bp, Mus musculus
ccagcctgtagcctgatgggaaacc

SEQ ID NO: 431333 - DNA, 25 bp, Mus musculus
gggtccggtgtcagctctgtccagc

SEQ ID NO: 431334 - DNA, 25 bp, Mus musculus
gaaaccaggggtccggtgtcagctc

SEQ ID NO: 431335 - DNA, 25 bp, Mus musculus
tagcctgatgggaaaccaggggtcc

SEQ ID NO: 431336 - DNA, 25 bp, Mus musculus
atggtgccacgcacctcttctgaca

SEQ ID NO: 431337 - DNA, 25 bp, Mus musculus
cgcctgcgcagtgaaaagagcaagc

SEQ ID NO: 431338 - DNA, 25 bp, Mus musculus
ctgttctgggacttccggcacgcct

SEQ ID NO: 431339 - DNA, 25 bp, Mus musculus
cgcacgcgctgttctgggacttccg

SEQ ID NO: 431340 - DNA, 25 bp, Mus musculus
cgcacttacgcgctcgcagccgcca

SEQ ID NO: 431341 - DNA, 25 bp, Mus musculus
tgctacaacttcaccttggctcctt

SEQ ID NO: 431342 - DNA, 25 bp, Mus musculus
tcttctgacacactgctacaacttc

SEQ ID NO: 431343 - DNA, 25 bp, Mus musculus
cagtgaaaagagcaagcgccgcagc

SEQ ID NO: 431344 - DNA, 25 bp, Mus musculus
ggcctcggccaactcctctacttcg

SEQ ID NO: 431345 - DNA, 25 bp, Mus musculus
cagccgccacgtctctcacctgccg

SEQ ID NO: 431346 - DNA, 25 bp, Mus musculus
gaagaccgggtgagctccctgccac

SEQ ID NO: 431347 - DNA, 25 bp, Mus musculus
ctgggaccagtgacgccggaagacc

SEQ ID NO: 431348 - DNA, 25 bp, Mus musculus
ttcgaccaggtaccgcagcacccgc

SEQ ID NO: 431349 - DNA, 25 bp, Mus musculus
ctcacctgccgcttgtccgacagca

SEQ ID NO: 431350 - DNA, 25 bp, Mus musculus
gcaccaaggacagtgctgtcgcctt

SEQ ID NO: 431351 - DNA, 25 bp, Mus musculus
ccacgctacgagctgcgggactgct

SEQ ID NO: 431352 - DNA, 25 bp, Mus musculus
cgctgctcgtgttcttctccgacgg

SEQ ID NO: 431353 - DNA, 25 bp, Mus musculus
gcctcctactacctgcagggtcaga

SEQ ID NO: 431354 - DNA, 25 bp, Mus musculus
ggtcagagcacctacttcggcctca

SEQ ID NO: 431355 - DNA, 25 bp, Mus musculus
tcttcgtgctgctgccctcactggt

SEQ ID NO: 431356 - DNA, 25 bp, Mus musculus
cctcactggtcgtgcagctgctcag

SEQ ID NO: 431357 - DNA, 25 bp, Mus musculus
cttccgctggttcgtctacgactac

SEQ ID NO: 431358 - DNA, 25 bp, Mus musculus
ttcgtctacgactactcggagcccg

SEQ ID NO: 431359 - DNA, 25 bp, Mus musculus
cgacatagtcggagccgccatcagc

SEQ ID NO: 431360 - DNA, 25 bp, Mus musculus
tgctgtcgccttccggaccaaagaa

SEQ ID NO: 431361 - DNA, 25 bp, Mus musculus
cttccggaccaaagaaggtagcgcg

SEQ ID NO: 431362 - DNA, 25 bp, Mus musculus
caacatggccgcgaagtcggatgga

SEQ ID NO: 431363 - DNA, 25 bp, Mus musculus
agcaccaaggacagcgacatagtcg

SEQ ID NO: 431364 - DNA, 25 bp, Mus musculus
tcttgtccctatcacggtgccggtg

SEQ ID NO: 431365 - DNA, 25 bp, Mus musculus
gctccaccactaggggtcggtccat

SEQ ID NO: 431366 - DNA, 25 bp, Mus musculus
gtctcggtgctttctgtcctgtcct

SEQ ID NO: 431367 - DNA, 25 bp, Mus musculus
ctcgttgttctctgcctcacgtgga

SEQ ID NO: 431368 - DNA, 25 bp, Mus musculus
tcacccttgggtacaagcaccggcg

SEQ ID NO: 431369 - DNA, 25 bp, Mus musculus
gccctccttgcttgagtcctgtgca

SEQ ID NO: 431370 - DNA, 25 bp, Mus musculus
ggtggtgacgtctactgcgctcaca

SEQ ID NO: 431371 - DNA, 25 bp, Mus musculus
gcgctcacagcgcacttgcgtgtca

SEQ ID NO: 431372 - DNA, 25 bp, Mus musculus
tcctgttcgcctccagcaggtgctg

SEQ ID NO: 431373 - DNA, 25 bp, Mus musculus
gccttcaggctttgacttgctccca

SEQ ID NO: 431374 - DNA, 25 bp, Mus musculus
gtgtcttcatgtctggcctcacatg

SEQ ID NO: 431375 - DNA, 25 bp, Mus musculus
acatggcgcgtgctggcataacgca

SEQ ID NO: 431376 - DNA, 25 bp, Mus musculus
ccctggagtctccttgctgtgactt

SEQ ID NO: 431377 - DNA, 25 bp, Mus musculus
gtgtcttgctcgtcgctcacccttg

SEQ ID NO: 431378 - DNA, 25 bp, Mus musculus
tgagcgagccgggacccctacactg

SEQ ID NO: 431379 - DNA, 25 bp, Mus musculus
gccaaggtctctgccgaggactaca

SEQ ID NO: 431380 - DNA, 25 bp, Mus musculus
cctgtcttccaggtgcgacccggtt

SEQ ID NO: 431381 - DNA, 25 bp, Mus musculus
ttccaggtgcgacccggtttgcctc

SEQ ID NO: 431382 - DNA, 25 bp, Mus musculus
gtttgcctcccacgccagtggctcg

SEQ ID NO: 431383 - DNA, 25 bp, Mus musculus
ccttgcggacagaggggcctgtcat

SEQ ID NO: 431384 - DNA, 25 bp, Mus musculus
aggggcctgtcattcggattgactt

SEQ ID NO: 431385 - DNA, 25 bp, Mus musculus
cattcggattgacttgcctaggaaa

SEQ ID NO: 431386 - DNA, 25 bp, Mus musculus
tgcctaggaaaaagtacccagcgtg

SEQ ID NO: 431387 - DNA, 25 bp, Mus musculus
tacccagcgtgggatgctcatttta

SEQ ID NO: 431388 - DNA, 25 bp, Mus musculus
gcgtgggatgctcattttattgacc

SEQ ID NO: 431389 - DNA, 25 bp, Mus musculus
ctcattttattgaccgccggctccg

SEQ ID NO: 431390 - DNA, 25 bp, Mus musculus
tctctgccgaggactacaggcactg

SEQ ID NO: 431391 - DNA, 25 bp, Mus musculus
tgccgaggactacaggcactgagcg

SEQ ID NO: 431392 - DNA, 25 bp, Mus musculus
ccctgacgacgacgacgtctatgag

SEQ ID NO: 431393 - DNA, 25 bp, Mus musculus
ggcggaatcctcactgacagctttg

SEQ ID NO: 431394 - DNA, 25 bp, Mus musculus
actgacagctttggccgcatcaagc

SEQ ID NO: 431395 - DNA, 25 bp, Mus musculus
tggccgcatcaagcgcagcatgagc

SEQ ID NO: 431396 - DNA, 25 bp, Mus musculus
agcatgagctccacgtctgcctctg

SEQ ID NO: 431397 - DNA, 25 bp, Mus musculus
cgtctgcctctgctgtgcgcagtta

SEQ ID NO: 431398 - DNA, 25 bp, Mus musculus
ctctgctgtgcgcagttacgacggg

SEQ ID NO: 431399 - DNA, 25 bp, Mus musculus
cgaggtgcagaccttccaccagctg

SEQ ID NO: 431400 - DNA, 25 bp, Mus musculus
gtgcagaccttccaccagctgctag

SEQ ID NO: 431401 - DNA, 25 bp, Mus musculus
agctgctagccgacatcactcatga

SEQ ID NO: 431402 - DNA, 25 bp, Mus musculus
cgcgagggcggaatcctcactgaca

SEQ ID NO: 431403 - DNA, 25 bp, Mus musculus
actcatgacattgaggcgctggccc

SEQ ID NO: 431404 - DNA, 25 bp, Mus musculus
gacgacgtctatgaggatgtctccc

SEQ ID NO: 431405 - DNA, 25 bp, Mus musculus
ctagccgacatcactcatgacattg

SEQ ID NO: 431406 - DNA, 25 bp, Mus musculus
ctctgtagcccgcaagtcttcgtcg

SEQ ID NO: 431407 - DNA, 25 bp, Mus musculus
gaacccgtcctaggagcaaccgatc

SEQ ID NO: 431408 - DNA, 25 bp, Mus musculus
tcgggctccagggatctgagatcct

SEQ ID NO: 431409 - DNA, 25 bp, Mus musculus
cgagaacgtgcagacctcgggctcc

SEQ ID NO: 431410 - DNA, 25 bp, Mus musculus
atccgggctgcccacgaagcgaagg

SEQ ID NO: 431411 - DNA, 25 bp, Mus musculus
cgcaagtcttcgtcgcttgctccgg

SEQ ID NO: 431412 - DNA, 25 bp, Mus musculus
cgagcgccaacgcagcctctgtagc

SEQ ID NO: 431413 - DNA, 25 bp, Mus musculus
ggctctgacccgttccgagcgccaa

SEQ ID NO: 431414 - DNA, 25 bp, Mus musculus
tgggttgcggctcccagcttgcact

SEQ ID NO: 431415 - DNA, 25 bp, Mus musculus
agcgccactgggttgcggctcccag

SEQ ID NO: 431416 - DNA, 25 bp, Mus musculus
ctaaggcgcccagatggccagtgag

SEQ ID NO: 431417 - DNA, 25 bp, Mus musculus
catcacccagggtgcggctaaggcg

SEQ ID NO: 431418 - DNA, 25 bp, Mus musculus
gtttgcatcacccagggtgcggcta

SEQ ID NO: 431419 - DNA, 25 bp, Mus musculus
tccgggctctgaagtccggggccac

SEQ ID NO: 431420 - DNA, 25 bp, Mus musculus
tactgagtgtctggctggagcggcc

SEQ ID NO: 431421 - DNA, 25 bp, Mus musculus
ggtctcctctctggggcgagctccg

SEQ ID NO: 431422 - DNA, 25 bp, Mus musculus
aggcggcaggcagggtctcctctct

SEQ ID NO: 431423 - DNA, 25 bp, Mus musculus
tatgtcgcggcagtagagatgcagg

SEQ ID NO: 431424 - DNA, 25 bp, Mus musculus
acccgcaggattgtggtatgtcgcg

SEQ ID NO: 431425 - DNA, 25 bp, Mus musculus
cggccaggagagcacccgcaggatt

SEQ ID NO: 431426 - DNA, 25 bp, Mus musculus
ctcccacgccatcacctactgagtg

SEQ ID NO: 431427 - DNA, 25 bp, Mus musculus
gcaggcacatggtcgcctccagaac

SEQ ID NO: 431428 - DNA, 25 bp, Mus musculus
cggcaggcacatggtcgcctccaga

SEQ ID NO: 431429 - DNA, 25 bp, Mus musculus
ccgctcttgtatgggcggcaggcac

SEQ ID NO: 431430 - DNA, 25 bp, Mus musculus
tgtgcatcccgctcttgtatgggcg

SEQ ID NO: 431431 - DNA, 25 bp, Mus musculus
cgggccgggtgtgcatcccgctctt

SEQ ID NO: 431432 - DNA, 25 bp, Mus musculus
ggttgcagggcctaagcggctcagc

SEQ ID NO: 431433 - DNA, 25 bp, Mus musculus
agcacccgcaggattgtggtatgtc

SEQ ID NO: 431434 - DNA, 25 bp, Mus musculus
ggttacctgctctactgtccctgca

SEQ ID NO: 431435 - DNA, 25 bp, Mus musculus
gtcgggccattgtgcggtgcattgt

SEQ ID NO: 431436 - DNA, 25 bp, Mus musculus
gtgccgcgggctctctatggtcccg

SEQ ID NO: 431437 - DNA, 25 bp, Mus musculus
cactctggggctctgccgtcgacat

SEQ ID NO: 431438 - DNA, 25 bp, Mus musculus
cgtgggcaccgccacacctgctgct

SEQ ID NO: 431439 - DNA, 25 bp, Mus musculus
acctgctgctgcgggcgtctttcct

SEQ ID NO: 431440 - DNA, 25 bp, Mus musculus
ctcctgggacctggccggttacctg

SEQ ID NO: 431441 - DNA, 25 bp, Mus musculus
gaccctcgccggcactcactgcgct

SEQ ID NO: 431442 - DNA, 25 bp, Mus musculus
ggaggcggagccacttctctgaggc

SEQ ID NO: 431443 - DNA, 25 bp, Mus musculus
ctgctctactgtccctgcatgggta

SEQ ID NO: 431444 - DNA, 25 bp, Mus musculus
actgtccctgcatgggtaaggcctc

SEQ ID NO: 431445 - DNA, 25 bp, Mus musculus
ctgcatgggtaaggcctccggaacc

SEQ ID NO: 431446 - DNA, 25 bp, Mus musculus
ccctctgcttaaacggagaaactga

SEQ ID NO: 431447 - DNA, 25 bp, Mus musculus
gacctggccggttacctgctctact

SEQ ID NO: 431448 - DNA, 25 bp, Mus musculus
tatccgatccacaacaagcagagca

SEQ ID NO: 431449 - DNA, 25 bp, Mus musculus
gcctgtttacatccggcgccttgga

SEQ ID NO: 431450 - DNA, 25 bp, Mus musculus
tggagcgactgaagactagattact

SEQ ID NO: 431451 - DNA, 25 bp, Mus musculus
gcgtggaatagtggccgcaaacaca

SEQ ID NO: 431452 - DNA, 25 bp, Mus musculus
cgatctagcgttaggctccgggctt

SEQ ID NO: 431453 - DNA, 25 bp, Mus musculus
ttcatgatgtttccgtgcctgcgcg

SEQ ID NO: 431454 - DNA, 25 bp, Mus musculus
cagagcaggactttaatggagcgac

SEQ ID NO: 431455 - DNA, 25 bp, Mus musculus
gttccttgcgaatatccgatccaca

SEQ ID NO: 431456 - DNA, 25 bp, Mus musculus
acacatgtgtggttccttgcgaata

SEQ ID NO: 431457 - DNA, 25 bp, Mus musculus
gggaatcttaccgaatcttaacaca

SEQ ID NO: 431458 - DNA, 25 bp, Mus musculus
tggagcctacaccaggcgactgtga

SEQ ID NO: 431459 - DNA, 25 bp, Mus musculus
gccaggcagagcgaccgcctgttta

SEQ ID NO: 431460 - DNA, 25 bp, Mus musculus
gtctggaagtggaaagcccacgcca

SEQ ID NO: 431461 - DNA, 25 bp, Mus musculus
cgactgtgagatgcggggaatctta

SEQ ID NO: 431462 - DNA, 25 bp, Mus musculus
ttcacgtagcttcagccgtccgtta

SEQ ID NO: 431463 - DNA, 25 bp, Mus musculus
gcccagaacaggtagctcagtcacg

SEQ ID NO: 431464 - DNA, 25 bp, Mus musculus
cgtccgtcgggtagacgtcactttg

SEQ ID NO: 431465 - DNA, 25 bp, Mus musculus
ctctaactagcggaggctgcgtttc

SEQ ID NO: 431466 - DNA, 25 bp, Mus musculus
ccgtccgttacgtagaatgcgtaca

SEQ ID NO: 431467 - DNA, 25 bp, Mus musculus
ccctgggctacaagtgctctaacta

SEQ ID NO: 431468 - DNA, 25 bp, Mus musculus
ctcggcctcgtttaacaaagaatcg

SEQ ID NO: 431469 - DNA, 25 bp, Mus musculus
taattggcgcctttcggcagccgta

SEQ ID NO: 431470 - DNA, 25 bp, Mus musculus
tccggaatcggaagagcggcattaa

SEQ ID NO: 431471 - DNA, 25 bp, Mus musculus
cgtagttatgttgcgttccggaatc

SEQ ID NO: 431472 - DNA, 25 bp, Mus musculus
gccgcggctctcttcattgcagact

SEQ ID NO: 431473 - DNA, 25 bp, Mus musculus
gctccggaagctaaaggtggccata

SEQ ID NO: 431474 - DNA, 25 bp, Mus musculus
cgtcactttgatcggatgctccgga

SEQ ID NO: 431475 - DNA, 25 bp, Mus musculus
tttcgcgccgactggagtagcaact

SEQ ID NO: 431476 - DNA, 25 bp, Mus musculus
tctgtggtatctctgaccacccggc

SEQ ID NO: 431477 - DNA, 25 bp, Mus musculus
cgctgggaacctggaaaacgccgct

SEQ ID NO: 431478 - DNA, 25 bp, Mus musculus
aaacgccgctgcactccgggttccg

SEQ ID NO: 431479 - DNA, 25 bp, Mus musculus
accagaggaccgagtccgggtgcct

SEQ ID NO: 431480 - DNA, 25 bp, Mus musculus
cttcggaggcccaataaagttattg

SEQ ID NO: 431481 - DNA, 25 bp, Mus musculus
aattgacgcggttgctaaggaagtg

SEQ ID NO: 431482 - DNA, 25 bp, Mus musculus
ccgggttgctaaggaagtgagcgcc

SEQ ID NO: 431483 - DNA, 25 bp, Mus musculus
gtgagttcgagatgctggggtcacc

SEQ ID NO: 431484 - DNA, 25 bp, Mus musculus
ggggcgcccagcattatcccgatgt

SEQ ID NO: 431485 - DNA, 25 bp, Mus musculus
gcccagcattatcccgatgtcgttg

SEQ ID NO: 431486 - DNA, 25 bp, Mus musculus
atcccgatgtcgttgctctgcgagc

SEQ ID NO: 431487 - DNA, 25 bp, Mus musculus
ctctgcgagccgcagcatcctttgt

SEQ ID NO: 431488 - DNA, 25 bp, Mus musculus
cagcatcctttgtccggcctctgtg

SEQ ID NO: 431489 - DNA, 25 bp, Mus musculus
ccggcctctgtggtatctctgacca

SEQ ID NO: 431490 - DNA, 25 bp, Mus musculus
gcccgccactagttcgctcttgggt

SEQ ID NO: 431491 - DNA, 25 bp, Mus musculus
cgaggaggctgggacgccttttctc

SEQ ID NO: 431492 - DNA, 25 bp, Mus musculus
cactccgggaaatgtggtccaagca

SEQ ID NO: 431493 - DNA, 25 bp, Mus musculus
aatgtggtccaagcacttgaggcag

SEQ ID NO: 431494 - DNA, 25 bp, Mus musculus
cttgaggcagccattttcttccgga

SEQ ID NO: 431495 - DNA, 25 bp, Mus musculus
cagccattttcttccggagaggggt

SEQ ID NO: 431496 - DNA, 25 bp, Mus musculus
ggccaggaagccagtgaggactaca

SEQ ID NO: 431497 - DNA, 25 bp, Mus musculus
ggcagacacgcacgcatccgagcgt

SEQ ID NO: 431498 - DNA, 25 bp, Mus musculus
catccgagcgtcgaaaggaaagccg

SEQ ID NO: 431499 - DNA, 25 bp, Mus musculus
gcattccttagccatcgcggggctg

SEQ ID NO: 431500 - DNA, 25 bp, Mus musculus
aaggaaagccgcgtctcgccatccg

SEQ ID NO: 431501 - DNA, 25 bp, Mus musculus
ctagttcgctcttgggtttcccagc

SEQ ID NO: 431502 - DNA, 25 bp, Mus musculus
gggtctcgctctagccagtcccggt

SEQ ID NO: 431503 - DNA, 25 bp, Mus musculus
ttctttaccgtgcttggagcgcagc

SEQ ID NO: 431504 - DNA, 25 bp, Mus musculus
gctgatcggcgatctagctctggga

SEQ ID NO: 431505 - DNA, 25 bp, Mus musculus
gggcacttgaagctagacgcacctc

SEQ ID NO: 431506 - DNA, 25 bp, Mus musculus
aaatccactttaacccttgcacgcg

SEQ ID NO: 431507 - DNA, 25 bp, Mus musculus
gcaatgtgcctcttcaccaggggtc

SEQ ID NO: 431508 - DNA, 25 bp, Mus musculus
caacaccctagtttcttcttcaagg

SEQ ID NO: 431509 - DNA, 25 bp, Mus musculus
cttcttcaagggtgcacacgagatg

SEQ ID NO: 431510 - DNA, 25 bp, Mus musculus
tgcacacgagatgggctgtcggtct

SEQ ID NO: 431511 - DNA, 25 bp, Mus musculus
tggagcgacaggagcctgccaaagt

SEQ ID NO: 431512 - DNA, 25 bp, Mus musculus
gcctgccaaagtgggctcaactgtg

SEQ ID NO: 431513 - DNA, 25 bp, Mus musculus
ggctcaactgtgcaaaccgcgtctc

SEQ ID NO: 431514 - DNA, 25 bp, Mus musculus
tcctttctcccggaggcagaagcca

SEQ ID NO: 431515 - DNA, 25 bp, Mus musculus
agccagcgaatgtctacctcccggg

SEQ ID NO: 431516 - DNA, 25 bp, Mus musculus
tgcaaacggcgtggccgctgcacaa

SEQ ID NO: 431517 - DNA, 25 bp, Mus musculus
atctagctctgggagtgaaccgggc

SEQ ID NO: 431518 - DNA, 25 bp, Mus musculus
tgggcgcgcacaatctgcgtggtct

SEQ ID NO: 431519 - DNA, 25 bp, Mus musculus
cgggtcattgtgctctagcagacca

SEQ ID NO: 431520 - DNA, 25 bp, Mus musculus
ctgcaggaaagggaagacgcacgcc

SEQ ID NO: 431521 - DNA, 25 bp, Mus musculus
tgcttcggcttcagaagatagaatg

SEQ ID NO: 431522 - DNA, 25 bp, Mus musculus
gctacagttgtaaagtcatagcata

SEQ ID NO: 431523 - DNA, 25 bp, Mus musculus
acgccgcgctggctacagttgtaaa

SEQ ID NO: 431524 - DNA, 25 bp, Mus musculus
tgtgctctagcagaccactcggtgc

SEQ ID NO: 431525 - DNA, 25 bp, Mus musculus
ataatattaagaatgctgcccagac

SEQ ID NO: 431526 - DNA, 25 bp, Mus musculus
ctgttcgacccaaacattccggcga

SEQ ID NO: 431527 - DNA, 25 bp, Mus musculus
caatctgcgtggtctctgcaggaaa

SEQ ID NO: 431528 - DNA, 25 bp, Mus musculus
acgccgactcaaggtgcggtcttcc

SEQ ID NO: 431529 - DNA, 25 bp, Mus musculus
tgcggtcttcctcggggcaaacaga

SEQ ID NO: 431530 - DNA, 25 bp, Mus musculus
gcaaacagaccttctgcttcggctt

SEQ ID NO: 431531 - DNA, 25 bp, Mus musculus
agaccactcggtgccggcttcttac

SEQ ID NO: 431532 - DNA, 25 bp, Mus musculus
cccgaccgctgaagaggttctaggc

SEQ ID NO: 431533 - DNA, 25 bp, Mus musculus
tggggacccgcctctctcgggagtc

SEQ ID NO: 431534 - DNA, 25 bp, Mus musculus
cgctgtcgtcaccactgcagagggg

SEQ ID NO: 431535 - DNA, 25 bp, Mus musculus
gtcgtcaccactgcagaggggcgcc

SEQ ID NO: 431536 - DNA, 25 bp, Mus musculus
gcctctctcgggagtctcagccgag

SEQ ID NO: 431537 - DNA, 25 bp, Mus musculus
tctcgggagtctcagccgaggactg

SEQ ID NO: 431538 - DNA, 25 bp, Mus musculus
ggacccgaccgctgaagaggttcta

SEQ ID NO: 431539 - DNA, 25 bp, Mus musculus
accgctgaagaggttctaggcagga

SEQ ID NO: 431540 - DNA, 25 bp, Mus musculus
caggaggaggctctgagcccaacga

SEQ ID NO: 431541 - DNA, 25 bp, Mus musculus
aggaggctctgagcccaacgagccc

SEQ ID NO: 431542 - DNA, 25 bp, Mus musculus
aggcccgcgcgctaatgactgttga

SEQ ID NO: 431543 - DNA, 25 bp, Mus musculus
cccgcgcgctaatgactgttgacag

SEQ ID NO: 431544 - DNA, 25 bp, Mus musculus
cgctaatgactgttgacagcgcgcg

SEQ ID NO: 431545 - DNA, 25 bp, Mus musculus
agtctcagccgaggactgggaatgg

SEQ ID NO: 431546 - DNA, 25 bp, Mus musculus
gggattctggttcccgctctcgctt

SEQ ID NO: 431547 - DNA, 25 bp, Mus musculus
ctcgcttccttgtccactgttgctg

SEQ ID NO: 431548 - DNA, 25 bp, Mus musculus
cccgcatcagctgcggacagacagg

SEQ ID NO: 431549 - DNA, 25 bp, Mus musculus
ccactgttgctgctgaatgacgtca

SEQ ID NO: 431550 - DNA, 25 bp, Mus musculus
ctgaatgacgtcacagccgctgaca

SEQ ID NO: 431551 - DNA, 25 bp, Mus musculus
tcacagccgctgacattgatgtgca

SEQ ID NO: 431552 - DNA, 25 bp, Mus musculus
ccgctgacattgatgtgcacgcaca

SEQ ID NO: 431553 - DNA, 25 bp, Mus musculus
gatgtgcacgcacactgccatgcca

SEQ ID NO: 431554 - DNA, 25 bp, Mus musculus
gcacactgccatgccaacggacaga

SEQ ID NO: 431555 - DNA, 25 bp, Mus musculus
gccaacggacagagacatggacacc

SEQ ID NO: 431556 - DNA, 25 bp, Mus musculus
gacagagacatggacaccaaggttc

SEQ ID NO: 431557 - DNA, 25 bp, Mus musculus
atggacaccaaggttcagatgtccc

SEQ ID NO: 431558 - DNA, 25 bp, Mus musculus
cccgccgcccacgacactgtgacca

SEQ ID NO: 431559 - DNA, 25 bp, Mus musculus
tgcggacagacagggattctggttc

SEQ ID NO: 431560 - DNA, 25 bp, Mus musculus
tggctgcaggtagacaccggtctgc

SEQ ID NO: 431561 - DNA, 25 bp, Mus musculus
ggtttggggattgatcgccacacta

SEQ ID NO: 431562 - DNA, 25 bp, Mus musculus
ctatgtccgcagacctgggagtgga

SEQ ID NO: 431563 - DNA, 25 bp, Mus musculus
cgctgcggacctggtaggtccgtta

SEQ ID NO: 431564 - DNA, 25 bp, Mus musculus
gatcgccacactaagaggacacccg

SEQ ID NO: 431565 - DNA, 25 bp, Mus musculus
tcaagttcccgaagggcactcactg

SEQ ID NO: 431566 - DNA, 25 bp, Mus musculus
tctccgaaagtttggacagtggtcg

SEQ ID NO: 431567 - DNA, 25 bp, Mus musculus
ctgcacacattctccgaaagtttgg

SEQ ID NO: 431568 - DNA, 25 bp, Mus musculus
cgagatgatgtttcctctgcacaca

SEQ ID NO: 431569 - DNA, 25 bp, Mus musculus
acattatctggggtcctcgctcgct

SEQ ID NO: 431570 - DNA, 25 bp, Mus musculus
ttcggcagcggctcggacattatct

SEQ ID NO: 431571 - DNA, 25 bp, Mus musculus
cgaagctgtcatttcggcagcggct

SEQ ID NO: 431572 - DNA, 25 bp, Mus musculus
gacactctggtgatccggcgaagct

SEQ ID NO: 431573 - DNA, 25 bp, Mus musculus
gaggcgggatctcccggcctatgtc

SEQ ID NO: 431574 - DNA, 25 bp, Mus musculus
gcggctgcatgaatggagaagaata

SEQ ID NO: 431575 - DNA, 25 bp, Mus musculus
tccttttccacctcgatggtctcgt

SEQ ID NO: 431576 - DNA, 25 bp, Mus musculus
tggtctcgtccagctcactatctga

SEQ ID NO: 431577 - DNA, 25 bp, Mus musculus
tcactatctgaggagctgtagtctg

SEQ ID NO: 431578 - DNA, 25 bp, Mus musculus
gtagtctgggtgagctctcttcatg

SEQ ID NO: 431579 - DNA, 25 bp, Mus musculus
tgagctctcttcatggtggcggagc

SEQ ID NO: 431580 - DNA, 25 bp, Mus musculus
aggagttaactgcagtggccgctca

SEQ ID NO: 431581 - DNA, 25 bp, Mus musculus
ggtgcgtgcacactgatcccactca

SEQ ID NO: 431582 - DNA, 25 bp, Mus musculus
cacgctcagtctccggttaaaactc

SEQ ID NO: 431583 - DNA, 25 bp, Mus musculus
cgctgcgcagattggcagccgcatg

SEQ ID NO: 431584 - DNA, 25 bp, Mus musculus
caaagggaacccagcatcagcgcac

SEQ ID NO: 431585 - DNA, 25 bp, Mus musculus
cgggctcctggtgtgaacctgtaat

SEQ ID NO: 431586 - DNA, 25 bp, Mus musculus
gtgaacctgtaatcggagtccgggc

SEQ ID NO: 431587 - DNA, 25 bp, Mus musculus
gccaattggcgcctcgctgcgcaga

SEQ ID NO: 431588 - DNA, 25 bp, Mus musculus
atctctgctgctcagtggatctgta

SEQ ID NO: 431589 - DNA, 25 bp, Mus musculus
cactagtgccgaagggcggtctaca

SEQ ID NO: 431590 - DNA, 25 bp, Mus musculus
ctcagctaaggggtgaagcgccttc

SEQ ID NO: 431591 - DNA, 25 bp, Mus musculus
tgtagcctcataggatcctgccgga

SEQ ID NO: 431592 - DNA, 25 bp, Mus musculus
cggagtccgtgacgtcaccagaagc

SEQ ID NO: 431593 - DNA, 25 bp, Mus musculus
gtagcccgcgactattgaaataaac

SEQ ID NO: 431594 - DNA, 25 bp, Mus musculus
ccggctgctggtcttgtagttcaag

SEQ ID NO: 431595 - DNA, 25 bp, Mus musculus
catcgcgacccgaatgcctcgaggt

SEQ ID NO: 431596 - DNA, 25 bp, Mus musculus
tcttggtcttcctgatgcagcgaga

SEQ ID NO: 431597 - DNA, 25 bp, Mus musculus
ttacccgtcgagtcttgagcttctg

SEQ ID NO: 431598 - DNA, 25 bp, Mus musculus
gagctcgtgggactatttggtacta

SEQ ID NO: 431599 - DNA, 25 bp, Mus musculus
ggcattttttggaacgcggcgccac

SEQ ID NO: 431600 - DNA, 25 bp, Mus musculus
cgagtggcaacgcttggtatgaccc

SEQ ID NO: 431601 - DNA, 25 bp, Mus musculus
tgggctgctaaacccaggaccgctc

SEQ ID NO: 431602 - DNA, 25 bp, Mus musculus
taacgtcagatccatggcggccgca

SEQ ID NO: 431603 - DNA, 25 bp, Mus musculus
ctgtggaagccttccctcggagagc

SEQ ID NO: 431604 - DNA, 25 bp, Mus musculus
tcggagagcccaccactagactgac

SEQ ID NO: 431605 - DNA, 25 bp, Mus musculus
tttccaaggcaaccggggcgcattc

SEQ ID NO: 431606 - DNA, 25 bp, Mus musculus
accactagactgacgagccggcctg

SEQ ID NO: 431607 - DNA, 25 bp, Mus musculus
cgggctcgacacgtgacccatctta

SEQ ID NO: 431608 - DNA, 25 bp, Mus musculus
tgacccatcttagctcactgtgaag

SEQ ID NO: 431609 - DNA, 25 bp, Mus musculus
tctcccggggagctgcaccaggaaa

SEQ ID NO: 431610 - DNA, 25 bp, Mus musculus
agggaacggtcctcagacgctggcc

SEQ ID NO: 431611 - DNA, 25 bp, Mus musculus
agacgctggccggtttccaaggcaa

SEQ ID NO: 431612 - DNA, 25 bp, Mus musculus
tgcccggcttaacgtcagatccatg

SEQ ID NO: 431613 - DNA, 25 bp, Mus musculus
gcgcccgccaatcggtttacctgga

SEQ ID NO: 431614 - DNA, 25 bp, Mus musculus
tttacctggaggtagtctgcccggc

SEQ ID NO: 431615 - DNA, 25 bp, Mus musculus
gccagcgatctgcttggagcttcgc

SEQ ID NO: 431616 - DNA, 25 bp, Mus musculus
ttcccaggaggaaagcctcacaatc

SEQ ID NO: 431617 - DNA, 25 bp, Mus musculus
aaggaactcgggactagaagaagcg

SEQ ID NO: 431618 - DNA, 25 bp, Mus musculus
cagagcgcgaacgataacctggatc

SEQ ID NO: 431619 - DNA, 25 bp, Mus musculus
aaagacggggatgttgttcctcagc

SEQ ID NO: 431620 - DNA, 25 bp, Mus musculus
gcaataccgtctacggaggcctttc

SEQ ID NO: 431621 - DNA, 25 bp, Mus musculus
ggaggaaagcctcacaatcccataa

SEQ ID NO: 431622 - DNA, 25 bp, Mus musculus
attgagctggatcagtttgaaggca

SEQ ID NO: 431623 - DNA, 25 bp, Mus musculus
tttgaaggcagagcgcgaacgataa

SEQ ID NO: 431624 - DNA, 25 bp, Mus musculus
ctgaaagcggcgattgagctggatc

SEQ ID NO: 431625 - DNA, 25 bp, Mus musculus
cccgggctttctgcaggaactgaaa

SEQ ID NO: 431626 - DNA, 25 bp, Mus musculus
cacaggtccaacaaggcccgggctt

SEQ ID NO: 431627 - DNA, 25 bp, Mus musculus
caggcgcagcacacaggtccaacaa

SEQ ID NO: 431628 - DNA, 25 bp, Mus musculus
acgataacctggatcgtggagagtg

SEQ ID NO: 431629 - DNA, 25 bp, Mus musculus
agtgggtgtataaggcaataccgtc

SEQ ID NO: 431630 - DNA, 25 bp, Mus musculus
gcgccaggttctccttcttcagcag

SEQ ID NO: 431631 - DNA, 25 bp, Mus musculus
ttcttcagcagcagctcggtcacct

SEQ ID NO: 431632 - DNA, 25 bp, Mus musculus
tcggtcacctccagatgctcattgc

SEQ ID NO: 431633 - DNA, 25 bp, Mus musculus
caggcgagaagcgtgtgccatcctc

SEQ ID NO: 431634 - DNA, 25 bp, Mus musculus
tgctcattgcctacagccagctgca

SEQ ID NO: 431635 - DNA, 25 bp, Mus musculus
tgacattgagcgtgcgagactcctc

SEQ ID NO: 431636 - DNA, 25 bp, Mus musculus
cagcatcttgcgcaccacagggatg

SEQ ID NO: 431637 - DNA, 25 bp, Mus musculus
cacagggatgttgccgtactccgca

SEQ ID NO: 431638 - DNA, 25 bp, Mus musculus
tgggcccacgagcaccgaacatgaa

SEQ ID NO: 431639 - DNA, 25 bp, Mus musculus
accgaacatgaaggccgggccacgc

SEQ ID NO: 431640 - DNA, 25 bp, Mus musculus
tgccctccgacgacctgatcagtgg

SEQ ID NO: 431641 - DNA, 25 bp, Mus musculus
cgacctgatcagtggggcgacaaaa

SEQ ID NO: 431642 - DNA, 25 bp, Mus musculus
cgcagttcttgctcgcaagggctga

SEQ ID NO: 431643 - DNA, 25 bp, Mus musculus
agaagtcatcatctcgcagttcttg

SEQ ID NO: 431644 - DNA, 25 bp, Mus musculus
gtcctccagcctccacggcgagctg

SEQ ID NO: 431645 - DNA, 25 bp, Mus musculus
cttgaccttggtggacatagcggcc

SEQ ID NO: 431646 - DNA, 25 bp, Mus musculus
cggcacttcttgaccttggtggaca

SEQ ID NO: 431647 - DNA, 25 bp, Mus musculus
gctcccggcacttcttgaccttggt

SEQ ID NO: 431648 - DNA, 25 bp, Mus musculus
tccggagcgggcaaggtcaccctcg

SEQ ID NO: 431649 - DNA, 25 bp, Mus musculus
gcgcttaaccagtccggatcccgag

SEQ ID NO: 431650 - DNA, 25 bp, Mus musculus
gcatgcatgcacgtgagcctggccc

SEQ ID NO: 431651 - DNA, 25 bp, Mus musculus
atggtccacgggcagtgcatgcatg

SEQ ID NO: 431652 - DNA, 25 bp, Mus musculus
agcccaggtggcctcgttctctctc

SEQ ID NO: 431653 - DNA, 25 bp, Mus musculus
cgagtcccaaatcctagcccaggtg

SEQ ID NO: 431654 - DNA, 25 bp, Mus musculus
ggttcgagtcccaaatcctagccca

SEQ ID NO: 431655 - DNA, 25 bp, Mus musculus
tgtgcacacaaaacggtccaggacc

SEQ ID NO: 431656 - DNA, 25 bp, Mus musculus
cagccgcaggtcctgtgcacacaaa

SEQ ID NO: 431657 - DNA, 25 bp, Mus musculus
ttggtggacatagcggccaagctcc

SEQ ID NO: 431658 - DNA, 25 bp, Mus musculus
aagcggcgcttctccgttcgggcct

SEQ ID NO: 431659 - DNA, 25 bp, Mus musculus
tagcaggccctgacagccgggtgct

SEQ ID NO: 431660 - DNA, 25 bp, Mus musculus
ctccgttcgggcctggtgccagtga

SEQ ID NO: 431661 - DNA, 25 bp, Mus musculus
cttgacgtgatacgctgccagttga

SEQ ID NO: 431662 - DNA, 25 bp, Mus musculus
atacgctgccagttgacgcagctgc

SEQ ID NO: 431663 - DNA, 25 bp, Mus musculus
cagttgacgcagctgcggtgccgct

SEQ ID NO: 431664 - DNA, 25 bp, Mus musculus
ccgagctggacgtgctacaggctga

SEQ ID NO: 431665 - DNA, 25 bp, Mus musculus
gctacaggctgagggtgtaagcatc

SEQ ID NO: 431666 - DNA, 25 bp, Mus musculus
taagcatcagcggaggtcccgactc

SEQ ID NO: 431667 - DNA, 25 bp, Mus musculus
cgactcggggctgttgtgctgtcaa

SEQ ID NO: 431668 - DNA, 25 bp, Mus musculus
ttgtgctgtcaagtgagaggagctc

SEQ ID NO: 431669 - DNA, 25 bp, Mus musculus
agcgcctttccgggtgagtctggaa

SEQ ID NO: 431670 - DNA, 25 bp, Mus musculus
aggcgctggcgccttgacgtgatac

SEQ ID NO: 431671 - DNA, 25 bp, Mus musculus
tggaggcctagcaggccctgacagc

SEQ ID NO: 431672 - DNA, 25 bp, Mus musculus
ccttttgaaagacgcgactgaccgc

SEQ ID NO: 431673 - DNA, 25 bp, Mus musculus
ctcggctcggcctgcctctggcagc

SEQ ID NO: 431674 - DNA, 25 bp, Mus musculus
cattcaccgtgacccaggcccagct

SEQ ID NO: 431675 - DNA, 25 bp, Mus musculus
tctggcagctcacctgccggcgagc

SEQ ID NO: 431676 - DNA, 25 bp, Mus musculus
aagacgcgactgaccgcgtggcccg

SEQ ID NO: 431677 - DNA, 25 bp, Mus musculus
gggcccttttgaaagacgcgactga

SEQ ID NO: 431678 - DNA, 25 bp, Mus musculus
cagggtcagctcgaggggccctttt

SEQ ID NO: 431679 - DNA, 25 bp, Mus musculus
ctcctcagggtcagctcgaggggcc

SEQ ID NO: 431680 - DNA, 25 bp, Mus musculus
cgaaggtccttgctgattggacgag

SEQ ID NO: 431681 - DNA, 25 bp, Mus musculus
ccagagcgaaggtccttgctgattg

SEQ ID NO: 431682 - DNA, 25 bp, Mus musculus
cggagccagagcgaaggtccttgct

SEQ ID NO: 431683 - DNA, 25 bp, Mus musculus
acacacgcagcccacgcgcataggg

SEQ ID NO: 431684 - DNA, 25 bp, Mus musculus
gacccaggcccagctacacacgcag

SEQ ID NO: 431685 - DNA, 25 bp, Mus musculus
cagcgcagcaatggcgaccgcgggc

SEQ ID NO: 431686 - DNA, 25 bp, Mus musculus
ggccaacagccctgcggccttccgg

SEQ ID NO: 431687 - DNA, 25 bp, Mus musculus
tgcgcccaatggaaagacaagagag

SEQ ID NO: 431688 - DNA, 25 bp, Mus musculus
ggcgagtgctccgtcacgcgtgtcc

SEQ ID NO: 431689 - DNA, 25 bp, Mus musculus
tcgtggaccctaggggcaggaagcc

SEQ ID NO: 431690 - DNA, 25 bp, Mus musculus
tccggcgctgtgcagatccgcgcgt

SEQ ID NO: 431691 - DNA, 25 bp, Mus musculus
agagagctctgaccgcgctcaagca

SEQ ID NO: 431692 - DNA, 25 bp, Mus musculus
gacaagagagctctgaccgcgctca

SEQ ID NO: 431693 - DNA, 25 bp, Mus musculus
tgattgacgaccattgcgcccaatg

SEQ ID NO: 431694 - DNA, 25 bp, Mus musculus
ttccgtgattgacgaccattgcgcc

SEQ ID NO: 431695 - DNA, 25 bp, Mus musculus
gcccaccagcttccgtgattgacga

SEQ ID NO: 431696 - DNA, 25 bp, Mus musculus
gttgctatagcagcgctcagcgcgc

SEQ ID NO: 431697 - DNA, 25 bp, Mus musculus
caggcggttgctatagcagcgctca

SEQ ID NO: 431698 - DNA, 25 bp, Mus musculus
tcccgacaggcggttgctatagcag

SEQ ID NO: 431699 - DNA, 25 bp, Mus musculus
ttgctcccgacaggcggttgctata

SEQ ID NO: 431700 - DNA, 25 bp, Mus musculus
tgcatggtctagaccacactgctcc

SEQ ID NO: 431701 - DNA, 25 bp, Mus musculus
atcacctcgcttcccgcactgccgg

SEQ ID NO: 431702 - DNA, 25 bp, Mus musculus
gcgccgccttcccaccaggccactt

SEQ ID NO: 431703 - DNA, 25 bp, Mus musculus
cccaagcggctctactgcaagaacg

SEQ ID NO: 431704 - DNA, 25 bp, Mus musculus
aagcggctctactgcaagaacggcg

SEQ ID NO: 431705 - DNA, 25 bp, Mus musculus
agggccatggctgccagcggcatca

SEQ ID NO: 431706 - DNA, 25 bp, Mus musculus
ggacttgggacactaagacgcggcc

SEQ ID NO: 431707 - DNA, 25 bp, Mus musculus
acccgcgtgcatggtctagaccaca

SEQ ID NO: 431708 - DNA, 25 bp, Mus musculus
ttcccacccgcgtgcatggtctaga

SEQ ID NO: 431709 - DNA, 25 bp, Mus musculus
gacccacacggtgagttgccacttc

SEQ ID NO: 431710 - DNA, 25 bp, Mus musculus
gaagagcgacccacacggtgagttg

SEQ ID NO: 431711 - DNA, 25 bp, Mus musculus
tcttcctgcgcatccatcccgacgg

SEQ ID NO: 431712 - DNA, 25 bp, Mus musculus
gcgtccgcgagaagagcgacccaca

SEQ ID NO: 431713 - DNA, 25 bp, Mus musculus
caagaacggcggcttcttcctgcgc

SEQ ID NO: 431714 - DNA, 25 bp, Mus musculus
cttgagctggacttgccatttggta

SEQ ID NO: 431715 - DNA, 25 bp, Mus musculus
aacgtgtctccacccgctaagcttg

SEQ ID NO: 431716 - DNA, 25 bp, Mus musculus
cttctacgcggagcattacggcgtg

SEQ ID NO: 431717 - DNA, 25 bp, Mus musculus
gactgtcctcgacgggtctggaaca

SEQ ID NO: 431718 - DNA, 25 bp, Mus musculus
gcggaacagccgaagtccacttttc

SEQ ID NO: 431719 - DNA, 25 bp, Mus musculus
gacgtagcatctcttccctgtcgca

SEQ ID NO: 431720 - DNA, 25 bp, Mus musculus
ttcataacgtcaacggcggtgccta

SEQ ID NO: 431721 - DNA, 25 bp, Mus musculus
acgccagacgtagcctggtctcatc

SEQ ID NO: 431722 - DNA, 25 bp, Mus musculus
tggtggtgaccaacttccttgagaa

SEQ ID NO: 431723 - DNA, 25 bp, Mus musculus
cctgcggtcatgtcttccaagaaga

SEQ ID NO: 431724 - DNA, 25 bp, Mus musculus
atggctgcacctagcctttccgttc

SEQ ID NO: 431725 - DNA, 25 bp, Mus musculus
aaacggtgtcttgcgagaccctcgc

SEQ ID NO: 431726 - DNA, 25 bp, Mus musculus
tgcttttctccgacagcctgcggtc

SEQ ID NO: 431727 - DNA, 25 bp, Mus musculus
tgacgtagccttgtctcctccaggg

SEQ ID NO: 431728 - DNA, 25 bp, Mus musculus
atagctggcgctcttgctcttcccg

SEQ ID NO: 431729 - DNA, 25 bp, Mus musculus
ccgaaagccgccttggcccaatgta

SEQ ID NO: 431730 - DNA, 25 bp, Mus musculus
gaaagccgccttggcccaatgtagg

SEQ ID NO: 431731 - DNA, 25 bp, Mus musculus
aagccgccttggcccaatgtaggtg

SEQ ID NO: 431732 - DNA, 25 bp, Mus musculus
aaggtggagctcgagcgtatgcttt

SEQ ID NO: 431733 - DNA, 25 bp, Mus musculus
ggacccgaaagatagtgaagtatgg

SEQ ID NO: 431734 - DNA, 25 bp, Mus musculus
cccgaaagatagtgaagtatggctg

SEQ ID NO: 431735 - DNA, 25 bp, Mus musculus
tccgaaagccgccttggcccaatgt

SEQ ID NO: 431736 - DNA, 25 bp, Mus musculus
tcttcccgatacacgcagttttatc

SEQ ID NO: 431737 - DNA, 25 bp, Mus musculus
agctggcgctcttgctcttcccgat

SEQ ID NO: 431738 - DNA, 25 bp, Mus musculus
tggcgctcttgctcttcccgataca

SEQ ID NO: 431739 - DNA, 25 bp, Mus musculus
cttgctcttcccgatacacgcagtt

SEQ ID NO: 431740 - DNA, 25 bp, Mus musculus
gctcttcccgatacacgcagtttta

SEQ ID NO: 431741 - DNA, 25 bp, Mus musculus
aaagatagtgaagtatggctgggca

SEQ ID NO: 431742 - DNA, 25 bp, Mus musculus
ctgcaaaccagtgacgcaaactgtc

SEQ ID NO: 431743 - DNA, 25 bp, Mus musculus
ttaggagccgccagcctacgtgcag

SEQ ID NO: 431744 - DNA, 25 bp, Mus musculus
tgtctcacggagaacctcatcaagc

SEQ ID NO: 431745 - DNA, 25 bp, Mus musculus
tgacgcaaactgtctcacggagaac

SEQ ID NO: 431746 - DNA, 25 bp, Mus musculus
gcgctaactgcaaaccagtgacgca

SEQ ID NO: 431747 - DNA, 25 bp, Mus musculus
tgccagcgctaactgcaaaccagtg

SEQ ID NO: 431748 - DNA, 25 bp, Mus musculus
gtctgccttgccagcgctaactgca

SEQ ID NO: 431749 - DNA, 25 bp, Mus musculus
ggtgtctgccttgccagcgctaact

SEQ ID NO: 431750 - DNA, 25 bp, Mus musculus
ctggggaacgcagcccttcccggtg

SEQ ID NO: 431751 - DNA, 25 bp, Mus musculus
cagcgactggggaacgcagcccttc

SEQ ID NO: 431752 - DNA, 25 bp, Mus musculus
ctacgtgcagcgactggggaacgca

SEQ ID NO: 431753 - DNA, 25 bp, Mus musculus
agcctacgtgcagcgactggggaac

SEQ ID NO: 431754 - DNA, 25 bp, Mus musculus
cgccagcctacgtgcagcgactggg

SEQ ID NO: 431755 - DNA, 25 bp, Mus musculus
gcaaactgtctcacggagaacctca

SEQ ID NO: 431756 - DNA, 25 bp, Mus musculus
tattttcgaggagctggacgttttc

SEQ ID NO: 431757 - DNA, 25 bp, Mus musculus
ctctgcactaggtaagagccttccc

SEQ ID NO: 431758 - DNA, 25 bp, Mus musculus
caggtgagaatggtgctttatttta

SEQ ID NO: 431759 - DNA, 25 bp, Mus musculus
ggacgttttcggagctggctctagc

SEQ ID NO: 431760 - DNA, 25 bp, Mus musculus
gctctagctctgtgcccggcgcttt

SEQ ID NO: 431761 - DNA, 25 bp, Mus musculus
ggccctgcagcgagttccgtagcca

SEQ ID NO: 431762 - DNA, 25 bp, Mus musculus
tccgtagccaggcagcgagttacgc

SEQ ID NO: 431763 - DNA, 25 bp, Mus musculus
gcgctcgtgccagacctgacttttc

SEQ ID NO: 431764 - DNA, 25 bp, Mus musculus
tgacttttcccgtccctgcgtgcgg

SEQ ID NO: 431765 - DNA, 25 bp, Mus musculus
gcgtctctcggacgcgctttggact

SEQ ID NO: 431766 - DNA, 25 bp, Mus musculus
tccatctcggcgagcaggacagcgt

SEQ ID NO: 431767 - DNA, 25 bp, Mus musculus
tggcaagggactcacgtgtttctgt

SEQ ID NO: 431768 - DNA, 25 bp, Mus musculus
gtgtttctgtctctgctcgtctgca

SEQ ID NO: 431769 - DNA, 25 bp, Mus musculus
ccgccgaggacctggcaagatcagg

SEQ ID NO: 431770 - DNA, 25 bp, Mus musculus
aagctcacgatgtctgtggcggggc

SEQ ID NO: 431771 - DNA, 25 bp, Mus musculus
ctttgtggcgcccggacacgcagca

SEQ ID NO: 431772 - DNA, 25 bp, Mus musculus
cgcccggacacgcagcaggggtgac

SEQ ID NO: 431773 - DNA, 25 bp, Mus musculus
ccggacacgcagcaggggtgaccgc

SEQ ID NO: 431774 - DNA, 25 bp, Mus musculus
gacacgcagcaggggtgaccgcctc

SEQ ID NO: 431775 - DNA, 25 bp, Mus musculus
tctgtggcggggctttgtggcgccc

SEQ ID NO: 431776 - DNA, 25 bp, Mus musculus
gcagcaggggtgaccgcctccgccc

SEQ ID NO: 431777 - DNA, 25 bp, Mus musculus
ccggggcagtgtcgcctggcatctc

SEQ ID NO: 431778 - DNA, 25 bp, Mus musculus
gggcagtgtcgcctggcatctcgca

SEQ ID NO: 431779 - DNA, 25 bp, Mus musculus
ggcagtgtcgcctggcatctcgcaa

SEQ ID NO: 431780 - DNA, 25 bp, Mus musculus
gcagtgtcgcctggcatctcgcaat

SEQ ID NO: 431781 - DNA, 25 bp, Mus musculus
gccacctagcgcctacccgggcata

SEQ ID NO: 431782 - DNA, 25 bp, Mus musculus
cacctagcgcctacccgggcataga

SEQ ID NO: 431783 - DNA, 25 bp, Mus musculus
acctagcgcctacccgggcatagac

SEQ ID NO: 431784 - DNA, 25 bp, Mus musculus
tcatggttcgacctcgtggtgcggc

SEQ ID NO: 431785 - DNA, 25 bp, Mus musculus
ttctttgtctttgggcgagagtgcc

SEQ ID NO: 431786 - DNA, 25 bp, Mus musculus
ctgcaagtttgctgcggtctttttt

SEQ ID NO: 431787 - DNA, 25 bp, Mus musculus
gagcgtgctgctgcaagtttgctgc

SEQ ID NO: 431788 - DNA, 25 bp, Mus musculus
ttatttgtctttgagcgagcgagcg

SEQ ID NO: 431789 - DNA, 25 bp, Mus musculus
gtcagcggccatcttctcctcttta

SEQ ID NO: 431790 - DNA, 25 bp, Mus musculus
gtgcagcgagcatgagacaagcgtc

SEQ ID NO: 431791 - DNA, 25 bp, Mus musculus
tgtccatcctggtaatcgaggtttt

SEQ ID NO: 431792 - DNA, 25 bp, Mus musculus
tctttgtcttttctgtctgtccatc

SEQ ID NO: 431793 - DNA, 25 bp, Mus musculus
gagcgcgtggacctcacttctgtct

SEQ ID NO: 431794 - DNA, 25 bp, Mus musculus
atgttttatgttgtgggtcgcgtga

SEQ ID NO: 431795 - DNA, 25 bp, Mus musculus
tgagttggccctttgatgttttatg

SEQ ID NO: 431796 - DNA, 25 bp, Mus musculus
ctgttgtgtcccttcggtgttttct

SEQ ID NO: 431797 - DNA, 25 bp, Mus musculus
cgagagtgccgcgataagcataagg

SEQ ID NO: 431798 - DNA, 25 bp, Mus musculus
tcggtgtgatcgacatctgctcctc

SEQ ID NO: 431799 - DNA, 25 bp, Mus musculus
ctgccgtccacgtcctcgtggttta

SEQ ID NO: 431800 - DNA, 25 bp, Mus musculus
cgctgtcgatgctgtccacggctgc

SEQ ID NO: 431801 - DNA, 25 bp, Mus musculus
cccagaacagaagcgtgttgaccac

SEQ ID NO: 431802 - DNA, 25 bp, Mus musculus
gcgtgttgaccacggacgcatgccc

SEQ ID NO: 431803 - DNA, 25 bp, Mus musculus
cgtccgcccgttgttatcggtgtga

SEQ ID NO: 431804 - DNA, 25 bp, Mus musculus
tctgctcctccttctagcagcaggt

SEQ ID NO: 431805 - DNA, 25 bp, Mus musculus
gggtcatgccatccttgtcacagtg

SEQ ID NO: 431806 - DNA, 25 bp, Mus musculus
ccttgtcacagtgatctacctcagc

SEQ ID NO: 431807 - DNA, 25 bp, Mus musculus
ctcgatcaatcaggaggctcacgac

SEQ ID NO: 431808 - DNA, 25 bp, Mus musculus
gctcacgactgacgcgtgccctttg

SEQ ID NO: 431809 - DNA, 25 bp, Mus musculus
gccctttgcttgcaggcacacagag

SEQ ID NO: 431810 - DNA, 25 bp, Mus musculus
acatgaccttcgtaggcggccacca

SEQ ID NO: 431811 - DNA, 25 bp, Mus musculus
caggcacacagagcgcggccacgga

SEQ ID NO: 431812 - DNA, 25 bp, Mus musculus
tcgttctttgttctccaggctccgc

SEQ ID NO: 431813 - DNA, 25 bp, Mus musculus
tgcttctctaggaaggcgactcaga

SEQ ID NO: 431814 - DNA, 25 bp, Mus musculus
agctaaacttcatcgggctccgtgc

SEQ ID NO: 431815 - DNA, 25 bp, Mus musculus
tccctgggcttttccgagaaagcta

SEQ ID NO: 431816 - DNA, 25 bp, Mus musculus
caatctcggcttcgtggccgctttg

SEQ ID NO: 431817 - DNA, 25 bp, Mus musculus
cacccgtatagagccgggtcgctgt

SEQ ID NO: 431818 - DNA, 25 bp, Mus musculus
gcaggtcctgcccaatcgttctttg

SEQ ID NO: 431819 - DNA, 25 bp, Mus musculus
actctattggctcgcctctcgcagg

SEQ ID NO: 431820 - DNA, 25 bp, Mus musculus
tcctataggtcacgtcccgcataga

SEQ ID NO: 431821 - DNA, 25 bp, Mus musculus
gcaaagactgtctcagccggagcca

SEQ ID NO: 431822 - DNA, 25 bp, Mus musculus
ggaatccaaagagggtctgacccgc

SEQ ID NO: 431823 - DNA, 25 bp, Mus musculus
ccgctcagctgacagacaaaggctc

SEQ ID NO: 431824 - DNA, 25 bp, Mus musculus
aaaggctcggaacgaggtgctgccc

SEQ ID NO: 431825 - DNA, 25 bp, Mus musculus
ctcaggcccaggaggacgcctgctt

SEQ ID NO: 431826 - DNA, 25 bp, Mus musculus
ctcttctgaactgcagaggtctctg

SEQ ID NO: 431827 - DNA, 25 bp, Mus musculus
cccgcgctcagtggacttacaaatg

SEQ ID NO: 431828 - DNA, 25 bp, Mus musculus
tggctttacctatcgtctcagtgaa

SEQ ID NO: 431829 - DNA, 25 bp, Mus musculus
ctctgtgccagctcctgagagtctg

SEQ ID NO: 431830 - DNA, 25 bp, Mus musculus
aggaccatgaacttggccgcaaacc

SEQ ID NO: 431831 - DNA, 25 bp, Mus musculus
ggtctctggccaaactggcttttta

SEQ ID NO: 431832 - DNA, 25 bp, Mus musculus
tagagccttctccagagcgcctgtc

SEQ ID NO: 431833 - DNA, 25 bp, Mus musculus
actctcttctgcgttgcgcgactta

SEQ ID NO: 431834 - DNA, 25 bp, Mus musculus
gtctagaggcctggaaactttcacc

SEQ ID NO: 431835 - DNA, 25 bp, Mus musculus
caggacgctcagacttgggatttca

SEQ ID NO: 431836 - DNA, 25 bp, Mus musculus
agagtcttcgcagctagcttcgggc

SEQ ID NO: 431837 - DNA, 25 bp, Mus musculus
ggctcgcccggaacgaaaccagaga

SEQ ID NO: 431838 - DNA, 25 bp, Mus musculus
gacttacaaatgatgccggcgcgga

SEQ ID NO: 431839 - DNA, 25 bp, Mus musculus
tggcgccactcagaagtcttccaga

SEQ ID NO: 431840 - DNA, 25 bp, Mus musculus
tccatcagaacctcagccgagctgg

SEQ ID NO: 431841 - DNA, 25 bp, Mus musculus
gacaccggtgtccaaagctggggcc

SEQ ID NO: 431842 - DNA, 25 bp, Mus musculus
cctaaggtcggcaaactctgggtga

SEQ ID NO: 431843 - DNA, 25 bp, Mus musculus
tctcggggacgtccagcacagagag

SEQ ID NO: 431844 - DNA, 25 bp, Mus musculus
cagagcgtccacctgccaggactga

SEQ ID NO: 431845 - DNA, 25 bp, Mus musculus
acctgccaggactgagcgatcgctc

SEQ ID NO: 431846 - DNA, 25 bp, Mus musculus
cgggcgatcccagggcatacggacc

SEQ ID NO: 431847 - DNA, 25 bp, Mus musculus
ggcatacggacccacggtgacactc

SEQ ID NO: 431848 - DNA, 25 bp, Mus musculus
cacggtgacactcggacatttgtgt

SEQ ID NO: 431849 - DNA, 25 bp, Mus musculus
gcgcgtcctgctacacaggtcagtg

SEQ ID NO: 431850 - DNA, 25 bp, Mus musculus
gacatttgtgtcctccatcagaacc

SEQ ID NO: 431851 - DNA, 25 bp, Mus musculus
aggcggctccctacaggaatgtttc

SEQ ID NO: 431852 - DNA, 25 bp, Mus musculus
ccgcaacctggaggacctggactcg

SEQ ID NO: 431853 - DNA, 25 bp, Mus musculus
acctggactcggtgcagcgcgtcct

SEQ ID NO: 431854 - DNA, 25 bp, Mus musculus
agccaatcgcaactgagtatcgggg

SEQ ID NO: 431855 - DNA, 25 bp, Mus musculus
actcctcagccagcagtgacacgta

SEQ ID NO: 431856 - DNA, 25 bp, Mus musculus
gtcacgtggcccgacctggcaaaat

SEQ ID NO: 431857 - DNA, 25 bp, Mus musculus
tgcccttgctcgcacgcacggggag

SEQ ID NO: 431858 - DNA, 25 bp, Mus musculus
ccagcagtgacacgtaaggctcctg

SEQ ID NO: 431859 - DNA, 25 bp, Mus musculus
agcagcttgggctcctactcctcag

SEQ ID NO: 431860 - DNA, 25 bp, Mus musculus
gggccagcagcttgggctcctactc

SEQ ID NO: 431861 - DNA, 25 bp, Mus musculus
aaggcgactccgacgccggggccag

SEQ ID NO: 431862 - DNA, 25 bp, Mus musculus
gagctctcgcgacccagaggatggc

SEQ ID NO: 431863 - DNA, 25 bp, Mus musculus
gcgtctgagcttctgccccggagct

SEQ ID NO: 431864 - DNA, 25 bp, Mus musculus
acgtggcccgacctggcaaaatggc

SEQ ID NO: 431865 - DNA, 25 bp, Mus musculus
cgcaactgagtatcggggtcacgtg

SEQ ID NO: 431866 - DNA, 25 bp, Mus musculus
ggcaaccggcgcctcagccaatcgc

SEQ ID NO: 431867 - DNA, 25 bp, Mus musculus
agtgacacgtaaggctcctggagac

SEQ ID NO: 431868 - DNA, 25 bp, Mus musculus
gcaggcgtcctccaagcagataagc

SEQ ID NO: 431869 - DNA, 25 bp, Mus musculus
cagataagccctgaggcgcgctaca

SEQ ID NO: 431870 - DNA, 25 bp, Mus musculus
cctctgcaaaagctgctgtgcactg

SEQ ID NO: 431871 - DNA, 25 bp, Mus musculus
cccatcgagcgtgtgaagctgctgc

SEQ ID NO: 431872 - DNA, 25 bp, Mus musculus
gatccggtgtctttctcgaaggacc

SEQ ID NO: 431873 - DNA, 25 bp, Mus musculus
caaagaaggcgctgttcgatccggt

SEQ ID NO: 431874 - DNA, 25 bp, Mus musculus
tcgaacgaatcctccaagaagcagt

SEQ ID NO: 431875 - DNA, 25 bp, Mus musculus
ccggtcctctgtccaacatgtcgaa

SEQ ID NO: 431876 - DNA, 25 bp, Mus musculus
cctggtgcgcattcctcgtgagcaa

SEQ ID NO: 431877 - DNA, 25 bp, Mus musculus
ttccagttctcctcagtgtcgcttg

SEQ ID NO: 431878 - DNA, 25 bp, Mus musculus
aagctgaagcggttttccagttctc

SEQ ID NO: 431879 - DNA, 25 bp, Mus musculus
tttcccgccagggtaaagctgaagc

SEQ ID NO: 431880 - DNA, 25 bp, Mus musculus
tgcgcaactggaaacacgtgttatg

SEQ ID NO: 431881 - DNA, 25 bp, Mus musculus
tgcactgattgagcatgcgcaactg

SEQ ID NO: 431882 - DNA, 25 bp, Mus musculus
ggtgagatcccaggctgtggctctc

SEQ ID NO: 431883 - DNA, 25 bp, Mus musculus
gcgacaggtgcacgccgtaagtgcc

SEQ ID NO: 431884 - DNA, 25 bp, Mus musculus
tcgccaacgagtacagcgacaggtg

SEQ ID NO: 431885 - DNA, 25 bp, Mus musculus
ggcttcctcaactgctacatcgctg

SEQ ID NO: 431886 - DNA, 25 bp, Mus musculus
tgggcattgacctcggcttcctcaa

SEQ ID NO: 431887 - DNA, 25 bp, Mus musculus
cagcccgagccttaagcgggatgtc

SEQ ID NO: 431888 - DNA, 25 bp, Mus musculus
gggtcctctcctttgcttctcgcag

SEQ ID NO: 431889 - DNA, 25 bp, Mus musculus
tttccgatagagagtgggtcctctc

SEQ ID NO: 431890 - DNA, 25 bp, Mus musculus
cctgccctagattttccgatagaga

SEQ ID NO: 431891 - DNA, 25 bp, Mus musculus
aggcgcagaccgcagtaactgccgg

SEQ ID NO: 431892 - DNA, 25 bp, Mus musculus
cagcgagccgttgccgagcgctgac

SEQ ID NO: 431893 - DNA, 25 bp, Mus musculus
tctttccagctctttctcgaacctg

SEQ ID NO: 431894 - DNA, 25 bp, Mus musculus
ccctgtgacaggtgcagcgtctaca

SEQ ID NO: 431895 - DNA, 25 bp, Mus musculus
cttagaagagcgtccgcgagacacc

SEQ ID NO: 431896 - DNA, 25 bp, Mus musculus
cgtaacctattattagcgtccgcgc

SEQ ID NO: 431897 - DNA, 25 bp, Mus musculus
cagtctggctcaggcgctcactggt

SEQ ID NO: 431898 - DNA, 25 bp, Mus musculus
cacacgggagaccagacgggttagc

SEQ ID NO: 431899 - DNA, 25 bp, Mus musculus
ggtccattgtggctcggcacaaaca

SEQ ID NO: 431900 - DNA, 25 bp, Mus musculus
gacccagtgagctgaggtgaaccga

SEQ ID NO: 431901 - DNA, 25 bp, Mus musculus
gcggactctggtattccgggaccca

SEQ ID NO: 431902 - DNA, 25 bp, Mus musculus
aagacctgctggcttctcggagcgc

SEQ ID NO: 431903 - DNA, 25 bp, Mus musculus
aggcgtcctgatgggcgccaagacc

SEQ ID NO: 431904 - DNA, 25 bp, Mus musculus
aagtggagagtgtgctgacgtcacc

SEQ ID NO: 431905 - DNA, 25 bp, Mus musculus
tcggtctccgcctctaagaagtgga

SEQ ID NO: 431906 - DNA, 25 bp, Mus musculus
cacttccggcctagagcgagggaaa

SEQ ID NO: 431907 - DNA, 25 bp, Mus musculus
agtcgtacactgaccgctttccgtc

SEQ ID NO: 431908 - DNA, 25 bp, Mus musculus
tccgcgctacggtcagtcgtacact

SEQ ID NO: 431909 - DNA, 25 bp, Mus musculus
ctcagtgacactagtaaagcgggga

SEQ ID NO: 431910 - DNA, 25 bp, Mus musculus
caagactcaggcagggacaatgaga

SEQ ID NO: 431911 - DNA, 25 bp, Mus musculus
ggggctccgctgaggctgccgctgc

SEQ ID NO: 431912 - DNA, 25 bp, Mus musculus
cgccgcccgcgtgactgtcaccggt

SEQ ID NO: 431913 - DNA, 25 bp, Mus musculus
tgactgtcaccggtcacgcggcaag

SEQ ID NO: 431914 - DNA, 25 bp, Mus musculus
actgtcaccggtcacgcggcaagac

SEQ ID NO: 431915 - DNA, 25 bp, Mus musculus
tgtcaccggtcacgcggcaagactc

SEQ ID NO: 431916 - DNA, 25 bp, Mus musculus
ccggtcacgcggcaagactcaggca

SEQ ID NO: 431917 - DNA, 25 bp, Mus musculus
tcacgcggcaagactcaggcaggga

SEQ ID NO: 431918 - DNA, 25 bp, Mus musculus
cgcggcaagactcaggcagggacaa

SEQ ID NO: 431919 - DNA, 25 bp, Mus musculus
cggcaagactcaggcagggacaatg

SEQ ID NO: 431920 - DNA, 25 bp, Mus musculus
ctcaggcagggacaatgagaaaagc

SEQ ID NO: 431921 - DNA, 25 bp, Mus musculus
acaatgagaaaagccagcgggagcc

SEQ ID NO: 431922 - DNA, 25 bp, Mus musculus
caggcagggacaatgagaaaagcca

SEQ ID NO: 431923 - DNA, 25 bp, Mus musculus
aatgagaaaagccagcgggagccgc

SEQ ID NO: 431924 - DNA, 25 bp, Mus musculus
cgccgcctccaccattgtataatgt

SEQ ID NO: 431925 - DNA, 25 bp, Mus musculus
cgatgcgttagctcctggtggacct

SEQ ID NO: 431926 - DNA, 25 bp, Mus musculus
cccgcatggagcgggcatagcttga

SEQ ID NO: 431927 - DNA, 25 bp, Mus musculus
cagaggacgccggagtcgtagctcc

SEQ ID NO: 431928 - DNA, 25 bp, Mus musculus
ttcccgactcgcaagcagaggacgc

SEQ ID NO: 431929 - DNA, 25 bp, Mus musculus
caggggcccggagcttttgccgtca

SEQ ID NO: 431930 - DNA, 25 bp, Mus musculus
gggcctacggagatctggacctgaa

SEQ ID NO: 431931 - DNA, 25 bp, Mus musculus
cagaggctcgcaggcggacgtcact

SEQ ID NO: 431932 - DNA, 25 bp, Mus musculus
cttttgccgtcacagctggtgtgtg

SEQ ID NO: 431933 - DNA, 25 bp, Mus musculus
gagcacgagctgtacctctctcggc

SEQ ID NO: 431934 - DNA, 25 bp, Mus musculus
tggagaccccgactgtcacgacctg

SEQ ID NO: 431935 - DNA, 25 bp, Mus musculus
cattgtataatgttcccgactcgca

SEQ ID NO: 431936 - DNA, 25 bp, Mus musculus
gctggagcacgagctgtacctctct

SEQ ID NO: 431937 - DNA, 25 bp, Mus musculus
ctccgatgcgttagctcctggtgga

SEQ ID NO: 431938 - DNA, 25 bp, Mus musculus
aggacgtcctccctgtcaggctggc

SEQ ID NO: 431939 - DNA, 25 bp, Mus musculus
tttcgggtccggacagtggactcac

SEQ ID NO: 431940 - DNA, 25 bp, Mus musculus
agtggactcactgttcccagctagt

SEQ ID NO: 431941 - DNA, 25 bp, Mus musculus
tcacttcccaggttcgccataattc

SEQ ID NO: 431942 - DNA, 25 bp, Mus musculus
ggttcgccataattccagctctcgc

SEQ ID NO: 431943 - DNA, 25 bp, Mus musculus
gcccggagctgtcaaaacactccta

SEQ ID NO: 431944 - DNA, 25 bp, Mus musculus
tccctgtcaggctggctggcagctc

SEQ ID NO: 431945 - DNA, 25 bp, Mus musculus
ctggcagctcgcctgctgttttgta

SEQ ID NO: 431946 - DNA, 25 bp, Mus musculus
tgctgttttgtacctgagcagattc

SEQ ID NO: 431947 - DNA, 25 bp, Mus musculus
tgagcagattcagctctctgctgtc

SEQ ID NO: 431948 - DNA, 25 bp, Mus musculus
ctctgctgtccgagctgaggcgaaa

SEQ ID NO: 431949 - DNA, 25 bp, Mus musculus
aagtccggtgccttaagcgtggaga

SEQ ID NO: 431950 - DNA, 25 bp, Mus musculus
cccttcaggtgtgcctcggcgagcg

SEQ ID NO: 431951 - DNA, 25 bp, Mus musculus
aattccagctctcgctaggcggcgc

SEQ ID NO: 431952 - DNA, 25 bp, Mus musculus
tcgtctgcgtacgtgcaaggcgaca

SEQ ID NO: 431953 - DNA, 25 bp, Mus musculus
gcgtacgtgcaaggcgacaggaagg

SEQ ID NO: 431954 - DNA, 25 bp, Mus musculus
tgcgtacgtgcaaggcgacaggaag

SEQ ID NO: 431955 - DNA, 25 bp, Mus musculus
ctgcgtacgtgcaaggcgacaggaa

SEQ ID NO: 431956 - DNA, 25 bp, Mus musculus
cgtctgcgtacgtgcaaggcgacag

SEQ ID NO: 431957 - DNA, 25 bp, Mus musculus
gtcgtctgcgtacgtgcaaggcgac

SEQ ID NO: 431958 - DNA, 25 bp, Mus musculus
tgtcgtctgcgtacgtgcaaggcga

SEQ ID NO: 431959 - DNA, 25 bp, Mus musculus
taagggaagtgtgaagcgtgtgggc

SEQ ID NO: 431960 - DNA, 25 bp, Mus musculus
cctaagggaagtgtgaagcgtgtgg

SEQ ID NO: 431961 - DNA, 25 bp, Mus musculus
agcctaagggaagtgtgaagcgtgt

SEQ ID NO: 431962 - DNA, 25 bp, Mus musculus
cagcctaagggaagtgtgaagcgtg

SEQ ID NO: 431963 - DNA, 25 bp, Mus musculus
gcagcctaagggaagtgtgaagcgt

SEQ ID NO: 431964 - DNA, 25 bp, Mus musculus
ggcagcctaagggaagtgtgaagcg

SEQ ID NO: 431965 - DNA, 25 bp, Mus musculus
tctgcgtacgtgcaaggcgacagga

SEQ ID NO: 431966 - DNA, 25 bp, Mus musculus
cgcagctcgccagagatccttcaga

SEQ ID NO: 431967 - DNA, 25 bp, Mus musculus
tcgccggcgctcgtgctgggacaca

SEQ ID NO: 431968 - DNA, 25 bp, Mus musculus
gcacgcccagcccatcggcccgcct

SEQ ID NO: 431969 - DNA, 25 bp, Mus musculus
gccctcagggacagttaccggctca

SEQ ID NO: 431970 - DNA, 25 bp, Mus musculus
gaacccgtggaccaagaagctgccg

SEQ ID NO: 431971 - DNA, 25 bp, Mus musculus
tgctgggacacagcgtgccgcaagc

SEQ ID NO: 431972 - DNA, 25 bp, Mus musculus
cccgtggaccaagaagctgccgcag

SEQ ID NO: 431973 - DNA, 25 bp, Mus musculus
acgcgctgttggcagcgacgagccg

SEQ ID NO: 431974 - DNA, 25 bp, Mus musculus
tcccaggaccgaagcgggtcggtgc

SEQ ID NO: 431975 - DNA, 25 bp, Mus musculus
ttcagactggctggagcgccgcgtt

SEQ ID NO: 431976 - DNA, 25 bp, Mus musculus
atccttcagactggctggagcgccg

SEQ ID NO: 431977 - DNA, 25 bp, Mus musculus
agagatccttcagactggctggagc

SEQ ID NO: 431978 - DNA, 25 bp, Mus musculus
cagggacagttaccggctcaggccg

SEQ ID NO: 431979 - DNA, 25 bp, Mus musculus
ctgcacctggcgcacaaggcgcgtg

SEQ ID NO: 431980 - DNA, 25 bp, Mus musculus
ctgcttattggctgttggctgggta

SEQ ID NO: 431981 - DNA, 25 bp, Mus musculus
tttggtcacgtcgaagactttccca

SEQ ID NO: 431982 - DNA, 25 bp, Mus musculus
gactttcccattgaccgcgagcagg

SEQ ID NO: 431983 - DNA, 25 bp, Mus musculus
tccaggctgaagtcccgcttcttca

SEQ ID NO: 431984 - DNA, 25 bp, Mus musculus
ccgcttcttcatgcgcggcagcgtg

SEQ ID NO: 431985 - DNA, 25 bp, Mus musculus
gcggcgctcagccaatcacgtgagg

SEQ ID NO: 431986 - DNA, 25 bp, Mus musculus
ggtaacgttgtctggcttcgctctc

SEQ ID NO: 431987 - DNA, 25 bp, Mus musculus
ccaacgctttcagcctggggagtgt

SEQ ID NO: 431988 - DNA, 25 bp, Mus musculus
tgtgcgcgtgcgtactcgcgcgtat

SEQ ID NO: 431989 - DNA, 25 bp, Mus musculus
ccacgcgctgggctctttttagcaa

SEQ ID NO: 431990 - DNA, 25 bp, Mus musculus
ggcttctctctgagacggctggttc

SEQ ID NO: 431991 - DNA, 25 bp, Mus musculus
cggggccgtagaacttgctgccttt

SEQ ID NO: 431992 - DNA, 25 bp, Mus musculus
gctggttcgcgtctgtgacgacgca

SEQ ID NO: 431993 - DNA, 25 bp, Mus musculus
gcgtgcgcccagaagcggcttctct

SEQ ID NO: 431994 - DNA, 25 bp, Mus musculus
tattattttcgatcggaggagggcg

SEQ ID NO: 431995 - DNA, 25 bp, Mus musculus
taatgccgaaggtcgctgcctagtg

SEQ ID NO: 431996 - DNA, 25 bp, Mus musculus
gtcgctgcctagtggaaataatata

SEQ ID NO: 431997 - DNA, 25 bp, Mus musculus
cctagtggaaataatatagtacgtc

SEQ ID NO: 431998 - DNA, 25 bp, Mus musculus
gcgccaaaagattgggctgtggatc

SEQ ID NO: 431999 - DNA, 25 bp, Mus musculus
aaagattgggctgtggatctgtagc

SEQ ID NO: 432000 - DNA, 25 bp, Mus musculus
ggcactatcccaccagcaacttggg

SEQ ID NO: 432001 - DNA, 25 bp, Mus musculus
ccgcggagcccgagaattgatcggt

SEQ ID NO: 432002 - DNA, 25 bp, Mus musculus
cggtgtcggatcagtaagttctatt

SEQ ID NO: 432003 - DNA, 25 bp, Mus musculus
tttgttgcttcgctcgggagttctc

SEQ ID NO: 432004 - DNA, 25 bp, Mus musculus
aggcccagcccgtgcgcagcaggta

SEQ ID NO: 432005 - DNA, 25 bp, Mus musculus
cgggagtaatgtaatgccgaaggtc

SEQ ID NO: 432006 - DNA, 25 bp, Mus musculus
ctcgggagttctcgggagtaatgta

SEQ ID NO: 432007 - DNA, 25 bp, Mus musculus
tcagtaagttctattccgattatta

SEQ ID NO: 432008 - DNA, 25 bp, Mus musculus
tggccactttcaaacgccgagggcg

SEQ ID NO: 432009 - DNA, 25 bp, Mus musculus
cttcctgtgacagaggtgatccaca

SEQ ID NO: 432010 - DNA, 25 bp, Mus musculus
gcgagggagcgtttgatttgcaact

SEQ ID NO: 432011 - DNA, 25 bp, Mus musculus
atgttgaccggagaaccgaatcctt

SEQ ID NO: 432012 - DNA, 25 bp, Mus musculus
gaggtgatccacagtttccagaact

SEQ ID NO: 432013 - DNA, 25 bp, Mus musculus
caggcgtttgtttgttgcttgcgcg

SEQ ID NO: 432014 - DNA, 25 bp, Mus musculus
aaggcggttccttgtcgctgcccga

SEQ ID NO: 432015 - DNA, 25 bp, Mus musculus
accggtaataggtgacctggcgctc

SEQ ID NO: 432016 - DNA, 25 bp, Mus musculus
gcgtttaaatagcagccgggctccc

SEQ ID NO: 432017 - DNA, 25 bp, Mus musculus
gtgcctcaacttccgcgggcgttta

SEQ ID NO: 432018 - DNA, 25 bp, Mus musculus
cgccgctgctgctcaaagtggcgga

SEQ ID NO: 432019 - DNA, 25 bp, Mus musculus
ggagaaattcgataccttccacctc

SEQ ID NO: 432020 - DNA, 25 bp, Mus musculus
acggtcccatttgctggagaaattc

SEQ ID NO: 432021 - DNA, 25 bp, Mus musculus
gtttgatttgcaactggggccgagc

SEQ ID NO: 432022 - DNA, 25 bp, Mus musculus
ggcgcggagacatcagcatcccact

SEQ ID NO: 432023 - DNA, 25 bp, Mus musculus
agcatcccactcacgcggcggcgca

SEQ ID NO: 432024 - DNA, 25 bp, Mus musculus
gcctcagactccgttccgcgctcgg

SEQ ID NO: 432025 - DNA, 25 bp, Mus musculus
agggcgccgagttcccgtcagaccg

SEQ ID NO: 432026 - DNA, 25 bp, Mus musculus
tcggcccgccctgcgactttgaaag

SEQ ID NO: 432027 - DNA, 25 bp, Mus musculus
cccagaccgttccttggagacggtg

SEQ ID NO: 432028 - DNA, 25 bp, Mus musculus
ccgttccttggagacggtgacgccg

SEQ ID NO: 432029 - DNA, 25 bp, Mus musculus
cgtccgtcatcacgcgtgcgtcggt

SEQ ID NO: 432030 - DNA, 25 bp, Mus musculus
tcacgcgtgcgtcggtaggcgtcat

SEQ ID NO: 432031 - DNA, 25 bp, Mus musculus
cggtaggcgtcattgcgccgtctca

SEQ ID NO: 432032 - DNA, 25 bp, Mus musculus
cattgcgccgtctcaggcgcaggca

SEQ ID NO: 432033 - DNA, 25 bp, Mus musculus
cgcaggcaggtgattggctatctgt

SEQ ID NO: 432034 - DNA, 25 bp, Mus musculus
caggtgattggctatctgtcaggcg

SEQ ID NO: 432035 - DNA, 25 bp, Mus musculus
ggatgaccctgcgacgcgcctggct

SEQ ID NO: 432036 - DNA, 25 bp, Mus musculus
atattgaggcgacgctgtgcaccct

SEQ ID NO: 432037 - DNA, 25 bp, Mus musculus
atatattgaggcgacgctgtgcacc

SEQ ID NO: 432038 - DNA, 25 bp, Mus musculus
tcgctggtcaccgactctggggctt

SEQ ID NO: 432039 - DNA, 25 bp, Mus musculus
ccgatatattgaggcgacgctgtgc

SEQ ID NO: 432040 - DNA, 25 bp, Mus musculus
cccgatatattgaggcgacgctgtg

SEQ ID NO: 432041 - DNA, 25 bp, Mus musculus
cacctcctggctcacgctctccagc

SEQ ID NO: 432042 - DNA, 25 bp, Mus musculus
ttgccacacctcctggctcacgctc

SEQ ID NO: 432043 - DNA, 25 bp, Mus musculus
ggggcttgccacacctcctggctca

SEQ ID NO: 432044 - DNA, 25 bp, Mus musculus
gactctggggcttgccacacctcct

SEQ ID NO: 432045 - DNA, 25 bp, Mus musculus
tatattgaggcgacgctgtgcaccc

SEQ ID NO: 432046 - DNA, 25 bp, Mus musculus
ggtcaccgactctggggcttgccac

SEQ ID NO: 432047 - DNA, 25 bp, Mus musculus
tggtcaccgactctggggcttgcca

SEQ ID NO: 432048 - DNA, 25 bp, Mus musculus
gctggtcaccgactctggggcttgc

SEQ ID NO: 432049 - DNA, 25 bp, Mus musculus
gtcaccgactctggggcttgccaca

SEQ ID NO: 432050 - DNA, 25 bp, Mus musculus
tttccagaaggcactgtagcgtacc

SEQ ID NO: 432051 - DNA, 25 bp, Mus musculus
atgtgcaaacgtgccggtggattcc

SEQ ID NO: 432052 - DNA, 25 bp, Mus musculus
accgaactcagcttgtggccagcca

SEQ ID NO: 432053 - DNA, 25 bp, Mus musculus
ctcccagcagcggagagttcgttcc

SEQ ID NO: 432054 - DNA, 25 bp, Mus musculus
gcgggcagcacgttgataagtatta

SEQ ID NO: 432055 - DNA, 25 bp, Mus musculus
aacaacctattccttgcgggcagca

SEQ ID NO: 432056 - DNA, 25 bp, Mus musculus
gggagtcattctagtctttggctta

SEQ ID NO: 432057 - DNA, 25 bp, Mus musculus
accgggaagcctctagggagtcatt

SEQ ID NO: 432058 - DNA, 25 bp, Mus musculus
cctgggtcattcattaccgggaagc

SEQ ID NO: 432059 - DNA, 25 bp, Mus musculus
cttcccttcggttgctgtagcgtta

SEQ ID NO: 432060 - DNA, 25 bp, Mus musculus
tggggacgcgcactcctaatttctt

SEQ ID NO: 432061 - DNA, 25 bp, Mus musculus
attcccgcagcggtgcacactctat

SEQ ID NO: 432062 - DNA, 25 bp, Mus musculus
ctgtagcgttactcctgggtcattc

SEQ ID NO: 432063 - DNA, 25 bp, Mus musculus
taaacacggactctcccgagtggtc

SEQ ID NO: 432064 - DNA, 25 bp, Mus musculus
ccaacgaacagtcgctcggtgggtg

SEQ ID NO: 432065 - DNA, 25 bp, Mus musculus
ccctgcaagcgcctcgggacctgcg

SEQ ID NO: 432066 - DNA, 25 bp, Mus musculus
gacctgcgggctgttcttgctctca

SEQ ID NO: 432067 - DNA, 25 bp, Mus musculus
ggctgttcttgctctcacactcaca

SEQ ID NO: 432068 - DNA, 25 bp, Mus musculus
gggcgctgcgcaaaaacagagaagc

SEQ ID NO: 432069 - DNA, 25 bp, Mus musculus
tgctcctcggcgattggttggcaga

SEQ ID NO: 432070 - DNA, 25 bp, Mus musculus
ttagccaacgaacagtcgctcggtg

SEQ ID NO: 432071 - DNA, 25 bp, Mus musculus
ggccactttagccaacgaacagtcg

SEQ ID NO: 432072 - DNA, 25 bp, Mus musculus
tgacggccactttagccaacgaaca

SEQ ID NO: 432073 - DNA, 25 bp, Mus musculus
gtaactacttgacggccactttagc

SEQ ID NO: 432074 - DNA, 25 bp, Mus musculus
gcgtgacgtaactacttgacggcca

SEQ ID NO: 432075 - DNA, 25 bp, Mus musculus
tcccgcagccaaagcgagcgttctg

SEQ ID NO: 432076 - DNA, 25 bp, Mus musculus
gctgccgcgtgacgtaactacttga

SEQ ID NO: 432077 - DNA, 25 bp, Mus musculus
cctcggcgattggttggcagaatga

SEQ ID NO: 432078 - DNA, 25 bp, Mus musculus
gccgtccgaactgttaggtgtttgc

SEQ ID NO: 432079 - DNA, 25 bp, Mus musculus
tttgatcgccggagtccagttaccc

SEQ ID NO: 432080 - DNA, 25 bp, Mus musculus
tcgagaatgcctctttaaatcccgc

SEQ ID NO: 432081 - DNA, 25 bp, Mus musculus
gttccgtcaattctgcgtcttcaag

SEQ ID NO: 432082 - DNA, 25 bp, Mus musculus
gcaagttctttgcagcccggcttta

SEQ ID NO: 432083 - DNA, 25 bp, Mus musculus
ctctcccggcctccggaggtttgat

SEQ ID NO: 432084 - DNA, 25 bp, Mus musculus
cgggatcttctactccaagttcgca

SEQ ID NO: 432085 - DNA, 25 bp, Mus musculus
ccagaggcggttacgaactcccagc

SEQ ID NO: 432086 - DNA, 25 bp, Mus musculus
cactttttaagagcccatctcgggg

SEQ ID NO: 432087 - DNA, 25 bp, Mus musculus
ccttaaaaataagcgatccgcggcg

SEQ ID NO: 432088 - DNA, 25 bp, Mus musculus
tttgctgtttgctccgtagtgctgc

SEQ ID NO: 432089 - DNA, 25 bp, Mus musculus
tgcccggcaacccaatcgagaatgc

SEQ ID NO: 432090 - DNA, 25 bp, Mus musculus
tcccataactgacggccttagagcc

SEQ ID NO: 432091 - DNA, 25 bp, Mus musculus
gctcctgccagggatactccagatc

SEQ ID NO: 432092 - DNA, 25 bp, Mus musculus
cggggatcgaggtacaagctttcaa

SEQ ID NO: 432093 - DNA, 25 bp, Mus musculus
tcgaggtacaagctttcaatccgta

SEQ ID NO: 432094 - DNA, 25 bp, Mus musculus
ctttcaatccgtagcacatggagtg

SEQ ID NO: 432095 - DNA, 25 bp, Mus musculus
agcacatggagtgcacgcatgcgtc

SEQ ID NO: 432096 - DNA, 25 bp, Mus musculus
cttactcagcgctgtaatgaggccg

SEQ ID NO: 432097 - DNA, 25 bp, Mus musculus
gttgctgcgcttaccgcttactcag

SEQ ID NO: 432098 - DNA, 25 bp, Mus musculus
gtcctcactgtgctgttgctgcgct

SEQ ID NO: 432099 - DNA, 25 bp, Mus musculus
acgcatgcgtccagtgcagcagtca

SEQ ID NO: 432100 - DNA, 25 bp, Mus musculus
agatccacttgtcctcactgtgctg

SEQ ID NO: 432101 - DNA, 25 bp, Mus musculus
ctgcagctgcgcatgcgttcctaga

SEQ ID NO: 432102 - DNA, 25 bp, Mus musculus
cacctactctcgtctcctttagggg

SEQ ID NO: 432103 - DNA, 25 bp, Mus musculus
gcgcacgagtgccatggcgccaaca

SEQ ID NO: 432104 - DNA, 25 bp, Mus musculus
tgcgtccagtgcagcagtcaatccc

SEQ ID NO: 432105 - DNA, 25 bp, Mus musculus
gcgcatgcgttcctagatccacttg

SEQ ID NO: 432106 - DNA, 25 bp, Mus musculus
gcccagtgtatcaggtgtatgtcca

SEQ ID NO: 432107 - DNA, 25 bp, Mus musculus
aacctctttcgactggactggcgca

SEQ ID NO: 432108 - DNA, 25 bp, Mus musculus
cctgcgcactgcaaggttctggtga

SEQ ID NO: 432109 - DNA, 25 bp, Mus musculus
ccgggtgcctacatttacgcggtga

SEQ ID NO: 432110 - DNA, 25 bp, Mus musculus
cgacgaaggggccaatgcaaaatta

SEQ ID NO: 432111 - DNA, 25 bp, Mus musculus
acgccctgagatccttcgactatga

SEQ ID NO: 432112 - DNA, 25 bp, Mus musculus
ggcaatgccacggtcaacatcttga

SEQ ID NO: 432113 - DNA, 25 bp, Mus musculus
tggggactcctacaccctgaccgtg

SEQ ID NO: 432114 - DNA, 25 bp, Mus musculus
tgcggggcaacgaaatgaacctctt

SEQ ID NO: 432115 - DNA, 25 bp, Mus musculus
tggctctgttcagcgtgaccgatcg

SEQ ID NO: 432116 - DNA, 25 bp, Mus musculus
tgtgaatgacaatgcgccgcgcttc

SEQ ID NO: 432117 - DNA, 25 bp, Mus musculus
cgcaccagagatcagcttcagcaca

SEQ ID NO: 432118 - DNA, 25 bp, Mus musculus
tccaccagtaagtcgatccaggttc

SEQ ID NO: 432119 - DNA, 25 bp, Mus musculus
ccagccggtctacgacgtgtatgtg

SEQ ID NO: 432120 - DNA, 25 bp, Mus musculus
cgcttcaagagcgactgtgactacg

SEQ ID NO: 432121 - DNA, 25 bp, Mus musculus
gctgccgcttgaactcgaagtccga

SEQ ID NO: 432122 - DNA, 25 bp, Mus musculus
ctgttccaggttgcgccgctctcgg

SEQ ID NO: 432123 - DNA, 25 bp, Mus musculus
ctgctcctgcgctttagatctcgct

SEQ ID NO: 432124 - DNA, 25 bp, Mus musculus
gcgctttagatctcgcttcaagagc

SEQ ID NO: 432125 - DNA, 25 bp, Mus musculus
tcaagagcgactgtgactacgcttc

SEQ ID NO: 432126 - DNA, 25 bp, Mus musculus
actgtgactacgcttcctgtgctga

SEQ ID NO: 432127 - DNA, 25 bp, Mus musculus
gactacgcttcctgtgctgattctc

SEQ ID NO: 432128 - DNA, 25 bp, Mus musculus
tgtgctgattctccttgtcccgttc

SEQ ID NO: 432129 - DNA, 25 bp, Mus musculus
gctgattctccttgtcccgttcttg

SEQ ID NO: 432130 - DNA, 25 bp, Mus musculus
cttgtcccgttcttgtttattctca

SEQ ID NO: 432131 - DNA, 25 bp, Mus musculus
tgtcccgttcttgtttattctcatt

SEQ ID NO: 432132 - DNA, 25 bp, Mus musculus
attgagctgccgcttgaactcgaag

SEQ ID NO: 432133 - DNA, 25 bp, Mus musculus
ctgcgctttagatctcgcttcaaga

SEQ ID NO: 432134 - DNA, 25 bp, Mus musculus
cgtgtgttgaatcgcttccagccaa

SEQ ID NO: 432135 - DNA, 25 bp, Mus musculus
gcttccaaatccgaagctgctggag

SEQ ID NO: 432136 - DNA, 25 bp, Mus musculus
gagcttccaaatccgaagctgctgg

SEQ ID NO: 432137 - DNA, 25 bp, Mus musculus
cgagcttccaaatccgaagctgctg

SEQ ID NO: 432138 - DNA, 25 bp, Mus musculus
agcgagcttccaaatccgaagctgc

SEQ ID NO: 432139 - DNA, 25 bp, Mus musculus
cagcgagcttccaaatccgaagctg

SEQ ID NO: 432140 - DNA, 25 bp, Mus musculus
atcagcgagcttccaaatccgaagc

SEQ ID NO: 432141 - DNA, 25 bp, Mus musculus
caatcagcgagcttccaaatccgaa

SEQ ID NO: 432142 - DNA, 25 bp, Mus musculus
ccaatcagcgagcttccaaatccga

SEQ ID NO: 432143 - DNA, 25 bp, Mus musculus
gccaatcagcgagcttccaaatccg

SEQ ID NO: 432144 - DNA, 25 bp, Mus musculus
agccaatcagcgagcttccaaatcc

SEQ ID NO: 432145 - DNA, 25 bp, Mus musculus
gtgttgaatcgcttccagccaatca

SEQ ID NO: 432146 - DNA, 25 bp, Mus musculus
tgtgttgaatcgcttccagccaatc

SEQ ID NO: 432147 - DNA, 25 bp, Mus musculus
atccactttctccaagcgtgccgcg

SEQ ID NO: 432148 - DNA, 25 bp, Mus musculus
cattctcggccggagctgtccgggt

SEQ ID NO: 432149 - DNA, 25 bp, Mus musculus
gctttccgcgttcgtgtctgatccc

SEQ ID NO: 432150 - DNA, 25 bp, Mus musculus
gggcctcgctttccgcgttcgtgtc

SEQ ID NO: 432151 - DNA, 25 bp, Mus musculus
ggtgctcggatctcggcccaagtcc

SEQ ID NO: 432152 - DNA, 25 bp, Mus musculus
ccggcatgtatcagagcccgcggcg

SEQ ID NO: 432153 - DNA, 25 bp, Mus musculus
gcggcgcccggcatgtatcagagcc

SEQ ID NO: 432154 - DNA, 25 bp, Mus musculus
agctgtccgggtctgactgcgccct

SEQ ID NO: 432155 - DNA, 25 bp, Mus musculus
tccagacggtccattctcggccgga

SEQ ID NO: 432156 - DNA, 25 bp, Mus musculus
gtcgctgtcactgatccagacggtc

SEQ ID NO: 432157 - DNA, 25 bp, Mus musculus
cgtgggagatctacagtcgctgtca

SEQ ID NO: 432158 - DNA, 25 bp, Mus musculus
agaggctcccggaacgcctctctaa

SEQ ID NO: 432159 - DNA, 25 bp, Mus musculus
gggacagaggctcccggaacgcctc

SEQ ID NO: 432160 - DNA, 25 bp, Mus musculus
ggcggtaacgctttggttgcagacg

SEQ ID NO: 432161 - DNA, 25 bp, Mus musculus
ggcgctagctccctcgcctcagtga

SEQ ID NO: 432162 - DNA, 25 bp, Mus musculus
agcagatccagctggttcgtgggtc

SEQ ID NO: 432163 - DNA, 25 bp, Mus musculus
ttaccggcccggatgagcagatcca

SEQ ID NO: 432164 - DNA, 25 bp, Mus musculus
tgggtccctcatgcagagacgtcgc

SEQ ID NO: 432165 - DNA, 25 bp, Mus musculus
gggcaatgccgagccgagacttccc

SEQ ID NO: 432166 - DNA, 25 bp, Mus musculus
tcgccatgtttatcccggggctgga

SEQ ID NO: 432167 - DNA, 25 bp, Mus musculus
acttcctgatttgtcgcctccatta

SEQ ID NO: 432168 - DNA, 25 bp, Mus musculus
ttcacattgacttacaccctgagcg

SEQ ID NO: 432169 - DNA, 25 bp, Mus musculus
tgcaccgatgcacgggagaaaagtt

SEQ ID NO: 432170 - DNA, 25 bp, Mus musculus
ctgcgcggaatacacccggtgtcct

SEQ ID NO: 432171 - DNA, 25 bp, Mus musculus
cagcccggatccgaggcaggttact

SEQ ID NO: 432172 - DNA, 25 bp, Mus musculus
ggctggaactgctgcttcacattga

SEQ ID NO: 432173 - DNA, 25 bp, Mus musculus
gcggggacaacagctccgctcactt

SEQ ID NO: 432174 - DNA, 25 bp, Mus musculus
cccgctttcatcttactgtggacca

SEQ ID NO: 432175 - DNA, 25 bp, Mus musculus
ggcaggttactctccaaggtgatca

SEQ ID NO: 432176 - DNA, 25 bp, Mus musculus
ctgctcaggtggagacgctcgccac

SEQ ID NO: 432177 - DNA, 25 bp, Mus musculus
actggcgccgcgaggtaaacagcgc

SEQ ID NO: 432178 - DNA, 25 bp, Mus musculus
gcgcctgtcaaaccgggccggctat

SEQ ID NO: 432179 - DNA, 25 bp, Mus musculus
cgagcaaacaacacaggcgcggggc

SEQ ID NO: 432180 - DNA, 25 bp, Mus musculus
ctgcgctctcgaatcccgccctctt

SEQ ID NO: 432181 - DNA, 25 bp, Mus musculus
acgcgcacctcttgggccactctca

SEQ ID NO: 432182 - DNA, 25 bp, Mus musculus
aggtggagacgctcgccactcgtcc

SEQ ID NO: 432183 - DNA, 25 bp, Mus musculus
ccgaacccgcctgctcaggtggaga

SEQ ID NO: 432184 - DNA, 25 bp, Mus musculus
ccaccaggacactggagtccgcctc

SEQ ID NO: 432185 - DNA, 25 bp, Mus musculus
ctgctctccctccacgtcgccgagt

SEQ ID NO: 432186 - DNA, 25 bp, Mus musculus
gctccgcaccacaggacgagacaaa

SEQ ID NO: 432187 - DNA, 25 bp, Mus musculus
ggacgagacaaaaccgcgctgcgcc

SEQ ID NO: 432188 - DNA, 25 bp, Mus musculus
cgccagtcaccgcagcgcctgtcaa

SEQ ID NO: 432189 - DNA, 25 bp, Mus musculus
gccctcttctcagcgcccaacttcg

SEQ ID NO: 432190 - DNA, 25 bp, Mus musculus
cgcaaaacacaagcgggaaatgtta

SEQ ID NO: 432191 - DNA, 25 bp, Mus musculus
tcgtggttttgccacgctggcgaga

SEQ ID NO: 432192 - DNA, 25 bp, Mus musculus
cctgatcttcggaggaccgtctgtc

SEQ ID NO: 432193 - DNA, 25 bp, Mus musculus
cgtctgtcctgcacagtgactgtga

SEQ ID NO: 432194 - DNA, 25 bp, Mus musculus
tgtgaccttcagaacgcgggcttcc

SEQ ID NO: 432195 - DNA, 25 bp, Mus musculus
cgggcttccacatgggcagtgtgaa

SEQ ID NO: 432196 - DNA, 25 bp, Mus musculus
acatgggcagtgtgaaacgtcagcc

SEQ ID NO: 432197 - DNA, 25 bp, Mus musculus
gctgctgacccgctctgagattcta

SEQ ID NO: 432198 - DNA, 25 bp, Mus musculus
cgctggcgagagaggcgcaaaacac

SEQ ID NO: 432199 - DNA, 25 bp, Mus musculus
ccacacaggtaatcgcgggctctca

SEQ ID NO: 432200 - DNA, 25 bp, Mus musculus
tcctctggtccacacaggtaatcgc

SEQ ID NO: 432201 - DNA, 25 bp, Mus musculus
ggtggctctcgcaccttcctctggt

SEQ ID NO: 432202 - DNA, 25 bp, Mus musculus
tgagattctagcagccgcacaagga

SEQ ID NO: 432203 - DNA, 25 bp, Mus musculus
gcgggctctcatcgtggttttgcca

SEQ ID NO: 432204 - DNA, 25 bp, Mus musculus
cgccagagtcttggacacagccctg

SEQ ID NO: 432205 - DNA, 25 bp, Mus musculus
agccctgcggagatacatcgccaga

SEQ ID NO: 432206 - DNA, 25 bp, Mus musculus
tcgccagatgcgctcagattcagca

SEQ ID NO: 432207 - DNA, 25 bp, Mus musculus
tgcgctcagattcagcagcggatca

SEQ ID NO: 432208 - DNA, 25 bp, Mus musculus
tcagcagcggatcaagcaacccagg

SEQ ID NO: 432209 - DNA, 25 bp, Mus musculus
gcggatcaagcaacccaggctcaga

SEQ ID NO: 432210 - DNA, 25 bp, Mus musculus
atcaagcaacccaggctcagaggga

SEQ ID NO: 432211 - DNA, 25 bp, Mus musculus
gtgggactccagatcccgtgcgtcc

SEQ ID NO: 432212 - DNA, 25 bp, Mus musculus
ttggacacagccctgcggagataca

SEQ ID NO: 432213 - DNA, 25 bp, Mus musculus
agtgtgggacactcaccgtccttcc

SEQ ID NO: 432214 - DNA, 25 bp, Mus musculus
agagaagtgtgggacactcaccgtc

SEQ ID NO: 432215 - DNA, 25 bp, Mus musculus
agatacatcgccagatgcgctcaga

SEQ ID NO: 432216 - DNA, 25 bp, Mus musculus
gggcagcgccagagtcttggacaca

SEQ ID NO: 432217 - DNA, 25 bp, Mus musculus
gcccagcctggacgggtagagaagt

SEQ ID NO: 432218 - DNA, 25 bp, Mus musculus
gtttggccgagctggcaccgccttc

SEQ ID NO: 432219 - DNA, 25 bp, Mus musculus
agattccagggtggctcgtgttgga

SEQ ID NO: 432220 - DNA, 25 bp, Mus musculus
ctgagggccgaatgggctctgaaaa

SEQ ID NO: 432221 - DNA, 25 bp, Mus musculus
ccgaatgggctctgaaaagacactc

SEQ ID NO: 432222 - DNA, 25 bp, Mus musculus
tgggctctgaaaagacactcacagc

SEQ ID NO: 432223 - DNA, 25 bp, Mus musculus
aagacactcacagcagctcggcagc

SEQ ID NO: 432224 - DNA, 25 bp, Mus musculus
aaacgagcgcagcactacggacggc

SEQ ID NO: 432225 - DNA, 25 bp, Mus musculus
acggcgccatcttgttccgcaggct

SEQ ID NO: 432226 - DNA, 25 bp, Mus musculus
aggtcactgcaggtcggcctggacc

SEQ ID NO: 432227 - DNA, 25 bp, Mus musculus
cttctcgggttgctcgtttggccga

SEQ ID NO: 432228 - DNA, 25 bp, Mus musculus
gccagcagccgcgaaaacgagcgca

SEQ ID NO: 432229 - DNA, 25 bp, Mus musculus
cctgcgcgcgcatctccggttggtg

SEQ ID NO: 432230 - DNA, 25 bp, Mus musculus
aggctccgcctcttctcgggttgct

SEQ ID NO: 432231 - DNA, 25 bp, Mus musculus
agcgcagcactacggacggcgccat

SEQ ID NO: 432232 - DNA, 25 bp, Mus musculus
gtcgatgcccgactctttcttgacg

SEQ ID NO: 432233 - DNA, 25 bp, Mus musculus
tcagggcgaacagcagcgtccggat

SEQ ID NO: 432234 - DNA, 25 bp, Mus musculus
catcatcagggcgaacagcagcgtc

SEQ ID NO: 432235 - DNA, 25 bp, Mus musculus
ggagtaaatgaacatgaccagaaag

SEQ ID NO: 432236 - DNA, 25 bp, Mus musculus
cgaagttagacatgccgaagatgga

SEQ ID NO: 432237 - DNA, 25 bp, Mus musculus
cgtaggcgaagttagacatgccgaa

SEQ ID NO: 432238 - DNA, 25 bp, Mus musculus
cttgacgtaggcgaagttagacatg

SEQ ID NO: 432239 - DNA, 25 bp, Mus musculus
gcgaacagcagcgtccggatgccct

SEQ ID NO: 432240 - DNA, 25 bp, Mus musculus
gaacagcagcgtccggatgcccttg

SEQ ID NO: 432241 - DNA, 25 bp, Mus musculus
acggatcagacgcaagacacgcccg

SEQ ID NO: 432242 - DNA, 25 bp, Mus musculus
agacgcaagacacgcccgatccgag

SEQ ID NO: 432243 - DNA, 25 bp, Mus musculus
cgcccgatccgagccaatcggatca

SEQ ID NO: 432244 - DNA, 25 bp, Mus musculus
gatgcccgactctttcttgacgtag

SEQ ID NO: 432245 - DNA, 25 bp, Mus musculus
tgcccgactctttcttgacgtaggc

SEQ ID NO: 432246 - DNA, 25 bp, Mus musculus
aaagccctccgagtccgccattttg

SEQ ID NO: 432247 - DNA, 25 bp, Mus musculus
ttgcttgaaagcacttctccctctc

SEQ ID NO: 432248 - DNA, 25 bp, Mus musculus
ggcagggactcattcattgcttgaa

SEQ ID NO: 432249 - DNA, 25 bp, Mus musculus
cagagccaactctgaaatccgcggc

SEQ ID NO: 432250 - DNA, 25 bp, Mus musculus
attttggctgcctctgtcggtcttt

SEQ ID NO: 432251 - DNA, 25 bp, Mus musculus
gtcggtcttttcagttaccacgtga

SEQ ID NO: 432252 - DNA, 25 bp, Mus musculus
ctccggacagggattctgccggctg

SEQ ID NO: 432253 - DNA, 25 bp, Mus musculus
aaggcttcaaggctgaagtgagctc

SEQ ID NO: 432254 - DNA, 25 bp, Mus musculus
gaacgcgctcttcaagcggatcttg

SEQ ID NO: 432255 - DNA, 25 bp, Mus musculus
gcttcgaggcctcggttccggacta

SEQ ID NO: 432256 - DNA, 25 bp, Mus musculus
ggctgccgtttaccctcctagagcg

SEQ ID NO: 432257 - DNA, 25 bp, Mus musculus
ttaccacgtgaaccgccgacggaga

SEQ ID NO: 432258 - DNA, 25 bp, Mus musculus
caccctcggaaggaacaggtggtgt

SEQ ID NO: 432259 - DNA, 25 bp, Mus musculus
tggcaggaccggcagagccaactct

SEQ ID NO: 432260 - DNA, 25 bp, Mus musculus
cgaggcctgcttaccagtcggagct

SEQ ID NO: 432261 - DNA, 25 bp, Mus musculus
gaaccactctccgtgcttgcatttc

SEQ ID NO: 432262 - DNA, 25 bp, Mus musculus
cgccttccgctgcaagtccgagtgt

SEQ ID NO: 432263 - DNA, 25 bp, Mus musculus
ggacgccagagagcgcatgcctcct

SEQ ID NO: 432264 - DNA, 25 bp, Mus musculus
tagtttaaagcttgcctcccgcgga

SEQ ID NO: 432265 - DNA, 25 bp, Mus musculus
gcgagcctactagtccggtagttta

SEQ ID NO: 432266 - DNA, 25 bp, Mus musculus
gccttaatcccaggcgagcctacta

SEQ ID NO: 432267 - DNA, 25 bp, Mus musculus
acctcttctgcacgcttgcaggtca

SEQ ID NO: 432268 - DNA, 25 bp, Mus musculus
tgggacctacacagcgccgccatga

SEQ ID NO: 432269 - DNA, 25 bp, Mus musculus
gacaagcgctctcaagaaacggctc

SEQ ID NO: 432270 - DNA, 25 bp, Mus musculus
cttgcatttcgcaaaggcttggaga

SEQ ID NO: 432271 - DNA, 25 bp, Mus musculus
tgggttgcgctctcggaaccactct

SEQ ID NO: 432272 - DNA, 25 bp, Mus musculus
aagtccgagtgtcgctccagagcgc

SEQ ID NO: 432273 - DNA, 25 bp, Mus musculus
agagcgctcgcgaagccgcctgaac

SEQ ID NO: 432274 - DNA, 25 bp, Mus musculus
cgtggatattgatggagagcgcatc

SEQ ID NO: 432275 - DNA, 25 bp, Mus musculus
aggggatgctcagagcccaactcca

SEQ ID NO: 432276 - DNA, 25 bp, Mus musculus
cttccgagagcgagccgtggatatt

SEQ ID NO: 432277 - DNA, 25 bp, Mus musculus
gacgtgcctgacttaccgcttctgc

SEQ ID NO: 432278 - DNA, 25 bp, Mus musculus
gatcatagtgatcggcgactcgaac

SEQ ID NO: 432279 - DNA, 25 bp, Mus musculus
ctcccgcatcttcaagatcatagtg

SEQ ID NO: 432280 - DNA, 25 bp, Mus musculus
ttctcgtccagctgtgcggtgtcag

SEQ ID NO: 432281 - DNA, 25 bp, Mus musculus
tcgctggaggtcagcttctcgtcca

SEQ ID NO: 432282 - DNA, 25 bp, Mus musculus
atgacttcggagatggagtcgtcgc

SEQ ID NO: 432283 - DNA, 25 bp, Mus musculus
tttgtcactgctagggagcgctgtc

SEQ ID NO: 432284 - DNA, 25 bp, Mus musculus
tttccaggtacaccgcaccgactgg

SEQ ID NO: 432285 - DNA, 25 bp, Mus musculus
gcgccgacgcatctttccaggtaca

SEQ ID NO: 432286 - DNA, 25 bp, Mus musculus
ttcctccagagctcgggaacctcgg

SEQ ID NO: 432287 - DNA, 25 bp, Mus musculus
tgccgctccttcttggcaggtgtcg

SEQ ID NO: 432288 - DNA, 25 bp, Mus musculus
cgctggagctaagccctgcgagttt

SEQ ID NO: 432289 - DNA, 25 bp, Mus musculus
tcgtcgctatccatggcggctgaga

SEQ ID NO: 432290 - DNA, 25 bp, Mus musculus
gtcctggagaaaagcttgtaccttc

SEQ ID NO: 432291 - DNA, 25 bp, Mus musculus
agaccgccactcttttggcgctttc

SEQ ID NO: 432292 - DNA, 25 bp, Mus musculus
gagcgacccgccatccgcttaggga

SEQ ID NO: 432293 - DNA, 25 bp, Mus musculus
caactcccagggaggatgctgccga

SEQ ID NO: 432294 - DNA, 25 bp, Mus musculus
tgctaggcagcgtcgcaactcccag

SEQ ID NO: 432295 - DNA, 25 bp, Mus musculus
cgcaaggactaaggccaaggtgcta

SEQ ID NO: 432296 - DNA, 25 bp, Mus musculus
tcgaggtggctgaaacaacgctgcc

SEQ ID NO: 432297 - DNA, 25 bp, Mus musculus
cgactcagtcaggaaaagggcaggc

SEQ ID NO: 432298 - DNA, 25 bp, Mus musculus
gccatgggacgcagcgactcagtca

SEQ ID NO: 432299 - DNA, 25 bp, Mus musculus
cgttgcgatgggagacccacctaga

SEQ ID NO: 432300 - DNA, 25 bp, Mus musculus
agcggcgtgctctacctagccatga

SEQ ID NO: 432301 - DNA, 25 bp, Mus musculus
gccactgcaactttctcctgtgata

SEQ ID NO: 432302 - DNA, 25 bp, Mus musculus
ttagcaacagcgagcagcgagcagc

SEQ ID NO: 432303 - DNA, 25 bp, Mus musculus
ttcagcatcatgtgcgagcgggtgc

SEQ ID NO: 432304 - DNA, 25 bp, Mus musculus
ccttcctgtcggaagagaaaaggtg

SEQ ID NO: 432305 - DNA, 25 bp, Mus musculus
tgcctctcgcttagcaacagcgagc

SEQ ID NO: 432306 - DNA, 25 bp, Mus musculus
catcatgtgcgagcgggtgcctctc

SEQ ID NO: 432307 - DNA, 25 bp, Mus musculus
attggttcagcatcatgtgcgagcg

SEQ ID NO: 432308 - DNA, 25 bp, Mus musculus
gctattggttcagcatcatgtgcga

SEQ ID NO: 432309 - DNA, 25 bp, Mus musculus
gacgctattggttcagcatcatgtg

SEQ ID NO: 432310 - DNA, 25 bp, Mus musculus
tcaggacgctattggttcagcatca

SEQ ID NO: 432311 - DNA, 25 bp, Mus musculus
gggtcaggacgctattggttcagca

SEQ ID NO: 432312 - DNA, 25 bp, Mus musculus
ttttaccagccaatgggggtcagga

SEQ ID NO: 432313 - DNA, 25 bp, Mus musculus
gcggcgcggtgggattctctttctt

SEQ ID NO: 432314 - DNA, 25 bp, Mus musculus
aggacccaccggtcacaggcggcgc

SEQ ID NO: 432315 - DNA, 25 bp, Mus musculus
atgtgcgagcgggtgcctctcgctt

SEQ ID NO: 432316 - DNA, 25 bp, Mus musculus
tgctcccggggcacactattttgga

SEQ ID NO: 432317 - DNA, 25 bp, Mus musculus
agcctccgcatcttgctgggtttta

SEQ ID NO: 432318 - DNA, 25 bp, Mus musculus
agcgtggtttctactcctgggttca

SEQ ID NO: 432319 - DNA, 25 bp, Mus musculus
cccttggagtcgtgactggcttctc

SEQ ID NO: 432320 - DNA, 25 bp, Mus musculus
gcggcgaaagcgtttaccctgagaa

SEQ ID NO: 432321 - DNA, 25 bp, Mus musculus
tatcagccttctccttgggtccaag

SEQ ID NO: 432322 - DNA, 25 bp, Mus musculus
gtgagccctcaccatgatcagcgta

SEQ ID NO: 432323 - DNA, 25 bp, Mus musculus
ctctctgctccagggtcctctgata

SEQ ID NO: 432324 - DNA, 25 bp, Mus musculus
ctctgatagaggctcacggtgtccc

SEQ ID NO: 432325 - DNA, 25 bp, Mus musculus
gctgctccacctgagcctgctgata

SEQ ID NO: 432326 - DNA, 25 bp, Mus musculus
gatacctgttctcgcagttgacgtg

SEQ ID NO: 432327 - DNA, 25 bp, Mus musculus
gggttcactctggttcgcatcgatt

SEQ ID NO: 432328 - DNA, 25 bp, Mus musculus
tactactaccattcgcggcggcagc

SEQ ID NO: 432329 - DNA, 25 bp, Mus musculus
gctattgggagtattcacgccgatc

SEQ ID NO: 432330 - DNA, 25 bp, Mus musculus
cccaatctcggagcgacactcgggt

SEQ ID NO: 432331 - DNA, 25 bp, Mus musculus
tcaacaggcagcagcgccgctgtcg

SEQ ID NO: 432332 - DNA, 25 bp, Mus musculus
tcaccaaggccatcgagagctcagc

SEQ ID NO: 432333 - DNA, 25 bp, Mus musculus
tggggcaacctgtcgtacgccgacc

SEQ ID NO: 432334 - DNA, 25 bp, Mus musculus
ggacagccgcgcaagaccagctcgt

SEQ ID NO: 432335 - DNA, 25 bp, Mus musculus
cgactttatgagcaacctgagcctg

SEQ ID NO: 432336 - DNA, 25 bp, Mus musculus
gtccgctgtcagcaccgactttatg

SEQ ID NO: 432337 - DNA, 25 bp, Mus musculus
tcggaggctccttagacaccggtga

SEQ ID NO: 432338 - DNA, 25 bp, Mus musculus
tgcccaggccggagtttaaccagtc

SEQ ID NO: 432339 - DNA, 25 bp, Mus musculus
cgaagttaagttctgggcgcgtccg

SEQ ID NO: 432340 - DNA, 25 bp, Mus musculus
gtctcccggtacttctctgctggtg

SEQ ID NO: 432341 - DNA, 25 bp, Mus musculus
gtcctaggcacgaactcggaggctc

SEQ ID NO: 432342 - DNA, 25 bp, Mus musculus
caccggtgacccagcgaagttaagt

SEQ ID NO: 432343 - DNA, 25 bp, Mus musculus
gagcccgctgcagatcccgtaagac

SEQ ID NO: 432344 - DNA, 25 bp, Mus musculus
agccatcgctgacagacccggcgta

SEQ ID NO: 432345 - DNA, 25 bp, Mus musculus
gaagcactgcgcttgtgcactcact

SEQ ID NO: 432346 - DNA, 25 bp, Mus musculus
cccattactgaagccattggcggcc

SEQ ID NO: 432347 - DNA, 25 bp, Mus musculus
gcagcttacgcgacagcggattgtt

SEQ ID NO: 432348 - DNA, 25 bp, Mus musculus
cgcgaagtactgctctagacggtta

SEQ ID NO: 432349 - DNA, 25 bp, Mus musculus
ttcaagtaaaggacacagcaagagc

SEQ ID NO: 432350 - DNA, 25 bp, Mus musculus
agcgcaagggcagggcacagctacc

SEQ ID NO: 432351 - DNA, 25 bp, Mus musculus
ttgtgcactcactcgcgcatgcgca

SEQ ID NO: 432352 - DNA, 25 bp, Mus musculus
caaaaagcgcttccctacgcctagg

SEQ ID NO: 432353 - DNA, 25 bp, Mus musculus
cctacgcctaggacagcagcagctt

SEQ ID NO: 432354 - DNA, 25 bp, Mus musculus
tccggttaccttgtcattttctagc

SEQ ID NO: 432355 - DNA, 25 bp, Mus musculus
tgtcattttctagccgtgtctccag

SEQ ID NO: 432356 - DNA, 25 bp, Mus musculus
aggatcttgtgcagcttacgcgaca

SEQ ID NO: 432357 - DNA, 25 bp, Mus musculus
agacccggcgtaacggaagcactgc

SEQ ID NO: 432358 - DNA, 25 bp, Mus musculus
gctggagccggcatccaccgtgttc

SEQ ID NO: 432359 - DNA, 25 bp, Mus musculus
acagcaagttgtgctgcgcccggga

SEQ ID NO: 432360 - DNA, 25 bp, Mus musculus
cccgccagggaaagacagcaagttg

SEQ ID NO: 432361 - DNA, 25 bp, Mus musculus
gtcttctttggtgccgcgctgtccc

SEQ ID NO: 432362 - DNA, 25 bp, Mus musculus
agacagtcttctttggtgccgcgct

SEQ ID NO: 432363 - DNA, 25 bp, Mus musculus
ggcaaaggcaagaaagacagtcttc

SEQ ID NO: 432364 - DNA, 25 bp, Mus musculus
tccgtcgggatagtggcaaaggcaa

SEQ ID NO: 432365 - DNA, 25 bp, Mus musculus
actcgcctcgatctccgtcgggata

SEQ ID NO: 432366 - DNA, 25 bp, Mus musculus
ctgccaaagctggagccggcatcca

SEQ ID NO: 432367 - DNA, 25 bp, Mus musculus
tggattctcagtctgtctgccgccc

SEQ ID NO: 432368 - DNA, 25 bp, Mus musculus
tctccctggattctcagtctgtctg

SEQ ID NO: 432369 - DNA, 25 bp, Mus musculus
gcggggaaggcgagcaactttctcc

SEQ ID NO: 432370 - DNA, 25 bp, Mus musculus
ggcgagcaactttctccctggattc

SEQ ID NO: 432371 - DNA, 25 bp, Mus musculus
ctcgatctccgtcgggatagtggca

SEQ ID NO: 432372 - DNA, 25 bp, Mus musculus
gtgctcgagagcctcccttcgcaag

SEQ ID NO: 432373 - DNA, 25 bp, Mus musculus
ggactttagtcacgtctgctccaca

SEQ ID NO: 432374 - DNA, 25 bp, Mus musculus
accattgcgtcttgtgggcgcgaca

SEQ ID NO: 432375 - DNA, 25 bp, Mus musculus
tccggagccctgatttctgcaaacg

SEQ ID NO: 432376 - DNA, 25 bp, Mus musculus
ggcgcgacacgctctatcaaaggtc

SEQ ID NO: 432377 - DNA, 25 bp, Mus musculus
tgctccacaagcattcaggcttctg

SEQ ID NO: 432378 - DNA, 25 bp, Mus musculus
tgactaccacgctccgaaaaggact

SEQ ID NO: 432379 - DNA, 25 bp, Mus musculus
gacctacttactcttcgctccttta

SEQ ID NO: 432380 - DNA, 25 bp, Mus musculus
tccgcagatcttcctgacctactta

SEQ ID NO: 432381 - DNA, 25 bp, Mus musculus
actaattccgggtgtcctgctcctt

SEQ ID NO: 432382 - DNA, 25 bp, Mus musculus
tcgaccggagaaccgccgaagacta

SEQ ID NO: 432383 - DNA, 25 bp, Mus musculus
ggcagactaaagcaccgggaaactc

SEQ ID NO: 432384 - DNA, 25 bp, Mus musculus
cgagccacagaagcgcgaatgcaaa

SEQ ID NO: 432385 - DNA, 25 bp, Mus musculus
ggcttctgccgtggacgcctatatt

SEQ ID NO: 432386 - DNA, 25 bp, Mus musculus
cgagtaaagactcaaaactccagtc

SEQ ID NO: 432387 - DNA, 25 bp, Mus musculus
cgccgtgcccattcccggcttcaaa

SEQ ID NO: 432388 - DNA, 25 bp, Mus musculus
aagtgccttgtgtcccggcttcttc

SEQ ID NO: 432389 - DNA, 25 bp, Mus musculus
agccctataagtgccttgtgtcccg

SEQ ID NO: 432390 - DNA, 25 bp, Mus musculus
cattcccagccctataagtgccttg

SEQ ID NO: 432391 - DNA, 25 bp, Mus musculus
cgcgactctcctctggccgcgagcc

SEQ ID NO: 432392 - DNA, 25 bp, Mus musculus
accgccaagcctcccgcagctgcct

SEQ ID NO: 432393 - DNA, 25 bp, Mus musculus
ggccgacgcagctcccaccgccaag

SEQ ID NO: 432394 - DNA, 25 bp, Mus musculus
ggcctttgggagacagctccgagtc

SEQ ID NO: 432395 - DNA, 25 bp, Mus musculus
ttcgggtgtccatccgcggccacgg

SEQ ID NO: 432396 - DNA, 25 bp, Mus musculus
gctggctaaaaacgccgtgcccatt

SEQ ID NO: 432397 - DNA, 25 bp, Mus musculus
caaacgctttccaaagtctcattta

SEQ ID NO: 432398 - DNA, 25 bp, Mus musculus
cggcttcaaacgctttccaaagtct

SEQ ID NO: 432399 - DNA, 25 bp, Mus musculus
cccggcctttgggagacagctccga

SEQ ID NO: 432400 - DNA, 25 bp, Mus musculus
cgctcagtgctacccacctccaatg

SEQ ID NO: 432401 - DNA, 25 bp, Mus musculus
aggcgccctctaccgtggcagttac

SEQ ID NO: 432402 - DNA, 25 bp, Mus musculus
tctgcagctgtacaccctagctctg

SEQ ID NO: 432403 - DNA, 25 bp, Mus musculus
gcaacagtgcgctcagtgctaccca

SEQ ID NO: 432404 - DNA, 25 bp, Mus musculus
gggtcgtcgaccaccaccacatctg

SEQ ID NO: 432405 - DNA, 25 bp, Mus musculus
cctccaatgcctcgcctgcggcctt

SEQ ID NO: 432406 - DNA, 25 bp, Mus musculus
gcctgcggccttcccactcaacctg

SEQ ID NO: 432407 - DNA, 25 bp, Mus musculus
tcaacctgtccaccgctgtaccctc

SEQ ID NO: 432408 - DNA, 25 bp, Mus musculus
gctgtaccctcgctctttgctgtca

SEQ ID NO: 432409 - DNA, 25 bp, Mus musculus
ttgctgtcacccagggcccgctacc

SEQ ID NO: 432410 - DNA, 25 bp, Mus musculus
cccggcttccctgtctccagtgccc

SEQ ID NO: 432411 - DNA, 25 bp, Mus musculus
cgctgccctcgttcccagggctgca

SEQ ID NO: 432412 - DNA, 25 bp, Mus musculus
ttgccagtggctgcctcggctccat

SEQ ID NO: 432413 - DNA, 25 bp, Mus musculus
tagctctgcaacagtgcgctcagtg

SEQ ID NO: 432414 - DNA, 25 bp, Mus musculus
agcttcctctgtagggactcccgaa

SEQ ID NO: 432415 - DNA, 25 bp, Mus musculus
ccgggccatagtcgcacgcaaaacg

SEQ ID NO: 432416 - DNA, 25 bp, Mus musculus
ctaacacggtcactgtgcagcggtc

SEQ ID NO: 432417 - DNA, 25 bp, Mus musculus
gcagcaccaagtcacgcaacggatc

SEQ ID NO: 432418 - DNA, 25 bp, Mus musculus
gatccagccagacttcgcgaccgaa

SEQ ID NO: 432419 - DNA, 25 bp, Mus musculus
agcccgcggtttgccaccactatag

SEQ ID NO: 432420 - DNA, 25 bp, Mus musculus
gacccagggactgaagtgctgcacc

SEQ ID NO: 432421 - DNA, 25 bp, Mus musculus
agcctgtgtggagacgtagcttacc

SEQ ID NO: 432422 - DNA, 25 bp, Mus musculus
ccggccttagagttccgacagttca

SEQ ID NO: 432423 - DNA, 25 bp, Mus musculus
ccggcgggtatgcaaagctagactt

SEQ ID NO: 432424 - DNA, 25 bp, Mus musculus
ggatggccaaatgcaccgcacggtc

SEQ ID NO: 432425 - DNA, 25 bp, Mus musculus
tggagccgcaatccaaggcactaaa

SEQ ID NO: 432426 - DNA, 25 bp, Mus musculus
aggcactaaacacttccagcgcgtc

SEQ ID NO: 432427 - DNA, 25 bp, Mus musculus
gccagcgcgtcgttgtctaacacgg

SEQ ID NO: 432428 - DNA, 25 bp, Mus musculus
caggtctgtagtgactcctccctta

SEQ ID NO: 432429 - DNA, 25 bp, Mus musculus
gtcaccacctgtcgctaattcactg

SEQ ID NO: 432430 - DNA, 25 bp, Mus musculus
aacgttctgtgtaggtgaaccaggc

SEQ ID NO: 432431 - DNA, 25 bp, Mus musculus
tcactgaacaaagaataaccggggc

SEQ ID NO: 432432 - DNA, 25 bp, Mus musculus
tcctcccttaggagggccctagtca

SEQ ID NO: 432433 - DNA, 25 bp, Mus musculus
tccggctcccacgagcaggtctgta

SEQ ID NO: 432434 - DNA, 25 bp, Mus musculus
tgagaagaggaaccgggcttaaagc

SEQ ID NO: 432435 - DNA, 25 bp, Mus musculus
agatccggctgacctgtgcagccca

SEQ ID NO: 432436 - DNA, 25 bp, Mus musculus
ccatgctagctgaaggcagcgagca

SEQ ID NO: 432437 - DNA, 25 bp, Mus musculus
atatctctgcactccatgctagctg

SEQ ID NO: 432438 - DNA, 25 bp, Mus musculus
gggattggtaatcatcagccaactc

SEQ ID NO: 432439 - DNA, 25 bp, Mus musculus
tcactccagaatcaaaatcaaaggg

SEQ ID NO: 432440 - DNA, 25 bp, Mus musculus
agaggtagttcttgttcactccaga

SEQ ID NO: 432441 - DNA, 25 bp, Mus musculus
taggagggccctagtcaccacctgt

SEQ ID NO: 432442 - DNA, 25 bp, Mus musculus
ccacacagcgcctgaaaattgtgtc

SEQ ID NO: 432443 - DNA, 25 bp, Mus musculus
ccacgtcgccctccagcgcggctat

SEQ ID NO: 432444 - DNA, 25 bp, Mus musculus
gccgcgcttccttgatggccggcag

SEQ ID NO: 432445 - DNA, 25 bp, Mus musculus
tggtggaaccgcctgacacacaccg

SEQ ID NO: 432446 - DNA, 25 bp, Mus musculus
ttacatggtggaaccgcctgacaca

SEQ ID NO: 432447 - DNA, 25 bp, Mus musculus
gatacttacatggtggaaccgcctg

SEQ ID NO: 432448 - DNA, 25 bp, Mus musculus
cagggacggatacttacatggtgga

SEQ ID NO: 432449 - DNA, 25 bp, Mus musculus
cgggacacagggacggatacttaca

SEQ ID NO: 432450 - DNA, 25 bp, Mus musculus
tcgacctgccggagagaacgagaag

SEQ ID NO: 432451 - DNA, 25 bp, Mus musculus
gacaccttcgacctgccggagagaa

SEQ ID NO: 432452 - DNA, 25 bp, Mus musculus
taaaggacaccttcgacctgccgga

SEQ ID NO: 432453 - DNA, 25 bp, Mus musculus
gacgtcaacgtgattttaaaggaca

SEQ ID NO: 432454 - DNA, 25 bp, Mus musculus
gcggctatccacacagcgcctgaaa

SEQ ID NO: 432455 - DNA, 25 bp, Mus musculus
cgcgggtccgacgtcaacgtgattt

SEQ ID NO: 432456 - DNA, 25 bp, Mus musculus
tgcgctagcaccaggcacagcactg

SEQ ID NO: 432457 - DNA, 25 bp, Mus musculus
gctctggctctccagcatcctcact

SEQ ID NO: 432458 - DNA, 25 bp, Mus musculus
cgcccagttctgtgccagctgcgtg

SEQ ID NO: 432459 - DNA, 25 bp, Mus musculus
cagttctgtgccagctgcgtgggct

SEQ ID NO: 432460 - DNA, 25 bp, Mus musculus
cccttggaatgctccaaaaaactcg

SEQ ID NO: 432461 - DNA, 25 bp, Mus musculus
gctccaaaaaactcggtagcgacta

SEQ ID NO: 432462 - DNA, 25 bp, Mus musculus
tagcgactacggaaaccccatcgga

SEQ ID NO: 432463 - DNA, 25 bp, Mus musculus
gaactgaccagctgcgctagcacca

SEQ ID NO: 432464 - DNA, 25 bp, Mus musculus
agattgcaactttgcgggtaagaga

SEQ ID NO: 432465 - DNA, 25 bp, Mus musculus
gcacagcactggtgctgcgcgctcg

SEQ ID NO: 432466 - DNA, 25 bp, Mus musculus
agcactggtgctgcgcgctcgccga

SEQ ID NO: 432467 - DNA, 25 bp, Mus musculus
ctcggtcacttcaaccaccagattg

SEQ ID NO: 432468 - DNA, 25 bp, Mus musculus
ggtcacttcaaccaccagattgcaa

SEQ ID NO: 432469 - DNA, 25 bp, Mus musculus
ccatcggaactgaccagctgcgcta

SEQ ID NO: 432470 - DNA, 25 bp, Mus musculus
gccgtgtgtggtataggacatctca

SEQ ID NO: 432471 - DNA, 25 bp, Mus musculus
tctcctgagaagagcactgccgacc

SEQ ID NO: 432472 - DNA, 25 bp, Mus musculus
acacgaggtacttggtgccacagcg

SEQ ID NO: 432473 - DNA, 25 bp, Mus musculus
cgcgaaagggaagccatgcgtcttc

SEQ ID NO: 432474 - DNA, 25 bp, Mus musculus
cggccggagaaagacacgaggtact

SEQ ID NO: 432475 - DNA, 25 bp, Mus musculus
cccagtggtacacgcagggctcaga

SEQ ID NO: 432476 - DNA, 25 bp, Mus musculus
cagccttcctccaccgggatggaga

SEQ ID NO: 432477 - DNA, 25 bp, Mus musculus
ttgcttggccaccttgcagccagtg

SEQ ID NO: 432478 - DNA, 25 bp, Mus musculus
tcctgccgtcctgcacgtgttgctt

SEQ ID NO: 432479 - DNA, 25 bp, Mus musculus
catgcaagttgtccttcctgccgtc

SEQ ID NO: 432480 - DNA, 25 bp, Mus musculus
ccagtccgtcttcgggaaggtcttg

SEQ ID NO: 432481 - DNA, 25 bp, Mus musculus
aagattcccgcatgcgcttcccagt

SEQ ID NO: 432482 - DNA, 25 bp, Mus musculus
tctcacagtccagcgcgaagattcc

SEQ ID NO: 432483 - DNA, 25 bp, Mus musculus
ccaccactgtgacgcgggtgagctc

SEQ ID NO: 432484 - DNA, 25 bp, Mus musculus
ggacaacttgctccagccttctgcg

SEQ ID NO: 432485 - DNA, 25 bp, Mus musculus
tctgcgcacacctaaagctactcta

SEQ ID NO: 432486 - DNA, 25 bp, Mus musculus
aaagccagggttcctcggctgcgct

SEQ ID NO: 432487 - DNA, 25 bp, Mus musculus
cgctagtagcgccttccaaaatgtc

SEQ ID NO: 432488 - DNA, 25 bp, Mus musculus
gcccagtccgccaatcagaagagcg

SEQ ID NO: 432489 - DNA, 25 bp, Mus musculus
ccaatcagaagagcggccgccggaa

SEQ ID NO: 432490 - DNA, 25 bp, Mus musculus
ccggaactcgctgttggagctgtaa

SEQ ID NO: 432491 - DNA, 25 bp, Mus musculus
tgtgtcgggccttgtacgacctcaa

SEQ ID NO: 432492 - DNA, 25 bp, Mus musculus
ttccactagcaacgcaccaatcgga

SEQ ID NO: 432493 - DNA, 25 bp, Mus musculus
ttacagcaggccttaggtgagttct

SEQ ID NO: 432494 - DNA, 25 bp, Mus musculus
aggtcgatccgcgtttcggagattc

SEQ ID NO: 432495 - DNA, 25 bp, Mus musculus
tcggcggccattctgcgtgaacgcc

SEQ ID NO: 432496 - DNA, 25 bp, Mus musculus
tccagccctacgaaagttaacgctc

SEQ ID NO: 432497 - DNA, 25 bp, Mus musculus
aagttaacgctcatgctctcccgcg

SEQ ID NO: 432498 - DNA, 25 bp, Mus musculus
tagtcgccaatctcgcggggtccca

SEQ ID NO: 432499 - DNA, 25 bp, Mus musculus
accgcgcttccgcaagtgtggagct

SEQ ID NO: 432500 - DNA, 25 bp, Mus musculus
tgaagccagtgcacaggtccagggc

SEQ ID NO: 432501 - DNA, 25 bp, Mus musculus
cacacgcaggcgcacgagatgaaaa

SEQ ID NO: 432502 - DNA, 25 bp, Mus musculus
tccagggctttgacttgccgcactc

SEQ ID NO: 432503 - DNA, 25 bp, Mus musculus
tgcgcccgaggcattaacgccagct

SEQ ID NO: 432504 - DNA, 25 bp, Mus musculus
ttagggaagtgcagctaccgtgttc

SEQ ID NO: 432505 - DNA, 25 bp, Mus musculus
tcacttgaacccagccgccattttt

SEQ ID NO: 432506 - DNA, 25 bp, Mus musculus
ccgtcctggatgcagtgtccctcag

SEQ ID NO: 432507 - DNA, 25 bp, Mus musculus
tccgggtttaaccagagcgcgccca

SEQ ID NO: 432508 - DNA, 25 bp, Mus musculus
agacgcgagtttgcaggctgcacgc

SEQ ID NO: 432509 - DNA, 25 bp, Mus musculus
ccgcggccacaagtgactgcaggta

SEQ ID NO: 432510 - DNA, 25 bp, Mus musculus
tgtacatacgtttggcctcctcgcc

SEQ ID NO: 432511 - DNA, 25 bp, Mus musculus
tccttagatggctgctctgcacggc

SEQ ID NO: 432512 - DNA, 25 bp, Mus musculus
gcagctaccgcgcaaccggagtgcg

SEQ ID NO: 432513 - DNA, 25 bp, Mus musculus
acctatggcgcgacgcgtgacccgg

SEQ ID NO: 432514 - DNA, 25 bp, Mus musculus
ccagcacctgggacctatggcgcga

SEQ ID NO: 432515 - DNA, 25 bp, Mus musculus
gctccgcggcatcccagcacctggg

SEQ ID NO: 432516 - DNA, 25 bp, Mus musculus
agaacctgggtggtgtctgtagtgt

SEQ ID NO: 432517 - DNA, 25 bp, Mus musculus
acaggtaagcgctgccatgccgcgg

SEQ ID NO: 432518 - DNA, 25 bp, Mus musculus
cgtggcacctctcggacaggtaagc

SEQ ID NO: 432519 - DNA, 25 bp, Mus musculus
gcccggccgaccctgcagctaccgc

SEQ ID NO: 432520 - DNA, 25 bp, Mus musculus
gggcacgcgtggcacctctcggaca

SEQ ID NO: 432521 - DNA, 25 bp, Mus musculus
tggcgcccttccagcgcggcgcact

SEQ ID NO: 432522 - DNA, 25 bp, Mus musculus
ccgaggaggaggctccagcctgact

SEQ ID NO: 432523 - DNA, 25 bp, Mus musculus
ggaggctccagcctgactgacgcct

SEQ ID NO: 432524 - DNA, 25 bp, Mus musculus
tgactgacgcctctggagccgctgt

SEQ ID NO: 432525 - DNA, 25 bp, Mus musculus
gacgcctctggagccgctgtctcgg

SEQ ID NO: 432526 - DNA, 25 bp, Mus musculus
ccctcatgccgcacaacgccaccta

SEQ ID NO: 432527 - DNA, 25 bp, Mus musculus
caacgccacctaccctgactctttc

SEQ ID NO: 432528 - DNA, 25 bp, Mus musculus
tgactctttccagcagtctctctgt

SEQ ID NO: 432529 - DNA, 25 bp, Mus musculus
tttccagcagtctctctgtccggca

SEQ ID NO: 432530 - DNA, 25 bp, Mus musculus
tcgccaggccatgtgtttccgcagt

SEQ ID NO: 432531 - DNA, 25 bp, Mus musculus
aggccatgtgtttccgcagtctcca

SEQ ID NO: 432532 - DNA, 25 bp, Mus musculus
atgtgtttccgcagtctccatgccc

SEQ ID NO: 432533 - DNA, 25 bp, Mus musculus
gtccttccgagtcagacagtcccta

SEQ ID NO: 432534 - DNA, 25 bp, Mus musculus
gtcagacagtccctatcaacactca

SEQ ID NO: 432535 - DNA, 25 bp, Mus musculus
gtccctatcaacactcaggtcagtc

SEQ ID NO: 432536 - DNA, 25 bp, Mus musculus
tcaacactcaggtcagtccgtggga

SEQ ID NO: 432537 - DNA, 25 bp, Mus musculus
actcaggtcagtccgtgggaaacga

SEQ ID NO: 432538 - DNA, 25 bp, Mus musculus
tcagtccgtgggaaacgagacgctt

SEQ ID NO: 432539 - DNA, 25 bp, Mus musculus
ggaagtccttccgagtcagacagtc

SEQ ID NO: 432540 - DNA, 25 bp, Mus musculus
acagcagacagcgtggacttctacc

SEQ ID NO: 432541 - DNA, 25 bp, Mus musculus
actctgctagcgcataactggggcc

SEQ ID NO: 432542 - DNA, 25 bp, Mus musculus
cgctggtgtcttgtgtgtcactgtc

SEQ ID NO: 432543 - DNA, 25 bp, Mus musculus
gcggcccttttaaccgctagctaca

SEQ ID NO: 432544 - DNA, 25 bp, Mus musculus
aatcgtaatctgagccgaccgcacc

SEQ ID NO: 432545 - DNA, 25 bp, Mus musculus
gatccgggtgatgcgaatcgtaatc

SEQ ID NO: 432546 - DNA, 25 bp, Mus musculus
cacgcgttagactgctgatccgggt

SEQ ID NO: 432547 - DNA, 25 bp, Mus musculus
gacactccatacatagcacgcgtta

SEQ ID NO: 432548 - DNA, 25 bp, Mus musculus
tggccggcgatgatgacactccata

SEQ ID NO: 432549 - DNA, 25 bp, Mus musculus
gttctctgaggaagctgaggctgca

SEQ ID NO: 432550 - DNA, 25 bp, Mus musculus
ctgctctaaggtaatgtgttctctg

SEQ ID NO: 432551 - DNA, 25 bp, Mus musculus
gcctcttatcgacggggactgctct

SEQ ID NO: 432552 - DNA, 25 bp, Mus musculus
gctttctttaagacaaggccacacg

SEQ ID NO: 432553 - DNA, 25 bp, Mus musculus
tgcggcgccataacactctgctagc

SEQ ID NO: 432554 - DNA, 25 bp, Mus musculus
gtgagcgacagcagcatctttgtcc

SEQ ID NO: 432555 - DNA, 25 bp, Mus musculus
tgtatgagctgacgaagatgtgcac

SEQ ID NO: 432556 - DNA, 25 bp, Mus musculus
ctttgaagtggtgtatgagctgacg

SEQ ID NO: 432557 - DNA, 25 bp, Mus musculus
accacggctttgaagtggtgtatga

SEQ ID NO: 432558 - DNA, 25 bp, Mus musculus
agctgctcgcccagtccgtgcacca

SEQ ID NO: 432559 - DNA, 25 bp, Mus musculus
aggtcttcaacaaccagctcttcgc

SEQ ID NO: 432560 - DNA, 25 bp, Mus musculus
tgcagcctcaaggtcttcaacaacc

SEQ ID NO: 432561 - DNA, 25 bp, Mus musculus
acccggccaccgtctgcaagatccc

SEQ ID NO: 432562 - DNA, 25 bp, Mus musculus
agcacggcttccacccggccaccgt

SEQ ID NO: 432563 - DNA, 25 bp, Mus musculus
ggaactgcaactaccagcacggctt

SEQ ID NO: 432564 - DNA, 25 bp, Mus musculus
tccagagccggaactgcaactacca

SEQ ID NO: 432565 - DNA, 25 bp, Mus musculus
atctttgtccagagccggaactgca

SEQ ID NO: 432566 - DNA, 25 bp, Mus musculus
agcagcatctttgtccagagccgga

SEQ ID NO: 432567 - DNA, 25 bp, Mus musculus
agctgacgaagatgtgcacgattcg

SEQ ID NO: 432568 - DNA, 25 bp, Mus musculus
agtgcctggtcgctcttcttcttct

SEQ ID NO: 432569 - DNA, 25 bp, Mus musculus
ctccagtttgacgttgcctgtgctg

SEQ ID NO: 432570 - DNA, 25 bp, Mus musculus
tgtccttgtacatcttgttgcggtg

SEQ ID NO: 432571 - DNA, 25 bp, Mus musculus
cttgttgcggtgcttcttgcacatc

SEQ ID NO: 432572 - DNA, 25 bp, Mus musculus
cttgcacatccagggcttgcgctgc

SEQ ID NO: 432573 - DNA, 25 bp, Mus musculus
tgcttggccacctggctggtggtct

SEQ ID NO: 432574 - DNA, 25 bp, Mus musculus
agccctcgtacgtgcaggtcttgga

SEQ ID NO: 432575 - DNA, 25 bp, Mus musculus
tccgatgtgtccagcaggtcggcgt

SEQ ID NO: 432576 - DNA, 25 bp, Mus musculus
atcaccagcaccgtcaccggagggg

SEQ ID NO: 432577 - DNA, 25 bp, Mus musculus
gcggcccgtcagctcttgagaaaca

SEQ ID NO: 432578 - DNA, 25 bp, Mus musculus
acaaccgtactcgacaagcggcagc

SEQ ID NO: 432579 - DNA, 25 bp, Mus musculus
tccgcgagcctctgcttgggaacgg

SEQ ID NO: 432580 - DNA, 25 bp, Mus musculus
tgcgagacagaaccgactgcgcctg

SEQ ID NO: 432581 - DNA, 25 bp, Mus musculus
gaggagcaagcatacctccagtttg

SEQ ID NO: 432582 - DNA, 25 bp, Mus musculus
tctagaacgccttgagtcttccttg

SEQ ID NO: 432583 - DNA, 25 bp, Mus musculus
cagaacgggattcccgctcgccgta

SEQ ID NO: 432584 - DNA, 25 bp, Mus musculus
cacttcgggaagcagaacgggattc

SEQ ID NO: 432585 - DNA, 25 bp, Mus musculus
gatccgtgagcacttccacttcggg

SEQ ID NO: 432586 - DNA, 25 bp, Mus musculus
gtcttccttggagcgagaccttgca

SEQ ID NO: 432587 - DNA, 25 bp, Mus musculus
cctggacctggactttgatctagaa

SEQ ID NO: 432588 - DNA, 25 bp, Mus musculus
ctagacctagattcagacctggacc

SEQ ID NO: 432589 - DNA, 25 bp, Mus musculus
gccttctagaacttcttctggatct

SEQ ID NO: 432590 - DNA, 25 bp, Mus musculus
gtgaccttgtataatgccttctaga

SEQ ID NO: 432591 - DNA, 25 bp, Mus musculus
gagatcgtgatcgtgaccttgtata

SEQ ID NO: 432592 - DNA, 25 bp, Mus musculus
atcgtctatgcgagcgagatcgtga

SEQ ID NO: 432593 - DNA, 25 bp, Mus musculus
acctgctccgggatcgtctatgcga

SEQ ID NO: 432594 - DNA, 25 bp, Mus musculus
taatctcggctgtaagacctgctcc

SEQ ID NO: 432595 - DNA, 25 bp, Mus musculus
caggtgtatgccgtgcagatttccc

SEQ ID NO: 432596 - DNA, 25 bp, Mus musculus
ccgcaccctcgcacgcgatcgcgca

SEQ ID NO: 432597 - DNA, 25 bp, Mus musculus
gggcacgcctgaacacactcgctca

SEQ ID NO: 432598 - DNA, 25 bp, Mus musculus
actcgctcacactccggctcccacg

SEQ ID NO: 432599 - DNA, 25 bp, Mus musculus
tctccgcgctcgtaagaggctccgg

SEQ ID NO: 432600 - DNA, 25 bp, Mus musculus
cgggatgacccagacgcggctccga

SEQ ID NO: 432601 - DNA, 25 bp, Mus musculus
tccgcacggccaccaggagccagtc

SEQ ID NO: 432602 - DNA, 25 bp, Mus musculus
aggagccagtcaccacctaccttgc

SEQ ID NO: 432603 - DNA, 25 bp, Mus musculus
tgctcgccgcggtccatgtctgagc

SEQ ID NO: 432604 - DNA, 25 bp, Mus musculus
atgtctgagccacctcgctcccggc

SEQ ID NO: 432605 - DNA, 25 bp, Mus musculus
ggcgtcaccgaccacctgaccgcga

SEQ ID NO: 432606 - DNA, 25 bp, Mus musculus
tgaccgcgacctgtgcgctccgcca

SEQ ID NO: 432607 - DNA, 25 bp, Mus musculus
gcgctttgcactggcgcggaatgaa

SEQ ID NO: 432608 - DNA, 25 bp, Mus musculus
ctggcgcggaatgaaagcaaagacg

SEQ ID NO: 432609 - DNA, 25 bp, Mus musculus
tgcgcgcatcctaacacctctgtgg

SEQ ID NO: 432610 - DNA, 25 bp, Mus musculus
cccgaggacgagtccaccgacgtgg

SEQ ID NO: 432611 - DNA, 25 bp, Mus musculus
tccaccgacgtggacagcgatgtgg

SEQ ID NO: 432612 - DNA, 25 bp, Mus musculus
acagcgatgtgggaaacagctccag

SEQ ID NO: 432613 - DNA, 25 bp, Mus musculus
acagctccaggaaagttccattctc

SEQ ID NO: 432614 - DNA, 25 bp, Mus musculus
ccacacttccggcaaatccagatga

SEQ ID NO: 432615 - DNA, 25 bp, Mus musculus
ttccggcaaatccagatgatgagtc

SEQ ID NO: 432616 - DNA, 25 bp, Mus musculus
ccagatgatgagtcagcctccgaca

SEQ ID NO: 432617 - DNA, 25 bp, Mus musculus
gcctccgacatctctacgaagaggg

SEQ ID NO: 432618 - DNA, 25 bp, Mus musculus
acatctctacgaagaggggaggtgt

SEQ ID NO: 432619 - DNA, 25 bp, Mus musculus
gaggtgtgagcaggcacgctcaaac

SEQ ID NO: 432620 - DNA, 25 bp, Mus musculus
agcaggcacgctcaaacgttggtcc

SEQ ID NO: 432621 - DNA, 25 bp, Mus musculus
tcaaacgttggtccgcgtccagtcc

SEQ ID NO: 432622 - DNA, 25 bp, Mus musculus
ccgtgttcgcgtccgcgtccggagt

SEQ ID NO: 432623 - DNA, 25 bp, Mus musculus
gtccgcgtccagtccgtgttcgcgt

SEQ ID NO: 432624 - DNA, 25 bp, Mus musculus
caggcgctctggagctaggacagca

SEQ ID NO: 432625 - DNA, 25 bp, Mus musculus
gacagcacggcgttctaacgaggga

SEQ ID NO: 432626 - DNA, 25 bp, Mus musculus
ttctaacgagggaggagcttacacc

SEQ ID NO: 432627 - DNA, 25 bp, Mus musculus
cagagcgcacgagcggcgagcgcaa

SEQ ID NO: 432628 - DNA, 25 bp, Mus musculus
gagctaggacagcacggcgttctaa

SEQ ID NO: 432629 - DNA, 25 bp, Mus musculus
gccatgcgaccaatggcagagagct

SEQ ID NO: 432630 - DNA, 25 bp, Mus musculus
ctgggctctgcgctgtccctcctcc

SEQ ID NO: 432631 - DNA, 25 bp, Mus musculus
atcctagggaatgcacctcgcgggg

SEQ ID NO: 432632 - DNA, 25 bp, Mus musculus
ccacgacgatcctagggaatgcacc

SEQ ID NO: 432633 - DNA, 25 bp, Mus musculus
ggcagcggccctgtcttgacgacgt

SEQ ID NO: 432634 - DNA, 25 bp, Mus musculus
gcggccctgtcttgacgacgtgcgc

SEQ ID NO: 432635 - DNA, 25 bp, Mus musculus
ttacaccctggttggaggacgagga

SEQ ID NO: 432636 - DNA, 25 bp, Mus musculus
cgagggaggagcttacaccctggtt

SEQ ID NO: 432637 - DNA, 25 bp, Mus musculus
ctccggggccatgcgaccaatggca

SEQ ID NO: 432638 - DNA, 25 bp, Mus musculus
gccggttccagcagcctcggctagt

SEQ ID NO: 432639 - DNA, 25 bp, Mus musculus
agcagagccgcttccatgccaaccg

SEQ ID NO: 432640 - DNA, 25 bp, Mus musculus
cacacggtagcctccctgaaaggga

SEQ ID NO: 432641 - DNA, 25 bp, Mus musculus
ccctctggtcgatgtcaccagggag

SEQ ID NO: 432642 - DNA, 25 bp, Mus musculus
gcaaagccaggcgtgccaggcgcac

SEQ ID NO: 432643 - DNA, 25 bp, Mus musculus
cgggctcctgaaccgcaaagccagg

SEQ ID NO: 432644 - DNA, 25 bp, Mus musculus
gccgcgtctgttgaatcagccaatc

SEQ ID NO: 432645 - DNA, 25 bp, Mus musculus
cgacccagccgcgtctgttgaatca

SEQ ID NO: 432646 - DNA, 25 bp, Mus musculus
actgaggactttcgacccagccgcg

SEQ ID NO: 432647 - DNA, 25 bp, Mus musculus
cccgagaaccctggctcgggagagc

SEQ ID NO: 432648 - DNA, 25 bp, Mus musculus
ttccagcagcctcggctagtgcgct

SEQ ID NO: 432649 - DNA, 25 bp, Mus musculus
tagcctccctgaaagggacagttcc

SEQ ID NO: 432650 - DNA, 25 bp, Mus musculus
ggctagtgcgctcgccactgaggac

SEQ ID NO: 432651 - DNA, 25 bp, Mus musculus
tgacggcggcttacacacggtagcc

SEQ ID NO: 432652 - DNA, 25 bp, Mus musculus
ccgtgcgcctttggaaggtcagagt

SEQ ID NO: 432653 - DNA, 25 bp, Mus musculus
gccggacctagagggcgtcacgcgg

SEQ ID NO: 432654 - DNA, 25 bp, Mus musculus
gccggaagctgtcattgccgtggca

SEQ ID NO: 432655 - DNA, 25 bp, Mus musculus
tcacgcggggctttgtgagccgggt

SEQ ID NO: 432656 - DNA, 25 bp, Mus musculus
gtcagagtgggcagaagctcagctc

SEQ ID NO: 432657 - DNA, 25 bp, Mus musculus
acccgtgcgcctttggaaggtcaga

SEQ ID NO: 432658 - DNA, 25 bp, Mus musculus
ctacccgtgcgcctttggaaggtca

SEQ ID NO: 432659 - DNA, 25 bp, Mus musculus
gctggctacccgtgcgcctttggaa

SEQ ID NO: 432660 - DNA, 25 bp, Mus musculus
gggcctgcagttgcgcgctctccgt

SEQ ID NO: 432661 - DNA, 25 bp, Mus musculus
tccgacgtggcctgggcctggctga

SEQ ID NO: 432662 - DNA, 25 bp, Mus musculus
cagggcagccggtacggagtgcgca

SEQ ID NO: 432663 - DNA, 25 bp, Mus musculus
attgccgtggcactgcgggtccctt

SEQ ID NO: 432664 - DNA, 25 bp, Mus musculus
ctgtcattgccgtggcactgcgggt

SEQ ID NO: 432665 - DNA, 25 bp, Mus musculus
agaagctcagctccgcgccggtgtg

SEQ ID NO: 432666 - DNA, 25 bp, Mus musculus
tccggccaggaagcgttgtgtgccc

SEQ ID NO: 432667 - DNA, 25 bp, Mus musculus
ccagcgcatcagtgcactagcggtc

SEQ ID NO: 432668 - DNA, 25 bp, Mus musculus
tgagcgagtgagacacaagaaaagc

SEQ ID NO: 432669 - DNA, 25 bp, Mus musculus
cacaagaaaagcttgcgcgccaccg

SEQ ID NO: 432670 - DNA, 25 bp, Mus musculus
gctgagcggagaaccgcatttcaat

SEQ ID NO: 432671 - DNA, 25 bp, Mus musculus
cgcatttcaatgaggaccagctcca

SEQ ID NO: 432672 - DNA, 25 bp, Mus musculus
ggaccagctccagcgcatcagtgca

SEQ ID NO: 432673 - DNA, 25 bp, Mus musculus
tgcactagcggtcgcagcttccaga

SEQ ID NO: 432674 - DNA, 25 bp, Mus musculus
gtcgcagcttccagacgctcgtgct

SEQ ID NO: 432675 - DNA, 25 bp, Mus musculus
ggtgccgtctgaccgcagccctgga

SEQ ID NO: 432676 - DNA, 25 bp, Mus musculus
cctggaagccctggccaggatggac

SEQ ID NO: 432677 - DNA, 25 bp, Mus musculus
cgttcctcgaaagacggctgctctg

SEQ ID NO: 432678 - DNA, 25 bp, Mus musculus
ctgctctgggctggctagtttggtc

SEQ ID NO: 432679 - DNA, 25 bp, Mus musculus
ctggctagtttggtccggccaggaa

SEQ ID NO: 432680 - DNA, 25 bp, Mus musculus
agcctggcccgcaacactctagttt

SEQ ID NO: 432681 - DNA, 25 bp, Mus musculus
ccagtgtccggttttatgtaaatca

SEQ ID NO: 432682 - DNA, 25 bp, Mus musculus
cagcacacgcttggctggggccatt

SEQ ID NO: 432683 - DNA, 25 bp, Mus musculus
ctcttgctccaagcgaaaatcgttc

SEQ ID NO: 432684 - DNA, 25 bp, Mus musculus
atcgttcggaaaaggcctcagttgc

SEQ ID NO: 432685 - DNA, 25 bp, Mus musculus
ggcctcagttgcatcaattagtttg

SEQ ID NO: 432686 - DNA, 25 bp, Mus musculus
ttagtttgcgcagaatgcttcggtg

SEQ ID NO: 432687 - DNA, 25 bp, Mus musculus
cgagcccagaaagatgcgccacctg

SEQ ID NO: 432688 - DNA, 25 bp, Mus musculus
tccttctgttggactgagggaacca

SEQ ID NO: 432689 - DNA, 25 bp, Mus musculus
ctcggcgtcgaagctacatcgagtc

SEQ ID NO: 432690 - DNA, 25 bp, Mus musculus
catcgagtcccatagtccggggtga

SEQ ID NO: 432691 - DNA, 25 bp, Mus musculus
ttcctgggtgttctgagtacagcac

SEQ ID NO: 432692 - DNA, 25 bp, Mus musculus
atgtaaatcactgtcggctccgggc

SEQ ID NO: 432693 - DNA, 25 bp, Mus musculus
tgcttcggtgtttagcttcgcctta

SEQ ID NO: 432694 - DNA, 25 bp, Mus musculus
ttcgcgcaaaagtaaccgcgctcct

SEQ ID NO: 432695 - DNA, 25 bp, Mus musculus
ccagcgatcggtcagggctgttaaa

SEQ ID NO: 432696 - DNA, 25 bp, Mus musculus
ccagacatgaccaatccagccagtg

SEQ ID NO: 432697 - DNA, 25 bp, Mus musculus
cccaagcagggaaggtctctcccgg

SEQ ID NO: 432698 - DNA, 25 bp, Mus musculus
tgtgaatgctgctttcccggaccca

SEQ ID NO: 432699 - DNA, 25 bp, Mus musculus
agtgttttccttcaacgagcgtgtg

SEQ ID NO: 432700 - DNA, 25 bp, Mus musculus
acgcacagaggtgacaagtgttttc

SEQ ID NO: 432701 - DNA, 25 bp, Mus musculus
ggcgccgacagccactgacagattc

SEQ ID NO: 432702 - DNA, 25 bp, Mus musculus
ttgggagaaaaacaagcgaggcgcc

SEQ ID NO: 432703 - DNA, 25 bp, Mus musculus
gtcacttgttaaccttccgatctcc

SEQ ID NO: 432704 - DNA, 25 bp, Mus musculus
ggcctcagcccaatgtcacttgtta

SEQ ID NO: 432705 - DNA, 25 bp, Mus musculus
gcagctagcgttaggcctcagccca

SEQ ID NO: 432706 - DNA, 25 bp, Mus musculus
actccggagtggcatgtggtgcaat

SEQ ID NO: 432707 - DNA, 25 bp, Mus musculus
tccatgctcccagcggggcagctag

SEQ ID NO: 432708 - DNA, 25 bp, Mus musculus
tagcagccgcattggatcccacagc

SEQ ID NO: 432709 - DNA, 25 bp, Mus musculus
tggaattcatcaccgcctctggcta

SEQ ID NO: 432710 - DNA, 25 bp, Mus musculus
agcatgtccctctgggtggaattca

SEQ ID NO: 432711 - DNA, 25 bp, Mus musculus
ctacgagggcctggaggttatctct

SEQ ID NO: 432712 - DNA, 25 bp, Mus musculus
ccctcaatgagatggacaaccgcta

SEQ ID NO: 432713 - DNA, 25 bp, Mus musculus
tgcaggaaccgcgtttcatcagctc

SEQ ID NO: 432714 - DNA, 25 bp, Mus musculus
aagtggtctccgacgtcctgaagga

SEQ ID NO: 432715 - DNA, 25 bp, Mus musculus
catccgggaagtctgcaaagtggtc

SEQ ID NO: 432716 - DNA, 25 bp, Mus musculus
tgccatcgccaaaaccatccgggaa

SEQ ID NO: 432717 - DNA, 25 bp, Mus musculus
ccctgctgcagctagtccgagagag

SEQ ID NO: 432718 - DNA, 25 bp, Mus musculus
gcctattgcgagactccggtgtaca

SEQ ID NO: 432719 - DNA, 25 bp, Mus musculus
accgaagttggctccagcgctagca

SEQ ID NO: 432720 - DNA, 25 bp, Mus musculus
ctggctacctctcggcacgcaaaat

SEQ ID NO: 432721 - DNA, 25 bp, Mus musculus
gccaagctggtctaccacctgaata

SEQ ID NO: 432722 - DNA, 25 bp, Mus musculus
tcttgccggcgcaggcccgacccaa

SEQ ID NO: 432723 - DNA, 25 bp, Mus musculus
ttggctcctgcacggctttccggag

SEQ ID NO: 432724 - DNA, 25 bp, Mus musculus
cggacagtggagttggctcctgcac

SEQ ID NO: 432725 - DNA, 25 bp, Mus musculus
gcccggcagaggagcgacacggctc

SEQ ID NO: 432726 - DNA, 25 bp, Mus musculus
ttcaggaacccgaccgcccggcaga

SEQ ID NO: 432727 - DNA, 25 bp, Mus musculus
tgtgggtcgccttcaggaacccgac

SEQ ID NO: 432728 - DNA, 25 bp, Mus musculus
gactatgtgggtcgccttcaggaac

SEQ ID NO: 432729 - DNA, 25 bp, Mus musculus
aagccgactatgtgggtcgccttca

SEQ ID NO: 432730 - DNA, 25 bp, Mus musculus
cccaaagccgactatgtgggtcgcc

SEQ ID NO: 432731 - DNA, 25 bp, Mus musculus
gtccggcccaaagccgactatgtgg

SEQ ID NO: 432732 - DNA, 25 bp, Mus musculus
ggagtccggcccaaagccgactatg

SEQ ID NO: 432733 - DNA, 25 bp, Mus musculus
cctaggctggcttcggtagggctaa

SEQ ID NO: 432734 - DNA, 25 bp, Mus musculus
cgcagtccagcccgcggtttctaag

SEQ ID NO: 432735 - DNA, 25 bp, Mus musculus
ctcctgcacggctttccggaggggt

SEQ ID NO: 432736 - DNA, 25 bp, Mus musculus
cgcttaccaggttgagcacggtctc

SEQ ID NO: 432737 - DNA, 25 bp, Mus musculus
ccaccggcgccgctgttgttgtgaa

SEQ ID NO: 432738 - DNA, 25 bp, Mus musculus
tgagcacggtctccacgatgtccct

SEQ ID NO: 432739 - DNA, 25 bp, Mus musculus
gccgacctgtatgagtccgatcaga

SEQ ID NO: 432740 - DNA, 25 bp, Mus musculus
agtccgatcagaacggcgaatttca

SEQ ID NO: 432741 - DNA, 25 bp, Mus musculus
acggcgaatttcatacggatgttgc

SEQ ID NO: 432742 - DNA, 25 bp, Mus musculus
catacggatgttgcggatcggcacc

SEQ ID NO: 432743 - DNA, 25 bp, Mus musculus
atcggcaccgaagggttgatcatgc

SEQ ID NO: 432744 - DNA, 25 bp, Mus musculus
agggttgatcatgcccgccggcagc

SEQ ID NO: 432745 - DNA, 25 bp, Mus musculus
cgcctccggggacagcctcaagggt

SEQ ID NO: 432746 - DNA, 25 bp, Mus musculus
ggacagcctcaagggtcgcttccga

SEQ ID NO: 432747 - DNA, 25 bp, Mus musculus
caagggtcgcttccgaggtctcctc

SEQ ID NO: 432748 - DNA, 25 bp, Mus musculus
tgttgctgacctcgccgacctgtat

SEQ ID NO: 432749 - DNA, 25 bp, Mus musculus
gaggatgccgcctcgtctcgcacgg

SEQ ID NO: 432750 - DNA, 25 bp, Mus musculus
agcaacaactgcttcccgttttgga

SEQ ID NO: 432751 - DNA, 25 bp, Mus musculus
tctgtgtcaggtgtgggtcgatgct

SEQ ID NO: 432752 - DNA, 25 bp, Mus musculus
cttctctggcggtgatggcgaaagt

SEQ ID NO: 432753 - DNA, 25 bp, Mus musculus
ctggctcttctctggcggtgatggc

SEQ ID NO: 432754 - DNA, 25 bp, Mus musculus
cgtgcttcgatctggctggctcttc

SEQ ID NO: 432755 - DNA, 25 bp, Mus musculus
ctagcgtgcttcgatctggctggct

SEQ ID NO: 432756 - DNA, 25 bp, Mus musculus
caaactgcttcctggggcgaaggga

SEQ ID NO: 432757 - DNA, 25 bp, Mus musculus
gaggcaaactgcttcctggggcgaa

SEQ ID NO: 432758 - DNA, 25 bp, Mus musculus
ttttggaggcaaactgcttcctggg

SEQ ID NO: 432759 - DNA, 25 bp, Mus musculus
tcccgttttggaggcaaactgcttc

SEQ ID NO: 432760 - DNA, 25 bp, Mus musculus
tgcttcccgttttggaggcaaactg

SEQ ID NO: 432761 - DNA, 25 bp, Mus musculus
caactgcttcccgttttggaggcaa

SEQ ID NO: 432762 - DNA, 25 bp, Mus musculus
gtcgatgctcaggaggccgcgctgg

SEQ ID NO: 432763 - DNA, 25 bp, Mus musculus
ccgcctcctgggaagcaacaactgc

SEQ ID NO: 432764 - DNA, 25 bp, Mus musculus
aatggaattggagggcctggagccc

SEQ ID NO: 432765 - DNA, 25 bp, Mus musculus
ccgccgccgaggacgtcaaggagtt

SEQ ID NO: 432766 - DNA, 25 bp, Mus musculus
ccgccgaggacgtcaaggagttgct

SEQ ID NO: 432767 - DNA, 25 bp, Mus musculus
ccgaggacgtcaaggagttgctgct

SEQ ID NO: 432768 - DNA, 25 bp, Mus musculus
ggacgtcaaggagttgctgctgctc

SEQ ID NO: 432769 - DNA, 25 bp, Mus musculus
acgtcaaggagttgctgctgctccc

SEQ ID NO: 432770 - DNA, 25 bp, Mus musculus
tcaaggagttgctgctgctccctca

SEQ ID NO: 432771 - DNA, 25 bp, Mus musculus
aaggagttgctgctgctccctcagg

SEQ ID NO: 432772 - DNA, 25 bp, Mus musculus
aggagttgctgctgctccctcagga

SEQ ID NO: 432773 - DNA, 25 bp, Mus musculus
agttgctgctgctccctcaggacac

SEQ ID NO: 432774 - DNA, 25 bp, Mus musculus
gttgctgctgctccctcaggacacg

SEQ ID NO: 432775 - DNA, 25 bp, Mus musculus
tgctgctgctccctcaggacacggg

SEQ ID NO: 432776 - DNA, 25 bp, Mus musculus
tgctgctccctcaggacacgggcgg

SEQ ID NO: 432777 - DNA, 25 bp, Mus musculus
gggccgacgaggaaatggaattgga

SEQ ID NO: 432778 - DNA, 25 bp, Mus musculus
acgctccgccggctttattgtcggc

SEQ ID NO: 432779 - DNA, 25 bp, Mus musculus
tgggcgcacggtccgttgttcattt

SEQ ID NO: 432780 - DNA, 25 bp, Mus musculus
cagcggttactgctaccccggtgca

SEQ ID NO: 432781 - DNA, 25 bp, Mus musculus
acggtccgttgttcatttgccattc

SEQ ID NO: 432782 - DNA, 25 bp, Mus musculus
ctggtcggacggaaacgctccgccg

SEQ ID NO: 432783 - DNA, 25 bp, Mus musculus
gggaggcctcttcttggcctccgca

SEQ ID NO: 432784 - DNA, 25 bp, Mus musculus
ccggctttattgtcggctcgctatg

SEQ ID NO: 432785 - DNA, 25 bp, Mus musculus
tttattgtcggctcgctatgtggcg

SEQ ID NO: 432786 - DNA, 25 bp, Mus musculus
tcctcaacttcgaaggccgcacgcg

SEQ ID NO: 432787 - DNA, 25 bp, Mus musculus
cgcgccatgtcgttcagtgagatga

SEQ ID NO: 432788 - DNA, 25 bp, Mus musculus
tcagtgagatgaaccgcaggacgct

SEQ ID NO: 432789 - DNA, 25 bp, Mus musculus
aaccgcaggacgctggcgttccgag

SEQ ID NO: 432790 - DNA, 25 bp, Mus musculus
agccgcaaccgcgactgcccgcgcc

SEQ ID NO: 432791 - DNA, 25 bp, Mus musculus
atttgccattcgacctccgccaggg

SEQ ID NO: 432792 - DNA, 25 bp, Mus musculus
tcctgcgtgacgtggatgacttgct

SEQ ID NO: 432793 - DNA, 25 bp, Mus musculus
agccgaaggcttatcctcttacatc

SEQ ID NO: 432794 - DNA, 25 bp, Mus musculus
gcagctcgtcggtcacgtcatagga

SEQ ID NO: 432795 - DNA, 25 bp, Mus musculus
cacgtcataggactgctggcggaga

SEQ ID NO: 432796 - DNA, 25 bp, Mus musculus
ccgcctgatgagtctgtgctggatt

SEQ ID NO: 432797 - DNA, 25 bp, Mus musculus
gcgagccggaatcgggctccttaaa

SEQ ID NO: 432798 - DNA, 25 bp, Mus musculus
ccgggaggatctttttccgccatga

SEQ ID NO: 432799 - DNA, 25 bp, Mus musculus
tcatgacagagttgaagagggcttc

SEQ ID NO: 432800 - DNA, 25 bp, Mus musculus
tcagatcagccttttggtgcaagtc

SEQ ID NO: 432801 - DNA, 25 bp, Mus musculus
tggcctccgagattatgcaactttc

SEQ ID NO: 432802 - DNA, 25 bp, Mus musculus
tcccgactgcggtcgtctaagagcc

SEQ ID NO: 432803 - DNA, 25 bp, Mus musculus
cgcctcccgaactgacgagctggaa

SEQ ID NO: 432804 - DNA, 25 bp, Mus musculus
cggattcccagcagccgaaggctta

SEQ ID NO: 432805 - DNA, 25 bp, Mus musculus
caccgaggacggattcatctttcta

SEQ ID NO: 432806 - DNA, 25 bp, Mus musculus
cgcgaggccagactttccacggaag

SEQ ID NO: 432807 - DNA, 25 bp, Mus musculus
ccatatttggtctgctggggagaca

SEQ ID NO: 432808 - DNA, 25 bp, Mus musculus
agacaacttggctgtttggctttca

SEQ ID NO: 432809 - DNA, 25 bp, Mus musculus
ttggctttcagttgtctgcgagacg

SEQ ID NO: 432810 - DNA, 25 bp, Mus musculus
ctgcgagacggtttcccaaaaagtg

SEQ ID NO: 432811 - DNA, 25 bp, Mus musculus
tttcccaaaaagtgccgctgttgct

SEQ ID NO: 432812 - DNA, 25 bp, Mus musculus
cggcttcaccgaggagtcgattgta

SEQ ID NO: 432813 - DNA, 25 bp, Mus musculus
catcaatccttagaaggccgagaca

SEQ ID NO: 432814 - DNA, 25 bp, Mus musculus
ggccgagacaaagctgcgttctaga

SEQ ID NO: 432815 - DNA, 25 bp, Mus musculus
gccctcgtcttaaggggagcgccca

SEQ ID NO: 432816 - DNA, 25 bp, Mus musculus
tccacggaaggctgcttaacgcttg

SEQ ID NO: 432817 - DNA, 25 bp, Mus musculus
gcccagcacccggaatgtggcacgg

SEQ ID NO: 432818 - DNA, 25 bp, Mus musculus
gcttaacgcttgtgaccatatttgg

SEQ ID NO: 432819 - DNA, 25 bp, Mus musculus
tgcgttctagaaggccaagcaattg

SEQ ID NO: 432820 - DNA, 25 bp, Mus musculus
cgcaagcactaacttacctgcagtg

SEQ ID NO: 432821 - DNA, 25 bp, Mus musculus
cagtcctaggagcacggtatcgtcc

SEQ ID NO: 432822 - DNA, 25 bp, Mus musculus
ggcgtcgcggtacagcccatgcttt

SEQ ID NO: 432823 - DNA, 25 bp, Mus musculus
tgtgcaggcaaaaagaagttccggc

SEQ ID NO: 432824 - DNA, 25 bp, Mus musculus
cacttccgacctctgtgcaggcaaa

SEQ ID NO: 432825 - DNA, 25 bp, Mus musculus
tagcggctcttcagactttgccacc

SEQ ID NO: 432826 - DNA, 25 bp, Mus musculus
cccatgctttgggttccggttgctg

SEQ ID NO: 432827 - DNA, 25 bp, Mus musculus
tccagcagcattttagcggctcttc

SEQ ID NO: 432828 - DNA, 25 bp, Mus musculus
gctccttgtgctcctcggacaaatc

SEQ ID NO: 432829 - DNA, 25 bp, Mus musculus
gcaggaaggccaagtgctccttgtg

SEQ ID NO: 432830 - DNA, 25 bp, Mus musculus
cgccttcgtagatcttcgggtttga

SEQ ID NO: 432831 - DNA, 25 bp, Mus musculus
tcggaggaactccacggcgatcctc

SEQ ID NO: 432832 - DNA, 25 bp, Mus musculus
tgcagtgtccacttgcggcaggaag

SEQ ID NO: 432833 - DNA, 25 bp, Mus musculus
tcggcgaccactgcaacggaagtca

SEQ ID NO: 432834 - DNA, 25 bp, Mus musculus
atgtatcacgcggttcagaacgaca

SEQ ID NO: 432835 - DNA, 25 bp, Mus musculus
cgggctcctctgctacgtgcagtga

SEQ ID NO: 432836 - DNA, 25 bp, Mus musculus
ttcaggtaagaaccagcgtggctcc

SEQ ID NO: 432837 - DNA, 25 bp, Mus musculus
ctcagtcatgaagtccgggtagcga

SEQ ID NO: 432838 - DNA, 25 bp, Mus musculus
ggctcagtgcggatactcagtcatg

SEQ ID NO: 432839 - DNA, 25 bp, Mus musculus
cccttctccgacttgcttgggtagg

SEQ ID NO: 432840 - DNA, 25 bp, Mus musculus
gcaagccaatcatctgcggatcagg

SEQ ID NO: 432841 - DNA, 25 bp, Mus musculus
gacactcaaaaactgggcaattctc

SEQ ID NO: 432842 - DNA, 25 bp, Mus musculus
ttcgctagggcctcactctgcaagc

SEQ ID NO: 432843 - DNA, 25 bp, Mus musculus
ggtgcaagacacttcgcggctcttc

SEQ ID NO: 432844 - DNA, 25 bp, Mus musculus
acctggattccagcgcaaggcgtca

SEQ ID NO: 432845 - DNA, 25 bp, Mus musculus
ggcaattctcccaacccagcagagg

SEQ ID NO: 432846 - DNA, 25 bp, Mus musculus
tttacctccgagtatgggccaatga

SEQ ID NO: 432847 - DNA, 25 bp, Mus musculus
ccgttcctaatagggatgatgtatc

SEQ ID NO: 432848 - DNA, 25 bp, Mus musculus
caccggctaggaggcgaagcagctt

SEQ ID NO: 432849 - DNA, 25 bp, Mus musculus
gaggcctcaccaccggctaggaggc

SEQ ID NO: 432850 - DNA, 25 bp, Mus musculus
aatcacggcccacacgtgcgggagg

SEQ ID NO: 432851 - DNA, 25 bp, Mus musculus
gataccgccggggacaatcacggcc

SEQ ID NO: 432852 - DNA, 25 bp, Mus musculus
acatcaagttatccacgtagctctg

SEQ ID NO: 432853 - DNA, 25 bp, Mus musculus
tagctctgccaaccggccatcttcg

SEQ ID NO: 432854 - DNA, 25 bp, Mus musculus
gtagccgacaatggcggcctcctgg

SEQ ID NO: 432855 - DNA, 25 bp, Mus musculus
tttggcgtcgcagtagccgacaatg

SEQ ID NO: 432856 - DNA, 25 bp, Mus musculus
cccagacgtatttggcgtcgcagta

SEQ ID NO: 432857 - DNA, 25 bp, Mus musculus
ccggccgtggctgcccagacgtatt

SEQ ID NO: 432858 - DNA, 25 bp, Mus musculus
caccgtgatgctctggaagacgccc

SEQ ID NO: 432859 - DNA, 25 bp, Mus musculus
ggcctcaccgtgatgctctggaaga

SEQ ID NO: 432860 - DNA, 25 bp, Mus musculus
gcgcgtgcgtgcgatccttccgcag

SEQ ID NO: 432861 - DNA, 25 bp, Mus musculus
ggcagcagccatcgcacatcaagtt

SEQ ID NO: 432862 - DNA, 25 bp, Mus musculus
gcgtcccgctgaaaaagtgcctcct

SEQ ID NO: 432863 - DNA, 25 bp, Mus musculus
gagcgtcacccgctgctgagcagca

SEQ ID NO: 432864 - DNA, 25 bp, Mus musculus
ggcagaggtctaccagcgcctcgcg

SEQ ID NO: 432865 - DNA, 25 bp, Mus musculus
aggctgctgcgtcccatctgcggga

SEQ ID NO: 432866 - DNA, 25 bp, Mus musculus
accgcagcgcatcgcttcaggagtc

SEQ ID NO: 432867 - DNA, 25 bp, Mus musculus
tcaggagtcggaacaccagcacctc

SEQ ID NO: 432868 - DNA, 25 bp, Mus musculus
agcagcagccgccttgggcgtatcc

SEQ ID NO: 432869 - DNA, 25 bp, Mus musculus
ctcccgtgcagagccgcagtttcaa

SEQ ID NO: 432870 - DNA, 25 bp, Mus musculus
tgcagagccgcagtttcaaacctac

SEQ ID NO: 432871 - DNA, 25 bp, Mus musculus
tttcaaacctacaccagcaccaggg

SEQ ID NO: 432872 - DNA, 25 bp, Mus musculus
caggcacagcggaaatggacgtgct

SEQ ID NO: 432873 - DNA, 25 bp, Mus musculus
aatggacgtgctgtagaccacgccc

SEQ ID NO: 432874 - DNA, 25 bp, Mus musculus
ccggaagagcgtcacccgctgctga

SEQ ID NO: 432875 - DNA, 25 bp, Mus musculus
cagagcagccgtgctgagctgctgc

SEQ ID NO: 432876 - DNA, 25 bp, Mus musculus
ccctgccacttgtagttcgcgtttc

SEQ ID NO: 432877 - DNA, 25 bp, Mus musculus
caggcgcgaactcggactttgtctt

SEQ ID NO: 432878 - DNA, 25 bp, Mus musculus
ccaggtccggggattgcattagaca

SEQ ID NO: 432879 - DNA, 25 bp, Mus musculus
gattcggatagcagcgtcctcacca

SEQ ID NO: 432880 - DNA, 25 bp, Mus musculus
cgcgtttccgcgtgatcaaactaga

SEQ ID NO: 432881 - DNA, 25 bp, Mus musculus
ctgggccgagtagtgcaactccatc

SEQ ID NO: 432882 - DNA, 25 bp, Mus musculus
cctcatcctggatgggcagctggca

SEQ ID NO: 432883 - DNA, 25 bp, Mus musculus
acaatgtcggggatgcggaaactcc

SEQ ID NO: 432884 - DNA, 25 bp, Mus musculus
tcctcggaagagacgctcaacaatg

SEQ ID NO: 432885 - DNA, 25 bp, Mus musculus
aggacgtgtcctccgagatcttcga

SEQ ID NO: 432886 - DNA, 25 bp, Mus musculus
gtggccaccagcatcaccgaggaca

SEQ ID NO: 432887 - DNA, 25 bp, Mus musculus
tgccggccaagaagaagagctgctt

SEQ ID NO: 432888 - DNA, 25 bp, Mus musculus
gagatcttcgacgtttcccgggcca

SEQ ID NO: 432889 - DNA, 25 bp, Mus musculus
cggccgatggacgtgtatggaatac

SEQ ID NO: 432890 - DNA, 25 bp, Mus musculus
gaactagttcgggttcggctgccaa

SEQ ID NO: 432891 - DNA, 25 bp, Mus musculus
ttgccgcgctgagttatgttcttgc

SEQ ID NO: 432892 - DNA, 25 bp, Mus musculus
gcgagagactcttcctttacggtga

SEQ ID NO: 432893 - DNA, 25 bp, Mus musculus
ccgctgttgacaggtgagttccaaa

SEQ ID NO: 432894 - DNA, 25 bp, Mus musculus
tctctttccgggacaagatggcgcc

SEQ ID NO: 432895 - DNA, 25 bp, Mus musculus
gggttcggcctttcttgaactctca

SEQ ID NO: 432896 - DNA, 25 bp, Mus musculus
ggcgccggaaacaccgactcgcaga

SEQ ID NO: 432897 - DNA, 25 bp, Mus musculus
ctcgggaaccagacgtggattggcc

SEQ ID NO: 432898 - DNA, 25 bp, Mus musculus
ttcggctgccaacgtcagcactggg

SEQ ID NO: 432899 - DNA, 25 bp, Mus musculus
tctcgttggccatacggatcctctg

SEQ ID NO: 432900 - DNA, 25 bp, Mus musculus
cggatcctctgcttggcgaccattt

SEQ ID NO: 432901 - DNA, 25 bp, Mus musculus
ttaccgaggtcttagcgacgttgcc

SEQ ID NO: 432902 - DNA, 25 bp, Mus musculus
gccgagaggcaagagtccaaccacc

SEQ ID NO: 432903 - DNA, 25 bp, Mus musculus
tgcaaccggcaacctcgaactagtt

SEQ ID NO: 432904 - DNA, 25 bp, Mus musculus
tacgatgaggctcctgctgcttctg

SEQ ID NO: 432905 - DNA, 25 bp, Mus musculus
ttcgtggcctagctgcctgcttctt

SEQ ID NO: 432906 - DNA, 25 bp, Mus musculus
tctggctgcgcatgcgcattccggc

SEQ ID NO: 432907 - DNA, 25 bp, Mus musculus
tgttcattcatagaaaaaggaacgg

SEQ ID NO: 432908 - DNA, 25 bp, Mus musculus
cggctctctctggagtgctgccgtg

SEQ ID NO: 432909 - DNA, 25 bp, Mus musculus
cggagcccgtcagttttcggcgtcg

SEQ ID NO: 432910 - DNA, 25 bp, Mus musculus
ccgaggtcccggcttcgtggcctag

SEQ ID NO: 432911 - DNA, 25 bp, Mus musculus
cagatttggtgagtacgcgcggcca

SEQ ID NO: 432912 - DNA, 25 bp, Mus musculus
gggccgctgctcaagttccagattt

SEQ ID NO: 432913 - DNA, 25 bp, Mus musculus
ttaaagatgcagtacgccaccgggc

SEQ ID NO: 432914 - DNA, 25 bp, Mus musculus
gcggcgtgcccagcaagagattaaa

SEQ ID NO: 432915 - DNA, 25 bp, Mus musculus
gcagcgaggcctctgccaacctggg

SEQ ID NO: 432916 - DNA, 25 bp, Mus musculus
ggagcggctgtctcaattacgatga

SEQ ID NO: 432917 - DNA, 25 bp, Mus musculus
cccgtttaaagatcttgttcattca

SEQ ID NO: 432918 - DNA, 25 bp, Mus musculus
ttctctgcgacagtggaagccggca

SEQ ID NO: 432919 - DNA, 25 bp, Mus musculus
ctactcggccggtagcttgacacgc

SEQ ID NO: 432920 - DNA, 25 bp, Mus musculus
ttttagccattgacgcgctggagca

SEQ ID NO: 432921 - DNA, 25 bp, Mus musculus
atcccacgtttcttttagccattga

SEQ ID NO: 432922 - DNA, 25 bp, Mus musculus
cgcaccgactccagctagaagggca

SEQ ID NO: 432923 - DNA, 25 bp, Mus musculus
cagggaaaggacgtagcccgagtct

SEQ ID NO: 432924 - DNA, 25 bp, Mus musculus
ccttgaatgagtcgatcgccgccgc

SEQ ID NO: 432925 - DNA, 25 bp, Mus musculus
ttcctcgctgggagcccttgaatga

SEQ ID NO: 432926 - DNA, 25 bp, Mus musculus
tcagggactggcagagccaccctgc

SEQ ID NO: 432927 - DNA, 25 bp, Mus musculus
cgctaagacacgtgtgcggccgacc

SEQ ID NO: 432928 - DNA, 25 bp, Mus musculus
gcgcgcggacgtgacgctaagacac

SEQ ID NO: 432929 - DNA, 25 bp, Mus musculus
cttgctgcagggtttgttagcgctg

SEQ ID NO: 432930 - DNA, 25 bp, Mus musculus
cagctggcgatcaggctactcggcc

SEQ ID NO: 432931 - DNA, 25 bp, Mus musculus
cactcgcttcaggagcggcagctga

SEQ ID NO: 432932 - DNA, 25 bp, Mus musculus
ctagggaccaacaggtaaactgttg

SEQ ID NO: 432933 - DNA, 25 bp, Mus musculus
cattggtgaagaaagtcacacgttc

SEQ ID NO: 432934 - DNA, 25 bp, Mus musculus
caaccctaacggagcgatggaggct

SEQ ID NO: 432935 - DNA, 25 bp, Mus musculus
gtcctccgagtgcaaagctgcgagc

SEQ ID NO: 432936 - DNA, 25 bp, Mus musculus
tggctgaacccggaggcaccggcct

SEQ ID NO: 432937 - DNA, 25 bp, Mus musculus
tgctcccgatgtgtccgtcggtgct

SEQ ID NO: 432938 - DNA, 25 bp, Mus musculus
aggacgcctagctctcggcgggcac

SEQ ID NO: 432939 - DNA, 25 bp, Mus musculus
gaaagtcacacgttcccatcatctg

SEQ ID NO: 432940 - DNA, 25 bp, Mus musculus
aacctgctttttctcctgcctgcag

SEQ ID NO: 432941 - DNA, 25 bp, Mus musculus
ctgtctgcaaagtgctgctccctgg

SEQ ID NO: 432942 - DNA, 25 bp, Mus musculus
aagtgctgctccctggtgctcagag

SEQ ID NO: 432943 - DNA, 25 bp, Mus musculus
tagccgctagctagggaccaacagg

SEQ ID NO: 432944 - DNA, 25 bp, Mus musculus
agccagacacctcgcaacgtcaaat

SEQ ID NO: 432945 - DNA, 25 bp, Mus musculus
cgcgcagctcgtgcactggctgaac

SEQ ID NO: 432946 - DNA, 25 bp, Mus musculus
ctgccttgccttacccgaggtggca

SEQ ID NO: 432947 - DNA, 25 bp, Mus musculus
tgccttgccttacccgaggtggcag

SEQ ID NO: 432948 - DNA, 25 bp, Mus musculus
tgccttacccgagatggcagagggc

SEQ ID NO: 432949 - DNA, 25 bp, Mus musculus
cgctgccttaccttacccgaggtgg

SEQ ID NO: 432950 - DNA, 25 bp, Mus musculus
tgctgccttgccttacccgagatgg

SEQ ID NO: 432951 - DNA, 25 bp, Mus musculus
gctgccttgccttacccgaggtgga

SEQ ID NO: 432952 - DNA, 25 bp, Mus musculus
acgctgccttgccttacccgaggtg

SEQ ID NO: 432953 - DNA, 25 bp, Mus musculus
ctgccttgccttacccgaggtggac

SEQ ID NO: 432954 - DNA, 25 bp, Mus musculus
gcgctgccttaccttacccgaggtg

SEQ ID NO: 432955 - DNA, 25 bp, Mus musculus
ctgccttgccttacccgagatggca

SEQ ID NO: 432956 - DNA, 25 bp, Mus musculus
cgctgccttgccttacccgagatgg

SEQ ID NO: 432957 - DNA, 25 bp, Mus musculus
tgccttgccttacccgaggtggaca

SEQ ID NO: 432958 - DNA, 25 bp, Mus musculus
cttgccttacccgagatggcagagg

SEQ ID NO: 432959 - DNA, 25 bp, Mus musculus
gctgccttgccttacccgagatggc

SEQ ID NO: 432960 - DNA, 25 bp, Mus musculus
ccttccaggttccaggcgatgcgct

SEQ ID NO: 432961 - DNA, 25 bp, Mus musculus
gtgcaagcttctttcccgcccttcg

SEQ ID NO: 432962 - DNA, 25 bp, Mus musculus
ccaggcgatgcgctgcttctgctgc

SEQ ID NO: 432963 - DNA, 25 bp, Mus musculus
tcggtgacctctgccagggtcgacg

SEQ ID NO: 432964 - DNA, 25 bp, Mus musculus
ctgcaggccgggcagctaactctaa

SEQ ID NO: 432965 - DNA, 25 bp, Mus musculus
gcagctaactctaaccttccgtcta

SEQ ID NO: 432966 - DNA, 25 bp, Mus musculus
ttccgtctaaccttgcgggcctcgc

SEQ ID NO: 432967 - DNA, 25 bp, Mus musculus
gcgataagaggctgcacggcgacat

SEQ ID NO: 432968 - DNA, 25 bp, Mus musculus
tgcacggcgacatgccacagtctct

SEQ ID NO: 432969 - DNA, 25 bp, Mus musculus
agtctctcgccgcagcccgtcgagt

SEQ ID NO: 432970 - DNA, 25 bp, Mus musculus
gctcgccatgctcccgtgacccgga

SEQ ID NO: 432971 - DNA, 25 bp, Mus musculus
gcatcccggagtcgcgatcccacaa

SEQ ID NO: 432972 - DNA, 25 bp, Mus musculus
ccgcgcattgttctgcgctgcgggc

SEQ ID NO: 432973 - DNA, 25 bp, Mus musculus
ggccgggcagctaactctaaccttc

SEQ ID NO: 432974 - DNA, 25 bp, Mus musculus
ttcagcttagatcggtcgcagctcc

SEQ ID NO: 432975 - DNA, 25 bp, Mus musculus
gcgcgtcctgttgtgtaacctccgc

SEQ ID NO: 432976 - DNA, 25 bp, Mus musculus
ggcaccgcgatctctgcttccagag

SEQ ID NO: 432977 - DNA, 25 bp, Mus musculus
gagctgcagccttcatggactgtga

SEQ ID NO: 432978 - DNA, 25 bp, Mus musculus
gctctccaaaagacctccaaggttg

SEQ ID NO: 432979 - DNA, 25 bp, Mus musculus
acctccaaggttgagcgcgggctca

SEQ ID NO: 432980 - DNA, 25 bp, Mus musculus
gccgctgggaacagccgaactactt

SEQ ID NO: 432981 - DNA, 25 bp, Mus musculus
cgaactacttggacttgacccgccg

SEQ ID NO: 432982 - DNA, 25 bp, Mus musculus
tgagcagcgcctatcagtcgccctg

SEQ ID NO: 432983 - DNA, 25 bp, Mus musculus
ttgcaaacttggtggaggtgccctg

SEQ ID NO: 432984 - DNA, 25 bp, Mus musculus
ttgcccgcacgtccttcagcttaga

SEQ ID NO: 432985 - DNA, 25 bp, Mus musculus
agatggccaggcaaagttgatcaga

SEQ ID NO: 432986 - DNA, 25 bp, Mus musculus
ggcgaatttcatggcccgcgacaaa

SEQ ID NO: 432987 - DNA, 25 bp, Mus musculus
tgcgcgggagcgcacttgcaaactt

SEQ ID NO: 432988 - DNA, 25 bp, Mus musculus
tctcctatggcgagggtaaggccct

SEQ ID NO: 432989 - DNA, 25 bp, Mus musculus
gggactcatgccacgcgtgtctcag

SEQ ID NO: 432990 - DNA, 25 bp, Mus musculus
aggcagatgaactacgcggcacagc

SEQ ID NO: 432991 - DNA, 25 bp, Mus musculus
agcctcagtggatgagctattcgca

SEQ ID NO: 432992 - DNA, 25 bp, Mus musculus
cctggtaggcaacaaggtggacttg

SEQ ID NO: 432993 - DNA, 25 bp, Mus musculus
cgagcgcgtacccatgatcctggta

SEQ ID NO: 432994 - DNA, 25 bp, Mus musculus
gcacggagcagttcgcctcaatgcg

SEQ ID NO: 432995 - DNA, 25 bp, Mus musculus
cgctcaccgtgcagttcgtaacagg

SEQ ID NO: 432996 - DNA, 25 bp, Mus musculus
ccgacggagccatgagagagtacaa

SEQ ID NO: 432997 - DNA, 25 bp, Mus musculus
gcattgtcctcagggtcctccgaca

SEQ ID NO: 432998 - DNA, 25 bp, Mus musculus
gcgaagagctccagccgttgtcttg

SEQ ID NO: 432999 - DNA, 25 bp, Mus musculus
atggccagggcttcattctcgtcta

SEQ ID NO: 433000 - DNA, 25 bp, Mus musculus
ctattcgcagagatcgtgaggcaga

SEQ ID NO: 433001 - DNA, 25 bp, Mus musculus
gtgtctcagccggacgcccaattag

SEQ ID NO: 433002 - DNA, 25 bp, Mus musculus
tagtcaataagtacctgaagggaaa

SEQ ID NO: 433003 - DNA, 25 bp, Mus musculus
ggtggttcaggtggatctttccctc

SEQ ID NO: 433004 - DNA, 25 bp, Mus musculus
ccatgctggtggttcaggtggatct

SEQ ID NO: 433005 - DNA, 25 bp, Mus musculus
tgcatgtccggccatgctggtggtt

SEQ ID NO: 433006 - DNA, 25 bp, Mus musculus
ttcaacccagcggtgcatgtccggc

SEQ ID NO: 433007 - DNA, 25 bp, Mus musculus
cccgaggattcaacccagcggtgca

SEQ ID NO: 433008 - DNA, 25 bp, Mus musculus
taaacgggtggaatctgcgcagtcc

SEQ ID NO: 433009 - DNA, 25 bp, Mus musculus
gagaccaatagtcaataagtacctg

SEQ ID NO: 433010 - DNA, 25 bp, Mus musculus
agtgagcgagccagcaagttagccc

SEQ ID NO: 433011 - DNA, 25 bp, Mus musculus
actggccagagagcatgagccagga

SEQ ID NO: 433012 - DNA, 25 bp, Mus musculus
ttgctactggccagagagcatgagc

SEQ ID NO: 433013 - DNA, 25 bp, Mus musculus
ctcgggcatgttgctactggccaga

SEQ ID NO: 433014 - DNA, 25 bp, Mus musculus
ccaactccggggagctcgagagacc

SEQ ID NO: 433015 - DNA, 25 bp, Mus musculus
cgggtggaatctgcgcagtccgccc

SEQ ID NO: 433016 - DNA, 25 bp, Mus musculus
tcggaggtcgtttcctcacaagggc

SEQ ID NO: 433017 - DNA, 25 bp, Mus musculus
cagtcgctcccacgcctagtgtgaa

SEQ ID NO: 433018 - DNA, 25 bp, Mus musculus
ccagtatgcgtgtcctgtgctgaca

SEQ ID NO: 433019 - DNA, 25 bp, Mus musculus
gcctagtgtgaactccatctctcgc

SEQ ID NO: 433020 - DNA, 25 bp, Mus musculus
tctcgtccaggtcgctttcggaggt

SEQ ID NO: 433021 - DNA, 25 bp, Mus musculus
aagccgtgatctctcccgccgagtt

SEQ ID NO: 433022 - DNA, 25 bp, Mus musculus
tcacaagggcgcttcatcgcgacga

SEQ ID NO: 433023 - DNA, 25 bp, Mus musculus
cgacgaaggaggagcagctactgtc

SEQ ID NO: 433024 - DNA, 25 bp, Mus musculus
agctactgtcgcctagcggaacgca

SEQ ID NO: 433025 - DNA, 25 bp, Mus musculus
tcggctcctggaggttctttcccac

SEQ ID NO: 433026 - DNA, 25 bp, Mus musculus
cggtgtggctttctattggttaata

SEQ ID NO: 433027 - DNA, 25 bp, Mus musculus
tttgggccatcacctgcaagccgtg

SEQ ID NO: 433028 - DNA, 25 bp, Mus musculus
tttaaagaataaccgctagcgcgtg

SEQ ID NO: 433029 - DNA, 25 bp, Mus musculus
tcacccagggtaattgttctcgctc

SEQ ID NO: 433030 - DNA, 25 bp, Mus musculus
gttcctctcctcttgctttaaaggc

SEQ ID NO: 433031 - DNA, 25 bp, Mus musculus
acagacacgcctcctggcgggggtt

SEQ ID NO: 433032 - DNA, 25 bp, Mus musculus
cagccgccagcgagagcgcaagtga

SEQ ID NO: 433033 - DNA, 25 bp, Mus musculus
gggtagtcctctcagagctgcggca

SEQ ID NO: 433034 - DNA, 25 bp, Mus musculus
tagggactggggtagtcctctcaga

SEQ ID NO: 433035 - DNA, 25 bp, Mus musculus
cgcacgaactcagccgggcagcggt

SEQ ID NO: 433036 - DNA, 25 bp, Mus musculus
ctggcgagtgcttacctgcggctag

SEQ ID NO: 433037 - DNA, 25 bp, Mus musculus
agggtccaccgctggcgagtgctta

SEQ ID NO: 433038 - DNA, 25 bp, Mus musculus
cgaacgccctgggattgagctccag

SEQ ID NO: 433039 - DNA, 25 bp, Mus musculus
acccacagcgaacgccctgggattg

SEQ ID NO: 433040 - DNA, 25 bp, Mus musculus
tccgcagtgcctccggacccacagc

SEQ ID NO: 433041 - DNA, 25 bp, Mus musculus
gctagtgctcctcgcgggtccgcag

SEQ ID NO: 433042 - DNA, 25 bp, Mus musculus
tgtccgcggctagtgctcctcgcgg

SEQ ID NO: 433043 - DNA, 25 bp, Mus musculus
tcttgctttaaaggcgccgcgcttc

SEQ ID NO: 433044 - DNA, 25 bp, Mus musculus
ctgggtgacaccactagaatgcctc

SEQ ID NO: 433045 - DNA, 25 bp, Mus musculus
gggttccggaatccgccatgttctc

SEQ ID NO: 433046 - DNA, 25 bp, Mus musculus
caccgactctacttgaagatgttta

SEQ ID NO: 433047 - DNA, 25 bp, Mus musculus
gcggatcgcactacttcctcgcttg

SEQ ID NO: 433048 - DNA, 25 bp, Mus musculus
atcacgtgatcggacccagggcaag

SEQ ID NO: 433049 - DNA, 25 bp, Mus musculus
cggagcttggcctcatcacgtgatc

SEQ ID NO: 433050 - DNA, 25 bp, Mus musculus
gcgcccgtttattactcgcttcacg

SEQ ID NO: 433051 - DNA, 25 bp, Mus musculus
tgggagccgctctatgacctaatca

SEQ ID NO: 433052 - DNA, 25 bp, Mus musculus
tcccggcagccgcttttatagtctg

SEQ ID NO: 433053 - DNA, 25 bp, Mus musculus
aagtagaatcctgcggcgacgagtc

SEQ ID NO: 433054 - DNA, 25 bp, Mus musculus
ggacgtgtgacaaaagccaggcctc

SEQ ID NO: 433055 - DNA, 25 bp, Mus musculus
gccattacccgaagcgtagccttta

SEQ ID NO: 433056 - DNA, 25 bp, Mus musculus
ggtttccctcaacagccgcgaggtc

SEQ ID NO: 433057 - DNA, 25 bp, Mus musculus
acggtccttaaaatggccagcgcca

SEQ ID NO: 433058 - DNA, 25 bp, Mus musculus
aatcactgagcgcactccgggaagg

SEQ ID NO: 433059 - DNA, 25 bp, Mus musculus
gtgaccaatggtcgcacggtgtccc

SEQ ID NO: 433060 - DNA, 25 bp, Mus musculus
tgctgatcaccgacttccctgtgga

SEQ ID NO: 433061 - DNA, 25 bp, Mus musculus
ggatttttccagcaacggcgtcacc

SEQ ID NO: 433062 - DNA, 25 bp, Mus musculus
gagcagctttcctcctctcggggct

SEQ ID NO: 433063 - DNA, 25 bp, Mus musculus
ctcttaggcaacctgagcagctttc

SEQ ID NO: 433064 - DNA, 25 bp, Mus musculus
tgtccggaggcaaagttcctttctc

SEQ ID NO: 433065 - DNA, 25 bp, Mus musculus
ttaggctcccagacaagactagttg

SEQ ID NO: 433066 - DNA, 25 bp, Mus musculus
tcggatctcagtcctcggtcgggaa

SEQ ID NO: 433067 - DNA, 25 bp, Mus musculus
ttcatctgatcaactgcggctcgga

SEQ ID NO: 433068 - DNA, 25 bp, Mus musculus
gccagctgaactctttccaagggtc

SEQ ID NO: 433069 - DNA, 25 bp, Mus musculus
gagcggttgtctccgcgctttagta

SEQ ID NO: 433070 - DNA, 25 bp, Mus musculus
ggactacagagctgcttctcctcga

SEQ ID NO: 433071 - DNA, 25 bp, Mus musculus
cgcgctttagtaaggacccaggcca

SEQ ID NO: 433072 - DNA, 25 bp, Mus musculus
cgggacgttgagtgtcacaagcaga

SEQ ID NO: 433073 - DNA, 25 bp, Mus musculus
caaccgctgaaaatggcgtccgggc

SEQ ID NO: 433074 - DNA, 25 bp, Mus musculus
acagaggttgcatcgagctcgagca

SEQ ID NO: 433075 - DNA, 25 bp, Mus musculus
gctctgccaaaactcaaccgctgaa

SEQ ID NO: 433076 - DNA, 25 bp, Mus musculus
ggagccgactagcagctctgccaaa

SEQ ID NO: 433077 - DNA, 25 bp, Mus musculus
cgtagctcattgtcggagccgacta

SEQ ID NO: 433078 - DNA, 25 bp, Mus musculus
cgcggctccagctctgatgatagtc

SEQ ID NO: 433079 - DNA, 25 bp, Mus musculus
ccgatctcgcgacccttaaggtgtg

SEQ ID NO: 433080 - DNA, 25 bp, Mus musculus
ttggcgtaccacaggccgatctcgc

SEQ ID NO: 433081 - DNA, 25 bp, Mus musculus
tcttctgcgtctgcttcttggcgta

SEQ ID NO: 433082 - DNA, 25 bp, Mus musculus
aacgcgtcctgacgagacctccata

SEQ ID NO: 433083 - DNA, 25 bp, Mus musculus
tcgagcaaacgccagggagagcaaa

SEQ ID NO: 433084 - DNA, 25 bp, Mus musculus
gttctggccagaaacttagctcctg

SEQ ID NO: 433085 - DNA, 25 bp, Mus musculus
caagcagacatttccggtgacgtca

SEQ ID NO: 433086 - DNA, 25 bp, Mus musculus
agacagagcactcttcccgcagcag

SEQ ID NO: 433087 - DNA, 25 bp, Mus musculus
agcccgaaagcggaagcgtataccg

SEQ ID NO: 433088 - DNA, 25 bp, Mus musculus
agagagaaccgccaggagcccgaaa

SEQ ID NO: 433089 - DNA, 25 bp, Mus musculus
ttcctccgaacacagcagctggtga

SEQ ID NO: 433090 - DNA, 25 bp, Mus musculus
ggagtctcagcggttcctccgaaca

SEQ ID NO: 433091 - DNA, 25 bp, Mus musculus
ttcctggtagttggcatggagtctc

SEQ ID NO: 433092 - DNA, 25 bp, Mus musculus
cgccacgagaaatttcctggtagtt

SEQ ID NO: 433093 - DNA, 25 bp, Mus musculus
tcccgcagcagcaggggtcccagga

SEQ ID NO: 433094 - DNA, 25 bp, Mus musculus
ctctggcggcagacagagcactctt

SEQ ID NO: 433095 - DNA, 25 bp, Mus musculus
tctcaacatcctctggcggcagaca

SEQ ID NO: 433096 - DNA, 25 bp, Mus musculus
tcgcagagcagggatctcaacatcc

SEQ ID NO: 433097 - DNA, 25 bp, Mus musculus
cacgtcggagctcggggagcatccc

SEQ ID NO: 433098 - DNA, 25 bp, Mus musculus
gggcaaacaccacgtcggagctcgg

SEQ ID NO: 433099 - DNA, 25 bp, Mus musculus
agtagaggcgccacgagaaatttcc

SEQ ID NO: 433100 - DNA, 25 bp, Mus musculus
cgccctggccggtgcgctcattggt

SEQ ID NO: 433101 - DNA, 25 bp, Mus musculus
gacgcgctaagcaagggcagaggcc

SEQ ID NO: 433102 - DNA, 25 bp, Mus musculus
agatgtgcaagtggaggagctggac

SEQ ID NO: 433103 - DNA, 25 bp, Mus musculus
agctggacggagtgcaggcgtaagc

SEQ ID NO: 433104 - DNA, 25 bp, Mus musculus
caggcgtaagctgcagagcggctaa

SEQ ID NO: 433105 - DNA, 25 bp, Mus musculus
gagggtccaaggaatgcgggcttcc

SEQ ID NO: 433106 - DNA, 25 bp, Mus musculus
gcacagagcggtgggcgctcgcccg

SEQ ID NO: 433107 - DNA, 25 bp, Mus musculus
tcattggtcgggatgtgtctgctca

SEQ ID NO: 433108 - DNA, 25 bp, Mus musculus
tgctcagtcgcctccaacttctccc

SEQ ID NO: 433109 - DNA, 25 bp, Mus musculus
ccaatcccactggtgagtcaccgga

SEQ ID NO: 433110 - DNA, 25 bp, Mus musculus
actggtgagtcaccggagagcgaac

SEQ ID NO: 433111 - DNA, 25 bp, Mus musculus
cgggatgtgtctgctcagtcgcctc

SEQ ID NO: 433112 - DNA, 25 bp, Mus musculus
ggacgggcaacaggaggacagagcg

SEQ ID NO: 433113 - DNA, 25 bp, Mus musculus
ccggagagcgaacaaccgggcaccg

SEQ ID NO: 433114 - DNA, 25 bp, Mus musculus
tttgaacagtaagactcgcaccggc

SEQ ID NO: 433115 - DNA, 25 bp, Mus musculus
cgcaggcgcagagaacaccttcaca

SEQ ID NO: 433116 - DNA, 25 bp, Mus musculus
ggcgtcgcttcggtaacccatgatt

SEQ ID NO: 433117 - DNA, 25 bp, Mus musculus
acccatgatttgtcgctaggaaagg

SEQ ID NO: 433118 - DNA, 25 bp, Mus musculus
agtaaatccttctcgcacctaatgc

SEQ ID NO: 433119 - DNA, 25 bp, Mus musculus
cctaatgcccggagctttttgaaca

SEQ ID NO: 433120 - DNA, 25 bp, Mus musculus
ctcacgagctactgtggtccagttc

SEQ ID NO: 433121 - DNA, 25 bp, Mus musculus
cgcaccggcaactaagggcgcgctt

SEQ ID NO: 433122 - DNA, 25 bp, Mus musculus
cagaactgctttccaggcggccaga

SEQ ID NO: 433123 - DNA, 25 bp, Mus musculus
aggtcttgtgggatcattccgccgc

SEQ ID NO: 433124 - DNA, 25 bp, Mus musculus
gaaggtcttgctcaggcacaaaagc

SEQ ID NO: 433125 - DNA, 25 bp, Mus musculus
ccgacccggtactgttgccatggta

SEQ ID NO: 433126 - DNA, 25 bp, Mus musculus
tgcccagaaagaattcgagcacctg

SEQ ID NO: 433127 - DNA, 25 bp, Mus musculus
caccaaccagggcagggaaggtctt

SEQ ID NO: 433128 - DNA, 25 bp, Mus musculus
aaataggctgatgtggctaaccagc

SEQ ID NO: 433129 - DNA, 25 bp, Mus musculus
cacacatagtaatggtgaaagtgca

SEQ ID NO: 433130 - DNA, 25 bp, Mus musculus
gcaaatggttagatttcttttttca

SEQ ID NO: 433131 - DNA, 25 bp, Mus musculus
ggttagatttcttttttcacacata

SEQ ID NO: 433132 - DNA, 25 bp, Mus musculus
ttagatttcttttttcacacatagt

SEQ ID NO: 433133 - DNA, 25 bp, Mus musculus
ataggctgatgtggctaaccagcaa

SEQ ID NO: 433134 - DNA, 25 bp, Mus musculus
tttccaggaaaccagggatctccca

SEQ ID NO: 433135 - DNA, 25 bp, Mus musculus
ttccaggaaaccagggatctcccac

SEQ ID NO: 433136 - DNA, 25 bp, Mus musculus
caggaaaccagggatctcccaccgc

SEQ ID NO: 433137 - DNA, 25 bp, Mus musculus
agttcctgtggtggcagtgacggct

SEQ ID NO: 433138 - DNA, 25 bp, Mus musculus
cgctctgccaggctgtcagccaagc

SEQ ID NO: 433139 - DNA, 25 bp, Mus musculus
atcaaccaacacctgttttgctttg

SEQ ID NO: 433140 - DNA, 25 bp, Mus musculus
gcaaataggctgatgtggctaacca

SEQ ID NO: 433141 - DNA, 25 bp, Mus musculus
agggcaaataggctgatgtggctaa

SEQ ID NO: 433142 - DNA, 25 bp, Mus musculus
caagtgcctgtgatggaaccgacca

SEQ ID NO: 433143 - DNA, 25 bp, Mus musculus
gttgcaggttgctggctagtttcca

SEQ ID NO: 433144 - DNA, 25 bp, Mus musculus
actccttcacaagtgcctgtgatgg

SEQ ID NO: 433145 - DNA, 25 bp, Mus musculus
cagagaagcgctccttccttgccta

SEQ ID NO: 433146 - DNA, 25 bp, Mus musculus
tgatggaaccgaccaacaactgttc

SEQ ID NO: 433147 - DNA, 25 bp, Mus musculus
ccaacaactgttctcaggtgaaagg

SEQ ID NO: 433148 - DNA, 25 bp, Mus musculus
ttctcaggtgaaaggaggtgttgca

SEQ ID NO: 433149 - DNA, 25 bp, Mus musculus
agcttgaacaagagaaggaagactc

SEQ ID NO: 433150 - DNA, 25 bp, Mus musculus
cccagagcagaataaaatatcaatg

SEQ ID NO: 433151 - DNA, 25 bp, Mus musculus
atatcaatgccaggccgatcggggc

SEQ ID NO: 433152 - DNA, 25 bp, Mus musculus
atgccaggccgatcggggctccgac

SEQ ID NO: 433153 - DNA, 25 bp, Mus musculus
tccgacctcgtccagctcccaagtt

SEQ ID NO: 433154 - DNA, 25 bp, Mus musculus
cttgcctaccggcacgcgggaccac

SEQ ID NO: 433155 - DNA, 25 bp, Mus musculus
tggctagtttccagaagcttgaaca

SEQ ID NO: 433156 - DNA, 25 bp, Mus musculus
ctgtggcacctggacaaggcgcaga

SEQ ID NO: 433157 - DNA, 25 bp, Mus musculus
tccggcgtccagcaagccttgcggg

SEQ ID NO: 433158 - DNA, 25 bp, Mus musculus
ccgccaggagggcaaatgaggcgat

SEQ ID NO: 433159 - DNA, 25 bp, Mus musculus
aatgaggcgatgtcgcctccctggc

SEQ ID NO: 433160 - DNA, 25 bp, Mus musculus
ggcgatgtcgcctccctggccattt

SEQ ID NO: 433161 - DNA, 25 bp, Mus musculus
ctgtggcccggctgtctttccgccc

SEQ ID NO: 433162 - DNA, 25 bp, Mus musculus
ctcttccaggcctgccgcgatcact

SEQ ID NO: 433163 - DNA, 25 bp, Mus musculus
cgatcactccgctcaggctagccca

SEQ ID NO: 433164 - DNA, 25 bp, Mus musculus
agatggttgtctgcccattgcgaca

SEQ ID NO: 433165 - DNA, 25 bp, Mus musculus
ttgtctgcccattgcgacacccgtg

SEQ ID NO: 433166 - DNA, 25 bp, Mus musculus
tgcgacacccgtgtcaccacgttgg

SEQ ID NO: 433167 - DNA, 25 bp, Mus musculus
tccggcgcctgcgacccgaggctcg

SEQ ID NO: 433168 - DNA, 25 bp, Mus musculus
catgttccggcgtccagcaagcctt

SEQ ID NO: 433169 - DNA, 25 bp, Mus musculus
caaggcgcagatggttgtctgccca

SEQ ID NO: 433170 - DNA, 25 bp, Mus musculus
gggccggcatcacctagaagaactt

SEQ ID NO: 433171 - DNA, 25 bp, Mus musculus
ggatctatagctccgcggggcttta

SEQ ID NO: 433172 - DNA, 25 bp, Mus musculus
cgcttgcatggaactcgtgtgcctc

SEQ ID NO: 433173 - DNA, 25 bp, Mus musculus
cagcgggccactcttcatatccaga

SEQ ID NO: 433174 - DNA, 25 bp, Mus musculus
tatccagagcgtggctaaacatgcc

SEQ ID NO: 433175 - DNA, 25 bp, Mus musculus
gcgttttgatcagtctagtcccagg

SEQ ID NO: 433176 - DNA, 25 bp, Mus musculus
agtcccaggtccaaggcagtctctc

SEQ ID NO: 433177 - DNA, 25 bp, Mus musculus
ctgttttgcagcagggagccagatc

SEQ ID NO: 433178 - DNA, 25 bp, Mus musculus
gctcttaactgcagcggggactcga

SEQ ID NO: 433179 - DNA, 25 bp, Mus musculus
ctgccaaaatgggttccgtgcctcc

SEQ ID NO: 433180 - DNA, 25 bp, Mus musculus
cggagccagcgaatcagaacaagtt

SEQ ID NO: 433181 - DNA, 25 bp, Mus musculus
gagcaacgtttgctaggaaccatta

SEQ ID NO: 433182 - DNA, 25 bp, Mus musculus
aaacccggttccgtttgcgcatgcg

SEQ ID NO: 433183 - DNA, 25 bp, Mus musculus
ctgcgacggagtctggctcttaact

SEQ ID NO: 433184 - DNA, 25 bp, Mus musculus
ctttgctagtgaagcatcgagttcc

SEQ ID NO: 433185 - DNA, 25 bp, Mus musculus
ccgctgttaggttccgggctgctct

SEQ ID NO: 433186 - DNA, 25 bp, Mus musculus
gggctgctcttgttcttcacgcttc

SEQ ID NO: 433187 - DNA, 25 bp, Mus musculus
acgcttctgccggtcccggtgttga

SEQ ID NO: 433188 - DNA, 25 bp, Mus musculus
gcgtccaggccttgccagcagtctg

SEQ ID NO: 433189 - DNA, 25 bp, Mus musculus
ccgatggccctgtgcaacggagatt

SEQ ID NO: 433190 - DNA, 25 bp, Mus musculus
cggagattccaaggtcagtctgtga

SEQ ID NO: 433191 - DNA, 25 bp, Mus musculus
cagtctgtgattggcgtctctgccg

SEQ ID NO: 433192 - DNA, 25 bp, Mus musculus
tcagtggcgctctacatgtgtcagc

SEQ ID NO: 433193 - DNA, 25 bp, Mus musculus
ttcggggcccttcaaccgcagggca

SEQ ID NO: 433194 - DNA, 25 bp, Mus musculus
aggcgctttgttggctttgctagtg

SEQ ID NO: 433195 - DNA, 25 bp, Mus musculus
catcgagttccagcggagaggcgac

SEQ ID NO: 433196 - DNA, 25 bp, Mus musculus
cgcgcttctgtgttctgaggccgct

SEQ ID NO: 433197 - DNA, 25 bp, Mus musculus
gctttattgcatccgaggcgctttg

SEQ ID NO: 433198 - DNA, 25 bp, Mus musculus
cgaggcgcagaggagtcaccacagc

SEQ ID NO: 433199 - DNA, 25 bp, Mus musculus
ttgtctgagagaacccggtcctggg

SEQ ID NO: 433200 - DNA, 25 bp, Mus musculus
gattcccgtccaacgccaccaccga

SEQ ID NO: 433201 - DNA, 25 bp, Mus musculus
tctgcttgcccacaggcgccacagc

SEQ ID NO: 433202 - DNA, 25 bp, Mus musculus
agctcacctgtcaggcgcagcttga

SEQ ID NO: 433203 - DNA, 25 bp, Mus musculus
ctccggcctccggggttagacatgt

SEQ ID NO: 433204 - DNA, 25 bp, Mus musculus
cggggttagacatgtccccagcggc

SEQ ID NO: 433205 - DNA, 25 bp, Mus musculus
cgcagaggagtcaccacagcggccg

SEQ ID NO: 433206 - DNA, 25 bp, Mus musculus
tcccacttctgcttcctcggcccgg

SEQ ID NO: 433207 - DNA, 25 bp, Mus musculus
cgcctcttgtcctcgcggtccgcct

SEQ ID NO: 433208 - DNA, 25 bp, Mus musculus
cggacggtgcgaagtctgctgaggc

SEQ ID NO: 433209 - DNA, 25 bp, Mus musculus
cgccctcttgtctgagagaacccgg

SEQ ID NO: 433210 - DNA, 25 bp, Mus musculus
cggatgtgccgagcgccgtcgccat

SEQ ID NO: 433211 - DNA, 25 bp, Mus musculus
tcttgtctgagagaacccggtcctg

SEQ ID NO: 433212 - DNA, 25 bp, Mus musculus
cggctcagaagcacgccgcgagtga

SEQ ID NO: 433213 - DNA, 25 bp, Mus musculus
attgggcatgcgaacaagacttccg

SEQ ID NO: 433214 - DNA, 25 bp, Mus musculus
cgtcgtttcacaagcgtcgaggtac

SEQ ID NO: 433215 - DNA, 25 bp, Mus musculus
gattggccatcttgccgtcgtttca

SEQ ID NO: 433216 - DNA, 25 bp, Mus musculus
gaaggttcagaaggccgcgtatccg

SEQ ID NO: 433217 - DNA, 25 bp, Mus musculus
agccatggccgagctgaagactgga

SEQ ID NO: 433218 - DNA, 25 bp, Mus musculus
gcaggtcctcctcggactgctgctt

SEQ ID NO: 433219 - DNA, 25 bp, Mus musculus
aggttgcggctgaaatcctgaagga

SEQ ID NO: 433220 - DNA, 25 bp, Mus musculus
gcgccgacgatttggccgacaggtt

SEQ ID NO: 433221 - DNA, 25 bp, Mus musculus
ttcccgaagaacagcgccgacgatt

SEQ ID NO: 433222 - DNA, 25 bp, Mus musculus
tggcagacacgatgaacgcgttccc

SEQ ID NO: 433223 - DNA, 25 bp, Mus musculus
ccgaagctcacagatggggatggca

SEQ ID NO: 433224 - DNA, 25 bp, Mus musculus
ccgcgagtgacttcccgaggacgct

SEQ ID NO: 433225 - DNA, 25 bp, Mus musculus
ttccgcatccttcagggtacgtggc

SEQ ID NO: 433226 - DNA, 25 bp, Mus musculus
tcgcgaaccgtcagagcctcgggga

SEQ ID NO: 433227 - DNA, 25 bp, Mus musculus
actcgccagccggtcctcgggaagg

SEQ ID NO: 433228 - DNA, 25 bp, Mus musculus
aggagaccggaagccacttaaagca

SEQ ID NO: 433229 - DNA, 25 bp, Mus musculus
gcctcgagagcagttgcggctttca

SEQ ID NO: 433230 - DNA, 25 bp, Mus musculus
cagttgcggctttcagcgctcaggt

SEQ ID NO: 433231 - DNA, 25 bp, Mus musculus
ctttcagcgctcaggtccgcggaat

SEQ ID NO: 433232 - DNA, 25 bp, Mus musculus
gacagcggcggatccctagactgcc

SEQ ID NO: 433233 - DNA, 25 bp, Mus musculus
gatccctagactgcccgggagagct

SEQ ID NO: 433234 - DNA, 25 bp, Mus musculus
gagctgaatgcgctcgcgtccgtcg

SEQ ID NO: 433235 - DNA, 25 bp, Mus musculus
gcccagaagtttgcaggctgtgttc

SEQ ID NO: 433236 - DNA, 25 bp, Mus musculus
tgcaggctgtgttcgagttaacttt

SEQ ID NO: 433237 - DNA, 25 bp, Mus musculus
tcgagttaactttgagtgccgcacc

SEQ ID NO: 433238 - DNA, 25 bp, Mus musculus
ccacttaaagcagagctggagctga

SEQ ID NO: 433239 - DNA, 25 bp, Mus musculus
ttaactttgagtgccgcaccggttc

SEQ ID NO: 433240 - DNA, 25 bp, Mus musculus
tgtcccatgtctacaggagctcctc

SEQ ID NO: 433241 - DNA, 25 bp, Mus musculus
cccgacgctgtggttatgcaaactg

SEQ ID NO: 433242 - DNA, 25 bp, Mus musculus
atgcaaactgatctcatcgctgttg

SEQ ID NO: 433243 - DNA, 25 bp, Mus musculus
tcgctgttgctcacgacacgcgctt

SEQ ID NO: 433244 - DNA, 25 bp, Mus musculus
tgcacgcggcgtaaccagatgcacg

SEQ ID NO: 433245 - DNA, 25 bp, Mus musculus
ggtctcagagcagcgagccagagct

SEQ ID NO: 433246 - DNA, 25 bp, Mus musculus
gagccagagctgcagataaacccgg

SEQ ID NO: 433247 - DNA, 25 bp, Mus musculus
tcgattccctttgtcattcctcaag

SEQ ID NO: 433248 - DNA, 25 bp, Mus musculus
tcgccgacttgcgtgtgccttgcaa

SEQ ID NO: 433249 - DNA, 25 bp, Mus musculus
gtgccttgcaacttccgagccggaa

SEQ ID NO: 433250 - DNA, 25 bp, Mus musculus
ccggctagagaaggcgtccggaata

SEQ ID NO: 433251 - DNA, 25 bp, Mus musculus
cggaataggattcctccgcggatta

SEQ ID NO: 433252 - DNA, 25 bp, Mus musculus
attacgcggcgccatcggcacgcaa

SEQ ID NO: 433253 - DNA, 25 bp, Mus musculus
gataaacccggccaggtcgccacga

SEQ ID NO: 433254 - DNA, 25 bp, Mus musculus
accagtgtcacagagaaggttctca

SEQ ID NO: 433255 - DNA, 25 bp, Mus musculus
cacgtctatctcgtgaccagtgtca

SEQ ID NO: 433256 - DNA, 25 bp, Mus musculus
gcgtttaagaacacgcacgtctatc

SEQ ID NO: 433257 - DNA, 25 bp, Mus musculus
accaagggcatttctgcgtttaaga

SEQ ID NO: 433258 - DNA, 25 bp, Mus musculus
gaatcggaaatgaaccaccaagggc

SEQ ID NO: 433259 - DNA, 25 bp, Mus musculus
ccgggcgtgacaccggtgtaagaat

SEQ ID NO: 433260 - DNA, 25 bp, Mus musculus
aacctgagttaatgaccgggcgtga

SEQ ID NO: 433261 - DNA, 25 bp, Mus musculus
gcggttagtttcctgcagtgacctc

SEQ ID NO: 433262 - DNA, 25 bp, Mus musculus
gtcatggccttcctcagtcctcaga

SEQ ID NO: 433263 - DNA, 25 bp, Mus musculus
gccttgacgtcaggccaacgtgcag

SEQ ID NO: 433264 - DNA, 25 bp, Mus musculus
aatgatgcaaaagaagctccgcttc

SEQ ID NO: 433265 - DNA, 25 bp, Mus musculus
gcctagctcgcttttgggacaaatg

SEQ ID NO: 433266 - DNA, 25 bp, Mus musculus
tccgtcacagaaccgcgcgtaaatc

SEQ ID NO: 433267 - DNA, 25 bp, Mus musculus
ttctcaaacgcacgtagcagcggcc

SEQ ID NO: 433268 - DNA, 25 bp, Mus musculus
atagttccagcgagctccacgcacg

SEQ ID NO: 433269 - DNA, 25 bp, Mus musculus
tcggcgacaccggagtgtaacaaag

SEQ ID NO: 433270 - DNA, 25 bp, Mus musculus
aacccggactctggcctggtgagtc

SEQ ID NO: 433271 - DNA, 25 bp, Mus musculus
taatggctttagtcaccggataacc

SEQ ID NO: 433272 - DNA, 25 bp, Mus musculus
ttcctccgcgcttcggtcggtgaca

SEQ ID NO: 433273 - DNA, 25 bp, Mus musculus
gcagccggaacccaaagcgagacta

SEQ ID NO: 433274 - DNA, 25 bp, Mus musculus
aggcccggacgccatagttccagcg

SEQ ID NO: 433275 - DNA, 25 bp, Mus musculus
ggtcgccgatcaggatccctccggt

SEQ ID NO: 433276 - DNA, 25 bp, Mus musculus
acctccgaatacaggcggtcgccga

SEQ ID NO: 433277 - DNA, 25 bp, Mus musculus
cgatggtgagcgacacctccgaata

SEQ ID NO: 433278 - DNA, 25 bp, Mus musculus
caggtccaggccgtcctgcatggac

SEQ ID NO: 433279 - DNA, 25 bp, Mus musculus
gcccaagatgcgcagatccgtctcg

SEQ ID NO: 433280 - DNA, 25 bp, Mus musculus
catcgccacctgcagacgagagagg

SEQ ID NO: 433281 - DNA, 25 bp, Mus musculus
agactaaccagcgtcctcggcgcga

SEQ ID NO: 433282 - DNA, 25 bp, Mus musculus
cttatccagtctggccgtgggcctc

SEQ ID NO: 433283 - DNA, 25 bp, Mus musculus
cgctgaccacgtggtaccgcagagc

SEQ ID NO: 433284 - DNA, 25 bp, Mus musculus
cgcagagcggcagacaagcgacgtt

SEQ ID NO: 433285 - DNA, 25 bp, Mus musculus
cttttccgccagagagcatacgctg

SEQ ID NO: 433286 - DNA, 25 bp, Mus musculus
gcatacgctgggactaacaagtttc

SEQ ID NO: 433287 - DNA, 25 bp, Mus musculus
caagtttcgggttgggactcatcca

SEQ ID NO: 433288 - DNA, 25 bp, Mus musculus
ccactgatcagtttctgggaaagcc

SEQ ID NO: 433289 - DNA, 25 bp, Mus musculus
tggagcggaagtgcacaaaccggaa

SEQ ID NO: 433290 - DNA, 25 bp, Mus musculus
tgcacaaaccggaagccgtcatcta

SEQ ID NO: 433291 - DNA, 25 bp, Mus musculus
ctcccatcctgtgggcgtgtctaac

SEQ ID NO: 433292 - DNA, 25 bp, Mus musculus
tgtctaactcgctctctggcttctg

SEQ ID NO: 433293 - DNA, 25 bp, Mus musculus
ttctgtccctgcgagcgctgacgct

SEQ ID NO: 433294 - DNA, 25 bp, Mus musculus
agcctcctgtgacgccaatagccga

SEQ ID NO: 433295 - DNA, 25 bp, Mus musculus
atagccgagtccttatccagtctgg

SEQ ID NO: 433296 - DNA, 25 bp, Mus musculus
tgggtgtccatctctccgtcacaca

SEQ ID NO: 433297 - DNA, 25 bp, Mus musculus
cactcatcgtggtgccgtgacaggt

SEQ ID NO: 433298 - DNA, 25 bp, Mus musculus
acacactcatcgtggtgccgtgaca

SEQ ID NO: 433299 - DNA, 25 bp, Mus musculus
gtcacacactcatcgtggtgccgtg

SEQ ID NO: 433300 - DNA, 25 bp, Mus musculus
acactcatcgtggtgccgtgacagg

SEQ ID NO: 433301 - DNA, 25 bp, Mus musculus
tcacacactcatcgtggtgccgtga

SEQ ID NO: 433302 - DNA, 25 bp, Mus musculus
tctccgtcacacactcatcgtggtg

SEQ ID NO: 433303 - DNA, 25 bp, Mus musculus
ttgggtgtccatctctccgtcacac

SEQ ID NO: 433304 - DNA, 25 bp, Mus musculus
ccgtgacaggtgcttgggtgtccat

SEQ ID NO: 433305 - DNA, 25 bp, Mus musculus
cacacactcatcgtggtgccgtgac

SEQ ID NO: 433306 - DNA, 25 bp, Mus musculus
actcatcgtggtgccgtgacaggtg

SEQ ID NO: 433307 - DNA, 25 bp, Mus musculus
gtgacaggtgcttgggtgtccatct

SEQ ID NO: 433308 - DNA, 25 bp, Mus musculus
atctctccgtcacacactcatcgtg

SEQ ID NO: 433309 - DNA, 25 bp, Mus musculus
catcgtggtgccgtgacaggtgctt

SEQ ID NO: 433310 - DNA, 25 bp, Mus musculus
gccgcacggccgtttctcaaacaat

SEQ ID NO: 433311 - DNA, 25 bp, Mus musculus
agcgttgtctgcgtgacagcgttaa

SEQ ID NO: 433312 - DNA, 25 bp, Mus musculus
ggaaaactaggcgtctggcttgctt

SEQ ID NO: 433313 - DNA, 25 bp, Mus musculus
aagaggctttgctgtcccggcccag

SEQ ID NO: 433314 - DNA, 25 bp, Mus musculus
tttgcggaaccgagacagactgagc

SEQ ID NO: 433315 - DNA, 25 bp, Mus musculus
caatctccggaaagctgggcattcc

SEQ ID NO: 433316 - DNA, 25 bp, Mus musculus
ctcacttccggaatctgcgggcttc

SEQ ID NO: 433317 - DNA, 25 bp, Mus musculus
cggggaattacacccagaagcaaca

SEQ ID NO: 433318 - DNA, 25 bp, Mus musculus
aagcaacaccgggtctgaggaaagc

SEQ ID NO: 433319 - DNA, 25 bp, Mus musculus
ataaggcctggccacggaaaatgcc

SEQ ID NO: 433320 - DNA, 25 bp, Mus musculus
caagaggacactccacgcactggga

SEQ ID NO: 433321 - DNA, 25 bp, Mus musculus
cacgcactgggattggtccgcaaag

SEQ ID NO: 433322 - DNA, 25 bp, Mus musculus
tggtccgcaaagctgcctctgattg

SEQ ID NO: 433323 - DNA, 25 bp, Mus musculus
tggcttgctttaccgcctttgcgga

SEQ ID NO: 433324 - DNA, 25 bp, Mus musculus
gctgctggctggcagacgcgcggac

SEQ ID NO: 433325 - DNA, 25 bp, Mus musculus
ctggtctccgttcagacaaaacccg

SEQ ID NO: 433326 - DNA, 25 bp, Mus musculus
ctccgttcagacaaaacccggactg

SEQ ID NO: 433327 - DNA, 25 bp, Mus musculus
tcctggtctccgttcagacaaaacc

SEQ ID NO: 433328 - DNA, 25 bp, Mus musculus
ccttcctggtctccgttcagacaaa

SEQ ID NO: 433329 - DNA, 25 bp, Mus musculus
tgccttcctggtctccgttcagaca

SEQ ID NO: 433330 - DNA, 25 bp, Mus musculus
tttgtgtcgtgtcttcaccgcctcc

SEQ ID NO: 433331 - DNA, 25 bp, Mus musculus
ctgtttgtgtcgtgtcttcaccgcc

SEQ ID NO: 433332 - DNA, 25 bp, Mus musculus
gagctgtttgtgtcgtgtcttcacc

SEQ ID NO: 433333 - DNA, 25 bp, Mus musculus
acgccgccttcgctggccgggcccg

SEQ ID NO: 433334 - DNA, 25 bp, Mus musculus
gcgagctgtttgtgtcgtgtcttca

SEQ ID NO: 433335 - DNA, 25 bp, Mus musculus
gcgcgagctgtttgtgtcgtgtctt

SEQ ID NO: 433336 - DNA, 25 bp, Mus musculus
cgttcagacaaaacccggactggat

SEQ ID NO: 433337 - DNA, 25 bp, Mus musculus
gctcagggcctaccgcggtgtcctg

SEQ ID NO: 433338 - DNA, 25 bp, Mus musculus
gctgttcatcatgctggagaactcg

SEQ ID NO: 433339 - DNA, 25 bp, Mus musculus
ttctagccacgccatgcgactgccg

SEQ ID NO: 433340 - DNA, 25 bp, Mus musculus
gcgactgccgccaggagcactcgga

SEQ ID NO: 433341 - DNA, 25 bp, Mus musculus
ctcggagtgggacaagctgttcatc

SEQ ID NO: 433342 - DNA, 25 bp, Mus musculus
gttcatcatgctggagaactcgcag

SEQ ID NO: 433343 - DNA, 25 bp, Mus musculus
agggcatgctgttgcaggccaccga

SEQ ID NO: 433344 - DNA, 25 bp, Mus musculus
gctgttgcaggccaccgacgacgtc

SEQ ID NO: 433345 - DNA, 25 bp, Mus musculus
ggctgcccgcaggtaagcccacggt

SEQ ID NO: 433346 - DNA, 25 bp, Mus musculus
cgcgccgacctgagcgccgtgcaga

SEQ ID NO: 433347 - DNA, 25 bp, Mus musculus
acccgaggcgacagtgcctggccta

SEQ ID NO: 433348 - DNA, 25 bp, Mus musculus
acgcgagcctcaggctggcgcgcct

SEQ ID NO: 433349 - DNA, 25 bp, Mus musculus
ccgacgacgtcctccgtggagagct

SEQ ID NO: 433350 - DNA, 25 bp, Mus musculus
caggagagccgtgacgcgagcctca

SEQ ID NO: 433351 - DNA, 25 bp, Mus musculus
agcactcggagtgggacaagctgtt

SEQ ID NO: 433352 - DNA, 25 bp, Mus musculus
ccacgaaaggtggtgcaggacactc

SEQ ID NO: 433353 - DNA, 25 bp, Mus musculus
agccggctcagatttccacgaaagg

SEQ ID NO: 433354 - DNA, 25 bp, Mus musculus
gcgcgttcattggtaggtttgaaaa

SEQ ID NO: 433355 - DNA, 25 bp, Mus musculus
gatttgagcctaagctgcgcgttca

SEQ ID NO: 433356 - DNA, 25 bp, Mus musculus
gccgcgttccgattggctgatttga

SEQ ID NO: 433357 - DNA, 25 bp, Mus musculus
cagattttgtgcctcgtgctgccgg

SEQ ID NO: 433358 - DNA, 25 bp, Mus musculus
tacccttcagccctcagattttgtg

SEQ ID NO: 433359 - DNA, 25 bp, Mus musculus
caggacactcaagctgcgggtcggc

SEQ ID NO: 433360 - DNA, 25 bp, Mus musculus
cctacctgtacagccggctcagatt

SEQ ID NO: 433361 - DNA, 25 bp, Mus musculus
ttactgctcaggaccggcttccgtt

SEQ ID NO: 433362 - DNA, 25 bp, Mus musculus
tccgtccggccgttactgctcagga

SEQ ID NO: 433363 - DNA, 25 bp, Mus musculus
caggtaggtccgctcgactgcggct

SEQ ID NO: 433364 - DNA, 25 bp, Mus musculus
gaagcatcaggaaagcggcggcaca

SEQ ID NO: 433365 - DNA, 25 bp, Mus musculus
ggctgtggaaacgtctgctaccctt

SEQ ID NO: 433366 - DNA, 25 bp, Mus musculus
cagagtcccgccctggggatccagg

SEQ ID NO: 433367 - DNA, 25 bp, Mus musculus
agctgcgcctgaacctgaaaggaca

SEQ ID NO: 433368 - DNA, 25 bp, Mus musculus
gctgtccagctgcagctgcgcctga

SEQ ID NO: 433369 - DNA, 25 bp, Mus musculus
gaacatcatgtaaggcgcgtgcgcg

SEQ ID NO: 433370 - DNA, 25 bp, Mus musculus
cggtgccgggaacatcatgtaaggc

SEQ ID NO: 433371 - DNA, 25 bp, Mus musculus
ccagcgtggccagcggcagtccgaa

SEQ ID NO: 433372 - DNA, 25 bp, Mus musculus
gatccgcgatgctggagttcttgct

SEQ ID NO: 433373 - DNA, 25 bp, Mus musculus
tctgagatccgcgatgctggagttc

SEQ ID NO: 433374 - DNA, 25 bp, Mus musculus
gctttttagctttcagtctgagatc

SEQ ID NO: 433375 - DNA, 25 bp, Mus musculus
gcggccgcgtgctttttagctttca

SEQ ID NO: 433376 - DNA, 25 bp, Mus musculus
cttaggaggctccaccgaccgtggc

SEQ ID NO: 433377 - DNA, 25 bp, Mus musculus
gatcgcgccgcttaggaggctccac

SEQ ID NO: 433378 - DNA, 25 bp, Mus musculus
atccagggtgcagaaagaaaaggcg

SEQ ID NO: 433379 - DNA, 25 bp, Mus musculus
aacctgaaaggacaagggcgtcacg

SEQ ID NO: 433380 - DNA, 25 bp, Mus musculus
aattcctcgcgcatgaaagcgtctg

SEQ ID NO: 433381 - DNA, 25 bp, Mus musculus
ctggatagtgggtctcatcgaaaag

SEQ ID NO: 433382 - DNA, 25 bp, Mus musculus
cgctggctcaattcctcgcgcatga

SEQ ID NO: 433383 - DNA, 25 bp, Mus musculus
gctggctcaattcctcgcgcatgaa

SEQ ID NO: 433384 - DNA, 25 bp, Mus musculus
tggctcaattcctcgcgcatgaaag

SEQ ID NO: 433385 - DNA, 25 bp, Mus musculus
ggctcaattcctcgcgcatgaaagc

SEQ ID NO: 433386 - DNA, 25 bp, Mus musculus
ttcctcgcgcatgaaagcgtctgga

SEQ ID NO: 433387 - DNA, 25 bp, Mus musculus
tcgcgcatgaaagcgtctggatagt

SEQ ID NO: 433388 - DNA, 25 bp, Mus musculus
catgaaagcgtctggatagtgggtc

SEQ ID NO: 433389 - DNA, 25 bp, Mus musculus
tgaaagcgtctggatagtgggtctc

SEQ ID NO: 433390 - DNA, 25 bp, Mus musculus
aagcgtctggatagtgggtctcatc

SEQ ID NO: 433391 - DNA, 25 bp, Mus musculus
cgtctggatagtgggtctcatcgaa

SEQ ID NO: 433392 - DNA, 25 bp, Mus musculus
cctcgcgcatgaaagcgtctggata

SEQ ID NO: 433393 - DNA, 25 bp, Mus musculus
tctggatagtgggtctcatcgaaaa

SEQ ID NO: 433394 - DNA, 25 bp, Mus musculus
ggtctcatcgaaaagcctctccagc

SEQ ID NO: 433395 - DNA, 25 bp, Mus musculus
cgatccttcagttcaggggacactg

SEQ ID NO: 433396 - DNA, 25 bp, Mus musculus
cagctcgttgagttgttccagggta

SEQ ID NO: 433397 - DNA, 25 bp, Mus musculus
gctcgttgagttgttccagggtaaa

SEQ ID NO: 433398 - DNA, 25 bp, Mus musculus
taaaattggtccgacttcgcctctg

SEQ ID NO: 433399 - DNA, 25 bp, Mus musculus
ccgacttcgcctctgcttgattttg

SEQ ID NO: 433400 - DNA, 25 bp, Mus musculus
tcgaaaagcctctccagctcgttga

SEQ ID NO: 433401 - DNA, 25 bp, Mus musculus
ttcaggggacactgaagagggcacc

SEQ ID NO: 433402 - DNA, 25 bp, Mus musculus
tttggtctggccttcgtcctccatc

SEQ ID NO: 433403 - DNA, 25 bp, Mus musculus
catccctttcgcatcgtctttgcga

SEQ ID NO: 433404 - DNA, 25 bp, Mus musculus
gaaggaccacacgtgcgtcggagca

SEQ ID NO: 433405 - DNA, 25 bp, Mus musculus
tcgtctttgcgatccttcagttcag

SEQ ID NO: 433406 - DNA, 25 bp, Mus musculus
aagagggcaccacggaaggaccaca

SEQ ID NO: 433407 - DNA, 25 bp, Mus musculus
cctctgcttgattttggtctggcct

SEQ ID NO: 433408 - DNA, 25 bp, Mus musculus
tggtctaatttaggaacaactgggc

SEQ ID NO: 433409 - DNA, 25 bp, Mus musculus
ctgaaaggttgcagcaggaaaacga

SEQ ID NO: 433410 - DNA, 25 bp, Mus musculus
caactgggcccgctgaaaggttgca

SEQ ID NO: 433411 - DNA, 25 bp, Mus musculus
aggttgcagcaggaaaacgagattc

SEQ ID NO: 433412 - DNA, 25 bp, Mus musculus
gttgcagcaggaaaacgagattctg

SEQ ID NO: 433413 - DNA, 25 bp, Mus musculus
cagcaggaaaacgagattctggtac

SEQ ID NO: 433414 - DNA, 25 bp, Mus musculus
aaacgagattctggtacagcgctgc

SEQ ID NO: 433415 - DNA, 25 bp, Mus musculus
cgagattctggtacagcgctgcgcc

SEQ ID NO: 433416 - DNA, 25 bp, Mus musculus
agattctggtacagcgctgcgccga

SEQ ID NO: 433417 - DNA, 25 bp, Mus musculus
tctggtacagcgctgcgccgaaagc

SEQ ID NO: 433418 - DNA, 25 bp, Mus musculus
tggtacagcgctgcgccgaaagcca

SEQ ID NO: 433419 - DNA, 25 bp, Mus musculus
actgggcccgctgaaaggttgcagc

SEQ ID NO: 433420 - DNA, 25 bp, Mus musculus
cccgctgaaaggttgcagcaggaaa

SEQ ID NO: 433421 - DNA, 25 bp, Mus musculus
agcgctgcgccgaaagccacgtccc

SEQ ID NO: 433422 - DNA, 25 bp, Mus musculus
cggctcgacgcaaccgggctctttg

SEQ ID NO: 433423 - DNA, 25 bp, Mus musculus
ccatgtccagctcccggacgggaga

SEQ ID NO: 433424 - DNA, 25 bp, Mus musculus
gttacaaccggcctcctagtgagcc

SEQ ID NO: 433425 - DNA, 25 bp, Mus musculus
ctcccgctcgcgaaaaacatatttc

SEQ ID NO: 433426 - DNA, 25 bp, Mus musculus
catatttcggtgcaaccggagcgac

SEQ ID NO: 433427 - DNA, 25 bp, Mus musculus
cacgacggagcagtctggcctccta

SEQ ID NO: 433428 - DNA, 25 bp, Mus musculus
ctatcccggtatctcccaaagctgg

SEQ ID NO: 433429 - DNA, 25 bp, Mus musculus
tctctagcacctcccggtacgtgat

SEQ ID NO: 433430 - DNA, 25 bp, Mus musculus
gtacgtgatggcctccttcttctcc

SEQ ID NO: 433431 - DNA, 25 bp, Mus musculus
ctccttcactttctggtcaaaagac

SEQ ID NO: 433432 - DNA, 25 bp, Mus musculus
tttctggtcaaaagacttggagacg

SEQ ID NO: 433433 - DNA, 25 bp, Mus musculus
cttggagacgaacgccgtaagttct

SEQ ID NO: 433434 - DNA, 25 bp, Mus musculus
cgtaagttcttccatcgcggccgct

SEQ ID NO: 433435 - DNA, 25 bp, Mus musculus
tctcccaaagctggggtccagggcc

SEQ ID NO: 433436 - DNA, 25 bp, Mus musculus
agttgatgtggagaggtagccccca

SEQ ID NO: 433437 - DNA, 25 bp, Mus musculus
cttggcctacagtgtggagttgatg

SEQ ID NO: 433438 - DNA, 25 bp, Mus musculus
ccaggcttggcctacagtgtggagt

SEQ ID NO: 433439 - DNA, 25 bp, Mus musculus
aggtgcgaacccgaaggtcgagcca

SEQ ID NO: 433440 - DNA, 25 bp, Mus musculus
tgaagcaagttctgaggacgccggt

SEQ ID NO: 433441 - DNA, 25 bp, Mus musculus
tcggcattcctaatggtccagcagc

SEQ ID NO: 433442 - DNA, 25 bp, Mus musculus
cgctgagcttaaattgaagcaagtt

SEQ ID NO: 433443 - DNA, 25 bp, Mus musculus
caggaaggcgctgagcttaaattga

SEQ ID NO: 433444 - DNA, 25 bp, Mus musculus
cagctcggctgaagctgcctggtgc

SEQ ID NO: 433445 - DNA, 25 bp, Mus musculus
cgacgcactcgacagctcggctgaa

SEQ ID NO: 433446 - DNA, 25 bp, Mus musculus
tgcatcgacgcactcgacagctcgg

SEQ ID NO: 433447 - DNA, 25 bp, Mus musculus
tcctaatggtccagcagcctgcatc

SEQ ID NO: 433448 - DNA, 25 bp, Mus musculus
cactcgctcggcattcctaatggtc

SEQ ID NO: 433449 - DNA, 25 bp, Mus musculus
ggcatgacaatccactcgctcggca

SEQ ID NO: 433450 - DNA, 25 bp, Mus musculus
tcatgaccaataggaaaacggcctg

SEQ ID NO: 433451 - DNA, 25 bp, Mus musculus
tggggcctccagacaaacttcacgc

SEQ ID NO: 433452 - DNA, 25 bp, Mus musculus
agacaaacttcacgccgccagtgtg

SEQ ID NO: 433453 - DNA, 25 bp, Mus musculus
cgccgccagtgtgtttacagaggtt

SEQ ID NO: 433454 - DNA, 25 bp, Mus musculus
tttacagaggttgccatagcagccg

SEQ ID NO: 433455 - DNA, 25 bp, Mus musculus
catagcagccgagcgatgtccttcc

SEQ ID NO: 433456 - DNA, 25 bp, Mus musculus
ttcttcgcgtgagtgtcccagccgc

SEQ ID NO: 433457 - DNA, 25 bp, Mus musculus
tgacgtcataaggtcatgaccaata

SEQ ID NO: 433458 - DNA, 25 bp, Mus musculus
taggaaaacggcctgcgtcaagccc

SEQ ID NO: 433459 - DNA, 25 bp, Mus musculus
cggcgcagagagctgcgcccatttc

SEQ ID NO: 433460 - DNA, 25 bp, Mus musculus
cgccgcaggatcacgatgttccgga

SEQ ID NO: 433461 - DNA, 25 bp, Mus musculus
aggatcacgatgttccggatgctga

SEQ ID NO: 433462 - DNA, 25 bp, Mus musculus
tgagcagcagctttgaggatgaccc

SEQ ID NO: 433463 - DNA, 25 bp, Mus musculus
tccgcctcaccttagtgacgtcata

SEQ ID NO: 433464 - DNA, 25 bp, Mus musculus
tcgagctcagacagaggtgcctctc

SEQ ID NO: 433465 - DNA, 25 bp, Mus musculus
tgatctaccttaaagagaagtgccc

SEQ ID NO: 433466 - DNA, 25 bp, Mus musculus
gggtccctcccttcctgatgatcta

SEQ ID NO: 433467 - DNA, 25 bp, Mus musculus
taagcccttgggtatccgcatgcca

SEQ ID NO: 433468 - DNA, 25 bp, Mus musculus
tcttgagcagcgatttcccgagccc

SEQ ID NO: 433469 - DNA, 25 bp, Mus musculus
ctttccttacctggggtcttgagca

SEQ ID NO: 433470 - DNA, 25 bp, Mus musculus
ggcaggttggcgacacctttcctta

SEQ ID NO: 433471 - DNA, 25 bp, Mus musculus
ccagagaaccttccagagcagggca

SEQ ID NO: 433472 - DNA, 25 bp, Mus musculus
aagcaggtactggtgccagagaacc

SEQ ID NO: 433473 - DNA, 25 bp, Mus musculus
agtggctgttccaggcttgccatgc

SEQ ID NO: 433474 - DNA, 25 bp, Mus musculus
atcacctcagagcaggagccttgga

SEQ ID NO: 433475 - DNA, 25 bp, Mus musculus
tgccggcgctgagcacaaccgatca

SEQ ID NO: 433476 - DNA, 25 bp, Mus musculus
ggcgtgactttgagctcttcccgct

SEQ ID NO: 433477 - DNA, 25 bp, Mus musculus
cccgagtgaaggtcagatgaaagtt

SEQ ID NO: 433478 - DNA, 25 bp, Mus musculus
ggatttccatcttgggggagacagc

SEQ ID NO: 433479 - DNA, 25 bp, Mus musculus
gggagaaaagctcgggcattccctc

SEQ ID NO: 433480 - DNA, 25 bp, Mus musculus
tccgggagaaaagctcgggcattcc

SEQ ID NO: 433481 - DNA, 25 bp, Mus musculus
cacctccgggagaaaagctcgggca

SEQ ID NO: 433482 - DNA, 25 bp, Mus musculus
aaaccgttcgggcagtggctctgcc

SEQ ID NO: 433483 - DNA, 25 bp, Mus musculus
cttcactcaggaaaccgttcgggca

SEQ ID NO: 433484 - DNA, 25 bp, Mus musculus
tggccagccgagtgggtgtccaagt

SEQ ID NO: 433485 - DNA, 25 bp, Mus musculus
tcccgtcagtgtggagtgctggcca

SEQ ID NO: 433486 - DNA, 25 bp, Mus musculus
tcaaagagatcacggcgggtgcagc

SEQ ID NO: 433487 - DNA, 25 bp, Mus musculus
tcctagttcaaagagatcacggcgg

SEQ ID NO: 433488 - DNA, 25 bp, Mus musculus
cgggctatcctagttcaaagagatc

SEQ ID NO: 433489 - DNA, 25 bp, Mus musculus
agacagcgcgggctatcctagttca

SEQ ID NO: 433490 - DNA, 25 bp, Mus musculus
accgaggcggccctggacgcagcat

SEQ ID NO: 433491 - DNA, 25 bp, Mus musculus
agcgcgggctatcctagttcaaaga

SEQ ID NO: 433492 - DNA, 25 bp, Mus musculus
gctcagtgacagcagcggccagtgc

SEQ ID NO: 433493 - DNA, 25 bp, Mus musculus
tgctcacggaaataggccacggcgg

SEQ ID NO: 433494 - DNA, 25 bp, Mus musculus
cagctgcaggatcccgcgtggcagc

SEQ ID NO: 433495 - DNA, 25 bp, Mus musculus
tctcgcgcgacacaagctcaggctg

SEQ ID NO: 433496 - DNA, 25 bp, Mus musculus
tcgcctccctgtccaagcagaagga

SEQ ID NO: 433497 - DNA, 25 bp, Mus musculus
ccggttcgcagtgctcacggaaata

SEQ ID NO: 433498 - DNA, 25 bp, Mus musculus
tgagctccctggacccggttcgcag

SEQ ID NO: 433499 - DNA, 25 bp, Mus musculus
ggctcagcaacagcgctggcatcgg

SEQ ID NO: 433500 - DNA, 25 bp, Mus musculus
cagccagaggctcagcaacagcgct

SEQ ID NO: 433501 - DNA, 25 bp, Mus musculus
gacttcggtgtattccaggtccgcg

SEQ ID NO: 433502 - DNA, 25 bp, Mus musculus
aagttgaagaagtgcagcgcagcgc

SEQ ID NO: 433503 - DNA, 25 bp, Mus musculus
cccgcgcggaagttgaagaagtgca

SEQ ID NO: 433504 - DNA, 25 bp, Mus musculus
cgacacaagctcaggctgggaacgc

SEQ ID NO: 433505 - DNA, 25 bp, Mus musculus
gagagcgggtcatgtcccatgtccc

SEQ ID NO: 433506 - DNA, 25 bp, Mus musculus
ttcgcgactgctgcggcacgtcacg

SEQ ID NO: 433507 - DNA, 25 bp, Mus musculus
aaaagcgctgcaactccgctgctcg

SEQ ID NO: 433508 - DNA, 25 bp, Mus musculus
ctcggcctggaaccacaggaataaa

SEQ ID NO: 433509 - DNA, 25 bp, Mus musculus
acgctgcccgaaacttcagaaacta

SEQ ID NO: 433510 - DNA, 25 bp, Mus musculus
tcagaaactacagtcaacttactgg

SEQ ID NO: 433511 - DNA, 25 bp, Mus musculus
cttactggttcgcagaggtcttctg

SEQ ID NO: 433512 - DNA, 25 bp, Mus musculus
ctggggctccagagctctaaaaagc

SEQ ID NO: 433513 - DNA, 25 bp, Mus musculus
cagagactcggactgcaccgggaac

SEQ ID NO: 433514 - DNA, 25 bp, Mus musculus
gaacccgagcaaacgccgtcgtggc

SEQ ID NO: 433515 - DNA, 25 bp, Mus musculus
ccagcccttgagagctgtgctcgga

SEQ ID NO: 433516 - DNA, 25 bp, Mus musculus
cctctctgagggaatgcgacaccac

SEQ ID NO: 433517 - DNA, 25 bp, Mus musculus
cagagcgctgcagagtcaccagtcc

SEQ ID NO: 433518 - DNA, 25 bp, Mus musculus
ggactcagtgcgcatgttcgcgact

SEQ ID NO: 433519 - DNA, 25 bp, Mus musculus
gaggagcagtcacagcacccgcgcg

SEQ ID NO: 433520 - DNA, 25 bp, Mus musculus
ggacacccacggcagacactctaaa

SEQ ID NO: 433521 - DNA, 25 bp, Mus musculus
tcgtaagccaaagaacgcgaagttg

SEQ ID NO: 433522 - DNA, 25 bp, Mus musculus
cctaacgcgcgaatatagagagctc

SEQ ID NO: 433523 - DNA, 25 bp, Mus musculus
acgcgcgaatatagagagctcgccc

SEQ ID NO: 433524 - DNA, 25 bp, Mus musculus
aacgcgaagttgctgcgcggtgggt

SEQ ID NO: 433525 - DNA, 25 bp, Mus musculus
tcggcatcgtaagccaaagaacgcg

SEQ ID NO: 433526 - DNA, 25 bp, Mus musculus
cgcactcggcatcgtaagccaaaga

SEQ ID NO: 433527 - DNA, 25 bp, Mus musculus
cgcaagcgcactcggcatcgtaagc

SEQ ID NO: 433528 - DNA, 25 bp, Mus musculus
cggcggcgcgagaagaagtgcgcaa

SEQ ID NO: 433529 - DNA, 25 bp, Mus musculus
gcgcaggcgcagtaagattctggcc

SEQ ID NO: 433530 - DNA, 25 bp, Mus musculus
acactctaaacagactgcgagcctt

SEQ ID NO: 433531 - DNA, 25 bp, Mus musculus
ggcagacactctaaacagactgcga

SEQ ID NO: 433532 - DNA, 25 bp, Mus musculus
acccacggcagacactctaaacaga

SEQ ID NO: 433533 - DNA, 25 bp, Mus musculus
gtggggctgcgatgatcgaatcacg

SEQ ID NO: 433534 - DNA, 25 bp, Mus musculus
caccggctcgtggtgctgtcgctca

SEQ ID NO: 433535 - DNA, 25 bp, Mus musculus
ttccaagtgtctggagcgaggtgac

SEQ ID NO: 433536 - DNA, 25 bp, Mus musculus
actcccactcccgaccggatctata

SEQ ID NO: 433537 - DNA, 25 bp, Mus musculus
gtgagcaaccgttcacgtgagcacg

SEQ ID NO: 433538 - DNA, 25 bp, Mus musculus
gcgtggcccgagcaagtcacgtgaa

SEQ ID NO: 433539 - DNA, 25 bp, Mus musculus
cccgagcaagtcacgtgaacacacg

SEQ ID NO: 433540 - DNA, 25 bp, Mus musculus
agtcacgtgaacacacgtgatcacg

SEQ ID NO: 433541 - DNA, 25 bp, Mus musculus
acgtgatcacgtgagtgctgccgct

SEQ ID NO: 433542 - DNA, 25 bp, Mus musculus
tttgcttcctgctccgttccaggct

SEQ ID NO: 433543 - DNA, 25 bp, Mus musculus
tccgttccaggctgcaagctgatgg

SEQ ID NO: 433544 - DNA, 25 bp, Mus musculus
gctgtcgctcatgtgcttccttggc

SEQ ID NO: 433545 - DNA, 25 bp, Mus musculus
atagagggattccagggttcgcgct

SEQ ID NO: 433546 - DNA, 25 bp, Mus musculus
agcccgctttttccaagtgtctgga

SEQ ID NO: 433547 - DNA, 25 bp, Mus musculus
ctcgggagcccgctttttccaagtg

SEQ ID NO: 433548 - DNA, 25 bp, Mus musculus
ggcgcctggcgtaaaatgcttcaca

SEQ ID NO: 433549 - DNA, 25 bp, Mus musculus
agtgcaaatcctcatcgtcgccggg

SEQ ID NO: 433550 - DNA, 25 bp, Mus musculus
ttaccgagaggatgggatggatcta

SEQ ID NO: 433551 - DNA, 25 bp, Mus musculus
gaacagtgggctctacccggccact

SEQ ID NO: 433552 - DNA, 25 bp, Mus musculus
cccaaggcctcttagggcgatcgca

SEQ ID NO: 433553 - DNA, 25 bp, Mus musculus
gaccctcaagacctcaggcacaatg

SEQ ID NO: 433554 - DNA, 25 bp, Mus musculus
ctatgagggtgaaaagtgcgcgccc

SEQ ID NO: 433555 - DNA, 25 bp, Mus musculus
ccggtctaccagaagaaggtgattg

SEQ ID NO: 433556 - DNA, 25 bp, Mus musculus
ccgcgaggtgcgaaatcagattctg

SEQ ID NO: 433557 - DNA, 25 bp, Mus musculus
ccttagaaagtaaagctgagctcgc

SEQ ID NO: 433558 - DNA, 25 bp, Mus musculus
cctgcgacaactgcggttccttaga

SEQ ID NO: 433559 - DNA, 25 bp, Mus musculus
tgaagagcccttcccggtctaccag

SEQ ID NO: 433560 - DNA, 25 bp, Mus musculus
acttggtgtctgctctggaagacta

SEQ ID NO: 433561 - DNA, 25 bp, Mus musculus
ttaaccggaggaagtcaacttgtgc

SEQ ID NO: 433562 - DNA, 25 bp, Mus musculus
gcgcctgtggatgctcagcgctttc

SEQ ID NO: 433563 - DNA, 25 bp, Mus musculus
agcagagcagcttggaggcttcaga

SEQ ID NO: 433564 - DNA, 25 bp, Mus musculus
agcttggaggcttcagagcgagctc

SEQ ID NO: 433565 - DNA, 25 bp, Mus musculus
gagctcggtggctgcgcgcttccca

SEQ ID NO: 433566 - DNA, 25 bp, Mus musculus
tgcgcgcttcccagcacaggcagtg

SEQ ID NO: 433567 - DNA, 25 bp, Mus musculus
cacaggcagtgccactgcgcaggtt

SEQ ID NO: 433568 - DNA, 25 bp, Mus musculus
agtgccactgcgcaggttgctcagc

SEQ ID NO: 433569 - DNA, 25 bp, Mus musculus
gttgctcagcggaacagcatccatt

SEQ ID NO: 433570 - DNA, 25 bp, Mus musculus
cagcggaacagcatccattttaatc

SEQ ID NO: 433571 - DNA, 25 bp, Mus musculus
ccattttaatctgcggggagtccct

SEQ ID NO: 433572 - DNA, 25 bp, Mus musculus
gagtccctgcctaaccagggcgttc

SEQ ID NO: 433573 - DNA, 25 bp, Mus musculus
taaccagggcgttctctcgcgcctg

SEQ ID NO: 433574 - DNA, 25 bp, Mus musculus
ttctctcgcgcctgtggatgctcag

SEQ ID NO: 433575 - DNA, 25 bp, Mus musculus
tgcctcccggttccggaggagcaga

SEQ ID NO: 433576 - DNA, 25 bp, Mus musculus
cctttctggacaacgtgggctggtt

SEQ ID NO: 433577 - DNA, 25 bp, Mus musculus
aacggccgagatgcccagagagacc

SEQ ID NO: 433578 - DNA, 25 bp, Mus musculus
ttcgtccgcaagctctctgggctgc

SEQ ID NO: 433579 - DNA, 25 bp, Mus musculus
gctgctcatcctgctggtgctcttc

SEQ ID NO: 433580 - DNA, 25 bp, Mus musculus
ggtgctcttcgccatcggctacttc

SEQ ID NO: 433581 - DNA, 25 bp, Mus musculus
gctacttcctgcagcgcatcatctg

SEQ ID NO: 433582 - DNA, 25 bp, Mus musculus
ggctcgcaggactcactgttggata

SEQ ID NO: 433583 - DNA, 25 bp, Mus musculus
tccctcctgcgtttcggagcacgag

SEQ ID NO: 433584 - DNA, 25 bp, Mus musculus
agcacgagctgcacgtggtgtcacc

SEQ ID NO: 433585 - DNA, 25 bp, Mus musculus
ggtgtcaccggtgtttctccagctg

SEQ ID NO: 433586 - DNA, 25 bp, Mus musculus
tgcccagctacgaggaggtcaagta

SEQ ID NO: 433587 - DNA, 25 bp, Mus musculus
gaggtcaagtacctgcccacctatg

SEQ ID NO: 433588 - DNA, 25 bp, Mus musculus
tgcccacctatgaggagtccatgcg

SEQ ID NO: 433589 - DNA, 25 bp, Mus musculus
cagcgtggccaagtgagcaccgctc

SEQ ID NO: 433590 - DNA, 25 bp, Mus musculus
gacccgccgacaggtgaagtccttc

SEQ ID NO: 433591 - DNA, 25 bp, Mus musculus
cccgaagctggacgaacttgtctct

SEQ ID NO: 433592 - DNA, 25 bp, Mus musculus
cactttcctagggacccgctactgg

SEQ ID NO: 433593 - DNA, 25 bp, Mus musculus
tgctgggttcctagtagccactttc

SEQ ID NO: 433594 - DNA, 25 bp, Mus musculus
ctgagcgaattcctccgtcctgggc

SEQ ID NO: 433595 - DNA, 25 bp, Mus musculus
tcttatgagatggttccacaggggc

SEQ ID NO: 433596 - DNA, 25 bp, Mus musculus
tgtcagcagacgtccttctcttatg

SEQ ID NO: 433597 - DNA, 25 bp, Mus musculus
gtccgggcgtcaggacctaaatggc

SEQ ID NO: 433598 - DNA, 25 bp, Mus musculus
agacctggacttctccgagggccgt

SEQ ID NO: 433599 - DNA, 25 bp, Mus musculus
cggaaagtgacccaacccaagcaga

SEQ ID NO: 433600 - DNA, 25 bp, Mus musculus
tggcttacactgtcgtccatcggga

SEQ ID NO: 433601 - DNA, 25 bp, Mus musculus
actcagagcctctcctgggcacttg

SEQ ID NO: 433602 - DNA, 25 bp, Mus musculus
tctcttctagatcaggttgtcacac

SEQ ID NO: 433603 - DNA, 25 bp, Mus musculus
cgtcctgtctcctaaggggactgca

SEQ ID NO: 433604 - DNA, 25 bp, Mus musculus
gcgcgcctaagccttcatctgtgtc

SEQ ID NO: 433605 - DNA, 25 bp, Mus musculus
cggagaaacgccattccagagctca

SEQ ID NO: 433606 - DNA, 25 bp, Mus musculus
ccattgttacctcacaggttccttg

SEQ ID NO: 433607 - DNA, 25 bp, Mus musculus
gcgggatctgctaggctcacctacc

SEQ ID NO: 433608 - DNA, 25 bp, Mus musculus
ctgggtcagaaaacacagtagtggc

SEQ ID NO: 433609 - DNA, 25 bp, Mus musculus
ctggctgagggactgcttattactt

SEQ ID NO: 433610 - DNA, 25 bp, Mus musculus
cgcgcaggcttcttccattgttacc

SEQ ID NO: 433611 - DNA, 25 bp, Mus musculus
tttgaacaccaacggccgagggcca

SEQ ID NO: 433612 - DNA, 25 bp, Mus musculus
gttccttgttcagtcaccggctgga

SEQ ID NO: 433613 - DNA, 25 bp, Mus musculus
ggtcctccaacttaggcgcgcctaa

SEQ ID NO: 433614 - DNA, 25 bp, Mus musculus
gtcctctctaacacgctgggtcaga

SEQ ID NO: 433615 - DNA, 25 bp, Mus musculus
tagtggcttttcactttctcggaga

SEQ ID NO: 433616 - DNA, 25 bp, Mus musculus
tcaatcccgccggtagctcggagcg

SEQ ID NO: 433617 - DNA, 25 bp, Mus musculus
tattacttaggaccacgcccgcacg

SEQ ID NO: 433618 - DNA, 25 bp, Mus musculus
tctggccggctcgacaggacaggcc

SEQ ID NO: 433619 - DNA, 25 bp, Mus musculus
aggacaggcctaggccgcacccggc

SEQ ID NO: 433620 - DNA, 25 bp, Mus musculus
ccggctcgacaggacaggcctaggc

SEQ ID NO: 433621 - DNA, 25 bp, Mus musculus
cctcacccgtgtctggccggctcga

SEQ ID NO: 433622 - DNA, 25 bp, Mus musculus
cgcggctgatatgcccgccgccctc

SEQ ID NO: 433623 - DNA, 25 bp, Mus musculus
cctccgccgcggctgatatgcccgc

SEQ ID NO: 433624 - DNA, 25 bp, Mus musculus
ccctccacccgcgacgcttggcgtc

SEQ ID NO: 433625 - DNA, 25 bp, Mus musculus
catcgccctccacccgcgacgcttg

SEQ ID NO: 433626 - DNA, 25 bp, Mus musculus
aaacctgcatgtggaggcgtctcgg

SEQ ID NO: 433627 - DNA, 25 bp, Mus musculus
gaaaacctgcatgtggaggcgtctc

SEQ ID NO: 433628 - DNA, 25 bp, Mus musculus
attaggaaaacctgcatgtggaggc

SEQ ID NO: 433629 - DNA, 25 bp, Mus musculus
gcgattaggaaaacctgcatgtgga

SEQ ID NO: 433630 - DNA, 25 bp, Mus musculus
cggggcgattaggaaaacctgcatg

SEQ ID NO: 433631 - DNA, 25 bp, Mus musculus
ctcgacaggacaggcctaggccgca

SEQ ID NO: 433632 - DNA, 25 bp, Mus musculus
gggcgcaggagcttgggaggggagg

SEQ ID NO: 433633 - DNA, 25 bp, Mus musculus
ggggcgcaggagcttgggaggggag

SEQ ID NO: 433634 - DNA, 25 bp, Mus musculus
ggaggggtcacgcgcggagggagaa

SEQ ID NO: 433635 - DNA, 25 bp, Mus musculus
gaggggtcacgcgcggagggagaaa

SEQ ID NO: 433636 - DNA, 25 bp, Mus musculus
agggagaaacccgaggcagccgaag

SEQ ID NO: 433637 - DNA, 25 bp, Mus musculus
gggagaaacccgaggcagccgaaga

SEQ ID NO: 433638 - DNA, 25 bp, Mus musculus
ggagaaacccgaggcagccgaagag

SEQ ID NO: 433639 - DNA, 25 bp, Mus musculus
agaaacccgaggcagccgaagagca

SEQ ID NO: 433640 - DNA, 25 bp, Mus musculus
gaaacccgaggcagccgaagagcag

SEQ ID NO: 433641 - DNA, 25 bp, Mus musculus
aaacccgaggcagccgaagagcagc

SEQ ID NO: 433642 - DNA, 25 bp, Mus musculus
ccgaggcagccgaagagcagcagat

SEQ ID NO: 433643 - DNA, 25 bp, Mus musculus
cgaggcagccgaagagcagcagatc

SEQ ID NO: 433644 - DNA, 25 bp, Mus musculus
gagaaacccgaggcagccgaagagc

SEQ ID NO: 433645 - DNA, 25 bp, Mus musculus
cggggcgcaggagcttgggagggga

SEQ ID NO: 433646 - DNA, 25 bp, Mus musculus
cttagccaatcaaaagggacgatgg

SEQ ID NO: 433647 - DNA, 25 bp, Mus musculus
tgagggcccggctttacggccacgc

SEQ ID NO: 433648 - DNA, 25 bp, Mus musculus
catcgccgccaacccggtccgccga

SEQ ID NO: 433649 - DNA, 25 bp, Mus musculus
gggctccggagtgcttagccaatca

SEQ ID NO: 433650 - DNA, 25 bp, Mus musculus
caatcaaaagggacgatggagagcg

SEQ ID NO: 433651 - DNA, 25 bp, Mus musculus
ctccggagtgcttagccaatcaaaa

SEQ ID NO: 433652 - DNA, 25 bp, Mus musculus
ccggagtgcttagccaatcaaaagg

SEQ ID NO: 433653 - DNA, 25 bp, Mus musculus
ggagtgcttagccaatcaaaaggga

SEQ ID NO: 433654 - DNA, 25 bp, Mus musculus
gcttagccaatcaaaagggacgatg

SEQ ID NO: 433655 - DNA, 25 bp, Mus musculus
agccaatcaaaagggacgatggaga

SEQ ID NO: 433656 - DNA, 25 bp, Mus musculus
ctgagggcccggctttacggccacg

SEQ ID NO: 433657 - DNA, 25 bp, Mus musculus
ccgggctccggagtgcttagccaat

SEQ ID NO: 433658 - DNA, 25 bp, Mus musculus
gtgcttagccaatcaaaagggacga

SEQ ID NO: 433659 - DNA, 25 bp, Mus musculus
gctccggagtgcttagccaatcaaa

SEQ ID NO: 433660 - DNA, 25 bp, Mus musculus
ctgccatcgttctggacgactgttc

SEQ ID NO: 433661 - DNA, 25 bp, Mus musculus
ctggtccgggctctagggataataa

SEQ ID NO: 433662 - DNA, 25 bp, Mus musculus
tgctgtctctgctgggtcgcatcat

SEQ ID NO: 433663 - DNA, 25 bp, Mus musculus
ccagccgggtgacagtgttacgcat

SEQ ID NO: 433664 - DNA, 25 bp, Mus musculus
tcgcatcatgcgctacttcttactg

SEQ ID NO: 433665 - DNA, 25 bp, Mus musculus
tgttacgcatctggaagcgccactc

SEQ ID NO: 433666 - DNA, 25 bp, Mus musculus
ccaggcaccggcaaaacttttattg

SEQ ID NO: 433667 - DNA, 25 bp, Mus musculus
gtgacgaaatcgcaacgctccgctg

SEQ ID NO: 433668 - DNA, 25 bp, Mus musculus
ccgaaatcctcttcaccgttgcgga

SEQ ID NO: 433669 - DNA, 25 bp, Mus musculus
ttcttactgagacccgagacgcttt

SEQ ID NO: 433670 - DNA, 25 bp, Mus musculus
ccggctcggcgcaactttaacttga

SEQ ID NO: 433671 - DNA, 25 bp, Mus musculus
gccgtcgctgcggtctcacaaagag

SEQ ID NO: 433672 - DNA, 25 bp, Mus musculus
cgagacgcttttcctgctgtgcatc

SEQ ID NO: 433673 - DNA, 25 bp, Mus musculus
cttcgggctgcccagacaaaaggga

SEQ ID NO: 433674 - DNA, 25 bp, Mus musculus
cagcccagcgccgttatcgctgtta

SEQ ID NO: 433675 - DNA, 25 bp, Mus musculus
tggcccagattctcgagtctctcgt

SEQ ID NO: 433676 - DNA, 25 bp, Mus musculus
cctgcagcaggtccatcggcgtggc

SEQ ID NO: 433677 - DNA, 25 bp, Mus musculus
ggcgtgcggacagtattctccactt

SEQ ID NO: 433678 - DNA, 25 bp, Mus musculus
ccacttctccttggtcgcggtgaca

SEQ ID NO: 433679 - DNA, 25 bp, Mus musculus
cgagtctctcgtccggagcctcgag

SEQ ID NO: 433680 - DNA, 25 bp, Mus musculus
tgcgcccgtggtacccgcaacggtg

SEQ ID NO: 433681 - DNA, 25 bp, Mus musculus
ctagaatgtgcgttcctccctccgg

SEQ ID NO: 433682 - DNA, 25 bp, Mus musculus
tatcgctgttatcgccgcagctgcc

SEQ ID NO: 433683 - DNA, 25 bp, Mus musculus
cgacccacgaacctagaaggctgcg

SEQ ID NO: 433684 - DNA, 25 bp, Mus musculus
ttacatagctcaaggcagggcagga

SEQ ID NO: 433685 - DNA, 25 bp, Mus musculus
ggtcgcggtgacaaccaggccacca

SEQ ID NO: 433686 - DNA, 25 bp, Mus musculus
cccgaggcttacatagctcaaggca

SEQ ID NO: 433687 - DNA, 25 bp, Mus musculus
ggcccggctcgccaagagcactgga

SEQ ID NO: 433688 - DNA, 25 bp, Mus musculus
gggaaccgctgctgtccatacgtca

SEQ ID NO: 433689 - DNA, 25 bp, Mus musculus
tccgtactcactgaagtgtgggctg

SEQ ID NO: 433690 - DNA, 25 bp, Mus musculus
gcccagtactttcccgatgagccgg

SEQ ID NO: 433691 - DNA, 25 bp, Mus musculus
tcgccattttggttgcgggcaaacg

SEQ ID NO: 433692 - DNA, 25 bp, Mus musculus
tcgtgtggaacgacgttcgccattt

SEQ ID NO: 433693 - DNA, 25 bp, Mus musculus
acagacttcttacttctgcgcaggc

SEQ ID NO: 433694 - DNA, 25 bp, Mus musculus
gggaattagtgtcacagacttctta

SEQ ID NO: 433695 - DNA, 25 bp, Mus musculus
tcccatcatgcagcggggaaccgct

SEQ ID NO: 433696 - DNA, 25 bp, Mus musculus
catggacgcccacccggagtttcag

SEQ ID NO: 433697 - DNA, 25 bp, Mus musculus
gagctgttcccagccctgtcagcgg

SEQ ID NO: 433698 - DNA, 25 bp, Mus musculus
ggaccggttactcggacgctgagct

SEQ ID NO: 433699 - DNA, 25 bp, Mus musculus
tccgcacccgcggagaagagcagag

SEQ ID NO: 433700 - DNA, 25 bp, Mus musculus
ccgcgaggcagacagtgtttacacc

SEQ ID NO: 433701 - DNA, 25 bp, Mus musculus
tttacacctgtcacgagggaggtgg

SEQ ID NO: 433702 - DNA, 25 bp, Mus musculus
cagctgtcactaagggaggcacagg

SEQ ID NO: 433703 - DNA, 25 bp, Mus musculus
ccaggccagggtggcaccttcagac

SEQ ID NO: 433704 - DNA, 25 bp, Mus musculus
ggactgtgccgcagctgtcactaag

SEQ ID NO: 433705 - DNA, 25 bp, Mus musculus
cacagggcgcgccagacgagtcgca

SEQ ID NO: 433706 - DNA, 25 bp, Mus musculus
ccagacgagtcgcagcttgcaggag

SEQ ID NO: 433707 - DNA, 25 bp, Mus musculus
gagctgcgggaaacgtgacgtccca

SEQ ID NO: 433708 - DNA, 25 bp, Mus musculus
aacgtgacgtcccagtccggcgcag

SEQ ID NO: 433709 - DNA, 25 bp, Mus musculus
tgaggcgcgcctcctattggctgcc

SEQ ID NO: 433710 - DNA, 25 bp, Mus musculus
cccacaccaaggacgatataagcgc

SEQ ID NO: 433711 - DNA, 25 bp, Mus musculus
caaggacgatataagcgcagatggc

SEQ ID NO: 433712 - DNA, 25 bp, Mus musculus
tataagcgcagatggcgccaggagc

SEQ ID NO: 433713 - DNA, 25 bp, Mus musculus
aggagcggaacagcgccctcgccac

SEQ ID NO: 433714 - DNA, 25 bp, Mus musculus
gatccctgggcccacgggactgtgc

SEQ ID NO: 433715 - DNA, 25 bp, Mus musculus
ccagcacagcccaaggcgcacaagt

SEQ ID NO: 433716 - DNA, 25 bp, Mus musculus
tgtatttcgccctgtcacggagctg

SEQ ID NO: 433717 - DNA, 25 bp, Mus musculus
aacgctagcaggagaggtccttttc

SEQ ID NO: 433718 - DNA, 25 bp, Mus musculus
atcgcgagatcttcgtaggtgtgta

SEQ ID NO: 433719 - DNA, 25 bp, Mus musculus
agccacatggtatgcggtgctcacg

SEQ ID NO: 433720 - DNA, 25 bp, Mus musculus
gctcctctgtcgtgctagccacatg

SEQ ID NO: 433721 - DNA, 25 bp, Mus musculus
aaaacggttgggtcttgatcgcata

SEQ ID NO: 433722 - DNA, 25 bp, Mus musculus
tggcgtctgcagatcgtaaaatacc

SEQ ID NO: 433723 - DNA, 25 bp, Mus musculus
cctgatcgatcccttggcgtctgca

SEQ ID NO: 433724 - DNA, 25 bp, Mus musculus
ggacacatgtgagttgcgagcccgc

SEQ ID NO: 433725 - DNA, 25 bp, Mus musculus
tccattgagcacagcccgggacaca

SEQ ID NO: 433726 - DNA, 25 bp, Mus musculus
gtcgcgcgcgaaccatggagtacat

SEQ ID NO: 433727 - DNA, 25 bp, Mus musculus
actcgacctgatggatccaagtctc

SEQ ID NO: 433728 - DNA, 25 bp, Mus musculus
gggatttccggttctcctatcgcga

SEQ ID NO: 433729 - DNA, 25 bp, Mus musculus
agtgctttgagaagacgtcctccta

SEQ ID NO: 433730 - DNA, 25 bp, Mus musculus
ctgtgtaaatcagccgccgcagtcc

SEQ ID NO: 433731 - DNA, 25 bp, Mus musculus
tcagggactagaaggcaatacagaa

SEQ ID NO: 433732 - DNA, 25 bp, Mus musculus
tcctccgcgccaactgtgtaaatca

SEQ ID NO: 433733 - DNA, 25 bp, Mus musculus
atcgctggagcctccgccagcttgt

SEQ ID NO: 433734 - DNA, 25 bp, Mus musculus
ccaaatcgcgcaccgagggagcggc

SEQ ID NO: 433735 - DNA, 25 bp, Mus musculus
tacagaaaacgcagggctggaaccc

SEQ ID NO: 433736 - DNA, 25 bp, Mus musculus
gtctgcctctaaactgggagcgcca

SEQ ID NO: 433737 - DNA, 25 bp, Mus musculus
gttacttaccgaacgtctgcctcta

SEQ ID NO: 433738 - DNA, 25 bp, Mus musculus
aaatcagattacacgttacttaccg

SEQ ID NO: 433739 - DNA, 25 bp, Mus musculus
taccgctttgatggcctaggaaata

SEQ ID NO: 433740 - DNA, 25 bp, Mus musculus
ctgacctgctttaaaagtaccgctt

SEQ ID NO: 433741 - DNA, 25 bp, Mus musculus
ggcggcgaccgcatcttttaaagac

SEQ ID NO: 433742 - DNA, 25 bp, Mus musculus
ttccaggccaaggagacgctcccgg

SEQ ID NO: 433743 - DNA, 25 bp, Mus musculus
ggaacccgaatgcaaagccaccagc

SEQ ID NO: 433744 - DNA, 25 bp, Mus musculus
actgaggcacggacttcacttccca

SEQ ID NO: 433745 - DNA, 25 bp, Mus musculus
ttgtccggaatcctgcccagcagga

SEQ ID NO: 433746 - DNA, 25 bp, Mus musculus
tccaggcctagccaagctttagcct

SEQ ID NO: 433747 - DNA, 25 bp, Mus musculus
tttggagccctcttcaactcccgga

SEQ ID NO: 433748 - DNA, 25 bp, Mus musculus
gaaccaggcgttgtccggaatcctg

SEQ ID NO: 433749 - DNA, 25 bp, Mus musculus
cggacttcacttcccacctttggag

SEQ ID NO: 433750 - DNA, 25 bp, Mus musculus
tgcccagcaggagtcgcgcaaggcc

SEQ ID NO: 433751 - DNA, 25 bp, Mus musculus
tagagacctcgctgacgcccacaag

SEQ ID NO: 433752 - DNA, 25 bp, Mus musculus
cagctttccgcagctcgcgtagaga

SEQ ID NO: 433753 - DNA, 25 bp, Mus musculus
ggcatttacaaacccagctttccgc

SEQ ID NO: 433754 - DNA, 25 bp, Mus musculus
ctgggcaggaggcatttacaaaccc

SEQ ID NO: 433755 - DNA, 25 bp, Mus musculus
aagctttagcctcacctgcccggga

SEQ ID NO: 433756 - DNA, 25 bp, Mus musculus
gaaacctcgccttaccggcaactga

SEQ ID NO: 433757 - DNA, 25 bp, Mus musculus
ggatcaattcactccggcgacgccg

SEQ ID NO: 433758 - DNA, 25 bp, Mus musculus
cacagcagcgtggacacacagcgtg

SEQ ID NO: 433759 - DNA, 25 bp, Mus musculus
acacagcagcgtggacacacagcgt

SEQ ID NO: 433760 - DNA, 25 bp, Mus musculus
acacacagcagcgtggacacacagc

SEQ ID NO: 433761 - DNA, 25 bp, Mus musculus
cagcgtggacacacagcagcgtgga

SEQ ID NO: 433762 - DNA, 25 bp, Mus musculus
acacagcgtggacacacagcgtgga

SEQ ID NO: 433763 - DNA, 25 bp, Mus musculus
cagcgtggacacacagcgtggacac

SEQ ID NO: 433764 - DNA, 25 bp, Mus musculus
ggacacacagcgtggacacacagca

SEQ ID NO: 433765 - DNA, 25 bp, Mus musculus
ggacacacagcagcgtggacacaca

SEQ ID NO: 433766 - DNA, 25 bp, Mus musculus
cacacagcgtggacacacagcgtgg

SEQ ID NO: 433767 - DNA, 25 bp, Mus musculus
cacagcgtggacacacagcgtggac

SEQ ID NO: 433768 - DNA, 25 bp, Mus musculus
gtggacacacagcagcgtggacaca

SEQ ID NO: 433769 - DNA, 25 bp, Mus musculus
cacacagcagcgtggacacacagca

SEQ ID NO: 433770 - DNA, 25 bp, Mus musculus
agcgtggacacacagcgtggacaca

SEQ ID NO: 433771 - DNA, 25 bp, Mus musculus
gcagcgtggacacacagcgtggaca

SEQ ID NO: 433772 - DNA, 25 bp, Mus musculus
ggctccattggacgccagctttgtc

SEQ ID NO: 433773 - DNA, 25 bp, Mus musculus
ccaccgcgagaagtagctggacacg

SEQ ID NO: 433774 - DNA, 25 bp, Mus musculus
ggagcacatcccgtttcccatagtc

SEQ ID NO: 433775 - DNA, 25 bp, Mus musculus
cgcgagacacaaaagccggaccaga

SEQ ID NO: 433776 - DNA, 25 bp, Mus musculus
cctcctttcggggagctaatgctgg

SEQ ID NO: 433777 - DNA, 25 bp, Mus musculus
cgctatcatggccaacgggattccg

SEQ ID NO: 433778 - DNA, 25 bp, Mus musculus
ccgctgctggactttgtcgctacca

SEQ ID NO: 433779 - DNA, 25 bp, Mus musculus
agctgcgtctgcagttccaagtaga

SEQ ID NO: 433780 - DNA, 25 bp, Mus musculus
tccaagtagagcatcgcgccataga

SEQ ID NO: 433781 - DNA, 25 bp, Mus musculus
gccatagaggaagccgaagaccacc

SEQ ID NO: 433782 - DNA, 25 bp, Mus musculus
gaccaccgtgagaagcagcagcgtc

SEQ ID NO: 433783 - DNA, 25 bp, Mus musculus
cagcagcgtctggaagatccgcttc

SEQ ID NO: 433784 - DNA, 25 bp, Mus musculus
gccaccaaacttctgcgatgtcgga

SEQ ID NO: 433785 - DNA, 25 bp, Mus musculus
tctttgcatacttcagagcccgctg

SEQ ID NO: 433786 - DNA, 25 bp, Mus musculus
tgcctcttcctcgtacgctcagcgc

SEQ ID NO: 433787 - DNA, 25 bp, Mus musculus
gcggatcagacgagctgagggccga

SEQ ID NO: 433788 - DNA, 25 bp, Mus musculus
gccgtagctgcctcttcctcgtacg

SEQ ID NO: 433789 - DNA, 25 bp, Mus musculus
tttatgcgctgctgccacagccgcc

SEQ ID NO: 433790 - DNA, 25 bp, Mus musculus
ggcggcggcccctttatgcgctgct

SEQ ID NO: 433791 - DNA, 25 bp, Mus musculus
gcttctgggcctgccgcagcggtca

SEQ ID NO: 433792 - DNA, 25 bp, Mus musculus
ccgcctgggaggaagagcccccaag

SEQ ID NO: 433793 - DNA, 25 bp, Mus musculus
cagcttctgggcctgccgcagcggt

SEQ ID NO: 433794 - DNA, 25 bp, Mus musculus
cagcggtcaccgcatcacccggcgg

SEQ ID NO: 433795 - DNA, 25 bp, Mus musculus
cgagcggtcgcgagtcgaccggaga

SEQ ID NO: 433796 - DNA, 25 bp, Mus musculus
gagctgagggccgaggccccactca

SEQ ID NO: 433797 - DNA, 25 bp, Mus musculus
cttcctcgtacgctcagcgccgcct

SEQ ID NO: 433798 - DNA, 25 bp, Mus musculus
tcgcccagcgccttacggtggcgga

SEQ ID NO: 433799 - DNA, 25 bp, Mus musculus
cccagcgccttacggtggcggagcc

SEQ ID NO: 433800 - DNA, 25 bp, Mus musculus
tgcgtcgctgggcttgtgccactgt

SEQ ID NO: 433801 - DNA, 25 bp, Mus musculus
gtctgcgtcgctgggcttgtgccac

SEQ ID NO: 433802 - DNA, 25 bp, Mus musculus
cacgttgtaatccgggggcttcctg

SEQ ID NO: 433803 - DNA, 25 bp, Mus musculus
aagccctgcggctggaagggcgcga

SEQ ID NO: 433804 - DNA, 25 bp, Mus musculus
cgctgcagggccacgttgtaatccg

SEQ ID NO: 433805 - DNA, 25 bp, Mus musculus
tcctgcgaagccctgcggctggaag

SEQ ID NO: 433806 - DNA, 25 bp, Mus musculus
gcttgtgccactgtggcttgctgcc

SEQ ID NO: 433807 - DNA, 25 bp, Mus musculus
ttgtgccactgtggcttgctgcccg

SEQ ID NO: 433808 - DNA, 25 bp, Mus musculus
tgcaggcggcgtctggcccggtgcc

SEQ ID NO: 433809 - DNA, 25 bp, Mus musculus
ctcagtgggccgtgccaccatgcgg

SEQ ID NO: 433810 - DNA, 25 bp, Mus musculus
ccgctgcagggccacgttgtaatcc

SEQ ID NO: 433811 - DNA, 25 bp, Mus musculus
ctgcagggccacgttgtaatccggg

SEQ ID NO: 433812 - DNA, 25 bp, Mus musculus
cgtcctcctccgctcctgcgaagcc

SEQ ID NO: 433813 - DNA, 25 bp, Mus musculus
tgccaccatgcgggaccgctgcagg

SEQ ID NO: 433814 - DNA, 25 bp, Mus musculus
ggcgcagacagcacgaaaggtccgt

SEQ ID NO: 433815 - DNA, 25 bp, Mus musculus
aactttgtgcgtcgtccgtgcggcg

SEQ ID NO: 433816 - DNA, 25 bp, Mus musculus
agcccggctcaggtctgggagccac

SEQ ID NO: 433817 - DNA, 25 bp, Mus musculus
cgctgagcctggtgagcccggctca

SEQ ID NO: 433818 - DNA, 25 bp, Mus musculus
ttatttttagggaggtgcaagcgac

SEQ ID NO: 433819 - DNA, 25 bp, Mus musculus
agcgctcccgatcggtcgcggatcg

SEQ ID NO: 433820 - DNA, 25 bp, Mus musculus
cctcgcggcttgctgtccgtagact

SEQ ID NO: 433821 - DNA, 25 bp, Mus musculus
cgcgctctaggcaactttgtgcgtc

SEQ ID NO: 433822 - DNA, 25 bp, Mus musculus
gccaagcgtctgctgaacggcgacc

SEQ ID NO: 433823 - DNA, 25 bp, Mus musculus
gccggagccactcttcagggaggaa

SEQ ID NO: 433824 - DNA, 25 bp, Mus musculus
cggggcttgttgctttgtgctgcaa

SEQ ID NO: 433825 - DNA, 25 bp, Mus musculus
ctttgtgctgcaaccatggtgagga

SEQ ID NO: 433826 - DNA, 25 bp, Mus musculus
ggctgttgcgatcgttgatcccata

SEQ ID NO: 433827 - DNA, 25 bp, Mus musculus
ccgtagactcggactcagcgactgc

SEQ ID NO: 433828 - DNA, 25 bp, Mus musculus
gcgtgcatatactagccctggactc

SEQ ID NO: 433829 - DNA, 25 bp, Mus musculus
gacggctttttcttccgcgtgcata

SEQ ID NO: 433830 - DNA, 25 bp, Mus musculus
ctgtacatcactcccgacggctttt

SEQ ID NO: 433831 - DNA, 25 bp, Mus musculus
agggagccagagactcagtcctgcg

SEQ ID NO: 433832 - DNA, 25 bp, Mus musculus
tggactcctccagttgccataagcc

SEQ ID NO: 433833 - DNA, 25 bp, Mus musculus
aagatgagccgcctgtacatcactc

SEQ ID NO: 433834 - DNA, 25 bp, Mus musculus
cccgacgggctgtacaagatgagcc

SEQ ID NO: 433835 - DNA, 25 bp, Mus musculus
gcctggtgactcttctggtggaccc

SEQ ID NO: 433836 - DNA, 25 bp, Mus musculus
cagcggtgaatggaatcgtgcacga

SEQ ID NO: 433837 - DNA, 25 bp, Mus musculus
ccctgtttttccaaagcagcggtga

SEQ ID NO: 433838 - DNA, 25 bp, Mus musculus
ccgtcccggagctagttgtaatgct

SEQ ID NO: 433839 - DNA, 25 bp, Mus musculus
agcgaattcggtgagcgcgctgcac

SEQ ID NO: 433840 - DNA, 25 bp, Mus musculus
gggaggcctattgcgccagcgaatt

SEQ ID NO: 433841 - DNA, 25 bp, Mus musculus
tgccataagccgtgtccagaattta

SEQ ID NO: 433842 - DNA, 25 bp, Mus musculus
ggcgcacacactaaaaagaaaccga

SEQ ID NO: 433843 - DNA, 25 bp, Mus musculus
gacggccactacagccacctaaaga

SEQ ID NO: 433844 - DNA, 25 bp, Mus musculus
tggcctccacgagtccagattgcgc

SEQ ID NO: 433845 - DNA, 25 bp, Mus musculus
agcattaggggccaggcgcagaaac

SEQ ID NO: 433846 - DNA, 25 bp, Mus musculus
aggcgccaccggaaaccagagtaca

SEQ ID NO: 433847 - DNA, 25 bp, Mus musculus
accagagtacagcttccggcggtgc

SEQ ID NO: 433848 - DNA, 25 bp, Mus musculus
gaagtaactcttccgcgcgttgcca

SEQ ID NO: 433849 - DNA, 25 bp, Mus musculus
ccgcgcgttgccaggttataacgta

SEQ ID NO: 433850 - DNA, 25 bp, Mus musculus
caggttataacgtagaggggcagta

SEQ ID NO: 433851 - DNA, 25 bp, Mus musculus
cagtagagtttgctccggtctcgcg

SEQ ID NO: 433852 - DNA, 25 bp, Mus musculus
gtctcgcgcacgaggtgctcgtgtc

SEQ ID NO: 433853 - DNA, 25 bp, Mus musculus
cccagtgcccgcagtgaagatgtcc

SEQ ID NO: 433854 - DNA, 25 bp, Mus musculus
ccgcgagtcttctttgacgtggaca

SEQ ID NO: 433855 - DNA, 25 bp, Mus musculus
gatagcagcctaggtcccagacgga

SEQ ID NO: 433856 - DNA, 25 bp, Mus musculus
aggacatcaccggacctggtcttgt

SEQ ID NO: 433857 - DNA, 25 bp, Mus musculus
ttcgctcagactggaggtgtaagcc

SEQ ID NO: 433858 - DNA, 25 bp, Mus musculus
gtaacggggattgctccgacaggaa

SEQ ID NO: 433859 - DNA, 25 bp, Mus musculus
ggctcggttcttcggctcttccgga

SEQ ID NO: 433860 - DNA, 25 bp, Mus musculus
gcgatcgatgctcaaccgccggcgt

SEQ ID NO: 433861 - DNA, 25 bp, Mus musculus
cgagcgcaccgcgatcgatgctcaa

SEQ ID NO: 433862 - DNA, 25 bp, Mus musculus
aagccagggacagaaccgactcacc

SEQ ID NO: 433863 - DNA, 25 bp, Mus musculus
tcggccaccgaataacgctgcacgg

SEQ ID NO: 433864 - DNA, 25 bp, Mus musculus
gagagcttgtctgcagcccgcacaa

SEQ ID NO: 433865 - DNA, 25 bp, Mus musculus
aacctcagagatcgaggaccgcctg

SEQ ID NO: 433866 - DNA, 25 bp, Mus musculus
gccgggctcattctgcgacacagaa

SEQ ID NO: 433867 - DNA, 25 bp, Mus musculus
ggaacttgccgtgtagagccctgag

SEQ ID NO: 433868 - DNA, 25 bp, Mus musculus
aaattcgtgagccagggaacttgcc

SEQ ID NO: 433869 - DNA, 25 bp, Mus musculus
ccctaatcctgtaaattcgtgagcc

SEQ ID NO: 433870 - DNA, 25 bp, Mus musculus
acttctaggctacgaggggcgccat

SEQ ID NO: 433871 - DNA, 25 bp, Mus musculus
agttgtagtgtttagctcctggagc

SEQ ID NO: 433872 - DNA, 25 bp, Mus musculus
tccaaccgtggacccgctggagcaa

SEQ ID NO: 433873 - DNA, 25 bp, Mus musculus
tcgtccctcagcatgccagtgagtt

SEQ ID NO: 433874 - DNA, 25 bp, Mus musculus
ctgactctgaggagtttcgggcttc

SEQ ID NO: 433875 - DNA, 25 bp, Mus musculus
tgacgcctggcttgatatctgattg

SEQ ID NO: 433876 - DNA, 25 bp, Mus musculus
agcgaggctgatttgctaggcattc

SEQ ID NO: 433877 - DNA, 25 bp, Mus musculus
cgcatgcgccctagaagcatagcga

SEQ ID NO: 433878 - DNA, 25 bp, Mus musculus
acctagtgtgcagaagaggccgaca

SEQ ID NO: 433879 - DNA, 25 bp, Mus musculus
gtcatcctcagccaggaacctagtg

SEQ ID NO: 433880 - DNA, 25 bp, Mus musculus
gccagtaaggtttccgggtcacata

SEQ ID NO: 433881 - DNA, 25 bp, Mus musculus
tcagcttctgtcagcgtctgggctc

SEQ ID NO: 433882 - DNA, 25 bp, Mus musculus
ggggcgccatcacctgccaagaagc

SEQ ID NO: 433883 - DNA, 25 bp, Mus musculus
ttcggttgcttgatccggtccagta

SEQ ID NO: 433884 - DNA, 25 bp, Mus musculus
caccgagagggacgagacgctgcac

SEQ ID NO: 433885 - DNA, 25 bp, Mus musculus
gacccttgtccgcaaggctctgtgg

SEQ ID NO: 433886 - DNA, 25 bp, Mus musculus
ccgcaaggctctgtggctttccaga

SEQ ID NO: 433887 - DNA, 25 bp, Mus musculus
aggctctgtggctttccagaacggc

SEQ ID NO: 433888 - DNA, 25 bp, Mus musculus
tggctttccagaacggccggccgct

SEQ ID NO: 433889 - DNA, 25 bp, Mus musculus
ccgctgcagggccaggtgagcctcc

SEQ ID NO: 433890 - DNA, 25 bp, Mus musculus
ccgcgggcatcggacactgcgtctt

SEQ ID NO: 433891 - DNA, 25 bp, Mus musculus
ggcatcggacactgcgtcttgcacc

SEQ ID NO: 433892 - DNA, 25 bp, Mus musculus
tcggacactgcgtcttgcaccgagc

SEQ ID NO: 433893 - DNA, 25 bp, Mus musculus
tcgccgccaggccttaccgcacgcg

SEQ ID NO: 433894 - DNA, 25 bp, Mus musculus
gcagctgcgaccagcgagtcccgcc

SEQ ID NO: 433895 - DNA, 25 bp, Mus musculus
ccgccgagtttgacgcgcctgctcc

SEQ ID NO: 433896 - DNA, 25 bp, Mus musculus
tcgccaccgagagggacgagacgct

SEQ ID NO: 433897 - DNA, 25 bp, Mus musculus
gccgcggacaactgcggggaccgcg

SEQ ID NO: 433898 - DNA, 25 bp, Mus musculus
aactgacaggtgctccctgcgagtc

SEQ ID NO: 433899 - DNA, 25 bp, Mus musculus
gcacttcggcacagctcaggatttg

SEQ ID NO: 433900 - DNA, 25 bp, Mus musculus
tggccaccgactgcagcaaggagga

SEQ ID NO: 433901 - DNA, 25 bp, Mus musculus
tcagcagctttgtcattgatcccaa

SEQ ID NO: 433902 - DNA, 25 bp, Mus musculus
cgacctggcttccagtctggcttgg

SEQ ID NO: 433903 - DNA, 25 bp, Mus musculus
ccagcgacaaggaacagaacggtga

SEQ ID NO: 433904 - DNA, 25 bp, Mus musculus
ttgatcccaaggtgctcgcctcgct

SEQ ID NO: 433905 - DNA, 25 bp, Mus musculus
tcaggtccaggttttgctttgatcc

SEQ ID NO: 433906 - DNA, 25 bp, Mus musculus
tcctccagtcgtggagctgatggtc

SEQ ID NO: 433907 - DNA, 25 bp, Mus musculus
agcaagttgcagctctccagcgaca

SEQ ID NO: 433908 - DNA, 25 bp, Mus musculus
actcgggctgagtccaacctgagca

SEQ ID NO: 433909 - DNA, 25 bp, Mus musculus
tgacatctgccctggccggccaaag

SEQ ID NO: 433910 - DNA, 25 bp, Mus musculus
taccctgcgattctctgctgccaga

SEQ ID NO: 433911 - DNA, 25 bp, Mus musculus
ggattatgtggaaactaccctgcga

SEQ ID NO: 433912 - DNA, 25 bp, Mus musculus
accagcagctccagggcatggttca

SEQ ID NO: 433913 - DNA, 25 bp, Mus musculus
cccaaggggcttgatcacgcggcca

SEQ ID NO: 433914 - DNA, 25 bp, Mus musculus
agaccgtggtcaaggacccgcgcct

SEQ ID NO: 433915 - DNA, 25 bp, Mus musculus
ccgcgccttgcaacccggtcttcca

SEQ ID NO: 433916 - DNA, 25 bp, Mus musculus
tcacgaaaccgtactgaagggcaga

SEQ ID NO: 433917 - DNA, 25 bp, Mus musculus
ctgggagcggggctgttcacttact

SEQ ID NO: 433918 - DNA, 25 bp, Mus musculus
agagagaccgtggtcaaggacccgc

SEQ ID NO: 433919 - DNA, 25 bp, Mus musculus
gctgttcacttacttgatgtcttcc

SEQ ID NO: 433920 - DNA, 25 bp, Mus musculus
acttgatgtcttcccacacctcggg

SEQ ID NO: 433921 - DNA, 25 bp, Mus musculus
cacacctcgggaccataattgcgga

SEQ ID NO: 433922 - DNA, 25 bp, Mus musculus
attgcggatcaccagcagctccagg

SEQ ID NO: 433923 - DNA, 25 bp, Mus musculus
ccagggcatggttcacgaaaccgta

SEQ ID NO: 433924 - DNA, 25 bp, Mus musculus
atgcgcaccacgaccctgctgggag

SEQ ID NO: 433925 - DNA, 25 bp, Mus musculus
tcgggaccataattgcggatcacca

SEQ ID NO: 433926 - DNA, 25 bp, Mus musculus
gccggcgatccaaatgggcctccga

SEQ ID NO: 433927 - DNA, 25 bp, Mus musculus
agagcatagccgctgggttctcagg

SEQ ID NO: 433928 - DNA, 25 bp, Mus musculus
ccgctgggttctcaggtggtcacag

SEQ ID NO: 433929 - DNA, 25 bp, Mus musculus
gggcgacacctgtgctagagcatag

SEQ ID NO: 433930 - DNA, 25 bp, Mus musculus
tacctggtttcccagaccgcgaggc

SEQ ID NO: 433931 - DNA, 25 bp, Mus musculus
ttattccaatacctggtttcccaga

SEQ ID NO: 433932 - DNA, 25 bp, Mus musculus
gtacccaagagaccaggcggttgga

SEQ ID NO: 433933 - DNA, 25 bp, Mus musculus
cgcctccaggttattccaatacctg

SEQ ID NO: 433934 - DNA, 25 bp, Mus musculus
tgttgcctagcaaccgccttctgcc

SEQ ID NO: 433935 - DNA, 25 bp, Mus musculus
ctcccggggacgctgttgcctagca

SEQ ID NO: 433936 - DNA, 25 bp, Mus musculus
aagtcacttcctcccggggacgctg

SEQ ID NO: 433937 - DNA, 25 bp, Mus musculus
acctgtgctagagcatagccgctgg

SEQ ID NO: 433938 - DNA, 25 bp, Mus musculus
gaccaggcggttggaagtcacttcc

SEQ ID NO: 433939 - DNA, 25 bp, Mus musculus
gcggtgttgggtacccaagagacca

SEQ ID NO: 433940 - DNA, 25 bp, Mus musculus
ccgccagagcttcggatcggcgctg

SEQ ID NO: 433941 - DNA, 25 bp, Mus musculus
gggcagttggctcccgacaaccact

SEQ ID NO: 433942 - DNA, 25 bp, Mus musculus
ccaatcaggaggagaaaagccagtc

SEQ ID NO: 433943 - DNA, 25 bp, Mus musculus
tggagtggcacgctcgctggccaat

SEQ ID NO: 433944 - DNA, 25 bp, Mus musculus
gcacttgcgacaggcgaaagggact

SEQ ID NO: 433945 - DNA, 25 bp, Mus musculus
agcctagcgtgcctcacgtggagtg

SEQ ID NO: 433946 - DNA, 25 bp, Mus musculus
agcttctgccgactgggcagccgcg

SEQ ID NO: 433947 - DNA, 25 bp, Mus musculus
tggccagtggcgctcgtgctgtcct

SEQ ID NO: 433948 - DNA, 25 bp, Mus musculus
aaaagccagtctgggcgagtgaagt

SEQ ID NO: 433949 - DNA, 25 bp, Mus musculus
aatccctggaccaacgagcacaaac

SEQ ID NO: 433950 - DNA, 25 bp, Mus musculus
gaggccagacctaaaaatccctgga

SEQ ID NO: 433951 - DNA, 25 bp, Mus musculus
gtcgggtcttcagaggccagaccta

SEQ ID NO: 433952 - DNA, 25 bp, Mus musculus
ccgttggcagcggtttgccggtcac

SEQ ID NO: 433953 - DNA, 25 bp, Mus musculus
gggctcttcgcctcagcctagcgtg

SEQ ID NO: 433954 - DNA, 25 bp, Mus musculus
cgctcttcgctgtggctcttataga

SEQ ID NO: 433955 - DNA, 25 bp, Mus musculus
cggaggatcggaacccaacagtctg

SEQ ID NO: 433956 - DNA, 25 bp, Mus musculus
acagtctggacgctccaaggctcca

SEQ ID NO: 433957 - DNA, 25 bp, Mus musculus
gctccgcgaattcctgcagatccta

SEQ ID NO: 433958 - DNA, 25 bp, Mus musculus
tttgattcgccaaagtgccggctcc

SEQ ID NO: 433959 - DNA, 25 bp, Mus musculus
accgtggccctcagcttactaaaga

SEQ ID NO: 433960 - DNA, 25 bp, Mus musculus
tgggacccgctctaaccgataataa

SEQ ID NO: 433961 - DNA, 25 bp, Mus musculus
tttcttggcggtgagaagcgccttc

SEQ ID NO: 433962 - DNA, 25 bp, Mus musculus
acctgccaggaatggagcacctttc

SEQ ID NO: 433963 - DNA, 25 bp, Mus musculus
ggaatggctctctgttcgtccagtg

SEQ ID NO: 433964 - DNA, 25 bp, Mus musculus
ctcgagcgctctgcttcactaggga

SEQ ID NO: 433965 - DNA, 25 bp, Mus musculus
cacccgcgcttgaggagctgaagag

SEQ ID NO: 433966 - DNA, 25 bp, Mus musculus
cccagagccaggagagcaagagatc

SEQ ID NO: 433967 - DNA, 25 bp, Mus musculus
gggagacctttaaacagccagcgta

SEQ ID NO: 433968 - DNA, 25 bp, Mus musculus
cgggttgccaatacgcatgtgcggt

SEQ ID NO: 433969 - DNA, 25 bp, Mus musculus
gctcccttagctccggctgaaatct

SEQ ID NO: 433970 - DNA, 25 bp, Mus musculus
cgcccttctgcctggagacatcgtt

SEQ ID NO: 433971 - DNA, 25 bp, Mus musculus
cgaagtcccgctctcctccaagagg

SEQ ID NO: 433972 - DNA, 25 bp, Mus musculus
acgcatgtgcggttagcgtcacgtc

SEQ ID NO: 433973 - DNA, 25 bp, Mus musculus
ttagcgtcacgtccggcgacgggcc

SEQ ID NO: 433974 - DNA, 25 bp, Mus musculus
cccaatctccggaaagagctgccga

SEQ ID NO: 433975 - DNA, 25 bp, Mus musculus
gctgccgaatagtggcggcgttttc

SEQ ID NO: 433976 - DNA, 25 bp, Mus musculus
gcggcgttttctgcggcgattattt

SEQ ID NO: 433977 - DNA, 25 bp, Mus musculus
ctgcggcgattatttgagttccttc

SEQ ID NO: 433978 - DNA, 25 bp, Mus musculus
attatttgagttccttcgctgctgg

SEQ ID NO: 433979 - DNA, 25 bp, Mus musculus
ttcgctgctggaggggtagactaaa

SEQ ID NO: 433980 - DNA, 25 bp, Mus musculus
cctaaacgttaaggctggcgcgctc

SEQ ID NO: 433981 - DNA, 25 bp, Mus musculus
tctgcctggagacatcgttcgtccc

SEQ ID NO: 433982 - DNA, 25 bp, Mus musculus
actgtattaaatgtcacataaaggc

SEQ ID NO: 433983 - DNA, 25 bp, Mus musculus
caccgcccagcgtgaagaactgtat

SEQ ID NO: 433984 - DNA, 25 bp, Mus musculus
accaccgcccagcgtgaagaactgt

SEQ ID NO: 433985 - DNA, 25 bp, Mus musculus
ctgcccagcgtgaagaactgtatta

SEQ ID NO: 433986 - DNA, 25 bp, Mus musculus
agaactgtattaaatgtcacataaa

SEQ ID NO: 433987 - DNA, 25 bp, Mus musculus
ccaccgcccagcgtgaagaactgta

SEQ ID NO: 433988 - DNA, 25 bp, Mus musculus
ccgcccagcgtgaagaactgtatta

SEQ ID NO: 433989 - DNA, 25 bp, Mus musculus
accgcccagcgtgaagaactgtatt

SEQ ID NO: 433990 - DNA, 25 bp, Mus musculus
attaaagggtcacataaaggtgtgc

SEQ ID NO: 433991 - DNA, 25 bp, Mus musculus
ctgtattaaatgtcacataaaggcg

SEQ ID NO: 433992 - DNA, 25 bp, Mus musculus
ccactgcccagcgtgaagaactgta

SEQ ID NO: 433993 - DNA, 25 bp, Mus musculus
gtattaaatgtcacataaaggcgtg

SEQ ID NO: 433994 - DNA, 25 bp, Mus musculus
ttaaagggtgacataaaggcgtgca

SEQ ID NO: 433995 - DNA, 25 bp, Mus musculus
aagggtcacataaaggtgtgcgcca

SEQ ID NO: 433996 - DNA, 25 bp, Mus musculus
ccagaggacgtctgcaccagttgca

SEQ ID NO: 433997 - DNA, 25 bp, Mus musculus
ccctggcttaatactgaagaggctc

SEQ ID NO: 433998 - DNA, 25 bp, Mus musculus
tgagatcccaatacaagctggcagc

SEQ ID NO: 433999 - DNA, 25 bp, Mus musculus
tcgggctcatctgcccaggtgttca

SEQ ID NO: 434000 - DNA, 25 bp, Mus musculus
ccagacacactggtgggtgacattc

SEQ ID NO: 434001 - DNA, 25 bp, Mus musculus
caacaggatgggaatggcttttttc

SEQ ID NO: 434002 - DNA, 25 bp, Mus musculus
ttctttcggaggactcggatgactc

SEQ ID NO: 434003 - DNA, 25 bp, Mus musculus
cacgtgcacccggacactggtatca

SEQ ID NO: 434004 - DNA, 25 bp, Mus musculus
accgcgagcgacaggaccactatag

SEQ ID NO: 434005 - DNA, 25 bp, Mus musculus
cgggactgttcagcatccagggcta

SEQ ID NO: 434006 - DNA, 25 bp, Mus musculus
tccagggctacactttgctgcaagc

SEQ ID NO: 434007 - DNA, 25 bp, Mus musculus
ggacccttcttccaattgcgctatg

SEQ ID NO: 434008 - DNA, 25 bp, Mus musculus
tcaccgctggaacccttagacttgg

SEQ ID NO: 434009 - DNA, 25 bp, Mus musculus
ttgcagatgccaccttgggaactcc

SEQ ID NO: 434010 - DNA, 25 bp, Mus musculus
tgagcccggtgttactggagactcc

SEQ ID NO: 434011 - DNA, 25 bp, Mus musculus
ccaaacaatgcctaggcccgcggta

SEQ ID NO: 434012 - DNA, 25 bp, Mus musculus
cgcctgtcacacaagcatgcaattg

SEQ ID NO: 434013 - DNA, 25 bp, Mus musculus
atgggcagcccgctgcactccgaaa

SEQ ID NO: 434014 - DNA, 25 bp, Mus musculus
tggagactcccgtaagacttcgggc

SEQ ID NO: 434015 - DNA, 25 bp, Mus musculus
tatgtttctgacgacccgggcaagc

SEQ ID NO: 434016 - DNA, 25 bp, Mus musculus
ggtctgcgacaacaagctatgtttc

SEQ ID NO: 434017 - DNA, 25 bp, Mus musculus
actgatgttggaacggtctgcgaca

SEQ ID NO: 434018 - DNA, 25 bp, Mus musculus
gtccaggccgagtggtactgatgtt

SEQ ID NO: 434019 - DNA, 25 bp, Mus musculus
atggagcttgagcttgagtccaggc

SEQ ID NO: 434020 - DNA, 25 bp, Mus musculus
gcacgactctagatggagaggaaga

SEQ ID NO: 434021 - DNA, 25 bp, Mus musculus
gacgaaaggagggtgcacgactcta

SEQ ID NO: 434022 - DNA, 25 bp, Mus musculus
tgcaattggctgatgatggacgaaa

SEQ ID NO: 434023 - DNA, 25 bp, Mus musculus
ctcctggcgagcgagacagacgcag

SEQ ID NO: 434024 - DNA, 25 bp, Mus musculus
cccggccaggaaatgcccaagagtg

SEQ ID NO: 434025 - DNA, 25 bp, Mus musculus
tgagcaagttgggtaagttctttaa

SEQ ID NO: 434026 - DNA, 25 bp, Mus musculus
atgcccaagagtgggtgtcacctgc

SEQ ID NO: 434027 - DNA, 25 bp, Mus musculus
tgggtgtcacctgccgaaacaactt

SEQ ID NO: 434028 - DNA, 25 bp, Mus musculus
tgtcacctgccgaaacaacttgttg

SEQ ID NO: 434029 - DNA, 25 bp, Mus musculus
aaacaacttgttgattcccaggagc

SEQ ID NO: 434030 - DNA, 25 bp, Mus musculus
aggaagccctggctcgcctccggga

SEQ ID NO: 434031 - DNA, 25 bp, Mus musculus
tgattcccaggagctctgtcggctc

SEQ ID NO: 434032 - DNA, 25 bp, Mus musculus
ccaggagctctgtcggctccgactg

SEQ ID NO: 434033 - DNA, 25 bp, Mus musculus
tctgtcggctccgactgtggcttac

SEQ ID NO: 434034 - DNA, 25 bp, Mus musculus
tcggctccgactgtggcttacctgt

SEQ ID NO: 434035 - DNA, 25 bp, Mus musculus
ccactgctcagccatgagcaagttg

SEQ ID NO: 434036 - DNA, 25 bp, Mus musculus
agccatgagcaagttgggtaagttc

SEQ ID NO: 434037 - DNA, 25 bp, Mus musculus
gagcccggccaggaaatgcccaaga

SEQ ID NO: 434038 - DNA, 25 bp, Mus musculus
ccagacatgctggagtgcgaccgtt

SEQ ID NO: 434039 - DNA, 25 bp, Mus musculus
accaagaagttcctgtgctcgctct

SEQ ID NO: 434040 - DNA, 25 bp, Mus musculus
gcgtgtcctcgactttcgttgcctc

SEQ ID NO: 434041 - DNA, 25 bp, Mus musculus
tgtcactcgctctgcgtgcaggtga

SEQ ID NO: 434042 - DNA, 25 bp, Mus musculus
ctgtctgtctcgacgacctagatga

SEQ ID NO: 434043 - DNA, 25 bp, Mus musculus
cctggattccgctggtcatgaagca

SEQ ID NO: 434044 - DNA, 25 bp, Mus musculus
agtaccagaacatgcggctgcccaa

SEQ ID NO: 434045 - DNA, 25 bp, Mus musculus
tgtgccacggcatcgagtaccagaa

SEQ ID NO: 434046 - DNA, 25 bp, Mus musculus
ccagaaagtagtgaccggcctcctc

SEQ ID NO: 434047 - DNA, 25 bp, Mus musculus
gaggggcattctcaacgcagccagc

SEQ ID NO: 434048 - DNA, 25 bp, Mus musculus
agcccgaatttcctgccagcgagcg

SEQ ID NO: 434049 - DNA, 25 bp, Mus musculus
ttgcaaggcaatcaccagagcgcgc

SEQ ID NO: 434050 - DNA, 25 bp, Mus musculus
cccgcgcttgtctgcttgcaaggca

SEQ ID NO: 434051 - DNA, 25 bp, Mus musculus
tgagaccatccagccgtgtcactcg

SEQ ID NO: 434052 - DNA, 25 bp, Mus musculus
tccgcccacagggatgtaagccggc

SEQ ID NO: 434053 - DNA, 25 bp, Mus musculus
cccgcagctcgagcaggtacccgcg

SEQ ID NO: 434054 - DNA, 25 bp, Mus musculus
caagactccgcccacagggatgtaa

SEQ ID NO: 434055 - DNA, 25 bp, Mus musculus
acgcggtctgttctccaagactccg

SEQ ID NO: 434056 - DNA, 25 bp, Mus musculus
gcgagacgcggtctgttctccaaga

SEQ ID NO: 434057 - DNA, 25 bp, Mus musculus
cccgcaagcgcgagacgcggtctgt

SEQ ID NO: 434058 - DNA, 25 bp, Mus musculus
cccgcacgagtcctgaggatgtggc

SEQ ID NO: 434059 - DNA, 25 bp, Mus musculus
ccgtgctggaggtagccccgcagct

SEQ ID NO: 434060 - DNA, 25 bp, Mus musculus
cgatcatggcggagctcaaagcggc

SEQ ID NO: 434061 - DNA, 25 bp, Mus musculus
ggcgacgatcatggcggagctcaaa

SEQ ID NO: 434062 - DNA, 25 bp, Mus musculus
atccgacgcggcgacgatcatggcg

SEQ ID NO: 434063 - DNA, 25 bp, Mus musculus
ctgctacactctcccggcggggatc

SEQ ID NO: 434064 - DNA, 25 bp, Mus musculus
tgtcagctcggctccaacgcggact

SEQ ID NO: 434065 - DNA, 25 bp, Mus musculus
tccaacgcggactctgctacactct

SEQ ID NO: 434066 - DNA, 25 bp, Mus musculus
ccgaacttcccggtcgccagcaccg

SEQ ID NO: 434067 - DNA, 25 bp, Mus musculus
atctgggcaccagcctaggaagact

SEQ ID NO: 434068 - DNA, 25 bp, Mus musculus
gggcgcaggtgcttcactttggaaa

SEQ ID NO: 434069 - DNA, 25 bp, Mus musculus
gactgaagacctggaagtgagggaa

SEQ ID NO: 434070 - DNA, 25 bp, Mus musculus
ggcaccagcctaggaagactgaaga

SEQ ID NO: 434071 - DNA, 25 bp, Mus musculus
gatgtccccaggtcagggccccgaa

SEQ ID NO: 434072 - DNA, 25 bp, Mus musculus
cccgtgcccactagccatctgggca

SEQ ID NO: 434073 - DNA, 25 bp, Mus musculus
tacctaggagtcctccagccgccgc

SEQ ID NO: 434074 - DNA, 25 bp, Mus musculus
ggaccgatccacctacctaggagtc

SEQ ID NO: 434075 - DNA, 25 bp, Mus musculus
agcaggaccgatccacctacctagg

SEQ ID NO: 434076 - DNA, 25 bp, Mus musculus
tgcttcactttggaaaccaggtccc

SEQ ID NO: 434077 - DNA, 25 bp, Mus musculus
ggtgcttcactttggaaaccaggtc

SEQ ID NO: 434078 - DNA, 25 bp, Mus musculus
cgcaggtgcttcactttggaaacca

SEQ ID NO: 434079 - DNA, 25 bp, Mus musculus
cagcctaggaagactgaagacctgg

SEQ ID NO: 434080 - DNA, 25 bp, Mus musculus
cgctcgcagcgatcttgttctcttg

SEQ ID NO: 434081 - DNA, 25 bp, Mus musculus
cccgcagctgttggactgctgctca

SEQ ID NO: 434082 - DNA, 25 bp, Mus musculus
ttggtcaagaccagggcatgaggcc

SEQ ID NO: 434083 - DNA, 25 bp, Mus musculus
gcgaaccctcacagatttcaacagt

SEQ ID NO: 434084 - DNA, 25 bp, Mus musculus
aagacgcccagcagaaggttcacgg

SEQ ID NO: 434085 - DNA, 25 bp, Mus musculus
tcttgttctcttgtttggtggcgcc

SEQ ID NO: 434086 - DNA, 25 bp, Mus musculus
aatcgtagcccagcgcttggccttg

SEQ ID NO: 434087 - DNA, 25 bp, Mus musculus
ggtcctgggaatgaatcgtagccca

SEQ ID NO: 434088 - DNA, 25 bp, Mus musculus
ctttgtcgatgacacccgggccacg

SEQ ID NO: 434089 - DNA, 25 bp, Mus musculus
catgaggttctctttgtcgatgaca

SEQ ID NO: 434090 - DNA, 25 bp, Mus musculus
agggtgttgtcgtgaactttcatga

SEQ ID NO: 434091 - DNA, 25 bp, Mus musculus
gggacgaagacaatgcgaacgctca

SEQ ID NO: 434092 - DNA, 25 bp, Mus musculus
gagcgcgtgtgctccgcagatagaa

SEQ ID NO: 434093 - DNA, 25 bp, Mus musculus
acgacgggctgaccttgtccctgag

SEQ ID NO: 434094 - DNA, 25 bp, Mus musculus
tcgggagccgcggatcggtccaact

SEQ ID NO: 434095 - DNA, 25 bp, Mus musculus
cctccctgtttgagtctggcgccaa

SEQ ID NO: 434096 - DNA, 25 bp, Mus musculus
cgcgaggcggcctccctgtttgagt

SEQ ID NO: 434097 - DNA, 25 bp, Mus musculus
ctcttaccatgctgcgcgaggcggc

SEQ ID NO: 434098 - DNA, 25 bp, Mus musculus
ggagcctcgctcttaccatgctgcg

SEQ ID NO: 434099 - DNA, 25 bp, Mus musculus
gcgtcggagcctcgctcttaccatg

SEQ ID NO: 434100 - DNA, 25 bp, Mus musculus
gcggggccaacctcacaaggcctgg

SEQ ID NO: 434101 - DNA, 25 bp, Mus musculus
aggccgccatcagggctcgggcgca

SEQ ID NO: 434102 - DNA, 25 bp, Mus musculus
tctagaacgctccggttcggaacca

SEQ ID NO: 434103 - DNA, 25 bp, Mus musculus
tggattcggttctagaacgctccgg

SEQ ID NO: 434104 - DNA, 25 bp, Mus musculus
ctgtttgagtctggcgccaacaacc

SEQ ID NO: 434105 - DNA, 25 bp, Mus musculus
ggggcttctggattcggttctagaa

SEQ ID NO: 434106 - DNA, 25 bp, Mus musculus
tctggcgccaacaaccgcgtggggt

SEQ ID NO: 434107 - DNA, 25 bp, Mus musculus
atcggtccaacttgcggggcttctg

SEQ ID NO: 434108 - DNA, 25 bp, Mus musculus
tctccgtctttgtccttggtggtta

SEQ ID NO: 434109 - DNA, 25 bp, Mus musculus
actcggaagatcaggtcgtcctcga

SEQ ID NO: 434110 - DNA, 25 bp, Mus musculus
gtccgccagttcgttcagcttctcg

SEQ ID NO: 434111 - DNA, 25 bp, Mus musculus
aaatccagctggtcgttctcgcgcg

SEQ ID NO: 434112 - DNA, 25 bp, Mus musculus
ttatagtaacggacatgggctgccc

SEQ ID NO: 434113 - DNA, 25 bp, Mus musculus
ggtatgcgttgcctgtcttgcacag

SEQ ID NO: 434114 - DNA, 25 bp, Mus musculus
ggtgccgttcttgttgtccaggatc

SEQ ID NO: 434115 - DNA, 25 bp, Mus musculus
ctgcctcggatatgctggtcgtaga

SEQ ID NO: 434116 - DNA, 25 bp, Mus musculus
cggatgaccttgagcttaaacgggc

SEQ ID NO: 434117 - DNA, 25 bp, Mus musculus
ggggacttgactcgtcgcttcacgc

SEQ ID NO: 434118 - DNA, 25 bp, Mus musculus
ttcacagccttctgcttgacgtgcc

SEQ ID NO: 434119 - DNA, 25 bp, Mus musculus
gctgtacatgctggcaggtctcttc

SEQ ID NO: 434120 - DNA, 25 bp, Mus musculus
gatggggttctcttttcgcttgccg

SEQ ID NO: 434121 - DNA, 25 bp, Mus musculus
cccaggttgtggatagacttcttca

SEQ ID NO: 434122 - DNA, 25 bp, Mus musculus
acacgcaagttggtgcccggttcca

SEQ ID NO: 434123 - DNA, 25 bp, Mus musculus
tcgcgcagaggcaaatcctggatta

SEQ ID NO: 434124 - DNA, 25 bp, Mus musculus
ttccctccgtgtcgtctgtaccaaa

SEQ ID NO: 434125 - DNA, 25 bp, Mus musculus
ctgtaccaaacagctcctctctggg

SEQ ID NO: 434126 - DNA, 25 bp, Mus musculus
ctgggtcacttccattctgtgctca

SEQ ID NO: 434127 - DNA, 25 bp, Mus musculus
gcggcgagacatctgctttccataa

SEQ ID NO: 434128 - DNA, 25 bp, Mus musculus
gcgggctgacagctccgaaaaaccg

SEQ ID NO: 434129 - DNA, 25 bp, Mus musculus
cccggttccagaacgattcggatga

SEQ ID NO: 434130 - DNA, 25 bp, Mus musculus
ctggctgggttttcaggtctactgc
